United States Patent 9,205,144 (IDENTIFICATION OF CONSERVED PEPTIDE BLOCKS IN HOMOLOGOUS POLYPEPTIDES) - sequence listing, part 5

SEQ ID NO: 151087 - protein, 11 aa, West Nile virus
GKGVKVRVWLF

SEQ ID NO: 151088 - protein, 11 aa, West Nile virus
KGVKVRVWLFE

SEQ ID NO: 151089 - protein, 11 aa, West Nile virus
GVKVRVWLFEN

SEQ ID NO: 151090 - protein, 11 aa, West Nile virus
VKVRVWLFENG

SEQ ID NO: 151091 - protein, 11 aa, West Nile virus
KVRVWLFENGE

SEQ ID NO: 151092 - protein, 11 aa, West Nile virus
VRVWLFENGEE

SEQ ID NO: 151093 - protein, 11 aa, West Nile virus
RVWLFENGEER

SEQ ID NO: 151094 - protein, 11 aa, West Nile virus
VWLFENGEERL

SEQ ID NO: 151095 - protein, 11 aa, West Nile virus
WLSENGEERLS

SEQ ID NO: 151096 - protein, 11 aa, West Nile virus
LSENGEERLSR

SEQ ID NO: 151097 - protein, 11 aa, West Nile virus
SENGEERLSRM

SEQ ID NO: 151098 - protein, 11 aa, West Nile virus
ENGEERLGRMA

SEQ ID NO: 151099 - protein, 11 aa, West Nile virus
NGEERLGRMAV

SEQ ID NO: 151100 - protein, 11 aa, West Nile virus
GEERLGRMAVS

SEQ ID NO: 151101 - protein, 11 aa, West Nile virus
EERLSRTAVSG

SEQ ID NO: 151102 - protein, 11 aa, West Nile virus
ERLGRMAVSGD

SEQ ID NO: 151103 - protein, 11 aa, West Nile virus
RLGRMAVSGDD

SEQ ID NO: 151104 - protein, 11 aa, West Nile virus
LGRMAVSGDDC

SEQ ID NO: 151105 - protein, 11 aa, West Nile virus
GRMAVSGDDCV

SEQ ID NO: 151106 - protein, 11 aa, West Nile virus
VVKPLDDRFAS

SEQ ID NO: 151107 - protein, 11 aa, West Nile virus
VKPLDDRFATA

SEQ ID NO: 151108 - protein, 11 aa, West Nile virus
KPLDDRFATAL

SEQ ID NO: 151109 - protein, 11 aa, West Nile virus
PLDDRFATALH

SEQ ID NO: 151110 - protein, 11 aa, West Nile virus
LDDRFATALHF

SEQ ID NO: 151111 - protein, 11 aa, West Nile virus
DDRFATALHFL

SEQ ID NO: 151112 - protein, 11 aa, West Nile virus
DRFATALHFLN

SEQ ID NO: 151113 - protein, 11 aa, West Nile virus
RFATALHFLNA

SEQ ID NO: 151114 - protein, 11 aa, West Nile virus
FATALHFLNAM

SEQ ID NO: 151115 - protein, 11 aa, West Nile virus
ATALHFLNAMS

SEQ ID NO: 151116 - protein, 11 aa, West Nile virus
ALHFLNAMSKV

SEQ ID NO: 151117 - protein, 11 aa, West Nile virus
LHFLNAMSQVR

SEQ ID NO: 151118 - protein, 11 aa, West Nile virus
HFLNAMPKVRK

SEQ ID NO: 151119 - protein, 11 aa, West Nile virus
FLNAMPKVRKD

SEQ ID NO: 151120 - protein, 11 aa, West Nile virus
LNDMSKVRKDI

SEQ ID NO: 151121 - protein, 11 aa, West Nile virus
NAMSQVRKDIQ

SEQ ID NO: 151122 - protein, 11 aa, West Nile virus
DMSKVRKDIQE

SEQ ID NO: 151123 - protein, 11 aa, West Nile virus
MSQVRKDIQEW

SEQ ID NO: 151124 - protein, 11 aa, West Nile virus
PKVRKDIQEWK

SEQ ID NO: 151125 - protein, 11 aa, West Nile virus
KPSVGWYDWQQ

SEQ ID NO: 151126 - protein, 11 aa, West Nile virus
PSTGWYDWQKV

SEQ ID NO: 151127 - protein, 11 aa, West Nile virus
STGWYDWQQVQ

SEQ ID NO: 151128 - protein, 11 aa, West Nile virus
TGWYDWQQVQF

SEQ ID NO: 151129 - protein, 11 aa, West Nile virus
GWYDWQQVQFC

SEQ ID NO: 151130 - protein, 11 aa, West Nile virus
WYDWQQVQFCS

SEQ ID NO: 151131 - protein, 11 aa, West Nile virus
YDWQQVQFCSN

SEQ ID NO: 151132 - protein, 11 aa, West Nile virus
DWQQVQFCSNH

SEQ ID NO: 151133 - protein, 11 aa, West Nile virus
WQQVQFCSNHF

SEQ ID NO: 151134 - protein, 11 aa, West Nile virus
QQVQFCSNHFT

SEQ ID NO: 151135 - protein, 11 aa, West Nile virus
QVQFCSNHFTE

SEQ ID NO: 151136 - protein, 11 aa, West Nile virus
VQFCSNHFTEL

SEQ ID NO: 151137 - protein, 11 aa, West Nile virus
QFCSNHFTELI

SEQ ID NO: 151138 - protein, 11 aa, West Nile virus
LIMKDGRTLVT

SEQ ID NO: 151139 - protein, 11 aa, West Nile virus
IMKDGRTLVTP

SEQ ID NO: 151140 - protein, 11 aa, West Nile virus
MKDGRTLVTPC

SEQ ID NO: 151141 - protein, 11 aa, West Nile virus
KDGRTLVTPCR

SEQ ID NO: 151142 - protein, 11 aa, West Nile virus
DGRTLVTPCRG

SEQ ID NO: 151143 - protein, 11 aa, West Nile virus
GRTLVTPCRGQ

SEQ ID NO: 151144 - protein, 11 aa, West Nile virus
RTLVTPCRGQD

SEQ ID NO: 151145 - protein, 11 aa, West Nile virus
TLVTPCRGQDE

SEQ ID NO: 151146 - protein, 11 aa, West Nile virus
LVTPCRGQDEL

SEQ ID NO: 151147 - protein, 11 aa, West Nile virus
VVPCRGQDELI

SEQ ID NO: 151148 - protein, 11 aa, West Nile virus
VPCRGQDELIG

SEQ ID NO: 151149 - protein, 11 aa, West Nile virus
PCRGQDELIGR

SEQ ID NO: 151150 - protein, 11 aa, West Nile virus
CRGQDELIGRA

SEQ ID NO: 151151 - protein, 11 aa, West Nile virus
RGQDELIGRAR

SEQ ID NO: 151152 - protein, 11 aa, West Nile virus
GQDELIGRARI

SEQ ID NO: 151153 - protein, 11 aa, West Nile virus
QDELIGRARIS

SEQ ID NO: 151154 - protein, 11 aa, West Nile virus
DELIGRARISP

SEQ ID NO: 151155 - protein, 11 aa, West Nile virus
ELIGRARISPG

SEQ ID NO: 151156 - protein, 11 aa, West Nile virus
LIGRARISPGA

SEQ ID NO: 151157 - protein, 11 aa, West Nile virus
IGRARISPGAG

SEQ ID NO: 151158 - protein, 11 aa, West Nile virus
CLAKSYAQMWQ

SEQ ID NO: 151159 - protein, 11 aa, West Nile virus
LAKSYAQMWQL

SEQ ID NO: 151160 - protein, 11 aa, West Nile virus
AKSYAQMWQLL

SEQ ID NO: 151161 - protein, 11 aa, West Nile virus
KSYAQMWQLLY

SEQ ID NO: 151162 - protein, 11 aa, West Nile virus
SYAQMWQLLYF

SEQ ID NO: 151163 - protein, 11 aa, West Nile virus
YAQMWQLLYFH

SEQ ID NO: 151164 - protein, 11 aa, West Nile virus
AQMWQLLYFHR

SEQ ID NO: 151165 - protein, 11 aa, West Nile virus
QMWQLLYFHRR

SEQ ID NO: 151166 - protein, 11 aa, West Nile virus
MWQLLYFHRRD

SEQ ID NO: 151167 - protein, 11 aa, West Nile virus
WQLLYFHRRDL

SEQ ID NO: 151168 - protein, 11 aa, West Nile virus
QLLYFHRRDLR

SEQ ID NO: 151169 - protein, 11 aa, West Nile virus
MANAICSAVPA

SEQ ID NO: 151170 - protein, 11 aa, West Nile virus
ANAICSAVPVS

SEQ ID NO: 151171 - protein, 11 aa, West Nile virus
NAICSAVPVSW

SEQ ID NO: 151172 - protein, 11 aa, West Nile virus
AICSAVPVSWV

SEQ ID NO: 151173 - protein, 11 aa, West Nile virus
ICSAVPVSWVP

SEQ ID NO: 151174 - protein, 11 aa, West Nile virus
CSAVPVSWVPT

SEQ ID NO: 151175 - protein, 11 aa, West Nile virus
SAVPVSWVPTG

SEQ ID NO: 151176 - protein, 11 aa, West Nile virus
AVPVSWVPTGR

SEQ ID NO: 151177 - protein, 11 aa, West Nile virus
VPVSWVPTGRT

SEQ ID NO: 151178 - protein, 11 aa, West Nile virus
PVSWVPTGRTT

SEQ ID NO: 151179 - protein, 11 aa, West Nile virus
VSWVPTGRTTW

SEQ ID NO: 151180 - protein, 11 aa, West Nile virus
SWVPTGRTTWS

SEQ ID NO: 151181 - protein, 11 aa, West Nile virus
PTGRTTWSIHV

SEQ ID NO: 151182 - protein, 11 aa, West Nile virus
TGRTTWSIHAK

SEQ ID NO: 151183 - protein, 11 aa, West Nile virus
GRTTWSIHAKG

SEQ ID NO: 151184 - protein, 11 aa, West Nile virus
RTTWSIHAKGE

SEQ ID NO: 151185 - protein, 11 aa, West Nile virus
TTWSIHAKGEW

SEQ ID NO: 151186 - protein, 11 aa, West Nile virus
TWSIHAKGEWM

SEQ ID NO: 151187 - protein, 11 aa, West Nile virus
WSIHAKGEWMT

SEQ ID NO: 151188 - protein, 11 aa, West Nile virus
SIHAKGEWMTT

SEQ ID NO: 151189 - protein, 11 aa, West Nile virus
KGEWMTTEDML

SEQ ID NO: 151190 - protein, 11 aa, West Nile virus
GEWMTTEDMLA

SEQ ID NO: 151191 - protein, 11 aa, West Nile virus
EWMTTEDMLAV

SEQ ID NO: 151192 - protein, 11 aa, West Nile virus
WMTTEDMLAVW

SEQ ID NO: 151193 - protein, 11 aa, West Nile virus
MTTEDMLAVWN

SEQ ID NO: 151194 - protein, 11 aa, West Nile virus
TTEDMLAVWNR

SEQ ID NO: 151195 - protein, 11 aa, West Nile virus
TEDMLAVWNRV

SEQ ID NO: 151196 - protein, 11 aa, West Nile virus
EDMLAVWNRVW

SEQ ID NO: 151197 - protein, 11 aa, West Nile virus
DMLAVWNRVWI

SEQ ID NO: 151198 - protein, 11 aa, West Nile virus
MLAVWNRVWIE

SEQ ID NO: 151199 - protein, 11 aa, West Nile virus
LAVWNRVWIEE

SEQ ID NO: 151200 - protein, 11 aa, West Nile virus
AVWNRVWIEEN

SEQ ID NO: 151201 - protein, 11 aa, West Nile virus
VWNRVWIEENK

SEQ ID NO: 151202 - protein, 11 aa, West Nile virus
WNKVWIEENEW

SEQ ID NO: 151203 - protein, 11 aa, West Nile virus
NKVWIEENEWM

SEQ ID NO: 151204 - protein, 11 aa, West Nile virus
RVWIEENKWME

SEQ ID NO: 151205 - protein, 11 aa, West Nile virus
EWMEDKTPVER

SEQ ID NO: 151206 - protein, 11 aa, West Nile virus
WMEDKTPVERW

SEQ ID NO: 151207 - protein, 11 aa, West Nile virus
MEDKTPVERWS

SEQ ID NO: 151208 - protein, 11 aa, West Nile virus
EDKTPVERWSD

SEQ ID NO: 151209 - protein, 11 aa, West Nile virus
DKTPVERWSDV

SEQ ID NO: 151210 - protein, 11 aa, West Nile virus
KTPVERWSDVP

SEQ ID NO: 151211 - protein, 11 aa, West Nile virus
TPVERWSDVPY

SEQ ID NO: 151212 - protein, 11 aa, West Nile virus
PVERWSDVPYS

SEQ ID NO: 151213 - protein, 11 aa, West Nile virus
VERWSDVPYSG

SEQ ID NO: 151214 - protein, 11 aa, West Nile virus
ERWSDVPYSGK

SEQ ID NO: 151215 - protein, 11 aa, West Nile virus
RWSDVPYSGKR

SEQ ID NO: 151216 - protein, 11 aa, West Nile virus
WSDIPYSGKRE

SEQ ID NO: 151217 - protein, 11 aa, West Nile virus
SDIPYSGKRED

SEQ ID NO: 151218 - protein, 11 aa, West Nile virus
DIPYSGKREDI

SEQ ID NO: 151219 - protein, 11 aa, West Nile virus
IPYSGKREDIW

SEQ ID NO: 151220 - protein, 11 aa, West Nile virus
IWCGSLIGTRT

SEQ ID NO: 151221 - protein, 11 aa, West Nile virus
WCGSLIGTRTR

SEQ ID NO: 151222 - protein, 11 aa, West Nile virus
CGSLIGTRTRA

SEQ ID NO: 151223 - protein, 11 aa, West Nile virus
GSLIGTRTRAT

SEQ ID NO: 151224 - protein, 11 aa, West Nile virus
SLIGTRTRATW

SEQ ID NO: 151225 - protein, 11 aa, West Nile virus
LIGTRTRATWA

SEQ ID NO: 151226 - protein, 11 aa, West Nile virus
IGTRTRATWAE

SEQ ID NO: 151227 - protein, 11 aa, West Nile virus
GTRTRATWAEN

SEQ ID NO: 151228 - protein, 11 aa, West Nile virus
TRTRATWAENI

SEQ ID NO: 151229 - protein, 11 aa, West Nile virus
RTRATWAENIH

SEQ ID NO: 151230 - protein, 11 aa, West Nile virus
TRATWAENIHV

SEQ ID NO: 151231 - protein, 11 aa, West Nile virus
RATWAENIHVA

SEQ ID NO: 151232 - protein, 11 aa, West Nile virus
ATWAENIHVAI

SEQ ID NO: 151233 - protein, 11 aa, West Nile virus
TWAENIHVAIN

SEQ ID NO: 151234 - protein, 11 aa, West Nile virus
WAENIHVAINQ

SEQ ID NO: 151235 - protein, 11 aa, West Nile virus
AENIHVAINQV

SEQ ID NO: 151236 - protein, 11 aa, West Nile virus
ENIHVAINQVR

SEQ ID NO: 151237 - protein, 11 aa, West Nile virus
NIHVAINQVRS

SEQ ID NO: 151238 - protein, 11 aa, West Nile virus
VIGEEKYVDYM

SEQ ID NO: 151239 - protein, 11 aa, West Nile virus
IGEEKYVDYMS

SEQ ID NO: 151240 - protein, 11 aa, West Nile virus
GEEKYVDYMSS

SEQ ID NO: 151241 - protein, 11 aa, West Nile virus
EEKYVDYMSSL

SEQ ID NO: 151242 - protein, 11 aa, West Nile virus
EKYVDYMSSLR

SEQ ID NO: 151243 - protein, 11 aa, West Nile virus
KYVDYMSSLRR

SEQ ID NO: 151244 - protein, 11 aa, West Nile virus
YVDYMSSLRRY

SEQ ID NO: 151245 - protein, 11 aa, West Nile virus
VDYMSSLRRYE

SEQ ID NO: 151246 - protein, 11 aa, West Nile virus
DYMSSLRRYED

SEQ ID NO: 151247 - protein, 11 aa, West Nile virus
GPGKNRAVNMQ

SEQ ID NO: 151248 - protein, 11 aa, West Nile virus
PGKNRAVNMQK

SEQ ID NO: 151249 - protein, 11 aa, West Nile virus
GKNRAVNMQKR

SEQ ID NO: 151250 - protein, 11 aa, West Nile virus
KNRAVNMQKRG

SEQ ID NO: 151251 - protein, 11 aa, West Nile virus
RAVNMQKRGMP

SEQ ID NO: 151252 - protein, 11 aa, West Nile virus
AVNMQKRGTPR

SEQ ID NO: 151253 - protein, 11 aa, West Nile virus
PRVLSLTGLKR

SEQ ID NO: 151254 - protein, 11 aa, West Nile virus
RVLSLTGLKRA

SEQ ID NO: 151255 - protein, 11 aa, West Nile virus
VLSLTGLKRAM

SEQ ID NO: 151256 - protein, 11 aa, West Nile virus
LSLIGLKRAVL

SEQ ID NO: 151257 - protein, 11 aa, West Nile virus
SLIGLKRAVLS

SEQ ID NO: 151258 - protein, 11 aa, West Nile virus
LIGLKRAVLSL

SEQ ID NO: 151259 - protein, 11 aa, West Nile virus
IGLKRAVLSLI

SEQ ID NO: 151260 - protein, 11 aa, West Nile virus
KRAVLSLIDGK

SEQ ID NO: 151261 - protein, 11 aa, West Nile virus
RAVLSLIDGKG

SEQ ID NO: 151262 - protein, 11 aa, West Nile virus
AVLSLIDGKGP

SEQ ID NO: 151263 - protein, 11 aa, West Nile virus
LSLIDGRGPTR

SEQ ID NO: 151264 - protein, 11 aa, West Nile virus
SLIDGRGPTRF

SEQ ID NO: 151265 - protein, 11 aa, West Nile virus
LIDGRGPTRFV

SEQ ID NO: 151266 - protein, 11 aa, West Nile virus
IDGRGPTRFVL

SEQ ID NO: 151267 - protein, 11 aa, West Nile virus
DGRGPTRFVLA

SEQ ID NO: 151268 - protein, 11 aa, West Nile virus
GRGPTRFVLAL

SEQ ID NO: 151269 - protein, 11 aa, West Nile virus
RGPTRFVLALL

SEQ ID NO: 151270 - protein, 11 aa, West Nile virus
GPTRFVLALLA

SEQ ID NO: 151271 - protein, 11 aa, West Nile virus
PIRFVLALLTF

SEQ ID NO: 151272 - protein, 11 aa, West Nile virus
TRFVLALLAFF

SEQ ID NO: 151273 - protein, 11 aa, West Nile virus
RFVLALLAFFK

SEQ ID NO: 151274 - protein, 11 aa, West Nile virus
FVLALLAFFKF

SEQ ID NO: 151275 - protein, 11 aa, West Nile virus
VLALLAFFKFT

SEQ ID NO: 151276 - protein, 11 aa, West Nile virus
LALLAFFKFTA

SEQ ID NO: 151277 - protein, 11 aa, West Nile virus
ALLAFFKFTAI

SEQ ID NO: 151278 - protein, 11 aa, West Nile virus
LLAFFKFTAIA

SEQ ID NO: 151279 - protein, 11 aa, West Nile virus
LAFFKFTAIAP

SEQ ID NO: 151280 - protein, 11 aa, West Nile virus
AFFKFTAIAPT

SEQ ID NO: 151281 - protein, 11 aa, West Nile virus
KFTAIAPTRAV

SEQ ID NO: 151282 - protein, 11 aa, West Nile virus
TAVAPTRAVLD

SEQ ID NO: 151283 - protein, 11 aa, West Nile virus
AIAPTRAVLNR

SEQ ID NO: 151284 - protein, 11 aa, West Nile virus
IAPTRAVLERW

SEQ ID NO: 151285 - protein, 11 aa, West Nile virus
APTRAVLNRWR

SEQ ID NO: 151286 - protein, 11 aa, West Nile virus
PTRAVLDRWRS

SEQ ID NO: 151287 - protein, 11 aa, West Nile virus
TRAVLDRWRSV

SEQ ID NO: 151288 - protein, 11 aa, West Nile virus
RAVLDRWRSVN

SEQ ID NO: 151289 - protein, 11 aa, West Nile virus
AVLDRWRSVNK

SEQ ID NO: 151290 - protein, 11 aa, West Nile virus
VLDRWRSVNKQ

SEQ ID NO: 151291 - protein, 11 aa, West Nile virus
LDRWRSVNKQT

SEQ ID NO: 151292 - protein, 11 aa, West Nile virus
DRWRSVNKQTA

SEQ ID NO: 151293 - protein, 11 aa, West Nile virus
RWRSVNKQTAM

SEQ ID NO: 151294 - protein, 11 aa, West Nile virus
WRSVNKQTAMK

SEQ ID NO: 151295 - protein, 11 aa, West Nile virus
RSVNKQTAMKH

SEQ ID NO: 151296 - protein, 11 aa, West Nile virus
SVNKQTAMKHL

SEQ ID NO: 151297 - protein, 11 aa, West Nile virus
HLTSFKKELGI

SEQ ID NO: 151298 - protein, 11 aa, West Nile virus
LLSFKRELGTL

SEQ ID NO: 151299 - protein, 11 aa, West Nile virus
TSFKKELGILT

SEQ ID NO: 151300 - protein, 11 aa, West Nile virus
SFKKELGILTN

SEQ ID NO: 151301 - protein, 11 aa, West Nile virus
FKKELGILTNA

SEQ ID NO: 151302 - protein, 11 aa, West Nile virus
KRELGTLTSAI

SEQ ID NO: 151303 - protein, 11 aa, West Nile virus
KELGALTSAIN

SEQ ID NO: 151304 - protein, 11 aa, West Nile virus
ELGILTNAISR

SEQ ID NO: 151305 - protein, 11 aa, West Nile virus
LGTLTNAMNRR

SEQ ID NO: 151306 - protein, 11 aa, West Nile virus
GTLTNAMNRRS

SEQ ID NO: 151307 - protein, 11 aa, West Nile virus
NRRSLKQKKRG

SEQ ID NO: 151308 - protein, 11 aa, West Nile virus
RRSLKQKKRGG

SEQ ID NO: 151309 - protein, 11 aa, West Nile virus
GAVTLSDFQGK

SEQ ID NO: 151310 - protein, 11 aa, West Nile virus
AVVLSNFQGKL

SEQ ID NO: 151311 - protein, 11 aa, West Nile virus
VTLSNFQGKVI

SEQ ID NO: 151312 - protein, 11 aa, West Nile virus
TLSNFQGKVIM

SEQ ID NO: 151313 - protein, 11 aa, West Nile virus
LSNFQGKVIMT

SEQ ID NO: 151314 - protein, 11 aa, West Nile virus
SNFQGKVIMTV

SEQ ID NO: 151315 - protein, 11 aa, West Nile virus
NFQGKVIMTVN

SEQ ID NO: 151316 - protein, 11 aa, West Nile virus
FQGKVIMTVNA

SEQ ID NO: 151317 - protein, 11 aa, West Nile virus
QGKVIMTVNAT

SEQ ID NO: 151318 - protein, 11 aa, West Nile virus
GKLMMTINATE

SEQ ID NO: 151319 - protein, 11 aa, West Nile virus
IITIPPAAGKN

SEQ ID NO: 151320 - protein, 11 aa, West Nile virus
ITIPTASGKNL

SEQ ID NO: 151321 - protein, 11 aa, West Nile virus
TIPTASGKNLC

SEQ ID NO: 151322 - protein, 11 aa, West Nile virus
IPIASGKNLCT

SEQ ID NO: 151323 - protein, 11 aa, West Nile virus
PTAAGKNLCTV

SEQ ID NO: 151324 - protein, 11 aa, West Nile virus
TAAGKNLCTVR

SEQ ID NO: 151325 - protein, 11 aa, West Nile virus
ASGKNLCTVRA

SEQ ID NO: 151326 - protein, 11 aa, West Nile virus
AGKNLCTVRAM

SEQ ID NO: 151327 - protein, 11 aa, West Nile virus
GKNLCTVRAMD

SEQ ID NO: 151328 - protein, 11 aa, West Nile virus
KNLCTVRAMDV

SEQ ID NO: 151329 - protein, 11 aa, West Nile virus
NLCTVRAMDVG

SEQ ID NO: 151330 - protein, 11 aa, West Nile virus
LCIVRAMDVGH

SEQ ID NO: 151331 - protein, 11 aa, West Nile virus
IRAMDVGFMCD

SEQ ID NO: 151332 - protein, 11 aa, West Nile virus
RAMDVGFMCDD

SEQ ID NO: 151333 - protein, 11 aa, West Nile virus
AMDVGFMCDDT

SEQ ID NO: 151334 - protein, 11 aa, West Nile virus
MDVGFMCDDTI

SEQ ID NO: 151335 - protein, 11 aa, West Nile virus
DVGFMCDDTIA

SEQ ID NO: 151336 - protein, 11 aa, West Nile virus
VGFMCDDTIAY

SEQ ID NO: 151337 - protein, 11 aa, West Nile virus
GFMCDDTIAYE

SEQ ID NO: 151338 - protein, 11 aa, West Nile virus
FMCDDTIAYEC

SEQ ID NO: 151339 - protein, 11 aa, West Nile virus
MCDDTIAYECP

SEQ ID NO: 151340 - protein, 11 aa, West Nile virus
CDDTIAYECPA

SEQ ID NO: 151341 - protein, 11 aa, West Nile virus
DDTIAYECPAL

SEQ ID NO: 151342 - protein, 11 aa, West Nile virus
DTIAYECPALM

SEQ ID NO: 151343 - protein, 11 aa, West Nile virus
TIAYECPALME

SEQ ID NO: 151344 - protein, 11 aa, West Nile virus
IAYECPALMEG

SEQ ID NO: 151345 - protein, 11 aa, West Nile virus
AYECPALMEGN

SEQ ID NO: 151346 - protein, 11 aa, West Nile virus
YECPALMEGND

SEQ ID NO: 151347 - protein, 11 aa, West Nile virus
ECPALMEGNDP

SEQ ID NO: 151348 - protein, 11 aa, West Nile virus
CPALMEGNDPE

SEQ ID NO: 151349 - protein, 11 aa, West Nile virus
PALMEGNDPED

SEQ ID NO: 151350 - protein, 11 aa, West Nile virus
ALMEGNDPEDI

SEQ ID NO: 151351 - protein, 11 aa, West Nile virus
LMEGNDPEDID

SEQ ID NO: 151352 - protein, 11 aa, West Nile virus
MEGNDPEDIDC

SEQ ID NO: 151353 - protein, 11 aa, West Nile virus
PEDVDCWCTKS

SEQ ID NO: 151354 - protein, 11 aa, West Nile virus
EDIDCWCTKLA

SEQ ID NO: 151355 - protein, 11 aa, West Nile virus
AVFVRYGRCTR

SEQ ID NO: 151356 - protein, 11 aa, West Nile virus
VYVRYGRCTRT

SEQ ID NO: 151357 - protein, 11 aa, West Nile virus
VRYGRCTKTRQ

SEQ ID NO: 151358 - protein, 11 aa, West Nile virus
RYGRCTKTRQS

SEQ ID NO: 151359 - protein, 11 aa, West Nile virus
YGRCTRTRHSR

SEQ ID NO: 151360 - protein, 11 aa, West Nile virus
GRCTRTRHSRR

SEQ ID NO: 151361 - protein, 11 aa, West Nile virus
RCTKTRQSRRS

SEQ ID NO: 151362 - protein, 11 aa, West Nile virus
CTRTRHSRRSR

SEQ ID NO: 151363 - protein, 11 aa, West Nile virus
TRTRHSRRSRR

SEQ ID NO: 151364 - protein, 11 aa, West Nile virus
KTRHSRRSKRS

SEQ ID NO: 151365 - protein, 11 aa, West Nile virus
TRQSRRSRRSL

SEQ ID NO: 151366 - protein, 11 aa, West Nile virus
RQSRRSRRSLT

SEQ ID NO: 151367 - protein, 11 aa, West Nile virus
QSRRSRRSLTV

SEQ ID NO: 151368 - protein, 11 aa, West Nile virus
RRSKRSLTVQT

SEQ ID NO: 151369 - protein, 11 aa, West Nile virus
RSRRSLTVQAH

SEQ ID NO: 151370 - protein, 11 aa, West Nile virus
SKRSLTVQTHG

SEQ ID NO: 151371 - protein, 11 aa, West Nile virus
RRSLTVQAHGE

SEQ ID NO: 151372 - protein, 11 aa, West Nile virus
RSLTVQTHGKS

SEQ ID NO: 151373 - protein, 11 aa, West Nile virus
SLTVQTHGKST

SEQ ID NO: 151374 - protein, 11 aa, West Nile virus
LTVQAHGESTL

SEQ ID NO: 151375 - protein, 11 aa, West Nile virus
TVQTHGESTLS

SEQ ID NO: 151376 - protein, 11 aa, West Nile virus
VQTHGESTLSN

SEQ ID NO: 151377 - protein, 11 aa, West Nile virus
QTHGESTLSNK

SEQ ID NO: 151378 - protein, 11 aa, West Nile virus
THGESTLSNKK

SEQ ID NO: 151379 - protein, 11 aa, West Nile virus
HGESTLSNKKG

SEQ ID NO: 151380 - protein, 11 aa, West Nile virus
GESTLSNKKGA

SEQ ID NO: 151381 - protein, 11 aa, West Nile virus
ESTLSNKKGAW

SEQ ID NO: 151382 - protein, 11 aa, West Nile virus
SSLSNRKGAWL

SEQ ID NO: 151383 - protein, 11 aa, West Nile virus
SLSNRKGAWLD

SEQ ID NO: 151384 - protein, 11 aa, West Nile virus
LSNRKGAWLDS

SEQ ID NO: 151385 - protein, 11 aa, West Nile virus
SNRKGAWLDST

SEQ ID NO: 151386 - protein, 11 aa, West Nile virus
NRKGAWLDSTK

SEQ ID NO: 151387 - protein, 11 aa, West Nile virus
RKGAWLDSTKA

SEQ ID NO: 151388 - protein, 11 aa, West Nile virus
KGAWLDSTKAS

SEQ ID NO: 151389 - protein, 11 aa, West Nile virus
GAWLDSTKASR

SEQ ID NO: 151390 - protein, 11 aa, West Nile virus
AWLDSTKASRY

SEQ ID NO: 151391 - protein, 11 aa, West Nile virus
WLDSTKASRYL

SEQ ID NO: 151392 - protein, 11 aa, West Nile virus
LDSTKASRYLM

SEQ ID NO: 151393 - protein, 11 aa, West Nile virus
VTGWMLGSNTM

SEQ ID NO: 151394 - protein, 11 aa, West Nile virus
TGWMLGSNTMQ

SEQ ID NO: 151395 - protein, 11 aa, West Nile virus
GSNTTQRVVFM

SEQ ID NO: 151396 - protein, 11 aa, West Nile virus
MQRVVFAVLLL

SEQ ID NO: 151397 - protein, 11 aa, West Nile virus
QRVVFAVLLLL

SEQ ID NO: 151398 - protein, 11 aa, West Nile virus
RVVFAVLLLLV

SEQ ID NO: 151399 - protein, 11 aa, West Nile virus
VVFAVLLLLVA

SEQ ID NO: 151400 - protein, 11 aa, West Nile virus
VFMILLLLVAP

SEQ ID NO: 151401 - protein, 11 aa, West Nile virus
FAVLLLLVAPA

SEQ ID NO: 151402 - protein, 11 aa, West Nile virus
AVLLLLVAPAY

SEQ ID NO: 151403 - protein, 11 aa, West Nile virus
NCLGMSSRDFL

SEQ ID NO: 151404 - protein, 11 aa, West Nile virus
CLGMSSRDFLE

SEQ ID NO: 151405 - protein, 11 aa, West Nile virus
LGMSSRDFLEG

SEQ ID NO: 151406 - protein, 11 aa, West Nile virus
GMSSRDFLEGV

SEQ ID NO: 151407 - protein, 11 aa, West Nile virus
MSSRDFLEGVS

SEQ ID NO: 151408 - protein, 11 aa, West Nile virus
SSRDFLEGVSG

SEQ ID NO: 151409 - protein, 11 aa, West Nile virus
SRDFLEGVSGA

SEQ ID NO: 151410 - protein, 11 aa, West Nile virus
FLEGVSGATWM

SEQ ID NO: 151411 - protein, 11 aa, West Nile virus
LEGVSGATWMD

SEQ ID NO: 151412 - protein, 11 aa, West Nile virus
EGVSGATWMDL

SEQ ID NO: 151413 - protein, 11 aa, West Nile virus
GVSGATWMDLV

SEQ ID NO: 151414 - protein, 11 aa, West Nile virus
VSGATWMDLVL

SEQ ID NO: 151415 - protein, 11 aa, West Nile virus
LEGDSCVTLMS

SEQ ID NO: 151416 - protein, 11 aa, West Nile virus
EGDSCVTITAK

SEQ ID NO: 151417 - protein, 11 aa, West Nile virus
GDSCVTIMSKN

SEQ ID NO: 151418 - protein, 11 aa, West Nile virus
DSCVTIMSKNK

SEQ ID NO: 151419 - protein, 11 aa, West Nile virus
SCVTITAKDRP

SEQ ID NO: 151420 - protein, 11 aa, West Nile virus
CVTLMSKDKPT

SEQ ID NO: 151421 - protein, 11 aa, West Nile virus
VTITAKDRPTI

SEQ ID NO: 151422 - protein, 11 aa, West Nile virus
TLMSKDKPTID

SEQ ID NO: 151423 - protein, 11 aa, West Nile virus
LMSKDKPTIDV

SEQ ID NO: 151424 - protein, 11 aa, West Nile virus
TAKDRPTIDVK

SEQ ID NO: 151425 - protein, 11 aa, West Nile virus
KNKPTIDVKMM

SEQ ID NO: 151426 - protein, 11 aa, West Nile virus
DKPTIDVKMTN

SEQ ID NO: 151427 - protein, 11 aa, West Nile virus
KPTIDVKMMKM

SEQ ID NO: 151428 - protein, 11 aa, West Nile virus
PTIDVKMMNVE

SEQ ID NO: 151429 - protein, 11 aa, West Nile virus
TIDVKMTNMEA

SEQ ID NO: 151430 - protein, 11 aa, West Nile virus
ATEISSSAACP

SEQ ID NO: 151431 - protein, 11 aa, West Nile virus
ISSSAACPTMG

SEQ ID NO: 151432 - protein, 11 aa, West Nile virus
SSSAACPTMGE

SEQ ID NO: 151433 - protein, 11 aa, West Nile virus
SSAACPTMGEA

SEQ ID NO: 151434 - protein, 11 aa, West Nile virus
SAACPTMGEAH

SEQ ID NO: 151435 - protein, 11 aa, West Nile virus
ACPAMGEAHND

SEQ ID NO: 151436 - protein, 11 aa, West Nile virus
CPTMGDAHNDK

SEQ ID NO: 151437 - protein, 11 aa, West Nile virus
PTMGDAHNDKR

SEQ ID NO: 151438 - protein, 11 aa, West Nile virus
TMGEAHNEKRT

SEQ ID NO: 151439 - protein, 11 aa, West Nile virus
MGEAHNEKRTD

SEQ ID NO: 151440 - protein, 11 aa, West Nile virus
GEAHNEKRTDS

SEQ ID NO: 151441 - protein, 11 aa, West Nile virus
YVCRQGVVDRG

SEQ ID NO: 151442 - protein, 11 aa, West Nile virus
SIDTCAKFTCS

SEQ ID NO: 151443 - protein, 11 aa, West Nile virus
IDTCAKFTCSN

SEQ ID NO: 151444 - protein, 11 aa, West Nile virus
DTCAKFTCSNK

SEQ ID NO: 151445 - protein, 11 aa, West Nile virus
TCAKFTCSNKA

SEQ ID NO: 151446 - protein, 11 aa, West Nile virus
CAKFACTTKAT

SEQ ID NO: 151447 - protein, 11 aa, West Nile virus
AKFACTTKATG

SEQ ID NO: 151448 - protein, 11 aa, West Nile virus
KFACTTKATGW

SEQ ID NO: 151449 - protein, 11 aa, West Nile virus
FACTTKATGWI

SEQ ID NO: 151450 - protein, 11 aa, West Nile virus
ACTTKATGWII

SEQ ID NO: 151451 - protein, 11 aa, West Nile virus
CTTKATGWIIQ

SEQ ID NO: 151452 - protein, 11 aa, West Nile virus
TTKATGWIIQK

SEQ ID NO: 151453 - protein, 11 aa, West Nile virus
TKATGWIIQKE

SEQ ID NO: 151454 - protein, 11 aa, West Nile virus
KATGWIIQKEN

SEQ ID NO: 151455 - protein, 11 aa, West Nile virus
ATGWIIQKENI

SEQ ID NO: 151456 - protein, 11 aa, West Nile virus
TGWIIQKENIK

SEQ ID NO: 151457 - protein, 11 aa, West Nile virus
GLTIQRENVKY

SEQ ID NO: 151458 - protein, 11 aa, West Nile virus
LTIQRENVKYE

SEQ ID NO: 151459 - protein, 11 aa, West Nile virus
TIQRENVKYEV

SEQ ID NO: 151460 - protein, 11 aa, West Nile virus
IQRENVKYEVA

SEQ ID NO: 151461 - protein, 11 aa, West Nile virus
QRENVKYEVAA

SEQ ID NO: 151462 - protein, 11 aa, West Nile virus
KEBIKYEVAIF

SEQ ID NO: 151463 - protein, 11 aa, West Nile virus
ENVKYEVAVSV

SEQ ID NO: 151464 - protein, 11 aa, West Nile virus
BIKYEVAIFVH

SEQ ID NO: 151465 - protein, 11 aa, West Nile virus
AVSVHGPTTVD

SEQ ID NO: 151466 - protein, 11 aa, West Nile virus
IFVHGPTTVDS

SEQ ID NO: 151467 - protein, 11 aa, West Nile virus
FVHGPTTVDSH

SEQ ID NO: 151468 - protein, 11 aa, West Nile virus
VHGPTTVESHR

SEQ ID NO: 151469 - protein, 11 aa, West Nile virus
GAAQAGRFSIT

SEQ ID NO: 151470 - protein, 11 aa, West Nile virus
ATQAGRLSITP

SEQ ID NO: 151471 - protein, 11 aa, West Nile virus
QAGRFSVSPAA

SEQ ID NO: 151472 - protein, 11 aa, West Nile virus
AGRFSVSPAAP

SEQ ID NO: 151473 - protein, 11 aa, West Nile virus
GRFSVSPAAPT

SEQ ID NO: 151474 - protein, 11 aa, West Nile virus
KLGDYGEVTID

SEQ ID NO: 151475 - protein, 11 aa, West Nile virus
LGEYGEVTMDC

SEQ ID NO: 151476 - protein, 11 aa, West Nile virus
GEYGEVTMDCE

SEQ ID NO: 151477 - protein, 11 aa, West Nile virus
DYGEVTIDCEP

SEQ ID NO: 151478 - protein, 11 aa, West Nile virus
YGEVTMDCEPR

SEQ ID NO: 151479 - protein, 11 aa, West Nile virus
GEVTIDCEPRS

SEQ ID NO: 151480 - protein, 11 aa, West Nile virus
EVTMDCEPRSG

SEQ ID NO: 151481 - protein, 11 aa, West Nile virus
VTMDCEPRSGI

SEQ ID NO: 151482 - protein, 11 aa, West Nile virus
TIDCEPRSGID

SEQ ID NO: 151483 - protein, 11 aa, West Nile virus
MDCEPRSGIDT

SEQ ID NO: 151484 - protein, 11 aa, West Nile virus
DCEPRSGVDVD

SEQ ID NO: 151485 - protein, 11 aa, West Nile virus
CEPRSGVDVDA

SEQ ID NO: 151486 - protein, 11 aa, West Nile virus
EPRSGVDVDAF

SEQ ID NO: 151487 - protein, 11 aa, West Nile virus
PRSGVDVDAFY

SEQ ID NO: 151488 - protein, 11 aa, West Nile virus
RSGVDVDAFYV

SEQ ID NO: 151489 - protein, 11 aa, West Nile virus
SGVDVDAFYVM

SEQ ID NO: 151490 - protein, 11 aa, West Nile virus
GVDVDAFYVMT

SEQ ID NO: 151491 - protein, 11 aa, West Nile virus
VDVDAFYVMTV

SEQ ID NO: 151492 - protein, 11 aa, West Nile virus
DVDAFYVMTVG

SEQ ID NO: 151493 - protein, 11 aa, West Nile virus
FTDLNLPWSSA

SEQ ID NO: 151494 - protein, 11 aa, West Nile virus
MDLNLPWSSAE

SEQ ID NO: 151495 - protein, 11 aa, West Nile virus
DLNLPWSSAES

SEQ ID NO: 151496 - protein, 11 aa, West Nile virus
LNLPWSSAESN

SEQ ID NO: 151497 - protein, 11 aa, West Nile virus
WRNRETLVEFE

SEQ ID NO: 151498 - protein, 11 aa, West Nile virus
RNRETLVEFEE

SEQ ID NO: 151499 - protein, 11 aa, West Nile virus
NRETLVEFEEP

SEQ ID NO: 151500 - protein, 11 aa, West Nile virus
RETLVEFEEPH

SEQ ID NO: 151501 - protein, 11 aa, West Nile virus
ETLVEFEEPHA

SEQ ID NO: 151502 - protein, 11 aa, West Nile virus
TLVEFEEPHAT

SEQ ID NO: 151503 - protein, 11 aa, West Nile virus
LVEFEEPHATK

SEQ ID NO: 151504 - protein, 11 aa, West Nile virus
VEFEEPHATKQ

SEQ ID NO: 151505 - protein, 11 aa, West Nile virus
EEAHATKQSVV

SEQ ID NO: 151506 - protein, 11 aa, West Nile virus
EAHATKQSVVA

SEQ ID NO: 151507 - protein, 11 aa, West Nile virus
AHATKQSVVAL

SEQ ID NO: 151508 - protein, 11 aa, West Nile virus
LHQALAGTIPV

SEQ ID NO: 151509 - protein, 11 aa, West Nile virus
HQALAGAIPVS

SEQ ID NO: 151510 - protein, 11 aa, West Nile virus
QALAGTIPVEF

SEQ ID NO: 151511 - protein, 11 aa, West Nile virus
ALAGTIPVEFS

SEQ ID NO: 151512 - protein, 11 aa, West Nile virus
LAGAIPVSFTS

SEQ ID NO: 151513 - protein, 11 aa, West Nile virus
AGAIPVSFTSN

SEQ ID NO: 151514 - protein, 11 aa, West Nile virus
GAIPLEFSSNT

SEQ ID NO: 151515 - protein, 11 aa, West Nile virus
AIPLEFSSNTV

SEQ ID NO: 151516 - protein, 11 aa, West Nile virus
IPVSFTSNTVK

SEQ ID NO: 151517 - protein, 11 aa, West Nile virus
PVEFSSNTVTL

SEQ ID NO: 151518 - protein, 11 aa, West Nile virus
VEFSSNTVTLT

SEQ ID NO: 151519 - protein, 11 aa, West Nile virus
SFTSNTVKLTS

SEQ ID NO: 151520 - protein, 11 aa, West Nile virus
FTSNTVKLTSG

SEQ ID NO: 151521 - protein, 11 aa, West Nile virus
TSNTVKLTSGH

SEQ ID NO: 151522 - protein, 11 aa, West Nile virus
LSSGHLKCRVK

SEQ ID NO: 151523 - protein, 11 aa, West Nile virus
SSGHLKCRVKM

SEQ ID NO: 151524 - protein, 11 aa, West Nile virus
LKCRVKMEKLK

SEQ ID NO: 151525 - protein, 11 aa, West Nile virus
KCRVKMEKLKL

SEQ ID NO: 151526 - protein, 11 aa, West Nile virus
CRVKMEKLKLK

SEQ ID NO: 151527 - protein, 11 aa, West Nile virus
RVKMEKLKLKG

SEQ ID NO: 151528 - protein, 11 aa, West Nile virus
VKMEKLKLKGT

SEQ ID NO: 151529 - protein, 11 aa, West Nile virus
KMEKLKLKGTT

SEQ ID NO: 151530 - protein, 11 aa, West Nile virus
TTYGVCSKAFR

SEQ ID NO: 151531 - protein, 11 aa, West Nile virus
TYGVCSKAFRF

SEQ ID NO: 151532 - protein, 11 aa, West Nile virus
NTPADTGHGTV

SEQ ID NO: 151533 - protein, 11 aa, West Nile virus
TVVLELQYTGK

SEQ ID NO: 151534 - protein, 11 aa, West Nile virus
VVLELQYTGKD

SEQ ID NO: 151535 - protein, 11 aa, West Nile virus
VLELQYTGKDG

SEQ ID NO: 151536 - protein, 11 aa, West Nile virus
LELQYTGKDGP

SEQ ID NO: 151537 - protein, 11 aa, West Nile virus
QYTGKDGPCKV

SEQ ID NO: 151538 - protein, 11 aa, West Nile virus
YTGKDGPCKVP

SEQ ID NO: 151539 - protein, 11 aa, West Nile virus
TGKDGPCKVPI

SEQ ID NO: 151540 - protein, 11 aa, West Nile virus
GTDGPCKIPIT

SEQ ID NO: 151541 - protein, 11 aa, West Nile virus
TDGPCKIPITS

SEQ ID NO: 151542 - protein, 11 aa, West Nile virus
DGPCKIPISSV

SEQ ID NO: 151543 - protein, 11 aa, West Nile virus
GPCKIPITSVA

SEQ ID NO: 151544 - protein, 11 aa, West Nile virus
PCKIPITSVAS

SEQ ID NO: 151545 - protein, 11 aa, West Nile virus
CKIPISSVASL

SEQ ID NO: 151546 - protein, 11 aa, West Nile virus
KIPISSVASLN

SEQ ID NO: 151547 - protein, 11 aa, West Nile virus
IPISSVASLND

SEQ ID NO: 151548 - protein, 11 aa, West Nile virus
RLVTVNPFVAA

SEQ ID NO: 151549 - protein, 11 aa, West Nile virus
LVTVNPFVSVS

SEQ ID NO: 151550 - protein, 11 aa, West Nile virus
VTVNPFVSVST

SEQ ID NO: 151551 - protein, 11 aa, West Nile virus
TVNPFVSVSTA

SEQ ID NO: 151552 - protein, 11 aa, West Nile virus
TANAKILVELE

SEQ ID NO: 151553 - protein, 11 aa, West Nile virus
ANAKILVELEP

SEQ ID NO: 151554 - protein, 11 aa, West Nile virus
NAKILVELEPP

SEQ ID NO: 151555 - protein, 11 aa, West Nile virus
AKILVELEPPF

SEQ ID NO: 151556 - protein, 11 aa, West Nile virus
IVVGRGEHQIN

SEQ ID NO: 151557 - protein, 11 aa, West Nile virus
VVGRGEHQINH

SEQ ID NO: 151558 - protein, 11 aa, West Nile virus
VGRGEQQISHH

SEQ ID NO: 151559 - protein, 11 aa, West Nile virus
GRGEHQINHHW

SEQ ID NO: 151560 - protein, 11 aa, West Nile virus
RGEHQINHHWH

SEQ ID NO: 151561 - protein, 11 aa, West Nile virus
GEHQINHHWHK

SEQ ID NO: 151562 - protein, 11 aa, West Nile virus
EQQINHHWYKS

SEQ ID NO: 151563 - protein, 11 aa, West Nile virus
QQINHHWYKSG

SEQ ID NO: 151564 - protein, 11 aa, West Nile virus
QINHHWHKSGI

SEQ ID NO: 151565 - protein, 11 aa, West Nile virus
INHHWHKSGIS

SEQ ID NO: 151566 - protein, 11 aa, West Nile virus
NHHWHKSGISI

SEQ ID NO: 151567 - protein, 11 aa, West Nile virus
SGSSIGKAFTA

SEQ ID NO: 151568 - protein, 11 aa, West Nile virus
GSSIGKAFTAT

SEQ ID NO: 151569 - protein, 11 aa, West Nile virus
SSIGKAFTATL

SEQ ID NO: 151570 - protein, 11 aa, West Nile virus
SIGKAFATTLQ

SEQ ID NO: 151571 - protein, 11 aa, West Nile virus
IGKAFATTLQG

SEQ ID NO: 151572 - protein, 11 aa, West Nile virus
GKAFATTLQGA

SEQ ID NO: 151573 - protein, 11 aa, West Nile virus
KAFATTLQGAQ

SEQ ID NO: 151574 - protein, 11 aa, West Nile virus
AFATTLQGAQR

SEQ ID NO: 151575 - protein, 11 aa, West Nile virus
FATTLQGAQRL

SEQ ID NO: 151576 - protein, 11 aa, West Nile virus
ATTLQGAQRLV

SEQ ID NO: 151577 - protein, 11 aa, West Nile virus
TTLQGAQRLVS

SEQ ID NO: 151578 - protein, 11 aa, West Nile virus
TLQGAQRLVSL

SEQ ID NO: 151579 - protein, 11 aa, West Nile virus
LQGAQRLVSLG

SEQ ID NO: 151580 - protein, 11 aa, West Nile virus
QGAQRLVSLGD

SEQ ID NO: 151581 - protein, 11 aa, West Nile virus
AWDFGSVGGIF

SEQ ID NO: 151582 - protein, 11 aa, West Nile virus
WDFGSVGGVFN

SEQ ID NO: 151583 - protein, 11 aa, West Nile virus
DFGSVGGVFNS

SEQ ID NO: 151584 - protein, 11 aa, West Nile virus
FGSVGGVFNSI

SEQ ID NO: 151585 - protein, 11 aa, West Nile virus
GSVGGVFNSIG

SEQ ID NO: 151586 - protein, 11 aa, West Nile virus
SVGGVFNSIGK

SEQ ID NO: 151587 - protein, 11 aa, West Nile virus
VGGVFNSIGKA

SEQ ID NO: 151588 - protein, 11 aa, West Nile virus
GGVFNSIGKAV

SEQ ID NO: 151589 - protein, 11 aa, West Nile virus
GVFNSIGKAVH

SEQ ID NO: 151590 - protein, 11 aa, West Nile virus
VFNSIGKAVHQ

SEQ ID NO: 151591 - protein, 11 aa, West Nile virus
FNSIGKAVHQL

SEQ ID NO: 151592 - protein, 11 aa, West Nile virus
NSIGKAVHQLF

SEQ ID NO: 151593 - protein, 11 aa, West Nile virus
SIGKAVHQLFG

SEQ ID NO: 151594 - protein, 11 aa, West Nile virus
IGKAVHQLFGG

SEQ ID NO: 151595 - protein, 11 aa, West Nile virus
GKAVHQLFGGA

SEQ ID NO: 151596 - protein, 11 aa, West Nile virus
KAVHQLFGGAF

SEQ ID NO: 151597 - protein, 11 aa, West Nile virus
AVHQLFGGAFR

SEQ ID NO: 151598 - protein, 11 aa, West Nile virus
VHQLFGGAFRS

SEQ ID NO: 151599 - protein, 11 aa, West Nile virus
HQVFGGAFRLL

SEQ ID NO: 151600 - protein, 11 aa, West Nile virus
QVFGGAFRLLF

SEQ ID NO: 151601 - protein, 11 aa, West Nile virus
VFGGAFRLLFG

SEQ ID NO: 151602 - protein, 11 aa, West Nile virus
LGALLLWMGIS

SEQ ID NO: 151603 - protein, 11 aa, West Nile virus
GALLLWMGISA

SEQ ID NO: 151604 - protein, 11 aa, West Nile virus
ALLLWMGISAR

SEQ ID NO: 151605 - protein, 11 aa, West Nile virus
LLLWMGISARD

SEQ ID NO: 151606 - protein, 11 aa, West Nile virus
LVWMGINARDK

SEQ ID NO: 151607 - protein, 11 aa, West Nile virus
LWMGVNARDRS

SEQ ID NO: 151608 - protein, 11 aa, West Nile virus
WMGVNARDRSI

SEQ ID NO: 151609 - protein, 11 aa, West Nile virus
MGISARDRSIA

SEQ ID NO: 151610 - protein, 11 aa, West Nile virus
SRDRSIALTFL

SEQ ID NO: 151611 - protein, 11 aa, West Nile virus
RDKSIALTFLA

SEQ ID NO: 151612 - protein, 11 aa, West Nile virus
DRSIALTFLAI

SEQ ID NO: 151613 - protein, 11 aa, West Nile virus
RSIALTFLAIG

SEQ ID NO: 151614 - protein, 11 aa, West Nile virus
SIALTFLAIGG

SEQ ID NO: 151615 - protein, 11 aa, West Nile virus
IALTFLAIGGV

SEQ ID NO: 151616 - protein, 11 aa, West Nile virus
ALTFLAIGGVL

SEQ ID NO: 151617 - protein, 11 aa, West Nile virus
LTFLAIGGVLL

SEQ ID NO: 151618 - protein, 11 aa, West Nile virus
TFLAIGGVLLF

SEQ ID NO: 151619 - protein, 11 aa, West Nile virus
FLAVGGILLFL

SEQ ID NO: 151620 - protein, 11 aa, West Nile virus
LAVGGILLFLS

SEQ ID NO: 151621 - protein, 11 aa, West Nile virus
AIGGVLLFLSV

SEQ ID NO: 151622 - protein, 11 aa, West Nile virus
VGGILLFLSVN

SEQ ID NO: 151623 - protein, 11 aa, West Nile virus
GGILLFLSANV

SEQ ID NO: 151624 - protein, 11 aa, West Nile virus
GILLFLSVNVH

SEQ ID NO: 151625 - protein, 11 aa, West Nile virus
VLLFLSVSVHA

SEQ ID NO: 151626 - protein, 11 aa, West Nile virus
LLFLSANVHAD

SEQ ID NO: 151627 - protein, 11 aa, West Nile virus
LFLSVSVHADT

SEQ ID NO: 151628 - protein, 11 aa, West Nile virus
FLSINVHADTG

SEQ ID NO: 151629 - protein, 11 aa, West Nile virus
LSINVHADTGC

SEQ ID NO: 151630 - protein, 11 aa, West Nile virus
SVSVHADTGCA

SEQ ID NO: 151631 - protein, 11 aa, West Nile virus
ANVHADTGCAI

SEQ ID NO: 151632 - protein, 11 aa, West Nile virus
VHADTGCAIDV

SEQ ID NO: 151633 - protein, 11 aa, West Nile virus
HADTGCAIDLK

SEQ ID NO: 151634 - protein, 11 aa, West Nile virus
ADTGCAIDLKR

SEQ ID NO: 151635 - protein, 11 aa, West Nile virus
DTGCAIDLKRQ

SEQ ID NO: 151636 - protein, 11 aa, West Nile virus
TGCAIDLKRQE

SEQ ID NO: 151637 - protein, 11 aa, West Nile virus
GCAIDLKRQEL

SEQ ID NO: 151638 - protein, 11 aa, West Nile virus
CAIDLKRQELR

SEQ ID NO: 151639 - protein, 11 aa, West Nile virus
AIDLKRQELRC

SEQ ID NO: 151640 - protein, 11 aa, West Nile virus
IDLKRQELRCG

SEQ ID NO: 151641 - protein, 11 aa, West Nile virus
KRQELRCGSGV

SEQ ID NO: 151642 - protein, 11 aa, West Nile virus
GSGVFIYNDVE

SEQ ID NO: 151643 - protein, 11 aa, West Nile virus
SGVFIHNDVKA

SEQ ID NO: 151644 - protein, 11 aa, West Nile virus
GVFIHNDVEVW

SEQ ID NO: 151645 - protein, 11 aa, West Nile virus
NDVEAWIDRYK

SEQ ID NO: 151646 - protein, 11 aa, West Nile virus
DRYRYHPETPQ

SEQ ID NO: 151647 - protein, 11 aa, West Nile virus
RYRYHPETPQG

SEQ ID NO: 151648 - protein, 11 aa, West Nile virus
YRYHPETPQGL

SEQ ID NO: 151649 - protein, 11 aa, West Nile virus
RYHPETPQGLA

SEQ ID NO: 151650 - protein, 11 aa, West Nile virus
YLETPQGLAKI

SEQ ID NO: 151651 - protein, 11 aa, West Nile virus
LETPQGLAKII

SEQ ID NO: 151652 - protein, 11 aa, West Nile virus
ETPQGLARVIQ

SEQ ID NO: 151653 - protein, 11 aa, West Nile virus
TPQGLARIIQK

SEQ ID NO: 151654 - protein, 11 aa, West Nile virus
PQGLAKVIQKA

SEQ ID NO: 151655 - protein, 11 aa, West Nile virus
QGLAKVIQKAH

SEQ ID NO: 151656 - protein, 11 aa, West Nile virus
SGTCGIRSVSR

SEQ ID NO: 151657 - protein, 11 aa, West Nile virus
GICGLRSVSRL

SEQ ID NO: 151658 - protein, 11 aa, West Nile virus
VCGLRSASRLE

SEQ ID NO: 151659 - protein, 11 aa, West Nile virus
CGIRSVSRLEH

SEQ ID NO: 151660 - protein, 11 aa, West Nile virus
GLRSASRLEHQ

SEQ ID NO: 151661 - protein, 11 aa, West Nile virus
IRSVSRLEHQM

SEQ ID NO: 151662 - protein, 11 aa, West Nile virus
SVSRLEHQMWG

SEQ ID NO: 151663 - protein, 11 aa, West Nile virus
VSRLEHQMWDS

SEQ ID NO: 151664 - protein, 11 aa, West Nile virus
SRLEHQMWEAI

SEQ ID NO: 151665 - protein, 11 aa, West Nile virus
RLEHQMWEAIK

SEQ ID NO: 151666 - protein, 11 aa, West Nile virus
LEHQMWEAIKD

SEQ ID NO: 151667 - protein, 11 aa, West Nile virus
EHQMWEAIKDE

SEQ ID NO: 151668 - protein, 11 aa, West Nile virus
HQMWEAIKDEL

SEQ ID NO: 151669 - protein, 11 aa, West Nile virus
QMWEAIKDELN

SEQ ID NO: 151670 - protein, 11 aa, West Nile virus
MWEAIKDELNT

SEQ ID NO: 151671 - protein, 11 aa, West Nile virus
AIKDELNTLLK

SEQ ID NO: 151672 - protein, 11 aa, West Nile virus
VKDELNTPLKE

SEQ ID NO: 151673 - protein, 11 aa, West Nile virus
ELNTLFRENGI

SEQ ID NO: 151674 - protein, 11 aa, West Nile virus
LNTLFRENGID

SEQ ID NO: 151675 - protein, 11 aa, West Nile virus
NTPLKENGVDL

SEQ ID NO: 151676 - protein, 11 aa, West Nile virus
TLFRENGIDLS

SEQ ID NO: 151677 - protein, 11 aa, West Nile virus
LKENGIDLSIV

SEQ ID NO: 151678 - protein, 11 aa, West Nile virus
KENGIDLSIVV

SEQ ID NO: 151679 - protein, 11 aa, West Nile virus
ENGIDLSIVVE

SEQ ID NO: 151680 - protein, 11 aa, West Nile virus
NGIDLSIVVEK

SEQ ID NO: 151681 - protein, 11 aa, West Nile virus
GIDLSIVVEKQ

SEQ ID NO: 151682 - protein, 11 aa, West Nile virus
ATTENLEIGWK

SEQ ID NO: 151683 - protein, 11 aa, West Nile virus
TTENLEIGWKA

SEQ ID NO: 151684 - protein, 11 aa, West Nile virus
TENLEIGWKAW

SEQ ID NO: 151685 - protein, 11 aa, West Nile virus
ENLEIGWKAWG

SEQ ID NO: 151686 - protein, 11 aa, West Nile virus
NLEIGWKAWGK

SEQ ID NO: 151687 - protein, 11 aa, West Nile virus
IGWKAWGKSII

SEQ ID NO: 151688 - protein, 11 aa, West Nile virus
WGKSIMFASEL

SEQ ID NO: 151689 - protein, 11 aa, West Nile virus
GKSIIFAPEIA

SEQ ID NO: 151690 - protein, 11 aa, West Nile virus
KSILFAPEIAN

SEQ ID NO: 151691 - protein, 11 aa, West Nile virus
FAPEIANNTFV

SEQ ID NO: 151692 - protein, 11 aa, West Nile virus
APELANHTFVI

SEQ ID NO: 151693 - protein, 11 aa, West Nile virus
PELANHTFVID

SEQ ID NO: 151694 - protein, 11 aa, West Nile virus
ELANHTFVIDG

SEQ ID NO: 151695 - protein, 11 aa, West Nile virus
ANHTFVIDGPE

SEQ ID NO: 151696 - protein, 11 aa, West Nile virus
NHTFVIDGPET

SEQ ID NO: 151697 - protein, 11 aa, West Nile virus
TFVIDGPETKE

SEQ ID NO: 151698 - protein, 11 aa, West Nile virus
FVIDGPETKEC

SEQ ID NO: 151699 - protein, 11 aa, West Nile virus
VIDGPETKECP

SEQ ID NO: 151700 - protein, 11 aa, West Nile virus
DRAWNSLEVED

SEQ ID NO: 151701 - protein, 11 aa, West Nile virus
GFGLTSTRIFL

SEQ ID NO: 151702 - protein, 11 aa, West Nile virus
FGLTSTRMFMK

SEQ ID NO: 151703 - protein, 11 aa, West Nile virus
NTTECDSKTIG

SEQ ID NO: 151704 - protein, 11 aa, West Nile virus
TTECDSKTIGT

SEQ ID NO: 151705 - protein, 11 aa, West Nile virus
TECDSKTIGTA

SEQ ID NO: 151706 - protein, 11 aa, West Nile virus
ECDSKTIGTAV

SEQ ID NO: 151707 - protein, 11 aa, West Nile virus
CDSKTIGTAVK

SEQ ID NO: 151708 - protein, 11 aa, West Nile virus
DSKTIGTAVKN

SEQ ID NO: 151709 - protein, 11 aa, West Nile virus
SKTIGTAVKNN

SEQ ID NO: 151710 - protein, 11 aa, West Nile virus
KTIGTAVKNNL

SEQ ID NO: 151711 - protein, 11 aa, West Nile virus
TIGTAVKNNLA

SEQ ID NO: 151712 - protein, 11 aa, West Nile virus
IGTAIKNNLAI

SEQ ID NO: 151713 - protein, 11 aa, West Nile virus
GTAIKNNLAIH

SEQ ID NO: 151714 - protein, 11 aa, West Nile virus
TAIKNNLAIHS

SEQ ID NO: 151715 - protein, 11 aa, West Nile virus
AVKNNLAVHSD

SEQ ID NO: 151716 - protein, 11 aa, West Nile virus
IKNNLAIHSDL

SEQ ID NO: 151717 - protein, 11 aa, West Nile virus
SDLSYWIESRF

SEQ ID NO: 151718 - protein, 11 aa, West Nile virus
DLSYWIESRFN

SEQ ID NO: 151719 - protein, 11 aa, West Nile virus
LNETWKLERAV

SEQ ID NO: 151720 - protein, 11 aa, West Nile virus
NHTWKLERAVL

SEQ ID NO: 151721 - protein, 11 aa, West Nile virus
HTWKLERAVLG

SEQ ID NO: 151722 - protein, 11 aa, West Nile virus
PETHTLWGEGI

SEQ ID NO: 151723 - protein, 11 aa, West Nile virus
ETHTLWGEGIL

SEQ ID NO: 151724 - protein, 11 aa, West Nile virus
THTLWGEGILE

SEQ ID NO: 151725 - protein, 11 aa, West Nile virus
HTLWGEGILES

SEQ ID NO: 151726 - protein, 11 aa, West Nile virus
ESELIIPVTLA

SEQ ID NO: 151727 - protein, 11 aa, West Nile virus
SELIIPVTLAG

SEQ ID NO: 151728 - protein, 11 aa, West Nile virus
DLIIPITLAGL

SEQ ID NO: 151729 - protein, 11 aa, West Nile virus
LIIPITLAGLR

SEQ ID NO: 151730 - protein, 11 aa, West Nile virus
IIPITLAGLRS

SEQ ID NO: 151731 - protein, 11 aa, West Nile virus
IPITLAGLRSN

SEQ ID NO: 151732 - protein, 11 aa, West Nile virus
PITLAGLRSNH

SEQ ID NO: 151733 - protein, 11 aa, West Nile virus
ITLAGLRSNHN

SEQ ID NO: 151734 - protein, 11 aa, West Nile virus
TLAGPRSNYNR

SEQ ID NO: 151735 - protein, 11 aa, West Nile virus
LAGPKSNHNKR

SEQ ID NO: 151736 - protein, 11 aa, West Nile virus
AGPRSNYNRRP

SEQ ID NO: 151737 - protein, 11 aa, West Nile virus
GPKSNHNKRPG

SEQ ID NO: 151738 - protein, 11 aa, West Nile virus
PKSNHNKRPGY

SEQ ID NO: 151739 - protein, 11 aa, West Nile virus
SNYNRRPGYKT

SEQ ID NO: 151740 - protein, 11 aa, West Nile virus
NYNRRPGYKTQ

SEQ ID NO: 151741 - protein, 11 aa, West Nile virus
HNKRPGYKTQN

SEQ ID NO: 151742 - protein, 11 aa, West Nile virus
NRRPGYKMQNQ

SEQ ID NO: 151743 - protein, 11 aa, West Nile virus
RRPGYKMQNQG

SEQ ID NO: 151744 - protein, 11 aa, West Nile virus
QNQGPWDEGRI

SEQ ID NO: 151745 - protein, 11 aa, West Nile virus
NQGPWDEGRIE

SEQ ID NO: 151746 - protein, 11 aa, West Nile virus
QGPWDEGRIEI

SEQ ID NO: 151747 - protein, 11 aa, West Nile virus
GPWDEGRIEID

SEQ ID NO: 151748 - protein, 11 aa, West Nile virus
PWDEGRIEIDF

SEQ ID NO: 151749 - protein, 11 aa, West Nile virus
WDEGRIEIDFD

SEQ ID NO: 151750 - protein, 11 aa, West Nile virus
DEGRIEIDFDY

SEQ ID NO: 151751 - protein, 11 aa, West Nile virus
EGRIEIDFDYC

SEQ ID NO: 151752 - protein, 11 aa, West Nile virus
GRIEIDFDYCP

SEQ ID NO: 151753 - protein, 11 aa, West Nile virus
RIEIDFDYCPG

SEQ ID NO: 151754 - protein, 11 aa, West Nile virus
IEIDFDYCPGT

SEQ ID NO: 151755 - protein, 11 aa, West Nile virus
DYCPGTTVTVS

SEQ ID NO: 151756 - protein, 11 aa, West Nile virus
CGHRGPAIRTT

SEQ ID NO: 151757 - protein, 11 aa, West Nile virus
GHRGPAIRTTT

SEQ ID NO: 151758 - protein, 11 aa, West Nile virus
HRGPAIRTTTE

SEQ ID NO: 151759 - protein, 11 aa, West Nile virus
RGPAIRTTTES

SEQ ID NO: 151760 - protein, 11 aa, West Nile virus
GPAIRTTTESG

SEQ ID NO: 151761 - protein, 11 aa, West Nile virus
PAIRTTTESGK

SEQ ID NO: 151762 - protein, 11 aa, West Nile virus
AIRTTTESGKL

SEQ ID NO: 151763 - protein, 11 aa, West Nile virus
IRTTTESGKLI

SEQ ID NO: 151764 - protein, 11 aa, West Nile virus
TESGKLITDWW

SEQ ID NO: 151765 - protein, 11 aa, West Nile virus
ESGKLITDWWC

SEQ ID NO: 151766 - protein, 11 aa, West Nile virus
RSCTLPPLRYR

SEQ ID NO: 151767 - protein, 11 aa, West Nile virus
SCTLPPLRYRT

SEQ ID NO: 151768 - protein, 11 aa, West Nile virus
CTLPPLRYRTE

SEQ ID NO: 151769 - protein, 11 aa, West Nile virus
TESGCWYGMEI

SEQ ID NO: 151770 - protein, 11 aa, West Nile virus
ESGCWYGMEIR

SEQ ID NO: 151771 - protein, 11 aa, West Nile virus
GCWYGMEIRPL

SEQ ID NO: 151772 - protein, 11 aa, West Nile virus
CWYGMEIRPLR

SEQ ID NO: 151773 - protein, 11 aa, West Nile virus
WYGMEIRPLRH

SEQ ID NO: 151774 - protein, 11 aa, West Nile virus
YGMEIRPLRHD

SEQ ID NO: 151775 - protein, 11 aa, West Nile virus
GMEIRPLRHDE

SEQ ID NO: 151776 - protein, 11 aa, West Nile virus
MEIRPLRHDEK

SEQ ID NO: 151777 - protein, 11 aa, West Nile virus
EIRPLRHDEKT

SEQ ID NO: 151778 - protein, 11 aa, West Nile virus
IRPLRHDEKTL

SEQ ID NO: 151779 - protein, 11 aa, West Nile virus
RPLRHDEKTLV

SEQ ID NO: 151780 - protein, 11 aa, West Nile virus
PLRHDEKTLVQ

SEQ ID NO: 151781 - protein, 11 aa, West Nile virus
LRHDEKTLVQS

SEQ ID NO: 151782 - protein, 11 aa, West Nile virus
RHDEKTLVQSK

SEQ ID NO: 151783 - protein, 11 aa, West Nile virus
HDEKTLVQSKV

SEQ ID NO: 151784 - protein, 11 aa, West Nile virus
DEKTLVQSKVT

SEQ ID NO: 151785 - protein, 11 aa, West Nile virus
EKTLVQSKVTA

SEQ ID NO: 151786 - protein, 11 aa, West Nile virus
KTLVQSKVTAY

SEQ ID NO: 151787 - protein, 11 aa, West Nile virus
TLVQSKVTAYN

SEQ ID NO: 151788 - protein, 11 aa, West Nile virus
LVQSKVTAYNA

SEQ ID NO: 151789 - protein, 11 aa, West Nile virus
VQSKVTAYNAD

SEQ ID NO: 151790 - protein, 11 aa, West Nile virus
QSKVTAYNADM

SEQ ID NO: 151791 - protein, 11 aa, West Nile virus
SKVTAYNADMI

SEQ ID NO: 151792 - protein, 11 aa, West Nile virus
KVTAYNADMID

SEQ ID NO: 151793 - protein, 11 aa, West Nile virus
VNAHNADMIDP

SEQ ID NO: 151794 - protein, 11 aa, West Nile virus
NAYNAEMIDPF

SEQ ID NO: 151795 - protein, 11 aa, West Nile virus
AHNADMIDPFQ

SEQ ID NO: 151796 - protein, 11 aa, West Nile virus
YKSDMIDPFQL

SEQ ID NO: 151797 - protein, 11 aa, West Nile virus
DPFQLGLLIVF

SEQ ID NO: 151798 - protein, 11 aa, West Nile virus
PFQLGLLIVFL

SEQ ID NO: 151799 - protein, 11 aa, West Nile virus
FQLGLLVVVLA

SEQ ID NO: 151800 - protein, 11 aa, West Nile virus
QLGLLVVFLVT

SEQ ID NO: 151801 - protein, 11 aa, West Nile virus
LGLLVVFLATK

SEQ ID NO: 151802 - protein, 11 aa, West Nile virus
GLLVVFLATKE

SEQ ID NO: 151803 - protein, 11 aa, West Nile virus
LLVVFLVTQEV

SEQ ID NO: 151804 - protein, 11 aa, West Nile virus
LIVFLATQEVL

SEQ ID NO: 151805 - protein, 11 aa, West Nile virus
VVFLVTQEVLR

SEQ ID NO: 151806 - protein, 11 aa, West Nile virus
VVLATQEVLRK

SEQ ID NO: 151807 - protein, 11 aa, West Nile virus
VLATQEVLRKR

SEQ ID NO: 151808 - protein, 11 aa, West Nile virus
LATQEVLRRRW

SEQ ID NO: 151809 - protein, 11 aa, West Nile virus
ATQEVLRRRWT

SEQ ID NO: 151810 - protein, 11 aa, West Nile virus
LRKRWTAKISV

SEQ ID NO: 151811 - protein, 11 aa, West Nile virus
RKRWTAKISVP

SEQ ID NO: 151812 - protein, 11 aa, West Nile virus
KRWTAKISVPA

SEQ ID NO: 151813 - protein, 11 aa, West Nile virus
RWTAKISVPAI

SEQ ID NO: 151814 - protein, 11 aa, West Nile virus
PAIIIALLTLV

SEQ ID NO: 151815 - protein, 11 aa, West Nile virus
AIIIALLTLVF

SEQ ID NO: 151816 - protein, 11 aa, West Nile virus
IIIALLTLVFG

SEQ ID NO: 151817 - protein, 11 aa, West Nile virus
IIALLTLVFGG

SEQ ID NO: 151818 - protein, 11 aa, West Nile virus
IALLTLVFGGV

SEQ ID NO: 151819 - protein, 11 aa, West Nile virus
ALLVLVFGGVT

SEQ ID NO: 151820 - protein, 11 aa, West Nile virus
LLVLVFGGVTY

SEQ ID NO: 151821 - protein, 11 aa, West Nile virus
VLVLGGITYTD

SEQ ID NO: 151822 - protein, 11 aa, West Nile virus
LVLGGITYTDV

SEQ ID NO: 151823 - protein, 11 aa, West Nile virus
VLGGITYTDVL

SEQ ID NO: 151824 - protein, 11 aa, West Nile virus
LGGITYTDVLR

SEQ ID NO: 151825 - protein, 11 aa, West Nile virus
GGITYIDVLRY

SEQ ID NO: 151826 - protein, 11 aa, West Nile virus
GVTYTDVLRYV

SEQ ID NO: 151827 - protein, 11 aa, West Nile virus
TYIDVLRYVIL

SEQ ID NO: 151828 - protein, 11 aa, West Nile virus
DVLRYVNLVGA

SEQ ID NO: 151829 - protein, 11 aa, West Nile virus
VLRYVILAGAA

SEQ ID NO: 151830 - protein, 11 aa, West Nile virus
LRYVNLVGAAF

SEQ ID NO: 151831 - protein, 11 aa, West Nile virus
RYVNLVGAAFA

SEQ ID NO: 151832 - protein, 11 aa, West Nile virus
YVILAGAAFAE

SEQ ID NO: 151833 - protein, 11 aa, West Nile virus
IILVGAAFMEA

SEQ ID NO: 151834 - protein, 11 aa, West Nile virus
ILVGAAFMEAN

SEQ ID NO: 151835 - protein, 11 aa, West Nile virus
LAGAAFAESNS

SEQ ID NO: 151836 - protein, 11 aa, West Nile virus
VGAAFMEANSG

SEQ ID NO: 151837 - protein, 11 aa, West Nile virus
VHLALMATFRI

SEQ ID NO: 151838 - protein, 11 aa, West Nile virus
HLALMATFRIQ

SEQ ID NO: 151839 - protein, 11 aa, West Nile virus
LALMATFRIQP

SEQ ID NO: 151840 - protein, 11 aa, West Nile virus
ALMATFKVQPV

SEQ ID NO: 151841 - protein, 11 aa, West Nile virus
LMATFKVQPVF

SEQ ID NO: 151842 - protein, 11 aa, West Nile virus
IQPAFMVASFL

SEQ ID NO: 151843 - protein, 11 aa, West Nile virus
QPAFMVASFLK

SEQ ID NO: 151844 - protein, 11 aa, West Nile virus
PAFMVASFLKT

SEQ ID NO: 151845 - protein, 11 aa, West Nile virus
VASFLKAKWTN

SEQ ID NO: 151846 - protein, 11 aa, West Nile virus
KWTNQESILLM

SEQ ID NO: 151847 - protein, 11 aa, West Nile virus
WTNHENILLML

SEQ ID NO: 151848 - protein, 11 aa, West Nile virus
TNHENILLMLA

SEQ ID NO: 151849 - protein, 11 aa, West Nile virus
NHENILLMLAA

SEQ ID NO: 151850 - protein, 11 aa, West Nile virus
QENILLMLAAA

SEQ ID NO: 151851 - protein, 11 aa, West Nile virus
ENILLMLAAAF

SEQ ID NO: 151852 - protein, 11 aa, West Nile virus
NILLMLAAAFF

SEQ ID NO: 151853 - protein, 11 aa, West Nile virus
LAAVFFQMAYY

SEQ ID NO: 151854 - protein, 11 aa, West Nile virus
AAVFFQMAYYD

SEQ ID NO: 151855 - protein, 11 aa, West Nile virus
AVFFQMAYYDA

SEQ ID NO: 151856 - protein, 11 aa, West Nile virus
PDVLNSLAAAW

SEQ ID NO: 151857 - protein, 11 aa, West Nile virus
DVLNSLAAAWM

SEQ ID NO: 151858 - protein, 11 aa, West Nile virus
VLNSLAIAWMI

SEQ ID NO: 151859 - protein, 11 aa, West Nile virus
LNSLAVAWMVL

SEQ ID NO: 151860 - protein, 11 aa, West Nile virus
NSLAAAWMILR

SEQ ID NO: 151861 - protein, 11 aa, West Nile virus
SLAIAWMILRA

SEQ ID NO: 151862 - protein, 11 aa, West Nile virus
LAVAWMVLRAI

SEQ ID NO: 151863 - protein, 11 aa, West Nile virus
SVAWMILRAIG

SEQ ID NO: 151864 - protein, 11 aa, West Nile virus
VAWMILRAIGF

SEQ ID NO: 151865 - protein, 11 aa, West Nile virus
AWMILRAIGFT

SEQ ID NO: 151866 - protein, 11 aa, West Nile virus
FTTTSNVATPL

SEQ ID NO: 151867 - protein, 11 aa, West Nile virus
TTTSNVATPLL

SEQ ID NO: 151868 - protein, 11 aa, West Nile virus
TTSNVATPLLA

SEQ ID NO: 151869 - protein, 11 aa, West Nile virus
TSNVVVPLMAL

SEQ ID NO: 151870 - protein, 11 aa, West Nile virus
SNVVVPLMALL

SEQ ID NO: 151871 - protein, 11 aa, West Nile virus
NVVVPLMALLT

SEQ ID NO: 151872 - protein, 11 aa, West Nile virus
VVVPLMALLTP

SEQ ID NO: 151873 - protein, 11 aa, West Nile virus
VVPLMALLTPG

SEQ ID NO: 151874 - protein, 11 aa, West Nile virus
VPLMALLTPGL

SEQ ID NO: 151875 - protein, 11 aa, West Nile virus
PLMALLTPGLR

SEQ ID NO: 151876 - protein, 11 aa, West Nile virus
LMALLTPGLRC

SEQ ID NO: 151877 - protein, 11 aa, West Nile virus
MALLTPGLRCL

SEQ ID NO: 151878 - protein, 11 aa, West Nile virus
ALLTPGLKCLH

SEQ ID NO: 151879 - protein, 11 aa, West Nile virus
LLTPGLKCLHL

SEQ ID NO: 151880 - protein, 11 aa, West Nile virus
LTPGLKCLHLD

SEQ ID NO: 151881 - protein, 11 aa, West Nile virus
TPGLKCLHLDI

SEQ ID NO: 151882 - protein, 11 aa, West Nile virus
PGLKCLHLDIY

SEQ ID NO: 151883 - protein, 11 aa, West Nile virus
GLKCLHLDIYR

SEQ ID NO: 151884 - protein, 11 aa, West Nile virus
LKCLHLDIYRI

SEQ ID NO: 151885 - protein, 11 aa, West Nile virus
KCLHLDIYRIL

SEQ ID NO: 151886 - protein, 11 aa, West Nile virus
CLNLDVYKILL

SEQ ID NO: 151887 - protein, 11 aa, West Nile virus
LNLDVSRILLL

SEQ ID NO: 151888 - protein, 11 aa, West Nile virus
NLDVSRILLLM

SEQ ID NO: 151889 - protein, 11 aa, West Nile virus
LDVSRILLLMV

SEQ ID NO: 151890 - protein, 11 aa, West Nile virus
DVYRIVLLMIG

SEQ ID NO: 151891 - protein, 11 aa, West Nile virus
YRIVLLMIGIG

SEQ ID NO: 151892 - protein, 11 aa, West Nile virus
RIVLLMIGIGS

SEQ ID NO: 151893 - protein, 11 aa, West Nile virus
ILLLMIGIGSL

SEQ ID NO: 151894 - protein, 11 aa, West Nile virus
LLLMVGVGSLV

SEQ ID NO: 151895 - protein, 11 aa, West Nile virus
LLMVGVGSLVK

SEQ ID NO: 151896 - protein, 11 aa, West Nile virus
LMVGVGSLVKE

SEQ ID NO: 151897 - protein, 11 aa, West Nile virus
ERRSAVAKKKG

SEQ ID NO: 151898 - protein, 11 aa, West Nile virus
RRSAVAKKKGA

SEQ ID NO: 151899 - protein, 11 aa, West Nile virus
RSAVAKKKGAS

SEQ ID NO: 151900 - protein, 11 aa, West Nile virus
SAVAKKKGASL

SEQ ID NO: 151901 - protein, 11 aa, West Nile virus
AVAKKKGASLI

SEQ ID NO: 151902 - protein, 11 aa, West Nile virus
VAKKKGASLIC

SEQ ID NO: 151903 - protein, 11 aa, West Nile virus
AKKKGASLICL

SEQ ID NO: 151904 - protein, 11 aa, West Nile virus
KKKGASLICLA

SEQ ID NO: 151905 - protein, 11 aa, West Nile virus
KKGASLICLAL

SEQ ID NO: 151906 - protein, 11 aa, West Nile virus
KGASLICLALA

SEQ ID NO: 151907 - protein, 11 aa, West Nile virus
GASLICLALAS

SEQ ID NO: 151908 - protein, 11 aa, West Nile virus
ASLICLALAST

SEQ ID NO: 151909 - protein, 11 aa, West Nile virus
SLICLALASTG

SEQ ID NO: 151910 - protein, 11 aa, West Nile virus
FNPLILVAGLL

SEQ ID NO: 151911 - protein, 11 aa, West Nile virus
LAAGLMACDPN

SEQ ID NO: 151912 - protein, 11 aa, West Nile virus
AAGLMACDPNR

SEQ ID NO: 151913 - protein, 11 aa, West Nile virus
AGLMACDPNRK

SEQ ID NO: 151914 - protein, 11 aa, West Nile virus
GLMACDPNRKR

SEQ ID NO: 151915 - protein, 11 aa, West Nile virus
LMACDPNRKRG

SEQ ID NO: 151916 - protein, 11 aa, West Nile virus
MACDPNRKRGW

SEQ ID NO: 151917 - protein, 11 aa, West Nile virus
VGGLAELDMDS

SEQ ID NO: 151918 - protein, 11 aa, West Nile virus
GGLAELDVDSM

SEQ ID NO: 151919 - protein, 11 aa, West Nile virus
GLAELDVDSMA

SEQ ID NO: 151920 - protein, 11 aa, West Nile virus
LAELDMDSMAI

SEQ ID NO: 151921 - protein, 11 aa, West Nile virus
AELDIDSMAVP

SEQ ID NO: 151922 - protein, 11 aa, West Nile virus
ELDIDTMAIPM

SEQ ID NO: 151923 - protein, 11 aa, West Nile virus
LDVDSMAIPMT

SEQ ID NO: 151924 - protein, 11 aa, West Nile virus
DVDSMAIPMTI

SEQ ID NO: 151925 - protein, 11 aa, West Nile virus
MDSMAIPMTIA

SEQ ID NO: 151926 - protein, 11 aa, West Nile virus
MTIAGLMFAAY

SEQ ID NO: 151927 - protein, 11 aa, West Nile virus
TIAGLMFAAYV

SEQ ID NO: 151928 - protein, 11 aa, West Nile virus
IAGLMFAAYVI

SEQ ID NO: 151929 - protein, 11 aa, West Nile virus
AGLMFAAYVIT

SEQ ID NO: 151930 - protein, 11 aa, West Nile virus
GLMFAAYVITG

SEQ ID NO: 151931 - protein, 11 aa, West Nile virus
LMFAAYVITGR

SEQ ID NO: 151932 - protein, 11 aa, West Nile virus
MFAAYVITGRS

SEQ ID NO: 151933 - protein, 11 aa, West Nile virus
FAAYVITGRST

SEQ ID NO: 151934 - protein, 11 aa, West Nile virus
AAYVITGRSTD

SEQ ID NO: 151935 - protein, 11 aa, West Nile virus
DMWIERTANIS

SEQ ID NO: 151936 - protein, 11 aa, West Nile virus
MWIERTANISW

SEQ ID NO: 151937 - protein, 11 aa, West Nile virus
WIERTANISWE

SEQ ID NO: 151938 - protein, 11 aa, West Nile virus
IERTADISWEG

SEQ ID NO: 151939 - protein, 11 aa, West Nile virus
ERTADISWEGD

SEQ ID NO: 151940 - protein, 11 aa, West Nile virus
ADISWEGDAEI

SEQ ID NO: 151941 - protein, 11 aa, West Nile virus
DISWEGDAEIT

SEQ ID NO: 151942 - protein, 11 aa, West Nile virus
ISWEGDAEITG

SEQ ID NO: 151943 - protein, 11 aa, West Nile virus
WEGDAEITGSS

SEQ ID NO: 151944 - protein, 11 aa, West Nile virus
EGDAEITGSSE

SEQ ID NO: 151945 - protein, 11 aa, West Nile virus
GDAEITGSSER

SEQ ID NO: 151946 - protein, 11 aa, West Nile virus
DVEITGSSERV

SEQ ID NO: 151947 - protein, 11 aa, West Nile virus
VEITGSSERVD

SEQ ID NO: 151948 - protein, 11 aa, West Nile virus
ITGSSERVDVK

SEQ ID NO: 151949 - protein, 11 aa, West Nile virus
TGSSDRVDVKL

SEQ ID NO: 151950 - protein, 11 aa, West Nile virus
GSSDRVDVKLD

SEQ ID NO: 151951 - protein, 11 aa, West Nile virus
SSDRVDVKLDD

SEQ ID NO: 151952 - protein, 11 aa, West Nile virus
SERVDVRLDDG

SEQ ID NO: 151953 - protein, 11 aa, West Nile virus
ERVDVKLDDDG

SEQ ID NO: 151954 - protein, 11 aa, West Nile virus
RVDVRLDDDGD

SEQ ID NO: 151955 - protein, 11 aa, West Nile virus
VDVRLDDDGDF

SEQ ID NO: 151956 - protein, 11 aa, West Nile virus
DVRLDDGENFQ

SEQ ID NO: 151957 - protein, 11 aa, West Nile virus
VRLDDDGDFQL

SEQ ID NO: 151958 - protein, 11 aa, West Nile virus
RLDDGENFQLM

SEQ ID NO: 151959 - protein, 11 aa, West Nile virus
LDDDGDFQLMN

SEQ ID NO: 151960 - protein, 11 aa, West Nile virus
DDDGNFQLMSD

SEQ ID NO: 151961 - protein, 11 aa, West Nile virus
DDGNFQLMSDP

SEQ ID NO: 151962 - protein, 11 aa, West Nile virus
DGNFQLMSDPG

SEQ ID NO: 151963 - protein, 11 aa, West Nile virus
ENFQLMNDPGA

SEQ ID NO: 151964 - protein, 11 aa, West Nile virus
DFQLMNDPGAP

SEQ ID NO: 151965 - protein, 11 aa, West Nile virus
LMSDPGAPWKI

SEQ ID NO: 151966 - protein, 11 aa, West Nile virus
MSDPGAPWKIW

SEQ ID NO: 151967 - protein, 11 aa, West Nile virus
SDPGAPWKIWM

SEQ ID NO: 151968 - protein, 11 aa, West Nile virus
PGAPWKIWMLK

SEQ ID NO: 151969 - protein, 11 aa, West Nile virus
GAPWKIWMLKM

SEQ ID NO: 151970 - protein, 11 aa, West Nile virus
MTCLAVSAYTP

SEQ ID NO: 151971 - protein, 11 aa, West Nile virus
TCLAVSAYTPW

SEQ ID NO: 151972 - protein, 11 aa, West Nile virus
YTPWAVLPSVV

SEQ ID NO: 151973 - protein, 11 aa, West Nile virus
TPWAILPSIVG

SEQ ID NO: 151974 - protein, 11 aa, West Nile virus
PWAVLPSVVGF

SEQ ID NO: 151975 - protein, 11 aa, West Nile virus
WAVLPSVVGFW

SEQ ID NO: 151976 - protein, 11 aa, West Nile virus
AVLPSVVGFWI

SEQ ID NO: 151977 - protein, 11 aa, West Nile virus
ILPSVVGFWIS

SEQ ID NO: 151978 - protein, 11 aa, West Nile virus
LPSVVGFWISL

SEQ ID NO: 151979 - protein, 11 aa, West Nile virus
PSVVGFWISLQ

SEQ ID NO: 151980 - protein, 11 aa, West Nile virus
SVVGFWISLQY

SEQ ID NO: 151981 - protein, 11 aa, West Nile virus
VVGFWISLQYT

SEQ ID NO: 151982 - protein, 11 aa, West Nile virus
LWDTPSPREYR

SEQ ID NO: 151983 - protein, 11 aa, West Nile virus
EYRKGDTTTGV

SEQ ID NO: 151984 - protein, 11 aa, West Nile virus
YRKGDTTTGVY

SEQ ID NO: 151985 - protein, 11 aa, West Nile virus
RKGDTTTGVYR

SEQ ID NO: 151986 - protein, 11 aa, West Nile virus
RGLLGNYQAGV

SEQ ID NO: 151987 - protein, 11 aa, West Nile virus
GILGSYQAGAG

SEQ ID NO: 151988 - protein, 11 aa, West Nile virus
LLGNYQAGVGV

SEQ ID NO: 151989 - protein, 11 aa, West Nile virus
LCYGGPWKLQC

SEQ ID NO: 151990 - protein, 11 aa, West Nile virus
CYGGPWKLQHR

SEQ ID NO: 151991 - protein, 11 aa, West Nile virus
YGGPWKLQCKW

SEQ ID NO: 151992 - protein, 11 aa, West Nile virus
GGPWKLQHRWN

SEQ ID NO: 151993 - protein, 11 aa, West Nile virus
GPWKLQHRWNG

SEQ ID NO: 151994 - protein, 11 aa, West Nile virus
PWKLQRKWNGL

SEQ ID NO: 151995 - protein, 11 aa, West Nile virus
WKLQRKWNGLD

SEQ ID NO: 151996 - protein, 11 aa, West Nile virus
KLQRKWNGLDE

SEQ ID NO: 151997 - protein, 11 aa, West Nile virus
LQRKWNGLDEV

SEQ ID NO: 151998 - protein, 11 aa, West Nile virus
QRKWNGLDEVQ

SEQ ID NO: 151999 - protein, 11 aa, West Nile virus
RKWNGLDEVQM

SEQ ID NO: 152000 - protein, 11 aa, West Nile virus
KWNGLDEVQMI

SEQ ID NO: 152001 - protein, 11 aa, West Nile virus
WNGLDEVQMIV

SEQ ID NO: 152002 - protein, 11 aa, West Nile virus
NGLDEVQMIVA

SEQ ID NO: 152003 - protein, 11 aa, West Nile virus
GLDEVQMIVAE

SEQ ID NO: 152004 - protein, 11 aa, West Nile virus
LDEVQMIVAEP

SEQ ID NO: 152005 - protein, 11 aa, West Nile virus
VQMIVAEPGRK

SEQ ID NO: 152006 - protein, 11 aa, West Nile virus
QMIVVEPGKNA

SEQ ID NO: 152007 - protein, 11 aa, West Nile virus
MIVVEPGKNAK

SEQ ID NO: 152008 - protein, 11 aa, West Nile virus
IVVEPGKNAKN

SEQ ID NO: 152009 - protein, 11 aa, West Nile virus
VVEPGKNAKNV

SEQ ID NO: 152010 - protein, 11 aa, West Nile virus
VEPGKNAKNVQ

SEQ ID NO: 152011 - protein, 11 aa, West Nile virus
EPGKNAKNVQT

SEQ ID NO: 152012 - protein, 11 aa, West Nile virus
PGKNAKNVQTK

SEQ ID NO: 152013 - protein, 11 aa, West Nile virus
GKNAKNVQTKP

SEQ ID NO: 152014 - protein, 11 aa, West Nile virus
KNAKNVQTKPG

SEQ ID NO: 152015 - protein, 11 aa, West Nile virus
NAKNVQTKPGV

SEQ ID NO: 152016 - protein, 11 aa, West Nile virus
AKNVQTKPGVF

SEQ ID NO: 152017 - protein, 11 aa, West Nile virus
DGEIGAVTLDY

SEQ ID NO: 152018 - protein, 11 aa, West Nile virus
TSGSPIVDKNS

SEQ ID NO: 152019 - protein, 11 aa, West Nile virus
SGSPIVDKSGD

SEQ ID NO: 152020 - protein, 11 aa, West Nile virus
GSPIVDKSGDV

SEQ ID NO: 152021 - protein, 11 aa, West Nile virus
SPIVDKSGDVI

SEQ ID NO: 152022 - protein, 11 aa, West Nile virus
PIVDKSGDVIG

SEQ ID NO: 152023 - protein, 11 aa, West Nile virus
IVDKNSDVIGL

SEQ ID NO: 152024 - protein, 11 aa, West Nile virus
VDKNSDVIGLY

SEQ ID NO: 152025 - protein, 11 aa, West Nile virus
DKSGDVIGLYG

SEQ ID NO: 152026 - protein, 11 aa, West Nile virus
KNSDVIGLYGN

SEQ ID NO: 152027 - protein, 11 aa, West Nile virus
YGNGVIMPSGS

SEQ ID NO: 152028 - protein, 11 aa, West Nile virus
GNGVIMPSGSY

SEQ ID NO: 152029 - protein, 11 aa, West Nile virus
NGVIMPSGSYI

SEQ ID NO: 152030 - protein, 11 aa, West Nile virus
GVIMPSGSYIS

SEQ ID NO: 152031 - protein, 11 aa, West Nile virus
VIMPSGSYISA

SEQ ID NO: 152032 - protein, 11 aa, West Nile virus
IMPSGSYISAI

SEQ ID NO: 152033 - protein, 11 aa, West Nile virus
MPSGSYISAIV

SEQ ID NO: 152034 - protein, 11 aa, West Nile virus
PSGSYISAIVQ

SEQ ID NO: 152035 - protein, 11 aa, West Nile virus
SGSYISAIVQG

SEQ ID NO: 152036 - protein, 11 aa, West Nile virus
IVQGERMDEPV

SEQ ID NO: 152037 - protein, 11 aa, West Nile virus
VQGERMDEPVP

SEQ ID NO: 152038 - protein, 11 aa, West Nile virus
QGERMDEPVPA

SEQ ID NO: 152039 - protein, 11 aa, West Nile virus
GERMDEPVPAG

SEQ ID NO: 152040 - protein, 11 aa, West Nile virus
ERMDEPVPAGF

SEQ ID NO: 152041 - protein, 11 aa, West Nile virus
GFEPETLKKKQ

SEQ ID NO: 152042 - protein, 11 aa, West Nile virus
FDPEMLRKKQI

SEQ ID NO: 152043 - protein, 11 aa, West Nile virus
PDMLRKKQISV

SEQ ID NO: 152044 - protein, 11 aa, West Nile virus
DMLRKKQISVL

SEQ ID NO: 152045 - protein, 11 aa, West Nile virus
TLKKKQITVLD

SEQ ID NO: 152046 - protein, 11 aa, West Nile virus
LKKKQITVLDL

SEQ ID NO: 152047 - protein, 11 aa, West Nile virus
RKKKITVLDLH

SEQ ID NO: 152048 - protein, 11 aa, West Nile virus
KKITVLDLHPG

SEQ ID NO: 152049 - protein, 11 aa, West Nile virus
KITVLDLHPGA

SEQ ID NO: 152050 - protein, 11 aa, West Nile virus
KTRKILPQIIR

SEQ ID NO: 152051 - protein, 11 aa, West Nile virus
TRKILPQIIRE

SEQ ID NO: 152052 - protein, 11 aa, West Nile virus
RKILPQIIREA

SEQ ID NO: 152053 - protein, 11 aa, West Nile virus
KILPQIIREAI

SEQ ID NO: 152054 - protein, 11 aa, West Nile virus
ILPQIIKEAIS

SEQ ID NO: 152055 - protein, 11 aa, West Nile virus
LPQIIREAINR

SEQ ID NO: 152056 - protein, 11 aa, West Nile virus
PQIIREAINRR

SEQ ID NO: 152057 - protein, 11 aa, West Nile virus
QIIREAINRRL

SEQ ID NO: 152058 - protein, 11 aa, West Nile virus
IIREAINRRLR

SEQ ID NO: 152059 - protein, 11 aa, West Nile virus
IREAINRRLRT

SEQ ID NO: 152060 - protein, 11 aa, West Nile virus
REAINRRLRTA

SEQ ID NO: 152061 - protein, 11 aa, West Nile virus
NKRLRTAILAP

SEQ ID NO: 152062 - protein, 11 aa, West Nile virus
KRLRTAILAPT

SEQ ID NO: 152063 - protein, 11 aa, West Nile virus
AILAPTRVVAA

SEQ ID NO: 152064 - protein, 11 aa, West Nile virus
ILAPTRVVAAE

SEQ ID NO: 152065 - protein, 11 aa, West Nile virus
APTRVVASEMA

SEQ ID NO: 152066 - protein, 11 aa, West Nile virus
PTRVVASEMAE

SEQ ID NO: 152067 - protein, 11 aa, West Nile virus
TRVVASEMAEA

SEQ ID NO: 152068 - protein, 11 aa, West Nile virus
RVVASEMAEAL

SEQ ID NO: 152069 - protein, 11 aa, West Nile virus
VVASEMAEALR

SEQ ID NO: 152070 - protein, 11 aa, West Nile virus
VASEMAEALRG

SEQ ID NO: 152071 - protein, 11 aa, West Nile virus
ASEMAEALRGL

SEQ ID NO: 152072 - protein, 11 aa, West Nile virus
SEMAEALRGLP

SEQ ID NO: 152073 - protein, 11 aa, West Nile virus
LPIRYQTSAVT

SEQ ID NO: 152074 - protein, 11 aa, West Nile virus
PIRYQTSAVTR

SEQ ID NO: 152075 - protein, 11 aa, West Nile virus
IRYQTSAVTRE

SEQ ID NO: 152076 - protein, 11 aa, West Nile virus
RYQTSAVTREH

SEQ ID NO: 152077 - protein, 11 aa, West Nile virus
REHTGNEIVDV

SEQ ID NO: 152078 - protein, 11 aa, West Nile virus
EHTGNEIVDVM

SEQ ID NO: 152079 - protein, 11 aa, West Nile virus
HTGNEIVDVMC

SEQ ID NO: 152080 - protein, 11 aa, West Nile virus
TGNEIVDVMCH

SEQ ID NO: 152081 - protein, 11 aa, West Nile virus
SIAARGYISTR

SEQ ID NO: 152082 - protein, 11 aa, West Nile virus
IAARGYISTRV

SEQ ID NO: 152083 - protein, 11 aa, West Nile virus
AARGYISTRVE

SEQ ID NO: 152084 - protein, 11 aa, West Nile virus
ARGYISTRVEL

SEQ ID NO: 152085 - protein, 11 aa, West Nile virus
RGYISTRVELG

SEQ ID NO: 152086 - protein, 11 aa, West Nile virus
GYISTRVELGE

SEQ ID NO: 152087 - protein, 11 aa, West Nile virus
YISTRVELGEA

SEQ ID NO: 152088 - protein, 11 aa, West Nile virus
ISTRVELGEAA

SEQ ID NO: 152089 - protein, 11 aa, West Nile virus
STRVELGEAAA

SEQ ID NO: 152090 - protein, 11 aa, West Nile virus
TPPGSSDPFPE

SEQ ID NO: 152091 - protein, 11 aa, West Nile virus
PPGTSDPFPKS

SEQ ID NO: 152092 - protein, 11 aa, West Nile virus
PGTHDPFPESN

SEQ ID NO: 152093 - protein, 11 aa, West Nile virus
GTHDPFPESNA

SEQ ID NO: 152094 - protein, 11 aa, West Nile virus
TSDPFPKSNSP

SEQ ID NO: 152095 - protein, 11 aa, West Nile virus
SDPFPESNAPV

SEQ ID NO: 152096 - protein, 11 aa, West Nile virus
DIQTEIPDRAW

SEQ ID NO: 152097 - protein, 11 aa, West Nile virus
IQTEIPDRAWN

SEQ ID NO: 152098 - protein, 11 aa, West Nile virus
NTGYEWITEYV

SEQ ID NO: 152099 - protein, 11 aa, West Nile virus
TGYEWITEYVG

SEQ ID NO: 152100 - protein, 11 aa, West Nile virus
GYEWITEYVGK

SEQ ID NO: 152101 - protein, 11 aa, West Nile virus
YEWITEYVGKT

SEQ ID NO: 152102 - protein, 11 aa, West Nile virus
EWITEYVGKTV

SEQ ID NO: 152103 - protein, 11 aa, West Nile virus
WITEYVGKTVW

SEQ ID NO: 152104 - protein, 11 aa, West Nile virus
ITEYVGKTVWF

SEQ ID NO: 152105 - protein, 11 aa, West Nile virus
TEYVGKTVWFV

SEQ ID NO: 152106 - protein, 11 aa, West Nile virus
EYVGKTVWFVP

SEQ ID NO: 152107 - protein, 11 aa, West Nile virus
YVGKTVWFVPS

SEQ ID NO: 152108 - protein, 11 aa, West Nile virus
VGKTVWFVPSV

SEQ ID NO: 152109 - protein, 11 aa, West Nile virus
MAQCLQRAGKR

SEQ ID NO: 152110 - protein, 11 aa, West Nile virus
ALCLQRAGKRV

SEQ ID NO: 152111 - protein, 11 aa, West Nile virus
QCLQRAGKKVI

SEQ ID NO: 152112 - protein, 11 aa, West Nile virus
CLQRAGKRVIQ

SEQ ID NO: 152113 - protein, 11 aa, West Nile virus
LQRAGKRVIQL

SEQ ID NO: 152114 - protein, 11 aa, West Nile virus
QRAGKRVIQLN

SEQ ID NO: 152115 - protein, 11 aa, West Nile virus
RAGKRVIQLNR

SEQ ID NO: 152116 - protein, 11 aa, West Nile virus
AGKRVIQLNRK

SEQ ID NO: 152117 - protein, 11 aa, West Nile virus
GKRVIQLNRKS

SEQ ID NO: 152118 - protein, 11 aa, West Nile virus
KRVIQLNRKSY

SEQ ID NO: 152119 - protein, 11 aa, West Nile virus
RVIQLNRKSYE

SEQ ID NO: 152120 - protein, 11 aa, West Nile virus
ISEMGANFRAS

SEQ ID NO: 152121 - protein, 11 aa, West Nile virus
SEMGANFKANR

SEQ ID NO: 152122 - protein, 11 aa, West Nile virus
EMGANFRASRV

SEQ ID NO: 152123 - protein, 11 aa, West Nile virus
MGANFKANRVI

SEQ ID NO: 152124 - protein, 11 aa, West Nile virus
GANFKANRVID

SEQ ID NO: 152125 - protein, 11 aa, West Nile virus
ANFRASRVIDS

SEQ ID NO: 152126 - protein, 11 aa, West Nile virus
NFKANRVIDSR

SEQ ID NO: 152127 - protein, 11 aa, West Nile virus
FKANRVIDSRK

SEQ ID NO: 152128 - protein, 11 aa, West Nile virus
RASRVIDSRKS

SEQ ID NO: 152129 - protein, 11 aa, West Nile virus
SRKSVKPIIIT

SEQ ID NO: 152130 - protein, 11 aa, West Nile virus
RKSVKPTIITD

SEQ ID NO: 152131 - protein, 11 aa, West Nile virus
KSVKPTIITDG

SEQ ID NO: 152132 - protein, 11 aa, West Nile virus
SVKPTIITDGE

SEQ ID NO: 152133 - protein, 11 aa, West Nile virus
ITDGENRVVLG

SEQ ID NO: 152134 - protein, 11 aa, West Nile virus
TDGENRVVLGE

SEQ ID NO: 152135 - protein, 11 aa, West Nile virus
DGENRVVLGEP

SEQ ID NO: 152136 - protein, 11 aa, West Nile virus
GENRVVLGEPS

SEQ ID NO: 152137 - protein, 11 aa, West Nile virus
ENRVVLGEPSA

SEQ ID NO: 152138 - protein, 11 aa, West Nile virus
NRVVLGEPSAI

SEQ ID NO: 152139 - protein, 11 aa, West Nile virus
RVVLGEPSAIT

SEQ ID NO: 152140 - protein, 11 aa, West Nile virus
VVLGEPSAITA

SEQ ID NO: 152141 - protein, 11 aa, West Nile virus
VLGEPSAITAA

SEQ ID NO: 152142 - protein, 11 aa, West Nile virus
AQRRGRTGRNP

SEQ ID NO: 152143 - protein, 11 aa, West Nile virus
QRRGRIGRNPT

SEQ ID NO: 152144 - protein, 11 aa, West Nile virus
RRGRIGRNPTQ

SEQ ID NO: 152145 - protein, 11 aa, West Nile virus
RGRIGRNPTQV

SEQ ID NO: 152146 - protein, 11 aa, West Nile virus
GRVGRNPSQVG

SEQ ID NO: 152147 - protein, 11 aa, West Nile virus
RIGRNPTQVGD

SEQ ID NO: 152148 - protein, 11 aa, West Nile virus
VGRNPSQVGDE

SEQ ID NO: 152149 - protein, 11 aa, West Nile virus
GRNPSQAGDEY

SEQ ID NO: 152150 - protein, 11 aa, West Nile virus
RNPSQAGDEYC

SEQ ID NO: 152151 - protein, 11 aa, West Nile virus
NPSQAGDEYCY

SEQ ID NO: 152152 - protein, 11 aa, West Nile virus
PTQVGDEYCYG

SEQ ID NO: 152153 - protein, 11 aa, West Nile virus
GGHTNEDDSNY

SEQ ID NO: 152154 - protein, 11 aa, West Nile virus
GHTNEDDSNCA

SEQ ID NO: 152155 - protein, 11 aa, West Nile virus
HTNEDDSNCAH

SEQ ID NO: 152156 - protein, 11 aa, West Nile virus
TNEDDSNCAHW

SEQ ID NO: 152157 - protein, 11 aa, West Nile virus
NEDDSNYAHWT

SEQ ID NO: 152158 - protein, 11 aa, West Nile virus
EDDSNCAHWTE

SEQ ID NO: 152159 - protein, 11 aa, West Nile virus
DDSNYAHWTEA

SEQ ID NO: 152160 - protein, 11 aa, West Nile virus
DSNCAHWTEAR

SEQ ID NO: 152161 - protein, 11 aa, West Nile virus
SNCAHWTEARI

SEQ ID NO: 152162 - protein, 11 aa, West Nile virus
NCAHWTEARIM

SEQ ID NO: 152163 - protein, 11 aa, West Nile virus
LAHWTEARIML

SEQ ID NO: 152164 - protein, 11 aa, West Nile virus
PDNINMPNGLI

SEQ ID NO: 152165 - protein, 11 aa, West Nile virus
INMPNGLIAQL

SEQ ID NO: 152166 - protein, 11 aa, West Nile virus
NMPNGLIAQLY

SEQ ID NO: 152167 - protein, 11 aa, West Nile virus
MPNGLIAQLYQ

SEQ ID NO: 152168 - protein, 11 aa, West Nile virus
PNGLIAQLYQP

SEQ ID NO: 152169 - protein, 11 aa, West Nile virus
NGLIAQLYQPE

SEQ ID NO: 152170 - protein, 11 aa, West Nile virus
GLIAQLYQPER

SEQ ID NO: 152171 - protein, 11 aa, West Nile virus
LIAQLYQPERE

SEQ ID NO: 152172 - protein, 11 aa, West Nile virus
IAQLYQPEREK

SEQ ID NO: 152173 - protein, 11 aa, West Nile virus
QFYQPEREKVH

SEQ ID NO: 152174 - protein, 11 aa, West Nile virus
LYQPEREKVCT

SEQ ID NO: 152175 - protein, 11 aa, West Nile virus
QPEREKVCTMD

SEQ ID NO: 152176 - protein, 11 aa, West Nile virus
PEREKVHTMDG

SEQ ID NO: 152177 - protein, 11 aa, West Nile virus
EREKVHTMDGE

SEQ ID NO: 152178 - protein, 11 aa, West Nile virus
REKVHTMDGEY

SEQ ID NO: 152179 - protein, 11 aa, West Nile virus
EKVYTMEGEYR

SEQ ID NO: 152180 - protein, 11 aa, West Nile virus
KVYTMEGEYRL

SEQ ID NO: 152181 - protein, 11 aa, West Nile virus
VYTMEGEYRLR

SEQ ID NO: 152182 - protein, 11 aa, West Nile virus
YTMEGEYRLRG

SEQ ID NO: 152183 - protein, 11 aa, West Nile virus
ADLPVWLAHKV

SEQ ID NO: 152184 - protein, 11 aa, West Nile virus
DLPVWLAHKVA

SEQ ID NO: 152185 - protein, 11 aa, West Nile virus
LPVWLAYKVAS

SEQ ID NO: 152186 - protein, 11 aa, West Nile virus
PVWLAYKAAAA

SEQ ID NO: 152187 - protein, 11 aa, West Nile virus
VWLAHKVAAAG

SEQ ID NO: 152188 - protein, 11 aa, West Nile virus
WLAYQVAAAGI

SEQ ID NO: 152189 - protein, 11 aa, West Nile virus
QVAAAGISYHD

SEQ ID NO: 152190 - protein, 11 aa, West Nile virus
VAAAGVPYHDR

SEQ ID NO: 152191 - protein, 11 aa, West Nile virus
AAAGISYHDRR

SEQ ID NO: 152192 - protein, 11 aa, West Nile virus
AAGISYHDRRW

SEQ ID NO: 152193 - protein, 11 aa, West Nile virus
AGVPYHDRRWC

SEQ ID NO: 152194 - protein, 11 aa, West Nile virus
GVPYHDRRWCF

SEQ ID NO: 152195 - protein, 11 aa, West Nile virus
VPYHDRRWCFD

SEQ ID NO: 152196 - protein, 11 aa, West Nile virus
PYHDRRWCFDG

SEQ ID NO: 152197 - protein, 11 aa, West Nile virus
DGPRTNMILED

SEQ ID NO: 152198 - protein, 11 aa, West Nile virus
GPRTNTVLEDN

SEQ ID NO: 152199 - protein, 11 aa, West Nile virus
PRTNTVLEDNN

SEQ ID NO: 152200 - protein, 11 aa, West Nile virus
RTNMILEDNNE

SEQ ID NO: 152201 - protein, 11 aa, West Nile virus
TNTVLEDNNEV

SEQ ID NO: 152202 - protein, 11 aa, West Nile virus
NTVLEDNNEVE

SEQ ID NO: 152203 - protein, 11 aa, West Nile virus
TVLEDNNEVEV

SEQ ID NO: 152204 - protein, 11 aa, West Nile virus
KVGERKILRPR

SEQ ID NO: 152205 - protein, 11 aa, West Nile virus
VGERKILRPRW

SEQ ID NO: 152206 - protein, 11 aa, West Nile virus
GERKILRPRWV

SEQ ID NO: 152207 - protein, 11 aa, West Nile virus
ERKILRPRWVD

SEQ ID NO: 152208 - protein, 11 aa, West Nile virus
RKILRPRWVDA

SEQ ID NO: 152209 - protein, 11 aa, West Nile virus
KILRPRWVDAR

SEQ ID NO: 152210 - protein, 11 aa, West Nile virus
ILRPRWVDARV

SEQ ID NO: 152211 - protein, 11 aa, West Nile virus
LRPRWVDARVY

SEQ ID NO: 152212 - protein, 11 aa, West Nile virus
RPRWVDARVYS

SEQ ID NO: 152213 - protein, 11 aa, West Nile virus
PRWVDARVYSD

SEQ ID NO: 152214 - protein, 11 aa, West Nile virus
RWVDARVYSDH

SEQ ID NO: 152215 - protein, 11 aa, West Nile virus
WVDARVYSDHQ

SEQ ID NO: 152216 - protein, 11 aa, West Nile virus
VDARVYSDHQA

SEQ ID NO: 152217 - protein, 11 aa, West Nile virus
RVYSDHQALKL

SEQ ID NO: 152218 - protein, 11 aa, West Nile virus
VYSDHQALKLF

SEQ ID NO: 152219 - protein, 11 aa, West Nile virus
YSDHQALKLFK

SEQ ID NO: 152220 - protein, 11 aa, West Nile virus
SDHQALKLFKD

SEQ ID NO: 152221 - protein, 11 aa, West Nile virus
DHQALKLFKDF

SEQ ID NO: 152222 - protein, 11 aa, West Nile virus
HQALKLFKDFA

SEQ ID NO: 152223 - protein, 11 aa, West Nile virus
QALKLFKDFAA

SEQ ID NO: 152224 - protein, 11 aa, West Nile virus
ALKLFKDFAAG

SEQ ID NO: 152225 - protein, 11 aa, West Nile virus
LKLFKDFAAGR

SEQ ID NO: 152226 - protein, 11 aa, West Nile virus
KLFKDFAAGRR

SEQ ID NO: 152227 - protein, 11 aa, West Nile virus
LFKDFAAGRRS

SEQ ID NO: 152228 - protein, 11 aa, West Nile virus
KDFASGKRSQM

SEQ ID NO: 152229 - protein, 11 aa, West Nile virus
DFAAGKRSQIG

SEQ ID NO: 152230 - protein, 11 aa, West Nile virus
FASGKRSQIGF

SEQ ID NO: 152231 - protein, 11 aa, West Nile virus
GRRSQIGLVEV

SEQ ID NO: 152232 - protein, 11 aa, West Nile virus
RRSQIGLVEVI

SEQ ID NO: 152233 - protein, 11 aa, West Nile virus
RSQIGLVEVIG

SEQ ID NO: 152234 - protein, 11 aa, West Nile virus
SQIGLVEVIGR

SEQ ID NO: 152235 - protein, 11 aa, West Nile virus
QIGLVEVIGRM

SEQ ID NO: 152236 - protein, 11 aa, West Nile virus
IGLVEVIGRMP

SEQ ID NO: 152237 - protein, 11 aa, West Nile virus
GLVEVIGRMPE

SEQ ID NO: 152238 - protein, 11 aa, West Nile virus
LVEVIGRMPEH

SEQ ID NO: 152239 - protein, 11 aa, West Nile virus
VEVIGRMPEHF

SEQ ID NO: 152240 - protein, 11 aa, West Nile virus
EVIGRMPEHFV

SEQ ID NO: 152241 - protein, 11 aa, West Nile virus
VIGRMPEHFVG

SEQ ID NO: 152242 - protein, 11 aa, West Nile virus
IGRMPEHFVGK

SEQ ID NO: 152243 - protein, 11 aa, West Nile virus
GRMPEHFVGKT

SEQ ID NO: 152244 - protein, 11 aa, West Nile virus
RMPEHFVGKTW

SEQ ID NO: 152245 - protein, 11 aa, West Nile virus
MPEHFMVKTWE

SEQ ID NO: 152246 - protein, 11 aa, West Nile virus
PEHFMVKTWEA

SEQ ID NO: 152247 - protein, 11 aa, West Nile virus
EHFMVKTWEAL

SEQ ID NO: 152248 - protein, 11 aa, West Nile virus
HFMVKTWEALD

SEQ ID NO: 152249 - protein, 11 aa, West Nile virus
FMVKTWEALDT

SEQ ID NO: 152250 - protein, 11 aa, West Nile virus
MVKTWEALDTM

SEQ ID NO: 152251 - protein, 11 aa, West Nile virus
MYVVATAEKGR

SEQ ID NO: 152252 - protein, 11 aa, West Nile virus
YVVATADKGGR

SEQ ID NO: 152253 - protein, 11 aa, West Nile virus
VVATAEKGRRA

SEQ ID NO: 152254 - protein, 11 aa, West Nile virus
VATAEKGRRAH

SEQ ID NO: 152255 - protein, 11 aa, West Nile virus
ATADKGGRAHR

SEQ ID NO: 152256 - protein, 11 aa, West Nile virus
TADKGGRAHRM

SEQ ID NO: 152257 - protein, 11 aa, West Nile virus
AEKGGRAHSMA

SEQ ID NO: 152258 - protein, 11 aa, West Nile virus
EKGGRAHSMAL

SEQ ID NO: 152259 - protein, 11 aa, West Nile virus
RGGRAHRSALE

SEQ ID NO: 152260 - protein, 11 aa, West Nile virus
GGRAHSMALEE

SEQ ID NO: 152261 - protein, 11 aa, West Nile virus
GRAHSMALEEL

SEQ ID NO: 152262 - protein, 11 aa, West Nile virus
RAHSMALEELP

SEQ ID NO: 152263 - protein, 11 aa, West Nile virus
AHSMALEELPD

SEQ ID NO: 152264 - protein, 11 aa, West Nile virus
HRSALEELPDA

SEQ ID NO: 152265 - protein, 11 aa, West Nile virus
SMALEELPDAL

SEQ ID NO: 152266 - protein, 11 aa, West Nile virus
EELPDALQTVA

SEQ ID NO: 152267 - protein, 11 aa, West Nile virus
ELPDALQTIIL

SEQ ID NO: 152268 - protein, 11 aa, West Nile virus
LPDALQTVALI

SEQ ID NO: 152269 - protein, 11 aa, West Nile virus
PDALQTIVLIA

SEQ ID NO: 152270 - protein, 11 aa, West Nile virus
DALQTIVLIAL

SEQ ID NO: 152271 - protein, 11 aa, West Nile virus
ALQTIVLIALL

SEQ ID NO: 152272 - protein, 11 aa, West Nile virus
LQTIVLIALLS

SEQ ID NO: 152273 - protein, 11 aa, West Nile virus
QTIVLIALLSV

SEQ ID NO: 152274 - protein, 11 aa, West Nile virus
TIVLIALLSVM

SEQ ID NO: 152275 - protein, 11 aa, West Nile virus
VMTLGVFCLLM

SEQ ID NO: 152276 - protein, 11 aa, West Nile virus
MTLGVFCLLMQ

SEQ ID NO: 152277 - protein, 11 aa, West Nile virus
TLGVFCLLMQR

SEQ ID NO: 152278 - protein, 11 aa, West Nile virus
LGVFCLLMQRK

SEQ ID NO: 152279 - protein, 11 aa, West Nile virus
GVFLLLMQRKG

SEQ ID NO: 152280 - protein, 11 aa, West Nile virus
VFLLLMQRKGI

SEQ ID NO: 152281 - protein, 11 aa, West Nile virus
KGIGKIGLGGV

SEQ ID NO: 152282 - protein, 11 aa, West Nile virus
LGLATFFCWMA

SEQ ID NO: 152283 - protein, 11 aa, West Nile virus
GLATFFCWMAE

SEQ ID NO: 152284 - protein, 11 aa, West Nile virus
LATFFCWMAEV

SEQ ID NO: 152285 - protein, 11 aa, West Nile virus
ATLFCWMAEVP

SEQ ID NO: 152286 - protein, 11 aa, West Nile virus
TLFCWMAEVPG

SEQ ID NO: 152287 - protein, 11 aa, West Nile virus
FFCWMADVPGT

SEQ ID NO: 152288 - protein, 11 aa, West Nile virus
FCWMADVPGTK

SEQ ID NO: 152289 - protein, 11 aa, West Nile virus
CWMADVPGTKI

SEQ ID NO: 152290 - protein, 11 aa, West Nile virus
WMADVPGTKIA

SEQ ID NO: 152291 - protein, 11 aa, West Nile virus
MADVPGTKIAG

SEQ ID NO: 152292 - protein, 11 aa, West Nile virus
ADVPGTKIAGM

SEQ ID NO: 152293 - protein, 11 aa, West Nile virus
DVPGTKIAGML

SEQ ID NO: 152294 - protein, 11 aa, West Nile virus
NQLAMFLICVM

SEQ ID NO: 152295 - protein, 11 aa, West Nile virus
QLAMFLICVMT

SEQ ID NO: 152296 - protein, 11 aa, West Nile virus
LAMFLICVMTL

SEQ ID NO: 152297 - protein, 11 aa, West Nile virus
AMFLICVMTLV

SEQ ID NO: 152298 - protein, 11 aa, West Nile virus
TLVGTVAANEM

SEQ ID NO: 152299 - protein, 11 aa, West Nile virus
LVGTVAANEMG

SEQ ID NO: 152300 - protein, 11 aa, West Nile virus
VGTVAANEMGW

SEQ ID NO: 152301 - protein, 11 aa, West Nile virus
GTVAANEMGWL

SEQ ID NO: 152302 - protein, 11 aa, West Nile virus
NEMGWLDRTKS

SEQ ID NO: 152303 - protein, 11 aa, West Nile virus
EMGWLDRTKSD

SEQ ID NO: 152304 - protein, 11 aa, West Nile virus
MGWLDRTKSDI

SEQ ID NO: 152305 - protein, 11 aa, West Nile virus
ESFLLDLKPAT

SEQ ID NO: 152306 - protein, 11 aa, West Nile virus
SFLLDLKPATA

SEQ ID NO: 152307 - protein, 11 aa, West Nile virus
FFLDLRPATAW

SEQ ID NO: 152308 - protein, 11 aa, West Nile virus
PATAWSLYAIS

SEQ ID NO: 152309 - protein, 11 aa, West Nile virus
ATAWSLYAIST

SEQ ID NO: 152310 - protein, 11 aa, West Nile virus
TAWSLYAVATA

SEQ ID NO: 152311 - protein, 11 aa, West Nile virus
AWSLYAVTTAF

SEQ ID NO: 152312 - protein, 11 aa, West Nile virus
WSLYAISTAFM

SEQ ID NO: 152313 - protein, 11 aa, West Nile virus
SLYAISTAFMT

SEQ ID NO: 152314 - protein, 11 aa, West Nile virus
LYAVTTAFLTP

SEQ ID NO: 152315 - protein, 11 aa, West Nile virus
YAVTTAFLTPL

SEQ ID NO: 152316 - protein, 11 aa, West Nile virus
AVTTAFLTPLL

SEQ ID NO: 152317 - protein, 11 aa, West Nile virus
VTTAFLTPLLK

SEQ ID NO: 152318 - protein, 11 aa, West Nile virus
ATAVLTPLLKH

SEQ ID NO: 152319 - protein, 11 aa, West Nile virus
TAFMTPLLKHL

SEQ ID NO: 152320 - protein, 11 aa, West Nile virus
AFMTPLLKHLI

SEQ ID NO: 152321 - protein, 11 aa, West Nile virus
VLTPLIKHLIT

SEQ ID NO: 152322 - protein, 11 aa, West Nile virus
LTPLLKHVITS

SEQ ID NO: 152323 - protein, 11 aa, West Nile virus
LKHLITSDYIT

SEQ ID NO: 152324 - protein, 11 aa, West Nile virus
TSINVQASTLF

SEQ ID NO: 152325 - protein, 11 aa, West Nile virus
SINVQASTLFT

SEQ ID NO: 152326 - protein, 11 aa, West Nile virus
INVQASTLFTL

SEQ ID NO: 152327 - protein, 11 aa, West Nile virus
NVQASALYSLA

SEQ ID NO: 152328 - protein, 11 aa, West Nile virus
VQASALYSLAR

SEQ ID NO: 152329 - protein, 11 aa, West Nile virus
QASALYSLARG

SEQ ID NO: 152330 - protein, 11 aa, West Nile virus
ASALYSLARGF

SEQ ID NO: 152331 - protein, 11 aa, West Nile virus
SALYSLARGFP

SEQ ID NO: 152332 - protein, 11 aa, West Nile virus
ALYSLARGFPF

SEQ ID NO: 152333 - protein, 11 aa, West Nile virus
LYSLARGFPFV

SEQ ID NO: 152334 - protein, 11 aa, West Nile virus
YSLARGFPFVD

SEQ ID NO: 152335 - protein, 11 aa, West Nile virus
SLARGFPFVDV

SEQ ID NO: 152336 - protein, 11 aa, West Nile virus
ARGFPFVDVGI

SEQ ID NO: 152337 - protein, 11 aa, West Nile virus
DVGISSLLLAV

SEQ ID NO: 152338 - protein, 11 aa, West Nile virus
VGISSLLLAVG

SEQ ID NO: 152339 - protein, 11 aa, West Nile virus
GISSLLLAVGC

SEQ ID NO: 152340 - protein, 11 aa, West Nile virus
ISSLLLAVGCW

SEQ ID NO: 152341 - protein, 11 aa, West Nile virus
SSLLLAVGCWG

SEQ ID NO: 152342 - protein, 11 aa, West Nile virus
SLLLAVGCWGQ

SEQ ID NO: 152343 - protein, 11 aa, West Nile virus
EQVTLTVTVTA

SEQ ID NO: 152344 - protein, 11 aa, West Nile virus
QVTLTVTVTSA

SEQ ID NO: 152345 - protein, 11 aa, West Nile virus
TLLLCHYAYMV

SEQ ID NO: 152346 - protein, 11 aa, West Nile virus
FCHYAYMVPGG

SEQ ID NO: 152347 - protein, 11 aa, West Nile virus
IPGWQAEAMRS

SEQ ID NO: 152348 - protein, 11 aa, West Nile virus
TAAGIMKNAVI

SEQ ID NO: 152349 - protein, 11 aa, West Nile virus
AAGIMKNAVID

SEQ ID NO: 152350 - protein, 11 aa, West Nile virus
AGIMKNVVVDG

SEQ ID NO: 152351 - protein, 11 aa, West Nile virus
GIMKNVVVDGI

SEQ ID NO: 152352 - protein, 11 aa, West Nile virus
IMKNAVIDGMV

SEQ ID NO: 152353 - protein, 11 aa, West Nile virus
MKNVVVDGIVA

SEQ ID NO: 152354 - protein, 11 aa, West Nile virus
KNVVVDGIVAT

SEQ ID NO: 152355 - protein, 11 aa, West Nile virus
NVVVDGIVATD

SEQ ID NO: 152356 - protein, 11 aa, West Nile virus
AVIDGMVATDV

SEQ ID NO: 152357 - protein, 11 aa, West Nile virus
DVPELERATPI

SEQ ID NO: 152358 - protein, 11 aa, West Nile virus
VPELERATPIM

SEQ ID NO: 152359 - protein, 11 aa, West Nile virus
PELERATPIMQ

SEQ ID NO: 152360 - protein, 11 aa, West Nile virus
ELERATPIMQK

SEQ ID NO: 152361 - protein, 11 aa, West Nile virus
LERATPIMQKK

SEQ ID NO: 152362 - protein, 11 aa, West Nile virus
ERATPIMQKKV

SEQ ID NO: 152363 - protein, 11 aa, West Nile virus
RATPIMQKKVG

SEQ ID NO: 152364 - protein, 11 aa, West Nile virus
ATPIMQKKVGQ

SEQ ID NO: 152365 - protein, 11 aa, West Nile virus
TPIMQKKVGQV

SEQ ID NO: 152366 - protein, 11 aa, West Nile virus
PVMQKKVGQII

SEQ ID NO: 152367 - protein, 11 aa, West Nile virus
IMQKKVGQVML

SEQ ID NO: 152368 - protein, 11 aa, West Nile virus
MQKKVGQIILI

SEQ ID NO: 152369 - protein, 11 aa, West Nile virus
QKKVGQIILIL

SEQ ID NO: 152370 - protein, 11 aa, West Nile virus
KKVGQIILILV

SEQ ID NO: 152371 - protein, 11 aa, West Nile virus
KVGQIILILVS

SEQ ID NO: 152372 - protein, 11 aa, West Nile virus
LILVSTAAVVV

SEQ ID NO: 152373 - protein, 11 aa, West Nile virus
ILVSTAAVVVN

SEQ ID NO: 152374 - protein, 11 aa, West Nile virus
LVSTAAVVVNP

SEQ ID NO: 152375 - protein, 11 aa, West Nile virus
VSTAAVVVNPS

SEQ ID NO: 152376 - protein, 11 aa, West Nile virus
STAAVVVNPSV

SEQ ID NO: 152377 - protein, 11 aa, West Nile virus
AALVVNPSVKT

SEQ ID NO: 152378 - protein, 11 aa, West Nile virus
ALVVNPSVKTV

SEQ ID NO: 152379 - protein, 11 aa, West Nile virus
LVVNPSVKTVR

SEQ ID NO: 152380 - protein, 11 aa, West Nile virus
TVREAGILVTA

SEQ ID NO: 152381 - protein, 11 aa, West Nile virus
VREAGILVTAA

SEQ ID NO: 152382 - protein, 11 aa, West Nile virus
REAGILVTAAA

SEQ ID NO: 152383 - protein, 11 aa, West Nile virus
EAGILVTAAAV

SEQ ID NO: 152384 - protein, 11 aa, West Nile virus
AGILVTAAAVT

SEQ ID NO: 152385 - protein, 11 aa, West Nile virus
GILVTAAAVTL

SEQ ID NO: 152386 - protein, 11 aa, West Nile virus
ILVTAAAVTLW

SEQ ID NO: 152387 - protein, 11 aa, West Nile virus
LVTAAAVTLWE

SEQ ID NO: 152388 - protein, 11 aa, West Nile virus
VTAAAVTLWEN

SEQ ID NO: 152389 - protein, 11 aa, West Nile virus
SAAAVTLWENG

SEQ ID NO: 152390 - protein, 11 aa, West Nile virus
AAVTLWEKGAS

SEQ ID NO: 152391 - protein, 11 aa, West Nile virus
AVTLWEKGASS

SEQ ID NO: 152392 - protein, 11 aa, West Nile virus
HVMRGGWLSCF

SEQ ID NO: 152393 - protein, 11 aa, West Nile virus
VMRGGWLSCFS

SEQ ID NO: 152394 - protein, 11 aa, West Nile virus
MRGGWLSCFSI

SEQ ID NO: 152395 - protein, 11 aa, West Nile virus
RGGWLSCLSIM

SEQ ID NO: 152396 - protein, 11 aa, West Nile virus
GGWLSCLSMTW

SEQ ID NO: 152397 - protein, 11 aa, West Nile virus
GWLSCLSIMWT

SEQ ID NO: 152398 - protein, 11 aa, West Nile virus
WLSCLSIMWTL

SEQ ID NO: 152399 - protein, 11 aa, West Nile virus
KNMGKPGLKRG

SEQ ID NO: 152400 - protein, 11 aa, West Nile virus
NMGKPGLKRGG

SEQ ID NO: 152401 - protein, 11 aa, West Nile virus
MGKPGLKRGGA

SEQ ID NO: 152402 - protein, 11 aa, West Nile virus
GKPGLKRGGAK

SEQ ID NO: 152403 - protein, 11 aa, West Nile virus
GRTLGEAWKER

SEQ ID NO: 152404 - protein, 11 aa, West Nile virus
RTLGEVWKEKL

SEQ ID NO: 152405 - protein, 11 aa, West Nile virus
TLGEVWKEKLN

SEQ ID NO: 152406 - protein, 11 aa, West Nile virus
LGEVWKDRLNR

SEQ ID NO: 152407 - protein, 11 aa, West Nile virus
GEVWKDRLNRL

SEQ ID NO: 152408 - protein, 11 aa, West Nile virus
EVWKDRLNRLT

SEQ ID NO: 152409 - protein, 11 aa, West Nile virus
TKEEFARYRKE

SEQ ID NO: 152410 - protein, 11 aa, West Nile virus
KEEFSRYRKEA

SEQ ID NO: 152411 - protein, 11 aa, West Nile virus
EEFTRYRREAI

SEQ ID NO: 152412 - protein, 11 aa, West Nile virus
EFIRYRKEAIT

SEQ ID NO: 152413 - protein, 11 aa, West Nile virus
FIRYRKEAITE

SEQ ID NO: 152414 - protein, 11 aa, West Nile virus
IRYRKEAITEV

SEQ ID NO: 152415 - protein, 11 aa, West Nile virus
RREAITEVDRS

SEQ ID NO: 152416 - protein, 11 aa, West Nile virus
KEAIIEVDRST

SEQ ID NO: 152417 - protein, 11 aa, West Nile virus
EAITEVDRAPA

SEQ ID NO: 152418 - protein, 11 aa, West Nile virus
AIIEVDRSAAR

SEQ ID NO: 152419 - protein, 11 aa, West Nile virus
ARKERNITGGH

SEQ ID NO: 152420 - protein, 11 aa, West Nile virus
ERNITGGHPVS

SEQ ID NO: 152421 - protein, 11 aa, West Nile virus
RNITGGHPVSR

SEQ ID NO: 152422 - protein, 11 aa, West Nile virus
NVTGGHSVSRG

SEQ ID NO: 152423 - protein, 11 aa, West Nile virus
VTGGHSVSRGT

SEQ ID NO: 152424 - protein, 11 aa, West Nile virus
TGGHPVSRGSA

SEQ ID NO: 152425 - protein, 11 aa, West Nile virus
GGHPVSRGSAK

SEQ ID NO: 152426 - protein, 11 aa, West Nile virus
GHPVSRGSAKL

SEQ ID NO: 152427 - protein, 11 aa, West Nile virus
YPVSRGTAKLR

SEQ ID NO: 152428 - protein, 11 aa, West Nile virus
WLVERRFLEPI

SEQ ID NO: 152429 - protein, 11 aa, West Nile virus
LVERRFLEPIG

SEQ ID NO: 152430 - protein, 11 aa, West Nile virus
VERKFVEPVGR

SEQ ID NO: 152431 - protein, 11 aa, West Nile virus
ERRFLEPIGKV

SEQ ID NO: 152432 - protein, 11 aa, West Nile virus
RRFLDPIGKVV

SEQ ID NO: 152433 - protein, 11 aa, West Nile virus
RFLDPIGKVVD

SEQ ID NO: 152434 - protein, 11 aa, West Nile virus
FLDPIGKVVDL

SEQ ID NO: 152435 - protein, 11 aa, West Nile virus
LDPIGKVVDLG

SEQ ID NO: 152436 - protein, 11 aa, West Nile virus
DPIGKVVDLGC

SEQ ID NO: 152437 - protein, 11 aa, West Nile virus
PIGKVVDLGCG

SEQ ID NO: 152438 - protein, 11 aa, West Nile virus
IGKVVDLGCGR

SEQ ID NO: 152439 - protein, 11 aa, West Nile virus
RVQEVRGYTKR

SEQ ID NO: 152440 - protein, 11 aa, West Nile virus
IVTMKSGVDVY

SEQ ID NO: 152441 - protein, 11 aa, West Nile virus
GVDVYYRASEA

SEQ ID NO: 152442 - protein, 11 aa, West Nile virus
VDVYYRASEAS

SEQ ID NO: 152443 - protein, 11 aa, West Nile virus
DVYYRASEASD

SEQ ID NO: 152444 - protein, 11 aa, West Nile virus
VYYRASEASDT

SEQ ID NO: 152445 - protein, 11 aa, West Nile virus
YYRASEASDTL

SEQ ID NO: 152446 - protein, 11 aa, West Nile virus
YRASEASDTLL

SEQ ID NO: 152447 - protein, 11 aa, West Nile virus
RASEASDTLLC

SEQ ID NO: 152448 - protein, 11 aa, West Nile virus
ASEASDTLLCD

SEQ ID NO: 152449 - protein, 11 aa, West Nile virus
SEVSDTLLCDI

SEQ ID NO: 152450 - protein, 11 aa, West Nile virus
EVSDTLLCDIG

SEQ ID NO: 152451 - protein, 11 aa, West Nile virus
VSDTLLCDIGE

SEQ ID NO: 152452 - protein, 11 aa, West Nile virus
SSAEVEEHRTL

SEQ ID NO: 152453 - protein, 11 aa, West Nile virus
SAEVEEHRTLR

SEQ ID NO: 152454 - protein, 11 aa, West Nile virus
AEVEEHRTLRV

SEQ ID NO: 152455 - protein, 11 aa, West Nile virus
EVEEHRTLRVL

SEQ ID NO: 152456 - protein, 11 aa, West Nile virus
VEEHRTLRVLE

SEQ ID NO: 152457 - protein, 11 aa, West Nile virus
EEHRTLRVLEM

SEQ ID NO: 152458 - protein, 11 aa, West Nile virus
EHRTLRVLEMV

SEQ ID NO: 152459 - protein, 11 aa, West Nile virus
HRTLRVLEMVE

SEQ ID NO: 152460 - protein, 11 aa, West Nile virus
RTLRVLEMVED

SEQ ID NO: 152461 - protein, 11 aa, West Nile virus
TLRVLEMVEDW

SEQ ID NO: 152462 - protein, 11 aa, West Nile virus
LRVLEMVEDWL

SEQ ID NO: 152463 - protein, 11 aa, West Nile virus
WLHRGPKEFCV

SEQ ID NO: 152464 - protein, 11 aa, West Nile virus
LHRGPKEFCVK

SEQ ID NO: 152465 - protein, 11 aa, West Nile virus
HRGPKEFCVKV

SEQ ID NO: 152466 - protein, 11 aa, West Nile virus
RGPKEFCVKVL

SEQ ID NO: 152467 - protein, 11 aa, West Nile virus
GPKEFCVKVLC

SEQ ID NO: 152468 - protein, 11 aa, West Nile virus
PKEFCVKVLCP

SEQ ID NO: 152469 - protein, 11 aa, West Nile virus
KEFCVKVLCPY

SEQ ID NO: 152470 - protein, 11 aa, West Nile virus
YMPKVIEKMEV

SEQ ID NO: 152471 - protein, 11 aa, West Nile virus
MPKVIEKMEVL

SEQ ID NO: 152472 - protein, 11 aa, West Nile virus
PKVIEKMEVLQ

SEQ ID NO: 152473 - protein, 11 aa, West Nile virus
VIEKMEVLQRR

SEQ ID NO: 152474 - protein, 11 aa, West Nile virus
IEKMEVLQRRY

SEQ ID NO: 152475 - protein, 11 aa, West Nile virus
EKMEVLQRRYG

SEQ ID NO: 152476 - protein, 11 aa, West Nile virus
KMEVLQRRYGG

SEQ ID NO: 152477 - protein, 11 aa, West Nile virus
MEVLQRRYGGG

SEQ ID NO: 152478 - protein, 11 aa, West Nile virus
EVLQRRYGGGL

SEQ ID NO: 152479 - protein, 11 aa, West Nile virus
HEMYWVSRASS

SEQ ID NO: 152480 - protein, 11 aa, West Nile virus
EMYWVSRASRN

SEQ ID NO: 152481 - protein, 11 aa, West Nile virus
MYWVSRASGNI

SEQ ID NO: 152482 - protein, 11 aa, West Nile virus
YWVSRASGNIV

SEQ ID NO: 152483 - protein, 11 aa, West Nile virus
WVSRASGNIVN

SEQ ID NO: 152484 - protein, 11 aa, West Nile virus
NIVNSVSMTSQ

SEQ ID NO: 152485 - protein, 11 aa, West Nile virus
IVNSVSMTSQV

SEQ ID NO: 152486 - protein, 11 aa, West Nile virus
VHAVNMTSQVL

SEQ ID NO: 152487 - protein, 11 aa, West Nile virus
HAVNMTSQVLL

SEQ ID NO: 152488 - protein, 11 aa, West Nile virus
AVNMTSQVLLG

SEQ ID NO: 152489 - protein, 11 aa, West Nile virus
GRMEKKTWKGA

SEQ ID NO: 152490 - protein, 11 aa, West Nile virus
RMEKKTWKGAH

SEQ ID NO: 152491 - protein, 11 aa, West Nile virus
MEKKTWKGPQY

SEQ ID NO: 152492 - protein, 11 aa, West Nile virus
EKKTWKGPQYE

SEQ ID NO: 152493 - protein, 11 aa, West Nile virus
KKTWKGPQYEE

SEQ ID NO: 152494 - protein, 11 aa, West Nile virus
KTWKGPQYEED

SEQ ID NO: 152495 - protein, 11 aa, West Nile virus
TWKGPQYEEDA

SEQ ID NO: 152496 - protein, 11 aa, West Nile virus
WKGPQYEEDAN

SEQ ID NO: 152497 - protein, 11 aa, West Nile virus
KGPQYEEDANL

SEQ ID NO: 152498 - protein, 11 aa, West Nile virus
GPQYEEDANLG

SEQ ID NO: 152499 - protein, 11 aa, West Nile virus
PQYEEDANLGS

SEQ ID NO: 152500 - protein, 11 aa, West Nile virus
HYEEDVNLGSG

SEQ ID NO: 152501 - protein, 11 aa, West Nile virus
YEEDANLGSGT

SEQ ID NO: 152502 - protein, 11 aa, West Nile virus
VGKPLLNSDTR

SEQ ID NO: 152503 - protein, 11 aa, West Nile virus
GKPLLNSDTSR

SEQ ID NO: 152504 - protein, 11 aa, West Nile virus
KPLLNSDTSRI

SEQ ID NO: 152505 - protein, 11 aa, West Nile virus
PLLNSDTSKIN

SEQ ID NO: 152506 - protein, 11 aa, West Nile virus
DDNHPYRTWNY

SEQ ID NO: 152507 - protein, 11 aa, West Nile virus
DNHPYRTWNYH

SEQ ID NO: 152508 - protein, 11 aa, West Nile virus
TWNYHGSYEVK

SEQ ID NO: 152509 - protein, 11 aa, West Nile virus
WNYHGSYEVKP

SEQ ID NO: 152510 - protein, 11 aa, West Nile virus
NYHGSYEVKPT

SEQ ID NO: 152511 - protein, 11 aa, West Nile virus
YHGSYEVKPTG

SEQ ID NO: 152512 - protein, 11 aa, West Nile virus
HGSYEVKPTGS

SEQ ID NO: 152513 - protein, 11 aa, West Nile virus
GSYEVKPTGSA

SEQ ID NO: 152514 - protein, 11 aa, West Nile virus
SYEVKPTGSAS

SEQ ID NO: 152515 - protein, 11 aa, West Nile virus
YEVKPTGSASS

SEQ ID NO: 152516 - protein, 11 aa, West Nile virus
EVKPTGSASSL

SEQ ID NO: 152517 - protein, 11 aa, West Nile virus
VNPLVSASSLV

SEQ ID NO: 152518 - protein, 11 aa, West Nile virus
NPTGSASSLVN

SEQ ID NO: 152519 - protein, 11 aa, West Nile virus
LLSKPWDVITN

SEQ ID NO: 152520 - protein, 11 aa, West Nile virus
LSKPWDTITSV

SEQ ID NO: 152521 - protein, 11 aa, West Nile virus
SKPWDVITNVT

SEQ ID NO: 152522 - protein, 11 aa, West Nile virus
KPWDTIMNVTT

SEQ ID NO: 152523 - protein, 11 aa, West Nile virus
PWDVITNVTTM

SEQ ID NO: 152524 - protein, 11 aa, West Nile virus
WDTIMNVTTMA

SEQ ID NO: 152525 - protein, 11 aa, West Nile virus
DTIMNVTTMAM

SEQ ID NO: 152526 - protein, 11 aa, West Nile virus
VITNVTTMAMT

SEQ ID NO: 152527 - protein, 11 aa, West Nile virus
DTKAPEPPAGV

SEQ ID NO: 152528 - protein, 11 aa, West Nile virus
TKAPEPPEGVR

SEQ ID NO: 152529 - protein, 11 aa, West Nile virus
VLKETTNWLWA

SEQ ID NO: 152530 - protein, 11 aa, West Nile virus
LKETTNWLWAF

SEQ ID NO: 152531 - protein, 11 aa, West Nile virus
NETTNWLWSHL

SEQ ID NO: 152532 - protein, 11 aa, West Nile virus
ETTNWLWSHLE

SEQ ID NO: 152533 - protein, 11 aa, West Nile virus
TTNWLWAYLAR

SEQ ID NO: 152534 - protein, 11 aa, West Nile virus
RNKRPRMCTRE

SEQ ID NO: 152535 - protein, 11 aa, West Nile virus
NKRPRMCTREE

SEQ ID NO: 152536 - protein, 11 aa, West Nile virus
KRPRMCTREEF

SEQ ID NO: 152537 - protein, 11 aa, West Nile virus
RPRMCTREEFI

SEQ ID NO: 152538 - protein, 11 aa, West Nile virus
PRMCSREEFIK

SEQ ID NO: 152539 - protein, 11 aa, West Nile virus
RMCSREEFIKK

SEQ ID NO: 152540 - protein, 11 aa, West Nile virus
MCSREEFIKKV

SEQ ID NO: 152541 - protein, 11 aa, West Nile virus
CSREEFIKKVN

SEQ ID NO: 152542 - protein, 11 aa, West Nile virus
SREEFIKKVNS

SEQ ID NO: 152543 - protein, 11 aa, West Nile virus
REEFISKVNSN

SEQ ID NO: 152544 - protein, 11 aa, West Nile virus
EEFIKKVNSNA

SEQ ID NO: 152545 - protein, 11 aa, West Nile virus
EFISKVNSNAA

SEQ ID NO: 152546 - protein, 11 aa, West Nile virus
FIKKVNSNAAL

SEQ ID NO: 152547 - protein, 11 aa, West Nile virus
IKKVNSNAALG

SEQ ID NO: 152548 - protein, 11 aa, West Nile virus
KKVNSNAALGA

SEQ ID NO: 152549 - protein, 11 aa, West Nile virus
GAMFEEQNQWS

SEQ ID NO: 152550 - protein, 11 aa, West Nile virus
AMFEEQNQWKS

SEQ ID NO: 152551 - protein, 11 aa, West Nile virus
MFEEQNQWKSA

SEQ ID NO: 152552 - protein, 11 aa, West Nile virus
FEEQNQWKSAR

SEQ ID NO: 152553 - protein, 11 aa, West Nile virus
EEQNQWKSARE

SEQ ID NO: 152554 - protein, 11 aa, West Nile virus
EQNQWKSAREA

SEQ ID NO: 152555 - protein, 11 aa, West Nile virus
QNQWKSAREAV

SEQ ID NO: 152556 - protein, 11 aa, West Nile virus
NQWKSAREAVE

SEQ ID NO: 152557 - protein, 11 aa, West Nile virus
QWKSAREAVED

SEQ ID NO: 152558 - protein, 11 aa, West Nile virus
SAREAVEDLKF

SEQ ID NO: 152559 - protein, 11 aa, West Nile virus
AREAVEDLKFW

SEQ ID NO: 152560 - protein, 11 aa, West Nile virus
REAVEDLKFWE

SEQ ID NO: 152561 - protein, 11 aa, West Nile virus
EAVEDLKFWEM

SEQ ID NO: 152562 - protein, 11 aa, West Nile virus
AVEDLKFWEMV

SEQ ID NO: 152563 - protein, 11 aa, West Nile virus
VEDPKFWEIVD

SEQ ID NO: 152564 - protein, 11 aa, West Nile virus
EDPKFWEIVDE

SEQ ID NO: 152565 - protein, 11 aa, West Nile virus
DPKFWEIVDEE

SEQ ID NO: 152566 - protein, 11 aa, West Nile virus
PKFWEIVDEER

SEQ ID NO: 152567 - protein, 11 aa, West Nile virus
KFWEIVDEERE

SEQ ID NO: 152568 - protein, 11 aa, West Nile virus
FWEIVDEEREA

SEQ ID NO: 152569 - protein, 11 aa, West Nile virus
WEIVDEEREAH

SEQ ID NO: 152570 - protein, 11 aa, West Nile virus
EIVDEEREAHL

SEQ ID NO: 152571 - protein, 11 aa, West Nile virus
IVDEEREAHLR

SEQ ID NO: 152572 - protein, 11 aa, West Nile virus
EREAHLRGECY

SEQ ID NO: 152573 - protein, 11 aa, West Nile virus
REAHLRGECYT

SEQ ID NO: 152574 - protein, 11 aa, West Nile virus
EAHLRGECYTC

SEQ ID NO: 152575 - protein, 11 aa, West Nile virus
AHLRGECYTCI

SEQ ID NO: 152576 - protein, 11 aa, West Nile virus
HLRGECYTCIY

SEQ ID NO: 152577 - protein, 11 aa, West Nile virus
LRGECYTCIYN

SEQ ID NO: 152578 - protein, 11 aa, West Nile virus
RGECYTCIYNM

SEQ ID NO: 152579 - protein, 11 aa, West Nile virus
GECYTCIYNMM

SEQ ID NO: 152580 - protein, 11 aa, West Nile virus
ECYTCIYNMMG

SEQ ID NO: 152581 - protein, 11 aa, West Nile virus
CYTCIYNMMGK

SEQ ID NO: 152582 - protein, 11 aa, West Nile virus
YTCIYNMMGKR

SEQ ID NO: 152583 - protein, 11 aa, West Nile virus
LGLQKLGYVLR

SEQ ID NO: 152584 - protein, 11 aa, West Nile virus
GLQKLGYVLRE

SEQ ID NO: 152585 - protein, 11 aa, West Nile virus
LQKLGYVLREV

SEQ ID NO: 152586 - protein, 11 aa, West Nile virus
QKLGYVLREVG

SEQ ID NO: 152587 - protein, 11 aa, West Nile virus
GGRIYADDTAG

SEQ ID NO: 152588 - protein, 11 aa, West Nile virus
GRIYADDTAGW

SEQ ID NO: 152589 - protein, 11 aa, West Nile virus
KVYADDTAGWD

SEQ ID NO: 152590 - protein, 11 aa, West Nile virus
VYADDTAGWDT

SEQ ID NO: 152591 - protein, 11 aa, West Nile virus
DTAGWDTRITM

SEQ ID NO: 152592 - protein, 11 aa, West Nile virus
TAGWDTPITKA

SEQ ID NO: 152593 - protein, 11 aa, West Nile virus
AGWDTRITMTD

SEQ ID NO: 152594 - protein, 11 aa, West Nile virus
GWDTPITKADL

SEQ ID NO: 152595 - protein, 11 aa, West Nile virus
WDTRITMTDLE

SEQ ID NO: 152596 - protein, 11 aa, West Nile virus
DTRITMTDLEN

SEQ ID NO: 152597 - protein, 11 aa, West Nile virus
TRITMTDLENE

SEQ ID NO: 152598 - protein, 11 aa, West Nile virus
PITKADLENEA

SEQ ID NO: 152599 - protein, 11 aa, West Nile virus
NEAKVLELLEG

SEQ ID NO: 152600 - protein, 11 aa, West Nile virus
EAKVLELLEGE

SEQ ID NO: 152601 - protein, 11 aa, West Nile virus
AKVLELLDREH

SEQ ID NO: 152602 - protein, 11 aa, West Nile virus
KVLELLEGEHR

SEQ ID NO: 152603 - protein, 11 aa, West Nile virus
VLELLEGEHRR

SEQ ID NO: 152604 - protein, 11 aa, West Nile virus
LELLDREHRRL

SEQ ID NO: 152605 - protein, 11 aa, West Nile virus
ELLEGEHRRLA

SEQ ID NO: 152606 - protein, 11 aa, West Nile virus
LLDREHRRLAR

SEQ ID NO: 152607 - protein, 11 aa, West Nile virus
LDREHRRLARA

SEQ ID NO: 152608 - protein, 11 aa, West Nile virus
DGEHRRLARSV

SEQ ID NO: 152609 - protein, 11 aa, West Nile virus
GEHRRLARSVI

SEQ ID NO: 152610 - protein, 11 aa, West Nile virus
EHRRLARSVIE

SEQ ID NO: 152611 - protein, 11 aa, West Nile virus
HRRLARSVIEL

SEQ ID NO: 152612 - protein, 11 aa, West Nile virus
RRLARSVIELT

SEQ ID NO: 152613 - protein, 11 aa, West Nile virus
RLARSVIELTY

SEQ ID NO: 152614 - protein, 11 aa, West Nile virus
LARSVIELTYR

SEQ ID NO: 152615 - protein, 11 aa, West Nile virus
ARSVIELTYRH

SEQ ID NO: 152616 - protein, 11 aa, West Nile virus
RSVIELTYRHK

SEQ ID NO: 152617 - protein, 11 aa, West Nile virus
SVIELTYRHKV

SEQ ID NO: 152618 - protein, 11 aa, West Nile virus
IIELTYCHKVV

SEQ ID NO: 152619 - protein, 11 aa, West Nile virus
IQLTYRHKVVK

SEQ ID NO: 152620 - protein, 11 aa, West Nile virus
QLTYRHKVVKV

SEQ ID NO: 152621 - protein, 11 aa, West Nile virus
LTYRYKVVKVM

SEQ ID NO: 152622 - protein, 11 aa, West Nile virus
TYRYKVVKVMR

SEQ ID NO: 152623 - protein, 11 aa, West Nile virus
YRHKVVKGMRP

SEQ ID NO: 152624 - protein, 11 aa, West Nile virus
RHKVVKGMRPA

SEQ ID NO: 152625 - protein, 11 aa, West Nile virus
YKVVKVMRPAA

SEQ ID NO: 152626 - protein, 11 aa, West Nile virus
VKVMRPAVGGK

SEQ ID NO: 152627 - protein, 11 aa, West Nile virus
KVMRPAVGGKT

SEQ ID NO: 152628 - protein, 11 aa, West Nile virus
VMRPAVGGKTV

SEQ ID NO: 152629 - protein, 11 aa, West Nile virus
MRPAVGGKTVM

SEQ ID NO: 152630 - protein, 11 aa, West Nile virus
RPAVGGKTVMD

SEQ ID NO: 152631 - protein, 11 aa, West Nile virus
PAVGGKTVMDI

SEQ ID NO: 152632 - protein, 11 aa, West Nile virus
AVGGKTVMDII

SEQ ID NO: 152633 - protein, 11 aa, West Nile virus
VGGKTVMDIIS

SEQ ID NO: 152634 - protein, 11 aa, West Nile virus
GGKTVMDIISR

SEQ ID NO: 152635 - protein, 11 aa, West Nile virus
GKTVMDIISRE

SEQ ID NO: 152636 - protein, 11 aa, West Nile virus
KTVMDIISRED

SEQ ID NO: 152637 - protein, 11 aa, West Nile virus
DVISREDQRGR

SEQ ID NO: 152638 - protein, 11 aa, West Nile virus
VISREDQRGRG

SEQ ID NO: 152639 - protein, 11 aa, West Nile virus
TYALNPFTNLA

SEQ ID NO: 152640 - protein, 11 aa, West Nile virus
YALNPFSNLAV

SEQ ID NO: 152641 - protein, 11 aa, West Nile virus
ALNPFTNLAFQ

SEQ ID NO: 152642 - protein, 11 aa, West Nile virus
LNPFSNLAVQL

SEQ ID NO: 152643 - protein, 11 aa, West Nile virus
NPFTNLAFQLG

SEQ ID NO: 152644 - protein, 11 aa, West Nile virus
PFSNLAVQLVR

SEQ ID NO: 152645 - protein, 11 aa, West Nile virus
FTNLAFQLGRR

SEQ ID NO: 152646 - protein, 11 aa, West Nile virus
TNLAFQLGRRR

SEQ ID NO: 152647 - protein, 11 aa, West Nile virus
NLAVQLVRRRE

SEQ ID NO: 152648 - protein, 11 aa, West Nile virus
LAVQLVRRREG

SEQ ID NO: 152649 - protein, 11 aa, West Nile virus
AFQLGRRREGE

SEQ ID NO: 152650 - protein, 11 aa, West Nile virus
LVRRREGEGVI

SEQ ID NO: 152651 - protein, 11 aa, West Nile virus
VRMMEGEGVIT

SEQ ID NO: 152652 - protein, 11 aa, West Nile virus
RRREGEGVIGP

SEQ ID NO: 152653 - protein, 11 aa, West Nile virus
RREGEGVIGPD

SEQ ID NO: 152654 - protein, 11 aa, West Nile virus
MEGEGVIGPED

SEQ ID NO: 152655 - protein, 11 aa, West Nile virus
EGEGVIGPYDV

SEQ ID NO: 152656 - protein, 11 aa, West Nile virus
GEGVIGPYDVE

SEQ ID NO: 152657 - protein, 11 aa, West Nile virus
KRKGPKVRTWL

SEQ ID NO: 152658 - protein, 11 aa, West Nile virus
GKGPKVRTWLS

SEQ ID NO: 152659 - protein, 11 aa, West Nile virus
KGPKVRTWLSE

SEQ ID NO: 152660 - protein, 11 aa, West Nile virus
GPKVRTWLSEN

SEQ ID NO: 152661 - protein, 11 aa, West Nile virus
PKVRTWLSENG

SEQ ID NO: 152662 - protein, 11 aa, West Nile virus
KVRTWLSENGE

SEQ ID NO: 152663 - protein, 11 aa, West Nile virus
VRTWLSENGEE

SEQ ID NO: 152664 - protein, 11 aa, West Nile virus
RTWLSENGEER

SEQ ID NO: 152665 - protein, 11 aa, West Nile virus
TWLSENGEERL

SEQ ID NO: 152666 - protein, 11 aa, West Nile virus
WLFENGEERLG

SEQ ID NO: 152667 - protein, 11 aa, West Nile virus
LFENGEERLGR

SEQ ID NO: 152668 - protein, 11 aa, West Nile virus
FENGEERLSRT

SEQ ID NO: 152669 - protein, 11 aa, West Nile virus
ENGEERLSRTA

SEQ ID NO: 152670 - protein, 11 aa, West Nile virus
NGEERLSRTAV

SEQ ID NO: 152671 - protein, 11 aa, West Nile virus
GEERLSRTAVS

SEQ ID NO: 152672 - protein, 11 aa, West Nile virus
KERLGRMAVSG

SEQ ID NO: 152673 - protein, 11 aa, West Nile virus
VKPLDDRFASS

SEQ ID NO: 152674 - protein, 11 aa, West Nile virus
KPLDDRFASSL

SEQ ID NO: 152675 - protein, 11 aa, West Nile virus
PLDDRFAISLH

SEQ ID NO: 152676 - protein, 11 aa, West Nile virus
LDDRFAISLHF

SEQ ID NO: 152677 - protein, 11 aa, West Nile virus
DDRFAISLHFL

SEQ ID NO: 152678 - protein, 11 aa, West Nile virus
DRFAISLHFLN

SEQ ID NO: 152679 - protein, 11 aa, West Nile virus
RFATSLHFLND

SEQ ID NO: 152680 - protein, 11 aa, West Nile virus
FATSLHFLNDM

SEQ ID NO: 152681 - protein, 11 aa, West Nile virus
AISLHFLNAMS

SEQ ID NO: 152682 - protein, 11 aa, West Nile virus
SLHFLNAMSQV

SEQ ID NO: 152683 - protein, 11 aa, West Nile virus
LHFLNAMPKVR

SEQ ID NO: 152684 - protein, 11 aa, West Nile virus
HFLNAMSQVRK

SEQ ID NO: 152685 - protein, 11 aa, West Nile virus
FLNDMSKVRKD

SEQ ID NO: 152686 - protein, 11 aa, West Nile virus
LNAMSQVRKDI

SEQ ID NO: 152687 - protein, 11 aa, West Nile virus
NAMPKVRKDIQ

SEQ ID NO: 152688 - protein, 11 aa, West Nile virus
AMPKVRKDIQE

SEQ ID NO: 152689 - protein, 11 aa, West Nile virus
STGWYDWQKVQ

SEQ ID NO: 152690 - protein, 11 aa, West Nile virus
TGWYDWQKVQF

SEQ ID NO: 152691 - protein, 11 aa, West Nile virus
LVMKDGRTLVV

SEQ ID NO: 152692 - protein, 11 aa, West Nile virus
VMKDGRTLVVP

SEQ ID NO: 152693 - protein, 11 aa, West Nile virus
VTPCRGQDELV

SEQ ID NO: 152694 - protein, 11 aa, West Nile virus
TPCRGQDELVG

SEQ ID NO: 152695 - protein, 11 aa, West Nile virus
ANAICSAVPAN

SEQ ID NO: 152696 - protein, 11 aa, West Nile virus
NAICSAVPANW

SEQ ID NO: 152697 - protein, 11 aa, West Nile virus
AICSAVPANWV

SEQ ID NO: 152698 - protein, 11 aa, West Nile virus
ICSAVPANWVP

SEQ ID NO: 152699 - protein, 11 aa, West Nile virus
CSAVPANWVPT

SEQ ID NO: 152700 - protein, 11 aa, West Nile virus
SAVPANWVPTG

SEQ ID NO: 152701 - protein, 11 aa, West Nile virus
AVPANWVPTGR

SEQ ID NO: 152702 - protein, 11 aa, West Nile virus
VPANWVPTGRT

SEQ ID NO: 152703 - protein, 11 aa, West Nile virus
PANWVPTGRTT

SEQ ID NO: 152704 - protein, 11 aa, West Nile virus
ANWVPTGRTTW

SEQ ID NO: 152705 - protein, 11 aa, West Nile virus
DWVPTGRTTWS

SEQ ID NO: 152706 - protein, 11 aa, West Nile virus
TGRTTWSIHAR

SEQ ID NO: 152707 - protein, 11 aa, West Nile virus
GRTTWSIHARG

SEQ ID NO: 152708 - protein, 11 aa, West Nile virus
RTTWSIHARGE

SEQ ID NO: 152709 - protein, 11 aa, West Nile virus
TTWSIHARGEW

SEQ ID NO: 152710 - protein, 11 aa, West Nile virus
TWSIHARGEWM

SEQ ID NO: 152711 - protein, 11 aa, West Nile virus
WSIHARGEWMT

SEQ ID NO: 152712 - protein, 11 aa, West Nile virus
SIHARGEWMTT

SEQ ID NO: 152713 - protein, 11 aa, West Nile virus
RGEWMTTADML

SEQ ID NO: 152714 - protein, 11 aa, West Nile virus
GEWMTTADMLG

SEQ ID NO: 152715 - protein, 11 aa, West Nile virus
EWMTTADMLGV

SEQ ID NO: 152716 - protein, 11 aa, West Nile virus
WMTTADMLGVW

SEQ ID NO: 152717 - protein, 11 aa, West Nile virus
MTTADMLGVWN

SEQ ID NO: 152718 - protein, 11 aa, West Nile virus
TTADMLGVWNR

SEQ ID NO: 152719 - protein, 11 aa, West Nile virus
TADMLGVWNRV

SEQ ID NO: 152720 - protein, 11 aa, West Nile virus
ADMLGVWNRVW

SEQ ID NO: 152721 - protein, 11 aa, West Nile virus
DMLGVWNRVWI

SEQ ID NO: 152722 - protein, 11 aa, West Nile virus
MLGVWNRVWIE

SEQ ID NO: 152723 - protein, 11 aa, West Nile virus
LGVWNRVWIEE

SEQ ID NO: 152724 - protein, 11 aa, West Nile virus
GVWNRVWIEEN

SEQ ID NO: 152725 - protein, 11 aa, West Nile virus
DKTPVERWSDI

SEQ ID NO: 152726 - protein, 11 aa, West Nile virus
KTPVERWSDIP

SEQ ID NO: 152727 - protein, 11 aa, West Nile virus
TPVERWSDIPY

SEQ ID NO: 152728 - protein, 11 aa, West Nile virus
PVERWSDIPYS

SEQ ID NO: 152729 - protein, 11 aa, West Nile virus
VERWSDIPYSG

SEQ ID NO: 152730 - protein, 11 aa, West Nile virus
ERWSDIPYSGK

SEQ ID NO: 152731 - protein, 11 aa, West Nile virus
RWSDIPYSGKR

SEQ ID NO: 152732 - protein, 11 aa, West Nile virus
IWCGSLIGTRS

SEQ ID NO: 152733 - protein, 11 aa, West Nile virus
WCGSLIGTRSR

SEQ ID NO: 152734 - protein, 11 aa, West Nile virus
CGSLIGTRSRA

SEQ ID NO: 152735 - protein, 11 aa, West Nile virus
GSLIGTRSRAT

SEQ ID NO: 152736 - protein, 11 aa, West Nile virus
SLIGTRSRATW

SEQ ID NO: 152737 - protein, 11 aa, West Nile virus
LIGTRSRATWA

SEQ ID NO: 152738 - protein, 11 aa, West Nile virus
IGTRSRATWAE

SEQ ID NO: 152739 - protein, 11 aa, West Nile virus
GTRSRATWAEN

SEQ ID NO: 152740 - protein, 11 aa, West Nile virus
TRSRATWAENI

SEQ ID NO: 152741 - protein, 11 aa, West Nile virus
RTRATWAENIQ

SEQ ID NO: 152742 - protein, 11 aa, West Nile virus
TRATWAENIQV

SEQ ID NO: 152743 - protein, 11 aa, West Nile virus
TWAENIQVAIG

SEQ ID NO: 152744 - protein, 11 aa, West Nile virus
ENIQVAIGQVR

SEQ ID NO: 152745 - protein, 11 aa, West Nile virus
NIQVAINQVRS

SEQ ID NO: 152746 - protein, 11 aa, West Nile virus
IIGEEKYVDYM

SEQ ID NO: 152747 - protein, 11 aa, West Nile virus
IGEEKYVDYMG

SEQ ID NO: 152748 - protein, 11 aa, West Nile virus
GEEKYVDYMGS

SEQ ID NO: 152749 - protein, 11 aa, West Nile virus
EEKYVDYMGSL

SEQ ID NO: 152750 - protein, 11 aa, West Nile virus
EKYVDYMGSLK

SEQ ID NO: 152751 - protein, 11 aa, West Nile virus
KYVDYMGSLKR

SEQ ID NO: 152752 - protein, 11 aa, West Nile virus
YVDYMGSLKRY

SEQ ID NO: 152753 - protein, 11 aa, West Nile virus
VDYMGSLKRYE

SEQ ID NO: 152754 - protein, 11 aa, West Nile virus
DYMGSLKRYEE

SEQ ID NO: 152755 - protein, 11 aa, West Nile virus
RAVNMLKRGKP

SEQ ID NO: 152756 - protein, 11 aa, West Nile virus
AVNMQKRGKPR

SEQ ID NO: 152757 - protein, 11 aa, West Nile virus
PRGGSLMGLKR

SEQ ID NO: 152758 - protein, 11 aa, West Nile virus
RGGSLMGLKRA

SEQ ID NO: 152759 - protein, 11 aa, West Nile virus
VLSLIGLKRAV

SEQ ID NO: 152760 - protein, 11 aa, West Nile virus
MSLIGLKRAML

SEQ ID NO: 152761 - protein, 11 aa, West Nile virus
LSLIDGKGPTR

SEQ ID NO: 152762 - protein, 11 aa, West Nile virus
SLIDGKGPVRF

SEQ ID NO: 152763 - protein, 11 aa, West Nile virus
LIDGKGPTRFV

SEQ ID NO: 152764 - protein, 11 aa, West Nile virus
IDGKGPVRFVL

SEQ ID NO: 152765 - protein, 11 aa, West Nile virus
DGKGPVRFVLA

SEQ ID NO: 152766 - protein, 11 aa, West Nile virus
GKGPVRFVLAL

SEQ ID NO: 152767 - protein, 11 aa, West Nile virus
KGPTRFVLALL

SEQ ID NO: 152768 - protein, 11 aa, West Nile virus
GPVRFVLALLA

SEQ ID NO: 152769 - protein, 11 aa, West Nile virus
PVRFVLALLAF

SEQ ID NO: 152770 - protein, 11 aa, West Nile virus
IRFVLALLVFF

SEQ ID NO: 152771 - protein, 11 aa, West Nile virus
ALLAFFRFTAV

SEQ ID NO: 152772 - protein, 11 aa, West Nile virus
LLAFFRFTAVA

SEQ ID NO: 152773 - protein, 11 aa, West Nile virus
LVFFRFTAIAP

SEQ ID NO: 152774 - protein, 11 aa, West Nile virus
VFFRFTAIAPT

SEQ ID NO: 152775 - protein, 11 aa, West Nile virus
KFTAIAPTRAL

SEQ ID NO: 152776 - protein, 11 aa, West Nile virus
TAIAPTRAVLN

SEQ ID NO: 152777 - protein, 11 aa, West Nile virus
AIAPTRAVLER

SEQ ID NO: 152778 - protein, 11 aa, West Nile virus
VAPTRAVLDRW

SEQ ID NO: 152779 - protein, 11 aa, West Nile virus
PTRAVLERWRG

SEQ ID NO: 152780 - protein, 11 aa, West Nile virus
TRAVLERWRGV

SEQ ID NO: 152781 - protein, 11 aa, West Nile virus
RAVLNRWRGVN

SEQ ID NO: 152782 - protein, 11 aa, West Nile virus
AVLERWRGVNK

SEQ ID NO: 152783 - protein, 11 aa, West Nile virus
LLDRWRGVNKQ

SEQ ID NO: 152784 - protein, 11 aa, West Nile virus
LERWRGVNKQT

SEQ ID NO: 152785 - protein, 11 aa, West Nile virus
ERWRGVNKQTA

SEQ ID NO: 152786 - protein, 11 aa, West Nile virus
SFKRELGTLTS

SEQ ID NO: 152787 - protein, 11 aa, West Nile virus
FKKELGALTSA

SEQ ID NO: 152788 - protein, 11 aa, West Nile virus
KKELGALTSAI

SEQ ID NO: 152789 - protein, 11 aa, West Nile virus
KELGTLTNAMN

SEQ ID NO: 152790 - protein, 11 aa, West Nile virus
ELGTLTNAMNR

SEQ ID NO: 152791 - protein, 11 aa, West Nile virus
LGALTSAINRR

SEQ ID NO: 152792 - protein, 11 aa, West Nile virus
GALTSAINRRS

SEQ ID NO: 152793 - protein, 11 aa, West Nile virus
NRRSAKQKKRG

SEQ ID NO: 152794 - protein, 11 aa, West Nile virus
RRSAKQKKRGG

SEQ ID NO: 152795 - protein, 11 aa, West Nile virus
RAVTLSNFQGK

SEQ ID NO: 152796 - protein, 11 aa, West Nile virus
AVTLSDFQGKV

SEQ ID NO: 152797 - protein, 11 aa, West Nile virus
VTLSDFQGKVM

SEQ ID NO: 152798 - protein, 11 aa, West Nile virus
TLSDFQGKVMM

SEQ ID NO: 152799 - protein, 11 aa, West Nile virus
SNFQGKVMMTI

SEQ ID NO: 152800 - protein, 11 aa, West Nile virus
NFQGKVMMTIN

SEQ ID NO: 152801 - protein, 11 aa, West Nile virus
FQGKLMMTVNA

SEQ ID NO: 152802 - protein, 11 aa, West Nile virus
QGKVMMTINAT

SEQ ID NO: 152803 - protein, 11 aa, West Nile virus
GKLMMTINATD

SEQ ID NO: 152804 - protein, 11 aa, West Nile virus
IITIPTASGKN

SEQ ID NO: 152805 - protein, 11 aa, West Nile virus
IPTASGKNLCT

SEQ ID NO: 152806 - protein, 11 aa, West Nile virus
PPAAGKNLCIV

SEQ ID NO: 152807 - protein, 11 aa, West Nile virus
IASGKNLCTVR

SEQ ID NO: 152808 - protein, 11 aa, West Nile virus
AAGKNLCTVRA

SEQ ID NO: 152809 - protein, 11 aa, West Nile virus
SGKNLCTVRAI

SEQ ID NO: 152810 - protein, 11 aa, West Nile virus
LCTVRAMDVGY

SEQ ID NO: 152811 - protein, 11 aa, West Nile virus
VRAMDVGHMCD

SEQ ID NO: 152812 - protein, 11 aa, West Nile virus
RAMDVGHMCDD

SEQ ID NO: 152813 - protein, 11 aa, West Nile virus
AMDVGHMCDDT

SEQ ID NO: 152814 - protein, 11 aa, West Nile virus
MDVGHMCDDTI

SEQ ID NO: 152815 - protein, 11 aa, West Nile virus
DVGHMCDDTIT

SEQ ID NO: 152816 - protein, 11 aa, West Nile virus
VGHMCDDTITY

SEQ ID NO: 152817 - protein, 11 aa, West Nile virus
GHMCDDTITYE

SEQ ID NO: 152818 - protein, 11 aa, West Nile virus
HMCDDTITYEC

SEQ ID NO: 152819 - protein, 11 aa, West Nile virus
LCDDTITYECP

SEQ ID NO: 152820 - protein, 11 aa, West Nile virus
CDDTITYECSV

SEQ ID NO: 152821 - protein, 11 aa, West Nile virus
DDTITYECSVL

SEQ ID NO: 152822 - protein, 11 aa, West Nile virus
DTITYECSVLS

SEQ ID NO: 152823 - protein, 11 aa, West Nile virus
TITYECSVLSA

SEQ ID NO: 152824 - protein, 11 aa, West Nile virus
ITYECPALAAG

SEQ ID NO: 152825 - protein, 11 aa, West Nile virus
TYECPALAAGN

SEQ ID NO: 152826 - protein, 11 aa, West Nile virus
YECPALAAGND

SEQ ID NO: 152827 - protein, 11 aa, West Nile virus
ECSVLSAGNDP

SEQ ID NO: 152828 - protein, 11 aa, West Nile virus
CSVLSAGNDPE

SEQ ID NO: 152829 - protein, 11 aa, West Nile virus
SVLSAGNDPED

SEQ ID NO: 152830 - protein, 11 aa, West Nile virus
ALAAGNDPEDI

SEQ ID NO: 152831 - protein, 11 aa, West Nile virus
EDVDCWCTKSA

SEQ ID NO: 152832 - protein, 11 aa, West Nile virus
AVYVRYGRCTR

SEQ ID NO: 152833 - protein, 11 aa, West Nile virus
CTKTRQSRRSR

SEQ ID NO: 152834 - protein, 11 aa, West Nile virus
TKTRHSRRSKR

SEQ ID NO: 152835 - protein, 11 aa, West Nile virus
KTRQSRRSRRS

SEQ ID NO: 152836 - protein, 11 aa, West Nile virus
RRSLTVQTHGK

SEQ ID NO: 152837 - protein, 11 aa, West Nile virus
TVQTHGESTLV

SEQ ID NO: 152838 - protein, 11 aa, West Nile virus
VQTHGKSTLAN

SEQ ID NO: 152839 - protein, 11 aa, West Nile virus
QTHGESTLVNK

SEQ ID NO: 152840 - protein, 11 aa, West Nile virus
THGESTLVNKK

SEQ ID NO: 152841 - protein, 11 aa, West Nile virus
HGESTLVNKKG

SEQ ID NO: 152842 - protein, 11 aa, West Nile virus
GESTLVNKKGA

SEQ ID NO: 152843 - protein, 11 aa, West Nile virus
KSTLANKKGAW

SEQ ID NO: 152844 - protein, 11 aa, West Nile virus
STLSNKKGAWM

SEQ ID NO: 152845 - protein, 11 aa, West Nile virus
TLSNKKGAWMD

SEQ ID NO: 152846 - protein, 11 aa, West Nile virus
LSNKKGAWMDS

SEQ ID NO: 152847 - protein, 11 aa, West Nile virus
SNKKGAWMDST

SEQ ID NO: 152848 - protein, 11 aa, West Nile virus
GSNTMQRVVFI

SEQ ID NO: 152849 - protein, 11 aa, West Nile virus
TQRVVFMILLL

SEQ ID NO: 152850 - protein, 11 aa, West Nile virus
QRVVFMILLLL

SEQ ID NO: 152851 - protein, 11 aa, West Nile virus
RVVFMILLLLV

SEQ ID NO: 152852 - protein, 11 aa, West Nile virus
VVFMILLLLVA

SEQ ID NO: 152853 - protein, 11 aa, West Nile virus
VFAVLLLLVAP

SEQ ID NO: 152854 - protein, 11 aa, West Nile virus
FMILLLLVAPA

SEQ ID NO: 152855 - protein, 11 aa, West Nile virus
MILLLLVAPAY

SEQ ID NO: 152856 - protein, 11 aa, West Nile virus
GDSCVTITAKD

SEQ ID NO: 152857 - protein, 11 aa, West Nile virus
DSCVTITAKDR

SEQ ID NO: 152858 - protein, 11 aa, West Nile virus
SCVTIMSKNKP

SEQ ID NO: 152859 - protein, 11 aa, West Nile virus
CVTIMSKNKPT

SEQ ID NO: 152860 - protein, 11 aa, West Nile virus
VTIMSKNKPTI

SEQ ID NO: 152861 - protein, 11 aa, West Nile virus
TIMSKNKPTID

SEQ ID NO: 152862 - protein, 11 aa, West Nile virus
IMSKNKPTIDV

SEQ ID NO: 152863 - protein, 11 aa, West Nile virus
NKPTIDVKMMN

SEQ ID NO: 152864 - protein, 11 aa, West Nile virus
KPTIDVKMTNM

SEQ ID NO: 152865 - protein, 11 aa, West Nile virus
PTIDVKMMKME

SEQ ID NO: 152866 - protein, 11 aa, West Nile virus
TIDVKMMNVEA

SEQ ID NO: 152867 - protein, 11 aa, West Nile virus
VSELSTKAACP

SEQ ID NO: 152868 - protein, 11 aa, West Nile virus
LSPRAACPTMG

SEQ ID NO: 152869 - protein, 11 aa, West Nile virus
STKAACPTMGD

SEQ ID NO: 152870 - protein, 11 aa, West Nile virus
PRAACPTMGEA

SEQ ID NO: 152871 - protein, 11 aa, West Nile virus
KAACPAMGEAH

SEQ ID NO: 152872 - protein, 11 aa, West Nile virus
TMGDAHNDKRA

SEQ ID NO: 152873 - protein, 11 aa, West Nile virus
GEAHNDKRADS

SEQ ID NO: 152874 - protein, 11 aa, West Nile virus
YFCKQGVVDRG

SEQ ID NO: 152875 - protein, 11 aa, West Nile virus
IDTCAKFACTS

SEQ ID NO: 152876 - protein, 11 aa, West Nile virus
DTCAKFACTSK

SEQ ID NO: 152877 - protein, 11 aa, West Nile virus
TCAKFACTSKA

SEQ ID NO: 152878 - protein, 11 aa, West Nile virus
CAKFTCSNKAT

SEQ ID NO: 152879 - protein, 11 aa, West Nile virus
AKFTCSNKATG

SEQ ID NO: 152880 - protein, 11 aa, West Nile virus
KFTCSNKATGL

SEQ ID NO: 152881 - protein, 11 aa, West Nile virus
FTCSNKATGLT

SEQ ID NO: 152882 - protein, 11 aa, West Nile virus
TCSNKATGLTI

SEQ ID NO: 152883 - protein, 11 aa, West Nile virus
CSNKATGLTIQ

SEQ ID NO: 152884 - protein, 11 aa, West Nile virus
SNKATGLTIQR

SEQ ID NO: 152885 - protein, 11 aa, West Nile virus
NKATGLTIQRE

SEQ ID NO: 152886 - protein, 11 aa, West Nile virus
KATGLTIQREN

SEQ ID NO: 152887 - protein, 11 aa, West Nile virus
ATGLTIQRENV

SEQ ID NO: 152888 - protein, 11 aa, West Nile virus
TGLTIQRENVK

SEQ ID NO: 152889 - protein, 11 aa, West Nile virus
LKEBIKYEVAI

SEQ ID NO: 152890 - protein, 11 aa, West Nile virus
GATQAGRLSIT

SEQ ID NO: 152891 - protein, 11 aa, West Nile virus
AAQAGRFSITP

SEQ ID NO: 152892 - protein, 11 aa, West Nile virus
QAGRLSITPAA

SEQ ID NO: 152893 - protein, 11 aa, West Nile virus
AGRLSITPAAP

SEQ ID NO: 152894 - protein, 11 aa, West Nile virus
GRLSITPAAPS

SEQ ID NO: 152895 - protein, 11 aa, West Nile virus
NLGDYGEVTFD

SEQ ID NO: 152896 - protein, 11 aa, West Nile virus
LGDYGEVTIDC

SEQ ID NO: 152897 - protein, 11 aa, West Nile virus
GGYGEVTVDCE

SEQ ID NO: 152898 - protein, 11 aa, West Nile virus
EYGEVTMDCEP

SEQ ID NO: 152899 - protein, 11 aa, West Nile virus
GIDTSAYYVMT

SEQ ID NO: 152900 - protein, 11 aa, West Nile virus
IDTSAYYVMTV

SEQ ID NO: 152901 - protein, 11 aa, West Nile virus
DTSAYYVMTVG

SEQ ID NO: 152902 - protein, 11 aa, West Nile virus
MDLNMPWSSAA

SEQ ID NO: 152903 - protein, 11 aa, West Nile virus
DLNLPWSSAGG

SEQ ID NO: 152904 - protein, 11 aa, West Nile virus
LNLPWSSAGGN

SEQ ID NO: 152905 - protein, 11 aa, West Nile virus
WRNRGTLMEFE

SEQ ID NO: 152906 - protein, 11 aa, West Nile virus
RNRGTLMEFEE

SEQ ID NO: 152907 - protein, 11 aa, West Nile virus
NRGTLMEFEEP

SEQ ID NO: 152908 - protein, 11 aa, West Nile virus
RGTLMEFEEPH

SEQ ID NO: 152909 - protein, 11 aa, West Nile virus
GTLMEFEEPHA

SEQ ID NO: 152910 - protein, 11 aa, West Nile virus
QQALAGAIPVE

SEQ ID NO: 152911 - protein, 11 aa, West Nile virus
QALAGAIPLEF

SEQ ID NO: 152912 - protein, 11 aa, West Nile virus
ALAGAIPVSFT

SEQ ID NO: 152913 - protein, 11 aa, West Nile virus
LAGTIPVEFSS

SEQ ID NO: 152914 - protein, 11 aa, West Nile virus
AGAIPLEFSSN

SEQ ID NO: 152915 - protein, 11 aa, West Nile virus
GTIPVEFSSNT

SEQ ID NO: 152916 - protein, 11 aa, West Nile virus
TIPVEFSSNTV

SEQ ID NO: 152917 - protein, 11 aa, West Nile virus
IPLEFSSNTVK

SEQ ID NO: 152918 - protein, 11 aa, West Nile virus
PVSFTSNTVKL

SEQ ID NO: 152919 - protein, 11 aa, West Nile virus
VSFTSNTVKLT

SEQ ID NO: 152920 - protein, 11 aa, West Nile virus
GKDGPCKVPIS

SEQ ID NO: 152921 - protein, 11 aa, West Nile virus
KDGPCKVPISS

SEQ ID NO: 152922 - protein, 11 aa, West Nile virus
LVTVNPFVAAA

SEQ ID NO: 152923 - protein, 11 aa, West Nile virus
VTVNPFVSMAT

SEQ ID NO: 152924 - protein, 11 aa, West Nile virus
TVNPFVSMATA

SEQ ID NO: 152925 - protein, 11 aa, West Nile virus
AANAKVLIELE

SEQ ID NO: 152926 - protein, 11 aa, West Nile virus
ANAKVLVELEP

SEQ ID NO: 152927 - protein, 11 aa, West Nile virus
NAKVLVELEPP

SEQ ID NO: 152928 - protein, 11 aa, West Nile virus
RGEQQINHHWY

SEQ ID NO: 152929 - protein, 11 aa, West Nile virus
GEQQINHHWYK

SEQ ID NO: 152930 - protein, 11 aa, West Nile virus
EQQISHHWHKS

SEQ ID NO: 152931 - protein, 11 aa, West Nile virus
QQISHHWHKSG

SEQ ID NO: 152932 - protein, 11 aa, West Nile virus
QISHHWHKSGS

SEQ ID NO: 152933 - protein, 11 aa, West Nile virus
INHHWYKSGSS

SEQ ID NO: 152934 - protein, 11 aa, West Nile virus
NHHWYKSGSSI

SEQ ID NO: 152935 - protein, 11 aa, West Nile virus
SIGKAFTATLK

SEQ ID NO: 152936 - protein, 11 aa, West Nile virus
IGKAFTATLKG

SEQ ID NO: 152937 - protein, 11 aa, West Nile virus
GKAFTATLKGA

SEQ ID NO: 152938 - protein, 11 aa, West Nile virus
KAFTATLKGAQ

SEQ ID NO: 152939 - protein, 11 aa, West Nile virus
AFTATLKGAQR

SEQ ID NO: 152940 - protein, 11 aa, West Nile virus
FTATLKGAQRL

SEQ ID NO: 152941 - protein, 11 aa, West Nile virus
TATLKGAQRLA

SEQ ID NO: 152942 - protein, 11 aa, West Nile virus
ATLKGAQRLAA

SEQ ID NO: 152943 - protein, 11 aa, West Nile virus
WDFGSVGGIFT

SEQ ID NO: 152944 - protein, 11 aa, West Nile virus
DFGSVGGIFTS

SEQ ID NO: 152945 - protein, 11 aa, West Nile virus
FGSVGGVLTSV

SEQ ID NO: 152946 - protein, 11 aa, West Nile virus
GSVGGVLTSVG

SEQ ID NO: 152947 - protein, 11 aa, West Nile virus
SVGGVLTSVGQ

SEQ ID NO: 152948 - protein, 11 aa, West Nile virus
VGGIFTSFGKA

SEQ ID NO: 152949 - protein, 11 aa, West Nile virus
GGVLTSVGQAI

SEQ ID NO: 152950 - protein, 11 aa, West Nile virus
GVLTSVGQAIH

SEQ ID NO: 152951 - protein, 11 aa, West Nile virus
IFTSFGKAVHQ

SEQ ID NO: 152952 - protein, 11 aa, West Nile virus
LTSVGQAIHQV

SEQ ID NO: 152953 - protein, 11 aa, West Nile virus
TSVGQAIHQVF

SEQ ID NO: 152954 - protein, 11 aa, West Nile virus
SFGKAVHQVFG

SEQ ID NO: 152955 - protein, 11 aa, West Nile virus
VGQAIHQVFGG

SEQ ID NO: 152956 - protein, 11 aa, West Nile virus
VHQVFGGAFRL

SEQ ID NO: 152957 - protein, 11 aa, West Nile virus
GALLLWMGVNA

SEQ ID NO: 152958 - protein, 11 aa, West Nile virus
ALLVWMGINAR

SEQ ID NO: 152959 - protein, 11 aa, West Nile virus
LLLWMGVNARD

SEQ ID NO: 152960 - protein, 11 aa, West Nile virus
LLWMGVNARDR

SEQ ID NO: 152961 - protein, 11 aa, West Nile virus
LWMGISARDRS

SEQ ID NO: 152962 - protein, 11 aa, West Nile virus
WMGISARDRSI

SEQ ID NO: 152963 - protein, 11 aa, West Nile virus
MGINARDKSIA

SEQ ID NO: 152964 - protein, 11 aa, West Nile virus
SRDRSIAMTFL

SEQ ID NO: 152965 - protein, 11 aa, West Nile virus
DRSIALMFLAV

SEQ ID NO: 152966 - protein, 11 aa, West Nile virus
RSIALMFLAVG

SEQ ID NO: 152967 - protein, 11 aa, West Nile virus
IAMTFLAVGGI

SEQ ID NO: 152968 - protein, 11 aa, West Nile virus
ALTFLAVGGIL

SEQ ID NO: 152969 - protein, 11 aa, West Nile virus
LMFLAVGGVLL

SEQ ID NO: 152970 - protein, 11 aa, West Nile virus
AIGGVLLFLSI

SEQ ID NO: 152971 - protein, 11 aa, West Nile virus
IGGVLLFLSIN

SEQ ID NO: 152972 - protein, 11 aa, West Nile virus
GGILLFLSVNV

SEQ ID NO: 152973 - protein, 11 aa, West Nile virus
GVLLFLSINVH

SEQ ID NO: 152974 - protein, 11 aa, West Nile virus
ILLFLSVNVHA

SEQ ID NO: 152975 - protein, 11 aa, West Nile virus
HADTGCAINIT

SEQ ID NO: 152976 - protein, 11 aa, West Nile virus
ADTGCAINITR

SEQ ID NO: 152977 - protein, 11 aa, West Nile virus
DTGCAIDVSRQ

SEQ ID NO: 152978 - protein, 11 aa, West Nile virus
TGCAINITRQE

SEQ ID NO: 152979 - protein, 11 aa, West Nile virus
GCAIDVGRQEL

SEQ ID NO: 152980 - protein, 11 aa, West Nile virus
CAINITRQELR

SEQ ID NO: 152981 - protein, 11 aa, West Nile virus
AINITRQELRC

SEQ ID NO: 152982 - protein, 11 aa, West Nile virus
IDVGRQELRCG

SEQ ID NO: 152983 - protein, 11 aa, West Nile virus
SRQELRCGNGV

SEQ ID NO: 152984 - protein, 11 aa, West Nile virus
SGVFIHNDVEV

SEQ ID NO: 152985 - protein, 11 aa, West Nile virus
NDVEAWTDRYK

SEQ ID NO: 152986 - protein, 11 aa, West Nile virus
DRYKFHPETPQ

SEQ ID NO: 152987 - protein, 11 aa, West Nile virus
RYKYHPETPQG

SEQ ID NO: 152988 - protein, 11 aa, West Nile virus
YKFHPETPQGL

SEQ ID NO: 152989 - protein, 11 aa, West Nile virus
KFHPETPQGLA

SEQ ID NO: 152990 - protein, 11 aa, West Nile virus
YPETPQGLAKV

SEQ ID NO: 152991 - protein, 11 aa, West Nile virus
PETPQGLARVI

SEQ ID NO: 152992 - protein, 11 aa, West Nile virus
ETPQGLARIIQ

SEQ ID NO: 152993 - protein, 11 aa, West Nile virus
TPQGLAKVIQK

SEQ ID NO: 152994 - protein, 11 aa, West Nile virus
PQGLARVIQKA

SEQ ID NO: 152995 - protein, 11 aa, West Nile virus
QGLARIIQKAH

SEQ ID NO: 152996 - protein, 11 aa, West Nile virus
EGVCGLRSASR

SEQ ID NO: 152997 - protein, 11 aa, West Nile virus
GVCGLRSASRL

SEQ ID NO: 152998 - protein, 11 aa, West Nile virus
TCGIRSVSRLE

SEQ ID NO: 152999 - protein, 11 aa, West Nile virus
ASRLEHQMWES

SEQ ID NO: 153000 - protein, 11 aa, West Nile virus
SRLEHQMWESI

SEQ ID NO: 153001 - protein, 11 aa, West Nile virus
RLEHQMWESIK

SEQ ID NO: 153002 - protein, 11 aa, West Nile virus
LEHQMWESIKD

SEQ ID NO: 153003 - protein, 11 aa, West Nile virus
EHQMWESIKDE

SEQ ID NO: 153004 - protein, 11 aa, West Nile virus
HQMWESIKDEL

SEQ ID NO: 153005 - protein, 11 aa, West Nile virus
QMWESIKDELN

SEQ ID NO: 153006 - protein, 11 aa, West Nile virus
MWESIKDELNT

SEQ ID NO: 153007 - protein, 11 aa, West Nile virus
SIKDELNTLLK

SEQ ID NO: 153008 - protein, 11 aa, West Nile virus
NTLFRENGIDL

SEQ ID NO: 153009 - protein, 11 aa, West Nile virus
TLLKENGVDFS

SEQ ID NO: 153010 - protein, 11 aa, West Nile virus
LKENGVDFSVV

SEQ ID NO: 153011 - protein, 11 aa, West Nile virus
KENGVDLTVVV

SEQ ID NO: 153012 - protein, 11 aa, West Nile virus
ENGVDFSVVVE

SEQ ID NO: 153013 - protein, 11 aa, West Nile virus
NGIDLSMVVEK

SEQ ID NO: 153014 - protein, 11 aa, West Nile virus
GIDLSMVVEKQ

SEQ ID NO: 153015 - protein, 11 aa, West Nile virus
ATSEKLEIGWK

SEQ ID NO: 153016 - protein, 11 aa, West Nile virus
TTDKLEIGWKA

SEQ ID NO: 153017 - protein, 11 aa, West Nile virus
SEKLEIGWKAW

SEQ ID NO: 153018 - protein, 11 aa, West Nile virus
DKLEIGWKAWG

SEQ ID NO: 153019 - protein, 11 aa, West Nile virus
WGKSIIFAPEI

SEQ ID NO: 153020 - protein, 11 aa, West Nile virus
GKSIMFASELA

SEQ ID NO: 153021 - protein, 11 aa, West Nile virus
KSIIFAPEIAN

SEQ ID NO: 153022 - protein, 11 aa, West Nile virus
FAPELANSTFV

SEQ ID NO: 153023 - protein, 11 aa, West Nile virus
APEIANNTFVV

SEQ ID NO: 153024 - protein, 11 aa, West Nile virus
PEIANNTFVVD

SEQ ID NO: 153025 - protein, 11 aa, West Nile virus
EIANNTFVVDG

SEQ ID NO: 153026 - protein, 11 aa, West Nile virus
ANNTFVVDGSE

SEQ ID NO: 153027 - protein, 11 aa, West Nile virus
NNTFVVDGSET

SEQ ID NO: 153028 - protein, 11 aa, West Nile virus
TFVVDGSETRE

SEQ ID NO: 153029 - protein, 11 aa, West Nile virus
FVVDGSETREC

SEQ ID NO: 153030 - protein, 11 aa, West Nile virus
VVDGSETRECP

SEQ ID NO: 153031 - protein, 11 aa, West Nile virus
SRAWNSMEVED

SEQ ID NO: 153032 - protein, 11 aa, West Nile virus
FGLTSTRIFLK

SEQ ID NO: 153033 - protein, 11 aa, West Nile virus
ECDSKIIGTAI

SEQ ID NO: 153034 - protein, 11 aa, West Nile virus
CDAKIIGTAVK

SEQ ID NO: 153035 - protein, 11 aa, West Nile virus
DAKIIGTAVKN

SEQ ID NO: 153036 - protein, 11 aa, West Nile virus
SKIIGTAIKNN

SEQ ID NO: 153037 - protein, 11 aa, West Nile virus
SDLSYWIESGF

SEQ ID NO: 153038 - protein, 11 aa, West Nile virus
DLSYWIESGFN

SEQ ID NO: 153039 - protein, 11 aa, West Nile virus
FNETWKLERAV

SEQ ID NO: 153040 - protein, 11 aa, West Nile virus
PETHTLWGEGV

SEQ ID NO: 153041 - protein, 11 aa, West Nile virus
ETHTLWGEGVQ

SEQ ID NO: 153042 - protein, 11 aa, West Nile virus
THTLWGEGVQE

SEQ ID NO: 153043 - protein, 11 aa, West Nile virus
HTLWGEGVQES

SEQ ID NO: 153044 - protein, 11 aa, West Nile virus
ESDLIIPATLA

SEQ ID NO: 153045 - protein, 11 aa, West Nile virus
SDLIIPATLAG

SEQ ID NO: 153046 - protein, 11 aa, West Nile virus
ELIIPITLAGP

SEQ ID NO: 153047 - protein, 11 aa, West Nile virus
LIIPVTLAGPK

SEQ ID NO: 153048 - protein, 11 aa, West Nile virus
IIPATLAGPRS

SEQ ID NO: 153049 - protein, 11 aa, West Nile virus
IPVTLAGPKSN

SEQ ID NO: 153050 - protein, 11 aa, West Nile virus
PVTLAGPRSNY

SEQ ID NO: 153051 - protein, 11 aa, West Nile virus
ATLAGPRSNHN

SEQ ID NO: 153052 - protein, 11 aa, West Nile virus
HNRRPGYKMQN

SEQ ID NO: 153053 - protein, 11 aa, West Nile virus
CEHRGPAARTT

SEQ ID NO: 153054 - protein, 11 aa, West Nile virus
EHRGPAARTTT

SEQ ID NO: 153055 - protein, 11 aa, West Nile virus
HRGPSARTTTE

SEQ ID NO: 153056 - protein, 11 aa, West Nile virus
RGPSARTTTES

SEQ ID NO: 153057 - protein, 11 aa, West Nile virus
GPSARTTTESG

SEQ ID NO: 153058 - protein, 11 aa, West Nile virus
PSARTTTESGK

SEQ ID NO: 153059 - protein, 11 aa, West Nile virus
SARTTTESGKL

SEQ ID NO: 153060 - protein, 11 aa, West Nile virus
RSCTLPPLRYT

SEQ ID NO: 153061 - protein, 11 aa, West Nile virus
SCTLPPLRFKT

SEQ ID NO: 153062 - protein, 11 aa, West Nile virus
CTLPPLRFKTE

SEQ ID NO: 153063 - protein, 11 aa, West Nile virus
TDNGCWYGMEI

SEQ ID NO: 153064 - protein, 11 aa, West Nile virus
DNGCWYGMEIR

SEQ ID NO: 153065 - protein, 11 aa, West Nile virus
CWYGMEIRPQK

SEQ ID NO: 153066 - protein, 11 aa, West Nile virus
WYGMEIRPQKH

SEQ ID NO: 153067 - protein, 11 aa, West Nile virus
YGMEIRPLKHD

SEQ ID NO: 153068 - protein, 11 aa, West Nile virus
GMEIRPQRHDG

SEQ ID NO: 153069 - protein, 11 aa, West Nile virus
MEIRPLKHDEK

SEQ ID NO: 153070 - protein, 11 aa, West Nile virus
EIRPQKHDERT

SEQ ID NO: 153071 - protein, 11 aa, West Nile virus
IRPQKHDERTL

SEQ ID NO: 153072 - protein, 11 aa, West Nile virus
RPLKHDEKTLV

SEQ ID NO: 153073 - protein, 11 aa, West Nile virus
PQRHDGKTLVQ

SEQ ID NO: 153074 - protein, 11 aa, West Nile virus
QKHDERTLVQS

SEQ ID NO: 153075 - protein, 11 aa, West Nile virus
KHDERTLVQSQ

SEQ ID NO: 153076 - protein, 11 aa, West Nile virus
HDGKTLVQSQV

SEQ ID NO: 153077 - protein, 11 aa, West Nile virus
DGKTLVQSQVN

SEQ ID NO: 153078 - protein, 11 aa, West Nile virus
EKTLVQSRVSA

SEQ ID NO: 153079 - protein, 11 aa, West Nile virus
KTLVQSRVNAH

SEQ ID NO: 153080 - protein, 11 aa, West Nile virus
TLVQSRVSAYK

SEQ ID NO: 153081 - protein, 11 aa, West Nile virus
LVQSRVSAYKS

SEQ ID NO: 153082 - protein, 11 aa, West Nile virus
VQSRVNAHNAD

SEQ ID NO: 153083 - protein, 11 aa, West Nile virus
QSRVSAYKSDM

SEQ ID NO: 153084 - protein, 11 aa, West Nile virus
SQVNAYNAEMI

SEQ ID NO: 153085 - protein, 11 aa, West Nile virus
RVNAHNADMID

SEQ ID NO: 153086 - protein, 11 aa, West Nile virus
VNAYNAEMIDP

SEQ ID NO: 153087 - protein, 11 aa, West Nile virus
NAHNADMIDPF

SEQ ID NO: 153088 - protein, 11 aa, West Nile virus
FQLGLLVVFLV

SEQ ID NO: 153089 - protein, 11 aa, West Nile virus
QLGLLVVVLAT

SEQ ID NO: 153090 - protein, 11 aa, West Nile virus
LGLLIVFLATQ

SEQ ID NO: 153091 - protein, 11 aa, West Nile virus
GLLVVVLATQE

SEQ ID NO: 153092 - protein, 11 aa, West Nile virus
LLIVFLATQEV

SEQ ID NO: 153093 - protein, 11 aa, West Nile virus
LVVVLATQEVL

SEQ ID NO: 153094 - protein, 11 aa, West Nile virus
IVFLATQEVLR

SEQ ID NO: 153095 - protein, 11 aa, West Nile virus
VFLVTQEVLRK

SEQ ID NO: 153096 - protein, 11 aa, West Nile virus
FLATKEVLRKR

SEQ ID NO: 153097 - protein, 11 aa, West Nile virus
LRKRWTAKISL

SEQ ID NO: 153098 - protein, 11 aa, West Nile virus
RKRWTAKISLP

SEQ ID NO: 153099 - protein, 11 aa, West Nile virus
KRWTAKISLPA

SEQ ID NO: 153100 - protein, 11 aa, West Nile virus
RWTAKISLPAI

SEQ ID NO: 153101 - protein, 11 aa, West Nile virus
PAILLALLVLV

SEQ ID NO: 153102 - protein, 11 aa, West Nile virus
AILVALAVLVL

SEQ ID NO: 153103 - protein, 11 aa, West Nile virus
ILVALAVLVLG

SEQ ID NO: 153104 - protein, 11 aa, West Nile virus
LVALAVLVLGG

SEQ ID NO: 153105 - protein, 11 aa, West Nile virus
IALLVLVLGGI

SEQ ID NO: 153106 - protein, 11 aa, West Nile virus
ALLVLVLGGIT

SEQ ID NO: 153107 - protein, 11 aa, West Nile virus
LLVLVLGGITY

SEQ ID NO: 153108 - protein, 11 aa, West Nile virus
VLVFGGITYAD

SEQ ID NO: 153109 - protein, 11 aa, West Nile virus
LVFGGITYIDV

SEQ ID NO: 153110 - protein, 11 aa, West Nile virus
VFGGITYIDVL

SEQ ID NO: 153111 - protein, 11 aa, West Nile virus
FGGITYIDVLR

SEQ ID NO: 153112 - protein, 11 aa, West Nile virus
GGITYADVLRY

SEQ ID NO: 153113 - protein, 11 aa, West Nile virus
GITYTDVLRYI

SEQ ID NO: 153114 - protein, 11 aa, West Nile virus
TYADVLRYVIL

SEQ ID NO: 153115 - protein, 11 aa, West Nile virus
DVLRYVILAGA

SEQ ID NO: 153116 - protein, 11 aa, West Nile virus
VLRYIILVGAA

SEQ ID NO: 153117 - protein, 11 aa, West Nile virus
LRYVILAGAAF

SEQ ID NO: 153118 - protein, 11 aa, West Nile virus
VNLVGAAFAES

SEQ ID NO: 153119 - protein, 11 aa, West Nile virus
NLVGAAFAESN

SEQ ID NO: 153120 - protein, 11 aa, West Nile virus
ALMATFRIQPV

SEQ ID NO: 153121 - protein, 11 aa, West Nile virus
LMATFRIQPVF

SEQ ID NO: 153122 - protein, 11 aa, West Nile virus
VQPVFMVASFL

SEQ ID NO: 153123 - protein, 11 aa, West Nile virus
QPVFMVASFLR

SEQ ID NO: 153124 - protein, 11 aa, West Nile virus
PVFMVATFVKA

SEQ ID NO: 153125 - protein, 11 aa, West Nile virus
VATFVKARWTN

SEQ ID NO: 153126 - protein, 11 aa, West Nile virus
RWTNHENILLM

SEQ ID NO: 153127 - protein, 11 aa, West Nile virus
HENILLMLAAV

SEQ ID NO: 153128 - protein, 11 aa, West Nile virus
LAAAFFQMAYI

SEQ ID NO: 153129 - protein, 11 aa, West Nile virus
AAAFFQMAYID

SEQ ID NO: 153130 - protein, 11 aa, West Nile virus
AAFFQMAYIDS

SEQ ID NO: 153131 - protein, 11 aa, West Nile virus
PDVLNSLAIAW

SEQ ID NO: 153132 - protein, 11 aa, West Nile virus
VLNSLAAAWMI

SEQ ID NO: 153133 - protein, 11 aa, West Nile virus
LNSLAIAWMIL

SEQ ID NO: 153134 - protein, 11 aa, West Nile virus
NSLAVAWMVLR

SEQ ID NO: 153135 - protein, 11 aa, West Nile virus
SLAAAWMILRA

SEQ ID NO: 153136 - protein, 11 aa, West Nile virus
LAAAWMILRAI

SEQ ID NO: 153137 - protein, 11 aa, West Nile virus
AAAWMILRAIT

SEQ ID NO: 153138 - protein, 11 aa, West Nile virus
VAWMVLRAISF

SEQ ID NO: 153139 - protein, 11 aa, West Nile virus
AWMVLRAISFT

SEQ ID NO: 153140 - protein, 11 aa, West Nile virus
FTSTSNVVVPA

SEQ ID NO: 153141 - protein, 11 aa, West Nile virus
TTTSNVVVPLM

SEQ ID NO: 153142 - protein, 11 aa, West Nile virus
TTSNVVVPLMA

SEQ ID NO: 153143 - protein, 11 aa, West Nile virus
VVPLLALLTPR

SEQ ID NO: 153144 - protein, 11 aa, West Nile virus
VPALAFLTPGL

SEQ ID NO: 153145 - protein, 11 aa, West Nile virus
PLLALLTPRLR

SEQ ID NO: 153146 - protein, 11 aa, West Nile virus
ALAFLTPGLKC

SEQ ID NO: 153147 - protein, 11 aa, West Nile virus
LALLTPRLRCL

SEQ ID NO: 153148 - protein, 11 aa, West Nile virus
AFLTPGLKCLN

SEQ ID NO: 153149 - protein, 11 aa, West Nile virus
LLTPRLRCLNL

SEQ ID NO: 153150 - protein, 11 aa, West Nile virus
PRLRCLNLDVY

SEQ ID NO: 153151 - protein, 11 aa, West Nile virus
GLRCLNLDVYK

SEQ ID NO: 153152 - protein, 11 aa, West Nile virus
LRCLNLDVYKI

SEQ ID NO: 153153 - protein, 11 aa, West Nile virus
RCLNLDVYKIL

SEQ ID NO: 153154 - protein, 11 aa, West Nile virus
CLNLDVYRIVL

SEQ ID NO: 153155 - protein, 11 aa, West Nile virus
LNLDVYRIVLL

SEQ ID NO: 153156 - protein, 11 aa, West Nile virus
NLDVYRIVLLM

SEQ ID NO: 153157 - protein, 11 aa, West Nile virus
LDVYKILLLMV

SEQ ID NO: 153158 - protein, 11 aa, West Nile virus
DVYRILLLMIG

SEQ ID NO: 153159 - protein, 11 aa, West Nile virus
YRILLLMIGIG

SEQ ID NO: 153160 - protein, 11 aa, West Nile virus
KILLLMVGIGS

SEQ ID NO: 153161 - protein, 11 aa, West Nile virus
LLLMIGIGSLI

SEQ ID NO: 153162 - protein, 11 aa, West Nile virus
LLMVGIGSLIK

SEQ ID NO: 153163 - protein, 11 aa, West Nile virus
LMIGIGSLIKE

SEQ ID NO: 153164 - protein, 11 aa, West Nile virus
ERRSSAAKKKG

SEQ ID NO: 153165 - protein, 11 aa, West Nile virus
RRSSAAKKKGA

SEQ ID NO: 153166 - protein, 11 aa, West Nile virus
KNSAAKKKGAS

SEQ ID NO: 153167 - protein, 11 aa, West Nile virus
NAAAKKKGASL

SEQ ID NO: 153168 - protein, 11 aa, West Nile virus
AAAKKKGASLI

SEQ ID NO: 153169 - protein, 11 aa, West Nile virus
AAKKKGASLIC

SEQ ID NO: 153170 - protein, 11 aa, West Nile virus
FNPMILAAGLV

SEQ ID NO: 153171 - protein, 11 aa, West Nile virus
LVAGLLACDPN

SEQ ID NO: 153172 - protein, 11 aa, West Nile virus
VAGLLACDPNR

SEQ ID NO: 153173 - protein, 11 aa, West Nile virus
AGLLACDPNRK

SEQ ID NO: 153174 - protein, 11 aa, West Nile virus
GLLACDPNRKR

SEQ ID NO: 153175 - protein, 11 aa, West Nile virus
LLACDPNRKRG

SEQ ID NO: 153176 - protein, 11 aa, West Nile virus
LACDPNRKRGW

SEQ ID NO: 153177 - protein, 11 aa, West Nile virus
LAELDIDSMAV

SEQ ID NO: 153178 - protein, 11 aa, West Nile virus
AELDVDSMAIP

SEQ ID NO: 153179 - protein, 11 aa, West Nile virus
ELDIDSMAVPM

SEQ ID NO: 153180 - protein, 11 aa, West Nile virus
LDIDTMAIPMT

SEQ ID NO: 153181 - protein, 11 aa, West Nile virus
DMDSMAIPMTI

SEQ ID NO: 153182 - protein, 11 aa, West Nile virus
VDSMAIPMTIA

SEQ ID NO: 153183 - protein, 11 aa, West Nile virus
IERVADISWEN

SEQ ID NO: 153184 - protein, 11 aa, West Nile virus
ERTADISWEND

SEQ ID NO: 153185 - protein, 11 aa, West Nile virus
ADISWESDVEI

SEQ ID NO: 153186 - protein, 11 aa, West Nile virus
DISWESDVEIT

SEQ ID NO: 153187 - protein, 11 aa, West Nile virus
ISWESDVEITG

SEQ ID NO: 153188 - protein, 11 aa, West Nile virus
WESDVEITGSS

SEQ ID NO: 153189 - protein, 11 aa, West Nile virus
ENDAEITGSSE

SEQ ID NO: 153190 - protein, 11 aa, West Nile virus
SDVEITGSSER

SEQ ID NO: 153191 - protein, 11 aa, West Nile virus
RLDDDGNFQLI

SEQ ID NO: 153192 - protein, 11 aa, West Nile virus
LDDDGNFQLMS

SEQ ID NO: 153193 - protein, 11 aa, West Nile virus
DDGENFQLMND

SEQ ID NO: 153194 - protein, 11 aa, West Nile virus
DDGDFQLMNDP

SEQ ID NO: 153195 - protein, 11 aa, West Nile virus
GENFQLMNDPG

SEQ ID NO: 153196 - protein, 11 aa, West Nile virus
GNFQLMSDPGA

SEQ ID NO: 153197 - protein, 11 aa, West Nile virus
MFCLAISAYTP

SEQ ID NO: 153198 - protein, 11 aa, West Nile virus
ACLAVSAYTPW

SEQ ID NO: 153199 - protein, 11 aa, West Nile virus
VLPSVVGFWIT

SEQ ID NO: 153200 - protein, 11 aa, West Nile virus
LWDTPSPKEYR

SEQ ID NO: 153201 - protein, 11 aa, West Nile virus
VYKKGDTTTGV

SEQ ID NO: 153202 - protein, 11 aa, West Nile virus
YEKGDTTTGVY

SEQ ID NO: 153203 - protein, 11 aa, West Nile virus
RKGDTATGVYR

SEQ ID NO: 153204 - protein, 11 aa, West Nile virus
CYGGPWKLQCK

SEQ ID NO: 153205 - protein, 11 aa, West Nile virus
YGGPWKLGHRW

SEQ ID NO: 153206 - protein, 11 aa, West Nile virus
GGPWKLGHRWN

SEQ ID NO: 153207 - protein, 11 aa, West Nile virus
GPWKLQCKWNG

SEQ ID NO: 153208 - protein, 11 aa, West Nile virus
PWKLQCKWNGQ

SEQ ID NO: 153209 - protein, 11 aa, West Nile virus
WKLQCKWNGQD

SEQ ID NO: 153210 - protein, 11 aa, West Nile virus
KLQCKWNGQDE

SEQ ID NO: 153211 - protein, 11 aa, West Nile virus
LQHRWNGQDEV

SEQ ID NO: 153212 - protein, 11 aa, West Nile virus
QCKWNGQDEVQ

SEQ ID NO: 153213 - protein, 11 aa, West Nile virus
HRWNGQDEVQM

SEQ ID NO: 153214 - protein, 11 aa, West Nile virus
RWNGQDEVQMI

SEQ ID NO: 153215 - protein, 11 aa, West Nile virus
GMDEVQMIVVE

SEQ ID NO: 153216 - protein, 11 aa, West Nile virus
HDEVQMIVVKP

SEQ ID NO: 153217 - protein, 11 aa, West Nile virus
QMIVAEPGRKT

SEQ ID NO: 153218 - protein, 11 aa, West Nile virus
MIVAEPGRKTR

SEQ ID NO: 153219 - protein, 11 aa, West Nile virus
IVVKPGESVKN

SEQ ID NO: 153220 - protein, 11 aa, West Nile virus
VAEPGRKTRNV

SEQ ID NO: 153221 - protein, 11 aa, West Nile virus
VKPGESVKNVQ

SEQ ID NO: 153222 - protein, 11 aa, West Nile virus
EPGRKTRNVQT

SEQ ID NO: 153223 - protein, 11 aa, West Nile virus
PGRKTRNVQTK

SEQ ID NO: 153224 - protein, 11 aa, West Nile virus
GRKTRNVQTKP

SEQ ID NO: 153225 - protein, 11 aa, West Nile virus
ESVKNVQTKPG

SEQ ID NO: 153226 - protein, 11 aa, West Nile virus
KTRNVQTKPGV

SEQ ID NO: 153227 - protein, 11 aa, West Nile virus
IVQGERMEEPV

SEQ ID NO: 153228 - protein, 11 aa, West Nile virus
VQGERMEEPVP

SEQ ID NO: 153229 - protein, 11 aa, West Nile virus
QGERMDEPIPV

SEQ ID NO: 153230 - protein, 11 aa, West Nile virus
GERMEEPVPSG

SEQ ID NO: 153231 - protein, 11 aa, West Nile virus
ERMEEPVPSGF

SEQ ID NO: 153232 - protein, 11 aa, West Nile virus
GFEPEMLRKKK

SEQ ID NO: 153233 - protein, 11 aa, West Nile virus
FEPEMLRKKKI

SEQ ID NO: 153234 - protein, 11 aa, West Nile virus
PEMLRKKKITV

SEQ ID NO: 153235 - protein, 11 aa, West Nile virus
ETLKKKQITVL

SEQ ID NO: 153236 - protein, 11 aa, West Nile virus
ILPQIIKEAMN

SEQ ID NO: 153237 - protein, 11 aa, West Nile virus
LPQIIKEAIDR

SEQ ID NO: 153238 - protein, 11 aa, West Nile virus
PQIIKEAIDRR

SEQ ID NO: 153239 - protein, 11 aa, West Nile virus
QIIKEAMNRRL

SEQ ID NO: 153240 - protein, 11 aa, West Nile virus
IIKEAISKRLR

SEQ ID NO: 153241 - protein, 11 aa, West Nile virus
IKEAMNRRLRT

SEQ ID NO: 153242 - protein, 11 aa, West Nile virus
KEAMNRRLRTA

SEQ ID NO: 153243 - protein, 11 aa, West Nile virus
DRRLRTAVLAP

SEQ ID NO: 153244 - protein, 11 aa, West Nile virus
AVLAPTRVVTA

SEQ ID NO: 153245 - protein, 11 aa, West Nile virus
VLAPTRVVTAE

SEQ ID NO: 153246 - protein, 11 aa, West Nile virus
PTRVVTAEMAE

SEQ ID NO: 153247 - protein, 11 aa, West Nile virus
TRVVAAEMADA

SEQ ID NO: 153248 - protein, 11 aa, West Nile virus
RVVTAEMAEAL

SEQ ID NO: 153249 - protein, 11 aa, West Nile virus
VVAAEMADALR

SEQ ID NO: 153250 - protein, 11 aa, West Nile virus
VAAEMADALRG

SEQ ID NO: 153251 - protein, 11 aa, West Nile virus
TAEMAEALRGL

SEQ ID NO: 153252 - protein, 11 aa, West Nile virus
LPIRYQTSAVA

SEQ ID NO: 153253 - protein, 11 aa, West Nile virus
PIRYQTSAVAR

SEQ ID NO: 153254 - protein, 11 aa, West Nile virus
IRYQTSAVARE

SEQ ID NO: 153255 - protein, 11 aa, West Nile virus
RYQTSAVAREH

SEQ ID NO: 153256 - protein, 11 aa, West Nile virus
SIAARGYIATR

SEQ ID NO: 153257 - protein, 11 aa, West Nile virus
IAAGGYIATKV

SEQ ID NO: 153258 - protein, 11 aa, West Nile virus
AARGYIATRVE

SEQ ID NO: 153259 - protein, 11 aa, West Nile virus
ARGYIATRVEL

SEQ ID NO: 153260 - protein, 11 aa, West Nile virus
RGYIATRVELG

SEQ ID NO: 153261 - protein, 11 aa, West Nile virus
GYISTRVELGD

SEQ ID NO: 153262 - protein, 11 aa, West Nile virus
YISTRVELGDA

SEQ ID NO: 153263 - protein, 11 aa, West Nile virus
ISTRVELGDAA

SEQ ID NO: 153264 - protein, 11 aa, West Nile virus
ATRVELGEAAA

SEQ ID NO: 153265 - protein, 11 aa, West Nile virus
GTSDPFPKSNS

SEQ ID NO: 153266 - protein, 11 aa, West Nile virus
SSDPFPESNAP

SEQ ID NO: 153267 - protein, 11 aa, West Nile virus
SDPFPKSNSPI

SEQ ID NO: 153268 - protein, 11 aa, West Nile virus
NSGYEWITEYV

SEQ ID NO: 153269 - protein, 11 aa, West Nile virus
SGYEWITEYVG

SEQ ID NO: 153270 - protein, 11 aa, West Nile virus
GYEWITEFVGK

SEQ ID NO: 153271 - protein, 11 aa, West Nile virus
YEWITEYAGKT

SEQ ID NO: 153272 - protein, 11 aa, West Nile virus
EWITEFVGKTV

SEQ ID NO: 153273 - protein, 11 aa, West Nile virus
WITEYAGKTVW

SEQ ID NO: 153274 - protein, 11 aa, West Nile virus
ITEFVGKTVWF

SEQ ID NO: 153275 - protein, 11 aa, West Nile virus
TEFVGKTVWFV

SEQ ID NO: 153276 - protein, 11 aa, West Nile virus
EYAGKTVWFVP

SEQ ID NO: 153277 - protein, 11 aa, West Nile virus
FVGKTVWFVPS

SEQ ID NO: 153278 - protein, 11 aa, West Nile virus
AQCLQRAGKRV

SEQ ID NO: 153279 - protein, 11 aa, West Nile virus
LCLQRAGKKIV

SEQ ID NO: 153280 - protein, 11 aa, West Nile virus
RKSVKPIIITE

SEQ ID NO: 153281 - protein, 11 aa, West Nile virus
KSVKPTSITEG

SEQ ID NO: 153282 - protein, 11 aa, West Nile virus
SVKPTSITEGE

SEQ ID NO: 153283 - protein, 11 aa, West Nile virus
ITEGEARVILG

SEQ ID NO: 153284 - protein, 11 aa, West Nile virus
TEGEARVILGE

SEQ ID NO: 153285 - protein, 11 aa, West Nile virus
EGEARVILGEP

SEQ ID NO: 153286 - protein, 11 aa, West Nile virus
GESRVVLGEPS

SEQ ID NO: 153287 - protein, 11 aa, West Nile virus
EGKVVLSEPSA

SEQ ID NO: 153288 - protein, 11 aa, West Nile virus
SRVVLGEPSAI

SEQ ID NO: 153289 - protein, 11 aa, West Nile virus
QRRGRVGRNPS

SEQ ID NO: 153290 - protein, 11 aa, West Nile virus
RRGRTGRNPSQ

SEQ ID NO: 153291 - protein, 11 aa, West Nile virus
RGRVGRNPSQV

SEQ ID NO: 153292 - protein, 11 aa, West Nile virus
GRTGRNPSQAG

SEQ ID NO: 153293 - protein, 11 aa, West Nile virus
RVGRNPSQVGD

SEQ ID NO: 153294 - protein, 11 aa, West Nile virus
IGRNPTQVGDE

SEQ ID NO: 153295 - protein, 11 aa, West Nile virus
GGHTNEDDSNL

SEQ ID NO: 153296 - protein, 11 aa, West Nile virus
GHTNEDDSNLA

SEQ ID NO: 153297 - protein, 11 aa, West Nile virus
HTNEDDSNLAH

SEQ ID NO: 153298 - protein, 11 aa, West Nile virus
TNEDDSNLAHW

SEQ ID NO: 153299 - protein, 11 aa, West Nile virus
NEDDSNLAHWT

SEQ ID NO: 153300 - protein, 11 aa, West Nile virus
EDDSNYAHWTE

SEQ ID NO: 153301 - protein, 11 aa, West Nile virus
DDSNLAHWTEA

SEQ ID NO: 153302 - protein, 11 aa, West Nile virus
DSNLAHWTEAR

SEQ ID NO: 153303 - protein, 11 aa, West Nile virus
SNLAHWTEARI

SEQ ID NO: 153304 - protein, 11 aa, West Nile virus
NLAHWTEARIM

SEQ ID NO: 153305 - protein, 11 aa, West Nile virus
YAHWTEARIML

SEQ ID NO: 153306 - protein, 11 aa, West Nile virus
EKVCTMDGEYR

SEQ ID NO: 153307 - protein, 11 aa, West Nile virus
KVHTMDGEYRL

SEQ ID NO: 153308 - protein, 11 aa, West Nile virus
VHTMDGEYRLR

SEQ ID NO: 153309 - protein, 11 aa, West Nile virus
HTMDGEYRLRG

SEQ ID NO: 153310 - protein, 11 aa, West Nile virus
LPVWLAYKAAA

SEQ ID NO: 153311 - protein, 11 aa, West Nile virus
PVWLAHKVAAA

SEQ ID NO: 153312 - protein, 11 aa, West Nile virus
VWLAYKAAAAG

SEQ ID NO: 153313 - protein, 11 aa, West Nile virus
WLAYKAAAAGV

SEQ ID NO: 153314 - protein, 11 aa, West Nile virus
KVAAAGVPYHD

SEQ ID NO: 153315 - protein, 11 aa, West Nile virus
AAAAGVSYHDR

SEQ ID NO: 153316 - protein, 11 aa, West Nile virus
AAAGVPYHDRR

SEQ ID NO: 153317 - protein, 11 aa, West Nile virus
AAGVPYHDRRW

SEQ ID NO: 153318 - protein, 11 aa, West Nile virus
AGISYHDRRWC

SEQ ID NO: 153319 - protein, 11 aa, West Nile virus
GISYHDRRWCF

SEQ ID NO: 153320 - protein, 11 aa, West Nile virus
ISYHDRRWCFD

SEQ ID NO: 153321 - protein, 11 aa, West Nile virus
RPRWIDARVYL

SEQ ID NO: 153322 - protein, 11 aa, West Nile virus
PWWTDARVYSD

SEQ ID NO: 153323 - protein, 11 aa, West Nile virus
WWTDARVYSDH

SEQ ID NO: 153324 - protein, 11 aa, West Nile virus
WIDARVYLDHQ

SEQ ID NO: 153325 - protein, 11 aa, West Nile virus
TDARVYSDHQA

SEQ ID NO: 153326 - protein, 11 aa, West Nile virus
KDFAAGKRSQI

SEQ ID NO: 153327 - protein, 11 aa, West Nile virus
DFASGKRSQMG

SEQ ID NO: 153328 - protein, 11 aa, West Nile virus
FAAGKRSQIGL

SEQ ID NO: 153329 - protein, 11 aa, West Nile virus
GKRSQIGFIEV

SEQ ID NO: 153330 - protein, 11 aa, West Nile virus
KRSQIGFIEVL

SEQ ID NO: 153331 - protein, 11 aa, West Nile virus
RSQIGFIEVLG

SEQ ID NO: 153332 - protein, 11 aa, West Nile virus
SQIGFIEVLGK

SEQ ID NO: 153333 - protein, 11 aa, West Nile virus
QIGFIEVLGKM

SEQ ID NO: 153334 - protein, 11 aa, West Nile virus
IGFIEVLGKMP

SEQ ID NO: 153335 - protein, 11 aa, West Nile virus
GFIEVLGKMPE

SEQ ID NO: 153336 - protein, 11 aa, West Nile virus
FIEVLGKMPEH

SEQ ID NO: 153337 - protein, 11 aa, West Nile virus
VLGRMPEHFMV

SEQ ID NO: 153338 - protein, 11 aa, West Nile virus
LGRMPEHFMVK

SEQ ID NO: 153339 - protein, 11 aa, West Nile virus
GRMPEHFMVKT

SEQ ID NO: 153340 - protein, 11 aa, West Nile virus
RMPEHFMVKTW

SEQ ID NO: 153341 - protein, 11 aa, West Nile virus
ATAERGGRAHR

SEQ ID NO: 153342 - protein, 11 aa, West Nile virus
TAEKGRRAHRM

SEQ ID NO: 153343 - protein, 11 aa, West Nile virus
AEKGRRAHRMA

SEQ ID NO: 153344 - protein, 11 aa, West Nile virus
ERGGRAHRSAL

SEQ ID NO: 153345 - protein, 11 aa, West Nile virus
KGRRAHRMALE

SEQ ID NO: 153346 - protein, 11 aa, West Nile virus
GRRAHRMALEE

SEQ ID NO: 153347 - protein, 11 aa, West Nile virus
RRAHRMALEEL

SEQ ID NO: 153348 - protein, 11 aa, West Nile virus
PDALQTVALIA

SEQ ID NO: 153349 - protein, 11 aa, West Nile virus
DALQTIILITL

SEQ ID NO: 153350 - protein, 11 aa, West Nile virus
ALQTIILITLL

SEQ ID NO: 153351 - protein, 11 aa, West Nile virus
LQTIILITLLS

SEQ ID NO: 153352 - protein, 11 aa, West Nile virus
QTIILITLLSV

SEQ ID NO: 153353 - protein, 11 aa, West Nile virus
TVALIALLGVM

SEQ ID NO: 153354 - protein, 11 aa, West Nile virus
VMSMGVFFLLM

SEQ ID NO: 153355 - protein, 11 aa, West Nile virus
MTMGVFLLLMQ

SEQ ID NO: 153356 - protein, 11 aa, West Nile virus
TMGIFFLLMQR

SEQ ID NO: 153357 - protein, 11 aa, West Nile virus
MGVFLLLMQRK

SEQ ID NO: 153358 - protein, 11 aa, West Nile virus
KGIGKIGLGGI

SEQ ID NO: 153359 - protein, 11 aa, West Nile virus
LGVATLFCWMA

SEQ ID NO: 153360 - protein, 11 aa, West Nile virus
GAATFFCWMAD

SEQ ID NO: 153361 - protein, 11 aa, West Nile virus
AATFFCWMADV

SEQ ID NO: 153362 - protein, 11 aa, West Nile virus
ATFFCWMADVP

SEQ ID NO: 153363 - protein, 11 aa, West Nile virus
TFFCWMADVPG

SEQ ID NO: 153364 - protein, 11 aa, West Nile virus
LFCWMAEVPGT

SEQ ID NO: 153365 - protein, 11 aa, West Nile virus
LAVFLICVLTF

SEQ ID NO: 153366 - protein, 11 aa, West Nile virus
AVFLICVMTPV

SEQ ID NO: 153367 - protein, 11 aa, West Nile virus
TPVSAVAANEM

SEQ ID NO: 153368 - protein, 11 aa, West Nile virus
PVSAVAANEMG

SEQ ID NO: 153369 - protein, 11 aa, West Nile virus
MGWLDKTKNDM

SEQ ID NO: 153370 - protein, 11 aa, West Nile virus
ADLLLDLKPAT

SEQ ID NO: 153371 - protein, 11 aa, West Nile virus
EFFLDLRPATA

SEQ ID NO: 153372 - protein, 11 aa, West Nile virus
AWSLYAISTAF

SEQ ID NO: 153373 - protein, 11 aa, West Nile virus
WSLYAVATAVL

SEQ ID NO: 153374 - protein, 11 aa, West Nile virus
SLYAVATAVLT

SEQ ID NO: 153375 - protein, 11 aa, West Nile virus
LYAISTAFMTP

SEQ ID NO: 153376 - protein, 11 aa, West Nile virus
YAISTAFMTPL

SEQ ID NO: 153377 - protein, 11 aa, West Nile virus
AVTTAVLTPLI

SEQ ID NO: 153378 - protein, 11 aa, West Nile virus
VTTAVLTPLIK

SEQ ID NO: 153379 - protein, 11 aa, West Nile virus
TTAVLTPLIKH

SEQ ID NO: 153380 - protein, 11 aa, West Nile virus
TAVLTPLLKHV

SEQ ID NO: 153381 - protein, 11 aa, West Nile virus
AVLTPLLKHVI

SEQ ID NO: 153382 - protein, 11 aa, West Nile virus
VLTPLLKHVIT

SEQ ID NO: 153383 - protein, 11 aa, West Nile virus
LTPLIKHLITS

SEQ ID NO: 153384 - protein, 11 aa, West Nile virus
NVQASTLFTLA

SEQ ID NO: 153385 - protein, 11 aa, West Nile virus
VQASTLFTLAR

SEQ ID NO: 153386 - protein, 11 aa, West Nile virus
QASTLFTLARG

SEQ ID NO: 153387 - protein, 11 aa, West Nile virus
ASTLFTLARGF

SEQ ID NO: 153388 - protein, 11 aa, West Nile virus
STLFTLARGFP

SEQ ID NO: 153389 - protein, 11 aa, West Nile virus
TLFTLARGFPF

SEQ ID NO: 153390 - protein, 11 aa, West Nile virus
VLLFCHYAYMV

SEQ ID NO: 153391 - protein, 11 aa, West Nile virus
ERTTPIMQKKI

SEQ ID NO: 153392 - protein, 11 aa, West Nile virus
RTTPIMQKKIG

SEQ ID NO: 153393 - protein, 11 aa, West Nile virus
ATPMMQKKVGQ

SEQ ID NO: 153394 - protein, 11 aa, West Nile virus
TPIMQKKIGQI

SEQ ID NO: 153395 - protein, 11 aa, West Nile virus
PIMQKKVGQVM

SEQ ID NO: 153396 - protein, 11 aa, West Nile virus
VMQKKVGQIIL

SEQ ID NO: 153397 - protein, 11 aa, West Nile virus
QKKIGQIMLIL

SEQ ID NO: 153398 - protein, 11 aa, West Nile virus
KKVGQIMLIWV

SEQ ID NO: 153399 - protein, 11 aa, West Nile virus
KIGQIMLILVS

SEQ ID NO: 153400 - protein, 11 aa, West Nile virus
LILVSLAALVV

SEQ ID NO: 153401 - protein, 11 aa, West Nile virus
ILVSLAALVVN

SEQ ID NO: 153402 - protein, 11 aa, West Nile virus
LVSLAALVVNP

SEQ ID NO: 153403 - protein, 11 aa, West Nile virus
VSLAALVVNPS

SEQ ID NO: 153404 - protein, 11 aa, West Nile virus
SLAALVVNPSV

SEQ ID NO: 153405 - protein, 11 aa, West Nile virus
TVREAGILTSA

SEQ ID NO: 153406 - protein, 11 aa, West Nile virus
VREAGILTSAA

SEQ ID NO: 153407 - protein, 11 aa, West Nile virus
REAGILTSAAA

SEQ ID NO: 153408 - protein, 11 aa, West Nile virus
EAGILTSAAAV

SEQ ID NO: 153409 - protein, 11 aa, West Nile virus
AGILTSAAAVT

SEQ ID NO: 153410 - protein, 11 aa, West Nile virus
GILITSASVTL

SEQ ID NO: 153411 - protein, 11 aa, West Nile virus
ILITSASVTLW

SEQ ID NO: 153412 - protein, 11 aa, West Nile virus
LITSASVTLWE

SEQ ID NO: 153413 - protein, 11 aa, West Nile virus
ITSASVTLWEN

SEQ ID NO: 153414 - protein, 11 aa, West Nile virus
RGGWLSCLSIA

SEQ ID NO: 153415 - protein, 11 aa, West Nile virus
GGWLSCLSIAW

SEQ ID NO: 153416 - protein, 11 aa, West Nile virus
GWLSCLSIAWT

SEQ ID NO: 153417 - protein, 11 aa, West Nile virus
WLSCLSIAWTL

SEQ ID NO: 153418 - protein, 11 aa, West Nile virus
KNLEKPGLKRG

SEQ ID NO: 153419 - protein, 11 aa, West Nile virus
NLEKPGLKRGG

SEQ ID NO: 153420 - protein, 11 aa, West Nile virus
LEKPGLKRGGA

SEQ ID NO: 153421 - protein, 11 aa, West Nile virus
EKPVLKRGGAK

SEQ ID NO: 153422 - protein, 11 aa, West Nile virus
LGEVWKERLNY

SEQ ID NO: 153423 - protein, 11 aa, West Nile virus
GEAWKERLNQL

SEQ ID NO: 153424 - protein, 11 aa, West Nile virus
EAWKERLNQLT

SEQ ID NO: 153425 - protein, 11 aa, West Nile virus
TKEEFTRYRRE

SEQ ID NO: 153426 - protein, 11 aa, West Nile virus
REEFTRYRKEA

SEQ ID NO: 153427 - protein, 11 aa, West Nile virus
EEFARYRKEAI

SEQ ID NO: 153428 - protein, 11 aa, West Nile virus
EFARYRKEAIT

SEQ ID NO: 153429 - protein, 11 aa, West Nile virus
FSRYRKEAIIE

SEQ ID NO: 153430 - protein, 11 aa, West Nile virus
TRYRREAITEV

SEQ ID NO: 153431 - protein, 11 aa, West Nile virus
KEAITEVDRAP

SEQ ID NO: 153432 - protein, 11 aa, West Nile virus
AIIEVDRSAAQ

SEQ ID NO: 153433 - protein, 11 aa, West Nile virus
ARREGNVTGGH

SEQ ID NO: 153434 - protein, 11 aa, West Nile virus
EGNVTGGHSVS

SEQ ID NO: 153435 - protein, 11 aa, West Nile virus
GNVTGGHSVSR

SEQ ID NO: 153436 - protein, 11 aa, West Nile virus
ITGGHPVSRGS

SEQ ID NO: 153437 - protein, 11 aa, West Nile virus
RKFVEPVGRVI

SEQ ID NO: 153438 - protein, 11 aa, West Nile virus
KFVEPVGRVID

SEQ ID NO: 153439 - protein, 11 aa, West Nile virus
FLEPIGKVIDL

SEQ ID NO: 153440 - protein, 11 aa, West Nile virus
VEPVGRVIDLG

SEQ ID NO: 153441 - protein, 11 aa, West Nile virus
EPIGKVIDLGC

SEQ ID NO: 153442 - protein, 11 aa, West Nile virus
PIGKVIDLGCG

SEQ ID NO: 153443 - protein, 11 aa, West Nile virus
IGKVIDLGCGR

SEQ ID NO: 153444 - protein, 11 aa, West Nile virus
KVDVFYRTSEA

SEQ ID NO: 153445 - protein, 11 aa, West Nile virus
VDVFYRTSEAS

SEQ ID NO: 153446 - protein, 11 aa, West Nile virus
DVFYRPSEVSD

SEQ ID NO: 153447 - protein, 11 aa, West Nile virus
VFYRPSEVSDT

SEQ ID NO: 153448 - protein, 11 aa, West Nile virus
FYRPSESCDTL

SEQ ID NO: 153449 - protein, 11 aa, West Nile virus
YRTSEASDTLL

SEQ ID NO: 153450 - protein, 11 aa, West Nile virus
RPSESCDTLLC

SEQ ID NO: 153451 - protein, 11 aa, West Nile virus
PSEVSDTLLCD

SEQ ID NO: 153452 - protein, 11 aa, West Nile virus
EEHRTMRVLEM

SEQ ID NO: 153453 - protein, 11 aa, West Nile virus
EHRTMRVLEMV

SEQ ID NO: 153454 - protein, 11 aa, West Nile virus
HRTIRVLEIVE

SEQ ID NO: 153455 - protein, 11 aa, West Nile virus
RTIRVLEIVED

SEQ ID NO: 153456 - protein, 11 aa, West Nile virus
TIRVLEIVEDW

SEQ ID NO: 153457 - protein, 11 aa, West Nile virus
IRVLEIVEDWL

SEQ ID NO: 153458 - protein, 11 aa, West Nile virus
YMPKVIEKMEI

SEQ ID NO: 153459 - protein, 11 aa, West Nile virus
MPKVIEKMEIL

SEQ ID NO: 153460 - protein, 11 aa, West Nile virus
PKVIEKMEILQ

SEQ ID NO: 153461 - protein, 11 aa, West Nile virus
VIEKMEILQRR

SEQ ID NO: 153462 - protein, 11 aa, West Nile virus
IEKMEILQRRY

SEQ ID NO: 153463 - protein, 11 aa, West Nile virus
EKMEILQRRYG

SEQ ID NO: 153464 - protein, 11 aa, West Nile virus
KMEILQRRYGG

SEQ ID NO: 153465 - protein, 11 aa, West Nile virus
MEILQRRYGGG

SEQ ID NO: 153466 - protein, 11 aa, West Nile virus
EILQRRYGGGL

SEQ ID NO: 153467 - protein, 11 aa, West Nile virus
HEMYWVSQASG

SEQ ID NO: 153468 - protein, 11 aa, West Nile virus
EMYWVSRASSN

SEQ ID NO: 153469 - protein, 11 aa, West Nile virus
MYWVSQASGNI

SEQ ID NO: 153470 - protein, 11 aa, West Nile virus
YWVSQASGNIV

SEQ ID NO: 153471 - protein, 11 aa, West Nile virus
WVSRASRNVVH

SEQ ID NO: 153472 - protein, 11 aa, West Nile virus
NIVHAVNMTSQ

SEQ ID NO: 153473 - protein, 11 aa, West Nile virus
IVHAVNMTSQV

SEQ ID NO: 153474 - protein, 11 aa, West Nile virus
MEKKTWKGAHY

SEQ ID NO: 153475 - protein, 11 aa, West Nile virus
EKKTWKGAHYE

SEQ ID NO: 153476 - protein, 11 aa, West Nile virus
KKTWKGAHYEE

SEQ ID NO: 153477 - protein, 11 aa, West Nile virus
KTWKGAHYEED

SEQ ID NO: 153478 - protein, 11 aa, West Nile virus
TWKGAHYEEDV

SEQ ID NO: 153479 - protein, 11 aa, West Nile virus
WKGAHYEEDVN

SEQ ID NO: 153480 - protein, 11 aa, West Nile virus
KGAHYEEDVNL

SEQ ID NO: 153481 - protein, 11 aa, West Nile virus
GAHYEEDVNLG

SEQ ID NO: 153482 - protein, 11 aa, West Nile virus
AHYEEDVNLGS

SEQ ID NO: 153483 - protein, 11 aa, West Nile virus
QYEEDANLGSG

SEQ ID NO: 153484 - protein, 11 aa, West Nile virus
VGKPLLSSDTS

SEQ ID NO: 153485 - protein, 11 aa, West Nile virus
GKPLLNSDTRK

SEQ ID NO: 153486 - protein, 11 aa, West Nile virus
RPLLNSDTSKI

SEQ ID NO: 153487 - protein, 11 aa, West Nile virus
PLLSSDTSKIK

SEQ ID NO: 153488 - protein, 11 aa, West Nile virus
DGNHPYRTWNY

SEQ ID NO: 153489 - protein, 11 aa, West Nile virus
GNHPYRTWNYH

SEQ ID NO: 153490 - protein, 11 aa, West Nile virus
TWNYHGSYDVN

SEQ ID NO: 153491 - protein, 11 aa, West Nile virus
WNYHGSYDVNP

SEQ ID NO: 153492 - protein, 11 aa, West Nile virus
NYHGSYEVNPL

SEQ ID NO: 153493 - protein, 11 aa, West Nile virus
YHGSYEVNPLV

SEQ ID NO: 153494 - protein, 11 aa, West Nile virus
HGSYDVNPTGS

SEQ ID NO: 153495 - protein, 11 aa, West Nile virus
GSYDVNPTGSA

SEQ ID NO: 153496 - protein, 11 aa, West Nile virus
SYEVNPLVSAS

SEQ ID NO: 153497 - protein, 11 aa, West Nile virus
YDVNPTGSASS

SEQ ID NO: 153498 - protein, 11 aa, West Nile virus
EVNPLVSASSL

SEQ ID NO: 153499 - protein, 11 aa, West Nile virus
TKAPEPPAGVK

SEQ ID NO: 153500 - protein, 11 aa, West Nile virus
VLNETTNWLWS

SEQ ID NO: 153501 - protein, 11 aa, West Nile virus
LNETTNWLWAY

SEQ ID NO: 153502 - protein, 11 aa, West Nile virus
KETTNWLWAFL

SEQ ID NO: 153503 - protein, 11 aa, West Nile virus
ETTNWLWAYLA

SEQ ID NO: 153504 - protein, 11 aa, West Nile virus
TTNWLWSHLER

SEQ ID NO: 153505 - protein, 11 aa, West Nile virus
RGKRPRMCSRE

SEQ ID NO: 153506 - protein, 11 aa, West Nile virus
GKRPRMCSREE

SEQ ID NO: 153507 - protein, 11 aa, West Nile virus
PRMCTREEFIS

SEQ ID NO: 153508 - protein, 11 aa, West Nile virus
RMCTREEFISK

SEQ ID NO: 153509 - protein, 11 aa, West Nile virus
MCTREEFISKV

SEQ ID NO: 153510 - protein, 11 aa, West Nile virus
CTREEFISKVN

SEQ ID NO: 153511 - protein, 11 aa, West Nile virus
TREEFISKVNS

SEQ ID NO: 153512 - protein, 11 aa, West Nile virus
REEFIKKVNSN

SEQ ID NO: 153513 - protein, 11 aa, West Nile virus
EEFISKVNSNA

SEQ ID NO: 153514 - protein, 11 aa, West Nile virus
EFIKKVNSNAA

SEQ ID NO: 153515 - protein, 11 aa, West Nile virus
FISKVNSNAAL

SEQ ID NO: 153516 - protein, 11 aa, West Nile virus
ISKVNSNAALG

SEQ ID NO: 153517 - protein, 11 aa, West Nile virus
SKVNSNAALGA

SEQ ID NO: 153518 - protein, 11 aa, West Nile virus
AMFEEQNQWSN

SEQ ID NO: 153519 - protein, 11 aa, West Nile virus
MFEEQNQWSNA

SEQ ID NO: 153520 - protein, 11 aa, West Nile virus
FEEQNQWSNAR

SEQ ID NO: 153521 - protein, 11 aa, West Nile virus
EEQNQWSNARE

SEQ ID NO: 153522 - protein, 11 aa, West Nile virus
EQNQWSNAREA

SEQ ID NO: 153523 - protein, 11 aa, West Nile virus
QNQWSNAREAV

SEQ ID NO: 153524 - protein, 11 aa, West Nile virus
NQWSNAREAVE

SEQ ID NO: 153525 - protein, 11 aa, West Nile virus
QWSNAREAVED

SEQ ID NO: 153526 - protein, 11 aa, West Nile virus
SARAAVEDPKF

SEQ ID NO: 153527 - protein, 11 aa, West Nile virus
AREAVEDSTFW

SEQ ID NO: 153528 - protein, 11 aa, West Nile virus
REAVEDSTFWE

SEQ ID NO: 153529 - protein, 11 aa, West Nile virus
EAVEDSTFWEM

SEQ ID NO: 153530 - protein, 11 aa, West Nile virus
AVEDQKFWEMV

SEQ ID NO: 153531 - protein, 11 aa, West Nile virus
VEDQKFWEMVD

SEQ ID NO: 153532 - protein, 11 aa, West Nile virus
EDLKFWEMVDE

SEQ ID NO: 153533 - protein, 11 aa, West Nile virus
DLKFWEMVDEE

SEQ ID NO: 153534 - protein, 11 aa, West Nile virus
LKFWEMVDEER

SEQ ID NO: 153535 - protein, 11 aa, West Nile virus
GGKVYADDTAG

SEQ ID NO: 153536 - protein, 11 aa, West Nile virus
GKVYADDTAGW

SEQ ID NO: 153537 - protein, 11 aa, West Nile virus
RIYADDTAGWD

SEQ ID NO: 153538 - protein, 11 aa, West Nile virus
TYADDTAGWDT

SEQ ID NO: 153539 - protein, 11 aa, West Nile virus
EGEHRRLARAI

SEQ ID NO: 153540 - protein, 11 aa, West Nile virus
LARSIIQLTYR

SEQ ID NO: 153541 - protein, 11 aa, West Nile virus
ARSIIQLTYRH

SEQ ID NO: 153542 - protein, 11 aa, West Nile virus
RSIIQLTYRHK

SEQ ID NO: 153543 - protein, 11 aa, West Nile virus
AIIELTYRYKV

SEQ ID NO: 153544 - protein, 11 aa, West Nile virus
IIQLTYRHKVV

SEQ ID NO: 153545 - protein, 11 aa, West Nile virus
ELTYRHKVVKG

SEQ ID NO: 153546 - protein, 11 aa, West Nile virus
RPAADGKTVMS

SEQ ID NO: 153547 - protein, 11 aa, West Nile virus
PAADRKTVMDV

SEQ ID NO: 153548 - protein, 11 aa, West Nile virus
AADGKTVMDII

SEQ ID NO: 153549 - protein, 11 aa, West Nile virus
ADRKTVMDVIS

SEQ ID NO: 153550 - protein, 11 aa, West Nile virus
DGKTVMSLISR

SEQ ID NO: 153551 - protein, 11 aa, West Nile virus
GKTVMSLISRE

SEQ ID NO: 153552 - protein, 11 aa, West Nile virus
VRRREGEGVIG

SEQ ID NO: 153553 - protein, 11 aa, West Nile virus
MMEGEGVIGPE

SEQ ID NO: 153554 - protein, 11 aa, West Nile virus
REGEGVIGPYD

SEQ ID NO: 153555 - protein, 11 aa, West Nile virus
EGEGVIGPEDV

SEQ ID NO: 153556 - protein, 11 aa, West Nile virus
GEGVIGPEDVE

SEQ ID NO: 153557 - protein, 11 aa, West Nile virus
KGNGPKVRTWL

SEQ ID NO: 153558 - protein, 11 aa, West Nile virus
RKGPKVRTWLF

SEQ ID NO: 153559 - protein, 11 aa, West Nile virus
FENGEERLGRM

SEQ ID NO: 153560 - protein, 11 aa, West Nile virus
RFAISLHFLNA

SEQ ID NO: 153561 - protein, 11 aa, West Nile virus
FAISLHFLNAM

SEQ ID NO: 153562 - protein, 11 aa, West Nile virus
ASSLHFLNAMS

SEQ ID NO: 153563 - protein, 11 aa, West Nile virus
SLHFLNAMPKV

SEQ ID NO: 153564 - protein, 11 aa, West Nile virus
ANAICSAVPVD

SEQ ID NO: 153565 - protein, 11 aa, West Nile virus
NAICSAVPVDW

SEQ ID NO: 153566 - protein, 11 aa, West Nile virus
AICSAVPVDWV

SEQ ID NO: 153567 - protein, 11 aa, West Nile virus
ICSAVPVDWVP

SEQ ID NO: 153568 - protein, 11 aa, West Nile virus
CSAVPVDWVPT

SEQ ID NO: 153569 - protein, 11 aa, West Nile virus
SAVPVDWVPTG

SEQ ID NO: 153570 - protein, 11 aa, West Nile virus
AVPVDWVPTGR

SEQ ID NO: 153571 - protein, 11 aa, West Nile virus
VPVDWVPTGRT

SEQ ID NO: 153572 - protein, 11 aa, West Nile virus
PVDWVPTGRTT

SEQ ID NO: 153573 - protein, 11 aa, West Nile virus
VDWVPTGRTTW

SEQ ID NO: 153574 - protein, 11 aa, West Nile virus
TGRTTWSIHVG

SEQ ID NO: 153575 - protein, 11 aa, West Nile virus
GRTTWSIHVGG

SEQ ID NO: 153576 - protein, 11 aa, West Nile virus
RTTWSIHVGGE

SEQ ID NO: 153577 - protein, 11 aa, West Nile virus
TTWSIHVGGEW

SEQ ID NO: 153578 - protein, 11 aa, West Nile virus
TWSIHVGGEWM

SEQ ID NO: 153579 - protein, 11 aa, West Nile virus
WSIHVGGEWMT

SEQ ID NO: 153580 - protein, 11 aa, West Nile virus
SIHVGGEWMTT

SEQ ID NO: 153581 - protein, 11 aa, West Nile virus
RGEWMTTEDML

SEQ ID NO: 153582 - protein, 11 aa, West Nile virus
GEWMTTEDMLS

SEQ ID NO: 153583 - protein, 11 aa, West Nile virus
EWMTTEDMLSV

SEQ ID NO: 153584 - protein, 11 aa, West Nile virus
WMTTEDMLSVW

SEQ ID NO: 153585 - protein, 11 aa, West Nile virus
MTTEDMLSVWN

SEQ ID NO: 153586 - protein, 11 aa, West Nile virus
TTEDMLSVWNR

SEQ ID NO: 153587 - protein, 11 aa, West Nile virus
TEDMLSVWNRV

SEQ ID NO: 153588 - protein, 11 aa, West Nile virus
EDMLSVWNRVW

SEQ ID NO: 153589 - protein, 11 aa, West Nile virus
DMLSVWNRVWI

SEQ ID NO: 153590 - protein, 11 aa, West Nile virus
MLSVWNRVWIE

SEQ ID NO: 153591 - protein, 11 aa, West Nile virus
LSVWNRVWIEE

SEQ ID NO: 153592 - protein, 11 aa, West Nile virus
SVWNRVWIEEN

SEQ ID NO: 153593 - protein, 11 aa, West Nile virus
RSRATWAENIQ

SEQ ID NO: 153594 - protein, 11 aa, West Nile virus
SRATWAENIQV

SEQ ID NO: 153595 - protein, 11 aa, West Nile virus
NIQVAINQVKA

SEQ ID NO: 153596 - protein, 11 aa, West Nile virus
GKYVDYMSSLR

SEQ ID NO: 153597 - protein, 11 aa, West Nile virus
DYMSSLRRYEE

SEQ ID NO: 153598 - protein, 11 aa, West Nile virus
RAVNMQKRGKP

SEQ ID NO: 153599 - protein, 11 aa, West Nile virus
AVNMLKRGTPR

SEQ ID NO: 153600 - protein, 11 aa, West Nile virus
VMSLIGLKRAM

SEQ ID NO: 153601 - protein, 11 aa, West Nile virus
RALLDRWRGVN

SEQ ID NO: 153602 - protein, 11 aa, West Nile virus
ALLDRWRGVNK

SEQ ID NO: 153603 - protein, 11 aa, West Nile virus
VLERWRGVNKQ

SEQ ID NO: 153604 - protein, 11 aa, West Nile virus
SFKKELGTLTN

SEQ ID NO: 153605 - protein, 11 aa, West Nile virus
FKRELGTLTSA

SEQ ID NO: 153606 - protein, 11 aa, West Nile virus
KKELGILTNAI

SEQ ID NO: 153607 - protein, 11 aa, West Nile virus
KELGILTNAIS

SEQ ID NO: 153608 - protein, 11 aa, West Nile virus
NRRSSKEKKRG

SEQ ID NO: 153609 - protein, 11 aa, West Nile virus
RRSSKEKKRGG

SEQ ID NO: 153610 - protein, 11 aa, West Nile virus
GSVTLSNFQGK

SEQ ID NO: 153611 - protein, 11 aa, West Nile virus
SDFQGKVMMTV

SEQ ID NO: 153612 - protein, 11 aa, West Nile virus
NFQGKLMMTVN

SEQ ID NO: 153613 - protein, 11 aa, West Nile virus
GKLMMTVNATD

SEQ ID NO: 153614 - protein, 11 aa, West Nile virus
VITIPIASGKN

SEQ ID NO: 153615 - protein, 11 aa, West Nile virus
PTASGKNLCTV

SEQ ID NO: 153616 - protein, 11 aa, West Nile virus
PAAGKNLCIVR

SEQ ID NO: 153617 - protein, 11 aa, West Nile virus
LCTVRAMDVGF

SEQ ID NO: 153618 - protein, 11 aa, West Nile virus
VRAMDVGFMCD

SEQ ID NO: 153619 - protein, 11 aa, West Nile virus
DVGFLCDDTIT

SEQ ID NO: 153620 - protein, 11 aa, West Nile virus
VGFLCDDTITY

SEQ ID NO: 153621 - protein, 11 aa, West Nile virus
GFMCDDTITYE

SEQ ID NO: 153622 - protein, 11 aa, West Nile virus
FLCDDTITYEC

SEQ ID NO: 153623 - protein, 11 aa, West Nile virus
EDIDCWCTKSP

SEQ ID NO: 153624 - protein, 11 aa, West Nile virus
PVYVRYGRCTK

SEQ ID NO: 153625 - protein, 11 aa, West Nile virus
TVQTHGKSTLA

SEQ ID NO: 153626 - protein, 11 aa, West Nile virus
VQTHGESTLVN

SEQ ID NO: 153627 - protein, 11 aa, West Nile virus
QTHGKSTLANK

SEQ ID NO: 153628 - protein, 11 aa, West Nile virus
THGKSTLANKK

SEQ ID NO: 153629 - protein, 11 aa, West Nile virus
TLANKKGAWMB

SEQ ID NO: 153630 - protein, 11 aa, West Nile virus
LANKKGAWMBS

SEQ ID NO: 153631 - protein, 11 aa, West Nile virus
VNKKGAWLDST

SEQ ID NO: 153632 - protein, 11 aa, West Nile virus
MQRVVFIVLLL

SEQ ID NO: 153633 - protein, 11 aa, West Nile virus
QRVVFIVLLLL

SEQ ID NO: 153634 - protein, 11 aa, West Nile virus
RVVFIVLLLLV

SEQ ID NO: 153635 - protein, 11 aa, West Nile virus
VVFIVLLLLVA

SEQ ID NO: 153636 - protein, 11 aa, West Nile virus
VFIVLLLLVAP

SEQ ID NO: 153637 - protein, 11 aa, West Nile virus
FIVLLLLVAPA

SEQ ID NO: 153638 - protein, 11 aa, West Nile virus
IVLLLLVAPAY

SEQ ID NO: 153639 - protein, 11 aa, West Nile virus
VSELSTRAACP

SEQ ID NO: 153640 - protein, 11 aa, West Nile virus
SPRAACPTMGE

SEQ ID NO: 153641 - protein, 11 aa, West Nile virus
TKAACPTMGDA

SEQ ID NO: 153642 - protein, 11 aa, West Nile virus
GDAHNDKRADP

SEQ ID NO: 153643 - protein, 11 aa, West Nile virus
CAKFACTSKAT

SEQ ID NO: 153644 - protein, 11 aa, West Nile virus
AKFACTSKATG

SEQ ID NO: 153645 - protein, 11 aa, West Nile virus
KFACTSKATGW

SEQ ID NO: 153646 - protein, 11 aa, West Nile virus
GATQAGRFSVT

SEQ ID NO: 153647 - protein, 11 aa, West Nile virus
ATQAGRFTVSP

SEQ ID NO: 153648 - protein, 11 aa, West Nile virus
QAGRFSVTPAA

SEQ ID NO: 153649 - protein, 11 aa, West Nile virus
AGRFTVSPSAP

SEQ ID NO: 153650 - protein, 11 aa, West Nile virus
GRFTVSPSAPT

SEQ ID NO: 153651 - protein, 11 aa, West Nile virus
KLGGYGEVTVD

SEQ ID NO: 153652 - protein, 11 aa, West Nile virus
GIDTNAYYVMS

SEQ ID NO: 153653 - protein, 11 aa, West Nile virus
IDTNAYYVMSV

SEQ ID NO: 153654 - protein, 11 aa, West Nile virus
DTNAYYVMSVG

SEQ ID NO: 153655 - protein, 11 aa, West Nile virus
LNMPWSSAAGT

SEQ ID NO: 153656 - protein, 11 aa, West Nile virus
HQALAGAIPLE

SEQ ID NO: 153657 - protein, 11 aa, West Nile virus
VTVNPFVAAAT

SEQ ID NO: 153658 - protein, 11 aa, West Nile virus
TVNPFVSVAAA

SEQ ID NO: 153659 - protein, 11 aa, West Nile virus
TADAKVLIELE

SEQ ID NO: 153660 - protein, 11 aa, West Nile virus
ARDKSIALTFL

SEQ ID NO: 153661 - protein, 11 aa, West Nile virus
IALTFLAVGGI

SEQ ID NO: 153662 - protein, 11 aa, West Nile virus
AMTFLAVGGIL

SEQ ID NO: 153663 - protein, 11 aa, West Nile virus
MTFLAVGGILL

SEQ ID NO: 153664 - protein, 11 aa, West Nile virus
VGGILLFLSAN

SEQ ID NO: 153665 - protein, 11 aa, West Nile virus
HADTGCAIDVS

SEQ ID NO: 153666 - protein, 11 aa, West Nile virus
ADTGCAIDVGR

SEQ ID NO: 153667 - protein, 11 aa, West Nile virus
DTGCAIDVGRQ

SEQ ID NO: 153668 - protein, 11 aa, West Nile virus
TGCAIDVGRQE

SEQ ID NO: 153669 - protein, 11 aa, West Nile virus
GCAIDVSRQEL

SEQ ID NO: 153670 - protein, 11 aa, West Nile virus
CAIDVSRQELR

SEQ ID NO: 153671 - protein, 11 aa, West Nile virus
AIDVGRQELRC

SEQ ID NO: 153672 - protein, 11 aa, West Nile virus
IDVSRQELRCG

SEQ ID NO: 153673 - protein, 11 aa, West Nile virus
NDVKAWMDRYK

SEQ ID NO: 153674 - protein, 11 aa, West Nile virus
DRYKYHPETPQ

SEQ ID NO: 153675 - protein, 11 aa, West Nile virus
RYKFHPETPQG

SEQ ID NO: 153676 - protein, 11 aa, West Nile virus
YKYHPETPQGL

SEQ ID NO: 153677 - protein, 11 aa, West Nile virus
KYHPETPQGLA

SEQ ID NO: 153678 - protein, 11 aa, West Nile virus
YPETPQGLARI

SEQ ID NO: 153679 - protein, 11 aa, West Nile virus
SRLEHQMWDSV

SEQ ID NO: 153680 - protein, 11 aa, West Nile virus
RLEHQMWDSVK

SEQ ID NO: 153681 - protein, 11 aa, West Nile virus
LEHQMWDSVKD

SEQ ID NO: 153682 - protein, 11 aa, West Nile virus
EHQMWDSVKDE

SEQ ID NO: 153683 - protein, 11 aa, West Nile virus
HQMWDSVKDEL

SEQ ID NO: 153684 - protein, 11 aa, West Nile virus
QMWDSVKDELN

SEQ ID NO: 153685 - protein, 11 aa, West Nile virus
MWDSVKDELNT

SEQ ID NO: 153686 - protein, 11 aa, West Nile virus
SVKDELNTLFR

SEQ ID NO: 153687 - protein, 11 aa, West Nile virus
TLLKENGVDLT

SEQ ID NO: 153688 - protein, 11 aa, West Nile virus
LKENGVDLTVV

SEQ ID NO: 153689 - protein, 11 aa, West Nile virus
KENGVDFSVVV

SEQ ID NO: 153690 - protein, 11 aa, West Nile virus
ENGVDLTVVVE

SEQ ID NO: 153691 - protein, 11 aa, West Nile virus
NGVDLTVVVEK

SEQ ID NO: 153692 - protein, 11 aa, West Nile virus
GVDLTVVVEKQ

SEQ ID NO: 153693 - protein, 11 aa, West Nile virus
ATTDKLEIGWK

SEQ ID NO: 153694 - protein, 11 aa, West Nile virus
TTEKFEIGWKA

SEQ ID NO: 153695 - protein, 11 aa, West Nile virus
TEKFEIGWKAW

SEQ ID NO: 153696 - protein, 11 aa, West Nile virus
ASELANHTFVV

SEQ ID NO: 153697 - protein, 11 aa, West Nile virus
SELANHTFVVD

SEQ ID NO: 153698 - protein, 11 aa, West Nile virus
ELANSTFVVDG

SEQ ID NO: 153699 - protein, 11 aa, West Nile virus
ANSTFVVDGPE

SEQ ID NO: 153700 - protein, 11 aa, West Nile virus
NHTFVVDGPET

SEQ ID NO: 153701 - protein, 11 aa, West Nile virus
VVDGPETEECP

SEQ ID NO: 153702 - protein, 11 aa, West Nile virus
LNHTWKLERAV

SEQ ID NO: 153703 - protein, 11 aa, West Nile virus
ETHTLWGDGVI

SEQ ID NO: 153704 - protein, 11 aa, West Nile virus
THTLWGDGVIE

SEQ ID NO: 153705 - protein, 11 aa, West Nile virus
HTLWGDGVIES

SEQ ID NO: 153706 - protein, 11 aa, West Nile virus
DLIIPATLAGP

SEQ ID NO: 153707 - protein, 11 aa, West Nile virus
PATLAGPRSNH

SEQ ID NO: 153708 - protein, 11 aa, West Nile virus
VTLAGPRSNYN

SEQ ID NO: 153709 - protein, 11 aa, West Nile virus
CGHRGPSARTT

SEQ ID NO: 153710 - protein, 11 aa, West Nile virus
GHRGPSARTTT

SEQ ID NO: 153711 - protein, 11 aa, West Nile virus
CTLPPLRYTTE

SEQ ID NO: 153712 - protein, 11 aa, West Nile virus
GMEIRPQKHDE

SEQ ID NO: 153713 - protein, 11 aa, West Nile virus
MEIRPQRHDGK

SEQ ID NO: 153714 - protein, 11 aa, West Nile virus
EIRPQRHDGKT

SEQ ID NO: 153715 - protein, 11 aa, West Nile virus
IRPLKHDEKTL

SEQ ID NO: 153716 - protein, 11 aa, West Nile virus
RPQKHDERTLV

SEQ ID NO: 153717 - protein, 11 aa, West Nile virus
PLKHDEKTLVQ

SEQ ID NO: 153718 - protein, 11 aa, West Nile virus
LKHDEKTLVQS

SEQ ID NO: 153719 - protein, 11 aa, West Nile virus
RHDGKTLVQSQ

SEQ ID NO: 153720 - protein, 11 aa, West Nile virus
DEKTLVQSRVS

SEQ ID NO: 153721 - protein, 11 aa, West Nile virus
GKTLVQSQVNA

SEQ ID NO: 153722 - protein, 11 aa, West Nile virus
KTLVQSRVSAY

SEQ ID NO: 153723 - protein, 11 aa, West Nile virus
VQSRVSAYKSD

SEQ ID NO: 153724 - protein, 11 aa, West Nile virus
QSRVNAHNADM

SEQ ID NO: 153725 - protein, 11 aa, West Nile virus
SRVSAYKSDMI

SEQ ID NO: 153726 - protein, 11 aa, West Nile virus
RVSAYKSDMID

SEQ ID NO: 153727 - protein, 11 aa, West Nile virus
LGLLVVVLATQ

SEQ ID NO: 153728 - protein, 11 aa, West Nile virus
GLLVVFLVTQE

SEQ ID NO: 153729 - protein, 11 aa, West Nile virus
LLVVVLATQEV

SEQ ID NO: 153730 - protein, 11 aa, West Nile virus
LVVFLVTQEVL

SEQ ID NO: 153731 - protein, 11 aa, West Nile virus
LRRRWTAKISM

SEQ ID NO: 153732 - protein, 11 aa, West Nile virus
RRRWTAKISMP

SEQ ID NO: 153733 - protein, 11 aa, West Nile virus
RRWTAKISMPA

SEQ ID NO: 153734 - protein, 11 aa, West Nile virus
PAIMIALLVLV

SEQ ID NO: 153735 - protein, 11 aa, West Nile virus
AILLALLVLVF

SEQ ID NO: 153736 - protein, 11 aa, West Nile virus
ILLALLVLVFG

SEQ ID NO: 153737 - protein, 11 aa, West Nile virus
LLALLVLVFGG

SEQ ID NO: 153738 - protein, 11 aa, West Nile virus
LALLVLVFGGV

SEQ ID NO: 153739 - protein, 11 aa, West Nile virus
VLVFGGITYID

SEQ ID NO: 153740 - protein, 11 aa, West Nile virus
LVFGGVTYTDV

SEQ ID NO: 153741 - protein, 11 aa, West Nile virus
VFGGITYADVL

SEQ ID NO: 153742 - protein, 11 aa, West Nile virus
FGGITYADVLR

SEQ ID NO: 153743 - protein, 11 aa, West Nile virus
GITYIDVLRYV

SEQ ID NO: 153744 - protein, 11 aa, West Nile virus
TYTDVLRYIIL

SEQ ID NO: 153745 - protein, 11 aa, West Nile virus
IQPVFMVATFV

SEQ ID NO: 153746 - protein, 11 aa, West Nile virus
QPVFVVASFLK

SEQ ID NO: 153747 - protein, 11 aa, West Nile virus
PVFVVASFLKA

SEQ ID NO: 153748 - protein, 11 aa, West Nile virus
VASFLKAGWTN

SEQ ID NO: 153749 - protein, 11 aa, West Nile virus
RWTNQENTLLM

SEQ ID NO: 153750 - protein, 11 aa, West Nile virus
LAAAFFQMAYH

SEQ ID NO: 153751 - protein, 11 aa, West Nile virus
AAAFFQMAYHD

SEQ ID NO: 153752 - protein, 11 aa, West Nile virus
AAFFQMAYHDA

SEQ ID NO: 153753 - protein, 11 aa, West Nile virus
AVAWMVLRAIS

SEQ ID NO: 153754 - protein, 11 aa, West Nile virus
IAWMILRAITF

SEQ ID NO: 153755 - protein, 11 aa, West Nile virus
PTTSNVVVPLL

SEQ ID NO: 153756 - protein, 11 aa, West Nile virus
RLRCLNLDVYR

SEQ ID NO: 153757 - protein, 11 aa, West Nile virus
RCLNLDVSRIL

SEQ ID NO: 153758 - protein, 11 aa, West Nile virus
LDVYRIVLLMI

SEQ ID NO: 153759 - protein, 11 aa, West Nile virus
DVYKILLLMVG

SEQ ID NO: 153760 - protein, 11 aa, West Nile virus
SRILLLMVGIG

SEQ ID NO: 153761 - protein, 11 aa, West Nile virus
LLMIGIGSLIK

SEQ ID NO: 153762 - protein, 11 aa, West Nile virus
LMIGIGSLIRE

SEQ ID NO: 153763 - protein, 11 aa, West Nile virus
EKRNAAAKKKG

SEQ ID NO: 153764 - protein, 11 aa, West Nile virus
KKNSAAKKKGA

SEQ ID NO: 153765 - protein, 11 aa, West Nile virus
FSPLVLAAGLI

SEQ ID NO: 153766 - protein, 11 aa, West Nile virus
LAAGLVACDPN

SEQ ID NO: 153767 - protein, 11 aa, West Nile virus
AAGLVACDPNR

SEQ ID NO: 153768 - protein, 11 aa, West Nile virus
AGLVACDPNRK

SEQ ID NO: 153769 - protein, 11 aa, West Nile virus
GLVACDPNRKR

SEQ ID NO: 153770 - protein, 11 aa, West Nile virus
LVACDPNRKRG

SEQ ID NO: 153771 - protein, 11 aa, West Nile virus
VACDPNRKRGW

SEQ ID NO: 153772 - protein, 11 aa, West Nile virus
IERTADISWEN

SEQ ID NO: 153773 - protein, 11 aa, West Nile virus
ERTANISWESD

SEQ ID NO: 153774 - protein, 11 aa, West Nile virus
ADISWENDAEI

SEQ ID NO: 153775 - protein, 11 aa, West Nile virus
DISWENDAEIT

SEQ ID NO: 153776 - protein, 11 aa, West Nile virus
ISWENDAEITG

SEQ ID NO: 153777 - protein, 11 aa, West Nile virus
WENDAEITGSS

SEQ ID NO: 153778 - protein, 11 aa, West Nile virus
ESDVEITGSSE

SEQ ID NO: 153779 - protein, 11 aa, West Nile virus
NDAEITGSSER

SEQ ID NO: 153780 - protein, 11 aa, West Nile virus
RLDDDGDFQLM

SEQ ID NO: 153781 - protein, 11 aa, West Nile virus
MVCLAVSAYTP

SEQ ID NO: 153782 - protein, 11 aa, West Nile virus
FCLAISAYTPW

SEQ ID NO: 153783 - protein, 11 aa, West Nile virus
LWDTPSPKVYK

SEQ ID NO: 153784 - protein, 11 aa, West Nile virus
EYRKGDTATGV

SEQ ID NO: 153785 - protein, 11 aa, West Nile virus
PWKLQHRWNGQ

SEQ ID NO: 153786 - protein, 11 aa, West Nile virus
WKLGHRWNGMD

SEQ ID NO: 153787 - protein, 11 aa, West Nile virus
KLGHRWNGMDE

SEQ ID NO: 153788 - protein, 11 aa, West Nile virus
LGHRWNGMDEV

SEQ ID NO: 153789 - protein, 11 aa, West Nile virus
QHRWNGQDEVQ

SEQ ID NO: 153790 - protein, 11 aa, West Nile virus
CKWNGQDEVQM

SEQ ID NO: 153791 - protein, 11 aa, West Nile virus
QGERMEEPVPS

SEQ ID NO: 153792 - protein, 11 aa, West Nile virus
GERMEEPPPVG

SEQ ID NO: 153793 - protein, 11 aa, West Nile virus
ERMEEPPPVGF

SEQ ID NO: 153794 - protein, 11 aa, West Nile virus
GFDPEMLRKKQ

SEQ ID NO: 153795 - protein, 11 aa, West Nile virus
FESEMLRKKQI

SEQ ID NO: 153796 - protein, 11 aa, West Nile virus
SEMLRKKQITV

SEQ ID NO: 153797 - protein, 11 aa, West Nile virus
LPQIIKEAISK

SEQ ID NO: 153798 - protein, 11 aa, West Nile virus
PQIIKEAMNRR

SEQ ID NO: 153799 - protein, 11 aa, West Nile virus
QIIKEAIDRRL

SEQ ID NO: 153800 - protein, 11 aa, West Nile virus
IIKEAMNRRLR

SEQ ID NO: 153801 - protein, 11 aa, West Nile virus
IKEAIDRRLRT

SEQ ID NO: 153802 - protein, 11 aa, West Nile virus
KEAIDRRLRTA

SEQ ID NO: 153803 - protein, 11 aa, West Nile virus
NRRLRTAILAP

SEQ ID NO: 153804 - protein, 11 aa, West Nile virus
LPIRYQTSAVN

SEQ ID NO: 153805 - protein, 11 aa, West Nile virus
PIRYHTSAVTR

SEQ ID NO: 153806 - protein, 11 aa, West Nile virus
IRYQTSAVNRE

SEQ ID NO: 153807 - protein, 11 aa, West Nile virus
RYQTSAVNREH

SEQ ID NO: 153808 - protein, 11 aa, West Nile virus
NSGYEWITEYA

SEQ ID NO: 153809 - protein, 11 aa, West Nile virus
AGYEWITEFVG

SEQ ID NO: 153810 - protein, 11 aa, West Nile virus
LCLQRAGKRVI

SEQ ID NO: 153811 - protein, 11 aa, West Nile virus
ITDGEGKVVLS

SEQ ID NO: 153812 - protein, 11 aa, West Nile virus
TDGESRVVLGE

SEQ ID NO: 153813 - protein, 11 aa, West Nile virus
DGEGKVVLSEP

SEQ ID NO: 153814 - protein, 11 aa, West Nile virus
GEARVILGEPS

SEQ ID NO: 153815 - protein, 11 aa, West Nile virus
ESRVVLGEPSA

SEQ ID NO: 153816 - protein, 11 aa, West Nile virus
GKVVLSEPSAI

SEQ ID NO: 153817 - protein, 11 aa, West Nile virus
FAHWTEARIMP

SEQ ID NO: 153818 - protein, 11 aa, West Nile virus
WLAYKVASAGI

SEQ ID NO: 153819 - protein, 11 aa, West Nile virus
KAAAAGVSYHD

SEQ ID NO: 153820 - protein, 11 aa, West Nile virus
ASAGISYHDRK

SEQ ID NO: 153821 - protein, 11 aa, West Nile virus
AAGVSYHDRKW

SEQ ID NO: 153822 - protein, 11 aa, West Nile virus
FASGKRSQVGL

SEQ ID NO: 153823 - protein, 11 aa, West Nile virus
GKRSQVGLIEV

SEQ ID NO: 153824 - protein, 11 aa, West Nile virus
KRSQVGLIEVL

SEQ ID NO: 153825 - protein, 11 aa, West Nile virus
RSQMGLIEVLG

SEQ ID NO: 153826 - protein, 11 aa, West Nile virus
SQMGLIEVLGK

SEQ ID NO: 153827 - protein, 11 aa, West Nile virus
QMGLIEVLGKM

SEQ ID NO: 153828 - protein, 11 aa, West Nile virus
MGLIEVLGKMP

SEQ ID NO: 153829 - protein, 11 aa, West Nile virus
TAEKGGRAHSM

SEQ ID NO: 153830 - protein, 11 aa, West Nile virus
AERGGRAHRSA

SEQ ID NO: 153831 - protein, 11 aa, West Nile virus
EKGRRAHRMAL

SEQ ID NO: 153832 - protein, 11 aa, West Nile virus
VMTMGIFFLLM

SEQ ID NO: 153833 - protein, 11 aa, West Nile virus
MTMGIFFLLMQ

SEQ ID NO: 153834 - protein, 11 aa, West Nile virus
SMGVFFLLMQR

SEQ ID NO: 153835 - protein, 11 aa, West Nile virus
KGVSKIGLAGV

SEQ ID NO: 153836 - protein, 11 aa, West Nile virus
IGVATFFCWMA

SEQ ID NO: 153837 - protein, 11 aa, West Nile virus
GVATLFCWMAE

SEQ ID NO: 153838 - protein, 11 aa, West Nile virus
VATLFCWMAEV

SEQ ID NO: 153839 - protein, 11 aa, West Nile virus
LAVFMICVMTL

SEQ ID NO: 153840 - protein, 11 aa, West Nile virus
AVFMICVMTLV

SEQ ID NO: 153841 - protein, 11 aa, West Nile virus
GEFFLDLRPAT

SEQ ID NO: 153842 - protein, 11 aa, West Nile virus
DLLLDLKPATA

SEQ ID NO: 153843 - protein, 11 aa, West Nile virus
AISTAFMTPLL

SEQ ID NO: 153844 - protein, 11 aa, West Nile virus
VATAVLTPLLK

SEQ ID NO: 153845 - protein, 11 aa, West Nile virus
TTAFLTPLLKH

SEQ ID NO: 153846 - protein, 11 aa, West Nile virus
TAVLTPLIKHL

SEQ ID NO: 153847 - protein, 11 aa, West Nile virus
AVLTPLIKHLI

SEQ ID NO: 153848 - protein, 11 aa, West Nile virus
FLTPLLKHLIT

SEQ ID NO: 153849 - protein, 11 aa, West Nile virus
ILLFCHYAYMV

SEQ ID NO: 153850 - protein, 11 aa, West Nile virus
PIMQKKIGQIM

SEQ ID NO: 153851 - protein, 11 aa, West Nile virus
IMQKKIGQIML

SEQ ID NO: 153852 - protein, 11 aa, West Nile virus
LILVSVAAVVV

SEQ ID NO: 153853 - protein, 11 aa, West Nile virus
ILVSVAAVVVN

SEQ ID NO: 153854 - protein, 11 aa, West Nile virus
WVSLAAVVVNP

SEQ ID NO: 153855 - protein, 11 aa, West Nile virus
ITAAAVTLWEK

SEQ ID NO: 153856 - protein, 11 aa, West Nile virus
RGGWLSCFSIT

SEQ ID NO: 153857 - protein, 11 aa, West Nile virus
GGWLSCFSITW

SEQ ID NO: 153858 - protein, 11 aa, West Nile virus
KNMEKPGIKRG

SEQ ID NO: 153859 - protein, 11 aa, West Nile virus
NMEKPGIKRGG

SEQ ID NO: 153860 - protein, 11 aa, West Nile virus
MEKPVLKRGGA

SEQ ID NO: 153861 - protein, 11 aa, West Nile virus
LGEVWKEKLNQ

SEQ ID NO: 153862 - protein, 11 aa, West Nile virus
GEVWKEKLNQM

SEQ ID NO: 153863 - protein, 11 aa, West Nile virus
EVWKEKLNQMS

SEQ ID NO: 153864 - protein, 11 aa, West Nile virus
TREEFTRYRKE

SEQ ID NO: 153865 - protein, 11 aa, West Nile virus
KEEFARYRKEA

SEQ ID NO: 153866 - protein, 11 aa, West Nile virus
EFTRYRREAIT

SEQ ID NO: 153867 - protein, 11 aa, West Nile virus
FARYRKEAITE

SEQ ID NO: 153868 - protein, 11 aa, West Nile virus
ARYRKEAITEV

SEQ ID NO: 153869 - protein, 11 aa, West Nile virus
AIIEVDRSTAK

SEQ ID NO: 153870 - protein, 11 aa, West Nile virus
ARKEGNVTGGY

SEQ ID NO: 153871 - protein, 11 aa, West Nile virus
GVDVFYRPSES

SEQ ID NO: 153872 - protein, 11 aa, West Nile virus
VDVFYRPSEVS

SEQ ID NO: 153873 - protein, 11 aa, West Nile virus
DVFYRPSESCD

SEQ ID NO: 153874 - protein, 11 aa, West Nile virus
VFYRTSEASDT

SEQ ID NO: 153875 - protein, 11 aa, West Nile virus
FYRPSEVSDTL

SEQ ID NO: 153876 - protein, 11 aa, West Nile virus
YRPSEVSDTLL

SEQ ID NO: 153877 - protein, 11 aa, West Nile virus
RPSEVSDTLLC

SEQ ID NO: 153878 - protein, 11 aa, West Nile virus
PSESCDTLLCD

SEQ ID NO: 153879 - protein, 11 aa, West Nile virus
YMPRVIEKMET

SEQ ID NO: 153880 - protein, 11 aa, West Nile virus
MPRVIEKMETL

SEQ ID NO: 153881 - protein, 11 aa, West Nile virus
PRVIEKMETLQ

SEQ ID NO: 153882 - protein, 11 aa, West Nile virus
VIEKMELLQLR

SEQ ID NO: 153883 - protein, 11 aa, West Nile virus
IEKMELLQLRY

SEQ ID NO: 153884 - protein, 11 aa, West Nile virus
MYWVSRASSNV

SEQ ID NO: 153885 - protein, 11 aa, West Nile virus
YWVSRASRNVV

SEQ ID NO: 153886 - protein, 11 aa, West Nile virus
WVSQASGNIVH

SEQ ID NO: 153887 - protein, 11 aa, West Nile virus
MEKRTWKGPQF

SEQ ID NO: 153888 - protein, 11 aa, West Nile virus
EKRTWKGPQFE

SEQ ID NO: 153889 - protein, 11 aa, West Nile virus
KRTWKGPQFEE

SEQ ID NO: 153890 - protein, 11 aa, West Nile virus
KTWKGPHYEED

SEQ ID NO: 153891 - protein, 11 aa, West Nile virus
WKGPQYEEDVS

SEQ ID NO: 153892 - protein, 11 aa, West Nile virus
KGPHYEEDVNL

SEQ ID NO: 153893 - protein, 11 aa, West Nile virus
GPHYEEDVNLG

SEQ ID NO: 153894 - protein, 11 aa, West Nile virus
PHYEEDVNLGS

SEQ ID NO: 153895 - protein, 11 aa, West Nile virus
GRPLLNSDTSK

SEQ ID NO: 153896 - protein, 11 aa, West Nile virus
KPLLSSDTSKI

SEQ ID NO: 153897 - protein, 11 aa, West Nile virus
PLLNSDTSRIK

SEQ ID NO: 153898 - protein, 11 aa, West Nile virus
DSNHPYRTWNY

SEQ ID NO: 153899 - protein, 11 aa, West Nile virus
VNHPYRTWNYH

SEQ ID NO: 153900 - protein, 11 aa, West Nile virus
REKKPRMCSRE

SEQ ID NO: 153901 - protein, 11 aa, West Nile virus
EKKPRMCSREE

SEQ ID NO: 153902 - protein, 11 aa, West Nile virus
PRMCSREEFIS

SEQ ID NO: 153903 - protein, 11 aa, West Nile virus
RMCSREEFISK

SEQ ID NO: 153904 - protein, 11 aa, West Nile virus
LCSREEFKRKV

SEQ ID NO: 153905 - protein, 11 aa, West Nile virus
CSREEFKRKVN

SEQ ID NO: 153906 - protein, 11 aa, West Nile virus
SREEFKRKVNS

SEQ ID NO: 153907 - protein, 11 aa, West Nile virus
EEQNQWRSARA

SEQ ID NO: 153908 - protein, 11 aa, West Nile virus
EQNQWRSARAA

SEQ ID NO: 153909 - protein, 11 aa, West Nile virus
QNQWRSARAAV

SEQ ID NO: 153910 - protein, 11 aa, West Nile virus
NQWRSARAAVE

SEQ ID NO: 153911 - protein, 11 aa, West Nile virus
QWRSARAAVED

SEQ ID NO: 153912 - protein, 11 aa, West Nile virus
SAREAVEDSTF

SEQ ID NO: 153913 - protein, 11 aa, West Nile virus
EDSTFWEMVDE

SEQ ID NO: 153914 - protein, 11 aa, West Nile virus
DQKFWEMVDEE

SEQ ID NO: 153915 - protein, 11 aa, West Nile virus
STFWEMVDEER

SEQ ID NO: 153916 - protein, 11 aa, West Nile virus
GGKTYADDTAG

SEQ ID NO: 153917 - protein, 11 aa, West Nile virus
GKIFADDTAGW

SEQ ID NO: 153918 - protein, 11 aa, West Nile virus
KIFADDTAGWD

SEQ ID NO: 153919 - protein, 11 aa, West Nile virus
ARAIIELTYRY

SEQ ID NO: 153920 - protein, 11 aa, West Nile virus
RAIIELTYRYK

SEQ ID NO: 153921 - protein, 11 aa, West Nile virus
SIIQLTYRHKV

SEQ ID NO: 153922 - protein, 11 aa, West Nile virus
PAADGKTVMDI

SEQ ID NO: 153923 - protein, 11 aa, West Nile virus
AADGKTVMSLI

SEQ ID NO: 153924 - protein, 11 aa, West Nile virus
ADGKTVMDIIS

SEQ ID NO: 153925 - protein, 11 aa, West Nile virus
DGKTVMDIISR

SEQ ID NO: 153926 - protein, 11 aa, West Nile virus
RREGEGVIGPY

SEQ ID NO: 153927 - protein, 11 aa, West Nile virus
REGEGVIGPDD

SEQ ID NO: 153928 - protein, 11 aa, West Nile virus
EGEGVIGPDDI

SEQ ID NO: 153929 - protein, 11 aa, West Nile virus
GEGVIGPDDIE

SEQ ID NO: 153930 - protein, 11 aa, West Nile virus
ATSLHFLNDMS

SEQ ID NO: 153931 - protein, 11 aa, West Nile virus
GGEWMTTEGML

SEQ ID NO: 153932 - protein, 11 aa, West Nile virus
TTEGMLEVWNR

SEQ ID NO: 153933 - protein, 11 aa, West Nile virus
TADMLGVWNKV

SEQ ID NO: 153934 - protein, 11 aa, West Nile virus
ADMLGVWNKVW

SEQ ID NO: 153935 - protein, 11 aa, West Nile virus
DMLGVWNKVWI

SEQ ID NO: 153936 - protein, 8 aa, Yellow fever virus
MSGRKAQG

SEQ ID NO: 153937 - protein, 8 aa, Yellow fever virus
SGRKAQGK

SEQ ID NO: 153938 - protein, 8 aa, Yellow fever virus
GRKAQGKT

SEQ ID NO: 153939 - protein, 8 aa, Yellow fever virus
RKAQGKTL

SEQ ID NO: 153940 - protein, 8 aa, Yellow fever virus
KAQGKTLG

SEQ ID NO: 153941 - protein, 8 aa, Yellow fever virus
AQGKTLGV

SEQ ID NO: 153942 - protein, 8 aa, Yellow fever virus
QGKTLGVN

SEQ ID NO: 153943 - protein, 8 aa, Yellow fever virus
GKTLGVNM

SEQ ID NO: 153944 - protein, 8 aa, Yellow fever virus
KTLGVNMV

SEQ ID NO: 153945 - protein, 8 aa, Yellow fever virus
TLGVNMVR

SEQ ID NO: 153946 - protein, 8 aa, Yellow fever virus
LGVNMVRR

SEQ ID NO: 153947 - protein, 8 aa, Yellow fever virus
GVNMVRRG

SEQ ID NO: 153948 - protein, 8 aa, Yellow fever virus
VNMVRRGV

SEQ ID NO: 153949 - protein, 8 aa, Yellow fever virus
NMVRRGVR

SEQ ID NO: 153950 - protein, 8 aa, Yellow fever virus
MVRRGVRS

SEQ ID NO: 153951 - protein, 8 aa, Yellow fever virus
VRRGVRSL

SEQ ID NO: 153952 - protein, 8 aa, Yellow fever virus
RRGVRSLS

SEQ ID NO: 153953 - protein, 8 aa, Yellow fever virus
RGVRSLSN

SEQ ID NO: 153954 - protein, 8 aa, Yellow fever virus
GVRSLSNK

SEQ ID NO: 153955 - protein, 8 aa, Yellow fever virus
VRSLSNKI

SEQ ID NO: 153956 - protein, 8 aa, Yellow fever virus
RSLSNKIK

SEQ ID NO: 153957 - protein, 8 aa, Yellow fever virus
SLSNKIKQ

SEQ ID NO: 153958 - protein, 8 aa, Yellow fever virus
LSNKIKQK

SEQ ID NO: 153959 - protein, 8 aa, Yellow fever virus
SNKIKQKT

SEQ ID NO: 153960 - protein, 8 aa, Yellow fever virus
NKIKQKTK

SEQ ID NO: 153961 - protein, 8 aa, Yellow fever virus
KIKQKTKQ

SEQ ID NO: 153962 - protein, 8 aa, Yellow fever virus
IKQKTKQI

SEQ ID NO: 153963 - protein, 8 aa, Yellow fever virus
KQKTKQIG

SEQ ID NO: 153964 - protein, 8 aa, Yellow fever virus
QKTKQIGN

SEQ ID NO: 153965 - protein, 8 aa, Yellow fever virus
KTKQIGNR

SEQ ID NO: 153966 - protein, 8 aa, Yellow fever virus
TKQIGNRP

SEQ ID NO: 153967 - protein, 8 aa, Yellow fever virus
KQIGNRPG

SEQ ID NO: 153968 - protein, 8 aa, Yellow fever virus
QIGNRPGP

SEQ ID NO: 153969 - protein, 8 aa, Yellow fever virus
IGNRPGPS

SEQ ID NO: 153970 - protein, 8 aa, Yellow fever virus
GNRPGPSR

SEQ ID NO: 153971 - protein, 8 aa, Yellow fever virus
NRPGPSRG

SEQ ID NO: 153972 - protein, 8 aa, Yellow fever virus
RPGPSRGV

SEQ ID NO: 153973 - protein, 8 aa, Yellow fever virus
PGPSRGVQ

SEQ ID NO: 153974 - protein, 8 aa, Yellow fever virus
GPSRGVQG

SEQ ID NO: 153975 - protein, 8 aa, Yellow fever virus
PSRGVQGF

SEQ ID NO: 153976 - protein, 8 aa, Yellow fever virus
SRGVQGFI

SEQ ID NO: 153977 - protein, 8 aa, Yellow fever virus
RGVQGFIF

SEQ ID NO: 153978 - protein, 8 aa, Yellow fever virus
GVQGFIFF

SEQ ID NO: 153979 - protein, 8 aa, Yellow fever virus
VQGFIFFF

SEQ ID NO: 153980 - protein, 8 aa, Yellow fever virus
QGFIFFFL

SEQ ID NO: 153981 - protein, 8 aa, Yellow fever virus
GFIFFFLF

SEQ ID NO: 153982 - protein, 8 aa, Yellow fever virus
FIFFFLFN

SEQ ID NO: 153983 - protein, 8 aa, Yellow fever virus
IFFFLFNI

SEQ ID NO: 153984 - protein, 8 aa, Yellow fever virus
FFFLFNIL

SEQ ID NO: 153985 - protein, 8 aa, Yellow fever virus
FFLFNILT

SEQ ID NO: 153986 - protein, 8 aa, Yellow fever virus
FLFNILTG

SEQ ID NO: 153987 - protein, 8 aa, Yellow fever virus
LFNILTGK

SEQ ID NO: 153988 - protein, 8 aa, Yellow fever virus
FNILTGKK

SEQ ID NO: 153989 - protein, 8 aa, Yellow fever virus
NILTGKKI

SEQ ID NO: 153990 - protein, 8 aa, Yellow fever virus
ILTGKKIT

SEQ ID NO: 153991 - protein, 8 aa, Yellow fever virus
LTGKKITA

SEQ ID NO: 153992 - protein, 8 aa, Yellow fever virus
TGKKITAH

SEQ ID NO: 153993 - protein, 8 aa, Yellow fever virus
GKKITAHL

SEQ ID NO: 153994 - protein, 8 aa, Yellow fever virus
KKITAHLK

SEQ ID NO: 153995 - protein, 8 aa, Yellow fever virus
KITAHLKR

SEQ ID NO: 153996 - protein, 8 aa, Yellow fever virus
ITAHLKRL

SEQ ID NO: 153997 - protein, 8 aa, Yellow fever virus
TAHLKRLW

SEQ ID NO: 153998 - protein, 8 aa, Yellow fever virus
AHLKRLWK

SEQ ID NO: 153999 - protein, 8 aa, Yellow fever virus
HLKRLWKM

SEQ ID NO: 154000 - protein, 8 aa, Yellow fever virus
LKRLWKML

SEQ ID NO: 154001 - protein, 8 aa, Yellow fever virus
KRLWKMLD

SEQ ID NO: 154002 - protein, 8 aa, Yellow fever virus
RLWKMLDP

SEQ ID NO: 154003 - protein, 8 aa, Yellow fever virus
LWKMLDPR

SEQ ID NO: 154004 - protein, 8 aa, Yellow fever virus
WKMLDPRQ

SEQ ID NO: 154005 - protein, 8 aa, Yellow fever virus
KMLDPRQG

SEQ ID NO: 154006 - protein, 8 aa, Yellow fever virus
MLDPRQGL

SEQ ID NO: 154007 - protein, 8 aa, Yellow fever virus
LDPRQGLA

SEQ ID NO: 154008 - protein, 8 aa, Yellow fever virus
DPRQGLAV

SEQ ID NO: 154009 - protein, 8 aa, Yellow fever virus
PRQGLAVL

SEQ ID NO: 154010 - protein, 8 aa, Yellow fever virus
RQGLAVLR

SEQ ID NO: 154011 - protein, 8 aa, Yellow fever virus
QGLAVLRK

SEQ ID NO: 154012 - protein, 8 aa, Yellow fever virus
GLAVLRKV

SEQ ID NO: 154013 - protein, 8 aa, Yellow fever virus
LAVLRKVK

SEQ ID NO: 154014 - protein, 8 aa, Yellow fever virus
AVLRKVKR

SEQ ID NO: 154015 - protein, 8 aa, Yellow fever virus
VLRKVKRV

SEQ ID NO: 154016 - protein, 8 aa, Yellow fever virus
LRKVKRVV

SEQ ID NO: 154017 - protein, 8 aa, Yellow fever virus
RKVKRVVA

SEQ ID NO: 154018 - protein, 8 aa, Yellow fever virus
KVKRVVAS

SEQ ID NO: 154019 - protein, 8 aa, Yellow fever virus
VKRVVASL

SEQ ID NO: 154020 - protein, 8 aa, Yellow fever virus
KRVVASLM

SEQ ID NO: 154021 - protein, 8 aa, Yellow fever virus
RVVASLMR

SEQ ID NO: 154022 - protein, 8 aa, Yellow fever virus
VVASLMRG

SEQ ID NO: 154023 - protein, 8 aa, Yellow fever virus
VASLMRGL

SEQ ID NO: 154024 - protein, 8 aa, Yellow fever virus
ASLMRGLS

SEQ ID NO: 154025 - protein, 8 aa, Yellow fever virus
SLMRGLSS

SEQ ID NO: 154026 - protein, 8 aa, Yellow fever virus
LMRGLSSR

SEQ ID NO: 154027 - protein, 8 aa, Yellow fever virus
MRGLSSRK

SEQ ID NO: 154028 - protein, 8 aa, Yellow fever virus
RGLSSRKR

SEQ ID NO: 154029 - protein, 8 aa, Yellow fever virus
GLSSRKRR

SEQ ID NO: 154030 - protein, 8 aa, Yellow fever virus
LSSRKRRS

SEQ ID NO: 154031 - protein, 8 aa, Yellow fever virus
SSRKRRSH

SEQ ID NO: 154032 - protein, 8 aa, Yellow fever virus
SRKRRSHD

SEQ ID NO: 154033 - protein, 8 aa, Yellow fever virus
RKRRSHDV

SEQ ID NO: 154034 - protein, 8 aa, Yellow fever virus
KRRSHDVL

SEQ ID NO: 154035 - protein, 8 aa, Yellow fever virus
TVQFLILG

SEQ ID NO: 154036 - protein, 8 aa, Yellow fever virus
VQFLILGM

SEQ ID NO: 154037 - protein, 8 aa, Yellow fever virus
QFLILGML

SEQ ID NO: 154038 - protein, 8 aa, Yellow fever virus
FLILGMLL

SEQ ID NO: 154039 - protein, 8 aa, Yellow fever virus
LILGMLLM

SEQ ID NO: 154040 - protein, 8 aa, Yellow fever virus
LMTGGVTL

SEQ ID NO: 154041 - protein, 8 aa, Yellow fever virus
TGGVTLVR

SEQ ID NO: 154042 - protein, 8 aa, Yellow fever virus
GGVTLVRK

SEQ ID NO: 154043 - protein, 8 aa, Yellow fever virus
GVTLVRKN

SEQ ID NO: 154044 - protein, 8 aa, Yellow fever virus
VTLVRKNR

SEQ ID NO: 154045 - protein, 8 aa, Yellow fever virus
TLVRKNRW

SEQ ID NO: 154046 - protein, 8 aa, Yellow fever virus
LVRKNRWL

SEQ ID NO: 154047 - protein, 8 aa, Yellow fever virus
VRKNRWLL

SEQ ID NO: 154048 - protein, 8 aa, Yellow fever virus
RKNRWLLL

SEQ ID NO: 154049 - protein, 8 aa, Yellow fever virus
KNRWLLLN

SEQ ID NO: 154050 - protein, 8 aa, Yellow fever virus
NRWLLLNV

SEQ ID NO: 154051 - protein, 8 aa, Yellow fever virus
RWLLLNVT

SEQ ID NO: 154052 - protein, 8 aa, Yellow fever virus
WLLLNVTS

SEQ ID NO: 154053 - protein, 8 aa, Yellow fever virus
LLLNVTSE

SEQ ID NO: 154054 - protein, 8 aa, Yellow fever virus
LLNVTSED

SEQ ID NO: 154055 - protein, 8 aa, Yellow fever virus
LNVTSEDL

SEQ ID NO: 154056 - protein, 8 aa, Yellow fever virus
NVTSEDLG

SEQ ID NO: 154057 - protein, 8 aa, Yellow fever virus
VTSEDLGK

SEQ ID NO: 154058 - protein, 8 aa, Yellow fever virus
TSEDLGKT

SEQ ID NO: 154059 - protein, 8 aa, Yellow fever virus
SEDLGKTF

SEQ ID NO: 154060 - protein, 8 aa, Yellow fever virus
EDLGKTFS

SEQ ID NO: 154061 - protein, 8 aa, Yellow fever virus
DLGKTFSV

SEQ ID NO: 154062 - protein, 8 aa, Yellow fever virus
LGKTFSVG

SEQ ID NO: 154063 - protein, 8 aa, Yellow fever virus
GKTFSVGT

SEQ ID NO: 154064 - protein, 8 aa, Yellow fever virus
KTFSVGTG

SEQ ID NO: 154065 - protein, 8 aa, Yellow fever virus
TFSVGTGN

SEQ ID NO: 154066 - protein, 8 aa, Yellow fever virus
FSVGTGNC

SEQ ID NO: 154067 - protein, 8 aa, Yellow fever virus
SVGTGNCT

SEQ ID NO: 154068 - protein, 8 aa, Yellow fever virus
VGTGNCTT

SEQ ID NO: 154069 - protein, 8 aa, Yellow fever virus
GTGNCTTN

SEQ ID NO: 154070 - protein, 8 aa, Yellow fever virus
TGNCTTNI

SEQ ID NO: 154071 - protein, 8 aa, Yellow fever virus
GNCTTNIL

SEQ ID NO: 154072 - protein, 8 aa, Yellow fever virus
NCTTNILE

SEQ ID NO: 154073 - protein, 8 aa, Yellow fever virus
CTTNILEA

SEQ ID NO: 154074 - protein, 8 aa, Yellow fever virus
TTNILEAK

SEQ ID NO: 154075 - protein, 8 aa, Yellow fever virus
TNILEAKY

SEQ ID NO: 154076 - protein, 8 aa, Yellow fever virus
NILEAKYW

SEQ ID NO: 154077 - protein, 8 aa, Yellow fever virus
ILEAKYWC

SEQ ID NO: 154078 - protein, 8 aa, Yellow fever virus
LEAKYWCP

SEQ ID NO: 154079 - protein, 8 aa, Yellow fever virus
EAKYWCPD

SEQ ID NO: 154080 - protein, 8 aa, Yellow fever virus
AKYWCPDS

SEQ ID NO: 154081 - protein, 8 aa, Yellow fever virus
KYWCPDSM

SEQ ID NO: 154082 - protein, 8 aa, Yellow fever virus
YWCPDSME

SEQ ID NO: 154083 - protein, 8 aa, Yellow fever virus
WCPDSMEY

SEQ ID NO: 154084 - protein, 8 aa, Yellow fever virus
CPDSMEYN

SEQ ID NO: 154085 - protein, 8 aa, Yellow fever virus
PDSMEYNC

SEQ ID NO: 154086 - protein, 8 aa, Yellow fever virus
DSMEYNCP

SEQ ID NO: 154087 - protein, 8 aa, Yellow fever virus
SMEYNCPN

SEQ ID NO: 154088 - protein, 8 aa, Yellow fever virus
MEYNCPNL

SEQ ID NO: 154089 - protein, 8 aa, Yellow fever virus
EYNCPNLS

SEQ ID NO: 154090 - protein, 8 aa, Yellow fever virus
YNCPNLSP

SEQ ID NO: 154091 - protein, 8 aa, Yellow fever virus
NCPNLSPR

SEQ ID NO: 154092 - protein, 8 aa, Yellow fever virus
CPNLSPRE

SEQ ID NO: 154093 - protein, 8 aa, Yellow fever virus
PNLSPREE

SEQ ID NO: 154094 - protein, 8 aa, Yellow fever virus
NLSPREEP

SEQ ID NO: 154095 - protein, 8 aa, Yellow fever virus
LSPREEPD

SEQ ID NO: 154096 - protein, 8 aa, Yellow fever virus
SPREEPDD

SEQ ID NO: 154097 - protein, 8 aa, Yellow fever virus
PREEPDDI

SEQ ID NO: 154098 - protein, 8 aa, Yellow fever virus
REEPDDID

SEQ ID NO: 154099 - protein, 8 aa, Yellow fever virus
EEPDDIDC

SEQ ID NO: 154100 - protein, 8 aa, Yellow fever virus
EPDDIDCW

SEQ ID NO: 154101 - protein, 8 aa, Yellow fever virus
PDDIDCWC

SEQ ID NO: 154102 - protein, 8 aa, Yellow fever virus
DDIDCWCY

SEQ ID NO: 154103 - protein, 8 aa, Yellow fever virus
DIDCWCYG

SEQ ID NO: 154104 - protein, 8 aa, Yellow fever virus
IDCWCYGV

SEQ ID NO: 154105 - protein, 8 aa, Yellow fever virus
DCWCYGVE

SEQ ID NO: 154106 - protein, 8 aa, Yellow fever virus
CWCYGVEN

SEQ ID NO: 154107 - protein, 8 aa, Yellow fever virus
WCYGVENV

SEQ ID NO: 154108 - protein, 8 aa, Yellow fever virus
CYGVENVR

SEQ ID NO: 154109 - protein, 8 aa, Yellow fever virus
YGVENVRV

SEQ ID NO: 154110 - protein, 8 aa, Yellow fever virus
GVENVRVA

SEQ ID NO: 154111 - protein, 8 aa, Yellow fever virus
VENVRVAY

SEQ ID NO: 154112 - protein, 8 aa, Yellow fever virus
ENVRVAYG

SEQ ID NO: 154113 - protein, 8 aa, Yellow fever virus
NVRVAYGK

SEQ ID NO: 154114 - protein, 8 aa, Yellow fever virus
VRVAYGKC

SEQ ID NO: 154115 - protein, 8 aa, Yellow fever virus
RVAYGKCD

SEQ ID NO: 154116 - protein, 8 aa, Yellow fever virus
VAYGKCDS

SEQ ID NO: 154117 - protein, 8 aa, Yellow fever virus
AYGKCDSA

SEQ ID NO: 154118 - protein, 8 aa, Yellow fever virus
YGKCDSAG

SEQ ID NO: 154119 - protein, 8 aa, Yellow fever virus
GKCDSAGR

SEQ ID NO: 154120 - protein, 8 aa, Yellow fever virus
KCDSAGRS

SEQ ID NO: 154121 - protein, 8 aa, Yellow fever virus
CDSAGRSR

SEQ ID NO: 154122 - protein, 8 aa, Yellow fever virus
DSAGRSRR

SEQ ID NO: 154123 - protein, 8 aa, Yellow fever virus
SAGRSRRS

SEQ ID NO: 154124 - protein, 8 aa, Yellow fever virus
AGRSRRSR

SEQ ID NO: 154125 - protein, 8 aa, Yellow fever virus
GRSRRSRR

SEQ ID NO: 154126 - protein, 8 aa, Yellow fever virus
RSRRSRRA

SEQ ID NO: 154127 - protein, 8 aa, Yellow fever virus
SRRSRRAI

SEQ ID NO: 154128 - protein, 8 aa, Yellow fever virus
RRSRRAID

SEQ ID NO: 154129 - protein, 8 aa, Yellow fever virus
RSRRAIDL

SEQ ID NO: 154130 - protein, 8 aa, Yellow fever virus
SRRAIDLP

SEQ ID NO: 154131 - protein, 8 aa, Yellow fever virus
RRAIDLPT

SEQ ID NO: 154132 - protein, 8 aa, Yellow fever virus
RAIDLPTH

SEQ ID NO: 154133 - protein, 8 aa, Yellow fever virus
AIDLPTHE

SEQ ID NO: 154134 - protein, 8 aa, Yellow fever virus
IDLPTHEN

SEQ ID NO: 154135 - protein, 8 aa, Yellow fever virus
DLPTHENH

SEQ ID NO: 154136 - protein, 8 aa, Yellow fever virus
LPTHENHG

SEQ ID NO: 154137 - protein, 8 aa, Yellow fever virus
PTHENHGL

SEQ ID NO: 154138 - protein, 8 aa, Yellow fever virus
THENHGLK

SEQ ID NO: 154139 - protein, 8 aa, Yellow fever virus
HENHGLKT

SEQ ID NO: 154140 - protein, 8 aa, Yellow fever virus
ENHGLKTR

SEQ ID NO: 154141 - protein, 8 aa, Yellow fever virus
NHGLKTRQ

SEQ ID NO: 154142 - protein, 8 aa, Yellow fever virus
HGLKTRQE

SEQ ID NO: 154143 - protein, 8 aa, Yellow fever virus
GLKTRQEK

SEQ ID NO: 154144 - protein, 8 aa, Yellow fever virus
LKTRQEKW

SEQ ID NO: 154145 - protein, 8 aa, Yellow fever virus
KTRQEKWM

SEQ ID NO: 154146 - protein, 8 aa, Yellow fever virus
TRQEKWMT

SEQ ID NO: 154147 - protein, 8 aa, Yellow fever virus
RQEKWMTG

SEQ ID NO: 154148 - protein, 8 aa, Yellow fever virus
QEKWMTGR

SEQ ID NO: 154149 - protein, 8 aa, Yellow fever virus
EKWMTGRM

SEQ ID NO: 154150 - protein, 8 aa, Yellow fever virus
KWMTGRMG

SEQ ID NO: 154151 - protein, 8 aa, Yellow fever virus
WMTGRMGE

SEQ ID NO: 154152 - protein, 8 aa, Yellow fever virus
MTGRMGER

SEQ ID NO: 154153 - protein, 8 aa, Yellow fever virus
TGRMGERQ

SEQ ID NO: 154154 - protein, 8 aa, Yellow fever virus
GRMGERQL

SEQ ID NO: 154155 - protein, 8 aa, Yellow fever virus
RMGERQLQ

SEQ ID NO: 154156 - protein, 8 aa, Yellow fever virus
MGERQLQK

SEQ ID NO: 154157 - protein, 8 aa, Yellow fever virus
GERQLQKI

SEQ ID NO: 154158 - protein, 8 aa, Yellow fever virus
ERQLQKIE

SEQ ID NO: 154159 - protein, 8 aa, Yellow fever virus
RQLQKIER

SEQ ID NO: 154160 - protein, 8 aa, Yellow fever virus
QLQKIERW

SEQ ID NO: 154161 - protein, 8 aa, Yellow fever virus
LQKIERWF

SEQ ID NO: 154162 - protein, 8 aa, Yellow fever virus
QKIERWFV

SEQ ID NO: 154163 - protein, 8 aa, Yellow fever virus
KIERWFVR

SEQ ID NO: 154164 - protein, 8 aa, Yellow fever virus
IERWFVRN

SEQ ID NO: 154165 - protein, 8 aa, Yellow fever virus
ERWFVRNP

SEQ ID NO: 154166 - protein, 8 aa, Yellow fever virus
RWFVRNPF

SEQ ID NO: 154167 - protein, 8 aa, Yellow fever virus
WFVRNPFF

SEQ ID NO: 154168 - protein, 8 aa, Yellow fever virus
FVRNPFFA

SEQ ID NO: 154169 - protein, 8 aa, Yellow fever virus
VRNPFFAV

SEQ ID NO: 154170 - protein, 8 aa, Yellow fever virus
RNPFFAVT

SEQ ID NO: 154171 - protein, 8 aa, Yellow fever virus
NPFFAVTA

SEQ ID NO: 154172 - protein, 8 aa, Yellow fever virus
PFFAVTAL

SEQ ID NO: 154173 - protein, 8 aa, Yellow fever virus
FFAVTALT

SEQ ID NO: 154174 - protein, 8 aa, Yellow fever virus
FAVTALTI

SEQ ID NO: 154175 - protein, 8 aa, Yellow fever virus
AVTALTIA

SEQ ID NO: 154176 - protein, 8 aa, Yellow fever virus
VTALTIAY

SEQ ID NO: 154177 - protein, 8 aa, Yellow fever virus
TALTIAYL

SEQ ID NO: 154178 - protein, 8 aa, Yellow fever virus
ALTIAYLV

SEQ ID NO: 154179 - protein, 8 aa, Yellow fever virus
LTIAYLVG

SEQ ID NO: 154180 - protein, 8 aa, Yellow fever virus
TIAYLVGS

SEQ ID NO: 154181 - protein, 8 aa, Yellow fever virus
IAYLVGSN

SEQ ID NO: 154182 - protein, 8 aa, Yellow fever virus
AYLVGSNM

SEQ ID NO: 154183 - protein, 8 aa, Yellow fever virus
YLVGSNMT

SEQ ID NO: 154184 - protein, 8 aa, Yellow fever virus
LVGSNMTQ

SEQ ID NO: 154185 - protein, 8 aa, Yellow fever virus
VGSNMTQR

SEQ ID NO: 154186 - protein, 8 aa, Yellow fever virus
GSNMTQRV

SEQ ID NO: 154187 - protein, 8 aa, Yellow fever virus
SNMTQRVV

SEQ ID NO: 154188 - protein, 8 aa, Yellow fever virus
NMTQRVVI

SEQ ID NO: 154189 - protein, 8 aa, Yellow fever virus
MTQRVVIA

SEQ ID NO: 154190 - protein, 8 aa, Yellow fever virus
TQRVVIAL

SEQ ID NO: 154191 - protein, 8 aa, Yellow fever virus
QRVVIALL

SEQ ID NO: 154192 - protein, 8 aa, Yellow fever virus
RVVIALLV

SEQ ID NO: 154193 - protein, 8 aa, Yellow fever virus
VVIALLVL

SEQ ID NO: 154194 - protein, 8 aa, Yellow fever virus
VIALLVLA

SEQ ID NO: 154195 - protein, 8 aa, Yellow fever virus
IALLVLAV

SEQ ID NO: 154196 - protein, 8 aa, Yellow fever virus
ALLVLAVG

SEQ ID NO: 154197 - protein, 8 aa, Yellow fever virus
LLVLAVGP

SEQ ID NO: 154198 - protein, 8 aa, Yellow fever virus
LVLAVGPA

SEQ ID NO: 154199 - protein, 8 aa, Yellow fever virus
VLAVGPAY

SEQ ID NO: 154200 - protein, 8 aa, Yellow fever virus
LAVGPAYS

SEQ ID NO: 154201 - protein, 8 aa, Yellow fever virus
AVGPAYSA

SEQ ID NO: 154202 - protein, 8 aa, Yellow fever virus
VGPAYSAH

SEQ ID NO: 154203 - protein, 8 aa, Yellow fever virus
GPAYSAHC

SEQ ID NO: 154204 - protein, 8 aa, Yellow fever virus
PAYSAHCI

SEQ ID NO: 154205 - protein, 8 aa, Yellow fever virus
AYSAHCIG

SEQ ID NO: 154206 - protein, 8 aa, Yellow fever virus
YSAHCIGI

SEQ ID NO: 154207 - protein, 8 aa, Yellow fever virus
SAHCIGIT

SEQ ID NO: 154208 - protein, 8 aa, Yellow fever virus
AHCIGITD

SEQ ID NO: 154209 - protein, 8 aa, Yellow fever virus
HCIGITDR

SEQ ID NO: 154210 - protein, 8 aa, Yellow fever virus
CIGITDRD

SEQ ID NO: 154211 - protein, 8 aa, Yellow fever virus
IGITDRDF

SEQ ID NO: 154212 - protein, 8 aa, Yellow fever virus
GITDRDFI

SEQ ID NO: 154213 - protein, 8 aa, Yellow fever virus
ITDRDFIE

SEQ ID NO: 154214 - protein, 8 aa, Yellow fever virus
TDRDFIEG

SEQ ID NO: 154215 - protein, 8 aa, Yellow fever virus
DRDFIEGV

SEQ ID NO: 154216 - protein, 8 aa, Yellow fever virus
RDFIEGVH

SEQ ID NO: 154217 - protein, 8 aa, Yellow fever virus
DFIEGVHG

SEQ ID NO: 154218 - protein, 8 aa, Yellow fever virus
FIEGVHGG

SEQ ID NO: 154219 - protein, 8 aa, Yellow fever virus
IEGVHGGT

SEQ ID NO: 154220 - protein, 8 aa, Yellow fever virus
EGVHGGTW

SEQ ID NO: 154221 - protein, 8 aa, Yellow fever virus
GVHGGTWV

SEQ ID NO: 154222 - protein, 8 aa, Yellow fever virus
VHGGTWVS

SEQ ID NO: 154223 - protein, 8 aa, Yellow fever virus
HGGTWVSA

SEQ ID NO: 154224 - protein, 8 aa, Yellow fever virus
GGTWVSAT

SEQ ID NO: 154225 - protein, 8 aa, Yellow fever virus
GTWVSATL

SEQ ID NO: 154226 - protein, 8 aa, Yellow fever virus
TWVSATLE

SEQ ID NO: 154227 - protein, 8 aa, Yellow fever virus
WVSATLEQ

SEQ ID NO: 154228 - protein, 8 aa, Yellow fever virus
VSATLEQD

SEQ ID NO: 154229 - protein, 8 aa, Yellow fever virus
SATLEQDK

SEQ ID NO: 154230 - protein, 8 aa, Yellow fever virus
ATLEQDKC

SEQ ID NO: 154231 - protein, 8 aa, Yellow fever virus
TLEQDKCV

SEQ ID NO: 154232 - protein, 8 aa, Yellow fever virus
LEQDKCVT

SEQ ID NO: 154233 - protein, 8 aa, Yellow fever virus
EQDKCVTV

SEQ ID NO: 154234 - protein, 8 aa, Yellow fever virus
QDKCVTVM

SEQ ID NO: 154235 - protein, 8 aa, Yellow fever virus
DKCVTVMA

SEQ ID NO: 154236 - protein, 8 aa, Yellow fever virus
KCVTVMAP

SEQ ID NO: 154237 - protein, 8 aa, Yellow fever virus
CVTVMAPD

SEQ ID NO: 154238 - protein, 8 aa, Yellow fever virus
VTVMAPDK

SEQ ID NO: 154239 - protein, 8 aa, Yellow fever virus
TVMAPDKP

SEQ ID NO: 154240 - protein, 8 aa, Yellow fever virus
VMAPDKPS

SEQ ID NO: 154241 - protein, 8 aa, Yellow fever virus
MAPDKPSL

SEQ ID NO: 154242 - protein, 8 aa, Yellow fever virus
APDKPSLD

SEQ ID NO: 154243 - protein, 8 aa, Yellow fever virus
PDKPSLDI

SEQ ID NO: 154244 - protein, 8 aa, Yellow fever virus
DKPSLDIS

SEQ ID NO: 154245 - protein, 8 aa, Yellow fever virus
KPSLDISL

SEQ ID NO: 154246 - protein, 8 aa, Yellow fever virus
PSLDISLE

SEQ ID NO: 154247 - protein, 8 aa, Yellow fever virus
SLDISLET

SEQ ID NO: 154248 - protein, 8 aa, Yellow fever virus
LDISLETV

SEQ ID NO: 154249 - protein, 8 aa, Yellow fever virus
DISLETVA

SEQ ID NO: 154250 - protein, 8 aa, Yellow fever virus
ISLETVAI

SEQ ID NO: 154251 - protein, 8 aa, Yellow fever virus
SLETVAID

SEQ ID NO: 154252 - protein, 8 aa, Yellow fever virus
LETVAIDR

SEQ ID NO: 154253 - protein, 8 aa, Yellow fever virus
ETVAIDRP

SEQ ID NO: 154254 - protein, 8 aa, Yellow fever virus
TVAIDRPA

SEQ ID NO: 154255 - protein, 8 aa, Yellow fever virus
VAIDRPAE

SEQ ID NO: 154256 - protein, 8 aa, Yellow fever virus
AIDRPAEV

SEQ ID NO: 154257 - protein, 8 aa, Yellow fever virus
IDRPAEVR

SEQ ID NO: 154258 - protein, 8 aa, Yellow fever virus
DRPAEVRK

SEQ ID NO: 154259 - protein, 8 aa, Yellow fever virus
RPAEVRKV

SEQ ID NO: 154260 - protein, 8 aa, Yellow fever virus
PAEVRKVC

SEQ ID NO: 154261 - protein, 8 aa, Yellow fever virus
AEVRKVCY

SEQ ID NO: 154262 - protein, 8 aa, Yellow fever virus
EVRKVCYN

SEQ ID NO: 154263 - protein, 8 aa, Yellow fever virus
VRKVCYNA

SEQ ID NO: 154264 - protein, 8 aa, Yellow fever virus
RKVCYNAV

SEQ ID NO: 154265 - protein, 8 aa, Yellow fever virus
KVCYNAVL

SEQ ID NO: 154266 - protein, 8 aa, Yellow fever virus
VCYNAVLT

SEQ ID NO: 154267 - protein, 8 aa, Yellow fever virus
CYNAVLTH

SEQ ID NO: 154268 - protein, 8 aa, Yellow fever virus
YNAVLTHV

SEQ ID NO: 154269 - protein, 8 aa, Yellow fever virus
NAVLTHVK

SEQ ID NO: 154270 - protein, 8 aa, Yellow fever virus
AVLTHVKI

SEQ ID NO: 154271 - protein, 8 aa, Yellow fever virus
VLTHVKIN

SEQ ID NO: 154272 - protein, 8 aa, Yellow fever virus
LTHVKIND

SEQ ID NO: 154273 - protein, 8 aa, Yellow fever virus
THVKINDK

SEQ ID NO: 154274 - protein, 8 aa, Yellow fever virus
HVKINDKC

SEQ ID NO: 154275 - protein, 8 aa, Yellow fever virus
VKINDKCP

SEQ ID NO: 154276 - protein, 8 aa, Yellow fever virus
KINDKCPS

SEQ ID NO: 154277 - protein, 8 aa, Yellow fever virus
INDKCPST

SEQ ID NO: 154278 - protein, 8 aa, Yellow fever virus
NDKCPSTG

SEQ ID NO: 154279 - protein, 8 aa, Yellow fever virus
DKCPSTGE

SEQ ID NO: 154280 - protein, 8 aa, Yellow fever virus
KCPSTGEA

SEQ ID NO: 154281 - protein, 8 aa, Yellow fever virus
CPSTGEAH

SEQ ID NO: 154282 - protein, 8 aa, Yellow fever virus
PSTGEAHL

SEQ ID NO: 154283 - protein, 8 aa, Yellow fever virus
STGEAHLA

SEQ ID NO: 154284 - protein, 8 aa, Yellow fever virus
TGEAHLAE

SEQ ID NO: 154285 - protein, 8 aa, Yellow fever virus
GEAHLAEE

SEQ ID NO: 154286 - protein, 8 aa, Yellow fever virus
EAHLAEEN

SEQ ID NO: 154287 - protein, 8 aa, Yellow fever virus
AHLAEENE

SEQ ID NO: 154288 - protein, 8 aa, Yellow fever virus
HLAEENEG

SEQ ID NO: 154289 - protein, 8 aa, Yellow fever virus
LAEENEGD

SEQ ID NO: 154290 - protein, 8 aa, Yellow fever virus
AEENEGDN

SEQ ID NO: 154291 - protein, 8 aa, Yellow fever virus
EENEGDNA

SEQ ID NO: 154292 - protein, 8 aa, Yellow fever virus
ENEGDNAC

SEQ ID NO: 154293 - protein, 8 aa, Yellow fever virus
NEGDNACK

SEQ ID NO: 154294 - protein, 8 aa, Yellow fever virus
EGDNACKR

SEQ ID NO: 154295 - protein, 8 aa, Yellow fever virus
GDNACKRT

SEQ ID NO: 154296 - protein, 8 aa, Yellow fever virus
DNACKRTY

SEQ ID NO: 154297 - protein, 8 aa, Yellow fever virus
NACKRTYS

SEQ ID NO: 154298 - protein, 8 aa, Yellow fever virus
ACKRTYSD

SEQ ID NO: 154299 - protein, 8 aa, Yellow fever virus
CKRTYSDR

SEQ ID NO: 154300 - protein, 8 aa, Yellow fever virus
KRTYSDRG

SEQ ID NO: 154301 - protein, 8 aa, Yellow fever virus
RTYSDRGW

SEQ ID NO: 154302 - protein, 8 aa, Yellow fever virus
TYSDRGWG

SEQ ID NO: 154303 - protein, 8 aa, Yellow fever virus
YSDRGWGN

SEQ ID NO: 154304 - protein, 8 aa, Yellow fever virus
SDRGWGNG

SEQ ID NO: 154305 - protein, 8 aa, Yellow fever virus
DRGWGNGC

SEQ ID NO: 154306 - protein, 8 aa, Yellow fever virus
RGWGNGCG

SEQ ID NO: 154307 - protein, 8 aa, Yellow fever virus
GWGNGCGL

SEQ ID NO: 154308 - protein, 8 aa, Yellow fever virus
WGNGCGLF

SEQ ID NO: 154309 - protein, 8 aa, Yellow fever virus
GNGCGLFG

SEQ ID NO: 154310 - protein, 8 aa, Yellow fever virus
NGCGLFGK

SEQ ID NO: 154311 - protein, 8 aa, Yellow fever virus
GCGLFGKG

SEQ ID NO: 154312 - protein, 8 aa, Yellow fever virus
CGLFGKGS

SEQ ID NO: 154313 - protein, 8 aa, Yellow fever virus
GLFGKGSI

SEQ ID NO: 154314 - protein, 8 aa, Yellow fever virus
LFGKGSIV

SEQ ID NO: 154315 - protein, 8 aa, Yellow fever virus
FGKGSIVA

SEQ ID NO: 154316 - protein, 8 aa, Yellow fever virus
GKGSIVAC

SEQ ID NO: 154317 - protein, 8 aa, Yellow fever virus
KGSIVACA

SEQ ID NO: 154318 - protein, 8 aa, Yellow fever virus
GSIVACAK

SEQ ID NO: 154319 - protein, 8 aa, Yellow fever virus
SIVACAKF

SEQ ID NO: 154320 - protein, 8 aa, Yellow fever virus
IVACAKFT

SEQ ID NO: 154321 - protein, 8 aa, Yellow fever virus
VACAKFTC

SEQ ID NO: 154322 - protein, 8 aa, Yellow fever virus
ACAKFTCA

SEQ ID NO: 154323 - protein, 8 aa, Yellow fever virus
CAKFTCAK

SEQ ID NO: 154324 - protein, 8 aa, Yellow fever virus
AKFTCAKS

SEQ ID NO: 154325 - protein, 8 aa, Yellow fever virus
KFTCAKSM

SEQ ID NO: 154326 - protein, 8 aa, Yellow fever virus
FTCAKSMS

SEQ ID NO: 154327 - protein, 8 aa, Yellow fever virus
TCAKSMSL

SEQ ID NO: 154328 - protein, 8 aa, Yellow fever virus
CAKSMSLF

SEQ ID NO: 154329 - protein, 8 aa, Yellow fever virus
AKSMSLFE

SEQ ID NO: 154330 - protein, 8 aa, Yellow fever virus
KSMSLFEV

SEQ ID NO: 154331 - protein, 8 aa, Yellow fever virus
SMSLFEVD

SEQ ID NO: 154332 - protein, 8 aa, Yellow fever virus
MSLFEVDQ

SEQ ID NO: 154333 - protein, 8 aa, Yellow fever virus
SLFEVDQT

SEQ ID NO: 154334 - protein, 8 aa, Yellow fever virus
LFEVDQTK

SEQ ID NO: 154335 - protein, 8 aa, Yellow fever virus
FEVDQTKI

SEQ ID NO: 154336 - protein, 8 aa, Yellow fever virus
EVDQTKIQ

SEQ ID NO: 154337 - protein, 8 aa, Yellow fever virus
VDQTKIQY

SEQ ID NO: 154338 - protein, 8 aa, Yellow fever virus
DQTKIQYV

SEQ ID NO: 154339 - protein, 8 aa, Yellow fever virus
QTKIQYVI

SEQ ID NO: 154340 - protein, 8 aa, Yellow fever virus
TKIQYVIR

SEQ ID NO: 154341 - protein, 8 aa, Yellow fever virus
KIQYVIRA

SEQ ID NO: 154342 - protein, 8 aa, Yellow fever virus
IQYVIRAQ

SEQ ID NO: 154343 - protein, 8 aa, Yellow fever virus
QYVIRAQL

SEQ ID NO: 154344 - protein, 8 aa, Yellow fever virus
YVIRAQLH

SEQ ID NO: 154345 - protein, 8 aa, Yellow fever virus
VIRAQLHV

SEQ ID NO: 154346 - protein, 8 aa, Yellow fever virus
IRAQLHVG

SEQ ID NO: 154347 - protein, 8 aa, Yellow fever virus
RAQLHVGA

SEQ ID NO: 154348 - protein, 8 aa, Yellow fever virus
AQLHVGAK

SEQ ID NO: 154349 - protein, 8 aa, Yellow fever virus
QLHVGAKQ

SEQ ID NO: 154350 - protein, 8 aa, Yellow fever virus
LHVGAKQE

SEQ ID NO: 154351 - protein, 8 aa, Yellow fever virus
HVGAKQEN

SEQ ID NO: 154352 - protein, 8 aa, Yellow fever virus
VGAKQENW

SEQ ID NO: 154353 - protein, 8 aa, Yellow fever virus
GAKQENWN

SEQ ID NO: 154354 - protein, 8 aa, Yellow fever virus
AKQENWNT

SEQ ID NO: 154355 - protein, 8 aa, Yellow fever virus
KQENWNTD

SEQ ID NO: 154356 - protein, 8 aa, Yellow fever virus
QENWNTDI

SEQ ID NO: 154357 - protein, 8 aa, Yellow fever virus
ENWNTDIK

SEQ ID NO: 154358 - protein, 8 aa, Yellow fever virus
NWNTDIKT

SEQ ID NO: 154359 - protein, 8 aa, Yellow fever virus
WNTDIKTL

SEQ ID NO: 154360 - protein, 8 aa, Yellow fever virus
NTDIKTLK

SEQ ID NO: 154361 - protein, 8 aa, Yellow fever virus
TDIKTLKF

SEQ ID NO: 154362 - protein, 8 aa, Yellow fever virus
DIKTLKFD

SEQ ID NO: 154363 - protein, 8 aa, Yellow fever virus
IKTLKFDA

SEQ ID NO: 154364 - protein, 8 aa, Yellow fever virus
KTLKFDAL

SEQ ID NO: 154365 - protein, 8 aa, Yellow fever virus
TLKFDALS

SEQ ID NO: 154366 - protein, 8 aa, Yellow fever virus
LKFDALSG

SEQ ID NO: 154367 - protein, 8 aa, Yellow fever virus
KFDALSGS

SEQ ID NO: 154368 - protein, 8 aa, Yellow fever virus
FDALSGSQ

SEQ ID NO: 154369 - protein, 8 aa, Yellow fever virus
DALSGSQE

SEQ ID NO: 154370 - protein, 8 aa, Yellow fever virus
ALSGSQEV

SEQ ID NO: 154371 - protein, 8 aa, Yellow fever virus
LSGSQEVE

SEQ ID NO: 154372 - protein, 8 aa, Yellow fever virus
SGSQEVEF

SEQ ID NO: 154373 - protein, 8 aa, Yellow fever virus
GSQEVEFI

SEQ ID NO: 154374 - protein, 8 aa, Yellow fever virus
SQEVEFIG

SEQ ID NO: 154375 - protein, 8 aa, Yellow fever virus
QEVEFIGY

SEQ ID NO: 154376 - protein, 8 aa, Yellow fever virus
EVEFIGYG

SEQ ID NO: 154377 - protein, 8 aa, Yellow fever virus
VEFIGYGK

SEQ ID NO: 154378 - protein, 8 aa, Yellow fever virus
EFIGYGKA

SEQ ID NO: 154379 - protein, 8 aa, Yellow fever virus
FIGYGKAT

SEQ ID NO: 154380 - protein, 8 aa, Yellow fever virus
IGYGKATL

SEQ ID NO: 154381 - protein, 8 aa, Yellow fever virus
GYGKATLE

SEQ ID NO: 154382 - protein, 8 aa, Yellow fever virus
YGKATLEC

SEQ ID NO: 154383 - protein, 8 aa, Yellow fever virus
GKATLECQ

SEQ ID NO: 154384 - protein, 8 aa, Yellow fever virus
KATLECQV

SEQ ID NO: 154385 - protein, 8 aa, Yellow fever virus
ATLECQVQ

SEQ ID NO: 154386 - protein, 8 aa, Yellow fever virus
TLECQVQT

SEQ ID NO: 154387 - protein, 8 aa, Yellow fever virus
LECQVQTA

SEQ ID NO: 154388 - protein, 8 aa, Yellow fever virus
ECQVQTAV

SEQ ID NO: 154389 - protein, 8 aa, Yellow fever virus
CQVQTAVD

SEQ ID NO: 154390 - protein, 8 aa, Yellow fever virus
QVQTAVDF

SEQ ID NO: 154391 - protein, 8 aa, Yellow fever virus
VQTAVDFG

SEQ ID NO: 154392 - protein, 8 aa, Yellow fever virus
QTAVDFGN

SEQ ID NO: 154393 - protein, 8 aa, Yellow fever virus
TAVDFGNS

SEQ ID NO: 154394 - protein, 8 aa, Yellow fever virus
AVDFGNSY

SEQ ID NO: 154395 - protein, 8 aa, Yellow fever virus
VDFGNSYI

SEQ ID NO: 154396 - protein, 8 aa, Yellow fever virus
DFGNSYIA

SEQ ID NO: 154397 - protein, 8 aa, Yellow fever virus
FGNSYIAE

SEQ ID NO: 154398 - protein, 8 aa, Yellow fever virus
GNSYIAEM

SEQ ID NO: 154399 - protein, 8 aa, Yellow fever virus
NSYIAEME

SEQ ID NO: 154400 - protein, 8 aa, Yellow fever virus
SYIAEMET

SEQ ID NO: 154401 - protein, 8 aa, Yellow fever virus
YIAEMETE

SEQ ID NO: 154402 - protein, 8 aa, Yellow fever virus
IAEMETES

SEQ ID NO: 154403 - protein, 8 aa, Yellow fever virus
AEMETESW

SEQ ID NO: 154404 - protein, 8 aa, Yellow fever virus
EMETESWI

SEQ ID NO: 154405 - protein, 8 aa, Yellow fever virus
METESWIV

SEQ ID NO: 154406 - protein, 8 aa, Yellow fever virus
ETESWIVD

SEQ ID NO: 154407 - protein, 8 aa, Yellow fever virus
TESWIVDR

SEQ ID NO: 154408 - protein, 8 aa, Yellow fever virus
ESWIVDRQ

SEQ ID NO: 154409 - protein, 8 aa, Yellow fever virus
SWIVDRQW

SEQ ID NO: 154410 - protein, 8 aa, Yellow fever virus
WIVDRQWA

SEQ ID NO: 154411 - protein, 8 aa, Yellow fever virus
IVDRQWAQ

SEQ ID NO: 154412 - protein, 8 aa, Yellow fever virus
VDRQWAQD

SEQ ID NO: 154413 - protein, 8 aa, Yellow fever virus
DRQWAQDL

SEQ ID NO: 154414 - protein, 8 aa, Yellow fever virus
RQWAQDLT

SEQ ID NO: 154415 - protein, 8 aa, Yellow fever virus
QWAQDLTL

SEQ ID NO: 154416 - protein, 8 aa, Yellow fever virus
WAQDLTLP

SEQ ID NO: 154417 - protein, 8 aa, Yellow fever virus
AQDLTLPW

SEQ ID NO: 154418 - protein, 8 aa, Yellow fever virus
QDLTLPWQ

SEQ ID NO: 154419 - protein, 8 aa, Yellow fever virus
DLTLPWQS

SEQ ID NO: 154420 - protein, 8 aa, Yellow fever virus
LTLPWQSG

SEQ ID NO: 154421 - protein, 8 aa, Yellow fever virus
TLPWQSGS

SEQ ID NO: 154422 - protein, 8 aa, Yellow fever virus
LPWQSGSG

SEQ ID NO: 154423 - protein, 8 aa, Yellow fever virus
PWQSGSGG

SEQ ID NO: 154424 - protein, 8 aa, Yellow fever virus
WQSGSGGV

SEQ ID NO: 154425 - protein, 8 aa, Yellow fever virus
QSGSGGVW

SEQ ID NO: 154426 - protein, 8 aa, Yellow fever virus
SGSGGVWR

SEQ ID NO: 154427 - protein, 8 aa, Yellow fever virus
GSGGVWRE

SEQ ID NO: 154428 - protein, 8 aa, Yellow fever virus
SGGVWREM

SEQ ID NO: 154429 - protein, 8 aa, Yellow fever virus
GGVWREMH

SEQ ID NO: 154430 - protein, 8 aa, Yellow fever virus
GVWREMHH

SEQ ID NO: 154431 - protein, 8 aa, Yellow fever virus
VWREMHHL

SEQ ID NO: 154432 - protein, 8 aa, Yellow fever virus
WREMHHLV

SEQ ID NO: 154433 - protein, 8 aa, Yellow fever virus
REMHHLVE

SEQ ID NO: 154434 - protein, 8 aa, Yellow fever virus
EMHHLVEF

SEQ ID NO: 154435 - protein, 8 aa, Yellow fever virus
MHHLVEFE

SEQ ID NO: 154436 - protein, 8 aa, Yellow fever virus
HHLVEFEP

SEQ ID NO: 154437 - protein, 8 aa, Yellow fever virus
HLVEFEPP

SEQ ID NO: 154438 - protein, 8 aa, Yellow fever virus
LVEFEPPH

SEQ ID NO: 154439 - protein, 8 aa, Yellow fever virus
VEFEPPHA

SEQ ID NO: 154440 - protein, 8 aa, Yellow fever virus
EFEPPHAA

SEQ ID NO: 154441 - protein, 8 aa, Yellow fever virus
FEPPHAAT

SEQ ID NO: 154442 - protein, 8 aa, Yellow fever virus
EPPHAATI

SEQ ID NO: 154443 - protein, 8 aa, Yellow fever virus
PPHAATIR

SEQ ID NO: 154444 - protein, 8 aa, Yellow fever virus
PHAATIRV

SEQ ID NO: 154445 - protein, 8 aa, Yellow fever virus
HAATIRVL

SEQ ID NO: 154446 - protein, 8 aa, Yellow fever virus
AATIRVLA

SEQ ID NO: 154447 - protein, 8 aa, Yellow fever virus
ATIRVLAL

SEQ ID NO: 154448 - protein, 8 aa, Yellow fever virus
TIRVLALG

SEQ ID NO: 154449 - protein, 8 aa, Yellow fever virus
IRVLALGN

SEQ ID NO: 154450 - protein, 8 aa, Yellow fever virus
RVLALGNQ

SEQ ID NO: 154451 - protein, 8 aa, Yellow fever virus
VLALGNQE

SEQ ID NO: 154452 - protein, 8 aa, Yellow fever virus
LALGNQEG

SEQ ID NO: 154453 - protein, 8 aa, Yellow fever virus
ALGNQEGS

SEQ ID NO: 154454 - protein, 8 aa, Yellow fever virus
LGNQEGSL

SEQ ID NO: 154455 - protein, 8 aa, Yellow fever virus
GNQEGSLK

SEQ ID NO: 154456 - protein, 8 aa, Yellow fever virus
NQEGSLKT

SEQ ID NO: 154457 - protein, 8 aa, Yellow fever virus
QEGSLKTA

SEQ ID NO: 154458 - protein, 8 aa, Yellow fever virus
EGSLKTAL

SEQ ID NO: 154459 - protein, 8 aa, Yellow fever virus
GSLKTALT

SEQ ID NO: 154460 - protein, 8 aa, Yellow fever virus
SLKTALTG

SEQ ID NO: 154461 - protein, 8 aa, Yellow fever virus
LKTALTGA

SEQ ID NO: 154462 - protein, 8 aa, Yellow fever virus
KTALTGAM

SEQ ID NO: 154463 - protein, 8 aa, Yellow fever virus
TALTGAMR

SEQ ID NO: 154464 - protein, 8 aa, Yellow fever virus
ALTGAMRV

SEQ ID NO: 154465 - protein, 8 aa, Yellow fever virus
LTGAMRVT

SEQ ID NO: 154466 - protein, 8 aa, Yellow fever virus
TGAMRVTK

SEQ ID NO: 154467 - protein, 8 aa, Yellow fever virus
GAMRVTKD

SEQ ID NO: 154468 - protein, 8 aa, Yellow fever virus
AMRVTKDT

SEQ ID NO: 154469 - protein, 8 aa, Yellow fever virus
MRVTKDTN

SEQ ID NO: 154470 - protein, 8 aa, Yellow fever virus
RVTKDTND

SEQ ID NO: 154471 - protein, 8 aa, Yellow fever virus
VTKDTNDN

SEQ ID NO: 154472 - protein, 8 aa, Yellow fever virus
TKDTNDNN

SEQ ID NO: 154473 - protein, 8 aa, Yellow fever virus
KDTNDNNL

SEQ ID NO: 154474 - protein, 8 aa, Yellow fever virus
DTNDNNLY

SEQ ID NO: 154475 - protein, 8 aa, Yellow fever virus
TNDNNLYK

SEQ ID NO: 154476 - protein, 8 aa, Yellow fever virus
NDNNLYKL

SEQ ID NO: 154477 - protein, 8 aa, Yellow fever virus
DNNLYKLH

SEQ ID NO: 154478 - protein, 8 aa, Yellow fever virus
NNLYKLHG

SEQ ID NO: 154479 - protein, 8 aa, Yellow fever virus
NLYKLHGG

SEQ ID NO: 154480 - protein, 8 aa, Yellow fever virus
LYKLHGGH

SEQ ID NO: 154481 - protein, 8 aa, Yellow fever virus
YKLHGGHV

SEQ ID NO: 154482 - protein, 8 aa, Yellow fever virus
KLHGGHVS

SEQ ID NO: 154483 - protein, 8 aa, Yellow fever virus
LHGGHVSC

SEQ ID NO: 154484 - protein, 8 aa, Yellow fever virus
HGGHVSCR

SEQ ID NO: 154485 - protein, 8 aa, Yellow fever virus
GGHVSCRV

SEQ ID NO: 154486 - protein, 8 aa, Yellow fever virus
GHVSCRVK

SEQ ID NO: 154487 - protein, 8 aa, Yellow fever virus
HVSCRVKL

SEQ ID NO: 154488 - protein, 8 aa, Yellow fever virus
VSCRVKLS

SEQ ID NO: 154489 - protein, 8 aa, Yellow fever virus
SCRVKLSA

SEQ ID NO: 154490 - protein, 8 aa, Yellow fever virus
CRVKLSAL

SEQ ID NO: 154491 - protein, 8 aa, Yellow fever virus
RVKLSALT

SEQ ID NO: 154492 - protein, 8 aa, Yellow fever virus
VKLSALTL

SEQ ID NO: 154493 - protein, 8 aa, Yellow fever virus
KLSALTLK

SEQ ID NO: 154494 - protein, 8 aa, Yellow fever virus
LSALTLKG

SEQ ID NO: 154495 - protein, 8 aa, Yellow fever virus
SALTLKGT

SEQ ID NO: 154496 - protein, 8 aa, Yellow fever virus
ALTLKGTS

SEQ ID NO: 154497 - protein, 8 aa, Yellow fever virus
LTLKGTSY

SEQ ID NO: 154498 - protein, 8 aa, Yellow fever virus
TLKGTSYK

SEQ ID NO: 154499 - protein, 8 aa, Yellow fever virus
LKGTSYKI

SEQ ID NO: 154500 - protein, 8 aa, Yellow fever virus
KGTSYKIC

SEQ ID NO: 154501 - protein, 8 aa, Yellow fever virus
GTSYKICT

SEQ ID NO: 154502 - protein, 8 aa, Yellow fever virus
TSYKICTD

SEQ ID NO: 154503 - protein, 8 aa, Yellow fever virus
SYKICTDK

SEQ ID NO: 154504 - protein, 8 aa, Yellow fever virus
YKICTDKM

SEQ ID NO: 154505 - protein, 8 aa, Yellow fever virus
KICTDKMF

SEQ ID NO: 154506 - protein, 8 aa, Yellow fever virus
ICTDKMFF

SEQ ID NO: 154507 - protein, 8 aa, Yellow fever virus
CTDKMFFV

SEQ ID NO: 154508 - protein, 8 aa, Yellow fever virus
TDKMFFVK

SEQ ID NO: 154509 - protein, 8 aa, Yellow fever virus
DKMFFVKN

SEQ ID NO: 154510 - protein, 8 aa, Yellow fever virus
KMFFVKNP

SEQ ID NO: 154511 - protein, 8 aa, Yellow fever virus
MFFVKNPT

SEQ ID NO: 154512 - protein, 8 aa, Yellow fever virus
FFVKNPTD

SEQ ID NO: 154513 - protein, 8 aa, Yellow fever virus
FVKNPTDT

SEQ ID NO: 154514 - protein, 8 aa, Yellow fever virus
VKNPTDTG

SEQ ID NO: 154515 - protein, 8 aa, Yellow fever virus
KNPTDTGH

SEQ ID NO: 154516 - protein, 8 aa, Yellow fever virus
NPTDTGHG

SEQ ID NO: 154517 - protein, 8 aa, Yellow fever virus
PTDTGHGT

SEQ ID NO: 154518 - protein, 8 aa, Yellow fever virus
TDTGHGTV

SEQ ID NO: 154519 - protein, 8 aa, Yellow fever virus
DTGHGTVV

SEQ ID NO: 154520 - protein, 8 aa, Yellow fever virus
TGHGTVVM

SEQ ID NO: 154521 - protein, 8 aa, Yellow fever virus
GHGTVVMQ

SEQ ID NO: 154522 - protein, 8 aa, Yellow fever virus
HGTVVMQV

SEQ ID NO: 154523 - protein, 8 aa, Yellow fever virus
GTVVMQVK

SEQ ID NO: 154524 - protein, 8 aa, Yellow fever virus
TVVMQVKV

SEQ ID NO: 154525 - protein, 8 aa, Yellow fever virus
VVMQVKVP

SEQ ID NO: 154526 - protein, 8 aa, Yellow fever virus
VMQVKVPK

SEQ ID NO: 154527 - protein, 8 aa, Yellow fever virus
MQVKVPKG

SEQ ID NO: 154528 - protein, 8 aa, Yellow fever virus
QVKVPKGA

SEQ ID NO: 154529 - protein, 8 aa, Yellow fever virus
VKVPKGAP

SEQ ID NO: 154530 - protein, 8 aa, Yellow fever virus
KVPKGAPC

SEQ ID NO: 154531 - protein, 8 aa, Yellow fever virus
VSKGAPCR

SEQ ID NO: 154532 - protein, 8 aa, Yellow fever virus
SKGAPCRI

SEQ ID NO: 154533 - protein, 8 aa, Yellow fever virus
KGAPCRIP

SEQ ID NO: 154534 - protein, 8 aa, Yellow fever virus
GAPCRIPV

SEQ ID NO: 154535 - protein, 8 aa, Yellow fever virus
APCRIPVI

SEQ ID NO: 154536 - protein, 8 aa, Yellow fever virus
PCRIPVIV

SEQ ID NO: 154537 - protein, 8 aa, Yellow fever virus
CRIPVIVA

SEQ ID NO: 154538 - protein, 8 aa, Yellow fever virus
RIPVIVAD

SEQ ID NO: 154539 - protein, 8 aa, Yellow fever virus
IPVIVADD

SEQ ID NO: 154540 - protein, 8 aa, Yellow fever virus
PVIVADDL

SEQ ID NO: 154541 - protein, 8 aa, Yellow fever virus
VIVADDLT

SEQ ID NO: 154542 - protein, 8 aa, Yellow fever virus
IVADDLTA

SEQ ID NO: 154543 - protein, 8 aa, Yellow fever virus
VADDLTAA

SEQ ID NO: 154544 - protein, 8 aa, Yellow fever virus
ADDLTAAI

SEQ ID NO: 154545 - protein, 8 aa, Yellow fever virus
DDLTAAIN

SEQ ID NO: 154546 - protein, 8 aa, Yellow fever virus
DLTAAINK

SEQ ID NO: 154547 - protein, 8 aa, Yellow fever virus
LTAAINKG

SEQ ID NO: 154548 - protein, 8 aa, Yellow fever virus
TAAINKGI

SEQ ID NO: 154549 - protein, 8 aa, Yellow fever virus
AAINKGIL

SEQ ID NO: 154550 - protein, 8 aa, Yellow fever virus
AINKGILV

SEQ ID NO: 154551 - protein, 8 aa, Yellow fever virus
INKGILVT

SEQ ID NO: 154552 - protein, 8 aa, Yellow fever virus
NKGILVTV

SEQ ID NO: 154553 - protein, 8 aa, Yellow fever virus
KGILVTVN

SEQ ID NO: 154554 - protein, 8 aa, Yellow fever virus
GILVTVNP

SEQ ID NO: 154555 - protein, 8 aa, Yellow fever virus
ILVTVNPI

SEQ ID NO: 154556 - protein, 8 aa, Yellow fever virus
LVTVNPIA

SEQ ID NO: 154557 - protein, 8 aa, Yellow fever virus
VTVNPIAS

SEQ ID NO: 154558 - protein, 8 aa, Yellow fever virus
TVNPIAST

SEQ ID NO: 154559 - protein, 8 aa, Yellow fever virus
VNPIASTN

SEQ ID NO: 154560 - protein, 8 aa, Yellow fever virus
NPIASTND

SEQ ID NO: 154561 - protein, 8 aa, Yellow fever virus
PIASTNDD

SEQ ID NO: 154562 - protein, 8 aa, Yellow fever virus
IASTNDDE

SEQ ID NO: 154563 - protein, 8 aa, Yellow fever virus
ASTNDDEV

SEQ ID NO: 154564 - protein, 8 aa, Yellow fever virus
STNDDEVL

SEQ ID NO: 154565 - protein, 8 aa, Yellow fever virus
TNDDEVLI

SEQ ID NO: 154566 - protein, 8 aa, Yellow fever virus
NDDEVLIE

SEQ ID NO: 154567 - protein, 8 aa, Yellow fever virus
DDEVLIEV

SEQ ID NO: 154568 - protein, 8 aa, Yellow fever virus
DEVLIEVN

SEQ ID NO: 154569 - protein, 8 aa, Yellow fever virus
EVLIEVNP

SEQ ID NO: 154570 - protein, 8 aa, Yellow fever virus
VLIEVNPP

SEQ ID NO: 154571 - protein, 8 aa, Yellow fever virus
LIEVNPPF

SEQ ID NO: 154572 - protein, 8 aa, Yellow fever virus
IEVNPPFG

SEQ ID NO: 154573 - protein, 8 aa, Yellow fever virus
EVNPPFGD

SEQ ID NO: 154574 - protein, 8 aa, Yellow fever virus
VNPPFGDS

SEQ ID NO: 154575 - protein, 8 aa, Yellow fever virus
NPPFGDSY

SEQ ID NO: 154576 - protein, 8 aa, Yellow fever virus
PPFGDSYI

SEQ ID NO: 154577 - protein, 8 aa, Yellow fever virus
PFGDSYII

SEQ ID NO: 154578 - protein, 8 aa, Yellow fever virus
FGDSYIIV

SEQ ID NO: 154579 - protein, 8 aa, Yellow fever virus
GDSYIIVG

SEQ ID NO: 154580 - protein, 8 aa, Yellow fever virus
DSYIIVGR

SEQ ID NO: 154581 - protein, 8 aa, Yellow fever virus
SYIIVGRG

SEQ ID NO: 154582 - protein, 8 aa, Yellow fever virus
YIIVGRGD

SEQ ID NO: 154583 - protein, 8 aa, Yellow fever virus
IIVGRGDS

SEQ ID NO: 154584 - protein, 8 aa, Yellow fever virus
IVGRGDSR

SEQ ID NO: 154585 - protein, 8 aa, Yellow fever virus
VGRGDSRL

SEQ ID NO: 154586 - protein, 8 aa, Yellow fever virus
GRGDSRLT

SEQ ID NO: 154587 - protein, 8 aa, Yellow fever virus
RGDSRLTY

SEQ ID NO: 154588 - protein, 8 aa, Yellow fever virus
GDSRLTYQ

SEQ ID NO: 154589 - protein, 8 aa, Yellow fever virus
DSRLTYQW

SEQ ID NO: 154590 - protein, 8 aa, Yellow fever virus
SRLTYQWH

SEQ ID NO: 154591 - protein, 8 aa, Yellow fever virus
RLTYQWHK

SEQ ID NO: 154592 - protein, 8 aa, Yellow fever virus
LTYQWHKE

SEQ ID NO: 154593 - protein, 8 aa, Yellow fever virus
TYQWHKEG

SEQ ID NO: 154594 - protein, 8 aa, Yellow fever virus
YQWHKEGS

SEQ ID NO: 154595 - protein, 8 aa, Yellow fever virus
QWHKEGSS

SEQ ID NO: 154596 - protein, 8 aa, Yellow fever virus
WHKEGSSI

SEQ ID NO: 154597 - protein, 8 aa, Yellow fever virus
HKEGSSIG

SEQ ID NO: 154598 - protein, 8 aa, Yellow fever virus
KEGSSIGK

SEQ ID NO: 154599 - protein, 8 aa, Yellow fever virus
EGSSIGKL

SEQ ID NO: 154600 - protein, 8 aa, Yellow fever virus
GSSIGKLF

SEQ ID NO: 154601 - protein, 8 aa, Yellow fever virus
SSIGKLFT

SEQ ID NO: 154602 - protein, 8 aa, Yellow fever virus
SIGKLFTQ

SEQ ID NO: 154603 - protein, 8 aa, Yellow fever virus
IGKLFTQT

SEQ ID NO: 154604 - protein, 8 aa, Yellow fever virus
GKLFTQTM

SEQ ID NO: 154605 - protein, 8 aa, Yellow fever virus
KLFTQTMK

SEQ ID NO: 154606 - protein, 8 aa, Yellow fever virus
LFTQTMKG

SEQ ID NO: 154607 - protein, 8 aa, Yellow fever virus
FTQTMKGV

SEQ ID NO: 154608 - protein, 8 aa, Yellow fever virus
TQTMKGVE

SEQ ID NO: 154609 - protein, 8 aa, Yellow fever virus
QTMKGVER

SEQ ID NO: 154610 - protein, 8 aa, Yellow fever virus
TMKGVERL

SEQ ID NO: 154611 - protein, 8 aa, Yellow fever virus
MKGVERLA

SEQ ID NO: 154612 - protein, 8 aa, Yellow fever virus
KGVERLAV

SEQ ID NO: 154613 - protein, 8 aa, Yellow fever virus
GVERLAVM

SEQ ID NO: 154614 - protein, 8 aa, Yellow fever virus
VERLAVMG

SEQ ID NO: 154615 - protein, 8 aa, Yellow fever virus
ERLAVMGD

SEQ ID NO: 154616 - protein, 8 aa, Yellow fever virus
RLAVMGDT

SEQ ID NO: 154617 - protein, 8 aa, Yellow fever virus
LAVMGDTA

SEQ ID NO: 154618 - protein, 8 aa, Yellow fever virus
AVMGDTAW

SEQ ID NO: 154619 - protein, 8 aa, Yellow fever virus
VMGDTAWD

SEQ ID NO: 154620 - protein, 8 aa, Yellow fever virus
MGDTAWDF

SEQ ID NO: 154621 - protein, 8 aa, Yellow fever virus
GDTAWDFS

SEQ ID NO: 154622 - protein, 8 aa, Yellow fever virus
DTAWDFSS

SEQ ID NO: 154623 - protein, 8 aa, Yellow fever virus
TAWDFSSA

SEQ ID NO: 154624 - protein, 8 aa, Yellow fever virus
AWDFSSAG

SEQ ID NO: 154625 - protein, 8 aa, Yellow fever virus
WDFSSAGG

SEQ ID NO: 154626 - protein, 8 aa, Yellow fever virus
DFSSAGGF

SEQ ID NO: 154627 - protein, 8 aa, Yellow fever virus
FSSAGGFF

SEQ ID NO: 154628 - protein, 8 aa, Yellow fever virus
SSAGGFFT

SEQ ID NO: 154629 - protein, 8 aa, Yellow fever virus
SAGGFFTS

SEQ ID NO: 154630 - protein, 8 aa, Yellow fever virus
AGGFFTSV

SEQ ID NO: 154631 - protein, 8 aa, Yellow fever virus
GGFFTSVG

SEQ ID NO: 154632 - protein, 8 aa, Yellow fever virus
GFFTSVGK

SEQ ID NO: 154633 - protein, 8 aa, Yellow fever virus
FFTSVGKG

SEQ ID NO: 154634 - protein, 8 aa, Yellow fever virus
FTSVGKGI

SEQ ID NO: 154635 - protein, 8 aa, Yellow fever virus
TSVGKGIH

SEQ ID NO: 154636 - protein, 8 aa, Yellow fever virus
SVGKGIHT

SEQ ID NO: 154637 - protein, 8 aa, Yellow fever virus
VGKGIHTV

SEQ ID NO: 154638 - protein, 8 aa, Yellow fever virus
GKGIHTVF

SEQ ID NO: 154639 - protein, 8 aa, Yellow fever virus
KGIHTVFG

SEQ ID NO: 154640 - protein, 8 aa, Yellow fever virus
GIHTVFGS

SEQ ID NO: 154641 - protein, 8 aa, Yellow fever virus
IHTVFGSA

SEQ ID NO: 154642 - protein, 8 aa, Yellow fever virus
HTVFGSAF

SEQ ID NO: 154643 - protein, 8 aa, Yellow fever virus
TVFGSAFQ

SEQ ID NO: 154644 - protein, 8 aa, Yellow fever virus
VFGSAFQG

SEQ ID NO: 154645 - protein, 8 aa, Yellow fever virus
FGSAFQGL

SEQ ID NO: 154646 - protein, 8 aa, Yellow fever virus
GSAFQGLF

SEQ ID NO: 154647 - protein, 8 aa, Yellow fever virus
SAFQGLFG

SEQ ID NO: 154648 - protein, 8 aa, Yellow fever virus
AFQGLFGG

SEQ ID NO: 154649 - protein, 8 aa, Yellow fever virus
FQGLFGGL

SEQ ID NO: 154650 - protein, 8 aa, Yellow fever virus
QGLFGGLN

SEQ ID NO: 154651 - protein, 8 aa, Yellow fever virus
GLFGGLNW

SEQ ID NO: 154652 - protein, 8 aa, Yellow fever virus
LFGGLNWI

SEQ ID NO: 154653 - protein, 8 aa, Yellow fever virus
FGGLNWIT

SEQ ID NO: 154654 - protein, 8 aa, Yellow fever virus
GGLNWITK

SEQ ID NO: 154655 - protein, 8 aa, Yellow fever virus
GLNWITKV

SEQ ID NO: 154656 - protein, 8 aa, Yellow fever virus
LNWITKVI

SEQ ID NO: 154657 - protein, 8 aa, Yellow fever virus
NWITKVIM

SEQ ID NO: 154658 - protein, 8 aa, Yellow fever virus
WITKVIMG

SEQ ID NO: 154659 - protein, 8 aa, Yellow fever virus
ITKVIMGA

SEQ ID NO: 154660 - protein, 8 aa, Yellow fever virus
TKVIMGAV

SEQ ID NO: 154661 - protein, 8 aa, Yellow fever virus
KVIMGAVL

SEQ ID NO: 154662 - protein, 8 aa, Yellow fever virus
VIMGAVLI

SEQ ID NO: 154663 - protein, 8 aa, Yellow fever virus
IMGAVLIW

SEQ ID NO: 154664 - protein, 8 aa, Yellow fever virus
MGAVLIWV

SEQ ID NO: 154665 - protein, 8 aa, Yellow fever virus
GAVLIWVG

SEQ ID NO: 154666 - protein, 8 aa, Yellow fever virus
AVLIWVGI

SEQ ID NO: 154667 - protein, 8 aa, Yellow fever virus
VLIWVGIN

SEQ ID NO: 154668 - protein, 8 aa, Yellow fever virus
LIWVGINT

SEQ ID NO: 154669 - protein, 8 aa, Yellow fever virus
IWVGINTR

SEQ ID NO: 154670 - protein, 8 aa, Yellow fever virus
WVGINTRN

SEQ ID NO: 154671 - protein, 8 aa, Yellow fever virus
VGINTRNM

SEQ ID NO: 154672 - protein, 8 aa, Yellow fever virus
GINTRNMT

SEQ ID NO: 154673 - protein, 8 aa, Yellow fever virus
INTRNMTM

SEQ ID NO: 154674 - protein, 8 aa, Yellow fever virus
NTRNMTMS

SEQ ID NO: 154675 - protein, 8 aa, Yellow fever virus
TRNMTMSM

SEQ ID NO: 154676 - protein, 8 aa, Yellow fever virus
RNMTMSMS

SEQ ID NO: 154677 - protein, 8 aa, Yellow fever virus
NMTMSMSM

SEQ ID NO: 154678 - protein, 8 aa, Yellow fever virus
MTMSMSMI

SEQ ID NO: 154679 - protein, 8 aa, Yellow fever virus
TMSMSMIL

SEQ ID NO: 154680 - protein, 8 aa, Yellow fever virus
MSMSMILV

SEQ ID NO: 154681 - protein, 8 aa, Yellow fever virus
SMSMILVG

SEQ ID NO: 154682 - protein, 8 aa, Yellow fever virus
MSMILVGV

SEQ ID NO: 154683 - protein, 8 aa, Yellow fever virus
SMILVGVI

SEQ ID NO: 154684 - protein, 8 aa, Yellow fever virus
MILVGVIM

SEQ ID NO: 154685 - protein, 8 aa, Yellow fever virus
ILVGVIMM

SEQ ID NO: 154686 - protein, 8 aa, Yellow fever virus
LVGVIMMF

SEQ ID NO: 154687 - protein, 8 aa, Yellow fever virus
VGVIMMFL

SEQ ID NO: 154688 - protein, 8 aa, Yellow fever virus
GVIMMFLS

SEQ ID NO: 154689 - protein, 8 aa, Yellow fever virus
VIMMFLSL

SEQ ID NO: 154690 - protein, 8 aa, Yellow fever virus
IMMFLSLG

SEQ ID NO: 154691 - protein, 8 aa, Yellow fever virus
MMFLSLGV

SEQ ID NO: 154692 - protein, 8 aa, Yellow fever virus
MFLSLGVG

SEQ ID NO: 154693 - protein, 8 aa, Yellow fever virus
FLSLGVGA

SEQ ID NO: 154694 - protein, 8 aa, Yellow fever virus
LSLGVGAD

SEQ ID NO: 154695 - protein, 8 aa, Yellow fever virus
SLGVGADQ

SEQ ID NO: 154696 - protein, 8 aa, Yellow fever virus
LGVGADQG

SEQ ID NO: 154697 - protein, 8 aa, Yellow fever virus
GVGADQGC

SEQ ID NO: 154698 - protein, 8 aa, Yellow fever virus
VGADQGCA

SEQ ID NO: 154699 - protein, 8 aa, Yellow fever virus
GADQGCAI

SEQ ID NO: 154700 - protein, 8 aa, Yellow fever virus
ADQGCAIN

SEQ ID NO: 154701 - protein, 8 aa, Yellow fever virus
DQGCAINF

SEQ ID NO: 154702 - protein, 8 aa, Yellow fever virus
QGCAINFG

SEQ ID NO: 154703 - protein, 8 aa, Yellow fever virus
GCAINFGK

SEQ ID NO: 154704 - protein, 8 aa, Yellow fever virus
CAINFGKR

SEQ ID NO: 154705 - protein, 8 aa, Yellow fever virus
AINFGKRE

SEQ ID NO: 154706 - protein, 8 aa, Yellow fever virus
INFGKREL

SEQ ID NO: 154707 - protein, 8 aa, Yellow fever virus
NFGKRELK

SEQ ID NO: 154708 - protein, 8 aa, Yellow fever virus
FGKRELKC

SEQ ID NO: 154709 - protein, 8 aa, Yellow fever virus
GKRELKCG

SEQ ID NO: 154710 - protein, 8 aa, Yellow fever virus
KRELKCGD

SEQ ID NO: 154711 - protein, 8 aa, Yellow fever virus
RELKCGDG

SEQ ID NO: 154712 - protein, 8 aa, Yellow fever virus
ELKCGDGI

SEQ ID NO: 154713 - protein, 8 aa, Yellow fever virus
LKCGDGIF

SEQ ID NO: 154714 - protein, 8 aa, Yellow fever virus
KCGDGIFI

SEQ ID NO: 154715 - protein, 8 aa, Yellow fever virus
CGDGIFIF

SEQ ID NO: 154716 - protein, 8 aa, Yellow fever virus
GDGIFIFR

SEQ ID NO: 154717 - protein, 8 aa, Yellow fever virus
DGIFIFRD

SEQ ID NO: 154718 - protein, 8 aa, Yellow fever virus
GIFIFRDS

SEQ ID NO: 154719 - protein, 8 aa, Yellow fever virus
IFIFRDSD

SEQ ID NO: 154720 - protein, 8 aa, Yellow fever virus
FIFRDSDD

SEQ ID NO: 154721 - protein, 8 aa, Yellow fever virus
IFRDSDDW

SEQ ID NO: 154722 - protein, 8 aa, Yellow fever virus
FRDSDDWL

SEQ ID NO: 154723 - protein, 8 aa, Yellow fever virus
RDSDDWLN

SEQ ID NO: 154724 - protein, 8 aa, Yellow fever virus
DSDDWLNK

SEQ ID NO: 154725 - protein, 8 aa, Yellow fever virus
SDDWLNKY

SEQ ID NO: 154726 - protein, 8 aa, Yellow fever virus
DDWLNKYS

SEQ ID NO: 154727 - protein, 8 aa, Yellow fever virus
DWLNKYSY

SEQ ID NO: 154728 - protein, 8 aa, Yellow fever virus
WLNKYSYY

SEQ ID NO: 154729 - protein, 8 aa, Yellow fever virus
LNKYSYYP

SEQ ID NO: 154730 - protein, 8 aa, Yellow fever virus
NKYSYYPE

SEQ ID NO: 154731 - protein, 8 aa, Yellow fever virus
KYSYYPED

SEQ ID NO: 154732 - protein, 8 aa, Yellow fever virus
YSYYPEDP

SEQ ID NO: 154733 - protein, 8 aa, Yellow fever virus
SYYPEDPV

SEQ ID NO: 154734 - protein, 8 aa, Yellow fever virus
YYPEDPVK

SEQ ID NO: 154735 - protein, 8 aa, Yellow fever virus
YPEDPVKL

SEQ ID NO: 154736 - protein, 8 aa, Yellow fever virus
PEDPVKLA

SEQ ID NO: 154737 - protein, 8 aa, Yellow fever virus
EDPVKLAS

SEQ ID NO: 154738 - protein, 8 aa, Yellow fever virus
DPVKLASI

SEQ ID NO: 154739 - protein, 8 aa, Yellow fever virus
PVKLASIV

SEQ ID NO: 154740 - protein, 8 aa, Yellow fever virus
VKLASIVK

SEQ ID NO: 154741 - protein, 8 aa, Yellow fever virus
KLASIVKA

SEQ ID NO: 154742 - protein, 8 aa, Yellow fever virus
LASIVKAS

SEQ ID NO: 154743 - protein, 8 aa, Yellow fever virus
ASIVKASF

SEQ ID NO: 154744 - protein, 8 aa, Yellow fever virus
SIVKASFE

SEQ ID NO: 154745 - protein, 8 aa, Yellow fever virus
IVKASFEE

SEQ ID NO: 154746 - protein, 8 aa, Yellow fever virus
VKASFEEG

SEQ ID NO: 154747 - protein, 8 aa, Yellow fever virus
KASFEEGK

SEQ ID NO: 154748 - protein, 8 aa, Yellow fever virus
ASFEEGKC

SEQ ID NO: 154749 - protein, 8 aa, Yellow fever virus
SFEEGKCG

SEQ ID NO: 154750 - protein, 8 aa, Yellow fever virus
FEEGKCGL

SEQ ID NO: 154751 - protein, 8 aa, Yellow fever virus
EEGKCGLN

SEQ ID NO: 154752 - protein, 8 aa, Yellow fever virus
EGKCGLNS

SEQ ID NO: 154753 - protein, 8 aa, Yellow fever virus
GKCGLNSV

SEQ ID NO: 154754 - protein, 8 aa, Yellow fever virus
KCGLNSVD

SEQ ID NO: 154755 - protein, 8 aa, Yellow fever virus
CGLNSVDS

SEQ ID NO: 154756 - protein, 8 aa, Yellow fever virus
GLNSVDSL

SEQ ID NO: 154757 - protein, 8 aa, Yellow fever virus
LNSVDSLE

SEQ ID NO: 154758 - protein, 8 aa, Yellow fever virus
NSVDSLEH

SEQ ID NO: 154759 - protein, 8 aa, Yellow fever virus
SVDSLEHE

SEQ ID NO: 154760 - protein, 8 aa, Yellow fever virus
VDSLEHEM

SEQ ID NO: 154761 - protein, 8 aa, Yellow fever virus
DSLEHEMW

SEQ ID NO: 154762 - protein, 8 aa, Yellow fever virus
SLEHEMWR

SEQ ID NO: 154763 - protein, 8 aa, Yellow fever virus
LEHEMWRS

SEQ ID NO: 154764 - protein, 8 aa, Yellow fever virus
EHEMWRSR

SEQ ID NO: 154765 - protein, 8 aa, Yellow fever virus
HEMWRSRA

SEQ ID NO: 154766 - protein, 8 aa, Yellow fever virus
EMWRSRAD

SEQ ID NO: 154767 - protein, 8 aa, Yellow fever virus
MWRSRADE

SEQ ID NO: 154768 - protein, 8 aa, Yellow fever virus
WRSRADEI

SEQ ID NO: 154769 - protein, 8 aa, Yellow fever virus
RSRADEIN

SEQ ID NO: 154770 - protein, 8 aa, Yellow fever virus
SRADEINA

SEQ ID NO: 154771 - protein, 8 aa, Yellow fever virus
RADEINAI

SEQ ID NO: 154772 - protein, 8 aa, Yellow fever virus
ADEINAIF

SEQ ID NO: 154773 - protein, 8 aa, Yellow fever virus
DEINAIFE

SEQ ID NO: 154774 - protein, 8 aa, Yellow fever virus
EINAIFEE

SEQ ID NO: 154775 - protein, 8 aa, Yellow fever virus
INAIFEEN

SEQ ID NO: 154776 - protein, 8 aa, Yellow fever virus
NAIFEENE

SEQ ID NO: 154777 - protein, 8 aa, Yellow fever virus
AIFEENEV

SEQ ID NO: 154778 - protein, 8 aa, Yellow fever virus
IFEENEVD

SEQ ID NO: 154779 - protein, 8 aa, Yellow fever virus
FEENEVDI

SEQ ID NO: 154780 - protein, 8 aa, Yellow fever virus
EENEVDIS

SEQ ID NO: 154781 - protein, 8 aa, Yellow fever virus
ENEVDISV

SEQ ID NO: 154782 - protein, 8 aa, Yellow fever virus
NEVDISVV

SEQ ID NO: 154783 - protein, 8 aa, Yellow fever virus
EVDISVVV

SEQ ID NO: 154784 - protein, 8 aa, Yellow fever virus
VDISVVVQ

SEQ ID NO: 154785 - protein, 8 aa, Yellow fever virus
DISVVVQD

SEQ ID NO: 154786 - protein, 8 aa, Yellow fever virus
ISVVVQDP

SEQ ID NO: 154787 - protein, 8 aa, Yellow fever virus
SVVVQDPK

SEQ ID NO: 154788 - protein, 8 aa, Yellow fever virus
VVVQDPKN

SEQ ID NO: 154789 - protein, 8 aa, Yellow fever virus
VVQDPKNV

SEQ ID NO: 154790 - protein, 8 aa, Yellow fever virus
VQDPKNVY

SEQ ID NO: 154791 - protein, 8 aa, Yellow fever virus
QDPKNVYQ

SEQ ID NO: 154792 - protein, 8 aa, Yellow fever virus
DPKNVYQR

SEQ ID NO: 154793 - protein, 8 aa, Yellow fever virus
PKNVYQRG

SEQ ID NO: 154794 - protein, 8 aa, Yellow fever virus
KNVYQRGT

SEQ ID NO: 154795 - protein, 8 aa, Yellow fever virus
NVYQRGTH

SEQ ID NO: 154796 - protein, 8 aa, Yellow fever virus
VYQRGTHP

SEQ ID NO: 154797 - protein, 8 aa, Yellow fever virus
YQRGTHPF

SEQ ID NO: 154798 - protein, 8 aa, Yellow fever virus
QRGTHPFS

SEQ ID NO: 154799 - protein, 8 aa, Yellow fever virus
RGTHPFSR

SEQ ID NO: 154800 - protein, 8 aa, Yellow fever virus
GTHPFSRI

SEQ ID NO: 154801 - protein, 8 aa, Yellow fever virus
THPFSRIR

SEQ ID NO: 154802 - protein, 8 aa, Yellow fever virus
HPFSRIRD

SEQ ID NO: 154803 - protein, 8 aa, Yellow fever virus
PFSRIRDG

SEQ ID NO: 154804 - protein, 8 aa, Yellow fever virus
FSRIRDGL

SEQ ID NO: 154805 - protein, 8 aa, Yellow fever virus
SRIRDGLQ

SEQ ID NO: 154806 - protein, 8 aa, Yellow fever virus
RIRDGLQY

SEQ ID NO: 154807 - protein, 8 aa, Yellow fever virus
IRDGLQYG

SEQ ID NO: 154808 - protein, 8 aa, Yellow fever virus
RDGLQYGW

SEQ ID NO: 154809 - protein, 8 aa, Yellow fever virus
DGLQYGWK

SEQ ID NO: 154810 - protein, 8 aa, Yellow fever virus
GLQYGWKT

SEQ ID NO: 154811 - protein, 8 aa, Yellow fever virus
LQYGWKTW

SEQ ID NO: 154812 - protein, 8 aa, Yellow fever virus
QYGWKTWG

SEQ ID NO: 154813 - protein, 8 aa, Yellow fever virus
YGWKTWGK

SEQ ID NO: 154814 - protein, 8 aa, Yellow fever virus
GWKTWGKN

SEQ ID NO: 154815 - protein, 8 aa, Yellow fever virus
WKTWGKNL

SEQ ID NO: 154816 - protein, 8 aa, Yellow fever virus
KTWGKNLV

SEQ ID NO: 154817 - protein, 8 aa, Yellow fever virus
TWGKNLVF

SEQ ID NO: 154818 - protein, 8 aa, Yellow fever virus
WGKNLVFS

SEQ ID NO: 154819 - protein, 8 aa, Yellow fever virus
GKNLVFSP

SEQ ID NO: 154820 - protein, 8 aa, Yellow fever virus
KNLVFSPG

SEQ ID NO: 154821 - protein, 8 aa, Yellow fever virus
NLVFSPGR

SEQ ID NO: 154822 - protein, 8 aa, Yellow fever virus
LVFSPGRK

SEQ ID NO: 154823 - protein, 8 aa, Yellow fever virus
VFSPGRKN

SEQ ID NO: 154824 - protein, 8 aa, Yellow fever virus
FSPGRKNG

SEQ ID NO: 154825 - protein, 8 aa, Yellow fever virus
SPGRKNGS

SEQ ID NO: 154826 - protein, 8 aa, Yellow fever virus
PGRKNGSF

SEQ ID NO: 154827 - protein, 8 aa, Yellow fever virus
GRKNGSFI

SEQ ID NO: 154828 - protein, 8 aa, Yellow fever virus
RKNGSFII

SEQ ID NO: 154829 - protein, 8 aa, Yellow fever virus
KNGSFIID

SEQ ID NO: 154830 - protein, 8 aa, Yellow fever virus
NGSFIIDG

SEQ ID NO: 154831 - protein, 8 aa, Yellow fever virus
GSFIIDGK

SEQ ID NO: 154832 - protein, 8 aa, Yellow fever virus
SFIIDGKS

SEQ ID NO: 154833 - protein, 8 aa, Yellow fever virus
FIIDGKSR

SEQ ID NO: 154834 - protein, 8 aa, Yellow fever virus
IIDGKSRK

SEQ ID NO: 154835 - protein, 8 aa, Yellow fever virus
IDGKSRKE

SEQ ID NO: 154836 - protein, 8 aa, Yellow fever virus
DGKSRKEC

SEQ ID NO: 154837 - protein, 8 aa, Yellow fever virus
GKSRKECP

SEQ ID NO: 154838 - protein, 8 aa, Yellow fever virus
KSRKECPF

SEQ ID NO: 154839 - protein, 8 aa, Yellow fever virus
SRKECPFS

SEQ ID NO: 154840 - protein, 8 aa, Yellow fever virus
RKECPFSN

SEQ ID NO: 154841 - protein, 8 aa, Yellow fever virus
KECPFSNR

SEQ ID NO: 154842 - protein, 8 aa, Yellow fever virus
ECPFSNRV

SEQ ID NO: 154843 - protein, 8 aa, Yellow fever virus
CPFSNRVW

SEQ ID NO: 154844 - protein, 8 aa, Yellow fever virus
PFSNRVWN

SEQ ID NO: 154845 - protein, 8 aa, Yellow fever virus
FSNRVWNS

SEQ ID NO: 154846 - protein, 8 aa, Yellow fever virus
SNRVWNSF

SEQ ID NO: 154847 - protein, 8 aa, Yellow fever virus
NRVWNSFQ

SEQ ID NO: 154848 - protein, 8 aa, Yellow fever virus
RVWNSFQI

SEQ ID NO: 154849 - protein, 8 aa, Yellow fever virus
VWNSFQIE

SEQ ID NO: 154850 - protein, 8 aa, Yellow fever virus
WNSFQIEE

SEQ ID NO: 154851 - protein, 8 aa, Yellow fever virus
NSFQIEEF

SEQ ID NO: 154852 - protein, 8 aa, Yellow fever virus
SFQIEEFG

SEQ ID NO: 154853 - protein, 8 aa, Yellow fever virus
FQIEEFGT

SEQ ID NO: 154854 - protein, 8 aa, Yellow fever virus
QIEEFGTG

SEQ ID NO: 154855 - protein, 8 aa, Yellow fever virus
IEEFGTGV

SEQ ID NO: 154856 - protein, 8 aa, Yellow fever virus
EEFGTGVF

SEQ ID NO: 154857 - protein, 8 aa, Yellow fever virus
EFGTGVFT

SEQ ID NO: 154858 - protein, 8 aa, Yellow fever virus
FGTGVFTT

SEQ ID NO: 154859 - protein, 8 aa, Yellow fever virus
GTGVFTTR

SEQ ID NO: 154860 - protein, 8 aa, Yellow fever virus
TGVFTTRV

SEQ ID NO: 154861 - protein, 8 aa, Yellow fever virus
GVFTTRVY

SEQ ID NO: 154862 - protein, 8 aa, Yellow fever virus
VFTTRVYM

SEQ ID NO: 154863 - protein, 8 aa, Yellow fever virus
FTTRVYMD

SEQ ID NO: 154864 - protein, 8 aa, Yellow fever virus
TTRVYMDA

SEQ ID NO: 154865 - protein, 8 aa, Yellow fever virus
TRVYMDAV

SEQ ID NO: 154866 - protein, 8 aa, Yellow fever virus
RVYMDAVF

SEQ ID NO: 154867 - protein, 8 aa, Yellow fever virus
VYMDAVFE

SEQ ID NO: 154868 - protein, 8 aa, Yellow fever virus
YMDAVFEY

SEQ ID NO: 154869 - protein, 8 aa, Yellow fever virus
MDAVFEYT

SEQ ID NO: 154870 - protein, 8 aa, Yellow fever virus
DAVFEYTI

SEQ ID NO: 154871 - protein, 8 aa, Yellow fever virus
AVFEYTID

SEQ ID NO: 154872 - protein, 8 aa, Yellow fever virus
VFEYTIDC

SEQ ID NO: 154873 - protein, 8 aa, Yellow fever virus
FEYTIDCD

SEQ ID NO: 154874 - protein, 8 aa, Yellow fever virus
EYTIDCDG

SEQ ID NO: 154875 - protein, 8 aa, Yellow fever virus
YTIDCDGS

SEQ ID NO: 154876 - protein, 8 aa, Yellow fever virus
TIDCDGSI

SEQ ID NO: 154877 - protein, 8 aa, Yellow fever virus
IDCDGSIL

SEQ ID NO: 154878 - protein, 8 aa, Yellow fever virus
DCDGSILG

SEQ ID NO: 154879 - protein, 8 aa, Yellow fever virus
CDGSILGA

SEQ ID NO: 154880 - protein, 8 aa, Yellow fever virus
DGSILGAA

SEQ ID NO: 154881 - protein, 8 aa, Yellow fever virus
GSILGAAV

SEQ ID NO: 154882 - protein, 8 aa, Yellow fever virus
SILGAAVN

SEQ ID NO: 154883 - protein, 8 aa, Yellow fever virus
ILGAAVNG

SEQ ID NO: 154884 - protein, 8 aa, Yellow fever virus
LGAAVNGK

SEQ ID NO: 154885 - protein, 8 aa, Yellow fever virus
GAAVNGKK

SEQ ID NO: 154886 - protein, 8 aa, Yellow fever virus
AAVNGKKS

SEQ ID NO: 154887 - protein, 8 aa, Yellow fever virus
AVNGKKSA

SEQ ID NO: 154888 - protein, 8 aa, Yellow fever virus
VNGKKSAH

SEQ ID NO: 154889 - protein, 8 aa, Yellow fever virus
NGKKSAHG

SEQ ID NO: 154890 - protein, 8 aa, Yellow fever virus
GKKSAHGS

SEQ ID NO: 154891 - protein, 8 aa, Yellow fever virus
KKSAHGSP

SEQ ID NO: 154892 - protein, 8 aa, Yellow fever virus
KSAHGSPT

SEQ ID NO: 154893 - protein, 8 aa, Yellow fever virus
SAHGSPTF

SEQ ID NO: 154894 - protein, 8 aa, Yellow fever virus
AHGSPTFW

SEQ ID NO: 154895 - protein, 8 aa, Yellow fever virus
HGSPTFWM

SEQ ID NO: 154896 - protein, 8 aa, Yellow fever virus
GSPTFWMG

SEQ ID NO: 154897 - protein, 8 aa, Yellow fever virus
SPTFWMGS

SEQ ID NO: 154898 - protein, 8 aa, Yellow fever virus
PTFWMGSH

SEQ ID NO: 154899 - protein, 8 aa, Yellow fever virus
TFWMGSHE

SEQ ID NO: 154900 - protein, 8 aa, Yellow fever virus
FWMGSHEV

SEQ ID NO: 154901 - protein, 8 aa, Yellow fever virus
WMGSHEVN

SEQ ID NO: 154902 - protein, 8 aa, Yellow fever virus
MGSHEVNG

SEQ ID NO: 154903 - protein, 8 aa, Yellow fever virus
GSHEVNGT

SEQ ID NO: 154904 - protein, 8 aa, Yellow fever virus
SHEVNGTW

SEQ ID NO: 154905 - protein, 8 aa, Yellow fever virus
HEVNGTWM

SEQ ID NO: 154906 - protein, 8 aa, Yellow fever virus
EVNGTWMI

SEQ ID NO: 154907 - protein, 8 aa, Yellow fever virus
VNGTWMIH

SEQ ID NO: 154908 - protein, 8 aa, Yellow fever virus
NGTWMIHT

SEQ ID NO: 154909 - protein, 8 aa, Yellow fever virus
GTWMIHTL

SEQ ID NO: 154910 - protein, 8 aa, Yellow fever virus
TWMIHTLE

SEQ ID NO: 154911 - protein, 8 aa, Yellow fever virus
WMIHTLEA

SEQ ID NO: 154912 - protein, 8 aa, Yellow fever virus
MIHTLEAL

SEQ ID NO: 154913 - protein, 8 aa, Yellow fever virus
IHTLEALD

SEQ ID NO: 154914 - protein, 8 aa, Yellow fever virus
HTLEALDY

SEQ ID NO: 154915 - protein, 8 aa, Yellow fever virus
TLEALDYK

SEQ ID NO: 154916 - protein, 8 aa, Yellow fever virus
LEALDYKE

SEQ ID NO: 154917 - protein, 8 aa, Yellow fever virus
EALDYKEC

SEQ ID NO: 154918 - protein, 8 aa, Yellow fever virus
ALDYKECE

SEQ ID NO: 154919 - protein, 8 aa, Yellow fever virus
LDYKECEW

SEQ ID NO: 154920 - protein, 8 aa, Yellow fever virus
DYKECEWP

SEQ ID NO: 154921 - protein, 8 aa, Yellow fever virus
YKECEWPL

SEQ ID NO: 154922 - protein, 8 aa, Yellow fever virus
KECEWPLT

SEQ ID NO: 154923 - protein, 8 aa, Yellow fever virus
ECEWPLTH

SEQ ID NO: 154924 - protein, 8 aa, Yellow fever virus
CEWPLTHT

SEQ ID NO: 154925 - protein, 8 aa, Yellow fever virus
EWPLTHTI

SEQ ID NO: 154926 - protein, 8 aa, Yellow fever virus
WPLTHTIG

SEQ ID NO: 154927 - protein, 8 aa, Yellow fever virus
PLTHTIGT

SEQ ID NO: 154928 - protein, 8 aa, Yellow fever virus
LTHTIGTS

SEQ ID NO: 154929 - protein, 8 aa, Yellow fever virus
THTIGTSV

SEQ ID NO: 154930 - protein, 8 aa, Yellow fever virus
HTIGTSVE

SEQ ID NO: 154931 - protein, 8 aa, Yellow fever virus
TIGTSVEE

SEQ ID NO: 154932 - protein, 8 aa, Yellow fever virus
IGTSVEES

SEQ ID NO: 154933 - protein, 8 aa, Yellow fever virus
GTSVEESE

SEQ ID NO: 154934 - protein, 8 aa, Yellow fever virus
TSVEESEM

SEQ ID NO: 154935 - protein, 8 aa, Yellow fever virus
SVEESEMF

SEQ ID NO: 154936 - protein, 8 aa, Yellow fever virus
VEESEMFM

SEQ ID NO: 154937 - protein, 8 aa, Yellow fever virus
EESEMFMP

SEQ ID NO: 154938 - protein, 8 aa, Yellow fever virus
ESEMFMPR

SEQ ID NO: 154939 - protein, 8 aa, Yellow fever virus
SEMFMPRS

SEQ ID NO: 154940 - protein, 8 aa, Yellow fever virus
EMFMPRSI

SEQ ID NO: 154941 - protein, 8 aa, Yellow fever virus
MFMPRSIG

SEQ ID NO: 154942 - protein, 8 aa, Yellow fever virus
FMPRSIGG

SEQ ID NO: 154943 - protein, 8 aa, Yellow fever virus
MPRSIGGP

SEQ ID NO: 154944 - protein, 8 aa, Yellow fever virus
PRSIGGPV

SEQ ID NO: 154945 - protein, 8 aa, Yellow fever virus
RSIGGPVS

SEQ ID NO: 154946 - protein, 8 aa, Yellow fever virus
SIGGPVSS

SEQ ID NO: 154947 - protein, 8 aa, Yellow fever virus
IGGPVSSH

SEQ ID NO: 154948 - protein, 8 aa, Yellow fever virus
GGPVSSHN

SEQ ID NO: 154949 - protein, 8 aa, Yellow fever virus
GPVSSHNH

SEQ ID NO: 154950 - protein, 8 aa, Yellow fever virus
PVSSHNHI

SEQ ID NO: 154951 - protein, 8 aa, Yellow fever virus
VSSHNHIP

SEQ ID NO: 154952 - protein, 8 aa, Yellow fever virus
SSHNHIPG

SEQ ID NO: 154953 - protein, 8 aa, Yellow fever virus
SHNHIPGY

SEQ ID NO: 154954 - protein, 8 aa, Yellow fever virus
HNHIPGYK

SEQ ID NO: 154955 - protein, 8 aa, Yellow fever virus
NHIPGYKV

SEQ ID NO: 154956 - protein, 8 aa, Yellow fever virus
HIPGYKVQ

SEQ ID NO: 154957 - protein, 8 aa, Yellow fever virus
IPGYKVQT

SEQ ID NO: 154958 - protein, 8 aa, Yellow fever virus
PGYKVQTN

SEQ ID NO: 154959 - protein, 8 aa, Yellow fever virus
GYKVQTNG

SEQ ID NO: 154960 - protein, 8 aa, Yellow fever virus
YKVQTNGP

SEQ ID NO: 154961 - protein, 8 aa, Yellow fever virus
KVQTNGPW

SEQ ID NO: 154962 - protein, 8 aa, Yellow fever virus
VQTNGPWM

SEQ ID NO: 154963 - protein, 8 aa, Yellow fever virus
QTNGPWMQ

SEQ ID NO: 154964 - protein, 8 aa, Yellow fever virus
TNGPWMQV

SEQ ID NO: 154965 - protein, 8 aa, Yellow fever virus
NGPWMQVP

SEQ ID NO: 154966 - protein, 8 aa, Yellow fever virus
GPWMQVPL

SEQ ID NO: 154967 - protein, 8 aa, Yellow fever virus
PWMQVPLE

SEQ ID NO: 154968 - protein, 8 aa, Yellow fever virus
WMQVPLEV

SEQ ID NO: 154969 - protein, 8 aa, Yellow fever virus
MQVPLEVK

SEQ ID NO: 154970 - protein, 8 aa, Yellow fever virus
QVPLEVKR

SEQ ID NO: 154971 - protein, 8 aa, Yellow fever virus
VPLEVKRE

SEQ ID NO: 154972 - protein, 8 aa, Yellow fever virus
PLEVKREA

SEQ ID NO: 154973 - protein, 8 aa, Yellow fever virus
LEVKREAC

SEQ ID NO: 154974 - protein, 8 aa, Yellow fever virus
EVKREACP

SEQ ID NO: 154975 - protein, 8 aa, Yellow fever virus
VKREACPG

SEQ ID NO: 154976 - protein, 8 aa, Yellow fever virus
KREACPGT

SEQ ID NO: 154977 - protein, 8 aa, Yellow fever virus
REACPGTS

SEQ ID NO: 154978 - protein, 8 aa, Yellow fever virus
EACPGTSV

SEQ ID NO: 154979 - protein, 8 aa, Yellow fever virus
ACPGTSVI

SEQ ID NO: 154980 - protein, 8 aa, Yellow fever virus
CPGTSVII

SEQ ID NO: 154981 - protein, 8 aa, Yellow fever virus
PGTSVIID

SEQ ID NO: 154982 - protein, 8 aa, Yellow fever virus
GTSVIIDG

SEQ ID NO: 154983 - protein, 8 aa, Yellow fever virus
TSVIIDGN

SEQ ID NO: 154984 - protein, 8 aa, Yellow fever virus
SVIIDGNC

SEQ ID NO: 154985 - protein, 8 aa, Yellow fever virus
VIIDGNCD

SEQ ID NO: 154986 - protein, 8 aa, Yellow fever virus
IIDGNCDG

SEQ ID NO: 154987 - protein, 8 aa, Yellow fever virus
IDGNCDGR

SEQ ID NO: 154988 - protein, 8 aa, Yellow fever virus
DGNCDGRG

SEQ ID NO: 154989 - protein, 8 aa, Yellow fever virus
GNCDGRGK

SEQ ID NO: 154990 - protein, 8 aa, Yellow fever virus
NCDGRGKS

SEQ ID NO: 154991 - protein, 8 aa, Yellow fever virus
CDGRGKST

SEQ ID NO: 154992 - protein, 8 aa, Yellow fever virus
DGRGKSTR

SEQ ID NO: 154993 - protein, 8 aa, Yellow fever virus
GRGKSTRS

SEQ ID NO: 154994 - protein, 8 aa, Yellow fever virus
RGKSTRST

SEQ ID NO: 154995 - protein, 8 aa, Yellow fever virus
GKSTRSTT

SEQ ID NO: 154996 - protein, 8 aa, Yellow fever virus
KSTRSTTD

SEQ ID NO: 154997 - protein, 8 aa, Yellow fever virus
STRSTTDS

SEQ ID NO: 154998 - protein, 8 aa, Yellow fever virus
TRSTTDSG

SEQ ID NO: 154999 - protein, 8 aa, Yellow fever virus
RSTTDSGK

SEQ ID NO: 155000 - protein, 8 aa, Yellow fever virus
STTDSGKV

SEQ ID NO: 155001 - protein, 8 aa, Yellow fever virus
TTDSGKVI

SEQ ID NO: 155002 - protein, 8 aa, Yellow fever virus
TDSGKVIP

SEQ ID NO: 155003 - protein, 8 aa, Yellow fever virus
DSGKVIPE

SEQ ID NO: 155004 - protein, 8 aa, Yellow fever virus
SGKVIPEW

SEQ ID NO: 155005 - protein, 8 aa, Yellow fever virus
GKVIPEWC

SEQ ID NO: 155006 - protein, 8 aa, Yellow fever virus
KVIPEWCC

SEQ ID NO: 155007 - protein, 8 aa, Yellow fever virus
VIPEWCCR

SEQ ID NO: 155008 - protein, 8 aa, Yellow fever virus
IPEWCCRS

SEQ ID NO: 155009 - protein, 8 aa, Yellow fever virus
PEWCCRSC

SEQ ID NO: 155010 - protein, 8 aa, Yellow fever virus
EWCCRSCT

SEQ ID NO: 155011 - protein, 8 aa, Yellow fever virus
WCCRSCTM

SEQ ID NO: 155012 - protein, 8 aa, Yellow fever virus
CCRSCTMP

SEQ ID NO: 155013 - protein, 8 aa, Yellow fever virus
CRSCTMPP

SEQ ID NO: 155014 - protein, 8 aa, Yellow fever virus
RSCTMPPV

SEQ ID NO: 155015 - protein, 8 aa, Yellow fever virus
SCTMPPVS

SEQ ID NO: 155016 - protein, 8 aa, Yellow fever virus
CTMPPVSF

SEQ ID NO: 155017 - protein, 8 aa, Yellow fever virus
TMPPVSFH

SEQ ID NO: 155018 - protein, 8 aa, Yellow fever virus
MPPVSFHG

SEQ ID NO: 155019 - protein, 8 aa, Yellow fever virus
PPVSFHGS

SEQ ID NO: 155020 - protein, 8 aa, Yellow fever virus
PVSFHGSD

SEQ ID NO: 155021 - protein, 8 aa, Yellow fever virus
VSFHGSDG

SEQ ID NO: 155022 - protein, 8 aa, Yellow fever virus
SFHGSDGC

SEQ ID NO: 155023 - protein, 8 aa, Yellow fever virus
FHGSDGCW

SEQ ID NO: 155024 - protein, 8 aa, Yellow fever virus
HGSDGCWY

SEQ ID NO: 155025 - protein, 8 aa, Yellow fever virus
GSDGCWYP

SEQ ID NO: 155026 - protein, 8 aa, Yellow fever virus
SDGCWYPM

SEQ ID NO: 155027 - protein, 8 aa, Yellow fever virus
DGCWYPME

SEQ ID NO: 155028 - protein, 8 aa, Yellow fever virus
GCWYPMEI

SEQ ID NO: 155029 - protein, 8 aa, Yellow fever virus
CWYPMEIR

SEQ ID NO: 155030 - protein, 8 aa, Yellow fever virus
WYPMEIRP

SEQ ID NO: 155031 - protein, 8 aa, Yellow fever virus
YPMEIRPR

SEQ ID NO: 155032 - protein, 8 aa, Yellow fever virus
PMEIRPRK

SEQ ID NO: 155033 - protein, 8 aa, Yellow fever virus
MEIRPRKT

SEQ ID NO: 155034 - protein, 8 aa, Yellow fever virus
EIRPRKTH

SEQ ID NO: 155035 - protein, 8 aa, Yellow fever virus
IRPRKTHE

SEQ ID NO: 155036 - protein, 8 aa, Yellow fever virus
RPRKTHES

SEQ ID NO: 155037 - protein, 8 aa, Yellow fever virus
PRKTHESH

SEQ ID NO: 155038 - protein, 8 aa, Yellow fever virus
RKTHESHL

SEQ ID NO: 155039 - protein, 8 aa, Yellow fever virus
KTHESHLV

SEQ ID NO: 155040 - protein, 8 aa, Yellow fever virus
THESHLVR

SEQ ID NO: 155041 - protein, 8 aa, Yellow fever virus
HESHLVRS

SEQ ID NO: 155042 - protein, 8 aa, Yellow fever virus
ESHLVRSW

SEQ ID NO: 155043 - protein, 8 aa, Yellow fever virus
SHLVRSWV

SEQ ID NO: 155044 - protein, 8 aa, Yellow fever virus
HLVRSWVT

SEQ ID NO: 155045 - protein, 8 aa, Yellow fever virus
LVRSWVTA

SEQ ID NO: 155046 - protein, 8 aa, Yellow fever virus
VRSWVTAG

SEQ ID NO: 155047 - protein, 8 aa, Yellow fever virus
RSWVTAGE

SEQ ID NO: 155048 - protein, 8 aa, Yellow fever virus
SWVTAGEI

SEQ ID NO: 155049 - protein, 8 aa, Yellow fever virus
WVTAGEIH

SEQ ID NO: 155050 - protein, 8 aa, Yellow fever virus
VTAGEIHA

SEQ ID NO: 155051 - protein, 8 aa, Yellow fever virus
TAGEIHAV

SEQ ID NO: 155052 - protein, 8 aa, Yellow fever virus
AGEIHAVP

SEQ ID NO: 155053 - protein, 8 aa, Yellow fever virus
GEIHAVPF

SEQ ID NO: 155054 - protein, 8 aa, Yellow fever virus
EIHAVPFG

SEQ ID NO: 155055 - protein, 8 aa, Yellow fever virus
IHAVPFGL

SEQ ID NO: 155056 - protein, 8 aa, Yellow fever virus
HAVPFGLV

SEQ ID NO: 155057 - protein, 8 aa, Yellow fever virus
AVPFGLVS

SEQ ID NO: 155058 - protein, 8 aa, Yellow fever virus
VPFGLVSM

SEQ ID NO: 155059 - protein, 8 aa, Yellow fever virus
PFGLVSMM

SEQ ID NO: 155060 - protein, 8 aa, Yellow fever virus
FGLVSMMI

SEQ ID NO: 155061 - protein, 8 aa, Yellow fever virus
GLVSMMIA

SEQ ID NO: 155062 - protein, 8 aa, Yellow fever virus
LVSMMIAM

SEQ ID NO: 155063 - protein, 8 aa, Yellow fever virus
VSMMIAME

SEQ ID NO: 155064 - protein, 8 aa, Yellow fever virus
SMMIAMEV

SEQ ID NO: 155065 - protein, 8 aa, Yellow fever virus
MMIAMEVV

SEQ ID NO: 155066 - protein, 8 aa, Yellow fever virus
MIAMEVVL

SEQ ID NO: 155067 - protein, 8 aa, Yellow fever virus
IAMEVVLR

SEQ ID NO: 155068 - protein, 8 aa, Yellow fever virus
AMEVVLRK

SEQ ID NO: 155069 - protein, 8 aa, Yellow fever virus
MEVVLRKR

SEQ ID NO: 155070 - protein, 8 aa, Yellow fever virus
EVVLRKRQ

SEQ ID NO: 155071 - protein, 8 aa, Yellow fever virus
VVLRKRQG

SEQ ID NO: 155072 - protein, 8 aa, Yellow fever virus
VLRKRQGP

SEQ ID NO: 155073 - protein, 8 aa, Yellow fever virus
LRKRQGPK

SEQ ID NO: 155074 - protein, 8 aa, Yellow fever virus
RKRQGPKQ

SEQ ID NO: 155075 - protein, 8 aa, Yellow fever virus
KRQGPKQM

SEQ ID NO: 155076 - protein, 8 aa, Yellow fever virus
RQGPKQML

SEQ ID NO: 155077 - protein, 8 aa, Yellow fever virus
QGPKQMLV

SEQ ID NO: 155078 - protein, 8 aa, Yellow fever virus
GPKQMLVG

SEQ ID NO: 155079 - protein, 8 aa, Yellow fever virus
PKQMLVGG

SEQ ID NO: 155080 - protein, 8 aa, Yellow fever virus
KQMLVGGV

SEQ ID NO: 155081 - protein, 8 aa, Yellow fever virus
QMLVGGVV

SEQ ID NO: 155082 - protein, 8 aa, Yellow fever virus
MLVGGVVL

SEQ ID NO: 155083 - protein, 8 aa, Yellow fever virus
LVGGVVLL

SEQ ID NO: 155084 - protein, 8 aa, Yellow fever virus
VGGVVLLG

SEQ ID NO: 155085 - protein, 8 aa, Yellow fever virus
GGVVLLGA

SEQ ID NO: 155086 - protein, 8 aa, Yellow fever virus
GVVLLGAM

SEQ ID NO: 155087 - protein, 8 aa, Yellow fever virus
VVLLGAML

SEQ ID NO: 155088 - protein, 8 aa, Yellow fever virus
VLLGAMLV

SEQ ID NO: 155089 - protein, 8 aa, Yellow fever virus
LLGAMLVG

SEQ ID NO: 155090 - protein, 8 aa, Yellow fever virus
LGAMLVGQ

SEQ ID NO: 155091 - protein, 8 aa, Yellow fever virus
GAMLVGQV

SEQ ID NO: 155092 - protein, 8 aa, Yellow fever virus
AMLVGQVT

SEQ ID NO: 155093 - protein, 8 aa, Yellow fever virus
MLVGQVTL

SEQ ID NO: 155094 - protein, 8 aa, Yellow fever virus
LVGQVTLL

SEQ ID NO: 155095 - protein, 8 aa, Yellow fever virus
VGQVTLLD

SEQ ID NO: 155096 - protein, 8 aa, Yellow fever virus
GQVTLLDL

SEQ ID NO: 155097 - protein, 8 aa, Yellow fever virus
QVTLLDLL

SEQ ID NO: 155098 - protein, 8 aa, Yellow fever virus
VTLLDLLK

SEQ ID NO: 155099 - protein, 8 aa, Yellow fever virus
LTVAVGLH

SEQ ID NO: 155100 - protein, 8 aa, Yellow fever virus
TVAVGLHF

SEQ ID NO: 155101 - protein, 8 aa, Yellow fever virus
VAVGLHFH

SEQ ID NO: 155102 - protein, 8 aa, Yellow fever virus
AVGLHFHE

SEQ ID NO: 155103 - protein, 8 aa, Yellow fever virus
VGLHFHEM

SEQ ID NO: 155104 - protein, 8 aa, Yellow fever virus
GLHFHEMN

SEQ ID NO: 155105 - protein, 8 aa, Yellow fever virus
LHFHEMNN

SEQ ID NO: 155106 - protein, 8 aa, Yellow fever virus
HFHEMNNG

SEQ ID NO: 155107 - protein, 8 aa, Yellow fever virus
FHEMNNGG

SEQ ID NO: 155108 - protein, 8 aa, Yellow fever virus
HEMNNGGD

SEQ ID NO: 155109 - protein, 8 aa, Yellow fever virus
EMNNGGDA

SEQ ID NO: 155110 - protein, 8 aa, Yellow fever virus
MNNGGDAM

SEQ ID NO: 155111 - protein, 8 aa, Yellow fever virus
NNGGDAMY

SEQ ID NO: 155112 - protein, 8 aa, Yellow fever virus
NGGDAMYM

SEQ ID NO: 155113 - protein, 8 aa, Yellow fever virus
GGDAMYMA

SEQ ID NO: 155114 - protein, 8 aa, Yellow fever virus
GDAMYMAL

SEQ ID NO: 155115 - protein, 8 aa, Yellow fever virus
DAMYMALI

SEQ ID NO: 155116 - protein, 8 aa, Yellow fever virus
AMYMALIA

SEQ ID NO: 155117 - protein, 8 aa, Yellow fever virus
MYMALIAA

SEQ ID NO: 155118 - protein, 8 aa, Yellow fever virus
YMALIAAF

SEQ ID NO: 155119 - protein, 8 aa, Yellow fever virus
MALIAAFS

SEQ ID NO: 155120 - protein, 8 aa, Yellow fever virus
ALIAAFSI

SEQ ID NO: 155121 - protein, 8 aa, Yellow fever virus
LIAAFSIR

SEQ ID NO: 155122 - protein, 8 aa, Yellow fever virus
IAAFSIRP

SEQ ID NO: 155123 - protein, 8 aa, Yellow fever virus
AAFSIRPG

SEQ ID NO: 155124 - protein, 8 aa, Yellow fever virus
AFSIRPGL

SEQ ID NO: 155125 - protein, 8 aa, Yellow fever virus
FSIRPGLL

SEQ ID NO: 155126 - protein, 8 aa, Yellow fever virus
SIRPGLLI

SEQ ID NO: 155127 - protein, 8 aa, Yellow fever virus
IRPGLLIG

SEQ ID NO: 155128 - protein, 8 aa, Yellow fever virus
RPGLLIGF

SEQ ID NO: 155129 - protein, 8 aa, Yellow fever virus
PGLLIGFG

SEQ ID NO: 155130 - protein, 8 aa, Yellow fever virus
GLLIGFGL

SEQ ID NO: 155131 - protein, 8 aa, Yellow fever virus
LLIGFGLR

SEQ ID NO: 155132 - protein, 8 aa, Yellow fever virus
LIGFGLRT

SEQ ID NO: 155133 - protein, 8 aa, Yellow fever virus
IGFGLRTL

SEQ ID NO: 155134 - protein, 8 aa, Yellow fever virus
GFGLRTLW

SEQ ID NO: 155135 - protein, 8 aa, Yellow fever virus
FGLRTLWS

SEQ ID NO: 155136 - protein, 8 aa, Yellow fever virus
GLRTLWSP

SEQ ID NO: 155137 - protein, 8 aa, Yellow fever virus
LRTLWSPR

SEQ ID NO: 155138 - protein, 8 aa, Yellow fever virus
RTLWSPRE

SEQ ID NO: 155139 - protein, 8 aa, Yellow fever virus
TLWSPRER

SEQ ID NO: 155140 - protein, 8 aa, Yellow fever virus
LWSPRERL

SEQ ID NO: 155141 - protein, 8 aa, Yellow fever virus
WSPRERLV

SEQ ID NO: 155142 - protein, 8 aa, Yellow fever virus
SPRERLVL

SEQ ID NO: 155143 - protein, 8 aa, Yellow fever virus
PRERLVLT

SEQ ID NO: 155144 - protein, 8 aa, Yellow fever virus
RERLVLTL

SEQ ID NO: 155145 - protein, 8 aa, Yellow fever virus
ERLVLTLG

SEQ ID NO: 155146 - protein, 8 aa, Yellow fever virus
RLVLTLGA

SEQ ID NO: 155147 - protein, 8 aa, Yellow fever virus
LVLTLGAA

SEQ ID NO: 155148 - protein, 8 aa, Yellow fever virus
VLTLGAAM

SEQ ID NO: 155149 - protein, 8 aa, Yellow fever virus
LTLGAAMV

SEQ ID NO: 155150 - protein, 8 aa, Yellow fever virus
TLGAAMVE

SEQ ID NO: 155151 - protein, 8 aa, Yellow fever virus
LGAAMVEI

SEQ ID NO: 155152 - protein, 8 aa, Yellow fever virus
GAAMVEIA

SEQ ID NO: 155153 - protein, 8 aa, Yellow fever virus
AAMVEIAL

SEQ ID NO: 155154 - protein, 8 aa, Yellow fever virus
AMVEIALG

SEQ ID NO: 155155 - protein, 8 aa, Yellow fever virus
MVEIALGG

SEQ ID NO: 155156 - protein, 8 aa, Yellow fever virus
VEIALGGV

SEQ ID NO: 155157 - protein, 8 aa, Yellow fever virus
EIALGGVM

SEQ ID NO: 155158 - protein, 8 aa, Yellow fever virus
IALGGVMG

SEQ ID NO: 155159 - protein, 8 aa, Yellow fever virus
ALGGVMGG

SEQ ID NO: 155160 - protein, 8 aa, Yellow fever virus
LGGVMGGL

SEQ ID NO: 155161 - protein, 8 aa, Yellow fever virus
GGVMGGLW

SEQ ID NO: 155162 - protein, 8 aa, Yellow fever virus
GVMGGLWK

SEQ ID NO: 155163 - protein, 8 aa, Yellow fever virus
VMGGLWKY

SEQ ID NO: 155164 - protein, 8 aa, Yellow fever virus
MGGLWKYL

SEQ ID NO: 155165 - protein, 8 aa, Yellow fever virus
GGLWKYLN

SEQ ID NO: 155166 - protein, 8 aa, Yellow fever virus
GLWKYLNA

SEQ ID NO: 155167 - protein, 8 aa, Yellow fever virus
LWKYLNAV

SEQ ID NO: 155168 - protein, 8 aa, Yellow fever virus
WKYLNAVS

SEQ ID NO: 155169 - protein, 8 aa, Yellow fever virus
KYLNAVSL

SEQ ID NO: 155170 - protein, 8 aa, Yellow fever virus
YLNAVSLC

SEQ ID NO: 155171 - protein, 8 aa, Yellow fever virus
LNAVSLCI

SEQ ID NO: 155172 - protein, 8 aa, Yellow fever virus
NAVSLCIL

SEQ ID NO: 155173 - protein, 8 aa, Yellow fever virus
AVSLCILT

SEQ ID NO: 155174 - protein, 8 aa, Yellow fever virus
VSLCILTI

SEQ ID NO: 155175 - protein, 8 aa, Yellow fever virus
SLCILTIN

SEQ ID NO: 155176 - protein, 8 aa, Yellow fever virus
LCILTINA

SEQ ID NO: 155177 - protein, 8 aa, Yellow fever virus
CILTINAV

SEQ ID NO: 155178 - protein, 8 aa, Yellow fever virus
ILTINAVA

SEQ ID NO: 155179 - protein, 8 aa, Yellow fever virus
LTINAVAS

SEQ ID NO: 155180 - protein, 8 aa, Yellow fever virus
TINAVASR

SEQ ID NO: 155181 - protein, 8 aa, Yellow fever virus
INAVASRK

SEQ ID NO: 155182 - protein, 8 aa, Yellow fever virus
NAVASRKA

SEQ ID NO: 155183 - protein, 8 aa, Yellow fever virus
AVASRKAS

SEQ ID NO: 155184 - protein, 8 aa, Yellow fever virus
VASRKASN

SEQ ID NO: 155185 - protein, 8 aa, Yellow fever virus
ASRKASNT

SEQ ID NO: 155186 - protein, 8 aa, Yellow fever virus
SRKASNTI

SEQ ID NO: 155187 - protein, 8 aa, Yellow fever virus
RKASNTIL

SEQ ID NO: 155188 - protein, 8 aa, Yellow fever virus
KASNTILP

SEQ ID NO: 155189 - protein, 8 aa, Yellow fever virus
ASNTILPL

SEQ ID NO: 155190 - protein, 8 aa, Yellow fever virus
SNTILPLM

SEQ ID NO: 155191 - protein, 8 aa, Yellow fever virus
NTILPLMA

SEQ ID NO: 155192 - protein, 8 aa, Yellow fever virus
TILPLMAL

SEQ ID NO: 155193 - protein, 8 aa, Yellow fever virus
ILPLMALL

SEQ ID NO: 155194 - protein, 8 aa, Yellow fever virus
LPLMALLT

SEQ ID NO: 155195 - protein, 8 aa, Yellow fever virus
PLMALLTP

SEQ ID NO: 155196 - protein, 8 aa, Yellow fever virus
LMALLTPV

SEQ ID NO: 155197 - protein, 8 aa, Yellow fever virus
MALLTPVT

SEQ ID NO: 155198 - protein, 8 aa, Yellow fever virus
ALLTPVTM

SEQ ID NO: 155199 - protein, 8 aa, Yellow fever virus
LLTPVTMA

SEQ ID NO: 155200 - protein, 8 aa, Yellow fever virus
LTPVTMAE

SEQ ID NO: 155201 - protein, 8 aa, Yellow fever virus
TPVTMAEV

SEQ ID NO: 155202 - protein, 8 aa, Yellow fever virus
PVTMAEVR

SEQ ID NO: 155203 - protein, 8 aa, Yellow fever virus
VTMAEVRL

SEQ ID NO: 155204 - protein, 8 aa, Yellow fever virus
TMAEVRLA

SEQ ID NO: 155205 - protein, 8 aa, Yellow fever virus
MAEVRLAA

SEQ ID NO: 155206 - protein, 8 aa, Yellow fever virus
AEVRLAAM

SEQ ID NO: 155207 - protein, 8 aa, Yellow fever virus
EVRLAAMF

SEQ ID NO: 155208 - protein, 8 aa, Yellow fever virus
VRLAAMFF

SEQ ID NO: 155209 - protein, 8 aa, Yellow fever virus
RLAAMFFC

SEQ ID NO: 155210 - protein, 8 aa, Yellow fever virus
AAMFFCAV

SEQ ID NO: 155211 - protein, 8 aa, Yellow fever virus
AMFFCAVV

SEQ ID NO: 155212 - protein, 8 aa, Yellow fever virus
MFFCAVVI

SEQ ID NO: 155213 - protein, 8 aa, Yellow fever virus
FFCAVVII

SEQ ID NO: 155214 - protein, 8 aa, Yellow fever virus
FCAVVIIG

SEQ ID NO: 155215 - protein, 8 aa, Yellow fever virus
CAVVIIGV

SEQ ID NO: 155216 - protein, 8 aa, Yellow fever virus
AVVIIGVL

SEQ ID NO: 155217 - protein, 8 aa, Yellow fever virus
VVIIGVLH

SEQ ID NO: 155218 - protein, 8 aa, Yellow fever virus
VIIGVLHQ

SEQ ID NO: 155219 - protein, 8 aa, Yellow fever virus
IIGVLHQN

SEQ ID NO: 155220 - protein, 8 aa, Yellow fever virus
IGVLHQNF

SEQ ID NO: 155221 - protein, 8 aa, Yellow fever virus
GVLHQNFK

SEQ ID NO: 155222 - protein, 8 aa, Yellow fever virus
VLHQNFKD

SEQ ID NO: 155223 - protein, 8 aa, Yellow fever virus
LHQNFKDT

SEQ ID NO: 155224 - protein, 8 aa, Yellow fever virus
HQNFKDTS

SEQ ID NO: 155225 - protein, 8 aa, Yellow fever virus
QNFKDTSM

SEQ ID NO: 155226 - protein, 8 aa, Yellow fever virus
NFKDTSMQ

SEQ ID NO: 155227 - protein, 8 aa, Yellow fever virus
FKDTSMQK

SEQ ID NO: 155228 - protein, 8 aa, Yellow fever virus
KDTSMQKT

SEQ ID NO: 155229 - protein, 8 aa, Yellow fever virus
DTSMQKTI

SEQ ID NO: 155230 - protein, 8 aa, Yellow fever virus
TSMQKTIP

SEQ ID NO: 155231 - protein, 8 aa, Yellow fever virus
SMQKTIPL

SEQ ID NO: 155232 - protein, 8 aa, Yellow fever virus
MQKTIPLV

SEQ ID NO: 155233 - protein, 8 aa, Yellow fever virus
QKTIPLVA

SEQ ID NO: 155234 - protein, 8 aa, Yellow fever virus
KTIPLVAL

SEQ ID NO: 155235 - protein, 8 aa, Yellow fever virus
TIPLVALT

SEQ ID NO: 155236 - protein, 8 aa, Yellow fever virus
IPLVALTL

SEQ ID NO: 155237 - protein, 8 aa, Yellow fever virus
PLVALTLT

SEQ ID NO: 155238 - protein, 8 aa, Yellow fever virus
LVALTLTS

SEQ ID NO: 155239 - protein, 8 aa, Yellow fever virus
VALTLTSY

SEQ ID NO: 155240 - protein, 8 aa, Yellow fever virus
ALTLTSYL

SEQ ID NO: 155241 - protein, 8 aa, Yellow fever virus
LTLTSYLG

SEQ ID NO: 155242 - protein, 8 aa, Yellow fever virus
TLTSYLGL

SEQ ID NO: 155243 - protein, 8 aa, Yellow fever virus
LTSYLGLT

SEQ ID NO: 155244 - protein, 8 aa, Yellow fever virus
TSYLGLTQ

SEQ ID NO: 155245 - protein, 8 aa, Yellow fever virus
SYLGLTQP

SEQ ID NO: 155246 - protein, 8 aa, Yellow fever virus
YLGLTQPF

SEQ ID NO: 155247 - protein, 8 aa, Yellow fever virus
LGLTQPFL

SEQ ID NO: 155248 - protein, 8 aa, Yellow fever virus
GLTQPFLG

SEQ ID NO: 155249 - protein, 8 aa, Yellow fever virus
LTQPFLGL

SEQ ID NO: 155250 - protein, 8 aa, Yellow fever virus
TQPFLGLC

SEQ ID NO: 155251 - protein, 8 aa, Yellow fever virus
QPFLGLCA

SEQ ID NO: 155252 - protein, 8 aa, Yellow fever virus
PFLGLCAF

SEQ ID NO: 155253 - protein, 8 aa, Yellow fever virus
FLGLCAFL

SEQ ID NO: 155254 - protein, 8 aa, Yellow fever virus
LGLCAFLA

SEQ ID NO: 155255 - protein, 8 aa, Yellow fever virus
GLCAFLAT

SEQ ID NO: 155256 - protein, 8 aa, Yellow fever virus
LCAFLATR

SEQ ID NO: 155257 - protein, 8 aa, Yellow fever virus
CAFLATRI

SEQ ID NO: 155258 - protein, 8 aa, Yellow fever virus
AFLATRIF

SEQ ID NO: 155259 - protein, 8 aa, Yellow fever virus
FLATRIFG

SEQ ID NO: 155260 - protein, 8 aa, Yellow fever virus
LATRIFGR

SEQ ID NO: 155261 - protein, 8 aa, Yellow fever virus
ATRIFGRR

SEQ ID NO: 155262 - protein, 8 aa, Yellow fever virus
TRIFGRRS

SEQ ID NO: 155263 - protein, 8 aa, Yellow fever virus
RIFGRRSI

SEQ ID NO: 155264 - protein, 8 aa, Yellow fever virus
IFGRRSIP

SEQ ID NO: 155265 - protein, 8 aa, Yellow fever virus
FGRRSIPV

SEQ ID NO: 155266 - protein, 8 aa, Yellow fever virus
GRRSIPVN

SEQ ID NO: 155267 - protein, 8 aa, Yellow fever virus
RRSIPVNE

SEQ ID NO: 155268 - protein, 8 aa, Yellow fever virus
RSIPVNEA

SEQ ID NO: 155269 - protein, 8 aa, Yellow fever virus
SIPVNEAL

SEQ ID NO: 155270 - protein, 8 aa, Yellow fever virus
IPVNEALA

SEQ ID NO: 155271 - protein, 8 aa, Yellow fever virus
PVNEALAA

SEQ ID NO: 155272 - protein, 8 aa, Yellow fever virus
VNEALAAA

SEQ ID NO: 155273 - protein, 8 aa, Yellow fever virus
NEALAAAG

SEQ ID NO: 155274 - protein, 8 aa, Yellow fever virus
EALAAAGL

SEQ ID NO: 155275 - protein, 8 aa, Yellow fever virus
ALAAAGLV

SEQ ID NO: 155276 - protein, 8 aa, Yellow fever virus
LAAAGLVG

SEQ ID NO: 155277 - protein, 8 aa, Yellow fever virus
AAAGLVGV

SEQ ID NO: 155278 - protein, 8 aa, Yellow fever virus
AAGLVGVL

SEQ ID NO: 155279 - protein, 8 aa, Yellow fever virus
AGLVGVLA

SEQ ID NO: 155280 - protein, 8 aa, Yellow fever virus
GLVGVLAG

SEQ ID NO: 155281 - protein, 8 aa, Yellow fever virus
LVGVLAGL

SEQ ID NO: 155282 - protein, 8 aa, Yellow fever virus
VGVLAGLA

SEQ ID NO: 155283 - protein, 8 aa, Yellow fever virus
GVLAGLAF

SEQ ID NO: 155284 - protein, 8 aa, Yellow fever virus
VLAGLAFQ

SEQ ID NO: 155285 - protein, 8 aa, Yellow fever virus
LAGLAFQE

SEQ ID NO: 155286 - protein, 8 aa, Yellow fever virus
AGLAFQEM

SEQ ID NO: 155287 - protein, 8 aa, Yellow fever virus
GLAFQEME

SEQ ID NO: 155288 - protein, 8 aa, Yellow fever virus
LAFQEMEN

SEQ ID NO: 155289 - protein, 8 aa, Yellow fever virus
AFQEMENF

SEQ ID NO: 155290 - protein, 8 aa, Yellow fever virus
FQEMENFL

SEQ ID NO: 155291 - protein, 8 aa, Yellow fever virus
QEMENFLG

SEQ ID NO: 155292 - protein, 8 aa, Yellow fever virus
EMENFLGP

SEQ ID NO: 155293 - protein, 8 aa, Yellow fever virus
MENFLGPI

SEQ ID NO: 155294 - protein, 8 aa, Yellow fever virus
ENFLGPIA

SEQ ID NO: 155295 - protein, 8 aa, Yellow fever virus
NFLGPIAV

SEQ ID NO: 155296 - protein, 8 aa, Yellow fever virus
FLGPIAVG

SEQ ID NO: 155297 - protein, 8 aa, Yellow fever virus
LGPIAVGG

SEQ ID NO: 155298 - protein, 8 aa, Yellow fever virus
GPIAVGGL

SEQ ID NO: 155299 - protein, 8 aa, Yellow fever virus
PIAVGGLL

SEQ ID NO: 155300 - protein, 8 aa, Yellow fever virus
IAVGGLLM

SEQ ID NO: 155301 - protein, 8 aa, Yellow fever virus
AVGGLLMM

SEQ ID NO: 155302 - protein, 8 aa, Yellow fever virus
VGGLLMML

SEQ ID NO: 155303 - protein, 8 aa, Yellow fever virus
GGLLMMLV

SEQ ID NO: 155304 - protein, 8 aa, Yellow fever virus
GLLMMLVS

SEQ ID NO: 155305 - protein, 8 aa, Yellow fever virus
LLMMLVSV

SEQ ID NO: 155306 - protein, 8 aa, Yellow fever virus
LMMLVSVA

SEQ ID NO: 155307 - protein, 8 aa, Yellow fever virus
MMLVSVAG

SEQ ID NO: 155308 - protein, 8 aa, Yellow fever virus
MLVSVAGR

SEQ ID NO: 155309 - protein, 8 aa, Yellow fever virus
LVSVAGRV

SEQ ID NO: 155310 - protein, 8 aa, Yellow fever virus
VSVAGRVD

SEQ ID NO: 155311 - protein, 8 aa, Yellow fever virus
SVAGRVDG

SEQ ID NO: 155312 - protein, 8 aa, Yellow fever virus
VAGRVDGL

SEQ ID NO: 155313 - protein, 8 aa, Yellow fever virus
AGRVDGLE

SEQ ID NO: 155314 - protein, 8 aa, Yellow fever virus
GRVDGLEL

SEQ ID NO: 155315 - protein, 8 aa, Yellow fever virus
RVDGLELK

SEQ ID NO: 155316 - protein, 8 aa, Yellow fever virus
VDGLELKK

SEQ ID NO: 155317 - protein, 8 aa, Yellow fever virus
DGLELKKL

SEQ ID NO: 155318 - protein, 8 aa, Yellow fever virus
GLELKKLG

SEQ ID NO: 155319 - protein, 8 aa, Yellow fever virus
LELKKLGE

SEQ ID NO: 155320 - protein, 8 aa, Yellow fever virus
ELKKLGEV

SEQ ID NO: 155321 - protein, 8 aa, Yellow fever virus
LKKLGEVS

SEQ ID NO: 155322 - protein, 8 aa, Yellow fever virus
KKLGEVSW

SEQ ID NO: 155323 - protein, 8 aa, Yellow fever virus
KLGEVSWE

SEQ ID NO: 155324 - protein, 8 aa, Yellow fever virus
LGEVSWEE

SEQ ID NO: 155325 - protein, 8 aa, Yellow fever virus
GEVSWEEE

SEQ ID NO: 155326 - protein, 8 aa, Yellow fever virus
EVSWEEEA

SEQ ID NO: 155327 - protein, 8 aa, Yellow fever virus
VSWEEEAE

SEQ ID NO: 155328 - protein, 8 aa, Yellow fever virus
SWEEEAEI

SEQ ID NO: 155329 - protein, 8 aa, Yellow fever virus
WEEEAEIS

SEQ ID NO: 155330 - protein, 8 aa, Yellow fever virus
EEEAEISG

SEQ ID NO: 155331 - protein, 8 aa, Yellow fever virus
EEAEISGS

SEQ ID NO: 155332 - protein, 8 aa, Yellow fever virus
EAEISGSS

SEQ ID NO: 155333 - protein, 8 aa, Yellow fever virus
AEISGSSA

SEQ ID NO: 155334 - protein, 8 aa, Yellow fever virus
EISGSSAR

SEQ ID NO: 155335 - protein, 8 aa, Yellow fever virus
ISGSSARY

SEQ ID NO: 155336 - protein, 8 aa, Yellow fever virus
SGSSARYD

SEQ ID NO: 155337 - protein, 8 aa, Yellow fever virus
GSSARYDV

SEQ ID NO: 155338 - protein, 8 aa, Yellow fever virus
SSARYDVA

SEQ ID NO: 155339 - protein, 8 aa, Yellow fever virus
SARYDVAL

SEQ ID NO: 155340 - protein, 8 aa, Yellow fever virus
ARYDVALS

SEQ ID NO: 155341 - protein, 8 aa, Yellow fever virus
RYDVALSE

SEQ ID NO: 155342 - protein, 8 aa, Yellow fever virus
YDVALSEQ

SEQ ID NO: 155343 - protein, 8 aa, Yellow fever virus
DVALSEQG

SEQ ID NO: 155344 - protein, 8 aa, Yellow fever virus
VALSEQGE

SEQ ID NO: 155345 - protein, 8 aa, Yellow fever virus
ALSEQGEF

SEQ ID NO: 155346 - protein, 8 aa, Yellow fever virus
LSEQGEFK

SEQ ID NO: 155347 - protein, 8 aa, Yellow fever virus
SEQGEFKL

SEQ ID NO: 155348 - protein, 8 aa, Yellow fever virus
EQGEFKLL

SEQ ID NO: 155349 - protein, 8 aa, Yellow fever virus
QGEFKLLS

SEQ ID NO: 155350 - protein, 8 aa, Yellow fever virus
GEFKLLSE

SEQ ID NO: 155351 - protein, 8 aa, Yellow fever virus
EFKLLSEE

SEQ ID NO: 155352 - protein, 8 aa, Yellow fever virus
FKLLSEEK

SEQ ID NO: 155353 - protein, 8 aa, Yellow fever virus
KLLSEEKV

SEQ ID NO: 155354 - protein, 8 aa, Yellow fever virus
LLSEEKVP

SEQ ID NO: 155355 - protein, 8 aa, Yellow fever virus
LSEEKVPW

SEQ ID NO: 155356 - protein, 8 aa, Yellow fever virus
SEEKVPWD

SEQ ID NO: 155357 - protein, 8 aa, Yellow fever virus
EEKVPWDQ

SEQ ID NO: 155358 - protein, 8 aa, Yellow fever virus
EKVPWDQV

SEQ ID NO: 155359 - protein, 8 aa, Yellow fever virus
KVPWDQVV

SEQ ID NO: 155360 - protein, 8 aa, Yellow fever virus
VPWDQVVM

SEQ ID NO: 155361 - protein, 8 aa, Yellow fever virus
PWDQVVMT

SEQ ID NO: 155362 - protein, 8 aa, Yellow fever virus
WDQVVMTS

SEQ ID NO: 155363 - protein, 8 aa, Yellow fever virus
DQVVMTSL

SEQ ID NO: 155364 - protein, 8 aa, Yellow fever virus
QVVMTSLA

SEQ ID NO: 155365 - protein, 8 aa, Yellow fever virus
VVMTSLAL

SEQ ID NO: 155366 - protein, 8 aa, Yellow fever virus
VMTSLALV

SEQ ID NO: 155367 - protein, 8 aa, Yellow fever virus
MTSLALVG

SEQ ID NO: 155368 - protein, 8 aa, Yellow fever virus
TSLALVGA

SEQ ID NO: 155369 - protein, 8 aa, Yellow fever virus
SLALVGAA

SEQ ID NO: 155370 - protein, 8 aa, Yellow fever virus
LALVGAAL

SEQ ID NO: 155371 - protein, 8 aa, Yellow fever virus
ALVGAALH

SEQ ID NO: 155372 - protein, 8 aa, Yellow fever virus
LVGAALHP

SEQ ID NO: 155373 - protein, 8 aa, Yellow fever virus
VGAALHPF

SEQ ID NO: 155374 - protein, 8 aa, Yellow fever virus
GAALHPFA

SEQ ID NO: 155375 - protein, 8 aa, Yellow fever virus
AALHPFAL

SEQ ID NO: 155376 - protein, 8 aa, Yellow fever virus
ALHPFALL

SEQ ID NO: 155377 - protein, 8 aa, Yellow fever virus
LHPFALLL

SEQ ID NO: 155378 - protein, 8 aa, Yellow fever virus
HPFALLLV

SEQ ID NO: 155379 - protein, 8 aa, Yellow fever virus
PFALLLVL

SEQ ID NO: 155380 - protein, 8 aa, Yellow fever virus
FALLLVLA

SEQ ID NO: 155381 - protein, 8 aa, Yellow fever virus
ALLLVLAG

SEQ ID NO: 155382 - protein, 8 aa, Yellow fever virus
LLLVLAGW

SEQ ID NO: 155383 - protein, 8 aa, Yellow fever virus
LLVLAGWL

SEQ ID NO: 155384 - protein, 8 aa, Yellow fever virus
LVLAGWLF

SEQ ID NO: 155385 - protein, 8 aa, Yellow fever virus
VLAGWLFH

SEQ ID NO: 155386 - protein, 8 aa, Yellow fever virus
LAGWLFHV

SEQ ID NO: 155387 - protein, 8 aa, Yellow fever virus
AGWLFHVR

SEQ ID NO: 155388 - protein, 8 aa, Yellow fever virus
GWLFHVRG

SEQ ID NO: 155389 - protein, 8 aa, Yellow fever virus
WLFHVRGA

SEQ ID NO: 155390 - protein, 8 aa, Yellow fever virus
LFHVRGAR

SEQ ID NO: 155391 - protein, 8 aa, Yellow fever virus
FHVRGARR

SEQ ID NO: 155392 - protein, 8 aa, Yellow fever virus
HVRGARRS

SEQ ID NO: 155393 - protein, 8 aa, Yellow fever virus
VRGARRSG

SEQ ID NO: 155394 - protein, 8 aa, Yellow fever virus
RGARRSGD

SEQ ID NO: 155395 - protein, 8 aa, Yellow fever virus
GARRSGDV

SEQ ID NO: 155396 - protein, 8 aa, Yellow fever virus
ARRSGDVL

SEQ ID NO: 155397 - protein, 8 aa, Yellow fever virus
RRSGDVLW

SEQ ID NO: 155398 - protein, 8 aa, Yellow fever virus
RSGDVLWD

SEQ ID NO: 155399 - protein, 8 aa, Yellow fever virus
SGDVLWDI

SEQ ID NO: 155400 - protein, 8 aa, Yellow fever virus
GDVLWDIP

SEQ ID NO: 155401 - protein, 8 aa, Yellow fever virus
DVLWDIPT

SEQ ID NO: 155402 - protein, 8 aa, Yellow fever virus
VLWDIPTP

SEQ ID NO: 155403 - protein, 8 aa, Yellow fever virus
LWDIPTPK

SEQ ID NO: 155404 - protein, 8 aa, Yellow fever virus
WDIPTPKI

SEQ ID NO: 155405 - protein, 8 aa, Yellow fever virus
DIPTPKII

SEQ ID NO: 155406 - protein, 8 aa, Yellow fever virus
IPTPKIIE

SEQ ID NO: 155407 - protein, 8 aa, Yellow fever virus
PTPKIIEE

SEQ ID NO: 155408 - protein, 8 aa, Yellow fever virus
TPKIIEEC

SEQ ID NO: 155409 - protein, 8 aa, Yellow fever virus
PKIIEECE

SEQ ID NO: 155410 - protein, 8 aa, Yellow fever virus
KIIEECEH

SEQ ID NO: 155411 - protein, 8 aa, Yellow fever virus
IIEECEHL

SEQ ID NO: 155412 - protein, 8 aa, Yellow fever virus
IEECEHLE

SEQ ID NO: 155413 - protein, 8 aa, Yellow fever virus
EECEHLED

SEQ ID NO: 155414 - protein, 8 aa, Yellow fever virus
ECEHLEDG

SEQ ID NO: 155415 - protein, 8 aa, Yellow fever virus
CEHLEDGI

SEQ ID NO: 155416 - protein, 8 aa, Yellow fever virus
EHLEDGIY

SEQ ID NO: 155417 - protein, 8 aa, Yellow fever virus
HLEDGIYG

SEQ ID NO: 155418 - protein, 8 aa, Yellow fever virus
LEDGIYGI

SEQ ID NO: 155419 - protein, 8 aa, Yellow fever virus
EDGIYGIF

SEQ ID NO: 155420 - protein, 8 aa, Yellow fever virus
DGIYGIFQ

SEQ ID NO: 155421 - protein, 8 aa, Yellow fever virus
GIYGIFQS

SEQ ID NO: 155422 - protein, 8 aa, Yellow fever virus
IYGIFQST

SEQ ID NO: 155423 - protein, 8 aa, Yellow fever virus
YGIFQSTF

SEQ ID NO: 155424 - protein, 8 aa, Yellow fever virus
GIFQSTFL

SEQ ID NO: 155425 - protein, 8 aa, Yellow fever virus
IFQSTFLG

SEQ ID NO: 155426 - protein, 8 aa, Yellow fever virus
FQSTFLGA

SEQ ID NO: 155427 - protein, 8 aa, Yellow fever virus
QSTFLGAS

SEQ ID NO: 155428 - protein, 8 aa, Yellow fever virus
STFLGASQ

SEQ ID NO: 155429 - protein, 8 aa, Yellow fever virus
TFLGASQR

SEQ ID NO: 155430 - protein, 8 aa, Yellow fever virus
FLGASQRG

SEQ ID NO: 155431 - protein, 8 aa, Yellow fever virus
LGASQRGV

SEQ ID NO: 155432 - protein, 8 aa, Yellow fever virus
GASQRGVG

SEQ ID NO: 155433 - protein, 8 aa, Yellow fever virus
ASQRGVGV

SEQ ID NO: 155434 - protein, 8 aa, Yellow fever virus
SQRGVGVA

SEQ ID NO: 155435 - protein, 8 aa, Yellow fever virus
QRGVGVAQ

SEQ ID NO: 155436 - protein, 8 aa, Yellow fever virus
RGVGVAQG

SEQ ID NO: 155437 - protein, 8 aa, Yellow fever virus
GVGVAQGG

SEQ ID NO: 155438 - protein, 8 aa, Yellow fever virus
VGVAQGGV

SEQ ID NO: 155439 - protein, 8 aa, Yellow fever virus
GVAQGGVF

SEQ ID NO: 155440 - protein, 8 aa, Yellow fever virus
VAQGGVFH

SEQ ID NO: 155441 - protein, 8 aa, Yellow fever virus
AQGGVFHT

SEQ ID NO: 155442 - protein, 8 aa, Yellow fever virus
QGGVFHTM

SEQ ID NO: 155443 - protein, 8 aa, Yellow fever virus
GGVFHTMW

SEQ ID NO: 155444 - protein, 8 aa, Yellow fever virus
GVFHTMWH

SEQ ID NO: 155445 - protein, 8 aa, Yellow fever virus
VFHTMWHV

SEQ ID NO: 155446 - protein, 8 aa, Yellow fever virus
FHTMWHVT

SEQ ID NO: 155447 - protein, 8 aa, Yellow fever virus
HTMWHVTR

SEQ ID NO: 155448 - protein, 8 aa, Yellow fever virus
TMWHVTRG

SEQ ID NO: 155449 - protein, 8 aa, Yellow fever virus
MWHVTRGA

SEQ ID NO: 155450 - protein, 8 aa, Yellow fever virus
WHVTRGAF

SEQ ID NO: 155451 - protein, 8 aa, Yellow fever virus
HVTRGAFL

SEQ ID NO: 155452 - protein, 8 aa, Yellow fever virus
VTRGAFLV

SEQ ID NO: 155453 - protein, 8 aa, Yellow fever virus
TRGAFLVR

SEQ ID NO: 155454 - protein, 8 aa, Yellow fever virus
RGAFLVRN

SEQ ID NO: 155455 - protein, 8 aa, Yellow fever virus
GAFLVRNG

SEQ ID NO: 155456 - protein, 8 aa, Yellow fever virus
AFLVRNGK

SEQ ID NO: 155457 - protein, 8 aa, Yellow fever virus
FLVRNGKK

SEQ ID NO: 155458 - protein, 8 aa, Yellow fever virus
LVRNGKKL

SEQ ID NO: 155459 - protein, 8 aa, Yellow fever virus
VRNGKKLI

SEQ ID NO: 155460 - protein, 8 aa, Yellow fever virus
RNGKKLIP

SEQ ID NO: 155461 - protein, 8 aa, Yellow fever virus
NGKKLIPS

SEQ ID NO: 155462 - protein, 8 aa, Yellow fever virus
GKKLIPSW

SEQ ID NO: 155463 - protein, 8 aa, Yellow fever virus
KKLIPSWA

SEQ ID NO: 155464 - protein, 8 aa, Yellow fever virus
KLIPSWAS

SEQ ID NO: 155465 - protein, 8 aa, Yellow fever virus
LIPSWASV

SEQ ID NO: 155466 - protein, 8 aa, Yellow fever virus
IPSWASVK

SEQ ID NO: 155467 - protein, 8 aa, Yellow fever virus
PSWASVKE

SEQ ID NO: 155468 - protein, 8 aa, Yellow fever virus
SWASVKED

SEQ ID NO: 155469 - protein, 8 aa, Yellow fever virus
WASVKEDL

SEQ ID NO: 155470 - protein, 8 aa, Yellow fever virus
ASVKEDLV

SEQ ID NO: 155471 - protein, 8 aa, Yellow fever virus
SVKEDLVA

SEQ ID NO: 155472 - protein, 8 aa, Yellow fever virus
VKEDLVAY

SEQ ID NO: 155473 - protein, 8 aa, Yellow fever virus
KEDLVAYG

SEQ ID NO: 155474 - protein, 8 aa, Yellow fever virus
EDLVAYGG

SEQ ID NO: 155475 - protein, 8 aa, Yellow fever virus
DLVAYGGS

SEQ ID NO: 155476 - protein, 8 aa, Yellow fever virus
LVAYGGSW

SEQ ID NO: 155477 - protein, 8 aa, Yellow fever virus
VAYGGSWK

SEQ ID NO: 155478 - protein, 8 aa, Yellow fever virus
AYGGSWKL

SEQ ID NO: 155479 - protein, 8 aa, Yellow fever virus
YGGSWKLE

SEQ ID NO: 155480 - protein, 8 aa, Yellow fever virus
GGSWKLEG

SEQ ID NO: 155481 - protein, 8 aa, Yellow fever virus
GSWKLEGR

SEQ ID NO: 155482 - protein, 8 aa, Yellow fever virus
SWKLEGRW

SEQ ID NO: 155483 - protein, 8 aa, Yellow fever virus
WKLEGRWD

SEQ ID NO: 155484 - protein, 8 aa, Yellow fever virus
KLEGRWDG

SEQ ID NO: 155485 - protein, 8 aa, Yellow fever virus
LEGRWDGE

SEQ ID NO: 155486 - protein, 8 aa, Yellow fever virus
EGRWDGEE

SEQ ID NO: 155487 - protein, 8 aa, Yellow fever virus
GRWDGEEE

SEQ ID NO: 155488 - protein, 8 aa, Yellow fever virus
RWDGEEEV

SEQ ID NO: 155489 - protein, 8 aa, Yellow fever virus
WDGEEEVQ

SEQ ID NO: 155490 - protein, 8 aa, Yellow fever virus
DGEEEVQL

SEQ ID NO: 155491 - protein, 8 aa, Yellow fever virus
GEEEVQLI

SEQ ID NO: 155492 - protein, 8 aa, Yellow fever virus
EEEVQLIA

SEQ ID NO: 155493 - protein, 8 aa, Yellow fever virus
EEVQLIAA

SEQ ID NO: 155494 - protein, 8 aa, Yellow fever virus
EVQLIAAV

SEQ ID NO: 155495 - protein, 8 aa, Yellow fever virus
VQLIAAVP

SEQ ID NO: 155496 - protein, 8 aa, Yellow fever virus
QLIAAVPG

SEQ ID NO: 155497 - protein, 8 aa, Yellow fever virus
LIAAVPGK

SEQ ID NO: 155498 - protein, 8 aa, Yellow fever virus
IAAVPGKN

SEQ ID NO: 155499 - protein, 8 aa, Yellow fever virus
AAVPGKNV

SEQ ID NO: 155500 - protein, 8 aa, Yellow fever virus
AVPGKNVV

SEQ ID NO: 155501 - protein, 8 aa, Yellow fever virus
VPGKNVVN

SEQ ID NO: 155502 - protein, 8 aa, Yellow fever virus
PGKNVVNV

SEQ ID NO: 155503 - protein, 8 aa, Yellow fever virus
GKNVVNVQ

SEQ ID NO: 155504 - protein, 8 aa, Yellow fever virus
KNVVNVQT

SEQ ID NO: 155505 - protein, 8 aa, Yellow fever virus
NVVNVQTK

SEQ ID NO: 155506 - protein, 8 aa, Yellow fever virus
VVNVQTKP

SEQ ID NO: 155507 - protein, 8 aa, Yellow fever virus
VNVQTKPS

SEQ ID NO: 155508 - protein, 8 aa, Yellow fever virus
NVQTKPSL

SEQ ID NO: 155509 - protein, 8 aa, Yellow fever virus
VQTKPSLF

SEQ ID NO: 155510 - protein, 8 aa, Yellow fever virus
QTKPSLFK

SEQ ID NO: 155511 - protein, 8 aa, Yellow fever virus
TKPSLFKV

SEQ ID NO: 155512 - protein, 8 aa, Yellow fever virus
KPSLFKVR

SEQ ID NO: 155513 - protein, 8 aa, Yellow fever virus
PSLFKVRN

SEQ ID NO: 155514 - protein, 8 aa, Yellow fever virus
SLFKVRNG

SEQ ID NO: 155515 - protein, 8 aa, Yellow fever virus
LFKVRNGG

SEQ ID NO: 155516 - protein, 8 aa, Yellow fever virus
FKVRNGGE

SEQ ID NO: 155517 - protein, 8 aa, Yellow fever virus
KVRNGGEI

SEQ ID NO: 155518 - protein, 8 aa, Yellow fever virus
VRNGGEIG

SEQ ID NO: 155519 - protein, 8 aa, Yellow fever virus
RNGGEIGA

SEQ ID NO: 155520 - protein, 8 aa, Yellow fever virus
NGGEIGAV

SEQ ID NO: 155521 - protein, 8 aa, Yellow fever virus
GGEIGAVA

SEQ ID NO: 155522 - protein, 8 aa, Yellow fever virus
GEIGAVAL

SEQ ID NO: 155523 - protein, 8 aa, Yellow fever virus
EIGAVALD

SEQ ID NO: 155524 - protein, 8 aa, Yellow fever virus
IGAVALDY

SEQ ID NO: 155525 - protein, 8 aa, Yellow fever virus
GAVALDYP

SEQ ID NO: 155526 - protein, 8 aa, Yellow fever virus
AVALDYPS

SEQ ID NO: 155527 - protein, 8 aa, Yellow fever virus
VALDYPSG

SEQ ID NO: 155528 - protein, 8 aa, Yellow fever virus
ALDYPSGT

SEQ ID NO: 155529 - protein, 8 aa, Yellow fever virus
LDYPSGTS

SEQ ID NO: 155530 - protein, 8 aa, Yellow fever virus
DYPSGTSG

SEQ ID NO: 155531 - protein, 8 aa, Yellow fever virus
YPSGTSGS

SEQ ID NO: 155532 - protein, 8 aa, Yellow fever virus
PSGTSGSP

SEQ ID NO: 155533 - protein, 8 aa, Yellow fever virus
SGTSGSPI

SEQ ID NO: 155534 - protein, 8 aa, Yellow fever virus
GTSGSPIV

SEQ ID NO: 155535 - protein, 8 aa, Yellow fever virus
TSGSPIVN

SEQ ID NO: 155536 - protein, 8 aa, Yellow fever virus
SGSPIVNR

SEQ ID NO: 155537 - protein, 8 aa, Yellow fever virus
GSPIVNRN

SEQ ID NO: 155538 - protein, 8 aa, Yellow fever virus
SPIVNRNG

SEQ ID NO: 155539 - protein, 8 aa, Yellow fever virus
PIVNRNGE

SEQ ID NO: 155540 - protein, 8 aa, Yellow fever virus
IVNRNGEV

SEQ ID NO: 155541 - protein, 8 aa, Yellow fever virus
VNRNGEVI

SEQ ID NO: 155542 - protein, 8 aa, Yellow fever virus
NRNGEVIG

SEQ ID NO: 155543 - protein, 8 aa, Yellow fever virus
RNGEVIGL

SEQ ID NO: 155544 - protein, 8 aa, Yellow fever virus
NGEVIGLY

SEQ ID NO: 155545 - protein, 8 aa, Yellow fever virus
GEVIGLYG

SEQ ID NO: 155546 - protein, 8 aa, Yellow fever virus
EVIGLYGN

SEQ ID NO: 155547 - protein, 8 aa, Yellow fever virus
VIGLYGNG

SEQ ID NO: 155548 - protein, 8 aa, Yellow fever virus
IGLYGNGI

SEQ ID NO: 155549 - protein, 8 aa, Yellow fever virus
GLYGNGIL

SEQ ID NO: 155550 - protein, 8 aa, Yellow fever virus
LYGNGILV

SEQ ID NO: 155551 - protein, 8 aa, Yellow fever virus
YGNGILVG

SEQ ID NO: 155552 - protein, 8 aa, Yellow fever virus
GNGILVGD

SEQ ID NO: 155553 - protein, 8 aa, Yellow fever virus
NGILVGDN

SEQ ID NO: 155554 - protein, 8 aa, Yellow fever virus
GILVGDNS

SEQ ID NO: 155555 - protein, 8 aa, Yellow fever virus
ILVGDNSF

SEQ ID NO: 155556 - protein, 8 aa, Yellow fever virus
LVGDNSFV

SEQ ID NO: 155557 - protein, 8 aa, Yellow fever virus
VGDNSFVS

SEQ ID NO: 155558 - protein, 8 aa, Yellow fever virus
GDNSFVSA

SEQ ID NO: 155559 - protein, 8 aa, Yellow fever virus
DNSFVSAI

SEQ ID NO: 155560 - protein, 8 aa, Yellow fever virus
NSFVSAIS

SEQ ID NO: 155561 - protein, 8 aa, Yellow fever virus
SFVSAISQ

SEQ ID NO: 155562 - protein, 8 aa, Yellow fever virus
FVSAISQT

SEQ ID NO: 155563 - protein, 8 aa, Yellow fever virus
VSAISQTE

SEQ ID NO: 155564 - protein, 8 aa, Yellow fever virus
SAISQTEV

SEQ ID NO: 155565 - protein, 8 aa, Yellow fever virus
AISQTEVK

SEQ ID NO: 155566 - protein, 8 aa, Yellow fever virus
ISQTEVKE

SEQ ID NO: 155567 - protein, 8 aa, Yellow fever virus
SQTEVKEE

SEQ ID NO: 155568 - protein, 8 aa, Yellow fever virus
QTEVKEEG

SEQ ID NO: 155569 - protein, 8 aa, Yellow fever virus
TEVKEEGK

SEQ ID NO: 155570 - protein, 8 aa, Yellow fever virus
EVKEEGKE

SEQ ID NO: 155571 - protein, 8 aa, Yellow fever virus
VKEEGKEE

SEQ ID NO: 155572 - protein, 8 aa, Yellow fever virus
KEEGKEEL

SEQ ID NO: 155573 - protein, 8 aa, Yellow fever virus
EEGKEELQ

SEQ ID NO: 155574 - protein, 8 aa, Yellow fever virus
EGKEELQE

SEQ ID NO: 155575 - protein, 8 aa, Yellow fever virus
GKEELQEI

SEQ ID NO: 155576 - protein, 8 aa, Yellow fever virus
KEELQEIP

SEQ ID NO: 155577 - protein, 8 aa, Yellow fever virus
EELQEIPT

SEQ ID NO: 155578 - protein, 8 aa, Yellow fever virus
ELQEIPTM

SEQ ID NO: 155579 - protein, 8 aa, Yellow fever virus
LQEIPTML

SEQ ID NO: 155580 - protein, 8 aa, Yellow fever virus
QEIPTMLK

SEQ ID NO: 155581 - protein, 8 aa, Yellow fever virus
EIPTMLKK

SEQ ID NO: 155582 - protein, 8 aa, Yellow fever virus
IPTMLKKG

SEQ ID NO: 155583 - protein, 8 aa, Yellow fever virus
PTMLKKGM

SEQ ID NO: 155584 - protein, 8 aa, Yellow fever virus
TMLKKGMT

SEQ ID NO: 155585 - protein, 8 aa, Yellow fever virus
MLKKGMTT

SEQ ID NO: 155586 - protein, 8 aa, Yellow fever virus
LKKGMTTI

SEQ ID NO: 155587 - protein, 8 aa, Yellow fever virus
KKGMTTVL

SEQ ID NO: 155588 - protein, 8 aa, Yellow fever virus
KGMTTILD

SEQ ID NO: 155589 - protein, 8 aa, Yellow fever virus
GMTTVLDF

SEQ ID NO: 155590 - protein, 8 aa, Yellow fever virus
MTTVLDFH

SEQ ID NO: 155591 - protein, 8 aa, Yellow fever virus
TTILDFHP

SEQ ID NO: 155592 - protein, 8 aa, Yellow fever virus
TILDFHPG

SEQ ID NO: 155593 - protein, 8 aa, Yellow fever virus
ILDFHPGA

SEQ ID NO: 155594 - protein, 8 aa, Yellow fever virus
LDFHPGAG

SEQ ID NO: 155595 - protein, 8 aa, Yellow fever virus
DFHPGAGK

SEQ ID NO: 155596 - protein, 8 aa, Yellow fever virus
FHPGAGKT

SEQ ID NO: 155597 - protein, 8 aa, Yellow fever virus
HPGAGKTR

SEQ ID NO: 155598 - protein, 8 aa, Yellow fever virus
PGAGKTRR

SEQ ID NO: 155599 - protein, 8 aa, Yellow fever virus
GAGKTRRF

SEQ ID NO: 155600 - protein, 8 aa, Yellow fever virus
AGKTRRFL

SEQ ID NO: 155601 - protein, 8 aa, Yellow fever virus
GKTRRFLP

SEQ ID NO: 155602 - protein, 8 aa, Yellow fever virus
KTRRFLPQ

SEQ ID NO: 155603 - protein, 8 aa, Yellow fever virus
TRRFLPQI

SEQ ID NO: 155604 - protein, 8 aa, Yellow fever virus
RRFLPQIL

SEQ ID NO: 155605 - protein, 8 aa, Yellow fever virus
RFLPQILA

SEQ ID NO: 155606 - protein, 8 aa, Yellow fever virus
FLPQILAE

SEQ ID NO: 155607 - protein, 8 aa, Yellow fever virus
LPQILAEC

SEQ ID NO: 155608 - protein, 8 aa, Yellow fever virus
PQILAECA

SEQ ID NO: 155609 - protein, 8 aa, Yellow fever virus
QILAECAR

SEQ ID NO: 155610 - protein, 8 aa, Yellow fever virus
ILAECARR

SEQ ID NO: 155611 - protein, 8 aa, Yellow fever virus
LAECARRR

SEQ ID NO: 155612 - protein, 8 aa, Yellow fever virus
AECARRRL

SEQ ID NO: 155613 - protein, 8 aa, Yellow fever virus
ECARRRLR

SEQ ID NO: 155614 - protein, 8 aa, Yellow fever virus
CARRRLRT

SEQ ID NO: 155615 - protein, 8 aa, Yellow fever virus
ARRRLRTL

SEQ ID NO: 155616 - protein, 8 aa, Yellow fever virus
RRRLRTLV

SEQ ID NO: 155617 - protein, 8 aa, Yellow fever virus
RRLRTLVL

SEQ ID NO: 155618 - protein, 8 aa, Yellow fever virus
RLRTLVLA

SEQ ID NO: 155619 - protein, 8 aa, Yellow fever virus
LRTLVLAP

SEQ ID NO: 155620 - protein, 8 aa, Yellow fever virus
RTLVLAPT

SEQ ID NO: 155621 - protein, 8 aa, Yellow fever virus
TLVLAPTR

SEQ ID NO: 155622 - protein, 8 aa, Yellow fever virus
LVLAPTRV

SEQ ID NO: 155623 - protein, 8 aa, Yellow fever virus
VLAPTRVV

SEQ ID NO: 155624 - protein, 8 aa, Yellow fever virus
LAPTRVVL

SEQ ID NO: 155625 - protein, 8 aa, Yellow fever virus
APTRVVLS

SEQ ID NO: 155626 - protein, 8 aa, Yellow fever virus
PTRVVLSE

SEQ ID NO: 155627 - protein, 8 aa, Yellow fever virus
TRVVLSEM

SEQ ID NO: 155628 - protein, 8 aa, Yellow fever virus
RVVLSEMK

SEQ ID NO: 155629 - protein, 8 aa, Yellow fever virus
VVLSEMKE

SEQ ID NO: 155630 - protein, 8 aa, Yellow fever virus
VLSEMKEA

SEQ ID NO: 155631 - protein, 8 aa, Yellow fever virus
LSEMKEAF

SEQ ID NO: 155632 - protein, 8 aa, Yellow fever virus
SEMKEAFH

SEQ ID NO: 155633 - protein, 8 aa, Yellow fever virus
EMKEAFHG

SEQ ID NO: 155634 - protein, 8 aa, Yellow fever virus
MKEAFHGL

SEQ ID NO: 155635 - protein, 8 aa, Yellow fever virus
KEAFHGLD

SEQ ID NO: 155636 - protein, 8 aa, Yellow fever virus
EAFHGLDV

SEQ ID NO: 155637 - protein, 8 aa, Yellow fever virus
AFHGLDVK

SEQ ID NO: 155638 - protein, 8 aa, Yellow fever virus
FHGLDVKF

SEQ ID NO: 155639 - protein, 8 aa, Yellow fever virus
HGLDVKFH

SEQ ID NO: 155640 - protein, 8 aa, Yellow fever virus
GLDVKFHT

SEQ ID NO: 155641 - protein, 8 aa, Yellow fever virus
LDVKFHTQ

SEQ ID NO: 155642 - protein, 8 aa, Yellow fever virus
DVKFHTQA

SEQ ID NO: 155643 - protein, 8 aa, Yellow fever virus
VKFHTQAF

SEQ ID NO: 155644 - protein, 8 aa, Yellow fever virus
KFHTQAFS

SEQ ID NO: 155645 - protein, 8 aa, Yellow fever virus
FHTQAFSA

SEQ ID NO: 155646 - protein, 8 aa, Yellow fever virus
HTQAFSAH

SEQ ID NO: 155647 - protein, 8 aa, Yellow fever virus
TQAFSAHG

SEQ ID NO: 155648 - protein, 8 aa, Yellow fever virus
QAFSAHGS

SEQ ID NO: 155649 - protein, 8 aa, Yellow fever virus
AFSAHGSG

SEQ ID NO: 155650 - protein, 8 aa, Yellow fever virus
FSAHGSGR

SEQ ID NO: 155651 - protein, 8 aa, Yellow fever virus
SAHGSGRE

SEQ ID NO: 155652 - protein, 8 aa, Yellow fever virus
AHGSGREV

SEQ ID NO: 155653 - protein, 8 aa, Yellow fever virus
HGSGREVI

SEQ ID NO: 155654 - protein, 8 aa, Yellow fever virus
GSGREVID

SEQ ID NO: 155655 - protein, 8 aa, Yellow fever virus
SGREVIDA

SEQ ID NO: 155656 - protein, 8 aa, Yellow fever virus
GREVIDAM

SEQ ID NO: 155657 - protein, 8 aa, Yellow fever virus
REVIDAMC

SEQ ID NO: 155658 - protein, 8 aa, Yellow fever virus
EVIDAMCH

SEQ ID NO: 155659 - protein, 8 aa, Yellow fever virus
VIDAMCHA

SEQ ID NO: 155660 - protein, 8 aa, Yellow fever virus
IDAMCHAT

SEQ ID NO: 155661 - protein, 8 aa, Yellow fever virus
DAMCHATL

SEQ ID NO: 155662 - protein, 8 aa, Yellow fever virus
AMCHATLT

SEQ ID NO: 155663 - protein, 8 aa, Yellow fever virus
MCHATLTY

SEQ ID NO: 155664 - protein, 8 aa, Yellow fever virus
CHATLTYR

SEQ ID NO: 155665 - protein, 8 aa, Yellow fever virus
HATLTYRM

SEQ ID NO: 155666 - protein, 8 aa, Yellow fever virus
ATLTYRML

SEQ ID NO: 155667 - protein, 8 aa, Yellow fever virus
TLTYRMLE

SEQ ID NO: 155668 - protein, 8 aa, Yellow fever virus
LTYRMLEP

SEQ ID NO: 155669 - protein, 8 aa, Yellow fever virus
TYRMLEPT

SEQ ID NO: 155670 - protein, 8 aa, Yellow fever virus
YRMLEPTR

SEQ ID NO: 155671 - protein, 8 aa, Yellow fever virus
RMLEPTRV

SEQ ID NO: 155672 - protein, 8 aa, Yellow fever virus
MLEPTRVV

SEQ ID NO: 155673 - protein, 8 aa, Yellow fever virus
LEPTRVVN

SEQ ID NO: 155674 - protein, 8 aa, Yellow fever virus
EPTRVVNW

SEQ ID NO: 155675 - protein, 8 aa, Yellow fever virus
PTRVVNWE

SEQ ID NO: 155676 - protein, 8 aa, Yellow fever virus
TRVVNWEV

SEQ ID NO: 155677 - protein, 8 aa, Yellow fever virus
RVVNWEVI

SEQ ID NO: 155678 - protein, 8 aa, Yellow fever virus
VVNWEVII

SEQ ID NO: 155679 - protein, 8 aa, Yellow fever virus
VNWEVIIM

SEQ ID NO: 155680 - protein, 8 aa, Yellow fever virus
NWEVIIMD

SEQ ID NO: 155681 - protein, 8 aa, Yellow fever virus
WEVIIMDE

SEQ ID NO: 155682 - protein, 8 aa, Yellow fever virus
EVIIMDEA

SEQ ID NO: 155683 - protein, 8 aa, Yellow fever virus
VIIMDEAH

SEQ ID NO: 155684 - protein, 8 aa, Yellow fever virus
IIMDEAHF

SEQ ID NO: 155685 - protein, 8 aa, Yellow fever virus
IMDEAHFL

SEQ ID NO: 155686 - protein, 8 aa, Yellow fever virus
MDEAHFLD

SEQ ID NO: 155687 - protein, 8 aa, Yellow fever virus
DEAHFLDP

SEQ ID NO: 155688 - protein, 8 aa, Yellow fever virus
EAHFLDPA

SEQ ID NO: 155689 - protein, 8 aa, Yellow fever virus
AHFLDPAS

SEQ ID NO: 155690 - protein, 8 aa, Yellow fever virus
HFLDPASI

SEQ ID NO: 155691 - protein, 8 aa, Yellow fever virus
FLDPASIA

SEQ ID NO: 155692 - protein, 8 aa, Yellow fever virus
LDPASIAA

SEQ ID NO: 155693 - protein, 8 aa, Yellow fever virus
DPASIAAR

SEQ ID NO: 155694 - protein, 8 aa, Yellow fever virus
PASIAARG

SEQ ID NO: 155695 - protein, 8 aa, Yellow fever virus
ASIAARGW

SEQ ID NO: 155696 - protein, 8 aa, Yellow fever virus
SIAARGWA

SEQ ID NO: 155697 - protein, 8 aa, Yellow fever virus
IAARGWAA

SEQ ID NO: 155698 - protein, 8 aa, Yellow fever virus
AARGWAAH

SEQ ID NO: 155699 - protein, 8 aa, Yellow fever virus
ARGWAAHR

SEQ ID NO: 155700 - protein, 8 aa, Yellow fever virus
RGWAAHRA

SEQ ID NO: 155701 - protein, 8 aa, Yellow fever virus
GWAAHRAR

SEQ ID NO: 155702 - protein, 8 aa, Yellow fever virus
WAAHRARA

SEQ ID NO: 155703 - protein, 8 aa, Yellow fever virus
AAHRARAN

SEQ ID NO: 155704 - protein, 8 aa, Yellow fever virus
AHRARANE

SEQ ID NO: 155705 - protein, 8 aa, Yellow fever virus
HRARANES

SEQ ID NO: 155706 - protein, 8 aa, Yellow fever virus
RARANESA

SEQ ID NO: 155707 - protein, 8 aa, Yellow fever virus
ARANESAT

SEQ ID NO: 155708 - protein, 8 aa, Yellow fever virus
RANESATI

SEQ ID NO: 155709 - protein, 8 aa, Yellow fever virus
ANESATIL

SEQ ID NO: 155710 - protein, 8 aa, Yellow fever virus
NESATILM

SEQ ID NO: 155711 - protein, 8 aa, Yellow fever virus
ESATILMT

SEQ ID NO: 155712 - protein, 8 aa, Yellow fever virus
SATILMTA

SEQ ID NO: 155713 - protein, 8 aa, Yellow fever virus
ATILMTAT

SEQ ID NO: 155714 - protein, 8 aa, Yellow fever virus
TILMTATP

SEQ ID NO: 155715 - protein, 8 aa, Yellow fever virus
ILMTATPP

SEQ ID NO: 155716 - protein, 8 aa, Yellow fever virus
LMTATPPG

SEQ ID NO: 155717 - protein, 8 aa, Yellow fever virus
MTATPPGT

SEQ ID NO: 155718 - protein, 8 aa, Yellow fever virus
TATPPGTS

SEQ ID NO: 155719 - protein, 8 aa, Yellow fever virus
ATPPGTSD

SEQ ID NO: 155720 - protein, 8 aa, Yellow fever virus
TPPGTSDE

SEQ ID NO: 155721 - protein, 8 aa, Yellow fever virus
PPGTSDEF

SEQ ID NO: 155722 - protein, 8 aa, Yellow fever virus
PGTSDEFP

SEQ ID NO: 155723 - protein, 8 aa, Yellow fever virus
GTSDEFPH

SEQ ID NO: 155724 - protein, 8 aa, Yellow fever virus
TSDEFPHS

SEQ ID NO: 155725 - protein, 8 aa, Yellow fever virus
SDEFPHSN

SEQ ID NO: 155726 - protein, 8 aa, Yellow fever virus
DEFPHSNG

SEQ ID NO: 155727 - protein, 8 aa, Yellow fever virus
EFPHSNGE

SEQ ID NO: 155728 - protein, 8 aa, Yellow fever virus
FPHSNGEI

SEQ ID NO: 155729 - protein, 8 aa, Yellow fever virus
PHSNGEIE

SEQ ID NO: 155730 - protein, 8 aa, Yellow fever virus
HSNGEIED

SEQ ID NO: 155731 - protein, 8 aa, Yellow fever virus
SNGEIEDV

SEQ ID NO: 155732 - protein, 8 aa, Yellow fever virus
NGEIEDVQ

SEQ ID NO: 155733 - protein, 8 aa, Yellow fever virus
GEIEDVQT

SEQ ID NO: 155734 - protein, 8 aa, Yellow fever virus
EIEDVQTD

SEQ ID NO: 155735 - protein, 8 aa, Yellow fever virus
IEDVQTDI

SEQ ID NO: 155736 - protein, 8 aa, Yellow fever virus
EDVQTDIP

SEQ ID NO: 155737 - protein, 8 aa, Yellow fever virus
DVQTDIPS

SEQ ID NO: 155738 - protein, 8 aa, Yellow fever virus
VQTDIPSE

SEQ ID NO: 155739 - protein, 8 aa, Yellow fever virus
QTDIPSEP

SEQ ID NO: 155740 - protein, 8 aa, Yellow fever virus
TDIPSEPW

SEQ ID NO: 155741 - protein, 8 aa, Yellow fever virus
DIPSEPWN

SEQ ID NO: 155742 - protein, 8 aa, Yellow fever virus
IPSEPWNT

SEQ ID NO: 155743 - protein, 8 aa, Yellow fever virus
PSEPWNTG

SEQ ID NO: 155744 - protein, 8 aa, Yellow fever virus
SEPWNTGH

SEQ ID NO: 155745 - protein, 8 aa, Yellow fever virus
EPWNTGHD

SEQ ID NO: 155746 - protein, 8 aa, Yellow fever virus
PWNTGHDW

SEQ ID NO: 155747 - protein, 8 aa, Yellow fever virus
WNTGHDWI

SEQ ID NO: 155748 - protein, 8 aa, Yellow fever virus
NTGHDWIL

SEQ ID NO: 155749 - protein, 8 aa, Yellow fever virus
TGHDWILA

SEQ ID NO: 155750 - protein, 8 aa, Yellow fever virus
GHDWILAD

SEQ ID NO: 155751 - protein, 8 aa, Yellow fever virus
HDWILADK

SEQ ID NO: 155752 - protein, 8 aa, Yellow fever virus
DWILADKR

SEQ ID NO: 155753 - protein, 8 aa, Yellow fever virus
WILADKRP

SEQ ID NO: 155754 - protein, 8 aa, Yellow fever virus
ILADKRPT

SEQ ID NO: 155755 - protein, 8 aa, Yellow fever virus
LADKRPTA

SEQ ID NO: 155756 - protein, 8 aa, Yellow fever virus
ADKRPTAW

SEQ ID NO: 155757 - protein, 8 aa, Yellow fever virus
DKRPTAWF

SEQ ID NO: 155758 - protein, 8 aa, Yellow fever virus
KRPTAWFL

SEQ ID NO: 155759 - protein, 8 aa, Yellow fever virus
RPTAWFLP

SEQ ID NO: 155760 - protein, 8 aa, Yellow fever virus
PTAWFLPS

SEQ ID NO: 155761 - protein, 8 aa, Yellow fever virus
TAWFLPSI

SEQ ID NO: 155762 - protein, 8 aa, Yellow fever virus
AWFLPSIR

SEQ ID NO: 155763 - protein, 8 aa, Yellow fever virus
WFLPSIRA

SEQ ID NO: 155764 - protein, 8 aa, Yellow fever virus
FLPSIRAA

SEQ ID NO: 155765 - protein, 8 aa, Yellow fever virus
LPSIRAAN

SEQ ID NO: 155766 - protein, 8 aa, Yellow fever virus
PSIRAANV

SEQ ID NO: 155767 - protein, 8 aa, Yellow fever virus
SIRAANVM

SEQ ID NO: 155768 - protein, 8 aa, Yellow fever virus
IRAANVMA

SEQ ID NO: 155769 - protein, 8 aa, Yellow fever virus
RAANVMAA

SEQ ID NO: 155770 - protein, 8 aa, Yellow fever virus
AANVMAAS

SEQ ID NO: 155771 - protein, 8 aa, Yellow fever virus
ANVMAASL

SEQ ID NO: 155772 - protein, 8 aa, Yellow fever virus
NVMAASLR

SEQ ID NO: 155773 - protein, 8 aa, Yellow fever virus
VMAASLRK

SEQ ID NO: 155774 - protein, 8 aa, Yellow fever virus
MAASLRKA

SEQ ID NO: 155775 - protein, 8 aa, Yellow fever virus
AASLRKAG

SEQ ID NO: 155776 - protein, 8 aa, Yellow fever virus
ASLRKAGK

SEQ ID NO: 155777 - protein, 8 aa, Yellow fever virus
SLRKAGKS

SEQ ID NO: 155778 - protein, 8 aa, Yellow fever virus
LRKAGKSV

SEQ ID NO: 155779 - protein, 8 aa, Yellow fever virus
RKAGKSVV

SEQ ID NO: 155780 - protein, 8 aa, Yellow fever virus
KAGKSVVV

SEQ ID NO: 155781 - protein, 8 aa, Yellow fever virus
AGKSVVVL

SEQ ID NO: 155782 - protein, 8 aa, Yellow fever virus
GKSVVVLN

SEQ ID NO: 155783 - protein, 8 aa, Yellow fever virus
KSVVVLNR

SEQ ID NO: 155784 - protein, 8 aa, Yellow fever virus
SVVVLNRK

SEQ ID NO: 155785 - protein, 8 aa, Yellow fever virus
VVVLNRKT

SEQ ID NO: 155786 - protein, 8 aa, Yellow fever virus
VVLNRKTF

SEQ ID NO: 155787 - protein, 8 aa, Yellow fever virus
VLNRKTFE

SEQ ID NO: 155788 - protein, 8 aa, Yellow fever virus
LNRKTFER

SEQ ID NO: 155789 - protein, 8 aa, Yellow fever virus
NRKTFERE

SEQ ID NO: 155790 - protein, 8 aa, Yellow fever virus
RKTFEREY

SEQ ID NO: 155791 - protein, 8 aa, Yellow fever virus
KTFEREYP

SEQ ID NO: 155792 - protein, 8 aa, Yellow fever virus
TFEREYPT

SEQ ID NO: 155793 - protein, 8 aa, Yellow fever virus
FEREYPTI

SEQ ID NO: 155794 - protein, 8 aa, Yellow fever virus
EREYPTIK

SEQ ID NO: 155795 - protein, 8 aa, Yellow fever virus
REYPTIKQ

SEQ ID NO: 155796 - protein, 8 aa, Yellow fever virus
EYPTIKQK

SEQ ID NO: 155797 - protein, 8 aa, Yellow fever virus
YPTIKQKK

SEQ ID NO: 155798 - protein, 8 aa, Yellow fever virus
PTIKQKKP

SEQ ID NO: 155799 - protein, 8 aa, Yellow fever virus
TIKQKKPD

SEQ ID NO: 155800 - protein, 8 aa, Yellow fever virus
IKQKKPDF

SEQ ID NO: 155801 - protein, 8 aa, Yellow fever virus
KQKKPDFI

SEQ ID NO: 155802 - protein, 8 aa, Yellow fever virus
QKKPDFIL

SEQ ID NO: 155803 - protein, 8 aa, Yellow fever virus
KKPDFILA

SEQ ID NO: 155804 - protein, 8 aa, Yellow fever virus
KPDFILAT

SEQ ID NO: 155805 - protein, 8 aa, Yellow fever virus
PDFILATD

SEQ ID NO: 155806 - protein, 8 aa, Yellow fever virus
DFILATDI

SEQ ID NO: 155807 - protein, 8 aa, Yellow fever virus
FILATDIA

SEQ ID NO: 155808 - protein, 8 aa, Yellow fever virus
ILATDIAE

SEQ ID NO: 155809 - protein, 8 aa, Yellow fever virus
LATDIAEM

SEQ ID NO: 155810 - protein, 8 aa, Yellow fever virus
ATDIAEMG

SEQ ID NO: 155811 - protein, 8 aa, Yellow fever virus
TDIAEMGA

SEQ ID NO: 155812 - protein, 8 aa, Yellow fever virus
DIAEMGAN

SEQ ID NO: 155813 - protein, 8 aa, Yellow fever virus
IAEMGANL

SEQ ID NO: 155814 - protein, 8 aa, Yellow fever virus
AEMGANLC

SEQ ID NO: 155815 - protein, 8 aa, Yellow fever virus
EMGANLCV

SEQ ID NO: 155816 - protein, 8 aa, Yellow fever virus
MGANLCVE

SEQ ID NO: 155817 - protein, 8 aa, Yellow fever virus
GANLCVER

SEQ ID NO: 155818 - protein, 8 aa, Yellow fever virus
ANLCVERV

SEQ ID NO: 155819 - protein, 8 aa, Yellow fever virus
NLCVERVL

SEQ ID NO: 155820 - protein, 8 aa, Yellow fever virus
LCVERVLD

SEQ ID NO: 155821 - protein, 8 aa, Yellow fever virus
CVERVLDC

SEQ ID NO: 155822 - protein, 8 aa, Yellow fever virus
VERVLDCR

SEQ ID NO: 155823 - protein, 8 aa, Yellow fever virus
ERVLDCRT

SEQ ID NO: 155824 - protein, 8 aa, Yellow fever virus
RVLDCRTA

SEQ ID NO: 155825 - protein, 8 aa, Yellow fever virus
VLDCRTAF

SEQ ID NO: 155826 - protein, 8 aa, Yellow fever virus
LDCRTAFK

SEQ ID NO: 155827 - protein, 8 aa, Yellow fever virus
DCRTAFKP

SEQ ID NO: 155828 - protein, 8 aa, Yellow fever virus
CRTAFKPV

SEQ ID NO: 155829 - protein, 8 aa, Yellow fever virus
RTAFKPVL

SEQ ID NO: 155830 - protein, 8 aa, Yellow fever virus
TAFKPVLV

SEQ ID NO: 155831 - protein, 8 aa, Yellow fever virus
AFKPVLVD

SEQ ID NO: 155832 - protein, 8 aa, Yellow fever virus
FKPVLVDE

SEQ ID NO: 155833 - protein, 8 aa, Yellow fever virus
KPVLVDEG

SEQ ID NO: 155834 - protein, 8 aa, Yellow fever virus
PVLVDEGR

SEQ ID NO: 155835 - protein, 8 aa, Yellow fever virus
VLVDEGRK

SEQ ID NO: 155836 - protein, 8 aa, Yellow fever virus
LVDEGRKV

SEQ ID NO: 155837 - protein, 8 aa, Yellow fever virus
VDEGRKVA

SEQ ID NO: 155838 - protein, 8 aa, Yellow fever virus
DEGRKVAI

SEQ ID NO: 155839 - protein, 8 aa, Yellow fever virus
EGRKVAIK

SEQ ID NO: 155840 - protein, 8 aa, Yellow fever virus
GRKVAIKG

SEQ ID NO: 155841 - protein, 8 aa, Yellow fever virus
RKVAIKGP

SEQ ID NO: 155842 - protein, 8 aa, Yellow fever virus
KVAIKGPL

SEQ ID NO: 155843 - protein, 8 aa, Yellow fever virus
VAIKGPLR

SEQ ID NO: 155844 - protein, 8 aa, Yellow fever virus
AIKGPLRI

SEQ ID NO: 155845 - protein, 8 aa, Yellow fever virus
IKGPLRIS

SEQ ID NO: 155846 - protein, 8 aa, Yellow fever virus
KGPLRISA

SEQ ID NO: 155847 - protein, 8 aa, Yellow fever virus
GPLRISAS

SEQ ID NO: 155848 - protein, 8 aa, Yellow fever virus
PLRISASS

SEQ ID NO: 155849 - protein, 8 aa, Yellow fever virus
LRISASSA

SEQ ID NO: 155850 - protein, 8 aa, Yellow fever virus
RISASSAA

SEQ ID NO: 155851 - protein, 8 aa, Yellow fever virus
ISASSAAQ

SEQ ID NO: 155852 - protein, 8 aa, Yellow fever virus
SASSAAQR

SEQ ID NO: 155853 - protein, 8 aa, Yellow fever virus
ASSAAQRR

SEQ ID NO: 155854 - protein, 8 aa, Yellow fever virus
SSAAQRRG

SEQ ID NO: 155855 - protein, 8 aa, Yellow fever virus
SAAQRRGR

SEQ ID NO: 155856 - protein, 8 aa, Yellow fever virus
AAQRRGRI

SEQ ID NO: 155857 - protein, 8 aa, Yellow fever virus
AQRRGRIG

SEQ ID NO: 155858 - protein, 8 aa, Yellow fever virus
QRRGRIGR

SEQ ID NO: 155859 - protein, 8 aa, Yellow fever virus
RRGRIGRN

SEQ ID NO: 155860 - protein, 8 aa, Yellow fever virus
RGRIGRNP

SEQ ID NO: 155861 - protein, 8 aa, Yellow fever virus
GRIGRNPN

SEQ ID NO: 155862 - protein, 8 aa, Yellow fever virus
RIGRNPNR

SEQ ID NO: 155863 - protein, 8 aa, Yellow fever virus
IGRNPNRD

SEQ ID NO: 155864 - protein, 8 aa, Yellow fever virus
GRNPNRDG

SEQ ID NO: 155865 - protein, 8 aa, Yellow fever virus
RNPNRDGD

SEQ ID NO: 155866 - protein, 8 aa, Yellow fever virus
NPNRDGDS

SEQ ID NO: 155867 - protein, 8 aa, Yellow fever virus
PNRDGDSY

SEQ ID NO: 155868 - protein, 8 aa, Yellow fever virus
NRDGDSYY

SEQ ID NO: 155869 - protein, 8 aa, Yellow fever virus
RDGDSYYY

SEQ ID NO: 155870 - protein, 8 aa, Yellow fever virus
DGDSYYYS

SEQ ID NO: 155871 - protein, 8 aa, Yellow fever virus
GDSYYYSE

SEQ ID NO: 155872 - protein, 8 aa, Yellow fever virus
DSYYYSEP

SEQ ID NO: 155873 - protein, 8 aa, Yellow fever virus
SYYYSEPT

SEQ ID NO: 155874 - protein, 8 aa, Yellow fever virus
YYYSEPTS

SEQ ID NO: 155875 - protein, 8 aa, Yellow fever virus
YYSEPTSE

SEQ ID NO: 155876 - protein, 8 aa, Yellow fever virus
YSEPTSEN

SEQ ID NO: 155877 - protein, 8 aa, Yellow fever virus
SEPTSENN

SEQ ID NO: 155878 - protein, 8 aa, Yellow fever virus
EPTSENNA

SEQ ID NO: 155879 - protein, 8 aa, Yellow fever virus
PTSENNAH

SEQ ID NO: 155880 - protein, 8 aa, Yellow fever virus
TSENNAHH

SEQ ID NO: 155881 - protein, 8 aa, Yellow fever virus
SENNAHHV

SEQ ID NO: 155882 - protein, 8 aa, Yellow fever virus
ENNAHHVC

SEQ ID NO: 155883 - protein, 8 aa, Yellow fever virus
NNAHHVCW

SEQ ID NO: 155884 - protein, 8 aa, Yellow fever virus
NAHHVCWL

SEQ ID NO: 155885 - protein, 8 aa, Yellow fever virus
AHHVCWLE

SEQ ID NO: 155886 - protein, 8 aa, Yellow fever virus
HHVCWLEA

SEQ ID NO: 155887 - protein, 8 aa, Yellow fever virus
HVCWLEAS

SEQ ID NO: 155888 - protein, 8 aa, Yellow fever virus
VCWLEASM

SEQ ID NO: 155889 - protein, 8 aa, Yellow fever virus
CWLEASML

SEQ ID NO: 155890 - protein, 8 aa, Yellow fever virus
WLEASMLL

SEQ ID NO: 155891 - protein, 8 aa, Yellow fever virus
LEASMLLD

SEQ ID NO: 155892 - protein, 8 aa, Yellow fever virus
EASMLLDN

SEQ ID NO: 155893 - protein, 8 aa, Yellow fever virus
ASMLLDNM

SEQ ID NO: 155894 - protein, 8 aa, Yellow fever virus
SMLLDNME

SEQ ID NO: 155895 - protein, 8 aa, Yellow fever virus
MLLDNMEV

SEQ ID NO: 155896 - protein, 8 aa, Yellow fever virus
LLDNMEVR

SEQ ID NO: 155897 - protein, 8 aa, Yellow fever virus
LDNMEVRG

SEQ ID NO: 155898 - protein, 8 aa, Yellow fever virus
DNMEVRGG

SEQ ID NO: 155899 - protein, 8 aa, Yellow fever virus
NMEVRGGM

SEQ ID NO: 155900 - protein, 8 aa, Yellow fever virus
MEVRGGMV

SEQ ID NO: 155901 - protein, 8 aa, Yellow fever virus
EVRGGMVA

SEQ ID NO: 155902 - protein, 8 aa, Yellow fever virus
VRGGMVAP

SEQ ID NO: 155903 - protein, 8 aa, Yellow fever virus
RGGMVAPL

SEQ ID NO: 155904 - protein, 8 aa, Yellow fever virus
GGMVAPLY

SEQ ID NO: 155905 - protein, 8 aa, Yellow fever virus
GMVAPLYG

SEQ ID NO: 155906 - protein, 8 aa, Yellow fever virus
MVAPLYGV

SEQ ID NO: 155907 - protein, 8 aa, Yellow fever virus
VAPLYGVE

SEQ ID NO: 155908 - protein, 8 aa, Yellow fever virus
APLYGVEG

SEQ ID NO: 155909 - protein, 8 aa, Yellow fever virus
PLYGVEGT

SEQ ID NO: 155910 - protein, 8 aa, Yellow fever virus
LYGVEGTK

SEQ ID NO: 155911 - protein, 8 aa, Yellow fever virus
YGVEGTKT

SEQ ID NO: 155912 - protein, 8 aa, Yellow fever virus
GVEGTKTP

SEQ ID NO: 155913 - protein, 8 aa, Yellow fever virus
VEGTKTPV

SEQ ID NO: 155914 - protein, 8 aa, Yellow fever virus
EGTKTPVS

SEQ ID NO: 155915 - protein, 8 aa, Yellow fever virus
GTKTPVSP

SEQ ID NO: 155916 - protein, 8 aa, Yellow fever virus
TKTPVSPG

SEQ ID NO: 155917 - protein, 8 aa, Yellow fever virus
KTPVSPGE

SEQ ID NO: 155918 - protein, 8 aa, Yellow fever virus
TPVSPGEM

SEQ ID NO: 155919 - protein, 8 aa, Yellow fever virus
PVSPGEMR

SEQ ID NO: 155920 - protein, 8 aa, Yellow fever virus
VSPGEMRL

SEQ ID NO: 155921 - protein, 8 aa, Yellow fever virus
SPGEMRLR

SEQ ID NO: 155922 - protein, 8 aa, Yellow fever virus
PGEMRLRD

SEQ ID NO: 155923 - protein, 8 aa, Yellow fever virus
GEMRLRDD

SEQ ID NO: 155924 - protein, 8 aa, Yellow fever virus
EMRLRDDQ

SEQ ID NO: 155925 - protein, 8 aa, Yellow fever virus
MRLRDDQR

SEQ ID NO: 155926 - protein, 8 aa, Yellow fever virus
RLRDDQRK

SEQ ID NO: 155927 - protein, 8 aa, Yellow fever virus
LRDDQRKV

SEQ ID NO: 155928 - protein, 8 aa, Yellow fever virus
RDDQRKVF

SEQ ID NO: 155929 - protein, 8 aa, Yellow fever virus
DDQRKVFR

SEQ ID NO: 155930 - protein, 8 aa, Yellow fever virus
DQRKVFRE

SEQ ID NO: 155931 - protein, 8 aa, Yellow fever virus
QRKVFREL

SEQ ID NO: 155932 - protein, 8 aa, Yellow fever virus
RKVFRELV

SEQ ID NO: 155933 - protein, 8 aa, Yellow fever virus
KVFRELVR

SEQ ID NO: 155934 - protein, 8 aa, Yellow fever virus
VFRELVRN

SEQ ID NO: 155935 - protein, 8 aa, Yellow fever virus
FRELVRNC

SEQ ID NO: 155936 - protein, 8 aa, Yellow fever virus
RELVRNCD

SEQ ID NO: 155937 - protein, 8 aa, Yellow fever virus
ELVRNCDL

SEQ ID NO: 155938 - protein, 8 aa, Yellow fever virus
LVRNCDLP

SEQ ID NO: 155939 - protein, 8 aa, Yellow fever virus
VRNCDLPV

SEQ ID NO: 155940 - protein, 8 aa, Yellow fever virus
RNCDLPVW

SEQ ID NO: 155941 - protein, 8 aa, Yellow fever virus
NCDLPVWL

SEQ ID NO: 155942 - protein, 8 aa, Yellow fever virus
CDLPVWLS

SEQ ID NO: 155943 - protein, 8 aa, Yellow fever virus
DLPVWLSW

SEQ ID NO: 155944 - protein, 8 aa, Yellow fever virus
LPVWLSWQ

SEQ ID NO: 155945 - protein, 8 aa, Yellow fever virus
PVWLSWQV

SEQ ID NO: 155946 - protein, 8 aa, Yellow fever virus
VWLSWQVA

SEQ ID NO: 155947 - protein, 8 aa, Yellow fever virus
WLSWQVAK

SEQ ID NO: 155948 - protein, 8 aa, Yellow fever virus
LSWQVAKA

SEQ ID NO: 155949 - protein, 8 aa, Yellow fever virus
SWQVAKAG

SEQ ID NO: 155950 - protein, 8 aa, Yellow fever virus
WQVAKAGL

SEQ ID NO: 155951 - protein, 8 aa, Yellow fever virus
QVAKAGLK

SEQ ID NO: 155952 - protein, 8 aa, Yellow fever virus
VAKAGLKT

SEQ ID NO: 155953 - protein, 8 aa, Yellow fever virus
AKAGLKTN

SEQ ID NO: 155954 - protein, 8 aa, Yellow fever virus
KAGLKTND

SEQ ID NO: 155955 - protein, 8 aa, Yellow fever virus
AGLKTNDR

SEQ ID NO: 155956 - protein, 8 aa, Yellow fever virus
GLKTNDRK

SEQ ID NO: 155957 - protein, 8 aa, Yellow fever virus
LKTNDRKW

SEQ ID NO: 155958 - protein, 8 aa, Yellow fever virus
KTNDRKWC

SEQ ID NO: 155959 - protein, 8 aa, Yellow fever virus
TNDRKWCF

SEQ ID NO: 155960 - protein, 8 aa, Yellow fever virus
NDRKWCFE

SEQ ID NO: 155961 - protein, 8 aa, Yellow fever virus
DRKWCFEG

SEQ ID NO: 155962 - protein, 8 aa, Yellow fever virus
RKWCFEGP

SEQ ID NO: 155963 - protein, 8 aa, Yellow fever virus
KWCFEGPE

SEQ ID NO: 155964 - protein, 8 aa, Yellow fever virus
WCFEGPEE

SEQ ID NO: 155965 - protein, 8 aa, Yellow fever virus
CFEGPEEH

SEQ ID NO: 155966 - protein, 8 aa, Yellow fever virus
FEGPEEHE

SEQ ID NO: 155967 - protein, 8 aa, Yellow fever virus
EGPEEHEI

SEQ ID NO: 155968 - protein, 8 aa, Yellow fever virus
GPEEHEIL

SEQ ID NO: 155969 - protein, 8 aa, Yellow fever virus
PEEHEILN

SEQ ID NO: 155970 - protein, 8 aa, Yellow fever virus
EEHEILND

SEQ ID NO: 155971 - protein, 8 aa, Yellow fever virus
EHEILNDS

SEQ ID NO: 155972 - protein, 8 aa, Yellow fever virus
HEILNDSG

SEQ ID NO: 155973 - protein, 8 aa, Yellow fever virus
EILNDSGE

SEQ ID NO: 155974 - protein, 8 aa, Yellow fever virus
ILNDSGET

SEQ ID NO: 155975 - protein, 8 aa, Yellow fever virus
LNDSGETV

SEQ ID NO: 155976 - protein, 8 aa, Yellow fever virus
NDSGETVK

SEQ ID NO: 155977 - protein, 8 aa, Yellow fever virus
DSGETVKC

SEQ ID NO: 155978 - protein, 8 aa, Yellow fever virus
SGETVKCR

SEQ ID NO: 155979 - protein, 8 aa, Yellow fever virus
GETVKCRA

SEQ ID NO: 155980 - protein, 8 aa, Yellow fever virus
ETVKCRAP

SEQ ID NO: 155981 - protein, 8 aa, Yellow fever virus
TVKCRAPG

SEQ ID NO: 155982 - protein, 8 aa, Yellow fever virus
VKCRAPGG

SEQ ID NO: 155983 - protein, 8 aa, Yellow fever virus
KCRAPGGA

SEQ ID NO: 155984 - protein, 8 aa, Yellow fever virus
CRAPGGAK

SEQ ID NO: 155985 - protein, 8 aa, Yellow fever virus
RAPGGAKK

SEQ ID NO: 155986 - protein, 8 aa, Yellow fever virus
APGGAKKP

SEQ ID NO: 155987 - protein, 8 aa, Yellow fever virus
PGGAKKPL

SEQ ID NO: 155988 - protein, 8 aa, Yellow fever virus
GGAKKPLR

SEQ ID NO: 155989 - protein, 8 aa, Yellow fever virus
GAKKPLRP

SEQ ID NO: 155990 - protein, 8 aa, Yellow fever virus
AKKPLRPR

SEQ ID NO: 155991 - protein, 8 aa, Yellow fever virus
KKPLRPRW

SEQ ID NO: 155992 - protein, 8 aa, Yellow fever virus
KPLRPRWC

SEQ ID NO: 155993 - protein, 8 aa, Yellow fever virus
PLRPRWCD

SEQ ID NO: 155994 - protein, 8 aa, Yellow fever virus
LRPRWCDE

SEQ ID NO: 155995 - protein, 8 aa, Yellow fever virus
RPRWCDER

SEQ ID NO: 155996 - protein, 8 aa, Yellow fever virus
PRWCDERV

SEQ ID NO: 155997 - protein, 8 aa, Yellow fever virus
RWCDERVS

SEQ ID NO: 155998 - protein, 8 aa, Yellow fever virus
WCDERVSS

SEQ ID NO: 155999 - protein, 8 aa, Yellow fever virus
CDERVSSD

SEQ ID NO: 156000 - protein, 8 aa, Yellow fever virus
DERVSSDQ

SEQ ID NO: 156001 - protein, 8 aa, Yellow fever virus
ERVSSDQS

SEQ ID NO: 156002 - protein, 8 aa, Yellow fever virus
RVSSDQSA

SEQ ID NO: 156003 - protein, 8 aa, Yellow fever virus
VSSDQSAL

SEQ ID NO: 156004 - protein, 8 aa, Yellow fever virus
SSDQSALS

SEQ ID NO: 156005 - protein, 8 aa, Yellow fever virus
SDQSALSE

SEQ ID NO: 156006 - protein, 8 aa, Yellow fever virus
DQSALSEF

SEQ ID NO: 156007 - protein, 8 aa, Yellow fever virus
QSALSEFI

SEQ ID NO: 156008 - protein, 8 aa, Yellow fever virus
SALSEFIK

SEQ ID NO: 156009 - protein, 8 aa, Yellow fever virus
ALSEFIKF

SEQ ID NO: 156010 - protein, 8 aa, Yellow fever virus
LSEFIKFA

SEQ ID NO: 156011 - protein, 8 aa, Yellow fever virus
SEFIKFAE

SEQ ID NO: 156012 - protein, 8 aa, Yellow fever virus
EFIKFAEG

SEQ ID NO: 156013 - protein, 8 aa, Yellow fever virus
FIKFAEGR

SEQ ID NO: 156014 - protein, 8 aa, Yellow fever virus
IKFAEGRR

SEQ ID NO: 156015 - protein, 8 aa, Yellow fever virus
KFAEGRRG

SEQ ID NO: 156016 - protein, 8 aa, Yellow fever virus
FAEGRRGA

SEQ ID NO: 156017 - protein, 8 aa, Yellow fever virus
AEGRRGAA

SEQ ID NO: 156018 - protein, 8 aa, Yellow fever virus
EGRRGAAE

SEQ ID NO: 156019 - protein, 8 aa, Yellow fever virus
GRRGAAEV

SEQ ID NO: 156020 - protein, 8 aa, Yellow fever virus
RRGAAEVL

SEQ ID NO: 156021 - protein, 8 aa, Yellow fever virus
RGAAEVLV

SEQ ID NO: 156022 - protein, 8 aa, Yellow fever virus
GAAEVLVV

SEQ ID NO: 156023 - protein, 8 aa, Yellow fever virus
AAEVLVVL

SEQ ID NO: 156024 - protein, 8 aa, Yellow fever virus
AEVLVVLS

SEQ ID NO: 156025 - protein, 8 aa, Yellow fever virus
EVLVVLSE

SEQ ID NO: 156026 - protein, 8 aa, Yellow fever virus
VLVVLSEL

SEQ ID NO: 156027 - protein, 8 aa, Yellow fever virus
LVVLSELP

SEQ ID NO: 156028 - protein, 8 aa, Yellow fever virus
VVLSELPD

SEQ ID NO: 156029 - protein, 8 aa, Yellow fever virus
VLSELPDF

SEQ ID NO: 156030 - protein, 8 aa, Yellow fever virus
LSELPDFL

SEQ ID NO: 156031 - protein, 8 aa, Yellow fever virus
SELPDFLA

SEQ ID NO: 156032 - protein, 8 aa, Yellow fever virus
ELPDFLAK

SEQ ID NO: 156033 - protein, 8 aa, Yellow fever virus
LPDFLAKK

SEQ ID NO: 156034 - protein, 8 aa, Yellow fever virus
PDFLAKKG

SEQ ID NO: 156035 - protein, 8 aa, Yellow fever virus
DFLAKKGG

SEQ ID NO: 156036 - protein, 8 aa, Yellow fever virus
FLAKKGGE

SEQ ID NO: 156037 - protein, 8 aa, Yellow fever virus
LAKKGGEA

SEQ ID NO: 156038 - protein, 8 aa, Yellow fever virus
AKKGGEAM

SEQ ID NO: 156039 - protein, 8 aa, Yellow fever virus
KKGGEAMD

SEQ ID NO: 156040 - protein, 8 aa, Yellow fever virus
KGGEAMDT

SEQ ID NO: 156041 - protein, 8 aa, Yellow fever virus
GGEAMDTI

SEQ ID NO: 156042 - protein, 8 aa, Yellow fever virus
GEAMDTIS

SEQ ID NO: 156043 - protein, 8 aa, Yellow fever virus
EAMDTISV

SEQ ID NO: 156044 - protein, 8 aa, Yellow fever virus
AMDTISVF

SEQ ID NO: 156045 - protein, 8 aa, Yellow fever virus
MDTISVFL

SEQ ID NO: 156046 - protein, 8 aa, Yellow fever virus
DTISVFLH

SEQ ID NO: 156047 - protein, 8 aa, Yellow fever virus
TISVFLHS

SEQ ID NO: 156048 - protein, 8 aa, Yellow fever virus
ISVFLHSE

SEQ ID NO: 156049 - protein, 8 aa, Yellow fever virus
SVFLHSEE

SEQ ID NO: 156050 - protein, 8 aa, Yellow fever virus
VFLHSEEG

SEQ ID NO: 156051 - protein, 8 aa, Yellow fever virus
FLHSEEGS

SEQ ID NO: 156052 - protein, 8 aa, Yellow fever virus
LHSEEGSR

SEQ ID NO: 156053 - protein, 8 aa, Yellow fever virus
HSEEGSRA

SEQ ID NO: 156054 - protein, 8 aa, Yellow fever virus
SEEGSRAY

SEQ ID NO: 156055 - protein, 8 aa, Yellow fever virus
EEGSRAYR

SEQ ID NO: 156056 - protein, 8 aa, Yellow fever virus
EGSRAYRN

SEQ ID NO: 156057 - protein, 8 aa, Yellow fever virus
GSRAYRNA

SEQ ID NO: 156058 - protein, 8 aa, Yellow fever virus
SRAYRNAL

SEQ ID NO: 156059 - protein, 8 aa, Yellow fever virus
RAYRNALS

SEQ ID NO: 156060 - protein, 8 aa, Yellow fever virus
AYRNALSM

SEQ ID NO: 156061 - protein, 8 aa, Yellow fever virus
YRNALSMM

SEQ ID NO: 156062 - protein, 8 aa, Yellow fever virus
RNALSMMP

SEQ ID NO: 156063 - protein, 8 aa, Yellow fever virus
NALSMMPE

SEQ ID NO: 156064 - protein, 8 aa, Yellow fever virus
ALSMMPEA

SEQ ID NO: 156065 - protein, 8 aa, Yellow fever virus
LSMMPEAM

SEQ ID NO: 156066 - protein, 8 aa, Yellow fever virus
SMMPEAMT

SEQ ID NO: 156067 - protein, 8 aa, Yellow fever virus
MMPEAMTI

SEQ ID NO: 156068 - protein, 8 aa, Yellow fever virus
MPEAMTIV

SEQ ID NO: 156069 - protein, 8 aa, Yellow fever virus
PEAMTIVM

SEQ ID NO: 156070 - protein, 8 aa, Yellow fever virus
EAMTIVML

SEQ ID NO: 156071 - protein, 8 aa, Yellow fever virus
AMTIVMLF

SEQ ID NO: 156072 - protein, 8 aa, Yellow fever virus
MTIVMLFI

SEQ ID NO: 156073 - protein, 8 aa, Yellow fever virus
TIVMLFIL

SEQ ID NO: 156074 - protein, 8 aa, Yellow fever virus
IVMLFILA

SEQ ID NO: 156075 - protein, 8 aa, Yellow fever virus
VMLFILAG

SEQ ID NO: 156076 - protein, 8 aa, Yellow fever virus
MLFILAGL

SEQ ID NO: 156077 - protein, 8 aa, Yellow fever virus
LFILAGLL

SEQ ID NO: 156078 - protein, 8 aa, Yellow fever virus
FILAGLLT

SEQ ID NO: 156079 - protein, 8 aa, Yellow fever virus
ILAGLLTS

SEQ ID NO: 156080 - protein, 8 aa, Yellow fever virus
LAGLLTSG

SEQ ID NO: 156081 - protein, 8 aa, Yellow fever virus
AGLLTSGM

SEQ ID NO: 156082 - protein, 8 aa, Yellow fever virus
GLLTSGMV

SEQ ID NO: 156083 - protein, 8 aa, Yellow fever virus
LLTSGMVI

SEQ ID NO: 156084 - protein, 8 aa, Yellow fever virus
LTSGMVIF

SEQ ID NO: 156085 - protein, 8 aa, Yellow fever virus
TSGMVIFF

SEQ ID NO: 156086 - protein, 8 aa, Yellow fever virus
SGMVIFFM

SEQ ID NO: 156087 - protein, 8 aa, Yellow fever virus
GMVIFFMS

SEQ ID NO: 156088 - protein, 8 aa, Yellow fever virus
MVIFFMSP

SEQ ID NO: 156089 - protein, 8 aa, Yellow fever virus
VIFFMSPK

SEQ ID NO: 156090 - protein, 8 aa, Yellow fever virus
IFFMSPKG

SEQ ID NO: 156091 - protein, 8 aa, Yellow fever virus
FFMSPKGI

SEQ ID NO: 156092 - protein, 8 aa, Yellow fever virus
FMSPKGIS

SEQ ID NO: 156093 - protein, 8 aa, Yellow fever virus
MSPKGISR

SEQ ID NO: 156094 - protein, 8 aa, Yellow fever virus
SPKGISRM

SEQ ID NO: 156095 - protein, 8 aa, Yellow fever virus
PKGISRMS

SEQ ID NO: 156096 - protein, 8 aa, Yellow fever virus
KGISRMSM

SEQ ID NO: 156097 - protein, 8 aa, Yellow fever virus
GISRMSMA

SEQ ID NO: 156098 - protein, 8 aa, Yellow fever virus
ISRMSMAM

SEQ ID NO: 156099 - protein, 8 aa, Yellow fever virus
SRMSMAMG

SEQ ID NO: 156100 - protein, 8 aa, Yellow fever virus
RMSMAMGT

SEQ ID NO: 156101 - protein, 8 aa, Yellow fever virus
MSMAMGTM

SEQ ID NO: 156102 - protein, 8 aa, Yellow fever virus
SMAMGTMA

SEQ ID NO: 156103 - protein, 8 aa, Yellow fever virus
MAMGTMAG

SEQ ID NO: 156104 - protein, 8 aa, Yellow fever virus
AMGTMAGC

SEQ ID NO: 156105 - protein, 8 aa, Yellow fever virus
MGTMAGCG

SEQ ID NO: 156106 - protein, 8 aa, Yellow fever virus
GTMAGCGY

SEQ ID NO: 156107 - protein, 8 aa, Yellow fever virus
TMAGCGYL

SEQ ID NO: 156108 - protein, 8 aa, Yellow fever virus
MAGCGYLM

SEQ ID NO: 156109 - protein, 8 aa, Yellow fever virus
AGCGYLMF

SEQ ID NO: 156110 - protein, 8 aa, Yellow fever virus
GCGYLMFL

SEQ ID NO: 156111 - protein, 8 aa, Yellow fever virus
CGYLMFLG

SEQ ID NO: 156112 - protein, 8 aa, Yellow fever virus
GYLMFLGG

SEQ ID NO: 156113 - protein, 8 aa, Yellow fever virus
YLMFLGGV

SEQ ID NO: 156114 - protein, 8 aa, Yellow fever virus
LMFLGGVK

SEQ ID NO: 156115 - protein, 8 aa, Yellow fever virus
MFLGGVKP

SEQ ID NO: 156116 - protein, 8 aa, Yellow fever virus
FLGGVKPT

SEQ ID NO: 156117 - protein, 8 aa, Yellow fever virus
LGGVKPTH

SEQ ID NO: 156118 - protein, 8 aa, Yellow fever virus
GGVKPTHI

SEQ ID NO: 156119 - protein, 8 aa, Yellow fever virus
GVKPTHIS

SEQ ID NO: 156120 - protein, 8 aa, Yellow fever virus
VKPTHISY

SEQ ID NO: 156121 - protein, 8 aa, Yellow fever virus
KPTHISYI

SEQ ID NO: 156122 - protein, 8 aa, Yellow fever virus
PTHISYIM

SEQ ID NO: 156123 - protein, 8 aa, Yellow fever virus
THISYIML

SEQ ID NO: 156124 - protein, 8 aa, Yellow fever virus
HISYIMLI

SEQ ID NO: 156125 - protein, 8 aa, Yellow fever virus
ISYIMLIF

SEQ ID NO: 156126 - protein, 8 aa, Yellow fever virus
SYIMLIFF

SEQ ID NO: 156127 - protein, 8 aa, Yellow fever virus
YIMLIFFV

SEQ ID NO: 156128 - protein, 8 aa, Yellow fever virus
IMLIFFVL

SEQ ID NO: 156129 - protein, 8 aa, Yellow fever virus
MLIFFVLM

SEQ ID NO: 156130 - protein, 8 aa, Yellow fever virus
LIFFVLMV

SEQ ID NO: 156131 - protein, 8 aa, Yellow fever virus
IFFVLMVV

SEQ ID NO: 156132 - protein, 8 aa, Yellow fever virus
FFVLMVVV

SEQ ID NO: 156133 - protein, 8 aa, Yellow fever virus
FVLMVVVI

SEQ ID NO: 156134 - protein, 8 aa, Yellow fever virus
VLMVVVIP

SEQ ID NO: 156135 - protein, 8 aa, Yellow fever virus
LMVVVIPE

SEQ ID NO: 156136 - protein, 8 aa, Yellow fever virus
MVVVIPEP

SEQ ID NO: 156137 - protein, 8 aa, Yellow fever virus
VVVIPEPG

SEQ ID NO: 156138 - protein, 8 aa, Yellow fever virus
VVIPEPGQ

SEQ ID NO: 156139 - protein, 8 aa, Yellow fever virus
VIPEPGQQ

SEQ ID NO: 156140 - protein, 8 aa, Yellow fever virus
IPEPGQQR

SEQ ID NO: 156141 - protein, 8 aa, Yellow fever virus
PEPGQQRS

SEQ ID NO: 156142 - protein, 8 aa, Yellow fever virus
EPGQQRSI

SEQ ID NO: 156143 - protein, 8 aa, Yellow fever virus
PGQQRSIQ

SEQ ID NO: 156144 - protein, 8 aa, Yellow fever virus
GQQRSIQD

SEQ ID NO: 156145 - protein, 8 aa, Yellow fever virus
QQRSIQDN

SEQ ID NO: 156146 - protein, 8 aa, Yellow fever virus
QRSIQDNQ

SEQ ID NO: 156147 - protein, 8 aa, Yellow fever virus
RSIQDNQV

SEQ ID NO: 156148 - protein, 8 aa, Yellow fever virus
SIQDNQVA

SEQ ID NO: 156149 - protein, 8 aa, Yellow fever virus
IQDNQVAY

SEQ ID NO: 156150 - protein, 8 aa, Yellow fever virus
QDNQVAYL

SEQ ID NO: 156151 - protein, 8 aa, Yellow fever virus
DNQVAYLI

SEQ ID NO: 156152 - protein, 8 aa, Yellow fever virus
NQVAYLII

SEQ ID NO: 156153 - protein, 8 aa, Yellow fever virus
QVAYLIIG

SEQ ID NO: 156154 - protein, 8 aa, Yellow fever virus
VAYLIIGI

SEQ ID NO: 156155 - protein, 8 aa, Yellow fever virus
AYLIIGIL

SEQ ID NO: 156156 - protein, 8 aa, Yellow fever virus
YLIIGILT

SEQ ID NO: 156157 - protein, 8 aa, Yellow fever virus
LIIGILTL

SEQ ID NO: 156158 - protein, 8 aa, Yellow fever virus
IIGILTLV

SEQ ID NO: 156159 - protein, 8 aa, Yellow fever virus
IGILTLVS

SEQ ID NO: 156160 - protein, 8 aa, Yellow fever virus
GILTLVSA

SEQ ID NO: 156161 - protein, 8 aa, Yellow fever virus
ILTLVSAV

SEQ ID NO: 156162 - protein, 8 aa, Yellow fever virus
LTLVSAVA

SEQ ID NO: 156163 - protein, 8 aa, Yellow fever virus
TLVSAVAA

SEQ ID NO: 156164 - protein, 8 aa, Yellow fever virus
LVSAVAAN

SEQ ID NO: 156165 - protein, 8 aa, Yellow fever virus
VSAVAANE

SEQ ID NO: 156166 - protein, 8 aa, Yellow fever virus
SAVAANEL

SEQ ID NO: 156167 - protein, 8 aa, Yellow fever virus
AVAANELG

SEQ ID NO: 156168 - protein, 8 aa, Yellow fever virus
VAANELGM

SEQ ID NO: 156169 - protein, 8 aa, Yellow fever virus
AANELGML

SEQ ID NO: 156170 - protein, 8 aa, Yellow fever virus
ANELGMLE

SEQ ID NO: 156171 - protein, 8 aa, Yellow fever virus
NELGMLEK

SEQ ID NO: 156172 - protein, 8 aa, Yellow fever virus
ELGMLEKT

SEQ ID NO: 156173 - protein, 8 aa, Yellow fever virus
LGMLEKTK

SEQ ID NO: 156174 - protein, 8 aa, Yellow fever virus
GMLEKTKE

SEQ ID NO: 156175 - protein, 8 aa, Yellow fever virus
MLEKTKED

SEQ ID NO: 156176 - protein, 8 aa, Yellow fever virus
LEKTKEDL

SEQ ID NO: 156177 - protein, 8 aa, Yellow fever virus
EKTKEDLF

SEQ ID NO: 156178 - protein, 8 aa, Yellow fever virus
KTKEDLFG

SEQ ID NO: 156179 - protein, 8 aa, Yellow fever virus
TKEDLFGK

SEQ ID NO: 156180 - protein, 8 aa, Yellow fever virus
KEDLFGKK

SEQ ID NO: 156181 - protein, 8 aa, Yellow fever virus
EDLFGKKN

SEQ ID NO: 156182 - protein, 8 aa, Yellow fever virus
IPSSASPW

SEQ ID NO: 156183 - protein, 8 aa, Yellow fever virus
PSSASPWS

SEQ ID NO: 156184 - protein, 8 aa, Yellow fever virus
SSASPWSW

SEQ ID NO: 156185 - protein, 8 aa, Yellow fever virus
SASPWSWP

SEQ ID NO: 156186 - protein, 8 aa, Yellow fever virus
ASPWSWPD

SEQ ID NO: 156187 - protein, 8 aa, Yellow fever virus
SPWSWPDL

SEQ ID NO: 156188 - protein, 8 aa, Yellow fever virus
PWSWPDLD

SEQ ID NO: 156189 - protein, 8 aa, Yellow fever virus
WSWPDLDL

SEQ ID NO: 156190 - protein, 8 aa, Yellow fever virus
SWPDLDLK

SEQ ID NO: 156191 - protein, 8 aa, Yellow fever virus
WPDLDLKP

SEQ ID NO: 156192 - protein, 8 aa, Yellow fever virus
PDLDLKPG

SEQ ID NO: 156193 - protein, 8 aa, Yellow fever virus
DLDLKPGA

SEQ ID NO: 156194 - protein, 8 aa, Yellow fever virus
LDLKPGAA

SEQ ID NO: 156195 - protein, 8 aa, Yellow fever virus
DLKPGAAW

SEQ ID NO: 156196 - protein, 8 aa, Yellow fever virus
LKPGAAWT

SEQ ID NO: 156197 - protein, 8 aa, Yellow fever virus
KPGAAWTV

SEQ ID NO: 156198 - protein, 8 aa, Yellow fever virus
PGAAWTVY

SEQ ID NO: 156199 - protein, 8 aa, Yellow fever virus
GAAWTVYV

SEQ ID NO: 156200 - protein, 8 aa, Yellow fever virus
AAWTVYVG

SEQ ID NO: 156201 - protein, 8 aa, Yellow fever virus
AWTVYVGI

SEQ ID NO: 156202 - protein, 8 aa, Yellow fever virus
WTVYVGIV

SEQ ID NO: 156203 - protein, 8 aa, Yellow fever virus
TVYVGIVT

SEQ ID NO: 156204 - protein, 8 aa, Yellow fever virus
VYVGIVTM

SEQ ID NO: 156205 - protein, 8 aa, Yellow fever virus
YVGIVTML

SEQ ID NO: 156206 - protein, 8 aa, Yellow fever virus
VGIVTMLS

SEQ ID NO: 156207 - protein, 8 aa, Yellow fever virus
GIVTMLSP

SEQ ID NO: 156208 - protein, 8 aa, Yellow fever virus
IVTMLSPM

SEQ ID NO: 156209 - protein, 8 aa, Yellow fever virus
VTMLSPML

SEQ ID NO: 156210 - protein, 8 aa, Yellow fever virus
TMLSPMLH

SEQ ID NO: 156211 - protein, 8 aa, Yellow fever virus
MLSPMLHH

SEQ ID NO: 156212 - protein, 8 aa, Yellow fever virus
LSPMLHHW

SEQ ID NO: 156213 - protein, 8 aa, Yellow fever virus
SPMLHHWI

SEQ ID NO: 156214 - protein, 8 aa, Yellow fever virus
PMLHHWIK

SEQ ID NO: 156215 - protein, 8 aa, Yellow fever virus
MLHHWIKV

SEQ ID NO: 156216 - protein, 8 aa, Yellow fever virus
LHHWIKVE

SEQ ID NO: 156217 - protein, 8 aa, Yellow fever virus
HHWIKVEY

SEQ ID NO: 156218 - protein, 8 aa, Yellow fever virus
HWIKVEYG

SEQ ID NO: 156219 - protein, 8 aa, Yellow fever virus
WIKVEYGN

SEQ ID NO: 156220 - protein, 8 aa, Yellow fever virus
IKVEYGNL

SEQ ID NO: 156221 - protein, 8 aa, Yellow fever virus
KVEYGNLS

SEQ ID NO: 156222 - protein, 8 aa, Yellow fever virus
VEYGNLSL

SEQ ID NO: 156223 - protein, 8 aa, Yellow fever virus
EYGNLSLS

SEQ ID NO: 156224 - protein, 8 aa, Yellow fever virus
YGNLSLSG

SEQ ID NO: 156225 - protein, 8 aa, Yellow fever virus
GNLSLSGI

SEQ ID NO: 156226 - protein, 8 aa, Yellow fever virus
NLSLSGIA

SEQ ID NO: 156227 - protein, 8 aa, Yellow fever virus
LSLSGIAQ

SEQ ID NO: 156228 - protein, 8 aa, Yellow fever virus
SLSGIAQS

SEQ ID NO: 156229 - protein, 8 aa, Yellow fever virus
LSGIAQSA

SEQ ID NO: 156230 - protein, 8 aa, Yellow fever virus
SGIAQSAS

SEQ ID NO: 156231 - protein, 8 aa, Yellow fever virus
GIAQSASV

SEQ ID NO: 156232 - protein, 8 aa, Yellow fever virus
IAQSASVL

SEQ ID NO: 156233 - protein, 8 aa, Yellow fever virus
AQSASVLS

SEQ ID NO: 156234 - protein, 8 aa, Yellow fever virus
QSASVLSF

SEQ ID NO: 156235 - protein, 8 aa, Yellow fever virus
SASVLSFM

SEQ ID NO: 156236 - protein, 8 aa, Yellow fever virus
ASVLSFMD

SEQ ID NO: 156237 - protein, 8 aa, Yellow fever virus
SVLSFMDK

SEQ ID NO: 156238 - protein, 8 aa, Yellow fever virus
VLSFMDKG

SEQ ID NO: 156239 - protein, 8 aa, Yellow fever virus
LSFMDKGI

SEQ ID NO: 156240 - protein, 8 aa, Yellow fever virus
SFMDKGIP

SEQ ID NO: 156241 - protein, 8 aa, Yellow fever virus
FMDKGIPF

SEQ ID NO: 156242 - protein, 8 aa, Yellow fever virus
MDKGIPFM

SEQ ID NO: 156243 - protein, 8 aa, Yellow fever virus
DKGIPFMK

SEQ ID NO: 156244 - protein, 8 aa, Yellow fever virus
KGIPFMKM

SEQ ID NO: 156245 - protein, 8 aa, Yellow fever virus
GIPFMKMN

SEQ ID NO: 156246 - protein, 8 aa, Yellow fever virus
IPFMKMNI

SEQ ID NO: 156247 - protein, 8 aa, Yellow fever virus
PFMKMNIS

SEQ ID NO: 156248 - protein, 8 aa, Yellow fever virus
FMKMNISV

SEQ ID NO: 156249 - protein, 8 aa, Yellow fever virus
MKMNISVI

SEQ ID NO: 156250 - protein, 8 aa, Yellow fever virus
KMNISVIM

SEQ ID NO: 156251 - protein, 8 aa, Yellow fever virus
MNISVIML

SEQ ID NO: 156252 - protein, 8 aa, Yellow fever virus
NISVIMLL

SEQ ID NO: 156253 - protein, 8 aa, Yellow fever virus
ISVIMLLV

SEQ ID NO: 156254 - protein, 8 aa, Yellow fever virus
SVIMLLVS

SEQ ID NO: 156255 - protein, 8 aa, Yellow fever virus
VIMLLVSG

SEQ ID NO: 156256 - protein, 8 aa, Yellow fever virus
IMLLVSGW

SEQ ID NO: 156257 - protein, 8 aa, Yellow fever virus
MLLVSGWN

SEQ ID NO: 156258 - protein, 8 aa, Yellow fever virus
LLVSGWNS

SEQ ID NO: 156259 - protein, 8 aa, Yellow fever virus
LVSGWNSI

SEQ ID NO: 156260 - protein, 8 aa, Yellow fever virus
VSGWNSIT

SEQ ID NO: 156261 - protein, 8 aa, Yellow fever virus
SGWNSITV

SEQ ID NO: 156262 - protein, 8 aa, Yellow fever virus
GWNSITVM

SEQ ID NO: 156263 - protein, 8 aa, Yellow fever virus
WNSITVMP

SEQ ID NO: 156264 - protein, 8 aa, Yellow fever virus
NSITVMPL

SEQ ID NO: 156265 - protein, 8 aa, Yellow fever virus
SITVMPLL

SEQ ID NO: 156266 - protein, 8 aa, Yellow fever virus
ITVMPLLC

SEQ ID NO: 156267 - protein, 8 aa, Yellow fever virus
TVMPLLCG

SEQ ID NO: 156268 - protein, 8 aa, Yellow fever virus
VMPLLCGI

SEQ ID NO: 156269 - protein, 8 aa, Yellow fever virus
MPLLCGIG

SEQ ID NO: 156270 - protein, 8 aa, Yellow fever virus
PLLCGIGC

SEQ ID NO: 156271 - protein, 8 aa, Yellow fever virus
LLCGIGCA

SEQ ID NO: 156272 - protein, 8 aa, Yellow fever virus
LCGIGCAM

SEQ ID NO: 156273 - protein, 8 aa, Yellow fever virus
CGIGCAML

SEQ ID NO: 156274 - protein, 8 aa, Yellow fever virus
GIGCAMLH

SEQ ID NO: 156275 - protein, 8 aa, Yellow fever virus
IGCAMLHW

SEQ ID NO: 156276 - protein, 8 aa, Yellow fever virus
GCAMLHWS

SEQ ID NO: 156277 - protein, 8 aa, Yellow fever virus
CAMLHWSL

SEQ ID NO: 156278 - protein, 8 aa, Yellow fever virus
AMLHWSLI

SEQ ID NO: 156279 - protein, 8 aa, Yellow fever virus
MLHWSLIL

SEQ ID NO: 156280 - protein, 8 aa, Yellow fever virus
LHWSLILP

SEQ ID NO: 156281 - protein, 8 aa, Yellow fever virus
HWSLILPG

SEQ ID NO: 156282 - protein, 8 aa, Yellow fever virus
WSLILPGI

SEQ ID NO: 156283 - protein, 8 aa, Yellow fever virus
SLILPGIK

SEQ ID NO: 156284 - protein, 8 aa, Yellow fever virus
LILPGIKA

SEQ ID NO: 156285 - protein, 8 aa, Yellow fever virus
ILPGIKAQ

SEQ ID NO: 156286 - protein, 8 aa, Yellow fever virus
LPGIKAQQ

SEQ ID NO: 156287 - protein, 8 aa, Yellow fever virus
PGIKAQQS

SEQ ID NO: 156288 - protein, 8 aa, Yellow fever virus
GIKAQQSK

SEQ ID NO: 156289 - protein, 8 aa, Yellow fever virus
IKAQQSKL

SEQ ID NO: 156290 - protein, 8 aa, Yellow fever virus
KAQQSKLA

SEQ ID NO: 156291 - protein, 8 aa, Yellow fever virus
AQQSKLAQ

SEQ ID NO: 156292 - protein, 8 aa, Yellow fever virus
QQSKLAQR

SEQ ID NO: 156293 - protein, 8 aa, Yellow fever virus
QSKLAQRR

SEQ ID NO: 156294 - protein, 8 aa, Yellow fever virus
SKLAQRRV

SEQ ID NO: 156295 - protein, 8 aa, Yellow fever virus
KLAQRRVF

SEQ ID NO: 156296 - protein, 8 aa, Yellow fever virus
LAQRRVFH

SEQ ID NO: 156297 - protein, 8 aa, Yellow fever virus
AQRRVFHG

SEQ ID NO: 156298 - protein, 8 aa, Yellow fever virus
QRRVFHGV

SEQ ID NO: 156299 - protein, 8 aa, Yellow fever virus
RRVFHGVA

SEQ ID NO: 156300 - protein, 8 aa, Yellow fever virus
RVFHGVAK

SEQ ID NO: 156301 - protein, 8 aa, Yellow fever virus
VFHGVAKN

SEQ ID NO: 156302 - protein, 8 aa, Yellow fever virus
FHGVAKNP

SEQ ID NO: 156303 - protein, 8 aa, Yellow fever virus
HGVAKNPV

SEQ ID NO: 156304 - protein, 8 aa, Yellow fever virus
GVAKNPVV

SEQ ID NO: 156305 - protein, 8 aa, Yellow fever virus
VAKNPVVD

SEQ ID NO: 156306 - protein, 8 aa, Yellow fever virus
AKNPVVDG

SEQ ID NO: 156307 - protein, 8 aa, Yellow fever virus
KNPVVDGN

SEQ ID NO: 156308 - protein, 8 aa, Yellow fever virus
NPVVDGNP

SEQ ID NO: 156309 - protein, 8 aa, Yellow fever virus
PVVDGNPT

SEQ ID NO: 156310 - protein, 8 aa, Yellow fever virus
VVDGNPTV

SEQ ID NO: 156311 - protein, 8 aa, Yellow fever virus
VDGNPTVD

SEQ ID NO: 156312 - protein, 8 aa, Yellow fever virus
DGNPTVDI

SEQ ID NO: 156313 - protein, 8 aa, Yellow fever virus
GNPTVDIE

SEQ ID NO: 156314 - protein, 8 aa, Yellow fever virus
NPTVDIEE

SEQ ID NO: 156315 - protein, 8 aa, Yellow fever virus
PTVDIEEA

SEQ ID NO: 156316 - protein, 8 aa, Yellow fever virus
TVDIEEAP

SEQ ID NO: 156317 - protein, 8 aa, Yellow fever virus
VDIEEAPE

SEQ ID NO: 156318 - protein, 8 aa, Yellow fever virus
DIEEAPEM

SEQ ID NO: 156319 - protein, 8 aa, Yellow fever virus
IEEAPEMP

SEQ ID NO: 156320 - protein, 8 aa, Yellow fever virus
EEAPEMPA

SEQ ID NO: 156321 - protein, 8 aa, Yellow fever virus
EAPEMPAL

SEQ ID NO: 156322 - protein, 8 aa, Yellow fever virus
APEMPALY

SEQ ID NO: 156323 - protein, 8 aa, Yellow fever virus
PEMPALYE

SEQ ID NO: 156324 - protein, 8 aa, Yellow fever virus
EMPALYEK

SEQ ID NO: 156325 - protein, 8 aa, Yellow fever virus
MPALYEKK

SEQ ID NO: 156326 - protein, 8 aa, Yellow fever virus
PALYEKKL

SEQ ID NO: 156327 - protein, 8 aa, Yellow fever virus
ALYEKKLA

SEQ ID NO: 156328 - protein, 8 aa, Yellow fever virus
LYEKKLAL

SEQ ID NO: 156329 - protein, 8 aa, Yellow fever virus
YEKKLALY

SEQ ID NO: 156330 - protein, 8 aa, Yellow fever virus
EKKLALYL

SEQ ID NO: 156331 - protein, 8 aa, Yellow fever virus
KKLALYLL

SEQ ID NO: 156332 - protein, 8 aa, Yellow fever virus
KLALYLLL

SEQ ID NO: 156333 - protein, 8 aa, Yellow fever virus
LALYLLLA

SEQ ID NO: 156334 - protein, 8 aa, Yellow fever virus
ALYLLLAL

SEQ ID NO: 156335 - protein, 8 aa, Yellow fever virus
LYLLLALS

SEQ ID NO: 156336 - protein, 8 aa, Yellow fever virus
YLLLALSL

SEQ ID NO: 156337 - protein, 8 aa, Yellow fever virus
LLLALSLA

SEQ ID NO: 156338 - protein, 8 aa, Yellow fever virus
LLALSLAS

SEQ ID NO: 156339 - protein, 8 aa, Yellow fever virus
LALSLASV

SEQ ID NO: 156340 - protein, 8 aa, Yellow fever virus
ALSLASVA

SEQ ID NO: 156341 - protein, 8 aa, Yellow fever virus
LSLASVAM

SEQ ID NO: 156342 - protein, 8 aa, Yellow fever virus
SLASVAMC

SEQ ID NO: 156343 - protein, 8 aa, Yellow fever virus
LASVAMCR

SEQ ID NO: 156344 - protein, 8 aa, Yellow fever virus
ASVAMCRT

SEQ ID NO: 156345 - protein, 8 aa, Yellow fever virus
SVAMCRTP

SEQ ID NO: 156346 - protein, 8 aa, Yellow fever virus
VAMCRTPF

SEQ ID NO: 156347 - protein, 8 aa, Yellow fever virus
AMCRTPFS

SEQ ID NO: 156348 - protein, 8 aa, Yellow fever virus
MCRTPFSL

SEQ ID NO: 156349 - protein, 8 aa, Yellow fever virus
CRTPFSLA

SEQ ID NO: 156350 - protein, 8 aa, Yellow fever virus
RTPFSLAE

SEQ ID NO: 156351 - protein, 8 aa, Yellow fever virus
TPFSLAEG

SEQ ID NO: 156352 - protein, 8 aa, Yellow fever virus
PFSLAEGI

SEQ ID NO: 156353 - protein, 8 aa, Yellow fever virus
FSLAEGIV

SEQ ID NO: 156354 - protein, 8 aa, Yellow fever virus
SLAEGIVL

SEQ ID NO: 156355 - protein, 8 aa, Yellow fever virus
LAEGIVLA

SEQ ID NO: 156356 - protein, 8 aa, Yellow fever virus
AEGIVLAS

SEQ ID NO: 156357 - protein, 8 aa, Yellow fever virus
EGIVLASA

SEQ ID NO: 156358 - protein, 8 aa, Yellow fever virus
GIVLASAA

SEQ ID NO: 156359 - protein, 8 aa, Yellow fever virus
IVLASAAL

SEQ ID NO: 156360 - protein, 8 aa, Yellow fever virus
VLASAALG

SEQ ID NO: 156361 - protein, 8 aa, Yellow fever virus
LASAALGP

SEQ ID NO: 156362 - protein, 8 aa, Yellow fever virus
ASAALGPL

SEQ ID NO: 156363 - protein, 8 aa, Yellow fever virus
SAALGPLI

SEQ ID NO: 156364 - protein, 8 aa, Yellow fever virus
AALGPLIE

SEQ ID NO: 156365 - protein, 8 aa, Yellow fever virus
ALGPLIEG

SEQ ID NO: 156366 - protein, 8 aa, Yellow fever virus
LGPLIEGN

SEQ ID NO: 156367 - protein, 8 aa, Yellow fever virus
GPLIEGNT

SEQ ID NO: 156368 - protein, 8 aa, Yellow fever virus
PLIEGNTS

SEQ ID NO: 156369 - protein, 8 aa, Yellow fever virus
LIEGNTSL

SEQ ID NO: 156370 - protein, 8 aa, Yellow fever virus
IEGNTSLL

SEQ ID NO: 156371 - protein, 8 aa, Yellow fever virus
EGNTSLLW

SEQ ID NO: 156372 - protein, 8 aa, Yellow fever virus
GNTSLLWN

SEQ ID NO: 156373 - protein, 8 aa, Yellow fever virus
NTSLLWNG

SEQ ID NO: 156374 - protein, 8 aa, Yellow fever virus
TSLLWNGP

SEQ ID NO: 156375 - protein, 8 aa, Yellow fever virus
SLLWNGPM

SEQ ID NO: 156376 - protein, 8 aa, Yellow fever virus
LLWNGPMA

SEQ ID NO: 156377 - protein, 8 aa, Yellow fever virus
LWNGPMAV

SEQ ID NO: 156378 - protein, 8 aa, Yellow fever virus
WNGPMAVS

SEQ ID NO: 156379 - protein, 8 aa, Yellow fever virus
NGPMAVSM

SEQ ID NO: 156380 - protein, 8 aa, Yellow fever virus
GPMAVSMT

SEQ ID NO: 156381 - protein, 8 aa, Yellow fever virus
PMAVSMTG

SEQ ID NO: 156382 - protein, 8 aa, Yellow fever virus
MAVSMTGV

SEQ ID NO: 156383 - protein, 8 aa, Yellow fever virus
AVSMTGVM

SEQ ID NO: 156384 - protein, 8 aa, Yellow fever virus
VSMTGVMR

SEQ ID NO: 156385 - protein, 8 aa, Yellow fever virus
SMTGVMRG

SEQ ID NO: 156386 - protein, 8 aa, Yellow fever virus
MTGVMRGN

SEQ ID NO: 156387 - protein, 8 aa, Yellow fever virus
TGVMRGNH

SEQ ID NO: 156388 - protein, 8 aa, Yellow fever virus
GVMRGNHY

SEQ ID NO: 156389 - protein, 8 aa, Yellow fever virus
VMRGNHYA

SEQ ID NO: 156390 - protein, 8 aa, Yellow fever virus
MRGNHYAF

SEQ ID NO: 156391 - protein, 8 aa, Yellow fever virus
RGNHYAFV

SEQ ID NO: 156392 - protein, 8 aa, Yellow fever virus
GNHYAFVG

SEQ ID NO: 156393 - protein, 8 aa, Yellow fever virus
NHYAFVGV

SEQ ID NO: 156394 - protein, 8 aa, Yellow fever virus
HYAFVGVM

SEQ ID NO: 156395 - protein, 8 aa, Yellow fever virus
YAFVGVMY

SEQ ID NO: 156396 - protein, 8 aa, Yellow fever virus
AFVGVMYN

SEQ ID NO: 156397 - protein, 8 aa, Yellow fever virus
FVGVMYNL

SEQ ID NO: 156398 - protein, 8 aa, Yellow fever virus
VGVMYNLW

SEQ ID NO: 156399 - protein, 8 aa, Yellow fever virus
GVMYNLWK

SEQ ID NO: 156400 - protein, 8 aa, Yellow fever virus
VMYNLWKM

SEQ ID NO: 156401 - protein, 8 aa, Yellow fever virus
MYNLWKMK

SEQ ID NO: 156402 - protein, 8 aa, Yellow fever virus
YNLWKMKT

SEQ ID NO: 156403 - protein, 8 aa, Yellow fever virus
NLWKMKTG

SEQ ID NO: 156404 - protein, 8 aa, Yellow fever virus
LWKMKTGR

SEQ ID NO: 156405 - protein, 8 aa, Yellow fever virus
WKMKTGRR

SEQ ID NO: 156406 - protein, 8 aa, Yellow fever virus
KMKTGRRG

SEQ ID NO: 156407 - protein, 8 aa, Yellow fever virus
RRGSANGK

SEQ ID NO: 156408 - protein, 8 aa, Yellow fever virus
RGSANGKT

SEQ ID NO: 156409 - protein, 8 aa, Yellow fever virus
GSANGKTL

SEQ ID NO: 156410 - protein, 8 aa, Yellow fever virus
SANGKTLG

SEQ ID NO: 156411 - protein, 8 aa, Yellow fever virus
ANGKTLGE

SEQ ID NO: 156412 - protein, 8 aa, Yellow fever virus
NGKTLGEV

SEQ ID NO: 156413 - protein, 8 aa, Yellow fever virus
GKTLGEVW

SEQ ID NO: 156414 - protein, 8 aa, Yellow fever virus
KTLGEVWK

SEQ ID NO: 156415 - protein, 8 aa, Yellow fever virus
TLGEVWKR

SEQ ID NO: 156416 - protein, 8 aa, Yellow fever virus
LGEVWKRE

SEQ ID NO: 156417 - protein, 8 aa, Yellow fever virus
GEVWKREL

SEQ ID NO: 156418 - protein, 8 aa, Yellow fever virus
EVWKRELN

SEQ ID NO: 156419 - protein, 8 aa, Yellow fever virus
VWKRELNL

SEQ ID NO: 156420 - protein, 8 aa, Yellow fever virus
WKRELNLL

SEQ ID NO: 156421 - protein, 8 aa, Yellow fever virus
KRELNLLD

SEQ ID NO: 156422 - protein, 8 aa, Yellow fever virus
RELNLLDK

SEQ ID NO: 156423 - protein, 8 aa, Yellow fever virus
ELNLLDKQ

SEQ ID NO: 156424 - protein, 8 aa, Yellow fever virus
LNLLDKQQ

SEQ ID NO: 156425 - protein, 8 aa, Yellow fever virus
NLLDKQQF

SEQ ID NO: 156426 - protein, 8 aa, Yellow fever virus
LLDKQQFE

SEQ ID NO: 156427 - protein, 8 aa, Yellow fever virus
LDKRQFEL

SEQ ID NO: 156428 - protein, 8 aa, Yellow fever virus
DKQQFELY

SEQ ID NO: 156429 - protein, 8 aa, Yellow fever virus
KRQFELYK

SEQ ID NO: 156430 - protein, 8 aa, Yellow fever virus
QQFELYKR

SEQ ID NO: 156431 - protein, 8 aa, Yellow fever virus
QFELYKRT

SEQ ID NO: 156432 - protein, 8 aa, Yellow fever virus
FELYKRTD

SEQ ID NO: 156433 - protein, 8 aa, Yellow fever virus
ELYKRTDI

SEQ ID NO: 156434 - protein, 8 aa, Yellow fever virus
LYKRTDIV

SEQ ID NO: 156435 - protein, 8 aa, Yellow fever virus
YKRTDIVE

SEQ ID NO: 156436 - protein, 8 aa, Yellow fever virus
KRTDIVEV

SEQ ID NO: 156437 - protein, 8 aa, Yellow fever virus
RTDIVEVD

SEQ ID NO: 156438 - protein, 8 aa, Yellow fever virus
TDIVEVDR

SEQ ID NO: 156439 - protein, 8 aa, Yellow fever virus
DIVEVDRD

SEQ ID NO: 156440 - protein, 8 aa, Yellow fever virus
IVEVDRDT

SEQ ID NO: 156441 - protein, 8 aa, Yellow fever virus
VEVDRDTA

SEQ ID NO: 156442 - protein, 8 aa, Yellow fever virus
EVDRDTAR

SEQ ID NO: 156443 - protein, 8 aa, Yellow fever virus
VDRDTARR

SEQ ID NO: 156444 - protein, 8 aa, Yellow fever virus
DRDTARRH

SEQ ID NO: 156445 - protein, 8 aa, Yellow fever virus
RDTARRHL

SEQ ID NO: 156446 - protein, 8 aa, Yellow fever virus
DTARRHLA

SEQ ID NO: 156447 - protein, 8 aa, Yellow fever virus
TARRHLAE

SEQ ID NO: 156448 - protein, 8 aa, Yellow fever virus
ARRHLAEG

SEQ ID NO: 156449 - protein, 8 aa, Yellow fever virus
RRHLAEGK

SEQ ID NO: 156450 - protein, 8 aa, Yellow fever virus
RHLAEGKV

SEQ ID NO: 156451 - protein, 8 aa, Yellow fever virus
HLAEGKVD

SEQ ID NO: 156452 - protein, 8 aa, Yellow fever virus
LAEGKVDT

SEQ ID NO: 156453 - protein, 8 aa, Yellow fever virus
AEGKVDTG

SEQ ID NO: 156454 - protein, 8 aa, Yellow fever virus
EGKVDTGV

SEQ ID NO: 156455 - protein, 8 aa, Yellow fever virus
GKVDTGVA

SEQ ID NO: 156456 - protein, 8 aa, Yellow fever virus
KVDTGVAV

SEQ ID NO: 156457 - protein, 8 aa, Yellow fever virus
VDTGVAVS

SEQ ID NO: 156458 - protein, 8 aa, Yellow fever virus
DTGVAVSR

SEQ ID NO: 156459 - protein, 8 aa, Yellow fever virus
TGVAVSRG

SEQ ID NO: 156460 - protein, 8 aa, Yellow fever virus
GVAVSRGT

SEQ ID NO: 156461 - protein, 8 aa, Yellow fever virus
VAVSRGTA

SEQ ID NO: 156462 - protein, 8 aa, Yellow fever virus
AVSRGTAK

SEQ ID NO: 156463 - protein, 8 aa, Yellow fever virus
VSRGTAKL

SEQ ID NO: 156464 - protein, 8 aa, Yellow fever virus
SRGTAKLR

SEQ ID NO: 156465 - protein, 8 aa, Yellow fever virus
RGTAKLRW

SEQ ID NO: 156466 - protein, 8 aa, Yellow fever virus
GTAKLRWF

SEQ ID NO: 156467 - protein, 8 aa, Yellow fever virus
TAKLRWFH

SEQ ID NO: 156468 - protein, 8 aa, Yellow fever virus
AKLRWFHE

SEQ ID NO: 156469 - protein, 8 aa, Yellow fever virus
KLRWFHER

SEQ ID NO: 156470 - protein, 8 aa, Yellow fever virus
LRWFHERG

SEQ ID NO: 156471 - protein, 8 aa, Yellow fever virus
RWFHERGY

SEQ ID NO: 156472 - protein, 8 aa, Yellow fever virus
WFHERGYV

SEQ ID NO: 156473 - protein, 8 aa, Yellow fever virus
FHERGYVK

SEQ ID NO: 156474 - protein, 8 aa, Yellow fever virus
HERGYVKL

SEQ ID NO: 156475 - protein, 8 aa, Yellow fever virus
ERGYVKLE

SEQ ID NO: 156476 - protein, 8 aa, Yellow fever virus
RGYVKLEG

SEQ ID NO: 156477 - protein, 8 aa, Yellow fever virus
GYVKLEGR

SEQ ID NO: 156478 - protein, 8 aa, Yellow fever virus
YVKLEGRV

SEQ ID NO: 156479 - protein, 8 aa, Yellow fever virus
VKLEGRVI

SEQ ID NO: 156480 - protein, 8 aa, Yellow fever virus
KLEGRVID

SEQ ID NO: 156481 - protein, 8 aa, Yellow fever virus
LEGRVIDL

SEQ ID NO: 156482 - protein, 8 aa, Yellow fever virus
EGRVIDLG

SEQ ID NO: 156483 - protein, 8 aa, Yellow fever virus
GRVIDLGC

SEQ ID NO: 156484 - protein, 8 aa, Yellow fever virus
RVIDLGCG

SEQ ID NO: 156485 - protein, 8 aa, Yellow fever virus
VIDLGCGR

SEQ ID NO: 156486 - protein, 8 aa, Yellow fever virus
IDLGCGRG

SEQ ID NO: 156487 - protein, 8 aa, Yellow fever virus
DLGCGRGG

SEQ ID NO: 156488 - protein, 8 aa, Yellow fever virus
LGCGRGGW

SEQ ID NO: 156489 - protein, 8 aa, Yellow fever virus
GCGRGGWC

SEQ ID NO: 156490 - protein, 8 aa, Yellow fever virus
CGRGGWCY

SEQ ID NO: 156491 - protein, 8 aa, Yellow fever virus
GRGGWCYY

SEQ ID NO: 156492 - protein, 8 aa, Yellow fever virus
RGGWCYYA

SEQ ID NO: 156493 - protein, 8 aa, Yellow fever virus
GGWCYYAA

SEQ ID NO: 156494 - protein, 8 aa, Yellow fever virus
GWCYYAAA

SEQ ID NO: 156495 - protein, 8 aa, Yellow fever virus
WCYYAAAQ

SEQ ID NO: 156496 - protein, 8 aa, Yellow fever virus
CYYAAAQK

SEQ ID NO: 156497 - protein, 8 aa, Yellow fever virus
YYAAAQKE

SEQ ID NO: 156498 - protein, 8 aa, Yellow fever virus
YAAAQKEV

SEQ ID NO: 156499 - protein, 8 aa, Yellow fever virus
AAAQKEVS

SEQ ID NO: 156500 - protein, 8 aa, Yellow fever virus
AAQKEVSG

SEQ ID NO: 156501 - protein, 8 aa, Yellow fever virus
AQKEVSGV

SEQ ID NO: 156502 - protein, 8 aa, Yellow fever virus
QKEVSGVK

SEQ ID NO: 156503 - protein, 8 aa, Yellow fever virus
KEVSGVKG

SEQ ID NO: 156504 - protein, 8 aa, Yellow fever virus
EVSGVKGF

SEQ ID NO: 156505 - protein, 8 aa, Yellow fever virus
VSGVKGFT

SEQ ID NO: 156506 - protein, 8 aa, Yellow fever virus
SGVKGFTL

SEQ ID NO: 156507 - protein, 8 aa, Yellow fever virus
GVKGFTLG

SEQ ID NO: 156508 - protein, 8 aa, Yellow fever virus
VKGFTLGR

SEQ ID NO: 156509 - protein, 8 aa, Yellow fever virus
KGFTLGRD

SEQ ID NO: 156510 - protein, 8 aa, Yellow fever virus
GFTLGRDG

SEQ ID NO: 156511 - protein, 8 aa, Yellow fever virus
FTLGRDGH

SEQ ID NO: 156512 - protein, 8 aa, Yellow fever virus
TLGRDGHE

SEQ ID NO: 156513 - protein, 8 aa, Yellow fever virus
LGRDGHEK

SEQ ID NO: 156514 - protein, 8 aa, Yellow fever virus
GRDGHEKP

SEQ ID NO: 156515 - protein, 8 aa, Yellow fever virus
RDGHEKPM

SEQ ID NO: 156516 - protein, 8 aa, Yellow fever virus
DGHEKPMN

SEQ ID NO: 156517 - protein, 8 aa, Yellow fever virus
GHEKPMNV

SEQ ID NO: 156518 - protein, 8 aa, Yellow fever virus
HEKPMNVQ

SEQ ID NO: 156519 - protein, 8 aa, Yellow fever virus
EKPMNVQS

SEQ ID NO: 156520 - protein, 8 aa, Yellow fever virus
KPMNVQSL

SEQ ID NO: 156521 - protein, 8 aa, Yellow fever virus
PMNVQSLG

SEQ ID NO: 156522 - protein, 8 aa, Yellow fever virus
MNVQSLGW

SEQ ID NO: 156523 - protein, 8 aa, Yellow fever virus
NVQSLGWN

SEQ ID NO: 156524 - protein, 8 aa, Yellow fever virus
VQSLGWNI

SEQ ID NO: 156525 - protein, 8 aa, Yellow fever virus
QSLGWNII

SEQ ID NO: 156526 - protein, 8 aa, Yellow fever virus
SLGWNIIT

SEQ ID NO: 156527 - protein, 8 aa, Yellow fever virus
LGWNIITF

SEQ ID NO: 156528 - protein, 8 aa, Yellow fever virus
GWNIITFK

SEQ ID NO: 156529 - protein, 8 aa, Yellow fever virus
WNIITFKD

SEQ ID NO: 156530 - protein, 8 aa, Yellow fever virus
NIITFKDK

SEQ ID NO: 156531 - protein, 8 aa, Yellow fever virus
IITFKDKT

SEQ ID NO: 156532 - protein, 8 aa, Yellow fever virus
ITFKDKTD

SEQ ID NO: 156533 - protein, 8 aa, Yellow fever virus
TFKDKTDI

SEQ ID NO: 156534 - protein, 8 aa, Yellow fever virus
FKDKTDIH

SEQ ID NO: 156535 - protein, 8 aa, Yellow fever virus
KDKTDIHR

SEQ ID NO: 156536 - protein, 8 aa, Yellow fever virus
DKTDIHRL

SEQ ID NO: 156537 - protein, 8 aa, Yellow fever virus
KTDIHRLE

SEQ ID NO: 156538 - protein, 8 aa, Yellow fever virus
TDIHRLEP

SEQ ID NO: 156539 - protein, 8 aa, Yellow fever virus
LEPVKCDT

SEQ ID NO: 156540 - protein, 8 aa, Yellow fever virus
EPVKCDTL

SEQ ID NO: 156541 - protein, 8 aa, Yellow fever virus
PVKCDTLL

SEQ ID NO: 156542 - protein, 8 aa, Yellow fever virus
VKCDTLLC

SEQ ID NO: 156543 - protein, 8 aa, Yellow fever virus
KCDTLLCD

SEQ ID NO: 156544 - protein, 8 aa, Yellow fever virus
CDTLLCDI

SEQ ID NO: 156545 - protein, 8 aa, Yellow fever virus
DTLLCDIG

SEQ ID NO: 156546 - protein, 8 aa, Yellow fever virus
TLLCDIGE

SEQ ID NO: 156547 - protein, 8 aa, Yellow fever virus
LLCDIGES

SEQ ID NO: 156548 - protein, 8 aa, Yellow fever virus
LCDIGESS

SEQ ID NO: 156549 - protein, 8 aa, Yellow fever virus
CDIGESSS

SEQ ID NO: 156550 - protein, 8 aa, Yellow fever virus
DIGESSSS

SEQ ID NO: 156551 - protein, 8 aa, Yellow fever virus
IGESSSSS

SEQ ID NO: 156552 - protein, 8 aa, Yellow fever virus
GESSSSSV

SEQ ID NO: 156553 - protein, 8 aa, Yellow fever virus
ESSSSSVT

SEQ ID NO: 156554 - protein, 8 aa, Yellow fever virus
SSSSSVTE

SEQ ID NO: 156555 - protein, 8 aa, Yellow fever virus
SSSSVTEG

SEQ ID NO: 156556 - protein, 8 aa, Yellow fever virus
SSSVTEGE

SEQ ID NO: 156557 - protein, 8 aa, Yellow fever virus
SSVTEGER

SEQ ID NO: 156558 - protein, 8 aa, Yellow fever virus
SVTEGERT

SEQ ID NO: 156559 - protein, 8 aa, Yellow fever virus
VTEGERTV

SEQ ID NO: 156560 - protein, 8 aa, Yellow fever virus
TEGERTVR

SEQ ID NO: 156561 - protein, 8 aa, Yellow fever virus
EGERTVRV

SEQ ID NO: 156562 - protein, 8 aa, Yellow fever virus
GERTVRVL

SEQ ID NO: 156563 - protein, 8 aa, Yellow fever virus
ERTVRVLD

SEQ ID NO: 156564 - protein, 8 aa, Yellow fever virus
RTVRVLDT

SEQ ID NO: 156565 - protein, 8 aa, Yellow fever virus
TVRVLDTV

SEQ ID NO: 156566 - protein, 8 aa, Yellow fever virus
VRVLDTVE

SEQ ID NO: 156567 - protein, 8 aa, Yellow fever virus
RVLDTVEK

SEQ ID NO: 156568 - protein, 8 aa, Yellow fever virus
VLDTVEKW

SEQ ID NO: 156569 - protein, 8 aa, Yellow fever virus
LDTVEKWL

SEQ ID NO: 156570 - protein, 8 aa, Yellow fever virus
DTVEKWLA

SEQ ID NO: 156571 - protein, 8 aa, Yellow fever virus
TVEKWLAC

SEQ ID NO: 156572 - protein, 8 aa, Yellow fever virus
VEKWLACG

SEQ ID NO: 156573 - protein, 8 aa, Yellow fever virus
EKWLACGV

SEQ ID NO: 156574 - protein, 8 aa, Yellow fever virus
KWLACGVD

SEQ ID NO: 156575 - protein, 8 aa, Yellow fever virus
WLACGVDN

SEQ ID NO: 156576 - protein, 8 aa, Yellow fever virus
LACGVDNF

SEQ ID NO: 156577 - protein, 8 aa, Yellow fever virus
ACGVDNFC

SEQ ID NO: 156578 - protein, 8 aa, Yellow fever virus
CGVDNFCV

SEQ ID NO: 156579 - protein, 8 aa, Yellow fever virus
GVDNFCVK

SEQ ID NO: 156580 - protein, 8 aa, Yellow fever virus
VDNFCVKV

SEQ ID NO: 156581 - protein, 8 aa, Yellow fever virus
DNFCVKVL

SEQ ID NO: 156582 - protein, 8 aa, Yellow fever virus
NFCVKVLA

SEQ ID NO: 156583 - protein, 8 aa, Yellow fever virus
FCVKVLAP

SEQ ID NO: 156584 - protein, 8 aa, Yellow fever virus
CVKVLAPY

SEQ ID NO: 156585 - protein, 8 aa, Yellow fever virus
VKVLAPYM

SEQ ID NO: 156586 - protein, 8 aa, Yellow fever virus
KVLAPYMP

SEQ ID NO: 156587 - protein, 8 aa, Yellow fever virus
VLAPYMPD

SEQ ID NO: 156588 - protein, 8 aa, Yellow fever virus
LAPYMPDV

SEQ ID NO: 156589 - protein, 8 aa, Yellow fever virus
APYMPDVL

SEQ ID NO: 156590 - protein, 8 aa, Yellow fever virus
PYMPDVLE

SEQ ID NO: 156591 - protein, 8 aa, Yellow fever virus
YMPDVLEK

SEQ ID NO: 156592 - protein, 8 aa, Yellow fever virus
MPDVLEKL

SEQ ID NO: 156593 - protein, 8 aa, Yellow fever virus
PDVLEKLE

SEQ ID NO: 156594 - protein, 8 aa, Yellow fever virus
DVLEKLEL

SEQ ID NO: 156595 - protein, 8 aa, Yellow fever virus
VLEKLELL

SEQ ID NO: 156596 - protein, 8 aa, Yellow fever virus
LEKLELLQ

SEQ ID NO: 156597 - protein, 8 aa, Yellow fever virus
EKLELLQR

SEQ ID NO: 156598 - protein, 8 aa, Yellow fever virus
KLELLQRR

SEQ ID NO: 156599 - protein, 8 aa, Yellow fever virus
LELLQRRF

SEQ ID NO: 156600 - protein, 8 aa, Yellow fever virus
ELLQRRFG

SEQ ID NO: 156601 - protein, 8 aa, Yellow fever virus
LLQRRFGG

SEQ ID NO: 156602 - protein, 8 aa, Yellow fever virus
LQRRFGGT

SEQ ID NO: 156603 - protein, 8 aa, Yellow fever virus
QRRFGGTV

SEQ ID NO: 156604 - protein, 8 aa, Yellow fever virus
RRFGGTVI

SEQ ID NO: 156605 - protein, 8 aa, Yellow fever virus
RFGGTVIR

SEQ ID NO: 156606 - protein, 8 aa, Yellow fever virus
FGGTVIRN

SEQ ID NO: 156607 - protein, 8 aa, Yellow fever virus
GGTVIRNP

SEQ ID NO: 156608 - protein, 8 aa, Yellow fever virus
GTVIRNPL

SEQ ID NO: 156609 - protein, 8 aa, Yellow fever virus
TVIRNPLS

SEQ ID NO: 156610 - protein, 8 aa, Yellow fever virus
VIRNPLSR

SEQ ID NO: 156611 - protein, 8 aa, Yellow fever virus
IRNPLSRN

SEQ ID NO: 156612 - protein, 8 aa, Yellow fever virus
RNPLSRNS

SEQ ID NO: 156613 - protein, 8 aa, Yellow fever virus
NPLSRNST

SEQ ID NO: 156614 - protein, 8 aa, Yellow fever virus
PLSRNSTH

SEQ ID NO: 156615 - protein, 8 aa, Yellow fever virus
LSRNSTHE

SEQ ID NO: 156616 - protein, 8 aa, Yellow fever virus
SRNSTHEM

SEQ ID NO: 156617 - protein, 8 aa, Yellow fever virus
RNSTHEMY

SEQ ID NO: 156618 - protein, 8 aa, Yellow fever virus
NSTHEMYY

SEQ ID NO: 156619 - protein, 8 aa, Yellow fever virus
STHEMYYV

SEQ ID NO: 156620 - protein, 8 aa, Yellow fever virus
THEMYYVS

SEQ ID NO: 156621 - protein, 8 aa, Yellow fever virus
HEMYYVSG

SEQ ID NO: 156622 - protein, 8 aa, Yellow fever virus
EMYYVSGA

SEQ ID NO: 156623 - protein, 8 aa, Yellow fever virus
MYYVSGAR

SEQ ID NO: 156624 - protein, 8 aa, Yellow fever virus
YYVSGARS

SEQ ID NO: 156625 - protein, 8 aa, Yellow fever virus
YVSGARSN

SEQ ID NO: 156626 - protein, 8 aa, Yellow fever virus
VSGARSNV

SEQ ID NO: 156627 - protein, 8 aa, Yellow fever virus
SGARSNVT

SEQ ID NO: 156628 - protein, 8 aa, Yellow fever virus
GARSNVTF

SEQ ID NO: 156629 - protein, 8 aa, Yellow fever virus
ARSNVTFT

SEQ ID NO: 156630 - protein, 8 aa, Yellow fever virus
RSNVTFTV

SEQ ID NO: 156631 - protein, 8 aa, Yellow fever virus
SNVTFTVN

SEQ ID NO: 156632 - protein, 8 aa, Yellow fever virus
NVTFTVNQ

SEQ ID NO: 156633 - protein, 8 aa, Yellow fever virus
VTFTVNQT

SEQ ID NO: 156634 - protein, 8 aa, Yellow fever virus
TFTVNQTS

SEQ ID NO: 156635 - protein, 8 aa, Yellow fever virus
FTVNQTSR

SEQ ID NO: 156636 - protein, 8 aa, Yellow fever virus
TVNQTSRL

SEQ ID NO: 156637 - protein, 8 aa, Yellow fever virus
VNQTSRLL

SEQ ID NO: 156638 - protein, 8 aa, Yellow fever virus
NQTSRLLM

SEQ ID NO: 156639 - protein, 8 aa, Yellow fever virus
QTSRLLMR

SEQ ID NO: 156640 - protein, 8 aa, Yellow fever virus
TSRLLMRR

SEQ ID NO: 156641 - protein, 8 aa, Yellow fever virus
SRLLMRRM

SEQ ID NO: 156642 - protein, 8 aa, Yellow fever virus
RLLMRRMR

SEQ ID NO: 156643 - protein, 8 aa, Yellow fever virus
LLMRRMRR

SEQ ID NO: 156644 - protein, 8 aa, Yellow fever virus
LMRRMRRP

SEQ ID NO: 156645 - protein, 8 aa, Yellow fever virus
MRRMRRPT

SEQ ID NO: 156646 - protein, 8 aa, Yellow fever virus
RRMRRPTG

SEQ ID NO: 156647 - protein, 8 aa, Yellow fever virus
RMRRPTGK

SEQ ID NO: 156648 - protein, 8 aa, Yellow fever virus
MRRPTGKV

SEQ ID NO: 156649 - protein, 8 aa, Yellow fever virus
RRPTGKVT

SEQ ID NO: 156650 - protein, 8 aa, Yellow fever virus
RPTGKVTL

SEQ ID NO: 156651 - protein, 8 aa, Yellow fever virus
PTGKVTLE

SEQ ID NO: 156652 - protein, 8 aa, Yellow fever virus
TGKVTLEA

SEQ ID NO: 156653 - protein, 8 aa, Yellow fever virus
GKVTLEAD

SEQ ID NO: 156654 - protein, 8 aa, Yellow fever virus
KVTLEADV

SEQ ID NO: 156655 - protein, 8 aa, Yellow fever virus
VTLEADVI

SEQ ID NO: 156656 - protein, 8 aa, Yellow fever virus
TLEADVIL

SEQ ID NO: 156657 - protein, 8 aa, Yellow fever virus
LEADVILP

SEQ ID NO: 156658 - protein, 8 aa, Yellow fever virus
EADVILPI

SEQ ID NO: 156659 - protein, 8 aa, Yellow fever virus
ADVILPIG

SEQ ID NO: 156660 - protein, 8 aa, Yellow fever virus
DVILPIGT

SEQ ID NO: 156661 - protein, 8 aa, Yellow fever virus
VILPIGTR

SEQ ID NO: 156662 - protein, 8 aa, Yellow fever virus
ILPIGTRS

SEQ ID NO: 156663 - protein, 8 aa, Yellow fever virus
LPIGTRSV

SEQ ID NO: 156664 - protein, 8 aa, Yellow fever virus
PIGTRSVE

SEQ ID NO: 156665 - protein, 8 aa, Yellow fever virus
IGTRSVET

SEQ ID NO: 156666 - protein, 8 aa, Yellow fever virus
GTRSVETD

SEQ ID NO: 156667 - protein, 8 aa, Yellow fever virus
TRSVETDK

SEQ ID NO: 156668 - protein, 8 aa, Yellow fever virus
RSVETDKG

SEQ ID NO: 156669 - protein, 8 aa, Yellow fever virus
SVETDKGP

SEQ ID NO: 156670 - protein, 8 aa, Yellow fever virus
VETDKGPL

SEQ ID NO: 156671 - protein, 8 aa, Yellow fever virus
ETDKGPLD

SEQ ID NO: 156672 - protein, 8 aa, Yellow fever virus
TDKGPLDK

SEQ ID NO: 156673 - protein, 8 aa, Yellow fever virus
EAIEERVE

SEQ ID NO: 156674 - protein, 8 aa, Yellow fever virus
AIEERVER

SEQ ID NO: 156675 - protein, 8 aa, Yellow fever virus
IEERVERI

SEQ ID NO: 156676 - protein, 8 aa, Yellow fever virus
EERVERIK

SEQ ID NO: 156677 - protein, 8 aa, Yellow fever virus
ERVERIKS

SEQ ID NO: 156678 - protein, 8 aa, Yellow fever virus
RVERIKSE

SEQ ID NO: 156679 - protein, 8 aa, Yellow fever virus
VERIKSEY

SEQ ID NO: 156680 - protein, 8 aa, Yellow fever virus
ERIKSEYM

SEQ ID NO: 156681 - protein, 8 aa, Yellow fever virus
RIKSEYMT

SEQ ID NO: 156682 - protein, 8 aa, Yellow fever virus
IKSEYMTS

SEQ ID NO: 156683 - protein, 8 aa, Yellow fever virus
KSEYMTSW

SEQ ID NO: 156684 - protein, 8 aa, Yellow fever virus
SEYMTSWF

SEQ ID NO: 156685 - protein, 8 aa, Yellow fever virus
EYMTSWFY

SEQ ID NO: 156686 - protein, 8 aa, Yellow fever virus
YMTSWFYD

SEQ ID NO: 156687 - protein, 8 aa, Yellow fever virus
MTSWFYDN

SEQ ID NO: 156688 - protein, 8 aa, Yellow fever virus
TSWFYDND

SEQ ID NO: 156689 - protein, 8 aa, Yellow fever virus
SWFYDNDN

SEQ ID NO: 156690 - protein, 8 aa, Yellow fever virus
WFYDNDNP

SEQ ID NO: 156691 - protein, 8 aa, Yellow fever virus
FYDNDNPY

SEQ ID NO: 156692 - protein, 8 aa, Yellow fever virus
YDNDNPYR

SEQ ID NO: 156693 - protein, 8 aa, Yellow fever virus
DNDNPYRT

SEQ ID NO: 156694 - protein, 8 aa, Yellow fever virus
NDNPYRTW

SEQ ID NO: 156695 - protein, 8 aa, Yellow fever virus
DNPYRTWH

SEQ ID NO: 156696 - protein, 8 aa, Yellow fever virus
NPYRTWHY

SEQ ID NO: 156697 - protein, 8 aa, Yellow fever virus
PYRTWHYC

SEQ ID NO: 156698 - protein, 8 aa, Yellow fever virus
YRTWHYCG

SEQ ID NO: 156699 - protein, 8 aa, Yellow fever virus
RTWHYCGS

SEQ ID NO: 156700 - protein, 8 aa, Yellow fever virus
TWHYCGSY

SEQ ID NO: 156701 - protein, 8 aa, Yellow fever virus
WHYCGSYV

SEQ ID NO: 156702 - protein, 8 aa, Yellow fever virus
HYCGSYVT

SEQ ID NO: 156703 - protein, 8 aa, Yellow fever virus
YCGSYVTK

SEQ ID NO: 156704 - protein, 8 aa, Yellow fever virus
CGSYVTKT

SEQ ID NO: 156705 - protein, 8 aa, Yellow fever virus
GSYVTKTS

SEQ ID NO: 156706 - protein, 8 aa, Yellow fever virus
SYVTKTSG

SEQ ID NO: 156707 - protein, 8 aa, Yellow fever virus
YVTKTSGS

SEQ ID NO: 156708 - protein, 8 aa, Yellow fever virus
VTKTSGSA

SEQ ID NO: 156709 - protein, 8 aa, Yellow fever virus
TKTSGSAA

SEQ ID NO: 156710 - protein, 8 aa, Yellow fever virus
KTSGSAAS

SEQ ID NO: 156711 - protein, 8 aa, Yellow fever virus
TSGSAASM

SEQ ID NO: 156712 - protein, 8 aa, Yellow fever virus
SGSAASMV

SEQ ID NO: 156713 - protein, 8 aa, Yellow fever virus
GSAASMVN

SEQ ID NO: 156714 - protein, 8 aa, Yellow fever virus
SAASMVNG

SEQ ID NO: 156715 - protein, 8 aa, Yellow fever virus
AASMVNGV

SEQ ID NO: 156716 - protein, 8 aa, Yellow fever virus
ASMVNGVI

SEQ ID NO: 156717 - protein, 8 aa, Yellow fever virus
SMVNGVIK

SEQ ID NO: 156718 - protein, 8 aa, Yellow fever virus
MVNGVIKI

SEQ ID NO: 156719 - protein, 8 aa, Yellow fever virus
VNGVIKIL

SEQ ID NO: 156720 - protein, 8 aa, Yellow fever virus
NGVIKILT

SEQ ID NO: 156721 - protein, 8 aa, Yellow fever virus
GVIKILTY

SEQ ID NO: 156722 - protein, 8 aa, Yellow fever virus
VIKILTYP

SEQ ID NO: 156723 - protein, 8 aa, Yellow fever virus
IKILTYPW

SEQ ID NO: 156724 - protein, 8 aa, Yellow fever virus
KILTYPWD

SEQ ID NO: 156725 - protein, 8 aa, Yellow fever virus
ILTYPWDR

SEQ ID NO: 156726 - protein, 8 aa, Yellow fever virus
LTYPWDRI

SEQ ID NO: 156727 - protein, 8 aa, Yellow fever virus
TYPWDRIE

SEQ ID NO: 156728 - protein, 8 aa, Yellow fever virus
YPWDRIEE

SEQ ID NO: 156729 - protein, 8 aa, Yellow fever virus
PWDRIEEV

SEQ ID NO: 156730 - protein, 8 aa, Yellow fever virus
WDRIEEVT

SEQ ID NO: 156731 - protein, 8 aa, Yellow fever virus
DRIEEVTR

SEQ ID NO: 156732 - protein, 8 aa, Yellow fever virus
RIEEVTRM

SEQ ID NO: 156733 - protein, 8 aa, Yellow fever virus
IEEVTRMA

SEQ ID NO: 156734 - protein, 8 aa, Yellow fever virus
EEVTRMAM

SEQ ID NO: 156735 - protein, 8 aa, Yellow fever virus
EVTRMAMT

SEQ ID NO: 156736 - protein, 8 aa, Yellow fever virus
VTRMAMTD

SEQ ID NO: 156737 - protein, 8 aa, Yellow fever virus
TRMAMTDT

SEQ ID NO: 156738 - protein, 8 aa, Yellow fever virus
RMAMTDTT

SEQ ID NO: 156739 - protein, 8 aa, Yellow fever virus
MAMTDTTP

SEQ ID NO: 156740 - protein, 8 aa, Yellow fever virus
AMTDTTPF

SEQ ID NO: 156741 - protein, 8 aa, Yellow fever virus
MTDTTPFG

SEQ ID NO: 156742 - protein, 8 aa, Yellow fever virus
TDTTPFGQ

SEQ ID NO: 156743 - protein, 8 aa, Yellow fever virus
DTTPFGQQ

SEQ ID NO: 156744 - protein, 8 aa, Yellow fever virus
TTPFGQQR

SEQ ID NO: 156745 - protein, 8 aa, Yellow fever virus
TPFGQQRV

SEQ ID NO: 156746 - protein, 8 aa, Yellow fever virus
PFGQQRVF

SEQ ID NO: 156747 - protein, 8 aa, Yellow fever virus
FGQQRVFK

SEQ ID NO: 156748 - protein, 8 aa, Yellow fever virus
GQQRVFKE

SEQ ID NO: 156749 - protein, 8 aa, Yellow fever virus
QQRVFKEK

SEQ ID NO: 156750 - protein, 8 aa, Yellow fever virus
QRVFKEKV

SEQ ID NO: 156751 - protein, 8 aa, Yellow fever virus
RVFKEKVD

SEQ ID NO: 156752 - protein, 8 aa, Yellow fever virus
VFKEKVDT

SEQ ID NO: 156753 - protein, 8 aa, Yellow fever virus
FKEKVDTR

SEQ ID NO: 156754 - protein, 8 aa, Yellow fever virus
KEKVDTRA

SEQ ID NO: 156755 - protein, 8 aa, Yellow fever virus
EKVDTRAK

SEQ ID NO: 156756 - protein, 8 aa, Yellow fever virus
KVDTRAKD

SEQ ID NO: 156757 - protein, 8 aa, Yellow fever virus
VDTRAKDP

SEQ ID NO: 156758 - protein, 8 aa, Yellow fever virus
DTRAKDPP

SEQ ID NO: 156759 - protein, 8 aa, Yellow fever virus
TRAKDPPA

SEQ ID NO: 156760 - protein, 8 aa, Yellow fever virus
RAKDPPAG

SEQ ID NO: 156761 - protein, 8 aa, Yellow fever virus
AKDPPAGT

SEQ ID NO: 156762 - protein, 8 aa, Yellow fever virus
KDPPAGTR

SEQ ID NO: 156763 - protein, 8 aa, Yellow fever virus
DPPAGTRK

SEQ ID NO: 156764 - protein, 8 aa, Yellow fever virus
PPAGTRKI

SEQ ID NO: 156765 - protein, 8 aa, Yellow fever virus
PAGTRKIM

SEQ ID NO: 156766 - protein, 8 aa, Yellow fever virus
AGTRKIMK

SEQ ID NO: 156767 - protein, 8 aa, Yellow fever virus
GTRKIMKV

SEQ ID NO: 156768 - protein, 8 aa, Yellow fever virus
TRKIMKVV

SEQ ID NO: 156769 - protein, 8 aa, Yellow fever virus
RKIMKVVN

SEQ ID NO: 156770 - protein, 8 aa, Yellow fever virus
KIMKVVNR

SEQ ID NO: 156771 - protein, 8 aa, Yellow fever virus
IMKVVNRW

SEQ ID NO: 156772 - protein, 8 aa, Yellow fever virus
MKVVNRWL

SEQ ID NO: 156773 - protein, 8 aa, Yellow fever virus
KVVNRWLF

SEQ ID NO: 156774 - protein, 8 aa, Yellow fever virus
VVNRWLFR

SEQ ID NO: 156775 - protein, 8 aa, Yellow fever virus
VNRWLFRH

SEQ ID NO: 156776 - protein, 8 aa, Yellow fever virus
NRWLFRHL

SEQ ID NO: 156777 - protein, 8 aa, Yellow fever virus
RWLFRHLA

SEQ ID NO: 156778 - protein, 8 aa, Yellow fever virus
WLFRHLAR

SEQ ID NO: 156779 - protein, 8 aa, Yellow fever virus
LFRHLARE

SEQ ID NO: 156780 - protein, 8 aa, Yellow fever virus
FRHLAREK

SEQ ID NO: 156781 - protein, 8 aa, Yellow fever virus
RHLAREKN

SEQ ID NO: 156782 - protein, 8 aa, Yellow fever virus
HLAREKNP

SEQ ID NO: 156783 - protein, 8 aa, Yellow fever virus
LAREKNPR

SEQ ID NO: 156784 - protein, 8 aa, Yellow fever virus
AREKNPRL

SEQ ID NO: 156785 - protein, 8 aa, Yellow fever virus
REKNPRLC

SEQ ID NO: 156786 - protein, 8 aa, Yellow fever virus
EKNPRLCT

SEQ ID NO: 156787 - protein, 8 aa, Yellow fever virus
KNPRLCTK

SEQ ID NO: 156788 - protein, 8 aa, Yellow fever virus
NPRLCTKE

SEQ ID NO: 156789 - protein, 8 aa, Yellow fever virus
PRLCTKEE

SEQ ID NO: 156790 - protein, 8 aa, Yellow fever virus
RLCTKEEF

SEQ ID NO: 156791 - protein, 8 aa, Yellow fever virus
LCTKEEFI

SEQ ID NO: 156792 - protein, 8 aa, Yellow fever virus
CTKEEFIA

SEQ ID NO: 156793 - protein, 8 aa, Yellow fever virus
TKEEFIAK

SEQ ID NO: 156794 - protein, 8 aa, Yellow fever virus
KEEFIAKV

SEQ ID NO: 156795 - protein, 8 aa, Yellow fever virus
EEFIAKVR

SEQ ID NO: 156796 - protein, 8 aa, Yellow fever virus
EFIAKVRS

SEQ ID NO: 156797 - protein, 8 aa, Yellow fever virus
FIAKVRSH

SEQ ID NO: 156798 - protein, 8 aa, Yellow fever virus
IAKVRSHA

SEQ ID NO: 156799 - protein, 8 aa, Yellow fever virus
AKVRSHAA

SEQ ID NO: 156800 - protein, 8 aa, Yellow fever virus
KVRSHAAI

SEQ ID NO: 156801 - protein, 8 aa, Yellow fever virus
VRSHAAIG

SEQ ID NO: 156802 - protein, 8 aa, Yellow fever virus
RSHAAIGA

SEQ ID NO: 156803 - protein, 8 aa, Yellow fever virus
SHAAIGAY

SEQ ID NO: 156804 - protein, 8 aa, Yellow fever virus
HAAIGAYL

SEQ ID NO: 156805 - protein, 8 aa, Yellow fever virus
AAIGAYLE

SEQ ID NO: 156806 - protein, 8 aa, Yellow fever virus
AIGAYLEE

SEQ ID NO: 156807 - protein, 8 aa, Yellow fever virus
IGAYLEEQ

SEQ ID NO: 156808 - protein, 8 aa, Yellow fever virus
GAYLEEQE

SEQ ID NO: 156809 - protein, 8 aa, Yellow fever virus
AYLEEQEQ

SEQ ID NO: 156810 - protein, 8 aa, Yellow fever virus
YLEEQEQW

SEQ ID NO: 156811 - protein, 8 aa, Yellow fever virus
LEEQEQWK

SEQ ID NO: 156812 - protein, 8 aa, Yellow fever virus
EEQEQWKT

SEQ ID NO: 156813 - protein, 8 aa, Yellow fever virus
EQEQWKTA

SEQ ID NO: 156814 - protein, 8 aa, Yellow fever virus
QEQWKTAN

SEQ ID NO: 156815 - protein, 8 aa, Yellow fever virus
EQWKTANE

SEQ ID NO: 156816 - protein, 8 aa, Yellow fever virus
QWKTANEA

SEQ ID NO: 156817 - protein, 8 aa, Yellow fever virus
WKTANEAV

SEQ ID NO: 156818 - protein, 8 aa, Yellow fever virus
KTANEAVQ

SEQ ID NO: 156819 - protein, 8 aa, Yellow fever virus
TANEAVQD

SEQ ID NO: 156820 - protein, 8 aa, Yellow fever virus
ANEAVQDP

SEQ ID NO: 156821 - protein, 8 aa, Yellow fever virus
NEAVQDPK

SEQ ID NO: 156822 - protein, 8 aa, Yellow fever virus
EAVQDPKF

SEQ ID NO: 156823 - protein, 8 aa, Yellow fever virus
AVQDPKFW

SEQ ID NO: 156824 - protein, 8 aa, Yellow fever virus
VQDPKFWE

SEQ ID NO: 156825 - protein, 8 aa, Yellow fever virus
QDPKFWEL

SEQ ID NO: 156826 - protein, 8 aa, Yellow fever virus
DPKFWELV

SEQ ID NO: 156827 - protein, 8 aa, Yellow fever virus
PKFWELVD

SEQ ID NO: 156828 - protein, 8 aa, Yellow fever virus
KFWELVDE

SEQ ID NO: 156829 - protein, 8 aa, Yellow fever virus
FWELVDEE

SEQ ID NO: 156830 - protein, 8 aa, Yellow fever virus
WELVDEER

SEQ ID NO: 156831 - protein, 8 aa, Yellow fever virus
ELVDEERK

SEQ ID NO: 156832 - protein, 8 aa, Yellow fever virus
LVDEERKL

SEQ ID NO: 156833 - protein, 8 aa, Yellow fever virus
VDEERKLH

SEQ ID NO: 156834 - protein, 8 aa, Yellow fever virus
DEERKLHQ

SEQ ID NO: 156835 - protein, 8 aa, Yellow fever virus
EERKLHQQ

SEQ ID NO: 156836 - protein, 8 aa, Yellow fever virus
ERKLHQQG

SEQ ID NO: 156837 - protein, 8 aa, Yellow fever virus
RKLHQQGR

SEQ ID NO: 156838 - protein, 8 aa, Yellow fever virus
KLHQQGRC

SEQ ID NO: 156839 - protein, 8 aa, Yellow fever virus
LHQQGRCR

SEQ ID NO: 156840 - protein, 8 aa, Yellow fever virus
HQQGRCRT

SEQ ID NO: 156841 - protein, 8 aa, Yellow fever virus
QQGRCRTC

SEQ ID NO: 156842 - protein, 8 aa, Yellow fever virus
QGRCRTCV

SEQ ID NO: 156843 - protein, 8 aa, Yellow fever virus
GRCRTCVY

SEQ ID NO: 156844 - protein, 8 aa, Yellow fever virus
RCRTCVYN

SEQ ID NO: 156845 - protein, 8 aa, Yellow fever virus
CRTCVYNM

SEQ ID NO: 156846 - protein, 8 aa, Yellow fever virus
RTCVYNMM

SEQ ID NO: 156847 - protein, 8 aa, Yellow fever virus
TCVYNMMG

SEQ ID NO: 156848 - protein, 8 aa, Yellow fever virus
CVYNMMGK

SEQ ID NO: 156849 - protein, 8 aa, Yellow fever virus
VYNMMGKR

SEQ ID NO: 156850 - protein, 8 aa, Yellow fever virus
YNMMGKRE

SEQ ID NO: 156851 - protein, 8 aa, Yellow fever virus
NMMGKREK

SEQ ID NO: 156852 - protein, 8 aa, Yellow fever virus
MMGKREKK

SEQ ID NO: 156853 - protein, 8 aa, Yellow fever virus
MGKREKKL

SEQ ID NO: 156854 - protein, 8 aa, Yellow fever virus
GKREKKLS

SEQ ID NO: 156855 - protein, 8 aa, Yellow fever virus
KREKKLSE

SEQ ID NO: 156856 - protein, 8 aa, Yellow fever virus
REKKLSEF

SEQ ID NO: 156857 - protein, 8 aa, Yellow fever virus
EKKLSEFG

SEQ ID NO: 156858 - protein, 8 aa, Yellow fever virus
KKLSEFGK

SEQ ID NO: 156859 - protein, 8 aa, Yellow fever virus
KLSEFGKA

SEQ ID NO: 156860 - protein, 8 aa, Yellow fever virus
LSEFGKAK

SEQ ID NO: 156861 - protein, 8 aa, Yellow fever virus
SEFGKAKG

SEQ ID NO: 156862 - protein, 8 aa, Yellow fever virus
EFGKAKGS

SEQ ID NO: 156863 - protein, 8 aa, Yellow fever virus
FGKAKGSR

SEQ ID NO: 156864 - protein, 8 aa, Yellow fever virus
GKAKGSRA

SEQ ID NO: 156865 - protein, 8 aa, Yellow fever virus
KAKGSRAI

SEQ ID NO: 156866 - protein, 8 aa, Yellow fever virus
AKGSRAIW

SEQ ID NO: 156867 - protein, 8 aa, Yellow fever virus
KGSRAIWY

SEQ ID NO: 156868 - protein, 8 aa, Yellow fever virus
GSRAIWYM

SEQ ID NO: 156869 - protein, 8 aa, Yellow fever virus
SRAIWYMW

SEQ ID NO: 156870 - protein, 8 aa, Yellow fever virus
RAIWYMWL

SEQ ID NO: 156871 - protein, 8 aa, Yellow fever virus
AIWYMWLG

SEQ ID NO: 156872 - protein, 8 aa, Yellow fever virus
IWYMWLGA

SEQ ID NO: 156873 - protein, 8 aa, Yellow fever virus
WYMWLGAR

SEQ ID NO: 156874 - protein, 8 aa, Yellow fever virus
YMWLGARY

SEQ ID NO: 156875 - protein, 8 aa, Yellow fever virus
MWLGARYL

SEQ ID NO: 156876 - protein, 8 aa, Yellow fever virus
WLGARYLE

SEQ ID NO: 156877 - protein, 8 aa, Yellow fever virus
LGARYLEF

SEQ ID NO: 156878 - protein, 8 aa, Yellow fever virus
GARYLEFE

SEQ ID NO: 156879 - protein, 8 aa, Yellow fever virus
ARYLEFEA

SEQ ID NO: 156880 - protein, 8 aa, Yellow fever virus
RYLEFEAL

SEQ ID NO: 156881 - protein, 8 aa, Yellow fever virus
YLEFEALG

SEQ ID NO: 156882 - protein, 8 aa, Yellow fever virus
LEFEALGF

SEQ ID NO: 156883 - protein, 8 aa, Yellow fever virus
EFEALGFL

SEQ ID NO: 156884 - protein, 8 aa, Yellow fever virus
FEALGFLN

SEQ ID NO: 156885 - protein, 8 aa, Yellow fever virus
EALGFLNE

SEQ ID NO: 156886 - protein, 8 aa, Yellow fever virus
ALGFLNED

SEQ ID NO: 156887 - protein, 8 aa, Yellow fever virus
LGFLNEDH

SEQ ID NO: 156888 - protein, 8 aa, Yellow fever virus
GFLNEDHW

SEQ ID NO: 156889 - protein, 8 aa, Yellow fever virus
FLNEDHWA

SEQ ID NO: 156890 - protein, 8 aa, Yellow fever virus
LNEDHWAS

SEQ ID NO: 156891 - protein, 8 aa, Yellow fever virus
NEDHWASR

SEQ ID NO: 156892 - protein, 8 aa, Yellow fever virus
EDHWASRE

SEQ ID NO: 156893 - protein, 8 aa, Yellow fever virus
DHWASREN

SEQ ID NO: 156894 - protein, 8 aa, Yellow fever virus
HWASRENS

SEQ ID NO: 156895 - protein, 8 aa, Yellow fever virus
WASRENSG

SEQ ID NO: 156896 - protein, 8 aa, Yellow fever virus
ASRENSGG

SEQ ID NO: 156897 - protein, 8 aa, Yellow fever virus
SRENSGGG

SEQ ID NO: 156898 - protein, 8 aa, Yellow fever virus
RENSGGGV

SEQ ID NO: 156899 - protein, 8 aa, Yellow fever virus
ENSGGGVE

SEQ ID NO: 156900 - protein, 8 aa, Yellow fever virus
NSGGGVEG

SEQ ID NO: 156901 - protein, 8 aa, Yellow fever virus
SGGGVEGI

SEQ ID NO: 156902 - protein, 8 aa, Yellow fever virus
GGGVEGIG

SEQ ID NO: 156903 - protein, 8 aa, Yellow fever virus
GGVEGIGL

SEQ ID NO: 156904 - protein, 8 aa, Yellow fever virus
GVEGIGLQ

SEQ ID NO: 156905 - protein, 8 aa, Yellow fever virus
VEGIGLQY

SEQ ID NO: 156906 - protein, 8 aa, Yellow fever virus
EGIGLQYL

SEQ ID NO: 156907 - protein, 8 aa, Yellow fever virus
GIGLQYLG

SEQ ID NO: 156908 - protein, 8 aa, Yellow fever virus
IGLQYLGY

SEQ ID NO: 156909 - protein, 8 aa, Yellow fever virus
GLQYLGYV

SEQ ID NO: 156910 - protein, 8 aa, Yellow fever virus
LQYLGYVI

SEQ ID NO: 156911 - protein, 8 aa, Yellow fever virus
QYLGYVIR

SEQ ID NO: 156912 - protein, 8 aa, Yellow fever virus
YLGYVIRD

SEQ ID NO: 156913 - protein, 8 aa, Yellow fever virus
LGYVIRDL

SEQ ID NO: 156914 - protein, 8 aa, Yellow fever virus
GYVIRDLA

SEQ ID NO: 156915 - protein, 8 aa, Yellow fever virus
YVIRDLAA

SEQ ID NO: 156916 - protein, 8 aa, Yellow fever virus
VIRDLAAM

SEQ ID NO: 156917 - protein, 8 aa, Yellow fever virus
IRDLAAMD

SEQ ID NO: 156918 - protein, 8 aa, Yellow fever virus
RDLAAMDG

SEQ ID NO: 156919 - protein, 8 aa, Yellow fever virus
DLAAMDGG

SEQ ID NO: 156920 - protein, 8 aa, Yellow fever virus
LAAMDGGG

SEQ ID NO: 156921 - protein, 8 aa, Yellow fever virus
AAMDGGGF

SEQ ID NO: 156922 - protein, 8 aa, Yellow fever virus
AMDGGGFY

SEQ ID NO: 156923 - protein, 8 aa, Yellow fever virus
MDGGGFYA

SEQ ID NO: 156924 - protein, 8 aa, Yellow fever virus
DGGGFYAD

SEQ ID NO: 156925 - protein, 8 aa, Yellow fever virus
GGGFYADD

SEQ ID NO: 156926 - protein, 8 aa, Yellow fever virus
GGFYADDT

SEQ ID NO: 156927 - protein, 8 aa, Yellow fever virus
GFYADDTA

SEQ ID NO: 156928 - protein, 8 aa, Yellow fever virus
FYADDTAG

SEQ ID NO: 156929 - protein, 8 aa, Yellow fever virus
YADDTAGW

SEQ ID NO: 156930 - protein, 8 aa, Yellow fever virus
ADDTAGWD

SEQ ID NO: 156931 - protein, 8 aa, Yellow fever virus
DDTAGWDT

SEQ ID NO: 156932 - protein, 8 aa, Yellow fever virus
DTAGWDTR

SEQ ID NO: 156933 - protein, 8 aa, Yellow fever virus
TAGWDTRI

SEQ ID NO: 156934 - protein, 8 aa, Yellow fever virus
AGWDTRIT

SEQ ID NO: 156935 - protein, 8 aa, Yellow fever virus
GWDTRITE

SEQ ID NO: 156936 - protein, 8 aa, Yellow fever virus
WDTRITEA

SEQ ID NO: 156937 - protein, 8 aa, Yellow fever virus
DTRITEAD

SEQ ID NO: 156938 - protein, 8 aa, Yellow fever virus
TRITEADL

SEQ ID NO: 156939 - protein, 8 aa, Yellow fever virus
RITEADLD

SEQ ID NO: 156940 - protein, 8 aa, Yellow fever virus
ITEADLDD

SEQ ID NO: 156941 - protein, 8 aa, Yellow fever virus
TEADLDDE

SEQ ID NO: 156942 - protein, 8 aa, Yellow fever virus
EADLDDEQ

SEQ ID NO: 156943 - protein, 8 aa, Yellow fever virus
ADLDDEQE

SEQ ID NO: 156944 - protein, 8 aa, Yellow fever virus
DLDDEQEI

SEQ ID NO: 156945 - protein, 8 aa, Yellow fever virus
LDDEQEIL

SEQ ID NO: 156946 - protein, 8 aa, Yellow fever virus
DDEQEILN

SEQ ID NO: 156947 - protein, 8 aa, Yellow fever virus
DEQEILNY

SEQ ID NO: 156948 - protein, 8 aa, Yellow fever virus
EQEILNYM

SEQ ID NO: 156949 - protein, 8 aa, Yellow fever virus
QEILNYMS

SEQ ID NO: 156950 - protein, 8 aa, Yellow fever virus
EILNYMSP

SEQ ID NO: 156951 - protein, 8 aa, Yellow fever virus
ILNYMSPH

SEQ ID NO: 156952 - protein, 8 aa, Yellow fever virus
LNYMSPHH

SEQ ID NO: 156953 - protein, 8 aa, Yellow fever virus
NYMSPHHK

SEQ ID NO: 156954 - protein, 8 aa, Yellow fever virus
YMSPHHKK

SEQ ID NO: 156955 - protein, 8 aa, Yellow fever virus
MSPHHKKL

SEQ ID NO: 156956 - protein, 8 aa, Yellow fever virus
SPHHKKLA

SEQ ID NO: 156957 - protein, 8 aa, Yellow fever virus
PHHKKLAQ

SEQ ID NO: 156958 - protein, 8 aa, Yellow fever virus
HHKKLAQA

SEQ ID NO: 156959 - protein, 8 aa, Yellow fever virus
HKKLAQAV

SEQ ID NO: 156960 - protein, 8 aa, Yellow fever virus
KKLAQAVM

SEQ ID NO: 156961 - protein, 8 aa, Yellow fever virus
KLAQAVME

SEQ ID NO: 156962 - protein, 8 aa, Yellow fever virus
LAQAVMEM

SEQ ID NO: 156963 - protein, 8 aa, Yellow fever virus
AQAVMEMT

SEQ ID NO: 156964 - protein, 8 aa, Yellow fever virus
QAVMEMTY

SEQ ID NO: 156965 - protein, 8 aa, Yellow fever virus
AVMEMTYK

SEQ ID NO: 156966 - protein, 8 aa, Yellow fever virus
VMEMTYKN

SEQ ID NO: 156967 - protein, 8 aa, Yellow fever virus
MEMTYKNK

SEQ ID NO: 156968 - protein, 8 aa, Yellow fever virus
EMTYKNKV

SEQ ID NO: 156969 - protein, 8 aa, Yellow fever virus
MTYKNKVV

SEQ ID NO: 156970 - protein, 8 aa, Yellow fever virus
TYKNKVVK

SEQ ID NO: 156971 - protein, 8 aa, Yellow fever virus
YKNKVVKV

SEQ ID NO: 156972 - protein, 8 aa, Yellow fever virus
KNKVVKVL

SEQ ID NO: 156973 - protein, 8 aa, Yellow fever virus
NKVVKVLR

SEQ ID NO: 156974 - protein, 8 aa, Yellow fever virus
KVVKVLRP

SEQ ID NO: 156975 - protein, 8 aa, Yellow fever virus
VVKVLRPA

SEQ ID NO: 156976 - protein, 8 aa, Yellow fever virus
VKVLRPAP

SEQ ID NO: 156977 - protein, 8 aa, Yellow fever virus
KVLRPAPG

SEQ ID NO: 156978 - protein, 8 aa, Yellow fever virus
VLRPAPGG

SEQ ID NO: 156979 - protein, 8 aa, Yellow fever virus
LRPAPGGK

SEQ ID NO: 156980 - protein, 8 aa, Yellow fever virus
RPAPGGKA

SEQ ID NO: 156981 - protein, 8 aa, Yellow fever virus
PAPGGKAY

SEQ ID NO: 156982 - protein, 8 aa, Yellow fever virus
APGGKAYM

SEQ ID NO: 156983 - protein, 8 aa, Yellow fever virus
PGGKAYMD

SEQ ID NO: 156984 - protein, 8 aa, Yellow fever virus
GGKAYMDV

SEQ ID NO: 156985 - protein, 8 aa, Yellow fever virus
GKAYMDVI

SEQ ID NO: 156986 - protein, 8 aa, Yellow fever virus
KAYMDVIS

SEQ ID NO: 156987 - protein, 8 aa, Yellow fever virus
AYMDVISR

SEQ ID NO: 156988 - protein, 8 aa, Yellow fever virus
YMDVISRR

SEQ ID NO: 156989 - protein, 8 aa, Yellow fever virus
MDVISRRD

SEQ ID NO: 156990 - protein, 8 aa, Yellow fever virus
DVISRRDQ

SEQ ID NO: 156991 - protein, 8 aa, Yellow fever virus
VISRRDQR

SEQ ID NO: 156992 - protein, 8 aa, Yellow fever virus
ISRRDQRG

SEQ ID NO: 156993 - protein, 8 aa, Yellow fever virus
SRRDQRGS

SEQ ID NO: 156994 - protein, 8 aa, Yellow fever virus
RRDQRGSG

SEQ ID NO: 156995 - protein, 8 aa, Yellow fever virus
RDQRGSGQ

SEQ ID NO: 156996 - protein, 8 aa, Yellow fever virus
DQRGSGQV

SEQ ID NO: 156997 - protein, 8 aa, Yellow fever virus
QRGSGQVV

SEQ ID NO: 156998 - protein, 8 aa, Yellow fever virus
RGSGQVVT

SEQ ID NO: 156999 - protein, 8 aa, Yellow fever virus
GSGQVVTY

SEQ ID NO: 157000 - protein, 8 aa, Yellow fever virus
SGQVVTYA

SEQ ID NO: 157001 - protein, 8 aa, Yellow fever virus
GQVVTYAL

SEQ ID NO: 157002 - protein, 8 aa, Yellow fever virus
QVVTYALN

SEQ ID NO: 157003 - protein, 8 aa, Yellow fever virus
VVTYALNT

SEQ ID NO: 157004 - protein, 8 aa, Yellow fever virus
VTYALNTI

SEQ ID NO: 157005 - protein, 8 aa, Yellow fever virus
TYALNTIT

SEQ ID NO: 157006 - protein, 8 aa, Yellow fever virus
YALNTITN

SEQ ID NO: 157007 - protein, 8 aa, Yellow fever virus
ALNTITNL

SEQ ID NO: 157008 - protein, 8 aa, Yellow fever virus
LNTITNLK

SEQ ID NO: 157009 - protein, 8 aa, Yellow fever virus
NTITNLKV

SEQ ID NO: 157010 - protein, 8 aa, Yellow fever virus
TITNLKVQ

SEQ ID NO: 157011 - protein, 8 aa, Yellow fever virus
ITNLKVQL

SEQ ID NO: 157012 - protein, 8 aa, Yellow fever virus
TNLKVQLI

SEQ ID NO: 157013 - protein, 8 aa, Yellow fever virus
NLKVQLIR

SEQ ID NO: 157014 - protein, 8 aa, Yellow fever virus
LKVQLIRM

SEQ ID NO: 157015 - protein, 8 aa, Yellow fever virus
KVQLIRMA

SEQ ID NO: 157016 - protein, 8 aa, Yellow fever virus
VQLIRMAE

SEQ ID NO: 157017 - protein, 8 aa, Yellow fever virus
QLIRMAEA

SEQ ID NO: 157018 - protein, 8 aa, Yellow fever virus
LIRMAEAE

SEQ ID NO: 157019 - protein, 8 aa, Yellow fever virus
IRMAEAEM

SEQ ID NO: 157020 - protein, 8 aa, Yellow fever virus
RMAEAEMV

SEQ ID NO: 157021 - protein, 8 aa, Yellow fever virus
MAEAEMVI

SEQ ID NO: 157022 - protein, 8 aa, Yellow fever virus
AEAEMVIH

SEQ ID NO: 157023 - protein, 8 aa, Yellow fever virus
EAEMVIHH

SEQ ID NO: 157024 - protein, 8 aa, Yellow fever virus
AEMVIHHQ

SEQ ID NO: 157025 - protein, 8 aa, Yellow fever virus
EMVIHHQH

SEQ ID NO: 157026 - protein, 8 aa, Yellow fever virus
MVIHHQHV

SEQ ID NO: 157027 - protein, 8 aa, Yellow fever virus
VIHHQHVQ

SEQ ID NO: 157028 - protein, 8 aa, Yellow fever virus
IHHQHVQD

SEQ ID NO: 157029 - protein, 8 aa, Yellow fever virus
HHQHVQDC

SEQ ID NO: 157030 - protein, 8 aa, Yellow fever virus
HQHVQDCD

SEQ ID NO: 157031 - protein, 8 aa, Yellow fever virus
QHVQDCDE

SEQ ID NO: 157032 - protein, 8 aa, Yellow fever virus
HVQDCDES

SEQ ID NO: 157033 - protein, 8 aa, Yellow fever virus
CDESVLTR

SEQ ID NO: 157034 - protein, 8 aa, Yellow fever virus
DESVLTRL

SEQ ID NO: 157035 - protein, 8 aa, Yellow fever virus
LTRLEAWL

SEQ ID NO: 157036 - protein, 8 aa, Yellow fever virus
TRLEAWLT

SEQ ID NO: 157037 - protein, 8 aa, Yellow fever virus
RLEAWLTE

SEQ ID NO: 157038 - protein, 8 aa, Yellow fever virus
LEAWLTEH

SEQ ID NO: 157039 - protein, 8 aa, Yellow fever virus
EAWLTEHG

SEQ ID NO: 157040 - protein, 8 aa, Yellow fever virus
AWLTEHGC

SEQ ID NO: 157041 - protein, 8 aa, Yellow fever virus
WLTEHGCN

SEQ ID NO: 157042 - protein, 8 aa, Yellow fever virus
LTEHGCNR

SEQ ID NO: 157043 - protein, 8 aa, Yellow fever virus
TEHGCNRL

SEQ ID NO: 157044 - protein, 8 aa, Yellow fever virus
RLKRMAVS

SEQ ID NO: 157045 - protein, 8 aa, Yellow fever virus
LKRMAVSG

SEQ ID NO: 157046 - protein, 8 aa, Yellow fever virus
KRMAVSGD

SEQ ID NO: 157047 - protein, 8 aa, Yellow fever virus
RMAVSGDD

SEQ ID NO: 157048 - protein, 8 aa, Yellow fever virus
MAVSGDDC

SEQ ID NO: 157049 - protein, 8 aa, Yellow fever virus
AVSGDDCV

SEQ ID NO: 157050 - protein, 8 aa, Yellow fever virus
VSGDDCVV

SEQ ID NO: 157051 - protein, 8 aa, Yellow fever virus
SGDDCVVR

SEQ ID NO: 157052 - protein, 8 aa, Yellow fever virus
GDDCVVRP

SEQ ID NO: 157053 - protein, 8 aa, Yellow fever virus
DDCVVRPI

SEQ ID NO: 157054 - protein, 8 aa, Yellow fever virus
DCVVRPID

SEQ ID NO: 157055 - protein, 8 aa, Yellow fever virus
CVVRPIDD

SEQ ID NO: 157056 - protein, 8 aa, Yellow fever virus
VVRPIDDR

SEQ ID NO: 157057 - protein, 8 aa, Yellow fever virus
VRPIDDRF

SEQ ID NO: 157058 - protein, 8 aa, Yellow fever virus
RPIDDRFG

SEQ ID NO: 157059 - protein, 8 aa, Yellow fever virus
PIDDRFGL

SEQ ID NO: 157060 - protein, 8 aa, Yellow fever virus
IDDRFGLA

SEQ ID NO: 157061 - protein, 8 aa, Yellow fever virus
DDRFGLAL

SEQ ID NO: 157062 - protein, 8 aa, Yellow fever virus
DRFGLALS

SEQ ID NO: 157063 - protein, 8 aa, Yellow fever virus
RFGLALSH

SEQ ID NO: 157064 - protein, 8 aa, Yellow fever virus
FGLALSHL

SEQ ID NO: 157065 - protein, 8 aa, Yellow fever virus
GLALSHLN

SEQ ID NO: 157066 - protein, 8 aa, Yellow fever virus
LALSHLNA

SEQ ID NO: 157067 - protein, 8 aa, Yellow fever virus
ALSHLNAM

SEQ ID NO: 157068 - protein, 8 aa, Yellow fever virus
LSHLNAMS

SEQ ID NO: 157069 - protein, 8 aa, Yellow fever virus
SHLNAMSK

SEQ ID NO: 157070 - protein, 8 aa, Yellow fever virus
HLNAMSKV

SEQ ID NO: 157071 - protein, 8 aa, Yellow fever virus
LNAMSKVR

SEQ ID NO: 157072 - protein, 8 aa, Yellow fever virus
NAMSKVRK

SEQ ID NO: 157073 - protein, 8 aa, Yellow fever virus
AMSKVRKD

SEQ ID NO: 157074 - protein, 8 aa, Yellow fever virus
MSKVRKDI

SEQ ID NO: 157075 - protein, 8 aa, Yellow fever virus
SKVRKDIS

SEQ ID NO: 157076 - protein, 8 aa, Yellow fever virus
KVRKDISE

SEQ ID NO: 157077 - protein, 8 aa, Yellow fever virus
VRKDISEW

SEQ ID NO: 157078 - protein, 8 aa, Yellow fever virus
RKDISEWQ

SEQ ID NO: 157079 - protein, 8 aa, Yellow fever virus
KDISEWQP

SEQ ID NO: 157080 - protein, 8 aa, Yellow fever virus
DISEWQPS

SEQ ID NO: 157081 - protein, 8 aa, Yellow fever virus
ISEWQPSK

SEQ ID NO: 157082 - protein, 8 aa, Yellow fever virus
SEWQPSKG

SEQ ID NO: 157083 - protein, 8 aa, Yellow fever virus
EWQPSKGW

SEQ ID NO: 157084 - protein, 8 aa, Yellow fever virus
WQPSKGWN

SEQ ID NO: 157085 - protein, 8 aa, Yellow fever virus
QPSKGWND

SEQ ID NO: 157086 - protein, 8 aa, Yellow fever virus
PSKGWNDW

SEQ ID NO: 157087 - protein, 8 aa, Yellow fever virus
SKGWNDWE

SEQ ID NO: 157088 - protein, 8 aa, Yellow fever virus
KGWNDWEN

SEQ ID NO: 157089 - protein, 8 aa, Yellow fever virus
GWNDWENV

SEQ ID NO: 157090 - protein, 8 aa, Yellow fever virus
WNDWENVP

SEQ ID NO: 157091 - protein, 8 aa, Yellow fever virus
NDWENVPF

SEQ ID NO: 157092 - protein, 8 aa, Yellow fever virus
DWENVPFC

SEQ ID NO: 157093 - protein, 8 aa, Yellow fever virus
WENVPFCS

SEQ ID NO: 157094 - protein, 8 aa, Yellow fever virus
ENVPFCSH

SEQ ID NO: 157095 - protein, 8 aa, Yellow fever virus
NVPFCSHH

SEQ ID NO: 157096 - protein, 8 aa, Yellow fever virus
VPFCSHHF

SEQ ID NO: 157097 - protein, 8 aa, Yellow fever virus
PFCSHHFH

SEQ ID NO: 157098 - protein, 8 aa, Yellow fever virus
FCSHHFHE

SEQ ID NO: 157099 - protein, 8 aa, Yellow fever virus
CSHHFHEL

SEQ ID NO: 157100 - protein, 8 aa, Yellow fever virus
SHHFHELQ

SEQ ID NO: 157101 - protein, 8 aa, Yellow fever virus
HHFHELQL

SEQ ID NO: 157102 - protein, 8 aa, Yellow fever virus
HFHELQLK

SEQ ID NO: 157103 - protein, 8 aa, Yellow fever virus
FHELQLKD

SEQ ID NO: 157104 - protein, 8 aa, Yellow fever virus
HELQLKDG

SEQ ID NO: 157105 - protein, 8 aa, Yellow fever virus
ELQLKDGR

SEQ ID NO: 157106 - protein, 8 aa, Yellow fever virus
LQLKDGRR

SEQ ID NO: 157107 - protein, 8 aa, Yellow fever virus
QLKDGRRI

SEQ ID NO: 157108 - protein, 8 aa, Yellow fever virus
LKDGRRIV

SEQ ID NO: 157109 - protein, 8 aa, Yellow fever virus
KDGRRIVV

SEQ ID NO: 157110 - protein, 8 aa, Yellow fever virus
DGRRIVVP

SEQ ID NO: 157111 - protein, 8 aa, Yellow fever virus
GRRIVVPC

SEQ ID NO: 157112 - protein, 8 aa, Yellow fever virus
RRIVVPCR

SEQ ID NO: 157113 - protein, 8 aa, Yellow fever virus
RIVVPCRE

SEQ ID NO: 157114 - protein, 8 aa, Yellow fever virus
IVVPCREQ

SEQ ID NO: 157115 - protein, 8 aa, Yellow fever virus
VVPCREQD

SEQ ID NO: 157116 - protein, 8 aa, Yellow fever virus
VPCREQDE

SEQ ID NO: 157117 - protein, 8 aa, Yellow fever virus
PCREQDEL

SEQ ID NO: 157118 - protein, 8 aa, Yellow fever virus
CREQDELI

SEQ ID NO: 157119 - protein, 8 aa, Yellow fever virus
REQDELIG

SEQ ID NO: 157120 - protein, 8 aa, Yellow fever virus
EQDELIGR

SEQ ID NO: 157121 - protein, 8 aa, Yellow fever virus
QDELIGRG

SEQ ID NO: 157122 - protein, 8 aa, Yellow fever virus
DELIGRGR

SEQ ID NO: 157123 - protein, 8 aa, Yellow fever virus
ELIGRGRV

SEQ ID NO: 157124 - protein, 8 aa, Yellow fever virus
LIGRGRVS

SEQ ID NO: 157125 - protein, 8 aa, Yellow fever virus
IGRGRVSP

SEQ ID NO: 157126 - protein, 8 aa, Yellow fever virus
GRGRVSPG

SEQ ID NO: 157127 - protein, 8 aa, Yellow fever virus
RGRVSPGN

SEQ ID NO: 157128 - protein, 8 aa, Yellow fever virus
GRVSPGNG

SEQ ID NO: 157129 - protein, 8 aa, Yellow fever virus
RVSPGNGW

SEQ ID NO: 157130 - protein, 8 aa, Yellow fever virus
VSPGNGWM

SEQ ID NO: 157131 - protein, 8 aa, Yellow fever virus
SPGNGWMI

SEQ ID NO: 157132 - protein, 8 aa, Yellow fever virus
PGNGWMIK

SEQ ID NO: 157133 - protein, 8 aa, Yellow fever virus
GNGWMIKE

SEQ ID NO: 157134 - protein, 8 aa, Yellow fever virus
NGWMIKET

SEQ ID NO: 157135 - protein, 8 aa, Yellow fever virus
GWMIKETA

SEQ ID NO: 157136 - protein, 8 aa, Yellow fever virus
WMIKETAC

SEQ ID NO: 157137 - protein, 8 aa, Yellow fever virus
MIKETACL

SEQ ID NO: 157138 - protein, 8 aa, Yellow fever virus
IKETACLS

SEQ ID NO: 157139 - protein, 8 aa, Yellow fever virus
KETACLSK

SEQ ID NO: 157140 - protein, 8 aa, Yellow fever virus
ETACLSKA

SEQ ID NO: 157141 - protein, 8 aa, Yellow fever virus
TACLSKAY

SEQ ID NO: 157142 - protein, 8 aa, Yellow fever virus
ACLSKAYA

SEQ ID NO: 157143 - protein, 8 aa, Yellow fever virus
CLSKAYAN

SEQ ID NO: 157144 - protein, 8 aa, Yellow fever virus
LSKAYANM

SEQ ID NO: 157145 - protein, 8 aa, Yellow fever virus
SKAYANMW

SEQ ID NO: 157146 - protein, 8 aa, Yellow fever virus
KAYANMWS

SEQ ID NO: 157147 - protein, 8 aa, Yellow fever virus
AYANMWSL

SEQ ID NO: 157148 - protein, 8 aa, Yellow fever virus
YANMWSLM

SEQ ID NO: 157149 - protein, 8 aa, Yellow fever virus
ANMWSLMY

SEQ ID NO: 157150 - protein, 8 aa, Yellow fever virus
NMWSLMYF

SEQ ID NO: 157151 - protein, 8 aa, Yellow fever virus
MWSLMYFH

SEQ ID NO: 157152 - protein, 8 aa, Yellow fever virus
WSLMYFHK

SEQ ID NO: 157153 - protein, 8 aa, Yellow fever virus
SLMYFHKR

SEQ ID NO: 157154 - protein, 8 aa, Yellow fever virus
LMYFHKRD

SEQ ID NO: 157155 - protein, 8 aa, Yellow fever virus
MYFHKRDM

SEQ ID NO: 157156 - protein, 8 aa, Yellow fever virus
YFHKRDMR

SEQ ID NO: 157157 - protein, 8 aa, Yellow fever virus
FHKRDMRL

SEQ ID NO: 157158 - protein, 8 aa, Yellow fever virus
HKRDMRLL

SEQ ID NO: 157159 - protein, 8 aa, Yellow fever virus
KRDMRLLS

SEQ ID NO: 157160 - protein, 8 aa, Yellow fever virus
RDMRLLSL

SEQ ID NO: 157161 - protein, 8 aa, Yellow fever virus
DMRLLSLA

SEQ ID NO: 157162 - protein, 8 aa, Yellow fever virus
MRLLSLAV

SEQ ID NO: 157163 - protein, 8 aa, Yellow fever virus
RLLSLAVS

SEQ ID NO: 157164 - protein, 8 aa, Yellow fever virus
LLSLAVSS

SEQ ID NO: 157165 - protein, 8 aa, Yellow fever virus
LSLAVSSA

SEQ ID NO: 157166 - protein, 8 aa, Yellow fever virus
SLAVSSAV

SEQ ID NO: 157167 - protein, 8 aa, Yellow fever virus
LAVSSAVP

SEQ ID NO: 157168 - protein, 8 aa, Yellow fever virus
AVSSAVPT

SEQ ID NO: 157169 - protein, 8 aa, Yellow fever virus
VSSAVPTS

SEQ ID NO: 157170 - protein, 8 aa, Yellow fever virus
SSAVPTSW

SEQ ID NO: 157171 - protein, 8 aa, Yellow fever virus
SAVPTSWV

SEQ ID NO: 157172 - protein, 8 aa, Yellow fever virus
AVPTSWVP

SEQ ID NO: 157173 - protein, 8 aa, Yellow fever virus
VPTSWVPQ

SEQ ID NO: 157174 - protein, 8 aa, Yellow fever virus
PTSWVPQG

SEQ ID NO: 157175 - protein, 8 aa, Yellow fever virus
TSWVPQGR

SEQ ID NO: 157176 - protein, 8 aa, Yellow fever virus
SWVPQGRT

SEQ ID NO: 157177 - protein, 8 aa, Yellow fever virus
WVPQGRTT

SEQ ID NO: 157178 - protein, 8 aa, Yellow fever virus
VPQGRTTW

SEQ ID NO: 157179 - protein, 8 aa, Yellow fever virus
PQGRTTWS

SEQ ID NO: 157180 - protein, 8 aa, Yellow fever virus
QGRTTWSI

SEQ ID NO: 157181 - protein, 8 aa, Yellow fever virus
GRTTWSIH

SEQ ID NO: 157182 - protein, 8 aa, Yellow fever virus
RTTWSIHG

SEQ ID NO: 157183 - protein, 8 aa, Yellow fever virus
TTWSIHGK

SEQ ID NO: 157184 - protein, 8 aa, Yellow fever virus
TWSIHGKG

SEQ ID NO: 157185 - protein, 8 aa, Yellow fever virus
WSIHGKGE

SEQ ID NO: 157186 - protein, 8 aa, Yellow fever virus
SIHGKGEW

SEQ ID NO: 157187 - protein, 8 aa, Yellow fever virus
IHGKGEWM

SEQ ID NO: 157188 - protein, 8 aa, Yellow fever virus
HGKGEWMT

SEQ ID NO: 157189 - protein, 8 aa, Yellow fever virus
GKGEWMTT

SEQ ID NO: 157190 - protein, 8 aa, Yellow fever virus
KGEWMTTE

SEQ ID NO: 157191 - protein, 8 aa, Yellow fever virus
GEWMTTED

SEQ ID NO: 157192 - protein, 8 aa, Yellow fever virus
EWMTTEDM

SEQ ID NO: 157193 - protein, 8 aa, Yellow fever virus
WMTTEDML

SEQ ID NO: 157194 - protein, 8 aa, Yellow fever virus
MTTEDMLE

SEQ ID NO: 157195 - protein, 8 aa, Yellow fever virus
TTEDMLEV

SEQ ID NO: 157196 - protein, 8 aa, Yellow fever virus
TEDMLEVW

SEQ ID NO: 157197 - protein, 8 aa, Yellow fever virus
EDMLEVWN

SEQ ID NO: 157198 - protein, 8 aa, Yellow fever virus
DMLEVWNR

SEQ ID NO: 157199 - protein, 8 aa, Yellow fever virus
MLEVWNRV

SEQ ID NO: 157200 - protein, 8 aa, Yellow fever virus
LEVWNRVW

SEQ ID NO: 157201 - protein, 8 aa, Yellow fever virus
EVWNRVWI

SEQ ID NO: 157202 - protein, 8 aa, Yellow fever virus
VWNRVWIT

SEQ ID NO: 157203 - protein, 8 aa, Yellow fever virus
WNRVWITN

SEQ ID NO: 157204 - protein, 8 aa, Yellow fever virus
NRVWITNN

SEQ ID NO: 157205 - protein, 8 aa, Yellow fever virus
RVWITNNP

SEQ ID NO: 157206 - protein, 8 aa, Yellow fever virus
VWITNNPH

SEQ ID NO: 157207 - protein, 8 aa, Yellow fever virus
WITNNPHM

SEQ ID NO: 157208 - protein, 8 aa, Yellow fever virus
ITNNPHMQ

SEQ ID NO: 157209 - protein, 8 aa, Yellow fever virus
TNNPHMQD

SEQ ID NO: 157210 - protein, 8 aa, Yellow fever virus
NNPHMQDK

SEQ ID NO: 157211 - protein, 8 aa, Yellow fever virus
NPHMQDKT

SEQ ID NO: 157212 - protein, 8 aa, Yellow fever virus
PHMQDKTM

SEQ ID NO: 157213 - protein, 8 aa, Yellow fever virus
HMQDKTMV

SEQ ID NO: 157214 - protein, 8 aa, Yellow fever virus
MQDKTMVK

SEQ ID NO: 157215 - protein, 8 aa, Yellow fever virus
QDKTMVKK

SEQ ID NO: 157216 - protein, 8 aa, Yellow fever virus
DKTMVKKW

SEQ ID NO: 157217 - protein, 8 aa, Yellow fever virus
KTMVKKWR

SEQ ID NO: 157218 - protein, 8 aa, Yellow fever virus
TMVKKWRD

SEQ ID NO: 157219 - protein, 8 aa, Yellow fever virus
MVKKWRDV

SEQ ID NO: 157220 - protein, 8 aa, Yellow fever virus
VKKWRDVP

SEQ ID NO: 157221 - protein, 8 aa, Yellow fever virus
KKWRDVPY

SEQ ID NO: 157222 - protein, 8 aa, Yellow fever virus
KWRDVPYL

SEQ ID NO: 157223 - protein, 8 aa, Yellow fever virus
WRDVPYLT

SEQ ID NO: 157224 - protein, 8 aa, Yellow fever virus
RDVPYLTK

SEQ ID NO: 157225 - protein, 8 aa, Yellow fever virus
DVPYLTKR

SEQ ID NO: 157226 - protein, 8 aa, Yellow fever virus
VPYLTKRQ

SEQ ID NO: 157227 - protein, 8 aa, Yellow fever virus
PYLTKRQD

SEQ ID NO: 157228 - protein, 8 aa, Yellow fever virus
YLTKRQDK

SEQ ID NO: 157229 - protein, 8 aa, Yellow fever virus
LTKRQDKL

SEQ ID NO: 157230 - protein, 8 aa, Yellow fever virus
TKRQDKLC

SEQ ID NO: 157231 - protein, 8 aa, Yellow fever virus
KRQDKLCG

SEQ ID NO: 157232 - protein, 8 aa, Yellow fever virus
RQDKLCGS

SEQ ID NO: 157233 - protein, 8 aa, Yellow fever virus
QDKLCGSL

SEQ ID NO: 157234 - protein, 8 aa, Yellow fever virus
DKLCGSLI

SEQ ID NO: 157235 - protein, 8 aa, Yellow fever virus
KLCGSLIG

SEQ ID NO: 157236 - protein, 8 aa, Yellow fever virus
LCGSLIGM

SEQ ID NO: 157237 - protein, 8 aa, Yellow fever virus
CGSLIGMT

SEQ ID NO: 157238 - protein, 8 aa, Yellow fever virus
GSLIGMTN

SEQ ID NO: 157239 - protein, 8 aa, Yellow fever virus
SLIGMTNR

SEQ ID NO: 157240 - protein, 8 aa, Yellow fever virus
LIGMTNRA

SEQ ID NO: 157241 - protein, 8 aa, Yellow fever virus
IGMTNRAT

SEQ ID NO: 157242 - protein, 8 aa, Yellow fever virus
GMTNRATW

SEQ ID NO: 157243 - protein, 8 aa, Yellow fever virus
MTNRATWA

SEQ ID NO: 157244 - protein, 8 aa, Yellow fever virus
TNRATWAS

SEQ ID NO: 157245 - protein, 8 aa, Yellow fever virus
NRATWASH

SEQ ID NO: 157246 - protein, 8 aa, Yellow fever virus
RATWASHI

SEQ ID NO: 157247 - protein, 8 aa, Yellow fever virus
ATWASHIH

SEQ ID NO: 157248 - protein, 8 aa, Yellow fever virus
TWASHIHL

SEQ ID NO: 157249 - protein, 8 aa, Yellow fever virus
WASHIHLV

SEQ ID NO: 157250 - protein, 8 aa, Yellow fever virus
ASHIHLVI

SEQ ID NO: 157251 - protein, 8 aa, Yellow fever virus
SHIHLVIH

SEQ ID NO: 157252 - protein, 8 aa, Yellow fever virus
HIHLVIHR

SEQ ID NO: 157253 - protein, 8 aa, Yellow fever virus
IHLVIHRI

SEQ ID NO: 157254 - protein, 8 aa, Yellow fever virus
HLVIHRIR

SEQ ID NO: 157255 - protein, 8 aa, Yellow fever virus
LVIHRIRT

SEQ ID NO: 157256 - protein, 8 aa, Yellow fever virus
VIHRIRTL

SEQ ID NO: 157257 - protein, 8 aa, Yellow fever virus
IHRIRTLI

SEQ ID NO: 157258 - protein, 8 aa, Yellow fever virus
HRIRTLIG

SEQ ID NO: 157259 - protein, 8 aa, Yellow fever virus
RIRTLIGQ

SEQ ID NO: 157260 - protein, 8 aa, Yellow fever virus
IRTLIGQE

SEQ ID NO: 157261 - protein, 8 aa, Yellow fever virus
RTLIGQEK

SEQ ID NO: 157262 - protein, 8 aa, Yellow fever virus
TLIGQEKY

SEQ ID NO: 157263 - protein, 8 aa, Yellow fever virus
LIGQEKYT

SEQ ID NO: 157264 - protein, 8 aa, Yellow fever virus
IGQEKYTD

SEQ ID NO: 157265 - protein, 8 aa, Yellow fever virus
GQEKYTDY

SEQ ID NO: 157266 - protein, 8 aa, Yellow fever virus
QEKYTDYL

SEQ ID NO: 157267 - protein, 8 aa, Yellow fever virus
EKYTDYLT

SEQ ID NO: 157268 - protein, 8 aa, Yellow fever virus
KYTDYLTV

SEQ ID NO: 157269 - protein, 8 aa, Yellow fever virus
YTDYLTVM

SEQ ID NO: 157270 - protein, 8 aa, Yellow fever virus
TDYLTVMD

SEQ ID NO: 157271 - protein, 8 aa, Yellow fever virus
DYLTVMDR

SEQ ID NO: 157272 - protein, 8 aa, Yellow fever virus
YLTVMDRY

SEQ ID NO: 157273 - protein, 8 aa, Yellow fever virus
LTVMDRYS

SEQ ID NO: 157274 - protein, 8 aa, Yellow fever virus
TVMDRYSV

SEQ ID NO: 157275 - protein, 8 aa, Yellow fever virus
VMDRYSVD

SEQ ID NO: 157276 - protein, 8 aa, Yellow fever virus
MDRYSVDA

SEQ ID NO: 157277 - protein, 8 aa, Yellow fever virus
DRYSVDAD

SEQ ID NO: 157278 - protein, 8 aa, Yellow fever virus
RYSVDADL

SEQ ID NO: 157279 - protein, 8 aa, Yellow fever virus
YSVDADLQ

SEQ ID NO: 157280 - protein, 8 aa, Yellow fever virus
SVDADLQL

SEQ ID NO: 157281 - protein, 8 aa, Yellow fever virus
VDADLQLG

SEQ ID NO: 157282 - protein, 8 aa, Yellow fever virus
DADLQLGE

SEQ ID NO: 157283 - protein, 8 aa, Yellow fever virus
ADLQLGEL

SEQ ID NO: 157284 - protein, 8 aa, Yellow fever virus
DLQLGELI

SEQ ID NO: 157285 - protein, 8 aa, Yellow fever virus
VNMVRRGA

SEQ ID NO: 157286 - protein, 8 aa, Yellow fever virus
NMVRRGAR

SEQ ID NO: 157287 - protein, 8 aa, Yellow fever virus
MVRRGARS

SEQ ID NO: 157288 - protein, 8 aa, Yellow fever virus
VRRGARSL

SEQ ID NO: 157289 - protein, 8 aa, Yellow fever virus
RRGARSLS

SEQ ID NO: 157290 - protein, 8 aa, Yellow fever virus
RGARSLSN

SEQ ID NO: 157291 - protein, 8 aa, Yellow fever virus
GARSLSNK

SEQ ID NO: 157292 - protein, 8 aa, Yellow fever virus
ARSLSNKI

SEQ ID NO: 157293 - protein, 8 aa, Yellow fever virus
QIGNRPGL

SEQ ID NO: 157294 - protein, 8 aa, Yellow fever virus
IGNRPGLS

SEQ ID NO: 157295 - protein, 8 aa, Yellow fever virus
GNRPGLSR

SEQ ID NO: 157296 - protein, 8 aa, Yellow fever virus
NRPGLSRG

SEQ ID NO: 157297 - protein, 8 aa, Yellow fever virus
RPGLSRGV

SEQ ID NO: 157298 - protein, 8 aa, Yellow fever virus
PGLSRGVQ

SEQ ID NO: 157299 - protein, 8 aa, Yellow fever virus
GLSRGVQG

SEQ ID NO: 157300 - protein, 8 aa, Yellow fever virus
LSRGVQGF

SEQ ID NO: 157301 - protein, 8 aa, Yellow fever virus
RGVQGFIS

SEQ ID NO: 157302 - protein, 8 aa, Yellow fever virus
GVQGFISF

SEQ ID NO: 157303 - protein, 8 aa, Yellow fever virus
VQGFISFF

SEQ ID NO: 157304 - protein, 8 aa, Yellow fever virus
QGFISFFS

SEQ ID NO: 157305 - protein, 8 aa, Yellow fever virus
GFISFFSF

SEQ ID NO: 157306 - protein, 8 aa, Yellow fever virus
FISFFSFN

SEQ ID NO: 157307 - protein, 8 aa, Yellow fever virus
ISFFSFNI

SEQ ID NO: 157308 - protein, 8 aa, Yellow fever virus
SFFSFNIL

SEQ ID NO: 157309 - protein, 8 aa, Yellow fever virus
FFSFNILT

SEQ ID NO: 157310 - protein, 8 aa, Yellow fever virus
FSFNILTG

SEQ ID NO: 157311 - protein, 8 aa, Yellow fever virus
SFNILTGK

SEQ ID NO: 157312 - protein, 8 aa, Yellow fever virus
NILTGKKL

SEQ ID NO: 157313 - protein, 8 aa, Yellow fever virus
ILTGKKLT

SEQ ID NO: 157314 - protein, 8 aa, Yellow fever virus
LTGKKLTT

SEQ ID NO: 157315 - protein, 8 aa, Yellow fever virus
TGKKLTTH

SEQ ID NO: 157316 - protein, 8 aa, Yellow fever virus
GKKLTTHL

SEQ ID NO: 157317 - protein, 8 aa, Yellow fever virus
KKLTTHLK

SEQ ID NO: 157318 - protein, 8 aa, Yellow fever virus
KLTTHLKR

SEQ ID NO: 157319 - protein, 8 aa, Yellow fever virus
LTTHLKRL

SEQ ID NO: 157320 - protein, 8 aa, Yellow fever virus
TTHLKRLW

SEQ ID NO: 157321 - protein, 8 aa, Yellow fever virus
THLKRLWR

SEQ ID NO: 157322 - protein, 8 aa, Yellow fever virus
HLKRLWRM

SEQ ID NO: 157323 - protein, 8 aa, Yellow fever virus
LKRLWRML

SEQ ID NO: 157324 - protein, 8 aa, Yellow fever virus
KRLWRMLD

SEQ ID NO: 157325 - protein, 8 aa, Yellow fever virus
RLWRMLDP

SEQ ID NO: 157326 - protein, 8 aa, Yellow fever virus
LWRMLDPR

SEQ ID NO: 157327 - protein, 8 aa, Yellow fever virus
WRMLDPRQ

SEQ ID NO: 157328 - protein, 8 aa, Yellow fever virus
RMLDPRQG

SEQ ID NO: 157329 - protein, 8 aa, Yellow fever virus
LDPRQGLT

SEQ ID NO: 157330 - protein, 8 aa, Yellow fever virus
DPRQGLAA

SEQ ID NO: 157331 - protein, 8 aa, Yellow fever virus
PRQGLAAL

SEQ ID NO: 157332 - protein, 8 aa, Yellow fever virus
RQGLAALR

SEQ ID NO: 157333 - protein, 8 aa, Yellow fever virus
QGLAALRK

SEQ ID NO: 157334 - protein, 8 aa, Yellow fever virus
GLAALRKV

SEQ ID NO: 157335 - protein, 8 aa, Yellow fever virus
LAALRKVK

SEQ ID NO: 157336 - protein, 8 aa, Yellow fever virus
AALRKVKR

SEQ ID NO: 157337 - protein, 8 aa, Yellow fever virus
ALRKVKRV

SEQ ID NO: 157338 - protein, 8 aa, Yellow fever virus
KVKRVVAG

SEQ ID NO: 157339 - protein, 8 aa, Yellow fever virus
VKRVVAGL

SEQ ID NO: 157340 - protein, 8 aa, Yellow fever virus
KRVVAGLM

SEQ ID NO: 157341 - protein, 8 aa, Yellow fever virus
RVVAGLMR

SEQ ID NO: 157342 - protein, 8 aa, Yellow fever virus
VVAGLMRG

SEQ ID NO: 157343 - protein, 8 aa, Yellow fever virus
VAGLMRGL

SEQ ID NO: 157344 - protein, 8 aa, Yellow fever virus
AGLMRGLS

SEQ ID NO: 157345 - protein, 8 aa, Yellow fever virus
GLMRGLSS

SEQ ID NO: 157346 - protein, 8 aa, Yellow fever virus
LMIGLSSR

SEQ ID NO: 157347 - protein, 8 aa, Yellow fever virus
MIGLSSRK

SEQ ID NO: 157348 - protein, 8 aa, Yellow fever virus
IGLSSRKR

SEQ ID NO: 157349 - protein, 8 aa, Yellow fever virus
SSRKRRSN

SEQ ID NO: 157350 - protein, 8 aa, Yellow fever virus
SRKRRSNE

SEQ ID NO: 157351 - protein, 8 aa, Yellow fever virus
RKRRSNEM

SEQ ID NO: 157352 - protein, 8 aa, Yellow fever virus
KRRSNEMA

SEQ ID NO: 157353 - protein, 8 aa, Yellow fever virus
MMPLLILS

SEQ ID NO: 157354 - protein, 8 aa, Yellow fever virus
MPLLILSM

SEQ ID NO: 157355 - protein, 8 aa, Yellow fever virus
PLLILSMV

SEQ ID NO: 157356 - protein, 8 aa, Yellow fever virus
LLILSMVI

SEQ ID NO: 157357 - protein, 8 aa, Yellow fever virus
LILSMVIL

SEQ ID NO: 157358 - protein, 8 aa, Yellow fever virus
LMAGGVTL

SEQ ID NO: 157359 - protein, 8 aa, Yellow fever virus
AGGVTLVR

SEQ ID NO: 157360 - protein, 8 aa, Yellow fever virus
GGVTLMRK

SEQ ID NO: 157361 - protein, 8 aa, Yellow fever virus
GVTLMRKN

SEQ ID NO: 157362 - protein, 8 aa, Yellow fever virus
VTLMRKNR

SEQ ID NO: 157363 - protein, 8 aa, Yellow fever virus
TLMRKNRW

SEQ ID NO: 157364 - protein, 8 aa, Yellow fever virus
LMRKNRWL

SEQ ID NO: 157365 - protein, 8 aa, Yellow fever virus
MRKNRWLL

SEQ ID NO: 157366 - protein, 8 aa, Yellow fever virus
WLLLNVTA

SEQ ID NO: 157367 - protein, 8 aa, Yellow fever virus
LLLNVTAE

SEQ ID NO: 157368 - protein, 8 aa, Yellow fever virus
LLNVTAED

SEQ ID NO: 157369 - protein, 8 aa, Yellow fever virus
LNVTAEDL

SEQ ID NO: 157370 - protein, 8 aa, Yellow fever virus
NVTAEDLG

SEQ ID NO: 157371 - protein, 8 aa, Yellow fever virus
VTAEDLGK

SEQ ID NO: 157372 - protein, 8 aa, Yellow fever virus
TAEDLGKT

SEQ ID NO: 157373 - protein, 8 aa, Yellow fever virus
AEDLGKTF

SEQ ID NO: 157374 - protein, 8 aa, Yellow fever virus
DLGKTFSM

SEQ ID NO: 157375 - protein, 8 aa, Yellow fever virus
LGKTFSIG

SEQ ID NO: 157376 - protein, 8 aa, Yellow fever virus
GKTFSIGT

SEQ ID NO: 157377 - protein, 8 aa, Yellow fever virus
KTFSVGAG

SEQ ID NO: 157378 - protein, 8 aa, Yellow fever virus
TFSLGTGN

SEQ ID NO: 157379 - protein, 8 aa, Yellow fever virus
FSIGTGNC

SEQ ID NO: 157380 - protein, 8 aa, Yellow fever virus
SMGTGNCT

SEQ ID NO: 157381 - protein, 8 aa, Yellow fever virus
VGAGNCTT

SEQ ID NO: 157382 - protein, 8 aa, Yellow fever virus
GAGNCTTN

SEQ ID NO: 157383 - protein, 8 aa, Yellow fever virus
AGNCTTNI

SEQ ID NO: 157384 - protein, 8 aa, Yellow fever virus
GVENVRVT

SEQ ID NO: 157385 - protein, 8 aa, Yellow fever virus
VENVRVTY

SEQ ID NO: 157386 - protein, 8 aa, Yellow fever virus
ENVRVTYG

SEQ ID NO: 157387 - protein, 8 aa, Yellow fever virus
NVRVAYGR

SEQ ID NO: 157388 - protein, 8 aa, Yellow fever virus
VRVAYGRC

SEQ ID NO: 157389 - protein, 8 aa, Yellow fever virus
RVAYGRCD

SEQ ID NO: 157390 - protein, 8 aa, Yellow fever virus
VAYGRCDA

SEQ ID NO: 157391 - protein, 8 aa, Yellow fever virus
AYGRCDAV

SEQ ID NO: 157392 - protein, 8 aa, Yellow fever virus
YGRCDAVG

SEQ ID NO: 157393 - protein, 8 aa, Yellow fever virus
GRCDAVGR

SEQ ID NO: 157394 - protein, 8 aa, Yellow fever virus
RCDAVGRS

SEQ ID NO: 157395 - protein, 8 aa, Yellow fever virus
CDAVGRSK

SEQ ID NO: 157396 - protein, 8 aa, Yellow fever virus
DAVGRSKR

SEQ ID NO: 157397 - protein, 8 aa, Yellow fever virus
AVGRSKRS

SEQ ID NO: 157398 - protein, 8 aa, Yellow fever virus
VGRSKRSR

SEQ ID NO: 157399 - protein, 8 aa, Yellow fever virus
GRSKRSRR

SEQ ID NO: 157400 - protein, 8 aa, Yellow fever virus
RSKRSRRA

SEQ ID NO: 157401 - protein, 8 aa, Yellow fever virus
SKRSRRAI

SEQ ID NO: 157402 - protein, 8 aa, Yellow fever virus
KRSRRAID

SEQ ID NO: 157403 - protein, 8 aa, Yellow fever virus
TRQEKWMA

SEQ ID NO: 157404 - protein, 8 aa, Yellow fever virus
RQEKWMAG

SEQ ID NO: 157405 - protein, 8 aa, Yellow fever virus
QEKWMAGR

SEQ ID NO: 157406 - protein, 8 aa, Yellow fever virus
EKWMAGRM

SEQ ID NO: 157407 - protein, 8 aa, Yellow fever virus
KWMAGRMG

SEQ ID NO: 157408 - protein, 8 aa, Yellow fever virus
WMAGRMGE

SEQ ID NO: 157409 - protein, 8 aa, Yellow fever virus
MAGRMGER

SEQ ID NO: 157410 - protein, 8 aa, Yellow fever virus
AGRMGERQ

SEQ ID NO: 157411 - protein, 8 aa, Yellow fever virus
LQKIERWL

SEQ ID NO: 157412 - protein, 8 aa, Yellow fever virus
QKIERWLV

SEQ ID NO: 157413 - protein, 8 aa, Yellow fever virus
KIERWLVR

SEQ ID NO: 157414 - protein, 8 aa, Yellow fever virus
IERWLVRN

SEQ ID NO: 157415 - protein, 8 aa, Yellow fever virus
ERWLVRNP

SEQ ID NO: 157416 - protein, 8 aa, Yellow fever virus
RWLVRNPF

SEQ ID NO: 157417 - protein, 8 aa, Yellow fever virus
WLVRNPFF

SEQ ID NO: 157418 - protein, 8 aa, Yellow fever virus
LVRNPFFA

SEQ ID NO: 157419 - protein, 8 aa, Yellow fever virus
VRNPFFAI

SEQ ID NO: 157420 - protein, 8 aa, Yellow fever virus
RNPFFAIT

SEQ ID NO: 157421 - protein, 8 aa, Yellow fever virus
NPFFAITA

SEQ ID NO: 157422 - protein, 8 aa, Yellow fever virus
PFFAITAL

SEQ ID NO: 157423 - protein, 8 aa, Yellow fever virus
FFAVTALA

SEQ ID NO: 157424 - protein, 8 aa, Yellow fever virus
FAVTALAI

SEQ ID NO: 157425 - protein, 8 aa, Yellow fever virus
AVTALAIA

SEQ ID NO: 157426 - protein, 8 aa, Yellow fever virus
VTALAIAY

SEQ ID NO: 157427 - protein, 8 aa, Yellow fever virus
TALAIAYL

SEQ ID NO: 157428 - protein, 8 aa, Yellow fever virus
ALAIAYLV

SEQ ID NO: 157429 - protein, 8 aa, Yellow fever virus
LAIAYLVG

SEQ ID NO: 157430 - protein, 8 aa, Yellow fever virus
AIAYLVGN

SEQ ID NO: 157431 - protein, 8 aa, Yellow fever virus
IAYLVGNN

SEQ ID NO: 157432 - protein, 8 aa, Yellow fever virus
AYLVGNNK

SEQ ID NO: 157433 - protein, 8 aa, Yellow fever virus
YLVGNNKT

SEQ ID NO: 157434 - protein, 8 aa, Yellow fever virus
LVGNNMTQ

SEQ ID NO: 157435 - protein, 8 aa, Yellow fever virus
VGNNTTQR

SEQ ID NO: 157436 - protein, 8 aa, Yellow fever virus
GNNTTQRV

SEQ ID NO: 157437 - protein, 8 aa, Yellow fever virus
NNKTQRVV

SEQ ID NO: 157438 - protein, 8 aa, Yellow fever virus
NTTQRVVI

SEQ ID NO: 157439 - protein, 8 aa, Yellow fever virus
TTQRVVIA

SEQ ID NO: 157440 - protein, 8 aa, Yellow fever virus
YSAHCIGV

SEQ ID NO: 157441 - protein, 8 aa, Yellow fever virus
SAHCIGVA

SEQ ID NO: 157442 - protein, 8 aa, Yellow fever virus
AHCIGVAD

SEQ ID NO: 157443 - protein, 8 aa, Yellow fever virus
HCIGVADR

SEQ ID NO: 157444 - protein, 8 aa, Yellow fever virus
CIGVADRD

SEQ ID NO: 157445 - protein, 8 aa, Yellow fever virus
IGVADRDF

SEQ ID NO: 157446 - protein, 8 aa, Yellow fever virus
GVADRDFI

SEQ ID NO: 157447 - protein, 8 aa, Yellow fever virus
VADRDFIE

SEQ ID NO: 157448 - protein, 8 aa, Yellow fever virus
ADRDFIEG

SEQ ID NO: 157449 - protein, 8 aa, Yellow fever virus
GGTWVSAS

SEQ ID NO: 157450 - protein, 8 aa, Yellow fever virus
GTWVSASL

SEQ ID NO: 157451 - protein, 8 aa, Yellow fever virus
TWVSASLE

SEQ ID NO: 157452 - protein, 8 aa, Yellow fever virus
WVSASLEQ

SEQ ID NO: 157453 - protein, 8 aa, Yellow fever virus
VSATLEQG

SEQ ID NO: 157454 - protein, 8 aa, Yellow fever virus
SATLEQGK

SEQ ID NO: 157455 - protein, 8 aa, Yellow fever virus
ATLEQGKC

SEQ ID NO: 157456 - protein, 8 aa, Yellow fever virus
SLEQDKCV

SEQ ID NO: 157457 - protein, 8 aa, Yellow fever virus
LEQGKCVT

SEQ ID NO: 157458 - protein, 8 aa, Yellow fever virus
EQGKCVTV

SEQ ID NO: 157459 - protein, 8 aa, Yellow fever virus
QGKCVTVM

SEQ ID NO: 157460 - protein, 8 aa, Yellow fever virus
GKCVTVMA

SEQ ID NO: 157461 - protein, 8 aa, Yellow fever virus
PSLDISLQ

SEQ ID NO: 157462 - protein, 8 aa, Yellow fever virus
SLDISLQT

SEQ ID NO: 157463 - protein, 8 aa, Yellow fever virus
LDISLQTV

SEQ ID NO: 157464 - protein, 8 aa, Yellow fever virus
DISLQTVA

SEQ ID NO: 157465 - protein, 8 aa, Yellow fever virus
ISLQTVAI

SEQ ID NO: 157466 - protein, 8 aa, Yellow fever virus
SLQTVAID

SEQ ID NO: 157467 - protein, 8 aa, Yellow fever virus
LETVAIDG

SEQ ID NO: 157468 - protein, 8 aa, Yellow fever virus
ETVAIDGP

SEQ ID NO: 157469 - protein, 8 aa, Yellow fever virus
TVAIDGPA

SEQ ID NO: 157470 - protein, 8 aa, Yellow fever virus
VAIDGPAE

SEQ ID NO: 157471 - protein, 8 aa, Yellow fever virus
AIDGPAEA

SEQ ID NO: 157472 - protein, 8 aa, Yellow fever virus
IDGPAEAR

SEQ ID NO: 157473 - protein, 8 aa, Yellow fever virus
DGPAEARK

SEQ ID NO: 157474 - protein, 8 aa, Yellow fever virus
GPAEARKV

SEQ ID NO: 157475 - protein, 8 aa, Yellow fever virus
PAEARKVC

SEQ ID NO: 157476 - protein, 8 aa, Yellow fever virus
AEARKVCY

SEQ ID NO: 157477 - protein, 8 aa, Yellow fever virus
EARKVCYN

SEQ ID NO: 157478 - protein, 8 aa, Yellow fever virus
ARKVCYNA

SEQ ID NO: 157479 - protein, 8 aa, Yellow fever virus
RKVCYSAV

SEQ ID NO: 157480 - protein, 8 aa, Yellow fever virus
KVCYSAVL

SEQ ID NO: 157481 - protein, 8 aa, Yellow fever virus
VCYSAVLT

SEQ ID NO: 157482 - protein, 8 aa, Yellow fever virus
CYSAVLTH

SEQ ID NO: 157483 - protein, 8 aa, Yellow fever virus
YSAVLTHV

SEQ ID NO: 157484 - protein, 8 aa, Yellow fever virus
SAVLTHVK

SEQ ID NO: 157485 - protein, 8 aa, Yellow fever virus
VLTHVKID

SEQ ID NO: 157486 - protein, 8 aa, Yellow fever virus
LTHVKIDD

SEQ ID NO: 157487 - protein, 8 aa, Yellow fever virus
THVKIDDK

SEQ ID NO: 157488 - protein, 8 aa, Yellow fever virus
HVKIDDKC

SEQ ID NO: 157489 - protein, 8 aa, Yellow fever virus
VKIDDKCP

SEQ ID NO: 157490 - protein, 8 aa, Yellow fever virus
KIDDKCPS

SEQ ID NO: 157491 - protein, 8 aa, Yellow fever virus
IDDKCPST

SEQ ID NO: 157492 - protein, 8 aa, Yellow fever virus
DDKCPSTG

SEQ ID NO: 157493 - protein, 8 aa, Yellow fever virus
AHLAEEND

SEQ ID NO: 157494 - protein, 8 aa, Yellow fever virus
HLAEENDG

SEQ ID NO: 157495 - protein, 8 aa, Yellow fever virus
LAEENDGD

SEQ ID NO: 157496 - protein, 8 aa, Yellow fever virus
AEENDGDN

SEQ ID NO: 157497 - protein, 8 aa, Yellow fever virus
EENDGDNA

SEQ ID NO: 157498 - protein, 8 aa, Yellow fever virus
ENDGDNAC

SEQ ID NO: 157499 - protein, 8 aa, Yellow fever virus
NDGDNACK

SEQ ID NO: 157500 - protein, 8 aa, Yellow fever virus
DGDNACKR

SEQ ID NO: 157501 - protein, 8 aa, Yellow fever virus
TKIQYVIK

SEQ ID NO: 157502 - protein, 8 aa, Yellow fever virus
KIQYVIKA

SEQ ID NO: 157503 - protein, 8 aa, Yellow fever virus
IQYVIKAQ

SEQ ID NO: 157504 - protein, 8 aa, Yellow fever virus
QYVIRARL

SEQ ID NO: 157505 - protein, 8 aa, Yellow fever virus
YVIKAQLH

SEQ ID NO: 157506 - protein, 8 aa, Yellow fever virus
VIRARLHV

SEQ ID NO: 157507 - protein, 8 aa, Yellow fever virus
IKAQLHVG

SEQ ID NO: 157508 - protein, 8 aa, Yellow fever virus
RARLHVGA

SEQ ID NO: 157509 - protein, 8 aa, Yellow fever virus
ARLHVGAK

SEQ ID NO: 157510 - protein, 8 aa, Yellow fever virus
RLHVGAKQ

SEQ ID NO: 157511 - protein, 8 aa, Yellow fever virus
HVGAKQED

SEQ ID NO: 157512 - protein, 8 aa, Yellow fever virus
VGAKQEDW

SEQ ID NO: 157513 - protein, 8 aa, Yellow fever virus
GAKQENWT

SEQ ID NO: 157514 - protein, 8 aa, Yellow fever virus
AKQENWTT

SEQ ID NO: 157515 - protein, 8 aa, Yellow fever virus
KQENWTTD

SEQ ID NO: 157516 - protein, 8 aa, Yellow fever virus
QENWTTDI

SEQ ID NO: 157517 - protein, 8 aa, Yellow fever virus
ENWTTDIK

SEQ ID NO: 157518 - protein, 8 aa, Yellow fever virus
NWTTDIKT

SEQ ID NO: 157519 - protein, 8 aa, Yellow fever virus
WTTDIKTL

SEQ ID NO: 157520 - protein, 8 aa, Yellow fever virus
TTDIKTLK

SEQ ID NO: 157521 - protein, 8 aa, Yellow fever virus
TSIKTLKF

SEQ ID NO: 157522 - protein, 8 aa, Yellow fever virus
SIKTLKFD

SEQ ID NO: 157523 - protein, 8 aa, Yellow fever virus
IKTLKFDV

SEQ ID NO: 157524 - protein, 8 aa, Yellow fever virus
KTLKFDVL

SEQ ID NO: 157525 - protein, 8 aa, Yellow fever virus
TLKFDVLS

SEQ ID NO: 157526 - protein, 8 aa, Yellow fever virus
LKFDVLSG

SEQ ID NO: 157527 - protein, 8 aa, Yellow fever virus
KFDVLSGS

SEQ ID NO: 157528 - protein, 8 aa, Yellow fever virus
FDVLSGSQ

SEQ ID NO: 157529 - protein, 8 aa, Yellow fever virus
DVLSGSQE

SEQ ID NO: 157530 - protein, 8 aa, Yellow fever virus
ALSGSQEA

SEQ ID NO: 157531 - protein, 8 aa, Yellow fever virus
LSGSQEAE

SEQ ID NO: 157532 - protein, 8 aa, Yellow fever virus
SGSQEAEF

SEQ ID NO: 157533 - protein, 8 aa, Yellow fever virus
GSQEAEFT

SEQ ID NO: 157534 - protein, 8 aa, Yellow fever virus
SQEAEFTG

SEQ ID NO: 157535 - protein, 8 aa, Yellow fever virus
QEAEFTGY

SEQ ID NO: 157536 - protein, 8 aa, Yellow fever virus
EAEFTGYG

SEQ ID NO: 157537 - protein, 8 aa, Yellow fever virus
AEFTGYGK

SEQ ID NO: 157538 - protein, 8 aa, Yellow fever virus
EFTGYGKA

SEQ ID NO: 157539 - protein, 8 aa, Yellow fever virus
FTGYGKAT

SEQ ID NO: 157540 - protein, 8 aa, Yellow fever virus
TGYGKATL

SEQ ID NO: 157541 - protein, 8 aa, Yellow fever virus
GYGKVTLE

SEQ ID NO: 157542 - protein, 8 aa, Yellow fever virus
YGKVTLEC

SEQ ID NO: 157543 - protein, 8 aa, Yellow fever virus
GKATLECR

SEQ ID NO: 157544 - protein, 8 aa, Yellow fever virus
KATLECRV

SEQ ID NO: 157545 - protein, 8 aa, Yellow fever virus
ATLECRVQ

SEQ ID NO: 157546 - protein, 8 aa, Yellow fever virus
TLECRVQT

SEQ ID NO: 157547 - protein, 8 aa, Yellow fever virus
LECRVQTA

SEQ ID NO: 157548 - protein, 8 aa, Yellow fever virus
ECRVQTAV

SEQ ID NO: 157549 - protein, 8 aa, Yellow fever virus
CRVQTAVD

SEQ ID NO: 157550 - protein, 8 aa, Yellow fever virus
RVQTAVDF

SEQ ID NO: 157551 - protein, 8 aa, Yellow fever virus
SYIAEMEK

SEQ ID NO: 157552 - protein, 8 aa, Yellow fever virus
YIAEMEKE

SEQ ID NO: 157553 - protein, 8 aa, Yellow fever virus
IAEMEKES

SEQ ID NO: 157554 - protein, 8 aa, Yellow fever virus
AEMEKESW

SEQ ID NO: 157555 - protein, 8 aa, Yellow fever virus
EMEKESWI

SEQ ID NO: 157556 - protein, 8 aa, Yellow fever virus
MEKESWIV

SEQ ID NO: 157557 - protein, 8 aa, Yellow fever virus
EKESWIVD

SEQ ID NO: 157558 - protein, 8 aa, Yellow fever virus
KESWIVDR

SEQ ID NO: 157559 - protein, 8 aa, Yellow fever virus
DSWIVDRQ

SEQ ID NO: 157560 - protein, 8 aa, Yellow fever virus
WQSGSGGI

SEQ ID NO: 157561 - protein, 8 aa, Yellow fever virus
QSGSGGIW

SEQ ID NO: 157562 - protein, 8 aa, Yellow fever virus
SGSGGIWR

SEQ ID NO: 157563 - protein, 8 aa, Yellow fever virus
GSGGIWRE

SEQ ID NO: 157564 - protein, 8 aa, Yellow fever virus
SGGIWREM

SEQ ID NO: 157565 - protein, 8 aa, Yellow fever virus
GGIWREMH

SEQ ID NO: 157566 - protein, 8 aa, Yellow fever virus
GIWREMHH

SEQ ID NO: 157567 - protein, 8 aa, Yellow fever virus
IWREMHHL

SEQ ID NO: 157568 - protein, 8 aa, Yellow fever virus
WRGMHHLV

SEQ ID NO: 157569 - protein, 8 aa, Yellow fever virus
RGMHHLVE

SEQ ID NO: 157570 - protein, 8 aa, Yellow fever virus
GMHHLVEF

SEQ ID NO: 157571 - protein, 8 aa, Yellow fever virus
EFEPPHAV

SEQ ID NO: 157572 - protein, 8 aa, Yellow fever virus
FEPPHAVT

SEQ ID NO: 157573 - protein, 8 aa, Yellow fever virus
EPPHAVTI

SEQ ID NO: 157574 - protein, 8 aa, Yellow fever virus
PPHAVTIR

SEQ ID NO: 157575 - protein, 8 aa, Yellow fever virus
PHAVTIRV

SEQ ID NO: 157576 - protein, 8 aa, Yellow fever virus
HAVTIRVL

SEQ ID NO: 157577 - protein, 8 aa, Yellow fever virus
AVTIRVLA

SEQ ID NO: 157578 - protein, 8 aa, Yellow fever virus
VTIRVLAL

SEQ ID NO: 157579 - protein, 8 aa, Yellow fever virus
IRVLALGD

SEQ ID NO: 157580 - protein, 8 aa, Yellow fever virus
RVLALGDQ

SEQ ID NO: 157581 - protein, 8 aa, Yellow fever virus
VLALGDQE

SEQ ID NO: 157582 - protein, 8 aa, Yellow fever virus
LALGDQEG

SEQ ID NO: 157583 - protein, 8 aa, Yellow fever virus
ALGDQEGS

SEQ ID NO: 157584 - protein, 8 aa, Yellow fever virus
LGDQEGSL

SEQ ID NO: 157585 - protein, 8 aa, Yellow fever virus
GDQEGSLK

SEQ ID NO: 157586 - protein, 8 aa, Yellow fever virus
DQEGSLKT

SEQ ID NO: 157587 - protein, 8 aa, Yellow fever virus
AMRVTKDE

SEQ ID NO: 157588 - protein, 8 aa, Yellow fever virus
MRVTKDEN

SEQ ID NO: 157589 - protein, 8 aa, Yellow fever virus
RVTKDEND

SEQ ID NO: 157590 - protein, 8 aa, Yellow fever virus
VTKDENDN

SEQ ID NO: 157591 - protein, 8 aa, Yellow fever virus
TKDENDNN

SEQ ID NO: 157592 - protein, 8 aa, Yellow fever virus
KDENDNNL

SEQ ID NO: 157593 - protein, 8 aa, Yellow fever virus
DENDNNLY

SEQ ID NO: 157594 - protein, 8 aa, Yellow fever virus
ENDNNLYK

SEQ ID NO: 157595 - protein, 8 aa, Yellow fever virus
LKGTSYKM

SEQ ID NO: 157596 - protein, 8 aa, Yellow fever virus
KGTSYKMC

SEQ ID NO: 157597 - protein, 8 aa, Yellow fever virus
GTSYKMCT

SEQ ID NO: 157598 - protein, 8 aa, Yellow fever virus
TSYKMCTD

SEQ ID NO: 157599 - protein, 8 aa, Yellow fever virus
SYKMCTDK

SEQ ID NO: 157600 - protein, 8 aa, Yellow fever virus
YKMCTDKM

SEQ ID NO: 157601 - protein, 8 aa, Yellow fever virus
KMCTDKMS

SEQ ID NO: 157602 - protein, 8 aa, Yellow fever virus
MCTDKMSF

SEQ ID NO: 157603 - protein, 8 aa, Yellow fever virus
CTDKMSFV

SEQ ID NO: 157604 - protein, 8 aa, Yellow fever virus
TDKMSFVK

SEQ ID NO: 157605 - protein, 8 aa, Yellow fever virus
DKMSFVKN

SEQ ID NO: 157606 - protein, 8 aa, Yellow fever virus
KMSFVKNP

SEQ ID NO: 157607 - protein, 8 aa, Yellow fever virus
MSFVKNPT

SEQ ID NO: 157608 - protein, 8 aa, Yellow fever virus
SFVKNPTD

SEQ ID NO: 157609 - protein, 8 aa, Yellow fever virus
VKNPTDTD

SEQ ID NO: 157610 - protein, 8 aa, Yellow fever virus
KNPTDTDH

SEQ ID NO: 157611 - protein, 8 aa, Yellow fever virus
NPTDTDHG

SEQ ID NO: 157612 - protein, 8 aa, Yellow fever virus
PTDTDHGT

SEQ ID NO: 157613 - protein, 8 aa, Yellow fever virus
TDTDHGTV

SEQ ID NO: 157614 - protein, 8 aa, Yellow fever virus
DTDHGTVV

SEQ ID NO: 157615 - protein, 8 aa, Yellow fever virus
TDHGTVVM

SEQ ID NO: 157616 - protein, 8 aa, Yellow fever virus
DHGTVVMQ

SEQ ID NO: 157617 - protein, 8 aa, Yellow fever virus
VVMQVKVS

SEQ ID NO: 157618 - protein, 8 aa, Yellow fever virus
VMQVKVSK

SEQ ID NO: 157619 - protein, 8 aa, Yellow fever virus
MQVKVSKG

SEQ ID NO: 157620 - protein, 8 aa, Yellow fever virus
QVKVSKGA

SEQ ID NO: 157621 - protein, 8 aa, Yellow fever virus
VKVSKGAP

SEQ ID NO: 157622 - protein, 8 aa, Yellow fever virus
KVSKGAPC

SEQ ID NO: 157623 - protein, 8 aa, Yellow fever virus
VPKGAPCK

SEQ ID NO: 157624 - protein, 8 aa, Yellow fever virus
PKGAPCKI

SEQ ID NO: 157625 - protein, 8 aa, Yellow fever virus
KGAPCKIP

SEQ ID NO: 157626 - protein, 8 aa, Yellow fever virus
GAPCKIPV

SEQ ID NO: 157627 - protein, 8 aa, Yellow fever virus
APCKIPVI

SEQ ID NO: 157628 - protein, 8 aa, Yellow fever virus
PCKIPVIV

SEQ ID NO: 157629 - protein, 8 aa, Yellow fever virus
CKIPVIVA

SEQ ID NO: 157630 - protein, 8 aa, Yellow fever virus
KIPVIVAD

SEQ ID NO: 157631 - protein, 8 aa, Yellow fever virus
ADDLTAAV

SEQ ID NO: 157632 - protein, 8 aa, Yellow fever virus
DDLTAAVN

SEQ ID NO: 157633 - protein, 8 aa, Yellow fever virus
DLTAAVNK

SEQ ID NO: 157634 - protein, 8 aa, Yellow fever virus
LTAAVNKG

SEQ ID NO: 157635 - protein, 8 aa, Yellow fever virus
TAAVNKGI

SEQ ID NO: 157636 - protein, 8 aa, Yellow fever virus
AAVNKGIL

SEQ ID NO: 157637 - protein, 8 aa, Yellow fever virus
AVNKGILV

SEQ ID NO: 157638 - protein, 8 aa, Yellow fever virus
VNKGILVT

SEQ ID NO: 157639 - protein, 8 aa, Yellow fever virus
FGDSYIII

SEQ ID NO: 157640 - protein, 8 aa, Yellow fever virus
GDSYIIIG

SEQ ID NO: 157641 - protein, 8 aa, Yellow fever virus
DSYIIVGT

SEQ ID NO: 157642 - protein, 8 aa, Yellow fever virus
SYIIVGTG

SEQ ID NO: 157643 - protein, 8 aa, Yellow fever virus
YIIVGTGD

SEQ ID NO: 157644 - protein, 8 aa, Yellow fever virus
IIVGTGDS

SEQ ID NO: 157645 - protein, 8 aa, Yellow fever virus
IVGTGDSR

SEQ ID NO: 157646 - protein, 8 aa, Yellow fever virus
VGTGDSRL

SEQ ID NO: 157647 - protein, 8 aa, Yellow fever virus
GTGDSRLT

SEQ ID NO: 157648 - protein, 8 aa, Yellow fever virus
TGDSRLTY

SEQ ID NO: 157649 - protein, 8 aa, Yellow fever virus
FTQTMKGA

SEQ ID NO: 157650 - protein, 8 aa, Yellow fever virus
TQTMKGAE

SEQ ID NO: 157651 - protein, 8 aa, Yellow fever virus
QTMKGAER

SEQ ID NO: 157652 - protein, 8 aa, Yellow fever virus
TMKGAERL

SEQ ID NO: 157653 - protein, 8 aa, Yellow fever virus
MKGAERLA

SEQ ID NO: 157654 - protein, 8 aa, Yellow fever virus
KGAERLAV

SEQ ID NO: 157655 - protein, 8 aa, Yellow fever virus
GAERLAVM

SEQ ID NO: 157656 - protein, 8 aa, Yellow fever virus
AERLAVMG

SEQ ID NO: 157657 - protein, 8 aa, Yellow fever virus
RLAVMGDA

SEQ ID NO: 157658 - protein, 8 aa, Yellow fever virus
LAVMGDAA

SEQ ID NO: 157659 - protein, 8 aa, Yellow fever virus
AVMGDAAW

SEQ ID NO: 157660 - protein, 8 aa, Yellow fever virus
VMGDAAWD

SEQ ID NO: 157661 - protein, 8 aa, Yellow fever virus
MGDAAWDF

SEQ ID NO: 157662 - protein, 8 aa, Yellow fever virus
GDAAWDFS

SEQ ID NO: 157663 - protein, 8 aa, Yellow fever virus
DAAWDFSS

SEQ ID NO: 157664 - protein, 8 aa, Yellow fever virus
AAWDFSSA

SEQ ID NO: 157665 - protein, 8 aa, Yellow fever virus
DFSSAGGL

SEQ ID NO: 157666 - protein, 8 aa, Yellow fever virus
FSSAGGFL

SEQ ID NO: 157667 - protein, 8 aa, Yellow fever virus
SSAGGFLT

SEQ ID NO: 157668 - protein, 8 aa, Yellow fever virus
SAGGLFTS

SEQ ID NO: 157669 - protein, 8 aa, Yellow fever virus
AGGLFTSI

SEQ ID NO: 157670 - protein, 8 aa, Yellow fever virus
GGLFTSIG

SEQ ID NO: 157671 - protein, 8 aa, Yellow fever virus
GFLTSVGK

SEQ ID NO: 157672 - protein, 8 aa, Yellow fever virus
LFTSIGKG

SEQ ID NO: 157673 - protein, 8 aa, Yellow fever virus
LTSVGKGI

SEQ ID NO: 157674 - protein, 8 aa, Yellow fever virus
TSIGKGSH

SEQ ID NO: 157675 - protein, 8 aa, Yellow fever virus
SIGKGSHT

SEQ ID NO: 157676 - protein, 8 aa, Yellow fever virus
IGKGSHTV

SEQ ID NO: 157677 - protein, 8 aa, Yellow fever virus
GKGSHTVF

SEQ ID NO: 157678 - protein, 8 aa, Yellow fever virus
KGSHTVFG

SEQ ID NO: 157679 - protein, 8 aa, Yellow fever virus
GSHTVFGS

SEQ ID NO: 157680 - protein, 8 aa, Yellow fever virus
SHTVFGSA

SEQ ID NO: 157681 - protein, 8 aa, Yellow fever virus
QGLFGGLS

SEQ ID NO: 157682 - protein, 8 aa, Yellow fever virus
GLFGGLSW

SEQ ID NO: 157683 - protein, 8 aa, Yellow fever virus
LFGGLSWI

SEQ ID NO: 157684 - protein, 8 aa, Yellow fever virus
FGGLSWIT

SEQ ID NO: 157685 - protein, 8 aa, Yellow fever virus
GGLSWITK

SEQ ID NO: 157686 - protein, 8 aa, Yellow fever virus
GLSWITKV

SEQ ID NO: 157687 - protein, 8 aa, Yellow fever virus
LSWITKVI

SEQ ID NO: 157688 - protein, 8 aa, Yellow fever virus
SWITKVIM

SEQ ID NO: 157689 - protein, 8 aa, Yellow fever virus
WITKVIIG

SEQ ID NO: 157690 - protein, 8 aa, Yellow fever virus
ITKVIMGV

SEQ ID NO: 157691 - protein, 8 aa, Yellow fever virus
TKVIIGAV

SEQ ID NO: 157692 - protein, 8 aa, Yellow fever virus
KVIIGAVL

SEQ ID NO: 157693 - protein, 8 aa, Yellow fever virus
VIMGVVLI

SEQ ID NO: 157694 - protein, 8 aa, Yellow fever virus
IIGAVLIW

SEQ ID NO: 157695 - protein, 8 aa, Yellow fever virus
IGAVLIWV

SEQ ID NO: 157696 - protein, 8 aa, Yellow fever virus
GVVLIWVG

SEQ ID NO: 157697 - protein, 8 aa, Yellow fever virus
VVLIWVGI

SEQ ID NO: 157698 - protein, 8 aa, Yellow fever virus
VLIWVGFN

SEQ ID NO: 157699 - protein, 8 aa, Yellow fever virus
LIWVGFNT

SEQ ID NO: 157700 - protein, 8 aa, Yellow fever virus
IWVGFNTR

SEQ ID NO: 157701 - protein, 8 aa, Yellow fever virus
WVGFNTRN

SEQ ID NO: 157702 - protein, 8 aa, Yellow fever virus
VGFNTRNM

SEQ ID NO: 157703 - protein, 8 aa, Yellow fever virus
GFNTRNMT

SEQ ID NO: 157704 - protein, 8 aa, Yellow fever virus
FNTRNMTM

SEQ ID NO: 157705 - protein, 8 aa, Yellow fever virus
TMSMSMIM

SEQ ID NO: 157706 - protein, 8 aa, Yellow fever virus
MSMSMIMV

SEQ ID NO: 157707 - protein, 8 aa, Yellow fever virus
SMSMIMVG

SEQ ID NO: 157708 - protein, 8 aa, Yellow fever virus
MSMIMVGV

SEQ ID NO: 157709 - protein, 8 aa, Yellow fever virus
SMIMVGVI

SEQ ID NO: 157710 - protein, 8 aa, Yellow fever virus
MIMVGVIM

SEQ ID NO: 157711 - protein, 8 aa, Yellow fever virus
IMVGVIMM

SEQ ID NO: 157712 - protein, 8 aa, Yellow fever virus
MVGVIMMF

SEQ ID NO: 157713 - protein, 8 aa, Yellow fever virus
GADQGCAV

SEQ ID NO: 157714 - protein, 8 aa, Yellow fever virus
ADQGCAVN

SEQ ID NO: 157715 - protein, 8 aa, Yellow fever virus
DQGCAVNF

SEQ ID NO: 157716 - protein, 8 aa, Yellow fever virus
QGCAVNFG

SEQ ID NO: 157717 - protein, 8 aa, Yellow fever virus
GCAVNFGK

SEQ ID NO: 157718 - protein, 8 aa, Yellow fever virus
CAVNFGKR

SEQ ID NO: 157719 - protein, 8 aa, Yellow fever virus
AVNFGKRE

SEQ ID NO: 157720 - protein, 8 aa, Yellow fever virus
VNFGKREL

SEQ ID NO: 157721 - protein, 8 aa, Yellow fever virus
NFAKRELK

SEQ ID NO: 157722 - protein, 8 aa, Yellow fever virus
FAKRELKC

SEQ ID NO: 157723 - protein, 8 aa, Yellow fever virus
AKRELKCG

SEQ ID NO: 157724 - protein, 8 aa, Yellow fever virus
KCGDGIFV

SEQ ID NO: 157725 - protein, 8 aa, Yellow fever virus
CGDGIFVF

SEQ ID NO: 157726 - protein, 8 aa, Yellow fever virus
GDGIFVFR

SEQ ID NO: 157727 - protein, 8 aa, Yellow fever virus
DGIFVFRD

SEQ ID NO: 157728 - protein, 8 aa, Yellow fever virus
GIFVFRDS

SEQ ID NO: 157729 - protein, 8 aa, Yellow fever virus
IFVFRDSD

SEQ ID NO: 157730 - protein, 8 aa, Yellow fever virus
FVFRDSDD

SEQ ID NO: 157731 - protein, 8 aa, Yellow fever virus
VFRDSDDW

SEQ ID NO: 157732 - protein, 8 aa, Yellow fever virus
RDSDDWLT

SEQ ID NO: 157733 - protein, 8 aa, Yellow fever virus
DSDDWLTK

SEQ ID NO: 157734 - protein, 8 aa, Yellow fever virus
SDDWLTKY

SEQ ID NO: 157735 - protein, 8 aa, Yellow fever virus
DDWLTKYS

SEQ ID NO: 157736 - protein, 8 aa, Yellow fever virus
DWLTKYSY

SEQ ID NO: 157737 - protein, 8 aa, Yellow fever virus
WLTKYSYY

SEQ ID NO: 157738 - protein, 8 aa, Yellow fever virus
LTKYSYYP

SEQ ID NO: 157739 - protein, 8 aa, Yellow fever virus
TKYSYYPE

SEQ ID NO: 157740 - protein, 8 aa, Yellow fever virus
PVKLASII

SEQ ID NO: 157741 - protein, 8 aa, Yellow fever virus
VKLASIIK

SEQ ID NO: 157742 - protein, 8 aa, Yellow fever virus
KLASIIKA

SEQ ID NO: 157743 - protein, 8 aa, Yellow fever virus
LASIIKAS

SEQ ID NO: 157744 - protein, 8 aa, Yellow fever virus
ASIIKASH

SEQ ID NO: 157745 - protein, 8 aa, Yellow fever virus
SIIKASHE

SEQ ID NO: 157746 - protein, 8 aa, Yellow fever virus
IIKASHEE

SEQ ID NO: 157747 - protein, 8 aa, Yellow fever virus
IKASHEEG

SEQ ID NO: 157748 - protein, 8 aa, Yellow fever virus
KASHEEGK

SEQ ID NO: 157749 - protein, 8 aa, Yellow fever virus
ASHEEGKC

SEQ ID NO: 157750 - protein, 8 aa, Yellow fever virus
SHEEGKCG

SEQ ID NO: 157751 - protein, 8 aa, Yellow fever virus
HEEGKCGL

SEQ ID NO: 157752 - protein, 8 aa, Yellow fever virus
LNSVDSLD

SEQ ID NO: 157753 - protein, 8 aa, Yellow fever virus
NSVDSLDH

SEQ ID NO: 157754 - protein, 8 aa, Yellow fever virus
SVDSLDHE

SEQ ID NO: 157755 - protein, 8 aa, Yellow fever virus
VDSLDHEM

SEQ ID NO: 157756 - protein, 8 aa, Yellow fever virus
DSLDHEMW

SEQ ID NO: 157757 - protein, 8 aa, Yellow fever virus
SLDHEMWR

SEQ ID NO: 157758 - protein, 8 aa, Yellow fever virus
LDHEMWRS

SEQ ID NO: 157759 - protein, 8 aa, Yellow fever virus
DHEMWRSR

SEQ ID NO: 157760 - protein, 8 aa, Yellow fever virus
ADEINAIL

SEQ ID NO: 157761 - protein, 8 aa, Yellow fever virus
DEINAILE

SEQ ID NO: 157762 - protein, 8 aa, Yellow fever virus
EINAILEE

SEQ ID NO: 157763 - protein, 8 aa, Yellow fever virus
INAILEEN

SEQ ID NO: 157764 - protein, 8 aa, Yellow fever virus
NAILEENE

SEQ ID NO: 157765 - protein, 8 aa, Yellow fever virus
AILEENEV

SEQ ID NO: 157766 - protein, 8 aa, Yellow fever virus
ILEENEVD

SEQ ID NO: 157767 - protein, 8 aa, Yellow fever virus
LEENEVDI

SEQ ID NO: 157768 - protein, 8 aa, Yellow fever virus
ENEVDISI

SEQ ID NO: 157769 - protein, 8 aa, Yellow fever virus
NEVDISIV

SEQ ID NO: 157770 - protein, 8 aa, Yellow fever virus
EVDISIVV

SEQ ID NO: 157771 - protein, 8 aa, Yellow fever virus
VDISIVVQ

SEQ ID NO: 157772 - protein, 8 aa, Yellow fever virus
DISIVVQD

SEQ ID NO: 157773 - protein, 8 aa, Yellow fever virus
ISIVVQDP

SEQ ID NO: 157774 - protein, 8 aa, Yellow fever virus
SIVVQDPK

SEQ ID NO: 157775 - protein, 8 aa, Yellow fever virus
IVVQDPKN

SEQ ID NO: 157776 - protein, 8 aa, Yellow fever virus
VVQDPKNI

SEQ ID NO: 157777 - protein, 8 aa, Yellow fever virus
VQDPKNIY

SEQ ID NO: 157778 - protein, 8 aa, Yellow fever virus
QDPKNIYQ

SEQ ID NO: 157779 - protein, 8 aa, Yellow fever virus
DPKNIYQR

SEQ ID NO: 157780 - protein, 8 aa, Yellow fever virus
PKNIYQRG

SEQ ID NO: 157781 - protein, 8 aa, Yellow fever virus
KNIYQRGT

SEQ ID NO: 157782 - protein, 8 aa, Yellow fever virus
NIYQRGTH

SEQ ID NO: 157783 - protein, 8 aa, Yellow fever virus
IYQRGTHP

SEQ ID NO: 157784 - protein, 8 aa, Yellow fever virus
GWKTWGKS

SEQ ID NO: 157785 - protein, 8 aa, Yellow fever virus
WKTWGKSL

SEQ ID NO: 157786 - protein, 8 aa, Yellow fever virus
KTWGKNLI

SEQ ID NO: 157787 - protein, 8 aa, Yellow fever virus
TWGKNLIF

SEQ ID NO: 157788 - protein, 8 aa, Yellow fever virus
WGKNLIFS

SEQ ID NO: 157789 - protein, 8 aa, Yellow fever virus
GKNLIFSP

SEQ ID NO: 157790 - protein, 8 aa, Yellow fever virus
KNLIFSPG

SEQ ID NO: 157791 - protein, 8 aa, Yellow fever virus
NLIFSPGR

SEQ ID NO: 157792 - protein, 8 aa, Yellow fever virus
LIFSPGRK

SEQ ID NO: 157793 - protein, 8 aa, Yellow fever virus
IFSPGRKN

SEQ ID NO: 157794 - protein, 8 aa, Yellow fever virus
FQIEEFGM

SEQ ID NO: 157795 - protein, 8 aa, Yellow fever virus
QIEEFGMG

SEQ ID NO: 157796 - protein, 8 aa, Yellow fever virus
IEEFGMGV

SEQ ID NO: 157797 - protein, 8 aa, Yellow fever virus
EEFGMGVF

SEQ ID NO: 157798 - protein, 8 aa, Yellow fever virus
EFGMGVFT

SEQ ID NO: 157799 - protein, 8 aa, Yellow fever virus
FGMGVFTT

SEQ ID NO: 157800 - protein, 8 aa, Yellow fever virus
GMGVFTTR

SEQ ID NO: 157801 - protein, 8 aa, Yellow fever virus
MGVFTTRV

SEQ ID NO: 157802 - protein, 8 aa, Yellow fever virus
GVFTTRVF

SEQ ID NO: 157803 - protein, 8 aa, Yellow fever virus
VFTTRVFM

SEQ ID NO: 157804 - protein, 8 aa, Yellow fever virus
FTTRVFMD

SEQ ID NO: 157805 - protein, 8 aa, Yellow fever virus
TTRVFMDA

SEQ ID NO: 157806 - protein, 8 aa, Yellow fever virus
TRVFMDAV

SEQ ID NO: 157807 - protein, 8 aa, Yellow fever virus
RVFMDAVF

SEQ ID NO: 157808 - protein, 8 aa, Yellow fever virus
VFMDAVFD

SEQ ID NO: 157809 - protein, 8 aa, Yellow fever virus
FMDAVFDY

SEQ ID NO: 157810 - protein, 8 aa, Yellow fever virus
MDAVFDYS

SEQ ID NO: 157811 - protein, 8 aa, Yellow fever virus
DAVFDYSV

SEQ ID NO: 157812 - protein, 8 aa, Yellow fever virus
AVFDYSVD

SEQ ID NO: 157813 - protein, 8 aa, Yellow fever virus
VFDYSVDC

SEQ ID NO: 157814 - protein, 8 aa, Yellow fever virus
FDYSVDCD

SEQ ID NO: 157815 - protein, 8 aa, Yellow fever virus
DYSVDCDG

SEQ ID NO: 157816 - protein, 8 aa, Yellow fever virus
YSVDCDGA

SEQ ID NO: 157817 - protein, 8 aa, Yellow fever virus
SVDCDGAI

SEQ ID NO: 157818 - protein, 8 aa, Yellow fever virus
VDCDGAIL

SEQ ID NO: 157819 - protein, 8 aa, Yellow fever virus
DCDGAILG

SEQ ID NO: 157820 - protein, 8 aa, Yellow fever virus
CDGAILGA

SEQ ID NO: 157821 - protein, 8 aa, Yellow fever virus
DGAILGAA

SEQ ID NO: 157822 - protein, 8 aa, Yellow fever virus
GAILGAAV

SEQ ID NO: 157823 - protein, 8 aa, Yellow fever virus
AILGAAVN

SEQ ID NO: 157824 - protein, 8 aa, Yellow fever virus
EVNGTWMV

SEQ ID NO: 157825 - protein, 8 aa, Yellow fever virus
VNGTWMVH

SEQ ID NO: 157826 - protein, 8 aa, Yellow fever virus
NGTWMMHT

SEQ ID NO: 157827 - protein, 8 aa, Yellow fever virus
GTWMVHTL

SEQ ID NO: 157828 - protein, 8 aa, Yellow fever virus
TWMVHTLE

SEQ ID NO: 157829 - protein, 8 aa, Yellow fever virus
WMIHTLET

SEQ ID NO: 157830 - protein, 8 aa, Yellow fever virus
MIHTLETL

SEQ ID NO: 157831 - protein, 8 aa, Yellow fever virus
IHTLETLD

SEQ ID NO: 157832 - protein, 8 aa, Yellow fever virus
HTLETLDY

SEQ ID NO: 157833 - protein, 8 aa, Yellow fever virus
TLETLDYK

SEQ ID NO: 157834 - protein, 8 aa, Yellow fever virus
LETLDYKE

SEQ ID NO: 157835 - protein, 8 aa, Yellow fever virus
ETLDYKEC

SEQ ID NO: 157836 - protein, 8 aa, Yellow fever virus
TLDYKECE

SEQ ID NO: 157837 - protein, 8 aa, Yellow fever virus
YKECEWPP

SEQ ID NO: 157838 - protein, 8 aa, Yellow fever virus
KECEWPPT

SEQ ID NO: 157839 - protein, 8 aa, Yellow fever virus
ECEWPPTH

SEQ ID NO: 157840 - protein, 8 aa, Yellow fever virus
CEWPPTHT

SEQ ID NO: 157841 - protein, 8 aa, Yellow fever virus
EWPPTHTI

SEQ ID NO: 157842 - protein, 8 aa, Yellow fever virus
WPPTHTIG

SEQ ID NO: 157843 - protein, 8 aa, Yellow fever virus
PPTHTIGT

SEQ ID NO: 157844 - protein, 8 aa, Yellow fever virus
PTHTIGTS

SEQ ID NO: 157845 - protein, 8 aa, Yellow fever virus
GTSVEESD

SEQ ID NO: 157846 - protein, 8 aa, Yellow fever virus
TSVEESDM

SEQ ID NO: 157847 - protein, 8 aa, Yellow fever virus
SVEESDMF

SEQ ID NO: 157848 - protein, 8 aa, Yellow fever virus
VEESDMFM

SEQ ID NO: 157849 - protein, 8 aa, Yellow fever virus
EESDMFMP

SEQ ID NO: 157850 - protein, 8 aa, Yellow fever virus
ESDMFMPR

SEQ ID NO: 157851 - protein, 8 aa, Yellow fever virus
SDMFMPRS

SEQ ID NO: 157852 - protein, 8 aa, Yellow fever virus
DMFMPRSI

SEQ ID NO: 157853 - protein, 8 aa, Yellow fever virus
GPVSSHNR

SEQ ID NO: 157854 - protein, 8 aa, Yellow fever virus
PVSSHNRI

SEQ ID NO: 157855 - protein, 8 aa, Yellow fever virus
VSSHNRIP

SEQ ID NO: 157856 - protein, 8 aa, Yellow fever virus
SSHNRIPG

SEQ ID NO: 157857 - protein, 8 aa, Yellow fever virus
SHNRIPGY

SEQ ID NO: 157858 - protein, 8 aa, Yellow fever virus
HNRIPGYK

SEQ ID NO: 157859 - protein, 8 aa, Yellow fever virus
NRIPGYKV

SEQ ID NO: 157860 - protein, 8 aa, Yellow fever virus
RIPGYKVQ

SEQ ID NO: 157861 - protein, 8 aa, Yellow fever virus
MQVPLEVR

SEQ ID NO: 157862 - protein, 8 aa, Yellow fever virus
QVPLEVRR

SEQ ID NO: 157863 - protein, 8 aa, Yellow fever virus
VPLEVRRE

SEQ ID NO: 157864 - protein, 8 aa, Yellow fever virus
PLEVRREA

SEQ ID NO: 157865 - protein, 8 aa, Yellow fever virus
LEVRREPC

SEQ ID NO: 157866 - protein, 8 aa, Yellow fever virus
EVRREPCP

SEQ ID NO: 157867 - protein, 8 aa, Yellow fever virus
VRREACPG

SEQ ID NO: 157868 - protein, 8 aa, Yellow fever virus
RREPCPGT

SEQ ID NO: 157869 - protein, 8 aa, Yellow fever virus
REPCPGTS

SEQ ID NO: 157870 - protein, 8 aa, Yellow fever virus
EPCPGTSV

SEQ ID NO: 157871 - protein, 8 aa, Yellow fever virus
PCPGTSVV

SEQ ID NO: 157872 - protein, 8 aa, Yellow fever virus
CPGTSVVV

SEQ ID NO: 157873 - protein, 8 aa, Yellow fever virus
PGTSVVVD

SEQ ID NO: 157874 - protein, 8 aa, Yellow fever virus
GTSVVVDT

SEQ ID NO: 157875 - protein, 8 aa, Yellow fever virus
TSVVLDTG

SEQ ID NO: 157876 - protein, 8 aa, Yellow fever virus
SVVVDTSC

SEQ ID NO: 157877 - protein, 8 aa, Yellow fever virus
VVLDTGCD

SEQ ID NO: 157878 - protein, 8 aa, Yellow fever virus
VLDTGCDG

SEQ ID NO: 157879 - protein, 8 aa, Yellow fever virus
VDTSCDGR

SEQ ID NO: 157880 - protein, 8 aa, Yellow fever virus
DTGCDGRG

SEQ ID NO: 157881 - protein, 8 aa, Yellow fever virus
TSCDGRGK

SEQ ID NO: 157882 - protein, 8 aa, Yellow fever virus
GCDGRGKS

SEQ ID NO: 157883 - protein, 8 aa, Yellow fever virus
CDGRGKSA

SEQ ID NO: 157884 - protein, 8 aa, Yellow fever virus
DGRGKSAR

SEQ ID NO: 157885 - protein, 8 aa, Yellow fever virus
GRGKSARS

SEQ ID NO: 157886 - protein, 8 aa, Yellow fever virus
RGKSARST

SEQ ID NO: 157887 - protein, 8 aa, Yellow fever virus
GKSARSTT

SEQ ID NO: 157888 - protein, 8 aa, Yellow fever virus
KSARSTTD

SEQ ID NO: 157889 - protein, 8 aa, Yellow fever virus
SARSTTDS

SEQ ID NO: 157890 - protein, 8 aa, Yellow fever virus
ARSTTDSG

SEQ ID NO: 157891 - protein, 8 aa, Yellow fever virus
STTDSGKI

SEQ ID NO: 157892 - protein, 8 aa, Yellow fever virus
TTDSGKII

SEQ ID NO: 157893 - protein, 8 aa, Yellow fever virus
TDSGKIIP

SEQ ID NO: 157894 - protein, 8 aa, Yellow fever virus
DSGKIIPE

SEQ ID NO: 157895 - protein, 8 aa, Yellow fever virus
SGKIIPEW

SEQ ID NO: 157896 - protein, 8 aa, Yellow fever virus
GKIIPEWC

SEQ ID NO: 157897 - protein, 8 aa, Yellow fever virus
KIIPEWCC

SEQ ID NO: 157898 - protein, 8 aa, Yellow fever virus
IIPEWCCR

SEQ ID NO: 157899 - protein, 8 aa, Yellow fever virus
PPVSFHGN

SEQ ID NO: 157900 - protein, 8 aa, Yellow fever virus
PVSFHGND

SEQ ID NO: 157901 - protein, 8 aa, Yellow fever virus
VSFHGNDG

SEQ ID NO: 157902 - protein, 8 aa, Yellow fever virus
SFHGNDGC

SEQ ID NO: 157903 - protein, 8 aa, Yellow fever virus
FHGNDGCW

SEQ ID NO: 157904 - protein, 8 aa, Yellow fever virus
HGNDGCWY

SEQ ID NO: 157905 - protein, 8 aa, Yellow fever virus
GNDGCWYP

SEQ ID NO: 157906 - protein, 8 aa, Yellow fever virus
NDGCWYPM

SEQ ID NO: 157907 - protein, 8 aa, Yellow fever virus
YPMEIRPM

SEQ ID NO: 157908 - protein, 8 aa, Yellow fever virus
PMEIRPMK

SEQ ID NO: 157909 - protein, 8 aa, Yellow fever virus
MEIRPMKT

SEQ ID NO: 157910 - protein, 8 aa, Yellow fever virus
EIRPMKTH

SEQ ID NO: 157911 - protein, 8 aa, Yellow fever virus
IRPMKTHE

SEQ ID NO: 157912 - protein, 8 aa, Yellow fever virus
RPMKTHES

SEQ ID NO: 157913 - protein, 8 aa, Yellow fever virus
PMKTHESH

SEQ ID NO: 157914 - protein, 8 aa, Yellow fever virus
MKTHESHL

SEQ ID NO: 157915 - protein, 8 aa, Yellow fever virus
KAHESHLV

SEQ ID NO: 157916 - protein, 8 aa, Yellow fever virus
AHESHLVR

SEQ ID NO: 157917 - protein, 8 aa, Yellow fever virus
SDSHLVRS

SEQ ID NO: 157918 - protein, 8 aa, Yellow fever virus
DSHLVRSW

SEQ ID NO: 157919 - protein, 8 aa, Yellow fever virus
SWVTAGEV

SEQ ID NO: 157920 - protein, 8 aa, Yellow fever virus
WVTAGEVH

SEQ ID NO: 157921 - protein, 8 aa, Yellow fever virus
VTAGEVHA

SEQ ID NO: 157922 - protein, 8 aa, Yellow fever virus
TAGEVHAV

SEQ ID NO: 157923 - protein, 8 aa, Yellow fever virus
AGEVHAVP

SEQ ID NO: 157924 - protein, 8 aa, Yellow fever virus
GEVHAVPF

SEQ ID NO: 157925 - protein, 8 aa, Yellow fever virus
EVHAVPFG

SEQ ID NO: 157926 - protein, 8 aa, Yellow fever virus
VHAVPFGL

SEQ ID NO: 157927 - protein, 8 aa, Yellow fever virus
LVSMMIAL

SEQ ID NO: 157928 - protein, 8 aa, Yellow fever virus
VSMMIALE

SEQ ID NO: 157929 - protein, 8 aa, Yellow fever virus
SMMIALEV

SEQ ID NO: 157930 - protein, 8 aa, Yellow fever virus
MMIALEVV

SEQ ID NO: 157931 - protein, 8 aa, Yellow fever virus
MIALEVVL

SEQ ID NO: 157932 - protein, 8 aa, Yellow fever virus
IALEVVLR

SEQ ID NO: 157933 - protein, 8 aa, Yellow fever virus
ALEVVLRK

SEQ ID NO: 157934 - protein, 8 aa, Yellow fever virus
MEVVLRRR

SEQ ID NO: 157935 - protein, 8 aa, Yellow fever virus
EVVLRRRQ

SEQ ID NO: 157936 - protein, 8 aa, Yellow fever virus
VVLRRRQG

SEQ ID NO: 157937 - protein, 8 aa, Yellow fever virus
VLRRRQGP

SEQ ID NO: 157938 - protein, 8 aa, Yellow fever virus
LRRRQGPK

SEQ ID NO: 157939 - protein, 8 aa, Yellow fever virus
RRRQGPKQ

SEQ ID NO: 157940 - protein, 8 aa, Yellow fever virus
KRQGPKQV

SEQ ID NO: 157941 - protein, 8 aa, Yellow fever virus
RQGPKQVL

SEQ ID NO: 157942 - protein, 8 aa, Yellow fever virus
QGPKQVLV

SEQ ID NO: 157943 - protein, 8 aa, Yellow fever virus
GPKQVLVG

SEQ ID NO: 157944 - protein, 8 aa, Yellow fever virus
PKQVLVGG

SEQ ID NO: 157945 - protein, 8 aa, Yellow fever virus
KQMLVGGI

SEQ ID NO: 157946 - protein, 8 aa, Yellow fever virus
QMLVGGII

SEQ ID NO: 157947 - protein, 8 aa, Yellow fever virus
MLVGGIIL

SEQ ID NO: 157948 - protein, 8 aa, Yellow fever virus
LVGGIILL

SEQ ID NO: 157949 - protein, 8 aa, Yellow fever virus
VGGIILLG

SEQ ID NO: 157950 - protein, 8 aa, Yellow fever virus
GGIILLGA

SEQ ID NO: 157951 - protein, 8 aa, Yellow fever virus
GIILLGAM

SEQ ID NO: 157952 - protein, 8 aa, Yellow fever virus
IILLGAML

SEQ ID NO: 157953 - protein, 8 aa, Yellow fever virus
ILLGAMLV

SEQ ID NO: 157954 - protein, 8 aa, Yellow fever virus
MLVGQVTV

SEQ ID NO: 157955 - protein, 8 aa, Yellow fever virus
LVGQVTVL

SEQ ID NO: 157956 - protein, 8 aa, Yellow fever virus
VGQVTVLD

SEQ ID NO: 157957 - protein, 8 aa, Yellow fever virus
GQVTVLDL

SEQ ID NO: 157958 - protein, 8 aa, Yellow fever virus
QVTVLDLV

SEQ ID NO: 157959 - protein, 8 aa, Yellow fever virus
VTVLDLVK

SEQ ID NO: 157960 - protein, 8 aa, Yellow fever virus
LIVAVGLH

SEQ ID NO: 157961 - protein, 8 aa, Yellow fever virus
IVAVGLHF

SEQ ID NO: 157962 - protein, 8 aa, Yellow fever virus
MAVGLHFH

SEQ ID NO: 157963 - protein, 8 aa, Yellow fever virus
VGLHFHEI

SEQ ID NO: 157964 - protein, 8 aa, Yellow fever virus
GLHFHEIN

SEQ ID NO: 157965 - protein, 8 aa, Yellow fever virus
LHFHEINN

SEQ ID NO: 157966 - protein, 8 aa, Yellow fever virus
HFHEINNG

SEQ ID NO: 157967 - protein, 8 aa, Yellow fever virus
FHEINNGG

SEQ ID NO: 157968 - protein, 8 aa, Yellow fever virus
HEINNGGD

SEQ ID NO: 157969 - protein, 8 aa, Yellow fever virus
EINNGGDA

SEQ ID NO: 157970 - protein, 8 aa, Yellow fever virus
INNGGDAM

SEQ ID NO: 157971 - protein, 8 aa, Yellow fever virus
MYMALIAS

SEQ ID NO: 157972 - protein, 8 aa, Yellow fever virus
YMALIASF

SEQ ID NO: 157973 - protein, 8 aa, Yellow fever virus
MALIASFS

SEQ ID NO: 157974 - protein, 8 aa, Yellow fever virus
ALIASFSI

SEQ ID NO: 157975 - protein, 8 aa, Yellow fever virus
LIASFSIR

SEQ ID NO: 157976 - protein, 8 aa, Yellow fever virus
IASFSIRP

SEQ ID NO: 157977 - protein, 8 aa, Yellow fever virus
ASFSIRPG

SEQ ID NO: 157978 - protein, 8 aa, Yellow fever virus
SFSIRPGL

SEQ ID NO: 157979 - protein, 8 aa, Yellow fever virus
FSVRPGLL

SEQ ID NO: 157980 - protein, 8 aa, Yellow fever virus
SVRPGLLI

SEQ ID NO: 157981 - protein, 8 aa, Yellow fever virus
VRPGLLIG

SEQ ID NO: 157982 - protein, 8 aa, Yellow fever virus
RPGLLVGF

SEQ ID NO: 157983 - protein, 8 aa, Yellow fever virus
PGLLMGFG

SEQ ID NO: 157984 - protein, 8 aa, Yellow fever virus
GLLVGFGL

SEQ ID NO: 157985 - protein, 8 aa, Yellow fever virus
LLVGFGLR

SEQ ID NO: 157986 - protein, 8 aa, Yellow fever virus
LMGFGLRT

SEQ ID NO: 157987 - protein, 8 aa, Yellow fever virus
MGFGLRTL

SEQ ID NO: 157988 - protein, 8 aa, Yellow fever virus
SPRERLVM

SEQ ID NO: 157989 - protein, 8 aa, Yellow fever virus
PRERLVMA

SEQ ID NO: 157990 - protein, 8 aa, Yellow fever virus
RERLVMAF

SEQ ID NO: 157991 - protein, 8 aa, Yellow fever virus
ERLVMAFG

SEQ ID NO: 157992 - protein, 8 aa, Yellow fever virus
RLVMAFGA

SEQ ID NO: 157993 - protein, 8 aa, Yellow fever virus
LVMAFGAA

SEQ ID NO: 157994 - protein, 8 aa, Yellow fever virus
VMAFGAAM

SEQ ID NO: 157995 - protein, 8 aa, Yellow fever virus
MAFGAAMV

SEQ ID NO: 157996 - protein, 8 aa, Yellow fever virus
AFGAAMVE

SEQ ID NO: 157997 - protein, 8 aa, Yellow fever virus
FGAAMVEV

SEQ ID NO: 157998 - protein, 8 aa, Yellow fever virus
GAAMVEVA

SEQ ID NO: 157999 - protein, 8 aa, Yellow fever virus
AAMVEVAL

SEQ ID NO: 158000 - protein, 8 aa, Yellow fever virus
AMVEVALG

SEQ ID NO: 158001 - protein, 8 aa, Yellow fever virus
MVEVALGG

SEQ ID NO: 158002 - protein, 8 aa, Yellow fever virus
VEIALGGM

SEQ ID NO: 158003 - protein, 8 aa, Yellow fever virus
EIALGGMM

SEQ ID NO: 158004 - protein, 8 aa, Yellow fever virus
IALGGMMG

SEQ ID NO: 158005 - protein, 8 aa, Yellow fever virus
ALGGMMGG

SEQ ID NO: 158006 - protein, 8 aa, Yellow fever virus
LGGMMGGL

SEQ ID NO: 158007 - protein, 8 aa, Yellow fever virus
GGMMGGLW

SEQ ID NO: 158008 - protein, 8 aa, Yellow fever virus
GMMGGLWK

SEQ ID NO: 158009 - protein, 8 aa, Yellow fever virus
MMGGLWKY

SEQ ID NO: 158010 - protein, 8 aa, Yellow fever virus
MGGLWQYL

SEQ ID NO: 158011 - protein, 8 aa, Yellow fever virus
GGLWQYLN

SEQ ID NO: 158012 - protein, 8 aa, Yellow fever virus
GLWQYLNA

SEQ ID NO: 158013 - protein, 8 aa, Yellow fever virus
LWQYLNAV

SEQ ID NO: 158014 - protein, 8 aa, Yellow fever virus
WQYLNAVS

SEQ ID NO: 158015 - protein, 8 aa, Yellow fever virus
QYLNAVSL

SEQ ID NO: 158016 - protein, 8 aa, Yellow fever virus
LNAVSLCV

SEQ ID NO: 158017 - protein, 8 aa, Yellow fever virus
NAVSLCVL

SEQ ID NO: 158018 - protein, 8 aa, Yellow fever virus
AVSLCVLT

SEQ ID NO: 158019 - protein, 8 aa, Yellow fever virus
VSLCVLTI

SEQ ID NO: 158020 - protein, 8 aa, Yellow fever virus
SLCVLTIN

SEQ ID NO: 158021 - protein, 8 aa, Yellow fever virus
LCVLTINA

SEQ ID NO: 158022 - protein, 8 aa, Yellow fever virus
CVLTINAI

SEQ ID NO: 158023 - protein, 8 aa, Yellow fever virus
VLTINAIS

SEQ ID NO: 158024 - protein, 8 aa, Yellow fever virus
LTINAISS

SEQ ID NO: 158025 - protein, 8 aa, Yellow fever virus
TINAISSR

SEQ ID NO: 158026 - protein, 8 aa, Yellow fever virus
INAISSRK

SEQ ID NO: 158027 - protein, 8 aa, Yellow fever virus
NAISSRKA

SEQ ID NO: 158028 - protein, 8 aa, Yellow fever virus
AISSRKAS

SEQ ID NO: 158029 - protein, 8 aa, Yellow fever virus
ISSRKASN

SEQ ID NO: 158030 - protein, 8 aa, Yellow fever virus
SSRKASNM

SEQ ID NO: 158031 - protein, 8 aa, Yellow fever virus
SRKASNMI

SEQ ID NO: 158032 - protein, 8 aa, Yellow fever virus
RKASNMIL

SEQ ID NO: 158033 - protein, 8 aa, Yellow fever virus
KASNAVLP

SEQ ID NO: 158034 - protein, 8 aa, Yellow fever virus
ASNAILPL

SEQ ID NO: 158035 - protein, 8 aa, Yellow fever virus
SNAILPLM

SEQ ID NO: 158036 - protein, 8 aa, Yellow fever virus
NMILPLMA

SEQ ID NO: 158037 - protein, 8 aa, Yellow fever virus
AILPLMAL

SEQ ID NO: 158038 - protein, 8 aa, Yellow fever virus
VLPLMALL

SEQ ID NO: 158039 - protein, 8 aa, Yellow fever virus
LPLMALMT

SEQ ID NO: 158040 - protein, 8 aa, Yellow fever virus
PLMALMTP

SEQ ID NO: 158041 - protein, 8 aa, Yellow fever virus
LMALMTPM

SEQ ID NO: 158042 - protein, 8 aa, Yellow fever virus
MALMTPMT

SEQ ID NO: 158043 - protein, 8 aa, Yellow fever virus
ALMTPMTM

SEQ ID NO: 158044 - protein, 8 aa, Yellow fever virus
LLTPVTMH

SEQ ID NO: 158045 - protein, 8 aa, Yellow fever virus
LTPVTMHE

SEQ ID NO: 158046 - protein, 8 aa, Yellow fever virus
TPVTMHEV

SEQ ID NO: 158047 - protein, 8 aa, Yellow fever virus
PVTMYEVR

SEQ ID NO: 158048 - protein, 8 aa, Yellow fever virus
VTMYEVRM

SEQ ID NO: 158049 - protein, 8 aa, Yellow fever virus
TMHEVRMA

SEQ ID NO: 158050 - protein, 8 aa, Yellow fever virus
MAEVRLAT

SEQ ID NO: 158051 - protein, 8 aa, Yellow fever virus
AEVRLATM

SEQ ID NO: 158052 - protein, 8 aa, Yellow fever virus
EVRLATML

SEQ ID NO: 158053 - protein, 8 aa, Yellow fever virus
VRLAAMLF

SEQ ID NO: 158054 - protein, 8 aa, Yellow fever virus
RLATMLFC

SEQ ID NO: 158055 - protein, 8 aa, Yellow fever virus
ATMLFCTV

SEQ ID NO: 158056 - protein, 8 aa, Yellow fever virus
TMLFCTVV

SEQ ID NO: 158057 - protein, 8 aa, Yellow fever virus
MLFCTVVI

SEQ ID NO: 158058 - protein, 8 aa, Yellow fever virus
LFCTVVII

SEQ ID NO: 158059 - protein, 8 aa, Yellow fever virus
FCTVVIIG

SEQ ID NO: 158060 - protein, 8 aa, Yellow fever virus
CTVVIIGV

SEQ ID NO: 158061 - protein, 8 aa, Yellow fever virus
TVVIIGVL

SEQ ID NO: 158062 - protein, 8 aa, Yellow fever virus
VVIVGVLH

SEQ ID NO: 158063 - protein, 8 aa, Yellow fever virus
VIVGVLHQ

SEQ ID NO: 158064 - protein, 8 aa, Yellow fever virus
IVGVLHQN

SEQ ID NO: 158065 - protein, 8 aa, Yellow fever virus
IGVLHQNS

SEQ ID NO: 158066 - protein, 8 aa, Yellow fever virus
GVLHQNSK

SEQ ID NO: 158067 - protein, 8 aa, Yellow fever virus
VLHQNSKD

SEQ ID NO: 158068 - protein, 8 aa, Yellow fever virus
LHQNSKDT

SEQ ID NO: 158069 - protein, 8 aa, Yellow fever virus
HQNSKDTS

SEQ ID NO: 158070 - protein, 8 aa, Yellow fever virus
QNSKDTSM

SEQ ID NO: 158071 - protein, 8 aa, Yellow fever virus
NSKDTSMQ

SEQ ID NO: 158072 - protein, 8 aa, Yellow fever virus
SKDTSMQK

SEQ ID NO: 158073 - protein, 8 aa, Yellow fever virus
SMQKTIPI

SEQ ID NO: 158074 - protein, 8 aa, Yellow fever virus
MQKTIPIV

SEQ ID NO: 158075 - protein, 8 aa, Yellow fever virus
QKTIPIVA

SEQ ID NO: 158076 - protein, 8 aa, Yellow fever virus
KTIPIVAL

SEQ ID NO: 158077 - protein, 8 aa, Yellow fever virus
TIPIVALT

SEQ ID NO: 158078 - protein, 8 aa, Yellow fever virus
IPIVALTL

SEQ ID NO: 158079 - protein, 8 aa, Yellow fever virus
PIVALTLT

SEQ ID NO: 158080 - protein, 8 aa, Yellow fever virus
IVALTLTS

SEQ ID NO: 158081 - protein, 8 aa, Yellow fever virus
ALTLTSYM

SEQ ID NO: 158082 - protein, 8 aa, Yellow fever virus
LTLTSYMG

SEQ ID NO: 158083 - protein, 8 aa, Yellow fever virus
TLTSYMGL

SEQ ID NO: 158084 - protein, 8 aa, Yellow fever virus
LTSYMGLT

SEQ ID NO: 158085 - protein, 8 aa, Yellow fever virus
TSYMGLTQ

SEQ ID NO: 158086 - protein, 8 aa, Yellow fever virus
SYMGLTQP

SEQ ID NO: 158087 - protein, 8 aa, Yellow fever virus
YMGLTQPF

SEQ ID NO: 158088 - protein, 8 aa, Yellow fever virus
MGLTQPFL

SEQ ID NO: 158089 - protein, 8 aa, Yellow fever virus
PFLGLCAY

SEQ ID NO: 158090 - protein, 8 aa, Yellow fever virus
FLGLCAYM

SEQ ID NO: 158091 - protein, 8 aa, Yellow fever virus
LGLCAYMS

SEQ ID NO: 158092 - protein, 8 aa, Yellow fever virus
GLCAYMST

SEQ ID NO: 158093 - protein, 8 aa, Yellow fever virus
LCAYMSTQ

SEQ ID NO: 158094 - protein, 8 aa, Yellow fever virus
CAYMSTQV

SEQ ID NO: 158095 - protein, 8 aa, Yellow fever virus
AYMSTQVF

SEQ ID NO: 158096 - protein, 8 aa, Yellow fever virus
YMSTQVFG

SEQ ID NO: 158097 - protein, 8 aa, Yellow fever virus
MSTQVFGR

SEQ ID NO: 158098 - protein, 8 aa, Yellow fever virus
STQVFGRR

SEQ ID NO: 158099 - protein, 8 aa, Yellow fever virus
TQVFGRRS

SEQ ID NO: 158100 - protein, 8 aa, Yellow fever virus
QVFGRRSI

SEQ ID NO: 158101 - protein, 8 aa, Yellow fever virus
VFGRRSIP

SEQ ID NO: 158102 - protein, 8 aa, Yellow fever virus
VNEALAAT

SEQ ID NO: 158103 - protein, 8 aa, Yellow fever virus
NEALAATG

SEQ ID NO: 158104 - protein, 8 aa, Yellow fever virus
EALAATGL

SEQ ID NO: 158105 - protein, 8 aa, Yellow fever virus
ALAATGLV

SEQ ID NO: 158106 - protein, 8 aa, Yellow fever virus
LAATGLVG

SEQ ID NO: 158107 - protein, 8 aa, Yellow fever virus
AATGLVGV

SEQ ID NO: 158108 - protein, 8 aa, Yellow fever virus
ATGLVGVL

SEQ ID NO: 158109 - protein, 8 aa, Yellow fever virus
TGLVGVLA

SEQ ID NO: 158110 - protein, 8 aa, Yellow fever virus
LAGLAFQD

SEQ ID NO: 158111 - protein, 8 aa, Yellow fever virus
AGLAFQDM

SEQ ID NO: 158112 - protein, 8 aa, Yellow fever virus
GLAFQDME

SEQ ID NO: 158113 - protein, 8 aa, Yellow fever virus
LAFQDMEN

SEQ ID NO: 158114 - protein, 8 aa, Yellow fever virus
AFQDMENF

SEQ ID NO: 158115 - protein, 8 aa, Yellow fever virus
FQDMENFL

SEQ ID NO: 158116 - protein, 8 aa, Yellow fever virus
QDMENFLG

SEQ ID NO: 158117 - protein, 8 aa, Yellow fever virus
DMENFLGP

SEQ ID NO: 158118 - protein, 8 aa, Yellow fever virus
GPIAVGGI

SEQ ID NO: 158119 - protein, 8 aa, Yellow fever virus
PIAVGGIL

SEQ ID NO: 158120 - protein, 8 aa, Yellow fever virus
IAVGGILM

SEQ ID NO: 158121 - protein, 8 aa, Yellow fever virus
AVGGILMM

SEQ ID NO: 158122 - protein, 8 aa, Yellow fever virus
VGGILMML

SEQ ID NO: 158123 - protein, 8 aa, Yellow fever virus
GGILMMLV

SEQ ID NO: 158124 - protein, 8 aa, Yellow fever virus
GILMMLVS

SEQ ID NO: 158125 - protein, 8 aa, Yellow fever virus
ILMMLVSV

SEQ ID NO: 158126 - protein, 8 aa, Yellow fever virus
MLVSVAGK

SEQ ID NO: 158127 - protein, 8 aa, Yellow fever virus
LVSVAGKV

SEQ ID NO: 158128 - protein, 8 aa, Yellow fever virus
VSVAGKVD

SEQ ID NO: 158129 - protein, 8 aa, Yellow fever virus
SVAGKVDG

SEQ ID NO: 158130 - protein, 8 aa, Yellow fever virus
VAGKVDGL

SEQ ID NO: 158131 - protein, 8 aa, Yellow fever virus
AGKVDGLE

SEQ ID NO: 158132 - protein, 8 aa, Yellow fever virus
GKVDGLEL

SEQ ID NO: 158133 - protein, 8 aa, Yellow fever virus
KVDGLELK

SEQ ID NO: 158134 - protein, 8 aa, Yellow fever virus
VDGLELRK

SEQ ID NO: 158135 - protein, 8 aa, Yellow fever virus
DGLELRKL

SEQ ID NO: 158136 - protein, 8 aa, Yellow fever virus
GLELRKLG

SEQ ID NO: 158137 - protein, 8 aa, Yellow fever virus
LELRKLGE

SEQ ID NO: 158138 - protein, 8 aa, Yellow fever virus
ELRKLGEV

SEQ ID NO: 158139 - protein, 8 aa, Yellow fever virus
LRKLGEVS

SEQ ID NO: 158140 - protein, 8 aa, Yellow fever virus
RKLGEVSW

SEQ ID NO: 158141 - protein, 8 aa, Yellow fever virus
KLGEISWE

SEQ ID NO: 158142 - protein, 8 aa, Yellow fever virus
LGEISWEE

SEQ ID NO: 158143 - protein, 8 aa, Yellow fever virus
GEISWEEE

SEQ ID NO: 158144 - protein, 8 aa, Yellow fever virus
EISWEEEA

SEQ ID NO: 158145 - protein, 8 aa, Yellow fever virus
ISWEEEAE

SEQ ID NO: 158146 - protein, 8 aa, Yellow fever virus
AWEEEAEI

SEQ ID NO: 158147 - protein, 8 aa, Yellow fever virus
AEISGSSS

SEQ ID NO: 158148 - protein, 8 aa, Yellow fever virus
EISGSSSR

SEQ ID NO: 158149 - protein, 8 aa, Yellow fever virus
ISGSSSRY

SEQ ID NO: 158150 - protein, 8 aa, Yellow fever virus
SGSSSRYD

SEQ ID NO: 158151 - protein, 8 aa, Yellow fever virus
GSSSRYDV

SEQ ID NO: 158152 - protein, 8 aa, Yellow fever virus
SSSRYDVA

SEQ ID NO: 158153 - protein, 8 aa, Yellow fever virus
SSRYDVAL

SEQ ID NO: 158154 - protein, 8 aa, Yellow fever virus
SRYDVALS

SEQ ID NO: 158155 - protein, 8 aa, Yellow fever virus
RYDVALNE

SEQ ID NO: 158156 - protein, 8 aa, Yellow fever virus
YDVALNEQ

SEQ ID NO: 158157 - protein, 8 aa, Yellow fever virus
DVALNEQG

SEQ ID NO: 158158 - protein, 8 aa, Yellow fever virus
VALNEQGE

SEQ ID NO: 158159 - protein, 8 aa, Yellow fever virus
ALNEQGEF

SEQ ID NO: 158160 - protein, 8 aa, Yellow fever virus
LNEQGEFK

SEQ ID NO: 158161 - protein, 8 aa, Yellow fever virus
NEQGEFKL

SEQ ID NO: 158162 - protein, 8 aa, Yellow fever virus
EFKLLSED

SEQ ID NO: 158163 - protein, 8 aa, Yellow fever virus
FKLLSEDK

SEQ ID NO: 158164 - protein, 8 aa, Yellow fever virus
KLLSEDKV

SEQ ID NO: 158165 - protein, 8 aa, Yellow fever virus
LLSEDKVP

SEQ ID NO: 158166 - protein, 8 aa, Yellow fever virus
LSEDKVPW

SEQ ID NO: 158167 - protein, 8 aa, Yellow fever virus
SEDKVPWD

SEQ ID NO: 158168 - protein, 8 aa, Yellow fever virus
EDKVPWDQ

SEQ ID NO: 158169 - protein, 8 aa, Yellow fever virus
DKVPWDQI

SEQ ID NO: 158170 - protein, 8 aa, Yellow fever virus
KVPWDQIV

SEQ ID NO: 158171 - protein, 8 aa, Yellow fever virus
VPWDQIVM

SEQ ID NO: 158172 - protein, 8 aa, Yellow fever virus
PWDQIVMT

SEQ ID NO: 158173 - protein, 8 aa, Yellow fever virus
WDQIVMTS

SEQ ID NO: 158174 - protein, 8 aa, Yellow fever virus
DQIVMTSL

SEQ ID NO: 158175 - protein, 8 aa, Yellow fever virus
QIVMTSLA

SEQ ID NO: 158176 - protein, 8 aa, Yellow fever virus
IVMTSLAL

SEQ ID NO: 158177 - protein, 8 aa, Yellow fever virus
LALVGAAI

SEQ ID NO: 158178 - protein, 8 aa, Yellow fever virus
ALVGAAIH

SEQ ID NO: 158179 - protein, 8 aa, Yellow fever virus
LVGAAIHP

SEQ ID NO: 158180 - protein, 8 aa, Yellow fever virus
VGAAIHPF

SEQ ID NO: 158181 - protein, 8 aa, Yellow fever virus
GAAIHPFA

SEQ ID NO: 158182 - protein, 8 aa, Yellow fever virus
AAIHPFAL

SEQ ID NO: 158183 - protein, 8 aa, Yellow fever virus
AIHPFALL

SEQ ID NO: 158184 - protein, 8 aa, Yellow fever virus
IHPFALLL

SEQ ID NO: 158185 - protein, 8 aa, Yellow fever virus
HPSALLLV

SEQ ID NO: 158186 - protein, 8 aa, Yellow fever virus
PSALLLVL

SEQ ID NO: 158187 - protein, 8 aa, Yellow fever virus
FALLLVLG

SEQ ID NO: 158188 - protein, 8 aa, Yellow fever virus
ALLLVLGG

SEQ ID NO: 158189 - protein, 8 aa, Yellow fever virus
LLLVLGGW

SEQ ID NO: 158190 - protein, 8 aa, Yellow fever virus
LLVLGGWV

SEQ ID NO: 158191 - protein, 8 aa, Yellow fever virus
LVLGGWVL

SEQ ID NO: 158192 - protein, 8 aa, Yellow fever virus
VLGGWVLH

SEQ ID NO: 158193 - protein, 8 aa, Yellow fever virus
LGGWVLHI

SEQ ID NO: 158194 - protein, 8 aa, Yellow fever virus
AGWLFHVK

SEQ ID NO: 158195 - protein, 8 aa, Yellow fever virus
GWLFHVKG

SEQ ID NO: 158196 - protein, 8 aa, Yellow fever virus
WLFHVKGA

SEQ ID NO: 158197 - protein, 8 aa, Yellow fever virus
LFHVKGAR

SEQ ID NO: 158198 - protein, 8 aa, Yellow fever virus
LHIKGARR

SEQ ID NO: 158199 - protein, 8 aa, Yellow fever virus
HVKGARRS

SEQ ID NO: 158200 - protein, 8 aa, Yellow fever virus
IKGARRSG

SEQ ID NO: 158201 - protein, 8 aa, Yellow fever virus
KGARRSGD

SEQ ID NO: 158202 - protein, 8 aa, Yellow fever virus
RARRSGDV

SEQ ID NO: 158203 - protein, 8 aa, Yellow fever virus
WDIPTPKV

SEQ ID NO: 158204 - protein, 8 aa, Yellow fever virus
DIPTPKVI

SEQ ID NO: 158205 - protein, 8 aa, Yellow fever virus
IPTPKVIE

SEQ ID NO: 158206 - protein, 8 aa, Yellow fever virus
PTPKVIEE

SEQ ID NO: 158207 - protein, 8 aa, Yellow fever virus
TPKVIEEC

SEQ ID NO: 158208 - protein, 8 aa, Yellow fever virus
PKVIEECE

SEQ ID NO: 158209 - protein, 8 aa, Yellow fever virus
KVIEECEH

SEQ ID NO: 158210 - protein, 8 aa, Yellow fever virus
VIEECEHL

SEQ ID NO: 158211 - protein, 8 aa, Yellow fever virus
IEECEYLE

SEQ ID NO: 158212 - protein, 8 aa, Yellow fever virus
EECEYLED

SEQ ID NO: 158213 - protein, 8 aa, Yellow fever virus
ECEYLEDG

SEQ ID NO: 158214 - protein, 8 aa, Yellow fever virus
CEYLEDGI

SEQ ID NO: 158215 - protein, 8 aa, Yellow fever virus
EHLEDGIS

SEQ ID NO: 158216 - protein, 8 aa, Yellow fever virus
HLEDGISG

SEQ ID NO: 158217 - protein, 8 aa, Yellow fever virus
LEDGISGI

SEQ ID NO: 158218 - protein, 8 aa, Yellow fever virus
EDGISGIF

SEQ ID NO: 158219 - protein, 8 aa, Yellow fever virus
DGISGIFQ

SEQ ID NO: 158220 - protein, 8 aa, Yellow fever virus
GISGIFQS

SEQ ID NO: 158221 - protein, 8 aa, Yellow fever virus
ISGIFQST

SEQ ID NO: 158222 - protein, 8 aa, Yellow fever virus
SGIFQSTF

SEQ ID NO: 158223 - protein, 8 aa, Yellow fever virus
VTRGAFLL

SEQ ID NO: 158224 - protein, 8 aa, Yellow fever virus
TRGAFLLR

SEQ ID NO: 158225 - protein, 8 aa, Yellow fever virus
RGAFLLRN

SEQ ID NO: 158226 - protein, 8 aa, Yellow fever virus
GAFLLRNG

SEQ ID NO: 158227 - protein, 8 aa, Yellow fever virus
AFLLRNGK

SEQ ID NO: 158228 - protein, 8 aa, Yellow fever virus
FLLRNGKK

SEQ ID NO: 158229 - protein, 8 aa, Yellow fever virus
LLRNGKKL

SEQ ID NO: 158230 - protein, 8 aa, Yellow fever virus
LRNGKKLV

SEQ ID NO: 158231 - protein, 8 aa, Yellow fever virus
RNGKKLVP

SEQ ID NO: 158232 - protein, 8 aa, Yellow fever virus
NGKKLVPS

SEQ ID NO: 158233 - protein, 8 aa, Yellow fever virus
GKKLVPSW

SEQ ID NO: 158234 - protein, 8 aa, Yellow fever virus
KKLVPSWA

SEQ ID NO: 158235 - protein, 8 aa, Yellow fever virus
KLVPSWAS

SEQ ID NO: 158236 - protein, 8 aa, Yellow fever virus
LVPSWASV

SEQ ID NO: 158237 - protein, 8 aa, Yellow fever virus
VPSWASVK

SEQ ID NO: 158238 - protein, 8 aa, Yellow fever virus
YGGSWKLD

SEQ ID NO: 158239 - protein, 8 aa, Yellow fever virus
GGSWKLDG

SEQ ID NO: 158240 - protein, 8 aa, Yellow fever virus
GSWKLDGK

SEQ ID NO: 158241 - protein, 8 aa, Yellow fever virus
SWKLDGKW

SEQ ID NO: 158242 - protein, 8 aa, Yellow fever virus
WKLDGKWD

SEQ ID NO: 158243 - protein, 8 aa, Yellow fever virus
KLDGKWDG

SEQ ID NO: 158244 - protein, 8 aa, Yellow fever virus
LDGKWDGE

SEQ ID NO: 158245 - protein, 8 aa, Yellow fever virus
DGKWDGEE

SEQ ID NO: 158246 - protein, 8 aa, Yellow fever virus
GKWDGEEE

SEQ ID NO: 158247 - protein, 8 aa, Yellow fever virus
KWDGEEEV

SEQ ID NO: 158248 - protein, 8 aa, Yellow fever virus
EVQLIAAA

SEQ ID NO: 158249 - protein, 8 aa, Yellow fever virus
VQLIAAAP

SEQ ID NO: 158250 - protein, 8 aa, Yellow fever virus
QLIAAAPG

SEQ ID NO: 158251 - protein, 8 aa, Yellow fever virus
LIAAAPGK

SEQ ID NO: 158252 - protein, 8 aa, Yellow fever virus
IAAVPGKA

SEQ ID NO: 158253 - protein, 8 aa, Yellow fever virus
AAVPGKAV

SEQ ID NO: 158254 - protein, 8 aa, Yellow fever virus
AVPGKAVV

SEQ ID NO: 158255 - protein, 8 aa, Yellow fever virus
VPGKAVVN

SEQ ID NO: 158256 - protein, 8 aa, Yellow fever virus
PGKAVVNV

SEQ ID NO: 158257 - protein, 8 aa, Yellow fever virus
GKAVVNVQ

SEQ ID NO: 158258 - protein, 8 aa, Yellow fever virus
KAVVNVQT

SEQ ID NO: 158259 - protein, 8 aa, Yellow fever virus
AVVNVQTK

SEQ ID NO: 158260 - protein, 8 aa, Yellow fever virus
NVQTKPSV

SEQ ID NO: 158261 - protein, 8 aa, Yellow fever virus
VQTKPSVF

SEQ ID NO: 158262 - protein, 8 aa, Yellow fever virus
QTKPSVFK

SEQ ID NO: 158263 - protein, 8 aa, Yellow fever virus
TKPSLFRV

SEQ ID NO: 158264 - protein, 8 aa, Yellow fever virus
KPSLFRVK

SEQ ID NO: 158265 - protein, 8 aa, Yellow fever virus
PSLFRVKN

SEQ ID NO: 158266 - protein, 8 aa, Yellow fever virus
SVFKVRNG

SEQ ID NO: 158267 - protein, 8 aa, Yellow fever virus
VFKVRNGG

SEQ ID NO: 158268 - protein, 8 aa, Yellow fever virus
FRVKNGGE

SEQ ID NO: 158269 - protein, 8 aa, Yellow fever virus
RVKNGGEI

SEQ ID NO: 158270 - protein, 8 aa, Yellow fever virus
VKNGGEIG

SEQ ID NO: 158271 - protein, 8 aa, Yellow fever virus
KNGGEIGA

SEQ ID NO: 158272 - protein, 8 aa, Yellow fever virus
GSPIVNRS

SEQ ID NO: 158273 - protein, 8 aa, Yellow fever virus
SPIVNRSG

SEQ ID NO: 158274 - protein, 8 aa, Yellow fever virus
PIVNRSGE

SEQ ID NO: 158275 - protein, 8 aa, Yellow fever virus
IVNRSGEV

SEQ ID NO: 158276 - protein, 8 aa, Yellow fever virus
VNRSGEVV

SEQ ID NO: 158277 - protein, 8 aa, Yellow fever virus
NRSGEVVG

SEQ ID NO: 158278 - protein, 8 aa, Yellow fever virus
RSGEVVGL

SEQ ID NO: 158279 - protein, 8 aa, Yellow fever virus
SGEVVGLY

SEQ ID NO: 158280 - protein, 8 aa, Yellow fever virus
GEVVGLYG

SEQ ID NO: 158281 - protein, 8 aa, Yellow fever virus
EVVGLYGN

SEQ ID NO: 158282 - protein, 8 aa, Yellow fever virus
VVGLYGNG

SEQ ID NO: 158283 - protein, 8 aa, Yellow fever virus
VGLYGNGI

SEQ ID NO: 158284 - protein, 8 aa, Yellow fever virus
SAISQTEL

SEQ ID NO: 158285 - protein, 8 aa, Yellow fever virus
AISQTELK

SEQ ID NO: 158286 - protein, 8 aa, Yellow fever virus
ISQTELKE

SEQ ID NO: 158287 - protein, 8 aa, Yellow fever virus
SQTELKEE

SEQ ID NO: 158288 - protein, 8 aa, Yellow fever virus
QTEVKEES

SEQ ID NO: 158289 - protein, 8 aa, Yellow fever virus
TEVKEESK

SEQ ID NO: 158290 - protein, 8 aa, Yellow fever virus
EVKEESKE

SEQ ID NO: 158291 - protein, 8 aa, Yellow fever virus
VKEESKEE

SEQ ID NO: 158292 - protein, 8 aa, Yellow fever virus
KEESKEEL

SEQ ID NO: 158293 - protein, 8 aa, Yellow fever virus
EESKEELQ

SEQ ID NO: 158294 - protein, 8 aa, Yellow fever virus
EGKEELRE

SEQ ID NO: 158295 - protein, 8 aa, Yellow fever virus
GKEELREI

SEQ ID NO: 158296 - protein, 8 aa, Yellow fever virus
KEELREIP

SEQ ID NO: 158297 - protein, 8 aa, Yellow fever virus
EELREIPT

SEQ ID NO: 158298 - protein, 8 aa, Yellow fever virus
ELREIPTM

SEQ ID NO: 158299 - protein, 8 aa, Yellow fever virus
LREIPTML

SEQ ID NO: 158300 - protein, 8 aa, Yellow fever virus
REIPTMLK

SEQ ID NO: 158301 - protein, 8 aa, Yellow fever virus
EISTMLKK

SEQ ID NO: 158302 - protein, 8 aa, Yellow fever virus
ISTMLKKG

SEQ ID NO: 158303 - protein, 8 aa, Yellow fever virus
PTMLKKGK

SEQ ID NO: 158304 - protein, 8 aa, Yellow fever virus
TMLKKGKT

SEQ ID NO: 158305 - protein, 8 aa, Yellow fever virus
MLKKGKTT

SEQ ID NO: 158306 - protein, 8 aa, Yellow fever virus
LKKGMTTV

SEQ ID NO: 158307 - protein, 8 aa, Yellow fever virus
KKGMTTIL

SEQ ID NO: 158308 - protein, 8 aa, Yellow fever virus
KGMTTVLD

SEQ ID NO: 158309 - protein, 8 aa, Yellow fever virus
GMTTILDF

SEQ ID NO: 158310 - protein, 8 aa, Yellow fever virus
MTTILDFH

SEQ ID NO: 158311 - protein, 8 aa, Yellow fever virus
TTVLDFHP

SEQ ID NO: 158312 - protein, 8 aa, Yellow fever virus
TVLDFHPG

SEQ ID NO: 158313 - protein, 8 aa, Yellow fever virus
VLDFHPGA

SEQ ID NO: 158314 - protein, 8 aa, Yellow fever virus
LDYHPGAG

SEQ ID NO: 158315 - protein, 8 aa, Yellow fever virus
DYHPGAGK

SEQ ID NO: 158316 - protein, 8 aa, Yellow fever virus
YHPGAGKT

SEQ ID NO: 158317 - protein, 8 aa, Yellow fever virus
SEMKEAFQ

SEQ ID NO: 158318 - protein, 8 aa, Yellow fever virus
EMKEAFQG

SEQ ID NO: 158319 - protein, 8 aa, Yellow fever virus
MKEAFQGL

SEQ ID NO: 158320 - protein, 8 aa, Yellow fever virus
KEAFQGLD

SEQ ID NO: 158321 - protein, 8 aa, Yellow fever virus
EAFQGLDV

SEQ ID NO: 158322 - protein, 8 aa, Yellow fever virus
AFQGLDVK

SEQ ID NO: 158323 - protein, 8 aa, Yellow fever virus
FQGLDVKF

SEQ ID NO: 158324 - protein, 8 aa, Yellow fever virus
QGLDVKFH

SEQ ID NO: 158325 - protein, 8 aa, Yellow fever virus
FSAHGSGK

SEQ ID NO: 158326 - protein, 8 aa, Yellow fever virus
SAHGSGKE

SEQ ID NO: 158327 - protein, 8 aa, Yellow fever virus
AHGSGKEV

SEQ ID NO: 158328 - protein, 8 aa, Yellow fever virus
HGSGKEVI

SEQ ID NO: 158329 - protein, 8 aa, Yellow fever virus
GSGKEVID

SEQ ID NO: 158330 - protein, 8 aa, Yellow fever virus
SGKEVIDA

SEQ ID NO: 158331 - protein, 8 aa, Yellow fever virus
GKEVIDAM

SEQ ID NO: 158332 - protein, 8 aa, Yellow fever virus
KEVIDAMC

SEQ ID NO: 158333 - protein, 8 aa, Yellow fever virus
EVIDVMCH

SEQ ID NO: 158334 - protein, 8 aa, Yellow fever virus
VIDVMCHA

SEQ ID NO: 158335 - protein, 8 aa, Yellow fever virus
IDVMCHAT

SEQ ID NO: 158336 - protein, 8 aa, Yellow fever virus
DVMCHATL

SEQ ID NO: 158337 - protein, 8 aa, Yellow fever virus
VMCHATLT

SEQ ID NO: 158338 - protein, 8 aa, Yellow fever virus
RMLEPTRI

SEQ ID NO: 158339 - protein, 8 aa, Yellow fever virus
MLEPTRIV

SEQ ID NO: 158340 - protein, 8 aa, Yellow fever virus
LEPTRIVN

SEQ ID NO: 158341 - protein, 8 aa, Yellow fever virus
EPTRIVNW

SEQ ID NO: 158342 - protein, 8 aa, Yellow fever virus
PTRIVNWE

SEQ ID NO: 158343 - protein, 8 aa, Yellow fever virus
TRIVNWEV

SEQ ID NO: 158344 - protein, 8 aa, Yellow fever virus
RIVNWEVI

SEQ ID NO: 158345 - protein, 8 aa, Yellow fever virus
IVNWEVII

SEQ ID NO: 158346 - protein, 8 aa, Yellow fever virus
DIPSEPWT

SEQ ID NO: 158347 - protein, 8 aa, Yellow fever virus
IPSEPWTS

SEQ ID NO: 158348 - protein, 8 aa, Yellow fever virus
PSEPWTSG

SEQ ID NO: 158349 - protein, 8 aa, Yellow fever virus
SEPWTSGH

SEQ ID NO: 158350 - protein, 8 aa, Yellow fever virus
EPWTSGHE

SEQ ID NO: 158351 - protein, 8 aa, Yellow fever virus
PWTSGHEW

SEQ ID NO: 158352 - protein, 8 aa, Yellow fever virus
WTSGHEWI

SEQ ID NO: 158353 - protein, 8 aa, Yellow fever virus
TSGHEWIL

SEQ ID NO: 158354 - protein, 8 aa, Yellow fever virus
SGHEWILA

SEQ ID NO: 158355 - protein, 8 aa, Yellow fever virus
GHEWILAD

SEQ ID NO: 158356 - protein, 8 aa, Yellow fever virus
HEWILADK

SEQ ID NO: 158357 - protein, 8 aa, Yellow fever virus
EWILADKR

SEQ ID NO: 158358 - protein, 8 aa, Yellow fever virus
SLRKAGKN

SEQ ID NO: 158359 - protein, 8 aa, Yellow fever virus
LRKAGKNV

SEQ ID NO: 158360 - protein, 8 aa, Yellow fever virus
RKAGKNVV

SEQ ID NO: 158361 - protein, 8 aa, Yellow fever virus
KAGKNVVV

SEQ ID NO: 158362 - protein, 8 aa, Yellow fever virus
AGKNVVVL

SEQ ID NO: 158363 - protein, 8 aa, Yellow fever virus
GKNVVVLN

SEQ ID NO: 158364 - protein, 8 aa, Yellow fever virus
KNVVVLNR

SEQ ID NO: 158365 - protein, 8 aa, Yellow fever virus
NVVVLNRK

SEQ ID NO: 158366 - protein, 8 aa, Yellow fever virus
LNRKTFEK

SEQ ID NO: 158367 - protein, 8 aa, Yellow fever virus
NRKTFEKE

SEQ ID NO: 158368 - protein, 8 aa, Yellow fever virus
RKTFEKEY

SEQ ID NO: 158369 - protein, 8 aa, Yellow fever virus
KTFEKEYP

SEQ ID NO: 158370 - protein, 8 aa, Yellow fever virus
TFEKEYPT

SEQ ID NO: 158371 - protein, 8 aa, Yellow fever virus
FEKEYPTI

SEQ ID NO: 158372 - protein, 8 aa, Yellow fever virus
EKEYPTIK

SEQ ID NO: 158373 - protein, 8 aa, Yellow fever virus
KEYPTIKQ

SEQ ID NO: 158374 - protein, 8 aa, Yellow fever virus
YPTIKQKR

SEQ ID NO: 158375 - protein, 8 aa, Yellow fever virus
PTIKQKRP

SEQ ID NO: 158376 - protein, 8 aa, Yellow fever virus
TIKQKRPD

SEQ ID NO: 158377 - protein, 8 aa, Yellow fever virus
IKQKRPDF

SEQ ID NO: 158378 - protein, 8 aa, Yellow fever virus
KQKRPDFI

SEQ ID NO: 158379 - protein, 8 aa, Yellow fever virus
QKRPDFIL

SEQ ID NO: 158380 - protein, 8 aa, Yellow fever virus
KRPDFILA

SEQ ID NO: 158381 - protein, 8 aa, Yellow fever virus
RPDFILAT

SEQ ID NO: 158382 - protein, 8 aa, Yellow fever virus
MGANLCVD

SEQ ID NO: 158383 - protein, 8 aa, Yellow fever virus
GANLCVDR

SEQ ID NO: 158384 - protein, 8 aa, Yellow fever virus
ANLCVDRV

SEQ ID NO: 158385 - protein, 8 aa, Yellow fever virus
NLCVDRVL

SEQ ID NO: 158386 - protein, 8 aa, Yellow fever virus
LCVDRVLD

SEQ ID NO: 158387 - protein, 8 aa, Yellow fever virus
CVDRVLDC

SEQ ID NO: 158388 - protein, 8 aa, Yellow fever virus
VDRVLDCR

SEQ ID NO: 158389 - protein, 8 aa, Yellow fever virus
DRVLDCRT

SEQ ID NO: 158390 - protein, 8 aa, Yellow fever virus
VLDCRTAY

SEQ ID NO: 158391 - protein, 8 aa, Yellow fever virus
LDCRTAYK

SEQ ID NO: 158392 - protein, 8 aa, Yellow fever virus
DCRTAYKP

SEQ ID NO: 158393 - protein, 8 aa, Yellow fever virus
CRTAYKPV

SEQ ID NO: 158394 - protein, 8 aa, Yellow fever virus
RTAYKPVL

SEQ ID NO: 158395 - protein, 8 aa, Yellow fever virus
TAYKPVLV

SEQ ID NO: 158396 - protein, 8 aa, Yellow fever virus
AYKPVLVD

SEQ ID NO: 158397 - protein, 8 aa, Yellow fever virus
YKPVLVDE

SEQ ID NO: 158398 - protein, 8 aa, Yellow fever virus
PVLVDEGK

SEQ ID NO: 158399 - protein, 8 aa, Yellow fever virus
VLVDEGKK

SEQ ID NO: 158400 - protein, 8 aa, Yellow fever virus
LVDEGKKV

SEQ ID NO: 158401 - protein, 8 aa, Yellow fever virus
VDEGKKVA

SEQ ID NO: 158402 - protein, 8 aa, Yellow fever virus
DEGKKVAI

SEQ ID NO: 158403 - protein, 8 aa, Yellow fever virus
EGKKVAIK

SEQ ID NO: 158404 - protein, 8 aa, Yellow fever virus
GKKVAIKG

SEQ ID NO: 158405 - protein, 8 aa, Yellow fever virus
KKVAIKGP

SEQ ID NO: 158406 - protein, 8 aa, Yellow fever virus
YSEPTSED

SEQ ID NO: 158407 - protein, 8 aa, Yellow fever virus
SEPTSEDN

SEQ ID NO: 158408 - protein, 8 aa, Yellow fever virus
EPTSEDNA

SEQ ID NO: 158409 - protein, 8 aa, Yellow fever virus
PTSEDNAH

SEQ ID NO: 158410 - protein, 8 aa, Yellow fever virus
TSEDNAHH

SEQ ID NO: 158411 - protein, 8 aa, Yellow fever virus
SEDNAHHV

SEQ ID NO: 158412 - protein, 8 aa, Yellow fever virus
EDNAHHVC

SEQ ID NO: 158413 - protein, 8 aa, Yellow fever virus
DNAHHVCW

SEQ ID NO: 158414 - protein, 8 aa, Yellow fever virus
MVAPLYGI

SEQ ID NO: 158415 - protein, 8 aa, Yellow fever virus
VAPLYGIE

SEQ ID NO: 158416 - protein, 8 aa, Yellow fever virus
APLYGIEG

SEQ ID NO: 158417 - protein, 8 aa, Yellow fever virus
PLYGIEGT

SEQ ID NO: 158418 - protein, 8 aa, Yellow fever virus
LYGIEGTK

SEQ ID NO: 158419 - protein, 8 aa, Yellow fever virus
YGIEGTKT

SEQ ID NO: 158420 - protein, 8 aa, Yellow fever virus
GIEGTKTP

SEQ ID NO: 158421 - protein, 8 aa, Yellow fever virus
IEGTKTPV

SEQ ID NO: 158422 - protein, 8 aa, Yellow fever virus
EGIKTPVS

SEQ ID NO: 158423 - protein, 8 aa, Yellow fever virus
GIKTPVSP

SEQ ID NO: 158424 - protein, 8 aa, Yellow fever virus
IKTPVSPG

SEQ ID NO: 158425 - protein, 8 aa, Yellow fever virus
RLRDDQRR

SEQ ID NO: 158426 - protein, 8 aa, Yellow fever virus
LRDDQRRV

SEQ ID NO: 158427 - protein, 8 aa, Yellow fever virus
RDDQRRVF

SEQ ID NO: 158428 - protein, 8 aa, Yellow fever virus
DDQRRVFR

SEQ ID NO: 158429 - protein, 8 aa, Yellow fever virus
DQRRVFRE

SEQ ID NO: 158430 - protein, 8 aa, Yellow fever virus
QRRVFREL

SEQ ID NO: 158431 - protein, 8 aa, Yellow fever virus
RRVFRELV

SEQ ID NO: 158432 - protein, 8 aa, Yellow fever virus
RVFRELVR

SEQ ID NO: 158433 - protein, 8 aa, Yellow fever virus
VFRELVRG

SEQ ID NO: 158434 - protein, 8 aa, Yellow fever virus
FRELVRGC

SEQ ID NO: 158435 - protein, 8 aa, Yellow fever virus
RELVRGCD

SEQ ID NO: 158436 - protein, 8 aa, Yellow fever virus
ELVRGCDL

SEQ ID NO: 158437 - protein, 8 aa, Yellow fever virus
LVRGCDLP

SEQ ID NO: 158438 - protein, 8 aa, Yellow fever virus
VRGCDLPV

SEQ ID NO: 158439 - protein, 8 aa, Yellow fever virus
RGCDLPVW

SEQ ID NO: 158440 - protein, 8 aa, Yellow fever virus
GCDLPVWL

SEQ ID NO: 158441 - protein, 8 aa, Yellow fever virus
CDQPVWLS

SEQ ID NO: 158442 - protein, 8 aa, Yellow fever virus
DQPVWLSW

SEQ ID NO: 158443 - protein, 8 aa, Yellow fever virus
LPVWLAWQ

SEQ ID NO: 158444 - protein, 8 aa, Yellow fever virus
PVWLAWQV

SEQ ID NO: 158445 - protein, 8 aa, Yellow fever virus
VWLAWQVA

SEQ ID NO: 158446 - protein, 8 aa, Yellow fever virus
WLAWQVAK

SEQ ID NO: 158447 - protein, 8 aa, Yellow fever virus
LSWQVAKP

SEQ ID NO: 158448 - protein, 8 aa, Yellow fever virus
SWQVAKPG

SEQ ID NO: 158449 - protein, 8 aa, Yellow fever virus
WQVAKPGL

SEQ ID NO: 158450 - protein, 8 aa, Yellow fever virus
QVAKPGLK

SEQ ID NO: 158451 - protein, 8 aa, Yellow fever virus
VAKPGLKT

SEQ ID NO: 158452 - protein, 8 aa, Yellow fever virus
AKPGLKTN

SEQ ID NO: 158453 - protein, 8 aa, Yellow fever virus
KPGLKTND

SEQ ID NO: 158454 - protein, 8 aa, Yellow fever virus
PGLKTNDR

SEQ ID NO: 158455 - protein, 8 aa, Yellow fever virus
NDRKWCFD

SEQ ID NO: 158456 - protein, 8 aa, Yellow fever virus
DRKWCFDG

SEQ ID NO: 158457 - protein, 8 aa, Yellow fever virus
RKWCFDGP

SEQ ID NO: 158458 - protein, 8 aa, Yellow fever virus
KWCFDGPK

SEQ ID NO: 158459 - protein, 8 aa, Yellow fever virus
WCFEGPDE

SEQ ID NO: 158460 - protein, 8 aa, Yellow fever virus
CFDGPKEH

SEQ ID NO: 158461 - protein, 8 aa, Yellow fever virus
FDGPKEHE

SEQ ID NO: 158462 - protein, 8 aa, Yellow fever virus
DGPKEHEI

SEQ ID NO: 158463 - protein, 8 aa, Yellow fever virus
GPDEHEIL

SEQ ID NO: 158464 - protein, 8 aa, Yellow fever virus
PKEHEILN

SEQ ID NO: 158465 - protein, 8 aa, Yellow fever virus
KEHEILND

SEQ ID NO: 158466 - protein, 8 aa, Yellow fever virus
EHEILNDN

SEQ ID NO: 158467 - protein, 8 aa, Yellow fever virus
HEILNDNG

SEQ ID NO: 158468 - protein, 8 aa, Yellow fever virus
EILNDNGE

SEQ ID NO: 158469 - protein, 8 aa, Yellow fever virus
ILNDNGET

SEQ ID NO: 158470 - protein, 8 aa, Yellow fever virus
LNDNGETV

SEQ ID NO: 158471 - protein, 8 aa, Yellow fever virus
NDNGETVK

SEQ ID NO: 158472 - protein, 8 aa, Yellow fever virus
DNGETVKC

SEQ ID NO: 158473 - protein, 8 aa, Yellow fever virus
NGETVKCR

SEQ ID NO: 158474 - protein, 8 aa, Yellow fever virus
GETVKCRS

SEQ ID NO: 158475 - protein, 8 aa, Yellow fever virus
ETVKCRSP

SEQ ID NO: 158476 - protein, 8 aa, Yellow fever virus
TVKCRSPG

SEQ ID NO: 158477 - protein, 8 aa, Yellow fever virus
VKCRSPGG

SEQ ID NO: 158478 - protein, 8 aa, Yellow fever virus
KCRSPGGA

SEQ ID NO: 158479 - protein, 8 aa, Yellow fever virus
CRSPGGAK

SEQ ID NO: 158480 - protein, 8 aa, Yellow fever virus
RSPGGAKK

SEQ ID NO: 158481 - protein, 8 aa, Yellow fever virus
SPGGAKKA

SEQ ID NO: 158482 - protein, 8 aa, Yellow fever virus
PGGAKKAL

SEQ ID NO: 158483 - protein, 8 aa, Yellow fever virus
GGAKKALR

SEQ ID NO: 158484 - protein, 8 aa, Yellow fever virus
GAKKALRP

SEQ ID NO: 158485 - protein, 8 aa, Yellow fever virus
AKKALRPR

SEQ ID NO: 158486 - protein, 8 aa, Yellow fever virus
KKALRPRW

SEQ ID NO: 158487 - protein, 8 aa, Yellow fever virus
KALRPRWC

SEQ ID NO: 158488 - protein, 8 aa, Yellow fever virus
ALRPRWCD

SEQ ID NO: 158489 - protein, 8 aa, Yellow fever virus
SSDQSALA

SEQ ID NO: 158490 - protein, 8 aa, Yellow fever virus
SDQSALAD

SEQ ID NO: 158491 - protein, 8 aa, Yellow fever virus
DQSALADF

SEQ ID NO: 158492 - protein, 8 aa, Yellow fever virus
QSALADFI

SEQ ID NO: 158493 - protein, 8 aa, Yellow fever virus
SALADFIK

SEQ ID NO: 158494 - protein, 8 aa, Yellow fever virus
ALADFIKF

SEQ ID NO: 158495 - protein, 8 aa, Yellow fever virus
LADFIKFA

SEQ ID NO: 158496 - protein, 8 aa, Yellow fever virus
ADFIKFAE

SEQ ID NO: 158497 - protein, 8 aa, Yellow fever virus
DFIKFAEG

SEQ ID NO: 158498 - protein, 8 aa, Yellow fever virus
EGRRGAAD

SEQ ID NO: 158499 - protein, 8 aa, Yellow fever virus
GRRGAAEM

SEQ ID NO: 158500 - protein, 8 aa, Yellow fever virus
RRGAAEML

SEQ ID NO: 158501 - protein, 8 aa, Yellow fever virus
RGAAEMLV

SEQ ID NO: 158502 - protein, 8 aa, Yellow fever virus
GAAEMLVV

SEQ ID NO: 158503 - protein, 8 aa, Yellow fever virus
AAEMLVVL

SEQ ID NO: 158504 - protein, 8 aa, Yellow fever virus
AEMLVVLT

SEQ ID NO: 158505 - protein, 8 aa, Yellow fever virus
EMLVVLTE

SEQ ID NO: 158506 - protein, 8 aa, Yellow fever virus
MLVVLTEL

SEQ ID NO: 158507 - protein, 8 aa, Yellow fever virus
LVVLTELP

SEQ ID NO: 158508 - protein, 8 aa, Yellow fever virus
VVLTELPD

SEQ ID NO: 158509 - protein, 8 aa, Yellow fever virus
VLTELPDF

SEQ ID NO: 158510 - protein, 8 aa, Yellow fever virus
LTELPDFL

SEQ ID NO: 158511 - protein, 8 aa, Yellow fever virus
TELPDFLA

SEQ ID NO: 158512 - protein, 8 aa, Yellow fever virus
AMDTISVL

SEQ ID NO: 158513 - protein, 8 aa, Yellow fever virus
MDTISVLL

SEQ ID NO: 158514 - protein, 8 aa, Yellow fever virus
DTISVLLH

SEQ ID NO: 158515 - protein, 8 aa, Yellow fever virus
TISVLLHS

SEQ ID NO: 158516 - protein, 8 aa, Yellow fever virus
ISVLLHSE

SEQ ID NO: 158517 - protein, 8 aa, Yellow fever virus
SVLLHSEE

SEQ ID NO: 158518 - protein, 8 aa, Yellow fever virus
VLLHSEEG

SEQ ID NO: 158519 - protein, 8 aa, Yellow fever virus
LLHSEEGS

SEQ ID NO: 158520 - protein, 8 aa, Yellow fever virus
MPEAMTIA

SEQ ID NO: 158521 - protein, 8 aa, Yellow fever virus
PEAMTIAM

SEQ ID NO: 158522 - protein, 8 aa, Yellow fever virus
EAMTIAML

SEQ ID NO: 158523 - protein, 8 aa, Yellow fever virus
AMTIAMLF

SEQ ID NO: 158524 - protein, 8 aa, Yellow fever virus
MTIVMLFL

SEQ ID NO: 158525 - protein, 8 aa, Yellow fever virus
TIVMLFLL

SEQ ID NO: 158526 - protein, 8 aa, Yellow fever virus
IVMLFLLA

SEQ ID NO: 158527 - protein, 8 aa, Yellow fever virus
VMLFLLAG

SEQ ID NO: 158528 - protein, 8 aa, Yellow fever virus
MLFLLAGL

SEQ ID NO: 158529 - protein, 8 aa, Yellow fever virus
LFLLAGLL

SEQ ID NO: 158530 - protein, 8 aa, Yellow fever virus
FLLAGLLT

SEQ ID NO: 158531 - protein, 8 aa, Yellow fever virus
LLAGLLTS

SEQ ID NO: 158532 - protein, 8 aa, Yellow fever virus
AGLLTSGA

SEQ ID NO: 158533 - protein, 8 aa, Yellow fever virus
GLLTSGAV

SEQ ID NO: 158534 - protein, 8 aa, Yellow fever virus
LLTSGAVI

SEQ ID NO: 158535 - protein, 8 aa, Yellow fever virus
LTSGAVIF

SEQ ID NO: 158536 - protein, 8 aa, Yellow fever virus
TSGAVIFF

SEQ ID NO: 158537 - protein, 8 aa, Yellow fever virus
SGAVIFFM

SEQ ID NO: 158538 - protein, 8 aa, Yellow fever virus
GAVIFFMS

SEQ ID NO: 158539 - protein, 8 aa, Yellow fever virus
AVIFFMSP

SEQ ID NO: 158540 - protein, 8 aa, Yellow fever virus
FFMSPKGM

SEQ ID NO: 158541 - protein, 8 aa, Yellow fever virus
FMSPKGMS

SEQ ID NO: 158542 - protein, 8 aa, Yellow fever virus
MSPKGMSR

SEQ ID NO: 158543 - protein, 8 aa, Yellow fever virus
SPKGMSRM

SEQ ID NO: 158544 - protein, 8 aa, Yellow fever virus
PKGMSRMS

SEQ ID NO: 158545 - protein, 8 aa, Yellow fever virus
KGMSRMSM

SEQ ID NO: 158546 - protein, 8 aa, Yellow fever virus
GMSRMSMA

SEQ ID NO: 158547 - protein, 8 aa, Yellow fever virus
MSRMSMAM

SEQ ID NO: 158548 - protein, 8 aa, Yellow fever virus
SRMSMAKG

SEQ ID NO: 158549 - protein, 8 aa, Yellow fever virus
RMSMAKGT

SEQ ID NO: 158550 - protein, 8 aa, Yellow fever virus
MSMAKGTM

SEQ ID NO: 158551 - protein, 8 aa, Yellow fever virus
SMAKGTMA

SEQ ID NO: 158552 - protein, 8 aa, Yellow fever virus
MAKGTMAG

SEQ ID NO: 158553 - protein, 8 aa, Yellow fever virus
AMGTMAGS

SEQ ID NO: 158554 - protein, 8 aa, Yellow fever virus
MGTMAGSG

SEQ ID NO: 158555 - protein, 8 aa, Yellow fever virus
GTMAGSGY

SEQ ID NO: 158556 - protein, 8 aa, Yellow fever virus
TMAGSGYL

SEQ ID NO: 158557 - protein, 8 aa, Yellow fever virus
MAGSGYLM

SEQ ID NO: 158558 - protein, 8 aa, Yellow fever virus
AGSGYLMF

SEQ ID NO: 158559 - protein, 8 aa, Yellow fever virus
GSGYLMFL

SEQ ID NO: 158560 - protein, 8 aa, Yellow fever virus
SGYLMFLG

SEQ ID NO: 158561 - protein, 8 aa, Yellow fever virus
YLMFLGGA

SEQ ID NO: 158562 - protein, 8 aa, Yellow fever virus
LMFLGGVE

SEQ ID NO: 158563 - protein, 8 aa, Yellow fever virus
MFLGGAKP

SEQ ID NO: 158564 - protein, 8 aa, Yellow fever virus
FLGGAKPT

SEQ ID NO: 158565 - protein, 8 aa, Yellow fever virus
LGGVEPTH

SEQ ID NO: 158566 - protein, 8 aa, Yellow fever virus
GGVEPTHI

SEQ ID NO: 158567 - protein, 8 aa, Yellow fever virus
GAKPTHIS

SEQ ID NO: 158568 - protein, 8 aa, Yellow fever virus
VEPTHISY

SEQ ID NO: 158569 - protein, 8 aa, Yellow fever virus
KPTHISYV

SEQ ID NO: 158570 - protein, 8 aa, Yellow fever virus
PTHISYVM

SEQ ID NO: 158571 - protein, 8 aa, Yellow fever virus
THISYVML

SEQ ID NO: 158572 - protein, 8 aa, Yellow fever virus
HISYVMLI

SEQ ID NO: 158573 - protein, 8 aa, Yellow fever virus
ISYVMLIF

SEQ ID NO: 158574 - protein, 8 aa, Yellow fever virus
SYVMLIFF

SEQ ID NO: 158575 - protein, 8 aa, Yellow fever virus
YVMLIFFV

SEQ ID NO: 158576 - protein, 8 aa, Yellow fever virus
VMLIFFVL

SEQ ID NO: 158577 - protein, 8 aa, Yellow fever virus
FFVLMVVI

SEQ ID NO: 158578 - protein, 8 aa, Yellow fever virus
FVLMVVII

SEQ ID NO: 158579 - protein, 8 aa, Yellow fever virus
VLMVVIIP

SEQ ID NO: 158580 - protein, 8 aa, Yellow fever virus
LMVVIIPE

SEQ ID NO: 158581 - protein, 8 aa, Yellow fever virus
MVVIIPEP

SEQ ID NO: 158582 - protein, 8 aa, Yellow fever virus
VVIIPEPG

SEQ ID NO: 158583 - protein, 8 aa, Yellow fever virus
VIIPEPGQ

SEQ ID NO: 158584 - protein, 8 aa, Yellow fever virus
IIPEPGQQ

SEQ ID NO: 158585 - protein, 8 aa, Yellow fever virus
PEPGQQRT

SEQ ID NO: 158586 - protein, 8 aa, Yellow fever virus
EPGQQRTI

SEQ ID NO: 158587 - protein, 8 aa, Yellow fever virus
PGQQRTIQ

SEQ ID NO: 158588 - protein, 8 aa, Yellow fever virus
GQQRTIQD

SEQ ID NO: 158589 - protein, 8 aa, Yellow fever virus
QQRTIQDN

SEQ ID NO: 158590 - protein, 8 aa, Yellow fever virus
QRTIQDNQ

SEQ ID NO: 158591 - protein, 8 aa, Yellow fever virus
RTIQDNQV

SEQ ID NO: 158592 - protein, 8 aa, Yellow fever virus
TIQDNQVA

SEQ ID NO: 158593 - protein, 8 aa, Yellow fever virus
IQDNQVAF

SEQ ID NO: 158594 - protein, 8 aa, Yellow fever virus
QDNQVAFL

SEQ ID NO: 158595 - protein, 8 aa, Yellow fever virus
DNQVAFLI

SEQ ID NO: 158596 - protein, 8 aa, Yellow fever virus
NQVAFLII

SEQ ID NO: 158597 - protein, 8 aa, Yellow fever virus
QVAFLIIG

SEQ ID NO: 158598 - protein, 8 aa, Yellow fever virus
VAFLIIGI

SEQ ID NO: 158599 - protein, 8 aa, Yellow fever virus
AFLIIGIL

SEQ ID NO: 158600 - protein, 8 aa, Yellow fever virus
FLIIGILT

SEQ ID NO: 158601 - protein, 8 aa, Yellow fever virus
IIGILTLL

SEQ ID NO: 158602 - protein, 8 aa, Yellow fever virus
IGILTLLS

SEQ ID NO: 158603 - protein, 8 aa, Yellow fever virus
GILTLVSV

SEQ ID NO: 158604 - protein, 8 aa, Yellow fever virus
ILTLVSVV

SEQ ID NO: 158605 - protein, 8 aa, Yellow fever virus
LTLVSVVA

SEQ ID NO: 158606 - protein, 8 aa, Yellow fever virus
TLVSVVAA

SEQ ID NO: 158607 - protein, 8 aa, Yellow fever virus
LVSVVAAN

SEQ ID NO: 158608 - protein, 8 aa, Yellow fever virus
VSVVAANE

SEQ ID NO: 158609 - protein, 8 aa, Yellow fever virus
SVVAANEL

SEQ ID NO: 158610 - protein, 8 aa, Yellow fever virus
VVAANELG

SEQ ID NO: 158611 - protein, 8 aa, Yellow fever virus
NELGMLER

SEQ ID NO: 158612 - protein, 8 aa, Yellow fever virus
ELGMLERT

SEQ ID NO: 158613 - protein, 8 aa, Yellow fever virus
LGMLERTK

SEQ ID NO: 158614 - protein, 8 aa, Yellow fever virus
GMLERTKE

SEQ ID NO: 158615 - protein, 8 aa, Yellow fever virus
MLERTKED

SEQ ID NO: 158616 - protein, 8 aa, Yellow fever virus
LEKTKEDF

SEQ ID NO: 158617 - protein, 8 aa, Yellow fever virus
EKTKEDFF

SEQ ID NO: 158618 - protein, 8 aa, Yellow fever virus
KTKEDFFG

SEQ ID NO: 158619 - protein, 8 aa, Yellow fever virus
TKEDFFGK

SEQ ID NO: 158620 - protein, 8 aa, Yellow fever virus
KEDFFGKR

SEQ ID NO: 158621 - protein, 8 aa, Yellow fever virus
EDLFGKKD

SEQ ID NO: 158622 - protein, 8 aa, Yellow fever virus
TSGGTIPW

SEQ ID NO: 158623 - protein, 8 aa, Yellow fever virus
SGGTIPWS

SEQ ID NO: 158624 - protein, 8 aa, Yellow fever virus
GGTIPWSW

SEQ ID NO: 158625 - protein, 8 aa, Yellow fever virus
GTIPWSWP

SEQ ID NO: 158626 - protein, 8 aa, Yellow fever virus
TIPWSWPD

SEQ ID NO: 158627 - protein, 8 aa, Yellow fever virus
IPWSWPDL

SEQ ID NO: 158628 - protein, 8 aa, Yellow fever virus
VYVGIVTI

SEQ ID NO: 158629 - protein, 8 aa, Yellow fever virus
YVGIVTIL

SEQ ID NO: 158630 - protein, 8 aa, Yellow fever virus
VGIVTILS

SEQ ID NO: 158631 - protein, 8 aa, Yellow fever virus
GIVTILSP

SEQ ID NO: 158632 - protein, 8 aa, Yellow fever virus
IVTILSPM

SEQ ID NO: 158633 - protein, 8 aa, Yellow fever virus
VTILSPML

SEQ ID NO: 158634 - protein, 8 aa, Yellow fever virus
TILSPMLH

SEQ ID NO: 158635 - protein, 8 aa, Yellow fever virus
ILSPMLHH

SEQ ID NO: 158636 - protein, 8 aa, Yellow fever virus
LSFMDKGV

SEQ ID NO: 158637 - protein, 8 aa, Yellow fever virus
SFMDKGVP

SEQ ID NO: 158638 - protein, 8 aa, Yellow fever virus
FMDKGVPF

SEQ ID NO: 158639 - protein, 8 aa, Yellow fever virus
MDKGVPFM

SEQ ID NO: 158640 - protein, 8 aa, Yellow fever virus
DKGVPFMK

SEQ ID NO: 158641 - protein, 8 aa, Yellow fever virus
KGVPFMKM

SEQ ID NO: 158642 - protein, 8 aa, Yellow fever virus
GVPFMKMN

SEQ ID NO: 158643 - protein, 8 aa, Yellow fever virus
VPFMKMNI

SEQ ID NO: 158644 - protein, 8 aa, Yellow fever virus
MKMNISVV

SEQ ID NO: 158645 - protein, 8 aa, Yellow fever virus
KMNISVII

SEQ ID NO: 158646 - protein, 8 aa, Yellow fever virus
MNISVIIL

SEQ ID NO: 158647 - protein, 8 aa, Yellow fever virus
NISVIILL

SEQ ID NO: 158648 - protein, 8 aa, Yellow fever virus
ISVIILLV

SEQ ID NO: 158649 - protein, 8 aa, Yellow fever virus
SVIILLVS

SEQ ID NO: 158650 - protein, 8 aa, Yellow fever virus
VIILLVSG

SEQ ID NO: 158651 - protein, 8 aa, Yellow fever virus
IILLVSGW

SEQ ID NO: 158652 - protein, 8 aa, Yellow fever virus
ILLVSGWN

SEQ ID NO: 158653 - protein, 8 aa, Yellow fever virus
LLISGWNS

SEQ ID NO: 158654 - protein, 8 aa, Yellow fever virus
LISGWNSI

SEQ ID NO: 158655 - protein, 8 aa, Yellow fever virus
ISGWNSIT

SEQ ID NO: 158656 - protein, 8 aa, Yellow fever virus
GWNSITVI

SEQ ID NO: 158657 - protein, 8 aa, Yellow fever virus
WNSITVIP

SEQ ID NO: 158658 - protein, 8 aa, Yellow fever virus
NSITVIPL

SEQ ID NO: 158659 - protein, 8 aa, Yellow fever virus
SITVIPLL

SEQ ID NO: 158660 - protein, 8 aa, Yellow fever virus
ITVIPLLC

SEQ ID NO: 158661 - protein, 8 aa, Yellow fever virus
TVIPLLCG

SEQ ID NO: 158662 - protein, 8 aa, Yellow fever virus
VIPLLCGV

SEQ ID NO: 158663 - protein, 8 aa, Yellow fever virus
IPLLCGVG

SEQ ID NO: 158664 - protein, 8 aa, Yellow fever virus
PLLCGVGG

SEQ ID NO: 158665 - protein, 8 aa, Yellow fever virus
LLCGVGGA

SEQ ID NO: 158666 - protein, 8 aa, Yellow fever virus
LCGVGGAM

SEQ ID NO: 158667 - protein, 8 aa, Yellow fever virus
CGVGGAML

SEQ ID NO: 158668 - protein, 8 aa, Yellow fever virus
GVGGAMLH

SEQ ID NO: 158669 - protein, 8 aa, Yellow fever virus
VGGAMLHW

SEQ ID NO: 158670 - protein, 8 aa, Yellow fever virus
GGAMLHWT

SEQ ID NO: 158671 - protein, 8 aa, Yellow fever virus
GAMLHWTL

SEQ ID NO: 158672 - protein, 8 aa, Yellow fever virus
AMLHWTLI

SEQ ID NO: 158673 - protein, 8 aa, Yellow fever virus
MLHWTLIL

SEQ ID NO: 158674 - protein, 8 aa, Yellow fever virus
LHWTLILP

SEQ ID NO: 158675 - protein, 8 aa, Yellow fever virus
HWTLILPG

SEQ ID NO: 158676 - protein, 8 aa, Yellow fever virus
WTLILPGI

SEQ ID NO: 158677 - protein, 8 aa, Yellow fever virus
TLILPGIK

SEQ ID NO: 158678 - protein, 8 aa, Yellow fever virus
KAQQSKLP

SEQ ID NO: 158679 - protein, 8 aa, Yellow fever virus
AQQSKLPQ

SEQ ID NO: 158680 - protein, 8 aa, Yellow fever virus
QQSKLAQK

SEQ ID NO: 158681 - protein, 8 aa, Yellow fever virus
QSKLAQKR

SEQ ID NO: 158682 - protein, 8 aa, Yellow fever virus
SKLAQKRV

SEQ ID NO: 158683 - protein, 8 aa, Yellow fever virus
KLAQKRVF

SEQ ID NO: 158684 - protein, 8 aa, Yellow fever virus
LAQKRVFH

SEQ ID NO: 158685 - protein, 8 aa, Yellow fever virus
AQKRVFHG

SEQ ID NO: 158686 - protein, 8 aa, Yellow fever virus
QKRVFHGV

SEQ ID NO: 158687 - protein, 8 aa, Yellow fever virus
KRVFHGVA

SEQ ID NO: 158688 - protein, 8 aa, Yellow fever virus
RVFHGVAE

SEQ ID NO: 158689 - protein, 8 aa, Yellow fever virus
VFHGVAEN

SEQ ID NO: 158690 - protein, 8 aa, Yellow fever virus
FHGVAENP

SEQ ID NO: 158691 - protein, 8 aa, Yellow fever virus
HGVAENPV

SEQ ID NO: 158692 - protein, 8 aa, Yellow fever virus
GVAENPVV

SEQ ID NO: 158693 - protein, 8 aa, Yellow fever virus
VAENPVVD

SEQ ID NO: 158694 - protein, 8 aa, Yellow fever virus
AENPVVDG

SEQ ID NO: 158695 - protein, 8 aa, Yellow fever virus
ENPVVDGN

SEQ ID NO: 158696 - protein, 8 aa, Yellow fever virus
VVDGNPTA

SEQ ID NO: 158697 - protein, 8 aa, Yellow fever virus
VDGNPTAD

SEQ ID NO: 158698 - protein, 8 aa, Yellow fever virus
DGNPTADI

SEQ ID NO: 158699 - protein, 8 aa, Yellow fever virus
GNPTADIE

SEQ ID NO: 158700 - protein, 8 aa, Yellow fever virus
NPTADIEE

SEQ ID NO: 158701 - protein, 8 aa, Yellow fever virus
PTADIEEA

SEQ ID NO: 158702 - protein, 8 aa, Yellow fever virus
TADIEEAP

SEQ ID NO: 158703 - protein, 8 aa, Yellow fever virus
ADIEEAPE

SEQ ID NO: 158704 - protein, 8 aa, Yellow fever virus
EEAPEMPV

SEQ ID NO: 158705 - protein, 8 aa, Yellow fever virus
EAPEMPVL

SEQ ID NO: 158706 - protein, 8 aa, Yellow fever virus
APEMPVLY

SEQ ID NO: 158707 - protein, 8 aa, Yellow fever virus
PEMPVLYE

SEQ ID NO: 158708 - protein, 8 aa, Yellow fever virus
EMPVLYEK

SEQ ID NO: 158709 - protein, 8 aa, Yellow fever virus
MPVLYEKK

SEQ ID NO: 158710 - protein, 8 aa, Yellow fever virus
PVLYEKKL

SEQ ID NO: 158711 - protein, 8 aa, Yellow fever virus
VLYEKKLA

SEQ ID NO: 158712 - protein, 8 aa, Yellow fever virus
LLLALSLM

SEQ ID NO: 158713 - protein, 8 aa, Yellow fever virus
LLALSLMS

SEQ ID NO: 158714 - protein, 8 aa, Yellow fever virus
LALSLMSV

SEQ ID NO: 158715 - protein, 8 aa, Yellow fever virus
ALSLMSVA

SEQ ID NO: 158716 - protein, 8 aa, Yellow fever virus
LSLMSVAM

SEQ ID NO: 158717 - protein, 8 aa, Yellow fever virus
SLMSVAMC

SEQ ID NO: 158718 - protein, 8 aa, Yellow fever virus
LMSVAMCR

SEQ ID NO: 158719 - protein, 8 aa, Yellow fever virus
MSVAMCRT

SEQ ID NO: 158720 - protein, 8 aa, Yellow fever virus
CRTPFSLD

SEQ ID NO: 158721 - protein, 8 aa, Yellow fever virus
RTPFSLDE

SEQ ID NO: 158722 - protein, 8 aa, Yellow fever virus
TPFSLDEG

SEQ ID NO: 158723 - protein, 8 aa, Yellow fever virus
PFSLDEGI

SEQ ID NO: 158724 - protein, 8 aa, Yellow fever virus
FSLDEGIV

SEQ ID NO: 158725 - protein, 8 aa, Yellow fever virus
SLDEGIVL

SEQ ID NO: 158726 - protein, 8 aa, Yellow fever virus
LAEGIVLS

SEQ ID NO: 158727 - protein, 8 aa, Yellow fever virus
AEGIVLSS

SEQ ID NO: 158728 - protein, 8 aa, Yellow fever virus
EGIVLSSA

SEQ ID NO: 158729 - protein, 8 aa, Yellow fever virus
GIVLSSAA

SEQ ID NO: 158730 - protein, 8 aa, Yellow fever virus
IVLASAAS

SEQ ID NO: 158731 - protein, 8 aa, Yellow fever virus
VLASAASG

SEQ ID NO: 158732 - protein, 8 aa, Yellow fever virus
LASAASGP

SEQ ID NO: 158733 - protein, 8 aa, Yellow fever virus
ASAASGPL

SEQ ID NO: 158734 - protein, 8 aa, Yellow fever virus
SAASGPLI

SEQ ID NO: 158735 - protein, 8 aa, Yellow fever virus
AASGPLIE

SEQ ID NO: 158736 - protein, 8 aa, Yellow fever virus
ASGPLIEG

SEQ ID NO: 158737 - protein, 8 aa, Yellow fever virus
SGPLIEGN

SEQ ID NO: 158738 - protein, 8 aa, Yellow fever virus
TGVMRGNY

SEQ ID NO: 158739 - protein, 8 aa, Yellow fever virus
GVMRGNYY

SEQ ID NO: 158740 - protein, 8 aa, Yellow fever virus
VMRGNYYA

SEQ ID NO: 158741 - protein, 8 aa, Yellow fever virus
MRGNYYAF

SEQ ID NO: 158742 - protein, 8 aa, Yellow fever virus
RGNYYAFV

SEQ ID NO: 158743 - protein, 8 aa, Yellow fever virus
GNYYAFVG

SEQ ID NO: 158744 - protein, 8 aa, Yellow fever virus
NYYAFVGV

SEQ ID NO: 158745 - protein, 8 aa, Yellow fever virus
YYAFVGVM

SEQ ID NO: 158746 - protein, 8 aa, Yellow fever virus
YAFVGVAY

SEQ ID NO: 158747 - protein, 8 aa, Yellow fever virus
AFVGVAYN

SEQ ID NO: 158748 - protein, 8 aa, Yellow fever virus
FVGVAYNL

SEQ ID NO: 158749 - protein, 8 aa, Yellow fever virus
VGVAYNLW

SEQ ID NO: 158750 - protein, 8 aa, Yellow fever virus
GVAYNLWK

SEQ ID NO: 158751 - protein, 8 aa, Yellow fever virus
VAYNLWKM

SEQ ID NO: 158752 - protein, 8 aa, Yellow fever virus
MYNLWKME

SEQ ID NO: 158753 - protein, 8 aa, Yellow fever virus
YNLWKMET

SEQ ID NO: 158754 - protein, 8 aa, Yellow fever virus
NLWKMETG

SEQ ID NO: 158755 - protein, 8 aa, Yellow fever virus
LWKMETGR

SEQ ID NO: 158756 - protein, 8 aa, Yellow fever virus
WKMETGRR

SEQ ID NO: 158757 - protein, 8 aa, Yellow fever virus
KMETGRRG

SEQ ID NO: 158758 - protein, 8 aa, Yellow fever virus
RRGRANGK

SEQ ID NO: 158759 - protein, 8 aa, Yellow fever virus
RGRANGKT

SEQ ID NO: 158760 - protein, 8 aa, Yellow fever virus
GRANGKTL

SEQ ID NO: 158761 - protein, 8 aa, Yellow fever virus
RANGKTLG

SEQ ID NO: 158762 - protein, 8 aa, Yellow fever virus
ASGKTLGE

SEQ ID NO: 158763 - protein, 8 aa, Yellow fever virus
SGKTLGEV

SEQ ID NO: 158764 - protein, 8 aa, Yellow fever virus
RELNLLDR

SEQ ID NO: 158765 - protein, 8 aa, Yellow fever virus
ELNLLDKR

SEQ ID NO: 158766 - protein, 8 aa, Yellow fever virus
LNLLDKRQ

SEQ ID NO: 158767 - protein, 8 aa, Yellow fever virus
NLLDKRQF

SEQ ID NO: 158768 - protein, 8 aa, Yellow fever virus
LLDKRQFE

SEQ ID NO: 158769 - protein, 8 aa, Yellow fever virus
LDKQQFEL

SEQ ID NO: 158770 - protein, 8 aa, Yellow fever virus
DKRQFELY

SEQ ID NO: 158771 - protein, 8 aa, Yellow fever virus
KQQFELYK

SEQ ID NO: 158772 - protein, 8 aa, Yellow fever virus
RQFELYKR

SEQ ID NO: 158773 - protein, 8 aa, Yellow fever virus
QFEMYKRT

SEQ ID NO: 158774 - protein, 8 aa, Yellow fever virus
FEMYKRTD

SEQ ID NO: 158775 - protein, 8 aa, Yellow fever virus
EMYKRTDI

SEQ ID NO: 158776 - protein, 8 aa, Yellow fever virus
LYKRTDIT

SEQ ID NO: 158777 - protein, 8 aa, Yellow fever virus
YKRTDITE

SEQ ID NO: 158778 - protein, 8 aa, Yellow fever virus
KRTDITEV

SEQ ID NO: 158779 - protein, 8 aa, Yellow fever virus
RTDITEVD

SEQ ID NO: 158780 - protein, 8 aa, Yellow fever virus
TDITEVDR

SEQ ID NO: 158781 - protein, 8 aa, Yellow fever virus
DITEVDRD

SEQ ID NO: 158782 - protein, 8 aa, Yellow fever virus
ITEVDRDM

SEQ ID NO: 158783 - protein, 8 aa, Yellow fever virus
TEVDRDMA

SEQ ID NO: 158784 - protein, 8 aa, Yellow fever virus
EVDRDMAR

SEQ ID NO: 158785 - protein, 8 aa, Yellow fever virus
VDRDMARR

SEQ ID NO: 158786 - protein, 8 aa, Yellow fever virus
DRDMARRH

SEQ ID NO: 158787 - protein, 8 aa, Yellow fever virus
RDMARRHL

SEQ ID NO: 158788 - protein, 8 aa, Yellow fever virus
DMARRHLA

SEQ ID NO: 158789 - protein, 8 aa, Yellow fever virus
MARRHLAE

SEQ ID NO: 158790 - protein, 8 aa, Yellow fever virus
VKLEGRVT

SEQ ID NO: 158791 - protein, 8 aa, Yellow fever virus
KLEGRVTD

SEQ ID NO: 158792 - protein, 8 aa, Yellow fever virus
LEGRVTDL

SEQ ID NO: 158793 - protein, 8 aa, Yellow fever virus
EGRVTDLG

SEQ ID NO: 158794 - protein, 8 aa, Yellow fever virus
GRVTDLGC

SEQ ID NO: 158795 - protein, 8 aa, Yellow fever virus
RVTDLGCG

SEQ ID NO: 158796 - protein, 8 aa, Yellow fever virus
VTDLGCGR

SEQ ID NO: 158797 - protein, 8 aa, Yellow fever virus
TDLGCGRG

SEQ ID NO: 158798 - protein, 8 aa, Yellow fever virus
EVSGVKGY

SEQ ID NO: 158799 - protein, 8 aa, Yellow fever virus
VSGVKGYT

SEQ ID NO: 158800 - protein, 8 aa, Yellow fever virus
SGVKGYTL

SEQ ID NO: 158801 - protein, 8 aa, Yellow fever virus
GVKGYTLG

SEQ ID NO: 158802 - protein, 8 aa, Yellow fever virus
VKGYTLGR

SEQ ID NO: 158803 - protein, 8 aa, Yellow fever virus
KGYTLGRD

SEQ ID NO: 158804 - protein, 8 aa, Yellow fever virus
GYTLGRDG

SEQ ID NO: 158805 - protein, 8 aa, Yellow fever virus
YTLGRDGH

SEQ ID NO: 158806 - protein, 8 aa, Yellow fever virus
TLGREGHE

SEQ ID NO: 158807 - protein, 8 aa, Yellow fever virus
LGREGHEK

SEQ ID NO: 158808 - protein, 8 aa, Yellow fever virus
GREGHEKP

SEQ ID NO: 158809 - protein, 8 aa, Yellow fever virus
REGHEKPM

SEQ ID NO: 158810 - protein, 8 aa, Yellow fever virus
EGHEKPMN

SEQ ID NO: 158811 - protein, 8 aa, Yellow fever virus
HEKPMNVR

SEQ ID NO: 158812 - protein, 8 aa, Yellow fever virus
EKPMNVRS

SEQ ID NO: 158813 - protein, 8 aa, Yellow fever virus
KPMNVRSL

SEQ ID NO: 158814 - protein, 8 aa, Yellow fever virus
PMNVRSLG

SEQ ID NO: 158815 - protein, 8 aa, Yellow fever virus
MNVRSLGW

SEQ ID NO: 158816 - protein, 8 aa, Yellow fever virus
NVRSLGWN

SEQ ID NO: 158817 - protein, 8 aa, Yellow fever virus
VRSLGWNI

SEQ ID NO: 158818 - protein, 8 aa, Yellow fever virus
QSLGWNIV

SEQ ID NO: 158819 - protein, 8 aa, Yellow fever virus
SLGWNIVT

SEQ ID NO: 158820 - protein, 8 aa, Yellow fever virus
LGWNIVTF

SEQ ID NO: 158821 - protein, 8 aa, Yellow fever virus
GWNIVTFK

SEQ ID NO: 158822 - protein, 8 aa, Yellow fever virus
WNIVTFKD

SEQ ID NO: 158823 - protein, 8 aa, Yellow fever virus
NIVTFKDK

SEQ ID NO: 158824 - protein, 8 aa, Yellow fever virus
IVTFKDKT

SEQ ID NO: 158825 - protein, 8 aa, Yellow fever virus
VTFKDKTD

SEQ ID NO: 158826 - protein, 8 aa, Yellow fever virus
TFKDKTDV

SEQ ID NO: 158827 - protein, 8 aa, Yellow fever virus
FKDKTDVH

SEQ ID NO: 158828 - protein, 8 aa, Yellow fever virus
KDKTDIHH

SEQ ID NO: 158829 - protein, 8 aa, Yellow fever virus
DKTDVHRL

SEQ ID NO: 158830 - protein, 8 aa, Yellow fever virus
KTDIHHLE

SEQ ID NO: 158831 - protein, 8 aa, Yellow fever virus
TDVHRLEP

SEQ ID NO: 158832 - protein, 8 aa, Yellow fever virus
LEPAKCET

SEQ ID NO: 158833 - protein, 8 aa, Yellow fever virus
EPAKCETL

SEQ ID NO: 158834 - protein, 8 aa, Yellow fever virus
PAKCETLL

SEQ ID NO: 158835 - protein, 8 aa, Yellow fever virus
AKCETLLC

SEQ ID NO: 158836 - protein, 8 aa, Yellow fever virus
KCETLLCD

SEQ ID NO: 158837 - protein, 8 aa, Yellow fever virus
CETLLCDI

SEQ ID NO: 158838 - protein, 8 aa, Yellow fever virus
ETLLCDIG

SEQ ID NO: 158839 - protein, 8 aa, Yellow fever virus
CDIGESSP

SEQ ID NO: 158840 - protein, 8 aa, Yellow fever virus
DIGESSPS

SEQ ID NO: 158841 - protein, 8 aa, Yellow fever virus
IGESSPSS

SEQ ID NO: 158842 - protein, 8 aa, Yellow fever virus
GESSPSSV

SEQ ID NO: 158843 - protein, 8 aa, Yellow fever virus
ESSPSSVT

SEQ ID NO: 158844 - protein, 8 aa, Yellow fever virus
SSPSSVTE

SEQ ID NO: 158845 - protein, 8 aa, Yellow fever virus
SPSSVTEG

SEQ ID NO: 158846 - protein, 8 aa, Yellow fever virus
PSSVTEGE

SEQ ID NO: 158847 - protein, 8 aa, Yellow fever virus
SSITEGER

SEQ ID NO: 158848 - protein, 8 aa, Yellow fever virus
SITEGERT

SEQ ID NO: 158849 - protein, 8 aa, Yellow fever virus
VTEGERTM

SEQ ID NO: 158850 - protein, 8 aa, Yellow fever virus
TEGERTMR

SEQ ID NO: 158851 - protein, 8 aa, Yellow fever virus
EGERTMRV

SEQ ID NO: 158852 - protein, 8 aa, Yellow fever virus
GERTMRVL

SEQ ID NO: 158853 - protein, 8 aa, Yellow fever virus
ERTMRVLD

SEQ ID NO: 158854 - protein, 8 aa, Yellow fever virus
RTMRVLDT

SEQ ID NO: 158855 - protein, 8 aa, Yellow fever virus
TMRVLDTV

SEQ ID NO: 158856 - protein, 8 aa, Yellow fever virus
MRVLDTVE

SEQ ID NO: 158857 - protein, 8 aa, Yellow fever virus
RVLETIEK

SEQ ID NO: 158858 - protein, 8 aa, Yellow fever virus
VLETIEKW

SEQ ID NO: 158859 - protein, 8 aa, Yellow fever virus
LETVEKWL

SEQ ID NO: 158860 - protein, 8 aa, Yellow fever virus
ETIEKWLA

SEQ ID NO: 158861 - protein, 8 aa, Yellow fever virus
TIEKWLAC

SEQ ID NO: 158862 - protein, 8 aa, Yellow fever virus
IEKWLACG

SEQ ID NO: 158863 - protein, 8 aa, Yellow fever virus
CGVDNFCI

SEQ ID NO: 158864 - protein, 8 aa, Yellow fever virus
GVDNFCIK

SEQ ID NO: 158865 - protein, 8 aa, Yellow fever virus
VDNFCIKV

SEQ ID NO: 158866 - protein, 8 aa, Yellow fever virus
DNFCIKVL

SEQ ID NO: 158867 - protein, 8 aa, Yellow fever virus
NFCIKVLA

SEQ ID NO: 158868 - protein, 8 aa, Yellow fever virus
FCIKVLAP

SEQ ID NO: 158869 - protein, 8 aa, Yellow fever virus
CIKVLAPY

SEQ ID NO: 158870 - protein, 8 aa, Yellow fever virus
IKVLAPYM

SEQ ID NO: 158871 - protein, 8 aa, Yellow fever virus
KVLAPYMR

SEQ ID NO: 158872 - protein, 8 aa, Yellow fever virus
VLAPYMRD

SEQ ID NO: 158873 - protein, 8 aa, Yellow fever virus
LAPYMRDV

SEQ ID NO: 158874 - protein, 8 aa, Yellow fever virus
APYMPDVI

SEQ ID NO: 158875 - protein, 8 aa, Yellow fever virus
PYMPDVIE

SEQ ID NO: 158876 - protein, 8 aa, Yellow fever virus
YMPDVIEK

SEQ ID NO: 158877 - protein, 8 aa, Yellow fever virus
MPDVIEKL

SEQ ID NO: 158878 - protein, 8 aa, Yellow fever virus
PDVIEKLE

SEQ ID NO: 158879 - protein, 8 aa, Yellow fever virus
DVIEKLEL

SEQ ID NO: 158880 - protein, 8 aa, Yellow fever virus
VIEKLELL

SEQ ID NO: 158881 - protein, 8 aa, Yellow fever virus
IEKLELLQ

SEQ ID NO: 158882 - protein, 8 aa, Yellow fever virus
QRRFGGTI

SEQ ID NO: 158883 - protein, 8 aa, Yellow fever virus
RRFGGTII

SEQ ID NO: 158884 - protein, 8 aa, Yellow fever virus
RFGGTIIR

SEQ ID NO: 158885 - protein, 8 aa, Yellow fever virus
FGGTIIRN

SEQ ID NO: 158886 - protein, 8 aa, Yellow fever virus
GGTIIRNP

SEQ ID NO: 158887 - protein, 8 aa, Yellow fever virus
GTIIRNPL

SEQ ID NO: 158888 - protein, 8 aa, Yellow fever virus
TIIRNPLS

SEQ ID NO: 158889 - protein, 8 aa, Yellow fever virus
IIRNPLSR

SEQ ID NO: 158890 - protein, 8 aa, Yellow fever virus
VSGARSNI

SEQ ID NO: 158891 - protein, 8 aa, Yellow fever virus
SGARSNIT

SEQ ID NO: 158892 - protein, 8 aa, Yellow fever virus
GARSNITF

SEQ ID NO: 158893 - protein, 8 aa, Yellow fever virus
ARSNITFT

SEQ ID NO: 158894 - protein, 8 aa, Yellow fever virus
RSNITFTV

SEQ ID NO: 158895 - protein, 8 aa, Yellow fever virus
SNITFTVN

SEQ ID NO: 158896 - protein, 8 aa, Yellow fever virus
NITFTVNQ

SEQ ID NO: 158897 - protein, 8 aa, Yellow fever virus
ITFTVNQT

SEQ ID NO: 158898 - protein, 8 aa, Yellow fever virus
TGKVTLEP

SEQ ID NO: 158899 - protein, 8 aa, Yellow fever virus
GKVTLEPD

SEQ ID NO: 158900 - protein, 8 aa, Yellow fever virus
KVTLEPDV

SEQ ID NO: 158901 - protein, 8 aa, Yellow fever virus
VTLEADVT

SEQ ID NO: 158902 - protein, 8 aa, Yellow fever virus
TLEADVTL

SEQ ID NO: 158903 - protein, 8 aa, Yellow fever virus
LEPDVILP

SEQ ID NO: 158904 - protein, 8 aa, Yellow fever virus
EPDVILPI

SEQ ID NO: 158905 - protein, 8 aa, Yellow fever virus
PDVILPIG

SEQ ID NO: 158906 - protein, 8 aa, Yellow fever virus
DVTLPIGT

SEQ ID NO: 158907 - protein, 8 aa, Yellow fever virus
VTLPIGTR

SEQ ID NO: 158908 - protein, 8 aa, Yellow fever virus
TLPIGTRS

SEQ ID NO: 158909 - protein, 8 aa, Yellow fever virus
ETDKGPLN

SEQ ID NO: 158910 - protein, 8 aa, Yellow fever virus
TDKGPLDR

SEQ ID NO: 158911 - protein, 8 aa, Yellow fever virus
DAIEERVE

SEQ ID NO: 158912 - protein, 8 aa, Yellow fever virus
AIKERVER

SEQ ID NO: 158913 - protein, 8 aa, Yellow fever virus
IKERVERI

SEQ ID NO: 158914 - protein, 8 aa, Yellow fever virus
KERVERIK

SEQ ID NO: 158915 - protein, 8 aa, Yellow fever virus
ERVERIKT

SEQ ID NO: 158916 - protein, 8 aa, Yellow fever virus
RVERIKTE

SEQ ID NO: 158917 - protein, 8 aa, Yellow fever virus
VERIKTEY

SEQ ID NO: 158918 - protein, 8 aa, Yellow fever virus
ERIKTEYA

SEQ ID NO: 158919 - protein, 8 aa, Yellow fever virus
RIKTEYAA

SEQ ID NO: 158920 - protein, 8 aa, Yellow fever virus
IKSEYMTT

SEQ ID NO: 158921 - protein, 8 aa, Yellow fever virus
KSEYMTTW

SEQ ID NO: 158922 - protein, 8 aa, Yellow fever virus
SEYMTTWF

SEQ ID NO: 158923 - protein, 8 aa, Yellow fever virus
EYMTTWFY

SEQ ID NO: 158924 - protein, 8 aa, Yellow fever virus
YMTTWFYD

SEQ ID NO: 158925 - protein, 8 aa, Yellow fever virus
MTTWFYDN

SEQ ID NO: 158926 - protein, 8 aa, Yellow fever virus
TTWFYDND

SEQ ID NO: 158927 - protein, 8 aa, Yellow fever virus
TWFYDNDN

SEQ ID NO: 158928 - protein, 8 aa, Yellow fever virus
WFHDNDNP

SEQ ID NO: 158929 - protein, 8 aa, Yellow fever virus
FHDNDNPY

SEQ ID NO: 158930 - protein, 8 aa, Yellow fever virus
HDNDNPYR

SEQ ID NO: 158931 - protein, 8 aa, Yellow fever virus
WHYCGSYI

SEQ ID NO: 158932 - protein, 8 aa, Yellow fever virus
HYCGSYIT

SEQ ID NO: 158933 - protein, 8 aa, Yellow fever virus
YCGSYITK

SEQ ID NO: 158934 - protein, 8 aa, Yellow fever virus
CGSYITKT

SEQ ID NO: 158935 - protein, 8 aa, Yellow fever virus
GSYITKTS

SEQ ID NO: 158936 - protein, 8 aa, Yellow fever virus
SYITKTSG

SEQ ID NO: 158937 - protein, 8 aa, Yellow fever virus
YITKTSGS

SEQ ID NO: 158938 - protein, 8 aa, Yellow fever virus
ITKTSGSA

SEQ ID NO: 158939 - protein, 8 aa, Yellow fever virus
SGSAASMI

SEQ ID NO: 158940 - protein, 8 aa, Yellow fever virus
GSAASMIN

SEQ ID NO: 158941 - protein, 8 aa, Yellow fever virus
SAASMING

SEQ ID NO: 158942 - protein, 8 aa, Yellow fever virus
AASMINGV

SEQ ID NO: 158943 - protein, 8 aa, Yellow fever virus
ASMINGVI

SEQ ID NO: 158944 - protein, 8 aa, Yellow fever virus
SMINGVIK

SEQ ID NO: 158945 - protein, 8 aa, Yellow fever virus
MINGVIKI

SEQ ID NO: 158946 - protein, 8 aa, Yellow fever virus
INGVIKIL

SEQ ID NO: 158947 - protein, 8 aa, Yellow fever virus
NGVIKLLT

SEQ ID NO: 158948 - protein, 8 aa, Yellow fever virus
GVIKILTF

SEQ ID NO: 158949 - protein, 8 aa, Yellow fever virus
VIKILTFP

SEQ ID NO: 158950 - protein, 8 aa, Yellow fever virus
IKILTFPW

SEQ ID NO: 158951 - protein, 8 aa, Yellow fever virus
KILTFPWD

SEQ ID NO: 158952 - protein, 8 aa, Yellow fever virus
ILTFPWDR

SEQ ID NO: 158953 - protein, 8 aa, Yellow fever virus
LTFPWDRI

SEQ ID NO: 158954 - protein, 8 aa, Yellow fever virus
TFPWDRIE

SEQ ID NO: 158955 - protein, 8 aa, Yellow fever virus
FPWDRIEE

SEQ ID NO: 158956 - protein, 8 aa, Yellow fever virus
PWDKIEEV

SEQ ID NO: 158957 - protein, 8 aa, Yellow fever virus
WDKIEEVT

SEQ ID NO: 158958 - protein, 8 aa, Yellow fever virus
DKIEEVTR

SEQ ID NO: 158959 - protein, 8 aa, Yellow fever virus
KIEEVTRM

SEQ ID NO: 158960 - protein, 8 aa, Yellow fever virus
AGTRKIMR

SEQ ID NO: 158961 - protein, 8 aa, Yellow fever virus
GTRKIMRV

SEQ ID NO: 158962 - protein, 8 aa, Yellow fever virus
TRKIMRVV

SEQ ID NO: 158963 - protein, 8 aa, Yellow fever virus
RKIMRVVN

SEQ ID NO: 158964 - protein, 8 aa, Yellow fever virus
KIMRVVNR

SEQ ID NO: 158965 - protein, 8 aa, Yellow fever virus
IMRVVNRW

SEQ ID NO: 158966 - protein, 8 aa, Yellow fever virus
MRVVNRWL

SEQ ID NO: 158967 - protein, 8 aa, Yellow fever virus
RVVNRWLF

SEQ ID NO: 158968 - protein, 8 aa, Yellow fever virus
RWLFRHLS

SEQ ID NO: 158969 - protein, 8 aa, Yellow fever virus
WLFRHLSR

SEQ ID NO: 158970 - protein, 8 aa, Yellow fever virus
LFRHLSRE

SEQ ID NO: 158971 - protein, 8 aa, Yellow fever virus
FRHLSREK

SEQ ID NO: 158972 - protein, 8 aa, Yellow fever virus
RHLAREKS

SEQ ID NO: 158973 - protein, 8 aa, Yellow fever virus
HLAREKSP

SEQ ID NO: 158974 - protein, 8 aa, Yellow fever virus
LAREKSPR

SEQ ID NO: 158975 - protein, 8 aa, Yellow fever virus
AREKSPRL

SEQ ID NO: 158976 - protein, 8 aa, Yellow fever virus
REKSPRLC

SEQ ID NO: 158977 - protein, 8 aa, Yellow fever virus
EKSPRLCT

SEQ ID NO: 158978 - protein, 8 aa, Yellow fever virus
KSPRLCTK

SEQ ID NO: 158979 - protein, 8 aa, Yellow fever virus
SPRLCTKE

SEQ ID NO: 158980 - protein, 8 aa, Yellow fever virus
KVRSHAAV

SEQ ID NO: 158981 - protein, 8 aa, Yellow fever virus
VRSHAAVG

SEQ ID NO: 158982 - protein, 8 aa, Yellow fever virus
RSHAAVGA

SEQ ID NO: 158983 - protein, 8 aa, Yellow fever virus
SHAAVGAF

SEQ ID NO: 158984 - protein, 8 aa, Yellow fever virus
HAAVGAFL

SEQ ID NO: 158985 - protein, 8 aa, Yellow fever virus
AAVGAFLE

SEQ ID NO: 158986 - protein, 8 aa, Yellow fever virus
AVGAFLEE

SEQ ID NO: 158987 - protein, 8 aa, Yellow fever virus
VGAFLEEQ

SEQ ID NO: 158988 - protein, 8 aa, Yellow fever virus
GAFLEEQE

SEQ ID NO: 158989 - protein, 8 aa, Yellow fever virus
AFLEEQEQ

SEQ ID NO: 158990 - protein, 8 aa, Yellow fever virus
FLEEQEQW

SEQ ID NO: 158991 - protein, 8 aa, Yellow fever virus
LEEQDQWK

SEQ ID NO: 158992 - protein, 8 aa, Yellow fever virus
EEQDQWKT

SEQ ID NO: 158993 - protein, 8 aa, Yellow fever virus
EQDQWKTA

SEQ ID NO: 158994 - protein, 8 aa, Yellow fever virus
QDQWKTAN

SEQ ID NO: 158995 - protein, 8 aa, Yellow fever virus
DQWKTANE

SEQ ID NO: 158996 - protein, 8 aa, Yellow fever virus
QDPKFWEM

SEQ ID NO: 158997 - protein, 8 aa, Yellow fever virus
DPKFWEMV

SEQ ID NO: 158998 - protein, 8 aa, Yellow fever virus
PKFWEMVD

SEQ ID NO: 158999 - protein, 8 aa, Yellow fever virus
KFWEMVDA

SEQ ID NO: 159000 - protein, 8 aa, Yellow fever virus
FWEMVDAE

SEQ ID NO: 159001 - protein, 8 aa, Yellow fever virus
WEMVDAER

SEQ ID NO: 159002 - protein, 8 aa, Yellow fever virus
EMVDAERK

SEQ ID NO: 159003 - protein, 8 aa, Yellow fever virus
MVDAERKL

SEQ ID NO: 159004 - protein, 8 aa, Yellow fever virus
VDAERKLH

SEQ ID NO: 159005 - protein, 8 aa, Yellow fever virus
DAERKLHQ

SEQ ID NO: 159006 - protein, 8 aa, Yellow fever virus
AERKLHQQ

SEQ ID NO: 159007 - protein, 8 aa, Yellow fever virus
ERRLHQQG

SEQ ID NO: 159008 - protein, 8 aa, Yellow fever virus
RRLHQQGR

SEQ ID NO: 159009 - protein, 8 aa, Yellow fever virus
RLHQQGRC

SEQ ID NO: 159010 - protein, 8 aa, Yellow fever virus
LHQQGRCQ

SEQ ID NO: 159011 - protein, 8 aa, Yellow fever virus
HQQGRCQS

SEQ ID NO: 159012 - protein, 8 aa, Yellow fever virus
QQGRCQSC

SEQ ID NO: 159013 - protein, 8 aa, Yellow fever virus
QGRCQSCV

SEQ ID NO: 159014 - protein, 8 aa, Yellow fever virus
GRCQSCVY

SEQ ID NO: 159015 - protein, 8 aa, Yellow fever virus
RCQSCVYN

SEQ ID NO: 159016 - protein, 8 aa, Yellow fever virus
CQSCVYNM

SEQ ID NO: 159017 - protein, 8 aa, Yellow fever virus
QSCVYNMM

SEQ ID NO: 159018 - protein, 8 aa, Yellow fever virus
SCVYNMMG

SEQ ID NO: 159019 - protein, 8 aa, Yellow fever virus
YMWLGARF

SEQ ID NO: 159020 - protein, 8 aa, Yellow fever virus
MWLGARFL

SEQ ID NO: 159021 - protein, 8 aa, Yellow fever virus
WLGARFLE

SEQ ID NO: 159022 - protein, 8 aa, Yellow fever virus
LGARFLEF

SEQ ID NO: 159023 - protein, 8 aa, Yellow fever virus
GARFLEFE

SEQ ID NO: 159024 - protein, 8 aa, Yellow fever virus
ARFLEFEA

SEQ ID NO: 159025 - protein, 8 aa, Yellow fever virus
RFLEFEAL

SEQ ID NO: 159026 - protein, 8 aa, Yellow fever virus
FLEFEALG

SEQ ID NO: 159027 - protein, 8 aa, Yellow fever virus
SGGGVEGT

SEQ ID NO: 159028 - protein, 8 aa, Yellow fever virus
GGGVEGTG

SEQ ID NO: 159029 - protein, 8 aa, Yellow fever virus
GGVEGTGL

SEQ ID NO: 159030 - protein, 8 aa, Yellow fever virus
GVEGTGLQ

SEQ ID NO: 159031 - protein, 8 aa, Yellow fever virus
VEGTGLQY

SEQ ID NO: 159032 - protein, 8 aa, Yellow fever virus
EGTGLQYL

SEQ ID NO: 159033 - protein, 8 aa, Yellow fever virus
GTGLQYLG

SEQ ID NO: 159034 - protein, 8 aa, Yellow fever virus
TGLQYLGY

SEQ ID NO: 159035 - protein, 8 aa, Yellow fever virus
QYLGYVIK

SEQ ID NO: 159036 - protein, 8 aa, Yellow fever virus
YLGYVIKD

SEQ ID NO: 159037 - protein, 8 aa, Yellow fever virus
LGYVIKDL

SEQ ID NO: 159038 - protein, 8 aa, Yellow fever virus
GYVIKDLS

SEQ ID NO: 159039 - protein, 8 aa, Yellow fever virus
YVIKDLST

SEQ ID NO: 159040 - protein, 8 aa, Yellow fever virus
VIKDLSTK

SEQ ID NO: 159041 - protein, 8 aa, Yellow fever virus
IKDLSTKE

SEQ ID NO: 159042 - protein, 8 aa, Yellow fever virus
KDLSTKEG

SEQ ID NO: 159043 - protein, 8 aa, Yellow fever virus
DLSTKEGG

SEQ ID NO: 159044 - protein, 8 aa, Yellow fever virus
LSTKEGGG

SEQ ID NO: 159045 - protein, 8 aa, Yellow fever virus
STKEGGGF

SEQ ID NO: 159046 - protein, 8 aa, Yellow fever virus
TKEGGGFY

SEQ ID NO: 159047 - protein, 8 aa, Yellow fever virus
KEGGGFYA

SEQ ID NO: 159048 - protein, 8 aa, Yellow fever virus
EGGGFYAD

SEQ ID NO: 159049 - protein, 8 aa, Yellow fever virus
GGGLYADD

SEQ ID NO: 159050 - protein, 8 aa, Yellow fever virus
GGLYADDT

SEQ ID NO: 159051 - protein, 8 aa, Yellow fever virus
GLYADDTA

SEQ ID NO: 159052 - protein, 8 aa, Yellow fever virus
LYADDTAG

SEQ ID NO: 159053 - protein, 8 aa, Yellow fever virus
LDDEQEIM

SEQ ID NO: 159054 - protein, 8 aa, Yellow fever virus
DDEQEIMS

SEQ ID NO: 159055 - protein, 8 aa, Yellow fever virus
DEQEIMSY

SEQ ID NO: 159056 - protein, 8 aa, Yellow fever virus
EQEIMSYM

SEQ ID NO: 159057 - protein, 8 aa, Yellow fever virus
QEIMSYMN

SEQ ID NO: 159058 - protein, 8 aa, Yellow fever virus
EIMSYMNA

SEQ ID NO: 159059 - protein, 8 aa, Yellow fever virus
IMSYMNAE

SEQ ID NO: 159060 - protein, 8 aa, Yellow fever virus
MSYMNAEQ

SEQ ID NO: 159061 - protein, 8 aa, Yellow fever virus
SYMNAEQR

SEQ ID NO: 159062 - protein, 8 aa, Yellow fever virus
YMNAEQRK

SEQ ID NO: 159063 - protein, 8 aa, Yellow fever virus
MNAEQRKL

SEQ ID NO: 159064 - protein, 8 aa, Yellow fever virus
NAEQRKLA

SEQ ID NO: 159065 - protein, 8 aa, Yellow fever virus
AEQRKLAW

SEQ ID NO: 159066 - protein, 8 aa, Yellow fever virus
EQRKLAWA

SEQ ID NO: 159067 - protein, 8 aa, Yellow fever virus
QRKLAWAV

SEQ ID NO: 159068 - protein, 8 aa, Yellow fever virus
RKLAWAVM

SEQ ID NO: 159069 - protein, 8 aa, Yellow fever virus
KLAWAVME

SEQ ID NO: 159070 - protein, 8 aa, Yellow fever virus
LAWAVMEM

SEQ ID NO: 159071 - protein, 8 aa, Yellow fever virus
AWAVMEMT

SEQ ID NO: 159072 - protein, 8 aa, Yellow fever virus
WAVMEMTY

SEQ ID NO: 159073 - protein, 8 aa, Yellow fever virus
AIMEMTYK

SEQ ID NO: 159074 - protein, 8 aa, Yellow fever virus
IMEMTYKN

SEQ ID NO: 159075 - protein, 8 aa, Yellow fever virus
VVKVLRPT

SEQ ID NO: 159076 - protein, 8 aa, Yellow fever virus
VKVLRPTP

SEQ ID NO: 159077 - protein, 8 aa, Yellow fever virus
KVLRPTPG

SEQ ID NO: 159078 - protein, 8 aa, Yellow fever virus
VLRPTPGG

SEQ ID NO: 159079 - protein, 8 aa, Yellow fever virus
LRPTPGGK

SEQ ID NO: 159080 - protein, 8 aa, Yellow fever virus
RPTPGGKA

SEQ ID NO: 159081 - protein, 8 aa, Yellow fever virus
PAPGGKAF

SEQ ID NO: 159082 - protein, 8 aa, Yellow fever virus
APGGKAFM

SEQ ID NO: 159083 - protein, 8 aa, Yellow fever virus
PGGKAFMD

SEQ ID NO: 159084 - protein, 8 aa, Yellow fever virus
GGKAFMDI

SEQ ID NO: 159085 - protein, 8 aa, Yellow fever virus
GKAFMDII

SEQ ID NO: 159086 - protein, 8 aa, Yellow fever virus
KAFMDIIS

SEQ ID NO: 159087 - protein, 8 aa, Yellow fever virus
AFMDIISR

SEQ ID NO: 159088 - protein, 8 aa, Yellow fever virus
FMDIISRR

SEQ ID NO: 159089 - protein, 8 aa, Yellow fever virus
MDIISRRD

SEQ ID NO: 159090 - protein, 8 aa, Yellow fever virus
DIISRRDQ

SEQ ID NO: 159091 - protein, 8 aa, Yellow fever virus
IISRRDQR

SEQ ID NO: 159092 - protein, 8 aa, Yellow fever virus
RRDQRGSR

SEQ ID NO: 159093 - protein, 8 aa, Yellow fever virus
RDQRGSRQ

SEQ ID NO: 159094 - protein, 8 aa, Yellow fever virus
DQRGSRQV

SEQ ID NO: 159095 - protein, 8 aa, Yellow fever virus
QRGSRQVV

SEQ ID NO: 159096 - protein, 8 aa, Yellow fever virus
RGSRQVVT

SEQ ID NO: 159097 - protein, 8 aa, Yellow fever virus
GSRQVVTY

SEQ ID NO: 159098 - protein, 8 aa, Yellow fever virus
SRQVVTYA

SEQ ID NO: 159099 - protein, 8 aa, Yellow fever virus
RQVVTYAL

SEQ ID NO: 159100 - protein, 8 aa, Yellow fever virus
IRMAEAEN

SEQ ID NO: 159101 - protein, 8 aa, Yellow fever virus
RMAEAENV

SEQ ID NO: 159102 - protein, 8 aa, Yellow fever virus
MAEAENVI

SEQ ID NO: 159103 - protein, 8 aa, Yellow fever virus
AEAEMVIN

SEQ ID NO: 159104 - protein, 8 aa, Yellow fever virus
EAEMVINH

SEQ ID NO: 159105 - protein, 8 aa, Yellow fever virus
AEMVINHQ

SEQ ID NO: 159106 - protein, 8 aa, Yellow fever virus
EMVINHQH

SEQ ID NO: 159107 - protein, 8 aa, Yellow fever virus
MVINHQHV

SEQ ID NO: 159108 - protein, 8 aa, Yellow fever virus
VINHQHVN

SEQ ID NO: 159109 - protein, 8 aa, Yellow fever virus
INHQHVNE

SEQ ID NO: 159110 - protein, 8 aa, Yellow fever virus
NHQHVNEC

SEQ ID NO: 159111 - protein, 8 aa, Yellow fever virus
HQHVNECD

SEQ ID NO: 159112 - protein, 8 aa, Yellow fever virus
QHVNECDE

SEQ ID NO: 159113 - protein, 8 aa, Yellow fever virus
HVQECGEN

SEQ ID NO: 159114 - protein, 8 aa, Yellow fever virus
CDESALAR

SEQ ID NO: 159115 - protein, 8 aa, Yellow fever virus
DESALARL

SEQ ID NO: 159116 - protein, 8 aa, Yellow fever virus
LARLEAWL

SEQ ID NO: 159117 - protein, 8 aa, Yellow fever virus
ARLEAWLT

SEQ ID NO: 159118 - protein, 8 aa, Yellow fever virus
RLDAWLAE

SEQ ID NO: 159119 - protein, 8 aa, Yellow fever virus
LDAWLAEN

SEQ ID NO: 159120 - protein, 8 aa, Yellow fever virus
DAWLAENG

SEQ ID NO: 159121 - protein, 8 aa, Yellow fever virus
AWLAENGC

SEQ ID NO: 159122 - protein, 8 aa, Yellow fever virus
WLTEHGCD

SEQ ID NO: 159123 - protein, 8 aa, Yellow fever virus
LTEHGCDR

SEQ ID NO: 159124 - protein, 8 aa, Yellow fever virus
TEHGCDRL

SEQ ID NO: 159125 - protein, 8 aa, Yellow fever virus
RLRRMAVS

SEQ ID NO: 159126 - protein, 8 aa, Yellow fever virus
LARMAVSG

SEQ ID NO: 159127 - protein, 8 aa, Yellow fever virus
ARMAVSGD

SEQ ID NO: 159128 - protein, 8 aa, Yellow fever virus
RMAVNGDD

SEQ ID NO: 159129 - protein, 8 aa, Yellow fever virus
MAVNGDDC

SEQ ID NO: 159130 - protein, 8 aa, Yellow fever virus
AVNGDDCV

SEQ ID NO: 159131 - protein, 8 aa, Yellow fever virus
VNGDDCVV

SEQ ID NO: 159132 - protein, 8 aa, Yellow fever virus
SGDDCVVK

SEQ ID NO: 159133 - protein, 8 aa, Yellow fever virus
GDDCVVKP

SEQ ID NO: 159134 - protein, 8 aa, Yellow fever virus
DDCVVRPV

SEQ ID NO: 159135 - protein, 8 aa, Yellow fever virus
DCVVRPVD

SEQ ID NO: 159136 - protein, 8 aa, Yellow fever virus
CVVRPVDD

SEQ ID NO: 159137 - protein, 8 aa, Yellow fever virus
VVRPVDDR

SEQ ID NO: 159138 - protein, 8 aa, Yellow fever virus
VRPVDDRF

SEQ ID NO: 159139 - protein, 8 aa, Yellow fever virus
RPVDDRFG

SEQ ID NO: 159140 - protein, 8 aa, Yellow fever virus
PVDDRFGL

SEQ ID NO: 159141 - protein, 8 aa, Yellow fever virus
VDDRFGLA

SEQ ID NO: 159142 - protein, 8 aa, Yellow fever virus
DDRFGMAL

SEQ ID NO: 159143 - protein, 8 aa, Yellow fever virus
DRFGMALS

SEQ ID NO: 159144 - protein, 8 aa, Yellow fever virus
RFGMALSH

SEQ ID NO: 159145 - protein, 8 aa, Yellow fever virus
FGMALSHL

SEQ ID NO: 159146 - protein, 8 aa, Yellow fever virus
GMALSHLN

SEQ ID NO: 159147 - protein, 8 aa, Yellow fever virus
MALSHLNA

SEQ ID NO: 159148 - protein, 8 aa, Yellow fever virus
SEWQPSKE

SEQ ID NO: 159149 - protein, 8 aa, Yellow fever virus
EWQPSKEW

SEQ ID NO: 159150 - protein, 8 aa, Yellow fever virus
WQPSKGWT

SEQ ID NO: 159151 - protein, 8 aa, Yellow fever virus
QPSKGWTD

SEQ ID NO: 159152 - protein, 8 aa, Yellow fever virus
PSKGWTDW

SEQ ID NO: 159153 - protein, 8 aa, Yellow fever virus
SKGWTDWE

SEQ ID NO: 159154 - protein, 8 aa, Yellow fever virus
KGWTDWEN

SEQ ID NO: 159155 - protein, 8 aa, Yellow fever virus
EWTDWENV

SEQ ID NO: 159156 - protein, 8 aa, Yellow fever virus
WTDWENVP

SEQ ID NO: 159157 - protein, 8 aa, Yellow fever virus
TDWENVPF

SEQ ID NO: 159158 - protein, 8 aa, Yellow fever virus
DWESVPFC

SEQ ID NO: 159159 - protein, 8 aa, Yellow fever virus
WESVPFCS

SEQ ID NO: 159160 - protein, 8 aa, Yellow fever virus
ESVPFCSH

SEQ ID NO: 159161 - protein, 8 aa, Yellow fever virus
SVPFCSHH

SEQ ID NO: 159162 - protein, 8 aa, Yellow fever virus
VPFCSHRF

SEQ ID NO: 159163 - protein, 8 aa, Yellow fever virus
PFCSHRFH

SEQ ID NO: 159164 - protein, 8 aa, Yellow fever virus
FCSHRFHE

SEQ ID NO: 159165 - protein, 8 aa, Yellow fever virus
CSHRFHEL

SEQ ID NO: 159166 - protein, 8 aa, Yellow fever virus
SHHFHELV

SEQ ID NO: 159167 - protein, 8 aa, Yellow fever virus
HHFHELVL

SEQ ID NO: 159168 - protein, 8 aa, Yellow fever virus
HFHELVLK

SEQ ID NO: 159169 - protein, 8 aa, Yellow fever virus
FHELVLKD

SEQ ID NO: 159170 - protein, 8 aa, Yellow fever virus
HELVLKDG

SEQ ID NO: 159171 - protein, 8 aa, Yellow fever virus
ELVLKDGR

SEQ ID NO: 159172 - protein, 8 aa, Yellow fever virus
LVLKDGRK

SEQ ID NO: 159173 - protein, 8 aa, Yellow fever virus
VLKDGRKV

SEQ ID NO: 159174 - protein, 8 aa, Yellow fever virus
LKDGRKVV

SEQ ID NO: 159175 - protein, 8 aa, Yellow fever virus
KDGRKVVV

SEQ ID NO: 159176 - protein, 8 aa, Yellow fever virus
DGRKVVVP

SEQ ID NO: 159177 - protein, 8 aa, Yellow fever virus
GRKVVVPC

SEQ ID NO: 159178 - protein, 8 aa, Yellow fever virus
RKVVVPCR

SEQ ID NO: 159179 - protein, 8 aa, Yellow fever virus
KVVVPCRD

SEQ ID NO: 159180 - protein, 8 aa, Yellow fever virus
VVVPCRDQ

SEQ ID NO: 159181 - protein, 8 aa, Yellow fever virus
VVPCRDQD

SEQ ID NO: 159182 - protein, 8 aa, Yellow fever virus
VPCRDQDE

SEQ ID NO: 159183 - protein, 8 aa, Yellow fever virus
PCRDQDEL

SEQ ID NO: 159184 - protein, 8 aa, Yellow fever virus
CRDQDELI

SEQ ID NO: 159185 - protein, 8 aa, Yellow fever virus
RDQDELIG

SEQ ID NO: 159186 - protein, 8 aa, Yellow fever virus
DQDELIGR

SEQ ID NO: 159187 - protein, 8 aa, Yellow fever virus
RDMRLLSF

SEQ ID NO: 159188 - protein, 8 aa, Yellow fever virus
DMRLLSFA

SEQ ID NO: 159189 - protein, 8 aa, Yellow fever virus
MRLLSFAV

SEQ ID NO: 159190 - protein, 8 aa, Yellow fever virus
RLLSFAVS

SEQ ID NO: 159191 - protein, 8 aa, Yellow fever virus
LLSFAVSS

SEQ ID NO: 159192 - protein, 8 aa, Yellow fever virus
LSFAVSSA

SEQ ID NO: 159193 - protein, 8 aa, Yellow fever virus
SFAVSSAV

SEQ ID NO: 159194 - protein, 8 aa, Yellow fever virus
FAVSSAVP

SEQ ID NO: 159195 - protein, 8 aa, Yellow fever virus
AVSSAVPM

SEQ ID NO: 159196 - protein, 8 aa, Yellow fever virus
VSSAVPTA

SEQ ID NO: 159197 - protein, 8 aa, Yellow fever virus
SSAVPTAW

SEQ ID NO: 159198 - protein, 8 aa, Yellow fever virus
SAVPTAWV

SEQ ID NO: 159199 - protein, 8 aa, Yellow fever virus
AVPTAWVP

SEQ ID NO: 159200 - protein, 8 aa, Yellow fever virus
VPTAWVPS

SEQ ID NO: 159201 - protein, 8 aa, Yellow fever virus
PTAWVPSG

SEQ ID NO: 159202 - protein, 8 aa, Yellow fever virus
TAWVPSGR

SEQ ID NO: 159203 - protein, 8 aa, Yellow fever virus
AWVPSGRT

SEQ ID NO: 159204 - protein, 8 aa, Yellow fever virus
WVPSGRTT

SEQ ID NO: 159205 - protein, 8 aa, Yellow fever virus
VPSGRTTW

SEQ ID NO: 159206 - protein, 8 aa, Yellow fever virus
PSGRTTWS

SEQ ID NO: 159207 - protein, 8 aa, Yellow fever virus
SGRTTWSV

SEQ ID NO: 159208 - protein, 8 aa, Yellow fever virus
GRTTWSVH

SEQ ID NO: 159209 - protein, 8 aa, Yellow fever virus
RTTWSVHG

SEQ ID NO: 159210 - protein, 8 aa, Yellow fever virus
TTWSVHGK

SEQ ID NO: 159211 - protein, 8 aa, Yellow fever virus
TWSVHGKG

SEQ ID NO: 159212 - protein, 8 aa, Yellow fever virus
WSVHGKGE

SEQ ID NO: 159213 - protein, 8 aa, Yellow fever virus
SVHGKGEW

SEQ ID NO: 159214 - protein, 8 aa, Yellow fever virus
VHGKGEWM

SEQ ID NO: 159215 - protein, 8 aa, Yellow fever virus
HGRGEWMT

SEQ ID NO: 159216 - protein, 8 aa, Yellow fever virus
GRGEWMTT

SEQ ID NO: 159217 - protein, 8 aa, Yellow fever virus
KGEWMTTQ

SEQ ID NO: 159218 - protein, 8 aa, Yellow fever virus
GEWMTTQD

SEQ ID NO: 159219 - protein, 8 aa, Yellow fever virus
EWMTTQDM

SEQ ID NO: 159220 - protein, 8 aa, Yellow fever virus
WMTTEDRL

SEQ ID NO: 159221 - protein, 8 aa, Yellow fever virus
MTTEDMLG

SEQ ID NO: 159222 - protein, 8 aa, Yellow fever virus
TTEDMLDV

SEQ ID NO: 159223 - protein, 8 aa, Yellow fever virus
TEDMLDVW

SEQ ID NO: 159224 - protein, 8 aa, Yellow fever virus
EDMLDVWN

SEQ ID NO: 159225 - protein, 8 aa, Yellow fever virus
DMLDVWNR

SEQ ID NO: 159226 - protein, 8 aa, Yellow fever virus
MLDVWNRV

SEQ ID NO: 159227 - protein, 8 aa, Yellow fever virus
LDVWNRVW

SEQ ID NO: 159228 - protein, 8 aa, Yellow fever virus
DVWNRVWV

SEQ ID NO: 159229 - protein, 8 aa, Yellow fever virus
VWNRVWVL

SEQ ID NO: 159230 - protein, 8 aa, Yellow fever virus
WNRVWVLN

SEQ ID NO: 159231 - protein, 8 aa, Yellow fever virus
NRVWVLNN

SEQ ID NO: 159232 - protein, 8 aa, Yellow fever virus
RVWVLNNP

SEQ ID NO: 159233 - protein, 8 aa, Yellow fever virus
VWVLNNPH

SEQ ID NO: 159234 - protein, 8 aa, Yellow fever virus
WVLNNPHM

SEQ ID NO: 159235 - protein, 8 aa, Yellow fever virus
VLNNPHMK

SEQ ID NO: 159236 - protein, 8 aa, Yellow fever virus
LNNPHMKD

SEQ ID NO: 159237 - protein, 8 aa, Yellow fever virus
NNPHMKDK

SEQ ID NO: 159238 - protein, 8 aa, Yellow fever virus
NPHMKDKT

SEQ ID NO: 159239 - protein, 8 aa, Yellow fever virus
PHMQDKTV

SEQ ID NO: 159240 - protein, 8 aa, Yellow fever virus
HMQDKTVV

SEQ ID NO: 159241 - protein, 8 aa, Yellow fever virus
MQDKTVVK

SEQ ID NO: 159242 - protein, 8 aa, Yellow fever virus
QDKTMVKE

SEQ ID NO: 159243 - protein, 8 aa, Yellow fever virus
DKTMVKEW

SEQ ID NO: 159244 - protein, 8 aa, Yellow fever virus
KTMVKEWR

SEQ ID NO: 159245 - protein, 8 aa, Yellow fever virus
TMVKEWRD

SEQ ID NO: 159246 - protein, 8 aa, Yellow fever virus
MVKEWRDV

SEQ ID NO: 159247 - protein, 8 aa, Yellow fever virus
VKEWRDVP

SEQ ID NO: 159248 - protein, 8 aa, Yellow fever virus
KEWRDVPY

SEQ ID NO: 159249 - protein, 8 aa, Yellow fever virus
EWRDVPYL

SEQ ID NO: 159250 - protein, 8 aa, Yellow fever virus
NRATWASN

SEQ ID NO: 159251 - protein, 8 aa, Yellow fever virus
RATWASNI

SEQ ID NO: 159252 - protein, 8 aa, Yellow fever virus
ATWASNIH

SEQ ID NO: 159253 - protein, 8 aa, Yellow fever virus
TWASNIHL

SEQ ID NO: 159254 - protein, 8 aa, Yellow fever virus
WASNIHLV

SEQ ID NO: 159255 - protein, 8 aa, Yellow fever virus
ASNIHLVI

SEQ ID NO: 159256 - protein, 8 aa, Yellow fever virus
SNIHLVIH

SEQ ID NO: 159257 - protein, 8 aa, Yellow fever virus
NIHLVIHR

SEQ ID NO: 159258 - protein, 8 aa, Yellow fever virus
LVIHRIRN

SEQ ID NO: 159259 - protein, 8 aa, Yellow fever virus
VIHRIRNL

SEQ ID NO: 159260 - protein, 8 aa, Yellow fever virus
IHRIRTLV

SEQ ID NO: 159261 - protein, 8 aa, Yellow fever virus
HRIRTLVG

SEQ ID NO: 159262 - protein, 8 aa, Yellow fever virus
RIRTLVGQ

SEQ ID NO: 159263 - protein, 8 aa, Yellow fever virus
IRTLVGQE

SEQ ID NO: 159264 - protein, 8 aa, Yellow fever virus
RTLVGQEK

SEQ ID NO: 159265 - protein, 8 aa, Yellow fever virus
TLVGQEKY

SEQ ID NO: 159266 - protein, 8 aa, Yellow fever virus
LVGQEKYT

SEQ ID NO: 159267 - protein, 8 aa, Yellow fever virus
VGQEKYTD

SEQ ID NO: 159268 - protein, 8 aa, Yellow fever virus
GQEKFTDY

SEQ ID NO: 159269 - protein, 8 aa, Yellow fever virus
QEKFTDYL

SEQ ID NO: 159270 - protein, 8 aa, Yellow fever virus
EKFTDYLT

SEQ ID NO: 159271 - protein, 8 aa, Yellow fever virus
KFTDYLTV

SEQ ID NO: 159272 - protein, 8 aa, Yellow fever virus
FTDYLTVM

SEQ ID NO: 159273 - protein, 8 aa, Yellow fever virus
SVDADLQP

SEQ ID NO: 159274 - protein, 8 aa, Yellow fever virus
VDADLQPG

SEQ ID NO: 159275 - protein, 8 aa, Yellow fever virus
DADLQPGE

SEQ ID NO: 159276 - protein, 8 aa, Yellow fever virus
ADLQPGEL

SEQ ID NO: 159277 - protein, 8 aa, Yellow fever virus
DLQPGELI

SEQ ID NO: 159278 - protein, 8 aa, Yellow fever virus
LTGKKLTA

SEQ ID NO: 159279 - protein, 8 aa, Yellow fever virus
TGKKLTAH

SEQ ID NO: 159280 - protein, 8 aa, Yellow fever virus
GKKLTAHL

SEQ ID NO: 159281 - protein, 8 aa, Yellow fever virus
KKLTAHLK

SEQ ID NO: 159282 - protein, 8 aa, Yellow fever virus
KLTAHLKK

SEQ ID NO: 159283 - protein, 8 aa, Yellow fever virus
ITAQLKRL

SEQ ID NO: 159284 - protein, 8 aa, Yellow fever virus
TAQLKRLW

SEQ ID NO: 159285 - protein, 8 aa, Yellow fever virus
AQLKRLWK

SEQ ID NO: 159286 - protein, 8 aa, Yellow fever virus
HLKKLWRM

SEQ ID NO: 159287 - protein, 8 aa, Yellow fever virus
LKKLWRML

SEQ ID NO: 159288 - protein, 8 aa, Yellow fever virus
KKLWRMLD

SEQ ID NO: 159289 - protein, 8 aa, Yellow fever virus
KLWRMLDP

SEQ ID NO: 159290 - protein, 8 aa, Yellow fever virus
DPRQGLTV

SEQ ID NO: 159291 - protein, 8 aa, Yellow fever virus
PRQGLTVL

SEQ ID NO: 159292 - protein, 8 aa, Yellow fever virus
RQGLTVLR

SEQ ID NO: 159293 - protein, 8 aa, Yellow fever virus
QGLTVLRK

SEQ ID NO: 159294 - protein, 8 aa, Yellow fever virus
GLTVLRKV

SEQ ID NO: 159295 - protein, 8 aa, Yellow fever virus
LTVLRKVK

SEQ ID NO: 159296 - protein, 8 aa, Yellow fever virus
TVLRKVKR

SEQ ID NO: 159297 - protein, 8 aa, Yellow fever virus
RVVASLMI

SEQ ID NO: 159298 - protein, 8 aa, Yellow fever virus
VVASLMIG

SEQ ID NO: 159299 - protein, 8 aa, Yellow fever virus
VASLMIGL

SEQ ID NO: 159300 - protein, 8 aa, Yellow fever virus
ASLMIGLS

SEQ ID NO: 159301 - protein, 8 aa, Yellow fever virus
SLMIGLSS

SEQ ID NO: 159302 - protein, 8 aa, Yellow fever virus
SSRKRRSS

SEQ ID NO: 159303 - protein, 8 aa, Yellow fever virus
SRKRRSSE

SEQ ID NO: 159304 - protein, 8 aa, Yellow fever virus
RKRRSHDA

SEQ ID NO: 159305 - protein, 8 aa, Yellow fever virus
KRRSHDAL

SEQ ID NO: 159306 - protein, 8 aa, Yellow fever virus
AVQFLILG

SEQ ID NO: 159307 - protein, 8 aa, Yellow fever virus
FPLLLLGL

SEQ ID NO: 159308 - protein, 8 aa, Yellow fever virus
QLLILGMI

SEQ ID NO: 159309 - protein, 8 aa, Yellow fever virus
LLLLGLLA

SEQ ID NO: 159310 - protein, 8 aa, Yellow fever virus
LILGMILM

SEQ ID NO: 159311 - protein, 8 aa, Yellow fever virus
ILAGGVTL

SEQ ID NO: 159312 - protein, 8 aa, Yellow fever virus
SGGVTLVR

SEQ ID NO: 159313 - protein, 8 aa, Yellow fever virus
DLGKTFSI

SEQ ID NO: 159314 - protein, 8 aa, Yellow fever virus
LGKTFSLG

SEQ ID NO: 159315 - protein, 8 aa, Yellow fever virus
GKTFSMGT

SEQ ID NO: 159316 - protein, 8 aa, Yellow fever virus
KTFSMGTG

SEQ ID NO: 159317 - protein, 8 aa, Yellow fever virus
TFSVGAGN

SEQ ID NO: 159318 - protein, 8 aa, Yellow fever virus
FSMGTGNC

SEQ ID NO: 159319 - protein, 8 aa, Yellow fever virus
SLGTGNCT

SEQ ID NO: 159320 - protein, 8 aa, Yellow fever virus
LGTGNCTT

SEQ ID NO: 159321 - protein, 8 aa, Yellow fever virus
NVRVTYGK

SEQ ID NO: 159322 - protein, 8 aa, Yellow fever virus
VRVTYGKC

SEQ ID NO: 159323 - protein, 8 aa, Yellow fever virus
RVTYGKCD

SEQ ID NO: 159324 - protein, 8 aa, Yellow fever virus
VTYGKCDS

SEQ ID NO: 159325 - protein, 8 aa, Yellow fever virus
TYGKCDSA

SEQ ID NO: 159326 - protein, 8 aa, Yellow fever virus
FFAITALA

SEQ ID NO: 159327 - protein, 8 aa, Yellow fever virus
FAITALAI

SEQ ID NO: 159328 - protein, 8 aa, Yellow fever virus
AITALAIA

SEQ ID NO: 159329 - protein, 8 aa, Yellow fever virus
ITALAIAY

SEQ ID NO: 159330 - protein, 8 aa, Yellow fever virus
AIAYLVGS

SEQ ID NO: 159331 - protein, 8 aa, Yellow fever virus
AYLVGNNT

SEQ ID NO: 159332 - protein, 8 aa, Yellow fever virus
YLVGNNMT

SEQ ID NO: 159333 - protein, 8 aa, Yellow fever virus
LVGNNKTQ

SEQ ID NO: 159334 - protein, 8 aa, Yellow fever virus
VGNNMTQR

SEQ ID NO: 159335 - protein, 8 aa, Yellow fever virus
GNNKTQRV

SEQ ID NO: 159336 - protein, 8 aa, Yellow fever virus
NNTTQRVV

SEQ ID NO: 159337 - protein, 8 aa, Yellow fever virus
NKTQRVVI

SEQ ID NO: 159338 - protein, 8 aa, Yellow fever virus
KTQRVVIA

SEQ ID NO: 159339 - protein, 8 aa, Yellow fever virus
VSASLEQD

SEQ ID NO: 159340 - protein, 8 aa, Yellow fever virus
SASLEQDK

SEQ ID NO: 159341 - protein, 8 aa, Yellow fever virus
ASLEQDKC

SEQ ID NO: 159342 - protein, 8 aa, Yellow fever virus
TLEQGKCV

SEQ ID NO: 159343 - protein, 8 aa, Yellow fever virus
LQTVAIDG

SEQ ID NO: 159344 - protein, 8 aa, Yellow fever virus
QTVAIDGP

SEQ ID NO: 159345 - protein, 8 aa, Yellow fever virus
TVAIDGPV

SEQ ID NO: 159346 - protein, 8 aa, Yellow fever virus
VAIDGPVE

SEQ ID NO: 159347 - protein, 8 aa, Yellow fever virus
AIDRPAEA

SEQ ID NO: 159348 - protein, 8 aa, Yellow fever virus
IDRPAEAR

SEQ ID NO: 159349 - protein, 8 aa, Yellow fever virus
DRPAEARK

SEQ ID NO: 159350 - protein, 8 aa, Yellow fever virus
RPAEARKV

SEQ ID NO: 159351 - protein, 8 aa, Yellow fever virus
PVEARKVC

SEQ ID NO: 159352 - protein, 8 aa, Yellow fever virus
VEARKVCY

SEQ ID NO: 159353 - protein, 8 aa, Yellow fever virus
EARKVCYS

SEQ ID NO: 159354 - protein, 8 aa, Yellow fever virus
ARKVCYSA

SEQ ID NO: 159355 - protein, 8 aa, Yellow fever virus
IQYVIRAR

SEQ ID NO: 159356 - protein, 8 aa, Yellow fever virus
QYVIKAQL

SEQ ID NO: 159357 - protein, 8 aa, Yellow fever virus
YVIRARLH

SEQ ID NO: 159358 - protein, 8 aa, Yellow fever virus
VIKAQLHV

SEQ ID NO: 159359 - protein, 8 aa, Yellow fever virus
IRARLHVG

SEQ ID NO: 159360 - protein, 8 aa, Yellow fever virus
KAQLHVGA

SEQ ID NO: 159361 - protein, 8 aa, Yellow fever virus
GAKQENWK

SEQ ID NO: 159362 - protein, 8 aa, Yellow fever virus
AKQENWKT

SEQ ID NO: 159363 - protein, 8 aa, Yellow fever virus
KQENWNTS

SEQ ID NO: 159364 - protein, 8 aa, Yellow fever virus
QENWNTSI

SEQ ID NO: 159365 - protein, 8 aa, Yellow fever virus
ENWNTSIK

SEQ ID NO: 159366 - protein, 8 aa, Yellow fever virus
NWNTSIKT

SEQ ID NO: 159367 - protein, 8 aa, Yellow fever virus
WNTSIKTL

SEQ ID NO: 159368 - protein, 8 aa, Yellow fever virus
NTSIKTLK

SEQ ID NO: 159369 - protein, 8 aa, Yellow fever virus
VLSGSQEA

SEQ ID NO: 159370 - protein, 8 aa, Yellow fever virus
GSQEVEFT

SEQ ID NO: 159371 - protein, 8 aa, Yellow fever virus
SQEVEFTG

SEQ ID NO: 159372 - protein, 8 aa, Yellow fever virus
QEVEFTGY

SEQ ID NO: 159373 - protein, 8 aa, Yellow fever virus
EVEFTGYG

SEQ ID NO: 159374 - protein, 8 aa, Yellow fever virus
VEFTGYGK

SEQ ID NO: 159375 - protein, 8 aa, Yellow fever virus
EFTGYGKV

SEQ ID NO: 159376 - protein, 8 aa, Yellow fever virus
FTGYGKVT

SEQ ID NO: 159377 - protein, 8 aa, Yellow fever virus
TGYGKVTL

SEQ ID NO: 159378 - protein, 8 aa, Yellow fever virus
GKVTLECQ

SEQ ID NO: 159379 - protein, 8 aa, Yellow fever virus
KVTLECQV

SEQ ID NO: 159380 - protein, 8 aa, Yellow fever virus
VTLECQVQ

SEQ ID NO: 159381 - protein, 8 aa, Yellow fever virus
YIAEMEKD

SEQ ID NO: 159382 - protein, 8 aa, Yellow fever virus
IAEMEKDS

SEQ ID NO: 159383 - protein, 8 aa, Yellow fever virus
AEMEKDSW

SEQ ID NO: 159384 - protein, 8 aa, Yellow fever virus
EMEKDSWI

SEQ ID NO: 159385 - protein, 8 aa, Yellow fever virus
MEKDSWIV

SEQ ID NO: 159386 - protein, 8 aa, Yellow fever virus
EKDSWIVD

SEQ ID NO: 159387 - protein, 8 aa, Yellow fever virus
KDSWIVDR

SEQ ID NO: 159388 - protein, 8 aa, Yellow fever virus
GSGGVWRG

SEQ ID NO: 159389 - protein, 8 aa, Yellow fever virus
SGGVWRGM

SEQ ID NO: 159390 - protein, 8 aa, Yellow fever virus
GGVWRGMH

SEQ ID NO: 159391 - protein, 8 aa, Yellow fever virus
GVWRGMHH

SEQ ID NO: 159392 - protein, 8 aa, Yellow fever virus
VWRGMHHL

SEQ ID NO: 159393 - protein, 8 aa, Yellow fever virus
VPKGAPCR

SEQ ID NO: 159394 - protein, 8 aa, Yellow fever virus
PKGAPCRI

SEQ ID NO: 159395 - protein, 8 aa, Yellow fever virus
DSYIIIGT

SEQ ID NO: 159396 - protein, 8 aa, Yellow fever virus
SYIIIGTG

SEQ ID NO: 159397 - protein, 8 aa, Yellow fever virus
YIIIGTGD

SEQ ID NO: 159398 - protein, 8 aa, Yellow fever virus
IIIGTGDS

SEQ ID NO: 159399 - protein, 8 aa, Yellow fever virus
IIGTGDSR

SEQ ID NO: 159400 - protein, 8 aa, Yellow fever virus
IGTGDSRL

SEQ ID NO: 159401 - protein, 8 aa, Yellow fever virus
RLAVMGDV

SEQ ID NO: 159402 - protein, 8 aa, Yellow fever virus
LAVMGDVA

SEQ ID NO: 159403 - protein, 8 aa, Yellow fever virus
AVMGDVAW

SEQ ID NO: 159404 - protein, 8 aa, Yellow fever virus
VMGDVAWD

SEQ ID NO: 159405 - protein, 8 aa, Yellow fever virus
MGDVAWDF

SEQ ID NO: 159406 - protein, 8 aa, Yellow fever virus
GDVAWDFS

SEQ ID NO: 159407 - protein, 8 aa, Yellow fever virus
DVAWDFSS

SEQ ID NO: 159408 - protein, 8 aa, Yellow fever virus
VAWDFSSA

SEQ ID NO: 159409 - protein, 8 aa, Yellow fever virus
FSSAGGLF

SEQ ID NO: 159410 - protein, 8 aa, Yellow fever virus
SSAGGLFT

SEQ ID NO: 159411 - protein, 8 aa, Yellow fever virus
SAGGFLTS

SEQ ID NO: 159412 - protein, 8 aa, Yellow fever virus
AGGFLTSV

SEQ ID NO: 159413 - protein, 8 aa, Yellow fever virus
GGFLTSVG

SEQ ID NO: 159414 - protein, 8 aa, Yellow fever virus
GLFTSIGK

SEQ ID NO: 159415 - protein, 8 aa, Yellow fever virus
FLTSVGKG

SEQ ID NO: 159416 - protein, 8 aa, Yellow fever virus
FTSIGKGS

SEQ ID NO: 159417 - protein, 8 aa, Yellow fever virus
NWITKVII

SEQ ID NO: 159418 - protein, 8 aa, Yellow fever virus
ITKVIIGA

SEQ ID NO: 159419 - protein, 8 aa, Yellow fever virus
TKVIMGVV

SEQ ID NO: 159420 - protein, 8 aa, Yellow fever virus
KVIMGVVL

SEQ ID NO: 159421 - protein, 8 aa, Yellow fever virus
VIIGAVLI

SEQ ID NO: 159422 - protein, 8 aa, Yellow fever virus
IMGVVLIW

SEQ ID NO: 159423 - protein, 8 aa, Yellow fever virus
MGVVLIWV

SEQ ID NO: 159424 - protein, 8 aa, Yellow fever virus
AVLIWVGF

SEQ ID NO: 159425 - protein, 8 aa, Yellow fever virus
QGCAINFA

SEQ ID NO: 159426 - protein, 8 aa, Yellow fever virus
GCAINFAK

SEQ ID NO: 159427 - protein, 8 aa, Yellow fever virus
CAINFAKR

SEQ ID NO: 159428 - protein, 8 aa, Yellow fever virus
AINFAKRE

SEQ ID NO: 159429 - protein, 8 aa, Yellow fever virus
INFAKREL

SEQ ID NO: 159430 - protein, 8 aa, Yellow fever virus
ASIIKASY

SEQ ID NO: 159431 - protein, 8 aa, Yellow fever virus
SIIKASYE

SEQ ID NO: 159432 - protein, 8 aa, Yellow fever virus
IIKASYEE

SEQ ID NO: 159433 - protein, 8 aa, Yellow fever virus
IKASYEEG

SEQ ID NO: 159434 - protein, 8 aa, Yellow fever virus
KASYEEGK

SEQ ID NO: 159435 - protein, 8 aa, Yellow fever virus
ASYEEGKC

SEQ ID NO: 159436 - protein, 8 aa, Yellow fever virus
SYEEGKCG

SEQ ID NO: 159437 - protein, 8 aa, Yellow fever virus
YEEGKCGL

SEQ ID NO: 159438 - protein, 8 aa, Yellow fever virus
KTWGKSLV

SEQ ID NO: 159439 - protein, 8 aa, Yellow fever virus
TWGKSLVF

SEQ ID NO: 159440 - protein, 8 aa, Yellow fever virus
WGKSLVFS

SEQ ID NO: 159441 - protein, 8 aa, Yellow fever virus
GKSLVFSP

SEQ ID NO: 159442 - protein, 8 aa, Yellow fever virus
KSLVFSPG

SEQ ID NO: 159443 - protein, 8 aa, Yellow fever virus
SLVFSPGR

SEQ ID NO: 159444 - protein, 8 aa, Yellow fever virus
TRVFMDAT

SEQ ID NO: 159445 - protein, 8 aa, Yellow fever virus
RVFMDATF

SEQ ID NO: 159446 - protein, 8 aa, Yellow fever virus
VFMDATFD

SEQ ID NO: 159447 - protein, 8 aa, Yellow fever virus
FMDATFDY

SEQ ID NO: 159448 - protein, 8 aa, Yellow fever virus
MDATFDYS

SEQ ID NO: 159449 - protein, 8 aa, Yellow fever virus
DATFDYSV

SEQ ID NO: 159450 - protein, 8 aa, Yellow fever virus
ATFDYSVD

SEQ ID NO: 159451 - protein, 8 aa, Yellow fever virus
TFDYSVDC

SEQ ID NO: 159452 - protein, 8 aa, Yellow fever virus
EVNGTWMM

SEQ ID NO: 159453 - protein, 8 aa, Yellow fever virus
VNGTWMMH

SEQ ID NO: 159454 - protein, 8 aa, Yellow fever virus
NGTWMVHT

SEQ ID NO: 159455 - protein, 8 aa, Yellow fever virus
GTWMMHTL

SEQ ID NO: 159456 - protein, 8 aa, Yellow fever virus
TWMMHTLE

SEQ ID NO: 159457 - protein, 8 aa, Yellow fever virus
WMVHTLET

SEQ ID NO: 159458 - protein, 8 aa, Yellow fever virus
MVHTLETL

SEQ ID NO: 159459 - protein, 8 aa, Yellow fever virus
MHTLETLD

SEQ ID NO: 159460 - protein, 8 aa, Yellow fever virus
PLEVRREP

SEQ ID NO: 159461 - protein, 8 aa, Yellow fever virus
LEVRREAC

SEQ ID NO: 159462 - protein, 8 aa, Yellow fever virus
EVRREACP

SEQ ID NO: 159463 - protein, 8 aa, Yellow fever virus
VRREPCPG

SEQ ID NO: 159464 - protein, 8 aa, Yellow fever virus
RREACPGT

SEQ ID NO: 159465 - protein, 8 aa, Yellow fever virus
REVCPGTS

SEQ ID NO: 159466 - protein, 8 aa, Yellow fever virus
EVCPGTSV

SEQ ID NO: 159467 - protein, 8 aa, Yellow fever virus
VCPGTSVV

SEQ ID NO: 159468 - protein, 8 aa, Yellow fever virus
CPGTSVVL

SEQ ID NO: 159469 - protein, 8 aa, Yellow fever virus
PGTSVVLD

SEQ ID NO: 159470 - protein, 8 aa, Yellow fever virus
GTSVVVDS

SEQ ID NO: 159471 - protein, 8 aa, Yellow fever virus
TSVVVDTS

SEQ ID NO: 159472 - protein, 8 aa, Yellow fever virus
SVVLDTGC

SEQ ID NO: 159473 - protein, 8 aa, Yellow fever virus
VVVDTSCD

SEQ ID NO: 159474 - protein, 8 aa, Yellow fever virus
VVDSNCDG

SEQ ID NO: 159475 - protein, 8 aa, Yellow fever virus
LDTGCDGR

SEQ ID NO: 159476 - protein, 8 aa, Yellow fever virus
DTSCDGRG

SEQ ID NO: 159477 - protein, 8 aa, Yellow fever virus
SNCDGRGK

SEQ ID NO: 159478 - protein, 8 aa, Yellow fever virus
SCDGRGKS

SEQ ID NO: 159479 - protein, 8 aa, Yellow fever virus
MEIRPRKA

SEQ ID NO: 159480 - protein, 8 aa, Yellow fever virus
EIRPRKAH

SEQ ID NO: 159481 - protein, 8 aa, Yellow fever virus
IRPRKAHE

SEQ ID NO: 159482 - protein, 8 aa, Yellow fever virus
RPRKAHES

SEQ ID NO: 159483 - protein, 8 aa, Yellow fever virus
PMKTSDSH

SEQ ID NO: 159484 - protein, 8 aa, Yellow fever virus
MKTSDSHL

SEQ ID NO: 159485 - protein, 8 aa, Yellow fever virus
KTSDSHLV

SEQ ID NO: 159486 - protein, 8 aa, Yellow fever virus
TSDSHLVR

SEQ ID NO: 159487 - protein, 8 aa, Yellow fever virus
AMEVVLRR

SEQ ID NO: 159488 - protein, 8 aa, Yellow fever virus
LEVVLRKR

SEQ ID NO: 159489 - protein, 8 aa, Yellow fever virus
RRQGPKQM

SEQ ID NO: 159490 - protein, 8 aa, Yellow fever virus
KQVLVGGV

SEQ ID NO: 159491 - protein, 8 aa, Yellow fever virus
QVLVGGVV

SEQ ID NO: 159492 - protein, 8 aa, Yellow fever virus
VLVGGVVL

SEQ ID NO: 159493 - protein, 8 aa, Yellow fever virus
LVGGMVLL

SEQ ID NO: 159494 - protein, 8 aa, Yellow fever virus
VGGMVLLG

SEQ ID NO: 159495 - protein, 8 aa, Yellow fever virus
GGMVLLGA

SEQ ID NO: 159496 - protein, 8 aa, Yellow fever virus
GMVLLGAM

SEQ ID NO: 159497 - protein, 8 aa, Yellow fever virus
MVLLGAML

SEQ ID NO: 159498 - protein, 8 aa, Yellow fever virus
MLVGQVTM

SEQ ID NO: 159499 - protein, 8 aa, Yellow fever virus
LVGQVTML

SEQ ID NO: 159500 - protein, 8 aa, Yellow fever virus
VGQVTMLD

SEQ ID NO: 159501 - protein, 8 aa, Yellow fever virus
GQVTMLDL

SEQ ID NO: 159502 - protein, 8 aa, Yellow fever virus
QVTMLDLV

SEQ ID NO: 159503 - protein, 8 aa, Yellow fever virus
VTMLDLVK

SEQ ID NO: 159504 - protein, 8 aa, Yellow fever virus
FTVAVGLH

SEQ ID NO: 159505 - protein, 8 aa, Yellow fever virus
VVAVGLHF

SEQ ID NO: 159506 - protein, 8 aa, Yellow fever virus
ALIAAFSV

SEQ ID NO: 159507 - protein, 8 aa, Yellow fever virus
LIAAFSVR

SEQ ID NO: 159508 - protein, 8 aa, Yellow fever virus
IAAFSVRP

SEQ ID NO: 159509 - protein, 8 aa, Yellow fever virus
AAFSVRPG

SEQ ID NO: 159510 - protein, 8 aa, Yellow fever virus
AFSVRPGL

SEQ ID NO: 159511 - protein, 8 aa, Yellow fever virus
SIRPGLLV

SEQ ID NO: 159512 - protein, 8 aa, Yellow fever virus
IRPGLLMG

SEQ ID NO: 159513 - protein, 8 aa, Yellow fever virus
RPGLLMGF

SEQ ID NO: 159514 - protein, 8 aa, Yellow fever virus
PGLLVGFG

SEQ ID NO: 159515 - protein, 8 aa, Yellow fever virus
GLLMGFGL

SEQ ID NO: 159516 - protein, 8 aa, Yellow fever virus
LLMGFGLR

SEQ ID NO: 159517 - protein, 8 aa, Yellow fever virus
LVGFGLRT

SEQ ID NO: 159518 - protein, 8 aa, Yellow fever virus
VGFGLRTL

SEQ ID NO: 159519 - protein, 8 aa, Yellow fever virus
PRERLVLA

SEQ ID NO: 159520 - protein, 8 aa, Yellow fever virus
RERLVLAL

SEQ ID NO: 159521 - protein, 8 aa, Yellow fever virus
ERLVLALG

SEQ ID NO: 159522 - protein, 8 aa, Yellow fever virus
RLVLALGA

SEQ ID NO: 159523 - protein, 8 aa, Yellow fever virus
LVLALGAA

SEQ ID NO: 159524 - protein, 8 aa, Yellow fever virus
VLALGAAM

SEQ ID NO: 159525 - protein, 8 aa, Yellow fever virus
LALGAAMV

SEQ ID NO: 159526 - protein, 8 aa, Yellow fever virus
ALGAAMVE

SEQ ID NO: 159527 - protein, 8 aa, Yellow fever virus
FGAAMVEI

SEQ ID NO: 159528 - protein, 8 aa, Yellow fever virus
VEVALGGM

SEQ ID NO: 159529 - protein, 8 aa, Yellow fever virus
EVALGGMM

SEQ ID NO: 159530 - protein, 8 aa, Yellow fever virus
VALGGMMG

SEQ ID NO: 159531 - protein, 8 aa, Yellow fever virus
GMMGGLWQ

SEQ ID NO: 159532 - protein, 8 aa, Yellow fever virus
MMGGLWQY

SEQ ID NO: 159533 - protein, 8 aa, Yellow fever virus
ASRKASNA

SEQ ID NO: 159534 - protein, 8 aa, Yellow fever virus
SRKASNAV

SEQ ID NO: 159535 - protein, 8 aa, Yellow fever virus
RKASNAVL

SEQ ID NO: 159536 - protein, 8 aa, Yellow fever virus
KASNMILP

SEQ ID NO: 159537 - protein, 8 aa, Yellow fever virus
ASNAVLPL

SEQ ID NO: 159538 - protein, 8 aa, Yellow fever virus
SNMILPLM

SEQ ID NO: 159539 - protein, 8 aa, Yellow fever virus
NAVLPLMA

SEQ ID NO: 159540 - protein, 8 aa, Yellow fever virus
MILPLMAL

SEQ ID NO: 159541 - protein, 8 aa, Yellow fever virus
ILPLMALM

SEQ ID NO: 159542 - protein, 8 aa, Yellow fever virus
LLTPVTMY

SEQ ID NO: 159543 - protein, 8 aa, Yellow fever virus
LTPVTMYE

SEQ ID NO: 159544 - protein, 8 aa, Yellow fever virus
TPMTMHEV

SEQ ID NO: 159545 - protein, 8 aa, Yellow fever virus
PVTMHEVR

SEQ ID NO: 159546 - protein, 8 aa, Yellow fever virus
VTMHEVRM

SEQ ID NO: 159547 - protein, 8 aa, Yellow fever virus
TMYEVRMA

SEQ ID NO: 159548 - protein, 8 aa, Yellow fever virus
MHEVRMAT

SEQ ID NO: 159549 - protein, 8 aa, Yellow fever virus
HEVRMATM

SEQ ID NO: 159550 - protein, 8 aa, Yellow fever virus
EVRLAAML

SEQ ID NO: 159551 - protein, 8 aa, Yellow fever virus
VRLATMLF

SEQ ID NO: 159552 - protein, 8 aa, Yellow fever virus
RLAAMLFC

SEQ ID NO: 159553 - protein, 8 aa, Yellow fever virus
AAMLFCAV

SEQ ID NO: 159554 - protein, 8 aa, Yellow fever virus
AMLFCAVV

SEQ ID NO: 159555 - protein, 8 aa, Yellow fever virus
MLFCAVVI

SEQ ID NO: 159556 - protein, 8 aa, Yellow fever virus
LFCAVVII

SEQ ID NO: 159557 - protein, 8 aa, Yellow fever virus
FCTVVIVG

SEQ ID NO: 159558 - protein, 8 aa, Yellow fever virus
CTVVIVGV

SEQ ID NO: 159559 - protein, 8 aa, Yellow fever virus
TVVIVGVL

SEQ ID NO: 159560 - protein, 8 aa, Yellow fever virus
VVIIGVLY

SEQ ID NO: 159561 - protein, 8 aa, Yellow fever virus
VIIGVLYQ

SEQ ID NO: 159562 - protein, 8 aa, Yellow fever virus
IIGVLYQN

SEQ ID NO: 159563 - protein, 8 aa, Yellow fever virus
IGVLYQNS

SEQ ID NO: 159564 - protein, 8 aa, Yellow fever virus
GVLYQNSK

SEQ ID NO: 159565 - protein, 8 aa, Yellow fever virus
VLYQNSKD

SEQ ID NO: 159566 - protein, 8 aa, Yellow fever virus
LYQNSKDT

SEQ ID NO: 159567 - protein, 8 aa, Yellow fever virus
HQNAKDTS

SEQ ID NO: 159568 - protein, 8 aa, Yellow fever virus
QNAKDTSM

SEQ ID NO: 159569 - protein, 8 aa, Yellow fever virus
NAKDTSMQ

SEQ ID NO: 159570 - protein, 8 aa, Yellow fever virus
AKDTSMQK

SEQ ID NO: 159571 - protein, 8 aa, Yellow fever virus
CAFLATRL

SEQ ID NO: 159572 - protein, 8 aa, Yellow fever virus
AFLATRLF

SEQ ID NO: 159573 - protein, 8 aa, Yellow fever virus
FLATRLFG

SEQ ID NO: 159574 - protein, 8 aa, Yellow fever virus
LATRLFGR

SEQ ID NO: 159575 - protein, 8 aa, Yellow fever virus
ATRLFGRR

SEQ ID NO: 159576 - protein, 8 aa, Yellow fever virus
TRLFGRRS

SEQ ID NO: 159577 - protein, 8 aa, Yellow fever virus
RLFGRRSI

SEQ ID NO: 159578 - protein, 8 aa, Yellow fever virus
LFGRRSIP

SEQ ID NO: 159579 - protein, 8 aa, Yellow fever virus
RVDGLELR

SEQ ID NO: 159580 - protein, 8 aa, Yellow fever virus
ELKKLGEI

SEQ ID NO: 159581 - protein, 8 aa, Yellow fever virus
LKKLGEVA

SEQ ID NO: 159582 - protein, 8 aa, Yellow fever virus
KKLGEISW

SEQ ID NO: 159583 - protein, 8 aa, Yellow fever virus
KLGEVAWE

SEQ ID NO: 159584 - protein, 8 aa, Yellow fever virus
LGEVAWEE

SEQ ID NO: 159585 - protein, 8 aa, Yellow fever virus
GEVAWEEE

SEQ ID NO: 159586 - protein, 8 aa, Yellow fever virus
EVAWEEEA

SEQ ID NO: 159587 - protein, 8 aa, Yellow fever virus
VAWEEEAE

SEQ ID NO: 159588 - protein, 8 aa, Yellow fever virus
ARYDVALN

SEQ ID NO: 159589 - protein, 8 aa, Yellow fever virus
VGAAIHPS

SEQ ID NO: 159590 - protein, 8 aa, Yellow fever virus
GAAIHPSA

SEQ ID NO: 159591 - protein, 8 aa, Yellow fever virus
AAIHPSAL

SEQ ID NO: 159592 - protein, 8 aa, Yellow fever virus
AIHPSALL

SEQ ID NO: 159593 - protein, 8 aa, Yellow fever virus
IHPSALLL

SEQ ID NO: 159594 - protein, 8 aa, Yellow fever virus
SALLLVLA

SEQ ID NO: 159595 - protein, 8 aa, Yellow fever virus
LLVLGGWI

SEQ ID NO: 159596 - protein, 8 aa, Yellow fever virus
LVLGGWIL

SEQ ID NO: 159597 - protein, 8 aa, Yellow fever virus
VLGGWILH

SEQ ID NO: 159598 - protein, 8 aa, Yellow fever virus
LGGWILHI

SEQ ID NO: 159599 - protein, 8 aa, Yellow fever virus
GGWVLHIK

SEQ ID NO: 159600 - protein, 8 aa, Yellow fever virus
GWLFHVRR

SEQ ID NO: 159601 - protein, 8 aa, Yellow fever virus
WVLHIKGA

SEQ ID NO: 159602 - protein, 8 aa, Yellow fever virus
VLHIKGAR

SEQ ID NO: 159603 - protein, 8 aa, Yellow fever virus
FHVKGARR

SEQ ID NO: 159604 - protein, 8 aa, Yellow fever virus
HIKGARRS

SEQ ID NO: 159605 - protein, 8 aa, Yellow fever virus
VKGARRSG

SEQ ID NO: 159606 - protein, 8 aa, Yellow fever virus
RRARRSGD

SEQ ID NO: 159607 - protein, 8 aa, Yellow fever virus
KVIEECEY

SEQ ID NO: 159608 - protein, 8 aa, Yellow fever virus
VIEECEYL

SEQ ID NO: 159609 - protein, 8 aa, Yellow fever virus
EYLEDGIY

SEQ ID NO: 159610 - protein, 8 aa, Yellow fever virus
YLEDGIYG

SEQ ID NO: 159611 - protein, 8 aa, Yellow fever virus
TRGAFLVW

SEQ ID NO: 159612 - protein, 8 aa, Yellow fever virus
RGAFLVWN

SEQ ID NO: 159613 - protein, 8 aa, Yellow fever virus
GAFLVWNG

SEQ ID NO: 159614 - protein, 8 aa, Yellow fever virus
AFLVWNGK

SEQ ID NO: 159615 - protein, 8 aa, Yellow fever virus
FLVWNGKK

SEQ ID NO: 159616 - protein, 8 aa, Yellow fever virus
LVWNGKKL

SEQ ID NO: 159617 - protein, 8 aa, Yellow fever virus
VWNGKKLI

SEQ ID NO: 159618 - protein, 8 aa, Yellow fever virus
WNGKKLIP

SEQ ID NO: 159619 - protein, 8 aa, Yellow fever virus
GSWKLDGR

SEQ ID NO: 159620 - protein, 8 aa, Yellow fever virus
SWKLDGRW

SEQ ID NO: 159621 - protein, 8 aa, Yellow fever virus
WKLDGRWD

SEQ ID NO: 159622 - protein, 8 aa, Yellow fever virus
KLDGRWDG

SEQ ID NO: 159623 - protein, 8 aa, Yellow fever virus
LDGRWDGE

SEQ ID NO: 159624 - protein, 8 aa, Yellow fever virus
DGRWDGEE

SEQ ID NO: 159625 - protein, 8 aa, Yellow fever virus
IAAVPGKS

SEQ ID NO: 159626 - protein, 8 aa, Yellow fever virus
AAVPGKSV

SEQ ID NO: 159627 - protein, 8 aa, Yellow fever virus
AVPGKSVV

SEQ ID NO: 159628 - protein, 8 aa, Yellow fever virus
APGKNVVN

SEQ ID NO: 159629 - protein, 8 aa, Yellow fever virus
PGKSVVNV

SEQ ID NO: 159630 - protein, 8 aa, Yellow fever virus
GKSVVNVQ

SEQ ID NO: 159631 - protein, 8 aa, Yellow fever virus
KSVVNVQT

SEQ ID NO: 159632 - protein, 8 aa, Yellow fever virus
SVVNVQTK

SEQ ID NO: 159633 - protein, 8 aa, Yellow fever virus
QTKPSLFR

SEQ ID NO: 159634 - protein, 8 aa, Yellow fever virus
TKPSVFKV

SEQ ID NO: 159635 - protein, 8 aa, Yellow fever virus
KPSVFKVR

SEQ ID NO: 159636 - protein, 8 aa, Yellow fever virus
PSVFKVRN

SEQ ID NO: 159637 - protein, 8 aa, Yellow fever virus
SLFRVKNG

SEQ ID NO: 159638 - protein, 8 aa, Yellow fever virus
LFRVKNGG

SEQ ID NO: 159639 - protein, 8 aa, Yellow fever virus
VNRNGEVV

SEQ ID NO: 159640 - protein, 8 aa, Yellow fever virus
NRNGEVVG

SEQ ID NO: 159641 - protein, 8 aa, Yellow fever virus
RNGEVVGL

SEQ ID NO: 159642 - protein, 8 aa, Yellow fever virus
NGEVVGLY

SEQ ID NO: 159643 - protein, 8 aa, Yellow fever virus
QTELKEES

SEQ ID NO: 159644 - protein, 8 aa, Yellow fever virus
TELKEESK

SEQ ID NO: 159645 - protein, 8 aa, Yellow fever virus
ELKEESKE

SEQ ID NO: 159646 - protein, 8 aa, Yellow fever virus
LKEESKEE

SEQ ID NO: 159647 - protein, 8 aa, Yellow fever virus
EEGKEELR

SEQ ID NO: 159648 - protein, 8 aa, Yellow fever virus
ESKEELQE

SEQ ID NO: 159649 - protein, 8 aa, Yellow fever virus
SKEELQEI

SEQ ID NO: 159650 - protein, 8 aa, Yellow fever virus
KEELQEIS

SEQ ID NO: 159651 - protein, 8 aa, Yellow fever virus
EELQEIST

SEQ ID NO: 159652 - protein, 8 aa, Yellow fever virus
ELQEISTM

SEQ ID NO: 159653 - protein, 8 aa, Yellow fever virus
LQEISTML

SEQ ID NO: 159654 - protein, 8 aa, Yellow fever virus
QEISTMLK

SEQ ID NO: 159655 - protein, 8 aa, Yellow fever virus
STMLKKGM

SEQ ID NO: 159656 - protein, 8 aa, Yellow fever virus
LKKGKTTI

SEQ ID NO: 159657 - protein, 8 aa, Yellow fever virus
KKGKTTIL

SEQ ID NO: 159658 - protein, 8 aa, Yellow fever virus
KGKTTILD

SEQ ID NO: 159659 - protein, 8 aa, Yellow fever virus
GKTTILDF

SEQ ID NO: 159660 - protein, 8 aa, Yellow fever virus
KTTILDFH

SEQ ID NO: 159661 - protein, 8 aa, Yellow fever virus
TTILDYHP

SEQ ID NO: 159662 - protein, 8 aa, Yellow fever virus
TILDYHPG

SEQ ID NO: 159663 - protein, 8 aa, Yellow fever virus
ILDYHPGA

SEQ ID NO: 159664 - protein, 8 aa, Yellow fever virus
SGREVIDV

SEQ ID NO: 159665 - protein, 8 aa, Yellow fever virus
GREVIDVM

SEQ ID NO: 159666 - protein, 8 aa, Yellow fever virus
REVIDVMC

SEQ ID NO: 159667 - protein, 8 aa, Yellow fever virus
RMLEPTRA

SEQ ID NO: 159668 - protein, 8 aa, Yellow fever virus
MLEPTRAV

SEQ ID NO: 159669 - protein, 8 aa, Yellow fever virus
LEPTRAVN

SEQ ID NO: 159670 - protein, 8 aa, Yellow fever virus
EPTRAVNW

SEQ ID NO: 159671 - protein, 8 aa, Yellow fever virus
PTRAVNWE

SEQ ID NO: 159672 - protein, 8 aa, Yellow fever virus
TRAVNWEV

SEQ ID NO: 159673 - protein, 8 aa, Yellow fever virus
RAVNWEVI

SEQ ID NO: 159674 - protein, 8 aa, Yellow fever virus
AVNWEVII

SEQ ID NO: 159675 - protein, 8 aa, Yellow fever virus
IPSEPWTA

SEQ ID NO: 159676 - protein, 8 aa, Yellow fever virus
PSEPWTAG

SEQ ID NO: 159677 - protein, 8 aa, Yellow fever virus
SEPWTAGH

SEQ ID NO: 159678 - protein, 8 aa, Yellow fever virus
EPWTAGHE

SEQ ID NO: 159679 - protein, 8 aa, Yellow fever virus
PWTAGHEW

SEQ ID NO: 159680 - protein, 8 aa, Yellow fever virus
WTAGHEWI

SEQ ID NO: 159681 - protein, 8 aa, Yellow fever virus
TAGHEWIL

SEQ ID NO: 159682 - protein, 8 aa, Yellow fever virus
AGHEWILA

SEQ ID NO: 159683 - protein, 8 aa, Yellow fever virus
PLYGVEGI

SEQ ID NO: 159684 - protein, 8 aa, Yellow fever virus
LYGVEGIK

SEQ ID NO: 159685 - protein, 8 aa, Yellow fever virus
YGVEGIKT

SEQ ID NO: 159686 - protein, 8 aa, Yellow fever virus
GVEGIKTP

SEQ ID NO: 159687 - protein, 8 aa, Yellow fever virus
VEGIKTPV

SEQ ID NO: 159688 - protein, 8 aa, Yellow fever virus
RDDQRRVS

SEQ ID NO: 159689 - protein, 8 aa, Yellow fever virus
DDQRRVSR

SEQ ID NO: 159690 - protein, 8 aa, Yellow fever virus
DQRRVSRE

SEQ ID NO: 159691 - protein, 8 aa, Yellow fever virus
QRRVSREL

SEQ ID NO: 159692 - protein, 8 aa, Yellow fever virus
RRVSRELV

SEQ ID NO: 159693 - protein, 8 aa, Yellow fever virus
RVSRELVR

SEQ ID NO: 159694 - protein, 8 aa, Yellow fever virus
VSRELVRN

SEQ ID NO: 159695 - protein, 8 aa, Yellow fever virus
SRELVRNC

SEQ ID NO: 159696 - protein, 8 aa, Yellow fever virus
ELVRNCDQ

SEQ ID NO: 159697 - protein, 8 aa, Yellow fever virus
LVRNCDQP

SEQ ID NO: 159698 - protein, 8 aa, Yellow fever virus
VRNCDQPV

SEQ ID NO: 159699 - protein, 8 aa, Yellow fever virus
RNCDQPVW

SEQ ID NO: 159700 - protein, 8 aa, Yellow fever virus
NCDQPVWL

SEQ ID NO: 159701 - protein, 8 aa, Yellow fever virus
CDLPVWLA

SEQ ID NO: 159702 - protein, 8 aa, Yellow fever virus
DLPVWLAW

SEQ ID NO: 159703 - protein, 8 aa, Yellow fever virus
QPVWLSWQ

SEQ ID NO: 159704 - protein, 8 aa, Yellow fever virus
LAWQVAKA

SEQ ID NO: 159705 - protein, 8 aa, Yellow fever virus
AWQVAKAG

SEQ ID NO: 159706 - protein, 8 aa, Yellow fever virus
KWCFEGPD

SEQ ID NO: 159707 - protein, 8 aa, Yellow fever virus
WCFDGPKE

SEQ ID NO: 159708 - protein, 8 aa, Yellow fever virus
CFEGPDEH

SEQ ID NO: 159709 - protein, 8 aa, Yellow fever virus
FEGPDEHE

SEQ ID NO: 159710 - protein, 8 aa, Yellow fever virus
EGPDEHEI

SEQ ID NO: 159711 - protein, 8 aa, Yellow fever virus
GPKEHEIL

SEQ ID NO: 159712 - protein, 8 aa, Yellow fever virus
PDEHEILN

SEQ ID NO: 159713 - protein, 8 aa, Yellow fever virus
DEHEILND

SEQ ID NO: 159714 - protein, 8 aa, Yellow fever virus
GETVKCRT

SEQ ID NO: 159715 - protein, 8 aa, Yellow fever virus
ETVKCRTP

SEQ ID NO: 159716 - protein, 8 aa, Yellow fever virus
TVKCRTPG

SEQ ID NO: 159717 - protein, 8 aa, Yellow fever virus
VKCRTPGG

SEQ ID NO: 159718 - protein, 8 aa, Yellow fever virus
KCRTPGGA

SEQ ID NO: 159719 - protein, 8 aa, Yellow fever virus
CRTPGGAK

SEQ ID NO: 159720 - protein, 8 aa, Yellow fever virus
RTPGGAKK

SEQ ID NO: 159721 - protein, 8 aa, Yellow fever virus
TPGGAKKP

SEQ ID NO: 159722 - protein, 8 aa, Yellow fever virus
PGGAKRPL

SEQ ID NO: 159723 - protein, 8 aa, Yellow fever virus
GGAKRALR

SEQ ID NO: 159724 - protein, 8 aa, Yellow fever virus
GAKRALRP

SEQ ID NO: 159725 - protein, 8 aa, Yellow fever virus
AKRALRPR

SEQ ID NO: 159726 - protein, 8 aa, Yellow fever virus
KRPLRPRW

SEQ ID NO: 159727 - protein, 8 aa, Yellow fever virus
RALRPRWC

SEQ ID NO: 159728 - protein, 8 aa, Yellow fever virus
GRRGAAEI

SEQ ID NO: 159729 - protein, 8 aa, Yellow fever virus
RRGAAEIL

SEQ ID NO: 159730 - protein, 8 aa, Yellow fever virus
RGAADVLV

SEQ ID NO: 159731 - protein, 8 aa, Yellow fever virus
GAAEMLVI

SEQ ID NO: 159732 - protein, 8 aa, Yellow fever virus
AAEMLVIL

SEQ ID NO: 159733 - protein, 8 aa, Yellow fever virus
AEILVVLS

SEQ ID NO: 159734 - protein, 8 aa, Yellow fever virus
EILVVLSE

SEQ ID NO: 159735 - protein, 8 aa, Yellow fever virus
MLVILTEL

SEQ ID NO: 159736 - protein, 8 aa, Yellow fever virus
LVILTELP

SEQ ID NO: 159737 - protein, 8 aa, Yellow fever virus
VILTELPD

SEQ ID NO: 159738 - protein, 8 aa, Yellow fever virus
ILTELPDF

SEQ ID NO: 159739 - protein, 8 aa, Yellow fever virus
MTIAMLFI

SEQ ID NO: 159740 - protein, 8 aa, Yellow fever virus
TIAMLFIL

SEQ ID NO: 159741 - protein, 8 aa, Yellow fever virus
IAMLFILA

SEQ ID NO: 159742 - protein, 8 aa, Yellow fever virus
AMLFILAG

SEQ ID NO: 159743 - protein, 8 aa, Yellow fever virus
ISRMSMAK

SEQ ID NO: 159744 - protein, 8 aa, Yellow fever virus
AKGTMAGC

SEQ ID NO: 159745 - protein, 8 aa, Yellow fever virus
KGTMAGCG

SEQ ID NO: 159746 - protein, 8 aa, Yellow fever virus
LMFLGGAK

SEQ ID NO: 159747 - protein, 8 aa, Yellow fever virus
MFLGGVEP

SEQ ID NO: 159748 - protein, 8 aa, Yellow fever virus
FLGGVEPT

SEQ ID NO: 159749 - protein, 8 aa, Yellow fever virus
LGGAKPTH

SEQ ID NO: 159750 - protein, 8 aa, Yellow fever virus
GGAKPTHI

SEQ ID NO: 159751 - protein, 8 aa, Yellow fever virus
GVEPTHIS

SEQ ID NO: 159752 - protein, 8 aa, Yellow fever virus
AKPTHISY

SEQ ID NO: 159753 - protein, 8 aa, Yellow fever virus
EPTHISYI

SEQ ID NO: 159754 - protein, 8 aa, Yellow fever virus
GILTLLSV

SEQ ID NO: 159755 - protein, 8 aa, Yellow fever virus
ILTLLSVV

SEQ ID NO: 159756 - protein, 8 aa, Yellow fever virus
LTLLSVVA

SEQ ID NO: 159757 - protein, 8 aa, Yellow fever virus
TLLSVVAA

SEQ ID NO: 159758 - protein, 8 aa, Yellow fever virus
LLSVVAAN

SEQ ID NO: 159759 - protein, 8 aa, Yellow fever virus
LSVVAANE

SEQ ID NO: 159760 - protein, 8 aa, Yellow fever virus
SIVAANEL

SEQ ID NO: 159761 - protein, 8 aa, Yellow fever virus
IVAANELG

SEQ ID NO: 159762 - protein, 8 aa, Yellow fever virus
LERTKEDL

SEQ ID NO: 159763 - protein, 8 aa, Yellow fever virus
ERTKEDLF

SEQ ID NO: 159764 - protein, 8 aa, Yellow fever virus
RTKEDLFG

SEQ ID NO: 159765 - protein, 8 aa, Yellow fever virus
TKEDFFGR

SEQ ID NO: 159766 - protein, 8 aa, Yellow fever virus
KEDFFGRR

SEQ ID NO: 159767 - protein, 8 aa, Yellow fever virus
EDFFGKRD

SEQ ID NO: 159768 - protein, 8 aa, Yellow fever virus
TPSGAIPW

SEQ ID NO: 159769 - protein, 8 aa, Yellow fever virus
PSGASPWS

SEQ ID NO: 159770 - protein, 8 aa, Yellow fever virus
SGASPWSW

SEQ ID NO: 159771 - protein, 8 aa, Yellow fever virus
GAIPWSWP

SEQ ID NO: 159772 - protein, 8 aa, Yellow fever virus
AIPWSWPD

SEQ ID NO: 159773 - protein, 8 aa, Yellow fever virus
KMNISVVI

SEQ ID NO: 159774 - protein, 8 aa, Yellow fever virus
MNISVVIL

SEQ ID NO: 159775 - protein, 8 aa, Yellow fever virus
NISVVILL

SEQ ID NO: 159776 - protein, 8 aa, Yellow fever virus
ISVVILLV

SEQ ID NO: 159777 - protein, 8 aa, Yellow fever virus
SVVILLVS

SEQ ID NO: 159778 - protein, 8 aa, Yellow fever virus
VVILLVSG

SEQ ID NO: 159779 - protein, 8 aa, Yellow fever virus
VILLVSGW

SEQ ID NO: 159780 - protein, 8 aa, Yellow fever virus
MLLISGWN

SEQ ID NO: 159781 - protein, 8 aa, Yellow fever virus
VIPLLCGI

SEQ ID NO: 159782 - protein, 8 aa, Yellow fever virus
IPLLCGIG

SEQ ID NO: 159783 - protein, 8 aa, Yellow fever virus
PLLCGIGG

SEQ ID NO: 159784 - protein, 8 aa, Yellow fever virus
LLCGIGGA

SEQ ID NO: 159785 - protein, 8 aa, Yellow fever virus
LCGIGGAM

SEQ ID NO: 159786 - protein, 8 aa, Yellow fever virus
CGIGCATL

SEQ ID NO: 159787 - protein, 8 aa, Yellow fever virus
GIGCATLH

SEQ ID NO: 159788 - protein, 8 aa, Yellow fever virus
IGCATLHW

SEQ ID NO: 159789 - protein, 8 aa, Yellow fever virus
GCAMLHWT

SEQ ID NO: 159790 - protein, 8 aa, Yellow fever virus
CAMLHWTL

SEQ ID NO: 159791 - protein, 8 aa, Yellow fever virus
ATLHWSLI

SEQ ID NO: 159792 - protein, 8 aa, Yellow fever virus
TLHWSLIL

SEQ ID NO: 159793 - protein, 8 aa, Yellow fever virus
QQSKLPQR

SEQ ID NO: 159794 - protein, 8 aa, Yellow fever virus
QSKLPQRR

SEQ ID NO: 159795 - protein, 8 aa, Yellow fever virus
SKLPQRRV

SEQ ID NO: 159796 - protein, 8 aa, Yellow fever virus
KLPQRRVF

SEQ ID NO: 159797 - protein, 8 aa, Yellow fever virus
LPQRRVFH

SEQ ID NO: 159798 - protein, 8 aa, Yellow fever virus
PQRRVFHG

SEQ ID NO: 159799 - protein, 8 aa, Yellow fever virus
LLLALSLS

SEQ ID NO: 159800 - protein, 8 aa, Yellow fever virus
LLALSLSS

SEQ ID NO: 159801 - protein, 8 aa, Yellow fever virus
LALSLSSV

SEQ ID NO: 159802 - protein, 8 aa, Yellow fever virus
ALSLSSVA

SEQ ID NO: 159803 - protein, 8 aa, Yellow fever virus
LSLSSVAM

SEQ ID NO: 159804 - protein, 8 aa, Yellow fever virus
SLSSVAMC

SEQ ID NO: 159805 - protein, 8 aa, Yellow fever virus
LSSVAMCR

SEQ ID NO: 159806 - protein, 8 aa, Yellow fever virus
SSVAMCRT

SEQ ID NO: 159807 - protein, 8 aa, Yellow fever virus
LDEGIVLA

SEQ ID NO: 159808 - protein, 8 aa, Yellow fever virus
DEGIVLAS

SEQ ID NO: 159809 - protein, 8 aa, Yellow fever virus
IVLSSAAL

SEQ ID NO: 159810 - protein, 8 aa, Yellow fever virus
VLSSAALG

SEQ ID NO: 159811 - protein, 8 aa, Yellow fever virus
LSSAALGP

SEQ ID NO: 159812 - protein, 8 aa, Yellow fever virus
SSAALGPL

SEQ ID NO: 159813 - protein, 8 aa, Yellow fever virus
YYAFVGVA

SEQ ID NO: 159814 - protein, 8 aa, Yellow fever virus
AYNLWKMK

SEQ ID NO: 159815 - protein, 8 aa, Yellow fever virus
NLWKMKTE

SEQ ID NO: 159816 - protein, 8 aa, Yellow fever virus
LWKMKTER

SEQ ID NO: 159817 - protein, 8 aa, Yellow fever virus
WKMKTARR

SEQ ID NO: 159818 - protein, 8 aa, Yellow fever virus
KMKTERRG

SEQ ID NO: 159819 - protein, 8 aa, Yellow fever virus
RRGTANGK

SEQ ID NO: 159820 - protein, 8 aa, Yellow fever virus
RGTANGKT

SEQ ID NO: 159821 - protein, 8 aa, Yellow fever virus
GSASGKTL

SEQ ID NO: 159822 - protein, 8 aa, Yellow fever virus
TANGKTLG

SEQ ID NO: 159823 - protein, 8 aa, Yellow fever virus
ELNLLDRQ

SEQ ID NO: 159824 - protein, 8 aa, Yellow fever virus
LNLLDRQQ

SEQ ID NO: 159825 - protein, 8 aa, Yellow fever virus
NLLDRQQF

SEQ ID NO: 159826 - protein, 8 aa, Yellow fever virus
LLDRQQFE

SEQ ID NO: 159827 - protein, 8 aa, Yellow fever virus
LDKQQFEM

SEQ ID NO: 159828 - protein, 8 aa, Yellow fever virus
DRQQFELY

SEQ ID NO: 159829 - protein, 8 aa, Yellow fever virus
RQQFELYK

SEQ ID NO: 159830 - protein, 8 aa, Yellow fever virus
QQFEMYKR

SEQ ID NO: 159831 - protein, 8 aa, Yellow fever virus
MYKRTDII

SEQ ID NO: 159832 - protein, 8 aa, Yellow fever virus
YKRTDIIE

SEQ ID NO: 159833 - protein, 8 aa, Yellow fever virus
KRTDIIEV

SEQ ID NO: 159834 - protein, 8 aa, Yellow fever virus
RTDIIEVD

SEQ ID NO: 159835 - protein, 8 aa, Yellow fever virus
TDIIEVDR

SEQ ID NO: 159836 - protein, 8 aa, Yellow fever virus
DIIEVDRD

SEQ ID NO: 159837 - protein, 8 aa, Yellow fever virus
IIEVDRDM

SEQ ID NO: 159838 - protein, 8 aa, Yellow fever virus
IEVDRDMA

SEQ ID NO: 159839 - protein, 8 aa, Yellow fever virus
VKLEGRVM

SEQ ID NO: 159840 - protein, 8 aa, Yellow fever virus
KLEGRVMD

SEQ ID NO: 159841 - protein, 8 aa, Yellow fever virus
LEGRVMDL

SEQ ID NO: 159842 - protein, 8 aa, Yellow fever virus
EGRVMDLG

SEQ ID NO: 159843 - protein, 8 aa, Yellow fever virus
GRVMDLGC

SEQ ID NO: 159844 - protein, 8 aa, Yellow fever virus
RVMDLGCG

SEQ ID NO: 159845 - protein, 8 aa, Yellow fever virus
VMDLGCGR

SEQ ID NO: 159846 - protein, 8 aa, Yellow fever virus
MDLGCGRG

SEQ ID NO: 159847 - protein, 8 aa, Yellow fever virus
KGFTLGRE

SEQ ID NO: 159848 - protein, 8 aa, Yellow fever virus
GFTLGREG

SEQ ID NO: 159849 - protein, 8 aa, Yellow fever virus
FTLGREGH

SEQ ID NO: 159850 - protein, 8 aa, Yellow fever virus
RSLGWNII

SEQ ID NO: 159851 - protein, 8 aa, Yellow fever virus
KDKTDVHR

SEQ ID NO: 159852 - protein, 8 aa, Yellow fever virus
DKTDVHPL

SEQ ID NO: 159853 - protein, 8 aa, Yellow fever virus
KTDVHPLE

SEQ ID NO: 159854 - protein, 8 aa, Yellow fever virus
TDIHRLES

SEQ ID NO: 159855 - protein, 8 aa, Yellow fever virus
LEPMKCDT

SEQ ID NO: 159856 - protein, 8 aa, Yellow fever virus
EPMKCDTL

SEQ ID NO: 159857 - protein, 8 aa, Yellow fever virus
PLKCETLL

SEQ ID NO: 159858 - protein, 8 aa, Yellow fever virus
LKCETLLC

SEQ ID NO: 159859 - protein, 8 aa, Yellow fever virus
GESSPSSA

SEQ ID NO: 159860 - protein, 8 aa, Yellow fever virus
ESSSSSIT

SEQ ID NO: 159861 - protein, 8 aa, Yellow fever virus
SSPSSATE

SEQ ID NO: 159862 - protein, 8 aa, Yellow fever virus
SPSSATEG

SEQ ID NO: 159863 - protein, 8 aa, Yellow fever virus
PSSATEGE

SEQ ID NO: 159864 - protein, 8 aa, Yellow fever virus
SSATEGER

SEQ ID NO: 159865 - protein, 8 aa, Yellow fever virus
SATEGERT

SEQ ID NO: 159866 - protein, 8 aa, Yellow fever virus
VTEGERTL

SEQ ID NO: 159867 - protein, 8 aa, Yellow fever virus
TEGERTLR

SEQ ID NO: 159868 - protein, 8 aa, Yellow fever virus
EGERTLRV

SEQ ID NO: 159869 - protein, 8 aa, Yellow fever virus
GERTLRVL

SEQ ID NO: 159870 - protein, 8 aa, Yellow fever virus
ERTLRVLE

SEQ ID NO: 159871 - protein, 8 aa, Yellow fever virus
RTLRVLET

SEQ ID NO: 159872 - protein, 8 aa, Yellow fever virus
TLRVLDTV

SEQ ID NO: 159873 - protein, 8 aa, Yellow fever virus
LRVLETIE

SEQ ID NO: 159874 - protein, 8 aa, Yellow fever virus
RVLETVEK

SEQ ID NO: 159875 - protein, 8 aa, Yellow fever virus
VLETVEKW

SEQ ID NO: 159876 - protein, 8 aa, Yellow fever virus
LETIEKWL

SEQ ID NO: 159877 - protein, 8 aa, Yellow fever virus
ETVEKWLA

SEQ ID NO: 159878 - protein, 8 aa, Yellow fever virus
APYMRDVL

SEQ ID NO: 159879 - protein, 8 aa, Yellow fever virus
PYMRDVLE

SEQ ID NO: 159880 - protein, 8 aa, Yellow fever virus
YMRDVLEK

SEQ ID NO: 159881 - protein, 8 aa, Yellow fever virus
MRDVLEKL

SEQ ID NO: 159882 - protein, 8 aa, Yellow fever virus
RDVLEKLE

SEQ ID NO: 159883 - protein, 8 aa, Yellow fever virus
VTLEPDVI

SEQ ID NO: 159884 - protein, 8 aa, Yellow fever virus
TLEPDVIL

SEQ ID NO: 159885 - protein, 8 aa, Yellow fever virus
LEADVTLP

SEQ ID NO: 159886 - protein, 8 aa, Yellow fever virus
EADVTLPI

SEQ ID NO: 159887 - protein, 8 aa, Yellow fever virus
ADVTLPIG

SEQ ID NO: 159888 - protein, 8 aa, Yellow fever virus
TDKGPLNR

SEQ ID NO: 159889 - protein, 8 aa, Yellow fever virus
EAIKERVE

SEQ ID NO: 159890 - protein, 8 aa, Yellow fever virus
ERVERIKN

SEQ ID NO: 159891 - protein, 8 aa, Yellow fever virus
RVERIKNE

SEQ ID NO: 159892 - protein, 8 aa, Yellow fever virus
VERIKNEY

SEQ ID NO: 159893 - protein, 8 aa, Yellow fever virus
ERIKNEYA

SEQ ID NO: 159894 - protein, 8 aa, Yellow fever virus
RIKNEYAT

SEQ ID NO: 159895 - protein, 8 aa, Yellow fever virus
IKTEYAAT

SEQ ID NO: 159896 - protein, 8 aa, Yellow fever virus
KTEYAATW

SEQ ID NO: 159897 - protein, 8 aa, Yellow fever virus
TEYAATWF

SEQ ID NO: 159898 - protein, 8 aa, Yellow fever virus
EYATTWFY

SEQ ID NO: 159899 - protein, 8 aa, Yellow fever virus
YATTWFYD

SEQ ID NO: 159900 - protein, 8 aa, Yellow fever virus
AATWFYDN

SEQ ID NO: 159901 - protein, 8 aa, Yellow fever virus
ATWFYDND

SEQ ID NO: 159902 - protein, 8 aa, Yellow fever virus
TWFHDNDN

SEQ ID NO: 159903 - protein, 8 aa, Yellow fever virus
MVNGVIKL

SEQ ID NO: 159904 - protein, 8 aa, Yellow fever virus
VNGVIKLL

SEQ ID NO: 159905 - protein, 8 aa, Yellow fever virus
GVIKLLTY

SEQ ID NO: 159906 - protein, 8 aa, Yellow fever virus
VIKLLTYP

SEQ ID NO: 159907 - protein, 8 aa, Yellow fever virus
IKLLTYPW

SEQ ID NO: 159908 - protein, 8 aa, Yellow fever virus
KLLTYPWD

SEQ ID NO: 159909 - protein, 8 aa, Yellow fever virus
ILTYPWDK

SEQ ID NO: 159910 - protein, 8 aa, Yellow fever virus
LTYPWDKI

SEQ ID NO: 159911 - protein, 8 aa, Yellow fever virus
TYPWDKIE

SEQ ID NO: 159912 - protein, 8 aa, Yellow fever virus
YPWDKIEE

SEQ ID NO: 159913 - protein, 8 aa, Yellow fever virus
RHLAREKK

SEQ ID NO: 159914 - protein, 8 aa, Yellow fever virus
HLAREKKP

SEQ ID NO: 159915 - protein, 8 aa, Yellow fever virus
LSREKNPR

SEQ ID NO: 159916 - protein, 8 aa, Yellow fever virus
AREKKPRL

SEQ ID NO: 159917 - protein, 8 aa, Yellow fever virus
REKKPRLC

SEQ ID NO: 159918 - protein, 8 aa, Yellow fever virus
EKKPRLCT

SEQ ID NO: 159919 - protein, 8 aa, Yellow fever virus
KKPRLCTK

SEQ ID NO: 159920 - protein, 8 aa, Yellow fever virus
KPRLCTKE

SEQ ID NO: 159921 - protein, 8 aa, Yellow fever virus
SHAAIGAF

SEQ ID NO: 159922 - protein, 8 aa, Yellow fever virus
HAAIGAFL

SEQ ID NO: 159923 - protein, 8 aa, Yellow fever virus
AAIGAFLE

SEQ ID NO: 159924 - protein, 8 aa, Yellow fever virus
AIGAFLEE

SEQ ID NO: 159925 - protein, 8 aa, Yellow fever virus
IGAFLEEQ

SEQ ID NO: 159926 - protein, 8 aa, Yellow fever virus
GAYLEEQD

SEQ ID NO: 159927 - protein, 8 aa, Yellow fever virus
AYLEEQDQ

SEQ ID NO: 159928 - protein, 8 aa, Yellow fever virus
YLEEQDQW

SEQ ID NO: 159929 - protein, 8 aa, Yellow fever virus
ELVDEERR

SEQ ID NO: 159930 - protein, 8 aa, Yellow fever virus
LVDEERRL

SEQ ID NO: 159931 - protein, 8 aa, Yellow fever virus
VDEERRLH

SEQ ID NO: 159932 - protein, 8 aa, Yellow fever virus
DEERRLHQ

SEQ ID NO: 159933 - protein, 8 aa, Yellow fever virus
EERRLHQQ

SEQ ID NO: 159934 - protein, 8 aa, Yellow fever virus
GYVIRDLS

SEQ ID NO: 159935 - protein, 8 aa, Yellow fever virus
YVIRDLSA

SEQ ID NO: 159936 - protein, 8 aa, Yellow fever virus
VIRDLSAK

SEQ ID NO: 159937 - protein, 8 aa, Yellow fever virus
IRDLSAKE

SEQ ID NO: 159938 - protein, 8 aa, Yellow fever virus
RDLSAKEG

SEQ ID NO: 159939 - protein, 8 aa, Yellow fever virus
DLSAKEGG

SEQ ID NO: 159940 - protein, 8 aa, Yellow fever virus
LSAKEGGG

SEQ ID NO: 159941 - protein, 8 aa, Yellow fever virus
SAKEGGGF

SEQ ID NO: 159942 - protein, 8 aa, Yellow fever virus
AKEGGGFY

SEQ ID NO: 159943 - protein, 8 aa, Yellow fever virus
MDGGGLYA

SEQ ID NO: 159944 - protein, 8 aa, Yellow fever virus
DGGGLYAD

SEQ ID NO: 159945 - protein, 8 aa, Yellow fever virus
QEIMSYMS

SEQ ID NO: 159946 - protein, 8 aa, Yellow fever virus
EIMSYMSP

SEQ ID NO: 159947 - protein, 8 aa, Yellow fever virus
IMSYMSPE

SEQ ID NO: 159948 - protein, 8 aa, Yellow fever virus
MSYMSPEQ

SEQ ID NO: 159949 - protein, 8 aa, Yellow fever virus
SYMSPEQR

SEQ ID NO: 159950 - protein, 8 aa, Yellow fever virus
YMSSHHKK

SEQ ID NO: 159951 - protein, 8 aa, Yellow fever virus
MSPEQRKL

SEQ ID NO: 159952 - protein, 8 aa, Yellow fever virus
SSHHKKLA

SEQ ID NO: 159953 - protein, 8 aa, Yellow fever virus
PEQRKLAW

SEQ ID NO: 159954 - protein, 8 aa, Yellow fever virus
QRKLAWAI

SEQ ID NO: 159955 - protein, 8 aa, Yellow fever virus
RKLAWAIM

SEQ ID NO: 159956 - protein, 8 aa, Yellow fever virus
KLAWAIME

SEQ ID NO: 159957 - protein, 8 aa, Yellow fever virus
LAWAIMEM

SEQ ID NO: 159958 - protein, 8 aa, Yellow fever virus
AWAIMEMT

SEQ ID NO: 159959 - protein, 8 aa, Yellow fever virus
WAIMEMTY

SEQ ID NO: 159960 - protein, 8 aa, Yellow fever virus
PTPGGKAY

SEQ ID NO: 159961 - protein, 8 aa, Yellow fever virus
TPGGKAYM

SEQ ID NO: 159962 - protein, 8 aa, Yellow fever virus
AEAENVIH

SEQ ID NO: 159963 - protein, 8 aa, Yellow fever virus
EAENVIHH

SEQ ID NO: 159964 - protein, 8 aa, Yellow fever virus
AENVIHHQ

SEQ ID NO: 159965 - protein, 8 aa, Yellow fever virus
ENVIHHQH

SEQ ID NO: 159966 - protein, 8 aa, Yellow fever virus
NVIHHQHV

SEQ ID NO: 159967 - protein, 8 aa, Yellow fever virus
VINHQHVQ

SEQ ID NO: 159968 - protein, 8 aa, Yellow fever virus
INHQHVQE

SEQ ID NO: 159969 - protein, 8 aa, Yellow fever virus
NHQHVQEC

SEQ ID NO: 159970 - protein, 8 aa, Yellow fever virus
HQHVQECG

SEQ ID NO: 159971 - protein, 8 aa, Yellow fever virus
QHVQECGE

SEQ ID NO: 159972 - protein, 8 aa, Yellow fever virus
HVQDCDDS

SEQ ID NO: 159973 - protein, 8 aa, Yellow fever virus
CGENVLER

SEQ ID NO: 159974 - protein, 8 aa, Yellow fever virus
DDSTLVRL

SEQ ID NO: 159975 - protein, 8 aa, Yellow fever virus
LARLDAWL

SEQ ID NO: 159976 - protein, 8 aa, Yellow fever virus
ARLDAWLA

SEQ ID NO: 159977 - protein, 8 aa, Yellow fever virus
RLEAWLIE

SEQ ID NO: 159978 - protein, 8 aa, Yellow fever virus
LEAWLIEH

SEQ ID NO: 159979 - protein, 8 aa, Yellow fever virus
ETWLAENG

SEQ ID NO: 159980 - protein, 8 aa, Yellow fever virus
AWLIEHGC

SEQ ID NO: 159981 - protein, 8 aa, Yellow fever virus
WLAENGCD

SEQ ID NO: 159982 - protein, 8 aa, Yellow fever virus
LAENGCDR

SEQ ID NO: 159983 - protein, 8 aa, Yellow fever virus
AENGCDRL

SEQ ID NO: 159984 - protein, 8 aa, Yellow fever virus
RLARMAVS

SEQ ID NO: 159985 - protein, 8 aa, Yellow fever virus
LRRMAVSG

SEQ ID NO: 159986 - protein, 8 aa, Yellow fever virus
RRMAVSGD

SEQ ID NO: 159987 - protein, 8 aa, Yellow fever virus
NGDDCVVR

SEQ ID NO: 159988 - protein, 8 aa, Yellow fever virus
DDCVVKPV

SEQ ID NO: 159989 - protein, 8 aa, Yellow fever virus
DCVVKPVD

SEQ ID NO: 159990 - protein, 8 aa, Yellow fever virus
CVVKPVDD

SEQ ID NO: 159991 - protein, 8 aa, Yellow fever virus
VVKPVDDR

SEQ ID NO: 159992 - protein, 8 aa, Yellow fever virus
VKPVDDRF

SEQ ID NO: 159993 - protein, 8 aa, Yellow fever virus
KPVDDRFG

SEQ ID NO: 159994 - protein, 8 aa, Yellow fever virus
PIDDRFGM

SEQ ID NO: 159995 - protein, 8 aa, Yellow fever virus
IDDRFGMA

SEQ ID NO: 159996 - protein, 8 aa, Yellow fever virus
WQPSKEWT

SEQ ID NO: 159997 - protein, 8 aa, Yellow fever virus
QPSKEWTD

SEQ ID NO: 159998 - protein, 8 aa, Yellow fever virus
PSKEWTDW

SEQ ID NO: 159999 - protein, 8 aa, Yellow fever virus
SKEWTDWE

SEQ ID NO: 160000 - protein, 8 aa, Yellow fever virus
KEWTDWEN

SEQ ID NO: 160001 - protein, 8 aa, Yellow fever virus
GWTDWENV

SEQ ID NO: 160002 - protein, 8 aa, Yellow fever virus
WTDWESVP

SEQ ID NO: 160003 - protein, 8 aa, Yellow fever virus
TDWESVPF

SEQ ID NO: 160004 - protein, 8 aa, Yellow fever virus
NVPFCSHR

SEQ ID NO: 160005 - protein, 8 aa, Yellow fever virus
SHHFHELH

SEQ ID NO: 160006 - protein, 8 aa, Yellow fever virus
HHFHELHL

SEQ ID NO: 160007 - protein, 8 aa, Yellow fever virus
HFHELHLK

SEQ ID NO: 160008 - protein, 8 aa, Yellow fever virus
FHELHLKD

SEQ ID NO: 160009 - protein, 8 aa, Yellow fever virus
HELHLKDG

SEQ ID NO: 160010 - protein, 8 aa, Yellow fever virus
ELHLKDGR

SEQ ID NO: 160011 - protein, 8 aa, Yellow fever virus
LHLKDGRR

SEQ ID NO: 160012 - protein, 8 aa, Yellow fever virus
HLKDGRRI

SEQ ID NO: 160013 - protein, 8 aa, Yellow fever virus
LKDGRKIV

SEQ ID NO: 160014 - protein, 8 aa, Yellow fever virus
KDGRKIVV

SEQ ID NO: 160015 - protein, 8 aa, Yellow fever virus
DGRKIVVP

SEQ ID NO: 160016 - protein, 8 aa, Yellow fever virus
GRKIVVPC

SEQ ID NO: 160017 - protein, 8 aa, Yellow fever virus
RKIVVPCR

SEQ ID NO: 160018 - protein, 8 aa, Yellow fever virus
KIVVPCRD

SEQ ID NO: 160019 - protein, 8 aa, Yellow fever virus
IVVPCRDQ

SEQ ID NO: 160020 - protein, 8 aa, Yellow fever virus
VSSAVPMA

SEQ ID NO: 160021 - protein, 8 aa, Yellow fever virus
SSAVPMAW

SEQ ID NO: 160022 - protein, 8 aa, Yellow fever virus
SAVPMAWV

SEQ ID NO: 160023 - protein, 8 aa, Yellow fever virus
AVPMAWVP

SEQ ID NO: 160024 - protein, 8 aa, Yellow fever virus
VPMAWVPS

SEQ ID NO: 160025 - protein, 8 aa, Yellow fever virus
PMAWVPSG

SEQ ID NO: 160026 - protein, 8 aa, Yellow fever virus
MAWVPSGR

SEQ ID NO: 160027 - protein, 8 aa, Yellow fever virus
TTWSVHGR

SEQ ID NO: 160028 - protein, 8 aa, Yellow fever virus
TWSVHGRG

SEQ ID NO: 160029 - protein, 8 aa, Yellow fever virus
WSVHGRGE

SEQ ID NO: 160030 - protein, 8 aa, Yellow fever virus
SVHGRGEW

SEQ ID NO: 160031 - protein, 8 aa, Yellow fever virus
VHGRGEWM

SEQ ID NO: 160032 - protein, 8 aa, Yellow fever virus
RGEWMTTE

SEQ ID NO: 160033 - protein, 8 aa, Yellow fever virus
EWMTTEDR

SEQ ID NO: 160034 - protein, 8 aa, Yellow fever virus
WMTTQDML

SEQ ID NO: 160035 - protein, 8 aa, Yellow fever virus
MTTEDMLD

SEQ ID NO: 160036 - protein, 8 aa, Yellow fever virus
TTEDMLGV

SEQ ID NO: 160037 - protein, 8 aa, Yellow fever virus
TEDMLGVW

SEQ ID NO: 160038 - protein, 8 aa, Yellow fever virus
EDMLGVWN

SEQ ID NO: 160039 - protein, 8 aa, Yellow fever virus
DMLGVWNR

SEQ ID NO: 160040 - protein, 8 aa, Yellow fever virus
MLGVWNRV

SEQ ID NO: 160041 - protein, 8 aa, Yellow fever virus
LGVWNRVW

SEQ ID NO: 160042 - protein, 8 aa, Yellow fever virus
GVWNRVWI

SEQ ID NO: 160043 - protein, 8 aa, Yellow fever virus
VLNNPHMT

SEQ ID NO: 160044 - protein, 8 aa, Yellow fever virus
LNNPHMTD

SEQ ID NO: 160045 - protein, 8 aa, Yellow fever virus
NNPHMTDK

SEQ ID NO: 160046 - protein, 8 aa, Yellow fever virus
NPHMTDKT

SEQ ID NO: 160047 - protein, 8 aa, Yellow fever virus
PHMKDKTT

SEQ ID NO: 160048 - protein, 8 aa, Yellow fever virus
HMKDKTTV

SEQ ID NO: 160049 - protein, 8 aa, Yellow fever virus
MKDKTTVK

SEQ ID NO: 160050 - protein, 8 aa, Yellow fever virus
QDKTVVKE

SEQ ID NO: 160051 - protein, 8 aa, Yellow fever virus
DKTVVKEW

SEQ ID NO: 160052 - protein, 8 aa, Yellow fever virus
KTVVKEWR

SEQ ID NO: 160053 - protein, 8 aa, Yellow fever virus
TVVKEWRD

SEQ ID NO: 160054 - protein, 8 aa, Yellow fever virus
VVKEWRDV

SEQ ID NO: 160055 - protein, 8 aa, Yellow fever virus
IKEWRDVP

SEQ ID NO: 160056 - protein, 8 aa, Yellow fever virus
IHRIRNLI

SEQ ID NO: 160057 - protein, 8 aa, Yellow fever virus
HRIRNLIG

SEQ ID NO: 160058 - protein, 8 aa, Yellow fever virus
RIRNLIGQ

SEQ ID NO: 160059 - protein, 8 aa, Yellow fever virus
IRNLIGQE

SEQ ID NO: 160060 - protein, 8 aa, Yellow fever virus
RNLIGQEK

SEQ ID NO: 160061 - protein, 8 aa, Yellow fever virus
TLIGQEKF

SEQ ID NO: 160062 - protein, 8 aa, Yellow fever virus
LIGQEKFT

SEQ ID NO: 160063 - protein, 8 aa, Yellow fever virus
IGQEKFTD

SEQ ID NO: 160064 - protein, 8 aa, Yellow fever virus
TGKKITAQ

SEQ ID NO: 160065 - protein, 8 aa, Yellow fever virus
GKKITAQL

SEQ ID NO: 160066 - protein, 8 aa, Yellow fever virus
KKITAQLK

SEQ ID NO: 160067 - protein, 8 aa, Yellow fever virus
KITAQLKR

SEQ ID NO: 160068 - protein, 8 aa, Yellow fever virus
LTAHLKKL

SEQ ID NO: 160069 - protein, 8 aa, Yellow fever virus
TAHLKKLW

SEQ ID NO: 160070 - protein, 8 aa, Yellow fever virus
AHLKKLWR

SEQ ID NO: 160071 - protein, 8 aa, Yellow fever virus
QLKRLWKM

SEQ ID NO: 160072 - protein, 8 aa, Yellow fever virus
RKRRSSEM

SEQ ID NO: 160073 - protein, 8 aa, Yellow fever virus
KRRSSEMT

SEQ ID NO: 160074 - protein, 8 aa, Yellow fever virus
TVQLLILG

SEQ ID NO: 160075 - protein, 8 aa, Yellow fever virus
VQLLILGM

SEQ ID NO: 160076 - protein, 8 aa, Yellow fever virus
PLLLLGLL

SEQ ID NO: 160077 - protein, 8 aa, Yellow fever virus
LLILGMIL

SEQ ID NO: 160078 - protein, 8 aa, Yellow fever virus
LLLGLLAL

SEQ ID NO: 160079 - protein, 8 aa, Yellow fever virus
ILGGGVTL

SEQ ID NO: 160080 - protein, 8 aa, Yellow fever virus
GGGVTLVR

SEQ ID NO: 160081 - protein, 8 aa, Yellow fever virus
DLGKTFSL

SEQ ID NO: 160082 - protein, 8 aa, Yellow fever virus
LGKTFSMG

SEQ ID NO: 160083 - protein, 8 aa, Yellow fever virus
GKTFSLGT

SEQ ID NO: 160084 - protein, 8 aa, Yellow fever virus
KTFSIGTG

SEQ ID NO: 160085 - protein, 8 aa, Yellow fever virus
TFSMGTGN

SEQ ID NO: 160086 - protein, 8 aa, Yellow fever virus
FSVGAGNC

SEQ ID NO: 160087 - protein, 8 aa, Yellow fever virus
SVGAGNCT

SEQ ID NO: 160088 - protein, 8 aa, Yellow fever virus
IGTGNCTT

SEQ ID NO: 160089 - protein, 8 aa, Yellow fever virus
AYLVGNNM

SEQ ID NO: 160090 - protein, 8 aa, Yellow fever virus
YLVGNNTT

SEQ ID NO: 160091 - protein, 8 aa, Yellow fever virus
LVGNNTTQ

SEQ ID NO: 160092 - protein, 8 aa, Yellow fever virus
VGNNKTQR

SEQ ID NO: 160093 - protein, 8 aa, Yellow fever virus
GNNMTQRV

SEQ ID NO: 160094 - protein, 8 aa, Yellow fever virus
NNMTQRVV

SEQ ID NO: 160095 - protein, 8 aa, Yellow fever virus
AIDGPVEA

SEQ ID NO: 160096 - protein, 8 aa, Yellow fever virus
IDGPVEAR

SEQ ID NO: 160097 - protein, 8 aa, Yellow fever virus
DGPVEARK

SEQ ID NO: 160098 - protein, 8 aa, Yellow fever virus
GPVEARKV

SEQ ID NO: 160099 - protein, 8 aa, Yellow fever virus
GAKQEDWK

SEQ ID NO: 160100 - protein, 8 aa, Yellow fever virus
AKQEDWKT

SEQ ID NO: 160101 - protein, 8 aa, Yellow fever virus
KQENWKTD

SEQ ID NO: 160102 - protein, 8 aa, Yellow fever virus
QENWKTDI

SEQ ID NO: 160103 - protein, 8 aa, Yellow fever virus
EDWKTDIK

SEQ ID NO: 160104 - protein, 8 aa, Yellow fever virus
NWKTDIKT

SEQ ID NO: 160105 - protein, 8 aa, Yellow fever virus
WKTDIKTL

SEQ ID NO: 160106 - protein, 8 aa, Yellow fever virus
KTDIKTLK

SEQ ID NO: 160107 - protein, 8 aa, Yellow fever virus
WMMHTLET

SEQ ID NO: 160108 - protein, 8 aa, Yellow fever virus
MMHTLETL

SEQ ID NO: 160109 - protein, 8 aa, Yellow fever virus
VHTLETLD

SEQ ID NO: 160110 - protein, 8 aa, Yellow fever virus
PLEVKREV

SEQ ID NO: 160111 - protein, 8 aa, Yellow fever virus
LEVKREVC

SEQ ID NO: 160112 - protein, 8 aa, Yellow fever virus
EVKREVCP

SEQ ID NO: 160113 - protein, 8 aa, Yellow fever virus
VKREVCPG

SEQ ID NO: 160114 - protein, 8 aa, Yellow fever virus
KREVCPGT

SEQ ID NO: 160115 - protein, 8 aa, Yellow fever virus
GTSVVLDT

SEQ ID NO: 160116 - protein, 8 aa, Yellow fever virus
TSVVVDSN

SEQ ID NO: 160117 - protein, 8 aa, Yellow fever virus
SVVVDSNC

SEQ ID NO: 160118 - protein, 8 aa, Yellow fever virus
VVVDSNCD

SEQ ID NO: 160119 - protein, 8 aa, Yellow fever virus
VVDTSCDG

SEQ ID NO: 160120 - protein, 8 aa, Yellow fever virus
VDSNCDGR

SEQ ID NO: 160121 - protein, 8 aa, Yellow fever virus
DSNCDGRG

SEQ ID NO: 160122 - protein, 8 aa, Yellow fever virus
TGCDGRGK

SEQ ID NO: 160123 - protein, 8 aa, Yellow fever virus
EIRPMKTS

SEQ ID NO: 160124 - protein, 8 aa, Yellow fever virus
IRPMKTSD

SEQ ID NO: 160125 - protein, 8 aa, Yellow fever virus
RPMKTSDS

SEQ ID NO: 160126 - protein, 8 aa, Yellow fever virus
PRKAHESH

SEQ ID NO: 160127 - protein, 8 aa, Yellow fever virus
RKAHESHL

SEQ ID NO: 160128 - protein, 8 aa, Yellow fever virus
KQMLVGGM

SEQ ID NO: 160129 - protein, 8 aa, Yellow fever virus
QMLVGGMV

SEQ ID NO: 160130 - protein, 8 aa, Yellow fever virus
MLVGGMVL

SEQ ID NO: 160131 - protein, 8 aa, Yellow fever virus
VTLLDLLE

SEQ ID NO: 160132 - protein, 8 aa, Yellow fever virus
FVVAVGLH

SEQ ID NO: 160133 - protein, 8 aa, Yellow fever virus
TMAVGLHF

SEQ ID NO: 160134 - protein, 8 aa, Yellow fever virus
SIRPGLLM

SEQ ID NO: 160135 - protein, 8 aa, Yellow fever virus
IRPGLLVG

SEQ ID NO: 160136 - protein, 8 aa, Yellow fever virus
SSRKASNT

SEQ ID NO: 160137 - protein, 8 aa, Yellow fever virus
SRKASNAI

SEQ ID NO: 160138 - protein, 8 aa, Yellow fever virus
RKASNAIL

SEQ ID NO: 160139 - protein, 8 aa, Yellow fever virus
KASNAILP

SEQ ID NO: 160140 - protein, 8 aa, Yellow fever virus
ASNMILPL

SEQ ID NO: 160141 - protein, 8 aa, Yellow fever virus
SNAVLPLM

SEQ ID NO: 160142 - protein, 8 aa, Yellow fever virus
NAILPLMA

SEQ ID NO: 160143 - protein, 8 aa, Yellow fever virus
AVLPLMAL

SEQ ID NO: 160144 - protein, 8 aa, Yellow fever virus
LMTPMTMH

SEQ ID NO: 160145 - protein, 8 aa, Yellow fever virus
MTPMTMHE

SEQ ID NO: 160146 - protein, 8 aa, Yellow fever virus
TPVTMYEV

SEQ ID NO: 160147 - protein, 8 aa, Yellow fever virus
PMTMHEVR

SEQ ID NO: 160148 - protein, 8 aa, Yellow fever virus
MTMHEVRM

SEQ ID NO: 160149 - protein, 8 aa, Yellow fever virus
MYEVRMAT

SEQ ID NO: 160150 - protein, 8 aa, Yellow fever virus
YEVRMATM

SEQ ID NO: 160151 - protein, 8 aa, Yellow fever virus
EVRMATML

SEQ ID NO: 160152 - protein, 8 aa, Yellow fever virus
VRMATMLF

SEQ ID NO: 160153 - protein, 8 aa, Yellow fever virus
RMATMLFC

SEQ ID NO: 160154 - protein, 8 aa, Yellow fever virus
AAMLFCTV

SEQ ID NO: 160155 - protein, 8 aa, Yellow fever virus
AMLFCTVV

SEQ ID NO: 160156 - protein, 8 aa, Yellow fever virus
MLLCAVVI

SEQ ID NO: 160157 - protein, 8 aa, Yellow fever virus
LFCTVVIV

SEQ ID NO: 160158 - protein, 8 aa, Yellow fever virus
LCAVVIIG

SEQ ID NO: 160159 - protein, 8 aa, Yellow fever virus
VGVLHQNS

SEQ ID NO: 160160 - protein, 8 aa, Yellow fever virus
GVLHQNAK

SEQ ID NO: 160161 - protein, 8 aa, Yellow fever virus
VLHQNAKD

SEQ ID NO: 160162 - protein, 8 aa, Yellow fever virus
LHQNAKDT

SEQ ID NO: 160163 - protein, 8 aa, Yellow fever virus
YQNSKDTS

SEQ ID NO: 160164 - protein, 8 aa, Yellow fever virus
LKKLGEIS

SEQ ID NO: 160165 - protein, 8 aa, Yellow fever virus
KKLGEVAW

SEQ ID NO: 160166 - protein, 8 aa, Yellow fever virus
GGWILHIK

SEQ ID NO: 160167 - protein, 8 aa, Yellow fever virus
GWVLHIKG

SEQ ID NO: 160168 - protein, 8 aa, Yellow fever virus
WLFHVRRA

SEQ ID NO: 160169 - protein, 8 aa, Yellow fever virus
LFHVRRAR

SEQ ID NO: 160170 - protein, 8 aa, Yellow fever virus
FHVRRARR

SEQ ID NO: 160171 - protein, 8 aa, Yellow fever virus
HVRRARRS

SEQ ID NO: 160172 - protein, 8 aa, Yellow fever virus
VRRARRSG

SEQ ID NO: 160173 - protein, 8 aa, Yellow fever virus
IAAAPGKN

SEQ ID NO: 160174 - protein, 8 aa, Yellow fever virus
AAAPGKNV

SEQ ID NO: 160175 - protein, 8 aa, Yellow fever virus
AAPGKNVV

SEQ ID NO: 160176 - protein, 8 aa, Yellow fever virus
VPGKSVVN

SEQ ID NO: 160177 - protein, 8 aa, Yellow fever virus
GMTTILDY

SEQ ID NO: 160178 - protein, 8 aa, Yellow fever virus
MTTILDYH

SEQ ID NO: 160179 - protein, 8 aa, Yellow fever virus
RSPGGAKR

SEQ ID NO: 160180 - protein, 8 aa, Yellow fever virus
APGGAKRP

SEQ ID NO: 160181 - protein, 8 aa, Yellow fever virus
PGGAKRAL

SEQ ID NO: 160182 - protein, 8 aa, Yellow fever virus
GGAKRPLR

SEQ ID NO: 160183 - protein, 8 aa, Yellow fever virus
GAKRPLRP

SEQ ID NO: 160184 - protein, 8 aa, Yellow fever virus
AKRPLRPR

SEQ ID NO: 160185 - protein, 8 aa, Yellow fever virus
KRALRPRW

SEQ ID NO: 160186 - protein, 8 aa, Yellow fever virus
RPLRPRWC

SEQ ID NO: 160187 - protein, 8 aa, Yellow fever virus
GRRGAADV

SEQ ID NO: 160188 - protein, 8 aa, Yellow fever virus
RRGAADVL

SEQ ID NO: 160189 - protein, 8 aa, Yellow fever virus
RGAAEILV

SEQ ID NO: 160190 - protein, 8 aa, Yellow fever virus
GAAEILVV

SEQ ID NO: 160191 - protein, 8 aa, Yellow fever virus
AADVLVVL

SEQ ID NO: 160192 - protein, 8 aa, Yellow fever virus
ADVLVVLS

SEQ ID NO: 160193 - protein, 8 aa, Yellow fever virus
DVLVVLSE

SEQ ID NO: 160194 - protein, 8 aa, Yellow fever virus
ILVVLSEL

SEQ ID NO: 160195 - protein, 8 aa, Yellow fever virus
GILTLLSI

SEQ ID NO: 160196 - protein, 8 aa, Yellow fever virus
ILTLLSIV

SEQ ID NO: 160197 - protein, 8 aa, Yellow fever virus
LTLLSIVA

SEQ ID NO: 160198 - protein, 8 aa, Yellow fever virus
TLLSIVAA

SEQ ID NO: 160199 - protein, 8 aa, Yellow fever virus
LLSIVAAN

SEQ ID NO: 160200 - protein, 8 aa, Yellow fever virus
LSIVAANE

SEQ ID NO: 160201 - protein, 8 aa, Yellow fever virus
EDFFGRRN

SEQ ID NO: 160202 - protein, 8 aa, Yellow fever virus
ISSSASPW

SEQ ID NO: 160203 - protein, 8 aa, Yellow fever virus
SSSASPWS

SEQ ID NO: 160204 - protein, 8 aa, Yellow fever virus
SGAIPWSW

SEQ ID NO: 160205 - protein, 8 aa, Yellow fever virus
GASPWSWP

SEQ ID NO: 160206 - protein, 8 aa, Yellow fever virus
ISVIMLLI

SEQ ID NO: 160207 - protein, 8 aa, Yellow fever virus
SVIMLLIS

SEQ ID NO: 160208 - protein, 8 aa, Yellow fever virus
VIMLLISG

SEQ ID NO: 160209 - protein, 8 aa, Yellow fever virus
IMLLISGW

SEQ ID NO: 160210 - protein, 8 aa, Yellow fever virus
LCGIGCAT

SEQ ID NO: 160211 - protein, 8 aa, Yellow fever virus
CGIGGAML

SEQ ID NO: 160212 - protein, 8 aa, Yellow fever virus
GIGGAMLH

SEQ ID NO: 160213 - protein, 8 aa, Yellow fever virus
IGGAMLHW

SEQ ID NO: 160214 - protein, 8 aa, Yellow fever virus
GCATLHWS

SEQ ID NO: 160215 - protein, 8 aa, Yellow fever virus
CATLHWSL

SEQ ID NO: 160216 - protein, 8 aa, Yellow fever virus
NLWKMKTA

SEQ ID NO: 160217 - protein, 8 aa, Yellow fever virus
LWKMKTAR

SEQ ID NO: 160218 - protein, 8 aa, Yellow fever virus
WKMKTERR

SEQ ID NO: 160219 - protein, 8 aa, Yellow fever virus
KMKTARRG

SEQ ID NO: 160220 - protein, 8 aa, Yellow fever virus
RRGSASGK

SEQ ID NO: 160221 - protein, 8 aa, Yellow fever virus
RGSASGKT

SEQ ID NO: 160222 - protein, 8 aa, Yellow fever virus
GTANGKTL

SEQ ID NO: 160223 - protein, 8 aa, Yellow fever virus
SASGKTLG

SEQ ID NO: 160224 - protein, 8 aa, Yellow fever virus
LDRQQFEL

SEQ ID NO: 160225 - protein, 8 aa, Yellow fever virus
DKQQFEMY

SEQ ID NO: 160226 - protein, 8 aa, Yellow fever virus
KQQFEMYK

SEQ ID NO: 160227 - protein, 8 aa, Yellow fever virus
KDKTDVHP

SEQ ID NO: 160228 - protein, 8 aa, Yellow fever virus
DKTDIHHL

SEQ ID NO: 160229 - protein, 8 aa, Yellow fever virus
KTDVHRLE

SEQ ID NO: 160230 - protein, 8 aa, Yellow fever virus
TDIHHLEP

SEQ ID NO: 160231 - protein, 8 aa, Yellow fever virus
LEPLKCET

SEQ ID NO: 160232 - protein, 8 aa, Yellow fever virus
EPLKCETL

SEQ ID NO: 160233 - protein, 8 aa, Yellow fever virus
PMKCDTLL

SEQ ID NO: 160234 - protein, 8 aa, Yellow fever virus
MKCDTLLC

SEQ ID NO: 160235 - protein, 8 aa, Yellow fever virus
GESSSSSI

SEQ ID NO: 160236 - protein, 8 aa, Yellow fever virus
ESSPSSAT

SEQ ID NO: 160237 - protein, 8 aa, Yellow fever virus
SSSSSITE

SEQ ID NO: 160238 - protein, 8 aa, Yellow fever virus
SSSSITEG

SEQ ID NO: 160239 - protein, 8 aa, Yellow fever virus
SSSITEGE

SEQ ID NO: 160240 - protein, 8 aa, Yellow fever virus
ATEGERTL

SEQ ID NO: 160241 - protein, 8 aa, Yellow fever virus
ERTLRVLD

SEQ ID NO: 160242 - protein, 8 aa, Yellow fever virus
RTLRVLDT

SEQ ID NO: 160243 - protein, 8 aa, Yellow fever virus
TLRVLETV

SEQ ID NO: 160244 - protein, 8 aa, Yellow fever virus
LRVLDTVE

SEQ ID NO: 160245 - protein, 8 aa, Yellow fever virus
GAIEERVE

SEQ ID NO: 160246 - protein, 8 aa, Yellow fever virus
IKNEYATT

SEQ ID NO: 160247 - protein, 8 aa, Yellow fever virus
KNEYATTW

SEQ ID NO: 160248 - protein, 8 aa, Yellow fever virus
NEYATTWF

SEQ ID NO: 160249 - protein, 8 aa, Yellow fever virus
EYAATWFH

SEQ ID NO: 160250 - protein, 8 aa, Yellow fever virus
YAATWFHD

SEQ ID NO: 160251 - protein, 8 aa, Yellow fever virus
ATTWFYDN

SEQ ID NO: 160252 - protein, 8 aa, Yellow fever virus
ATWFHDND

SEQ ID NO: 160253 - protein, 8 aa, Yellow fever virus
LLTYPWDK

SEQ ID NO: 160254 - protein, 8 aa, Yellow fever virus
RHLSREKN

SEQ ID NO: 160255 - protein, 8 aa, Yellow fever virus
HLSREKNP

SEQ ID NO: 160256 - protein, 8 aa, Yellow fever virus
LAREKKPR

SEQ ID NO: 160257 - protein, 8 aa, Yellow fever virus
SREKNPRL

SEQ ID NO: 160258 - protein, 8 aa, Yellow fever virus
AAMDGGGL

SEQ ID NO: 160259 - protein, 8 aa, Yellow fever virus
AMDGGGLY

SEQ ID NO: 160260 - protein, 8 aa, Yellow fever virus
EILNYMSS

SEQ ID NO: 160261 - protein, 8 aa, Yellow fever virus
ILNYMSSH

SEQ ID NO: 160262 - protein, 8 aa, Yellow fever virus
LNYMSSHH

SEQ ID NO: 160263 - protein, 8 aa, Yellow fever virus
NYMSSHHK

SEQ ID NO: 160264 - protein, 8 aa, Yellow fever virus
YMSPEQRK

SEQ ID NO: 160265 - protein, 8 aa, Yellow fever virus
MSSHHKKL

SEQ ID NO: 160266 - protein, 8 aa, Yellow fever virus
SPEQRKLA

SEQ ID NO: 160267 - protein, 8 aa, Yellow fever virus
SHHKKLAQ

SEQ ID NO: 160268 - protein, 8 aa, Yellow fever virus
AEMVIHHH

SEQ ID NO: 160269 - protein, 8 aa, Yellow fever virus
EMVIHHHH

SEQ ID NO: 160270 - protein, 8 aa, Yellow fever virus
MVIHHHHV

SEQ ID NO: 160271 - protein, 8 aa, Yellow fever virus
VIHHHHVQ

SEQ ID NO: 160272 - protein, 8 aa, Yellow fever virus
IHHHHVQD

SEQ ID NO: 160273 - protein, 8 aa, Yellow fever virus
HHHHVQDC

SEQ ID NO: 160274 - protein, 8 aa, Yellow fever virus
HHHVQDCD

SEQ ID NO: 160275 - protein, 8 aa, Yellow fever virus
HHVQDCDD

SEQ ID NO: 160276 - protein, 8 aa, Yellow fever virus
HVNECDES

SEQ ID NO: 160277 - protein, 8 aa, Yellow fever virus
CDDSTLVR

SEQ ID NO: 160278 - protein, 8 aa, Yellow fever virus
GENVLERL

SEQ ID NO: 160279 - protein, 8 aa, Yellow fever virus
LERLETWL

SEQ ID NO: 160280 - protein, 8 aa, Yellow fever virus
ERLETWLA

SEQ ID NO: 160281 - protein, 8 aa, Yellow fever virus
RLETWLAE

SEQ ID NO: 160282 - protein, 8 aa, Yellow fever virus
LETWLAEN

SEQ ID NO: 160283 - protein, 8 aa, Yellow fever virus
EAWLIEHG

SEQ ID NO: 160284 - protein, 8 aa, Yellow fever virus
TWLAENGC

SEQ ID NO: 160285 - protein, 8 aa, Yellow fever virus
WLIEHGCD

SEQ ID NO: 160286 - protein, 8 aa, Yellow fever virus
LIEHGCDR

SEQ ID NO: 160287 - protein, 8 aa, Yellow fever virus
IEHGCDRL

SEQ ID NO: 160288 - protein, 8 aa, Yellow fever virus
RLNRMAVN

SEQ ID NO: 160289 - protein, 8 aa, Yellow fever virus
LNRMAVNG

SEQ ID NO: 160290 - protein, 8 aa, Yellow fever virus
NRMAVNGD

SEQ ID NO: 160291 - protein, 8 aa, Yellow fever virus
KGWTDWES

SEQ ID NO: 160292 - protein, 8 aa, Yellow fever virus
GWTDWESV

SEQ ID NO: 160293 - protein, 8 aa, Yellow fever virus
SHRFHELQ

SEQ ID NO: 160294 - protein, 8 aa, Yellow fever virus
HRFHELQL

SEQ ID NO: 160295 - protein, 8 aa, Yellow fever virus
RFHELQLK

SEQ ID NO: 160296 - protein, 8 aa, Yellow fever virus
VLKDGRKI

SEQ ID NO: 160297 - protein, 8 aa, Yellow fever virus
MTTEDRLE

SEQ ID NO: 160298 - protein, 8 aa, Yellow fever virus
TTEDRLEV

SEQ ID NO: 160299 - protein, 8 aa, Yellow fever virus
TEDRLEVW

SEQ ID NO: 160300 - protein, 8 aa, Yellow fever virus
QDMLDVWN

SEQ ID NO: 160301 - protein, 8 aa, Yellow fever virus
DRLEVWNR

SEQ ID NO: 160302 - protein, 8 aa, Yellow fever virus
RLEVWNRV

SEQ ID NO: 160303 - protein, 8 aa, Yellow fever virus
PHMTDKTT

SEQ ID NO: 160304 - protein, 8 aa, Yellow fever virus
HMTDKTTI

SEQ ID NO: 160305 - protein, 8 aa, Yellow fever virus
MTDKTTIK

SEQ ID NO: 160306 - protein, 8 aa, Yellow fever virus
KDKTTVKE

SEQ ID NO: 160307 - protein, 8 aa, Yellow fever virus
DKTTVKEW

SEQ ID NO: 160308 - protein, 8 aa, Yellow fever virus
KTTVKEWR

SEQ ID NO: 160309 - protein, 8 aa, Yellow fever virus
TTVKEWRD

SEQ ID NO: 160310 - protein, 8 aa, Yellow fever virus
TVKEWRDV

SEQ ID NO: 160311 - protein, 8 aa, Yellow fever virus
NLIGQEKY

SEQ ID NO: 160312 - protein, 8 aa, Yellow fever virus
LFPLLLLG

SEQ ID NO: 160313 - protein, 8 aa, Yellow fever virus
ALSGGVTL

SEQ ID NO: 160314 - protein, 8 aa, Yellow fever virus
TGGVTLMR

SEQ ID NO: 160315 - protein, 8 aa, Yellow fever virus
GKTFSVGA

SEQ ID NO: 160316 - protein, 8 aa, Yellow fever virus
KTFSLGTG

SEQ ID NO: 160317 - protein, 8 aa, Yellow fever virus
TFSIGTGN

SEQ ID NO: 160318 - protein, 8 aa, Yellow fever virus
FSLGTGNC

SEQ ID NO: 160319 - protein, 8 aa, Yellow fever virus
SIGTGNCT

SEQ ID NO: 160320 - protein, 8 aa, Yellow fever virus
MGTGNCTT

SEQ ID NO: 160321 - protein, 8 aa, Yellow fever virus
KQEDWKTD

SEQ ID NO: 160322 - protein, 8 aa, Yellow fever virus
QEDWKTDI

SEQ ID NO: 160323 - protein, 8 aa, Yellow fever virus
ENWKTDIK

SEQ ID NO: 160324 - protein, 8 aa, Yellow fever virus
DWKTDIKT

SEQ ID NO: 160325 - protein, 8 aa, Yellow fever virus
LTMAVGLH

SEQ ID NO: 160326 - protein, 8 aa, Yellow fever virus
SSRKASNA

SEQ ID NO: 160327 - protein, 8 aa, Yellow fever virus
VRLATMLL

SEQ ID NO: 160328 - protein, 8 aa, Yellow fever virus
RLATMLLC

SEQ ID NO: 160329 - protein, 8 aa, Yellow fever virus
ATMLLCAV

SEQ ID NO: 160330 - protein, 8 aa, Yellow fever virus
TMLLCAVV

SEQ ID NO: 160331 - protein, 8 aa, Yellow fever virus
LLCAVVII

SEQ ID NO: 160332 - protein, 8 aa, Yellow fever virus
VGVLHQNA

SEQ ID NO: 160333 - protein, 8 aa, Yellow fever virus
GWILHIKG

SEQ ID NO: 160334 - protein, 8 aa, Yellow fever virus
WILHIKGA

SEQ ID NO: 160335 - protein, 8 aa, Yellow fever virus
ILHIKGAR

SEQ ID NO: 160336 - protein, 8 aa, Yellow fever virus
RAPGGAKR

SEQ ID NO: 160337 - protein, 8 aa, Yellow fever virus
SPGGAKRA

SEQ ID NO: 160338 - protein, 8 aa, Yellow fever virus
GAADVLVV

SEQ ID NO: 160339 - protein, 8 aa, Yellow fever virus
AAEILVVL

SEQ ID NO: 160340 - protein, 8 aa, Yellow fever virus
AEMLVILT

SEQ ID NO: 160341 - protein, 8 aa, Yellow fever virus
EMLVILTE

SEQ ID NO: 160342 - protein, 8 aa, Yellow fever virus
EDFFGKRN

SEQ ID NO: 160343 - protein, 8 aa, Yellow fever virus
IPSGASPW

SEQ ID NO: 160344 - protein, 8 aa, Yellow fever virus
PSGAIPWS

SEQ ID NO: 160345 - protein, 8 aa, Yellow fever virus
TDVHPLEP

SEQ ID NO: 160346 - protein, 8 aa, Yellow fever virus
LESVKCDT

SEQ ID NO: 160347 - protein, 8 aa, Yellow fever virus
ESVKCDTL

SEQ ID NO: 160348 - protein, 8 aa, Yellow fever virus
SVKCDTLL

SEQ ID NO: 160349 - protein, 8 aa, Yellow fever virus
ITEGERTV

SEQ ID NO: 160350 - protein, 8 aa, Yellow fever virus
TLRVLETI

SEQ ID NO: 160351 - protein, 8 aa, Yellow fever virus
LRVLETVE

SEQ ID NO: 160352 - protein, 8 aa, Yellow fever virus
EYAATWFY

SEQ ID NO: 160353 - protein, 8 aa, Yellow fever virus
YAATWFYD

SEQ ID NO: 160354 - protein, 8 aa, Yellow fever virus
AATWFHDN

SEQ ID NO: 160355 - protein, 8 aa, Yellow fever virus
HVNECDEG

SEQ ID NO: 160356 - protein, 8 aa, Yellow fever virus
CDEGVLAR

SEQ ID NO: 160357 - protein, 8 aa, Yellow fever virus
DEGVLARL

SEQ ID NO: 160358 - protein, 8 aa, Yellow fever virus
LVRLEAWL

SEQ ID NO: 160359 - protein, 8 aa, Yellow fever virus
VRLEAWLI

SEQ ID NO: 160360 - protein, 8 aa, Yellow fever virus
RLSRMAVS

SEQ ID NO: 160361 - protein, 8 aa, Yellow fever virus
LSRMAVSG

SEQ ID NO: 160362 - protein, 8 aa, Yellow fever virus
SRMAVSGD

SEQ ID NO: 160363 - protein, 8 aa, Yellow fever virus
MTTQDMLD

SEQ ID NO: 160364 - protein, 8 aa, Yellow fever virus
TTQDMLDV

SEQ ID NO: 160365 - protein, 8 aa, Yellow fever virus
TQDMLDVW

SEQ ID NO: 160366 - protein, 8 aa, Yellow fever virus
EDRLEVWN

SEQ ID NO: 160367 - protein, 8 aa, Yellow fever virus
TDKTTIKE

SEQ ID NO: 160368 - protein, 8 aa, Yellow fever virus
DKTTIKEW

SEQ ID NO: 160369 - protein, 8 aa, Yellow fever virus
KTTIKEWR

SEQ ID NO: 160370 - protein, 8 aa, Yellow fever virus
TTIKEWRD

SEQ ID NO: 160371 - protein, 8 aa, Yellow fever virus
TIKEWRDV

SEQ ID NO: 160372 - protein, 9 aa, Yellow fever virus
MSGRKAQGK

SEQ ID NO: 160373 - protein, 9 aa, Yellow fever virus
SGRKAQGKT

SEQ ID NO: 160374 - protein, 9 aa, Yellow fever virus
GRKAQGKTL

SEQ ID NO: 160375 - protein, 9 aa, Yellow fever virus
RKAQGKTLG

SEQ ID NO: 160376 - protein, 9 aa, Yellow fever virus
KAQGKTLGV

SEQ ID NO: 160377 - protein, 9 aa, Yellow fever virus
AQGKTLGVN

SEQ ID NO: 160378 - protein, 9 aa, Yellow fever virus
QGKTLGVNM

SEQ ID NO: 160379 - protein, 9 aa, Yellow fever virus
GKTLGVNMV

SEQ ID NO: 160380 - protein, 9 aa, Yellow fever virus
KTLGVNMVR

SEQ ID NO: 160381 - protein, 9 aa, Yellow fever virus
TLGVNMVRR

SEQ ID NO: 160382 - protein, 9 aa, Yellow fever virus
LGVNMVRRG

SEQ ID NO: 160383 - protein, 9 aa, Yellow fever virus
GVNMVRRGV

SEQ ID NO: 160384 - protein, 9 aa, Yellow fever virus
VNMVRRGVR

SEQ ID NO: 160385 - protein, 9 aa, Yellow fever virus
NMVRRGVRS

SEQ ID NO: 160386 - protein, 9 aa, Yellow fever virus
MVRRGVRSL

SEQ ID NO: 160387 - protein, 9 aa, Yellow fever virus
VRRGVRSLS

SEQ ID NO: 160388 - protein, 9 aa, Yellow fever virus
RRGVRSLSN

SEQ ID NO: 160389 - protein, 9 aa, Yellow fever virus
RGVRSLSNK

SEQ ID NO: 160390 - protein, 9 aa, Yellow fever virus
GVRSLSNKI

SEQ ID NO: 160391 - protein, 9 aa, Yellow fever virus
VRSLSNKIK

SEQ ID NO: 160392 - protein, 9 aa, Yellow fever virus
RSLSNKIKQ

SEQ ID NO: 160393 - protein, 9 aa, Yellow fever virus
SLSNKIKQK

SEQ ID NO: 160394 - protein, 9 aa, Yellow fever virus
LSNKIKQKT

SEQ ID NO: 160395 - protein, 9 aa, Yellow fever virus
SNKIKQKTK

SEQ ID NO: 160396 - protein, 9 aa, Yellow fever virus
NKIKQKTKQ

SEQ ID NO: 160397 - protein, 9 aa, Yellow fever virus
KIKQKTKQI

SEQ ID NO: 160398 - protein, 9 aa, Yellow fever virus
IKQKTKQIG

SEQ ID NO: 160399 - protein, 9 aa, Yellow fever virus
KQKTKQIGN

SEQ ID NO: 160400 - protein, 9 aa, Yellow fever virus
QKTKQIGNR

SEQ ID NO: 160401 - protein, 9 aa, Yellow fever virus
KTKQIGNRP

SEQ ID NO: 160402 - protein, 9 aa, Yellow fever virus
TKQIGNRPG

SEQ ID NO: 160403 - protein, 9 aa, Yellow fever virus
KQIGNRPGP

SEQ ID NO: 160404 - protein, 9 aa, Yellow fever virus
QIGNRPGPS

SEQ ID NO: 160405 - protein, 9 aa, Yellow fever virus
IGNRPGPSR

SEQ ID NO: 160406 - protein, 9 aa, Yellow fever virus
GNRPGPSRG

SEQ ID NO: 160407 - protein, 9 aa, Yellow fever virus
NRPGPSRGV

SEQ ID NO: 160408 - protein, 9 aa, Yellow fever virus
RPGPSRGVQ

SEQ ID NO: 160409 - protein, 9 aa, Yellow fever virus
PGPSRGVQG

SEQ ID NO: 160410 - protein, 9 aa, Yellow fever virus
GPSRGVQGF

SEQ ID NO: 160411 - protein, 9 aa, Yellow fever virus
PSRGVQGFI

SEQ ID NO: 160412 - protein, 9 aa, Yellow fever virus
SRGVQGFIF

SEQ ID NO: 160413 - protein, 9 aa, Yellow fever virus
RGVQGFIFF

SEQ ID NO: 160414 - protein, 9 aa, Yellow fever virus
GVQGFIFFF

SEQ ID NO: 160415 - protein, 9 aa, Yellow fever virus
VQGFIFFFL

SEQ ID NO: 160416 - protein, 9 aa, Yellow fever virus
QGFIFFFLF

SEQ ID NO: 160417 - protein, 9 aa, Yellow fever virus
GFIFFFLFN

SEQ ID NO: 160418 - protein, 9 aa, Yellow fever virus
FIFFFLFNI

SEQ ID NO: 160419 - protein, 9 aa, Yellow fever virus
IFFFLFNIL

SEQ ID NO: 160420 - protein, 9 aa, Yellow fever virus
FFFLFNILT

SEQ ID NO: 160421 - protein, 9 aa, Yellow fever virus
FFLFNILTG

SEQ ID NO: 160422 - protein, 9 aa, Yellow fever virus
FLFNILTGK

SEQ ID NO: 160423 - protein, 9 aa, Yellow fever virus
LFNILTGKK

SEQ ID NO: 160424 - protein, 9 aa, Yellow fever virus
FNILTGKKI

SEQ ID NO: 160425 - protein, 9 aa, Yellow fever virus
NILTGKKIT

SEQ ID NO: 160426 - protein, 9 aa, Yellow fever virus
ILTGKKITA

SEQ ID NO: 160427 - protein, 9 aa, Yellow fever virus
LTGKKITAH

SEQ ID NO: 160428 - protein, 9 aa, Yellow fever virus
TGKKITAHL

SEQ ID NO: 160429 - protein, 9 aa, Yellow fever virus
GKKITAHLK

SEQ ID NO: 160430 - protein, 9 aa, Yellow fever virus
KKITAHLKR

SEQ ID NO: 160431 - protein, 9 aa, Yellow fever virus
KITAHLKRL

SEQ ID NO: 160432 - protein, 9 aa, Yellow fever virus
ITAHLKRLW

SEQ ID NO: 160433 - protein, 9 aa, Yellow fever virus
TAHLKRLWK

SEQ ID NO: 160434 - protein, 9 aa, Yellow fever virus
AHLKRLWKM

SEQ ID NO: 160435 - protein, 9 aa, Yellow fever virus
HLKRLWKML

SEQ ID NO: 160436 - protein, 9 aa, Yellow fever virus
LKRLWKMLD

SEQ ID NO: 160437 - protein, 9 aa, Yellow fever virus
KRLWKMLDP

SEQ ID NO: 160438 - protein, 9 aa, Yellow fever virus
RLWKMLDPR

SEQ ID NO: 160439 - protein, 9 aa, Yellow fever virus
LWKMLDPRQ

SEQ ID NO: 160440 - protein, 9 aa, Yellow fever virus
WKMLDPRQG

SEQ ID NO: 160441 - protein, 9 aa, Yellow fever virus
KMLDPRQGL

SEQ ID NO: 160442 - protein, 9 aa, Yellow fever virus
MLDPRQGLA

SEQ ID NO: 160443 - protein, 9 aa, Yellow fever virus
LDPRQGLAV

SEQ ID NO: 160444 - protein, 9 aa, Yellow fever virus
DPRQGLAVL

SEQ ID NO: 160445 - protein, 9 aa, Yellow fever virus
PRQGLAVLR

SEQ ID NO: 160446 - protein, 9 aa, Yellow fever virus
RQGLAVLRK

SEQ ID NO: 160447 - protein, 9 aa, Yellow fever virus
QGLAVLRKV

SEQ ID NO: 160448 - protein, 9 aa, Yellow fever virus
GLAVLRKVK

SEQ ID NO: 160449 - protein, 9 aa, Yellow fever virus
LAVLRKVKR

SEQ ID NO: 160450 - protein, 9 aa, Yellow fever virus
AVLRKVKRV

SEQ ID NO: 160451 - protein, 9 aa, Yellow fever virus
VLRKVKRVV

SEQ ID NO: 160452 - protein, 9 aa, Yellow fever virus
LRKVKRVVA

SEQ ID NO: 160453 - protein, 9 aa, Yellow fever virus
RKVKRVVAS

SEQ ID NO: 160454 - protein, 9 aa, Yellow fever virus
KVKRVVASL

SEQ ID NO: 160455 - protein, 9 aa, Yellow fever virus
VKRVVASLM

SEQ ID NO: 160456 - protein, 9 aa, Yellow fever virus
KRVVASLMR

SEQ ID NO: 160457 - protein, 9 aa, Yellow fever virus
RVVASLMRG

SEQ ID NO: 160458 - protein, 9 aa, Yellow fever virus
VVASLMRGL

SEQ ID NO: 160459 - protein, 9 aa, Yellow fever virus
VASLMRGLS

SEQ ID NO: 160460 - protein, 9 aa, Yellow fever virus
ASLMRGLSS

SEQ ID NO: 160461 - protein, 9 aa, Yellow fever virus
SLMRGLSSR

SEQ ID NO: 160462 - protein, 9 aa, Yellow fever virus
LMRGLSSRK

SEQ ID NO: 160463 - protein, 9 aa, Yellow fever virus
MRGLSSRKR

SEQ ID NO: 160464 - protein, 9 aa, Yellow fever virus
RGLSSRKRR

SEQ ID NO: 160465 - protein, 9 aa, Yellow fever virus
GLSSRKRRS

SEQ ID NO: 160466 - protein, 9 aa, Yellow fever virus
LSSRKRRSH

SEQ ID NO: 160467 - protein, 9 aa, Yellow fever virus
SSRKRRSHD

SEQ ID NO: 160468 - protein, 9 aa, Yellow fever virus
SRKRRSHDV

SEQ ID NO: 160469 - protein, 9 aa, Yellow fever virus
RKRRSHDVL

SEQ ID NO: 160470 - protein, 9 aa, Yellow fever virus
TVQFLILGM

SEQ ID NO: 160471 - protein, 9 aa, Yellow fever virus
VQFLILGML

SEQ ID NO: 160472 - protein, 9 aa, Yellow fever virus
QFLILGMLL

SEQ ID NO: 160473 - protein, 9 aa, Yellow fever virus
FLILGMLLM

SEQ ID NO: 160474 - protein, 9 aa, Yellow fever virus
TGGVTLVRK

SEQ ID NO: 160475 - protein, 9 aa, Yellow fever virus
GGVTLVRKN

SEQ ID NO: 160476 - protein, 9 aa, Yellow fever virus
GVTLVRKNR

SEQ ID NO: 160477 - protein, 9 aa, Yellow fever virus
VTLVRKNRW

SEQ ID NO: 160478 - protein, 9 aa, Yellow fever virus
TLVRKNRWL

SEQ ID NO: 160479 - protein, 9 aa, Yellow fever virus
LVRKNRWLL

SEQ ID NO: 160480 - protein, 9 aa, Yellow fever virus
VRKNRWLLL

SEQ ID NO: 160481 - protein, 9 aa, Yellow fever virus
RKNRWLLLN

SEQ ID NO: 160482 - protein, 9 aa, Yellow fever virus
KNRWLLLNV

SEQ ID NO: 160483 - protein, 9 aa, Yellow fever virus
NRWLLLNVT

SEQ ID NO: 160484 - protein, 9 aa, Yellow fever virus
RWLLLNVTS

SEQ ID NO: 160485 - protein, 9 aa, Yellow fever virus
WLLLNVTSE

SEQ ID NO: 160486 - protein, 9 aa, Yellow fever virus
LLLNVTSED

SEQ ID NO: 160487 - protein, 9 aa, Yellow fever virus
LLNVTSEDL

SEQ ID NO: 160488 - protein, 9 aa, Yellow fever virus
LNVTSEDLG

SEQ ID NO: 160489 - protein, 9 aa, Yellow fever virus
NVTSEDLGK

SEQ ID NO: 160490 - protein, 9 aa, Yellow fever virus
VTSEDLGKT

SEQ ID NO: 160491 - protein, 9 aa, Yellow fever virus
TSEDLGKTF

SEQ ID NO: 160492 - protein, 9 aa, Yellow fever virus
SEDLGKTFS

SEQ ID NO: 160493 - protein, 9 aa, Yellow fever virus
EDLGKTFSV

SEQ ID NO: 160494 - protein, 9 aa, Yellow fever virus
DLGKTFSVG

SEQ ID NO: 160495 - protein, 9 aa, Yellow fever virus
LGKTFSVGT

SEQ ID NO: 160496 - protein, 9 aa, Yellow fever virus
GKTFSVGTG

SEQ ID NO: 160497 - protein, 9 aa, Yellow fever virus
KTFSVGTGN

SEQ ID NO: 160498 - protein, 9 aa, Yellow fever virus
TFSVGTGNC

SEQ ID NO: 160499 - protein, 9 aa, Yellow fever virus
FSVGTGNCT

SEQ ID NO: 160500 - protein, 9 aa, Yellow fever virus
SVGTGNCTT

SEQ ID NO: 160501 - protein, 9 aa, Yellow fever virus
VGTGNCTTN

SEQ ID NO: 160502 - protein, 9 aa, Yellow fever virus
GTGNCTTNI

SEQ ID NO: 160503 - protein, 9 aa, Yellow fever virus
TGNCTTNIL

SEQ ID NO: 160504 - protein, 9 aa, Yellow fever virus
GNCTTNILE

SEQ ID NO: 160505 - protein, 9 aa, Yellow fever virus
NCTTNILEA

SEQ ID NO: 160506 - protein, 9 aa, Yellow fever virus
CTTNILEAK

SEQ ID NO: 160507 - protein, 9 aa, Yellow fever virus
TTNILEAKY

SEQ ID NO: 160508 - protein, 9 aa, Yellow fever virus
TNILEAKYW

SEQ ID NO: 160509 - protein, 9 aa, Yellow fever virus
NILEAKYWC

SEQ ID NO: 160510 - protein, 9 aa, Yellow fever virus
ILEAKYWCP

SEQ ID NO: 160511 - protein, 9 aa, Yellow fever virus
LEAKYWCPD

SEQ ID NO: 160512 - protein, 9 aa, Yellow fever virus
EAKYWCPDS

SEQ ID NO: 160513 - protein, 9 aa, Yellow fever virus
AKYWCPDSM

SEQ ID NO: 160514 - protein, 9 aa, Yellow fever virus
KYWCPDSME

SEQ ID NO: 160515 - protein, 9 aa, Yellow fever virus
YWCPDSMEY

SEQ ID NO: 160516 - protein, 9 aa, Yellow fever virus
WCPDSMEYN

SEQ ID NO: 160517 - protein, 9 aa, Yellow fever virus
CPDSMEYNC

SEQ ID NO: 160518 - protein, 9 aa, Yellow fever virus
PDSMEYNCP

SEQ ID NO: 160519 - protein, 9 aa, Yellow fever virus
DSMEYNCPN

SEQ ID NO: 160520 - protein, 9 aa, Yellow fever virus
SMEYNCPNL

SEQ ID NO: 160521 - protein, 9 aa, Yellow fever virus
MEYNCPNLS

SEQ ID NO: 160522 - protein, 9 aa, Yellow fever virus
EYNCPNLSP

SEQ ID NO: 160523 - protein, 9 aa, Yellow fever virus
YNCPNLSPR

SEQ ID NO: 160524 - protein, 9 aa, Yellow fever virus
NCPNLSPRE

SEQ ID NO: 160525 - protein, 9 aa, Yellow fever virus
CPNLSPREE

SEQ ID NO: 160526 - protein, 9 aa, Yellow fever virus
PNLSPREEP

SEQ ID NO: 160527 - protein, 9 aa, Yellow fever virus
NLSPREEPD

SEQ ID NO: 160528 - protein, 9 aa, Yellow fever virus
LSPREEPDD

SEQ ID NO: 160529 - protein, 9 aa, Yellow fever virus
SPREEPDDI

SEQ ID NO: 160530 - protein, 9 aa, Yellow fever virus
PREEPDDID

SEQ ID NO: 160531 - protein, 9 aa, Yellow fever virus
REEPDDIDC

SEQ ID NO: 160532 - protein, 9 aa, Yellow fever virus
EEPDDIDCW

SEQ ID NO: 160533 - protein, 9 aa, Yellow fever virus
EPDDIDCWC

SEQ ID NO: 160534 - protein, 9 aa, Yellow fever virus
PDDIDCWCY

SEQ ID NO: 160535 - protein, 9 aa, Yellow fever virus
DDIDCWCYG

SEQ ID NO: 160536 - protein, 9 aa, Yellow fever virus
DIDCWCYGV

SEQ ID NO: 160537 - protein, 9 aa, Yellow fever virus
IDCWCYGVE

SEQ ID NO: 160538 - protein, 9 aa, Yellow fever virus
DCWCYGVEN

SEQ ID NO: 160539 - protein, 9 aa, Yellow fever virus
CWCYGVENV

SEQ ID NO: 160540 - protein, 9 aa, Yellow fever virus
WCYGVENVR

SEQ ID NO: 160541 - protein, 9 aa, Yellow fever virus
CYGVENVRV

SEQ ID NO: 160542 - protein, 9 aa, Yellow fever virus
YGVENVRVA

SEQ ID NO: 160543 - protein, 9 aa, Yellow fever virus
GVENVRVAY

SEQ ID NO: 160544 - protein, 9 aa, Yellow fever virus
VENVRVAYG

SEQ ID NO: 160545 - protein, 9 aa, Yellow fever virus
ENVRVAYGK

SEQ ID NO: 160546 - protein, 9 aa, Yellow fever virus
NVRVAYGKC

SEQ ID NO: 160547 - protein, 9 aa, Yellow fever virus
VRVAYGKCD

SEQ ID NO: 160548 - protein, 9 aa, Yellow fever virus
RVAYGKCDS

SEQ ID NO: 160549 - protein, 9 aa, Yellow fever virus
VAYGKCDSA

SEQ ID NO: 160550 - protein, 9 aa, Yellow fever virus
AYGKCDSAG

SEQ ID NO: 160551 - protein, 9 aa, Yellow fever virus
YGKCDSAGR

SEQ ID NO: 160552 - protein, 9 aa, Yellow fever virus
GKCDSAGRS

SEQ ID NO: 160553 - protein, 9 aa, Yellow fever virus
KCDSAGRSR

SEQ ID NO: 160554 - protein, 9 aa, Yellow fever virus
CDSAGRSRR

SEQ ID NO: 160555 - protein, 9 aa, Yellow fever virus
DSAGRSRRS

SEQ ID NO: 160556 - protein, 9 aa, Yellow fever virus
SAGRSRRSR

SEQ ID NO: 160557 - protein, 9 aa, Yellow fever virus
AGRSRRSRR

SEQ ID NO: 160558 - protein, 9 aa, Yellow fever virus
GRSRRSRRA

SEQ ID NO: 160559 - protein, 9 aa, Yellow fever virus
RSRRSRRAI

SEQ ID NO: 160560 - protein, 9 aa, Yellow fever virus
SRRSRRAID

SEQ ID NO: 160561 - protein, 9 aa, Yellow fever virus
RRSRRAIDL

SEQ ID NO: 160562 - protein, 9 aa, Yellow fever virus
RSRRAIDLP

SEQ ID NO: 160563 - protein, 9 aa, Yellow fever virus
SRRAIDLPT

SEQ ID NO: 160564 - protein, 9 aa, Yellow fever virus
RRAIDLPTH

SEQ ID NO: 160565 - protein, 9 aa, Yellow fever virus
RAIDLPTHE

SEQ ID NO: 160566 - protein, 9 aa, Yellow fever virus
AIDLPTHEN

SEQ ID NO: 160567 - protein, 9 aa, Yellow fever virus
IDLPTHENH

SEQ ID NO: 160568 - protein, 9 aa, Yellow fever virus
DLPTHENHG

SEQ ID NO: 160569 - protein, 9 aa, Yellow fever virus
LPTHENHGL

SEQ ID NO: 160570 - protein, 9 aa, Yellow fever virus
PTHENHGLK

SEQ ID NO: 160571 - protein, 9 aa, Yellow fever virus
THENHGLKT

SEQ ID NO: 160572 - protein, 9 aa, Yellow fever virus
HENHGLKTR

SEQ ID NO: 160573 - protein, 9 aa, Yellow fever virus
ENHGLKTRQ

SEQ ID NO: 160574 - protein, 9 aa, Yellow fever virus
NHGLKTRQE

SEQ ID NO: 160575 - protein, 9 aa, Yellow fever virus
HGLKTRQEK

SEQ ID NO: 160576 - protein, 9 aa, Yellow fever virus
GLKTRQEKW

SEQ ID NO: 160577 - protein, 9 aa, Yellow fever virus
LKTRQEKWM

SEQ ID NO: 160578 - protein, 9 aa, Yellow fever virus
KTRQEKWMT

SEQ ID NO: 160579 - protein, 9 aa, Yellow fever virus
TRQEKWMTG

SEQ ID NO: 160580 - protein, 9 aa, Yellow fever virus
RQEKWMTGR

SEQ ID NO: 160581 - protein, 9 aa, Yellow fever virus
QEKWMTGRM

SEQ ID NO: 160582 - protein, 9 aa, Yellow fever virus
EKWMTGRMG

SEQ ID NO: 160583 - protein, 9 aa, Yellow fever virus
KWMTGRMGE

SEQ ID NO: 160584 - protein, 9 aa, Yellow fever virus
WMTGRMGER

SEQ ID NO: 160585 - protein, 9 aa, Yellow fever virus
MTGRMGERQ

SEQ ID NO: 160586 - protein, 9 aa, Yellow fever virus
TGRMGERQL

SEQ ID NO: 160587 - protein, 9 aa, Yellow fever virus
GRMGERQLQ

SEQ ID NO: 160588 - protein, 9 aa, Yellow fever virus
RMGERQLQK

SEQ ID NO: 160589 - protein, 9 aa, Yellow fever virus
MGERQLQKI

SEQ ID NO: 160590 - protein, 9 aa, Yellow fever virus
GERQLQKIE

SEQ ID NO: 160591 - protein, 9 aa, Yellow fever virus
ERQLQKIER

SEQ ID NO: 160592 - protein, 9 aa, Yellow fever virus
RQLQKIERW

SEQ ID NO: 160593 - protein, 9 aa, Yellow fever virus
QLQKIERWF

SEQ ID NO: 160594 - protein, 9 aa, Yellow fever virus
LQKIERWFV

SEQ ID NO: 160595 - protein, 9 aa, Yellow fever virus
QKIERWFVR

SEQ ID NO: 160596 - protein, 9 aa, Yellow fever virus
KIERWFVRN

SEQ ID NO: 160597 - protein, 9 aa, Yellow fever virus
IERWFVRNP

SEQ ID NO: 160598 - protein, 9 aa, Yellow fever virus
ERWFVRNPF

SEQ ID NO: 160599 - protein, 9 aa, Yellow fever virus
RWFVRNPFF

SEQ ID NO: 160600 - protein, 9 aa, Yellow fever virus
WFVRNPFFA

SEQ ID NO: 160601 - protein, 9 aa, Yellow fever virus
FVRNPFFAV

SEQ ID NO: 160602 - protein, 9 aa, Yellow fever virus
VRNPFFAVT

SEQ ID NO: 160603 - protein, 9 aa, Yellow fever virus
RNPFFAVTA

SEQ ID NO: 160604 - protein, 9 aa, Yellow fever virus
NPFFAVTAL

SEQ ID NO: 160605 - protein, 9 aa, Yellow fever virus
PFFAVTALT

SEQ ID NO: 160606 - protein, 9 aa, Yellow fever virus
FFAVTALTI

SEQ ID NO: 160607 - protein, 9 aa, Yellow fever virus
FAVTALTIA

SEQ ID NO: 160608 - protein, 9 aa, Yellow fever virus
AVTALTIAY

SEQ ID NO: 160609 - protein, 9 aa, Yellow fever virus
VTALTIAYL

SEQ ID NO: 160610 - protein, 9 aa, Yellow fever virus
TALTIAYLV

SEQ ID NO: 160611 - protein, 9 aa, Yellow fever virus
ALTIAYLVG

SEQ ID NO: 160612 - protein, 9 aa, Yellow fever virus
LTIAYLVGS

SEQ ID NO: 160613 - protein, 9 aa, Yellow fever virus
TIAYLVGSN

SEQ ID NO: 160614 - protein, 9 aa, Yellow fever virus
IAYLVGSNM

SEQ ID NO: 160615 - protein, 9 aa, Yellow fever virus
AYLVGSNMT

SEQ ID NO: 160616 - protein, 9 aa, Yellow fever virus
YLVGSNMTQ

SEQ ID NO: 160617 - protein, 9 aa, Yellow fever virus
LVGSNMTQR

SEQ ID NO: 160618 - protein, 9 aa, Yellow fever virus
VGSNMTQRV

SEQ ID NO: 160619 - protein, 9 aa, Yellow fever virus
GSNMTQRVV

SEQ ID NO: 160620 - protein, 9 aa, Yellow fever virus
SNMTQRVVI

SEQ ID NO: 160621 - protein, 9 aa, Yellow fever virus
NMTQRVVIA

SEQ ID NO: 160622 - protein, 9 aa, Yellow fever virus
MTQRVVIAL

SEQ ID NO: 160623 - protein, 9 aa, Yellow fever virus
TQRVVIALL

SEQ ID NO: 160624 - protein, 9 aa, Yellow fever virus
QRVVIALLV

SEQ ID NO: 160625 - protein, 9 aa, Yellow fever virus
RVVIALLVL

SEQ ID NO: 160626 - protein, 9 aa, Yellow fever virus
VVIALLVLA

SEQ ID NO: 160627 - protein, 9 aa, Yellow fever virus
VIALLVLAV

SEQ ID NO: 160628 - protein, 9 aa, Yellow fever virus
IALLVLAVG

SEQ ID NO: 160629 - protein, 9 aa, Yellow fever virus
ALLVLAVGP

SEQ ID NO: 160630 - protein, 9 aa, Yellow fever virus
LLVLAVGPA

SEQ ID NO: 160631 - protein, 9 aa, Yellow fever virus
LVLAVGPAY

SEQ ID NO: 160632 - protein, 9 aa, Yellow fever virus
VLAVGPAYS

SEQ ID NO: 160633 - protein, 9 aa, Yellow fever virus
LAVGPAYSA

SEQ ID NO: 160634 - protein, 9 aa, Yellow fever virus
AVGPAYSAH

SEQ ID NO: 160635 - protein, 9 aa, Yellow fever virus
VGPAYSAHC

SEQ ID NO: 160636 - protein, 9 aa, Yellow fever virus
GPAYSAHCI

SEQ ID NO: 160637 - protein, 9 aa, Yellow fever virus
PAYSAHCIG

SEQ ID NO: 160638 - protein, 9 aa, Yellow fever virus
AYSAHCIGI

SEQ ID NO: 160639 - protein, 9 aa, Yellow fever virus
YSAHCIGIT

SEQ ID NO: 160640 - protein, 9 aa, Yellow fever virus
SAHCIGITD

SEQ ID NO: 160641 - protein, 9 aa, Yellow fever virus
AHCIGITDR

SEQ ID NO: 160642 - protein, 9 aa, Yellow fever virus
HCIGITDRD

SEQ ID NO: 160643 - protein, 9 aa, Yellow fever virus
CIGITDRDF

SEQ ID NO: 160644 - protein, 9 aa, Yellow fever virus
IGITDRDFI

SEQ ID NO: 160645 - protein, 9 aa, Yellow fever virus
GITDRDFIE

SEQ ID NO: 160646 - protein, 9 aa, Yellow fever virus
ITDRDFIEG

SEQ ID NO: 160647 - protein, 9 aa, Yellow fever virus
TDRDFIEGV

SEQ ID NO: 160648 - protein, 9 aa, Yellow fever virus
DRDFIEGVH

SEQ ID NO: 160649 - protein, 9 aa, Yellow fever virus
RDFIEGVHG

SEQ ID NO: 160650 - protein, 9 aa, Yellow fever virus
DFIEGVHGG

SEQ ID NO: 160651 - protein, 9 aa, Yellow fever virus
FIEGVHGGT

SEQ ID NO: 160652 - protein, 9 aa, Yellow fever virus
IEGVHGGTW

SEQ ID NO: 160653 - protein, 9 aa, Yellow fever virus
EGVHGGTWV

SEQ ID NO: 160654 - protein, 9 aa, Yellow fever virus
GVHGGTWVS

SEQ ID NO: 160655 - protein, 9 aa, Yellow fever virus
VHGGTWVSA

SEQ ID NO: 160656 - protein, 9 aa, Yellow fever virus
HGGTWVSAT

SEQ ID NO: 160657 - protein, 9 aa, Yellow fever virus
GGTWVSATL

SEQ ID NO: 160658 - protein, 9 aa, Yellow fever virus
GTWVSATLE

SEQ ID NO: 160659 - protein, 9 aa, Yellow fever virus
TWVSATLEQ

SEQ ID NO: 160660 - protein, 9 aa, Yellow fever virus
WVSATLEQD

SEQ ID NO: 160661 - protein, 9 aa, Yellow fever virus
VSATLEQDK

SEQ ID NO: 160662 - protein, 9 aa, Yellow fever virus
SATLEQDKC

SEQ ID NO: 160663 - protein, 9 aa, Yellow fever virus
ATLEQDKCV

SEQ ID NO: 160664 - protein, 9 aa, Yellow fever virus
TLEQDKCVT

SEQ ID NO: 160665 - protein, 9 aa, Yellow fever virus
LEQDKCVTV

SEQ ID NO: 160666 - protein, 9 aa, Yellow fever virus
EQDKCVTVM

SEQ ID NO: 160667 - protein, 9 aa, Yellow fever virus
QDKCVTVMA

SEQ ID NO: 160668 - protein, 9 aa, Yellow fever virus
DKCVTVMAP

SEQ ID NO: 160669 - protein, 9 aa, Yellow fever virus
KCVTVMAPD

SEQ ID NO: 160670 - protein, 9 aa, Yellow fever virus
CVTVMAPDK

SEQ ID NO: 160671 - protein, 9 aa, Yellow fever virus
VTVMAPDKP

SEQ ID NO: 160672 - protein, 9 aa, Yellow fever virus
TVMAPDKPS

SEQ ID NO: 160673 - protein, 9 aa, Yellow fever virus
VMAPDKPSL

SEQ ID NO: 160674 - protein, 9 aa, Yellow fever virus
MAPDKPSLD

SEQ ID NO: 160675 - protein, 9 aa, Yellow fever virus
APDKPSLDI

SEQ ID NO: 160676 - protein, 9 aa, Yellow fever virus
PDKPSLDIS

SEQ ID NO: 160677 - protein, 9 aa, Yellow fever virus
DKPSLDISL

SEQ ID NO: 160678 - protein, 9 aa, Yellow fever virus
KPSLDISLE

SEQ ID NO: 160679 - protein, 9 aa, Yellow fever virus
PSLDISLET

SEQ ID NO: 160680 - protein, 9 aa, Yellow fever virus
SLDISLETV

SEQ ID NO: 160681 - protein, 9 aa, Yellow fever virus
LDISLETVA

SEQ ID NO: 160682 - protein, 9 aa, Yellow fever virus
DISLETVAI

SEQ ID NO: 160683 - protein, 9 aa, Yellow fever virus
ISLETVAID

SEQ ID NO: 160684 - protein, 9 aa, Yellow fever virus
SLETVAIDR

SEQ ID NO: 160685 - protein, 9 aa, Yellow fever virus
LETVAIDRP

SEQ ID NO: 160686 - protein, 9 aa, Yellow fever virus
ETVAIDRPA

SEQ ID NO: 160687 - protein, 9 aa, Yellow fever virus
TVAIDRPAE

SEQ ID NO: 160688 - protein, 9 aa, Yellow fever virus
VAIDRPAEV

SEQ ID NO: 160689 - protein, 9 aa, Yellow fever virus
AIDRPAEVR

SEQ ID NO: 160690 - protein, 9 aa, Yellow fever virus
IDRPAEVRK

SEQ ID NO: 160691 - protein, 9 aa, Yellow fever virus
DRPAEVRKV

SEQ ID NO: 160692 - protein, 9 aa, Yellow fever virus
RPAEVRKVC

SEQ ID NO: 160693 - protein, 9 aa, Yellow fever virus
PAEARKVCY

SEQ ID NO: 160694 - protein, 9 aa, Yellow fever virus
AEVRKVCYN

SEQ ID NO: 160695 - protein, 9 aa, Yellow fever virus
EVRKVCYNA

SEQ ID NO: 160696 - protein, 9 aa, Yellow fever virus
VRKVCYNAV

SEQ ID NO: 160697 - protein, 9 aa, Yellow fever virus
RKVCYNAVL

SEQ ID NO: 160698 - protein, 9 aa, Yellow fever virus
KVCYNAVLT

SEQ ID NO: 160699 - protein, 9 aa, Yellow fever virus
VCYNAVLTH

SEQ ID NO: 160700 - protein, 9 aa, Yellow fever virus
CYNAVLTHV

SEQ ID NO: 160701 - protein, 9 aa, Yellow fever virus
YNAVLTHVK

SEQ ID NO: 160702 - protein, 9 aa, Yellow fever virus
NAVLTHVKI

SEQ ID NO: 160703 - protein, 9 aa, Yellow fever virus
AVLTHVKIN

SEQ ID NO: 160704 - protein, 9 aa, Yellow fever virus
VLTHVKIND

SEQ ID NO: 160705 - protein, 9 aa, Yellow fever virus
LTHVKINDK

SEQ ID NO: 160706 - protein, 9 aa, Yellow fever virus
THVKINDKC

SEQ ID NO: 160707 - protein, 9 aa, Yellow fever virus
HVKINDKCP

SEQ ID NO: 160708 - protein, 9 aa, Yellow fever virus
VKINDKCPS

SEQ ID NO: 160709 - protein, 9 aa, Yellow fever virus
KINDKCPST

SEQ ID NO: 160710 - protein, 9 aa, Yellow fever virus
INDKCPSTG

SEQ ID NO: 160711 - protein, 9 aa, Yellow fever virus
NDKCPSTGE

SEQ ID NO: 160712 - protein, 9 aa, Yellow fever virus
DKCPSTGEA

SEQ ID NO: 160713 - protein, 9 aa, Yellow fever virus
KCPSTGEAH

SEQ ID NO: 160714 - protein, 9 aa, Yellow fever virus
CPSTGEAHL

SEQ ID NO: 160715 - protein, 9 aa, Yellow fever virus
PSTGEAHLA

SEQ ID NO: 160716 - protein, 9 aa, Yellow fever virus
STGEAHLAE

SEQ ID NO: 160717 - protein, 9 aa, Yellow fever virus
TGEAHLAEE

SEQ ID NO: 160718 - protein, 9 aa, Yellow fever virus
GEAHLAEEN

SEQ ID NO: 160719 - protein, 9 aa, Yellow fever virus
EAHLAEENE

SEQ ID NO: 160720 - protein, 9 aa, Yellow fever virus
AHLAEENEG

SEQ ID NO: 160721 - protein, 9 aa, Yellow fever virus
HLAEENEGD

SEQ ID NO: 160722 - protein, 9 aa, Yellow fever virus
LAEENEGDN

SEQ ID NO: 160723 - protein, 9 aa, Yellow fever virus
AEENEGDNA

SEQ ID NO: 160724 - protein, 9 aa, Yellow fever virus
EENEGDNAC

SEQ ID NO: 160725 - protein, 9 aa, Yellow fever virus
ENEGDNACK

SEQ ID NO: 160726 - protein, 9 aa, Yellow fever virus
NEGDNACKR

SEQ ID NO: 160727 - protein, 9 aa, Yellow fever virus
EGDNACKRT

SEQ ID NO: 160728 - protein, 9 aa, Yellow fever virus
GDNACKRTY

SEQ ID NO: 160729 - protein, 9 aa, Yellow fever virus
DNACKRTYS

SEQ ID NO: 160730 - protein, 9 aa, Yellow fever virus
NACKRTYSD

SEQ ID NO: 160731 - protein, 9 aa, Yellow fever virus
ACKRTYSDR

SEQ ID NO: 160732 - protein, 9 aa, Yellow fever virus
CKRTYSDRG

SEQ ID NO: 160733 - protein, 9 aa, Yellow fever virus
KRTYSDRGW

SEQ ID NO: 160734 - protein, 9 aa, Yellow fever virus
RTYSDRGWG

SEQ ID NO: 160735 - protein, 9 aa, Yellow fever virus
TYSDRGWGN

SEQ ID NO: 160736 - protein, 9 aa, Yellow fever virus
YSDRGWGNG

SEQ ID NO: 160737 - protein, 9 aa, Yellow fever virus
SDRGWGNGC

SEQ ID NO: 160738 - protein, 9 aa, Yellow fever virus
DRGWGNGCG

SEQ ID NO: 160739 - protein, 9 aa, Yellow fever virus
RGWGNGCGL

SEQ ID NO: 160740 - protein, 9 aa, Yellow fever virus
GWGNGCGLF

SEQ ID NO: 160741 - protein, 9 aa, Yellow fever virus
WGNGCGLFG

SEQ ID NO: 160742 - protein, 9 aa, Yellow fever virus
GNGCGLFGK

SEQ ID NO: 160743 - protein, 9 aa, Yellow fever virus
NGCGLFGKG

SEQ ID NO: 160744 - protein, 9 aa, Yellow fever virus
GCGLFGKGS

SEQ ID NO: 160745 - protein, 9 aa, Yellow fever virus
CGLFGKGSI

SEQ ID NO: 160746 - protein, 9 aa, Yellow fever virus
GLFGKGSIV

SEQ ID NO: 160747 - protein, 9 aa, Yellow fever virus
LFGKGSIVA

SEQ ID NO: 160748 - protein, 9 aa, Yellow fever virus
FGKGSIVAC

SEQ ID NO: 160749 - protein, 9 aa, Yellow fever virus
GKGSIVACA

SEQ ID NO: 160750 - protein, 9 aa, Yellow fever virus
KGSIVACAK

SEQ ID NO: 160751 - protein, 9 aa, Yellow fever virus
GSIVACAKF

SEQ ID NO: 160752 - protein, 9 aa, Yellow fever virus
SIVACAKFT

SEQ ID NO: 160753 - protein, 9 aa, Yellow fever virus
IVACAKFTC

SEQ ID NO: 160754 - protein, 9 aa, Yellow fever virus
VACAKFTCA

SEQ ID NO: 160755 - protein, 9 aa, Yellow fever virus
ACAKFTCAK

SEQ ID NO: 160756 - protein, 9 aa, Yellow fever virus
CAKFTCAKS

SEQ ID NO: 160757 - protein, 9 aa, Yellow fever virus
AKFTCAKSM

SEQ ID NO: 160758 - protein, 9 aa, Yellow fever virus
KFTCAKSMS

SEQ ID NO: 160759 - protein, 9 aa, Yellow fever virus
FTCAKSMSL

SEQ ID NO: 160760 - protein, 9 aa, Yellow fever virus
TCAKSMSLF

SEQ ID NO: 160761 - protein, 9 aa, Yellow fever virus
CAKSMSLFE

SEQ ID NO: 160762 - protein, 9 aa, Yellow fever virus
AKSMSLFEV

SEQ ID NO: 160763 - protein, 9 aa, Yellow fever virus
KSMSLFEVD

SEQ ID NO: 160764 - protein, 9 aa, Yellow fever virus
SMSLFEVDQ

SEQ ID NO: 160765 - protein, 9 aa, Yellow fever virus
MSLFEVDQT

SEQ ID NO: 160766 - protein, 9 aa, Yellow fever virus
SLFEVDQTK

SEQ ID NO: 160767 - protein, 9 aa, Yellow fever virus
LFEVDQTKI

SEQ ID NO: 160768 - protein, 9 aa, Yellow fever virus
FEVDQTKIQ

SEQ ID NO: 160769 - protein, 9 aa, Yellow fever virus
EVDQTKIQY

SEQ ID NO: 160770 - protein, 9 aa, Yellow fever virus
VDQTKIQYV

SEQ ID NO: 160771 - protein, 9 aa, Yellow fever virus
DQTKIQYVI

SEQ ID NO: 160772 - protein, 9 aa, Yellow fever virus
QTKIQYVIR

SEQ ID NO: 160773 - protein, 9 aa, Yellow fever virus
TKIQYVIRA

SEQ ID NO: 160774 - protein, 9 aa, Yellow fever virus
KIQYVIRAQ

SEQ ID NO: 160775 - protein, 9 aa, Yellow fever virus
IQYVIRAQL

SEQ ID NO: 160776 - protein, 9 aa, Yellow fever virus
QYVIRAQLH

SEQ ID NO: 160777 - protein, 9 aa, Yellow fever virus
YVIRAQLHV

SEQ ID NO: 160778 - protein, 9 aa, Yellow fever virus
VIRAQLHVG

SEQ ID NO: 160779 - protein, 9 aa, Yellow fever virus
IRAQLHVGA

SEQ ID NO: 160780 - protein, 9 aa, Yellow fever virus
RAQLHVGAK

SEQ ID NO: 160781 - protein, 9 aa, Yellow fever virus
AQLHVGAKQ

SEQ ID NO: 160782 - protein, 9 aa, Yellow fever virus
QLHVGAKQE

SEQ ID NO: 160783 - protein, 9 aa, Yellow fever virus
LHVGAKQEN

SEQ ID NO: 160784 - protein, 9 aa, Yellow fever virus
HVGAKQENW

SEQ ID NO: 160785 - protein, 9 aa, Yellow fever virus
VGAKQENWN

SEQ ID NO: 160786 - protein, 9 aa, Yellow fever virus
GAKQENWNT

SEQ ID NO: 160787 - protein, 9 aa, Yellow fever virus
AKQENWNTD

SEQ ID NO: 160788 - protein, 9 aa, Yellow fever virus
KQENWNTDI

SEQ ID NO: 160789 - protein, 9 aa, Yellow fever virus
QENWNTDIK

SEQ ID NO: 160790 - protein, 9 aa, Yellow fever virus
ENWNTDIKT

SEQ ID NO: 160791 - protein, 9 aa, Yellow fever virus
NWNTDIKTL

SEQ ID NO: 160792 - protein, 9 aa, Yellow fever virus
WNTDIKTLK

SEQ ID NO: 160793 - protein, 9 aa, Yellow fever virus
NTDIKTLKF

SEQ ID NO: 160794 - protein, 9 aa, Yellow fever virus
TDIKTLKFD

SEQ ID NO: 160795 - protein, 9 aa, Yellow fever virus
DIKTLKFDA

SEQ ID NO: 160796 - protein, 9 aa, Yellow fever virus
IKTLKFDAL

SEQ ID NO: 160797 - protein, 9 aa, Yellow fever virus
KTLKFDALS

SEQ ID NO: 160798 - protein, 9 aa, Yellow fever virus
TLKFDALSG

SEQ ID NO: 160799 - protein, 9 aa, Yellow fever virus
LKFDALSGS

SEQ ID NO: 160800 - protein, 9 aa, Yellow fever virus
KFDALSGSQ

SEQ ID NO: 160801 - protein, 9 aa, Yellow fever virus
FDALSGSQE

SEQ ID NO: 160802 - protein, 9 aa, Yellow fever virus
DALSGSQEV

SEQ ID NO: 160803 - protein, 9 aa, Yellow fever virus
ALSGSQEVE

SEQ ID NO: 160804 - protein, 9 aa, Yellow fever virus
LSGSQEVEF

SEQ ID NO: 160805 - protein, 9 aa, Yellow fever virus
SGSQEVEFI

SEQ ID NO: 160806 - protein, 9 aa, Yellow fever virus
GSQEVEFIG

SEQ ID NO: 160807 - protein, 9 aa, Yellow fever virus
SQEVEFIGY

SEQ ID NO: 160808 - protein, 9 aa, Yellow fever virus
QEVEFIGYG

SEQ ID NO: 160809 - protein, 9 aa, Yellow fever virus
EVEFIGYGK

SEQ ID NO: 160810 - protein, 9 aa, Yellow fever virus
VEFIGYGKA

SEQ ID NO: 160811 - protein, 9 aa, Yellow fever virus
EFIGYGKAT

SEQ ID NO: 160812 - protein, 9 aa, Yellow fever virus
FIGYGKATL

SEQ ID NO: 160813 - protein, 9 aa, Yellow fever virus
IGYGKATLE

SEQ ID NO: 160814 - protein, 9 aa, Yellow fever virus
GYGKATLEC

SEQ ID NO: 160815 - protein, 9 aa, Yellow fever virus
YGKATLECQ

SEQ ID NO: 160816 - protein, 9 aa, Yellow fever virus
GKATLECQV

SEQ ID NO: 160817 - protein, 9 aa, Yellow fever virus
KATLECQVQ

SEQ ID NO: 160818 - protein, 9 aa, Yellow fever virus
ATLECQVQT

SEQ ID NO: 160819 - protein, 9 aa, Yellow fever virus
TLECQVQTA

SEQ ID NO: 160820 - protein, 9 aa, Yellow fever virus
LECQVQTAV

SEQ ID NO: 160821 - protein, 9 aa, Yellow fever virus
ECQVQTAVD

SEQ ID NO: 160822 - protein, 9 aa, Yellow fever virus
CQVQTAVDF

SEQ ID NO: 160823 - protein, 9 aa, Yellow fever virus
QVQTAVDFG

SEQ ID NO: 160824 - protein, 9 aa, Yellow fever virus
VQTAVDFGN

SEQ ID NO: 160825 - protein, 9 aa, Yellow fever virus
QTAVDFGNS

SEQ ID NO: 160826 - protein, 9 aa, Yellow fever virus
TAVDFGNSY

SEQ ID NO: 160827 - protein, 9 aa, Yellow fever virus
AVDFGNSYI

SEQ ID NO: 160828 - protein, 9 aa, Yellow fever virus
VDFGNSYIA

SEQ ID NO: 160829 - protein, 9 aa, Yellow fever virus
DFGNSYIAE

SEQ ID NO: 160830 - protein, 9 aa, Yellow fever virus
FGNSYIAEM

SEQ ID NO: 160831 - protein, 9 aa, Yellow fever virus
GNSYIAEME

SEQ ID NO: 160832 - protein, 9 aa, Yellow fever virus
NSYIAEMET

SEQ ID NO: 160833 - protein, 9 aa, Yellow fever virus
SYIAEMETE

SEQ ID NO: 160834 - protein, 9 aa, Yellow fever virus
YIAEMETES

SEQ ID NO: 160835 - protein, 9 aa, Yellow fever virus
IAEMETESW

SEQ ID NO: 160836 - protein, 9 aa, Yellow fever virus
AEMETESWI

SEQ ID NO: 160837 - protein, 9 aa, Yellow fever virus
EMETESWIV

SEQ ID NO: 160838 - protein, 9 aa, Yellow fever virus
METESWIVD

SEQ ID NO: 160839 - protein, 9 aa, Yellow fever virus
ETESWIVDR

SEQ ID NO: 160840 - protein, 9 aa, Yellow fever virus
TESWIVDRQ

SEQ ID NO: 160841 - protein, 9 aa, Yellow fever virus
ESWIVDRQW

SEQ ID NO: 160842 - protein, 9 aa, Yellow fever virus
SWIVDRQWA

SEQ ID NO: 160843 - protein, 9 aa, Yellow fever virus
WIVDRQWAQ

SEQ ID NO: 160844 - protein, 9 aa, Yellow fever virus
IVDRQWAQD

SEQ ID NO: 160845 - protein, 9 aa, Yellow fever virus
VDRQWAQDL

SEQ ID NO: 160846 - protein, 9 aa, Yellow fever virus
DRQWAQDLT

SEQ ID NO: 160847 - protein, 9 aa, Yellow fever virus
RQWAQDLTL

SEQ ID NO: 160848 - protein, 9 aa, Yellow fever virus
QWAQDLTLP

SEQ ID NO: 160849 - protein, 9 aa, Yellow fever virus
WAQDLTLPW

SEQ ID NO: 160850 - protein, 9 aa, Yellow fever virus
AQDLTLPWQ

SEQ ID NO: 160851 - protein, 9 aa, Yellow fever virus
QDLTLPWQS

SEQ ID NO: 160852 - protein, 9 aa, Yellow fever virus
DLTLPWQSG

SEQ ID NO: 160853 - protein, 9 aa, Yellow fever virus
LTLPWQSGS

SEQ ID NO: 160854 - protein, 9 aa, Yellow fever virus
TLPWQSGSG

SEQ ID NO: 160855 - protein, 9 aa, Yellow fever virus
LPWQSGSGG

SEQ ID NO: 160856 - protein, 9 aa, Yellow fever virus
PWQSGSGGV

SEQ ID NO: 160857 - protein, 9 aa, Yellow fever virus
WQSGSGGVW

SEQ ID NO: 160858 - protein, 9 aa, Yellow fever virus
QSGSGGVWR

SEQ ID NO: 160859 - protein, 9 aa, Yellow fever virus
SGSGGVWRE

SEQ ID NO: 160860 - protein, 9 aa, Yellow fever virus
GSGGVWREM

SEQ ID NO: 160861 - protein, 9 aa, Yellow fever virus
SGGVWREMH

SEQ ID NO: 160862 - protein, 9 aa, Yellow fever virus
GGVWREMHH

SEQ ID NO: 160863 - protein, 9 aa, Yellow fever virus
GVWREMHHL

SEQ ID NO: 160864 - protein, 9 aa, Yellow fever virus
VWREMHHLV

SEQ ID NO: 160865 - protein, 9 aa, Yellow fever virus
WREMHHLVE

SEQ ID NO: 160866 - protein, 9 aa, Yellow fever virus
REMHHLVEF

SEQ ID NO: 160867 - protein, 9 aa, Yellow fever virus
EMHHLVEFE

SEQ ID NO: 160868 - protein, 9 aa, Yellow fever virus
MHHLVEFEP

SEQ ID NO: 160869 - protein, 9 aa, Yellow fever virus
HHLVEFEPP

SEQ ID NO: 160870 - protein, 9 aa, Yellow fever virus
HLVEFEPPH

SEQ ID NO: 160871 - protein, 9 aa, Yellow fever virus
LVEFEPPHA

SEQ ID NO: 160872 - protein, 9 aa, Yellow fever virus
VEFEPPHAA

SEQ ID NO: 160873 - protein, 9 aa, Yellow fever virus
EFEPPHAAT

SEQ ID NO: 160874 - protein, 9 aa, Yellow fever virus
FEPPHAATI

SEQ ID NO: 160875 - protein, 9 aa, Yellow fever virus
EPPHAATIR

SEQ ID NO: 160876 - protein, 9 aa, Yellow fever virus
PPHAATIRV

SEQ ID NO: 160877 - protein, 9 aa, Yellow fever virus
PHAATIRVL

SEQ ID NO: 160878 - protein, 9 aa, Yellow fever virus
HAATIRVLA

SEQ ID NO: 160879 - protein, 9 aa, Yellow fever virus
AATIRVLAL

SEQ ID NO: 160880 - protein, 9 aa, Yellow fever virus
ATIRVLALG

SEQ ID NO: 160881 - protein, 9 aa, Yellow fever virus
TIRVLALGN

SEQ ID NO: 160882 - protein, 9 aa, Yellow fever virus
IRVLALGNQ

SEQ ID NO: 160883 - protein, 9 aa, Yellow fever virus
RVLALGNQE

SEQ ID NO: 160884 - protein, 9 aa, Yellow fever virus
VLALGNQEG

SEQ ID NO: 160885 - protein, 9 aa, Yellow fever virus
LALGNQEGS

SEQ ID NO: 160886 - protein, 9 aa, Yellow fever virus
ALGNQEGSL

SEQ ID NO: 160887 - protein, 9 aa, Yellow fever virus
LGNQEGSLK

SEQ ID NO: 160888 - protein, 9 aa, Yellow fever virus
GNQEGSLKT

SEQ ID NO: 160889 - protein, 9 aa, Yellow fever virus
NQEGSLKTA

SEQ ID NO: 160890 - protein, 9 aa, Yellow fever virus
QEGSLKTAL

SEQ ID NO: 160891 - protein, 9 aa, Yellow fever virus
EGSLKTALT

SEQ ID NO: 160892 - protein, 9 aa, Yellow fever virus
GSLKTALTG

SEQ ID NO: 160893 - protein, 9 aa, Yellow fever virus
SLKTALTGA

SEQ ID NO: 160894 - protein, 9 aa, Yellow fever virus
LKTALTGAM

SEQ ID NO: 160895 - protein, 9 aa, Yellow fever virus
KTALTGAMR

SEQ ID NO: 160896 - protein, 9 aa, Yellow fever virus
TALTGAMRV

SEQ ID NO: 160897 - protein, 9 aa, Yellow fever virus
ALTGAMRVT

SEQ ID NO: 160898 - protein, 9 aa, Yellow fever virus
LTGAMRVTK

SEQ ID NO: 160899 - protein, 9 aa, Yellow fever virus
TGAMRVTKD

SEQ ID NO: 160900 - protein, 9 aa, Yellow fever virus
GAMRVTKDT

SEQ ID NO: 160901 - protein, 9 aa, Yellow fever virus
AMRVTKDTN

SEQ ID NO: 160902 - protein, 9 aa, Yellow fever virus
MRVTKDTND

SEQ ID NO: 160903 - protein, 9 aa, Yellow fever virus
RVTKDTNDN

SEQ ID NO: 160904 - protein, 9 aa, Yellow fever virus
VTKDTNDNN

SEQ ID NO: 160905 - protein, 9 aa, Yellow fever virus
TKDTNDNNL

SEQ ID NO: 160906 - protein, 9 aa, Yellow fever virus
KDTNDNNLY

SEQ ID NO: 160907 - protein, 9 aa, Yellow fever virus
DTNDNNLYK

SEQ ID NO: 160908 - protein, 9 aa, Yellow fever virus
TNDNNLYKL

SEQ ID NO: 160909 - protein, 9 aa, Yellow fever virus
NDNNLYKLH

SEQ ID NO: 160910 - protein, 9 aa, Yellow fever virus
DNNLYKLHG

SEQ ID NO: 160911 - protein, 9 aa, Yellow fever virus
NNLYKLHGG

SEQ ID NO: 160912 - protein, 9 aa, Yellow fever virus
NLYKLHGGH

SEQ ID NO: 160913 - protein, 9 aa, Yellow fever virus
LYKLHGGHV

SEQ ID NO: 160914 - protein, 9 aa, Yellow fever virus
YKLHGGHVS

SEQ ID NO: 160915 - protein, 9 aa, Yellow fever virus
KLHGGHVSC

SEQ ID NO: 160916 - protein, 9 aa, Yellow fever virus
LHGGHVSCR

SEQ ID NO: 160917 - protein, 9 aa, Yellow fever virus
HGGHVSCRV

SEQ ID NO: 160918 - protein, 9 aa, Yellow fever virus
GGHVSCRVK

SEQ ID NO: 160919 - protein, 9 aa, Yellow fever virus
GHVSCRVKL

SEQ ID NO: 160920 - protein, 9 aa, Yellow fever virus
HVSCRVKLS

SEQ ID NO: 160921 - protein, 9 aa, Yellow fever virus
VSCRVKLSA

SEQ ID NO: 160922 - protein, 9 aa, Yellow fever virus
SCRVKLSAL

SEQ ID NO: 160923 - protein, 9 aa, Yellow fever virus
CRVKLSALT

SEQ ID NO: 160924 - protein, 9 aa, Yellow fever virus
RVKLSALTL

SEQ ID NO: 160925 - protein, 9 aa, Yellow fever virus
VKLSALTLK

SEQ ID NO: 160926 - protein, 9 aa, Yellow fever virus
KLSALTLKG

SEQ ID NO: 160927 - protein, 9 aa, Yellow fever virus
LSALTLKGT

SEQ ID NO: 160928 - protein, 9 aa, Yellow fever virus
SALTLKGTS

SEQ ID NO: 160929 - protein, 9 aa, Yellow fever virus
ALTLKGTSY

SEQ ID NO: 160930 - protein, 9 aa, Yellow fever virus
LTLKGTSYK

SEQ ID NO: 160931 - protein, 9 aa, Yellow fever virus
TLKGTSYKI

SEQ ID NO: 160932 - protein, 9 aa, Yellow fever virus
LKGTSYKIC

SEQ ID NO: 160933 - protein, 9 aa, Yellow fever virus
KGTSYKICT

SEQ ID NO: 160934 - protein, 9 aa, Yellow fever virus
GTSYKICTD

SEQ ID NO: 160935 - protein, 9 aa, Yellow fever virus
TSYKICTDK

SEQ ID NO: 160936 - protein, 9 aa, Yellow fever virus
SYKICTDKM

SEQ ID NO: 160937 - protein, 9 aa, Yellow fever virus
YKICTDKMF

SEQ ID NO: 160938 - protein, 9 aa, Yellow fever virus
KICTDKMFF

SEQ ID NO: 160939 - protein, 9 aa, Yellow fever virus
ICTDKMFFV

SEQ ID NO: 160940 - protein, 9 aa, Yellow fever virus
CTDKMFFVK

SEQ ID NO: 160941 - protein, 9 aa, Yellow fever virus
TDKMFFVKN

SEQ ID NO: 160942 - protein, 9 aa, Yellow fever virus
DKMFFVKNP

SEQ ID NO: 160943 - protein, 9 aa, Yellow fever virus
KMFFVKNPT

SEQ ID NO: 160944 - protein, 9 aa, Yellow fever virus
MFFVKNPTD

SEQ ID NO: 160945 - protein, 9 aa, Yellow fever virus
FFVKNPTDT

SEQ ID NO: 160946 - protein, 9 aa, Yellow fever virus
FVKNPTDTG

SEQ ID NO: 160947 - protein, 9 aa, Yellow fever virus
VKNPTDTGH

SEQ ID NO: 160948 - protein, 9 aa, Yellow fever virus
KNPTDTGHG

SEQ ID NO: 160949 - protein, 9 aa, Yellow fever virus
NPTDTGHGT

SEQ ID NO: 160950 - protein, 9 aa, Yellow fever virus
PTDTGHGTV

SEQ ID NO: 160951 - protein, 9 aa, Yellow fever virus
TDTGHGTVV

SEQ ID NO: 160952 - protein, 9 aa, Yellow fever virus
DTGHGTVVM

SEQ ID NO: 160953 - protein, 9 aa, Yellow fever virus
TGHGTVVMQ

SEQ ID NO: 160954 - protein, 9 aa, Yellow fever virus
GHGTVVMQV

SEQ ID NO: 160955 - protein, 9 aa, Yellow fever virus
HGTVVMQVK

SEQ ID NO: 160956 - protein, 9 aa, Yellow fever virus
GTVVMQVKV

SEQ ID NO: 160957 - protein, 9 aa, Yellow fever virus
TVVMQVKVP

SEQ ID NO: 160958 - protein, 9 aa, Yellow fever virus
VVMQVKVPK

SEQ ID NO: 160959 - protein, 9 aa, Yellow fever virus
VMQVKVPKG

SEQ ID NO: 160960 - protein, 9 aa, Yellow fever virus
MQVKVPKGA

SEQ ID NO: 160961 - protein, 9 aa, Yellow fever virus
QVKVPKGAP

SEQ ID NO: 160962 - protein, 9 aa, Yellow fever virus
VKVPKGAPC

SEQ ID NO: 160963 - protein, 9 aa, Yellow fever virus
KVSKGAPCR

SEQ ID NO: 160964 - protein, 9 aa, Yellow fever virus
VSKGAPCRI

SEQ ID NO: 160965 - protein, 9 aa, Yellow fever virus
SKGAPCRIP

SEQ ID NO: 160966 - protein, 9 aa, Yellow fever virus
KGAPCRIPV

SEQ ID NO: 160967 - protein, 9 aa, Yellow fever virus
GAPCRIPVI

SEQ ID NO: 160968 - protein, 9 aa, Yellow fever virus
APCRIPVIV

SEQ ID NO: 160969 - protein, 9 aa, Yellow fever virus
PCRIPVIVA

SEQ ID NO: 160970 - protein, 9 aa, Yellow fever virus
CRIPVIVAD

SEQ ID NO: 160971 - protein, 9 aa, Yellow fever virus
RIPVIVADD

SEQ ID NO: 160972 - protein, 9 aa, Yellow fever virus
IPVIVADDL

SEQ ID NO: 160973 - protein, 9 aa, Yellow fever virus
PVIVADDLT

SEQ ID NO: 160974 - protein, 9 aa, Yellow fever virus
VIVADDLTA

SEQ ID NO: 160975 - protein, 9 aa, Yellow fever virus
IVADDLTAA

SEQ ID NO: 160976 - protein, 9 aa, Yellow fever virus
VADDLTAAI

SEQ ID NO: 160977 - protein, 9 aa, Yellow fever virus
ADDLTAAIN

SEQ ID NO: 160978 - protein, 9 aa, Yellow fever virus
DDLTAAINK

SEQ ID NO: 160979 - protein, 9 aa, Yellow fever virus
DLTAAINKG

SEQ ID NO: 160980 - protein, 9 aa, Yellow fever virus
LTAAINKGI

SEQ ID NO: 160981 - protein, 9 aa, Yellow fever virus
TAAINKGIL

SEQ ID NO: 160982 - protein, 9 aa, Yellow fever virus
AAINKGILV

SEQ ID NO: 160983 - protein, 9 aa, Yellow fever virus
AINKGILVT

SEQ ID NO: 160984 - protein, 9 aa, Yellow fever virus
INKGILVTV

SEQ ID NO: 160985 - protein, 9 aa, Yellow fever virus
NKGILVTVN

SEQ ID NO: 160986 - protein, 9 aa, Yellow fever virus
KGILVTVNP

SEQ ID NO: 160987 - protein, 9 aa, Yellow fever virus
GILVTVNPI

SEQ ID NO: 160988 - protein, 9 aa, Yellow fever virus
ILVTVNPIA

SEQ ID NO: 160989 - protein, 9 aa, Yellow fever virus
LVTVNPIAS

SEQ ID NO: 160990 - protein, 9 aa, Yellow fever virus
VTVNPIAST

SEQ ID NO: 160991 - protein, 9 aa, Yellow fever virus
TVNPIASTN

SEQ ID NO: 160992 - protein, 9 aa, Yellow fever virus
VNPIASTND

SEQ ID NO: 160993 - protein, 9 aa, Yellow fever virus
NPIASTNDD

SEQ ID NO: 160994 - protein, 9 aa, Yellow fever virus
PIASTNDDE

SEQ ID NO: 160995 - protein, 9 aa, Yellow fever virus
IASTNDDEV

SEQ ID NO: 160996 - protein, 9 aa, Yellow fever virus
ASTNDDEVL

SEQ ID NO: 160997 - protein, 9 aa, Yellow fever virus
STNDDEVLI

SEQ ID NO: 160998 - protein, 9 aa, Yellow fever virus
TNDDEVLIE

SEQ ID NO: 160999 - protein, 9 aa, Yellow fever virus
NDDEVLIEV

SEQ ID NO: 161000 - protein, 9 aa, Yellow fever virus
DDEVLIEVN

SEQ ID NO: 161001 - protein, 9 aa, Yellow fever virus
DEVLIEVNP

SEQ ID NO: 161002 - protein, 9 aa, Yellow fever virus
EVLIEVNPP

SEQ ID NO: 161003 - protein, 9 aa, Yellow fever virus
VLIEVNPPF

SEQ ID NO: 161004 - protein, 9 aa, Yellow fever virus
LIEVNPPFG

SEQ ID NO: 161005 - protein, 9 aa, Yellow fever virus
IEVNPPFGD

SEQ ID NO: 161006 - protein, 9 aa, Yellow fever virus
EVNPPFGDS

SEQ ID NO: 161007 - protein, 9 aa, Yellow fever virus
VNPPFGDSY

SEQ ID NO: 161008 - protein, 9 aa, Yellow fever virus
NPPFGDSYI

SEQ ID NO: 161009 - protein, 9 aa, Yellow fever virus
PPFGDSYII

SEQ ID NO: 161010 - protein, 9 aa, Yellow fever virus
PFGDSYIIV

SEQ ID NO: 161011 - protein, 9 aa, Yellow fever virus
FGDSYIIVG

SEQ ID NO: 161012 - protein, 9 aa, Yellow fever virus
GDSYIIVGR

SEQ ID NO: 161013 - protein, 9 aa, Yellow fever virus
DSYIIVGRG

SEQ ID NO: 161014 - protein, 9 aa, Yellow fever virus
SYIIVGRGD

SEQ ID NO: 161015 - protein, 9 aa, Yellow fever virus
YIIVGRGDS

SEQ ID NO: 161016 - protein, 9 aa, Yellow fever virus
IIVGRGDSR

SEQ ID NO: 161017 - protein, 9 aa, Yellow fever virus
IVGRGDSRL

SEQ ID NO: 161018 - protein, 9 aa, Yellow fever virus
VGRGDSRLT

SEQ ID NO: 161019 - protein, 9 aa, Yellow fever virus
GRGDSRLTY

SEQ ID NO: 161020 - protein, 9 aa, Yellow fever virus
RGDSRLTYQ

SEQ ID NO: 161021 - protein, 9 aa, Yellow fever virus
GDSRLTYQW

SEQ ID NO: 161022 - protein, 9 aa, Yellow fever virus
DSRLTYQWH

SEQ ID NO: 161023 - protein, 9 aa, Yellow fever virus
SRLTYQWHK

SEQ ID NO: 161024 - protein, 9 aa, Yellow fever virus
RLTYQWHKE

SEQ ID NO: 161025 - protein, 9 aa, Yellow fever virus
LTYQWHKEG

SEQ ID NO: 161026 - protein, 9 aa, Yellow fever virus
TYQWHKEGS

SEQ ID NO: 161027 - protein, 9 aa, Yellow fever virus
YQWHKEGSS

SEQ ID NO: 161028 - protein, 9 aa, Yellow fever virus
QWHKEGSSI

SEQ ID NO: 161029 - protein, 9 aa, Yellow fever virus
WHKEGSSIG

SEQ ID NO: 161030 - protein, 9 aa, Yellow fever virus
HKEGSSIGK

SEQ ID NO: 161031 - protein, 9 aa, Yellow fever virus
KEGSSIGKL

SEQ ID NO: 161032 - protein, 9 aa, Yellow fever virus
EGSSIGKLF

SEQ ID NO: 161033 - protein, 9 aa, Yellow fever virus
GSSIGKLFT

SEQ ID NO: 161034 - protein, 9 aa, Yellow fever virus
SSIGKLFTQ

SEQ ID NO: 161035 - protein, 9 aa, Yellow fever virus
SIGKLFTQT

SEQ ID NO: 161036 - protein, 9 aa, Yellow fever virus
IGKLFTQTM

SEQ ID NO: 161037 - protein, 9 aa, Yellow fever virus
GKLFTQTMK

SEQ ID NO: 161038 - protein, 9 aa, Yellow fever virus
KLFTQTMKG

SEQ ID NO: 161039 - protein, 9 aa, Yellow fever virus
LFTQTMKGV

SEQ ID NO: 161040 - protein, 9 aa, Yellow fever virus
FTQTMKGVE

SEQ ID NO: 161041 - protein, 9 aa, Yellow fever virus
TQTMKGVER

SEQ ID NO: 161042 - protein, 9 aa, Yellow fever virus
QTMKGVERL

SEQ ID NO: 161043 - protein, 9 aa, Yellow fever virus
TMKGVERLA

SEQ ID NO: 161044 - protein, 9 aa, Yellow fever virus
MKGVERLAV

SEQ ID NO: 161045 - protein, 9 aa, Yellow fever virus
KGVERLAVM

SEQ ID NO: 161046 - protein, 9 aa, Yellow fever virus
GVERLAVMG

SEQ ID NO: 161047 - protein, 9 aa, Yellow fever virus
VERLAVMGD

SEQ ID NO: 161048 - protein, 9 aa, Yellow fever virus
ERLAVMGDT

SEQ ID NO: 161049 - protein, 9 aa, Yellow fever virus
RLAVMGDTA

SEQ ID NO: 161050 - protein, 9 aa, Yellow fever virus
LAVMGDTAW

SEQ ID NO: 161051 - protein, 9 aa, Yellow fever virus
AVMGDTAWD

SEQ ID NO: 161052 - protein, 9 aa, Yellow fever virus
VMGDTAWDF

SEQ ID NO: 161053 - protein, 9 aa, Yellow fever virus
MGDTAWDFS

SEQ ID NO: 161054 - protein, 9 aa, Yellow fever virus
GDTAWDFSS

SEQ ID NO: 161055 - protein, 9 aa, Yellow fever virus
DTAWDFSSA

SEQ ID NO: 161056 - protein, 9 aa, Yellow fever virus
TAWDFSSAG

SEQ ID NO: 161057 - protein, 9 aa, Yellow fever virus
AWDFSSAGG

SEQ ID NO: 161058 - protein, 9 aa, Yellow fever virus
WDFSSAGGF

SEQ ID NO: 161059 - protein, 9 aa, Yellow fever virus
DFSSAGGFF

SEQ ID NO: 161060 - protein, 9 aa, Yellow fever virus
FSSAGGFFT

SEQ ID NO: 161061 - protein, 9 aa, Yellow fever virus
SSAGGFFTS

SEQ ID NO: 161062 - protein, 9 aa, Yellow fever virus
SAGGFFTSV

SEQ ID NO: 161063 - protein, 9 aa, Yellow fever virus
AGGFFTSVG

SEQ ID NO: 161064 - protein, 9 aa, Yellow fever virus
GGFFTSVGK

SEQ ID NO: 161065 - protein, 9 aa, Yellow fever virus
GFFTSVGKG

SEQ ID NO: 161066 - protein, 9 aa, Yellow fever virus
FFTSVGKGI

SEQ ID NO: 161067 - protein, 9 aa, Yellow fever virus
FTSVGKGIH

SEQ ID NO: 161068 - protein, 9 aa, Yellow fever virus
TSVGKGIHT

SEQ ID NO: 161069 - protein, 9 aa, Yellow fever virus
SVGKGIHTV

SEQ ID NO: 161070 - protein, 9 aa, Yellow fever virus
VGKGIHTVF

SEQ ID NO: 161071 - protein, 9 aa, Yellow fever virus
GKGIHTVFG

SEQ ID NO: 161072 - protein, 9 aa, Yellow fever virus
KGIHTVFGS

SEQ ID NO: 161073 - protein, 9 aa, Yellow fever virus
GIHTVFGSA

SEQ ID NO: 161074 - protein, 9 aa, Yellow fever virus
IHTVFGSAF

SEQ ID NO: 161075 - protein, 9 aa, Yellow fever virus
HTVFGSAFQ

SEQ ID NO: 161076 - protein, 9 aa, Yellow fever virus
TVFGSAFQG

SEQ ID NO: 161077 - protein, 9 aa, Yellow fever virus
VFGSAFQGL

SEQ ID NO: 161078 - protein, 9 aa, Yellow fever virus
FGSAFQGLF

SEQ ID NO: 161079 - protein, 9 aa, Yellow fever virus
GSAFQGLFG

SEQ ID NO: 161080 - protein, 9 aa, Yellow fever virus
SAFQGLFGG

SEQ ID NO: 161081 - protein, 9 aa, Yellow fever virus
AFQGLFGGL

SEQ ID NO: 161082 - protein, 9 aa, Yellow fever virus
FQGLFGGLN

SEQ ID NO: 161083 - protein, 9 aa, Yellow fever virus
QGLFGGLNW

SEQ ID NO: 161084 - protein, 9 aa, Yellow fever virus
GLFGGLNWI

SEQ ID NO: 161085 - protein, 9 aa, Yellow fever virus
LFGGLNWIT

SEQ ID NO: 161086 - protein, 9 aa, Yellow fever virus
FGGLNWITK

SEQ ID NO: 161087 - protein, 9 aa, Yellow fever virus
GGLNWITKV

SEQ ID NO: 161088 - protein, 9 aa, Yellow fever virus
GLNWITKVI

SEQ ID NO: 161089 - protein, 9 aa, Yellow fever virus
LNWITKVIM

SEQ ID NO: 161090 - protein, 9 aa, Yellow fever virus
NWITKVIMG

SEQ ID NO: 161091 - protein, 9 aa, Yellow fever virus
WITKVIMGA

SEQ ID NO: 161092 - protein, 9 aa, Yellow fever virus
ITKVIMGAV

SEQ ID NO: 161093 - protein, 9 aa, Yellow fever virus
TKVIMGAVL

SEQ ID NO: 161094 - protein, 9 aa, Yellow fever virus
KVIMGAVLI

SEQ ID NO: 161095 - protein, 9 aa, Yellow fever virus
VIMGAVLIW

SEQ ID NO: 161096 - protein, 9 aa, Yellow fever virus
IMGAVLIWV

SEQ ID NO: 161097 - protein, 9 aa, Yellow fever virus
MGAVLIWVG

SEQ ID NO: 161098 - protein, 9 aa, Yellow fever virus
GAVLIWVGI

SEQ ID NO: 161099 - protein, 9 aa, Yellow fever virus
AVLIWVGIN

SEQ ID NO: 161100 - protein, 9 aa, Yellow fever virus
VLIWVGINT

SEQ ID NO: 161101 - protein, 9 aa, Yellow fever virus
LIWVGINTR

SEQ ID NO: 161102 - protein, 9 aa, Yellow fever virus
IWVGINTRN

SEQ ID NO: 161103 - protein, 9 aa, Yellow fever virus
WVGINTRNM

SEQ ID NO: 161104 - protein, 9 aa, Yellow fever virus
VGINTRNMT

SEQ ID NO: 161105 - protein, 9 aa, Yellow fever virus
GINTRNMTM

SEQ ID NO: 161106 - protein, 9 aa, Yellow fever virus
INTRNMTMS

SEQ ID NO: 161107 - protein, 9 aa, Yellow fever virus
NTRNMTMSM

SEQ ID NO: 161108 - protein, 9 aa, Yellow fever virus
TRNMTMSMS

SEQ ID NO: 161109 - protein, 9 aa, Yellow fever virus
RNMTMSMSM

SEQ ID NO: 161110 - protein, 9 aa, Yellow fever virus
NMTMSMSMI

SEQ ID NO: 161111 - protein, 9 aa, Yellow fever virus
MTMSMSMIL

SEQ ID NO: 161112 - protein, 9 aa, Yellow fever virus
TMSMSMILV

SEQ ID NO: 161113 - protein, 9 aa, Yellow fever virus
MSMSMILVG

SEQ ID NO: 161114 - protein, 9 aa, Yellow fever virus
SMSMILVGV

SEQ ID NO: 161115 - protein, 9 aa, Yellow fever virus
MSMILVGVI

SEQ ID NO: 161116 - protein, 9 aa, Yellow fever virus
SMILVGVIM

SEQ ID NO: 161117 - protein, 9 aa, Yellow fever virus
MILVGVIMM

SEQ ID NO: 161118 - protein, 9 aa, Yellow fever virus
ILVGVIMMF

SEQ ID NO: 161119 - protein, 9 aa, Yellow fever virus
LVGVIMMFL

SEQ ID NO: 161120 - protein, 9 aa, Yellow fever virus
VGVIMMFLS

SEQ ID NO: 161121 - protein, 9 aa, Yellow fever virus
GVIMMFLSL

SEQ ID NO: 161122 - protein, 9 aa, Yellow fever virus
VIMMFLSLG

SEQ ID NO: 161123 - protein, 9 aa, Yellow fever virus
IMMFLSLGV

SEQ ID NO: 161124 - protein, 9 aa, Yellow fever virus
MMFLSLGVG

SEQ ID NO: 161125 - protein, 9 aa, Yellow fever virus
MFLSLGVGA

SEQ ID NO: 161126 - protein, 9 aa, Yellow fever virus
FLSLGVGAD

SEQ ID NO: 161127 - protein, 9 aa, Yellow fever virus
LSLGVGADQ

SEQ ID NO: 161128 - protein, 9 aa, Yellow fever virus
SLGVGADQG

SEQ ID NO: 161129 - protein, 9 aa, Yellow fever virus
LGVGADQGC

SEQ ID NO: 161130 - protein, 9 aa, Yellow fever virus
GVGADQGCA

SEQ ID NO: 161131 - protein, 9 aa, Yellow fever virus
VGADQGCAI

SEQ ID NO: 161132 - protein, 9 aa, Yellow fever virus
GADQGCAIN

SEQ ID NO: 161133 - protein, 9 aa, Yellow fever virus
ADQGCAINF

SEQ ID NO: 161134 - protein, 9 aa, Yellow fever virus
DQGCAINFG

SEQ ID NO: 161135 - protein, 9 aa, Yellow fever virus
QGCAINFGK

SEQ ID NO: 161136 - protein, 9 aa, Yellow fever virus
GCAINFGKR

SEQ ID NO: 161137 - protein, 9 aa, Yellow fever virus
CAINFGKRE

SEQ ID NO: 161138 - protein, 9 aa, Yellow fever virus
AINFGKREL

SEQ ID NO: 161139 - protein, 9 aa, Yellow fever virus
INFGKRELK

SEQ ID NO: 161140 - protein, 9 aa, Yellow fever virus
NFGKRELKC

SEQ ID NO: 161141 - protein, 9 aa, Yellow fever virus
FGKRELKCG

SEQ ID NO: 161142 - protein, 9 aa, Yellow fever virus
GKRELKCGD

SEQ ID NO: 161143 - protein, 9 aa, Yellow fever virus
KRELKCGDG

SEQ ID NO: 161144 - protein, 9 aa, Yellow fever virus
RELKCGDGI

SEQ ID NO: 161145 - protein, 9 aa, Yellow fever virus
ELKCGDGIF

SEQ ID NO: 161146 - protein, 9 aa, Yellow fever virus
LKCGDGIFI

SEQ ID NO: 161147 - protein, 9 aa, Yellow fever virus
KCGDGIFIF

SEQ ID NO: 161148 - protein, 9 aa, Yellow fever virus
CGDGIFIFR

SEQ ID NO: 161149 - protein, 9 aa, Yellow fever virus
GDGIFIFRD

SEQ ID NO: 161150 - protein, 9 aa, Yellow fever virus
DGIFIFRDS

SEQ ID NO: 161151 - protein, 9 aa, Yellow fever virus
GIFIFRDSD

SEQ ID NO: 161152 - protein, 9 aa, Yellow fever virus
IFIFRDSDD

SEQ ID NO: 161153 - protein, 9 aa, Yellow fever virus
FIFRDSDDW

SEQ ID NO: 161154 - protein, 9 aa, Yellow fever virus
IFRDSDDWL

SEQ ID NO: 161155 - protein, 9 aa, Yellow fever virus
FRDSDDWLN

SEQ ID NO: 161156 - protein, 9 aa, Yellow fever virus
RDSDDWLNK

SEQ ID NO: 161157 - protein, 9 aa, Yellow fever virus
DSDDWLNKY

SEQ ID NO: 161158 - protein, 9 aa, Yellow fever virus
SDDWLNKYS

SEQ ID NO: 161159 - protein, 9 aa, Yellow fever virus
DDWLNKYSY

SEQ ID NO: 161160 - protein, 9 aa, Yellow fever virus
DWLNKYSYY

SEQ ID NO: 161161 - protein, 9 aa, Yellow fever virus
WLNKYSYYP

SEQ ID NO: 161162 - protein, 9 aa, Yellow fever virus
LNKYSYYPE

SEQ ID NO: 161163 - protein, 9 aa, Yellow fever virus
NKYSYYPED

SEQ ID NO: 161164 - protein, 9 aa, Yellow fever virus
KYSYYPEDP

SEQ ID NO: 161165 - protein, 9 aa, Yellow fever virus
YSYYPEDPV

SEQ ID NO: 161166 - protein, 9 aa, Yellow fever virus
SYYPEDPVK

SEQ ID NO: 161167 - protein, 9 aa, Yellow fever virus
YYPEDPVKL

SEQ ID NO: 161168 - protein, 9 aa, Yellow fever virus
YPEDPVKLA

SEQ ID NO: 161169 - protein, 9 aa, Yellow fever virus
PEDPVKLAS

SEQ ID NO: 161170 - protein, 9 aa, Yellow fever virus
EDPVKLASI

SEQ ID NO: 161171 - protein, 9 aa, Yellow fever virus
DPVKLASIV

SEQ ID NO: 161172 - protein, 9 aa, Yellow fever virus
PVKLASIVK

SEQ ID NO: 161173 - protein, 9 aa, Yellow fever virus
VKLASIVKA

SEQ ID NO: 161174 - protein, 9 aa, Yellow fever virus
KLASIVKAS

SEQ ID NO: 161175 - protein, 9 aa, Yellow fever virus
LASIVKASF

SEQ ID NO: 161176 - protein, 9 aa, Yellow fever virus
ASIVKASFE

SEQ ID NO: 161177 - protein, 9 aa, Yellow fever virus
SIVKASFEE

SEQ ID NO: 161178 - protein, 9 aa, Yellow fever virus
IVKASFEEG

SEQ ID NO: 161179 - protein, 9 aa, Yellow fever virus
VKASFEEGK

SEQ ID NO: 161180 - protein, 9 aa, Yellow fever virus
KASFEEGKC

SEQ ID NO: 161181 - protein, 9 aa, Yellow fever virus
ASFEEGKCG

SEQ ID NO: 161182 - protein, 9 aa, Yellow fever virus
SFEEGKCGL

SEQ ID NO: 161183 - protein, 9 aa, Yellow fever virus
FEEGKCGLN

SEQ ID NO: 161184 - protein, 9 aa, Yellow fever virus
EEGKCGLNS

SEQ ID NO: 161185 - protein, 9 aa, Yellow fever virus
EGKCGLNSV

SEQ ID NO: 161186 - protein, 9 aa, Yellow fever virus
GKCGLNSVD

SEQ ID NO: 161187 - protein, 9 aa, Yellow fever virus
KCGLNSVDS

SEQ ID NO: 161188 - protein, 9 aa, Yellow fever virus
CGLNSVDSL

SEQ ID NO: 161189 - protein, 9 aa, Yellow fever virus
GLNSVDSLE

SEQ ID NO: 161190 - protein, 9 aa, Yellow fever virus
LNSVDSLEH

SEQ ID NO: 161191 - protein, 9 aa, Yellow fever virus
NSVDSLEHE

SEQ ID NO: 161192 - protein, 9 aa, Yellow fever virus
SVDSLEHEM

SEQ ID NO: 161193 - protein, 9 aa, Yellow fever virus
VDSLEHEMW

SEQ ID NO: 161194 - protein, 9 aa, Yellow fever virus
DSLEHEMWR

SEQ ID NO: 161195 - protein, 9 aa, Yellow fever virus
SLEHEMWRS

SEQ ID NO: 161196 - protein, 9 aa, Yellow fever virus
LEHEMWRSR

SEQ ID NO: 161197 - protein, 9 aa, Yellow fever virus
EHEMWRSRA

SEQ ID NO: 161198 - protein, 9 aa, Yellow fever virus
HEMWRSRAD

SEQ ID NO: 161199 - protein, 9 aa, Yellow fever virus
EMWRSRADE

SEQ ID NO: 161200 - protein, 9 aa, Yellow fever virus
MWRSRADEI

SEQ ID NO: 161201 - protein, 9 aa, Yellow fever virus
WRSRADEIN

SEQ ID NO: 161202 - protein, 9 aa, Yellow fever virus
RSRADEINA

SEQ ID NO: 161203 - protein, 9 aa, Yellow fever virus
SRADEINAI

SEQ ID NO: 161204 - protein, 9 aa, Yellow fever virus
RADEINAIF

SEQ ID NO: 161205 - protein, 9 aa, Yellow fever virus
ADEINAIFE

SEQ ID NO: 161206 - protein, 9 aa, Yellow fever virus
DEINAIFEE

SEQ ID NO: 161207 - protein, 9 aa, Yellow fever virus
EINAIFEEN

SEQ ID NO: 161208 - protein, 9 aa, Yellow fever virus
INAIFEENE

SEQ ID NO: 161209 - protein, 9 aa, Yellow fever virus
NAIFEENEV

SEQ ID NO: 161210 - protein, 9 aa, Yellow fever virus
AIFEENEVD

SEQ ID NO: 161211 - protein, 9 aa, Yellow fever virus
IFEENEVDI

SEQ ID NO: 161212 - protein, 9 aa, Yellow fever virus
FEENEVDIS

SEQ ID NO: 161213 - protein, 9 aa, Yellow fever virus
EENEVDISV

SEQ ID NO: 161214 - protein, 9 aa, Yellow fever virus
ENEVDISVV

SEQ ID NO: 161215 - protein, 9 aa, Yellow fever virus
NEVDISVVV

SEQ ID NO: 161216 - protein, 9 aa, Yellow fever virus
EVDISVVVQ

SEQ ID NO: 161217 - protein, 9 aa, Yellow fever virus
VDISVVVQD

SEQ ID NO: 161218 - protein, 9 aa, Yellow fever virus
DISVVVQDP

SEQ ID NO: 161219 - protein, 9 aa, Yellow fever virus
ISVVVQDPK

SEQ ID NO: 161220 - protein, 9 aa, Yellow fever virus
SVVVQDPKN

SEQ ID NO: 161221 - protein, 9 aa, Yellow fever virus
VVVQDPKNV

SEQ ID NO: 161222 - protein, 9 aa, Yellow fever virus
VVQDPKNVY

SEQ ID NO: 161223 - protein, 9 aa, Yellow fever virus
VQDPKNVYQ

SEQ ID NO: 161224 - protein, 9 aa, Yellow fever virus
QDPKNVYQR

SEQ ID NO: 161225 - protein, 9 aa, Yellow fever virus
DPKNVYQRG

SEQ ID NO: 161226 - protein, 9 aa, Yellow fever virus
PKNVYQRGT

SEQ ID NO: 161227 - protein, 9 aa, Yellow fever virus
KNVYQRGTH

SEQ ID NO: 161228 - protein, 9 aa, Yellow fever virus
NVYQRGTHP

SEQ ID NO: 161229 - protein, 9 aa, Yellow fever virus
VYQRGTHPF

SEQ ID NO: 161230 - protein, 9 aa, Yellow fever virus
YQRGTHPFS

SEQ ID NO: 161231 - protein, 9 aa, Yellow fever virus
QRGTHPFSR

SEQ ID NO: 161232 - protein, 9 aa, Yellow fever virus
RGTHPFSRI

SEQ ID NO: 161233 - protein, 9 aa, Yellow fever virus
GTHPFSRIR

SEQ ID NO: 161234 - protein, 9 aa, Yellow fever virus
THPFSRIRD

SEQ ID NO: 161235 - protein, 9 aa, Yellow fever virus
HPFSRIRDG

SEQ ID NO: 161236 - protein, 9 aa, Yellow fever virus
PFSRIRDGL

SEQ ID NO: 161237 - protein, 9 aa, Yellow fever virus
FSRIRDGLQ

SEQ ID NO: 161238 - protein, 9 aa, Yellow fever virus
SRIRDGLQY

SEQ ID NO: 161239 - protein, 9 aa, Yellow fever virus
RIRDGLQYG

SEQ ID NO: 161240 - protein, 9 aa, Yellow fever virus
IRDGLQYGW

SEQ ID NO: 161241 - protein, 9 aa, Yellow fever virus
RDGLQYGWK

SEQ ID NO: 161242 - protein, 9 aa, Yellow fever virus
DGLQYGWKT

SEQ ID NO: 161243 - protein, 9 aa, Yellow fever virus
GLQYGWKTW

SEQ ID NO: 161244 - protein, 9 aa, Yellow fever virus
LQYGWKTWG

SEQ ID NO: 161245 - protein, 9 aa, Yellow fever virus
QYGWKTWGK

SEQ ID NO: 161246 - protein, 9 aa, Yellow fever virus
YGWKTWGKN

SEQ ID NO: 161247 - protein, 9 aa, Yellow fever virus
GWKTWGKNL

SEQ ID NO: 161248 - protein, 9 aa, Yellow fever virus
WKTWGKNLV

SEQ ID NO: 161249 - protein, 9 aa, Yellow fever virus
KTWGKNLVF

SEQ ID NO: 161250 - protein, 9 aa, Yellow fever virus
TWGKNLVFS

SEQ ID NO: 161251 - protein, 9 aa, Yellow fever virus
WGKNLVFSP

SEQ ID NO: 161252 - protein, 9 aa, Yellow fever virus
GKNLVFSPG

SEQ ID NO: 161253 - protein, 9 aa, Yellow fever virus
KNLVFSPGR

SEQ ID NO: 161254 - protein, 9 aa, Yellow fever virus
NLVFSPGRK

SEQ ID NO: 161255 - protein, 9 aa, Yellow fever virus
LVFSPGRKN

SEQ ID NO: 161256 - protein, 9 aa, Yellow fever virus
VFSPGRKNG

SEQ ID NO: 161257 - protein, 9 aa, Yellow fever virus
FSPGRKNGS

SEQ ID NO: 161258 - protein, 9 aa, Yellow fever virus
SPGRKNGSF

SEQ ID NO: 161259 - protein, 9 aa, Yellow fever virus
PGRKNGSFI

SEQ ID NO: 161260 - protein, 9 aa, Yellow fever virus
GRKNGSFII

SEQ ID NO: 161261 - protein, 9 aa, Yellow fever virus
RKNGSFIID

SEQ ID NO: 161262 - protein, 9 aa, Yellow fever virus
KNGSFIIDG

SEQ ID NO: 161263 - protein, 9 aa, Yellow fever virus
NGSFIIDGK

SEQ ID NO: 161264 - protein, 9 aa, Yellow fever virus
GSFIIDGKS

SEQ ID NO: 161265 - protein, 9 aa, Yellow fever virus
SFIIDGKSR

SEQ ID NO: 161266 - protein, 9 aa, Yellow fever virus
FIIDGKSRK

SEQ ID NO: 161267 - protein, 9 aa, Yellow fever virus
IIDGKSRKE

SEQ ID NO: 161268 - protein, 9 aa, Yellow fever virus
IDGKSRKEC

SEQ ID NO: 161269 - protein, 9 aa, Yellow fever virus
DGKSRKECP

SEQ ID NO: 161270 - protein, 9 aa, Yellow fever virus
GKSRKECPF

SEQ ID NO: 161271 - protein, 9 aa, Yellow fever virus
KSRKECPFS

SEQ ID NO: 161272 - protein, 9 aa, Yellow fever virus
SRKECPFSN

SEQ ID NO: 161273 - protein, 9 aa, Yellow fever virus
RKECPFSNR

SEQ ID NO: 161274 - protein, 9 aa, Yellow fever virus
KECPFSNRV

SEQ ID NO: 161275 - protein, 9 aa, Yellow fever virus
ECPFSNRVW

SEQ ID NO: 161276 - protein, 9 aa, Yellow fever virus
CPFSNRVWN

SEQ ID NO: 161277 - protein, 9 aa, Yellow fever virus
PFSNRVWNS

SEQ ID NO: 161278 - protein, 9 aa, Yellow fever virus
FSNRVWNSF

SEQ ID NO: 161279 - protein, 9 aa, Yellow fever virus
SNRVWNSFQ

SEQ ID NO: 161280 - protein, 9 aa, Yellow fever virus
NRVWNSFQI

SEQ ID NO: 161281 - protein, 9 aa, Yellow fever virus
RVWNSFQIE

SEQ ID NO: 161282 - protein, 9 aa, Yellow fever virus
VWNSFQIEE

SEQ ID NO: 161283 - protein, 9 aa, Yellow fever virus
WNSFQIEEF

SEQ ID NO: 161284 - protein, 9 aa, Yellow fever virus
NSFQIEEFG

SEQ ID NO: 161285 - protein, 9 aa, Yellow fever virus
SFQIEEFGT

SEQ ID NO: 161286 - protein, 9 aa, Yellow fever virus
FQIEEFGTG

SEQ ID NO: 161287 - protein, 9 aa, Yellow fever virus
QIEEFGTGV

SEQ ID NO: 161288 - protein, 9 aa, Yellow fever virus
IEEFGTGVF

SEQ ID NO: 161289 - protein, 9 aa, Yellow fever virus
EEFGTGVFT

SEQ ID NO: 161290 - protein, 9 aa, Yellow fever virus
EFGTGVFTT

SEQ ID NO: 161291 - protein, 9 aa, Yellow fever virus
FGTGVFTTR

SEQ ID NO: 161292 - protein, 9 aa, Yellow fever virus
GTGVFTTRV

SEQ ID NO: 161293 - protein, 9 aa, Yellow fever virus
TGVFTTRVY

SEQ ID NO: 161294 - protein, 9 aa, Yellow fever virus
GVFTTRVYM

SEQ ID NO: 161295 - protein, 9 aa, Yellow fever virus
VFTTRVYMD

SEQ ID NO: 161296 - protein, 9 aa, Yellow fever virus
FTTRVYMDA

SEQ ID NO: 161297 - protein, 9 aa, Yellow fever virus
TTRVYMDAV

SEQ ID NO: 161298 - protein, 9 aa, Yellow fever virus
TRVYMDAVF

SEQ ID NO: 161299 - protein, 9 aa, Yellow fever virus
RVYMDAVFE

SEQ ID NO: 161300 - protein, 9 aa, Yellow fever virus
VYMDAVFEY

SEQ ID NO: 161301 - protein, 9 aa, Yellow fever virus
YMDAVFEYT

SEQ ID NO: 161302 - protein, 9 aa, Yellow fever virus
MDAVFEYTI

SEQ ID NO: 161303 - protein, 9 aa, Yellow fever virus
DAVFEYTID

SEQ ID NO: 161304 - protein, 9 aa, Yellow fever virus
AVFEYTIDC

SEQ ID NO: 161305 - protein, 9 aa, Yellow fever virus
VFEYTIDCD

SEQ ID NO: 161306 - protein, 9 aa, Yellow fever virus
FEYTIDCDG

SEQ ID NO: 161307 - protein, 9 aa, Yellow fever virus
EYTIDCDGS

SEQ ID NO: 161308 - protein, 9 aa, Yellow fever virus
YTIDCDGSI

SEQ ID NO: 161309 - protein, 9 aa, Yellow fever virus
TIDCDGSIL

SEQ ID NO: 161310 - protein, 9 aa, Yellow fever virus
IDCDGSILG

SEQ ID NO: 161311 - protein, 9 aa, Yellow fever virus
DCDGSILGA

SEQ ID NO: 161312 - protein, 9 aa, Yellow fever virus
CDGSILGAA

SEQ ID NO: 161313 - protein, 9 aa, Yellow fever virus
DGSILGAAV

SEQ ID NO: 161314 - protein, 9 aa, Yellow fever virus
GSILGAAVN

SEQ ID NO: 161315 - protein, 9 aa, Yellow fever virus
SILGAAVNG

SEQ ID NO: 161316 - protein, 9 aa, Yellow fever virus
ILGAAVNGK

SEQ ID NO: 161317 - protein, 9 aa, Yellow fever virus
LGAAVNGKK

SEQ ID NO: 161318 - protein, 9 aa, Yellow fever virus
GAAVNGKKS

SEQ ID NO: 161319 - protein, 9 aa, Yellow fever virus
AAVNGKKSA

SEQ ID NO: 161320 - protein, 9 aa, Yellow fever virus
AVNGKKSAH

SEQ ID NO: 161321 - protein, 9 aa, Yellow fever virus
VNGKKSAHG

SEQ ID NO: 161322 - protein, 9 aa, Yellow fever virus
NGKKSAHGS

SEQ ID NO: 161323 - protein, 9 aa, Yellow fever virus
GKKSAHGSP

SEQ ID NO: 161324 - protein, 9 aa, Yellow fever virus
KKSAHGSPT

SEQ ID NO: 161325 - protein, 9 aa, Yellow fever virus
KSAHGSPTF

SEQ ID NO: 161326 - protein, 9 aa, Yellow fever virus
SAHGSPTFW

SEQ ID NO: 161327 - protein, 9 aa, Yellow fever virus
AHGSPTFWM

SEQ ID NO: 161328 - protein, 9 aa, Yellow fever virus
HGSPTFWMG

SEQ ID NO: 161329 - protein, 9 aa, Yellow fever virus
GSPTFWMGS

SEQ ID NO: 161330 - protein, 9 aa, Yellow fever virus
SPTFWMGSH

SEQ ID NO: 161331 - protein, 9 aa, Yellow fever virus
PTFWMGSHE

SEQ ID NO: 161332 - protein, 9 aa, Yellow fever virus
TFWMGSHEV

SEQ ID NO: 161333 - protein, 9 aa, Yellow fever virus
FWMGSHEVN

SEQ ID NO: 161334 - protein, 9 aa, Yellow fever virus
WMGSHEVNG

SEQ ID NO: 161335 - protein, 9 aa, Yellow fever virus
MGSHEVNGT

SEQ ID NO: 161336 - protein, 9 aa, Yellow fever virus
GSHEVNGTW

SEQ ID NO: 161337 - protein, 9 aa, Yellow fever virus
SHEVNGTWM

SEQ ID NO: 161338 - protein, 9 aa, Yellow fever virus
HEVNGTWMI

SEQ ID NO: 161339 - protein, 9 aa, Yellow fever virus
EVNGTWMIH

SEQ ID NO: 161340 - protein, 9 aa, Yellow fever virus
VNGTWMIHT

SEQ ID NO: 161341 - protein, 9 aa, Yellow fever virus
NGTWMIHTL

SEQ ID NO: 161342 - protein, 9 aa, Yellow fever virus
GTWMIHTLE

SEQ ID NO: 161343 - protein, 9 aa, Yellow fever virus
TWMIHTLEA

SEQ ID NO: 161344 - protein, 9 aa, Yellow fever virus
WMIHTLEAL

SEQ ID NO: 161345 - protein, 9 aa, Yellow fever virus
MIHTLEALD

SEQ ID NO: 161346 - protein, 9 aa, Yellow fever virus
IHTLEALDY

SEQ ID NO: 161347 - protein, 9 aa, Yellow fever virus
HTLEALDYK

SEQ ID NO: 161348 - protein, 9 aa, Yellow fever virus
TLEALDYKE

SEQ ID NO: 161349 - protein, 9 aa, Yellow fever virus
LEALDYKEC

SEQ ID NO: 161350 - protein, 9 aa, Yellow fever virus
EALDYKECE

SEQ ID NO: 161351 - protein, 9 aa, Yellow fever virus
ALDYKECEW

SEQ ID NO: 161352 - protein, 9 aa, Yellow fever virus
LDYKECEWP

SEQ ID NO: 161353 - protein, 9 aa, Yellow fever virus
DYKECEWPL

SEQ ID NO: 161354 - protein, 9 aa, Yellow fever virus
YKECEWPLT

SEQ ID NO: 161355 - protein, 9 aa, Yellow fever virus
KECEWPLTH

SEQ ID NO: 161356 - protein, 9 aa, Yellow fever virus
ECEWPLTHT

SEQ ID NO: 161357 - protein, 9 aa, Yellow fever virus
CEWPLTHTI

SEQ ID NO: 161358 - protein, 9 aa, Yellow fever virus
EWPLTHTIG

SEQ ID NO: 161359 - protein, 9 aa, Yellow fever virus
WPLTHTIGT

SEQ ID NO: 161360 - protein, 9 aa, Yellow fever virus
PLTHTIGTS

SEQ ID NO: 161361 - protein, 9 aa, Yellow fever virus
LTHTIGTSV

SEQ ID NO: 161362 - protein, 9 aa, Yellow fever virus
THTIGTSVE

SEQ ID NO: 161363 - protein, 9 aa, Yellow fever virus
HTIGTSVEE

SEQ ID NO: 161364 - protein, 9 aa, Yellow fever virus
TIGTSVEES

SEQ ID NO: 161365 - protein, 9 aa, Yellow fever virus
IGTSVEESE

SEQ ID NO: 161366 - protein, 9 aa, Yellow fever virus
GTSVEESEM

SEQ ID NO: 161367 - protein, 9 aa, Yellow fever virus
TSVEESEMF

SEQ ID NO: 161368 - protein, 9 aa, Yellow fever virus
SVEESEMFM

SEQ ID NO: 161369 - protein, 9 aa, Yellow fever virus
VEESEMFMP

SEQ ID NO: 161370 - protein, 9 aa, Yellow fever virus
EESEMFMPR

SEQ ID NO: 161371 - protein, 9 aa, Yellow fever virus
ESEMFMPRS

SEQ ID NO: 161372 - protein, 9 aa, Yellow fever virus
SEMFMPRSI

SEQ ID NO: 161373 - protein, 9 aa, Yellow fever virus
EMFMPRSIG

SEQ ID NO: 161374 - protein, 9 aa, Yellow fever virus
MFMPRSIGG

SEQ ID NO: 161375 - protein, 9 aa, Yellow fever virus
FMPRSIGGP

SEQ ID NO: 161376 - protein, 9 aa, Yellow fever virus
MPRSIGGPV

SEQ ID NO: 161377 - protein, 9 aa, Yellow fever virus
PRSIGGPVS

SEQ ID NO: 161378 - protein, 9 aa, Yellow fever virus
RSIGGPVSS

SEQ ID NO: 161379 - protein, 9 aa, Yellow fever virus
SIGGPVSSH

SEQ ID NO: 161380 - protein, 9 aa, Yellow fever virus
IGGPVSSHN

SEQ ID NO: 161381 - protein, 9 aa, Yellow fever virus
GGPVSSHNH

SEQ ID NO: 161382 - protein, 9 aa, Yellow fever virus
GPVSSHNHI

SEQ ID NO: 161383 - protein, 9 aa, Yellow fever virus
PVSSHNHIP

SEQ ID NO: 161384 - protein, 9 aa, Yellow fever virus
VSSHNHIPG

SEQ ID NO: 161385 - protein, 9 aa, Yellow fever virus
SSHNHIPGY

SEQ ID NO: 161386 - protein, 9 aa, Yellow fever virus
SHNHIPGYK

SEQ ID NO: 161387 - protein, 9 aa, Yellow fever virus
HNHIPGYKV

SEQ ID NO: 161388 - protein, 9 aa, Yellow fever virus
NHIPGYKVQ

SEQ ID NO: 161389 - protein, 9 aa, Yellow fever virus
HIPGYKVQT

SEQ ID NO: 161390 - protein, 9 aa, Yellow fever virus
IPGYKVQTN

SEQ ID NO: 161391 - protein, 9 aa, Yellow fever virus
PGYKVQTNG

SEQ ID NO: 161392 - protein, 9 aa, Yellow fever virus
GYKVQTNGP

SEQ ID NO: 161393 - protein, 9 aa, Yellow fever virus
YKVQTNGPW

SEQ ID NO: 161394 - protein, 9 aa, Yellow fever virus
KVQTNGPWM

SEQ ID NO: 161395 - protein, 9 aa, Yellow fever virus
VQTNGPWMQ

SEQ ID NO: 161396 - protein, 9 aa, Yellow fever virus
QTNGPWMQV

SEQ ID NO: 161397 - protein, 9 aa, Yellow fever virus
TNGPWMQVP

SEQ ID NO: 161398 - protein, 9 aa, Yellow fever virus
NGPWMQVPL

SEQ ID NO: 161399 - protein, 9 aa, Yellow fever virus
GPWMQVPLE

SEQ ID NO: 161400 - protein, 9 aa, Yellow fever virus
PWMQVPLEV

SEQ ID NO: 161401 - protein, 9 aa, Yellow fever virus
WMQVPLEVK

SEQ ID NO: 161402 - protein, 9 aa, Yellow fever virus
MQVPLEVKR

SEQ ID NO: 161403 - protein, 9 aa, Yellow fever virus
QVPLEVKRE

SEQ ID NO: 161404 - protein, 9 aa, Yellow fever virus
VPLEVKREA

SEQ ID NO: 161405 - protein, 9 aa, Yellow fever virus
PLEVKREAC

SEQ ID NO: 161406 - protein, 9 aa, Yellow fever virus
LEVKREACP

SEQ ID NO: 161407 - protein, 9 aa, Yellow fever virus
EVKREACPG

SEQ ID NO: 161408 - protein, 9 aa, Yellow fever virus
VKREACPGT

SEQ ID NO: 161409 - protein, 9 aa, Yellow fever virus
KREACPGTS

SEQ ID NO: 161410 - protein, 9 aa, Yellow fever virus
REACPGTSV

SEQ ID NO: 161411 - protein, 9 aa, Yellow fever virus
EACPGTSVI

SEQ ID NO: 161412 - protein, 9 aa, Yellow fever virus
ACPGTSVII

SEQ ID NO: 161413 - protein, 9 aa, Yellow fever virus
CPGTSVIID

SEQ ID NO: 161414 - protein, 9 aa, Yellow fever virus
PGTSVIIDG

SEQ ID NO: 161415 - protein, 9 aa, Yellow fever virus
GTSVIIDGN

SEQ ID NO: 161416 - protein, 9 aa, Yellow fever virus
TSVIIDGNC

SEQ ID NO: 161417 - protein, 9 aa, Yellow fever virus
SVIIDGNCD

SEQ ID NO: 161418 - protein, 9 aa, Yellow fever virus
VIIDGNCDG

SEQ ID NO: 161419 - protein, 9 aa, Yellow fever virus
IIDGNCDGR

SEQ ID NO: 161420 - protein, 9 aa, Yellow fever virus
IDGNCDGRG

SEQ ID NO: 161421 - protein, 9 aa, Yellow fever virus
DGNCDGRGK

SEQ ID NO: 161422 - protein, 9 aa, Yellow fever virus
GNCDGRGKS

SEQ ID NO: 161423 - protein, 9 aa, Yellow fever virus
NCDGRGKST

SEQ ID NO: 161424 - protein, 9 aa, Yellow fever virus
CDGRGKSTR

SEQ ID NO: 161425 - protein, 9 aa, Yellow fever virus
DGRGKSTRS

SEQ ID NO: 161426 - protein, 9 aa, Yellow fever virus
GRGKSTRST

SEQ ID NO: 161427 - protein, 9 aa, Yellow fever virus
RGKSTRSTT

SEQ ID NO: 161428 - protein, 9 aa, Yellow fever virus
GKSTRSTTD

SEQ ID NO: 161429 - protein, 9 aa, Yellow fever virus
KSTRSTTDS

SEQ ID NO: 161430 - protein, 9 aa, Yellow fever virus
STRSTTDSG

SEQ ID NO: 161431 - protein, 9 aa, Yellow fever virus
TRSTTDSGK

SEQ ID NO: 161432 - protein, 9 aa, Yellow fever virus
RSTTDSGKV

SEQ ID NO: 161433 - protein, 9 aa, Yellow fever virus
STTDSGKVI

SEQ ID NO: 161434 - protein, 9 aa, Yellow fever virus
TTDSGKVIP

SEQ ID NO: 161435 - protein, 9 aa, Yellow fever virus
TDSGKVIPE

SEQ ID NO: 161436 - protein, 9 aa, Yellow fever virus
DSGKVIPEW

SEQ ID NO: 161437 - protein, 9 aa, Yellow fever virus
SGKVIPEWC

SEQ ID NO: 161438 - protein, 9 aa, Yellow fever virus
GKVIPEWCC

SEQ ID NO: 161439 - protein, 9 aa, Yellow fever virus
KVIPEWCCR

SEQ ID NO: 161440 - protein, 9 aa, Yellow fever virus
VIPEWCCRS

SEQ ID NO: 161441 - protein, 9 aa, Yellow fever virus
IPEWCCRSC

SEQ ID NO: 161442 - protein, 9 aa, Yellow fever virus
PEWCCRSCT

SEQ ID NO: 161443 - protein, 9 aa, Yellow fever virus
EWCCRSCTM

SEQ ID NO: 161444 - protein, 9 aa, Yellow fever virus
WCCRSCTMP

SEQ ID NO: 161445 - protein, 9 aa, Yellow fever virus
CCRSCTMPP

SEQ ID NO: 161446 - protein, 9 aa, Yellow fever virus
CRSCTMPPV

SEQ ID NO: 161447 - protein, 9 aa, Yellow fever virus
RSCTMPPVS

SEQ ID NO: 161448 - protein, 9 aa, Yellow fever virus
SCTMPPVSF

SEQ ID NO: 161449 - protein, 9 aa, Yellow fever virus
CTMPPVSFH

SEQ ID NO: 161450 - protein, 9 aa, Yellow fever virus
TMPPVSFHG

SEQ ID NO: 161451 - protein, 9 aa, Yellow fever virus
MPPVSFHGS

SEQ ID NO: 161452 - protein, 9 aa, Yellow fever virus
PPVSFHGSD

SEQ ID NO: 161453 - protein, 9 aa, Yellow fever virus
PVSFHGSDG

SEQ ID NO: 161454 - protein, 9 aa, Yellow fever virus
VSFHGSDGC

SEQ ID NO: 161455 - protein, 9 aa, Yellow fever virus
SFHGSDGCW

SEQ ID NO: 161456 - protein, 9 aa, Yellow fever virus
FHGSDGCWY

SEQ ID NO: 161457 - protein, 9 aa, Yellow fever virus
HGSDGCWYP

SEQ ID NO: 161458 - protein, 9 aa, Yellow fever virus
GSDGCWYPM

SEQ ID NO: 161459 - protein, 9 aa, Yellow fever virus
SDGCWYPME

SEQ ID NO: 161460 - protein, 9 aa, Yellow fever virus
DGCWYPMEI

SEQ ID NO: 161461 - protein, 9 aa, Yellow fever virus
GCWYPMEIR

SEQ ID NO: 161462 - protein, 9 aa, Yellow fever virus
CWYPMEIRP

SEQ ID NO: 161463 - protein, 9 aa, Yellow fever virus
WYPMEIRPR

SEQ ID NO: 161464 - protein, 9 aa, Yellow fever virus
YPMEIRPRK

SEQ ID NO: 161465 - protein, 9 aa, Yellow fever virus
PMEIRPRKT

SEQ ID NO: 161466 - protein, 9 aa, Yellow fever virus
MEIRPRKTH

SEQ ID NO: 161467 - protein, 9 aa, Yellow fever virus
EIRPRKTHE

SEQ ID NO: 161468 - protein, 9 aa, Yellow fever virus
IRPRKTHES

SEQ ID NO: 161469 - protein, 9 aa, Yellow fever virus
RPRKTHESH

SEQ ID NO: 161470 - protein, 9 aa, Yellow fever virus
PRKTHESHL

SEQ ID NO: 161471 - protein, 9 aa, Yellow fever virus
RKTHESHLV

SEQ ID NO: 161472 - protein, 9 aa, Yellow fever virus
KTHESHLVR

SEQ ID NO: 161473 - protein, 9 aa, Yellow fever virus
THESHLVRS

SEQ ID NO: 161474 - protein, 9 aa, Yellow fever virus
HESHLVRSW

SEQ ID NO: 161475 - protein, 9 aa, Yellow fever virus
ESHLVRSWV

SEQ ID NO: 161476 - protein, 9 aa, Yellow fever virus
SHLVRSWVT

SEQ ID NO: 161477 - protein, 9 aa, Yellow fever virus
HLVRSWVTA

SEQ ID NO: 161478 - protein, 9 aa, Yellow fever virus
LVRSWVTAG

SEQ ID NO: 161479 - protein, 9 aa, Yellow fever virus
VRSWVTAGE

SEQ ID NO: 161480 - protein, 9 aa, Yellow fever virus
RSWVTAGEI

SEQ ID NO: 161481 - protein, 9 aa, Yellow fever virus
SWVTAGEIH

SEQ ID NO: 161482 - protein, 9 aa, Yellow fever virus
WVTAGEIHA

SEQ ID NO: 161483 - protein, 9 aa, Yellow fever virus
VTAGEIHAV

SEQ ID NO: 161484 - protein, 9 aa, Yellow fever virus
TAGEIHAVP

SEQ ID NO: 161485 - protein, 9 aa, Yellow fever virus
AGEIHAVPF

SEQ ID NO: 161486 - protein, 9 aa, Yellow fever virus
GEIHAVPFG

SEQ ID NO: 161487 - protein, 9 aa, Yellow fever virus
EIHAVPFGL

SEQ ID NO: 161488 - protein, 9 aa, Yellow fever virus
IHAVPFGLV

SEQ ID NO: 161489 - protein, 9 aa, Yellow fever virus
HAVPFGLVS

SEQ ID NO: 161490 - protein, 9 aa, Yellow fever virus
AVPFGLVSM

SEQ ID NO: 161491 - protein, 9 aa, Yellow fever virus
VPFGLVSMM

SEQ ID NO: 161492 - protein, 9 aa, Yellow fever virus
PFGLVSMMI

SEQ ID NO: 161493 - protein, 9 aa, Yellow fever virus
FGLVSMMIA

SEQ ID NO: 161494 - protein, 9 aa, Yellow fever virus
GLVSMMIAM

SEQ ID NO: 161495 - protein, 9 aa, Yellow fever virus
LVSMMIAME

SEQ ID NO: 161496 - protein, 9 aa, Yellow fever virus
VSMMIAMEV

SEQ ID NO: 161497 - protein, 9 aa, Yellow fever virus
SMMIAMEVV

SEQ ID NO: 161498 - protein, 9 aa, Yellow fever virus
MMIAMEVVL

SEQ ID NO: 161499 - protein, 9 aa, Yellow fever virus
MIAMEVVLR

SEQ ID NO: 161500 - protein, 9 aa, Yellow fever virus
IAMEVVLRK

SEQ ID NO: 161501 - protein, 9 aa, Yellow fever virus
AMEVVLRKR

SEQ ID NO: 161502 - protein, 9 aa, Yellow fever virus
MEVVLRKRQ

SEQ ID NO: 161503 - protein, 9 aa, Yellow fever virus
EVVLRKRQG

SEQ ID NO: 161504 - protein, 9 aa, Yellow fever virus
VVLRKRQGP

SEQ ID NO: 161505 - protein, 9 aa, Yellow fever virus
VLRKRQGPK

SEQ ID NO: 161506 - protein, 9 aa, Yellow fever virus
LRKRQGPKQ

SEQ ID NO: 161507 - protein, 9 aa, Yellow fever virus
RKRQGPKQM

SEQ ID NO: 161508 - protein, 9 aa, Yellow fever virus
KRQGPKQML

SEQ ID NO: 161509 - protein, 9 aa, Yellow fever virus
RQGPKQMLV

SEQ ID NO: 161510 - protein, 9 aa, Yellow fever virus
QGPKQMLVG

SEQ ID NO: 161511 - protein, 9 aa, Yellow fever virus
GPKQMLVGG

SEQ ID NO: 161512 - protein, 9 aa, Yellow fever virus
PKQMLVGGV

SEQ ID NO: 161513 - protein, 9 aa, Yellow fever virus
KQMLVGGVV

SEQ ID NO: 161514 - protein, 9 aa, Yellow fever virus
QMLVGGVVL

SEQ ID NO: 161515 - protein, 9 aa, Yellow fever virus
MLVGGVVLL

SEQ ID NO: 161516 - protein, 9 aa, Yellow fever virus
LVGGVVLLG

SEQ ID NO: 161517 - protein, 9 aa, Yellow fever virus
VGGVVLLGA

SEQ ID NO: 161518 - protein, 9 aa, Yellow fever virus
GGVVLLGAM

SEQ ID NO: 161519 - protein, 9 aa, Yellow fever virus
GVVLLGAML

SEQ ID NO: 161520 - protein, 9 aa, Yellow fever virus
VVLLGAMLV

SEQ ID NO: 161521 - protein, 9 aa, Yellow fever virus
VLLGAMLVG

SEQ ID NO: 161522 - protein, 9 aa, Yellow fever virus
LLGAMLVGQ

SEQ ID NO: 161523 - protein, 9 aa, Yellow fever virus
LGAMLVGQV

SEQ ID NO: 161524 - protein, 9 aa, Yellow fever virus
GAMLVGQVT

SEQ ID NO: 161525 - protein, 9 aa, Yellow fever virus
AMLVGQVTL

SEQ ID NO: 161526 - protein, 9 aa, Yellow fever virus
MLVGQVTLL

SEQ ID NO: 161527 - protein, 9 aa, Yellow fever virus
LVGQVTLLD

SEQ ID NO: 161528 - protein, 9 aa, Yellow fever virus
VGQVTLLDL

SEQ ID NO: 161529 - protein, 9 aa, Yellow fever virus
GQVTLLDLL

SEQ ID NO: 161530 - protein, 9 aa, Yellow fever virus
QVTLLDLLK

SEQ ID NO: 161531 - protein, 9 aa, Yellow fever virus
LTVAVGLHF

SEQ ID NO: 161532 - protein, 9 aa, Yellow fever virus
TVAVGLHFH

SEQ ID NO: 161533 - protein, 9 aa, Yellow fever virus
VAVGLHFHE

SEQ ID NO: 161534 - protein, 9 aa, Yellow fever virus
AVGLHFHEM

SEQ ID NO: 161535 - protein, 9 aa, Yellow fever virus
VGLHFHEMN

SEQ ID NO: 161536 - protein, 9 aa, Yellow fever virus
GLHFHEMNN

SEQ ID NO: 161537 - protein, 9 aa, Yellow fever virus
LHFHEMNNG

SEQ ID NO: 161538 - protein, 9 aa, Yellow fever virus
HFHEMNNGG

SEQ ID NO: 161539 - protein, 9 aa, Yellow fever virus
FHEMNNGGD

SEQ ID NO: 161540 - protein, 9 aa, Yellow fever virus
HEMNNGGDA

SEQ ID NO: 161541 - protein, 9 aa, Yellow fever virus
EMNNGGDAM

SEQ ID NO: 161542 - protein, 9 aa, Yellow fever virus
MNNGGDAMY

SEQ ID NO: 161543 - protein, 9 aa, Yellow fever virus
NNGGDAMYM

SEQ ID NO: 161544 - protein, 9 aa, Yellow fever virus
NGGDAMYMA

SEQ ID NO: 161545 - protein, 9 aa, Yellow fever virus
GGDAMYMAL

SEQ ID NO: 161546 - protein, 9 aa, Yellow fever virus
GDAMYMALI

SEQ ID NO: 161547 - protein, 9 aa, Yellow fever virus
DAMYMALIA

SEQ ID NO: 161548 - protein, 9 aa, Yellow fever virus
AMYMALIAA

SEQ ID NO: 161549 - protein, 9 aa, Yellow fever virus
MYMALIAAF

SEQ ID NO: 161550 - protein, 9 aa, Yellow fever virus
YMALIAAFS

SEQ ID NO: 161551 - protein, 9 aa, Yellow fever virus
MALIAAFSI

SEQ ID NO: 161552 - protein, 9 aa, Yellow fever virus
ALIAAFSIR

SEQ ID NO: 161553 - protein, 9 aa, Yellow fever virus
LIAAFSIRP

SEQ ID NO: 161554 - protein, 9 aa, Yellow fever virus
IAAFSIRPG

SEQ ID NO: 161555 - protein, 9 aa, Yellow fever virus
AAFSIRPGL

SEQ ID NO: 161556 - protein, 9 aa, Yellow fever virus
AFSIRPGLL

SEQ ID NO: 161557 - protein, 9 aa, Yellow fever virus
FSIRPGLLI

SEQ ID NO: 161558 - protein, 9 aa, Yellow fever virus
SIRPGLLIG

SEQ ID NO: 161559 - protein, 9 aa, Yellow fever virus
IRPGLLIGF

SEQ ID NO: 161560 - protein, 9 aa, Yellow fever virus
RPGLLIGFG

SEQ ID NO: 161561 - protein, 9 aa, Yellow fever virus
PGLLIGFGL

SEQ ID NO: 161562 - protein, 9 aa, Yellow fever virus
GLLIGFGLR

SEQ ID NO: 161563 - protein, 9 aa, Yellow fever virus
LLIGFGLRT

SEQ ID NO: 161564 - protein, 9 aa, Yellow fever virus
LIGFGLRTL

SEQ ID NO: 161565 - protein, 9 aa, Yellow fever virus
IGFGLRTLW

SEQ ID NO: 161566 - protein, 9 aa, Yellow fever virus
GFGLRTLWS

SEQ ID NO: 161567 - protein, 9 aa, Yellow fever virus
FGLRTLWSP

SEQ ID NO: 161568 - protein, 9 aa, Yellow fever virus
GLRTLWSPR

SEQ ID NO: 161569 - protein, 9 aa, Yellow fever virus
LRTLWSPRE

SEQ ID NO: 161570 - protein, 9 aa, Yellow fever virus
RTLWSPRER

SEQ ID NO: 161571 - protein, 9 aa, Yellow fever virus
TLWSPRERL

SEQ ID NO: 161572 - protein, 9 aa, Yellow fever virus
LWSPRERLV

SEQ ID NO: 161573 - protein, 9 aa, Yellow fever virus
WSPRERLVL

SEQ ID NO: 161574 - protein, 9 aa, Yellow fever virus
SPRERLVLT

SEQ ID NO: 161575 - protein, 9 aa, Yellow fever virus
PRERLVLTL

SEQ ID NO: 161576 - protein, 9 aa, Yellow fever virus
RERLVLTLG

SEQ ID NO: 161577 - protein, 9 aa, Yellow fever virus
ERLVLTLGA

SEQ ID NO: 161578 - protein, 9 aa, Yellow fever virus
RLVLTLGAA

SEQ ID NO: 161579 - protein, 9 aa, Yellow fever virus
LVLTLGAAM

SEQ ID NO: 161580 - protein, 9 aa, Yellow fever virus
VLTLGAAMV

SEQ ID NO: 161581 - protein, 9 aa, Yellow fever virus
LTLGAAMVE

SEQ ID NO: 161582 - protein, 9 aa, Yellow fever virus
TLGAAMVEI

SEQ ID NO: 161583 - protein, 9 aa, Yellow fever virus
LGAAMVEIA

SEQ ID NO: 161584 - protein, 9 aa, Yellow fever virus
GAAMVEIAL

SEQ ID NO: 161585 - protein, 9 aa, Yellow fever virus
AAMVEIALG

SEQ ID NO: 161586 - protein, 9 aa, Yellow fever virus
AMVEIALGG

SEQ ID NO: 161587 - protein, 9 aa, Yellow fever virus
MVEIALGGV

SEQ ID NO: 161588 - protein, 9 aa, Yellow fever virus
VEIALGGVM

SEQ ID NO: 161589 - protein, 9 aa, Yellow fever virus
EIALGGVMG

SEQ ID NO: 161590 - protein, 9 aa, Yellow fever virus
IALGGVMGG

SEQ ID NO: 161591 - protein, 9 aa, Yellow fever virus
ALGGVMGGL

SEQ ID NO: 161592 - protein, 9 aa, Yellow fever virus
LGGVMGGLW

SEQ ID NO: 161593 - protein, 9 aa, Yellow fever virus
GGVMGGLWK

SEQ ID NO: 161594 - protein, 9 aa, Yellow fever virus
GVMGGLWKY

SEQ ID NO: 161595 - protein, 9 aa, Yellow fever virus
VMGGLWKYL

SEQ ID NO: 161596 - protein, 9 aa, Yellow fever virus
MGGLWKYLN

SEQ ID NO: 161597 - protein, 9 aa, Yellow fever virus
GGLWKYLNA

SEQ ID NO: 161598 - protein, 9 aa, Yellow fever virus
GLWKYLNAV

SEQ ID NO: 161599 - protein, 9 aa, Yellow fever virus
LWKYLNAVS

SEQ ID NO: 161600 - protein, 9 aa, Yellow fever virus
WKYLNAVSL

SEQ ID NO: 161601 - protein, 9 aa, Yellow fever virus
KYLNAVSLC

SEQ ID NO: 161602 - protein, 9 aa, Yellow fever virus
YLNAVSLCI

SEQ ID NO: 161603 - protein, 9 aa, Yellow fever virus
LNAVSLCIL

SEQ ID NO: 161604 - protein, 9 aa, Yellow fever virus
NAVSLCILT

SEQ ID NO: 161605 - protein, 9 aa, Yellow fever virus
AVSLCILTI

SEQ ID NO: 161606 - protein, 9 aa, Yellow fever virus
VSLCILTIN

SEQ ID NO: 161607 - protein, 9 aa, Yellow fever virus
SLCILTINA

SEQ ID NO: 161608 - protein, 9 aa, Yellow fever virus
LCILTINAV

SEQ ID NO: 161609 - protein, 9 aa, Yellow fever virus
CILTINAVA

SEQ ID NO: 161610 - protein, 9 aa, Yellow fever virus
ILTINAVAS

SEQ ID NO: 161611 - protein, 9 aa, Yellow fever virus
LTINAVASR

SEQ ID NO: 161612 - protein, 9 aa, Yellow fever virus
TINAVASRK

SEQ ID NO: 161613 - protein, 9 aa, Yellow fever virus
INAVASRKA

SEQ ID NO: 161614 - protein, 9 aa, Yellow fever virus
NAVASRKAS

SEQ ID NO: 161615 - protein, 9 aa, Yellow fever virus
AVASRKASN

SEQ ID NO: 161616 - protein, 9 aa, Yellow fever virus
VASRKASNT

SEQ ID NO: 161617 - protein, 9 aa, Yellow fever virus
ASRKASNTI

SEQ ID NO: 161618 - protein, 9 aa, Yellow fever virus
SRKASNTIL

SEQ ID NO: 161619 - protein, 9 aa, Yellow fever virus
RKASNTILP

SEQ ID NO: 161620 - protein, 9 aa, Yellow fever virus
KASNTILPL

SEQ ID NO: 161621 - protein, 9 aa, Yellow fever virus
ASNTILPLM

SEQ ID NO: 161622 - protein, 9 aa, Yellow fever virus
SNTILPLMA

SEQ ID NO: 161623 - protein, 9 aa, Yellow fever virus
NTILPLMAL

SEQ ID NO: 161624 - protein, 9 aa, Yellow fever virus
TILPLMALL

SEQ ID NO: 161625 - protein, 9 aa, Yellow fever virus
ILPLMALLT

SEQ ID NO: 161626 - protein, 9 aa, Yellow fever virus
LPLMALLTP

SEQ ID NO: 161627 - protein, 9 aa, Yellow fever virus
PLMALLTPV

SEQ ID NO: 161628 - protein, 9 aa, Yellow fever virus
LMALLTPVT

SEQ ID NO: 161629 - protein, 9 aa, Yellow fever virus
MALLTPVTM

SEQ ID NO: 161630 - protein, 9 aa, Yellow fever virus
ALLTPVTMA

SEQ ID NO: 161631 - protein, 9 aa, Yellow fever virus
LLTPVTMAE

SEQ ID NO: 161632 - protein, 9 aa, Yellow fever virus
LTPVTMAEV

SEQ ID NO: 161633 - protein, 9 aa, Yellow fever virus
TPVTMAEVR

SEQ ID NO: 161634 - protein, 9 aa, Yellow fever virus
PVTMAEVRL

SEQ ID NO: 161635 - protein, 9 aa, Yellow fever virus
VTMAEVRLA

SEQ ID NO: 161636 - protein, 9 aa, Yellow fever virus
TMAEVRLAA

SEQ ID NO: 161637 - protein, 9 aa, Yellow fever virus
MAEVRLAAM

SEQ ID NO: 161638 - protein, 9 aa, Yellow fever virus
AEVRLAAMF

SEQ ID NO: 161639 - protein, 9 aa, Yellow fever virus
EVRLAAMFF

SEQ ID NO: 161640 - protein, 9 aa, Yellow fever virus
VRLAAMFFC

SEQ ID NO: 161641 - protein, 9 aa, Yellow fever virus
AAMFFCAVV

SEQ ID NO: 161642 - protein, 9 aa, Yellow fever virus
AMFFCAVVI

SEQ ID NO: 161643 - protein, 9 aa, Yellow fever virus
MFFCAVVII

SEQ ID NO: 161644 - protein, 9 aa, Yellow fever virus
FFCAVVIIG

SEQ ID NO: 161645 - protein, 9 aa, Yellow fever virus
FCAVVIIGV

SEQ ID NO: 161646 - protein, 9 aa, Yellow fever virus
CAVVIIGVL

SEQ ID NO: 161647 - protein, 9 aa, Yellow fever virus
AVVIIGVLH

SEQ ID NO: 161648 - protein, 9 aa, Yellow fever virus
VVIIGVLHQ

SEQ ID NO: 161649 - protein, 9 aa, Yellow fever virus
VIIGVLHQN

SEQ ID NO: 161650 - protein, 9 aa, Yellow fever virus
IIGVLHQNF

SEQ ID NO: 161651 - protein, 9 aa, Yellow fever virus
IGVLHQNFK

SEQ ID NO: 161652 - protein, 9 aa, Yellow fever virus
GVLHQNFKD

SEQ ID NO: 161653 - protein, 9 aa, Yellow fever virus
VLHQNFKDT

SEQ ID NO: 161654 - protein, 9 aa, Yellow fever virus
LHQNFKDTS

SEQ ID NO: 161655 - protein, 9 aa, Yellow fever virus
HQNFKDTSM

SEQ ID NO: 161656 - protein, 9 aa, Yellow fever virus
QNFKDTSMQ

SEQ ID NO: 161657 - protein, 9 aa, Yellow fever virus
NFKDTSMQK

SEQ ID NO: 161658 - protein, 9 aa, Yellow fever virus
FKDTSMQKT

SEQ ID NO: 161659 - protein, 9 aa, Yellow fever virus
KDTSMQKTI

SEQ ID NO: 161660 - protein, 9 aa, Yellow fever virus
DTSMQKTIP

SEQ ID NO: 161661 - protein, 9 aa, Yellow fever virus
TSMQKTIPL

SEQ ID NO: 161662 - protein, 9 aa, Yellow fever virus
SMQKTIPLV

SEQ ID NO: 161663 - protein, 9 aa, Yellow fever virus
MQKTIPLVA

SEQ ID NO: 161664 - protein, 9 aa, Yellow fever virus
QKTIPLVAL

SEQ ID NO: 161665 - protein, 9 aa, Yellow fever virus
KTIPLVALT

SEQ ID NO: 161666 - protein, 9 aa, Yellow fever virus
TIPLVALTL

SEQ ID NO: 161667 - protein, 9 aa, Yellow fever virus
IPLVALTLT

SEQ ID NO: 161668 - protein, 9 aa, Yellow fever virus
PLVALTLTS

SEQ ID NO: 161669 - protein, 9 aa, Yellow fever virus
LVALTLTSY

SEQ ID NO: 161670 - protein, 9 aa, Yellow fever virus
VALTLTSYL

SEQ ID NO: 161671 - protein, 9 aa, Yellow fever virus
ALTLTSYLG

SEQ ID NO: 161672 - protein, 9 aa, Yellow fever virus
LTLTSYLGL

SEQ ID NO: 161673 - protein, 9 aa, Yellow fever virus
TLTSYLGLT

SEQ ID NO: 161674 - protein, 9 aa, Yellow fever virus
LTSYLGLTQ

SEQ ID NO: 161675 - protein, 9 aa, Yellow fever virus
TSYLGLTQP

SEQ ID NO: 161676 - protein, 9 aa, Yellow fever virus
SYLGLTQPF

SEQ ID NO: 161677 - protein, 9 aa, Yellow fever virus
YLGLTQPFL

SEQ ID NO: 161678 - protein, 9 aa, Yellow fever virus
LGLTQPFLG

SEQ ID NO: 161679 - protein, 9 aa, Yellow fever virus
GLTQPFLGL

SEQ ID NO: 161680 - protein, 9 aa, Yellow fever virus
LTQPFLGLC

SEQ ID NO: 161681 - protein, 9 aa, Yellow fever virus
TQPFLGLCA

SEQ ID NO: 161682 - protein, 9 aa, Yellow fever virus
QPFLGLCAF

SEQ ID NO: 161683 - protein, 9 aa, Yellow fever virus
PFLGLCAFL

SEQ ID NO: 161684 - protein, 9 aa, Yellow fever virus
FLGLCAFLA

SEQ ID NO: 161685 - protein, 9 aa, Yellow fever virus
LGLCAFLAT

SEQ ID NO: 161686 - protein, 9 aa, Yellow fever virus
GLCAFLATR

SEQ ID NO: 161687 - protein, 9 aa, Yellow fever virus
LCAFLATRI

SEQ ID NO: 161688 - protein, 9 aa, Yellow fever virus
CAFLATRIF

SEQ ID NO: 161689 - protein, 9 aa, Yellow fever virus
AFLATRIFG

SEQ ID NO: 161690 - protein, 9 aa, Yellow fever virus
FLATRIFGR

SEQ ID NO: 161691 - protein, 9 aa, Yellow fever virus
LATRIFGRR

SEQ ID NO: 161692 - protein, 9 aa, Yellow fever virus
ATRIFGRRS

SEQ ID NO: 161693 - protein, 9 aa, Yellow fever virus
TRIFGRRSI

SEQ ID NO: 161694 - protein, 9 aa, Yellow fever virus
RIFGRRSIP

SEQ ID NO: 161695 - protein, 9 aa, Yellow fever virus
IFGRRSIPV

SEQ ID NO: 161696 - protein, 9 aa, Yellow fever virus
FGRRSIPVN

SEQ ID NO: 161697 - protein, 9 aa, Yellow fever virus
GRRSIPVNE

SEQ ID NO: 161698 - protein, 9 aa, Yellow fever virus
RRSIPVNEA

SEQ ID NO: 161699 - protein, 9 aa, Yellow fever virus
RSIPVNEAL

SEQ ID NO: 161700 - protein, 9 aa, Yellow fever virus
SIPVNEALA

SEQ ID NO: 161701 - protein, 9 aa, Yellow fever virus
IPVNEALAA

SEQ ID NO: 161702 - protein, 9 aa, Yellow fever virus
PVNEALAAA

SEQ ID NO: 161703 - protein, 9 aa, Yellow fever virus
VNEALAAAG

SEQ ID NO: 161704 - protein, 9 aa, Yellow fever virus
NEALAAAGL

SEQ ID NO: 161705 - protein, 9 aa, Yellow fever virus
EALAAAGLV

SEQ ID NO: 161706 - protein, 9 aa, Yellow fever virus
ALAAAGLVG

SEQ ID NO: 161707 - protein, 9 aa, Yellow fever virus
LAAAGLVGV

SEQ ID NO: 161708 - protein, 9 aa, Yellow fever virus
AAAGLVGVL

SEQ ID NO: 161709 - protein, 9 aa, Yellow fever virus
AAGLVGVLA

SEQ ID NO: 161710 - protein, 9 aa, Yellow fever virus
AGLVGVLAG

SEQ ID NO: 161711 - protein, 9 aa, Yellow fever virus
GLVGVLAGL

SEQ ID NO: 161712 - protein, 9 aa, Yellow fever virus
LVGVLAGLA

SEQ ID NO: 161713 - protein, 9 aa, Yellow fever virus
VGVLAGLAF

SEQ ID NO: 161714 - protein, 9 aa, Yellow fever virus
GVLAGLAFQ

SEQ ID NO: 161715 - protein, 9 aa, Yellow fever virus
VLAGLAFQE

SEQ ID NO: 161716 - protein, 9 aa, Yellow fever virus
LAGLAFQEM

SEQ ID NO: 161717 - protein, 9 aa, Yellow fever virus
AGLAFQEME

SEQ ID NO: 161718 - protein, 9 aa, Yellow fever virus
GLAFQEMEN

SEQ ID NO: 161719 - protein, 9 aa, Yellow fever virus
LAFQEMENF

SEQ ID NO: 161720 - protein, 9 aa, Yellow fever virus
AFQEMENFL

SEQ ID NO: 161721 - protein, 9 aa, Yellow fever virus
FQEMENFLG

SEQ ID NO: 161722 - protein, 9 aa, Yellow fever virus
QEMENFLGP

SEQ ID NO: 161723 - protein, 9 aa, Yellow fever virus
EMENFLGPI

SEQ ID NO: 161724 - protein, 9 aa, Yellow fever virus
MENFLGPIA

SEQ ID NO: 161725 - protein, 9 aa, Yellow fever virus
ENFLGPIAV

SEQ ID NO: 161726 - protein, 9 aa, Yellow fever virus
NFLGPIAVG

SEQ ID NO: 161727 - protein, 9 aa, Yellow fever virus
FLGPIAVGG

SEQ ID NO: 161728 - protein, 9 aa, Yellow fever virus
LGPIAVGGL

SEQ ID NO: 161729 - protein, 9 aa, Yellow fever virus
GPIAVGGLL

SEQ ID NO: 161730 - protein, 9 aa, Yellow fever virus
PIAVGGLLM

SEQ ID NO: 161731 - protein, 9 aa, Yellow fever virus
IAVGGLLMM

SEQ ID NO: 161732 - protein, 9 aa, Yellow fever virus
AVGGLLMML

SEQ ID NO: 161733 - protein, 9 aa, Yellow fever virus
VGGLLMMLV

SEQ ID NO: 161734 - protein, 9 aa, Yellow fever virus
GGLLMMLVS

SEQ ID NO: 161735 - protein, 9 aa, Yellow fever virus
GLLMMLVSV

SEQ ID NO: 161736 - protein, 9 aa, Yellow fever virus
LLMMLVSVA

SEQ ID NO: 161737 - protein, 9 aa, Yellow fever virus
LMMLVSVAG

SEQ ID NO: 161738 - protein, 9 aa, Yellow fever virus
MMLVSVAGR

SEQ ID NO: 161739 - protein, 9 aa, Yellow fever virus
MLVSVAGRV

SEQ ID NO: 161740 - protein, 9 aa, Yellow fever virus
LVSVAGRVD

SEQ ID NO: 161741 - protein, 9 aa, Yellow fever virus
VSVAGRVDG

SEQ ID NO: 161742 - protein, 9 aa, Yellow fever virus
SVAGRVDGL

SEQ ID NO: 161743 - protein, 9 aa, Yellow fever virus
VAGRVDGLE

SEQ ID NO: 161744 - protein, 9 aa, Yellow fever virus
AGRVDGLEL

SEQ ID NO: 161745 - protein, 9 aa, Yellow fever virus
GRVDGLELK

SEQ ID NO: 161746 - protein, 9 aa, Yellow fever virus
RVDGLELKK

SEQ ID NO: 161747 - protein, 9 aa, Yellow fever virus
VDGLELKKL

SEQ ID NO: 161748 - protein, 9 aa, Yellow fever virus
DGLELKKLG

SEQ ID NO: 161749 - protein, 9 aa, Yellow fever virus
GLELKKLGE

SEQ ID NO: 161750 - protein, 9 aa, Yellow fever virus
LELKKLGEV

SEQ ID NO: 161751 - protein, 9 aa, Yellow fever virus
ELKKLGEVS

SEQ ID NO: 161752 - protein, 9 aa, Yellow fever virus
LKKLGEVSW

SEQ ID NO: 161753 - protein, 9 aa, Yellow fever virus
KKLGEVSWE

SEQ ID NO: 161754 - protein, 9 aa, Yellow fever virus
KLGEVSWEE

SEQ ID NO: 161755 - protein, 9 aa, Yellow fever virus
LGEVSWEEE

SEQ ID NO: 161756 - protein, 9 aa, Yellow fever virus
GEVSWEEEA

SEQ ID NO: 161757 - protein, 9 aa, Yellow fever virus
EVSWEEEAE

SEQ ID NO: 161758 - protein, 9 aa, Yellow fever virus
VSWEEEAEI

SEQ ID NO: 161759 - protein, 9 aa, Yellow fever virus
SWEEEAEIS

SEQ ID NO: 161760 - protein, 9 aa, Yellow fever virus
WEEEAEISG

SEQ ID NO: 161761 - protein, 9 aa, Yellow fever virus
EEEAEISGS

SEQ ID NO: 161762 - protein, 9 aa, Yellow fever virus
EEAEISGSS

SEQ ID NO: 161763 - protein, 9 aa, Yellow fever virus
EAEISGSSA

SEQ ID NO: 161764 - protein, 9 aa, Yellow fever virus
AEISGSSAR

SEQ ID NO: 161765 - protein, 9 aa, Yellow fever virus
EISGSSARY

SEQ ID NO: 161766 - protein, 9 aa, Yellow fever virus
ISGSSARYD

SEQ ID NO: 161767 - protein, 9 aa, Yellow fever virus
SGSSARYDV

SEQ ID NO: 161768 - protein, 9 aa, Yellow fever virus
GSSARYDVA

SEQ ID NO: 161769 - protein, 9 aa, Yellow fever virus
SSARYDVAL

SEQ ID NO: 161770 - protein, 9 aa, Yellow fever virus
SARYDVALS

SEQ ID NO: 161771 - protein, 9 aa, Yellow fever virus
ARYDVALSE

SEQ ID NO: 161772 - protein, 9 aa, Yellow fever virus
RYDVALSEQ

SEQ ID NO: 161773 - protein, 9 aa, Yellow fever virus
YDVALSEQG

SEQ ID NO: 161774 - protein, 9 aa, Yellow fever virus
DVALSEQGE

SEQ ID NO: 161775 - protein, 9 aa, Yellow fever virus
VALSEQGEF

SEQ ID NO: 161776 - protein, 9 aa, Yellow fever virus
ALSEQGEFK

SEQ ID NO: 161777 - protein, 9 aa, Yellow fever virus
LSEQGEFKL

SEQ ID NO: 161778 - protein, 9 aa, Yellow fever virus
SEQGEFKLL

SEQ ID NO: 161779 - protein, 9 aa, Yellow fever virus
EQGEFKLLS

SEQ ID NO: 161780 - protein, 9 aa, Yellow fever virus
QGEFKLLSE

SEQ ID NO: 161781 - protein, 9 aa, Yellow fever virus
GEFKLLSEE

SEQ ID NO: 161782 - protein, 9 aa, Yellow fever virus
EFKLLSEEK

SEQ ID NO: 161783 - protein, 9 aa, Yellow fever virus
FKLLSEEKV

SEQ ID NO: 161784 - protein, 9 aa, Yellow fever virus
KLLSEEKVP

SEQ ID NO: 161785 - protein, 9 aa, Yellow fever virus
LLSEEKVPW

SEQ ID NO: 161786 - protein, 9 aa, Yellow fever virus
LSEEKVPWD

SEQ ID NO: 161787 - protein, 9 aa, Yellow fever virus
SEEKVPWDQ

SEQ ID NO: 161788 - protein, 9 aa, Yellow fever virus
EEKVPWDQV

SEQ ID NO: 161789 - protein, 9 aa, Yellow fever virus
EKVPWDQVV

SEQ ID NO: 161790 - protein, 9 aa, Yellow fever virus
KVPWDQVVM

SEQ ID NO: 161791 - protein, 9 aa, Yellow fever virus
VPWDQVVMT

SEQ ID NO: 161792 - protein, 9 aa, Yellow fever virus
PWDQVVMTS

SEQ ID NO: 161793 - protein, 9 aa, Yellow fever virus
WDQVVMTSL

SEQ ID NO: 161794 - protein, 9 aa, Yellow fever virus
DQVVMTSLA

SEQ ID NO: 161795 - protein, 9 aa, Yellow fever virus
QVVMTSLAL

SEQ ID NO: 161796 - protein, 9 aa, Yellow fever virus
VVMTSLALV

SEQ ID NO: 161797 - protein, 9 aa, Yellow fever virus
VMTSLALVG

SEQ ID NO: 161798 - protein, 9 aa, Yellow fever virus
MTSLALVGA

SEQ ID NO: 161799 - protein, 9 aa, Yellow fever virus
TSLALVGAA

SEQ ID NO: 161800 - protein, 9 aa, Yellow fever virus
SLALVGAAL

SEQ ID NO: 161801 - protein, 9 aa, Yellow fever virus
LALVGAALH

SEQ ID NO: 161802 - protein, 9 aa, Yellow fever virus
ALVGAALHP

SEQ ID NO: 161803 - protein, 9 aa, Yellow fever virus
LVGAALHPF

SEQ ID NO: 161804 - protein, 9 aa, Yellow fever virus
VGAALHPFA

SEQ ID NO: 161805 - protein, 9 aa, Yellow fever virus
GAALHPFAL

SEQ ID NO: 161806 - protein, 9 aa, Yellow fever virus
AALHPFALL

SEQ ID NO: 161807 - protein, 9 aa, Yellow fever virus
ALHPFALLL

SEQ ID NO: 161808 - protein, 9 aa, Yellow fever virus
LHPFALLLV

SEQ ID NO: 161809 - protein, 9 aa, Yellow fever virus
HPFALLLVL

SEQ ID NO: 161810 - protein, 9 aa, Yellow fever virus
PFALLLVLA

SEQ ID NO: 161811 - protein, 9 aa, Yellow fever virus
FALLLVLAG

SEQ ID NO: 161812 - protein, 9 aa, Yellow fever virus
ALLLVLAGW

SEQ ID NO: 161813 - protein, 9 aa, Yellow fever virus
LLLVLAGWL

SEQ ID NO: 161814 - protein, 9 aa, Yellow fever virus
LLVLAGWLF

SEQ ID NO: 161815 - protein, 9 aa, Yellow fever virus
LVLAGWLFH

SEQ ID NO: 161816 - protein, 9 aa, Yellow fever virus
VLAGWLFHV

SEQ ID NO: 161817 - protein, 9 aa, Yellow fever virus
LAGWLFHVR

SEQ ID NO: 161818 - protein, 9 aa, Yellow fever virus
AGWLFHVRG

SEQ ID NO: 161819 - protein, 9 aa, Yellow fever virus
GWLFHVRGA

SEQ ID NO: 161820 - protein, 9 aa, Yellow fever virus
WLFHVRGAR

SEQ ID NO: 161821 - protein, 9 aa, Yellow fever virus
LFHVRGARR

SEQ ID NO: 161822 - protein, 9 aa, Yellow fever virus
FHVRGARRS

SEQ ID NO: 161823 - protein, 9 aa, Yellow fever virus
HVRGARRSG

SEQ ID NO: 161824 - protein, 9 aa, Yellow fever virus
VRGARRSGD

SEQ ID NO: 161825 - protein, 9 aa, Yellow fever virus
RGARRSGDV

SEQ ID NO: 161826 - protein, 9 aa, Yellow fever virus
GARRSGDVL

SEQ ID NO: 161827 - protein, 9 aa, Yellow fever virus
ARRSGDVLW

SEQ ID NO: 161828 - protein, 9 aa, Yellow fever virus
RRSGDVLWD

SEQ ID NO: 161829 - protein, 9 aa, Yellow fever virus
RSGDVLWDI

SEQ ID NO: 161830 - protein, 9 aa, Yellow fever virus
SGDVLWDIP

SEQ ID NO: 161831 - protein, 9 aa, Yellow fever virus
GDVLWDIPT

SEQ ID NO: 161832 - protein, 9 aa, Yellow fever virus
DVLWDIPTP

SEQ ID NO: 161833 - protein, 9 aa, Yellow fever virus
VLWDIPTPK

SEQ ID NO: 161834 - protein, 9 aa, Yellow fever virus
LWDIPTPKI

SEQ ID NO: 161835 - protein, 9 aa, Yellow fever virus
WDIPTPKII

SEQ ID NO: 161836 - protein, 9 aa, Yellow fever virus
DIPTPKIIE

SEQ ID NO: 161837 - protein, 9 aa, Yellow fever virus
IPTPKIIEE

SEQ ID NO: 161838 - protein, 9 aa, Yellow fever virus
PTPKIIEEC

SEQ ID NO: 161839 - protein, 9 aa, Yellow fever virus
TPKIIEECE

SEQ ID NO: 161840 - protein, 9 aa, Yellow fever virus
PKIIEECEH

SEQ ID NO: 161841 - protein, 9 aa, Yellow fever virus
KIIEECEHL

SEQ ID NO: 161842 - protein, 9 aa, Yellow fever virus
IIEECEHLE

SEQ ID NO: 161843 - protein, 9 aa, Yellow fever virus
IEECEHLED

SEQ ID NO: 161844 - protein, 9 aa, Yellow fever virus
EECEHLEDG

SEQ ID NO: 161845 - protein, 9 aa, Yellow fever virus
ECEHLEDGI

SEQ ID NO: 161846 - protein, 9 aa, Yellow fever virus
CEHLEDGIY

SEQ ID NO: 161847 - protein, 9 aa, Yellow fever virus
EHLEDGIYG

SEQ ID NO: 161848 - protein, 9 aa, Yellow fever virus
HLEDGIYGI

SEQ ID NO: 161849 - protein, 9 aa, Yellow fever virus
LEDGIYGIF

SEQ ID NO: 161850 - protein, 9 aa, Yellow fever virus
EDGIYGIFQ

SEQ ID NO: 161851 - protein, 9 aa, Yellow fever virus
DGIYGIFQS

SEQ ID NO: 161852 - protein, 9 aa, Yellow fever virus
GIYGIFQST

SEQ ID NO: 161853 - protein, 9 aa, Yellow fever virus
IYGIFQSTF

SEQ ID NO: 161854 - protein, 9 aa, Yellow fever virus
YGIFQSTFL

SEQ ID NO: 161855 - protein, 9 aa, Yellow fever virus
GIFQSTFLG

SEQ ID NO: 161856 - protein, 9 aa, Yellow fever virus
IFQSTFLGA

SEQ ID NO: 161857 - protein, 9 aa, Yellow fever virus
FQSTFLGAS

SEQ ID NO: 161858 - protein, 9 aa, Yellow fever virus
QSTFLGASQ

SEQ ID NO: 161859 - protein, 9 aa, Yellow fever virus
STFLGASQR

SEQ ID NO: 161860 - protein, 9 aa, Yellow fever virus
TFLGASQRG

SEQ ID NO: 161861 - protein, 9 aa, Yellow fever virus
FLGASQRGV

SEQ ID NO: 161862 - protein, 9 aa, Yellow fever virus
LGASQRGVG

SEQ ID NO: 161863 - protein, 9 aa, Yellow fever virus
GASQRGVGV

SEQ ID NO: 161864 - protein, 9 aa, Yellow fever virus
ASQRGVGVA

SEQ ID NO: 161865 - protein, 9 aa, Yellow fever virus
SQRGVGVAQ

SEQ ID NO: 161866 - protein, 9 aa, Yellow fever virus
QRGVGVAQG

SEQ ID NO: 161867 - protein, 9 aa, Yellow fever virus
RGVGVAQGG

SEQ ID NO: 161868 - protein, 9 aa, Yellow fever virus
GVGVAQGGV

SEQ ID NO: 161869 - protein, 9 aa, Yellow fever virus
VGVAQGGVF

SEQ ID NO: 161870 - protein, 9 aa, Yellow fever virus
GVAQGGVFH

SEQ ID NO: 161871 - protein, 9 aa, Yellow fever virus
VAQGGVFHT

SEQ ID NO: 161872 - protein, 9 aa, Yellow fever virus
AQGGVFHTM

SEQ ID NO: 161873 - protein, 9 aa, Yellow fever virus
QGGVFHTMW

SEQ ID NO: 161874 - protein, 9 aa, Yellow fever virus
GGVFHTMWH

SEQ ID NO: 161875 - protein, 9 aa, Yellow fever virus
GVFHTMWHV

SEQ ID NO: 161876 - protein, 9 aa, Yellow fever virus
VFHTMWHVT

SEQ ID NO: 161877 - protein, 9 aa, Yellow fever virus
FHTMWHVTR

SEQ ID NO: 161878 - protein, 9 aa, Yellow fever virus
HTMWHVTRG

SEQ ID NO: 161879 - protein, 9 aa, Yellow fever virus
TMWHVTRGA

SEQ ID NO: 161880 - protein, 9 aa, Yellow fever virus
MWHVTRGAF

SEQ ID NO: 161881 - protein, 9 aa, Yellow fever virus
WHVTRGAFL

SEQ ID NO: 161882 - protein, 9 aa, Yellow fever virus
HVTRGAFLV

SEQ ID NO: 161883 - protein, 9 aa, Yellow fever virus
VTRGAFLVR

SEQ ID NO: 161884 - protein, 9 aa, Yellow fever virus
TRGAFLVRN

SEQ ID NO: 161885 - protein, 9 aa, Yellow fever virus
RGAFLVRNG

SEQ ID NO: 161886 - protein, 9 aa, Yellow fever virus
GAFLVRNGK

SEQ ID NO: 161887 - protein, 9 aa, Yellow fever virus
AFLVRNGKK

SEQ ID NO: 161888 - protein, 9 aa, Yellow fever virus
FLVRNGKKL

SEQ ID NO: 161889 - protein, 9 aa, Yellow fever virus
LVRNGKKLI

SEQ ID NO: 161890 - protein, 9 aa, Yellow fever virus
VRNGKKLIP

SEQ ID NO: 161891 - protein, 9 aa, Yellow fever virus
RNGKKLIPS

SEQ ID NO: 161892 - protein, 9 aa, Yellow fever virus
NGKKLIPSW

SEQ ID NO: 161893 - protein, 9 aa, Yellow fever virus
GKKLIPSWA

SEQ ID NO: 161894 - protein, 9 aa, Yellow fever virus
KKLIPSWAS

SEQ ID NO: 161895 - protein, 9 aa, Yellow fever virus
KLIPSWASV

SEQ ID NO: 161896 - protein, 9 aa, Yellow fever virus
LIPSWASVK

SEQ ID NO: 161897 - protein, 9 aa, Yellow fever virus
IPSWASVKE

SEQ ID NO: 161898 - protein, 9 aa, Yellow fever virus
PSWASVKED

SEQ ID NO: 161899 - protein, 9 aa, Yellow fever virus
SWASVKEDL

SEQ ID NO: 161900 - protein, 9 aa, Yellow fever virus
WASVKEDLV

SEQ ID NO: 161901 - protein, 9 aa, Yellow fever virus
ASVKEDLVA

SEQ ID NO: 161902 - protein, 9 aa, Yellow fever virus
SVKEDLVAY

SEQ ID NO: 161903 - protein, 9 aa, Yellow fever virus
VKEDLVAYG

SEQ ID NO: 161904 - protein, 9 aa, Yellow fever virus
KEDLVAYGG

SEQ ID NO: 161905 - protein, 9 aa, Yellow fever virus
EDLVAYGGS

SEQ ID NO: 161906 - protein, 9 aa, Yellow fever virus
DLVAYGGSW

SEQ ID NO: 161907 - protein, 9 aa, Yellow fever virus
LVAYGGSWK

SEQ ID NO: 161908 - protein, 9 aa, Yellow fever virus
VAYGGSWKL

SEQ ID NO: 161909 - protein, 9 aa, Yellow fever virus
AYGGSWKLE

SEQ ID NO: 161910 - protein, 9 aa, Yellow fever virus
YGGSWKLEG

SEQ ID NO: 161911 - protein, 9 aa, Yellow fever virus
GGSWKLEGR

SEQ ID NO: 161912 - protein, 9 aa, Yellow fever virus
GSWKLEGRW

SEQ ID NO: 161913 - protein, 9 aa, Yellow fever virus
SWKLEGRWD

SEQ ID NO: 161914 - protein, 9 aa, Yellow fever virus
WKLEGRWDG

SEQ ID NO: 161915 - protein, 9 aa, Yellow fever virus
KLEGRWDGE

SEQ ID NO: 161916 - protein, 9 aa, Yellow fever virus
LEGRWDGEE

SEQ ID NO: 161917 - protein, 9 aa, Yellow fever virus
EGRWDGEEE

SEQ ID NO: 161918 - protein, 9 aa, Yellow fever virus
GRWDGEEEV

SEQ ID NO: 161919 - protein, 9 aa, Yellow fever virus
RWDGEEEVQ

SEQ ID NO: 161920 - protein, 9 aa, Yellow fever virus
WDGEEEVQL

SEQ ID NO: 161921 - protein, 9 aa, Yellow fever virus
DGEEEVQLI

SEQ ID NO: 161922 - protein, 9 aa, Yellow fever virus
GEEEVQLIA

SEQ ID NO: 161923 - protein, 9 aa, Yellow fever virus
EEEVQLIAA

SEQ ID NO: 161924 - protein, 9 aa, Yellow fever virus
EEVQLIAAV

SEQ ID NO: 161925 - protein, 9 aa, Yellow fever virus
EVQLIAAVP

SEQ ID NO: 161926 - protein, 9 aa, Yellow fever virus
VQLIAAVPG

SEQ ID NO: 161927 - protein, 9 aa, Yellow fever virus
QLIAAVPGK

SEQ ID NO: 161928 - protein, 9 aa, Yellow fever virus
LIAAVPGKN

SEQ ID NO: 161929 - protein, 9 aa, Yellow fever virus
IAAVPGKNV

SEQ ID NO: 161930 - protein, 9 aa, Yellow fever virus
AAVPGKNVV

SEQ ID NO: 161931 - protein, 9 aa, Yellow fever virus
AVPGKNVVN

SEQ ID NO: 161932 - protein, 9 aa, Yellow fever virus
VPGKNVVNV

SEQ ID NO: 161933 - protein, 9 aa, Yellow fever virus
PGKNVVNVQ

SEQ ID NO: 161934 - protein, 9 aa, Yellow fever virus
GKNVVNVQT

SEQ ID NO: 161935 - protein, 9 aa, Yellow fever virus
KNVVNVQTK

SEQ ID NO: 161936 - protein, 9 aa, Yellow fever virus
NVVNVQTKP

SEQ ID NO: 161937 - protein, 9 aa, Yellow fever virus
VVNVQTKPS

SEQ ID NO: 161938 - protein, 9 aa, Yellow fever virus
VNVQTKPSL

SEQ ID NO: 161939 - protein, 9 aa, Yellow fever virus
NVQTKPSLF

SEQ ID NO: 161940 - protein, 9 aa, Yellow fever virus
VQTKPSLFK

SEQ ID NO: 161941 - protein, 9 aa, Yellow fever virus
QTKPSLFKV

SEQ ID NO: 161942 - protein, 9 aa, Yellow fever virus
TKPSLFKVR

SEQ ID NO: 161943 - protein, 9 aa, Yellow fever virus
KPSLFKVRN

SEQ ID NO: 161944 - protein, 9 aa, Yellow fever virus
PSLFKVRNG

SEQ ID NO: 161945 - protein, 9 aa, Yellow fever virus
SLFKVRNGG

SEQ ID NO: 161946 - protein, 9 aa, Yellow fever virus
LFKVRNGGE

SEQ ID NO: 161947 - protein, 9 aa, Yellow fever virus
FKVRNGGEI

SEQ ID NO: 161948 - protein, 9 aa, Yellow fever virus
KVRNGGEIG

SEQ ID NO: 161949 - protein, 9 aa, Yellow fever virus
VRNGGEIGA

SEQ ID NO: 161950 - protein, 9 aa, Yellow fever virus
RNGGEIGAV

SEQ ID NO: 161951 - protein, 9 aa, Yellow fever virus
NGGEIGAVA

SEQ ID NO: 161952 - protein, 9 aa, Yellow fever virus
GGEIGAVAL

SEQ ID NO: 161953 - protein, 9 aa, Yellow fever virus
GEIGAVALD

SEQ ID NO: 161954 - protein, 9 aa, Yellow fever virus
EIGAVALDY

SEQ ID NO: 161955 - protein, 9 aa, Yellow fever virus
IGAVALDYP

SEQ ID NO: 161956 - protein, 9 aa, Yellow fever virus
GAVALDYPS

SEQ ID NO: 161957 - protein, 9 aa, Yellow fever virus
AVALDYPSG

SEQ ID NO: 161958 - protein, 9 aa, Yellow fever virus
VALDYPSGT

SEQ ID NO: 161959 - protein, 9 aa, Yellow fever virus
ALDYPSGTS

SEQ ID NO: 161960 - protein, 9 aa, Yellow fever virus
LDYPSGTSG

SEQ ID NO: 161961 - protein, 9 aa, Yellow fever virus
DYPSGTSGS

SEQ ID NO: 161962 - protein, 9 aa, Yellow fever virus
YPSGTSGSP

SEQ ID NO: 161963 - protein, 9 aa, Yellow fever virus
PSGTSGSPI

SEQ ID NO: 161964 - protein, 9 aa, Yellow fever virus
SGTSGSPIV

SEQ ID NO: 161965 - protein, 9 aa, Yellow fever virus
GTSGSPIVN

SEQ ID NO: 161966 - protein, 9 aa, Yellow fever virus
TSGSPIVNR

SEQ ID NO: 161967 - protein, 9 aa, Yellow fever virus
SGSPIVNRN

SEQ ID NO: 161968 - protein, 9 aa, Yellow fever virus
GSPIVNRNG

SEQ ID NO: 161969 - protein, 9 aa, Yellow fever virus
SPIVNRNGE

SEQ ID NO: 161970 - protein, 9 aa, Yellow fever virus
PIVNRNGEV

SEQ ID NO: 161971 - protein, 9 aa, Yellow fever virus
IVNRNGEVI

SEQ ID NO: 161972 - protein, 9 aa, Yellow fever virus
VNRNGEVIG

SEQ ID NO: 161973 - protein, 9 aa, Yellow fever virus
NRNGEVIGL

SEQ ID NO: 161974 - protein, 9 aa, Yellow fever virus
RNGEVIGLY

SEQ ID NO: 161975 - protein, 9 aa, Yellow fever virus
NGEVIGLYG

SEQ ID NO: 161976 - protein, 9 aa, Yellow fever virus
GEVIGLYGN

SEQ ID NO: 161977 - protein, 9 aa, Yellow fever virus
EVIGLYGNG

SEQ ID NO: 161978 - protein, 9 aa, Yellow fever virus
VIGLYGNGI

SEQ ID NO: 161979 - protein, 9 aa, Yellow fever virus
IGLYGNGIL

SEQ ID NO: 161980 - protein, 9 aa, Yellow fever virus
GLYGNGILV

SEQ ID NO: 161981 - protein, 9 aa, Yellow fever virus
LYGNGILVG

SEQ ID NO: 161982 - protein, 9 aa, Yellow fever virus
YGNGILVGD

SEQ ID NO: 161983 - protein, 9 aa, Yellow fever virus
GNGILVGDN

SEQ ID NO: 161984 - protein, 9 aa, Yellow fever virus
NGILVGDNS

SEQ ID NO: 161985 - protein, 9 aa, Yellow fever virus
GILVGDNSF

SEQ ID NO: 161986 - protein, 9 aa, Yellow fever virus
ILVGDNSFV

SEQ ID NO: 161987 - protein, 9 aa, Yellow fever virus
LVGDNSFVS

SEQ ID NO: 161988 - protein, 9 aa, Yellow fever virus
VGDNSFVSA

SEQ ID NO: 161989 - protein, 9 aa, Yellow fever virus
GDNSFVSAI

SEQ ID NO: 161990 - protein, 9 aa, Yellow fever virus
DNSFVSAIS

SEQ ID NO: 161991 - protein, 9 aa, Yellow fever virus
NSFVSAISQ

SEQ ID NO: 161992 - protein, 9 aa, Yellow fever virus
SFVSAISQT

SEQ ID NO: 161993 - protein, 9 aa, Yellow fever virus
FVSAISQTE

SEQ ID NO: 161994 - protein, 9 aa, Yellow fever virus
VSAISQTEV

SEQ ID NO: 161995 - protein, 9 aa, Yellow fever virus
SAISQTEVK

SEQ ID NO: 161996 - protein, 9 aa, Yellow fever virus
AISQTEVKE

SEQ ID NO: 161997 - protein, 9 aa, Yellow fever virus
ISQTEVKEE

SEQ ID NO: 161998 - protein, 9 aa, Yellow fever virus
SQTEVKEEG

SEQ ID NO: 161999 - protein, 9 aa, Yellow fever virus
QTEVKEEGK

SEQ ID NO: 162000 - protein, 9 aa, Yellow fever virus
TEVKEEGKE

SEQ ID NO: 162001 - protein, 9 aa, Yellow fever virus
EVKEEGKEE

SEQ ID NO: 162002 - protein, 9 aa, Yellow fever virus
VKEEGKEEL

SEQ ID NO: 162003 - protein, 9 aa, Yellow fever virus
KEEGKEELQ

SEQ ID NO: 162004 - protein, 9 aa, Yellow fever virus
EEGKEELQE

SEQ ID NO: 162005 - protein, 9 aa, Yellow fever virus
EGKEELQEI

SEQ ID NO: 162006 - protein, 9 aa, Yellow fever virus
GKEELQEIP

SEQ ID NO: 162007 - protein, 9 aa, Yellow fever virus
KEELQEIPT

SEQ ID NO: 162008 - protein, 9 aa, Yellow fever virus
EELQEIPTM

SEQ ID NO: 162009 - protein, 9 aa, Yellow fever virus
ELQEIPTML

SEQ ID NO: 162010 - protein, 9 aa, Yellow fever virus
LQEIPTMLK

SEQ ID NO: 162011 - protein, 9 aa, Yellow fever virus
QEIPTMLKK

SEQ ID NO: 162012 - protein, 9 aa, Yellow fever virus
EIPTMLKKG

SEQ ID NO: 162013 - protein, 9 aa, Yellow fever virus
IPTMLKKGM

SEQ ID NO: 162014 - protein, 9 aa, Yellow fever virus
PTMLKKGMT

SEQ ID NO: 162015 - protein, 9 aa, Yellow fever virus
TMLKKGMTT

SEQ ID NO: 162016 - protein, 9 aa, Yellow fever virus
MLKKGMTTV

SEQ ID NO: 162017 - protein, 9 aa, Yellow fever virus
LKKGMTTVL

SEQ ID NO: 162018 - protein, 9 aa, Yellow fever virus
KKGMTTILD

SEQ ID NO: 162019 - protein, 9 aa, Yellow fever virus
KGMTTVLDF

SEQ ID NO: 162020 - protein, 9 aa, Yellow fever virus
GMTTVLDFH

SEQ ID NO: 162021 - protein, 9 aa, Yellow fever virus
MTTVLDFHP

SEQ ID NO: 162022 - protein, 9 aa, Yellow fever virus
TTILDFHPG

SEQ ID NO: 162023 - protein, 9 aa, Yellow fever virus
TILDFHPGA

SEQ ID NO: 162024 - protein, 9 aa, Yellow fever virus
ILDFHPGAG

SEQ ID NO: 162025 - protein, 9 aa, Yellow fever virus
LDFHPGAGK

SEQ ID NO: 162026 - protein, 9 aa, Yellow fever virus
DFHPGAGKT

SEQ ID NO: 162027 - protein, 9 aa, Yellow fever virus
FHPGAGKTR

SEQ ID NO: 162028 - protein, 9 aa, Yellow fever virus
HPGAGKTRR

SEQ ID NO: 162029 - protein, 9 aa, Yellow fever virus
PGAGKTRRF

SEQ ID NO: 162030 - protein, 9 aa, Yellow fever virus
GAGKTRRFL

SEQ ID NO: 162031 - protein, 9 aa, Yellow fever virus
AGKTRRFLP

SEQ ID NO: 162032 - protein, 9 aa, Yellow fever virus
GKTRRFLPQ

SEQ ID NO: 162033 - protein, 9 aa, Yellow fever virus
KTRRFLPQI

SEQ ID NO: 162034 - protein, 9 aa, Yellow fever virus
TRRFLPQIL

SEQ ID NO: 162035 - protein, 9 aa, Yellow fever virus
RRFLPQILA

SEQ ID NO: 162036 - protein, 9 aa, Yellow fever virus
RFLPQILAE

SEQ ID NO: 162037 - protein, 9 aa, Yellow fever virus
FLPQILAEC

SEQ ID NO: 162038 - protein, 9 aa, Yellow fever virus
LPQILAECA

SEQ ID NO: 162039 - protein, 9 aa, Yellow fever virus
PQILAECAR

SEQ ID NO: 162040 - protein, 9 aa, Yellow fever virus
QILAECARR

SEQ ID NO: 162041 - protein, 9 aa, Yellow fever virus
ILAECARRR

SEQ ID NO: 162042 - protein, 9 aa, Yellow fever virus
LAECARRRL

SEQ ID NO: 162043 - protein, 9 aa, Yellow fever virus
AECARRRLR

SEQ ID NO: 162044 - protein, 9 aa, Yellow fever virus
ECARRRLRT

SEQ ID NO: 162045 - protein, 9 aa, Yellow fever virus
CARRRLRTL

SEQ ID NO: 162046 - protein, 9 aa, Yellow fever virus
ARRRLRTLV

SEQ ID NO: 162047 - protein, 9 aa, Yellow fever virus
RRRLRTLVL

SEQ ID NO: 162048 - protein, 9 aa, Yellow fever virus
RRLRTLVLA

SEQ ID NO: 162049 - protein, 9 aa, Yellow fever virus
RLRTLVLAP

SEQ ID NO: 162050 - protein, 9 aa, Yellow fever virus
LRTLVLAPT

SEQ ID NO: 162051 - protein, 9 aa, Yellow fever virus
RTLVLAPTR

SEQ ID NO: 162052 - protein, 9 aa, Yellow fever virus
TLVLAPTRV

SEQ ID NO: 162053 - protein, 9 aa, Yellow fever virus
LVLAPTRVV

SEQ ID NO: 162054 - protein, 9 aa, Yellow fever virus
VLAPTRVVL

SEQ ID NO: 162055 - protein, 9 aa, Yellow fever virus
LAPTRVVLS

SEQ ID NO: 162056 - protein, 9 aa, Yellow fever virus
APTRVVLSE

SEQ ID NO: 162057 - protein, 9 aa, Yellow fever virus
PTRVVLSEM

SEQ ID NO: 162058 - protein, 9 aa, Yellow fever virus
TRVVLSEMK

SEQ ID NO: 162059 - protein, 9 aa, Yellow fever virus
RVVLSEMKE

SEQ ID NO: 162060 - protein, 9 aa, Yellow fever virus
VVLSEMKEA

SEQ ID NO: 162061 - protein, 9 aa, Yellow fever virus
VLSEMKEAF

SEQ ID NO: 162062 - protein, 9 aa, Yellow fever virus
LSEMKEAFH

SEQ ID NO: 162063 - protein, 9 aa, Yellow fever virus
SEMKEAFHG

SEQ ID NO: 162064 - protein, 9 aa, Yellow fever virus
EMKEAFHGL

SEQ ID NO: 162065 - protein, 9 aa, Yellow fever virus
MKEAFHGLD

SEQ ID NO: 162066 - protein, 9 aa, Yellow fever virus
KEAFHGLDV

SEQ ID NO: 162067 - protein, 9 aa, Yellow fever virus
EAFHGLDVK

SEQ ID NO: 162068 - protein, 9 aa, Yellow fever virus
AFHGLDVKF

SEQ ID NO: 162069 - protein, 9 aa, Yellow fever virus
FHGLDVKFH

SEQ ID NO: 162070 - protein, 9 aa, Yellow fever virus
HGLDVKFHT

SEQ ID NO: 162071 - protein, 9 aa, Yellow fever virus
GLDVKFHTQ

SEQ ID NO: 162072 - protein, 9 aa, Yellow fever virus
LDVKFHTQA

SEQ ID NO: 162073 - protein, 9 aa, Yellow fever virus
DVKFHTQAF

SEQ ID NO: 162074 - protein, 9 aa, Yellow fever virus
VKFHTQAFS

SEQ ID NO: 162075 - protein, 9 aa, Yellow fever virus
KFHTQAFSA

SEQ ID NO: 162076 - protein, 9 aa, Yellow fever virus
FHTQAFSAH

SEQ ID NO: 162077 - protein, 9 aa, Yellow fever virus
HTQAFSAHG

SEQ ID NO: 162078 - protein, 9 aa, Yellow fever virus
TQAFSAHGS

SEQ ID NO: 162079 - protein, 9 aa, Yellow fever virus
QAFSAHGSG

SEQ ID NO: 162080 - protein, 9 aa, Yellow fever virus
AFSAHGSGR

SEQ ID NO: 162081 - protein, 9 aa, Yellow fever virus
FSAHGSGRE

SEQ ID NO: 162082 - protein, 9 aa, Yellow fever virus
SAHGSGREV

SEQ ID NO: 162083 - protein, 9 aa, Yellow fever virus
AHGSGREVI

SEQ ID NO: 162084 - protein, 9 aa, Yellow fever virus
HGSGREVID

SEQ ID NO: 162085 - protein, 9 aa, Yellow fever virus
GSGREVIDA

SEQ ID NO: 162086 - protein, 9 aa, Yellow fever virus
SGREVIDAM

SEQ ID NO: 162087 - protein, 9 aa, Yellow fever virus
GREVIDAMC

SEQ ID NO: 162088 - protein, 9 aa, Yellow fever virus
REVIDAMCH

SEQ ID NO: 162089 - protein, 9 aa, Yellow fever virus
EVIDAMCHA

SEQ ID NO: 162090 - protein, 9 aa, Yellow fever virus
VIDAMCHAT

SEQ ID NO: 162091 - protein, 9 aa, Yellow fever virus
IDAMCHATL

SEQ ID NO: 162092 - protein, 9 aa, Yellow fever virus
DAMCHATLT

SEQ ID NO: 162093 - protein, 9 aa, Yellow fever virus
AMCHATLTY

SEQ ID NO: 162094 - protein, 9 aa, Yellow fever virus
MCHATLTYR

SEQ ID NO: 162095 - protein, 9 aa, Yellow fever virus
CHATLTYRM

SEQ ID NO: 162096 - protein, 9 aa, Yellow fever virus
HATLTYRML

SEQ ID NO: 162097 - protein, 9 aa, Yellow fever virus
ATLTYRMLE

SEQ ID NO: 162098 - protein, 9 aa, Yellow fever virus
TLTYRMLEP

SEQ ID NO: 162099 - protein, 9 aa, Yellow fever virus
LTYRMLEPT

SEQ ID NO: 162100 - protein, 9 aa, Yellow fever virus
TYRMLEPTR

SEQ ID NO: 162101 - protein, 9 aa, Yellow fever virus
YRMLEPTRV

SEQ ID NO: 162102 - protein, 9 aa, Yellow fever virus
RMLEPTRVV

SEQ ID NO: 162103 - protein, 9 aa, Yellow fever virus
MLEPTRVVN

SEQ ID NO: 162104 - protein, 9 aa, Yellow fever virus
LEPTRVVNW

SEQ ID NO: 162105 - protein, 9 aa, Yellow fever virus
EPTRVVNWE

SEQ ID NO: 162106 - protein, 9 aa, Yellow fever virus
PTRVVNWEV

SEQ ID NO: 162107 - protein, 9 aa, Yellow fever virus
TRVVNWEVI

SEQ ID NO: 162108 - protein, 9 aa, Yellow fever virus
RVVNWEVII

SEQ ID NO: 162109 - protein, 9 aa, Yellow fever virus
VVNWEVIIM

SEQ ID NO: 162110 - protein, 9 aa, Yellow fever virus
VNWEVIIMD

SEQ ID NO: 162111 - protein, 9 aa, Yellow fever virus
NWEVIIMDE

SEQ ID NO: 162112 - protein, 9 aa, Yellow fever virus
WEVIIMDEA

SEQ ID NO: 162113 - protein, 9 aa, Yellow fever virus
EVIIMDEAH

SEQ ID NO: 162114 - protein, 9 aa, Yellow fever virus
VIIMDEAHF

SEQ ID NO: 162115 - protein, 9 aa, Yellow fever virus
IIMDEAHFL

SEQ ID NO: 162116 - protein, 9 aa, Yellow fever virus
IMDEAHFLD

SEQ ID NO: 162117 - protein, 9 aa, Yellow fever virus
MDEAHFLDP

SEQ ID NO: 162118 - protein, 9 aa, Yellow fever virus
DEAHFLDPA

SEQ ID NO: 162119 - protein, 9 aa, Yellow fever virus
EAHFLDPAS

SEQ ID NO: 162120 - protein, 9 aa, Yellow fever virus
AHFLDPASI

SEQ ID NO: 162121 - protein, 9 aa, Yellow fever virus
HFLDPASIA

SEQ ID NO: 162122 - protein, 9 aa, Yellow fever virus
FLDPASIAA

SEQ ID NO: 162123 - protein, 9 aa, Yellow fever virus
LDPASIAAR

SEQ ID NO: 162124 - protein, 9 aa, Yellow fever virus
DPASIAARG

SEQ ID NO: 162125 - protein, 9 aa, Yellow fever virus
PASIAARGW

SEQ ID NO: 162126 - protein, 9 aa, Yellow fever virus
ASIAARGWA

SEQ ID NO: 162127 - protein, 9 aa, Yellow fever virus
SIAARGWAA

SEQ ID NO: 162128 - protein, 9 aa, Yellow fever virus
IAARGWAAH

SEQ ID NO: 162129 - protein, 9 aa, Yellow fever virus
AARGWAAHR

SEQ ID NO: 162130 - protein, 9 aa, Yellow fever virus
ARGWAAHRA

SEQ ID NO: 162131 - protein, 9 aa, Yellow fever virus
RGWAAHRAR

SEQ ID NO: 162132 - protein, 9 aa, Yellow fever virus
GWAAHRARA

SEQ ID NO: 162133 - protein, 9 aa, Yellow fever virus
WAAHRARAN

SEQ ID NO: 162134 - protein, 9 aa, Yellow fever virus
AAHRARANE

SEQ ID NO: 162135 - protein, 9 aa, Yellow fever virus
AHRARANES

SEQ ID NO: 162136 - protein, 9 aa, Yellow fever virus
HRARANESA

SEQ ID NO: 162137 - protein, 9 aa, Yellow fever virus
RARANESAT

SEQ ID NO: 162138 - protein, 9 aa, Yellow fever virus
ARANESATI

SEQ ID NO: 162139 - protein, 9 aa, Yellow fever virus
RANESATIL

SEQ ID NO: 162140 - protein, 9 aa, Yellow fever virus
ANESATILM

SEQ ID NO: 162141 - protein, 9 aa, Yellow fever virus
NESATILMT

SEQ ID NO: 162142 - protein, 9 aa, Yellow fever virus
ESATILMTA

SEQ ID NO: 162143 - protein, 9 aa, Yellow fever virus
SATILMTAT

SEQ ID NO: 162144 - protein, 9 aa, Yellow fever virus
ATILMTATP

SEQ ID NO: 162145 - protein, 9 aa, Yellow fever virus
TILMTATPP

SEQ ID NO: 162146 - protein, 9 aa, Yellow fever virus
ILMTATPPG

SEQ ID NO: 162147 - protein, 9 aa, Yellow fever virus
LMTATPPGT

SEQ ID NO: 162148 - protein, 9 aa, Yellow fever virus
MTATPPGTS

SEQ ID NO: 162149 - protein, 9 aa, Yellow fever virus
TATPPGTSD

SEQ ID NO: 162150 - protein, 9 aa, Yellow fever virus
ATPPGTSDE

SEQ ID NO: 162151 - protein, 9 aa, Yellow fever virus
TPPGTSDEF

SEQ ID NO: 162152 - protein, 9 aa, Yellow fever virus
PPGTSDEFP

SEQ ID NO: 162153 - protein, 9 aa, Yellow fever virus
PGTSDEFPH

SEQ ID NO: 162154 - protein, 9 aa, Yellow fever virus
GTSDEFPHS

SEQ ID NO: 162155 - protein, 9 aa, Yellow fever virus
TSDEFPHSN

SEQ ID NO: 162156 - protein, 9 aa, Yellow fever virus
SDEFPHSNG

SEQ ID NO: 162157 - protein, 9 aa, Yellow fever virus
DEFPHSNGE

SEQ ID NO: 162158 - protein, 9 aa, Yellow fever virus
EFPHSNGEI

SEQ ID NO: 162159 - protein, 9 aa, Yellow fever virus
FPHSNGEIE

SEQ ID NO: 162160 - protein, 9 aa, Yellow fever virus
PHSNGEIED

SEQ ID NO: 162161 - protein, 9 aa, Yellow fever virus
HSNGEIEDV

SEQ ID NO: 162162 - protein, 9 aa, Yellow fever virus
SNGEIEDVQ

SEQ ID NO: 162163 - protein, 9 aa, Yellow fever virus
NGEIEDVQT

SEQ ID NO: 162164 - protein, 9 aa, Yellow fever virus
GEIEDVQTD

SEQ ID NO: 162165 - protein, 9 aa, Yellow fever virus
EIEDVQTDI

SEQ ID NO: 162166 - protein, 9 aa, Yellow fever virus
IEDVQTDIP

SEQ ID NO: 162167 - protein, 9 aa, Yellow fever virus
EDVQTDIPS

SEQ ID NO: 162168 - protein, 9 aa, Yellow fever virus
DVQTDIPSE

SEQ ID NO: 162169 - protein, 9 aa, Yellow fever virus
VQTDIPSEP

SEQ ID NO: 162170 - protein, 9 aa, Yellow fever virus
QTDIPSEPW

SEQ ID NO: 162171 - protein, 9 aa, Yellow fever virus
TDIPSEPWN

SEQ ID NO: 162172 - protein, 9 aa, Yellow fever virus
DIPSEPWNT

SEQ ID NO: 162173 - protein, 9 aa, Yellow fever virus
IPSEPWNTG

SEQ ID NO: 162174 - protein, 9 aa, Yellow fever virus
PSEPWNTGH

SEQ ID NO: 162175 - protein, 9 aa, Yellow fever virus
SEPWNTGHD

SEQ ID NO: 162176 - protein, 9 aa, Yellow fever virus
EPWNTGHDW

SEQ ID NO: 162177 - protein, 9 aa, Yellow fever virus
PWNTGHDWI

SEQ ID NO: 162178 - protein, 9 aa, Yellow fever virus
WNTGHDWIL

SEQ ID NO: 162179 - protein, 9 aa, Yellow fever virus
NTGHDWILA

SEQ ID NO: 162180 - protein, 9 aa, Yellow fever virus
TGHDWILAD

SEQ ID NO: 162181 - protein, 9 aa, Yellow fever virus
GHDWILADK

SEQ ID NO: 162182 - protein, 9 aa, Yellow fever virus
HDWILADKR

SEQ ID NO: 162183 - protein, 9 aa, Yellow fever virus
DWILADKRP

SEQ ID NO: 162184 - protein, 9 aa, Yellow fever virus
WILADKRPT

SEQ ID NO: 162185 - protein, 9 aa, Yellow fever virus
ILADKRPTA

SEQ ID NO: 162186 - protein, 9 aa, Yellow fever virus
LADKRPTAW

SEQ ID NO: 162187 - protein, 9 aa, Yellow fever virus
ADKRPTAWF

SEQ ID NO: 162188 - protein, 9 aa, Yellow fever virus
DKRPTAWFL

SEQ ID NO: 162189 - protein, 9 aa, Yellow fever virus
KRPTAWFLP

SEQ ID NO: 162190 - protein, 9 aa, Yellow fever virus
RPTAWFLPS

SEQ ID NO: 162191 - protein, 9 aa, Yellow fever virus
PTAWFLPSI

SEQ ID NO: 162192 - protein, 9 aa, Yellow fever virus
TAWFLPSIR

SEQ ID NO: 162193 - protein, 9 aa, Yellow fever virus
AWFLPSIRA

SEQ ID NO: 162194 - protein, 9 aa, Yellow fever virus
WFLPSIRAA

SEQ ID NO: 162195 - protein, 9 aa, Yellow fever virus
FLPSIRAAN

SEQ ID NO: 162196 - protein, 9 aa, Yellow fever virus
LPSIRAANV

SEQ ID NO: 162197 - protein, 9 aa, Yellow fever virus
PSIRAANVM

SEQ ID NO: 162198 - protein, 9 aa, Yellow fever virus
SIRAANVMA

SEQ ID NO: 162199 - protein, 9 aa, Yellow fever virus
IRAANVMAA

SEQ ID NO: 162200 - protein, 9 aa, Yellow fever virus
RAANVMAAS

SEQ ID NO: 162201 - protein, 9 aa, Yellow fever virus
AANVMAASL

SEQ ID NO: 162202 - protein, 9 aa, Yellow fever virus
ANVMAASLR

SEQ ID NO: 162203 - protein, 9 aa, Yellow fever virus
NVMAASLRK

SEQ ID NO: 162204 - protein, 9 aa, Yellow fever virus
VMAASLRKA

SEQ ID NO: 162205 - protein, 9 aa, Yellow fever virus
MAASLRKAG

SEQ ID NO: 162206 - protein, 9 aa, Yellow fever virus
AASLRKAGK

SEQ ID NO: 162207 - protein, 9 aa, Yellow fever virus
ASLRKAGKS

SEQ ID NO: 162208 - protein, 9 aa, Yellow fever virus
SLRKAGKSV

SEQ ID NO: 162209 - protein, 9 aa, Yellow fever virus
LRKAGKSVV

SEQ ID NO: 162210 - protein, 9 aa, Yellow fever virus
RKAGKSVVV

SEQ ID NO: 162211 - protein, 9 aa, Yellow fever virus
KAGKSVVVL

SEQ ID NO: 162212 - protein, 9 aa, Yellow fever virus
AGKSVVVLN

SEQ ID NO: 162213 - protein, 9 aa, Yellow fever virus
GKSVVVLNR

SEQ ID NO: 162214 - protein, 9 aa, Yellow fever virus
KSVVVLNRK

SEQ ID NO: 162215 - protein, 9 aa, Yellow fever virus
SVVVLNRKT

SEQ ID NO: 162216 - protein, 9 aa, Yellow fever virus
VVVLNRKTF

SEQ ID NO: 162217 - protein, 9 aa, Yellow fever virus
VVLNRKTFE

SEQ ID NO: 162218 - protein, 9 aa, Yellow fever virus
VLNRKTFER

SEQ ID NO: 162219 - protein, 9 aa, Yellow fever virus
LNRKTFERE

SEQ ID NO: 162220 - protein, 9 aa, Yellow fever virus
NRKTFEREY

SEQ ID NO: 162221 - protein, 9 aa, Yellow fever virus
RKTFEREYP

SEQ ID NO: 162222 - protein, 9 aa, Yellow fever virus
KTFEREYPT

SEQ ID NO: 162223 - protein, 9 aa, Yellow fever virus
TFEREYPTI

SEQ ID NO: 162224 - protein, 9 aa, Yellow fever virus
FEREYPTIK

SEQ ID NO: 162225 - protein, 9 aa, Yellow fever virus
EREYPTIKQ

SEQ ID NO: 162226 - protein, 9 aa, Yellow fever virus
REYPTIKQK

SEQ ID NO: 162227 - protein, 9 aa, Yellow fever virus
EYPTIKQKK

SEQ ID NO: 162228 - protein, 9 aa, Yellow fever virus
YPTIKQKKP

SEQ ID NO: 162229 - protein, 9 aa, Yellow fever virus
PTIKQKKPD

SEQ ID NO: 162230 - protein, 9 aa, Yellow fever virus
TIKQKKPDF

SEQ ID NO: 162231 - protein, 9 aa, Yellow fever virus
IKQKKPDFI

SEQ ID NO: 162232 - protein, 9 aa, Yellow fever virus
KQKKPDFIL

SEQ ID NO: 162233 - protein, 9 aa, Yellow fever virus
QKKPDFILA

SEQ ID NO: 162234 - protein, 9 aa, Yellow fever virus
KKPDFILAT

SEQ ID NO: 162235 - protein, 9 aa, Yellow fever virus
KPDFILATD

SEQ ID NO: 162236 - protein, 9 aa, Yellow fever virus
PDFILATDI

SEQ ID NO: 162237 - protein, 9 aa, Yellow fever virus
DFILATDIA

SEQ ID NO: 162238 - protein, 9 aa, Yellow fever virus
FILATDIAE

SEQ ID NO: 162239 - protein, 9 aa, Yellow fever virus
ILATDIAEM

SEQ ID NO: 162240 - protein, 9 aa, Yellow fever virus
LATDIAEMG

SEQ ID NO: 162241 - protein, 9 aa, Yellow fever virus
ATDIAEMGA

SEQ ID NO: 162242 - protein, 9 aa, Yellow fever virus
TDIAEMGAN

SEQ ID NO: 162243 - protein, 9 aa, Yellow fever virus
DIAEMGANL

SEQ ID NO: 162244 - protein, 9 aa, Yellow fever virus
IAEMGANLC

SEQ ID NO: 162245 - protein, 9 aa, Yellow fever virus
AEMGANLCV

SEQ ID NO: 162246 - protein, 9 aa, Yellow fever virus
EMGANLCVE

SEQ ID NO: 162247 - protein, 9 aa, Yellow fever virus
MGANLCVER

SEQ ID NO: 162248 - protein, 9 aa, Yellow fever virus
GANLCVERV

SEQ ID NO: 162249 - protein, 9 aa, Yellow fever virus
ANLCVERVL

SEQ ID NO: 162250 - protein, 9 aa, Yellow fever virus
NLCVERVLD

SEQ ID NO: 162251 - protein, 9 aa, Yellow fever virus
LCVERVLDC

SEQ ID NO: 162252 - protein, 9 aa, Yellow fever virus
CVERVLDCR

SEQ ID NO: 162253 - protein, 9 aa, Yellow fever virus
VERVLDCRT

SEQ ID NO: 162254 - protein, 9 aa, Yellow fever virus
ERVLDCRTA

SEQ ID NO: 162255 - protein, 9 aa, Yellow fever virus
RVLDCRTAF

SEQ ID NO: 162256 - protein, 9 aa, Yellow fever virus
VLDCRTAFK

SEQ ID NO: 162257 - protein, 9 aa, Yellow fever virus
LDCRTAFKP

SEQ ID NO: 162258 - protein, 9 aa, Yellow fever virus
DCRTAFKPV

SEQ ID NO: 162259 - protein, 9 aa, Yellow fever virus
CRTAFKPVL

SEQ ID NO: 162260 - protein, 9 aa, Yellow fever virus
RTAFKPVLV

SEQ ID NO: 162261 - protein, 9 aa, Yellow fever virus
TAFKPVLVD

SEQ ID NO: 162262 - protein, 9 aa, Yellow fever virus
AFKPVLVDE

SEQ ID NO: 162263 - protein, 9 aa, Yellow fever virus
FKPVLVDEG

SEQ ID NO: 162264 - protein, 9 aa, Yellow fever virus
KPVLVDEGR

SEQ ID NO: 162265 - protein, 9 aa, Yellow fever virus
PVLVDEGRK

SEQ ID NO: 162266 - protein, 9 aa, Yellow fever virus
VLVDEGRKV

SEQ ID NO: 162267 - protein, 9 aa, Yellow fever virus
LVDEGRKVA

SEQ ID NO: 162268 - protein, 9 aa, Yellow fever virus
VDEGRKVAI

SEQ ID NO: 162269 - protein, 9 aa, Yellow fever virus
DEGRKVAIK

SEQ ID NO: 162270 - protein, 9 aa, Yellow fever virus
EGRKVAIKG

SEQ ID NO: 162271 - protein, 9 aa, Yellow fever virus
GRKVAIKGP

SEQ ID NO: 162272 - protein, 9 aa, Yellow fever virus
RKVAIKGPL

SEQ ID NO: 162273 - protein, 9 aa, Yellow fever virus
KVAIKGPLR

SEQ ID NO: 162274 - protein, 9 aa, Yellow fever virus
VAIKGPLRI

SEQ ID NO: 162275 - protein, 9 aa, Yellow fever virus
AIKGPLRIS

SEQ ID NO: 162276 - protein, 9 aa, Yellow fever virus
IKGPLRISA

SEQ ID NO: 162277 - protein, 9 aa, Yellow fever virus
KGPLRISAS

SEQ ID NO: 162278 - protein, 9 aa, Yellow fever virus
GPLRISASS

SEQ ID NO: 162279 - protein, 9 aa, Yellow fever virus
PLRISASSA

SEQ ID NO: 162280 - protein, 9 aa, Yellow fever virus
LRISASSAA

SEQ ID NO: 162281 - protein, 9 aa, Yellow fever virus
RISASSAAQ

SEQ ID NO: 162282 - protein, 9 aa, Yellow fever virus
ISASSAAQR

SEQ ID NO: 162283 - protein, 9 aa, Yellow fever virus
SASSAAQRR

SEQ ID NO: 162284 - protein, 9 aa, Yellow fever virus
ASSAAQRRG

SEQ ID NO: 162285 - protein, 9 aa, Yellow fever virus
SSAAQRRGR

SEQ ID NO: 162286 - protein, 9 aa, Yellow fever virus
SAAQRRGRI

SEQ ID NO: 162287 - protein, 9 aa, Yellow fever virus
AAQRRGRIG

SEQ ID NO: 162288 - protein, 9 aa, Yellow fever virus
AQRRGRIGR

SEQ ID NO: 162289 - protein, 9 aa, Yellow fever virus
QRRGRIGRN

SEQ ID NO: 162290 - protein, 9 aa, Yellow fever virus
RRGRIGRNP

SEQ ID NO: 162291 - protein, 9 aa, Yellow fever virus
RGRIGRNPN

SEQ ID NO: 162292 - protein, 9 aa, Yellow fever virus
GRIGRNPNR

SEQ ID NO: 162293 - protein, 9 aa, Yellow fever virus
RIGRNPNRD

SEQ ID NO: 162294 - protein, 9 aa, Yellow fever virus
IGRNPNRDG

SEQ ID NO: 162295 - protein, 9 aa, Yellow fever virus
GRNPNRDGD

SEQ ID NO: 162296 - protein, 9 aa, Yellow fever virus
RNPNRDGDS

SEQ ID NO: 162297 - protein, 9 aa, Yellow fever virus
NPNRDGDSY

SEQ ID NO: 162298 - protein, 9 aa, Yellow fever virus
PNRDGDSYY

SEQ ID NO: 162299 - protein, 9 aa, Yellow fever virus
NRDGDSYYY

SEQ ID NO: 162300 - protein, 9 aa, Yellow fever virus
RDGDSYYYS

SEQ ID NO: 162301 - protein, 9 aa, Yellow fever virus
DGDSYYYSE

SEQ ID NO: 162302 - protein, 9 aa, Yellow fever virus
GDSYYYSEP

SEQ ID NO: 162303 - protein, 9 aa, Yellow fever virus
DSYYYSEPT

SEQ ID NO: 162304 - protein, 9 aa, Yellow fever virus
SYYYSEPTS

SEQ ID NO: 162305 - protein, 9 aa, Yellow fever virus
YYYSEPTSE

SEQ ID NO: 162306 - protein, 9 aa, Yellow fever virus
YYSEPTSEN

SEQ ID NO: 162307 - protein, 9 aa, Yellow fever virus
YSEPTSENN

SEQ ID NO: 162308 - protein, 9 aa, Yellow fever virus
SEPTSENNA

SEQ ID NO: 162309 - protein, 9 aa, Yellow fever virus
EPTSENNAH

SEQ ID NO: 162310 - protein, 9 aa, Yellow fever virus
PTSENNAHH

SEQ ID NO: 162311 - protein, 9 aa, Yellow fever virus
TSENNAHHV

SEQ ID NO: 162312 - protein, 9 aa, Yellow fever virus
SENNAHHVC

SEQ ID NO: 162313 - protein, 9 aa, Yellow fever virus
ENNAHHVCW

SEQ ID NO: 162314 - protein, 9 aa, Yellow fever virus
NNAHHVCWL

SEQ ID NO: 162315 - protein, 9 aa, Yellow fever virus
NAHHVCWLE

SEQ ID NO: 162316 - protein, 9 aa, Yellow fever virus
AHHVCWLEA

SEQ ID NO: 162317 - protein, 9 aa, Yellow fever virus
HHVCWLEAS

SEQ ID NO: 162318 - protein, 9 aa, Yellow fever virus
HVCWLEASM

SEQ ID NO: 162319 - protein, 9 aa, Yellow fever virus
VCWLEASML

SEQ ID NO: 162320 - protein, 9 aa, Yellow fever virus
CWLEASMLL

SEQ ID NO: 162321 - protein, 9 aa, Yellow fever virus
WLEASMLLD

SEQ ID NO: 162322 - protein, 9 aa, Yellow fever virus
LEASMLLDN

SEQ ID NO: 162323 - protein, 9 aa, Yellow fever virus
EASMLLDNM

SEQ ID NO: 162324 - protein, 9 aa, Yellow fever virus
ASMLLDNME

SEQ ID NO: 162325 - protein, 9 aa, Yellow fever virus
SMLLDNMEV

SEQ ID NO: 162326 - protein, 9 aa, Yellow fever virus
MLLDNMEVR

SEQ ID NO: 162327 - protein, 9 aa, Yellow fever virus
LLDNMEVRG

SEQ ID NO: 162328 - protein, 9 aa, Yellow fever virus
LDNMEVRGG

SEQ ID NO: 162329 - protein, 9 aa, Yellow fever virus
DNMEVRGGM

SEQ ID NO: 162330 - protein, 9 aa, Yellow fever virus
NMEVRGGMV

SEQ ID NO: 162331 - protein, 9 aa, Yellow fever virus
MEVRGGMVA

SEQ ID NO: 162332 - protein, 9 aa, Yellow fever virus
EVRGGMVAP

SEQ ID NO: 162333 - protein, 9 aa, Yellow fever virus
VRGGMVAPL

SEQ ID NO: 162334 - protein, 9 aa, Yellow fever virus
RGGMVAPLY

SEQ ID NO: 162335 - protein, 9 aa, Yellow fever virus
GGMVAPLYG

SEQ ID NO: 162336 - protein, 9 aa, Yellow fever virus
GMVAPLYGV

SEQ ID NO: 162337 - protein, 9 aa, Yellow fever virus
MVAPLYGVE

SEQ ID NO: 162338 - protein, 9 aa, Yellow fever virus
VAPLYGVEG

SEQ ID NO: 162339 - protein, 9 aa, Yellow fever virus
APLYGVEGT

SEQ ID NO: 162340 - protein, 9 aa, Yellow fever virus
PLYGVEGTK

SEQ ID NO: 162341 - protein, 9 aa, Yellow fever virus
LYGVEGTKT

SEQ ID NO: 162342 - protein, 9 aa, Yellow fever virus
YGVEGTKTP

SEQ ID NO: 162343 - protein, 9 aa, Yellow fever virus
GVEGTKTPV

SEQ ID NO: 162344 - protein, 9 aa, Yellow fever virus
VEGTKTPVS

SEQ ID NO: 162345 - protein, 9 aa, Yellow fever virus
EGTKTPVSP

SEQ ID NO: 162346 - protein, 9 aa, Yellow fever virus
GTKTPVSPG

SEQ ID NO: 162347 - protein, 9 aa, Yellow fever virus
TKTPVSPGE

SEQ ID NO: 162348 - protein, 9 aa, Yellow fever virus
KTPVSPGEM

SEQ ID NO: 162349 - protein, 9 aa, Yellow fever virus
TPVSPGEMR

SEQ ID NO: 162350 - protein, 9 aa, Yellow fever virus
PVSPGEMRL

SEQ ID NO: 162351 - protein, 9 aa, Yellow fever virus
VSPGEMRLR

SEQ ID NO: 162352 - protein, 9 aa, Yellow fever virus
SPGEMRLRD

SEQ ID NO: 162353 - protein, 9 aa, Yellow fever virus
PGEMRLRDD

SEQ ID NO: 162354 - protein, 9 aa, Yellow fever virus
GEMRLRDDQ

SEQ ID NO: 162355 - protein, 9 aa, Yellow fever virus
EMRLRDDQR

SEQ ID NO: 162356 - protein, 9 aa, Yellow fever virus
MRLRDDQRK

SEQ ID NO: 162357 - protein, 9 aa, Yellow fever virus
RLRDDQRKV

SEQ ID NO: 162358 - protein, 9 aa, Yellow fever virus
LRDDQRKVF

SEQ ID NO: 162359 - protein, 9 aa, Yellow fever virus
RDDQRKVFR

SEQ ID NO: 162360 - protein, 9 aa, Yellow fever virus
DDQRKVFRE

SEQ ID NO: 162361 - protein, 9 aa, Yellow fever virus
DQRKVFREL

SEQ ID NO: 162362 - protein, 9 aa, Yellow fever virus
QRKVFRELV

SEQ ID NO: 162363 - protein, 9 aa, Yellow fever virus
RKVFRELVR

SEQ ID NO: 162364 - protein, 9 aa, Yellow fever virus
KVFRELVRN

SEQ ID NO: 162365 - protein, 9 aa, Yellow fever virus
VFRELVRNC

SEQ ID NO: 162366 - protein, 9 aa, Yellow fever virus
FRELVRNCD

SEQ ID NO: 162367 - protein, 9 aa, Yellow fever virus
RELVRNCDL

SEQ ID NO: 162368 - protein, 9 aa, Yellow fever virus
ELVRNCDLP

SEQ ID NO: 162369 - protein, 9 aa, Yellow fever virus
LVRNCDLPV

SEQ ID NO: 162370 - protein, 9 aa, Yellow fever virus
VRNCDLPVW

SEQ ID NO: 162371 - protein, 9 aa, Yellow fever virus
RNCDLPVWL

SEQ ID NO: 162372 - protein, 9 aa, Yellow fever virus
NCDLPVWLS

SEQ ID NO: 162373 - protein, 9 aa, Yellow fever virus
CDLPVWLSW

SEQ ID NO: 162374 - protein, 9 aa, Yellow fever virus
DLPVWLSWQ

SEQ ID NO: 162375 - protein, 9 aa, Yellow fever virus
LPVWLSWQV

SEQ ID NO: 162376 - protein, 9 aa, Yellow fever virus
PVWLSWQVA

SEQ ID NO: 162377 - protein, 9 aa, Yellow fever virus
VWLSWQVAK

SEQ ID NO: 162378 - protein, 9 aa, Yellow fever virus
WLSWQVAKA

SEQ ID NO: 162379 - protein, 9 aa, Yellow fever virus
LSWQVAKAG

SEQ ID NO: 162380 - protein, 9 aa, Yellow fever virus
SWQVAKAGL

SEQ ID NO: 162381 - protein, 9 aa, Yellow fever virus
WQVAKAGLK

SEQ ID NO: 162382 - protein, 9 aa, Yellow fever virus
QVAKAGLKT

SEQ ID NO: 162383 - protein, 9 aa, Yellow fever virus
VAKAGLKTN

SEQ ID NO: 162384 - protein, 9 aa, Yellow fever virus
AKAGLKTND

SEQ ID NO: 162385 - protein, 9 aa, Yellow fever virus
KAGLKTNDR

SEQ ID NO: 162386 - protein, 9 aa, Yellow fever virus
AGLKTNDRK

SEQ ID NO: 162387 - protein, 9 aa, Yellow fever virus
GLKTNDRKW

SEQ ID NO: 162388 - protein, 9 aa, Yellow fever virus
LKTNDRKWC

SEQ ID NO: 162389 - protein, 9 aa, Yellow fever virus
KTNDRKWCF

SEQ ID NO: 162390 - protein, 9 aa, Yellow fever virus
TNDRKWCFE

SEQ ID NO: 162391 - protein, 9 aa, Yellow fever virus
NDRKWCFEG

SEQ ID NO: 162392 - protein, 9 aa, Yellow fever virus
DRKWCFEGP

SEQ ID NO: 162393 - protein, 9 aa, Yellow fever virus
RKWCFEGPE

SEQ ID NO: 162394 - protein, 9 aa, Yellow fever virus
KWCFEGPEE

SEQ ID NO: 162395 - protein, 9 aa, Yellow fever virus
WCFEGPEEH

SEQ ID NO: 162396 - protein, 9 aa, Yellow fever virus
CFEGPEEHE

SEQ ID NO: 162397 - protein, 9 aa, Yellow fever virus
FEGPEEHEI

SEQ ID NO: 162398 - protein, 9 aa, Yellow fever virus
EGPEEHEIL

SEQ ID NO: 162399 - protein, 9 aa, Yellow fever virus
GPEEHEILN

SEQ ID NO: 162400 - protein, 9 aa, Yellow fever virus
PEEHEILND

SEQ ID NO: 162401 - protein, 9 aa, Yellow fever virus
EEHEILNDS

SEQ ID NO: 162402 - protein, 9 aa, Yellow fever virus
EHEILNDSG

SEQ ID NO: 162403 - protein, 9 aa, Yellow fever virus
HEILNDSGE

SEQ ID NO: 162404 - protein, 9 aa, Yellow fever virus
EILNDSGET

SEQ ID NO: 162405 - protein, 9 aa, Yellow fever virus
ILNDSGETV

SEQ ID NO: 162406 - protein, 9 aa, Yellow fever virus
LNDSGETVK

SEQ ID NO: 162407 - protein, 9 aa, Yellow fever virus
NDSGETVKC

SEQ ID NO: 162408 - protein, 9 aa, Yellow fever virus
DSGETVKCR

SEQ ID NO: 162409 - protein, 9 aa, Yellow fever virus
SGETVKCRA

SEQ ID NO: 162410 - protein, 9 aa, Yellow fever virus
GETVKCRAP

SEQ ID NO: 162411 - protein, 9 aa, Yellow fever virus
ETVKCRAPG

SEQ ID NO: 162412 - protein, 9 aa, Yellow fever virus
TVKCRAPGG

SEQ ID NO: 162413 - protein, 9 aa, Yellow fever virus
VKCRAPGGA

SEQ ID NO: 162414 - protein, 9 aa, Yellow fever virus
KCRAPGGAK

SEQ ID NO: 162415 - protein, 9 aa, Yellow fever virus
CRAPGGAKK

SEQ ID NO: 162416 - protein, 9 aa, Yellow fever virus
RAPGGAKKP

SEQ ID NO: 162417 - protein, 9 aa, Yellow fever virus
APGGAKKPL

SEQ ID NO: 162418 - protein, 9 aa, Yellow fever virus
PGGAKKPLR

SEQ ID NO: 162419 - protein, 9 aa, Yellow fever virus
GGAKKPLRP

SEQ ID NO: 162420 - protein, 9 aa, Yellow fever virus
GAKKPLRPR

SEQ ID NO: 162421 - protein, 9 aa, Yellow fever virus
AKKPLRPRW

SEQ ID NO: 162422 - protein, 9 aa, Yellow fever virus
KKPLRPRWC

SEQ ID NO: 162423 - protein, 9 aa, Yellow fever virus
KPLRPRWCD

SEQ ID NO: 162424 - protein, 9 aa, Yellow fever virus
PLRPRWCDE

SEQ ID NO: 162425 - protein, 9 aa, Yellow fever virus
LRPRWCDER

SEQ ID NO: 162426 - protein, 9 aa, Yellow fever virus
RPRWCDERV

SEQ ID NO: 162427 - protein, 9 aa, Yellow fever virus
PRWCDERVS

SEQ ID NO: 162428 - protein, 9 aa, Yellow fever virus
RWCDERVSS

SEQ ID NO: 162429 - protein, 9 aa, Yellow fever virus
WCDERVSSD

SEQ ID NO: 162430 - protein, 9 aa, Yellow fever virus
CDERVSSDQ

SEQ ID NO: 162431 - protein, 9 aa, Yellow fever virus
DERVSSDQS

SEQ ID NO: 162432 - protein, 9 aa, Yellow fever virus
ERVSSDQSA

SEQ ID NO: 162433 - protein, 9 aa, Yellow fever virus
RVSSDQSAL

SEQ ID NO: 162434 - protein, 9 aa, Yellow fever virus
VSSDQSALS

SEQ ID NO: 162435 - protein, 9 aa, Yellow fever virus
SSDQSALSE

SEQ ID NO: 162436 - protein, 9 aa, Yellow fever virus
SDQSALSEF

SEQ ID NO: 162437 - protein, 9 aa, Yellow fever virus
DQSALSEFI

SEQ ID NO: 162438 - protein, 9 aa, Yellow fever virus
QSALSEFIK

SEQ ID NO: 162439 - protein, 9 aa, Yellow fever virus
SALSEFIKF

SEQ ID NO: 162440 - protein, 9 aa, Yellow fever virus
ALSEFIKFA

SEQ ID NO: 162441 - protein, 9 aa, Yellow fever virus
LSEFIKFAE

SEQ ID NO: 162442 - protein, 9 aa, Yellow fever virus
SEFIKFAEG

SEQ ID NO: 162443 - protein, 9 aa, Yellow fever virus
EFIKFAEGR

SEQ ID NO: 162444 - protein, 9 aa, Yellow fever virus
FIKFAEGRR

SEQ ID NO: 162445 - protein, 9 aa, Yellow fever virus
IKFAEGRRG

SEQ ID NO: 162446 - protein, 9 aa, Yellow fever virus
KFAEGRRGA

SEQ ID NO: 162447 - protein, 9 aa, Yellow fever virus
FAEGRRGAA

SEQ ID NO: 162448 - protein, 9 aa, Yellow fever virus
AEGRRGAAE

SEQ ID NO: 162449 - protein, 9 aa, Yellow fever virus
EGRRGAAEV

SEQ ID NO: 162450 - protein, 9 aa, Yellow fever virus
GRRGAAEVL

SEQ ID NO: 162451 - protein, 9 aa, Yellow fever virus
RRGAAEVLV

SEQ ID NO: 162452 - protein, 9 aa, Yellow fever virus
RGAAEVLVV

SEQ ID NO: 162453 - protein, 9 aa, Yellow fever virus
GAAEVLVVL

SEQ ID NO: 162454 - protein, 9 aa, Yellow fever virus
AAEVLVVLS

SEQ ID NO: 162455 - protein, 9 aa, Yellow fever virus
AEVLVVLSE

SEQ ID NO: 162456 - protein, 9 aa, Yellow fever virus
EVLVVLSEL

SEQ ID NO: 162457 - protein, 9 aa, Yellow fever virus
VLVVLSELP

SEQ ID NO: 162458 - protein, 9 aa, Yellow fever virus
LVVLSELPD

SEQ ID NO: 162459 - protein, 9 aa, Yellow fever virus
VVLSELPDF

SEQ ID NO: 162460 - protein, 9 aa, Yellow fever virus
VLSELPDFL

SEQ ID NO: 162461 - protein, 9 aa, Yellow fever virus
LSELPDFLA

SEQ ID NO: 162462 - protein, 9 aa, Yellow fever virus
SELPDFLAK

SEQ ID NO: 162463 - protein, 9 aa, Yellow fever virus
ELPDFLAKK

SEQ ID NO: 162464 - protein, 9 aa, Yellow fever virus
LPDFLAKKG

SEQ ID NO: 162465 - protein, 9 aa, Yellow fever virus
PDFLAKKGG

SEQ ID NO: 162466 - protein, 9 aa, Yellow fever virus
DFLAKKGGE

SEQ ID NO: 162467 - protein, 9 aa, Yellow fever virus
FLAKKGGEA

SEQ ID NO: 162468 - protein, 9 aa, Yellow fever virus
LAKKGGEAM

SEQ ID NO: 162469 - protein, 9 aa, Yellow fever virus
AKKGGEAMD

SEQ ID NO: 162470 - protein, 9 aa, Yellow fever virus
KKGGEAMDT

SEQ ID NO: 162471 - protein, 9 aa, Yellow fever virus
KGGEAMDTI

SEQ ID NO: 162472 - protein, 9 aa, Yellow fever virus
GGEAMDTIS

SEQ ID NO: 162473 - protein, 9 aa, Yellow fever virus
GEAMDTISV

SEQ ID NO: 162474 - protein, 9 aa, Yellow fever virus
EAMDTISVF

SEQ ID NO: 162475 - protein, 9 aa, Yellow fever virus
AMDTISVFL

SEQ ID NO: 162476 - protein, 9 aa, Yellow fever virus
MDTISVFLH

SEQ ID NO: 162477 - protein, 9 aa, Yellow fever virus
DTISVFLHS

SEQ ID NO: 162478 - protein, 9 aa, Yellow fever virus
TISVFLHSE

SEQ ID NO: 162479 - protein, 9 aa, Yellow fever virus
ISVFLHSEE

SEQ ID NO: 162480 - protein, 9 aa, Yellow fever virus
SVFLHSEEG

SEQ ID NO: 162481 - protein, 9 aa, Yellow fever virus
VFLHSEEGS

SEQ ID NO: 162482 - protein, 9 aa, Yellow fever virus
FLHSEEGSR

SEQ ID NO: 162483 - protein, 9 aa, Yellow fever virus
LHSEEGSRA

SEQ ID NO: 162484 - protein, 9 aa, Yellow fever virus
HSEEGSRAY

SEQ ID NO: 162485 - protein, 9 aa, Yellow fever virus
SEEGSRAYR

SEQ ID NO: 162486 - protein, 9 aa, Yellow fever virus
EEGSRAYRN

SEQ ID NO: 162487 - protein, 9 aa, Yellow fever virus
EGSRAYRNA

SEQ ID NO: 162488 - protein, 9 aa, Yellow fever virus
GSRAYRNAL

SEQ ID NO: 162489 - protein, 9 aa, Yellow fever virus
SRAYRNALS

SEQ ID NO: 162490 - protein, 9 aa, Yellow fever virus
RAYRNALSM

SEQ ID NO: 162491 - protein, 9 aa, Yellow fever virus
AYRNALSMM

SEQ ID NO: 162492 - protein, 9 aa, Yellow fever virus
YRNALSMMP

SEQ ID NO: 162493 - protein, 9 aa, Yellow fever virus
RNALSMMPE

SEQ ID NO: 162494 - protein, 9 aa, Yellow fever virus
NALSMMPEA

SEQ ID NO: 162495 - protein, 9 aa, Yellow fever virus
ALSMMPEAM

SEQ ID NO: 162496 - protein, 9 aa, Yellow fever virus
LSMMPEAMT

SEQ ID NO: 162497 - protein, 9 aa, Yellow fever virus
SMMPEAMTI

SEQ ID NO: 162498 - protein, 9 aa, Yellow fever virus
MMPEAMTIV

SEQ ID NO: 162499 - protein, 9 aa, Yellow fever virus
MPEAMTIVM

SEQ ID NO: 162500 - protein, 9 aa, Yellow fever virus
PEAMTIVML

SEQ ID NO: 162501 - protein, 9 aa, Yellow fever virus
EAMTIVMLF

SEQ ID NO: 162502 - protein, 9 aa, Yellow fever virus
AMTIVMLFI

SEQ ID NO: 162503 - protein, 9 aa, Yellow fever virus
MTIVMLFIL

SEQ ID NO: 162504 - protein, 9 aa, Yellow fever virus
TIVMLFILA

SEQ ID NO: 162505 - protein, 9 aa, Yellow fever virus
IVMLFILAG

SEQ ID NO: 162506 - protein, 9 aa, Yellow fever virus
VMLFILAGL

SEQ ID NO: 162507 - protein, 9 aa, Yellow fever virus
MLFILAGLL

SEQ ID NO: 162508 - protein, 9 aa, Yellow fever virus
LFILAGLLT

SEQ ID NO: 162509 - protein, 9 aa, Yellow fever virus
FILAGLLTS

SEQ ID NO: 162510 - protein, 9 aa, Yellow fever virus
ILAGLLTSG

SEQ ID NO: 162511 - protein, 9 aa, Yellow fever virus
LAGLLTSGM

SEQ ID NO: 162512 - protein, 9 aa, Yellow fever virus
AGLLTSGMV

SEQ ID NO: 162513 - protein, 9 aa, Yellow fever virus
GLLTSGMVI

SEQ ID NO: 162514 - protein, 9 aa, Yellow fever virus
LLTSGMVIF

SEQ ID NO: 162515 - protein, 9 aa, Yellow fever virus
LTSGMVIFF

SEQ ID NO: 162516 - protein, 9 aa, Yellow fever virus
TSGMVIFFM

SEQ ID NO: 162517 - protein, 9 aa, Yellow fever virus
SGMVIFFMS

SEQ ID NO: 162518 - protein, 9 aa, Yellow fever virus
GMVIFFMSP

SEQ ID NO: 162519 - protein, 9 aa, Yellow fever virus
MVIFFMSPK

SEQ ID NO: 162520 - protein, 9 aa, Yellow fever virus
VIFFMSPKG

SEQ ID NO: 162521 - protein, 9 aa, Yellow fever virus
IFFMSPKGI

SEQ ID NO: 162522 - protein, 9 aa, Yellow fever virus
FFMSPKGIS

SEQ ID NO: 162523 - protein, 9 aa, Yellow fever virus
FMSPKGISR

SEQ ID NO: 162524 - protein, 9 aa, Yellow fever virus
MSPKGISRM

SEQ ID NO: 162525 - protein, 9 aa, Yellow fever virus
SPKGISRMS

SEQ ID NO: 162526 - protein, 9 aa, Yellow fever virus
PKGISRMSM

SEQ ID NO: 162527 - protein, 9 aa, Yellow fever virus
KGISRMSMA

SEQ ID NO: 162528 - protein, 9 aa, Yellow fever virus
GISRMSMAM

SEQ ID NO: 162529 - protein, 9 aa, Yellow fever virus
ISRMSMAMG

SEQ ID NO: 162530 - protein, 9 aa, Yellow fever virus
SRMSMAMGT

SEQ ID NO: 162531 - protein, 9 aa, Yellow fever virus
RMSMAMGTM

SEQ ID NO: 162532 - protein, 9 aa, Yellow fever virus
MSMAMGTMA

SEQ ID NO: 162533 - protein, 9 aa, Yellow fever virus
SMAMGTMAG

SEQ ID NO: 162534 - protein, 9 aa, Yellow fever virus
MAMGTMAGC

SEQ ID NO: 162535 - protein, 9 aa, Yellow fever virus
AMGTMAGCG

SEQ ID NO: 162536 - protein, 9 aa, Yellow fever virus
MGTMAGCGY

SEQ ID NO: 162537 - protein, 9 aa, Yellow fever virus
GTMAGCGYL

SEQ ID NO: 162538 - protein, 9 aa, Yellow fever virus
TMAGCGYLM

SEQ ID NO: 162539 - protein, 9 aa, Yellow fever virus
MAGCGYLMF

SEQ ID NO: 162540 - protein, 9 aa, Yellow fever virus
AGCGYLMFL

SEQ ID NO: 162541 - protein, 9 aa, Yellow fever virus
GCGYLMFLG

SEQ ID NO: 162542 - protein, 9 aa, Yellow fever virus
CGYLMFLGG

SEQ ID NO: 162543 - protein, 9 aa, Yellow fever virus
GYLMFLGGV

SEQ ID NO: 162544 - protein, 9 aa, Yellow fever virus
YLMFLGGVK

SEQ ID NO: 162545 - protein, 9 aa, Yellow fever virus
LMFLGGVKP

SEQ ID NO: 162546 - protein, 9 aa, Yellow fever virus
MFLGGVKPT

SEQ ID NO: 162547 - protein, 9 aa, Yellow fever virus
FLGGVKPTH

SEQ ID NO: 162548 - protein, 9 aa, Yellow fever virus
LGGVKPTHI

SEQ ID NO: 162549 - protein, 9 aa, Yellow fever virus
GGVKPTHIS

SEQ ID NO: 162550 - protein, 9 aa, Yellow fever virus
GVKPTHISY

SEQ ID NO: 162551 - protein, 9 aa, Yellow fever virus
VKPTHISYI

SEQ ID NO: 162552 - protein, 9 aa, Yellow fever virus
KPTHISYIM

SEQ ID NO: 162553 - protein, 9 aa, Yellow fever virus
PTHISYIML

SEQ ID NO: 162554 - protein, 9 aa, Yellow fever virus
THISYIMLI

SEQ ID NO: 162555 - protein, 9 aa, Yellow fever virus
HISYIMLIF

SEQ ID NO: 162556 - protein, 9 aa, Yellow fever virus
ISYIMLIFF

SEQ ID NO: 162557 - protein, 9 aa, Yellow fever virus
SYIMLIFFV

SEQ ID NO: 162558 - protein, 9 aa, Yellow fever virus
YIMLIFFVL

SEQ ID NO: 162559 - protein, 9 aa, Yellow fever virus
IMLIFFVLM

SEQ ID NO: 162560 - protein, 9 aa, Yellow fever virus
MLIFFVLMV

SEQ ID NO: 162561 - protein, 9 aa, Yellow fever virus
LIFFVLMVV

SEQ ID NO: 162562 - protein, 9 aa, Yellow fever virus
IFFVLMVVV

SEQ ID NO: 162563 - protein, 9 aa, Yellow fever virus
FFVLMVVVI

SEQ ID NO: 162564 - protein, 9 aa, Yellow fever virus
FVLMVVVIP

SEQ ID NO: 162565 - protein, 9 aa, Yellow fever virus
VLMVVVIPE

SEQ ID NO: 162566 - protein, 9 aa, Yellow fever virus
LMVVVIPEP

SEQ ID NO: 162567 - protein, 9 aa, Yellow fever virus
MVVVIPEPG

SEQ ID NO: 162568 - protein, 9 aa, Yellow fever virus
VVVIPEPGQ

SEQ ID NO: 162569 - protein, 9 aa, Yellow fever virus
VVIPEPGQQ

SEQ ID NO: 162570 - protein, 9 aa, Yellow fever virus
VIPEPGQQR

SEQ ID NO: 162571 - protein, 9 aa, Yellow fever virus
IPEPGQQRS

SEQ ID NO: 162572 - protein, 9 aa, Yellow fever virus
PEPGQQRSI

SEQ ID NO: 162573 - protein, 9 aa, Yellow fever virus
EPGQQRSIQ

SEQ ID NO: 162574 - protein, 9 aa, Yellow fever virus
PGQQRSIQD

SEQ ID NO: 162575 - protein, 9 aa, Yellow fever virus
GQQRSIQDN

SEQ ID NO: 162576 - protein, 9 aa, Yellow fever virus
QQRSIQDNQ

SEQ ID NO: 162577 - protein, 9 aa, Yellow fever virus
QRSIQDNQV

SEQ ID NO: 162578 - protein, 9 aa, Yellow fever virus
RSIQDNQVA

SEQ ID NO: 162579 - protein, 9 aa, Yellow fever virus
SIQDNQVAY

SEQ ID NO: 162580 - protein, 9 aa, Yellow fever virus
IQDNQVAYL

SEQ ID NO: 162581 - protein, 9 aa, Yellow fever virus
QDNQVAYLI

SEQ ID NO: 162582 - protein, 9 aa, Yellow fever virus
DNQVAYLII

SEQ ID NO: 162583 - protein, 9 aa, Yellow fever virus
NQVAYLIIG

SEQ ID NO: 162584 - protein, 9 aa, Yellow fever virus
QVAYLIIGI

SEQ ID NO: 162585 - protein, 9 aa, Yellow fever virus
VAYLIIGIL

SEQ ID NO: 162586 - protein, 9 aa, Yellow fever virus
AYLIIGILT

SEQ ID NO: 162587 - protein, 9 aa, Yellow fever virus
YLIIGILTL

SEQ ID NO: 162588 - protein, 9 aa, Yellow fever virus
LIIGILTLV

SEQ ID NO: 162589 - protein, 9 aa, Yellow fever virus
IIGILTLVS

SEQ ID NO: 162590 - protein, 9 aa, Yellow fever virus
IGILTLVSA

SEQ ID NO: 162591 - protein, 9 aa, Yellow fever virus
GILTLVSAV

SEQ ID NO: 162592 - protein, 9 aa, Yellow fever virus
ILTLVSAVA

SEQ ID NO: 162593 - protein, 9 aa, Yellow fever virus
LTLVSAVAA

SEQ ID NO: 162594 - protein, 9 aa, Yellow fever virus
TLVSAVAAN

SEQ ID NO: 162595 - protein, 9 aa, Yellow fever virus
LVSAVAANE

SEQ ID NO: 162596 - protein, 9 aa, Yellow fever virus
VSAVAANEL

SEQ ID NO: 162597 - protein, 9 aa, Yellow fever virus
SAVAANELG

SEQ ID NO: 162598 - protein, 9 aa, Yellow fever virus
AVAANELGM

SEQ ID NO: 162599 - protein, 9 aa, Yellow fever virus
VAANELGML

SEQ ID NO: 162600 - protein, 9 aa, Yellow fever virus
AANELGMLE

SEQ ID NO: 162601 - protein, 9 aa, Yellow fever virus
ANELGMLEK

SEQ ID NO: 162602 - protein, 9 aa, Yellow fever virus
NELGMLEKT

SEQ ID NO: 162603 - protein, 9 aa, Yellow fever virus
ELGMLEKTK

SEQ ID NO: 162604 - protein, 9 aa, Yellow fever virus
LGMLEKTKE

SEQ ID NO: 162605 - protein, 9 aa, Yellow fever virus
GMLEKTKED

SEQ ID NO: 162606 - protein, 9 aa, Yellow fever virus
MLEKTKEDL

SEQ ID NO: 162607 - protein, 9 aa, Yellow fever virus
LEKTKEDLF

SEQ ID NO: 162608 - protein, 9 aa, Yellow fever virus
EKTKEDLFG

SEQ ID NO: 162609 - protein, 9 aa, Yellow fever virus
KTKEDLFGK

SEQ ID NO: 162610 - protein, 9 aa, Yellow fever virus
TKEDLFGKK

SEQ ID NO: 162611 - protein, 9 aa, Yellow fever virus
KEDLFGKKN

SEQ ID NO: 162612 - protein, 9 aa, Yellow fever virus
IPSSASPWS

SEQ ID NO: 162613 - protein, 9 aa, Yellow fever virus
PSSASPWSW

SEQ ID NO: 162614 - protein, 9 aa, Yellow fever virus
SSASPWSWP

SEQ ID NO: 162615 - protein, 9 aa, Yellow fever virus
SASPWSWPD

SEQ ID NO: 162616 - protein, 9 aa, Yellow fever virus
ASPWSWPDL

SEQ ID NO: 162617 - protein, 9 aa, Yellow fever virus
SPWSWPDLD

SEQ ID NO: 162618 - protein, 9 aa, Yellow fever virus
PWSWPDLDL

SEQ ID NO: 162619 - protein, 9 aa, Yellow fever virus
WSWPDLDLK

SEQ ID NO: 162620 - protein, 9 aa, Yellow fever virus
SWPDLDLKP

SEQ ID NO: 162621 - protein, 9 aa, Yellow fever virus
WPDLDLKPG

SEQ ID NO: 162622 - protein, 9 aa, Yellow fever virus
PDLDLKPGA

SEQ ID NO: 162623 - protein, 9 aa, Yellow fever virus
DLDLKPGAA

SEQ ID NO: 162624 - protein, 9 aa, Yellow fever virus
LDLKPGAAW

SEQ ID NO: 162625 - protein, 9 aa, Yellow fever virus
DLKPGAAWT

SEQ ID NO: 162626 - protein, 9 aa, Yellow fever virus
LKPGAAWTV

SEQ ID NO: 162627 - protein, 9 aa, Yellow fever virus
KPGAAWTVY

SEQ ID NO: 162628 - protein, 9 aa, Yellow fever virus
PGAAWTVYV

SEQ ID NO: 162629 - protein, 9 aa, Yellow fever virus
GAAWTVYVG

SEQ ID NO: 162630 - protein, 9 aa, Yellow fever virus
AAWTVYVGI

SEQ ID NO: 162631 - protein, 9 aa, Yellow fever virus
AWTVYVGIV

SEQ ID NO: 162632 - protein, 9 aa, Yellow fever virus
WTVYVGIVT

SEQ ID NO: 162633 - protein, 9 aa, Yellow fever virus
TVYVGIVTM

SEQ ID NO: 162634 - protein, 9 aa, Yellow fever virus
VYVGIVTML

SEQ ID NO: 162635 - protein, 9 aa, Yellow fever virus
YVGIVTMLS

SEQ ID NO: 162636 - protein, 9 aa, Yellow fever virus
VGIVTMLSP

SEQ ID NO: 162637 - protein, 9 aa, Yellow fever virus
GIVTMLSPM

SEQ ID NO: 162638 - protein, 9 aa, Yellow fever virus
IVTMLSPML

SEQ ID NO: 162639 - protein, 9 aa, Yellow fever virus
VTMLSPMLH

SEQ ID NO: 162640 - protein, 9 aa, Yellow fever virus
TMLSPMLHH

SEQ ID NO: 162641 - protein, 9 aa, Yellow fever virus
MLSPMLHHW

SEQ ID NO: 162642 - protein, 9 aa, Yellow fever virus
LSPMLHHWI

SEQ ID NO: 162643 - protein, 9 aa, Yellow fever virus
SPMLHHWIK

SEQ ID NO: 162644 - protein, 9 aa, Yellow fever virus
PMLHHWIKV

SEQ ID NO: 162645 - protein, 9 aa, Yellow fever virus
MLHHWIKVE

SEQ ID NO: 162646 - protein, 9 aa, Yellow fever virus
LHHWIKVEY

SEQ ID NO: 162647 - protein, 9 aa, Yellow fever virus
HHWIKVEYG

SEQ ID NO: 162648 - protein, 9 aa, Yellow fever virus
HWIKVEYGN

SEQ ID NO: 162649 - protein, 9 aa, Yellow fever virus
WIKVEYGNL

SEQ ID NO: 162650 - protein, 9 aa, Yellow fever virus
IKVEYGNLS

SEQ ID NO: 162651 - protein, 9 aa, Yellow fever virus
KVEYGNLSL

SEQ ID NO: 162652 - protein, 9 aa, Yellow fever virus
VEYGNLSLS

SEQ ID NO: 162653 - protein, 9 aa, Yellow fever virus
EYGNLSLSG

SEQ ID NO: 162654 - protein, 9 aa, Yellow fever virus
YGNLSLSGI

SEQ ID NO: 162655 - protein, 9 aa, Yellow fever virus
GNLSLSGIA

SEQ ID NO: 162656 - protein, 9 aa, Yellow fever virus
NLSLSGIAQ

SEQ ID NO: 162657 - protein, 9 aa, Yellow fever virus
LSLSGIAQS

SEQ ID NO: 162658 - protein, 9 aa, Yellow fever virus
SLSGIAQSA

SEQ ID NO: 162659 - protein, 9 aa, Yellow fever virus
LSGIAQSAS

SEQ ID NO: 162660 - protein, 9 aa, Yellow fever virus
SGIAQSASV

SEQ ID NO: 162661 - protein, 9 aa, Yellow fever virus
GIAQSASVL

SEQ ID NO: 162662 - protein, 9 aa, Yellow fever virus
IAQSASVLS

SEQ ID NO: 162663 - protein, 9 aa, Yellow fever virus
AQSASVLSF

SEQ ID NO: 162664 - protein, 9 aa, Yellow fever virus
QSASVLSFM

SEQ ID NO: 162665 - protein, 9 aa, Yellow fever virus
SASVLSFMD

SEQ ID NO: 162666 - protein, 9 aa, Yellow fever virus
ASVLSFMDK

SEQ ID NO: 162667 - protein, 9 aa, Yellow fever virus
SVLSFMDKG

SEQ ID NO: 162668 - protein, 9 aa, Yellow fever virus
VLSFMDKGI

SEQ ID NO: 162669 - protein, 9 aa, Yellow fever virus
LSFMDKGIP

SEQ ID NO: 162670 - protein, 9 aa, Yellow fever virus
SFMDKGIPF

SEQ ID NO: 162671 - protein, 9 aa, Yellow fever virus
FMDKGIPFM

SEQ ID NO: 162672 - protein, 9 aa, Yellow fever virus
MDKGIPFMK

SEQ ID NO: 162673 - protein, 9 aa, Yellow fever virus
DKGIPFMKM

SEQ ID NO: 162674 - protein, 9 aa, Yellow fever virus
KGIPFMKMN

SEQ ID NO: 162675 - protein, 9 aa, Yellow fever virus
GIPFMKMNI

SEQ ID NO: 162676 - protein, 9 aa, Yellow fever virus
IPFMKMNIS

SEQ ID NO: 162677 - protein, 9 aa, Yellow fever virus
PFMKMNISV

SEQ ID NO: 162678 - protein, 9 aa, Yellow fever virus
FMKMNISVI

SEQ ID NO: 162679 - protein, 9 aa, Yellow fever virus
MKMNISVIM

SEQ ID NO: 162680 - protein, 9 aa, Yellow fever virus
KMNISVIML

SEQ ID NO: 162681 - protein, 9 aa, Yellow fever virus
MNISVIMLL

SEQ ID NO: 162682 - protein, 9 aa, Yellow fever virus
NISVIMLLV

SEQ ID NO: 162683 - protein, 9 aa, Yellow fever virus
ISVIMLLVS

SEQ ID NO: 162684 - protein, 9 aa, Yellow fever virus
SVIMLLVSG

SEQ ID NO: 162685 - protein, 9 aa, Yellow fever virus
VIMLLVSGW

SEQ ID NO: 162686 - protein, 9 aa, Yellow fever virus
IMLLVSGWN

SEQ ID NO: 162687 - protein, 9 aa, Yellow fever virus
MLLVSGWNS

SEQ ID NO: 162688 - protein, 9 aa, Yellow fever virus
LLVSGWNSI

SEQ ID NO: 162689 - protein, 9 aa, Yellow fever virus
LVSGWNSIT

SEQ ID NO: 162690 - protein, 9 aa, Yellow fever virus
VSGWNSITV

SEQ ID NO: 162691 - protein, 9 aa, Yellow fever virus
SGWNSITVM

SEQ ID NO: 162692 - protein, 9 aa, Yellow fever virus
GWNSITVMP

SEQ ID NO: 162693 - protein, 9 aa, Yellow fever virus
WNSITVMPL

SEQ ID NO: 162694 - protein, 9 aa, Yellow fever virus
NSITVMPLL

SEQ ID NO: 162695 - protein, 9 aa, Yellow fever virus
SITVMPLLC

SEQ ID NO: 162696 - protein, 9 aa, Yellow fever virus
ITVMPLLCG

SEQ ID NO: 162697 - protein, 9 aa, Yellow fever virus
TVMPLLCGI

SEQ ID NO: 162698 - protein, 9 aa, Yellow fever virus
VMPLLCGIG

SEQ ID NO: 162699 - protein, 9 aa, Yellow fever virus
MPLLCGIGC

SEQ ID NO: 162700 - protein, 9 aa, Yellow fever virus
PLLCGIGCA

SEQ ID NO: 162701 - protein, 9 aa, Yellow fever virus
LLCGIGCAM

SEQ ID NO: 162702 - protein, 9 aa, Yellow fever virus
LCGIGCAML

SEQ ID NO: 162703 - protein, 9 aa, Yellow fever virus
CGIGCAMLH

SEQ ID NO: 162704 - protein, 9 aa, Yellow fever virus
GIGCAMLHW

SEQ ID NO: 162705 - protein, 9 aa, Yellow fever virus
IGCAMLHWS

SEQ ID NO: 162706 - protein, 9 aa, Yellow fever virus
GCAMLHWSL

SEQ ID NO: 162707 - protein, 9 aa, Yellow fever virus
CAMLHWSLI

SEQ ID NO: 162708 - protein, 9 aa, Yellow fever virus
AMLHWSLIL

SEQ ID NO: 162709 - protein, 9 aa, Yellow fever virus
MLHWSLILP

SEQ ID NO: 162710 - protein, 9 aa, Yellow fever virus
LHWSLILPG

SEQ ID NO: 162711 - protein, 9 aa, Yellow fever virus
HWSLILPGI

SEQ ID NO: 162712 - protein, 9 aa, Yellow fever virus
WSLILPGIK

SEQ ID NO: 162713 - protein, 9 aa, Yellow fever virus
SLILPGIKA

SEQ ID NO: 162714 - protein, 9 aa, Yellow fever virus
LILPGIKAQ

SEQ ID NO: 162715 - protein, 9 aa, Yellow fever virus
ILPGIKAQQ

SEQ ID NO: 162716 - protein, 9 aa, Yellow fever virus
LPGIKAQQS

SEQ ID NO: 162717 - protein, 9 aa, Yellow fever virus
PGIKAQQSK

SEQ ID NO: 162718 - protein, 9 aa, Yellow fever virus
GIKAQQSKL

SEQ ID NO: 162719 - protein, 9 aa, Yellow fever virus
IKAQQSKLA

SEQ ID NO: 162720 - protein, 9 aa, Yellow fever virus
KAQQSKLAQ

SEQ ID NO: 162721 - protein, 9 aa, Yellow fever virus
AQQSKLAQR

SEQ ID NO: 162722 - protein, 9 aa, Yellow fever virus
QQSKLAQRR

SEQ ID NO: 162723 - protein, 9 aa, Yellow fever virus
QSKLAQRRV

SEQ ID NO: 162724 - protein, 9 aa, Yellow fever virus
SKLAQRRVF

SEQ ID NO: 162725 - protein, 9 aa, Yellow fever virus
KLAQRRVFH

SEQ ID NO: 162726 - protein, 9 aa, Yellow fever virus
LAQRRVFHG

SEQ ID NO: 162727 - protein, 9 aa, Yellow fever virus
AQRRVFHGV

SEQ ID NO: 162728 - protein, 9 aa, Yellow fever virus
QRRVFHGVA

SEQ ID NO: 162729 - protein, 9 aa, Yellow fever virus
RRVFHGVAK

SEQ ID NO: 162730 - protein, 9 aa, Yellow fever virus
RVFHGVAKN

SEQ ID NO: 162731 - protein, 9 aa, Yellow fever virus
VFHGVAKNP

SEQ ID NO: 162732 - protein, 9 aa, Yellow fever virus
FHGVAKNPV

SEQ ID NO: 162733 - protein, 9 aa, Yellow fever virus
HGVAKNPVV

SEQ ID NO: 162734 - protein, 9 aa, Yellow fever virus
GVAKNPVVD

SEQ ID NO: 162735 - protein, 9 aa, Yellow fever virus
VAKNPVVDG

SEQ ID NO: 162736 - protein, 9 aa, Yellow fever virus
AKNPVVDGN

SEQ ID NO: 162737 - protein, 9 aa, Yellow fever virus
KNPVVDGNP

SEQ ID NO: 162738 - protein, 9 aa, Yellow fever virus
NPVVDGNPT

SEQ ID NO: 162739 - protein, 9 aa, Yellow fever virus
PVVDGNPTV

SEQ ID NO: 162740 - protein, 9 aa, Yellow fever virus
VVDGNPTVD

SEQ ID NO: 162741 - protein, 9 aa, Yellow fever virus
VDGNPTVDI

SEQ ID NO: 162742 - protein, 9 aa, Yellow fever virus
DGNPTVDIE

SEQ ID NO: 162743 - protein, 9 aa, Yellow fever virus
GNPTVDIEE

SEQ ID NO: 162744 - protein, 9 aa, Yellow fever virus
NPTVDIEEA

SEQ ID NO: 162745 - protein, 9 aa, Yellow fever virus
PTVDIEEAP

SEQ ID NO: 162746 - protein, 9 aa, Yellow fever virus
TVDIEEAPE

SEQ ID NO: 162747 - protein, 9 aa, Yellow fever virus
VDIEEAPEM

SEQ ID NO: 162748 - protein, 9 aa, Yellow fever virus
DIEEAPEMP

SEQ ID NO: 162749 - protein, 9 aa, Yellow fever virus
IEEAPEMPA

SEQ ID NO: 162750 - protein, 9 aa, Yellow fever virus
EEAPEMPAL

SEQ ID NO: 162751 - protein, 9 aa, Yellow fever virus
EAPEMPALY

SEQ ID NO: 162752 - protein, 9 aa, Yellow fever virus
APEMPALYE

SEQ ID NO: 162753 - protein, 9 aa, Yellow fever virus
PEMPALYEK

SEQ ID NO: 162754 - protein, 9 aa, Yellow fever virus
EMPALYEKK

SEQ ID NO: 162755 - protein, 9 aa, Yellow fever virus
MPALYEKKL

SEQ ID NO: 162756 - protein, 9 aa, Yellow fever virus
PALYEKKLA

SEQ ID NO: 162757 - protein, 9 aa, Yellow fever virus
ALYEKKLAL

SEQ ID NO: 162758 - protein, 9 aa, Yellow fever virus
LYEKKLALY

SEQ ID NO: 162759 - protein, 9 aa, Yellow fever virus
YEKKLALYL

SEQ ID NO: 162760 - protein, 9 aa, Yellow fever virus
EKKLALYLL

SEQ ID NO: 162761 - protein, 9 aa, Yellow fever virus
KKLALYLLL

SEQ ID NO: 162762 - protein, 9 aa, Yellow fever virus
KLALYLLLA

SEQ ID NO: 162763 - protein, 9 aa, Yellow fever virus
LALYLLLAL

SEQ ID NO: 162764 - protein, 9 aa, Yellow fever virus
ALYLLLALS

SEQ ID NO: 162765 - protein, 9 aa, Yellow fever virus
LYLLLALSL

SEQ ID NO: 162766 - protein, 9 aa, Yellow fever virus
YLLLALSLA

SEQ ID NO: 162767 - protein, 9 aa, Yellow fever virus
LLLALSLAS

SEQ ID NO: 162768 - protein, 9 aa, Yellow fever virus
LLALSLASV

SEQ ID NO: 162769 - protein, 9 aa, Yellow fever virus
LALSLASVA

SEQ ID NO: 162770 - protein, 9 aa, Yellow fever virus
ALSLASVAM

SEQ ID NO: 162771 - protein, 9 aa, Yellow fever virus
LSLASVAMC

SEQ ID NO: 162772 - protein, 9 aa, Yellow fever virus
SLASVAMCR

SEQ ID NO: 162773 - protein, 9 aa, Yellow fever virus
LASVAMCRT

SEQ ID NO: 162774 - protein, 9 aa, Yellow fever virus
ASVAMCRTP

SEQ ID NO: 162775 - protein, 9 aa, Yellow fever virus
SVAMCRTPF

SEQ ID NO: 162776 - protein, 9 aa, Yellow fever virus
VAMCRTPFS

SEQ ID NO: 162777 - protein, 9 aa, Yellow fever virus
AMCRTPFSL

SEQ ID NO: 162778 - protein, 9 aa, Yellow fever virus
MCRTPFSLA

SEQ ID NO: 162779 - protein, 9 aa, Yellow fever virus
CRTPFSLAE

SEQ ID NO: 162780 - protein, 9 aa, Yellow fever virus
RTPFSLAEG

SEQ ID NO: 162781 - protein, 9 aa, Yellow fever virus
TPFSLAEGI

SEQ ID NO: 162782 - protein, 9 aa, Yellow fever virus
PFSLAEGIV

SEQ ID NO: 162783 - protein, 9 aa, Yellow fever virus
FSLAEGIVL

SEQ ID NO: 162784 - protein, 9 aa, Yellow fever virus
SLAEGIVLA

SEQ ID NO: 162785 - protein, 9 aa, Yellow fever virus
LAEGIVLAS

SEQ ID NO: 162786 - protein, 9 aa, Yellow fever virus
AEGIVLASA

SEQ ID NO: 162787 - protein, 9 aa, Yellow fever virus
EGIVLASAA

SEQ ID NO: 162788 - protein, 9 aa, Yellow fever virus
GIVLASAAL

SEQ ID NO: 162789 - protein, 9 aa, Yellow fever virus
IVLASAALG

SEQ ID NO: 162790 - protein, 9 aa, Yellow fever virus
VLASAALGP

SEQ ID NO: 162791 - protein, 9 aa, Yellow fever virus
LASAALGPL

SEQ ID NO: 162792 - protein, 9 aa, Yellow fever virus
ASAALGPLI

SEQ ID NO: 162793 - protein, 9 aa, Yellow fever virus
SAALGPLIE

SEQ ID NO: 162794 - protein, 9 aa, Yellow fever virus
AALGPLIEG

SEQ ID NO: 162795 - protein, 9 aa, Yellow fever virus
ALGPLIEGN

SEQ ID NO: 162796 - protein, 9 aa, Yellow fever virus
LGPLIEGNT

SEQ ID NO: 162797 - protein, 9 aa, Yellow fever virus
GPLIEGNTS

SEQ ID NO: 162798 - protein, 9 aa, Yellow fever virus
PLIEGNTSL

SEQ ID NO: 162799 - protein, 9 aa, Yellow fever virus
LIEGNTSLL

SEQ ID NO: 162800 - protein, 9 aa, Yellow fever virus
IEGNTSLLW

SEQ ID NO: 162801 - protein, 9 aa, Yellow fever virus
EGNTSLLWN

SEQ ID NO: 162802 - protein, 9 aa, Yellow fever virus
GNTSLLWNG

SEQ ID NO: 162803 - protein, 9 aa, Yellow fever virus
NTSLLWNGP

SEQ ID NO: 162804 - protein, 9 aa, Yellow fever virus
TSLLWNGPM

SEQ ID NO: 162805 - protein, 9 aa, Yellow fever virus
SLLWNGPMA

SEQ ID NO: 162806 - protein, 9 aa, Yellow fever virus
LLWNGPMAV

SEQ ID NO: 162807 - protein, 9 aa, Yellow fever virus
LWNGPMAVS

SEQ ID NO: 162808 - protein, 9 aa, Yellow fever virus
WNGPMAVSM

SEQ ID NO: 162809 - protein, 9 aa, Yellow fever virus
NGPMAVSMT

SEQ ID NO: 162810 - protein, 9 aa, Yellow fever virus
GPMAVSMTG

SEQ ID NO: 162811 - protein, 9 aa, Yellow fever virus
PMAVSMTGV

SEQ ID NO: 162812 - protein, 9 aa, Yellow fever virus
MAVSMTGVM

SEQ ID NO: 162813 - protein, 9 aa, Yellow fever virus
AVSMTGVMR

SEQ ID NO: 162814 - protein, 9 aa, Yellow fever virus
VSMTGVMRG

SEQ ID NO: 162815 - protein, 9 aa, Yellow fever virus
SMTGVMRGN

SEQ ID NO: 162816 - protein, 9 aa, Yellow fever virus
MTGVMRGNH

SEQ ID NO: 162817 - protein, 9 aa, Yellow fever virus
TGVMRGNHY

SEQ ID NO: 162818 - protein, 9 aa, Yellow fever virus
GVMRGNHYA

SEQ ID NO: 162819 - protein, 9 aa, Yellow fever virus
VMRGNHYAF

SEQ ID NO: 162820 - protein, 9 aa, Yellow fever virus
MRGNHYAFV

SEQ ID NO: 162821 - protein, 9 aa, Yellow fever virus
RGNHYAFVG

SEQ ID NO: 162822 - protein, 9 aa, Yellow fever virus
GNHYAFVGV

SEQ ID NO: 162823 - protein, 9 aa, Yellow fever virus
NHYAFVGVM

SEQ ID NO: 162824 - protein, 9 aa, Yellow fever virus
HYAFVGVMY

SEQ ID NO: 162825 - protein, 9 aa, Yellow fever virus
YAFVGVMYN

SEQ ID NO: 162826 - protein, 9 aa, Yellow fever virus
AFVGVMYNL

SEQ ID NO: 162827 - protein, 9 aa, Yellow fever virus
FVGVMYNLW

SEQ ID NO: 162828 - protein, 9 aa, Yellow fever virus
VGVMYNLWK

SEQ ID NO: 162829 - protein, 9 aa, Yellow fever virus
GVMYNLWKM

SEQ ID NO: 162830 - protein, 9 aa, Yellow fever virus
VMYNLWKMK

SEQ ID NO: 162831 - protein, 9 aa, Yellow fever virus
MYNLWKMKT

SEQ ID NO: 162832 - protein, 9 aa, Yellow fever virus
YNLWKMKTG

SEQ ID NO: 162833 - protein, 9 aa, Yellow fever virus
NLWKMKTGR

SEQ ID NO: 162834 - protein, 9 aa, Yellow fever virus
LWKMKTGRR

SEQ ID NO: 162835 - protein, 9 aa, Yellow fever virus
WKMKTGRRG

SEQ ID NO: 162836 - protein, 9 aa, Yellow fever virus
RRGSANGKT

SEQ ID NO: 162837 - protein, 9 aa, Yellow fever virus
RGSANGKTL

SEQ ID NO: 162838 - protein, 9 aa, Yellow fever virus
GSANGKTLG

SEQ ID NO: 162839 - protein, 9 aa, Yellow fever virus
SANGKTLGE

SEQ ID NO: 162840 - protein, 9 aa, Yellow fever virus
ANGKTLGEV

SEQ ID NO: 162841 - protein, 9 aa, Yellow fever virus
NGKTLGEVW

SEQ ID NO: 162842 - protein, 9 aa, Yellow fever virus
GKTLGEVWK

SEQ ID NO: 162843 - protein, 9 aa, Yellow fever virus
KTLGEVWKR

SEQ ID NO: 162844 - protein, 9 aa, Yellow fever virus
TLGEVWKRE

SEQ ID NO: 162845 - protein, 9 aa, Yellow fever virus
LGEVWKREL

SEQ ID NO: 162846 - protein, 9 aa, Yellow fever virus
GEVWKRELN

SEQ ID NO: 162847 - protein, 9 aa, Yellow fever virus
EVWKRELNL

SEQ ID NO: 162848 - protein, 9 aa, Yellow fever virus
VWKRELNLL

SEQ ID NO: 162849 - protein, 9 aa, Yellow fever virus
WKRELNLLD

SEQ ID NO: 162850 - protein, 9 aa, Yellow fever virus
KRELNLLDK

SEQ ID NO: 162851 - protein, 9 aa, Yellow fever virus
RELNLLDKQ

SEQ ID NO: 162852 - protein, 9 aa, Yellow fever virus
ELNLLDKQQ

SEQ ID NO: 162853 - protein, 9 aa, Yellow fever virus
LNLLDKQQF

SEQ ID NO: 162854 - protein, 9 aa, Yellow fever virus
NLLDKQQFE

SEQ ID NO: 162855 - protein, 9 aa, Yellow fever virus
LLDKRQFEL

SEQ ID NO: 162856 - protein, 9 aa, Yellow fever virus
LDKQQFELY

SEQ ID NO: 162857 - protein, 9 aa, Yellow fever virus
DKRQFELYK

SEQ ID NO: 162858 - protein, 9 aa, Yellow fever virus
KQQFELYKR

SEQ ID NO: 162859 - protein, 9 aa, Yellow fever virus
QQFELYKRT

SEQ ID NO: 162860 - protein, 9 aa, Yellow fever virus
QFELYKRTD

SEQ ID NO: 162861 - protein, 9 aa, Yellow fever virus
FELYKRTDI

SEQ ID NO: 162862 - protein, 9 aa, Yellow fever virus
ELYKRTDIV

SEQ ID NO: 162863 - protein, 9 aa, Yellow fever virus
LYKRTDIVE

SEQ ID NO: 162864 - protein, 9 aa, Yellow fever virus
YKRTDIVEV

SEQ ID NO: 162865 - protein, 9 aa, Yellow fever virus
KRTDIVEVD

SEQ ID NO: 162866 - protein, 9 aa, Yellow fever virus
RTDIVEVDR

SEQ ID NO: 162867 - protein, 9 aa, Yellow fever virus
TDIVEVDRD

SEQ ID NO: 162868 - protein, 9 aa, Yellow fever virus
DIVEVDRDT

SEQ ID NO: 162869 - protein, 9 aa, Yellow fever virus
IVEVDRDTA

SEQ ID NO: 162870 - protein, 9 aa, Yellow fever virus
VEVDRDTAR

SEQ ID NO: 162871 - protein, 9 aa, Yellow fever virus
EVDRDTARR

SEQ ID NO: 162872 - protein, 9 aa, Yellow fever virus
VDRDTARRH

SEQ ID NO: 162873 - protein, 9 aa, Yellow fever virus
DRDTARRHL

SEQ ID NO: 162874 - protein, 9 aa, Yellow fever virus
RDTARRHLA

SEQ ID NO: 162875 - protein, 9 aa, Yellow fever virus
DTARRHLAE

SEQ ID NO: 162876 - protein, 9 aa, Yellow fever virus
TARRHLAEG

SEQ ID NO: 162877 - protein, 9 aa, Yellow fever virus
ARRHLAEGK

SEQ ID NO: 162878 - protein, 9 aa, Yellow fever virus
RRHLAEGKV

SEQ ID NO: 162879 - protein, 9 aa, Yellow fever virus
RHLAEGKVD

SEQ ID NO: 162880 - protein, 9 aa, Yellow fever virus
HLAEGKVDT

SEQ ID NO: 162881 - protein, 9 aa, Yellow fever virus
LAEGKVDTG

SEQ ID NO: 162882 - protein, 9 aa, Yellow fever virus
AEGKVDTGV

SEQ ID NO: 162883 - protein, 9 aa, Yellow fever virus
EGKVDTGVA

SEQ ID NO: 162884 - protein, 9 aa, Yellow fever virus
GKVDTGVAV

SEQ ID NO: 162885 - protein, 9 aa, Yellow fever virus
KVDTGVAVS

SEQ ID NO: 162886 - protein, 9 aa, Yellow fever virus
VDTGVAVSR

SEQ ID NO: 162887 - protein, 9 aa, Yellow fever virus
DTGVAVSRG

SEQ ID NO: 162888 - protein, 9 aa, Yellow fever virus
TGVAVSRGT

SEQ ID NO: 162889 - protein, 9 aa, Yellow fever virus
GVAVSRGTA

SEQ ID NO: 162890 - protein, 9 aa, Yellow fever virus
VAVSRGTAK

SEQ ID NO: 162891 - protein, 9 aa, Yellow fever virus
AVSRGTAKL

SEQ ID NO: 162892 - protein, 9 aa, Yellow fever virus
VSRGTAKLR

SEQ ID NO: 162893 - protein, 9 aa, Yellow fever virus
SRGTAKLRW

SEQ ID NO: 162894 - protein, 9 aa, Yellow fever virus
RGTAKLRWF

SEQ ID NO: 162895 - protein, 9 aa, Yellow fever virus
GTAKLRWFH

SEQ ID NO: 162896 - protein, 9 aa, Yellow fever virus
TAKLRWFHE

SEQ ID NO: 162897 - protein, 9 aa, Yellow fever virus
AKLRWFHER

SEQ ID NO: 162898 - protein, 9 aa, Yellow fever virus
KLRWFHERG

SEQ ID NO: 162899 - protein, 9 aa, Yellow fever virus
LRWFHERGY

SEQ ID NO: 162900 - protein, 9 aa, Yellow fever virus
RWFHERGYV

SEQ ID NO: 162901 - protein, 9 aa, Yellow fever virus
WFHERGYVK

SEQ ID NO: 162902 - protein, 9 aa, Yellow fever virus
FHERGYVKL

SEQ ID NO: 162903 - protein, 9 aa, Yellow fever virus
HERGYVKLE

SEQ ID NO: 162904 - protein, 9 aa, Yellow fever virus
ERGYVKLEG

SEQ ID NO: 162905 - protein, 9 aa, Yellow fever virus
RGYVKLEGR

SEQ ID NO: 162906 - protein, 9 aa, Yellow fever virus
GYVKLEGRV

SEQ ID NO: 162907 - protein, 9 aa, Yellow fever virus
YVKLEGRVI

SEQ ID NO: 162908 - protein, 9 aa, Yellow fever virus
VKLEGRVID

SEQ ID NO: 162909 - protein, 9 aa, Yellow fever virus
KLEGRVIDL

SEQ ID NO: 162910 - protein, 9 aa, Yellow fever virus
LEGRVIDLG

SEQ ID NO: 162911 - protein, 9 aa, Yellow fever virus
EGRVIDLGC

SEQ ID NO: 162912 - protein, 9 aa, Yellow fever virus
GRVIDLGCG

SEQ ID NO: 162913 - protein, 9 aa, Yellow fever virus
RVIDLGCGR

SEQ ID NO: 162914 - protein, 9 aa, Yellow fever virus
VIDLGCGRG

SEQ ID NO: 162915 - protein, 9 aa, Yellow fever virus
IDLGCGRGG

SEQ ID NO: 162916 - protein, 9 aa, Yellow fever virus
DLGCGRGGW

SEQ ID NO: 162917 - protein, 9 aa, Yellow fever virus
LGCGRGGWC

SEQ ID NO: 162918 - protein, 9 aa, Yellow fever virus
GCGRGGWCY

SEQ ID NO: 162919 - protein, 9 aa, Yellow fever virus
CGRGGWCYY

SEQ ID NO: 162920 - protein, 9 aa, Yellow fever virus
GRGGWCYYA

SEQ ID NO: 162921 - protein, 9 aa, Yellow fever virus
RGGWCYYAA

SEQ ID NO: 162922 - protein, 9 aa, Yellow fever virus
GGWCYYAAA

SEQ ID NO: 162923 - protein, 9 aa, Yellow fever virus
GWCYYAAAQ

SEQ ID NO: 162924 - protein, 9 aa, Yellow fever virus
WCYYAAAQK

SEQ ID NO: 162925 - protein, 9 aa, Yellow fever virus
CYYAAAQKE

SEQ ID NO: 162926 - protein, 9 aa, Yellow fever virus
YYAAAQKEV

SEQ ID NO: 162927 - protein, 9 aa, Yellow fever virus
YAAAQKEVS

SEQ ID NO: 162928 - protein, 9 aa, Yellow fever virus
AAAQKEVSG

SEQ ID NO: 162929 - protein, 9 aa, Yellow fever virus
AAQKEVSGV

SEQ ID NO: 162930 - protein, 9 aa, Yellow fever virus
AQKEVSGVK

SEQ ID NO: 162931 - protein, 9 aa, Yellow fever virus
QKEVSGVKG

SEQ ID NO: 162932 - protein, 9 aa, Yellow fever virus
KEVSGVKGF

SEQ ID NO: 162933 - protein, 9 aa, Yellow fever virus
EVSGVKGFT

SEQ ID NO: 162934 - protein, 9 aa, Yellow fever virus
VSGVKGFTL

SEQ ID NO: 162935 - protein, 9 aa, Yellow fever virus
SGVKGFTLG

SEQ ID NO: 162936 - protein, 9 aa, Yellow fever virus
GVKGFTLGR

SEQ ID NO: 162937 - protein, 9 aa, Yellow fever virus
VKGFTLGRD

SEQ ID NO: 162938 - protein, 9 aa, Yellow fever virus
KGFTLGRDG

SEQ ID NO: 162939 - protein, 9 aa, Yellow fever virus
GFTLGRDGH

SEQ ID NO: 162940 - protein, 9 aa, Yellow fever virus
FTLGRDGHE

SEQ ID NO: 162941 - protein, 9 aa, Yellow fever virus
TLGRDGHEK

SEQ ID NO: 162942 - protein, 9 aa, Yellow fever virus
LGRDGHEKP

SEQ ID NO: 162943 - protein, 9 aa, Yellow fever virus
GRDGHEKPM

SEQ ID NO: 162944 - protein, 9 aa, Yellow fever virus
RDGHEKPMN

SEQ ID NO: 162945 - protein, 9 aa, Yellow fever virus
DGHEKPMNV

SEQ ID NO: 162946 - protein, 9 aa, Yellow fever virus
GHEKPMNVQ

SEQ ID NO: 162947 - protein, 9 aa, Yellow fever virus
HEKPMNVQS

SEQ ID NO: 162948 - protein, 9 aa, Yellow fever virus
EKPMNVQSL

SEQ ID NO: 162949 - protein, 9 aa, Yellow fever virus
KPMNVQSLG

SEQ ID NO: 162950 - protein, 9 aa, Yellow fever virus
PMNVQSLGW

SEQ ID NO: 162951 - protein, 9 aa, Yellow fever virus
MNVQSLGWN

SEQ ID NO: 162952 - protein, 9 aa, Yellow fever virus
NVQSLGWNI

SEQ ID NO: 162953 - protein, 9 aa, Yellow fever virus
VQSLGWNII

SEQ ID NO: 162954 - protein, 9 aa, Yellow fever virus
QSLGWNIIT

SEQ ID NO: 162955 - protein, 9 aa, Yellow fever virus
SLGWNIITF

SEQ ID NO: 162956 - protein, 9 aa, Yellow fever virus
LGWNIITFK

SEQ ID NO: 162957 - protein, 9 aa, Yellow fever virus
GWNIITFKD

SEQ ID NO: 162958 - protein, 9 aa, Yellow fever virus
WNIITFKDK

SEQ ID NO: 162959 - protein, 9 aa, Yellow fever virus
NIITFKDKT

SEQ ID NO: 162960 - protein, 9 aa, Yellow fever virus
IITFKDKTD

SEQ ID NO: 162961 - protein, 9 aa, Yellow fever virus
ITFKDKTDI

SEQ ID NO: 162962 - protein, 9 aa, Yellow fever virus
TFKDKTDIH

SEQ ID NO: 162963 - protein, 9 aa, Yellow fever virus
FKDKTDIHR

SEQ ID NO: 162964 - protein, 9 aa, Yellow fever virus
KDKTDIHRL

SEQ ID NO: 162965 - protein, 9 aa, Yellow fever virus
DKTDIHRLE

SEQ ID NO: 162966 - protein, 9 aa, Yellow fever virus
KTDIHRLEP

SEQ ID NO: 162967 - protein, 9 aa, Yellow fever virus
LEPVKCDTL

SEQ ID NO: 162968 - protein, 9 aa, Yellow fever virus
EPVKCDTLL

SEQ ID NO: 162969 - protein, 9 aa, Yellow fever virus
PVKCDTLLC

SEQ ID NO: 162970 - protein, 9 aa, Yellow fever virus
VKCDTLLCD

SEQ ID NO: 162971 - protein, 9 aa, Yellow fever virus
KCDTLLCDI

SEQ ID NO: 162972 - protein, 9 aa, Yellow fever virus
CDTLLCDIG

SEQ ID NO: 162973 - protein, 9 aa, Yellow fever virus
DTLLCDIGE

SEQ ID NO: 162974 - protein, 9 aa, Yellow fever virus
TLLCDIGES

SEQ ID NO: 162975 - protein, 9 aa, Yellow fever virus
LLCDIGESS

SEQ ID NO: 162976 - protein, 9 aa, Yellow fever virus
LCDIGESSS

SEQ ID NO: 162977 - protein, 9 aa, Yellow fever virus
CDIGESSSS

SEQ ID NO: 162978 - protein, 9 aa, Yellow fever virus
DIGESSSSS

SEQ ID NO: 162979 - protein, 9 aa, Yellow fever virus
IGESSSSSV

SEQ ID NO: 162980 - protein, 9 aa, Yellow fever virus
GESSSSSVT

SEQ ID NO: 162981 - protein, 9 aa, Yellow fever virus
ESSSSSVTE

SEQ ID NO: 162982 - protein, 9 aa, Yellow fever virus
SSSSSVTEG

SEQ ID NO: 162983 - protein, 9 aa, Yellow fever virus
SSSSVTEGE

SEQ ID NO: 162984 - protein, 9 aa, Yellow fever virus
SSSVTEGER

SEQ ID NO: 162985 - protein, 9 aa, Yellow fever virus
SSVTEGERT

SEQ ID NO: 162986 - protein, 9 aa, Yellow fever virus
SVTEGERTV

SEQ ID NO: 162987 - protein, 9 aa, Yellow fever virus
VTEGERTVR

SEQ ID NO: 162988 - protein, 9 aa, Yellow fever virus
TEGERTVRV

SEQ ID NO: 162989 - protein, 9 aa, Yellow fever virus
EGERTVRVL

SEQ ID NO: 162990 - protein, 9 aa, Yellow fever virus
GERTVRVLD

SEQ ID NO: 162991 - protein, 9 aa, Yellow fever virus
ERTVRVLDT

SEQ ID NO: 162992 - protein, 9 aa, Yellow fever virus
RTVRVLDTV

SEQ ID NO: 162993 - protein, 9 aa, Yellow fever virus
TVRVLDTVE

SEQ ID NO: 162994 - protein, 9 aa, Yellow fever virus
VRVLDTVEK

SEQ ID NO: 162995 - protein, 9 aa, Yellow fever virus
RVLDTVEKW

SEQ ID NO: 162996 - protein, 9 aa, Yellow fever virus
VLDTVEKWL

SEQ ID NO: 162997 - protein, 9 aa, Yellow fever virus
LDTVEKWLA

SEQ ID NO: 162998 - protein, 9 aa, Yellow fever virus
DTVEKWLAC

SEQ ID NO: 162999 - protein, 9 aa, Yellow fever virus
TVEKWLACG

SEQ ID NO: 163000 - protein, 9 aa, Yellow fever virus
VEKWLACGV

SEQ ID NO: 163001 - protein, 9 aa, Yellow fever virus
EKWLACGVD

SEQ ID NO: 163002 - protein, 9 aa, Yellow fever virus
KWLACGVDN

SEQ ID NO: 163003 - protein, 9 aa, Yellow fever virus
WLACGVDNF

SEQ ID NO: 163004 - protein, 9 aa, Yellow fever virus
LACGVDNFC

SEQ ID NO: 163005 - protein, 9 aa, Yellow fever virus
ACGVDNFCV

SEQ ID NO: 163006 - protein, 9 aa, Yellow fever virus
CGVDNFCVK

SEQ ID NO: 163007 - protein, 9 aa, Yellow fever virus
GVDNFCVKV

SEQ ID NO: 163008 - protein, 9 aa, Yellow fever virus
VDNFCVKVL

SEQ ID NO: 163009 - protein, 9 aa, Yellow fever virus
DNFCVKVLA

SEQ ID NO: 163010 - protein, 9 aa, Yellow fever virus
NFCVKVLAP

SEQ ID NO: 163011 - protein, 9 aa, Yellow fever virus
FCVKVLAPY

SEQ ID NO: 163012 - protein, 9 aa, Yellow fever virus
CVKVLAPYM

SEQ ID NO: 163013 - protein, 9 aa, Yellow fever virus
VKVLAPYMP

SEQ ID NO: 163014 - protein, 9 aa, Yellow fever virus
KVLAPYMPD

SEQ ID NO: 163015 - protein, 9 aa, Yellow fever virus
VLAPYMPDV

SEQ ID NO: 163016 - protein, 9 aa, Yellow fever virus
LAPYMPDVL

SEQ ID NO: 163017 - protein, 9 aa, Yellow fever virus
APYMPDVLE

SEQ ID NO: 163018 - protein, 9 aa, Yellow fever virus
PYMPDVLEK

SEQ ID NO: 163019 - protein, 9 aa, Yellow fever virus
YMPDVLEKL

SEQ ID NO: 163020 - protein, 9 aa, Yellow fever virus
MPDVLEKLE

SEQ ID NO: 163021 - protein, 9 aa, Yellow fever virus
PDVLEKLEL

SEQ ID NO: 163022 - protein, 9 aa, Yellow fever virus
DVLEKLELL

SEQ ID NO: 163023 - protein, 9 aa, Yellow fever virus
VLEKLELLQ

SEQ ID NO: 163024 - protein, 9 aa, Yellow fever virus
LEKLELLQR

SEQ ID NO: 163025 - protein, 9 aa, Yellow fever virus
EKLELLQRR

SEQ ID NO: 163026 - protein, 9 aa, Yellow fever virus
KLELLQRRF

SEQ ID NO: 163027 - protein, 9 aa, Yellow fever virus
LELLQRRFG

SEQ ID NO: 163028 - protein, 9 aa, Yellow fever virus
ELLQRRFGG

SEQ ID NO: 163029 - protein, 9 aa, Yellow fever virus
LLQRRFGGT

SEQ ID NO: 163030 - protein, 9 aa, Yellow fever virus
LQRRFGGTV

SEQ ID NO: 163031 - protein, 9 aa, Yellow fever virus
QRRFGGTVI

SEQ ID NO: 163032 - protein, 9 aa, Yellow fever virus
RRFGGTVIR

SEQ ID NO: 163033 - protein, 9 aa, Yellow fever virus
RFGGTVIRN

SEQ ID NO: 163034 - protein, 9 aa, Yellow fever virus
FGGTVIRNP

SEQ ID NO: 163035 - protein, 9 aa, Yellow fever virus
GGTVIRNPL

SEQ ID NO: 163036 - protein, 9 aa, Yellow fever virus
GTVIRNPLS

SEQ ID NO: 163037 - protein, 9 aa, Yellow fever virus
TVIRNPLSR

SEQ ID NO: 163038 - protein, 9 aa, Yellow fever virus
VIRNPLSRN

SEQ ID NO: 163039 - protein, 9 aa, Yellow fever virus
IRNPLSRNS

SEQ ID NO: 163040 - protein, 9 aa, Yellow fever virus
RNPLSRNST

SEQ ID NO: 163041 - protein, 9 aa, Yellow fever virus
NPLSRNSTH

SEQ ID NO: 163042 - protein, 9 aa, Yellow fever virus
PLSRNSTHE

SEQ ID NO: 163043 - protein, 9 aa, Yellow fever virus
LSRNSTHEM

SEQ ID NO: 163044 - protein, 9 aa, Yellow fever virus
SRNSTHEMY

SEQ ID NO: 163045 - protein, 9 aa, Yellow fever virus
RNSTHEMYY

SEQ ID NO: 163046 - protein, 9 aa, Yellow fever virus
NSTHEMYYV

SEQ ID NO: 163047 - protein, 9 aa, Yellow fever virus
STHEMYYVS

SEQ ID NO: 163048 - protein, 9 aa, Yellow fever virus
THEMYYVSG

SEQ ID NO: 163049 - protein, 9 aa, Yellow fever virus
HEMYYVSGA

SEQ ID NO: 163050 - protein, 9 aa, Yellow fever virus
EMYYVSGAR

SEQ ID NO: 163051 - protein, 9 aa, Yellow fever virus
MYYVSGARS

SEQ ID NO: 163052 - protein, 9 aa, Yellow fever virus
YYVSGARSN

SEQ ID NO: 163053 - protein, 9 aa, Yellow fever virus
YVSGARSNV

SEQ ID NO: 163054 - protein, 9 aa, Yellow fever virus
VSGARSNVT

SEQ ID NO: 163055 - protein, 9 aa, Yellow fever virus
SGARSNVTF

SEQ ID NO: 163056 - protein, 9 aa, Yellow fever virus
GARSNVTFT

SEQ ID NO: 163057 - protein, 9 aa, Yellow fever virus
ARSNVTFTV

SEQ ID NO: 163058 - protein, 9 aa, Yellow fever virus
RSNVTFTVN

SEQ ID NO: 163059 - protein, 9 aa, Yellow fever virus
SNVTFTVNQ

SEQ ID NO: 163060 - protein, 9 aa, Yellow fever virus
NVTFTVNQT

SEQ ID NO: 163061 - protein, 9 aa, Yellow fever virus
VTFTVNQTS

SEQ ID NO: 163062 - protein, 9 aa, Yellow fever virus
TFTVNQTSR

SEQ ID NO: 163063 - protein, 9 aa, Yellow fever virus
FTVNQTSRL

SEQ ID NO: 163064 - protein, 9 aa, Yellow fever virus
TVNQTSRLL

SEQ ID NO: 163065 - protein, 9 aa, Yellow fever virus
VNQTSRLLM

SEQ ID NO: 163066 - protein, 9 aa, Yellow fever virus
NQTSRLLMR

SEQ ID NO: 163067 - protein, 9 aa, Yellow fever virus
QTSRLLMRR

SEQ ID NO: 163068 - protein, 9 aa, Yellow fever virus
TSRLLMRRM

SEQ ID NO: 163069 - protein, 9 aa, Yellow fever virus
SRLLMRRMR

SEQ ID NO: 163070 - protein, 9 aa, Yellow fever virus
RLLMRRMRR

SEQ ID NO: 163071 - protein, 9 aa, Yellow fever virus
LLMRRMRRP

SEQ ID NO: 163072 - protein, 9 aa, Yellow fever virus
LMRRMRRPT

SEQ ID NO: 163073 - protein, 9 aa, Yellow fever virus
MRRMRRPTG

SEQ ID NO: 163074 - protein, 9 aa, Yellow fever virus
RRMRRPTGK

SEQ ID NO: 163075 - protein, 9 aa, Yellow fever virus
RMRRPTGKV

SEQ ID NO: 163076 - protein, 9 aa, Yellow fever virus
MRRPTGKVT

SEQ ID NO: 163077 - protein, 9 aa, Yellow fever virus
RRPTGKVTL

SEQ ID NO: 163078 - protein, 9 aa, Yellow fever virus
RPTGKVTLE

SEQ ID NO: 163079 - protein, 9 aa, Yellow fever virus
PTGKVTLEA

SEQ ID NO: 163080 - protein, 9 aa, Yellow fever virus
TGKVTLEAD

SEQ ID NO: 163081 - protein, 9 aa, Yellow fever virus
GKVTLEADV

SEQ ID NO: 163082 - protein, 9 aa, Yellow fever virus
KVTLEADVI

SEQ ID NO: 163083 - protein, 9 aa, Yellow fever virus
VTLEADVIL

SEQ ID NO: 163084 - protein, 9 aa, Yellow fever virus
TLEADVILP

SEQ ID NO: 163085 - protein, 9 aa, Yellow fever virus
LEADVILPI

SEQ ID NO: 163086 - protein, 9 aa, Yellow fever virus
EADVILPIG

SEQ ID NO: 163087 - protein, 9 aa, Yellow fever virus
ADVILPIGT

SEQ ID NO: 163088 - protein, 9 aa, Yellow fever virus
DVILPIGTR

SEQ ID NO: 163089 - protein, 9 aa, Yellow fever virus
VILPIGTRS

SEQ ID NO: 163090 - protein, 9 aa, Yellow fever virus
ILPIGTRSV

SEQ ID NO: 163091 - protein, 9 aa, Yellow fever virus
LPIGTRSVE

SEQ ID NO: 163092 - protein, 9 aa, Yellow fever virus
PIGTRSVET

SEQ ID NO: 163093 - protein, 9 aa, Yellow fever virus
IGTRSVETD

SEQ ID NO: 163094 - protein, 9 aa, Yellow fever virus
GTRSVETDK

SEQ ID NO: 163095 - protein, 9 aa, Yellow fever virus
TRSVETDKG

SEQ ID NO: 163096 - protein, 9 aa, Yellow fever virus
RSVETDKGP

SEQ ID NO: 163097 - protein, 9 aa, Yellow fever virus
SVETDKGPL

SEQ ID NO: 163098 - protein, 9 aa, Yellow fever virus
VETDKGPLD

SEQ ID NO: 163099 - protein, 9 aa, Yellow fever virus
ETDKGPLDK

SEQ ID NO: 163100 - protein, 9 aa, Yellow fever virus
EAIEERVER

SEQ ID NO: 163101 - protein, 9 aa, Yellow fever virus
AIEERVERI

SEQ ID NO: 163102 - protein, 9 aa, Yellow fever virus
IEERVERIK

SEQ ID NO: 163103 - protein, 9 aa, Yellow fever virus
EERVERIKS

SEQ ID NO: 163104 - protein, 9 aa, Yellow fever virus
ERVERIKSE

SEQ ID NO: 163105 - protein, 9 aa, Yellow fever virus
RVERIKSEY

SEQ ID NO: 163106 - protein, 9 aa, Yellow fever virus
VERIKSEYM

SEQ ID NO: 163107 - protein, 9 aa, Yellow fever virus
ERIKSEYMT

SEQ ID NO: 163108 - protein, 9 aa, Yellow fever virus
RIKSEYMTS

SEQ ID NO: 163109 - protein, 9 aa, Yellow fever virus
IKSEYMTSW

SEQ ID NO: 163110 - protein, 9 aa, Yellow fever virus
KSEYMTSWF

SEQ ID NO: 163111 - protein, 9 aa, Yellow fever virus
SEYMTSWFY

SEQ ID NO: 163112 - protein, 9 aa, Yellow fever virus
EYMTSWFYD

SEQ ID NO: 163113 - protein, 9 aa, Yellow fever virus
YMTSWFYDN

SEQ ID NO: 163114 - protein, 9 aa, Yellow fever virus
MTSWFYDND

SEQ ID NO: 163115 - protein, 9 aa, Yellow fever virus
TSWFYDNDN

SEQ ID NO: 163116 - protein, 9 aa, Yellow fever virus
SWFYDNDNP

SEQ ID NO: 163117 - protein, 9 aa, Yellow fever virus
WFYDNDNPY

SEQ ID NO: 163118 - protein, 9 aa, Yellow fever virus
FYDNDNPYR

SEQ ID NO: 163119 - protein, 9 aa, Yellow fever virus
YDNDNPYRT

SEQ ID NO: 163120 - protein, 9 aa, Yellow fever virus
DNDNPYRTW

SEQ ID NO: 163121 - protein, 9 aa, Yellow fever virus
NDNPYRTWH

SEQ ID NO: 163122 - protein, 9 aa, Yellow fever virus
DNPYRTWHY

SEQ ID NO: 163123 - protein, 9 aa, Yellow fever virus
NPYRTWHYC

SEQ ID NO: 163124 - protein, 9 aa, Yellow fever virus
PYRTWHYCG

SEQ ID NO: 163125 - protein, 9 aa, Yellow fever virus
YRTWHYCGS

SEQ ID NO: 163126 - protein, 9 aa, Yellow fever virus
RTWHYCGSY

SEQ ID NO: 163127 - protein, 9 aa, Yellow fever virus
TWHYCGSYV

SEQ ID NO: 163128 - protein, 9 aa, Yellow fever virus
WHYCGSYVT

SEQ ID NO: 163129 - protein, 9 aa, Yellow fever virus
HYCGSYVTK

SEQ ID NO: 163130 - protein, 9 aa, Yellow fever virus
YCGSYVTKT

SEQ ID NO: 163131 - protein, 9 aa, Yellow fever virus
CGSYVTKTS

SEQ ID NO: 163132 - protein, 9 aa, Yellow fever virus
GSYVTKTSG

SEQ ID NO: 163133 - protein, 9 aa, Yellow fever virus
SYVTKTSGS

SEQ ID NO: 163134 - protein, 9 aa, Yellow fever virus
YVTKTSGSA

SEQ ID NO: 163135 - protein, 9 aa, Yellow fever virus
VTKTSGSAA

SEQ ID NO: 163136 - protein, 9 aa, Yellow fever virus
TKTSGSAAS

SEQ ID NO: 163137 - protein, 9 aa, Yellow fever virus
KTSGSAASM

SEQ ID NO: 163138 - protein, 9 aa, Yellow fever virus
TSGSAASMV

SEQ ID NO: 163139 - protein, 9 aa, Yellow fever virus
SGSAASMVN

SEQ ID NO: 163140 - protein, 9 aa, Yellow fever virus
GSAASMVNG

SEQ ID NO: 163141 - protein, 9 aa, Yellow fever virus
SAASMVNGV

SEQ ID NO: 163142 - protein, 9 aa, Yellow fever virus
AASMVNGVI

SEQ ID NO: 163143 - protein, 9 aa, Yellow fever virus
ASMVNGVIK

SEQ ID NO: 163144 - protein, 9 aa, Yellow fever virus
SMVNGVIKI

SEQ ID NO: 163145 - protein, 9 aa, Yellow fever virus
MVNGVIKIL

SEQ ID NO: 163146 - protein, 9 aa, Yellow fever virus
VNGVIKILT

SEQ ID NO: 163147 - protein, 9 aa, Yellow fever virus
NGVIKILTY

SEQ ID NO: 163148 - protein, 9 aa, Yellow fever virus
GVIKILTYP

SEQ ID NO: 163149 - protein, 9 aa, Yellow fever virus
VIKILTYPW

SEQ ID NO: 163150 - protein, 9 aa, Yellow fever virus
IKILTYPWD

SEQ ID NO: 163151 - protein, 9 aa, Yellow fever virus
KILTYPWDR

SEQ ID NO: 163152 - protein, 9 aa, Yellow fever virus
ILTYPWDRI

SEQ ID NO: 163153 - protein, 9 aa, Yellow fever virus
LTYPWDRIE

SEQ ID NO: 163154 - protein, 9 aa, Yellow fever virus
TYPWDRIEE

SEQ ID NO: 163155 - protein, 9 aa, Yellow fever virus
YPWDRIEEV

SEQ ID NO: 163156 - protein, 9 aa, Yellow fever virus
PWDRIEEVT

SEQ ID NO: 163157 - protein, 9 aa, Yellow fever virus
WDRIEEVTR

SEQ ID NO: 163158 - protein, 9 aa, Yellow fever virus
DRIEEVTRM

SEQ ID NO: 163159 - protein, 9 aa, Yellow fever virus
RIEEVTRMA

SEQ ID NO: 163160 - protein, 9 aa, Yellow fever virus
IEEVTRMAM

SEQ ID NO: 163161 - protein, 9 aa, Yellow fever virus
EEVTRMAMT

SEQ ID NO: 163162 - protein, 9 aa, Yellow fever virus
EVTRMAMTD

SEQ ID NO: 163163 - protein, 9 aa, Yellow fever virus
VTRMAMTDT

SEQ ID NO: 163164 - protein, 9 aa, Yellow fever virus
TRMAMTDTT

SEQ ID NO: 163165 - protein, 9 aa, Yellow fever virus
RMAMTDTTP

SEQ ID NO: 163166 - protein, 9 aa, Yellow fever virus
MAMTDTTPF

SEQ ID NO: 163167 - protein, 9 aa, Yellow fever virus
AMTDTTPFG

SEQ ID NO: 163168 - protein, 9 aa, Yellow fever virus
MTDTTPFGQ

SEQ ID NO: 163169 - protein, 9 aa, Yellow fever virus
TDTTPFGQQ

SEQ ID NO: 163170 - protein, 9 aa, Yellow fever virus
DTTPFGQQR

SEQ ID NO: 163171 - protein, 9 aa, Yellow fever virus
TTPFGQQRV

SEQ ID NO: 163172 - protein, 9 aa, Yellow fever virus
TPFGQQRVF

SEQ ID NO: 163173 - protein, 9 aa, Yellow fever virus
PFGQQRVFK

SEQ ID NO: 163174 - protein, 9 aa, Yellow fever virus
FGQQRVFKE

SEQ ID NO: 163175 - protein, 9 aa, Yellow fever virus
GQQRVFKEK

SEQ ID NO: 163176 - protein, 9 aa, Yellow fever virus
QQRVFKEKV

SEQ ID NO: 163177 - protein, 9 aa, Yellow fever virus
QRVFKEKVD

SEQ ID NO: 163178 - protein, 9 aa, Yellow fever virus
RVFKEKVDT

SEQ ID NO: 163179 - protein, 9 aa, Yellow fever virus
VFKEKVDTR

SEQ ID NO: 163180 - protein, 9 aa, Yellow fever virus
FKEKVDTRA

SEQ ID NO: 163181 - protein, 9 aa, Yellow fever virus
KEKVDTRAK

SEQ ID NO: 163182 - protein, 9 aa, Yellow fever virus
EKVDTRAKD

SEQ ID NO: 163183 - protein, 9 aa, Yellow fever virus
KVDTRAKDP

SEQ ID NO: 163184 - protein, 9 aa, Yellow fever virus
VDTRAKDPP

SEQ ID NO: 163185 - protein, 9 aa, Yellow fever virus
DTRAKDPPA

SEQ ID NO: 163186 - protein, 9 aa, Yellow fever virus
TRAKDPPAG

SEQ ID NO: 163187 - protein, 9 aa, Yellow fever virus
RAKDPPAGT

SEQ ID NO: 163188 - protein, 9 aa, Yellow fever virus
AKDPPAGTR

SEQ ID NO: 163189 - protein, 9 aa, Yellow fever virus
KDPPAGTRK

SEQ ID NO: 163190 - protein, 9 aa, Yellow fever virus
DPPAGTRKI

SEQ ID NO: 163191 - protein, 9 aa, Yellow fever virus
PPAGTRKIM

SEQ ID NO: 163192 - protein, 9 aa, Yellow fever virus
PAGTRKIMK

SEQ ID NO: 163193 - protein, 9 aa, Yellow fever virus
AGTRKIMKV

SEQ ID NO: 163194 - protein, 9 aa, Yellow fever virus
GTRKIMKVV

SEQ ID NO: 163195 - protein, 9 aa, Yellow fever virus
TRKIMKVVN

SEQ ID NO: 163196 - protein, 9 aa, Yellow fever virus
RKIMKVVNR

SEQ ID NO: 163197 - protein, 9 aa, Yellow fever virus
KIMKVVNRW

SEQ ID NO: 163198 - protein, 9 aa, Yellow fever virus
IMKVVNRWL

SEQ ID NO: 163199 - protein, 9 aa, Yellow fever virus
MKVVNRWLF

SEQ ID NO: 163200 - protein, 9 aa, Yellow fever virus
KVVNRWLFR

SEQ ID NO: 163201 - protein, 9 aa, Yellow fever virus
VVNRWLFRH

SEQ ID NO: 163202 - protein, 9 aa, Yellow fever virus
VNRWLFRHL

SEQ ID NO: 163203 - protein, 9 aa, Yellow fever virus
NRWLFRHLA

SEQ ID NO: 163204 - protein, 9 aa, Yellow fever virus
RWLFRHLAR

SEQ ID NO: 163205 - protein, 9 aa, Yellow fever virus
WLFRHLARE

SEQ ID NO: 163206 - protein, 9 aa, Yellow fever virus
LFRHLAREK

SEQ ID NO: 163207 - protein, 9 aa, Yellow fever virus
FRHLAREKN

SEQ ID NO: 163208 - protein, 9 aa, Yellow fever virus
RHLAREKNP

SEQ ID NO: 163209 - protein, 9 aa, Yellow fever virus
HLAREKNPR

SEQ ID NO: 163210 - protein, 9 aa, Yellow fever virus
LAREKNPRL

SEQ ID NO: 163211 - protein, 9 aa, Yellow fever virus
AREKNPRLC

SEQ ID NO: 163212 - protein, 9 aa, Yellow fever virus
REKNPRLCT

SEQ ID NO: 163213 - protein, 9 aa, Yellow fever virus
EKNPRLCTK

SEQ ID NO: 163214 - protein, 9 aa, Yellow fever virus
KNPRLCTKE

SEQ ID NO: 163215 - protein, 9 aa, Yellow fever virus
NPRLCTKEE

SEQ ID NO: 163216 - protein, 9 aa, Yellow fever virus
PRLCTKEEF

SEQ ID NO: 163217 - protein, 9 aa, Yellow fever virus
RLCTKEEFI

SEQ ID NO: 163218 - protein, 9 aa, Yellow fever virus
LCTKEEFIA

SEQ ID NO: 163219 - protein, 9 aa, Yellow fever virus
CTKEEFIAK

SEQ ID NO: 163220 - protein, 9 aa, Yellow fever virus
TKEEFIAKV

SEQ ID NO: 163221 - protein, 9 aa, Yellow fever virus
KEEFIAKVR

SEQ ID NO: 163222 - protein, 9 aa, Yellow fever virus
EEFIAKVRS

SEQ ID NO: 163223 - protein, 9 aa, Yellow fever virus
EFIAKVRSH

SEQ ID NO: 163224 - protein, 9 aa, Yellow fever virus
FIAKVRSHA

SEQ ID NO: 163225 - protein, 9 aa, Yellow fever virus
IAKVRSHAA

SEQ ID NO: 163226 - protein, 9 aa, Yellow fever virus
AKVRSHAAI

SEQ ID NO: 163227 - protein, 9 aa, Yellow fever virus
KVRSHAAIG

SEQ ID NO: 163228 - protein, 9 aa, Yellow fever virus
VRSHAAIGA

SEQ ID NO: 163229 - protein, 9 aa, Yellow fever virus
RSHAAIGAY

SEQ ID NO: 163230 - protein, 9 aa, Yellow fever virus
SHAAIGAYL

SEQ ID NO: 163231 - protein, 9 aa, Yellow fever virus
HAAIGAYLE

SEQ ID NO: 163232 - protein, 9 aa, Yellow fever virus
AAIGAYLEE

SEQ ID NO: 163233 - protein, 9 aa, Yellow fever virus
AIGAYLEEQ

SEQ ID NO: 163234 - protein, 9 aa, Yellow fever virus
IGAYLEEQE

SEQ ID NO: 163235 - protein, 9 aa, Yellow fever virus
GAYLEEQEQ

SEQ ID NO: 163236 - protein, 9 aa, Yellow fever virus
AYLEEQEQW

SEQ ID NO: 163237 - protein, 9 aa, Yellow fever virus
YLEEQEQWK

SEQ ID NO: 163238 - protein, 9 aa, Yellow fever virus
LEEQEQWKT

SEQ ID NO: 163239 - protein, 9 aa, Yellow fever virus
EEQEQWKTA

SEQ ID NO: 163240 - protein, 9 aa, Yellow fever virus
EQEQWKTAN

SEQ ID NO: 163241 - protein, 9 aa, Yellow fever virus
QEQWKTANE

SEQ ID NO: 163242 - protein, 9 aa, Yellow fever virus
EQWKTANEA

SEQ ID NO: 163243 - protein, 9 aa, Yellow fever virus
QWKTANEAV

SEQ ID NO: 163244 - protein, 9 aa, Yellow fever virus
WKTANEAVQ

SEQ ID NO: 163245 - protein, 9 aa, Yellow fever virus
KTANEAVQD

SEQ ID NO: 163246 - protein, 9 aa, Yellow fever virus
TANEAVQDP

SEQ ID NO: 163247 - protein, 9 aa, Yellow fever virus
ANEAVQDPK

SEQ ID NO: 163248 - protein, 9 aa, Yellow fever virus
NEAVQDPKF

SEQ ID NO: 163249 - protein, 9 aa, Yellow fever virus
EAVQDPKFW

SEQ ID NO: 163250 - protein, 9 aa, Yellow fever virus
AVQDPKFWE

SEQ ID NO: 163251 - protein, 9 aa, Yellow fever virus
VQDPKFWEL

SEQ ID NO: 163252 - protein, 9 aa, Yellow fever virus
QDPKFWELV

SEQ ID NO: 163253 - protein, 9 aa, Yellow fever virus
DPKFWELVD

SEQ ID NO: 163254 - protein, 9 aa, Yellow fever virus
PKFWELVDE

SEQ ID NO: 163255 - protein, 9 aa, Yellow fever virus
KFWELVDEE

SEQ ID NO: 163256 - protein, 9 aa, Yellow fever virus
FWELVDEER

SEQ ID NO: 163257 - protein, 9 aa, Yellow fever virus
WELVDEERK

SEQ ID NO: 163258 - protein, 9 aa, Yellow fever virus
ELVDEERKL

SEQ ID NO: 163259 - protein, 9 aa, Yellow fever virus
LVDEERKLH

SEQ ID NO: 163260 - protein, 9 aa, Yellow fever virus
VDEERKLHQ

SEQ ID NO: 163261 - protein, 9 aa, Yellow fever virus
DEERKLHQQ

SEQ ID NO: 163262 - protein, 9 aa, Yellow fever virus
EERKLHQQG

SEQ ID NO: 163263 - protein, 9 aa, Yellow fever virus
ERKLHQQGR

SEQ ID NO: 163264 - protein, 9 aa, Yellow fever virus
RKLHQQGRC

SEQ ID NO: 163265 - protein, 9 aa, Yellow fever virus
KLHQQGRCR

SEQ ID NO: 163266 - protein, 9 aa, Yellow fever virus
LHQQGRCRT

SEQ ID NO: 163267 - protein, 9 aa, Yellow fever virus
HQQGRCRTC

SEQ ID NO: 163268 - protein, 9 aa, Yellow fever virus
QQGRCRTCV

SEQ ID NO: 163269 - protein, 9 aa, Yellow fever virus
QGRCRTCVY

SEQ ID NO: 163270 - protein, 9 aa, Yellow fever virus
GRCRTCVYN

SEQ ID NO: 163271 - protein, 9 aa, Yellow fever virus
RCRTCVYNM

SEQ ID NO: 163272 - protein, 9 aa, Yellow fever virus
CRTCVYNMM

SEQ ID NO: 163273 - protein, 9 aa, Yellow fever virus
RTCVYNMMG

SEQ ID NO: 163274 - protein, 9 aa, Yellow fever virus
TCVYNMMGK

SEQ ID NO: 163275 - protein, 9 aa, Yellow fever virus
CVYNMMGKR

SEQ ID NO: 163276 - protein, 9 aa, Yellow fever virus
VYNMMGKRE

SEQ ID NO: 163277 - protein, 9 aa, Yellow fever virus
YNMMGKREK

SEQ ID NO: 163278 - protein, 9 aa, Yellow fever virus
NMMGKREKK

SEQ ID NO: 163279 - protein, 9 aa, Yellow fever virus
MMGKREKKL

SEQ ID NO: 163280 - protein, 9 aa, Yellow fever virus
MGKREKKLS

SEQ ID NO: 163281 - protein, 9 aa, Yellow fever virus
GKREKKLSE

SEQ ID NO: 163282 - protein, 9 aa, Yellow fever virus
KREKKLSEF

SEQ ID NO: 163283 - protein, 9 aa, Yellow fever virus
REKKLSEFG

SEQ ID NO: 163284 - protein, 9 aa, Yellow fever virus
EKKLSEFGK

SEQ ID NO: 163285 - protein, 9 aa, Yellow fever virus
KKLSEFGKA

SEQ ID NO: 163286 - protein, 9 aa, Yellow fever virus
KLSEFGKAK

SEQ ID NO: 163287 - protein, 9 aa, Yellow fever virus
LSEFGKAKG

SEQ ID NO: 163288 - protein, 9 aa, Yellow fever virus
SEFGKAKGS

SEQ ID NO: 163289 - protein, 9 aa, Yellow fever virus
EFGKAKGSR

SEQ ID NO: 163290 - protein, 9 aa, Yellow fever virus
FGKAKGSRA

SEQ ID NO: 163291 - protein, 9 aa, Yellow fever virus
GKAKGSRAI

SEQ ID NO: 163292 - protein, 9 aa, Yellow fever virus
KAKGSRAIW

SEQ ID NO: 163293 - protein, 9 aa, Yellow fever virus
AKGSRAIWY

SEQ ID NO: 163294 - protein, 9 aa, Yellow fever virus
KGSRAIWYM

SEQ ID NO: 163295 - protein, 9 aa, Yellow fever virus
GSRAIWYMW

SEQ ID NO: 163296 - protein, 9 aa, Yellow fever virus
SRAIWYMWL

SEQ ID NO: 163297 - protein, 9 aa, Yellow fever virus
RAIWYMWLG

SEQ ID NO: 163298 - protein, 9 aa, Yellow fever virus
AIWYMWLGA

SEQ ID NO: 163299 - protein, 9 aa, Yellow fever virus
IWYMWLGAR

SEQ ID NO: 163300 - protein, 9 aa, Yellow fever virus
WYMWLGARY

SEQ ID NO: 163301 - protein, 9 aa, Yellow fever virus
YMWLGARYL

SEQ ID NO: 163302 - protein, 9 aa, Yellow fever virus
MWLGARYLE

SEQ ID NO: 163303 - protein, 9 aa, Yellow fever virus
WLGARYLEF

SEQ ID NO: 163304 - protein, 9 aa, Yellow fever virus
LGARYLEFE

SEQ ID NO: 163305 - protein, 9 aa, Yellow fever virus
GARYLEFEA

SEQ ID NO: 163306 - protein, 9 aa, Yellow fever virus
ARYLEFEAL

SEQ ID NO: 163307 - protein, 9 aa, Yellow fever virus
RYLEFEALG

SEQ ID NO: 163308 - protein, 9 aa, Yellow fever virus
YLEFEALGF

SEQ ID NO: 163309 - protein, 9 aa, Yellow fever virus
LEFEALGFL

SEQ ID NO: 163310 - protein, 9 aa, Yellow fever virus
EFEALGFLN

SEQ ID NO: 163311 - protein, 9 aa, Yellow fever virus
FEALGFLNE

SEQ ID NO: 163312 - protein, 9 aa, Yellow fever virus
EALGFLNED

SEQ ID NO: 163313 - protein, 9 aa, Yellow fever virus
ALGFLNEDH

SEQ ID NO: 163314 - protein, 9 aa, Yellow fever virus
LGFLNEDHW

SEQ ID NO: 163315 - protein, 9 aa, Yellow fever virus
GFLNEDHWA

SEQ ID NO: 163316 - protein, 9 aa, Yellow fever virus
FLNEDHWAS

SEQ ID NO: 163317 - protein, 9 aa, Yellow fever virus
LNEDHWASR

SEQ ID NO: 163318 - protein, 9 aa, Yellow fever virus
NEDHWASRE

SEQ ID NO: 163319 - protein, 9 aa, Yellow fever virus
EDHWASREN

SEQ ID NO: 163320 - protein, 9 aa, Yellow fever virus
DHWASRENS

SEQ ID NO: 163321 - protein, 9 aa, Yellow fever virus
HWASRENSG

SEQ ID NO: 163322 - protein, 9 aa, Yellow fever virus
WASRENSGG

SEQ ID NO: 163323 - protein, 9 aa, Yellow fever virus
ASRENSGGG

SEQ ID NO: 163324 - protein, 9 aa, Yellow fever virus
SRENSGGGV

SEQ ID NO: 163325 - protein, 9 aa, Yellow fever virus
RENSGGGVE

SEQ ID NO: 163326 - protein, 9 aa, Yellow fever virus
ENSGGGVEG

SEQ ID NO: 163327 - protein, 9 aa, Yellow fever virus
NSGGGVEGI

SEQ ID NO: 163328 - protein, 9 aa, Yellow fever virus
SGGGVEGIG

SEQ ID NO: 163329 - protein, 9 aa, Yellow fever virus
GGGVEGIGL

SEQ ID NO: 163330 - protein, 9 aa, Yellow fever virus
GGVEGIGLQ

SEQ ID NO: 163331 - protein, 9 aa, Yellow fever virus
GVEGIGLQY

SEQ ID NO: 163332 - protein, 9 aa, Yellow fever virus
VEGIGLQYL

SEQ ID NO: 163333 - protein, 9 aa, Yellow fever virus
EGIGLQYLG

SEQ ID NO: 163334 - protein, 9 aa, Yellow fever virus
GIGLQYLGY

SEQ ID NO: 163335 - protein, 9 aa, Yellow fever virus
IGLQYLGYV

SEQ ID NO: 163336 - protein, 9 aa, Yellow fever virus
GLQYLGYVI

SEQ ID NO: 163337 - protein, 9 aa, Yellow fever virus
LQYLGYVIR

SEQ ID NO: 163338 - protein, 9 aa, Yellow fever virus
QYLGYVIRD

SEQ ID NO: 163339 - protein, 9 aa, Yellow fever virus
YLGYVIRDL

SEQ ID NO: 163340 - protein, 9 aa, Yellow fever virus
LGYVIRDLA

SEQ ID NO: 163341 - protein, 9 aa, Yellow fever virus
GYVIRDLAA

SEQ ID NO: 163342 - protein, 9 aa, Yellow fever virus
YVIRDLAAM

SEQ ID NO: 163343 - protein, 9 aa, Yellow fever virus
VIRDLAAMD

SEQ ID NO: 163344 - protein, 9 aa, Yellow fever virus
IRDLAAMDG

SEQ ID NO: 163345 - protein, 9 aa, Yellow fever virus
RDLAAMDGG

SEQ ID NO: 163346 - protein, 9 aa, Yellow fever virus
DLAAMDGGG

SEQ ID NO: 163347 - protein, 9 aa, Yellow fever virus
LAAMDGGGF

SEQ ID NO: 163348 - protein, 9 aa, Yellow fever virus
AAMDGGGFY

SEQ ID NO: 163349 - protein, 9 aa, Yellow fever virus
AMDGGGFYA

SEQ ID NO: 163350 - protein, 9 aa, Yellow fever virus
MDGGGFYAD

SEQ ID NO: 163351 - protein, 9 aa, Yellow fever virus
DGGGFYADD

SEQ ID NO: 163352 - protein, 9 aa, Yellow fever virus
GGGFYADDT

SEQ ID NO: 163353 - protein, 9 aa, Yellow fever virus
GGFYADDTA

SEQ ID NO: 163354 - protein, 9 aa, Yellow fever virus
GFYADDTAG

SEQ ID NO: 163355 - protein, 9 aa, Yellow fever virus
FYADDTAGW

SEQ ID NO: 163356 - protein, 9 aa, Yellow fever virus
YADDTAGWD

SEQ ID NO: 163357 - protein, 9 aa, Yellow fever virus
ADDTAGWDT

SEQ ID NO: 163358 - protein, 9 aa, Yellow fever virus
DDTAGWDTR

SEQ ID NO: 163359 - protein, 9 aa, Yellow fever virus
DTAGWDTRI

SEQ ID NO: 163360 - protein, 9 aa, Yellow fever virus
TAGWDTRIT

SEQ ID NO: 163361 - protein, 9 aa, Yellow fever virus
AGWDTRITE

SEQ ID NO: 163362 - protein, 9 aa, Yellow fever virus
GWDTRITEA

SEQ ID NO: 163363 - protein, 9 aa, Yellow fever virus
WDTRITEAD

SEQ ID NO: 163364 - protein, 9 aa, Yellow fever virus
DTRITEADL

SEQ ID NO: 163365 - protein, 9 aa, Yellow fever virus
TRITEADLD

SEQ ID NO: 163366 - protein, 9 aa, Yellow fever virus
RITEADLDD

SEQ ID NO: 163367 - protein, 9 aa, Yellow fever virus
ITEADLDDE

SEQ ID NO: 163368 - protein, 9 aa, Yellow fever virus
TEADLDDEQ

SEQ ID NO: 163369 - protein, 9 aa, Yellow fever virus
EADLDDEQE

SEQ ID NO: 163370 - protein, 9 aa, Yellow fever virus
ADLDDEQEI

SEQ ID NO: 163371 - protein, 9 aa, Yellow fever virus
DLDDEQEIL

SEQ ID NO: 163372 - protein, 9 aa, Yellow fever virus
LDDEQEILN

SEQ ID NO: 163373 - protein, 9 aa, Yellow fever virus
DDEQEILNY

SEQ ID NO: 163374 - protein, 9 aa, Yellow fever virus
DEQEILNYM

SEQ ID NO: 163375 - protein, 9 aa, Yellow fever virus
EQEILNYMS

SEQ ID NO: 163376 - protein, 9 aa, Yellow fever virus
QEILNYMSP

SEQ ID NO: 163377 - protein, 9 aa, Yellow fever virus
EILNYMSPH

SEQ ID NO: 163378 - protein, 9 aa, Yellow fever virus
ILNYMSPHH

SEQ ID NO: 163379 - protein, 9 aa, Yellow fever virus
LNYMSPHHK

SEQ ID NO: 163380 - protein, 9 aa, Yellow fever virus
NYMSPHHKK

SEQ ID NO: 163381 - protein, 9 aa, Yellow fever virus
YMSPHHKKL

SEQ ID NO: 163382 - protein, 9 aa, Yellow fever virus
MSPHHKKLA

SEQ ID NO: 163383 - protein, 9 aa, Yellow fever virus
SPHHKKLAQ

SEQ ID NO: 163384 - protein, 9 aa, Yellow fever virus
PHHKKLAQA

SEQ ID NO: 163385 - protein, 9 aa, Yellow fever virus
HHKKLAQAV

SEQ ID NO: 163386 - protein, 9 aa, Yellow fever virus
HKKLAQAVM

SEQ ID NO: 163387 - protein, 9 aa, Yellow fever virus
KKLAQAVME

SEQ ID NO: 163388 - protein, 9 aa, Yellow fever virus
KLAQAVMEM

SEQ ID NO: 163389 - protein, 9 aa, Yellow fever virus
LAQAVMEMT

SEQ ID NO: 163390 - protein, 9 aa, Yellow fever virus
AQAVMEMTY

SEQ ID NO: 163391 - protein, 9 aa, Yellow fever virus
QAVMEMTYK

SEQ ID NO: 163392 - protein, 9 aa, Yellow fever virus
AVMEMTYKN

SEQ ID NO: 163393 - protein, 9 aa, Yellow fever virus
VMEMTYKNK

SEQ ID NO: 163394 - protein, 9 aa, Yellow fever virus
MEMTYKNKV

SEQ ID NO: 163395 - protein, 9 aa, Yellow fever virus
EMTYKNKVV

SEQ ID NO: 163396 - protein, 9 aa, Yellow fever virus
MTYKNKVVK

SEQ ID NO: 163397 - protein, 9 aa, Yellow fever virus
TYKNKVVKV

SEQ ID NO: 163398 - protein, 9 aa, Yellow fever virus
YKNKVVKVL

SEQ ID NO: 163399 - protein, 9 aa, Yellow fever virus
KNKVVKVLR

SEQ ID NO: 163400 - protein, 9 aa, Yellow fever virus
NKVVKVLRP

SEQ ID NO: 163401 - protein, 9 aa, Yellow fever virus
KVVKVLRPA

SEQ ID NO: 163402 - protein, 9 aa, Yellow fever virus
VVKVLRPAP

SEQ ID NO: 163403 - protein, 9 aa, Yellow fever virus
VKVLRPAPG

SEQ ID NO: 163404 - protein, 9 aa, Yellow fever virus
KVLRPAPGG

SEQ ID NO: 163405 - protein, 9 aa, Yellow fever virus
VLRPAPGGK

SEQ ID NO: 163406 - protein, 9 aa, Yellow fever virus
LRPAPGGKA

SEQ ID NO: 163407 - protein, 9 aa, Yellow fever virus
RPAPGGKAY

SEQ ID NO: 163408 - protein, 9 aa, Yellow fever virus
PAPGGKAYM

SEQ ID NO: 163409 - protein, 9 aa, Yellow fever virus
APGGKAYMD

SEQ ID NO: 163410 - protein, 9 aa, Yellow fever virus
PGGKAYMDV

SEQ ID NO: 163411 - protein, 9 aa, Yellow fever virus
GGKAYMDVI

SEQ ID NO: 163412 - protein, 9 aa, Yellow fever virus
GKAYMDVIS

SEQ ID NO: 163413 - protein, 9 aa, Yellow fever virus
KAYMDVISR

SEQ ID NO: 163414 - protein, 9 aa, Yellow fever virus
AYMDVISRR

SEQ ID NO: 163415 - protein, 9 aa, Yellow fever virus
YMDVISRRD

SEQ ID NO: 163416 - protein, 9 aa, Yellow fever virus
MDVISRRDQ

SEQ ID NO: 163417 - protein, 9 aa, Yellow fever virus
DVISRRDQR

SEQ ID NO: 163418 - protein, 9 aa, Yellow fever virus
VISRRDQRG

SEQ ID NO: 163419 - protein, 9 aa, Yellow fever virus
ISRRDQRGS

SEQ ID NO: 163420 - protein, 9 aa, Yellow fever virus
SRRDQRGSG

SEQ ID NO: 163421 - protein, 9 aa, Yellow fever virus
RRDQRGSGQ

SEQ ID NO: 163422 - protein, 9 aa, Yellow fever virus
RDQRGSGQV

SEQ ID NO: 163423 - protein, 9 aa, Yellow fever virus
DQRGSGQVV

SEQ ID NO: 163424 - protein, 9 aa, Yellow fever virus
QRGSGQVVT

SEQ ID NO: 163425 - protein, 9 aa, Yellow fever virus
RGSGQVVTY

SEQ ID NO: 163426 - protein, 9 aa, Yellow fever virus
GSGQVVTYA

SEQ ID NO: 163427 - protein, 9 aa, Yellow fever virus
SGQVVTYAL

SEQ ID NO: 163428 - protein, 9 aa, Yellow fever virus
GQVVTYALN

SEQ ID NO: 163429 - protein, 9 aa, Yellow fever virus
QVVTYALNT

SEQ ID NO: 163430 - protein, 9 aa, Yellow fever virus
VVTYALNTI

SEQ ID NO: 163431 - protein, 9 aa, Yellow fever virus
VTYALNTIT

SEQ ID NO: 163432 - protein, 9 aa, Yellow fever virus
TYALNTITN

SEQ ID NO: 163433 - protein, 9 aa, Yellow fever virus
YALNTITNL

SEQ ID NO: 163434 - protein, 9 aa, Yellow fever virus
ALNTITNLK

SEQ ID NO: 163435 - protein, 9 aa, Yellow fever virus
LNTITNLKV

SEQ ID NO: 163436 - protein, 9 aa, Yellow fever virus
NTITNLKVQ

SEQ ID NO: 163437 - protein, 9 aa, Yellow fever virus
TITNLKVQL

SEQ ID NO: 163438 - protein, 9 aa, Yellow fever virus
ITNLKVQLI

SEQ ID NO: 163439 - protein, 9 aa, Yellow fever virus
TNLKVQLIR

SEQ ID NO: 163440 - protein, 9 aa, Yellow fever virus
NLKVQLIRM

SEQ ID NO: 163441 - protein, 9 aa, Yellow fever virus
LKVQLIRMA

SEQ ID NO: 163442 - protein, 9 aa, Yellow fever virus
KVQLIRMAE

SEQ ID NO: 163443 - protein, 9 aa, Yellow fever virus
VQLIRMAEA

SEQ ID NO: 163444 - protein, 9 aa, Yellow fever virus
QLIRMAEAE

SEQ ID NO: 163445 - protein, 9 aa, Yellow fever virus
LIRMAEAEM

SEQ ID NO: 163446 - protein, 9 aa, Yellow fever virus
IRMAEAEMV

SEQ ID NO: 163447 - protein, 9 aa, Yellow fever virus
RMAEAEMVI

SEQ ID NO: 163448 - protein, 9 aa, Yellow fever virus
MAEAEMVIH

SEQ ID NO: 163449 - protein, 9 aa, Yellow fever virus
AEAEMVIHH

SEQ ID NO: 163450 - protein, 9 aa, Yellow fever virus
EAEMVIHHQ

SEQ ID NO: 163451 - protein, 9 aa, Yellow fever virus
AEMVIHHQH

SEQ ID NO: 163452 - protein, 9 aa, Yellow fever virus
EMVIHHQHV

SEQ ID NO: 163453 - protein, 9 aa, Yellow fever virus
MVIHHQHVQ

SEQ ID NO: 163454 - protein, 9 aa, Yellow fever virus
VIHHQHVQD

SEQ ID NO: 163455 - protein, 9 aa, Yellow fever virus
IHHQHVQDC

SEQ ID NO: 163456 - protein, 9 aa, Yellow fever virus
HHQHVQDCD

SEQ ID NO: 163457 - protein, 9 aa, Yellow fever virus
HQHVQDCDE

SEQ ID NO: 163458 - protein, 9 aa, Yellow fever virus
QHVQDCDES

SEQ ID NO: 163459 - protein, 9 aa, Yellow fever virus
CDESVLTRL

SEQ ID NO: 163460 - protein, 9 aa, Yellow fever virus
LTRLEAWLT

SEQ ID NO: 163461 - protein, 9 aa, Yellow fever virus
TRLEAWLTE

SEQ ID NO: 163462 - protein, 9 aa, Yellow fever virus
RLEAWLTEH

SEQ ID NO: 163463 - protein, 9 aa, Yellow fever virus
LEAWLTEHG

SEQ ID NO: 163464 - protein, 9 aa, Yellow fever virus
EAWLTEHGC

SEQ ID NO: 163465 - protein, 9 aa, Yellow fever virus
AWLTEHGCN

SEQ ID NO: 163466 - protein, 9 aa, Yellow fever virus
WLTEHGCNR

SEQ ID NO: 163467 - protein, 9 aa, Yellow fever virus
LTEHGCNRL

SEQ ID NO: 163468 - protein, 9 aa, Yellow fever virus
RLKRMAVSG

SEQ ID NO: 163469 - protein, 9 aa, Yellow fever virus
LKRMAVSGD

SEQ ID NO: 163470 - protein, 9 aa, Yellow fever virus
KRMAVSGDD

SEQ ID NO: 163471 - protein, 9 aa, Yellow fever virus
RMAVSGDDC

SEQ ID NO: 163472 - protein, 9 aa, Yellow fever virus
MAVSGDDCV

SEQ ID NO: 163473 - protein, 9 aa, Yellow fever virus
AVSGDDCVV

SEQ ID NO: 163474 - protein, 9 aa, Yellow fever virus
VSGDDCVVR

SEQ ID NO: 163475 - protein, 9 aa, Yellow fever virus
SGDDCVVRP

SEQ ID NO: 163476 - protein, 9 aa, Yellow fever virus
GDDCVVRPI

SEQ ID NO: 163477 - protein, 9 aa, Yellow fever virus
DDCVVRPID

SEQ ID NO: 163478 - protein, 9 aa, Yellow fever virus
DCVVRPIDD

SEQ ID NO: 163479 - protein, 9 aa, Yellow fever virus
CVVRPIDDR

SEQ ID NO: 163480 - protein, 9 aa, Yellow fever virus
VVRPIDDRF

SEQ ID NO: 163481 - protein, 9 aa, Yellow fever virus
VRPIDDRFG

SEQ ID NO: 163482 - protein, 9 aa, Yellow fever virus
RPIDDRFGL

SEQ ID NO: 163483 - protein, 9 aa, Yellow fever virus
PIDDRFGLA

SEQ ID NO: 163484 - protein, 9 aa, Yellow fever virus
IDDRFGLAL

SEQ ID NO: 163485 - protein, 9 aa, Yellow fever virus
DDRFGLALS

SEQ ID NO: 163486 - protein, 9 aa, Yellow fever virus
DRFGLALSH

SEQ ID NO: 163487 - protein, 9 aa, Yellow fever virus
RFGLALSHL

SEQ ID NO: 163488 - protein, 9 aa, Yellow fever virus
FGLALSHLN

SEQ ID NO: 163489 - protein, 9 aa, Yellow fever virus
GLALSHLNA

SEQ ID NO: 163490 - protein, 9 aa, Yellow fever virus
LALSHLNAM

SEQ ID NO: 163491 - protein, 9 aa, Yellow fever virus
ALSHLNAMS

SEQ ID NO: 163492 - protein, 9 aa, Yellow fever virus
LSHLNAMSK

SEQ ID NO: 163493 - protein, 9 aa, Yellow fever virus
SHLNAMSKV

SEQ ID NO: 163494 - protein, 9 aa, Yellow fever virus
HLNAMSKVR

SEQ ID NO: 163495 - protein, 9 aa, Yellow fever virus
LNAMSKVRK

SEQ ID NO: 163496 - protein, 9 aa, Yellow fever virus
NAMSKVRKD

SEQ ID NO: 163497 - protein, 9 aa, Yellow fever virus
AMSKVRKDI

SEQ ID NO: 163498 - protein, 9 aa, Yellow fever virus
MSKVRKDIS

SEQ ID NO: 163499 - protein, 9 aa, Yellow fever virus
SKVRKDISE

SEQ ID NO: 163500 - protein, 9 aa, Yellow fever virus
KVRKDISEW

SEQ ID NO: 163501 - protein, 9 aa, Yellow fever virus
VRKDISEWQ

SEQ ID NO: 163502 - protein, 9 aa, Yellow fever virus
RKDISEWQP

SEQ ID NO: 163503 - protein, 9 aa, Yellow fever virus
KDISEWQPS

SEQ ID NO: 163504 - protein, 9 aa, Yellow fever virus
DISEWQPSK

SEQ ID NO: 163505 - protein, 9 aa, Yellow fever virus
ISEWQPSKG

SEQ ID NO: 163506 - protein, 9 aa, Yellow fever virus
SEWQPSKGW

SEQ ID NO: 163507 - protein, 9 aa, Yellow fever virus
EWQPSKGWN

SEQ ID NO: 163508 - protein, 9 aa, Yellow fever virus
WQPSKGWND

SEQ ID NO: 163509 - protein, 9 aa, Yellow fever virus
QPSKGWNDW

SEQ ID NO: 163510 - protein, 9 aa, Yellow fever virus
PSKGWNDWE

SEQ ID NO: 163511 - protein, 9 aa, Yellow fever virus
SKGWNDWEN

SEQ ID NO: 163512 - protein, 9 aa, Yellow fever virus
KGWNDWENV

SEQ ID NO: 163513 - protein, 9 aa, Yellow fever virus
GWNDWENVP

SEQ ID NO: 163514 - protein, 9 aa, Yellow fever virus
WNDWENVPF

SEQ ID NO: 163515 - protein, 9 aa, Yellow fever virus
NDWENVPFC

SEQ ID NO: 163516 - protein, 9 aa, Yellow fever virus
DWENVPFCS

SEQ ID NO: 163517 - protein, 9 aa, Yellow fever virus
WENVPFCSH

SEQ ID NO: 163518 - protein, 9 aa, Yellow fever virus
ENVPFCSHH

SEQ ID NO: 163519 - protein, 9 aa, Yellow fever virus
NVPFCSHHF

SEQ ID NO: 163520 - protein, 9 aa, Yellow fever virus
VPFCSHHFH

SEQ ID NO: 163521 - protein, 9 aa, Yellow fever virus
PFCSHHFHE

SEQ ID NO: 163522 - protein, 9 aa, Yellow fever virus
FCSHHFHEL

SEQ ID NO: 163523 - protein, 9 aa, Yellow fever virus
CSHHFHELQ

SEQ ID NO: 163524 - protein, 9 aa, Yellow fever virus
SHHFHELQL

SEQ ID NO: 163525 - protein, 9 aa, Yellow fever virus
HHFHELQLK

SEQ ID NO: 163526 - protein, 9 aa, Yellow fever virus
HFHELQLKD

SEQ ID NO: 163527 - protein, 9 aa, Yellow fever virus
FHELQLKDG

SEQ ID NO: 163528 - protein, 9 aa, Yellow fever virus
HELQLKDGR

SEQ ID NO: 163529 - protein, 9 aa, Yellow fever virus
ELQLKDGRR

SEQ ID NO: 163530 - protein, 9 aa, Yellow fever virus
LQLKDGRRI

SEQ ID NO: 163531 - protein, 9 aa, Yellow fever virus
QLKDGRRIV

SEQ ID NO: 163532 - protein, 9 aa, Yellow fever virus
LKDGRRIVV

SEQ ID NO: 163533 - protein, 9 aa, Yellow fever virus
KDGRRIVVP

SEQ ID NO: 163534 - protein, 9 aa, Yellow fever virus
DGRRIVVPC

SEQ ID NO: 163535 - protein, 9 aa, Yellow fever virus
GRRIVVPCR

SEQ ID NO: 163536 - protein, 9 aa, Yellow fever virus
RRIVVPCRE

SEQ ID NO: 163537 - protein, 9 aa, Yellow fever virus
RIVVPCREQ

SEQ ID NO: 163538 - protein, 9 aa, Yellow fever virus
IVVPCREQD

SEQ ID NO: 163539 - protein, 9 aa, Yellow fever virus
VVPCREQDE

SEQ ID NO: 163540 - protein, 9 aa, Yellow fever virus
VPCREQDEL

SEQ ID NO: 163541 - protein, 9 aa, Yellow fever virus
PCREQDELI

SEQ ID NO: 163542 - protein, 9 aa, Yellow fever virus
CREQDELIG

SEQ ID NO: 163543 - protein, 9 aa, Yellow fever virus
REQDELIGR

SEQ ID NO: 163544 - protein, 9 aa, Yellow fever virus
EQDELIGRG

SEQ ID NO: 163545 - protein, 9 aa, Yellow fever virus
QDELIGRGR

SEQ ID NO: 163546 - protein, 9 aa, Yellow fever virus
DELIGRGRV

SEQ ID NO: 163547 - protein, 9 aa, Yellow fever virus
ELIGRGRVS

SEQ ID NO: 163548 - protein, 9 aa, Yellow fever virus
LIGRGRVSP

SEQ ID NO: 163549 - protein, 9 aa, Yellow fever virus
IGRGRVSPG

SEQ ID NO: 163550 - protein, 9 aa, Yellow fever virus
GRGRVSPGN

SEQ ID NO: 163551 - protein, 9 aa, Yellow fever virus
RGRVSPGNG

SEQ ID NO: 163552 - protein, 9 aa, Yellow fever virus
GRVSPGNGW

SEQ ID NO: 163553 - protein, 9 aa, Yellow fever virus
RVSPGNGWM

SEQ ID NO: 163554 - protein, 9 aa, Yellow fever virus
VSPGNGWMI

SEQ ID NO: 163555 - protein, 9 aa, Yellow fever virus
SPGNGWMIK

SEQ ID NO: 163556 - protein, 9 aa, Yellow fever virus
PGNGWMIKE

SEQ ID NO: 163557 - protein, 9 aa, Yellow fever virus
GNGWMIKET

SEQ ID NO: 163558 - protein, 9 aa, Yellow fever virus
NGWMIKETA

SEQ ID NO: 163559 - protein, 9 aa, Yellow fever virus
GWMIKETAC

SEQ ID NO: 163560 - protein, 9 aa, Yellow fever virus
WMIKETACL

SEQ ID NO: 163561 - protein, 9 aa, Yellow fever virus
MIKETACLS

SEQ ID NO: 163562 - protein, 9 aa, Yellow fever virus
IKETACLSK

SEQ ID NO: 163563 - protein, 9 aa, Yellow fever virus
KETACLSKA

SEQ ID NO: 163564 - protein, 9 aa, Yellow fever virus
ETACLSKAY

SEQ ID NO: 163565 - protein, 9 aa, Yellow fever virus
TACLSKAYA

SEQ ID NO: 163566 - protein, 9 aa, Yellow fever virus
ACLSKAYAN

SEQ ID NO: 163567 - protein, 9 aa, Yellow fever virus
CLSKAYANM

SEQ ID NO: 163568 - protein, 9 aa, Yellow fever virus
LSKAYANMW

SEQ ID NO: 163569 - protein, 9 aa, Yellow fever virus
SKAYANMWS

SEQ ID NO: 163570 - protein, 9 aa, Yellow fever virus
KAYANMWSL

SEQ ID NO: 163571 - protein, 9 aa, Yellow fever virus
AYANMWSLM

SEQ ID NO: 163572 - protein, 9 aa, Yellow fever virus
YANMWSLMY

SEQ ID NO: 163573 - protein, 9 aa, Yellow fever virus
ANMWSLMYF

SEQ ID NO: 163574 - protein, 9 aa, Yellow fever virus
NMWSLMYFH

SEQ ID NO: 163575 - protein, 9 aa, Yellow fever virus
MWSLMYFHK

SEQ ID NO: 163576 - protein, 9 aa, Yellow fever virus
WSLMYFHKR

SEQ ID NO: 163577 - protein, 9 aa, Yellow fever virus
SLMYFHKRD

SEQ ID NO: 163578 - protein, 9 aa, Yellow fever virus
LMYFHKRDM

SEQ ID NO: 163579 - protein, 9 aa, Yellow fever virus
MYFHKRDMR

SEQ ID NO: 163580 - protein, 9 aa, Yellow fever virus
YFHKRDMRL

SEQ ID NO: 163581 - protein, 9 aa, Yellow fever virus
FHKRDMRLL

SEQ ID NO: 163582 - protein, 9 aa, Yellow fever virus
HKRDMRLLS

SEQ ID NO: 163583 - protein, 9 aa, Yellow fever virus
KRDMRLLSL

SEQ ID NO: 163584 - protein, 9 aa, Yellow fever virus
RDMRLLSLA

SEQ ID NO: 163585 - protein, 9 aa, Yellow fever virus
DMRLLSLAV

SEQ ID NO: 163586 - protein, 9 aa, Yellow fever virus
MRLLSLAVS

SEQ ID NO: 163587 - protein, 9 aa, Yellow fever virus
RLLSLAVSS

SEQ ID NO: 163588 - protein, 9 aa, Yellow fever virus
LLSLAVSSA

SEQ ID NO: 163589 - protein, 9 aa, Yellow fever virus
LSLAVSSAV

SEQ ID NO: 163590 - protein, 9 aa, Yellow fever virus
SLAVSSAVP

SEQ ID NO: 163591 - protein, 9 aa, Yellow fever virus
LAVSSAVPT

SEQ ID NO: 163592 - protein, 9 aa, Yellow fever virus
AVSSAVPTS

SEQ ID NO: 163593 - protein, 9 aa, Yellow fever virus
VSSAVPTSW

SEQ ID NO: 163594 - protein, 9 aa, Yellow fever virus
SSAVPTSWV

SEQ ID NO: 163595 - protein, 9 aa, Yellow fever virus
SAVPTSWVP

SEQ ID NO: 163596 - protein, 9 aa, Yellow fever virus
AVPTSWVPQ

SEQ ID NO: 163597 - protein, 9 aa, Yellow fever virus
VPTSWVPQG

SEQ ID NO: 163598 - protein, 9 aa, Yellow fever virus
PTSWVPQGR

SEQ ID NO: 163599 - protein, 9 aa, Yellow fever virus
TSWVPQGRT

SEQ ID NO: 163600 - protein, 9 aa, Yellow fever virus
SWVPQGRTT

SEQ ID NO: 163601 - protein, 9 aa, Yellow fever virus
WVPQGRTTW

SEQ ID NO: 163602 - protein, 9 aa, Yellow fever virus
VPQGRTTWS

SEQ ID NO: 163603 - protein, 9 aa, Yellow fever virus
PQGRTTWSI

SEQ ID NO: 163604 - protein, 9 aa, Yellow fever virus
QGRTTWSIH

SEQ ID NO: 163605 - protein, 9 aa, Yellow fever virus
GRTTWSIHG

SEQ ID NO: 163606 - protein, 9 aa, Yellow fever virus
RTTWSIHGK

SEQ ID NO: 163607 - protein, 9 aa, Yellow fever virus
TTWSIHGKG

SEQ ID NO: 163608 - protein, 9 aa, Yellow fever virus
TWSIHGKGE

SEQ ID NO: 163609 - protein, 9 aa, Yellow fever virus
WSIHGKGEW

SEQ ID NO: 163610 - protein, 9 aa, Yellow fever virus
SIHGKGEWM

SEQ ID NO: 163611 - protein, 9 aa, Yellow fever virus
IHGKGEWMT

SEQ ID NO: 163612 - protein, 9 aa, Yellow fever virus
HGKGEWMTT

SEQ ID NO: 163613 - protein, 9 aa, Yellow fever virus
GKGEWMTTE

SEQ ID NO: 163614 - protein, 9 aa, Yellow fever virus
KGEWMTTED

SEQ ID NO: 163615 - protein, 9 aa, Yellow fever virus
GEWMTTEDM

SEQ ID NO: 163616 - protein, 9 aa, Yellow fever virus
EWMTTEDML

SEQ ID NO: 163617 - protein, 9 aa, Yellow fever virus
WMTTEDMLE

SEQ ID NO: 163618 - protein, 9 aa, Yellow fever virus
MTTEDMLEV

SEQ ID NO: 163619 - protein, 9 aa, Yellow fever virus
TTEDMLEVW

SEQ ID NO: 163620 - protein, 9 aa, Yellow fever virus
TEDMLEVWN

SEQ ID NO: 163621 - protein, 9 aa, Yellow fever virus
EDMLEVWNR

SEQ ID NO: 163622 - protein, 9 aa, Yellow fever virus
DMLEVWNRV

SEQ ID NO: 163623 - protein, 9 aa, Yellow fever virus
MLEVWNRVW

SEQ ID NO: 163624 - protein, 9 aa, Yellow fever virus
LEVWNRVWI

SEQ ID NO: 163625 - protein, 9 aa, Yellow fever virus
EVWNRVWIT

SEQ ID NO: 163626 - protein, 9 aa, Yellow fever virus
VWNRVWITN

SEQ ID NO: 163627 - protein, 9 aa, Yellow fever virus
WNRVWITNN

SEQ ID NO: 163628 - protein, 9 aa, Yellow fever virus
NRVWITNNP

SEQ ID NO: 163629 - protein, 9 aa, Yellow fever virus
RVWITNNPH

SEQ ID NO: 163630 - protein, 9 aa, Yellow fever virus
VWITNNPHM

SEQ ID NO: 163631 - protein, 9 aa, Yellow fever virus
WITNNPHMQ

SEQ ID NO: 163632 - protein, 9 aa, Yellow fever virus
ITNNPHMQD

SEQ ID NO: 163633 - protein, 9 aa, Yellow fever virus
TNNPHMQDK

SEQ ID NO: 163634 - protein, 9 aa, Yellow fever virus
NNPHMQDKT

SEQ ID NO: 163635 - protein, 9 aa, Yellow fever virus
NPHMQDKTM

SEQ ID NO: 163636 - protein, 9 aa, Yellow fever virus
PHMQDKTMV

SEQ ID NO: 163637 - protein, 9 aa, Yellow fever virus
HMQDKTMVK

SEQ ID NO: 163638 - protein, 9 aa, Yellow fever virus
MQDKTMVKK

SEQ ID NO: 163639 - protein, 9 aa, Yellow fever virus
QDKTMVKKW

SEQ ID NO: 163640 - protein, 9 aa, Yellow fever virus
DKTMVKKWR

SEQ ID NO: 163641 - protein, 9 aa, Yellow fever virus
KTMVKKWRD

SEQ ID NO: 163642 - protein, 9 aa, Yellow fever virus
TMVKKWRDV

SEQ ID NO: 163643 - protein, 9 aa, Yellow fever virus
MVKKWRDVP

SEQ ID NO: 163644 - protein, 9 aa, Yellow fever virus
VKKWRDVPY

SEQ ID NO: 163645 - protein, 9 aa, Yellow fever virus
KKWRDVPYL

SEQ ID NO: 163646 - protein, 9 aa, Yellow fever virus
KWRDVPYLT

SEQ ID NO: 163647 - protein, 9 aa, Yellow fever virus
WRDVPYLTK

SEQ ID NO: 163648 - protein, 9 aa, Yellow fever virus
RDVPYLTKR

SEQ ID NO: 163649 - protein, 9 aa, Yellow fever virus
DVPYLTKRQ

SEQ ID NO: 163650 - protein, 9 aa, Yellow fever virus
VPYLTKRQD

SEQ ID NO: 163651 - protein, 9 aa, Yellow fever virus
PYLTKRQDK

SEQ ID NO: 163652 - protein, 9 aa, Yellow fever virus
YLTKRQDKL

SEQ ID NO: 163653 - protein, 9 aa, Yellow fever virus
LTKRQDKLC

SEQ ID NO: 163654 - protein, 9 aa, Yellow fever virus
TKRQDKLCG

SEQ ID NO: 163655 - protein, 9 aa, Yellow fever virus
KRQDKLCGS

SEQ ID NO: 163656 - protein, 9 aa, Yellow fever virus
RQDKLCGSL

SEQ ID NO: 163657 - protein, 9 aa, Yellow fever virus
QDKLCGSLI

SEQ ID NO: 163658 - protein, 9 aa, Yellow fever virus
DKLCGSLIG

SEQ ID NO: 163659 - protein, 9 aa, Yellow fever virus
KLCGSLIGM

SEQ ID NO: 163660 - protein, 9 aa, Yellow fever virus
LCGSLIGMT

SEQ ID NO: 163661 - protein, 9 aa, Yellow fever virus
CGSLIGMTN

SEQ ID NO: 163662 - protein, 9 aa, Yellow fever virus
GSLIGMTNR

SEQ ID NO: 163663 - protein, 9 aa, Yellow fever virus
SLIGMTNRA

SEQ ID NO: 163664 - protein, 9 aa, Yellow fever virus
LIGMTNRAT

SEQ ID NO: 163665 - protein, 9 aa, Yellow fever virus
IGMTNRATW

SEQ ID NO: 163666 - protein, 9 aa, Yellow fever virus
GMTNRATWA

SEQ ID NO: 163667 - protein, 9 aa, Yellow fever virus
MTNRATWAS

SEQ ID NO: 163668 - protein, 9 aa, Yellow fever virus
TNRATWASH

SEQ ID NO: 163669 - protein, 9 aa, Yellow fever virus
NRATWASHI

SEQ ID NO: 163670 - protein, 9 aa, Yellow fever virus
RATWASHIH

SEQ ID NO: 163671 - protein, 9 aa, Yellow fever virus
ATWASHIHL

SEQ ID NO: 163672 - protein, 9 aa, Yellow fever virus
TWASHIHLV

SEQ ID NO: 163673 - protein, 9 aa, Yellow fever virus
WASHIHLVI

SEQ ID NO: 163674 - protein, 9 aa, Yellow fever virus
ASHIHLVIH

SEQ ID NO: 163675 - protein, 9 aa, Yellow fever virus
SHIHLVIHR

SEQ ID NO: 163676 - protein, 9 aa, Yellow fever virus
HIHLVIHRI

SEQ ID NO: 163677 - protein, 9 aa, Yellow fever virus
IHLVIHRIR

SEQ ID NO: 163678 - protein, 9 aa, Yellow fever virus
HLVIHRIRT

SEQ ID NO: 163679 - protein, 9 aa, Yellow fever virus
LVIHRIRTL

SEQ ID NO: 163680 - protein, 9 aa, Yellow fever virus
VIHRIRTLI

SEQ ID NO: 163681 - protein, 9 aa, Yellow fever virus
IHRIRTLIG

SEQ ID NO: 163682 - protein, 9 aa, Yellow fever virus
HRIRTLIGQ

SEQ ID NO: 163683 - protein, 9 aa, Yellow fever virus
RIRTLIGQE

SEQ ID NO: 163684 - protein, 9 aa, Yellow fever virus
IRTLIGQEK

SEQ ID NO: 163685 - protein, 9 aa, Yellow fever virus
RTLIGQEKY

SEQ ID NO: 163686 - protein, 9 aa, Yellow fever virus
TLIGQEKYT

SEQ ID NO: 163687 - protein, 9 aa, Yellow fever virus
LIGQEKYTD

SEQ ID NO: 163688 - protein, 9 aa, Yellow fever virus
IGQEKYTDY

SEQ ID NO: 163689 - protein, 9 aa, Yellow fever virus
GQEKYTDYL

SEQ ID NO: 163690 - protein, 9 aa, Yellow fever virus
QEKYTDYLT

SEQ ID NO: 163691 - protein, 9 aa, Yellow fever virus
EKYTDYLTV

SEQ ID NO: 163692 - protein, 9 aa, Yellow fever virus
KYTDYLTVM

SEQ ID NO: 163693 - protein, 9 aa, Yellow fever virus
YTDYLTVMD

SEQ ID NO: 163694 - protein, 9 aa, Yellow fever virus
TDYLTVMDR

SEQ ID NO: 163695 - protein, 9 aa, Yellow fever virus
DYLTVMDRY

SEQ ID NO: 163696 - protein, 9 aa, Yellow fever virus
YLTVMDRYS

SEQ ID NO: 163697 - protein, 9 aa, Yellow fever virus
LTVMDRYSV

SEQ ID NO: 163698 - protein, 9 aa, Yellow fever virus
TVMDRYSVD

SEQ ID NO: 163699 - protein, 9 aa, Yellow fever virus
VMDRYSVDA

SEQ ID NO: 163700 - protein, 9 aa, Yellow fever virus
MDRYSVDAD

SEQ ID NO: 163701 - protein, 9 aa, Yellow fever virus
DRYSVDADL

SEQ ID NO: 163702 - protein, 9 aa, Yellow fever virus
RYSVDADLQ

SEQ ID NO: 163703 - protein, 9 aa, Yellow fever virus
YSVDADLQL

SEQ ID NO: 163704 - protein, 9 aa, Yellow fever virus
SVDADLQLG

SEQ ID NO: 163705 - protein, 9 aa, Yellow fever virus
VDADLQLGE

SEQ ID NO: 163706 - protein, 9 aa, Yellow fever virus
DADLQLGEL

SEQ ID NO: 163707 - protein, 9 aa, Yellow fever virus
ADLQLGELI

SEQ ID NO: 163708 - protein, 9 aa, Yellow fever virus
GVNMVRRGA

SEQ ID NO: 163709 - protein, 9 aa, Yellow fever virus
VNMVRRGAR

SEQ ID NO: 163710 - protein, 9 aa, Yellow fever virus
NMVRRGARS

SEQ ID NO: 163711 - protein, 9 aa, Yellow fever virus
MVRRGARSL

SEQ ID NO: 163712 - protein, 9 aa, Yellow fever virus
VRRGARSLS

SEQ ID NO: 163713 - protein, 9 aa, Yellow fever virus
RRGARSLSN

SEQ ID NO: 163714 - protein, 9 aa, Yellow fever virus
RGARSLSNK

SEQ ID NO: 163715 - protein, 9 aa, Yellow fever virus
GARSLSNKI

SEQ ID NO: 163716 - protein, 9 aa, Yellow fever virus
ARSLSNKIK

SEQ ID NO: 163717 - protein, 9 aa, Yellow fever virus
KQIGNRPGL

SEQ ID NO: 163718 - protein, 9 aa, Yellow fever virus
QIGNRPGLS

SEQ ID NO: 163719 - protein, 9 aa, Yellow fever virus
IGNRPGLSR

SEQ ID NO: 163720 - protein, 9 aa, Yellow fever virus
GNRPGLSRG

SEQ ID NO: 163721 - protein, 9 aa, Yellow fever virus
NRPGLSRGV

SEQ ID NO: 163722 - protein, 9 aa, Yellow fever virus
RPGLSRGVQ

SEQ ID NO: 163723 - protein, 9 aa, Yellow fever virus
PGLSRGVQG

SEQ ID NO: 163724 - protein, 9 aa, Yellow fever virus
GLSRGVQGF

SEQ ID NO: 163725 - protein, 9 aa, Yellow fever virus
LSRGVQGFI

SEQ ID NO: 163726 - protein, 9 aa, Yellow fever virus
SRGVQGFIS

SEQ ID NO: 163727 - protein, 9 aa, Yellow fever virus
RGVQGFISF

SEQ ID NO: 163728 - protein, 9 aa, Yellow fever virus
GVQGFISFF

SEQ ID NO: 163729 - protein, 9 aa, Yellow fever virus
VQGFISFFS

SEQ ID NO: 163730 - protein, 9 aa, Yellow fever virus
QGFISFFSF

SEQ ID NO: 163731 - protein, 9 aa, Yellow fever virus
GFISFFSFN

SEQ ID NO: 163732 - protein, 9 aa, Yellow fever virus
FISFFSFNI

SEQ ID NO: 163733 - protein, 9 aa, Yellow fever virus
ISFFSFNIL

SEQ ID NO: 163734 - protein, 9 aa, Yellow fever virus
SFFSFNILT

SEQ ID NO: 163735 - protein, 9 aa, Yellow fever virus
FFSFNILTG

SEQ ID NO: 163736 - protein, 9 aa, Yellow fever virus
FSFNILTGK

SEQ ID NO: 163737 - protein, 9 aa, Yellow fever virus
SFNILTGKK

SEQ ID NO: 163738 - protein, 9 aa, Yellow fever virus
FNILTGKKL

SEQ ID NO: 163739 - protein, 9 aa, Yellow fever virus
NILTGKKLT

SEQ ID NO: 163740 - protein, 9 aa, Yellow fever virus
ILTGKKLTT

SEQ ID NO: 163741 - protein, 9 aa, Yellow fever virus
LTGKKLTTH

SEQ ID NO: 163742 - protein, 9 aa, Yellow fever virus
TGKKLTTHL

SEQ ID NO: 163743 - protein, 9 aa, Yellow fever virus
GKKLTTHLK

SEQ ID NO: 163744 - protein, 9 aa, Yellow fever virus
KKLTTHLKR

SEQ ID NO: 163745 - protein, 9 aa, Yellow fever virus
KLTTHLKRL

SEQ ID NO: 163746 - protein, 9 aa, Yellow fever virus
LTTHLKRLW

SEQ ID NO: 163747 - protein, 9 aa, Yellow fever virus
TTHLKRLWR

SEQ ID NO: 163748 - protein, 9 aa, Yellow fever virus
THLKRLWRM

SEQ ID NO: 163749 - protein, 9 aa, Yellow fever virus
HLKRLWRML

SEQ ID NO: 163750 - protein, 9 aa, Yellow fever virus
LKRLWRMLD

SEQ ID NO: 163751 - protein, 9 aa, Yellow fever virus
KRLWRMLDP

SEQ ID NO: 163752 - protein, 9 aa, Yellow fever virus
RLWRMLDPR

SEQ ID NO: 163753 - protein, 9 aa, Yellow fever virus
LWRMLDPRQ

SEQ ID NO: 163754 - protein, 9 aa, Yellow fever virus
WRMLDPRQG

SEQ ID NO: 163755 - protein, 9 aa, Yellow fever virus
RMLDPRQGL

SEQ ID NO: 163756 - protein, 9 aa, Yellow fever virus
MLDPRQGLT

SEQ ID NO: 163757 - protein, 9 aa, Yellow fever virus
LDPRQGLAA

SEQ ID NO: 163758 - protein, 9 aa, Yellow fever virus
DPRQGLAAL

SEQ ID NO: 163759 - protein, 9 aa, Yellow fever virus
PRQGLAALR

SEQ ID NO: 163760 - protein, 9 aa, Yellow fever virus
RQGLAALRK

SEQ ID NO: 163761 - protein, 9 aa, Yellow fever virus
QGLAALRKV

SEQ ID NO: 163762 - protein, 9 aa, Yellow fever virus
GLAALRKVK

SEQ ID NO: 163763 - protein, 9 aa, Yellow fever virus
LAALRKVKR

SEQ ID NO: 163764 - protein, 9 aa, Yellow fever virus
AALRKVKRV

SEQ ID NO: 163765 - protein, 9 aa, Yellow fever virus
ALRKVKRVV

SEQ ID NO: 163766 - protein, 9 aa, Yellow fever virus
RKVKRVVAG

SEQ ID NO: 163767 - protein, 9 aa, Yellow fever virus
KVKRVVAGL

SEQ ID NO: 163768 - protein, 9 aa, Yellow fever virus
VKRVVAGLM

SEQ ID NO: 163769 - protein, 9 aa, Yellow fever virus
KRVVAGLMR

SEQ ID NO: 163770 - protein, 9 aa, Yellow fever virus
RVVAGLMRG

SEQ ID NO: 163771 - protein, 9 aa, Yellow fever virus
VVAGLMRGL

SEQ ID NO: 163772 - protein, 9 aa, Yellow fever virus
VAGLMRGLS

SEQ ID NO: 163773 - protein, 9 aa, Yellow fever virus
AGLMRGLSS

SEQ ID NO: 163774 - protein, 9 aa, Yellow fever virus
GLMRGLSSR

SEQ ID NO: 163775 - protein, 9 aa, Yellow fever virus
LMIGLSSRK

SEQ ID NO: 163776 - protein, 9 aa, Yellow fever virus
MIGLSSRKR

SEQ ID NO: 163777 - protein, 9 aa, Yellow fever virus
IGLSSRKRR

SEQ ID NO: 163778 - protein, 9 aa, Yellow fever virus
LSSRKRRSN

SEQ ID NO: 163779 - protein, 9 aa, Yellow fever virus
SSRKRRSNE

SEQ ID NO: 163780 - protein, 9 aa, Yellow fever virus
SRKRRSHDA

SEQ ID NO: 163781 - protein, 9 aa, Yellow fever virus
RKRRSNEMA

SEQ ID NO: 163782 - protein, 9 aa, Yellow fever virus
MMPLLILSM

SEQ ID NO: 163783 - protein, 9 aa, Yellow fever virus
MPLLILSMV

SEQ ID NO: 163784 - protein, 9 aa, Yellow fever virus
PLLILSMVI

SEQ ID NO: 163785 - protein, 9 aa, Yellow fever virus
LLILSMVIL

SEQ ID NO: 163786 - protein, 9 aa, Yellow fever virus
AGGVTLVRK

SEQ ID NO: 163787 - protein, 9 aa, Yellow fever virus
GGVTLMRKN

SEQ ID NO: 163788 - protein, 9 aa, Yellow fever virus
GVTLMRKNR

SEQ ID NO: 163789 - protein, 9 aa, Yellow fever virus
VTLMRKNRW

SEQ ID NO: 163790 - protein, 9 aa, Yellow fever virus
TLMRKNRWL

SEQ ID NO: 163791 - protein, 9 aa, Yellow fever virus
LMRKNRWLL

SEQ ID NO: 163792 - protein, 9 aa, Yellow fever virus
MRKNRWLLL

SEQ ID NO: 163793 - protein, 9 aa, Yellow fever virus
RWLLLNVTA

SEQ ID NO: 163794 - protein, 9 aa, Yellow fever virus
WLLLNVTAE

SEQ ID NO: 163795 - protein, 9 aa, Yellow fever virus
LLLNVTAED

SEQ ID NO: 163796 - protein, 9 aa, Yellow fever virus
LLNVTAEDL

SEQ ID NO: 163797 - protein, 9 aa, Yellow fever virus
LNVTAEDLG

SEQ ID NO: 163798 - protein, 9 aa, Yellow fever virus
NVTAEDLGK

SEQ ID NO: 163799 - protein, 9 aa, Yellow fever virus
VTAEDLGKT

SEQ ID NO: 163800 - protein, 9 aa, Yellow fever virus
TAEDLGKTF

SEQ ID NO: 163801 - protein, 9 aa, Yellow fever virus
AEDLGKTFS

SEQ ID NO: 163802 - protein, 9 aa, Yellow fever virus
EDLGKTFSI

SEQ ID NO: 163803 - protein, 9 aa, Yellow fever virus
DLGKTFSIG

SEQ ID NO: 163804 - protein, 9 aa, Yellow fever virus
LGKTFSVGA

SEQ ID NO: 163805 - protein, 9 aa, Yellow fever virus
GKTFSIGTG

SEQ ID NO: 163806 - protein, 9 aa, Yellow fever virus
KTFSLGTGN

SEQ ID NO: 163807 - protein, 9 aa, Yellow fever virus
TFSIGTGNC

SEQ ID NO: 163808 - protein, 9 aa, Yellow fever virus
FSIGTGNCT

SEQ ID NO: 163809 - protein, 9 aa, Yellow fever virus
SLGTGNCTT

SEQ ID NO: 163810 - protein, 9 aa, Yellow fever virus
VGAGNCTTN

SEQ ID NO: 163811 - protein, 9 aa, Yellow fever virus
GAGNCTTNI

SEQ ID NO: 163812 - protein, 9 aa, Yellow fever virus
AGNCTTNIL

SEQ ID NO: 163813 - protein, 9 aa, Yellow fever virus
YGVENVRVT

SEQ ID NO: 163814 - protein, 9 aa, Yellow fever virus
GVENVRVTY

SEQ ID NO: 163815 - protein, 9 aa, Yellow fever virus
VENVRVTYG

SEQ ID NO: 163816 - protein, 9 aa, Yellow fever virus
ENVRVAYGR

SEQ ID NO: 163817 - protein, 9 aa, Yellow fever virus
NVRVAYGRC

SEQ ID NO: 163818 - protein, 9 aa, Yellow fever virus
VRVAYGRCD

SEQ ID NO: 163819 - protein, 9 aa, Yellow fever virus
RVAYGRCDA

SEQ ID NO: 163820 - protein, 9 aa, Yellow fever virus
VAYGRCDAV

SEQ ID NO: 163821 - protein, 9 aa, Yellow fever virus
AYGRCDAVG

SEQ ID NO: 163822 - protein, 9 aa, Yellow fever virus
YGRCDAVGR

SEQ ID NO: 163823 - protein, 9 aa, Yellow fever virus
GRCDAVGRS

SEQ ID NO: 163824 - protein, 9 aa, Yellow fever virus
RCDAVGRSK

SEQ ID NO: 163825 - protein, 9 aa, Yellow fever virus
CDAVGRSKR

SEQ ID NO: 163826 - protein, 9 aa, Yellow fever virus
DAVGRSKRS

SEQ ID NO: 163827 - protein, 9 aa, Yellow fever virus
AVGRSKRSR

SEQ ID NO: 163828 - protein, 9 aa, Yellow fever virus
VGRSKRSRR

SEQ ID NO: 163829 - protein, 9 aa, Yellow fever virus
GRSKRSRRA

SEQ ID NO: 163830 - protein, 9 aa, Yellow fever virus
RSKRSRRAI

SEQ ID NO: 163831 - protein, 9 aa, Yellow fever virus
SKRSRRAID

SEQ ID NO: 163832 - protein, 9 aa, Yellow fever virus
KRSRRAIDL

SEQ ID NO: 163833 - protein, 9 aa, Yellow fever virus
KTRQEKWMA

SEQ ID NO: 163834 - protein, 9 aa, Yellow fever virus
TRQEKWMAG

SEQ ID NO: 163835 - protein, 9 aa, Yellow fever virus
RQEKWMAGR

SEQ ID NO: 163836 - protein, 9 aa, Yellow fever virus
QEKWMAGRM

SEQ ID NO: 163837 - protein, 9 aa, Yellow fever virus
EKWMAGRMG

SEQ ID NO: 163838 - protein, 9 aa, Yellow fever virus
KWMAGRMGE

SEQ ID NO: 163839 - protein, 9 aa, Yellow fever virus
WMAGRMGER

SEQ ID NO: 163840 - protein, 9 aa, Yellow fever virus
MAGRMGERQ

SEQ ID NO: 163841 - protein, 9 aa, Yellow fever virus
AGRMGERQL

SEQ ID NO: 163842 - protein, 9 aa, Yellow fever virus
QLQKIERWL

SEQ ID NO: 163843 - protein, 9 aa, Yellow fever virus
LQKIERWLV

SEQ ID NO: 163844 - protein, 9 aa, Yellow fever virus
QKIERWLVR

SEQ ID NO: 163845 - protein, 9 aa, Yellow fever virus
KIERWLVRN

SEQ ID NO: 163846 - protein, 9 aa, Yellow fever virus
IERWLVRNP

SEQ ID NO: 163847 - protein, 9 aa, Yellow fever virus
ERWLVRNPF

SEQ ID NO: 163848 - protein, 9 aa, Yellow fever virus
RWLVRNPFF

SEQ ID NO: 163849 - protein, 9 aa, Yellow fever virus
WLVRNPFFA

SEQ ID NO: 163850 - protein, 9 aa, Yellow fever virus
LVRNPFFAV

SEQ ID NO: 163851 - protein, 9 aa, Yellow fever virus
VRNPFFAIT

SEQ ID NO: 163852 - protein, 9 aa, Yellow fever virus
RNPFFAITA

SEQ ID NO: 163853 - protein, 9 aa, Yellow fever virus
NPFFAITAL

SEQ ID NO: 163854 - protein, 9 aa, Yellow fever virus
PFFAVTALA

SEQ ID NO: 163855 - protein, 9 aa, Yellow fever virus
FFAVTALAI

SEQ ID NO: 163856 - protein, 9 aa, Yellow fever virus
FAVTALAIA

SEQ ID NO: 163857 - protein, 9 aa, Yellow fever virus
AVTALAIAY

SEQ ID NO: 163858 - protein, 9 aa, Yellow fever virus
VTALAIAYL

SEQ ID NO: 163859 - protein, 9 aa, Yellow fever virus
TALAIAYLV

SEQ ID NO: 163860 - protein, 9 aa, Yellow fever virus
ALAIAYLVG

SEQ ID NO: 163861 - protein, 9 aa, Yellow fever virus
LAIAYLVGN

SEQ ID NO: 163862 - protein, 9 aa, Yellow fever virus
AIAYLVGNN

SEQ ID NO: 163863 - protein, 9 aa, Yellow fever virus
IAYLVGNNT

SEQ ID NO: 163864 - protein, 9 aa, Yellow fever virus
AYLVGNNKT

SEQ ID NO: 163865 - protein, 9 aa, Yellow fever virus
YLVGNNMTQ

SEQ ID NO: 163866 - protein, 9 aa, Yellow fever virus
LVGNNKTQR

SEQ ID NO: 163867 - protein, 9 aa, Yellow fever virus
VGNNKTQRV

SEQ ID NO: 163868 - protein, 9 aa, Yellow fever virus
GNNTTQRVV

SEQ ID NO: 163869 - protein, 9 aa, Yellow fever virus
NNTTQRVVI

SEQ ID NO: 163870 - protein, 9 aa, Yellow fever virus
NKTQRVVIA

SEQ ID NO: 163871 - protein, 9 aa, Yellow fever virus
TTQRVVIAL

SEQ ID NO: 163872 - protein, 9 aa, Yellow fever virus
AYSAHCIGV

SEQ ID NO: 163873 - protein, 9 aa, Yellow fever virus
YSAHCIGVA

SEQ ID NO: 163874 - protein, 9 aa, Yellow fever virus
SAHCIGVAD

SEQ ID NO: 163875 - protein, 9 aa, Yellow fever virus
AHCIGVADR

SEQ ID NO: 163876 - protein, 9 aa, Yellow fever virus
HCIGVADRD

SEQ ID NO: 163877 - protein, 9 aa, Yellow fever virus
CIGVADRDF

SEQ ID NO: 163878 - protein, 9 aa, Yellow fever virus
IGVADRDFI

SEQ ID NO: 163879 - protein, 9 aa, Yellow fever virus
GVADRDFIE

SEQ ID NO: 163880 - protein, 9 aa, Yellow fever virus
VADRDFIEG

SEQ ID NO: 163881 - protein, 9 aa, Yellow fever virus
ADRDFIEGV

SEQ ID NO: 163882 - protein, 9 aa, Yellow fever virus
HGGTWVSAS

SEQ ID NO: 163883 - protein, 9 aa, Yellow fever virus
GGTWVSASL

SEQ ID NO: 163884 - protein, 9 aa, Yellow fever virus
GTWVSASLE

SEQ ID NO: 163885 - protein, 9 aa, Yellow fever virus
TWVSASLEQ

SEQ ID NO: 163886 - protein, 9 aa, Yellow fever virus
WVSASLEQD

SEQ ID NO: 163887 - protein, 9 aa, Yellow fever virus
VSATLEQGK

SEQ ID NO: 163888 - protein, 9 aa, Yellow fever virus
SASLEQDKC

SEQ ID NO: 163889 - protein, 9 aa, Yellow fever virus
ATLEQGKCV

SEQ ID NO: 163890 - protein, 9 aa, Yellow fever virus
SLEQDKCVT

SEQ ID NO: 163891 - protein, 9 aa, Yellow fever virus
LEQGKCVTV

SEQ ID NO: 163892 - protein, 9 aa, Yellow fever virus
EQGKCVTVM

SEQ ID NO: 163893 - protein, 9 aa, Yellow fever virus
QGKCVTVMA

SEQ ID NO: 163894 - protein, 9 aa, Yellow fever virus
GKCVTVMAP

SEQ ID NO: 163895 - protein, 9 aa, Yellow fever virus
KPSLDISLQ

SEQ ID NO: 163896 - protein, 9 aa, Yellow fever virus
PSLDISLQT

SEQ ID NO: 163897 - protein, 9 aa, Yellow fever virus
SLDISLQTV

SEQ ID NO: 163898 - protein, 9 aa, Yellow fever virus
LDISLQTVA

SEQ ID NO: 163899 - protein, 9 aa, Yellow fever virus
DISLQTVAI

SEQ ID NO: 163900 - protein, 9 aa, Yellow fever virus
ISLQTVAID

SEQ ID NO: 163901 - protein, 9 aa, Yellow fever virus
SLETVAIDG

SEQ ID NO: 163902 - protein, 9 aa, Yellow fever virus
LETVAIDGP

SEQ ID NO: 163903 - protein, 9 aa, Yellow fever virus
ETVAIDGPA

SEQ ID NO: 163904 - protein, 9 aa, Yellow fever virus
TVAIDGPAE

SEQ ID NO: 163905 - protein, 9 aa, Yellow fever virus
VAIDGPAEA

SEQ ID NO: 163906 - protein, 9 aa, Yellow fever virus
AIDGPAEAR

SEQ ID NO: 163907 - protein, 9 aa, Yellow fever virus
IDGPAEARK

SEQ ID NO: 163908 - protein, 9 aa, Yellow fever virus
DGPAEARKV

SEQ ID NO: 163909 - protein, 9 aa, Yellow fever virus
GPAEARKVC

SEQ ID NO: 163910 - protein, 9 aa, Yellow fever virus
PAEVRKVCY

SEQ ID NO: 163911 - protein, 9 aa, Yellow fever virus
AEARKVCYN

SEQ ID NO: 163912 - protein, 9 aa, Yellow fever virus
EARKVCYNA

SEQ ID NO: 163913 - protein, 9 aa, Yellow fever virus
ARKVCYNAV

SEQ ID NO: 163914 - protein, 9 aa, Yellow fever virus
RKVCYSAVL

SEQ ID NO: 163915 - protein, 9 aa, Yellow fever virus
KVCYSAVLT

SEQ ID NO: 163916 - protein, 9 aa, Yellow fever virus
VCYSAVLTH

SEQ ID NO: 163917 - protein, 9 aa, Yellow fever virus
CYSAVLTHV

SEQ ID NO: 163918 - protein, 9 aa, Yellow fever virus
YSAVLTHVK

SEQ ID NO: 163919 - protein, 9 aa, Yellow fever virus
SAVLTHVKI

SEQ ID NO: 163920 - protein, 9 aa, Yellow fever virus
AVLTHVKID

SEQ ID NO: 163921 - protein, 9 aa, Yellow fever virus
VLTHVKIDD

SEQ ID NO: 163922 - protein, 9 aa, Yellow fever virus
LTHVKIDDK

SEQ ID NO: 163923 - protein, 9 aa, Yellow fever virus
THVKIDDKC

SEQ ID NO: 163924 - protein, 9 aa, Yellow fever virus
HVKIDDKCP

SEQ ID NO: 163925 - protein, 9 aa, Yellow fever virus
VKIDDKCPS

SEQ ID NO: 163926 - protein, 9 aa, Yellow fever virus
KIDDKCPST

SEQ ID NO: 163927 - protein, 9 aa, Yellow fever virus
IDDKCPSTG

SEQ ID NO: 163928 - protein, 9 aa, Yellow fever virus
DDKCPSTGE

SEQ ID NO: 163929 - protein, 9 aa, Yellow fever virus
EAHLAEEND

SEQ ID NO: 163930 - protein, 9 aa, Yellow fever virus
AHLAEENDG

SEQ ID NO: 163931 - protein, 9 aa, Yellow fever virus
HLAEENDGD

SEQ ID NO: 163932 - protein, 9 aa, Yellow fever virus
LAEENDGDN

SEQ ID NO: 163933 - protein, 9 aa, Yellow fever virus
AEENDGDNA

SEQ ID NO: 163934 - protein, 9 aa, Yellow fever virus
EENDGDNAC

SEQ ID NO: 163935 - protein, 9 aa, Yellow fever virus
ENDGDNACK

SEQ ID NO: 163936 - protein, 9 aa, Yellow fever virus
NDGDNACKR

SEQ ID NO: 163937 - protein, 9 aa, Yellow fever virus
DGDNACKRT

SEQ ID NO: 163938 - protein, 9 aa, Yellow fever virus
QTKIQYVIK

SEQ ID NO: 163939 - protein, 9 aa, Yellow fever virus
TKIQYVIKA

SEQ ID NO: 163940 - protein, 9 aa, Yellow fever virus
KIQYVIRAR

SEQ ID NO: 163941 - protein, 9 aa, Yellow fever virus
IQYVIRARL

SEQ ID NO: 163942 - protein, 9 aa, Yellow fever virus
QYVIKAQLH

SEQ ID NO: 163943 - protein, 9 aa, Yellow fever virus
YVIKAQLHV

SEQ ID NO: 163944 - protein, 9 aa, Yellow fever virus
VIKAQLHVG

SEQ ID NO: 163945 - protein, 9 aa, Yellow fever virus
IKAQLHVGA

SEQ ID NO: 163946 - protein, 9 aa, Yellow fever virus
RARLHVGAK

SEQ ID NO: 163947 - protein, 9 aa, Yellow fever virus
ARLHVGAKQ

SEQ ID NO: 163948 - protein, 9 aa, Yellow fever virus
RLHVGAKQE

SEQ ID NO: 163949 - protein, 9 aa, Yellow fever virus
LHVGAKQED

SEQ ID NO: 163950 - protein, 9 aa, Yellow fever virus
HVGAKQEDW

SEQ ID NO: 163951 - protein, 9 aa, Yellow fever virus
VGAKQENWT

SEQ ID NO: 163952 - protein, 9 aa, Yellow fever virus
GAKQENWTT

SEQ ID NO: 163953 - protein, 9 aa, Yellow fever virus
AKQENWTTD

SEQ ID NO: 163954 - protein, 9 aa, Yellow fever virus
KQENWTTDI

SEQ ID NO: 163955 - protein, 9 aa, Yellow fever virus
QENWTTDIK

SEQ ID NO: 163956 - protein, 9 aa, Yellow fever virus
ENWTTDIKT

SEQ ID NO: 163957 - protein, 9 aa, Yellow fever virus
NWTTDIKTL

SEQ ID NO: 163958 - protein, 9 aa, Yellow fever virus
WTTDIKTLK

SEQ ID NO: 163959 - protein, 9 aa, Yellow fever virus
TTDIKTLKF

SEQ ID NO: 163960 - protein, 9 aa, Yellow fever virus
TSIKTLKFD

SEQ ID NO: 163961 - protein, 9 aa, Yellow fever virus
SIKTLKFDA

SEQ ID NO: 163962 - protein, 9 aa, Yellow fever virus
IKTLKFDVL

SEQ ID NO: 163963 - protein, 9 aa, Yellow fever virus
KTLKFDVLS

SEQ ID NO: 163964 - protein, 9 aa, Yellow fever virus
TLKFDVLSG

SEQ ID NO: 163965 - protein, 9 aa, Yellow fever virus
LKFDVLSGS

SEQ ID NO: 163966 - protein, 9 aa, Yellow fever virus
KFDVLSGSQ

SEQ ID NO: 163967 - protein, 9 aa, Yellow fever virus
FDVLSGSQE

SEQ ID NO: 163968 - protein, 9 aa, Yellow fever virus
DALSGSQEA

SEQ ID NO: 163969 - protein, 9 aa, Yellow fever virus
ALSGSQEAE

SEQ ID NO: 163970 - protein, 9 aa, Yellow fever virus
LSGSQEAEF

SEQ ID NO: 163971 - protein, 9 aa, Yellow fever virus
SGSQEAEFT

SEQ ID NO: 163972 - protein, 9 aa, Yellow fever virus
GSQEAEFTG

SEQ ID NO: 163973 - protein, 9 aa, Yellow fever virus
SQEAEFTGY

SEQ ID NO: 163974 - protein, 9 aa, Yellow fever virus
QEAEFTGYG

SEQ ID NO: 163975 - protein, 9 aa, Yellow fever virus
EAEFTGYGK

SEQ ID NO: 163976 - protein, 9 aa, Yellow fever virus
AEFTGYGKA

SEQ ID NO: 163977 - protein, 9 aa, Yellow fever virus
EFTGYGKAT

SEQ ID NO: 163978 - protein, 9 aa, Yellow fever virus
FTGYGKATL

SEQ ID NO: 163979 - protein, 9 aa, Yellow fever virus
TGYGKATLE

SEQ ID NO: 163980 - protein, 9 aa, Yellow fever virus
GYGKVTLEC

SEQ ID NO: 163981 - protein, 9 aa, Yellow fever virus
YGKATLECR

SEQ ID NO: 163982 - protein, 9 aa, Yellow fever virus
GKATLECRV

SEQ ID NO: 163983 - protein, 9 aa, Yellow fever virus
KVTLECQVQ

SEQ ID NO: 163984 - protein, 9 aa, Yellow fever virus
ATLECRVQT

SEQ ID NO: 163985 - protein, 9 aa, Yellow fever virus
TLECRVQTA

SEQ ID NO: 163986 - protein, 9 aa, Yellow fever virus
LECRVQTAV

SEQ ID NO: 163987 - protein, 9 aa, Yellow fever virus
ECRVQTAVD

SEQ ID NO: 163988 - protein, 9 aa, Yellow fever virus
CRVQTAVDF

SEQ ID NO: 163989 - protein, 9 aa, Yellow fever virus
RVQTAVDFG

SEQ ID NO: 163990 - protein, 9 aa, Yellow fever virus
NSYIAEMEK

SEQ ID NO: 163991 - protein, 9 aa, Yellow fever virus
SYIAEMEKE

SEQ ID NO: 163992 - protein, 9 aa, Yellow fever virus
YIAEMEKES

SEQ ID NO: 163993 - protein, 9 aa, Yellow fever virus
IAEMEKESW

SEQ ID NO: 163994 - protein, 9 aa, Yellow fever virus
AEMEKESWI

SEQ ID NO: 163995 - protein, 9 aa, Yellow fever virus
EMEKESWIV

SEQ ID NO: 163996 - protein, 9 aa, Yellow fever virus
MEKESWIVD

SEQ ID NO: 163997 - protein, 9 aa, Yellow fever virus
EKESWIVDR

SEQ ID NO: 163998 - protein, 9 aa, Yellow fever virus
KESWIVDRQ

SEQ ID NO: 163999 - protein, 9 aa, Yellow fever virus
DSWIVDRQW

SEQ ID NO: 164000 - protein, 9 aa, Yellow fever virus
PWQSGSGGI

SEQ ID NO: 164001 - protein, 9 aa, Yellow fever virus
WQSGSGGIW

SEQ ID NO: 164002 - protein, 9 aa, Yellow fever virus
QSGSGGIWR

SEQ ID NO: 164003 - protein, 9 aa, Yellow fever virus
SGSGGIWRE

SEQ ID NO: 164004 - protein, 9 aa, Yellow fever virus
GSGGIWREM

SEQ ID NO: 164005 - protein, 9 aa, Yellow fever virus
SGGIWREMH

SEQ ID NO: 164006 - protein, 9 aa, Yellow fever virus
GGIWREMHH

SEQ ID NO: 164007 - protein, 9 aa, Yellow fever virus
GIWREMHHL

SEQ ID NO: 164008 - protein, 9 aa, Yellow fever virus
IWREMHHLV

SEQ ID NO: 164009 - protein, 9 aa, Yellow fever virus
WRGMHHLVE

SEQ ID NO: 164010 - protein, 9 aa, Yellow fever virus
RGMHHLVEF

SEQ ID NO: 164011 - protein, 9 aa, Yellow fever virus
GMHHLVEFE

SEQ ID NO: 164012 - protein, 9 aa, Yellow fever virus
VEFEPPHAV

SEQ ID NO: 164013 - protein, 9 aa, Yellow fever virus
EFEPPHAVT

SEQ ID NO: 164014 - protein, 9 aa, Yellow fever virus
FEPPHAVTI

SEQ ID NO: 164015 - protein, 9 aa, Yellow fever virus
EPPHAVTIR

SEQ ID NO: 164016 - protein, 9 aa, Yellow fever virus
PPHAVTIRV

SEQ ID NO: 164017 - protein, 9 aa, Yellow fever virus
PHAVTIRVL

SEQ ID NO: 164018 - protein, 9 aa, Yellow fever virus
HAVTIRVLA

SEQ ID NO: 164019 - protein, 9 aa, Yellow fever virus
AVTIRVLAL

SEQ ID NO: 164020 - protein, 9 aa, Yellow fever virus
VTIRVLALG

SEQ ID NO: 164021 - protein, 9 aa, Yellow fever virus
TIRVLALGD

SEQ ID NO: 164022 - protein, 9 aa, Yellow fever virus
IRVLALGDQ

SEQ ID NO: 164023 - protein, 9 aa, Yellow fever virus
RVLALGDQE

SEQ ID NO: 164024 - protein, 9 aa, Yellow fever virus
VLALGDQEG

SEQ ID NO: 164025 - protein, 9 aa, Yellow fever virus
LALGDQEGS

SEQ ID NO: 164026 - protein, 9 aa, Yellow fever virus
ALGDQEGSL

SEQ ID NO: 164027 - protein, 9 aa, Yellow fever virus
LGDQEGSLK

SEQ ID NO: 164028 - protein, 9 aa, Yellow fever virus
GDQEGSLKT

SEQ ID NO: 164029 - protein, 9 aa, Yellow fever virus
DQEGSLKTA

SEQ ID NO: 164030 - protein, 9 aa, Yellow fever virus
GAMRVTKDE

SEQ ID NO: 164031 - protein, 9 aa, Yellow fever virus
AMRVTKDEN

SEQ ID NO: 164032 - protein, 9 aa, Yellow fever virus
MRVTKDEND

SEQ ID NO: 164033 - protein, 9 aa, Yellow fever virus
RVTKDENDN

SEQ ID NO: 164034 - protein, 9 aa, Yellow fever virus
VTKDENDNN

SEQ ID NO: 164035 - protein, 9 aa, Yellow fever virus
TKDENDNNL

SEQ ID NO: 164036 - protein, 9 aa, Yellow fever virus
KDENDNNLY

SEQ ID NO: 164037 - protein, 9 aa, Yellow fever virus
DENDNNLYK

SEQ ID NO: 164038 - protein, 9 aa, Yellow fever virus
ENDNNLYKL

SEQ ID NO: 164039 - protein, 9 aa, Yellow fever virus
TLKGTSYKM

SEQ ID NO: 164040 - protein, 9 aa, Yellow fever virus
LKGTSYKMC

SEQ ID NO: 164041 - protein, 9 aa, Yellow fever virus
KGTSYKMCT

SEQ ID NO: 164042 - protein, 9 aa, Yellow fever virus
GTSYKMCTD

SEQ ID NO: 164043 - protein, 9 aa, Yellow fever virus
TSYKMCTDK

SEQ ID NO: 164044 - protein, 9 aa, Yellow fever virus
SYKMCTDKM

SEQ ID NO: 164045 - protein, 9 aa, Yellow fever virus
YKMCTDKMS

SEQ ID NO: 164046 - protein, 9 aa, Yellow fever virus
KMCTDKMSF

SEQ ID NO: 164047 - protein, 9 aa, Yellow fever virus
MCTDKMSFV

SEQ ID NO: 164048 - protein, 9 aa, Yellow fever virus
CTDKMSFVK

SEQ ID NO: 164049 - protein, 9 aa, Yellow fever virus
TDKMSFVKN

SEQ ID NO: 164050 - protein, 9 aa, Yellow fever virus
DKMSFVKNP

SEQ ID NO: 164051 - protein, 9 aa, Yellow fever virus
KMSFVKNPT

SEQ ID NO: 164052 - protein, 9 aa, Yellow fever virus
MSFVKNPTD

SEQ ID NO: 164053 - protein, 9 aa, Yellow fever virus
SFVKNPTDT

SEQ ID NO: 164054 - protein, 9 aa, Yellow fever virus
FVKNPTDTD

SEQ ID NO: 164055 - protein, 9 aa, Yellow fever virus
VKNPTDTDH

SEQ ID NO: 164056 - protein, 9 aa, Yellow fever virus
KNPTDTDHG

SEQ ID NO: 164057 - protein, 9 aa, Yellow fever virus
NPTDTDHGT

SEQ ID NO: 164058 - protein, 9 aa, Yellow fever virus
PTDTDHGTV

SEQ ID NO: 164059 - protein, 9 aa, Yellow fever virus
TDTDHGTVV

SEQ ID NO: 164060 - protein, 9 aa, Yellow fever virus
DTDHGTVVM

SEQ ID NO: 164061 - protein, 9 aa, Yellow fever virus
TDHGTVVMQ

SEQ ID NO: 164062 - protein, 9 aa, Yellow fever virus
DHGTVVMQV

SEQ ID NO: 164063 - protein, 9 aa, Yellow fever virus
TVVMQVKVS

SEQ ID NO: 164064 - protein, 9 aa, Yellow fever virus
VVMQVKVSK

SEQ ID NO: 164065 - protein, 9 aa, Yellow fever virus
VMQVKVSKG

SEQ ID NO: 164066 - protein, 9 aa, Yellow fever virus
MQVKVSKGA

SEQ ID NO: 164067 - protein, 9 aa, Yellow fever virus
QVKVSKGAP

SEQ ID NO: 164068 - protein, 9 aa, Yellow fever virus
VKVSKGAPC

SEQ ID NO: 164069 - protein, 9 aa, Yellow fever virus
KVPKGAPCK

SEQ ID NO: 164070 - protein, 9 aa, Yellow fever virus
VPKGAPCKI

SEQ ID NO: 164071 - protein, 9 aa, Yellow fever virus
PKGAPCKIP

SEQ ID NO: 164072 - protein, 9 aa, Yellow fever virus
KGAPCKIPV

SEQ ID NO: 164073 - protein, 9 aa, Yellow fever virus
GAPCKIPVI

SEQ ID NO: 164074 - protein, 9 aa, Yellow fever virus
APCKIPVIV

SEQ ID NO: 164075 - protein, 9 aa, Yellow fever virus
PCKIPVIVA

SEQ ID NO: 164076 - protein, 9 aa, Yellow fever virus
CKIPVIVAD

SEQ ID NO: 164077 - protein, 9 aa, Yellow fever virus
KIPVIVADD

SEQ ID NO: 164078 - protein, 9 aa, Yellow fever virus
VADDLTAAV

SEQ ID NO: 164079 - protein, 9 aa, Yellow fever virus
ADDLTAAVN

SEQ ID NO: 164080 - protein, 9 aa, Yellow fever virus
DDLTAAVNK

SEQ ID NO: 164081 - protein, 9 aa, Yellow fever virus
DLTAAVNKG

SEQ ID NO: 164082 - protein, 9 aa, Yellow fever virus
LTAAVNKGI

SEQ ID NO: 164083 - protein, 9 aa, Yellow fever virus
TAAVNKGIL

SEQ ID NO: 164084 - protein, 9 aa, Yellow fever virus
AAVNKGILV

SEQ ID NO: 164085 - protein, 9 aa, Yellow fever virus
AVNKGILVT

SEQ ID NO: 164086 - protein, 9 aa, Yellow fever virus
VNKGILVTV

SEQ ID NO: 164087 - protein, 9 aa, Yellow fever virus
PFGDSYIII

SEQ ID NO: 164088 - protein, 9 aa, Yellow fever virus
FGDSYIIIG

SEQ ID NO: 164089 - protein, 9 aa, Yellow fever virus
GDSYIIVGT

SEQ ID NO: 164090 - protein, 9 aa, Yellow fever virus
DSYIIVGTG

SEQ ID NO: 164091 - protein, 9 aa, Yellow fever virus
SYIIVGTGD

SEQ ID NO: 164092 - protein, 9 aa, Yellow fever virus
YIIVGTGDS

SEQ ID NO: 164093 - protein, 9 aa, Yellow fever virus
IIVGTGDSR

SEQ ID NO: 164094 - protein, 9 aa, Yellow fever virus
IVGTGDSRL

SEQ ID NO: 164095 - protein, 9 aa, Yellow fever virus
VGTGDSRLT

SEQ ID NO: 164096 - protein, 9 aa, Yellow fever virus
GTGDSRLTY

SEQ ID NO: 164097 - protein, 9 aa, Yellow fever virus
TGDSRLTYQ

SEQ ID NO: 164098 - protein, 9 aa, Yellow fever virus
LFTQTMKGA

SEQ ID NO: 164099 - protein, 9 aa, Yellow fever virus
FTQTMKGAE

SEQ ID NO: 164100 - protein, 9 aa, Yellow fever virus
TQTMKGAER

SEQ ID NO: 164101 - protein, 9 aa, Yellow fever virus
QTMKGAERL

SEQ ID NO: 164102 - protein, 9 aa, Yellow fever virus
TMKGAERLA

SEQ ID NO: 164103 - protein, 9 aa, Yellow fever virus
MKGAERLAV

SEQ ID NO: 164104 - protein, 9 aa, Yellow fever virus
KGAERLAVM

SEQ ID NO: 164105 - protein, 9 aa, Yellow fever virus
GAERLAVMG

SEQ ID NO: 164106 - protein, 9 aa, Yellow fever virus
AERLAVMGD

SEQ ID NO: 164107 - protein, 9 aa, Yellow fever virus
ERLAVMGDA

SEQ ID NO: 164108 - protein, 9 aa, Yellow fever virus
RLAVMGDAA

SEQ ID NO: 164109 - protein, 9 aa, Yellow fever virus
LAVMGDAAW

SEQ ID NO: 164110 - protein, 9 aa, Yellow fever virus
AVMGDAAWD

SEQ ID NO: 164111 - protein, 9 aa, Yellow fever virus
VMGDAAWDF

SEQ ID NO: 164112 - protein, 9 aa, Yellow fever virus
MGDAAWDFS

SEQ ID NO: 164113 - protein, 9 aa, Yellow fever virus
GDAAWDFSS

SEQ ID NO: 164114 - protein, 9 aa, Yellow fever virus
DAAWDFSSA

SEQ ID NO: 164115 - protein, 9 aa, Yellow fever virus
AAWDFSSAG

SEQ ID NO: 164116 - protein, 9 aa, Yellow fever virus
WDFSSAGGL

SEQ ID NO: 164117 - protein, 9 aa, Yellow fever virus
DFSSAGGFL

SEQ ID NO: 164118 - protein, 9 aa, Yellow fever virus
FSSAGGLFT

SEQ ID NO: 164119 - protein, 9 aa, Yellow fever virus
SSAGGFLTS

SEQ ID NO: 164120 - protein, 9 aa, Yellow fever virus
SAGGLFTSI

SEQ ID NO: 164121 - protein, 9 aa, Yellow fever virus
AGGFLTSVG

SEQ ID NO: 164122 - protein, 9 aa, Yellow fever virus
GGFLTSVGK

SEQ ID NO: 164123 - protein, 9 aa, Yellow fever virus
GFLTSVGKG

SEQ ID NO: 164124 - protein, 9 aa, Yellow fever virus
LFTSIGKGS

SEQ ID NO: 164125 - protein, 9 aa, Yellow fever virus
FTSIGKGSH

SEQ ID NO: 164126 - protein, 9 aa, Yellow fever virus
TSIGKGSHT

SEQ ID NO: 164127 - protein, 9 aa, Yellow fever virus
SIGKGSHTV

SEQ ID NO: 164128 - protein, 9 aa, Yellow fever virus
IGKGSHTVF

SEQ ID NO: 164129 - protein, 9 aa, Yellow fever virus
GKGSHTVFG

SEQ ID NO: 164130 - protein, 9 aa, Yellow fever virus
KGSHTVFGS

SEQ ID NO: 164131 - protein, 9 aa, Yellow fever virus
GSHTVFGSA

SEQ ID NO: 164132 - protein, 9 aa, Yellow fever virus
SHTVFGSAF

SEQ ID NO: 164133 - protein, 9 aa, Yellow fever virus
FQGLFGGLS

SEQ ID NO: 164134 - protein, 9 aa, Yellow fever virus
QGLFGGLSW

SEQ ID NO: 164135 - protein, 9 aa, Yellow fever virus
GLFGGLSWI

SEQ ID NO: 164136 - protein, 9 aa, Yellow fever virus
LFGGLSWIT

SEQ ID NO: 164137 - protein, 9 aa, Yellow fever virus
FGGLSWITK

SEQ ID NO: 164138 - protein, 9 aa, Yellow fever virus
GGLSWITKV

SEQ ID NO: 164139 - protein, 9 aa, Yellow fever virus
GLSWITKVI

SEQ ID NO: 164140 - protein, 9 aa, Yellow fever virus
LSWITKVIM

SEQ ID NO: 164141 - protein, 9 aa, Yellow fever virus
SWITKVIMG

SEQ ID NO: 164142 - protein, 9 aa, Yellow fever virus
WITKVIMGV

SEQ ID NO: 164143 - protein, 9 aa, Yellow fever virus
ITKVIMGVV

SEQ ID NO: 164144 - protein, 9 aa, Yellow fever virus
TKVIIGAVL

SEQ ID NO: 164145 - protein, 9 aa, Yellow fever virus
KVIMGVVLI

SEQ ID NO: 164146 - protein, 9 aa, Yellow fever virus
VIMGVVLIW

SEQ ID NO: 164147 - protein, 9 aa, Yellow fever virus
IMGVVLIWV

SEQ ID NO: 164148 - protein, 9 aa, Yellow fever virus
MGVVLIWVG

SEQ ID NO: 164149 - protein, 9 aa, Yellow fever virus
GAVLIWVGF

SEQ ID NO: 164150 - protein, 9 aa, Yellow fever virus
AVLIWVGFN

SEQ ID NO: 164151 - protein, 9 aa, Yellow fever virus
VLIWVGFNT

SEQ ID NO: 164152 - protein, 9 aa, Yellow fever virus
LIWVGFNTR

SEQ ID NO: 164153 - protein, 9 aa, Yellow fever virus
IWVGFNTRN

SEQ ID NO: 164154 - protein, 9 aa, Yellow fever virus
WVGFNTRNM

SEQ ID NO: 164155 - protein, 9 aa, Yellow fever virus
VGFNTRNMT

SEQ ID NO: 164156 - protein, 9 aa, Yellow fever virus
GFNTRNMTM

SEQ ID NO: 164157 - protein, 9 aa, Yellow fever virus
FNTRNMTMS

SEQ ID NO: 164158 - protein, 9 aa, Yellow fever virus
MTMSMSMIM

SEQ ID NO: 164159 - protein, 9 aa, Yellow fever virus
TMSMSMIMV

SEQ ID NO: 164160 - protein, 9 aa, Yellow fever virus
MSMSMIMVG

SEQ ID NO: 164161 - protein, 9 aa, Yellow fever virus
SMSMIMVGV

SEQ ID NO: 164162 - protein, 9 aa, Yellow fever virus
MSMIMVGVI

SEQ ID NO: 164163 - protein, 9 aa, Yellow fever virus
SMIMVGVIM

SEQ ID NO: 164164 - protein, 9 aa, Yellow fever virus
MIMVGVIMM

SEQ ID NO: 164165 - protein, 9 aa, Yellow fever virus
IMVGVIMMF

SEQ ID NO: 164166 - protein, 9 aa, Yellow fever virus
MVGVIMMFL

SEQ ID NO: 164167 - protein, 9 aa, Yellow fever virus
VGADQGCAV

SEQ ID NO: 164168 - protein, 9 aa, Yellow fever virus
GADQGCAVN

SEQ ID NO: 164169 - protein, 9 aa, Yellow fever virus
ADQGCAVNF

SEQ ID NO: 164170 - protein, 9 aa, Yellow fever virus
DQGCAVNFG

SEQ ID NO: 164171 - protein, 9 aa, Yellow fever virus
QGCAVNFGK

SEQ ID NO: 164172 - protein, 9 aa, Yellow fever virus
GCAVNFGKR

SEQ ID NO: 164173 - protein, 9 aa, Yellow fever virus
CAVNFGKRE

SEQ ID NO: 164174 - protein, 9 aa, Yellow fever virus
AVNFGKREL

SEQ ID NO: 164175 - protein, 9 aa, Yellow fever virus
VNFGKRELK

SEQ ID NO: 164176 - protein, 9 aa, Yellow fever virus
NFAKRELKC

SEQ ID NO: 164177 - protein, 9 aa, Yellow fever virus
FAKRELKCG

SEQ ID NO: 164178 - protein, 9 aa, Yellow fever virus
AKRELKCGD

SEQ ID NO: 164179 - protein, 9 aa, Yellow fever virus
LKCGDGIFV

SEQ ID NO: 164180 - protein, 9 aa, Yellow fever virus
KCGDGIFVF

SEQ ID NO: 164181 - protein, 9 aa, Yellow fever virus
CGDGIFVFR

SEQ ID NO: 164182 - protein, 9 aa, Yellow fever virus
GDGIFVFRD

SEQ ID NO: 164183 - protein, 9 aa, Yellow fever virus
DGIFVFRDS

SEQ ID NO: 164184 - protein, 9 aa, Yellow fever virus
GIFVFRDSD

SEQ ID NO: 164185 - protein, 9 aa, Yellow fever virus
IFVFRDSDD

SEQ ID NO: 164186 - protein, 9 aa, Yellow fever virus
FVFRDSDDW

SEQ ID NO: 164187 - protein, 9 aa, Yellow fever virus
VFRDSDDWL

SEQ ID NO: 164188 - protein, 9 aa, Yellow fever virus
FRDSDDWLT

SEQ ID NO: 164189 - protein, 9 aa, Yellow fever virus
RDSDDWLTK

SEQ ID NO: 164190 - protein, 9 aa, Yellow fever virus
DSDDWLTKY

SEQ ID NO: 164191 - protein, 9 aa, Yellow fever virus
SDDWLTKYS

SEQ ID NO: 164192 - protein, 9 aa, Yellow fever virus
DDWLTKYSY

SEQ ID NO: 164193 - protein, 9 aa, Yellow fever virus
DWLTKYSYY

SEQ ID NO: 164194 - protein, 9 aa, Yellow fever virus
WLTKYSYYP

SEQ ID NO: 164195 - protein, 9 aa, Yellow fever virus
LTKYSYYPE

SEQ ID NO: 164196 - protein, 9 aa, Yellow fever virus
TKYSYYPED

SEQ ID NO: 164197 - protein, 9 aa, Yellow fever virus
DPVKLASII

SEQ ID NO: 164198 - protein, 9 aa, Yellow fever virus
PVKLASIIK

SEQ ID NO: 164199 - protein, 9 aa, Yellow fever virus
VKLASIIKA

SEQ ID NO: 164200 - protein, 9 aa, Yellow fever virus
KLASIIKAS

SEQ ID NO: 164201 - protein, 9 aa, Yellow fever virus
LASIIKASH

SEQ ID NO: 164202 - protein, 9 aa, Yellow fever virus
ASIIKASHE

SEQ ID NO: 164203 - protein, 9 aa, Yellow fever virus
SIIKASHEE

SEQ ID NO: 164204 - protein, 9 aa, Yellow fever virus
IIKASHEEG

SEQ ID NO: 164205 - protein, 9 aa, Yellow fever virus
IKASHEEGK

SEQ ID NO: 164206 - protein, 9 aa, Yellow fever virus
KASHEEGKC

SEQ ID NO: 164207 - protein, 9 aa, Yellow fever virus
ASHEEGKCG

SEQ ID NO: 164208 - protein, 9 aa, Yellow fever virus
SHEEGKCGL

SEQ ID NO: 164209 - protein, 9 aa, Yellow fever virus
HEEGKCGLN

SEQ ID NO: 164210 - protein, 9 aa, Yellow fever virus
GLNSVDSLD

SEQ ID NO: 164211 - protein, 9 aa, Yellow fever virus
LNSVDSLDH

SEQ ID NO: 164212 - protein, 9 aa, Yellow fever virus
NSVDSLDHE

SEQ ID NO: 164213 - protein, 9 aa, Yellow fever virus
SVDSLDHEM

SEQ ID NO: 164214 - protein, 9 aa, Yellow fever virus
VDSLDHEMW

SEQ ID NO: 164215 - protein, 9 aa, Yellow fever virus
DSLDHEMWR

SEQ ID NO: 164216 - protein, 9 aa, Yellow fever virus
SLDHEMWRS

SEQ ID NO: 164217 - protein, 9 aa, Yellow fever virus
LDHEMWRSR

SEQ ID NO: 164218 - protein, 9 aa, Yellow fever virus
DHEMWRSRA

SEQ ID NO: 164219 - protein, 9 aa, Yellow fever virus
RADEINAIL

SEQ ID NO: 164220 - protein, 9 aa, Yellow fever virus
ADEINAILE

SEQ ID NO: 164221 - protein, 9 aa, Yellow fever virus
DEINAILEE

SEQ ID NO: 164222 - protein, 9 aa, Yellow fever virus
EINAILEEN

SEQ ID NO: 164223 - protein, 9 aa, Yellow fever virus
INAILEENE

SEQ ID NO: 164224 - protein, 9 aa, Yellow fever virus
NAILEENEV

SEQ ID NO: 164225 - protein, 9 aa, Yellow fever virus
AILEENEVD

SEQ ID NO: 164226 - protein, 9 aa, Yellow fever virus
ILEENEVDI

SEQ ID NO: 164227 - protein, 9 aa, Yellow fever virus
LEENEVDIS

SEQ ID NO: 164228 - protein, 9 aa, Yellow fever virus
EENEVDISI

SEQ ID NO: 164229 - protein, 9 aa, Yellow fever virus
ENEVDISIV

SEQ ID NO: 164230 - protein, 9 aa, Yellow fever virus
NEVDISIVV

SEQ ID NO: 164231 - protein, 9 aa, Yellow fever virus
EVDISIVVQ

SEQ ID NO: 164232 - protein, 9 aa, Yellow fever virus
VDISIVVQD

SEQ ID NO: 164233 - protein, 9 aa, Yellow fever virus
DISIVVQDP

SEQ ID NO: 164234 - protein, 9 aa, Yellow fever virus
ISIVVQDPK

SEQ ID NO: 164235 - protein, 9 aa, Yellow fever virus
SIVVQDPKN

SEQ ID NO: 164236 - protein, 9 aa, Yellow fever virus
VVVQDPKNI

SEQ ID NO: 164237 - protein, 9 aa, Yellow fever virus
VVQDPKNIY

SEQ ID NO: 164238 - protein, 9 aa, Yellow fever virus
VQDPKNIYQ

SEQ ID NO: 164239 - protein, 9 aa, Yellow fever virus
QDPKNIYQR

SEQ ID NO: 164240 - protein, 9 aa, Yellow fever virus
DPKNIYQRG

SEQ ID NO: 164241 - protein, 9 aa, Yellow fever virus
PKNIYQRGT

SEQ ID NO: 164242 - protein, 9 aa, Yellow fever virus
KNIYQRGTH

SEQ ID NO: 164243 - protein, 9 aa, Yellow fever virus
NIYQRGTHP

SEQ ID NO: 164244 - protein, 9 aa, Yellow fever virus
IYQRGTHPF

SEQ ID NO: 164245 - protein, 9 aa, Yellow fever virus
YGWKTWGKS

SEQ ID NO: 164246 - protein, 9 aa, Yellow fever virus
GWKTWGKSL

SEQ ID NO: 164247 - protein, 9 aa, Yellow fever virus
WKTWGKNLI

SEQ ID NO: 164248 - protein, 9 aa, Yellow fever virus
KTWGKNLIF

SEQ ID NO: 164249 - protein, 9 aa, Yellow fever virus
TWGKNLIFS

SEQ ID NO: 164250 - protein, 9 aa, Yellow fever virus
WGKNLIFSP

SEQ ID NO: 164251 - protein, 9 aa, Yellow fever virus
GKNLIFSPG

SEQ ID NO: 164252 - protein, 9 aa, Yellow fever virus
KNLIFSPGR

SEQ ID NO: 164253 - protein, 9 aa, Yellow fever virus
NLIFSPGRK

SEQ ID NO: 164254 - protein, 9 aa, Yellow fever virus
LIFSPGRKN

SEQ ID NO: 164255 - protein, 9 aa, Yellow fever virus
IFSPGRKNG

SEQ ID NO: 164256 - protein, 9 aa, Yellow fever virus
SFQIEEFGM

SEQ ID NO: 164257 - protein, 9 aa, Yellow fever virus
FQIEEFGMG

SEQ ID NO: 164258 - protein, 9 aa, Yellow fever virus
QIEEFGMGV

SEQ ID NO: 164259 - protein, 9 aa, Yellow fever virus
IEEFGMGVF

SEQ ID NO: 164260 - protein, 9 aa, Yellow fever virus
EEFGMGVFT

SEQ ID NO: 164261 - protein, 9 aa, Yellow fever virus
EFGMGVFTT

SEQ ID NO: 164262 - protein, 9 aa, Yellow fever virus
FGMGVFTTR

SEQ ID NO: 164263 - protein, 9 aa, Yellow fever virus
GMGVFTTRV

SEQ ID NO: 164264 - protein, 9 aa, Yellow fever virus
MGVFTTRVF

SEQ ID NO: 164265 - protein, 9 aa, Yellow fever virus
GVFTTRVFM

SEQ ID NO: 164266 - protein, 9 aa, Yellow fever virus
VFTTRVFMD

SEQ ID NO: 164267 - protein, 9 aa, Yellow fever virus
FTTRVFMDA

SEQ ID NO: 164268 - protein, 9 aa, Yellow fever virus
TTRVFMDAV

SEQ ID NO: 164269 - protein, 9 aa, Yellow fever virus
TRVFMDAVF

SEQ ID NO: 164270 - protein, 9 aa, Yellow fever virus
RVFMDAVFD

SEQ ID NO: 164271 - protein, 9 aa, Yellow fever virus
VFMDAVFDY

SEQ ID NO: 164272 - protein, 9 aa, Yellow fever virus
FMDAVFDYS

SEQ ID NO: 164273 - protein, 9 aa, Yellow fever virus
MDAVFDYSV

SEQ ID NO: 164274 - protein, 9 aa, Yellow fever virus
DAVFDYSVD

SEQ ID NO: 164275 - protein, 9 aa, Yellow fever virus
AVFDYSVDC

SEQ ID NO: 164276 - protein, 9 aa, Yellow fever virus
VFDYSVDCD

SEQ ID NO: 164277 - protein, 9 aa, Yellow fever virus
FDYSVDCDG

SEQ ID NO: 164278 - protein, 9 aa, Yellow fever virus
DYSVDCDGA

SEQ ID NO: 164279 - protein, 9 aa, Yellow fever virus
YSVDCDGAI

SEQ ID NO: 164280 - protein, 9 aa, Yellow fever virus
SVDCDGAIL

SEQ ID NO: 164281 - protein, 9 aa, Yellow fever virus
VDCDGAILG

SEQ ID NO: 164282 - protein, 9 aa, Yellow fever virus
DCDGAILGA

SEQ ID NO: 164283 - protein, 9 aa, Yellow fever virus
CDGAILGAA

SEQ ID NO: 164284 - protein, 9 aa, Yellow fever virus
DGAILGAAV

SEQ ID NO: 164285 - protein, 9 aa, Yellow fever virus
GAILGAAVN

SEQ ID NO: 164286 - protein, 9 aa, Yellow fever virus
AILGAAVNG

SEQ ID NO: 164287 - protein, 9 aa, Yellow fever virus
HEVNGTWMM

SEQ ID NO: 164288 - protein, 9 aa, Yellow fever virus
EVNGTWMVH

SEQ ID NO: 164289 - protein, 9 aa, Yellow fever virus
VNGTWMVHT

SEQ ID NO: 164290 - protein, 9 aa, Yellow fever virus
NGTWMVHTL

SEQ ID NO: 164291 - protein, 9 aa, Yellow fever virus
GTWMVHTLE

SEQ ID NO: 164292 - protein, 9 aa, Yellow fever virus
TWMIHTLET

SEQ ID NO: 164293 - protein, 9 aa, Yellow fever virus
WMIHTLETL

SEQ ID NO: 164294 - protein, 9 aa, Yellow fever virus
MIHTLETLD

SEQ ID NO: 164295 - protein, 9 aa, Yellow fever virus
IHTLETLDY

SEQ ID NO: 164296 - protein, 9 aa, Yellow fever virus
HTLETLDYK

SEQ ID NO: 164297 - protein, 9 aa, Yellow fever virus
TLETLDYKE

SEQ ID NO: 164298 - protein, 9 aa, Yellow fever virus
LETLDYKEC

SEQ ID NO: 164299 - protein, 9 aa, Yellow fever virus
ETLDYKECE

SEQ ID NO: 164300 - protein, 9 aa, Yellow fever virus
TLDYKECEW

SEQ ID NO: 164301 - protein, 9 aa, Yellow fever virus
DYKECEWPP

SEQ ID NO: 164302 - protein, 9 aa, Yellow fever virus
YKECEWPPT

SEQ ID NO: 164303 - protein, 9 aa, Yellow fever virus
KECEWPPTH

SEQ ID NO: 164304 - protein, 9 aa, Yellow fever virus
ECEWPPTHT

SEQ ID NO: 164305 - protein, 9 aa, Yellow fever virus
CEWPPTHTI

SEQ ID NO: 164306 - protein, 9 aa, Yellow fever virus
EWPPTHTIG

SEQ ID NO: 164307 - protein, 9 aa, Yellow fever virus
WPPTHTIGT

SEQ ID NO: 164308 - protein, 9 aa, Yellow fever virus
PPTHTIGTS

SEQ ID NO: 164309 - protein, 9 aa, Yellow fever virus
PTHTIGTSV

SEQ ID NO: 164310 - protein, 9 aa, Yellow fever virus
IGTSVEESD

SEQ ID NO: 164311 - protein, 9 aa, Yellow fever virus
GTSVEESDM

SEQ ID NO: 164312 - protein, 9 aa, Yellow fever virus
TSVEESDMF

SEQ ID NO: 164313 - protein, 9 aa, Yellow fever virus
SVEESDMFM

SEQ ID NO: 164314 - protein, 9 aa, Yellow fever virus
VEESDMFMP

SEQ ID NO: 164315 - protein, 9 aa, Yellow fever virus
EESDMFMPR

SEQ ID NO: 164316 - protein, 9 aa, Yellow fever virus
ESDMFMPRS

SEQ ID NO: 164317 - protein, 9 aa, Yellow fever virus
SDMFMPRSI

SEQ ID NO: 164318 - protein, 9 aa, Yellow fever virus
DMFMPRSIG

SEQ ID NO: 164319 - protein, 9 aa, Yellow fever virus
GGPVSSHNR

SEQ ID NO: 164320 - protein, 9 aa, Yellow fever virus
GPVSSHNRI

SEQ ID NO: 164321 - protein, 9 aa, Yellow fever virus
PVSSHNRIP

SEQ ID NO: 164322 - protein, 9 aa, Yellow fever virus
VSSHNRIPG

SEQ ID NO: 164323 - protein, 9 aa, Yellow fever virus
SSHNRIPGY

SEQ ID NO: 164324 - protein, 9 aa, Yellow fever virus
SHNRIPGYK

SEQ ID NO: 164325 - protein, 9 aa, Yellow fever virus
HNRIPGYKV

SEQ ID NO: 164326 - protein, 9 aa, Yellow fever virus
NRIPGYKVQ

SEQ ID NO: 164327 - protein, 9 aa, Yellow fever virus
RIPGYKVQT

SEQ ID NO: 164328 - protein, 9 aa, Yellow fever virus
WMQVPLEVR

SEQ ID NO: 164329 - protein, 9 aa, Yellow fever virus
MQVPLEVRR

SEQ ID NO: 164330 - protein, 9 aa, Yellow fever virus
QVPLEVRRE

SEQ ID NO: 164331 - protein, 9 aa, Yellow fever virus
VPLEVRREA

SEQ ID NO: 164332 - protein, 9 aa, Yellow fever virus
PLEVRREAC

SEQ ID NO: 164333 - protein, 9 aa, Yellow fever virus
LEVRREACP

SEQ ID NO: 164334 - protein, 9 aa, Yellow fever virus
EVRREPCPG

SEQ ID NO: 164335 - protein, 9 aa, Yellow fever virus
VRREPCPGT

SEQ ID NO: 164336 - protein, 9 aa, Yellow fever virus
RREPCPGTS

SEQ ID NO: 164337 - protein, 9 aa, Yellow fever virus
REPCPGTSV

SEQ ID NO: 164338 - protein, 9 aa, Yellow fever virus
EPCPGTSVV

SEQ ID NO: 164339 - protein, 9 aa, Yellow fever virus
VCPGTSVVV

SEQ ID NO: 164340 - protein, 9 aa, Yellow fever virus
CPGTSVVVD

SEQ ID NO: 164341 - protein, 9 aa, Yellow fever virus
PGTSVVVDT

SEQ ID NO: 164342 - protein, 9 aa, Yellow fever virus
GTSVVVDSN

SEQ ID NO: 164343 - protein, 9 aa, Yellow fever virus
TSVVLDTGC

SEQ ID NO: 164344 - protein, 9 aa, Yellow fever virus
SVVVDSNCD

SEQ ID NO: 164345 - protein, 9 aa, Yellow fever virus
VVVDTSCDG

SEQ ID NO: 164346 - protein, 9 aa, Yellow fever virus
VLDTGCDGR

SEQ ID NO: 164347 - protein, 9 aa, Yellow fever virus
LDTGCDGRG

SEQ ID NO: 164348 - protein, 9 aa, Yellow fever virus
DSNCDGRGK

SEQ ID NO: 164349 - protein, 9 aa, Yellow fever virus
TGCDGRGKS

SEQ ID NO: 164350 - protein, 9 aa, Yellow fever virus
SCDGRGKST

SEQ ID NO: 164351 - protein, 9 aa, Yellow fever virus
CDGRGKSAR

SEQ ID NO: 164352 - protein, 9 aa, Yellow fever virus
DGRGKSARS

SEQ ID NO: 164353 - protein, 9 aa, Yellow fever virus
GRGKSARST

SEQ ID NO: 164354 - protein, 9 aa, Yellow fever virus
RGKSARSTT

SEQ ID NO: 164355 - protein, 9 aa, Yellow fever virus
GKSARSTTD

SEQ ID NO: 164356 - protein, 9 aa, Yellow fever virus
KSARSTTDS

SEQ ID NO: 164357 - protein, 9 aa, Yellow fever virus
SARSTTDSG

SEQ ID NO: 164358 - protein, 9 aa, Yellow fever virus
ARSTTDSGK

SEQ ID NO: 164359 - protein, 9 aa, Yellow fever virus
RSTTDSGKI

SEQ ID NO: 164360 - protein, 9 aa, Yellow fever virus
STTDSGKII

SEQ ID NO: 164361 - protein, 9 aa, Yellow fever virus
TTDSGKIIP

SEQ ID NO: 164362 - protein, 9 aa, Yellow fever virus
TDSGKIIPE

SEQ ID NO: 164363 - protein, 9 aa, Yellow fever virus
DSGKIIPEW

SEQ ID NO: 164364 - protein, 9 aa, Yellow fever virus
SGKIIPEWC

SEQ ID NO: 164365 - protein, 9 aa, Yellow fever virus
GKIIPEWCC

SEQ ID NO: 164366 - protein, 9 aa, Yellow fever virus
KIIPEWCCR

SEQ ID NO: 164367 - protein, 9 aa, Yellow fever virus
IIPEWCCRS

SEQ ID NO: 164368 - protein, 9 aa, Yellow fever virus
MPPVSFHGN

SEQ ID NO: 164369 - protein, 9 aa, Yellow fever virus
PPVSFHGND

SEQ ID NO: 164370 - protein, 9 aa, Yellow fever virus
PVSFHGNDG

SEQ ID NO: 164371 - protein, 9 aa, Yellow fever virus
VSFHGNDGC

SEQ ID NO: 164372 - protein, 9 aa, Yellow fever virus
SFHGNDGCW

SEQ ID NO: 164373 - protein, 9 aa, Yellow fever virus
FHGNDGCWY

SEQ ID NO: 164374 - protein, 9 aa, Yellow fever virus
HGNDGCWYP

SEQ ID NO: 164375 - protein, 9 aa, Yellow fever virus
GNDGCWYPM

SEQ ID NO: 164376 - protein, 9 aa, Yellow fever virus
NDGCWYPME

SEQ ID NO: 164377 - protein, 9 aa, Yellow fever virus
WYPMEIRPM

SEQ ID NO: 164378 - protein, 9 aa, Yellow fever virus
YPMEIRPMK

SEQ ID NO: 164379 - protein, 9 aa, Yellow fever virus
PMEIRPMKT

SEQ ID NO: 164380 - protein, 9 aa, Yellow fever virus
MEIRPMKTH

SEQ ID NO: 164381 - protein, 9 aa, Yellow fever virus
EIRPMKTHE

SEQ ID NO: 164382 - protein, 9 aa, Yellow fever virus
IRPMKTHES

SEQ ID NO: 164383 - protein, 9 aa, Yellow fever virus
RPMKTHESH

SEQ ID NO: 164384 - protein, 9 aa, Yellow fever virus
PMKTHESHL

SEQ ID NO: 164385 - protein, 9 aa, Yellow fever virus
MKTHESHLV

SEQ ID NO: 164386 - protein, 9 aa, Yellow fever virus
KAHESHLVR

SEQ ID NO: 164387 - protein, 9 aa, Yellow fever virus
TSDSHLVRS

SEQ ID NO: 164388 - protein, 9 aa, Yellow fever virus
SDSHLVRSW

SEQ ID NO: 164389 - protein, 9 aa, Yellow fever virus
DSHLVRSWV

SEQ ID NO: 164390 - protein, 9 aa, Yellow fever virus
RSWVTAGEV

SEQ ID NO: 164391 - protein, 9 aa, Yellow fever virus
SWVTAGEVH

SEQ ID NO: 164392 - protein, 9 aa, Yellow fever virus
WVTAGEVHA

SEQ ID NO: 164393 - protein, 9 aa, Yellow fever virus
VTAGEVHAV

SEQ ID NO: 164394 - protein, 9 aa, Yellow fever virus
TAGEVHAVP

SEQ ID NO: 164395 - protein, 9 aa, Yellow fever virus
AGEVHAVPF

SEQ ID NO: 164396 - protein, 9 aa, Yellow fever virus
GEVHAVPFG

SEQ ID NO: 164397 - protein, 9 aa, Yellow fever virus
EVHAVPFGL

SEQ ID NO: 164398 - protein, 9 aa, Yellow fever virus
VHAVPFGLV

SEQ ID NO: 164399 - protein, 9 aa, Yellow fever virus
GLVSMMIAL

SEQ ID NO: 164400 - protein, 9 aa, Yellow fever virus
LVSMMIALE

SEQ ID NO: 164401 - protein, 9 aa, Yellow fever virus
VSMMIALEV

SEQ ID NO: 164402 - protein, 9 aa, Yellow fever virus
SMMIALEVV

SEQ ID NO: 164403 - protein, 9 aa, Yellow fever virus
MMIALEVVL

SEQ ID NO: 164404 - protein, 9 aa, Yellow fever virus
MIALEVVLR

SEQ ID NO: 164405 - protein, 9 aa, Yellow fever virus
IALEVVLRK

SEQ ID NO: 164406 - protein, 9 aa, Yellow fever virus
AMEVVLRRR

SEQ ID NO: 164407 - protein, 9 aa, Yellow fever virus
LEVVLRKRQ

SEQ ID NO: 164408 - protein, 9 aa, Yellow fever virus
EVVLRRRQG

SEQ ID NO: 164409 - protein, 9 aa, Yellow fever virus
VVLRRRQGP

SEQ ID NO: 164410 - protein, 9 aa, Yellow fever virus
VLRRRQGPK

SEQ ID NO: 164411 - protein, 9 aa, Yellow fever virus
LRRRQGPKQ

SEQ ID NO: 164412 - protein, 9 aa, Yellow fever virus
RKRQGPKQV

SEQ ID NO: 164413 - protein, 9 aa, Yellow fever virus
KRQGPKQVL

SEQ ID NO: 164414 - protein, 9 aa, Yellow fever virus
RQGPKQVLV

SEQ ID NO: 164415 - protein, 9 aa, Yellow fever virus
QGPKQVLVG

SEQ ID NO: 164416 - protein, 9 aa, Yellow fever virus
GPKQVLVGG

SEQ ID NO: 164417 - protein, 9 aa, Yellow fever virus
PKQMLVGGI

SEQ ID NO: 164418 - protein, 9 aa, Yellow fever virus
KQMLVGGII

SEQ ID NO: 164419 - protein, 9 aa, Yellow fever virus
QMLVGGIIL

SEQ ID NO: 164420 - protein, 9 aa, Yellow fever virus
MLVGGIILL

SEQ ID NO: 164421 - protein, 9 aa, Yellow fever virus
LVGGIILLG

SEQ ID NO: 164422 - protein, 9 aa, Yellow fever virus
VGGIILLGA

SEQ ID NO: 164423 - protein, 9 aa, Yellow fever virus
GGIILLGAM

SEQ ID NO: 164424 - protein, 9 aa, Yellow fever virus
GIILLGAML

SEQ ID NO: 164425 - protein, 9 aa, Yellow fever virus
IILLGAMLV

SEQ ID NO: 164426 - protein, 9 aa, Yellow fever virus
ILLGAMLVG

SEQ ID NO: 164427 - protein, 9 aa, Yellow fever virus
AMLVGQVTV

SEQ ID NO: 164428 - protein, 9 aa, Yellow fever virus
MLVGQVTVL

SEQ ID NO: 164429 - protein, 9 aa, Yellow fever virus
LVGQVTVLD

SEQ ID NO: 164430 - protein, 9 aa, Yellow fever virus
VGQVTVLDL

SEQ ID NO: 164431 - protein, 9 aa, Yellow fever virus
GQVTVLDLV

SEQ ID NO: 164432 - protein, 9 aa, Yellow fever virus
QVTVLDLVK

SEQ ID NO: 164433 - protein, 9 aa, Yellow fever virus
LIVAVGLHF

SEQ ID NO: 164434 - protein, 9 aa, Yellow fever virus
IVAVGLHFH

SEQ ID NO: 164435 - protein, 9 aa, Yellow fever virus
MAVGLHFHE

SEQ ID NO: 164436 - protein, 9 aa, Yellow fever virus
AVGLHFHEI

SEQ ID NO: 164437 - protein, 9 aa, Yellow fever virus
VGLHFHEIN

SEQ ID NO: 164438 - protein, 9 aa, Yellow fever virus
GLHFHEINN

SEQ ID NO: 164439 - protein, 9 aa, Yellow fever virus
LHFHEINNG

SEQ ID NO: 164440 - protein, 9 aa, Yellow fever virus
HFHEINNGG

SEQ ID NO: 164441 - protein, 9 aa, Yellow fever virus
FHEINNGGD

SEQ ID NO: 164442 - protein, 9 aa, Yellow fever virus
HEINNGGDA

SEQ ID NO: 164443 - protein, 9 aa, Yellow fever virus
EINNGGDAM

SEQ ID NO: 164444 - protein, 9 aa, Yellow fever virus
INNGGDAMY

SEQ ID NO: 164445 - protein, 9 aa, Yellow fever virus
AMYMALIAS

SEQ ID NO: 164446 - protein, 9 aa, Yellow fever virus
MYMALIASF

SEQ ID NO: 164447 - protein, 9 aa, Yellow fever virus
YMALIASFS

SEQ ID NO: 164448 - protein, 9 aa, Yellow fever virus
MALIASFSI

SEQ ID NO: 164449 - protein, 9 aa, Yellow fever virus
ALIASFSIR

SEQ ID NO: 164450 - protein, 9 aa, Yellow fever virus
LIASFSIRP

SEQ ID NO: 164451 - protein, 9 aa, Yellow fever virus
IASFSIRPG

SEQ ID NO: 164452 - protein, 9 aa, Yellow fever virus
ASFSIRPGL

SEQ ID NO: 164453 - protein, 9 aa, Yellow fever virus
SFSIRPGLL

SEQ ID NO: 164454 - protein, 9 aa, Yellow fever virus
FSVRPGLLI

SEQ ID NO: 164455 - protein, 9 aa, Yellow fever virus
SVRPGLLIG

SEQ ID NO: 164456 - protein, 9 aa, Yellow fever virus
VRPGLLIGF

SEQ ID NO: 164457 - protein, 9 aa, Yellow fever virus
RPGLLMGFG

SEQ ID NO: 164458 - protein, 9 aa, Yellow fever virus
PGLLMGFGL

SEQ ID NO: 164459 - protein, 9 aa, Yellow fever virus
GLLMGFGLR

SEQ ID NO: 164460 - protein, 9 aa, Yellow fever virus
LLVGFGLRT

SEQ ID NO: 164461 - protein, 9 aa, Yellow fever virus
LVGFGLRTL

SEQ ID NO: 164462 - protein, 9 aa, Yellow fever virus
MGFGLRTLW

SEQ ID NO: 164463 - protein, 9 aa, Yellow fever virus
WSPRERLVM

SEQ ID NO: 164464 - protein, 9 aa, Yellow fever virus
SPRERLVMA

SEQ ID NO: 164465 - protein, 9 aa, Yellow fever virus
PRERLVMAF

SEQ ID NO: 164466 - protein, 9 aa, Yellow fever virus
RERLVMAFG

SEQ ID NO: 164467 - protein, 9 aa, Yellow fever virus
ERLVMAFGA

SEQ ID NO: 164468 - protein, 9 aa, Yellow fever virus
RLVMAFGAA

SEQ ID NO: 164469 - protein, 9 aa, Yellow fever virus
LVMAFGAAM

SEQ ID NO: 164470 - protein, 9 aa, Yellow fever virus
VMAFGAAMV

SEQ ID NO: 164471 - protein, 9 aa, Yellow fever virus
MAFGAAMVE

SEQ ID NO: 164472 - protein, 9 aa, Yellow fever virus
ALGAAMVEI

SEQ ID NO: 164473 - protein, 9 aa, Yellow fever virus
FGAAMVEVA

SEQ ID NO: 164474 - protein, 9 aa, Yellow fever virus
GAAMVEVAL

SEQ ID NO: 164475 - protein, 9 aa, Yellow fever virus
AAMVEVALG

SEQ ID NO: 164476 - protein, 9 aa, Yellow fever virus
AMVEVALGG

SEQ ID NO: 164477 - protein, 9 aa, Yellow fever virus
MVEIALGGM

SEQ ID NO: 164478 - protein, 9 aa, Yellow fever virus
VEIALGGMM

SEQ ID NO: 164479 - protein, 9 aa, Yellow fever virus
EIALGGMMG

SEQ ID NO: 164480 - protein, 9 aa, Yellow fever virus
IALGGMMGG

SEQ ID NO: 164481 - protein, 9 aa, Yellow fever virus
ALGGMMGGL

SEQ ID NO: 164482 - protein, 9 aa, Yellow fever virus
LGGMMGGLW

SEQ ID NO: 164483 - protein, 9 aa, Yellow fever virus
GGMMGGLWK

SEQ ID NO: 164484 - protein, 9 aa, Yellow fever virus
GMMGGLWKY

SEQ ID NO: 164485 - protein, 9 aa, Yellow fever virus
MMGGLWKYL

SEQ ID NO: 164486 - protein, 9 aa, Yellow fever virus
MGGLWQYLN

SEQ ID NO: 164487 - protein, 9 aa, Yellow fever virus
GGLWQYLNA

SEQ ID NO: 164488 - protein, 9 aa, Yellow fever virus
GLWQYLNAV

SEQ ID NO: 164489 - protein, 9 aa, Yellow fever virus
LWQYLNAVS

SEQ ID NO: 164490 - protein, 9 aa, Yellow fever virus
WQYLNAVSL

SEQ ID NO: 164491 - protein, 9 aa, Yellow fever virus
QYLNAVSLC

SEQ ID NO: 164492 - protein, 9 aa, Yellow fever virus
YLNAVSLCV

SEQ ID NO: 164493 - protein, 9 aa, Yellow fever virus
LNAVSLCVL

SEQ ID NO: 164494 - protein, 9 aa, Yellow fever virus
NAVSLCVLT

SEQ ID NO: 164495 - protein, 9 aa, Yellow fever virus
AVSLCVLTI

SEQ ID NO: 164496 - protein, 9 aa, Yellow fever virus
VSLCVLTIN

SEQ ID NO: 164497 - protein, 9 aa, Yellow fever virus
SLCVLTINA

SEQ ID NO: 164498 - protein, 9 aa, Yellow fever virus
LCVLTINAI

SEQ ID NO: 164499 - protein, 9 aa, Yellow fever virus
CVLTINAIS

SEQ ID NO: 164500 - protein, 9 aa, Yellow fever virus
VLTINAISS

SEQ ID NO: 164501 - protein, 9 aa, Yellow fever virus
LTINAISSR

SEQ ID NO: 164502 - protein, 9 aa, Yellow fever virus
TINAISSRK

SEQ ID NO: 164503 - protein, 9 aa, Yellow fever virus
INAISSRKA

SEQ ID NO: 164504 - protein, 9 aa, Yellow fever virus
NAISSRKAS

SEQ ID NO: 164505 - protein, 9 aa, Yellow fever virus
AISSRKASN

SEQ ID NO: 164506 - protein, 9 aa, Yellow fever virus
VASRKASNA

SEQ ID NO: 164507 - protein, 9 aa, Yellow fever virus
SSRKASNMI

SEQ ID NO: 164508 - protein, 9 aa, Yellow fever virus
SRKASNAIL

SEQ ID NO: 164509 - protein, 9 aa, Yellow fever virus
RKASNAVLP

SEQ ID NO: 164510 - protein, 9 aa, Yellow fever virus
KASNAVLPL

SEQ ID NO: 164511 - protein, 9 aa, Yellow fever virus
ASNMILPLM

SEQ ID NO: 164512 - protein, 9 aa, Yellow fever virus
SNAILPLMA

SEQ ID NO: 164513 - protein, 9 aa, Yellow fever virus
NMILPLMAL

SEQ ID NO: 164514 - protein, 9 aa, Yellow fever virus
AVLPLMALL

SEQ ID NO: 164515 - protein, 9 aa, Yellow fever virus
ILPLMALMT

SEQ ID NO: 164516 - protein, 9 aa, Yellow fever virus
LPLMALMTP

SEQ ID NO: 164517 - protein, 9 aa, Yellow fever virus
PLMALMTPM

SEQ ID NO: 164518 - protein, 9 aa, Yellow fever virus
LMALMTPMT

SEQ ID NO: 164519 - protein, 9 aa, Yellow fever virus
MALMTPMTM

SEQ ID NO: 164520 - protein, 9 aa, Yellow fever virus
ALLTPVTMY

SEQ ID NO: 164521 - protein, 9 aa, Yellow fever virus
LLTPVTMYE

SEQ ID NO: 164522 - protein, 9 aa, Yellow fever virus
LTPVTMHEV

SEQ ID NO: 164523 - protein, 9 aa, Yellow fever virus
TPVTMYEVR

SEQ ID NO: 164524 - protein, 9 aa, Yellow fever virus
PVTMYEVRM

SEQ ID NO: 164525 - protein, 9 aa, Yellow fever virus
VTMYEVRMA

SEQ ID NO: 164526 - protein, 9 aa, Yellow fever virus
TMAEVRLAT

SEQ ID NO: 164527 - protein, 9 aa, Yellow fever virus
MAEVRLATM

SEQ ID NO: 164528 - protein, 9 aa, Yellow fever virus
AEVRLATML

SEQ ID NO: 164529 - protein, 9 aa, Yellow fever virus
EVRLATMLF

SEQ ID NO: 164530 - protein, 9 aa, Yellow fever virus
VRLAAMLFC

SEQ ID NO: 164531 - protein, 9 aa, Yellow fever virus
ATMLFCTVV

SEQ ID NO: 164532 - protein, 9 aa, Yellow fever virus
TMLFCTVVI

SEQ ID NO: 164533 - protein, 9 aa, Yellow fever virus
MLFCTVVII

SEQ ID NO: 164534 - protein, 9 aa, Yellow fever virus
LFCTVVIIG

SEQ ID NO: 164535 - protein, 9 aa, Yellow fever virus
FCTVVIIGV

SEQ ID NO: 164536 - protein, 9 aa, Yellow fever virus
CTVVIIGVL

SEQ ID NO: 164537 - protein, 9 aa, Yellow fever virus
TVVIIGVLH

SEQ ID NO: 164538 - protein, 9 aa, Yellow fever virus
VVIVGVLHQ

SEQ ID NO: 164539 - protein, 9 aa, Yellow fever virus
VIVGVLHQN

SEQ ID NO: 164540 - protein, 9 aa, Yellow fever virus
IIGVLHQNS

SEQ ID NO: 164541 - protein, 9 aa, Yellow fever virus
IGVLHQNSK

SEQ ID NO: 164542 - protein, 9 aa, Yellow fever virus
GVLHQNSKD

SEQ ID NO: 164543 - protein, 9 aa, Yellow fever virus
VLHQNSKDT

SEQ ID NO: 164544 - protein, 9 aa, Yellow fever virus
LHQNSKDTS

SEQ ID NO: 164545 - protein, 9 aa, Yellow fever virus
HQNSKDTSM

SEQ ID NO: 164546 - protein, 9 aa, Yellow fever virus
QNSKDTSMQ

SEQ ID NO: 164547 - protein, 9 aa, Yellow fever virus
NSKDTSMQK

SEQ ID NO: 164548 - protein, 9 aa, Yellow fever virus
SKDTSMQKT

SEQ ID NO: 164549 - protein, 9 aa, Yellow fever virus
TSMQKTIPI

SEQ ID NO: 164550 - protein, 9 aa, Yellow fever virus
SMQKTIPIV

SEQ ID NO: 164551 - protein, 9 aa, Yellow fever virus
MQKTIPIVA

SEQ ID NO: 164552 - protein, 9 aa, Yellow fever virus
QKTIPIVAL

SEQ ID NO: 164553 - protein, 9 aa, Yellow fever virus
KTIPIVALT

SEQ ID NO: 164554 - protein, 9 aa, Yellow fever virus
TIPIVALTL

SEQ ID NO: 164555 - protein, 9 aa, Yellow fever virus
IPIVALTLT

SEQ ID NO: 164556 - protein, 9 aa, Yellow fever virus
PIVALTLTS

SEQ ID NO: 164557 - protein, 9 aa, Yellow fever virus
IVALTLTSY

SEQ ID NO: 164558 - protein, 9 aa, Yellow fever virus
VALTLTSYM

SEQ ID NO: 164559 - protein, 9 aa, Yellow fever virus
ALTLTSYMG

SEQ ID NO: 164560 - protein, 9 aa, Yellow fever virus
LTLTSYMGL

SEQ ID NO: 164561 - protein, 9 aa, Yellow fever virus
TLTSYMGLT

SEQ ID NO: 164562 - protein, 9 aa, Yellow fever virus
LTSYMGLTQ

SEQ ID NO: 164563 - protein, 9 aa, Yellow fever virus
TSYMGLTQP

SEQ ID NO: 164564 - protein, 9 aa, Yellow fever virus
SYMGLTQPF

SEQ ID NO: 164565 - protein, 9 aa, Yellow fever virus
YMGLTQPFL

SEQ ID NO: 164566 - protein, 9 aa, Yellow fever virus
MGLTQPFLG

SEQ ID NO: 164567 - protein, 9 aa, Yellow fever virus
QPFLGLCAY

SEQ ID NO: 164568 - protein, 9 aa, Yellow fever virus
PFLGLCAYM

SEQ ID NO: 164569 - protein, 9 aa, Yellow fever virus
FLGLCAYMS

SEQ ID NO: 164570 - protein, 9 aa, Yellow fever virus
LGLCAYMST

SEQ ID NO: 164571 - protein, 9 aa, Yellow fever virus
GLCAYMSTQ

SEQ ID NO: 164572 - protein, 9 aa, Yellow fever virus
LCAYMSTQV

SEQ ID NO: 164573 - protein, 9 aa, Yellow fever virus
CAYMSTQVF

SEQ ID NO: 164574 - protein, 9 aa, Yellow fever virus
AYMSTQVFG

SEQ ID NO: 164575 - protein, 9 aa, Yellow fever virus
YMSTQVFGR

SEQ ID NO: 164576 - protein, 9 aa, Yellow fever virus
MSTQVFGRR

SEQ ID NO: 164577 - protein, 9 aa, Yellow fever virus
STQVFGRRS

SEQ ID NO: 164578 - protein, 9 aa, Yellow fever virus
TQVFGRRSI

SEQ ID NO: 164579 - protein, 9 aa, Yellow fever virus
QVFGRRSIP

SEQ ID NO: 164580 - protein, 9 aa, Yellow fever virus
VFGRRSIPV

SEQ ID NO: 164581 - protein, 9 aa, Yellow fever virus
PVNEALAAT

SEQ ID NO: 164582 - protein, 9 aa, Yellow fever virus
VNEALAATG

SEQ ID NO: 164583 - protein, 9 aa, Yellow fever virus
NEALAATGL

SEQ ID NO: 164584 - protein, 9 aa, Yellow fever virus
EALAATGLV

SEQ ID NO: 164585 - protein, 9 aa, Yellow fever virus
ALAATGLVG

SEQ ID NO: 164586 - protein, 9 aa, Yellow fever virus
LAATGLVGV

SEQ ID NO: 164587 - protein, 9 aa, Yellow fever virus
AATGLVGVL

SEQ ID NO: 164588 - protein, 9 aa, Yellow fever virus
ATGLVGVLA

SEQ ID NO: 164589 - protein, 9 aa, Yellow fever virus
TGLVGVLAG

SEQ ID NO: 164590 - protein, 9 aa, Yellow fever virus
VLAGLAFQD

SEQ ID NO: 164591 - protein, 9 aa, Yellow fever virus
LAGLAFQDM

SEQ ID NO: 164592 - protein, 9 aa, Yellow fever virus
AGLAFQDME

SEQ ID NO: 164593 - protein, 9 aa, Yellow fever virus
GLAFQDMEN

SEQ ID NO: 164594 - protein, 9 aa, Yellow fever virus
LAFQDMENF

SEQ ID NO: 164595 - protein, 9 aa, Yellow fever virus
AFQDMENFL

SEQ ID NO: 164596 - protein, 9 aa, Yellow fever virus
FQDMENFLG

SEQ ID NO: 164597 - protein, 9 aa, Yellow fever virus
QDMENFLGP

SEQ ID NO: 164598 - protein, 9 aa, Yellow fever virus
DMENFLGPI

SEQ ID NO: 164599 - protein, 9 aa, Yellow fever virus
LGPIAVGGI

SEQ ID NO: 164600 - protein, 9 aa, Yellow fever virus
GPIAVGGIL

SEQ ID NO: 164601 - protein, 9 aa, Yellow fever virus
PIAVGGILM

SEQ ID NO: 164602 - protein, 9 aa, Yellow fever virus
IAVGGILMM

SEQ ID NO: 164603 - protein, 9 aa, Yellow fever virus
AVGGILMML

SEQ ID NO: 164604 - protein, 9 aa, Yellow fever virus
VGGILMMLV

SEQ ID NO: 164605 - protein, 9 aa, Yellow fever virus
GGILMMLVS

SEQ ID NO: 164606 - protein, 9 aa, Yellow fever virus
GILMMLVSV

SEQ ID NO: 164607 - protein, 9 aa, Yellow fever virus
ILMMLVSVA

SEQ ID NO: 164608 - protein, 9 aa, Yellow fever virus
MMLVSVAGK

SEQ ID NO: 164609 - protein, 9 aa, Yellow fever virus
MLVSVAGKV

SEQ ID NO: 164610 - protein, 9 aa, Yellow fever virus
LVSVAGKVD

SEQ ID NO: 164611 - protein, 9 aa, Yellow fever virus
VSVAGKVDG

SEQ ID NO: 164612 - protein, 9 aa, Yellow fever virus
SVAGKVDGL

SEQ ID NO: 164613 - protein, 9 aa, Yellow fever virus
VAGKVDGLE

SEQ ID NO: 164614 - protein, 9 aa, Yellow fever virus
AGKVDGLEL

SEQ ID NO: 164615 - protein, 9 aa, Yellow fever virus
GKVDGLELK

SEQ ID NO: 164616 - protein, 9 aa, Yellow fever virus
RVDGLELRK

SEQ ID NO: 164617 - protein, 9 aa, Yellow fever virus
VDGLELRKL

SEQ ID NO: 164618 - protein, 9 aa, Yellow fever virus
DGLELRKLG

SEQ ID NO: 164619 - protein, 9 aa, Yellow fever virus
GLELRKLGE

SEQ ID NO: 164620 - protein, 9 aa, Yellow fever virus
LELRKLGEV

SEQ ID NO: 164621 - protein, 9 aa, Yellow fever virus
ELRKLGEVS

SEQ ID NO: 164622 - protein, 9 aa, Yellow fever virus
LRKLGEVSW

SEQ ID NO: 164623 - protein, 9 aa, Yellow fever virus
RKLGEVSWE

SEQ ID NO: 164624 - protein, 9 aa, Yellow fever virus
KLGEISWEE

SEQ ID NO: 164625 - protein, 9 aa, Yellow fever virus
LGEISWEEE

SEQ ID NO: 164626 - protein, 9 aa, Yellow fever virus
GEVAWEEEA

SEQ ID NO: 164627 - protein, 9 aa, Yellow fever virus
EVAWEEEAE

SEQ ID NO: 164628 - protein, 9 aa, Yellow fever virus
ISWEEEAEI

SEQ ID NO: 164629 - protein, 9 aa, Yellow fever virus
AWEEEAEIS

SEQ ID NO: 164630 - protein, 9 aa, Yellow fever virus
EAEISGSSS

SEQ ID NO: 164631 - protein, 9 aa, Yellow fever virus
AEISGSSSR

SEQ ID NO: 164632 - protein, 9 aa, Yellow fever virus
EISGSSSRY

SEQ ID NO: 164633 - protein, 9 aa, Yellow fever virus
ISGSSSRYD

SEQ ID NO: 164634 - protein, 9 aa, Yellow fever virus
SGSSSRYDV

SEQ ID NO: 164635 - protein, 9 aa, Yellow fever virus
GSSSRYDVA

SEQ ID NO: 164636 - protein, 9 aa, Yellow fever virus
SSSRYDVAL

SEQ ID NO: 164637 - protein, 9 aa, Yellow fever virus
SSRYDVALS

SEQ ID NO: 164638 - protein, 9 aa, Yellow fever virus
SRYDVALSE

SEQ ID NO: 164639 - protein, 9 aa, Yellow fever virus
RYDVALNEQ

SEQ ID NO: 164640 - protein, 9 aa, Yellow fever virus
YDVALNEQG

SEQ ID NO: 164641 - protein, 9 aa, Yellow fever virus
DVALNEQGE

SEQ ID NO: 164642 - protein, 9 aa, Yellow fever virus
VALNEQGEF

SEQ ID NO: 164643 - protein, 9 aa, Yellow fever virus
ALNEQGEFK

SEQ ID NO: 164644 - protein, 9 aa, Yellow fever virus
LNEQGEFKL

SEQ ID NO: 164645 - protein, 9 aa, Yellow fever virus
NEQGEFKLL

SEQ ID NO: 164646 - protein, 9 aa, Yellow fever virus
GEFKLLSED

SEQ ID NO: 164647 - protein, 9 aa, Yellow fever virus
EFKLLSEDK

SEQ ID NO: 164648 - protein, 9 aa, Yellow fever virus
FKLLSEDKV

SEQ ID NO: 164649 - protein, 9 aa, Yellow fever virus
KLLSEDKVP

SEQ ID NO: 164650 - protein, 9 aa, Yellow fever virus
LLSEDKVPW

SEQ ID NO: 164651 - protein, 9 aa, Yellow fever virus
LSEDKVPWD

SEQ ID NO: 164652 - protein, 9 aa, Yellow fever virus
SEDKVPWDQ

SEQ ID NO: 164653 - protein, 9 aa, Yellow fever virus
EDKVPWDQI

SEQ ID NO: 164654 - protein, 9 aa, Yellow fever virus
DKVPWDQIV

SEQ ID NO: 164655 - protein, 9 aa, Yellow fever virus
KVPWDQIVM

SEQ ID NO: 164656 - protein, 9 aa, Yellow fever virus
VPWDQIVMT

SEQ ID NO: 164657 - protein, 9 aa, Yellow fever virus
PWDQIVMTS

SEQ ID NO: 164658 - protein, 9 aa, Yellow fever virus
WDQIVMTSL

SEQ ID NO: 164659 - protein, 9 aa, Yellow fever virus
DQIVMTSLA

SEQ ID NO: 164660 - protein, 9 aa, Yellow fever virus
QIVMTSLAL

SEQ ID NO: 164661 - protein, 9 aa, Yellow fever virus
IVMTSLALV

SEQ ID NO: 164662 - protein, 9 aa, Yellow fever virus
SLALVGAAI

SEQ ID NO: 164663 - protein, 9 aa, Yellow fever virus
LALVGAAIH

SEQ ID NO: 164664 - protein, 9 aa, Yellow fever virus
ALVGAAIHP

SEQ ID NO: 164665 - protein, 9 aa, Yellow fever virus
LVGAAIHPF

SEQ ID NO: 164666 - protein, 9 aa, Yellow fever virus
VGAAIHPFA

SEQ ID NO: 164667 - protein, 9 aa, Yellow fever virus
GAAIHPFAL

SEQ ID NO: 164668 - protein, 9 aa, Yellow fever virus
AAIHPFALL

SEQ ID NO: 164669 - protein, 9 aa, Yellow fever virus
AIHPFALLL

SEQ ID NO: 164670 - protein, 9 aa, Yellow fever virus
IHPFALLLV

SEQ ID NO: 164671 - protein, 9 aa, Yellow fever virus
HPSALLLVL

SEQ ID NO: 164672 - protein, 9 aa, Yellow fever virus
PFALLLVLG

SEQ ID NO: 164673 - protein, 9 aa, Yellow fever virus
FALLLVLGG

SEQ ID NO: 164674 - protein, 9 aa, Yellow fever virus
ALLLVLGGW

SEQ ID NO: 164675 - protein, 9 aa, Yellow fever virus
LLLVLGGWV

SEQ ID NO: 164676 - protein, 9 aa, Yellow fever virus
LLVLGGWVL

SEQ ID NO: 164677 - protein, 9 aa, Yellow fever virus
LVLGGWVLH

SEQ ID NO: 164678 - protein, 9 aa, Yellow fever virus
VLGGWVLHI

SEQ ID NO: 164679 - protein, 9 aa, Yellow fever virus
LAGWLFHVK

SEQ ID NO: 164680 - protein, 9 aa, Yellow fever virus
AGWLFHVKG

SEQ ID NO: 164681 - protein, 9 aa, Yellow fever virus
GWLFHVKGA

SEQ ID NO: 164682 - protein, 9 aa, Yellow fever virus
WLFHVKGAR

SEQ ID NO: 164683 - protein, 9 aa, Yellow fever virus
LFHVKGARR

SEQ ID NO: 164684 - protein, 9 aa, Yellow fever virus
FHVKGARRS

SEQ ID NO: 164685 - protein, 9 aa, Yellow fever virus
HIKGARRSG

SEQ ID NO: 164686 - protein, 9 aa, Yellow fever virus
IKGARRSGD

SEQ ID NO: 164687 - protein, 9 aa, Yellow fever virus
KGARRSGDV

SEQ ID NO: 164688 - protein, 9 aa, Yellow fever virus
RARRSGDVL

SEQ ID NO: 164689 - protein, 9 aa, Yellow fever virus
LWDIPTPKV

SEQ ID NO: 164690 - protein, 9 aa, Yellow fever virus
WDIPTPKVI

SEQ ID NO: 164691 - protein, 9 aa, Yellow fever virus
DIPTPKVIE

SEQ ID NO: 164692 - protein, 9 aa, Yellow fever virus
IPTPKVIEE

SEQ ID NO: 164693 - protein, 9 aa, Yellow fever virus
PTPKVIEEC

SEQ ID NO: 164694 - protein, 9 aa, Yellow fever virus
TPKVIEECE

SEQ ID NO: 164695 - protein, 9 aa, Yellow fever virus
PKVIEECEH

SEQ ID NO: 164696 - protein, 9 aa, Yellow fever virus
KVIEECEHL

SEQ ID NO: 164697 - protein, 9 aa, Yellow fever virus
VIEECEHLE

SEQ ID NO: 164698 - protein, 9 aa, Yellow fever virus
IEECEYLED

SEQ ID NO: 164699 - protein, 9 aa, Yellow fever virus
EECEYLEDG

SEQ ID NO: 164700 - protein, 9 aa, Yellow fever virus
ECEYLEDGI

SEQ ID NO: 164701 - protein, 9 aa, Yellow fever virus
CEHLEDGIS

SEQ ID NO: 164702 - protein, 9 aa, Yellow fever virus
EYLEDGIYG

SEQ ID NO: 164703 - protein, 9 aa, Yellow fever virus
HLEDGISGI

SEQ ID NO: 164704 - protein, 9 aa, Yellow fever virus
LEDGISGIF

SEQ ID NO: 164705 - protein, 9 aa, Yellow fever virus
EDGISGIFQ

SEQ ID NO: 164706 - protein, 9 aa, Yellow fever virus
DGISGIFQS

SEQ ID NO: 164707 - protein, 9 aa, Yellow fever virus
GISGIFQST

SEQ ID NO: 164708 - protein, 9 aa, Yellow fever virus
ISGIFQSTF

SEQ ID NO: 164709 - protein, 9 aa, Yellow fever virus
SGIFQSTFL

SEQ ID NO: 164710 - protein, 9 aa, Yellow fever virus
HVTRGAFLL

SEQ ID NO: 164711 - protein, 9 aa, Yellow fever virus
VTRGAFLLR

SEQ ID NO: 164712 - protein, 9 aa, Yellow fever virus
TRGAFLLRN

SEQ ID NO: 164713 - protein, 9 aa, Yellow fever virus
RGAFLLRNG

SEQ ID NO: 164714 - protein, 9 aa, Yellow fever virus
GAFLLRNGK

SEQ ID NO: 164715 - protein, 9 aa, Yellow fever virus
AFLLRNGKK

SEQ ID NO: 164716 - protein, 9 aa, Yellow fever virus
FLLRNGKKL

SEQ ID NO: 164717 - protein, 9 aa, Yellow fever virus
LLRNGKKLV

SEQ ID NO: 164718 - protein, 9 aa, Yellow fever virus
LRNGKKLVP

SEQ ID NO: 164719 - protein, 9 aa, Yellow fever virus
RNGKKLVPS

SEQ ID NO: 164720 - protein, 9 aa, Yellow fever virus
NGKKLVPSW

SEQ ID NO: 164721 - protein, 9 aa, Yellow fever virus
GKKLVPSWA

SEQ ID NO: 164722 - protein, 9 aa, Yellow fever virus
KKLVPSWAS

SEQ ID NO: 164723 - protein, 9 aa, Yellow fever virus
KLVPSWASV

SEQ ID NO: 164724 - protein, 9 aa, Yellow fever virus
LVPSWASVK

SEQ ID NO: 164725 - protein, 9 aa, Yellow fever virus
VPSWASVKE

SEQ ID NO: 164726 - protein, 9 aa, Yellow fever virus
AYGGSWKLD

SEQ ID NO: 164727 - protein, 9 aa, Yellow fever virus
YGGSWKLDG

SEQ ID NO: 164728 - protein, 9 aa, Yellow fever virus
GGSWKLDGK

SEQ ID NO: 164729 - protein, 9 aa, Yellow fever virus
GSWKLDGKW

SEQ ID NO: 164730 - protein, 9 aa, Yellow fever virus
SWKLDGKWD

SEQ ID NO: 164731 - protein, 9 aa, Yellow fever virus
WKLDGKWDG

SEQ ID NO: 164732 - protein, 9 aa, Yellow fever virus
KLDGKWDGE

SEQ ID NO: 164733 - protein, 9 aa, Yellow fever virus
LDGKWDGEE

SEQ ID NO: 164734 - protein, 9 aa, Yellow fever virus
DGKWDGEEE

SEQ ID NO: 164735 - protein, 9 aa, Yellow fever virus
GKWDGEEEV

SEQ ID NO: 164736 - protein, 9 aa, Yellow fever virus
KWDGEEEVQ

SEQ ID NO: 164737 - protein, 9 aa, Yellow fever virus
EEVQLIAAA

SEQ ID NO: 164738 - protein, 9 aa, Yellow fever virus
EVQLIAAAP

SEQ ID NO: 164739 - protein, 9 aa, Yellow fever virus
VQLIAAAPG

SEQ ID NO: 164740 - protein, 9 aa, Yellow fever virus
QLIAAAPGK

SEQ ID NO: 164741 - protein, 9 aa, Yellow fever virus
LIAAVPGKA

SEQ ID NO: 164742 - protein, 9 aa, Yellow fever virus
IAAVPGKAV

SEQ ID NO: 164743 - protein, 9 aa, Yellow fever virus
AAVPGKAVV

SEQ ID NO: 164744 - protein, 9 aa, Yellow fever virus
AVPGKAVVN

SEQ ID NO: 164745 - protein, 9 aa, Yellow fever virus
VPGKAVVNV

SEQ ID NO: 164746 - protein, 9 aa, Yellow fever virus
PGKAVVNVQ

SEQ ID NO: 164747 - protein, 9 aa, Yellow fever virus
GKAVVNVQT

SEQ ID NO: 164748 - protein, 9 aa, Yellow fever virus
KAVVNVQTK

SEQ ID NO: 164749 - protein, 9 aa, Yellow fever virus
AVVNVQTKP

SEQ ID NO: 164750 - protein, 9 aa, Yellow fever virus
VNVQTKPSV

SEQ ID NO: 164751 - protein, 9 aa, Yellow fever virus
NVQTKPSVF

SEQ ID NO: 164752 - protein, 9 aa, Yellow fever virus
VQTKPSVFK

SEQ ID NO: 164753 - protein, 9 aa, Yellow fever virus
QTKPSLFRV

SEQ ID NO: 164754 - protein, 9 aa, Yellow fever virus
TKPSLFRVK

SEQ ID NO: 164755 - protein, 9 aa, Yellow fever virus
KPSVFKVRN

SEQ ID NO: 164756 - protein, 9 aa, Yellow fever virus
PSVFKVRNG

SEQ ID NO: 164757 - protein, 9 aa, Yellow fever virus
SVFKVRNGG

SEQ ID NO: 164758 - protein, 9 aa, Yellow fever virus
VFKVRNGGE

SEQ ID NO: 164759 - protein, 9 aa, Yellow fever virus
FRVKNGGEI

SEQ ID NO: 164760 - protein, 9 aa, Yellow fever virus
RVKNGGEIG

SEQ ID NO: 164761 - protein, 9 aa, Yellow fever virus
VKNGGEIGA

SEQ ID NO: 164762 - protein, 9 aa, Yellow fever virus
KNGGEIGAV

SEQ ID NO: 164763 - protein, 9 aa, Yellow fever virus
SGSPIVNRS

SEQ ID NO: 164764 - protein, 9 aa, Yellow fever virus
GSPIVNRSG

SEQ ID NO: 164765 - protein, 9 aa, Yellow fever virus
SPIVNRSGE

SEQ ID NO: 164766 - protein, 9 aa, Yellow fever virus
PIVNRSGEV

SEQ ID NO: 164767 - protein, 9 aa, Yellow fever virus
IVNRSGEVV

SEQ ID NO: 164768 - protein, 9 aa, Yellow fever virus
VNRSGEVVG

SEQ ID NO: 164769 - protein, 9 aa, Yellow fever virus
NRSGEVVGL

SEQ ID NO: 164770 - protein, 9 aa, Yellow fever virus
RSGEVVGLY

SEQ ID NO: 164771 - protein, 9 aa, Yellow fever virus
SGEVVGLYG

SEQ ID NO: 164772 - protein, 9 aa, Yellow fever virus
GEVVGLYGN

SEQ ID NO: 164773 - protein, 9 aa, Yellow fever virus
EVVGLYGNG

SEQ ID NO: 164774 - protein, 9 aa, Yellow fever virus
VVGLYGNGI

SEQ ID NO: 164775 - protein, 9 aa, Yellow fever virus
VGLYGNGIL

SEQ ID NO: 164776 - protein, 9 aa, Yellow fever virus
VSAISQTEL

SEQ ID NO: 164777 - protein, 9 aa, Yellow fever virus
SAISQTELK

SEQ ID NO: 164778 - protein, 9 aa, Yellow fever virus
AISQTELKE

SEQ ID NO: 164779 - protein, 9 aa, Yellow fever virus
ISQTELKEE

SEQ ID NO: 164780 - protein, 9 aa, Yellow fever virus
SQTEVKEES

SEQ ID NO: 164781 - protein, 9 aa, Yellow fever virus
QTEVKEESK

SEQ ID NO: 164782 - protein, 9 aa, Yellow fever virus
TEVKEESKE

SEQ ID NO: 164783 - protein, 9 aa, Yellow fever virus
EVKEESKEE

SEQ ID NO: 164784 - protein, 9 aa, Yellow fever virus
VKEESKEEL

SEQ ID NO: 164785 - protein, 9 aa, Yellow fever virus
KEESKEELQ

SEQ ID NO: 164786 - protein, 9 aa, Yellow fever virus
EEGKEELRE

SEQ ID NO: 164787 - protein, 9 aa, Yellow fever virus
EGKEELREI

SEQ ID NO: 164788 - protein, 9 aa, Yellow fever virus
GKEELREIP

SEQ ID NO: 164789 - protein, 9 aa, Yellow fever virus
KEELREIPT

SEQ ID NO: 164790 - protein, 9 aa, Yellow fever virus
EELREIPTM

SEQ ID NO: 164791 - protein, 9 aa, Yellow fever virus
ELREIPTML

SEQ ID NO: 164792 - protein, 9 aa, Yellow fever virus
LREIPTMLK

SEQ ID NO: 164793 - protein, 9 aa, Yellow fever virus
REIPTMLKK

SEQ ID NO: 164794 - protein, 9 aa, Yellow fever virus
EISTMLKKG

SEQ ID NO: 164795 - protein, 9 aa, Yellow fever virus
IPTMLKKGK

SEQ ID NO: 164796 - protein, 9 aa, Yellow fever virus
PTMLKKGKT

SEQ ID NO: 164797 - protein, 9 aa, Yellow fever virus
TMLKKGKTT

SEQ ID NO: 164798 - protein, 9 aa, Yellow fever virus
MLKKGMTTI

SEQ ID NO: 164799 - protein, 9 aa, Yellow fever virus
LKKGMTTIL

SEQ ID NO: 164800 - protein, 9 aa, Yellow fever virus
KKGMTTVLD

SEQ ID NO: 164801 - protein, 9 aa, Yellow fever virus
KGMTTILDF

SEQ ID NO: 164802 - protein, 9 aa, Yellow fever virus
GMTTILDFH

SEQ ID NO: 164803 - protein, 9 aa, Yellow fever virus
MTTILDFHP

SEQ ID NO: 164804 - protein, 9 aa, Yellow fever virus
TTVLDFHPG

SEQ ID NO: 164805 - protein, 9 aa, Yellow fever virus
TVLDFHPGA

SEQ ID NO: 164806 - protein, 9 aa, Yellow fever virus
VLDFHPGAG

SEQ ID NO: 164807 - protein, 9 aa, Yellow fever virus
LDYHPGAGK

SEQ ID NO: 164808 - protein, 9 aa, Yellow fever virus
DYHPGAGKT

SEQ ID NO: 164809 - protein, 9 aa, Yellow fever virus
YHPGAGKTR

SEQ ID NO: 164810 - protein, 9 aa, Yellow fever virus
LSEMKEAFQ

SEQ ID NO: 164811 - protein, 9 aa, Yellow fever virus
SEMKEAFQG

SEQ ID NO: 164812 - protein, 9 aa, Yellow fever virus
EMKEAFQGL

SEQ ID NO: 164813 - protein, 9 aa, Yellow fever virus
MKEAFQGLD

SEQ ID NO: 164814 - protein, 9 aa, Yellow fever virus
KEAFQGLDV

SEQ ID NO: 164815 - protein, 9 aa, Yellow fever virus
EAFQGLDVK

SEQ ID NO: 164816 - protein, 9 aa, Yellow fever virus
AFQGLDVKF

SEQ ID NO: 164817 - protein, 9 aa, Yellow fever virus
FQGLDVKFH

SEQ ID NO: 164818 - protein, 9 aa, Yellow fever virus
QGLDVKFHT

SEQ ID NO: 164819 - protein, 9 aa, Yellow fever virus
AFSAHGSGK

SEQ ID NO: 164820 - protein, 9 aa, Yellow fever virus
FSAHGSGKE

SEQ ID NO: 164821 - protein, 9 aa, Yellow fever virus
SAHGSGKEV

SEQ ID NO: 164822 - protein, 9 aa, Yellow fever virus
AHGSGKEVI

SEQ ID NO: 164823 - protein, 9 aa, Yellow fever virus
HGSGKEVID

SEQ ID NO: 164824 - protein, 9 aa, Yellow fever virus
GSGKEVIDA

SEQ ID NO: 164825 - protein, 9 aa, Yellow fever virus
SGKEVIDAM

SEQ ID NO: 164826 - protein, 9 aa, Yellow fever virus
GKEVIDAMC

SEQ ID NO: 164827 - protein, 9 aa, Yellow fever virus
KEVIDAMCH

SEQ ID NO: 164828 - protein, 9 aa, Yellow fever virus
EVIDVMCHA

SEQ ID NO: 164829 - protein, 9 aa, Yellow fever virus
VIDVMCHAT

SEQ ID NO: 164830 - protein, 9 aa, Yellow fever virus
IDVMCHATL

SEQ ID NO: 164831 - protein, 9 aa, Yellow fever virus
DVMCHATLT

SEQ ID NO: 164832 - protein, 9 aa, Yellow fever virus
VMCHATLTY

SEQ ID NO: 164833 - protein, 9 aa, Yellow fever virus
YRMLEPTRI

SEQ ID NO: 164834 - protein, 9 aa, Yellow fever virus
RMLEPTRIV

SEQ ID NO: 164835 - protein, 9 aa, Yellow fever virus
MLEPTRIVN

SEQ ID NO: 164836 - protein, 9 aa, Yellow fever virus
LEPTRIVNW

SEQ ID NO: 164837 - protein, 9 aa, Yellow fever virus
EPTRIVNWE

SEQ ID NO: 164838 - protein, 9 aa, Yellow fever virus
PTRIVNWEV

SEQ ID NO: 164839 - protein, 9 aa, Yellow fever virus
TRIVNWEVI

SEQ ID NO: 164840 - protein, 9 aa, Yellow fever virus
RIVNWEVII

SEQ ID NO: 164841 - protein, 9 aa, Yellow fever virus
IVNWEVIIM

SEQ ID NO: 164842 - protein, 9 aa, Yellow fever virus
TDIPSEPWT

SEQ ID NO: 164843 - protein, 9 aa, Yellow fever virus
DIPSEPWTS

SEQ ID NO: 164844 - protein, 9 aa, Yellow fever virus
IPSEPWTSG

SEQ ID NO: 164845 - protein, 9 aa, Yellow fever virus
PSEPWTSGH

SEQ ID NO: 164846 - protein, 9 aa, Yellow fever virus
SEPWTSGHE

SEQ ID NO: 164847 - protein, 9 aa, Yellow fever virus
EPWTSGHEW

SEQ ID NO: 164848 - protein, 9 aa, Yellow fever virus
PWTSGHEWI

SEQ ID NO: 164849 - protein, 9 aa, Yellow fever virus
WTSGHEWIL

SEQ ID NO: 164850 - protein, 9 aa, Yellow fever virus
TSGHEWILA

SEQ ID NO: 164851 - protein, 9 aa, Yellow fever virus
SGHEWILAD

SEQ ID NO: 164852 - protein, 9 aa, Yellow fever virus
GHEWILADK

SEQ ID NO: 164853 - protein, 9 aa, Yellow fever virus
HEWILADKR

SEQ ID NO: 164854 - protein, 9 aa, Yellow fever virus
EWILADKRP

SEQ ID NO: 164855 - protein, 9 aa, Yellow fever virus
ASLRKAGKN

SEQ ID NO: 164856 - protein, 9 aa, Yellow fever virus
SLRKAGKNV

SEQ ID NO: 164857 - protein, 9 aa, Yellow fever virus
LRKAGKNVV

SEQ ID NO: 164858 - protein, 9 aa, Yellow fever virus
RKAGKNVVV

SEQ ID NO: 164859 - protein, 9 aa, Yellow fever virus
KAGKNVVVL

SEQ ID NO: 164860 - protein, 9 aa, Yellow fever virus
AGKNVVVLN

SEQ ID NO: 164861 - protein, 9 aa, Yellow fever virus
GKNVVVLNR

SEQ ID NO: 164862 - protein, 9 aa, Yellow fever virus
KNVVVLNRK

SEQ ID NO: 164863 - protein, 9 aa, Yellow fever virus
NVVVLNRKT

SEQ ID NO: 164864 - protein, 9 aa, Yellow fever virus
VLNRKTFEK

SEQ ID NO: 164865 - protein, 9 aa, Yellow fever virus
LNRKTFEKE

SEQ ID NO: 164866 - protein, 9 aa, Yellow fever virus
NRKTFEKEY

SEQ ID NO: 164867 - protein, 9 aa, Yellow fever virus
RKTFEKEYP

SEQ ID NO: 164868 - protein, 9 aa, Yellow fever virus
KTFEKEYPT

SEQ ID NO: 164869 - protein, 9 aa, Yellow fever virus
TFEKEYPTI

SEQ ID NO: 164870 - protein, 9 aa, Yellow fever virus
FEKEYPTIK

SEQ ID NO: 164871 - protein, 9 aa, Yellow fever virus
EKEYPTIKQ

SEQ ID NO: 164872 - protein, 9 aa, Yellow fever virus
KEYPTIKQK

SEQ ID NO: 164873 - protein, 9 aa, Yellow fever virus
EYPTIKQKR

SEQ ID NO: 164874 - protein, 9 aa, Yellow fever virus
YPTIKQKRP

SEQ ID NO: 164875 - protein, 9 aa, Yellow fever virus
PTIKQKRPD

SEQ ID NO: 164876 - protein, 9 aa, Yellow fever virus
TIKQKRPDF

SEQ ID NO: 164877 - protein, 9 aa, Yellow fever virus
IKQKRPDFI

SEQ ID NO: 164878 - protein, 9 aa, Yellow fever virus
KQKRPDFIL

SEQ ID NO: 164879 - protein, 9 aa, Yellow fever virus
QKRPDFILA

SEQ ID NO: 164880 - protein, 9 aa, Yellow fever virus
KRPDFILAT

SEQ ID NO: 164881 - protein, 9 aa, Yellow fever virus
RPDFILATD

SEQ ID NO: 164882 - protein, 9 aa, Yellow fever virus
EMGANLCVD

SEQ ID NO: 164883 - protein, 9 aa, Yellow fever virus
MGANLCVDR

SEQ ID NO: 164884 - protein, 9 aa, Yellow fever virus
GANLCVDRV

SEQ ID NO: 164885 - protein, 9 aa, Yellow fever virus
ANLCVDRVL

SEQ ID NO: 164886 - protein, 9 aa, Yellow fever virus
NLCVDRVLD

SEQ ID NO: 164887 - protein, 9 aa, Yellow fever virus
LCVDRVLDC

SEQ ID NO: 164888 - protein, 9 aa, Yellow fever virus
CVDRVLDCR

SEQ ID NO: 164889 - protein, 9 aa, Yellow fever virus
VDRVLDCRT

SEQ ID NO: 164890 - protein, 9 aa, Yellow fever virus
DRVLDCRTA

SEQ ID NO: 164891 - protein, 9 aa, Yellow fever virus
RVLDCRTAY

SEQ ID NO: 164892 - protein, 9 aa, Yellow fever virus
VLDCRTAYK

SEQ ID NO: 164893 - protein, 9 aa, Yellow fever virus
LDCRTAYKP

SEQ ID NO: 164894 - protein, 9 aa, Yellow fever virus
DCRTAYKPV

SEQ ID NO: 164895 - protein, 9 aa, Yellow fever virus
CRTAYKPVL

SEQ ID NO: 164896 - protein, 9 aa, Yellow fever virus
RTAYKPVLV

SEQ ID NO: 164897 - protein, 9 aa, Yellow fever virus
TAYKPVLVD

SEQ ID NO: 164898 - protein, 9 aa, Yellow fever virus
AYKPVLVDE

SEQ ID NO: 164899 - protein, 9 aa, Yellow fever virus
YKPVLVDEG

SEQ ID NO: 164900 - protein, 9 aa, Yellow fever virus
KPVLVDEGK

SEQ ID NO: 164901 - protein, 9 aa, Yellow fever virus
PVLVDEGKK

SEQ ID NO: 164902 - protein, 9 aa, Yellow fever virus
VLVDEGKKV

SEQ ID NO: 164903 - protein, 9 aa, Yellow fever virus
LVDEGKKVA

SEQ ID NO: 164904 - protein, 9 aa, Yellow fever virus
VDEGKKVAI

SEQ ID NO: 164905 - protein, 9 aa, Yellow fever virus
DEGKKVAIK

SEQ ID NO: 164906 - protein, 9 aa, Yellow fever virus
EGKKVAIKG

SEQ ID NO: 164907 - protein, 9 aa, Yellow fever virus
GKKVAIKGP

SEQ ID NO: 164908 - protein, 9 aa, Yellow fever virus
KKVAIKGPL

SEQ ID NO: 164909 - protein, 9 aa, Yellow fever virus
YYSEPTSED

SEQ ID NO: 164910 - protein, 9 aa, Yellow fever virus
YSEPTSEDN

SEQ ID NO: 164911 - protein, 9 aa, Yellow fever virus
SEPTSEDNA

SEQ ID NO: 164912 - protein, 9 aa, Yellow fever virus
EPTSEDNAH

SEQ ID NO: 164913 - protein, 9 aa, Yellow fever virus
PTSEDNAHH

SEQ ID NO: 164914 - protein, 9 aa, Yellow fever virus
TSEDNAHHV

SEQ ID NO: 164915 - protein, 9 aa, Yellow fever virus
SEDNAHHVC

SEQ ID NO: 164916 - protein, 9 aa, Yellow fever virus
EDNAHHVCW

SEQ ID NO: 164917 - protein, 9 aa, Yellow fever virus
DNAHHVCWL

SEQ ID NO: 164918 - protein, 9 aa, Yellow fever virus
GMVAPLYGI

SEQ ID NO: 164919 - protein, 9 aa, Yellow fever virus
MVAPLYGIE

SEQ ID NO: 164920 - protein, 9 aa, Yellow fever virus
VAPLYGIEG

SEQ ID NO: 164921 - protein, 9 aa, Yellow fever virus
APLYGIEGT

SEQ ID NO: 164922 - protein, 9 aa, Yellow fever virus
PLYGIEGTK

SEQ ID NO: 164923 - protein, 9 aa, Yellow fever virus
LYGIEGTKT

SEQ ID NO: 164924 - protein, 9 aa, Yellow fever virus
YGIEGTKTP

SEQ ID NO: 164925 - protein, 9 aa, Yellow fever virus
GIEGTKTPV

SEQ ID NO: 164926 - protein, 9 aa, Yellow fever virus
IEGTKTPVS

SEQ ID NO: 164927 - protein, 9 aa, Yellow fever virus
EGIKTPVSP

SEQ ID NO: 164928 - protein, 9 aa, Yellow fever virus
GIKTPVSPG

SEQ ID NO: 164929 - protein, 9 aa, Yellow fever virus
IKTPVSPGE

SEQ ID NO: 164930 - protein, 9 aa, Yellow fever virus
MRLRDDQRR

SEQ ID NO: 164931 - protein, 9 aa, Yellow fever virus
RLRDDQRRV

SEQ ID NO: 164932 - protein, 9 aa, Yellow fever virus
LRDDQRRVF

SEQ ID NO: 164933 - protein, 9 aa, Yellow fever virus
RDDQRRVFR

SEQ ID NO: 164934 - protein, 9 aa, Yellow fever virus
DDQRRVFRE

SEQ ID NO: 164935 - protein, 9 aa, Yellow fever virus
DQRRVFREL

SEQ ID NO: 164936 - protein, 9 aa, Yellow fever virus
QRRVFRELV

SEQ ID NO: 164937 - protein, 9 aa, Yellow fever virus
RRVFRELVR

SEQ ID NO: 164938 - protein, 9 aa, Yellow fever virus
RVFRELVRG

SEQ ID NO: 164939 - protein, 9 aa, Yellow fever virus
VFRELVRGC

SEQ ID NO: 164940 - protein, 9 aa, Yellow fever virus
FRELVRGCD

SEQ ID NO: 164941 - protein, 9 aa, Yellow fever virus
RELVRGCDL

SEQ ID NO: 164942 - protein, 9 aa, Yellow fever virus
ELVRGCDLP

SEQ ID NO: 164943 - protein, 9 aa, Yellow fever virus
LVRGCDLPV

SEQ ID NO: 164944 - protein, 9 aa, Yellow fever virus
VRGCDLPVW

SEQ ID NO: 164945 - protein, 9 aa, Yellow fever virus
RGCDLPVWL

SEQ ID NO: 164946 - protein, 9 aa, Yellow fever virus
GCDLPVWLS

SEQ ID NO: 164947 - protein, 9 aa, Yellow fever virus
CDLPVWLAW

SEQ ID NO: 164948 - protein, 9 aa, Yellow fever virus
DLPVWLAWQ

SEQ ID NO: 164949 - protein, 9 aa, Yellow fever virus
QPVWLSWQV

SEQ ID NO: 164950 - protein, 9 aa, Yellow fever virus
PVWLAWQVA

SEQ ID NO: 164951 - protein, 9 aa, Yellow fever virus
VWLAWQVAK

SEQ ID NO: 164952 - protein, 9 aa, Yellow fever virus
WLAWQVAKA

SEQ ID NO: 164953 - protein, 9 aa, Yellow fever virus
LAWQVAKAG

SEQ ID NO: 164954 - protein, 9 aa, Yellow fever virus
SWQVAKPGL

SEQ ID NO: 164955 - protein, 9 aa, Yellow fever virus
WQVAKPGLK

SEQ ID NO: 164956 - protein, 9 aa, Yellow fever virus
QVAKPGLKT

SEQ ID NO: 164957 - protein, 9 aa, Yellow fever virus
VAKPGLKTN

SEQ ID NO: 164958 - protein, 9 aa, Yellow fever virus
AKPGLKTND

SEQ ID NO: 164959 - protein, 9 aa, Yellow fever virus
KPGLKTNDR

SEQ ID NO: 164960 - protein, 9 aa, Yellow fever virus
PGLKTNDRK

SEQ ID NO: 164961 - protein, 9 aa, Yellow fever virus
TNDRKWCFD

SEQ ID NO: 164962 - protein, 9 aa, Yellow fever virus
NDRKWCFDG

SEQ ID NO: 164963 - protein, 9 aa, Yellow fever virus
DRKWCFDGP

SEQ ID NO: 164964 - protein, 9 aa, Yellow fever virus
RKWCFDGPK

SEQ ID NO: 164965 - protein, 9 aa, Yellow fever virus
KWCFDGPKE

SEQ ID NO: 164966 - protein, 9 aa, Yellow fever virus
WCFDGPKEH

SEQ ID NO: 164967 - protein, 9 aa, Yellow fever virus
CFDGPKEHE

SEQ ID NO: 164968 - protein, 9 aa, Yellow fever virus
FDGPKEHEI

SEQ ID NO: 164969 - protein, 9 aa, Yellow fever virus
EGPDEHEIL

SEQ ID NO: 164970 - protein, 9 aa, Yellow fever virus
GPDEHEILN

SEQ ID NO: 164971 - protein, 9 aa, Yellow fever virus
PKEHEILND

SEQ ID NO: 164972 - protein, 9 aa, Yellow fever virus
EEHEILNDN

SEQ ID NO: 164973 - protein, 9 aa, Yellow fever virus
EHEILNDNG

SEQ ID NO: 164974 - protein, 9 aa, Yellow fever virus
HEILNDNGE

SEQ ID NO: 164975 - protein, 9 aa, Yellow fever virus
EILNDNGET

SEQ ID NO: 164976 - protein, 9 aa, Yellow fever virus
ILNDNGETV

SEQ ID NO: 164977 - protein, 9 aa, Yellow fever virus
LNDNGETVK

SEQ ID NO: 164978 - protein, 9 aa, Yellow fever virus
NDNGETVKC

SEQ ID NO: 164979 - protein, 9 aa, Yellow fever virus
DNGETVKCR

SEQ ID NO: 164980 - protein, 9 aa, Yellow fever virus
NGETVKCRS

SEQ ID NO: 164981 - protein, 9 aa, Yellow fever virus
GETVKCRSP

SEQ ID NO: 164982 - protein, 9 aa, Yellow fever virus
ETVKCRSPG

SEQ ID NO: 164983 - protein, 9 aa, Yellow fever virus
TVKCRSPGG

SEQ ID NO: 164984 - protein, 9 aa, Yellow fever virus
VKCRSPGGA

SEQ ID NO: 164985 - protein, 9 aa, Yellow fever virus
KCRSPGGAK

SEQ ID NO: 164986 - protein, 9 aa, Yellow fever virus
CRSPGGAKK

SEQ ID NO: 164987 - protein, 9 aa, Yellow fever virus
RSPGGAKKA

SEQ ID NO: 164988 - protein, 9 aa, Yellow fever virus
SPGGAKKAL

SEQ ID NO: 164989 - protein, 9 aa, Yellow fever virus
PGGAKKALR

SEQ ID NO: 164990 - protein, 9 aa, Yellow fever virus
GGAKKALRP

SEQ ID NO: 164991 - protein, 9 aa, Yellow fever virus
GAKKALRPR

SEQ ID NO: 164992 - protein, 9 aa, Yellow fever virus
AKKALRPRW

SEQ ID NO: 164993 - protein, 9 aa, Yellow fever virus
KKALRPRWC

SEQ ID NO: 164994 - protein, 9 aa, Yellow fever virus
KALRPRWCD

SEQ ID NO: 164995 - protein, 9 aa, Yellow fever virus
ALRPRWCDE

SEQ ID NO: 164996 - protein, 9 aa, Yellow fever virus
VSSDQSALA

SEQ ID NO: 164997 - protein, 9 aa, Yellow fever virus
SSDQSALAD

SEQ ID NO: 164998 - protein, 9 aa, Yellow fever virus
SDQSALADF

SEQ ID NO: 164999 - protein, 9 aa, Yellow fever virus
DQSALADFI

SEQ ID NO: 165000 - protein, 9 aa, Yellow fever virus
QSALADFIK

SEQ ID NO: 165001 - protein, 9 aa, Yellow fever virus
SALADFIKF

SEQ ID NO: 165002 - protein, 9 aa, Yellow fever virus
ALADFIKFA

SEQ ID NO: 165003 - protein, 9 aa, Yellow fever virus
LADFIKFAE

SEQ ID NO: 165004 - protein, 9 aa, Yellow fever virus
ADFIKFAEG

SEQ ID NO: 165005 - protein, 9 aa, Yellow fever virus
DFIKFAEGR

SEQ ID NO: 165006 - protein, 9 aa, Yellow fever virus
AEGRRGAAD

SEQ ID NO: 165007 - protein, 9 aa, Yellow fever virus
EGRRGAAEM

SEQ ID NO: 165008 - protein, 9 aa, Yellow fever virus
GRRGAAEML

SEQ ID NO: 165009 - protein, 9 aa, Yellow fever virus
RRGAAEMLV

SEQ ID NO: 165010 - protein, 9 aa, Yellow fever virus
RGAAEMLVV

SEQ ID NO: 165011 - protein, 9 aa, Yellow fever virus
GAAEMLVVL

SEQ ID NO: 165012 - protein, 9 aa, Yellow fever virus
AAEMLVVLT

SEQ ID NO: 165013 - protein, 9 aa, Yellow fever virus
AEMLVVLTE

SEQ ID NO: 165014 - protein, 9 aa, Yellow fever virus
EMLVVLTEL

SEQ ID NO: 165015 - protein, 9 aa, Yellow fever virus
MLVVLTELP

SEQ ID NO: 165016 - protein, 9 aa, Yellow fever virus
LVVLTELPD

SEQ ID NO: 165017 - protein, 9 aa, Yellow fever virus
VVLTELPDF

SEQ ID NO: 165018 - protein, 9 aa, Yellow fever virus
VLTELPDFL

SEQ ID NO: 165019 - protein, 9 aa, Yellow fever virus
LTELPDFLA

SEQ ID NO: 165020 - protein, 9 aa, Yellow fever virus
TELPDFLAK

SEQ ID NO: 165021 - protein, 9 aa, Yellow fever virus
EAMDTISVL

SEQ ID NO: 165022 - protein, 9 aa, Yellow fever virus
AMDTISVLL

SEQ ID NO: 165023 - protein, 9 aa, Yellow fever virus
MDTISVLLH

SEQ ID NO: 165024 - protein, 9 aa, Yellow fever virus
DTISVLLHS

SEQ ID NO: 165025 - protein, 9 aa, Yellow fever virus
TISVLLHSE

SEQ ID NO: 165026 - protein, 9 aa, Yellow fever virus
ISVLLHSEE

SEQ ID NO: 165027 - protein, 9 aa, Yellow fever virus
SVLLHSEEG

SEQ ID NO: 165028 - protein, 9 aa, Yellow fever virus
VLLHSEEGS

SEQ ID NO: 165029 - protein, 9 aa, Yellow fever virus
LLHSEEGSR

SEQ ID NO: 165030 - protein, 9 aa, Yellow fever virus
MMPEAMTIA

SEQ ID NO: 165031 - protein, 9 aa, Yellow fever virus
MPEAMTIAM

SEQ ID NO: 165032 - protein, 9 aa, Yellow fever virus
PEAMTIAML

SEQ ID NO: 165033 - protein, 9 aa, Yellow fever virus
EAMTIAMLF

SEQ ID NO: 165034 - protein, 9 aa, Yellow fever virus
AMTIVMLFL

SEQ ID NO: 165035 - protein, 9 aa, Yellow fever virus
MTIVMLFLL

SEQ ID NO: 165036 - protein, 9 aa, Yellow fever virus
TIVMLFLLA

SEQ ID NO: 165037 - protein, 9 aa, Yellow fever virus
IVMLFLLAG

SEQ ID NO: 165038 - protein, 9 aa, Yellow fever virus
VMLFLLAGL

SEQ ID NO: 165039 - protein, 9 aa, Yellow fever virus
MLFLLAGLL

SEQ ID NO: 165040 - protein, 9 aa, Yellow fever virus
LFLLAGLLT

SEQ ID NO: 165041 - protein, 9 aa, Yellow fever virus
FLLAGLLTS

SEQ ID NO: 165042 - protein, 9 aa, Yellow fever virus
LLAGLLTSG

SEQ ID NO: 165043 - protein, 9 aa, Yellow fever virus
LAGLLTSGA

SEQ ID NO: 165044 - protein, 9 aa, Yellow fever virus
AGLLTSGAV

SEQ ID NO: 165045 - protein, 9 aa, Yellow fever virus
GLLTSGAVI

SEQ ID NO: 165046 - protein, 9 aa, Yellow fever virus
LLTSGAVIF

SEQ ID NO: 165047 - protein, 9 aa, Yellow fever virus
LTSGAVIFF

SEQ ID NO: 165048 - protein, 9 aa, Yellow fever virus
TSGAVIFFM

SEQ ID NO: 165049 - protein, 9 aa, Yellow fever virus
SGAVIFFMS

SEQ ID NO: 165050 - protein, 9 aa, Yellow fever virus
GAVIFFMSP

SEQ ID NO: 165051 - protein, 9 aa, Yellow fever virus
AVIFFMSPK

SEQ ID NO: 165052 - protein, 9 aa, Yellow fever virus
IFFMSPKGM

SEQ ID NO: 165053 - protein, 9 aa, Yellow fever virus
FFMSPKGMS

SEQ ID NO: 165054 - protein, 9 aa, Yellow fever virus
FMSPKGMSR

SEQ ID NO: 165055 - protein, 9 aa, Yellow fever virus
MSPKGMSRM

SEQ ID NO: 165056 - protein, 9 aa, Yellow fever virus
SPKGMSRMS

SEQ ID NO: 165057 - protein, 9 aa, Yellow fever virus
PKGMSRMSM

SEQ ID NO: 165058 - protein, 9 aa, Yellow fever virus
KGMSRMSMA

SEQ ID NO: 165059 - protein, 9 aa, Yellow fever virus
GMSRMSMAM

SEQ ID NO: 165060 - protein, 9 aa, Yellow fever virus
MSRMSMAMG

SEQ ID NO: 165061 - protein, 9 aa, Yellow fever virus
SRMSMAKGT

SEQ ID NO: 165062 - protein, 9 aa, Yellow fever virus
RMSMAKGTM

SEQ ID NO: 165063 - protein, 9 aa, Yellow fever virus
MSMAKGTMA

SEQ ID NO: 165064 - protein, 9 aa, Yellow fever virus
SMAKGTMAG

SEQ ID NO: 165065 - protein, 9 aa, Yellow fever virus
MAMGTMAGS

SEQ ID NO: 165066 - protein, 9 aa, Yellow fever virus
AMGTMAGSG

SEQ ID NO: 165067 - protein, 9 aa, Yellow fever virus
MGTMAGSGY

SEQ ID NO: 165068 - protein, 9 aa, Yellow fever virus
GTMAGSGYL

SEQ ID NO: 165069 - protein, 9 aa, Yellow fever virus
TMAGSGYLM

SEQ ID NO: 165070 - protein, 9 aa, Yellow fever virus
MAGSGYLMF

SEQ ID NO: 165071 - protein, 9 aa, Yellow fever virus
AGSGYLMFL

SEQ ID NO: 165072 - protein, 9 aa, Yellow fever virus
GSGYLMFLG

SEQ ID NO: 165073 - protein, 9 aa, Yellow fever virus
SGYLMFLGG

SEQ ID NO: 165074 - protein, 9 aa, Yellow fever virus
GYLMFLGGA

SEQ ID NO: 165075 - protein, 9 aa, Yellow fever virus
YLMFLGGAK

SEQ ID NO: 165076 - protein, 9 aa, Yellow fever virus
LMFLGGVEP

SEQ ID NO: 165077 - protein, 9 aa, Yellow fever virus
MFLGGVEPT

SEQ ID NO: 165078 - protein, 9 aa, Yellow fever virus
FLGGAKPTH

SEQ ID NO: 165079 - protein, 9 aa, Yellow fever virus
LGGAKPTHI

SEQ ID NO: 165080 - protein, 9 aa, Yellow fever virus
GGVEPTHIS

SEQ ID NO: 165081 - protein, 9 aa, Yellow fever virus
GVEPTHISY

SEQ ID NO: 165082 - protein, 9 aa, Yellow fever virus
VKPTHISYV

SEQ ID NO: 165083 - protein, 9 aa, Yellow fever virus
KPTHISYVM

SEQ ID NO: 165084 - protein, 9 aa, Yellow fever virus
PTHISYVML

SEQ ID NO: 165085 - protein, 9 aa, Yellow fever virus
THISYVMLI

SEQ ID NO: 165086 - protein, 9 aa, Yellow fever virus
HISYVMLIF

SEQ ID NO: 165087 - protein, 9 aa, Yellow fever virus
ISYVMLIFF

SEQ ID NO: 165088 - protein, 9 aa, Yellow fever virus
SYVMLIFFV

SEQ ID NO: 165089 - protein, 9 aa, Yellow fever virus
YVMLIFFVL

SEQ ID NO: 165090 - protein, 9 aa, Yellow fever virus
VMLIFFVLM

SEQ ID NO: 165091 - protein, 9 aa, Yellow fever virus
IFFVLMVVI

SEQ ID NO: 165092 - protein, 9 aa, Yellow fever virus
FFVLMVVII

SEQ ID NO: 165093 - protein, 9 aa, Yellow fever virus
FVLMVVIIP

SEQ ID NO: 165094 - protein, 9 aa, Yellow fever virus
VLMVVIIPE

SEQ ID NO: 165095 - protein, 9 aa, Yellow fever virus
LMVVIIPEP

SEQ ID NO: 165096 - protein, 9 aa, Yellow fever virus
MVVIIPEPG

SEQ ID NO: 165097 - protein, 9 aa, Yellow fever virus
VVIIPEPGQ

SEQ ID NO: 165098 - protein, 9 aa, Yellow fever virus
VIIPEPGQQ

SEQ ID NO: 165099 - protein, 9 aa, Yellow fever virus
IIPEPGQQR

SEQ ID NO: 165100 - protein, 9 aa, Yellow fever virus
IPEPGQQRT

SEQ ID NO: 165101 - protein, 9 aa, Yellow fever virus
PEPGQQRTI

SEQ ID NO: 165102 - protein, 9 aa, Yellow fever virus
EPGQQRTIQ

SEQ ID NO: 165103 - protein, 9 aa, Yellow fever virus
PGQQRTIQD

SEQ ID NO: 165104 - protein, 9 aa, Yellow fever virus
GQQRTIQDN

SEQ ID NO: 165105 - protein, 9 aa, Yellow fever virus
QQRTIQDNQ

SEQ ID NO: 165106 - protein, 9 aa, Yellow fever virus
QRTIQDNQV

SEQ ID NO: 165107 - protein, 9 aa, Yellow fever virus
RTIQDNQVA

SEQ ID NO: 165108 - protein, 9 aa, Yellow fever virus
TIQDNQVAY

SEQ ID NO: 165109 - protein, 9 aa, Yellow fever virus
IQDNQVAFL

SEQ ID NO: 165110 - protein, 9 aa, Yellow fever virus
QDNQVAFLI

SEQ ID NO: 165111 - protein, 9 aa, Yellow fever virus
DNQVAFLII

SEQ ID NO: 165112 - protein, 9 aa, Yellow fever virus
NQVAFLIIG

SEQ ID NO: 165113 - protein, 9 aa, Yellow fever virus
QVAFLIIGI

SEQ ID NO: 165114 - protein, 9 aa, Yellow fever virus
VAFLIIGIL

SEQ ID NO: 165115 - protein, 9 aa, Yellow fever virus
AFLIIGILT

SEQ ID NO: 165116 - protein, 9 aa, Yellow fever virus
FLIIGILTL

SEQ ID NO: 165117 - protein, 9 aa, Yellow fever virus
LIIGILTLL

SEQ ID NO: 165118 - protein, 9 aa, Yellow fever virus
IIGILTLLS

SEQ ID NO: 165119 - protein, 9 aa, Yellow fever virus
IGILTLVSV

SEQ ID NO: 165120 - protein, 9 aa, Yellow fever virus
GILTLVSVV

SEQ ID NO: 165121 - protein, 9 aa, Yellow fever virus
ILTLVSVVA

SEQ ID NO: 165122 - protein, 9 aa, Yellow fever virus
LTLVSVVAA

SEQ ID NO: 165123 - protein, 9 aa, Yellow fever virus
TLVSVVAAN

SEQ ID NO: 165124 - protein, 9 aa, Yellow fever virus
LVSVVAANE

SEQ ID NO: 165125 - protein, 9 aa, Yellow fever virus
VSVVAANEL

SEQ ID NO: 165126 - protein, 9 aa, Yellow fever virus
SVVAANELG

SEQ ID NO: 165127 - protein, 9 aa, Yellow fever virus
VVAANELGM

SEQ ID NO: 165128 - protein, 9 aa, Yellow fever virus
ANELGMLER

SEQ ID NO: 165129 - protein, 9 aa, Yellow fever virus
NELGMLERT

SEQ ID NO: 165130 - protein, 9 aa, Yellow fever virus
ELGMLERTK

SEQ ID NO: 165131 - protein, 9 aa, Yellow fever virus
LGMLERTKE

SEQ ID NO: 165132 - protein, 9 aa, Yellow fever virus
GMLERTKED

SEQ ID NO: 165133 - protein, 9 aa, Yellow fever virus
MLEKTKEDF

SEQ ID NO: 165134 - protein, 9 aa, Yellow fever virus
LEKTKEDFF

SEQ ID NO: 165135 - protein, 9 aa, Yellow fever virus
EKTKEDFFG

SEQ ID NO: 165136 - protein, 9 aa, Yellow fever virus
KTKEDFFGK

SEQ ID NO: 165137 - protein, 9 aa, Yellow fever virus
TKEDFFGKR

SEQ ID NO: 165138 - protein, 9 aa, Yellow fever virus
KEDLFGKKD

SEQ ID NO: 165139 - protein, 9 aa, Yellow fever virus
TSGGTIPWS

SEQ ID NO: 165140 - protein, 9 aa, Yellow fever virus
SGGTIPWSW

SEQ ID NO: 165141 - protein, 9 aa, Yellow fever virus
GGTIPWSWP

SEQ ID NO: 165142 - protein, 9 aa, Yellow fever virus
GTIPWSWPD

SEQ ID NO: 165143 - protein, 9 aa, Yellow fever virus
TIPWSWPDL

SEQ ID NO: 165144 - protein, 9 aa, Yellow fever virus
IPWSWPDLD

SEQ ID NO: 165145 - protein, 9 aa, Yellow fever virus
TVYVGIVTI

SEQ ID NO: 165146 - protein, 9 aa, Yellow fever virus
VYVGIVTIL

SEQ ID NO: 165147 - protein, 9 aa, Yellow fever virus
YVGIVTILS

SEQ ID NO: 165148 - protein, 9 aa, Yellow fever virus
VGIVTILSP

SEQ ID NO: 165149 - protein, 9 aa, Yellow fever virus
GIVTILSPM

SEQ ID NO: 165150 - protein, 9 aa, Yellow fever virus
IVTILSPML

SEQ ID NO: 165151 - protein, 9 aa, Yellow fever virus
VTILSPMLH

SEQ ID NO: 165152 - protein, 9 aa, Yellow fever virus
TILSPMLHH

SEQ ID NO: 165153 - protein, 9 aa, Yellow fever virus
ILSPMLHHW

SEQ ID NO: 165154 - protein, 9 aa, Yellow fever virus
VLSFMDKGV

SEQ ID NO: 165155 - protein, 9 aa, Yellow fever virus
LSFMDKGVP

SEQ ID NO: 165156 - protein, 9 aa, Yellow fever virus
SFMDKGVPF

SEQ ID NO: 165157 - protein, 9 aa, Yellow fever virus
FMDKGVPFM

SEQ ID NO: 165158 - protein, 9 aa, Yellow fever virus
MDKGVPFMK

SEQ ID NO: 165159 - protein, 9 aa, Yellow fever virus
DKGVPFMKM

SEQ ID NO: 165160 - protein, 9 aa, Yellow fever virus
KGVPFMKMN

SEQ ID NO: 165161 - protein, 9 aa, Yellow fever virus
GVPFMKMNI

SEQ ID NO: 165162 - protein, 9 aa, Yellow fever virus
VPFMKMNIS

SEQ ID NO: 165163 - protein, 9 aa, Yellow fever virus
FMKMNISVV

SEQ ID NO: 165164 - protein, 9 aa, Yellow fever virus
MKMNISVII

SEQ ID NO: 165165 - protein, 9 aa, Yellow fever virus
KMNISVIIL

SEQ ID NO: 165166 - protein, 9 aa, Yellow fever virus
MNISVIILL

SEQ ID NO: 165167 - protein, 9 aa, Yellow fever virus
NISVIILLV

SEQ ID NO: 165168 - protein, 9 aa, Yellow fever virus
ISVIILLVS

SEQ ID NO: 165169 - protein, 9 aa, Yellow fever virus
SVIILLVSG

SEQ ID NO: 165170 - protein, 9 aa, Yellow fever virus
VIILLVSGW

SEQ ID NO: 165171 - protein, 9 aa, Yellow fever virus
IILLVSGWN

SEQ ID NO: 165172 - protein, 9 aa, Yellow fever virus
ILLVSGWNS

SEQ ID NO: 165173 - protein, 9 aa, Yellow fever virus
LLISGWNSI

SEQ ID NO: 165174 - protein, 9 aa, Yellow fever virus
LISGWNSIT

SEQ ID NO: 165175 - protein, 9 aa, Yellow fever virus
ISGWNSITV

SEQ ID NO: 165176 - protein, 9 aa, Yellow fever virus
SGWNSITVI

SEQ ID NO: 165177 - protein, 9 aa, Yellow fever virus
GWNSITVIP

SEQ ID NO: 165178 - protein, 9 aa, Yellow fever virus
WNSITVIPL

SEQ ID NO: 165179 - protein, 9 aa, Yellow fever virus
NSITVIPLL

SEQ ID NO: 165180 - protein, 9 aa, Yellow fever virus
SITVIPLLC

SEQ ID NO: 165181 - protein, 9 aa, Yellow fever virus
ITVIPLLCG

SEQ ID NO: 165182 - protein, 9 aa, Yellow fever virus
TVIPLLCGV

SEQ ID NO: 165183 - protein, 9 aa, Yellow fever virus
VIPLLCGVG

SEQ ID NO: 165184 - protein, 9 aa, Yellow fever virus
IPLLCGVGG

SEQ ID NO: 165185 - protein, 9 aa, Yellow fever virus
PLLCGVGGA

SEQ ID NO: 165186 - protein, 9 aa, Yellow fever virus
LLCGVGGAM

SEQ ID NO: 165187 - protein, 9 aa, Yellow fever virus
LCGVGGAML

SEQ ID NO: 165188 - protein, 9 aa, Yellow fever virus
CGVGGAMLH

SEQ ID NO: 165189 - protein, 9 aa, Yellow fever virus
GVGGAMLHW

SEQ ID NO: 165190 - protein, 9 aa, Yellow fever virus
VGGAMLHWT

SEQ ID NO: 165191 - protein, 9 aa, Yellow fever virus
GGAMLHWTL

SEQ ID NO: 165192 - protein, 9 aa, Yellow fever virus
GAMLHWTLI

SEQ ID NO: 165193 - protein, 9 aa, Yellow fever virus
AMLHWTLIL

SEQ ID NO: 165194 - protein, 9 aa, Yellow fever virus
MLHWTLILP

SEQ ID NO: 165195 - protein, 9 aa, Yellow fever virus
LHWTLILPG

SEQ ID NO: 165196 - protein, 9 aa, Yellow fever virus
HWTLILPGI

SEQ ID NO: 165197 - protein, 9 aa, Yellow fever virus
WTLILPGIK

SEQ ID NO: 165198 - protein, 9 aa, Yellow fever virus
TLILPGIKA

SEQ ID NO: 165199 - protein, 9 aa, Yellow fever virus
IKAQQSKLP

SEQ ID NO: 165200 - protein, 9 aa, Yellow fever virus
KAQQSKLPQ

SEQ ID NO: 165201 - protein, 9 aa, Yellow fever virus
AQQSKLAQK

SEQ ID NO: 165202 - protein, 9 aa, Yellow fever virus
QQSKLAQKR

SEQ ID NO: 165203 - protein, 9 aa, Yellow fever virus
QSKLAQKRV

SEQ ID NO: 165204 - protein, 9 aa, Yellow fever virus
SKLAQKRVF

SEQ ID NO: 165205 - protein, 9 aa, Yellow fever virus
KLAQKRVFH

SEQ ID NO: 165206 - protein, 9 aa, Yellow fever virus
LAQKRVFHG

SEQ ID NO: 165207 - protein, 9 aa, Yellow fever virus
AQKRVFHGV

SEQ ID NO: 165208 - protein, 9 aa, Yellow fever virus
QKRVFHGVA

SEQ ID NO: 165209 - protein, 9 aa, Yellow fever virus
KRVFHGVAK

SEQ ID NO: 165210 - protein, 9 aa, Yellow fever virus
RVFHGVAEN

SEQ ID NO: 165211 - protein, 9 aa, Yellow fever virus
VFHGVAENP

SEQ ID NO: 165212 - protein, 9 aa, Yellow fever virus
FHGVAENPV

SEQ ID NO: 165213 - protein, 9 aa, Yellow fever virus
HGVAENPVV

SEQ ID NO: 165214 - protein, 9 aa, Yellow fever virus
GVAENPVVD

SEQ ID NO: 165215 - protein, 9 aa, Yellow fever virus
VAENPVVDG

SEQ ID NO: 165216 - protein, 9 aa, Yellow fever virus
AENPVVDGN

SEQ ID NO: 165217 - protein, 9 aa, Yellow fever virus
ENPVVDGNP

SEQ ID NO: 165218 - protein, 9 aa, Yellow fever virus
PVVDGNPTA

SEQ ID NO: 165219 - protein, 9 aa, Yellow fever virus
VVDGNPTAD

SEQ ID NO: 165220 - protein, 9 aa, Yellow fever virus
VDGNPTADI

SEQ ID NO: 165221 - protein, 9 aa, Yellow fever virus
DGNPTADIE

SEQ ID NO: 165222 - protein, 9 aa, Yellow fever virus
GNPTADIEE

SEQ ID NO: 165223 - protein, 9 aa, Yellow fever virus
NPTADIEEA

SEQ ID NO: 165224 - protein, 9 aa, Yellow fever virus
PTADIEEAP

SEQ ID NO: 165225 - protein, 9 aa, Yellow fever virus
TADIEEAPE

SEQ ID NO: 165226 - protein, 9 aa, Yellow fever virus
ADIEEAPEM

SEQ ID NO: 165227 - protein, 9 aa, Yellow fever virus
IEEAPEMPV

SEQ ID NO: 165228 - protein, 9 aa, Yellow fever virus
EEAPEMPVL

SEQ ID NO: 165229 - protein, 9 aa, Yellow fever virus
EAPEMPVLY

SEQ ID NO: 165230 - protein, 9 aa, Yellow fever virus
APEMPVLYE

SEQ ID NO: 165231 - protein, 9 aa, Yellow fever virus
PEMPVLYEK

SEQ ID NO: 165232 - protein, 9 aa, Yellow fever virus
EMPVLYEKK

SEQ ID NO: 165233 - protein, 9 aa, Yellow fever virus
MPVLYEKKL

SEQ ID NO: 165234 - protein, 9 aa, Yellow fever virus
PVLYEKKLA

SEQ ID NO: 165235 - protein, 9 aa, Yellow fever virus
VLYEKKLAL

SEQ ID NO: 165236 - protein, 9 aa, Yellow fever virus
YLLLALSLM

SEQ ID NO: 165237 - protein, 9 aa, Yellow fever virus
LLLALSLMS

SEQ ID NO: 165238 - protein, 9 aa, Yellow fever virus
LLALSLMSV

SEQ ID NO: 165239 - protein, 9 aa, Yellow fever virus
LALSLMSVA

SEQ ID NO: 165240 - protein, 9 aa, Yellow fever virus
ALSLMSVAM

SEQ ID NO: 165241 - protein, 9 aa, Yellow fever virus
LSLMSVAMC

SEQ ID NO: 165242 - protein, 9 aa, Yellow fever virus
SLMSVAMCR

SEQ ID NO: 165243 - protein, 9 aa, Yellow fever virus
LMSVAMCRT

SEQ ID NO: 165244 - protein, 9 aa, Yellow fever virus
MSVAMCRTP

SEQ ID NO: 165245 - protein, 9 aa, Yellow fever virus
MCRTPFSLD

SEQ ID NO: 165246 - protein, 9 aa, Yellow fever virus
CRTPFSLDE

SEQ ID NO: 165247 - protein, 9 aa, Yellow fever virus
RTPFSLDEG

SEQ ID NO: 165248 - protein, 9 aa, Yellow fever virus
TPFSLDEGI

SEQ ID NO: 165249 - protein, 9 aa, Yellow fever virus
PFSLDEGIV

SEQ ID NO: 165250 - protein, 9 aa, Yellow fever virus
FSLDEGIVL

SEQ ID NO: 165251 - protein, 9 aa, Yellow fever virus
SLAEGIVLS

SEQ ID NO: 165252 - protein, 9 aa, Yellow fever virus
LAEGIVLSS

SEQ ID NO: 165253 - protein, 9 aa, Yellow fever virus
AEGIVLSSA

SEQ ID NO: 165254 - protein, 9 aa, Yellow fever virus
EGIVLSSAA

SEQ ID NO: 165255 - protein, 9 aa, Yellow fever virus
GIVLASAAS

SEQ ID NO: 165256 - protein, 9 aa, Yellow fever virus
IVLASAASG

SEQ ID NO: 165257 - protein, 9 aa, Yellow fever virus
VLASAASGP

SEQ ID NO: 165258 - protein, 9 aa, Yellow fever virus
LASAASGPL

SEQ ID NO: 165259 - protein, 9 aa, Yellow fever virus
ASAASGPLI

SEQ ID NO: 165260 - protein, 9 aa, Yellow fever virus
SAASGPLIE

SEQ ID NO: 165261 - protein, 9 aa, Yellow fever virus
AASGPLIEG

SEQ ID NO: 165262 - protein, 9 aa, Yellow fever virus
ASGPLIEGN

SEQ ID NO: 165263 - protein, 9 aa, Yellow fever virus
SGPLIEGNT

SEQ ID NO: 165264 - protein, 9 aa, Yellow fever virus
MTGVMRGNY

SEQ ID NO: 165265 - protein, 9 aa, Yellow fever virus
TGVMRGNYY

SEQ ID NO: 165266 - protein, 9 aa, Yellow fever virus
GVMRGNYYA

SEQ ID NO: 165267 - protein, 9 aa, Yellow fever virus
VMRGNYYAF

SEQ ID NO: 165268 - protein, 9 aa, Yellow fever virus
MRGNYYAFV

SEQ ID NO: 165269 - protein, 9 aa, Yellow fever virus
RGNYYAFVG

SEQ ID NO: 165270 - protein, 9 aa, Yellow fever virus
GNYYAFVGV

SEQ ID NO: 165271 - protein, 9 aa, Yellow fever virus
NYYAFVGVM

SEQ ID NO: 165272 - protein, 9 aa, Yellow fever virus
YYAFVGVMY

SEQ ID NO: 165273 - protein, 9 aa, Yellow fever virus
YAFVGVAYN

SEQ ID NO: 165274 - protein, 9 aa, Yellow fever virus
AFVGVAYNL

SEQ ID NO: 165275 - protein, 9 aa, Yellow fever virus
FVGVAYNLW

SEQ ID NO: 165276 - protein, 9 aa, Yellow fever virus
VGVAYNLWK

SEQ ID NO: 165277 - protein, 9 aa, Yellow fever virus
GVAYNLWKM

SEQ ID NO: 165278 - protein, 9 aa, Yellow fever virus
VMYNLWKME

SEQ ID NO: 165279 - protein, 9 aa, Yellow fever virus
MYNLWKMET

SEQ ID NO: 165280 - protein, 9 aa, Yellow fever virus
YNLWKMETG

SEQ ID NO: 165281 - protein, 9 aa, Yellow fever virus
NLWKMETGR

SEQ ID NO: 165282 - protein, 9 aa, Yellow fever virus
LWKMETGRR

SEQ ID NO: 165283 - protein, 9 aa, Yellow fever virus
WKMETGRRG

SEQ ID NO: 165284 - protein, 9 aa, Yellow fever virus
RRGRANGKT

SEQ ID NO: 165285 - protein, 9 aa, Yellow fever virus
RGRANGKTL

SEQ ID NO: 165286 - protein, 9 aa, Yellow fever virus
GRANGKTLG

SEQ ID NO: 165287 - protein, 9 aa, Yellow fever virus
RANGKTLGE

SEQ ID NO: 165288 - protein, 9 aa, Yellow fever virus
ASGKTLGEV

SEQ ID NO: 165289 - protein, 9 aa, Yellow fever virus
SGKTLGEVW

SEQ ID NO: 165290 - protein, 9 aa, Yellow fever virus
KRELNLLDR

SEQ ID NO: 165291 - protein, 9 aa, Yellow fever virus
RELNLLDKR

SEQ ID NO: 165292 - protein, 9 aa, Yellow fever virus
ELNLLDKRQ

SEQ ID NO: 165293 - protein, 9 aa, Yellow fever virus
LNLLDKRQF

SEQ ID NO: 165294 - protein, 9 aa, Yellow fever virus
NLLDKRQFE

SEQ ID NO: 165295 - protein, 9 aa, Yellow fever virus
LLDKQQFEL

SEQ ID NO: 165296 - protein, 9 aa, Yellow fever virus
LDKRQFELY

SEQ ID NO: 165297 - protein, 9 aa, Yellow fever virus
DKQQFELYK

SEQ ID NO: 165298 - protein, 9 aa, Yellow fever virus
KRQFELYKR

SEQ ID NO: 165299 - protein, 9 aa, Yellow fever virus
RQFELYKRT

SEQ ID NO: 165300 - protein, 9 aa, Yellow fever virus
QFEMYKRTD

SEQ ID NO: 165301 - protein, 9 aa, Yellow fever virus
FEMYKRTDI

SEQ ID NO: 165302 - protein, 9 aa, Yellow fever virus
ELYKRTDIT

SEQ ID NO: 165303 - protein, 9 aa, Yellow fever virus
LYKRTDITE

SEQ ID NO: 165304 - protein, 9 aa, Yellow fever virus
YKRTDITEV

SEQ ID NO: 165305 - protein, 9 aa, Yellow fever virus
KRTDITEVD

SEQ ID NO: 165306 - protein, 9 aa, Yellow fever virus
RTDITEVDR

SEQ ID NO: 165307 - protein, 9 aa, Yellow fever virus
TDITEVDRD

SEQ ID NO: 165308 - protein, 9 aa, Yellow fever virus
DITEVDRDM

SEQ ID NO: 165309 - protein, 9 aa, Yellow fever virus
ITEVDRDMA

SEQ ID NO: 165310 - protein, 9 aa, Yellow fever virus
TEVDRDMAR

SEQ ID NO: 165311 - protein, 9 aa, Yellow fever virus
EVDRDMARR

SEQ ID NO: 165312 - protein, 9 aa, Yellow fever virus
VDRDMARRH

SEQ ID NO: 165313 - protein, 9 aa, Yellow fever virus
DRDMARRHL

SEQ ID NO: 165314 - protein, 9 aa, Yellow fever virus
RDMARRHLA

SEQ ID NO: 165315 - protein, 9 aa, Yellow fever virus
DMARRHLAE

SEQ ID NO: 165316 - protein, 9 aa, Yellow fever virus
MARRHLAEG

SEQ ID NO: 165317 - protein, 9 aa, Yellow fever virus
YVKLEGRVT

SEQ ID NO: 165318 - protein, 9 aa, Yellow fever virus
VKLEGRVTD

SEQ ID NO: 165319 - protein, 9 aa, Yellow fever virus
KLEGRVTDL

SEQ ID NO: 165320 - protein, 9 aa, Yellow fever virus
LEGRVTDLG

SEQ ID NO: 165321 - protein, 9 aa, Yellow fever virus
EGRVTDLGC

SEQ ID NO: 165322 - protein, 9 aa, Yellow fever virus
GRVTDLGCG

SEQ ID NO: 165323 - protein, 9 aa, Yellow fever virus
RVTDLGCGR

SEQ ID NO: 165324 - protein, 9 aa, Yellow fever virus
VTDLGCGRG

SEQ ID NO: 165325 - protein, 9 aa, Yellow fever virus
TDLGCGRGG

SEQ ID NO: 165326 - protein, 9 aa, Yellow fever virus
KEVSGVKGY

SEQ ID NO: 165327 - protein, 9 aa, Yellow fever virus
EVSGVKGYT

SEQ ID NO: 165328 - protein, 9 aa, Yellow fever virus
VSGVKGYTL

SEQ ID NO: 165329 - protein, 9 aa, Yellow fever virus
SGVKGYTLG

SEQ ID NO: 165330 - protein, 9 aa, Yellow fever virus
GVKGYTLGR

SEQ ID NO: 165331 - protein, 9 aa, Yellow fever virus
VKGYTLGRD

SEQ ID NO: 165332 - protein, 9 aa, Yellow fever virus
KGYTLGRDG

SEQ ID NO: 165333 - protein, 9 aa, Yellow fever virus
GYTLGRDGH

SEQ ID NO: 165334 - protein, 9 aa, Yellow fever virus
YTLGRDGHE

SEQ ID NO: 165335 - protein, 9 aa, Yellow fever virus
TLGREGHEK

SEQ ID NO: 165336 - protein, 9 aa, Yellow fever virus
LGREGHEKP

SEQ ID NO: 165337 - protein, 9 aa, Yellow fever virus
GREGHEKPM

SEQ ID NO: 165338 - protein, 9 aa, Yellow fever virus
REGHEKPMN

SEQ ID NO: 165339 - protein, 9 aa, Yellow fever virus
EGHEKPMNV

SEQ ID NO: 165340 - protein, 9 aa, Yellow fever virus
GHEKPMNVR

SEQ ID NO: 165341 - protein, 9 aa, Yellow fever virus
HEKPMNVRS

SEQ ID NO: 165342 - protein, 9 aa, Yellow fever virus
EKPMNVRSL

SEQ ID NO: 165343 - protein, 9 aa, Yellow fever virus
KPMNVRSLG

SEQ ID NO: 165344 - protein, 9 aa, Yellow fever virus
PMNVRSLGW

SEQ ID NO: 165345 - protein, 9 aa, Yellow fever virus
MNVRSLGWN

SEQ ID NO: 165346 - protein, 9 aa, Yellow fever virus
NVRSLGWNI

SEQ ID NO: 165347 - protein, 9 aa, Yellow fever virus
VQSLGWNIV

SEQ ID NO: 165348 - protein, 9 aa, Yellow fever virus
QSLGWNIVT

SEQ ID NO: 165349 - protein, 9 aa, Yellow fever virus
SLGWNIVTF

SEQ ID NO: 165350 - protein, 9 aa, Yellow fever virus
LGWNIVTFK

SEQ ID NO: 165351 - protein, 9 aa, Yellow fever virus
GWNIVTFKD

SEQ ID NO: 165352 - protein, 9 aa, Yellow fever virus
WNIVTFKDK

SEQ ID NO: 165353 - protein, 9 aa, Yellow fever virus
NIVTFKDKT

SEQ ID NO: 165354 - protein, 9 aa, Yellow fever virus
IVTFKDKTD

SEQ ID NO: 165355 - protein, 9 aa, Yellow fever virus
VTFKDKTDI

SEQ ID NO: 165356 - protein, 9 aa, Yellow fever virus
TFKDKTDVH

SEQ ID NO: 165357 - protein, 9 aa, Yellow fever virus
FKDKTDVHP

SEQ ID NO: 165358 - protein, 9 aa, Yellow fever virus
KDKTDVHPL

SEQ ID NO: 165359 - protein, 9 aa, Yellow fever virus
DKTDVHRLE

SEQ ID NO: 165360 - protein, 9 aa, Yellow fever virus
KTDVHPLEP

SEQ ID NO: 165361 - protein, 9 aa, Yellow fever virus
LEPAKCETL

SEQ ID NO: 165362 - protein, 9 aa, Yellow fever virus
EPAKCETLL

SEQ ID NO: 165363 - protein, 9 aa, Yellow fever virus
PAKCETLLC

SEQ ID NO: 165364 - protein, 9 aa, Yellow fever virus
AKCETLLCD

SEQ ID NO: 165365 - protein, 9 aa, Yellow fever virus
KCETLLCDI

SEQ ID NO: 165366 - protein, 9 aa, Yellow fever virus
CETLLCDIG

SEQ ID NO: 165367 - protein, 9 aa, Yellow fever virus
ETLLCDIGE

SEQ ID NO: 165368 - protein, 9 aa, Yellow fever virus
LCDIGESSP

SEQ ID NO: 165369 - protein, 9 aa, Yellow fever virus
CDIGESSPS

SEQ ID NO: 165370 - protein, 9 aa, Yellow fever virus
DIGESSPSS

SEQ ID NO: 165371 - protein, 9 aa, Yellow fever virus
IGESSPSSV

SEQ ID NO: 165372 - protein, 9 aa, Yellow fever virus
GESSPSSVT

SEQ ID NO: 165373 - protein, 9 aa, Yellow fever virus
ESSPSSVTE

SEQ ID NO: 165374 - protein, 9 aa, Yellow fever virus
SSPSSVTEG

SEQ ID NO: 165375 - protein, 9 aa, Yellow fever virus
SPSSVTEGE

SEQ ID NO: 165376 - protein, 9 aa, Yellow fever virus
PSSVTEGER

SEQ ID NO: 165377 - protein, 9 aa, Yellow fever virus
SSATEGERT

SEQ ID NO: 165378 - protein, 9 aa, Yellow fever virus
SVTEGERTM

SEQ ID NO: 165379 - protein, 9 aa, Yellow fever virus
VTEGERTMR

SEQ ID NO: 165380 - protein, 9 aa, Yellow fever virus
TEGERTLRV

SEQ ID NO: 165381 - protein, 9 aa, Yellow fever virus
EGERTLRVL

SEQ ID NO: 165382 - protein, 9 aa, Yellow fever virus
GERTMRVLD

SEQ ID NO: 165383 - protein, 9 aa, Yellow fever virus
ERTMRVLDT

SEQ ID NO: 165384 - protein, 9 aa, Yellow fever virus
RTMRVLDTV

SEQ ID NO: 165385 - protein, 9 aa, Yellow fever virus
TMRVLDTVE

SEQ ID NO: 165386 - protein, 9 aa, Yellow fever virus
MRVLDTVEK

SEQ ID NO: 165387 - protein, 9 aa, Yellow fever virus
RVLETIEKW

SEQ ID NO: 165388 - protein, 9 aa, Yellow fever virus
VLETIEKWL

SEQ ID NO: 165389 - protein, 9 aa, Yellow fever virus
LETIEKWLA

SEQ ID NO: 165390 - protein, 9 aa, Yellow fever virus
ETIEKWLAC

SEQ ID NO: 165391 - protein, 9 aa, Yellow fever virus
TIEKWLACG

SEQ ID NO: 165392 - protein, 9 aa, Yellow fever virus
IEKWLACGV

SEQ ID NO: 165393 - protein, 9 aa, Yellow fever virus
ACGVDNFCI

SEQ ID NO: 165394 - protein, 9 aa, Yellow fever virus
CGVDNFCIK

SEQ ID NO: 165395 - protein, 9 aa, Yellow fever virus
GVDNFCIKV

SEQ ID NO: 165396 - protein, 9 aa, Yellow fever virus
VDNFCIKVL

SEQ ID NO: 165397 - protein, 9 aa, Yellow fever virus
DNFCIKVLA

SEQ ID NO: 165398 - protein, 9 aa, Yellow fever virus
NFCIKVLAP

SEQ ID NO: 165399 - protein, 9 aa, Yellow fever virus
FCIKVLAPY

SEQ ID NO: 165400 - protein, 9 aa, Yellow fever virus
CIKVLAPYM

SEQ ID NO: 165401 - protein, 9 aa, Yellow fever virus
VKVLAPYMR

SEQ ID NO: 165402 - protein, 9 aa, Yellow fever virus
KVLAPYMRD

SEQ ID NO: 165403 - protein, 9 aa, Yellow fever virus
VLAPYMRDV

SEQ ID NO: 165404 - protein, 9 aa, Yellow fever virus
LAPYMPDVI

SEQ ID NO: 165405 - protein, 9 aa, Yellow fever virus
APYMPDVIE

SEQ ID NO: 165406 - protein, 9 aa, Yellow fever virus
PYMPDVIEK

SEQ ID NO: 165407 - protein, 9 aa, Yellow fever virus
YMPDVIEKL

SEQ ID NO: 165408 - protein, 9 aa, Yellow fever virus
MPDVIEKLE

SEQ ID NO: 165409 - protein, 9 aa, Yellow fever virus
PDVIEKLEL

SEQ ID NO: 165410 - protein, 9 aa, Yellow fever virus
DVIEKLELL

SEQ ID NO: 165411 - protein, 9 aa, Yellow fever virus
VIEKLELLQ

SEQ ID NO: 165412 - protein, 9 aa, Yellow fever virus
IEKLELLQR

SEQ ID NO: 165413 - protein, 9 aa, Yellow fever virus
LQRRFGGTI

SEQ ID NO: 165414 - protein, 9 aa, Yellow fever virus
QRRFGGTII

SEQ ID NO: 165415 - protein, 9 aa, Yellow fever virus
RRFGGTIIR

SEQ ID NO: 165416 - protein, 9 aa, Yellow fever virus
RFGGTIIRN

SEQ ID NO: 165417 - protein, 9 aa, Yellow fever virus
FGGTIIRNP

SEQ ID NO: 165418 - protein, 9 aa, Yellow fever virus
GGTIIRNPL

SEQ ID NO: 165419 - protein, 9 aa, Yellow fever virus
GTIIRNPLS

SEQ ID NO: 165420 - protein, 9 aa, Yellow fever virus
TIIRNPLSR

SEQ ID NO: 165421 - protein, 9 aa, Yellow fever virus
IIRNPLSRN

SEQ ID NO: 165422 - protein, 9 aa, Yellow fever virus
YVSGARSNI

SEQ ID NO: 165423 - protein, 9 aa, Yellow fever virus
VSGARSNIT

SEQ ID NO: 165424 - protein, 9 aa, Yellow fever virus
SGARSNITF

SEQ ID NO: 165425 - protein, 9 aa, Yellow fever virus
GARSNITFT

SEQ ID NO: 165426 - protein, 9 aa, Yellow fever virus
ARSNITFTV

SEQ ID NO: 165427 - protein, 9 aa, Yellow fever virus
RSNITFTVN

SEQ ID NO: 165428 - protein, 9 aa, Yellow fever virus
SNITFTVNQ

SEQ ID NO: 165429 - protein, 9 aa, Yellow fever virus
NITFTVNQT

SEQ ID NO: 165430 - protein, 9 aa, Yellow fever virus
ITFTVNQTS

SEQ ID NO: 165431 - protein, 9 aa, Yellow fever virus
PTGKVTLEP

SEQ ID NO: 165432 - protein, 9 aa, Yellow fever virus
TGKVTLEPD

SEQ ID NO: 165433 - protein, 9 aa, Yellow fever virus
GKVTLEPDV

SEQ ID NO: 165434 - protein, 9 aa, Yellow fever virus
KVTLEPDVI

SEQ ID NO: 165435 - protein, 9 aa, Yellow fever virus
VTLEPDVIL

SEQ ID NO: 165436 - protein, 9 aa, Yellow fever virus
TLEADVTLP

SEQ ID NO: 165437 - protein, 9 aa, Yellow fever virus
LEADVTLPI

SEQ ID NO: 165438 - protein, 9 aa, Yellow fever virus
EPDVILPIG

SEQ ID NO: 165439 - protein, 9 aa, Yellow fever virus
ADVTLPIGT

SEQ ID NO: 165440 - protein, 9 aa, Yellow fever virus
DVTLPIGTR

SEQ ID NO: 165441 - protein, 9 aa, Yellow fever virus
VTLPIGTRS

SEQ ID NO: 165442 - protein, 9 aa, Yellow fever virus
TLPIGTRSV

SEQ ID NO: 165443 - protein, 9 aa, Yellow fever virus
VETDKGPLN

SEQ ID NO: 165444 - protein, 9 aa, Yellow fever virus
ETDKGPLDR

SEQ ID NO: 165445 - protein, 9 aa, Yellow fever virus
DAIEERVER

SEQ ID NO: 165446 - protein, 9 aa, Yellow fever virus
AIKERVERI

SEQ ID NO: 165447 - protein, 9 aa, Yellow fever virus
IKERVERIK

SEQ ID NO: 165448 - protein, 9 aa, Yellow fever virus
EERVERIKT

SEQ ID NO: 165449 - protein, 9 aa, Yellow fever virus
ERVERIKTE

SEQ ID NO: 165450 - protein, 9 aa, Yellow fever virus
RVERIKTEY

SEQ ID NO: 165451 - protein, 9 aa, Yellow fever virus
VERIKTEYA

SEQ ID NO: 165452 - protein, 9 aa, Yellow fever virus
ERIKTEYAA

SEQ ID NO: 165453 - protein, 9 aa, Yellow fever virus
RIKSEYMTT

SEQ ID NO: 165454 - protein, 9 aa, Yellow fever virus
IKSEYMTTW

SEQ ID NO: 165455 - protein, 9 aa, Yellow fever virus
KSEYMTTWF

SEQ ID NO: 165456 - protein, 9 aa, Yellow fever virus
SEYMTTWFY

SEQ ID NO: 165457 - protein, 9 aa, Yellow fever virus
EYMTTWFYD

SEQ ID NO: 165458 - protein, 9 aa, Yellow fever virus
YMTTWFYDN

SEQ ID NO: 165459 - protein, 9 aa, Yellow fever virus
MTTWFYDND

SEQ ID NO: 165460 - protein, 9 aa, Yellow fever virus
TTWFYDNDN

SEQ ID NO: 165461 - protein, 9 aa, Yellow fever virus
TWFYDNDNP

SEQ ID NO: 165462 - protein, 9 aa, Yellow fever virus
WFHDNDNPY

SEQ ID NO: 165463 - protein, 9 aa, Yellow fever virus
FHDNDNPYR

SEQ ID NO: 165464 - protein, 9 aa, Yellow fever virus
HDNDNPYRT

SEQ ID NO: 165465 - protein, 9 aa, Yellow fever virus
TWHYCGSYI

SEQ ID NO: 165466 - protein, 9 aa, Yellow fever virus
WHYCGSYIT

SEQ ID NO: 165467 - protein, 9 aa, Yellow fever virus
HYCGSYITK

SEQ ID NO: 165468 - protein, 9 aa, Yellow fever virus
YCGSYITKT

SEQ ID NO: 165469 - protein, 9 aa, Yellow fever virus
CGSYITKTS

SEQ ID NO: 165470 - protein, 9 aa, Yellow fever virus
GSYITKTSG

SEQ ID NO: 165471 - protein, 9 aa, Yellow fever virus
SYITKTSGS

SEQ ID NO: 165472 - protein, 9 aa, Yellow fever virus
YITKTSGSA

SEQ ID NO: 165473 - protein, 9 aa, Yellow fever virus
ITKTSGSAA

SEQ ID NO: 165474 - protein, 9 aa, Yellow fever virus
TSGSAASMI

SEQ ID NO: 165475 - protein, 9 aa, Yellow fever virus
SGSAASMIN

SEQ ID NO: 165476 - protein, 9 aa, Yellow fever virus
GSAASMING

SEQ ID NO: 165477 - protein, 9 aa, Yellow fever virus
SAASMINGV

SEQ ID NO: 165478 - protein, 9 aa, Yellow fever virus
AASMINGVI

SEQ ID NO: 165479 - protein, 9 aa, Yellow fever virus
ASMINGVIK

SEQ ID NO: 165480 - protein, 9 aa, Yellow fever virus
SMINGVIKI

SEQ ID NO: 165481 - protein, 9 aa, Yellow fever virus
MINGVIKIL

SEQ ID NO: 165482 - protein, 9 aa, Yellow fever virus
INGVIKILT

SEQ ID NO: 165483 - protein, 9 aa, Yellow fever virus
NGVIKILTF

SEQ ID NO: 165484 - protein, 9 aa, Yellow fever virus
GVIKILTFP

SEQ ID NO: 165485 - protein, 9 aa, Yellow fever virus
VIKILTFPW

SEQ ID NO: 165486 - protein, 9 aa, Yellow fever virus
IKILTFPWD

SEQ ID NO: 165487 - protein, 9 aa, Yellow fever virus
KILTFPWDR

SEQ ID NO: 165488 - protein, 9 aa, Yellow fever virus
ILTFPWDRI

SEQ ID NO: 165489 - protein, 9 aa, Yellow fever virus
LTFPWDRIE

SEQ ID NO: 165490 - protein, 9 aa, Yellow fever virus
TFPWDRIEE

SEQ ID NO: 165491 - protein, 9 aa, Yellow fever virus
FPWDRIEEV

SEQ ID NO: 165492 - protein, 9 aa, Yellow fever virus
PWDKIEEVT

SEQ ID NO: 165493 - protein, 9 aa, Yellow fever virus
WDKIEEVTR

SEQ ID NO: 165494 - protein, 9 aa, Yellow fever virus
DKIEEVTRM

SEQ ID NO: 165495 - protein, 9 aa, Yellow fever virus
KIEEVTRMA

SEQ ID NO: 165496 - protein, 9 aa, Yellow fever virus
PAGTRKIMR

SEQ ID NO: 165497 - protein, 9 aa, Yellow fever virus
AGTRKIMRV

SEQ ID NO: 165498 - protein, 9 aa, Yellow fever virus
GTRKIMRVV

SEQ ID NO: 165499 - protein, 9 aa, Yellow fever virus
TRKIMRVVN

SEQ ID NO: 165500 - protein, 9 aa, Yellow fever virus
RKIMRVVNR

SEQ ID NO: 165501 - protein, 9 aa, Yellow fever virus
KIMRVVNRW

SEQ ID NO: 165502 - protein, 9 aa, Yellow fever virus
IMRVVNRWL

SEQ ID NO: 165503 - protein, 9 aa, Yellow fever virus
MRVVNRWLF

SEQ ID NO: 165504 - protein, 9 aa, Yellow fever virus
RVVNRWLFR

SEQ ID NO: 165505 - protein, 9 aa, Yellow fever virus
NRWLFRHLS

SEQ ID NO: 165506 - protein, 9 aa, Yellow fever virus
RWLFRHLSR

SEQ ID NO: 165507 - protein, 9 aa, Yellow fever virus
WLFRHLSRE

SEQ ID NO: 165508 - protein, 9 aa, Yellow fever virus
LFRHLSREK

SEQ ID NO: 165509 - protein, 9 aa, Yellow fever virus
FRHLAREKS

SEQ ID NO: 165510 - protein, 9 aa, Yellow fever virus
RHLAREKSP

SEQ ID NO: 165511 - protein, 9 aa, Yellow fever virus
HLAREKSPR

SEQ ID NO: 165512 - protein, 9 aa, Yellow fever virus
LAREKSPRL

SEQ ID NO: 165513 - protein, 9 aa, Yellow fever virus
AREKSPRLC

SEQ ID NO: 165514 - protein, 9 aa, Yellow fever virus
REKSPRLCT

SEQ ID NO: 165515 - protein, 9 aa, Yellow fever virus
EKSPRLCTK

SEQ ID NO: 165516 - protein, 9 aa, Yellow fever virus
KSPRLCTKE

SEQ ID NO: 165517 - protein, 9 aa, Yellow fever virus
SPRLCTKEE

SEQ ID NO: 165518 - protein, 9 aa, Yellow fever virus
AKVRSHAAV

SEQ ID NO: 165519 - protein, 9 aa, Yellow fever virus
KVRSHAAVG

SEQ ID NO: 165520 - protein, 9 aa, Yellow fever virus
VRSHAAVGA

SEQ ID NO: 165521 - protein, 9 aa, Yellow fever virus
RSHAAVGAF

SEQ ID NO: 165522 - protein, 9 aa, Yellow fever virus
SHAAVGAFL

SEQ ID NO: 165523 - protein, 9 aa, Yellow fever virus
HAAVGAFLE

SEQ ID NO: 165524 - protein, 9 aa, Yellow fever virus
AAVGAFLEE

SEQ ID NO: 165525 - protein, 9 aa, Yellow fever virus
AVGAFLEEQ

SEQ ID NO: 165526 - protein, 9 aa, Yellow fever virus
VGAFLEEQE

SEQ ID NO: 165527 - protein, 9 aa, Yellow fever virus
GAFLEEQEQ

SEQ ID NO: 165528 - protein, 9 aa, Yellow fever virus
AFLEEQEQW

SEQ ID NO: 165529 - protein, 9 aa, Yellow fever virus
FLEEQEQWK

SEQ ID NO: 165530 - protein, 9 aa, Yellow fever virus
LEEQDQWKT

SEQ ID NO: 165531 - protein, 9 aa, Yellow fever virus
EEQDQWKTA

SEQ ID NO: 165532 - protein, 9 aa, Yellow fever virus
EQDQWKTAN

SEQ ID NO: 165533 - protein, 9 aa, Yellow fever virus
QDQWKTANE

SEQ ID NO: 165534 - protein, 9 aa, Yellow fever virus
DQWKTANEA

SEQ ID NO: 165535 - protein, 9 aa, Yellow fever virus
VQDPKFWEM

SEQ ID NO: 165536 - protein, 9 aa, Yellow fever virus
QDPKFWEMV

SEQ ID NO: 165537 - protein, 9 aa, Yellow fever virus
DPKFWEMVD

SEQ ID NO: 165538 - protein, 9 aa, Yellow fever virus
PKFWEMVDA

SEQ ID NO: 165539 - protein, 9 aa, Yellow fever virus
KFWEMVDAE

SEQ ID NO: 165540 - protein, 9 aa, Yellow fever virus
FWEMVDAER

SEQ ID NO: 165541 - protein, 9 aa, Yellow fever virus
WEMVDAERK

SEQ ID NO: 165542 - protein, 9 aa, Yellow fever virus
EMVDAERKL

SEQ ID NO: 165543 - protein, 9 aa, Yellow fever virus
MVDAERKLH

SEQ ID NO: 165544 - protein, 9 aa, Yellow fever virus
VDAERKLHQ

SEQ ID NO: 165545 - protein, 9 aa, Yellow fever virus
DAERKLHQQ

SEQ ID NO: 165546 - protein, 9 aa, Yellow fever virus
AERKLHQQG

SEQ ID NO: 165547 - protein, 9 aa, Yellow fever virus
ERRLHQQGR

SEQ ID NO: 165548 - protein, 9 aa, Yellow fever virus
RRLHQQGRC

SEQ ID NO: 165549 - protein, 9 aa, Yellow fever virus
KLHQQGRCQ

SEQ ID NO: 165550 - protein, 9 aa, Yellow fever virus
LHQQGRCQS

SEQ ID NO: 165551 - protein, 9 aa, Yellow fever virus
HQQGRCQSC

SEQ ID NO: 165552 - protein, 9 aa, Yellow fever virus
QQGRCQSCV

SEQ ID NO: 165553 - protein, 9 aa, Yellow fever virus
QGRCQSCVY

SEQ ID NO: 165554 - protein, 9 aa, Yellow fever virus
GRCQSCVYN

SEQ ID NO: 165555 - protein, 9 aa, Yellow fever virus
RCQSCVYNM

SEQ ID NO: 165556 - protein, 9 aa, Yellow fever virus
CQSCVYNMM

SEQ ID NO: 165557 - protein, 9 aa, Yellow fever virus
QSCVYNMMG

SEQ ID NO: 165558 - protein, 9 aa, Yellow fever virus
SCVYNMMGK

SEQ ID NO: 165559 - protein, 9 aa, Yellow fever virus
WYMWLGARF

SEQ ID NO: 165560 - protein, 9 aa, Yellow fever virus
YMWLGARFL

SEQ ID NO: 165561 - protein, 9 aa, Yellow fever virus
MWLGARFLE

SEQ ID NO: 165562 - protein, 9 aa, Yellow fever virus
WLGARFLEF

SEQ ID NO: 165563 - protein, 9 aa, Yellow fever virus
LGARFLEFE

SEQ ID NO: 165564 - protein, 9 aa, Yellow fever virus
GARFLEFEA

SEQ ID NO: 165565 - protein, 9 aa, Yellow fever virus
ARFLEFEAL

SEQ ID NO: 165566 - protein, 9 aa, Yellow fever virus
RFLEFEALG

SEQ ID NO: 165567 - protein, 9 aa, Yellow fever virus
FLEFEALGF

SEQ ID NO: 165568 - protein, 9 aa, Yellow fever virus
NSGGGVEGT

SEQ ID NO: 165569 - protein, 9 aa, Yellow fever virus
SGGGVEGTG

SEQ ID NO: 165570 - protein, 9 aa, Yellow fever virus
GGGVEGTGL

SEQ ID NO: 165571 - protein, 9 aa, Yellow fever virus
GGVEGTGLQ

SEQ ID NO: 165572 - protein, 9 aa, Yellow fever virus
GVEGTGLQY

SEQ ID NO: 165573 - protein, 9 aa, Yellow fever virus
VEGTGLQYL

SEQ ID NO: 165574 - protein, 9 aa, Yellow fever virus
EGTGLQYLG

SEQ ID NO: 165575 - protein, 9 aa, Yellow fever virus
GTGLQYLGY

SEQ ID NO: 165576 - protein, 9 aa, Yellow fever virus
TGLQYLGYV

SEQ ID NO: 165577 - protein, 9 aa, Yellow fever virus
LQYLGYVIK

SEQ ID NO: 165578 - protein, 9 aa, Yellow fever virus
QYLGYVIKD

SEQ ID NO: 165579 - protein, 9 aa, Yellow fever virus
YLGYVIKDL

SEQ ID NO: 165580 - protein, 9 aa, Yellow fever virus
LGYVIKDLS

SEQ ID NO: 165581 - protein, 9 aa, Yellow fever virus
GYVIKDLST

SEQ ID NO: 165582 - protein, 9 aa, Yellow fever virus
YVIKDLSTK

SEQ ID NO: 165583 - protein, 9 aa, Yellow fever virus
VIKDLSTKE

SEQ ID NO: 165584 - protein, 9 aa, Yellow fever virus
IKDLSTKEG

SEQ ID NO: 165585 - protein, 9 aa, Yellow fever virus
KDLSTKEGG

SEQ ID NO: 165586 - protein, 9 aa, Yellow fever virus
DLSTKEGGG

SEQ ID NO: 165587 - protein, 9 aa, Yellow fever virus
LSTKEGGGF

SEQ ID NO: 165588 - protein, 9 aa, Yellow fever virus
STKEGGGFY

SEQ ID NO: 165589 - protein, 9 aa, Yellow fever virus
TKEGGGFYA

SEQ ID NO: 165590 - protein, 9 aa, Yellow fever virus
KEGGGFYAD

SEQ ID NO: 165591 - protein, 9 aa, Yellow fever virus
EGGGFYADD

SEQ ID NO: 165592 - protein, 9 aa, Yellow fever virus
GGGLYADDT

SEQ ID NO: 165593 - protein, 9 aa, Yellow fever virus
GGLYADDTA

SEQ ID NO: 165594 - protein, 9 aa, Yellow fever virus
GLYADDTAG

SEQ ID NO: 165595 - protein, 9 aa, Yellow fever virus
LYADDTAGW

SEQ ID NO: 165596 - protein, 9 aa, Yellow fever virus
DLDDEQEIM

SEQ ID NO: 165597 - protein, 9 aa, Yellow fever virus
LDDEQEIMS

SEQ ID NO: 165598 - protein, 9 aa, Yellow fever virus
DDEQEIMSY

SEQ ID NO: 165599 - protein, 9 aa, Yellow fever virus
DEQEIMSYM

SEQ ID NO: 165600 - protein, 9 aa, Yellow fever virus
EQEIMSYMN

SEQ ID NO: 165601 - protein, 9 aa, Yellow fever virus
QEIMSYMNA

SEQ ID NO: 165602 - protein, 9 aa, Yellow fever virus
EIMSYMNAE

SEQ ID NO: 165603 - protein, 9 aa, Yellow fever virus
IMSYMNAEQ

SEQ ID NO: 165604 - protein, 9 aa, Yellow fever virus
MSYMNAEQR

SEQ ID NO: 165605 - protein, 9 aa, Yellow fever virus
SYMNAEQRK

SEQ ID NO: 165606 - protein, 9 aa, Yellow fever virus
YMNAEQRKL

SEQ ID NO: 165607 - protein, 9 aa, Yellow fever virus
MNAEQRKLA

SEQ ID NO: 165608 - protein, 9 aa, Yellow fever virus
NAEQRKLAW

SEQ ID NO: 165609 - protein, 9 aa, Yellow fever virus
AEQRKLAWA

SEQ ID NO: 165610 - protein, 9 aa, Yellow fever virus
EQRKLAWAV

SEQ ID NO: 165611 - protein, 9 aa, Yellow fever virus
QRKLAWAVM

SEQ ID NO: 165612 - protein, 9 aa, Yellow fever virus
RKLAWAVME

SEQ ID NO: 165613 - protein, 9 aa, Yellow fever virus
KLAWAVMEM

SEQ ID NO: 165614 - protein, 9 aa, Yellow fever virus
LAWAVMEMT

SEQ ID NO: 165615 - protein, 9 aa, Yellow fever virus
AWAVMEMTY

SEQ ID NO: 165616 - protein, 9 aa, Yellow fever virus
WAVMEMTYK

SEQ ID NO: 165617 - protein, 9 aa, Yellow fever virus
AIMEMTYKN

SEQ ID NO: 165618 - protein, 9 aa, Yellow fever virus
IMEMTYKNK

SEQ ID NO: 165619 - protein, 9 aa, Yellow fever virus
KVVKVLRPT

SEQ ID NO: 165620 - protein, 9 aa, Yellow fever virus
VVKVLRPTP

SEQ ID NO: 165621 - protein, 9 aa, Yellow fever virus
VKVLRPTPG

SEQ ID NO: 165622 - protein, 9 aa, Yellow fever virus
KVLRPTPGG

SEQ ID NO: 165623 - protein, 9 aa, Yellow fever virus
VLRPTPGGK

SEQ ID NO: 165624 - protein, 9 aa, Yellow fever virus
LRPTPGGKA

SEQ ID NO: 165625 - protein, 9 aa, Yellow fever virus
RPAPGGKAF

SEQ ID NO: 165626 - protein, 9 aa, Yellow fever virus
PAPGGKAFM

SEQ ID NO: 165627 - protein, 9 aa, Yellow fever virus
APGGKAFMD

SEQ ID NO: 165628 - protein, 9 aa, Yellow fever virus
PGGKAFMDI

SEQ ID NO: 165629 - protein, 9 aa, Yellow fever virus
GGKAFMDII

SEQ ID NO: 165630 - protein, 9 aa, Yellow fever virus
GKAFMDIIS

SEQ ID NO: 165631 - protein, 9 aa, Yellow fever virus
KAFMDIISR

SEQ ID NO: 165632 - protein, 9 aa, Yellow fever virus
AFMDIISRR

SEQ ID NO: 165633 - protein, 9 aa, Yellow fever virus
FMDIISRRD

SEQ ID NO: 165634 - protein, 9 aa, Yellow fever virus
MDIISRRDQ

SEQ ID NO: 165635 - protein, 9 aa, Yellow fever virus
DIISRRDQR

SEQ ID NO: 165636 - protein, 9 aa, Yellow fever virus
IISRRDQRG

SEQ ID NO: 165637 - protein, 9 aa, Yellow fever virus
SRRDQRGSR

SEQ ID NO: 165638 - protein, 9 aa, Yellow fever virus
RRDQRGSRQ

SEQ ID NO: 165639 - protein, 9 aa, Yellow fever virus
RDQRGSRQV

SEQ ID NO: 165640 - protein, 9 aa, Yellow fever virus
DQRGSRQVV

SEQ ID NO: 165641 - protein, 9 aa, Yellow fever virus
QRGSRQVVT

SEQ ID NO: 165642 - protein, 9 aa, Yellow fever virus
RGSRQVVTY

SEQ ID NO: 165643 - protein, 9 aa, Yellow fever virus
GSRQVVTYA

SEQ ID NO: 165644 - protein, 9 aa, Yellow fever virus
SRQVVTYAL

SEQ ID NO: 165645 - protein, 9 aa, Yellow fever virus
RQVVTYALN

SEQ ID NO: 165646 - protein, 9 aa, Yellow fever virus
LIRMAEAEN

SEQ ID NO: 165647 - protein, 9 aa, Yellow fever virus
IRMAEAENV

SEQ ID NO: 165648 - protein, 9 aa, Yellow fever virus
RMAEAENVI

SEQ ID NO: 165649 - protein, 9 aa, Yellow fever virus
MAEAEMVIN

SEQ ID NO: 165650 - protein, 9 aa, Yellow fever virus
AEAEMVINH

SEQ ID NO: 165651 - protein, 9 aa, Yellow fever virus
EAEMVINHQ

SEQ ID NO: 165652 - protein, 9 aa, Yellow fever virus
AEMVINHQH

SEQ ID NO: 165653 - protein, 9 aa, Yellow fever virus
EMVINHQHV

SEQ ID NO: 165654 - protein, 9 aa, Yellow fever virus
MVINHQHVN

SEQ ID NO: 165655 - protein, 9 aa, Yellow fever virus
VINHQHVNE

SEQ ID NO: 165656 - protein, 9 aa, Yellow fever virus
INHQHVNEC

SEQ ID NO: 165657 - protein, 9 aa, Yellow fever virus
NHQHVNECD

SEQ ID NO: 165658 - protein, 9 aa, Yellow fever virus
HQHVNECDE

SEQ ID NO: 165659 - protein, 9 aa, Yellow fever virus
QHVNECDES

SEQ ID NO: 165660 - protein, 9 aa, Yellow fever virus
CDESALARL

SEQ ID NO: 165661 - protein, 9 aa, Yellow fever virus
LARLDAWLA

SEQ ID NO: 165662 - protein, 9 aa, Yellow fever virus
ARLDAWLAE

SEQ ID NO: 165663 - protein, 9 aa, Yellow fever virus
RLDAWLAEN

SEQ ID NO: 165664 - protein, 9 aa, Yellow fever virus
LDAWLAENG

SEQ ID NO: 165665 - protein, 9 aa, Yellow fever virus
DAWLAENGC

SEQ ID NO: 165666 - protein, 9 aa, Yellow fever virus
AWLTEHGCD

SEQ ID NO: 165667 - protein, 9 aa, Yellow fever virus
WLTEHGCDR

SEQ ID NO: 165668 - protein, 9 aa, Yellow fever virus
LTEHGCDRL

SEQ ID NO: 165669 - protein, 9 aa, Yellow fever virus
RLRRMAVSG

SEQ ID NO: 165670 - protein, 9 aa, Yellow fever virus
LRRMAVSGD

SEQ ID NO: 165671 - protein, 9 aa, Yellow fever virus
RRMAVSGDD

SEQ ID NO: 165672 - protein, 9 aa, Yellow fever virus
RMAVNGDDC

SEQ ID NO: 165673 - protein, 9 aa, Yellow fever virus
MAVNGDDCV

SEQ ID NO: 165674 - protein, 9 aa, Yellow fever virus
AVNGDDCVV

SEQ ID NO: 165675 - protein, 9 aa, Yellow fever virus
VNGDDCVVR

SEQ ID NO: 165676 - protein, 9 aa, Yellow fever virus
SGDDCVVKP

SEQ ID NO: 165677 - protein, 9 aa, Yellow fever virus
GDDCVVRPV

SEQ ID NO: 165678 - protein, 9 aa, Yellow fever virus
DDCVVRPVD

SEQ ID NO: 165679 - protein, 9 aa, Yellow fever virus
DCVVRPVDD

SEQ ID NO: 165680 - protein, 9 aa, Yellow fever virus
CVVRPVDDR

SEQ ID NO: 165681 - protein, 9 aa, Yellow fever virus
VVRPVDDRF

SEQ ID NO: 165682 - protein, 9 aa, Yellow fever virus
VRPVDDRFG

SEQ ID NO: 165683 - protein, 9 aa, Yellow fever virus
RPVDDRFGL

SEQ ID NO: 165684 - protein, 9 aa, Yellow fever virus
PVDDRFGLA

SEQ ID NO: 165685 - protein, 9 aa, Yellow fever virus
VDDRFGLAL

SEQ ID NO: 165686 - protein, 9 aa, Yellow fever virus
DDRFGMALS

SEQ ID NO: 165687 - protein, 9 aa, Yellow fever virus
DRFGMALSH

SEQ ID NO: 165688 - protein, 9 aa, Yellow fever virus
RFGMALSHL

SEQ ID NO: 165689 - protein, 9 aa, Yellow fever virus
FGMALSHLN

SEQ ID NO: 165690 - protein, 9 aa, Yellow fever virus
GMALSHLNA

SEQ ID NO: 165691 - protein, 9 aa, Yellow fever virus
MALSHLNAM

SEQ ID NO: 165692 - protein, 9 aa, Yellow fever virus
ISEWQPSKE

SEQ ID NO: 165693 - protein, 9 aa, Yellow fever virus
SEWQPSKEW

SEQ ID NO: 165694 - protein, 9 aa, Yellow fever virus
EWQPSKGWT

SEQ ID NO: 165695 - protein, 9 aa, Yellow fever virus
WQPSKGWTD

SEQ ID NO: 165696 - protein, 9 aa, Yellow fever virus
QPSKGWTDW

SEQ ID NO: 165697 - protein, 9 aa, Yellow fever virus
PSKGWTDWE

SEQ ID NO: 165698 - protein, 9 aa, Yellow fever virus
SKGWTDWEN

SEQ ID NO: 165699 - protein, 9 aa, Yellow fever virus
KEWTDWENV

SEQ ID NO: 165700 - protein, 9 aa, Yellow fever virus
EWTDWENVP

SEQ ID NO: 165701 - protein, 9 aa, Yellow fever virus
WTDWENVPF

SEQ ID NO: 165702 - protein, 9 aa, Yellow fever virus
TDWENVPFC

SEQ ID NO: 165703 - protein, 9 aa, Yellow fever virus
DWESVPFCS

SEQ ID NO: 165704 - protein, 9 aa, Yellow fever virus
WESVPFCSH

SEQ ID NO: 165705 - protein, 9 aa, Yellow fever virus
ENVPFCSHR

SEQ ID NO: 165706 - protein, 9 aa, Yellow fever virus
SVPFCSHHF

SEQ ID NO: 165707 - protein, 9 aa, Yellow fever virus
VPFCSHRFH

SEQ ID NO: 165708 - protein, 9 aa, Yellow fever virus
PFCSHRFHE

SEQ ID NO: 165709 - protein, 9 aa, Yellow fever virus
FCSHRFHEL

SEQ ID NO: 165710 - protein, 9 aa, Yellow fever virus
CSHHFHELV

SEQ ID NO: 165711 - protein, 9 aa, Yellow fever virus
SHHFHELVL

SEQ ID NO: 165712 - protein, 9 aa, Yellow fever virus
HHFHELVLK

SEQ ID NO: 165713 - protein, 9 aa, Yellow fever virus
HFHELVLKD

SEQ ID NO: 165714 - protein, 9 aa, Yellow fever virus
FHELVLKDG

SEQ ID NO: 165715 - protein, 9 aa, Yellow fever virus
HELVLKDGR

SEQ ID NO: 165716 - protein, 9 aa, Yellow fever virus
ELVLKDGRK

SEQ ID NO: 165717 - protein, 9 aa, Yellow fever virus
LVLKDGRKV

SEQ ID NO: 165718 - protein, 9 aa, Yellow fever virus
HLKDGRRIV

SEQ ID NO: 165719 - protein, 9 aa, Yellow fever virus
LKDGRKVVV

SEQ ID NO: 165720 - protein, 9 aa, Yellow fever virus
KDGRKVVVP

SEQ ID NO: 165721 - protein, 9 aa, Yellow fever virus
DGRKVVVPC

SEQ ID NO: 165722 - protein, 9 aa, Yellow fever virus
GRKVVVPCR

SEQ ID NO: 165723 - protein, 9 aa, Yellow fever virus
RKVVVPCRD

SEQ ID NO: 165724 - protein, 9 aa, Yellow fever virus
KVVVPCRDQ

SEQ ID NO: 165725 - protein, 9 aa, Yellow fever virus
VVVPCRDQD

SEQ ID NO: 165726 - protein, 9 aa, Yellow fever virus
VVPCRDQDE

SEQ ID NO: 165727 - protein, 9 aa, Yellow fever virus
VPCRDQDEL

SEQ ID NO: 165728 - protein, 9 aa, Yellow fever virus
PCRDQDELI

SEQ ID NO: 165729 - protein, 9 aa, Yellow fever virus
CRDQDELIG

SEQ ID NO: 165730 - protein, 9 aa, Yellow fever virus
RDQDELIGR

SEQ ID NO: 165731 - protein, 9 aa, Yellow fever virus
DQDELIGRG

SEQ ID NO: 165732 - protein, 9 aa, Yellow fever virus
KRDMRLLSF

SEQ ID NO: 165733 - protein, 9 aa, Yellow fever virus
RDMRLLSFA

SEQ ID NO: 165734 - protein, 9 aa, Yellow fever virus
DMRLLSFAV

SEQ ID NO: 165735 - protein, 9 aa, Yellow fever virus
MRLLSFAVS

SEQ ID NO: 165736 - protein, 9 aa, Yellow fever virus
RLLSFAVSS

SEQ ID NO: 165737 - protein, 9 aa, Yellow fever virus
LLSFAVSSA

SEQ ID NO: 165738 - protein, 9 aa, Yellow fever virus
LSFAVSSAV

SEQ ID NO: 165739 - protein, 9 aa, Yellow fever virus
SFAVSSAVP

SEQ ID NO: 165740 - protein, 9 aa, Yellow fever virus
FAVSSAVPT

SEQ ID NO: 165741 - protein, 9 aa, Yellow fever virus
AVSSAVPTA

SEQ ID NO: 165742 - protein, 9 aa, Yellow fever virus
VSSAVPTAW

SEQ ID NO: 165743 - protein, 9 aa, Yellow fever virus
SSAVPTAWV

SEQ ID NO: 165744 - protein, 9 aa, Yellow fever virus
SAVPTAWVP

SEQ ID NO: 165745 - protein, 9 aa, Yellow fever virus
AVPTAWVPS

SEQ ID NO: 165746 - protein, 9 aa, Yellow fever virus
VPTAWVPSG

SEQ ID NO: 165747 - protein, 9 aa, Yellow fever virus
PTAWVPSGR

SEQ ID NO: 165748 - protein, 9 aa, Yellow fever virus
TAWVPSGRT

SEQ ID NO: 165749 - protein, 9 aa, Yellow fever virus
AWVPSGRTT

SEQ ID NO: 165750 - protein, 9 aa, Yellow fever virus
WVPSGRTTW

SEQ ID NO: 165751 - protein, 9 aa, Yellow fever virus
VPSGRTTWS

SEQ ID NO: 165752 - protein, 9 aa, Yellow fever virus
PSGRTTWSV

SEQ ID NO: 165753 - protein, 9 aa, Yellow fever virus
SGRTTWSVH

SEQ ID NO: 165754 - protein, 9 aa, Yellow fever virus
GRTTWSVHG

SEQ ID NO: 165755 - protein, 9 aa, Yellow fever virus
RTTWSVHGK

SEQ ID NO: 165756 - protein, 9 aa, Yellow fever virus
TTWSVHGKG

SEQ ID NO: 165757 - protein, 9 aa, Yellow fever virus
TWSVHGKGE

SEQ ID NO: 165758 - protein, 9 aa, Yellow fever virus
WSVHGKGEW

SEQ ID NO: 165759 - protein, 9 aa, Yellow fever virus
SVHGKGEWM

SEQ ID NO: 165760 - protein, 9 aa, Yellow fever virus
VHGKGEWMT

SEQ ID NO: 165761 - protein, 9 aa, Yellow fever virus
HGRGEWMTT

SEQ ID NO: 165762 - protein, 9 aa, Yellow fever virus
GRGEWMTTE

SEQ ID NO: 165763 - protein, 9 aa, Yellow fever virus
RGEWMTTED

SEQ ID NO: 165764 - protein, 9 aa, Yellow fever virus
GEWMTTEDR

SEQ ID NO: 165765 - protein, 9 aa, Yellow fever virus
EWMTTQDML

SEQ ID NO: 165766 - protein, 9 aa, Yellow fever virus
WMTTEDMLD

SEQ ID NO: 165767 - protein, 9 aa, Yellow fever virus
MTTEDMLDV

SEQ ID NO: 165768 - protein, 9 aa, Yellow fever virus
TTEDMLGVW

SEQ ID NO: 165769 - protein, 9 aa, Yellow fever virus
TEDMLGVWN

SEQ ID NO: 165770 - protein, 9 aa, Yellow fever virus
EDMLGVWNR

SEQ ID NO: 165771 - protein, 9 aa, Yellow fever virus
DMLDVWNRV

SEQ ID NO: 165772 - protein, 9 aa, Yellow fever virus
MLDVWNRVW

SEQ ID NO: 165773 - protein, 9 aa, Yellow fever virus
LDVWNRVWV

SEQ ID NO: 165774 - protein, 9 aa, Yellow fever virus
DVWNRVWVL

SEQ ID NO: 165775 - protein, 9 aa, Yellow fever virus
VWNRVWVLN

SEQ ID NO: 165776 - protein, 9 aa, Yellow fever virus
WNRVWVLNN

SEQ ID NO: 165777 - protein, 9 aa, Yellow fever virus
NRVWVLNNP

SEQ ID NO: 165778 - protein, 9 aa, Yellow fever virus
RVWVLNNPH

SEQ ID NO: 165779 - protein, 9 aa, Yellow fever virus
VWVLNNPHM

SEQ ID NO: 165780 - protein, 9 aa, Yellow fever virus
WVLNNPHMK

SEQ ID NO: 165781 - protein, 9 aa, Yellow fever virus
VLNNPHMKD

SEQ ID NO: 165782 - protein, 9 aa, Yellow fever virus
LNNPHMKDK

SEQ ID NO: 165783 - protein, 9 aa, Yellow fever virus
NNPHMKDKT

SEQ ID NO: 165784 - protein, 9 aa, Yellow fever virus
NPHMQDKTV

SEQ ID NO: 165785 - protein, 9 aa, Yellow fever virus
PHMQDKTVV

SEQ ID NO: 165786 - protein, 9 aa, Yellow fever virus
HMQDKTVVK

SEQ ID NO: 165787 - protein, 9 aa, Yellow fever virus
MQDKTMVKE

SEQ ID NO: 165788 - protein, 9 aa, Yellow fever virus
QDKTMVKEW

SEQ ID NO: 165789 - protein, 9 aa, Yellow fever virus
DKTMVKEWR

SEQ ID NO: 165790 - protein, 9 aa, Yellow fever virus
KTMVKEWRD

SEQ ID NO: 165791 - protein, 9 aa, Yellow fever virus
TMVKEWRDV

SEQ ID NO: 165792 - protein, 9 aa, Yellow fever virus
MVKEWRDVP

SEQ ID NO: 165793 - protein, 9 aa, Yellow fever virus
VKEWRDVPY

SEQ ID NO: 165794 - protein, 9 aa, Yellow fever virus
KEWRDVPYL

SEQ ID NO: 165795 - protein, 9 aa, Yellow fever virus
EWRDVPYLT

SEQ ID NO: 165796 - protein, 9 aa, Yellow fever virus
TNRATWASN

SEQ ID NO: 165797 - protein, 9 aa, Yellow fever virus
NRATWASNI

SEQ ID NO: 165798 - protein, 9 aa, Yellow fever virus
RATWASNIH

SEQ ID NO: 165799 - protein, 9 aa, Yellow fever virus
ATWASNIHL

SEQ ID NO: 165800 - protein, 9 aa, Yellow fever virus
TWASNIHLV

SEQ ID NO: 165801 - protein, 9 aa, Yellow fever virus
WASNIHLVI

SEQ ID NO: 165802 - protein, 9 aa, Yellow fever virus
ASNIHLVIH

SEQ ID NO: 165803 - protein, 9 aa, Yellow fever virus
SNIHLVIHR

SEQ ID NO: 165804 - protein, 9 aa, Yellow fever virus
NIHLVIHRI

SEQ ID NO: 165805 - protein, 9 aa, Yellow fever virus
HLVIHRIRN

SEQ ID NO: 165806 - protein, 9 aa, Yellow fever virus
LVIHRIRNL

SEQ ID NO: 165807 - protein, 9 aa, Yellow fever virus
VIHRIRTLV

SEQ ID NO: 165808 - protein, 9 aa, Yellow fever virus
IHRIRTLVG

SEQ ID NO: 165809 - protein, 9 aa, Yellow fever virus
HRIRTLVGQ

SEQ ID NO: 165810 - protein, 9 aa, Yellow fever virus
RIRTLVGQE

SEQ ID NO: 165811 - protein, 9 aa, Yellow fever virus
IRTLVGQEK

SEQ ID NO: 165812 - protein, 9 aa, Yellow fever virus
RTLVGQEKY

SEQ ID NO: 165813 - protein, 9 aa, Yellow fever virus
TLVGQEKYT

SEQ ID NO: 165814 - protein, 9 aa, Yellow fever virus
LVGQEKYTD

SEQ ID NO: 165815 - protein, 9 aa, Yellow fever virus
VGQEKYTDY

SEQ ID NO: 165816 - protein, 9 aa, Yellow fever virus
GQEKFTDYL

SEQ ID NO: 165817 - protein, 9 aa, Yellow fever virus
QEKFTDYLT

SEQ ID NO: 165818 - protein, 9 aa, Yellow fever virus
EKFTDYLTV

SEQ ID NO: 165819 - protein, 9 aa, Yellow fever virus
KFTDYLTVM

SEQ ID NO: 165820 - protein, 9 aa, Yellow fever virus
FTDYLTVMD

SEQ ID NO: 165821 - protein, 9 aa, Yellow fever virus
YSVDADLQP

SEQ ID NO: 165822 - protein, 9 aa, Yellow fever virus
SVDADLQPG

SEQ ID NO: 165823 - protein, 9 aa, Yellow fever virus
VDADLQPGE

SEQ ID NO: 165824 - protein, 9 aa, Yellow fever virus
DADLQPGEL

SEQ ID NO: 165825 - protein, 9 aa, Yellow fever virus
ADLQPGELI

SEQ ID NO: 165826 - protein, 9 aa, Yellow fever virus
ILTGKKLTA

SEQ ID NO: 165827 - protein, 9 aa, Yellow fever virus
LTGKKITAQ

SEQ ID NO: 165828 - protein, 9 aa, Yellow fever virus
TGKKLTAHL

SEQ ID NO: 165829 - protein, 9 aa, Yellow fever virus
GKKLTAHLK

SEQ ID NO: 165830 - protein, 9 aa, Yellow fever virus
KKLTAHLKK

SEQ ID NO: 165831 - protein, 9 aa, Yellow fever virus
KITAQLKRL

SEQ ID NO: 165832 - protein, 9 aa, Yellow fever virus
LTAHLKKLW

SEQ ID NO: 165833 - protein, 9 aa, Yellow fever virus
TAQLKRLWK

SEQ ID NO: 165834 - protein, 9 aa, Yellow fever virus
AHLKKLWRM

SEQ ID NO: 165835 - protein, 9 aa, Yellow fever virus
QLKRLWKML

SEQ ID NO: 165836 - protein, 9 aa, Yellow fever virus
LKKLWRMLD

SEQ ID NO: 165837 - protein, 9 aa, Yellow fever virus
KKLWRMLDP

SEQ ID NO: 165838 - protein, 9 aa, Yellow fever virus
KLWRMLDPR

SEQ ID NO: 165839 - protein, 9 aa, Yellow fever virus
LDPRQGLTV

SEQ ID NO: 165840 - protein, 9 aa, Yellow fever virus
DPRQGLTVL

SEQ ID NO: 165841 - protein, 9 aa, Yellow fever virus
PRQGLTVLR

SEQ ID NO: 165842 - protein, 9 aa, Yellow fever virus
RQGLTVLRK

SEQ ID NO: 165843 - protein, 9 aa, Yellow fever virus
QGLTVLRKV

SEQ ID NO: 165844 - protein, 9 aa, Yellow fever virus
GLTVLRKVK

SEQ ID NO: 165845 - protein, 9 aa, Yellow fever virus
LTVLRKVKR

SEQ ID NO: 165846 - protein, 9 aa, Yellow fever virus
TVLRKVKRV

SEQ ID NO: 165847 - protein, 9 aa, Yellow fever virus
KRVVASLMI

SEQ ID NO: 165848 - protein, 9 aa, Yellow fever virus
RVVASLMIG

SEQ ID NO: 165849 - protein, 9 aa, Yellow fever virus
VVASLMIGL

SEQ ID NO: 165850 - protein, 9 aa, Yellow fever virus
VASLMIGLS

SEQ ID NO: 165851 - protein, 9 aa, Yellow fever virus
ASLMIGLSS

SEQ ID NO: 165852 - protein, 9 aa, Yellow fever virus
SLMIGLSSR

SEQ ID NO: 165853 - protein, 9 aa, Yellow fever virus
LSSRKRRSS

SEQ ID NO: 165854 - protein, 9 aa, Yellow fever virus
SSRKRRSSE

SEQ ID NO: 165855 - protein, 9 aa, Yellow fever virus
SRKRRSNEM

SEQ ID NO: 165856 - protein, 9 aa, Yellow fever virus
RKRRSHDAL

SEQ ID NO: 165857 - protein, 9 aa, Yellow fever virus
LFPLLLLGL

SEQ ID NO: 165858 - protein, 9 aa, Yellow fever virus
VQLLILGMI

SEQ ID NO: 165859 - protein, 9 aa, Yellow fever virus
PLLLLGLLA

SEQ ID NO: 165860 - protein, 9 aa, Yellow fever virus
LLLLGLLAL

SEQ ID NO: 165861 - protein, 9 aa, Yellow fever virus
SGGVTLVRK

SEQ ID NO: 165862 - protein, 9 aa, Yellow fever virus
EDLGKTFSM

SEQ ID NO: 165863 - protein, 9 aa, Yellow fever virus
DLGKTFSMG

SEQ ID NO: 165864 - protein, 9 aa, Yellow fever virus
LGKTFSLGT

SEQ ID NO: 165865 - protein, 9 aa, Yellow fever virus
GKTFSMGTG

SEQ ID NO: 165866 - protein, 9 aa, Yellow fever virus
KTFSMGTGN

SEQ ID NO: 165867 - protein, 9 aa, Yellow fever virus
TFSVGAGNC

SEQ ID NO: 165868 - protein, 9 aa, Yellow fever virus
FSLGTGNCT

SEQ ID NO: 165869 - protein, 9 aa, Yellow fever virus
SVGAGNCTT

SEQ ID NO: 165870 - protein, 9 aa, Yellow fever virus
LGTGNCTTN

SEQ ID NO: 165871 - protein, 9 aa, Yellow fever virus
ENVRVTYGK

SEQ ID NO: 165872 - protein, 9 aa, Yellow fever virus
NVRVTYGKC

SEQ ID NO: 165873 - protein, 9 aa, Yellow fever virus
VRVTYGKCD

SEQ ID NO: 165874 - protein, 9 aa, Yellow fever virus
RVTYGKCDS

SEQ ID NO: 165875 - protein, 9 aa, Yellow fever virus
VTYGKCDSA

SEQ ID NO: 165876 - protein, 9 aa, Yellow fever virus
TYGKCDSAG

SEQ ID NO: 165877 - protein, 9 aa, Yellow fever virus
LVRNPFFAI

SEQ ID NO: 165878 - protein, 9 aa, Yellow fever virus
PFFAITALA

SEQ ID NO: 165879 - protein, 9 aa, Yellow fever virus
FFAITALAI

SEQ ID NO: 165880 - protein, 9 aa, Yellow fever virus
FAITALAIA

SEQ ID NO: 165881 - protein, 9 aa, Yellow fever virus
AITALAIAY

SEQ ID NO: 165882 - protein, 9 aa, Yellow fever virus
ITALAIAYL

SEQ ID NO: 165883 - protein, 9 aa, Yellow fever virus
LAIAYLVGS

SEQ ID NO: 165884 - protein, 9 aa, Yellow fever virus
AIAYLVGSN

SEQ ID NO: 165885 - protein, 9 aa, Yellow fever virus
IAYLVGNNM

SEQ ID NO: 165886 - protein, 9 aa, Yellow fever virus
AYLVGNNMT

SEQ ID NO: 165887 - protein, 9 aa, Yellow fever virus
YLVGNNTTQ

SEQ ID NO: 165888 - protein, 9 aa, Yellow fever virus
LVGNNTTQR

SEQ ID NO: 165889 - protein, 9 aa, Yellow fever virus
VGNNTTQRV

SEQ ID NO: 165890 - protein, 9 aa, Yellow fever virus
GNNKTQRVV

SEQ ID NO: 165891 - protein, 9 aa, Yellow fever virus
NNMTQRVVI

SEQ ID NO: 165892 - protein, 9 aa, Yellow fever virus
NTTQRVVIA

SEQ ID NO: 165893 - protein, 9 aa, Yellow fever virus
KTQRVVIAL

SEQ ID NO: 165894 - protein, 9 aa, Yellow fever virus
WVSATLEQG

SEQ ID NO: 165895 - protein, 9 aa, Yellow fever virus
VSASLEQDK

SEQ ID NO: 165896 - protein, 9 aa, Yellow fever virus
SATLEQGKC

SEQ ID NO: 165897 - protein, 9 aa, Yellow fever virus
ASLEQDKCV

SEQ ID NO: 165898 - protein, 9 aa, Yellow fever virus
TLEQGKCVT

SEQ ID NO: 165899 - protein, 9 aa, Yellow fever virus
SLQTVAIDG

SEQ ID NO: 165900 - protein, 9 aa, Yellow fever virus
LQTVAIDGP

SEQ ID NO: 165901 - protein, 9 aa, Yellow fever virus
QTVAIDGPA

SEQ ID NO: 165902 - protein, 9 aa, Yellow fever virus
TVAIDGPVE

SEQ ID NO: 165903 - protein, 9 aa, Yellow fever virus
VAIDRPAEA

SEQ ID NO: 165904 - protein, 9 aa, Yellow fever virus
AIDRPAEAR

SEQ ID NO: 165905 - protein, 9 aa, Yellow fever virus
IDRPAEARK

SEQ ID NO: 165906 - protein, 9 aa, Yellow fever virus
DRPAEARKV

SEQ ID NO: 165907 - protein, 9 aa, Yellow fever virus
RPAEARKVC

SEQ ID NO: 165908 - protein, 9 aa, Yellow fever virus
PVEARKVCY

SEQ ID NO: 165909 - protein, 9 aa, Yellow fever virus
AEARKVCYS

SEQ ID NO: 165910 - protein, 9 aa, Yellow fever virus
EARKVCYSA

SEQ ID NO: 165911 - protein, 9 aa, Yellow fever virus
ARKVCYSAV

SEQ ID NO: 165912 - protein, 9 aa, Yellow fever virus
KIQYVIKAQ

SEQ ID NO: 165913 - protein, 9 aa, Yellow fever virus
IQYVIKAQL

SEQ ID NO: 165914 - protein, 9 aa, Yellow fever virus
QYVIRARLH

SEQ ID NO: 165915 - protein, 9 aa, Yellow fever virus
YVIRARLHV

SEQ ID NO: 165916 - protein, 9 aa, Yellow fever virus
VIRARLHVG

SEQ ID NO: 165917 - protein, 9 aa, Yellow fever virus
IRARLHVGA

SEQ ID NO: 165918 - protein, 9 aa, Yellow fever virus
KAQLHVGAK

SEQ ID NO: 165919 - protein, 9 aa, Yellow fever virus
VGAKQENWK

SEQ ID NO: 165920 - protein, 9 aa, Yellow fever virus
GAKQENWKT

SEQ ID NO: 165921 - protein, 9 aa, Yellow fever virus
AKQENWNTS

SEQ ID NO: 165922 - protein, 9 aa, Yellow fever virus
KQENWNTSI

SEQ ID NO: 165923 - protein, 9 aa, Yellow fever virus
QENWNTSIK

SEQ ID NO: 165924 - protein, 9 aa, Yellow fever virus
ENWNTSIKT

SEQ ID NO: 165925 - protein, 9 aa, Yellow fever virus
NWNTSIKTL

SEQ ID NO: 165926 - protein, 9 aa, Yellow fever virus
WNTSIKTLK

SEQ ID NO: 165927 - protein, 9 aa, Yellow fever virus
NTSIKTLKF

SEQ ID NO: 165928 - protein, 9 aa, Yellow fever virus
DIKTLKFDV

SEQ ID NO: 165929 - protein, 9 aa, Yellow fever virus
DVLSGSQEA

SEQ ID NO: 165930 - protein, 9 aa, Yellow fever virus
VLSGSQEAE

SEQ ID NO: 165931 - protein, 9 aa, Yellow fever virus
SGSQEVEFT

SEQ ID NO: 165932 - protein, 9 aa, Yellow fever virus
GSQEVEFTG

SEQ ID NO: 165933 - protein, 9 aa, Yellow fever virus
SQEVEFTGY

SEQ ID NO: 165934 - protein, 9 aa, Yellow fever virus
QEVEFTGYG

SEQ ID NO: 165935 - protein, 9 aa, Yellow fever virus
EVEFTGYGK

SEQ ID NO: 165936 - protein, 9 aa, Yellow fever virus
AEFTGYGKV

SEQ ID NO: 165937 - protein, 9 aa, Yellow fever virus
EFTGYGKVT

SEQ ID NO: 165938 - protein, 9 aa, Yellow fever virus
FTGYGKVTL

SEQ ID NO: 165939 - protein, 9 aa, Yellow fever virus
TGYGKVTLE

SEQ ID NO: 165940 - protein, 9 aa, Yellow fever virus
YGKVTLECQ

SEQ ID NO: 165941 - protein, 9 aa, Yellow fever virus
GKVTLECQV

SEQ ID NO: 165942 - protein, 9 aa, Yellow fever virus
KATLECRVQ

SEQ ID NO: 165943 - protein, 9 aa, Yellow fever virus
VTLECQVQT

SEQ ID NO: 165944 - protein, 9 aa, Yellow fever virus
SYIAEMEKD

SEQ ID NO: 165945 - protein, 9 aa, Yellow fever virus
YIAEMEKDS

SEQ ID NO: 165946 - protein, 9 aa, Yellow fever virus
IAEMEKDSW

SEQ ID NO: 165947 - protein, 9 aa, Yellow fever virus
AEMEKDSWI

SEQ ID NO: 165948 - protein, 9 aa, Yellow fever virus
EMEKDSWIV

SEQ ID NO: 165949 - protein, 9 aa, Yellow fever virus
MEKDSWIVD

SEQ ID NO: 165950 - protein, 9 aa, Yellow fever virus
EKDSWIVDR

SEQ ID NO: 165951 - protein, 9 aa, Yellow fever virus
KDSWIVDRQ

SEQ ID NO: 165952 - protein, 9 aa, Yellow fever virus
SGSGGVWRG

SEQ ID NO: 165953 - protein, 9 aa, Yellow fever virus
GSGGVWRGM

SEQ ID NO: 165954 - protein, 9 aa, Yellow fever virus
SGGVWRGMH

SEQ ID NO: 165955 - protein, 9 aa, Yellow fever virus
GGVWRGMHH

SEQ ID NO: 165956 - protein, 9 aa, Yellow fever virus
GVWRGMHHL

SEQ ID NO: 165957 - protein, 9 aa, Yellow fever virus
VWRGMHHLV

SEQ ID NO: 165958 - protein, 9 aa, Yellow fever virus
KVPKGAPCR

SEQ ID NO: 165959 - protein, 9 aa, Yellow fever virus
VPKGAPCRI

SEQ ID NO: 165960 - protein, 9 aa, Yellow fever virus
PKGAPCRIP

SEQ ID NO: 165961 - protein, 9 aa, Yellow fever virus
GDSYIIIGT

SEQ ID NO: 165962 - protein, 9 aa, Yellow fever virus
DSYIIIGTG

SEQ ID NO: 165963 - protein, 9 aa, Yellow fever virus
SYIIIGTGD

SEQ ID NO: 165964 - protein, 9 aa, Yellow fever virus
YIIIGTGDS

SEQ ID NO: 165965 - protein, 9 aa, Yellow fever virus
IIIGTGDSR

SEQ ID NO: 165966 - protein, 9 aa, Yellow fever virus
IIGTGDSRL

SEQ ID NO: 165967 - protein, 9 aa, Yellow fever virus
IGTGDSRLT

SEQ ID NO: 165968 - protein, 9 aa, Yellow fever virus
ERLAVMGDV

SEQ ID NO: 165969 - protein, 9 aa, Yellow fever virus
RLAVMGDVA

SEQ ID NO: 165970 - protein, 9 aa, Yellow fever virus
LAVMGDVAW

SEQ ID NO: 165971 - protein, 9 aa, Yellow fever virus
AVMGDVAWD

SEQ ID NO: 165972 - protein, 9 aa, Yellow fever virus
VMGDVAWDF

SEQ ID NO: 165973 - protein, 9 aa, Yellow fever virus
MGDVAWDFS

SEQ ID NO: 165974 - protein, 9 aa, Yellow fever virus
GDVAWDFSS

SEQ ID NO: 165975 - protein, 9 aa, Yellow fever virus
DVAWDFSSA

SEQ ID NO: 165976 - protein, 9 aa, Yellow fever virus
VAWDFSSAG

SEQ ID NO: 165977 - protein, 9 aa, Yellow fever virus
DFSSAGGLF

SEQ ID NO: 165978 - protein, 9 aa, Yellow fever virus
FSSAGGFLT

SEQ ID NO: 165979 - protein, 9 aa, Yellow fever virus
SSAGGLFTS

SEQ ID NO: 165980 - protein, 9 aa, Yellow fever virus
SAGGFLTSV

SEQ ID NO: 165981 - protein, 9 aa, Yellow fever virus
AGGLFTSIG

SEQ ID NO: 165982 - protein, 9 aa, Yellow fever virus
GGLFTSIGK

SEQ ID NO: 165983 - protein, 9 aa, Yellow fever virus
GLFTSIGKG

SEQ ID NO: 165984 - protein, 9 aa, Yellow fever virus
FLTSVGKGI

SEQ ID NO: 165985 - protein, 9 aa, Yellow fever virus
LTSVGKGIH

SEQ ID NO: 165986 - protein, 9 aa, Yellow fever virus
LNWITKVII

SEQ ID NO: 165987 - protein, 9 aa, Yellow fever virus
NWITKVIIG

SEQ ID NO: 165988 - protein, 9 aa, Yellow fever virus
WITKVIIGA

SEQ ID NO: 165989 - protein, 9 aa, Yellow fever virus
ITKVIIGAV

SEQ ID NO: 165990 - protein, 9 aa, Yellow fever virus
TKVIMGVVL

SEQ ID NO: 165991 - protein, 9 aa, Yellow fever virus
KVIIGAVLI

SEQ ID NO: 165992 - protein, 9 aa, Yellow fever virus
VIIGAVLIW

SEQ ID NO: 165993 - protein, 9 aa, Yellow fever virus
IIGAVLIWV

SEQ ID NO: 165994 - protein, 9 aa, Yellow fever virus
IGAVLIWVG

SEQ ID NO: 165995 - protein, 9 aa, Yellow fever virus
GVVLIWVGI

SEQ ID NO: 165996 - protein, 9 aa, Yellow fever virus
VVLIWVGIN

SEQ ID NO: 165997 - protein, 9 aa, Yellow fever virus
DQGCAINFA

SEQ ID NO: 165998 - protein, 9 aa, Yellow fever virus
QGCAINFAK

SEQ ID NO: 165999 - protein, 9 aa, Yellow fever virus
GCAINFAKR

SEQ ID NO: 166000 - protein, 9 aa, Yellow fever virus
CAINFAKRE

SEQ ID NO: 166001 - protein, 9 aa, Yellow fever virus
AINFAKREL

SEQ ID NO: 166002 - protein, 9 aa, Yellow fever virus
INFAKRELK

SEQ ID NO: 166003 - protein, 9 aa, Yellow fever virus
LASIIKASY

SEQ ID NO: 166004 - protein, 9 aa, Yellow fever virus
ASIIKASYE

SEQ ID NO: 166005 - protein, 9 aa, Yellow fever virus
SIIKASYEE

SEQ ID NO: 166006 - protein, 9 aa, Yellow fever virus
IIKASYEEG

SEQ ID NO: 166007 - protein, 9 aa, Yellow fever virus
IKASYEEGK

SEQ ID NO: 166008 - protein, 9 aa, Yellow fever virus
KASYEEGKC

SEQ ID NO: 166009 - protein, 9 aa, Yellow fever virus
ASYEEGKCG

SEQ ID NO: 166010 - protein, 9 aa, Yellow fever virus
SYEEGKCGL

SEQ ID NO: 166011 - protein, 9 aa, Yellow fever virus
YEEGKCGLN

SEQ ID NO: 166012 - protein, 9 aa, Yellow fever virus
IVVQDPKNI

SEQ ID NO: 166013 - protein, 9 aa, Yellow fever virus
WKTWGKSLV

SEQ ID NO: 166014 - protein, 9 aa, Yellow fever virus
KTWGKSLVF

SEQ ID NO: 166015 - protein, 9 aa, Yellow fever virus
TWGKSLVFS

SEQ ID NO: 166016 - protein, 9 aa, Yellow fever virus
WGKSLVFSP

SEQ ID NO: 166017 - protein, 9 aa, Yellow fever virus
GKSLVFSPG

SEQ ID NO: 166018 - protein, 9 aa, Yellow fever virus
KSLVFSPGR

SEQ ID NO: 166019 - protein, 9 aa, Yellow fever virus
SLVFSPGRK

SEQ ID NO: 166020 - protein, 9 aa, Yellow fever virus
TTRVFMDAT

SEQ ID NO: 166021 - protein, 9 aa, Yellow fever virus
TRVFMDATF

SEQ ID NO: 166022 - protein, 9 aa, Yellow fever virus
RVFMDATFD

SEQ ID NO: 166023 - protein, 9 aa, Yellow fever virus
VFMDATFDY

SEQ ID NO: 166024 - protein, 9 aa, Yellow fever virus
FMDATFDYS

SEQ ID NO: 166025 - protein, 9 aa, Yellow fever virus
MDATFDYSV

SEQ ID NO: 166026 - protein, 9 aa, Yellow fever virus
DATFDYSVD

SEQ ID NO: 166027 - protein, 9 aa, Yellow fever virus
ATFDYSVDC

SEQ ID NO: 166028 - protein, 9 aa, Yellow fever virus
TFDYSVDCD

SEQ ID NO: 166029 - protein, 9 aa, Yellow fever virus
HEVNGTWMV

SEQ ID NO: 166030 - protein, 9 aa, Yellow fever virus
EVNGTWMMH

SEQ ID NO: 166031 - protein, 9 aa, Yellow fever virus
VNGTWMMHT

SEQ ID NO: 166032 - protein, 9 aa, Yellow fever virus
NGTWMMHTL

SEQ ID NO: 166033 - protein, 9 aa, Yellow fever virus
GTWMMHTLE

SEQ ID NO: 166034 - protein, 9 aa, Yellow fever virus
TWMMHTLET

SEQ ID NO: 166035 - protein, 9 aa, Yellow fever virus
WMMHTLETL

SEQ ID NO: 166036 - protein, 9 aa, Yellow fever virus
MVHTLETLD

SEQ ID NO: 166037 - protein, 9 aa, Yellow fever virus
VHTLETLDY

SEQ ID NO: 166038 - protein, 9 aa, Yellow fever virus
VPLEVRREP

SEQ ID NO: 166039 - protein, 9 aa, Yellow fever virus
PLEVRREPC

SEQ ID NO: 166040 - protein, 9 aa, Yellow fever virus
LEVRREPCP

SEQ ID NO: 166041 - protein, 9 aa, Yellow fever virus
EVRREACPG

SEQ ID NO: 166042 - protein, 9 aa, Yellow fever virus
VRREACPGT

SEQ ID NO: 166043 - protein, 9 aa, Yellow fever virus
RREACPGTS

SEQ ID NO: 166044 - protein, 9 aa, Yellow fever virus
REVCPGTSV

SEQ ID NO: 166045 - protein, 9 aa, Yellow fever virus
EVCPGTSVV

SEQ ID NO: 166046 - protein, 9 aa, Yellow fever virus
PCPGTSVVL

SEQ ID NO: 166047 - protein, 9 aa, Yellow fever virus
CPGTSVVLD

SEQ ID NO: 166048 - protein, 9 aa, Yellow fever virus
PGTSVVVDS

SEQ ID NO: 166049 - protein, 9 aa, Yellow fever virus
GTSVVLDTG

SEQ ID NO: 166050 - protein, 9 aa, Yellow fever virus
TSVVVDTSC

SEQ ID NO: 166051 - protein, 9 aa, Yellow fever virus
SVVVDTSCD

SEQ ID NO: 166052 - protein, 9 aa, Yellow fever virus
VVLDTGCDG

SEQ ID NO: 166053 - protein, 9 aa, Yellow fever virus
VVDTSCDGR

SEQ ID NO: 166054 - protein, 9 aa, Yellow fever virus
VDTSCDGRG

SEQ ID NO: 166055 - protein, 9 aa, Yellow fever virus
DTGCDGRGK

SEQ ID NO: 166056 - protein, 9 aa, Yellow fever virus
SNCDGRGKS

SEQ ID NO: 166057 - protein, 9 aa, Yellow fever virus
NCDGRGKSA

SEQ ID NO: 166058 - protein, 9 aa, Yellow fever virus
PMEIRPRKA

SEQ ID NO: 166059 - protein, 9 aa, Yellow fever virus
MEIRPMKTS

SEQ ID NO: 166060 - protein, 9 aa, Yellow fever virus
EIRPMKTSD

SEQ ID NO: 166061 - protein, 9 aa, Yellow fever virus
IRPMKTSDS

SEQ ID NO: 166062 - protein, 9 aa, Yellow fever virus
RPMKTSDSH

SEQ ID NO: 166063 - protein, 9 aa, Yellow fever virus
PRKAHESHL

SEQ ID NO: 166064 - protein, 9 aa, Yellow fever virus
MKTSDSHLV

SEQ ID NO: 166065 - protein, 9 aa, Yellow fever virus
KTSDSHLVR

SEQ ID NO: 166066 - protein, 9 aa, Yellow fever virus
AHESHLVRS

SEQ ID NO: 166067 - protein, 9 aa, Yellow fever virus
IAMEVVLRR

SEQ ID NO: 166068 - protein, 9 aa, Yellow fever virus
ALEVVLRKR

SEQ ID NO: 166069 - protein, 9 aa, Yellow fever virus
MEVVLRRRQ

SEQ ID NO: 166070 - protein, 9 aa, Yellow fever virus
RRRQGPKQM

SEQ ID NO: 166071 - protein, 9 aa, Yellow fever virus
RRQGPKQML

SEQ ID NO: 166072 - protein, 9 aa, Yellow fever virus
PKQMLVGGM

SEQ ID NO: 166073 - protein, 9 aa, Yellow fever virus
KQMLVGGMV

SEQ ID NO: 166074 - protein, 9 aa, Yellow fever virus
QVLVGGVVL

SEQ ID NO: 166075 - protein, 9 aa, Yellow fever virus
MLVGGMVLL

SEQ ID NO: 166076 - protein, 9 aa, Yellow fever virus
LVGGMVLLG

SEQ ID NO: 166077 - protein, 9 aa, Yellow fever virus
VGGMVLLGA

SEQ ID NO: 166078 - protein, 9 aa, Yellow fever virus
GGMVLLGAM

SEQ ID NO: 166079 - protein, 9 aa, Yellow fever virus
GMVLLGAML

SEQ ID NO: 166080 - protein, 9 aa, Yellow fever virus
MVLLGAMLV

SEQ ID NO: 166081 - protein, 9 aa, Yellow fever virus
AMLVGQVTM

SEQ ID NO: 166082 - protein, 9 aa, Yellow fever virus
MLVGQVTML

SEQ ID NO: 166083 - protein, 9 aa, Yellow fever virus
LVGQVTMLD

SEQ ID NO: 166084 - protein, 9 aa, Yellow fever virus
VGQVTMLDL

SEQ ID NO: 166085 - protein, 9 aa, Yellow fever virus
GQVTMLDLV

SEQ ID NO: 166086 - protein, 9 aa, Yellow fever virus
QVTMLDLVK

SEQ ID NO: 166087 - protein, 9 aa, Yellow fever virus
LTMAVGLHF

SEQ ID NO: 166088 - protein, 9 aa, Yellow fever virus
VVAVGLHFH

SEQ ID NO: 166089 - protein, 9 aa, Yellow fever virus
MALIAAFSV

SEQ ID NO: 166090 - protein, 9 aa, Yellow fever virus
ALIAAFSVR

SEQ ID NO: 166091 - protein, 9 aa, Yellow fever virus
LIAAFSVRP

SEQ ID NO: 166092 - protein, 9 aa, Yellow fever virus
IAAFSVRPG

SEQ ID NO: 166093 - protein, 9 aa, Yellow fever virus
AAFSVRPGL

SEQ ID NO: 166094 - protein, 9 aa, Yellow fever virus
AFSVRPGLL

SEQ ID NO: 166095 - protein, 9 aa, Yellow fever virus
FSIRPGLLV

SEQ ID NO: 166096 - protein, 9 aa, Yellow fever virus
SIRPGLLVG

SEQ ID NO: 166097 - protein, 9 aa, Yellow fever virus
IRPGLLMGF

SEQ ID NO: 166098 - protein, 9 aa, Yellow fever virus
RPGLLVGFG

SEQ ID NO: 166099 - protein, 9 aa, Yellow fever virus
PGLLVGFGL

SEQ ID NO: 166100 - protein, 9 aa, Yellow fever virus
GLLVGFGLR

SEQ ID NO: 166101 - protein, 9 aa, Yellow fever virus
LLMGFGLRT

SEQ ID NO: 166102 - protein, 9 aa, Yellow fever virus
LMGFGLRTL

SEQ ID NO: 166103 - protein, 9 aa, Yellow fever virus
VGFGLRTLW

SEQ ID NO: 166104 - protein, 9 aa, Yellow fever virus
SPRERLVLA

SEQ ID NO: 166105 - protein, 9 aa, Yellow fever virus
PRERLVLAL

SEQ ID NO: 166106 - protein, 9 aa, Yellow fever virus
RERLVLALG

SEQ ID NO: 166107 - protein, 9 aa, Yellow fever virus
ERLVLALGA

SEQ ID NO: 166108 - protein, 9 aa, Yellow fever virus
RLVLALGAA

SEQ ID NO: 166109 - protein, 9 aa, Yellow fever virus
LVLALGAAM

SEQ ID NO: 166110 - protein, 9 aa, Yellow fever virus
VLALGAAMV

SEQ ID NO: 166111 - protein, 9 aa, Yellow fever virus
LALGAAMVE

SEQ ID NO: 166112 - protein, 9 aa, Yellow fever virus
AFGAAMVEV

SEQ ID NO: 166113 - protein, 9 aa, Yellow fever virus
FGAAMVEIA

SEQ ID NO: 166114 - protein, 9 aa, Yellow fever virus
MVEVALGGM

SEQ ID NO: 166115 - protein, 9 aa, Yellow fever virus
VEVALGGMM

SEQ ID NO: 166116 - protein, 9 aa, Yellow fever virus
EVALGGMMG

SEQ ID NO: 166117 - protein, 9 aa, Yellow fever virus
VALGGMMGG

SEQ ID NO: 166118 - protein, 9 aa, Yellow fever virus
GGMMGGLWQ

SEQ ID NO: 166119 - protein, 9 aa, Yellow fever virus
GMMGGLWQY

SEQ ID NO: 166120 - protein, 9 aa, Yellow fever virus
MMGGLWQYL

SEQ ID NO: 166121 - protein, 9 aa, Yellow fever virus
ISSRKASNT

SEQ ID NO: 166122 - protein, 9 aa, Yellow fever virus
ASRKASNAI

SEQ ID NO: 166123 - protein, 9 aa, Yellow fever virus
SRKASNAVL

SEQ ID NO: 166124 - protein, 9 aa, Yellow fever virus
RKASNMILP

SEQ ID NO: 166125 - protein, 9 aa, Yellow fever virus
KASNMILPL

SEQ ID NO: 166126 - protein, 9 aa, Yellow fever virus
ASNAVLPLM

SEQ ID NO: 166127 - protein, 9 aa, Yellow fever virus
SNAVLPLMA

SEQ ID NO: 166128 - protein, 9 aa, Yellow fever virus
NAVLPLMAL

SEQ ID NO: 166129 - protein, 9 aa, Yellow fever virus
AILPLMALL

SEQ ID NO: 166130 - protein, 9 aa, Yellow fever virus
VLPLMALLT

SEQ ID NO: 166131 - protein, 9 aa, Yellow fever virus
ALMTPMTMH

SEQ ID NO: 166132 - protein, 9 aa, Yellow fever virus
LMTPMTMHE

SEQ ID NO: 166133 - protein, 9 aa, Yellow fever virus
MTPMTMHEV

SEQ ID NO: 166134 - protein, 9 aa, Yellow fever virus
TPMTMHEVR

SEQ ID NO: 166135 - protein, 9 aa, Yellow fever virus
PVTMHEVRM

SEQ ID NO: 166136 - protein, 9 aa, Yellow fever virus
VTMHEVRMA

SEQ ID NO: 166137 - protein, 9 aa, Yellow fever virus
TMHEVRMAT

SEQ ID NO: 166138 - protein, 9 aa, Yellow fever virus
MHEVRMATM

SEQ ID NO: 166139 - protein, 9 aa, Yellow fever virus
AEVRLAAML

SEQ ID NO: 166140 - protein, 9 aa, Yellow fever virus
EVRLAAMLF

SEQ ID NO: 166141 - protein, 9 aa, Yellow fever virus
VRLATMLFC

SEQ ID NO: 166142 - protein, 9 aa, Yellow fever virus
AAMLFCAVV

SEQ ID NO: 166143 - protein, 9 aa, Yellow fever virus
AMLFCAVVI

SEQ ID NO: 166144 - protein, 9 aa, Yellow fever virus
MLFCAVVII

SEQ ID NO: 166145 - protein, 9 aa, Yellow fever virus
LFCAVVIIG

SEQ ID NO: 166146 - protein, 9 aa, Yellow fever virus
FCTVVIVGV

SEQ ID NO: 166147 - protein, 9 aa, Yellow fever virus
CTVVIVGVL

SEQ ID NO: 166148 - protein, 9 aa, Yellow fever virus
TVVIVGVLH

SEQ ID NO: 166149 - protein, 9 aa, Yellow fever virus
VVIIGVLYQ

SEQ ID NO: 166150 - protein, 9 aa, Yellow fever virus
VIIGVLYQN

SEQ ID NO: 166151 - protein, 9 aa, Yellow fever virus
IVGVLHQNS

SEQ ID NO: 166152 - protein, 9 aa, Yellow fever virus
IGVLYQNSK

SEQ ID NO: 166153 - protein, 9 aa, Yellow fever virus
GVLYQNSKD

SEQ ID NO: 166154 - protein, 9 aa, Yellow fever virus
VLYQNSKDT

SEQ ID NO: 166155 - protein, 9 aa, Yellow fever virus
LYQNSKDTS

SEQ ID NO: 166156 - protein, 9 aa, Yellow fever virus
HQNAKDTSM

SEQ ID NO: 166157 - protein, 9 aa, Yellow fever virus
QNAKDTSMQ

SEQ ID NO: 166158 - protein, 9 aa, Yellow fever virus
NAKDTSMQK

SEQ ID NO: 166159 - protein, 9 aa, Yellow fever virus
AKDTSMQKT

SEQ ID NO: 166160 - protein, 9 aa, Yellow fever virus
LCAFLATRL

SEQ ID NO: 166161 - protein, 9 aa, Yellow fever virus
CAFLATRLF

SEQ ID NO: 166162 - protein, 9 aa, Yellow fever virus
AFLATRLFG

SEQ ID NO: 166163 - protein, 9 aa, Yellow fever virus
FLATRLFGR

SEQ ID NO: 166164 - protein, 9 aa, Yellow fever virus
LATRLFGRR

SEQ ID NO: 166165 - protein, 9 aa, Yellow fever virus
ATRLFGRRS

SEQ ID NO: 166166 - protein, 9 aa, Yellow fever virus
TRLFGRRSI

SEQ ID NO: 166167 - protein, 9 aa, Yellow fever virus
RLFGRRSIP

SEQ ID NO: 166168 - protein, 9 aa, Yellow fever virus
LFGRRSIPV

SEQ ID NO: 166169 - protein, 9 aa, Yellow fever virus
GRVDGLELR

SEQ ID NO: 166170 - protein, 9 aa, Yellow fever virus
KVDGLELKK

SEQ ID NO: 166171 - protein, 9 aa, Yellow fever virus
LELKKLGEI

SEQ ID NO: 166172 - protein, 9 aa, Yellow fever virus
ELKKLGEIS

SEQ ID NO: 166173 - protein, 9 aa, Yellow fever virus
LKKLGEISW

SEQ ID NO: 166174 - protein, 9 aa, Yellow fever virus
KKLGEISWE

SEQ ID NO: 166175 - protein, 9 aa, Yellow fever virus
KLGEVAWEE

SEQ ID NO: 166176 - protein, 9 aa, Yellow fever virus
LGEVAWEEE

SEQ ID NO: 166177 - protein, 9 aa, Yellow fever virus
GEISWEEEA

SEQ ID NO: 166178 - protein, 9 aa, Yellow fever virus
EISWEEEAE

SEQ ID NO: 166179 - protein, 9 aa, Yellow fever virus
VAWEEEAEI

SEQ ID NO: 166180 - protein, 9 aa, Yellow fever virus
SARYDVALN

SEQ ID NO: 166181 - protein, 9 aa, Yellow fever virus
ARYDVALNE

SEQ ID NO: 166182 - protein, 9 aa, Yellow fever virus
LVGAAIHPS

SEQ ID NO: 166183 - protein, 9 aa, Yellow fever virus
VGAAIHPSA

SEQ ID NO: 166184 - protein, 9 aa, Yellow fever virus
GAAIHPSAL

SEQ ID NO: 166185 - protein, 9 aa, Yellow fever virus
AAIHPSALL

SEQ ID NO: 166186 - protein, 9 aa, Yellow fever virus
AIHPSALLL

SEQ ID NO: 166187 - protein, 9 aa, Yellow fever virus
IHPSALLLV

SEQ ID NO: 166188 - protein, 9 aa, Yellow fever virus
PSALLLVLA

SEQ ID NO: 166189 - protein, 9 aa, Yellow fever virus
SALLLVLAG

SEQ ID NO: 166190 - protein, 9 aa, Yellow fever virus
LLLVLGGWI

SEQ ID NO: 166191 - protein, 9 aa, Yellow fever virus
LLVLGGWIL

SEQ ID NO: 166192 - protein, 9 aa, Yellow fever virus
LVLGGWILH

SEQ ID NO: 166193 - protein, 9 aa, Yellow fever virus
VLGGWILHI

SEQ ID NO: 166194 - protein, 9 aa, Yellow fever virus
LGGWVLHIK

SEQ ID NO: 166195 - protein, 9 aa, Yellow fever virus
AGWLFHVRR

SEQ ID NO: 166196 - protein, 9 aa, Yellow fever virus
GWLFHVRRA

SEQ ID NO: 166197 - protein, 9 aa, Yellow fever virus
WVLHIKGAR

SEQ ID NO: 166198 - protein, 9 aa, Yellow fever virus
VLHIKGARR

SEQ ID NO: 166199 - protein, 9 aa, Yellow fever virus
LHIKGARRS

SEQ ID NO: 166200 - protein, 9 aa, Yellow fever virus
HVKGARRSG

SEQ ID NO: 166201 - protein, 9 aa, Yellow fever virus
VKGARRSGD

SEQ ID NO: 166202 - protein, 9 aa, Yellow fever virus
RRARRSGDV

SEQ ID NO: 166203 - protein, 9 aa, Yellow fever virus
PKVIEECEY

SEQ ID NO: 166204 - protein, 9 aa, Yellow fever virus
KVIEECEYL

SEQ ID NO: 166205 - protein, 9 aa, Yellow fever virus
VIEECEYLE

SEQ ID NO: 166206 - protein, 9 aa, Yellow fever virus
CEYLEDGIY

SEQ ID NO: 166207 - protein, 9 aa, Yellow fever virus
EHLEDGISG

SEQ ID NO: 166208 - protein, 9 aa, Yellow fever virus
YLEDGIYGI

SEQ ID NO: 166209 - protein, 9 aa, Yellow fever virus
VTRGAFLVW

SEQ ID NO: 166210 - protein, 9 aa, Yellow fever virus
TRGAFLVWN

SEQ ID NO: 166211 - protein, 9 aa, Yellow fever virus
RGAFLVWNG

SEQ ID NO: 166212 - protein, 9 aa, Yellow fever virus
GAFLVWNGK

SEQ ID NO: 166213 - protein, 9 aa, Yellow fever virus
AFLVWNGKK

SEQ ID NO: 166214 - protein, 9 aa, Yellow fever virus
FLVWNGKKL

SEQ ID NO: 166215 - protein, 9 aa, Yellow fever virus
LVWNGKKLI

SEQ ID NO: 166216 - protein, 9 aa, Yellow fever virus
VWNGKKLIP

SEQ ID NO: 166217 - protein, 9 aa, Yellow fever virus
WNGKKLIPS

SEQ ID NO: 166218 - protein, 9 aa, Yellow fever virus
GGSWKLDGR

SEQ ID NO: 166219 - protein, 9 aa, Yellow fever virus
GSWKLDGRW

SEQ ID NO: 166220 - protein, 9 aa, Yellow fever virus
SWKLDGRWD

SEQ ID NO: 166221 - protein, 9 aa, Yellow fever virus
WKLDGRWDG

SEQ ID NO: 166222 - protein, 9 aa, Yellow fever virus
KLDGRWDGE

SEQ ID NO: 166223 - protein, 9 aa, Yellow fever virus
LDGRWDGEE

SEQ ID NO: 166224 - protein, 9 aa, Yellow fever virus
DGRWDGEEE

SEQ ID NO: 166225 - protein, 9 aa, Yellow fever virus
LIAAAPGKN

SEQ ID NO: 166226 - protein, 9 aa, Yellow fever virus
IAAAPGKNV

SEQ ID NO: 166227 - protein, 9 aa, Yellow fever virus
AAVPGKSVV

SEQ ID NO: 166228 - protein, 9 aa, Yellow fever virus
AAPGKNVVN

SEQ ID NO: 166229 - protein, 9 aa, Yellow fever virus
VPGKSVVNV

SEQ ID NO: 166230 - protein, 9 aa, Yellow fever virus
PGKSVVNVQ

SEQ ID NO: 166231 - protein, 9 aa, Yellow fever virus
GKSVVNVQT

SEQ ID NO: 166232 - protein, 9 aa, Yellow fever virus
KSVVNVQTK

SEQ ID NO: 166233 - protein, 9 aa, Yellow fever virus
SVVNVQTKP

SEQ ID NO: 166234 - protein, 9 aa, Yellow fever virus
VQTKPSLFR

SEQ ID NO: 166235 - protein, 9 aa, Yellow fever virus
QTKPSVFKV

SEQ ID NO: 166236 - protein, 9 aa, Yellow fever virus
TKPSVFKVR

SEQ ID NO: 166237 - protein, 9 aa, Yellow fever virus
KPSLFRVKN

SEQ ID NO: 166238 - protein, 9 aa, Yellow fever virus
PSLFRVKNG

SEQ ID NO: 166239 - protein, 9 aa, Yellow fever virus
SLFRVKNGG

SEQ ID NO: 166240 - protein, 9 aa, Yellow fever virus
LFRVKNGGE

SEQ ID NO: 166241 - protein, 9 aa, Yellow fever virus
IVNRNGEVV

SEQ ID NO: 166242 - protein, 9 aa, Yellow fever virus
VNRNGEVVG

SEQ ID NO: 166243 - protein, 9 aa, Yellow fever virus
NRNGEVVGL

SEQ ID NO: 166244 - protein, 9 aa, Yellow fever virus
RNGEVVGLY

SEQ ID NO: 166245 - protein, 9 aa, Yellow fever virus
NGEVVGLYG

SEQ ID NO: 166246 - protein, 9 aa, Yellow fever virus
SQTELKEES

SEQ ID NO: 166247 - protein, 9 aa, Yellow fever virus
QTELKEESK

SEQ ID NO: 166248 - protein, 9 aa, Yellow fever virus
TELKEESKE

SEQ ID NO: 166249 - protein, 9 aa, Yellow fever virus
ELKEESKEE

SEQ ID NO: 166250 - protein, 9 aa, Yellow fever virus
LKEESKEEL

SEQ ID NO: 166251 - protein, 9 aa, Yellow fever virus
KEEGKEELR

SEQ ID NO: 166252 - protein, 9 aa, Yellow fever virus
EESKEELQE

SEQ ID NO: 166253 - protein, 9 aa, Yellow fever virus
ESKEELQEI

SEQ ID NO: 166254 - protein, 9 aa, Yellow fever virus
SKEELQEIP

SEQ ID NO: 166255 - protein, 9 aa, Yellow fever virus
KEELQEIST

SEQ ID NO: 166256 - protein, 9 aa, Yellow fever virus
EELQEISTM

SEQ ID NO: 166257 - protein, 9 aa, Yellow fever virus
ELQEISTML

SEQ ID NO: 166258 - protein, 9 aa, Yellow fever virus
LQEISTMLK

SEQ ID NO: 166259 - protein, 9 aa, Yellow fever virus
QEISTMLKK

SEQ ID NO: 166260 - protein, 9 aa, Yellow fever virus
ISTMLKKGM

SEQ ID NO: 166261 - protein, 9 aa, Yellow fever virus
STMLKKGMT

SEQ ID NO: 166262 - protein, 9 aa, Yellow fever virus
MLKKGKTTI

SEQ ID NO: 166263 - protein, 9 aa, Yellow fever virus
LKKGKTTIL

SEQ ID NO: 166264 - protein, 9 aa, Yellow fever virus
KKGKTTILD

SEQ ID NO: 166265 - protein, 9 aa, Yellow fever virus
KGKTTILDF

SEQ ID NO: 166266 - protein, 9 aa, Yellow fever virus
GKTTILDFH

SEQ ID NO: 166267 - protein, 9 aa, Yellow fever virus
KTTILDFHP

SEQ ID NO: 166268 - protein, 9 aa, Yellow fever virus
TTILDYHPG

SEQ ID NO: 166269 - protein, 9 aa, Yellow fever virus
TILDYHPGA

SEQ ID NO: 166270 - protein, 9 aa, Yellow fever virus
ILDYHPGAG

SEQ ID NO: 166271 - protein, 9 aa, Yellow fever virus
GSGREVIDV

SEQ ID NO: 166272 - protein, 9 aa, Yellow fever virus
SGREVIDVM

SEQ ID NO: 166273 - protein, 9 aa, Yellow fever virus
GREVIDVMC

SEQ ID NO: 166274 - protein, 9 aa, Yellow fever virus
REVIDVMCH

SEQ ID NO: 166275 - protein, 9 aa, Yellow fever virus
YRMLEPTRA

SEQ ID NO: 166276 - protein, 9 aa, Yellow fever virus
RMLEPTRAV

SEQ ID NO: 166277 - protein, 9 aa, Yellow fever virus
MLEPTRAVN

SEQ ID NO: 166278 - protein, 9 aa, Yellow fever virus
LEPTRAVNW

SEQ ID NO: 166279 - protein, 9 aa, Yellow fever virus
EPTRAVNWE

SEQ ID NO: 166280 - protein, 9 aa, Yellow fever virus
PTRAVNWEV

SEQ ID NO: 166281 - protein, 9 aa, Yellow fever virus
TRAVNWEVI

SEQ ID NO: 166282 - protein, 9 aa, Yellow fever virus
RAVNWEVII

SEQ ID NO: 166283 - protein, 9 aa, Yellow fever virus
AVNWEVIIM

SEQ ID NO: 166284 - protein, 9 aa, Yellow fever virus
DIPSEPWTA

SEQ ID NO: 166285 - protein, 9 aa, Yellow fever virus
IPSEPWTAG

SEQ ID NO: 166286 - protein, 9 aa, Yellow fever virus
PSEPWTAGH

SEQ ID NO: 166287 - protein, 9 aa, Yellow fever virus
SEPWTAGHE

SEQ ID NO: 166288 - protein, 9 aa, Yellow fever virus
EPWTAGHEW

SEQ ID NO: 166289 - protein, 9 aa, Yellow fever virus
PWTAGHEWI

SEQ ID NO: 166290 - protein, 9 aa, Yellow fever virus
WTAGHEWIL

SEQ ID NO: 166291 - protein, 9 aa, Yellow fever virus
TAGHEWILA

SEQ ID NO: 166292 - protein, 9 aa, Yellow fever virus
AGHEWILAD

SEQ ID NO: 166293 - protein, 9 aa, Yellow fever virus
APLYGVEGI

SEQ ID NO: 166294 - protein, 9 aa, Yellow fever virus
PLYGVEGIK

SEQ ID NO: 166295 - protein, 9 aa, Yellow fever virus
LYGVEGIKT

SEQ ID NO: 166296 - protein, 9 aa, Yellow fever virus
YGVEGIKTP

SEQ ID NO: 166297 - protein, 9 aa, Yellow fever virus
GVEGIKTPV

SEQ ID NO: 166298 - protein, 9 aa, Yellow fever virus
VEGIKTPVS

SEQ ID NO: 166299 - protein, 9 aa, Yellow fever virus
LRDDQRRVS

SEQ ID NO: 166300 - protein, 9 aa, Yellow fever virus
RDDQRRVSR

SEQ ID NO: 166301 - protein, 9 aa, Yellow fever virus
DDQRRVSRE

SEQ ID NO: 166302 - protein, 9 aa, Yellow fever virus
DQRRVSREL

SEQ ID NO: 166303 - protein, 9 aa, Yellow fever virus
QRRVSRELV

SEQ ID NO: 166304 - protein, 9 aa, Yellow fever virus
RRVSRELVR

SEQ ID NO: 166305 - protein, 9 aa, Yellow fever virus
RVSRELVRN

SEQ ID NO: 166306 - protein, 9 aa, Yellow fever virus
VSRELVRNC

SEQ ID NO: 166307 - protein, 9 aa, Yellow fever virus
SRELVRNCD

SEQ ID NO: 166308 - protein, 9 aa, Yellow fever virus
RELVRNCDQ

SEQ ID NO: 166309 - protein, 9 aa, Yellow fever virus
ELVRNCDQP

SEQ ID NO: 166310 - protein, 9 aa, Yellow fever virus
LVRNCDQPV

SEQ ID NO: 166311 - protein, 9 aa, Yellow fever virus
VRNCDQPVW

SEQ ID NO: 166312 - protein, 9 aa, Yellow fever virus
RNCDQPVWL

SEQ ID NO: 166313 - protein, 9 aa, Yellow fever virus
GCDLPVWLA

SEQ ID NO: 166314 - protein, 9 aa, Yellow fever virus
CDQPVWLSW

SEQ ID NO: 166315 - protein, 9 aa, Yellow fever virus
DQPVWLSWQ

SEQ ID NO: 166316 - protein, 9 aa, Yellow fever virus
LPVWLAWQV

SEQ ID NO: 166317 - protein, 9 aa, Yellow fever virus
WLSWQVAKP

SEQ ID NO: 166318 - protein, 9 aa, Yellow fever virus
LSWQVAKPG

SEQ ID NO: 166319 - protein, 9 aa, Yellow fever virus
AWQVAKAGL

SEQ ID NO: 166320 - protein, 9 aa, Yellow fever virus
RKWCFEGPD

SEQ ID NO: 166321 - protein, 9 aa, Yellow fever virus
KWCFEGPDE

SEQ ID NO: 166322 - protein, 9 aa, Yellow fever virus
WCFEGPDEH

SEQ ID NO: 166323 - protein, 9 aa, Yellow fever virus
CFEGPDEHE

SEQ ID NO: 166324 - protein, 9 aa, Yellow fever virus
FEGPDEHEI

SEQ ID NO: 166325 - protein, 9 aa, Yellow fever virus
DGPKEHEIL

SEQ ID NO: 166326 - protein, 9 aa, Yellow fever virus
GPKEHEILN

SEQ ID NO: 166327 - protein, 9 aa, Yellow fever virus
PDEHEILND

SEQ ID NO: 166328 - protein, 9 aa, Yellow fever virus
KEHEILNDS

SEQ ID NO: 166329 - protein, 9 aa, Yellow fever virus
SGETVKCRT

SEQ ID NO: 166330 - protein, 9 aa, Yellow fever virus
GETVKCRTP

SEQ ID NO: 166331 - protein, 9 aa, Yellow fever virus
ETVKCRTPG

SEQ ID NO: 166332 - protein, 9 aa, Yellow fever virus
TVKCRTPGG

SEQ ID NO: 166333 - protein, 9 aa, Yellow fever virus
VKCRTPGGA

SEQ ID NO: 166334 - protein, 9 aa, Yellow fever virus
KCRTPGGAK

SEQ ID NO: 166335 - protein, 9 aa, Yellow fever virus
CRAPGGAKR

SEQ ID NO: 166336 - protein, 9 aa, Yellow fever virus
RTPGGAKKP

SEQ ID NO: 166337 - protein, 9 aa, Yellow fever virus
APGGAKRPL

SEQ ID NO: 166338 - protein, 9 aa, Yellow fever virus
PGGAKRALR

SEQ ID NO: 166339 - protein, 9 aa, Yellow fever virus
GGAKRALRP

SEQ ID NO: 166340 - protein, 9 aa, Yellow fever virus
GAKRPLRPR

SEQ ID NO: 166341 - protein, 9 aa, Yellow fever virus
AKRALRPRW

SEQ ID NO: 166342 - protein, 9 aa, Yellow fever virus
KRALRPRWC

SEQ ID NO: 166343 - protein, 9 aa, Yellow fever virus
RALRPRWCD

SEQ ID NO: 166344 - protein, 9 aa, Yellow fever virus
EGRRGAADV

SEQ ID NO: 166345 - protein, 9 aa, Yellow fever virus
GRRGAADVL

SEQ ID NO: 166346 - protein, 9 aa, Yellow fever virus
RRGAADVLV

SEQ ID NO: 166347 - protein, 9 aa, Yellow fever virus
RGAAEILVV

SEQ ID NO: 166348 - protein, 9 aa, Yellow fever virus
GAAEILVVL

SEQ ID NO: 166349 - protein, 9 aa, Yellow fever virus
AAEMLVILT

SEQ ID NO: 166350 - protein, 9 aa, Yellow fever virus
AEILVVLSE

SEQ ID NO: 166351 - protein, 9 aa, Yellow fever virus
EILVVLSEL

SEQ ID NO: 166352 - protein, 9 aa, Yellow fever virus
MLVILTELP

SEQ ID NO: 166353 - protein, 9 aa, Yellow fever virus
LVILTELPD

SEQ ID NO: 166354 - protein, 9 aa, Yellow fever virus
VILTELPDF

SEQ ID NO: 166355 - protein, 9 aa, Yellow fever virus
ILTELPDFL

SEQ ID NO: 166356 - protein, 9 aa, Yellow fever virus
AMTIAMLFI

SEQ ID NO: 166357 - protein, 9 aa, Yellow fever virus
MTIAMLFIL

SEQ ID NO: 166358 - protein, 9 aa, Yellow fever virus
TIAMLFILA

SEQ ID NO: 166359 - protein, 9 aa, Yellow fever virus
IAMLFILAG

SEQ ID NO: 166360 - protein, 9 aa, Yellow fever virus
AMLFILAGL

SEQ ID NO: 166361 - protein, 9 aa, Yellow fever virus
GISRMSMAK

SEQ ID NO: 166362 - protein, 9 aa, Yellow fever virus
ISRMSMAKG

SEQ ID NO: 166363 - protein, 9 aa, Yellow fever virus
MAKGTMAGC

SEQ ID NO: 166364 - protein, 9 aa, Yellow fever virus
AKGTMAGCG

SEQ ID NO: 166365 - protein, 9 aa, Yellow fever virus
KGTMAGCGY

SEQ ID NO: 166366 - protein, 9 aa, Yellow fever virus
YLMFLGGVE

SEQ ID NO: 166367 - protein, 9 aa, Yellow fever virus
LMFLGGAKP

SEQ ID NO: 166368 - protein, 9 aa, Yellow fever virus
MFLGGAKPT

SEQ ID NO: 166369 - protein, 9 aa, Yellow fever virus
FLGGVEPTH

SEQ ID NO: 166370 - protein, 9 aa, Yellow fever virus
LGGVEPTHI

SEQ ID NO: 166371 - protein, 9 aa, Yellow fever virus
GGAKPTHIS

SEQ ID NO: 166372 - protein, 9 aa, Yellow fever virus
GAKPTHISY

SEQ ID NO: 166373 - protein, 9 aa, Yellow fever virus
VEPTHISYI

SEQ ID NO: 166374 - protein, 9 aa, Yellow fever virus
EPTHISYIM

SEQ ID NO: 166375 - protein, 9 aa, Yellow fever virus
SIQDNQVAF

SEQ ID NO: 166376 - protein, 9 aa, Yellow fever virus
IGILTLLSV

SEQ ID NO: 166377 - protein, 9 aa, Yellow fever virus
GILTLLSVV

SEQ ID NO: 166378 - protein, 9 aa, Yellow fever virus
ILTLLSVVA

SEQ ID NO: 166379 - protein, 9 aa, Yellow fever virus
LTLLSVVAA

SEQ ID NO: 166380 - protein, 9 aa, Yellow fever virus
TLLSVVAAN

SEQ ID NO: 166381 - protein, 9 aa, Yellow fever virus
LLSVVAANE

SEQ ID NO: 166382 - protein, 9 aa, Yellow fever virus
LSVVAANEL

SEQ ID NO: 166383 - protein, 9 aa, Yellow fever virus
SIVAANELG

SEQ ID NO: 166384 - protein, 9 aa, Yellow fever virus
IVAANELGM

SEQ ID NO: 166385 - protein, 9 aa, Yellow fever virus
MLERTKEDL

SEQ ID NO: 166386 - protein, 9 aa, Yellow fever virus
LERTKEDLF

SEQ ID NO: 166387 - protein, 9 aa, Yellow fever virus
ERTKEDLFG

SEQ ID NO: 166388 - protein, 9 aa, Yellow fever virus
KTKEDFFGR

SEQ ID NO: 166389 - protein, 9 aa, Yellow fever virus
TKEDFFGRR

SEQ ID NO: 166390 - protein, 9 aa, Yellow fever virus
KEDFFGRRN

SEQ ID NO: 166391 - protein, 9 aa, Yellow fever virus
TPSGAIPWS

SEQ ID NO: 166392 - protein, 9 aa, Yellow fever virus
PSGAIPWSW

SEQ ID NO: 166393 - protein, 9 aa, Yellow fever virus
SGASPWSWP

SEQ ID NO: 166394 - protein, 9 aa, Yellow fever virus
GAIPWSWPD

SEQ ID NO: 166395 - protein, 9 aa, Yellow fever virus
AIPWSWPDL

SEQ ID NO: 166396 - protein, 9 aa, Yellow fever virus
MKMNISVVI

SEQ ID NO: 166397 - protein, 9 aa, Yellow fever virus
KMNISVVIL

SEQ ID NO: 166398 - protein, 9 aa, Yellow fever virus
MNISVVILL

SEQ ID NO: 166399 - protein, 9 aa, Yellow fever virus
NISVVILLV

SEQ ID NO: 166400 - protein, 9 aa, Yellow fever virus
ISVVILLVS

SEQ ID NO: 166401 - protein, 9 aa, Yellow fever virus
SVVILLVSG

SEQ ID NO: 166402 - protein, 9 aa, Yellow fever virus
VVILLVSGW

SEQ ID NO: 166403 - protein, 9 aa, Yellow fever virus
VILLVSGWN

SEQ ID NO: 166404 - protein, 9 aa, Yellow fever virus
MLLISGWNS

SEQ ID NO: 166405 - protein, 9 aa, Yellow fever virus
TVIPLLCGI

SEQ ID NO: 166406 - protein, 9 aa, Yellow fever virus
VIPLLCGIG

SEQ ID NO: 166407 - protein, 9 aa, Yellow fever virus
IPLLCGIGG

SEQ ID NO: 166408 - protein, 9 aa, Yellow fever virus
PLLCGIGGA

SEQ ID NO: 166409 - protein, 9 aa, Yellow fever virus
LLCGIGCAT

SEQ ID NO: 166410 - protein, 9 aa, Yellow fever virus
LCGIGCATL

SEQ ID NO: 166411 - protein, 9 aa, Yellow fever virus
CGIGCATLH

SEQ ID NO: 166412 - protein, 9 aa, Yellow fever virus
GIGGAMLHW

SEQ ID NO: 166413 - protein, 9 aa, Yellow fever virus
IGGAMLHWT

SEQ ID NO: 166414 - protein, 9 aa, Yellow fever virus
GCATLHWSL

SEQ ID NO: 166415 - protein, 9 aa, Yellow fever virus
CATLHWSLI

SEQ ID NO: 166416 - protein, 9 aa, Yellow fever virus
ATLHWSLIL

SEQ ID NO: 166417 - protein, 9 aa, Yellow fever virus
TLHWSLILP

SEQ ID NO: 166418 - protein, 9 aa, Yellow fever virus
AQQSKLPQR

SEQ ID NO: 166419 - protein, 9 aa, Yellow fever virus
QQSKLPQRR

SEQ ID NO: 166420 - protein, 9 aa, Yellow fever virus
QSKLPQRRV

SEQ ID NO: 166421 - protein, 9 aa, Yellow fever virus
SKLPQRRVF

SEQ ID NO: 166422 - protein, 9 aa, Yellow fever virus
KLPQRRVFH

SEQ ID NO: 166423 - protein, 9 aa, Yellow fever virus
LPQRRVFHG

SEQ ID NO: 166424 - protein, 9 aa, Yellow fever virus
PQRRVFHGV

SEQ ID NO: 166425 - protein, 9 aa, Yellow fever virus
RRVFHGVAE

SEQ ID NO: 166426 - protein, 9 aa, Yellow fever virus
YLLLALSLS

SEQ ID NO: 166427 - protein, 9 aa, Yellow fever virus
LLLALSLSS

SEQ ID NO: 166428 - protein, 9 aa, Yellow fever virus
LLALSLSSV

SEQ ID NO: 166429 - protein, 9 aa, Yellow fever virus
LALSLSSVA

SEQ ID NO: 166430 - protein, 9 aa, Yellow fever virus
ALSLSSVAM

SEQ ID NO: 166431 - protein, 9 aa, Yellow fever virus
LSLSSVAMC

SEQ ID NO: 166432 - protein, 9 aa, Yellow fever virus
SLSSVAMCR

SEQ ID NO: 166433 - protein, 9 aa, Yellow fever virus
LSSVAMCRT

SEQ ID NO: 166434 - protein, 9 aa, Yellow fever virus
SSVAMCRTP

SEQ ID NO: 166435 - protein, 9 aa, Yellow fever virus
SLDEGIVLA

SEQ ID NO: 166436 - protein, 9 aa, Yellow fever virus
LDEGIVLAS

SEQ ID NO: 166437 - protein, 9 aa, Yellow fever virus
DEGIVLASA

SEQ ID NO: 166438 - protein, 9 aa, Yellow fever virus
GIVLSSAAL

SEQ ID NO: 166439 - protein, 9 aa, Yellow fever virus
IVLSSAALG

SEQ ID NO: 166440 - protein, 9 aa, Yellow fever virus
VLSSAALGP

SEQ ID NO: 166441 - protein, 9 aa, Yellow fever virus
LSSAALGPL

SEQ ID NO: 166442 - protein, 9 aa, Yellow fever virus
SSAALGPLI

SEQ ID NO: 166443 - protein, 9 aa, Yellow fever virus
NYYAFVGVA

SEQ ID NO: 166444 - protein, 9 aa, Yellow fever virus
YYAFVGVAY

SEQ ID NO: 166445 - protein, 9 aa, Yellow fever virus
VAYNLWKMK

SEQ ID NO: 166446 - protein, 9 aa, Yellow fever virus
AYNLWKMKT

SEQ ID NO: 166447 - protein, 9 aa, Yellow fever virus
YNLWKMKTA

SEQ ID NO: 166448 - protein, 9 aa, Yellow fever virus
NLWKMKTAR

SEQ ID NO: 166449 - protein, 9 aa, Yellow fever virus
LWKMKTERR

SEQ ID NO: 166450 - protein, 9 aa, Yellow fever virus
WKMKTARRG

SEQ ID NO: 166451 - protein, 9 aa, Yellow fever virus
RRGSASGKT

SEQ ID NO: 166452 - protein, 9 aa, Yellow fever virus
RGSASGKTL

SEQ ID NO: 166453 - protein, 9 aa, Yellow fever virus
GTANGKTLG

SEQ ID NO: 166454 - protein, 9 aa, Yellow fever virus
SASGKTLGE

SEQ ID NO: 166455 - protein, 9 aa, Yellow fever virus
RELNLLDRQ

SEQ ID NO: 166456 - protein, 9 aa, Yellow fever virus
ELNLLDRQQ

SEQ ID NO: 166457 - protein, 9 aa, Yellow fever virus
LNLLDRQQF

SEQ ID NO: 166458 - protein, 9 aa, Yellow fever virus
NLLDRQQFE

SEQ ID NO: 166459 - protein, 9 aa, Yellow fever virus
LLDRQQFEL

SEQ ID NO: 166460 - protein, 9 aa, Yellow fever virus
LDKQQFEMY

SEQ ID NO: 166461 - protein, 9 aa, Yellow fever virus
DKQQFEMYK

SEQ ID NO: 166462 - protein, 9 aa, Yellow fever virus
RQQFELYKR

SEQ ID NO: 166463 - protein, 9 aa, Yellow fever virus
QQFEMYKRT

SEQ ID NO: 166464 - protein, 9 aa, Yellow fever virus
EMYKRTDII

SEQ ID NO: 166465 - protein, 9 aa, Yellow fever virus
MYKRTDIIE

SEQ ID NO: 166466 - protein, 9 aa, Yellow fever virus
YKRTDIIEV

SEQ ID NO: 166467 - protein, 9 aa, Yellow fever virus
KRTDIIEVD

SEQ ID NO: 166468 - protein, 9 aa, Yellow fever virus
RTDIIEVDR

SEQ ID NO: 166469 - protein, 9 aa, Yellow fever virus
TDIIEVDRD

SEQ ID NO: 166470 - protein, 9 aa, Yellow fever virus
DIIEVDRDM

SEQ ID NO: 166471 - protein, 9 aa, Yellow fever virus
IIEVDRDMA

SEQ ID NO: 166472 - protein, 9 aa, Yellow fever virus
IEVDRDMAR

SEQ ID NO: 166473 - protein, 9 aa, Yellow fever virus
YVKLEGRVM

SEQ ID NO: 166474 - protein, 9 aa, Yellow fever virus
VKLEGRVMD

SEQ ID NO: 166475 - protein, 9 aa, Yellow fever virus
KLEGRVMDL

SEQ ID NO: 166476 - protein, 9 aa, Yellow fever virus
LEGRVMDLG

SEQ ID NO: 166477 - protein, 9 aa, Yellow fever virus
EGRVMDLGC

SEQ ID NO: 166478 - protein, 9 aa, Yellow fever virus
GRVMDLGCG

SEQ ID NO: 166479 - protein, 9 aa, Yellow fever virus
RVMDLGCGR

SEQ ID NO: 166480 - protein, 9 aa, Yellow fever virus
VMDLGCGRG

SEQ ID NO: 166481 - protein, 9 aa, Yellow fever virus
MDLGCGRGG

SEQ ID NO: 166482 - protein, 9 aa, Yellow fever virus
VKGFTLGRE

SEQ ID NO: 166483 - protein, 9 aa, Yellow fever virus
KGFTLGREG

SEQ ID NO: 166484 - protein, 9 aa, Yellow fever virus
GFTLGREGH

SEQ ID NO: 166485 - protein, 9 aa, Yellow fever virus
FTLGREGHE

SEQ ID NO: 166486 - protein, 9 aa, Yellow fever virus
VRSLGWNII

SEQ ID NO: 166487 - protein, 9 aa, Yellow fever virus
RSLGWNIIT

SEQ ID NO: 166488 - protein, 9 aa, Yellow fever virus
ITFKDKTDV

SEQ ID NO: 166489 - protein, 9 aa, Yellow fever virus
FKDKTDIHH

SEQ ID NO: 166490 - protein, 9 aa, Yellow fever virus
KDKTDIHHL

SEQ ID NO: 166491 - protein, 9 aa, Yellow fever virus
DKTDVHPLE

SEQ ID NO: 166492 - protein, 9 aa, Yellow fever virus
KTDVHRLEP

SEQ ID NO: 166493 - protein, 9 aa, Yellow fever virus
LESVKCDTL

SEQ ID NO: 166494 - protein, 9 aa, Yellow fever virus
EPMKCDTLL

SEQ ID NO: 166495 - protein, 9 aa, Yellow fever virus
SVKCDTLLC

SEQ ID NO: 166496 - protein, 9 aa, Yellow fever virus
MKCDTLLCD

SEQ ID NO: 166497 - protein, 9 aa, Yellow fever virus
IGESSPSSA

SEQ ID NO: 166498 - protein, 9 aa, Yellow fever virus
GESSSSSIT

SEQ ID NO: 166499 - protein, 9 aa, Yellow fever virus
ESSPSSATE

SEQ ID NO: 166500 - protein, 9 aa, Yellow fever virus
SSPSSATEG

SEQ ID NO: 166501 - protein, 9 aa, Yellow fever virus
SPSSATEGE

SEQ ID NO: 166502 - protein, 9 aa, Yellow fever virus
PSSATEGER

SEQ ID NO: 166503 - protein, 9 aa, Yellow fever virus
SSITEGERT

SEQ ID NO: 166504 - protein, 9 aa, Yellow fever virus
SVTEGERTL

SEQ ID NO: 166505 - protein, 9 aa, Yellow fever virus
VTEGERTLR

SEQ ID NO: 166506 - protein, 9 aa, Yellow fever virus
TEGERTMRV

SEQ ID NO: 166507 - protein, 9 aa, Yellow fever virus
EGERTMRVL

SEQ ID NO: 166508 - protein, 9 aa, Yellow fever virus
GERTLRVLE

SEQ ID NO: 166509 - protein, 9 aa, Yellow fever virus
ERTLRVLET

SEQ ID NO: 166510 - protein, 9 aa, Yellow fever virus
RTLRVLDTV

SEQ ID NO: 166511 - protein, 9 aa, Yellow fever virus
TLRVLETVE

SEQ ID NO: 166512 - protein, 9 aa, Yellow fever virus
LRVLDTVEK

SEQ ID NO: 166513 - protein, 9 aa, Yellow fever virus
RVLETVEKW

SEQ ID NO: 166514 - protein, 9 aa, Yellow fever virus
VLETVEKWL

SEQ ID NO: 166515 - protein, 9 aa, Yellow fever virus
LETVEKWLA

SEQ ID NO: 166516 - protein, 9 aa, Yellow fever virus
ETVEKWLAC

SEQ ID NO: 166517 - protein, 9 aa, Yellow fever virus
IKVLAPYMP

SEQ ID NO: 166518 - protein, 9 aa, Yellow fever virus
LAPYMRDVL

SEQ ID NO: 166519 - protein, 9 aa, Yellow fever virus
APYMRDVLE

SEQ ID NO: 166520 - protein, 9 aa, Yellow fever virus
PYMRDVLEK

SEQ ID NO: 166521 - protein, 9 aa, Yellow fever virus
YMRDVLEKL

SEQ ID NO: 166522 - protein, 9 aa, Yellow fever virus
MRDVLEKLE

SEQ ID NO: 166523 - protein, 9 aa, Yellow fever virus
RDVLEKLEL

SEQ ID NO: 166524 - protein, 9 aa, Yellow fever virus
KVTLEADVT

SEQ ID NO: 166525 - protein, 9 aa, Yellow fever virus
VTLEADVTL

SEQ ID NO: 166526 - protein, 9 aa, Yellow fever virus
TLEPDVILP

SEQ ID NO: 166527 - protein, 9 aa, Yellow fever virus
LEPDVILPI

SEQ ID NO: 166528 - protein, 9 aa, Yellow fever virus
EADVTLPIG

SEQ ID NO: 166529 - protein, 9 aa, Yellow fever virus
PDVILPIGT

SEQ ID NO: 166530 - protein, 9 aa, Yellow fever virus
ETDKGPLNR

SEQ ID NO: 166531 - protein, 9 aa, Yellow fever virus
EAIKERVER

SEQ ID NO: 166532 - protein, 9 aa, Yellow fever virus
KERVERIKS

SEQ ID NO: 166533 - protein, 9 aa, Yellow fever virus
ERVERIKNE

SEQ ID NO: 166534 - protein, 9 aa, Yellow fever virus
RVERIKNEY

SEQ ID NO: 166535 - protein, 9 aa, Yellow fever virus
VERIKNEYA

SEQ ID NO: 166536 - protein, 9 aa, Yellow fever virus
ERIKNEYAT

SEQ ID NO: 166537 - protein, 9 aa, Yellow fever virus
RIKTEYAAT

SEQ ID NO: 166538 - protein, 9 aa, Yellow fever virus
IKTEYAATW

SEQ ID NO: 166539 - protein, 9 aa, Yellow fever virus
KTEYAATWF

SEQ ID NO: 166540 - protein, 9 aa, Yellow fever virus
TEYAATWFH

SEQ ID NO: 166541 - protein, 9 aa, Yellow fever virus
EYAATWFYD

SEQ ID NO: 166542 - protein, 9 aa, Yellow fever virus
YAATWFYDN

SEQ ID NO: 166543 - protein, 9 aa, Yellow fever virus
AATWFHDND

SEQ ID NO: 166544 - protein, 9 aa, Yellow fever virus
ATWFYDNDN

SEQ ID NO: 166545 - protein, 9 aa, Yellow fever virus
TWFHDNDNP

SEQ ID NO: 166546 - protein, 9 aa, Yellow fever virus
SMVNGVIKL

SEQ ID NO: 166547 - protein, 9 aa, Yellow fever virus
MVNGVIKLL

SEQ ID NO: 166548 - protein, 9 aa, Yellow fever virus
VNGVIKLLT

SEQ ID NO: 166549 - protein, 9 aa, Yellow fever virus
NGVIKLLTY

SEQ ID NO: 166550 - protein, 9 aa, Yellow fever virus
GVIKLLTYP

SEQ ID NO: 166551 - protein, 9 aa, Yellow fever virus
VIKLLTYPW

SEQ ID NO: 166552 - protein, 9 aa, Yellow fever virus
IKLLTYPWD

SEQ ID NO: 166553 - protein, 9 aa, Yellow fever virus
KILTYPWDK

SEQ ID NO: 166554 - protein, 9 aa, Yellow fever virus
ILTYPWDKI

SEQ ID NO: 166555 - protein, 9 aa, Yellow fever virus
LTYPWDKIE

SEQ ID NO: 166556 - protein, 9 aa, Yellow fever virus
TYPWDKIEE

SEQ ID NO: 166557 - protein, 9 aa, Yellow fever virus
YPWDKIEEV

SEQ ID NO: 166558 - protein, 9 aa, Yellow fever virus
FRHLAREKK

SEQ ID NO: 166559 - protein, 9 aa, Yellow fever virus
RHLSREKNP

SEQ ID NO: 166560 - protein, 9 aa, Yellow fever virus
HLAREKKPR

SEQ ID NO: 166561 - protein, 9 aa, Yellow fever virus
LAREKKPRL

SEQ ID NO: 166562 - protein, 9 aa, Yellow fever virus
SREKNPRLC

SEQ ID NO: 166563 - protein, 9 aa, Yellow fever virus
REKKPRLCT

SEQ ID NO: 166564 - protein, 9 aa, Yellow fever virus
EKKPRLCTK

SEQ ID NO: 166565 - protein, 9 aa, Yellow fever virus
KKPRLCTKE

SEQ ID NO: 166566 - protein, 9 aa, Yellow fever virus
KPRLCTKEE

SEQ ID NO: 166567 - protein, 9 aa, Yellow fever virus
RSHAAIGAF

SEQ ID NO: 166568 - protein, 9 aa, Yellow fever virus
SHAAIGAFL

SEQ ID NO: 166569 - protein, 9 aa, Yellow fever virus
HAAIGAFLE

SEQ ID NO: 166570 - protein, 9 aa, Yellow fever virus
AAIGAFLEE

SEQ ID NO: 166571 - protein, 9 aa, Yellow fever virus
AIGAFLEEQ

SEQ ID NO: 166572 - protein, 9 aa, Yellow fever virus
IGAFLEEQE

SEQ ID NO: 166573 - protein, 9 aa, Yellow fever virus
GAYLEEQDQ

SEQ ID NO: 166574 - protein, 9 aa, Yellow fever virus
AYLEEQDQW

SEQ ID NO: 166575 - protein, 9 aa, Yellow fever virus
YLEEQDQWK

SEQ ID NO: 166576 - protein, 9 aa, Yellow fever virus
WELVDEERR

SEQ ID NO: 166577 - protein, 9 aa, Yellow fever virus
ELVDEERRL

SEQ ID NO: 166578 - protein, 9 aa, Yellow fever virus
LVDEERRLH

SEQ ID NO: 166579 - protein, 9 aa, Yellow fever virus
VDEERRLHQ

SEQ ID NO: 166580 - protein, 9 aa, Yellow fever virus
DEERRLHQQ

SEQ ID NO: 166581 - protein, 9 aa, Yellow fever virus
EERRLHQQG

SEQ ID NO: 166582 - protein, 9 aa, Yellow fever virus
RLHQQGRCR

SEQ ID NO: 166583 - protein, 9 aa, Yellow fever virus
LGYVIRDLS

SEQ ID NO: 166584 - protein, 9 aa, Yellow fever virus
GYVIRDLSA

SEQ ID NO: 166585 - protein, 9 aa, Yellow fever virus
YVIRDLSAK

SEQ ID NO: 166586 - protein, 9 aa, Yellow fever virus
VIRDLSAKE

SEQ ID NO: 166587 - protein, 9 aa, Yellow fever virus
IRDLSAKEG

SEQ ID NO: 166588 - protein, 9 aa, Yellow fever virus
RDLSAKEGG

SEQ ID NO: 166589 - protein, 9 aa, Yellow fever virus
DLSAKEGGG

SEQ ID NO: 166590 - protein, 9 aa, Yellow fever virus
LSAKEGGGF

SEQ ID NO: 166591 - protein, 9 aa, Yellow fever virus
SAKEGGGFY

SEQ ID NO: 166592 - protein, 9 aa, Yellow fever virus
AKEGGGFYA

SEQ ID NO: 166593 - protein, 9 aa, Yellow fever virus
MDGGGLYAD

SEQ ID NO: 166594 - protein, 9 aa, Yellow fever virus
DGGGLYADD

SEQ ID NO: 166595 - protein, 9 aa, Yellow fever virus
EQEIMSYMS

SEQ ID NO: 166596 - protein, 9 aa, Yellow fever virus
QEIMSYMSP

SEQ ID NO: 166597 - protein, 9 aa, Yellow fever virus
EILNYMSSH

SEQ ID NO: 166598 - protein, 9 aa, Yellow fever virus
IMSYMSPEQ

SEQ ID NO: 166599 - protein, 9 aa, Yellow fever virus
MSYMSPEQR

SEQ ID NO: 166600 - protein, 9 aa, Yellow fever virus
SYMSPEQRK

SEQ ID NO: 166601 - protein, 9 aa, Yellow fever virus
YMSSHHKKL

SEQ ID NO: 166602 - protein, 9 aa, Yellow fever virus
MSPEQRKLA

SEQ ID NO: 166603 - protein, 9 aa, Yellow fever virus
SPEQRKLAW

SEQ ID NO: 166604 - protein, 9 aa, Yellow fever virus
SHHKKLAQA

SEQ ID NO: 166605 - protein, 9 aa, Yellow fever virus
EQRKLAWAI

SEQ ID NO: 166606 - protein, 9 aa, Yellow fever virus
QRKLAWAIM

SEQ ID NO: 166607 - protein, 9 aa, Yellow fever virus
RKLAWAIME

SEQ ID NO: 166608 - protein, 9 aa, Yellow fever virus
KLAWAIMEM

SEQ ID NO: 166609 - protein, 9 aa, Yellow fever virus
LAWAIMEMT

SEQ ID NO: 166610 - protein, 9 aa, Yellow fever virus
AWAIMEMTY

SEQ ID NO: 166611 - protein, 9 aa, Yellow fever virus
WAIMEMTYK

SEQ ID NO: 166612 - protein, 9 aa, Yellow fever virus
RPTPGGKAY

SEQ ID NO: 166613 - protein, 9 aa, Yellow fever virus
PTPGGKAYM

SEQ ID NO: 166614 - protein, 9 aa, Yellow fever virus
TPGGKAYMD

SEQ ID NO: 166615 - protein, 9 aa, Yellow fever virus
MAEAENVIH

SEQ ID NO: 166616 - protein, 9 aa, Yellow fever virus
AEAENVIHH

SEQ ID NO: 166617 - protein, 9 aa, Yellow fever virus
EAEMVIHHH

SEQ ID NO: 166618 - protein, 9 aa, Yellow fever virus
AENVIHHQH

SEQ ID NO: 166619 - protein, 9 aa, Yellow fever virus
ENVIHHQHV

SEQ ID NO: 166620 - protein, 9 aa, Yellow fever virus
MVIHHHHVQ

SEQ ID NO: 166621 - protein, 9 aa, Yellow fever virus
VINHQHVQE

SEQ ID NO: 166622 - protein, 9 aa, Yellow fever virus
INHQHVQEC

SEQ ID NO: 166623 - protein, 9 aa, Yellow fever virus
HHHHVQDCD

SEQ ID NO: 166624 - protein, 9 aa, Yellow fever virus
HHHVQDCDD

SEQ ID NO: 166625 - protein, 9 aa, Yellow fever virus
QHVQECGEN

SEQ ID NO: 166626 - protein, 9 aa, Yellow fever virus
CDDSTLVRL

SEQ ID NO: 166627 - protein, 9 aa, Yellow fever virus
LARLEAWLT

SEQ ID NO: 166628 - protein, 9 aa, Yellow fever virus
ARLEAWLTE

SEQ ID NO: 166629 - protein, 9 aa, Yellow fever virus
RLEAWLIEH

SEQ ID NO: 166630 - protein, 9 aa, Yellow fever virus
LETWLAENG

SEQ ID NO: 166631 - protein, 9 aa, Yellow fever virus
ETWLAENGC

SEQ ID NO: 166632 - protein, 9 aa, Yellow fever virus
AWLAENGCD

SEQ ID NO: 166633 - protein, 9 aa, Yellow fever virus
WLAENGCDR

SEQ ID NO: 166634 - protein, 9 aa, Yellow fever virus
LAENGCDRL

SEQ ID NO: 166635 - protein, 9 aa, Yellow fever virus
RLARMAVSG

SEQ ID NO: 166636 - protein, 9 aa, Yellow fever virus
LARMAVSGD

SEQ ID NO: 166637 - protein, 9 aa, Yellow fever virus
ARMAVSGDD

SEQ ID NO: 166638 - protein, 9 aa, Yellow fever virus
VSGDDCVVK

SEQ ID NO: 166639 - protein, 9 aa, Yellow fever virus
NGDDCVVRP

SEQ ID NO: 166640 - protein, 9 aa, Yellow fever virus
GDDCVVKPV

SEQ ID NO: 166641 - protein, 9 aa, Yellow fever virus
DDCVVKPVD

SEQ ID NO: 166642 - protein, 9 aa, Yellow fever virus
DCVVKPVDD

SEQ ID NO: 166643 - protein, 9 aa, Yellow fever virus
CVVKPVDDR

SEQ ID NO: 166644 - protein, 9 aa, Yellow fever virus
VVKPVDDRF

SEQ ID NO: 166645 - protein, 9 aa, Yellow fever virus
VKPVDDRFG

SEQ ID NO: 166646 - protein, 9 aa, Yellow fever virus
RPIDDRFGM

SEQ ID NO: 166647 - protein, 9 aa, Yellow fever virus
PIDDRFGMA

SEQ ID NO: 166648 - protein, 9 aa, Yellow fever virus
IDDRFGMAL

SEQ ID NO: 166649 - protein, 9 aa, Yellow fever virus
EWQPSKEWT

SEQ ID NO: 166650 - protein, 9 aa, Yellow fever virus
WQPSKEWTD

SEQ ID NO: 166651 - protein, 9 aa, Yellow fever virus
QPSKEWTDW

SEQ ID NO: 166652 - protein, 9 aa, Yellow fever virus
PSKEWTDWE

SEQ ID NO: 166653 - protein, 9 aa, Yellow fever virus
SKEWTDWEN

SEQ ID NO: 166654 - protein, 9 aa, Yellow fever virus
KGWTDWESV

SEQ ID NO: 166655 - protein, 9 aa, Yellow fever virus
GWTDWESVP

SEQ ID NO: 166656 - protein, 9 aa, Yellow fever virus
WTDWESVPF

SEQ ID NO: 166657 - protein, 9 aa, Yellow fever virus
TDWESVPFC

SEQ ID NO: 166658 - protein, 9 aa, Yellow fever virus
ESVPFCSHH

SEQ ID NO: 166659 - protein, 9 aa, Yellow fever virus
NVPFCSHRF

SEQ ID NO: 166660 - protein, 9 aa, Yellow fever virus
CSHHFHELH

SEQ ID NO: 166661 - protein, 9 aa, Yellow fever virus
SHHFHELHL

SEQ ID NO: 166662 - protein, 9 aa, Yellow fever virus
HHFHELHLK

SEQ ID NO: 166663 - protein, 9 aa, Yellow fever virus
HFHELHLKD

SEQ ID NO: 166664 - protein, 9 aa, Yellow fever virus
FHELHLKDG

SEQ ID NO: 166665 - protein, 9 aa, Yellow fever virus
HELHLKDGR

SEQ ID NO: 166666 - protein, 9 aa, Yellow fever virus
ELHLKDGRR

SEQ ID NO: 166667 - protein, 9 aa, Yellow fever virus
LHLKDGRRI

SEQ ID NO: 166668 - protein, 9 aa, Yellow fever virus
VLKDGRKVV

SEQ ID NO: 166669 - protein, 9 aa, Yellow fever virus
LKDGRKIVV

SEQ ID NO: 166670 - protein, 9 aa, Yellow fever virus
KDGRKIVVP

SEQ ID NO: 166671 - protein, 9 aa, Yellow fever virus
DGRKIVVPC

SEQ ID NO: 166672 - protein, 9 aa, Yellow fever virus
GRKIVVPCR

SEQ ID NO: 166673 - protein, 9 aa, Yellow fever virus
RKIVVPCRD

SEQ ID NO: 166674 - protein, 9 aa, Yellow fever virus
KIVVPCRDQ

SEQ ID NO: 166675 - protein, 9 aa, Yellow fever virus
IVVPCRDQD

SEQ ID NO: 166676 - protein, 9 aa, Yellow fever virus
FAVSSAVPM

SEQ ID NO: 166677 - protein, 9 aa, Yellow fever virus
AVSSAVPMA

SEQ ID NO: 166678 - protein, 9 aa, Yellow fever virus
VSSAVPMAW

SEQ ID NO: 166679 - protein, 9 aa, Yellow fever virus
SSAVPMAWV

SEQ ID NO: 166680 - protein, 9 aa, Yellow fever virus
SAVPMAWVP

SEQ ID NO: 166681 - protein, 9 aa, Yellow fever virus
AVPMAWVPS

SEQ ID NO: 166682 - protein, 9 aa, Yellow fever virus
VPMAWVPSG

SEQ ID NO: 166683 - protein, 9 aa, Yellow fever virus
PMAWVPSGR

SEQ ID NO: 166684 - protein, 9 aa, Yellow fever virus
MAWVPSGRT

SEQ ID NO: 166685 - protein, 9 aa, Yellow fever virus
RTTWSVHGR

SEQ ID NO: 166686 - protein, 9 aa, Yellow fever virus
TTWSVHGRG

SEQ ID NO: 166687 - protein, 9 aa, Yellow fever virus
TWSVHGRGE

SEQ ID NO: 166688 - protein, 9 aa, Yellow fever virus
WSVHGRGEW

SEQ ID NO: 166689 - protein, 9 aa, Yellow fever virus
SVHGRGEWM

SEQ ID NO: 166690 - protein, 9 aa, Yellow fever virus
VHGRGEWMT

SEQ ID NO: 166691 - protein, 9 aa, Yellow fever virus
GKGEWMTTQ

SEQ ID NO: 166692 - protein, 9 aa, Yellow fever virus
KGEWMTTQD

SEQ ID NO: 166693 - protein, 9 aa, Yellow fever virus
GEWMTTQDM

SEQ ID NO: 166694 - protein, 9 aa, Yellow fever virus
EWMTTEDRL

SEQ ID NO: 166695 - protein, 9 aa, Yellow fever virus
WMTTEDMLG

SEQ ID NO: 166696 - protein, 9 aa, Yellow fever virus
MTTEDMLGV

SEQ ID NO: 166697 - protein, 9 aa, Yellow fever virus
TTEDMLDVW

SEQ ID NO: 166698 - protein, 9 aa, Yellow fever virus
TEDMLDVWN

SEQ ID NO: 166699 - protein, 9 aa, Yellow fever virus
EDMLDVWNR

SEQ ID NO: 166700 - protein, 9 aa, Yellow fever virus
DMLGVWNRV

SEQ ID NO: 166701 - protein, 9 aa, Yellow fever virus
MLGVWNRVW

SEQ ID NO: 166702 - protein, 9 aa, Yellow fever virus
LGVWNRVWI

SEQ ID NO: 166703 - protein, 9 aa, Yellow fever virus
GVWNRVWIT

SEQ ID NO: 166704 - protein, 9 aa, Yellow fever virus
WVLNNPHMT

SEQ ID NO: 166705 - protein, 9 aa, Yellow fever virus
VLNNPHMTD

SEQ ID NO: 166706 - protein, 9 aa, Yellow fever virus
LNNPHMTDK

SEQ ID NO: 166707 - protein, 9 aa, Yellow fever virus
NNPHMTDKT

SEQ ID NO: 166708 - protein, 9 aa, Yellow fever virus
NPHMKDKTT

SEQ ID NO: 166709 - protein, 9 aa, Yellow fever virus
PHMKDKTTV

SEQ ID NO: 166710 - protein, 9 aa, Yellow fever virus
HMKDKTTVK

SEQ ID NO: 166711 - protein, 9 aa, Yellow fever virus
MQDKTVVKE

SEQ ID NO: 166712 - protein, 9 aa, Yellow fever virus
QDKTVVKEW

SEQ ID NO: 166713 - protein, 9 aa, Yellow fever virus
DKTVVKEWR

SEQ ID NO: 166714 - protein, 9 aa, Yellow fever virus
KTVVKEWRD

SEQ ID NO: 166715 - protein, 9 aa, Yellow fever virus
TVVKEWRDV

SEQ ID NO: 166716 - protein, 9 aa, Yellow fever virus
VVKEWRDVP

SEQ ID NO: 166717 - protein, 9 aa, Yellow fever virus
IKEWRDVPY

SEQ ID NO: 166718 - protein, 9 aa, Yellow fever virus
VIHRIRNLI

SEQ ID NO: 166719 - protein, 9 aa, Yellow fever virus
IHRIRNLIG

SEQ ID NO: 166720 - protein, 9 aa, Yellow fever virus
HRIRNLIGQ

SEQ ID NO: 166721 - protein, 9 aa, Yellow fever virus
RIRNLIGQE

SEQ ID NO: 166722 - protein, 9 aa, Yellow fever virus
IRNLIGQEK

SEQ ID NO: 166723 - protein, 9 aa, Yellow fever virus
RTLIGQEKF

SEQ ID NO: 166724 - protein, 9 aa, Yellow fever virus
TLIGQEKFT

SEQ ID NO: 166725 - protein, 9 aa, Yellow fever virus
LIGQEKFTD

SEQ ID NO: 166726 - protein, 9 aa, Yellow fever virus
IGQEKFTDY

SEQ ID NO: 166727 - protein, 9 aa, Yellow fever virus
LTGKKLTAH

SEQ ID NO: 166728 - protein, 9 aa, Yellow fever virus
TGKKITAQL

SEQ ID NO: 166729 - protein, 9 aa, Yellow fever virus
GKKITAQLK

SEQ ID NO: 166730 - protein, 9 aa, Yellow fever virus
KKITAQLKR

SEQ ID NO: 166731 - protein, 9 aa, Yellow fever virus
KLTAHLKKL

SEQ ID NO: 166732 - protein, 9 aa, Yellow fever virus
ITAQLKRLW

SEQ ID NO: 166733 - protein, 9 aa, Yellow fever virus
TAHLKKLWR

SEQ ID NO: 166734 - protein, 9 aa, Yellow fever virus
AQLKRLWKM

SEQ ID NO: 166735 - protein, 9 aa, Yellow fever virus
HLKKLWRML

SEQ ID NO: 166736 - protein, 9 aa, Yellow fever virus
SRKRRSSEM

SEQ ID NO: 166737 - protein, 9 aa, Yellow fever virus
RKRRSSEMT

SEQ ID NO: 166738 - protein, 9 aa, Yellow fever virus
AVQFLILGM

SEQ ID NO: 166739 - protein, 9 aa, Yellow fever virus
FPLLLLGLL

SEQ ID NO: 166740 - protein, 9 aa, Yellow fever virus
QLLILGMIL

SEQ ID NO: 166741 - protein, 9 aa, Yellow fever virus
LLILGMILM

SEQ ID NO: 166742 - protein, 9 aa, Yellow fever virus
GGGVTLVRK

SEQ ID NO: 166743 - protein, 9 aa, Yellow fever virus
EDLGKTFSL

SEQ ID NO: 166744 - protein, 9 aa, Yellow fever virus
DLGKTFSLG

SEQ ID NO: 166745 - protein, 9 aa, Yellow fever virus
LGKTFSMGT

SEQ ID NO: 166746 - protein, 9 aa, Yellow fever virus
GKTFSLGTG

SEQ ID NO: 166747 - protein, 9 aa, Yellow fever virus
KTFSVGAGN

SEQ ID NO: 166748 - protein, 9 aa, Yellow fever virus
TFSLGTGNC

SEQ ID NO: 166749 - protein, 9 aa, Yellow fever virus
FSMGTGNCT

SEQ ID NO: 166750 - protein, 9 aa, Yellow fever virus
SMGTGNCTT

SEQ ID NO: 166751 - protein, 9 aa, Yellow fever virus
IGTGNCTTN

SEQ ID NO: 166752 - protein, 9 aa, Yellow fever virus
IAYLVGNNK

SEQ ID NO: 166753 - protein, 9 aa, Yellow fever virus
AYLVGNNTT

SEQ ID NO: 166754 - protein, 9 aa, Yellow fever virus
YLVGNNKTQ

SEQ ID NO: 166755 - protein, 9 aa, Yellow fever virus
LVGNNMTQR

SEQ ID NO: 166756 - protein, 9 aa, Yellow fever virus
VGNNMTQRV

SEQ ID NO: 166757 - protein, 9 aa, Yellow fever virus
GNNMTQRVV

SEQ ID NO: 166758 - protein, 9 aa, Yellow fever virus
NNKTQRVVI

SEQ ID NO: 166759 - protein, 9 aa, Yellow fever virus
ETVAIDGPV

SEQ ID NO: 166760 - protein, 9 aa, Yellow fever virus
VAIDGPVEA

SEQ ID NO: 166761 - protein, 9 aa, Yellow fever virus
AIDGPVEAR

SEQ ID NO: 166762 - protein, 9 aa, Yellow fever virus
IDGPVEARK

SEQ ID NO: 166763 - protein, 9 aa, Yellow fever virus
DGPVEARKV

SEQ ID NO: 166764 - protein, 9 aa, Yellow fever virus
GPVEARKVC

SEQ ID NO: 166765 - protein, 9 aa, Yellow fever virus
VEARKVCYN

SEQ ID NO: 166766 - protein, 9 aa, Yellow fever virus
VGAKQEDWK

SEQ ID NO: 166767 - protein, 9 aa, Yellow fever virus
GAKQEDWKT

SEQ ID NO: 166768 - protein, 9 aa, Yellow fever virus
AKQENWKTD

SEQ ID NO: 166769 - protein, 9 aa, Yellow fever virus
KQEDWKTDI

SEQ ID NO: 166770 - protein, 9 aa, Yellow fever virus
QEDWKTDIK

SEQ ID NO: 166771 - protein, 9 aa, Yellow fever virus
EDWKTDIKT

SEQ ID NO: 166772 - protein, 9 aa, Yellow fever virus
DWKTDIKTL

SEQ ID NO: 166773 - protein, 9 aa, Yellow fever virus
WKTDIKTLK

SEQ ID NO: 166774 - protein, 9 aa, Yellow fever virus
KTDIKTLKF

SEQ ID NO: 166775 - protein, 9 aa, Yellow fever virus
VEFTGYGKA

SEQ ID NO: 166776 - protein, 9 aa, Yellow fever virus
TWMVHTLET

SEQ ID NO: 166777 - protein, 9 aa, Yellow fever virus
WMVHTLETL

SEQ ID NO: 166778 - protein, 9 aa, Yellow fever virus
MMHTLETLD

SEQ ID NO: 166779 - protein, 9 aa, Yellow fever virus
MHTLETLDY

SEQ ID NO: 166780 - protein, 9 aa, Yellow fever virus
VPLEVKREV

SEQ ID NO: 166781 - protein, 9 aa, Yellow fever virus
PLEVKREVC

SEQ ID NO: 166782 - protein, 9 aa, Yellow fever virus
LEVKREVCP

SEQ ID NO: 166783 - protein, 9 aa, Yellow fever virus
EVKREVCPG

SEQ ID NO: 166784 - protein, 9 aa, Yellow fever virus
VKREVCPGT

SEQ ID NO: 166785 - protein, 9 aa, Yellow fever virus
KREVCPGTS

SEQ ID NO: 166786 - protein, 9 aa, Yellow fever virus
PCPGTSVVV

SEQ ID NO: 166787 - protein, 9 aa, Yellow fever virus
PGTSVVLDT

SEQ ID NO: 166788 - protein, 9 aa, Yellow fever virus
GTSVVVDTS

SEQ ID NO: 166789 - protein, 9 aa, Yellow fever virus
TSVVVDSNC

SEQ ID NO: 166790 - protein, 9 aa, Yellow fever virus
SVVLDTGCD

SEQ ID NO: 166791 - protein, 9 aa, Yellow fever virus
VVVDSNCDG

SEQ ID NO: 166792 - protein, 9 aa, Yellow fever virus
VVDSNCDGR

SEQ ID NO: 166793 - protein, 9 aa, Yellow fever virus
VDSNCDGRG

SEQ ID NO: 166794 - protein, 9 aa, Yellow fever virus
DTSCDGRGK

SEQ ID NO: 166795 - protein, 9 aa, Yellow fever virus
TSCDGRGKS

SEQ ID NO: 166796 - protein, 9 aa, Yellow fever virus
GCDGRGKST

SEQ ID NO: 166797 - protein, 9 aa, Yellow fever virus
MEIRPRKAH

SEQ ID NO: 166798 - protein, 9 aa, Yellow fever virus
EIRPRKAHE

SEQ ID NO: 166799 - protein, 9 aa, Yellow fever virus
IRPRKAHES

SEQ ID NO: 166800 - protein, 9 aa, Yellow fever virus
RPRKAHESH

SEQ ID NO: 166801 - protein, 9 aa, Yellow fever virus
PMKTSDSHL

SEQ ID NO: 166802 - protein, 9 aa, Yellow fever virus
RKAHESHLV

SEQ ID NO: 166803 - protein, 9 aa, Yellow fever virus
PKQVLVGGV

SEQ ID NO: 166804 - protein, 9 aa, Yellow fever virus
KQVLVGGVV

SEQ ID NO: 166805 - protein, 9 aa, Yellow fever virus
QMLVGGMVL

SEQ ID NO: 166806 - protein, 9 aa, Yellow fever virus
VLVGGVVLL

SEQ ID NO: 166807 - protein, 9 aa, Yellow fever virus
QVTLLDLLE

SEQ ID NO: 166808 - protein, 9 aa, Yellow fever virus
FVVAVGLHF

SEQ ID NO: 166809 - protein, 9 aa, Yellow fever virus
TMAVGLHFH

SEQ ID NO: 166810 - protein, 9 aa, Yellow fever virus
FSIRPGLLM

SEQ ID NO: 166811 - protein, 9 aa, Yellow fever virus
SIRPGLLMG

SEQ ID NO: 166812 - protein, 9 aa, Yellow fever virus
IRPGLLVGF

SEQ ID NO: 166813 - protein, 9 aa, Yellow fever virus
AFGAAMVEI

SEQ ID NO: 166814 - protein, 9 aa, Yellow fever virus
ISSRKASNM

SEQ ID NO: 166815 - protein, 9 aa, Yellow fever virus
SSRKASNAV

SEQ ID NO: 166816 - protein, 9 aa, Yellow fever virus
SRKASNMIL

SEQ ID NO: 166817 - protein, 9 aa, Yellow fever virus
RKASNAILP

SEQ ID NO: 166818 - protein, 9 aa, Yellow fever virus
KASNAILPL

SEQ ID NO: 166819 - protein, 9 aa, Yellow fever virus
ASNAILPLM

SEQ ID NO: 166820 - protein, 9 aa, Yellow fever virus
SNMILPLMA

SEQ ID NO: 166821 - protein, 9 aa, Yellow fever virus
NAILPLMAL

SEQ ID NO: 166822 - protein, 9 aa, Yellow fever virus
MILPLMALM

SEQ ID NO: 166823 - protein, 9 aa, Yellow fever virus
ALLTPVTMH

SEQ ID NO: 166824 - protein, 9 aa, Yellow fever virus
LLTPVTMHE

SEQ ID NO: 166825 - protein, 9 aa, Yellow fever virus
LTPVTMYEV

SEQ ID NO: 166826 - protein, 9 aa, Yellow fever virus
TPVTMHEVR

SEQ ID NO: 166827 - protein, 9 aa, Yellow fever virus
PMTMHEVRM

SEQ ID NO: 166828 - protein, 9 aa, Yellow fever virus
MTMHEVRMA

SEQ ID NO: 166829 - protein, 9 aa, Yellow fever virus
TMYEVRMAT

SEQ ID NO: 166830 - protein, 9 aa, Yellow fever virus
MYEVRMATM

SEQ ID NO: 166831 - protein, 9 aa, Yellow fever virus
HEVRMATML

SEQ ID NO: 166832 - protein, 9 aa, Yellow fever virus
EVRMATMLF

SEQ ID NO: 166833 - protein, 9 aa, Yellow fever virus
VRMATMLFC

SEQ ID NO: 166834 - protein, 9 aa, Yellow fever virus
AAMLFCTVV

SEQ ID NO: 166835 - protein, 9 aa, Yellow fever virus
AMLFCTVVI

SEQ ID NO: 166836 - protein, 9 aa, Yellow fever virus
MLFCTVVIV

SEQ ID NO: 166837 - protein, 9 aa, Yellow fever virus
LFCTVVIVG

SEQ ID NO: 166838 - protein, 9 aa, Yellow fever virus
LCAVVIIGV

SEQ ID NO: 166839 - protein, 9 aa, Yellow fever virus
TVVIIGVLY

SEQ ID NO: 166840 - protein, 9 aa, Yellow fever virus
IVGVLHQNA

SEQ ID NO: 166841 - protein, 9 aa, Yellow fever virus
VGVLHQNSK

SEQ ID NO: 166842 - protein, 9 aa, Yellow fever virus
GVLHQNAKD

SEQ ID NO: 166843 - protein, 9 aa, Yellow fever virus
VLHQNAKDT

SEQ ID NO: 166844 - protein, 9 aa, Yellow fever virus
LHQNAKDTS

SEQ ID NO: 166845 - protein, 9 aa, Yellow fever virus
YQNSKDTSM

SEQ ID NO: 166846 - protein, 9 aa, Yellow fever virus
ELKKLGEVA

SEQ ID NO: 166847 - protein, 9 aa, Yellow fever virus
LKKLGEVAW

SEQ ID NO: 166848 - protein, 9 aa, Yellow fever virus
KKLGEVAWE

SEQ ID NO: 166849 - protein, 9 aa, Yellow fever virus
LGGWILHIK

SEQ ID NO: 166850 - protein, 9 aa, Yellow fever virus
GGWVLHIKG

SEQ ID NO: 166851 - protein, 9 aa, Yellow fever virus
GWVLHIKGA

SEQ ID NO: 166852 - protein, 9 aa, Yellow fever virus
WLFHVRRAR

SEQ ID NO: 166853 - protein, 9 aa, Yellow fever virus
LFHVRRARR

SEQ ID NO: 166854 - protein, 9 aa, Yellow fever virus
FHVRRARRS

SEQ ID NO: 166855 - protein, 9 aa, Yellow fever virus
HVRRARRSG

SEQ ID NO: 166856 - protein, 9 aa, Yellow fever virus
VRRARRSGD

SEQ ID NO: 166857 - protein, 9 aa, Yellow fever virus
LIAAVPGKS

SEQ ID NO: 166858 - protein, 9 aa, Yellow fever virus
IAAVPGKSV

SEQ ID NO: 166859 - protein, 9 aa, Yellow fever virus
AAAPGKNVV

SEQ ID NO: 166860 - protein, 9 aa, Yellow fever virus
AVPGKSVVN

SEQ ID NO: 166861 - protein, 9 aa, Yellow fever virus
APGKNVVNV

SEQ ID NO: 166862 - protein, 9 aa, Yellow fever virus
GKEELQEIS

SEQ ID NO: 166863 - protein, 9 aa, Yellow fever virus
KGMTTILDY

SEQ ID NO: 166864 - protein, 9 aa, Yellow fever virus
GMTTILDYH

SEQ ID NO: 166865 - protein, 9 aa, Yellow fever virus
MTTILDYHP

SEQ ID NO: 166866 - protein, 9 aa, Yellow fever virus
NCDQPVWLS

SEQ ID NO: 166867 - protein, 9 aa, Yellow fever virus
DEHEILNDS

SEQ ID NO: 166868 - protein, 9 aa, Yellow fever virus
CRSPGGAKR

SEQ ID NO: 166869 - protein, 9 aa, Yellow fever virus
RAPGGAKRP

SEQ ID NO: 166870 - protein, 9 aa, Yellow fever virus
TPGGAKKPL

SEQ ID NO: 166871 - protein, 9 aa, Yellow fever virus
PGGAKRPLR

SEQ ID NO: 166872 - protein, 9 aa, Yellow fever virus
GGAKRPLRP

SEQ ID NO: 166873 - protein, 9 aa, Yellow fever virus
GAKRALRPR

SEQ ID NO: 166874 - protein, 9 aa, Yellow fever virus
AKRPLRPRW

SEQ ID NO: 166875 - protein, 9 aa, Yellow fever virus
KRPLRPRWC

SEQ ID NO: 166876 - protein, 9 aa, Yellow fever virus
RPLRPRWCD

SEQ ID NO: 166877 - protein, 9 aa, Yellow fever virus
EGRRGAAEI

SEQ ID NO: 166878 - protein, 9 aa, Yellow fever virus
GRRGAAEIL

SEQ ID NO: 166879 - protein, 9 aa, Yellow fever virus
RRGAAEILV

SEQ ID NO: 166880 - protein, 9 aa, Yellow fever virus
RGAAEMLVI

SEQ ID NO: 166881 - protein, 9 aa, Yellow fever virus
GAAEMLVIL

SEQ ID NO: 166882 - protein, 9 aa, Yellow fever virus
AADVLVVLS

SEQ ID NO: 166883 - protein, 9 aa, Yellow fever virus
AEMLVILTE

SEQ ID NO: 166884 - protein, 9 aa, Yellow fever virus
DVLVVLSEL

SEQ ID NO: 166885 - protein, 9 aa, Yellow fever virus
ILVVLSELP

SEQ ID NO: 166886 - protein, 9 aa, Yellow fever virus
AKPTHISYI

SEQ ID NO: 166887 - protein, 9 aa, Yellow fever virus
IGILTLLSI

SEQ ID NO: 166888 - protein, 9 aa, Yellow fever virus
GILTLLSIV

SEQ ID NO: 166889 - protein, 9 aa, Yellow fever virus
ILTLLSIVA

SEQ ID NO: 166890 - protein, 9 aa, Yellow fever virus
LTLLSIVAA

SEQ ID NO: 166891 - protein, 9 aa, Yellow fever virus
TLLSIVAAN

SEQ ID NO: 166892 - protein, 9 aa, Yellow fever virus
LLSIVAANE

SEQ ID NO: 166893 - protein, 9 aa, Yellow fever virus
LSIVAANEL

SEQ ID NO: 166894 - protein, 9 aa, Yellow fever virus
RTKEDLFGK

SEQ ID NO: 166895 - protein, 9 aa, Yellow fever virus
KEDFFGKRN

SEQ ID NO: 166896 - protein, 9 aa, Yellow fever virus
ISSSASPWS

SEQ ID NO: 166897 - protein, 9 aa, Yellow fever virus
SSSASPWSW

SEQ ID NO: 166898 - protein, 9 aa, Yellow fever virus
SGAIPWSWP

SEQ ID NO: 166899 - protein, 9 aa, Yellow fever virus
GASPWSWPD

SEQ ID NO: 166900 - protein, 9 aa, Yellow fever virus
NISVIMLLI

SEQ ID NO: 166901 - protein, 9 aa, Yellow fever virus
ISVIMLLIS

SEQ ID NO: 166902 - protein, 9 aa, Yellow fever virus
SVIMLLISG

SEQ ID NO: 166903 - protein, 9 aa, Yellow fever virus
VIMLLISGW

SEQ ID NO: 166904 - protein, 9 aa, Yellow fever virus
IMLLISGWN

SEQ ID NO: 166905 - protein, 9 aa, Yellow fever virus
LLCGIGGAM

SEQ ID NO: 166906 - protein, 9 aa, Yellow fever virus
LCGIGGAML

SEQ ID NO: 166907 - protein, 9 aa, Yellow fever virus
CGIGGAMLH

SEQ ID NO: 166908 - protein, 9 aa, Yellow fever virus
GIGCATLHW

SEQ ID NO: 166909 - protein, 9 aa, Yellow fever virus
IGCATLHWS

SEQ ID NO: 166910 - protein, 9 aa, Yellow fever virus
GCAMLHWTL

SEQ ID NO: 166911 - protein, 9 aa, Yellow fever virus
CAMLHWTLI

SEQ ID NO: 166912 - protein, 9 aa, Yellow fever virus
YNLWKMKTE

SEQ ID NO: 166913 - protein, 9 aa, Yellow fever virus
NLWKMKTER

SEQ ID NO: 166914 - protein, 9 aa, Yellow fever virus
LWKMKTARR

SEQ ID NO: 166915 - protein, 9 aa, Yellow fever virus
WKMKTERRG

SEQ ID NO: 166916 - protein, 9 aa, Yellow fever virus
RRGTANGKT

SEQ ID NO: 166917 - protein, 9 aa, Yellow fever virus
RGTANGKTL

SEQ ID NO: 166918 - protein, 9 aa, Yellow fever virus
GSASGKTLG

SEQ ID NO: 166919 - protein, 9 aa, Yellow fever virus
TANGKTLGE

SEQ ID NO: 166920 - protein, 9 aa, Yellow fever virus
LLDKQQFEM

SEQ ID NO: 166921 - protein, 9 aa, Yellow fever virus
LDRQQFELY

SEQ ID NO: 166922 - protein, 9 aa, Yellow fever virus
DRQQFELYK

SEQ ID NO: 166923 - protein, 9 aa, Yellow fever virus
KQQFEMYKR

SEQ ID NO: 166924 - protein, 9 aa, Yellow fever virus
VTFKDKTDV

SEQ ID NO: 166925 - protein, 9 aa, Yellow fever virus
FKDKTDVHR

SEQ ID NO: 166926 - protein, 9 aa, Yellow fever virus
KDKTDVHRL

SEQ ID NO: 166927 - protein, 9 aa, Yellow fever virus
DKTDIHHLE

SEQ ID NO: 166928 - protein, 9 aa, Yellow fever virus
KTDIHRLES

SEQ ID NO: 166929 - protein, 9 aa, Yellow fever virus
LEPLKCETL

SEQ ID NO: 166930 - protein, 9 aa, Yellow fever virus
EPLKCETLL

SEQ ID NO: 166931 - protein, 9 aa, Yellow fever virus
PLKCETLLC

SEQ ID NO: 166932 - protein, 9 aa, Yellow fever virus
LKCETLLCD

SEQ ID NO: 166933 - protein, 9 aa, Yellow fever virus
IGESSSSSI

SEQ ID NO: 166934 - protein, 9 aa, Yellow fever virus
GESSPSSAT

SEQ ID NO: 166935 - protein, 9 aa, Yellow fever virus
ESSSSSITE

SEQ ID NO: 166936 - protein, 9 aa, Yellow fever virus
SSSSSITEG

SEQ ID NO: 166937 - protein, 9 aa, Yellow fever virus
SSSSITEGE

SEQ ID NO: 166938 - protein, 9 aa, Yellow fever virus
SSSITEGER

SEQ ID NO: 166939 - protein, 9 aa, Yellow fever virus
SATEGERTL

SEQ ID NO: 166940 - protein, 9 aa, Yellow fever virus
ITEGERTVR

SEQ ID NO: 166941 - protein, 9 aa, Yellow fever virus
GERTLRVLD

SEQ ID NO: 166942 - protein, 9 aa, Yellow fever virus
ERTLRVLDT

SEQ ID NO: 166943 - protein, 9 aa, Yellow fever virus
RTLRVLETI

SEQ ID NO: 166944 - protein, 9 aa, Yellow fever virus
TLRVLETIE

SEQ ID NO: 166945 - protein, 9 aa, Yellow fever virus
LRVLETVEK

SEQ ID NO: 166946 - protein, 9 aa, Yellow fever virus
GAIEERVER

SEQ ID NO: 166947 - protein, 9 aa, Yellow fever virus
EERVERIKN

SEQ ID NO: 166948 - protein, 9 aa, Yellow fever virus
RIKNEYATT

SEQ ID NO: 166949 - protein, 9 aa, Yellow fever virus
IKNEYATTW

SEQ ID NO: 166950 - protein, 9 aa, Yellow fever virus
KNEYATTWF

SEQ ID NO: 166951 - protein, 9 aa, Yellow fever virus
TEYAATWFY

SEQ ID NO: 166952 - protein, 9 aa, Yellow fever virus
EYATTWFYD

SEQ ID NO: 166953 - protein, 9 aa, Yellow fever virus
YATTWFYDN

SEQ ID NO: 166954 - protein, 9 aa, Yellow fever virus
AATWFYDND

SEQ ID NO: 166955 - protein, 9 aa, Yellow fever virus
ATWFHDNDN

SEQ ID NO: 166956 - protein, 9 aa, Yellow fever virus
KLLTYPWDK

SEQ ID NO: 166957 - protein, 9 aa, Yellow fever virus
LLTYPWDKI

SEQ ID NO: 166958 - protein, 9 aa, Yellow fever virus
FRHLSREKN

SEQ ID NO: 166959 - protein, 9 aa, Yellow fever virus
RHLAREKKP

SEQ ID NO: 166960 - protein, 9 aa, Yellow fever virus
HLSREKNPR

SEQ ID NO: 166961 - protein, 9 aa, Yellow fever virus
LSREKNPRL

SEQ ID NO: 166962 - protein, 9 aa, Yellow fever virus
AREKKPRLC

SEQ ID NO: 166963 - protein, 9 aa, Yellow fever virus
IGAYLEEQD

SEQ ID NO: 166964 - protein, 9 aa, Yellow fever virus
LAAMDGGGL

SEQ ID NO: 166965 - protein, 9 aa, Yellow fever virus
AAMDGGGLY

SEQ ID NO: 166966 - protein, 9 aa, Yellow fever virus
AMDGGGLYA

SEQ ID NO: 166967 - protein, 9 aa, Yellow fever virus
QEILNYMSS

SEQ ID NO: 166968 - protein, 9 aa, Yellow fever virus
EIMSYMSPE

SEQ ID NO: 166969 - protein, 9 aa, Yellow fever virus
ILNYMSSHH

SEQ ID NO: 166970 - protein, 9 aa, Yellow fever virus
LNYMSSHHK

SEQ ID NO: 166971 - protein, 9 aa, Yellow fever virus
NYMSSHHKK

SEQ ID NO: 166972 - protein, 9 aa, Yellow fever virus
YMSPEQRKL

SEQ ID NO: 166973 - protein, 9 aa, Yellow fever virus
MSSHHKKLA

SEQ ID NO: 166974 - protein, 9 aa, Yellow fever virus
SSHHKKLAQ

SEQ ID NO: 166975 - protein, 9 aa, Yellow fever virus
PEQRKLAWA

SEQ ID NO: 166976 - protein, 9 aa, Yellow fever virus
EAENVIHHQ

SEQ ID NO: 166977 - protein, 9 aa, Yellow fever virus
AEMVIHHHH

SEQ ID NO: 166978 - protein, 9 aa, Yellow fever virus
EMVIHHHHV

SEQ ID NO: 166979 - protein, 9 aa, Yellow fever virus
MVINHQHVQ

SEQ ID NO: 166980 - protein, 9 aa, Yellow fever virus
VIHHHHVQD

SEQ ID NO: 166981 - protein, 9 aa, Yellow fever virus
IHHHHVQDC

SEQ ID NO: 166982 - protein, 9 aa, Yellow fever virus
NHQHVQECG

SEQ ID NO: 166983 - protein, 9 aa, Yellow fever virus
HQHVQECGE

SEQ ID NO: 166984 - protein, 9 aa, Yellow fever virus
QHVNECDEG

SEQ ID NO: 166985 - protein, 9 aa, Yellow fever virus
CGENVLERL

SEQ ID NO: 166986 - protein, 9 aa, Yellow fever virus
LERLETWLA

SEQ ID NO: 166987 - protein, 9 aa, Yellow fever virus
VRLEAWLIE

SEQ ID NO: 166988 - protein, 9 aa, Yellow fever virus
RLETWLAEN

SEQ ID NO: 166989 - protein, 9 aa, Yellow fever virus
LEAWLIEHG

SEQ ID NO: 166990 - protein, 9 aa, Yellow fever virus
EAWLIEHGC

SEQ ID NO: 166991 - protein, 9 aa, Yellow fever virus
AWLIEHGCD

SEQ ID NO: 166992 - protein, 9 aa, Yellow fever virus
WLIEHGCDR

SEQ ID NO: 166993 - protein, 9 aa, Yellow fever virus
LIEHGCDRL

SEQ ID NO: 166994 - protein, 9 aa, Yellow fever virus
RLSRMAVSG

SEQ ID NO: 166995 - protein, 9 aa, Yellow fever virus
LSRMAVSGD

SEQ ID NO: 166996 - protein, 9 aa, Yellow fever virus
SRMAVSGDD

SEQ ID NO: 166997 - protein, 9 aa, Yellow fever virus
KPVDDRFGL

SEQ ID NO: 166998 - protein, 9 aa, Yellow fever virus
SKGWTDWES

SEQ ID NO: 166999 - protein, 9 aa, Yellow fever virus
KGWTDWENV

SEQ ID NO: 167000 - protein, 9 aa, Yellow fever virus
GWTDWENVP

SEQ ID NO: 167001 - protein, 9 aa, Yellow fever virus
CSHRFHELQ

SEQ ID NO: 167002 - protein, 9 aa, Yellow fever virus
SHRFHELQL

SEQ ID NO: 167003 - protein, 9 aa, Yellow fever virus
HRFHELQLK

SEQ ID NO: 167004 - protein, 9 aa, Yellow fever virus
RFHELQLKD

SEQ ID NO: 167005 - protein, 9 aa, Yellow fever virus
LVLKDGRKI

SEQ ID NO: 167006 - protein, 9 aa, Yellow fever virus
VLKDGRKIV

SEQ ID NO: 167007 - protein, 9 aa, Yellow fever virus
WMTTQDMLD

SEQ ID NO: 167008 - protein, 9 aa, Yellow fever virus
MTTQDMLDV

SEQ ID NO: 167009 - protein, 9 aa, Yellow fever virus
TTEDRLEVW

SEQ ID NO: 167010 - protein, 9 aa, Yellow fever virus
TQDMLDVWN

SEQ ID NO: 167011 - protein, 9 aa, Yellow fever virus
EDRLEVWNR

SEQ ID NO: 167012 - protein, 9 aa, Yellow fever virus
DRLEVWNRV

SEQ ID NO: 167013 - protein, 9 aa, Yellow fever virus
RLEVWNRVW

SEQ ID NO: 167014 - protein, 9 aa, Yellow fever virus
NPHMTDKTT

SEQ ID NO: 167015 - protein, 9 aa, Yellow fever virus
PHMTDKTTI

SEQ ID NO: 167016 - protein, 9 aa, Yellow fever virus
HMTDKTTIK

SEQ ID NO: 167017 - protein, 9 aa, Yellow fever virus
MKDKTTVKE

SEQ ID NO: 167018 - protein, 9 aa, Yellow fever virus
KDKTTVKEW

SEQ ID NO: 167019 - protein, 9 aa, Yellow fever virus
DKTTVKEWR

SEQ ID NO: 167020 - protein, 9 aa, Yellow fever virus
KTTVKEWRD

SEQ ID NO: 167021 - protein, 9 aa, Yellow fever virus
TTVKEWRDV

SEQ ID NO: 167022 - protein, 9 aa, Yellow fever virus
TVKEWRDVP

SEQ ID NO: 167023 - protein, 9 aa, Yellow fever virus
RNLIGQEKY

SEQ ID NO: 167024 - protein, 9 aa, Yellow fever virus
NLIGQEKYT

SEQ ID NO: 167025 - protein, 9 aa, Yellow fever virus
TVQLLILGM

SEQ ID NO: 167026 - protein, 9 aa, Yellow fever virus
TGGVTLMRK

SEQ ID NO: 167027 - protein, 9 aa, Yellow fever virus
LGKTFSIGT

SEQ ID NO: 167028 - protein, 9 aa, Yellow fever virus
GKTFSVGAG

SEQ ID NO: 167029 - protein, 9 aa, Yellow fever virus
KTFSIGTGN

SEQ ID NO: 167030 - protein, 9 aa, Yellow fever virus
TFSMGTGNC

SEQ ID NO: 167031 - protein, 9 aa, Yellow fever virus
FSVGAGNCT

SEQ ID NO: 167032 - protein, 9 aa, Yellow fever virus
SIGTGNCTT

SEQ ID NO: 167033 - protein, 9 aa, Yellow fever virus
MGTGNCTTN

SEQ ID NO: 167034 - protein, 9 aa, Yellow fever virus
AKQEDWKTD

SEQ ID NO: 167035 - protein, 9 aa, Yellow fever virus
KQENWKTDI

SEQ ID NO: 167036 - protein, 9 aa, Yellow fever virus
QENWKTDIK

SEQ ID NO: 167037 - protein, 9 aa, Yellow fever virus
ENWKTDIKT

SEQ ID NO: 167038 - protein, 9 aa, Yellow fever virus
NWKTDIKTL

SEQ ID NO: 167039 - protein, 9 aa, Yellow fever virus
FTVAVGLHF

SEQ ID NO: 167040 - protein, 9 aa, Yellow fever virus
ISSRKASNA

SEQ ID NO: 167041 - protein, 9 aa, Yellow fever virus
SSRKASNTI

SEQ ID NO: 167042 - protein, 9 aa, Yellow fever virus
YEVRMATML

SEQ ID NO: 167043 - protein, 9 aa, Yellow fever virus
EVRLATMLL

SEQ ID NO: 167044 - protein, 9 aa, Yellow fever virus
VRLATMLLC

SEQ ID NO: 167045 - protein, 9 aa, Yellow fever virus
ATMLLCAVV

SEQ ID NO: 167046 - protein, 9 aa, Yellow fever virus
TMLLCAVVI

SEQ ID NO: 167047 - protein, 9 aa, Yellow fever virus
MLLCAVVII

SEQ ID NO: 167048 - protein, 9 aa, Yellow fever virus
LLCAVVIIG

SEQ ID NO: 167049 - protein, 9 aa, Yellow fever virus
IIGVLYQNS

SEQ ID NO: 167050 - protein, 9 aa, Yellow fever virus
VGVLHQNAK

SEQ ID NO: 167051 - protein, 9 aa, Yellow fever virus
GGWILHIKG

SEQ ID NO: 167052 - protein, 9 aa, Yellow fever virus
GWILHIKGA

SEQ ID NO: 167053 - protein, 9 aa, Yellow fever virus
WILHIKGAR

SEQ ID NO: 167054 - protein, 9 aa, Yellow fever virus
ILHIKGARR

SEQ ID NO: 167055 - protein, 9 aa, Yellow fever virus
CRTPGGAKK

SEQ ID NO: 167056 - protein, 9 aa, Yellow fever virus
RSPGGAKRA

SEQ ID NO: 167057 - protein, 9 aa, Yellow fever virus
SPGGAKRAL

SEQ ID NO: 167058 - protein, 9 aa, Yellow fever virus
RGAADVLVV

SEQ ID NO: 167059 - protein, 9 aa, Yellow fever virus
GAADVLVVL

SEQ ID NO: 167060 - protein, 9 aa, Yellow fever virus
AAEILVVLS

SEQ ID NO: 167061 - protein, 9 aa, Yellow fever virus
ADVLVVLSE

SEQ ID NO: 167062 - protein, 9 aa, Yellow fever virus
EMLVILTEL

SEQ ID NO: 167063 - protein, 9 aa, Yellow fever virus
KEDFFGKRD

SEQ ID NO: 167064 - protein, 9 aa, Yellow fever virus
IPSGASPWS

SEQ ID NO: 167065 - protein, 9 aa, Yellow fever virus
PSGASPWSW

SEQ ID NO: 167066 - protein, 9 aa, Yellow fever virus
IGCAMLHWT

SEQ ID NO: 167067 - protein, 9 aa, Yellow fever virus
KTDIHHLEP

SEQ ID NO: 167068 - protein, 9 aa, Yellow fever virus
LEPMKCDTL

SEQ ID NO: 167069 - protein, 9 aa, Yellow fever virus
ESVKCDTLL

SEQ ID NO: 167070 - protein, 9 aa, Yellow fever virus
PMKCDTLLC

SEQ ID NO: 167071 - protein, 9 aa, Yellow fever virus
SITEGERTV

SEQ ID NO: 167072 - protein, 9 aa, Yellow fever virus
ATEGERTLR

SEQ ID NO: 167073 - protein, 9 aa, Yellow fever virus
RTLRVLETV

SEQ ID NO: 167074 - protein, 9 aa, Yellow fever virus
TLRVLDTVE

SEQ ID NO: 167075 - protein, 9 aa, Yellow fever virus
LRVLETIEK

SEQ ID NO: 167076 - protein, 9 aa, Yellow fever virus
NEYATTWFY

SEQ ID NO: 167077 - protein, 9 aa, Yellow fever virus
EYAATWFHD

SEQ ID NO: 167078 - protein, 9 aa, Yellow fever virus
YAATWFHDN

SEQ ID NO: 167079 - protein, 9 aa, Yellow fever virus
ATTWFYDND

SEQ ID NO: 167080 - protein, 9 aa, Yellow fever virus
NVIHHQHVQ

SEQ ID NO: 167081 - protein, 9 aa, Yellow fever virus
HHVQDCDDS

SEQ ID NO: 167082 - protein, 9 aa, Yellow fever virus
CDEGVLARL

SEQ ID NO: 167083 - protein, 9 aa, Yellow fever virus
LVRLEAWLI

SEQ ID NO: 167084 - protein, 9 aa, Yellow fever virus
ERLETWLAE

SEQ ID NO: 167085 - protein, 9 aa, Yellow fever virus
TWLAENGCD

SEQ ID NO: 167086 - protein, 9 aa, Yellow fever virus
RLNRMAVNG

SEQ ID NO: 167087 - protein, 9 aa, Yellow fever virus
LNRMAVNGD

SEQ ID NO: 167088 - protein, 9 aa, Yellow fever virus
NRMAVNGDD

SEQ ID NO: 167089 - protein, 9 aa, Yellow fever virus
WMTTEDRLE

SEQ ID NO: 167090 - protein, 9 aa, Yellow fever virus
MTTEDRLEV

SEQ ID NO: 167091 - protein, 9 aa, Yellow fever virus
TTQDMLDVW

SEQ ID NO: 167092 - protein, 9 aa, Yellow fever virus
TEDRLEVWN

SEQ ID NO: 167093 - protein, 9 aa, Yellow fever virus
QDMLDVWNR

SEQ ID NO: 167094 - protein, 9 aa, Yellow fever virus
MTDKTTIKE

SEQ ID NO: 167095 - protein, 9 aa, Yellow fever virus
TDKTTIKEW

SEQ ID NO: 167096 - protein, 9 aa, Yellow fever virus
DKTTIKEWR

SEQ ID NO: 167097 - protein, 9 aa, Yellow fever virus
KTTIKEWRD

SEQ ID NO: 167098 - protein, 9 aa, Yellow fever virus
TTIKEWRDV

SEQ ID NO: 167099 - protein, 9 aa, Yellow fever virus
TIKEWRDVP

SEQ ID NO: 167100 - protein, 10 aa, Yellow fever virus
MSGRKAQGKT

SEQ ID NO: 167101 - protein, 10 aa, Yellow fever virus
SGRKAQGKTL

SEQ ID NO: 167102 - protein, 10 aa, Yellow fever virus
GRKAQGKTLG

SEQ ID NO: 167103 - protein, 10 aa, Yellow fever virus
RKAQGKTLGV

SEQ ID NO: 167104 - protein, 10 aa, Yellow fever virus
KAQGKTLGVN

SEQ ID NO: 167105 - protein, 10 aa, Yellow fever virus
AQGKTLGVNM

SEQ ID NO: 167106 - protein, 10 aa, Yellow fever virus
QGKTLGVNMV

SEQ ID NO: 167107 - protein, 10 aa, Yellow fever virus
GKTLGVNMVR

SEQ ID NO: 167108 - protein, 10 aa, Yellow fever virus
KTLGVNMVRR

SEQ ID NO: 167109 - protein, 10 aa, Yellow fever virus
TLGVNMVRRG

SEQ ID NO: 167110 - protein, 10 aa, Yellow fever virus
LGVNMVRRGV

SEQ ID NO: 167111 - protein, 10 aa, Yellow fever virus
GVNMVRRGVR

SEQ ID NO: 167112 - protein, 10 aa, Yellow fever virus
VNMVRRGVRS

SEQ ID NO: 167113 - protein, 10 aa, Yellow fever virus
NMVRRGVRSL

SEQ ID NO: 167114 - protein, 10 aa, Yellow fever virus
MVRRGVRSLS

SEQ ID NO: 167115 - protein, 10 aa, Yellow fever virus
VRRGVRSLSN

SEQ ID NO: 167116 - protein, 10 aa, Yellow fever virus
RRGVRSLSNK

SEQ ID NO: 167117 - protein, 10 aa, Yellow fever virus
RGVRSLSNKI

SEQ ID NO: 167118 - protein, 10 aa, Yellow fever virus
GVRSLSNKIK

SEQ ID NO: 167119 - protein, 10 aa, Yellow fever virus
VRSLSNKIKQ

SEQ ID NO: 167120 - protein, 10 aa, Yellow fever virus
RSLSNKIKQK

SEQ ID NO: 167121 - protein, 10 aa, Yellow fever virus
SLSNKIKQKT

SEQ ID NO: 167122 - protein, 10 aa, Yellow fever virus
LSNKIKQKTK

SEQ ID NO: 167123 - protein, 10 aa, Yellow fever virus
SNKIKQKTKQ

SEQ ID NO: 167124 - protein, 10 aa, Yellow fever virus
NKIKQKTKQI

SEQ ID NO: 167125 - protein, 10 aa, Yellow fever virus
KIKQKTKQIG

SEQ ID NO: 167126 - protein, 10 aa, Yellow fever virus
IKQKTKQIGN

SEQ ID NO: 167127 - protein, 10 aa, Yellow fever virus
KQKTKQIGNR

SEQ ID NO: 167128 - protein, 10 aa, Yellow fever virus
QKTKQIGNRP

SEQ ID NO: 167129 - protein, 10 aa, Yellow fever virus
KTKQIGNRPG

SEQ ID NO: 167130 - protein, 10 aa, Yellow fever virus
TKQIGNRPGP

SEQ ID NO: 167131 - protein, 10 aa, Yellow fever virus
KQIGNRPGPS

SEQ ID NO: 167132 - protein, 10 aa, Yellow fever virus
QIGNRPGPSR

SEQ ID NO: 167133 - protein, 10 aa, Yellow fever virus
IGNRPGPSRG

SEQ ID NO: 167134 - protein, 10 aa, Yellow fever virus
GNRPGPSRGV

SEQ ID NO: 167135 - protein, 10 aa, Yellow fever virus
NRPGPSRGVQ

SEQ ID NO: 167136 - protein, 10 aa, Yellow fever virus
RPGPSRGVQG

SEQ ID NO: 167137 - protein, 10 aa, Yellow fever virus
PGPSRGVQGF

SEQ ID NO: 167138 - protein, 10 aa, Yellow fever virus
GPSRGVQGFI

SEQ ID NO: 167139 - protein, 10 aa, Yellow fever virus
PSRGVQGFIF

SEQ ID NO: 167140 - protein, 10 aa, Yellow fever virus
SRGVQGFIFF

SEQ ID NO: 167141 - protein, 10 aa, Yellow fever virus
RGVQGFIFFF

SEQ ID NO: 167142 - protein, 10 aa, Yellow fever virus
GVQGFIFFFL

SEQ ID NO: 167143 - protein, 10 aa, Yellow fever virus
VQGFIFFFLF

SEQ ID NO: 167144 - protein, 10 aa, Yellow fever virus
QGFIFFFLFN

SEQ ID NO: 167145 - protein, 10 aa, Yellow fever virus
GFIFFFLFNI

SEQ ID NO: 167146 - protein, 10 aa, Yellow fever virus
FIFFFLFNIL

SEQ ID NO: 167147 - protein, 10 aa, Yellow fever virus
IFFFLFNILT

SEQ ID NO: 167148 - protein, 10 aa, Yellow fever virus
FFFLFNILTG

SEQ ID NO: 167149 - protein, 10 aa, Yellow fever virus
FFLFNILTGK

SEQ ID NO: 167150 - protein, 10 aa, Yellow fever virus
FLFNILTGKK

SEQ ID NO: 167151 - protein, 10 aa, Yellow fever virus
LFNILTGKKI

SEQ ID NO: 167152 - protein, 10 aa, Yellow fever virus
FNILTGKKIT

SEQ ID NO: 167153 - protein, 10 aa, Yellow fever virus
NILTGKKITA

SEQ ID NO: 167154 - protein, 10 aa, Yellow fever virus
ILTGKKITAH

SEQ ID NO: 167155 - protein, 10 aa, Yellow fever virus
LTGKKITAHL

SEQ ID NO: 167156 - protein, 10 aa, Yellow fever virus
TGKKITAHLK

SEQ ID NO: 167157 - protein, 10 aa, Yellow fever virus
GKKITAHLKR

SEQ ID NO: 167158 - protein, 10 aa, Yellow fever virus
KKITAHLKRL

SEQ ID NO: 167159 - protein, 10 aa, Yellow fever virus
KITAHLKRLW

SEQ ID NO: 167160 - protein, 10 aa, Yellow fever virus
ITAHLKRLWK

SEQ ID NO: 167161 - protein, 10 aa, Yellow fever virus
TAHLKRLWKM

SEQ ID NO: 167162 - protein, 10 aa, Yellow fever virus
AHLKRLWKML

SEQ ID NO: 167163 - protein, 10 aa, Yellow fever virus
HLKRLWKMLD

SEQ ID NO: 167164 - protein, 10 aa, Yellow fever virus
LKRLWKMLDP

SEQ ID NO: 167165 - protein, 10 aa, Yellow fever virus
KRLWKMLDPR

SEQ ID NO: 167166 - protein, 10 aa, Yellow fever virus
RLWKMLDPRQ

SEQ ID NO: 167167 - protein, 10 aa, Yellow fever virus
LWKMLDPRQG

SEQ ID NO: 167168 - protein, 10 aa, Yellow fever virus
WKMLDPRQGL

SEQ ID NO: 167169 - protein, 10 aa, Yellow fever virus
KMLDPRQGLA

SEQ ID NO: 167170 - protein, 10 aa, Yellow fever virus
MLDPRQGLAV

SEQ ID NO: 167171 - protein, 10 aa, Yellow fever virus
LDPRQGLAVL

SEQ ID NO: 167172 - protein, 10 aa, Yellow fever virus
DPRQGLAVLR

SEQ ID NO: 167173 - protein, 10 aa, Yellow fever virus
PRQGLAVLRK

SEQ ID NO: 167174 - protein, 10 aa, Yellow fever virus
RQGLAVLRKV

SEQ ID NO: 167175 - protein, 10 aa, Yellow fever virus
QGLAVLRKVK

SEQ ID NO: 167176 - protein, 10 aa, Yellow fever virus
GLAVLRKVKR

SEQ ID NO: 167177 - protein, 10 aa, Yellow fever virus
LAVLRKVKRV

SEQ ID NO: 167178 - protein, 10 aa, Yellow fever virus
AVLRKVKRVV

SEQ ID NO: 167179 - protein, 10 aa, Yellow fever virus
VLRKVKRVVA

SEQ ID NO: 167180 - protein, 10 aa, Yellow fever virus
LRKVKRVVAS

SEQ ID NO: 167181 - protein, 10 aa, Yellow fever virus
RKVKRVVASL

SEQ ID NO: 167182 - protein, 10 aa, Yellow fever virus
KVKRVVASLM

SEQ ID NO: 167183 - protein, 10 aa, Yellow fever virus
VKRVVASLMR

SEQ ID NO: 167184 - protein, 10 aa, Yellow fever virus
KRVVASLMRG

SEQ ID NO: 167185 - protein, 10 aa, Yellow fever virus
RVVASLMRGL

SEQ ID NO: 167186 - protein, 10 aa, Yellow fever virus
VVASLMRGLS

SEQ ID NO: 167187 - protein, 10 aa, Yellow fever virus
VASLMRGLSS

SEQ ID NO: 167188 - protein, 10 aa, Yellow fever virus
ASLMRGLSSR

SEQ ID NO: 167189 - protein, 10 aa, Yellow fever virus
SLMRGLSSRK

SEQ ID NO: 167190 - protein, 10 aa, Yellow fever virus
LMRGLSSRKR

SEQ ID NO: 167191 - protein, 10 aa, Yellow fever virus
MRGLSSRKRR

SEQ ID NO: 167192 - protein, 10 aa, Yellow fever virus
RGLSSRKRRS

SEQ ID NO: 167193 - protein, 10 aa, Yellow fever virus
GLSSRKRRSH

SEQ ID NO: 167194 - protein, 10 aa, Yellow fever virus
LSSRKRRSHD

SEQ ID NO: 167195 - protein, 10 aa, Yellow fever virus
SSRKRRSHDV

SEQ ID NO: 167196 - protein, 10 aa, Yellow fever virus
SRKRRSHDVL

SEQ ID NO: 167197 - protein, 10 aa, Yellow fever virus
TVQFLILGML

SEQ ID NO: 167198 - protein, 10 aa, Yellow fever virus
VQFLILGMLL

SEQ ID NO: 167199 - protein, 10 aa, Yellow fever virus
QFLILGMLLM

SEQ ID NO: 167200 - protein, 10 aa, Yellow fever virus
TGGVTLVRKN

SEQ ID NO: 167201 - protein, 10 aa, Yellow fever virus
GGVTLVRKNR

SEQ ID NO: 167202 - protein, 10 aa, Yellow fever virus
GVTLVRKNRW

SEQ ID NO: 167203 - protein, 10 aa, Yellow fever virus
VTLVRKNRWL

SEQ ID NO: 167204 - protein, 10 aa, Yellow fever virus
TLVRKNRWLL

SEQ ID NO: 167205 - protein, 10 aa, Yellow fever virus
LVRKNRWLLL

SEQ ID NO: 167206 - protein, 10 aa, Yellow fever virus
VRKNRWLLLN

SEQ ID NO: 167207 - protein, 10 aa, Yellow fever virus
RKNRWLLLNV

SEQ ID NO: 167208 - protein, 10 aa, Yellow fever virus
KNRWLLLNVT

SEQ ID NO: 167209 - protein, 10 aa, Yellow fever virus
NRWLLLNVTS

SEQ ID NO: 167210 - protein, 10 aa, Yellow fever virus
RWLLLNVTSE

SEQ ID NO: 167211 - protein, 10 aa, Yellow fever virus
WLLLNVTSED

SEQ ID NO: 167212 - protein, 10 aa, Yellow fever virus
LLLNVTSEDL

SEQ ID NO: 167213 - protein, 10 aa, Yellow fever virus
LLNVTSEDLG

SEQ ID NO: 167214 - protein, 10 aa, Yellow fever virus
LNVTSEDLGK

SEQ ID NO: 167215 - protein, 10 aa, Yellow fever virus
NVTSEDLGKT

SEQ ID NO: 167216 - protein, 10 aa, Yellow fever virus
VTSEDLGKTF

SEQ ID NO: 167217 - protein, 10 aa, Yellow fever virus
TSEDLGKTFS

SEQ ID NO: 167218 - protein, 10 aa, Yellow fever virus
SEDLGKTFSV

SEQ ID NO: 167219 - protein, 10 aa, Yellow fever virus
EDLGKTFSVG

SEQ ID NO: 167220 - protein, 10 aa, Yellow fever virus
DLGKTFSVGT

SEQ ID NO: 167221 - protein, 10 aa, Yellow fever virus
LGKTFSVGTG

SEQ ID NO: 167222 - protein, 10 aa, Yellow fever virus
GKTFSVGTGN

SEQ ID NO: 167223 - protein, 10 aa, Yellow fever virus
KTFSVGTGNC

SEQ ID NO: 167224 - protein, 10 aa, Yellow fever virus
TFSVGTGNCT

SEQ ID NO: 167225 - protein, 10 aa, Yellow fever virus
FSVGTGNCTT

SEQ ID NO: 167226 - protein, 10 aa, Yellow fever virus
SVGTGNCTTN

SEQ ID NO: 167227 - protein, 10 aa, Yellow fever virus
VGTGNCTTNI

SEQ ID NO: 167228 - protein, 10 aa, Yellow fever virus
GTGNCTTNIL

SEQ ID NO: 167229 - protein, 10 aa, Yellow fever virus
TGNCTTNILE

SEQ ID NO: 167230 - protein, 10 aa, Yellow fever virus
GNCTTNILEA

SEQ ID NO: 167231 - protein, 10 aa, Yellow fever virus
NCTTNILEAK

SEQ ID NO: 167232 - protein, 10 aa, Yellow fever virus
CTTNILEAKY

SEQ ID NO: 167233 - protein, 10 aa, Yellow fever virus
TTNILEAKYW

SEQ ID NO: 167234 - protein, 10 aa, Yellow fever virus
TNILEAKYWC

SEQ ID NO: 167235 - protein, 10 aa, Yellow fever virus
NILEAKYWCP

SEQ ID NO: 167236 - protein, 10 aa, Yellow fever virus
ILEAKYWCPD

SEQ ID NO: 167237 - protein, 10 aa, Yellow fever virus
LEAKYWCPDS

SEQ ID NO: 167238 - protein, 10 aa, Yellow fever virus
EAKYWCPDSM

SEQ ID NO: 167239 - protein, 10 aa, Yellow fever virus
AKYWCPDSME

SEQ ID NO: 167240 - protein, 10 aa, Yellow fever virus
KYWCPDSMEY

SEQ ID NO: 167241 - protein, 10 aa, Yellow fever virus
YWCPDSMEYN

SEQ ID NO: 167242 - protein, 10 aa, Yellow fever virus
WCPDSMEYNC

SEQ ID NO: 167243 - protein, 10 aa, Yellow fever virus
CPDSMEYNCP

SEQ ID NO: 167244 - protein, 10 aa, Yellow fever virus
PDSMEYNCPN

SEQ ID NO: 167245 - protein, 10 aa, Yellow fever virus
DSMEYNCPNL

SEQ ID NO: 167246 - protein, 10 aa, Yellow fever virus
SMEYNCPNLS

SEQ ID NO: 167247 - protein, 10 aa, Yellow fever virus
MEYNCPNLSP

SEQ ID NO: 167248 - protein, 10 aa, Yellow fever virus
EYNCPNLSPR

SEQ ID NO: 167249 - protein, 10 aa, Yellow fever virus
YNCPNLSPRE

SEQ ID NO: 167250 - protein, 10 aa, Yellow fever virus
NCPNLSPREE

SEQ ID NO: 167251 - protein, 10 aa, Yellow fever virus
CPNLSPREEP

SEQ ID NO: 167252 - protein, 10 aa, Yellow fever virus
PNLSPREEPD

SEQ ID NO: 167253 - protein, 10 aa, Yellow fever virus
NLSPREEPDD

SEQ ID NO: 167254 - protein, 10 aa, Yellow fever virus
LSPREEPDDI

SEQ ID NO: 167255 - protein, 10 aa, Yellow fever virus
SPREEPDDID

SEQ ID NO: 167256 - protein, 10 aa, Yellow fever virus
PREEPDDIDC

SEQ ID NO: 167257 - protein, 10 aa, Yellow fever virus
REEPDDIDCW

SEQ ID NO: 167258 - protein, 10 aa, Yellow fever virus
EEPDDIDCWC

SEQ ID NO: 167259 - protein, 10 aa, Yellow fever virus
EPDDIDCWCY

SEQ ID NO: 167260 - protein, 10 aa, Yellow fever virus
PDDIDCWCYG

SEQ ID NO: 167261 - protein, 10 aa, Yellow fever virus
DDIDCWCYGV

SEQ ID NO: 167262 - protein, 10 aa, Yellow fever virus
DIDCWCYGVE

SEQ ID NO: 167263 - protein, 10 aa, Yellow fever virus
IDCWCYGVEN

SEQ ID NO: 167264 - protein, 10 aa, Yellow fever virus
DCWCYGVENV

SEQ ID NO: 167265 - protein, 10 aa, Yellow fever virus
CWCYGVENVR

SEQ ID NO: 167266 - protein, 10 aa, Yellow fever virus
WCYGVENVRV

SEQ ID NO: 167267 - protein, 10 aa, Yellow fever virus
CYGVENVRVA

SEQ ID NO: 167268 - protein, 10 aa, Yellow fever virus
YGVENVRVAY

SEQ ID NO: 167269 - protein, 10 aa, Yellow fever virus
GVENVRVAYG

SEQ ID NO: 167270 - protein, 10 aa, Yellow fever virus
VENVRVAYGK

SEQ ID NO: 167271 - protein, 10 aa, Yellow fever virus
ENVRVAYGKC

SEQ ID NO: 167272 - protein, 10 aa, Yellow fever virus
NVRVAYGKCD

SEQ ID NO: 167273 - protein, 10 aa, Yellow fever virus
VRVAYGKCDS

SEQ ID NO: 167274 - protein, 10 aa, Yellow fever virus
RVAYGKCDSA

SEQ ID NO: 167275 - protein, 10 aa, Yellow fever virus
VAYGKCDSAG

SEQ ID NO: 167276 - protein, 10 aa, Yellow fever virus
AYGKCDSAGR

SEQ ID NO: 167277 - protein, 10 aa, Yellow fever virus
YGKCDSAGRS

SEQ ID NO: 167278 - protein, 10 aa, Yellow fever virus
GKCDSAGRSR

SEQ ID NO: 167279 - protein, 10 aa, Yellow fever virus
KCDSAGRSRR

SEQ ID NO: 167280 - protein, 10 aa, Yellow fever virus
CDSAGRSRRS

SEQ ID NO: 167281 - protein, 10 aa, Yellow fever virus
DSAGRSRRSR

SEQ ID NO: 167282 - protein, 10 aa, Yellow fever virus
SAGRSRRSRR

SEQ ID NO: 167283 - protein, 10 aa, Yellow fever virus
AGRSRRSRRA

SEQ ID NO: 167284 - protein, 10 aa, Yellow fever virus
GRSRRSRRAI

SEQ ID NO: 167285 - protein, 10 aa, Yellow fever virus
RSRRSRRAID

SEQ ID NO: 167286 - protein, 10 aa, Yellow fever virus
SRRSRRAIDL

SEQ ID NO: 167287 - protein, 10 aa, Yellow fever virus
RRSRRAIDLP

SEQ ID NO: 167288 - protein, 10 aa, Yellow fever virus
RSRRAIDLPT

SEQ ID NO: 167289 - protein, 10 aa, Yellow fever virus
SRRAIDLPTH

SEQ ID NO: 167290 - protein, 10 aa, Yellow fever virus
RRAIDLPTHE

SEQ ID NO: 167291 - protein, 10 aa, Yellow fever virus
RAIDLPTHEN

SEQ ID NO: 167292 - protein, 10 aa, Yellow fever virus
AIDLPTHENH

SEQ ID NO: 167293 - protein, 10 aa, Yellow fever virus
IDLPTHENHG

SEQ ID NO: 167294 - protein, 10 aa, Yellow fever virus
DLPTHENHGL

SEQ ID NO: 167295 - protein, 10 aa, Yellow fever virus
LPTHENHGLK

SEQ ID NO: 167296 - protein, 10 aa, Yellow fever virus
PTHENHGLKT

SEQ ID NO: 167297 - protein, 10 aa, Yellow fever virus
THENHGLKTR

SEQ ID NO: 167298 - protein, 10 aa, Yellow fever virus
HENHGLKTRQ

SEQ ID NO: 167299 - protein, 10 aa, Yellow fever virus
ENHGLKTRQE

SEQ ID NO: 167300 - protein, 10 aa, Yellow fever virus
NHGLKTRQEK

SEQ ID NO: 167301 - protein, 10 aa, Yellow fever virus
HGLKTRQEKW

SEQ ID NO: 167302 - protein, 10 aa, Yellow fever virus
GLKTRQEKWM

SEQ ID NO: 167303 - protein, 10 aa, Yellow fever virus
LKTRQEKWMT

SEQ ID NO: 167304 - protein, 10 aa, Yellow fever virus
KTRQEKWMTG

SEQ ID NO: 167305 - protein, 10 aa, Yellow fever virus
TRQEKWMTGR

SEQ ID NO: 167306 - protein, 10 aa, Yellow fever virus
RQEKWMTGRM

SEQ ID NO: 167307 - protein, 10 aa, Yellow fever virus
QEKWMTGRMG

SEQ ID NO: 167308 - protein, 10 aa, Yellow fever virus
EKWMTGRMGE

SEQ ID NO: 167309 - protein, 10 aa, Yellow fever virus
KWMTGRMGER

SEQ ID NO: 167310 - protein, 10 aa, Yellow fever virus
WMTGRMGERQ

SEQ ID NO: 167311 - protein, 10 aa, Yellow fever virus
MTGRMGERQL

SEQ ID NO: 167312 - protein, 10 aa, Yellow fever virus
TGRMGERQLQ

SEQ ID NO: 167313 - protein, 10 aa, Yellow fever virus
GRMGERQLQK

SEQ ID NO: 167314 - protein, 10 aa, Yellow fever virus
RMGERQLQKI

SEQ ID NO: 167315 - protein, 10 aa, Yellow fever virus
MGERQLQKIE

SEQ ID NO: 167316 - protein, 10 aa, Yellow fever virus
GERQLQKIER

SEQ ID NO: 167317 - protein, 10 aa, Yellow fever virus
ERQLQKIERW

SEQ ID NO: 167318 - protein, 10 aa, Yellow fever virus
RQLQKIERWF

SEQ ID NO: 167319 - protein, 10 aa, Yellow fever virus
QLQKIERWFV

SEQ ID NO: 167320 - protein, 10 aa, Yellow fever virus
LQKIERWFVR

SEQ ID NO: 167321 - protein, 10 aa, Yellow fever virus
QKIERWFVRN

SEQ ID NO: 167322 - protein, 10 aa, Yellow fever virus
KIERWFVRNP

SEQ ID NO: 167323 - protein, 10 aa, Yellow fever virus
IERWFVRNPF

SEQ ID NO: 167324 - protein, 10 aa, Yellow fever virus
ERWFVRNPFF

SEQ ID NO: 167325 - protein, 10 aa, Yellow fever virus
RWFVRNPFFA

SEQ ID NO: 167326 - protein, 10 aa, Yellow fever virus
WFVRNPFFAV

SEQ ID NO: 167327 - protein, 10 aa, Yellow fever virus
FVRNPFFAVT

SEQ ID NO: 167328 - protein, 10 aa, Yellow fever virus
VRNPFFAVTA

SEQ ID NO: 167329 - protein, 10 aa, Yellow fever virus
RNPFFAVTAL

SEQ ID NO: 167330 - protein, 10 aa, Yellow fever virus
NPFFAVTALT

SEQ ID NO: 167331 - protein, 10 aa, Yellow fever virus
PFFAVTALTI

SEQ ID NO: 167332 - protein, 10 aa, Yellow fever virus
FFAVTALTIA

SEQ ID NO: 167333 - protein, 10 aa, Yellow fever virus
FAVTALTIAY

SEQ ID NO: 167334 - protein, 10 aa, Yellow fever virus
AVTALTIAYL

SEQ ID NO: 167335 - protein, 10 aa, Yellow fever virus
VTALTIAYLV

SEQ ID NO: 167336 - protein, 10 aa, Yellow fever virus
TALTIAYLVG

SEQ ID NO: 167337 - protein, 10 aa, Yellow fever virus
ALTIAYLVGS

SEQ ID NO: 167338 - protein, 10 aa, Yellow fever virus
LTIAYLVGSN

SEQ ID NO: 167339 - protein, 10 aa, Yellow fever virus
TIAYLVGSNM

SEQ ID NO: 167340 - protein, 10 aa, Yellow fever virus
IAYLVGSNMT

SEQ ID NO: 167341 - protein, 10 aa, Yellow fever virus
AYLVGSNMTQ

SEQ ID NO: 167342 - protein, 10 aa, Yellow fever virus
YLVGSNMTQR

SEQ ID NO: 167343 - protein, 10 aa, Yellow fever virus
LVGSNMTQRV

SEQ ID NO: 167344 - protein, 10 aa, Yellow fever virus
VGSNMTQRVV

SEQ ID NO: 167345 - protein, 10 aa, Yellow fever virus
GSNMTQRVVI

SEQ ID NO: 167346 - protein, 10 aa, Yellow fever virus
SNMTQRVVIA

SEQ ID NO: 167347 - protein, 10 aa, Yellow fever virus
NMTQRVVIAL

SEQ ID NO: 167348 - protein, 10 aa, Yellow fever virus
MTQRVVIALL

SEQ ID NO: 167349 - protein, 10 aa, Yellow fever virus
TQRVVIALLV

SEQ ID NO: 167350 - protein, 10 aa, Yellow fever virus
QRVVIALLVL

SEQ ID NO: 167351 - protein, 10 aa, Yellow fever virus
RVVIALLVLA

SEQ ID NO: 167352 - protein, 10 aa, Yellow fever virus
VVIALLVLAV

SEQ ID NO: 167353 - protein, 10 aa, Yellow fever virus
VIALLVLAVG

SEQ ID NO: 167354 - protein, 10 aa, Yellow fever virus
IALLVLAVGP

SEQ ID NO: 167355 - protein, 10 aa, Yellow fever virus
ALLVLAVGPA

SEQ ID NO: 167356 - protein, 10 aa, Yellow fever virus
LLVLAVGPAY

SEQ ID NO: 167357 - protein, 10 aa, Yellow fever virus
LVLAVGPAYS

SEQ ID NO: 167358 - protein, 10 aa, Yellow fever virus
VLAVGPAYSA

SEQ ID NO: 167359 - protein, 10 aa, Yellow fever virus
LAVGPAYSAH

SEQ ID NO: 167360 - protein, 10 aa, Yellow fever virus
AVGPAYSAHC

SEQ ID NO: 167361 - protein, 10 aa, Yellow fever virus
VGPAYSAHCI

SEQ ID NO: 167362 - protein, 10 aa, Yellow fever virus
GPAYSAHCIG

SEQ ID NO: 167363 - protein, 10 aa, Yellow fever virus
PAYSAHCIGI

SEQ ID NO: 167364 - protein, 10 aa, Yellow fever virus
AYSAHCIGIT

SEQ ID NO: 167365 - protein, 10 aa, Yellow fever virus
YSAHCIGITD

SEQ ID NO: 167366 - protein, 10 aa, Yellow fever virus
SAHCIGITDR

SEQ ID NO: 167367 - protein, 10 aa, Yellow fever virus
AHCIGITDRD

SEQ ID NO: 167368 - protein, 10 aa, Yellow fever virus
HCIGITDRDF

SEQ ID NO: 167369 - protein, 10 aa, Yellow fever virus
CIGITDRDFI

SEQ ID NO: 167370 - protein, 10 aa, Yellow fever virus
IGITDRDFIE

SEQ ID NO: 167371 - protein, 10 aa, Yellow fever virus
GITDRDFIEG

SEQ ID NO: 167372 - protein, 10 aa, Yellow fever virus
ITDRDFIEGV

SEQ ID NO: 167373 - protein, 10 aa, Yellow fever virus
TDRDFIEGVH

SEQ ID NO: 167374 - protein, 10 aa, Yellow fever virus
DRDFIEGVHG

SEQ ID NO: 167375 - protein, 10 aa, Yellow fever virus
RDFIEGVHGG

SEQ ID NO: 167376 - protein, 10 aa, Yellow fever virus
DFIEGVHGGT

SEQ ID NO: 167377 - protein, 10 aa, Yellow fever virus
FIEGVHGGTW

SEQ ID NO: 167378 - protein, 10 aa, Yellow fever virus
IEGVHGGTWV

SEQ ID NO: 167379 - protein, 10 aa, Yellow fever virus
EGVHGGTWVS

SEQ ID NO: 167380 - protein, 10 aa, Yellow fever virus
GVHGGTWVSA

SEQ ID NO: 167381 - protein, 10 aa, Yellow fever virus
VHGGTWVSAT

SEQ ID NO: 167382 - protein, 10 aa, Yellow fever virus
HGGTWVSATL

SEQ ID NO: 167383 - protein, 10 aa, Yellow fever virus
GGTWVSATLE

SEQ ID NO: 167384 - protein, 10 aa, Yellow fever virus
GTWVSATLEQ

SEQ ID NO: 167385 - protein, 10 aa, Yellow fever virus
TWVSATLEQD

SEQ ID NO: 167386 - protein, 10 aa, Yellow fever virus
WVSATLEQDK

SEQ ID NO: 167387 - protein, 10 aa, Yellow fever virus
VSATLEQDKC

SEQ ID NO: 167388 - protein, 10 aa, Yellow fever virus
SATLEQDKCV

SEQ ID NO: 167389 - protein, 10 aa, Yellow fever virus
ATLEQDKCVT

SEQ ID NO: 167390 - protein, 10 aa, Yellow fever virus
TLEQDKCVTV

SEQ ID NO: 167391 - protein, 10 aa, Yellow fever virus
LEQDKCVTVM

SEQ ID NO: 167392 - protein, 10 aa, Yellow fever virus
EQDKCVTVMA

SEQ ID NO: 167393 - protein, 10 aa, Yellow fever virus
QDKCVTVMAP

SEQ ID NO: 167394 - protein, 10 aa, Yellow fever virus
DKCVTVMAPD

SEQ ID NO: 167395 - protein, 10 aa, Yellow fever virus
KCVTVMAPDK

SEQ ID NO: 167396 - protein, 10 aa, Yellow fever virus
CVTVMAPDKP

SEQ ID NO: 167397 - protein, 10 aa, Yellow fever virus
VTVMAPDKPS

SEQ ID NO: 167398 - protein, 10 aa, Yellow fever virus
TVMAPDKPSL

SEQ ID NO: 167399 - protein, 10 aa, Yellow fever virus
VMAPDKPSLD

SEQ ID NO: 167400 - protein, 10 aa, Yellow fever virus
MAPDKPSLDI

SEQ ID NO: 167401 - protein, 10 aa, Yellow fever virus
APDKPSLDIS

SEQ ID NO: 167402 - protein, 10 aa, Yellow fever virus
PDKPSLDISL

SEQ ID NO: 167403 - protein, 10 aa, Yellow fever virus
DKPSLDISLE

SEQ ID NO: 167404 - protein, 10 aa, Yellow fever virus
KPSLDISLET

SEQ ID NO: 167405 - protein, 10 aa, Yellow fever virus
PSLDISLETV

SEQ ID NO: 167406 - protein, 10 aa, Yellow fever virus
SLDISLETVA

SEQ ID NO: 167407 - protein, 10 aa, Yellow fever virus
LDISLETVAI

SEQ ID NO: 167408 - protein, 10 aa, Yellow fever virus
DISLETVAID

SEQ ID NO: 167409 - protein, 10 aa, Yellow fever virus
ISLETVAIDR

SEQ ID NO: 167410 - protein, 10 aa, Yellow fever virus
SLETVAIDRP

SEQ ID NO: 167411 - protein, 10 aa, Yellow fever virus
LETVAIDRPA

SEQ ID NO: 167412 - protein, 10 aa, Yellow fever virus
ETVAIDRPAE

SEQ ID NO: 167413 - protein, 10 aa, Yellow fever virus
TVAIDRPAEV

SEQ ID NO: 167414 - protein, 10 aa, Yellow fever virus
VAIDRPAEVR

SEQ ID NO: 167415 - protein, 10 aa, Yellow fever virus
AIDRPAEVRK

SEQ ID NO: 167416 - protein, 10 aa, Yellow fever virus
IDRPAEVRKV

SEQ ID NO: 167417 - protein, 10 aa, Yellow fever virus
DRPAEVRKVC

SEQ ID NO: 167418 - protein, 10 aa, Yellow fever virus
RPAEVRKVCY

SEQ ID NO: 167419 - protein, 10 aa, Yellow fever virus
PAEVRKVCYN

SEQ ID NO: 167420 - protein, 10 aa, Yellow fever virus
AEVRKVCYNA

SEQ ID NO: 167421 - protein, 10 aa, Yellow fever virus
EVRKVCYNAV

SEQ ID NO: 167422 - protein, 10 aa, Yellow fever virus
VRKVCYNAVL

SEQ ID NO: 167423 - protein, 10 aa, Yellow fever virus
RKVCYNAVLT

SEQ ID NO: 167424 - protein, 10 aa, Yellow fever virus
KVCYNAVLTH

SEQ ID NO: 167425 - protein, 10 aa, Yellow fever virus
VCYNAVLTHV

SEQ ID NO: 167426 - protein, 10 aa, Yellow fever virus
CYNAVLTHVK

SEQ ID NO: 167427 - protein, 10 aa, Yellow fever virus
YNAVLTHVKI

SEQ ID NO: 167428 - protein, 10 aa, Yellow fever virus
NAVLTHVKIN

SEQ ID NO: 167429 - protein, 10 aa, Yellow fever virus
AVLTHVKIND

SEQ ID NO: 167430 - protein, 10 aa, Yellow fever virus
VLTHVKINDK

SEQ ID NO: 167431 - protein, 10 aa, Yellow fever virus
LTHVKINDKC

SEQ ID NO: 167432 - protein, 10 aa, Yellow fever virus
THVKINDKCP

SEQ ID NO: 167433 - protein, 10 aa, Yellow fever virus
HVKINDKCPS

SEQ ID NO: 167434 - protein, 10 aa, Yellow fever virus
VKINDKCPST

SEQ ID NO: 167435 - protein, 10 aa, Yellow fever virus
KINDKCPSTG

SEQ ID NO: 167436 - protein, 10 aa, Yellow fever virus
INDKCPSTGE

SEQ ID NO: 167437 - protein, 10 aa, Yellow fever virus
NDKCPSTGEA

SEQ ID NO: 167438 - protein, 10 aa, Yellow fever virus
DKCPSTGEAH

SEQ ID NO: 167439 - protein, 10 aa, Yellow fever virus
KCPSTGEAHL

SEQ ID NO: 167440 - protein, 10 aa, Yellow fever virus
CPSTGEAHLA

SEQ ID NO: 167441 - protein, 10 aa, Yellow fever virus
PSTGEAHLAE

SEQ ID NO: 167442 - protein, 10 aa, Yellow fever virus
STGEAHLAEE

SEQ ID NO: 167443 - protein, 10 aa, Yellow fever virus
TGEAHLAEEN

SEQ ID NO: 167444 - protein, 10 aa, Yellow fever virus
GEAHLAEENE

SEQ ID NO: 167445 - protein, 10 aa, Yellow fever virus
EAHLAEENEG

SEQ ID NO: 167446 - protein, 10 aa, Yellow fever virus
AHLAEENEGD

SEQ ID NO: 167447 - protein, 10 aa, Yellow fever virus
HLAEENEGDN

SEQ ID NO: 167448 - protein, 10 aa, Yellow fever virus
LAEENEGDNA

SEQ ID NO: 167449 - protein, 10 aa, Yellow fever virus
AEENEGDNAC

SEQ ID NO: 167450 - protein, 10 aa, Yellow fever virus
EENEGDNACK

SEQ ID NO: 167451 - protein, 10 aa, Yellow fever virus
ENEGDNACKR

SEQ ID NO: 167452 - protein, 10 aa, Yellow fever virus
NEGDNACKRT

SEQ ID NO: 167453 - protein, 10 aa, Yellow fever virus
EGDNACKRTY

SEQ ID NO: 167454 - protein, 10 aa, Yellow fever virus
GDNACKRTYS

SEQ ID NO: 167455 - protein, 10 aa, Yellow fever virus
DNACKRTYSD

SEQ ID NO: 167456 - protein, 10 aa, Yellow fever virus
NACKRTYSDR

SEQ ID NO: 167457 - protein, 10 aa, Yellow fever virus
ACKRTYSDRG

SEQ ID NO: 167458 - protein, 10 aa, Yellow fever virus
CKRTYSDRGW

SEQ ID NO: 167459 - protein, 10 aa, Yellow fever virus
KRTYSDRGWG

SEQ ID NO: 167460 - protein, 10 aa, Yellow fever virus
RTYSDRGWGN

SEQ ID NO: 167461 - protein, 10 aa, Yellow fever virus
TYSDRGWGNG

SEQ ID NO: 167462 - protein, 10 aa, Yellow fever virus
YSDRGWGNGC

SEQ ID NO: 167463 - protein, 10 aa, Yellow fever virus
SDRGWGNGCG

SEQ ID NO: 167464 - protein, 10 aa, Yellow fever virus
DRGWGNGCGL

SEQ ID NO: 167465 - protein, 10 aa, Yellow fever virus
RGWGNGCGLF

SEQ ID NO: 167466 - protein, 10 aa, Yellow fever virus
GWGNGCGLFG

SEQ ID NO: 167467 - protein, 10 aa, Yellow fever virus
WGNGCGLFGK

SEQ ID NO: 167468 - protein, 10 aa, Yellow fever virus
GNGCGLFGKG

SEQ ID NO: 167469 - protein, 10 aa, Yellow fever virus
NGCGLFGKGS

SEQ ID NO: 167470 - protein, 10 aa, Yellow fever virus
GCGLFGKGSI

SEQ ID NO: 167471 - protein, 10 aa, Yellow fever virus
CGLFGKGSIV

SEQ ID NO: 167472 - protein, 10 aa, Yellow fever virus
GLFGKGSIVA

SEQ ID NO: 167473 - protein, 10 aa, Yellow fever virus
LFGKGSIVAC

SEQ ID NO: 167474 - protein, 10 aa, Yellow fever virus
FGKGSIVACA

SEQ ID NO: 167475 - protein, 10 aa, Yellow fever virus
GKGSIVACAK

SEQ ID NO: 167476 - protein, 10 aa, Yellow fever virus
KGSIVACAKF

SEQ ID NO: 167477 - protein, 10 aa, Yellow fever virus
GSIVACAKFT

SEQ ID NO: 167478 - protein, 10 aa, Yellow fever virus
SIVACAKFTC

SEQ ID NO: 167479 - protein, 10 aa, Yellow fever virus
IVACAKFTCA

SEQ ID NO: 167480 - protein, 10 aa, Yellow fever virus
VACAKFTCAK

SEQ ID NO: 167481 - protein, 10 aa, Yellow fever virus
ACAKFTCAKS

SEQ ID NO: 167482 - protein, 10 aa, Yellow fever virus
CAKFTCAKSM

SEQ ID NO: 167483 - protein, 10 aa, Yellow fever virus
AKFTCAKSMS

SEQ ID NO: 167484 - protein, 10 aa, Yellow fever virus
KFTCAKSMSL

SEQ ID NO: 167485 - protein, 10 aa, Yellow fever virus
FTCAKSMSLF

SEQ ID NO: 167486 - protein, 10 aa, Yellow fever virus
TCAKSMSLFE

SEQ ID NO: 167487 - protein, 10 aa, Yellow fever virus
CAKSMSLFEV

SEQ ID NO: 167488 - protein, 10 aa, Yellow fever virus
AKSMSLFEVD

SEQ ID NO: 167489 - protein, 10 aa, Yellow fever virus
KSMSLFEVDQ

SEQ ID NO: 167490 - protein, 10 aa, Yellow fever virus
SMSLFEVDQT

SEQ ID NO: 167491 - protein, 10 aa, Yellow fever virus
MSLFEVDQTK

SEQ ID NO: 167492 - protein, 10 aa, Yellow fever virus
SLFEVDQTKI

SEQ ID NO: 167493 - protein, 10 aa, Yellow fever virus
LFEVDQTKIQ

SEQ ID NO: 167494 - protein, 10 aa, Yellow fever virus
FEVDQTKIQY

SEQ ID NO: 167495 - protein, 10 aa, Yellow fever virus
EVDQTKIQYV

SEQ ID NO: 167496 - protein, 10 aa, Yellow fever virus
VDQTKIQYVI

SEQ ID NO: 167497 - protein, 10 aa, Yellow fever virus
DQTKIQYVIR

SEQ ID NO: 167498 - protein, 10 aa, Yellow fever virus
QTKIQYVIRA

SEQ ID NO: 167499 - protein, 10 aa, Yellow fever virus
TKIQYVIRAQ

SEQ ID NO: 167500 - protein, 10 aa, Yellow fever virus
KIQYVIRAQL

SEQ ID NO: 167501 - protein, 10 aa, Yellow fever virus
IQYVIRAQLH

SEQ ID NO: 167502 - protein, 10 aa, Yellow fever virus
QYVIRAQLHV

SEQ ID NO: 167503 - protein, 10 aa, Yellow fever virus
YVIRAQLHVG

SEQ ID NO: 167504 - protein, 10 aa, Yellow fever virus
VIRAQLHVGA

SEQ ID NO: 167505 - protein, 10 aa, Yellow fever virus
IRAQLHVGAK

SEQ ID NO: 167506 - protein, 10 aa, Yellow fever virus
RAQLHVGAKQ

SEQ ID NO: 167507 - protein, 10 aa, Yellow fever virus
AQLHVGAKQE

SEQ ID NO: 167508 - protein, 10 aa, Yellow fever virus
QLHVGAKQEN

SEQ ID NO: 167509 - protein, 10 aa, Yellow fever virus
LHVGAKQENW

SEQ ID NO: 167510 - protein, 10 aa, Yellow fever virus
HVGAKQENWN

SEQ ID NO: 167511 - protein, 10 aa, Yellow fever virus
VGAKQENWNT

SEQ ID NO: 167512 - protein, 10 aa, Yellow fever virus
GAKQENWNTD

SEQ ID NO: 167513 - protein, 10 aa, Yellow fever virus
AKQENWNTDI

SEQ ID NO: 167514 - protein, 10 aa, Yellow fever virus
KQENWNTDIK

SEQ ID NO: 167515 - protein, 10 aa, Yellow fever virus
QENWNTDIKT

SEQ ID NO: 167516 - protein, 10 aa, Yellow fever virus
ENWNTDIKTL

SEQ ID NO: 167517 - protein, 10 aa, Yellow fever virus
NWNTDIKTLK

SEQ ID NO: 167518 - protein, 10 aa, Yellow fever virus
WNTDIKTLKF

SEQ ID NO: 167519 - protein, 10 aa, Yellow fever virus
NTDIKTLKFD

SEQ ID NO: 167520 - protein, 10 aa, Yellow fever virus
TDIKTLKFDA

SEQ ID NO: 167521 - protein, 10 aa, Yellow fever virus
DIKTLKFDAL

SEQ ID NO: 167522 - protein, 10 aa, Yellow fever virus
IKTLKFDALS

SEQ ID NO: 167523 - protein, 10 aa, Yellow fever virus
KTLKFDALSG

SEQ ID NO: 167524 - protein, 10 aa, Yellow fever virus
TLKFDALSGS

SEQ ID NO: 167525 - protein, 10 aa, Yellow fever virus
LKFDALSGSQ

SEQ ID NO: 167526 - protein, 10 aa, Yellow fever virus
KFDALSGSQE

SEQ ID NO: 167527 - protein, 10 aa, Yellow fever virus
FDALSGSQEV

SEQ ID NO: 167528 - protein, 10 aa, Yellow fever virus
DALSGSQEVE

SEQ ID NO: 167529 - protein, 10 aa, Yellow fever virus
ALSGSQEVEF

SEQ ID NO: 167530 - protein, 10 aa, Yellow fever virus
LSGSQEVEFI

SEQ ID NO: 167531 - protein, 10 aa, Yellow fever virus
SGSQEVEFIG

SEQ ID NO: 167532 - protein, 10 aa, Yellow fever virus
GSQEVEFIGY

SEQ ID NO: 167533 - protein, 10 aa, Yellow fever virus
SQEVEFIGYG

SEQ ID NO: 167534 - protein, 10 aa, Yellow fever virus
QEVEFIGYGK

SEQ ID NO: 167535 - protein, 10 aa, Yellow fever virus
EVEFIGYGKA

SEQ ID NO: 167536 - protein, 10 aa, Yellow fever virus
VEFIGYGKAT

SEQ ID NO: 167537 - protein, 10 aa, Yellow fever virus
EFIGYGKATL

SEQ ID NO: 167538 - protein, 10 aa, Yellow fever virus
FIGYGKATLE

SEQ ID NO: 167539 - protein, 10 aa, Yellow fever virus
IGYGKATLEC

SEQ ID NO: 167540 - protein, 10 aa, Yellow fever virus
GYGKATLECQ

SEQ ID NO: 167541 - protein, 10 aa, Yellow fever virus
YGKATLECQV

SEQ ID NO: 167542 - protein, 10 aa, Yellow fever virus
GKATLECQVQ

SEQ ID NO: 167543 - protein, 10 aa, Yellow fever virus
KATLECQVQT

SEQ ID NO: 167544 - protein, 10 aa, Yellow fever virus
ATLECQVQTA

SEQ ID NO: 167545 - protein, 10 aa, Yellow fever virus
TLECQVQTAV

SEQ ID NO: 167546 - protein, 10 aa, Yellow fever virus
LECQVQTAVD

SEQ ID NO: 167547 - protein, 10 aa, Yellow fever virus
ECQVQTAVDF

SEQ ID NO: 167548 - protein, 10 aa, Yellow fever virus
CQVQTAVDFG

SEQ ID NO: 167549 - protein, 10 aa, Yellow fever virus
QVQTAVDFGN

SEQ ID NO: 167550 - protein, 10 aa, Yellow fever virus
VQTAVDFGNS

SEQ ID NO: 167551 - protein, 10 aa, Yellow fever virus
QTAVDFGNSY

SEQ ID NO: 167552 - protein, 10 aa, Yellow fever virus
TAVDFGNSYI

SEQ ID NO: 167553 - protein, 10 aa, Yellow fever virus
AVDFGNSYIA

SEQ ID NO: 167554 - protein, 10 aa, Yellow fever virus
VDFGNSYIAE

SEQ ID NO: 167555 - protein, 10 aa, Yellow fever virus
DFGNSYIAEM

SEQ ID NO: 167556 - protein, 10 aa, Yellow fever virus
FGNSYIAEME

SEQ ID NO: 167557 - protein, 10 aa, Yellow fever virus
GNSYIAEMET

SEQ ID NO: 167558 - protein, 10 aa, Yellow fever virus
NSYIAEMETE

SEQ ID NO: 167559 - protein, 10 aa, Yellow fever virus
SYIAEMETES

SEQ ID NO: 167560 - protein, 10 aa, Yellow fever virus
YIAEMETESW

SEQ ID NO: 167561 - protein, 10 aa, Yellow fever virus
IAEMETESWI

SEQ ID NO: 167562 - protein, 10 aa, Yellow fever virus
AEMETESWIV

SEQ ID NO: 167563 - protein, 10 aa, Yellow fever virus
EMETESWIVD

SEQ ID NO: 167564 - protein, 10 aa, Yellow fever virus
METESWIVDR

SEQ ID NO: 167565 - protein, 10 aa, Yellow fever virus
ETESWIVDRQ

SEQ ID NO: 167566 - protein, 10 aa, Yellow fever virus
TESWIVDRQW

SEQ ID NO: 167567 - protein, 10 aa, Yellow fever virus
ESWIVDRQWA

SEQ ID NO: 167568 - protein, 10 aa, Yellow fever virus
SWIVDRQWAQ

SEQ ID NO: 167569 - protein, 10 aa, Yellow fever virus
WIVDRQWAQD

SEQ ID NO: 167570 - protein, 10 aa, Yellow fever virus
IVDRQWAQDL

SEQ ID NO: 167571 - protein, 10 aa, Yellow fever virus
VDRQWAQDLT

SEQ ID NO: 167572 - protein, 10 aa, Yellow fever virus
DRQWAQDLTL

SEQ ID NO: 167573 - protein, 10 aa, Yellow fever virus
RQWAQDLTLP

SEQ ID NO: 167574 - protein, 10 aa, Yellow fever virus
QWAQDLTLPW

SEQ ID NO: 167575 - protein, 10 aa, Yellow fever virus
WAQDLTLPWQ

SEQ ID NO: 167576 - protein, 10 aa, Yellow fever virus
AQDLTLPWQS

SEQ ID NO: 167577 - protein, 10 aa, Yellow fever virus
QDLTLPWQSG

SEQ ID NO: 167578 - protein, 10 aa, Yellow fever virus
DLTLPWQSGS

SEQ ID NO: 167579 - protein, 10 aa, Yellow fever virus
LTLPWQSGSG

SEQ ID NO: 167580 - protein, 10 aa, Yellow fever virus
TLPWQSGSGG

SEQ ID NO: 167581 - protein, 10 aa, Yellow fever virus
LPWQSGSGGV

SEQ ID NO: 167582 - protein, 10 aa, Yellow fever virus
PWQSGSGGVW

SEQ ID NO: 167583 - protein, 10 aa, Yellow fever virus
WQSGSGGVWR

SEQ ID NO: 167584 - protein, 10 aa, Yellow fever virus
QSGSGGVWRE

SEQ ID NO: 167585 - protein, 10 aa, Yellow fever virus
SGSGGVWREM

SEQ ID NO: 167586 - protein, 10 aa, Yellow fever virus
GSGGVWREMH

SEQ ID NO: 167587 - protein, 10 aa, Yellow fever virus
SGGVWREMHH

SEQ ID NO: 167588 - protein, 10 aa, Yellow fever virus
GGVWREMHHL

SEQ ID NO: 167589 - protein, 10 aa, Yellow fever virus
GVWREMHHLV

SEQ ID NO: 167590 - protein, 10 aa, Yellow fever virus
VWREMHHLVE

SEQ ID NO: 167591 - protein, 10 aa, Yellow fever virus
WREMHHLVEF

SEQ ID NO: 167592 - protein, 10 aa, Yellow fever virus
REMHHLVEFE

SEQ ID NO: 167593 - protein, 10 aa, Yellow fever virus
EMHHLVEFEP

SEQ ID NO: 167594 - protein, 10 aa, Yellow fever virus
MHHLVEFEPP

SEQ ID NO: 167595 - protein, 10 aa, Yellow fever virus
HHLVEFEPPH

SEQ ID NO: 167596 - protein, 10 aa, Yellow fever virus
HLVEFEPPHA

SEQ ID NO: 167597 - protein, 10 aa, Yellow fever virus
LVEFEPPHAA

SEQ ID NO: 167598 - protein, 10 aa, Yellow fever virus
VEFEPPHAAT

SEQ ID NO: 167599 - protein, 10 aa, Yellow fever virus
EFEPPHAATI

SEQ ID NO: 167600 - protein, 10 aa, Yellow fever virus
FEPPHAATIR

SEQ ID NO: 167601 - protein, 10 aa, Yellow fever virus
EPPHAATIRV

SEQ ID NO: 167602 - protein, 10 aa, Yellow fever virus
PPHAATIRVL

SEQ ID NO: 167603 - protein, 10 aa, Yellow fever virus
PHAATIRVLA

SEQ ID NO: 167604 - protein, 10 aa, Yellow fever virus
HAATIRVLAL

SEQ ID NO: 167605 - protein, 10 aa, Yellow fever virus
AATIRVLALG

SEQ ID NO: 167606 - protein, 10 aa, Yellow fever virus
ATIRVLALGN

SEQ ID NO: 167607 - protein, 10 aa, Yellow fever virus
TIRVLALGNQ

SEQ ID NO: 167608 - protein, 10 aa, Yellow fever virus
IRVLALGNQE

SEQ ID NO: 167609 - protein, 10 aa, Yellow fever virus
RVLALGNQEG

SEQ ID NO: 167610 - protein, 10 aa, Yellow fever virus
VLALGNQEGS

SEQ ID NO: 167611 - protein, 10 aa, Yellow fever virus
LALGNQEGSL

SEQ ID NO: 167612 - protein, 10 aa, Yellow fever virus
ALGNQEGSLK

SEQ ID NO: 167613 - protein, 10 aa, Yellow fever virus
LGNQEGSLKT

SEQ ID NO: 167614 - protein, 10 aa, Yellow fever virus
GNQEGSLKTA

SEQ ID NO: 167615 - protein, 10 aa, Yellow fever virus
NQEGSLKTAL

SEQ ID NO: 167616 - protein, 10 aa, Yellow fever virus
QEGSLKTALT

SEQ ID NO: 167617 - protein, 10 aa, Yellow fever virus
EGSLKTALTG

SEQ ID NO: 167618 - protein, 10 aa, Yellow fever virus
GSLKTALTGA

SEQ ID NO: 167619 - protein, 10 aa, Yellow fever virus
SLKTALTGAM

SEQ ID NO: 167620 - protein, 10 aa, Yellow fever virus
LKTALTGAMR

SEQ ID NO: 167621 - protein, 10 aa, Yellow fever virus
KTALTGAMRV

SEQ ID NO: 167622 - protein, 10 aa, Yellow fever virus
TALTGAMRVT

SEQ ID NO: 167623 - protein, 10 aa, Yellow fever virus
ALTGAMRVTK

SEQ ID NO: 167624 - protein, 10 aa, Yellow fever virus
LTGAMRVTKD

SEQ ID NO: 167625 - protein, 10 aa, Yellow fever virus
TGAMRVTKDT

SEQ ID NO: 167626 - protein, 10 aa, Yellow fever virus
GAMRVTKDTN

SEQ ID NO: 167627 - protein, 10 aa, Yellow fever virus
AMRVTKDTND

SEQ ID NO: 167628 - protein, 10 aa, Yellow fever virus
MRVTKDTNDN

SEQ ID NO: 167629 - protein, 10 aa, Yellow fever virus
RVTKDTNDNN

SEQ ID NO: 167630 - protein, 10 aa, Yellow fever virus
VTKDTNDNNL

SEQ ID NO: 167631 - protein, 10 aa, Yellow fever virus
TKDTNDNNLY

SEQ ID NO: 167632 - protein, 10 aa, Yellow fever virus
KDTNDNNLYK

SEQ ID NO: 167633 - protein, 10 aa, Yellow fever virus
DTNDNNLYKL

SEQ ID NO: 167634 - protein, 10 aa, Yellow fever virus
TNDNNLYKLH

SEQ ID NO: 167635 - protein, 10 aa, Yellow fever virus
NDNNLYKLHG

SEQ ID NO: 167636 - protein, 10 aa, Yellow fever virus
DNNLYKLHGG

SEQ ID NO: 167637 - protein, 10 aa, Yellow fever virus
NNLYKLHGGH

SEQ ID NO: 167638 - protein, 10 aa, Yellow fever virus
NLYKLHGGHV

SEQ ID NO: 167639 - protein, 10 aa, Yellow fever virus
LYKLHGGHVS

SEQ ID NO: 167640 - protein, 10 aa, Yellow fever virus
YKLHGGHVSC

SEQ ID NO: 167641 - protein, 10 aa, Yellow fever virus
KLHGGHVSCR

SEQ ID NO: 167642 - protein, 10 aa, Yellow fever virus
LHGGHVSCRV

SEQ ID NO: 167643 - protein, 10 aa, Yellow fever virus
HGGHVSCRVK

SEQ ID NO: 167644 - protein, 10 aa, Yellow fever virus
GGHVSCRVKL

SEQ ID NO: 167645 - protein, 10 aa, Yellow fever virus
GHVSCRVKLS

SEQ ID NO: 167646 - protein, 10 aa, Yellow fever virus
HVSCRVKLSA

SEQ ID NO: 167647 - protein, 10 aa, Yellow fever virus
VSCRVKLSAL

SEQ ID NO: 167648 - protein, 10 aa, Yellow fever virus
SCRVKLSALT

SEQ ID NO: 167649 - protein, 10 aa, Yellow fever virus
CRVKLSALTL

SEQ ID NO: 167650 - protein, 10 aa, Yellow fever virus
RVKLSALTLK

SEQ ID NO: 167651 - protein, 10 aa, Yellow fever virus
VKLSALTLKG

SEQ ID NO: 167652 - protein, 10 aa, Yellow fever virus
KLSALTLKGT

SEQ ID NO: 167653 - protein, 10 aa, Yellow fever virus
LSALTLKGTS

SEQ ID NO: 167654 - protein, 10 aa, Yellow fever virus
SALTLKGTSY

SEQ ID NO: 167655 - protein, 10 aa, Yellow fever virus
ALTLKGTSYK

SEQ ID NO: 167656 - protein, 10 aa, Yellow fever virus
LTLKGTSYKI

SEQ ID NO: 167657 - protein, 10 aa, Yellow fever virus
TLKGTSYKIC

SEQ ID NO: 167658 - protein, 10 aa, Yellow fever virus
LKGTSYKICT

SEQ ID NO: 167659 - protein, 10 aa, Yellow fever virus
KGTSYKICTD

SEQ ID NO: 167660 - protein, 10 aa, Yellow fever virus
GTSYKICTDK

SEQ ID NO: 167661 - protein, 10 aa, Yellow fever virus
TSYKICTDKM

SEQ ID NO: 167662 - protein, 10 aa, Yellow fever virus
SYKICTDKMF

SEQ ID NO: 167663 - protein, 10 aa, Yellow fever virus
YKICTDKMFF

SEQ ID NO: 167664 - protein, 10 aa, Yellow fever virus
KICTDKMFFV

SEQ ID NO: 167665 - protein, 10 aa, Yellow fever virus
ICTDKMFFVK

SEQ ID NO: 167666 - protein, 10 aa, Yellow fever virus
CTDKMFFVKN

SEQ ID NO: 167667 - protein, 10 aa, Yellow fever virus
TDKMFFVKNP

SEQ ID NO: 167668 - protein, 10 aa, Yellow fever virus
DKMFFVKNPT

SEQ ID NO: 167669 - protein, 10 aa, Yellow fever virus
KMFFVKNPTD

SEQ ID NO: 167670 - protein, 10 aa, Yellow fever virus
MFFVKNPTDT

SEQ ID NO: 167671 - protein, 10 aa, Yellow fever virus
FFVKNPTDTG

SEQ ID NO: 167672 - protein, 10 aa, Yellow fever virus
FVKNPTDTGH

SEQ ID NO: 167673 - protein, 10 aa, Yellow fever virus
VKNPTDTGHG

SEQ ID NO: 167674 - protein, 10 aa, Yellow fever virus
KNPTDTGHGT

SEQ ID NO: 167675 - protein, 10 aa, Yellow fever virus
NPTDTGHGTV

SEQ ID NO: 167676 - protein, 10 aa, Yellow fever virus
PTDTGHGTVV

SEQ ID NO: 167677 - protein, 10 aa, Yellow fever virus
TDTGHGTVVM

SEQ ID NO: 167678 - protein, 10 aa, Yellow fever virus
DTGHGTVVMQ

SEQ ID NO: 167679 - protein, 10 aa, Yellow fever virus
TGHGTVVMQV

SEQ ID NO: 167680 - protein, 10 aa, Yellow fever virus
GHGTVVMQVK

SEQ ID NO: 167681 - protein, 10 aa, Yellow fever virus
HGTVVMQVKV

SEQ ID NO: 167682 - protein, 10 aa, Yellow fever virus
GTVVMQVKVP

SEQ ID NO: 167683 - protein, 10 aa, Yellow fever virus
TVVMQVKVPK

SEQ ID NO: 167684 - protein, 10 aa, Yellow fever virus
VVMQVKVPKG

SEQ ID NO: 167685 - protein, 10 aa, Yellow fever virus
VMQVKVPKGA

SEQ ID NO: 167686 - protein, 10 aa, Yellow fever virus
MQVKVPKGAP

SEQ ID NO: 167687 - protein, 10 aa, Yellow fever virus
QVKVPKGAPC

SEQ ID NO: 167688 - protein, 10 aa, Yellow fever virus
VKVSKGAPCR

SEQ ID NO: 167689 - protein, 10 aa, Yellow fever virus
KVSKGAPCRI

SEQ ID NO: 167690 - protein, 10 aa, Yellow fever virus
VSKGAPCRIP

SEQ ID NO: 167691 - protein, 10 aa, Yellow fever virus
SKGAPCRIPV

SEQ ID NO: 167692 - protein, 10 aa, Yellow fever virus
KGAPCRIPVI

SEQ ID NO: 167693 - protein, 10 aa, Yellow fever virus
GAPCRIPVIV

SEQ ID NO: 167694 - protein, 10 aa, Yellow fever virus
APCRIPVIVA

SEQ ID NO: 167695 - protein, 10 aa, Yellow fever virus
PCRIPVIVAD

SEQ ID NO: 167696 - protein, 10 aa, Yellow fever virus
CRIPVIVADD

SEQ ID NO: 167697 - protein, 10 aa, Yellow fever virus
RIPVIVADDL

SEQ ID NO: 167698 - protein, 10 aa, Yellow fever virus
IPVIVADDLT

SEQ ID NO: 167699 - protein, 10 aa, Yellow fever virus
PVIVADDLTA

SEQ ID NO: 167700 - protein, 10 aa, Yellow fever virus
VIVADDLTAA

SEQ ID NO: 167701 - protein, 10 aa, Yellow fever virus
IVADDLTAAI

SEQ ID NO: 167702 - protein, 10 aa, Yellow fever virus
VADDLTAAIN

SEQ ID NO: 167703 - protein, 10 aa, Yellow fever virus
ADDLTAAINK

SEQ ID NO: 167704 - protein, 10 aa, Yellow fever virus
DDLTAAINKG

SEQ ID NO: 167705 - protein, 10 aa, Yellow fever virus
DLTAAINKGI

SEQ ID NO: 167706 - protein, 10 aa, Yellow fever virus
LTAAINKGIL

SEQ ID NO: 167707 - protein, 10 aa, Yellow fever virus
TAAINKGILV

SEQ ID NO: 167708 - protein, 10 aa, Yellow fever virus
AAINKGILVT

SEQ ID NO: 167709 - protein, 10 aa, Yellow fever virus
AINKGILVTV

SEQ ID NO: 167710 - protein, 10 aa, Yellow fever virus
INKGILVTVN

SEQ ID NO: 167711 - protein, 10 aa, Yellow fever virus
NKGILVTVNP

SEQ ID NO: 167712 - protein, 10 aa, Yellow fever virus
KGILVTVNPI

SEQ ID NO: 167713 - protein, 10 aa, Yellow fever virus
GILVTVNPIA

SEQ ID NO: 167714 - protein, 10 aa, Yellow fever virus
ILVTVNPIAS

SEQ ID NO: 167715 - protein, 10 aa, Yellow fever virus
LVTVNPIAST

SEQ ID NO: 167716 - protein, 10 aa, Yellow fever virus
VTVNPIASTN

SEQ ID NO: 167717 - protein, 10 aa, Yellow fever virus
TVNPIASTND

SEQ ID NO: 167718 - protein, 10 aa, Yellow fever virus
VNPIASTNDD

SEQ ID NO: 167719 - protein, 10 aa, Yellow fever virus
NPIASTNDDE

SEQ ID NO: 167720 - protein, 10 aa, Yellow fever virus
PIASTNDDEV

SEQ ID NO: 167721 - protein, 10 aa, Yellow fever virus
IASTNDDEVL

SEQ ID NO: 167722 - protein, 10 aa, Yellow fever virus
ASTNDDEVLI

SEQ ID NO: 167723 - protein, 10 aa, Yellow fever virus
STNDDEVLIE

SEQ ID NO: 167724 - protein, 10 aa, Yellow fever virus
TNDDEVLIEV

SEQ ID NO: 167725 - protein, 10 aa, Yellow fever virus
NDDEVLIEVN

SEQ ID NO: 167726 - protein, 10 aa, Yellow fever virus
DDEVLIEVNP

SEQ ID NO: 167727 - protein, 10 aa, Yellow fever virus
DEVLIEVNPP

SEQ ID NO: 167728 - protein, 10 aa, Yellow fever virus
EVLIEVNPPF

SEQ ID NO: 167729 - protein, 10 aa, Yellow fever virus
VLIEVNPPFG

SEQ ID NO: 167730 - protein, 10 aa, Yellow fever virus
LIEVNPPFGD

SEQ ID NO: 167731 - protein, 10 aa, Yellow fever virus
IEVNPPFGDS

SEQ ID NO: 167732 - protein, 10 aa, Yellow fever virus
EVNPPFGDSY

SEQ ID NO: 167733 - protein, 10 aa, Yellow fever virus
VNPPFGDSYI

SEQ ID NO: 167734 - protein, 10 aa, Yellow fever virus
NPPFGDSYII

SEQ ID NO: 167735 - protein, 10 aa, Yellow fever virus
PPFGDSYIIV

SEQ ID NO: 167736 - protein, 10 aa, Yellow fever virus
PFGDSYIIVG

SEQ ID NO: 167737 - protein, 10 aa, Yellow fever virus
FGDSYIIVGR

SEQ ID NO: 167738 - protein, 10 aa, Yellow fever virus
GDSYIIVGRG

SEQ ID NO: 167739 - protein, 10 aa, Yellow fever virus
DSYIIVGRGD

SEQ ID NO: 167740 - protein, 10 aa, Yellow fever virus
SYIIVGRGDS

SEQ ID NO: 167741 - protein, 10 aa, Yellow fever virus
YIIVGRGDSR

SEQ ID NO: 167742 - protein, 10 aa, Yellow fever virus
IIVGRGDSRL

SEQ ID NO: 167743 - protein, 10 aa, Yellow fever virus
IVGRGDSRLT

SEQ ID NO: 167744 - protein, 10 aa, Yellow fever virus
VGRGDSRLTY

SEQ ID NO: 167745 - protein, 10 aa, Yellow fever virus
GRGDSRLTYQ

SEQ ID NO: 167746 - protein, 10 aa, Yellow fever virus
RGDSRLTYQW

SEQ ID NO: 167747 - protein, 10 aa, Yellow fever virus
GDSRLTYQWH

SEQ ID NO: 167748 - protein, 10 aa, Yellow fever virus
DSRLTYQWHK

SEQ ID NO: 167749 - protein, 10 aa, Yellow fever virus
SRLTYQWHKE

SEQ ID NO: 167750 - protein, 10 aa, Yellow fever virus
RLTYQWHKEG

SEQ ID NO: 167751 - protein, 10 aa, Yellow fever virus
LTYQWHKEGS

SEQ ID NO: 167752 - protein, 10 aa, Yellow fever virus
TYQWHKEGSS

SEQ ID NO: 167753 - protein, 10 aa, Yellow fever virus
YQWHKEGSSI

SEQ ID NO: 167754 - protein, 10 aa, Yellow fever virus
QWHKEGSSIG

SEQ ID NO: 167755 - protein, 10 aa, Yellow fever virus
WHKEGSSIGK

SEQ ID NO: 167756 - protein, 10 aa, Yellow fever virus
HKEGSSIGKL

SEQ ID NO: 167757 - protein, 10 aa, Yellow fever virus
KEGSSIGKLF

SEQ ID NO: 167758 - protein, 10 aa, Yellow fever virus
EGSSIGKLFT

SEQ ID NO: 167759 - protein, 10 aa, Yellow fever virus
GSSIGKLFTQ

SEQ ID NO: 167760 - protein, 10 aa, Yellow fever virus
SSIGKLFTQT

SEQ ID NO: 167761 - protein, 10 aa, Yellow fever virus
SIGKLFTQTM

SEQ ID NO: 167762 - protein, 10 aa, Yellow fever virus
IGKLFTQTMK

SEQ ID NO: 167763 - protein, 10 aa, Yellow fever virus
GKLFTQTMKG

SEQ ID NO: 167764 - protein, 10 aa, Yellow fever virus
KLFTQTMKGV

SEQ ID NO: 167765 - protein, 10 aa, Yellow fever virus
LFTQTMKGVE

SEQ ID NO: 167766 - protein, 10 aa, Yellow fever virus
FTQTMKGVER

SEQ ID NO: 167767 - protein, 10 aa, Yellow fever virus
TQTMKGVERL

SEQ ID NO: 167768 - protein, 10 aa, Yellow fever virus
QTMKGVERLA

SEQ ID NO: 167769 - protein, 10 aa, Yellow fever virus
TMKGVERLAV

SEQ ID NO: 167770 - protein, 10 aa, Yellow fever virus
MKGVERLAVM

SEQ ID NO: 167771 - protein, 10 aa, Yellow fever virus
KGVERLAVMG

SEQ ID NO: 167772 - protein, 10 aa, Yellow fever virus
GVERLAVMGD

SEQ ID NO: 167773 - protein, 10 aa, Yellow fever virus
VERLAVMGDT

SEQ ID NO: 167774 - protein, 10 aa, Yellow fever virus
ERLAVMGDTA

SEQ ID NO: 167775 - protein, 10 aa, Yellow fever virus
RLAVMGDTAW

SEQ ID NO: 167776 - protein, 10 aa, Yellow fever virus
LAVMGDTAWD

SEQ ID NO: 167777 - protein, 10 aa, Yellow fever virus
AVMGDTAWDF

SEQ ID NO: 167778 - protein, 10 aa, Yellow fever virus
VMGDTAWDFS

SEQ ID NO: 167779 - protein, 10 aa, Yellow fever virus
MGDTAWDFSS

SEQ ID NO: 167780 - protein, 10 aa, Yellow fever virus
GDTAWDFSSA

SEQ ID NO: 167781 - protein, 10 aa, Yellow fever virus
DTAWDFSSAG

SEQ ID NO: 167782 - protein, 10 aa, Yellow fever virus
TAWDFSSAGG

SEQ ID NO: 167783 - protein, 10 aa, Yellow fever virus
AWDFSSAGGF

SEQ ID NO: 167784 - protein, 10 aa, Yellow fever virus
WDFSSAGGFF

SEQ ID NO: 167785 - protein, 10 aa, Yellow fever virus
DFSSAGGFFT

SEQ ID NO: 167786 - protein, 10 aa, Yellow fever virus
FSSAGGFFTS

SEQ ID NO: 167787 - protein, 10 aa, Yellow fever virus
SSAGGFFTSV

SEQ ID NO: 167788 - protein, 10 aa, Yellow fever virus
SAGGFFTSVG

SEQ ID NO: 167789 - protein, 10 aa, Yellow fever virus
AGGFFTSVGK

SEQ ID NO: 167790 - protein, 10 aa, Yellow fever virus
GGFFTSVGKG

SEQ ID NO: 167791 - protein, 10 aa, Yellow fever virus
GFFTSVGKGI

SEQ ID NO: 167792 - protein, 10 aa, Yellow fever virus
FFTSVGKGIH

SEQ ID NO: 167793 - protein, 10 aa, Yellow fever virus
FTSVGKGIHT

SEQ ID NO: 167794 - protein, 10 aa, Yellow fever virus
TSVGKGIHTV

SEQ ID NO: 167795 - protein, 10 aa, Yellow fever virus
SVGKGIHTVF

SEQ ID NO: 167796 - protein, 10 aa, Yellow fever virus
VGKGIHTVFG

SEQ ID NO: 167797 - protein, 10 aa, Yellow fever virus
GKGIHTVFGS

SEQ ID NO: 167798 - protein, 10 aa, Yellow fever virus
KGIHTVFGSA

SEQ ID NO: 167799 - protein, 10 aa, Yellow fever virus
GIHTVFGSAF

SEQ ID NO: 167800 - protein, 10 aa, Yellow fever virus
IHTVFGSAFQ

SEQ ID NO: 167801 - protein, 10 aa, Yellow fever virus
HTVFGSAFQG

SEQ ID NO: 167802 - protein, 10 aa, Yellow fever virus
TVFGSAFQGL

SEQ ID NO: 167803 - protein, 10 aa, Yellow fever virus
VFGSAFQGLF

SEQ ID NO: 167804 - protein, 10 aa, Yellow fever virus
FGSAFQGLFG

SEQ ID NO: 167805 - protein, 10 aa, Yellow fever virus
GSAFQGLFGG

SEQ ID NO: 167806 - protein, 10 aa, Yellow fever virus
SAFQGLFGGL

SEQ ID NO: 167807 - protein, 10 aa, Yellow fever virus
AFQGLFGGLN

SEQ ID NO: 167808 - protein, 10 aa, Yellow fever virus
FQGLFGGLNW

SEQ ID NO: 167809 - protein, 10 aa, Yellow fever virus
QGLFGGLNWI

SEQ ID NO: 167810 - protein, 10 aa, Yellow fever virus
GLFGGLNWIT

SEQ ID NO: 167811 - protein, 10 aa, Yellow fever virus
LFGGLNWITK

SEQ ID NO: 167812 - protein, 10 aa, Yellow fever virus
FGGLNWITKV

SEQ ID NO: 167813 - protein, 10 aa, Yellow fever virus
GGLNWITKVI

SEQ ID NO: 167814 - protein, 10 aa, Yellow fever virus
GLNWITKVIM

SEQ ID NO: 167815 - protein, 10 aa, Yellow fever virus
LNWITKVIMG

SEQ ID NO: 167816 - protein, 10 aa, Yellow fever virus
NWITKVIMGA

SEQ ID NO: 167817 - protein, 10 aa, Yellow fever virus
WITKVIMGAV

SEQ ID NO: 167818 - protein, 10 aa, Yellow fever virus
ITKVIMGAVL

SEQ ID NO: 167819 - protein, 10 aa, Yellow fever virus
TKVIMGAVLI

SEQ ID NO: 167820 - protein, 10 aa, Yellow fever virus
KVIMGAVLIW

SEQ ID NO: 167821 - protein, 10 aa, Yellow fever virus
VIMGAVLIWV

SEQ ID NO: 167822 - protein, 10 aa, Yellow fever virus
IMGAVLIWVG

SEQ ID NO: 167823 - protein, 10 aa, Yellow fever virus
MGAVLIWVGI

SEQ ID NO: 167824 - protein, 10 aa, Yellow fever virus
GAVLIWVGIN

SEQ ID NO: 167825 - protein, 10 aa, Yellow fever virus
AVLIWVGINT

SEQ ID NO: 167826 - protein, 10 aa, Yellow fever virus
VLIWVGINTR

SEQ ID NO: 167827 - protein, 10 aa, Yellow fever virus
LIWVGINTRN

SEQ ID NO: 167828 - protein, 10 aa, Yellow fever virus
IWVGINTRNM

SEQ ID NO: 167829 - protein, 10 aa, Yellow fever virus
WVGINTRNMT

SEQ ID NO: 167830 - protein, 10 aa, Yellow fever virus
VGINTRNMTM

SEQ ID NO: 167831 - protein, 10 aa, Yellow fever virus
GINTRNMTMS

SEQ ID NO: 167832 - protein, 10 aa, Yellow fever virus
INTRNMTMSM

SEQ ID NO: 167833 - protein, 10 aa, Yellow fever virus
NTRNMTMSMS

SEQ ID NO: 167834 - protein, 10 aa, Yellow fever virus
TRNMTMSMSM

SEQ ID NO: 167835 - protein, 10 aa, Yellow fever virus
RNMTMSMSMI

SEQ ID NO: 167836 - protein, 10 aa, Yellow fever virus
NMTMSMSMIL

SEQ ID NO: 167837 - protein, 10 aa, Yellow fever virus
MTMSMSMILV

SEQ ID NO: 167838 - protein, 10 aa, Yellow fever virus
TMSMSMILVG

SEQ ID NO: 167839 - protein, 10 aa, Yellow fever virus
MSMSMILVGV

SEQ ID NO: 167840 - protein, 10 aa, Yellow fever virus
SMSMILVGVI

SEQ ID NO: 167841 - protein, 10 aa, Yellow fever virus
MSMILVGVIM

SEQ ID NO: 167842 - protein, 10 aa, Yellow fever virus
SMILVGVIMM

SEQ ID NO: 167843 - protein, 10 aa, Yellow fever virus
MILVGVIMMF

SEQ ID NO: 167844 - protein, 10 aa, Yellow fever virus
ILVGVIMMFL

SEQ ID NO: 167845 - protein, 10 aa, Yellow fever virus
LVGVIMMFLS

SEQ ID NO: 167846 - protein, 10 aa, Yellow fever virus
VGVIMMFLSL

SEQ ID NO: 167847 - protein, 10 aa, Yellow fever virus
GVIMMFLSLG

SEQ ID NO: 167848 - protein, 10 aa, Yellow fever virus
VIMMFLSLGV

SEQ ID NO: 167849 - protein, 10 aa, Yellow fever virus
IMMFLSLGVG

SEQ ID NO: 167850 - protein, 10 aa, Yellow fever virus
MMFLSLGVGA

SEQ ID NO: 167851 - protein, 10 aa, Yellow fever virus
MFLSLGVGAD

SEQ ID NO: 167852 - protein, 10 aa, Yellow fever virus
FLSLGVGADQ

SEQ ID NO: 167853 - protein, 10 aa, Yellow fever virus
LSLGVGADQG

SEQ ID NO: 167854 - protein, 10 aa, Yellow fever virus
SLGVGADQGC

SEQ ID NO: 167855 - protein, 10 aa, Yellow fever virus
LGVGADQGCA

SEQ ID NO: 167856 - protein, 10 aa, Yellow fever virus
GVGADQGCAI

SEQ ID NO: 167857 - protein, 10 aa, Yellow fever virus
VGADQGCAIN

SEQ ID NO: 167858 - protein, 10 aa, Yellow fever virus
GADQGCAINF

SEQ ID NO: 167859 - protein, 10 aa, Yellow fever virus
ADQGCAINFG

SEQ ID NO: 167860 - protein, 10 aa, Yellow fever virus
DQGCAINFGK

SEQ ID NO: 167861 - protein, 10 aa, Yellow fever virus
QGCAINFGKR

SEQ ID NO: 167862 - protein, 10 aa, Yellow fever virus
GCAINFGKRE

SEQ ID NO: 167863 - protein, 10 aa, Yellow fever virus
CAINFGKREL

SEQ ID NO: 167864 - protein, 10 aa, Yellow fever virus
AINFGKRELK

SEQ ID NO: 167865 - protein, 10 aa, Yellow fever virus
INFGKRELKC

SEQ ID NO: 167866 - protein, 10 aa, Yellow fever virus
NFGKRELKCG

SEQ ID NO: 167867 - protein, 10 aa, Yellow fever virus
FGKRELKCGD

SEQ ID NO: 167868 - protein, 10 aa, Yellow fever virus
GKRELKCGDG

SEQ ID NO: 167869 - protein, 10 aa, Yellow fever virus
KRELKCGDGI

SEQ ID NO: 167870 - protein, 10 aa, Yellow fever virus
RELKCGDGIF

SEQ ID NO: 167871 - protein, 10 aa, Yellow fever virus
ELKCGDGIFI

SEQ ID NO: 167872 - protein, 10 aa, Yellow fever virus
LKCGDGIFIF

SEQ ID NO: 167873 - protein, 10 aa, Yellow fever virus
KCGDGIFIFR

SEQ ID NO: 167874 - protein, 10 aa, Yellow fever virus
CGDGIFIFRD

SEQ ID NO: 167875 - protein, 10 aa, Yellow fever virus
GDGIFIFRDS

SEQ ID NO: 167876 - protein, 10 aa, Yellow fever virus
DGIFIFRDSD

SEQ ID NO: 167877 - protein, 10 aa, Yellow fever virus
GIFIFRDSDD

SEQ ID NO: 167878 - protein, 10 aa, Yellow fever virus
IFIFRDSDDW

SEQ ID NO: 167879 - protein, 10 aa, Yellow fever virus
FIFRDSDDWL

SEQ ID NO: 167880 - protein, 10 aa, Yellow fever virus
IFRDSDDWLN

SEQ ID NO: 167881 - protein, 10 aa, Yellow fever virus
FRDSDDWLNK

SEQ ID NO: 167882 - protein, 10 aa, Yellow fever virus
RDSDDWLNKY

SEQ ID NO: 167883 - protein, 10 aa, Yellow fever virus
DSDDWLNKYS

SEQ ID NO: 167884 - protein, 10 aa, Yellow fever virus
SDDWLNKYSY

SEQ ID NO: 167885 - protein, 10 aa, Yellow fever virus
DDWLNKYSYY

SEQ ID NO: 167886 - protein, 10 aa, Yellow fever virus
DWLNKYSYYP

SEQ ID NO: 167887 - protein, 10 aa, Yellow fever virus
WLNKYSYYPE

SEQ ID NO: 167888 - protein, 10 aa, Yellow fever virus
LNKYSYYPED

SEQ ID NO: 167889 - protein, 10 aa, Yellow fever virus
NKYSYYPEDP

SEQ ID NO: 167890 - protein, 10 aa, Yellow fever virus
KYSYYPEDPV

SEQ ID NO: 167891 - protein, 10 aa, Yellow fever virus
YSYYPEDPVK

SEQ ID NO: 167892 - protein, 10 aa, Yellow fever virus
SYYPEDPVKL

SEQ ID NO: 167893 - protein, 10 aa, Yellow fever virus
YYPEDPVKLA

SEQ ID NO: 167894 - protein, 10 aa, Yellow fever virus
YPEDPVKLAS

SEQ ID NO: 167895 - protein, 10 aa, Yellow fever virus
PEDPVKLASI

SEQ ID NO: 167896 - protein, 10 aa, Yellow fever virus
EDPVKLASIV

SEQ ID NO: 167897 - protein, 10 aa, Yellow fever virus
DPVKLASIVK

SEQ ID NO: 167898 - protein, 10 aa, Yellow fever virus
PVKLASIVKA

SEQ ID NO: 167899 - protein, 10 aa, Yellow fever virus
VKLASIVKAS

SEQ ID NO: 167900 - protein, 10 aa, Yellow fever virus
KLASIVKASF

SEQ ID NO: 167901 - protein, 10 aa, Yellow fever virus
LASIVKASFE

SEQ ID NO: 167902 - protein, 10 aa, Yellow fever virus
ASIVKASFEE

SEQ ID NO: 167903 - protein, 10 aa, Yellow fever virus
SIVKASFEEG

SEQ ID NO: 167904 - protein, 10 aa, Yellow fever virus
IVKASFEEGK

SEQ ID NO: 167905 - protein, 10 aa, Yellow fever virus
VKASFEEGKC

SEQ ID NO: 167906 - protein, 10 aa, Yellow fever virus
KASFEEGKCG

SEQ ID NO: 167907 - protein, 10 aa, Yellow fever virus
ASFEEGKCGL

SEQ ID NO: 167908 - protein, 10 aa, Yellow fever virus
SFEEGKCGLN

SEQ ID NO: 167909 - protein, 10 aa, Yellow fever virus
FEEGKCGLNS

SEQ ID NO: 167910 - protein, 10 aa, Yellow fever virus
EEGKCGLNSV

SEQ ID NO: 167911 - protein, 10 aa, Yellow fever virus
EGKCGLNSVD

SEQ ID NO: 167912 - protein, 10 aa, Yellow fever virus
GKCGLNSVDS

SEQ ID NO: 167913 - protein, 10 aa, Yellow fever virus
KCGLNSVDSL

SEQ ID NO: 167914 - protein, 10 aa, Yellow fever virus
CGLNSVDSLE

SEQ ID NO: 167915 - protein, 10 aa, Yellow fever virus
GLNSVDSLEH

SEQ ID NO: 167916 - protein, 10 aa, Yellow fever virus
LNSVDSLEHE

SEQ ID NO: 167917 - protein, 10 aa, Yellow fever virus
NSVDSLEHEM

SEQ ID NO: 167918 - protein, 10 aa, Yellow fever virus
SVDSLEHEMW

SEQ ID NO: 167919 - protein, 10 aa, Yellow fever virus
VDSLEHEMWR

SEQ ID NO: 167920 - protein, 10 aa, Yellow fever virus
DSLEHEMWRS

SEQ ID NO: 167921 - protein, 10 aa, Yellow fever virus
SLEHEMWRSR

SEQ ID NO: 167922 - protein, 10 aa, Yellow fever virus
LEHEMWRSRA

SEQ ID NO: 167923 - protein, 10 aa, Yellow fever virus
EHEMWRSRAD

SEQ ID NO: 167924 - protein, 10 aa, Yellow fever virus
HEMWRSRADE

SEQ ID NO: 167925 - protein, 10 aa, Yellow fever virus
EMWRSRADEI

SEQ ID NO: 167926 - protein, 10 aa, Yellow fever virus
MWRSRADEIN

SEQ ID NO: 167927 - protein, 10 aa, Yellow fever virus
WRSRADEINA

SEQ ID NO: 167928 - protein, 10 aa, Yellow fever virus
RSRADEINAI

SEQ ID NO: 167929 - protein, 10 aa, Yellow fever virus
SRADEINAIF

SEQ ID NO: 167930 - protein, 10 aa, Yellow fever virus
RADEINAIFE

SEQ ID NO: 167931 - protein, 10 aa, Yellow fever virus
ADEINAIFEE

SEQ ID NO: 167932 - protein, 10 aa, Yellow fever virus
DEINAIFEEN

SEQ ID NO: 167933 - protein, 10 aa, Yellow fever virus
EINAIFEENE

SEQ ID NO: 167934 - protein, 10 aa, Yellow fever virus
INAIFEENEV

SEQ ID NO: 167935 - protein, 10 aa, Yellow fever virus
NAIFEENEVD

SEQ ID NO: 167936 - protein, 10 aa, Yellow fever virus
AIFEENEVDI

SEQ ID NO: 167937 - protein, 10 aa, Yellow fever virus
IFEENEVDIS

SEQ ID NO: 167938 - protein, 10 aa, Yellow fever virus
FEENEVDISV

SEQ ID NO: 167939 - protein, 10 aa, Yellow fever virus
EENEVDISVV

SEQ ID NO: 167940 - protein, 10 aa, Yellow fever virus
ENEVDISVVV

SEQ ID NO: 167941 - protein, 10 aa, Yellow fever virus
NEVDISVVVQ

SEQ ID NO: 167942 - protein, 10 aa, Yellow fever virus
EVDISVVVQD

SEQ ID NO: 167943 - protein, 10 aa, Yellow fever virus
VDISVVVQDP

SEQ ID NO: 167944 - protein, 10 aa, Yellow fever virus
DISVVVQDPK

SEQ ID NO: 167945 - protein, 10 aa, Yellow fever virus
ISVVVQDPKN

SEQ ID NO: 167946 - protein, 10 aa, Yellow fever virus
SVVVQDPKNV

SEQ ID NO: 167947 - protein, 10 aa, Yellow fever virus
VVVQDPKNVY

SEQ ID NO: 167948 - protein, 10 aa, Yellow fever virus
VVQDPKNVYQ

SEQ ID NO: 167949 - protein, 10 aa, Yellow fever virus
VQDPKNVYQR

SEQ ID NO: 167950 - protein, 10 aa, Yellow fever virus
QDPKNVYQRG

SEQ ID NO: 167951 - protein, 10 aa, Yellow fever virus
DPKNVYQRGT

SEQ ID NO: 167952 - protein, 10 aa, Yellow fever virus
PKNVYQRGTH

SEQ ID NO: 167953 - protein, 10 aa, Yellow fever virus
KNVYQRGTHP

SEQ ID NO: 167954 - protein, 10 aa, Yellow fever virus
NVYQRGTHPF

SEQ ID NO: 167955 - protein, 10 aa, Yellow fever virus
VYQRGTHPFS

SEQ ID NO: 167956 - protein, 10 aa, Yellow fever virus
YQRGTHPFSR

SEQ ID NO: 167957 - protein, 10 aa, Yellow fever virus
QRGTHPFSRI

SEQ ID NO: 167958 - protein, 10 aa, Yellow fever virus
RGTHPFSRIR

SEQ ID NO: 167959 - protein, 10 aa, Yellow fever virus
GTHPFSRIRD

SEQ ID NO: 167960 - protein, 10 aa, Yellow fever virus
THPFSRIRDG

SEQ ID NO: 167961 - protein, 10 aa, Yellow fever virus
HPFSRIRDGL

SEQ ID NO: 167962 - protein, 10 aa, Yellow fever virus
PFSRIRDGLQ

SEQ ID NO: 167963 - protein, 10 aa, Yellow fever virus
FSRIRDGLQY

SEQ ID NO: 167964 - protein, 10 aa, Yellow fever virus
SRIRDGLQYG

SEQ ID NO: 167965 - protein, 10 aa, Yellow fever virus
RIRDGLQYGW

SEQ ID NO: 167966 - protein, 10 aa, Yellow fever virus
IRDGLQYGWK

SEQ ID NO: 167967 - protein, 10 aa, Yellow fever virus
RDGLQYGWKT

SEQ ID NO: 167968 - protein, 10 aa, Yellow fever virus
DGLQYGWKTW

SEQ ID NO: 167969 - protein, 10 aa, Yellow fever virus
GLQYGWKTWG

SEQ ID NO: 167970 - protein, 10 aa, Yellow fever virus
LQYGWKTWGK

SEQ ID NO: 167971 - protein, 10 aa, Yellow fever virus
QYGWKTWGKN

SEQ ID NO: 167972 - protein, 10 aa, Yellow fever virus
YGWKTWGKNL

SEQ ID NO: 167973 - protein, 10 aa, Yellow fever virus
GWKTWGKNLV

SEQ ID NO: 167974 - protein, 10 aa, Yellow fever virus
WKTWGKNLVF

SEQ ID NO: 167975 - protein, 10 aa, Yellow fever virus
KTWGKNLVFS

SEQ ID NO: 167976 - protein, 10 aa, Yellow fever virus
TWGKNLVFSP

SEQ ID NO: 167977 - protein, 10 aa, Yellow fever virus
WGKNLVFSPG

SEQ ID NO: 167978 - protein, 10 aa, Yellow fever virus
GKNLVFSPGR

SEQ ID NO: 167979 - protein, 10 aa, Yellow fever virus
KNLVFSPGRK

SEQ ID NO: 167980 - protein, 10 aa, Yellow fever virus
NLVFSPGRKN

SEQ ID NO: 167981 - protein, 10 aa, Yellow fever virus
LVFSPGRKNG

SEQ ID NO: 167982 - protein, 10 aa, Yellow fever virus
VFSPGRKNGS

SEQ ID NO: 167983 - protein, 10 aa, Yellow fever virus
FSPGRKNGSF

SEQ ID NO: 167984 - protein, 10 aa, Yellow fever virus
SPGRKNGSFI

SEQ ID NO: 167985 - protein, 10 aa, Yellow fever virus
PGRKNGSFII

SEQ ID NO: 167986 - protein, 10 aa, Yellow fever virus
GRKNGSFIID

SEQ ID NO: 167987 - protein, 10 aa, Yellow fever virus
RKNGSFIIDG

SEQ ID NO: 167988 - protein, 10 aa, Yellow fever virus
KNGSFIIDGK

SEQ ID NO: 167989 - protein, 10 aa, Yellow fever virus
NGSFIIDGKS

SEQ ID NO: 167990 - protein, 10 aa, Yellow fever virus
GSFIIDGKSR

SEQ ID NO: 167991 - protein, 10 aa, Yellow fever virus
SFIIDGKSRK

SEQ ID NO: 167992 - protein, 10 aa, Yellow fever virus
FIIDGKSRKE

SEQ ID NO: 167993 - protein, 10 aa, Yellow fever virus
IIDGKSRKEC

SEQ ID NO: 167994 - protein, 10 aa, Yellow fever virus
IDGKSRKECP

SEQ ID NO: 167995 - protein, 10 aa, Yellow fever virus
DGKSRKECPF

SEQ ID NO: 167996 - protein, 10 aa, Yellow fever virus
GKSRKECPFS

SEQ ID NO: 167997 - protein, 10 aa, Yellow fever virus
KSRKECPFSN

SEQ ID NO: 167998 - protein, 10 aa, Yellow fever virus
SRKECPFSNR

SEQ ID NO: 167999 - protein, 10 aa, Yellow fever virus
RKECPFSNRV

SEQ ID NO: 168000 - protein, 10 aa, Yellow fever virus
KECPFSNRVW

SEQ ID NO: 168001 - protein, 10 aa, Yellow fever virus
ECPFSNRVWN

SEQ ID NO: 168002 - protein, 10 aa, Yellow fever virus
CPFSNRVWNS

SEQ ID NO: 168003 - protein, 10 aa, Yellow fever virus
PFSNRVWNSF

SEQ ID NO: 168004 - protein, 10 aa, Yellow fever virus
FSNRVWNSFQ

SEQ ID NO: 168005 - protein, 10 aa, Yellow fever virus
SNRVWNSFQI

SEQ ID NO: 168006 - protein, 10 aa, Yellow fever virus
NRVWNSFQIE

SEQ ID NO: 168007 - protein, 10 aa, Yellow fever virus
RVWNSFQIEE

SEQ ID NO: 168008 - protein, 10 aa, Yellow fever virus
VWNSFQIEEF

SEQ ID NO: 168009 - protein, 10 aa, Yellow fever virus
WNSFQIEEFG

SEQ ID NO: 168010 - protein, 10 aa, Yellow fever virus
NSFQIEEFGT

SEQ ID NO: 168011 - protein, 10 aa, Yellow fever virus
SFQIEEFGTG

SEQ ID NO: 168012 - protein, 10 aa, Yellow fever virus
FQIEEFGTGV

SEQ ID NO: 168013 - protein, 10 aa, Yellow fever virus
QIEEFGTGVF

SEQ ID NO: 168014 - protein, 10 aa, Yellow fever virus
IEEFGTGVFT

SEQ ID NO: 168015 - protein, 10 aa, Yellow fever virus
EEFGTGVFTT

SEQ ID NO: 168016 - protein, 10 aa, Yellow fever virus
EFGTGVFTTR

SEQ ID NO: 168017 - protein, 10 aa, Yellow fever virus
FGTGVFTTRV

SEQ ID NO: 168018 - protein, 10 aa, Yellow fever virus
GTGVFTTRVY

SEQ ID NO: 168019 - protein, 10 aa, Yellow fever virus
TGVFTTRVYM

SEQ ID NO: 168020 - protein, 10 aa, Yellow fever virus
GVFTTRVYMD

SEQ ID NO: 168021 - protein, 10 aa, Yellow fever virus
VFTTRVYMDA

SEQ ID NO: 168022 - protein, 10 aa, Yellow fever virus
FTTRVYMDAV

SEQ ID NO: 168023 - protein, 10 aa, Yellow fever virus
TTRVYMDAVF

SEQ ID NO: 168024 - protein, 10 aa, Yellow fever virus
TRVYMDAVFE

SEQ ID NO: 168025 - protein, 10 aa, Yellow fever virus
RVYMDAVFEY

SEQ ID NO: 168026 - protein, 10 aa, Yellow fever virus
VYMDAVFEYT

SEQ ID NO: 168027 - protein, 10 aa, Yellow fever virus
YMDAVFEYTI

SEQ ID NO: 168028 - protein, 10 aa, Yellow fever virus
MDAVFEYTID

SEQ ID NO: 168029 - protein, 10 aa, Yellow fever virus
DAVFEYTIDC

SEQ ID NO: 168030 - protein, 10 aa, Yellow fever virus
AVFEYTIDCD

SEQ ID NO: 168031 - protein, 10 aa, Yellow fever virus
VFEYTIDCDG

SEQ ID NO: 168032 - protein, 10 aa, Yellow fever virus
FEYTIDCDGS

SEQ ID NO: 168033 - protein, 10 aa, Yellow fever virus
EYTIDCDGSI

SEQ ID NO: 168034 - protein, 10 aa, Yellow fever virus
YTIDCDGSIL

SEQ ID NO: 168035 - protein, 10 aa, Yellow fever virus
TIDCDGSILG

SEQ ID NO: 168036 - protein, 10 aa, Yellow fever virus
IDCDGSILGA

SEQ ID NO: 168037 - protein, 10 aa, Yellow fever virus
DCDGSILGAA

SEQ ID NO: 168038 - protein, 10 aa, Yellow fever virus
CDGSILGAAV

SEQ ID NO: 168039 - protein, 10 aa, Yellow fever virus
DGSILGAAVN

SEQ ID NO: 168040 - protein, 10 aa, Yellow fever virus
GSILGAAVNG

SEQ ID NO: 168041 - protein, 10 aa, Yellow fever virus
SILGAAVNGK

SEQ ID NO: 168042 - protein, 10 aa, Yellow fever virus
ILGAAVNGKK

SEQ ID NO: 168043 - protein, 10 aa, Yellow fever virus
LGAAVNGKKS

SEQ ID NO: 168044 - protein, 10 aa, Yellow fever virus
GAAVNGKKSA

SEQ ID NO: 168045 - protein, 10 aa, Yellow fever virus
AAVNGKKSAH

SEQ ID NO: 168046 - protein, 10 aa, Yellow fever virus
AVNGKKSAHG

SEQ ID NO: 168047 - protein, 10 aa, Yellow fever virus
VNGKKSAHGS

SEQ ID NO: 168048 - protein, 10 aa, Yellow fever virus
NGKKSAHGSP

SEQ ID NO: 168049 - protein, 10 aa, Yellow fever virus
GKKSAHGSPT

SEQ ID NO: 168050 - protein, 10 aa, Yellow fever virus
KKSAHGSPTF

SEQ ID NO: 168051 - protein, 10 aa, Yellow fever virus
KSAHGSPTFW

SEQ ID NO: 168052 - protein, 10 aa, Yellow fever virus
SAHGSPTFWM

SEQ ID NO: 168053 - protein, 10 aa, Yellow fever virus
AHGSPTFWMG

SEQ ID NO: 168054 - protein, 10 aa, Yellow fever virus
HGSPTFWMGS

SEQ ID NO: 168055 - protein, 10 aa, Yellow fever virus
GSPTFWMGSH

SEQ ID NO: 168056 - protein, 10 aa, Yellow fever virus
SPTFWMGSHE

SEQ ID NO: 168057 - protein, 10 aa, Yellow fever virus
PTFWMGSHEV

SEQ ID NO: 168058 - protein, 10 aa, Yellow fever virus
TFWMGSHEVN

SEQ ID NO: 168059 - protein, 10 aa, Yellow fever virus
FWMGSHEVNG

SEQ ID NO: 168060 - protein, 10 aa, Yellow fever virus
WMGSHEVNGT

SEQ ID NO: 168061 - protein, 10 aa, Yellow fever virus
MGSHEVNGTW

SEQ ID NO: 168062 - protein, 10 aa, Yellow fever virus
GSHEVNGTWM

SEQ ID NO: 168063 - protein, 10 aa, Yellow fever virus
SHEVNGTWMI

SEQ ID NO: 168064 - protein, 10 aa, Yellow fever virus
HEVNGTWMIH

SEQ ID NO: 168065 - protein, 10 aa, Yellow fever virus
EVNGTWMIHT

SEQ ID NO: 168066 - protein, 10 aa, Yellow fever virus
VNGTWMIHTL

SEQ ID NO: 168067 - protein, 10 aa, Yellow fever virus
NGTWMIHTLE

SEQ ID NO: 168068 - protein, 10 aa, Yellow fever virus
GTWMIHTLEA

SEQ ID NO: 168069 - protein, 10 aa, Yellow fever virus
TWMIHTLEAL

SEQ ID NO: 168070 - protein, 10 aa, Yellow fever virus
WMIHTLEALD

SEQ ID NO: 168071 - protein, 10 aa, Yellow fever virus
MIHTLEALDY

SEQ ID NO: 168072 - protein, 10 aa, Yellow fever virus
IHTLEALDYK

SEQ ID NO: 168073 - protein, 10 aa, Yellow fever virus
HTLEALDYKE

SEQ ID NO: 168074 - protein, 10 aa, Yellow fever virus
TLEALDYKEC

SEQ ID NO: 168075 - protein, 10 aa, Yellow fever virus
LEALDYKECE

SEQ ID NO: 168076 - protein, 10 aa, Yellow fever virus
EALDYKECEW

SEQ ID NO: 168077 - protein, 10 aa, Yellow fever virus
ALDYKECEWP

SEQ ID NO: 168078 - protein, 10 aa, Yellow fever virus
LDYKECEWPL

SEQ ID NO: 168079 - protein, 10 aa, Yellow fever virus
DYKECEWPLT

SEQ ID NO: 168080 - protein, 10 aa, Yellow fever virus
YKECEWPLTH

SEQ ID NO: 168081 - protein, 10 aa, Yellow fever virus
KECEWPLTHT

SEQ ID NO: 168082 - protein, 10 aa, Yellow fever virus
ECEWPLTHTI

SEQ ID NO: 168083 - protein, 10 aa, Yellow fever virus
CEWPLTHTIG

SEQ ID NO: 168084 - protein, 10 aa, Yellow fever virus
EWPLTHTIGT

SEQ ID NO: 168085 - protein, 10 aa, Yellow fever virus
WPLTHTIGTS

SEQ ID NO: 168086 - protein, 10 aa, Yellow fever virus
PLTHTIGTSV

SEQ ID NO: 168087 - protein, 10 aa, Yellow fever virus
LTHTIGTSVE

SEQ ID NO: 168088 - protein, 10 aa, Yellow fever virus
THTIGTSVEE

SEQ ID NO: 168089 - protein, 10 aa, Yellow fever virus
HTIGTSVEES

SEQ ID NO: 168090 - protein, 10 aa, Yellow fever virus
TIGTSVEESE

SEQ ID NO: 168091 - protein, 10 aa, Yellow fever virus
IGTSVEESEM

SEQ ID NO: 168092 - protein, 10 aa, Yellow fever virus
GTSVEESEMF

SEQ ID NO: 168093 - protein, 10 aa, Yellow fever virus
TSVEESEMFM

SEQ ID NO: 168094 - protein, 10 aa, Yellow fever virus
SVEESEMFMP

SEQ ID NO: 168095 - protein, 10 aa, Yellow fever virus
VEESEMFMPR

SEQ ID NO: 168096 - protein, 10 aa, Yellow fever virus
EESEMFMPRS

SEQ ID NO: 168097 - protein, 10 aa, Yellow fever virus
ESEMFMPRSI

SEQ ID NO: 168098 - protein, 10 aa, Yellow fever virus
SEMFMPRSIG

SEQ ID NO: 168099 - protein, 10 aa, Yellow fever virus
EMFMPRSIGG

SEQ ID NO: 168100 - protein, 10 aa, Yellow fever virus
MFMPRSIGGP

SEQ ID NO: 168101 - protein, 10 aa, Yellow fever virus
FMPRSIGGPV

SEQ ID NO: 168102 - protein, 10 aa, Yellow fever virus
MPRSIGGPVS

SEQ ID NO: 168103 - protein, 10 aa, Yellow fever virus
PRSIGGPVSS

SEQ ID NO: 168104 - protein, 10 aa, Yellow fever virus
RSIGGPVSSH

SEQ ID NO: 168105 - protein, 10 aa, Yellow fever virus
SIGGPVSSHN

SEQ ID NO: 168106 - protein, 10 aa, Yellow fever virus
IGGPVSSHNH

SEQ ID NO: 168107 - protein, 10 aa, Yellow fever virus
GGPVSSHNHI

SEQ ID NO: 168108 - protein, 10 aa, Yellow fever virus
GPVSSHNHIP

SEQ ID NO: 168109 - protein, 10 aa, Yellow fever virus
PVSSHNHIPG

SEQ ID NO: 168110 - protein, 10 aa, Yellow fever virus
VSSHNHIPGY

SEQ ID NO: 168111 - protein, 10 aa, Yellow fever virus
SSHNHIPGYK

SEQ ID NO: 168112 - protein, 10 aa, Yellow fever virus
SHNHIPGYKV

SEQ ID NO: 168113 - protein, 10 aa, Yellow fever virus
HNHIPGYKVQ

SEQ ID NO: 168114 - protein, 10 aa, Yellow fever virus
NHIPGYKVQT

SEQ ID NO: 168115 - protein, 10 aa, Yellow fever virus
HIPGYKVQTN

SEQ ID NO: 168116 - protein, 10 aa, Yellow fever virus
IPGYKVQTNG

SEQ ID NO: 168117 - protein, 10 aa, Yellow fever virus
PGYKVQTNGP

SEQ ID NO: 168118 - protein, 10 aa, Yellow fever virus
GYKVQTNGPW

SEQ ID NO: 168119 - protein, 10 aa, Yellow fever virus
YKVQTNGPWM

SEQ ID NO: 168120 - protein, 10 aa, Yellow fever virus
KVQTNGPWMQ

SEQ ID NO: 168121 - protein, 10 aa, Yellow fever virus
VQTNGPWMQV

SEQ ID NO: 168122 - protein, 10 aa, Yellow fever virus
QTNGPWMQVP

SEQ ID NO: 168123 - protein, 10 aa, Yellow fever virus
TNGPWMQVPL

SEQ ID NO: 168124 - protein, 10 aa, Yellow fever virus
NGPWMQVPLE

SEQ ID NO: 168125 - protein, 10 aa, Yellow fever virus
GPWMQVPLEV

SEQ ID NO: 168126 - protein, 10 aa, Yellow fever virus
PWMQVPLEVK

SEQ ID NO: 168127 - protein, 10 aa, Yellow fever virus
WMQVPLEVKR

SEQ ID NO: 168128 - protein, 10 aa, Yellow fever virus
MQVPLEVKRE

SEQ ID NO: 168129 - protein, 10 aa, Yellow fever virus
QVPLEVKREA

SEQ ID NO: 168130 - protein, 10 aa, Yellow fever virus
VPLEVKREAC

SEQ ID NO: 168131 - protein, 10 aa, Yellow fever virus
PLEVKREACP

SEQ ID NO: 168132 - protein, 10 aa, Yellow fever virus
LEVKREACPG

SEQ ID NO: 168133 - protein, 10 aa, Yellow fever virus
EVKREACPGT

SEQ ID NO: 168134 - protein, 10 aa, Yellow fever virus
VKREACPGTS

SEQ ID NO: 168135 - protein, 10 aa, Yellow fever virus
KREACPGTSV

SEQ ID NO: 168136 - protein, 10 aa, Yellow fever virus
REACPGTSVI

SEQ ID NO: 168137 - protein, 10 aa, Yellow fever virus
EACPGTSVII

SEQ ID NO: 168138 - protein, 10 aa, Yellow fever virus
ACPGTSVIID

SEQ ID NO: 168139 - protein, 10 aa, Yellow fever virus
CPGTSVIIDG

SEQ ID NO: 168140 - protein, 10 aa, Yellow fever virus
PGTSVIIDGN

SEQ ID NO: 168141 - protein, 10 aa, Yellow fever virus
GTSVIIDGNC

SEQ ID NO: 168142 - protein, 10 aa, Yellow fever virus
TSVIIDGNCD

SEQ ID NO: 168143 - protein, 10 aa, Yellow fever virus
SVIIDGNCDG

SEQ ID NO: 168144 - protein, 10 aa, Yellow fever virus
VIIDGNCDGR

SEQ ID NO: 168145 - protein, 10 aa, Yellow fever virus
IIDGNCDGRG

SEQ ID NO: 168146 - protein, 10 aa, Yellow fever virus
IDGNCDGRGK

SEQ ID NO: 168147 - protein, 10 aa, Yellow fever virus
DGNCDGRGKS

SEQ ID NO: 168148 - protein, 10 aa, Yellow fever virus
GNCDGRGKST

SEQ ID NO: 168149 - protein, 10 aa, Yellow fever virus
NCDGRGKSTR

SEQ ID NO: 168150 - protein, 10 aa, Yellow fever virus
CDGRGKSTRS

SEQ ID NO: 168151 - protein, 10 aa, Yellow fever virus
DGRGKSTRST

SEQ ID NO: 168152 - protein, 10 aa, Yellow fever virus
GRGKSTRSTT

SEQ ID NO: 168153 - protein, 10 aa, Yellow fever virus
RGKSTRSTTD

SEQ ID NO: 168154 - protein, 10 aa, Yellow fever virus
GKSTRSTTDS

SEQ ID NO: 168155 - protein, 10 aa, Yellow fever virus
KSTRSTTDSG

SEQ ID NO: 168156 - protein, 10 aa, Yellow fever virus
STRSTTDSGK

SEQ ID NO: 168157 - protein, 10 aa, Yellow fever virus
TRSTTDSGKV

SEQ ID NO: 168158 - protein, 10 aa, Yellow fever virus
RSTTDSGKVI

SEQ ID NO: 168159 - protein, 10 aa, Yellow fever virus
STTDSGKVIP

SEQ ID NO: 168160 - protein, 10 aa, Yellow fever virus
TTDSGKVIPE

SEQ ID NO: 168161 - protein, 10 aa, Yellow fever virus
TDSGKVIPEW

SEQ ID NO: 168162 - protein, 10 aa, Yellow fever virus
DSGKVIPEWC

SEQ ID NO: 168163 - protein, 10 aa, Yellow fever virus
SGKVIPEWCC

SEQ ID NO: 168164 - protein, 10 aa, Yellow fever virus
GKVIPEWCCR

SEQ ID NO: 168165 - protein, 10 aa, Yellow fever virus
KVIPEWCCRS

SEQ ID NO: 168166 - protein, 10 aa, Yellow fever virus
VIPEWCCRSC

SEQ ID NO: 168167 - protein, 10 aa, Yellow fever virus
IPEWCCRSCT

SEQ ID NO: 168168 - protein, 10 aa, Yellow fever virus
PEWCCRSCTM

SEQ ID NO: 168169 - protein, 10 aa, Yellow fever virus
EWCCRSCTMP

SEQ ID NO: 168170 - protein, 10 aa, Yellow fever virus
WCCRSCTMPP

SEQ ID NO: 168171 - protein, 10 aa, Yellow fever virus
CCRSCTMPPV

SEQ ID NO: 168172 - protein, 10 aa, Yellow fever virus
CRSCTMPPVS

SEQ ID NO: 168173 - protein, 10 aa, Yellow fever virus
RSCTMPPVSF

SEQ ID NO: 168174 - protein, 10 aa, Yellow fever virus
SCTMPPVSFH

SEQ ID NO: 168175 - protein, 10 aa, Yellow fever virus
CTMPPVSFHG

SEQ ID NO: 168176 - protein, 10 aa, Yellow fever virus
TMPPVSFHGS

SEQ ID NO: 168177 - protein, 10 aa, Yellow fever virus
MPPVSFHGSD

SEQ ID NO: 168178 - protein, 10 aa, Yellow fever virus
PPVSFHGSDG

SEQ ID NO: 168179 - protein, 10 aa, Yellow fever virus
PVSFHGSDGC

SEQ ID NO: 168180 - protein, 10 aa, Yellow fever virus
VSFHGSDGCW

SEQ ID NO: 168181 - protein, 10 aa, Yellow fever virus
SFHGSDGCWY

SEQ ID NO: 168182 - protein, 10 aa, Yellow fever virus
FHGSDGCWYP

SEQ ID NO: 168183 - protein, 10 aa, Yellow fever virus
HGSDGCWYPM

SEQ ID NO: 168184 - protein, 10 aa, Yellow fever virus
GSDGCWYPME

SEQ ID NO: 168185 - protein, 10 aa, Yellow fever virus
SDGCWYPMEI

SEQ ID NO: 168186 - protein, 10 aa, Yellow fever virus
DGCWYPMEIR

SEQ ID NO: 168187 - protein, 10 aa, Yellow fever virus
GCWYPMEIRP

SEQ ID NO: 168188 - protein, 10 aa, Yellow fever virus
CWYPMEIRPR

SEQ ID NO: 168189 - protein, 10 aa, Yellow fever virus
WYPMEIRPRK

SEQ ID NO: 168190 - protein, 10 aa, Yellow fever virus
YPMEIRPRKT

SEQ ID NO: 168191 - protein, 10 aa, Yellow fever virus
PMEIRPRKTH

SEQ ID NO: 168192 - protein, 10 aa, Yellow fever virus
MEIRPRKTHE

SEQ ID NO: 168193 - protein, 10 aa, Yellow fever virus
EIRPRKTHES

SEQ ID NO: 168194 - protein, 10 aa, Yellow fever virus
IRPRKTHESH

SEQ ID NO: 168195 - protein, 10 aa, Yellow fever virus
RPRKTHESHL

SEQ ID NO: 168196 - protein, 10 aa, Yellow fever virus
PRKTHESHLV

SEQ ID NO: 168197 - protein, 10 aa, Yellow fever virus
RKTHESHLVR

SEQ ID NO: 168198 - protein, 10 aa, Yellow fever virus
KTHESHLVRS

SEQ ID NO: 168199 - protein, 10 aa, Yellow fever virus
THESHLVRSW

SEQ ID NO: 168200 - protein, 10 aa, Yellow fever virus
HESHLVRSWV

SEQ ID NO: 168201 - protein, 10 aa, Yellow fever virus
ESHLVRSWVT

SEQ ID NO: 168202 - protein, 10 aa, Yellow fever virus
SHLVRSWVTA

SEQ ID NO: 168203 - protein, 10 aa, Yellow fever virus
HLVRSWVTAG

SEQ ID NO: 168204 - protein, 10 aa, Yellow fever virus
LVRSWVTAGE

SEQ ID NO: 168205 - protein, 10 aa, Yellow fever virus
VRSWVTAGEI

SEQ ID NO: 168206 - protein, 10 aa, Yellow fever virus
RSWVTAGEIH

SEQ ID NO: 168207 - protein, 10 aa, Yellow fever virus
SWVTAGEIHA

SEQ ID NO: 168208 - protein, 10 aa, Yellow fever virus
WVTAGEIHAV

SEQ ID NO: 168209 - protein, 10 aa, Yellow fever virus
VTAGEIHAVP

SEQ ID NO: 168210 - protein, 10 aa, Yellow fever virus
TAGEIHAVPF

SEQ ID NO: 168211 - protein, 10 aa, Yellow fever virus
AGEIHAVPFG

SEQ ID NO: 168212 - protein, 10 aa, Yellow fever virus
GEIHAVPFGL

SEQ ID NO: 168213 - protein, 10 aa, Yellow fever virus
EIHAVPFGLV

SEQ ID NO: 168214 - protein, 10 aa, Yellow fever virus
IHAVPFGLVS

SEQ ID NO: 168215 - protein, 10 aa, Yellow fever virus
HAVPFGLVSM

SEQ ID NO: 168216 - protein, 10 aa, Yellow fever virus
AVPFGLVSMM

SEQ ID NO: 168217 - protein, 10 aa, Yellow fever virus
VPFGLVSMMI

SEQ ID NO: 168218 - protein, 10 aa, Yellow fever virus
PFGLVSMMIA

SEQ ID NO: 168219 - protein, 10 aa, Yellow fever virus
FGLVSMMIAM

SEQ ID NO: 168220 - protein, 10 aa, Yellow fever virus
GLVSMMIAME

SEQ ID NO: 168221 - protein, 10 aa, Yellow fever virus
LVSMMIAMEV

SEQ ID NO: 168222 - protein, 10 aa, Yellow fever virus
VSMMIAMEVV

SEQ ID NO: 168223 - protein, 10 aa, Yellow fever virus
SMMIAMEVVL

SEQ ID NO: 168224 - protein, 10 aa, Yellow fever virus
MMIAMEVVLR

SEQ ID NO: 168225 - protein, 10 aa, Yellow fever virus
MIAMEVVLRK

SEQ ID NO: 168226 - protein, 10 aa, Yellow fever virus
IAMEVVLRKR

SEQ ID NO: 168227 - protein, 10 aa, Yellow fever virus
AMEVVLRKRQ

SEQ ID NO: 168228 - protein, 10 aa, Yellow fever virus
MEVVLRKRQG

SEQ ID NO: 168229 - protein, 10 aa, Yellow fever virus
EVVLRKRQGP

SEQ ID NO: 168230 - protein, 10 aa, Yellow fever virus
VVLRKRQGPK

SEQ ID NO: 168231 - protein, 10 aa, Yellow fever virus
VLRKRQGPKQ

SEQ ID NO: 168232 - protein, 10 aa, Yellow fever virus
LRKRQGPKQM

SEQ ID NO: 168233 - protein, 10 aa, Yellow fever virus
RKRQGPKQML

SEQ ID NO: 168234 - protein, 10 aa, Yellow fever virus
KRQGPKQMLV

SEQ ID NO: 168235 - protein, 10 aa, Yellow fever virus
RQGPKQMLVG

SEQ ID NO: 168236 - protein, 10 aa, Yellow fever virus
QGPKQMLVGG

SEQ ID NO: 168237 - protein, 10 aa, Yellow fever virus
GPKQMLVGGV

SEQ ID NO: 168238 - protein, 10 aa, Yellow fever virus
PKQMLVGGVV

SEQ ID NO: 168239 - protein, 10 aa, Yellow fever virus
KQMLVGGVVL

SEQ ID NO: 168240 - protein, 10 aa, Yellow fever virus
QMLVGGVVLL

SEQ ID NO: 168241 - protein, 10 aa, Yellow fever virus
MLVGGVVLLG

SEQ ID NO: 168242 - protein, 10 aa, Yellow fever virus
LVGGVVLLGA

SEQ ID NO: 168243 - protein, 10 aa, Yellow fever virus
VGGVVLLGAM

SEQ ID NO: 168244 - protein, 10 aa, Yellow fever virus
GGVVLLGAML

SEQ ID NO: 168245 - protein, 10 aa, Yellow fever virus
GVVLLGAMLV

SEQ ID NO: 168246 - protein, 10 aa, Yellow fever virus
VVLLGAMLVG

SEQ ID NO: 168247 - protein, 10 aa, Yellow fever virus
VLLGAMLVGQ

SEQ ID NO: 168248 - protein, 10 aa, Yellow fever virus
LLGAMLVGQV

SEQ ID NO: 168249 - protein, 10 aa, Yellow fever virus
LGAMLVGQVT

SEQ ID NO: 168250 - protein, 10 aa, Yellow fever virus
GAMLVGQVTL

SEQ ID NO: 168251 - protein, 10 aa, Yellow fever virus
AMLVGQVTLL

SEQ ID NO: 168252 - protein, 10 aa, Yellow fever virus
MLVGQVTLLD

SEQ ID NO: 168253 - protein, 10 aa, Yellow fever virus
LVGQVTLLDL

SEQ ID NO: 168254 - protein, 10 aa, Yellow fever virus
VGQVTLLDLL

SEQ ID NO: 168255 - protein, 10 aa, Yellow fever virus
GQVTLLDLLK

SEQ ID NO: 168256 - protein, 10 aa, Yellow fever virus
LTVAVGLHFH

SEQ ID NO: 168257 - protein, 10 aa, Yellow fever virus
TVAVGLHFHE

SEQ ID NO: 168258 - protein, 10 aa, Yellow fever virus
VAVGLHFHEM

SEQ ID NO: 168259 - protein, 10 aa, Yellow fever virus
AVGLHFHEMN

SEQ ID NO: 168260 - protein, 10 aa, Yellow fever virus
VGLHFHEMNN

SEQ ID NO: 168261 - protein, 10 aa, Yellow fever virus
GLHFHEMNNG

SEQ ID NO: 168262 - protein, 10 aa, Yellow fever virus
LHFHEMNNGG

SEQ ID NO: 168263 - protein, 10 aa, Yellow fever virus
HFHEMNNGGD

SEQ ID NO: 168264 - protein, 10 aa, Yellow fever virus
FHEMNNGGDA

SEQ ID NO: 168265 - protein, 10 aa, Yellow fever virus
HEMNNGGDAM

SEQ ID NO: 168266 - protein, 10 aa, Yellow fever virus
EMNNGGDAMY

SEQ ID NO: 168267 - protein, 10 aa, Yellow fever virus
MNNGGDAMYM

SEQ ID NO: 168268 - protein, 10 aa, Yellow fever virus
NNGGDAMYMA

SEQ ID NO: 168269 - protein, 10 aa, Yellow fever virus
NGGDAMYMAL

SEQ ID NO: 168270 - protein, 10 aa, Yellow fever virus
GGDAMYMALI

SEQ ID NO: 168271 - protein, 10 aa, Yellow fever virus
GDAMYMALIA

SEQ ID NO: 168272 - protein, 10 aa, Yellow fever virus
DAMYMALIAA

SEQ ID NO: 168273 - protein, 10 aa, Yellow fever virus
AMYMALIAAF

SEQ ID NO: 168274 - protein, 10 aa, Yellow fever virus
MYMALIAAFS

SEQ ID NO: 168275 - protein, 10 aa, Yellow fever virus
YMALIAAFSI

SEQ ID NO: 168276 - protein, 10 aa, Yellow fever virus
MALIAAFSIR

SEQ ID NO: 168277 - protein, 10 aa, Yellow fever virus
ALIAAFSIRP

SEQ ID NO: 168278 - protein, 10 aa, Yellow fever virus
LIAAFSIRPG

SEQ ID NO: 168279 - protein, 10 aa, Yellow fever virus
IAAFSIRPGL

SEQ ID NO: 168280 - protein, 10 aa, Yellow fever virus
AAFSIRPGLL

SEQ ID NO: 168281 - protein, 10 aa, Yellow fever virus
AFSIRPGLLI

SEQ ID NO: 168282 - protein, 10 aa, Yellow fever virus
FSIRPGLLIG

SEQ ID NO: 168283 - protein, 10 aa, Yellow fever virus
SIRPGLLIGF

SEQ ID NO: 168284 - protein, 10 aa, Yellow fever virus
IRPGLLIGFG

SEQ ID NO: 168285 - protein, 10 aa, Yellow fever virus
RPGLLIGFGL

SEQ ID NO: 168286 - protein, 10 aa, Yellow fever virus
PGLLIGFGLR

SEQ ID NO: 168287 - protein, 10 aa, Yellow fever virus
GLLIGFGLRT

SEQ ID NO: 168288 - protein, 10 aa, Yellow fever virus
LLIGFGLRTL

SEQ ID NO: 168289 - protein, 10 aa, Yellow fever virus
LIGFGLRTLW

SEQ ID NO: 168290 - protein, 10 aa, Yellow fever virus
IGFGLRTLWS

SEQ ID NO: 168291 - protein, 10 aa, Yellow fever virus
GFGLRTLWSP

SEQ ID NO: 168292 - protein, 10 aa, Yellow fever virus
FGLRTLWSPR

SEQ ID NO: 168293 - protein, 10 aa, Yellow fever virus
GLRTLWSPRE

SEQ ID NO: 168294 - protein, 10 aa, Yellow fever virus
LRTLWSPRER

SEQ ID NO: 168295 - protein, 10 aa, Yellow fever virus
RTLWSPRERL

SEQ ID NO: 168296 - protein, 10 aa, Yellow fever virus
TLWSPRERLV

SEQ ID NO: 168297 - protein, 10 aa, Yellow fever virus
LWSPRERLVL

SEQ ID NO: 168298 - protein, 10 aa, Yellow fever virus
WSPRERLVLT

SEQ ID NO: 168299 - protein, 10 aa, Yellow fever virus
SPRERLVLTL

SEQ ID NO: 168300 - protein, 10 aa, Yellow fever virus
PRERLVLTLG

SEQ ID NO: 168301 - protein, 10 aa, Yellow fever virus
RERLVLTLGA

SEQ ID NO: 168302 - protein, 10 aa, Yellow fever virus
ERLVLTLGAA

SEQ ID NO: 168303 - protein, 10 aa, Yellow fever virus
RLVLTLGAAM

SEQ ID NO: 168304 - protein, 10 aa, Yellow fever virus
LVLTLGAAMV

SEQ ID NO: 168305 - protein, 10 aa, Yellow fever virus
VLTLGAAMVE

SEQ ID NO: 168306 - protein, 10 aa, Yellow fever virus
LTLGAAMVEI

SEQ ID NO: 168307 - protein, 10 aa, Yellow fever virus
TLGAAMVEIA

SEQ ID NO: 168308 - protein, 10 aa, Yellow fever virus
LGAAMVEIAL

SEQ ID NO: 168309 - protein, 10 aa, Yellow fever virus
GAAMVEIALG

SEQ ID NO: 168310 - protein, 10 aa, Yellow fever virus
AAMVEIALGG

SEQ ID NO: 168311 - protein, 10 aa, Yellow fever virus
AMVEIALGGV

SEQ ID NO: 168312 - protein, 10 aa, Yellow fever virus
MVEIALGGVM

SEQ ID NO: 168313 - protein, 10 aa, Yellow fever virus
VEIALGGVMG

SEQ ID NO: 168314 - protein, 10 aa, Yellow fever virus
EIALGGVMGG

SEQ ID NO: 168315 - protein, 10 aa, Yellow fever virus
IALGGVMGGL

SEQ ID NO: 168316 - protein, 10 aa, Yellow fever virus
ALGGVMGGLW

SEQ ID NO: 168317 - protein, 10 aa, Yellow fever virus
LGGVMGGLWK

SEQ ID NO: 168318 - protein, 10 aa, Yellow fever virus
GGVMGGLWKY

SEQ ID NO: 168319 - protein, 10 aa, Yellow fever virus
GVMGGLWKYL

SEQ ID NO: 168320 - protein, 10 aa, Yellow fever virus
VMGGLWKYLN

SEQ ID NO: 168321 - protein, 10 aa, Yellow fever virus
MGGLWKYLNA

SEQ ID NO: 168322 - protein, 10 aa, Yellow fever virus
GGLWKYLNAV

SEQ ID NO: 168323 - protein, 10 aa, Yellow fever virus
GLWKYLNAVS

SEQ ID NO: 168324 - protein, 10 aa, Yellow fever virus
LWKYLNAVSL

SEQ ID NO: 168325 - protein, 10 aa, Yellow fever virus
WKYLNAVSLC

SEQ ID NO: 168326 - protein, 10 aa, Yellow fever virus
KYLNAVSLCI

SEQ ID NO: 168327 - protein, 10 aa, Yellow fever virus
YLNAVSLCIL

SEQ ID NO: 168328 - protein, 10 aa, Yellow fever virus
LNAVSLCILT

SEQ ID NO: 168329 - protein, 10 aa, Yellow fever virus
NAVSLCILTI

SEQ ID NO: 168330 - protein, 10 aa, Yellow fever virus
AVSLCILTIN

SEQ ID NO: 168331 - protein, 10 aa, Yellow fever virus
VSLCILTINA

SEQ ID NO: 168332 - protein, 10 aa, Yellow fever virus
SLCILTINAV

SEQ ID NO: 168333 - protein, 10 aa, Yellow fever virus
LCILTINAVA

SEQ ID NO: 168334 - protein, 10 aa, Yellow fever virus
CILTINAVAS

SEQ ID NO: 168335 - protein, 10 aa, Yellow fever virus
ILTINAVASR

SEQ ID NO: 168336 - protein, 10 aa, Yellow fever virus
LTINAVASRK

SEQ ID NO: 168337 - protein, 10 aa, Yellow fever virus
TINAVASRKA

SEQ ID NO: 168338 - protein, 10 aa, Yellow fever virus
INAVASRKAS

SEQ ID NO: 168339 - protein, 10 aa, Yellow fever virus
NAVASRKASN

SEQ ID NO: 168340 - protein, 10 aa, Yellow fever virus
AVASRKASNT

SEQ ID NO: 168341 - protein, 10 aa, Yellow fever virus
VASRKASNTI

SEQ ID NO: 168342 - protein, 10 aa, Yellow fever virus
ASRKASNTIL

SEQ ID NO: 168343 - protein, 10 aa, Yellow fever virus
SRKASNTILP

SEQ ID NO: 168344 - protein, 10 aa, Yellow fever virus
RKASNTILPL

SEQ ID NO: 168345 - protein, 10 aa, Yellow fever virus
KASNTILPLM

SEQ ID NO: 168346 - protein, 10 aa, Yellow fever virus
ASNTILPLMA

SEQ ID NO: 168347 - protein, 10 aa, Yellow fever virus
SNTILPLMAL

SEQ ID NO: 168348 - protein, 10 aa, Yellow fever virus
NTILPLMALL

SEQ ID NO: 168349 - protein, 10 aa, Yellow fever virus
TILPLMALLT

SEQ ID NO: 168350 - protein, 10 aa, Yellow fever virus
ILPLMALLTP

SEQ ID NO: 168351 - protein, 10 aa, Yellow fever virus
LPLMALLTPV

SEQ ID NO: 168352 - protein, 10 aa, Yellow fever virus
PLMALLTPVT

SEQ ID NO: 168353 - protein, 10 aa, Yellow fever virus
LMALLTPVTM

SEQ ID NO: 168354 - protein, 10 aa, Yellow fever virus
MALLTPVTMA

SEQ ID NO: 168355 - protein, 10 aa, Yellow fever virus
ALLTPVTMAE

SEQ ID NO: 168356 - protein, 10 aa, Yellow fever virus
LLTPVTMAEV

SEQ ID NO: 168357 - protein, 10 aa, Yellow fever virus
LTPVTMAEVR

SEQ ID NO: 168358 - protein, 10 aa, Yellow fever virus
TPVTMAEVRL

SEQ ID NO: 168359 - protein, 10 aa, Yellow fever virus
PVTMAEVRLA

SEQ ID NO: 168360 - protein, 10 aa, Yellow fever virus
VTMAEVRLAA

SEQ ID NO: 168361 - protein, 10 aa, Yellow fever virus
TMAEVRLAAM

SEQ ID NO: 168362 - protein, 10 aa, Yellow fever virus
MAEVRLAAMF

SEQ ID NO: 168363 - protein, 10 aa, Yellow fever virus
EVRLAAMFFC

SEQ ID NO: 168364 - protein, 10 aa, Yellow fever virus
AAMFFCAVVI

SEQ ID NO: 168365 - protein, 10 aa, Yellow fever virus
MFFCAVVIIG

SEQ ID NO: 168366 - protein, 10 aa, Yellow fever virus
FFCAVVIIGV

SEQ ID NO: 168367 - protein, 10 aa, Yellow fever virus
FCAVVIIGVL

SEQ ID NO: 168368 - protein, 10 aa, Yellow fever virus
CAVVIIGVLH

SEQ ID NO: 168369 - protein, 10 aa, Yellow fever virus
AVVIIGVLHQ

SEQ ID NO: 168370 - protein, 10 aa, Yellow fever virus
VVIIGVLHQN

SEQ ID NO: 168371 - protein, 10 aa, Yellow fever virus
VIIGVLHQNF

SEQ ID NO: 168372 - protein, 10 aa, Yellow fever virus
IIGVLHQNFK

SEQ ID NO: 168373 - protein, 10 aa, Yellow fever virus
IGVLHQNFKD

SEQ ID NO: 168374 - protein, 10 aa, Yellow fever virus
GVLHQNFKDT

SEQ ID NO: 168375 - protein, 10 aa, Yellow fever virus
VLHQNFKDTS

SEQ ID NO: 168376 - protein, 10 aa, Yellow fever virus
LHQNFKDTSM

SEQ ID NO: 168377 - protein, 10 aa, Yellow fever virus
HQNFKDTSMQ

SEQ ID NO: 168378 - protein, 10 aa, Yellow fever virus
QNFKDTSMQK

SEQ ID NO: 168379 - protein, 10 aa, Yellow fever virus
NFKDTSMQKT

SEQ ID NO: 168380 - protein, 10 aa, Yellow fever virus
FKDTSMQKTI

SEQ ID NO: 168381 - protein, 10 aa, Yellow fever virus
KDTSMQKTIP

SEQ ID NO: 168382 - protein, 10 aa, Yellow fever virus
DTSMQKTIPL

SEQ ID NO: 168383 - protein, 10 aa, Yellow fever virus
TSMQKTIPLV

SEQ ID NO: 168384 - protein, 10 aa, Yellow fever virus
SMQKTIPLVA

SEQ ID NO: 168385 - protein, 10 aa, Yellow fever virus
MQKTIPLVAL

SEQ ID NO: 168386 - protein, 10 aa, Yellow fever virus
QKTIPLVALT

SEQ ID NO: 168387 - protein, 10 aa, Yellow fever virus
KTIPLVALTL

SEQ ID NO: 168388 - protein, 10 aa, Yellow fever virus
TIPLVALTLT

SEQ ID NO: 168389 - protein, 10 aa, Yellow fever virus
IPLVALTLTS

SEQ ID NO: 168390 - protein, 10 aa, Yellow fever virus
PLVALTLTSY

SEQ ID NO: 168391 - protein, 10 aa, Yellow fever virus
LVALTLTSYL

SEQ ID NO: 168392 - protein, 10 aa, Yellow fever virus
VALTLTSYLG

SEQ ID NO: 168393 - protein, 10 aa, Yellow fever virus
ALTLTSYLGL

SEQ ID NO: 168394 - protein, 10 aa, Yellow fever virus
LTLTSYLGLT

SEQ ID NO: 168395 - protein, 10 aa, Yellow fever virus
TLTSYLGLTQ

SEQ ID NO: 168396 - protein, 10 aa, Yellow fever virus
LTSYLGLTQP

SEQ ID NO: 168397 - protein, 10 aa, Yellow fever virus
TSYLGLTQPF

SEQ ID NO: 168398 - protein, 10 aa, Yellow fever virus
SYLGLTQPFL

SEQ ID NO: 168399 - protein, 10 aa, Yellow fever virus
YLGLTQPFLG

SEQ ID NO: 168400 - protein, 10 aa, Yellow fever virus
LGLTQPFLGL

SEQ ID NO: 168401 - protein, 10 aa, Yellow fever virus
GLTQPFLGLC

SEQ ID NO: 168402 - protein, 10 aa, Yellow fever virus
LTQPFLGLCA

SEQ ID NO: 168403 - protein, 10 aa, Yellow fever virus
TQPFLGLCAF

SEQ ID NO: 168404 - protein, 10 aa, Yellow fever virus
QPFLGLCAFL

SEQ ID NO: 168405 - protein, 10 aa, Yellow fever virus
PFLGLCAFLA

SEQ ID NO: 168406 - protein, 10 aa, Yellow fever virus
FLGLCAFLAT

SEQ ID NO: 168407 - protein, 10 aa, Yellow fever virus
LGLCAFLATR

SEQ ID NO: 168408 - protein, 10 aa, Yellow fever virus
GLCAFLATRI

SEQ ID NO: 168409 - protein, 10 aa, Yellow fever virus
LCAFLATRIF

SEQ ID NO: 168410 - protein, 10 aa, Yellow fever virus
CAFLATRIFG

SEQ ID NO: 168411 - protein, 10 aa, Yellow fever virus
AFLATRIFGR

SEQ ID NO: 168412 - protein, 10 aa, Yellow fever virus
FLATRIFGRR

SEQ ID NO: 168413 - protein, 10 aa, Yellow fever virus
LATRIFGRRS

SEQ ID NO: 168414 - protein, 10 aa, Yellow fever virus
ATRIFGRRSI

SEQ ID NO: 168415 - protein, 10 aa, Yellow fever virus
TRIFGRRSIP

SEQ ID NO: 168416 - protein, 10 aa, Yellow fever virus
RIFGRRSIPV

SEQ ID NO: 168417 - protein, 10 aa, Yellow fever virus
IFGRRSIPVN

SEQ ID NO: 168418 - protein, 10 aa, Yellow fever virus
FGRRSIPVNE

SEQ ID NO: 168419 - protein, 10 aa, Yellow fever virus
GRRSIPVNEA

SEQ ID NO: 168420 - protein, 10 aa, Yellow fever virus
RRSIPVNEAL

SEQ ID NO: 168421 - protein, 10 aa, Yellow fever virus
RSIPVNEALA

SEQ ID NO: 168422 - protein, 10 aa, Yellow fever virus
SIPVNEALAA

SEQ ID NO: 168423 - protein, 10 aa, Yellow fever virus
IPVNEALAAA

SEQ ID NO: 168424 - protein, 10 aa, Yellow fever virus
PVNEALAAAG

SEQ ID NO: 168425 - protein, 10 aa, Yellow fever virus
VNEALAAAGL

SEQ ID NO: 168426 - protein, 10 aa, Yellow fever virus
NEALAAAGLV

SEQ ID NO: 168427 - protein, 10 aa, Yellow fever virus
EALAAAGLVG

SEQ ID NO: 168428 - protein, 10 aa, Yellow fever virus
ALAAAGLVGV

SEQ ID NO: 168429 - protein, 10 aa, Yellow fever virus
LAAAGLVGVL

SEQ ID NO: 168430 - protein, 10 aa, Yellow fever virus
AAAGLVGVLA

SEQ ID NO: 168431 - protein, 10 aa, Yellow fever virus
AAGLVGVLAG

SEQ ID NO: 168432 - protein, 10 aa, Yellow fever virus
AGLVGVLAGL

SEQ ID NO: 168433 - protein, 10 aa, Yellow fever virus
GLVGVLAGLA

SEQ ID NO: 168434 - protein, 10 aa, Yellow fever virus
LVGVLAGLAF

SEQ ID NO: 168435 - protein, 10 aa, Yellow fever virus
VGVLAGLAFQ

SEQ ID NO: 168436 - protein, 10 aa, Yellow fever virus
GVLAGLAFQE

SEQ ID NO: 168437 - protein, 10 aa, Yellow fever virus
VLAGLAFQEM

SEQ ID NO: 168438 - protein, 10 aa, Yellow fever virus
LAGLAFQEME

SEQ ID NO: 168439 - protein, 10 aa, Yellow fever virus
AGLAFQEMEN

SEQ ID NO: 168440 - protein, 10 aa, Yellow fever virus
GLAFQEMENF

SEQ ID NO: 168441 - protein, 10 aa, Yellow fever virus
LAFQEMENFL

SEQ ID NO: 168442 - protein, 10 aa, Yellow fever virus
AFQEMENFLG

SEQ ID NO: 168443 - protein, 10 aa, Yellow fever virus
FQEMENFLGP

SEQ ID NO: 168444 - protein, 10 aa, Yellow fever virus
QEMENFLGPI

SEQ ID NO: 168445 - protein, 10 aa, Yellow fever virus
EMENFLGPIA

SEQ ID NO: 168446 - protein, 10 aa, Yellow fever virus
MENFLGPIAV

SEQ ID NO: 168447 - protein, 10 aa, Yellow fever virus
ENFLGPIAVG

SEQ ID NO: 168448 - protein, 10 aa, Yellow fever virus
NFLGPIAVGG

SEQ ID NO: 168449 - protein, 10 aa, Yellow fever virus
FLGPIAVGGL

SEQ ID NO: 168450 - protein, 10 aa, Yellow fever virus
LGPIAVGGLL

SEQ ID NO: 168451 - protein, 10 aa, Yellow fever virus
GPIAVGGLLM

SEQ ID NO: 168452 - protein, 10 aa, Yellow fever virus
PIAVGGLLMM

SEQ ID NO: 168453 - protein, 10 aa, Yellow fever virus
IAVGGLLMML

SEQ ID NO: 168454 - protein, 10 aa, Yellow fever virus
AVGGLLMMLV

SEQ ID NO: 168455 - protein, 10 aa, Yellow fever virus
VGGLLMMLVS

SEQ ID NO: 168456 - protein, 10 aa, Yellow fever virus
GGLLMMLVSV

SEQ ID NO: 168457 - protein, 10 aa, Yellow fever virus
GLLMMLVSVA

SEQ ID NO: 168458 - protein, 10 aa, Yellow fever virus
LLMMLVSVAG

SEQ ID NO: 168459 - protein, 10 aa, Yellow fever virus
LMMLVSVAGR

SEQ ID NO: 168460 - protein, 10 aa, Yellow fever virus
MMLVSVAGRV

SEQ ID NO: 168461 - protein, 10 aa, Yellow fever virus
MLVSVAGRVD

SEQ ID NO: 168462 - protein, 10 aa, Yellow fever virus
LVSVAGRVDG

SEQ ID NO: 168463 - protein, 10 aa, Yellow fever virus
VSVAGRVDGL

SEQ ID NO: 168464 - protein, 10 aa, Yellow fever virus
SVAGRVDGLE

SEQ ID NO: 168465 - protein, 10 aa, Yellow fever virus
VAGRVDGLEL

SEQ ID NO: 168466 - protein, 10 aa, Yellow fever virus
AGRVDGLELK

SEQ ID NO: 168467 - protein, 10 aa, Yellow fever virus
GRVDGLELKK

SEQ ID NO: 168468 - protein, 10 aa, Yellow fever virus
RVDGLELKKL

SEQ ID NO: 168469 - protein, 10 aa, Yellow fever virus
VDGLELKKLG

SEQ ID NO: 168470 - protein, 10 aa, Yellow fever virus
DGLELKKLGE

SEQ ID NO: 168471 - protein, 10 aa, Yellow fever virus
GLELKKLGEV

SEQ ID NO: 168472 - protein, 10 aa, Yellow fever virus
LELKKLGEVS

SEQ ID NO: 168473 - protein, 10 aa, Yellow fever virus
ELKKLGEVSW

SEQ ID NO: 168474 - protein, 10 aa, Yellow fever virus
LKKLGEVSWE

SEQ ID NO: 168475 - protein, 10 aa, Yellow fever virus
KKLGEVSWEE

SEQ ID NO: 168476 - protein, 10 aa, Yellow fever virus
KLGEVSWEEE

SEQ ID NO: 168477 - protein, 10 aa, Yellow fever virus
LGEVSWEEEA

SEQ ID NO: 168478 - protein, 10 aa, Yellow fever virus
GEVSWEEEAE

SEQ ID NO: 168479 - protein, 10 aa, Yellow fever virus
EVSWEEEAEI

SEQ ID NO: 168480 - protein, 10 aa, Yellow fever virus
VSWEEEAEIS

SEQ ID NO: 168481 - protein, 10 aa, Yellow fever virus
SWEEEAEISG

SEQ ID NO: 168482 - protein, 10 aa, Yellow fever virus
WEEEAEISGS

SEQ ID NO: 168483 - protein, 10 aa, Yellow fever virus
EEEAEISGSS

SEQ ID NO: 168484 - protein, 10 aa, Yellow fever virus
EEAEISGSSA

SEQ ID NO: 168485 - protein, 10 aa, Yellow fever virus
EAEISGSSAR

SEQ ID NO: 168486 - protein, 10 aa, Yellow fever virus
AEISGSSARY

SEQ ID NO: 168487 - protein, 10 aa, Yellow fever virus
EISGSSARYD

SEQ ID NO: 168488 - protein, 10 aa, Yellow fever virus
ISGSSARYDV

SEQ ID NO: 168489 - protein, 10 aa, Yellow fever virus
SGSSARYDVA

SEQ ID NO: 168490 - protein, 10 aa, Yellow fever virus
GSSARYDVAL

SEQ ID NO: 168491 - protein, 10 aa, Yellow fever virus
SSARYDVALS

SEQ ID NO: 168492 - protein, 10 aa, Yellow fever virus
SARYDVALSE

SEQ ID NO: 168493 - protein, 10 aa, Yellow fever virus
ARYDVALSEQ

SEQ ID NO: 168494 - protein, 10 aa, Yellow fever virus
RYDVALSEQG

SEQ ID NO: 168495 - protein, 10 aa, Yellow fever virus
YDVALSEQGE

SEQ ID NO: 168496 - protein, 10 aa, Yellow fever virus
DVALSEQGEF

SEQ ID NO: 168497 - protein, 10 aa, Yellow fever virus
VALSEQGEFK

SEQ ID NO: 168498 - protein, 10 aa, Yellow fever virus
ALSEQGEFKL

SEQ ID NO: 168499 - protein, 10 aa, Yellow fever virus
LSEQGEFKLL

SEQ ID NO: 168500 - protein, 10 aa, Yellow fever virus
SEQGEFKLLS

SEQ ID NO: 168501 - protein, 10 aa, Yellow fever virus
EQGEFKLLSE

SEQ ID NO: 168502 - protein, 10 aa, Yellow fever virus
QGEFKLLSEE

SEQ ID NO: 168503 - protein, 10 aa, Yellow fever virus
GEFKLLSEEK

SEQ ID NO: 168504 - protein, 10 aa, Yellow fever virus
EFKLLSEEKV

SEQ ID NO: 168505 - protein, 10 aa, Yellow fever virus
FKLLSEEKVP

SEQ ID NO: 168506 - protein, 10 aa, Yellow fever virus
KLLSEEKVPW

SEQ ID NO: 168507 - protein, 10 aa, Yellow fever virus
LLSEEKVPWD

SEQ ID NO: 168508 - protein, 10 aa, Yellow fever virus
LSEEKVPWDQ

SEQ ID NO: 168509 - protein, 10 aa, Yellow fever virus
SEEKVPWDQV

SEQ ID NO: 168510 - protein, 10 aa, Yellow fever virus
EEKVPWDQVV

SEQ ID NO: 168511 - protein, 10 aa, Yellow fever virus
EKVPWDQVVM

SEQ ID NO: 168512 - protein, 10 aa, Yellow fever virus
KVPWDQVVMT

SEQ ID NO: 168513 - protein, 10 aa, Yellow fever virus
VPWDQVVMTS

SEQ ID NO: 168514 - protein, 10 aa, Yellow fever virus
PWDQVVMTSL

SEQ ID NO: 168515 - protein, 10 aa, Yellow fever virus
WDQVVMTSLA

SEQ ID NO: 168516 - protein, 10 aa, Yellow fever virus
DQVVMTSLAL

SEQ ID NO: 168517 - protein, 10 aa, Yellow fever virus
QVVMTSLALV

SEQ ID NO: 168518 - protein, 10 aa, Yellow fever virus
VVMTSLALVG

SEQ ID NO: 168519 - protein, 10 aa, Yellow fever virus
VMTSLALVGA

SEQ ID NO: 168520 - protein, 10 aa, Yellow fever virus
MTSLALVGAA

SEQ ID NO: 168521 - protein, 10 aa, Yellow fever virus
TSLALVGAAL

SEQ ID NO: 168522 - protein, 10 aa, Yellow fever virus
SLALVGAALH

SEQ ID NO: 168523 - protein, 10 aa, Yellow fever virus
LALVGAALHP

SEQ ID NO: 168524 - protein, 10 aa, Yellow fever virus
ALVGAALHPF

SEQ ID NO: 168525 - protein, 10 aa, Yellow fever virus
LVGAALHPFA

SEQ ID NO: 168526 - protein, 10 aa, Yellow fever virus
VGAALHPFAL

SEQ ID NO: 168527 - protein, 10 aa, Yellow fever virus
GAALHPFALL

SEQ ID NO: 168528 - protein, 10 aa, Yellow fever virus
AALHPFALLL

SEQ ID NO: 168529 - protein, 10 aa, Yellow fever virus
ALHPFALLLV

SEQ ID NO: 168530 - protein, 10 aa, Yellow fever virus
LHPFALLLVL

SEQ ID NO: 168531 - protein, 10 aa, Yellow fever virus
HPFALLLVLA

SEQ ID NO: 168532 - protein, 10 aa, Yellow fever virus
PFALLLVLAG

SEQ ID NO: 168533 - protein, 10 aa, Yellow fever virus
FALLLVLAGW

SEQ ID NO: 168534 - protein, 10 aa, Yellow fever virus
ALLLVLAGWL

SEQ ID NO: 168535 - protein, 10 aa, Yellow fever virus
LLLVLAGWLF

SEQ ID NO: 168536 - protein, 10 aa, Yellow fever virus
LLVLAGWLFH

SEQ ID NO: 168537 - protein, 10 aa, Yellow fever virus
LVLAGWLFHV

SEQ ID NO: 168538 - protein, 10 aa, Yellow fever virus
VLAGWLFHVR

SEQ ID NO: 168539 - protein, 10 aa, Yellow fever virus
LAGWLFHVRG

SEQ ID NO: 168540 - protein, 10 aa, Yellow fever virus
AGWLFHVRGA

SEQ ID NO: 168541 - protein, 10 aa, Yellow fever virus
GWLFHVRGAR

SEQ ID NO: 168542 - protein, 10 aa, Yellow fever virus
WLFHVRGARR

SEQ ID NO: 168543 - protein, 10 aa, Yellow fever virus
LFHVRGARRS

SEQ ID NO: 168544 - protein, 10 aa, Yellow fever virus
FHVRGARRSG

SEQ ID NO: 168545 - protein, 10 aa, Yellow fever virus
HVRGARRSGD

SEQ ID NO: 168546 - protein, 10 aa, Yellow fever virus
VRGARRSGDV

SEQ ID NO: 168547 - protein, 10 aa, Yellow fever virus
RGARRSGDVL

SEQ ID NO: 168548 - protein, 10 aa, Yellow fever virus
GARRSGDVLW

SEQ ID NO: 168549 - protein, 10 aa, Yellow fever virus
ARRSGDVLWD

SEQ ID NO: 168550 - protein, 10 aa, Yellow fever virus
RRSGDVLWDI

SEQ ID NO: 168551 - protein, 10 aa, Yellow fever virus
RSGDVLWDIP

SEQ ID NO: 168552 - protein, 10 aa, Yellow fever virus
SGDVLWDIPT

SEQ ID NO: 168553 - protein, 10 aa, Yellow fever virus
GDVLWDIPTP

SEQ ID NO: 168554 - protein, 10 aa, Yellow fever virus
DVLWDIPTPK

SEQ ID NO: 168555 - protein, 10 aa, Yellow fever virus
VLWDIPTPKI

SEQ ID NO: 168556 - protein, 10 aa, Yellow fever virus
LWDIPTPKII

SEQ ID NO: 168557 - protein, 10 aa, Yellow fever virus
WDIPTPKIIE

SEQ ID NO: 168558 - protein, 10 aa, Yellow fever virus
DIPTPKIIEE

SEQ ID NO: 168559 - protein, 10 aa, Yellow fever virus
IPTPKIIEEC

SEQ ID NO: 168560 - protein, 10 aa, Yellow fever virus
PTPKIIEECE

SEQ ID NO: 168561 - protein, 10 aa, Yellow fever virus
TPKIIEECEH

SEQ ID NO: 168562 - protein, 10 aa, Yellow fever virus
PKIIEECEHL

SEQ ID NO: 168563 - protein, 10 aa, Yellow fever virus
KIIEECEHLE

SEQ ID NO: 168564 - protein, 10 aa, Yellow fever virus
IIEECEHLED

SEQ ID NO: 168565 - protein, 10 aa, Yellow fever virus
IEECEHLEDG

SEQ ID NO: 168566 - protein, 10 aa, Yellow fever virus
EECEHLEDGI

SEQ ID NO: 168567 - protein, 10 aa, Yellow fever virus
ECEHLEDGIY

SEQ ID NO: 168568 - protein, 10 aa, Yellow fever virus
CEHLEDGIYG

SEQ ID NO: 168569 - protein, 10 aa, Yellow fever virus
EHLEDGIYGI

SEQ ID NO: 168570 - protein, 10 aa, Yellow fever virus
HLEDGIYGIF

SEQ ID NO: 168571 - protein, 10 aa, Yellow fever virus
LEDGIYGIFQ

SEQ ID NO: 168572 - protein, 10 aa, Yellow fever virus
EDGIYGIFQS

SEQ ID NO: 168573 - protein, 10 aa, Yellow fever virus
DGIYGIFQST

SEQ ID NO: 168574 - protein, 10 aa, Yellow fever virus
GIYGIFQSTF

SEQ ID NO: 168575 - protein, 10 aa, Yellow fever virus
IYGIFQSTFL

SEQ ID NO: 168576 - protein, 10 aa, Yellow fever virus
YGIFQSTFLG

SEQ ID NO: 168577 - protein, 10 aa, Yellow fever virus
GIFQSTFLGA

SEQ ID NO: 168578 - protein, 10 aa, Yellow fever virus
IFQSTFLGAS

SEQ ID NO: 168579 - protein, 10 aa, Yellow fever virus
FQSTFLGASQ

SEQ ID NO: 168580 - protein, 10 aa, Yellow fever virus
QSTFLGASQR

SEQ ID NO: 168581 - protein, 10 aa, Yellow fever virus
STFLGASQRG

SEQ ID NO: 168582 - protein, 10 aa, Yellow fever virus
TFLGASQRGV

SEQ ID NO: 168583 - protein, 10 aa, Yellow fever virus
FLGASQRGVG

SEQ ID NO: 168584 - protein, 10 aa, Yellow fever virus
LGASQRGVGV

SEQ ID NO: 168585 - protein, 10 aa, Yellow fever virus
GASQRGVGVA

SEQ ID NO: 168586 - protein, 10 aa, Yellow fever virus
ASQRGVGVAQ

SEQ ID NO: 168587 - protein, 10 aa, Yellow fever virus
SQRGVGVAQG

SEQ ID NO: 168588 - protein, 10 aa, Yellow fever virus
QRGVGVAQGG

SEQ ID NO: 168589 - protein, 10 aa, Yellow fever virus
RGVGVAQGGV

SEQ ID NO: 168590 - protein, 10 aa, Yellow fever virus
GVGVAQGGVF

SEQ ID NO: 168591 - protein, 10 aa, Yellow fever virus
VGVAQGGVFH

SEQ ID NO: 168592 - protein, 10 aa, Yellow fever virus
GVAQGGVFHT

SEQ ID NO: 168593 - protein, 10 aa, Yellow fever virus
VAQGGVFHTM

SEQ ID NO: 168594 - protein, 10 aa, Yellow fever virus
AQGGVFHTMW

SEQ ID NO: 168595 - protein, 10 aa, Yellow fever virus
QGGVFHTMWH

SEQ ID NO: 168596 - protein, 10 aa, Yellow fever virus
GGVFHTMWHV

SEQ ID NO: 168597 - protein, 10 aa, Yellow fever virus
GVFHTMWHVT

SEQ ID NO: 168598 - protein, 10 aa, Yellow fever virus
VFHTMWHVTR

SEQ ID NO: 168599 - protein, 10 aa, Yellow fever virus
FHTMWHVTRG

SEQ ID NO: 168600 - protein, 10 aa, Yellow fever virus
HTMWHVTRGA

SEQ ID NO: 168601 - protein, 10 aa, Yellow fever virus
TMWHVTRGAF

SEQ ID NO: 168602 - protein, 10 aa, Yellow fever virus
MWHVTRGAFL

SEQ ID NO: 168603 - protein, 10 aa, Yellow fever virus
WHVTRGAFLV

SEQ ID NO: 168604 - protein, 10 aa, Yellow fever virus
HVTRGAFLVR

SEQ ID NO: 168605 - protein, 10 aa, Yellow fever virus
VTRGAFLVRN

SEQ ID NO: 168606 - protein, 10 aa, Yellow fever virus
TRGAFLVRNG

SEQ ID NO: 168607 - protein, 10 aa, Yellow fever virus
RGAFLVRNGK

SEQ ID NO: 168608 - protein, 10 aa, Yellow fever virus
GAFLVRNGKK

SEQ ID NO: 168609 - protein, 10 aa, Yellow fever virus
AFLVRNGKKL

SEQ ID NO: 168610 - protein, 10 aa, Yellow fever virus
FLVRNGKKLI

SEQ ID NO: 168611 - protein, 10 aa, Yellow fever virus
LVRNGKKLIP

SEQ ID NO: 168612 - protein, 10 aa, Yellow fever virus
VRNGKKLIPS

SEQ ID NO: 168613 - protein, 10 aa, Yellow fever virus
RNGKKLIPSW

SEQ ID NO: 168614 - protein, 10 aa, Yellow fever virus
NGKKLIPSWA

SEQ ID NO: 168615 - protein, 10 aa, Yellow fever virus
GKKLIPSWAS

SEQ ID NO: 168616 - protein, 10 aa, Yellow fever virus
KKLIPSWASV

SEQ ID NO: 168617 - protein, 10 aa, Yellow fever virus
KLIPSWASVK

SEQ ID NO: 168618 - protein, 10 aa, Yellow fever virus
LIPSWASVKE

SEQ ID NO: 168619 - protein, 10 aa, Yellow fever virus
IPSWASVKED

SEQ ID NO: 168620 - protein, 10 aa, Yellow fever virus
PSWASVKEDL

SEQ ID NO: 168621 - protein, 10 aa, Yellow fever virus
SWASVKEDLV

SEQ ID NO: 168622 - protein, 10 aa, Yellow fever virus
WASVKEDLVA

SEQ ID NO: 168623 - protein, 10 aa, Yellow fever virus
ASVKEDLVAY

SEQ ID NO: 168624 - protein, 10 aa, Yellow fever virus
SVKEDLVAYG

SEQ ID NO: 168625 - protein, 10 aa, Yellow fever virus
VKEDLVAYGG

SEQ ID NO: 168626 - protein, 10 aa, Yellow fever virus
KEDLVAYGGS

SEQ ID NO: 168627 - protein, 10 aa, Yellow fever virus
EDLVAYGGSW

SEQ ID NO: 168628 - protein, 10 aa, Yellow fever virus
DLVAYGGSWK

SEQ ID NO: 168629 - protein, 10 aa, Yellow fever virus
LVAYGGSWKL

SEQ ID NO: 168630 - protein, 10 aa, Yellow fever virus
VAYGGSWKLE

SEQ ID NO: 168631 - protein, 10 aa, Yellow fever virus
AYGGSWKLEG

SEQ ID NO: 168632 - protein, 10 aa, Yellow fever virus
YGGSWKLEGR

SEQ ID NO: 168633 - protein, 10 aa, Yellow fever virus
GGSWKLEGRW

SEQ ID NO: 168634 - protein, 10 aa, Yellow fever virus
GSWKLEGRWD

SEQ ID NO: 168635 - protein, 10 aa, Yellow fever virus
SWKLEGRWDG

SEQ ID NO: 168636 - protein, 10 aa, Yellow fever virus
WKLEGRWDGE

SEQ ID NO: 168637 - protein, 10 aa, Yellow fever virus
KLEGRWDGEE

SEQ ID NO: 168638 - protein, 10 aa, Yellow fever virus
LEGRWDGEEE

SEQ ID NO: 168639 - protein, 10 aa, Yellow fever virus
EGRWDGEEEV

SEQ ID NO: 168640 - protein, 10 aa, Yellow fever virus
GRWDGEEEVQ

SEQ ID NO: 168641 - protein, 10 aa, Yellow fever virus
RWDGEEEVQL

SEQ ID NO: 168642 - protein, 10 aa, Yellow fever virus
WDGEEEVQLI

SEQ ID NO: 168643 - protein, 10 aa, Yellow fever virus
DGEEEVQLIA

SEQ ID NO: 168644 - protein, 10 aa, Yellow fever virus
GEEEVQLIAA

SEQ ID NO: 168645 - protein, 10 aa, Yellow fever virus
EEEVQLIAAV

SEQ ID NO: 168646 - protein, 10 aa, Yellow fever virus
EEVQLIAAVP

SEQ ID NO: 168647 - protein, 10 aa, Yellow fever virus
EVQLIAAVPG

SEQ ID NO: 168648 - protein, 10 aa, Yellow fever virus
VQLIAAVPGK

SEQ ID NO: 168649 - protein, 10 aa, Yellow fever virus
QLIAAVPGKN

SEQ ID NO: 168650 - protein, 10 aa, Yellow fever virus
LIAAVPGKNV

SEQ ID NO: 168651 - protein, 10 aa, Yellow fever virus
IAAVPGKNVV

SEQ ID NO: 168652 - protein, 10 aa, Yellow fever virus
AAVPGKNVVN

SEQ ID NO: 168653 - protein, 10 aa, Yellow fever virus
AVPGKNVVNV

SEQ ID NO: 168654 - protein, 10 aa, Yellow fever virus
VPGKNVVNVQ

SEQ ID NO: 168655 - protein, 10 aa, Yellow fever virus
PGKNVVNVQT

SEQ ID NO: 168656 - protein, 10 aa, Yellow fever virus
GKNVVNVQTK

SEQ ID NO: 168657 - protein, 10 aa, Yellow fever virus
KNVVNVQTKP

SEQ ID NO: 168658 - protein, 10 aa, Yellow fever virus
NVVNVQTKPS

SEQ ID NO: 168659 - protein, 10 aa, Yellow fever virus
VVNVQTKPSL

SEQ ID NO: 168660 - protein, 10 aa, Yellow fever virus
VNVQTKPSLF

SEQ ID NO: 168661 - protein, 10 aa, Yellow fever virus
NVQTKPSLFK

SEQ ID NO: 168662 - protein, 10 aa, Yellow fever virus
VQTKPSLFKV

SEQ ID NO: 168663 - protein, 10 aa, Yellow fever virus
QTKPSLFKVR

SEQ ID NO: 168664 - protein, 10 aa, Yellow fever virus
TKPSLFKVRN

SEQ ID NO: 168665 - protein, 10 aa, Yellow fever virus
KPSLFKVRNG

SEQ ID NO: 168666 - protein, 10 aa, Yellow fever virus
PSLFKVRNGG

SEQ ID NO: 168667 - protein, 10 aa, Yellow fever virus
SLFKVRNGGE

SEQ ID NO: 168668 - protein, 10 aa, Yellow fever virus
LFKVRNGGEI

SEQ ID NO: 168669 - protein, 10 aa, Yellow fever virus
FKVRNGGEIG

SEQ ID NO: 168670 - protein, 10 aa, Yellow fever virus
KVRNGGEIGA

SEQ ID NO: 168671 - protein, 10 aa, Yellow fever virus
VRNGGEIGAV

SEQ ID NO: 168672 - protein, 10 aa, Yellow fever virus
RNGGEIGAVA

SEQ ID NO: 168673 - protein, 10 aa, Yellow fever virus
NGGEIGAVAL

SEQ ID NO: 168674 - protein, 10 aa, Yellow fever virus
GGEIGAVALD

SEQ ID NO: 168675 - protein, 10 aa, Yellow fever virus
GEIGAVALDY

SEQ ID NO: 168676 - protein, 10 aa, Yellow fever virus
EIGAVALDYP

SEQ ID NO: 168677 - protein, 10 aa, Yellow fever virus
IGAVALDYPS

SEQ ID NO: 168678 - protein, 10 aa, Yellow fever virus
GAVALDYPSG

SEQ ID NO: 168679 - protein, 10 aa, Yellow fever virus
AVALDYPSGT

SEQ ID NO: 168680 - protein, 10 aa, Yellow fever virus
VALDYPSGTS

SEQ ID NO: 168681 - protein, 10 aa, Yellow fever virus
ALDYPSGTSG

SEQ ID NO: 168682 - protein, 10 aa, Yellow fever virus
LDYPSGTSGS

SEQ ID NO: 168683 - protein, 10 aa, Yellow fever virus
DYPSGTSGSP

SEQ ID NO: 168684 - protein, 10 aa, Yellow fever virus
YPSGTSGSPI

SEQ ID NO: 168685 - protein, 10 aa, Yellow fever virus
PSGTSGSPIV

SEQ ID NO: 168686 - protein, 10 aa, Yellow fever virus
SGTSGSPIVN

SEQ ID NO: 168687 - protein, 10 aa, Yellow fever virus
GTSGSPIVNR

SEQ ID NO: 168688 - protein, 10 aa, Yellow fever virus
TSGSPIVNRN

SEQ ID NO: 168689 - protein, 10 aa, Yellow fever virus
SGSPIVNRNG

SEQ ID NO: 168690 - protein, 10 aa, Yellow fever virus
GSPIVNRNGE

SEQ ID NO: 168691 - protein, 10 aa, Yellow fever virus
SPIVNRNGEV

SEQ ID NO: 168692 - protein, 10 aa, Yellow fever virus
PIVNRNGEVI

SEQ ID NO: 168693 - protein, 10 aa, Yellow fever virus
IVNRNGEVIG

SEQ ID NO: 168694 - protein, 10 aa, Yellow fever virus
VNRNGEVIGL

SEQ ID NO: 168695 - protein, 10 aa, Yellow fever virus
NRNGEVIGLY

SEQ ID NO: 168696 - protein, 10 aa, Yellow fever virus
RNGEVIGLYG

SEQ ID NO: 168697 - protein, 10 aa, Yellow fever virus
NGEVIGLYGN

SEQ ID NO: 168698 - protein, 10 aa, Yellow fever virus
GEVIGLYGNG

SEQ ID NO: 168699 - protein, 10 aa, Yellow fever virus
EVIGLYGNGI

SEQ ID NO: 168700 - protein, 10 aa, Yellow fever virus
VIGLYGNGIL

SEQ ID NO: 168701 - protein, 10 aa, Yellow fever virus
IGLYGNGILV

SEQ ID NO: 168702 - protein, 10 aa, Yellow fever virus
GLYGNGILVG

SEQ ID NO: 168703 - protein, 10 aa, Yellow fever virus
LYGNGILVGD

SEQ ID NO: 168704 - protein, 10 aa, Yellow fever virus
YGNGILVGDN

SEQ ID NO: 168705 - protein, 10 aa, Yellow fever virus
GNGILVGDNS

SEQ ID NO: 168706 - protein, 10 aa, Yellow fever virus
NGILVGDNSF

SEQ ID NO: 168707 - protein, 10 aa, Yellow fever virus
GILVGDNSFV

SEQ ID NO: 168708 - protein, 10 aa, Yellow fever virus
ILVGDNSFVS

SEQ ID NO: 168709 - protein, 10 aa, Yellow fever virus
LVGDNSFVSA

SEQ ID NO: 168710 - protein, 10 aa, Yellow fever virus
VGDNSFVSAI

SEQ ID NO: 168711 - protein, 10 aa, Yellow fever virus
GDNSFVSAIS

SEQ ID NO: 168712 - protein, 10 aa, Yellow fever virus
DNSFVSAISQ

SEQ ID NO: 168713 - protein, 10 aa, Yellow fever virus
NSFVSAISQT

SEQ ID NO: 168714 - protein, 10 aa, Yellow fever virus
SFVSAISQTE

SEQ ID NO: 168715 - protein, 10 aa, Yellow fever virus
FVSAISQTEV

SEQ ID NO: 168716 - protein, 10 aa, Yellow fever virus
VSAISQTEVK

SEQ ID NO: 168717 - protein, 10 aa, Yellow fever virus
SAISQTEVKE

SEQ ID NO: 168718 - protein, 10 aa, Yellow fever virus
AISQTEVKEE

SEQ ID NO: 168719 - protein, 10 aa, Yellow fever virus
ISQTEVKEEG

SEQ ID NO: 168720 - protein, 10 aa, Yellow fever virus
SQTEVKEEGK

SEQ ID NO: 168721 - protein, 10 aa, Yellow fever virus
QTEVKEEGKE

SEQ ID NO: 168722 - protein, 10 aa, Yellow fever virus
TEVKEEGKEE

SEQ ID NO: 168723 - protein, 10 aa, Yellow fever virus
EVKEEGKEEL

SEQ ID NO: 168724 - protein, 10 aa, Yellow fever virus
VKEEGKEELQ

SEQ ID NO: 168725 - protein, 10 aa, Yellow fever virus
KEEGKEELQE

SEQ ID NO: 168726 - protein, 10 aa, Yellow fever virus
EEGKEELQEI

SEQ ID NO: 168727 - protein, 10 aa, Yellow fever virus
EGKEELQEIP

SEQ ID NO: 168728 - protein, 10 aa, Yellow fever virus
GKEELQEIPT

SEQ ID NO: 168729 - protein, 10 aa, Yellow fever virus
KEELQEIPTM

SEQ ID NO: 168730 - protein, 10 aa, Yellow fever virus
EELQEIPTML

SEQ ID NO: 168731 - protein, 10 aa, Yellow fever virus
ELQEIPTMLK

SEQ ID NO: 168732 - protein, 10 aa, Yellow fever virus
LQEIPTMLKK

SEQ ID NO: 168733 - protein, 10 aa, Yellow fever virus
QEIPTMLKKG

SEQ ID NO: 168734 - protein, 10 aa, Yellow fever virus
EIPTMLKKGM

SEQ ID NO: 168735 - protein, 10 aa, Yellow fever virus
IPTMLKKGMT

SEQ ID NO: 168736 - protein, 10 aa, Yellow fever virus
PTMLKKGMTT

SEQ ID NO: 168737 - protein, 10 aa, Yellow fever virus
TMLKKGMTTV

SEQ ID NO: 168738 - protein, 10 aa, Yellow fever virus
MLKKGMTTIL

SEQ ID NO: 168739 - protein, 10 aa, Yellow fever virus
LKKGMTTVLD

SEQ ID NO: 168740 - protein, 10 aa, Yellow fever virus
KKGMTTVLDF

SEQ ID NO: 168741 - protein, 10 aa, Yellow fever virus
KGMTTVLDFH

SEQ ID NO: 168742 - protein, 10 aa, Yellow fever virus
GMTTVLDFHP

SEQ ID NO: 168743 - protein, 10 aa, Yellow fever virus
MTTVLDFHPG

SEQ ID NO: 168744 - protein, 10 aa, Yellow fever virus
TTILDFHPGA

SEQ ID NO: 168745 - protein, 10 aa, Yellow fever virus
TILDFHPGAG

SEQ ID NO: 168746 - protein, 10 aa, Yellow fever virus
ILDFHPGAGK

SEQ ID NO: 168747 - protein, 10 aa, Yellow fever virus
LDFHPGAGKT

SEQ ID NO: 168748 - protein, 10 aa, Yellow fever virus
DFHPGAGKTR

SEQ ID NO: 168749 - protein, 10 aa, Yellow fever virus
FHPGAGKTRR

SEQ ID NO: 168750 - protein, 10 aa, Yellow fever virus
HPGAGKTRRF

SEQ ID NO: 168751 - protein, 10 aa, Yellow fever virus
PGAGKTRRFL

SEQ ID NO: 168752 - protein, 10 aa, Yellow fever virus
GAGKTRRFLP

SEQ ID NO: 168753 - protein, 10 aa, Yellow fever virus
AGKTRRFLPQ

SEQ ID NO: 168754 - protein, 10 aa, Yellow fever virus
GKTRRFLPQI

SEQ ID NO: 168755 - protein, 10 aa, Yellow fever virus
KTRRFLPQIL

SEQ ID NO: 168756 - protein, 10 aa, Yellow fever virus
TRRFLPQILA

SEQ ID NO: 168757 - protein, 10 aa, Yellow fever virus
RRFLPQILAE

SEQ ID NO: 168758 - protein, 10 aa, Yellow fever virus
RFLPQILAEC

SEQ ID NO: 168759 - protein, 10 aa, Yellow fever virus
FLPQILAECA

SEQ ID NO: 168760 - protein, 10 aa, Yellow fever virus
LPQILAECAR

SEQ ID NO: 168761 - protein, 10 aa, Yellow fever virus
PQILAECARR

SEQ ID NO: 168762 - protein, 10 aa, Yellow fever virus
QILAECARRR

SEQ ID NO: 168763 - protein, 10 aa, Yellow fever virus
ILAECARRRL

SEQ ID NO: 168764 - protein, 10 aa, Yellow fever virus
LAECARRRLR

SEQ ID NO: 168765 - protein, 10 aa, Yellow fever virus
AECARRRLRT

SEQ ID NO: 168766 - protein, 10 aa, Yellow fever virus
ECARRRLRTL

SEQ ID NO: 168767 - protein, 10 aa, Yellow fever virus
CARRRLRTLV

SEQ ID NO: 168768 - protein, 10 aa, Yellow fever virus
ARRRLRTLVL

SEQ ID NO: 168769 - protein, 10 aa, Yellow fever virus
RRRLRTLVLA

SEQ ID NO: 168770 - protein, 10 aa, Yellow fever virus
RRLRTLVLAP

SEQ ID NO: 168771 - protein, 10 aa, Yellow fever virus
RLRTLVLAPT

SEQ ID NO: 168772 - protein, 10 aa, Yellow fever virus
LRTLVLAPTR

SEQ ID NO: 168773 - protein, 10 aa, Yellow fever virus
RTLVLAPTRV

SEQ ID NO: 168774 - protein, 10 aa, Yellow fever virus
TLVLAPTRVV

SEQ ID NO: 168775 - protein, 10 aa, Yellow fever virus
LVLAPTRVVL

SEQ ID NO: 168776 - protein, 10 aa, Yellow fever virus
VLAPTRVVLS

SEQ ID NO: 168777 - protein, 10 aa, Yellow fever virus
LAPTRVVLSE

SEQ ID NO: 168778 - protein, 10 aa, Yellow fever virus
APTRVVLSEM

SEQ ID NO: 168779 - protein, 10 aa, Yellow fever virus
PTRVVLSEMK

SEQ ID NO: 168780 - protein, 10 aa, Yellow fever virus
TRVVLSEMKE

SEQ ID NO: 168781 - protein, 10 aa, Yellow fever virus
RVVLSEMKEA

SEQ ID NO: 168782 - protein, 10 aa, Yellow fever virus
VVLSEMKEAF

SEQ ID NO: 168783 - protein, 10 aa, Yellow fever virus
VLSEMKEAFH

SEQ ID NO: 168784 - protein, 10 aa, Yellow fever virus
LSEMKEAFHG

SEQ ID NO: 168785 - protein, 10 aa, Yellow fever virus
SEMKEAFHGL

SEQ ID NO: 168786 - protein, 10 aa, Yellow fever virus
EMKEAFHGLD

SEQ ID NO: 168787 - protein, 10 aa, Yellow fever virus
MKEAFHGLDV

SEQ ID NO: 168788 - protein, 10 aa, Yellow fever virus
KEAFHGLDVK

SEQ ID NO: 168789 - protein, 10 aa, Yellow fever virus
EAFHGLDVKF

SEQ ID NO: 168790 - protein, 10 aa, Yellow fever virus
AFHGLDVKFH

SEQ ID NO: 168791 - protein, 10 aa, Yellow fever virus
FHGLDVKFHT

SEQ ID NO: 168792 - protein, 10 aa, Yellow fever virus
HGLDVKFHTQ

SEQ ID NO: 168793 - protein, 10 aa, Yellow fever virus
GLDVKFHTQA

SEQ ID NO: 168794 - protein, 10 aa, Yellow fever virus
LDVKFHTQAF

SEQ ID NO: 168795 - protein, 10 aa, Yellow fever virus
DVKFHTQAFS

SEQ ID NO: 168796 - protein, 10 aa, Yellow fever virus
VKFHTQAFSA

SEQ ID NO: 168797 - protein, 10 aa, Yellow fever virus
KFHTQAFSAH

SEQ ID NO: 168798 - protein, 10 aa, Yellow fever virus
FHTQAFSAHG

SEQ ID NO: 168799 - protein, 10 aa, Yellow fever virus
HTQAFSAHGS

SEQ ID NO: 168800 - protein, 10 aa, Yellow fever virus
TQAFSAHGSG

SEQ ID NO: 168801 - protein, 10 aa, Yellow fever virus
QAFSAHGSGR

SEQ ID NO: 168802 - protein, 10 aa, Yellow fever virus
AFSAHGSGRE

SEQ ID NO: 168803 - protein, 10 aa, Yellow fever virus
FSAHGSGREV

SEQ ID NO: 168804 - protein, 10 aa, Yellow fever virus
SAHGSGREVI

SEQ ID NO: 168805 - protein, 10 aa, Yellow fever virus
AHGSGREVID

SEQ ID NO: 168806 - protein, 10 aa, Yellow fever virus
HGSGREVIDA

SEQ ID NO: 168807 - protein, 10 aa, Yellow fever virus
GSGREVIDAM

SEQ ID NO: 168808 - protein, 10 aa, Yellow fever virus
SGREVIDAMC

SEQ ID NO: 168809 - protein, 10 aa, Yellow fever virus
GREVIDAMCH

SEQ ID NO: 168810 - protein, 10 aa, Yellow fever virus
REVIDAMCHA

SEQ ID NO: 168811 - protein, 10 aa, Yellow fever virus
EVIDAMCHAT

SEQ ID NO: 168812 - protein, 10 aa, Yellow fever virus
VIDAMCHATL

SEQ ID NO: 168813 - protein, 10 aa, Yellow fever virus
IDAMCHATLT

SEQ ID NO: 168814 - protein, 10 aa, Yellow fever virus
DAMCHATLTY

SEQ ID NO: 168815 - protein, 10 aa, Yellow fever virus
AMCHATLTYR

SEQ ID NO: 168816 - protein, 10 aa, Yellow fever virus
MCHATLTYRM

SEQ ID NO: 168817 - protein, 10 aa, Yellow fever virus
CHATLTYRML

SEQ ID NO: 168818 - protein, 10 aa, Yellow fever virus
HATLTYRMLE

SEQ ID NO: 168819 - protein, 10 aa, Yellow fever virus
ATLTYRMLEP

SEQ ID NO: 168820 - protein, 10 aa, Yellow fever virus
TLTYRMLEPT

SEQ ID NO: 168821 - protein, 10 aa, Yellow fever virus
LTYRMLEPTR

SEQ ID NO: 168822 - protein, 10 aa, Yellow fever virus
TYRMLEPTRV

SEQ ID NO: 168823 - protein, 10 aa, Yellow fever virus
YRMLEPTRVV

SEQ ID NO: 168824 - protein, 10 aa, Yellow fever virus
RMLEPTRVVN

SEQ ID NO: 168825 - protein, 10 aa, Yellow fever virus
MLEPTRVVNW

SEQ ID NO: 168826 - protein, 10 aa, Yellow fever virus
LEPTRVVNWE

SEQ ID NO: 168827 - protein, 10 aa, Yellow fever virus
EPTRVVNWEV

SEQ ID NO: 168828 - protein, 10 aa, Yellow fever virus
PTRVVNWEVI

SEQ ID NO: 168829 - protein, 10 aa, Yellow fever virus
TRVVNWEVII

SEQ ID NO: 168830 - protein, 10 aa, Yellow fever virus
RVVNWEVIIM

SEQ ID NO: 168831 - protein, 10 aa, Yellow fever virus
VVNWEVIIMD

SEQ ID NO: 168832 - protein, 10 aa, Yellow fever virus
VNWEVIIMDE

SEQ ID NO: 168833 - protein, 10 aa, Yellow fever virus
NWEVIIMDEA

SEQ ID NO: 168834 - protein, 10 aa, Yellow fever virus
WEVIIMDEAH

SEQ ID NO: 168835 - protein, 10 aa, Yellow fever virus
EVIIMDEAHF

SEQ ID NO: 168836 - protein, 10 aa, Yellow fever virus
VIIMDEAHFL

SEQ ID NO: 168837 - protein, 10 aa, Yellow fever virus
IIMDEAHFLD

SEQ ID NO: 168838 - protein, 10 aa, Yellow fever virus
IMDEAHFLDP

SEQ ID NO: 168839 - protein, 10 aa, Yellow fever virus
MDEAHFLDPA

SEQ ID NO: 168840 - protein, 10 aa, Yellow fever virus
DEAHFLDPAS

SEQ ID NO: 168841 - protein, 10 aa, Yellow fever virus
EAHFLDPASI

SEQ ID NO: 168842 - protein, 10 aa, Yellow fever virus
AHFLDPASIA

SEQ ID NO: 168843 - protein, 10 aa, Yellow fever virus
HFLDPASIAA

SEQ ID NO: 168844 - protein, 10 aa, Yellow fever virus
FLDPASIAAR

SEQ ID NO: 168845 - protein, 10 aa, Yellow fever virus
LDPASIAARG

SEQ ID NO: 168846 - protein, 10 aa, Yellow fever virus
DPASIAARGW

SEQ ID NO: 168847 - protein, 10 aa, Yellow fever virus
PASIAARGWA

SEQ ID NO: 168848 - protein, 10 aa, Yellow fever virus
ASIAARGWAA

SEQ ID NO: 168849 - protein, 10 aa, Yellow fever virus
SIAARGWAAH

SEQ ID NO: 168850 - protein, 10 aa, Yellow fever virus
IAARGWAAHR

SEQ ID NO: 168851 - protein, 10 aa, Yellow fever virus
AARGWAAHRA

SEQ ID NO: 168852 - protein, 10 aa, Yellow fever virus
ARGWAAHRAR

SEQ ID NO: 168853 - protein, 10 aa, Yellow fever virus
RGWAAHRARA

SEQ ID NO: 168854 - protein, 10 aa, Yellow fever virus
GWAAHRARAN

SEQ ID NO: 168855 - protein, 10 aa, Yellow fever virus
WAAHRARANE

SEQ ID NO: 168856 - protein, 10 aa, Yellow fever virus
AAHRARANES

SEQ ID NO: 168857 - protein, 10 aa, Yellow fever virus
AHRARANESA

SEQ ID NO: 168858 - protein, 10 aa, Yellow fever virus
HRARANESAT

SEQ ID NO: 168859 - protein, 10 aa, Yellow fever virus
RARANESATI

SEQ ID NO: 168860 - protein, 10 aa, Yellow fever virus
ARANESATIL

SEQ ID NO: 168861 - protein, 10 aa, Yellow fever virus
RANESATILM

SEQ ID NO: 168862 - protein, 10 aa, Yellow fever virus
ANESATILMT

SEQ ID NO: 168863 - protein, 10 aa, Yellow fever virus
NESATILMTA

SEQ ID NO: 168864 - protein, 10 aa, Yellow fever virus
ESATILMTAT

SEQ ID NO: 168865 - protein, 10 aa, Yellow fever virus
SATILMTATP

SEQ ID NO: 168866 - protein, 10 aa, Yellow fever virus
ATILMTATPP

SEQ ID NO: 168867 - protein, 10 aa, Yellow fever virus
TILMTATPPG

SEQ ID NO: 168868 - protein, 10 aa, Yellow fever virus
ILMTATPPGT

SEQ ID NO: 168869 - protein, 10 aa, Yellow fever virus
LMTATPPGTS

SEQ ID NO: 168870 - protein, 10 aa, Yellow fever virus
MTATPPGTSD

SEQ ID NO: 168871 - protein, 10 aa, Yellow fever virus
TATPPGTSDE

SEQ ID NO: 168872 - protein, 10 aa, Yellow fever virus
ATPPGTSDEF

SEQ ID NO: 168873 - protein, 10 aa, Yellow fever virus
TPPGTSDEFP

SEQ ID NO: 168874 - protein, 10 aa, Yellow fever virus
PPGTSDEFPH

SEQ ID NO: 168875 - protein, 10 aa, Yellow fever virus
PGTSDEFPHS

SEQ ID NO: 168876 - protein, 10 aa, Yellow fever virus
GTSDEFPHSN

SEQ ID NO: 168877 - protein, 10 aa, Yellow fever virus
TSDEFPHSNG

SEQ ID NO: 168878 - protein, 10 aa, Yellow fever virus
SDEFPHSNGE

SEQ ID NO: 168879 - protein, 10 aa, Yellow fever virus
DEFPHSNGEI

SEQ ID NO: 168880 - protein, 10 aa, Yellow fever virus
EFPHSNGEIE

SEQ ID NO: 168881 - protein, 10 aa, Yellow fever virus
FPHSNGEIED

SEQ ID NO: 168882 - protein, 10 aa, Yellow fever virus
PHSNGEIEDV

SEQ ID NO: 168883 - protein, 10 aa, Yellow fever virus
HSNGEIEDVQ

SEQ ID NO: 168884 - protein, 10 aa, Yellow fever virus
SNGEIEDVQT

SEQ ID NO: 168885 - protein, 10 aa, Yellow fever virus
NGEIEDVQTD

SEQ ID NO: 168886 - protein, 10 aa, Yellow fever virus
GEIEDVQTDI

SEQ ID NO: 168887 - protein, 10 aa, Yellow fever virus
EIEDVQTDIP

SEQ ID NO: 168888 - protein, 10 aa, Yellow fever virus
IEDVQTDIPS

SEQ ID NO: 168889 - protein, 10 aa, Yellow fever virus
EDVQTDIPSE

SEQ ID NO: 168890 - protein, 10 aa, Yellow fever virus
DVQTDIPSEP

SEQ ID NO: 168891 - protein, 10 aa, Yellow fever virus
VQTDIPSEPW

SEQ ID NO: 168892 - protein, 10 aa, Yellow fever virus
QTDIPSEPWN

SEQ ID NO: 168893 - protein, 10 aa, Yellow fever virus
TDIPSEPWNT

SEQ ID NO: 168894 - protein, 10 aa, Yellow fever virus
DIPSEPWNTG

SEQ ID NO: 168895 - protein, 10 aa, Yellow fever virus
IPSEPWNTGH

SEQ ID NO: 168896 - protein, 10 aa, Yellow fever virus
PSEPWNTGHD

SEQ ID NO: 168897 - protein, 10 aa, Yellow fever virus
SEPWNTGHDW

SEQ ID NO: 168898 - protein, 10 aa, Yellow fever virus
EPWNTGHDWI

SEQ ID NO: 168899 - protein, 10 aa, Yellow fever virus
PWNTGHDWIL

SEQ ID NO: 168900 - protein, 10 aa, Yellow fever virus
WNTGHDWILA

SEQ ID NO: 168901 - protein, 10 aa, Yellow fever virus
NTGHDWILAD

SEQ ID NO: 168902 - protein, 10 aa, Yellow fever virus
TGHDWILADK

SEQ ID NO: 168903 - protein, 10 aa, Yellow fever virus
GHDWILADKR

SEQ ID NO: 168904 - protein, 10 aa, Yellow fever virus
HDWILADKRP

SEQ ID NO: 168905 - protein, 10 aa, Yellow fever virus
DWILADKRPT

SEQ ID NO: 168906 - protein, 10 aa, Yellow fever virus
WILADKRPTA

SEQ ID NO: 168907 - protein, 10 aa, Yellow fever virus
ILADKRPTAW

SEQ ID NO: 168908 - protein, 10 aa, Yellow fever virus
LADKRPTAWF

SEQ ID NO: 168909 - protein, 10 aa, Yellow fever virus
ADKRPTAWFL

SEQ ID NO: 168910 - protein, 10 aa, Yellow fever virus
DKRPTAWFLP

SEQ ID NO: 168911 - protein, 10 aa, Yellow fever virus
KRPTAWFLPS

SEQ ID NO: 168912 - protein, 10 aa, Yellow fever virus
RPTAWFLPSI

SEQ ID NO: 168913 - protein, 10 aa, Yellow fever virus
PTAWFLPSIR

SEQ ID NO: 168914 - protein, 10 aa, Yellow fever virus
TAWFLPSIRA

SEQ ID NO: 168915 - protein, 10 aa, Yellow fever virus
AWFLPSIRAA

SEQ ID NO: 168916 - protein, 10 aa, Yellow fever virus
WFLPSIRAAN

SEQ ID NO: 168917 - protein, 10 aa, Yellow fever virus
FLPSIRAANV

SEQ ID NO: 168918 - protein, 10 aa, Yellow fever virus
LPSIRAANVM

SEQ ID NO: 168919 - protein, 10 aa, Yellow fever virus
PSIRAANVMA

SEQ ID NO: 168920 - protein, 10 aa, Yellow fever virus
SIRAANVMAA

SEQ ID NO: 168921 - protein, 10 aa, Yellow fever virus
IRAANVMAAS

SEQ ID NO: 168922 - protein, 10 aa, Yellow fever virus
RAANVMAASL

SEQ ID NO: 168923 - protein, 10 aa, Yellow fever virus
AANVMAASLR

SEQ ID NO: 168924 - protein, 10 aa, Yellow fever virus
ANVMAASLRK

SEQ ID NO: 168925 - protein, 10 aa, Yellow fever virus
NVMAASLRKA

SEQ ID NO: 168926 - protein, 10 aa, Yellow fever virus
VMAASLRKAG

SEQ ID NO: 168927 - protein, 10 aa, Yellow fever virus
MAASLRKAGK

SEQ ID NO: 168928 - protein, 10 aa, Yellow fever virus
AASLRKAGKS

SEQ ID NO: 168929 - protein, 10 aa, Yellow fever virus
ASLRKAGKSV

SEQ ID NO: 168930 - protein, 10 aa, Yellow fever virus
SLRKAGKSVV

SEQ ID NO: 168931 - protein, 10 aa, Yellow fever virus
LRKAGKSVVV

SEQ ID NO: 168932 - protein, 10 aa, Yellow fever virus
RKAGKSVVVL

SEQ ID NO: 168933 - protein, 10 aa, Yellow fever virus
KAGKSVVVLN

SEQ ID NO: 168934 - protein, 10 aa, Yellow fever virus
AGKSVVVLNR

SEQ ID NO: 168935 - protein, 10 aa, Yellow fever virus
GKSVVVLNRK

SEQ ID NO: 168936 - protein, 10 aa, Yellow fever virus
KSVVVLNRKT

SEQ ID NO: 168937 - protein, 10 aa, Yellow fever virus
SVVVLNRKTF

SEQ ID NO: 168938 - protein, 10 aa, Yellow fever virus
VVVLNRKTFE

SEQ ID NO: 168939 - protein, 10 aa, Yellow fever virus
VVLNRKTFER

SEQ ID NO: 168940 - protein, 10 aa, Yellow fever virus
VLNRKTFERE

SEQ ID NO: 168941 - protein, 10 aa, Yellow fever virus
LNRKTFEREY

SEQ ID NO: 168942 - protein, 10 aa, Yellow fever virus
NRKTFEREYP

SEQ ID NO: 168943 - protein, 10 aa, Yellow fever virus
RKTFEREYPT

SEQ ID NO: 168944 - protein, 10 aa, Yellow fever virus
KTFEREYPTI

SEQ ID NO: 168945 - protein, 10 aa, Yellow fever virus
TFEREYPTIK

SEQ ID NO: 168946 - protein, 10 aa, Yellow fever virus
FEREYPTIKQ

SEQ ID NO: 168947 - protein, 10 aa, Yellow fever virus
EREYPTIKQK

SEQ ID NO: 168948 - protein, 10 aa, Yellow fever virus
REYPTIKQKK

SEQ ID NO: 168949 - protein, 10 aa, Yellow fever virus
EYPTIKQKKP

SEQ ID NO: 168950 - protein, 10 aa, Yellow fever virus
YPTIKQKKPD

SEQ ID NO: 168951 - protein, 10 aa, Yellow fever virus
PTIKQKKPDF

SEQ ID NO: 168952 - protein, 10 aa, Yellow fever virus
TIKQKKPDFI

SEQ ID NO: 168953 - protein, 10 aa, Yellow fever virus
IKQKKPDFIL

SEQ ID NO: 168954 - protein, 10 aa, Yellow fever virus
KQKKPDFILA

SEQ ID NO: 168955 - protein, 10 aa, Yellow fever virus
QKKPDFILAT

SEQ ID NO: 168956 - protein, 10 aa, Yellow fever virus
KKPDFILATD

SEQ ID NO: 168957 - protein, 10 aa, Yellow fever virus
KPDFILATDI

SEQ ID NO: 168958 - protein, 10 aa, Yellow fever virus
PDFILATDIA

SEQ ID NO: 168959 - protein, 10 aa, Yellow fever virus
DFILATDIAE

SEQ ID NO: 168960 - protein, 10 aa, Yellow fever virus
FILATDIAEM

SEQ ID NO: 168961 - protein, 10 aa, Yellow fever virus
ILATDIAEMG

SEQ ID NO: 168962 - protein, 10 aa, Yellow fever virus
LATDIAEMGA

SEQ ID NO: 168963 - protein, 10 aa, Yellow fever virus
ATDIAEMGAN

SEQ ID NO: 168964 - protein, 10 aa, Yellow fever virus
TDIAEMGANL

SEQ ID NO: 168965 - protein, 10 aa, Yellow fever virus
DIAEMGANLC

SEQ ID NO: 168966 - protein, 10 aa, Yellow fever virus
IAEMGANLCV

SEQ ID NO: 168967 - protein, 10 aa, Yellow fever virus
AEMGANLCVE

SEQ ID NO: 168968 - protein, 10 aa, Yellow fever virus
EMGANLCVER

SEQ ID NO: 168969 - protein, 10 aa, Yellow fever virus
MGANLCVERV

SEQ ID NO: 168970 - protein, 10 aa, Yellow fever virus
GANLCVERVL

SEQ ID NO: 168971 - protein, 10 aa, Yellow fever virus
ANLCVERVLD

SEQ ID NO: 168972 - protein, 10 aa, Yellow fever virus
NLCVERVLDC

SEQ ID NO: 168973 - protein, 10 aa, Yellow fever virus
LCVERVLDCR

SEQ ID NO: 168974 - protein, 10 aa, Yellow fever virus
CVERVLDCRT

SEQ ID NO: 168975 - protein, 10 aa, Yellow fever virus
VERVLDCRTA

SEQ ID NO: 168976 - protein, 10 aa, Yellow fever virus
ERVLDCRTAF

SEQ ID NO: 168977 - protein, 10 aa, Yellow fever virus
RVLDCRTAFK

SEQ ID NO: 168978 - protein, 10 aa, Yellow fever virus
VLDCRTAFKP

SEQ ID NO: 168979 - protein, 10 aa, Yellow fever virus
LDCRTAFKPV

SEQ ID NO: 168980 - protein, 10 aa, Yellow fever virus
DCRTAFKPVL

SEQ ID NO: 168981 - protein, 10 aa, Yellow fever virus
CRTAFKPVLV

SEQ ID NO: 168982 - protein, 10 aa, Yellow fever virus
RTAFKPVLVD

SEQ ID NO: 168983 - protein, 10 aa, Yellow fever virus
TAFKPVLVDE

SEQ ID NO: 168984 - protein, 10 aa, Yellow fever virus
AFKPVLVDEG

SEQ ID NO: 168985 - protein, 10 aa, Yellow fever virus
FKPVLVDEGR

SEQ ID NO: 168986 - protein, 10 aa, Yellow fever virus
KPVLVDEGRK

SEQ ID NO: 168987 - protein, 10 aa, Yellow fever virus
PVLVDEGRKV

SEQ ID NO: 168988 - protein, 10 aa, Yellow fever virus
VLVDEGRKVA

SEQ ID NO: 168989 - protein, 10 aa, Yellow fever virus
LVDEGRKVAI

SEQ ID NO: 168990 - protein, 10 aa, Yellow fever virus
VDEGRKVAIK

SEQ ID NO: 168991 - protein, 10 aa, Yellow fever virus
DEGRKVAIKG

SEQ ID NO: 168992 - protein, 10 aa, Yellow fever virus
EGRKVAIKGP

SEQ ID NO: 168993 - protein, 10 aa, Yellow fever virus
GRKVAIKGPL

SEQ ID NO: 168994 - protein, 10 aa, Yellow fever virus
RKVAIKGPLR

SEQ ID NO: 168995 - protein, 10 aa, Yellow fever virus
KVAIKGPLRI

SEQ ID NO: 168996 - protein, 10 aa, Yellow fever virus
VAIKGPLRIS

SEQ ID NO: 168997 - protein, 10 aa, Yellow fever virus
AIKGPLRISA

SEQ ID NO: 168998 - protein, 10 aa, Yellow fever virus
IKGPLRISAS

SEQ ID NO: 168999 - protein, 10 aa, Yellow fever virus
KGPLRISASS

SEQ ID NO: 169000 - protein, 10 aa, Yellow fever virus
GPLRISASSA

SEQ ID NO: 169001 - protein, 10 aa, Yellow fever virus
PLRISASSAA

SEQ ID NO: 169002 - protein, 10 aa, Yellow fever virus
LRISASSAAQ

SEQ ID NO: 169003 - protein, 10 aa, Yellow fever virus
RISASSAAQR

SEQ ID NO: 169004 - protein, 10 aa, Yellow fever virus
ISASSAAQRR

SEQ ID NO: 169005 - protein, 10 aa, Yellow fever virus
SASSAAQRRG

SEQ ID NO: 169006 - protein, 10 aa, Yellow fever virus
ASSAAQRRGR

SEQ ID NO: 169007 - protein, 10 aa, Yellow fever virus
SSAAQRRGRI

SEQ ID NO: 169008 - protein, 10 aa, Yellow fever virus
SAAQRRGRIG

SEQ ID NO: 169009 - protein, 10 aa, Yellow fever virus
AAQRRGRIGR

SEQ ID NO: 169010 - protein, 10 aa, Yellow fever virus
AQRRGRIGRN

SEQ ID NO: 169011 - protein, 10 aa, Yellow fever virus
QRRGRIGRNP

SEQ ID NO: 169012 - protein, 10 aa, Yellow fever virus
RRGRIGRNPN

SEQ ID NO: 169013 - protein, 10 aa, Yellow fever virus
RGRIGRNPNR

SEQ ID NO: 169014 - protein, 10 aa, Yellow fever virus
GRIGRNPNRD

SEQ ID NO: 169015 - protein, 10 aa, Yellow fever virus
RIGRNPNRDG

SEQ ID NO: 169016 - protein, 10 aa, Yellow fever virus
IGRNPNRDGD

SEQ ID NO: 169017 - protein, 10 aa, Yellow fever virus
GRNPNRDGDS

SEQ ID NO: 169018 - protein, 10 aa, Yellow fever virus
RNPNRDGDSY

SEQ ID NO: 169019 - protein, 10 aa, Yellow fever virus
NPNRDGDSYY

SEQ ID NO: 169020 - protein, 10 aa, Yellow fever virus
PNRDGDSYYY

SEQ ID NO: 169021 - protein, 10 aa, Yellow fever virus
NRDGDSYYYS

SEQ ID NO: 169022 - protein, 10 aa, Yellow fever virus
RDGDSYYYSE

SEQ ID NO: 169023 - protein, 10 aa, Yellow fever virus
DGDSYYYSEP

SEQ ID NO: 169024 - protein, 10 aa, Yellow fever virus
GDSYYYSEPT

SEQ ID NO: 169025 - protein, 10 aa, Yellow fever virus
DSYYYSEPTS

SEQ ID NO: 169026 - protein, 10 aa, Yellow fever virus
SYYYSEPTSE

SEQ ID NO: 169027 - protein, 10 aa, Yellow fever virus
YYYSEPTSEN

SEQ ID NO: 169028 - protein, 10 aa, Yellow fever virus
YYSEPTSENN

SEQ ID NO: 169029 - protein, 10 aa, Yellow fever virus
YSEPTSENNA

SEQ ID NO: 169030 - protein, 10 aa, Yellow fever virus
SEPTSENNAH

SEQ ID NO: 169031 - protein, 10 aa, Yellow fever virus
EPTSENNAHH

SEQ ID NO: 169032 - protein, 10 aa, Yellow fever virus
PTSENNAHHV

SEQ ID NO: 169033 - protein, 10 aa, Yellow fever virus
TSENNAHHVC

SEQ ID NO: 169034 - protein, 10 aa, Yellow fever virus
SENNAHHVCW

SEQ ID NO: 169035 - protein, 10 aa, Yellow fever virus
ENNAHHVCWL

SEQ ID NO: 169036 - protein, 10 aa, Yellow fever virus
NNAHHVCWLE

SEQ ID NO: 169037 - protein, 10 aa, Yellow fever virus
NAHHVCWLEA

SEQ ID NO: 169038 - protein, 10 aa, Yellow fever virus
AHHVCWLEAS

SEQ ID NO: 169039 - protein, 10 aa, Yellow fever virus
HHVCWLEASM

SEQ ID NO: 169040 - protein, 10 aa, Yellow fever virus
HVCWLEASML

SEQ ID NO: 169041 - protein, 10 aa, Yellow fever virus
VCWLEASMLL

SEQ ID NO: 169042 - protein, 10 aa, Yellow fever virus
CWLEASMLLD

SEQ ID NO: 169043 - protein, 10 aa, Yellow fever virus
WLEASMLLDN

SEQ ID NO: 169044 - protein, 10 aa, Yellow fever virus
LEASMLLDNM

SEQ ID NO: 169045 - protein, 10 aa, Yellow fever virus
EASMLLDNME

SEQ ID NO: 169046 - protein, 10 aa, Yellow fever virus
ASMLLDNMEV

SEQ ID NO: 169047 - protein, 10 aa, Yellow fever virus
SMLLDNMEVR

SEQ ID NO: 169048 - protein, 10 aa, Yellow fever virus
MLLDNMEVRG

SEQ ID NO: 169049 - protein, 10 aa, Yellow fever virus
LLDNMEVRGG

SEQ ID NO: 169050 - protein, 10 aa, Yellow fever virus
LDNMEVRGGM

SEQ ID NO: 169051 - protein, 10 aa, Yellow fever virus
DNMEVRGGMV

SEQ ID NO: 169052 - protein, 10 aa, Yellow fever virus
NMEVRGGMVA

SEQ ID NO: 169053 - protein, 10 aa, Yellow fever virus
MEVRGGMVAP

SEQ ID NO: 169054 - protein, 10 aa, Yellow fever virus
EVRGGMVAPL

SEQ ID NO: 169055 - protein, 10 aa, Yellow fever virus
VRGGMVAPLY

SEQ ID NO: 169056 - protein, 10 aa, Yellow fever virus
RGGMVAPLYG

SEQ ID NO: 169057 - protein, 10 aa, Yellow fever virus
GGMVAPLYGV

SEQ ID NO: 169058 - protein, 10 aa, Yellow fever virus
GMVAPLYGVE

SEQ ID NO: 169059 - protein, 10 aa, Yellow fever virus
MVAPLYGVEG

SEQ ID NO: 169060 - protein, 10 aa, Yellow fever virus
VAPLYGVEGT

SEQ ID NO: 169061 - protein, 10 aa, Yellow fever virus
APLYGVEGTK

SEQ ID NO: 169062 - protein, 10 aa, Yellow fever virus
PLYGVEGTKT

SEQ ID NO: 169063 - protein, 10 aa, Yellow fever virus
LYGVEGTKTP

SEQ ID NO: 169064 - protein, 10 aa, Yellow fever virus
YGVEGTKTPV

SEQ ID NO: 169065 - protein, 10 aa, Yellow fever virus
GVEGTKTPVS

SEQ ID NO: 169066 - protein, 10 aa, Yellow fever virus
VEGTKTPVSP

SEQ ID NO: 169067 - protein, 10 aa, Yellow fever virus
EGTKTPVSPG

SEQ ID NO: 169068 - protein, 10 aa, Yellow fever virus
GTKTPVSPGE

SEQ ID NO: 169069 - protein, 10 aa, Yellow fever virus
TKTPVSPGEM

SEQ ID NO: 169070 - protein, 10 aa, Yellow fever virus
KTPVSPGEMR

SEQ ID NO: 169071 - protein, 10 aa, Yellow fever virus
TPVSPGEMRL

SEQ ID NO: 169072 - protein, 10 aa, Yellow fever virus
PVSPGEMRLR

SEQ ID NO: 169073 - protein, 10 aa, Yellow fever virus
VSPGEMRLRD

SEQ ID NO: 169074 - protein, 10 aa, Yellow fever virus
SPGEMRLRDD

SEQ ID NO: 169075 - protein, 10 aa, Yellow fever virus
PGEMRLRDDQ

SEQ ID NO: 169076 - protein, 10 aa, Yellow fever virus
GEMRLRDDQR

SEQ ID NO: 169077 - protein, 10 aa, Yellow fever virus
EMRLRDDQRK

SEQ ID NO: 169078 - protein, 10 aa, Yellow fever virus
MRLRDDQRKV

SEQ ID NO: 169079 - protein, 10 aa, Yellow fever virus
RLRDDQRKVF

SEQ ID NO: 169080 - protein, 10 aa, Yellow fever virus
LRDDQRKVFR

SEQ ID NO: 169081 - protein, 10 aa, Yellow fever virus
RDDQRKVFRE

SEQ ID NO: 169082 - protein, 10 aa, Yellow fever virus
DDQRKVFREL

SEQ ID NO: 169083 - protein, 10 aa, Yellow fever virus
DQRKVFRELV

SEQ ID NO: 169084 - protein, 10 aa, Yellow fever virus
QRKVFRELVR

SEQ ID NO: 169085 - protein, 10 aa, Yellow fever virus
RKVFRELVRN

SEQ ID NO: 169086 - protein, 10 aa, Yellow fever virus
KVFRELVRNC

SEQ ID NO: 169087 - protein, 10 aa, Yellow fever virus
VFRELVRNCD

SEQ ID NO: 169088 - protein, 10 aa, Yellow fever virus
FRELVRNCDL

SEQ ID NO: 169089 - protein, 10 aa, Yellow fever virus
RELVRNCDLP

SEQ ID NO: 169090 - protein, 10 aa, Yellow fever virus
ELVRNCDLPV

SEQ ID NO: 169091 - protein, 10 aa, Yellow fever virus
LVRNCDLPVW

SEQ ID NO: 169092 - protein, 10 aa, Yellow fever virus
VRNCDLPVWL

SEQ ID NO: 169093 - protein, 10 aa, Yellow fever virus
RNCDLPVWLS

SEQ ID NO: 169094 - protein, 10 aa, Yellow fever virus
NCDLPVWLSW

SEQ ID NO: 169095 - protein, 10 aa, Yellow fever virus
CDLPVWLSWQ

SEQ ID NO: 169096 - protein, 10 aa, Yellow fever virus
DLPVWLSWQV

SEQ ID NO: 169097 - protein, 10 aa, Yellow fever virus
LPVWLSWQVA

SEQ ID NO: 169098 - protein, 10 aa, Yellow fever virus
PVWLSWQVAK

SEQ ID NO: 169099 - protein, 10 aa, Yellow fever virus
VWLSWQVAKA

SEQ ID NO: 169100 - protein, 10 aa, Yellow fever virus
WLSWQVAKAG

SEQ ID NO: 169101 - protein, 10 aa, Yellow fever virus
LSWQVAKAGL

SEQ ID NO: 169102 - protein, 10 aa, Yellow fever virus
SWQVAKAGLK

SEQ ID NO: 169103 - protein, 10 aa, Yellow fever virus
WQVAKAGLKT

SEQ ID NO: 169104 - protein, 10 aa, Yellow fever virus
QVAKAGLKTN

SEQ ID NO: 169105 - protein, 10 aa, Yellow fever virus
VAKAGLKTND

SEQ ID NO: 169106 - protein, 10 aa, Yellow fever virus
AKAGLKTNDR

SEQ ID NO: 169107 - protein, 10 aa, Yellow fever virus
KAGLKTNDRK

SEQ ID NO: 169108 - protein, 10 aa, Yellow fever virus
AGLKTNDRKW

SEQ ID NO: 169109 - protein, 10 aa, Yellow fever virus
GLKTNDRKWC

SEQ ID NO: 169110 - protein, 10 aa, Yellow fever virus
LKTNDRKWCF

SEQ ID NO: 169111 - protein, 10 aa, Yellow fever virus
KTNDRKWCFE

SEQ ID NO: 169112 - protein, 10 aa, Yellow fever virus
TNDRKWCFEG

SEQ ID NO: 169113 - protein, 10 aa, Yellow fever virus
NDRKWCFEGP

SEQ ID NO: 169114 - protein, 10 aa, Yellow fever virus
DRKWCFEGPE

SEQ ID NO: 169115 - protein, 10 aa, Yellow fever virus
RKWCFEGPEE

SEQ ID NO: 169116 - protein, 10 aa, Yellow fever virus
KWCFEGPEEH

SEQ ID NO: 169117 - protein, 10 aa, Yellow fever virus
WCFEGPEEHE

SEQ ID NO: 169118 - protein, 10 aa, Yellow fever virus
CFEGPEEHEI

SEQ ID NO: 169119 - protein, 10 aa, Yellow fever virus
FEGPEEHEIL

SEQ ID NO: 169120 - protein, 10 aa, Yellow fever virus
EGPEEHEILN

SEQ ID NO: 169121 - protein, 10 aa, Yellow fever virus
GPEEHEILND

SEQ ID NO: 169122 - protein, 10 aa, Yellow fever virus
PEEHEILNDS

SEQ ID NO: 169123 - protein, 10 aa, Yellow fever virus
EEHEILNDSG

SEQ ID NO: 169124 - protein, 10 aa, Yellow fever virus
EHEILNDSGE

SEQ ID NO: 169125 - protein, 10 aa, Yellow fever virus
HEILNDSGET

SEQ ID NO: 169126 - protein, 10 aa, Yellow fever virus
EILNDSGETV

SEQ ID NO: 169127 - protein, 10 aa, Yellow fever virus
ILNDSGETVK

SEQ ID NO: 169128 - protein, 10 aa, Yellow fever virus
LNDSGETVKC

SEQ ID NO: 169129 - protein, 10 aa, Yellow fever virus
NDSGETVKCR

SEQ ID NO: 169130 - protein, 10 aa, Yellow fever virus
DSGETVKCRA

SEQ ID NO: 169131 - protein, 10 aa, Yellow fever virus
SGETVKCRAP

SEQ ID NO: 169132 - protein, 10 aa, Yellow fever virus
GETVKCRAPG

SEQ ID NO: 169133 - protein, 10 aa, Yellow fever virus
ETVKCRAPGG

SEQ ID NO: 169134 - protein, 10 aa, Yellow fever virus
TVKCRAPGGA

SEQ ID NO: 169135 - protein, 10 aa, Yellow fever virus
VKCRAPGGAK

SEQ ID NO: 169136 - protein, 10 aa, Yellow fever virus
KCRAPGGAKK

SEQ ID NO: 169137 - protein, 10 aa, Yellow fever virus
CRAPGGAKKP

SEQ ID NO: 169138 - protein, 10 aa, Yellow fever virus
RAPGGAKKPL

SEQ ID NO: 169139 - protein, 10 aa, Yellow fever virus
APGGAKKPLR

SEQ ID NO: 169140 - protein, 10 aa, Yellow fever virus
PGGAKKPLRP

SEQ ID NO: 169141 - protein, 10 aa, Yellow fever virus
GGAKKPLRPR

SEQ ID NO: 169142 - protein, 10 aa, Yellow fever virus
GAKKPLRPRW

SEQ ID NO: 169143 - protein, 10 aa, Yellow fever virus
AKKPLRPRWC

SEQ ID NO: 169144 - protein, 10 aa, Yellow fever virus
KKPLRPRWCD

SEQ ID NO: 169145 - protein, 10 aa, Yellow fever virus
KPLRPRWCDE

SEQ ID NO: 169146 - protein, 10 aa, Yellow fever virus
PLRPRWCDER

SEQ ID NO: 169147 - protein, 10 aa, Yellow fever virus
LRPRWCDERV

SEQ ID NO: 169148 - protein, 10 aa, Yellow fever virus
RPRWCDERVS

SEQ ID NO: 169149 - protein, 10 aa, Yellow fever virus
PRWCDERVSS

SEQ ID NO: 169150 - protein, 10 aa, Yellow fever virus
RWCDERVSSD

SEQ ID NO: 169151 - protein, 10 aa, Yellow fever virus
WCDERVSSDQ

SEQ ID NO: 169152 - protein, 10 aa, Yellow fever virus
CDERVSSDQS

SEQ ID NO: 169153 - protein, 10 aa, Yellow fever virus
DERVSSDQSA

SEQ ID NO: 169154 - protein, 10 aa, Yellow fever virus
ERVSSDQSAL

SEQ ID NO: 169155 - protein, 10 aa, Yellow fever virus
RVSSDQSALS

SEQ ID NO: 169156 - protein, 10 aa, Yellow fever virus
VSSDQSALSE

SEQ ID NO: 169157 - protein, 10 aa, Yellow fever virus
SSDQSALSEF

SEQ ID NO: 169158 - protein, 10 aa, Yellow fever virus
SDQSALSEFI

SEQ ID NO: 169159 - protein, 10 aa, Yellow fever virus
DQSALSEFIK

SEQ ID NO: 169160 - protein, 10 aa, Yellow fever virus
QSALSEFIKF

SEQ ID NO: 169161 - protein, 10 aa, Yellow fever virus
SALSEFIKFA

SEQ ID NO: 169162 - protein, 10 aa, Yellow fever virus
ALSEFIKFAE

SEQ ID NO: 169163 - protein, 10 aa, Yellow fever virus
LSEFIKFAEG

SEQ ID NO: 169164 - protein, 10 aa, Yellow fever virus
SEFIKFAEGR

SEQ ID NO: 169165 - protein, 10 aa, Yellow fever virus
EFIKFAEGRR

SEQ ID NO: 169166 - protein, 10 aa, Yellow fever virus
FIKFAEGRRG

SEQ ID NO: 169167 - protein, 10 aa, Yellow fever virus
IKFAEGRRGA

SEQ ID NO: 169168 - protein, 10 aa, Yellow fever virus
KFAEGRRGAA

SEQ ID NO: 169169 - protein, 10 aa, Yellow fever virus
FAEGRRGAAE

SEQ ID NO: 169170 - protein, 10 aa, Yellow fever virus
AEGRRGAAEV

SEQ ID NO: 169171 - protein, 10 aa, Yellow fever virus
EGRRGAAEVL

SEQ ID NO: 169172 - protein, 10 aa, Yellow fever virus
GRRGAAEVLV

SEQ ID NO: 169173 - protein, 10 aa, Yellow fever virus
RRGAAEVLVV

SEQ ID NO: 169174 - protein, 10 aa, Yellow fever virus
RGAAEVLVVL

SEQ ID NO: 169175 - protein, 10 aa, Yellow fever virus
GAAEVLVVLS

SEQ ID NO: 169176 - protein, 10 aa, Yellow fever virus
AAEVLVVLSE

SEQ ID NO: 169177 - protein, 10 aa, Yellow fever virus
AEVLVVLSEL

SEQ ID NO: 169178 - protein, 10 aa, Yellow fever virus
EVLVVLSELP

SEQ ID NO: 169179 - protein, 10 aa, Yellow fever virus
VLVVLSELPD

SEQ ID NO: 169180 - protein, 10 aa, Yellow fever virus
LVVLSELPDF

SEQ ID NO: 169181 - protein, 10 aa, Yellow fever virus
VVLSELPDFL

SEQ ID NO: 169182 - protein, 10 aa, Yellow fever virus
VLSELPDFLA

SEQ ID NO: 169183 - protein, 10 aa, Yellow fever virus
LSELPDFLAK

SEQ ID NO: 169184 - protein, 10 aa, Yellow fever virus
SELPDFLAKK

SEQ ID NO: 169185 - protein, 10 aa, Yellow fever virus
ELPDFLAKKG

SEQ ID NO: 169186 - protein, 10 aa, Yellow fever virus
LPDFLAKKGG

SEQ ID NO: 169187 - protein, 10 aa, Yellow fever virus
PDFLAKKGGE

SEQ ID NO: 169188 - protein, 10 aa, Yellow fever virus
DFLAKKGGEA

SEQ ID NO: 169189 - protein, 10 aa, Yellow fever virus
FLAKKGGEAM

SEQ ID NO: 169190 - protein, 10 aa, Yellow fever virus
LAKKGGEAMD

SEQ ID NO: 169191 - protein, 10 aa, Yellow fever virus
AKKGGEAMDT

SEQ ID NO: 169192 - protein, 10 aa, Yellow fever virus
KKGGEAMDTI

SEQ ID NO: 169193 - protein, 10 aa, Yellow fever virus
KGGEAMDTIS

SEQ ID NO: 169194 - protein, 10 aa, Yellow fever virus
GGEAMDTISV

SEQ ID NO: 169195 - protein, 10 aa, Yellow fever virus
GEAMDTISVF

SEQ ID NO: 169196 - protein, 10 aa, Yellow fever virus
EAMDTISVFL

SEQ ID NO: 169197 - protein, 10 aa, Yellow fever virus
AMDTISVFLH

SEQ ID NO: 169198 - protein, 10 aa, Yellow fever virus
MDTISVFLHS

SEQ ID NO: 169199 - protein, 10 aa, Yellow fever virus
DTISVFLHSE

SEQ ID NO: 169200 - protein, 10 aa, Yellow fever virus
TISVFLHSEE

SEQ ID NO: 169201 - protein, 10 aa, Yellow fever virus
ISVFLHSEEG

SEQ ID NO: 169202 - protein, 10 aa, Yellow fever virus
SVFLHSEEGS

SEQ ID NO: 169203 - protein, 10 aa, Yellow fever virus
VFLHSEEGSR

SEQ ID NO: 169204 - protein, 10 aa, Yellow fever virus
FLHSEEGSRA

SEQ ID NO: 169205 - protein, 10 aa, Yellow fever virus
LHSEEGSRAY

SEQ ID NO: 169206 - protein, 10 aa, Yellow fever virus
HSEEGSRAYR

SEQ ID NO: 169207 - protein, 10 aa, Yellow fever virus
SEEGSRAYRN

SEQ ID NO: 169208 - protein, 10 aa, Yellow fever virus
EEGSRAYRNA

SEQ ID NO: 169209 - protein, 10 aa, Yellow fever virus
EGSRAYRNAL

SEQ ID NO: 169210 - protein, 10 aa, Yellow fever virus
GSRAYRNALS

SEQ ID NO: 169211 - protein, 10 aa, Yellow fever virus
SRAYRNALSM

SEQ ID NO: 169212 - protein, 10 aa, Yellow fever virus
RAYRNALSMM

SEQ ID NO: 169213 - protein, 10 aa, Yellow fever virus
AYRNALSMMP

SEQ ID NO: 169214 - protein, 10 aa, Yellow fever virus
YRNALSMMPE

SEQ ID NO: 169215 - protein, 10 aa, Yellow fever virus
RNALSMMPEA

SEQ ID NO: 169216 - protein, 10 aa, Yellow fever virus
NALSMMPEAM

SEQ ID NO: 169217 - protein, 10 aa, Yellow fever virus
ALSMMPEAMT

SEQ ID NO: 169218 - protein, 10 aa, Yellow fever virus
LSMMPEAMTI

SEQ ID NO: 169219 - protein, 10 aa, Yellow fever virus
SMMPEAMTIV

SEQ ID NO: 169220 - protein, 10 aa, Yellow fever virus
MMPEAMTIVM

SEQ ID NO: 169221 - protein, 10 aa, Yellow fever virus
MPEAMTIVML

SEQ ID NO: 169222 - protein, 10 aa, Yellow fever virus
PEAMTIVMLF

SEQ ID NO: 169223 - protein, 10 aa, Yellow fever virus
EAMTIVMLFI

SEQ ID NO: 169224 - protein, 10 aa, Yellow fever virus
AMTIVMLFIL

SEQ ID NO: 169225 - protein, 10 aa, Yellow fever virus
MTIVMLFILA

SEQ ID NO: 169226 - protein, 10 aa, Yellow fever virus
TIVMLFILAG

SEQ ID NO: 169227 - protein, 10 aa, Yellow fever virus
IVMLFILAGL

SEQ ID NO: 169228 - protein, 10 aa, Yellow fever virus
VMLFILAGLL

SEQ ID NO: 169229 - protein, 10 aa, Yellow fever virus
MLFILAGLLT

SEQ ID NO: 169230 - protein, 10 aa, Yellow fever virus
LFILAGLLTS

SEQ ID NO: 169231 - protein, 10 aa, Yellow fever virus
FILAGLLTSG

SEQ ID NO: 169232 - protein, 10 aa, Yellow fever virus
ILAGLLTSGM

SEQ ID NO: 169233 - protein, 10 aa, Yellow fever virus
LAGLLTSGMV

SEQ ID NO: 169234 - protein, 10 aa, Yellow fever virus
AGLLTSGMVI

SEQ ID NO: 169235 - protein, 10 aa, Yellow fever virus
GLLTSGMVIF

SEQ ID NO: 169236 - protein, 10 aa, Yellow fever virus
LLTSGMVIFF

SEQ ID NO: 169237 - protein, 10 aa, Yellow fever virus
LTSGMVIFFM

SEQ ID NO: 169238 - protein, 10 aa, Yellow fever virus
TSGMVIFFMS

SEQ ID NO: 169239 - protein, 10 aa, Yellow fever virus
SGMVIFFMSP

SEQ ID NO: 169240 - protein, 10 aa, Yellow fever virus
GMVIFFMSPK

SEQ ID NO: 169241 - protein, 10 aa, Yellow fever virus
MVIFFMSPKG

SEQ ID NO: 169242 - protein, 10 aa, Yellow fever virus
VIFFMSPKGI

SEQ ID NO: 169243 - protein, 10 aa, Yellow fever virus
IFFMSPKGIS

SEQ ID NO: 169244 - protein, 10 aa, Yellow fever virus
FFMSPKGISR

SEQ ID NO: 169245 - protein, 10 aa, Yellow fever virus
FMSPKGISRM

SEQ ID NO: 169246 - protein, 10 aa, Yellow fever virus
MSPKGISRMS

SEQ ID NO: 169247 - protein, 10 aa, Yellow fever virus
SPKGISRMSM

SEQ ID NO: 169248 - protein, 10 aa, Yellow fever virus
PKGISRMSMA

SEQ ID NO: 169249 - protein, 10 aa, Yellow fever virus
KGISRMSMAM

SEQ ID NO: 169250 - protein, 10 aa, Yellow fever virus
GISRMSMAMG

SEQ ID NO: 169251 - protein, 10 aa, Yellow fever virus
ISRMSMAMGT

SEQ ID NO: 169252 - protein, 10 aa, Yellow fever virus
SRMSMAMGTM

SEQ ID NO: 169253 - protein, 10 aa, Yellow fever virus
RMSMAMGTMA

SEQ ID NO: 169254 - protein, 10 aa, Yellow fever virus
MSMAMGTMAG

SEQ ID NO: 169255 - protein, 10 aa, Yellow fever virus
SMAMGTMAGC

SEQ ID NO: 169256 - protein, 10 aa, Yellow fever virus
MAMGTMAGCG

SEQ ID NO: 169257 - protein, 10 aa, Yellow fever virus
AMGTMAGCGY

SEQ ID NO: 169258 - protein, 10 aa, Yellow fever virus
MGTMAGCGYL

SEQ ID NO: 169259 - protein, 10 aa, Yellow fever virus
GTMAGCGYLM

SEQ ID NO: 169260 - protein, 10 aa, Yellow fever virus
TMAGCGYLMF

SEQ ID NO: 169261 - protein, 10 aa, Yellow fever virus
MAGCGYLMFL

SEQ ID NO: 169262 - protein, 10 aa, Yellow fever virus
AGCGYLMFLG

SEQ ID NO: 169263 - protein, 10 aa, Yellow fever virus
GCGYLMFLGG

SEQ ID NO: 169264 - protein, 10 aa, Yellow fever virus
CGYLMFLGGV

SEQ ID NO: 169265 - protein, 10 aa, Yellow fever virus
GYLMFLGGVK

SEQ ID NO: 169266 - protein, 10 aa, Yellow fever virus
YLMFLGGVKP

SEQ ID NO: 169267 - protein, 10 aa, Yellow fever virus
LMFLGGVKPT

SEQ ID NO: 169268 - protein, 10 aa, Yellow fever virus
MFLGGVKPTH

SEQ ID NO: 169269 - protein, 10 aa, Yellow fever virus
FLGGVKPTHI

SEQ ID NO: 169270 - protein, 10 aa, Yellow fever virus
LGGVKPTHIS

SEQ ID NO: 169271 - protein, 10 aa, Yellow fever virus
GGVKPTHISY

SEQ ID NO: 169272 - protein, 10 aa, Yellow fever virus
GVKPTHISYI

SEQ ID NO: 169273 - protein, 10 aa, Yellow fever virus
VKPTHISYIM

SEQ ID NO: 169274 - protein, 10 aa, Yellow fever virus
KPTHISYIML

SEQ ID NO: 169275 - protein, 10 aa, Yellow fever virus
PTHISYIMLI

SEQ ID NO: 169276 - protein, 10 aa, Yellow fever virus
THISYIMLIF

SEQ ID NO: 169277 - protein, 10 aa, Yellow fever virus
HISYIMLIFF

SEQ ID NO: 169278 - protein, 10 aa, Yellow fever virus
ISYIMLIFFV

SEQ ID NO: 169279 - protein, 10 aa, Yellow fever virus
SYIMLIFFVL

SEQ ID NO: 169280 - protein, 10 aa, Yellow fever virus
YIMLIFFVLM

SEQ ID NO: 169281 - protein, 10 aa, Yellow fever virus
IMLIFFVLMV

SEQ ID NO: 169282 - protein, 10 aa, Yellow fever virus
MLIFFVLMVV

SEQ ID NO: 169283 - protein, 10 aa, Yellow fever virus
LIFFVLMVVV

SEQ ID NO: 169284 - protein, 10 aa, Yellow fever virus
IFFVLMVVVI

SEQ ID NO: 169285 - protein, 10 aa, Yellow fever virus
FFVLMVVVIP

SEQ ID NO: 169286 - protein, 10 aa, Yellow fever virus
FVLMVVVIPE

SEQ ID NO: 169287 - protein, 10 aa, Yellow fever virus
VLMVVVIPEP

SEQ ID NO: 169288 - protein, 10 aa, Yellow fever virus
LMVVVIPEPG

SEQ ID NO: 169289 - protein, 10 aa, Yellow fever virus
MVVVIPEPGQ

SEQ ID NO: 169290 - protein, 10 aa, Yellow fever virus
VVVIPEPGQQ

SEQ ID NO: 169291 - protein, 10 aa, Yellow fever virus
VVIPEPGQQR

SEQ ID NO: 169292 - protein, 10 aa, Yellow fever virus
VIPEPGQQRS

SEQ ID NO: 169293 - protein, 10 aa, Yellow fever virus
IPEPGQQRSI

SEQ ID NO: 169294 - protein, 10 aa, Yellow fever virus
PEPGQQRSIQ

SEQ ID NO: 169295 - protein, 10 aa, Yellow fever virus
EPGQQRSIQD

SEQ ID NO: 169296 - protein, 10 aa, Yellow fever virus
PGQQRSIQDN

SEQ ID NO: 169297 - protein, 10 aa, Yellow fever virus
GQQRSIQDNQ

SEQ ID NO: 169298 - protein, 10 aa, Yellow fever virus
QQRSIQDNQV

SEQ ID NO: 169299 - protein, 10 aa, Yellow fever virus
QRSIQDNQVA

SEQ ID NO: 169300 - protein, 10 aa, Yellow fever virus
RSIQDNQVAY

SEQ ID NO: 169301 - protein, 10 aa, Yellow fever virus
SIQDNQVAYL

SEQ ID NO: 169302 - protein, 10 aa, Yellow fever virus
IQDNQVAYLI

SEQ ID NO: 169303 - protein, 10 aa, Yellow fever virus
QDNQVAYLII

SEQ ID NO: 169304 - protein, 10 aa, Yellow fever virus
DNQVAYLIIG

SEQ ID NO: 169305 - protein, 10 aa, Yellow fever virus
NQVAYLIIGI

SEQ ID NO: 169306 - protein, 10 aa, Yellow fever virus
QVAYLIIGIL

SEQ ID NO: 169307 - protein, 10 aa, Yellow fever virus
VAYLIIGILT

SEQ ID NO: 169308 - protein, 10 aa, Yellow fever virus
AYLIIGILTL

SEQ ID NO: 169309 - protein, 10 aa, Yellow fever virus
YLIIGILTLV

SEQ ID NO: 169310 - protein, 10 aa, Yellow fever virus
LIIGILTLVS

SEQ ID NO: 169311 - protein, 10 aa, Yellow fever virus
IIGILTLVSA

SEQ ID NO: 169312 - protein, 10 aa, Yellow fever virus
IGILTLVSAV

SEQ ID NO: 169313 - protein, 10 aa, Yellow fever virus
GILTLVSAVA

SEQ ID NO: 169314 - protein, 10 aa, Yellow fever virus
ILTLVSAVAA

SEQ ID NO: 169315 - protein, 10 aa, Yellow fever virus
LTLVSAVAAN

SEQ ID NO: 169316 - protein, 10 aa, Yellow fever virus
TLVSAVAANE

SEQ ID NO: 169317 - protein, 10 aa, Yellow fever virus
LVSAVAANEL

SEQ ID NO: 169318 - protein, 10 aa, Yellow fever virus
VSAVAANELG

SEQ ID NO: 169319 - protein, 10 aa, Yellow fever virus
SAVAANELGM

SEQ ID NO: 169320 - protein, 10 aa, Yellow fever virus
AVAANELGML

SEQ ID NO: 169321 - protein, 10 aa, Yellow fever virus
VAANELGMLE

SEQ ID NO: 169322 - protein, 10 aa, Yellow fever virus
AANELGMLEK

SEQ ID NO: 169323 - protein, 10 aa, Yellow fever virus
ANELGMLEKT

SEQ ID NO: 169324 - protein, 10 aa, Yellow fever virus
NELGMLEKTK

SEQ ID NO: 169325 - protein, 10 aa, Yellow fever virus
ELGMLEKTKE

SEQ ID NO: 169326 - protein, 10 aa, Yellow fever virus
LGMLEKTKED

SEQ ID NO: 169327 - protein, 10 aa, Yellow fever virus
GMLEKTKEDL

SEQ ID NO: 169328 - protein, 10 aa, Yellow fever virus
MLEKTKEDLF

SEQ ID NO: 169329 - protein, 10 aa, Yellow fever virus
LEKTKEDLFG

SEQ ID NO: 169330 - protein, 10 aa, Yellow fever virus
EKTKEDLFGK

SEQ ID NO: 169331 - protein, 10 aa, Yellow fever virus
KTKEDLFGKK

SEQ ID NO: 169332 - protein, 10 aa, Yellow fever virus
TKEDLFGKKN

SEQ ID NO: 169333 - protein, 10 aa, Yellow fever virus
IPSSASPWSW

SEQ ID NO: 169334 - protein, 10 aa, Yellow fever virus
PSSASPWSWP

SEQ ID NO: 169335 - protein, 10 aa, Yellow fever virus
SSASPWSWPD

SEQ ID NO: 169336 - protein, 10 aa, Yellow fever virus
SASPWSWPDL

SEQ ID NO: 169337 - protein, 10 aa, Yellow fever virus
ASPWSWPDLD

SEQ ID NO: 169338 - protein, 10 aa, Yellow fever virus
SPWSWPDLDL

SEQ ID NO: 169339 - protein, 10 aa, Yellow fever virus
PWSWPDLDLK

SEQ ID NO: 169340 - protein, 10 aa, Yellow fever virus
WSWPDLDLKP

SEQ ID NO: 169341 - protein, 10 aa, Yellow fever virus
SWPDLDLKPG

SEQ ID NO: 169342 - protein, 10 aa, Yellow fever virus
WPDLDLKPGA

SEQ ID NO: 169343 - protein, 10 aa, Yellow fever virus
PDLDLKPGAA

SEQ ID NO: 169344 - protein, 10 aa, Yellow fever virus
DLDLKPGAAW

SEQ ID NO: 169345 - protein, 10 aa, Yellow fever virus
LDLKPGAAWT

SEQ ID NO: 169346 - protein, 10 aa, Yellow fever virus
DLKPGAAWTV

SEQ ID NO: 169347 - protein, 10 aa, Yellow fever virus
LKPGAAWTVY

SEQ ID NO: 169348 - protein, 10 aa, Yellow fever virus
KPGAAWTVYV

SEQ ID NO: 169349 - protein, 10 aa, Yellow fever virus
PGAAWTVYVG

SEQ ID NO: 169350 - protein, 10 aa, Yellow fever virus
GAAWTVYVGI

SEQ ID NO: 169351 - protein, 10 aa, Yellow fever virus
AAWTVYVGIV

SEQ ID NO: 169352 - protein, 10 aa, Yellow fever virus
AWTVYVGIVT

SEQ ID NO: 169353 - protein, 10 aa, Yellow fever virus
WTVYVGIVTM

SEQ ID NO: 169354 - protein, 10 aa, Yellow fever virus
TVYVGIVTML

SEQ ID NO: 169355 - protein, 10 aa, Yellow fever virus
VYVGIVTMLS

SEQ ID NO: 169356 - protein, 10 aa, Yellow fever virus
YVGIVTMLSP

SEQ ID NO: 169357 - protein, 10 aa, Yellow fever virus
VGIVTMLSPM

SEQ ID NO: 169358 - protein, 10 aa, Yellow fever virus
GIVTMLSPML

SEQ ID NO: 169359 - protein, 10 aa, Yellow fever virus
IVTMLSPMLH

SEQ ID NO: 169360 - protein, 10 aa, Yellow fever virus
VTMLSPMLHH

SEQ ID NO: 169361 - protein, 10 aa, Yellow fever virus
TMLSPMLHHW

SEQ ID NO: 169362 - protein, 10 aa, Yellow fever virus
MLSPMLHHWI

SEQ ID NO: 169363 - protein, 10 aa, Yellow fever virus
LSPMLHHWIK

SEQ ID NO: 169364 - protein, 10 aa, Yellow fever virus
SPMLHHWIKV

SEQ ID NO: 169365 - protein, 10 aa, Yellow fever virus
PMLHHWIKVE

SEQ ID NO: 169366 - protein, 10 aa, Yellow fever virus
MLHHWIKVEY

SEQ ID NO: 169367 - protein, 10 aa, Yellow fever virus
LHHWIKVEYG

SEQ ID NO: 169368 - protein, 10 aa, Yellow fever virus
HHWIKVEYGN

SEQ ID NO: 169369 - protein, 10 aa, Yellow fever virus
HWIKVEYGNL

SEQ ID NO: 169370 - protein, 10 aa, Yellow fever virus
WIKVEYGNLS

SEQ ID NO: 169371 - protein, 10 aa, Yellow fever virus
IKVEYGNLSL

SEQ ID NO: 169372 - protein, 10 aa, Yellow fever virus
KVEYGNLSLS

SEQ ID NO: 169373 - protein, 10 aa, Yellow fever virus
VEYGNLSLSG

SEQ ID NO: 169374 - protein, 10 aa, Yellow fever virus
EYGNLSLSGI

SEQ ID NO: 169375 - protein, 10 aa, Yellow fever virus
YGNLSLSGIA

SEQ ID NO: 169376 - protein, 10 aa, Yellow fever virus
GNLSLSGIAQ

SEQ ID NO: 169377 - protein, 10 aa, Yellow fever virus
NLSLSGIAQS

SEQ ID NO: 169378 - protein, 10 aa, Yellow fever virus
LSLSGIAQSA

SEQ ID NO: 169379 - protein, 10 aa, Yellow fever virus
SLSGIAQSAS

SEQ ID NO: 169380 - protein, 10 aa, Yellow fever virus
LSGIAQSASV

SEQ ID NO: 169381 - protein, 10 aa, Yellow fever virus
SGIAQSASVL

SEQ ID NO: 169382 - protein, 10 aa, Yellow fever virus
GIAQSASVLS

SEQ ID NO: 169383 - protein, 10 aa, Yellow fever virus
IAQSASVLSF

SEQ ID NO: 169384 - protein, 10 aa, Yellow fever virus
AQSASVLSFM

SEQ ID NO: 169385 - protein, 10 aa, Yellow fever virus
QSASVLSFMD

SEQ ID NO: 169386 - protein, 10 aa, Yellow fever virus
SASVLSFMDK

SEQ ID NO: 169387 - protein, 10 aa, Yellow fever virus
ASVLSFMDKG

SEQ ID NO: 169388 - protein, 10 aa, Yellow fever virus
SVLSFMDKGI

SEQ ID NO: 169389 - protein, 10 aa, Yellow fever virus
VLSFMDKGIP

SEQ ID NO: 169390 - protein, 10 aa, Yellow fever virus
LSFMDKGIPF

SEQ ID NO: 169391 - protein, 10 aa, Yellow fever virus
SFMDKGIPFM

SEQ ID NO: 169392 - protein, 10 aa, Yellow fever virus
FMDKGIPFMK

SEQ ID NO: 169393 - protein, 10 aa, Yellow fever virus
MDKGIPFMKM

SEQ ID NO: 169394 - protein, 10 aa, Yellow fever virus
DKGIPFMKMN

SEQ ID NO: 169395 - protein, 10 aa, Yellow fever virus
KGIPFMKMNI

SEQ ID NO: 169396 - protein, 10 aa, Yellow fever virus
GIPFMKMNIS

SEQ ID NO: 169397 - protein, 10 aa, Yellow fever virus
IPFMKMNISV

SEQ ID NO: 169398 - protein, 10 aa, Yellow fever virus
PFMKMNISVI

SEQ ID NO: 169399 - protein, 10 aa, Yellow fever virus
FMKMNISVIM

SEQ ID NO: 169400 - protein, 10 aa, Yellow fever virus
MKMNISVIML

SEQ ID NO: 169401 - protein, 10 aa, Yellow fever virus
KMNISVIMLL

SEQ ID NO: 169402 - protein, 10 aa, Yellow fever virus
MNISVIMLLV

SEQ ID NO: 169403 - protein, 10 aa, Yellow fever virus
NISVIMLLVS

SEQ ID NO: 169404 - protein, 10 aa, Yellow fever virus
ISVIMLLVSG

SEQ ID NO: 169405 - protein, 10 aa, Yellow fever virus
SVIMLLVSGW

SEQ ID NO: 169406 - protein, 10 aa, Yellow fever virus
VIMLLVSGWN

SEQ ID NO: 169407 - protein, 10 aa, Yellow fever virus
IMLLVSGWNS

SEQ ID NO: 169408 - protein, 10 aa, Yellow fever virus
MLLVSGWNSI

SEQ ID NO: 169409 - protein, 10 aa, Yellow fever virus
LLVSGWNSIT

SEQ ID NO: 169410 - protein, 10 aa, Yellow fever virus
LVSGWNSITV

SEQ ID NO: 169411 - protein, 10 aa, Yellow fever virus
VSGWNSITVM

SEQ ID NO: 169412 - protein, 10 aa, Yellow fever virus
SGWNSITVMP

SEQ ID NO: 169413 - protein, 10 aa, Yellow fever virus
GWNSITVMPL

SEQ ID NO: 169414 - protein, 10 aa, Yellow fever virus
WNSITVMPLL

SEQ ID NO: 169415 - protein, 10 aa, Yellow fever virus
NSITVMPLLC

SEQ ID NO: 169416 - protein, 10 aa, Yellow fever virus
SITVMPLLCG

SEQ ID NO: 169417 - protein, 10 aa, Yellow fever virus
ITVMPLLCGI

SEQ ID NO: 169418 - protein, 10 aa, Yellow fever virus
TVMPLLCGIG

SEQ ID NO: 169419 - protein, 10 aa, Yellow fever virus
VMPLLCGIGC

SEQ ID NO: 169420 - protein, 10 aa, Yellow fever virus
MPLLCGIGCA

SEQ ID NO: 169421 - protein, 10 aa, Yellow fever virus
PLLCGIGCAM

SEQ ID NO: 169422 - protein, 10 aa, Yellow fever virus
LLCGIGCAML

SEQ ID NO: 169423 - protein, 10 aa, Yellow fever virus
LCGIGCAMLH

SEQ ID NO: 169424 - protein, 10 aa, Yellow fever virus
CGIGCAMLHW

SEQ ID NO: 169425 - protein, 10 aa, Yellow fever virus
GIGCAMLHWS

SEQ ID NO: 169426 - protein, 10 aa, Yellow fever virus
IGCAMLHWSL

SEQ ID NO: 169427 - protein, 10 aa, Yellow fever virus
GCAMLHWSLI

SEQ ID NO: 169428 - protein, 10 aa, Yellow fever virus
CAMLHWSLIL

SEQ ID NO: 169429 - protein, 10 aa, Yellow fever virus
AMLHWSLILP

SEQ ID NO: 169430 - protein, 10 aa, Yellow fever virus
MLHWSLILPG

SEQ ID NO: 169431 - protein, 10 aa, Yellow fever virus
LHWSLILPGI

SEQ ID NO: 169432 - protein, 10 aa, Yellow fever virus
HWSLILPGIK

SEQ ID NO: 169433 - protein, 10 aa, Yellow fever virus
WSLILPGIKA

SEQ ID NO: 169434 - protein, 10 aa, Yellow fever virus
SLILPGIKAQ

SEQ ID NO: 169435 - protein, 10 aa, Yellow fever virus
LILPGIKAQQ

SEQ ID NO: 169436 - protein, 10 aa, Yellow fever virus
ILPGIKAQQS

SEQ ID NO: 169437 - protein, 10 aa, Yellow fever virus
LPGIKAQQSK

SEQ ID NO: 169438 - protein, 10 aa, Yellow fever virus
PGIKAQQSKL

SEQ ID NO: 169439 - protein, 10 aa, Yellow fever virus
GIKAQQSKLA

SEQ ID NO: 169440 - protein, 10 aa, Yellow fever virus
IKAQQSKLAQ

SEQ ID NO: 169441 - protein, 10 aa, Yellow fever virus
KAQQSKLAQR

SEQ ID NO: 169442 - protein, 10 aa, Yellow fever virus
AQQSKLAQRR

SEQ ID NO: 169443 - protein, 10 aa, Yellow fever virus
QQSKLAQRRV

SEQ ID NO: 169444 - protein, 10 aa, Yellow fever virus
QSKLAQRRVF

SEQ ID NO: 169445 - protein, 10 aa, Yellow fever virus
SKLAQRRVFH

SEQ ID NO: 169446 - protein, 10 aa, Yellow fever virus
KLAQRRVFHG

SEQ ID NO: 169447 - protein, 10 aa, Yellow fever virus
LAQRRVFHGV

SEQ ID NO: 169448 - protein, 10 aa, Yellow fever virus
AQRRVFHGVA

SEQ ID NO: 169449 - protein, 10 aa, Yellow fever virus
QRRVFHGVAK

SEQ ID NO: 169450 - protein, 10 aa, Yellow fever virus
RRVFHGVAKN

SEQ ID NO: 169451 - protein, 10 aa, Yellow fever virus
RVFHGVAKNP

SEQ ID NO: 169452 - protein, 10 aa, Yellow fever virus
VFHGVAKNPV

SEQ ID NO: 169453 - protein, 10 aa, Yellow fever virus
FHGVAKNPVV

SEQ ID NO: 169454 - protein, 10 aa, Yellow fever virus
HGVAKNPVVD

SEQ ID NO: 169455 - protein, 10 aa, Yellow fever virus
GVAKNPVVDG

SEQ ID NO: 169456 - protein, 10 aa, Yellow fever virus
VAKNPVVDGN

SEQ ID NO: 169457 - protein, 10 aa, Yellow fever virus
AKNPVVDGNP

SEQ ID NO: 169458 - protein, 10 aa, Yellow fever virus
KNPVVDGNPT

SEQ ID NO: 169459 - protein, 10 aa, Yellow fever virus
NPVVDGNPTV

SEQ ID NO: 169460 - protein, 10 aa, Yellow fever virus
PVVDGNPTVD

SEQ ID NO: 169461 - protein, 10 aa, Yellow fever virus
VVDGNPTVDI

SEQ ID NO: 169462 - protein, 10 aa, Yellow fever virus
VDGNPTVDIE

SEQ ID NO: 169463 - protein, 10 aa, Yellow fever virus
DGNPTVDIEE

SEQ ID NO: 169464 - protein, 10 aa, Yellow fever virus
GNPTVDIEEA

SEQ ID NO: 169465 - protein, 10 aa, Yellow fever virus
NPTVDIEEAP

SEQ ID NO: 169466 - protein, 10 aa, Yellow fever virus
PTVDIEEAPE

SEQ ID NO: 169467 - protein, 10 aa, Yellow fever virus
TVDIEEAPEM

SEQ ID NO: 169468 - protein, 10 aa, Yellow fever virus
VDIEEAPEMP

SEQ ID NO: 169469 - protein, 10 aa, Yellow fever virus
DIEEAPEMPA

SEQ ID NO: 169470 - protein, 10 aa, Yellow fever virus
IEEAPEMPAL

SEQ ID NO: 169471 - protein, 10 aa, Yellow fever virus
EEAPEMPALY

SEQ ID NO: 169472 - protein, 10 aa, Yellow fever virus
EAPEMPALYE

SEQ ID NO: 169473 - protein, 10 aa, Yellow fever virus
APEMPALYEK

SEQ ID NO: 169474 - protein, 10 aa, Yellow fever virus
PEMPALYEKK

SEQ ID NO: 169475 - protein, 10 aa, Yellow fever virus
EMPALYEKKL

SEQ ID NO: 169476 - protein, 10 aa, Yellow fever virus
MPALYEKKLA

SEQ ID NO: 169477 - protein, 10 aa, Yellow fever virus
PALYEKKLAL

SEQ ID NO: 169478 - protein, 10 aa, Yellow fever virus
ALYEKKLALY

SEQ ID NO: 169479 - protein, 10 aa, Yellow fever virus
LYEKKLALYL

SEQ ID NO: 169480 - protein, 10 aa, Yellow fever virus
YEKKLALYLL

SEQ ID NO: 169481 - protein, 10 aa, Yellow fever virus
EKKLALYLLL

SEQ ID NO: 169482 - protein, 10 aa, Yellow fever virus
KKLALYLLLA

SEQ ID NO: 169483 - protein, 10 aa, Yellow fever virus
KLALYLLLAL

SEQ ID NO: 169484 - protein, 10 aa, Yellow fever virus
LALYLLLALS

SEQ ID NO: 169485 - protein, 10 aa, Yellow fever virus
ALYLLLALSL

SEQ ID NO: 169486 - protein, 10 aa, Yellow fever virus
LYLLLALSLA

SEQ ID NO: 169487 - protein, 10 aa, Yellow fever virus
YLLLALSLAS

SEQ ID NO: 169488 - protein, 10 aa, Yellow fever virus
LLLALSLASV

SEQ ID NO: 169489 - protein, 10 aa, Yellow fever virus
LLALSLASVA

SEQ ID NO: 169490 - protein, 10 aa, Yellow fever virus
LALSLASVAM

SEQ ID NO: 169491 - protein, 10 aa, Yellow fever virus
ALSLASVAMC

SEQ ID NO: 169492 - protein, 10 aa, Yellow fever virus
LSLASVAMCR

SEQ ID NO: 169493 - protein, 10 aa, Yellow fever virus
SLASVAMCRT

SEQ ID NO: 169494 - protein, 10 aa, Yellow fever virus
LASVAMCRTP

SEQ ID NO: 169495 - protein, 10 aa, Yellow fever virus
ASVAMCRTPF

SEQ ID NO: 169496 - protein, 10 aa, Yellow fever virus
SVAMCRTPFS

SEQ ID NO: 169497 - protein, 10 aa, Yellow fever virus
VAMCRTPFSL

SEQ ID NO: 169498 - protein, 10 aa, Yellow fever virus
AMCRTPFSLA

SEQ ID NO: 169499 - protein, 10 aa, Yellow fever virus
MCRTPFSLAE

SEQ ID NO: 169500 - protein, 10 aa, Yellow fever virus
CRTPFSLAEG

SEQ ID NO: 169501 - protein, 10 aa, Yellow fever virus
RTPFSLAEGI

SEQ ID NO: 169502 - protein, 10 aa, Yellow fever virus
TPFSLAEGIV

SEQ ID NO: 169503 - protein, 10 aa, Yellow fever virus
PFSLAEGIVL

SEQ ID NO: 169504 - protein, 10 aa, Yellow fever virus
FSLAEGIVLA

SEQ ID NO: 169505 - protein, 10 aa, Yellow fever virus
SLAEGIVLAS

SEQ ID NO: 169506 - protein, 10 aa, Yellow fever virus
LAEGIVLASA

SEQ ID NO: 169507 - protein, 10 aa, Yellow fever virus
AEGIVLASAA

SEQ ID NO: 169508 - protein, 10 aa, Yellow fever virus
EGIVLASAAL

SEQ ID NO: 169509 - protein, 10 aa, Yellow fever virus
GIVLASAALG

SEQ ID NO: 169510 - protein, 10 aa, Yellow fever virus
IVLASAALGP

SEQ ID NO: 169511 - protein, 10 aa, Yellow fever virus
VLASAALGPL

SEQ ID NO: 169512 - protein, 10 aa, Yellow fever virus
LASAALGPLI

SEQ ID NO: 169513 - protein, 10 aa, Yellow fever virus
ASAALGPLIE

SEQ ID NO: 169514 - protein, 10 aa, Yellow fever virus
SAALGPLIEG

SEQ ID NO: 169515 - protein, 10 aa, Yellow fever virus
AALGPLIEGN

SEQ ID NO: 169516 - protein, 10 aa, Yellow fever virus
ALGPLIEGNT

SEQ ID NO: 169517 - protein, 10 aa, Yellow fever virus
LGPLIEGNTS

SEQ ID NO: 169518 - protein, 10 aa, Yellow fever virus
GPLIEGNTSL

SEQ ID NO: 169519 - protein, 10 aa, Yellow fever virus
PLIEGNTSLL

SEQ ID NO: 169520 - protein, 10 aa, Yellow fever virus
LIEGNTSLLW

SEQ ID NO: 169521 - protein, 10 aa, Yellow fever virus
IEGNTSLLWN

SEQ ID NO: 169522 - protein, 10 aa, Yellow fever virus
EGNTSLLWNG

SEQ ID NO: 169523 - protein, 10 aa, Yellow fever virus
GNTSLLWNGP

SEQ ID NO: 169524 - protein, 10 aa, Yellow fever virus
NTSLLWNGPM

SEQ ID NO: 169525 - protein, 10 aa, Yellow fever virus
TSLLWNGPMA

SEQ ID NO: 169526 - protein, 10 aa, Yellow fever virus
SLLWNGPMAV

SEQ ID NO: 169527 - protein, 10 aa, Yellow fever virus
LLWNGPMAVS

SEQ ID NO: 169528 - protein, 10 aa, Yellow fever virus
LWNGPMAVSM

SEQ ID NO: 169529 - protein, 10 aa, Yellow fever virus
WNGPMAVSMT

SEQ ID NO: 169530 - protein, 10 aa, Yellow fever virus
NGPMAVSMTG

SEQ ID NO: 169531 - protein, 10 aa, Yellow fever virus
GPMAVSMTGV

SEQ ID NO: 169532 - protein, 10 aa, Yellow fever virus
PMAVSMTGVM

SEQ ID NO: 169533 - protein, 10 aa, Yellow fever virus
MAVSMTGVMR

SEQ ID NO: 169534 - protein, 10 aa, Yellow fever virus
AVSMTGVMRG

SEQ ID NO: 169535 - protein, 10 aa, Yellow fever virus
VSMTGVMRGN

SEQ ID NO: 169536 - protein, 10 aa, Yellow fever virus
SMTGVMRGNH

SEQ ID NO: 169537 - protein, 10 aa, Yellow fever virus
MTGVMRGNHY

SEQ ID NO: 169538 - protein, 10 aa, Yellow fever virus
TGVMRGNHYA

SEQ ID NO: 169539 - protein, 10 aa, Yellow fever virus
GVMRGNHYAF

SEQ ID NO: 169540 - protein, 10 aa, Yellow fever virus
VMRGNHYAFV

SEQ ID NO: 169541 - protein, 10 aa, Yellow fever virus
MRGNHYAFVG

SEQ ID NO: 169542 - protein, 10 aa, Yellow fever virus
RGNHYAFVGV

SEQ ID NO: 169543 - protein, 10 aa, Yellow fever virus
GNHYAFVGVM

SEQ ID NO: 169544 - protein, 10 aa, Yellow fever virus
NHYAFVGVMY

SEQ ID NO: 169545 - protein, 10 aa, Yellow fever virus
HYAFVGVMYN

SEQ ID NO: 169546 - protein, 10 aa, Yellow fever virus
YAFVGVMYNL

SEQ ID NO: 169547 - protein, 10 aa, Yellow fever virus
AFVGVMYNLW

SEQ ID NO: 169548 - protein, 10 aa, Yellow fever virus
FVGVMYNLWK

SEQ ID NO: 169549 - protein, 10 aa, Yellow fever virus
VGVMYNLWKM

SEQ ID NO: 169550 - protein, 10 aa, Yellow fever virus
GVMYNLWKMK

SEQ ID NO: 169551 - protein, 10 aa, Yellow fever virus
VMYNLWKMKT

SEQ ID NO: 169552 - protein, 10 aa, Yellow fever virus
MYNLWKMKTG

SEQ ID NO: 169553 - protein, 10 aa, Yellow fever virus
YNLWKMKTGR

SEQ ID NO: 169554 - protein, 10 aa, Yellow fever virus
NLWKMKTGRR

SEQ ID NO: 169555 - protein, 10 aa, Yellow fever virus
LWKMKTGRRG

SEQ ID NO: 169556 - protein, 10 aa, Yellow fever virus
RRGSANGKTL

SEQ ID NO: 169557 - protein, 10 aa, Yellow fever virus
RGSANGKTLG

SEQ ID NO: 169558 - protein, 10 aa, Yellow fever virus
GSANGKTLGE

SEQ ID NO: 169559 - protein, 10 aa, Yellow fever virus
SANGKTLGEV

SEQ ID NO: 169560 - protein, 10 aa, Yellow fever virus
ANGKTLGEVW

SEQ ID NO: 169561 - protein, 10 aa, Yellow fever virus
NGKTLGEVWK

SEQ ID NO: 169562 - protein, 10 aa, Yellow fever virus
GKTLGEVWKR

SEQ ID NO: 169563 - protein, 10 aa, Yellow fever virus
KTLGEVWKRE

SEQ ID NO: 169564 - protein, 10 aa, Yellow fever virus
TLGEVWKREL

SEQ ID NO: 169565 - protein, 10 aa, Yellow fever virus
LGEVWKRELN

SEQ ID NO: 169566 - protein, 10 aa, Yellow fever virus
GEVWKRELNL

SEQ ID NO: 169567 - protein, 10 aa, Yellow fever virus
EVWKRELNLL

SEQ ID NO: 169568 - protein, 10 aa, Yellow fever virus
VWKRELNLLD

SEQ ID NO: 169569 - protein, 10 aa, Yellow fever virus
WKRELNLLDK

SEQ ID NO: 169570 - protein, 10 aa, Yellow fever virus
KRELNLLDKQ

SEQ ID NO: 169571 - protein, 10 aa, Yellow fever virus
RELNLLDKQQ

SEQ ID NO: 169572 - protein, 10 aa, Yellow fever virus
ELNLLDKQQF

SEQ ID NO: 169573 - protein, 10 aa, Yellow fever virus
LNLLDKQQFE

SEQ ID NO: 169574 - protein, 10 aa, Yellow fever virus
NLLDKQQFEL

SEQ ID NO: 169575 - protein, 10 aa, Yellow fever virus
LLDKQQFELY

SEQ ID NO: 169576 - protein, 10 aa, Yellow fever virus
LDKQQFELYK

SEQ ID NO: 169577 - protein, 10 aa, Yellow fever virus
DKRQFELYKR

SEQ ID NO: 169578 - protein, 10 aa, Yellow fever virus
KQQFELYKRT

SEQ ID NO: 169579 - protein, 10 aa, Yellow fever virus
QQFELYKRTD

SEQ ID NO: 169580 - protein, 10 aa, Yellow fever virus
QFELYKRTDI

SEQ ID NO: 169581 - protein, 10 aa, Yellow fever virus
FELYKRTDIV

SEQ ID NO: 169582 - protein, 10 aa, Yellow fever virus
ELYKRTDIVE

SEQ ID NO: 169583 - protein, 10 aa, Yellow fever virus
LYKRTDIVEV

SEQ ID NO: 169584 - protein, 10 aa, Yellow fever virus
YKRTDIVEVD

SEQ ID NO: 169585 - protein, 10 aa, Yellow fever virus
KRTDIVEVDR

SEQ ID NO: 169586 - protein, 10 aa, Yellow fever virus
RTDIVEVDRD

SEQ ID NO: 169587 - protein, 10 aa, Yellow fever virus
TDIVEVDRDT

SEQ ID NO: 169588 - protein, 10 aa, Yellow fever virus
DIVEVDRDTA

SEQ ID NO: 169589 - protein, 10 aa, Yellow fever virus
IVEVDRDTAR

SEQ ID NO: 169590 - protein, 10 aa, Yellow fever virus
VEVDRDTARR

SEQ ID NO: 169591 - protein, 10 aa, Yellow fever virus
EVDRDTARRH

SEQ ID NO: 169592 - protein, 10 aa, Yellow fever virus
VDRDTARRHL

SEQ ID NO: 169593 - protein, 10 aa, Yellow fever virus
DRDTARRHLA

SEQ ID NO: 169594 - protein, 10 aa, Yellow fever virus
RDTARRHLAE

SEQ ID NO: 169595 - protein, 10 aa, Yellow fever virus
DTARRHLAEG

SEQ ID NO: 169596 - protein, 10 aa, Yellow fever virus
TARRHLAEGK

SEQ ID NO: 169597 - protein, 10 aa, Yellow fever virus
ARRHLAEGKV

SEQ ID NO: 169598 - protein, 10 aa, Yellow fever virus
RRHLAEGKVD

SEQ ID NO: 169599 - protein, 10 aa, Yellow fever virus
RHLAEGKVDT

SEQ ID NO: 169600 - protein, 10 aa, Yellow fever virus
HLAEGKVDTG

SEQ ID NO: 169601 - protein, 10 aa, Yellow fever virus
LAEGKVDTGV

SEQ ID NO: 169602 - protein, 10 aa, Yellow fever virus
AEGKVDTGVA

SEQ ID NO: 169603 - protein, 10 aa, Yellow fever virus
EGKVDTGVAV

SEQ ID NO: 169604 - protein, 10 aa, Yellow fever virus
GKVDTGVAVS

SEQ ID NO: 169605 - protein, 10 aa, Yellow fever virus
KVDTGVAVSR

SEQ ID NO: 169606 - protein, 10 aa, Yellow fever virus
VDTGVAVSRG

SEQ ID NO: 169607 - protein, 10 aa, Yellow fever virus
DTGVAVSRGT

SEQ ID NO: 169608 - protein, 10 aa, Yellow fever virus
TGVAVSRGTA

SEQ ID NO: 169609 - protein, 10 aa, Yellow fever virus
GVAVSRGTAK

SEQ ID NO: 169610 - protein, 10 aa, Yellow fever virus
VAVSRGTAKL

SEQ ID NO: 169611 - protein, 10 aa, Yellow fever virus
AVSRGTAKLR

SEQ ID NO: 169612 - protein, 10 aa, Yellow fever virus
VSRGTAKLRW

SEQ ID NO: 169613 - protein, 10 aa, Yellow fever virus
SRGTAKLRWF

SEQ ID NO: 169614 - protein, 10 aa, Yellow fever virus
RGTAKLRWFH

SEQ ID NO: 169615 - protein, 10 aa, Yellow fever virus
GTAKLRWFHE

SEQ ID NO: 169616 - protein, 10 aa, Yellow fever virus
TAKLRWFHER

SEQ ID NO: 169617 - protein, 10 aa, Yellow fever virus
AKLRWFHERG

SEQ ID NO: 169618 - protein, 10 aa, Yellow fever virus
KLRWFHERGY

SEQ ID NO: 169619 - protein, 10 aa, Yellow fever virus
LRWFHERGYV

SEQ ID NO: 169620 - protein, 10 aa, Yellow fever virus
RWFHERGYVK

SEQ ID NO: 169621 - protein, 10 aa, Yellow fever virus
WFHERGYVKL

SEQ ID NO: 169622 - protein, 10 aa, Yellow fever virus
FHERGYVKLE

SEQ ID NO: 169623 - protein, 10 aa, Yellow fever virus
HERGYVKLEG

SEQ ID NO: 169624 - protein, 10 aa, Yellow fever virus
ERGYVKLEGR

SEQ ID NO: 169625 - protein, 10 aa, Yellow fever virus
RGYVKLEGRV

SEQ ID NO: 169626 - protein, 10 aa, Yellow fever virus
GYVKLEGRVI

SEQ ID NO: 169627 - protein, 10 aa, Yellow fever virus
YVKLEGRVID

SEQ ID NO: 169628 - protein, 10 aa, Yellow fever virus
VKLEGRVIDL

SEQ ID NO: 169629 - protein, 10 aa, Yellow fever virus
KLEGRVIDLG

SEQ ID NO: 169630 - protein, 10 aa, Yellow fever virus
LEGRVIDLGC

SEQ ID NO: 169631 - protein, 10 aa, Yellow fever virus
EGRVIDLGCG

SEQ ID NO: 169632 - protein, 10 aa, Yellow fever virus
GRVIDLGCGR

SEQ ID NO: 169633 - protein, 10 aa, Yellow fever virus
RVIDLGCGRG

SEQ ID NO: 169634 - protein, 10 aa, Yellow fever virus
VIDLGCGRGG

SEQ ID NO: 169635 - protein, 10 aa, Yellow fever virus
IDLGCGRGGW

SEQ ID NO: 169636 - protein, 10 aa, Yellow fever virus
DLGCGRGGWC

SEQ ID NO: 169637 - protein, 10 aa, Yellow fever virus
LGCGRGGWCY

SEQ ID NO: 169638 - protein, 10 aa, Yellow fever virus
GCGRGGWCYY

SEQ ID NO: 169639 - protein, 10 aa, Yellow fever virus
CGRGGWCYYA

SEQ ID NO: 169640 - protein, 10 aa, Yellow fever virus
GRGGWCYYAA

SEQ ID NO: 169641 - protein, 10 aa, Yellow fever virus
RGGWCYYAAA

SEQ ID NO: 169642 - protein, 10 aa, Yellow fever virus
GGWCYYAAAQ

SEQ ID NO: 169643 - protein, 10 aa, Yellow fever virus
GWCYYAAAQK

SEQ ID NO: 169644 - protein, 10 aa, Yellow fever virus
WCYYAAAQKE

SEQ ID NO: 169645 - protein, 10 aa, Yellow fever virus
CYYAAAQKEV

SEQ ID NO: 169646 - protein, 10 aa, Yellow fever virus
YYAAAQKEVS

SEQ ID NO: 169647 - protein, 10 aa, Yellow fever virus
YAAAQKEVSG

SEQ ID NO: 169648 - protein, 10 aa, Yellow fever virus
AAAQKEVSGV

SEQ ID NO: 169649 - protein, 10 aa, Yellow fever virus
AAQKEVSGVK

SEQ ID NO: 169650 - protein, 10 aa, Yellow fever virus
AQKEVSGVKG

SEQ ID NO: 169651 - protein, 10 aa, Yellow fever virus
QKEVSGVKGF

SEQ ID NO: 169652 - protein, 10 aa, Yellow fever virus
KEVSGVKGFT

SEQ ID NO: 169653 - protein, 10 aa, Yellow fever virus
EVSGVKGFTL

SEQ ID NO: 169654 - protein, 10 aa, Yellow fever virus
VSGVKGFTLG

SEQ ID NO: 169655 - protein, 10 aa, Yellow fever virus
SGVKGFTLGR

SEQ ID NO: 169656 - protein, 10 aa, Yellow fever virus
GVKGFTLGRD

SEQ ID NO: 169657 - protein, 10 aa, Yellow fever virus
VKGFTLGRDG

SEQ ID NO: 169658 - protein, 10 aa, Yellow fever virus
KGFTLGRDGH

SEQ ID NO: 169659 - protein, 10 aa, Yellow fever virus
GFTLGRDGHE

SEQ ID NO: 169660 - protein, 10 aa, Yellow fever virus
FTLGRDGHEK

SEQ ID NO: 169661 - protein, 10 aa, Yellow fever virus
TLGRDGHEKP

SEQ ID NO: 169662 - protein, 10 aa, Yellow fever virus
LGRDGHEKPM

SEQ ID NO: 169663 - protein, 10 aa, Yellow fever virus
GRDGHEKPMN

SEQ ID NO: 169664 - protein, 10 aa, Yellow fever virus
RDGHEKPMNV

SEQ ID NO: 169665 - protein, 10 aa, Yellow fever virus
DGHEKPMNVQ

SEQ ID NO: 169666 - protein, 10 aa, Yellow fever virus
GHEKPMNVQS

SEQ ID NO: 169667 - protein, 10 aa, Yellow fever virus
HEKPMNVQSL

SEQ ID NO: 169668 - protein, 10 aa, Yellow fever virus
EKPMNVQSLG

SEQ ID NO: 169669 - protein, 10 aa, Yellow fever virus
KPMNVQSLGW

SEQ ID NO: 169670 - protein, 10 aa, Yellow fever virus
PMNVQSLGWN

SEQ ID NO: 169671 - protein, 10 aa, Yellow fever virus
MNVQSLGWNI

SEQ ID NO: 169672 - protein, 10 aa, Yellow fever virus
NVQSLGWNII

SEQ ID NO: 169673 - protein, 10 aa, Yellow fever virus
VQSLGWNIIT

SEQ ID NO: 169674 - protein, 10 aa, Yellow fever virus
QSLGWNIITF

SEQ ID NO: 169675 - protein, 10 aa, Yellow fever virus
SLGWNIITFK

SEQ ID NO: 169676 - protein, 10 aa, Yellow fever virus
LGWNIITFKD

SEQ ID NO: 169677 - protein, 10 aa, Yellow fever virus
GWNIITFKDK

SEQ ID NO: 169678 - protein, 10 aa, Yellow fever virus
WNIITFKDKT

SEQ ID NO: 169679 - protein, 10 aa, Yellow fever virus
NIITFKDKTD

SEQ ID NO: 169680 - protein, 10 aa, Yellow fever virus
IITFKDKTDI

SEQ ID NO: 169681 - protein, 10 aa, Yellow fever virus
ITFKDKTDIH

SEQ ID NO: 169682 - protein, 10 aa, Yellow fever virus
TFKDKTDIHR

SEQ ID NO: 169683 - protein, 10 aa, Yellow fever virus
FKDKTDIHRL

SEQ ID NO: 169684 - protein, 10 aa, Yellow fever virus
KDKTDIHRLE

SEQ ID NO: 169685 - protein, 10 aa, Yellow fever virus
DKTDIHRLEP

SEQ ID NO: 169686 - protein, 10 aa, Yellow fever virus
LEPVKCDTLL

SEQ ID NO: 169687 - protein, 10 aa, Yellow fever virus
EPVKCDTLLC

SEQ ID NO: 169688 - protein, 10 aa, Yellow fever virus
PVKCDTLLCD

SEQ ID NO: 169689 - protein, 10 aa, Yellow fever virus
VKCDTLLCDI

SEQ ID NO: 169690 - protein, 10 aa, Yellow fever virus
KCDTLLCDIG

SEQ ID NO: 169691 - protein, 10 aa, Yellow fever virus
CDTLLCDIGE

SEQ ID NO: 169692 - protein, 10 aa, Yellow fever virus
DTLLCDIGES

SEQ ID NO: 169693 - protein, 10 aa, Yellow fever virus
TLLCDIGESS

SEQ ID NO: 169694 - protein, 10 aa, Yellow fever virus
LLCDIGESSS

SEQ ID NO: 169695 - protein, 10 aa, Yellow fever virus
LCDIGESSSS

SEQ ID NO: 169696 - protein, 10 aa, Yellow fever virus
CDIGESSSSS

SEQ ID NO: 169697 - protein, 10 aa, Yellow fever virus
DIGESSSSSV

SEQ ID NO: 169698 - protein, 10 aa, Yellow fever virus
IGESSSSSVT

SEQ ID NO: 169699 - protein, 10 aa, Yellow fever virus
GESSSSSVTE

SEQ ID NO: 169700 - protein, 10 aa, Yellow fever virus
ESSSSSVTEG

SEQ ID NO: 169701 - protein, 10 aa, Yellow fever virus
SSSSSVTEGE

SEQ ID NO: 169702 - protein, 10 aa, Yellow fever virus
SSSSVTEGER

SEQ ID NO: 169703 - protein, 10 aa, Yellow fever virus
SSSVTEGERT

SEQ ID NO: 169704 - protein, 10 aa, Yellow fever virus
SSVTEGERTV

SEQ ID NO: 169705 - protein, 10 aa, Yellow fever virus
SVTEGERTVR

SEQ ID NO: 169706 - protein, 10 aa, Yellow fever virus
VTEGERTVRV

SEQ ID NO: 169707 - protein, 10 aa, Yellow fever virus
TEGERTVRVL

SEQ ID NO: 169708 - protein, 10 aa, Yellow fever virus
EGERTVRVLD

SEQ ID NO: 169709 - protein, 10 aa, Yellow fever virus
GERTVRVLDT

SEQ ID NO: 169710 - protein, 10 aa, Yellow fever virus
ERTVRVLDTV

SEQ ID NO: 169711 - protein, 10 aa, Yellow fever virus
RTVRVLDTVE

SEQ ID NO: 169712 - protein, 10 aa, Yellow fever virus
TVRVLDTVEK

SEQ ID NO: 169713 - protein, 10 aa, Yellow fever virus
VRVLDTVEKW

SEQ ID NO: 169714 - protein, 10 aa, Yellow fever virus
RVLDTVEKWL

SEQ ID NO: 169715 - protein, 10 aa, Yellow fever virus
VLDTVEKWLA

SEQ ID NO: 169716 - protein, 10 aa, Yellow fever virus
LDTVEKWLAC

SEQ ID NO: 169717 - protein, 10 aa, Yellow fever virus
DTVEKWLACG

SEQ ID NO: 169718 - protein, 10 aa, Yellow fever virus
TVEKWLACGV

SEQ ID NO: 169719 - protein, 10 aa, Yellow fever virus
VEKWLACGVD

SEQ ID NO: 169720 - protein, 10 aa, Yellow fever virus
EKWLACGVDN

SEQ ID NO: 169721 - protein, 10 aa, Yellow fever virus
KWLACGVDNF

SEQ ID NO: 169722 - protein, 10 aa, Yellow fever virus
WLACGVDNFC

SEQ ID NO: 169723 - protein, 10 aa, Yellow fever virus
LACGVDNFCV

SEQ ID NO: 169724 - protein, 10 aa, Yellow fever virus
ACGVDNFCVK

SEQ ID NO: 169725 - protein, 10 aa, Yellow fever virus
CGVDNFCVKV

SEQ ID NO: 169726 - protein, 10 aa, Yellow fever virus
GVDNFCVKVL

SEQ ID NO: 169727 - protein, 10 aa, Yellow fever virus
VDNFCVKVLA

SEQ ID NO: 169728 - protein, 10 aa, Yellow fever virus
DNFCVKVLAP

SEQ ID NO: 169729 - protein, 10 aa, Yellow fever virus
NFCVKVLAPY

SEQ ID NO: 169730 - protein, 10 aa, Yellow fever virus
FCVKVLAPYM

SEQ ID NO: 169731 - protein, 10 aa, Yellow fever virus
CVKVLAPYMP

SEQ ID NO: 169732 - protein, 10 aa, Yellow fever virus
VKVLAPYMPD

SEQ ID NO: 169733 - protein, 10 aa, Yellow fever virus
KVLAPYMPDV

SEQ ID NO: 169734 - protein, 10 aa, Yellow fever virus
VLAPYMPDVL

SEQ ID NO: 169735 - protein, 10 aa, Yellow fever virus
LAPYMPDVLE

SEQ ID NO: 169736 - protein, 10 aa, Yellow fever virus
APYMPDVLEK

SEQ ID NO: 169737 - protein, 10 aa, Yellow fever virus
PYMPDVLEKL

SEQ ID NO: 169738 - protein, 10 aa, Yellow fever virus
YMPDVLEKLE

SEQ ID NO: 169739 - protein, 10 aa, Yellow fever virus
MPDVLEKLEL

SEQ ID NO: 169740 - protein, 10 aa, Yellow fever virus
PDVLEKLELL

SEQ ID NO: 169741 - protein, 10 aa, Yellow fever virus
DVLEKLELLQ

SEQ ID NO: 169742 - protein, 10 aa, Yellow fever virus
VLEKLELLQR

SEQ ID NO: 169743 - protein, 10 aa, Yellow fever virus
LEKLELLQRR

SEQ ID NO: 169744 - protein, 10 aa, Yellow fever virus
EKLELLQRRF

SEQ ID NO: 169745 - protein, 10 aa, Yellow fever virus
KLELLQRRFG

SEQ ID NO: 169746 - protein, 10 aa, Yellow fever virus
LELLQRRFGG

SEQ ID NO: 169747 - protein, 10 aa, Yellow fever virus
ELLQRRFGGT

SEQ ID NO: 169748 - protein, 10 aa, Yellow fever virus
LLQRRFGGTV

SEQ ID NO: 169749 - protein, 10 aa, Yellow fever virus
LQRRFGGTVI

SEQ ID NO: 169750 - protein, 10 aa, Yellow fever virus
QRRFGGTVIR

SEQ ID NO: 169751 - protein, 10 aa, Yellow fever virus
RRFGGTVIRN

SEQ ID NO: 169752 - protein, 10 aa, Yellow fever virus
RFGGTVIRNP

SEQ ID NO: 169753 - protein, 10 aa, Yellow fever virus
FGGTVIRNPL

SEQ ID NO: 169754 - protein, 10 aa, Yellow fever virus
GGTVIRNPLS

SEQ ID NO: 169755 - protein, 10 aa, Yellow fever virus
GTVIRNPLSR

SEQ ID NO: 169756 - protein, 10 aa, Yellow fever virus
TVIRNPLSRN

SEQ ID NO: 169757 - protein, 10 aa, Yellow fever virus
VIRNPLSRNS

SEQ ID NO: 169758 - protein, 10 aa, Yellow fever virus
IRNPLSRNST

SEQ ID NO: 169759 - protein, 10 aa, Yellow fever virus
RNPLSRNSTH

SEQ ID NO: 169760 - protein, 10 aa, Yellow fever virus
NPLSRNSTHE

SEQ ID NO: 169761 - protein, 10 aa, Yellow fever virus
PLSRNSTHEM

SEQ ID NO: 169762 - protein, 10 aa, Yellow fever virus
LSRNSTHEMY

SEQ ID NO: 169763 - protein, 10 aa, Yellow fever virus
SRNSTHEMYY

SEQ ID NO: 169764 - protein, 10 aa, Yellow fever virus
RNSTHEMYYV

SEQ ID NO: 169765 - protein, 10 aa, Yellow fever virus
NSTHEMYYVS

SEQ ID NO: 169766 - protein, 10 aa, Yellow fever virus
STHEMYYVSG

SEQ ID NO: 169767 - protein, 10 aa, Yellow fever virus
THEMYYVSGA

SEQ ID NO: 169768 - protein, 10 aa, Yellow fever virus
HEMYYVSGAR

SEQ ID NO: 169769 - protein, 10 aa, Yellow fever virus
EMYYVSGARS

SEQ ID NO: 169770 - protein, 10 aa, Yellow fever virus
MYYVSGARSN

SEQ ID NO: 169771 - protein, 10 aa, Yellow fever virus
YYVSGARSNV

SEQ ID NO: 169772 - protein, 10 aa, Yellow fever virus
YVSGARSNVT

SEQ ID NO: 169773 - protein, 10 aa, Yellow fever virus
VSGARSNVTF

SEQ ID NO: 169774 - protein, 10 aa, Yellow fever virus
SGARSNVTFT

SEQ ID NO: 169775 - protein, 10 aa, Yellow fever virus
GARSNVTFTV

SEQ ID NO: 169776 - protein, 10 aa, Yellow fever virus
ARSNVTFTVN

SEQ ID NO: 169777 - protein, 10 aa, Yellow fever virus
RSNVTFTVNQ

SEQ ID NO: 169778 - protein, 10 aa, Yellow fever virus
SNVTFTVNQT

SEQ ID NO: 169779 - protein, 10 aa, Yellow fever virus
NVTFTVNQTS

SEQ ID NO: 169780 - protein, 10 aa, Yellow fever virus
VTFTVNQTSR

SEQ ID NO: 169781 - protein, 10 aa, Yellow fever virus
TFTVNQTSRL

SEQ ID NO: 169782 - protein, 10 aa, Yellow fever virus
FTVNQTSRLL

SEQ ID NO: 169783 - protein, 10 aa, Yellow fever virus
TVNQTSRLLM

SEQ ID NO: 169784 - protein, 10 aa, Yellow fever virus
VNQTSRLLMR

SEQ ID NO: 169785 - protein, 10 aa, Yellow fever virus
NQTSRLLMRR

SEQ ID NO: 169786 - protein, 10 aa, Yellow fever virus
QTSRLLMRRM

SEQ ID NO: 169787 - protein, 10 aa, Yellow fever virus
TSRLLMRRMR

SEQ ID NO: 169788 - protein, 10 aa, Yellow fever virus
SRLLMRRMRR

SEQ ID NO: 169789 - protein, 10 aa, Yellow fever virus
RLLMRRMRRP

SEQ ID NO: 169790 - protein, 10 aa, Yellow fever virus
LLMRRMRRPT

SEQ ID NO: 169791 - protein, 10 aa, Yellow fever virus
LMRRMRRPTG

SEQ ID NO: 169792 - protein, 10 aa, Yellow fever virus
MRRMRRPTGK

SEQ ID NO: 169793 - protein, 10 aa, Yellow fever virus
RRMRRPTGKV

SEQ ID NO: 169794 - protein, 10 aa, Yellow fever virus
RMRRPTGKVT

SEQ ID NO: 169795 - protein, 10 aa, Yellow fever virus
MRRPTGKVTL

SEQ ID NO: 169796 - protein, 10 aa, Yellow fever virus
RRPTGKVTLE

SEQ ID NO: 169797 - protein, 10 aa, Yellow fever virus
RPTGKVTLEA

SEQ ID NO: 169798 - protein, 10 aa, Yellow fever virus
PTGKVTLEAD

SEQ ID NO: 169799 - protein, 10 aa, Yellow fever virus
TGKVTLEADV

SEQ ID NO: 169800 - protein, 10 aa, Yellow fever virus
GKVTLEADVI

SEQ ID NO: 169801 - protein, 10 aa, Yellow fever virus
KVTLEADVIL

SEQ ID NO: 169802 - protein, 10 aa, Yellow fever virus
VTLEADVILP

SEQ ID NO: 169803 - protein, 10 aa, Yellow fever virus
TLEADVILPI

SEQ ID NO: 169804 - protein, 10 aa, Yellow fever virus
LEADVILPIG

SEQ ID NO: 169805 - protein, 10 aa, Yellow fever virus
EADVILPIGT

SEQ ID NO: 169806 - protein, 10 aa, Yellow fever virus
ADVILPIGTR

SEQ ID NO: 169807 - protein, 10 aa, Yellow fever virus
DVILPIGTRS

SEQ ID NO: 169808 - protein, 10 aa, Yellow fever virus
VILPIGTRSV

SEQ ID NO: 169809 - protein, 10 aa, Yellow fever virus
ILPIGTRSVE

SEQ ID NO: 169810 - protein, 10 aa, Yellow fever virus
LPIGTRSVET

SEQ ID NO: 169811 - protein, 10 aa, Yellow fever virus
PIGTRSVETD

SEQ ID NO: 169812 - protein, 10 aa, Yellow fever virus
IGTRSVETDK

SEQ ID NO: 169813 - protein, 10 aa, Yellow fever virus
GTRSVETDKG

SEQ ID NO: 169814 - protein, 10 aa, Yellow fever virus
TRSVETDKGP

SEQ ID NO: 169815 - protein, 10 aa, Yellow fever virus
RSVETDKGPL

SEQ ID NO: 169816 - protein, 10 aa, Yellow fever virus
SVETDKGPLD

SEQ ID NO: 169817 - protein, 10 aa, Yellow fever virus
VETDKGPLDK

SEQ ID NO: 169818 - protein, 10 aa, Yellow fever virus
EAIEERVERI

SEQ ID NO: 169819 - protein, 10 aa, Yellow fever virus
AIEERVERIK

SEQ ID NO: 169820 - protein, 10 aa, Yellow fever virus
IEERVERIKS

SEQ ID NO: 169821 - protein, 10 aa, Yellow fever virus
EERVERIKSE

SEQ ID NO: 169822 - protein, 10 aa, Yellow fever virus
ERVERIKSEY

SEQ ID NO: 169823 - protein, 10 aa, Yellow fever virus
RVERIKSEYM

SEQ ID NO: 169824 - protein, 10 aa, Yellow fever virus
VERIKSEYMT

SEQ ID NO: 169825 - protein, 10 aa, Yellow fever virus
ERIKSEYMTS

SEQ ID NO: 169826 - protein, 10 aa, Yellow fever virus
RIKSEYMTSW

SEQ ID NO: 169827 - protein, 10 aa, Yellow fever virus
IKSEYMTSWF

SEQ ID NO: 169828 - protein, 10 aa, Yellow fever virus
KSEYMTSWFY

SEQ ID NO: 169829 - protein, 10 aa, Yellow fever virus
SEYMTSWFYD

SEQ ID NO: 169830 - protein, 10 aa, Yellow fever virus
EYMTSWFYDN

SEQ ID NO: 169831 - protein, 10 aa, Yellow fever virus
YMTSWFYDND

SEQ ID NO: 169832 - protein, 10 aa, Yellow fever virus
MTSWFYDNDN

SEQ ID NO: 169833 - protein, 10 aa, Yellow fever virus
TSWFYDNDNP

SEQ ID NO: 169834 - protein, 10 aa, Yellow fever virus
SWFYDNDNPY

SEQ ID NO: 169835 - protein, 10 aa, Yellow fever virus
WFYDNDNPYR

SEQ ID NO: 169836 - protein, 10 aa, Yellow fever virus
FYDNDNPYRT

SEQ ID NO: 169837 - protein, 10 aa, Yellow fever virus
YDNDNPYRTW

SEQ ID NO: 169838 - protein, 10 aa, Yellow fever virus
DNDNPYRTWH

SEQ ID NO: 169839 - protein, 10 aa, Yellow fever virus
NDNPYRTWHY

SEQ ID NO: 169840 - protein, 10 aa, Yellow fever virus
DNPYRTWHYC

SEQ ID NO: 169841 - protein, 10 aa, Yellow fever virus
NPYRTWHYCG

SEQ ID NO: 169842 - protein, 10 aa, Yellow fever virus
PYRTWHYCGS

SEQ ID NO: 169843 - protein, 10 aa, Yellow fever virus
YRTWHYCGSY

SEQ ID NO: 169844 - protein, 10 aa, Yellow fever virus
RTWHYCGSYV

SEQ ID NO: 169845 - protein, 10 aa, Yellow fever virus
TWHYCGSYVT

SEQ ID NO: 169846 - protein, 10 aa, Yellow fever virus
WHYCGSYVTK

SEQ ID NO: 169847 - protein, 10 aa, Yellow fever virus
HYCGSYVTKT

SEQ ID NO: 169848 - protein, 10 aa, Yellow fever virus
YCGSYVTKTS

SEQ ID NO: 169849 - protein, 10 aa, Yellow fever virus
CGSYVTKTSG

SEQ ID NO: 169850 - protein, 10 aa, Yellow fever virus
GSYVTKTSGS

SEQ ID NO: 169851 - protein, 10 aa, Yellow fever virus
SYVTKTSGSA

SEQ ID NO: 169852 - protein, 10 aa, Yellow fever virus
YVTKTSGSAA

SEQ ID NO: 169853 - protein, 10 aa, Yellow fever virus
VTKTSGSAAS

SEQ ID NO: 169854 - protein, 10 aa, Yellow fever virus
TKTSGSAASM

SEQ ID NO: 169855 - protein, 10 aa, Yellow fever virus
KTSGSAASMV

SEQ ID NO: 169856 - protein, 10 aa, Yellow fever virus
TSGSAASMVN

SEQ ID NO: 169857 - protein, 10 aa, Yellow fever virus
SGSAASMVNG

SEQ ID NO: 169858 - protein, 10 aa, Yellow fever virus
GSAASMVNGV

SEQ ID NO: 169859 - protein, 10 aa, Yellow fever virus
SAASMVNGVI

SEQ ID NO: 169860 - protein, 10 aa, Yellow fever virus
AASMVNGVIK

SEQ ID NO: 169861 - protein, 10 aa, Yellow fever virus
ASMVNGVIKI

SEQ ID NO: 169862 - protein, 10 aa, Yellow fever virus
SMVNGVIKIL

SEQ ID NO: 169863 - protein, 10 aa, Yellow fever virus
MVNGVIKILT

SEQ ID NO: 169864 - protein, 10 aa, Yellow fever virus
VNGVIKILTY

SEQ ID NO: 169865 - protein, 10 aa, Yellow fever virus
NGVIKILTYP

SEQ ID NO: 169866 - protein, 10 aa, Yellow fever virus
GVIKILTYPW

SEQ ID NO: 169867 - protein, 10 aa, Yellow fever virus
VIKILTYPWD

SEQ ID NO: 169868 - protein, 10 aa, Yellow fever virus
IKILTYPWDR

SEQ ID NO: 169869 - protein, 10 aa, Yellow fever virus
KILTYPWDRI

SEQ ID NO: 169870 - protein, 10 aa, Yellow fever virus
ILTYPWDRIE

SEQ ID NO: 169871 - protein, 10 aa, Yellow fever virus
LTYPWDRIEE

SEQ ID NO: 169872 - protein, 10 aa, Yellow fever virus
TYPWDRIEEV

SEQ ID NO: 169873 - protein, 10 aa, Yellow fever virus
YPWDRIEEVT

SEQ ID NO: 169874 - protein, 10 aa, Yellow fever virus
PWDRIEEVTR

SEQ ID NO: 169875 - protein, 10 aa, Yellow fever virus
WDRIEEVTRM

SEQ ID NO: 169876 - protein, 10 aa, Yellow fever virus
DRIEEVTRMA

SEQ ID NO: 169877 - protein, 10 aa, Yellow fever virus
RIEEVTRMAM

SEQ ID NO: 169878 - protein, 10 aa, Yellow fever virus
IEEVTRMAMT

SEQ ID NO: 169879 - protein, 10 aa, Yellow fever virus
EEVTRMAMTD

SEQ ID NO: 169880 - protein, 10 aa, Yellow fever virus
EVTRMAMTDT

SEQ ID NO: 169881 - protein, 10 aa, Yellow fever virus
VTRMAMTDTT

SEQ ID NO: 169882 - protein, 10 aa, Yellow fever virus
TRMAMTDTTP

SEQ ID NO: 169883 - protein, 10 aa, Yellow fever virus
RMAMTDTTPF

SEQ ID NO: 169884 - protein, 10 aa, Yellow fever virus
MAMTDTTPFG

SEQ ID NO: 169885 - protein, 10 aa, Yellow fever virus
AMTDTTPFGQ

SEQ ID NO: 169886 - protein, 10 aa, Yellow fever virus
MTDTTPFGQQ

SEQ ID NO: 169887 - protein, 10 aa, Yellow fever virus
TDTTPFGQQR

SEQ ID NO: 169888 - protein, 10 aa, Yellow fever virus
DTTPFGQQRV

SEQ ID NO: 169889 - protein, 10 aa, Yellow fever virus
TTPFGQQRVF

SEQ ID NO: 169890 - protein, 10 aa, Yellow fever virus
TPFGQQRVFK

SEQ ID NO: 169891 - protein, 10 aa, Yellow fever virus
PFGQQRVFKE

SEQ ID NO: 169892 - protein, 10 aa, Yellow fever virus
FGQQRVFKEK

SEQ ID NO: 169893 - protein, 10 aa, Yellow fever virus
GQQRVFKEKV

SEQ ID NO: 169894 - protein, 10 aa, Yellow fever virus
QQRVFKEKVD

SEQ ID NO: 169895 - protein, 10 aa, Yellow fever virus
QRVFKEKVDT

SEQ ID NO: 169896 - protein, 10 aa, Yellow fever virus
RVFKEKVDTR

SEQ ID NO: 169897 - protein, 10 aa, Yellow fever virus
VFKEKVDTRA

SEQ ID NO: 169898 - protein, 10 aa, Yellow fever virus
FKEKVDTRAK

SEQ ID NO: 169899 - protein, 10 aa, Yellow fever virus
KEKVDTRAKD

SEQ ID NO: 169900 - protein, 10 aa, Yellow fever virus
EKVDTRAKDP

SEQ ID NO: 169901 - protein, 10 aa, Yellow fever virus
KVDTRAKDPP

SEQ ID NO: 169902 - protein, 10 aa, Yellow fever virus
VDTRAKDPPA

SEQ ID NO: 169903 - protein, 10 aa, Yellow fever virus
DTRAKDPPAG

SEQ ID NO: 169904 - protein, 10 aa, Yellow fever virus
TRAKDPPAGT

SEQ ID NO: 169905 - protein, 10 aa, Yellow fever virus
RAKDPPAGTR

SEQ ID NO: 169906 - protein, 10 aa, Yellow fever virus
AKDPPAGTRK

SEQ ID NO: 169907 - protein, 10 aa, Yellow fever virus
KDPPAGTRKI

SEQ ID NO: 169908 - protein, 10 aa, Yellow fever virus
DPPAGTRKIM

SEQ ID NO: 169909 - protein, 10 aa, Yellow fever virus
PPAGTRKIMK

SEQ ID NO: 169910 - protein, 10 aa, Yellow fever virus
PAGTRKIMKV

SEQ ID NO: 169911 - protein, 10 aa, Yellow fever virus
AGTRKIMKVV

SEQ ID NO: 169912 - protein, 10 aa, Yellow fever virus
GTRKIMKVVN

SEQ ID NO: 169913 - protein, 10 aa, Yellow fever virus
TRKIMKVVNR

SEQ ID NO: 169914 - protein, 10 aa, Yellow fever virus
RKIMKVVNRW

SEQ ID NO: 169915 - protein, 10 aa, Yellow fever virus
KIMKVVNRWL

SEQ ID NO: 169916 - protein, 10 aa, Yellow fever virus
IMKVVNRWLF

SEQ ID NO: 169917 - protein, 10 aa, Yellow fever virus
MKVVNRWLFR

SEQ ID NO: 169918 - protein, 10 aa, Yellow fever virus
KVVNRWLFRH

SEQ ID NO: 169919 - protein, 10 aa, Yellow fever virus
VVNRWLFRHL

SEQ ID NO: 169920 - protein, 10 aa, Yellow fever virus
VNRWLFRHLA

SEQ ID NO: 169921 - protein, 10 aa, Yellow fever virus
NRWLFRHLAR

SEQ ID NO: 169922 - protein, 10 aa, Yellow fever virus
RWLFRHLARE

SEQ ID NO: 169923 - protein, 10 aa, Yellow fever virus
WLFRHLAREK

SEQ ID NO: 169924 - protein, 10 aa, Yellow fever virus
LFRHLAREKN

SEQ ID NO: 169925 - protein, 10 aa, Yellow fever virus
FRHLAREKNP

SEQ ID NO: 169926 - protein, 10 aa, Yellow fever virus
RHLAREKNPR

SEQ ID NO: 169927 - protein, 10 aa, Yellow fever virus
HLAREKNPRL

SEQ ID NO: 169928 - protein, 10 aa, Yellow fever virus
LAREKNPRLC

SEQ ID NO: 169929 - protein, 10 aa, Yellow fever virus
AREKNPRLCT

SEQ ID NO: 169930 - protein, 10 aa, Yellow fever virus
REKNPRLCTK

SEQ ID NO: 169931 - protein, 10 aa, Yellow fever virus
EKNPRLCTKE

SEQ ID NO: 169932 - protein, 10 aa, Yellow fever virus
KNPRLCTKEE

SEQ ID NO: 169933 - protein, 10 aa, Yellow fever virus
NPRLCTKEEF

SEQ ID NO: 169934 - protein, 10 aa, Yellow fever virus
PRLCTKEEFI

SEQ ID NO: 169935 - protein, 10 aa, Yellow fever virus
RLCTKEEFIA

SEQ ID NO: 169936 - protein, 10 aa, Yellow fever virus
LCTKEEFIAK

SEQ ID NO: 169937 - protein, 10 aa, Yellow fever virus
CTKEEFIAKV

SEQ ID NO: 169938 - protein, 10 aa, Yellow fever virus
TKEEFIAKVR

SEQ ID NO: 169939 - protein, 10 aa, Yellow fever virus
KEEFIAKVRS

SEQ ID NO: 169940 - protein, 10 aa, Yellow fever virus
EEFIAKVRSH

SEQ ID NO: 169941 - protein, 10 aa, Yellow fever virus
EFIAKVRSHA

SEQ ID NO: 169942 - protein, 10 aa, Yellow fever virus
FIAKVRSHAA

SEQ ID NO: 169943 - protein, 10 aa, Yellow fever virus
IAKVRSHAAI

SEQ ID NO: 169944 - protein, 10 aa, Yellow fever virus
AKVRSHAAIG

SEQ ID NO: 169945 - protein, 10 aa, Yellow fever virus
KVRSHAAIGA

SEQ ID NO: 169946 - protein, 10 aa, Yellow fever virus
VRSHAAIGAY

SEQ ID NO: 169947 - protein, 10 aa, Yellow fever virus
RSHAAIGAYL

SEQ ID NO: 169948 - protein, 10 aa, Yellow fever virus
SHAAIGAYLE

SEQ ID NO: 169949 - protein, 10 aa, Yellow fever virus
HAAIGAYLEE

SEQ ID NO: 169950 - protein, 10 aa, Yellow fever virus
AAIGAYLEEQ

SEQ ID NO: 169951 - protein, 10 aa, Yellow fever virus
AIGAYLEEQE

SEQ ID NO: 169952 - protein, 10 aa, Yellow fever virus
IGAYLEEQEQ

SEQ ID NO: 169953 - protein, 10 aa, Yellow fever virus
GAYLEEQEQW

SEQ ID NO: 169954 - protein, 10 aa, Yellow fever virus
AYLEEQEQWK

SEQ ID NO: 169955 - protein, 10 aa, Yellow fever virus
YLEEQEQWKT

SEQ ID NO: 169956 - protein, 10 aa, Yellow fever virus
LEEQEQWKTA

SEQ ID NO: 169957 - protein, 10 aa, Yellow fever virus
EEQEQWKTAN

SEQ ID NO: 169958 - protein, 10 aa, Yellow fever virus
EQEQWKTANE

SEQ ID NO: 169959 - protein, 10 aa, Yellow fever virus
QEQWKTANEA

SEQ ID NO: 169960 - protein, 10 aa, Yellow fever virus
EQWKTANEAV

SEQ ID NO: 169961 - protein, 10 aa, Yellow fever virus
QWKTANEAVQ

SEQ ID NO: 169962 - protein, 10 aa, Yellow fever virus
WKTANEAVQD

SEQ ID NO: 169963 - protein, 10 aa, Yellow fever virus
KTANEAVQDP

SEQ ID NO: 169964 - protein, 10 aa, Yellow fever virus
TANEAVQDPK

SEQ ID NO: 169965 - protein, 10 aa, Yellow fever virus
ANEAVQDPKF

SEQ ID NO: 169966 - protein, 10 aa, Yellow fever virus
NEAVQDPKFW

SEQ ID NO: 169967 - protein, 10 aa, Yellow fever virus
EAVQDPKFWE

SEQ ID NO: 169968 - protein, 10 aa, Yellow fever virus
AVQDPKFWEL

SEQ ID NO: 169969 - protein, 10 aa, Yellow fever virus
VQDPKFWELV

SEQ ID NO: 169970 - protein, 10 aa, Yellow fever virus
QDPKFWELVD

SEQ ID NO: 169971 - protein, 10 aa, Yellow fever virus
DPKFWELVDE

SEQ ID NO: 169972 - protein, 10 aa, Yellow fever virus
PKFWELVDEE

SEQ ID NO: 169973 - protein, 10 aa, Yellow fever virus
KFWELVDEER

SEQ ID NO: 169974 - protein, 10 aa, Yellow fever virus
FWELVDEERK

SEQ ID NO: 169975 - protein, 10 aa, Yellow fever virus
WELVDEERKL

SEQ ID NO: 169976 - protein, 10 aa, Yellow fever virus
ELVDEERKLH

SEQ ID NO: 169977 - protein, 10 aa, Yellow fever virus
LVDEERKLHQ

SEQ ID NO: 169978 - protein, 10 aa, Yellow fever virus
VDEERKLHQQ

SEQ ID NO: 169979 - protein, 10 aa, Yellow fever virus
DEERKLHQQG

SEQ ID NO: 169980 - protein, 10 aa, Yellow fever virus
EERKLHQQGR

SEQ ID NO: 169981 - protein, 10 aa, Yellow fever virus
ERKLHQQGRC

SEQ ID NO: 169982 - protein, 10 aa, Yellow fever virus
RKLHQQGRCR

SEQ ID NO: 169983 - protein, 10 aa, Yellow fever virus
KLHQQGRCRT

SEQ ID NO: 169984 - protein, 10 aa, Yellow fever virus
LHQQGRCRTC

SEQ ID NO: 169985 - protein, 10 aa, Yellow fever virus
HQQGRCRTCV

SEQ ID NO: 169986 - protein, 10 aa, Yellow fever virus
QQGRCRTCVY

SEQ ID NO: 169987 - protein, 10 aa, Yellow fever virus
QGRCRTCVYN

SEQ ID NO: 169988 - protein, 10 aa, Yellow fever virus
GRCRTCVYNM

SEQ ID NO: 169989 - protein, 10 aa, Yellow fever virus
RCRTCVYNMM

SEQ ID NO: 169990 - protein, 10 aa, Yellow fever virus
CRTCVYNMMG

SEQ ID NO: 169991 - protein, 10 aa, Yellow fever virus
RTCVYNMMGK

SEQ ID NO: 169992 - protein, 10 aa, Yellow fever virus
TCVYNMMGKR

SEQ ID NO: 169993 - protein, 10 aa, Yellow fever virus
CVYNMMGKRE

SEQ ID NO: 169994 - protein, 10 aa, Yellow fever virus
VYNMMGKREK

SEQ ID NO: 169995 - protein, 10 aa, Yellow fever virus
YNMMGKREKK

SEQ ID NO: 169996 - protein, 10 aa, Yellow fever virus
NMMGKREKKL

SEQ ID NO: 169997 - protein, 10 aa, Yellow fever virus
MMGKREKKLS

SEQ ID NO: 169998 - protein, 10 aa, Yellow fever virus
MGKREKKLSE

SEQ ID NO: 169999 - protein, 10 aa, Yellow fever virus
GKREKKLSEF

SEQ ID NO: 170000 - protein, 10 aa, Yellow fever virus
KREKKLSEFG

SEQ ID NO: 170001 - protein, 10 aa, Yellow fever virus
REKKLSEFGK

SEQ ID NO: 170002 - protein, 10 aa, Yellow fever virus
EKKLSEFGKA

SEQ ID NO: 170003 - protein, 10 aa, Yellow fever virus
KKLSEFGKAK

SEQ ID NO: 170004 - protein, 10 aa, Yellow fever virus
KLSEFGKAKG

SEQ ID NO: 170005 - protein, 10 aa, Yellow fever virus
LSEFGKAKGS

SEQ ID NO: 170006 - protein, 10 aa, Yellow fever virus
SEFGKAKGSR

SEQ ID NO: 170007 - protein, 10 aa, Yellow fever virus
EFGKAKGSRA

SEQ ID NO: 170008 - protein, 10 aa, Yellow fever virus
FGKAKGSRAI

SEQ ID NO: 170009 - protein, 10 aa, Yellow fever virus
GKAKGSRAIW

SEQ ID NO: 170010 - protein, 10 aa, Yellow fever virus
KAKGSRAIWY

SEQ ID NO: 170011 - protein, 10 aa, Yellow fever virus
AKGSRAIWYM

SEQ ID NO: 170012 - protein, 10 aa, Yellow fever virus
KGSRAIWYMW

SEQ ID NO: 170013 - protein, 10 aa, Yellow fever virus
GSRAIWYMWL

SEQ ID NO: 170014 - protein, 10 aa, Yellow fever virus
SRAIWYMWLG

SEQ ID NO: 170015 - protein, 10 aa, Yellow fever virus
RAIWYMWLGA

SEQ ID NO: 170016 - protein, 10 aa, Yellow fever virus
AIWYMWLGAR

SEQ ID NO: 170017 - protein, 10 aa, Yellow fever virus
IWYMWLGARY

SEQ ID NO: 170018 - protein, 10 aa, Yellow fever virus
WYMWLGARYL

SEQ ID NO: 170019 - protein, 10 aa, Yellow fever virus
YMWLGARYLE

SEQ ID NO: 170020 - protein, 10 aa, Yellow fever virus
MWLGARYLEF

SEQ ID NO: 170021 - protein, 10 aa, Yellow fever virus
WLGARYLEFE

SEQ ID NO: 170022 - protein, 10 aa, Yellow fever virus
LGARYLEFEA

SEQ ID NO: 170023 - protein, 10 aa, Yellow fever virus
GARYLEFEAL

SEQ ID NO: 170024 - protein, 10 aa, Yellow fever virus
ARYLEFEALG

SEQ ID NO: 170025 - protein, 10 aa, Yellow fever virus
RYLEFEALGF

SEQ ID NO: 170026 - protein, 10 aa, Yellow fever virus
YLEFEALGFL

SEQ ID NO: 170027 - protein, 10 aa, Yellow fever virus
LEFEALGFLN

SEQ ID NO: 170028 - protein, 10 aa, Yellow fever virus
EFEALGFLNE

SEQ ID NO: 170029 - protein, 10 aa, Yellow fever virus
FEALGFLNED

SEQ ID NO: 170030 - protein, 10 aa, Yellow fever virus
EALGFLNEDH

SEQ ID NO: 170031 - protein, 10 aa, Yellow fever virus
ALGFLNEDHW

SEQ ID NO: 170032 - protein, 10 aa, Yellow fever virus
LGFLNEDHWA

SEQ ID NO: 170033 - protein, 10 aa, Yellow fever virus
GFLNEDHWAS

SEQ ID NO: 170034 - protein, 10 aa, Yellow fever virus
FLNEDHWASR

SEQ ID NO: 170035 - protein, 10 aa, Yellow fever virus
LNEDHWASRE

SEQ ID NO: 170036 - protein, 10 aa, Yellow fever virus
NEDHWASREN

SEQ ID NO: 170037 - protein, 10 aa, Yellow fever virus
EDHWASRENS

SEQ ID NO: 170038 - protein, 10 aa, Yellow fever virus
DHWASRENSG

SEQ ID NO: 170039 - protein, 10 aa, Yellow fever virus
HWASRENSGG

SEQ ID NO: 170040 - protein, 10 aa, Yellow fever virus
WASRENSGGG

SEQ ID NO: 170041 - protein, 10 aa, Yellow fever virus
ASRENSGGGV

SEQ ID NO: 170042 - protein, 10 aa, Yellow fever virus
SRENSGGGVE

SEQ ID NO: 170043 - protein, 10 aa, Yellow fever virus
RENSGGGVEG

SEQ ID NO: 170044 - protein, 10 aa, Yellow fever virus
ENSGGGVEGI

SEQ ID NO: 170045 - protein, 10 aa, Yellow fever virus
NSGGGVEGIG

SEQ ID NO: 170046 - protein, 10 aa, Yellow fever virus
SGGGVEGIGL

SEQ ID NO: 170047 - protein, 10 aa, Yellow fever virus
GGGVEGIGLQ

SEQ ID NO: 170048 - protein, 10 aa, Yellow fever virus
GGVEGIGLQY

SEQ ID NO: 170049 - protein, 10 aa, Yellow fever virus
GVEGIGLQYL

SEQ ID NO: 170050 - protein, 10 aa, Yellow fever virus
VEGIGLQYLG

SEQ ID NO: 170051 - protein, 10 aa, Yellow fever virus
EGIGLQYLGY

SEQ ID NO: 170052 - protein, 10 aa, Yellow fever virus
GIGLQYLGYV

SEQ ID NO: 170053 - protein, 10 aa, Yellow fever virus
IGLQYLGYVI

SEQ ID NO: 170054 - protein, 10 aa, Yellow fever virus
GLQYLGYVIR

SEQ ID NO: 170055 - protein, 10 aa, Yellow fever virus
LQYLGYVIRD

SEQ ID NO: 170056 - protein, 10 aa, Yellow fever virus
QYLGYVIRDL

SEQ ID NO: 170057 - protein, 10 aa, Yellow fever virus
YLGYVIRDLA

SEQ ID NO: 170058 - protein, 10 aa, Yellow fever virus
LGYVIRDLAA

SEQ ID NO: 170059 - protein, 10 aa, Yellow fever virus
GYVIRDLAAM

SEQ ID NO: 170060 - protein, 10 aa, Yellow fever virus
YVIRDLAAMD

SEQ ID NO: 170061 - protein, 10 aa, Yellow fever virus
VIRDLAAMDG

SEQ ID NO: 170062 - protein, 10 aa, Yellow fever virus
IRDLAAMDGG

SEQ ID NO: 170063 - protein, 10 aa, Yellow fever virus
RDLAAMDGGG

SEQ ID NO: 170064 - protein, 10 aa, Yellow fever virus
DLAAMDGGGF

SEQ ID NO: 170065 - protein, 10 aa, Yellow fever virus
LAAMDGGGFY

SEQ ID NO: 170066 - protein, 10 aa, Yellow fever virus
AAMDGGGFYA

SEQ ID NO: 170067 - protein, 10 aa, Yellow fever virus
AMDGGGFYAD

SEQ ID NO: 170068 - protein, 10 aa, Yellow fever virus
MDGGGFYADD

SEQ ID NO: 170069 - protein, 10 aa, Yellow fever virus
DGGGFYADDT

SEQ ID NO: 170070 - protein, 10 aa, Yellow fever virus
GGGFYADDTA

SEQ ID NO: 170071 - protein, 10 aa, Yellow fever virus
GGFYADDTAG

SEQ ID NO: 170072 - protein, 10 aa, Yellow fever virus
GFYADDTAGW

SEQ ID NO: 170073 - protein, 10 aa, Yellow fever virus
FYADDTAGWD

SEQ ID NO: 170074 - protein, 10 aa, Yellow fever virus
YADDTAGWDT

SEQ ID NO: 170075 - protein, 10 aa, Yellow fever virus
ADDTAGWDTR

SEQ ID NO: 170076 - protein, 10 aa, Yellow fever virus
DDTAGWDTRI

SEQ ID NO: 170077 - protein, 10 aa, Yellow fever virus
DTAGWDTRIT

SEQ ID NO: 170078 - protein, 10 aa, Yellow fever virus
TAGWDTRITE

SEQ ID NO: 170079 - protein, 10 aa, Yellow fever virus
AGWDTRITEA

SEQ ID NO: 170080 - protein, 10 aa, Yellow fever virus
GWDTRITEAD

SEQ ID NO: 170081 - protein, 10 aa, Yellow fever virus
WDTRITEADL

SEQ ID NO: 170082 - protein, 10 aa, Yellow fever virus
DTRITEADLD

SEQ ID NO: 170083 - protein, 10 aa, Yellow fever virus
TRITEADLDD

SEQ ID NO: 170084 - protein, 10 aa, Yellow fever virus
RITEADLDDE

SEQ ID NO: 170085 - protein, 10 aa, Yellow fever virus
ITEADLDDEQ

SEQ ID NO: 170086 - protein, 10 aa, Yellow fever virus
TEADLDDEQE

SEQ ID NO: 170087 - protein, 10 aa, Yellow fever virus
EADLDDEQEI

SEQ ID NO: 170088 - protein, 10 aa, Yellow fever virus
ADLDDEQEIL

SEQ ID NO: 170089 - protein, 10 aa, Yellow fever virus
DLDDEQEILN

SEQ ID NO: 170090 - protein, 10 aa, Yellow fever virus
LDDEQEILNY

SEQ ID NO: 170091 - protein, 10 aa, Yellow fever virus
DDEQEILNYM

SEQ ID NO: 170092 - protein, 10 aa, Yellow fever virus
DEQEILNYMS

SEQ ID NO: 170093 - protein, 10 aa, Yellow fever virus
EQEILNYMSP

SEQ ID NO: 170094 - protein, 10 aa, Yellow fever virus
QEILNYMSPH

SEQ ID NO: 170095 - protein, 10 aa, Yellow fever virus
EILNYMSPHH

SEQ ID NO: 170096 - protein, 10 aa, Yellow fever virus
ILNYMSPHHK

SEQ ID NO: 170097 - protein, 10 aa, Yellow fever virus
LNYMSPHHKK

SEQ ID NO: 170098 - protein, 10 aa, Yellow fever virus
NYMSPHHKKL

SEQ ID NO: 170099 - protein, 10 aa, Yellow fever virus
YMSPHHKKLA

SEQ ID NO: 170100 - protein, 10 aa, Yellow fever virus
MSPHHKKLAQ

SEQ ID NO: 170101 - protein, 10 aa, Yellow fever virus
SPHHKKLAQA

SEQ ID NO: 170102 - protein, 10 aa, Yellow fever virus
PHHKKLAQAV

SEQ ID NO: 170103 - protein, 10 aa, Yellow fever virus
HHKKLAQAVM

SEQ ID NO: 170104 - protein, 10 aa, Yellow fever virus
HKKLAQAVME

SEQ ID NO: 170105 - protein, 10 aa, Yellow fever virus
KKLAQAVMEM

SEQ ID NO: 170106 - protein, 10 aa, Yellow fever virus
KLAQAVMEMT

SEQ ID NO: 170107 - protein, 10 aa, Yellow fever virus
LAQAVMEMTY

SEQ ID NO: 170108 - protein, 10 aa, Yellow fever virus
AQAVMEMTYK

SEQ ID NO: 170109 - protein, 10 aa, Yellow fever virus
QAVMEMTYKN

SEQ ID NO: 170110 - protein, 10 aa, Yellow fever virus
AVMEMTYKNK

SEQ ID NO: 170111 - protein, 10 aa, Yellow fever virus
VMEMTYKNKV

SEQ ID NO: 170112 - protein, 10 aa, Yellow fever virus
MEMTYKNKVV

SEQ ID NO: 170113 - protein, 10 aa, Yellow fever virus
EMTYKNKVVK

SEQ ID NO: 170114 - protein, 10 aa, Yellow fever virus
MTYKNKVVKV

SEQ ID NO: 170115 - protein, 10 aa, Yellow fever virus
TYKNKVVKVL

SEQ ID NO: 170116 - protein, 10 aa, Yellow fever virus
YKNKVVKVLR

SEQ ID NO: 170117 - protein, 10 aa, Yellow fever virus
KNKVVKVLRP

SEQ ID NO: 170118 - protein, 10 aa, Yellow fever virus
NKVVKVLRPA

SEQ ID NO: 170119 - protein, 10 aa, Yellow fever virus
KVVKVLRPAP

SEQ ID NO: 170120 - protein, 10 aa, Yellow fever virus
VVKVLRPAPG

SEQ ID NO: 170121 - protein, 10 aa, Yellow fever virus
VKVLRPAPGG

SEQ ID NO: 170122 - protein, 10 aa, Yellow fever virus
KVLRPAPGGK

SEQ ID NO: 170123 - protein, 10 aa, Yellow fever virus
VLRPAPGGKA

SEQ ID NO: 170124 - protein, 10 aa, Yellow fever virus
LRPAPGGKAY

SEQ ID NO: 170125 - protein, 10 aa, Yellow fever virus
RPAPGGKAYM

SEQ ID NO: 170126 - protein, 10 aa, Yellow fever virus
PAPGGKAYMD

SEQ ID NO: 170127 - protein, 10 aa, Yellow fever virus
APGGKAYMDV

SEQ ID NO: 170128 - protein, 10 aa, Yellow fever virus
PGGKAYMDVI

SEQ ID NO: 170129 - protein, 10 aa, Yellow fever virus
GGKAYMDVIS

SEQ ID NO: 170130 - protein, 10 aa, Yellow fever virus
GKAYMDVISR

SEQ ID NO: 170131 - protein, 10 aa, Yellow fever virus
KAYMDVISRR

SEQ ID NO: 170132 - protein, 10 aa, Yellow fever virus
AYMDVISRRD

SEQ ID NO: 170133 - protein, 10 aa, Yellow fever virus
YMDVISRRDQ

SEQ ID NO: 170134 - protein, 10 aa, Yellow fever virus
MDVISRRDQR

SEQ ID NO: 170135 - protein, 10 aa, Yellow fever virus
DVISRRDQRG

SEQ ID NO: 170136 - protein, 10 aa, Yellow fever virus
VISRRDQRGS

SEQ ID NO: 170137 - protein, 10 aa, Yellow fever virus
ISRRDQRGSG

SEQ ID NO: 170138 - protein, 10 aa, Yellow fever virus
SRRDQRGSGQ

SEQ ID NO: 170139 - protein, 10 aa, Yellow fever virus
RRDQRGSGQV

SEQ ID NO: 170140 - protein, 10 aa, Yellow fever virus
RDQRGSGQVV

SEQ ID NO: 170141 - protein, 10 aa, Yellow fever virus
DQRGSGQVVT

SEQ ID NO: 170142 - protein, 10 aa, Yellow fever virus
QRGSGQVVTY

SEQ ID NO: 170143 - protein, 10 aa, Yellow fever virus
RGSGQVVTYA

SEQ ID NO: 170144 - protein, 10 aa, Yellow fever virus
GSGQVVTYAL

SEQ ID NO: 170145 - protein, 10 aa, Yellow fever virus
SGQVVTYALN

SEQ ID NO: 170146 - protein, 10 aa, Yellow fever virus
GQVVTYALNT

SEQ ID NO: 170147 - protein, 10 aa, Yellow fever virus
QVVTYALNTI

SEQ ID NO: 170148 - protein, 10 aa, Yellow fever virus
VVTYALNTIT

SEQ ID NO: 170149 - protein, 10 aa, Yellow fever virus
VTYALNTITN

SEQ ID NO: 170150 - protein, 10 aa, Yellow fever virus
TYALNTITNL

SEQ ID NO: 170151 - protein, 10 aa, Yellow fever virus
YALNTITNLK

SEQ ID NO: 170152 - protein, 10 aa, Yellow fever virus
ALNTITNLKV

SEQ ID NO: 170153 - protein, 10 aa, Yellow fever virus
LNTITNLKVQ

SEQ ID NO: 170154 - protein, 10 aa, Yellow fever virus
NTITNLKVQL

SEQ ID NO: 170155 - protein, 10 aa, Yellow fever virus
TITNLKVQLI

SEQ ID NO: 170156 - protein, 10 aa, Yellow fever virus
ITNLKVQLIR

SEQ ID NO: 170157 - protein, 10 aa, Yellow fever virus
TNLKVQLIRM

SEQ ID NO: 170158 - protein, 10 aa, Yellow fever virus
NLKVQLIRMA

SEQ ID NO: 170159 - protein, 10 aa, Yellow fever virus
LKVQLIRMAE

SEQ ID NO: 170160 - protein, 10 aa, Yellow fever virus
KVQLIRMAEA

SEQ ID NO: 170161 - protein, 10 aa, Yellow fever virus
VQLIRMAEAE

SEQ ID NO: 170162 - protein, 10 aa, Yellow fever virus
QLIRMAEAEM

SEQ ID NO: 170163 - protein, 10 aa, Yellow fever virus
LIRMAEAEMV

SEQ ID NO: 170164 - protein, 10 aa, Yellow fever virus
IRMAEAEMVI

SEQ ID NO: 170165 - protein, 10 aa, Yellow fever virus
RMAEAEMVIH

SEQ ID NO: 170166 - protein, 10 aa, Yellow fever virus
MAEAEMVIHH

SEQ ID NO: 170167 - protein, 10 aa, Yellow fever virus
AEAEMVIHHQ

SEQ ID NO: 170168 - protein, 10 aa, Yellow fever virus
EAEMVIHHQH

SEQ ID NO: 170169 - protein, 10 aa, Yellow fever virus
AEMVIHHQHV

SEQ ID NO: 170170 - protein, 10 aa, Yellow fever virus
EMVIHHQHVQ

SEQ ID NO: 170171 - protein, 10 aa, Yellow fever virus
MVIHHQHVQD

SEQ ID NO: 170172 - protein, 10 aa, Yellow fever virus
VIHHQHVQDC

SEQ ID NO: 170173 - protein, 10 aa, Yellow fever virus
IHHQHVQDCD

SEQ ID NO: 170174 - protein, 10 aa, Yellow fever virus
HHQHVQDCDE

SEQ ID NO: 170175 - protein, 10 aa, Yellow fever virus
HQHVQDCDES

SEQ ID NO: 170176 - protein, 10 aa, Yellow fever virus
LTRLEAWLTE

SEQ ID NO: 170177 - protein, 10 aa, Yellow fever virus
TRLEAWLTEH

SEQ ID NO: 170178 - protein, 10 aa, Yellow fever virus
RLEAWLTEHG

SEQ ID NO: 170179 - protein, 10 aa, Yellow fever virus
LEAWLTEHGC

SEQ ID NO: 170180 - protein, 10 aa, Yellow fever virus
EAWLTEHGCN

SEQ ID NO: 170181 - protein, 10 aa, Yellow fever virus
AWLTEHGCNR

SEQ ID NO: 170182 - protein, 10 aa, Yellow fever virus
WLTEHGCNRL

SEQ ID NO: 170183 - protein, 10 aa, Yellow fever virus
RLKRMAVSGD

SEQ ID NO: 170184 - protein, 10 aa, Yellow fever virus
LKRMAVSGDD

SEQ ID NO: 170185 - protein, 10 aa, Yellow fever virus
KRMAVSGDDC

SEQ ID NO: 170186 - protein, 10 aa, Yellow fever virus
RMAVSGDDCV

SEQ ID NO: 170187 - protein, 10 aa, Yellow fever virus
MAVSGDDCVV

SEQ ID NO: 170188 - protein, 10 aa, Yellow fever virus
AVSGDDCVVR

SEQ ID NO: 170189 - protein, 10 aa, Yellow fever virus
VSGDDCVVRP

SEQ ID NO: 170190 - protein, 10 aa, Yellow fever virus
SGDDCVVRPI

SEQ ID NO: 170191 - protein, 10 aa, Yellow fever virus
GDDCVVRPID

SEQ ID NO: 170192 - protein, 10 aa, Yellow fever virus
DDCVVRPIDD

SEQ ID NO: 170193 - protein, 10 aa, Yellow fever virus
DCVVRPIDDR

SEQ ID NO: 170194 - protein, 10 aa, Yellow fever virus
CVVRPIDDRF

SEQ ID NO: 170195 - protein, 10 aa, Yellow fever virus
VVRPIDDRFG

SEQ ID NO: 170196 - protein, 10 aa, Yellow fever virus
VRPIDDRFGL

SEQ ID NO: 170197 - protein, 10 aa, Yellow fever virus
RPIDDRFGLA

SEQ ID NO: 170198 - protein, 10 aa, Yellow fever virus
PIDDRFGLAL

SEQ ID NO: 170199 - protein, 10 aa, Yellow fever virus
IDDRFGLALS

SEQ ID NO: 170200 - protein, 10 aa, Yellow fever virus
DDRFGLALSH

SEQ ID NO: 170201 - protein, 10 aa, Yellow fever virus
DRFGLALSHL

SEQ ID NO: 170202 - protein, 10 aa, Yellow fever virus
RFGLALSHLN

SEQ ID NO: 170203 - protein, 10 aa, Yellow fever virus
FGLALSHLNA

SEQ ID NO: 170204 - protein, 10 aa, Yellow fever virus
GLALSHLNAM

SEQ ID NO: 170205 - protein, 10 aa, Yellow fever virus
LALSHLNAMS

SEQ ID NO: 170206 - protein, 10 aa, Yellow fever virus
ALSHLNAMSK

SEQ ID NO: 170207 - protein, 10 aa, Yellow fever virus
LSHLNAMSKV

SEQ ID NO: 170208 - protein, 10 aa, Yellow fever virus
SHLNAMSKVR

SEQ ID NO: 170209 - protein, 10 aa, Yellow fever virus
HLNAMSKVRK

SEQ ID NO: 170210 - protein, 10 aa, Yellow fever virus
LNAMSKVRKD

SEQ ID NO: 170211 - protein, 10 aa, Yellow fever virus
NAMSKVRKDI

SEQ ID NO: 170212 - protein, 10 aa, Yellow fever virus
AMSKVRKDIS

SEQ ID NO: 170213 - protein, 10 aa, Yellow fever virus
MSKVRKDISE

SEQ ID NO: 170214 - protein, 10 aa, Yellow fever virus
SKVRKDISEW

SEQ ID NO: 170215 - protein, 10 aa, Yellow fever virus
KVRKDISEWQ

SEQ ID NO: 170216 - protein, 10 aa, Yellow fever virus
VRKDISEWQP

SEQ ID NO: 170217 - protein, 10 aa, Yellow fever virus
RKDISEWQPS

SEQ ID NO: 170218 - protein, 10 aa, Yellow fever virus
KDISEWQPSK

SEQ ID NO: 170219 - protein, 10 aa, Yellow fever virus
DISEWQPSKG

SEQ ID NO: 170220 - protein, 10 aa, Yellow fever virus
ISEWQPSKGW

SEQ ID NO: 170221 - protein, 10 aa, Yellow fever virus
SEWQPSKGWN

SEQ ID NO: 170222 - protein, 10 aa, Yellow fever virus
EWQPSKGWND

SEQ ID NO: 170223 - protein, 10 aa, Yellow fever virus
WQPSKGWNDW

SEQ ID NO: 170224 - protein, 10 aa, Yellow fever virus
QPSKGWNDWE

SEQ ID NO: 170225 - protein, 10 aa, Yellow fever virus
PSKGWNDWEN

SEQ ID NO: 170226 - protein, 10 aa, Yellow fever virus
SKGWNDWENV

SEQ ID NO: 170227 - protein, 10 aa, Yellow fever virus
KGWNDWENVP

SEQ ID NO: 170228 - protein, 10 aa, Yellow fever virus
GWNDWENVPF

SEQ ID NO: 170229 - protein, 10 aa, Yellow fever virus
WNDWENVPFC

SEQ ID NO: 170230 - protein, 10 aa, Yellow fever virus
NDWENVPFCS

SEQ ID NO: 170231 - protein, 10 aa, Yellow fever virus
DWENVPFCSH

SEQ ID NO: 170232 - protein, 10 aa, Yellow fever virus
WENVPFCSHH

SEQ ID NO: 170233 - protein, 10 aa, Yellow fever virus
ENVPFCSHHF

SEQ ID NO: 170234 - protein, 10 aa, Yellow fever virus
NVPFCSHHFH

SEQ ID NO: 170235 - protein, 10 aa, Yellow fever virus
VPFCSHHFHE

SEQ ID NO: 170236 - protein, 10 aa, Yellow fever virus
PFCSHHFHEL

SEQ ID NO: 170237 - protein, 10 aa, Yellow fever virus
FCSHHFHELQ

SEQ ID NO: 170238 - protein, 10 aa, Yellow fever virus
CSHHFHELQL

SEQ ID NO: 170239 - protein, 10 aa, Yellow fever virus
SHHFHELQLK

SEQ ID NO: 170240 - protein, 10 aa, Yellow fever virus
HHFHELQLKD

SEQ ID NO: 170241 - protein, 10 aa, Yellow fever virus
HFHELQLKDG

SEQ ID NO: 170242 - protein, 10 aa, Yellow fever virus
FHELQLKDGR

SEQ ID NO: 170243 - protein, 10 aa, Yellow fever virus
HELQLKDGRR

SEQ ID NO: 170244 - protein, 10 aa, Yellow fever virus
ELQLKDGRRI

SEQ ID NO: 170245 - protein, 10 aa, Yellow fever virus
LQLKDGRRIV

SEQ ID NO: 170246 - protein, 10 aa, Yellow fever virus
QLKDGRRIVV

SEQ ID NO: 170247 - protein, 10 aa, Yellow fever virus
LKDGRRIVVP

SEQ ID NO: 170248 - protein, 10 aa, Yellow fever virus
KDGRRIVVPC

SEQ ID NO: 170249 - protein, 10 aa, Yellow fever virus
DGRRIVVPCR

SEQ ID NO: 170250 - protein, 10 aa, Yellow fever virus
GRRIVVPCRE

SEQ ID NO: 170251 - protein, 10 aa, Yellow fever virus
RRIVVPCREQ

SEQ ID NO: 170252 - protein, 10 aa, Yellow fever virus
RIVVPCREQD

SEQ ID NO: 170253 - protein, 10 aa, Yellow fever virus
IVVPCREQDE

SEQ ID NO: 170254 - protein, 10 aa, Yellow fever virus
VVPCREQDEL

SEQ ID NO: 170255 - protein, 10 aa, Yellow fever virus
VPCREQDELI

SEQ ID NO: 170256 - protein, 10 aa, Yellow fever virus
PCREQDELIG

SEQ ID NO: 170257 - protein, 10 aa, Yellow fever virus
CREQDELIGR

SEQ ID NO: 170258 - protein, 10 aa, Yellow fever virus
REQDELIGRG

SEQ ID NO: 170259 - protein, 10 aa, Yellow fever virus
EQDELIGRGR

SEQ ID NO: 170260 - protein, 10 aa, Yellow fever virus
QDELIGRGRV

SEQ ID NO: 170261 - protein, 10 aa, Yellow fever virus
DELIGRGRVS

SEQ ID NO: 170262 - protein, 10 aa, Yellow fever virus
ELIGRGRVSP

SEQ ID NO: 170263 - protein, 10 aa, Yellow fever virus
LIGRGRVSPG

SEQ ID NO: 170264 - protein, 10 aa, Yellow fever virus
IGRGRVSPGN

SEQ ID NO: 170265 - protein, 10 aa, Yellow fever virus
GRGRVSPGNG

SEQ ID NO: 170266 - protein, 10 aa, Yellow fever virus
RGRVSPGNGW

SEQ ID NO: 170267 - protein, 10 aa, Yellow fever virus
GRVSPGNGWM

SEQ ID NO: 170268 - protein, 10 aa, Yellow fever virus
RVSPGNGWMI

SEQ ID NO: 170269 - protein, 10 aa, Yellow fever virus
VSPGNGWMIK

SEQ ID NO: 170270 - protein, 10 aa, Yellow fever virus
SPGNGWMIKE

SEQ ID NO: 170271 - protein, 10 aa, Yellow fever virus
PGNGWMIKET

SEQ ID NO: 170272 - protein, 10 aa, Yellow fever virus
GNGWMIKETA

SEQ ID NO: 170273 - protein, 10 aa, Yellow fever virus
NGWMIKETAC

SEQ ID NO: 170274 - protein, 10 aa, Yellow fever virus
GWMIKETACL

SEQ ID NO: 170275 - protein, 10 aa, Yellow fever virus
WMIKETACLS

SEQ ID NO: 170276 - protein, 10 aa, Yellow fever virus
MIKETACLSK

SEQ ID NO: 170277 - protein, 10 aa, Yellow fever virus
IKETACLSKA

SEQ ID NO: 170278 - protein, 10 aa, Yellow fever virus
KETACLSKAY

SEQ ID NO: 170279 - protein, 10 aa, Yellow fever virus
ETACLSKAYA

SEQ ID NO: 170280 - protein, 10 aa, Yellow fever virus
TACLSKAYAN

SEQ ID NO: 170281 - protein, 10 aa, Yellow fever virus
ACLSKAYANM

SEQ ID NO: 170282 - protein, 10 aa, Yellow fever virus
CLSKAYANMW

SEQ ID NO: 170283 - protein, 10 aa, Yellow fever virus
LSKAYANMWS

SEQ ID NO: 170284 - protein, 10 aa, Yellow fever virus
SKAYANMWSL

SEQ ID NO: 170285 - protein, 10 aa, Yellow fever virus
KAYANMWSLM

SEQ ID NO: 170286 - protein, 10 aa, Yellow fever virus
AYANMWSLMY

SEQ ID NO: 170287 - protein, 10 aa, Yellow fever virus
YANMWSLMYF

SEQ ID NO: 170288 - protein, 10 aa, Yellow fever virus
ANMWSLMYFH

SEQ ID NO: 170289 - protein, 10 aa, Yellow fever virus
NMWSLMYFHK

SEQ ID NO: 170290 - protein, 10 aa, Yellow fever virus
MWSLMYFHKR

SEQ ID NO: 170291 - protein, 10 aa, Yellow fever virus
WSLMYFHKRD

SEQ ID NO: 170292 - protein, 10 aa, Yellow fever virus
SLMYFHKRDM

SEQ ID NO: 170293 - protein, 10 aa, Yellow fever virus
LMYFHKRDMR

SEQ ID NO: 170294 - protein, 10 aa, Yellow fever virus
MYFHKRDMRL

SEQ ID NO: 170295 - protein, 10 aa, Yellow fever virus
YFHKRDMRLL

SEQ ID NO: 170296 - protein, 10 aa, Yellow fever virus
FHKRDMRLLS

SEQ ID NO: 170297 - protein, 10 aa, Yellow fever virus
HKRDMRLLSL

SEQ ID NO: 170298 - protein, 10 aa, Yellow fever virus
KRDMRLLSLA

SEQ ID NO: 170299 - protein, 10 aa, Yellow fever virus
RDMRLLSLAV

SEQ ID NO: 170300 - protein, 10 aa, Yellow fever virus
DMRLLSLAVS

SEQ ID NO: 170301 - protein, 10 aa, Yellow fever virus
MRLLSLAVSS

SEQ ID NO: 170302 - protein, 10 aa, Yellow fever virus
RLLSLAVSSA

SEQ ID NO: 170303 - protein, 10 aa, Yellow fever virus
LLSLAVSSAV

SEQ ID NO: 170304 - protein, 10 aa, Yellow fever virus
LSLAVSSAVP

SEQ ID NO: 170305 - protein, 10 aa, Yellow fever virus
SLAVSSAVPT

SEQ ID NO: 170306 - protein, 10 aa, Yellow fever virus
LAVSSAVPTS

SEQ ID NO: 170307 - protein, 10 aa, Yellow fever virus
AVSSAVPTSW

SEQ ID NO: 170308 - protein, 10 aa, Yellow fever virus
VSSAVPTSWV

SEQ ID NO: 170309 - protein, 10 aa, Yellow fever virus
SSAVPTSWVP

SEQ ID NO: 170310 - protein, 10 aa, Yellow fever virus
SAVPTSWVPQ

SEQ ID NO: 170311 - protein, 10 aa, Yellow fever virus
AVPTSWVPQG

SEQ ID NO: 170312 - protein, 10 aa, Yellow fever virus
VPTSWVPQGR

SEQ ID NO: 170313 - protein, 10 aa, Yellow fever virus
PTSWVPQGRT

SEQ ID NO: 170314 - protein, 10 aa, Yellow fever virus
TSWVPQGRTT

SEQ ID NO: 170315 - protein, 10 aa, Yellow fever virus
SWVPQGRTTW

SEQ ID NO: 170316 - protein, 10 aa, Yellow fever virus
WVPQGRTTWS

SEQ ID NO: 170317 - protein, 10 aa, Yellow fever virus
VPQGRTTWSI

SEQ ID NO: 170318 - protein, 10 aa, Yellow fever virus
PQGRTTWSIH

SEQ ID NO: 170319 - protein, 10 aa, Yellow fever virus
QGRTTWSIHG

SEQ ID NO: 170320 - protein, 10 aa, Yellow fever virus
GRTTWSIHGK

SEQ ID NO: 170321 - protein, 10 aa, Yellow fever virus
RTTWSIHGKG

SEQ ID NO: 170322 - protein, 10 aa, Yellow fever virus
TTWSIHGKGE

SEQ ID NO: 170323 - protein, 10 aa, Yellow fever virus
TWSIHGKGEW

SEQ ID NO: 170324 - protein, 10 aa, Yellow fever virus
WSIHGKGEWM

SEQ ID NO: 170325 - protein, 10 aa, Yellow fever virus
SIHGKGEWMT

SEQ ID NO: 170326 - protein, 10 aa, Yellow fever virus
IHGKGEWMTT

SEQ ID NO: 170327 - protein, 10 aa, Yellow fever virus
HGKGEWMTTE

SEQ ID NO: 170328 - protein, 10 aa, Yellow fever virus
GKGEWMTTED

SEQ ID NO: 170329 - protein, 10 aa, Yellow fever virus
KGEWMTTEDM

SEQ ID NO: 170330 - protein, 10 aa, Yellow fever virus
GEWMTTEDML

SEQ ID NO: 170331 - protein, 10 aa, Yellow fever virus
EWMTTEDMLE

SEQ ID NO: 170332 - protein, 10 aa, Yellow fever virus
WMTTEDMLEV

SEQ ID NO: 170333 - protein, 10 aa, Yellow fever virus
MTTEDMLEVW

SEQ ID NO: 170334 - protein, 10 aa, Yellow fever virus
TTEDMLEVWN

SEQ ID NO: 170335 - protein, 10 aa, Yellow fever virus
TEDMLEVWNR

SEQ ID NO: 170336 - protein, 10 aa, Yellow fever virus
EDMLEVWNRV

SEQ ID NO: 170337 - protein, 10 aa, Yellow fever virus
DMLEVWNRVW

SEQ ID NO: 170338 - protein, 10 aa, Yellow fever virus
MLEVWNRVWI

SEQ ID NO: 170339 - protein, 10 aa, Yellow fever virus
LEVWNRVWIT

SEQ ID NO: 170340 - protein, 10 aa, Yellow fever virus
EVWNRVWITN

SEQ ID NO: 170341 - protein, 10 aa, Yellow fever virus
VWNRVWITNN

SEQ ID NO: 170342 - protein, 10 aa, Yellow fever virus
WNRVWITNNP

SEQ ID NO: 170343 - protein, 10 aa, Yellow fever virus
NRVWITNNPH

SEQ ID NO: 170344 - protein, 10 aa, Yellow fever virus
RVWITNNPHM

SEQ ID NO: 170345 - protein, 10 aa, Yellow fever virus
VWITNNPHMQ

SEQ ID NO: 170346 - protein, 10 aa, Yellow fever virus
WITNNPHMQD

SEQ ID NO: 170347 - protein, 10 aa, Yellow fever virus
ITNNPHMQDK

SEQ ID NO: 170348 - protein, 10 aa, Yellow fever virus
TNNPHMQDKT

SEQ ID NO: 170349 - protein, 10 aa, Yellow fever virus
NNPHMQDKTM

SEQ ID NO: 170350 - protein, 10 aa, Yellow fever virus
NPHMQDKTMV

SEQ ID NO: 170351 - protein, 10 aa, Yellow fever virus
PHMQDKTMVK

SEQ ID NO: 170352 - protein, 10 aa, Yellow fever virus
HMQDKTMVKK

SEQ ID NO: 170353 - protein, 10 aa, Yellow fever virus
MQDKTMVKKW

SEQ ID NO: 170354 - protein, 10 aa, Yellow fever virus
QDKTMVKKWR

SEQ ID NO: 170355 - protein, 10 aa, Yellow fever virus
DKTMVKKWRD

SEQ ID NO: 170356 - protein, 10 aa, Yellow fever virus
KTMVKKWRDV

SEQ ID NO: 170357 - protein, 10 aa, Yellow fever virus
TMVKKWRDVP

SEQ ID NO: 170358 - protein, 10 aa, Yellow fever virus
MVKKWRDVPY

SEQ ID NO: 170359 - protein, 10 aa, Yellow fever virus
VKKWRDVPYL

SEQ ID NO: 170360 - protein, 10 aa, Yellow fever virus
KKWRDVPYLT

SEQ ID NO: 170361 - protein, 10 aa, Yellow fever virus
KWRDVPYLTK

SEQ ID NO: 170362 - protein, 10 aa, Yellow fever virus
WRDVPYLTKR

SEQ ID NO: 170363 - protein, 10 aa, Yellow fever virus
RDVPYLTKRQ

SEQ ID NO: 170364 - protein, 10 aa, Yellow fever virus
DVPYLTKRQD

SEQ ID NO: 170365 - protein, 10 aa, Yellow fever virus
VPYLTKRQDK

SEQ ID NO: 170366 - protein, 10 aa, Yellow fever virus
PYLTKRQDKL

SEQ ID NO: 170367 - protein, 10 aa, Yellow fever virus
YLTKRQDKLC

SEQ ID NO: 170368 - protein, 10 aa, Yellow fever virus
LTKRQDKLCG

SEQ ID NO: 170369 - protein, 10 aa, Yellow fever virus
TKRQDKLCGS

SEQ ID NO: 170370 - protein, 10 aa, Yellow fever virus
KRQDKLCGSL

SEQ ID NO: 170371 - protein, 10 aa, Yellow fever virus
RQDKLCGSLI

SEQ ID NO: 170372 - protein, 10 aa, Yellow fever virus
QDKLCGSLIG

SEQ ID NO: 170373 - protein, 10 aa, Yellow fever virus
DKLCGSLIGM

SEQ ID NO: 170374 - protein, 10 aa, Yellow fever virus
KLCGSLIGMT

SEQ ID NO: 170375 - protein, 10 aa, Yellow fever virus
LCGSLIGMTN

SEQ ID NO: 170376 - protein, 10 aa, Yellow fever virus
CGSLIGMTNR

SEQ ID NO: 170377 - protein, 10 aa, Yellow fever virus
GSLIGMTNRA

SEQ ID NO: 170378 - protein, 10 aa, Yellow fever virus
SLIGMTNRAT

SEQ ID NO: 170379 - protein, 10 aa, Yellow fever virus
LIGMTNRATW

SEQ ID NO: 170380 - protein, 10 aa, Yellow fever virus
IGMTNRATWA

SEQ ID NO: 170381 - protein, 10 aa, Yellow fever virus
GMTNRATWAS

SEQ ID NO: 170382 - protein, 10 aa, Yellow fever virus
MTNRATWASH

SEQ ID NO: 170383 - protein, 10 aa, Yellow fever virus
TNRATWASHI

SEQ ID NO: 170384 - protein, 10 aa, Yellow fever virus
NRATWASHIH

SEQ ID NO: 170385 - protein, 10 aa, Yellow fever virus
RATWASHIHL

SEQ ID NO: 170386 - protein, 10 aa, Yellow fever virus
ATWASHIHLV

SEQ ID NO: 170387 - protein, 10 aa, Yellow fever virus
TWASHIHLVI

SEQ ID NO: 170388 - protein, 10 aa, Yellow fever virus
WASHIHLVIH

SEQ ID NO: 170389 - protein, 10 aa, Yellow fever virus
ASHIHLVIHR

SEQ ID NO: 170390 - protein, 10 aa, Yellow fever virus
SHIHLVIHRI

SEQ ID NO: 170391 - protein, 10 aa, Yellow fever virus
HIHLVIHRIR

SEQ ID NO: 170392 - protein, 10 aa, Yellow fever virus
IHLVIHRIRT

SEQ ID NO: 170393 - protein, 10 aa, Yellow fever virus
HLVIHRIRTL

SEQ ID NO: 170394 - protein, 10 aa, Yellow fever virus
LVIHRIRTLI

SEQ ID NO: 170395 - protein, 10 aa, Yellow fever virus
VIHRIRTLIG

SEQ ID NO: 170396 - protein, 10 aa, Yellow fever virus
IHRIRTLIGQ

SEQ ID NO: 170397 - protein, 10 aa, Yellow fever virus
HRIRTLIGQE

SEQ ID NO: 170398 - protein, 10 aa, Yellow fever virus
RIRTLIGQEK

SEQ ID NO: 170399 - protein, 10 aa, Yellow fever virus
IRTLIGQEKY

SEQ ID NO: 170400 - protein, 10 aa, Yellow fever virus
RTLIGQEKYT

SEQ ID NO: 170401 - protein, 10 aa, Yellow fever virus
TLIGQEKYTD

SEQ ID NO: 170402 - protein, 10 aa, Yellow fever virus
LIGQEKYTDY

SEQ ID NO: 170403 - protein, 10 aa, Yellow fever virus
IGQEKYTDYL

SEQ ID NO: 170404 - protein, 10 aa, Yellow fever virus
GQEKYTDYLT

SEQ ID NO: 170405 - protein, 10 aa, Yellow fever virus
QEKYTDYLTV

SEQ ID NO: 170406 - protein, 10 aa, Yellow fever virus
EKYTDYLTVM

SEQ ID NO: 170407 - protein, 10 aa, Yellow fever virus
KYTDYLTVMD

SEQ ID NO: 170408 - protein, 10 aa, Yellow fever virus
YTDYLTVMDR

SEQ ID NO: 170409 - protein, 10 aa, Yellow fever virus
TDYLTVMDRY

SEQ ID NO: 170410 - protein, 10 aa, Yellow fever virus
DYLTVMDRYS

SEQ ID NO: 170411 - protein, 10 aa, Yellow fever virus
YLTVMDRYSV

SEQ ID NO: 170412 - protein, 10 aa, Yellow fever virus
LTVMDRYSVD

SEQ ID NO: 170413 - protein, 10 aa, Yellow fever virus
TVMDRYSVDA

SEQ ID NO: 170414 - protein, 10 aa, Yellow fever virus
VMDRYSVDAD

SEQ ID NO: 170415 - protein, 10 aa, Yellow fever virus
MDRYSVDADL

SEQ ID NO: 170416 - protein, 10 aa, Yellow fever virus
DRYSVDADLQ

SEQ ID NO: 170417 - protein, 10 aa, Yellow fever virus
RYSVDADLQL

SEQ ID NO: 170418 - protein, 10 aa, Yellow fever virus
YSVDADLQLG

SEQ ID NO: 170419 - protein, 10 aa, Yellow fever virus
SVDADLQLGE

SEQ ID NO: 170420 - protein, 10 aa, Yellow fever virus
VDADLQLGEL

SEQ ID NO: 170421 - protein, 10 aa, Yellow fever virus
DADLQLGELI

SEQ ID NO: 170422 - protein, 10 aa, Yellow fever virus
LGVNMVRRGA

SEQ ID NO: 170423 - protein, 10 aa, Yellow fever virus
GVNMVRRGAR

SEQ ID NO: 170424 - protein, 10 aa, Yellow fever virus
VNMVRRGARS

SEQ ID NO: 170425 - protein, 10 aa, Yellow fever virus
NMVRRGARSL

SEQ ID NO: 170426 - protein, 10 aa, Yellow fever virus
MVRRGARSLS

SEQ ID NO: 170427 - protein, 10 aa, Yellow fever virus
VRRGARSLSN

SEQ ID NO: 170428 - protein, 10 aa, Yellow fever virus
RRGARSLSNK

SEQ ID NO: 170429 - protein, 10 aa, Yellow fever virus
RGARSLSNKI

SEQ ID NO: 170430 - protein, 10 aa, Yellow fever virus
GARSLSNKIK

SEQ ID NO: 170431 - protein, 10 aa, Yellow fever virus
ARSLSNKIKQ

SEQ ID NO: 170432 - protein, 10 aa, Yellow fever virus
TKQIGNRPGL

SEQ ID NO: 170433 - protein, 10 aa, Yellow fever virus
KQIGNRPGLS

SEQ ID NO: 170434 - protein, 10 aa, Yellow fever virus
QIGNRPGLSR

SEQ ID NO: 170435 - protein, 10 aa, Yellow fever virus
IGNRPGLSRG

SEQ ID NO: 170436 - protein, 10 aa, Yellow fever virus
GNRPGLSRGV

SEQ ID NO: 170437 - protein, 10 aa, Yellow fever virus
NRPGLSRGVQ

SEQ ID NO: 170438 - protein, 10 aa, Yellow fever virus
RPGLSRGVQG

SEQ ID NO: 170439 - protein, 10 aa, Yellow fever virus
PGLSRGVQGF

SEQ ID NO: 170440 - protein, 10 aa, Yellow fever virus
GLSRGVQGFI

SEQ ID NO: 170441 - protein, 10 aa, Yellow fever virus
LSRGVQGFIF

SEQ ID NO: 170442 - protein, 10 aa, Yellow fever virus
SRGVQGFISF

SEQ ID NO: 170443 - protein, 10 aa, Yellow fever virus
RGVQGFISFF

SEQ ID NO: 170444 - protein, 10 aa, Yellow fever virus
GVQGFISFFS

SEQ ID NO: 170445 - protein, 10 aa, Yellow fever virus
VQGFISFFSF

SEQ ID NO: 170446 - protein, 10 aa, Yellow fever virus
QGFISFFSFN

SEQ ID NO: 170447 - protein, 10 aa, Yellow fever virus
GFISFFSFNI

SEQ ID NO: 170448 - protein, 10 aa, Yellow fever virus
FISFFSFNIL

SEQ ID NO: 170449 - protein, 10 aa, Yellow fever virus
ISFFSFNILT

SEQ ID NO: 170450 - protein, 10 aa, Yellow fever virus
SFFSFNILTG

SEQ ID NO: 170451 - protein, 10 aa, Yellow fever virus
FFSFNILTGK

SEQ ID NO: 170452 - protein, 10 aa, Yellow fever virus
FSFNILTGKK

SEQ ID NO: 170453 - protein, 10 aa, Yellow fever virus
LFNILTGKKL

SEQ ID NO: 170454 - protein, 10 aa, Yellow fever virus
FNILTGKKLT

SEQ ID NO: 170455 - protein, 10 aa, Yellow fever virus
NILTGKKLTT

SEQ ID NO: 170456 - protein, 10 aa, Yellow fever virus
ILTGKKLTTH

SEQ ID NO: 170457 - protein, 10 aa, Yellow fever virus
LTGKKLTTHL

SEQ ID NO: 170458 - protein, 10 aa, Yellow fever virus
TGKKLTTHLK

SEQ ID NO: 170459 - protein, 10 aa, Yellow fever virus
GKKLTTHLKR

SEQ ID NO: 170460 - protein, 10 aa, Yellow fever virus
KKLTTHLKRL

SEQ ID NO: 170461 - protein, 10 aa, Yellow fever virus
KLTTHLKRLW

SEQ ID NO: 170462 - protein, 10 aa, Yellow fever virus
LTTHLKRLWR

SEQ ID NO: 170463 - protein, 10 aa, Yellow fever virus
TTHLKRLWRM

SEQ ID NO: 170464 - protein, 10 aa, Yellow fever virus
THLKRLWRML

SEQ ID NO: 170465 - protein, 10 aa, Yellow fever virus
HLKRLWRMLD

SEQ ID NO: 170466 - protein, 10 aa, Yellow fever virus
LKRLWRMLDP

SEQ ID NO: 170467 - protein, 10 aa, Yellow fever virus
KRLWRMLDPR

SEQ ID NO: 170468 - protein, 10 aa, Yellow fever virus
RLWRMLDPRQ

SEQ ID NO: 170469 - protein, 10 aa, Yellow fever virus
LWRMLDPRQG

SEQ ID NO: 170470 - protein, 10 aa, Yellow fever virus
WRMLDPRQGL

SEQ ID NO: 170471 - protein, 10 aa, Yellow fever virus
RMLDPRQGLA

SEQ ID NO: 170472 - protein, 10 aa, Yellow fever virus
MLDPRQGLAA

SEQ ID NO: 170473 - protein, 10 aa, Yellow fever virus
LDPRQGLAAL

SEQ ID NO: 170474 - protein, 10 aa, Yellow fever virus
DPRQGLAALR

SEQ ID NO: 170475 - protein, 10 aa, Yellow fever virus
PRQGLAALRK

SEQ ID NO: 170476 - protein, 10 aa, Yellow fever virus
RQGLAALRKV

SEQ ID NO: 170477 - protein, 10 aa, Yellow fever virus
QGLAALRKVK

SEQ ID NO: 170478 - protein, 10 aa, Yellow fever virus
GLAALRKVKR

SEQ ID NO: 170479 - protein, 10 aa, Yellow fever virus
LAALRKVKRV

SEQ ID NO: 170480 - protein, 10 aa, Yellow fever virus
AALRKVKRVV

SEQ ID NO: 170481 - protein, 10 aa, Yellow fever virus
ALRKVKRVVA

SEQ ID NO: 170482 - protein, 10 aa, Yellow fever virus
LRKVKRVVAG

SEQ ID NO: 170483 - protein, 10 aa, Yellow fever virus
RKVKRVVAGL

SEQ ID NO: 170484 - protein, 10 aa, Yellow fever virus
KVKRVVAGLM

SEQ ID NO: 170485 - protein, 10 aa, Yellow fever virus
VKRVVAGLMR

SEQ ID NO: 170486 - protein, 10 aa, Yellow fever virus
KRVVAGLMRG

SEQ ID NO: 170487 - protein, 10 aa, Yellow fever virus
RVVAGLMRGL

SEQ ID NO: 170488 - protein, 10 aa, Yellow fever virus
VVAGLMRGLS

SEQ ID NO: 170489 - protein, 10 aa, Yellow fever virus
VAGLMRGLSS

SEQ ID NO: 170490 - protein, 10 aa, Yellow fever virus
AGLMRGLSSR

SEQ ID NO: 170491 - protein, 10 aa, Yellow fever virus
GLMRGLSSRK

SEQ ID NO: 170492 - protein, 10 aa, Yellow fever virus
LMIGLSSRKR

SEQ ID NO: 170493 - protein, 10 aa, Yellow fever virus
MIGLSSRKRR

SEQ ID NO: 170494 - protein, 10 aa, Yellow fever virus
IGLSSRKRRS

SEQ ID NO: 170495 - protein, 10 aa, Yellow fever virus
GLSSRKRRSN

SEQ ID NO: 170496 - protein, 10 aa, Yellow fever virus
LSSRKRRSNE

SEQ ID NO: 170497 - protein, 10 aa, Yellow fever virus
SSRKRRSNEM

SEQ ID NO: 170498 - protein, 10 aa, Yellow fever virus
SRKRRSNEMA

SEQ ID NO: 170499 - protein, 10 aa, Yellow fever virus
MMPLLILSMV

SEQ ID NO: 170500 - protein, 10 aa, Yellow fever virus
MPLLILSMVI

SEQ ID NO: 170501 - protein, 10 aa, Yellow fever virus
PLLILSMVIL

SEQ ID NO: 170502 - protein, 10 aa, Yellow fever virus
AGGVTLVRKN

SEQ ID NO: 170503 - protein, 10 aa, Yellow fever virus
GGVTLMRKNR

SEQ ID NO: 170504 - protein, 10 aa, Yellow fever virus
GVTLMRKNRW

SEQ ID NO: 170505 - protein, 10 aa, Yellow fever virus
VTLMRKNRWL

SEQ ID NO: 170506 - protein, 10 aa, Yellow fever virus
TLMRKNRWLL

SEQ ID NO: 170507 - protein, 10 aa, Yellow fever virus
LMRKNRWLLL

SEQ ID NO: 170508 - protein, 10 aa, Yellow fever virus
MRKNRWLLLN

SEQ ID NO: 170509 - protein, 10 aa, Yellow fever virus
NRWLLLNVTA

SEQ ID NO: 170510 - protein, 10 aa, Yellow fever virus
RWLLLNVTAE

SEQ ID NO: 170511 - protein, 10 aa, Yellow fever virus
WLLLNVTAED

SEQ ID NO: 170512 - protein, 10 aa, Yellow fever virus
LLLNVTAEDL

SEQ ID NO: 170513 - protein, 10 aa, Yellow fever virus
LLNVTAEDLG

SEQ ID NO: 170514 - protein, 10 aa, Yellow fever virus
LNVTAEDLGK

SEQ ID NO: 170515 - protein, 10 aa, Yellow fever virus
NVTAEDLGKT

SEQ ID NO: 170516 - protein, 10 aa, Yellow fever virus
VTAEDLGKTF

SEQ ID NO: 170517 - protein, 10 aa, Yellow fever virus
TAEDLGKTFS

SEQ ID NO: 170518 - protein, 10 aa, Yellow fever virus
AEDLGKTFSV

SEQ ID NO: 170519 - protein, 10 aa, Yellow fever virus
EDLGKTFSLG

SEQ ID NO: 170520 - protein, 10 aa, Yellow fever virus
DLGKTFSLGT

SEQ ID NO: 170521 - protein, 10 aa, Yellow fever virus
LGKTFSLGTG

SEQ ID NO: 170522 - protein, 10 aa, Yellow fever virus
GKTFSMGTGN

SEQ ID NO: 170523 - protein, 10 aa, Yellow fever virus
KTFSMGTGNC

SEQ ID NO: 170524 - protein, 10 aa, Yellow fever virus
TFSVGAGNCT

SEQ ID NO: 170525 - protein, 10 aa, Yellow fever virus
FSLGTGNCTT

SEQ ID NO: 170526 - protein, 10 aa, Yellow fever virus
SIGTGNCTTN

SEQ ID NO: 170527 - protein, 10 aa, Yellow fever virus
LGTGNCTTNI

SEQ ID NO: 170528 - protein, 10 aa, Yellow fever virus
GAGNCTTNIL

SEQ ID NO: 170529 - protein, 10 aa, Yellow fever virus
AGNCTTNILE

SEQ ID NO: 170530 - protein, 10 aa, Yellow fever virus
CYGVENVRVT

SEQ ID NO: 170531 - protein, 10 aa, Yellow fever virus
YGVENVRVTY

SEQ ID NO: 170532 - protein, 10 aa, Yellow fever virus
GVENVRVTYG

SEQ ID NO: 170533 - protein, 10 aa, Yellow fever virus
VENVRVAYGR

SEQ ID NO: 170534 - protein, 10 aa, Yellow fever virus
ENVRVAYGRC

SEQ ID NO: 170535 - protein, 10 aa, Yellow fever virus
NVRVAYGRCD

SEQ ID NO: 170536 - protein, 10 aa, Yellow fever virus
VRVAYGRCDA

SEQ ID NO: 170537 - protein, 10 aa, Yellow fever virus
RVAYGRCDAV

SEQ ID NO: 170538 - protein, 10 aa, Yellow fever virus
VAYGRCDAVG

SEQ ID NO: 170539 - protein, 10 aa, Yellow fever virus
AYGRCDAVGR

SEQ ID NO: 170540 - protein, 10 aa, Yellow fever virus
YGRCDAVGRS

SEQ ID NO: 170541 - protein, 10 aa, Yellow fever virus
GRCDAVGRSK

SEQ ID NO: 170542 - protein, 10 aa, Yellow fever virus
RCDAVGRSKR

SEQ ID NO: 170543 - protein, 10 aa, Yellow fever virus
CDAVGRSKRS

SEQ ID NO: 170544 - protein, 10 aa, Yellow fever virus
DAVGRSKRSR

SEQ ID NO: 170545 - protein, 10 aa, Yellow fever virus
AVGRSKRSRR

SEQ ID NO: 170546 - protein, 10 aa, Yellow fever virus
VGRSKRSRRA

SEQ ID NO: 170547 - protein, 10 aa, Yellow fever virus
GRSKRSRRAI

SEQ ID NO: 170548 - protein, 10 aa, Yellow fever virus
RSKRSRRAID

SEQ ID NO: 170549 - protein, 10 aa, Yellow fever virus
SKRSRRAIDL

SEQ ID NO: 170550 - protein, 10 aa, Yellow fever virus
KRSRRAIDLP

SEQ ID NO: 170551 - protein, 10 aa, Yellow fever virus
LKTRQEKWMA

SEQ ID NO: 170552 - protein, 10 aa, Yellow fever virus
KTRQEKWMAG

SEQ ID NO: 170553 - protein, 10 aa, Yellow fever virus
TRQEKWMAGR

SEQ ID NO: 170554 - protein, 10 aa, Yellow fever virus
RQEKWMAGRM

SEQ ID NO: 170555 - protein, 10 aa, Yellow fever virus
QEKWMAGRMG

SEQ ID NO: 170556 - protein, 10 aa, Yellow fever virus
EKWMAGRMGE

SEQ ID NO: 170557 - protein, 10 aa, Yellow fever virus
KWMAGRMGER

SEQ ID NO: 170558 - protein, 10 aa, Yellow fever virus
WMAGRMGERQ

SEQ ID NO: 170559 - protein, 10 aa, Yellow fever virus
MAGRMGERQL

SEQ ID NO: 170560 - protein, 10 aa, Yellow fever virus
AGRMGERQLQ

SEQ ID NO: 170561 - protein, 10 aa, Yellow fever virus
RQLQKIERWL

SEQ ID NO: 170562 - protein, 10 aa, Yellow fever virus
QLQKIERWLV

SEQ ID NO: 170563 - protein, 10 aa, Yellow fever virus
LQKIERWLVR

SEQ ID NO: 170564 - protein, 10 aa, Yellow fever virus
QKIERWLVRN

SEQ ID NO: 170565 - protein, 10 aa, Yellow fever virus
KIERWLVRNP

SEQ ID NO: 170566 - protein, 10 aa, Yellow fever virus
IERWLVRNPF

SEQ ID NO: 170567 - protein, 10 aa, Yellow fever virus
ERWLVRNPFF

SEQ ID NO: 170568 - protein, 10 aa, Yellow fever virus
RWLVRNPFFA

SEQ ID NO: 170569 - protein, 10 aa, Yellow fever virus
WLVRNPFFAV

SEQ ID NO: 170570 - protein, 10 aa, Yellow fever virus
LVRNPFFAVT

SEQ ID NO: 170571 - protein, 10 aa, Yellow fever virus
VRNPFFAITA

SEQ ID NO: 170572 - protein, 10 aa, Yellow fever virus
RNPFFAITAL

SEQ ID NO: 170573 - protein, 10 aa, Yellow fever virus
NPFFAVTALA

SEQ ID NO: 170574 - protein, 10 aa, Yellow fever virus
PFFAVTALAI

SEQ ID NO: 170575 - protein, 10 aa, Yellow fever virus
FFAVTALAIA

SEQ ID NO: 170576 - protein, 10 aa, Yellow fever virus
FAVTALAIAY

SEQ ID NO: 170577 - protein, 10 aa, Yellow fever virus
AVTALAIAYL

SEQ ID NO: 170578 - protein, 10 aa, Yellow fever virus
VTALAIAYLV

SEQ ID NO: 170579 - protein, 10 aa, Yellow fever virus
TALAIAYLVG

SEQ ID NO: 170580 - protein, 10 aa, Yellow fever virus
ALAIAYLVGN

SEQ ID NO: 170581 - protein, 10 aa, Yellow fever virus
LAIAYLVGNN

SEQ ID NO: 170582 - protein, 10 aa, Yellow fever virus
AIAYLVGNNK

SEQ ID NO: 170583 - protein, 10 aa, Yellow fever virus
IAYLVGNNTT

SEQ ID NO: 170584 - protein, 10 aa, Yellow fever virus
AYLVGNNMTQ

SEQ ID NO: 170585 - protein, 10 aa, Yellow fever virus
YLVGNNKTQR

SEQ ID NO: 170586 - protein, 10 aa, Yellow fever virus
LVGNNMTQRV

SEQ ID NO: 170587 - protein, 10 aa, Yellow fever virus
VGNNTTQRVV

SEQ ID NO: 170588 - protein, 10 aa, Yellow fever virus
GNNMTQRVVI

SEQ ID NO: 170589 - protein, 10 aa, Yellow fever virus
NNTTQRVVIA

SEQ ID NO: 170590 - protein, 10 aa, Yellow fever virus
NKTQRVVIAL

SEQ ID NO: 170591 - protein, 10 aa, Yellow fever virus
TTQRVVIALL

SEQ ID NO: 170592 - protein, 10 aa, Yellow fever virus
PAYSAHCIGV

SEQ ID NO: 170593 - protein, 10 aa, Yellow fever virus
AYSAHCIGVA

SEQ ID NO: 170594 - protein, 10 aa, Yellow fever virus
YSAHCIGVAD

SEQ ID NO: 170595 - protein, 10 aa, Yellow fever virus
SAHCIGVADR

SEQ ID NO: 170596 - protein, 10 aa, Yellow fever virus
AHCIGVADRD

SEQ ID NO: 170597 - protein, 10 aa, Yellow fever virus
HCIGVADRDF

SEQ ID NO: 170598 - protein, 10 aa, Yellow fever virus
CIGVADRDFI

SEQ ID NO: 170599 - protein, 10 aa, Yellow fever virus
IGVADRDFIE

SEQ ID NO: 170600 - protein, 10 aa, Yellow fever virus
GVADRDFIEG

SEQ ID NO: 170601 - protein, 10 aa, Yellow fever virus
VADRDFIEGV

SEQ ID NO: 170602 - protein, 10 aa, Yellow fever virus
ADRDFIEGVH

SEQ ID NO: 170603 - protein, 10 aa, Yellow fever virus
VHGGTWVSAS

SEQ ID NO: 170604 - protein, 10 aa, Yellow fever virus
HGGTWVSASL

SEQ ID NO: 170605 - protein, 10 aa, Yellow fever virus
GGTWVSASLE

SEQ ID NO: 170606 - protein, 10 aa, Yellow fever virus
GTWVSASLEQ

SEQ ID NO: 170607 - protein, 10 aa, Yellow fever virus
TWVSATLEQG

SEQ ID NO: 170608 - protein, 10 aa, Yellow fever virus
WVSASLEQDK

SEQ ID NO: 170609 - protein, 10 aa, Yellow fever virus
VSATLEQGKC

SEQ ID NO: 170610 - protein, 10 aa, Yellow fever virus
SATLEQGKCV

SEQ ID NO: 170611 - protein, 10 aa, Yellow fever virus
ATLEQGKCVT

SEQ ID NO: 170612 - protein, 10 aa, Yellow fever virus
SLEQDKCVTV

SEQ ID NO: 170613 - protein, 10 aa, Yellow fever virus
LEQGKCVTVM

SEQ ID NO: 170614 - protein, 10 aa, Yellow fever virus
EQGKCVTVMA

SEQ ID NO: 170615 - protein, 10 aa, Yellow fever virus
QGKCVTVMAP

SEQ ID NO: 170616 - protein, 10 aa, Yellow fever virus
GKCVTVMAPD

SEQ ID NO: 170617 - protein, 10 aa, Yellow fever virus
DKPSLDISLQ

SEQ ID NO: 170618 - protein, 10 aa, Yellow fever virus
KPSLDISLQT

SEQ ID NO: 170619 - protein, 10 aa, Yellow fever virus
PSLDISLQTV

SEQ ID NO: 170620 - protein, 10 aa, Yellow fever virus
SLDISLQTVA

SEQ ID NO: 170621 - protein, 10 aa, Yellow fever virus
LDISLQTVAI

SEQ ID NO: 170622 - protein, 10 aa, Yellow fever virus
DISLQTVAID

SEQ ID NO: 170623 - protein, 10 aa, Yellow fever virus
ISLETVAIDG

SEQ ID NO: 170624 - protein, 10 aa, Yellow fever virus
SLETVAIDGP

SEQ ID NO: 170625 - protein, 10 aa, Yellow fever virus
LETVAIDGPA

SEQ ID NO: 170626 - protein, 10 aa, Yellow fever virus
ETVAIDGPAE

SEQ ID NO: 170627 - protein, 10 aa, Yellow fever virus
TVAIDGPAEA

SEQ ID NO: 170628 - protein, 10 aa, Yellow fever virus
VAIDGPAEAR

SEQ ID NO: 170629 - protein, 10 aa, Yellow fever virus
AIDGPAEARK

SEQ ID NO: 170630 - protein, 10 aa, Yellow fever virus
IDGPAEARKV

SEQ ID NO: 170631 - protein, 10 aa, Yellow fever virus
DGPAEARKVC

SEQ ID NO: 170632 - protein, 10 aa, Yellow fever virus
GPAEARKVCY

SEQ ID NO: 170633 - protein, 10 aa, Yellow fever virus
PAEARKVCYN

SEQ ID NO: 170634 - protein, 10 aa, Yellow fever virus
AEARKVCYNA

SEQ ID NO: 170635 - protein, 10 aa, Yellow fever virus
EARKVCYNAV

SEQ ID NO: 170636 - protein, 10 aa, Yellow fever virus
ARKVCYNAVL

SEQ ID NO: 170637 - protein, 10 aa, Yellow fever virus
RKVCYSAVLT

SEQ ID NO: 170638 - protein, 10 aa, Yellow fever virus
KVCYSAVLTH

SEQ ID NO: 170639 - protein, 10 aa, Yellow fever virus
VCYSAVLTHV

SEQ ID NO: 170640 - protein, 10 aa, Yellow fever virus
CYSAVLTHVK

SEQ ID NO: 170641 - protein, 10 aa, Yellow fever virus
YSAVLTHVKI

SEQ ID NO: 170642 - protein, 10 aa, Yellow fever virus
SAVLTHVKIN

SEQ ID NO: 170643 - protein, 10 aa, Yellow fever virus
AVLTHVKIDD

SEQ ID NO: 170644 - protein, 10 aa, Yellow fever virus
VLTHVKIDDK

SEQ ID NO: 170645 - protein, 10 aa, Yellow fever virus
LTHVKIDDKC

SEQ ID NO: 170646 - protein, 10 aa, Yellow fever virus
THVKIDDKCP

SEQ ID NO: 170647 - protein, 10 aa, Yellow fever virus
HVKIDDKCPS

SEQ ID NO: 170648 - protein, 10 aa, Yellow fever virus
VKIDDKCPST

SEQ ID NO: 170649 - protein, 10 aa, Yellow fever virus
KIDDKCPSTG

SEQ ID NO: 170650 - protein, 10 aa, Yellow fever virus
IDDKCPSTGE

SEQ ID NO: 170651 - protein, 10 aa, Yellow fever virus
DDKCPSTGEA

SEQ ID NO: 170652 - protein, 10 aa, Yellow fever virus
GEAHLAEEND

SEQ ID NO: 170653 - protein, 10 aa, Yellow fever virus
EAHLAEENDG

SEQ ID NO: 170654 - protein, 10 aa, Yellow fever virus
AHLAEENDGD

SEQ ID NO: 170655 - protein, 10 aa, Yellow fever virus
HLAEENDGDN

SEQ ID NO: 170656 - protein, 10 aa, Yellow fever virus
LAEENDGDNA

SEQ ID NO: 170657 - protein, 10 aa, Yellow fever virus
AEENDGDNAC

SEQ ID NO: 170658 - protein, 10 aa, Yellow fever virus
EENDGDNACK

SEQ ID NO: 170659 - protein, 10 aa, Yellow fever virus
ENDGDNACKR

SEQ ID NO: 170660 - protein, 10 aa, Yellow fever virus
NDGDNACKRT

SEQ ID NO: 170661 - protein, 10 aa, Yellow fever virus
DGDNACKRTY

SEQ ID NO: 170662 - protein, 10 aa, Yellow fever virus
DQTKIQYVIK

SEQ ID NO: 170663 - protein, 10 aa, Yellow fever virus
QTKIQYVIKA

SEQ ID NO: 170664 - protein, 10 aa, Yellow fever virus
TKIQYVIRAR

SEQ ID NO: 170665 - protein, 10 aa, Yellow fever virus
KIQYVIKAQL

SEQ ID NO: 170666 - protein, 10 aa, Yellow fever virus
IQYVIRARLH

SEQ ID NO: 170667 - protein, 10 aa, Yellow fever virus
QYVIKAQLHV

SEQ ID NO: 170668 - protein, 10 aa, Yellow fever virus
YVIKAQLHVG

SEQ ID NO: 170669 - protein, 10 aa, Yellow fever virus
VIRARLHVGA

SEQ ID NO: 170670 - protein, 10 aa, Yellow fever virus
IKAQLHVGAK

SEQ ID NO: 170671 - protein, 10 aa, Yellow fever virus
KAQLHVGAKQ

SEQ ID NO: 170672 - protein, 10 aa, Yellow fever virus
ARLHVGAKQE

SEQ ID NO: 170673 - protein, 10 aa, Yellow fever virus
RLHVGAKQEN

SEQ ID NO: 170674 - protein, 10 aa, Yellow fever virus
LHVGAKQEDW

SEQ ID NO: 170675 - protein, 10 aa, Yellow fever virus
HVGAKQENWT

SEQ ID NO: 170676 - protein, 10 aa, Yellow fever virus
VGAKQENWTT

SEQ ID NO: 170677 - protein, 10 aa, Yellow fever virus
GAKQENWTTD

SEQ ID NO: 170678 - protein, 10 aa, Yellow fever virus
AKQENWTTDI

SEQ ID NO: 170679 - protein, 10 aa, Yellow fever virus
KQENWTTDIK

SEQ ID NO: 170680 - protein, 10 aa, Yellow fever virus
QENWTTDIKT

SEQ ID NO: 170681 - protein, 10 aa, Yellow fever virus
ENWTTDIKTL

SEQ ID NO: 170682 - protein, 10 aa, Yellow fever virus
NWTTDIKTLK

SEQ ID NO: 170683 - protein, 10 aa, Yellow fever virus
WTTDIKTLKF

SEQ ID NO: 170684 - protein, 10 aa, Yellow fever virus
TTDIKTLKFD

SEQ ID NO: 170685 - protein, 10 aa, Yellow fever virus
TSIKTLKFDA

SEQ ID NO: 170686 - protein, 10 aa, Yellow fever virus
SIKTLKFDAL

SEQ ID NO: 170687 - protein, 10 aa, Yellow fever virus
IKTLKFDVLS

SEQ ID NO: 170688 - protein, 10 aa, Yellow fever virus
KTLKFDVLSG

SEQ ID NO: 170689 - protein, 10 aa, Yellow fever virus
TLKFDVLSGS

SEQ ID NO: 170690 - protein, 10 aa, Yellow fever virus
LKFDVLSGSQ

SEQ ID NO: 170691 - protein, 10 aa, Yellow fever virus
KFDVLSGSQE

SEQ ID NO: 170692 - protein, 10 aa, Yellow fever virus
FDALSGSQEA

SEQ ID NO: 170693 - protein, 10 aa, Yellow fever virus
DALSGSQEAE

SEQ ID NO: 170694 - protein, 10 aa, Yellow fever virus
ALSGSQEAEF

SEQ ID NO: 170695 - protein, 10 aa, Yellow fever virus
LSGSQEAEFT

SEQ ID NO: 170696 - protein, 10 aa, Yellow fever virus
SGSQEAEFTG

SEQ ID NO: 170697 - protein, 10 aa, Yellow fever virus
GSQEAEFTGY

SEQ ID NO: 170698 - protein, 10 aa, Yellow fever virus
SQEAEFTGYG

SEQ ID NO: 170699 - protein, 10 aa, Yellow fever virus
QEAEFTGYGK

SEQ ID NO: 170700 - protein, 10 aa, Yellow fever virus
EAEFTGYGKA

SEQ ID NO: 170701 - protein, 10 aa, Yellow fever virus
AEFTGYGKAT

SEQ ID NO: 170702 - protein, 10 aa, Yellow fever virus
EFTGYGKATL

SEQ ID NO: 170703 - protein, 10 aa, Yellow fever virus
FTGYGKATLE

SEQ ID NO: 170704 - protein, 10 aa, Yellow fever virus
TGYGKATLEC

SEQ ID NO: 170705 - protein, 10 aa, Yellow fever virus
GYGKVTLECQ

SEQ ID NO: 170706 - protein, 10 aa, Yellow fever virus
YGKATLECRV

SEQ ID NO: 170707 - protein, 10 aa, Yellow fever virus
GKVTLECQVQ

SEQ ID NO: 170708 - protein, 10 aa, Yellow fever virus
KVTLECQVQT

SEQ ID NO: 170709 - protein, 10 aa, Yellow fever virus
VTLECQVQTA

SEQ ID NO: 170710 - protein, 10 aa, Yellow fever virus
TLECRVQTAV

SEQ ID NO: 170711 - protein, 10 aa, Yellow fever virus
LECRVQTAVD

SEQ ID NO: 170712 - protein, 10 aa, Yellow fever virus
ECRVQTAVDF

SEQ ID NO: 170713 - protein, 10 aa, Yellow fever virus
CRVQTAVDFG

SEQ ID NO: 170714 - protein, 10 aa, Yellow fever virus
RVQTAVDFGN

SEQ ID NO: 170715 - protein, 10 aa, Yellow fever virus
GNSYIAEMEK

SEQ ID NO: 170716 - protein, 10 aa, Yellow fever virus
NSYIAEMEKE

SEQ ID NO: 170717 - protein, 10 aa, Yellow fever virus
SYIAEMEKES

SEQ ID NO: 170718 - protein, 10 aa, Yellow fever virus
YIAEMEKESW

SEQ ID NO: 170719 - protein, 10 aa, Yellow fever virus
IAEMEKESWI

SEQ ID NO: 170720 - protein, 10 aa, Yellow fever virus
AEMEKESWIV

SEQ ID NO: 170721 - protein, 10 aa, Yellow fever virus
EMEKESWIVD

SEQ ID NO: 170722 - protein, 10 aa, Yellow fever virus
MEKESWIVDR

SEQ ID NO: 170723 - protein, 10 aa, Yellow fever virus
EKESWIVDRQ

SEQ ID NO: 170724 - protein, 10 aa, Yellow fever virus
KESWIVDRQW

SEQ ID NO: 170725 - protein, 10 aa, Yellow fever virus
DSWIVDRQWA

SEQ ID NO: 170726 - protein, 10 aa, Yellow fever virus
LPWQSGSGGI

SEQ ID NO: 170727 - protein, 10 aa, Yellow fever virus
PWQSGSGGIW

SEQ ID NO: 170728 - protein, 10 aa, Yellow fever virus
WQSGSGGIWR

SEQ ID NO: 170729 - protein, 10 aa, Yellow fever virus
QSGSGGIWRE

SEQ ID NO: 170730 - protein, 10 aa, Yellow fever virus
SGSGGIWREM

SEQ ID NO: 170731 - protein, 10 aa, Yellow fever virus
GSGGIWREMH

SEQ ID NO: 170732 - protein, 10 aa, Yellow fever virus
SGGIWREMHH

SEQ ID NO: 170733 - protein, 10 aa, Yellow fever virus
GGIWREMHHL

SEQ ID NO: 170734 - protein, 10 aa, Yellow fever virus
GIWREMHHLV

SEQ ID NO: 170735 - protein, 10 aa, Yellow fever virus
IWREMHHLVE

SEQ ID NO: 170736 - protein, 10 aa, Yellow fever virus
WRGMHHLVEF

SEQ ID NO: 170737 - protein, 10 aa, Yellow fever virus
RGMHHLVEFE

SEQ ID NO: 170738 - protein, 10 aa, Yellow fever virus
GMHHLVEFEP

SEQ ID NO: 170739 - protein, 10 aa, Yellow fever virus
LVEFEPPHAV

SEQ ID NO: 170740 - protein, 10 aa, Yellow fever virus
VEFEPPHAVT

SEQ ID NO: 170741 - protein, 10 aa, Yellow fever virus
EFEPPHAVTI

SEQ ID NO: 170742 - protein, 10 aa, Yellow fever virus
FEPPHAVTIR

SEQ ID NO: 170743 - protein, 10 aa, Yellow fever virus
EPPHAVTIRV

SEQ ID NO: 170744 - protein, 10 aa, Yellow fever virus
PPHAVTIRVL

SEQ ID NO: 170745 - protein, 10 aa, Yellow fever virus
PHAVTIRVLA

SEQ ID NO: 170746 - protein, 10 aa, Yellow fever virus
HAVTIRVLAL

SEQ ID NO: 170747 - protein, 10 aa, Yellow fever virus
AVTIRVLALG

SEQ ID NO: 170748 - protein, 10 aa, Yellow fever virus
ATIRVLALGD

SEQ ID NO: 170749 - protein, 10 aa, Yellow fever virus
TIRVLALGDQ

SEQ ID NO: 170750 - protein, 10 aa, Yellow fever virus
IRVLALGDQE

SEQ ID NO: 170751 - protein, 10 aa, Yellow fever virus
RVLALGDQEG

SEQ ID NO: 170752 - protein, 10 aa, Yellow fever virus
VLALGDQEGS

SEQ ID NO: 170753 - protein, 10 aa, Yellow fever virus
LALGDQEGSL

SEQ ID NO: 170754 - protein, 10 aa, Yellow fever virus
ALGDQEGSLK

SEQ ID NO: 170755 - protein, 10 aa, Yellow fever virus
LGDQEGSLKT

SEQ ID NO: 170756 - protein, 10 aa, Yellow fever virus
GDQEGSLKTA

SEQ ID NO: 170757 - protein, 10 aa, Yellow fever virus
DQEGSLKTAL

SEQ ID NO: 170758 - protein, 10 aa, Yellow fever virus
TGAMRVTKDE

SEQ ID NO: 170759 - protein, 10 aa, Yellow fever virus
GAMRVTKDEN

SEQ ID NO: 170760 - protein, 10 aa, Yellow fever virus
AMRVTKDEND

SEQ ID NO: 170761 - protein, 10 aa, Yellow fever virus
MRVTKDENDN

SEQ ID NO: 170762 - protein, 10 aa, Yellow fever virus
RVTKDENDNN

SEQ ID NO: 170763 - protein, 10 aa, Yellow fever virus
VTKDENDNNL

SEQ ID NO: 170764 - protein, 10 aa, Yellow fever virus
TKDENDNNLY

SEQ ID NO: 170765 - protein, 10 aa, Yellow fever virus
KDENDNNLYK

SEQ ID NO: 170766 - protein, 10 aa, Yellow fever virus
DENDNNLYKL

SEQ ID NO: 170767 - protein, 10 aa, Yellow fever virus
ENDNNLYKLH

SEQ ID NO: 170768 - protein, 10 aa, Yellow fever virus
LTLKGTSYKM

SEQ ID NO: 170769 - protein, 10 aa, Yellow fever virus
TLKGTSYKMC

SEQ ID NO: 170770 - protein, 10 aa, Yellow fever virus
LKGTSYKMCT

SEQ ID NO: 170771 - protein, 10 aa, Yellow fever virus
KGTSYKMCTD

SEQ ID NO: 170772 - protein, 10 aa, Yellow fever virus
GTSYKMCTDK

SEQ ID NO: 170773 - protein, 10 aa, Yellow fever virus
TSYKMCTDKM

SEQ ID NO: 170774 - protein, 10 aa, Yellow fever virus
SYKMCTDKMS

SEQ ID NO: 170775 - protein, 10 aa, Yellow fever virus
YKMCTDKMSF

SEQ ID NO: 170776 - protein, 10 aa, Yellow fever virus
KMCTDKMSFV

SEQ ID NO: 170777 - protein, 10 aa, Yellow fever virus
MCTDKMSFVK

SEQ ID NO: 170778 - protein, 10 aa, Yellow fever virus
CTDKMSFVKN

SEQ ID NO: 170779 - protein, 10 aa, Yellow fever virus
TDKMSFVKNP

SEQ ID NO: 170780 - protein, 10 aa, Yellow fever virus
DKMSFVKNPT

SEQ ID NO: 170781 - protein, 10 aa, Yellow fever virus
KMSFVKNPTD

SEQ ID NO: 170782 - protein, 10 aa, Yellow fever virus
MSFVKNPTDT

SEQ ID NO: 170783 - protein, 10 aa, Yellow fever virus
SFVKNPTDTG

SEQ ID NO: 170784 - protein, 10 aa, Yellow fever virus
FVKNPTDTDH

SEQ ID NO: 170785 - protein, 10 aa, Yellow fever virus
VKNPTDTDHG

SEQ ID NO: 170786 - protein, 10 aa, Yellow fever virus
KNPTDTDHGT

SEQ ID NO: 170787 - protein, 10 aa, Yellow fever virus
NPTDTDHGTV

SEQ ID NO: 170788 - protein, 10 aa, Yellow fever virus
PTDTDHGTVV

SEQ ID NO: 170789 - protein, 10 aa, Yellow fever virus
TDTDHGTVVM

SEQ ID NO: 170790 - protein, 10 aa, Yellow fever virus
DTDHGTVVMQ

SEQ ID NO: 170791 - protein, 10 aa, Yellow fever virus
TDHGTVVMQV

SEQ ID NO: 170792 - protein, 10 aa, Yellow fever virus
DHGTVVMQVK

SEQ ID NO: 170793 - protein, 10 aa, Yellow fever virus
GTVVMQVKVS

SEQ ID NO: 170794 - protein, 10 aa, Yellow fever virus
TVVMQVKVSK

SEQ ID NO: 170795 - protein, 10 aa, Yellow fever virus
VVMQVKVSKG

SEQ ID NO: 170796 - protein, 10 aa, Yellow fever virus
VMQVKVSKGA

SEQ ID NO: 170797 - protein, 10 aa, Yellow fever virus
MQVKVSKGAP

SEQ ID NO: 170798 - protein, 10 aa, Yellow fever virus
QVKVSKGAPC

SEQ ID NO: 170799 - protein, 10 aa, Yellow fever virus
VKVPKGAPCK

SEQ ID NO: 170800 - protein, 10 aa, Yellow fever virus
KVPKGAPCKI

SEQ ID NO: 170801 - protein, 10 aa, Yellow fever virus
VPKGAPCKIP

SEQ ID NO: 170802 - protein, 10 aa, Yellow fever virus
PKGAPCKIPV

SEQ ID NO: 170803 - protein, 10 aa, Yellow fever virus
KGAPCKIPVI

SEQ ID NO: 170804 - protein, 10 aa, Yellow fever virus
GAPCKIPVIV

SEQ ID NO: 170805 - protein, 10 aa, Yellow fever virus
APCKIPVIVA

SEQ ID NO: 170806 - protein, 10 aa, Yellow fever virus
PCKIPVIVAD

SEQ ID NO: 170807 - protein, 10 aa, Yellow fever virus
CKIPVIVADD

SEQ ID NO: 170808 - protein, 10 aa, Yellow fever virus
KIPVIVADDL

SEQ ID NO: 170809 - protein, 10 aa, Yellow fever virus
IVADDLTAAV

SEQ ID NO: 170810 - protein, 10 aa, Yellow fever virus
VADDLTAAVN

SEQ ID NO: 170811 - protein, 10 aa, Yellow fever virus
ADDLTAAVNK

SEQ ID NO: 170812 - protein, 10 aa, Yellow fever virus
DDLTAAVNKG

SEQ ID NO: 170813 - protein, 10 aa, Yellow fever virus
DLTAAVNKGI

SEQ ID NO: 170814 - protein, 10 aa, Yellow fever virus
LTAAVNKGIL

SEQ ID NO: 170815 - protein, 10 aa, Yellow fever virus
TAAVNKGILV

SEQ ID NO: 170816 - protein, 10 aa, Yellow fever virus
AAVNKGILVT

SEQ ID NO: 170817 - protein, 10 aa, Yellow fever virus
AVNKGILVTV

SEQ ID NO: 170818 - protein, 10 aa, Yellow fever virus
VNKGILVTVN

SEQ ID NO: 170819 - protein, 10 aa, Yellow fever virus
PPFGDSYIII

SEQ ID NO: 170820 - protein, 10 aa, Yellow fever virus
PFGDSYIIIG

SEQ ID NO: 170821 - protein, 10 aa, Yellow fever virus
FGDSYIIVGT

SEQ ID NO: 170822 - protein, 10 aa, Yellow fever virus
GDSYIIVGTG

SEQ ID NO: 170823 - protein, 10 aa, Yellow fever virus
DSYIIVGTGD

SEQ ID NO: 170824 - protein, 10 aa, Yellow fever virus
SYIIVGTGDS

SEQ ID NO: 170825 - protein, 10 aa, Yellow fever virus
YIIVGTGDSR

SEQ ID NO: 170826 - protein, 10 aa, Yellow fever virus
IIVGTGDSRL

SEQ ID NO: 170827 - protein, 10 aa, Yellow fever virus
IVGTGDSRLT

SEQ ID NO: 170828 - protein, 10 aa, Yellow fever virus
VGTGDSRLTY

SEQ ID NO: 170829 - protein, 10 aa, Yellow fever virus
GTGDSRLTYQ

SEQ ID NO: 170830 - protein, 10 aa, Yellow fever virus
TGDSRLTYQW

SEQ ID NO: 170831 - protein, 10 aa, Yellow fever virus
KLFTQTMKGA

SEQ ID NO: 170832 - protein, 10 aa, Yellow fever virus
LFTQTMKGAE

SEQ ID NO: 170833 - protein, 10 aa, Yellow fever virus
FTQTMKGAER

SEQ ID NO: 170834 - protein, 10 aa, Yellow fever virus
TQTMKGAERL

SEQ ID NO: 170835 - protein, 10 aa, Yellow fever virus
QTMKGAERLA

SEQ ID NO: 170836 - protein, 10 aa, Yellow fever virus
TMKGAERLAV

SEQ ID NO: 170837 - protein, 10 aa, Yellow fever virus
MKGAERLAVM

SEQ ID NO: 170838 - protein, 10 aa, Yellow fever virus
KGAERLAVMG

SEQ ID NO: 170839 - protein, 10 aa, Yellow fever virus
GAERLAVMGD

SEQ ID NO: 170840 - protein, 10 aa, Yellow fever virus
AERLAVMGDA

SEQ ID NO: 170841 - protein, 10 aa, Yellow fever virus
ERLAVMGDAA

SEQ ID NO: 170842 - protein, 10 aa, Yellow fever virus
RLAVMGDAAW

SEQ ID NO: 170843 - protein, 10 aa, Yellow fever virus
LAVMGDAAWD

SEQ ID NO: 170844 - protein, 10 aa, Yellow fever virus
AVMGDAAWDF

SEQ ID NO: 170845 - protein, 10 aa, Yellow fever virus
VMGDAAWDFS

SEQ ID NO: 170846 - protein, 10 aa, Yellow fever virus
MGDAAWDFSS

SEQ ID NO: 170847 - protein, 10 aa, Yellow fever virus
GDAAWDFSSA

SEQ ID NO: 170848 - protein, 10 aa, Yellow fever virus
DAAWDFSSAG

SEQ ID NO: 170849 - protein, 10 aa, Yellow fever virus
AAWDFSSAGG

SEQ ID NO: 170850 - protein, 10 aa, Yellow fever virus
AWDFSSAGGL

SEQ ID NO: 170851 - protein, 10 aa, Yellow fever virus
WDFSSAGGLF

SEQ ID NO: 170852 - protein, 10 aa, Yellow fever virus
DFSSAGGLFT

SEQ ID NO: 170853 - protein, 10 aa, Yellow fever virus
FSSAGGLFTS

SEQ ID NO: 170854 - protein, 10 aa, Yellow fever virus
SSAGGFLTSV

SEQ ID NO: 170855 - protein, 10 aa, Yellow fever virus
SAGGLFTSIG

SEQ ID NO: 170856 - protein, 10 aa, Yellow fever virus
AGGFLTSVGK

SEQ ID NO: 170857 - protein, 10 aa, Yellow fever virus
GGLFTSIGKG

SEQ ID NO: 170858 - protein, 10 aa, Yellow fever virus
GFLTSVGKGI

SEQ ID NO: 170859 - protein, 10 aa, Yellow fever virus
LFTSIGKGSH

SEQ ID NO: 170860 - protein, 10 aa, Yellow fever virus
FTSIGKGSHT

SEQ ID NO: 170861 - protein, 10 aa, Yellow fever virus
TSIGKGSHTV

SEQ ID NO: 170862 - protein, 10 aa, Yellow fever virus
SIGKGSHTVF

SEQ ID NO: 170863 - protein, 10 aa, Yellow fever virus
IGKGSHTVFG

SEQ ID NO: 170864 - protein, 10 aa, Yellow fever virus
GKGSHTVFGS

SEQ ID NO: 170865 - protein, 10 aa, Yellow fever virus
KGSHTVFGSA

SEQ ID NO: 170866 - protein, 10 aa, Yellow fever virus
GSHTVFGSAF

SEQ ID NO: 170867 - protein, 10 aa, Yellow fever virus
SHTVFGSAFQ

SEQ ID NO: 170868 - protein, 10 aa, Yellow fever virus
AFQGLFGGLS

SEQ ID NO: 170869 - protein, 10 aa, Yellow fever virus
FQGLFGGLSW

SEQ ID NO: 170870 - protein, 10 aa, Yellow fever virus
QGLFGGLSWI

SEQ ID NO: 170871 - protein, 10 aa, Yellow fever virus
GLFGGLSWIT

SEQ ID NO: 170872 - protein, 10 aa, Yellow fever virus
LFGGLSWITK

SEQ ID NO: 170873 - protein, 10 aa, Yellow fever virus
FGGLSWITKV

SEQ ID NO: 170874 - protein, 10 aa, Yellow fever virus
GGLSWITKVI

SEQ ID NO: 170875 - protein, 10 aa, Yellow fever virus
GLSWITKVIM

SEQ ID NO: 170876 - protein, 10 aa, Yellow fever virus
LSWITKVIMG

SEQ ID NO: 170877 - protein, 10 aa, Yellow fever virus
SWITKVIMGA

SEQ ID NO: 170878 - protein, 10 aa, Yellow fever virus
WITKVIMGVV

SEQ ID NO: 170879 - protein, 10 aa, Yellow fever virus
ITKVIIGAVL

SEQ ID NO: 170880 - protein, 10 aa, Yellow fever virus
TKVIIGAVLI

SEQ ID NO: 170881 - protein, 10 aa, Yellow fever virus
KVIMGVVLIW

SEQ ID NO: 170882 - protein, 10 aa, Yellow fever virus
VIMGVVLIWV

SEQ ID NO: 170883 - protein, 10 aa, Yellow fever virus
IMGVVLIWVG

SEQ ID NO: 170884 - protein, 10 aa, Yellow fever virus
MGVVLIWVGI

SEQ ID NO: 170885 - protein, 10 aa, Yellow fever virus
GAVLIWVGFN

SEQ ID NO: 170886 - protein, 10 aa, Yellow fever virus
AVLIWVGFNT

SEQ ID NO: 170887 - protein, 10 aa, Yellow fever virus
VLIWVGFNTR

SEQ ID NO: 170888 - protein, 10 aa, Yellow fever virus
LIWVGFNTRN

SEQ ID NO: 170889 - protein, 10 aa, Yellow fever virus
IWVGFNTRNM

SEQ ID NO: 170890 - protein, 10 aa, Yellow fever virus
WVGFNTRNMT

SEQ ID NO: 170891 - protein, 10 aa, Yellow fever virus
VGFNTRNMTM

SEQ ID NO: 170892 - protein, 10 aa, Yellow fever virus
GFNTRNMTMS

SEQ ID NO: 170893 - protein, 10 aa, Yellow fever virus
FNTRNMTMSM

SEQ ID NO: 170894 - protein, 10 aa, Yellow fever virus
NMTMSMSMIM

SEQ ID NO: 170895 - protein, 10 aa, Yellow fever virus
MTMSMSMIMV

SEQ ID NO: 170896 - protein, 10 aa, Yellow fever virus
TMSMSMIMVG

SEQ ID NO: 170897 - protein, 10 aa, Yellow fever virus
MSMSMIMVGV

SEQ ID NO: 170898 - protein, 10 aa, Yellow fever virus
SMSMIMVGVI

SEQ ID NO: 170899 - protein, 10 aa, Yellow fever virus
MSMIMVGVIM

SEQ ID NO: 170900 - protein, 10 aa, Yellow fever virus
SMIMVGVIMM

SEQ ID NO: 170901 - protein, 10 aa, Yellow fever virus
MIMVGVIMMF

SEQ ID NO: 170902 - protein, 10 aa, Yellow fever virus
IMVGVIMMFL

SEQ ID NO: 170903 - protein, 10 aa, Yellow fever virus
MVGVIMMFLS

SEQ ID NO: 170904 - protein, 10 aa, Yellow fever virus
GVGADQGCAV

SEQ ID NO: 170905 - protein, 10 aa, Yellow fever virus
VGADQGCAVN

SEQ ID NO: 170906 - protein, 10 aa, Yellow fever virus
GADQGCAVNF

SEQ ID NO: 170907 - protein, 10 aa, Yellow fever virus
ADQGCAVNFG

SEQ ID NO: 170908 - protein, 10 aa, Yellow fever virus
DQGCAVNFGK

SEQ ID NO: 170909 - protein, 10 aa, Yellow fever virus
QGCAVNFGKR

SEQ ID NO: 170910 - protein, 10 aa, Yellow fever virus
GCAVNFGKRE

SEQ ID NO: 170911 - protein, 10 aa, Yellow fever virus
CAVNFGKREL

SEQ ID NO: 170912 - protein, 10 aa, Yellow fever virus
AVNFGKRELK

SEQ ID NO: 170913 - protein, 10 aa, Yellow fever virus
VNFGKRELKC

SEQ ID NO: 170914 - protein, 10 aa, Yellow fever virus
NFAKRELKCG

SEQ ID NO: 170915 - protein, 10 aa, Yellow fever virus
FAKRELKCGD

SEQ ID NO: 170916 - protein, 10 aa, Yellow fever virus
AKRELKCGDG

SEQ ID NO: 170917 - protein, 10 aa, Yellow fever virus
ELKCGDGIFV

SEQ ID NO: 170918 - protein, 10 aa, Yellow fever virus
LKCGDGIFVF

SEQ ID NO: 170919 - protein, 10 aa, Yellow fever virus
KCGDGIFVFR

SEQ ID NO: 170920 - protein, 10 aa, Yellow fever virus
CGDGIFVFRD

SEQ ID NO: 170921 - protein, 10 aa, Yellow fever virus
GDGIFVFRDS

SEQ ID NO: 170922 - protein, 10 aa, Yellow fever virus
DGIFVFRDSD

SEQ ID NO: 170923 - protein, 10 aa, Yellow fever virus
GIFVFRDSDD

SEQ ID NO: 170924 - protein, 10 aa, Yellow fever virus
IFVFRDSDDW

SEQ ID NO: 170925 - protein, 10 aa, Yellow fever virus
FVFRDSDDWL

SEQ ID NO: 170926 - protein, 10 aa, Yellow fever virus
VFRDSDDWLT

SEQ ID NO: 170927 - protein, 10 aa, Yellow fever virus
FRDSDDWLTK

SEQ ID NO: 170928 - protein, 10 aa, Yellow fever virus
RDSDDWLTKY

SEQ ID NO: 170929 - protein, 10 aa, Yellow fever virus
DSDDWLTKYS

SEQ ID NO: 170930 - protein, 10 aa, Yellow fever virus
SDDWLTKYSY

SEQ ID NO: 170931 - protein, 10 aa, Yellow fever virus
DDWLTKYSYY

SEQ ID NO: 170932 - protein, 10 aa, Yellow fever virus
DWLTKYSYYP

SEQ ID NO: 170933 - protein, 10 aa, Yellow fever virus
WLTKYSYYPE

SEQ ID NO: 170934 - protein, 10 aa, Yellow fever virus
LTKYSYYPED

SEQ ID NO: 170935 - protein, 10 aa, Yellow fever virus
TKYSYYPEDP

SEQ ID NO: 170936 - protein, 10 aa, Yellow fever virus
EDPVKLASII

SEQ ID NO: 170937 - protein, 10 aa, Yellow fever virus
DPVKLASIIK

SEQ ID NO: 170938 - protein, 10 aa, Yellow fever virus
PVKLASIIKA

SEQ ID NO: 170939 - protein, 10 aa, Yellow fever virus
VKLASIIKAS

SEQ ID NO: 170940 - protein, 10 aa, Yellow fever virus
KLASIIKASH

SEQ ID NO: 170941 - protein, 10 aa, Yellow fever virus
LASIIKASHE

SEQ ID NO: 170942 - protein, 10 aa, Yellow fever virus
ASIIKASHEE

SEQ ID NO: 170943 - protein, 10 aa, Yellow fever virus
SIIKASHEEG

SEQ ID NO: 170944 - protein, 10 aa, Yellow fever virus
IIKASHEEGK

SEQ ID NO: 170945 - protein, 10 aa, Yellow fever virus
IKASHEEGKC

SEQ ID NO: 170946 - protein, 10 aa, Yellow fever virus
KASHEEGKCG

SEQ ID NO: 170947 - protein, 10 aa, Yellow fever virus
ASHEEGKCGL

SEQ ID NO: 170948 - protein, 10 aa, Yellow fever virus
SHEEGKCGLN

SEQ ID NO: 170949 - protein, 10 aa, Yellow fever virus
HEEGKCGLNS

SEQ ID NO: 170950 - protein, 10 aa, Yellow fever virus
CGLNSVDSLD

SEQ ID NO: 170951 - protein, 10 aa, Yellow fever virus
GLNSVDSLDH

SEQ ID NO: 170952 - protein, 10 aa, Yellow fever virus
LNSVDSLDHE

SEQ ID NO: 170953 - protein, 10 aa, Yellow fever virus
NSVDSLDHEM

SEQ ID NO: 170954 - protein, 10 aa, Yellow fever virus
SVDSLDHEMW

SEQ ID NO: 170955 - protein, 10 aa, Yellow fever virus
VDSLDHEMWR

SEQ ID NO: 170956 - protein, 10 aa, Yellow fever virus
DSLDHEMWRS

SEQ ID NO: 170957 - protein, 10 aa, Yellow fever virus
SLDHEMWRSR

SEQ ID NO: 170958 - protein, 10 aa, Yellow fever virus
LDHEMWRSRA

SEQ ID NO: 170959 - protein, 10 aa, Yellow fever virus
DHEMWRSRAD

SEQ ID NO: 170960 - protein, 10 aa, Yellow fever virus
SRADEINAIL

SEQ ID NO: 170961 - protein, 10 aa, Yellow fever virus
RADEINAILE

SEQ ID NO: 170962 - protein, 10 aa, Yellow fever virus
ADEINAILEE

SEQ ID NO: 170963 - protein, 10 aa, Yellow fever virus
DEINAILEEN

SEQ ID NO: 170964 - protein, 10 aa, Yellow fever virus
EINAILEENE

SEQ ID NO: 170965 - protein, 10 aa, Yellow fever virus
INAILEENEV

SEQ ID NO: 170966 - protein, 10 aa, Yellow fever virus
NAILEENEVD

SEQ ID NO: 170967 - protein, 10 aa, Yellow fever virus
AILEENEVDI

SEQ ID NO: 170968 - protein, 10 aa, Yellow fever virus
ILEENEVDIS

SEQ ID NO: 170969 - protein, 10 aa, Yellow fever virus
LEENEVDISV

SEQ ID NO: 170970 - protein, 10 aa, Yellow fever virus
EENEVDISIV

SEQ ID NO: 170971 - protein, 10 aa, Yellow fever virus
ENEVDISIVV

SEQ ID NO: 170972 - protein, 10 aa, Yellow fever virus
NEVDISIVVQ

SEQ ID NO: 170973 - protein, 10 aa, Yellow fever virus
EVDISIVVQD

SEQ ID NO: 170974 - protein, 10 aa, Yellow fever virus
VDISIVVQDP

SEQ ID NO: 170975 - protein, 10 aa, Yellow fever virus
DISIVVQDPK

SEQ ID NO: 170976 - protein, 10 aa, Yellow fever virus
ISIVVQDPKN

SEQ ID NO: 170977 - protein, 10 aa, Yellow fever virus
SVVVQDPKNI

SEQ ID NO: 170978 - protein, 10 aa, Yellow fever virus
VVVQDPKNIY

SEQ ID NO: 170979 - protein, 10 aa, Yellow fever virus
VVQDPKNIYQ

SEQ ID NO: 170980 - protein, 10 aa, Yellow fever virus
VQDPKNIYQR

SEQ ID NO: 170981 - protein, 10 aa, Yellow fever virus
QDPKNIYQRG

SEQ ID NO: 170982 - protein, 10 aa, Yellow fever virus
DPKNIYQRGT

SEQ ID NO: 170983 - protein, 10 aa, Yellow fever virus
PKNIYQRGTH

SEQ ID NO: 170984 - protein, 10 aa, Yellow fever virus
KNIYQRGTHP

SEQ ID NO: 170985 - protein, 10 aa, Yellow fever virus
NIYQRGTHPF

SEQ ID NO: 170986 - protein, 10 aa, Yellow fever virus
IYQRGTHPFS

SEQ ID NO: 170987 - protein, 10 aa, Yellow fever virus
QYGWKTWGKS

SEQ ID NO: 170988 - protein, 10 aa, Yellow fever virus
YGWKTWGKSL

SEQ ID NO: 170989 - protein, 10 aa, Yellow fever virus
GWKTWGKNLI

SEQ ID NO: 170990 - protein, 10 aa, Yellow fever virus
WKTWGKNLIF

SEQ ID NO: 170991 - protein, 10 aa, Yellow fever virus
KTWGKNLIFS

SEQ ID NO: 170992 - protein, 10 aa, Yellow fever virus
TWGKNLIFSP

SEQ ID NO: 170993 - protein, 10 aa, Yellow fever virus
WGKNLIFSPG

SEQ ID NO: 170994 - protein, 10 aa, Yellow fever virus
GKNLIFSPGR

SEQ ID NO: 170995 - protein, 10 aa, Yellow fever virus
KNLIFSPGRK

SEQ ID NO: 170996 - protein, 10 aa, Yellow fever virus
NLIFSPGRKN

SEQ ID NO: 170997 - protein, 10 aa, Yellow fever virus
LIFSPGRKNG

SEQ ID NO: 170998 - protein, 10 aa, Yellow fever virus
IFSPGRKNGS

SEQ ID NO: 170999 - protein, 10 aa, Yellow fever virus
NSFQIEEFGM

SEQ ID NO: 171000 - protein, 10 aa, Yellow fever virus
SFQIEEFGMG

SEQ ID NO: 171001 - protein, 10 aa, Yellow fever virus
FQIEEFGMGV

SEQ ID NO: 171002 - protein, 10 aa, Yellow fever virus
QIEEFGMGVF

SEQ ID NO: 171003 - protein, 10 aa, Yellow fever virus
IEEFGMGVFT

SEQ ID NO: 171004 - protein, 10 aa, Yellow fever virus
EEFGMGVFTT

SEQ ID NO: 171005 - protein, 10 aa, Yellow fever virus
EFGMGVFTTR

SEQ ID NO: 171006 - protein, 10 aa, Yellow fever virus
FGMGVFTTRV

SEQ ID NO: 171007 - protein, 10 aa, Yellow fever virus
GMGVFTTRVF

SEQ ID NO: 171008 - protein, 10 aa, Yellow fever virus
MGVFTTRVFM

SEQ ID NO: 171009 - protein, 10 aa, Yellow fever virus
GVFTTRVFMD

SEQ ID NO: 171010 - protein, 10 aa, Yellow fever virus
VFTTRVFMDA

SEQ ID NO: 171011 - protein, 10 aa, Yellow fever virus
FTTRVFMDAV

SEQ ID NO: 171012 - protein, 10 aa, Yellow fever virus
TTRVFMDAVF

SEQ ID NO: 171013 - protein, 10 aa, Yellow fever virus
TRVFMDAVFD

SEQ ID NO: 171014 - protein, 10 aa, Yellow fever virus
RVFMDAVFDY

SEQ ID NO: 171015 - protein, 10 aa, Yellow fever virus
VFMDAVFDYS

SEQ ID NO: 171016 - protein, 10 aa, Yellow fever virus
FMDAVFDYSV

SEQ ID NO: 171017 - protein, 10 aa, Yellow fever virus
MDAVFDYSVD

SEQ ID NO: 171018 - protein, 10 aa, Yellow fever virus
DAVFDYSVDC

SEQ ID NO: 171019 - protein, 10 aa, Yellow fever virus
AVFDYSVDCD

SEQ ID NO: 171020 - protein, 10 aa, Yellow fever virus
VFDYSVDCDG

SEQ ID NO: 171021 - protein, 10 aa, Yellow fever virus
FDYSVDCDGA

SEQ ID NO: 171022 - protein, 10 aa, Yellow fever virus
DYSVDCDGAI

SEQ ID NO: 171023 - protein, 10 aa, Yellow fever virus
YSVDCDGAIL

SEQ ID NO: 171024 - protein, 10 aa, Yellow fever virus
SVDCDGAILG

SEQ ID NO: 171025 - protein, 10 aa, Yellow fever virus
VDCDGAILGA

SEQ ID NO: 171026 - protein, 10 aa, Yellow fever virus
DCDGAILGAA

SEQ ID NO: 171027 - protein, 10 aa, Yellow fever virus
CDGAILGAAV

SEQ ID NO: 171028 - protein, 10 aa, Yellow fever virus
DGAILGAAVN

SEQ ID NO: 171029 - protein, 10 aa, Yellow fever virus
GAILGAAVNG

SEQ ID NO: 171030 - protein, 10 aa, Yellow fever virus
AILGAAVNGK

SEQ ID NO: 171031 - protein, 10 aa, Yellow fever virus
SHEVNGTWMV

SEQ ID NO: 171032 - protein, 10 aa, Yellow fever virus
HEVNGTWMMH

SEQ ID NO: 171033 - protein, 10 aa, Yellow fever virus
EVNGTWMVHT

SEQ ID NO: 171034 - protein, 10 aa, Yellow fever virus
VNGTWMVHTL

SEQ ID NO: 171035 - protein, 10 aa, Yellow fever virus
NGTWMMHTLE

SEQ ID NO: 171036 - protein, 10 aa, Yellow fever virus
GTWMIHTLET

SEQ ID NO: 171037 - protein, 10 aa, Yellow fever virus
TWMIHTLETL

SEQ ID NO: 171038 - protein, 10 aa, Yellow fever virus
WMIHTLETLD

SEQ ID NO: 171039 - protein, 10 aa, Yellow fever virus
MIHTLETLDY

SEQ ID NO: 171040 - protein, 10 aa, Yellow fever virus
IHTLETLDYK

SEQ ID NO: 171041 - protein, 10 aa, Yellow fever virus
HTLETLDYKE

SEQ ID NO: 171042 - protein, 10 aa, Yellow fever virus
TLETLDYKEC

SEQ ID NO: 171043 - protein, 10 aa, Yellow fever virus
LETLDYKECE

SEQ ID NO: 171044 - protein, 10 aa, Yellow fever virus
ETLDYKECEW

SEQ ID NO: 171045 - protein, 10 aa, Yellow fever virus
TLDYKECEWP

SEQ ID NO: 171046 - protein, 10 aa, Yellow fever virus
LDYKECEWPP

SEQ ID NO: 171047 - protein, 10 aa, Yellow fever virus
DYKECEWPPT

SEQ ID NO: 171048 - protein, 10 aa, Yellow fever virus
YKECEWPPTH

SEQ ID NO: 171049 - protein, 10 aa, Yellow fever virus
KECEWPPTHT

SEQ ID NO: 171050 - protein, 10 aa, Yellow fever virus
ECEWPPTHTI

SEQ ID NO: 171051 - protein, 10 aa, Yellow fever virus
CEWPPTHTIG

SEQ ID NO: 171052 - protein, 10 aa, Yellow fever virus
EWPPTHTIGT

SEQ ID NO: 171053 - protein, 10 aa, Yellow fever virus
WPPTHTIGTS

SEQ ID NO: 171054 - protein, 10 aa, Yellow fever virus
PPTHTIGTSV

SEQ ID NO: 171055 - protein, 10 aa, Yellow fever virus
PTHTIGTSVE

SEQ ID NO: 171056 - protein, 10 aa, Yellow fever virus
TIGTSVEESD

SEQ ID NO: 171057 - protein, 10 aa, Yellow fever virus
IGTSVEESDM

SEQ ID NO: 171058 - protein, 10 aa, Yellow fever virus
GTSVEESDMF

SEQ ID NO: 171059 - protein, 10 aa, Yellow fever virus
TSVEESDMFM

SEQ ID NO: 171060 - protein, 10 aa, Yellow fever virus
SVEESDMFMP

SEQ ID NO: 171061 - protein, 10 aa, Yellow fever virus
VEESDMFMPR

SEQ ID NO: 171062 - protein, 10 aa, Yellow fever virus
EESDMFMPRS

SEQ ID NO: 171063 - protein, 10 aa, Yellow fever virus
ESDMFMPRSI

SEQ ID NO: 171064 - protein, 10 aa, Yellow fever virus
SDMFMPRSIG

SEQ ID NO: 171065 - protein, 10 aa, Yellow fever virus
DMFMPRSIGG

SEQ ID NO: 171066 - protein, 10 aa, Yellow fever virus
IGGPVSSHNR

SEQ ID NO: 171067 - protein, 10 aa, Yellow fever virus
GGPVSSHNRI

SEQ ID NO: 171068 - protein, 10 aa, Yellow fever virus
GPVSSHNRIP

SEQ ID NO: 171069 - protein, 10 aa, Yellow fever virus
PVSSHNRIPG

SEQ ID NO: 171070 - protein, 10 aa, Yellow fever virus
VSSHNRIPGY

SEQ ID NO: 171071 - protein, 10 aa, Yellow fever virus
SSHNRIPGYK

SEQ ID NO: 171072 - protein, 10 aa, Yellow fever virus
SHNRIPGYKV

SEQ ID NO: 171073 - protein, 10 aa, Yellow fever virus
HNRIPGYKVQ

SEQ ID NO: 171074 - protein, 10 aa, Yellow fever virus
NRIPGYKVQT

SEQ ID NO: 171075 - protein, 10 aa, Yellow fever virus
RIPGYKVQTN

SEQ ID NO: 171076 - protein, 10 aa, Yellow fever virus
PWMQVPLEVR

SEQ ID NO: 171077 - protein, 10 aa, Yellow fever virus
WMQVPLEVRR

SEQ ID NO: 171078 - protein, 10 aa, Yellow fever virus
MQVPLEVRRE

SEQ ID NO: 171079 - protein, 10 aa, Yellow fever virus
QVPLEVRREP

SEQ ID NO: 171080 - protein, 10 aa, Yellow fever virus
VPLEVRREPC

SEQ ID NO: 171081 - protein, 10 aa, Yellow fever virus
PLEVRREACP

SEQ ID NO: 171082 - protein, 10 aa, Yellow fever virus
LEVRREACPG

SEQ ID NO: 171083 - protein, 10 aa, Yellow fever virus
EVRREPCPGT

SEQ ID NO: 171084 - protein, 10 aa, Yellow fever virus
VRREPCPGTS

SEQ ID NO: 171085 - protein, 10 aa, Yellow fever virus
RREPCPGTSV

SEQ ID NO: 171086 - protein, 10 aa, Yellow fever virus
REPCPGTSVV

SEQ ID NO: 171087 - protein, 10 aa, Yellow fever virus
EPCPGTSVVL

SEQ ID NO: 171088 - protein, 10 aa, Yellow fever virus
PCPGTSVVLD

SEQ ID NO: 171089 - protein, 10 aa, Yellow fever virus
CPGTSVVVDS

SEQ ID NO: 171090 - protein, 10 aa, Yellow fever virus
PGTSVVVDTS

SEQ ID NO: 171091 - protein, 10 aa, Yellow fever virus
GTSVVLDTGC

SEQ ID NO: 171092 - protein, 10 aa, Yellow fever virus
TSVVVDTSCD

SEQ ID NO: 171093 - protein, 10 aa, Yellow fever virus
SVVLDTGCDG

SEQ ID NO: 171094 - protein, 10 aa, Yellow fever virus
VVVDSNCDGR

SEQ ID NO: 171095 - protein, 10 aa, Yellow fever virus
VLDTGCDGRG

SEQ ID NO: 171096 - protein, 10 aa, Yellow fever virus
LDTGCDGRGK

SEQ ID NO: 171097 - protein, 10 aa, Yellow fever virus
DSNCDGRGKS

SEQ ID NO: 171098 - protein, 10 aa, Yellow fever virus
SNCDGRGKST

SEQ ID NO: 171099 - protein, 10 aa, Yellow fever virus
GCDGRGKSTR

SEQ ID NO: 171100 - protein, 10 aa, Yellow fever virus
CDGRGKSARS

SEQ ID NO: 171101 - protein, 10 aa, Yellow fever virus
DGRGKSARST

SEQ ID NO: 171102 - protein, 10 aa, Yellow fever virus
GRGKSARSTT

SEQ ID NO: 171103 - protein, 10 aa, Yellow fever virus
RGKSARSTTD

SEQ ID NO: 171104 - protein, 10 aa, Yellow fever virus
GKSARSTTDS

SEQ ID NO: 171105 - protein, 10 aa, Yellow fever virus
KSARSTTDSG

SEQ ID NO: 171106 - protein, 10 aa, Yellow fever virus
SARSTTDSGK

SEQ ID NO: 171107 - protein, 10 aa, Yellow fever virus
TRSTTDSGKI

SEQ ID NO: 171108 - protein, 10 aa, Yellow fever virus
RSTTDSGKII

SEQ ID NO: 171109 - protein, 10 aa, Yellow fever virus
STTDSGKIIP

SEQ ID NO: 171110 - protein, 10 aa, Yellow fever virus
TTDSGKIIPE

SEQ ID NO: 171111 - protein, 10 aa, Yellow fever virus
TDSGKIIPEW

SEQ ID NO: 171112 - protein, 10 aa, Yellow fever virus
DSGKIIPEWC

SEQ ID NO: 171113 - protein, 10 aa, Yellow fever virus
SGKIIPEWCC

SEQ ID NO: 171114 - protein, 10 aa, Yellow fever virus
GKIIPEWCCR

SEQ ID NO: 171115 - protein, 10 aa, Yellow fever virus
KIIPEWCCRS

SEQ ID NO: 171116 - protein, 10 aa, Yellow fever virus
IIPEWCCRSC

SEQ ID NO: 171117 - protein, 10 aa, Yellow fever virus
TMPPVSFHGN

SEQ ID NO: 171118 - protein, 10 aa, Yellow fever virus
MPPVSFHGND

SEQ ID NO: 171119 - protein, 10 aa, Yellow fever virus
PPVSFHGNDG

SEQ ID NO: 171120 - protein, 10 aa, Yellow fever virus
PVSFHGNDGC

SEQ ID NO: 171121 - protein, 10 aa, Yellow fever virus
VSFHGNDGCW

SEQ ID NO: 171122 - protein, 10 aa, Yellow fever virus
SFHGNDGCWY

SEQ ID NO: 171123 - protein, 10 aa, Yellow fever virus
FHGNDGCWYP

SEQ ID NO: 171124 - protein, 10 aa, Yellow fever virus
HGNDGCWYPM

SEQ ID NO: 171125 - protein, 10 aa, Yellow fever virus
GNDGCWYPME

SEQ ID NO: 171126 - protein, 10 aa, Yellow fever virus
NDGCWYPMEI

SEQ ID NO: 171127 - protein, 10 aa, Yellow fever virus
CWYPMEIRPM

SEQ ID NO: 171128 - protein, 10 aa, Yellow fever virus
WYPMEIRPMK

SEQ ID NO: 171129 - protein, 10 aa, Yellow fever virus
YPMEIRPMKT

SEQ ID NO: 171130 - protein, 10 aa, Yellow fever virus
PMEIRPMKTH

SEQ ID NO: 171131 - protein, 10 aa, Yellow fever virus
MEIRPMKTHE

SEQ ID NO: 171132 - protein, 10 aa, Yellow fever virus
EIRPMKTHES

SEQ ID NO: 171133 - protein, 10 aa, Yellow fever virus
IRPMKTHESH

SEQ ID NO: 171134 - protein, 10 aa, Yellow fever virus
RPMKTHESHL

SEQ ID NO: 171135 - protein, 10 aa, Yellow fever virus
PMKTHESHLV

SEQ ID NO: 171136 - protein, 10 aa, Yellow fever virus
MKTHESHLVR

SEQ ID NO: 171137 - protein, 10 aa, Yellow fever virus
KAHESHLVRS

SEQ ID NO: 171138 - protein, 10 aa, Yellow fever virus
AHESHLVRSW

SEQ ID NO: 171139 - protein, 10 aa, Yellow fever virus
SDSHLVRSWV

SEQ ID NO: 171140 - protein, 10 aa, Yellow fever virus
DSHLVRSWVT

SEQ ID NO: 171141 - protein, 10 aa, Yellow fever virus
VRSWVTAGEV

SEQ ID NO: 171142 - protein, 10 aa, Yellow fever virus
RSWVTAGEVH

SEQ ID NO: 171143 - protein, 10 aa, Yellow fever virus
SWVTAGEVHA

SEQ ID NO: 171144 - protein, 10 aa, Yellow fever virus
WVTAGEVHAV

SEQ ID NO: 171145 - protein, 10 aa, Yellow fever virus
VTAGEVHAVP

SEQ ID NO: 171146 - protein, 10 aa, Yellow fever virus
TAGEVHAVPF

SEQ ID NO: 171147 - protein, 10 aa, Yellow fever virus
AGEVHAVPFG

SEQ ID NO: 171148 - protein, 10 aa, Yellow fever virus
GEVHAVPFGL

SEQ ID NO: 171149 - protein, 10 aa, Yellow fever virus
EVHAVPFGLV

SEQ ID NO: 171150 - protein, 10 aa, Yellow fever virus
VHAVPFGLVS

SEQ ID NO: 171151 - protein, 10 aa, Yellow fever virus
FGLVSMMIAL

SEQ ID NO: 171152 - protein, 10 aa, Yellow fever virus
GLVSMMIALE

SEQ ID NO: 171153 - protein, 10 aa, Yellow fever virus
LVSMMIALEV

SEQ ID NO: 171154 - protein, 10 aa, Yellow fever virus
VSMMIALEVV

SEQ ID NO: 171155 - protein, 10 aa, Yellow fever virus
SMMIALEVVL

SEQ ID NO: 171156 - protein, 10 aa, Yellow fever virus
MMIALEVVLR

SEQ ID NO: 171157 - protein, 10 aa, Yellow fever virus
MIALEVVLRK

SEQ ID NO: 171158 - protein, 10 aa, Yellow fever virus
IAMEVVLRRR

SEQ ID NO: 171159 - protein, 10 aa, Yellow fever virus
AMEVVLRRRQ

SEQ ID NO: 171160 - protein, 10 aa, Yellow fever virus
LEVVLRKRQG

SEQ ID NO: 171161 - protein, 10 aa, Yellow fever virus
EVVLRRRQGP

SEQ ID NO: 171162 - protein, 10 aa, Yellow fever virus
VVLRRRQGPK

SEQ ID NO: 171163 - protein, 10 aa, Yellow fever virus
VLRRRQGPKQ

SEQ ID NO: 171164 - protein, 10 aa, Yellow fever virus
LRKRQGPKQV

SEQ ID NO: 171165 - protein, 10 aa, Yellow fever virus
RKRQGPKQVL

SEQ ID NO: 171166 - protein, 10 aa, Yellow fever virus
KRQGPKQVLV

SEQ ID NO: 171167 - protein, 10 aa, Yellow fever virus
RQGPKQVLVG

SEQ ID NO: 171168 - protein, 10 aa, Yellow fever virus
QGPKQVLVGG

SEQ ID NO: 171169 - protein, 10 aa, Yellow fever virus
GPKQMLVGGI

SEQ ID NO: 171170 - protein, 10 aa, Yellow fever virus
PKQMLVGGII

SEQ ID NO: 171171 - protein, 10 aa, Yellow fever virus
KQMLVGGIIL

SEQ ID NO: 171172 - protein, 10 aa, Yellow fever virus
QMLVGGIILL

SEQ ID NO: 171173 - protein, 10 aa, Yellow fever virus
MLVGGIILLG

SEQ ID NO: 171174 - protein, 10 aa, Yellow fever virus
LVGGIILLGA

SEQ ID NO: 171175 - protein, 10 aa, Yellow fever virus
VGGIILLGAM

SEQ ID NO: 171176 - protein, 10 aa, Yellow fever virus
GGIILLGAML

SEQ ID NO: 171177 - protein, 10 aa, Yellow fever virus
GIILLGAMLV

SEQ ID NO: 171178 - protein, 10 aa, Yellow fever virus
IILLGAMLVG

SEQ ID NO: 171179 - protein, 10 aa, Yellow fever virus
ILLGAMLVGQ

SEQ ID NO: 171180 - protein, 10 aa, Yellow fever virus
GAMLVGQVTV

SEQ ID NO: 171181 - protein, 10 aa, Yellow fever virus
AMLVGQVTVL

SEQ ID NO: 171182 - protein, 10 aa, Yellow fever virus
MLVGQVTVLD

SEQ ID NO: 171183 - protein, 10 aa, Yellow fever virus
LVGQVTVLDL

SEQ ID NO: 171184 - protein, 10 aa, Yellow fever virus
VGQVTVLDLV

SEQ ID NO: 171185 - protein, 10 aa, Yellow fever virus
GQVTVLDLVK

SEQ ID NO: 171186 - protein, 10 aa, Yellow fever virus
LIVAVGLHFH

SEQ ID NO: 171187 - protein, 10 aa, Yellow fever virus
IVAVGLHFHE

SEQ ID NO: 171188 - protein, 10 aa, Yellow fever virus
VAVGLHFHEI

SEQ ID NO: 171189 - protein, 10 aa, Yellow fever virus
AVGLHFHEIN

SEQ ID NO: 171190 - protein, 10 aa, Yellow fever virus
VGLHFHEINN

SEQ ID NO: 171191 - protein, 10 aa, Yellow fever virus
GLHFHEINNG

SEQ ID NO: 171192 - protein, 10 aa, Yellow fever virus
LHFHEINNGG

SEQ ID NO: 171193 - protein, 10 aa, Yellow fever virus
HFHEINNGGD

SEQ ID NO: 171194 - protein, 10 aa, Yellow fever virus
FHEINNGGDA

SEQ ID NO: 171195 - protein, 10 aa, Yellow fever virus
HEINNGGDAM

SEQ ID NO: 171196 - protein, 10 aa, Yellow fever virus
EINNGGDAMY

SEQ ID NO: 171197 - protein, 10 aa, Yellow fever virus
INNGGDAMYM

SEQ ID NO: 171198 - protein, 10 aa, Yellow fever virus
DAMYMALIAS

SEQ ID NO: 171199 - protein, 10 aa, Yellow fever virus
AMYMALIASF

SEQ ID NO: 171200 - protein, 10 aa, Yellow fever virus
MYMALIASFS

SEQ ID NO: 171201 - protein, 10 aa, Yellow fever virus
YMALIASFSI

SEQ ID NO: 171202 - protein, 10 aa, Yellow fever virus
MALIASFSIR

SEQ ID NO: 171203 - protein, 10 aa, Yellow fever virus
ALIASFSIRP

SEQ ID NO: 171204 - protein, 10 aa, Yellow fever virus
LIASFSIRPG

SEQ ID NO: 171205 - protein, 10 aa, Yellow fever virus
IASFSIRPGL

SEQ ID NO: 171206 - protein, 10 aa, Yellow fever virus
ASFSIRPGLL

SEQ ID NO: 171207 - protein, 10 aa, Yellow fever virus
AFSVRPGLLI

SEQ ID NO: 171208 - protein, 10 aa, Yellow fever virus
FSVRPGLLIG

SEQ ID NO: 171209 - protein, 10 aa, Yellow fever virus
SVRPGLLIGF

SEQ ID NO: 171210 - protein, 10 aa, Yellow fever virus
VRPGLLIGFG

SEQ ID NO: 171211 - protein, 10 aa, Yellow fever virus
RPGLLMGFGL

SEQ ID NO: 171212 - protein, 10 aa, Yellow fever virus
PGLLVGFGLR

SEQ ID NO: 171213 - protein, 10 aa, Yellow fever virus
GLLMGFGLRT

SEQ ID NO: 171214 - protein, 10 aa, Yellow fever virus
LLMGFGLRTL

SEQ ID NO: 171215 - protein, 10 aa, Yellow fever virus
LVGFGLRTLW

SEQ ID NO: 171216 - protein, 10 aa, Yellow fever virus
VGFGLRTLWS

SEQ ID NO: 171217 - protein, 10 aa, Yellow fever virus
LWSPRERLVM

SEQ ID NO: 171218 - protein, 10 aa, Yellow fever virus
WSPRERLVMA

SEQ ID NO: 171219 - protein, 10 aa, Yellow fever virus
SPRERLVMAF

SEQ ID NO: 171220 - protein, 10 aa, Yellow fever virus
PRERLVMAFG

SEQ ID NO: 171221 - protein, 10 aa, Yellow fever virus
RERLVMAFGA

SEQ ID NO: 171222 - protein, 10 aa, Yellow fever virus
ERLVMAFGAA

SEQ ID NO: 171223 - protein, 10 aa, Yellow fever virus
RLVMAFGAAM

SEQ ID NO: 171224 - protein, 10 aa, Yellow fever virus
LVMAFGAAMV

SEQ ID NO: 171225 - protein, 10 aa, Yellow fever virus
VMAFGAAMVE

SEQ ID NO: 171226 - protein, 10 aa, Yellow fever virus
LALGAAMVEI

SEQ ID NO: 171227 - protein, 10 aa, Yellow fever virus
AFGAAMVEVA

SEQ ID NO: 171228 - protein, 10 aa, Yellow fever virus
FGAAMVEVAL

SEQ ID NO: 171229 - protein, 10 aa, Yellow fever virus
GAAMVEVALG

SEQ ID NO: 171230 - protein, 10 aa, Yellow fever virus
AAMVEVALGG

SEQ ID NO: 171231 - protein, 10 aa, Yellow fever virus
AMVEIALGGM

SEQ ID NO: 171232 - protein, 10 aa, Yellow fever virus
MVEIALGGMM

SEQ ID NO: 171233 - protein, 10 aa, Yellow fever virus
VEIALGGMMG

SEQ ID NO: 171234 - protein, 10 aa, Yellow fever virus
EIALGGMMGG

SEQ ID NO: 171235 - protein, 10 aa, Yellow fever virus
IALGGMMGGL

SEQ ID NO: 171236 - protein, 10 aa, Yellow fever virus
ALGGMMGGLW

SEQ ID NO: 171237 - protein, 10 aa, Yellow fever virus
LGGMMGGLWK

SEQ ID NO: 171238 - protein, 10 aa, Yellow fever virus
GGMMGGLWKY

SEQ ID NO: 171239 - protein, 10 aa, Yellow fever virus
GMMGGLWKYL

SEQ ID NO: 171240 - protein, 10 aa, Yellow fever virus
MMGGLWKYLN

SEQ ID NO: 171241 - protein, 10 aa, Yellow fever virus
MGGLWQYLNA

SEQ ID NO: 171242 - protein, 10 aa, Yellow fever virus
GGLWQYLNAV

SEQ ID NO: 171243 - protein, 10 aa, Yellow fever virus
GLWQYLNAVS

SEQ ID NO: 171244 - protein, 10 aa, Yellow fever virus
LWQYLNAVSL

SEQ ID NO: 171245 - protein, 10 aa, Yellow fever virus
WQYLNAVSLC

SEQ ID NO: 171246 - protein, 10 aa, Yellow fever virus
QYLNAVSLCV

SEQ ID NO: 171247 - protein, 10 aa, Yellow fever virus
YLNAVSLCVL

SEQ ID NO: 171248 - protein, 10 aa, Yellow fever virus
LNAVSLCVLT

SEQ ID NO: 171249 - protein, 10 aa, Yellow fever virus
NAVSLCVLTI

SEQ ID NO: 171250 - protein, 10 aa, Yellow fever virus
AVSLCVLTIN

SEQ ID NO: 171251 - protein, 10 aa, Yellow fever virus
VSLCVLTINA

SEQ ID NO: 171252 - protein, 10 aa, Yellow fever virus
SLCVLTINAI

SEQ ID NO: 171253 - protein, 10 aa, Yellow fever virus
LCVLTINAIS

SEQ ID NO: 171254 - protein, 10 aa, Yellow fever virus
CVLTINAISS

SEQ ID NO: 171255 - protein, 10 aa, Yellow fever virus
VLTINAISSR

SEQ ID NO: 171256 - protein, 10 aa, Yellow fever virus
LTINAISSRK

SEQ ID NO: 171257 - protein, 10 aa, Yellow fever virus
TINAISSRKA

SEQ ID NO: 171258 - protein, 10 aa, Yellow fever virus
INAISSRKAS

SEQ ID NO: 171259 - protein, 10 aa, Yellow fever virus
NAISSRKASN

SEQ ID NO: 171260 - protein, 10 aa, Yellow fever virus
AISSRKASNA

SEQ ID NO: 171261 - protein, 10 aa, Yellow fever virus
VASRKASNAI

SEQ ID NO: 171262 - protein, 10 aa, Yellow fever virus
ASRKASNAIL

SEQ ID NO: 171263 - protein, 10 aa, Yellow fever virus
SRKASNMILP

SEQ ID NO: 171264 - protein, 10 aa, Yellow fever virus
RKASNAILPL

SEQ ID NO: 171265 - protein, 10 aa, Yellow fever virus
KASNMILPLM

SEQ ID NO: 171266 - protein, 10 aa, Yellow fever virus
ASNAILPLMA

SEQ ID NO: 171267 - protein, 10 aa, Yellow fever virus
SNAVLPLMAL

SEQ ID NO: 171268 - protein, 10 aa, Yellow fever virus
NMILPLMALM

SEQ ID NO: 171269 - protein, 10 aa, Yellow fever virus
AILPLMALLT

SEQ ID NO: 171270 - protein, 10 aa, Yellow fever virus
ILPLMALMTP

SEQ ID NO: 171271 - protein, 10 aa, Yellow fever virus
LPLMALMTPM

SEQ ID NO: 171272 - protein, 10 aa, Yellow fever virus
PLMALMTPMT

SEQ ID NO: 171273 - protein, 10 aa, Yellow fever virus
LMALMTPMTM

SEQ ID NO: 171274 - protein, 10 aa, Yellow fever virus
MALLTPVTMH

SEQ ID NO: 171275 - protein, 10 aa, Yellow fever virus
ALLTPVTMHE

SEQ ID NO: 171276 - protein, 10 aa, Yellow fever virus
LMTPMTMHEV

SEQ ID NO: 171277 - protein, 10 aa, Yellow fever virus
MTPMTMHEVR

SEQ ID NO: 171278 - protein, 10 aa, Yellow fever virus
TPVTMHEVRM

SEQ ID NO: 171279 - protein, 10 aa, Yellow fever virus
PVTMYEVRMA

SEQ ID NO: 171280 - protein, 10 aa, Yellow fever virus
VTMAEVRLAT

SEQ ID NO: 171281 - protein, 10 aa, Yellow fever virus
TMAEVRLATM

SEQ ID NO: 171282 - protein, 10 aa, Yellow fever virus
MAEVRLATML

SEQ ID NO: 171283 - protein, 10 aa, Yellow fever virus
EVRLAAMLFC

SEQ ID NO: 171284 - protein, 10 aa, Yellow fever virus
ATMLFCTVVI

SEQ ID NO: 171285 - protein, 10 aa, Yellow fever virus
MLFCTVVIIG

SEQ ID NO: 171286 - protein, 10 aa, Yellow fever virus
LFCTVVIIGV

SEQ ID NO: 171287 - protein, 10 aa, Yellow fever virus
FCTVVIIGVL

SEQ ID NO: 171288 - protein, 10 aa, Yellow fever virus
CTVVIIGVLH

SEQ ID NO: 171289 - protein, 10 aa, Yellow fever virus
TVVIIGVLHQ

SEQ ID NO: 171290 - protein, 10 aa, Yellow fever virus
VVIVGVLHQN

SEQ ID NO: 171291 - protein, 10 aa, Yellow fever virus
VIIGVLHQNS

SEQ ID NO: 171292 - protein, 10 aa, Yellow fever virus
IIGVLHQNSK

SEQ ID NO: 171293 - protein, 10 aa, Yellow fever virus
IGVLHQNSKD

SEQ ID NO: 171294 - protein, 10 aa, Yellow fever virus
GVLHQNSKDT

SEQ ID NO: 171295 - protein, 10 aa, Yellow fever virus
VLHQNSKDTS

SEQ ID NO: 171296 - protein, 10 aa, Yellow fever virus
LHQNSKDTSM

SEQ ID NO: 171297 - protein, 10 aa, Yellow fever virus
HQNSKDTSMQ

SEQ ID NO: 171298 - protein, 10 aa, Yellow fever virus
QNSKDTSMQK

SEQ ID NO: 171299 - protein, 10 aa, Yellow fever virus
NSKDTSMQKT

SEQ ID NO: 171300 - protein, 10 aa, Yellow fever virus
SKDTSMQKTI

SEQ ID NO: 171301 - protein, 10 aa, Yellow fever virus
DTSMQKTIPI

SEQ ID NO: 171302 - protein, 10 aa, Yellow fever virus
TSMQKTIPIV

SEQ ID NO: 171303 - protein, 10 aa, Yellow fever virus
SMQKTIPIVA

SEQ ID NO: 171304 - protein, 10 aa, Yellow fever virus
MQKTIPIVAL

SEQ ID NO: 171305 - protein, 10 aa, Yellow fever virus
QKTIPIVALT

SEQ ID NO: 171306 - protein, 10 aa, Yellow fever virus
KTIPIVALTL

SEQ ID NO: 171307 - protein, 10 aa, Yellow fever virus
TIPIVALTLT

SEQ ID NO: 171308 - protein, 10 aa, Yellow fever virus
IPIVALTLTS

SEQ ID NO: 171309 - protein, 10 aa, Yellow fever virus
PIVALTLTSY

SEQ ID NO: 171310 - protein, 10 aa, Yellow fever virus
IVALTLTSYM

SEQ ID NO: 171311 - protein, 10 aa, Yellow fever virus
VALTLTSYMG

SEQ ID NO: 171312 - protein, 10 aa, Yellow fever virus
ALTLTSYMGL

SEQ ID NO: 171313 - protein, 10 aa, Yellow fever virus
LTLTSYMGLT

SEQ ID NO: 171314 - protein, 10 aa, Yellow fever virus
TLTSYMGLTQ

SEQ ID NO: 171315 - protein, 10 aa, Yellow fever virus
LTSYMGLTQP

SEQ ID NO: 171316 - protein, 10 aa, Yellow fever virus
TSYMGLTQPF

SEQ ID NO: 171317 - protein, 10 aa, Yellow fever virus
SYMGLTQPFL

SEQ ID NO: 171318 - protein, 10 aa, Yellow fever virus
YMGLTQPFLG

SEQ ID NO: 171319 - protein, 10 aa, Yellow fever virus
MGLTQPFLGL

SEQ ID NO: 171320 - protein, 10 aa, Yellow fever virus
TQPFLGLCAY

SEQ ID NO: 171321 - protein, 10 aa, Yellow fever virus
QPFLGLCAYM

SEQ ID NO: 171322 - protein, 10 aa, Yellow fever virus
PFLGLCAYMS

SEQ ID NO: 171323 - protein, 10 aa, Yellow fever virus
FLGLCAYMST

SEQ ID NO: 171324 - protein, 10 aa, Yellow fever virus
LGLCAYMSTQ

SEQ ID NO: 171325 - protein, 10 aa, Yellow fever virus
GLCAYMSTQV

SEQ ID NO: 171326 - protein, 10 aa, Yellow fever virus
LCAYMSTQVF

SEQ ID NO: 171327 - protein, 10 aa, Yellow fever virus
CAYMSTQVFG

SEQ ID NO: 171328 - protein, 10 aa, Yellow fever virus
AYMSTQVFGR

SEQ ID NO: 171329 - protein, 10 aa, Yellow fever virus
YMSTQVFGRR

SEQ ID NO: 171330 - protein, 10 aa, Yellow fever virus
MSTQVFGRRS

SEQ ID NO: 171331 - protein, 10 aa, Yellow fever virus
STQVFGRRSI

SEQ ID NO: 171332 - protein, 10 aa, Yellow fever virus
TQVFGRRSIP

SEQ ID NO: 171333 - protein, 10 aa, Yellow fever virus
QVFGRRSIPV

SEQ ID NO: 171334 - protein, 10 aa, Yellow fever virus
VFGRRSIPVN

SEQ ID NO: 171335 - protein, 10 aa, Yellow fever virus
IPVNEALAAT

SEQ ID NO: 171336 - protein, 10 aa, Yellow fever virus
PVNEALAATG

SEQ ID NO: 171337 - protein, 10 aa, Yellow fever virus
VNEALAATGL

SEQ ID NO: 171338 - protein, 10 aa, Yellow fever virus
NEALAATGLV

SEQ ID NO: 171339 - protein, 10 aa, Yellow fever virus
EALAATGLVG

SEQ ID NO: 171340 - protein, 10 aa, Yellow fever virus
ALAATGLVGV

SEQ ID NO: 171341 - protein, 10 aa, Yellow fever virus
LAATGLVGVL

SEQ ID NO: 171342 - protein, 10 aa, Yellow fever virus
AATGLVGVLA

SEQ ID NO: 171343 - protein, 10 aa, Yellow fever virus
ATGLVGVLAG

SEQ ID NO: 171344 - protein, 10 aa, Yellow fever virus
TGLVGVLAGL

SEQ ID NO: 171345 - protein, 10 aa, Yellow fever virus
GVLAGLAFQD

SEQ ID NO: 171346 - protein, 10 aa, Yellow fever virus
VLAGLAFQDM

SEQ ID NO: 171347 - protein, 10 aa, Yellow fever virus
LAGLAFQDME

SEQ ID NO: 171348 - protein, 10 aa, Yellow fever virus
AGLAFQDMEN

SEQ ID NO: 171349 - protein, 10 aa, Yellow fever virus
GLAFQDMENF

SEQ ID NO: 171350 - protein, 10 aa, Yellow fever virus
LAFQDMENFL

SEQ ID NO: 171351 - protein, 10 aa, Yellow fever virus
AFQDMENFLG

SEQ ID NO: 171352 - protein, 10 aa, Yellow fever virus
FQDMENFLGP

SEQ ID NO: 171353 - protein, 10 aa, Yellow fever virus
QDMENFLGPI

SEQ ID NO: 171354 - protein, 10 aa, Yellow fever virus
DMENFLGPIA

SEQ ID NO: 171355 - protein, 10 aa, Yellow fever virus
FLGPIAVGGI

SEQ ID NO: 171356 - protein, 10 aa, Yellow fever virus
LGPIAVGGIL

SEQ ID NO: 171357 - protein, 10 aa, Yellow fever virus
GPIAVGGILM

SEQ ID NO: 171358 - protein, 10 aa, Yellow fever virus
PIAVGGILMM

SEQ ID NO: 171359 - protein, 10 aa, Yellow fever virus
IAVGGILMML

SEQ ID NO: 171360 - protein, 10 aa, Yellow fever virus
AVGGILMMLV

SEQ ID NO: 171361 - protein, 10 aa, Yellow fever virus
VGGILMMLVS

SEQ ID NO: 171362 - protein, 10 aa, Yellow fever virus
GGILMMLVSV

SEQ ID NO: 171363 - protein, 10 aa, Yellow fever virus
GILMMLVSVA

SEQ ID NO: 171364 - protein, 10 aa, Yellow fever virus
ILMMLVSVAG

SEQ ID NO: 171365 - protein, 10 aa, Yellow fever virus
LMMLVSVAGK

SEQ ID NO: 171366 - protein, 10 aa, Yellow fever virus
MMLVSVAGKV

SEQ ID NO: 171367 - protein, 10 aa, Yellow fever virus
MLVSVAGKVD

SEQ ID NO: 171368 - protein, 10 aa, Yellow fever virus
LVSVAGKVDG

SEQ ID NO: 171369 - protein, 10 aa, Yellow fever virus
VSVAGKVDGL

SEQ ID NO: 171370 - protein, 10 aa, Yellow fever virus
SVAGKVDGLE

SEQ ID NO: 171371 - protein, 10 aa, Yellow fever virus
VAGKVDGLEL

SEQ ID NO: 171372 - protein, 10 aa, Yellow fever virus
AGKVDGLELK

SEQ ID NO: 171373 - protein, 10 aa, Yellow fever virus
GKVDGLELKK

SEQ ID NO: 171374 - protein, 10 aa, Yellow fever virus
RVDGLELRKL

SEQ ID NO: 171375 - protein, 10 aa, Yellow fever virus
VDGLELRKLG

SEQ ID NO: 171376 - protein, 10 aa, Yellow fever virus
DGLELRKLGE

SEQ ID NO: 171377 - protein, 10 aa, Yellow fever virus
GLELRKLGEV

SEQ ID NO: 171378 - protein, 10 aa, Yellow fever virus
LELRKLGEVS

SEQ ID NO: 171379 - protein, 10 aa, Yellow fever virus
ELRKLGEVSW

SEQ ID NO: 171380 - protein, 10 aa, Yellow fever virus
LRKLGEVSWE

SEQ ID NO: 171381 - protein, 10 aa, Yellow fever virus
RKLGEVSWEE

SEQ ID NO: 171382 - protein, 10 aa, Yellow fever virus
KLGEISWEEE

SEQ ID NO: 171383 - protein, 10 aa, Yellow fever virus
LGEVAWEEEA

SEQ ID NO: 171384 - protein, 10 aa, Yellow fever virus
GEVAWEEEAE

SEQ ID NO: 171385 - protein, 10 aa, Yellow fever virus
EVAWEEEAEI

SEQ ID NO: 171386 - protein, 10 aa, Yellow fever virus
ISWEEEAEIS

SEQ ID NO: 171387 - protein, 10 aa, Yellow fever virus
AWEEEAEISG

SEQ ID NO: 171388 - protein, 10 aa, Yellow fever virus
EEAEISGSSS

SEQ ID NO: 171389 - protein, 10 aa, Yellow fever virus
EAEISGSSSR

SEQ ID NO: 171390 - protein, 10 aa, Yellow fever virus
AEISGSSSRY

SEQ ID NO: 171391 - protein, 10 aa, Yellow fever virus
EISGSSSRYD

SEQ ID NO: 171392 - protein, 10 aa, Yellow fever virus
ISGSSSRYDV

SEQ ID NO: 171393 - protein, 10 aa, Yellow fever virus
SGSSSRYDVA

SEQ ID NO: 171394 - protein, 10 aa, Yellow fever virus
GSSSRYDVAL

SEQ ID NO: 171395 - protein, 10 aa, Yellow fever virus
SSSRYDVALS

SEQ ID NO: 171396 - protein, 10 aa, Yellow fever virus
SSRYDVALSE

SEQ ID NO: 171397 - protein, 10 aa, Yellow fever virus
SRYDVALSEQ

SEQ ID NO: 171398 - protein, 10 aa, Yellow fever virus
RYDVALNEQG

SEQ ID NO: 171399 - protein, 10 aa, Yellow fever virus
YDVALNEQGE

SEQ ID NO: 171400 - protein, 10 aa, Yellow fever virus
DVALNEQGEF

SEQ ID NO: 171401 - protein, 10 aa, Yellow fever virus
VALNEQGEFK

SEQ ID NO: 171402 - protein, 10 aa, Yellow fever virus
ALNEQGEFKL

SEQ ID NO: 171403 - protein, 10 aa, Yellow fever virus
LNEQGEFKLL

SEQ ID NO: 171404 - protein, 10 aa, Yellow fever virus
NEQGEFKLLS

SEQ ID NO: 171405 - protein, 10 aa, Yellow fever virus
QGEFKLLSED

SEQ ID NO: 171406 - protein, 10 aa, Yellow fever virus
GEFKLLSEDK

SEQ ID NO: 171407 - protein, 10 aa, Yellow fever virus
EFKLLSEDKV

SEQ ID NO: 171408 - protein, 10 aa, Yellow fever virus
FKLLSEDKVP

SEQ ID NO: 171409 - protein, 10 aa, Yellow fever virus
KLLSEDKVPW

SEQ ID NO: 171410 - protein, 10 aa, Yellow fever virus
LLSEDKVPWD

SEQ ID NO: 171411 - protein, 10 aa, Yellow fever virus
LSEDKVPWDQ

SEQ ID NO: 171412 - protein, 10 aa, Yellow fever virus
SEDKVPWDQI

SEQ ID NO: 171413 - protein, 10 aa, Yellow fever virus
EDKVPWDQIV

SEQ ID NO: 171414 - protein, 10 aa, Yellow fever virus
DKVPWDQIVM

SEQ ID NO: 171415 - protein, 10 aa, Yellow fever virus
KVPWDQIVMT

SEQ ID NO: 171416 - protein, 10 aa, Yellow fever virus
VPWDQIVMTS

SEQ ID NO: 171417 - protein, 10 aa, Yellow fever virus
PWDQIVMTSL

SEQ ID NO: 171418 - protein, 10 aa, Yellow fever virus
WDQIVMTSLA

SEQ ID NO: 171419 - protein, 10 aa, Yellow fever virus
DQIVMTSLAL

SEQ ID NO: 171420 - protein, 10 aa, Yellow fever virus
QIVMTSLALV

SEQ ID NO: 171421 - protein, 10 aa, Yellow fever virus
IVMTSLALVG

SEQ ID NO: 171422 - protein, 10 aa, Yellow fever virus
TSLALVGAAI

SEQ ID NO: 171423 - protein, 10 aa, Yellow fever virus
SLALVGAAIH

SEQ ID NO: 171424 - protein, 10 aa, Yellow fever virus
LALVGAAIHP

SEQ ID NO: 171425 - protein, 10 aa, Yellow fever virus
ALVGAAIHPF

SEQ ID NO: 171426 - protein, 10 aa, Yellow fever virus
LVGAAIHPFA

SEQ ID NO: 171427 - protein, 10 aa, Yellow fever virus
VGAAIHPFAL

SEQ ID NO: 171428 - protein, 10 aa, Yellow fever virus
GAAIHPFALL

SEQ ID NO: 171429 - protein, 10 aa, Yellow fever virus
AAIHPFALLL

SEQ ID NO: 171430 - protein, 10 aa, Yellow fever virus
AIHPFALLLV

SEQ ID NO: 171431 - protein, 10 aa, Yellow fever virus
IHPFALLLVL

SEQ ID NO: 171432 - protein, 10 aa, Yellow fever virus
HPFALLLVLG

SEQ ID NO: 171433 - protein, 10 aa, Yellow fever virus
PFALLLVLGG

SEQ ID NO: 171434 - protein, 10 aa, Yellow fever virus
FALLLVLGGW

SEQ ID NO: 171435 - protein, 10 aa, Yellow fever virus
ALLLVLGGWV

SEQ ID NO: 171436 - protein, 10 aa, Yellow fever virus
LLLVLGGWVL

SEQ ID NO: 171437 - protein, 10 aa, Yellow fever virus
LLVLGGWVLH

SEQ ID NO: 171438 - protein, 10 aa, Yellow fever virus
LVLGGWVLHI

SEQ ID NO: 171439 - protein, 10 aa, Yellow fever virus
VLAGWLFHVK

SEQ ID NO: 171440 - protein, 10 aa, Yellow fever virus
LAGWLFHVKG

SEQ ID NO: 171441 - protein, 10 aa, Yellow fever virus
AGWLFHVKGA

SEQ ID NO: 171442 - protein, 10 aa, Yellow fever virus
GWLFHVKGAR

SEQ ID NO: 171443 - protein, 10 aa, Yellow fever virus
WLFHVKGARR

SEQ ID NO: 171444 - protein, 10 aa, Yellow fever virus
LFHVKGARRS

SEQ ID NO: 171445 - protein, 10 aa, Yellow fever virus
LHIKGARRSG

SEQ ID NO: 171446 - protein, 10 aa, Yellow fever virus
HIKGARRSGD

SEQ ID NO: 171447 - protein, 10 aa, Yellow fever virus
VKGARRSGDV

SEQ ID NO: 171448 - protein, 10 aa, Yellow fever virus
KGARRSGDVL

SEQ ID NO: 171449 - protein, 10 aa, Yellow fever virus
RARRSGDVLW

SEQ ID NO: 171450 - protein, 10 aa, Yellow fever virus
VLWDIPTPKV

SEQ ID NO: 171451 - protein, 10 aa, Yellow fever virus
LWDIPTPKVI

SEQ ID NO: 171452 - protein, 10 aa, Yellow fever virus
WDIPTPKVIE

SEQ ID NO: 171453 - protein, 10 aa, Yellow fever virus
DIPTPKVIEE

SEQ ID NO: 171454 - protein, 10 aa, Yellow fever virus
IPTPKVIEEC

SEQ ID NO: 171455 - protein, 10 aa, Yellow fever virus
PTPKVIEECE

SEQ ID NO: 171456 - protein, 10 aa, Yellow fever virus
TPKVIEECEH

SEQ ID NO: 171457 - protein, 10 aa, Yellow fever virus
PKVIEECEHL

SEQ ID NO: 171458 - protein, 10 aa, Yellow fever virus
KVIEECEHLE

SEQ ID NO: 171459 - protein, 10 aa, Yellow fever virus
VIEECEHLED

SEQ ID NO: 171460 - protein, 10 aa, Yellow fever virus
IEECEYLEDG

SEQ ID NO: 171461 - protein, 10 aa, Yellow fever virus
EECEYLEDGI

SEQ ID NO: 171462 - protein, 10 aa, Yellow fever virus
ECEYLEDGIY

SEQ ID NO: 171463 - protein, 10 aa, Yellow fever virus
CEYLEDGIYG

SEQ ID NO: 171464 - protein, 10 aa, Yellow fever virus
EYLEDGIYGI

SEQ ID NO: 171465 - protein, 10 aa, Yellow fever virus
HLEDGISGIF

SEQ ID NO: 171466 - protein, 10 aa, Yellow fever virus
LEDGISGIFQ

SEQ ID NO: 171467 - protein, 10 aa, Yellow fever virus
EDGISGIFQS

SEQ ID NO: 171468 - protein, 10 aa, Yellow fever virus
DGISGIFQST

SEQ ID NO: 171469 - protein, 10 aa, Yellow fever virus
GISGIFQSTF

SEQ ID NO: 171470 - protein, 10 aa, Yellow fever virus
ISGIFQSTFL

SEQ ID NO: 171471 - protein, 10 aa, Yellow fever virus
SGIFQSTFLG

SEQ ID NO: 171472 - protein, 10 aa, Yellow fever virus
WHVTRGAFLL

SEQ ID NO: 171473 - protein, 10 aa, Yellow fever virus
HVTRGAFLLR

SEQ ID NO: 171474 - protein, 10 aa, Yellow fever virus
VTRGAFLLRN

SEQ ID NO: 171475 - protein, 10 aa, Yellow fever virus
TRGAFLLRNG

SEQ ID NO: 171476 - protein, 10 aa, Yellow fever virus
RGAFLLRNGK

SEQ ID NO: 171477 - protein, 10 aa, Yellow fever virus
GAFLLRNGKK

SEQ ID NO: 171478 - protein, 10 aa, Yellow fever virus
AFLLRNGKKL

SEQ ID NO: 171479 - protein, 10 aa, Yellow fever virus
FLLRNGKKLV

SEQ ID NO: 171480 - protein, 10 aa, Yellow fever virus
LLRNGKKLVP

SEQ ID NO: 171481 - protein, 10 aa, Yellow fever virus
LRNGKKLVPS

SEQ ID NO: 171482 - protein, 10 aa, Yellow fever virus
RNGKKLVPSW

SEQ ID NO: 171483 - protein, 10 aa, Yellow fever virus
NGKKLVPSWA

SEQ ID NO: 171484 - protein, 10 aa, Yellow fever virus
GKKLVPSWAS

SEQ ID NO: 171485 - protein, 10 aa, Yellow fever virus
KKLVPSWASV

SEQ ID NO: 171486 - protein, 10 aa, Yellow fever virus
KLVPSWASVK

SEQ ID NO: 171487 - protein, 10 aa, Yellow fever virus
LVPSWASVKE

SEQ ID NO: 171488 - protein, 10 aa, Yellow fever virus
VPSWASVKED

SEQ ID NO: 171489 - protein, 10 aa, Yellow fever virus
VAYGGSWKLD

SEQ ID NO: 171490 - protein, 10 aa, Yellow fever virus
AYGGSWKLDG

SEQ ID NO: 171491 - protein, 10 aa, Yellow fever virus
YGGSWKLDGK

SEQ ID NO: 171492 - protein, 10 aa, Yellow fever virus
GGSWKLDGKW

SEQ ID NO: 171493 - protein, 10 aa, Yellow fever virus
GSWKLDGKWD

SEQ ID NO: 171494 - protein, 10 aa, Yellow fever virus
SWKLDGKWDG

SEQ ID NO: 171495 - protein, 10 aa, Yellow fever virus
WKLDGKWDGE

SEQ ID NO: 171496 - protein, 10 aa, Yellow fever virus
KLDGKWDGEE

SEQ ID NO: 171497 - protein, 10 aa, Yellow fever virus
LDGKWDGEEE

SEQ ID NO: 171498 - protein, 10 aa, Yellow fever virus
DGKWDGEEEV

SEQ ID NO: 171499 - protein, 10 aa, Yellow fever virus
GKWDGEEEVQ

SEQ ID NO: 171500 - protein, 10 aa, Yellow fever virus
KWDGEEEVQL

SEQ ID NO: 171501 - protein, 10 aa, Yellow fever virus
EEEVQLIAAA

SEQ ID NO: 171502 - protein, 10 aa, Yellow fever virus
EEVQLIAAAP

SEQ ID NO: 171503 - protein, 10 aa, Yellow fever virus
EVQLIAAAPG

SEQ ID NO: 171504 - protein, 10 aa, Yellow fever virus
VQLIAAAPGK

SEQ ID NO: 171505 - protein, 10 aa, Yellow fever virus
QLIAAVPGKA

SEQ ID NO: 171506 - protein, 10 aa, Yellow fever virus
LIAAVPGKAV

SEQ ID NO: 171507 - protein, 10 aa, Yellow fever virus
IAAVPGKAVV

SEQ ID NO: 171508 - protein, 10 aa, Yellow fever virus
AAVPGKAVVN

SEQ ID NO: 171509 - protein, 10 aa, Yellow fever virus
AVPGKAVVNV

SEQ ID NO: 171510 - protein, 10 aa, Yellow fever virus
VPGKAVVNVQ

SEQ ID NO: 171511 - protein, 10 aa, Yellow fever virus
PGKAVVNVQT

SEQ ID NO: 171512 - protein, 10 aa, Yellow fever virus
GKAVVNVQTK

SEQ ID NO: 171513 - protein, 10 aa, Yellow fever virus
KAVVNVQTKP

SEQ ID NO: 171514 - protein, 10 aa, Yellow fever virus
AVVNVQTKPS

SEQ ID NO: 171515 - protein, 10 aa, Yellow fever virus
VVNVQTKPSV

SEQ ID NO: 171516 - protein, 10 aa, Yellow fever virus
VNVQTKPSVF

SEQ ID NO: 171517 - protein, 10 aa, Yellow fever virus
NVQTKPSVFK

SEQ ID NO: 171518 - protein, 10 aa, Yellow fever virus
VQTKPSLFRV

SEQ ID NO: 171519 - protein, 10 aa, Yellow fever virus
QTKPSLFRVK

SEQ ID NO: 171520 - protein, 10 aa, Yellow fever virus
TKPSVFKVRN

SEQ ID NO: 171521 - protein, 10 aa, Yellow fever virus
KPSLFRVKNG

SEQ ID NO: 171522 - protein, 10 aa, Yellow fever virus
PSLFRVKNGG

SEQ ID NO: 171523 - protein, 10 aa, Yellow fever virus
SLFRVKNGGE

SEQ ID NO: 171524 - protein, 10 aa, Yellow fever virus
VFKVRNGGEI

SEQ ID NO: 171525 - protein, 10 aa, Yellow fever virus
FRVKNGGEIG

SEQ ID NO: 171526 - protein, 10 aa, Yellow fever virus
RVKNGGEIGA

SEQ ID NO: 171527 - protein, 10 aa, Yellow fever virus
VKNGGEIGAV

SEQ ID NO: 171528 - protein, 10 aa, Yellow fever virus
KNGGEIGAVA

SEQ ID NO: 171529 - protein, 10 aa, Yellow fever virus
TSGSPIVNRS

SEQ ID NO: 171530 - protein, 10 aa, Yellow fever virus
SGSPIVNRSG

SEQ ID NO: 171531 - protein, 10 aa, Yellow fever virus
GSPIVNRSGE

SEQ ID NO: 171532 - protein, 10 aa, Yellow fever virus
SPIVNRSGEV

SEQ ID NO: 171533 - protein, 10 aa, Yellow fever virus
PIVNRSGEVV

SEQ ID NO: 171534 - protein, 10 aa, Yellow fever virus
IVNRSGEVVG

SEQ ID NO: 171535 - protein, 10 aa, Yellow fever virus
VNRSGEVVGL

SEQ ID NO: 171536 - protein, 10 aa, Yellow fever virus
NRSGEVVGLY

SEQ ID NO: 171537 - protein, 10 aa, Yellow fever virus
RSGEVVGLYG

SEQ ID NO: 171538 - protein, 10 aa, Yellow fever virus
SGEVVGLYGN

SEQ ID NO: 171539 - protein, 10 aa, Yellow fever virus
GEVVGLYGNG

SEQ ID NO: 171540 - protein, 10 aa, Yellow fever virus
EVVGLYGNGI

SEQ ID NO: 171541 - protein, 10 aa, Yellow fever virus
VVGLYGNGIL

SEQ ID NO: 171542 - protein, 10 aa, Yellow fever virus
VGLYGNGILV

SEQ ID NO: 171543 - protein, 10 aa, Yellow fever virus
FVSAISQTEL

SEQ ID NO: 171544 - protein, 10 aa, Yellow fever virus
VSAISQTELK

SEQ ID NO: 171545 - protein, 10 aa, Yellow fever virus
SAISQTELKE

SEQ ID NO: 171546 - protein, 10 aa, Yellow fever virus
AISQTELKEE

SEQ ID NO: 171547 - protein, 10 aa, Yellow fever virus
ISQTEVKEES

SEQ ID NO: 171548 - protein, 10 aa, Yellow fever virus
SQTEVKEESK

SEQ ID NO: 171549 - protein, 10 aa, Yellow fever virus
QTEVKEESKE

SEQ ID NO: 171550 - protein, 10 aa, Yellow fever virus
TEVKEESKEE

SEQ ID NO: 171551 - protein, 10 aa, Yellow fever virus
EVKEESKEEL

SEQ ID NO: 171552 - protein, 10 aa, Yellow fever virus
VKEEGKEELR

SEQ ID NO: 171553 - protein, 10 aa, Yellow fever virus
KEEGKEELRE

SEQ ID NO: 171554 - protein, 10 aa, Yellow fever virus
EESKEELQEI

SEQ ID NO: 171555 - protein, 10 aa, Yellow fever virus
ESKEELQEIP

SEQ ID NO: 171556 - protein, 10 aa, Yellow fever virus
GKEELREIPT

SEQ ID NO: 171557 - protein, 10 aa, Yellow fever virus
KEELREIPTM

SEQ ID NO: 171558 - protein, 10 aa, Yellow fever virus
EELREIPTML

SEQ ID NO: 171559 - protein, 10 aa, Yellow fever virus
ELREIPTMLK

SEQ ID NO: 171560 - protein, 10 aa, Yellow fever virus
LREIPTMLKK

SEQ ID NO: 171561 - protein, 10 aa, Yellow fever virus
REIPTMLKKG

SEQ ID NO: 171562 - protein, 10 aa, Yellow fever virus
EIPTMLKKGK

SEQ ID NO: 171563 - protein, 10 aa, Yellow fever virus
IPTMLKKGKT

SEQ ID NO: 171564 - protein, 10 aa, Yellow fever virus
PTMLKKGKTT

SEQ ID NO: 171565 - protein, 10 aa, Yellow fever virus
TMLKKGMTTI

SEQ ID NO: 171566 - protein, 10 aa, Yellow fever virus
MLKKGMTTVL

SEQ ID NO: 171567 - protein, 10 aa, Yellow fever virus
LKKGMTTILD

SEQ ID NO: 171568 - protein, 10 aa, Yellow fever virus
KKGMTTILDF

SEQ ID NO: 171569 - protein, 10 aa, Yellow fever virus
KGMTTILDFH

SEQ ID NO: 171570 - protein, 10 aa, Yellow fever virus
GMTTILDFHP

SEQ ID NO: 171571 - protein, 10 aa, Yellow fever virus
MTTILDFHPG

SEQ ID NO: 171572 - protein, 10 aa, Yellow fever virus
TTVLDFHPGA

SEQ ID NO: 171573 - protein, 10 aa, Yellow fever virus
TVLDFHPGAG

SEQ ID NO: 171574 - protein, 10 aa, Yellow fever virus
VLDFHPGAGK

SEQ ID NO: 171575 - protein, 10 aa, Yellow fever virus
LDYHPGAGKT

SEQ ID NO: 171576 - protein, 10 aa, Yellow fever virus
DYHPGAGKTR

SEQ ID NO: 171577 - protein, 10 aa, Yellow fever virus
YHPGAGKTRR

SEQ ID NO: 171578 - protein, 10 aa, Yellow fever virus
VLSEMKEAFQ

SEQ ID NO: 171579 - protein, 10 aa, Yellow fever virus
LSEMKEAFQG

SEQ ID NO: 171580 - protein, 10 aa, Yellow fever virus
SEMKEAFQGL

SEQ ID NO: 171581 - protein, 10 aa, Yellow fever virus
EMKEAFQGLD

SEQ ID NO: 171582 - protein, 10 aa, Yellow fever virus
MKEAFQGLDV

SEQ ID NO: 171583 - protein, 10 aa, Yellow fever virus
KEAFQGLDVK

SEQ ID NO: 171584 - protein, 10 aa, Yellow fever virus
EAFQGLDVKF

SEQ ID NO: 171585 - protein, 10 aa, Yellow fever virus
AFQGLDVKFH

SEQ ID NO: 171586 - protein, 10 aa, Yellow fever virus
FQGLDVKFHT

SEQ ID NO: 171587 - protein, 10 aa, Yellow fever virus
QGLDVKFHTQ

SEQ ID NO: 171588 - protein, 10 aa, Yellow fever virus
QAFSAHGSGK

SEQ ID NO: 171589 - protein, 10 aa, Yellow fever virus
AFSAHGSGKE

SEQ ID NO: 171590 - protein, 10 aa, Yellow fever virus
FSAHGSGKEV

SEQ ID NO: 171591 - protein, 10 aa, Yellow fever virus
SAHGSGKEVI

SEQ ID NO: 171592 - protein, 10 aa, Yellow fever virus
AHGSGKEVID

SEQ ID NO: 171593 - protein, 10 aa, Yellow fever virus
HGSGKEVIDA

SEQ ID NO: 171594 - protein, 10 aa, Yellow fever virus
GSGKEVIDAM

SEQ ID NO: 171595 - protein, 10 aa, Yellow fever virus
SGKEVIDAMC

SEQ ID NO: 171596 - protein, 10 aa, Yellow fever virus
GKEVIDAMCH

SEQ ID NO: 171597 - protein, 10 aa, Yellow fever virus
KEVIDAMCHA

SEQ ID NO: 171598 - protein, 10 aa, Yellow fever virus
EVIDVMCHAT

SEQ ID NO: 171599 - protein, 10 aa, Yellow fever virus
VIDVMCHATL

SEQ ID NO: 171600 - protein, 10 aa, Yellow fever virus
IDVMCHATLT

SEQ ID NO: 171601 - protein, 10 aa, Yellow fever virus
DVMCHATLTY

SEQ ID NO: 171602 - protein, 10 aa, Yellow fever virus
VMCHATLTYR

SEQ ID NO: 171603 - protein, 10 aa, Yellow fever virus
TYRMLEPTRI

SEQ ID NO: 171604 - protein, 10 aa, Yellow fever virus
YRMLEPTRIV

SEQ ID NO: 171605 - protein, 10 aa, Yellow fever virus
RMLEPTRIVN

SEQ ID NO: 171606 - protein, 10 aa, Yellow fever virus
MLEPTRIVNW

SEQ ID NO: 171607 - protein, 10 aa, Yellow fever virus
LEPTRIVNWE

SEQ ID NO: 171608 - protein, 10 aa, Yellow fever virus
EPTRIVNWEV

SEQ ID NO: 171609 - protein, 10 aa, Yellow fever virus
PTRIVNWEVI

SEQ ID NO: 171610 - protein, 10 aa, Yellow fever virus
TRIVNWEVII

SEQ ID NO: 171611 - protein, 10 aa, Yellow fever virus
RIVNWEVIIM

SEQ ID NO: 171612 - protein, 10 aa, Yellow fever virus
IVNWEVIIMD

SEQ ID NO: 171613 - protein, 10 aa, Yellow fever virus
QTDIPSEPWT

SEQ ID NO: 171614 - protein, 10 aa, Yellow fever virus
TDIPSEPWTS

SEQ ID NO: 171615 - protein, 10 aa, Yellow fever virus
DIPSEPWTSG

SEQ ID NO: 171616 - protein, 10 aa, Yellow fever virus
IPSEPWTSGH

SEQ ID NO: 171617 - protein, 10 aa, Yellow fever virus
PSEPWTSGHE

SEQ ID NO: 171618 - protein, 10 aa, Yellow fever virus
SEPWTSGHEW

SEQ ID NO: 171619 - protein, 10 aa, Yellow fever virus
EPWTSGHEWI

SEQ ID NO: 171620 - protein, 10 aa, Yellow fever virus
PWTSGHEWIL

SEQ ID NO: 171621 - protein, 10 aa, Yellow fever virus
WTSGHEWILA

SEQ ID NO: 171622 - protein, 10 aa, Yellow fever virus
TSGHEWILAD

SEQ ID NO: 171623 - protein, 10 aa, Yellow fever virus
SGHEWILADK

SEQ ID NO: 171624 - protein, 10 aa, Yellow fever virus
GHEWILADKR

SEQ ID NO: 171625 - protein, 10 aa, Yellow fever virus
HEWILADKRP

SEQ ID NO: 171626 - protein, 10 aa, Yellow fever virus
EWILADKRPT

SEQ ID NO: 171627 - protein, 10 aa, Yellow fever virus
AASLRKAGKN

SEQ ID NO: 171628 - protein, 10 aa, Yellow fever virus
ASLRKAGKNV

SEQ ID NO: 171629 - protein, 10 aa, Yellow fever virus
SLRKAGKNVV

SEQ ID NO: 171630 - protein, 10 aa, Yellow fever virus
LRKAGKNVVV

SEQ ID NO: 171631 - protein, 10 aa, Yellow fever virus
RKAGKNVVVL

SEQ ID NO: 171632 - protein, 10 aa, Yellow fever virus
KAGKNVVVLN

SEQ ID NO: 171633 - protein, 10 aa, Yellow fever virus
AGKNVVVLNR

SEQ ID NO: 171634 - protein, 10 aa, Yellow fever virus
GKNVVVLNRK

SEQ ID NO: 171635 - protein, 10 aa, Yellow fever virus
KNVVVLNRKT

SEQ ID NO: 171636 - protein, 10 aa, Yellow fever virus
NVVVLNRKTF

SEQ ID NO: 171637 - protein, 10 aa, Yellow fever virus
VVLNRKTFEK

SEQ ID NO: 171638 - protein, 10 aa, Yellow fever virus
VLNRKTFEKE

SEQ ID NO: 171639 - protein, 10 aa, Yellow fever virus
LNRKTFEKEY

SEQ ID NO: 171640 - protein, 10 aa, Yellow fever virus
NRKTFEKEYP

SEQ ID NO: 171641 - protein, 10 aa, Yellow fever virus
RKTFEKEYPT

SEQ ID NO: 171642 - protein, 10 aa, Yellow fever virus
KTFEKEYPTI

SEQ ID NO: 171643 - protein, 10 aa, Yellow fever virus
TFEKEYPTIK

SEQ ID NO: 171644 - protein, 10 aa, Yellow fever virus
FEKEYPTIKQ

SEQ ID NO: 171645 - protein, 10 aa, Yellow fever virus
EKEYPTIKQK

SEQ ID NO: 171646 - protein, 10 aa, Yellow fever virus
KEYPTIKQKR

SEQ ID NO: 171647 - protein, 10 aa, Yellow fever virus
EYPTIKQKRP

SEQ ID NO: 171648 - protein, 10 aa, Yellow fever virus
YPTIKQKRPD

SEQ ID NO: 171649 - protein, 10 aa, Yellow fever virus
PTIKQKRPDF

SEQ ID NO: 171650 - protein, 10 aa, Yellow fever virus
TIKQKRPDFI

SEQ ID NO: 171651 - protein, 10 aa, Yellow fever virus
IKQKRPDFIL

SEQ ID NO: 171652 - protein, 10 aa, Yellow fever virus
KQKRPDFILA

SEQ ID NO: 171653 - protein, 10 aa, Yellow fever virus
QKRPDFILAT

SEQ ID NO: 171654 - protein, 10 aa, Yellow fever virus
KRPDFILATD

SEQ ID NO: 171655 - protein, 10 aa, Yellow fever virus
RPDFILATDI

SEQ ID NO: 171656 - protein, 10 aa, Yellow fever virus
AEMGANLCVD

SEQ ID NO: 171657 - protein, 10 aa, Yellow fever virus
EMGANLCVDR

SEQ ID NO: 171658 - protein, 10 aa, Yellow fever virus
MGANLCVDRV

SEQ ID NO: 171659 - protein, 10 aa, Yellow fever virus
GANLCVDRVL

SEQ ID NO: 171660 - protein, 10 aa, Yellow fever virus
ANLCVDRVLD

SEQ ID NO: 171661 - protein, 10 aa, Yellow fever virus
NLCVDRVLDC

SEQ ID NO: 171662 - protein, 10 aa, Yellow fever virus
LCVDRVLDCR

SEQ ID NO: 171663 - protein, 10 aa, Yellow fever virus
CVDRVLDCRT

SEQ ID NO: 171664 - protein, 10 aa, Yellow fever virus
VDRVLDCRTA

SEQ ID NO: 171665 - protein, 10 aa, Yellow fever virus
ERVLDCRTAY

SEQ ID NO: 171666 - protein, 10 aa, Yellow fever virus
RVLDCRTAYK

SEQ ID NO: 171667 - protein, 10 aa, Yellow fever virus
VLDCRTAYKP

SEQ ID NO: 171668 - protein, 10 aa, Yellow fever virus
LDCRTAYKPV

SEQ ID NO: 171669 - protein, 10 aa, Yellow fever virus
DCRTAYKPVL

SEQ ID NO: 171670 - protein, 10 aa, Yellow fever virus
CRTAYKPVLV

SEQ ID NO: 171671 - protein, 10 aa, Yellow fever virus
RTAYKPVLVD

SEQ ID NO: 171672 - protein, 10 aa, Yellow fever virus
TAYKPVLVDE

SEQ ID NO: 171673 - protein, 10 aa, Yellow fever virus
AYKPVLVDEG

SEQ ID NO: 171674 - protein, 10 aa, Yellow fever virus
YKPVLVDEGR

SEQ ID NO: 171675 - protein, 10 aa, Yellow fever virus
KPVLVDEGKK

SEQ ID NO: 171676 - protein, 10 aa, Yellow fever virus
PVLVDEGKKV

SEQ ID NO: 171677 - protein, 10 aa, Yellow fever virus
VLVDEGKKVA

SEQ ID NO: 171678 - protein, 10 aa, Yellow fever virus
LVDEGKKVAI

SEQ ID NO: 171679 - protein, 10 aa, Yellow fever virus
VDEGKKVAIK

SEQ ID NO: 171680 - protein, 10 aa, Yellow fever virus
DEGKKVAIKG

SEQ ID NO: 171681 - protein, 10 aa, Yellow fever virus
EGKKVAIKGP

SEQ ID NO: 171682 - protein, 10 aa, Yellow fever virus
GKKVAIKGPL

SEQ ID NO: 171683 - protein, 10 aa, Yellow fever virus
KKVAIKGPLR

SEQ ID NO: 171684 - protein, 10 aa, Yellow fever virus
YYYSEPTSED

SEQ ID NO: 171685 - protein, 10 aa, Yellow fever virus
YYSEPTSEDN

SEQ ID NO: 171686 - protein, 10 aa, Yellow fever virus
YSEPTSEDNA

SEQ ID NO: 171687 - protein, 10 aa, Yellow fever virus
SEPTSEDNAH

SEQ ID NO: 171688 - protein, 10 aa, Yellow fever virus
EPTSEDNAHH

SEQ ID NO: 171689 - protein, 10 aa, Yellow fever virus
PTSEDNAHHV

SEQ ID NO: 171690 - protein, 10 aa, Yellow fever virus
TSEDNAHHVC

SEQ ID NO: 171691 - protein, 10 aa, Yellow fever virus
SEDNAHHVCW

SEQ ID NO: 171692 - protein, 10 aa, Yellow fever virus
EDNAHHVCWL

SEQ ID NO: 171693 - protein, 10 aa, Yellow fever virus
DNAHHVCWLE

SEQ ID NO: 171694 - protein, 10 aa, Yellow fever virus
GGMVAPLYGI

SEQ ID NO: 171695 - protein, 10 aa, Yellow fever virus
GMVAPLYGIE

SEQ ID NO: 171696 - protein, 10 aa, Yellow fever virus
MVAPLYGIEG

SEQ ID NO: 171697 - protein, 10 aa, Yellow fever virus
VAPLYGIEGT

SEQ ID NO: 171698 - protein, 10 aa, Yellow fever virus
APLYGIEGTK

SEQ ID NO: 171699 - protein, 10 aa, Yellow fever virus
PLYGIEGTKT

SEQ ID NO: 171700 - protein, 10 aa, Yellow fever virus
LYGIEGTKTP

SEQ ID NO: 171701 - protein, 10 aa, Yellow fever virus
YGIEGTKTPV

SEQ ID NO: 171702 - protein, 10 aa, Yellow fever virus
GIEGTKTPVS

SEQ ID NO: 171703 - protein, 10 aa, Yellow fever virus
IEGTKTPVSP

SEQ ID NO: 171704 - protein, 10 aa, Yellow fever virus
EGIKTPVSPG

SEQ ID NO: 171705 - protein, 10 aa, Yellow fever virus
GIKTPVSPGE

SEQ ID NO: 171706 - protein, 10 aa, Yellow fever virus
IKTPVSPGEM

SEQ ID NO: 171707 - protein, 10 aa, Yellow fever virus
EMRLRDDQRR

SEQ ID NO: 171708 - protein, 10 aa, Yellow fever virus
MRLRDDQRRV

SEQ ID NO: 171709 - protein, 10 aa, Yellow fever virus
RLRDDQRRVF

SEQ ID NO: 171710 - protein, 10 aa, Yellow fever virus
LRDDQRRVFR

SEQ ID NO: 171711 - protein, 10 aa, Yellow fever virus
RDDQRRVFRE

SEQ ID NO: 171712 - protein, 10 aa, Yellow fever virus
DDQRRVFREL

SEQ ID NO: 171713 - protein, 10 aa, Yellow fever virus
DQRRVFRELV

SEQ ID NO: 171714 - protein, 10 aa, Yellow fever virus
QRRVFRELVR

SEQ ID NO: 171715 - protein, 10 aa, Yellow fever virus
RRVFRELVRG

SEQ ID NO: 171716 - protein, 10 aa, Yellow fever virus
RVFRELVRGC

SEQ ID NO: 171717 - protein, 10 aa, Yellow fever virus
VFRELVRGCD

SEQ ID NO: 171718 - protein, 10 aa, Yellow fever virus
FRELVRGCDL

SEQ ID NO: 171719 - protein, 10 aa, Yellow fever virus
RELVRGCDLP

SEQ ID NO: 171720 - protein, 10 aa, Yellow fever virus
ELVRGCDLPV

SEQ ID NO: 171721 - protein, 10 aa, Yellow fever virus
LVRGCDLPVW

SEQ ID NO: 171722 - protein, 10 aa, Yellow fever virus
VRGCDLPVWL

SEQ ID NO: 171723 - protein, 10 aa, Yellow fever virus
RGCDLPVWLS

SEQ ID NO: 171724 - protein, 10 aa, Yellow fever virus
GCDLPVWLSW

SEQ ID NO: 171725 - protein, 10 aa, Yellow fever virus
CDQPVWLSWQ

SEQ ID NO: 171726 - protein, 10 aa, Yellow fever virus
DLPVWLAWQV

SEQ ID NO: 171727 - protein, 10 aa, Yellow fever virus
QPVWLSWQVA

SEQ ID NO: 171728 - protein, 10 aa, Yellow fever virus
PVWLAWQVAK

SEQ ID NO: 171729 - protein, 10 aa, Yellow fever virus
VWLAWQVAKA

SEQ ID NO: 171730 - protein, 10 aa, Yellow fever virus
WLAWQVAKAG

SEQ ID NO: 171731 - protein, 10 aa, Yellow fever virus
LAWQVAKAGL

SEQ ID NO: 171732 - protein, 10 aa, Yellow fever virus
AWQVAKAGLK

SEQ ID NO: 171733 - protein, 10 aa, Yellow fever virus
WQVAKPGLKT

SEQ ID NO: 171734 - protein, 10 aa, Yellow fever virus
QVAKPGLKTN

SEQ ID NO: 171735 - protein, 10 aa, Yellow fever virus
VAKPGLKTND

SEQ ID NO: 171736 - protein, 10 aa, Yellow fever virus
AKPGLKTNDR

SEQ ID NO: 171737 - protein, 10 aa, Yellow fever virus
KPGLKTNDRK

SEQ ID NO: 171738 - protein, 10 aa, Yellow fever virus
PGLKTNDRKW

SEQ ID NO: 171739 - protein, 10 aa, Yellow fever virus
KTNDRKWCFD

SEQ ID NO: 171740 - protein, 10 aa, Yellow fever virus
TNDRKWCFDG

SEQ ID NO: 171741 - protein, 10 aa, Yellow fever virus
NDRKWCFDGP

SEQ ID NO: 171742 - protein, 10 aa, Yellow fever virus
DRKWCFEGPD

SEQ ID NO: 171743 - protein, 10 aa, Yellow fever virus
RKWCFDGPKE

SEQ ID NO: 171744 - protein, 10 aa, Yellow fever virus
KWCFDGPKEH

SEQ ID NO: 171745 - protein, 10 aa, Yellow fever virus
WCFEGPDEHE

SEQ ID NO: 171746 - protein, 10 aa, Yellow fever virus
CFEGPDEHEI

SEQ ID NO: 171747 - protein, 10 aa, Yellow fever virus
FDGPKEHEIL

SEQ ID NO: 171748 - protein, 10 aa, Yellow fever virus
DGPKEHEILN

SEQ ID NO: 171749 - protein, 10 aa, Yellow fever virus
GPKEHEILND

SEQ ID NO: 171750 - protein, 10 aa, Yellow fever virus
PEEHEILNDN

SEQ ID NO: 171751 - protein, 10 aa, Yellow fever virus
EEHEILNDNG

SEQ ID NO: 171752 - protein, 10 aa, Yellow fever virus
EHEILNDNGE

SEQ ID NO: 171753 - protein, 10 aa, Yellow fever virus
HEILNDNGET

SEQ ID NO: 171754 - protein, 10 aa, Yellow fever virus
EILNDNGETV

SEQ ID NO: 171755 - protein, 10 aa, Yellow fever virus
ILNDNGETVK

SEQ ID NO: 171756 - protein, 10 aa, Yellow fever virus
LNDNGETVKC

SEQ ID NO: 171757 - protein, 10 aa, Yellow fever virus
NDNGETVKCR

SEQ ID NO: 171758 - protein, 10 aa, Yellow fever virus
DNGETVKCRS

SEQ ID NO: 171759 - protein, 10 aa, Yellow fever virus
NGETVKCRSP

SEQ ID NO: 171760 - protein, 10 aa, Yellow fever virus
GETVKCRSPG

SEQ ID NO: 171761 - protein, 10 aa, Yellow fever virus
ETVKCRSPGG

SEQ ID NO: 171762 - protein, 10 aa, Yellow fever virus
TVKCRSPGGA

SEQ ID NO: 171763 - protein, 10 aa, Yellow fever virus
VKCRSPGGAK

SEQ ID NO: 171764 - protein, 10 aa, Yellow fever virus
KCRSPGGAKK

SEQ ID NO: 171765 - protein, 10 aa, Yellow fever virus
CRSPGGAKKA

SEQ ID NO: 171766 - protein, 10 aa, Yellow fever virus
RSPGGAKKAL

SEQ ID NO: 171767 - protein, 10 aa, Yellow fever virus
SPGGAKKALR

SEQ ID NO: 171768 - protein, 10 aa, Yellow fever virus
PGGAKKALRP

SEQ ID NO: 171769 - protein, 10 aa, Yellow fever virus
GGAKKALRPR

SEQ ID NO: 171770 - protein, 10 aa, Yellow fever virus
GAKKALRPRW

SEQ ID NO: 171771 - protein, 10 aa, Yellow fever virus
AKKALRPRWC

SEQ ID NO: 171772 - protein, 10 aa, Yellow fever virus
KKALRPRWCD

SEQ ID NO: 171773 - protein, 10 aa, Yellow fever virus
KALRPRWCDE

SEQ ID NO: 171774 - protein, 10 aa, Yellow fever virus
ALRPRWCDER

SEQ ID NO: 171775 - protein, 10 aa, Yellow fever virus
RVSSDQSALA

SEQ ID NO: 171776 - protein, 10 aa, Yellow fever virus
VSSDQSALAD

SEQ ID NO: 171777 - protein, 10 aa, Yellow fever virus
SSDQSALADF

SEQ ID NO: 171778 - protein, 10 aa, Yellow fever virus
SDQSALADFI

SEQ ID NO: 171779 - protein, 10 aa, Yellow fever virus
DQSALADFIK

SEQ ID NO: 171780 - protein, 10 aa, Yellow fever virus
QSALADFIKF

SEQ ID NO: 171781 - protein, 10 aa, Yellow fever virus
SALADFIKFA

SEQ ID NO: 171782 - protein, 10 aa, Yellow fever virus
ALADFIKFAE

SEQ ID NO: 171783 - protein, 10 aa, Yellow fever virus
LADFIKFAEG

SEQ ID NO: 171784 - protein, 10 aa, Yellow fever virus
ADFIKFAEGR

SEQ ID NO: 171785 - protein, 10 aa, Yellow fever virus
DFIKFAEGRR

SEQ ID NO: 171786 - protein, 10 aa, Yellow fever virus
FAEGRRGAAD

SEQ ID NO: 171787 - protein, 10 aa, Yellow fever virus
AEGRRGAAEM

SEQ ID NO: 171788 - protein, 10 aa, Yellow fever virus
EGRRGAAEML

SEQ ID NO: 171789 - protein, 10 aa, Yellow fever virus
GRRGAAEMLV

SEQ ID NO: 171790 - protein, 10 aa, Yellow fever virus
RRGAAEMLVV

SEQ ID NO: 171791 - protein, 10 aa, Yellow fever virus
RGAAEMLVVL

SEQ ID NO: 171792 - protein, 10 aa, Yellow fever virus
GAAEMLVVLT

SEQ ID NO: 171793 - protein, 10 aa, Yellow fever virus
AAEMLVVLTE

SEQ ID NO: 171794 - protein, 10 aa, Yellow fever virus
AEMLVVLTEL

SEQ ID NO: 171795 - protein, 10 aa, Yellow fever virus
EMLVVLTELP

SEQ ID NO: 171796 - protein, 10 aa, Yellow fever virus
MLVVLTELPD

SEQ ID NO: 171797 - protein, 10 aa, Yellow fever virus
LVVLTELPDF

SEQ ID NO: 171798 - protein, 10 aa, Yellow fever virus
VVLTELPDFL

SEQ ID NO: 171799 - protein, 10 aa, Yellow fever virus
VLTELPDFLA

SEQ ID NO: 171800 - protein, 10 aa, Yellow fever virus
LTELPDFLAK

SEQ ID NO: 171801 - protein, 10 aa, Yellow fever virus
TELPDFLAKK

SEQ ID NO: 171802 - protein, 10 aa, Yellow fever virus
GEAMDTISVL

SEQ ID NO: 171803 - protein, 10 aa, Yellow fever virus
EAMDTISVLL

SEQ ID NO: 171804 - protein, 10 aa, Yellow fever virus
AMDTISVLLH

SEQ ID NO: 171805 - protein, 10 aa, Yellow fever virus
MDTISVLLHS

SEQ ID NO: 171806 - protein, 10 aa, Yellow fever virus
DTISVLLHSE

SEQ ID NO: 171807 - protein, 10 aa, Yellow fever virus
TISVLLHSEE

SEQ ID NO: 171808 - protein, 10 aa, Yellow fever virus
ISVLLHSEEG

SEQ ID NO: 171809 - protein, 10 aa, Yellow fever virus
SVLLHSEEGS

SEQ ID NO: 171810 - protein, 10 aa, Yellow fever virus
VLLHSEEGSR

SEQ ID NO: 171811 - protein, 10 aa, Yellow fever virus
LLHSEEGSRA

SEQ ID NO: 171812 - protein, 10 aa, Yellow fever virus
SMMPEAMTIA

SEQ ID NO: 171813 - protein, 10 aa, Yellow fever virus
MMPEAMTIAM

SEQ ID NO: 171814 - protein, 10 aa, Yellow fever virus
MPEAMTIAML

SEQ ID NO: 171815 - protein, 10 aa, Yellow fever virus
PEAMTIAMLF

SEQ ID NO: 171816 - protein, 10 aa, Yellow fever virus
EAMTIVMLFL

SEQ ID NO: 171817 - protein, 10 aa, Yellow fever virus
AMTIVMLFLL

SEQ ID NO: 171818 - protein, 10 aa, Yellow fever virus
MTIVMLFLLA

SEQ ID NO: 171819 - protein, 10 aa, Yellow fever virus
TIVMLFLLAG

SEQ ID NO: 171820 - protein, 10 aa, Yellow fever virus
IVMLFLLAGL

SEQ ID NO: 171821 - protein, 10 aa, Yellow fever virus
VMLFLLAGLL

SEQ ID NO: 171822 - protein, 10 aa, Yellow fever virus
MLFLLAGLLT

SEQ ID NO: 171823 - protein, 10 aa, Yellow fever virus
LFLLAGLLTS

SEQ ID NO: 171824 - protein, 10 aa, Yellow fever virus
FLLAGLLTSG

SEQ ID NO: 171825 - protein, 10 aa, Yellow fever virus
LLAGLLTSGM

SEQ ID NO: 171826 - protein, 10 aa, Yellow fever virus
LAGLLTSGAV

SEQ ID NO: 171827 - protein, 10 aa, Yellow fever virus
AGLLTSGAVI

SEQ ID NO: 171828 - protein, 10 aa, Yellow fever virus
GLLTSGAVIF

SEQ ID NO: 171829 - protein, 10 aa, Yellow fever virus
LLTSGAVIFF

SEQ ID NO: 171830 - protein, 10 aa, Yellow fever virus
LTSGAVIFFM

SEQ ID NO: 171831 - protein, 10 aa, Yellow fever virus
TSGAVIFFMS

SEQ ID NO: 171832 - protein, 10 aa, Yellow fever virus
SGAVIFFMSP

SEQ ID NO: 171833 - protein, 10 aa, Yellow fever virus
GAVIFFMSPK

SEQ ID NO: 171834 - protein, 10 aa, Yellow fever virus
AVIFFMSPKG

SEQ ID NO: 171835 - protein, 10 aa, Yellow fever virus
VIFFMSPKGM

SEQ ID NO: 171836 - protein, 10 aa, Yellow fever virus
IFFMSPKGMS

SEQ ID NO: 171837 - protein, 10 aa, Yellow fever virus
FFMSPKGMSR

SEQ ID NO: 171838 - protein, 10 aa, Yellow fever virus
FMSPKGMSRM

SEQ ID NO: 171839 - protein, 10 aa, Yellow fever virus
MSPKGMSRMS

SEQ ID NO: 171840 - protein, 10 aa, Yellow fever virus
SPKGMSRMSM

SEQ ID NO: 171841 - protein, 10 aa, Yellow fever virus
PKGMSRMSMA

SEQ ID NO: 171842 - protein, 10 aa, Yellow fever virus
KGMSRMSMAM

SEQ ID NO: 171843 - protein, 10 aa, Yellow fever virus
GMSRMSMAMG

SEQ ID NO: 171844 - protein, 10 aa, Yellow fever virus
MSRMSMAMGT

SEQ ID NO: 171845 - protein, 10 aa, Yellow fever virus
SRMSMAKGTM

SEQ ID NO: 171846 - protein, 10 aa, Yellow fever virus
RMSMAKGTMA

SEQ ID NO: 171847 - protein, 10 aa, Yellow fever virus
MSMAKGTMAG

SEQ ID NO: 171848 - protein, 10 aa, Yellow fever virus
SMAMGTMAGS

SEQ ID NO: 171849 - protein, 10 aa, Yellow fever virus
MAMGTMAGSG

SEQ ID NO: 171850 - protein, 10 aa, Yellow fever virus
AMGTMAGSGY

SEQ ID NO: 171851 - protein, 10 aa, Yellow fever virus
MGTMAGSGYL

SEQ ID NO: 171852 - protein, 10 aa, Yellow fever virus
GTMAGSGYLM

SEQ ID NO: 171853 - protein, 10 aa, Yellow fever virus
TMAGSGYLMF

SEQ ID NO: 171854 - protein, 10 aa, Yellow fever virus
MAGSGYLMFL

SEQ ID NO: 171855 - protein, 10 aa, Yellow fever virus
AGSGYLMFLG

SEQ ID NO: 171856 - protein, 10 aa, Yellow fever virus
GSGYLMFLGG

SEQ ID NO: 171857 - protein, 10 aa, Yellow fever virus
SGYLMFLGGV

SEQ ID NO: 171858 - protein, 10 aa, Yellow fever virus
GYLMFLGGVE

SEQ ID NO: 171859 - protein, 10 aa, Yellow fever virus
YLMFLGGVEP

SEQ ID NO: 171860 - protein, 10 aa, Yellow fever virus
LMFLGGAKPT

SEQ ID NO: 171861 - protein, 10 aa, Yellow fever virus
MFLGGVEPTH

SEQ ID NO: 171862 - protein, 10 aa, Yellow fever virus
FLGGVEPTHI

SEQ ID NO: 171863 - protein, 10 aa, Yellow fever virus
LGGVEPTHIS

SEQ ID NO: 171864 - protein, 10 aa, Yellow fever virus
GGAKPTHISY

SEQ ID NO: 171865 - protein, 10 aa, Yellow fever virus
GVKPTHISYV

SEQ ID NO: 171866 - protein, 10 aa, Yellow fever virus
VKPTHISYVM

SEQ ID NO: 171867 - protein, 10 aa, Yellow fever virus
KPTHISYVML

SEQ ID NO: 171868 - protein, 10 aa, Yellow fever virus
PTHISYVMLI

SEQ ID NO: 171869 - protein, 10 aa, Yellow fever virus
THISYVMLIF

SEQ ID NO: 171870 - protein, 10 aa, Yellow fever virus
HISYVMLIFF

SEQ ID NO: 171871 - protein, 10 aa, Yellow fever virus
ISYVMLIFFV

SEQ ID NO: 171872 - protein, 10 aa, Yellow fever virus
SYVMLIFFVL

SEQ ID NO: 171873 - protein, 10 aa, Yellow fever virus
YVMLIFFVLM

SEQ ID NO: 171874 - protein, 10 aa, Yellow fever virus
VMLIFFVLMV

SEQ ID NO: 171875 - protein, 10 aa, Yellow fever virus
LIFFVLMVVI

SEQ ID NO: 171876 - protein, 10 aa, Yellow fever virus
IFFVLMVVII

SEQ ID NO: 171877 - protein, 10 aa, Yellow fever virus
FFVLMVVIIP

SEQ ID NO: 171878 - protein, 10 aa, Yellow fever virus
FVLMVVIIPE

SEQ ID NO: 171879 - protein, 10 aa, Yellow fever virus
VLMVVIIPEP

SEQ ID NO: 171880 - protein, 10 aa, Yellow fever virus
LMVVIIPEPG

SEQ ID NO: 171881 - protein, 10 aa, Yellow fever virus
MVVIIPEPGQ

SEQ ID NO: 171882 - protein, 10 aa, Yellow fever virus
VVIIPEPGQQ

SEQ ID NO: 171883 - protein, 10 aa, Yellow fever virus
VIIPEPGQQR

SEQ ID NO: 171884 - protein, 10 aa, Yellow fever virus
VIPEPGQQRT

SEQ ID NO: 171885 - protein, 10 aa, Yellow fever virus
IPEPGQQRTI

SEQ ID NO: 171886 - protein, 10 aa, Yellow fever virus
PEPGQQRTIQ

SEQ ID NO: 171887 - protein, 10 aa, Yellow fever virus
EPGQQRTIQD

SEQ ID NO: 171888 - protein, 10 aa, Yellow fever virus
PGQQRTIQDN

SEQ ID NO: 171889 - protein, 10 aa, Yellow fever virus
GQQRTIQDNQ

SEQ ID NO: 171890 - protein, 10 aa, Yellow fever virus
QQRTIQDNQV

SEQ ID NO: 171891 - protein, 10 aa, Yellow fever virus
QRTIQDNQVA

SEQ ID NO: 171892 - protein, 10 aa, Yellow fever virus
RSIQDNQVAF

SEQ ID NO: 171893 - protein, 10 aa, Yellow fever virus
TIQDNQVAYL

SEQ ID NO: 171894 - protein, 10 aa, Yellow fever virus
IQDNQVAFLI

SEQ ID NO: 171895 - protein, 10 aa, Yellow fever virus
QDNQVAFLII

SEQ ID NO: 171896 - protein, 10 aa, Yellow fever virus
DNQVAFLIIG

SEQ ID NO: 171897 - protein, 10 aa, Yellow fever virus
NQVAFLIIGI

SEQ ID NO: 171898 - protein, 10 aa, Yellow fever virus
QVAFLIIGIL

SEQ ID NO: 171899 - protein, 10 aa, Yellow fever virus
VAFLIIGILT

SEQ ID NO: 171900 - protein, 10 aa, Yellow fever virus
AFLIIGILTL

SEQ ID NO: 171901 - protein, 10 aa, Yellow fever virus
YLIIGILTLL

SEQ ID NO: 171902 - protein, 10 aa, Yellow fever virus
LIIGILTLLS

SEQ ID NO: 171903 - protein, 10 aa, Yellow fever virus
IIGILTLVSV

SEQ ID NO: 171904 - protein, 10 aa, Yellow fever virus
IGILTLVSVV

SEQ ID NO: 171905 - protein, 10 aa, Yellow fever virus
GILTLVSVVA

SEQ ID NO: 171906 - protein, 10 aa, Yellow fever virus
ILTLVSVVAA

SEQ ID NO: 171907 - protein, 10 aa, Yellow fever virus
LTLVSVVAAN

SEQ ID NO: 171908 - protein, 10 aa, Yellow fever virus
TLVSVVAANE

SEQ ID NO: 171909 - protein, 10 aa, Yellow fever virus
LVSVVAANEL

SEQ ID NO: 171910 - protein, 10 aa, Yellow fever virus
VSVVAANELG

SEQ ID NO: 171911 - protein, 10 aa, Yellow fever virus
SVVAANELGM

SEQ ID NO: 171912 - protein, 10 aa, Yellow fever virus
VVAANELGML

SEQ ID NO: 171913 - protein, 10 aa, Yellow fever virus
AANELGMLER

SEQ ID NO: 171914 - protein, 10 aa, Yellow fever virus
ANELGMLERT

SEQ ID NO: 171915 - protein, 10 aa, Yellow fever virus
NELGMLERTK

SEQ ID NO: 171916 - protein, 10 aa, Yellow fever virus
ELGMLERTKE

SEQ ID NO: 171917 - protein, 10 aa, Yellow fever virus
LGMLERTKED

SEQ ID NO: 171918 - protein, 10 aa, Yellow fever virus
GMLEKTKEDF

SEQ ID NO: 171919 - protein, 10 aa, Yellow fever virus
MLEKTKEDFF

SEQ ID NO: 171920 - protein, 10 aa, Yellow fever virus
LEKTKEDFFG

SEQ ID NO: 171921 - protein, 10 aa, Yellow fever virus
EKTKEDFFGK

SEQ ID NO: 171922 - protein, 10 aa, Yellow fever virus
KTKEDFFGKR

SEQ ID NO: 171923 - protein, 10 aa, Yellow fever virus
TKEDLFGKKD

SEQ ID NO: 171924 - protein, 10 aa, Yellow fever virus
TSGGTIPWSW

SEQ ID NO: 171925 - protein, 10 aa, Yellow fever virus
SGGTIPWSWP

SEQ ID NO: 171926 - protein, 10 aa, Yellow fever virus
GGTIPWSWPD

SEQ ID NO: 171927 - protein, 10 aa, Yellow fever virus
GTIPWSWPDL

SEQ ID NO: 171928 - protein, 10 aa, Yellow fever virus
TIPWSWPDLD

SEQ ID NO: 171929 - protein, 10 aa, Yellow fever virus
IPWSWPDLDL

SEQ ID NO: 171930 - protein, 10 aa, Yellow fever virus
WTVYVGIVTI

SEQ ID NO: 171931 - protein, 10 aa, Yellow fever virus
TVYVGIVTIL

SEQ ID NO: 171932 - protein, 10 aa, Yellow fever virus
VYVGIVTILS

SEQ ID NO: 171933 - protein, 10 aa, Yellow fever virus
YVGIVTILSP

SEQ ID NO: 171934 - protein, 10 aa, Yellow fever virus
VGIVTILSPM

SEQ ID NO: 171935 - protein, 10 aa, Yellow fever virus
GIVTILSPML

SEQ ID NO: 171936 - protein, 10 aa, Yellow fever virus
IVTILSPMLH

SEQ ID NO: 171937 - protein, 10 aa, Yellow fever virus
VTILSPMLHH

SEQ ID NO: 171938 - protein, 10 aa, Yellow fever virus
TILSPMLHHW

SEQ ID NO: 171939 - protein, 10 aa, Yellow fever virus
ILSPMLHHWI

SEQ ID NO: 171940 - protein, 10 aa, Yellow fever virus
SVLSFMDKGV

SEQ ID NO: 171941 - protein, 10 aa, Yellow fever virus
VLSFMDKGVP

SEQ ID NO: 171942 - protein, 10 aa, Yellow fever virus
LSFMDKGVPF

SEQ ID NO: 171943 - protein, 10 aa, Yellow fever virus
SFMDKGVPFM

SEQ ID NO: 171944 - protein, 10 aa, Yellow fever virus
FMDKGVPFMK

SEQ ID NO: 171945 - protein, 10 aa, Yellow fever virus
MDKGVPFMKM

SEQ ID NO: 171946 - protein, 10 aa, Yellow fever virus
DKGVPFMKMN

SEQ ID NO: 171947 - protein, 10 aa, Yellow fever virus
KGVPFMKMNI

SEQ ID NO: 171948 - protein, 10 aa, Yellow fever virus
GVPFMKMNIS

SEQ ID NO: 171949 - protein, 10 aa, Yellow fever virus
VPFMKMNISV

SEQ ID NO: 171950 - protein, 10 aa, Yellow fever virus
PFMKMNISVV

SEQ ID NO: 171951 - protein, 10 aa, Yellow fever virus
FMKMNISVII

SEQ ID NO: 171952 - protein, 10 aa, Yellow fever virus
MKMNISVIIL

SEQ ID NO: 171953 - protein, 10 aa, Yellow fever virus
KMNISVIILL

SEQ ID NO: 171954 - protein, 10 aa, Yellow fever virus
MNISVIILLV

SEQ ID NO: 171955 - protein, 10 aa, Yellow fever virus
NISVIILLVS

SEQ ID NO: 171956 - protein, 10 aa, Yellow fever virus
ISVIILLVSG

SEQ ID NO: 171957 - protein, 10 aa, Yellow fever virus
SVIILLVSGW

SEQ ID NO: 171958 - protein, 10 aa, Yellow fever virus
VIILLVSGWN

SEQ ID NO: 171959 - protein, 10 aa, Yellow fever virus
IILLVSGWNS

SEQ ID NO: 171960 - protein, 10 aa, Yellow fever virus
ILLVSGWNSI

SEQ ID NO: 171961 - protein, 10 aa, Yellow fever virus
LLISGWNSIT

SEQ ID NO: 171962 - protein, 10 aa, Yellow fever virus
LISGWNSITV

SEQ ID NO: 171963 - protein, 10 aa, Yellow fever virus
VSGWNSITVI

SEQ ID NO: 171964 - protein, 10 aa, Yellow fever virus
SGWNSITVIP

SEQ ID NO: 171965 - protein, 10 aa, Yellow fever virus
GWNSITVIPL

SEQ ID NO: 171966 - protein, 10 aa, Yellow fever virus
WNSITVIPLL

SEQ ID NO: 171967 - protein, 10 aa, Yellow fever virus
NSITVIPLLC

SEQ ID NO: 171968 - protein, 10 aa, Yellow fever virus
SITVIPLLCG

SEQ ID NO: 171969 - protein, 10 aa, Yellow fever virus
ITVIPLLCGV

SEQ ID NO: 171970 - protein, 10 aa, Yellow fever virus
TVIPLLCGVG

SEQ ID NO: 171971 - protein, 10 aa, Yellow fever virus
VIPLLCGVGG

SEQ ID NO: 171972 - protein, 10 aa, Yellow fever virus
IPLLCGVGGA

SEQ ID NO: 171973 - protein, 10 aa, Yellow fever virus
PLLCGVGGAM

SEQ ID NO: 171974 - protein, 10 aa, Yellow fever virus
LLCGVGGAML

SEQ ID NO: 171975 - protein, 10 aa, Yellow fever virus
LCGVGGAMLH

SEQ ID NO: 171976 - protein, 10 aa, Yellow fever virus
CGVGGAMLHW

SEQ ID NO: 171977 - protein, 10 aa, Yellow fever virus
GVGGAMLHWT

SEQ ID NO: 171978 - protein, 10 aa, Yellow fever virus
VGGAMLHWTL

SEQ ID NO: 171979 - protein, 10 aa, Yellow fever virus
GGAMLHWTLI

SEQ ID NO: 171980 - protein, 10 aa, Yellow fever virus
GAMLHWTLIL

SEQ ID NO: 171981 - protein, 10 aa, Yellow fever virus
AMLHWTLILP

SEQ ID NO: 171982 - protein, 10 aa, Yellow fever virus
MLHWTLILPG

SEQ ID NO: 171983 - protein, 10 aa, Yellow fever virus
LHWTLILPGI

SEQ ID NO: 171984 - protein, 10 aa, Yellow fever virus
HWTLILPGIK

SEQ ID NO: 171985 - protein, 10 aa, Yellow fever virus
WTLILPGIKA

SEQ ID NO: 171986 - protein, 10 aa, Yellow fever virus
TLILPGIKAQ

SEQ ID NO: 171987 - protein, 10 aa, Yellow fever virus
GIKAQQSKLP

SEQ ID NO: 171988 - protein, 10 aa, Yellow fever virus
IKAQQSKLPQ

SEQ ID NO: 171989 - protein, 10 aa, Yellow fever virus
KAQQSKLAQK

SEQ ID NO: 171990 - protein, 10 aa, Yellow fever virus
AQQSKLAQKR

SEQ ID NO: 171991 - protein, 10 aa, Yellow fever virus
QQSKLAQKRV

SEQ ID NO: 171992 - protein, 10 aa, Yellow fever virus
QSKLAQKRVF

SEQ ID NO: 171993 - protein, 10 aa, Yellow fever virus
SKLAQKRVFH

SEQ ID NO: 171994 - protein, 10 aa, Yellow fever virus
KLAQKRVFHG

SEQ ID NO: 171995 - protein, 10 aa, Yellow fever virus
LAQKRVFHGV

SEQ ID NO: 171996 - protein, 10 aa, Yellow fever virus
AQKRVFHGVA

SEQ ID NO: 171997 - protein, 10 aa, Yellow fever virus
QKRVFHGVAK

SEQ ID NO: 171998 - protein, 10 aa, Yellow fever virus
KRVFHGVAKN

SEQ ID NO: 171999 - protein, 10 aa, Yellow fever virus
RVFHGVAENP

SEQ ID NO: 172000 - protein, 10 aa, Yellow fever virus
VFHGVAENPV

SEQ ID NO: 172001 - protein, 10 aa, Yellow fever virus
FHGVAENPVV

SEQ ID NO: 172002 - protein, 10 aa, Yellow fever virus
HGVAENPVVD

SEQ ID NO: 172003 - protein, 10 aa, Yellow fever virus
GVAENPVVDG

SEQ ID NO: 172004 - protein, 10 aa, Yellow fever virus
VAENPVVDGN

SEQ ID NO: 172005 - protein, 10 aa, Yellow fever virus
AENPVVDGNP

SEQ ID NO: 172006 - protein, 10 aa, Yellow fever virus
ENPVVDGNPT

SEQ ID NO: 172007 - protein, 10 aa, Yellow fever virus
NPVVDGNPTA

SEQ ID NO: 172008 - protein, 10 aa, Yellow fever virus
PVVDGNPTAD

SEQ ID NO: 172009 - protein, 10 aa, Yellow fever virus
VVDGNPTADI

SEQ ID NO: 172010 - protein, 10 aa, Yellow fever virus
VDGNPTADIE

SEQ ID NO: 172011 - protein, 10 aa, Yellow fever virus
DGNPTADIEE

SEQ ID NO: 172012 - protein, 10 aa, Yellow fever virus
GNPTADIEEA

SEQ ID NO: 172013 - protein, 10 aa, Yellow fever virus
NPTADIEEAP

SEQ ID NO: 172014 - protein, 10 aa, Yellow fever virus
PTADIEEAPE

SEQ ID NO: 172015 - protein, 10 aa, Yellow fever virus
TADIEEAPEM

SEQ ID NO: 172016 - protein, 10 aa, Yellow fever virus
ADIEEAPEMP

SEQ ID NO: 172017 - protein, 10 aa, Yellow fever virus
DIEEAPEMPV

SEQ ID NO: 172018 - protein, 10 aa, Yellow fever virus
IEEAPEMPVL

SEQ ID NO: 172019 - protein, 10 aa, Yellow fever virus
EEAPEMPVLY

SEQ ID NO: 172020 - protein, 10 aa, Yellow fever virus
EAPEMPVLYE

SEQ ID NO: 172021 - protein, 10 aa, Yellow fever virus
APEMPVLYEK

SEQ ID NO: 172022 - protein, 10 aa, Yellow fever virus
PEMPVLYEKK

SEQ ID NO: 172023 - protein, 10 aa, Yellow fever virus
EMPVLYEKKL

SEQ ID NO: 172024 - protein, 10 aa, Yellow fever virus
MPVLYEKKLA

SEQ ID NO: 172025 - protein, 10 aa, Yellow fever virus
PVLYEKKLAL

SEQ ID NO: 172026 - protein, 10 aa, Yellow fever virus
VLYEKKLALY

SEQ ID NO: 172027 - protein, 10 aa, Yellow fever virus
LYLLLALSLM

SEQ ID NO: 172028 - protein, 10 aa, Yellow fever virus
YLLLALSLMS

SEQ ID NO: 172029 - protein, 10 aa, Yellow fever virus
LLLALSLMSV

SEQ ID NO: 172030 - protein, 10 aa, Yellow fever virus
LLALSLMSVA

SEQ ID NO: 172031 - protein, 10 aa, Yellow fever virus
LALSLMSVAM

SEQ ID NO: 172032 - protein, 10 aa, Yellow fever virus
ALSLMSVAMC

SEQ ID NO: 172033 - protein, 10 aa, Yellow fever virus
LSLMSVAMCR

SEQ ID NO: 172034 - protein, 10 aa, Yellow fever virus
SLMSVAMCRT

SEQ ID NO: 172035 - protein, 10 aa, Yellow fever virus
LMSVAMCRTP

SEQ ID NO: 172036 - protein, 10 aa, Yellow fever virus
MSVAMCRTPF

SEQ ID NO: 172037 - protein, 10 aa, Yellow fever virus
AMCRTPFSLD

SEQ ID NO: 172038 - protein, 10 aa, Yellow fever virus
MCRTPFSLDE

SEQ ID NO: 172039 - protein, 10 aa, Yellow fever virus
CRTPFSLDEG

SEQ ID NO: 172040 - protein, 10 aa, Yellow fever virus
RTPFSLDEGI

SEQ ID NO: 172041 - protein, 10 aa, Yellow fever virus
TPFSLDEGIV

SEQ ID NO: 172042 - protein, 10 aa, Yellow fever virus
PFSLDEGIVL

SEQ ID NO: 172043 - protein, 10 aa, Yellow fever virus
FSLAEGIVLS

SEQ ID NO: 172044 - protein, 10 aa, Yellow fever virus
SLAEGIVLSS

SEQ ID NO: 172045 - protein, 10 aa, Yellow fever virus
LAEGIVLSSA

SEQ ID NO: 172046 - protein, 10 aa, Yellow fever virus
AEGIVLSSAA

SEQ ID NO: 172047 - protein, 10 aa, Yellow fever virus
EGIVLASAAS

SEQ ID NO: 172048 - protein, 10 aa, Yellow fever virus
GIVLASAASG

SEQ ID NO: 172049 - protein, 10 aa, Yellow fever virus
IVLASAASGP

SEQ ID NO: 172050 - protein, 10 aa, Yellow fever virus
VLASAASGPL

SEQ ID NO: 172051 - protein, 10 aa, Yellow fever virus
LASAASGPLI

SEQ ID NO: 172052 - protein, 10 aa, Yellow fever virus
ASAASGPLIE

SEQ ID NO: 172053 - protein, 10 aa, Yellow fever virus
SAASGPLIEG

SEQ ID NO: 172054 - protein, 10 aa, Yellow fever virus
AASGPLIEGN

SEQ ID NO: 172055 - protein, 10 aa, Yellow fever virus
ASGPLIEGNT

SEQ ID NO: 172056 - protein, 10 aa, Yellow fever virus
SGPLIEGNTS

SEQ ID NO: 172057 - protein, 10 aa, Yellow fever virus
SMTGVMRGNY

SEQ ID NO: 172058 - protein, 10 aa, Yellow fever virus
MTGVMRGNYY

SEQ ID NO: 172059 - protein, 10 aa, Yellow fever virus
TGVMRGNYYA

SEQ ID NO: 172060 - protein, 10 aa, Yellow fever virus
GVMRGNYYAF

SEQ ID NO: 172061 - protein, 10 aa, Yellow fever virus
VMRGNYYAFV

SEQ ID NO: 172062 - protein, 10 aa, Yellow fever virus
MRGNYYAFVG

SEQ ID NO: 172063 - protein, 10 aa, Yellow fever virus
RGNYYAFVGV

SEQ ID NO: 172064 - protein, 10 aa, Yellow fever virus
GNYYAFVGVM

SEQ ID NO: 172065 - protein, 10 aa, Yellow fever virus
NYYAFVGVMY

SEQ ID NO: 172066 - protein, 10 aa, Yellow fever virus
YYAFVGVMYN

SEQ ID NO: 172067 - protein, 10 aa, Yellow fever virus
YAFVGVAYNL

SEQ ID NO: 172068 - protein, 10 aa, Yellow fever virus
AFVGVAYNLW

SEQ ID NO: 172069 - protein, 10 aa, Yellow fever virus
FVGVAYNLWK

SEQ ID NO: 172070 - protein, 10 aa, Yellow fever virus
VGVAYNLWKM

SEQ ID NO: 172071 - protein, 10 aa, Yellow fever virus
GVMYNLWKME

SEQ ID NO: 172072 - protein, 10 aa, Yellow fever virus
VMYNLWKMET

SEQ ID NO: 172073 - protein, 10 aa, Yellow fever virus
MYNLWKMETG

SEQ ID NO: 172074 - protein, 10 aa, Yellow fever virus
YNLWKMETGR

SEQ ID NO: 172075 - protein, 10 aa, Yellow fever virus
NLWKMETGRR

SEQ ID NO: 172076 - protein, 10 aa, Yellow fever virus
LWKMETGRRG

SEQ ID NO: 172077 - protein, 10 aa, Yellow fever virus
RRGRANGKTL

SEQ ID NO: 172078 - protein, 10 aa, Yellow fever virus
RGRANGKTLG

SEQ ID NO: 172079 - protein, 10 aa, Yellow fever virus
GRANGKTLGE

SEQ ID NO: 172080 - protein, 10 aa, Yellow fever virus
RANGKTLGEV

SEQ ID NO: 172081 - protein, 10 aa, Yellow fever virus
ASGKTLGEVW

SEQ ID NO: 172082 - protein, 10 aa, Yellow fever virus
SGKTLGEVWK

SEQ ID NO: 172083 - protein, 10 aa, Yellow fever virus
WKRELNLLDR

SEQ ID NO: 172084 - protein, 10 aa, Yellow fever virus
KRELNLLDKR

SEQ ID NO: 172085 - protein, 10 aa, Yellow fever virus
RELNLLDKRQ

SEQ ID NO: 172086 - protein, 10 aa, Yellow fever virus
ELNLLDKRQF

SEQ ID NO: 172087 - protein, 10 aa, Yellow fever virus
LNLLDKRQFE

SEQ ID NO: 172088 - protein, 10 aa, Yellow fever virus
NLLDKRQFEL

SEQ ID NO: 172089 - protein, 10 aa, Yellow fever virus
LLDKRQFELY

SEQ ID NO: 172090 - protein, 10 aa, Yellow fever virus
LDKRQFELYK

SEQ ID NO: 172091 - protein, 10 aa, Yellow fever virus
DKQQFELYKR

SEQ ID NO: 172092 - protein, 10 aa, Yellow fever virus
KRQFELYKRT

SEQ ID NO: 172093 - protein, 10 aa, Yellow fever virus
RQFELYKRTD

SEQ ID NO: 172094 - protein, 10 aa, Yellow fever virus
QFEMYKRTDI

SEQ ID NO: 172095 - protein, 10 aa, Yellow fever virus
FELYKRTDIT

SEQ ID NO: 172096 - protein, 10 aa, Yellow fever virus
ELYKRTDITE

SEQ ID NO: 172097 - protein, 10 aa, Yellow fever virus
LYKRTDITEV

SEQ ID NO: 172098 - protein, 10 aa, Yellow fever virus
YKRTDITEVD

SEQ ID NO: 172099 - protein, 10 aa, Yellow fever virus
KRTDITEVDR

SEQ ID NO: 172100 - protein, 10 aa, Yellow fever virus
RTDITEVDRD

SEQ ID NO: 172101 - protein, 10 aa, Yellow fever virus
TDITEVDRDM

SEQ ID NO: 172102 - protein, 10 aa, Yellow fever virus
DITEVDRDMA

SEQ ID NO: 172103 - protein, 10 aa, Yellow fever virus
ITEVDRDMAR

SEQ ID NO: 172104 - protein, 10 aa, Yellow fever virus
TEVDRDMARR

SEQ ID NO: 172105 - protein, 10 aa, Yellow fever virus
EVDRDMARRH

SEQ ID NO: 172106 - protein, 10 aa, Yellow fever virus
VDRDMARRHL

SEQ ID NO: 172107 - protein, 10 aa, Yellow fever virus
DRDMARRHLA

SEQ ID NO: 172108 - protein, 10 aa, Yellow fever virus
RDMARRHLAE

SEQ ID NO: 172109 - protein, 10 aa, Yellow fever virus
DMARRHLAEG

SEQ ID NO: 172110 - protein, 10 aa, Yellow fever virus
MARRHLAEGK

SEQ ID NO: 172111 - protein, 10 aa, Yellow fever virus
GYVKLEGRVT

SEQ ID NO: 172112 - protein, 10 aa, Yellow fever virus
YVKLEGRVTD

SEQ ID NO: 172113 - protein, 10 aa, Yellow fever virus
VKLEGRVTDL

SEQ ID NO: 172114 - protein, 10 aa, Yellow fever virus
KLEGRVTDLG

SEQ ID NO: 172115 - protein, 10 aa, Yellow fever virus
LEGRVTDLGC

SEQ ID NO: 172116 - protein, 10 aa, Yellow fever virus
EGRVTDLGCG

SEQ ID NO: 172117 - protein, 10 aa, Yellow fever virus
GRVTDLGCGR

SEQ ID NO: 172118 - protein, 10 aa, Yellow fever virus
RVTDLGCGRG

SEQ ID NO: 172119 - protein, 10 aa, Yellow fever virus
VTDLGCGRGG

SEQ ID NO: 172120 - protein, 10 aa, Yellow fever virus
TDLGCGRGGW

SEQ ID NO: 172121 - protein, 10 aa, Yellow fever virus
QKEVSGVKGY

SEQ ID NO: 172122 - protein, 10 aa, Yellow fever virus
KEVSGVKGYT

SEQ ID NO: 172123 - protein, 10 aa, Yellow fever virus
EVSGVKGYTL

SEQ ID NO: 172124 - protein, 10 aa, Yellow fever virus
VSGVKGYTLG

SEQ ID NO: 172125 - protein, 10 aa, Yellow fever virus
SGVKGYTLGR

SEQ ID NO: 172126 - protein, 10 aa, Yellow fever virus
GVKGYTLGRD

SEQ ID NO: 172127 - protein, 10 aa, Yellow fever virus
VKGYTLGRDG

SEQ ID NO: 172128 - protein, 10 aa, Yellow fever virus
KGYTLGRDGH

SEQ ID NO: 172129 - protein, 10 aa, Yellow fever virus
GYTLGRDGHE

SEQ ID NO: 172130 - protein, 10 aa, Yellow fever virus
YTLGRDGHEK

SEQ ID NO: 172131 - protein, 10 aa, Yellow fever virus
TLGREGHEKP

SEQ ID NO: 172132 - protein, 10 aa, Yellow fever virus
LGREGHEKPM

SEQ ID NO: 172133 - protein, 10 aa, Yellow fever virus
GREGHEKPMN

SEQ ID NO: 172134 - protein, 10 aa, Yellow fever virus
REGHEKPMNV

SEQ ID NO: 172135 - protein, 10 aa, Yellow fever virus
EGHEKPMNVR

SEQ ID NO: 172136 - protein, 10 aa, Yellow fever virus
GHEKPMNVRS

SEQ ID NO: 172137 - protein, 10 aa, Yellow fever virus
HEKPMNVRSL

SEQ ID NO: 172138 - protein, 10 aa, Yellow fever virus
EKPMNVRSLG

SEQ ID NO: 172139 - protein, 10 aa, Yellow fever virus
KPMNVRSLGW

SEQ ID NO: 172140 - protein, 10 aa, Yellow fever virus
PMNVRSLGWN

SEQ ID NO: 172141 - protein, 10 aa, Yellow fever virus
MNVRSLGWNI

SEQ ID NO: 172142 - protein, 10 aa, Yellow fever virus
NVQSLGWNIV

SEQ ID NO: 172143 - protein, 10 aa, Yellow fever virus
VQSLGWNIVT

SEQ ID NO: 172144 - protein, 10 aa, Yellow fever virus
QSLGWNIVTF

SEQ ID NO: 172145 - protein, 10 aa, Yellow fever virus
SLGWNIVTFK

SEQ ID NO: 172146 - protein, 10 aa, Yellow fever virus
LGWNIVTFKD

SEQ ID NO: 172147 - protein, 10 aa, Yellow fever virus
GWNIVTFKDK

SEQ ID NO: 172148 - protein, 10 aa, Yellow fever virus
WNIVTFKDKT

SEQ ID NO: 172149 - protein, 10 aa, Yellow fever virus
NIVTFKDKTD

SEQ ID NO: 172150 - protein, 10 aa, Yellow fever virus
IVTFKDKTDI

SEQ ID NO: 172151 - protein, 10 aa, Yellow fever virus
VTFKDKTDIH

SEQ ID NO: 172152 - protein, 10 aa, Yellow fever virus
TFKDKTDVHR

SEQ ID NO: 172153 - protein, 10 aa, Yellow fever virus
FKDKTDVHPL

SEQ ID NO: 172154 - protein, 10 aa, Yellow fever virus
KDKTDIHHLE

SEQ ID NO: 172155 - protein, 10 aa, Yellow fever virus
DKTDIHHLEP

SEQ ID NO: 172156 - protein, 10 aa, Yellow fever virus
LEPAKCETLL

SEQ ID NO: 172157 - protein, 10 aa, Yellow fever virus
EPAKCETLLC

SEQ ID NO: 172158 - protein, 10 aa, Yellow fever virus
PAKCETLLCD

SEQ ID NO: 172159 - protein, 10 aa, Yellow fever virus
AKCETLLCDI

SEQ ID NO: 172160 - protein, 10 aa, Yellow fever virus
KCETLLCDIG

SEQ ID NO: 172161 - protein, 10 aa, Yellow fever virus
CETLLCDIGE

SEQ ID NO: 172162 - protein, 10 aa, Yellow fever virus
ETLLCDIGES

SEQ ID NO: 172163 - protein, 10 aa, Yellow fever virus
LLCDIGESSP

SEQ ID NO: 172164 - protein, 10 aa, Yellow fever virus
LCDIGESSPS

SEQ ID NO: 172165 - protein, 10 aa, Yellow fever virus
CDIGESSPSS

SEQ ID NO: 172166 - protein, 10 aa, Yellow fever virus
DIGESSPSSV

SEQ ID NO: 172167 - protein, 10 aa, Yellow fever virus
IGESSPSSVT

SEQ ID NO: 172168 - protein, 10 aa, Yellow fever virus
GESSPSSVTE

SEQ ID NO: 172169 - protein, 10 aa, Yellow fever virus
ESSPSSVTEG

SEQ ID NO: 172170 - protein, 10 aa, Yellow fever virus
SSPSSVTEGE

SEQ ID NO: 172171 - protein, 10 aa, Yellow fever virus
SPSSVTEGER

SEQ ID NO: 172172 - protein, 10 aa, Yellow fever virus
PSSVTEGERT

SEQ ID NO: 172173 - protein, 10 aa, Yellow fever virus
SSVTEGERTM

SEQ ID NO: 172174 - protein, 10 aa, Yellow fever virus
SVTEGERTMR

SEQ ID NO: 172175 - protein, 10 aa, Yellow fever virus
VTEGERTMRV

SEQ ID NO: 172176 - protein, 10 aa, Yellow fever virus
TEGERTLRVL

SEQ ID NO: 172177 - protein, 10 aa, Yellow fever virus
EGERTMRVLD

SEQ ID NO: 172178 - protein, 10 aa, Yellow fever virus
GERTMRVLDT

SEQ ID NO: 172179 - protein, 10 aa, Yellow fever virus
ERTMRVLDTV

SEQ ID NO: 172180 - protein, 10 aa, Yellow fever virus
RTMRVLDTVE

SEQ ID NO: 172181 - protein, 10 aa, Yellow fever virus
TMRVLDTVEK

SEQ ID NO: 172182 - protein, 10 aa, Yellow fever virus
MRVLDTVEKW

SEQ ID NO: 172183 - protein, 10 aa, Yellow fever virus
RVLETVEKWL

SEQ ID NO: 172184 - protein, 10 aa, Yellow fever virus
VLETIEKWLA

SEQ ID NO: 172185 - protein, 10 aa, Yellow fever virus
LETIEKWLAC

SEQ ID NO: 172186 - protein, 10 aa, Yellow fever virus
ETIEKWLACG

SEQ ID NO: 172187 - protein, 10 aa, Yellow fever virus
TIEKWLACGV

SEQ ID NO: 172188 - protein, 10 aa, Yellow fever virus
IEKWLACGVD

SEQ ID NO: 172189 - protein, 10 aa, Yellow fever virus
LACGVDNFCI

SEQ ID NO: 172190 - protein, 10 aa, Yellow fever virus
ACGVDNFCIK

SEQ ID NO: 172191 - protein, 10 aa, Yellow fever virus
CGVDNFCIKV

SEQ ID NO: 172192 - protein, 10 aa, Yellow fever virus
GVDNFCIKVL

SEQ ID NO: 172193 - protein, 10 aa, Yellow fever virus
VDNFCIKVLA

SEQ ID NO: 172194 - protein, 10 aa, Yellow fever virus
DNFCIKVLAP

SEQ ID NO: 172195 - protein, 10 aa, Yellow fever virus
NFCIKVLAPY

SEQ ID NO: 172196 - protein, 10 aa, Yellow fever virus
FCIKVLAPYM

SEQ ID NO: 172197 - protein, 10 aa, Yellow fever virus
CIKVLAPYMP

SEQ ID NO: 172198 - protein, 10 aa, Yellow fever virus
VKVLAPYMRD

SEQ ID NO: 172199 - protein, 10 aa, Yellow fever virus
KVLAPYMRDV

SEQ ID NO: 172200 - protein, 10 aa, Yellow fever virus
VLAPYMPDVI

SEQ ID NO: 172201 - protein, 10 aa, Yellow fever virus
LAPYMPDVIE

SEQ ID NO: 172202 - protein, 10 aa, Yellow fever virus
APYMPDVIEK

SEQ ID NO: 172203 - protein, 10 aa, Yellow fever virus
PYMPDVIEKL

SEQ ID NO: 172204 - protein, 10 aa, Yellow fever virus
YMPDVIEKLE

SEQ ID NO: 172205 - protein, 10 aa, Yellow fever virus
MPDVIEKLEL

SEQ ID NO: 172206 - protein, 10 aa, Yellow fever virus
PDVIEKLELL

SEQ ID NO: 172207 - protein, 10 aa, Yellow fever virus
DVIEKLELLQ

SEQ ID NO: 172208 - protein, 10 aa, Yellow fever virus
VIEKLELLQR

SEQ ID NO: 172209 - protein, 10 aa, Yellow fever virus
IEKLELLQRR

SEQ ID NO: 172210 - protein, 10 aa, Yellow fever virus
LLQRRFGGTI

SEQ ID NO: 172211 - protein, 10 aa, Yellow fever virus
LQRRFGGTII

SEQ ID NO: 172212 - protein, 10 aa, Yellow fever virus
QRRFGGTIIR

SEQ ID NO: 172213 - protein, 10 aa, Yellow fever virus
RRFGGTIIRN

SEQ ID NO: 172214 - protein, 10 aa, Yellow fever virus
RFGGTIIRNP

SEQ ID NO: 172215 - protein, 10 aa, Yellow fever virus
FGGTIIRNPL

SEQ ID NO: 172216 - protein, 10 aa, Yellow fever virus
GGTIIRNPLS

SEQ ID NO: 172217 - protein, 10 aa, Yellow fever virus
GTIIRNPLSR

SEQ ID NO: 172218 - protein, 10 aa, Yellow fever virus
TIIRNPLSRN

SEQ ID NO: 172219 - protein, 10 aa, Yellow fever virus
IIRNPLSRNS

SEQ ID NO: 172220 - protein, 10 aa, Yellow fever virus
YYVSGARSNI

SEQ ID NO: 172221 - protein, 10 aa, Yellow fever virus
YVSGARSNIT

SEQ ID NO: 172222 - protein, 10 aa, Yellow fever virus
VSGARSNITF

SEQ ID NO: 172223 - protein, 10 aa, Yellow fever virus
SGARSNITFT

SEQ ID NO: 172224 - protein, 10 aa, Yellow fever virus
GARSNITFTV

SEQ ID NO: 172225 - protein, 10 aa, Yellow fever virus
ARSNITFTVN

SEQ ID NO: 172226 - protein, 10 aa, Yellow fever virus
RSNITFTVNQ

SEQ ID NO: 172227 - protein, 10 aa, Yellow fever virus
SNITFTVNQT

SEQ ID NO: 172228 - protein, 10 aa, Yellow fever virus
NITFTVNQTS

SEQ ID NO: 172229 - protein, 10 aa, Yellow fever virus
ITFTVNQTSR

SEQ ID NO: 172230 - protein, 10 aa, Yellow fever virus
RPTGKVTLEP

SEQ ID NO: 172231 - protein, 10 aa, Yellow fever virus
PTGKVTLEPD

SEQ ID NO: 172232 - protein, 10 aa, Yellow fever virus
TGKVTLEPDV

SEQ ID NO: 172233 - protein, 10 aa, Yellow fever virus
GKVTLEADVT

SEQ ID NO: 172234 - protein, 10 aa, Yellow fever virus
KVTLEADVTL

SEQ ID NO: 172235 - protein, 10 aa, Yellow fever virus
VTLEPDVILP

SEQ ID NO: 172236 - protein, 10 aa, Yellow fever virus
TLEADVTLPI

SEQ ID NO: 172237 - protein, 10 aa, Yellow fever virus
LEADVTLPIG

SEQ ID NO: 172238 - protein, 10 aa, Yellow fever virus
EADVTLPIGT

SEQ ID NO: 172239 - protein, 10 aa, Yellow fever virus
ADVTLPIGTR

SEQ ID NO: 172240 - protein, 10 aa, Yellow fever virus
DVTLPIGTRS

SEQ ID NO: 172241 - protein, 10 aa, Yellow fever virus
VTLPIGTRSV

SEQ ID NO: 172242 - protein, 10 aa, Yellow fever virus
TLPIGTRSVE

SEQ ID NO: 172243 - protein, 10 aa, Yellow fever virus
SVETDKGPLN

SEQ ID NO: 172244 - protein, 10 aa, Yellow fever virus
VETDKGPLDR

SEQ ID NO: 172245 - protein, 10 aa, Yellow fever virus
DAIEERVERI

SEQ ID NO: 172246 - protein, 10 aa, Yellow fever virus
AIKERVERIK

SEQ ID NO: 172247 - protein, 10 aa, Yellow fever virus
IEERVERIKT

SEQ ID NO: 172248 - protein, 10 aa, Yellow fever virus
EERVERIKTE

SEQ ID NO: 172249 - protein, 10 aa, Yellow fever virus
ERVERIKTEY

SEQ ID NO: 172250 - protein, 10 aa, Yellow fever virus
RVERIKTEYA

SEQ ID NO: 172251 - protein, 10 aa, Yellow fever virus
VERIKTEYAA

SEQ ID NO: 172252 - protein, 10 aa, Yellow fever virus
ERIKSEYMTT

SEQ ID NO: 172253 - protein, 10 aa, Yellow fever virus
RIKSEYMTTW

SEQ ID NO: 172254 - protein, 10 aa, Yellow fever virus
IKSEYMTTWF

SEQ ID NO: 172255 - protein, 10 aa, Yellow fever virus
KSEYMTTWFY

SEQ ID NO: 172256 - protein, 10 aa, Yellow fever virus
SEYMTTWFYD

SEQ ID NO: 172257 - protein, 10 aa, Yellow fever virus
EYMTTWFYDN

SEQ ID NO: 172258 - protein, 10 aa, Yellow fever virus
YMTTWFYDND

SEQ ID NO: 172259 - protein, 10 aa, Yellow fever virus
MTTWFYDNDN

SEQ ID NO: 172260 - protein, 10 aa, Yellow fever virus
TTWFYDNDNP

SEQ ID NO: 172261 - protein, 10 aa, Yellow fever virus
TWFYDNDNPY

SEQ ID NO: 172262 - protein, 10 aa, Yellow fever virus
WFHDNDNPYR

SEQ ID NO: 172263 - protein, 10 aa, Yellow fever virus
FHDNDNPYRT

SEQ ID NO: 172264 - protein, 10 aa, Yellow fever virus
HDNDNPYRTW

SEQ ID NO: 172265 - protein, 10 aa, Yellow fever virus
RTWHYCGSYI

SEQ ID NO: 172266 - protein, 10 aa, Yellow fever virus
TWHYCGSYIT

SEQ ID NO: 172267 - protein, 10 aa, Yellow fever virus
WHYCGSYITK

SEQ ID NO: 172268 - protein, 10 aa, Yellow fever virus
HYCGSYITKT

SEQ ID NO: 172269 - protein, 10 aa, Yellow fever virus
YCGSYITKTS

SEQ ID NO: 172270 - protein, 10 aa, Yellow fever virus
CGSYITKTSG

SEQ ID NO: 172271 - protein, 10 aa, Yellow fever virus
GSYITKTSGS

SEQ ID NO: 172272 - protein, 10 aa, Yellow fever virus
SYITKTSGSA

SEQ ID NO: 172273 - protein, 10 aa, Yellow fever virus
YITKTSGSAA

SEQ ID NO: 172274 - protein, 10 aa, Yellow fever virus
ITKTSGSAAS

SEQ ID NO: 172275 - protein, 10 aa, Yellow fever virus
KTSGSAASMI

SEQ ID NO: 172276 - protein, 10 aa, Yellow fever virus
TSGSAASMIN

SEQ ID NO: 172277 - protein, 10 aa, Yellow fever virus
SGSAASMING

SEQ ID NO: 172278 - protein, 10 aa, Yellow fever virus
GSAASMINGV

SEQ ID NO: 172279 - protein, 10 aa, Yellow fever virus
SAASMINGVI

SEQ ID NO: 172280 - protein, 10 aa, Yellow fever virus
AASMINGVIK

SEQ ID NO: 172281 - protein, 10 aa, Yellow fever virus
ASMINGVIKI

SEQ ID NO: 172282 - protein, 10 aa, Yellow fever virus
SMINGVIKIL

SEQ ID NO: 172283 - protein, 10 aa, Yellow fever virus
MINGVIKILT

SEQ ID NO: 172284 - protein, 10 aa, Yellow fever virus
INGVIKILTF

SEQ ID NO: 172285 - protein, 10 aa, Yellow fever virus
NGVIKILTFP

SEQ ID NO: 172286 - protein, 10 aa, Yellow fever virus
GVIKILTFPW

SEQ ID NO: 172287 - protein, 10 aa, Yellow fever virus
VIKILTFPWD

SEQ ID NO: 172288 - protein, 10 aa, Yellow fever virus
IKILTFPWDR

SEQ ID NO: 172289 - protein, 10 aa, Yellow fever virus
KILTFPWDRI

SEQ ID NO: 172290 - protein, 10 aa, Yellow fever virus
ILTFPWDRIE

SEQ ID NO: 172291 - protein, 10 aa, Yellow fever virus
LTFPWDRIEE

SEQ ID NO: 172292 - protein, 10 aa, Yellow fever virus
TFPWDRIEEV

SEQ ID NO: 172293 - protein, 10 aa, Yellow fever virus
FPWDRIEEVT

SEQ ID NO: 172294 - protein, 10 aa, Yellow fever virus
PWDKIEEVTR

SEQ ID NO: 172295 - protein, 10 aa, Yellow fever virus
WDKIEEVTRM

SEQ ID NO: 172296 - protein, 10 aa, Yellow fever virus
DKIEEVTRMA

SEQ ID NO: 172297 - protein, 10 aa, Yellow fever virus
KIEEVTRMAM

SEQ ID NO: 172298 - protein, 10 aa, Yellow fever virus
PPAGTRKIMR

SEQ ID NO: 172299 - protein, 10 aa, Yellow fever virus
PAGTRKIMRV

SEQ ID NO: 172300 - protein, 10 aa, Yellow fever virus
AGTRKIMRVV

SEQ ID NO: 172301 - protein, 10 aa, Yellow fever virus
GTRKIMRVVN

SEQ ID NO: 172302 - protein, 10 aa, Yellow fever virus
TRKIMRVVNR

SEQ ID NO: 172303 - protein, 10 aa, Yellow fever virus
RKIMRVVNRW

SEQ ID NO: 172304 - protein, 10 aa, Yellow fever virus
KIMRVVNRWL

SEQ ID NO: 172305 - protein, 10 aa, Yellow fever virus
IMRVVNRWLF

SEQ ID NO: 172306 - protein, 10 aa, Yellow fever virus
MRVVNRWLFR

SEQ ID NO: 172307 - protein, 10 aa, Yellow fever virus
RVVNRWLFRH

SEQ ID NO: 172308 - protein, 10 aa, Yellow fever virus
VNRWLFRHLS

SEQ ID NO: 172309 - protein, 10 aa, Yellow fever virus
NRWLFRHLSR

SEQ ID NO: 172310 - protein, 10 aa, Yellow fever virus
RWLFRHLSRE

SEQ ID NO: 172311 - protein, 10 aa, Yellow fever virus
WLFRHLSREK

SEQ ID NO: 172312 - protein, 10 aa, Yellow fever virus
LFRHLAREKS

SEQ ID NO: 172313 - protein, 10 aa, Yellow fever virus
FRHLAREKSP

SEQ ID NO: 172314 - protein, 10 aa, Yellow fever virus
RHLAREKSPR

SEQ ID NO: 172315 - protein, 10 aa, Yellow fever virus
HLAREKSPRL

SEQ ID NO: 172316 - protein, 10 aa, Yellow fever virus
LAREKSPRLC

SEQ ID NO: 172317 - protein, 10 aa, Yellow fever virus
AREKSPRLCT

SEQ ID NO: 172318 - protein, 10 aa, Yellow fever virus
REKSPRLCTK

SEQ ID NO: 172319 - protein, 10 aa, Yellow fever virus
EKSPRLCTKE

SEQ ID NO: 172320 - protein, 10 aa, Yellow fever virus
KSPRLCTKEE

SEQ ID NO: 172321 - protein, 10 aa, Yellow fever virus
SPRLCTKEEF

SEQ ID NO: 172322 - protein, 10 aa, Yellow fever virus
IAKVRSHAAV

SEQ ID NO: 172323 - protein, 10 aa, Yellow fever virus
AKVRSHAAVG

SEQ ID NO: 172324 - protein, 10 aa, Yellow fever virus
KVRSHAAVGA

SEQ ID NO: 172325 - protein, 10 aa, Yellow fever virus
VRSHAAVGAF

SEQ ID NO: 172326 - protein, 10 aa, Yellow fever virus
RSHAAVGAFL

SEQ ID NO: 172327 - protein, 10 aa, Yellow fever virus
SHAAVGAFLE

SEQ ID NO: 172328 - protein, 10 aa, Yellow fever virus
HAAVGAFLEE

SEQ ID NO: 172329 - protein, 10 aa, Yellow fever virus
AAVGAFLEEQ

SEQ ID NO: 172330 - protein, 10 aa, Yellow fever virus
AVGAFLEEQE

SEQ ID NO: 172331 - protein, 10 aa, Yellow fever virus
VGAFLEEQEQ

SEQ ID NO: 172332 - protein, 10 aa, Yellow fever virus
GAFLEEQEQW

SEQ ID NO: 172333 - protein, 10 aa, Yellow fever virus
AFLEEQEQWK

SEQ ID NO: 172334 - protein, 10 aa, Yellow fever virus
FLEEQEQWKT

SEQ ID NO: 172335 - protein, 10 aa, Yellow fever virus
LEEQDQWKTA

SEQ ID NO: 172336 - protein, 10 aa, Yellow fever virus
EEQDQWKTAN

SEQ ID NO: 172337 - protein, 10 aa, Yellow fever virus
EQDQWKTANE

SEQ ID NO: 172338 - protein, 10 aa, Yellow fever virus
QDQWKTANEA

SEQ ID NO: 172339 - protein, 10 aa, Yellow fever virus
DQWKTANEAV

SEQ ID NO: 172340 - protein, 10 aa, Yellow fever virus
AVQDPKFWEM

SEQ ID NO: 172341 - protein, 10 aa, Yellow fever virus
VQDPKFWEMV

SEQ ID NO: 172342 - protein, 10 aa, Yellow fever virus
QDPKFWEMVD

SEQ ID NO: 172343 - protein, 10 aa, Yellow fever virus
DPKFWEMVDA

SEQ ID NO: 172344 - protein, 10 aa, Yellow fever virus
PKFWEMVDAE

SEQ ID NO: 172345 - protein, 10 aa, Yellow fever virus
KFWEMVDAER

SEQ ID NO: 172346 - protein, 10 aa, Yellow fever virus
FWEMVDAERK

SEQ ID NO: 172347 - protein, 10 aa, Yellow fever virus
WEMVDAERKL

SEQ ID NO: 172348 - protein, 10 aa, Yellow fever virus
EMVDAERKLH

SEQ ID NO: 172349 - protein, 10 aa, Yellow fever virus
MVDAERKLHQ

SEQ ID NO: 172350 - protein, 10 aa, Yellow fever virus
VDAERKLHQQ

SEQ ID NO: 172351 - protein, 10 aa, Yellow fever virus
DAERKLHQQG

SEQ ID NO: 172352 - protein, 10 aa, Yellow fever virus
AERKLHQQGR

SEQ ID NO: 172353 - protein, 10 aa, Yellow fever virus
ERRLHQQGRC

SEQ ID NO: 172354 - protein, 10 aa, Yellow fever virus
RKLHQQGRCQ

SEQ ID NO: 172355 - protein, 10 aa, Yellow fever virus
KLHQQGRCQS

SEQ ID NO: 172356 - protein, 10 aa, Yellow fever virus
LHQQGRCQSC

SEQ ID NO: 172357 - protein, 10 aa, Yellow fever virus
HQQGRCQSCV

SEQ ID NO: 172358 - protein, 10 aa, Yellow fever virus
QQGRCQSCVY

SEQ ID NO: 172359 - protein, 10 aa, Yellow fever virus
QGRCQSCVYN

SEQ ID NO: 172360 - protein, 10 aa, Yellow fever virus
GRCQSCVYNM

SEQ ID NO: 172361 - protein, 10 aa, Yellow fever virus
RCQSCVYNMM

SEQ ID NO: 172362 - protein, 10 aa, Yellow fever virus
CQSCVYNMMG

SEQ ID NO: 172363 - protein, 10 aa, Yellow fever virus
QSCVYNMMGK

SEQ ID NO: 172364 - protein, 10 aa, Yellow fever virus
SCVYNMMGKR

SEQ ID NO: 172365 - protein, 10 aa, Yellow fever virus
IWYMWLGARF

SEQ ID NO: 172366 - protein, 10 aa, Yellow fever virus
WYMWLGARFL

SEQ ID NO: 172367 - protein, 10 aa, Yellow fever virus
YMWLGARFLE

SEQ ID NO: 172368 - protein, 10 aa, Yellow fever virus
MWLGARFLEF

SEQ ID NO: 172369 - protein, 10 aa, Yellow fever virus
WLGARFLEFE

SEQ ID NO: 172370 - protein, 10 aa, Yellow fever virus
LGARFLEFEA

SEQ ID NO: 172371 - protein, 10 aa, Yellow fever virus
GARFLEFEAL

SEQ ID NO: 172372 - protein, 10 aa, Yellow fever virus
ARFLEFEALG

SEQ ID NO: 172373 - protein, 10 aa, Yellow fever virus
RFLEFEALGF

SEQ ID NO: 172374 - protein, 10 aa, Yellow fever virus
FLEFEALGFL

SEQ ID NO: 172375 - protein, 10 aa, Yellow fever virus
ENSGGGVEGT

SEQ ID NO: 172376 - protein, 10 aa, Yellow fever virus
NSGGGVEGTG

SEQ ID NO: 172377 - protein, 10 aa, Yellow fever virus
SGGGVEGTGL

SEQ ID NO: 172378 - protein, 10 aa, Yellow fever virus
GGGVEGTGLQ

SEQ ID NO: 172379 - protein, 10 aa, Yellow fever virus
GGVEGTGLQY

SEQ ID NO: 172380 - protein, 10 aa, Yellow fever virus
GVEGTGLQYL

SEQ ID NO: 172381 - protein, 10 aa, Yellow fever virus
VEGTGLQYLG

SEQ ID NO: 172382 - protein, 10 aa, Yellow fever virus
EGTGLQYLGY

SEQ ID NO: 172383 - protein, 10 aa, Yellow fever virus
GTGLQYLGYV

SEQ ID NO: 172384 - protein, 10 aa, Yellow fever virus
TGLQYLGYVI

SEQ ID NO: 172385 - protein, 10 aa, Yellow fever virus
GLQYLGYVIK

SEQ ID NO: 172386 - protein, 10 aa, Yellow fever virus
LQYLGYVIKD

SEQ ID NO: 172387 - protein, 10 aa, Yellow fever virus
QYLGYVIKDL

SEQ ID NO: 172388 - protein, 10 aa, Yellow fever virus
YLGYVIKDLS

SEQ ID NO: 172389 - protein, 10 aa, Yellow fever virus
LGYVIKDLST

SEQ ID NO: 172390 - protein, 10 aa, Yellow fever virus
GYVIKDLSTK

SEQ ID NO: 172391 - protein, 10 aa, Yellow fever virus
YVIKDLSTKE

SEQ ID NO: 172392 - protein, 10 aa, Yellow fever virus
VIKDLSTKEG

SEQ ID NO: 172393 - protein, 10 aa, Yellow fever virus
IKDLSTKEGG

SEQ ID NO: 172394 - protein, 10 aa, Yellow fever virus
KDLSTKEGGG

SEQ ID NO: 172395 - protein, 10 aa, Yellow fever virus
DLSTKEGGGF

SEQ ID NO: 172396 - protein, 10 aa, Yellow fever virus
LSTKEGGGFY

SEQ ID NO: 172397 - protein, 10 aa, Yellow fever virus
STKEGGGFYA

SEQ ID NO: 172398 - protein, 10 aa, Yellow fever virus
TKEGGGFYAD

SEQ ID NO: 172399 - protein, 10 aa, Yellow fever virus
KEGGGFYADD

SEQ ID NO: 172400 - protein, 10 aa, Yellow fever virus
EGGGFYADDT

SEQ ID NO: 172401 - protein, 10 aa, Yellow fever virus
GGGLYADDTA

SEQ ID NO: 172402 - protein, 10 aa, Yellow fever virus
GGLYADDTAG

SEQ ID NO: 172403 - protein, 10 aa, Yellow fever virus
GLYADDTAGW

SEQ ID NO: 172404 - protein, 10 aa, Yellow fever virus
LYADDTAGWD

SEQ ID NO: 172405 - protein, 10 aa, Yellow fever virus
ADLDDEQEIM

SEQ ID NO: 172406 - protein, 10 aa, Yellow fever virus
DLDDEQEIMS

SEQ ID NO: 172407 - protein, 10 aa, Yellow fever virus
LDDEQEIMSY

SEQ ID NO: 172408 - protein, 10 aa, Yellow fever virus
DDEQEIMSYM

SEQ ID NO: 172409 - protein, 10 aa, Yellow fever virus
DEQEIMSYMN

SEQ ID NO: 172410 - protein, 10 aa, Yellow fever virus
EQEIMSYMNA

SEQ ID NO: 172411 - protein, 10 aa, Yellow fever virus
QEIMSYMNAE

SEQ ID NO: 172412 - protein, 10 aa, Yellow fever virus
EIMSYMNAEQ

SEQ ID NO: 172413 - protein, 10 aa, Yellow fever virus
IMSYMNAEQR

SEQ ID NO: 172414 - protein, 10 aa, Yellow fever virus
MSYMNAEQRK

SEQ ID NO: 172415 - protein, 10 aa, Yellow fever virus
SYMNAEQRKL

SEQ ID NO: 172416 - protein, 10 aa, Yellow fever virus
YMNAEQRKLA

SEQ ID NO: 172417 - protein, 10 aa, Yellow fever virus
MNAEQRKLAW

SEQ ID NO: 172418 - protein, 10 aa, Yellow fever virus
NAEQRKLAWA

SEQ ID NO: 172419 - protein, 10 aa, Yellow fever virus
AEQRKLAWAV

SEQ ID NO: 172420 - protein, 10 aa, Yellow fever virus
EQRKLAWAVM

SEQ ID NO: 172421 - protein, 10 aa, Yellow fever virus
QRKLAWAVME

SEQ ID NO: 172422 - protein, 10 aa, Yellow fever virus
RKLAWAVMEM

SEQ ID NO: 172423 - protein, 10 aa, Yellow fever virus
KLAWAVMEMT

SEQ ID NO: 172424 - protein, 10 aa, Yellow fever virus
LAWAVMEMTY

SEQ ID NO: 172425 - protein, 10 aa, Yellow fever virus
AWAVMEMTYK

SEQ ID NO: 172426 - protein, 10 aa, Yellow fever virus
WAVMEMTYKN

SEQ ID NO: 172427 - protein, 10 aa, Yellow fever virus
AIMEMTYKNK

SEQ ID NO: 172428 - protein, 10 aa, Yellow fever virus
IMEMTYKNKV

SEQ ID NO: 172429 - protein, 10 aa, Yellow fever virus
NKVVKVLRPT

SEQ ID NO: 172430 - protein, 10 aa, Yellow fever virus
KVVKVLRPTP

SEQ ID NO: 172431 - protein, 10 aa, Yellow fever virus
VVKVLRPTPG

SEQ ID NO: 172432 - protein, 10 aa, Yellow fever virus
VKVLRPTPGG

SEQ ID NO: 172433 - protein, 10 aa, Yellow fever virus
KVLRPTPGGK

SEQ ID NO: 172434 - protein, 10 aa, Yellow fever virus
VLRPTPGGKA

SEQ ID NO: 172435 - protein, 10 aa, Yellow fever virus
LRPAPGGKAF

SEQ ID NO: 172436 - protein, 10 aa, Yellow fever virus
RPAPGGKAFM

SEQ ID NO: 172437 - protein, 10 aa, Yellow fever virus
PAPGGKAFMD

SEQ ID NO: 172438 - protein, 10 aa, Yellow fever virus
APGGKAFMDI

SEQ ID NO: 172439 - protein, 10 aa, Yellow fever virus
PGGKAFMDII

SEQ ID NO: 172440 - protein, 10 aa, Yellow fever virus
GGKAFMDIIS

SEQ ID NO: 172441 - protein, 10 aa, Yellow fever virus
GKAFMDIISR

SEQ ID NO: 172442 - protein, 10 aa, Yellow fever virus
KAFMDIISRR

SEQ ID NO: 172443 - protein, 10 aa, Yellow fever virus
AFMDIISRRD

SEQ ID NO: 172444 - protein, 10 aa, Yellow fever virus
FMDIISRRDQ

SEQ ID NO: 172445 - protein, 10 aa, Yellow fever virus
MDIISRRDQR

SEQ ID NO: 172446 - protein, 10 aa, Yellow fever virus
DIISRRDQRG

SEQ ID NO: 172447 - protein, 10 aa, Yellow fever virus
IISRRDQRGS

SEQ ID NO: 172448 - protein, 10 aa, Yellow fever virus
ISRRDQRGSR

SEQ ID NO: 172449 - protein, 10 aa, Yellow fever virus
SRRDQRGSRQ

SEQ ID NO: 172450 - protein, 10 aa, Yellow fever virus
RRDQRGSRQV

SEQ ID NO: 172451 - protein, 10 aa, Yellow fever virus
RDQRGSRQVV

SEQ ID NO: 172452 - protein, 10 aa, Yellow fever virus
DQRGSRQVVT

SEQ ID NO: 172453 - protein, 10 aa, Yellow fever virus
QRGSRQVVTY

SEQ ID NO: 172454 - protein, 10 aa, Yellow fever virus
RGSRQVVTYA

SEQ ID NO: 172455 - protein, 10 aa, Yellow fever virus
GSRQVVTYAL

SEQ ID NO: 172456 - protein, 10 aa, Yellow fever virus
SRQVVTYALN

SEQ ID NO: 172457 - protein, 10 aa, Yellow fever virus
RQVVTYALNT

SEQ ID NO: 172458 - protein, 10 aa, Yellow fever virus
QLIRMAEAEN

SEQ ID NO: 172459 - protein, 10 aa, Yellow fever virus
LIRMAEAENV

SEQ ID NO: 172460 - protein, 10 aa, Yellow fever virus
IRMAEAENVI

SEQ ID NO: 172461 - protein, 10 aa, Yellow fever virus
RMAEAEMVIN

SEQ ID NO: 172462 - protein, 10 aa, Yellow fever virus
MAEAEMVINH

SEQ ID NO: 172463 - protein, 10 aa, Yellow fever virus
AEAEMVINHQ

SEQ ID NO: 172464 - protein, 10 aa, Yellow fever virus
EAEMVINHQH

SEQ ID NO: 172465 - protein, 10 aa, Yellow fever virus
AEMVINHQHV

SEQ ID NO: 172466 - protein, 10 aa, Yellow fever virus
EMVINHQHVN

SEQ ID NO: 172467 - protein, 10 aa, Yellow fever virus
MVINHQHVNE

SEQ ID NO: 172468 - protein, 10 aa, Yellow fever virus
VINHQHVNEC

SEQ ID NO: 172469 - protein, 10 aa, Yellow fever virus
INHQHVNECD

SEQ ID NO: 172470 - protein, 10 aa, Yellow fever virus
NHQHVNECDE

SEQ ID NO: 172471 - protein, 10 aa, Yellow fever virus
HQHVNECDEG

SEQ ID NO: 172472 - protein, 10 aa, Yellow fever virus
LARLDAWLAE

SEQ ID NO: 172473 - protein, 10 aa, Yellow fever virus
ARLDAWLAEN

SEQ ID NO: 172474 - protein, 10 aa, Yellow fever virus
RLDAWLAENG

SEQ ID NO: 172475 - protein, 10 aa, Yellow fever virus
LDAWLAENGC

SEQ ID NO: 172476 - protein, 10 aa, Yellow fever virus
EAWLTEHGCD

SEQ ID NO: 172477 - protein, 10 aa, Yellow fever virus
AWLTEHGCDR

SEQ ID NO: 172478 - protein, 10 aa, Yellow fever virus
WLTEHGCDRL

SEQ ID NO: 172479 - protein, 10 aa, Yellow fever virus
RLARMAVSGD

SEQ ID NO: 172480 - protein, 10 aa, Yellow fever virus
LRRMAVSGDD

SEQ ID NO: 172481 - protein, 10 aa, Yellow fever virus
ARMAVSGDDC

SEQ ID NO: 172482 - protein, 10 aa, Yellow fever virus
RMAVNGDDCV

SEQ ID NO: 172483 - protein, 10 aa, Yellow fever virus
MAVNGDDCVV

SEQ ID NO: 172484 - protein, 10 aa, Yellow fever virus
AVSGDDCVVK

SEQ ID NO: 172485 - protein, 10 aa, Yellow fever virus
VSGDDCVVKP

SEQ ID NO: 172486 - protein, 10 aa, Yellow fever virus
SGDDCVVRPV

SEQ ID NO: 172487 - protein, 10 aa, Yellow fever virus
GDDCVVRPVD

SEQ ID NO: 172488 - protein, 10 aa, Yellow fever virus
DDCVVRPVDD

SEQ ID NO: 172489 - protein, 10 aa, Yellow fever virus
DCVVRPVDDR

SEQ ID NO: 172490 - protein, 10 aa, Yellow fever virus
CVVRPVDDRF

SEQ ID NO: 172491 - protein, 10 aa, Yellow fever virus
VVRPVDDRFG

SEQ ID NO: 172492 - protein, 10 aa, Yellow fever virus
VRPVDDRFGL

SEQ ID NO: 172493 - protein, 10 aa, Yellow fever virus
RPVDDRFGLA

SEQ ID NO: 172494 - protein, 10 aa, Yellow fever virus
PVDDRFGLAL

SEQ ID NO: 172495 - protein, 10 aa, Yellow fever virus
VDDRFGLALS

SEQ ID NO: 172496 - protein, 10 aa, Yellow fever virus
DDRFGMALSH

SEQ ID NO: 172497 - protein, 10 aa, Yellow fever virus
DRFGMALSHL

SEQ ID NO: 172498 - protein, 10 aa, Yellow fever virus
RFGMALSHLN

SEQ ID NO: 172499 - protein, 10 aa, Yellow fever virus
FGMALSHLNA

SEQ ID NO: 172500 - protein, 10 aa, Yellow fever virus
GMALSHLNAM

SEQ ID NO: 172501 - protein, 10 aa, Yellow fever virus
MALSHLNAMS

SEQ ID NO: 172502 - protein, 10 aa, Yellow fever virus
DISEWQPSKE

SEQ ID NO: 172503 - protein, 10 aa, Yellow fever virus
ISEWQPSKEW

SEQ ID NO: 172504 - protein, 10 aa, Yellow fever virus
SEWQPSKGWT

SEQ ID NO: 172505 - protein, 10 aa, Yellow fever virus
EWQPSKGWTD

SEQ ID NO: 172506 - protein, 10 aa, Yellow fever virus
WQPSKGWTDW

SEQ ID NO: 172507 - protein, 10 aa, Yellow fever virus
QPSKGWTDWE

SEQ ID NO: 172508 - protein, 10 aa, Yellow fever virus
PSKGWTDWES

SEQ ID NO: 172509 - protein, 10 aa, Yellow fever virus
SKEWTDWENV

SEQ ID NO: 172510 - protein, 10 aa, Yellow fever virus
KGWTDWESVP

SEQ ID NO: 172511 - protein, 10 aa, Yellow fever virus
GWTDWENVPF

SEQ ID NO: 172512 - protein, 10 aa, Yellow fever virus
WTDWENVPFC

SEQ ID NO: 172513 - protein, 10 aa, Yellow fever virus
TDWENVPFCS

SEQ ID NO: 172514 - protein, 10 aa, Yellow fever virus
DWESVPFCSH

SEQ ID NO: 172515 - protein, 10 aa, Yellow fever virus
WESVPFCSHH

SEQ ID NO: 172516 - protein, 10 aa, Yellow fever virus
ESVPFCSHHF

SEQ ID NO: 172517 - protein, 10 aa, Yellow fever virus
NVPFCSHRFH

SEQ ID NO: 172518 - protein, 10 aa, Yellow fever virus
VPFCSHRFHE

SEQ ID NO: 172519 - protein, 10 aa, Yellow fever virus
PFCSHRFHEL

SEQ ID NO: 172520 - protein, 10 aa, Yellow fever virus
FCSHHFHELV

SEQ ID NO: 172521 - protein, 10 aa, Yellow fever virus
CSHHFHELVL

SEQ ID NO: 172522 - protein, 10 aa, Yellow fever virus
SHHFHELVLK

SEQ ID NO: 172523 - protein, 10 aa, Yellow fever virus
HHFHELVLKD

SEQ ID NO: 172524 - protein, 10 aa, Yellow fever virus
HFHELVLKDG

SEQ ID NO: 172525 - protein, 10 aa, Yellow fever virus
FHELVLKDGR

SEQ ID NO: 172526 - protein, 10 aa, Yellow fever virus
HELVLKDGRK

SEQ ID NO: 172527 - protein, 10 aa, Yellow fever virus
ELVLKDGRKV

SEQ ID NO: 172528 - protein, 10 aa, Yellow fever virus
LHLKDGRRIV

SEQ ID NO: 172529 - protein, 10 aa, Yellow fever virus
HLKDGRRIVV

SEQ ID NO: 172530 - protein, 10 aa, Yellow fever virus
LKDGRKVVVP

SEQ ID NO: 172531 - protein, 10 aa, Yellow fever virus
KDGRKVVVPC

SEQ ID NO: 172532 - protein, 10 aa, Yellow fever virus
DGRKVVVPCR

SEQ ID NO: 172533 - protein, 10 aa, Yellow fever virus
GRKVVVPCRD

SEQ ID NO: 172534 - protein, 10 aa, Yellow fever virus
RKVVVPCRDQ

SEQ ID NO: 172535 - protein, 10 aa, Yellow fever virus
KVVVPCRDQD

SEQ ID NO: 172536 - protein, 10 aa, Yellow fever virus
VVVPCRDQDE

SEQ ID NO: 172537 - protein, 10 aa, Yellow fever virus
VVPCRDQDEL

SEQ ID NO: 172538 - protein, 10 aa, Yellow fever virus
VPCRDQDELI

SEQ ID NO: 172539 - protein, 10 aa, Yellow fever virus
PCRDQDELIG

SEQ ID NO: 172540 - protein, 10 aa, Yellow fever virus
CRDQDELIGR

SEQ ID NO: 172541 - protein, 10 aa, Yellow fever virus
RDQDELIGRG

SEQ ID NO: 172542 - protein, 10 aa, Yellow fever virus
DQDELIGRGR

SEQ ID NO: 172543 - protein, 10 aa, Yellow fever virus
HKRDMRLLSF

SEQ ID NO: 172544 - protein, 10 aa, Yellow fever virus
KRDMRLLSFA

SEQ ID NO: 172545 - protein, 10 aa, Yellow fever virus
RDMRLLSFAV

SEQ ID NO: 172546 - protein, 10 aa, Yellow fever virus
DMRLLSFAVS

SEQ ID NO: 172547 - protein, 10 aa, Yellow fever virus
MRLLSFAVSS

SEQ ID NO: 172548 - protein, 10 aa, Yellow fever virus
RLLSFAVSSA

SEQ ID NO: 172549 - protein, 10 aa, Yellow fever virus
LLSFAVSSAV

SEQ ID NO: 172550 - protein, 10 aa, Yellow fever virus
LSFAVSSAVP

SEQ ID NO: 172551 - protein, 10 aa, Yellow fever virus
SFAVSSAVPT

SEQ ID NO: 172552 - protein, 10 aa, Yellow fever virus
FAVSSAVPTA

SEQ ID NO: 172553 - protein, 10 aa, Yellow fever virus
AVSSAVPTAW

SEQ ID NO: 172554 - protein, 10 aa, Yellow fever virus
VSSAVPTAWV

SEQ ID NO: 172555 - protein, 10 aa, Yellow fever virus
SSAVPTAWVP

SEQ ID NO: 172556 - protein, 10 aa, Yellow fever virus
SAVPTAWVPS

SEQ ID NO: 172557 - protein, 10 aa, Yellow fever virus
AVPTAWVPSG

SEQ ID NO: 172558 - protein, 10 aa, Yellow fever virus
VPTAWVPSGR

SEQ ID NO: 172559 - protein, 10 aa, Yellow fever virus
PTAWVPSGRT

SEQ ID NO: 172560 - protein, 10 aa, Yellow fever virus
TAWVPSGRTT

SEQ ID NO: 172561 - protein, 10 aa, Yellow fever virus
AWVPSGRTTW

SEQ ID NO: 172562 - protein, 10 aa, Yellow fever virus
WVPSGRTTWS

SEQ ID NO: 172563 - protein, 10 aa, Yellow fever virus
VPSGRTTWSV

SEQ ID NO: 172564 - protein, 10 aa, Yellow fever virus
PSGRTTWSVH

SEQ ID NO: 172565 - protein, 10 aa, Yellow fever virus
SGRTTWSVHG

SEQ ID NO: 172566 - protein, 10 aa, Yellow fever virus
GRTTWSVHGK

SEQ ID NO: 172567 - protein, 10 aa, Yellow fever virus
RTTWSVHGKG

SEQ ID NO: 172568 - protein, 10 aa, Yellow fever virus
TTWSVHGKGE

SEQ ID NO: 172569 - protein, 10 aa, Yellow fever virus
TWSVHGKGEW

SEQ ID NO: 172570 - protein, 10 aa, Yellow fever virus
WSVHGKGEWM

SEQ ID NO: 172571 - protein, 10 aa, Yellow fever virus
SVHGKGEWMT

SEQ ID NO: 172572 - protein, 10 aa, Yellow fever virus
VHGKGEWMTT

SEQ ID NO: 172573 - protein, 10 aa, Yellow fever virus
HGRGEWMTTE

SEQ ID NO: 172574 - protein, 10 aa, Yellow fever virus
GKGEWMTTQD

SEQ ID NO: 172575 - protein, 10 aa, Yellow fever virus
KGEWMTTQDM

SEQ ID NO: 172576 - protein, 10 aa, Yellow fever virus
GEWMTTEDRL

SEQ ID NO: 172577 - protein, 10 aa, Yellow fever virus
EWMTTEDMLG

SEQ ID NO: 172578 - protein, 10 aa, Yellow fever virus
WMTTEDMLDV

SEQ ID NO: 172579 - protein, 10 aa, Yellow fever virus
MTTEDMLGVW

SEQ ID NO: 172580 - protein, 10 aa, Yellow fever virus
TTEDMLGVWN

SEQ ID NO: 172581 - protein, 10 aa, Yellow fever virus
TEDMLDVWNR

SEQ ID NO: 172582 - protein, 10 aa, Yellow fever virus
EDMLDVWNRV

SEQ ID NO: 172583 - protein, 10 aa, Yellow fever virus
DMLDVWNRVW

SEQ ID NO: 172584 - protein, 10 aa, Yellow fever virus
MLDVWNRVWV

SEQ ID NO: 172585 - protein, 10 aa, Yellow fever virus
LDVWNRVWVL

SEQ ID NO: 172586 - protein, 10 aa, Yellow fever virus
DVWNRVWVLN

SEQ ID NO: 172587 - protein, 10 aa, Yellow fever virus
VWNRVWVLNN

SEQ ID NO: 172588 - protein, 10 aa, Yellow fever virus
WNRVWVLNNP

SEQ ID NO: 172589 - protein, 10 aa, Yellow fever virus
NRVWVLNNPH

SEQ ID NO: 172590 - protein, 10 aa, Yellow fever virus
RVWVLNNPHM

SEQ ID NO: 172591 - protein, 10 aa, Yellow fever virus
VWVLNNPHMK

SEQ ID NO: 172592 - protein, 10 aa, Yellow fever virus
WVLNNPHMKD

SEQ ID NO: 172593 - protein, 10 aa, Yellow fever virus
VLNNPHMKDK

SEQ ID NO: 172594 - protein, 10 aa, Yellow fever virus
LNNPHMKDKT

SEQ ID NO: 172595 - protein, 10 aa, Yellow fever virus
NNPHMQDKTV

SEQ ID NO: 172596 - protein, 10 aa, Yellow fever virus
NPHMQDKTVV

SEQ ID NO: 172597 - protein, 10 aa, Yellow fever virus
PHMQDKTVVK

SEQ ID NO: 172598 - protein, 10 aa, Yellow fever virus
HMQDKTMVKE

SEQ ID NO: 172599 - protein, 10 aa, Yellow fever virus
MQDKTMVKEW

SEQ ID NO: 172600 - protein, 10 aa, Yellow fever virus
QDKTMVKEWR

SEQ ID NO: 172601 - protein, 10 aa, Yellow fever virus
DKTMVKEWRD

SEQ ID NO: 172602 - protein, 10 aa, Yellow fever virus
KTMVKEWRDV

SEQ ID NO: 172603 - protein, 10 aa, Yellow fever virus
TMVKEWRDVP

SEQ ID NO: 172604 - protein, 10 aa, Yellow fever virus
MVKEWRDVPY

SEQ ID NO: 172605 - protein, 10 aa, Yellow fever virus
VKEWRDVPYL

SEQ ID NO: 172606 - protein, 10 aa, Yellow fever virus
KEWRDVPYLT

SEQ ID NO: 172607 - protein, 10 aa, Yellow fever virus
EWRDVPYLTK

SEQ ID NO: 172608 - protein, 10 aa, Yellow fever virus
MTNRATWASN

SEQ ID NO: 172609 - protein, 10 aa, Yellow fever virus
TNRATWASNI

SEQ ID NO: 172610 - protein, 10 aa, Yellow fever virus
NRATWASNIH

SEQ ID NO: 172611 - protein, 10 aa, Yellow fever virus
RATWASNIHL

SEQ ID NO: 172612 - protein, 10 aa, Yellow fever virus
ATWASNIHLV

SEQ ID NO: 172613 - protein, 10 aa, Yellow fever virus
TWASNIHLVI

SEQ ID NO: 172614 - protein, 10 aa, Yellow fever virus
WASNIHLVIH

SEQ ID NO: 172615 - protein, 10 aa, Yellow fever virus
ASNIHLVIHR

SEQ ID NO: 172616 - protein, 10 aa, Yellow fever virus
SNIHLVIHRI

SEQ ID NO: 172617 - protein, 10 aa, Yellow fever virus
NIHLVIHRIR

SEQ ID NO: 172618 - protein, 10 aa, Yellow fever virus
IHLVIHRIRN

SEQ ID NO: 172619 - protein, 10 aa, Yellow fever virus
HLVIHRIRNL

SEQ ID NO: 172620 - protein, 10 aa, Yellow fever virus
LVIHRIRTLV

SEQ ID NO: 172621 - protein, 10 aa, Yellow fever virus
VIHRIRTLVG

SEQ ID NO: 172622 - protein, 10 aa, Yellow fever virus
IHRIRTLVGQ

SEQ ID NO: 172623 - protein, 10 aa, Yellow fever virus
HRIRTLVGQE

SEQ ID NO: 172624 - protein, 10 aa, Yellow fever virus
RIRTLVGQEK

SEQ ID NO: 172625 - protein, 10 aa, Yellow fever virus
IRTLVGQEKY

SEQ ID NO: 172626 - protein, 10 aa, Yellow fever virus
RTLVGQEKYT

SEQ ID NO: 172627 - protein, 10 aa, Yellow fever virus
TLVGQEKYTD

SEQ ID NO: 172628 - protein, 10 aa, Yellow fever virus
LVGQEKYTDY

SEQ ID NO: 172629 - protein, 10 aa, Yellow fever virus
VGQEKYTDYL

SEQ ID NO: 172630 - protein, 10 aa, Yellow fever virus
GQEKFTDYLT

SEQ ID NO: 172631 - protein, 10 aa, Yellow fever virus
QEKFTDYLTV

SEQ ID NO: 172632 - protein, 10 aa, Yellow fever virus
EKFTDYLTVM

SEQ ID NO: 172633 - protein, 10 aa, Yellow fever virus
KFTDYLTVMD

SEQ ID NO: 172634 - protein, 10 aa, Yellow fever virus
FTDYLTVMDR

SEQ ID NO: 172635 - protein, 10 aa, Yellow fever virus
RYSVDADLQP

SEQ ID NO: 172636 - protein, 10 aa, Yellow fever virus
YSVDADLQPG

SEQ ID NO: 172637 - protein, 10 aa, Yellow fever virus
SVDADLQPGE

SEQ ID NO: 172638 - protein, 10 aa, Yellow fever virus
VDADLQPGEL

SEQ ID NO: 172639 - protein, 10 aa, Yellow fever virus
DADLQPGELI

SEQ ID NO: 172640 - protein, 10 aa, Yellow fever virus
PSRGVQGFIS

SEQ ID NO: 172641 - protein, 10 aa, Yellow fever virus
SFNILTGKKI

SEQ ID NO: 172642 - protein, 10 aa, Yellow fever virus
NILTGKKLTA

SEQ ID NO: 172643 - protein, 10 aa, Yellow fever virus
ILTGKKLTAH

SEQ ID NO: 172644 - protein, 10 aa, Yellow fever virus
LTGKKLTAHL

SEQ ID NO: 172645 - protein, 10 aa, Yellow fever virus
TGKKITAQLK

SEQ ID NO: 172646 - protein, 10 aa, Yellow fever virus
GKKITAQLKR

SEQ ID NO: 172647 - protein, 10 aa, Yellow fever virus
KKLTAHLKKL

SEQ ID NO: 172648 - protein, 10 aa, Yellow fever virus
KITAQLKRLW

SEQ ID NO: 172649 - protein, 10 aa, Yellow fever virus
LTAHLKKLWR

SEQ ID NO: 172650 - protein, 10 aa, Yellow fever virus
TAQLKRLWKM

SEQ ID NO: 172651 - protein, 10 aa, Yellow fever virus
AHLKKLWRML

SEQ ID NO: 172652 - protein, 10 aa, Yellow fever virus
HLKKLWRMLD

SEQ ID NO: 172653 - protein, 10 aa, Yellow fever virus
LKKLWRMLDP

SEQ ID NO: 172654 - protein, 10 aa, Yellow fever virus
KKLWRMLDPR

SEQ ID NO: 172655 - protein, 10 aa, Yellow fever virus
KLWRMLDPRQ

SEQ ID NO: 172656 - protein, 10 aa, Yellow fever virus
RMLDPRQGLT

SEQ ID NO: 172657 - protein, 10 aa, Yellow fever virus
MLDPRQGLTV

SEQ ID NO: 172658 - protein, 10 aa, Yellow fever virus
LDPRQGLTVL

SEQ ID NO: 172659 - protein, 10 aa, Yellow fever virus
DPRQGLTVLR

SEQ ID NO: 172660 - protein, 10 aa, Yellow fever virus
PRQGLTVLRK

SEQ ID NO: 172661 - protein, 10 aa, Yellow fever virus
RQGLTVLRKV

SEQ ID NO: 172662 - protein, 10 aa, Yellow fever virus
QGLTVLRKVK

SEQ ID NO: 172663 - protein, 10 aa, Yellow fever virus
GLTVLRKVKR

SEQ ID NO: 172664 - protein, 10 aa, Yellow fever virus
LTVLRKVKRV

SEQ ID NO: 172665 - protein, 10 aa, Yellow fever virus
TVLRKVKRVV

SEQ ID NO: 172666 - protein, 10 aa, Yellow fever virus
VKRVVASLMI

SEQ ID NO: 172667 - protein, 10 aa, Yellow fever virus
KRVVASLMIG

SEQ ID NO: 172668 - protein, 10 aa, Yellow fever virus
RVVASLMIGL

SEQ ID NO: 172669 - protein, 10 aa, Yellow fever virus
VVASLMIGLS

SEQ ID NO: 172670 - protein, 10 aa, Yellow fever virus
VASLMIGLSS

SEQ ID NO: 172671 - protein, 10 aa, Yellow fever virus
ASLMIGLSSR

SEQ ID NO: 172672 - protein, 10 aa, Yellow fever virus
SLMIGLSSRK

SEQ ID NO: 172673 - protein, 10 aa, Yellow fever virus
GLSSRKRRSS

SEQ ID NO: 172674 - protein, 10 aa, Yellow fever virus
LSSRKRRSSE

SEQ ID NO: 172675 - protein, 10 aa, Yellow fever virus
SSRKRRSHDA

SEQ ID NO: 172676 - protein, 10 aa, Yellow fever virus
SRKRRSHDAL

SEQ ID NO: 172677 - protein, 10 aa, Yellow fever virus
TVQLLILGMI

SEQ ID NO: 172678 - protein, 10 aa, Yellow fever virus
FPLLLLGLLA

SEQ ID NO: 172679 - protein, 10 aa, Yellow fever virus
PLLLLGLLAL

SEQ ID NO: 172680 - protein, 10 aa, Yellow fever virus
SGGVTLVRKN

SEQ ID NO: 172681 - protein, 10 aa, Yellow fever virus
SEDLGKTFSI

SEQ ID NO: 172682 - protein, 10 aa, Yellow fever virus
EDLGKTFSIG

SEQ ID NO: 172683 - protein, 10 aa, Yellow fever virus
DLGKTFSMGT

SEQ ID NO: 172684 - protein, 10 aa, Yellow fever virus
LGKTFSVGAG

SEQ ID NO: 172685 - protein, 10 aa, Yellow fever virus
GKTFSVGAGN

SEQ ID NO: 172686 - protein, 10 aa, Yellow fever virus
KTFSIGTGNC

SEQ ID NO: 172687 - protein, 10 aa, Yellow fever virus
TFSLGTGNCT

SEQ ID NO: 172688 - protein, 10 aa, Yellow fever virus
FSIGTGNCTT

SEQ ID NO: 172689 - protein, 10 aa, Yellow fever virus
SMGTGNCTTN

SEQ ID NO: 172690 - protein, 10 aa, Yellow fever virus
MGTGNCTTNI

SEQ ID NO: 172691 - protein, 10 aa, Yellow fever virus
VENVRVTYGK

SEQ ID NO: 172692 - protein, 10 aa, Yellow fever virus
ENVRVTYGKC

SEQ ID NO: 172693 - protein, 10 aa, Yellow fever virus
NVRVTYGKCD

SEQ ID NO: 172694 - protein, 10 aa, Yellow fever virus
VRVTYGKCDS

SEQ ID NO: 172695 - protein, 10 aa, Yellow fever virus
RVTYGKCDSA

SEQ ID NO: 172696 - protein, 10 aa, Yellow fever virus
VTYGKCDSAG

SEQ ID NO: 172697 - protein, 10 aa, Yellow fever virus
TYGKCDSAGR

SEQ ID NO: 172698 - protein, 10 aa, Yellow fever virus
WLVRNPFFAI

SEQ ID NO: 172699 - protein, 10 aa, Yellow fever virus
LVRNPFFAIT

SEQ ID NO: 172700 - protein, 10 aa, Yellow fever virus
NPFFAITALA

SEQ ID NO: 172701 - protein, 10 aa, Yellow fever virus
PFFAITALAI

SEQ ID NO: 172702 - protein, 10 aa, Yellow fever virus
FFAITALAIA

SEQ ID NO: 172703 - protein, 10 aa, Yellow fever virus
FAITALAIAY

SEQ ID NO: 172704 - protein, 10 aa, Yellow fever virus
AITALAIAYL

SEQ ID NO: 172705 - protein, 10 aa, Yellow fever virus
ITALAIAYLV

SEQ ID NO: 172706 - protein, 10 aa, Yellow fever virus
ALAIAYLVGS

SEQ ID NO: 172707 - protein, 10 aa, Yellow fever virus
LAIAYLVGSN

SEQ ID NO: 172708 - protein, 10 aa, Yellow fever virus
AIAYLVGSNM

SEQ ID NO: 172709 - protein, 10 aa, Yellow fever virus
IAYLVGNNKT

SEQ ID NO: 172710 - protein, 10 aa, Yellow fever virus
AYLVGNNKTQ

SEQ ID NO: 172711 - protein, 10 aa, Yellow fever virus
YLVGNNTTQR

SEQ ID NO: 172712 - protein, 10 aa, Yellow fever virus
LVGNNTTQRV

SEQ ID NO: 172713 - protein, 10 aa, Yellow fever virus
VGNNKTQRVV

SEQ ID NO: 172714 - protein, 10 aa, Yellow fever virus
GNNTTQRVVI

SEQ ID NO: 172715 - protein, 10 aa, Yellow fever virus
NNMTQRVVIA

SEQ ID NO: 172716 - protein, 10 aa, Yellow fever virus
NTTQRVVIAL

SEQ ID NO: 172717 - protein, 10 aa, Yellow fever virus
KTQRVVIALL

SEQ ID NO: 172718 - protein, 10 aa, Yellow fever virus
TWVSASLEQD

SEQ ID NO: 172719 - protein, 10 aa, Yellow fever virus
WVSATLEQGK

SEQ ID NO: 172720 - protein, 10 aa, Yellow fever virus
VSASLEQDKC

SEQ ID NO: 172721 - protein, 10 aa, Yellow fever virus
SASLEQDKCV

SEQ ID NO: 172722 - protein, 10 aa, Yellow fever virus
ASLEQDKCVT

SEQ ID NO: 172723 - protein, 10 aa, Yellow fever virus
TLEQGKCVTV

SEQ ID NO: 172724 - protein, 10 aa, Yellow fever virus
ISLQTVAIDG

SEQ ID NO: 172725 - protein, 10 aa, Yellow fever virus
SLQTVAIDGP

SEQ ID NO: 172726 - protein, 10 aa, Yellow fever virus
LQTVAIDGPA

SEQ ID NO: 172727 - protein, 10 aa, Yellow fever virus
QTVAIDGPAE

SEQ ID NO: 172728 - protein, 10 aa, Yellow fever virus
TVAIDRPAEA

SEQ ID NO: 172729 - protein, 10 aa, Yellow fever virus
VAIDRPAEAR

SEQ ID NO: 172730 - protein, 10 aa, Yellow fever virus
AIDRPAEARK

SEQ ID NO: 172731 - protein, 10 aa, Yellow fever virus
IDRPAEARKV

SEQ ID NO: 172732 - protein, 10 aa, Yellow fever virus
DRPAEARKVC

SEQ ID NO: 172733 - protein, 10 aa, Yellow fever virus
RPAEARKVCY

SEQ ID NO: 172734 - protein, 10 aa, Yellow fever virus
PAEARKVCYS

SEQ ID NO: 172735 - protein, 10 aa, Yellow fever virus
AEARKVCYSA

SEQ ID NO: 172736 - protein, 10 aa, Yellow fever virus
EARKVCYSAV

SEQ ID NO: 172737 - protein, 10 aa, Yellow fever virus
ARKVCYSAVL

SEQ ID NO: 172738 - protein, 10 aa, Yellow fever virus
NAVLTHVKID

SEQ ID NO: 172739 - protein, 10 aa, Yellow fever virus
TKIQYVIKAQ

SEQ ID NO: 172740 - protein, 10 aa, Yellow fever virus
KIQYVIRARL

SEQ ID NO: 172741 - protein, 10 aa, Yellow fever virus
IQYVIKAQLH

SEQ ID NO: 172742 - protein, 10 aa, Yellow fever virus
QYVIRARLHV

SEQ ID NO: 172743 - protein, 10 aa, Yellow fever virus
YVIRARLHVG

SEQ ID NO: 172744 - protein, 10 aa, Yellow fever virus
VIKAQLHVGA

SEQ ID NO: 172745 - protein, 10 aa, Yellow fever virus
IRARLHVGAK

SEQ ID NO: 172746 - protein, 10 aa, Yellow fever virus
RARLHVGAKQ

SEQ ID NO: 172747 - protein, 10 aa, Yellow fever virus
QLHVGAKQED

SEQ ID NO: 172748 - protein, 10 aa, Yellow fever virus
HVGAKQEDWK

SEQ ID NO: 172749 - protein, 10 aa, Yellow fever virus
VGAKQENWKT

SEQ ID NO: 172750 - protein, 10 aa, Yellow fever virus
GAKQENWNTS

SEQ ID NO: 172751 - protein, 10 aa, Yellow fever virus
AKQENWNTSI

SEQ ID NO: 172752 - protein, 10 aa, Yellow fever virus
KQENWNTSIK

SEQ ID NO: 172753 - protein, 10 aa, Yellow fever virus
QENWNTSIKT

SEQ ID NO: 172754 - protein, 10 aa, Yellow fever virus
ENWNTSIKTL

SEQ ID NO: 172755 - protein, 10 aa, Yellow fever virus
NWNTSIKTLK

SEQ ID NO: 172756 - protein, 10 aa, Yellow fever virus
WNTSIKTLKF

SEQ ID NO: 172757 - protein, 10 aa, Yellow fever virus
NTSIKTLKFD

SEQ ID NO: 172758 - protein, 10 aa, Yellow fever virus
TDIKTLKFDV

SEQ ID NO: 172759 - protein, 10 aa, Yellow fever virus
DIKTLKFDVL

SEQ ID NO: 172760 - protein, 10 aa, Yellow fever virus
FDVLSGSQEA

SEQ ID NO: 172761 - protein, 10 aa, Yellow fever virus
DVLSGSQEAE

SEQ ID NO: 172762 - protein, 10 aa, Yellow fever virus
VLSGSQEAEF

SEQ ID NO: 172763 - protein, 10 aa, Yellow fever virus
LSGSQEVEFT

SEQ ID NO: 172764 - protein, 10 aa, Yellow fever virus
SGSQEVEFTG

SEQ ID NO: 172765 - protein, 10 aa, Yellow fever virus
GSQEVEFTGY

SEQ ID NO: 172766 - protein, 10 aa, Yellow fever virus
SQEVEFTGYG

SEQ ID NO: 172767 - protein, 10 aa, Yellow fever virus
QEVEFTGYGK

SEQ ID NO: 172768 - protein, 10 aa, Yellow fever virus
EVEFTGYGKA

SEQ ID NO: 172769 - protein, 10 aa, Yellow fever virus
AEFTGYGKVT

SEQ ID NO: 172770 - protein, 10 aa, Yellow fever virus
EFTGYGKVTL

SEQ ID NO: 172771 - protein, 10 aa, Yellow fever virus
FTGYGKVTLE

SEQ ID NO: 172772 - protein, 10 aa, Yellow fever virus
TGYGKVTLEC

SEQ ID NO: 172773 - protein, 10 aa, Yellow fever virus
GYGKATLECR

SEQ ID NO: 172774 - protein, 10 aa, Yellow fever virus
YGKVTLECQV

SEQ ID NO: 172775 - protein, 10 aa, Yellow fever virus
GKATLECRVQ

SEQ ID NO: 172776 - protein, 10 aa, Yellow fever virus
KATLECRVQT

SEQ ID NO: 172777 - protein, 10 aa, Yellow fever virus
ATLECRVQTA

SEQ ID NO: 172778 - protein, 10 aa, Yellow fever virus
NSYIAEMEKD

SEQ ID NO: 172779 - protein, 10 aa, Yellow fever virus
SYIAEMEKDS

SEQ ID NO: 172780 - protein, 10 aa, Yellow fever virus
YIAEMEKDSW

SEQ ID NO: 172781 - protein, 10 aa, Yellow fever virus
IAEMEKDSWI

SEQ ID NO: 172782 - protein, 10 aa, Yellow fever virus
AEMEKDSWIV

SEQ ID NO: 172783 - protein, 10 aa, Yellow fever virus
EMEKDSWIVD

SEQ ID NO: 172784 - protein, 10 aa, Yellow fever virus
MEKDSWIVDR

SEQ ID NO: 172785 - protein, 10 aa, Yellow fever virus
EKDSWIVDRQ

SEQ ID NO: 172786 - protein, 10 aa, Yellow fever virus
KDSWIVDRQW

SEQ ID NO: 172787 - protein, 10 aa, Yellow fever virus
QSGSGGVWRG

SEQ ID NO: 172788 - protein, 10 aa, Yellow fever virus
SGSGGVWRGM

SEQ ID NO: 172789 - protein, 10 aa, Yellow fever virus
GSGGVWRGMH

SEQ ID NO: 172790 - protein, 10 aa, Yellow fever virus
SGGVWRGMHH

SEQ ID NO: 172791 - protein, 10 aa, Yellow fever virus
GGVWRGMHHL

SEQ ID NO: 172792 - protein, 10 aa, Yellow fever virus
GVWRGMHHLV

SEQ ID NO: 172793 - protein, 10 aa, Yellow fever virus
VWRGMHHLVE

SEQ ID NO: 172794 - protein, 10 aa, Yellow fever virus
VTIRVLALGN

SEQ ID NO: 172795 - protein, 10 aa, Yellow fever virus
SFVKNPTDTD

SEQ ID NO: 172796 - protein, 10 aa, Yellow fever virus
VKVPKGAPCR

SEQ ID NO: 172797 - protein, 10 aa, Yellow fever virus
KVPKGAPCRI

SEQ ID NO: 172798 - protein, 10 aa, Yellow fever virus
VPKGAPCRIP

SEQ ID NO: 172799 - protein, 10 aa, Yellow fever virus
PKGAPCRIPV

SEQ ID NO: 172800 - protein, 10 aa, Yellow fever virus
FGDSYIIIGT

SEQ ID NO: 172801 - protein, 10 aa, Yellow fever virus
GDSYIIIGTG

SEQ ID NO: 172802 - protein, 10 aa, Yellow fever virus
DSYIIIGTGD

SEQ ID NO: 172803 - protein, 10 aa, Yellow fever virus
SYIIIGTGDS

SEQ ID NO: 172804 - protein, 10 aa, Yellow fever virus
YIIIGTGDSR

SEQ ID NO: 172805 - protein, 10 aa, Yellow fever virus
IIIGTGDSRL

SEQ ID NO: 172806 - protein, 10 aa, Yellow fever virus
IIGTGDSRLT

SEQ ID NO: 172807 - protein, 10 aa, Yellow fever virus
IGTGDSRLTY

SEQ ID NO: 172808 - protein, 10 aa, Yellow fever virus
VERLAVMGDV

SEQ ID NO: 172809 - protein, 10 aa, Yellow fever virus
ERLAVMGDVA

SEQ ID NO: 172810 - protein, 10 aa, Yellow fever virus
RLAVMGDVAW

SEQ ID NO: 172811 - protein, 10 aa, Yellow fever virus
LAVMGDVAWD

SEQ ID NO: 172812 - protein, 10 aa, Yellow fever virus
AVMGDVAWDF

SEQ ID NO: 172813 - protein, 10 aa, Yellow fever virus
VMGDVAWDFS

SEQ ID NO: 172814 - protein, 10 aa, Yellow fever virus
MGDVAWDFSS

SEQ ID NO: 172815 - protein, 10 aa, Yellow fever virus
GDVAWDFSSA

SEQ ID NO: 172816 - protein, 10 aa, Yellow fever virus
DVAWDFSSAG

SEQ ID NO: 172817 - protein, 10 aa, Yellow fever virus
VAWDFSSAGG

SEQ ID NO: 172818 - protein, 10 aa, Yellow fever virus
WDFSSAGGFL

SEQ ID NO: 172819 - protein, 10 aa, Yellow fever virus
DFSSAGGFLT

SEQ ID NO: 172820 - protein, 10 aa, Yellow fever virus
FSSAGGFLTS

SEQ ID NO: 172821 - protein, 10 aa, Yellow fever virus
SSAGGLFTSI

SEQ ID NO: 172822 - protein, 10 aa, Yellow fever virus
SAGGFLTSVG

SEQ ID NO: 172823 - protein, 10 aa, Yellow fever virus
AGGLFTSIGK

SEQ ID NO: 172824 - protein, 10 aa, Yellow fever virus
GGFLTSVGKG

SEQ ID NO: 172825 - protein, 10 aa, Yellow fever virus
GLFTSIGKGS

SEQ ID NO: 172826 - protein, 10 aa, Yellow fever virus
FLTSVGKGIH

SEQ ID NO: 172827 - protein, 10 aa, Yellow fever virus
LTSVGKGIHT

SEQ ID NO: 172828 - protein, 10 aa, Yellow fever virus
GLNWITKVII

SEQ ID NO: 172829 - protein, 10 aa, Yellow fever virus
LNWITKVIIG

SEQ ID NO: 172830 - protein, 10 aa, Yellow fever virus
NWITKVIMGV

SEQ ID NO: 172831 - protein, 10 aa, Yellow fever virus
WITKVIIGAV

SEQ ID NO: 172832 - protein, 10 aa, Yellow fever virus
ITKVIMGVVL

SEQ ID NO: 172833 - protein, 10 aa, Yellow fever virus
TKVIMGVVLI

SEQ ID NO: 172834 - protein, 10 aa, Yellow fever virus
KVIIGAVLIW

SEQ ID NO: 172835 - protein, 10 aa, Yellow fever virus
VIIGAVLIWV

SEQ ID NO: 172836 - protein, 10 aa, Yellow fever virus
IIGAVLIWVG

SEQ ID NO: 172837 - protein, 10 aa, Yellow fever virus
MGAVLIWVGF

SEQ ID NO: 172838 - protein, 10 aa, Yellow fever virus
GVVLIWVGIN

SEQ ID NO: 172839 - protein, 10 aa, Yellow fever virus
VVLIWVGINT

SEQ ID NO: 172840 - protein, 10 aa, Yellow fever virus
ADQGCAINFA

SEQ ID NO: 172841 - protein, 10 aa, Yellow fever virus
DQGCAINFAK

SEQ ID NO: 172842 - protein, 10 aa, Yellow fever virus
QGCAINFAKR

SEQ ID NO: 172843 - protein, 10 aa, Yellow fever virus
GCAINFAKRE

SEQ ID NO: 172844 - protein, 10 aa, Yellow fever virus
CAINFAKREL

SEQ ID NO: 172845 - protein, 10 aa, Yellow fever virus
AINFAKRELK

SEQ ID NO: 172846 - protein, 10 aa, Yellow fever virus
INFAKRELKC

SEQ ID NO: 172847 - protein, 10 aa, Yellow fever virus
KLASIIKASY

SEQ ID NO: 172848 - protein, 10 aa, Yellow fever virus
LASIIKASYE

SEQ ID NO: 172849 - protein, 10 aa, Yellow fever virus
ASIIKASYEE

SEQ ID NO: 172850 - protein, 10 aa, Yellow fever virus
SIIKASYEEG

SEQ ID NO: 172851 - protein, 10 aa, Yellow fever virus
IIKASYEEGK

SEQ ID NO: 172852 - protein, 10 aa, Yellow fever virus
IKASYEEGKC

SEQ ID NO: 172853 - protein, 10 aa, Yellow fever virus
KASYEEGKCG

SEQ ID NO: 172854 - protein, 10 aa, Yellow fever virus
ASYEEGKCGL

SEQ ID NO: 172855 - protein, 10 aa, Yellow fever virus
SYEEGKCGLN

SEQ ID NO: 172856 - protein, 10 aa, Yellow fever virus
YEEGKCGLNS

SEQ ID NO: 172857 - protein, 10 aa, Yellow fever virus
FEENEVDISI

SEQ ID NO: 172858 - protein, 10 aa, Yellow fever virus
SIVVQDPKNI

SEQ ID NO: 172859 - protein, 10 aa, Yellow fever virus
IVVQDPKNIY

SEQ ID NO: 172860 - protein, 10 aa, Yellow fever virus
GWKTWGKSLV

SEQ ID NO: 172861 - protein, 10 aa, Yellow fever virus
WKTWGKSLVF

SEQ ID NO: 172862 - protein, 10 aa, Yellow fever virus
KTWGKSLVFS

SEQ ID NO: 172863 - protein, 10 aa, Yellow fever virus
TWGKSLVFSP

SEQ ID NO: 172864 - protein, 10 aa, Yellow fever virus
WGKSLVFSPG

SEQ ID NO: 172865 - protein, 10 aa, Yellow fever virus
GKSLVFSPGR

SEQ ID NO: 172866 - protein, 10 aa, Yellow fever virus
KSLVFSPGRK

SEQ ID NO: 172867 - protein, 10 aa, Yellow fever virus
SLVFSPGRKN

SEQ ID NO: 172868 - protein, 10 aa, Yellow fever virus
FTTRVFMDAT

SEQ ID NO: 172869 - protein, 10 aa, Yellow fever virus
TTRVFMDATF

SEQ ID NO: 172870 - protein, 10 aa, Yellow fever virus
TRVFMDATFD

SEQ ID NO: 172871 - protein, 10 aa, Yellow fever virus
RVFMDATFDY

SEQ ID NO: 172872 - protein, 10 aa, Yellow fever virus
VFMDATFDYS

SEQ ID NO: 172873 - protein, 10 aa, Yellow fever virus
FMDATFDYSV

SEQ ID NO: 172874 - protein, 10 aa, Yellow fever virus
MDATFDYSVD

SEQ ID NO: 172875 - protein, 10 aa, Yellow fever virus
DATFDYSVDC

SEQ ID NO: 172876 - protein, 10 aa, Yellow fever virus
ATFDYSVDCD

SEQ ID NO: 172877 - protein, 10 aa, Yellow fever virus
TFDYSVDCDG

SEQ ID NO: 172878 - protein, 10 aa, Yellow fever virus
SHEVNGTWMM

SEQ ID NO: 172879 - protein, 10 aa, Yellow fever virus
HEVNGTWMVH

SEQ ID NO: 172880 - protein, 10 aa, Yellow fever virus
EVNGTWMMHT

SEQ ID NO: 172881 - protein, 10 aa, Yellow fever virus
VNGTWMMHTL

SEQ ID NO: 172882 - protein, 10 aa, Yellow fever virus
NGTWMVHTLE

SEQ ID NO: 172883 - protein, 10 aa, Yellow fever virus
GTWMMHTLET

SEQ ID NO: 172884 - protein, 10 aa, Yellow fever virus
TWMVHTLETL

SEQ ID NO: 172885 - protein, 10 aa, Yellow fever virus
WMMHTLETLD

SEQ ID NO: 172886 - protein, 10 aa, Yellow fever virus
MVHTLETLDY

SEQ ID NO: 172887 - protein, 10 aa, Yellow fever virus
MHTLETLDYK

SEQ ID NO: 172888 - protein, 10 aa, Yellow fever virus
QVPLEVRREA

SEQ ID NO: 172889 - protein, 10 aa, Yellow fever virus
VPLEVRREAC

SEQ ID NO: 172890 - protein, 10 aa, Yellow fever virus
PLEVRREPCP

SEQ ID NO: 172891 - protein, 10 aa, Yellow fever virus
LEVRREPCPG

SEQ ID NO: 172892 - protein, 10 aa, Yellow fever virus
EVRREACPGT

SEQ ID NO: 172893 - protein, 10 aa, Yellow fever virus
VRREACPGTS

SEQ ID NO: 172894 - protein, 10 aa, Yellow fever virus
RREACPGTSV

SEQ ID NO: 172895 - protein, 10 aa, Yellow fever virus
REVCPGTSVV

SEQ ID NO: 172896 - protein, 10 aa, Yellow fever virus
EVCPGTSVVV

SEQ ID NO: 172897 - protein, 10 aa, Yellow fever virus
VCPGTSVVVD

SEQ ID NO: 172898 - protein, 10 aa, Yellow fever virus
CPGTSVVVDT

SEQ ID NO: 172899 - protein, 10 aa, Yellow fever virus
PGTSVVLDTG

SEQ ID NO: 172900 - protein, 10 aa, Yellow fever virus
GTSVVVDTSC

SEQ ID NO: 172901 - protein, 10 aa, Yellow fever virus
TSVVLDTGCD

SEQ ID NO: 172902 - protein, 10 aa, Yellow fever virus
SVVVDTSCDG

SEQ ID NO: 172903 - protein, 10 aa, Yellow fever virus
VVLDTGCDGR

SEQ ID NO: 172904 - protein, 10 aa, Yellow fever virus
VVDSNCDGRG

SEQ ID NO: 172905 - protein, 10 aa, Yellow fever virus
VDSNCDGRGK

SEQ ID NO: 172906 - protein, 10 aa, Yellow fever virus
DTSCDGRGKS

SEQ ID NO: 172907 - protein, 10 aa, Yellow fever virus
TGCDGRGKST

SEQ ID NO: 172908 - protein, 10 aa, Yellow fever virus
NCDGRGKSAR

SEQ ID NO: 172909 - protein, 10 aa, Yellow fever virus
ARSTTDSGKI

SEQ ID NO: 172910 - protein, 10 aa, Yellow fever virus
YPMEIRPRKA

SEQ ID NO: 172911 - protein, 10 aa, Yellow fever virus
PMEIRPRKAH

SEQ ID NO: 172912 - protein, 10 aa, Yellow fever virus
MEIRPRKAHE

SEQ ID NO: 172913 - protein, 10 aa, Yellow fever virus
EIRPMKTSDS

SEQ ID NO: 172914 - protein, 10 aa, Yellow fever virus
IRPRKAHESH

SEQ ID NO: 172915 - protein, 10 aa, Yellow fever virus
RPMKTSDSHL

SEQ ID NO: 172916 - protein, 10 aa, Yellow fever virus
PMKTSDSHLV

SEQ ID NO: 172917 - protein, 10 aa, Yellow fever virus
RKAHESHLVR

SEQ ID NO: 172918 - protein, 10 aa, Yellow fever virus
KTSDSHLVRS

SEQ ID NO: 172919 - protein, 10 aa, Yellow fever virus
TSDSHLVRSW

SEQ ID NO: 172920 - protein, 10 aa, Yellow fever virus
MIAMEVVLRR

SEQ ID NO: 172921 - protein, 10 aa, Yellow fever virus
IALEVVLRKR

SEQ ID NO: 172922 - protein, 10 aa, Yellow fever virus
ALEVVLRKRQ

SEQ ID NO: 172923 - protein, 10 aa, Yellow fever virus
MEVVLRRRQG

SEQ ID NO: 172924 - protein, 10 aa, Yellow fever virus
LRRRQGPKQM

SEQ ID NO: 172925 - protein, 10 aa, Yellow fever virus
RRRQGPKQML

SEQ ID NO: 172926 - protein, 10 aa, Yellow fever virus
RRQGPKQMLV

SEQ ID NO: 172927 - protein, 10 aa, Yellow fever virus
GPKQMLVGGM

SEQ ID NO: 172928 - protein, 10 aa, Yellow fever virus
PKQMLVGGMV

SEQ ID NO: 172929 - protein, 10 aa, Yellow fever virus
KQVLVGGVVL

SEQ ID NO: 172930 - protein, 10 aa, Yellow fever virus
QMLVGGMVLL

SEQ ID NO: 172931 - protein, 10 aa, Yellow fever virus
VLVGGVVLLG

SEQ ID NO: 172932 - protein, 10 aa, Yellow fever virus
LVGGMVLLGA

SEQ ID NO: 172933 - protein, 10 aa, Yellow fever virus
VGGMVLLGAM

SEQ ID NO: 172934 - protein, 10 aa, Yellow fever virus
GGMVLLGAML

SEQ ID NO: 172935 - protein, 10 aa, Yellow fever virus
GMVLLGAMLV

SEQ ID NO: 172936 - protein, 10 aa, Yellow fever virus
MVLLGAMLVG

SEQ ID NO: 172937 - protein, 10 aa, Yellow fever virus
GAMLVGQVTM

SEQ ID NO: 172938 - protein, 10 aa, Yellow fever virus
AMLVGQVTML

SEQ ID NO: 172939 - protein, 10 aa, Yellow fever virus
MLVGQVTMLD

SEQ ID NO: 172940 - protein, 10 aa, Yellow fever virus
LVGQVTMLDL

SEQ ID NO: 172941 - protein, 10 aa, Yellow fever virus
VGQVTMLDLV

SEQ ID NO: 172942 - protein, 10 aa, Yellow fever virus
GQVTMLDLVK

SEQ ID NO: 172943 - protein, 10 aa, Yellow fever virus
FVVAVGLHFH

SEQ ID NO: 172944 - protein, 10 aa, Yellow fever virus
TMAVGLHFHE

SEQ ID NO: 172945 - protein, 10 aa, Yellow fever virus
MAVGLHFHEM

SEQ ID NO: 172946 - protein, 10 aa, Yellow fever virus
YMALIAAFSV

SEQ ID NO: 172947 - protein, 10 aa, Yellow fever virus
MALIAAFSVR

SEQ ID NO: 172948 - protein, 10 aa, Yellow fever virus
ALIAAFSVRP

SEQ ID NO: 172949 - protein, 10 aa, Yellow fever virus
LIAAFSVRPG

SEQ ID NO: 172950 - protein, 10 aa, Yellow fever virus
IAAFSVRPGL

SEQ ID NO: 172951 - protein, 10 aa, Yellow fever virus
AAFSVRPGLL

SEQ ID NO: 172952 - protein, 10 aa, Yellow fever virus
SFSIRPGLLV

SEQ ID NO: 172953 - protein, 10 aa, Yellow fever virus
FSIRPGLLMG

SEQ ID NO: 172954 - protein, 10 aa, Yellow fever virus
SIRPGLLVGF

SEQ ID NO: 172955 - protein, 10 aa, Yellow fever virus
IRPGLLVGFG

SEQ ID NO: 172956 - protein, 10 aa, Yellow fever virus
RPGLLVGFGL

SEQ ID NO: 172957 - protein, 10 aa, Yellow fever virus
PGLLMGFGLR

SEQ ID NO: 172958 - protein, 10 aa, Yellow fever virus
GLLVGFGLRT

SEQ ID NO: 172959 - protein, 10 aa, Yellow fever virus
LLVGFGLRTL

SEQ ID NO: 172960 - protein, 10 aa, Yellow fever virus
LMGFGLRTLW

SEQ ID NO: 172961 - protein, 10 aa, Yellow fever virus
MGFGLRTLWS

SEQ ID NO: 172962 - protein, 10 aa, Yellow fever virus
WSPRERLVLA

SEQ ID NO: 172963 - protein, 10 aa, Yellow fever virus
SPRERLVLAL

SEQ ID NO: 172964 - protein, 10 aa, Yellow fever virus
PRERLVLALG

SEQ ID NO: 172965 - protein, 10 aa, Yellow fever virus
RERLVLALGA

SEQ ID NO: 172966 - protein, 10 aa, Yellow fever virus
ERLVLALGAA

SEQ ID NO: 172967 - protein, 10 aa, Yellow fever virus
RLVLALGAAM

SEQ ID NO: 172968 - protein, 10 aa, Yellow fever virus
LVLALGAAMV

SEQ ID NO: 172969 - protein, 10 aa, Yellow fever virus
VLALGAAMVE

SEQ ID NO: 172970 - protein, 10 aa, Yellow fever virus
MAFGAAMVEV

SEQ ID NO: 172971 - protein, 10 aa, Yellow fever virus
ALGAAMVEIA

SEQ ID NO: 172972 - protein, 10 aa, Yellow fever virus
FGAAMVEIAL

SEQ ID NO: 172973 - protein, 10 aa, Yellow fever virus
AMVEVALGGM

SEQ ID NO: 172974 - protein, 10 aa, Yellow fever virus
MVEVALGGMM

SEQ ID NO: 172975 - protein, 10 aa, Yellow fever virus
VEVALGGMMG

SEQ ID NO: 172976 - protein, 10 aa, Yellow fever virus
EVALGGMMGG

SEQ ID NO: 172977 - protein, 10 aa, Yellow fever virus
VALGGMMGGL

SEQ ID NO: 172978 - protein, 10 aa, Yellow fever virus
LGGMMGGLWQ

SEQ ID NO: 172979 - protein, 10 aa, Yellow fever virus
GGMMGGLWQY

SEQ ID NO: 172980 - protein, 10 aa, Yellow fever virus
GMMGGLWQYL

SEQ ID NO: 172981 - protein, 10 aa, Yellow fever virus
MMGGLWQYLN

SEQ ID NO: 172982 - protein, 10 aa, Yellow fever virus
AVASRKASNA

SEQ ID NO: 172983 - protein, 10 aa, Yellow fever virus
ISSRKASNTI

SEQ ID NO: 172984 - protein, 10 aa, Yellow fever virus
SSRKASNTIL

SEQ ID NO: 172985 - protein, 10 aa, Yellow fever virus
SRKASNAILP

SEQ ID NO: 172986 - protein, 10 aa, Yellow fever virus
RKASNMILPL

SEQ ID NO: 172987 - protein, 10 aa, Yellow fever virus
KASNAVLPLM

SEQ ID NO: 172988 - protein, 10 aa, Yellow fever virus
ASNMILPLMA

SEQ ID NO: 172989 - protein, 10 aa, Yellow fever virus
SNAILPLMAL

SEQ ID NO: 172990 - protein, 10 aa, Yellow fever virus
NAVLPLMALL

SEQ ID NO: 172991 - protein, 10 aa, Yellow fever virus
AVLPLMALLT

SEQ ID NO: 172992 - protein, 10 aa, Yellow fever virus
VLPLMALLTP

SEQ ID NO: 172993 - protein, 10 aa, Yellow fever virus
MALMTPMTMH

SEQ ID NO: 172994 - protein, 10 aa, Yellow fever virus
ALMTPMTMHE

SEQ ID NO: 172995 - protein, 10 aa, Yellow fever virus
LLTPVTMHEV

SEQ ID NO: 172996 - protein, 10 aa, Yellow fever virus
LTPVTMHEVR

SEQ ID NO: 172997 - protein, 10 aa, Yellow fever virus
TPVTMYEVRM

SEQ ID NO: 172998 - protein, 10 aa, Yellow fever virus
PMTMHEVRMA

SEQ ID NO: 172999 - protein, 10 aa, Yellow fever virus
VTMYEVRMAT

SEQ ID NO: 173000 - protein, 10 aa, Yellow fever virus
TMHEVRMATM

SEQ ID NO: 173001 - protein, 10 aa, Yellow fever virus
MAEVRLAAML

SEQ ID NO: 173002 - protein, 10 aa, Yellow fever virus
EVRLATMLFC

SEQ ID NO: 173003 - protein, 10 aa, Yellow fever virus
AAMLFCAVVI

SEQ ID NO: 173004 - protein, 10 aa, Yellow fever virus
MLFCAVVIIG

SEQ ID NO: 173005 - protein, 10 aa, Yellow fever virus
LFCAVVIIGV

SEQ ID NO: 173006 - protein, 10 aa, Yellow fever virus
FCTVVIVGVL

SEQ ID NO: 173007 - protein, 10 aa, Yellow fever virus
CTVVIVGVLH

SEQ ID NO: 173008 - protein, 10 aa, Yellow fever virus
TVVIVGVLHQ

SEQ ID NO: 173009 - protein, 10 aa, Yellow fever virus
VVIIGVLYQN

SEQ ID NO: 173010 - protein, 10 aa, Yellow fever virus
VIIGVLYQNS

SEQ ID NO: 173011 - protein, 10 aa, Yellow fever virus
IVGVLHQNAK

SEQ ID NO: 173012 - protein, 10 aa, Yellow fever virus
VGVLHQNSKD

SEQ ID NO: 173013 - protein, 10 aa, Yellow fever virus
GVLYQNSKDT

SEQ ID NO: 173014 - protein, 10 aa, Yellow fever virus
VLYQNSKDTS

SEQ ID NO: 173015 - protein, 10 aa, Yellow fever virus
LYQNSKDTSM

SEQ ID NO: 173016 - protein, 10 aa, Yellow fever virus
HQNAKDTSMQ

SEQ ID NO: 173017 - protein, 10 aa, Yellow fever virus
QNAKDTSMQK

SEQ ID NO: 173018 - protein, 10 aa, Yellow fever virus
NAKDTSMQKT

SEQ ID NO: 173019 - protein, 10 aa, Yellow fever virus
AKDTSMQKTI

SEQ ID NO: 173020 - protein, 10 aa, Yellow fever virus
GLCAFLATRL

SEQ ID NO: 173021 - protein, 10 aa, Yellow fever virus
LCAFLATRLF

SEQ ID NO: 173022 - protein, 10 aa, Yellow fever virus
CAFLATRLFG

SEQ ID NO: 173023 - protein, 10 aa, Yellow fever virus
AFLATRLFGR

SEQ ID NO: 173024 - protein, 10 aa, Yellow fever virus
FLATRLFGRR

SEQ ID NO: 173025 - protein, 10 aa, Yellow fever virus
LATRLFGRRS

SEQ ID NO: 173026 - protein, 10 aa, Yellow fever virus
ATRLFGRRSI

SEQ ID NO: 173027 - protein, 10 aa, Yellow fever virus
TRLFGRRSIP

SEQ ID NO: 173028 - protein, 10 aa, Yellow fever virus
RLFGRRSIPV

SEQ ID NO: 173029 - protein, 10 aa, Yellow fever virus
LFGRRSIPVN

SEQ ID NO: 173030 - protein, 10 aa, Yellow fever virus
AGRVDGLELR

SEQ ID NO: 173031 - protein, 10 aa, Yellow fever virus
GRVDGLELRK

SEQ ID NO: 173032 - protein, 10 aa, Yellow fever virus
KVDGLELKKL

SEQ ID NO: 173033 - protein, 10 aa, Yellow fever virus
GLELKKLGEI

SEQ ID NO: 173034 - protein, 10 aa, Yellow fever virus
LELKKLGEVA

SEQ ID NO: 173035 - protein, 10 aa, Yellow fever virus
ELKKLGEISW

SEQ ID NO: 173036 - protein, 10 aa, Yellow fever virus
LKKLGEISWE

SEQ ID NO: 173037 - protein, 10 aa, Yellow fever virus
KKLGEVAWEE

SEQ ID NO: 173038 - protein, 10 aa, Yellow fever virus
KLGEVAWEEE

SEQ ID NO: 173039 - protein, 10 aa, Yellow fever virus
LGEISWEEEA

SEQ ID NO: 173040 - protein, 10 aa, Yellow fever virus
GEISWEEEAE

SEQ ID NO: 173041 - protein, 10 aa, Yellow fever virus
EISWEEEAEI

SEQ ID NO: 173042 - protein, 10 aa, Yellow fever virus
VAWEEEAEIS

SEQ ID NO: 173043 - protein, 10 aa, Yellow fever virus
SSARYDVALN

SEQ ID NO: 173044 - protein, 10 aa, Yellow fever virus
SARYDVALNE

SEQ ID NO: 173045 - protein, 10 aa, Yellow fever virus
ARYDVALNEQ

SEQ ID NO: 173046 - protein, 10 aa, Yellow fever virus
ALVGAAIHPS

SEQ ID NO: 173047 - protein, 10 aa, Yellow fever virus
LVGAAIHPSA

SEQ ID NO: 173048 - protein, 10 aa, Yellow fever virus
VGAAIHPSAL

SEQ ID NO: 173049 - protein, 10 aa, Yellow fever virus
GAAIHPSALL

SEQ ID NO: 173050 - protein, 10 aa, Yellow fever virus
AAIHPSALLL

SEQ ID NO: 173051 - protein, 10 aa, Yellow fever virus
AIHPSALLLV

SEQ ID NO: 173052 - protein, 10 aa, Yellow fever virus
IHPSALLLVL

SEQ ID NO: 173053 - protein, 10 aa, Yellow fever virus
HPSALLLVLA

SEQ ID NO: 173054 - protein, 10 aa, Yellow fever virus
PSALLLVLAG

SEQ ID NO: 173055 - protein, 10 aa, Yellow fever virus
SALLLVLAGW

SEQ ID NO: 173056 - protein, 10 aa, Yellow fever virus
ALLLVLGGWI

SEQ ID NO: 173057 - protein, 10 aa, Yellow fever virus
LLLVLGGWIL

SEQ ID NO: 173058 - protein, 10 aa, Yellow fever virus
LLVLGGWILH

SEQ ID NO: 173059 - protein, 10 aa, Yellow fever virus
LVLGGWILHI

SEQ ID NO: 173060 - protein, 10 aa, Yellow fever virus
VLGGWVLHIK

SEQ ID NO: 173061 - protein, 10 aa, Yellow fever virus
LAGWLFHVRR

SEQ ID NO: 173062 - protein, 10 aa, Yellow fever virus
AGWLFHVRRA

SEQ ID NO: 173063 - protein, 10 aa, Yellow fever virus
GWVLHIKGAR

SEQ ID NO: 173064 - protein, 10 aa, Yellow fever virus
WLFHVRRARR

SEQ ID NO: 173065 - protein, 10 aa, Yellow fever virus
VLHIKGARRS

SEQ ID NO: 173066 - protein, 10 aa, Yellow fever virus
FHVKGARRSG

SEQ ID NO: 173067 - protein, 10 aa, Yellow fever virus
HVKGARRSGD

SEQ ID NO: 173068 - protein, 10 aa, Yellow fever virus
IKGARRSGDV

SEQ ID NO: 173069 - protein, 10 aa, Yellow fever virus
RRARRSGDVL

SEQ ID NO: 173070 - protein, 10 aa, Yellow fever virus
TPKVIEECEY

SEQ ID NO: 173071 - protein, 10 aa, Yellow fever virus
PKVIEECEYL

SEQ ID NO: 173072 - protein, 10 aa, Yellow fever virus
KVIEECEYLE

SEQ ID NO: 173073 - protein, 10 aa, Yellow fever virus
VIEECEYLED

SEQ ID NO: 173074 - protein, 10 aa, Yellow fever virus
ECEHLEDGIS

SEQ ID NO: 173075 - protein, 10 aa, Yellow fever virus
CEHLEDGISG

SEQ ID NO: 173076 - protein, 10 aa, Yellow fever virus
EHLEDGISGI

SEQ ID NO: 173077 - protein, 10 aa, Yellow fever virus
YLEDGIYGIF

SEQ ID NO: 173078 - protein, 10 aa, Yellow fever virus
HVTRGAFLVW

SEQ ID NO: 173079 - protein, 10 aa, Yellow fever virus
VTRGAFLVWN

SEQ ID NO: 173080 - protein, 10 aa, Yellow fever virus
TRGAFLVWNG

SEQ ID NO: 173081 - protein, 10 aa, Yellow fever virus
RGAFLVWNGK

SEQ ID NO: 173082 - protein, 10 aa, Yellow fever virus
GAFLVWNGKK

SEQ ID NO: 173083 - protein, 10 aa, Yellow fever virus
AFLVWNGKKL

SEQ ID NO: 173084 - protein, 10 aa, Yellow fever virus
FLVWNGKKLI

SEQ ID NO: 173085 - protein, 10 aa, Yellow fever virus
LVWNGKKLIP

SEQ ID NO: 173086 - protein, 10 aa, Yellow fever virus
VWNGKKLIPS

SEQ ID NO: 173087 - protein, 10 aa, Yellow fever virus
WNGKKLIPSW

SEQ ID NO: 173088 - protein, 10 aa, Yellow fever virus
YGGSWKLDGR

SEQ ID NO: 173089 - protein, 10 aa, Yellow fever virus
GGSWKLDGRW

SEQ ID NO: 173090 - protein, 10 aa, Yellow fever virus
GSWKLDGRWD

SEQ ID NO: 173091 - protein, 10 aa, Yellow fever virus
SWKLDGRWDG

SEQ ID NO: 173092 - protein, 10 aa, Yellow fever virus
WKLDGRWDGE

SEQ ID NO: 173093 - protein, 10 aa, Yellow fever virus
KLDGRWDGEE

SEQ ID NO: 173094 - protein, 10 aa, Yellow fever virus
LDGRWDGEEE

SEQ ID NO: 173095 - protein, 10 aa, Yellow fever virus
DGRWDGEEEV

SEQ ID NO: 173096 - protein, 10 aa, Yellow fever virus
QLIAAAPGKN

SEQ ID NO: 173097 - protein, 10 aa, Yellow fever virus
LIAAAPGKNV

SEQ ID NO: 173098 - protein, 10 aa, Yellow fever virus
IAAVPGKSVV

SEQ ID NO: 173099 - protein, 10 aa, Yellow fever virus
AAVPGKSVVN

SEQ ID NO: 173100 - protein, 10 aa, Yellow fever virus
AVPGKSVVNV

SEQ ID NO: 173101 - protein, 10 aa, Yellow fever virus
VPGKSVVNVQ

SEQ ID NO: 173102 - protein, 10 aa, Yellow fever virus
PGKSVVNVQT

SEQ ID NO: 173103 - protein, 10 aa, Yellow fever virus
GKSVVNVQTK

SEQ ID NO: 173104 - protein, 10 aa, Yellow fever virus
KSVVNVQTKP

SEQ ID NO: 173105 - protein, 10 aa, Yellow fever virus
SVVNVQTKPS

SEQ ID NO: 173106 - protein, 10 aa, Yellow fever virus
NVQTKPSLFR

SEQ ID NO: 173107 - protein, 10 aa, Yellow fever virus
VQTKPSVFKV

SEQ ID NO: 173108 - protein, 10 aa, Yellow fever virus
QTKPSVFKVR

SEQ ID NO: 173109 - protein, 10 aa, Yellow fever virus
TKPSLFRVKN

SEQ ID NO: 173110 - protein, 10 aa, Yellow fever virus
KPSVFKVRNG

SEQ ID NO: 173111 - protein, 10 aa, Yellow fever virus
PSVFKVRNGG

SEQ ID NO: 173112 - protein, 10 aa, Yellow fever virus
SVFKVRNGGE

SEQ ID NO: 173113 - protein, 10 aa, Yellow fever virus
LFRVKNGGEI

SEQ ID NO: 173114 - protein, 10 aa, Yellow fever virus
PIVNRNGEVV

SEQ ID NO: 173115 - protein, 10 aa, Yellow fever virus
IVNRNGEVVG

SEQ ID NO: 173116 - protein, 10 aa, Yellow fever virus
VNRNGEVVGL

SEQ ID NO: 173117 - protein, 10 aa, Yellow fever virus
NRNGEVVGLY

SEQ ID NO: 173118 - protein, 10 aa, Yellow fever virus
RNGEVVGLYG

SEQ ID NO: 173119 - protein, 10 aa, Yellow fever virus
NGEVVGLYGN

SEQ ID NO: 173120 - protein, 10 aa, Yellow fever virus
ISQTELKEES

SEQ ID NO: 173121 - protein, 10 aa, Yellow fever virus
SQTELKEESK

SEQ ID NO: 173122 - protein, 10 aa, Yellow fever virus
QTELKEESKE

SEQ ID NO: 173123 - protein, 10 aa, Yellow fever virus
TELKEESKEE

SEQ ID NO: 173124 - protein, 10 aa, Yellow fever virus
ELKEESKEEL

SEQ ID NO: 173125 - protein, 10 aa, Yellow fever virus
VKEESKEELQ

SEQ ID NO: 173126 - protein, 10 aa, Yellow fever virus
KEESKEELQE

SEQ ID NO: 173127 - protein, 10 aa, Yellow fever virus
EEGKEELREI

SEQ ID NO: 173128 - protein, 10 aa, Yellow fever virus
EGKEELREIP

SEQ ID NO: 173129 - protein, 10 aa, Yellow fever virus
SKEELQEIPT

SEQ ID NO: 173130 - protein, 10 aa, Yellow fever virus
KEELQEISTM

SEQ ID NO: 173131 - protein, 10 aa, Yellow fever virus
EELQEISTML

SEQ ID NO: 173132 - protein, 10 aa, Yellow fever virus
ELQEISTMLK

SEQ ID NO: 173133 - protein, 10 aa, Yellow fever virus
LQEISTMLKK

SEQ ID NO: 173134 - protein, 10 aa, Yellow fever virus
QEISTMLKKG

SEQ ID NO: 173135 - protein, 10 aa, Yellow fever virus
EISTMLKKGM

SEQ ID NO: 173136 - protein, 10 aa, Yellow fever virus
ISTMLKKGMT

SEQ ID NO: 173137 - protein, 10 aa, Yellow fever virus
STMLKKGMTT

SEQ ID NO: 173138 - protein, 10 aa, Yellow fever virus
TMLKKGKTTI

SEQ ID NO: 173139 - protein, 10 aa, Yellow fever virus
MLKKGKTTIL

SEQ ID NO: 173140 - protein, 10 aa, Yellow fever virus
LKKGKTTILD

SEQ ID NO: 173141 - protein, 10 aa, Yellow fever virus
KKGKTTILDF

SEQ ID NO: 173142 - protein, 10 aa, Yellow fever virus
KGKTTILDFH

SEQ ID NO: 173143 - protein, 10 aa, Yellow fever virus
GKTTILDFHP

SEQ ID NO: 173144 - protein, 10 aa, Yellow fever virus
KTTILDFHPG

SEQ ID NO: 173145 - protein, 10 aa, Yellow fever virus
TTILDYHPGA

SEQ ID NO: 173146 - protein, 10 aa, Yellow fever virus
TILDYHPGAG

SEQ ID NO: 173147 - protein, 10 aa, Yellow fever virus
ILDYHPGAGK

SEQ ID NO: 173148 - protein, 10 aa, Yellow fever virus
HGSGREVIDV

SEQ ID NO: 173149 - protein, 10 aa, Yellow fever virus
GSGREVIDVM

SEQ ID NO: 173150 - protein, 10 aa, Yellow fever virus
SGREVIDVMC

SEQ ID NO: 173151 - protein, 10 aa, Yellow fever virus
GREVIDVMCH

SEQ ID NO: 173152 - protein, 10 aa, Yellow fever virus
REVIDVMCHA

SEQ ID NO: 173153 - protein, 10 aa, Yellow fever virus
TYRMLEPTRA

SEQ ID NO: 173154 - protein, 10 aa, Yellow fever virus
YRMLEPTRAV

SEQ ID NO: 173155 - protein, 10 aa, Yellow fever virus
RMLEPTRAVN

SEQ ID NO: 173156 - protein, 10 aa, Yellow fever virus
MLEPTRAVNW

SEQ ID NO: 173157 - protein, 10 aa, Yellow fever virus
LEPTRAVNWE

SEQ ID NO: 173158 - protein, 10 aa, Yellow fever virus
EPTRAVNWEV

SEQ ID NO: 173159 - protein, 10 aa, Yellow fever virus
PTRAVNWEVI

SEQ ID NO: 173160 - protein, 10 aa, Yellow fever virus
TRAVNWEVII

SEQ ID NO: 173161 - protein, 10 aa, Yellow fever virus
RAVNWEVIIM

SEQ ID NO: 173162 - protein, 10 aa, Yellow fever virus
AVNWEVIIMD

SEQ ID NO: 173163 - protein, 10 aa, Yellow fever virus
TDIPSEPWTA

SEQ ID NO: 173164 - protein, 10 aa, Yellow fever virus
DIPSEPWTAG

SEQ ID NO: 173165 - protein, 10 aa, Yellow fever virus
IPSEPWTAGH

SEQ ID NO: 173166 - protein, 10 aa, Yellow fever virus
PSEPWTAGHE

SEQ ID NO: 173167 - protein, 10 aa, Yellow fever virus
SEPWTAGHEW

SEQ ID NO: 173168 - protein, 10 aa, Yellow fever virus
EPWTAGHEWI

SEQ ID NO: 173169 - protein, 10 aa, Yellow fever virus
PWTAGHEWIL

SEQ ID NO: 173170 - protein, 10 aa, Yellow fever virus
WTAGHEWILA

SEQ ID NO: 173171 - protein, 10 aa, Yellow fever virus
TAGHEWILAD

SEQ ID NO: 173172 - protein, 10 aa, Yellow fever virus
AGHEWILADK

SEQ ID NO: 173173 - protein, 10 aa, Yellow fever virus
KEYPTIKQKK

SEQ ID NO: 173174 - protein, 10 aa, Yellow fever virus
DRVLDCRTAF

SEQ ID NO: 173175 - protein, 10 aa, Yellow fever virus
YKPVLVDEGK

SEQ ID NO: 173176 - protein, 10 aa, Yellow fever virus
VAPLYGVEGI

SEQ ID NO: 173177 - protein, 10 aa, Yellow fever virus
APLYGVEGIK

SEQ ID NO: 173178 - protein, 10 aa, Yellow fever virus
PLYGVEGIKT

SEQ ID NO: 173179 - protein, 10 aa, Yellow fever virus
LYGVEGIKTP

SEQ ID NO: 173180 - protein, 10 aa, Yellow fever virus
YGVEGIKTPV

SEQ ID NO: 173181 - protein, 10 aa, Yellow fever virus
GVEGIKTPVS

SEQ ID NO: 173182 - protein, 10 aa, Yellow fever virus
VEGIKTPVSP

SEQ ID NO: 173183 - protein, 10 aa, Yellow fever virus
RLRDDQRRVS

SEQ ID NO: 173184 - protein, 10 aa, Yellow fever virus
LRDDQRRVSR

SEQ ID NO: 173185 - protein, 10 aa, Yellow fever virus
RDDQRRVSRE

SEQ ID NO: 173186 - protein, 10 aa, Yellow fever virus
DDQRRVSREL

SEQ ID NO: 173187 - protein, 10 aa, Yellow fever virus
DQRRVSRELV

SEQ ID NO: 173188 - protein, 10 aa, Yellow fever virus
QRRVSRELVR

SEQ ID NO: 173189 - protein, 10 aa, Yellow fever virus
RRVSRELVRN

SEQ ID NO: 173190 - protein, 10 aa, Yellow fever virus
RVSRELVRNC

SEQ ID NO: 173191 - protein, 10 aa, Yellow fever virus
VSRELVRNCD

SEQ ID NO: 173192 - protein, 10 aa, Yellow fever virus
FRELVRNCDQ

SEQ ID NO: 173193 - protein, 10 aa, Yellow fever virus
RELVRNCDQP

SEQ ID NO: 173194 - protein, 10 aa, Yellow fever virus
ELVRNCDQPV

SEQ ID NO: 173195 - protein, 10 aa, Yellow fever virus
LVRNCDQPVW

SEQ ID NO: 173196 - protein, 10 aa, Yellow fever virus
VRNCDQPVWL

SEQ ID NO: 173197 - protein, 10 aa, Yellow fever virus
RNCDQPVWLS

SEQ ID NO: 173198 - protein, 10 aa, Yellow fever virus
NCDQPVWLSW

SEQ ID NO: 173199 - protein, 10 aa, Yellow fever virus
CDLPVWLAWQ

SEQ ID NO: 173200 - protein, 10 aa, Yellow fever virus
DQPVWLSWQV

SEQ ID NO: 173201 - protein, 10 aa, Yellow fever virus
LPVWLAWQVA

SEQ ID NO: 173202 - protein, 10 aa, Yellow fever virus
VWLSWQVAKP

SEQ ID NO: 173203 - protein, 10 aa, Yellow fever virus
WLSWQVAKPG

SEQ ID NO: 173204 - protein, 10 aa, Yellow fever virus
LSWQVAKPGL

SEQ ID NO: 173205 - protein, 10 aa, Yellow fever virus
SWQVAKPGLK

SEQ ID NO: 173206 - protein, 10 aa, Yellow fever virus
DRKWCFDGPK

SEQ ID NO: 173207 - protein, 10 aa, Yellow fever virus
RKWCFEGPDE

SEQ ID NO: 173208 - protein, 10 aa, Yellow fever virus
KWCFEGPDEH

SEQ ID NO: 173209 - protein, 10 aa, Yellow fever virus
WCFDGPKEHE

SEQ ID NO: 173210 - protein, 10 aa, Yellow fever virus
CFDGPKEHEI

SEQ ID NO: 173211 - protein, 10 aa, Yellow fever virus
FEGPDEHEIL

SEQ ID NO: 173212 - protein, 10 aa, Yellow fever virus
EGPDEHEILN

SEQ ID NO: 173213 - protein, 10 aa, Yellow fever virus
GPDEHEILND

SEQ ID NO: 173214 - protein, 10 aa, Yellow fever virus
PKEHEILNDS

SEQ ID NO: 173215 - protein, 10 aa, Yellow fever virus
KEHEILNDSG

SEQ ID NO: 173216 - protein, 10 aa, Yellow fever virus
DSGETVKCRT

SEQ ID NO: 173217 - protein, 10 aa, Yellow fever virus
SGETVKCRTP

SEQ ID NO: 173218 - protein, 10 aa, Yellow fever virus
GETVKCRTPG

SEQ ID NO: 173219 - protein, 10 aa, Yellow fever virus
ETVKCRTPGG

SEQ ID NO: 173220 - protein, 10 aa, Yellow fever virus
TVKCRTPGGA

SEQ ID NO: 173221 - protein, 10 aa, Yellow fever virus
VKCRTPGGAK

SEQ ID NO: 173222 - protein, 10 aa, Yellow fever virus
KCRSPGGAKR

SEQ ID NO: 173223 - protein, 10 aa, Yellow fever virus
CRSPGGAKRA

SEQ ID NO: 173224 - protein, 10 aa, Yellow fever virus
RAPGGAKRPL

SEQ ID NO: 173225 - protein, 10 aa, Yellow fever virus
APGGAKRPLR

SEQ ID NO: 173226 - protein, 10 aa, Yellow fever virus
PGGAKRALRP

SEQ ID NO: 173227 - protein, 10 aa, Yellow fever virus
GGAKRPLRPR

SEQ ID NO: 173228 - protein, 10 aa, Yellow fever virus
GAKRPLRPRW

SEQ ID NO: 173229 - protein, 10 aa, Yellow fever virus
AKRPLRPRWC

SEQ ID NO: 173230 - protein, 10 aa, Yellow fever virus
KRPLRPRWCD

SEQ ID NO: 173231 - protein, 10 aa, Yellow fever virus
RPLRPRWCDE

SEQ ID NO: 173232 - protein, 10 aa, Yellow fever virus
AEGRRGAADV

SEQ ID NO: 173233 - protein, 10 aa, Yellow fever virus
EGRRGAAEIL

SEQ ID NO: 173234 - protein, 10 aa, Yellow fever virus
GRRGAADVLV

SEQ ID NO: 173235 - protein, 10 aa, Yellow fever virus
RRGAADVLVV

SEQ ID NO: 173236 - protein, 10 aa, Yellow fever virus
RGAAEILVVL

SEQ ID NO: 173237 - protein, 10 aa, Yellow fever virus
GAAEILVVLS

SEQ ID NO: 173238 - protein, 10 aa, Yellow fever virus
AADVLVVLSE

SEQ ID NO: 173239 - protein, 10 aa, Yellow fever virus
ADVLVVLSEL

SEQ ID NO: 173240 - protein, 10 aa, Yellow fever virus
EILVVLSELP

SEQ ID NO: 173241 - protein, 10 aa, Yellow fever virus
MLVILTELPD

SEQ ID NO: 173242 - protein, 10 aa, Yellow fever virus
LVILTELPDF

SEQ ID NO: 173243 - protein, 10 aa, Yellow fever virus
VILTELPDFL

SEQ ID NO: 173244 - protein, 10 aa, Yellow fever virus
ILTELPDFLA

SEQ ID NO: 173245 - protein, 10 aa, Yellow fever virus
EAMTIAMLFI

SEQ ID NO: 173246 - protein, 10 aa, Yellow fever virus
AMTIAMLFIL

SEQ ID NO: 173247 - protein, 10 aa, Yellow fever virus
MTIAMLFILA

SEQ ID NO: 173248 - protein, 10 aa, Yellow fever virus
TIAMLFILAG

SEQ ID NO: 173249 - protein, 10 aa, Yellow fever virus
IAMLFILAGL

SEQ ID NO: 173250 - protein, 10 aa, Yellow fever virus
AMLFILAGLL

SEQ ID NO: 173251 - protein, 10 aa, Yellow fever virus
LLAGLLTSGA

SEQ ID NO: 173252 - protein, 10 aa, Yellow fever virus
KGISRMSMAK

SEQ ID NO: 173253 - protein, 10 aa, Yellow fever virus
GISRMSMAKG

SEQ ID NO: 173254 - protein, 10 aa, Yellow fever virus
ISRMSMAKGT

SEQ ID NO: 173255 - protein, 10 aa, Yellow fever virus
SMAKGTMAGC

SEQ ID NO: 173256 - protein, 10 aa, Yellow fever virus
MAKGTMAGCG

SEQ ID NO: 173257 - protein, 10 aa, Yellow fever virus
AKGTMAGCGY

SEQ ID NO: 173258 - protein, 10 aa, Yellow fever virus
KGTMAGCGYL

SEQ ID NO: 173259 - protein, 10 aa, Yellow fever virus
CGYLMFLGGA

SEQ ID NO: 173260 - protein, 10 aa, Yellow fever virus
GYLMFLGGAK

SEQ ID NO: 173261 - protein, 10 aa, Yellow fever virus
YLMFLGGAKP

SEQ ID NO: 173262 - protein, 10 aa, Yellow fever virus
LMFLGGVEPT

SEQ ID NO: 173263 - protein, 10 aa, Yellow fever virus
MFLGGAKPTH

SEQ ID NO: 173264 - protein, 10 aa, Yellow fever virus
FLGGAKPTHI

SEQ ID NO: 173265 - protein, 10 aa, Yellow fever virus
LGGAKPTHIS

SEQ ID NO: 173266 - protein, 10 aa, Yellow fever virus
GGVEPTHISY

SEQ ID NO: 173267 - protein, 10 aa, Yellow fever virus
GAKPTHISYI

SEQ ID NO: 173268 - protein, 10 aa, Yellow fever virus
VEPTHISYIM

SEQ ID NO: 173269 - protein, 10 aa, Yellow fever virus
EPTHISYIML

SEQ ID NO: 173270 - protein, 10 aa, Yellow fever virus
IIPEPGQQRT

SEQ ID NO: 173271 - protein, 10 aa, Yellow fever virus
RTIQDNQVAY

SEQ ID NO: 173272 - protein, 10 aa, Yellow fever virus
SIQDNQVAFL

SEQ ID NO: 173273 - protein, 10 aa, Yellow fever virus
FLIIGILTLV

SEQ ID NO: 173274 - protein, 10 aa, Yellow fever virus
IIGILTLLSV

SEQ ID NO: 173275 - protein, 10 aa, Yellow fever virus
IGILTLLSVV

SEQ ID NO: 173276 - protein, 10 aa, Yellow fever virus
GILTLLSVVA

SEQ ID NO: 173277 - protein, 10 aa, Yellow fever virus
ILTLLSVVAA

SEQ ID NO: 173278 - protein, 10 aa, Yellow fever virus
LTLLSVVAAN

SEQ ID NO: 173279 - protein, 10 aa, Yellow fever virus
TLLSVVAANE

SEQ ID NO: 173280 - protein, 10 aa, Yellow fever virus
LLSVVAANEL

SEQ ID NO: 173281 - protein, 10 aa, Yellow fever virus
LSVVAANELG

SEQ ID NO: 173282 - protein, 10 aa, Yellow fever virus
SIVAANELGM

SEQ ID NO: 173283 - protein, 10 aa, Yellow fever virus
IVAANELGML

SEQ ID NO: 173284 - protein, 10 aa, Yellow fever virus
GMLERTKEDL

SEQ ID NO: 173285 - protein, 10 aa, Yellow fever virus
MLERTKEDLF

SEQ ID NO: 173286 - protein, 10 aa, Yellow fever virus
LERTKEDLFG

SEQ ID NO: 173287 - protein, 10 aa, Yellow fever virus
EKTKEDFFGR

SEQ ID NO: 173288 - protein, 10 aa, Yellow fever virus
RTKEDLFGKK

SEQ ID NO: 173289 - protein, 10 aa, Yellow fever virus
TKEDFFGKRN

SEQ ID NO: 173290 - protein, 10 aa, Yellow fever virus
IPSGASPWSW

SEQ ID NO: 173291 - protein, 10 aa, Yellow fever virus
PSGASPWSWP

SEQ ID NO: 173292 - protein, 10 aa, Yellow fever virus
SGAIPWSWPD

SEQ ID NO: 173293 - protein, 10 aa, Yellow fever virus
GAIPWSWPDL

SEQ ID NO: 173294 - protein, 10 aa, Yellow fever virus
AIPWSWPDLD

SEQ ID NO: 173295 - protein, 10 aa, Yellow fever virus
FMKMNISVVI

SEQ ID NO: 173296 - protein, 10 aa, Yellow fever virus
MKMNISVVIL

SEQ ID NO: 173297 - protein, 10 aa, Yellow fever virus
KMNISVVILL

SEQ ID NO: 173298 - protein, 10 aa, Yellow fever virus
MNISVVILLV

SEQ ID NO: 173299 - protein, 10 aa, Yellow fever virus
NISVVILLVS

SEQ ID NO: 173300 - protein, 10 aa, Yellow fever virus
ISVVILLVSG

SEQ ID NO: 173301 - protein, 10 aa, Yellow fever virus
SVVILLVSGW

SEQ ID NO: 173302 - protein, 10 aa, Yellow fever virus
VVILLVSGWN

SEQ ID NO: 173303 - protein, 10 aa, Yellow fever virus
VILLVSGWNS

SEQ ID NO: 173304 - protein, 10 aa, Yellow fever virus
MLLISGWNSI

SEQ ID NO: 173305 - protein, 10 aa, Yellow fever virus
ISGWNSITVM

SEQ ID NO: 173306 - protein, 10 aa, Yellow fever virus
ITVIPLLCGI

SEQ ID NO: 173307 - protein, 10 aa, Yellow fever virus
TVIPLLCGIG

SEQ ID NO: 173308 - protein, 10 aa, Yellow fever virus
VIPLLCGIGG

SEQ ID NO: 173309 - protein, 10 aa, Yellow fever virus
IPLLCGIGGA

SEQ ID NO: 173310 - protein, 10 aa, Yellow fever virus
PLLCGIGCAT

SEQ ID NO: 173311 - protein, 10 aa, Yellow fever virus
LLCGIGGAML

SEQ ID NO: 173312 - protein, 10 aa, Yellow fever virus
LCGIGCATLH

SEQ ID NO: 173313 - protein, 10 aa, Yellow fever virus
CGIGGAMLHW

SEQ ID NO: 173314 - protein, 10 aa, Yellow fever virus
GIGCAMLHWT

SEQ ID NO: 173315 - protein, 10 aa, Yellow fever virus
IGCAMLHWTL

SEQ ID NO: 173316 - protein, 10 aa, Yellow fever virus
GCAMLHWTLI

SEQ ID NO: 173317 - protein, 10 aa, Yellow fever virus
CATLHWSLIL

SEQ ID NO: 173318 - protein, 10 aa, Yellow fever virus
ATLHWSLILP

SEQ ID NO: 173319 - protein, 10 aa, Yellow fever virus
TLHWSLILPG

SEQ ID NO: 173320 - protein, 10 aa, Yellow fever virus
KAQQSKLPQR

SEQ ID NO: 173321 - protein, 10 aa, Yellow fever virus
AQQSKLPQRR

SEQ ID NO: 173322 - protein, 10 aa, Yellow fever virus
QQSKLPQRRV

SEQ ID NO: 173323 - protein, 10 aa, Yellow fever virus
QSKLPQRRVF

SEQ ID NO: 173324 - protein, 10 aa, Yellow fever virus
SKLPQRRVFH

SEQ ID NO: 173325 - protein, 10 aa, Yellow fever virus
KLPQRRVFHG

SEQ ID NO: 173326 - protein, 10 aa, Yellow fever virus
LPQRRVFHGV

SEQ ID NO: 173327 - protein, 10 aa, Yellow fever virus
PQRRVFHGVA

SEQ ID NO: 173328 - protein, 10 aa, Yellow fever virus
QRRVFHGVAE

SEQ ID NO: 173329 - protein, 10 aa, Yellow fever virus
RRVFHGVAEN

SEQ ID NO: 173330 - protein, 10 aa, Yellow fever virus
LYLLLALSLS

SEQ ID NO: 173331 - protein, 10 aa, Yellow fever virus
YLLLALSLSS

SEQ ID NO: 173332 - protein, 10 aa, Yellow fever virus
LLLALSLSSV

SEQ ID NO: 173333 - protein, 10 aa, Yellow fever virus
LLALSLSSVA

SEQ ID NO: 173334 - protein, 10 aa, Yellow fever virus
LALSLSSVAM

SEQ ID NO: 173335 - protein, 10 aa, Yellow fever virus
ALSLSSVAMC

SEQ ID NO: 173336 - protein, 10 aa, Yellow fever virus
LSLSSVAMCR

SEQ ID NO: 173337 - protein, 10 aa, Yellow fever virus
SLSSVAMCRT

SEQ ID NO: 173338 - protein, 10 aa, Yellow fever virus
LSSVAMCRTP

SEQ ID NO: 173339 - protein, 10 aa, Yellow fever virus
SSVAMCRTPF

SEQ ID NO: 173340 - protein, 10 aa, Yellow fever virus
FSLDEGIVLA

SEQ ID NO: 173341 - protein, 10 aa, Yellow fever virus
SLDEGIVLAS

SEQ ID NO: 173342 - protein, 10 aa, Yellow fever virus
LDEGIVLASA

SEQ ID NO: 173343 - protein, 10 aa, Yellow fever virus
DEGIVLASAA

SEQ ID NO: 173344 - protein, 10 aa, Yellow fever virus
EGIVLSSAAL

SEQ ID NO: 173345 - protein, 10 aa, Yellow fever virus
GIVLSSAALG

SEQ ID NO: 173346 - protein, 10 aa, Yellow fever virus
IVLSSAALGP

SEQ ID NO: 173347 - protein, 10 aa, Yellow fever virus
VLSSAALGPL

SEQ ID NO: 173348 - protein, 10 aa, Yellow fever virus
LSSAALGPLI

SEQ ID NO: 173349 - protein, 10 aa, Yellow fever virus
SSAALGPLIE

SEQ ID NO: 173350 - protein, 10 aa, Yellow fever virus
GNYYAFVGVA

SEQ ID NO: 173351 - protein, 10 aa, Yellow fever virus
NYYAFVGVAY

SEQ ID NO: 173352 - protein, 10 aa, Yellow fever virus
YYAFVGVAYN

SEQ ID NO: 173353 - protein, 10 aa, Yellow fever virus
GVAYNLWKMK

SEQ ID NO: 173354 - protein, 10 aa, Yellow fever virus
VAYNLWKMKT

SEQ ID NO: 173355 - protein, 10 aa, Yellow fever virus
AYNLWKMKTA

SEQ ID NO: 173356 - protein, 10 aa, Yellow fever virus
YNLWKMKTAR

SEQ ID NO: 173357 - protein, 10 aa, Yellow fever virus
NLWKMKTERR

SEQ ID NO: 173358 - protein, 10 aa, Yellow fever virus
LWKMKTARRG

SEQ ID NO: 173359 - protein, 10 aa, Yellow fever virus
RRGSASGKTL

SEQ ID NO: 173360 - protein, 10 aa, Yellow fever virus
RGSASGKTLG

SEQ ID NO: 173361 - protein, 10 aa, Yellow fever virus
GSASGKTLGE

SEQ ID NO: 173362 - protein, 10 aa, Yellow fever virus
SASGKTLGEV

SEQ ID NO: 173363 - protein, 10 aa, Yellow fever virus
KRELNLLDRQ

SEQ ID NO: 173364 - protein, 10 aa, Yellow fever virus
RELNLLDRQQ

SEQ ID NO: 173365 - protein, 10 aa, Yellow fever virus
ELNLLDRQQF

SEQ ID NO: 173366 - protein, 10 aa, Yellow fever virus
LNLLDRQQFE

SEQ ID NO: 173367 - protein, 10 aa, Yellow fever virus
NLLDKQQFEM

SEQ ID NO: 173368 - protein, 10 aa, Yellow fever virus
LLDKQQFEMY

SEQ ID NO: 173369 - protein, 10 aa, Yellow fever virus
LDRQQFELYK

SEQ ID NO: 173370 - protein, 10 aa, Yellow fever virus
DRQQFELYKR

SEQ ID NO: 173371 - protein, 10 aa, Yellow fever virus
RQQFELYKRT

SEQ ID NO: 173372 - protein, 10 aa, Yellow fever virus
QQFEMYKRTD

SEQ ID NO: 173373 - protein, 10 aa, Yellow fever virus
FEMYKRTDII

SEQ ID NO: 173374 - protein, 10 aa, Yellow fever virus
EMYKRTDIIE

SEQ ID NO: 173375 - protein, 10 aa, Yellow fever virus
MYKRTDIIEV

SEQ ID NO: 173376 - protein, 10 aa, Yellow fever virus
YKRTDIIEVD

SEQ ID NO: 173377 - protein, 10 aa, Yellow fever virus
KRTDIIEVDR

SEQ ID NO: 173378 - protein, 10 aa, Yellow fever virus
RTDIIEVDRD

SEQ ID NO: 173379 - protein, 10 aa, Yellow fever virus
TDIIEVDRDM

SEQ ID NO: 173380 - protein, 10 aa, Yellow fever virus
DIIEVDRDMA

SEQ ID NO: 173381 - protein, 10 aa, Yellow fever virus
IIEVDRDMAR

SEQ ID NO: 173382 - protein, 10 aa, Yellow fever virus
IEVDRDMARR

SEQ ID NO: 173383 - protein, 10 aa, Yellow fever virus
GYVKLEGRVM

SEQ ID NO: 173384 - protein, 10 aa, Yellow fever virus
YVKLEGRVMD

SEQ ID NO: 173385 - protein, 10 aa, Yellow fever virus
VKLEGRVMDL

SEQ ID NO: 173386 - protein, 10 aa, Yellow fever virus
KLEGRVMDLG

SEQ ID NO: 173387 - protein, 10 aa, Yellow fever virus
LEGRVMDLGC

SEQ ID NO: 173388 - protein, 10 aa, Yellow fever virus
EGRVMDLGCG

SEQ ID NO: 173389 - protein, 10 aa, Yellow fever virus
GRVMDLGCGR

SEQ ID NO: 173390 - protein, 10 aa, Yellow fever virus
RVMDLGCGRG

SEQ ID NO: 173391 - protein, 10 aa, Yellow fever virus
VMDLGCGRGG

SEQ ID NO: 173392 - protein, 10 aa, Yellow fever virus
MDLGCGRGGW

SEQ ID NO: 173393 - protein, 10 aa, Yellow fever virus
GVKGFTLGRE

SEQ ID NO: 173394 - protein, 10 aa, Yellow fever virus
VKGFTLGREG

SEQ ID NO: 173395 - protein, 10 aa, Yellow fever virus
KGFTLGREGH

SEQ ID NO: 173396 - protein, 10 aa, Yellow fever virus
GFTLGREGHE

SEQ ID NO: 173397 - protein, 10 aa, Yellow fever virus
FTLGREGHEK

SEQ ID NO: 173398 - protein, 10 aa, Yellow fever virus
NVRSLGWNII

SEQ ID NO: 173399 - protein, 10 aa, Yellow fever virus
VRSLGWNIIT

SEQ ID NO: 173400 - protein, 10 aa, Yellow fever virus
RSLGWNIITF

SEQ ID NO: 173401 - protein, 10 aa, Yellow fever virus
IITFKDKTDV

SEQ ID NO: 173402 - protein, 10 aa, Yellow fever virus
ITFKDKTDVH

SEQ ID NO: 173403 - protein, 10 aa, Yellow fever virus
TFKDKTDIHH

SEQ ID NO: 173404 - protein, 10 aa, Yellow fever virus
FKDKTDIHHL

SEQ ID NO: 173405 - protein, 10 aa, Yellow fever virus
KDKTDVHPLE

SEQ ID NO: 173406 - protein, 10 aa, Yellow fever virus
DKTDVHPLEP

SEQ ID NO: 173407 - protein, 10 aa, Yellow fever virus
LESVKCDTLL

SEQ ID NO: 173408 - protein, 10 aa, Yellow fever virus
ESVKCDTLLC

SEQ ID NO: 173409 - protein, 10 aa, Yellow fever virus
PMKCDTLLCD

SEQ ID NO: 173410 - protein, 10 aa, Yellow fever virus
MKCDTLLCDI

SEQ ID NO: 173411 - protein, 10 aa, Yellow fever virus
DIGESSSSSI

SEQ ID NO: 173412 - protein, 10 aa, Yellow fever virus
IGESSSSSIT

SEQ ID NO: 173413 - protein, 10 aa, Yellow fever virus
GESSPSSATE

SEQ ID NO: 173414 - protein, 10 aa, Yellow fever virus
ESSSSSITEG

SEQ ID NO: 173415 - protein, 10 aa, Yellow fever virus
SSSSSITEGE

SEQ ID NO: 173416 - protein, 10 aa, Yellow fever virus
SPSSATEGER

SEQ ID NO: 173417 - protein, 10 aa, Yellow fever virus
SSSITEGERT

SEQ ID NO: 173418 - protein, 10 aa, Yellow fever virus
SSVTEGERTL

SEQ ID NO: 173419 - protein, 10 aa, Yellow fever virus
SVTEGERTLR

SEQ ID NO: 173420 - protein, 10 aa, Yellow fever virus
VTEGERTLRV

SEQ ID NO: 173421 - protein, 10 aa, Yellow fever virus
TEGERTMRVL

SEQ ID NO: 173422 - protein, 10 aa, Yellow fever virus
EGERTLRVLE

SEQ ID NO: 173423 - protein, 10 aa, Yellow fever virus
GERTLRVLET

SEQ ID NO: 173424 - protein, 10 aa, Yellow fever virus
ERTLRVLETI

SEQ ID NO: 173425 - protein, 10 aa, Yellow fever virus
RTLRVLDTVE

SEQ ID NO: 173426 - protein, 10 aa, Yellow fever virus
TLRVLETIEK

SEQ ID NO: 173427 - protein, 10 aa, Yellow fever virus
LRVLDTVEKW

SEQ ID NO: 173428 - protein, 10 aa, Yellow fever virus
RVLETIEKWL

SEQ ID NO: 173429 - protein, 10 aa, Yellow fever virus
VLETVEKWLA

SEQ ID NO: 173430 - protein, 10 aa, Yellow fever virus
LETVEKWLAC

SEQ ID NO: 173431 - protein, 10 aa, Yellow fever virus
ETVEKWLACG

SEQ ID NO: 173432 - protein, 10 aa, Yellow fever virus
CVKVLAPYMR

SEQ ID NO: 173433 - protein, 10 aa, Yellow fever virus
IKVLAPYMPD

SEQ ID NO: 173434 - protein, 10 aa, Yellow fever virus
VLAPYMRDVL

SEQ ID NO: 173435 - protein, 10 aa, Yellow fever virus
LAPYMRDVLE

SEQ ID NO: 173436 - protein, 10 aa, Yellow fever virus
APYMRDVLEK

SEQ ID NO: 173437 - protein, 10 aa, Yellow fever virus
PYMRDVLEKL

SEQ ID NO: 173438 - protein, 10 aa, Yellow fever virus
YMRDVLEKLE

SEQ ID NO: 173439 - protein, 10 aa, Yellow fever virus
MRDVLEKLEL

SEQ ID NO: 173440 - protein, 10 aa, Yellow fever virus
RDVLEKLELL

SEQ ID NO: 173441 - protein, 10 aa, Yellow fever virus
GKVTLEPDVI

SEQ ID NO: 173442 - protein, 10 aa, Yellow fever virus
KVTLEPDVIL

SEQ ID NO: 173443 - protein, 10 aa, Yellow fever virus
VTLEADVTLP

SEQ ID NO: 173444 - protein, 10 aa, Yellow fever virus
TLEPDVILPI

SEQ ID NO: 173445 - protein, 10 aa, Yellow fever virus
LEPDVILPIG

SEQ ID NO: 173446 - protein, 10 aa, Yellow fever virus
EPDVILPIGT

SEQ ID NO: 173447 - protein, 10 aa, Yellow fever virus
PDVILPIGTR

SEQ ID NO: 173448 - protein, 10 aa, Yellow fever virus
VETDKGPLNR

SEQ ID NO: 173449 - protein, 10 aa, Yellow fever virus
EAIKERVERI

SEQ ID NO: 173450 - protein, 10 aa, Yellow fever virus
IKERVERIKS

SEQ ID NO: 173451 - protein, 10 aa, Yellow fever virus
KERVERIKSE

SEQ ID NO: 173452 - protein, 10 aa, Yellow fever virus
ERVERIKNEY

SEQ ID NO: 173453 - protein, 10 aa, Yellow fever virus
RVERIKNEYA

SEQ ID NO: 173454 - protein, 10 aa, Yellow fever virus
VERIKNEYAT

SEQ ID NO: 173455 - protein, 10 aa, Yellow fever virus
ERIKTEYAAT

SEQ ID NO: 173456 - protein, 10 aa, Yellow fever virus
RIKTEYAATW

SEQ ID NO: 173457 - protein, 10 aa, Yellow fever virus
IKTEYAATWF

SEQ ID NO: 173458 - protein, 10 aa, Yellow fever virus
KTEYAATWFY

SEQ ID NO: 173459 - protein, 10 aa, Yellow fever virus
TEYAATWFYD

SEQ ID NO: 173460 - protein, 10 aa, Yellow fever virus
EYAATWFHDN

SEQ ID NO: 173461 - protein, 10 aa, Yellow fever virus
YAATWFHDND

SEQ ID NO: 173462 - protein, 10 aa, Yellow fever virus
ATTWFYDNDN

SEQ ID NO: 173463 - protein, 10 aa, Yellow fever virus
ATWFHDNDNP

SEQ ID NO: 173464 - protein, 10 aa, Yellow fever virus
TWFHDNDNPY

SEQ ID NO: 173465 - protein, 10 aa, Yellow fever virus
ASMVNGVIKL

SEQ ID NO: 173466 - protein, 10 aa, Yellow fever virus
SMVNGVIKLL

SEQ ID NO: 173467 - protein, 10 aa, Yellow fever virus
MVNGVIKLLT

SEQ ID NO: 173468 - protein, 10 aa, Yellow fever virus
VNGVIKLLTY

SEQ ID NO: 173469 - protein, 10 aa, Yellow fever virus
NGVIKLLTYP

SEQ ID NO: 173470 - protein, 10 aa, Yellow fever virus
GVIKLLTYPW

SEQ ID NO: 173471 - protein, 10 aa, Yellow fever virus
VIKLLTYPWD

SEQ ID NO: 173472 - protein, 10 aa, Yellow fever virus
IKILTYPWDK

SEQ ID NO: 173473 - protein, 10 aa, Yellow fever virus
KILTYPWDKI

SEQ ID NO: 173474 - protein, 10 aa, Yellow fever virus
ILTYPWDKIE

SEQ ID NO: 173475 - protein, 10 aa, Yellow fever virus
LTYPWDKIEE

SEQ ID NO: 173476 - protein, 10 aa, Yellow fever virus
TYPWDKIEEV

SEQ ID NO: 173477 - protein, 10 aa, Yellow fever virus
YPWDKIEEVT

SEQ ID NO: 173478 - protein, 10 aa, Yellow fever virus
LFRHLAREKK

SEQ ID NO: 173479 - protein, 10 aa, Yellow fever virus
FRHLAREKKP

SEQ ID NO: 173480 - protein, 10 aa, Yellow fever virus
RHLSREKNPR

SEQ ID NO: 173481 - protein, 10 aa, Yellow fever virus
HLAREKKPRL

SEQ ID NO: 173482 - protein, 10 aa, Yellow fever virus
LSREKNPRLC

SEQ ID NO: 173483 - protein, 10 aa, Yellow fever virus
SREKNPRLCT

SEQ ID NO: 173484 - protein, 10 aa, Yellow fever virus
REKKPRLCTK

SEQ ID NO: 173485 - protein, 10 aa, Yellow fever virus
EKKPRLCTKE

SEQ ID NO: 173486 - protein, 10 aa, Yellow fever virus
KKPRLCTKEE

SEQ ID NO: 173487 - protein, 10 aa, Yellow fever virus
KPRLCTKEEF

SEQ ID NO: 173488 - protein, 10 aa, Yellow fever virus
VRSHAAIGAF

SEQ ID NO: 173489 - protein, 10 aa, Yellow fever virus
RSHAAIGAFL

SEQ ID NO: 173490 - protein, 10 aa, Yellow fever virus
SHAAIGAFLE

SEQ ID NO: 173491 - protein, 10 aa, Yellow fever virus
HAAIGAFLEE

SEQ ID NO: 173492 - protein, 10 aa, Yellow fever virus
AAIGAFLEEQ

SEQ ID NO: 173493 - protein, 10 aa, Yellow fever virus
AIGAYLEEQD

SEQ ID NO: 173494 - protein, 10 aa, Yellow fever virus
IGAYLEEQDQ

SEQ ID NO: 173495 - protein, 10 aa, Yellow fever virus
GAYLEEQDQW

SEQ ID NO: 173496 - protein, 10 aa, Yellow fever virus
AYLEEQDQWK

SEQ ID NO: 173497 - protein, 10 aa, Yellow fever virus
YLEEQDQWKT

SEQ ID NO: 173498 - protein, 10 aa, Yellow fever virus
FWELVDEERR

SEQ ID NO: 173499 - protein, 10 aa, Yellow fever virus
WELVDEERRL

SEQ ID NO: 173500 - protein, 10 aa, Yellow fever virus
ELVDEERRLH

SEQ ID NO: 173501 - protein, 10 aa, Yellow fever virus
LVDEERRLHQ

SEQ ID NO: 173502 - protein, 10 aa, Yellow fever virus
VDEERRLHQQ

SEQ ID NO: 173503 - protein, 10 aa, Yellow fever virus
DEERRLHQQG

SEQ ID NO: 173504 - protein, 10 aa, Yellow fever virus
EERRLHQQGR

SEQ ID NO: 173505 - protein, 10 aa, Yellow fever virus
RRLHQQGRCR

SEQ ID NO: 173506 - protein, 10 aa, Yellow fever virus
RLHQQGRCRT

SEQ ID NO: 173507 - protein, 10 aa, Yellow fever virus
YLGYVIRDLS

SEQ ID NO: 173508 - protein, 10 aa, Yellow fever virus
LGYVIRDLSA

SEQ ID NO: 173509 - protein, 10 aa, Yellow fever virus
GYVIRDLSAK

SEQ ID NO: 173510 - protein, 10 aa, Yellow fever virus
YVIRDLSAKE

SEQ ID NO: 173511 - protein, 10 aa, Yellow fever virus
VIRDLSAKEG

SEQ ID NO: 173512 - protein, 10 aa, Yellow fever virus
IRDLSAKEGG

SEQ ID NO: 173513 - protein, 10 aa, Yellow fever virus
RDLSAKEGGG

SEQ ID NO: 173514 - protein, 10 aa, Yellow fever virus
DLSAKEGGGF

SEQ ID NO: 173515 - protein, 10 aa, Yellow fever virus
LAAMDGGGLY

SEQ ID NO: 173516 - protein, 10 aa, Yellow fever virus
AAMDGGGLYA

SEQ ID NO: 173517 - protein, 10 aa, Yellow fever virus
AMDGGGLYAD

SEQ ID NO: 173518 - protein, 10 aa, Yellow fever virus
MDGGGLYADD

SEQ ID NO: 173519 - protein, 10 aa, Yellow fever virus
DGGGLYADDT

SEQ ID NO: 173520 - protein, 10 aa, Yellow fever virus
DEQEIMSYMS

SEQ ID NO: 173521 - protein, 10 aa, Yellow fever virus
EQEIMSYMSP

SEQ ID NO: 173522 - protein, 10 aa, Yellow fever virus
QEILNYMSSH

SEQ ID NO: 173523 - protein, 10 aa, Yellow fever virus
EIMSYMSPEQ

SEQ ID NO: 173524 - protein, 10 aa, Yellow fever virus
ILNYMSSHHK

SEQ ID NO: 173525 - protein, 10 aa, Yellow fever virus
MSYMSPEQRK

SEQ ID NO: 173526 - protein, 10 aa, Yellow fever virus
NYMSSHHKKL

SEQ ID NO: 173527 - protein, 10 aa, Yellow fever virus
YMSSHHKKLA

SEQ ID NO: 173528 - protein, 10 aa, Yellow fever virus
MSSHHKKLAQ

SEQ ID NO: 173529 - protein, 10 aa, Yellow fever virus
SPEQRKLAWA

SEQ ID NO: 173530 - protein, 10 aa, Yellow fever virus
PEQRKLAWAI

SEQ ID NO: 173531 - protein, 10 aa, Yellow fever virus
EQRKLAWAIM

SEQ ID NO: 173532 - protein, 10 aa, Yellow fever virus
QRKLAWAIME

SEQ ID NO: 173533 - protein, 10 aa, Yellow fever virus
RKLAWAIMEM

SEQ ID NO: 173534 - protein, 10 aa, Yellow fever virus
KLAWAIMEMT

SEQ ID NO: 173535 - protein, 10 aa, Yellow fever virus
LAWAIMEMTY

SEQ ID NO: 173536 - protein, 10 aa, Yellow fever virus
AWAIMEMTYK

SEQ ID NO: 173537 - protein, 10 aa, Yellow fever virus
WAIMEMTYKN

SEQ ID NO: 173538 - protein, 10 aa, Yellow fever virus
LRPTPGGKAY

SEQ ID NO: 173539 - protein, 10 aa, Yellow fever virus
RPTPGGKAYM

SEQ ID NO: 173540 - protein, 10 aa, Yellow fever virus
PTPGGKAYMD

SEQ ID NO: 173541 - protein, 10 aa, Yellow fever virus
TPGGKAYMDV

SEQ ID NO: 173542 - protein, 10 aa, Yellow fever virus
RMAEAENVIH

SEQ ID NO: 173543 - protein, 10 aa, Yellow fever virus
MAEAENVIHH

SEQ ID NO: 173544 - protein, 10 aa, Yellow fever virus
AEAEMVIHHH

SEQ ID NO: 173545 - protein, 10 aa, Yellow fever virus
EAENVIHHQH

SEQ ID NO: 173546 - protein, 10 aa, Yellow fever virus
AENVIHHQHV

SEQ ID NO: 173547 - protein, 10 aa, Yellow fever virus
EMVINHQHVQ

SEQ ID NO: 173548 - protein, 10 aa, Yellow fever virus
MVIHHHHVQD

SEQ ID NO: 173549 - protein, 10 aa, Yellow fever virus
VIHHHHVQDC

SEQ ID NO: 173550 - protein, 10 aa, Yellow fever virus
INHQHVQECG

SEQ ID NO: 173551 - protein, 10 aa, Yellow fever virus
NHQHVQECGE

SEQ ID NO: 173552 - protein, 10 aa, Yellow fever virus
HQHVNECDES

SEQ ID NO: 173553 - protein, 10 aa, Yellow fever virus
LARLEAWLTE

SEQ ID NO: 173554 - protein, 10 aa, Yellow fever virus
ARLEAWLTEH

SEQ ID NO: 173555 - protein, 10 aa, Yellow fever virus
RLETWLAENG

SEQ ID NO: 173556 - protein, 10 aa, Yellow fever virus
LEAWLIEHGC

SEQ ID NO: 173557 - protein, 10 aa, Yellow fever virus
DAWLAENGCD

SEQ ID NO: 173558 - protein, 10 aa, Yellow fever virus
AWLAENGCDR

SEQ ID NO: 173559 - protein, 10 aa, Yellow fever virus
WLAENGCDRL

SEQ ID NO: 173560 - protein, 10 aa, Yellow fever virus
RLRRMAVSGD

SEQ ID NO: 173561 - protein, 10 aa, Yellow fever virus
LARMAVSGDD

SEQ ID NO: 173562 - protein, 10 aa, Yellow fever virus
RRMAVSGDDC

SEQ ID NO: 173563 - protein, 10 aa, Yellow fever virus
AVNGDDCVVR

SEQ ID NO: 173564 - protein, 10 aa, Yellow fever virus
VNGDDCVVRP

SEQ ID NO: 173565 - protein, 10 aa, Yellow fever virus
SGDDCVVKPV

SEQ ID NO: 173566 - protein, 10 aa, Yellow fever virus
GDDCVVKPVD

SEQ ID NO: 173567 - protein, 10 aa, Yellow fever virus
DDCVVKPVDD

SEQ ID NO: 173568 - protein, 10 aa, Yellow fever virus
DCVVKPVDDR

SEQ ID NO: 173569 - protein, 10 aa, Yellow fever virus
CVVKPVDDRF

SEQ ID NO: 173570 - protein, 10 aa, Yellow fever virus
VVKPVDDRFG

SEQ ID NO: 173571 - protein, 10 aa, Yellow fever virus
VKPVDDRFGL

SEQ ID NO: 173572 - protein, 10 aa, Yellow fever virus
RPIDDRFGMA

SEQ ID NO: 173573 - protein, 10 aa, Yellow fever virus
PIDDRFGMAL

SEQ ID NO: 173574 - protein, 10 aa, Yellow fever virus
IDDRFGMALS

SEQ ID NO: 173575 - protein, 10 aa, Yellow fever virus
SEWQPSKEWT

SEQ ID NO: 173576 - protein, 10 aa, Yellow fever virus
EWQPSKEWTD

SEQ ID NO: 173577 - protein, 10 aa, Yellow fever virus
WQPSKEWTDW

SEQ ID NO: 173578 - protein, 10 aa, Yellow fever virus
QPSKEWTDWE

SEQ ID NO: 173579 - protein, 10 aa, Yellow fever virus
PSKGWTDWEN

SEQ ID NO: 173580 - protein, 10 aa, Yellow fever virus
SKGWTDWENV

SEQ ID NO: 173581 - protein, 10 aa, Yellow fever virus
KGWTDWENVP

SEQ ID NO: 173582 - protein, 10 aa, Yellow fever virus
GWTDWESVPF

SEQ ID NO: 173583 - protein, 10 aa, Yellow fever virus
WTDWESVPFC

SEQ ID NO: 173584 - protein, 10 aa, Yellow fever virus
TDWESVPFCS

SEQ ID NO: 173585 - protein, 10 aa, Yellow fever virus
WENVPFCSHR

SEQ ID NO: 173586 - protein, 10 aa, Yellow fever virus
ENVPFCSHRF

SEQ ID NO: 173587 - protein, 10 aa, Yellow fever virus
SVPFCSHHFH

SEQ ID NO: 173588 - protein, 10 aa, Yellow fever virus
FCSHHFHELH

SEQ ID NO: 173589 - protein, 10 aa, Yellow fever virus
CSHHFHELHL

SEQ ID NO: 173590 - protein, 10 aa, Yellow fever virus
SHHFHELHLK

SEQ ID NO: 173591 - protein, 10 aa, Yellow fever virus
HHFHELHLKD

SEQ ID NO: 173592 - protein, 10 aa, Yellow fever virus
HFHELHLKDG

SEQ ID NO: 173593 - protein, 10 aa, Yellow fever virus
FHELHLKDGR

SEQ ID NO: 173594 - protein, 10 aa, Yellow fever virus
HELHLKDGRR

SEQ ID NO: 173595 - protein, 10 aa, Yellow fever virus
ELHLKDGRRI

SEQ ID NO: 173596 - protein, 10 aa, Yellow fever virus
LVLKDGRKVV

SEQ ID NO: 173597 - protein, 10 aa, Yellow fever virus
VLKDGRKVVV

SEQ ID NO: 173598 - protein, 10 aa, Yellow fever virus
LKDGRKIVVP

SEQ ID NO: 173599 - protein, 10 aa, Yellow fever virus
KDGRKIVVPC

SEQ ID NO: 173600 - protein, 10 aa, Yellow fever virus
DGRKIVVPCR

SEQ ID NO: 173601 - protein, 10 aa, Yellow fever virus
GRKIVVPCRD

SEQ ID NO: 173602 - protein, 10 aa, Yellow fever virus
RKIVVPCRDQ

SEQ ID NO: 173603 - protein, 10 aa, Yellow fever virus
KIVVPCRDQD

SEQ ID NO: 173604 - protein, 10 aa, Yellow fever virus
IVVPCRDQDE

SEQ ID NO: 173605 - protein, 10 aa, Yellow fever virus
SFAVSSAVPM

SEQ ID NO: 173606 - protein, 10 aa, Yellow fever virus
FAVSSAVPMA

SEQ ID NO: 173607 - protein, 10 aa, Yellow fever virus
AVSSAVPMAW

SEQ ID NO: 173608 - protein, 10 aa, Yellow fever virus
VSSAVPMAWV

SEQ ID NO: 173609 - protein, 10 aa, Yellow fever virus
SSAVPMAWVP

SEQ ID NO: 173610 - protein, 10 aa, Yellow fever virus
SAVPMAWVPS

SEQ ID NO: 173611 - protein, 10 aa, Yellow fever virus
AVPMAWVPSG

SEQ ID NO: 173612 - protein, 10 aa, Yellow fever virus
VPMAWVPSGR

SEQ ID NO: 173613 - protein, 10 aa, Yellow fever virus
PMAWVPSGRT

SEQ ID NO: 173614 - protein, 10 aa, Yellow fever virus
MAWVPSGRTT

SEQ ID NO: 173615 - protein, 10 aa, Yellow fever virus
GRTTWSVHGR

SEQ ID NO: 173616 - protein, 10 aa, Yellow fever virus
RTTWSVHGRG

SEQ ID NO: 173617 - protein, 10 aa, Yellow fever virus
TTWSVHGRGE

SEQ ID NO: 173618 - protein, 10 aa, Yellow fever virus
TWSVHGRGEW

SEQ ID NO: 173619 - protein, 10 aa, Yellow fever virus
WSVHGRGEWM

SEQ ID NO: 173620 - protein, 10 aa, Yellow fever virus
SVHGRGEWMT

SEQ ID NO: 173621 - protein, 10 aa, Yellow fever virus
VHGRGEWMTT

SEQ ID NO: 173622 - protein, 10 aa, Yellow fever virus
HGKGEWMTTQ

SEQ ID NO: 173623 - protein, 10 aa, Yellow fever virus
GRGEWMTTED

SEQ ID NO: 173624 - protein, 10 aa, Yellow fever virus
KGEWMTTEDR

SEQ ID NO: 173625 - protein, 10 aa, Yellow fever virus
GEWMTTQDML

SEQ ID NO: 173626 - protein, 10 aa, Yellow fever virus
EWMTTEDMLD

SEQ ID NO: 173627 - protein, 10 aa, Yellow fever virus
WMTTEDMLGV

SEQ ID NO: 173628 - protein, 10 aa, Yellow fever virus
MTTEDMLDVW

SEQ ID NO: 173629 - protein, 10 aa, Yellow fever virus
TTEDMLDVWN

SEQ ID NO: 173630 - protein, 10 aa, Yellow fever virus
TEDMLGVWNR

SEQ ID NO: 173631 - protein, 10 aa, Yellow fever virus
EDMLGVWNRV

SEQ ID NO: 173632 - protein, 10 aa, Yellow fever virus
DMLGVWNRVW

SEQ ID NO: 173633 - protein, 10 aa, Yellow fever virus
MLGVWNRVWI

SEQ ID NO: 173634 - protein, 10 aa, Yellow fever virus
LGVWNRVWIT

SEQ ID NO: 173635 - protein, 10 aa, Yellow fever virus
GVWNRVWITN

SEQ ID NO: 173636 - protein, 10 aa, Yellow fever virus
VWVLNNPHMT

SEQ ID NO: 173637 - protein, 10 aa, Yellow fever virus
WVLNNPHMTD

SEQ ID NO: 173638 - protein, 10 aa, Yellow fever virus
VLNNPHMTDK

SEQ ID NO: 173639 - protein, 10 aa, Yellow fever virus
LNNPHMTDKT

SEQ ID NO: 173640 - protein, 10 aa, Yellow fever virus
NNPHMKDKTT

SEQ ID NO: 173641 - protein, 10 aa, Yellow fever virus
NPHMKDKTTV

SEQ ID NO: 173642 - protein, 10 aa, Yellow fever virus
PHMKDKTTVK

SEQ ID NO: 173643 - protein, 10 aa, Yellow fever virus
HMQDKTVVKE

SEQ ID NO: 173644 - protein, 10 aa, Yellow fever virus
MQDKTVVKEW

SEQ ID NO: 173645 - protein, 10 aa, Yellow fever virus
QDKTVVKEWR

SEQ ID NO: 173646 - protein, 10 aa, Yellow fever virus
DKTVVKEWRD

SEQ ID NO: 173647 - protein, 10 aa, Yellow fever virus
KTVVKEWRDV

SEQ ID NO: 173648 - protein, 10 aa, Yellow fever virus
TVVKEWRDVP

SEQ ID NO: 173649 - protein, 10 aa, Yellow fever virus
VVKEWRDVPY

SEQ ID NO: 173650 - protein, 10 aa, Yellow fever virus
IKEWRDVPYL

SEQ ID NO: 173651 - protein, 10 aa, Yellow fever virus
LVIHRIRNLI

SEQ ID NO: 173652 - protein, 10 aa, Yellow fever virus
VIHRIRNLIG

SEQ ID NO: 173653 - protein, 10 aa, Yellow fever virus
IHRIRNLIGQ

SEQ ID NO: 173654 - protein, 10 aa, Yellow fever virus
HRIRNLIGQE

SEQ ID NO: 173655 - protein, 10 aa, Yellow fever virus
RIRNLIGQEK

SEQ ID NO: 173656 - protein, 10 aa, Yellow fever virus
IRNLIGQEKY

SEQ ID NO: 173657 - protein, 10 aa, Yellow fever virus
RTLIGQEKFT

SEQ ID NO: 173658 - protein, 10 aa, Yellow fever virus
TLIGQEKFTD

SEQ ID NO: 173659 - protein, 10 aa, Yellow fever virus
LIGQEKFTDY

SEQ ID NO: 173660 - protein, 10 aa, Yellow fever virus
IGQEKFTDYL

SEQ ID NO: 173661 - protein, 10 aa, Yellow fever virus
ILTGKKITAQ

SEQ ID NO: 173662 - protein, 10 aa, Yellow fever virus
LTGKKITAQL

SEQ ID NO: 173663 - protein, 10 aa, Yellow fever virus
TGKKLTAHLK

SEQ ID NO: 173664 - protein, 10 aa, Yellow fever virus
GKKLTAHLKK

SEQ ID NO: 173665 - protein, 10 aa, Yellow fever virus
KKITAQLKRL

SEQ ID NO: 173666 - protein, 10 aa, Yellow fever virus
KLTAHLKKLW

SEQ ID NO: 173667 - protein, 10 aa, Yellow fever virus
ITAQLKRLWK

SEQ ID NO: 173668 - protein, 10 aa, Yellow fever virus
TAHLKKLWRM

SEQ ID NO: 173669 - protein, 10 aa, Yellow fever virus
AQLKRLWKML

SEQ ID NO: 173670 - protein, 10 aa, Yellow fever virus
QLKRLWKMLD

SEQ ID NO: 173671 - protein, 10 aa, Yellow fever virus
SSRKRRSSEM

SEQ ID NO: 173672 - protein, 10 aa, Yellow fever virus
SRKRRSSEMT

SEQ ID NO: 173673 - protein, 10 aa, Yellow fever virus
LFPLLLLGLL

SEQ ID NO: 173674 - protein, 10 aa, Yellow fever virus
VQLLILGMIL

SEQ ID NO: 173675 - protein, 10 aa, Yellow fever virus
QLLILGMILM

SEQ ID NO: 173676 - protein, 10 aa, Yellow fever virus
GGGVTLVRKN

SEQ ID NO: 173677 - protein, 10 aa, Yellow fever virus
SEDLGKTFSM

SEQ ID NO: 173678 - protein, 10 aa, Yellow fever virus
EDLGKTFSMG

SEQ ID NO: 173679 - protein, 10 aa, Yellow fever virus
DLGKTFSIGT

SEQ ID NO: 173680 - protein, 10 aa, Yellow fever virus
LGKTFSMGTG

SEQ ID NO: 173681 - protein, 10 aa, Yellow fever virus
GKTFSLGTGN

SEQ ID NO: 173682 - protein, 10 aa, Yellow fever virus
KTFSLGTGNC

SEQ ID NO: 173683 - protein, 10 aa, Yellow fever virus
TFSIGTGNCT

SEQ ID NO: 173684 - protein, 10 aa, Yellow fever virus
FSMGTGNCTT

SEQ ID NO: 173685 - protein, 10 aa, Yellow fever virus
SLGTGNCTTN

SEQ ID NO: 173686 - protein, 10 aa, Yellow fever virus
VGAGNCTTNI

SEQ ID NO: 173687 - protein, 10 aa, Yellow fever virus
AIAYLVGNNM

SEQ ID NO: 173688 - protein, 10 aa, Yellow fever virus
IAYLVGNNMT

SEQ ID NO: 173689 - protein, 10 aa, Yellow fever virus
AYLVGNNTTQ

SEQ ID NO: 173690 - protein, 10 aa, Yellow fever virus
YLVGNNMTQR

SEQ ID NO: 173691 - protein, 10 aa, Yellow fever virus
LVGNNKTQRV

SEQ ID NO: 173692 - protein, 10 aa, Yellow fever virus
VGNNMTQRVV

SEQ ID NO: 173693 - protein, 10 aa, Yellow fever virus
GNNKTQRVVI

SEQ ID NO: 173694 - protein, 10 aa, Yellow fever virus
NNKTQRVVIA

SEQ ID NO: 173695 - protein, 10 aa, Yellow fever virus
LETVAIDGPV

SEQ ID NO: 173696 - protein, 10 aa, Yellow fever virus
ETVAIDGPVE

SEQ ID NO: 173697 - protein, 10 aa, Yellow fever virus
TVAIDGPVEA

SEQ ID NO: 173698 - protein, 10 aa, Yellow fever virus
VAIDGPVEAR

SEQ ID NO: 173699 - protein, 10 aa, Yellow fever virus
AIDGPVEARK

SEQ ID NO: 173700 - protein, 10 aa, Yellow fever virus
IDGPVEARKV

SEQ ID NO: 173701 - protein, 10 aa, Yellow fever virus
DGPVEARKVC

SEQ ID NO: 173702 - protein, 10 aa, Yellow fever virus
GPVEARKVCY

SEQ ID NO: 173703 - protein, 10 aa, Yellow fever virus
PVEARKVCYN

SEQ ID NO: 173704 - protein, 10 aa, Yellow fever virus
VEARKVCYNA

SEQ ID NO: 173705 - protein, 10 aa, Yellow fever virus
HVGAKQENWK

SEQ ID NO: 173706 - protein, 10 aa, Yellow fever virus
VGAKQEDWKT

SEQ ID NO: 173707 - protein, 10 aa, Yellow fever virus
GAKQENWKTD

SEQ ID NO: 173708 - protein, 10 aa, Yellow fever virus
AKQENWKTDI

SEQ ID NO: 173709 - protein, 10 aa, Yellow fever virus
KQENWKTDIK

SEQ ID NO: 173710 - protein, 10 aa, Yellow fever virus
QENWKTDIKT

SEQ ID NO: 173711 - protein, 10 aa, Yellow fever virus
EDWKTDIKTL

SEQ ID NO: 173712 - protein, 10 aa, Yellow fever virus
DWKTDIKTLK

SEQ ID NO: 173713 - protein, 10 aa, Yellow fever virus
WKTDIKTLKF

SEQ ID NO: 173714 - protein, 10 aa, Yellow fever virus
KTDIKTLKFD

SEQ ID NO: 173715 - protein, 10 aa, Yellow fever virus
EAEFTGYGKV

SEQ ID NO: 173716 - protein, 10 aa, Yellow fever virus
VEFTGYGKAT

SEQ ID NO: 173717 - protein, 10 aa, Yellow fever virus
VERLAVMGDA

SEQ ID NO: 173718 - protein, 10 aa, Yellow fever virus
NWITKVIIGA

SEQ ID NO: 173719 - protein, 10 aa, Yellow fever virus
IGAVLIWVGI

SEQ ID NO: 173720 - protein, 10 aa, Yellow fever virus
GTWMVHTLET

SEQ ID NO: 173721 - protein, 10 aa, Yellow fever virus
TWMMHTLETL

SEQ ID NO: 173722 - protein, 10 aa, Yellow fever virus
WMVHTLETLD

SEQ ID NO: 173723 - protein, 10 aa, Yellow fever virus
MMHTLETLDY

SEQ ID NO: 173724 - protein, 10 aa, Yellow fever virus
VHTLETLDYK

SEQ ID NO: 173725 - protein, 10 aa, Yellow fever virus
QVPLEVKREV

SEQ ID NO: 173726 - protein, 10 aa, Yellow fever virus
VPLEVKREVC

SEQ ID NO: 173727 - protein, 10 aa, Yellow fever virus
PLEVKREVCP

SEQ ID NO: 173728 - protein, 10 aa, Yellow fever virus
LEVKREVCPG

SEQ ID NO: 173729 - protein, 10 aa, Yellow fever virus
EVKREVCPGT

SEQ ID NO: 173730 - protein, 10 aa, Yellow fever virus
VKREVCPGTS

SEQ ID NO: 173731 - protein, 10 aa, Yellow fever virus
KREVCPGTSV

SEQ ID NO: 173732 - protein, 10 aa, Yellow fever virus
EPCPGTSVVV

SEQ ID NO: 173733 - protein, 10 aa, Yellow fever virus
PCPGTSVVVD

SEQ ID NO: 173734 - protein, 10 aa, Yellow fever virus
CPGTSVVLDT

SEQ ID NO: 173735 - protein, 10 aa, Yellow fever virus
PGTSVVVDSN

SEQ ID NO: 173736 - protein, 10 aa, Yellow fever virus
GTSVVVDSNC

SEQ ID NO: 173737 - protein, 10 aa, Yellow fever virus
TSVVVDSNCD

SEQ ID NO: 173738 - protein, 10 aa, Yellow fever virus
SVVVDSNCDG

SEQ ID NO: 173739 - protein, 10 aa, Yellow fever virus
VVVDTSCDGR

SEQ ID NO: 173740 - protein, 10 aa, Yellow fever virus
VVDTSCDGRG

SEQ ID NO: 173741 - protein, 10 aa, Yellow fever virus
VDTSCDGRGK

SEQ ID NO: 173742 - protein, 10 aa, Yellow fever virus
DTGCDGRGKS

SEQ ID NO: 173743 - protein, 10 aa, Yellow fever virus
TSCDGRGKST

SEQ ID NO: 173744 - protein, 10 aa, Yellow fever virus
SCDGRGKSTR

SEQ ID NO: 173745 - protein, 10 aa, Yellow fever virus
PMEIRPMKTS

SEQ ID NO: 173746 - protein, 10 aa, Yellow fever virus
MEIRPMKTSD

SEQ ID NO: 173747 - protein, 10 aa, Yellow fever virus
EIRPRKAHES

SEQ ID NO: 173748 - protein, 10 aa, Yellow fever virus
IRPMKTSDSH

SEQ ID NO: 173749 - protein, 10 aa, Yellow fever virus
RPRKAHESHL

SEQ ID NO: 173750 - protein, 10 aa, Yellow fever virus
PRKAHESHLV

SEQ ID NO: 173751 - protein, 10 aa, Yellow fever virus
MKTSDSHLVR

SEQ ID NO: 173752 - protein, 10 aa, Yellow fever virus
GPKQVLVGGV

SEQ ID NO: 173753 - protein, 10 aa, Yellow fever virus
PKQVLVGGVV

SEQ ID NO: 173754 - protein, 10 aa, Yellow fever virus
KQMLVGGMVL

SEQ ID NO: 173755 - protein, 10 aa, Yellow fever virus
QVLVGGVVLL

SEQ ID NO: 173756 - protein, 10 aa, Yellow fever virus
MLVGGMVLLG

SEQ ID NO: 173757 - protein, 10 aa, Yellow fever virus
GQVTLLDLLE

SEQ ID NO: 173758 - protein, 10 aa, Yellow fever virus
LTMAVGLHFH

SEQ ID NO: 173759 - protein, 10 aa, Yellow fever virus
VVAVGLHFHE

SEQ ID NO: 173760 - protein, 10 aa, Yellow fever virus
SFSIRPGLLM

SEQ ID NO: 173761 - protein, 10 aa, Yellow fever virus
FSIRPGLLVG

SEQ ID NO: 173762 - protein, 10 aa, Yellow fever virus
SIRPGLLMGF

SEQ ID NO: 173763 - protein, 10 aa, Yellow fever virus
IRPGLLMGFG

SEQ ID NO: 173764 - protein, 10 aa, Yellow fever virus
MAFGAAMVEI

SEQ ID NO: 173765 - protein, 10 aa, Yellow fever virus
AFGAAMVEIA

SEQ ID NO: 173766 - protein, 10 aa, Yellow fever virus
AISSRKASNT

SEQ ID NO: 173767 - protein, 10 aa, Yellow fever virus
ISSRKASNMI

SEQ ID NO: 173768 - protein, 10 aa, Yellow fever virus
SSRKASNMIL

SEQ ID NO: 173769 - protein, 10 aa, Yellow fever virus
SRKASNAVLP

SEQ ID NO: 173770 - protein, 10 aa, Yellow fever virus
RKASNAVLPL

SEQ ID NO: 173771 - protein, 10 aa, Yellow fever virus
KASNAILPLM

SEQ ID NO: 173772 - protein, 10 aa, Yellow fever virus
ASNAVLPLMA

SEQ ID NO: 173773 - protein, 10 aa, Yellow fever virus
SNMILPLMAL

SEQ ID NO: 173774 - protein, 10 aa, Yellow fever virus
NAILPLMALL

SEQ ID NO: 173775 - protein, 10 aa, Yellow fever virus
MILPLMALMT

SEQ ID NO: 173776 - protein, 10 aa, Yellow fever virus
MALLTPVTMY

SEQ ID NO: 173777 - protein, 10 aa, Yellow fever virus
ALLTPVTMYE

SEQ ID NO: 173778 - protein, 10 aa, Yellow fever virus
LLTPVTMYEV

SEQ ID NO: 173779 - protein, 10 aa, Yellow fever virus
LTPVTMYEVR

SEQ ID NO: 173780 - protein, 10 aa, Yellow fever virus
TPMTMHEVRM

SEQ ID NO: 173781 - protein, 10 aa, Yellow fever virus
PVTMHEVRMA

SEQ ID NO: 173782 - protein, 10 aa, Yellow fever virus
VTMHEVRMAT

SEQ ID NO: 173783 - protein, 10 aa, Yellow fever virus
TMYEVRMATM

SEQ ID NO: 173784 - protein, 10 aa, Yellow fever virus
MHEVRMATML

SEQ ID NO: 173785 - protein, 10 aa, Yellow fever virus
EVRMATMLFC

SEQ ID NO: 173786 - protein, 10 aa, Yellow fever virus
ATMLLCAVVI

SEQ ID NO: 173787 - protein, 10 aa, Yellow fever virus
MLFCTVVIVG

SEQ ID NO: 173788 - protein, 10 aa, Yellow fever virus
LFCTVVIVGV

SEQ ID NO: 173789 - protein, 10 aa, Yellow fever virus
LCAVVIIGVL

SEQ ID NO: 173790 - protein, 10 aa, Yellow fever virus
CTVVIIGVLY

SEQ ID NO: 173791 - protein, 10 aa, Yellow fever virus
TVVIIGVLYQ

SEQ ID NO: 173792 - protein, 10 aa, Yellow fever virus
VIVGVLHQNA

SEQ ID NO: 173793 - protein, 10 aa, Yellow fever virus
IVGVLHQNSK

SEQ ID NO: 173794 - protein, 10 aa, Yellow fever virus
VGVLHQNAKD

SEQ ID NO: 173795 - protein, 10 aa, Yellow fever virus
GVLHQNAKDT

SEQ ID NO: 173796 - protein, 10 aa, Yellow fever virus
VLHQNAKDTS

SEQ ID NO: 173797 - protein, 10 aa, Yellow fever virus
LHQNAKDTSM

SEQ ID NO: 173798 - protein, 10 aa, Yellow fever virus
YQNSKDTSMQ

SEQ ID NO: 173799 - protein, 10 aa, Yellow fever virus
LELKKLGEIS

SEQ ID NO: 173800 - protein, 10 aa, Yellow fever virus
ELKKLGEVAW

SEQ ID NO: 173801 - protein, 10 aa, Yellow fever virus
LKKLGEVAWE

SEQ ID NO: 173802 - protein, 10 aa, Yellow fever virus
KKLGEISWEE

SEQ ID NO: 173803 - protein, 10 aa, Yellow fever virus
VLGGWILHIK

SEQ ID NO: 173804 - protein, 10 aa, Yellow fever virus
LGGWVLHIKG

SEQ ID NO: 173805 - protein, 10 aa, Yellow fever virus
GGWVLHIKGA

SEQ ID NO: 173806 - protein, 10 aa, Yellow fever virus
GWLFHVRRAR

SEQ ID NO: 173807 - protein, 10 aa, Yellow fever virus
WVLHIKGARR

SEQ ID NO: 173808 - protein, 10 aa, Yellow fever virus
LFHVRRARRS

SEQ ID NO: 173809 - protein, 10 aa, Yellow fever virus
FHVRRARRSG

SEQ ID NO: 173810 - protein, 10 aa, Yellow fever virus
HVRRARRSGD

SEQ ID NO: 173811 - protein, 10 aa, Yellow fever virus
VRRARRSGDV

SEQ ID NO: 173812 - protein, 10 aa, Yellow fever virus
QLIAAVPGKS

SEQ ID NO: 173813 - protein, 10 aa, Yellow fever virus
LIAAVPGKSV

SEQ ID NO: 173814 - protein, 10 aa, Yellow fever virus
IAAAPGKNVV

SEQ ID NO: 173815 - protein, 10 aa, Yellow fever virus
AAAPGKNVVN

SEQ ID NO: 173816 - protein, 10 aa, Yellow fever virus
AAPGKNVVNV

SEQ ID NO: 173817 - protein, 10 aa, Yellow fever virus
APGKNVVNVQ

SEQ ID NO: 173818 - protein, 10 aa, Yellow fever virus
LKEESKEELQ

SEQ ID NO: 173819 - protein, 10 aa, Yellow fever virus
EGKEELQEIS

SEQ ID NO: 173820 - protein, 10 aa, Yellow fever virus
GKEELQEIST

SEQ ID NO: 173821 - protein, 10 aa, Yellow fever virus
KKGMTTILDY

SEQ ID NO: 173822 - protein, 10 aa, Yellow fever virus
KGMTTILDYH

SEQ ID NO: 173823 - protein, 10 aa, Yellow fever virus
GMTTILDYHP

SEQ ID NO: 173824 - protein, 10 aa, Yellow fever virus
MTTILDYHPG

SEQ ID NO: 173825 - protein, 10 aa, Yellow fever virus
SRELVRNCDL

SEQ ID NO: 173826 - protein, 10 aa, Yellow fever virus
RGCDLPVWLA

SEQ ID NO: 173827 - protein, 10 aa, Yellow fever virus
GCDLPVWLAW

SEQ ID NO: 173828 - protein, 10 aa, Yellow fever virus
PDEHEILNDS

SEQ ID NO: 173829 - protein, 10 aa, Yellow fever virus
DEHEILNDSG

SEQ ID NO: 173830 - protein, 10 aa, Yellow fever virus
KCRAPGGAKR

SEQ ID NO: 173831 - protein, 10 aa, Yellow fever virus
CRAPGGAKRP

SEQ ID NO: 173832 - protein, 10 aa, Yellow fever virus
RSPGGAKRAL

SEQ ID NO: 173833 - protein, 10 aa, Yellow fever virus
TPGGAKKPLR

SEQ ID NO: 173834 - protein, 10 aa, Yellow fever virus
PGGAKRPLRP

SEQ ID NO: 173835 - protein, 10 aa, Yellow fever virus
GGAKRALRPR

SEQ ID NO: 173836 - protein, 10 aa, Yellow fever virus
GAKRALRPRW

SEQ ID NO: 173837 - protein, 10 aa, Yellow fever virus
AKRALRPRWC

SEQ ID NO: 173838 - protein, 10 aa, Yellow fever virus
KRALRPRWCD

SEQ ID NO: 173839 - protein, 10 aa, Yellow fever virus
RALRPRWCDE

SEQ ID NO: 173840 - protein, 10 aa, Yellow fever virus
AEGRRGAAEI

SEQ ID NO: 173841 - protein, 10 aa, Yellow fever virus
EGRRGAADVL

SEQ ID NO: 173842 - protein, 10 aa, Yellow fever virus
GRRGAAEILV

SEQ ID NO: 173843 - protein, 10 aa, Yellow fever virus
RRGAAEILVV

SEQ ID NO: 173844 - protein, 10 aa, Yellow fever virus
RGAAEMLVIL

SEQ ID NO: 173845 - protein, 10 aa, Yellow fever virus
GAAEMLVILT

SEQ ID NO: 173846 - protein, 10 aa, Yellow fever virus
AAEMLVILTE

SEQ ID NO: 173847 - protein, 10 aa, Yellow fever virus
AEMLVILTEL

SEQ ID NO: 173848 - protein, 10 aa, Yellow fever virus
EMLVILTELP

SEQ ID NO: 173849 - protein, 10 aa, Yellow fever virus
ILVVLSELPD

SEQ ID NO: 173850 - protein, 10 aa, Yellow fever virus
GVEPTHISYI

SEQ ID NO: 173851 - protein, 10 aa, Yellow fever virus
AKPTHISYIM

SEQ ID NO: 173852 - protein, 10 aa, Yellow fever virus
IIPEPGQQRS

SEQ ID NO: 173853 - protein, 10 aa, Yellow fever virus
IIGILTLLSI

SEQ ID NO: 173854 - protein, 10 aa, Yellow fever virus
IGILTLLSIV

SEQ ID NO: 173855 - protein, 10 aa, Yellow fever virus
GILTLLSIVA

SEQ ID NO: 173856 - protein, 10 aa, Yellow fever virus
ILTLLSIVAA

SEQ ID NO: 173857 - protein, 10 aa, Yellow fever virus
LTLLSIVAAN

SEQ ID NO: 173858 - protein, 10 aa, Yellow fever virus
TLLSIVAANE

SEQ ID NO: 173859 - protein, 10 aa, Yellow fever virus
LLSIVAANEL

SEQ ID NO: 173860 - protein, 10 aa, Yellow fever virus
LSIVAANELG

SEQ ID NO: 173861 - protein, 10 aa, Yellow fever virus
ERTKEDLFGK

SEQ ID NO: 173862 - protein, 10 aa, Yellow fever virus
KTKEDFFGRR

SEQ ID NO: 173863 - protein, 10 aa, Yellow fever virus
TKEDFFGRRN

SEQ ID NO: 173864 - protein, 10 aa, Yellow fever virus
ISSSASPWSW

SEQ ID NO: 173865 - protein, 10 aa, Yellow fever virus
PSGAIPWSWP

SEQ ID NO: 173866 - protein, 10 aa, Yellow fever virus
SGASPWSWPD

SEQ ID NO: 173867 - protein, 10 aa, Yellow fever virus
GASPWSWPDL

SEQ ID NO: 173868 - protein, 10 aa, Yellow fever virus
MNISVIMLLI

SEQ ID NO: 173869 - protein, 10 aa, Yellow fever virus
NISVIMLLIS

SEQ ID NO: 173870 - protein, 10 aa, Yellow fever virus
ISVIMLLISG

SEQ ID NO: 173871 - protein, 10 aa, Yellow fever virus
SVIMLLISGW

SEQ ID NO: 173872 - protein, 10 aa, Yellow fever virus
VIMLLISGWN

SEQ ID NO: 173873 - protein, 10 aa, Yellow fever virus
IMLLISGWNS

SEQ ID NO: 173874 - protein, 10 aa, Yellow fever virus
PLLCGIGGAM

SEQ ID NO: 173875 - protein, 10 aa, Yellow fever virus
LLCGIGCATL

SEQ ID NO: 173876 - protein, 10 aa, Yellow fever virus
LCGIGGAMLH

SEQ ID NO: 173877 - protein, 10 aa, Yellow fever virus
CGIGCATLHW

SEQ ID NO: 173878 - protein, 10 aa, Yellow fever virus
GIGCATLHWS

SEQ ID NO: 173879 - protein, 10 aa, Yellow fever virus
IGGAMLHWTL

SEQ ID NO: 173880 - protein, 10 aa, Yellow fever virus
GCATLHWSLI

SEQ ID NO: 173881 - protein, 10 aa, Yellow fever virus
CAMLHWTLIL

SEQ ID NO: 173882 - protein, 10 aa, Yellow fever virus
MYNLWKMKTE

SEQ ID NO: 173883 - protein, 10 aa, Yellow fever virus
YNLWKMKTER

SEQ ID NO: 173884 - protein, 10 aa, Yellow fever virus
NLWKMKTARR

SEQ ID NO: 173885 - protein, 10 aa, Yellow fever virus
LWKMKTERRG

SEQ ID NO: 173886 - protein, 10 aa, Yellow fever virus
RRGTANGKTL

SEQ ID NO: 173887 - protein, 10 aa, Yellow fever virus
RGTANGKTLG

SEQ ID NO: 173888 - protein, 10 aa, Yellow fever virus
GTANGKTLGE

SEQ ID NO: 173889 - protein, 10 aa, Yellow fever virus
TANGKTLGEV

SEQ ID NO: 173890 - protein, 10 aa, Yellow fever virus
NLLDRQQFEL

SEQ ID NO: 173891 - protein, 10 aa, Yellow fever virus
LLDRQQFELY

SEQ ID NO: 173892 - protein, 10 aa, Yellow fever virus
LDKQQFEMYK

SEQ ID NO: 173893 - protein, 10 aa, Yellow fever virus
DKQQFEMYKR

SEQ ID NO: 173894 - protein, 10 aa, Yellow fever virus
KQQFEMYKRT

SEQ ID NO: 173895 - protein, 10 aa, Yellow fever virus
IVTFKDKTDV

SEQ ID NO: 173896 - protein, 10 aa, Yellow fever virus
VTFKDKTDVH

SEQ ID NO: 173897 - protein, 10 aa, Yellow fever virus
TFKDKTDVHP

SEQ ID NO: 173898 - protein, 10 aa, Yellow fever virus
FKDKTDVHRL

SEQ ID NO: 173899 - protein, 10 aa, Yellow fever virus
KDKTDVHRLE

SEQ ID NO: 173900 - protein, 10 aa, Yellow fever virus
DKTDIHRLES

SEQ ID NO: 173901 - protein, 10 aa, Yellow fever virus
LEPMKCDTLL

SEQ ID NO: 173902 - protein, 10 aa, Yellow fever virus
EPLKCETLLC

SEQ ID NO: 173903 - protein, 10 aa, Yellow fever virus
PLKCETLLCD

SEQ ID NO: 173904 - protein, 10 aa, Yellow fever virus
LKCETLLCDI

SEQ ID NO: 173905 - protein, 10 aa, Yellow fever virus
DIGESSPSSA

SEQ ID NO: 173906 - protein, 10 aa, Yellow fever virus
IGESSPSSAT

SEQ ID NO: 173907 - protein, 10 aa, Yellow fever virus
GESSSSSITE

SEQ ID NO: 173908 - protein, 10 aa, Yellow fever virus
ESSPSSATEG

SEQ ID NO: 173909 - protein, 10 aa, Yellow fever virus
SSPSSATEGE

SEQ ID NO: 173910 - protein, 10 aa, Yellow fever virus
SSSSITEGER

SEQ ID NO: 173911 - protein, 10 aa, Yellow fever virus
PSSATEGERT

SEQ ID NO: 173912 - protein, 10 aa, Yellow fever virus
SSITEGERTV

SEQ ID NO: 173913 - protein, 10 aa, Yellow fever virus
SITEGERTVR

SEQ ID NO: 173914 - protein, 10 aa, Yellow fever virus
ITEGERTVRV

SEQ ID NO: 173915 - protein, 10 aa, Yellow fever virus
EGERTLRVLD

SEQ ID NO: 173916 - protein, 10 aa, Yellow fever virus
GERTLRVLDT

SEQ ID NO: 173917 - protein, 10 aa, Yellow fever virus
ERTLRVLDTV

SEQ ID NO: 173918 - protein, 10 aa, Yellow fever virus
RTLRVLETIE

SEQ ID NO: 173919 - protein, 10 aa, Yellow fever virus
TLRVLDTVEK

SEQ ID NO: 173920 - protein, 10 aa, Yellow fever virus
LRVLETIEKW

SEQ ID NO: 173921 - protein, 10 aa, Yellow fever virus
GAIEERVERI

SEQ ID NO: 173922 - protein, 10 aa, Yellow fever virus
IEERVERIKN

SEQ ID NO: 173923 - protein, 10 aa, Yellow fever virus
EERVERIKNE

SEQ ID NO: 173924 - protein, 10 aa, Yellow fever virus
ERIKNEYATT

SEQ ID NO: 173925 - protein, 10 aa, Yellow fever virus
RIKNEYATTW

SEQ ID NO: 173926 - protein, 10 aa, Yellow fever virus
IKNEYATTWF

SEQ ID NO: 173927 - protein, 10 aa, Yellow fever virus
KTEYAATWFH

SEQ ID NO: 173928 - protein, 10 aa, Yellow fever virus
NEYATTWFYD

SEQ ID NO: 173929 - protein, 10 aa, Yellow fever virus
EYATTWFYDN

SEQ ID NO: 173930 - protein, 10 aa, Yellow fever virus
YAATWFYDND

SEQ ID NO: 173931 - protein, 10 aa, Yellow fever virus
AATWFHDNDN

SEQ ID NO: 173932 - protein, 10 aa, Yellow fever virus
ATWFYDNDNP

SEQ ID NO: 173933 - protein, 10 aa, Yellow fever virus
IKLLTYPWDK

SEQ ID NO: 173934 - protein, 10 aa, Yellow fever virus
KLLTYPWDKI

SEQ ID NO: 173935 - protein, 10 aa, Yellow fever virus
LLTYPWDKIE

SEQ ID NO: 173936 - protein, 10 aa, Yellow fever virus
LFRHLSREKN

SEQ ID NO: 173937 - protein, 10 aa, Yellow fever virus
FRHLSREKNP

SEQ ID NO: 173938 - protein, 10 aa, Yellow fever virus
RHLAREKKPR

SEQ ID NO: 173939 - protein, 10 aa, Yellow fever virus
HLSREKNPRL

SEQ ID NO: 173940 - protein, 10 aa, Yellow fever virus
LAREKKPRLC

SEQ ID NO: 173941 - protein, 10 aa, Yellow fever virus
AREKKPRLCT

SEQ ID NO: 173942 - protein, 10 aa, Yellow fever virus
AIGAFLEEQE

SEQ ID NO: 173943 - protein, 10 aa, Yellow fever virus
IGAFLEEQEQ

SEQ ID NO: 173944 - protein, 10 aa, Yellow fever virus
DLAAMDGGGL

SEQ ID NO: 173945 - protein, 10 aa, Yellow fever virus
LSAKEGGGFY

SEQ ID NO: 173946 - protein, 10 aa, Yellow fever virus
SAKEGGGFYA

SEQ ID NO: 173947 - protein, 10 aa, Yellow fever virus
AKEGGGFYAD

SEQ ID NO: 173948 - protein, 10 aa, Yellow fever virus
EQEILNYMSS

SEQ ID NO: 173949 - protein, 10 aa, Yellow fever virus
QEIMSYMSPE

SEQ ID NO: 173950 - protein, 10 aa, Yellow fever virus
EILNYMSSHH

SEQ ID NO: 173951 - protein, 10 aa, Yellow fever virus
IMSYMSPEQR

SEQ ID NO: 173952 - protein, 10 aa, Yellow fever virus
LNYMSSHHKK

SEQ ID NO: 173953 - protein, 10 aa, Yellow fever virus
SYMSPEQRKL

SEQ ID NO: 173954 - protein, 10 aa, Yellow fever virus
YMSPEQRKLA

SEQ ID NO: 173955 - protein, 10 aa, Yellow fever virus
MSPEQRKLAW

SEQ ID NO: 173956 - protein, 10 aa, Yellow fever virus
SSHHKKLAQA

SEQ ID NO: 173957 - protein, 10 aa, Yellow fever virus
SHHKKLAQAV

SEQ ID NO: 173958 - protein, 10 aa, Yellow fever virus
AEAENVIHHQ

SEQ ID NO: 173959 - protein, 10 aa, Yellow fever virus
EAEMVIHHHH

SEQ ID NO: 173960 - protein, 10 aa, Yellow fever virus
AEMVIHHHHV

SEQ ID NO: 173961 - protein, 10 aa, Yellow fever virus
ENVIHHQHVQ

SEQ ID NO: 173962 - protein, 10 aa, Yellow fever virus
NVIHHQHVQD

SEQ ID NO: 173963 - protein, 10 aa, Yellow fever virus
VINHQHVQEC

SEQ ID NO: 173964 - protein, 10 aa, Yellow fever virus
IHHHHVQDCD

SEQ ID NO: 173965 - protein, 10 aa, Yellow fever virus
HHHHVQDCDD

SEQ ID NO: 173966 - protein, 10 aa, Yellow fever virus
HQHVQECGEN

SEQ ID NO: 173967 - protein, 10 aa, Yellow fever virus
LERLETWLAE

SEQ ID NO: 173968 - protein, 10 aa, Yellow fever virus
VRLEAWLIEH

SEQ ID NO: 173969 - protein, 10 aa, Yellow fever virus
RLEAWLIEHG

SEQ ID NO: 173970 - protein, 10 aa, Yellow fever virus
LETWLAENGC

SEQ ID NO: 173971 - protein, 10 aa, Yellow fever virus
ETWLAENGCD

SEQ ID NO: 173972 - protein, 10 aa, Yellow fever virus
TWLAENGCDR

SEQ ID NO: 173973 - protein, 10 aa, Yellow fever virus
WLIEHGCDRL

SEQ ID NO: 173974 - protein, 10 aa, Yellow fever virus
RLSRMAVSGD

SEQ ID NO: 173975 - protein, 10 aa, Yellow fever virus
LSRMAVSGDD

SEQ ID NO: 173976 - protein, 10 aa, Yellow fever virus
SRMAVSGDDC

SEQ ID NO: 173977 - protein, 10 aa, Yellow fever virus
NGDDCVVRPI

SEQ ID NO: 173978 - protein, 10 aa, Yellow fever virus
VRPIDDRFGM

SEQ ID NO: 173979 - protein, 10 aa, Yellow fever virus
KPVDDRFGLA

SEQ ID NO: 173980 - protein, 10 aa, Yellow fever virus
PSKEWTDWEN

SEQ ID NO: 173981 - protein, 10 aa, Yellow fever virus
SKGWTDWESV

SEQ ID NO: 173982 - protein, 10 aa, Yellow fever virus
KEWTDWENVP

SEQ ID NO: 173983 - protein, 10 aa, Yellow fever virus
EWTDWENVPF

SEQ ID NO: 173984 - protein, 10 aa, Yellow fever virus
FCSHRFHELQ

SEQ ID NO: 173985 - protein, 10 aa, Yellow fever virus
CSHRFHELQL

SEQ ID NO: 173986 - protein, 10 aa, Yellow fever virus
SHRFHELQLK

SEQ ID NO: 173987 - protein, 10 aa, Yellow fever virus
HRFHELQLKD

SEQ ID NO: 173988 - protein, 10 aa, Yellow fever virus
RFHELQLKDG

SEQ ID NO: 173989 - protein, 10 aa, Yellow fever virus
ELVLKDGRKI

SEQ ID NO: 173990 - protein, 10 aa, Yellow fever virus
LVLKDGRKIV

SEQ ID NO: 173991 - protein, 10 aa, Yellow fever virus
VLKDGRKIVV

SEQ ID NO: 173992 - protein, 10 aa, Yellow fever virus
RGEWMTTEDM

SEQ ID NO: 173993 - protein, 10 aa, Yellow fever virus
EWMTTEDRLE

SEQ ID NO: 173994 - protein, 10 aa, Yellow fever virus
WMTTQDMLDV

SEQ ID NO: 173995 - protein, 10 aa, Yellow fever virus
MTTEDRLEVW

SEQ ID NO: 173996 - protein, 10 aa, Yellow fever virus
TTQDMLDVWN

SEQ ID NO: 173997 - protein, 10 aa, Yellow fever virus
TQDMLDVWNR

SEQ ID NO: 173998 - protein, 10 aa, Yellow fever virus
EDRLEVWNRV

SEQ ID NO: 173999 - protein, 10 aa, Yellow fever virus
DRLEVWNRVW

SEQ ID NO: 174000 - protein, 10 aa, Yellow fever virus
RLEVWNRVWI

SEQ ID NO: 174001 - protein, 10 aa, Yellow fever virus
NNPHMTDKTT

SEQ ID NO: 174002 - protein, 10 aa, Yellow fever virus
NPHMTDKTTI

SEQ ID NO: 174003 - protein, 10 aa, Yellow fever virus
PHMTDKTTIK

SEQ ID NO: 174004 - protein, 10 aa, Yellow fever virus
HMKDKTTVKE

SEQ ID NO: 174005 - protein, 10 aa, Yellow fever virus
MKDKTTVKEW

SEQ ID NO: 174006 - protein, 10 aa, Yellow fever virus
KDKTTVKEWR

SEQ ID NO: 174007 - protein, 10 aa, Yellow fever virus
DKTTVKEWRD

SEQ ID NO: 174008 - protein, 10 aa, Yellow fever virus
KTTVKEWRDV

SEQ ID NO: 174009 - protein, 10 aa, Yellow fever virus
TTVKEWRDVP

SEQ ID NO: 174010 - protein, 10 aa, Yellow fever virus
TVKEWRDVPY

SEQ ID NO: 174011 - protein, 10 aa, Yellow fever virus
IRTLIGQEKF

SEQ ID NO: 174012 - protein, 10 aa, Yellow fever virus
RNLIGQEKYT

SEQ ID NO: 174013 - protein, 10 aa, Yellow fever virus
NLIGQEKYTD

SEQ ID NO: 174014 - protein, 10 aa, Yellow fever virus
AVQFLILGML

SEQ ID NO: 174015 - protein, 10 aa, Yellow fever virus
TGGVTLMRKN

SEQ ID NO: 174016 - protein, 10 aa, Yellow fever virus
AEDLGKTFSL

SEQ ID NO: 174017 - protein, 10 aa, Yellow fever virus
DLGKTFSVGA

SEQ ID NO: 174018 - protein, 10 aa, Yellow fever virus
LGKTFSIGTG

SEQ ID NO: 174019 - protein, 10 aa, Yellow fever virus
GKTFSIGTGN

SEQ ID NO: 174020 - protein, 10 aa, Yellow fever virus
KTFSVGAGNC

SEQ ID NO: 174021 - protein, 10 aa, Yellow fever virus
TFSMGTGNCT

SEQ ID NO: 174022 - protein, 10 aa, Yellow fever virus
FSVGAGNCTT

SEQ ID NO: 174023 - protein, 10 aa, Yellow fever virus
SVGAGNCTTN

SEQ ID NO: 174024 - protein, 10 aa, Yellow fever virus
IGTGNCTTNI

SEQ ID NO: 174025 - protein, 10 aa, Yellow fever virus
AIAYLVGNNT

SEQ ID NO: 174026 - protein, 10 aa, Yellow fever virus
GAKQEDWKTD

SEQ ID NO: 174027 - protein, 10 aa, Yellow fever virus
AKQEDWKTDI

SEQ ID NO: 174028 - protein, 10 aa, Yellow fever virus
KQEDWKTDIK

SEQ ID NO: 174029 - protein, 10 aa, Yellow fever virus
QEDWKTDIKT

SEQ ID NO: 174030 - protein, 10 aa, Yellow fever virus
ENWKTDIKTL

SEQ ID NO: 174031 - protein, 10 aa, Yellow fever virus
NWKTDIKTLK

SEQ ID NO: 174032 - protein, 10 aa, Yellow fever virus
GNCDGRGKSA

SEQ ID NO: 174033 - protein, 10 aa, Yellow fever virus
FTVAVGLHFH

SEQ ID NO: 174034 - protein, 10 aa, Yellow fever virus
SFSIRPGLLI

SEQ ID NO: 174035 - protein, 10 aa, Yellow fever virus
AISSRKASNM

SEQ ID NO: 174036 - protein, 10 aa, Yellow fever virus
ISSRKASNAV

SEQ ID NO: 174037 - protein, 10 aa, Yellow fever virus
SSRKASNAVL

SEQ ID NO: 174038 - protein, 10 aa, Yellow fever virus
MTMHEVRMAT

SEQ ID NO: 174039 - protein, 10 aa, Yellow fever virus
MYEVRMATML

SEQ ID NO: 174040 - protein, 10 aa, Yellow fever virus
EVRLATMLLC

SEQ ID NO: 174041 - protein, 10 aa, Yellow fever virus
AAMLFCTVVI

SEQ ID NO: 174042 - protein, 10 aa, Yellow fever virus
MLLCAVVIIG

SEQ ID NO: 174043 - protein, 10 aa, Yellow fever virus
LLCAVVIIGV

SEQ ID NO: 174044 - protein, 10 aa, Yellow fever virus
VIVGVLHQNS

SEQ ID NO: 174045 - protein, 10 aa, Yellow fever virus
IIGVLYQNSK

SEQ ID NO: 174046 - protein, 10 aa, Yellow fever virus
IGVLYQNSKD

SEQ ID NO: 174047 - protein, 10 aa, Yellow fever virus
LGGWILHIKG

SEQ ID NO: 174048 - protein, 10 aa, Yellow fever virus
GGWILHIKGA

SEQ ID NO: 174049 - protein, 10 aa, Yellow fever virus
GWILHIKGAR

SEQ ID NO: 174050 - protein, 10 aa, Yellow fever virus
WILHIKGARR

SEQ ID NO: 174051 - protein, 10 aa, Yellow fever virus
ILHIKGARRS

SEQ ID NO: 174052 - protein, 10 aa, Yellow fever virus
KCRTPGGAKK

SEQ ID NO: 174053 - protein, 10 aa, Yellow fever virus
CRTPGGAKKP

SEQ ID NO: 174054 - protein, 10 aa, Yellow fever virus
RTPGGAKKPL

SEQ ID NO: 174055 - protein, 10 aa, Yellow fever virus
SPGGAKRALR

SEQ ID NO: 174056 - protein, 10 aa, Yellow fever virus
RRGAAEMLVI

SEQ ID NO: 174057 - protein, 10 aa, Yellow fever virus
RGAADVLVVL

SEQ ID NO: 174058 - protein, 10 aa, Yellow fever virus
GAADVLVVLS

SEQ ID NO: 174059 - protein, 10 aa, Yellow fever virus
AAEILVVLSE

SEQ ID NO: 174060 - protein, 10 aa, Yellow fever virus
AEILVVLSEL

SEQ ID NO: 174061 - protein, 10 aa, Yellow fever virus
DVLVVLSELP

SEQ ID NO: 174062 - protein, 10 aa, Yellow fever virus
TKEDFFGKRD

SEQ ID NO: 174063 - protein, 10 aa, Yellow fever virus
TPSGAIPWSW

SEQ ID NO: 174064 - protein, 10 aa, Yellow fever virus
SSSASPWSWP

SEQ ID NO: 174065 - protein, 10 aa, Yellow fever virus
GIGGAMLHWT

SEQ ID NO: 174066 - protein, 10 aa, Yellow fever virus
IGCATLHWSL

SEQ ID NO: 174067 - protein, 10 aa, Yellow fever virus
DKTDVHRLEP

SEQ ID NO: 174068 - protein, 10 aa, Yellow fever virus
LEPLKCETLL

SEQ ID NO: 174069 - protein, 10 aa, Yellow fever virus
EPMKCDTLLC

SEQ ID NO: 174070 - protein, 10 aa, Yellow fever virus
SVKCDTLLCD

SEQ ID NO: 174071 - protein, 10 aa, Yellow fever virus
SSATEGERTL

SEQ ID NO: 174072 - protein, 10 aa, Yellow fever virus
SATEGERTLR

SEQ ID NO: 174073 - protein, 10 aa, Yellow fever virus
ATEGERTLRV

SEQ ID NO: 174074 - protein, 10 aa, Yellow fever virus
ERTLRVLETV

SEQ ID NO: 174075 - protein, 10 aa, Yellow fever virus
RTLRVLETVE

SEQ ID NO: 174076 - protein, 10 aa, Yellow fever virus
TLRVLETVEK

SEQ ID NO: 174077 - protein, 10 aa, Yellow fever virus
LRVLETVEKW

SEQ ID NO: 174078 - protein, 10 aa, Yellow fever virus
KNEYATTWFY

SEQ ID NO: 174079 - protein, 10 aa, Yellow fever virus
TEYAATWFHD

SEQ ID NO: 174080 - protein, 10 aa, Yellow fever virus
EYAATWFYDN

SEQ ID NO: 174081 - protein, 10 aa, Yellow fever virus
YATTWFYDND

SEQ ID NO: 174082 - protein, 10 aa, Yellow fever virus
AATWFYDNDN

SEQ ID NO: 174083 - protein, 10 aa, Yellow fever virus
EMVIHHHHVQ

SEQ ID NO: 174084 - protein, 10 aa, Yellow fever virus
MVINHQHVQE

SEQ ID NO: 174085 - protein, 10 aa, Yellow fever virus
HHHVQDCDDS

SEQ ID NO: 174086 - protein, 10 aa, Yellow fever virus
LVRLEAWLIE

SEQ ID NO: 174087 - protein, 10 aa, Yellow fever virus
ERLETWLAEN

SEQ ID NO: 174088 - protein, 10 aa, Yellow fever virus
EAWLIEHGCD

SEQ ID NO: 174089 - protein, 10 aa, Yellow fever virus
AWLIEHGCDR

SEQ ID NO: 174090 - protein, 10 aa, Yellow fever virus
RLNRMAVNGD

SEQ ID NO: 174091 - protein, 10 aa, Yellow fever virus
LNRMAVNGDD

SEQ ID NO: 174092 - protein, 10 aa, Yellow fever virus
NRMAVNGDDC

SEQ ID NO: 174093 - protein, 10 aa, Yellow fever virus
EWMTTQDMLD

SEQ ID NO: 174094 - protein, 10 aa, Yellow fever virus
WMTTEDRLEV

SEQ ID NO: 174095 - protein, 10 aa, Yellow fever virus
MTTQDMLDVW

SEQ ID NO: 174096 - protein, 10 aa, Yellow fever virus
TTEDRLEVWN

SEQ ID NO: 174097 - protein, 10 aa, Yellow fever virus
TEDRLEVWNR

SEQ ID NO: 174098 - protein, 10 aa, Yellow fever virus
QDMLDVWNRV

SEQ ID NO: 174099 - protein, 10 aa, Yellow fever virus
HMTDKTTIKE

SEQ ID NO: 174100 - protein, 10 aa, Yellow fever virus
MTDKTTIKEW

SEQ ID NO: 174101 - protein, 10 aa, Yellow fever virus
TDKTTIKEWR

SEQ ID NO: 174102 - protein, 10 aa, Yellow fever virus
DKTTIKEWRD

SEQ ID NO: 174103 - protein, 10 aa, Yellow fever virus
KTTIKEWRDV

SEQ ID NO: 174104 - protein, 10 aa, Yellow fever virus
TTIKEWRDVP

SEQ ID NO: 174105 - protein, 10 aa, Yellow fever virus
TIKEWRDVPY

SEQ ID NO: 174106 - protein, 11 aa, Yellow fever virus
MSGRKAQGKTL

SEQ ID NO: 174107 - protein, 11 aa, Yellow fever virus
SGRKAQGKTLG

SEQ ID NO: 174108 - protein, 11 aa, Yellow fever virus
GRKAQGKTLGV

SEQ ID NO: 174109 - protein, 11 aa, Yellow fever virus
RKAQGKTLGVN

SEQ ID NO: 174110 - protein, 11 aa, Yellow fever virus
KAQGKTLGVNM

SEQ ID NO: 174111 - protein, 11 aa, Yellow fever virus
AQGKTLGVNMV

SEQ ID NO: 174112 - protein, 11 aa, Yellow fever virus
QGKTLGVNMVR

SEQ ID NO: 174113 - protein, 11 aa, Yellow fever virus
GKTLGVNMVRR

SEQ ID NO: 174114 - protein, 11 aa, Yellow fever virus
KTLGVNMVRRG

SEQ ID NO: 174115 - protein, 11 aa, Yellow fever virus
TLGVNMVRRGV

SEQ ID NO: 174116 - protein, 11 aa, Yellow fever virus
LGVNMVRRGVR

SEQ ID NO: 174117 - protein, 11 aa, Yellow fever virus
GVNMVRRGVRS

SEQ ID NO: 174118 - protein, 11 aa, Yellow fever virus
VNMVRRGVRSL

SEQ ID NO: 174119 - protein, 11 aa, Yellow fever virus
NMVRRGVRSLS

SEQ ID NO: 174120 - protein, 11 aa, Yellow fever virus
MVRRGVRSLSN

SEQ ID NO: 174121 - protein, 11 aa, Yellow fever virus
VRRGVRSLSNK

SEQ ID NO: 174122 - protein, 11 aa, Yellow fever virus
RRGVRSLSNKI

SEQ ID NO: 174123 - protein, 11 aa, Yellow fever virus
RGVRSLSNKIK

SEQ ID NO: 174124 - protein, 11 aa, Yellow fever virus
GVRSLSNKIKQ

SEQ ID NO: 174125 - protein, 11 aa, Yellow fever virus
VRSLSNKIKQK

SEQ ID NO: 174126 - protein, 11 aa, Yellow fever virus
RSLSNKIKQKT

SEQ ID NO: 174127 - protein, 11 aa, Yellow fever virus
SLSNKIKQKTK

SEQ ID NO: 174128 - protein, 11 aa, Yellow fever virus
LSNKIKQKTKQ

SEQ ID NO: 174129 - protein, 11 aa, Yellow fever virus
SNKIKQKTKQI

SEQ ID NO: 174130 - protein, 11 aa, Yellow fever virus
NKIKQKTKQIG

SEQ ID NO: 174131 - protein, 11 aa, Yellow fever virus
KIKQKTKQIGN

SEQ ID NO: 174132 - protein, 11 aa, Yellow fever virus
IKQKTKQIGNR

SEQ ID NO: 174133 - protein, 11 aa, Yellow fever virus
KQKTKQIGNRP

SEQ ID NO: 174134 - protein, 11 aa, Yellow fever virus
QKTKQIGNRPG

SEQ ID NO: 174135 - protein, 11 aa, Yellow fever virus
KTKQIGNRPGP

SEQ ID NO: 174136 - protein, 11 aa, Yellow fever virus
TKQIGNRPGPS

SEQ ID NO: 174137 - protein, 11 aa, Yellow fever virus
KQIGNRPGPSR

SEQ ID NO: 174138 - protein, 11 aa, Yellow fever virus
QIGNRPGPSRG

SEQ ID NO: 174139 - protein, 11 aa, Yellow fever virus
IGNRPGPSRGV

SEQ ID NO: 174140 - protein, 11 aa, Yellow fever virus
GNRPGPSRGVQ

SEQ ID NO: 174141 - protein, 11 aa, Yellow fever virus
NRPGPSRGVQG

SEQ ID NO: 174142 - protein, 11 aa, Yellow fever virus
RPGPSRGVQGF

SEQ ID NO: 174143 - protein, 11 aa, Yellow fever virus
PGPSRGVQGFI

SEQ ID NO: 174144 - protein, 11 aa, Yellow fever virus
GPSRGVQGFIF

SEQ ID NO: 174145 - protein, 11 aa, Yellow fever virus
PSRGVQGFIFF

SEQ ID NO: 174146 - protein, 11 aa, Yellow fever virus
SRGVQGFIFFF

SEQ ID NO: 174147 - protein, 11 aa, Yellow fever virus
RGVQGFIFFFL

SEQ ID NO: 174148 - protein, 11 aa, Yellow fever virus
GVQGFIFFFLF

SEQ ID NO: 174149 - protein, 11 aa, Yellow fever virus
VQGFIFFFLFN

SEQ ID NO: 174150 - protein, 11 aa, Yellow fever virus
QGFIFFFLFNI

SEQ ID NO: 174151 - protein, 11 aa, Yellow fever virus
GFIFFFLFNIL

SEQ ID NO: 174152 - protein, 11 aa, Yellow fever virus
FIFFFLFNILT

SEQ ID NO: 174153 - protein, 11 aa, Yellow fever virus
IFFFLFNILTG

SEQ ID NO: 174154 - protein, 11 aa, Yellow fever virus
FFFLFNILTGK

SEQ ID NO: 174155 - protein, 11 aa, Yellow fever virus
FFLFNILTGKK

SEQ ID NO: 174156 - protein, 11 aa, Yellow fever virus
FLFNILTGKKI

SEQ ID NO: 174157 - protein, 11 aa, Yellow fever virus
LFNILTGKKIT

SEQ ID NO: 174158 - protein, 11 aa, Yellow fever virus
FNILTGKKITA

SEQ ID NO: 174159 - protein, 11 aa, Yellow fever virus
NILTGKKITAH

SEQ ID NO: 174160 - protein, 11 aa, Yellow fever virus
ILTGKKITAHL

SEQ ID NO: 174161 - protein, 11 aa, Yellow fever virus
LTGKKITAHLK

SEQ ID NO: 174162 - protein, 11 aa, Yellow fever virus
TGKKITAHLKR

SEQ ID NO: 174163 - protein, 11 aa, Yellow fever virus
GKKITAHLKRL

SEQ ID NO: 174164 - protein, 11 aa, Yellow fever virus
KKITAHLKRLW

SEQ ID NO: 174165 - protein, 11 aa, Yellow fever virus
KITAHLKRLWK

SEQ ID NO: 174166 - protein, 11 aa, Yellow fever virus
ITAHLKRLWKM

SEQ ID NO: 174167 - protein, 11 aa, Yellow fever virus
TAHLKRLWKML

SEQ ID NO: 174168 - protein, 11 aa, Yellow fever virus
AHLKRLWKMLD

SEQ ID NO: 174169 - protein, 11 aa, Yellow fever virus
HLKRLWKMLDP

SEQ ID NO: 174170 - protein, 11 aa, Yellow fever virus
LKRLWKMLDPR

SEQ ID NO: 174171 - protein, 11 aa, Yellow fever virus
KRLWKMLDPRQ

SEQ ID NO: 174172 - protein, 11 aa, Yellow fever virus
RLWKMLDPRQG

SEQ ID NO: 174173 - protein, 11 aa, Yellow fever virus
LWKMLDPRQGL

SEQ ID NO: 174174 - protein, 11 aa, Yellow fever virus
WKMLDPRQGLA

SEQ ID NO: 174175 - protein, 11 aa, Yellow fever virus
KMLDPRQGLAV

SEQ ID NO: 174176 - protein, 11 aa, Yellow fever virus
MLDPRQGLAVL

SEQ ID NO: 174177 - protein, 11 aa, Yellow fever virus
LDPRQGLAVLR

SEQ ID NO: 174178 - protein, 11 aa, Yellow fever virus
DPRQGLAVLRK

SEQ ID NO: 174179 - protein, 11 aa, Yellow fever virus
PRQGLAVLRKV

SEQ ID NO: 174180 - protein, 11 aa, Yellow fever virus
RQGLAVLRKVK

SEQ ID NO: 174181 - protein, 11 aa, Yellow fever virus
QGLAVLRKVKR

SEQ ID NO: 174182 - protein, 11 aa, Yellow fever virus
GLAVLRKVKRV

SEQ ID NO: 174183 - protein, 11 aa, Yellow fever virus
LAVLRKVKRVV

SEQ ID NO: 174184 - protein, 11 aa, Yellow fever virus
AVLRKVKRVVA

SEQ ID NO: 174185 - protein, 11 aa, Yellow fever virus
VLRKVKRVVAS

SEQ ID NO: 174186 - protein, 11 aa, Yellow fever virus
LRKVKRVVASL

SEQ ID NO: 174187 - protein, 11 aa, Yellow fever virus
RKVKRVVASLM

SEQ ID NO: 174188 - protein, 11 aa, Yellow fever virus
KVKRVVASLMR

SEQ ID NO: 174189 - protein, 11 aa, Yellow fever virus
VKRVVASLMRG

SEQ ID NO: 174190 - protein, 11 aa, Yellow fever virus
KRVVASLMRGL

SEQ ID NO: 174191 - protein, 11 aa, Yellow fever virus
RVVASLMRGLS

SEQ ID NO: 174192 - protein, 11 aa, Yellow fever virus
VVASLMRGLSS

SEQ ID NO: 174193 - protein, 11 aa, Yellow fever virus
VASLMRGLSSR

SEQ ID NO: 174194 - protein, 11 aa, Yellow fever virus
ASLMRGLSSRK

SEQ ID NO: 174195 - protein, 11 aa, Yellow fever virus
SLMRGLSSRKR

SEQ ID NO: 174196 - protein, 11 aa, Yellow fever virus
LMRGLSSRKRR

SEQ ID NO: 174197 - protein, 11 aa, Yellow fever virus
MRGLSSRKRRS

SEQ ID NO: 174198 - protein, 11 aa, Yellow fever virus
RGLSSRKRRSH

SEQ ID NO: 174199 - protein, 11 aa, Yellow fever virus
GLSSRKRRSHD

SEQ ID NO: 174200 - protein, 11 aa, Yellow fever virus
LSSRKRRSHDV

SEQ ID NO: 174201 - protein, 11 aa, Yellow fever virus
SSRKRRSHDVL

SEQ ID NO: 174202 - protein, 11 aa, Yellow fever virus
TVQFLILGMLL

SEQ ID NO: 174203 - protein, 11 aa, Yellow fever virus
VQFLILGMLLM

SEQ ID NO: 174204 - protein, 11 aa, Yellow fever virus
TGGVTLVRKNR

SEQ ID NO: 174205 - protein, 11 aa, Yellow fever virus
GGVTLVRKNRW

SEQ ID NO: 174206 - protein, 11 aa, Yellow fever virus
GVTLVRKNRWL

SEQ ID NO: 174207 - protein, 11 aa, Yellow fever virus
VTLVRKNRWLL

SEQ ID NO: 174208 - protein, 11 aa, Yellow fever virus
TLVRKNRWLLL

SEQ ID NO: 174209 - protein, 11 aa, Yellow fever virus
LVRKNRWLLLN

SEQ ID NO: 174210 - protein, 11 aa, Yellow fever virus
VRKNRWLLLNV

SEQ ID NO: 174211 - protein, 11 aa, Yellow fever virus
RKNRWLLLNVT

SEQ ID NO: 174212 - protein, 11 aa, Yellow fever virus
KNRWLLLNVTS

SEQ ID NO: 174213 - protein, 11 aa, Yellow fever virus
NRWLLLNVTSE

SEQ ID NO: 174214 - protein, 11 aa, Yellow fever virus
RWLLLNVTSED

SEQ ID NO: 174215 - protein, 11 aa, Yellow fever virus
WLLLNVTSEDL

SEQ ID NO: 174216 - protein, 11 aa, Yellow fever virus
LLLNVTSEDLG

SEQ ID NO: 174217 - protein, 11 aa, Yellow fever virus
LLNVTSEDLGK

SEQ ID NO: 174218 - protein, 11 aa, Yellow fever virus
LNVTSEDLGKT

SEQ ID NO: 174219 - protein, 11 aa, Yellow fever virus
NVTSEDLGKTF

SEQ ID NO: 174220 - protein, 11 aa, Yellow fever virus
VTSEDLGKTFS

SEQ ID NO: 174221 - protein, 11 aa, Yellow fever virus
TSEDLGKTFSV

SEQ ID NO: 174222 - protein, 11 aa, Yellow fever virus
SEDLGKTFSVG

SEQ ID NO: 174223 - protein, 11 aa, Yellow fever virus
EDLGKTFSVGT

SEQ ID NO: 174224 - protein, 11 aa, Yellow fever virus
DLGKTFSVGTG

SEQ ID NO: 174225 - protein, 11 aa, Yellow fever virus
LGKTFSVGTGN

SEQ ID NO: 174226 - protein, 11 aa, Yellow fever virus
GKTFSVGTGNC

SEQ ID NO: 174227 - protein, 11 aa, Yellow fever virus
KTFSVGTGNCT

SEQ ID NO: 174228 - protein, 11 aa, Yellow fever virus
TFSVGTGNCTT

SEQ ID NO: 174229 - protein, 11 aa, Yellow fever virus
FSVGTGNCTTN

SEQ ID NO: 174230 - protein, 11 aa, Yellow fever virus
SVGTGNCTTNI

SEQ ID NO: 174231 - protein, 11 aa, Yellow fever virus
VGTGNCTTNIL

SEQ ID NO: 174232 - protein, 11 aa, Yellow fever virus
GTGNCTTNILE

SEQ ID NO: 174233 - protein, 11 aa, Yellow fever virus
TGNCTTNILEA

SEQ ID NO: 174234 - protein, 11 aa, Yellow fever virus
GNCTTNILEAK

SEQ ID NO: 174235 - protein, 11 aa, Yellow fever virus
NCTTNILEAKY

SEQ ID NO: 174236 - protein, 11 aa, Yellow fever virus
CTTNILEAKYW

SEQ ID NO: 174237 - protein, 11 aa, Yellow fever virus
TTNILEAKYWC

SEQ ID NO: 174238 - protein, 11 aa, Yellow fever virus
TNILEAKYWCP

SEQ ID NO: 174239 - protein, 11 aa, Yellow fever virus
NILEAKYWCPD

SEQ ID NO: 174240 - protein, 11 aa, Yellow fever virus
ILEAKYWCPDS

SEQ ID NO: 174241 - protein, 11 aa, Yellow fever virus
LEAKYWCPDSM

SEQ ID NO: 174242 - protein, 11 aa, Yellow fever virus
EAKYWCPDSME

SEQ ID NO: 174243 - protein, 11 aa, Yellow fever virus
AKYWCPDSMEY

SEQ ID NO: 174244 - protein, 11 aa, Yellow fever virus
KYWCPDSMEYN

SEQ ID NO: 174245 - protein, 11 aa, Yellow fever virus
YWCPDSMEYNC

SEQ ID NO: 174246 - protein, 11 aa, Yellow fever virus
WCPDSMEYNCP

SEQ ID NO: 174247 - protein, 11 aa, Yellow fever virus
CPDSMEYNCPN

SEQ ID NO: 174248 - protein, 11 aa, Yellow fever virus
PDSMEYNCPNL

SEQ ID NO: 174249 - protein, 11 aa, Yellow fever virus
DSMEYNCPNLS

SEQ ID NO: 174250 - protein, 11 aa, Yellow fever virus
SMEYNCPNLSP

SEQ ID NO: 174251 - protein, 11 aa, Yellow fever virus
MEYNCPNLSPR

SEQ ID NO: 174252 - protein, 11 aa, Yellow fever virus
EYNCPNLSPRE

SEQ ID NO: 174253 - protein, 11 aa, Yellow fever virus
YNCPNLSPREE

SEQ ID NO: 174254 - protein, 11 aa, Yellow fever virus
NCPNLSPREEP

SEQ ID NO: 174255 - protein, 11 aa, Yellow fever virus
CPNLSPREEPD

SEQ ID NO: 174256 - protein, 11 aa, Yellow fever virus
PNLSPREEPDD

SEQ ID NO: 174257 - protein, 11 aa, Yellow fever virus
NLSPREEPDDI

SEQ ID NO: 174258 - protein, 11 aa, Yellow fever virus
LSPREEPDDID

SEQ ID NO: 174259 - protein, 11 aa, Yellow fever virus
SPREEPDDIDC

SEQ ID NO: 174260 - protein, 11 aa, Yellow fever virus
PREEPDDIDCW

SEQ ID NO: 174261 - protein, 11 aa, Yellow fever virus
REEPDDIDCWC

SEQ ID NO: 174262 - protein, 11 aa, Yellow fever virus
EEPDDIDCWCY

SEQ ID NO: 174263 - protein, 11 aa, Yellow fever virus
EPDDIDCWCYG

SEQ ID NO: 174264 - protein, 11 aa, Yellow fever virus
PDDIDCWCYGV

SEQ ID NO: 174265 - protein, 11 aa, Yellow fever virus
DDIDCWCYGVE

SEQ ID NO: 174266 - protein, 11 aa, Yellow fever virus
DIDCWCYGVEN

SEQ ID NO: 174267 - protein, 11 aa, Yellow fever virus
IDCWCYGVENV

SEQ ID NO: 174268 - protein, 11 aa, Yellow fever virus
DCWCYGVENVR

SEQ ID NO: 174269 - protein, 11 aa, Yellow fever virus
CWCYGVENVRV

SEQ ID NO: 174270 - protein, 11 aa, Yellow fever virus
WCYGVENVRVA

SEQ ID NO: 174271 - protein, 11 aa, Yellow fever virus
CYGVENVRVAY

SEQ ID NO: 174272 - protein, 11 aa, Yellow fever virus
YGVENVRVAYG

SEQ ID NO: 174273 - protein, 11 aa, Yellow fever virus
GVENVRVAYGK

SEQ ID NO: 174274 - protein, 11 aa, Yellow fever virus
VENVRVAYGKC

SEQ ID NO: 174275 - protein, 11 aa, Yellow fever virus
ENVRVAYGKCD

SEQ ID NO: 174276 - protein, 11 aa, Yellow fever virus
NVRVAYGKCDS

SEQ ID NO: 174277 - protein, 11 aa, Yellow fever virus
VRVAYGKCDSA

SEQ ID NO: 174278 - protein, 11 aa, Yellow fever virus
RVAYGKCDSAG

SEQ ID NO: 174279 - protein, 11 aa, Yellow fever virus
VAYGKCDSAGR

SEQ ID NO: 174280 - protein, 11 aa, Yellow fever virus
AYGKCDSAGRS

SEQ ID NO: 174281 - protein, 11 aa, Yellow fever virus
YGKCDSAGRSR

SEQ ID NO: 174282 - protein, 11 aa, Yellow fever virus
GKCDSAGRSRR

SEQ ID NO: 174283 - protein, 11 aa, Yellow fever virus
KCDSAGRSRRS

SEQ ID NO: 174284 - protein, 11 aa, Yellow fever virus
CDSAGRSRRSR

SEQ ID NO: 174285 - protein, 11 aa, Yellow fever virus
DSAGRSRRSRR

SEQ ID NO: 174286 - protein, 11 aa, Yellow fever virus
SAGRSRRSRRA

SEQ ID NO: 174287 - protein, 11 aa, Yellow fever virus
AGRSRRSRRAI

SEQ ID NO: 174288 - protein, 11 aa, Yellow fever virus
GRSRRSRRAID

SEQ ID NO: 174289 - protein, 11 aa, Yellow fever virus
RSRRSRRAIDL

SEQ ID NO: 174290 - protein, 11 aa, Yellow fever virus
SRRSRRAIDLP

SEQ ID NO: 174291 - protein, 11 aa, Yellow fever virus
RRSRRAIDLPT

SEQ ID NO: 174292 - protein, 11 aa, Yellow fever virus
RSRRAIDLPTH

SEQ ID NO: 174293 - protein, 11 aa, Yellow fever virus
SRRAIDLPTHE

SEQ ID NO: 174294 - protein, 11 aa, Yellow fever virus
RRAIDLPTHEN

SEQ ID NO: 174295 - protein, 11 aa, Yellow fever virus
RAIDLPTHENH

SEQ ID NO: 174296 - protein, 11 aa, Yellow fever virus
AIDLPTHENHG

SEQ ID NO: 174297 - protein, 11 aa, Yellow fever virus
IDLPTHENHGL

SEQ ID NO: 174298 - protein, 11 aa, Yellow fever virus
DLPTHENHGLK

SEQ ID NO: 174299 - protein, 11 aa, Yellow fever virus
LPTHENHGLKT

SEQ ID NO: 174300 - protein, 11 aa, Yellow fever virus
PTHENHGLKTR

SEQ ID NO: 174301 - protein, 11 aa, Yellow fever virus
THENHGLKTRQ

SEQ ID NO: 174302 - protein, 11 aa, Yellow fever virus
HENHGLKTRQE

SEQ ID NO: 174303 - protein, 11 aa, Yellow fever virus
ENHGLKTRQEK

SEQ ID NO: 174304 - protein, 11 aa, Yellow fever virus
NHGLKTRQEKW

SEQ ID NO: 174305 - protein, 11 aa, Yellow fever virus
HGLKTRQEKWM

SEQ ID NO: 174306 - protein, 11 aa, Yellow fever virus
GLKTRQEKWMT

SEQ ID NO: 174307 - protein, 11 aa, Yellow fever virus
LKTRQEKWMTG

SEQ ID NO: 174308 - protein, 11 aa, Yellow fever virus
KTRQEKWMTGR

SEQ ID NO: 174309 - protein, 11 aa, Yellow fever virus
TRQEKWMTGRM

SEQ ID NO: 174310 - protein, 11 aa, Yellow fever virus
RQEKWMTGRMG

SEQ ID NO: 174311 - protein, 11 aa, Yellow fever virus
QEKWMTGRMGE

SEQ ID NO: 174312 - protein, 11 aa, Yellow fever virus
EKWMTGRMGER

SEQ ID NO: 174313 - protein, 11 aa, Yellow fever virus
KWMTGRMGERQ

SEQ ID NO: 174314 - protein, 11 aa, Yellow fever virus
WMTGRMGERQL

SEQ ID NO: 174315 - protein, 11 aa, Yellow fever virus
MTGRMGERQLQ

SEQ ID NO: 174316 - protein, 11 aa, Yellow fever virus
TGRMGERQLQK

SEQ ID NO: 174317 - protein, 11 aa, Yellow fever virus
GRMGERQLQKI

SEQ ID NO: 174318 - protein, 11 aa, Yellow fever virus
RMGERQLQKIE

SEQ ID NO: 174319 - protein, 11 aa, Yellow fever virus
MGERQLQKIER

SEQ ID NO: 174320 - protein, 11 aa, Yellow fever virus
GERQLQKIERW

SEQ ID NO: 174321 - protein, 11 aa, Yellow fever virus
ERQLQKIERWF

SEQ ID NO: 174322 - protein, 11 aa, Yellow fever virus
RQLQKIERWFV

SEQ ID NO: 174323 - protein, 11 aa, Yellow fever virus
QLQKIERWFVR

SEQ ID NO: 174324 - protein, 11 aa, Yellow fever virus
LQKIERWFVRN

SEQ ID NO: 174325 - protein, 11 aa, Yellow fever virus
QKIERWFVRNP

SEQ ID NO: 174326 - protein, 11 aa, Yellow fever virus
KIERWFVRNPF

SEQ ID NO: 174327 - protein, 11 aa, Yellow fever virus
IERWFVRNPFF

SEQ ID NO: 174328 - protein, 11 aa, Yellow fever virus
ERWFVRNPFFA

SEQ ID NO: 174329 - protein, 11 aa, Yellow fever virus
RWFVRNPFFAV

SEQ ID NO: 174330 - protein, 11 aa, Yellow fever virus
WFVRNPFFAVT

SEQ ID NO: 174331 - protein, 11 aa, Yellow fever virus
FVRNPFFAVTA

SEQ ID NO: 174332 - protein, 11 aa, Yellow fever virus
VRNPFFAVTAL

SEQ ID NO: 174333 - protein, 11 aa, Yellow fever virus
RNPFFAVTALT

SEQ ID NO: 174334 - protein, 11 aa, Yellow fever virus
NPFFAVTALTI

SEQ ID NO: 174335 - protein, 11 aa, Yellow fever virus
PFFAVTALTIA

SEQ ID NO: 174336 - protein, 11 aa, Yellow fever virus
FFAVTALTIAY

SEQ ID NO: 174337 - protein, 11 aa, Yellow fever virus
FAVTALTIAYL

SEQ ID NO: 174338 - protein, 11 aa, Yellow fever virus
AVTALTIAYLV

SEQ ID NO: 174339 - protein, 11 aa, Yellow fever virus
VTALTIAYLVG

SEQ ID NO: 174340 - protein, 11 aa, Yellow fever virus
TALTIAYLVGS

SEQ ID NO: 174341 - protein, 11 aa, Yellow fever virus
ALTIAYLVGSN

SEQ ID NO: 174342 - protein, 11 aa, Yellow fever virus
LTIAYLVGSNM

SEQ ID NO: 174343 - protein, 11 aa, Yellow fever virus
TIAYLVGSNMT

SEQ ID NO: 174344 - protein, 11 aa, Yellow fever virus
IAYLVGSNMTQ

SEQ ID NO: 174345 - protein, 11 aa, Yellow fever virus
AYLVGSNMTQR

SEQ ID NO: 174346 - protein, 11 aa, Yellow fever virus
YLVGSNMTQRV

SEQ ID NO: 174347 - protein, 11 aa, Yellow fever virus
LVGSNMTQRVV

SEQ ID NO: 174348 - protein, 11 aa, Yellow fever virus
VGSNMTQRVVI

SEQ ID NO: 174349 - protein, 11 aa, Yellow fever virus
GSNMTQRVVIA

SEQ ID NO: 174350 - protein, 11 aa, Yellow fever virus
SNMTQRVVIAL

SEQ ID NO: 174351 - protein, 11 aa, Yellow fever virus
NMTQRVVIALL

SEQ ID NO: 174352 - protein, 11 aa, Yellow fever virus
MTQRVVIALLV

SEQ ID NO: 174353 - protein, 11 aa, Yellow fever virus
TQRVVIALLVL

SEQ ID NO: 174354 - protein, 11 aa, Yellow fever virus
QRVVIALLVLA

SEQ ID NO: 174355 - protein, 11 aa, Yellow fever virus
RVVIALLVLAV

SEQ ID NO: 174356 - protein, 11 aa, Yellow fever virus
VVIALLVLAVG

SEQ ID NO: 174357 - protein, 11 aa, Yellow fever virus
VIALLVLAVGP

SEQ ID NO: 174358 - protein, 11 aa, Yellow fever virus
IALLVLAVGPA

SEQ ID NO: 174359 - protein, 11 aa, Yellow fever virus
ALLVLAVGPAY

SEQ ID NO: 174360 - protein, 11 aa, Yellow fever virus
LLVLAVGPAYS

SEQ ID NO: 174361 - protein, 11 aa, Yellow fever virus
LVLAVGPAYSA

SEQ ID NO: 174362 - protein, 11 aa, Yellow fever virus
VLAVGPAYSAH

SEQ ID NO: 174363 - protein, 11 aa, Yellow fever virus
LAVGPAYSAHC

SEQ ID NO: 174364 - protein, 11 aa, Yellow fever virus
AVGPAYSAHCI

SEQ ID NO: 174365 - protein, 11 aa, Yellow fever virus
VGPAYSAHCIG

SEQ ID NO: 174366 - protein, 11 aa, Yellow fever virus
GPAYSAHCIGI

SEQ ID NO: 174367 - protein, 11 aa, Yellow fever virus
PAYSAHCIGIT

SEQ ID NO: 174368 - protein, 11 aa, Yellow fever virus
AYSAHCIGITD

SEQ ID NO: 174369 - protein, 11 aa, Yellow fever virus
YSAHCIGITDR

SEQ ID NO: 174370 - protein, 11 aa, Yellow fever virus
SAHCIGITDRD

SEQ ID NO: 174371 - protein, 11 aa, Yellow fever virus
AHCIGITDRDF

SEQ ID NO: 174372 - protein, 11 aa, Yellow fever virus
HCIGITDRDFI

SEQ ID NO: 174373 - protein, 11 aa, Yellow fever virus
CIGITDRDFIE

SEQ ID NO: 174374 - protein, 11 aa, Yellow fever virus
IGITDRDFIEG

SEQ ID NO: 174375 - protein, 11 aa, Yellow fever virus
GITDRDFIEGV

SEQ ID NO: 174376 - protein, 11 aa, Yellow fever virus
ITDRDFIEGVH

SEQ ID NO: 174377 - protein, 11 aa, Yellow fever virus
TDRDFIEGVHG

SEQ ID NO: 174378 - protein, 11 aa, Yellow fever virus
DRDFIEGVHGG

SEQ ID NO: 174379 - protein, 11 aa, Yellow fever virus
RDFIEGVHGGT

SEQ ID NO: 174380 - protein, 11 aa, Yellow fever virus
DFIEGVHGGTW

SEQ ID NO: 174381 - protein, 11 aa, Yellow fever virus
FIEGVHGGTWV

SEQ ID NO: 174382 - protein, 11 aa, Yellow fever virus
IEGVHGGTWVS

SEQ ID NO: 174383 - protein, 11 aa, Yellow fever virus
EGVHGGTWVSA

SEQ ID NO: 174384 - protein, 11 aa, Yellow fever virus
GVHGGTWVSAT

SEQ ID NO: 174385 - protein, 11 aa, Yellow fever virus
VHGGTWVSATL

SEQ ID NO: 174386 - protein, 11 aa, Yellow fever virus
HGGTWVSATLE

SEQ ID NO: 174387 - protein, 11 aa, Yellow fever virus
GGTWVSATLEQ

SEQ ID NO: 174388 - protein, 11 aa, Yellow fever virus
GTWVSATLEQD

SEQ ID NO: 174389 - protein, 11 aa, Yellow fever virus
TWVSATLEQDK

SEQ ID NO: 174390 - protein, 11 aa, Yellow fever virus
WVSATLEQDKC

SEQ ID NO: 174391 - protein, 11 aa, Yellow fever virus
VSATLEQDKCV

SEQ ID NO: 174392 - protein, 11 aa, Yellow fever virus
SATLEQDKCVT

SEQ ID NO: 174393 - protein, 11 aa, Yellow fever virus
ATLEQDKCVTV

SEQ ID NO: 174394 - protein, 11 aa, Yellow fever virus
TLEQDKCVTVM

SEQ ID NO: 174395 - protein, 11 aa, Yellow fever virus
LEQDKCVTVMA

SEQ ID NO: 174396 - protein, 11 aa, Yellow fever virus
EQDKCVTVMAP

SEQ ID NO: 174397 - protein, 11 aa, Yellow fever virus
QDKCVTVMAPD

SEQ ID NO: 174398 - protein, 11 aa, Yellow fever virus
DKCVTVMAPDK

SEQ ID NO: 174399 - protein, 11 aa, Yellow fever virus
KCVTVMAPDKP

SEQ ID NO: 174400 - protein, 11 aa, Yellow fever virus
CVTVMAPDKPS

SEQ ID NO: 174401 - protein, 11 aa, Yellow fever virus
VTVMAPDKPSL

SEQ ID NO: 174402 - protein, 11 aa, Yellow fever virus
TVMAPDKPSLD

SEQ ID NO: 174403 - protein, 11 aa, Yellow fever virus
VMAPDKPSLDI

SEQ ID NO: 174404 - protein, 11 aa, Yellow fever virus
MAPDKPSLDIS

SEQ ID NO: 174405 - protein, 11 aa, Yellow fever virus
APDKPSLDISL

SEQ ID NO: 174406 - protein, 11 aa, Yellow fever virus
PDKPSLDISLE

SEQ ID NO: 174407 - protein, 11 aa, Yellow fever virus
DKPSLDISLET

SEQ ID NO: 174408 - protein, 11 aa, Yellow fever virus
KPSLDISLETV

SEQ ID NO: 174409 - protein, 11 aa, Yellow fever virus
PSLDISLETVA

SEQ ID NO: 174410 - protein, 11 aa, Yellow fever virus
SLDISLETVAI

SEQ ID NO: 174411 - protein, 11 aa, Yellow fever virus
LDISLETVAID

SEQ ID NO: 174412 - protein, 11 aa, Yellow fever virus
DISLETVAIDR

SEQ ID NO: 174413 - protein, 11 aa, Yellow fever virus
ISLETVAIDRP

SEQ ID NO: 174414 - protein, 11 aa, Yellow fever virus
SLETVAIDRPA

SEQ ID NO: 174415 - protein, 11 aa, Yellow fever virus
LETVAIDRPAE

SEQ ID NO: 174416 - protein, 11 aa, Yellow fever virus
ETVAIDRPAEV

SEQ ID NO: 174417 - protein, 11 aa, Yellow fever virus
TVAIDRPAEVR

SEQ ID NO: 174418 - protein, 11 aa, Yellow fever virus
VAIDRPAEVRK

SEQ ID NO: 174419 - protein, 11 aa, Yellow fever virus
AIDRPAEVRKV

SEQ ID NO: 174420 - protein, 11 aa, Yellow fever virus
IDRPAEVRKVC

SEQ ID NO: 174421 - protein, 11 aa, Yellow fever virus
DRPAEVRKVCY

SEQ ID NO: 174422 - protein, 11 aa, Yellow fever virus
RPAEVRKVCYN

SEQ ID NO: 174423 - protein, 11 aa, Yellow fever virus
PAEVRKVCYNA

SEQ ID NO: 174424 - protein, 11 aa, Yellow fever virus
AEVRKVCYNAV

SEQ ID NO: 174425 - protein, 11 aa, Yellow fever virus
EVRKVCYNAVL

SEQ ID NO: 174426 - protein, 11 aa, Yellow fever virus
VRKVCYNAVLT

SEQ ID NO: 174427 - protein, 11 aa, Yellow fever virus
RKVCYNAVLTH

SEQ ID NO: 174428 - protein, 11 aa, Yellow fever virus
KVCYNAVLTHV

SEQ ID NO: 174429 - protein, 11 aa, Yellow fever virus
VCYNAVLTHVK

SEQ ID NO: 174430 - protein, 11 aa, Yellow fever virus
CYNAVLTHVKI

SEQ ID NO: 174431 - protein, 11 aa, Yellow fever virus
YNAVLTHVKIN

SEQ ID NO: 174432 - protein, 11 aa, Yellow fever virus
NAVLTHVKIND

SEQ ID NO: 174433 - protein, 11 aa, Yellow fever virus
AVLTHVKINDK

SEQ ID NO: 174434 - protein, 11 aa, Yellow fever virus
VLTHVKINDKC

SEQ ID NO: 174435 - protein, 11 aa, Yellow fever virus
LTHVKINDKCP

SEQ ID NO: 174436 - protein, 11 aa, Yellow fever virus
THVKINDKCPS

SEQ ID NO: 174437 - protein, 11 aa, Yellow fever virus
HVKINDKCPST

SEQ ID NO: 174438 - protein, 11 aa, Yellow fever virus
VKINDKCPSTG

SEQ ID NO: 174439 - protein, 11 aa, Yellow fever virus
KINDKCPSTGE

SEQ ID NO: 174440 - protein, 11 aa, Yellow fever virus
INDKCPSTGEA

SEQ ID NO: 174441 - protein, 11 aa, Yellow fever virus
NDKCPSTGEAH

SEQ ID NO: 174442 - protein, 11 aa, Yellow fever virus
DKCPSTGEAHL

SEQ ID NO: 174443 - protein, 11 aa, Yellow fever virus
KCPSTGEAHLA

SEQ ID NO: 174444 - protein, 11 aa, Yellow fever virus
CPSTGEAHLAE

SEQ ID NO: 174445 - protein, 11 aa, Yellow fever virus
PSTGEAHLAEE

SEQ ID NO: 174446 - protein, 11 aa, Yellow fever virus
STGEAHLAEEN

SEQ ID NO: 174447 - protein, 11 aa, Yellow fever virus
TGEAHLAEENE

SEQ ID NO: 174448 - protein, 11 aa, Yellow fever virus
GEAHLAEENEG

SEQ ID NO: 174449 - protein, 11 aa, Yellow fever virus
EAHLAEENEGD

SEQ ID NO: 174450 - protein, 11 aa, Yellow fever virus
AHLAEENEGDN

SEQ ID NO: 174451 - protein, 11 aa, Yellow fever virus
HLAEENEGDNA

SEQ ID NO: 174452 - protein, 11 aa, Yellow fever virus
LAEENEGDNAC

SEQ ID NO: 174453 - protein, 11 aa, Yellow fever virus
AEENEGDNACK

SEQ ID NO: 174454 - protein, 11 aa, Yellow fever virus
EENEGDNACKR

SEQ ID NO: 174455 - protein, 11 aa, Yellow fever virus
ENEGDNACKRT

SEQ ID NO: 174456 - protein, 11 aa, Yellow fever virus
NEGDNACKRTY

SEQ ID NO: 174457 - protein, 11 aa, Yellow fever virus
EGDNACKRTYS

SEQ ID NO: 174458 - protein, 11 aa, Yellow fever virus
GDNACKRTYSD

SEQ ID NO: 174459 - protein, 11 aa, Yellow fever virus
DNACKRTYSDR

SEQ ID NO: 174460 - protein, 11 aa, Yellow fever virus
NACKRTYSDRG

SEQ ID NO: 174461 - protein, 11 aa, Yellow fever virus
ACKRTYSDRGW

SEQ ID NO: 174462 - protein, 11 aa, Yellow fever virus
CKRTYSDRGWG

SEQ ID NO: 174463 - protein, 11 aa, Yellow fever virus
KRTYSDRGWGN

SEQ ID NO: 174464 - protein, 11 aa, Yellow fever virus
RTYSDRGWGNG

SEQ ID NO: 174465 - protein, 11 aa, Yellow fever virus
TYSDRGWGNGC

SEQ ID NO: 174466 - protein, 11 aa, Yellow fever virus
YSDRGWGNGCG

SEQ ID NO: 174467 - protein, 11 aa, Yellow fever virus
SDRGWGNGCGL

SEQ ID NO: 174468 - protein, 11 aa, Yellow fever virus
DRGWGNGCGLF

SEQ ID NO: 174469 - protein, 11 aa, Yellow fever virus
RGWGNGCGLFG

SEQ ID NO: 174470 - protein, 11 aa, Yellow fever virus
GWGNGCGLFGK

SEQ ID NO: 174471 - protein, 11 aa, Yellow fever virus
WGNGCGLFGKG

SEQ ID NO: 174472 - protein, 11 aa, Yellow fever virus
GNGCGLFGKGS

SEQ ID NO: 174473 - protein, 11 aa, Yellow fever virus
NGCGLFGKGSI

SEQ ID NO: 174474 - protein, 11 aa, Yellow fever virus
GCGLFGKGSIV

SEQ ID NO: 174475 - protein, 11 aa, Yellow fever virus
CGLFGKGSIVA

SEQ ID NO: 174476 - protein, 11 aa, Yellow fever virus
GLFGKGSIVAC

SEQ ID NO: 174477 - protein, 11 aa, Yellow fever virus
LFGKGSIVACA

SEQ ID NO: 174478 - protein, 11 aa, Yellow fever virus
FGKGSIVACAK

SEQ ID NO: 174479 - protein, 11 aa, Yellow fever virus
GKGSIVACAKF

SEQ ID NO: 174480 - protein, 11 aa, Yellow fever virus
KGSIVACAKFT

SEQ ID NO: 174481 - protein, 11 aa, Yellow fever virus
GSIVACAKFTC

SEQ ID NO: 174482 - protein, 11 aa, Yellow fever virus
SIVACAKFTCA

SEQ ID NO: 174483 - protein, 11 aa, Yellow fever virus
IVACAKFTCAK

SEQ ID NO: 174484 - protein, 11 aa, Yellow fever virus
VACAKFTCAKS

SEQ ID NO: 174485 - protein, 11 aa, Yellow fever virus
ACAKFTCAKSM

SEQ ID NO: 174486 - protein, 11 aa, Yellow fever virus
CAKFTCAKSMS

SEQ ID NO: 174487 - protein, 11 aa, Yellow fever virus
AKFTCAKSMSL

SEQ ID NO: 174488 - protein, 11 aa, Yellow fever virus
KFTCAKSMSLF

SEQ ID NO: 174489 - protein, 11 aa, Yellow fever virus
FTCAKSMSLFE

SEQ ID NO: 174490 - protein, 11 aa, Yellow fever virus
TCAKSMSLFEV

SEQ ID NO: 174491 - protein, 11 aa, Yellow fever virus
CAKSMSLFEVD

SEQ ID NO: 174492 - protein, 11 aa, Yellow fever virus
AKSMSLFEVDQ

SEQ ID NO: 174493 - protein, 11 aa, Yellow fever virus
KSMSLFEVDQT

SEQ ID NO: 174494 - protein, 11 aa, Yellow fever virus
SMSLFEVDQTK

SEQ ID NO: 174495 - protein, 11 aa, Yellow fever virus
MSLFEVDQTKI

SEQ ID NO: 174496 - protein, 11 aa, Yellow fever virus
SLFEVDQTKIQ

SEQ ID NO: 174497 - protein, 11 aa, Yellow fever virus
LFEVDQTKIQY

SEQ ID NO: 174498 - protein, 11 aa, Yellow fever virus
FEVDQTKIQYV

SEQ ID NO: 174499 - protein, 11 aa, Yellow fever virus
EVDQTKIQYVI

SEQ ID NO: 174500 - protein, 11 aa, Yellow fever virus
VDQTKIQYVIR

SEQ ID NO: 174501 - protein, 11 aa, Yellow fever virus
DQTKIQYVIRA

SEQ ID NO: 174502 - protein, 11 aa, Yellow fever virus
QTKIQYVIRAQ

SEQ ID NO: 174503 - protein, 11 aa, Yellow fever virus
TKIQYVIRAQL

SEQ ID NO: 174504 - protein, 11 aa, Yellow fever virus
KIQYVIRAQLH

SEQ ID NO: 174505 - protein, 11 aa, Yellow fever virus
IQYVIRAQLHV

SEQ ID NO: 174506 - protein, 11 aa, Yellow fever virus
QYVIRAQLHVG

SEQ ID NO: 174507 - protein, 11 aa, Yellow fever virus
YVIRAQLHVGA

SEQ ID NO: 174508 - protein, 11 aa, Yellow fever virus
VIRAQLHVGAK

SEQ ID NO: 174509 - protein, 11 aa, Yellow fever virus
IRAQLHVGAKQ

SEQ ID NO: 174510 - protein, 11 aa, Yellow fever virus
RAQLHVGAKQE

SEQ ID NO: 174511 - protein, 11 aa, Yellow fever virus
AQLHVGAKQEN

SEQ ID NO: 174512 - protein, 11 aa, Yellow fever virus
QLHVGAKQENW

SEQ ID NO: 174513 - protein, 11 aa, Yellow fever virus
LHVGAKQENWN

SEQ ID NO: 174514 - protein, 11 aa, Yellow fever virus
HVGAKQENWNT

SEQ ID NO: 174515 - protein, 11 aa, Yellow fever virus
VGAKQENWNTD

SEQ ID NO: 174516 - protein, 11 aa, Yellow fever virus
GAKQENWNTDI

SEQ ID NO: 174517 - protein, 11 aa, Yellow fever virus
AKQENWNTDIK

SEQ ID NO: 174518 - protein, 11 aa, Yellow fever virus
KQENWNTDIKT

SEQ ID NO: 174519 - protein, 11 aa, Yellow fever virus
QENWNTDIKTL

SEQ ID NO: 174520 - protein, 11 aa, Yellow fever virus
ENWNTDIKTLK

SEQ ID NO: 174521 - protein, 11 aa, Yellow fever virus
NWNTDIKTLKF

SEQ ID NO: 174522 - protein, 11 aa, Yellow fever virus
WNTDIKTLKFD

SEQ ID NO: 174523 - protein, 11 aa, Yellow fever virus
NTDIKTLKFDA

SEQ ID NO: 174524 - protein, 11 aa, Yellow fever virus
TDIKTLKFDAL

SEQ ID NO: 174525 - protein, 11 aa, Yellow fever virus
DIKTLKFDALS

SEQ ID NO: 174526 - protein, 11 aa, Yellow fever virus
IKTLKFDALSG

SEQ ID NO: 174527 - protein, 11 aa, Yellow fever virus
KTLKFDALSGS

SEQ ID NO: 174528 - protein, 11 aa, Yellow fever virus
TLKFDALSGSQ

SEQ ID NO: 174529 - protein, 11 aa, Yellow fever virus
LKFDALSGSQE

SEQ ID NO: 174530 - protein, 11 aa, Yellow fever virus
KFDALSGSQEV

SEQ ID NO: 174531 - protein, 11 aa, Yellow fever virus
FDALSGSQEVE

SEQ ID NO: 174532 - protein, 11 aa, Yellow fever virus
DALSGSQEVEF

SEQ ID NO: 174533 - protein, 11 aa, Yellow fever virus
ALSGSQEVEFI

SEQ ID NO: 174534 - protein, 11 aa, Yellow fever virus
LSGSQEVEFIG

SEQ ID NO: 174535 - protein, 11 aa, Yellow fever virus
SGSQEVEFIGY

SEQ ID NO: 174536 - protein, 11 aa, Yellow fever virus
GSQEVEFIGYG

SEQ ID NO: 174537 - protein, 11 aa, Yellow fever virus
SQEVEFIGYGK

SEQ ID NO: 174538 - protein, 11 aa, Yellow fever virus
QEVEFIGYGKA

SEQ ID NO: 174539 - protein, 11 aa, Yellow fever virus
EVEFIGYGKAT

SEQ ID NO: 174540 - protein, 11 aa, Yellow fever virus
VEFIGYGKATL

SEQ ID NO: 174541 - protein, 11 aa, Yellow fever virus
EFIGYGKATLE

SEQ ID NO: 174542 - protein, 11 aa, Yellow fever virus
FIGYGKATLEC

SEQ ID NO: 174543 - protein, 11 aa, Yellow fever virus
IGYGKATLECQ

SEQ ID NO: 174544 - protein, 11 aa, Yellow fever virus
GYGKATLECQV

SEQ ID NO: 174545 - protein, 11 aa, Yellow fever virus
YGKATLECQVQ

SEQ ID NO: 174546 - protein, 11 aa, Yellow fever virus
GKATLECQVQT

SEQ ID NO: 174547 - protein, 11 aa, Yellow fever virus
KATLECQVQTA

SEQ ID NO: 174548 - protein, 11 aa, Yellow fever virus
ATLECQVQTAV

SEQ ID NO: 174549 - protein, 11 aa, Yellow fever virus
TLECQVQTAVD

SEQ ID NO: 174550 - protein, 11 aa, Yellow fever virus
LECQVQTAVDF

SEQ ID NO: 174551 - protein, 11 aa, Yellow fever virus
ECQVQTAVDFG

SEQ ID NO: 174552 - protein, 11 aa, Yellow fever virus
CQVQTAVDFGN

SEQ ID NO: 174553 - protein, 11 aa, Yellow fever virus
QVQTAVDFGNS

SEQ ID NO: 174554 - protein, 11 aa, Yellow fever virus
VQTAVDFGNSY

SEQ ID NO: 174555 - protein, 11 aa, Yellow fever virus
QTAVDFGNSYI

SEQ ID NO: 174556 - protein, 11 aa, Yellow fever virus
TAVDFGNSYIA

SEQ ID NO: 174557 - protein, 11 aa, Yellow fever virus
AVDFGNSYIAE

SEQ ID NO: 174558 - protein, 11 aa, Yellow fever virus
VDFGNSYIAEM

SEQ ID NO: 174559 - protein, 11 aa, Yellow fever virus
DFGNSYIAEME

SEQ ID NO: 174560 - protein, 11 aa, Yellow fever virus
FGNSYIAEMET

SEQ ID NO: 174561 - protein, 11 aa, Yellow fever virus
GNSYIAEMETE

SEQ ID NO: 174562 - protein, 11 aa, Yellow fever virus
NSYIAEMETES

SEQ ID NO: 174563 - protein, 11 aa, Yellow fever virus
SYIAEMETESW

SEQ ID NO: 174564 - protein, 11 aa, Yellow fever virus
YIAEMETESWI

SEQ ID NO: 174565 - protein, 11 aa, Yellow fever virus
IAEMETESWIV

SEQ ID NO: 174566 - protein, 11 aa, Yellow fever virus
AEMETESWIVD

SEQ ID NO: 174567 - protein, 11 aa, Yellow fever virus
EMETESWIVDR

SEQ ID NO: 174568 - protein, 11 aa, Yellow fever virus
METESWIVDRQ

SEQ ID NO: 174569 - protein, 11 aa, Yellow fever virus
ETESWIVDRQW

SEQ ID NO: 174570 - protein, 11 aa, Yellow fever virus
TESWIVDRQWA

SEQ ID NO: 174571 - protein, 11 aa, Yellow fever virus
ESWIVDRQWAQ

SEQ ID NO: 174572 - protein, 11 aa, Yellow fever virus
SWIVDRQWAQD

SEQ ID NO: 174573 - protein, 11 aa, Yellow fever virus
WIVDRQWAQDL

SEQ ID NO: 174574 - protein, 11 aa, Yellow fever virus
IVDRQWAQDLT

SEQ ID NO: 174575 - protein, 11 aa, Yellow fever virus
VDRQWAQDLTL

SEQ ID NO: 174576 - protein, 11 aa, Yellow fever virus
DRQWAQDLTLP

SEQ ID NO: 174577 - protein, 11 aa, Yellow fever virus
RQWAQDLTLPW

SEQ ID NO: 174578 - protein, 11 aa, Yellow fever virus
QWAQDLTLPWQ

SEQ ID NO: 174579 - protein, 11 aa, Yellow fever virus
WAQDLTLPWQS

SEQ ID NO: 174580 - protein, 11 aa, Yellow fever virus
AQDLTLPWQSG

SEQ ID NO: 174581 - protein, 11 aa, Yellow fever virus
QDLTLPWQSGS

SEQ ID NO: 174582 - protein, 11 aa, Yellow fever virus
DLTLPWQSGSG

SEQ ID NO: 174583 - protein, 11 aa, Yellow fever virus
LTLPWQSGSGG

SEQ ID NO: 174584 - protein, 11 aa, Yellow fever virus
TLPWQSGSGGV

SEQ ID NO: 174585 - protein, 11 aa, Yellow fever virus
LPWQSGSGGVW

SEQ ID NO: 174586 - protein, 11 aa, Yellow fever virus
PWQSGSGGVWR

SEQ ID NO: 174587 - protein, 11 aa, Yellow fever virus
WQSGSGGVWRE

SEQ ID NO: 174588 - protein, 11 aa, Yellow fever virus
QSGSGGVWREM

SEQ ID NO: 174589 - protein, 11 aa, Yellow fever virus
SGSGGVWREMH

SEQ ID NO: 174590 - protein, 11 aa, Yellow fever virus
GSGGVWREMHH

SEQ ID NO: 174591 - protein, 11 aa, Yellow fever virus
SGGVWREMHHL

SEQ ID NO: 174592 - protein, 11 aa, Yellow fever virus
GGVWREMHHLV

SEQ ID NO: 174593 - protein, 11 aa, Yellow fever virus
GVWREMHHLVE

SEQ ID NO: 174594 - protein, 11 aa, Yellow fever virus
VWREMHHLVEF

SEQ ID NO: 174595 - protein, 11 aa, Yellow fever virus
WREMHHLVEFE

SEQ ID NO: 174596 - protein, 11 aa, Yellow fever virus
REMHHLVEFEP

SEQ ID NO: 174597 - protein, 11 aa, Yellow fever virus
EMHHLVEFEPP

SEQ ID NO: 174598 - protein, 11 aa, Yellow fever virus
MHHLVEFEPPH

SEQ ID NO: 174599 - protein, 11 aa, Yellow fever virus
HHLVEFEPPHA

SEQ ID NO: 174600 - protein, 11 aa, Yellow fever virus
HLVEFEPPHAA

SEQ ID NO: 174601 - protein, 11 aa, Yellow fever virus
LVEFEPPHAAT

SEQ ID NO: 174602 - protein, 11 aa, Yellow fever virus
VEFEPPHAATI

SEQ ID NO: 174603 - protein, 11 aa, Yellow fever virus
EFEPPHAATIR

SEQ ID NO: 174604 - protein, 11 aa, Yellow fever virus
FEPPHAATIRV

SEQ ID NO: 174605 - protein, 11 aa, Yellow fever virus
EPPHAATIRVL

SEQ ID NO: 174606 - protein, 11 aa, Yellow fever virus
PPHAATIRVLA

SEQ ID NO: 174607 - protein, 11 aa, Yellow fever virus
PHAATIRVLAL

SEQ ID NO: 174608 - protein, 11 aa, Yellow fever virus
HAATIRVLALG

SEQ ID NO: 174609 - protein, 11 aa, Yellow fever virus
AATIRVLALGN

SEQ ID NO: 174610 - protein, 11 aa, Yellow fever virus
ATIRVLALGNQ

SEQ ID NO: 174611 - protein, 11 aa, Yellow fever virus
TIRVLALGNQE

SEQ ID NO: 174612 - protein, 11 aa, Yellow fever virus
IRVLALGNQEG

SEQ ID NO: 174613 - protein, 11 aa, Yellow fever virus
RVLALGNQEGS

SEQ ID NO: 174614 - protein, 11 aa, Yellow fever virus
VLALGNQEGSL

SEQ ID NO: 174615 - protein, 11 aa, Yellow fever virus
LALGNQEGSLK

SEQ ID NO: 174616 - protein, 11 aa, Yellow fever virus
ALGNQEGSLKT

SEQ ID NO: 174617 - protein, 11 aa, Yellow fever virus
LGNQEGSLKTA

SEQ ID NO: 174618 - protein, 11 aa, Yellow fever virus
GNQEGSLKTAL

SEQ ID NO: 174619 - protein, 11 aa, Yellow fever virus
NQEGSLKTALT

SEQ ID NO: 174620 - protein, 11 aa, Yellow fever virus
QEGSLKTALTG

SEQ ID NO: 174621 - protein, 11 aa, Yellow fever virus
EGSLKTALTGA

SEQ ID NO: 174622 - protein, 11 aa, Yellow fever virus
GSLKTALTGAM

SEQ ID NO: 174623 - protein, 11 aa, Yellow fever virus
SLKTALTGAMR

SEQ ID NO: 174624 - protein, 11 aa, Yellow fever virus
LKTALTGAMRV

SEQ ID NO: 174625 - protein, 11 aa, Yellow fever virus
KTALTGAMRVT

SEQ ID NO: 174626 - protein, 11 aa, Yellow fever virus
TALTGAMRVTK

SEQ ID NO: 174627 - protein, 11 aa, Yellow fever virus
ALTGAMRVTKD

SEQ ID NO: 174628 - protein, 11 aa, Yellow fever virus
LTGAMRVTKDT

SEQ ID NO: 174629 - protein, 11 aa, Yellow fever virus
TGAMRVTKDTN

SEQ ID NO: 174630 - protein, 11 aa, Yellow fever virus
GAMRVTKDTND

SEQ ID NO: 174631 - protein, 11 aa, Yellow fever virus
AMRVTKDTNDN

SEQ ID NO: 174632 - protein, 11 aa, Yellow fever virus
MRVTKDTNDNN

SEQ ID NO: 174633 - protein, 11 aa, Yellow fever virus
RVTKDTNDNNL

SEQ ID NO: 174634 - protein, 11 aa, Yellow fever virus
VTKDTNDNNLY

SEQ ID NO: 174635 - protein, 11 aa, Yellow fever virus
TKDTNDNNLYK

SEQ ID NO: 174636 - protein, 11 aa, Yellow fever virus
KDTNDNNLYKL

SEQ ID NO: 174637 - protein, 11 aa, Yellow fever virus
DTNDNNLYKLH

SEQ ID NO: 174638 - protein, 11 aa, Yellow fever virus
TNDNNLYKLHG

SEQ ID NO: 174639 - protein, 11 aa, Yellow fever virus
NDNNLYKLHGG

SEQ ID NO: 174640 - protein, 11 aa, Yellow fever virus
DNNLYKLHGGH

SEQ ID NO: 174641 - protein, 11 aa, Yellow fever virus
NNLYKLHGGHV

SEQ ID NO: 174642 - protein, 11 aa, Yellow fever virus
NLYKLHGGHVS

SEQ ID NO: 174643 - protein, 11 aa, Yellow fever virus
LYKLHGGHVSC

SEQ ID NO: 174644 - protein, 11 aa, Yellow fever virus
YKLHGGHVSCR

SEQ ID NO: 174645 - protein, 11 aa, Yellow fever virus
KLHGGHVSCRV

SEQ ID NO: 174646 - protein, 11 aa, Yellow fever virus
LHGGHVSCRVK

SEQ ID NO: 174647 - protein, 11 aa, Yellow fever virus
HGGHVSCRVKL

SEQ ID NO: 174648 - protein, 11 aa, Yellow fever virus
GGHVSCRVKLS

SEQ ID NO: 174649 - protein, 11 aa, Yellow fever virus
GHVSCRVKLSA

SEQ ID NO: 174650 - protein, 11 aa, Yellow fever virus
HVSCRVKLSAL

SEQ ID NO: 174651 - protein, 11 aa, Yellow fever virus
VSCRVKLSALT

SEQ ID NO: 174652 - protein, 11 aa, Yellow fever virus
SCRVKLSALTL

SEQ ID NO: 174653 - protein, 11 aa, Yellow fever virus
CRVKLSALTLK

SEQ ID NO: 174654 - protein, 11 aa, Yellow fever virus
RVKLSALTLKG

SEQ ID NO: 174655 - protein, 11 aa, Yellow fever virus
VKLSALTLKGT

SEQ ID NO: 174656 - protein, 11 aa, Yellow fever virus
KLSALTLKGTS

SEQ ID NO: 174657 - protein, 11 aa, Yellow fever virus
LSALTLKGTSY

SEQ ID NO: 174658 - protein, 11 aa, Yellow fever virus
SALTLKGTSYK

SEQ ID NO: 174659 - protein, 11 aa, Yellow fever virus
ALTLKGTSYKI

SEQ ID NO: 174660 - protein, 11 aa, Yellow fever virus
LTLKGTSYKIC

SEQ ID NO: 174661 - protein, 11 aa, Yellow fever virus
TLKGTSYKICT

SEQ ID NO: 174662 - protein, 11 aa, Yellow fever virus
LKGTSYKICTD

SEQ ID NO: 174663 - protein, 11 aa, Yellow fever virus
KGTSYKICTDK

SEQ ID NO: 174664 - protein, 11 aa, Yellow fever virus
GTSYKICTDKM

SEQ ID NO: 174665 - protein, 11 aa, Yellow fever virus
TSYKICTDKMF

SEQ ID NO: 174666 - protein, 11 aa, Yellow fever virus
SYKICTDKMFF

SEQ ID NO: 174667 - protein, 11 aa, Yellow fever virus
YKICTDKMFFV

SEQ ID NO: 174668 - protein, 11 aa, Yellow fever virus
KICTDKMFFVK

SEQ ID NO: 174669 - protein, 11 aa, Yellow fever virus
ICTDKMFFVKN

SEQ ID NO: 174670 - protein, 11 aa, Yellow fever virus
CTDKMFFVKNP

SEQ ID NO: 174671 - protein, 11 aa, Yellow fever virus
TDKMFFVKNPT

SEQ ID NO: 174672 - protein, 11 aa, Yellow fever virus
DKMFFVKNPTD

SEQ ID NO: 174673 - protein, 11 aa, Yellow fever virus
KMFFVKNPTDT

SEQ ID NO: 174674 - protein, 11 aa, Yellow fever virus
MFFVKNPTDTG

SEQ ID NO: 174675 - protein, 11 aa, Yellow fever virus
FFVKNPTDTGH

SEQ ID NO: 174676 - protein, 11 aa, Yellow fever virus
FVKNPTDTGHG

SEQ ID NO: 174677 - protein, 11 aa, Yellow fever virus
VKNPTDTGHGT

SEQ ID NO: 174678 - protein, 11 aa, Yellow fever virus
KNPTDTGHGTV

SEQ ID NO: 174679 - protein, 11 aa, Yellow fever virus
NPTDTGHGTVV

SEQ ID NO: 174680 - protein, 11 aa, Yellow fever virus
PTDTGHGTVVM

SEQ ID NO: 174681 - protein, 11 aa, Yellow fever virus
TDTGHGTVVMQ

SEQ ID NO: 174682 - protein, 11 aa, Yellow fever virus
DTGHGTVVMQV

SEQ ID NO: 174683 - protein, 11 aa, Yellow fever virus
TGHGTVVMQVK

SEQ ID NO: 174684 - protein, 11 aa, Yellow fever virus
GHGTVVMQVKV

SEQ ID NO: 174685 - protein, 11 aa, Yellow fever virus
HGTVVMQVKVP

SEQ ID NO: 174686 - protein, 11 aa, Yellow fever virus
GTVVMQVKVPK

SEQ ID NO: 174687 - protein, 11 aa, Yellow fever virus
TVVMQVKVPKG

SEQ ID NO: 174688 - protein, 11 aa, Yellow fever virus
VVMQVKVPKGA

SEQ ID NO: 174689 - protein, 11 aa, Yellow fever virus
VMQVKVPKGAP

SEQ ID NO: 174690 - protein, 11 aa, Yellow fever virus
MQVKVPKGAPC

SEQ ID NO: 174691 - protein, 11 aa, Yellow fever virus
QVKVSKGAPCR

SEQ ID NO: 174692 - protein, 11 aa, Yellow fever virus
VKVSKGAPCRI

SEQ ID NO: 174693 - protein, 11 aa, Yellow fever virus
KVSKGAPCRIP

SEQ ID NO: 174694 - protein, 11 aa, Yellow fever virus
VSKGAPCRIPV

SEQ ID NO: 174695 - protein, 11 aa, Yellow fever virus
SKGAPCRIPVI

SEQ ID NO: 174696 - protein, 11 aa, Yellow fever virus
KGAPCRIPVIV

SEQ ID NO: 174697 - protein, 11 aa, Yellow fever virus
GAPCRIPVIVA

SEQ ID NO: 174698 - protein, 11 aa, Yellow fever virus
APCRIPVIVAD

SEQ ID NO: 174699 - protein, 11 aa, Yellow fever virus
PCRIPVIVADD

SEQ ID NO: 174700 - protein, 11 aa, Yellow fever virus
CRIPVIVADDL

SEQ ID NO: 174701 - protein, 11 aa, Yellow fever virus
RIPVIVADDLT

SEQ ID NO: 174702 - protein, 11 aa, Yellow fever virus
IPVIVADDLTA

SEQ ID NO: 174703 - protein, 11 aa, Yellow fever virus
PVIVADDLTAA

SEQ ID NO: 174704 - protein, 11 aa, Yellow fever virus
VIVADDLTAAI

SEQ ID NO: 174705 - protein, 11 aa, Yellow fever virus
IVADDLTAAIN

SEQ ID NO: 174706 - protein, 11 aa, Yellow fever virus
VADDLTAAINK

SEQ ID NO: 174707 - protein, 11 aa, Yellow fever virus
ADDLTAAINKG

SEQ ID NO: 174708 - protein, 11 aa, Yellow fever virus
DDLTAAINKGI

SEQ ID NO: 174709 - protein, 11 aa, Yellow fever virus
DLTAAINKGIL

SEQ ID NO: 174710 - protein, 11 aa, Yellow fever virus
LTAAINKGILV

SEQ ID NO: 174711 - protein, 11 aa, Yellow fever virus
TAAINKGILVT

SEQ ID NO: 174712 - protein, 11 aa, Yellow fever virus
AAINKGILVTV

SEQ ID NO: 174713 - protein, 11 aa, Yellow fever virus
AINKGILVTVN

SEQ ID NO: 174714 - protein, 11 aa, Yellow fever virus
INKGILVTVNP

SEQ ID NO: 174715 - protein, 11 aa, Yellow fever virus
NKGILVTVNPI

SEQ ID NO: 174716 - protein, 11 aa, Yellow fever virus
KGILVTVNPIA

SEQ ID NO: 174717 - protein, 11 aa, Yellow fever virus
GILVTVNPIAS

SEQ ID NO: 174718 - protein, 11 aa, Yellow fever virus
ILVTVNPIAST

SEQ ID NO: 174719 - protein, 11 aa, Yellow fever virus
LVTVNPIASTN

SEQ ID NO: 174720 - protein, 11 aa, Yellow fever virus
VTVNPIASTND

SEQ ID NO: 174721 - protein, 11 aa, Yellow fever virus
TVNPIASTNDD

SEQ ID NO: 174722 - protein, 11 aa, Yellow fever virus
VNPIASTNDDE

SEQ ID NO: 174723 - protein, 11 aa, Yellow fever virus
NPIASTNDDEV

SEQ ID NO: 174724 - protein, 11 aa, Yellow fever virus
PIASTNDDEVL

SEQ ID NO: 174725 - protein, 11 aa, Yellow fever virus
IASTNDDEVLI

SEQ ID NO: 174726 - protein, 11 aa, Yellow fever virus
ASTNDDEVLIE

SEQ ID NO: 174727 - protein, 11 aa, Yellow fever virus
STNDDEVLIEV

SEQ ID NO: 174728 - protein, 11 aa, Yellow fever virus
TNDDEVLIEVN

SEQ ID NO: 174729 - protein, 11 aa, Yellow fever virus
NDDEVLIEVNP

SEQ ID NO: 174730 - protein, 11 aa, Yellow fever virus
DDEVLIEVNPP

SEQ ID NO: 174731 - protein, 11 aa, Yellow fever virus
DEVLIEVNPPF

SEQ ID NO: 174732 - protein, 11 aa, Yellow fever virus
EVLIEVNPPFG

SEQ ID NO: 174733 - protein, 11 aa, Yellow fever virus
VLIEVNPPFGD

SEQ ID NO: 174734 - protein, 11 aa, Yellow fever virus
LIEVNPPFGDS

SEQ ID NO: 174735 - protein, 11 aa, Yellow fever virus
IEVNPPFGDSY

SEQ ID NO: 174736 - protein, 11 aa, Yellow fever virus
EVNPPFGDSYI

SEQ ID NO: 174737 - protein, 11 aa, Yellow fever virus
VNPPFGDSYII

SEQ ID NO: 174738 - protein, 11 aa, Yellow fever virus
NPPFGDSYIIV

SEQ ID NO: 174739 - protein, 11 aa, Yellow fever virus
PPFGDSYIIVG

SEQ ID NO: 174740 - protein, 11 aa, Yellow fever virus
PFGDSYIIVGR

SEQ ID NO: 174741 - protein, 11 aa, Yellow fever virus
FGDSYIIVGRG

SEQ ID NO: 174742 - protein, 11 aa, Yellow fever virus
GDSYIIVGRGD

SEQ ID NO: 174743 - protein, 11 aa, Yellow fever virus
DSYIIVGRGDS

SEQ ID NO: 174744 - protein, 11 aa, Yellow fever virus
SYIIVGRGDSR

SEQ ID NO: 174745 - protein, 11 aa, Yellow fever virus
YIIVGRGDSRL

SEQ ID NO: 174746 - protein, 11 aa, Yellow fever virus
IIVGRGDSRLT

SEQ ID NO: 174747 - protein, 11 aa, Yellow fever virus
IVGRGDSRLTY

SEQ ID NO: 174748 - protein, 11 aa, Yellow fever virus
VGRGDSRLTYQ

SEQ ID NO: 174749 - protein, 11 aa, Yellow fever virus
GRGDSRLTYQW

SEQ ID NO: 174750 - protein, 11 aa, Yellow fever virus
RGDSRLTYQWH

SEQ ID NO: 174751 - protein, 11 aa, Yellow fever virus
GDSRLTYQWHK

SEQ ID NO: 174752 - protein, 11 aa, Yellow fever virus
DSRLTYQWHKE

SEQ ID NO: 174753 - protein, 11 aa, Yellow fever virus
SRLTYQWHKEG

SEQ ID NO: 174754 - protein, 11 aa, Yellow fever virus
RLTYQWHKEGS

SEQ ID NO: 174755 - protein, 11 aa, Yellow fever virus
LTYQWHKEGSS

SEQ ID NO: 174756 - protein, 11 aa, Yellow fever virus
TYQWHKEGSSI

SEQ ID NO: 174757 - protein, 11 aa, Yellow fever virus
YQWHKEGSSIG

SEQ ID NO: 174758 - protein, 11 aa, Yellow fever virus
QWHKEGSSIGK

SEQ ID NO: 174759 - protein, 11 aa, Yellow fever virus
WHKEGSSIGKL

SEQ ID NO: 174760 - protein, 11 aa, Yellow fever virus
HKEGSSIGKLF

SEQ ID NO: 174761 - protein, 11 aa, Yellow fever virus
KEGSSIGKLFT

SEQ ID NO: 174762 - protein, 11 aa, Yellow fever virus
EGSSIGKLFTQ

SEQ ID NO: 174763 - protein, 11 aa, Yellow fever virus
GSSIGKLFTQT

SEQ ID NO: 174764 - protein, 11 aa, Yellow fever virus
SSIGKLFTQTM

SEQ ID NO: 174765 - protein, 11 aa, Yellow fever virus
SIGKLFTQTMK

SEQ ID NO: 174766 - protein, 11 aa, Yellow fever virus
IGKLFTQTMKG

SEQ ID NO: 174767 - protein, 11 aa, Yellow fever virus
GKLFTQTMKGV

SEQ ID NO: 174768 - protein, 11 aa, Yellow fever virus
KLFTQTMKGVE

SEQ ID NO: 174769 - protein, 11 aa, Yellow fever virus
LFTQTMKGVER

SEQ ID NO: 174770 - protein, 11 aa, Yellow fever virus
FTQTMKGVERL

SEQ ID NO: 174771 - protein, 11 aa, Yellow fever virus
TQTMKGVERLA

SEQ ID NO: 174772 - protein, 11 aa, Yellow fever virus
QTMKGVERLAV

SEQ ID NO: 174773 - protein, 11 aa, Yellow fever virus
TMKGVERLAVM

SEQ ID NO: 174774 - protein, 11 aa, Yellow fever virus
MKGVERLAVMG

SEQ ID NO: 174775 - protein, 11 aa, Yellow fever virus
KGVERLAVMGD

SEQ ID NO: 174776 - protein, 11 aa, Yellow fever virus
GVERLAVMGDT

SEQ ID NO: 174777 - protein, 11 aa, Yellow fever virus
VERLAVMGDTA

SEQ ID NO: 174778 - protein, 11 aa, Yellow fever virus
ERLAVMGDTAW

SEQ ID NO: 174779 - protein, 11 aa, Yellow fever virus
RLAVMGDTAWD

SEQ ID NO: 174780 - protein, 11 aa, Yellow fever virus
LAVMGDTAWDF

SEQ ID NO: 174781 - protein, 11 aa, Yellow fever virus
AVMGDTAWDFS

SEQ ID NO: 174782 - protein, 11 aa, Yellow fever virus
VMGDTAWDFSS

SEQ ID NO: 174783 - protein, 11 aa, Yellow fever virus
MGDTAWDFSSA

SEQ ID NO: 174784 - protein, 11 aa, Yellow fever virus
GDTAWDFSSAG

SEQ ID NO: 174785 - protein, 11 aa, Yellow fever virus
DTAWDFSSAGG

SEQ ID NO: 174786 - protein, 11 aa, Yellow fever virus
TAWDFSSAGGF

SEQ ID NO: 174787 - protein, 11 aa, Yellow fever virus
AWDFSSAGGFF

SEQ ID NO: 174788 - protein, 11 aa, Yellow fever virus
WDFSSAGGFFT

SEQ ID NO: 174789 - protein, 11 aa, Yellow fever virus
DFSSAGGFFTS

SEQ ID NO: 174790 - protein, 11 aa, Yellow fever virus
FSSAGGFFTSV

SEQ ID NO: 174791 - protein, 11 aa, Yellow fever virus
SSAGGFFTSVG

SEQ ID NO: 174792 - protein, 11 aa, Yellow fever virus
SAGGFFTSVGK

SEQ ID NO: 174793 - protein, 11 aa, Yellow fever virus
AGGFFTSVGKG

SEQ ID NO: 174794 - protein, 11 aa, Yellow fever virus
GGFFTSVGKGI

SEQ ID NO: 174795 - protein, 11 aa, Yellow fever virus
GFFTSVGKGIH

SEQ ID NO: 174796 - protein, 11 aa, Yellow fever virus
FFTSVGKGIHT

SEQ ID NO: 174797 - protein, 11 aa, Yellow fever virus
FTSVGKGIHTV

SEQ ID NO: 174798 - protein, 11 aa, Yellow fever virus
TSVGKGIHTVF

SEQ ID NO: 174799 - protein, 11 aa, Yellow fever virus
SVGKGIHTVFG

SEQ ID NO: 174800 - protein, 11 aa, Yellow fever virus
VGKGIHTVFGS

SEQ ID NO: 174801 - protein, 11 aa, Yellow fever virus
GKGIHTVFGSA

SEQ ID NO: 174802 - protein, 11 aa, Yellow fever virus
KGIHTVFGSAF

SEQ ID NO: 174803 - protein, 11 aa, Yellow fever virus
GIHTVFGSAFQ

SEQ ID NO: 174804 - protein, 11 aa, Yellow fever virus
IHTVFGSAFQG

SEQ ID NO: 174805 - protein, 11 aa, Yellow fever virus
HTVFGSAFQGL

SEQ ID NO: 174806 - protein, 11 aa, Yellow fever virus
TVFGSAFQGLF

SEQ ID NO: 174807 - protein, 11 aa, Yellow fever virus
VFGSAFQGLFG

SEQ ID NO: 174808 - protein, 11 aa, Yellow fever virus
FGSAFQGLFGG

SEQ ID NO: 174809 - protein, 11 aa, Yellow fever virus
GSAFQGLFGGL

SEQ ID NO: 174810 - protein, 11 aa, Yellow fever virus
SAFQGLFGGLN

SEQ ID NO: 174811 - protein, 11 aa, Yellow fever virus
AFQGLFGGLNW

SEQ ID NO: 174812 - protein, 11 aa, Yellow fever virus
FQGLFGGLNWI

SEQ ID NO: 174813 - protein, 11 aa, Yellow fever virus
QGLFGGLNWIT

SEQ ID NO: 174814 - protein, 11 aa, Yellow fever virus
GLFGGLNWITK

SEQ ID NO: 174815 - protein, 11 aa, Yellow fever virus
LFGGLNWITKV

SEQ ID NO: 174816 - protein, 11 aa, Yellow fever virus
FGGLNWITKVI

SEQ ID NO: 174817 - protein, 11 aa, Yellow fever virus
GGLNWITKVIM

SEQ ID NO: 174818 - protein, 11 aa, Yellow fever virus
GLNWITKVIMG

SEQ ID NO: 174819 - protein, 11 aa, Yellow fever virus
LNWITKVIMGA

SEQ ID NO: 174820 - protein, 11 aa, Yellow fever virus
NWITKVIMGAV

SEQ ID NO: 174821 - protein, 11 aa, Yellow fever virus
WITKVIMGAVL

SEQ ID NO: 174822 - protein, 11 aa, Yellow fever virus
ITKVIMGAVLI

SEQ ID NO: 174823 - protein, 11 aa, Yellow fever virus
TKVIMGAVLIW

SEQ ID NO: 174824 - protein, 11 aa, Yellow fever virus
KVIMGAVLIWV

SEQ ID NO: 174825 - protein, 11 aa, Yellow fever virus
VIMGAVLIWVG

SEQ ID NO: 174826 - protein, 11 aa, Yellow fever virus
IMGAVLIWVGI

SEQ ID NO: 174827 - protein, 11 aa, Yellow fever virus
MGAVLIWVGIN

SEQ ID NO: 174828 - protein, 11 aa, Yellow fever virus
GAVLIWVGINT

SEQ ID NO: 174829 - protein, 11 aa, Yellow fever virus
AVLIWVGINTR

SEQ ID NO: 174830 - protein, 11 aa, Yellow fever virus
VLIWVGINTRN

SEQ ID NO: 174831 - protein, 11 aa, Yellow fever virus
LIWVGINTRNM

SEQ ID NO: 174832 - protein, 11 aa, Yellow fever virus
IWVGINTRNMT

SEQ ID NO: 174833 - protein, 11 aa, Yellow fever virus
WVGINTRNMTM

SEQ ID NO: 174834 - protein, 11 aa, Yellow fever virus
VGINTRNMTMS

SEQ ID NO: 174835 - protein, 11 aa, Yellow fever virus
GINTRNMTMSM

SEQ ID NO: 174836 - protein, 11 aa, Yellow fever virus
INTRNMTMSMS

SEQ ID NO: 174837 - protein, 11 aa, Yellow fever virus
NTRNMTMSMSM

SEQ ID NO: 174838 - protein, 11 aa, Yellow fever virus
TRNMTMSMSMI

SEQ ID NO: 174839 - protein, 11 aa, Yellow fever virus
RNMTMSMSMIL

SEQ ID NO: 174840 - protein, 11 aa, Yellow fever virus
NMTMSMSMILV

SEQ ID NO: 174841 - protein, 11 aa, Yellow fever virus
MTMSMSMILVG

SEQ ID NO: 174842 - protein, 11 aa, Yellow fever virus
TMSMSMILVGV

SEQ ID NO: 174843 - protein, 11 aa, Yellow fever virus
MSMSMILVGVI

SEQ ID NO: 174844 - protein, 11 aa, Yellow fever virus
SMSMILVGVIM

SEQ ID NO: 174845 - protein, 11 aa, Yellow fever virus
MSMILVGVIMM

SEQ ID NO: 174846 - protein, 11 aa, Yellow fever virus
SMILVGVIMMF

SEQ ID NO: 174847 - protein, 11 aa, Yellow fever virus
MILVGVIMMFL

SEQ ID NO: 174848 - protein, 11 aa, Yellow fever virus
ILVGVIMMFLS

SEQ ID NO: 174849 - protein, 11 aa, Yellow fever virus
LVGVIMMFLSL

SEQ ID NO: 174850 - protein, 11 aa, Yellow fever virus
VGVIMMFLSLG

SEQ ID NO: 174851 - protein, 11 aa, Yellow fever virus
GVIMMFLSLGV

SEQ ID NO: 174852 - protein, 11 aa, Yellow fever virus
VIMMFLSLGVG

SEQ ID NO: 174853 - protein, 11 aa, Yellow fever virus
IMMFLSLGVGA

SEQ ID NO: 174854 - protein, 11 aa, Yellow fever virus
MMFLSLGVGAD

SEQ ID NO: 174855 - protein, 11 aa, Yellow fever virus
MFLSLGVGADQ

SEQ ID NO: 174856 - protein, 11 aa, Yellow fever virus
FLSLGVGADQG

SEQ ID NO: 174857 - protein, 11 aa, Yellow fever virus
LSLGVGADQGC

SEQ ID NO: 174858 - protein, 11 aa, Yellow fever virus
SLGVGADQGCA

SEQ ID NO: 174859 - protein, 11 aa, Yellow fever virus
LGVGADQGCAI

SEQ ID NO: 174860 - protein, 11 aa, Yellow fever virus
GVGADQGCAIN

SEQ ID NO: 174861 - protein, 11 aa, Yellow fever virus
VGADQGCAINF

SEQ ID NO: 174862 - protein, 11 aa, Yellow fever virus
GADQGCAINFG

SEQ ID NO: 174863 - protein, 11 aa, Yellow fever virus
ADQGCAINFGK

SEQ ID NO: 174864 - protein, 11 aa, Yellow fever virus
DQGCAINFGKR

SEQ ID NO: 174865 - protein, 11 aa, Yellow fever virus
QGCAINFGKRE

SEQ ID NO: 174866 - protein, 11 aa, Yellow fever virus
GCAINFGKREL

SEQ ID NO: 174867 - protein, 11 aa, Yellow fever virus
CAINFGKRELK

SEQ ID NO: 174868 - protein, 11 aa, Yellow fever virus
AINFGKRELKC

SEQ ID NO: 174869 - protein, 11 aa, Yellow fever virus
INFGKRELKCG

SEQ ID NO: 174870 - protein, 11 aa, Yellow fever virus
NFGKRELKCGD

SEQ ID NO: 174871 - protein, 11 aa, Yellow fever virus
FGKRELKCGDG

SEQ ID NO: 174872 - protein, 11 aa, Yellow fever virus
GKRELKCGDGI

SEQ ID NO: 174873 - protein, 11 aa, Yellow fever virus
KRELKCGDGIF

SEQ ID NO: 174874 - protein, 11 aa, Yellow fever virus
RELKCGDGIFI

SEQ ID NO: 174875 - protein, 11 aa, Yellow fever virus
ELKCGDGIFIF

SEQ ID NO: 174876 - protein, 11 aa, Yellow fever virus
LKCGDGIFIFR

SEQ ID NO: 174877 - protein, 11 aa, Yellow fever virus
KCGDGIFIFRD

SEQ ID NO: 174878 - protein, 11 aa, Yellow fever virus
CGDGIFIFRDS

SEQ ID NO: 174879 - protein, 11 aa, Yellow fever virus
GDGIFIFRDSD

SEQ ID NO: 174880 - protein, 11 aa, Yellow fever virus
DGIFIFRDSDD

SEQ ID NO: 174881 - protein, 11 aa, Yellow fever virus
GIFIFRDSDDW

SEQ ID NO: 174882 - protein, 11 aa, Yellow fever virus
IFIFRDSDDWL

SEQ ID NO: 174883 - protein, 11 aa, Yellow fever virus
FIFRDSDDWLN

SEQ ID NO: 174884 - protein, 11 aa, Yellow fever virus
IFRDSDDWLNK

SEQ ID NO: 174885 - protein, 11 aa, Yellow fever virus
FRDSDDWLNKY

SEQ ID NO: 174886 - protein, 11 aa, Yellow fever virus
RDSDDWLNKYS

SEQ ID NO: 174887 - protein, 11 aa, Yellow fever virus
DSDDWLNKYSY

SEQ ID NO: 174888 - protein, 11 aa, Yellow fever virus
SDDWLNKYSYY

SEQ ID NO: 174889 - protein, 11 aa, Yellow fever virus
DDWLNKYSYYP

SEQ ID NO: 174890 - protein, 11 aa, Yellow fever virus
DWLNKYSYYPE

SEQ ID NO: 174891 - protein, 11 aa, Yellow fever virus
WLNKYSYYPED

SEQ ID NO: 174892 - protein, 11 aa, Yellow fever virus
LNKYSYYPEDP

SEQ ID NO: 174893 - protein, 11 aa, Yellow fever virus
NKYSYYPEDPV

SEQ ID NO: 174894 - protein, 11 aa, Yellow fever virus
KYSYYPEDPVK

SEQ ID NO: 174895 - protein, 11 aa, Yellow fever virus
YSYYPEDPVKL

SEQ ID NO: 174896 - protein, 11 aa, Yellow fever virus
SYYPEDPVKLA

SEQ ID NO: 174897 - protein, 11 aa, Yellow fever virus
YYPEDPVKLAS

SEQ ID NO: 174898 - protein, 11 aa, Yellow fever virus
YPEDPVKLASI

SEQ ID NO: 174899 - protein, 11 aa, Yellow fever virus
PEDPVKLASIV

SEQ ID NO: 174900 - protein, 11 aa, Yellow fever virus
EDPVKLASIVK

SEQ ID NO: 174901 - protein, 11 aa, Yellow fever virus
DPVKLASIVKA

SEQ ID NO: 174902 - protein, 11 aa, Yellow fever virus
PVKLASIVKAS

SEQ ID NO: 174903 - protein, 11 aa, Yellow fever virus
VKLASIVKASF

SEQ ID NO: 174904 - protein, 11 aa, Yellow fever virus
KLASIVKASFE

SEQ ID NO: 174905 - protein, 11 aa, Yellow fever virus
LASIVKASFEE

SEQ ID NO: 174906 - protein, 11 aa, Yellow fever virus
ASIVKASFEEG

SEQ ID NO: 174907 - protein, 11 aa, Yellow fever virus
SIVKASFEEGK

SEQ ID NO: 174908 - protein, 11 aa, Yellow fever virus
IVKASFEEGKC

SEQ ID NO: 174909 - protein, 11 aa, Yellow fever virus
VKASFEEGKCG

SEQ ID NO: 174910 - protein, 11 aa, Yellow fever virus
KASFEEGKCGL

SEQ ID NO: 174911 - protein, 11 aa, Yellow fever virus
ASFEEGKCGLN

SEQ ID NO: 174912 - protein, 11 aa, Yellow fever virus
SFEEGKCGLNS

SEQ ID NO: 174913 - protein, 11 aa, Yellow fever virus
FEEGKCGLNSV

SEQ ID NO: 174914 - protein, 11 aa, Yellow fever virus
EEGKCGLNSVD

SEQ ID NO: 174915 - protein, 11 aa, Yellow fever virus
EGKCGLNSVDS

SEQ ID NO: 174916 - protein, 11 aa, Yellow fever virus
GKCGLNSVDSL

SEQ ID NO: 174917 - protein, 11 aa, Yellow fever virus
KCGLNSVDSLE

SEQ ID NO: 174918 - protein, 11 aa, Yellow fever virus
CGLNSVDSLEH

SEQ ID NO: 174919 - protein, 11 aa, Yellow fever virus
GLNSVDSLEHE

SEQ ID NO: 174920 - protein, 11 aa, Yellow fever virus
LNSVDSLEHEM

SEQ ID NO: 174921 - protein, 11 aa, Yellow fever virus
NSVDSLEHEMW

SEQ ID NO: 174922 - protein, 11 aa, Yellow fever virus
SVDSLEHEMWR

SEQ ID NO: 174923 - protein, 11 aa, Yellow fever virus
VDSLEHEMWRS

SEQ ID NO: 174924 - protein, 11 aa, Yellow fever virus
DSLEHEMWRSR

SEQ ID NO: 174925 - protein, 11 aa, Yellow fever virus
SLEHEMWRSRA

SEQ ID NO: 174926 - protein, 11 aa, Yellow fever virus
LEHEMWRSRAD

SEQ ID NO: 174927 - protein, 11 aa, Yellow fever virus
EHEMWRSRADE

SEQ ID NO: 174928 - protein, 11 aa, Yellow fever virus
HEMWRSRADEI

SEQ ID NO: 174929 - protein, 11 aa, Yellow fever virus
EMWRSRADEIN

SEQ ID NO: 174930 - protein, 11 aa, Yellow fever virus
MWRSRADEINA

SEQ ID NO: 174931 - protein, 11 aa, Yellow fever virus
WRSRADEINAI

SEQ ID NO: 174932 - protein, 11 aa, Yellow fever virus
RSRADEINAIF

SEQ ID NO: 174933 - protein, 11 aa, Yellow fever virus
SRADEINAIFE

SEQ ID NO: 174934 - protein, 11 aa, Yellow fever virus
RADEINAIFEE

SEQ ID NO: 174935 - protein, 11 aa, Yellow fever virus
ADEINAIFEEN

SEQ ID NO: 174936 - protein, 11 aa, Yellow fever virus
DEINAIFEENE

SEQ ID NO: 174937 - protein, 11 aa, Yellow fever virus
EINAIFEENEV

SEQ ID NO: 174938 - protein, 11 aa, Yellow fever virus
INAIFEENEVD

SEQ ID NO: 174939 - protein, 11 aa, Yellow fever virus
NAIFEENEVDI

SEQ ID NO: 174940 - protein, 11 aa, Yellow fever virus
AIFEENEVDIS

SEQ ID NO: 174941 - protein, 11 aa, Yellow fever virus
IFEENEVDISV

SEQ ID NO: 174942 - protein, 11 aa, Yellow fever virus
FEENEVDISVV

SEQ ID NO: 174943 - protein, 11 aa, Yellow fever virus
EENEVDISVVV

SEQ ID NO: 174944 - protein, 11 aa, Yellow fever virus
ENEVDISVVVQ

SEQ ID NO: 174945 - protein, 11 aa, Yellow fever virus
NEVDISVVVQD

SEQ ID NO: 174946 - protein, 11 aa, Yellow fever virus
EVDISVVVQDP

SEQ ID NO: 174947 - protein, 11 aa, Yellow fever virus
VDISVVVQDPK

SEQ ID NO: 174948 - protein, 11 aa, Yellow fever virus
DISVVVQDPKN

SEQ ID NO: 174949 - protein, 11 aa, Yellow fever virus
ISVVVQDPKNV

SEQ ID NO: 174950 - protein, 11 aa, Yellow fever virus
SVVVQDPKNVY

SEQ ID NO: 174951 - protein, 11 aa, Yellow fever virus
VVVQDPKNVYQ

SEQ ID NO: 174952 - protein, 11 aa, Yellow fever virus
VVQDPKNVYQR

SEQ ID NO: 174953 - protein, 11 aa, Yellow fever virus
VQDPKNVYQRG

SEQ ID NO: 174954 - protein, 11 aa, Yellow fever virus
QDPKNVYQRGT

SEQ ID NO: 174955 - protein, 11 aa, Yellow fever virus
DPKNVYQRGTH

SEQ ID NO: 174956 - protein, 11 aa, Yellow fever virus
PKNVYQRGTHP

SEQ ID NO: 174957 - protein, 11 aa, Yellow fever virus
KNVYQRGTHPF

SEQ ID NO: 174958 - protein, 11 aa, Yellow fever virus
NVYQRGTHPFS

SEQ ID NO: 174959 - protein, 11 aa, Yellow fever virus
VYQRGTHPFSR

SEQ ID NO: 174960 - protein, 11 aa, Yellow fever virus
YQRGTHPFSRI

SEQ ID NO: 174961 - protein, 11 aa, Yellow fever virus
QRGTHPFSRIR

SEQ ID NO: 174962 - protein, 11 aa, Yellow fever virus
RGTHPFSRIRD

SEQ ID NO: 174963 - protein, 11 aa, Yellow fever virus
GTHPFSRIRDG

SEQ ID NO: 174964 - protein, 11 aa, Yellow fever virus
THPFSRIRDGL

SEQ ID NO: 174965 - protein, 11 aa, Yellow fever virus
HPFSRIRDGLQ

SEQ ID NO: 174966 - protein, 11 aa, Yellow fever virus
PFSRIRDGLQY

SEQ ID NO: 174967 - protein, 11 aa, Yellow fever virus
FSRIRDGLQYG

SEQ ID NO: 174968 - protein, 11 aa, Yellow fever virus
SRIRDGLQYGW

SEQ ID NO: 174969 - protein, 11 aa, Yellow fever virus
RIRDGLQYGWK

SEQ ID NO: 174970 - protein, 11 aa, Yellow fever virus
IRDGLQYGWKT

SEQ ID NO: 174971 - protein, 11 aa, Yellow fever virus
RDGLQYGWKTW

SEQ ID NO: 174972 - protein, 11 aa, Yellow fever virus
DGLQYGWKTWG

SEQ ID NO: 174973 - protein, 11 aa, Yellow fever virus
GLQYGWKTWGK

SEQ ID NO: 174974 - protein, 11 aa, Yellow fever virus
LQYGWKTWGKN

SEQ ID NO: 174975 - protein, 11 aa, Yellow fever virus
QYGWKTWGKNL

SEQ ID NO: 174976 - protein, 11 aa, Yellow fever virus
YGWKTWGKNLV

SEQ ID NO: 174977 - protein, 11 aa, Yellow fever virus
GWKTWGKNLVF

SEQ ID NO: 174978 - protein, 11 aa, Yellow fever virus
WKTWGKNLVFS

SEQ ID NO: 174979 - protein, 11 aa, Yellow fever virus
KTWGKNLVFSP

SEQ ID NO: 174980 - protein, 11 aa, Yellow fever virus
TWGKNLVFSPG

SEQ ID NO: 174981 - protein, 11 aa, Yellow fever virus
WGKNLVFSPGR

SEQ ID NO: 174982 - protein, 11 aa, Yellow fever virus
GKNLVFSPGRK

SEQ ID NO: 174983 - protein, 11 aa, Yellow fever virus
KNLVFSPGRKN

SEQ ID NO: 174984 - protein, 11 aa, Yellow fever virus
NLVFSPGRKNG

SEQ ID NO: 174985 - protein, 11 aa, Yellow fever virus
LVFSPGRKNGS

SEQ ID NO: 174986 - protein, 11 aa, Yellow fever virus
VFSPGRKNGSF

SEQ ID NO: 174987 - protein, 11 aa, Yellow fever virus
FSPGRKNGSFI

SEQ ID NO: 174988 - protein, 11 aa, Yellow fever virus
SPGRKNGSFII

SEQ ID NO: 174989 - protein, 11 aa, Yellow fever virus
PGRKNGSFIID

SEQ ID NO: 174990 - protein, 11 aa, Yellow fever virus
GRKNGSFIIDG

SEQ ID NO: 174991 - protein, 11 aa, Yellow fever virus
RKNGSFIIDGK

SEQ ID NO: 174992 - protein, 11 aa, Yellow fever virus
KNGSFIIDGKS

SEQ ID NO: 174993 - protein, 11 aa, Yellow fever virus
NGSFIIDGKSR

SEQ ID NO: 174994 - protein, 11 aa, Yellow fever virus
GSFIIDGKSRK

SEQ ID NO: 174995 - protein, 11 aa, Yellow fever virus
SFIIDGKSRKE

SEQ ID NO: 174996 - protein, 11 aa, Yellow fever virus
FIIDGKSRKEC

SEQ ID NO: 174997 - protein, 11 aa, Yellow fever virus
IIDGKSRKECP

SEQ ID NO: 174998 - protein, 11 aa, Yellow fever virus
IDGKSRKECPF

SEQ ID NO: 174999 - protein, 11 aa, Yellow fever virus
DGKSRKECPFS

SEQ ID NO: 175000 - protein, 11 aa, Yellow fever virus
GKSRKECPFSN

SEQ ID NO: 175001 - protein, 11 aa, Yellow fever virus
KSRKECPFSNR

SEQ ID NO: 175002 - protein, 11 aa, Yellow fever virus
SRKECPFSNRV

SEQ ID NO: 175003 - protein, 11 aa, Yellow fever virus
RKECPFSNRVW

SEQ ID NO: 175004 - protein, 11 aa, Yellow fever virus
KECPFSNRVWN

SEQ ID NO: 175005 - protein, 11 aa, Yellow fever virus
ECPFSNRVWNS

SEQ ID NO: 175006 - protein, 11 aa, Yellow fever virus
CPFSNRVWNSF

SEQ ID NO: 175007 - protein, 11 aa, Yellow fever virus
PFSNRVWNSFQ

SEQ ID NO: 175008 - protein, 11 aa, Yellow fever virus
FSNRVWNSFQI

SEQ ID NO: 175009 - protein, 11 aa, Yellow fever virus
SNRVWNSFQIE

SEQ ID NO: 175010 - protein, 11 aa, Yellow fever virus
NRVWNSFQIEE

SEQ ID NO: 175011 - protein, 11 aa, Yellow fever virus
RVWNSFQIEEF

SEQ ID NO: 175012 - protein, 11 aa, Yellow fever virus
VWNSFQIEEFG

SEQ ID NO: 175013 - protein, 11 aa, Yellow fever virus
WNSFQIEEFGT

SEQ ID NO: 175014 - protein, 11 aa, Yellow fever virus
NSFQIEEFGTG

SEQ ID NO: 175015 - protein, 11 aa, Yellow fever virus
SFQIEEFGTGV

SEQ ID NO: 175016 - protein, 11 aa, Yellow fever virus
FQIEEFGTGVF

SEQ ID NO: 175017 - protein, 11 aa, Yellow fever virus
QIEEFGTGVFT

SEQ ID NO: 175018 - protein, 11 aa, Yellow fever virus
IEEFGTGVFTT

SEQ ID NO: 175019 - protein, 11 aa, Yellow fever virus
EEFGTGVFTTR

SEQ ID NO: 175020 - protein, 11 aa, Yellow fever virus
EFGTGVFTTRV

SEQ ID NO: 175021 - protein, 11 aa, Yellow fever virus
FGTGVFTTRVY

SEQ ID NO: 175022 - protein, 11 aa, Yellow fever virus
GTGVFTTRVYM

SEQ ID NO: 175023 - protein, 11 aa, Yellow fever virus
TGVFTTRVYMD

SEQ ID NO: 175024 - protein, 11 aa, Yellow fever virus
GVFTTRVYMDA

SEQ ID NO: 175025 - protein, 11 aa, Yellow fever virus
VFTTRVYMDAV

SEQ ID NO: 175026 - protein, 11 aa, Yellow fever virus
FTTRVYMDAVF

SEQ ID NO: 175027 - protein, 11 aa, Yellow fever virus
TTRVYMDAVFE

SEQ ID NO: 175028 - protein, 11 aa, Yellow fever virus
TRVYMDAVFEY

SEQ ID NO: 175029 - protein, 11 aa, Yellow fever virus
RVYMDAVFEYT

SEQ ID NO: 175030 - protein, 11 aa, Yellow fever virus
VYMDAVFEYTI

SEQ ID NO: 175031 - protein, 11 aa, Yellow fever virus
YMDAVFEYTID

SEQ ID NO: 175032 - protein, 11 aa, Yellow fever virus
MDAVFEYTIDC

SEQ ID NO: 175033 - protein, 11 aa, Yellow fever virus
DAVFEYTIDCD

SEQ ID NO: 175034 - protein, 11 aa, Yellow fever virus
AVFEYTIDCDG

SEQ ID NO: 175035 - protein, 11 aa, Yellow fever virus
VFEYTIDCDGS

SEQ ID NO: 175036 - protein, 11 aa, Yellow fever virus
FEYTIDCDGSI

SEQ ID NO: 175037 - protein, 11 aa, Yellow fever virus
EYTIDCDGSIL

SEQ ID NO: 175038 - protein, 11 aa, Yellow fever virus
YTIDCDGSILG

SEQ ID NO: 175039 - protein, 11 aa, Yellow fever virus
TIDCDGSILGA

SEQ ID NO: 175040 - protein, 11 aa, Yellow fever virus
IDCDGSILGAA

SEQ ID NO: 175041 - protein, 11 aa, Yellow fever virus
DCDGSILGAAV

SEQ ID NO: 175042 - protein, 11 aa, Yellow fever virus
CDGSILGAAVN

SEQ ID NO: 175043 - protein, 11 aa, Yellow fever virus
DGSILGAAVNG

SEQ ID NO: 175044 - protein, 11 aa, Yellow fever virus
GSILGAAVNGK

SEQ ID NO: 175045 - protein, 11 aa, Yellow fever virus
SILGAAVNGKK

SEQ ID NO: 175046 - protein, 11 aa, Yellow fever virus
ILGAAVNGKKS

SEQ ID NO: 175047 - protein, 11 aa, Yellow fever virus
LGAAVNGKKSA

SEQ ID NO: 175048 - protein, 11 aa, Yellow fever virus
GAAVNGKKSAH

SEQ ID NO: 175049 - protein, 11 aa, Yellow fever virus
AAVNGKKSAHG

SEQ ID NO: 175050 - protein, 11 aa, Yellow fever virus
AVNGKKSAHGS

SEQ ID NO: 175051 - protein, 11 aa, Yellow fever virus
VNGKKSAHGSP

SEQ ID NO: 175052 - protein, 11 aa, Yellow fever virus
NGKKSAHGSPT

SEQ ID NO: 175053 - protein, 11 aa, Yellow fever virus
GKKSAHGSPTF

SEQ ID NO: 175054 - protein, 11 aa, Yellow fever virus
KKSAHGSPTFW

SEQ ID NO: 175055 - protein, 11 aa, Yellow fever virus
KSAHGSPTFWM

SEQ ID NO: 175056 - protein, 11 aa, Yellow fever virus
SAHGSPTFWMG

SEQ ID NO: 175057 - protein, 11 aa, Yellow fever virus
AHGSPTFWMGS

SEQ ID NO: 175058 - protein, 11 aa, Yellow fever virus
HGSPTFWMGSH

SEQ ID NO: 175059 - protein, 11 aa, Yellow fever virus
GSPTFWMGSHE

SEQ ID NO: 175060 - protein, 11 aa, Yellow fever virus
SPTFWMGSHEV

SEQ ID NO: 175061 - protein, 11 aa, Yellow fever virus
PTFWMGSHEVN

SEQ ID NO: 175062 - protein, 11 aa, Yellow fever virus
TFWMGSHEVNG

SEQ ID NO: 175063 - protein, 11 aa, Yellow fever virus
FWMGSHEVNGT

SEQ ID NO: 175064 - protein, 11 aa, Yellow fever virus
WMGSHEVNGTW

SEQ ID NO: 175065 - protein, 11 aa, Yellow fever virus
MGSHEVNGTWM

SEQ ID NO: 175066 - protein, 11 aa, Yellow fever virus
GSHEVNGTWMI

SEQ ID NO: 175067 - protein, 11 aa, Yellow fever virus
SHEVNGTWMIH

SEQ ID NO: 175068 - protein, 11 aa, Yellow fever virus
HEVNGTWMIHT

SEQ ID NO: 175069 - protein, 11 aa, Yellow fever virus
EVNGTWMIHTL

SEQ ID NO: 175070 - protein, 11 aa, Yellow fever virus
VNGTWMIHTLE

SEQ ID NO: 175071 - protein, 11 aa, Yellow fever virus
NGTWMIHTLEA

SEQ ID NO: 175072 - protein, 11 aa, Yellow fever virus
GTWMIHTLEAL

SEQ ID NO: 175073 - protein, 11 aa, Yellow fever virus
TWMIHTLEALD

SEQ ID NO: 175074 - protein, 11 aa, Yellow fever virus
WMIHTLEALDY

SEQ ID NO: 175075 - protein, 11 aa, Yellow fever virus
MIHTLEALDYK

SEQ ID NO: 175076 - protein, 11 aa, Yellow fever virus
IHTLEALDYKE

SEQ ID NO: 175077 - protein, 11 aa, Yellow fever virus
HTLEALDYKEC

SEQ ID NO: 175078 - protein, 11 aa, Yellow fever virus
TLEALDYKECE

SEQ ID NO: 175079 - protein, 11 aa, Yellow fever virus
LEALDYKECEW

SEQ ID NO: 175080 - protein, 11 aa, Yellow fever virus
EALDYKECEWP

SEQ ID NO: 175081 - protein, 11 aa, Yellow fever virus
ALDYKECEWPL

SEQ ID NO: 175082 - protein, 11 aa, Yellow fever virus
LDYKECEWPLT

SEQ ID NO: 175083 - protein, 11 aa, Yellow fever virus
DYKECEWPLTH

SEQ ID NO: 175084 - protein, 11 aa, Yellow fever virus
YKECEWPLTHT

SEQ ID NO: 175085 - protein, 11 aa, Yellow fever virus
KECEWPLTHTI

SEQ ID NO: 175086 - protein, 11 aa, Yellow fever virus
ECEWPLTHTIG

SEQ ID NO: 175087 - protein, 11 aa, Yellow fever virus
CEWPLTHTIGT

SEQ ID NO: 175088 - protein, 11 aa, Yellow fever virus
EWPLTHTIGTS

SEQ ID NO: 175089 - protein, 11 aa, Yellow fever virus
WPLTHTIGTSV

SEQ ID NO: 175090 - protein, 11 aa, Yellow fever virus
PLTHTIGTSVE

SEQ ID NO: 175091 - protein, 11 aa, Yellow fever virus
LTHTIGTSVEE

SEQ ID NO: 175092 - protein, 11 aa, Yellow fever virus
THTIGTSVEES

SEQ ID NO: 175093 - protein, 11 aa, Yellow fever virus
HTIGTSVEESE

SEQ ID NO: 175094 - protein, 11 aa, Yellow fever virus
TIGTSVEESEM

SEQ ID NO: 175095 - protein, 11 aa, Yellow fever virus
IGTSVEESEMF

SEQ ID NO: 175096 - protein, 11 aa, Yellow fever virus
GTSVEESEMFM

SEQ ID NO: 175097 - protein, 11 aa, Yellow fever virus
TSVEESEMFMP

SEQ ID NO: 175098 - protein, 11 aa, Yellow fever virus
SVEESEMFMPR

SEQ ID NO: 175099 - protein, 11 aa, Yellow fever virus
VEESEMFMPRS

SEQ ID NO: 175100 - protein, 11 aa, Yellow fever virus
EESEMFMPRSI

SEQ ID NO: 175101 - protein, 11 aa, Yellow fever virus
ESEMFMPRSIG

SEQ ID NO: 175102 - protein, 11 aa, Yellow fever virus
SEMFMPRSIGG

SEQ ID NO: 175103 - protein, 11 aa, Yellow fever virus
EMFMPRSIGGP

SEQ ID NO: 175104 - protein, 11 aa, Yellow fever virus
MFMPRSIGGPV

SEQ ID NO: 175105 - protein, 11 aa, Yellow fever virus
FMPRSIGGPVS

SEQ ID NO: 175106 - protein, 11 aa, Yellow fever virus
MPRSIGGPVSS

SEQ ID NO: 175107 - protein, 11 aa, Yellow fever virus
PRSIGGPVSSH

SEQ ID NO: 175108 - protein, 11 aa, Yellow fever virus
RSIGGPVSSHN

SEQ ID NO: 175109 - protein, 11 aa, Yellow fever virus
SIGGPVSSHNH

SEQ ID NO: 175110 - protein, 11 aa, Yellow fever virus
IGGPVSSHNHI

SEQ ID NO: 175111 - protein, 11 aa, Yellow fever virus
GGPVSSHNHIP

SEQ ID NO: 175112 - protein, 11 aa, Yellow fever virus
GPVSSHNHIPG

SEQ ID NO: 175113 - protein, 11 aa, Yellow fever virus
PVSSHNHIPGY

SEQ ID NO: 175114 - protein, 11 aa, Yellow fever virus
VSSHNHIPGYK

SEQ ID NO: 175115 - protein, 11 aa, Yellow fever virus
SSHNHIPGYKV

SEQ ID NO: 175116 - protein, 11 aa, Yellow fever virus
SHNHIPGYKVQ

SEQ ID NO: 175117 - protein, 11 aa, Yellow fever virus
HNHIPGYKVQT

SEQ ID NO: 175118 - protein, 11 aa, Yellow fever virus
NHIPGYKVQTN

SEQ ID NO: 175119 - protein, 11 aa, Yellow fever virus
HIPGYKVQTNG

SEQ ID NO: 175120 - protein, 11 aa, Yellow fever virus
IPGYKVQTNGP

SEQ ID NO: 175121 - protein, 11 aa, Yellow fever virus
PGYKVQTNGPW

SEQ ID NO: 175122 - protein, 11 aa, Yellow fever virus
GYKVQTNGPWM

SEQ ID NO: 175123 - protein, 11 aa, Yellow fever virus
YKVQTNGPWMQ

SEQ ID NO: 175124 - protein, 11 aa, Yellow fever virus
KVQTNGPWMQV

SEQ ID NO: 175125 - protein, 11 aa, Yellow fever virus
VQTNGPWMQVP

SEQ ID NO: 175126 - protein, 11 aa, Yellow fever virus
QTNGPWMQVPL

SEQ ID NO: 175127 - protein, 11 aa, Yellow fever virus
TNGPWMQVPLE

SEQ ID NO: 175128 - protein, 11 aa, Yellow fever virus
NGPWMQVPLEV

SEQ ID NO: 175129 - protein, 11 aa, Yellow fever virus
GPWMQVPLEVK

SEQ ID NO: 175130 - protein, 11 aa, Yellow fever virus
PWMQVPLEVKR

SEQ ID NO: 175131 - protein, 11 aa, Yellow fever virus
WMQVPLEVKRE

SEQ ID NO: 175132 - protein, 11 aa, Yellow fever virus
MQVPLEVKREA

SEQ ID NO: 175133 - protein, 11 aa, Yellow fever virus
QVPLEVKREAC

SEQ ID NO: 175134 - protein, 11 aa, Yellow fever virus
VPLEVKREACP

SEQ ID NO: 175135 - protein, 11 aa, Yellow fever virus
PLEVKREACPG

SEQ ID NO: 175136 - protein, 11 aa, Yellow fever virus
LEVKREACPGT

SEQ ID NO: 175137 - protein, 11 aa, Yellow fever virus
EVKREACPGTS

SEQ ID NO: 175138 - protein, 11 aa, Yellow fever virus
VKREACPGTSV

SEQ ID NO: 175139 - protein, 11 aa, Yellow fever virus
KREACPGTSVI

SEQ ID NO: 175140 - protein, 11 aa, Yellow fever virus
REACPGTSVII

SEQ ID NO: 175141 - protein, 11 aa, Yellow fever virus
EACPGTSVIID

SEQ ID NO: 175142 - protein, 11 aa, Yellow fever virus
ACPGTSVIIDG

SEQ ID NO: 175143 - protein, 11 aa, Yellow fever virus
CPGTSVIIDGN

SEQ ID NO: 175144 - protein, 11 aa, Yellow fever virus
PGTSVIIDGNC

SEQ ID NO: 175145 - protein, 11 aa, Yellow fever virus
GTSVIIDGNCD

SEQ ID NO: 175146 - protein, 11 aa, Yellow fever virus
TSVIIDGNCDG

SEQ ID NO: 175147 - protein, 11 aa, Yellow fever virus
SVIIDGNCDGR

SEQ ID NO: 175148 - protein, 11 aa, Yellow fever virus
VIIDGNCDGRG

SEQ ID NO: 175149 - protein, 11 aa, Yellow fever virus
IIDGNCDGRGK

SEQ ID NO: 175150 - protein, 11 aa, Yellow fever virus
IDGNCDGRGKS

SEQ ID NO: 175151 - protein, 11 aa, Yellow fever virus
DGNCDGRGKST

SEQ ID NO: 175152 - protein, 11 aa, Yellow fever virus
GNCDGRGKSTR

SEQ ID NO: 175153 - protein, 11 aa, Yellow fever virus
NCDGRGKSTRS

SEQ ID NO: 175154 - protein, 11 aa, Yellow fever virus
CDGRGKSTRST

SEQ ID NO: 175155 - protein, 11 aa, Yellow fever virus
DGRGKSTRSTT

SEQ ID NO: 175156 - protein, 11 aa, Yellow fever virus
GRGKSTRSTTD

SEQ ID NO: 175157 - protein, 11 aa, Yellow fever virus
RGKSTRSTTDS

SEQ ID NO: 175158 - protein, 11 aa, Yellow fever virus
GKSTRSTTDSG

SEQ ID NO: 175159 - protein, 11 aa, Yellow fever virus
KSTRSTTDSGK

SEQ ID NO: 175160 - protein, 11 aa, Yellow fever virus
STRSTTDSGKV

SEQ ID NO: 175161 - protein, 11 aa, Yellow fever virus
TRSTTDSGKVI

SEQ ID NO: 175162 - protein, 11 aa, Yellow fever virus
RSTTDSGKVIP

SEQ ID NO: 175163 - protein, 11 aa, Yellow fever virus
STTDSGKVIPE

SEQ ID NO: 175164 - protein, 11 aa, Yellow fever virus
TTDSGKVIPEW

SEQ ID NO: 175165 - protein, 11 aa, Yellow fever virus
TDSGKVIPEWC

SEQ ID NO: 175166 - protein, 11 aa, Yellow fever virus
DSGKVIPEWCC

SEQ ID NO: 175167 - protein, 11 aa, Yellow fever virus
SGKVIPEWCCR

SEQ ID NO: 175168 - protein, 11 aa, Yellow fever virus
GKVIPEWCCRS

SEQ ID NO: 175169 - protein, 11 aa, Yellow fever virus
KVIPEWCCRSC

SEQ ID NO: 175170 - protein, 11 aa, Yellow fever virus
VIPEWCCRSCT

SEQ ID NO: 175171 - protein, 11 aa, Yellow fever virus
IPEWCCRSCTM

SEQ ID NO: 175172 - protein, 11 aa, Yellow fever virus
PEWCCRSCTMP

SEQ ID NO: 175173 - protein, 11 aa, Yellow fever virus
EWCCRSCTMPP

SEQ ID NO: 175174 - protein, 11 aa, Yellow fever virus
WCCRSCTMPPV

SEQ ID NO: 175175 - protein, 11 aa, Yellow fever virus
CCRSCTMPPVS

SEQ ID NO: 175176 - protein, 11 aa, Yellow fever virus
CRSCTMPPVSF

SEQ ID NO: 175177 - protein, 11 aa, Yellow fever virus
RSCTMPPVSFH

SEQ ID NO: 175178 - protein, 11 aa, Yellow fever virus
SCTMPPVSFHG

SEQ ID NO: 175179 - protein, 11 aa, Yellow fever virus
CTMPPVSFHGS

SEQ ID NO: 175180 - protein, 11 aa, Yellow fever virus
TMPPVSFHGSD

SEQ ID NO: 175181 - protein, 11 aa, Yellow fever virus
MPPVSFHGSDG

SEQ ID NO: 175182 - protein, 11 aa, Yellow fever virus
PPVSFHGSDGC

SEQ ID NO: 175183 - protein, 11 aa, Yellow fever virus
PVSFHGSDGCW

SEQ ID NO: 175184 - protein, 11 aa, Yellow fever virus
VSFHGSDGCWY

SEQ ID NO: 175185 - protein, 11 aa, Yellow fever virus
SFHGSDGCWYP

SEQ ID NO: 175186 - protein, 11 aa, Yellow fever virus
FHGSDGCWYPM

SEQ ID NO: 175187 - protein, 11 aa, Yellow fever virus
HGSDGCWYPME

SEQ ID NO: 175188 - protein, 11 aa, Yellow fever virus
GSDGCWYPMEI

SEQ ID NO: 175189 - protein, 11 aa, Yellow fever virus
SDGCWYPMEIR

SEQ ID NO: 175190 - protein, 11 aa, Yellow fever virus
DGCWYPMEIRP

SEQ ID NO: 175191 - protein, 11 aa, Yellow fever virus
GCWYPMEIRPR

SEQ ID NO: 175192 - protein, 11 aa, Yellow fever virus
CWYPMEIRPRK

SEQ ID NO: 175193 - protein, 11 aa, Yellow fever virus
WYPMEIRPRKT

SEQ ID NO: 175194 - protein, 11 aa, Yellow fever virus
YPMEIRPRKTH

SEQ ID NO: 175195 - protein, 11 aa, Yellow fever virus
PMEIRPRKTHE

SEQ ID NO: 175196 - protein, 11 aa, Yellow fever virus
MEIRPRKTHES

SEQ ID NO: 175197 - protein, 11 aa, Yellow fever virus
EIRPRKTHESH

SEQ ID NO: 175198 - protein, 11 aa, Yellow fever virus
IRPRKTHESHL

SEQ ID NO: 175199 - protein, 11 aa, Yellow fever virus
RPRKTHESHLV

SEQ ID NO: 175200 - protein, 11 aa, Yellow fever virus
PRKTHESHLVR

SEQ ID NO: 175201 - protein, 11 aa, Yellow fever virus
RKTHESHLVRS

SEQ ID NO: 175202 - protein, 11 aa, Yellow fever virus
KTHESHLVRSW

SEQ ID NO: 175203 - protein, 11 aa, Yellow fever virus
THESHLVRSWV

SEQ ID NO: 175204 - protein, 11 aa, Yellow fever virus
HESHLVRSWVT

SEQ ID NO: 175205 - protein, 11 aa, Yellow fever virus
ESHLVRSWVTA

SEQ ID NO: 175206 - protein, 11 aa, Yellow fever virus
SHLVRSWVTAG

SEQ ID NO: 175207 - protein, 11 aa, Yellow fever virus
HLVRSWVTAGE

SEQ ID NO: 175208 - protein, 11 aa, Yellow fever virus
LVRSWVTAGEI

SEQ ID NO: 175209 - protein, 11 aa, Yellow fever virus
VRSWVTAGEIH

SEQ ID NO: 175210 - protein, 11 aa, Yellow fever virus
RSWVTAGEIHA

SEQ ID NO: 175211 - protein, 11 aa, Yellow fever virus
SWVTAGEIHAV

SEQ ID NO: 175212 - protein, 11 aa, Yellow fever virus
WVTAGEIHAVP

SEQ ID NO: 175213 - protein, 11 aa, Yellow fever virus
VTAGEIHAVPF

SEQ ID NO: 175214 - protein, 11 aa, Yellow fever virus
TAGEIHAVPFG

SEQ ID NO: 175215 - protein, 11 aa, Yellow fever virus
AGEIHAVPFGL

SEQ ID NO: 175216 - protein, 11 aa, Yellow fever virus
GEIHAVPFGLV

SEQ ID NO: 175217 - protein, 11 aa, Yellow fever virus
EIHAVPFGLVS

SEQ ID NO: 175218 - protein, 11 aa, Yellow fever virus
IHAVPFGLVSM

SEQ ID NO: 175219 - protein, 11 aa, Yellow fever virus
HAVPFGLVSMM

SEQ ID NO: 175220 - protein, 11 aa, Yellow fever virus
AVPFGLVSMMI

SEQ ID NO: 175221 - protein, 11 aa, Yellow fever virus
VPFGLVSMMIA

SEQ ID NO: 175222 - protein, 11 aa, Yellow fever virus
PFGLVSMMIAM

SEQ ID NO: 175223 - protein, 11 aa, Yellow fever virus
FGLVSMMIAME

SEQ ID NO: 175224 - protein, 11 aa, Yellow fever virus
GLVSMMIAMEV

SEQ ID NO: 175225 - protein, 11 aa, Yellow fever virus
LVSMMIAMEVV

SEQ ID NO: 175226 - protein, 11 aa, Yellow fever virus
VSMMIAMEVVL

SEQ ID NO: 175227 - protein, 11 aa, Yellow fever virus
SMMIAMEVVLR

SEQ ID NO: 175228 - protein, 11 aa, Yellow fever virus
MMIAMEVVLRK

SEQ ID NO: 175229 - protein, 11 aa, Yellow fever virus
MIAMEVVLRKR

SEQ ID NO: 175230 - protein, 11 aa, Yellow fever virus
IAMEVVLRKRQ

SEQ ID NO: 175231 - protein, 11 aa, Yellow fever virus
AMEVVLRKRQG

SEQ ID NO: 175232 - protein, 11 aa, Yellow fever virus
MEVVLRKRQGP

SEQ ID NO: 175233 - protein, 11 aa, Yellow fever virus
EVVLRKRQGPK

SEQ ID NO: 175234 - protein, 11 aa, Yellow fever virus
VVLRKRQGPKQ

SEQ ID NO: 175235 - protein, 11 aa, Yellow fever virus
VLRKRQGPKQM

SEQ ID NO: 175236 - protein, 11 aa, Yellow fever virus
LRKRQGPKQML

SEQ ID NO: 175237 - protein, 11 aa, Yellow fever virus
RKRQGPKQMLV

SEQ ID NO: 175238 - protein, 11 aa, Yellow fever virus
KRQGPKQMLVG

SEQ ID NO: 175239 - protein, 11 aa, Yellow fever virus
RQGPKQMLVGG

SEQ ID NO: 175240 - protein, 11 aa, Yellow fever virus
QGPKQMLVGGV

SEQ ID NO: 175241 - protein, 11 aa, Yellow fever virus
GPKQMLVGGVV

SEQ ID NO: 175242 - protein, 11 aa, Yellow fever virus
PKQMLVGGVVL

SEQ ID NO: 175243 - protein, 11 aa, Yellow fever virus
KQMLVGGVVLL

SEQ ID NO: 175244 - protein, 11 aa, Yellow fever virus
QMLVGGVVLLG

SEQ ID NO: 175245 - protein, 11 aa, Yellow fever virus
MLVGGVVLLGA

SEQ ID NO: 175246 - protein, 11 aa, Yellow fever virus
LVGGVVLLGAM

SEQ ID NO: 175247 - protein, 11 aa, Yellow fever virus
VGGVVLLGAML

SEQ ID NO: 175248 - protein, 11 aa, Yellow fever virus
GGVVLLGAMLV

SEQ ID NO: 175249 - protein, 11 aa, Yellow fever virus
GVVLLGAMLVG

SEQ ID NO: 175250 - protein, 11 aa, Yellow fever virus
VVLLGAMLVGQ

SEQ ID NO: 175251 - protein, 11 aa, Yellow fever virus
VLLGAMLVGQV

SEQ ID NO: 175252 - protein, 11 aa, Yellow fever virus
LLGAMLVGQVT

SEQ ID NO: 175253 - protein, 11 aa, Yellow fever virus
LGAMLVGQVTL

SEQ ID NO: 175254 - protein, 11 aa, Yellow fever virus
GAMLVGQVTLL

SEQ ID NO: 175255 - protein, 11 aa, Yellow fever virus
AMLVGQVTLLD

SEQ ID NO: 175256 - protein, 11 aa, Yellow fever virus
MLVGQVTLLDL

SEQ ID NO: 175257 - protein, 11 aa, Yellow fever virus
LVGQVTLLDLL

SEQ ID NO: 175258 - protein, 11 aa, Yellow fever virus
VGQVTLLDLLK

SEQ ID NO: 175259 - protein, 11 aa, Yellow fever virus
LTVAVGLHFHE

SEQ ID NO: 175260 - protein, 11 aa, Yellow fever virus
TVAVGLHFHEM

SEQ ID NO: 175261 - protein, 11 aa, Yellow fever virus
VAVGLHFHEMN

SEQ ID NO: 175262 - protein, 11 aa, Yellow fever virus
AVGLHFHEMNN

SEQ ID NO: 175263 - protein, 11 aa, Yellow fever virus
VGLHFHEMNNG

SEQ ID NO: 175264 - protein, 11 aa, Yellow fever virus
GLHFHEMNNGG

SEQ ID NO: 175265 - protein, 11 aa, Yellow fever virus
LHFHEMNNGGD

SEQ ID NO: 175266 - protein, 11 aa, Yellow fever virus
HFHEMNNGGDA

SEQ ID NO: 175267 - protein, 11 aa, Yellow fever virus
FHEMNNGGDAM

SEQ ID NO: 175268 - protein, 11 aa, Yellow fever virus
HEMNNGGDAMY

SEQ ID NO: 175269 - protein, 11 aa, Yellow fever virus
EMNNGGDAMYM

SEQ ID NO: 175270 - protein, 11 aa, Yellow fever virus
MNNGGDAMYMA

SEQ ID NO: 175271 - protein, 11 aa, Yellow fever virus
NNGGDAMYMAL

SEQ ID NO: 175272 - protein, 11 aa, Yellow fever virus
NGGDAMYMALI

SEQ ID NO: 175273 - protein, 11 aa, Yellow fever virus
GGDAMYMALIA

SEQ ID NO: 175274 - protein, 11 aa, Yellow fever virus
GDAMYMALIAA

SEQ ID NO: 175275 - protein, 11 aa, Yellow fever virus
DAMYMALIAAF

SEQ ID NO: 175276 - protein, 11 aa, Yellow fever virus
AMYMALIAAFS

SEQ ID NO: 175277 - protein, 11 aa, Yellow fever virus
MYMALIAAFSI

SEQ ID NO: 175278 - protein, 11 aa, Yellow fever virus
YMALIAAFSIR

SEQ ID NO: 175279 - protein, 11 aa, Yellow fever virus
MALIAAFSIRP

SEQ ID NO: 175280 - protein, 11 aa, Yellow fever virus
ALIAAFSIRPG

SEQ ID NO: 175281 - protein, 11 aa, Yellow fever virus
LIAAFSIRPGL

SEQ ID NO: 175282 - protein, 11 aa, Yellow fever virus
IAAFSIRPGLL

SEQ ID NO: 175283 - protein, 11 aa, Yellow fever virus
AAFSIRPGLLI

SEQ ID NO: 175284 - protein, 11 aa, Yellow fever virus
AFSIRPGLLIG

SEQ ID NO: 175285 - protein, 11 aa, Yellow fever virus
FSIRPGLLIGF

SEQ ID NO: 175286 - protein, 11 aa, Yellow fever virus
SIRPGLLIGFG

SEQ ID NO: 175287 - protein, 11 aa, Yellow fever virus
IRPGLLIGFGL

SEQ ID NO: 175288 - protein, 11 aa, Yellow fever virus
RPGLLIGFGLR

SEQ ID NO: 175289 - protein, 11 aa, Yellow fever virus
PGLLIGFGLRT

SEQ ID NO: 175290 - protein, 11 aa, Yellow fever virus
GLLIGFGLRTL

SEQ ID NO: 175291 - protein, 11 aa, Yellow fever virus
LLIGFGLRTLW

SEQ ID NO: 175292 - protein, 11 aa, Yellow fever virus
LIGFGLRTLWS

SEQ ID NO: 175293 - protein, 11 aa, Yellow fever virus
IGFGLRTLWSP

SEQ ID NO: 175294 - protein, 11 aa, Yellow fever virus
GFGLRTLWSPR

SEQ ID NO: 175295 - protein, 11 aa, Yellow fever virus
FGLRTLWSPRE

SEQ ID NO: 175296 - protein, 11 aa, Yellow fever virus
GLRTLWSPRER

SEQ ID NO: 175297 - protein, 11 aa, Yellow fever virus
LRTLWSPRERL

SEQ ID NO: 175298 - protein, 11 aa, Yellow fever virus
RTLWSPRERLV

SEQ ID NO: 175299 - protein, 11 aa, Yellow fever virus
TLWSPRERLVL

SEQ ID NO: 175300 - protein, 11 aa, Yellow fever virus
LWSPRERLVLT

SEQ ID NO: 175301 - protein, 11 aa, Yellow fever virus
WSPRERLVLTL

SEQ ID NO: 175302 - protein, 11 aa, Yellow fever virus
SPRERLVLTLG

SEQ ID NO: 175303 - protein, 11 aa, Yellow fever virus
PRERLVLTLGA

SEQ ID NO: 175304 - protein, 11 aa, Yellow fever virus
RERLVLTLGAA

SEQ ID NO: 175305 - protein, 11 aa, Yellow fever virus
ERLVLTLGAAM

SEQ ID NO: 175306 - protein, 11 aa, Yellow fever virus
RLVLTLGAAMV

SEQ ID NO: 175307 - protein, 11 aa, Yellow fever virus
LVLTLGAAMVE

SEQ ID NO: 175308 - protein, 11 aa, Yellow fever virus
VLTLGAAMVEI

SEQ ID NO: 175309 - protein, 11 aa, Yellow fever virus
LTLGAAMVEIA

SEQ ID NO: 175310 - protein, 11 aa, Yellow fever virus
TLGAAMVEIAL

SEQ ID NO: 175311 - protein, 11 aa, Yellow fever virus
LGAAMVEIALG

SEQ ID NO: 175312 - protein, 11 aa, Yellow fever virus
GAAMVEIALGG

SEQ ID NO: 175313 - protein, 11 aa, Yellow fever virus
AAMVEIALGGV

SEQ ID NO: 175314 - protein, 11 aa, Yellow fever virus
AMVEIALGGVM

SEQ ID NO: 175315 - protein, 11 aa, Yellow fever virus
MVEIALGGVMG

SEQ ID NO: 175316 - protein, 11 aa, Yellow fever virus
VEIALGGVMGG

SEQ ID NO: 175317 - protein, 11 aa, Yellow fever virus
EIALGGVMGGL

SEQ ID NO: 175318 - protein, 11 aa, Yellow fever virus
IALGGVMGGLW

SEQ ID NO: 175319 - protein, 11 aa, Yellow fever virus
ALGGVMGGLWK

SEQ ID NO: 175320 - protein, 11 aa, Yellow fever virus
LGGVMGGLWKY

SEQ ID NO: 175321 - protein, 11 aa, Yellow fever virus
GGVMGGLWKYL

SEQ ID NO: 175322 - protein, 11 aa, Yellow fever virus
GVMGGLWKYLN

SEQ ID NO: 175323 - protein, 11 aa, Yellow fever virus
VMGGLWKYLNA

SEQ ID NO: 175324 - protein, 11 aa, Yellow fever virus
MGGLWKYLNAV

SEQ ID NO: 175325 - protein, 11 aa, Yellow fever virus
GGLWKYLNAVS

SEQ ID NO: 175326 - protein, 11 aa, Yellow fever virus
GLWKYLNAVSL

SEQ ID NO: 175327 - protein, 11 aa, Yellow fever virus
LWKYLNAVSLC

SEQ ID NO: 175328 - protein, 11 aa, Yellow fever virus
WKYLNAVSLCI

SEQ ID NO: 175329 - protein, 11 aa, Yellow fever virus
KYLNAVSLCIL

SEQ ID NO: 175330 - protein, 11 aa, Yellow fever virus
YLNAVSLCILT

SEQ ID NO: 175331 - protein, 11 aa, Yellow fever virus
LNAVSLCILTI

SEQ ID NO: 175332 - protein, 11 aa, Yellow fever virus
NAVSLCILTIN

SEQ ID NO: 175333 - protein, 11 aa, Yellow fever virus
AVSLCILTINA

SEQ ID NO: 175334 - protein, 11 aa, Yellow fever virus
VSLCILTINAV

SEQ ID NO: 175335 - protein, 11 aa, Yellow fever virus
SLCILTINAVA

SEQ ID NO: 175336 - protein, 11 aa, Yellow fever virus
LCILTINAVAS

SEQ ID NO: 175337 - protein, 11 aa, Yellow fever virus
CILTINAVASR

SEQ ID NO: 175338 - protein, 11 aa, Yellow fever virus
ILTINAVASRK

SEQ ID NO: 175339 - protein, 11 aa, Yellow fever virus
LTINAVASRKA

SEQ ID NO: 175340 - protein, 11 aa, Yellow fever virus
TINAVASRKAS

SEQ ID NO: 175341 - protein, 11 aa, Yellow fever virus
INAVASRKASN

SEQ ID NO: 175342 - protein, 11 aa, Yellow fever virus
NAVASRKASNT

SEQ ID NO: 175343 - protein, 11 aa, Yellow fever virus
AVASRKASNTI

SEQ ID NO: 175344 - protein, 11 aa, Yellow fever virus
VASRKASNTIL

SEQ ID NO: 175345 - protein, 11 aa, Yellow fever virus
ASRKASNTILP

SEQ ID NO: 175346 - protein, 11 aa, Yellow fever virus
SRKASNTILPL

SEQ ID NO: 175347 - protein, 11 aa, Yellow fever virus
RKASNTILPLM

SEQ ID NO: 175348 - protein, 11 aa, Yellow fever virus
KASNTILPLMA

SEQ ID NO: 175349 - protein, 11 aa, Yellow fever virus
ASNTILPLMAL

SEQ ID NO: 175350 - protein, 11 aa, Yellow fever virus
SNTILPLMALL

SEQ ID NO: 175351 - protein, 11 aa, Yellow fever virus
NTILPLMALLT

SEQ ID NO: 175352 - protein, 11 aa, Yellow fever virus
TILPLMALLTP

SEQ ID NO: 175353 - protein, 11 aa, Yellow fever virus
ILPLMALLTPV

SEQ ID NO: 175354 - protein, 11 aa, Yellow fever virus
LPLMALLTPVT

SEQ ID NO: 175355 - protein, 11 aa, Yellow fever virus
PLMALLTPVTM

SEQ ID NO: 175356 - protein, 11 aa, Yellow fever virus
LMALLTPVTMA

SEQ ID NO: 175357 - protein, 11 aa, Yellow fever virus
MALLTPVTMAE

SEQ ID NO: 175358 - protein, 11 aa, Yellow fever virus
ALLTPVTMAEV

SEQ ID NO: 175359 - protein, 11 aa, Yellow fever virus
LLTPVTMAEVR

SEQ ID NO: 175360 - protein, 11 aa, Yellow fever virus
LTPVTMAEVRL

SEQ ID NO: 175361 - protein, 11 aa, Yellow fever virus
TPVTMAEVRLA

SEQ ID NO: 175362 - protein, 11 aa, Yellow fever virus
PVTMAEVRLAA

SEQ ID NO: 175363 - protein, 11 aa, Yellow fever virus
VTMAEVRLAAM

SEQ ID NO: 175364 - protein, 11 aa, Yellow fever virus
TMAEVRLAAMF

SEQ ID NO: 175365 - protein, 11 aa, Yellow fever virus
MFFCAVVIIGV

SEQ ID NO: 175366 - protein, 11 aa, Yellow fever virus
FFCAVVIIGVL

SEQ ID NO: 175367 - protein, 11 aa, Yellow fever virus
FCAVVIIGVLH

SEQ ID NO: 175368 - protein, 11 aa, Yellow fever virus
CAVVIIGVLHQ

SEQ ID NO: 175369 - protein, 11 aa, Yellow fever virus
AVVIIGVLHQN

SEQ ID NO: 175370 - protein, 11 aa, Yellow fever virus
VVIIGVLHQNF

SEQ ID NO: 175371 - protein, 11 aa, Yellow fever virus
VIIGVLHQNFK

SEQ ID NO: 175372 - protein, 11 aa, Yellow fever virus
IIGVLHQNFKD

SEQ ID NO: 175373 - protein, 11 aa, Yellow fever virus
IGVLHQNFKDT

SEQ ID NO: 175374 - protein, 11 aa, Yellow fever virus
GVLHQNFKDTS

SEQ ID NO: 175375 - protein, 11 aa, Yellow fever virus
VLHQNFKDTSM

SEQ ID NO: 175376 - protein, 11 aa, Yellow fever virus
LHQNFKDTSMQ

SEQ ID NO: 175377 - protein, 11 aa, Yellow fever virus
HQNFKDTSMQK

SEQ ID NO: 175378 - protein, 11 aa, Yellow fever virus
QNFKDTSMQKT

SEQ ID NO: 175379 - protein, 11 aa, Yellow fever virus
NFKDTSMQKTI

SEQ ID NO: 175380 - protein, 11 aa, Yellow fever virus
FKDTSMQKTIP

SEQ ID NO: 175381 - protein, 11 aa, Yellow fever virus
KDTSMQKTIPL

SEQ ID NO: 175382 - protein, 11 aa, Yellow fever virus
DTSMQKTIPLV

SEQ ID NO: 175383 - protein, 11 aa, Yellow fever virus
TSMQKTIPLVA

SEQ ID NO: 175384 - protein, 11 aa, Yellow fever virus
SMQKTIPLVAL

SEQ ID NO: 175385 - protein, 11 aa, Yellow fever virus
MQKTIPLVALT

SEQ ID NO: 175386 - protein, 11 aa, Yellow fever virus
QKTIPLVALTL

SEQ ID NO: 175387 - protein, 11 aa, Yellow fever virus
KTIPLVALTLT

SEQ ID NO: 175388 - protein, 11 aa, Yellow fever virus
TIPLVALTLTS

SEQ ID NO: 175389 - protein, 11 aa, Yellow fever virus
IPLVALTLTSY

SEQ ID NO: 175390 - protein, 11 aa, Yellow fever virus
PLVALTLTSYL

SEQ ID NO: 175391 - protein, 11 aa, Yellow fever virus
LVALTLTSYLG

SEQ ID NO: 175392 - protein, 11 aa, Yellow fever virus
VALTLTSYLGL

SEQ ID NO: 175393 - protein, 11 aa, Yellow fever virus
ALTLTSYLGLT

SEQ ID NO: 175394 - protein, 11 aa, Yellow fever virus
LTLTSYLGLTQ

SEQ ID NO: 175395 - protein, 11 aa, Yellow fever virus
TLTSYLGLTQP

SEQ ID NO: 175396 - protein, 11 aa, Yellow fever virus
LTSYLGLTQPF

SEQ ID NO: 175397 - protein, 11 aa, Yellow fever virus
TSYLGLTQPFL

SEQ ID NO: 175398 - protein, 11 aa, Yellow fever virus
SYLGLTQPFLG

SEQ ID NO: 175399 - protein, 11 aa, Yellow fever virus
YLGLTQPFLGL

SEQ ID NO: 175400 - protein, 11 aa, Yellow fever virus
LGLTQPFLGLC

SEQ ID NO: 175401 - protein, 11 aa, Yellow fever virus
GLTQPFLGLCA

SEQ ID NO: 175402 - protein, 11 aa, Yellow fever virus
LTQPFLGLCAF

SEQ ID NO: 175403 - protein, 11 aa, Yellow fever virus
TQPFLGLCAFL

SEQ ID NO: 175404 - protein, 11 aa, Yellow fever virus
QPFLGLCAFLA

SEQ ID NO: 175405 - protein, 11 aa, Yellow fever virus
PFLGLCAFLAT

SEQ ID NO: 175406 - protein, 11 aa, Yellow fever virus
FLGLCAFLATR

SEQ ID NO: 175407 - protein, 11 aa, Yellow fever virus
LGLCAFLATRI

SEQ ID NO: 175408 - protein, 11 aa, Yellow fever virus
GLCAFLATRIF

SEQ ID NO: 175409 - protein, 11 aa, Yellow fever virus
LCAFLATRIFG

SEQ ID NO: 175410 - protein, 11 aa, Yellow fever virus
CAFLATRIFGR

SEQ ID NO: 175411 - protein, 11 aa, Yellow fever virus
AFLATRIFGRR

SEQ ID NO: 175412 - protein, 11 aa, Yellow fever virus
FLATRIFGRRS

SEQ ID NO: 175413 - protein, 11 aa, Yellow fever virus
LATRIFGRRSI

SEQ ID NO: 175414 - protein, 11 aa, Yellow fever virus
ATRIFGRRSIP

SEQ ID NO: 175415 - protein, 11 aa, Yellow fever virus
TRIFGRRSIPV

SEQ ID NO: 175416 - protein, 11 aa, Yellow fever virus
RIFGRRSIPVN

SEQ ID NO: 175417 - protein, 11 aa, Yellow fever virus
IFGRRSIPVNE

SEQ ID NO: 175418 - protein, 11 aa, Yellow fever virus
FGRRSIPVNEA

SEQ ID NO: 175419 - protein, 11 aa, Yellow fever virus
GRRSIPVNEAL

SEQ ID NO: 175420 - protein, 11 aa, Yellow fever virus
RRSIPVNEALA

SEQ ID NO: 175421 - protein, 11 aa, Yellow fever virus
RSIPVNEALAA

SEQ ID NO: 175422 - protein, 11 aa, Yellow fever virus
SIPVNEALAAA

SEQ ID NO: 175423 - protein, 11 aa, Yellow fever virus
IPVNEALAAAG

SEQ ID NO: 175424 - protein, 11 aa, Yellow fever virus
PVNEALAAAGL

SEQ ID NO: 175425 - protein, 11 aa, Yellow fever virus
VNEALAAAGLV

SEQ ID NO: 175426 - protein, 11 aa, Yellow fever virus
NEALAAAGLVG

SEQ ID NO: 175427 - protein, 11 aa, Yellow fever virus
EALAAAGLVGV

SEQ ID NO: 175428 - protein, 11 aa, Yellow fever virus
ALAAAGLVGVL

SEQ ID NO: 175429 - protein, 11 aa, Yellow fever virus
LAAAGLVGVLA

SEQ ID NO: 175430 - protein, 11 aa, Yellow fever virus
AAAGLVGVLAG

SEQ ID NO: 175431 - protein, 11 aa, Yellow fever virus
AAGLVGVLAGL

SEQ ID NO: 175432 - protein, 11 aa, Yellow fever virus
AGLVGVLAGLA

SEQ ID NO: 175433 - protein, 11 aa, Yellow fever virus
GLVGVLAGLAF

SEQ ID NO: 175434 - protein, 11 aa, Yellow fever virus
LVGVLAGLAFQ

SEQ ID NO: 175435 - protein, 11 aa, Yellow fever virus
VGVLAGLAFQE

SEQ ID NO: 175436 - protein, 11 aa, Yellow fever virus
GVLAGLAFQEM

SEQ ID NO: 175437 - protein, 11 aa, Yellow fever virus
VLAGLAFQEME

SEQ ID NO: 175438 - protein, 11 aa, Yellow fever virus
LAGLAFQEMEN

SEQ ID NO: 175439 - protein, 11 aa, Yellow fever virus
AGLAFQEMENF

SEQ ID NO: 175440 - protein, 11 aa, Yellow fever virus
GLAFQEMENFL

SEQ ID NO: 175441 - protein, 11 aa, Yellow fever virus
LAFQEMENFLG

SEQ ID NO: 175442 - protein, 11 aa, Yellow fever virus
AFQEMENFLGP

SEQ ID NO: 175443 - protein, 11 aa, Yellow fever virus
FQEMENFLGPI

SEQ ID NO: 175444 - protein, 11 aa, Yellow fever virus
QEMENFLGPIA

SEQ ID NO: 175445 - protein, 11 aa, Yellow fever virus
EMENFLGPIAV

SEQ ID NO: 175446 - protein, 11 aa, Yellow fever virus
MENFLGPIAVG

SEQ ID NO: 175447 - protein, 11 aa, Yellow fever virus
ENFLGPIAVGG

SEQ ID NO: 175448 - protein, 11 aa, Yellow fever virus
NFLGPIAVGGL

SEQ ID NO: 175449 - protein, 11 aa, Yellow fever virus
FLGPIAVGGLL

SEQ ID NO: 175450 - protein, 11 aa, Yellow fever virus
LGPIAVGGLLM

SEQ ID NO: 175451 - protein, 11 aa, Yellow fever virus
GPIAVGGLLMM

SEQ ID NO: 175452 - protein, 11 aa, Yellow fever virus
PIAVGGLLMML

SEQ ID NO: 175453 - protein, 11 aa, Yellow fever virus
IAVGGLLMMLV

SEQ ID NO: 175454 - protein, 11 aa, Yellow fever virus
AVGGLLMMLVS

SEQ ID NO: 175455 - protein, 11 aa, Yellow fever virus
VGGLLMMLVSV

SEQ ID NO: 175456 - protein, 11 aa, Yellow fever virus
GGLLMMLVSVA

SEQ ID NO: 175457 - protein, 11 aa, Yellow fever virus
GLLMMLVSVAG

SEQ ID NO: 175458 - protein, 11 aa, Yellow fever virus
LLMMLVSVAGR

SEQ ID NO: 175459 - protein, 11 aa, Yellow fever virus
LMMLVSVAGRV

SEQ ID NO: 175460 - protein, 11 aa, Yellow fever virus
MMLVSVAGRVD

SEQ ID NO: 175461 - protein, 11 aa, Yellow fever virus
MLVSVAGRVDG

SEQ ID NO: 175462 - protein, 11 aa, Yellow fever virus
LVSVAGRVDGL

SEQ ID NO: 175463 - protein, 11 aa, Yellow fever virus
VSVAGRVDGLE

SEQ ID NO: 175464 - protein, 11 aa, Yellow fever virus
SVAGRVDGLEL

SEQ ID NO: 175465 - protein, 11 aa, Yellow fever virus
VAGRVDGLELK

SEQ ID NO: 175466 - protein, 11 aa, Yellow fever virus
AGRVDGLELKK

SEQ ID NO: 175467 - protein, 11 aa, Yellow fever virus
GRVDGLELKKL

SEQ ID NO: 175468 - protein, 11 aa, Yellow fever virus
RVDGLELKKLG

SEQ ID NO: 175469 - protein, 11 aa, Yellow fever virus
VDGLELKKLGE

SEQ ID NO: 175470 - protein, 11 aa, Yellow fever virus
DGLELKKLGEV

SEQ ID NO: 175471 - protein, 11 aa, Yellow fever virus
GLELKKLGEVS

SEQ ID NO: 175472 - protein, 11 aa, Yellow fever virus
LELKKLGEVSW

SEQ ID NO: 175473 - protein, 11 aa, Yellow fever virus
ELKKLGEVSWE

SEQ ID NO: 175474 - protein, 11 aa, Yellow fever virus
LKKLGEVSWEE

SEQ ID NO: 175475 - protein, 11 aa, Yellow fever virus
KKLGEVSWEEE

SEQ ID NO: 175476 - protein, 11 aa, Yellow fever virus
KLGEVSWEEEA

SEQ ID NO: 175477 - protein, 11 aa, Yellow fever virus
LGEVSWEEEAE

SEQ ID NO: 175478 - protein, 11 aa, Yellow fever virus
GEVSWEEEAEI

SEQ ID NO: 175479 - protein, 11 aa, Yellow fever virus
EVSWEEEAEIS

SEQ ID NO: 175480 - protein, 11 aa, Yellow fever virus
VSWEEEAEISG

SEQ ID NO: 175481 - protein, 11 aa, Yellow fever virus
SWEEEAEISGS

SEQ ID NO: 175482 - protein, 11 aa, Yellow fever virus
WEEEAEISGSS

SEQ ID NO: 175483 - protein, 11 aa, Yellow fever virus
EEEAEISGSSA

SEQ ID NO: 175484 - protein, 11 aa, Yellow fever virus
EEAEISGSSAR

SEQ ID NO: 175485 - protein, 11 aa, Yellow fever virus
EAEISGSSARY

SEQ ID NO: 175486 - protein, 11 aa, Yellow fever virus
AEISGSSARYD

SEQ ID NO: 175487 - protein, 11 aa, Yellow fever virus
EISGSSARYDV

SEQ ID NO: 175488 - protein, 11 aa, Yellow fever virus
ISGSSARYDVA

SEQ ID NO: 175489 - protein, 11 aa, Yellow fever virus
SGSSARYDVAL

SEQ ID NO: 175490 - protein, 11 aa, Yellow fever virus
GSSARYDVALS

SEQ ID NO: 175491 - protein, 11 aa, Yellow fever virus
SSARYDVALSE

SEQ ID NO: 175492 - protein, 11 aa, Yellow fever virus
SARYDVALSEQ

SEQ ID NO: 175493 - protein, 11 aa, Yellow fever virus
ARYDVALSEQG

SEQ ID NO: 175494 - protein, 11 aa, Yellow fever virus
RYDVALSEQGE

SEQ ID NO: 175495 - protein, 11 aa, Yellow fever virus
YDVALSEQGEF

SEQ ID NO: 175496 - protein, 11 aa, Yellow fever virus
DVALSEQGEFK

SEQ ID NO: 175497 - protein, 11 aa, Yellow fever virus
VALSEQGEFKL

SEQ ID NO: 175498 - protein, 11 aa, Yellow fever virus
ALSEQGEFKLL

SEQ ID NO: 175499 - protein, 11 aa, Yellow fever virus
LSEQGEFKLLS

SEQ ID NO: 175500 - protein, 11 aa, Yellow fever virus
SEQGEFKLLSE

SEQ ID NO: 175501 - protein, 11 aa, Yellow fever virus
EQGEFKLLSEE

SEQ ID NO: 175502 - protein, 11 aa, Yellow fever virus
QGEFKLLSEEK

SEQ ID NO: 175503 - protein, 11 aa, Yellow fever virus
GEFKLLSEEKV

SEQ ID NO: 175504 - protein, 11 aa, Yellow fever virus
EFKLLSEEKVP

SEQ ID NO: 175505 - protein, 11 aa, Yellow fever virus
FKLLSEEKVPW

SEQ ID NO: 175506 - protein, 11 aa, Yellow fever virus
KLLSEEKVPWD

SEQ ID NO: 175507 - protein, 11 aa, Yellow fever virus
LLSEEKVPWDQ

SEQ ID NO: 175508 - protein, 11 aa, Yellow fever virus
LSEEKVPWDQV

SEQ ID NO: 175509 - protein, 11 aa, Yellow fever virus
SEEKVPWDQVV

SEQ ID NO: 175510 - protein, 11 aa, Yellow fever virus
EEKVPWDQVVM

SEQ ID NO: 175511 - protein, 11 aa, Yellow fever virus
EKVPWDQVVMT

SEQ ID NO: 175512 - protein, 11 aa, Yellow fever virus
KVPWDQVVMTS

SEQ ID NO: 175513 - protein, 11 aa, Yellow fever virus
VPWDQVVMTSL

SEQ ID NO: 175514 - protein, 11 aa, Yellow fever virus
PWDQVVMTSLA

SEQ ID NO: 175515 - protein, 11 aa, Yellow fever virus
WDQVVMTSLAL

SEQ ID NO: 175516 - protein, 11 aa, Yellow fever virus
DQVVMTSLALV

SEQ ID NO: 175517 - protein, 11 aa, Yellow fever virus
QVVMTSLALVG

SEQ ID NO: 175518 - protein, 11 aa, Yellow fever virus
VVMTSLALVGA

SEQ ID NO: 175519 - protein, 11 aa, Yellow fever virus
VMTSLALVGAA

SEQ ID NO: 175520 - protein, 11 aa, Yellow fever virus
MTSLALVGAAL

SEQ ID NO: 175521 - protein, 11 aa, Yellow fever virus
TSLALVGAALH

SEQ ID NO: 175522 - protein, 11 aa, Yellow fever virus
SLALVGAALHP

SEQ ID NO: 175523 - protein, 11 aa, Yellow fever virus
LALVGAALHPF

SEQ ID NO: 175524 - protein, 11 aa, Yellow fever virus
ALVGAALHPFA

SEQ ID NO: 175525 - protein, 11 aa, Yellow fever virus
LVGAALHPFAL

SEQ ID NO: 175526 - protein, 11 aa, Yellow fever virus
VGAALHPFALL

SEQ ID NO: 175527 - protein, 11 aa, Yellow fever virus
GAALHPFALLL

SEQ ID NO: 175528 - protein, 11 aa, Yellow fever virus
AALHPFALLLV

SEQ ID NO: 175529 - protein, 11 aa, Yellow fever virus
ALHPFALLLVL

SEQ ID NO: 175530 - protein, 11 aa, Yellow fever virus
LHPFALLLVLA

SEQ ID NO: 175531 - protein, 11 aa, Yellow fever virus
HPFALLLVLAG

SEQ ID NO: 175532 - protein, 11 aa, Yellow fever virus
PFALLLVLAGW

SEQ ID NO: 175533 - protein, 11 aa, Yellow fever virus
FALLLVLAGWL

SEQ ID NO: 175534 - protein, 11 aa, Yellow fever virus
ALLLVLAGWLF

SEQ ID NO: 175535 - protein, 11 aa, Yellow fever virus
LLLVLAGWLFH

SEQ ID NO: 175536 - protein, 11 aa, Yellow fever virus
LLVLAGWLFHV

SEQ ID NO: 175537 - protein, 11 aa, Yellow fever virus
LVLAGWLFHVR

SEQ ID NO: 175538 - protein, 11 aa, Yellow fever virus
VLAGWLFHVRG

SEQ ID NO: 175539 - protein, 11 aa, Yellow fever virus
LAGWLFHVRGA

SEQ ID NO: 175540 - protein, 11 aa, Yellow fever virus
AGWLFHVRGAR

SEQ ID NO: 175541 - protein, 11 aa, Yellow fever virus
GWLFHVRGARR

SEQ ID NO: 175542 - protein, 11 aa, Yellow fever virus
WLFHVRGARRS

SEQ ID NO: 175543 - protein, 11 aa, Yellow fever virus
LFHVRGARRSG

SEQ ID NO: 175544 - protein, 11 aa, Yellow fever virus
FHVRGARRSGD

SEQ ID NO: 175545 - protein, 11 aa, Yellow fever virus
HVRGARRSGDV

SEQ ID NO: 175546 - protein, 11 aa, Yellow fever virus
VRGARRSGDVL

SEQ ID NO: 175547 - protein, 11 aa, Yellow fever virus
RGARRSGDVLW

SEQ ID NO: 175548 - protein, 11 aa, Yellow fever virus
GARRSGDVLWD

SEQ ID NO: 175549 - protein, 11 aa, Yellow fever virus
ARRSGDVLWDI

SEQ ID NO: 175550 - protein, 11 aa, Yellow fever virus
RRSGDVLWDIP

SEQ ID NO: 175551 - protein, 11 aa, Yellow fever virus
RSGDVLWDIPT

SEQ ID NO: 175552 - protein, 11 aa, Yellow fever virus
SGDVLWDIPTP

SEQ ID NO: 175553 - protein, 11 aa, Yellow fever virus
GDVLWDIPTPK

SEQ ID NO: 175554 - protein, 11 aa, Yellow fever virus
DVLWDIPTPKI

SEQ ID NO: 175555 - protein, 11 aa, Yellow fever virus
VLWDIPTPKII

SEQ ID NO: 175556 - protein, 11 aa, Yellow fever virus
LWDIPTPKIIE

SEQ ID NO: 175557 - protein, 11 aa, Yellow fever virus
WDIPTPKIIEE

SEQ ID NO: 175558 - protein, 11 aa, Yellow fever virus
DIPTPKIIEEC

SEQ ID NO: 175559 - protein, 11 aa, Yellow fever virus
IPTPKIIEECE

SEQ ID NO: 175560 - protein, 11 aa, Yellow fever virus
PTPKIIEECEH

SEQ ID NO: 175561 - protein, 11 aa, Yellow fever virus
TPKIIEECEHL

SEQ ID NO: 175562 - protein, 11 aa, Yellow fever virus
PKIIEECEHLE

SEQ ID NO: 175563 - protein, 11 aa, Yellow fever virus
KIIEECEHLED

SEQ ID NO: 175564 - protein, 11 aa, Yellow fever virus
IIEECEHLEDG

SEQ ID NO: 175565 - protein, 11 aa, Yellow fever virus
IEECEHLEDGI

SEQ ID NO: 175566 - protein, 11 aa, Yellow fever virus
EECEHLEDGIY

SEQ ID NO: 175567 - protein, 11 aa, Yellow fever virus
ECEHLEDGIYG

SEQ ID NO: 175568 - protein, 11 aa, Yellow fever virus
CEHLEDGIYGI

SEQ ID NO: 175569 - protein, 11 aa, Yellow fever virus
EHLEDGIYGIF

SEQ ID NO: 175570 - protein, 11 aa, Yellow fever virus
HLEDGIYGIFQ

SEQ ID NO: 175571 - protein, 11 aa, Yellow fever virus
LEDGIYGIFQS

SEQ ID NO: 175572 - protein, 11 aa, Yellow fever virus
EDGIYGIFQST

SEQ ID NO: 175573 - protein, 11 aa, Yellow fever virus
DGIYGIFQSTF

SEQ ID NO: 175574 - protein, 11 aa, Yellow fever virus
GIYGIFQSTFL

SEQ ID NO: 175575 - protein, 11 aa, Yellow fever virus
IYGIFQSTFLG

SEQ ID NO: 175576 - protein, 11 aa, Yellow fever virus
YGIFQSTFLGA

SEQ ID NO: 175577 - protein, 11 aa, Yellow fever virus
GIFQSTFLGAS

SEQ ID NO: 175578 - protein, 11 aa, Yellow fever virus
IFQSTFLGASQ

SEQ ID NO: 175579 - protein, 11 aa, Yellow fever virus
FQSTFLGASQR

SEQ ID NO: 175580 - protein, 11 aa, Yellow fever virus
QSTFLGASQRG

SEQ ID NO: 175581 - protein, 11 aa, Yellow fever virus
STFLGASQRGV

SEQ ID NO: 175582 - protein, 11 aa, Yellow fever virus
TFLGASQRGVG

SEQ ID NO: 175583 - protein, 11 aa, Yellow fever virus
FLGASQRGVGV

SEQ ID NO: 175584 - protein, 11 aa, Yellow fever virus
LGASQRGVGVA

SEQ ID NO: 175585 - protein, 11 aa, Yellow fever virus
GASQRGVGVAQ

SEQ ID NO: 175586 - protein, 11 aa, Yellow fever virus
ASQRGVGVAQG

SEQ ID NO: 175587 - protein, 11 aa, Yellow fever virus
SQRGVGVAQGG

SEQ ID NO: 175588 - protein, 11 aa, Yellow fever virus
QRGVGVAQGGV

SEQ ID NO: 175589 - protein, 11 aa, Yellow fever virus
RGVGVAQGGVF

SEQ ID NO: 175590 - protein, 11 aa, Yellow fever virus
GVGVAQGGVFH

SEQ ID NO: 175591 - protein, 11 aa, Yellow fever virus
VGVAQGGVFHT

SEQ ID NO: 175592 - protein, 11 aa, Yellow fever virus
GVAQGGVFHTM

SEQ ID NO: 175593 - protein, 11 aa, Yellow fever virus
VAQGGVFHTMW

SEQ ID NO: 175594 - protein, 11 aa, Yellow fever virus
AQGGVFHTMWH

SEQ ID NO: 175595 - protein, 11 aa, Yellow fever virus
QGGVFHTMWHV

SEQ ID NO: 175596 - protein, 11 aa, Yellow fever virus
GGVFHTMWHVT

SEQ ID NO: 175597 - protein, 11 aa, Yellow fever virus
GVFHTMWHVTR

SEQ ID NO: 175598 - protein, 11 aa, Yellow fever virus
VFHTMWHVTRG

SEQ ID NO: 175599 - protein, 11 aa, Yellow fever virus
FHTMWHVTRGA

SEQ ID NO: 175600 - protein, 11 aa, Yellow fever virus
HTMWHVTRGAF

SEQ ID NO: 175601 - protein, 11 aa, Yellow fever virus
TMWHVTRGAFL

SEQ ID NO: 175602 - protein, 11 aa, Yellow fever virus
MWHVTRGAFLV

SEQ ID NO: 175603 - protein, 11 aa, Yellow fever virus
WHVTRGAFLVR

SEQ ID NO: 175604 - protein, 11 aa, Yellow fever virus
HVTRGAFLVRN

SEQ ID NO: 175605 - protein, 11 aa, Yellow fever virus
VTRGAFLVRNG

SEQ ID NO: 175606 - protein, 11 aa, Yellow fever virus
TRGAFLVRNGK

SEQ ID NO: 175607 - protein, 11 aa, Yellow fever virus
RGAFLVRNGKK

SEQ ID NO: 175608 - protein, 11 aa, Yellow fever virus
GAFLVRNGKKL

SEQ ID NO: 175609 - protein, 11 aa, Yellow fever virus
AFLVRNGKKLI

SEQ ID NO: 175610 - protein, 11 aa, Yellow fever virus
FLVRNGKKLIP

SEQ ID NO: 175611 - protein, 11 aa, Yellow fever virus
LVRNGKKLIPS

SEQ ID NO: 175612 - protein, 11 aa, Yellow fever virus
VRNGKKLIPSW

SEQ ID NO: 175613 - protein, 11 aa, Yellow fever virus
RNGKKLIPSWA

SEQ ID NO: 175614 - protein, 11 aa, Yellow fever virus
NGKKLIPSWAS

SEQ ID NO: 175615 - protein, 11 aa, Yellow fever virus
GKKLIPSWASV

SEQ ID NO: 175616 - protein, 11 aa, Yellow fever virus
KKLIPSWASVK

SEQ ID NO: 175617 - protein, 11 aa, Yellow fever virus
KLIPSWASVKE

SEQ ID NO: 175618 - protein, 11 aa, Yellow fever virus
LIPSWASVKED

SEQ ID NO: 175619 - protein, 11 aa, Yellow fever virus
IPSWASVKEDL

SEQ ID NO: 175620 - protein, 11 aa, Yellow fever virus
PSWASVKEDLV

SEQ ID NO: 175621 - protein, 11 aa, Yellow fever virus
SWASVKEDLVA

SEQ ID NO: 175622 - protein, 11 aa, Yellow fever virus
WASVKEDLVAY

SEQ ID NO: 175623 - protein, 11 aa, Yellow fever virus
ASVKEDLVAYG

SEQ ID NO: 175624 - protein, 11 aa, Yellow fever virus
SVKEDLVAYGG

SEQ ID NO: 175625 - protein, 11 aa, Yellow fever virus
VKEDLVAYGGS

SEQ ID NO: 175626 - protein, 11 aa, Yellow fever virus
KEDLVAYGGSW

SEQ ID NO: 175627 - protein, 11 aa, Yellow fever virus
EDLVAYGGSWK

SEQ ID NO: 175628 - protein, 11 aa, Yellow fever virus
DLVAYGGSWKL

SEQ ID NO: 175629 - protein, 11 aa, Yellow fever virus
LVAYGGSWKLE

SEQ ID NO: 175630 - protein, 11 aa, Yellow fever virus
VAYGGSWKLEG

SEQ ID NO: 175631 - protein, 11 aa, Yellow fever virus
AYGGSWKLEGR

SEQ ID NO: 175632 - protein, 11 aa, Yellow fever virus
YGGSWKLEGRW

SEQ ID NO: 175633 - protein, 11 aa, Yellow fever virus
GGSWKLEGRWD

SEQ ID NO: 175634 - protein, 11 aa, Yellow fever virus
GSWKLEGRWDG

SEQ ID NO: 175635 - protein, 11 aa, Yellow fever virus
SWKLEGRWDGE

SEQ ID NO: 175636 - protein, 11 aa, Yellow fever virus
WKLEGRWDGEE

SEQ ID NO: 175637 - protein, 11 aa, Yellow fever virus
KLEGRWDGEEE

SEQ ID NO: 175638 - protein, 11 aa, Yellow fever virus
LEGRWDGEEEV

SEQ ID NO: 175639 - protein, 11 aa, Yellow fever virus
EGRWDGEEEVQ

SEQ ID NO: 175640 - protein, 11 aa, Yellow fever virus
GRWDGEEEVQL

SEQ ID NO: 175641 - protein, 11 aa, Yellow fever virus
RWDGEEEVQLI

SEQ ID NO: 175642 - protein, 11 aa, Yellow fever virus
WDGEEEVQLIA

SEQ ID NO: 175643 - protein, 11 aa, Yellow fever virus
DGEEEVQLIAA

SEQ ID NO: 175644 - protein, 11 aa, Yellow fever virus
GEEEVQLIAAV

SEQ ID NO: 175645 - protein, 11 aa, Yellow fever virus
EEEVQLIAAVP

SEQ ID NO: 175646 - protein, 11 aa, Yellow fever virus
EEVQLIAAVPG

SEQ ID NO: 175647 - protein, 11 aa, Yellow fever virus
EVQLIAAVPGK

SEQ ID NO: 175648 - protein, 11 aa, Yellow fever virus
VQLIAAVPGKN

SEQ ID NO: 175649 - protein, 11 aa, Yellow fever virus
QLIAAVPGKNV

SEQ ID NO: 175650 - protein, 11 aa, Yellow fever virus
LIAAVPGKNVV

SEQ ID NO: 175651 - protein, 11 aa, Yellow fever virus
IAAVPGKNVVN

SEQ ID NO: 175652 - protein, 11 aa, Yellow fever virus
AAVPGKNVVNV

SEQ ID NO: 175653 - protein, 11 aa, Yellow fever virus
AVPGKNVVNVQ

SEQ ID NO: 175654 - protein, 11 aa, Yellow fever virus
VPGKNVVNVQT

SEQ ID NO: 175655 - protein, 11 aa, Yellow fever virus
PGKNVVNVQTK

SEQ ID NO: 175656 - protein, 11 aa, Yellow fever virus
GKNVVNVQTKP

SEQ ID NO: 175657 - protein, 11 aa, Yellow fever virus
KNVVNVQTKPS

SEQ ID NO: 175658 - protein, 11 aa, Yellow fever virus
NVVNVQTKPSL

SEQ ID NO: 175659 - protein, 11 aa, Yellow fever virus
VVNVQTKPSLF

SEQ ID NO: 175660 - protein, 11 aa, Yellow fever virus
VNVQTKPSLFK

SEQ ID NO: 175661 - protein, 11 aa, Yellow fever virus
NVQTKPSLFKV

SEQ ID NO: 175662 - protein, 11 aa, Yellow fever virus
VQTKPSLFKVR

SEQ ID NO: 175663 - protein, 11 aa, Yellow fever virus
QTKPSLFKVRN

SEQ ID NO: 175664 - protein, 11 aa, Yellow fever virus
TKPSLFKVRNG

SEQ ID NO: 175665 - protein, 11 aa, Yellow fever virus
KPSLFKVRNGG

SEQ ID NO: 175666 - protein, 11 aa, Yellow fever virus
PSLFKVRNGGE

SEQ ID NO: 175667 - protein, 11 aa, Yellow fever virus
SLFKVRNGGEI

SEQ ID NO: 175668 - protein, 11 aa, Yellow fever virus
LFKVRNGGEIG

SEQ ID NO: 175669 - protein, 11 aa, Yellow fever virus
FKVRNGGEIGA

SEQ ID NO: 175670 - protein, 11 aa, Yellow fever virus
KVRNGGEIGAV

SEQ ID NO: 175671 - protein, 11 aa, Yellow fever virus
VRNGGEIGAVA

SEQ ID NO: 175672 - protein, 11 aa, Yellow fever virus
RNGGEIGAVAL

SEQ ID NO: 175673 - protein, 11 aa, Yellow fever virus
NGGEIGAVALD

SEQ ID NO: 175674 - protein, 11 aa, Yellow fever virus
GGEIGAVALDY

SEQ ID NO: 175675 - protein, 11 aa, Yellow fever virus
GEIGAVALDYP

SEQ ID NO: 175676 - protein, 11 aa, Yellow fever virus
EIGAVALDYPS

SEQ ID NO: 175677 - protein, 11 aa, Yellow fever virus
IGAVALDYPSG

SEQ ID NO: 175678 - protein, 11 aa, Yellow fever virus
GAVALDYPSGT

SEQ ID NO: 175679 - protein, 11 aa, Yellow fever virus
AVALDYPSGTS

SEQ ID NO: 175680 - protein, 11 aa, Yellow fever virus
VALDYPSGTSG

SEQ ID NO: 175681 - protein, 11 aa, Yellow fever virus
ALDYPSGTSGS

SEQ ID NO: 175682 - protein, 11 aa, Yellow fever virus
LDYPSGTSGSP

SEQ ID NO: 175683 - protein, 11 aa, Yellow fever virus
DYPSGTSGSPI

SEQ ID NO: 175684 - protein, 11 aa, Yellow fever virus
YPSGTSGSPIV

SEQ ID NO: 175685 - protein, 11 aa, Yellow fever virus
PSGTSGSPIVN

SEQ ID NO: 175686 - protein, 11 aa, Yellow fever virus
SGTSGSPIVNR

SEQ ID NO: 175687 - protein, 11 aa, Yellow fever virus
GTSGSPIVNRN

SEQ ID NO: 175688 - protein, 11 aa, Yellow fever virus
TSGSPIVNRNG

SEQ ID NO: 175689 - protein, 11 aa, Yellow fever virus
SGSPIVNRNGE

SEQ ID NO: 175690 - protein, 11 aa, Yellow fever virus
GSPIVNRNGEV

SEQ ID NO: 175691 - protein, 11 aa, Yellow fever virus
SPIVNRNGEVI

SEQ ID NO: 175692 - protein, 11 aa, Yellow fever virus
PIVNRNGEVIG

SEQ ID NO: 175693 - protein, 11 aa, Yellow fever virus
IVNRNGEVIGL

SEQ ID NO: 175694 - protein, 11 aa, Yellow fever virus
VNRNGEVIGLY

SEQ ID NO: 175695 - protein, 11 aa, Yellow fever virus
NRNGEVIGLYG

SEQ ID NO: 175696 - protein, 11 aa, Yellow fever virus
RNGEVIGLYGN

SEQ ID NO: 175697 - protein, 11 aa, Yellow fever virus
NGEVIGLYGNG

SEQ ID NO: 175698 - protein, 11 aa, Yellow fever virus
GEVIGLYGNGI

SEQ ID NO: 175699 - protein, 11 aa, Yellow fever virus
EVIGLYGNGIL

SEQ ID NO: 175700 - protein, 11 aa, Yellow fever virus
VIGLYGNGILV

SEQ ID NO: 175701 - protein, 11 aa, Yellow fever virus
IGLYGNGILVG

SEQ ID NO: 175702 - protein, 11 aa, Yellow fever virus
GLYGNGILVGD

SEQ ID NO: 175703 - protein, 11 aa, Yellow fever virus
LYGNGILVGDN

SEQ ID NO: 175704 - protein, 11 aa, Yellow fever virus
YGNGILVGDNS

SEQ ID NO: 175705 - protein, 11 aa, Yellow fever virus
GNGILVGDNSF

SEQ ID NO: 175706 - protein, 11 aa, Yellow fever virus
NGILVGDNSFV

SEQ ID NO: 175707 - protein, 11 aa, Yellow fever virus
GILVGDNSFVS

SEQ ID NO: 175708 - protein, 11 aa, Yellow fever virus
ILVGDNSFVSA

SEQ ID NO: 175709 - protein, 11 aa, Yellow fever virus
LVGDNSFVSAI

SEQ ID NO: 175710 - protein, 11 aa, Yellow fever virus
VGDNSFVSAIS

SEQ ID NO: 175711 - protein, 11 aa, Yellow fever virus
GDNSFVSAISQ

SEQ ID NO: 175712 - protein, 11 aa, Yellow fever virus
DNSFVSAISQT

SEQ ID NO: 175713 - protein, 11 aa, Yellow fever virus
NSFVSAISQTE

SEQ ID NO: 175714 - protein, 11 aa, Yellow fever virus
SFVSAISQTEV

SEQ ID NO: 175715 - protein, 11 aa, Yellow fever virus
FVSAISQTEVK

SEQ ID NO: 175716 - protein, 11 aa, Yellow fever virus
VSAISQTEVKE

SEQ ID NO: 175717 - protein, 11 aa, Yellow fever virus
SAISQTEVKEE

SEQ ID NO: 175718 - protein, 11 aa, Yellow fever virus
AISQTEVKEEG

SEQ ID NO: 175719 - protein, 11 aa, Yellow fever virus
ISQTEVKEEGK

SEQ ID NO: 175720 - protein, 11 aa, Yellow fever virus
SQTEVKEEGKE

SEQ ID NO: 175721 - protein, 11 aa, Yellow fever virus
QTEVKEEGKEE

SEQ ID NO: 175722 - protein, 11 aa, Yellow fever virus
TEVKEEGKEEL

SEQ ID NO: 175723 - protein, 11 aa, Yellow fever virus
EVKEEGKEELQ

SEQ ID NO: 175724 - protein, 11 aa, Yellow fever virus
VKEEGKEELQE

SEQ ID NO: 175725 - protein, 11 aa, Yellow fever virus
KEEGKEELQEI

SEQ ID NO: 175726 - protein, 11 aa, Yellow fever virus
EEGKEELQEIP

SEQ ID NO: 175727 - protein, 11 aa, Yellow fever virus
EGKEELQEIPT

SEQ ID NO: 175728 - protein, 11 aa, Yellow fever virus
GKEELQEIPTM

SEQ ID NO: 175729 - protein, 11 aa, Yellow fever virus
KEELQEIPTML

SEQ ID NO: 175730 - protein, 11 aa, Yellow fever virus
EELQEIPTMLK

SEQ ID NO: 175731 - protein, 11 aa, Yellow fever virus
ELQEIPTMLKK

SEQ ID NO: 175732 - protein, 11 aa, Yellow fever virus
LQEIPTMLKKG

SEQ ID NO: 175733 - protein, 11 aa, Yellow fever virus
QEIPTMLKKGM

SEQ ID NO: 175734 - protein, 11 aa, Yellow fever virus
EIPTMLKKGMT

SEQ ID NO: 175735 - protein, 11 aa, Yellow fever virus
IPTMLKKGMTT

SEQ ID NO: 175736 - protein, 11 aa, Yellow fever virus
PTMLKKGMTTV

SEQ ID NO: 175737 - protein, 11 aa, Yellow fever virus
TMLKKGMTTVL

SEQ ID NO: 175738 - protein, 11 aa, Yellow fever virus
MLKKGMTTVLD

SEQ ID NO: 175739 - protein, 11 aa, Yellow fever virus
LKKGMTTVLDF

SEQ ID NO: 175740 - protein, 11 aa, Yellow fever virus
KKGMTTVLDFH

SEQ ID NO: 175741 - protein, 11 aa, Yellow fever virus
KGMTTVLDFHP

SEQ ID NO: 175742 - protein, 11 aa, Yellow fever virus
GMTTVLDFHPG

SEQ ID NO: 175743 - protein, 11 aa, Yellow fever virus
MTTVLDFHPGA

SEQ ID NO: 175744 - protein, 11 aa, Yellow fever virus
TTILDFHPGAG

SEQ ID NO: 175745 - protein, 11 aa, Yellow fever virus
TILDFHPGAGK

SEQ ID NO: 175746 - protein, 11 aa, Yellow fever virus
ILDFHPGAGKT

SEQ ID NO: 175747 - protein, 11 aa, Yellow fever virus
LDFHPGAGKTR

SEQ ID NO: 175748 - protein, 11 aa, Yellow fever virus
DFHPGAGKTRR

SEQ ID NO: 175749 - protein, 11 aa, Yellow fever virus
FHPGAGKTRRF

SEQ ID NO: 175750 - protein, 11 aa, Yellow fever virus
HPGAGKTRRFL

SEQ ID NO: 175751 - protein, 11 aa, Yellow fever virus
PGAGKTRRFLP

SEQ ID NO: 175752 - protein, 11 aa, Yellow fever virus
GAGKTRRFLPQ

SEQ ID NO: 175753 - protein, 11 aa, Yellow fever virus
AGKTRRFLPQI

SEQ ID NO: 175754 - protein, 11 aa, Yellow fever virus
GKTRRFLPQIL

SEQ ID NO: 175755 - protein, 11 aa, Yellow fever virus
KTRRFLPQILA

SEQ ID NO: 175756 - protein, 11 aa, Yellow fever virus
TRRFLPQILAE

SEQ ID NO: 175757 - protein, 11 aa, Yellow fever virus
RRFLPQILAEC

SEQ ID NO: 175758 - protein, 11 aa, Yellow fever virus
RFLPQILAECA

SEQ ID NO: 175759 - protein, 11 aa, Yellow fever virus
FLPQILAECAR

SEQ ID NO: 175760 - protein, 11 aa, Yellow fever virus
LPQILAECARR

SEQ ID NO: 175761 - protein, 11 aa, Yellow fever virus
PQILAECARRR

SEQ ID NO: 175762 - protein, 11 aa, Yellow fever virus
QILAECARRRL

SEQ ID NO: 175763 - protein, 11 aa, Yellow fever virus
ILAECARRRLR

SEQ ID NO: 175764 - protein, 11 aa, Yellow fever virus
LAECARRRLRT

SEQ ID NO: 175765 - protein, 11 aa, Yellow fever virus
AECARRRLRTL

SEQ ID NO: 175766 - protein, 11 aa, Yellow fever virus
ECARRRLRTLV

SEQ ID NO: 175767 - protein, 11 aa, Yellow fever virus
CARRRLRTLVL

SEQ ID NO: 175768 - protein, 11 aa, Yellow fever virus
ARRRLRTLVLA

SEQ ID NO: 175769 - protein, 11 aa, Yellow fever virus
RRRLRTLVLAP

SEQ ID NO: 175770 - protein, 11 aa, Yellow fever virus
RRLRTLVLAPT

SEQ ID NO: 175771 - protein, 11 aa, Yellow fever virus
RLRTLVLAPTR

SEQ ID NO: 175772 - protein, 11 aa, Yellow fever virus
LRTLVLAPTRV

SEQ ID NO: 175773 - protein, 11 aa, Yellow fever virus
RTLVLAPTRVV

SEQ ID NO: 175774 - protein, 11 aa, Yellow fever virus
TLVLAPTRVVL

SEQ ID NO: 175775 - protein, 11 aa, Yellow fever virus
LVLAPTRVVLS

SEQ ID NO: 175776 - protein, 11 aa, Yellow fever virus
VLAPTRVVLSE

SEQ ID NO: 175777 - protein, 11 aa, Yellow fever virus
LAPTRVVLSEM

SEQ ID NO: 175778 - protein, 11 aa, Yellow fever virus
APTRVVLSEMK

SEQ ID NO: 175779 - protein, 11 aa, Yellow fever virus
PTRVVLSEMKE

SEQ ID NO: 175780 - protein, 11 aa, Yellow fever virus
TRVVLSEMKEA

SEQ ID NO: 175781 - protein, 11 aa, Yellow fever virus
RVVLSEMKEAF

SEQ ID NO: 175782 - protein, 11 aa, Yellow fever virus
VVLSEMKEAFH

SEQ ID NO: 175783 - protein, 11 aa, Yellow fever virus
VLSEMKEAFHG

SEQ ID NO: 175784 - protein, 11 aa, Yellow fever virus
LSEMKEAFHGL

SEQ ID NO: 175785 - protein, 11 aa, Yellow fever virus
SEMKEAFHGLD

SEQ ID NO: 175786 - protein, 11 aa, Yellow fever virus
EMKEAFHGLDV

SEQ ID NO: 175787 - protein, 11 aa, Yellow fever virus
MKEAFHGLDVK

SEQ ID NO: 175788 - protein, 11 aa, Yellow fever virus
KEAFHGLDVKF

SEQ ID NO: 175789 - protein, 11 aa, Yellow fever virus
EAFHGLDVKFH

SEQ ID NO: 175790 - protein, 11 aa, Yellow fever virus
AFHGLDVKFHT

SEQ ID NO: 175791 - protein, 11 aa, Yellow fever virus
FHGLDVKFHTQ

SEQ ID NO: 175792 - protein, 11 aa, Yellow fever virus
HGLDVKFHTQA

SEQ ID NO: 175793 - protein, 11 aa, Yellow fever virus
GLDVKFHTQAF

SEQ ID NO: 175794 - protein, 11 aa, Yellow fever virus
LDVKFHTQAFS

SEQ ID NO: 175795 - protein, 11 aa, Yellow fever virus
DVKFHTQAFSA

SEQ ID NO: 175796 - protein, 11 aa, Yellow fever virus
VKFHTQAFSAH

SEQ ID NO: 175797 - protein, 11 aa, Yellow fever virus
KFHTQAFSAHG

SEQ ID NO: 175798 - protein, 11 aa, Yellow fever virus
FHTQAFSAHGS

SEQ ID NO: 175799 - protein, 11 aa, Yellow fever virus
HTQAFSAHGSG

SEQ ID NO: 175800 - protein, 11 aa, Yellow fever virus
TQAFSAHGSGR

SEQ ID NO: 175801 - protein, 11 aa, Yellow fever virus
QAFSAHGSGRE

SEQ ID NO: 175802 - protein, 11 aa, Yellow fever virus
AFSAHGSGREV

SEQ ID NO: 175803 - protein, 11 aa, Yellow fever virus
FSAHGSGREVI

SEQ ID NO: 175804 - protein, 11 aa, Yellow fever virus
SAHGSGREVID

SEQ ID NO: 175805 - protein, 11 aa, Yellow fever virus
AHGSGREVIDA

SEQ ID NO: 175806 - protein, 11 aa, Yellow fever virus
HGSGREVIDAM

SEQ ID NO: 175807 - protein, 11 aa, Yellow fever virus
GSGREVIDAMC

SEQ ID NO: 175808 - protein, 11 aa, Yellow fever virus
SGREVIDAMCH

SEQ ID NO: 175809 - protein, 11 aa, Yellow fever virus
GREVIDAMCHA

SEQ ID NO: 175810 - protein, 11 aa, Yellow fever virus
REVIDAMCHAT

SEQ ID NO: 175811 - protein, 11 aa, Yellow fever virus
EVIDAMCHATL

SEQ ID NO: 175812 - protein, 11 aa, Yellow fever virus
VIDAMCHATLT

SEQ ID NO: 175813 - protein, 11 aa, Yellow fever virus
IDAMCHATLTY

SEQ ID NO: 175814 - protein, 11 aa, Yellow fever virus
DAMCHATLTYR

SEQ ID NO: 175815 - protein, 11 aa, Yellow fever virus
AMCHATLTYRM

SEQ ID NO: 175816 - protein, 11 aa, Yellow fever virus
MCHATLTYRML

SEQ ID NO: 175817 - protein, 11 aa, Yellow fever virus
CHATLTYRMLE

SEQ ID NO: 175818 - protein, 11 aa, Yellow fever virus
HATLTYRMLEP

SEQ ID NO: 175819 - protein, 11 aa, Yellow fever virus
ATLTYRMLEPT

SEQ ID NO: 175820 - protein, 11 aa, Yellow fever virus
TLTYRMLEPTR

SEQ ID NO: 175821 - protein, 11 aa, Yellow fever virus
LTYRMLEPTRV

SEQ ID NO: 175822 - protein, 11 aa, Yellow fever virus
TYRMLEPTRVV

SEQ ID NO: 175823 - protein, 11 aa, Yellow fever virus
YRMLEPTRVVN

SEQ ID NO: 175824 - protein, 11 aa, Yellow fever virus
RMLEPTRVVNW

SEQ ID NO: 175825 - protein, 11 aa, Yellow fever virus
MLEPTRVVNWE

SEQ ID NO: 175826 - protein, 11 aa, Yellow fever virus
LEPTRVVNWEV

SEQ ID NO: 175827 - protein, 11 aa, Yellow fever virus
EPTRVVNWEVI

SEQ ID NO: 175828 - protein, 11 aa, Yellow fever virus
PTRVVNWEVII

SEQ ID NO: 175829 - protein, 11 aa, Yellow fever virus
TRVVNWEVIIM

SEQ ID NO: 175830 - protein, 11 aa, Yellow fever virus
RVVNWEVIIMD

SEQ ID NO: 175831 - protein, 11 aa, Yellow fever virus
VVNWEVIIMDE

SEQ ID NO: 175832 - protein, 11 aa, Yellow fever virus
VNWEVIIMDEA

SEQ ID NO: 175833 - protein, 11 aa, Yellow fever virus
NWEVIIMDEAH

SEQ ID NO: 175834 - protein, 11 aa, Yellow fever virus
WEVIIMDEAHF

SEQ ID NO: 175835 - protein, 11 aa, Yellow fever virus
EVIIMDEAHFL

SEQ ID NO: 175836 - protein, 11 aa, Yellow fever virus
VIIMDEAHFLD

SEQ ID NO: 175837 - protein, 11 aa, Yellow fever virus
IIMDEAHFLDP

SEQ ID NO: 175838 - protein, 11 aa, Yellow fever virus
IMDEAHFLDPA

SEQ ID NO: 175839 - protein, 11 aa, Yellow fever virus
MDEAHFLDPAS

SEQ ID NO: 175840 - protein, 11 aa, Yellow fever virus
DEAHFLDPASI

SEQ ID NO: 175841 - protein, 11 aa, Yellow fever virus
EAHFLDPASIA

SEQ ID NO: 175842 - protein, 11 aa, Yellow fever virus
AHFLDPASIAA

SEQ ID NO: 175843 - protein, 11 aa, Yellow fever virus
HFLDPASIAAR

SEQ ID NO: 175844 - protein, 11 aa, Yellow fever virus
FLDPASIAARG

SEQ ID NO: 175845 - protein, 11 aa, Yellow fever virus
LDPASIAARGW

SEQ ID NO: 175846 - protein, 11 aa, Yellow fever virus
DPASIAARGWA

SEQ ID NO: 175847 - protein, 11 aa, Yellow fever virus
PASIAARGWAA

SEQ ID NO: 175848 - protein, 11 aa, Yellow fever virus
ASIAARGWAAH

SEQ ID NO: 175849 - protein, 11 aa, Yellow fever virus
SIAARGWAAHR

SEQ ID NO: 175850 - protein, 11 aa, Yellow fever virus
IAARGWAAHRA

SEQ ID NO: 175851 - protein, 11 aa, Yellow fever virus
AARGWAAHRAR

SEQ ID NO: 175852 - protein, 11 aa, Yellow fever virus
ARGWAAHRARA

SEQ ID NO: 175853 - protein, 11 aa, Yellow fever virus
RGWAAHRARAN

SEQ ID NO: 175854 - protein, 11 aa, Yellow fever virus
GWAAHRARANE

SEQ ID NO: 175855 - protein, 11 aa, Yellow fever virus
WAAHRARANES

SEQ ID NO: 175856 - protein, 11 aa, Yellow fever virus
AAHRARANESA

SEQ ID NO: 175857 - protein, 11 aa, Yellow fever virus
AHRARANESAT

SEQ ID NO: 175858 - protein, 11 aa, Yellow fever virus
HRARANESATI

SEQ ID NO: 175859 - protein, 11 aa, Yellow fever virus
RARANESATIL

SEQ ID NO: 175860 - protein, 11 aa, Yellow fever virus
ARANESATILM

SEQ ID NO: 175861 - protein, 11 aa, Yellow fever virus
RANESATILMT

SEQ ID NO: 175862 - protein, 11 aa, Yellow fever virus
ANESATILMTA

SEQ ID NO: 175863 - protein, 11 aa, Yellow fever virus
NESATILMTAT

SEQ ID NO: 175864 - protein, 11 aa, Yellow fever virus
ESATILMTATP

SEQ ID NO: 175865 - protein, 11 aa, Yellow fever virus
SATILMTATPP

SEQ ID NO: 175866 - protein, 11 aa, Yellow fever virus
ATILMTATPPG

SEQ ID NO: 175867 - protein, 11 aa, Yellow fever virus
TILMTATPPGT

SEQ ID NO: 175868 - protein, 11 aa, Yellow fever virus
ILMTATPPGTS

SEQ ID NO: 175869 - protein, 11 aa, Yellow fever virus
LMTATPPGTSD

SEQ ID NO: 175870 - protein, 11 aa, Yellow fever virus
MTATPPGTSDE

SEQ ID NO: 175871 - protein, 11 aa, Yellow fever virus
TATPPGTSDEF

SEQ ID NO: 175872 - protein, 11 aa, Yellow fever virus
ATPPGTSDEFP

SEQ ID NO: 175873 - protein, 11 aa, Yellow fever virus
TPPGTSDEFPH

SEQ ID NO: 175874 - protein, 11 aa, Yellow fever virus
PPGTSDEFPHS

SEQ ID NO: 175875 - protein, 11 aa, Yellow fever virus
PGTSDEFPHSN

SEQ ID NO: 175876 - protein, 11 aa, Yellow fever virus
GTSDEFPHSNG

SEQ ID NO: 175877 - protein, 11 aa, Yellow fever virus
TSDEFPHSNGE

SEQ ID NO: 175878 - protein, 11 aa, Yellow fever virus
SDEFPHSNGEI

SEQ ID NO: 175879 - protein, 11 aa, Yellow fever virus
DEFPHSNGEIE

SEQ ID NO: 175880 - protein, 11 aa, Yellow fever virus
EFPHSNGEIED

SEQ ID NO: 175881 - protein, 11 aa, Yellow fever virus
FPHSNGEIEDV

SEQ ID NO: 175882 - protein, 11 aa, Yellow fever virus
PHSNGEIEDVQ

SEQ ID NO: 175883 - protein, 11 aa, Yellow fever virus
HSNGEIEDVQT

SEQ ID NO: 175884 - protein, 11 aa, Yellow fever virus
SNGEIEDVQTD

SEQ ID NO: 175885 - protein, 11 aa, Yellow fever virus
NGEIEDVQTDI

SEQ ID NO: 175886 - protein, 11 aa, Yellow fever virus
GEIEDVQTDIP

SEQ ID NO: 175887 - protein, 11 aa, Yellow fever virus
EIEDVQTDIPS

SEQ ID NO: 175888 - protein, 11 aa, Yellow fever virus
IEDVQTDIPSE

SEQ ID NO: 175889 - protein, 11 aa, Yellow fever virus
EDVQTDIPSEP

SEQ ID NO: 175890 - protein, 11 aa, Yellow fever virus
DVQTDIPSEPW

SEQ ID NO: 175891 - protein, 11 aa, Yellow fever virus
VQTDIPSEPWN

SEQ ID NO: 175892 - protein, 11 aa, Yellow fever virus
QTDIPSEPWNT

SEQ ID NO: 175893 - protein, 11 aa, Yellow fever virus
TDIPSEPWNTG

SEQ ID NO: 175894 - protein, 11 aa, Yellow fever virus
DIPSEPWNTGH

SEQ ID NO: 175895 - protein, 11 aa, Yellow fever virus
IPSEPWNTGHD

SEQ ID NO: 175896 - protein, 11 aa, Yellow fever virus
PSEPWNTGHDW

SEQ ID NO: 175897 - protein, 11 aa, Yellow fever virus
SEPWNTGHDWI

SEQ ID NO: 175898 - protein, 11 aa, Yellow fever virus
EPWNTGHDWIL

SEQ ID NO: 175899 - protein, 11 aa, Yellow fever virus
PWNTGHDWILA

SEQ ID NO: 175900 - protein, 11 aa, Yellow fever virus
WNTGHDWILAD

SEQ ID NO: 175901 - protein, 11 aa, Yellow fever virus
NTGHDWILADK

SEQ ID NO: 175902 - protein, 11 aa, Yellow fever virus
TGHDWILADKR

SEQ ID NO: 175903 - protein, 11 aa, Yellow fever virus
GHDWILADKRP

SEQ ID NO: 175904 - protein, 11 aa, Yellow fever virus
HDWILADKRPT

SEQ ID NO: 175905 - protein, 11 aa, Yellow fever virus
DWILADKRPTA

SEQ ID NO: 175906 - protein, 11 aa, Yellow fever virus
WILADKRPTAW

SEQ ID NO: 175907 - protein, 11 aa, Yellow fever virus
ILADKRPTAWF

SEQ ID NO: 175908 - protein, 11 aa, Yellow fever virus
LADKRPTAWFL

SEQ ID NO: 175909 - protein, 11 aa, Yellow fever virus
ADKRPTAWFLP

SEQ ID NO: 175910 - protein, 11 aa, Yellow fever virus
DKRPTAWFLPS

SEQ ID NO: 175911 - protein, 11 aa, Yellow fever virus
KRPTAWFLPSI

SEQ ID NO: 175912 - protein, 11 aa, Yellow fever virus
RPTAWFLPSIR

SEQ ID NO: 175913 - protein, 11 aa, Yellow fever virus
PTAWFLPSIRA

SEQ ID NO: 175914 - protein, 11 aa, Yellow fever virus
TAWFLPSIRAA

SEQ ID NO: 175915 - protein, 11 aa, Yellow fever virus
AWFLPSIRAAN

SEQ ID NO: 175916 - protein, 11 aa, Yellow fever virus
WFLPSIRAANV

SEQ ID NO: 175917 - protein, 11 aa, Yellow fever virus
FLPSIRAANVM

SEQ ID NO: 175918 - protein, 11 aa, Yellow fever virus
LPSIRAANVMA

SEQ ID NO: 175919 - protein, 11 aa, Yellow fever virus
PSIRAANVMAA

SEQ ID NO: 175920 - protein, 11 aa, Yellow fever virus
SIRAANVMAAS

SEQ ID NO: 175921 - protein, 11 aa, Yellow fever virus
IRAANVMAASL

SEQ ID NO: 175922 - protein, 11 aa, Yellow fever virus
RAANVMAASLR

SEQ ID NO: 175923 - protein, 11 aa, Yellow fever virus
AANVMAASLRK

SEQ ID NO: 175924 - protein, 11 aa, Yellow fever virus
ANVMAASLRKA

SEQ ID NO: 175925 - protein, 11 aa, Yellow fever virus
NVMAASLRKAG

SEQ ID NO: 175926 - protein, 11 aa, Yellow fever virus
VMAASLRKAGK

SEQ ID NO: 175927 - protein, 11 aa, Yellow fever virus
MAASLRKAGKS

SEQ ID NO: 175928 - protein, 11 aa, Yellow fever virus
AASLRKAGKSV

SEQ ID NO: 175929 - protein, 11 aa, Yellow fever virus
ASLRKAGKSVV

SEQ ID NO: 175930 - protein, 11 aa, Yellow fever virus
SLRKAGKSVVV

SEQ ID NO: 175931 - protein, 11 aa, Yellow fever virus
LRKAGKSVVVL

SEQ ID NO: 175932 - protein, 11 aa, Yellow fever virus
RKAGKSVVVLN

SEQ ID NO: 175933 - protein, 11 aa, Yellow fever virus
KAGKSVVVLNR

SEQ ID NO: 175934 - protein, 11 aa, Yellow fever virus
AGKSVVVLNRK

SEQ ID NO: 175935 - protein, 11 aa, Yellow fever virus
GKSVVVLNRKT

SEQ ID NO: 175936 - protein, 11 aa, Yellow fever virus
KSVVVLNRKTF

SEQ ID NO: 175937 - protein, 11 aa, Yellow fever virus
SVVVLNRKTFE

SEQ ID NO: 175938 - protein, 11 aa, Yellow fever virus
VVVLNRKTFER

SEQ ID NO: 175939 - protein, 11 aa, Yellow fever virus
VVLNRKTFERE

SEQ ID NO: 175940 - protein, 11 aa, Yellow fever virus
VLNRKTFEREY

SEQ ID NO: 175941 - protein, 11 aa, Yellow fever virus
LNRKTFEREYP

SEQ ID NO: 175942 - protein, 11 aa, Yellow fever virus
NRKTFEREYPT

SEQ ID NO: 175943 - protein, 11 aa, Yellow fever virus
RKTFEREYPTI

SEQ ID NO: 175944 - protein, 11 aa, Yellow fever virus
KTFEREYPTIK

SEQ ID NO: 175945 - protein, 11 aa, Yellow fever virus
TFEREYPTIKQ

SEQ ID NO: 175946 - protein, 11 aa, Yellow fever virus
FEREYPTIKQK

SEQ ID NO: 175947 - protein, 11 aa, Yellow fever virus
EREYPTIKQKK

SEQ ID NO: 175948 - protein, 11 aa, Yellow fever virus
REYPTIKQKKP

SEQ ID NO: 175949 - protein, 11 aa, Yellow fever virus
EYPTIKQKKPD

SEQ ID NO: 175950 - protein, 11 aa, Yellow fever virus
YPTIKQKKPDF

SEQ ID NO: 175951 - protein, 11 aa, Yellow fever virus
PTIKQKKPDFI

SEQ ID NO: 175952 - protein, 11 aa, Yellow fever virus
TIKQKKPDFIL

SEQ ID NO: 175953 - protein, 11 aa, Yellow fever virus
IKQKKPDFILA

SEQ ID NO: 175954 - protein, 11 aa, Yellow fever virus
KQKKPDFILAT

SEQ ID NO: 175955 - protein, 11 aa, Yellow fever virus
QKKPDFILATD

SEQ ID NO: 175956 - protein, 11 aa, Yellow fever virus
KKPDFILATDI

SEQ ID NO: 175957 - protein, 11 aa, Yellow fever virus
KPDFILATDIA

SEQ ID NO: 175958 - protein, 11 aa, Yellow fever virus
PDFILATDIAE

SEQ ID NO: 175959 - protein, 11 aa, Yellow fever virus
DFILATDIAEM

SEQ ID NO: 175960 - protein, 11 aa, Yellow fever virus
FILATDIAEMG

SEQ ID NO: 175961 - protein, 11 aa, Yellow fever virus
ILATDIAEMGA

SEQ ID NO: 175962 - protein, 11 aa, Yellow fever virus
LATDIAEMGAN

SEQ ID NO: 175963 - protein, 11 aa, Yellow fever virus
ATDIAEMGANL

SEQ ID NO: 175964 - protein, 11 aa, Yellow fever virus
TDIAEMGANLC

SEQ ID NO: 175965 - protein, 11 aa, Yellow fever virus
DIAEMGANLCV

SEQ ID NO: 175966 - protein, 11 aa, Yellow fever virus
IAEMGANLCVE

SEQ ID NO: 175967 - protein, 11 aa, Yellow fever virus
AEMGANLCVER

SEQ ID NO: 175968 - protein, 11 aa, Yellow fever virus
EMGANLCVERV

SEQ ID NO: 175969 - protein, 11 aa, Yellow fever virus
MGANLCVERVL

SEQ ID NO: 175970 - protein, 11 aa, Yellow fever virus
GANLCVERVLD

SEQ ID NO: 175971 - protein, 11 aa, Yellow fever virus
ANLCVERVLDC

SEQ ID NO: 175972 - protein, 11 aa, Yellow fever virus
NLCVERVLDCR

SEQ ID NO: 175973 - protein, 11 aa, Yellow fever virus
LCVERVLDCRT

SEQ ID NO: 175974 - protein, 11 aa, Yellow fever virus
CVERVLDCRTA

SEQ ID NO: 175975 - protein, 11 aa, Yellow fever virus
VERVLDCRTAF

SEQ ID NO: 175976 - protein, 11 aa, Yellow fever virus
ERVLDCRTAFK

SEQ ID NO: 175977 - protein, 11 aa, Yellow fever virus
RVLDCRTAFKP

SEQ ID NO: 175978 - protein, 11 aa, Yellow fever virus
VLDCRTAFKPV

SEQ ID NO: 175979 - protein, 11 aa, Yellow fever virus
LDCRTAFKPVL

SEQ ID NO: 175980 - protein, 11 aa, Yellow fever virus
DCRTAFKPVLV

SEQ ID NO: 175981 - protein, 11 aa, Yellow fever virus
CRTAFKPVLVD

SEQ ID NO: 175982 - protein, 11 aa, Yellow fever virus
RTAFKPVLVDE

SEQ ID NO: 175983 - protein, 11 aa, Yellow fever virus
TAFKPVLVDEG

SEQ ID NO: 175984 - protein, 11 aa, Yellow fever virus
AFKPVLVDEGR

SEQ ID NO: 175985 - protein, 11 aa, Yellow fever virus
FKPVLVDEGRK

SEQ ID NO: 175986 - protein, 11 aa, Yellow fever virus
KPVLVDEGRKV

SEQ ID NO: 175987 - protein, 11 aa, Yellow fever virus
PVLVDEGRKVA

SEQ ID NO: 175988 - protein, 11 aa, Yellow fever virus
VLVDEGRKVAI

SEQ ID NO: 175989 - protein, 11 aa, Yellow fever virus
LVDEGRKVAIK

SEQ ID NO: 175990 - protein, 11 aa, Yellow fever virus
VDEGRKVAIKG

SEQ ID NO: 175991 - protein, 11 aa, Yellow fever virus
DEGRKVAIKGP

SEQ ID NO: 175992 - protein, 11 aa, Yellow fever virus
EGRKVAIKGPL

SEQ ID NO: 175993 - protein, 11 aa, Yellow fever virus
GRKVAIKGPLR

SEQ ID NO: 175994 - protein, 11 aa, Yellow fever virus
RKVAIKGPLRI

SEQ ID NO: 175995 - protein, 11 aa, Yellow fever virus
KVAIKGPLRIS

SEQ ID NO: 175996 - protein, 11 aa, Yellow fever virus
VAIKGPLRISA

SEQ ID NO: 175997 - protein, 11 aa, Yellow fever virus
AIKGPLRISAS

SEQ ID NO: 175998 - protein, 11 aa, Yellow fever virus
IKGPLRISASS

SEQ ID NO: 175999 - protein, 11 aa, Yellow fever virus
KGPLRISASSA

SEQ ID NO: 176000 - protein, 11 aa, Yellow fever virus
GPLRISASSAA

SEQ ID NO: 176001 - protein, 11 aa, Yellow fever virus
PLRISASSAAQ

SEQ ID NO: 176002 - protein, 11 aa, Yellow fever virus
LRISASSAAQR

SEQ ID NO: 176003 - protein, 11 aa, Yellow fever virus
RISASSAAQRR

SEQ ID NO: 176004 - protein, 11 aa, Yellow fever virus
ISASSAAQRRG

SEQ ID NO: 176005 - protein, 11 aa, Yellow fever virus
SASSAAQRRGR

SEQ ID NO: 176006 - protein, 11 aa, Yellow fever virus
ASSAAQRRGRI

SEQ ID NO: 176007 - protein, 11 aa, Yellow fever virus
SSAAQRRGRIG

SEQ ID NO: 176008 - protein, 11 aa, Yellow fever virus
SAAQRRGRIGR

SEQ ID NO: 176009 - protein, 11 aa, Yellow fever virus
AAQRRGRIGRN

SEQ ID NO: 176010 - protein, 11 aa, Yellow fever virus
AQRRGRIGRNP

SEQ ID NO: 176011 - protein, 11 aa, Yellow fever virus
QRRGRIGRNPN

SEQ ID NO: 176012 - protein, 11 aa, Yellow fever virus
RRGRIGRNPNR

SEQ ID NO: 176013 - protein, 11 aa, Yellow fever virus
RGRIGRNPNRD

SEQ ID NO: 176014 - protein, 11 aa, Yellow fever virus
GRIGRNPNRDG

SEQ ID NO: 176015 - protein, 11 aa, Yellow fever virus
RIGRNPNRDGD

SEQ ID NO: 176016 - protein, 11 aa, Yellow fever virus
IGRNPNRDGDS

SEQ ID NO: 176017 - protein, 11 aa, Yellow fever virus
GRNPNRDGDSY

SEQ ID NO: 176018 - protein, 11 aa, Yellow fever virus
RNPNRDGDSYY

SEQ ID NO: 176019 - protein, 11 aa, Yellow fever virus
NPNRDGDSYYY

SEQ ID NO: 176020 - protein, 11 aa, Yellow fever virus
PNRDGDSYYYS

SEQ ID NO: 176021 - protein, 11 aa, Yellow fever virus
NRDGDSYYYSE

SEQ ID NO: 176022 - protein, 11 aa, Yellow fever virus
RDGDSYYYSEP

SEQ ID NO: 176023 - protein, 11 aa, Yellow fever virus
DGDSYYYSEPT

SEQ ID NO: 176024 - protein, 11 aa, Yellow fever virus
GDSYYYSEPTS

SEQ ID NO: 176025 - protein, 11 aa, Yellow fever virus
DSYYYSEPTSE

SEQ ID NO: 176026 - protein, 11 aa, Yellow fever virus
SYYYSEPTSEN

SEQ ID NO: 176027 - protein, 11 aa, Yellow fever virus
YYYSEPTSENN

SEQ ID NO: 176028 - protein, 11 aa, Yellow fever virus
YYSEPTSENNA

SEQ ID NO: 176029 - protein, 11 aa, Yellow fever virus
YSEPTSENNAH

SEQ ID NO: 176030 - protein, 11 aa, Yellow fever virus
SEPTSENNAHH

SEQ ID NO: 176031 - protein, 11 aa, Yellow fever virus
EPTSENNAHHV

SEQ ID NO: 176032 - protein, 11 aa, Yellow fever virus
PTSENNAHHVC

SEQ ID NO: 176033 - protein, 11 aa, Yellow fever virus
TSENNAHHVCW

SEQ ID NO: 176034 - protein, 11 aa, Yellow fever virus
SENNAHHVCWL

SEQ ID NO: 176035 - protein, 11 aa, Yellow fever virus
ENNAHHVCWLE

SEQ ID NO: 176036 - protein, 11 aa, Yellow fever virus
NNAHHVCWLEA

SEQ ID NO: 176037 - protein, 11 aa, Yellow fever virus
NAHHVCWLEAS

SEQ ID NO: 176038 - protein, 11 aa, Yellow fever virus
AHHVCWLEASM

SEQ ID NO: 176039 - protein, 11 aa, Yellow fever virus
HHVCWLEASML

SEQ ID NO: 176040 - protein, 11 aa, Yellow fever virus
HVCWLEASMLL

SEQ ID NO: 176041 - protein, 11 aa, Yellow fever virus
VCWLEASMLLD

SEQ ID NO: 176042 - protein, 11 aa, Yellow fever virus
CWLEASMLLDN

SEQ ID NO: 176043 - protein, 11 aa, Yellow fever virus
WLEASMLLDNM

SEQ ID NO: 176044 - protein, 11 aa, Yellow fever virus
LEASMLLDNME

SEQ ID NO: 176045 - protein, 11 aa, Yellow fever virus
EASMLLDNMEV

SEQ ID NO: 176046 - protein, 11 aa, Yellow fever virus
ASMLLDNMEVR

SEQ ID NO: 176047 - protein, 11 aa, Yellow fever virus
SMLLDNMEVRG

SEQ ID NO: 176048 - protein, 11 aa, Yellow fever virus
MLLDNMEVRGG

SEQ ID NO: 176049 - protein, 11 aa, Yellow fever virus
LLDNMEVRGGM

SEQ ID NO: 176050 - protein, 11 aa, Yellow fever virus
LDNMEVRGGMV

SEQ ID NO: 176051 - protein, 11 aa, Yellow fever virus
DNMEVRGGMVA

SEQ ID NO: 176052 - protein, 11 aa, Yellow fever virus
NMEVRGGMVAP

SEQ ID NO: 176053 - protein, 11 aa, Yellow fever virus
MEVRGGMVAPL

SEQ ID NO: 176054 - protein, 11 aa, Yellow fever virus
EVRGGMVAPLY

SEQ ID NO: 176055 - protein, 11 aa, Yellow fever virus
VRGGMVAPLYG

SEQ ID NO: 176056 - protein, 11 aa, Yellow fever virus
RGGMVAPLYGV

SEQ ID NO: 176057 - protein, 11 aa, Yellow fever virus
GGMVAPLYGVE

SEQ ID NO: 176058 - protein, 11 aa, Yellow fever virus
GMVAPLYGVEG

SEQ ID NO: 176059 - protein, 11 aa, Yellow fever virus
MVAPLYGVEGT

SEQ ID NO: 176060 - protein, 11 aa, Yellow fever virus
VAPLYGVEGTK

SEQ ID NO: 176061 - protein, 11 aa, Yellow fever virus
APLYGVEGTKT

SEQ ID NO: 176062 - protein, 11 aa, Yellow fever virus
PLYGVEGTKTP

SEQ ID NO: 176063 - protein, 11 aa, Yellow fever virus
LYGVEGTKTPV

SEQ ID NO: 176064 - protein, 11 aa, Yellow fever virus
YGVEGTKTPVS

SEQ ID NO: 176065 - protein, 11 aa, Yellow fever virus
GVEGTKTPVSP

SEQ ID NO: 176066 - protein, 11 aa, Yellow fever virus
VEGTKTPVSPG

SEQ ID NO: 176067 - protein, 11 aa, Yellow fever virus
EGTKTPVSPGE

SEQ ID NO: 176068 - protein, 11 aa, Yellow fever virus
GTKTPVSPGEM

SEQ ID NO: 176069 - protein, 11 aa, Yellow fever virus
TKTPVSPGEMR

SEQ ID NO: 176070 - protein, 11 aa, Yellow fever virus
KTPVSPGEMRL

SEQ ID NO: 176071 - protein, 11 aa, Yellow fever virus
TPVSPGEMRLR

SEQ ID NO: 176072 - protein, 11 aa, Yellow fever virus
PVSPGEMRLRD

SEQ ID NO: 176073 - protein, 11 aa, Yellow fever virus
VSPGEMRLRDD

SEQ ID NO: 176074 - protein, 11 aa, Yellow fever virus
SPGEMRLRDDQ

SEQ ID NO: 176075 - protein, 11 aa, Yellow fever virus
PGEMRLRDDQR

SEQ ID NO: 176076 - protein, 11 aa, Yellow fever virus
GEMRLRDDQRK

SEQ ID NO: 176077 - protein, 11 aa, Yellow fever virus
EMRLRDDQRKV

SEQ ID NO: 176078 - protein, 11 aa, Yellow fever virus
MRLRDDQRKVF

SEQ ID NO: 176079 - protein, 11 aa, Yellow fever virus
RLRDDQRKVFR

SEQ ID NO: 176080 - protein, 11 aa, Yellow fever virus
LRDDQRKVFRE

SEQ ID NO: 176081 - protein, 11 aa, Yellow fever virus
RDDQRKVFREL

SEQ ID NO: 176082 - protein, 11 aa, Yellow fever virus
DDQRKVFRELV

SEQ ID NO: 176083 - protein, 11 aa, Yellow fever virus
DQRKVFRELVR

SEQ ID NO: 176084 - protein, 11 aa, Yellow fever virus
QRKVFRELVRN

SEQ ID NO: 176085 - protein, 11 aa, Yellow fever virus
RKVFRELVRNC

SEQ ID NO: 176086 - protein, 11 aa, Yellow fever virus
KVFRELVRNCD

SEQ ID NO: 176087 - protein, 11 aa, Yellow fever virus
VFRELVRNCDL

SEQ ID NO: 176088 - protein, 11 aa, Yellow fever virus
FRELVRNCDLP

SEQ ID NO: 176089 - protein, 11 aa, Yellow fever virus
RELVRNCDLPV

SEQ ID NO: 176090 - protein, 11 aa, Yellow fever virus
ELVRNCDLPVW

SEQ ID NO: 176091 - protein, 11 aa, Yellow fever virus
LVRNCDLPVWL

SEQ ID NO: 176092 - protein, 11 aa, Yellow fever virus
VRNCDLPVWLS

SEQ ID NO: 176093 - protein, 11 aa, Yellow fever virus
RNCDLPVWLSW

SEQ ID NO: 176094 - protein, 11 aa, Yellow fever virus
NCDLPVWLSWQ

SEQ ID NO: 176095 - protein, 11 aa, Yellow fever virus
CDLPVWLSWQV

SEQ ID NO: 176096 - protein, 11 aa, Yellow fever virus
DLPVWLSWQVA

SEQ ID NO: 176097 - protein, 11 aa, Yellow fever virus
LPVWLSWQVAK

SEQ ID NO: 176098 - protein, 11 aa, Yellow fever virus
PVWLSWQVAKA

SEQ ID NO: 176099 - protein, 11 aa, Yellow fever virus
VWLSWQVAKAG

SEQ ID NO: 176100 - protein, 11 aa, Yellow fever virus
WLSWQVAKAGL

SEQ ID NO: 176101 - protein, 11 aa, Yellow fever virus
LSWQVAKAGLK

SEQ ID NO: 176102 - protein, 11 aa, Yellow fever virus
SWQVAKAGLKT

SEQ ID NO: 176103 - protein, 11 aa, Yellow fever virus
WQVAKAGLKTN

SEQ ID NO: 176104 - protein, 11 aa, Yellow fever virus
QVAKAGLKTND

SEQ ID NO: 176105 - protein, 11 aa, Yellow fever virus
VAKAGLKTNDR

SEQ ID NO: 176106 - protein, 11 aa, Yellow fever virus
AKAGLKTNDRK

SEQ ID NO: 176107 - protein, 11 aa, Yellow fever virus
KAGLKTNDRKW

SEQ ID NO: 176108 - protein, 11 aa, Yellow fever virus
AGLKTNDRKWC

SEQ ID NO: 176109 - protein, 11 aa, Yellow fever virus
GLKTNDRKWCF

SEQ ID NO: 176110 - protein, 11 aa, Yellow fever virus
LKTNDRKWCFE

SEQ ID NO: 176111 - protein, 11 aa, Yellow fever virus
KTNDRKWCFEG

SEQ ID NO: 176112 - protein, 11 aa, Yellow fever virus
TNDRKWCFEGP

SEQ ID NO: 176113 - protein, 11 aa, Yellow fever virus
NDRKWCFEGPE

SEQ ID NO: 176114 - protein, 11 aa, Yellow fever virus
DRKWCFEGPEE

SEQ ID NO: 176115 - protein, 11 aa, Yellow fever virus
RKWCFEGPEEH

SEQ ID NO: 176116 - protein, 11 aa, Yellow fever virus
KWCFEGPEEHE

SEQ ID NO: 176117 - protein, 11 aa, Yellow fever virus
WCFEGPEEHEI

SEQ ID NO: 176118 - protein, 11 aa, Yellow fever virus
CFEGPEEHEIL

SEQ ID NO: 176119 - protein, 11 aa, Yellow fever virus
FEGPEEHEILN

SEQ ID NO: 176120 - protein, 11 aa, Yellow fever virus
EGPEEHEILND

SEQ ID NO: 176121 - protein, 11 aa, Yellow fever virus
GPEEHEILNDS

SEQ ID NO: 176122 - protein, 11 aa, Yellow fever virus
PEEHEILNDSG

SEQ ID NO: 176123 - protein, 11 aa, Yellow fever virus
EEHEILNDSGE

SEQ ID NO: 176124 - protein, 11 aa, Yellow fever virus
EHEILNDSGET

SEQ ID NO: 176125 - protein, 11 aa, Yellow fever virus
HEILNDSGETV

SEQ ID NO: 176126 - protein, 11 aa, Yellow fever virus
EILNDSGETVK

SEQ ID NO: 176127 - protein, 11 aa, Yellow fever virus
ILNDSGETVKC

SEQ ID NO: 176128 - protein, 11 aa, Yellow fever virus
LNDSGETVKCR

SEQ ID NO: 176129 - protein, 11 aa, Yellow fever virus
NDSGETVKCRA

SEQ ID NO: 176130 - protein, 11 aa, Yellow fever virus
DSGETVKCRAP

SEQ ID NO: 176131 - protein, 11 aa, Yellow fever virus
SGETVKCRAPG

SEQ ID NO: 176132 - protein, 11 aa, Yellow fever virus
GETVKCRAPGG

SEQ ID NO: 176133 - protein, 11 aa, Yellow fever virus
ETVKCRAPGGA

SEQ ID NO: 176134 - protein, 11 aa, Yellow fever virus
TVKCRAPGGAK

SEQ ID NO: 176135 - protein, 11 aa, Yellow fever virus
VKCRAPGGAKK

SEQ ID NO: 176136 - protein, 11 aa, Yellow fever virus
KCRAPGGAKKP

SEQ ID NO: 176137 - protein, 11 aa, Yellow fever virus
CRAPGGAKKPL

SEQ ID NO: 176138 - protein, 11 aa, Yellow fever virus
RAPGGAKKPLR

SEQ ID NO: 176139 - protein, 11 aa, Yellow fever virus
APGGAKKPLRP

SEQ ID NO: 176140 - protein, 11 aa, Yellow fever virus
PGGAKKPLRPR

SEQ ID NO: 176141 - protein, 11 aa, Yellow fever virus
GGAKKPLRPRW

SEQ ID NO: 176142 - protein, 11 aa, Yellow fever virus
GAKKPLRPRWC

SEQ ID NO: 176143 - protein, 11 aa, Yellow fever virus
AKKPLRPRWCD

SEQ ID NO: 176144 - protein, 11 aa, Yellow fever virus
KKPLRPRWCDE

SEQ ID NO: 176145 - protein, 11 aa, Yellow fever virus
KPLRPRWCDER

SEQ ID NO: 176146 - protein, 11 aa, Yellow fever virus
PLRPRWCDERV

SEQ ID NO: 176147 - protein, 11 aa, Yellow fever virus
LRPRWCDERVS

SEQ ID NO: 176148 - protein, 11 aa, Yellow fever virus
RPRWCDERVSS

SEQ ID NO: 176149 - protein, 11 aa, Yellow fever virus
PRWCDERVSSD

SEQ ID NO: 176150 - protein, 11 aa, Yellow fever virus
RWCDERVSSDQ

SEQ ID NO: 176151 - protein, 11 aa, Yellow fever virus
WCDERVSSDQS

SEQ ID NO: 176152 - protein, 11 aa, Yellow fever virus
CDERVSSDQSA

SEQ ID NO: 176153 - protein, 11 aa, Yellow fever virus
DERVSSDQSAL

SEQ ID NO: 176154 - protein, 11 aa, Yellow fever virus
ERVSSDQSALS

SEQ ID NO: 176155 - protein, 11 aa, Yellow fever virus
RVSSDQSALSE

SEQ ID NO: 176156 - protein, 11 aa, Yellow fever virus
VSSDQSALSEF

SEQ ID NO: 176157 - protein, 11 aa, Yellow fever virus
SSDQSALSEFI

SEQ ID NO: 176158 - protein, 11 aa, Yellow fever virus
SDQSALSEFIK

SEQ ID NO: 176159 - protein, 11 aa, Yellow fever virus
DQSALSEFIKF

SEQ ID NO: 176160 - protein, 11 aa, Yellow fever virus
QSALSEFIKFA

SEQ ID NO: 176161 - protein, 11 aa, Yellow fever virus
SALSEFIKFAE

SEQ ID NO: 176162 - protein, 11 aa, Yellow fever virus
ALSEFIKFAEG

SEQ ID NO: 176163 - protein, 11 aa, Yellow fever virus
LSEFIKFAEGR

SEQ ID NO: 176164 - protein, 11 aa, Yellow fever virus
SEFIKFAEGRR

SEQ ID NO: 176165 - protein, 11 aa, Yellow fever virus
EFIKFAEGRRG

SEQ ID NO: 176166 - protein, 11 aa, Yellow fever virus
FIKFAEGRRGA

SEQ ID NO: 176167 - protein, 11 aa, Yellow fever virus
IKFAEGRRGAA

SEQ ID NO: 176168 - protein, 11 aa, Yellow fever virus
KFAEGRRGAAE

SEQ ID NO: 176169 - protein, 11 aa, Yellow fever virus
FAEGRRGAAEV

SEQ ID NO: 176170 - protein, 11 aa, Yellow fever virus
AEGRRGAAEVL

SEQ ID NO: 176171 - protein, 11 aa, Yellow fever virus
EGRRGAAEVLV

SEQ ID NO: 176172 - protein, 11 aa, Yellow fever virus
GRRGAAEVLVV

SEQ ID NO: 176173 - protein, 11 aa, Yellow fever virus
RRGAAEVLVVL

SEQ ID NO: 176174 - protein, 11 aa, Yellow fever virus
RGAAEVLVVLS

SEQ ID NO: 176175 - protein, 11 aa, Yellow fever virus
GAAEVLVVLSE

SEQ ID NO: 176176 - protein, 11 aa, Yellow fever virus
AAEVLVVLSEL

SEQ ID NO: 176177 - protein, 11 aa, Yellow fever virus
AEVLVVLSELP

SEQ ID NO: 176178 - protein, 11 aa, Yellow fever virus
EVLVVLSELPD

SEQ ID NO: 176179 - protein, 11 aa, Yellow fever virus
VLVVLSELPDF

SEQ ID NO: 176180 - protein, 11 aa, Yellow fever virus
LVVLSELPDFL

SEQ ID NO: 176181 - protein, 11 aa, Yellow fever virus
VVLSELPDFLA

SEQ ID NO: 176182 - protein, 11 aa, Yellow fever virus
VLSELPDFLAK

SEQ ID NO: 176183 - protein, 11 aa, Yellow fever virus
LSELPDFLAKK

SEQ ID NO: 176184 - protein, 11 aa, Yellow fever virus
SELPDFLAKKG

SEQ ID NO: 176185 - protein, 11 aa, Yellow fever virus
ELPDFLAKKGG

SEQ ID NO: 176186 - protein, 11 aa, Yellow fever virus
LPDFLAKKGGE

SEQ ID NO: 176187 - protein, 11 aa, Yellow fever virus
PDFLAKKGGEA

SEQ ID NO: 176188 - protein, 11 aa, Yellow fever virus
DFLAKKGGEAM

SEQ ID NO: 176189 - protein, 11 aa, Yellow fever virus
FLAKKGGEAMD

SEQ ID NO: 176190 - protein, 11 aa, Yellow fever virus
LAKKGGEAMDT

SEQ ID NO: 176191 - protein, 11 aa, Yellow fever virus
AKKGGEAMDTI

SEQ ID NO: 176192 - protein, 11 aa, Yellow fever virus
KKGGEAMDTIS

SEQ ID NO: 176193 - protein, 11 aa, Yellow fever virus
KGGEAMDTISV

SEQ ID NO: 176194 - protein, 11 aa, Yellow fever virus
GGEAMDTISVF

SEQ ID NO: 176195 - protein, 11 aa, Yellow fever virus
GEAMDTISVFL

SEQ ID NO: 176196 - protein, 11 aa, Yellow fever virus
EAMDTISVFLH

SEQ ID NO: 176197 - protein, 11 aa, Yellow fever virus
AMDTISVFLHS

SEQ ID NO: 176198 - protein, 11 aa, Yellow fever virus
MDTISVFLHSE

SEQ ID NO: 176199 - protein, 11 aa, Yellow fever virus
DTISVFLHSEE

SEQ ID NO: 176200 - protein, 11 aa, Yellow fever virus
TISVFLHSEEG

SEQ ID NO: 176201 - protein, 11 aa, Yellow fever virus
ISVFLHSEEGS

SEQ ID NO: 176202 - protein, 11 aa, Yellow fever virus
SVFLHSEEGSR

SEQ ID NO: 176203 - protein, 11 aa, Yellow fever virus
VFLHSEEGSRA

SEQ ID NO: 176204 - protein, 11 aa, Yellow fever virus
FLHSEEGSRAY

SEQ ID NO: 176205 - protein, 11 aa, Yellow fever virus
LHSEEGSRAYR

SEQ ID NO: 176206 - protein, 11 aa, Yellow fever virus
HSEEGSRAYRN

SEQ ID NO: 176207 - protein, 11 aa, Yellow fever virus
SEEGSRAYRNA

SEQ ID NO: 176208 - protein, 11 aa, Yellow fever virus
EEGSRAYRNAL

SEQ ID NO: 176209 - protein, 11 aa, Yellow fever virus
EGSRAYRNALS

SEQ ID NO: 176210 - protein, 11 aa, Yellow fever virus
GSRAYRNALSM

SEQ ID NO: 176211 - protein, 11 aa, Yellow fever virus
SRAYRNALSMM

SEQ ID NO: 176212 - protein, 11 aa, Yellow fever virus
RAYRNALSMMP

SEQ ID NO: 176213 - protein, 11 aa, Yellow fever virus
AYRNALSMMPE

SEQ ID NO: 176214 - protein, 11 aa, Yellow fever virus
YRNALSMMPEA

SEQ ID NO: 176215 - protein, 11 aa, Yellow fever virus
RNALSMMPEAM

SEQ ID NO: 176216 - protein, 11 aa, Yellow fever virus
NALSMMPEAMT

SEQ ID NO: 176217 - protein, 11 aa, Yellow fever virus
ALSMMPEAMTI

SEQ ID NO: 176218 - protein, 11 aa, Yellow fever virus
LSMMPEAMTIV

SEQ ID NO: 176219 - protein, 11 aa, Yellow fever virus
SMMPEAMTIVM

SEQ ID NO: 176220 - protein, 11 aa, Yellow fever virus
MMPEAMTIVML

SEQ ID NO: 176221 - protein, 11 aa, Yellow fever virus
MPEAMTIVMLF

SEQ ID NO: 176222 - protein, 11 aa, Yellow fever virus
PEAMTIVMLFI

SEQ ID NO: 176223 - protein, 11 aa, Yellow fever virus
EAMTIVMLFIL

SEQ ID NO: 176224 - protein, 11 aa, Yellow fever virus
AMTIVMLFILA

SEQ ID NO: 176225 - protein, 11 aa, Yellow fever virus
MTIVMLFILAG

SEQ ID NO: 176226 - protein, 11 aa, Yellow fever virus
TIVMLFILAGL

SEQ ID NO: 176227 - protein, 11 aa, Yellow fever virus
IVMLFILAGLL

SEQ ID NO: 176228 - protein, 11 aa, Yellow fever virus
VMLFILAGLLT

SEQ ID NO: 176229 - protein, 11 aa, Yellow fever virus
MLFILAGLLTS

SEQ ID NO: 176230 - protein, 11 aa, Yellow fever virus
LFILAGLLTSG

SEQ ID NO: 176231 - protein, 11 aa, Yellow fever virus
FILAGLLTSGM

SEQ ID NO: 176232 - protein, 11 aa, Yellow fever virus
ILAGLLTSGMV

SEQ ID NO: 176233 - protein, 11 aa, Yellow fever virus
LAGLLTSGMVI

SEQ ID NO: 176234 - protein, 11 aa, Yellow fever virus
AGLLTSGMVIF

SEQ ID NO: 176235 - protein, 11 aa, Yellow fever virus
GLLTSGMVIFF

SEQ ID NO: 176236 - protein, 11 aa, Yellow fever virus
LLTSGMVIFFM

SEQ ID NO: 176237 - protein, 11 aa, Yellow fever virus
LTSGMVIFFMS

SEQ ID NO: 176238 - protein, 11 aa, Yellow fever virus
TSGMVIFFMSP

SEQ ID NO: 176239 - protein, 11 aa, Yellow fever virus
SGMVIFFMSPK

SEQ ID NO: 176240 - protein, 11 aa, Yellow fever virus
GMVIFFMSPKG

SEQ ID NO: 176241 - protein, 11 aa, Yellow fever virus
MVIFFMSPKGI

SEQ ID NO: 176242 - protein, 11 aa, Yellow fever virus
VIFFMSPKGIS

SEQ ID NO: 176243 - protein, 11 aa, Yellow fever virus
IFFMSPKGISR

SEQ ID NO: 176244 - protein, 11 aa, Yellow fever virus
FFMSPKGISRM

SEQ ID NO: 176245 - protein, 11 aa, Yellow fever virus
FMSPKGISRMS

SEQ ID NO: 176246 - protein, 11 aa, Yellow fever virus
MSPKGISRMSM

SEQ ID NO: 176247 - protein, 11 aa, Yellow fever virus
SPKGISRMSMA

SEQ ID NO: 176248 - protein, 11 aa, Yellow fever virus
PKGISRMSMAM

SEQ ID NO: 176249 - protein, 11 aa, Yellow fever virus
KGISRMSMAMG

SEQ ID NO: 176250 - protein, 11 aa, Yellow fever virus
GISRMSMAMGT

SEQ ID NO: 176251 - protein, 11 aa, Yellow fever virus
ISRMSMAMGTM

SEQ ID NO: 176252 - protein, 11 aa, Yellow fever virus
SRMSMAMGTMA

SEQ ID NO: 176253 - protein, 11 aa, Yellow fever virus
RMSMAMGTMAG

SEQ ID NO: 176254 - protein, 11 aa, Yellow fever virus
MSMAMGTMAGC

SEQ ID NO: 176255 - protein, 11 aa, Yellow fever virus
SMAMGTMAGCG

SEQ ID NO: 176256 - protein, 11 aa, Yellow fever virus
MAMGTMAGCGY

SEQ ID NO: 176257 - protein, 11 aa, Yellow fever virus
AMGTMAGCGYL

SEQ ID NO: 176258 - protein, 11 aa, Yellow fever virus
MGTMAGCGYLM

SEQ ID NO: 176259 - protein, 11 aa, Yellow fever virus
GTMAGCGYLMF

SEQ ID NO: 176260 - protein, 11 aa, Yellow fever virus
TMAGCGYLMFL

SEQ ID NO: 176261 - protein, 11 aa, Yellow fever virus
MAGCGYLMFLG

SEQ ID NO: 176262 - protein, 11 aa, Yellow fever virus
AGCGYLMFLGG

SEQ ID NO: 176263 - protein, 11 aa, Yellow fever virus
GCGYLMFLGGV

SEQ ID NO: 176264 - protein, 11 aa, Yellow fever virus
CGYLMFLGGVK

SEQ ID NO: 176265 - protein, 11 aa, Yellow fever virus
GYLMFLGGVKP

SEQ ID NO: 176266 - protein, 11 aa, Yellow fever virus
YLMFLGGVKPT

SEQ ID NO: 176267 - protein, 11 aa, Yellow fever virus
LMFLGGVKPTH

SEQ ID NO: 176268 - protein, 11 aa, Yellow fever virus
MFLGGVKPTHI

SEQ ID NO: 176269 - protein, 11 aa, Yellow fever virus
FLGGVKPTHIS

SEQ ID NO: 176270 - protein, 11 aa, Yellow fever virus
LGGVKPTHISY

SEQ ID NO: 176271 - protein, 11 aa, Yellow fever virus
GGVKPTHISYI

SEQ ID NO: 176272 - protein, 11 aa, Yellow fever virus
GVKPTHISYIM

SEQ ID NO: 176273 - protein, 11 aa, Yellow fever virus
VKPTHISYIML

SEQ ID NO: 176274 - protein, 11 aa, Yellow fever virus
KPTHISYIMLI

SEQ ID NO: 176275 - protein, 11 aa, Yellow fever virus
PTHISYIMLIF

SEQ ID NO: 176276 - protein, 11 aa, Yellow fever virus
THISYIMLIFF

SEQ ID NO: 176277 - protein, 11 aa, Yellow fever virus
HISYIMLIFFV

SEQ ID NO: 176278 - protein, 11 aa, Yellow fever virus
ISYIMLIFFVL

SEQ ID NO: 176279 - protein, 11 aa, Yellow fever virus
SYIMLIFFVLM

SEQ ID NO: 176280 - protein, 11 aa, Yellow fever virus
YIMLIFFVLMV

SEQ ID NO: 176281 - protein, 11 aa, Yellow fever virus
IMLIFFVLMVV

SEQ ID NO: 176282 - protein, 11 aa, Yellow fever virus
MLIFFVLMVVV

SEQ ID NO: 176283 - protein, 11 aa, Yellow fever virus
LIFFVLMVVVI

SEQ ID NO: 176284 - protein, 11 aa, Yellow fever virus
IFFVLMVVVIP

SEQ ID NO: 176285 - protein, 11 aa, Yellow fever virus
FFVLMVVVIPE

SEQ ID NO: 176286 - protein, 11 aa, Yellow fever virus
FVLMVVVIPEP

SEQ ID NO: 176287 - protein, 11 aa, Yellow fever virus
VLMVVVIPEPG

SEQ ID NO: 176288 - protein, 11 aa, Yellow fever virus
LMVVVIPEPGQ

SEQ ID NO: 176289 - protein, 11 aa, Yellow fever virus
MVVVIPEPGQQ

SEQ ID NO: 176290 - protein, 11 aa, Yellow fever virus
VVVIPEPGQQR

SEQ ID NO: 176291 - protein, 11 aa, Yellow fever virus
VVIPEPGQQRS

SEQ ID NO: 176292 - protein, 11 aa, Yellow fever virus
VIPEPGQQRSI

SEQ ID NO: 176293 - protein, 11 aa, Yellow fever virus
IPEPGQQRSIQ

SEQ ID NO: 176294 - protein, 11 aa, Yellow fever virus
PEPGQQRSIQD

SEQ ID NO: 176295 - protein, 11 aa, Yellow fever virus
EPGQQRSIQDN

SEQ ID NO: 176296 - protein, 11 aa, Yellow fever virus
PGQQRSIQDNQ

SEQ ID NO: 176297 - protein, 11 aa, Yellow fever virus
GQQRSIQDNQV

SEQ ID NO: 176298 - protein, 11 aa, Yellow fever virus
QQRSIQDNQVA

SEQ ID NO: 176299 - protein, 11 aa, Yellow fever virus
QRSIQDNQVAY

SEQ ID NO: 176300 - protein, 11 aa, Yellow fever virus
RSIQDNQVAYL

SEQ ID NO: 176301 - protein, 11 aa, Yellow fever virus
SIQDNQVAYLI

SEQ ID NO: 176302 - protein, 11 aa, Yellow fever virus
IQDNQVAYLII

SEQ ID NO: 176303 - protein, 11 aa, Yellow fever virus
QDNQVAYLIIG

SEQ ID NO: 176304 - protein, 11 aa, Yellow fever virus
DNQVAYLIIGI

SEQ ID NO: 176305 - protein, 11 aa, Yellow fever virus
NQVAYLIIGIL

SEQ ID NO: 176306 - protein, 11 aa, Yellow fever virus
QVAYLIIGILT

SEQ ID NO: 176307 - protein, 11 aa, Yellow fever virus
VAYLIIGILTL

SEQ ID NO: 176308 - protein, 11 aa, Yellow fever virus
AYLIIGILTLV

SEQ ID NO: 176309 - protein, 11 aa, Yellow fever virus
YLIIGILTLVS

SEQ ID NO: 176310 - protein, 11 aa, Yellow fever virus
LIIGILTLVSA

SEQ ID NO: 176311 - protein, 11 aa, Yellow fever virus
IIGILTLVSAV

SEQ ID NO: 176312 - protein, 11 aa, Yellow fever virus
IGILTLVSAVA

SEQ ID NO: 176313 - protein, 11 aa, Yellow fever virus
GILTLVSAVAA

SEQ ID NO: 176314 - protein, 11 aa, Yellow fever virus
ILTLVSAVAAN

SEQ ID NO: 176315 - protein, 11 aa, Yellow fever virus
LTLVSAVAANE

SEQ ID NO: 176316 - protein, 11 aa, Yellow fever virus
TLVSAVAANEL

SEQ ID NO: 176317 - protein, 11 aa, Yellow fever virus
LVSAVAANELG

SEQ ID NO: 176318 - protein, 11 aa, Yellow fever virus
VSAVAANELGM

SEQ ID NO: 176319 - protein, 11 aa, Yellow fever virus
SAVAANELGML

SEQ ID NO: 176320 - protein, 11 aa, Yellow fever virus
AVAANELGMLE

SEQ ID NO: 176321 - protein, 11 aa, Yellow fever virus
VAANELGMLEK

SEQ ID NO: 176322 - protein, 11 aa, Yellow fever virus
AANELGMLEKT

SEQ ID NO: 176323 - protein, 11 aa, Yellow fever virus
ANELGMLEKTK

SEQ ID NO: 176324 - protein, 11 aa, Yellow fever virus
NELGMLEKTKE

SEQ ID NO: 176325 - protein, 11 aa, Yellow fever virus
ELGMLEKTKED

SEQ ID NO: 176326 - protein, 11 aa, Yellow fever virus
LGMLEKTKEDL

SEQ ID NO: 176327 - protein, 11 aa, Yellow fever virus
GMLEKTKEDLF

SEQ ID NO: 176328 - protein, 11 aa, Yellow fever virus
MLEKTKEDLFG

SEQ ID NO: 176329 - protein, 11 aa, Yellow fever virus
LEKTKEDLFGK

SEQ ID NO: 176330 - protein, 11 aa, Yellow fever virus
EKTKEDLFGKK

SEQ ID NO: 176331 - protein, 11 aa, Yellow fever virus
IPSSASPWSWP

SEQ ID NO: 176332 - protein, 11 aa, Yellow fever virus
PSSASPWSWPD

SEQ ID NO: 176333 - protein, 11 aa, Yellow fever virus
SSASPWSWPDL

SEQ ID NO: 176334 - protein, 11 aa, Yellow fever virus
SASPWSWPDLD

SEQ ID NO: 176335 - protein, 11 aa, Yellow fever virus
ASPWSWPDLDL

SEQ ID NO: 176336 - protein, 11 aa, Yellow fever virus
SPWSWPDLDLK

SEQ ID NO: 176337 - protein, 11 aa, Yellow fever virus
PWSWPDLDLKP

SEQ ID NO: 176338 - protein, 11 aa, Yellow fever virus
WSWPDLDLKPG

SEQ ID NO: 176339 - protein, 11 aa, Yellow fever virus
SWPDLDLKPGA

SEQ ID NO: 176340 - protein, 11 aa, Yellow fever virus
WPDLDLKPGAA

SEQ ID NO: 176341 - protein, 11 aa, Yellow fever virus
PDLDLKPGAAW

SEQ ID NO: 176342 - protein, 11 aa, Yellow fever virus
DLDLKPGAAWT

SEQ ID NO: 176343 - protein, 11 aa, Yellow fever virus
LDLKPGAAWTV

SEQ ID NO: 176344 - protein, 11 aa, Yellow fever virus
DLKPGAAWTVY

SEQ ID NO: 176345 - protein, 11 aa, Yellow fever virus
LKPGAAWTVYV

SEQ ID NO: 176346 - protein, 11 aa, Yellow fever virus
KPGAAWTVYVG

SEQ ID NO: 176347 - protein, 11 aa, Yellow fever virus
PGAAWTVYVGI

SEQ ID NO: 176348 - protein, 11 aa, Yellow fever virus
GAAWTVYVGIV

SEQ ID NO: 176349 - protein, 11 aa, Yellow fever virus
AAWTVYVGIVT

SEQ ID NO: 176350 - protein, 11 aa, Yellow fever virus
AWTVYVGIVTM

SEQ ID NO: 176351 - protein, 11 aa, Yellow fever virus
WTVYVGIVTML

SEQ ID NO: 176352 - protein, 11 aa, Yellow fever virus
TVYVGIVTMLS

SEQ ID NO: 176353 - protein, 11 aa, Yellow fever virus
VYVGIVTMLSP

SEQ ID NO: 176354 - protein, 11 aa, Yellow fever virus
YVGIVTMLSPM

SEQ ID NO: 176355 - protein, 11 aa, Yellow fever virus
VGIVTMLSPML

SEQ ID NO: 176356 - protein, 11 aa, Yellow fever virus
GIVTMLSPMLH

SEQ ID NO: 176357 - protein, 11 aa, Yellow fever virus
IVTMLSPMLHH

SEQ ID NO: 176358 - protein, 11 aa, Yellow fever virus
VTMLSPMLHHW

SEQ ID NO: 176359 - protein, 11 aa, Yellow fever virus
TMLSPMLHHWI

SEQ ID NO: 176360 - protein, 11 aa, Yellow fever virus
MLSPMLHHWIK

SEQ ID NO: 176361 - protein, 11 aa, Yellow fever virus
LSPMLHHWIKV

SEQ ID NO: 176362 - protein, 11 aa, Yellow fever virus
SPMLHHWIKVE

SEQ ID NO: 176363 - protein, 11 aa, Yellow fever virus
PMLHHWIKVEY

SEQ ID NO: 176364 - protein, 11 aa, Yellow fever virus
MLHHWIKVEYG

SEQ ID NO: 176365 - protein, 11 aa, Yellow fever virus
LHHWIKVEYGN

SEQ ID NO: 176366 - protein, 11 aa, Yellow fever virus
HHWIKVEYGNL

SEQ ID NO: 176367 - protein, 11 aa, Yellow fever virus
HWIKVEYGNLS

SEQ ID NO: 176368 - protein, 11 aa, Yellow fever virus
WIKVEYGNLSL

SEQ ID NO: 176369 - protein, 11 aa, Yellow fever virus
IKVEYGNLSLS

SEQ ID NO: 176370 - protein, 11 aa, Yellow fever virus
KVEYGNLSLSG

SEQ ID NO: 176371 - protein, 11 aa, Yellow fever virus
VEYGNLSLSGI

SEQ ID NO: 176372 - protein, 11 aa, Yellow fever virus
EYGNLSLSGIA

SEQ ID NO: 176373 - protein, 11 aa, Yellow fever virus
YGNLSLSGIAQ

SEQ ID NO: 176374 - protein, 11 aa, Yellow fever virus
GNLSLSGIAQS

SEQ ID NO: 176375 - protein, 11 aa, Yellow fever virus
NLSLSGIAQSA

SEQ ID NO: 176376 - protein, 11 aa, Yellow fever virus
LSLSGIAQSAS

SEQ ID NO: 176377 - protein, 11 aa, Yellow fever virus
SLSGIAQSASV

SEQ ID NO: 176378 - protein, 11 aa, Yellow fever virus
LSGIAQSASVL

SEQ ID NO: 176379 - protein, 11 aa, Yellow fever virus
SGIAQSASVLS

SEQ ID NO: 176380 - protein, 11 aa, Yellow fever virus
GIAQSASVLSF

SEQ ID NO: 176381 - protein, 11 aa, Yellow fever virus
IAQSASVLSFM

SEQ ID NO: 176382 - protein, 11 aa, Yellow fever virus
AQSASVLSFMD

SEQ ID NO: 176383 - protein, 11 aa, Yellow fever virus
QSASVLSFMDK

SEQ ID NO: 176384 - protein, 11 aa, Yellow fever virus
SASVLSFMDKG

SEQ ID NO: 176385 - protein, 11 aa, Yellow fever virus
ASVLSFMDKGI

SEQ ID NO: 176386 - protein, 11 aa, Yellow fever virus
SVLSFMDKGIP

SEQ ID NO: 176387 - protein, 11 aa, Yellow fever virus
VLSFMDKGIPF

SEQ ID NO: 176388 - protein, 11 aa, Yellow fever virus
LSFMDKGIPFM

SEQ ID NO: 176389 - protein, 11 aa, Yellow fever virus
SFMDKGIPFMK

SEQ ID NO: 176390 - protein, 11 aa, Yellow fever virus
FMDKGIPFMKM

SEQ ID NO: 176391 - protein, 11 aa, Yellow fever virus
MDKGIPFMKMN

SEQ ID NO: 176392 - protein, 11 aa, Yellow fever virus
DKGIPFMKMNI

SEQ ID NO: 176393 - protein, 11 aa, Yellow fever virus
KGIPFMKMNIS

SEQ ID NO: 176394 - protein, 11 aa, Yellow fever virus
GIPFMKMNISV

SEQ ID NO: 176395 - protein, 11 aa, Yellow fever virus
IPFMKMNISVI

SEQ ID NO: 176396 - protein, 11 aa, Yellow fever virus
PFMKMNISVIM

SEQ ID NO: 176397 - protein, 11 aa, Yellow fever virus
FMKMNISVIML

SEQ ID NO: 176398 - protein, 11 aa, Yellow fever virus
MKMNISVIMLL

SEQ ID NO: 176399 - protein, 11 aa, Yellow fever virus
KMNISVIMLLV

SEQ ID NO: 176400 - protein, 11 aa, Yellow fever virus
MNISVIMLLVS

SEQ ID NO: 176401 - protein, 11 aa, Yellow fever virus
NISVIMLLVSG

SEQ ID NO: 176402 - protein, 11 aa, Yellow fever virus
ISVIMLLVSGW

SEQ ID NO: 176403 - protein, 11 aa, Yellow fever virus
SVIMLLVSGWN

SEQ ID NO: 176404 - protein, 11 aa, Yellow fever virus
VIMLLVSGWNS

SEQ ID NO: 176405 - protein, 11 aa, Yellow fever virus
IMLLVSGWNSI

SEQ ID NO: 176406 - protein, 11 aa, Yellow fever virus
MLLVSGWNSIT

SEQ ID NO: 176407 - protein, 11 aa, Yellow fever virus
LLVSGWNSITV

SEQ ID NO: 176408 - protein, 11 aa, Yellow fever virus
LVSGWNSITVM

SEQ ID NO: 176409 - protein, 11 aa, Yellow fever virus
VSGWNSITVMP

SEQ ID NO: 176410 - protein, 11 aa, Yellow fever virus
SGWNSITVMPL

SEQ ID NO: 176411 - protein, 11 aa, Yellow fever virus
GWNSITVMPLL

SEQ ID NO: 176412 - protein, 11 aa, Yellow fever virus
WNSITVMPLLC

SEQ ID NO: 176413 - protein, 11 aa, Yellow fever virus
NSITVMPLLCG

SEQ ID NO: 176414 - protein, 11 aa, Yellow fever virus
SITVMPLLCGI

SEQ ID NO: 176415 - protein, 11 aa, Yellow fever virus
ITVMPLLCGIG

SEQ ID NO: 176416 - protein, 11 aa, Yellow fever virus
TVMPLLCGIGC

SEQ ID NO: 176417 - protein, 11 aa, Yellow fever virus
VMPLLCGIGCA

SEQ ID NO: 176418 - protein, 11 aa, Yellow fever virus
MPLLCGIGCAM

SEQ ID NO: 176419 - protein, 11 aa, Yellow fever virus
PLLCGIGCAML

SEQ ID NO: 176420 - protein, 11 aa, Yellow fever virus
LLCGIGCAMLH

SEQ ID NO: 176421 - protein, 11 aa, Yellow fever virus
LCGIGCAMLHW

SEQ ID NO: 176422 - protein, 11 aa, Yellow fever virus
CGIGCAMLHWS

SEQ ID NO: 176423 - protein, 11 aa, Yellow fever virus
GIGCAMLHWSL

SEQ ID NO: 176424 - protein, 11 aa, Yellow fever virus
IGCAMLHWSLI

SEQ ID NO: 176425 - protein, 11 aa, Yellow fever virus
GCAMLHWSLIL

SEQ ID NO: 176426 - protein, 11 aa, Yellow fever virus
CAMLHWSLILP

SEQ ID NO: 176427 - protein, 11 aa, Yellow fever virus
AMLHWSLILPG

SEQ ID NO: 176428 - protein, 11 aa, Yellow fever virus
MLHWSLILPGI

SEQ ID NO: 176429 - protein, 11 aa, Yellow fever virus
LHWSLILPGIK

SEQ ID NO: 176430 - protein, 11 aa, Yellow fever virus
HWSLILPGIKA

SEQ ID NO: 176431 - protein, 11 aa, Yellow fever virus
WSLILPGIKAQ

SEQ ID NO: 176432 - protein, 11 aa, Yellow fever virus
SLILPGIKAQQ

SEQ ID NO: 176433 - protein, 11 aa, Yellow fever virus
LILPGIKAQQS

SEQ ID NO: 176434 - protein, 11 aa, Yellow fever virus
ILPGIKAQQSK

SEQ ID NO: 176435 - protein, 11 aa, Yellow fever virus
LPGIKAQQSKL

SEQ ID NO: 176436 - protein, 11 aa, Yellow fever virus
PGIKAQQSKLA

SEQ ID NO: 176437 - protein, 11 aa, Yellow fever virus
GIKAQQSKLAQ

SEQ ID NO: 176438 - protein, 11 aa, Yellow fever virus
IKAQQSKLAQR

SEQ ID NO: 176439 - protein, 11 aa, Yellow fever virus
KAQQSKLAQRR

SEQ ID NO: 176440 - protein, 11 aa, Yellow fever virus
AQQSKLAQRRV

SEQ ID NO: 176441 - protein, 11 aa, Yellow fever virus
QQSKLAQRRVF

SEQ ID NO: 176442 - protein, 11 aa, Yellow fever virus
QSKLAQRRVFH

SEQ ID NO: 176443 - protein, 11 aa, Yellow fever virus
SKLAQRRVFHG

SEQ ID NO: 176444 - protein, 11 aa, Yellow fever virus
KLAQRRVFHGV

SEQ ID NO: 176445 - protein, 11 aa, Yellow fever virus
LAQRRVFHGVA

SEQ ID NO: 176446 - protein, 11 aa, Yellow fever virus
AQRRVFHGVAK

SEQ ID NO: 176447 - protein, 11 aa, Yellow fever virus
QRRVFHGVAKN

SEQ ID NO: 176448 - protein, 11 aa, Yellow fever virus
RRVFHGVAKNP

SEQ ID NO: 176449 - protein, 11 aa, Yellow fever virus
RVFHGVAKNPV

SEQ ID NO: 176450 - protein, 11 aa, Yellow fever virus
VFHGVAKNPVV

SEQ ID NO: 176451 - protein, 11 aa, Yellow fever virus
FHGVAKNPVVD

SEQ ID NO: 176452 - protein, 11 aa, Yellow fever virus
HGVAKNPVVDG

SEQ ID NO: 176453 - protein, 11 aa, Yellow fever virus
GVAKNPVVDGN

SEQ ID NO: 176454 - protein, 11 aa, Yellow fever virus
VAKNPVVDGNP

SEQ ID NO: 176455 - protein, 11 aa, Yellow fever virus
AKNPVVDGNPT

SEQ ID NO: 176456 - protein, 11 aa, Yellow fever virus
KNPVVDGNPTV

SEQ ID NO: 176457 - protein, 11 aa, Yellow fever virus
NPVVDGNPTVD

SEQ ID NO: 176458 - protein, 11 aa, Yellow fever virus
PVVDGNPTVDI

SEQ ID NO: 176459 - protein, 11 aa, Yellow fever virus
VVDGNPTVDIE

SEQ ID NO: 176460 - protein, 11 aa, Yellow fever virus
VDGNPTVDIEE

SEQ ID NO: 176461 - protein, 11 aa, Yellow fever virus
DGNPTVDIEEA

SEQ ID NO: 176462 - protein, 11 aa, Yellow fever virus
GNPTVDIEEAP

SEQ ID NO: 176463 - protein, 11 aa, Yellow fever virus
NPTVDIEEAPE

SEQ ID NO: 176464 - protein, 11 aa, Yellow fever virus
PTVDIEEAPEM

SEQ ID NO: 176465 - protein, 11 aa, Yellow fever virus
TVDIEEAPEMP

SEQ ID NO: 176466 - protein, 11 aa, Yellow fever virus
VDIEEAPEMPA

SEQ ID NO: 176467 - protein, 11 aa, Yellow fever virus
DIEEAPEMPAL

SEQ ID NO: 176468 - protein, 11 aa, Yellow fever virus
IEEAPEMPALY

SEQ ID NO: 176469 - protein, 11 aa, Yellow fever virus
EEAPEMPALYE

SEQ ID NO: 176470 - protein, 11 aa, Yellow fever virus
EAPEMPALYEK

SEQ ID NO: 176471 - protein, 11 aa, Yellow fever virus
APEMPALYEKK

SEQ ID NO: 176472 - protein, 11 aa, Yellow fever virus
PEMPALYEKKL

SEQ ID NO: 176473 - protein, 11 aa, Yellow fever virus
EMPALYEKKLA

SEQ ID NO: 176474 - protein, 11 aa, Yellow fever virus
MPALYEKKLAL

SEQ ID NO: 176475 - protein, 11 aa, Yellow fever virus
PALYEKKLALY

SEQ ID NO: 176476 - protein, 11 aa, Yellow fever virus
ALYEKKLALYL

SEQ ID NO: 176477 - protein, 11 aa, Yellow fever virus
LYEKKLALYLL

SEQ ID NO: 176478 - protein, 11 aa, Yellow fever virus
YEKKLALYLLL

SEQ ID NO: 176479 - protein, 11 aa, Yellow fever virus
EKKLALYLLLA

SEQ ID NO: 176480 - protein, 11 aa, Yellow fever virus
KKLALYLLLAL

SEQ ID NO: 176481 - protein, 11 aa, Yellow fever virus
KLALYLLLALS

SEQ ID NO: 176482 - protein, 11 aa, Yellow fever virus
LALYLLLALSL

SEQ ID NO: 176483 - protein, 11 aa, Yellow fever virus
ALYLLLALSLA

SEQ ID NO: 176484 - protein, 11 aa, Yellow fever virus
LYLLLALSLAS

SEQ ID NO: 176485 - protein, 11 aa, Yellow fever virus
YLLLALSLASV

SEQ ID NO: 176486 - protein, 11 aa, Yellow fever virus
LLLALSLASVA

SEQ ID NO: 176487 - protein, 11 aa, Yellow fever virus
LLALSLASVAM

SEQ ID NO: 176488 - protein, 11 aa, Yellow fever virus
LALSLASVAMC

SEQ ID NO: 176489 - protein, 11 aa, Yellow fever virus
ALSLASVAMCR

SEQ ID NO: 176490 - protein, 11 aa, Yellow fever virus
LSLASVAMCRT

SEQ ID NO: 176491 - protein, 11 aa, Yellow fever virus
SLASVAMCRTP

SEQ ID NO: 176492 - protein, 11 aa, Yellow fever virus
LASVAMCRTPF

SEQ ID NO: 176493 - protein, 11 aa, Yellow fever virus
ASVAMCRTPFS

SEQ ID NO: 176494 - protein, 11 aa, Yellow fever virus
SVAMCRTPFSL

SEQ ID NO: 176495 - protein, 11 aa, Yellow fever virus
VAMCRTPFSLA

SEQ ID NO: 176496 - protein, 11 aa, Yellow fever virus
AMCRTPFSLAE

SEQ ID NO: 176497 - protein, 11 aa, Yellow fever virus
MCRTPFSLAEG

SEQ ID NO: 176498 - protein, 11 aa, Yellow fever virus
CRTPFSLAEGI

SEQ ID NO: 176499 - protein, 11 aa, Yellow fever virus
RTPFSLAEGIV

SEQ ID NO: 176500 - protein, 11 aa, Yellow fever virus
TPFSLAEGIVL

SEQ ID NO: 176501 - protein, 11 aa, Yellow fever virus
PFSLAEGIVLA

SEQ ID NO: 176502 - protein, 11 aa, Yellow fever virus
FSLAEGIVLAS

SEQ ID NO: 176503 - protein, 11 aa, Yellow fever virus
SLAEGIVLASA

SEQ ID NO: 176504 - protein, 11 aa, Yellow fever virus
LAEGIVLASAA

SEQ ID NO: 176505 - protein, 11 aa, Yellow fever virus
AEGIVLASAAL

SEQ ID NO: 176506 - protein, 11 aa, Yellow fever virus
EGIVLASAALG

SEQ ID NO: 176507 - protein, 11 aa, Yellow fever virus
GIVLASAALGP

SEQ ID NO: 176508 - protein, 11 aa, Yellow fever virus
IVLASAALGPL

SEQ ID NO: 176509 - protein, 11 aa, Yellow fever virus
VLASAALGPLI

SEQ ID NO: 176510 - protein, 11 aa, Yellow fever virus
LASAALGPLIE

SEQ ID NO: 176511 - protein, 11 aa, Yellow fever virus
ASAALGPLIEG

SEQ ID NO: 176512 - protein, 11 aa, Yellow fever virus
SAALGPLIEGN

SEQ ID NO: 176513 - protein, 11 aa, Yellow fever virus
AALGPLIEGNT

SEQ ID NO: 176514 - protein, 11 aa, Yellow fever virus
ALGPLIEGNTS

SEQ ID NO: 176515 - protein, 11 aa, Yellow fever virus
LGPLIEGNTSL

SEQ ID NO: 176516 - protein, 11 aa, Yellow fever virus
GPLIEGNTSLL

SEQ ID NO: 176517 - protein, 11 aa, Yellow fever virus
PLIEGNTSLLW

SEQ ID NO: 176518 - protein, 11 aa, Yellow fever virus
LIEGNTSLLWN

SEQ ID NO: 176519 - protein, 11 aa, Yellow fever virus
IEGNTSLLWNG

SEQ ID NO: 176520 - protein, 11 aa, Yellow fever virus
EGNTSLLWNGP

SEQ ID NO: 176521 - protein, 11 aa, Yellow fever virus
GNTSLLWNGPM

SEQ ID NO: 176522 - protein, 11 aa, Yellow fever virus
NTSLLWNGPMA

SEQ ID NO: 176523 - protein, 11 aa, Yellow fever virus
TSLLWNGPMAV

SEQ ID NO: 176524 - protein, 11 aa, Yellow fever virus
SLLWNGPMAVS

SEQ ID NO: 176525 - protein, 11 aa, Yellow fever virus
LLWNGPMAVSM

SEQ ID NO: 176526 - protein, 11 aa, Yellow fever virus
LWNGPMAVSMT

SEQ ID NO: 176527 - protein, 11 aa, Yellow fever virus
WNGPMAVSMTG

SEQ ID NO: 176528 - protein, 11 aa, Yellow fever virus
NGPMAVSMTGV

SEQ ID NO: 176529 - protein, 11 aa, Yellow fever virus
GPMAVSMTGVM

SEQ ID NO: 176530 - protein, 11 aa, Yellow fever virus
PMAVSMTGVMR

SEQ ID NO: 176531 - protein, 11 aa, Yellow fever virus
MAVSMTGVMRG

SEQ ID NO: 176532 - protein, 11 aa, Yellow fever virus
AVSMTGVMRGN

SEQ ID NO: 176533 - protein, 11 aa, Yellow fever virus
VSMTGVMRGNH

SEQ ID NO: 176534 - protein, 11 aa, Yellow fever virus
SMTGVMRGNHY

SEQ ID NO: 176535 - protein, 11 aa, Yellow fever virus
MTGVMRGNHYA

SEQ ID NO: 176536 - protein, 11 aa, Yellow fever virus
TGVMRGNHYAF

SEQ ID NO: 176537 - protein, 11 aa, Yellow fever virus
GVMRGNHYAFV

SEQ ID NO: 176538 - protein, 11 aa, Yellow fever virus
VMRGNHYAFVG

SEQ ID NO: 176539 - protein, 11 aa, Yellow fever virus
MRGNHYAFVGV

SEQ ID NO: 176540 - protein, 11 aa, Yellow fever virus
RGNHYAFVGVM

SEQ ID NO: 176541 - protein, 11 aa, Yellow fever virus
GNHYAFVGVMY

SEQ ID NO: 176542 - protein, 11 aa, Yellow fever virus
NHYAFVGVMYN

SEQ ID NO: 176543 - protein, 11 aa, Yellow fever virus
HYAFVGVMYNL

SEQ ID NO: 176544 - protein, 11 aa, Yellow fever virus
YAFVGVMYNLW

SEQ ID NO: 176545 - protein, 11 aa, Yellow fever virus
AFVGVMYNLWK

SEQ ID NO: 176546 - protein, 11 aa, Yellow fever virus
FVGVMYNLWKM

SEQ ID NO: 176547 - protein, 11 aa, Yellow fever virus
VGVMYNLWKMK

SEQ ID NO: 176548 - protein, 11 aa, Yellow fever virus
GVMYNLWKMKT

SEQ ID NO: 176549 - protein, 11 aa, Yellow fever virus
VMYNLWKMKTG

SEQ ID NO: 176550 - protein, 11 aa, Yellow fever virus
MYNLWKMKTGR

SEQ ID NO: 176551 - protein, 11 aa, Yellow fever virus
YNLWKMKTGRR

SEQ ID NO: 176552 - protein, 11 aa, Yellow fever virus
NLWKMKTGRRG

SEQ ID NO: 176553 - protein, 11 aa, Yellow fever virus
RRGSANGKTLG

SEQ ID NO: 176554 - protein, 11 aa, Yellow fever virus
RGSANGKTLGE

SEQ ID NO: 176555 - protein, 11 aa, Yellow fever virus
GSANGKTLGEV

SEQ ID NO: 176556 - protein, 11 aa, Yellow fever virus
SANGKTLGEVW

SEQ ID NO: 176557 - protein, 11 aa, Yellow fever virus
ANGKTLGEVWK

SEQ ID NO: 176558 - protein, 11 aa, Yellow fever virus
NGKTLGEVWKR

SEQ ID NO: 176559 - protein, 11 aa, Yellow fever virus
GKTLGEVWKRE

SEQ ID NO: 176560 - protein, 11 aa, Yellow fever virus
KTLGEVWKREL

SEQ ID NO: 176561 - protein, 11 aa, Yellow fever virus
TLGEVWKRELN

SEQ ID NO: 176562 - protein, 11 aa, Yellow fever virus
LGEVWKRELNL

SEQ ID NO: 176563 - protein, 11 aa, Yellow fever virus
GEVWKRELNLL

SEQ ID NO: 176564 - protein, 11 aa, Yellow fever virus
EVWKRELNLLD

SEQ ID NO: 176565 - protein, 11 aa, Yellow fever virus
VWKRELNLLDK

SEQ ID NO: 176566 - protein, 11 aa, Yellow fever virus
WKRELNLLDKQ

SEQ ID NO: 176567 - protein, 11 aa, Yellow fever virus
KRELNLLDKQQ

SEQ ID NO: 176568 - protein, 11 aa, Yellow fever virus
RELNLLDKQQF

SEQ ID NO: 176569 - protein, 11 aa, Yellow fever virus
ELNLLDKQQFE

SEQ ID NO: 176570 - protein, 11 aa, Yellow fever virus
LNLLDKQQFEL

SEQ ID NO: 176571 - protein, 11 aa, Yellow fever virus
NLLDKRQFELY

SEQ ID NO: 176572 - protein, 11 aa, Yellow fever virus
LLDKRQFELYK

SEQ ID NO: 176573 - protein, 11 aa, Yellow fever virus
LDKRQFELYKR

SEQ ID NO: 176574 - protein, 11 aa, Yellow fever virus
DKQQFELYKRT

SEQ ID NO: 176575 - protein, 11 aa, Yellow fever virus
KQQFELYKRTD

SEQ ID NO: 176576 - protein, 11 aa, Yellow fever virus
QQFELYKRTDI

SEQ ID NO: 176577 - protein, 11 aa, Yellow fever virus
QFELYKRTDIV

SEQ ID NO: 176578 - protein, 11 aa, Yellow fever virus
FELYKRTDIVE

SEQ ID NO: 176579 - protein, 11 aa, Yellow fever virus
ELYKRTDIVEV

SEQ ID NO: 176580 - protein, 11 aa, Yellow fever virus
LYKRTDIVEVD

SEQ ID NO: 176581 - protein, 11 aa, Yellow fever virus
YKRTDIVEVDR

SEQ ID NO: 176582 - protein, 11 aa, Yellow fever virus
KRTDIVEVDRD

SEQ ID NO: 176583 - protein, 11 aa, Yellow fever virus
RTDIVEVDRDT

SEQ ID NO: 176584 - protein, 11 aa, Yellow fever virus
TDIVEVDRDTA

SEQ ID NO: 176585 - protein, 11 aa, Yellow fever virus
DIVEVDRDTAR

SEQ ID NO: 176586 - protein, 11 aa, Yellow fever virus
IVEVDRDTARR

SEQ ID NO: 176587 - protein, 11 aa, Yellow fever virus
VEVDRDTARRH

SEQ ID NO: 176588 - protein, 11 aa, Yellow fever virus
EVDRDTARRHL

SEQ ID NO: 176589 - protein, 11 aa, Yellow fever virus
VDRDTARRHLA

SEQ ID NO: 176590 - protein, 11 aa, Yellow fever virus
DRDTARRHLAE

SEQ ID NO: 176591 - protein, 11 aa, Yellow fever virus
RDTARRHLAEG

SEQ ID NO: 176592 - protein, 11 aa, Yellow fever virus
DTARRHLAEGK

SEQ ID NO: 176593 - protein, 11 aa, Yellow fever virus
TARRHLAEGKV

SEQ ID NO: 176594 - protein, 11 aa, Yellow fever virus
ARRHLAEGKVD

SEQ ID NO: 176595 - protein, 11 aa, Yellow fever virus
RRHLAEGKVDT

SEQ ID NO: 176596 - protein, 11 aa, Yellow fever virus
RHLAEGKVDTG

SEQ ID NO: 176597 - protein, 11 aa, Yellow fever virus
HLAEGKVDTGV

SEQ ID NO: 176598 - protein, 11 aa, Yellow fever virus
LAEGKVDTGVA

SEQ ID NO: 176599 - protein, 11 aa, Yellow fever virus
AEGKVDTGVAV

SEQ ID NO: 176600 - protein, 11 aa, Yellow fever virus
EGKVDTGVAVS

SEQ ID NO: 176601 - protein, 11 aa, Yellow fever virus
GKVDTGVAVSR

SEQ ID NO: 176602 - protein, 11 aa, Yellow fever virus
KVDTGVAVSRG

SEQ ID NO: 176603 - protein, 11 aa, Yellow fever virus
VDTGVAVSRGT

SEQ ID NO: 176604 - protein, 11 aa, Yellow fever virus
DTGVAVSRGTA

SEQ ID NO: 176605 - protein, 11 aa, Yellow fever virus
TGVAVSRGTAK

SEQ ID NO: 176606 - protein, 11 aa, Yellow fever virus
GVAVSRGTAKL

SEQ ID NO: 176607 - protein, 11 aa, Yellow fever virus
VAVSRGTAKLR

SEQ ID NO: 176608 - protein, 11 aa, Yellow fever virus
AVSRGTAKLRW

SEQ ID NO: 176609 - protein, 11 aa, Yellow fever virus
VSRGTAKLRWF

SEQ ID NO: 176610 - protein, 11 aa, Yellow fever virus
SRGTAKLRWFH

SEQ ID NO: 176611 - protein, 11 aa, Yellow fever virus
RGTAKLRWFHE

SEQ ID NO: 176612 - protein, 11 aa, Yellow fever virus
GTAKLRWFHER

SEQ ID NO: 176613 - protein, 11 aa, Yellow fever virus
TAKLRWFHERG

SEQ ID NO: 176614 - protein, 11 aa, Yellow fever virus
AKLRWFHERGY

SEQ ID NO: 176615 - protein, 11 aa, Yellow fever virus
KLRWFHERGYV

SEQ ID NO: 176616 - protein, 11 aa, Yellow fever virus
LRWFHERGYVK

SEQ ID NO: 176617 - protein, 11 aa, Yellow fever virus
RWFHERGYVKL

SEQ ID NO: 176618 - protein, 11 aa, Yellow fever virus
WFHERGYVKLE

SEQ ID NO: 176619 - protein, 11 aa, Yellow fever virus
FHERGYVKLEG

SEQ ID NO: 176620 - protein, 11 aa, Yellow fever virus
HERGYVKLEGR

SEQ ID NO: 176621 - protein, 11 aa, Yellow fever virus
ERGYVKLEGRV

SEQ ID NO: 176622 - protein, 11 aa, Yellow fever virus
RGYVKLEGRVI

SEQ ID NO: 176623 - protein, 11 aa, Yellow fever virus
GYVKLEGRVID

SEQ ID NO: 176624 - protein, 11 aa, Yellow fever virus
YVKLEGRVIDL

SEQ ID NO: 176625 - protein, 11 aa, Yellow fever virus
VKLEGRVIDLG

SEQ ID NO: 176626 - protein, 11 aa, Yellow fever virus
KLEGRVIDLGC

SEQ ID NO: 176627 - protein, 11 aa, Yellow fever virus
LEGRVIDLGCG

SEQ ID NO: 176628 - protein, 11 aa, Yellow fever virus
EGRVIDLGCGR

SEQ ID NO: 176629 - protein, 11 aa, Yellow fever virus
GRVIDLGCGRG

SEQ ID NO: 176630 - protein, 11 aa, Yellow fever virus
RVIDLGCGRGG

SEQ ID NO: 176631 - protein, 11 aa, Yellow fever virus
VIDLGCGRGGW

SEQ ID NO: 176632 - protein, 11 aa, Yellow fever virus
IDLGCGRGGWC

SEQ ID NO: 176633 - protein, 11 aa, Yellow fever virus
DLGCGRGGWCY

SEQ ID NO: 176634 - protein, 11 aa, Yellow fever virus
LGCGRGGWCYY

SEQ ID NO: 176635 - protein, 11 aa, Yellow fever virus
GCGRGGWCYYA

SEQ ID NO: 176636 - protein, 11 aa, Yellow fever virus
CGRGGWCYYAA

SEQ ID NO: 176637 - protein, 11 aa, Yellow fever virus
GRGGWCYYAAA

SEQ ID NO: 176638 - protein, 11 aa, Yellow fever virus
RGGWCYYAAAQ

SEQ ID NO: 176639 - protein, 11 aa, Yellow fever virus
GGWCYYAAAQK

SEQ ID NO: 176640 - protein, 11 aa, Yellow fever virus
GWCYYAAAQKE

SEQ ID NO: 176641 - protein, 11 aa, Yellow fever virus
WCYYAAAQKEV

SEQ ID NO: 176642 - protein, 11 aa, Yellow fever virus
CYYAAAQKEVS

SEQ ID NO: 176643 - protein, 11 aa, Yellow fever virus
YYAAAQKEVSG

SEQ ID NO: 176644 - protein, 11 aa, Yellow fever virus
YAAAQKEVSGV

SEQ ID NO: 176645 - protein, 11 aa, Yellow fever virus
AAAQKEVSGVK

SEQ ID NO: 176646 - protein, 11 aa, Yellow fever virus
AAQKEVSGVKG

SEQ ID NO: 176647 - protein, 11 aa, Yellow fever virus
AQKEVSGVKGF

SEQ ID NO: 176648 - protein, 11 aa, Yellow fever virus
QKEVSGVKGFT

SEQ ID NO: 176649 - protein, 11 aa, Yellow fever virus
KEVSGVKGFTL

SEQ ID NO: 176650 - protein, 11 aa, Yellow fever virus
EVSGVKGFTLG

SEQ ID NO: 176651 - protein, 11 aa, Yellow fever virus
VSGVKGFTLGR

SEQ ID NO: 176652 - protein, 11 aa, Yellow fever virus
SGVKGFTLGRD

SEQ ID NO: 176653 - protein, 11 aa, Yellow fever virus
GVKGFTLGRDG

SEQ ID NO: 176654 - protein, 11 aa, Yellow fever virus
VKGFTLGRDGH

SEQ ID NO: 176655 - protein, 11 aa, Yellow fever virus
KGFTLGRDGHE

SEQ ID NO: 176656 - protein, 11 aa, Yellow fever virus
GFTLGRDGHEK

SEQ ID NO: 176657 - protein, 11 aa, Yellow fever virus
FTLGRDGHEKP

SEQ ID NO: 176658 - protein, 11 aa, Yellow fever virus
TLGRDGHEKPM

SEQ ID NO: 176659 - protein, 11 aa, Yellow fever virus
LGRDGHEKPMN

SEQ ID NO: 176660 - protein, 11 aa, Yellow fever virus
GRDGHEKPMNV

SEQ ID NO: 176661 - protein, 11 aa, Yellow fever virus
RDGHEKPMNVQ

SEQ ID NO: 176662 - protein, 11 aa, Yellow fever virus
DGHEKPMNVQS

SEQ ID NO: 176663 - protein, 11 aa, Yellow fever virus
GHEKPMNVQSL

SEQ ID NO: 176664 - protein, 11 aa, Yellow fever virus
HEKPMNVQSLG

SEQ ID NO: 176665 - protein, 11 aa, Yellow fever virus
EKPMNVQSLGW

SEQ ID NO: 176666 - protein, 11 aa, Yellow fever virus
KPMNVQSLGWN

SEQ ID NO: 176667 - protein, 11 aa, Yellow fever virus
PMNVQSLGWNI

SEQ ID NO: 176668 - protein, 11 aa, Yellow fever virus
MNVQSLGWNII

SEQ ID NO: 176669 - protein, 11 aa, Yellow fever virus
NVQSLGWNIIT

SEQ ID NO: 176670 - protein, 11 aa, Yellow fever virus
VQSLGWNIITF

SEQ ID NO: 176671 - protein, 11 aa, Yellow fever virus
QSLGWNIITFK

SEQ ID NO: 176672 - protein, 11 aa, Yellow fever virus
SLGWNIITFKD

SEQ ID NO: 176673 - protein, 11 aa, Yellow fever virus
LGWNIITFKDK

SEQ ID NO: 176674 - protein, 11 aa, Yellow fever virus
GWNIITFKDKT

SEQ ID NO: 176675 - protein, 11 aa, Yellow fever virus
WNIITFKDKTD

SEQ ID NO: 176676 - protein, 11 aa, Yellow fever virus
NIITFKDKTDI

SEQ ID NO: 176677 - protein, 11 aa, Yellow fever virus
IITFKDKTDIH

SEQ ID NO: 176678 - protein, 11 aa, Yellow fever virus
ITFKDKTDIHR

SEQ ID NO: 176679 - protein, 11 aa, Yellow fever virus
TFKDKTDIHRL

SEQ ID NO: 176680 - protein, 11 aa, Yellow fever virus
FKDKTDIHRLE

SEQ ID NO: 176681 - protein, 11 aa, Yellow fever virus
KDKTDIHRLEP

SEQ ID NO: 176682 - protein, 11 aa, Yellow fever virus
LEPVKCDTLLC

SEQ ID NO: 176683 - protein, 11 aa, Yellow fever virus
EPVKCDTLLCD

SEQ ID NO: 176684 - protein, 11 aa, Yellow fever virus
PVKCDTLLCDI

SEQ ID NO: 176685 - protein, 11 aa, Yellow fever virus
VKCDTLLCDIG

SEQ ID NO: 176686 - protein, 11 aa, Yellow fever virus
KCDTLLCDIGE

SEQ ID NO: 176687 - protein, 11 aa, Yellow fever virus
CDTLLCDIGES

SEQ ID NO: 176688 - protein, 11 aa, Yellow fever virus
DTLLCDIGESS

SEQ ID NO: 176689 - protein, 11 aa, Yellow fever virus
TLLCDIGESSS

SEQ ID NO: 176690 - protein, 11 aa, Yellow fever virus
LLCDIGESSSS

SEQ ID NO: 176691 - protein, 11 aa, Yellow fever virus
LCDIGESSSSS

SEQ ID NO: 176692 - protein, 11 aa, Yellow fever virus
CDIGESSSSSV

SEQ ID NO: 176693 - protein, 11 aa, Yellow fever virus
DIGESSSSSVT

SEQ ID NO: 176694 - protein, 11 aa, Yellow fever virus
IGESSSSSVTE

SEQ ID NO: 176695 - protein, 11 aa, Yellow fever virus
GESSSSSVTEG

SEQ ID NO: 176696 - protein, 11 aa, Yellow fever virus
ESSSSSVTEGE

SEQ ID NO: 176697 - protein, 11 aa, Yellow fever virus
SSSSSVTEGER

SEQ ID NO: 176698 - protein, 11 aa, Yellow fever virus
SSSSVTEGERT

SEQ ID NO: 176699 - protein, 11 aa, Yellow fever virus
SSSVTEGERTV

SEQ ID NO: 176700 - protein, 11 aa, Yellow fever virus
SSVTEGERTVR

SEQ ID NO: 176701 - protein, 11 aa, Yellow fever virus
SVTEGERTVRV

SEQ ID NO: 176702 - protein, 11 aa, Yellow fever virus
VTEGERTVRVL

SEQ ID NO: 176703 - protein, 11 aa, Yellow fever virus
TEGERTVRVLD

SEQ ID NO: 176704 - protein, 11 aa, Yellow fever virus
EGERTVRVLDT

SEQ ID NO: 176705 - protein, 11 aa, Yellow fever virus
GERTVRVLDTV

SEQ ID NO: 176706 - protein, 11 aa, Yellow fever virus
ERTVRVLDTVE

SEQ ID NO: 176707 - protein, 11 aa, Yellow fever virus
RTVRVLDTVEK

SEQ ID NO: 176708 - protein, 11 aa, Yellow fever virus
TVRVLDTVEKW

SEQ ID NO: 176709 - protein, 11 aa, Yellow fever virus
VRVLDTVEKWL

SEQ ID NO: 176710 - protein, 11 aa, Yellow fever virus
RVLDTVEKWLA

SEQ ID NO: 176711 - protein, 11 aa, Yellow fever virus
VLDTVEKWLAC

SEQ ID NO: 176712 - protein, 11 aa, Yellow fever virus
LDTVEKWLACG

SEQ ID NO: 176713 - protein, 11 aa, Yellow fever virus
DTVEKWLACGV

SEQ ID NO: 176714 - protein, 11 aa, Yellow fever virus
TVEKWLACGVD

SEQ ID NO: 176715 - protein, 11 aa, Yellow fever virus
VEKWLACGVDN

SEQ ID NO: 176716 - protein, 11 aa, Yellow fever virus
EKWLACGVDNF

SEQ ID NO: 176717 - protein, 11 aa, Yellow fever virus
KWLACGVDNFC

SEQ ID NO: 176718 - protein, 11 aa, Yellow fever virus
WLACGVDNFCV

SEQ ID NO: 176719 - protein, 11 aa, Yellow fever virus
LACGVDNFCVK

SEQ ID NO: 176720 - protein, 11 aa, Yellow fever virus
ACGVDNFCVKV

SEQ ID NO: 176721 - protein, 11 aa, Yellow fever virus
CGVDNFCVKVL

SEQ ID NO: 176722 - protein, 11 aa, Yellow fever virus
GVDNFCVKVLA

SEQ ID NO: 176723 - protein, 11 aa, Yellow fever virus
VDNFCVKVLAP

SEQ ID NO: 176724 - protein, 11 aa, Yellow fever virus
DNFCVKVLAPY

SEQ ID NO: 176725 - protein, 11 aa, Yellow fever virus
NFCVKVLAPYM

SEQ ID NO: 176726 - protein, 11 aa, Yellow fever virus
FCVKVLAPYMP

SEQ ID NO: 176727 - protein, 11 aa, Yellow fever virus
CVKVLAPYMPD

SEQ ID NO: 176728 - protein, 11 aa, Yellow fever virus
VKVLAPYMPDV

SEQ ID NO: 176729 - protein, 11 aa, Yellow fever virus
KVLAPYMPDVL

SEQ ID NO: 176730 - protein, 11 aa, Yellow fever virus
VLAPYMPDVLE

SEQ ID NO: 176731 - protein, 11 aa, Yellow fever virus
LAPYMPDVLEK

SEQ ID NO: 176732 - protein, 11 aa, Yellow fever virus
APYMPDVLEKL

SEQ ID NO: 176733 - protein, 11 aa, Yellow fever virus
PYMPDVLEKLE

SEQ ID NO: 176734 - protein, 11 aa, Yellow fever virus
YMPDVLEKLEL

SEQ ID NO: 176735 - protein, 11 aa, Yellow fever virus
MPDVLEKLELL

SEQ ID NO: 176736 - protein, 11 aa, Yellow fever virus
PDVLEKLELLQ

SEQ ID NO: 176737 - protein, 11 aa, Yellow fever virus
DVLEKLELLQR

SEQ ID NO: 176738 - protein, 11 aa, Yellow fever virus
VLEKLELLQRR

SEQ ID NO: 176739 - protein, 11 aa, Yellow fever virus
LEKLELLQRRF

SEQ ID NO: 176740 - protein, 11 aa, Yellow fever virus
EKLELLQRRFG

SEQ ID NO: 176741 - protein, 11 aa, Yellow fever virus
KLELLQRRFGG

SEQ ID NO: 176742 - protein, 11 aa, Yellow fever virus
LELLQRRFGGT

SEQ ID NO: 176743 - protein, 11 aa, Yellow fever virus
ELLQRRFGGTV

SEQ ID NO: 176744 - protein, 11 aa, Yellow fever virus
LLQRRFGGTVI

SEQ ID NO: 176745 - protein, 11 aa, Yellow fever virus
LQRRFGGTVIR

SEQ ID NO: 176746 - protein, 11 aa, Yellow fever virus
QRRFGGTVIRN

SEQ ID NO: 176747 - protein, 11 aa, Yellow fever virus
RRFGGTVIRNP

SEQ ID NO: 176748 - protein, 11 aa, Yellow fever virus
RFGGTVIRNPL

SEQ ID NO: 176749 - protein, 11 aa, Yellow fever virus
FGGTVIRNPLS

SEQ ID NO: 176750 - protein, 11 aa, Yellow fever virus
GGTVIRNPLSR

SEQ ID NO: 176751 - protein, 11 aa, Yellow fever virus
GTVIRNPLSRN

SEQ ID NO: 176752 - protein, 11 aa, Yellow fever virus
TVIRNPLSRNS

SEQ ID NO: 176753 - protein, 11 aa, Yellow fever virus
VIRNPLSRNST

SEQ ID NO: 176754 - protein, 11 aa, Yellow fever virus
IRNPLSRNSTH

SEQ ID NO: 176755 - protein, 11 aa, Yellow fever virus
RNPLSRNSTHE

SEQ ID NO: 176756 - protein, 11 aa, Yellow fever virus
NPLSRNSTHEM

SEQ ID NO: 176757 - protein, 11 aa, Yellow fever virus
PLSRNSTHEMY

SEQ ID NO: 176758 - protein, 11 aa, Yellow fever virus
LSRNSTHEMYY

SEQ ID NO: 176759 - protein, 11 aa, Yellow fever virus
SRNSTHEMYYV

SEQ ID NO: 176760 - protein, 11 aa, Yellow fever virus
RNSTHEMYYVS

SEQ ID NO: 176761 - protein, 11 aa, Yellow fever virus
NSTHEMYYVSG

SEQ ID NO: 176762 - protein, 11 aa, Yellow fever virus
STHEMYYVSGA

SEQ ID NO: 176763 - protein, 11 aa, Yellow fever virus
THEMYYVSGAR

SEQ ID NO: 176764 - protein, 11 aa, Yellow fever virus
HEMYYVSGARS

SEQ ID NO: 176765 - protein, 11 aa, Yellow fever virus
EMYYVSGARSN

SEQ ID NO: 176766 - protein, 11 aa, Yellow fever virus
MYYVSGARSNV

SEQ ID NO: 176767 - protein, 11 aa, Yellow fever virus
YYVSGARSNVT

SEQ ID NO: 176768 - protein, 11 aa, Yellow fever virus
YVSGARSNVTF

SEQ ID NO: 176769 - protein, 11 aa, Yellow fever virus
VSGARSNVTFT

SEQ ID NO: 176770 - protein, 11 aa, Yellow fever virus
SGARSNVTFTV

SEQ ID NO: 176771 - protein, 11 aa, Yellow fever virus
GARSNVTFTVN

SEQ ID NO: 176772 - protein, 11 aa, Yellow fever virus
ARSNVTFTVNQ

SEQ ID NO: 176773 - protein, 11 aa, Yellow fever virus
RSNVTFTVNQT

SEQ ID NO: 176774 - protein, 11 aa, Yellow fever virus
SNVTFTVNQTS

SEQ ID NO: 176775 - protein, 11 aa, Yellow fever virus
NVTFTVNQTSR

SEQ ID NO: 176776 - protein, 11 aa, Yellow fever virus
VTFTVNQTSRL

SEQ ID NO: 176777 - protein, 11 aa, Yellow fever virus
TFTVNQTSRLL

SEQ ID NO: 176778 - protein, 11 aa, Yellow fever virus
FTVNQTSRLLM

SEQ ID NO: 176779 - protein, 11 aa, Yellow fever virus
TVNQTSRLLMR

SEQ ID NO: 176780 - protein, 11 aa, Yellow fever virus
VNQTSRLLMRR

SEQ ID NO: 176781 - protein, 11 aa, Yellow fever virus
NQTSRLLMRRM

SEQ ID NO: 176782 - protein, 11 aa, Yellow fever virus
QTSRLLMRRMR

SEQ ID NO: 176783 - protein, 11 aa, Yellow fever virus
TSRLLMRRMRR

SEQ ID NO: 176784 - protein, 11 aa, Yellow fever virus
SRLLMRRMRRP

SEQ ID NO: 176785 - protein, 11 aa, Yellow fever virus
RLLMRRMRRPT

SEQ ID NO: 176786 - protein, 11 aa, Yellow fever virus
LLMRRMRRPTG

SEQ ID NO: 176787 - protein, 11 aa, Yellow fever virus
LMRRMRRPTGK

SEQ ID NO: 176788 - protein, 11 aa, Yellow fever virus
MRRMRRPTGKV

SEQ ID NO: 176789 - protein, 11 aa, Yellow fever virus
RRMRRPTGKVT

SEQ ID NO: 176790 - protein, 11 aa, Yellow fever virus
RMRRPTGKVTL

SEQ ID NO: 176791 - protein, 11 aa, Yellow fever virus
MRRPTGKVTLE

SEQ ID NO: 176792 - protein, 11 aa, Yellow fever virus
RRPTGKVTLEA

SEQ ID NO: 176793 - protein, 11 aa, Yellow fever virus
RPTGKVTLEAD

SEQ ID NO: 176794 - protein, 11 aa, Yellow fever virus
PTGKVTLEADV

SEQ ID NO: 176795 - protein, 11 aa, Yellow fever virus
TGKVTLEADVI

SEQ ID NO: 176796 - protein, 11 aa, Yellow fever virus
GKVTLEADVIL

SEQ ID NO: 176797 - protein, 11 aa, Yellow fever virus
KVTLEADVILP

SEQ ID NO: 176798 - protein, 11 aa, Yellow fever virus
VTLEADVILPI

SEQ ID NO: 176799 - protein, 11 aa, Yellow fever virus
TLEADVILPIG

SEQ ID NO: 176800 - protein, 11 aa, Yellow fever virus
LEADVILPIGT

SEQ ID NO: 176801 - protein, 11 aa, Yellow fever virus
EADVILPIGTR

SEQ ID NO: 176802 - protein, 11 aa, Yellow fever virus
ADVILPIGTRS

SEQ ID NO: 176803 - protein, 11 aa, Yellow fever virus
DVILPIGTRSV

SEQ ID NO: 176804 - protein, 11 aa, Yellow fever virus
VILPIGTRSVE

SEQ ID NO: 176805 - protein, 11 aa, Yellow fever virus
ILPIGTRSVET

SEQ ID NO: 176806 - protein, 11 aa, Yellow fever virus
LPIGTRSVETD

SEQ ID NO: 176807 - protein, 11 aa, Yellow fever virus
PIGTRSVETDK

SEQ ID NO: 176808 - protein, 11 aa, Yellow fever virus
IGTRSVETDKG

SEQ ID NO: 176809 - protein, 11 aa, Yellow fever virus
GTRSVETDKGP

SEQ ID NO: 176810 - protein, 11 aa, Yellow fever virus
TRSVETDKGPL

SEQ ID NO: 176811 - protein, 11 aa, Yellow fever virus
RSVETDKGPLD

SEQ ID NO: 176812 - protein, 11 aa, Yellow fever virus
SVETDKGPLDK

SEQ ID NO: 176813 - protein, 11 aa, Yellow fever virus
EAIEERVERIK

SEQ ID NO: 176814 - protein, 11 aa, Yellow fever virus
AIEERVERIKS

SEQ ID NO: 176815 - protein, 11 aa, Yellow fever virus
IEERVERIKSE

SEQ ID NO: 176816 - protein, 11 aa, Yellow fever virus
EERVERIKSEY

SEQ ID NO: 176817 - protein, 11 aa, Yellow fever virus
ERVERIKSEYM

SEQ ID NO: 176818 - protein, 11 aa, Yellow fever virus
RVERIKSEYMT

SEQ ID NO: 176819 - protein, 11 aa, Yellow fever virus
VERIKSEYMTS

SEQ ID NO: 176820 - protein, 11 aa, Yellow fever virus
ERIKSEYMTSW

SEQ ID NO: 176821 - protein, 11 aa, Yellow fever virus
RIKSEYMTSWF

SEQ ID NO: 176822 - protein, 11 aa, Yellow fever virus
IKSEYMTSWFY

SEQ ID NO: 176823 - protein, 11 aa, Yellow fever virus
KSEYMTSWFYD

SEQ ID NO: 176824 - protein, 11 aa, Yellow fever virus
SEYMTSWFYDN

SEQ ID NO: 176825 - protein, 11 aa, Yellow fever virus
EYMTSWFYDND

SEQ ID NO: 176826 - protein, 11 aa, Yellow fever virus
YMTSWFYDNDN

SEQ ID NO: 176827 - protein, 11 aa, Yellow fever virus
MTSWFYDNDNP

SEQ ID NO: 176828 - protein, 11 aa, Yellow fever virus
TSWFYDNDNPY

SEQ ID NO: 176829 - protein, 11 aa, Yellow fever virus
SWFYDNDNPYR

SEQ ID NO: 176830 - protein, 11 aa, Yellow fever virus
WFYDNDNPYRT

SEQ ID NO: 176831 - protein, 11 aa, Yellow fever virus
FYDNDNPYRTW

SEQ ID NO: 176832 - protein, 11 aa, Yellow fever virus
YDNDNPYRTWH

SEQ ID NO: 176833 - protein, 11 aa, Yellow fever virus
DNDNPYRTWHY

SEQ ID NO: 176834 - protein, 11 aa, Yellow fever virus
NDNPYRTWHYC

SEQ ID NO: 176835 - protein, 11 aa, Yellow fever virus
DNPYRTWHYCG

SEQ ID NO: 176836 - protein, 11 aa, Yellow fever virus
NPYRTWHYCGS

SEQ ID NO: 176837 - protein, 11 aa, Yellow fever virus
PYRTWHYCGSY

SEQ ID NO: 176838 - protein, 11 aa, Yellow fever virus
YRTWHYCGSYV

SEQ ID NO: 176839 - protein, 11 aa, Yellow fever virus
RTWHYCGSYVT

SEQ ID NO: 176840 - protein, 11 aa, Yellow fever virus
TWHYCGSYVTK

SEQ ID NO: 176841 - protein, 11 aa, Yellow fever virus
WHYCGSYVTKT

SEQ ID NO: 176842 - protein, 11 aa, Yellow fever virus
HYCGSYVTKTS

SEQ ID NO: 176843 - protein, 11 aa, Yellow fever virus
YCGSYVTKTSG

SEQ ID NO: 176844 - protein, 11 aa, Yellow fever virus
CGSYVTKTSGS

SEQ ID NO: 176845 - protein, 11 aa, Yellow fever virus
GSYVTKTSGSA

SEQ ID NO: 176846 - protein, 11 aa, Yellow fever virus
SYVTKTSGSAA

SEQ ID NO: 176847 - protein, 11 aa, Yellow fever virus
YVTKTSGSAAS

SEQ ID NO: 176848 - protein, 11 aa, Yellow fever virus
VTKTSGSAASM

SEQ ID NO: 176849 - protein, 11 aa, Yellow fever virus
TKTSGSAASMV

SEQ ID NO: 176850 - protein, 11 aa, Yellow fever virus
KTSGSAASMVN

SEQ ID NO: 176851 - protein, 11 aa, Yellow fever virus
TSGSAASMVNG

SEQ ID NO: 176852 - protein, 11 aa, Yellow fever virus
SGSAASMVNGV

SEQ ID NO: 176853 - protein, 11 aa, Yellow fever virus
GSAASMVNGVI

SEQ ID NO: 176854 - protein, 11 aa, Yellow fever virus
SAASMVNGVIK

SEQ ID NO: 176855 - protein, 11 aa, Yellow fever virus
AASMVNGVIKI

SEQ ID NO: 176856 - protein, 11 aa, Yellow fever virus
ASMVNGVIKIL

SEQ ID NO: 176857 - protein, 11 aa, Yellow fever virus
SMVNGVIKILT

SEQ ID NO: 176858 - protein, 11 aa, Yellow fever virus
MVNGVIKILTY

SEQ ID NO: 176859 - protein, 11 aa, Yellow fever virus
VNGVIKILTYP

SEQ ID NO: 176860 - protein, 11 aa, Yellow fever virus
NGVIKILTYPW

SEQ ID NO: 176861 - protein, 11 aa, Yellow fever virus
GVIKILTYPWD

SEQ ID NO: 176862 - protein, 11 aa, Yellow fever virus
VIKILTYPWDR

SEQ ID NO: 176863 - protein, 11 aa, Yellow fever virus
IKILTYPWDRI

SEQ ID NO: 176864 - protein, 11 aa, Yellow fever virus
KILTYPWDRIE

SEQ ID NO: 176865 - protein, 11 aa, Yellow fever virus
ILTYPWDRIEE

SEQ ID NO: 176866 - protein, 11 aa, Yellow fever virus
LTYPWDRIEEV

SEQ ID NO: 176867 - protein, 11 aa, Yellow fever virus
TYPWDRIEEVT

SEQ ID NO: 176868 - protein, 11 aa, Yellow fever virus
YPWDRIEEVTR

SEQ ID NO: 176869 - protein, 11 aa, Yellow fever virus
PWDRIEEVTRM

SEQ ID NO: 176870 - protein, 11 aa, Yellow fever virus
WDRIEEVTRMA

SEQ ID NO: 176871 - protein, 11 aa, Yellow fever virus
DRIEEVTRMAM

SEQ ID NO: 176872 - protein, 11 aa, Yellow fever virus
RIEEVTRMAMT

SEQ ID NO: 176873 - protein, 11 aa, Yellow fever virus
IEEVTRMAMTD

SEQ ID NO: 176874 - protein, 11 aa, Yellow fever virus
EEVTRMAMTDT

SEQ ID NO: 176875 - protein, 11 aa, Yellow fever virus
EVTRMAMTDTT

SEQ ID NO: 176876 - protein, 11 aa, Yellow fever virus
VTRMAMTDTTP

SEQ ID NO: 176877 - protein, 11 aa, Yellow fever virus
TRMAMTDTTPF

SEQ ID NO: 176878 - protein, 11 aa, Yellow fever virus
RMAMTDTTPFG

SEQ ID NO: 176879 - protein, 11 aa, Yellow fever virus
MAMTDTTPFGQ

SEQ ID NO: 176880 - protein, 11 aa, Yellow fever virus
AMTDTTPFGQQ

SEQ ID NO: 176881 - protein, 11 aa, Yellow fever virus
MTDTTPFGQQR

SEQ ID NO: 176882 - protein, 11 aa, Yellow fever virus
TDTTPFGQQRV

SEQ ID NO: 176883 - protein, 11 aa, Yellow fever virus
DTTPFGQQRVF

SEQ ID NO: 176884 - protein, 11 aa, Yellow fever virus
TTPFGQQRVFK

SEQ ID NO: 176885 - protein, 11 aa, Yellow fever virus
TPFGQQRVFKE

SEQ ID NO: 176886 - protein, 11 aa, Yellow fever virus
PFGQQRVFKEK

SEQ ID NO: 176887 - protein, 11 aa, Yellow fever virus
FGQQRVFKEKV

SEQ ID NO: 176888 - protein, 11 aa, Yellow fever virus
GQQRVFKEKVD

SEQ ID NO: 176889 - protein, 11 aa, Yellow fever virus
QQRVFKEKVDT

SEQ ID NO: 176890 - protein, 11 aa, Yellow fever virus
QRVFKEKVDTR

SEQ ID NO: 176891 - protein, 11 aa, Yellow fever virus
RVFKEKVDTRA

SEQ ID NO: 176892 - protein, 11 aa, Yellow fever virus
VFKEKVDTRAK

SEQ ID NO: 176893 - protein, 11 aa, Yellow fever virus
FKEKVDTRAKD

SEQ ID NO: 176894 - protein, 11 aa, Yellow fever virus
KEKVDTRAKDP

SEQ ID NO: 176895 - protein, 11 aa, Yellow fever virus
EKVDTRAKDPP

SEQ ID NO: 176896 - protein, 11 aa, Yellow fever virus
KVDTRAKDPPA

SEQ ID NO: 176897 - protein, 11 aa, Yellow fever virus
VDTRAKDPPAG

SEQ ID NO: 176898 - protein, 11 aa, Yellow fever virus
DTRAKDPPAGT

SEQ ID NO: 176899 - protein, 11 aa, Yellow fever virus
TRAKDPPAGTR

SEQ ID NO: 176900 - protein, 11 aa, Yellow fever virus
RAKDPPAGTRK

SEQ ID NO: 176901 - protein, 11 aa, Yellow fever virus
AKDPPAGTRKI

SEQ ID NO: 176902 - protein, 11 aa, Yellow fever virus
KDPPAGTRKIM

SEQ ID NO: 176903 - protein, 11 aa, Yellow fever virus
DPPAGTRKIMK

SEQ ID NO: 176904 - protein, 11 aa, Yellow fever virus
PPAGTRKIMKV

SEQ ID NO: 176905 - protein, 11 aa, Yellow fever virus
PAGTRKIMKVV

SEQ ID NO: 176906 - protein, 11 aa, Yellow fever virus
AGTRKIMKVVN

SEQ ID NO: 176907 - protein, 11 aa, Yellow fever virus
GTRKIMKVVNR

SEQ ID NO: 176908 - protein, 11 aa, Yellow fever virus
TRKIMKVVNRW

SEQ ID NO: 176909 - protein, 11 aa, Yellow fever virus
RKIMKVVNRWL

SEQ ID NO: 176910 - protein, 11 aa, Yellow fever virus
KIMKVVNRWLF

SEQ ID NO: 176911 - protein, 11 aa, Yellow fever virus
IMKVVNRWLFR

SEQ ID NO: 176912 - protein, 11 aa, Yellow fever virus
MKVVNRWLFRH

SEQ ID NO: 176913 - protein, 11 aa, Yellow fever virus
KVVNRWLFRHL

SEQ ID NO: 176914 - protein, 11 aa, Yellow fever virus
VVNRWLFRHLA

SEQ ID NO: 176915 - protein, 11 aa, Yellow fever virus
VNRWLFRHLAR

SEQ ID NO: 176916 - protein, 11 aa, Yellow fever virus
NRWLFRHLARE

SEQ ID NO: 176917 - protein, 11 aa, Yellow fever virus
RWLFRHLAREK

SEQ ID NO: 176918 - protein, 11 aa, Yellow fever virus
WLFRHLAREKN

SEQ ID NO: 176919 - protein, 11 aa, Yellow fever virus
LFRHLAREKNP

SEQ ID NO: 176920 - protein, 11 aa, Yellow fever virus
FRHLAREKNPR

SEQ ID NO: 176921 - protein, 11 aa, Yellow fever virus
RHLAREKNPRL

SEQ ID NO: 176922 - protein, 11 aa, Yellow fever virus
HLAREKNPRLC

SEQ ID NO: 176923 - protein, 11 aa, Yellow fever virus
LAREKNPRLCT

SEQ ID NO: 176924 - protein, 11 aa, Yellow fever virus
AREKNPRLCTK

SEQ ID NO: 176925 - protein, 11 aa, Yellow fever virus
REKNPRLCTKE

SEQ ID NO: 176926 - protein, 11 aa, Yellow fever virus
EKNPRLCTKEE

SEQ ID NO: 176927 - protein, 11 aa, Yellow fever virus
KNPRLCTKEEF

SEQ ID NO: 176928 - protein, 11 aa, Yellow fever virus
NPRLCTKEEFI

SEQ ID NO: 176929 - protein, 11 aa, Yellow fever virus
PRLCTKEEFIA

SEQ ID NO: 176930 - protein, 11 aa, Yellow fever virus
RLCTKEEFIAK

SEQ ID NO: 176931 - protein, 11 aa, Yellow fever virus
LCTKEEFIAKV

SEQ ID NO: 176932 - protein, 11 aa, Yellow fever virus
CTKEEFIAKVR

SEQ ID NO: 176933 - protein, 11 aa, Yellow fever virus
TKEEFIAKVRS

SEQ ID NO: 176934 - protein, 11 aa, Yellow fever virus
KEEFIAKVRSH

SEQ ID NO: 176935 - protein, 11 aa, Yellow fever virus
EEFIAKVRSHA

SEQ ID NO: 176936 - protein, 11 aa, Yellow fever virus
EFIAKVRSHAA

SEQ ID NO: 176937 - protein, 11 aa, Yellow fever virus
FIAKVRSHAAI

SEQ ID NO: 176938 - protein, 11 aa, Yellow fever virus
IAKVRSHAAIG

SEQ ID NO: 176939 - protein, 11 aa, Yellow fever virus
AKVRSHAAIGA

SEQ ID NO: 176940 - protein, 11 aa, Yellow fever virus
KVRSHAAIGAY

SEQ ID NO: 176941 - protein, 11 aa, Yellow fever virus
VRSHAAIGAYL

SEQ ID NO: 176942 - protein, 11 aa, Yellow fever virus
RSHAAIGAYLE

SEQ ID NO: 176943 - protein, 11 aa, Yellow fever virus
SHAAIGAYLEE

SEQ ID NO: 176944 - protein, 11 aa, Yellow fever virus
HAAIGAYLEEQ

SEQ ID NO: 176945 - protein, 11 aa, Yellow fever virus
AAIGAYLEEQE

SEQ ID NO: 176946 - protein, 11 aa, Yellow fever virus
AIGAYLEEQEQ

SEQ ID NO: 176947 - protein, 11 aa, Yellow fever virus
IGAYLEEQEQW

SEQ ID NO: 176948 - protein, 11 aa, Yellow fever virus
GAYLEEQEQWK

SEQ ID NO: 176949 - protein, 11 aa, Yellow fever virus
AYLEEQEQWKT

SEQ ID NO: 176950 - protein, 11 aa, Yellow fever virus
YLEEQEQWKTA

SEQ ID NO: 176951 - protein, 11 aa, Yellow fever virus
LEEQEQWKTAN

SEQ ID NO: 176952 - protein, 11 aa, Yellow fever virus
EEQEQWKTANE

SEQ ID NO: 176953 - protein, 11 aa, Yellow fever virus
EQEQWKTANEA

SEQ ID NO: 176954 - protein, 11 aa, Yellow fever virus
QEQWKTANEAV

SEQ ID NO: 176955 - protein, 11 aa, Yellow fever virus
EQWKTANEAVQ

SEQ ID NO: 176956 - protein, 11 aa, Yellow fever virus
QWKTANEAVQD

SEQ ID NO: 176957 - protein, 11 aa, Yellow fever virus
WKTANEAVQDP

SEQ ID NO: 176958 - protein, 11 aa, Yellow fever virus
KTANEAVQDPK

SEQ ID NO: 176959 - protein, 11 aa, Yellow fever virus
TANEAVQDPKF

SEQ ID NO: 176960 - protein, 11 aa, Yellow fever virus
ANEAVQDPKFW

SEQ ID NO: 176961 - protein, 11 aa, Yellow fever virus
NEAVQDPKFWE

SEQ ID NO: 176962 - protein, 11 aa, Yellow fever virus
EAVQDPKFWEL

SEQ ID NO: 176963 - protein, 11 aa, Yellow fever virus
AVQDPKFWELV

SEQ ID NO: 176964 - protein, 11 aa, Yellow fever virus
VQDPKFWELVD

SEQ ID NO: 176965 - protein, 11 aa, Yellow fever virus
QDPKFWELVDE

SEQ ID NO: 176966 - protein, 11 aa, Yellow fever virus
DPKFWELVDEE

SEQ ID NO: 176967 - protein, 11 aa, Yellow fever virus
PKFWELVDEER

SEQ ID NO: 176968 - protein, 11 aa, Yellow fever virus
KFWELVDEERK

SEQ ID NO: 176969 - protein, 11 aa, Yellow fever virus
FWELVDEERKL

SEQ ID NO: 176970 - protein, 11 aa, Yellow fever virus
WELVDEERKLH

SEQ ID NO: 176971 - protein, 11 aa, Yellow fever virus
ELVDEERKLHQ

SEQ ID NO: 176972 - protein, 11 aa, Yellow fever virus
LVDEERKLHQQ

SEQ ID NO: 176973 - protein, 11 aa, Yellow fever virus
VDEERKLHQQG

SEQ ID NO: 176974 - protein, 11 aa, Yellow fever virus
DEERKLHQQGR

SEQ ID NO: 176975 - protein, 11 aa, Yellow fever virus
EERKLHQQGRC

SEQ ID NO: 176976 - protein, 11 aa, Yellow fever virus
ERKLHQQGRCR

SEQ ID NO: 176977 - protein, 11 aa, Yellow fever virus
RKLHQQGRCRT

SEQ ID NO: 176978 - protein, 11 aa, Yellow fever virus
KLHQQGRCRTC

SEQ ID NO: 176979 - protein, 11 aa, Yellow fever virus
LHQQGRCRTCV

SEQ ID NO: 176980 - protein, 11 aa, Yellow fever virus
HQQGRCRTCVY

SEQ ID NO: 176981 - protein, 11 aa, Yellow fever virus
QQGRCRTCVYN

SEQ ID NO: 176982 - protein, 11 aa, Yellow fever virus
QGRCRTCVYNM

SEQ ID NO: 176983 - protein, 11 aa, Yellow fever virus
GRCRTCVYNMM

SEQ ID NO: 176984 - protein, 11 aa, Yellow fever virus
RCRTCVYNMMG

SEQ ID NO: 176985 - protein, 11 aa, Yellow fever virus
CRTCVYNMMGK

SEQ ID NO: 176986 - protein, 11 aa, Yellow fever virus
RTCVYNMMGKR

SEQ ID NO: 176987 - protein, 11 aa, Yellow fever virus
TCVYNMMGKRE

SEQ ID NO: 176988 - protein, 11 aa, Yellow fever virus
CVYNMMGKREK

SEQ ID NO: 176989 - protein, 11 aa, Yellow fever virus
VYNMMGKREKK

SEQ ID NO: 176990 - protein, 11 aa, Yellow fever virus
YNMMGKREKKL

SEQ ID NO: 176991 - protein, 11 aa, Yellow fever virus
NMMGKREKKLS

SEQ ID NO: 176992 - protein, 11 aa, Yellow fever virus
MMGKREKKLSE

SEQ ID NO: 176993 - protein, 11 aa, Yellow fever virus
MGKREKKLSEF

SEQ ID NO: 176994 - protein, 11 aa, Yellow fever virus
GKREKKLSEFG

SEQ ID NO: 176995 - protein, 11 aa, Yellow fever virus
KREKKLSEFGK

SEQ ID NO: 176996 - protein, 11 aa, Yellow fever virus
REKKLSEFGKA

SEQ ID NO: 176997 - protein, 11 aa, Yellow fever virus
EKKLSEFGKAK

SEQ ID NO: 176998 - protein, 11 aa, Yellow fever virus
KKLSEFGKAKG

SEQ ID NO: 176999 - protein, 11 aa, Yellow fever virus
KLSEFGKAKGS

SEQ ID NO: 177000 - protein, 11 aa, Yellow fever virus
LSEFGKAKGSR

SEQ ID NO: 177001 - protein, 11 aa, Yellow fever virus
SEFGKAKGSRA

SEQ ID NO: 177002 - protein, 11 aa, Yellow fever virus
EFGKAKGSRAI

SEQ ID NO: 177003 - protein, 11 aa, Yellow fever virus
FGKAKGSRAIW

SEQ ID NO: 177004 - protein, 11 aa, Yellow fever virus
GKAKGSRAIWY

SEQ ID NO: 177005 - protein, 11 aa, Yellow fever virus
KAKGSRAIWYM

SEQ ID NO: 177006 - protein, 11 aa, Yellow fever virus
AKGSRAIWYMW

SEQ ID NO: 177007 - protein, 11 aa, Yellow fever virus
KGSRAIWYMWL

SEQ ID NO: 177008 - protein, 11 aa, Yellow fever virus
GSRAIWYMWLG

SEQ ID NO: 177009 - protein, 11 aa, Yellow fever virus
SRAIWYMWLGA

SEQ ID NO: 177010 - protein, 11 aa, Yellow fever virus
RAIWYMWLGAR

SEQ ID NO: 177011 - protein, 11 aa, Yellow fever virus
AIWYMWLGARY

SEQ ID NO: 177012 - protein, 11 aa, Yellow fever virus
IWYMWLGARYL

SEQ ID NO: 177013 - protein, 11 aa, Yellow fever virus
WYMWLGARYLE

SEQ ID NO: 177014 - protein, 11 aa, Yellow fever virus
YMWLGARYLEF

SEQ ID NO: 177015 - protein, 11 aa, Yellow fever virus
MWLGARYLEFE

SEQ ID NO: 177016 - protein, 11 aa, Yellow fever virus
WLGARYLEFEA

SEQ ID NO: 177017 - protein, 11 aa, Yellow fever virus
LGARYLEFEAL

SEQ ID NO: 177018 - protein, 11 aa, Yellow fever virus
GARYLEFEALG

SEQ ID NO: 177019 - protein, 11 aa, Yellow fever virus
ARYLEFEALGF

SEQ ID NO: 177020 - protein, 11 aa, Yellow fever virus
RYLEFEALGFL

SEQ ID NO: 177021 - protein, 11 aa, Yellow fever virus
YLEFEALGFLN

SEQ ID NO: 177022 - protein, 11 aa, Yellow fever virus
LEFEALGFLNE

SEQ ID NO: 177023 - protein, 11 aa, Yellow fever virus
EFEALGFLNED

SEQ ID NO: 177024 - protein, 11 aa, Yellow fever virus
FEALGFLNEDH

SEQ ID NO: 177025 - protein, 11 aa, Yellow fever virus
EALGFLNEDHW

SEQ ID NO: 177026 - protein, 11 aa, Yellow fever virus
ALGFLNEDHWA

SEQ ID NO: 177027 - protein, 11 aa, Yellow fever virus
LGFLNEDHWAS

SEQ ID NO: 177028 - protein, 11 aa, Yellow fever virus
GFLNEDHWASR

SEQ ID NO: 177029 - protein, 11 aa, Yellow fever virus
FLNEDHWASRE

SEQ ID NO: 177030 - protein, 11 aa, Yellow fever virus
LNEDHWASREN

SEQ ID NO: 177031 - protein, 11 aa, Yellow fever virus
NEDHWASRENS

SEQ ID NO: 177032 - protein, 11 aa, Yellow fever virus
EDHWASRENSG

SEQ ID NO: 177033 - protein, 11 aa, Yellow fever virus
DHWASRENSGG

SEQ ID NO: 177034 - protein, 11 aa, Yellow fever virus
HWASRENSGGG

SEQ ID NO: 177035 - protein, 11 aa, Yellow fever virus
WASRENSGGGV

SEQ ID NO: 177036 - protein, 11 aa, Yellow fever virus
ASRENSGGGVE

SEQ ID NO: 177037 - protein, 11 aa, Yellow fever virus
SRENSGGGVEG

SEQ ID NO: 177038 - protein, 11 aa, Yellow fever virus
RENSGGGVEGI

SEQ ID NO: 177039 - protein, 11 aa, Yellow fever virus
ENSGGGVEGIG

SEQ ID NO: 177040 - protein, 11 aa, Yellow fever virus
NSGGGVEGIGL

SEQ ID NO: 177041 - protein, 11 aa, Yellow fever virus
SGGGVEGIGLQ

SEQ ID NO: 177042 - protein, 11 aa, Yellow fever virus
GGGVEGIGLQY

SEQ ID NO: 177043 - protein, 11 aa, Yellow fever virus
GGVEGIGLQYL

SEQ ID NO: 177044 - protein, 11 aa, Yellow fever virus
GVEGIGLQYLG

SEQ ID NO: 177045 - protein, 11 aa, Yellow fever virus
VEGIGLQYLGY

SEQ ID NO: 177046 - protein, 11 aa, Yellow fever virus
EGIGLQYLGYV

SEQ ID NO: 177047 - protein, 11 aa, Yellow fever virus
GIGLQYLGYVI

SEQ ID NO: 177048 - protein, 11 aa, Yellow fever virus
IGLQYLGYVIR

SEQ ID NO: 177049 - protein, 11 aa, Yellow fever virus
GLQYLGYVIRD

SEQ ID NO: 177050 - protein, 11 aa, Yellow fever virus
LQYLGYVIRDL

SEQ ID NO: 177051 - protein, 11 aa, Yellow fever virus
QYLGYVIRDLA

SEQ ID NO: 177052 - protein, 11 aa, Yellow fever virus
YLGYVIRDLAA

SEQ ID NO: 177053 - protein, 11 aa, Yellow fever virus
LGYVIRDLAAM

SEQ ID NO: 177054 - protein, 11 aa, Yellow fever virus
GYVIRDLAAMD

SEQ ID NO: 177055 - protein, 11 aa, Yellow fever virus
YVIRDLAAMDG

SEQ ID NO: 177056 - protein, 11 aa, Yellow fever virus
VIRDLAAMDGG

SEQ ID NO: 177057 - protein, 11 aa, Yellow fever virus
IRDLAAMDGGG

SEQ ID NO: 177058 - protein, 11 aa, Yellow fever virus
RDLAAMDGGGF

SEQ ID NO: 177059 - protein, 11 aa, Yellow fever virus
DLAAMDGGGFY

SEQ ID NO: 177060 - protein, 11 aa, Yellow fever virus
LAAMDGGGFYA

SEQ ID NO: 177061 - protein, 11 aa, Yellow fever virus
AAMDGGGFYAD

SEQ ID NO: 177062 - protein, 11 aa, Yellow fever virus
AMDGGGFYADD

SEQ ID NO: 177063 - protein, 11 aa, Yellow fever virus
MDGGGFYADDT

SEQ ID NO: 177064 - protein, 11 aa, Yellow fever virus
DGGGFYADDTA

SEQ ID NO: 177065 - protein, 11 aa, Yellow fever virus
GGGFYADDTAG

SEQ ID NO: 177066 - protein, 11 aa, Yellow fever virus
GGFYADDTAGW

SEQ ID NO: 177067 - protein, 11 aa, Yellow fever virus
GFYADDTAGWD

SEQ ID NO: 177068 - protein, 11 aa, Yellow fever virus
FYADDTAGWDT

SEQ ID NO: 177069 - protein, 11 aa, Yellow fever virus
YADDTAGWDTR

SEQ ID NO: 177070 - protein, 11 aa, Yellow fever virus
ADDTAGWDTRI

SEQ ID NO: 177071 - protein, 11 aa, Yellow fever virus
DDTAGWDTRIT

SEQ ID NO: 177072 - protein, 11 aa, Yellow fever virus
DTAGWDTRITE

SEQ ID NO: 177073 - protein, 11 aa, Yellow fever virus
TAGWDTRITEA

SEQ ID NO: 177074 - protein, 11 aa, Yellow fever virus
AGWDTRITEAD

SEQ ID NO: 177075 - protein, 11 aa, Yellow fever virus
GWDTRITEADL

SEQ ID NO: 177076 - protein, 11 aa, Yellow fever virus
WDTRITEADLD

SEQ ID NO: 177077 - protein, 11 aa, Yellow fever virus
DTRITEADLDD

SEQ ID NO: 177078 - protein, 11 aa, Yellow fever virus
TRITEADLDDE

SEQ ID NO: 177079 - protein, 11 aa, Yellow fever virus
RITEADLDDEQ

SEQ ID NO: 177080 - protein, 11 aa, Yellow fever virus
ITEADLDDEQE

SEQ ID NO: 177081 - protein, 11 aa, Yellow fever virus
TEADLDDEQEI

SEQ ID NO: 177082 - protein, 11 aa, Yellow fever virus
EADLDDEQEIL

SEQ ID NO: 177083 - protein, 11 aa, Yellow fever virus
ADLDDEQEILN

SEQ ID NO: 177084 - protein, 11 aa, Yellow fever virus
DLDDEQEILNY

SEQ ID NO: 177085 - protein, 11 aa, Yellow fever virus
LDDEQEILNYM

SEQ ID NO: 177086 - protein, 11 aa, Yellow fever virus
DDEQEILNYMS

SEQ ID NO: 177087 - protein, 11 aa, Yellow fever virus
DEQEILNYMSP

SEQ ID NO: 177088 - protein, 11 aa, Yellow fever virus
EQEILNYMSPH

SEQ ID NO: 177089 - protein, 11 aa, Yellow fever virus
QEILNYMSPHH

SEQ ID NO: 177090 - protein, 11 aa, Yellow fever virus
EILNYMSPHHK

SEQ ID NO: 177091 - protein, 11 aa, Yellow fever virus
ILNYMSPHHKK

SEQ ID NO: 177092 - protein, 11 aa, Yellow fever virus
LNYMSPHHKKL

SEQ ID NO: 177093 - protein, 11 aa, Yellow fever virus
NYMSPHHKKLA

SEQ ID NO: 177094 - protein, 11 aa, Yellow fever virus
YMSPHHKKLAQ

SEQ ID NO: 177095 - protein, 11 aa, Yellow fever virus
MSPHHKKLAQA

SEQ ID NO: 177096 - protein, 11 aa, Yellow fever virus
SPHHKKLAQAV

SEQ ID NO: 177097 - protein, 11 aa, Yellow fever virus
PHHKKLAQAVM

SEQ ID NO: 177098 - protein, 11 aa, Yellow fever virus
HHKKLAQAVME

SEQ ID NO: 177099 - protein, 11 aa, Yellow fever virus
HKKLAQAVMEM

SEQ ID NO: 177100 - protein, 11 aa, Yellow fever virus
KKLAQAVMEMT

SEQ ID NO: 177101 - protein, 11 aa, Yellow fever virus
KLAQAVMEMTY

SEQ ID NO: 177102 - protein, 11 aa, Yellow fever virus
LAQAVMEMTYK

SEQ ID NO: 177103 - protein, 11 aa, Yellow fever virus
AQAVMEMTYKN

SEQ ID NO: 177104 - protein, 11 aa, Yellow fever virus
QAVMEMTYKNK

SEQ ID NO: 177105 - protein, 11 aa, Yellow fever virus
AVMEMTYKNKV

SEQ ID NO: 177106 - protein, 11 aa, Yellow fever virus
VMEMTYKNKVV

SEQ ID NO: 177107 - protein, 11 aa, Yellow fever virus
MEMTYKNKVVK

SEQ ID NO: 177108 - protein, 11 aa, Yellow fever virus
EMTYKNKVVKV

SEQ ID NO: 177109 - protein, 11 aa, Yellow fever virus
MTYKNKVVKVL

SEQ ID NO: 177110 - protein, 11 aa, Yellow fever virus
TYKNKVVKVLR

SEQ ID NO: 177111 - protein, 11 aa, Yellow fever virus
YKNKVVKVLRP

SEQ ID NO: 177112 - protein, 11 aa, Yellow fever virus
KNKVVKVLRPA

SEQ ID NO: 177113 - protein, 11 aa, Yellow fever virus
NKVVKVLRPAP

SEQ ID NO: 177114 - protein, 11 aa, Yellow fever virus
KVVKVLRPAPG

SEQ ID NO: 177115 - protein, 11 aa, Yellow fever virus
VVKVLRPAPGG

SEQ ID NO: 177116 - protein, 11 aa, Yellow fever virus
VKVLRPAPGGK

SEQ ID NO: 177117 - protein, 11 aa, Yellow fever virus
KVLRPAPGGKA

SEQ ID NO: 177118 - protein, 11 aa, Yellow fever virus
VLRPAPGGKAY

SEQ ID NO: 177119 - protein, 11 aa, Yellow fever virus
LRPAPGGKAYM

SEQ ID NO: 177120 - protein, 11 aa, Yellow fever virus
RPAPGGKAYMD

SEQ ID NO: 177121 - protein, 11 aa, Yellow fever virus
PAPGGKAYMDV

SEQ ID NO: 177122 - protein, 11 aa, Yellow fever virus
APGGKAYMDVI

SEQ ID NO: 177123 - protein, 11 aa, Yellow fever virus
PGGKAYMDVIS

SEQ ID NO: 177124 - protein, 11 aa, Yellow fever virus
GGKAYMDVISR

SEQ ID NO: 177125 - protein, 11 aa, Yellow fever virus
GKAYMDVISRR

SEQ ID NO: 177126 - protein, 11 aa, Yellow fever virus
KAYMDVISRRD

SEQ ID NO: 177127 - protein, 11 aa, Yellow fever virus
AYMDVISRRDQ

SEQ ID NO: 177128 - protein, 11 aa, Yellow fever virus
YMDVISRRDQR

SEQ ID NO: 177129 - protein, 11 aa, Yellow fever virus
MDVISRRDQRG

SEQ ID NO: 177130 - protein, 11 aa, Yellow fever virus
DVISRRDQRGS

SEQ ID NO: 177131 - protein, 11 aa, Yellow fever virus
VISRRDQRGSG

SEQ ID NO: 177132 - protein, 11 aa, Yellow fever virus
ISRRDQRGSGQ

SEQ ID NO: 177133 - protein, 11 aa, Yellow fever virus
SRRDQRGSGQV

SEQ ID NO: 177134 - protein, 11 aa, Yellow fever virus
RRDQRGSGQVV

SEQ ID NO: 177135 - protein, 11 aa, Yellow fever virus
RDQRGSGQVVT

SEQ ID NO: 177136 - protein, 11 aa, Yellow fever virus
DQRGSGQVVTY

SEQ ID NO: 177137 - protein, 11 aa, Yellow fever virus
QRGSGQVVTYA

SEQ ID NO: 177138 - protein, 11 aa, Yellow fever virus
RGSGQVVTYAL

SEQ ID NO: 177139 - protein, 11 aa, Yellow fever virus
GSGQVVTYALN

SEQ ID NO: 177140 - protein, 11 aa, Yellow fever virus
SGQVVTYALNT

SEQ ID NO: 177141 - protein, 11 aa, Yellow fever virus
GQVVTYALNTI

SEQ ID NO: 177142 - protein, 11 aa, Yellow fever virus
QVVTYALNTIT

SEQ ID NO: 177143 - protein, 11 aa, Yellow fever virus
VVTYALNTITN

SEQ ID NO: 177144 - protein, 11 aa, Yellow fever virus
VTYALNTITNL

SEQ ID NO: 177145 - protein, 11 aa, Yellow fever virus
TYALNTITNLK

SEQ ID NO: 177146 - protein, 11 aa, Yellow fever virus
YALNTITNLKV

SEQ ID NO: 177147 - protein, 11 aa, Yellow fever virus
ALNTITNLKVQ

SEQ ID NO: 177148 - protein, 11 aa, Yellow fever virus
LNTITNLKVQL

SEQ ID NO: 177149 - protein, 11 aa, Yellow fever virus
NTITNLKVQLI

SEQ ID NO: 177150 - protein, 11 aa, Yellow fever virus
TITNLKVQLIR

SEQ ID NO: 177151 - protein, 11 aa, Yellow fever virus
ITNLKVQLIRM

SEQ ID NO: 177152 - protein, 11 aa, Yellow fever virus
TNLKVQLIRMA

SEQ ID NO: 177153 - protein, 11 aa, Yellow fever virus
NLKVQLIRMAE

SEQ ID NO: 177154 - protein, 11 aa, Yellow fever virus
LKVQLIRMAEA

SEQ ID NO: 177155 - protein, 11 aa, Yellow fever virus
KVQLIRMAEAE

SEQ ID NO: 177156 - protein, 11 aa, Yellow fever virus
VQLIRMAEAEM

SEQ ID NO: 177157 - protein, 11 aa, Yellow fever virus
QLIRMAEAEMV

SEQ ID NO: 177158 - protein, 11 aa, Yellow fever virus
LIRMAEAEMVI

SEQ ID NO: 177159 - protein, 11 aa, Yellow fever virus
IRMAEAEMVIH

SEQ ID NO: 177160 - protein, 11 aa, Yellow fever virus
RMAEAEMVIHH

SEQ ID NO: 177161 - protein, 11 aa, Yellow fever virus
MAEAEMVIHHQ

SEQ ID NO: 177162 - protein, 11 aa, Yellow fever virus
AEAEMVIHHQH

SEQ ID NO: 177163 - protein, 11 aa, Yellow fever virus
EAEMVIHHQHV

SEQ ID NO: 177164 - protein, 11 aa, Yellow fever virus
AEMVIHHQHVQ

SEQ ID NO: 177165 - protein, 11 aa, Yellow fever virus
EMVIHHQHVQD

SEQ ID NO: 177166 - protein, 11 aa, Yellow fever virus
MVIHHQHVQDC

SEQ ID NO: 177167 - protein, 11 aa, Yellow fever virus
VIHHQHVQDCD

SEQ ID NO: 177168 - protein, 11 aa, Yellow fever virus
IHHQHVQDCDE

SEQ ID NO: 177169 - protein, 11 aa, Yellow fever virus
HHQHVQDCDES

SEQ ID NO: 177170 - protein, 11 aa, Yellow fever virus
LTRLEAWLTEH

SEQ ID NO: 177171 - protein, 11 aa, Yellow fever virus
TRLEAWLTEHG

SEQ ID NO: 177172 - protein, 11 aa, Yellow fever virus
RLEAWLTEHGC

SEQ ID NO: 177173 - protein, 11 aa, Yellow fever virus
LEAWLTEHGCN

SEQ ID NO: 177174 - protein, 11 aa, Yellow fever virus
EAWLTEHGCNR

SEQ ID NO: 177175 - protein, 11 aa, Yellow fever virus
AWLTEHGCNRL

SEQ ID NO: 177176 - protein, 11 aa, Yellow fever virus
RLKRMAVSGDD

SEQ ID NO: 177177 - protein, 11 aa, Yellow fever virus
LKRMAVSGDDC

SEQ ID NO: 177178 - protein, 11 aa, Yellow fever virus
KRMAVSGDDCV

SEQ ID NO: 177179 - protein, 11 aa, Yellow fever virus
RMAVSGDDCVV

SEQ ID NO: 177180 - protein, 11 aa, Yellow fever virus
MAVSGDDCVVR

SEQ ID NO: 177181 - protein, 11 aa, Yellow fever virus
AVSGDDCVVRP

SEQ ID NO: 177182 - protein, 11 aa, Yellow fever virus
VSGDDCVVRPI

SEQ ID NO: 177183 - protein, 11 aa, Yellow fever virus
SGDDCVVRPID

SEQ ID NO: 177184 - protein, 11 aa, Yellow fever virus
GDDCVVRPIDD

SEQ ID NO: 177185 - protein, 11 aa, Yellow fever virus
DDCVVRPIDDR

SEQ ID NO: 177186 - protein, 11 aa, Yellow fever virus
DCVVRPIDDRF

SEQ ID NO: 177187 - protein, 11 aa, Yellow fever virus
CVVRPIDDRFG

SEQ ID NO: 177188 - protein, 11 aa, Yellow fever virus
VVRPIDDRFGL

SEQ ID NO: 177189 - protein, 11 aa, Yellow fever virus
VRPIDDRFGLA

SEQ ID NO: 177190 - protein, 11 aa, Yellow fever virus
RPIDDRFGLAL

SEQ ID NO: 177191 - protein, 11 aa, Yellow fever virus
PIDDRFGLALS

SEQ ID NO: 177192 - protein, 11 aa, Yellow fever virus
IDDRFGLALSH

SEQ ID NO: 177193 - protein, 11 aa, Yellow fever virus
DDRFGLALSHL

SEQ ID NO: 177194 - protein, 11 aa, Yellow fever virus
DRFGLALSHLN

SEQ ID NO: 177195 - protein, 11 aa, Yellow fever virus
RFGLALSHLNA

SEQ ID NO: 177196 - protein, 11 aa, Yellow fever virus
FGLALSHLNAM

SEQ ID NO: 177197 - protein, 11 aa, Yellow fever virus
GLALSHLNAMS

SEQ ID NO: 177198 - protein, 11 aa, Yellow fever virus
LALSHLNAMSK

SEQ ID NO: 177199 - protein, 11 aa, Yellow fever virus
ALSHLNAMSKV

SEQ ID NO: 177200 - protein, 11 aa, Yellow fever virus
LSHLNAMSKVR

SEQ ID NO: 177201 - protein, 11 aa, Yellow fever virus
SHLNAMSKVRK

SEQ ID NO: 177202 - protein, 11 aa, Yellow fever virus
HLNAMSKVRKD

SEQ ID NO: 177203 - protein, 11 aa, Yellow fever virus
LNAMSKVRKDI

SEQ ID NO: 177204 - protein, 11 aa, Yellow fever virus
NAMSKVRKDIS

SEQ ID NO: 177205 - protein, 11 aa, Yellow fever virus
AMSKVRKDISE

SEQ ID NO: 177206 - protein, 11 aa, Yellow fever virus
MSKVRKDISEW

SEQ ID NO: 177207 - protein, 11 aa, Yellow fever virus
SKVRKDISEWQ

SEQ ID NO: 177208 - protein, 11 aa, Yellow fever virus
KVRKDISEWQP

SEQ ID NO: 177209 - protein, 11 aa, Yellow fever virus
VRKDISEWQPS

SEQ ID NO: 177210 - protein, 11 aa, Yellow fever virus
RKDISEWQPSK

SEQ ID NO: 177211 - protein, 11 aa, Yellow fever virus
KDISEWQPSKG

SEQ ID NO: 177212 - protein, 11 aa, Yellow fever virus
DISEWQPSKGW

SEQ ID NO: 177213 - protein, 11 aa, Yellow fever virus
ISEWQPSKGWN

SEQ ID NO: 177214 - protein, 11 aa, Yellow fever virus
SEWQPSKGWND

SEQ ID NO: 177215 - protein, 11 aa, Yellow fever virus
EWQPSKGWNDW

SEQ ID NO: 177216 - protein, 11 aa, Yellow fever virus
WQPSKGWNDWE

SEQ ID NO: 177217 - protein, 11 aa, Yellow fever virus
QPSKGWNDWEN

SEQ ID NO: 177218 - protein, 11 aa, Yellow fever virus
PSKGWNDWENV

SEQ ID NO: 177219 - protein, 11 aa, Yellow fever virus
SKGWNDWENVP

SEQ ID NO: 177220 - protein, 11 aa, Yellow fever virus
KGWNDWENVPF

SEQ ID NO: 177221 - protein, 11 aa, Yellow fever virus
GWNDWENVPFC

SEQ ID NO: 177222 - protein, 11 aa, Yellow fever virus
WNDWENVPFCS

SEQ ID NO: 177223 - protein, 11 aa, Yellow fever virus
NDWENVPFCSH

SEQ ID NO: 177224 - protein, 11 aa, Yellow fever virus
DWENVPFCSHH

SEQ ID NO: 177225 - protein, 11 aa, Yellow fever virus
WENVPFCSHHF

SEQ ID NO: 177226 - protein, 11 aa, Yellow fever virus
ENVPFCSHHFH

SEQ ID NO: 177227 - protein, 11 aa, Yellow fever virus
NVPFCSHHFHE

SEQ ID NO: 177228 - protein, 11 aa, Yellow fever virus
VPFCSHHFHEL

SEQ ID NO: 177229 - protein, 11 aa, Yellow fever virus
PFCSHHFHELQ

SEQ ID NO: 177230 - protein, 11 aa, Yellow fever virus
FCSHHFHELQL

SEQ ID NO: 177231 - protein, 11 aa, Yellow fever virus
CSHHFHELQLK

SEQ ID NO: 177232 - protein, 11 aa, Yellow fever virus
SHHFHELQLKD

SEQ ID NO: 177233 - protein, 11 aa, Yellow fever virus
HHFHELQLKDG

SEQ ID NO: 177234 - protein, 11 aa, Yellow fever virus
HFHELQLKDGR

SEQ ID NO: 177235 - protein, 11 aa, Yellow fever virus
FHELQLKDGRR

SEQ ID NO: 177236 - protein, 11 aa, Yellow fever virus
HELQLKDGRRI

SEQ ID NO: 177237 - protein, 11 aa, Yellow fever virus
ELQLKDGRRIV

SEQ ID NO: 177238 - protein, 11 aa, Yellow fever virus
LQLKDGRRIVV

SEQ ID NO: 177239 - protein, 11 aa, Yellow fever virus
QLKDGRRIVVP

SEQ ID NO: 177240 - protein, 11 aa, Yellow fever virus
LKDGRRIVVPC

SEQ ID NO: 177241 - protein, 11 aa, Yellow fever virus
KDGRRIVVPCR

SEQ ID NO: 177242 - protein, 11 aa, Yellow fever virus
DGRRIVVPCRE

SEQ ID NO: 177243 - protein, 11 aa, Yellow fever virus
GRRIVVPCREQ

SEQ ID NO: 177244 - protein, 11 aa, Yellow fever virus
RRIVVPCREQD

SEQ ID NO: 177245 - protein, 11 aa, Yellow fever virus
RIVVPCREQDE

SEQ ID NO: 177246 - protein, 11 aa, Yellow fever virus
IVVPCREQDEL

SEQ ID NO: 177247 - protein, 11 aa, Yellow fever virus
VVPCREQDELI

SEQ ID NO: 177248 - protein, 11 aa, Yellow fever virus
VPCREQDELIG

SEQ ID NO: 177249 - protein, 11 aa, Yellow fever virus
PCREQDELIGR

SEQ ID NO: 177250 - protein, 11 aa, Yellow fever virus
CREQDELIGRG

SEQ ID NO: 177251 - protein, 11 aa, Yellow fever virus
REQDELIGRGR

SEQ ID NO: 177252 - protein, 11 aa, Yellow fever virus
EQDELIGRGRV

SEQ ID NO: 177253 - protein, 11 aa, Yellow fever virus
QDELIGRGRVS

SEQ ID NO: 177254 - protein, 11 aa, Yellow fever virus
DELIGRGRVSP

SEQ ID NO: 177255 - protein, 11 aa, Yellow fever virus
ELIGRGRVSPG

SEQ ID NO: 177256 - protein, 11 aa, Yellow fever virus
LIGRGRVSPGN

SEQ ID NO: 177257 - protein, 11 aa, Yellow fever virus
IGRGRVSPGNG

SEQ ID NO: 177258 - protein, 11 aa, Yellow fever virus
GRGRVSPGNGW

SEQ ID NO: 177259 - protein, 11 aa, Yellow fever virus
RGRVSPGNGWM

SEQ ID NO: 177260 - protein, 11 aa, Yellow fever virus
GRVSPGNGWMI

SEQ ID NO: 177261 - protein, 11 aa, Yellow fever virus
RVSPGNGWMIK

SEQ ID NO: 177262 - protein, 11 aa, Yellow fever virus
VSPGNGWMIKE

SEQ ID NO: 177263 - protein, 11 aa, Yellow fever virus
SPGNGWMIKET

SEQ ID NO: 177264 - protein, 11 aa, Yellow fever virus
PGNGWMIKETA

SEQ ID NO: 177265 - protein, 11 aa, Yellow fever virus
GNGWMIKETAC

SEQ ID NO: 177266 - protein, 11 aa, Yellow fever virus
NGWMIKETACL

SEQ ID NO: 177267 - protein, 11 aa, Yellow fever virus
GWMIKETACLS

SEQ ID NO: 177268 - protein, 11 aa, Yellow fever virus
WMIKETACLSK

SEQ ID NO: 177269 - protein, 11 aa, Yellow fever virus
MIKETACLSKA

SEQ ID NO: 177270 - protein, 11 aa, Yellow fever virus
IKETACLSKAY

SEQ ID NO: 177271 - protein, 11 aa, Yellow fever virus
KETACLSKAYA

SEQ ID NO: 177272 - protein, 11 aa, Yellow fever virus
ETACLSKAYAN

SEQ ID NO: 177273 - protein, 11 aa, Yellow fever virus
TACLSKAYANM

SEQ ID NO: 177274 - protein, 11 aa, Yellow fever virus
ACLSKAYANMW

SEQ ID NO: 177275 - protein, 11 aa, Yellow fever virus
CLSKAYANMWS

SEQ ID NO: 177276 - protein, 11 aa, Yellow fever virus
LSKAYANMWSL

SEQ ID NO: 177277 - protein, 11 aa, Yellow fever virus
SKAYANMWSLM

SEQ ID NO: 177278 - protein, 11 aa, Yellow fever virus
KAYANMWSLMY

SEQ ID NO: 177279 - protein, 11 aa, Yellow fever virus
AYANMWSLMYF

SEQ ID NO: 177280 - protein, 11 aa, Yellow fever virus
YANMWSLMYFH

SEQ ID NO: 177281 - protein, 11 aa, Yellow fever virus
ANMWSLMYFHK

SEQ ID NO: 177282 - protein, 11 aa, Yellow fever virus
NMWSLMYFHKR

SEQ ID NO: 177283 - protein, 11 aa, Yellow fever virus
MWSLMYFHKRD

SEQ ID NO: 177284 - protein, 11 aa, Yellow fever virus
WSLMYFHKRDM

SEQ ID NO: 177285 - protein, 11 aa, Yellow fever virus
SLMYFHKRDMR

SEQ ID NO: 177286 - protein, 11 aa, Yellow fever virus
LMYFHKRDMRL

SEQ ID NO: 177287 - protein, 11 aa, Yellow fever virus
MYFHKRDMRLL

SEQ ID NO: 177288 - protein, 11 aa, Yellow fever virus
YFHKRDMRLLS

SEQ ID NO: 177289 - protein, 11 aa, Yellow fever virus
FHKRDMRLLSL

SEQ ID NO: 177290 - protein, 11 aa, Yellow fever virus
HKRDMRLLSLA

SEQ ID NO: 177291 - protein, 11 aa, Yellow fever virus
KRDMRLLSLAV

SEQ ID NO: 177292 - protein, 11 aa, Yellow fever virus
RDMRLLSLAVS

SEQ ID NO: 177293 - protein, 11 aa, Yellow fever virus
DMRLLSLAVSS

SEQ ID NO: 177294 - protein, 11 aa, Yellow fever virus
MRLLSLAVSSA

SEQ ID NO: 177295 - protein, 11 aa, Yellow fever virus
RLLSLAVSSAV

SEQ ID NO: 177296 - protein, 11 aa, Yellow fever virus
LLSLAVSSAVP

SEQ ID NO: 177297 - protein, 11 aa, Yellow fever virus
LSLAVSSAVPT

SEQ ID NO: 177298 - protein, 11 aa, Yellow fever virus
SLAVSSAVPTS

SEQ ID NO: 177299 - protein, 11 aa, Yellow fever virus
LAVSSAVPTSW

SEQ ID NO: 177300 - protein, 11 aa, Yellow fever virus
AVSSAVPTSWV

SEQ ID NO: 177301 - protein, 11 aa, Yellow fever virus
VSSAVPTSWVP

SEQ ID NO: 177302 - protein, 11 aa, Yellow fever virus
SSAVPTSWVPQ

SEQ ID NO: 177303 - protein, 11 aa, Yellow fever virus
SAVPTSWVPQG

SEQ ID NO: 177304 - protein, 11 aa, Yellow fever virus
AVPTSWVPQGR

SEQ ID NO: 177305 - protein, 11 aa, Yellow fever virus
VPTSWVPQGRT

SEQ ID NO: 177306 - protein, 11 aa, Yellow fever virus
PTSWVPQGRTT

SEQ ID NO: 177307 - protein, 11 aa, Yellow fever virus
TSWVPQGRTTW

SEQ ID NO: 177308 - protein, 11 aa, Yellow fever virus
SWVPQGRTTWS

SEQ ID NO: 177309 - protein, 11 aa, Yellow fever virus
WVPQGRTTWSI

SEQ ID NO: 177310 - protein, 11 aa, Yellow fever virus
VPQGRTTWSIH

SEQ ID NO: 177311 - protein, 11 aa, Yellow fever virus
PQGRTTWSIHG

SEQ ID NO: 177312 - protein, 11 aa, Yellow fever virus
QGRTTWSIHGK

SEQ ID NO: 177313 - protein, 11 aa, Yellow fever virus
GRTTWSIHGKG

SEQ ID NO: 177314 - protein, 11 aa, Yellow fever virus
RTTWSIHGKGE

SEQ ID NO: 177315 - protein, 11 aa, Yellow fever virus
TTWSIHGKGEW

SEQ ID NO: 177316 - protein, 11 aa, Yellow fever virus
TWSIHGKGEWM

SEQ ID NO: 177317 - protein, 11 aa, Yellow fever virus
WSIHGKGEWMT

SEQ ID NO: 177318 - protein, 11 aa, Yellow fever virus
SIHGKGEWMTT

SEQ ID NO: 177319 - protein, 11 aa, Yellow fever virus
IHGKGEWMTTE

SEQ ID NO: 177320 - protein, 11 aa, Yellow fever virus
HGKGEWMTTED

SEQ ID NO: 177321 - protein, 11 aa, Yellow fever virus
GKGEWMTTEDM

SEQ ID NO: 177322 - protein, 11 aa, Yellow fever virus
KGEWMTTEDML

SEQ ID NO: 177323 - protein, 11 aa, Yellow fever virus
GEWMTTEDMLE

SEQ ID NO: 177324 - protein, 11 aa, Yellow fever virus
EWMTTEDMLEV

SEQ ID NO: 177325 - protein, 11 aa, Yellow fever virus
WMTTEDMLEVW

SEQ ID NO: 177326 - protein, 11 aa, Yellow fever virus
MTTEDMLEVWN

SEQ ID NO: 177327 - protein, 11 aa, Yellow fever virus
TTEDMLEVWNR

SEQ ID NO: 177328 - protein, 11 aa, Yellow fever virus
TEDMLEVWNRV

SEQ ID NO: 177329 - protein, 11 aa, Yellow fever virus
EDMLEVWNRVW

SEQ ID NO: 177330 - protein, 11 aa, Yellow fever virus
DMLEVWNRVWI

SEQ ID NO: 177331 - protein, 11 aa, Yellow fever virus
MLEVWNRVWIT

SEQ ID NO: 177332 - protein, 11 aa, Yellow fever virus
LEVWNRVWITN

SEQ ID NO: 177333 - protein, 11 aa, Yellow fever virus
EVWNRVWITNN

SEQ ID NO: 177334 - protein, 11 aa, Yellow fever virus
VWNRVWITNNP

SEQ ID NO: 177335 - protein, 11 aa, Yellow fever virus
WNRVWITNNPH

SEQ ID NO: 177336 - protein, 11 aa, Yellow fever virus
NRVWITNNPHM

SEQ ID NO: 177337 - protein, 11 aa, Yellow fever virus
RVWITNNPHMQ

SEQ ID NO: 177338 - protein, 11 aa, Yellow fever virus
VWITNNPHMQD

SEQ ID NO: 177339 - protein, 11 aa, Yellow fever virus
WITNNPHMQDK

SEQ ID NO: 177340 - protein, 11 aa, Yellow fever virus
ITNNPHMQDKT

SEQ ID NO: 177341 - protein, 11 aa, Yellow fever virus
TNNPHMQDKTM

SEQ ID NO: 177342 - protein, 11 aa, Yellow fever virus
NNPHMQDKTMV

SEQ ID NO: 177343 - protein, 11 aa, Yellow fever virus
NPHMQDKTMVK

SEQ ID NO: 177344 - protein, 11 aa, Yellow fever virus
PHMQDKTMVKK

SEQ ID NO: 177345 - protein, 11 aa, Yellow fever virus
HMQDKTMVKKW

SEQ ID NO: 177346 - protein, 11 aa, Yellow fever virus
MQDKTMVKKWR

SEQ ID NO: 177347 - protein, 11 aa, Yellow fever virus
QDKTMVKKWRD

SEQ ID NO: 177348 - protein, 11 aa, Yellow fever virus
DKTMVKKWRDV

SEQ ID NO: 177349 - protein, 11 aa, Yellow fever virus
KTMVKKWRDVP

SEQ ID NO: 177350 - protein, 11 aa, Yellow fever virus
TMVKKWRDVPY

SEQ ID NO: 177351 - protein, 11 aa, Yellow fever virus
MVKKWRDVPYL

SEQ ID NO: 177352 - protein, 11 aa, Yellow fever virus
VKKWRDVPYLT

SEQ ID NO: 177353 - protein, 11 aa, Yellow fever virus
KKWRDVPYLTK

SEQ ID NO: 177354 - protein, 11 aa, Yellow fever virus
KWRDVPYLTKR

SEQ ID NO: 177355 - protein, 11 aa, Yellow fever virus
WRDVPYLTKRQ

SEQ ID NO: 177356 - protein, 11 aa, Yellow fever virus
RDVPYLTKRQD

SEQ ID NO: 177357 - protein, 11 aa, Yellow fever virus
DVPYLTKRQDK

SEQ ID NO: 177358 - protein, 11 aa, Yellow fever virus
VPYLTKRQDKL

SEQ ID NO: 177359 - protein, 11 aa, Yellow fever virus
PYLTKRQDKLC

SEQ ID NO: 177360 - protein, 11 aa, Yellow fever virus
YLTKRQDKLCG

SEQ ID NO: 177361 - protein, 11 aa, Yellow fever virus
LTKRQDKLCGS

SEQ ID NO: 177362 - protein, 11 aa, Yellow fever virus
TKRQDKLCGSL

SEQ ID NO: 177363 - protein, 11 aa, Yellow fever virus
KRQDKLCGSLI

SEQ ID NO: 177364 - protein, 11 aa, Yellow fever virus
RQDKLCGSLIG

SEQ ID NO: 177365 - protein, 11 aa, Yellow fever virus
QDKLCGSLIGM

SEQ ID NO: 177366 - protein, 11 aa, Yellow fever virus
DKLCGSLIGMT

SEQ ID NO: 177367 - protein, 11 aa, Yellow fever virus
KLCGSLIGMTN

SEQ ID NO: 177368 - protein, 11 aa, Yellow fever virus
LCGSLIGMTNR

SEQ ID NO: 177369 - protein, 11 aa, Yellow fever virus
CGSLIGMTNRA

SEQ ID NO: 177370 - protein, 11 aa, Yellow fever virus
GSLIGMTNRAT

SEQ ID NO: 177371 - protein, 11 aa, Yellow fever virus
SLIGMTNRATW

SEQ ID NO: 177372 - protein, 11 aa, Yellow fever virus
LIGMTNRATWA

SEQ ID NO: 177373 - protein, 11 aa, Yellow fever virus
IGMTNRATWAS

SEQ ID NO: 177374 - protein, 11 aa, Yellow fever virus
GMTNRATWASH

SEQ ID NO: 177375 - protein, 11 aa, Yellow fever virus
MTNRATWASHI

SEQ ID NO: 177376 - protein, 11 aa, Yellow fever virus
TNRATWASHIH

SEQ ID NO: 177377 - protein, 11 aa, Yellow fever virus
NRATWASHIHL

SEQ ID NO: 177378 - protein, 11 aa, Yellow fever virus
RATWASHIHLV

SEQ ID NO: 177379 - protein, 11 aa, Yellow fever virus
ATWASHIHLVI

SEQ ID NO: 177380 - protein, 11 aa, Yellow fever virus
TWASHIHLVIH

SEQ ID NO: 177381 - protein, 11 aa, Yellow fever virus
WASHIHLVIHR

SEQ ID NO: 177382 - protein, 11 aa, Yellow fever virus
ASHIHLVIHRI

SEQ ID NO: 177383 - protein, 11 aa, Yellow fever virus
SHIHLVIHRIR

SEQ ID NO: 177384 - protein, 11 aa, Yellow fever virus
HIHLVIHRIRT

SEQ ID NO: 177385 - protein, 11 aa, Yellow fever virus
IHLVIHRIRTL

SEQ ID NO: 177386 - protein, 11 aa, Yellow fever virus
HLVIHRIRTLI

SEQ ID NO: 177387 - protein, 11 aa, Yellow fever virus
LVIHRIRTLIG

SEQ ID NO: 177388 - protein, 11 aa, Yellow fever virus
VIHRIRTLIGQ

SEQ ID NO: 177389 - protein, 11 aa, Yellow fever virus
IHRIRTLIGQE

SEQ ID NO: 177390 - protein, 11 aa, Yellow fever virus
HRIRTLIGQEK

SEQ ID NO: 177391 - protein, 11 aa, Yellow fever virus
RIRTLIGQEKY

SEQ ID NO: 177392 - protein, 11 aa, Yellow fever virus
IRTLIGQEKYT

SEQ ID NO: 177393 - protein, 11 aa, Yellow fever virus
RTLIGQEKYTD

SEQ ID NO: 177394 - protein, 11 aa, Yellow fever virus
TLIGQEKYTDY

SEQ ID NO: 177395 - protein, 11 aa, Yellow fever virus
LIGQEKYTDYL

SEQ ID NO: 177396 - protein, 11 aa, Yellow fever virus
IGQEKYTDYLT

SEQ ID NO: 177397 - protein, 11 aa, Yellow fever virus
GQEKYTDYLTV

SEQ ID NO: 177398 - protein, 11 aa, Yellow fever virus
QEKYTDYLTVM

SEQ ID NO: 177399 - protein, 11 aa, Yellow fever virus
EKYTDYLTVMD

SEQ ID NO: 177400 - protein, 11 aa, Yellow fever virus
KYTDYLTVMDR

SEQ ID NO: 177401 - protein, 11 aa, Yellow fever virus
YTDYLTVMDRY

SEQ ID NO: 177402 - protein, 11 aa, Yellow fever virus
TDYLTVMDRYS

SEQ ID NO: 177403 - protein, 11 aa, Yellow fever virus
DYLTVMDRYSV

SEQ ID NO: 177404 - protein, 11 aa, Yellow fever virus
YLTVMDRYSVD

SEQ ID NO: 177405 - protein, 11 aa, Yellow fever virus
LTVMDRYSVDA

SEQ ID NO: 177406 - protein, 11 aa, Yellow fever virus
TVMDRYSVDAD

SEQ ID NO: 177407 - protein, 11 aa, Yellow fever virus
VMDRYSVDADL

SEQ ID NO: 177408 - protein, 11 aa, Yellow fever virus
MDRYSVDADLQ

SEQ ID NO: 177409 - protein, 11 aa, Yellow fever virus
DRYSVDADLQL

SEQ ID NO: 177410 - protein, 11 aa, Yellow fever virus
RYSVDADLQLG

SEQ ID NO: 177411 - protein, 11 aa, Yellow fever virus
YSVDADLQLGE

SEQ ID NO: 177412 - protein, 11 aa, Yellow fever virus
SVDADLQLGEL

SEQ ID NO: 177413 - protein, 11 aa, Yellow fever virus
VDADLQLGELI

SEQ ID NO: 177414 - protein, 11 aa, Yellow fever virus
TLGVNMVRRGA

SEQ ID NO: 177415 - protein, 11 aa, Yellow fever virus
LGVNMVRRGAR

SEQ ID NO: 177416 - protein, 11 aa, Yellow fever virus
GVNMVRRGARS

SEQ ID NO: 177417 - protein, 11 aa, Yellow fever virus
VNMVRRGARSL

SEQ ID NO: 177418 - protein, 11 aa, Yellow fever virus
NMVRRGARSLS

SEQ ID NO: 177419 - protein, 11 aa, Yellow fever virus
MVRRGARSLSN

SEQ ID NO: 177420 - protein, 11 aa, Yellow fever virus
VRRGARSLSNK

SEQ ID NO: 177421 - protein, 11 aa, Yellow fever virus
RRGARSLSNKI

SEQ ID NO: 177422 - protein, 11 aa, Yellow fever virus
RGARSLSNKIK

SEQ ID NO: 177423 - protein, 11 aa, Yellow fever virus
GARSLSNKIKQ

SEQ ID NO: 177424 - protein, 11 aa, Yellow fever virus
ARSLSNKIKQK

SEQ ID NO: 177425 - protein, 11 aa, Yellow fever virus
KTKQIGNRPGL

SEQ ID NO: 177426 - protein, 11 aa, Yellow fever virus
TKQIGNRPGLS

SEQ ID NO: 177427 - protein, 11 aa, Yellow fever virus
KQIGNRPGLSR

SEQ ID NO: 177428 - protein, 11 aa, Yellow fever virus
QIGNRPGLSRG

SEQ ID NO: 177429 - protein, 11 aa, Yellow fever virus
IGNRPGLSRGV

SEQ ID NO: 177430 - protein, 11 aa, Yellow fever virus
GNRPGLSRGVQ

SEQ ID NO: 177431 - protein, 11 aa, Yellow fever virus
NRPGLSRGVQG

SEQ ID NO: 177432 - protein, 11 aa, Yellow fever virus
RPGLSRGVQGF

SEQ ID NO: 177433 - protein, 11 aa, Yellow fever virus
PGLSRGVQGFI

SEQ ID NO: 177434 - protein, 11 aa, Yellow fever virus
GLSRGVQGFIF

SEQ ID NO: 177435 - protein, 11 aa, Yellow fever virus
LSRGVQGFIFF

SEQ ID NO: 177436 - protein, 11 aa, Yellow fever virus
SRGVQGFISFF

SEQ ID NO: 177437 - protein, 11 aa, Yellow fever virus
RGVQGFISFFS

SEQ ID NO: 177438 - protein, 11 aa, Yellow fever virus
GVQGFISFFSF

SEQ ID NO: 177439 - protein, 11 aa, Yellow fever virus
VQGFISFFSFN

SEQ ID NO: 177440 - protein, 11 aa, Yellow fever virus
QGFISFFSFNI

SEQ ID NO: 177441 - protein, 11 aa, Yellow fever virus
GFISFFSFNIL

SEQ ID NO: 177442 - protein, 11 aa, Yellow fever virus
FISFFSFNILT

SEQ ID NO: 177443 - protein, 11 aa, Yellow fever virus
ISFFSFNILTG

SEQ ID NO: 177444 - protein, 11 aa, Yellow fever virus
SFFSFNILTGK

SEQ ID NO: 177445 - protein, 11 aa, Yellow fever virus
FFSFNILTGKK

SEQ ID NO: 177446 - protein, 11 aa, Yellow fever virus
FLFNILTGKKL

SEQ ID NO: 177447 - protein, 11 aa, Yellow fever virus
LFNILTGKKLT

SEQ ID NO: 177448 - protein, 11 aa, Yellow fever virus
FNILTGKKLTT

SEQ ID NO: 177449 - protein, 11 aa, Yellow fever virus
NILTGKKLTTH

SEQ ID NO: 177450 - protein, 11 aa, Yellow fever virus
ILTGKKLTTHL

SEQ ID NO: 177451 - protein, 11 aa, Yellow fever virus
LTGKKLTTHLK

SEQ ID NO: 177452 - protein, 11 aa, Yellow fever virus
TGKKLTTHLKR

SEQ ID NO: 177453 - protein, 11 aa, Yellow fever virus
GKKLTTHLKRL

SEQ ID NO: 177454 - protein, 11 aa, Yellow fever virus
KKLTTHLKRLW

SEQ ID NO: 177455 - protein, 11 aa, Yellow fever virus
KLTTHLKRLWR

SEQ ID NO: 177456 - protein, 11 aa, Yellow fever virus
LTTHLKRLWRM

SEQ ID NO: 177457 - protein, 11 aa, Yellow fever virus
TTHLKRLWRML

SEQ ID NO: 177458 - protein, 11 aa, Yellow fever virus
THLKRLWRMLD

SEQ ID NO: 177459 - protein, 11 aa, Yellow fever virus
HLKRLWRMLDP

SEQ ID NO: 177460 - protein, 11 aa, Yellow fever virus
LKRLWRMLDPR

SEQ ID NO: 177461 - protein, 11 aa, Yellow fever virus
KRLWRMLDPRQ

SEQ ID NO: 177462 - protein, 11 aa, Yellow fever virus
RLWRMLDPRQG

SEQ ID NO: 177463 - protein, 11 aa, Yellow fever virus
LWRMLDPRQGL

SEQ ID NO: 177464 - protein, 11 aa, Yellow fever virus
WRMLDPRQGLA

SEQ ID NO: 177465 - protein, 11 aa, Yellow fever virus
RMLDPRQGLAV

SEQ ID NO: 177466 - protein, 11 aa, Yellow fever virus
MLDPRQGLAAL

SEQ ID NO: 177467 - protein, 11 aa, Yellow fever virus
LDPRQGLAALR

SEQ ID NO: 177468 - protein, 11 aa, Yellow fever virus
DPRQGLAALRK

SEQ ID NO: 177469 - protein, 11 aa, Yellow fever virus
PRQGLAALRKV

SEQ ID NO: 177470 - protein, 11 aa, Yellow fever virus
RQGLAALRKVK

SEQ ID NO: 177471 - protein, 11 aa, Yellow fever virus
QGLAALRKVKR

SEQ ID NO: 177472 - protein, 11 aa, Yellow fever virus
GLAALRKVKRV

SEQ ID NO: 177473 - protein, 11 aa, Yellow fever virus
LAALRKVKRVV

SEQ ID NO: 177474 - protein, 11 aa, Yellow fever virus
AALRKVKRVVA

SEQ ID NO: 177475 - protein, 11 aa, Yellow fever virus
ALRKVKRVVAG

SEQ ID NO: 177476 - protein, 11 aa, Yellow fever virus
LRKVKRVVAGL

SEQ ID NO: 177477 - protein, 11 aa, Yellow fever virus
RKVKRVVAGLM

SEQ ID NO: 177478 - protein, 11 aa, Yellow fever virus
KVKRVVAGLMR

SEQ ID NO: 177479 - protein, 11 aa, Yellow fever virus
VKRVVAGLMRG

SEQ ID NO: 177480 - protein, 11 aa, Yellow fever virus
KRVVAGLMRGL

SEQ ID NO: 177481 - protein, 11 aa, Yellow fever virus
RVVAGLMRGLS

SEQ ID NO: 177482 - protein, 11 aa, Yellow fever virus
VVAGLMRGLSS

SEQ ID NO: 177483 - protein, 11 aa, Yellow fever virus
VAGLMRGLSSR

SEQ ID NO: 177484 - protein, 11 aa, Yellow fever virus
AGLMRGLSSRK

SEQ ID NO: 177485 - protein, 11 aa, Yellow fever virus
GLMRGLSSRKR

SEQ ID NO: 177486 - protein, 11 aa, Yellow fever virus
LMIGLSSRKRR

SEQ ID NO: 177487 - protein, 11 aa, Yellow fever virus
MIGLSSRKRRS

SEQ ID NO: 177488 - protein, 11 aa, Yellow fever virus
RGLSSRKRRSN

SEQ ID NO: 177489 - protein, 11 aa, Yellow fever virus
GLSSRKRRSNE

SEQ ID NO: 177490 - protein, 11 aa, Yellow fever virus
LSSRKRRSNEM

SEQ ID NO: 177491 - protein, 11 aa, Yellow fever virus
SSRKRRSNEMA

SEQ ID NO: 177492 - protein, 11 aa, Yellow fever virus
MMPLLILSMVI

SEQ ID NO: 177493 - protein, 11 aa, Yellow fever virus
MPLLILSMVIL

SEQ ID NO: 177494 - protein, 11 aa, Yellow fever virus
AGGVTLVRKNR

SEQ ID NO: 177495 - protein, 11 aa, Yellow fever virus
GGVTLMRKNRW

SEQ ID NO: 177496 - protein, 11 aa, Yellow fever virus
GVTLMRKNRWL

SEQ ID NO: 177497 - protein, 11 aa, Yellow fever virus
VTLMRKNRWLL

SEQ ID NO: 177498 - protein, 11 aa, Yellow fever virus
TLMRKNRWLLL

SEQ ID NO: 177499 - protein, 11 aa, Yellow fever virus
LMRKNRWLLLN

SEQ ID NO: 177500 - protein, 11 aa, Yellow fever virus
MRKNRWLLLNV

SEQ ID NO: 177501 - protein, 11 aa, Yellow fever virus
KNRWLLLNVTA

SEQ ID NO: 177502 - protein, 11 aa, Yellow fever virus
NRWLLLNVTAE

SEQ ID NO: 177503 - protein, 11 aa, Yellow fever virus
RWLLLNVTAED

SEQ ID NO: 177504 - protein, 11 aa, Yellow fever virus
WLLLNVTAEDL

SEQ ID NO: 177505 - protein, 11 aa, Yellow fever virus
LLLNVTAEDLG

SEQ ID NO: 177506 - protein, 11 aa, Yellow fever virus
LLNVTAEDLGK

SEQ ID NO: 177507 - protein, 11 aa, Yellow fever virus
LNVTAEDLGKT

SEQ ID NO: 177508 - protein, 11 aa, Yellow fever virus
NVTAEDLGKTF

SEQ ID NO: 177509 - protein, 11 aa, Yellow fever virus
VTAEDLGKTFS

SEQ ID NO: 177510 - protein, 11 aa, Yellow fever virus
TAEDLGKTFSV

SEQ ID NO: 177511 - protein, 11 aa, Yellow fever virus
AEDLGKTFSVG

SEQ ID NO: 177512 - protein, 11 aa, Yellow fever virus
EDLGKTFSIGT

SEQ ID NO: 177513 - protein, 11 aa, Yellow fever virus
DLGKTFSIGTG

SEQ ID NO: 177514 - protein, 11 aa, Yellow fever virus
LGKTFSMGTGN

SEQ ID NO: 177515 - protein, 11 aa, Yellow fever virus
GKTFSMGTGNC

SEQ ID NO: 177516 - protein, 11 aa, Yellow fever virus
KTFSVGAGNCT

SEQ ID NO: 177517 - protein, 11 aa, Yellow fever virus
TFSMGTGNCTT

SEQ ID NO: 177518 - protein, 11 aa, Yellow fever virus
FSLGTGNCTTN

SEQ ID NO: 177519 - protein, 11 aa, Yellow fever virus
SIGTGNCTTNI

SEQ ID NO: 177520 - protein, 11 aa, Yellow fever virus
IGTGNCTTNIL

SEQ ID NO: 177521 - protein, 11 aa, Yellow fever virus
GAGNCTTNILE

SEQ ID NO: 177522 - protein, 11 aa, Yellow fever virus
AGNCTTNILEA

SEQ ID NO: 177523 - protein, 11 aa, Yellow fever virus
WCYGVENVRVT

SEQ ID NO: 177524 - protein, 11 aa, Yellow fever virus
CYGVENVRVTY

SEQ ID NO: 177525 - protein, 11 aa, Yellow fever virus
YGVENVRVTYG

SEQ ID NO: 177526 - protein, 11 aa, Yellow fever virus
GVENVRVAYGR

SEQ ID NO: 177527 - protein, 11 aa, Yellow fever virus
VENVRVAYGRC

SEQ ID NO: 177528 - protein, 11 aa, Yellow fever virus
ENVRVAYGRCD

SEQ ID NO: 177529 - protein, 11 aa, Yellow fever virus
NVRVAYGRCDA

SEQ ID NO: 177530 - protein, 11 aa, Yellow fever virus
VRVAYGRCDAV

SEQ ID NO: 177531 - protein, 11 aa, Yellow fever virus
RVAYGRCDAVG

SEQ ID NO: 177532 - protein, 11 aa, Yellow fever virus
VAYGRCDAVGR

SEQ ID NO: 177533 - protein, 11 aa, Yellow fever virus
AYGRCDAVGRS

SEQ ID NO: 177534 - protein, 11 aa, Yellow fever virus
YGRCDAVGRSK

SEQ ID NO: 177535 - protein, 11 aa, Yellow fever virus
GRCDAVGRSKR

SEQ ID NO: 177536 - protein, 11 aa, Yellow fever virus
RCDAVGRSKRS

SEQ ID NO: 177537 - protein, 11 aa, Yellow fever virus
CDAVGRSKRSR

SEQ ID NO: 177538 - protein, 11 aa, Yellow fever virus
DAVGRSKRSRR

SEQ ID NO: 177539 - protein, 11 aa, Yellow fever virus
AVGRSKRSRRA

SEQ ID NO: 177540 - protein, 11 aa, Yellow fever virus
VGRSKRSRRAI

SEQ ID NO: 177541 - protein, 11 aa, Yellow fever virus
GRSKRSRRAID

SEQ ID NO: 177542 - protein, 11 aa, Yellow fever virus
RSKRSRRAIDL

SEQ ID NO: 177543 - protein, 11 aa, Yellow fever virus
SKRSRRAIDLP

SEQ ID NO: 177544 - protein, 11 aa, Yellow fever virus
KRSRRAIDLPT

SEQ ID NO: 177545 - protein, 11 aa, Yellow fever virus
GLKTRQEKWMA

SEQ ID NO: 177546 - protein, 11 aa, Yellow fever virus
LKTRQEKWMAG

SEQ ID NO: 177547 - protein, 11 aa, Yellow fever virus
KTRQEKWMAGR

SEQ ID NO: 177548 - protein, 11 aa, Yellow fever virus
TRQEKWMAGRM

SEQ ID NO: 177549 - protein, 11 aa, Yellow fever virus
RQEKWMAGRMG

SEQ ID NO: 177550 - protein, 11 aa, Yellow fever virus
QEKWMAGRMGE

SEQ ID NO: 177551 - protein, 11 aa, Yellow fever virus
EKWMAGRMGER

SEQ ID NO: 177552 - protein, 11 aa, Yellow fever virus
KWMAGRMGERQ

SEQ ID NO: 177553 - protein, 11 aa, Yellow fever virus
WMAGRMGERQL

SEQ ID NO: 177554 - protein, 11 aa, Yellow fever virus
MAGRMGERQLQ

SEQ ID NO: 177555 - protein, 11 aa, Yellow fever virus
AGRMGERQLQK

SEQ ID NO: 177556 - protein, 11 aa, Yellow fever virus
ERQLQKIERWL

SEQ ID NO: 177557 - protein, 11 aa, Yellow fever virus
RQLQKIERWLV

SEQ ID NO: 177558 - protein, 11 aa, Yellow fever virus
QLQKIERWLVR

SEQ ID NO: 177559 - protein, 11 aa, Yellow fever virus
LQKIERWLVRN

SEQ ID NO: 177560 - protein, 11 aa, Yellow fever virus
QKIERWLVRNP

SEQ ID NO: 177561 - protein, 11 aa, Yellow fever virus
KIERWLVRNPF

SEQ ID NO: 177562 - protein, 11 aa, Yellow fever virus
IERWLVRNPFF

SEQ ID NO: 177563 - protein, 11 aa, Yellow fever virus
ERWLVRNPFFA

SEQ ID NO: 177564 - protein, 11 aa, Yellow fever virus
RWLVRNPFFAV

SEQ ID NO: 177565 - protein, 11 aa, Yellow fever virus
WLVRNPFFAVT

SEQ ID NO: 177566 - protein, 11 aa, Yellow fever virus
LVRNPFFAVTA

SEQ ID NO: 177567 - protein, 11 aa, Yellow fever virus
VRNPFFAITAL

SEQ ID NO: 177568 - protein, 11 aa, Yellow fever virus
RNPFFAVTALA

SEQ ID NO: 177569 - protein, 11 aa, Yellow fever virus
NPFFAVTALAI

SEQ ID NO: 177570 - protein, 11 aa, Yellow fever virus
PFFAVTALAIA

SEQ ID NO: 177571 - protein, 11 aa, Yellow fever virus
FFAVTALAIAY

SEQ ID NO: 177572 - protein, 11 aa, Yellow fever virus
FAVTALAIAYL

SEQ ID NO: 177573 - protein, 11 aa, Yellow fever virus
AVTALAIAYLV

SEQ ID NO: 177574 - protein, 11 aa, Yellow fever virus
VTALAIAYLVG

SEQ ID NO: 177575 - protein, 11 aa, Yellow fever virus
TALAIAYLVGN

SEQ ID NO: 177576 - protein, 11 aa, Yellow fever virus
ALAIAYLVGNN

SEQ ID NO: 177577 - protein, 11 aa, Yellow fever virus
LAIAYLVGNNM

SEQ ID NO: 177578 - protein, 11 aa, Yellow fever virus
AIAYLVGSNMT

SEQ ID NO: 177579 - protein, 11 aa, Yellow fever virus
IAYLVGNNKTQ

SEQ ID NO: 177580 - protein, 11 aa, Yellow fever virus
AYLVGNNMTQR

SEQ ID NO: 177581 - protein, 11 aa, Yellow fever virus
YLVGNNTTQRV

SEQ ID NO: 177582 - protein, 11 aa, Yellow fever virus
LVGNNMTQRVV

SEQ ID NO: 177583 - protein, 11 aa, Yellow fever virus
VGNNTTQRVVI

SEQ ID NO: 177584 - protein, 11 aa, Yellow fever virus
GNNKTQRVVIA

SEQ ID NO: 177585 - protein, 11 aa, Yellow fever virus
NNMTQRVVIAL

SEQ ID NO: 177586 - protein, 11 aa, Yellow fever virus
NKTQRVVIALL

SEQ ID NO: 177587 - protein, 11 aa, Yellow fever virus
KTQRVVIALLV

SEQ ID NO: 177588 - protein, 11 aa, Yellow fever virus
GPAYSAHCIGV

SEQ ID NO: 177589 - protein, 11 aa, Yellow fever virus
PAYSAHCIGVA

SEQ ID NO: 177590 - protein, 11 aa, Yellow fever virus
AYSAHCIGVAD

SEQ ID NO: 177591 - protein, 11 aa, Yellow fever virus
YSAHCIGVADR

SEQ ID NO: 177592 - protein, 11 aa, Yellow fever virus
SAHCIGVADRD

SEQ ID NO: 177593 - protein, 11 aa, Yellow fever virus
AHCIGVADRDF

SEQ ID NO: 177594 - protein, 11 aa, Yellow fever virus
HCIGVADRDFI

SEQ ID NO: 177595 - protein, 11 aa, Yellow fever virus
CIGVADRDFIE

SEQ ID NO: 177596 - protein, 11 aa, Yellow fever virus
IGVADRDFIEG

SEQ ID NO: 177597 - protein, 11 aa, Yellow fever virus
GVADRDFIEGV

SEQ ID NO: 177598 - protein, 11 aa, Yellow fever virus
VADRDFIEGVH

SEQ ID NO: 177599 - protein, 11 aa, Yellow fever virus
ADRDFIEGVHG

SEQ ID NO: 177600 - protein, 11 aa, Yellow fever virus
GVHGGTWVSAS

SEQ ID NO: 177601 - protein, 11 aa, Yellow fever virus
VHGGTWVSASL

SEQ ID NO: 177602 - protein, 11 aa, Yellow fever virus
HGGTWVSASLE

SEQ ID NO: 177603 - protein, 11 aa, Yellow fever virus
GGTWVSASLEQ

SEQ ID NO: 177604 - protein, 11 aa, Yellow fever virus
GTWVSATLEQG

SEQ ID NO: 177605 - protein, 11 aa, Yellow fever virus
TWVSATLEQGK

SEQ ID NO: 177606 - protein, 11 aa, Yellow fever virus
WVSATLEQGKC

SEQ ID NO: 177607 - protein, 11 aa, Yellow fever virus
VSATLEQGKCV

SEQ ID NO: 177608 - protein, 11 aa, Yellow fever virus
SASLEQDKCVT

SEQ ID NO: 177609 - protein, 11 aa, Yellow fever virus
ATLEQGKCVTV

SEQ ID NO: 177610 - protein, 11 aa, Yellow fever virus
SLEQDKCVTVM

SEQ ID NO: 177611 - protein, 11 aa, Yellow fever virus
LEQGKCVTVMA

SEQ ID NO: 177612 - protein, 11 aa, Yellow fever virus
EQGKCVTVMAP

SEQ ID NO: 177613 - protein, 11 aa, Yellow fever virus
QGKCVTVMAPD

SEQ ID NO: 177614 - protein, 11 aa, Yellow fever virus
GKCVTVMAPDK

SEQ ID NO: 177615 - protein, 11 aa, Yellow fever virus
PDKPSLDISLQ

SEQ ID NO: 177616 - protein, 11 aa, Yellow fever virus
DKPSLDISLQT

SEQ ID NO: 177617 - protein, 11 aa, Yellow fever virus
KPSLDISLQTV

SEQ ID NO: 177618 - protein, 11 aa, Yellow fever virus
PSLDISLQTVA

SEQ ID NO: 177619 - protein, 11 aa, Yellow fever virus
SLDISLQTVAI

SEQ ID NO: 177620 - protein, 11 aa, Yellow fever virus
LDISLQTVAID

SEQ ID NO: 177621 - protein, 11 aa, Yellow fever virus
DISLETVAIDG

SEQ ID NO: 177622 - protein, 11 aa, Yellow fever virus
ISLETVAIDGP

SEQ ID NO: 177623 - protein, 11 aa, Yellow fever virus
SLETVAIDGPA

SEQ ID NO: 177624 - protein, 11 aa, Yellow fever virus
LETVAIDGPAE

SEQ ID NO: 177625 - protein, 11 aa, Yellow fever virus
ETVAIDGPAEA

SEQ ID NO: 177626 - protein, 11 aa, Yellow fever virus
TVAIDGPAEAR

SEQ ID NO: 177627 - protein, 11 aa, Yellow fever virus
VAIDGPAEARK

SEQ ID NO: 177628 - protein, 11 aa, Yellow fever virus
AIDGPAEARKV

SEQ ID NO: 177629 - protein, 11 aa, Yellow fever virus
IDGPAEARKVC

SEQ ID NO: 177630 - protein, 11 aa, Yellow fever virus
DGPAEARKVCY

SEQ ID NO: 177631 - protein, 11 aa, Yellow fever virus
GPAEARKVCYN

SEQ ID NO: 177632 - protein, 11 aa, Yellow fever virus
PAEARKVCYNA

SEQ ID NO: 177633 - protein, 11 aa, Yellow fever virus
AEARKVCYNAV

SEQ ID NO: 177634 - protein, 11 aa, Yellow fever virus
EARKVCYNAVL

SEQ ID NO: 177635 - protein, 11 aa, Yellow fever virus
ARKVCYNAVLT

SEQ ID NO: 177636 - protein, 11 aa, Yellow fever virus
RKVCYSAVLTH

SEQ ID NO: 177637 - protein, 11 aa, Yellow fever virus
KVCYSAVLTHV

SEQ ID NO: 177638 - protein, 11 aa, Yellow fever virus
VCYSAVLTHVK

SEQ ID NO: 177639 - protein, 11 aa, Yellow fever virus
CYSAVLTHVKI

SEQ ID NO: 177640 - protein, 11 aa, Yellow fever virus
YSAVLTHVKIN

SEQ ID NO: 177641 - protein, 11 aa, Yellow fever virus
SAVLTHVKIND

SEQ ID NO: 177642 - protein, 11 aa, Yellow fever virus
AVLTHVKIDDK

SEQ ID NO: 177643 - protein, 11 aa, Yellow fever virus
VLTHVKIDDKC

SEQ ID NO: 177644 - protein, 11 aa, Yellow fever virus
LTHVKIDDKCP

SEQ ID NO: 177645 - protein, 11 aa, Yellow fever virus
THVKIDDKCPS

SEQ ID NO: 177646 - protein, 11 aa, Yellow fever virus
HVKIDDKCPST

SEQ ID NO: 177647 - protein, 11 aa, Yellow fever virus
VKIDDKCPSTG

SEQ ID NO: 177648 - protein, 11 aa, Yellow fever virus
KIDDKCPSTGE

SEQ ID NO: 177649 - protein, 11 aa, Yellow fever virus
IDDKCPSTGEA

SEQ ID NO: 177650 - protein, 11 aa, Yellow fever virus
DDKCPSTGEAH

SEQ ID NO: 177651 - protein, 11 aa, Yellow fever virus
TGEAHLAEEND

SEQ ID NO: 177652 - protein, 11 aa, Yellow fever virus
GEAHLAEENDG

SEQ ID NO: 177653 - protein, 11 aa, Yellow fever virus
EAHLAEENDGD

SEQ ID NO: 177654 - protein, 11 aa, Yellow fever virus
AHLAEENDGDN

SEQ ID NO: 177655 - protein, 11 aa, Yellow fever virus
HLAEENDGDNA

SEQ ID NO: 177656 - protein, 11 aa, Yellow fever virus
LAEENDGDNAC

SEQ ID NO: 177657 - protein, 11 aa, Yellow fever virus
AEENDGDNACK

SEQ ID NO: 177658 - protein, 11 aa, Yellow fever virus
EENDGDNACKR

SEQ ID NO: 177659 - protein, 11 aa, Yellow fever virus
ENDGDNACKRT

SEQ ID NO: 177660 - protein, 11 aa, Yellow fever virus
NDGDNACKRTY

SEQ ID NO: 177661 - protein, 11 aa, Yellow fever virus
DGDNACKRTYS

SEQ ID NO: 177662 - protein, 11 aa, Yellow fever virus
VDQTKIQYVIK

SEQ ID NO: 177663 - protein, 11 aa, Yellow fever virus
DQTKIQYVIKA

SEQ ID NO: 177664 - protein, 11 aa, Yellow fever virus
QTKIQYVIKAQ

SEQ ID NO: 177665 - protein, 11 aa, Yellow fever virus
TKIQYVIKAQL

SEQ ID NO: 177666 - protein, 11 aa, Yellow fever virus
KIQYVIKAQLH

SEQ ID NO: 177667 - protein, 11 aa, Yellow fever virus
IQYVIKAQLHV

SEQ ID NO: 177668 - protein, 11 aa, Yellow fever virus
QYVIKAQLHVG

SEQ ID NO: 177669 - protein, 11 aa, Yellow fever virus
YVIKAQLHVGA

SEQ ID NO: 177670 - protein, 11 aa, Yellow fever virus
VIRARLHVGAK

SEQ ID NO: 177671 - protein, 11 aa, Yellow fever virus
IRARLHVGAKQ

SEQ ID NO: 177672 - protein, 11 aa, Yellow fever virus
RARLHVGAKQE

SEQ ID NO: 177673 - protein, 11 aa, Yellow fever virus
ARLHVGAKQEN

SEQ ID NO: 177674 - protein, 11 aa, Yellow fever virus
RLHVGAKQENW

SEQ ID NO: 177675 - protein, 11 aa, Yellow fever virus
LHVGAKQENWT

SEQ ID NO: 177676 - protein, 11 aa, Yellow fever virus
HVGAKQENWTT

SEQ ID NO: 177677 - protein, 11 aa, Yellow fever virus
VGAKQENWTTD

SEQ ID NO: 177678 - protein, 11 aa, Yellow fever virus
GAKQENWTTDI

SEQ ID NO: 177679 - protein, 11 aa, Yellow fever virus
AKQENWTTDIK

SEQ ID NO: 177680 - protein, 11 aa, Yellow fever virus
KQENWTTDIKT

SEQ ID NO: 177681 - protein, 11 aa, Yellow fever virus
QENWTTDIKTL

SEQ ID NO: 177682 - protein, 11 aa, Yellow fever virus
ENWTTDIKTLK

SEQ ID NO: 177683 - protein, 11 aa, Yellow fever virus
NWTTDIKTLKF

SEQ ID NO: 177684 - protein, 11 aa, Yellow fever virus
WTTDIKTLKFD

SEQ ID NO: 177685 - protein, 11 aa, Yellow fever virus
TTDIKTLKFDA

SEQ ID NO: 177686 - protein, 11 aa, Yellow fever virus
TSIKTLKFDAL

SEQ ID NO: 177687 - protein, 11 aa, Yellow fever virus
SIKTLKFDALS

SEQ ID NO: 177688 - protein, 11 aa, Yellow fever virus
IKTLKFDVLSG

SEQ ID NO: 177689 - protein, 11 aa, Yellow fever virus
KTLKFDVLSGS

SEQ ID NO: 177690 - protein, 11 aa, Yellow fever virus
TLKFDVLSGSQ

SEQ ID NO: 177691 - protein, 11 aa, Yellow fever virus
LKFDVLSGSQE

SEQ ID NO: 177692 - protein, 11 aa, Yellow fever virus
KFDALSGSQEA

SEQ ID NO: 177693 - protein, 11 aa, Yellow fever virus
FDALSGSQEAE

SEQ ID NO: 177694 - protein, 11 aa, Yellow fever virus
DALSGSQEAEF

SEQ ID NO: 177695 - protein, 11 aa, Yellow fever virus
ALSGSQEAEFT

SEQ ID NO: 177696 - protein, 11 aa, Yellow fever virus
LSGSQEAEFTG

SEQ ID NO: 177697 - protein, 11 aa, Yellow fever virus
SGSQEAEFTGY

SEQ ID NO: 177698 - protein, 11 aa, Yellow fever virus
GSQEAEFTGYG

SEQ ID NO: 177699 - protein, 11 aa, Yellow fever virus
SQEAEFTGYGK

SEQ ID NO: 177700 - protein, 11 aa, Yellow fever virus
QEAEFTGYGKA

SEQ ID NO: 177701 - protein, 11 aa, Yellow fever virus
EAEFTGYGKAT

SEQ ID NO: 177702 - protein, 11 aa, Yellow fever virus
AEFTGYGKATL

SEQ ID NO: 177703 - protein, 11 aa, Yellow fever virus
EFTGYGKATLE

SEQ ID NO: 177704 - protein, 11 aa, Yellow fever virus
FTGYGKATLEC

SEQ ID NO: 177705 - protein, 11 aa, Yellow fever virus
TGYGKATLECQ

SEQ ID NO: 177706 - protein, 11 aa, Yellow fever virus
GYGKATLECRV

SEQ ID NO: 177707 - protein, 11 aa, Yellow fever virus
YGKVTLECQVQ

SEQ ID NO: 177708 - protein, 11 aa, Yellow fever virus
GKATLECRVQT

SEQ ID NO: 177709 - protein, 11 aa, Yellow fever virus
KVTLECQVQTA

SEQ ID NO: 177710 - protein, 11 aa, Yellow fever virus
VTLECQVQTAV

SEQ ID NO: 177711 - protein, 11 aa, Yellow fever virus
TLECRVQTAVD

SEQ ID NO: 177712 - protein, 11 aa, Yellow fever virus
LECRVQTAVDF

SEQ ID NO: 177713 - protein, 11 aa, Yellow fever virus
ECRVQTAVDFG

SEQ ID NO: 177714 - protein, 11 aa, Yellow fever virus
CRVQTAVDFGN

SEQ ID NO: 177715 - protein, 11 aa, Yellow fever virus
RVQTAVDFGNS

SEQ ID NO: 177716 - protein, 11 aa, Yellow fever virus
FGNSYIAEMEK

SEQ ID NO: 177717 - protein, 11 aa, Yellow fever virus
GNSYIAEMEKE

SEQ ID NO: 177718 - protein, 11 aa, Yellow fever virus
NSYIAEMEKES

SEQ ID NO: 177719 - protein, 11 aa, Yellow fever virus
SYIAEMEKESW

SEQ ID NO: 177720 - protein, 11 aa, Yellow fever virus
YIAEMEKESWI

SEQ ID NO: 177721 - protein, 11 aa, Yellow fever virus
IAEMEKESWIV

SEQ ID NO: 177722 - protein, 11 aa, Yellow fever virus
AEMEKESWIVD

SEQ ID NO: 177723 - protein, 11 aa, Yellow fever virus
EMEKESWIVDR

SEQ ID NO: 177724 - protein, 11 aa, Yellow fever virus
MEKESWIVDRQ

SEQ ID NO: 177725 - protein, 11 aa, Yellow fever virus
EKESWIVDRQW

SEQ ID NO: 177726 - protein, 11 aa, Yellow fever virus
KESWIVDRQWA

SEQ ID NO: 177727 - protein, 11 aa, Yellow fever virus
DSWIVDRQWAQ

SEQ ID NO: 177728 - protein, 11 aa, Yellow fever virus
TLPWQSGSGGI

SEQ ID NO: 177729 - protein, 11 aa, Yellow fever virus
LPWQSGSGGIW

SEQ ID NO: 177730 - protein, 11 aa, Yellow fever virus
PWQSGSGGIWR

SEQ ID NO: 177731 - protein, 11 aa, Yellow fever virus
WQSGSGGIWRE

SEQ ID NO: 177732 - protein, 11 aa, Yellow fever virus
QSGSGGIWREM

SEQ ID NO: 177733 - protein, 11 aa, Yellow fever virus
SGSGGIWREMH

SEQ ID NO: 177734 - protein, 11 aa, Yellow fever virus
GSGGIWREMHH

SEQ ID NO: 177735 - protein, 11 aa, Yellow fever virus
SGGIWREMHHL

SEQ ID NO: 177736 - protein, 11 aa, Yellow fever virus
GGIWREMHHLV

SEQ ID NO: 177737 - protein, 11 aa, Yellow fever virus
GIWREMHHLVE

SEQ ID NO: 177738 - protein, 11 aa, Yellow fever virus
IWREMHHLVEF

SEQ ID NO: 177739 - protein, 11 aa, Yellow fever virus
WRGMHHLVEFE

SEQ ID NO: 177740 - protein, 11 aa, Yellow fever virus
RGMHHLVEFEP

SEQ ID NO: 177741 - protein, 11 aa, Yellow fever virus
GMHHLVEFEPP

SEQ ID NO: 177742 - protein, 11 aa, Yellow fever virus
HLVEFEPPHAV

SEQ ID NO: 177743 - protein, 11 aa, Yellow fever virus
LVEFEPPHAVT

SEQ ID NO: 177744 - protein, 11 aa, Yellow fever virus
VEFEPPHAVTI

SEQ ID NO: 177745 - protein, 11 aa, Yellow fever virus
EFEPPHAVTIR

SEQ ID NO: 177746 - protein, 11 aa, Yellow fever virus
FEPPHAVTIRV

SEQ ID NO: 177747 - protein, 11 aa, Yellow fever virus
EPPHAVTIRVL

SEQ ID NO: 177748 - protein, 11 aa, Yellow fever virus
PPHAVTIRVLA

SEQ ID NO: 177749 - protein, 11 aa, Yellow fever virus
PHAVTIRVLAL

SEQ ID NO: 177750 - protein, 11 aa, Yellow fever virus
HAVTIRVLALG

SEQ ID NO: 177751 - protein, 11 aa, Yellow fever virus
AATIRVLALGD

SEQ ID NO: 177752 - protein, 11 aa, Yellow fever virus
ATIRVLALGDQ

SEQ ID NO: 177753 - protein, 11 aa, Yellow fever virus
TIRVLALGDQE

SEQ ID NO: 177754 - protein, 11 aa, Yellow fever virus
IRVLALGDQEG

SEQ ID NO: 177755 - protein, 11 aa, Yellow fever virus
RVLALGDQEGS

SEQ ID NO: 177756 - protein, 11 aa, Yellow fever virus
VLALGDQEGSL

SEQ ID NO: 177757 - protein, 11 aa, Yellow fever virus
LALGDQEGSLK

SEQ ID NO: 177758 - protein, 11 aa, Yellow fever virus
ALGDQEGSLKT

SEQ ID NO: 177759 - protein, 11 aa, Yellow fever virus
LGDQEGSLKTA

SEQ ID NO: 177760 - protein, 11 aa, Yellow fever virus
GDQEGSLKTAL

SEQ ID NO: 177761 - protein, 11 aa, Yellow fever virus
DQEGSLKTALT

SEQ ID NO: 177762 - protein, 11 aa, Yellow fever virus
LTGAMRVTKDE

SEQ ID NO: 177763 - protein, 11 aa, Yellow fever virus
TGAMRVTKDEN

SEQ ID NO: 177764 - protein, 11 aa, Yellow fever virus
GAMRVTKDEND

SEQ ID NO: 177765 - protein, 11 aa, Yellow fever virus
AMRVTKDENDN

SEQ ID NO: 177766 - protein, 11 aa, Yellow fever virus
MRVTKDENDNN

SEQ ID NO: 177767 - protein, 11 aa, Yellow fever virus
RVTKDENDNNL

SEQ ID NO: 177768 - protein, 11 aa, Yellow fever virus
VTKDENDNNLY

SEQ ID NO: 177769 - protein, 11 aa, Yellow fever virus
TKDENDNNLYK

SEQ ID NO: 177770 - protein, 11 aa, Yellow fever virus
KDENDNNLYKL

SEQ ID NO: 177771 - protein, 11 aa, Yellow fever virus
DENDNNLYKLH

SEQ ID NO: 177772 - protein, 11 aa, Yellow fever virus
ENDNNLYKLHG

SEQ ID NO: 177773 - protein, 11 aa, Yellow fever virus
ALTLKGTSYKM

SEQ ID NO: 177774 - protein, 11 aa, Yellow fever virus
LTLKGTSYKMC

SEQ ID NO: 177775 - protein, 11 aa, Yellow fever virus
TLKGTSYKMCT

SEQ ID NO: 177776 - protein, 11 aa, Yellow fever virus
LKGTSYKMCTD

SEQ ID NO: 177777 - protein, 11 aa, Yellow fever virus
KGTSYKMCTDK

SEQ ID NO: 177778 - protein, 11 aa, Yellow fever virus
GTSYKMCTDKM

SEQ ID NO: 177779 - protein, 11 aa, Yellow fever virus
TSYKMCTDKMS

SEQ ID NO: 177780 - protein, 11 aa, Yellow fever virus
SYKMCTDKMSF

SEQ ID NO: 177781 - protein, 11 aa, Yellow fever virus
YKMCTDKMSFV

SEQ ID NO: 177782 - protein, 11 aa, Yellow fever virus
KMCTDKMSFVK

SEQ ID NO: 177783 - protein, 11 aa, Yellow fever virus
MCTDKMSFVKN

SEQ ID NO: 177784 - protein, 11 aa, Yellow fever virus
CTDKMSFVKNP

SEQ ID NO: 177785 - protein, 11 aa, Yellow fever virus
TDKMSFVKNPT

SEQ ID NO: 177786 - protein, 11 aa, Yellow fever virus
DKMSFVKNPTD

SEQ ID NO: 177787 - protein, 11 aa, Yellow fever virus
KMSFVKNPTDT

SEQ ID NO: 177788 - protein, 11 aa, Yellow fever virus
MSFVKNPTDTG

SEQ ID NO: 177789 - protein, 11 aa, Yellow fever virus
SFVKNPTDTGH

SEQ ID NO: 177790 - protein, 11 aa, Yellow fever virus
FVKNPTDTDHG

SEQ ID NO: 177791 - protein, 11 aa, Yellow fever virus
VKNPTDTDHGT

SEQ ID NO: 177792 - protein, 11 aa, Yellow fever virus
KNPTDTDHGTV

SEQ ID NO: 177793 - protein, 11 aa, Yellow fever virus
NPTDTDHGTVV

SEQ ID NO: 177794 - protein, 11 aa, Yellow fever virus
PTDTDHGTVVM

SEQ ID NO: 177795 - protein, 11 aa, Yellow fever virus
TDTDHGTVVMQ

SEQ ID NO: 177796 - protein, 11 aa, Yellow fever virus
DTDHGTVVMQV

SEQ ID NO: 177797 - protein, 11 aa, Yellow fever virus
TDHGTVVMQVK

SEQ ID NO: 177798 - protein, 11 aa, Yellow fever virus
DHGTVVMQVKV

SEQ ID NO: 177799 - protein, 11 aa, Yellow fever virus
HGTVVMQVKVS

SEQ ID NO: 177800 - protein, 11 aa, Yellow fever virus
GTVVMQVKVSK

SEQ ID NO: 177801 - protein, 11 aa, Yellow fever virus
TVVMQVKVSKG

SEQ ID NO: 177802 - protein, 11 aa, Yellow fever virus
VVMQVKVSKGA

SEQ ID NO: 177803 - protein, 11 aa, Yellow fever virus
VMQVKVSKGAP

SEQ ID NO: 177804 - protein, 11 aa, Yellow fever virus
MQVKVSKGAPC

SEQ ID NO: 177805 - protein, 11 aa, Yellow fever virus
QVKVPKGAPCK

SEQ ID NO: 177806 - protein, 11 aa, Yellow fever virus
VKVPKGAPCKI

SEQ ID NO: 177807 - protein, 11 aa, Yellow fever virus
KVPKGAPCKIP

SEQ ID NO: 177808 - protein, 11 aa, Yellow fever virus
VPKGAPCKIPV

SEQ ID NO: 177809 - protein, 11 aa, Yellow fever virus
PKGAPCKIPVI

SEQ ID NO: 177810 - protein, 11 aa, Yellow fever virus
KGAPCKIPVIV

SEQ ID NO: 177811 - protein, 11 aa, Yellow fever virus
GAPCKIPVIVA

SEQ ID NO: 177812 - protein, 11 aa, Yellow fever virus
APCKIPVIVAD

SEQ ID NO: 177813 - protein, 11 aa, Yellow fever virus
PCKIPVIVADD

SEQ ID NO: 177814 - protein, 11 aa, Yellow fever virus
CKIPVIVADDL

SEQ ID NO: 177815 - protein, 11 aa, Yellow fever virus
KIPVIVADDLT

SEQ ID NO: 177816 - protein, 11 aa, Yellow fever virus
VIVADDLTAAV

SEQ ID NO: 177817 - protein, 11 aa, Yellow fever virus
IVADDLTAAVN

SEQ ID NO: 177818 - protein, 11 aa, Yellow fever virus
VADDLTAAVNK

SEQ ID NO: 177819 - protein, 11 aa, Yellow fever virus
ADDLTAAVNKG

SEQ ID NO: 177820 - protein, 11 aa, Yellow fever virus
DDLTAAVNKGI

SEQ ID NO: 177821 - protein, 11 aa, Yellow fever virus
DLTAAVNKGIL

SEQ ID NO: 177822 - protein, 11 aa, Yellow fever virus
LTAAVNKGILV

SEQ ID NO: 177823 - protein, 11 aa, Yellow fever virus
TAAVNKGILVT

SEQ ID NO: 177824 - protein, 11 aa, Yellow fever virus
AAVNKGILVTV

SEQ ID NO: 177825 - protein, 11 aa, Yellow fever virus
AVNKGILVTVN

SEQ ID NO: 177826 - protein, 11 aa, Yellow fever virus
VNKGILVTVNP

SEQ ID NO: 177827 - protein, 11 aa, Yellow fever virus
NPPFGDSYIII

SEQ ID NO: 177828 - protein, 11 aa, Yellow fever virus
PPFGDSYIIIG

SEQ ID NO: 177829 - protein, 11 aa, Yellow fever virus
PFGDSYIIVGT

SEQ ID NO: 177830 - protein, 11 aa, Yellow fever virus
FGDSYIIVGTG

SEQ ID NO: 177831 - protein, 11 aa, Yellow fever virus
GDSYIIVGTGD

SEQ ID NO: 177832 - protein, 11 aa, Yellow fever virus
DSYIIVGTGDS

SEQ ID NO: 177833 - protein, 11 aa, Yellow fever virus
SYIIVGTGDSR

SEQ ID NO: 177834 - protein, 11 aa, Yellow fever virus
YIIVGTGDSRL

SEQ ID NO: 177835 - protein, 11 aa, Yellow fever virus
IIVGTGDSRLT

SEQ ID NO: 177836 - protein, 11 aa, Yellow fever virus
IVGTGDSRLTY

SEQ ID NO: 177837 - protein, 11 aa, Yellow fever virus
VGTGDSRLTYQ

SEQ ID NO: 177838 - protein, 11 aa, Yellow fever virus
GTGDSRLTYQW

SEQ ID NO: 177839 - protein, 11 aa, Yellow fever virus
TGDSRLTYQWH

SEQ ID NO: 177840 - protein, 11 aa, Yellow fever virus
GKLFTQTMKGA

SEQ ID NO: 177841 - protein, 11 aa, Yellow fever virus
KLFTQTMKGAE

SEQ ID NO: 177842 - protein, 11 aa, Yellow fever virus
LFTQTMKGAER

SEQ ID NO: 177843 - protein, 11 aa, Yellow fever virus
FTQTMKGAERL

SEQ ID NO: 177844 - protein, 11 aa, Yellow fever virus
TQTMKGAERLA

SEQ ID NO: 177845 - protein, 11 aa, Yellow fever virus
QTMKGAERLAV

SEQ ID NO: 177846 - protein, 11 aa, Yellow fever virus
TMKGAERLAVM

SEQ ID NO: 177847 - protein, 11 aa, Yellow fever virus
MKGAERLAVMG

SEQ ID NO: 177848 - protein, 11 aa, Yellow fever virus
KGAERLAVMGD

SEQ ID NO: 177849 - protein, 11 aa, Yellow fever virus
GAERLAVMGDA

SEQ ID NO: 177850 - protein, 11 aa, Yellow fever virus
AERLAVMGDAA

SEQ ID NO: 177851 - protein, 11 aa, Yellow fever virus
ERLAVMGDAAW

SEQ ID NO: 177852 - protein, 11 aa, Yellow fever virus
RLAVMGDAAWD

SEQ ID NO: 177853 - protein, 11 aa, Yellow fever virus
LAVMGDAAWDF

SEQ ID NO: 177854 - protein, 11 aa, Yellow fever virus
AVMGDAAWDFS

SEQ ID NO: 177855 - protein, 11 aa, Yellow fever virus
VMGDAAWDFSS

SEQ ID NO: 177856 - protein, 11 aa, Yellow fever virus
MGDAAWDFSSA

SEQ ID NO: 177857 - protein, 11 aa, Yellow fever virus
GDAAWDFSSAG

SEQ ID NO: 177858 - protein, 11 aa, Yellow fever virus
DAAWDFSSAGG

SEQ ID NO: 177859 - protein, 11 aa, Yellow fever virus
AAWDFSSAGGF

SEQ ID NO: 177860 - protein, 11 aa, Yellow fever virus
AWDFSSAGGLF

SEQ ID NO: 177861 - protein, 11 aa, Yellow fever virus
WDFSSAGGFLT

SEQ ID NO: 177862 - protein, 11 aa, Yellow fever virus
DFSSAGGFLTS

SEQ ID NO: 177863 - protein, 11 aa, Yellow fever virus
FSSAGGFLTSV

SEQ ID NO: 177864 - protein, 11 aa, Yellow fever virus
SSAGGFLTSVG

SEQ ID NO: 177865 - protein, 11 aa, Yellow fever virus
SAGGLFTSIGK

SEQ ID NO: 177866 - protein, 11 aa, Yellow fever virus
AGGLFTSIGKG

SEQ ID NO: 177867 - protein, 11 aa, Yellow fever virus
GGLFTSIGKGS

SEQ ID NO: 177868 - protein, 11 aa, Yellow fever virus
GLFTSIGKGSH

SEQ ID NO: 177869 - protein, 11 aa, Yellow fever virus
LFTSIGKGSHT

SEQ ID NO: 177870 - protein, 11 aa, Yellow fever virus
FTSIGKGSHTV

SEQ ID NO: 177871 - protein, 11 aa, Yellow fever virus
TSIGKGSHTVF

SEQ ID NO: 177872 - protein, 11 aa, Yellow fever virus
SIGKGSHTVFG

SEQ ID NO: 177873 - protein, 11 aa, Yellow fever virus
IGKGSHTVFGS

SEQ ID NO: 177874 - protein, 11 aa, Yellow fever virus
GKGSHTVFGSA

SEQ ID NO: 177875 - protein, 11 aa, Yellow fever virus
KGSHTVFGSAF

SEQ ID NO: 177876 - protein, 11 aa, Yellow fever virus
GSHTVFGSAFQ

SEQ ID NO: 177877 - protein, 11 aa, Yellow fever virus
SHTVFGSAFQG

SEQ ID NO: 177878 - protein, 11 aa, Yellow fever virus
SAFQGLFGGLS

SEQ ID NO: 177879 - protein, 11 aa, Yellow fever virus
AFQGLFGGLSW

SEQ ID NO: 177880 - protein, 11 aa, Yellow fever virus
FQGLFGGLSWI

SEQ ID NO: 177881 - protein, 11 aa, Yellow fever virus
QGLFGGLSWIT

SEQ ID NO: 177882 - protein, 11 aa, Yellow fever virus
GLFGGLSWITK

SEQ ID NO: 177883 - protein, 11 aa, Yellow fever virus
LFGGLSWITKV

SEQ ID NO: 177884 - protein, 11 aa, Yellow fever virus
FGGLSWITKVI

SEQ ID NO: 177885 - protein, 11 aa, Yellow fever virus
GGLSWITKVIM

SEQ ID NO: 177886 - protein, 11 aa, Yellow fever virus
GLSWITKVIMG

SEQ ID NO: 177887 - protein, 11 aa, Yellow fever virus
LSWITKVIMGA

SEQ ID NO: 177888 - protein, 11 aa, Yellow fever virus
SWITKVIMGAV

SEQ ID NO: 177889 - protein, 11 aa, Yellow fever virus
WITKVIMGVVL

SEQ ID NO: 177890 - protein, 11 aa, Yellow fever virus
ITKVIMGVVLI

SEQ ID NO: 177891 - protein, 11 aa, Yellow fever virus
TKVIIGAVLIW

SEQ ID NO: 177892 - protein, 11 aa, Yellow fever virus
KVIIGAVLIWV

SEQ ID NO: 177893 - protein, 11 aa, Yellow fever virus
VIIGAVLIWVG

SEQ ID NO: 177894 - protein, 11 aa, Yellow fever virus
IMGVVLIWVGI

SEQ ID NO: 177895 - protein, 11 aa, Yellow fever virus
IGAVLIWVGIN

SEQ ID NO: 177896 - protein, 11 aa, Yellow fever virus
GAVLIWVGFNT

SEQ ID NO: 177897 - protein, 11 aa, Yellow fever virus
AVLIWVGFNTR

SEQ ID NO: 177898 - protein, 11 aa, Yellow fever virus
VLIWVGFNTRN

SEQ ID NO: 177899 - protein, 11 aa, Yellow fever virus
LIWVGFNTRNM

SEQ ID NO: 177900 - protein, 11 aa, Yellow fever virus
IWVGFNTRNMT

SEQ ID NO: 177901 - protein, 11 aa, Yellow fever virus
WVGFNTRNMTM

SEQ ID NO: 177902 - protein, 11 aa, Yellow fever virus
VGFNTRNMTMS

SEQ ID NO: 177903 - protein, 11 aa, Yellow fever virus
GFNTRNMTMSM

SEQ ID NO: 177904 - protein, 11 aa, Yellow fever virus
FNTRNMTMSMS

SEQ ID NO: 177905 - protein, 11 aa, Yellow fever virus
RNMTMSMSMIM

SEQ ID NO: 177906 - protein, 11 aa, Yellow fever virus
NMTMSMSMIMV

SEQ ID NO: 177907 - protein, 11 aa, Yellow fever virus
MTMSMSMIMVG

SEQ ID NO: 177908 - protein, 11 aa, Yellow fever virus
TMSMSMIMVGV

SEQ ID NO: 177909 - protein, 11 aa, Yellow fever virus
MSMSMIMVGVI

SEQ ID NO: 177910 - protein, 11 aa, Yellow fever virus
SMSMIMVGVIM

SEQ ID NO: 177911 - protein, 11 aa, Yellow fever virus
MSMIMVGVIMM

SEQ ID NO: 177912 - protein, 11 aa, Yellow fever virus
SMIMVGVIMMF

SEQ ID NO: 177913 - protein, 11 aa, Yellow fever virus
MIMVGVIMMFL

SEQ ID NO: 177914 - protein, 11 aa, Yellow fever virus
IMVGVIMMFLS

SEQ ID NO: 177915 - protein, 11 aa, Yellow fever virus
MVGVIMMFLSL

SEQ ID NO: 177916 - protein, 11 aa, Yellow fever virus
LGVGADQGCAV

SEQ ID NO: 177917 - protein, 11 aa, Yellow fever virus
GVGADQGCAVN

SEQ ID NO: 177918 - protein, 11 aa, Yellow fever virus
VGADQGCAVNF

SEQ ID NO: 177919 - protein, 11 aa, Yellow fever virus
GADQGCAVNFG

SEQ ID NO: 177920 - protein, 11 aa, Yellow fever virus
ADQGCAVNFGK

SEQ ID NO: 177921 - protein, 11 aa, Yellow fever virus
DQGCAVNFGKR

SEQ ID NO: 177922 - protein, 11 aa, Yellow fever virus
QGCAVNFGKRE

SEQ ID NO: 177923 - protein, 11 aa, Yellow fever virus
GCAVNFGKREL

SEQ ID NO: 177924 - protein, 11 aa, Yellow fever virus
CAVNFGKRELK

SEQ ID NO: 177925 - protein, 11 aa, Yellow fever virus
AVNFGKRELKC

SEQ ID NO: 177926 - protein, 11 aa, Yellow fever virus
VNFGKRELKCG

SEQ ID NO: 177927 - protein, 11 aa, Yellow fever virus
NFAKRELKCGD

SEQ ID NO: 177928 - protein, 11 aa, Yellow fever virus
FAKRELKCGDG

SEQ ID NO: 177929 - protein, 11 aa, Yellow fever virus
AKRELKCGDGI

SEQ ID NO: 177930 - protein, 11 aa, Yellow fever virus
RELKCGDGIFV

SEQ ID NO: 177931 - protein, 11 aa, Yellow fever virus
ELKCGDGIFVF

SEQ ID NO: 177932 - protein, 11 aa, Yellow fever virus
LKCGDGIFVFR

SEQ ID NO: 177933 - protein, 11 aa, Yellow fever virus
KCGDGIFVFRD

SEQ ID NO: 177934 - protein, 11 aa, Yellow fever virus
CGDGIFVFRDS

SEQ ID NO: 177935 - protein, 11 aa, Yellow fever virus
GDGIFVFRDSD

SEQ ID NO: 177936 - protein, 11 aa, Yellow fever virus
DGIFVFRDSDD

SEQ ID NO: 177937 - protein, 11 aa, Yellow fever virus
GIFVFRDSDDW

SEQ ID NO: 177938 - protein, 11 aa, Yellow fever virus
IFVFRDSDDWL

SEQ ID NO: 177939 - protein, 11 aa, Yellow fever virus
FVFRDSDDWLT

SEQ ID NO: 177940 - protein, 11 aa, Yellow fever virus
VFRDSDDWLTK

SEQ ID NO: 177941 - protein, 11 aa, Yellow fever virus
FRDSDDWLTKY

SEQ ID NO: 177942 - protein, 11 aa, Yellow fever virus
RDSDDWLTKYS

SEQ ID NO: 177943 - protein, 11 aa, Yellow fever virus
DSDDWLTKYSY

SEQ ID NO: 177944 - protein, 11 aa, Yellow fever virus
SDDWLTKYSYY

SEQ ID NO: 177945 - protein, 11 aa, Yellow fever virus
DDWLTKYSYYP

SEQ ID NO: 177946 - protein, 11 aa, Yellow fever virus
DWLTKYSYYPE

SEQ ID NO: 177947 - protein, 11 aa, Yellow fever virus
WLTKYSYYPED

SEQ ID NO: 177948 - protein, 11 aa, Yellow fever virus
LTKYSYYPEDP

SEQ ID NO: 177949 - protein, 11 aa, Yellow fever virus
TKYSYYPEDPV

SEQ ID NO: 177950 - protein, 11 aa, Yellow fever virus
PEDPVKLASII

SEQ ID NO: 177951 - protein, 11 aa, Yellow fever virus
EDPVKLASIIK

SEQ ID NO: 177952 - protein, 11 aa, Yellow fever virus
DPVKLASIIKA

SEQ ID NO: 177953 - protein, 11 aa, Yellow fever virus
PVKLASIIKAS

SEQ ID NO: 177954 - protein, 11 aa, Yellow fever virus
VKLASIIKASH

SEQ ID NO: 177955 - protein, 11 aa, Yellow fever virus
KLASIIKASHE

SEQ ID NO: 177956 - protein, 11 aa, Yellow fever virus
LASIIKASHEE

SEQ ID NO: 177957 - protein, 11 aa, Yellow fever virus
ASIIKASHEEG

SEQ ID NO: 177958 - protein, 11 aa, Yellow fever virus
SIIKASHEEGK

SEQ ID NO: 177959 - protein, 11 aa, Yellow fever virus
IIKASHEEGKC

SEQ ID NO: 177960 - protein, 11 aa, Yellow fever virus
IKASHEEGKCG

SEQ ID NO: 177961 - protein, 11 aa, Yellow fever virus
KASHEEGKCGL

SEQ ID NO: 177962 - protein, 11 aa, Yellow fever virus
ASHEEGKCGLN

SEQ ID NO: 177963 - protein, 11 aa, Yellow fever virus
SHEEGKCGLNS

SEQ ID NO: 177964 - protein, 11 aa, Yellow fever virus
HEEGKCGLNSV

SEQ ID NO: 177965 - protein, 11 aa, Yellow fever virus
KCGLNSVDSLD

SEQ ID NO: 177966 - protein, 11 aa, Yellow fever virus
CGLNSVDSLDH

SEQ ID NO: 177967 - protein, 11 aa, Yellow fever virus
GLNSVDSLDHE

SEQ ID NO: 177968 - protein, 11 aa, Yellow fever virus
LNSVDSLDHEM

SEQ ID NO: 177969 - protein, 11 aa, Yellow fever virus
NSVDSLDHEMW

SEQ ID NO: 177970 - protein, 11 aa, Yellow fever virus
SVDSLDHEMWR

SEQ ID NO: 177971 - protein, 11 aa, Yellow fever virus
VDSLDHEMWRS

SEQ ID NO: 177972 - protein, 11 aa, Yellow fever virus
DSLDHEMWRSR

SEQ ID NO: 177973 - protein, 11 aa, Yellow fever virus
SLDHEMWRSRA

SEQ ID NO: 177974 - protein, 11 aa, Yellow fever virus
LDHEMWRSRAD

SEQ ID NO: 177975 - protein, 11 aa, Yellow fever virus
DHEMWRSRADE

SEQ ID NO: 177976 - protein, 11 aa, Yellow fever virus
RSRADEINAIL

SEQ ID NO: 177977 - protein, 11 aa, Yellow fever virus
SRADEINAILE

SEQ ID NO: 177978 - protein, 11 aa, Yellow fever virus
RADEINAILEE

SEQ ID NO: 177979 - protein, 11 aa, Yellow fever virus
ADEINAILEEN

SEQ ID NO: 177980 - protein, 11 aa, Yellow fever virus
DEINAILEENE

SEQ ID NO: 177981 - protein, 11 aa, Yellow fever virus
EINAILEENEV

SEQ ID NO: 177982 - protein, 11 aa, Yellow fever virus
INAILEENEVD

SEQ ID NO: 177983 - protein, 11 aa, Yellow fever virus
NAILEENEVDI

SEQ ID NO: 177984 - protein, 11 aa, Yellow fever virus
AILEENEVDIS

SEQ ID NO: 177985 - protein, 11 aa, Yellow fever virus
ILEENEVDISV

SEQ ID NO: 177986 - protein, 11 aa, Yellow fever virus
LEENEVDISVV

SEQ ID NO: 177987 - protein, 11 aa, Yellow fever virus
EENEVDISIVV

SEQ ID NO: 177988 - protein, 11 aa, Yellow fever virus
ENEVDISIVVQ

SEQ ID NO: 177989 - protein, 11 aa, Yellow fever virus
NEVDISIVVQD

SEQ ID NO: 177990 - protein, 11 aa, Yellow fever virus
EVDISIVVQDP

SEQ ID NO: 177991 - protein, 11 aa, Yellow fever virus
VDISIVVQDPK

SEQ ID NO: 177992 - protein, 11 aa, Yellow fever virus
DISIVVQDPKN

SEQ ID NO: 177993 - protein, 11 aa, Yellow fever virus
ISVVVQDPKNI

SEQ ID NO: 177994 - protein, 11 aa, Yellow fever virus
SVVVQDPKNIY

SEQ ID NO: 177995 - protein, 11 aa, Yellow fever virus
VVVQDPKNIYQ

SEQ ID NO: 177996 - protein, 11 aa, Yellow fever virus
VVQDPKNIYQR

SEQ ID NO: 177997 - protein, 11 aa, Yellow fever virus
VQDPKNIYQRG

SEQ ID NO: 177998 - protein, 11 aa, Yellow fever virus
QDPKNIYQRGT

SEQ ID NO: 177999 - protein, 11 aa, Yellow fever virus
DPKNIYQRGTH

SEQ ID NO: 178000 - protein, 11 aa, Yellow fever virus
PKNIYQRGTHP

SEQ ID NO: 178001 - protein, 11 aa, Yellow fever virus
KNIYQRGTHPF

SEQ ID NO: 178002 - protein, 11 aa, Yellow fever virus
NIYQRGTHPFS

SEQ ID NO: 178003 - protein, 11 aa, Yellow fever virus
IYQRGTHPFSR

SEQ ID NO: 178004 - protein, 11 aa, Yellow fever virus
LQYGWKTWGKS

SEQ ID NO: 178005 - protein, 11 aa, Yellow fever virus
QYGWKTWGKSL

SEQ ID NO: 178006 - protein, 11 aa, Yellow fever virus
YGWKTWGKNLI

SEQ ID NO: 178007 - protein, 11 aa, Yellow fever virus
GWKTWGKNLIF

SEQ ID NO: 178008 - protein, 11 aa, Yellow fever virus
WKTWGKNLIFS

SEQ ID NO: 178009 - protein, 11 aa, Yellow fever virus
KTWGKNLIFSP

SEQ ID NO: 178010 - protein, 11 aa, Yellow fever virus
TWGKNLIFSPG

SEQ ID NO: 178011 - protein, 11 aa, Yellow fever virus
WGKNLIFSPGR

SEQ ID NO: 178012 - protein, 11 aa, Yellow fever virus
GKNLIFSPGRK

SEQ ID NO: 178013 - protein, 11 aa, Yellow fever virus
KNLIFSPGRKN

SEQ ID NO: 178014 - protein, 11 aa, Yellow fever virus
NLIFSPGRKNG

SEQ ID NO: 178015 - protein, 11 aa, Yellow fever virus
LIFSPGRKNGS

SEQ ID NO: 178016 - protein, 11 aa, Yellow fever virus
IFSPGRKNGSF

SEQ ID NO: 178017 - protein, 11 aa, Yellow fever virus
WNSFQIEEFGM

SEQ ID NO: 178018 - protein, 11 aa, Yellow fever virus
NSFQIEEFGMG

SEQ ID NO: 178019 - protein, 11 aa, Yellow fever virus
SFQIEEFGMGV

SEQ ID NO: 178020 - protein, 11 aa, Yellow fever virus
FQIEEFGMGVF

SEQ ID NO: 178021 - protein, 11 aa, Yellow fever virus
QIEEFGMGVFT

SEQ ID NO: 178022 - protein, 11 aa, Yellow fever virus
IEEFGMGVFTT

SEQ ID NO: 178023 - protein, 11 aa, Yellow fever virus
EEFGMGVFTTR

SEQ ID NO: 178024 - protein, 11 aa, Yellow fever virus
EFGMGVFTTRV

SEQ ID NO: 178025 - protein, 11 aa, Yellow fever virus
FGMGVFTTRVF

SEQ ID NO: 178026 - protein, 11 aa, Yellow fever virus
GMGVFTTRVFM

SEQ ID NO: 178027 - protein, 11 aa, Yellow fever virus
MGVFTTRVFMD

SEQ ID NO: 178028 - protein, 11 aa, Yellow fever virus
GVFTTRVFMDA

SEQ ID NO: 178029 - protein, 11 aa, Yellow fever virus
VFTTRVFMDAV

SEQ ID NO: 178030 - protein, 11 aa, Yellow fever virus
FTTRVFMDAVF

SEQ ID NO: 178031 - protein, 11 aa, Yellow fever virus
TTRVFMDAVFD

SEQ ID NO: 178032 - protein, 11 aa, Yellow fever virus
TRVFMDAVFDY

SEQ ID NO: 178033 - protein, 11 aa, Yellow fever virus
RVFMDAVFDYS

SEQ ID NO: 178034 - protein, 11 aa, Yellow fever virus
VFMDAVFDYSV

SEQ ID NO: 178035 - protein, 11 aa, Yellow fever virus
FMDAVFDYSVD

SEQ ID NO: 178036 - protein, 11 aa, Yellow fever virus
MDAVFDYSVDC

SEQ ID NO: 178037 - protein, 11 aa, Yellow fever virus
DAVFDYSVDCD

SEQ ID NO: 178038 - protein, 11 aa, Yellow fever virus
AVFDYSVDCDG

SEQ ID NO: 178039 - protein, 11 aa, Yellow fever virus
VFDYSVDCDGA

SEQ ID NO: 178040 - protein, 11 aa, Yellow fever virus
FDYSVDCDGAI

SEQ ID NO: 178041 - protein, 11 aa, Yellow fever virus
DYSVDCDGAIL

SEQ ID NO: 178042 - protein, 11 aa, Yellow fever virus
YSVDCDGAILG

SEQ ID NO: 178043 - protein, 11 aa, Yellow fever virus
SVDCDGAILGA

SEQ ID NO: 178044 - protein, 11 aa, Yellow fever virus
VDCDGAILGAA

SEQ ID NO: 178045 - protein, 11 aa, Yellow fever virus
DCDGAILGAAV

SEQ ID NO: 178046 - protein, 11 aa, Yellow fever virus
CDGAILGAAVN

SEQ ID NO: 178047 - protein, 11 aa, Yellow fever virus
DGAILGAAVNG

SEQ ID NO: 178048 - protein, 11 aa, Yellow fever virus
GAILGAAVNGK

SEQ ID NO: 178049 - protein, 11 aa, Yellow fever virus
AILGAAVNGKK

SEQ ID NO: 178050 - protein, 11 aa, Yellow fever virus
GSHEVNGTWMM

SEQ ID NO: 178051 - protein, 11 aa, Yellow fever virus
SHEVNGTWMMH

SEQ ID NO: 178052 - protein, 11 aa, Yellow fever virus
HEVNGTWMVHT

SEQ ID NO: 178053 - protein, 11 aa, Yellow fever virus
EVNGTWMMHTL

SEQ ID NO: 178054 - protein, 11 aa, Yellow fever virus
VNGTWMMHTLE

SEQ ID NO: 178055 - protein, 11 aa, Yellow fever virus
NGTWMIHTLET

SEQ ID NO: 178056 - protein, 11 aa, Yellow fever virus
GTWMIHTLETL

SEQ ID NO: 178057 - protein, 11 aa, Yellow fever virus
TWMIHTLETLD

SEQ ID NO: 178058 - protein, 11 aa, Yellow fever virus
WMIHTLETLDY

SEQ ID NO: 178059 - protein, 11 aa, Yellow fever virus
MIHTLETLDYK

SEQ ID NO: 178060 - protein, 11 aa, Yellow fever virus
IHTLETLDYKE

SEQ ID NO: 178061 - protein, 11 aa, Yellow fever virus
HTLETLDYKEC

SEQ ID NO: 178062 - protein, 11 aa, Yellow fever virus
TLETLDYKECE

SEQ ID NO: 178063 - protein, 11 aa, Yellow fever virus
LETLDYKECEW

SEQ ID NO: 178064 - protein, 11 aa, Yellow fever virus
ETLDYKECEWP

SEQ ID NO: 178065 - protein, 11 aa, Yellow fever virus
TLDYKECEWPL

SEQ ID NO: 178066 - protein, 11 aa, Yellow fever virus
LDYKECEWPPT

SEQ ID NO: 178067 - protein, 11 aa, Yellow fever virus
DYKECEWPPTH

SEQ ID NO: 178068 - protein, 11 aa, Yellow fever virus
YKECEWPPTHT

SEQ ID NO: 178069 - protein, 11 aa, Yellow fever virus
KECEWPPTHTI

SEQ ID NO: 178070 - protein, 11 aa, Yellow fever virus
ECEWPPTHTIG

SEQ ID NO: 178071 - protein, 11 aa, Yellow fever virus
CEWPPTHTIGT

SEQ ID NO: 178072 - protein, 11 aa, Yellow fever virus
EWPPTHTIGTS

SEQ ID NO: 178073 - protein, 11 aa, Yellow fever virus
WPPTHTIGTSV

SEQ ID NO: 178074 - protein, 11 aa, Yellow fever virus
PPTHTIGTSVE

SEQ ID NO: 178075 - protein, 11 aa, Yellow fever virus
PTHTIGTSVEE

SEQ ID NO: 178076 - protein, 11 aa, Yellow fever virus
HTIGTSVEESD

SEQ ID NO: 178077 - protein, 11 aa, Yellow fever virus
TIGTSVEESDM

SEQ ID NO: 178078 - protein, 11 aa, Yellow fever virus
IGTSVEESDMF

SEQ ID NO: 178079 - protein, 11 aa, Yellow fever virus
GTSVEESDMFM

SEQ ID NO: 178080 - protein, 11 aa, Yellow fever virus
TSVEESDMFMP

SEQ ID NO: 178081 - protein, 11 aa, Yellow fever virus
SVEESDMFMPR

SEQ ID NO: 178082 - protein, 11 aa, Yellow fever virus
VEESDMFMPRS

SEQ ID NO: 178083 - protein, 11 aa, Yellow fever virus
EESDMFMPRSI

SEQ ID NO: 178084 - protein, 11 aa, Yellow fever virus
ESDMFMPRSIG

SEQ ID NO: 178085 - protein, 11 aa, Yellow fever virus
SDMFMPRSIGG

SEQ ID NO: 178086 - protein, 11 aa, Yellow fever virus
DMFMPRSIGGP

SEQ ID NO: 178087 - protein, 11 aa, Yellow fever virus
SIGGPVSSHNR

SEQ ID NO: 178088 - protein, 11 aa, Yellow fever virus
IGGPVSSHNRI

SEQ ID NO: 178089 - protein, 11 aa, Yellow fever virus
GGPVSSHNRIP

SEQ ID NO: 178090 - protein, 11 aa, Yellow fever virus
GPVSSHNRIPG

SEQ ID NO: 178091 - protein, 11 aa, Yellow fever virus
PVSSHNRIPGY

SEQ ID NO: 178092 - protein, 11 aa, Yellow fever virus
VSSHNRIPGYK

SEQ ID NO: 178093 - protein, 11 aa, Yellow fever virus
SSHNRIPGYKV

SEQ ID NO: 178094 - protein, 11 aa, Yellow fever virus
SHNRIPGYKVQ

SEQ ID NO: 178095 - protein, 11 aa, Yellow fever virus
HNRIPGYKVQT

SEQ ID NO: 178096 - protein, 11 aa, Yellow fever virus
NRIPGYKVQTN

SEQ ID NO: 178097 - protein, 11 aa, Yellow fever virus
RIPGYKVQTNG

SEQ ID NO: 178098 - protein, 11 aa, Yellow fever virus
GPWMQVPLEVR

SEQ ID NO: 178099 - protein, 11 aa, Yellow fever virus
PWMQVPLEVRR

SEQ ID NO: 178100 - protein, 11 aa, Yellow fever virus
WMQVPLEVRRE

SEQ ID NO: 178101 - protein, 11 aa, Yellow fever virus
MQVPLEVRREP

SEQ ID NO: 178102 - protein, 11 aa, Yellow fever virus
QVPLEVRREAC

SEQ ID NO: 178103 - protein, 11 aa, Yellow fever virus
VPLEVRREPCP

SEQ ID NO: 178104 - protein, 11 aa, Yellow fever virus
PLEVRREPCPG

SEQ ID NO: 178105 - protein, 11 aa, Yellow fever virus
LEVRREACPGT

SEQ ID NO: 178106 - protein, 11 aa, Yellow fever virus
EVRREACPGTS

SEQ ID NO: 178107 - protein, 11 aa, Yellow fever virus
VRREPCPGTSV

SEQ ID NO: 178108 - protein, 11 aa, Yellow fever virus
RREACPGTSVI

SEQ ID NO: 178109 - protein, 11 aa, Yellow fever virus
REPCPGTSVVV

SEQ ID NO: 178110 - protein, 11 aa, Yellow fever virus
EPCPGTSVVLD

SEQ ID NO: 178111 - protein, 11 aa, Yellow fever virus
PCPGTSVVVDT

SEQ ID NO: 178112 - protein, 11 aa, Yellow fever virus
CPGTSVVVDTS

SEQ ID NO: 178113 - protein, 11 aa, Yellow fever virus
PGTSVVVDSNC

SEQ ID NO: 178114 - protein, 11 aa, Yellow fever virus
GTSVVVDTSCD

SEQ ID NO: 178115 - protein, 11 aa, Yellow fever virus
TSVVLDTGCDG

SEQ ID NO: 178116 - protein, 11 aa, Yellow fever virus
SVVVDTSCDGR

SEQ ID NO: 178117 - protein, 11 aa, Yellow fever virus
VVLDTGCDGRG

SEQ ID NO: 178118 - protein, 11 aa, Yellow fever virus
VVDSNCDGRGK

SEQ ID NO: 178119 - protein, 11 aa, Yellow fever virus
VDTSCDGRGKS

SEQ ID NO: 178120 - protein, 11 aa, Yellow fever virus
DGNCDGRGKSA

SEQ ID NO: 178121 - protein, 11 aa, Yellow fever virus
SNCDGRGKSTR

SEQ ID NO: 178122 - protein, 11 aa, Yellow fever virus
NCDGRGKSARS

SEQ ID NO: 178123 - protein, 11 aa, Yellow fever virus
CDGRGKSARST

SEQ ID NO: 178124 - protein, 11 aa, Yellow fever virus
DGRGKSARSTT

SEQ ID NO: 178125 - protein, 11 aa, Yellow fever virus
GRGKSARSTTD

SEQ ID NO: 178126 - protein, 11 aa, Yellow fever virus
RGKSARSTTDS

SEQ ID NO: 178127 - protein, 11 aa, Yellow fever virus
GKSARSTTDSG

SEQ ID NO: 178128 - protein, 11 aa, Yellow fever virus
KSARSTTDSGK

SEQ ID NO: 178129 - protein, 11 aa, Yellow fever virus
STRSTTDSGKI

SEQ ID NO: 178130 - protein, 11 aa, Yellow fever virus
TRSTTDSGKII

SEQ ID NO: 178131 - protein, 11 aa, Yellow fever virus
RSTTDSGKIIP

SEQ ID NO: 178132 - protein, 11 aa, Yellow fever virus
STTDSGKIIPE

SEQ ID NO: 178133 - protein, 11 aa, Yellow fever virus
TTDSGKIIPEW

SEQ ID NO: 178134 - protein, 11 aa, Yellow fever virus
TDSGKIIPEWC

SEQ ID NO: 178135 - protein, 11 aa, Yellow fever virus
DSGKIIPEWCC

SEQ ID NO: 178136 - protein, 11 aa, Yellow fever virus
SGKIIPEWCCR

SEQ ID NO: 178137 - protein, 11 aa, Yellow fever virus
GKIIPEWCCRS

SEQ ID NO: 178138 - protein, 11 aa, Yellow fever virus
KIIPEWCCRSC

SEQ ID NO: 178139 - protein, 11 aa, Yellow fever virus
IIPEWCCRSCT

SEQ ID NO: 178140 - protein, 11 aa, Yellow fever virus
CTMPPVSFHGN

SEQ ID NO: 178141 - protein, 11 aa, Yellow fever virus
TMPPVSFHGND

SEQ ID NO: 178142 - protein, 11 aa, Yellow fever virus
MPPVSFHGNDG

SEQ ID NO: 178143 - protein, 11 aa, Yellow fever virus
PPVSFHGNDGC

SEQ ID NO: 178144 - protein, 11 aa, Yellow fever virus
PVSFHGNDGCW

SEQ ID NO: 178145 - protein, 11 aa, Yellow fever virus
VSFHGNDGCWY

SEQ ID NO: 178146 - protein, 11 aa, Yellow fever virus
SFHGNDGCWYP

SEQ ID NO: 178147 - protein, 11 aa, Yellow fever virus
FHGNDGCWYPM

SEQ ID NO: 178148 - protein, 11 aa, Yellow fever virus
HGNDGCWYPME

SEQ ID NO: 178149 - protein, 11 aa, Yellow fever virus
GNDGCWYPMEI

SEQ ID NO: 178150 - protein, 11 aa, Yellow fever virus
NDGCWYPMEIR

SEQ ID NO: 178151 - protein, 11 aa, Yellow fever virus
GCWYPMEIRPM

SEQ ID NO: 178152 - protein, 11 aa, Yellow fever virus
CWYPMEIRPMK

SEQ ID NO: 178153 - protein, 11 aa, Yellow fever virus
WYPMEIRPMKT

SEQ ID NO: 178154 - protein, 11 aa, Yellow fever virus
YPMEIRPMKTH

SEQ ID NO: 178155 - protein, 11 aa, Yellow fever virus
PMEIRPMKTHE

SEQ ID NO: 178156 - protein, 11 aa, Yellow fever virus
MEIRPMKTHES

SEQ ID NO: 178157 - protein, 11 aa, Yellow fever virus
EIRPMKTHESH

SEQ ID NO: 178158 - protein, 11 aa, Yellow fever virus
IRPMKTHESHL

SEQ ID NO: 178159 - protein, 11 aa, Yellow fever virus
RPMKTHESHLV

SEQ ID NO: 178160 - protein, 11 aa, Yellow fever virus
PMKTHESHLVR

SEQ ID NO: 178161 - protein, 11 aa, Yellow fever virus
MKTHESHLVRS

SEQ ID NO: 178162 - protein, 11 aa, Yellow fever virus
KAHESHLVRSW

SEQ ID NO: 178163 - protein, 11 aa, Yellow fever virus
TSDSHLVRSWV

SEQ ID NO: 178164 - protein, 11 aa, Yellow fever virus
SDSHLVRSWVT

SEQ ID NO: 178165 - protein, 11 aa, Yellow fever virus
DSHLVRSWVTA

SEQ ID NO: 178166 - protein, 11 aa, Yellow fever virus
LVRSWVTAGEV

SEQ ID NO: 178167 - protein, 11 aa, Yellow fever virus
VRSWVTAGEVH

SEQ ID NO: 178168 - protein, 11 aa, Yellow fever virus
RSWVTAGEVHA

SEQ ID NO: 178169 - protein, 11 aa, Yellow fever virus
SWVTAGEVHAV

SEQ ID NO: 178170 - protein, 11 aa, Yellow fever virus
WVTAGEVHAVP

SEQ ID NO: 178171 - protein, 11 aa, Yellow fever virus
VTAGEVHAVPF

SEQ ID NO: 178172 - protein, 11 aa, Yellow fever virus
TAGEVHAVPFG

SEQ ID NO: 178173 - protein, 11 aa, Yellow fever virus
AGEVHAVPFGL

SEQ ID NO: 178174 - protein, 11 aa, Yellow fever virus
GEVHAVPFGLV

SEQ ID NO: 178175 - protein, 11 aa, Yellow fever virus
EVHAVPFGLVS

SEQ ID NO: 178176 - protein, 11 aa, Yellow fever virus
VHAVPFGLVSM

SEQ ID NO: 178177 - protein, 11 aa, Yellow fever virus
PFGLVSMMIAL

SEQ ID NO: 178178 - protein, 11 aa, Yellow fever virus
FGLVSMMIALE

SEQ ID NO: 178179 - protein, 11 aa, Yellow fever virus
GLVSMMIALEV

SEQ ID NO: 178180 - protein, 11 aa, Yellow fever virus
LVSMMIALEVV

SEQ ID NO: 178181 - protein, 11 aa, Yellow fever virus
VSMMIALEVVL

SEQ ID NO: 178182 - protein, 11 aa, Yellow fever virus
SMMIALEVVLR

SEQ ID NO: 178183 - protein, 11 aa, Yellow fever virus
MMIALEVVLRK

SEQ ID NO: 178184 - protein, 11 aa, Yellow fever virus
MIALEVVLRKR

SEQ ID NO: 178185 - protein, 11 aa, Yellow fever virus
IAMEVVLRRRQ

SEQ ID NO: 178186 - protein, 11 aa, Yellow fever virus
ALEVVLRKRQG

SEQ ID NO: 178187 - protein, 11 aa, Yellow fever virus
LEVVLRKRQGP

SEQ ID NO: 178188 - protein, 11 aa, Yellow fever virus
EVVLRRRQGPK

SEQ ID NO: 178189 - protein, 11 aa, Yellow fever virus
VVLRRRQGPKQ

SEQ ID NO: 178190 - protein, 11 aa, Yellow fever virus
VLRKRQGPKQV

SEQ ID NO: 178191 - protein, 11 aa, Yellow fever virus
LRKRQGPKQVL

SEQ ID NO: 178192 - protein, 11 aa, Yellow fever virus
RRRQGPKQMLV

SEQ ID NO: 178193 - protein, 11 aa, Yellow fever virus
KRQGPKQVLVG

SEQ ID NO: 178194 - protein, 11 aa, Yellow fever virus
RQGPKQVLVGG

SEQ ID NO: 178195 - protein, 11 aa, Yellow fever virus
QGPKQMLVGGI

SEQ ID NO: 178196 - protein, 11 aa, Yellow fever virus
GPKQMLVGGII

SEQ ID NO: 178197 - protein, 11 aa, Yellow fever virus
PKQMLVGGIIL

SEQ ID NO: 178198 - protein, 11 aa, Yellow fever virus
KQMLVGGIILL

SEQ ID NO: 178199 - protein, 11 aa, Yellow fever virus
QMLVGGIILLG

SEQ ID NO: 178200 - protein, 11 aa, Yellow fever virus
MLVGGIILLGA

SEQ ID NO: 178201 - protein, 11 aa, Yellow fever virus
LVGGIILLGAM

SEQ ID NO: 178202 - protein, 11 aa, Yellow fever virus
VGGIILLGAML

SEQ ID NO: 178203 - protein, 11 aa, Yellow fever virus
GGIILLGAMLV

SEQ ID NO: 178204 - protein, 11 aa, Yellow fever virus
GIILLGAMLVG

SEQ ID NO: 178205 - protein, 11 aa, Yellow fever virus
IILLGAMLVGQ

SEQ ID NO: 178206 - protein, 11 aa, Yellow fever virus
ILLGAMLVGQV

SEQ ID NO: 178207 - protein, 11 aa, Yellow fever virus
LGAMLVGQVTV

SEQ ID NO: 178208 - protein, 11 aa, Yellow fever virus
GAMLVGQVTVL

SEQ ID NO: 178209 - protein, 11 aa, Yellow fever virus
AMLVGQVTVLD

SEQ ID NO: 178210 - protein, 11 aa, Yellow fever virus
MLVGQVTVLDL

SEQ ID NO: 178211 - protein, 11 aa, Yellow fever virus
LVGQVTVLDLV

SEQ ID NO: 178212 - protein, 11 aa, Yellow fever virus
VGQVTVLDLVK

SEQ ID NO: 178213 - protein, 11 aa, Yellow fever virus
LIVAVGLHFHE

SEQ ID NO: 178214 - protein, 11 aa, Yellow fever virus
IVAVGLHFHEI

SEQ ID NO: 178215 - protein, 11 aa, Yellow fever virus
VAVGLHFHEIN

SEQ ID NO: 178216 - protein, 11 aa, Yellow fever virus
AVGLHFHEINN

SEQ ID NO: 178217 - protein, 11 aa, Yellow fever virus
VGLHFHEINNG

SEQ ID NO: 178218 - protein, 11 aa, Yellow fever virus
GLHFHEINNGG

SEQ ID NO: 178219 - protein, 11 aa, Yellow fever virus
LHFHEINNGGD

SEQ ID NO: 178220 - protein, 11 aa, Yellow fever virus
HFHEINNGGDA

SEQ ID NO: 178221 - protein, 11 aa, Yellow fever virus
FHEINNGGDAM

SEQ ID NO: 178222 - protein, 11 aa, Yellow fever virus
HEINNGGDAMY

SEQ ID NO: 178223 - protein, 11 aa, Yellow fever virus
EINNGGDAMYM

SEQ ID NO: 178224 - protein, 11 aa, Yellow fever virus
INNGGDAMYMA

SEQ ID NO: 178225 - protein, 11 aa, Yellow fever virus
GDAMYMALIAS

SEQ ID NO: 178226 - protein, 11 aa, Yellow fever virus
DAMYMALIASF

SEQ ID NO: 178227 - protein, 11 aa, Yellow fever virus
AMYMALIASFS

SEQ ID NO: 178228 - protein, 11 aa, Yellow fever virus
MYMALIASFSI

SEQ ID NO: 178229 - protein, 11 aa, Yellow fever virus
YMALIASFSIR

SEQ ID NO: 178230 - protein, 11 aa, Yellow fever virus
MALIASFSIRP

SEQ ID NO: 178231 - protein, 11 aa, Yellow fever virus
ALIASFSIRPG

SEQ ID NO: 178232 - protein, 11 aa, Yellow fever virus
LIASFSIRPGL

SEQ ID NO: 178233 - protein, 11 aa, Yellow fever virus
IASFSIRPGLL

SEQ ID NO: 178234 - protein, 11 aa, Yellow fever virus
AAFSVRPGLLI

SEQ ID NO: 178235 - protein, 11 aa, Yellow fever virus
AFSVRPGLLIG

SEQ ID NO: 178236 - protein, 11 aa, Yellow fever virus
FSVRPGLLIGF

SEQ ID NO: 178237 - protein, 11 aa, Yellow fever virus
SVRPGLLIGFG

SEQ ID NO: 178238 - protein, 11 aa, Yellow fever virus
VRPGLLIGFGL

SEQ ID NO: 178239 - protein, 11 aa, Yellow fever virus
RPGLLMGFGLR

SEQ ID NO: 178240 - protein, 11 aa, Yellow fever virus
PGLLVGFGLRT

SEQ ID NO: 178241 - protein, 11 aa, Yellow fever virus
GLLMGFGLRTL

SEQ ID NO: 178242 - protein, 11 aa, Yellow fever virus
LLVGFGLRTLW

SEQ ID NO: 178243 - protein, 11 aa, Yellow fever virus
LMGFGLRTLWS

SEQ ID NO: 178244 - protein, 11 aa, Yellow fever virus
MGFGLRTLWSP

SEQ ID NO: 178245 - protein, 11 aa, Yellow fever virus
TLWSPRERLVM

SEQ ID NO: 178246 - protein, 11 aa, Yellow fever virus
LWSPRERLVMA

SEQ ID NO: 178247 - protein, 11 aa, Yellow fever virus
WSPRERLVMAF

SEQ ID NO: 178248 - protein, 11 aa, Yellow fever virus
SPRERLVMAFG

SEQ ID NO: 178249 - protein, 11 aa, Yellow fever virus
PRERLVMAFGA

SEQ ID NO: 178250 - protein, 11 aa, Yellow fever virus
RERLVMAFGAA

SEQ ID NO: 178251 - protein, 11 aa, Yellow fever virus
ERLVMAFGAAM

SEQ ID NO: 178252 - protein, 11 aa, Yellow fever virus
RLVMAFGAAMV

SEQ ID NO: 178253 - protein, 11 aa, Yellow fever virus
LVMAFGAAMVE

SEQ ID NO: 178254 - protein, 11 aa, Yellow fever virus
VLALGAAMVEI

SEQ ID NO: 178255 - protein, 11 aa, Yellow fever virus
LALGAAMVEIA

SEQ ID NO: 178256 - protein, 11 aa, Yellow fever virus
ALGAAMVEIAL

SEQ ID NO: 178257 - protein, 11 aa, Yellow fever virus
FGAAMVEVALG

SEQ ID NO: 178258 - protein, 11 aa, Yellow fever virus
GAAMVEVALGG

SEQ ID NO: 178259 - protein, 11 aa, Yellow fever virus
AAMVEIALGGM

SEQ ID NO: 178260 - protein, 11 aa, Yellow fever virus
AMVEIALGGMM

SEQ ID NO: 178261 - protein, 11 aa, Yellow fever virus
MVEIALGGMMG

SEQ ID NO: 178262 - protein, 11 aa, Yellow fever virus
VEIALGGMMGG

SEQ ID NO: 178263 - protein, 11 aa, Yellow fever virus
EIALGGMMGGL

SEQ ID NO: 178264 - protein, 11 aa, Yellow fever virus
IALGGMMGGLW

SEQ ID NO: 178265 - protein, 11 aa, Yellow fever virus
ALGGMMGGLWK

SEQ ID NO: 178266 - protein, 11 aa, Yellow fever virus
LGGMMGGLWKY

SEQ ID NO: 178267 - protein, 11 aa, Yellow fever virus
GGMMGGLWKYL

SEQ ID NO: 178268 - protein, 11 aa, Yellow fever virus
GMMGGLWKYLN

SEQ ID NO: 178269 - protein, 11 aa, Yellow fever virus
MMGGLWKYLNA

SEQ ID NO: 178270 - protein, 11 aa, Yellow fever virus
MGGLWQYLNAV

SEQ ID NO: 178271 - protein, 11 aa, Yellow fever virus
GGLWQYLNAVS

SEQ ID NO: 178272 - protein, 11 aa, Yellow fever virus
GLWQYLNAVSL

SEQ ID NO: 178273 - protein, 11 aa, Yellow fever virus
LWQYLNAVSLC

SEQ ID NO: 178274 - protein, 11 aa, Yellow fever virus
WQYLNAVSLCV

SEQ ID NO: 178275 - protein, 11 aa, Yellow fever virus
QYLNAVSLCVL

SEQ ID NO: 178276 - protein, 11 aa, Yellow fever virus
YLNAVSLCVLT

SEQ ID NO: 178277 - protein, 11 aa, Yellow fever virus
LNAVSLCVLTI

SEQ ID NO: 178278 - protein, 11 aa, Yellow fever virus
NAVSLCVLTIN

SEQ ID NO: 178279 - protein, 11 aa, Yellow fever virus
AVSLCVLTINA

SEQ ID NO: 178280 - protein, 11 aa, Yellow fever virus
VSLCVLTINAI

SEQ ID NO: 178281 - protein, 11 aa, Yellow fever virus
SLCVLTINAIS

SEQ ID NO: 178282 - protein, 11 aa, Yellow fever virus
LCVLTINAISS

SEQ ID NO: 178283 - protein, 11 aa, Yellow fever virus
CVLTINAISSR

SEQ ID NO: 178284 - protein, 11 aa, Yellow fever virus
VLTINAISSRK

SEQ ID NO: 178285 - protein, 11 aa, Yellow fever virus
LTINAISSRKA

SEQ ID NO: 178286 - protein, 11 aa, Yellow fever virus
TINAISSRKAS

SEQ ID NO: 178287 - protein, 11 aa, Yellow fever virus
INAISSRKASN

SEQ ID NO: 178288 - protein, 11 aa, Yellow fever virus
NAISSRKASNA

SEQ ID NO: 178289 - protein, 11 aa, Yellow fever virus
AISSRKASNTI

SEQ ID NO: 178290 - protein, 11 aa, Yellow fever virus
VASRKASNAIL

SEQ ID NO: 178291 - protein, 11 aa, Yellow fever virus
SSRKASNTILP

SEQ ID NO: 178292 - protein, 11 aa, Yellow fever virus
SRKASNAVLPL

SEQ ID NO: 178293 - protein, 11 aa, Yellow fever virus
RKASNAILPLM

SEQ ID NO: 178294 - protein, 11 aa, Yellow fever virus
KASNAILPLMA

SEQ ID NO: 178295 - protein, 11 aa, Yellow fever virus
ASNAVLPLMAL

SEQ ID NO: 178296 - protein, 11 aa, Yellow fever virus
SNAVLPLMALL

SEQ ID NO: 178297 - protein, 11 aa, Yellow fever virus
NMILPLMALMT

SEQ ID NO: 178298 - protein, 11 aa, Yellow fever virus
AILPLMALLTP

SEQ ID NO: 178299 - protein, 11 aa, Yellow fever virus
VLPLMALLTPV

SEQ ID NO: 178300 - protein, 11 aa, Yellow fever virus
LPLMALMTPMT

SEQ ID NO: 178301 - protein, 11 aa, Yellow fever virus
PLMALMTPMTM

SEQ ID NO: 178302 - protein, 11 aa, Yellow fever virus
LMALLTPVTMH

SEQ ID NO: 178303 - protein, 11 aa, Yellow fever virus
MALLTPVTMYE

SEQ ID NO: 178304 - protein, 11 aa, Yellow fever virus
ALMTPMTMHEV

SEQ ID NO: 178305 - protein, 11 aa, Yellow fever virus
LLTPVTMYEVR

SEQ ID NO: 178306 - protein, 11 aa, Yellow fever virus
LTPVTMYEVRM

SEQ ID NO: 178307 - protein, 11 aa, Yellow fever virus
TPMTMHEVRMA

SEQ ID NO: 178308 - protein, 11 aa, Yellow fever virus
PVTMAEVRLAT

SEQ ID NO: 178309 - protein, 11 aa, Yellow fever virus
VTMAEVRLATM

SEQ ID NO: 178310 - protein, 11 aa, Yellow fever virus
TMAEVRLATML

SEQ ID NO: 178311 - protein, 11 aa, Yellow fever virus
MLFCTVVIIGV

SEQ ID NO: 178312 - protein, 11 aa, Yellow fever virus
LFCTVVIIGVL

SEQ ID NO: 178313 - protein, 11 aa, Yellow fever virus
FCTVVIIGVLH

SEQ ID NO: 178314 - protein, 11 aa, Yellow fever virus
CTVVIIGVLHQ

SEQ ID NO: 178315 - protein, 11 aa, Yellow fever virus
TVVIIGVLHQN

SEQ ID NO: 178316 - protein, 11 aa, Yellow fever virus
VVIIGVLHQNS

SEQ ID NO: 178317 - protein, 11 aa, Yellow fever virus
VIIGVLHQNSK

SEQ ID NO: 178318 - protein, 11 aa, Yellow fever virus
IIGVLHQNSKD

SEQ ID NO: 178319 - protein, 11 aa, Yellow fever virus
IGVLHQNSKDT

SEQ ID NO: 178320 - protein, 11 aa, Yellow fever virus
GVLHQNSKDTS

SEQ ID NO: 178321 - protein, 11 aa, Yellow fever virus
VLHQNSKDTSM

SEQ ID NO: 178322 - protein, 11 aa, Yellow fever virus
LHQNSKDTSMQ

SEQ ID NO: 178323 - protein, 11 aa, Yellow fever virus
HQNSKDTSMQK

SEQ ID NO: 178324 - protein, 11 aa, Yellow fever virus
QNSKDTSMQKT

SEQ ID NO: 178325 - protein, 11 aa, Yellow fever virus
NSKDTSMQKTI

SEQ ID NO: 178326 - protein, 11 aa, Yellow fever virus
SKDTSMQKTIP

SEQ ID NO: 178327 - protein, 11 aa, Yellow fever virus
KDTSMQKTIPI

SEQ ID NO: 178328 - protein, 11 aa, Yellow fever virus
DTSMQKTIPIV

SEQ ID NO: 178329 - protein, 11 aa, Yellow fever virus
TSMQKTIPIVA

SEQ ID NO: 178330 - protein, 11 aa, Yellow fever virus
SMQKTIPIVAL

SEQ ID NO: 178331 - protein, 11 aa, Yellow fever virus
MQKTIPIVALT

SEQ ID NO: 178332 - protein, 11 aa, Yellow fever virus
QKTIPIVALTL

SEQ ID NO: 178333 - protein, 11 aa, Yellow fever virus
KTIPIVALTLT

SEQ ID NO: 178334 - protein, 11 aa, Yellow fever virus
TIPIVALTLTS

SEQ ID NO: 178335 - protein, 11 aa, Yellow fever virus
IPIVALTLTSY

SEQ ID NO: 178336 - protein, 11 aa, Yellow fever virus
PIVALTLTSYM

SEQ ID NO: 178337 - protein, 11 aa, Yellow fever virus
IVALTLTSYMG

SEQ ID NO: 178338 - protein, 11 aa, Yellow fever virus
VALTLTSYMGL

SEQ ID NO: 178339 - protein, 11 aa, Yellow fever virus
ALTLTSYMGLT

SEQ ID NO: 178340 - protein, 11 aa, Yellow fever virus
LTLTSYMGLTQ

SEQ ID NO: 178341 - protein, 11 aa, Yellow fever virus
TLTSYMGLTQP

SEQ ID NO: 178342 - protein, 11 aa, Yellow fever virus
LTSYMGLTQPF

SEQ ID NO: 178343 - protein, 11 aa, Yellow fever virus
TSYMGLTQPFL

SEQ ID NO: 178344 - protein, 11 aa, Yellow fever virus
SYMGLTQPFLG

SEQ ID NO: 178345 - protein, 11 aa, Yellow fever virus
YMGLTQPFLGL

SEQ ID NO: 178346 - protein, 11 aa, Yellow fever virus
MGLTQPFLGLC

SEQ ID NO: 178347 - protein, 11 aa, Yellow fever virus
LTQPFLGLCAY

SEQ ID NO: 178348 - protein, 11 aa, Yellow fever virus
TQPFLGLCAYM

SEQ ID NO: 178349 - protein, 11 aa, Yellow fever virus
QPFLGLCAYMS

SEQ ID NO: 178350 - protein, 11 aa, Yellow fever virus
PFLGLCAYMST

SEQ ID NO: 178351 - protein, 11 aa, Yellow fever virus
FLGLCAYMSTQ

SEQ ID NO: 178352 - protein, 11 aa, Yellow fever virus
LGLCAYMSTQV

SEQ ID NO: 178353 - protein, 11 aa, Yellow fever virus
GLCAYMSTQVF

SEQ ID NO: 178354 - protein, 11 aa, Yellow fever virus
LCAYMSTQVFG

SEQ ID NO: 178355 - protein, 11 aa, Yellow fever virus
CAYMSTQVFGR

SEQ ID NO: 178356 - protein, 11 aa, Yellow fever virus
AYMSTQVFGRR

SEQ ID NO: 178357 - protein, 11 aa, Yellow fever virus
YMSTQVFGRRS

SEQ ID NO: 178358 - protein, 11 aa, Yellow fever virus
MSTQVFGRRSI

SEQ ID NO: 178359 - protein, 11 aa, Yellow fever virus
STQVFGRRSIP

SEQ ID NO: 178360 - protein, 11 aa, Yellow fever virus
TQVFGRRSIPV

SEQ ID NO: 178361 - protein, 11 aa, Yellow fever virus
QVFGRRSIPVN

SEQ ID NO: 178362 - protein, 11 aa, Yellow fever virus
VFGRRSIPVNE

SEQ ID NO: 178363 - protein, 11 aa, Yellow fever virus
SIPVNEALAAT

SEQ ID NO: 178364 - protein, 11 aa, Yellow fever virus
IPVNEALAATG

SEQ ID NO: 178365 - protein, 11 aa, Yellow fever virus
PVNEALAATGL

SEQ ID NO: 178366 - protein, 11 aa, Yellow fever virus
VNEALAATGLV

SEQ ID NO: 178367 - protein, 11 aa, Yellow fever virus
NEALAATGLVG

SEQ ID NO: 178368 - protein, 11 aa, Yellow fever virus
EALAATGLVGV

SEQ ID NO: 178369 - protein, 11 aa, Yellow fever virus
ALAATGLVGVL

SEQ ID NO: 178370 - protein, 11 aa, Yellow fever virus
LAATGLVGVLA

SEQ ID NO: 178371 - protein, 11 aa, Yellow fever virus
AATGLVGVLAG

SEQ ID NO: 178372 - protein, 11 aa, Yellow fever virus
ATGLVGVLAGL

SEQ ID NO: 178373 - protein, 11 aa, Yellow fever virus
TGLVGVLAGLA

SEQ ID NO: 178374 - protein, 11 aa, Yellow fever virus
VGVLAGLAFQD

SEQ ID NO: 178375 - protein, 11 aa, Yellow fever virus
GVLAGLAFQDM

SEQ ID NO: 178376 - protein, 11 aa, Yellow fever virus
VLAGLAFQDME

SEQ ID NO: 178377 - protein, 11 aa, Yellow fever virus
LAGLAFQDMEN

SEQ ID NO: 178378 - protein, 11 aa, Yellow fever virus
AGLAFQDMENF

SEQ ID NO: 178379 - protein, 11 aa, Yellow fever virus
GLAFQDMENFL

SEQ ID NO: 178380 - protein, 11 aa, Yellow fever virus
LAFQDMENFLG

SEQ ID NO: 178381 - protein, 11 aa, Yellow fever virus
AFQDMENFLGP

SEQ ID NO: 178382 - protein, 11 aa, Yellow fever virus
FQDMENFLGPI

SEQ ID NO: 178383 - protein, 11 aa, Yellow fever virus
QDMENFLGPIA

SEQ ID NO: 178384 - protein, 11 aa, Yellow fever virus
DMENFLGPIAV

SEQ ID NO: 178385 - protein, 11 aa, Yellow fever virus
NFLGPIAVGGI

SEQ ID NO: 178386 - protein, 11 aa, Yellow fever virus
FLGPIAVGGIL

SEQ ID NO: 178387 - protein, 11 aa, Yellow fever virus
LGPIAVGGILM

SEQ ID NO: 178388 - protein, 11 aa, Yellow fever virus
GPIAVGGILMM

SEQ ID NO: 178389 - protein, 11 aa, Yellow fever virus
PIAVGGILMML

SEQ ID NO: 178390 - protein, 11 aa, Yellow fever virus
IAVGGILMMLV

SEQ ID NO: 178391 - protein, 11 aa, Yellow fever virus
AVGGILMMLVS

SEQ ID NO: 178392 - protein, 11 aa, Yellow fever virus
VGGILMMLVSV

SEQ ID NO: 178393 - protein, 11 aa, Yellow fever virus
GGILMMLVSVA

SEQ ID NO: 178394 - protein, 11 aa, Yellow fever virus
GILMMLVSVAG

SEQ ID NO: 178395 - protein, 11 aa, Yellow fever virus
ILMMLVSVAGR

SEQ ID NO: 178396 - protein, 11 aa, Yellow fever virus
LMMLVSVAGKV

SEQ ID NO: 178397 - protein, 11 aa, Yellow fever virus
MMLVSVAGKVD

SEQ ID NO: 178398 - protein, 11 aa, Yellow fever virus
MLVSVAGKVDG

SEQ ID NO: 178399 - protein, 11 aa, Yellow fever virus
LVSVAGKVDGL

SEQ ID NO: 178400 - protein, 11 aa, Yellow fever virus
VSVAGKVDGLE

SEQ ID NO: 178401 - protein, 11 aa, Yellow fever virus
SVAGKVDGLEL

SEQ ID NO: 178402 - protein, 11 aa, Yellow fever virus
VAGRVDGLELR

SEQ ID NO: 178403 - protein, 11 aa, Yellow fever virus
AGKVDGLELKK

SEQ ID NO: 178404 - protein, 11 aa, Yellow fever virus
GKVDGLELKKL

SEQ ID NO: 178405 - protein, 11 aa, Yellow fever virus
KVDGLELKKLG

SEQ ID NO: 178406 - protein, 11 aa, Yellow fever virus
VDGLELRKLGE

SEQ ID NO: 178407 - protein, 11 aa, Yellow fever virus
DGLELRKLGEV

SEQ ID NO: 178408 - protein, 11 aa, Yellow fever virus
GLELRKLGEVS

SEQ ID NO: 178409 - protein, 11 aa, Yellow fever virus
LELRKLGEVSW

SEQ ID NO: 178410 - protein, 11 aa, Yellow fever virus
ELRKLGEVSWE

SEQ ID NO: 178411 - protein, 11 aa, Yellow fever virus
LRKLGEVSWEE

SEQ ID NO: 178412 - protein, 11 aa, Yellow fever virus
RKLGEVSWEEE

SEQ ID NO: 178413 - protein, 11 aa, Yellow fever virus
KLGEISWEEEA

SEQ ID NO: 178414 - protein, 11 aa, Yellow fever virus
LGEVAWEEEAE

SEQ ID NO: 178415 - protein, 11 aa, Yellow fever virus
GEVAWEEEAEI

SEQ ID NO: 178416 - protein, 11 aa, Yellow fever virus
EISWEEEAEIS

SEQ ID NO: 178417 - protein, 11 aa, Yellow fever virus
VAWEEEAEISG

SEQ ID NO: 178418 - protein, 11 aa, Yellow fever virus
AWEEEAEISGS

SEQ ID NO: 178419 - protein, 11 aa, Yellow fever virus
EEEAEISGSSS

SEQ ID NO: 178420 - protein, 11 aa, Yellow fever virus
EEAEISGSSSR

SEQ ID NO: 178421 - protein, 11 aa, Yellow fever virus
EAEISGSSSRY

SEQ ID NO: 178422 - protein, 11 aa, Yellow fever virus
AEISGSSSRYD

SEQ ID NO: 178423 - protein, 11 aa, Yellow fever virus
EISGSSSRYDV

SEQ ID NO: 178424 - protein, 11 aa, Yellow fever virus
ISGSSSRYDVA

SEQ ID NO: 178425 - protein, 11 aa, Yellow fever virus
SGSSSRYDVAL

SEQ ID NO: 178426 - protein, 11 aa, Yellow fever virus
GSSSRYDVALS

SEQ ID NO: 178427 - protein, 11 aa, Yellow fever virus
SSSRYDVALSE

SEQ ID NO: 178428 - protein, 11 aa, Yellow fever virus
SSRYDVALSEQ

SEQ ID NO: 178429 - protein, 11 aa, Yellow fever virus
SRYDVALSEQG

SEQ ID NO: 178430 - protein, 11 aa, Yellow fever virus
RYDVALNEQGE

SEQ ID NO: 178431 - protein, 11 aa, Yellow fever virus
YDVALNEQGEF

SEQ ID NO: 178432 - protein, 11 aa, Yellow fever virus
DVALNEQGEFK

SEQ ID NO: 178433 - protein, 11 aa, Yellow fever virus
VALNEQGEFKL

SEQ ID NO: 178434 - protein, 11 aa, Yellow fever virus
ALNEQGEFKLL

SEQ ID NO: 178435 - protein, 11 aa, Yellow fever virus
LNEQGEFKLLS

SEQ ID NO: 178436 - protein, 11 aa, Yellow fever virus
NEQGEFKLLSE

SEQ ID NO: 178437 - protein, 11 aa, Yellow fever virus
EQGEFKLLSED

SEQ ID NO: 178438 - protein, 11 aa, Yellow fever virus
QGEFKLLSEDK

SEQ ID NO: 178439 - protein, 11 aa, Yellow fever virus
GEFKLLSEDKV

SEQ ID NO: 178440 - protein, 11 aa, Yellow fever virus
EFKLLSEDKVP

SEQ ID NO: 178441 - protein, 11 aa, Yellow fever virus
FKLLSEDKVPW

SEQ ID NO: 178442 - protein, 11 aa, Yellow fever virus
KLLSEDKVPWD

SEQ ID NO: 178443 - protein, 11 aa, Yellow fever virus
LLSEDKVPWDQ

SEQ ID NO: 178444 - protein, 11 aa, Yellow fever virus
LSEDKVPWDQI

SEQ ID NO: 178445 - protein, 11 aa, Yellow fever virus
SEDKVPWDQIV

SEQ ID NO: 178446 - protein, 11 aa, Yellow fever virus
EDKVPWDQIVM

SEQ ID NO: 178447 - protein, 11 aa, Yellow fever virus
DKVPWDQIVMT

SEQ ID NO: 178448 - protein, 11 aa, Yellow fever virus
KVPWDQIVMTS

SEQ ID NO: 178449 - protein, 11 aa, Yellow fever virus
VPWDQIVMTSL

SEQ ID NO: 178450 - protein, 11 aa, Yellow fever virus
PWDQIVMTSLA

SEQ ID NO: 178451 - protein, 11 aa, Yellow fever virus
WDQIVMTSLAL

SEQ ID NO: 178452 - protein, 11 aa, Yellow fever virus
DQIVMTSLALV

SEQ ID NO: 178453 - protein, 11 aa, Yellow fever virus
QIVMTSLALVG

SEQ ID NO: 178454 - protein, 11 aa, Yellow fever virus
IVMTSLALVGA

SEQ ID NO: 178455 - protein, 11 aa, Yellow fever virus
MTSLALVGAAI

SEQ ID NO: 178456 - protein, 11 aa, Yellow fever virus
TSLALVGAAIH

SEQ ID NO: 178457 - protein, 11 aa, Yellow fever virus
SLALVGAAIHP

SEQ ID NO: 178458 - protein, 11 aa, Yellow fever virus
LALVGAAIHPF

SEQ ID NO: 178459 - protein, 11 aa, Yellow fever virus
ALVGAAIHPFA

SEQ ID NO: 178460 - protein, 11 aa, Yellow fever virus
LVGAAIHPFAL

SEQ ID NO: 178461 - protein, 11 aa, Yellow fever virus
VGAAIHPFALL

SEQ ID NO: 178462 - protein, 11 aa, Yellow fever virus
GAAIHPFALLL

SEQ ID NO: 178463 - protein, 11 aa, Yellow fever virus
AAIHPFALLLV

SEQ ID NO: 178464 - protein, 11 aa, Yellow fever virus
AIHPFALLLVL

SEQ ID NO: 178465 - protein, 11 aa, Yellow fever virus
IHPFALLLVLA

SEQ ID NO: 178466 - protein, 11 aa, Yellow fever virus
HPFALLLVLGG

SEQ ID NO: 178467 - protein, 11 aa, Yellow fever virus
PFALLLVLGGW

SEQ ID NO: 178468 - protein, 11 aa, Yellow fever virus
FALLLVLGGWV

SEQ ID NO: 178469 - protein, 11 aa, Yellow fever virus
ALLLVLGGWVL

SEQ ID NO: 178470 - protein, 11 aa, Yellow fever virus
LLLVLGGWVLH

SEQ ID NO: 178471 - protein, 11 aa, Yellow fever virus
LLVLGGWVLHI

SEQ ID NO: 178472 - protein, 11 aa, Yellow fever virus
LVLAGWLFHVK

SEQ ID NO: 178473 - protein, 11 aa, Yellow fever virus
VLAGWLFHVKG

SEQ ID NO: 178474 - protein, 11 aa, Yellow fever virus
LAGWLFHVKGA

SEQ ID NO: 178475 - protein, 11 aa, Yellow fever virus
AGWLFHVKGAR

SEQ ID NO: 178476 - protein, 11 aa, Yellow fever virus
GWLFHVKGARR

SEQ ID NO: 178477 - protein, 11 aa, Yellow fever virus
WLFHVKGARRS

SEQ ID NO: 178478 - protein, 11 aa, Yellow fever virus
LFHVKGARRSG

SEQ ID NO: 178479 - protein, 11 aa, Yellow fever virus
LHIKGARRSGD

SEQ ID NO: 178480 - protein, 11 aa, Yellow fever virus
HIKGARRSGDV

SEQ ID NO: 178481 - protein, 11 aa, Yellow fever virus
IKGARRSGDVL

SEQ ID NO: 178482 - protein, 11 aa, Yellow fever virus
KGARRSGDVLW

SEQ ID NO: 178483 - protein, 11 aa, Yellow fever virus
RARRSGDVLWD

SEQ ID NO: 178484 - protein, 11 aa, Yellow fever virus
DVLWDIPTPKV

SEQ ID NO: 178485 - protein, 11 aa, Yellow fever virus
VLWDIPTPKVI

SEQ ID NO: 178486 - protein, 11 aa, Yellow fever virus
LWDIPTPKVIE

SEQ ID NO: 178487 - protein, 11 aa, Yellow fever virus
WDIPTPKVIEE

SEQ ID NO: 178488 - protein, 11 aa, Yellow fever virus
DIPTPKVIEEC

SEQ ID NO: 178489 - protein, 11 aa, Yellow fever virus
IPTPKVIEECE

SEQ ID NO: 178490 - protein, 11 aa, Yellow fever virus
PTPKVIEECEH

SEQ ID NO: 178491 - protein, 11 aa, Yellow fever virus
TPKVIEECEHL

SEQ ID NO: 178492 - protein, 11 aa, Yellow fever virus
PKVIEECEHLE

SEQ ID NO: 178493 - protein, 11 aa, Yellow fever virus
KVIEECEHLED

SEQ ID NO: 178494 - protein, 11 aa, Yellow fever virus
VIEECEHLEDG

SEQ ID NO: 178495 - protein, 11 aa, Yellow fever virus
IEECEYLEDGI

SEQ ID NO: 178496 - protein, 11 aa, Yellow fever virus
EECEHLEDGIS

SEQ ID NO: 178497 - protein, 11 aa, Yellow fever virus
ECEHLEDGISG

SEQ ID NO: 178498 - protein, 11 aa, Yellow fever virus
CEYLEDGIYGI

SEQ ID NO: 178499 - protein, 11 aa, Yellow fever virus
EHLEDGISGIF

SEQ ID NO: 178500 - protein, 11 aa, Yellow fever virus
YLEDGIYGIFQ

SEQ ID NO: 178501 - protein, 11 aa, Yellow fever virus
LEDGISGIFQS

SEQ ID NO: 178502 - protein, 11 aa, Yellow fever virus
EDGISGIFQST

SEQ ID NO: 178503 - protein, 11 aa, Yellow fever virus
DGISGIFQSTF

SEQ ID NO: 178504 - protein, 11 aa, Yellow fever virus
GISGIFQSTFL

SEQ ID NO: 178505 - protein, 11 aa, Yellow fever virus
ISGIFQSTFLG

SEQ ID NO: 178506 - protein, 11 aa, Yellow fever virus
SGIFQSTFLGA

SEQ ID NO: 178507 - protein, 11 aa, Yellow fever virus
MWHVTRGAFLL

SEQ ID NO: 178508 - protein, 11 aa, Yellow fever virus
WHVTRGAFLLR

SEQ ID NO: 178509 - protein, 11 aa, Yellow fever virus
HVTRGAFLLRN

SEQ ID NO: 178510 - protein, 11 aa, Yellow fever virus
VTRGAFLLRNG

SEQ ID NO: 178511 - protein, 11 aa, Yellow fever virus
TRGAFLLRNGK

SEQ ID NO: 178512 - protein, 11 aa, Yellow fever virus
RGAFLLRNGKK

SEQ ID NO: 178513 - protein, 11 aa, Yellow fever virus
GAFLLRNGKKL

SEQ ID NO: 178514 - protein, 11 aa, Yellow fever virus
AFLLRNGKKLV

SEQ ID NO: 178515 - protein, 11 aa, Yellow fever virus
FLLRNGKKLVP

SEQ ID NO: 178516 - protein, 11 aa, Yellow fever virus
LLRNGKKLVPS

SEQ ID NO: 178517 - protein, 11 aa, Yellow fever virus
LRNGKKLVPSW

SEQ ID NO: 178518 - protein, 11 aa, Yellow fever virus
RNGKKLVPSWA

SEQ ID NO: 178519 - protein, 11 aa, Yellow fever virus
NGKKLVPSWAS

SEQ ID NO: 178520 - protein, 11 aa, Yellow fever virus
GKKLVPSWASV

SEQ ID NO: 178521 - protein, 11 aa, Yellow fever virus
KKLVPSWASVK

SEQ ID NO: 178522 - protein, 11 aa, Yellow fever virus
KLVPSWASVKE

SEQ ID NO: 178523 - protein, 11 aa, Yellow fever virus
LVPSWASVKED

SEQ ID NO: 178524 - protein, 11 aa, Yellow fever virus
VPSWASVKEDL

SEQ ID NO: 178525 - protein, 11 aa, Yellow fever virus
LVAYGGSWKLD

SEQ ID NO: 178526 - protein, 11 aa, Yellow fever virus
VAYGGSWKLDG

SEQ ID NO: 178527 - protein, 11 aa, Yellow fever virus
AYGGSWKLDGK

SEQ ID NO: 178528 - protein, 11 aa, Yellow fever virus
YGGSWKLDGKW

SEQ ID NO: 178529 - protein, 11 aa, Yellow fever virus
GGSWKLDGKWD

SEQ ID NO: 178530 - protein, 11 aa, Yellow fever virus
GSWKLDGKWDG

SEQ ID NO: 178531 - protein, 11 aa, Yellow fever virus
SWKLDGKWDGE

SEQ ID NO: 178532 - protein, 11 aa, Yellow fever virus
WKLDGKWDGEE

SEQ ID NO: 178533 - protein, 11 aa, Yellow fever virus
KLDGKWDGEEE

SEQ ID NO: 178534 - protein, 11 aa, Yellow fever virus
LDGKWDGEEEV

SEQ ID NO: 178535 - protein, 11 aa, Yellow fever virus
DGKWDGEEEVQ

SEQ ID NO: 178536 - protein, 11 aa, Yellow fever virus
GKWDGEEEVQL

SEQ ID NO: 178537 - protein, 11 aa, Yellow fever virus
KWDGEEEVQLI

SEQ ID NO: 178538 - protein, 11 aa, Yellow fever virus
GEEEVQLIAAA

SEQ ID NO: 178539 - protein, 11 aa, Yellow fever virus
EEEVQLIAAAP

SEQ ID NO: 178540 - protein, 11 aa, Yellow fever virus
EEVQLIAAAPG

SEQ ID NO: 178541 - protein, 11 aa, Yellow fever virus
EVQLIAAAPGK

SEQ ID NO: 178542 - protein, 11 aa, Yellow fever virus
VQLIAAVPGKA

SEQ ID NO: 178543 - protein, 11 aa, Yellow fever virus
QLIAAVPGKAV

SEQ ID NO: 178544 - protein, 11 aa, Yellow fever virus
LIAAVPGKAVV

SEQ ID NO: 178545 - protein, 11 aa, Yellow fever virus
IAAVPGKAVVN

SEQ ID NO: 178546 - protein, 11 aa, Yellow fever virus
AAVPGKAVVNV

SEQ ID NO: 178547 - protein, 11 aa, Yellow fever virus
AVPGKAVVNVQ

SEQ ID NO: 178548 - protein, 11 aa, Yellow fever virus
VPGKAVVNVQT

SEQ ID NO: 178549 - protein, 11 aa, Yellow fever virus
PGKAVVNVQTK

SEQ ID NO: 178550 - protein, 11 aa, Yellow fever virus
GKAVVNVQTKP

SEQ ID NO: 178551 - protein, 11 aa, Yellow fever virus
KAVVNVQTKPS

SEQ ID NO: 178552 - protein, 11 aa, Yellow fever virus
SVVNVQTKPSL

SEQ ID NO: 178553 - protein, 11 aa, Yellow fever virus
VVNVQTKPSVF

SEQ ID NO: 178554 - protein, 11 aa, Yellow fever virus
VNVQTKPSLFR

SEQ ID NO: 178555 - protein, 11 aa, Yellow fever virus
NVQTKPSLFRV

SEQ ID NO: 178556 - protein, 11 aa, Yellow fever virus
VQTKPSVFKVR

SEQ ID NO: 178557 - protein, 11 aa, Yellow fever virus
QTKPSLFRVKN

SEQ ID NO: 178558 - protein, 11 aa, Yellow fever virus
TKPSLFRVKNG

SEQ ID NO: 178559 - protein, 11 aa, Yellow fever virus
KPSVFKVRNGG

SEQ ID NO: 178560 - protein, 11 aa, Yellow fever virus
PSVFKVRNGGE

SEQ ID NO: 178561 - protein, 11 aa, Yellow fever virus
SVFKVRNGGEI

SEQ ID NO: 178562 - protein, 11 aa, Yellow fever virus
LFRVKNGGEIG

SEQ ID NO: 178563 - protein, 11 aa, Yellow fever virus
FRVKNGGEIGA

SEQ ID NO: 178564 - protein, 11 aa, Yellow fever virus
RVKNGGEIGAV

SEQ ID NO: 178565 - protein, 11 aa, Yellow fever virus
VKNGGEIGAVA

SEQ ID NO: 178566 - protein, 11 aa, Yellow fever virus
KNGGEIGAVAL

SEQ ID NO: 178567 - protein, 11 aa, Yellow fever virus
GTSGSPIVNRS

SEQ ID NO: 178568 - protein, 11 aa, Yellow fever virus
TSGSPIVNRSG

SEQ ID NO: 178569 - protein, 11 aa, Yellow fever virus
SGSPIVNRSGE

SEQ ID NO: 178570 - protein, 11 aa, Yellow fever virus
GSPIVNRSGEV

SEQ ID NO: 178571 - protein, 11 aa, Yellow fever virus
SPIVNRSGEVV

SEQ ID NO: 178572 - protein, 11 aa, Yellow fever virus
PIVNRSGEVVG

SEQ ID NO: 178573 - protein, 11 aa, Yellow fever virus
IVNRSGEVVGL

SEQ ID NO: 178574 - protein, 11 aa, Yellow fever virus
VNRSGEVVGLY

SEQ ID NO: 178575 - protein, 11 aa, Yellow fever virus
NRSGEVVGLYG

SEQ ID NO: 178576 - protein, 11 aa, Yellow fever virus
RSGEVVGLYGN

SEQ ID NO: 178577 - protein, 11 aa, Yellow fever virus
SGEVVGLYGNG

SEQ ID NO: 178578 - protein, 11 aa, Yellow fever virus
GEVVGLYGNGI

SEQ ID NO: 178579 - protein, 11 aa, Yellow fever virus
EVVGLYGNGIL

SEQ ID NO: 178580 - protein, 11 aa, Yellow fever virus
VVGLYGNGILV

SEQ ID NO: 178581 - protein, 11 aa, Yellow fever virus
VGLYGNGILVG

SEQ ID NO: 178582 - protein, 11 aa, Yellow fever virus
SFVSAISQTEL

SEQ ID NO: 178583 - protein, 11 aa, Yellow fever virus
FVSAISQTELK

SEQ ID NO: 178584 - protein, 11 aa, Yellow fever virus
VSAISQTELKE

SEQ ID NO: 178585 - protein, 11 aa, Yellow fever virus
SAISQTELKEE

SEQ ID NO: 178586 - protein, 11 aa, Yellow fever virus
AISQTEVKEES

SEQ ID NO: 178587 - protein, 11 aa, Yellow fever virus
ISQTEVKEESK

SEQ ID NO: 178588 - protein, 11 aa, Yellow fever virus
SQTEVKEESKE

SEQ ID NO: 178589 - protein, 11 aa, Yellow fever virus
QTEVKEESKEE

SEQ ID NO: 178590 - protein, 11 aa, Yellow fever virus
TEVKEESKEEL

SEQ ID NO: 178591 - protein, 11 aa, Yellow fever virus
EVKEEGKEELR

SEQ ID NO: 178592 - protein, 11 aa, Yellow fever virus
VKEEGKEELRE

SEQ ID NO: 178593 - protein, 11 aa, Yellow fever virus
KEEGKEELREI

SEQ ID NO: 178594 - protein, 11 aa, Yellow fever virus
EEGKEELREIP

SEQ ID NO: 178595 - protein, 11 aa, Yellow fever virus
ESKEELQEIPT

SEQ ID NO: 178596 - protein, 11 aa, Yellow fever virus
SKEELQEIPTM

SEQ ID NO: 178597 - protein, 11 aa, Yellow fever virus
KEELREIPTML

SEQ ID NO: 178598 - protein, 11 aa, Yellow fever virus
EELREIPTMLK

SEQ ID NO: 178599 - protein, 11 aa, Yellow fever virus
ELREIPTMLKK

SEQ ID NO: 178600 - protein, 11 aa, Yellow fever virus
LREIPTMLKKG

SEQ ID NO: 178601 - protein, 11 aa, Yellow fever virus
REIPTMLKKGM

SEQ ID NO: 178602 - protein, 11 aa, Yellow fever virus
EIPTMLKKGKT

SEQ ID NO: 178603 - protein, 11 aa, Yellow fever virus
IPTMLKKGKTT

SEQ ID NO: 178604 - protein, 11 aa, Yellow fever virus
PTMLKKGMTTI

SEQ ID NO: 178605 - protein, 11 aa, Yellow fever virus
TMLKKGMTTIL

SEQ ID NO: 178606 - protein, 11 aa, Yellow fever virus
MLKKGMTTILD

SEQ ID NO: 178607 - protein, 11 aa, Yellow fever virus
LKKGMTTILDF

SEQ ID NO: 178608 - protein, 11 aa, Yellow fever virus
KKGMTTILDFH

SEQ ID NO: 178609 - protein, 11 aa, Yellow fever virus
KGMTTILDFHP

SEQ ID NO: 178610 - protein, 11 aa, Yellow fever virus
GMTTILDFHPG

SEQ ID NO: 178611 - protein, 11 aa, Yellow fever virus
MTTILDFHPGA

SEQ ID NO: 178612 - protein, 11 aa, Yellow fever virus
TTVLDFHPGAG

SEQ ID NO: 178613 - protein, 11 aa, Yellow fever virus
TVLDFHPGAGK

SEQ ID NO: 178614 - protein, 11 aa, Yellow fever virus
VLDFHPGAGKT

SEQ ID NO: 178615 - protein, 11 aa, Yellow fever virus
LDYHPGAGKTR

SEQ ID NO: 178616 - protein, 11 aa, Yellow fever virus
DYHPGAGKTRR

SEQ ID NO: 178617 - protein, 11 aa, Yellow fever virus
YHPGAGKTRRF

SEQ ID NO: 178618 - protein, 11 aa, Yellow fever virus
VVLSEMKEAFQ

SEQ ID NO: 178619 - protein, 11 aa, Yellow fever virus
VLSEMKEAFQG

SEQ ID NO: 178620 - protein, 11 aa, Yellow fever virus
LSEMKEAFQGL

SEQ ID NO: 178621 - protein, 11 aa, Yellow fever virus
SEMKEAFQGLD

SEQ ID NO: 178622 - protein, 11 aa, Yellow fever virus
EMKEAFQGLDV

SEQ ID NO: 178623 - protein, 11 aa, Yellow fever virus
MKEAFQGLDVK

SEQ ID NO: 178624 - protein, 11 aa, Yellow fever virus
KEAFQGLDVKF

SEQ ID NO: 178625 - protein, 11 aa, Yellow fever virus
EAFQGLDVKFH

SEQ ID NO: 178626 - protein, 11 aa, Yellow fever virus
AFQGLDVKFHT

SEQ ID NO: 178627 - protein, 11 aa, Yellow fever virus
FQGLDVKFHTQ

SEQ ID NO: 178628 - protein, 11 aa, Yellow fever virus
QGLDVKFHTQA

SEQ ID NO: 178629 - protein, 11 aa, Yellow fever virus
TQAFSAHGSGK

SEQ ID NO: 178630 - protein, 11 aa, Yellow fever virus
QAFSAHGSGKE

SEQ ID NO: 178631 - protein, 11 aa, Yellow fever virus
AFSAHGSGKEV

SEQ ID NO: 178632 - protein, 11 aa, Yellow fever virus
FSAHGSGKEVI

SEQ ID NO: 178633 - protein, 11 aa, Yellow fever virus
SAHGSGKEVID

SEQ ID NO: 178634 - protein, 11 aa, Yellow fever virus
AHGSGKEVIDA

SEQ ID NO: 178635 - protein, 11 aa, Yellow fever virus
HGSGKEVIDAM

SEQ ID NO: 178636 - protein, 11 aa, Yellow fever virus
GSGKEVIDAMC

SEQ ID NO: 178637 - protein, 11 aa, Yellow fever virus
SGKEVIDAMCH

SEQ ID NO: 178638 - protein, 11 aa, Yellow fever virus
GKEVIDAMCHA

SEQ ID NO: 178639 - protein, 11 aa, Yellow fever virus
KEVIDAMCHAT

SEQ ID NO: 178640 - protein, 11 aa, Yellow fever virus
EVIDVMCHATL

SEQ ID NO: 178641 - protein, 11 aa, Yellow fever virus
VIDVMCHATLT

SEQ ID NO: 178642 - protein, 11 aa, Yellow fever virus
IDVMCHATLTY

SEQ ID NO: 178643 - protein, 11 aa, Yellow fever virus
DVMCHATLTYR

SEQ ID NO: 178644 - protein, 11 aa, Yellow fever virus
VMCHATLTYRM

SEQ ID NO: 178645 - protein, 11 aa, Yellow fever virus
LTYRMLEPTRI

SEQ ID NO: 178646 - protein, 11 aa, Yellow fever virus
TYRMLEPTRIV

SEQ ID NO: 178647 - protein, 11 aa, Yellow fever virus
YRMLEPTRIVN

SEQ ID NO: 178648 - protein, 11 aa, Yellow fever virus
RMLEPTRIVNW

SEQ ID NO: 178649 - protein, 11 aa, Yellow fever virus
MLEPTRIVNWE

SEQ ID NO: 178650 - protein, 11 aa, Yellow fever virus
LEPTRIVNWEV

SEQ ID NO: 178651 - protein, 11 aa, Yellow fever virus
EPTRIVNWEVI

SEQ ID NO: 178652 - protein, 11 aa, Yellow fever virus
PTRIVNWEVII

SEQ ID NO: 178653 - protein, 11 aa, Yellow fever virus
TRIVNWEVIIM

SEQ ID NO: 178654 - protein, 11 aa, Yellow fever virus
RIVNWEVIIMD

SEQ ID NO: 178655 - protein, 11 aa, Yellow fever virus
IVNWEVIIMDE

SEQ ID NO: 178656 - protein, 11 aa, Yellow fever virus
VQTDIPSEPWT

SEQ ID NO: 178657 - protein, 11 aa, Yellow fever virus
QTDIPSEPWTS

SEQ ID NO: 178658 - protein, 11 aa, Yellow fever virus
TDIPSEPWTSG

SEQ ID NO: 178659 - protein, 11 aa, Yellow fever virus
DIPSEPWTSGH

SEQ ID NO: 178660 - protein, 11 aa, Yellow fever virus
IPSEPWTSGHE

SEQ ID NO: 178661 - protein, 11 aa, Yellow fever virus
PSEPWTSGHEW

SEQ ID NO: 178662 - protein, 11 aa, Yellow fever virus
SEPWTSGHEWI

SEQ ID NO: 178663 - protein, 11 aa, Yellow fever virus
EPWTSGHEWIL

SEQ ID NO: 178664 - protein, 11 aa, Yellow fever virus
PWTSGHEWILA

SEQ ID NO: 178665 - protein, 11 aa, Yellow fever virus
WTSGHEWILAD

SEQ ID NO: 178666 - protein, 11 aa, Yellow fever virus
TSGHEWILADK

SEQ ID NO: 178667 - protein, 11 aa, Yellow fever virus
SGHEWILADKR

SEQ ID NO: 178668 - protein, 11 aa, Yellow fever virus
GHEWILADKRP

SEQ ID NO: 178669 - protein, 11 aa, Yellow fever virus
HEWILADKRPT

SEQ ID NO: 178670 - protein, 11 aa, Yellow fever virus
EWILADKRPTA

SEQ ID NO: 178671 - protein, 11 aa, Yellow fever virus
MAASLRKAGKN

SEQ ID NO: 178672 - protein, 11 aa, Yellow fever virus
AASLRKAGKNV

SEQ ID NO: 178673 - protein, 11 aa, Yellow fever virus
ASLRKAGKNVV

SEQ ID NO: 178674 - protein, 11 aa, Yellow fever virus
SLRKAGKNVVV

SEQ ID NO: 178675 - protein, 11 aa, Yellow fever virus
LRKAGKNVVVL

SEQ ID NO: 178676 - protein, 11 aa, Yellow fever virus
RKAGKNVVVLN

SEQ ID NO: 178677 - protein, 11 aa, Yellow fever virus
KAGKNVVVLNR

SEQ ID NO: 178678 - protein, 11 aa, Yellow fever virus
AGKNVVVLNRK

SEQ ID NO: 178679 - protein, 11 aa, Yellow fever virus
GKNVVVLNRKT

SEQ ID NO: 178680 - protein, 11 aa, Yellow fever virus
KNVVVLNRKTF

SEQ ID NO: 178681 - protein, 11 aa, Yellow fever virus
NVVVLNRKTFE

SEQ ID NO: 178682 - protein, 11 aa, Yellow fever virus
VVVLNRKTFEK

SEQ ID NO: 178683 - protein, 11 aa, Yellow fever virus
VVLNRKTFEKE

SEQ ID NO: 178684 - protein, 11 aa, Yellow fever virus
VLNRKTFEKEY

SEQ ID NO: 178685 - protein, 11 aa, Yellow fever virus
LNRKTFEKEYP

SEQ ID NO: 178686 - protein, 11 aa, Yellow fever virus
NRKTFEKEYPT

SEQ ID NO: 178687 - protein, 11 aa, Yellow fever virus
RKTFEKEYPTI

SEQ ID NO: 178688 - protein, 11 aa, Yellow fever virus
KTFEKEYPTIK

SEQ ID NO: 178689 - protein, 11 aa, Yellow fever virus
TFEKEYPTIKQ

SEQ ID NO: 178690 - protein, 11 aa, Yellow fever virus
FEKEYPTIKQK

SEQ ID NO: 178691 - protein, 11 aa, Yellow fever virus
EKEYPTIKQKR

SEQ ID NO: 178692 - protein, 11 aa, Yellow fever virus
KEYPTIKQKRP

SEQ ID NO: 178693 - protein, 11 aa, Yellow fever virus
EYPTIKQKRPD

SEQ ID NO: 178694 - protein, 11 aa, Yellow fever virus
YPTIKQKRPDF

SEQ ID NO: 178695 - protein, 11 aa, Yellow fever virus
PTIKQKRPDFI

SEQ ID NO: 178696 - protein, 11 aa, Yellow fever virus
TIKQKRPDFIL

SEQ ID NO: 178697 - protein, 11 aa, Yellow fever virus
IKQKRPDFILA

SEQ ID NO: 178698 - protein, 11 aa, Yellow fever virus
KQKRPDFILAT

SEQ ID NO: 178699 - protein, 11 aa, Yellow fever virus
QKRPDFILATD

SEQ ID NO: 178700 - protein, 11 aa, Yellow fever virus
KRPDFILATDI

SEQ ID NO: 178701 - protein, 11 aa, Yellow fever virus
RPDFILATDIA

SEQ ID NO: 178702 - protein, 11 aa, Yellow fever virus
IAEMGANLCVD

SEQ ID NO: 178703 - protein, 11 aa, Yellow fever virus
AEMGANLCVDR

SEQ ID NO: 178704 - protein, 11 aa, Yellow fever virus
EMGANLCVDRV

SEQ ID NO: 178705 - protein, 11 aa, Yellow fever virus
MGANLCVDRVL

SEQ ID NO: 178706 - protein, 11 aa, Yellow fever virus
GANLCVDRVLD

SEQ ID NO: 178707 - protein, 11 aa, Yellow fever virus
ANLCVDRVLDC

SEQ ID NO: 178708 - protein, 11 aa, Yellow fever virus
NLCVDRVLDCR

SEQ ID NO: 178709 - protein, 11 aa, Yellow fever virus
LCVDRVLDCRT

SEQ ID NO: 178710 - protein, 11 aa, Yellow fever virus
CVDRVLDCRTA

SEQ ID NO: 178711 - protein, 11 aa, Yellow fever virus
VERVLDCRTAY

SEQ ID NO: 178712 - protein, 11 aa, Yellow fever virus
ERVLDCRTAYK

SEQ ID NO: 178713 - protein, 11 aa, Yellow fever virus
RVLDCRTAYKP

SEQ ID NO: 178714 - protein, 11 aa, Yellow fever virus
VLDCRTAYKPV

SEQ ID NO: 178715 - protein, 11 aa, Yellow fever virus
LDCRTAYKPVL

SEQ ID NO: 178716 - protein, 11 aa, Yellow fever virus
DCRTAYKPVLV

SEQ ID NO: 178717 - protein, 11 aa, Yellow fever virus
CRTAYKPVLVD

SEQ ID NO: 178718 - protein, 11 aa, Yellow fever virus
RTAYKPVLVDE

SEQ ID NO: 178719 - protein, 11 aa, Yellow fever virus
TAYKPVLVDEG

SEQ ID NO: 178720 - protein, 11 aa, Yellow fever virus
AYKPVLVDEGR

SEQ ID NO: 178721 - protein, 11 aa, Yellow fever virus
YKPVLVDEGRK

SEQ ID NO: 178722 - protein, 11 aa, Yellow fever virus
KPVLVDEGKKV

SEQ ID NO: 178723 - protein, 11 aa, Yellow fever virus
PVLVDEGKKVA

SEQ ID NO: 178724 - protein, 11 aa, Yellow fever virus
VLVDEGKKVAI

SEQ ID NO: 178725 - protein, 11 aa, Yellow fever virus
LVDEGKKVAIK

SEQ ID NO: 178726 - protein, 11 aa, Yellow fever virus
VDEGKKVAIKG

SEQ ID NO: 178727 - protein, 11 aa, Yellow fever virus
DEGKKVAIKGP

SEQ ID NO: 178728 - protein, 11 aa, Yellow fever virus
EGKKVAIKGPL

SEQ ID NO: 178729 - protein, 11 aa, Yellow fever virus
GKKVAIKGPLR

SEQ ID NO: 178730 - protein, 11 aa, Yellow fever virus
KKVAIKGPLRI

SEQ ID NO: 178731 - protein, 11 aa, Yellow fever virus
SYYYSEPTSED

SEQ ID NO: 178732 - protein, 11 aa, Yellow fever virus
YYYSEPTSEDN

SEQ ID NO: 178733 - protein, 11 aa, Yellow fever virus
YYSEPTSEDNA

SEQ ID NO: 178734 - protein, 11 aa, Yellow fever virus
YSEPTSEDNAH

SEQ ID NO: 178735 - protein, 11 aa, Yellow fever virus
SEPTSEDNAHH

SEQ ID NO: 178736 - protein, 11 aa, Yellow fever virus
EPTSEDNAHHV

SEQ ID NO: 178737 - protein, 11 aa, Yellow fever virus
PTSEDNAHHVC

SEQ ID NO: 178738 - protein, 11 aa, Yellow fever virus
TSEDNAHHVCW

SEQ ID NO: 178739 - protein, 11 aa, Yellow fever virus
SEDNAHHVCWL

SEQ ID NO: 178740 - protein, 11 aa, Yellow fever virus
EDNAHHVCWLE

SEQ ID NO: 178741 - protein, 11 aa, Yellow fever virus
DNAHHVCWLEA

SEQ ID NO: 178742 - protein, 11 aa, Yellow fever virus
RGGMVAPLYGI

SEQ ID NO: 178743 - protein, 11 aa, Yellow fever virus
GGMVAPLYGIE

SEQ ID NO: 178744 - protein, 11 aa, Yellow fever virus
GMVAPLYGIEG

SEQ ID NO: 178745 - protein, 11 aa, Yellow fever virus
MVAPLYGIEGT

SEQ ID NO: 178746 - protein, 11 aa, Yellow fever virus
VAPLYGIEGTK

SEQ ID NO: 178747 - protein, 11 aa, Yellow fever virus
APLYGIEGTKT

SEQ ID NO: 178748 - protein, 11 aa, Yellow fever virus
PLYGIEGTKTP

SEQ ID NO: 178749 - protein, 11 aa, Yellow fever virus
LYGIEGTKTPV

SEQ ID NO: 178750 - protein, 11 aa, Yellow fever virus
YGIEGTKTPVS

SEQ ID NO: 178751 - protein, 11 aa, Yellow fever virus
GIEGTKTPVSP

SEQ ID NO: 178752 - protein, 11 aa, Yellow fever virus
IEGTKTPVSPG

SEQ ID NO: 178753 - protein, 11 aa, Yellow fever virus
EGIKTPVSPGE

SEQ ID NO: 178754 - protein, 11 aa, Yellow fever virus
GIKTPVSPGEM

SEQ ID NO: 178755 - protein, 11 aa, Yellow fever virus
IKTPVSPGEMR

SEQ ID NO: 178756 - protein, 11 aa, Yellow fever virus
GEMRLRDDQRR

SEQ ID NO: 178757 - protein, 11 aa, Yellow fever virus
EMRLRDDQRRV

SEQ ID NO: 178758 - protein, 11 aa, Yellow fever virus
MRLRDDQRRVF

SEQ ID NO: 178759 - protein, 11 aa, Yellow fever virus
RLRDDQRRVFR

SEQ ID NO: 178760 - protein, 11 aa, Yellow fever virus
LRDDQRRVFRE

SEQ ID NO: 178761 - protein, 11 aa, Yellow fever virus
RDDQRRVFREL

SEQ ID NO: 178762 - protein, 11 aa, Yellow fever virus
DDQRRVFRELV

SEQ ID NO: 178763 - protein, 11 aa, Yellow fever virus
DQRRVFRELVR

SEQ ID NO: 178764 - protein, 11 aa, Yellow fever virus
QRRVFRELVRG

SEQ ID NO: 178765 - protein, 11 aa, Yellow fever virus
RRVFRELVRGC

SEQ ID NO: 178766 - protein, 11 aa, Yellow fever virus
RVFRELVRGCD

SEQ ID NO: 178767 - protein, 11 aa, Yellow fever virus
VFRELVRGCDL

SEQ ID NO: 178768 - protein, 11 aa, Yellow fever virus
FRELVRGCDLP

SEQ ID NO: 178769 - protein, 11 aa, Yellow fever virus
RELVRGCDLPV

SEQ ID NO: 178770 - protein, 11 aa, Yellow fever virus
ELVRGCDLPVW

SEQ ID NO: 178771 - protein, 11 aa, Yellow fever virus
LVRGCDLPVWL

SEQ ID NO: 178772 - protein, 11 aa, Yellow fever virus
VRGCDLPVWLS

SEQ ID NO: 178773 - protein, 11 aa, Yellow fever virus
RGCDLPVWLSW

SEQ ID NO: 178774 - protein, 11 aa, Yellow fever virus
GCDLPVWLSWQ

SEQ ID NO: 178775 - protein, 11 aa, Yellow fever virus
CDQPVWLSWQV

SEQ ID NO: 178776 - protein, 11 aa, Yellow fever virus
DLPVWLAWQVA

SEQ ID NO: 178777 - protein, 11 aa, Yellow fever virus
QPVWLSWQVAK

SEQ ID NO: 178778 - protein, 11 aa, Yellow fever virus
PVWLAWQVAKA

SEQ ID NO: 178779 - protein, 11 aa, Yellow fever virus
VWLAWQVAKAG

SEQ ID NO: 178780 - protein, 11 aa, Yellow fever virus
WLSWQVAKPGL

SEQ ID NO: 178781 - protein, 11 aa, Yellow fever virus
LAWQVAKAGLK

SEQ ID NO: 178782 - protein, 11 aa, Yellow fever virus
SWQVAKPGLKT

SEQ ID NO: 178783 - protein, 11 aa, Yellow fever virus
WQVAKPGLKTN

SEQ ID NO: 178784 - protein, 11 aa, Yellow fever virus
QVAKPGLKTND

SEQ ID NO: 178785 - protein, 11 aa, Yellow fever virus
VAKPGLKTNDR

SEQ ID NO: 178786 - protein, 11 aa, Yellow fever virus
AKPGLKTNDRK

SEQ ID NO: 178787 - protein, 11 aa, Yellow fever virus
KPGLKTNDRKW

SEQ ID NO: 178788 - protein, 11 aa, Yellow fever virus
PGLKTNDRKWC

SEQ ID NO: 178789 - protein, 11 aa, Yellow fever virus
LKTNDRKWCFD

SEQ ID NO: 178790 - protein, 11 aa, Yellow fever virus
KTNDRKWCFDG

SEQ ID NO: 178791 - protein, 11 aa, Yellow fever virus
TNDRKWCFDGP

SEQ ID NO: 178792 - protein, 11 aa, Yellow fever virus
NDRKWCFDGPK

SEQ ID NO: 178793 - protein, 11 aa, Yellow fever virus
DRKWCFDGPKE

SEQ ID NO: 178794 - protein, 11 aa, Yellow fever virus
RKWCFDGPKEH

SEQ ID NO: 178795 - protein, 11 aa, Yellow fever virus
KWCFEGPDEHE

SEQ ID NO: 178796 - protein, 11 aa, Yellow fever virus
WCFDGPKEHEI

SEQ ID NO: 178797 - protein, 11 aa, Yellow fever virus
CFEGPDEHEIL

SEQ ID NO: 178798 - protein, 11 aa, Yellow fever virus
FDGPKEHEILN

SEQ ID NO: 178799 - protein, 11 aa, Yellow fever virus
DGPKEHEILND

SEQ ID NO: 178800 - protein, 11 aa, Yellow fever virus
GPEEHEILNDN

SEQ ID NO: 178801 - protein, 11 aa, Yellow fever virus
PEEHEILNDNG

SEQ ID NO: 178802 - protein, 11 aa, Yellow fever virus
EEHEILNDNGE

SEQ ID NO: 178803 - protein, 11 aa, Yellow fever virus
EHEILNDNGET

SEQ ID NO: 178804 - protein, 11 aa, Yellow fever virus
HEILNDNGETV

SEQ ID NO: 178805 - protein, 11 aa, Yellow fever virus
EILNDNGETVK

SEQ ID NO: 178806 - protein, 11 aa, Yellow fever virus
ILNDNGETVKC

SEQ ID NO: 178807 - protein, 11 aa, Yellow fever virus
LNDNGETVKCR

SEQ ID NO: 178808 - protein, 11 aa, Yellow fever virus
NDNGETVKCRS

SEQ ID NO: 178809 - protein, 11 aa, Yellow fever virus
DNGETVKCRSP

SEQ ID NO: 178810 - protein, 11 aa, Yellow fever virus
NGETVKCRSPG

SEQ ID NO: 178811 - protein, 11 aa, Yellow fever virus
GETVKCRSPGG

SEQ ID NO: 178812 - protein, 11 aa, Yellow fever virus
ETVKCRSPGGA

SEQ ID NO: 178813 - protein, 11 aa, Yellow fever virus
TVKCRSPGGAK

SEQ ID NO: 178814 - protein, 11 aa, Yellow fever virus
VKCRSPGGAKK

SEQ ID NO: 178815 - protein, 11 aa, Yellow fever virus
KCRSPGGAKKA

SEQ ID NO: 178816 - protein, 11 aa, Yellow fever virus
CRSPGGAKKAL

SEQ ID NO: 178817 - protein, 11 aa, Yellow fever virus
RSPGGAKKALR

SEQ ID NO: 178818 - protein, 11 aa, Yellow fever virus
SPGGAKKALRP

SEQ ID NO: 178819 - protein, 11 aa, Yellow fever virus
PGGAKKALRPR

SEQ ID NO: 178820 - protein, 11 aa, Yellow fever virus
GGAKKALRPRW

SEQ ID NO: 178821 - protein, 11 aa, Yellow fever virus
GAKKALRPRWC

SEQ ID NO: 178822 - protein, 11 aa, Yellow fever virus
AKKALRPRWCD

SEQ ID NO: 178823 - protein, 11 aa, Yellow fever virus
KKALRPRWCDE

SEQ ID NO: 178824 - protein, 11 aa, Yellow fever virus
KALRPRWCDER

SEQ ID NO: 178825 - protein, 11 aa, Yellow fever virus
ALRPRWCDERV

SEQ ID NO: 178826 - protein, 11 aa, Yellow fever virus
ERVSSDQSALA

SEQ ID NO: 178827 - protein, 11 aa, Yellow fever virus
RVSSDQSALAD

SEQ ID NO: 178828 - protein, 11 aa, Yellow fever virus
VSSDQSALADF

SEQ ID NO: 178829 - protein, 11 aa, Yellow fever virus
SSDQSALADFI

SEQ ID NO: 178830 - protein, 11 aa, Yellow fever virus
SDQSALADFIK

SEQ ID NO: 178831 - protein, 11 aa, Yellow fever virus
DQSALADFIKF

SEQ ID NO: 178832 - protein, 11 aa, Yellow fever virus
QSALADFIKFA

SEQ ID NO: 178833 - protein, 11 aa, Yellow fever virus
SALADFIKFAE

SEQ ID NO: 178834 - protein, 11 aa, Yellow fever virus
ALADFIKFAEG

SEQ ID NO: 178835 - protein, 11 aa, Yellow fever virus
LADFIKFAEGR

SEQ ID NO: 178836 - protein, 11 aa, Yellow fever virus
ADFIKFAEGRR

SEQ ID NO: 178837 - protein, 11 aa, Yellow fever virus
DFIKFAEGRRG

SEQ ID NO: 178838 - protein, 11 aa, Yellow fever virus
KFAEGRRGAAD

SEQ ID NO: 178839 - protein, 11 aa, Yellow fever virus
FAEGRRGAAEM

SEQ ID NO: 178840 - protein, 11 aa, Yellow fever virus
AEGRRGAAEML

SEQ ID NO: 178841 - protein, 11 aa, Yellow fever virus
EGRRGAAEMLV

SEQ ID NO: 178842 - protein, 11 aa, Yellow fever virus
GRRGAAEMLVV

SEQ ID NO: 178843 - protein, 11 aa, Yellow fever virus
RRGAAEMLVVL

SEQ ID NO: 178844 - protein, 11 aa, Yellow fever virus
RGAAEMLVVLT

SEQ ID NO: 178845 - protein, 11 aa, Yellow fever virus
GAAEMLVVLTE

SEQ ID NO: 178846 - protein, 11 aa, Yellow fever virus
AAEMLVVLTEL

SEQ ID NO: 178847 - protein, 11 aa, Yellow fever virus
AEMLVVLTELP

SEQ ID NO: 178848 - protein, 11 aa, Yellow fever virus
EMLVVLTELPD

SEQ ID NO: 178849 - protein, 11 aa, Yellow fever virus
MLVVLTELPDF

SEQ ID NO: 178850 - protein, 11 aa, Yellow fever virus
LVVLTELPDFL

SEQ ID NO: 178851 - protein, 11 aa, Yellow fever virus
VVLTELPDFLA

SEQ ID NO: 178852 - protein, 11 aa, Yellow fever virus
VLTELPDFLAK

SEQ ID NO: 178853 - protein, 11 aa, Yellow fever virus
LTELPDFLAKK

SEQ ID NO: 178854 - protein, 11 aa, Yellow fever virus
TELPDFLAKKG

SEQ ID NO: 178855 - protein, 11 aa, Yellow fever virus
GGEAMDTISVL

SEQ ID NO: 178856 - protein, 11 aa, Yellow fever virus
GEAMDTISVLL

SEQ ID NO: 178857 - protein, 11 aa, Yellow fever virus
EAMDTISVLLH

SEQ ID NO: 178858 - protein, 11 aa, Yellow fever virus
AMDTISVLLHS

SEQ ID NO: 178859 - protein, 11 aa, Yellow fever virus
MDTISVLLHSE

SEQ ID NO: 178860 - protein, 11 aa, Yellow fever virus
DTISVLLHSEE

SEQ ID NO: 178861 - protein, 11 aa, Yellow fever virus
TISVLLHSEEG

SEQ ID NO: 178862 - protein, 11 aa, Yellow fever virus
ISVLLHSEEGS

SEQ ID NO: 178863 - protein, 11 aa, Yellow fever virus
SVLLHSEEGSR

SEQ ID NO: 178864 - protein, 11 aa, Yellow fever virus
VLLHSEEGSRA

SEQ ID NO: 178865 - protein, 11 aa, Yellow fever virus
LLHSEEGSRAY

SEQ ID NO: 178866 - protein, 11 aa, Yellow fever virus
LSMMPEAMTIA

SEQ ID NO: 178867 - protein, 11 aa, Yellow fever virus
SMMPEAMTIAM

SEQ ID NO: 178868 - protein, 11 aa, Yellow fever virus
MMPEAMTIAML

SEQ ID NO: 178869 - protein, 11 aa, Yellow fever virus
MPEAMTIAMLF

SEQ ID NO: 178870 - protein, 11 aa, Yellow fever virus
PEAMTIVMLFL

SEQ ID NO: 178871 - protein, 11 aa, Yellow fever virus
EAMTIVMLFLL

SEQ ID NO: 178872 - protein, 11 aa, Yellow fever virus
AMTIVMLFLLA

SEQ ID NO: 178873 - protein, 11 aa, Yellow fever virus
MTIVMLFLLAG

SEQ ID NO: 178874 - protein, 11 aa, Yellow fever virus
TIVMLFLLAGL

SEQ ID NO: 178875 - protein, 11 aa, Yellow fever virus
IVMLFLLAGLL

SEQ ID NO: 178876 - protein, 11 aa, Yellow fever virus
VMLFLLAGLLT

SEQ ID NO: 178877 - protein, 11 aa, Yellow fever virus
MLFLLAGLLTS

SEQ ID NO: 178878 - protein, 11 aa, Yellow fever virus
LFLLAGLLTSG

SEQ ID NO: 178879 - protein, 11 aa, Yellow fever virus
FLLAGLLTSGM

SEQ ID NO: 178880 - protein, 11 aa, Yellow fever virus
LLAGLLTSGMV

SEQ ID NO: 178881 - protein, 11 aa, Yellow fever virus
LAGLLTSGAVI

SEQ ID NO: 178882 - protein, 11 aa, Yellow fever virus
AGLLTSGAVIF

SEQ ID NO: 178883 - protein, 11 aa, Yellow fever virus
GLLTSGAVIFF

SEQ ID NO: 178884 - protein, 11 aa, Yellow fever virus
LLTSGAVIFFM

SEQ ID NO: 178885 - protein, 11 aa, Yellow fever virus
LTSGAVIFFMS

SEQ ID NO: 178886 - protein, 11 aa, Yellow fever virus
TSGAVIFFMSP

SEQ ID NO: 178887 - protein, 11 aa, Yellow fever virus
SGAVIFFMSPK

SEQ ID NO: 178888 - protein, 11 aa, Yellow fever virus
GAVIFFMSPKG

SEQ ID NO: 178889 - protein, 11 aa, Yellow fever virus
MVIFFMSPKGM

SEQ ID NO: 178890 - protein, 11 aa, Yellow fever virus
VIFFMSPKGMS

SEQ ID NO: 178891 - protein, 11 aa, Yellow fever virus
IFFMSPKGMSR

SEQ ID NO: 178892 - protein, 11 aa, Yellow fever virus
FFMSPKGMSRM

SEQ ID NO: 178893 - protein, 11 aa, Yellow fever virus
FMSPKGMSRMS

SEQ ID NO: 178894 - protein, 11 aa, Yellow fever virus
MSPKGMSRMSM

SEQ ID NO: 178895 - protein, 11 aa, Yellow fever virus
SPKGMSRMSMA

SEQ ID NO: 178896 - protein, 11 aa, Yellow fever virus
PKGMSRMSMAM

SEQ ID NO: 178897 - protein, 11 aa, Yellow fever virus
KGMSRMSMAMG

SEQ ID NO: 178898 - protein, 11 aa, Yellow fever virus
GMSRMSMAMGT

SEQ ID NO: 178899 - protein, 11 aa, Yellow fever virus
MSRMSMAMGTM

SEQ ID NO: 178900 - protein, 11 aa, Yellow fever virus
SRMSMAKGTMA

SEQ ID NO: 178901 - protein, 11 aa, Yellow fever virus
RMSMAKGTMAG

SEQ ID NO: 178902 - protein, 11 aa, Yellow fever virus
MSMAMGTMAGS

SEQ ID NO: 178903 - protein, 11 aa, Yellow fever virus
SMAMGTMAGSG

SEQ ID NO: 178904 - protein, 11 aa, Yellow fever virus
MAMGTMAGSGY

SEQ ID NO: 178905 - protein, 11 aa, Yellow fever virus
AMGTMAGSGYL

SEQ ID NO: 178906 - protein, 11 aa, Yellow fever virus
MGTMAGSGYLM

SEQ ID NO: 178907 - protein, 11 aa, Yellow fever virus
GTMAGSGYLMF

SEQ ID NO: 178908 - protein, 11 aa, Yellow fever virus
TMAGSGYLMFL

SEQ ID NO: 178909 - protein, 11 aa, Yellow fever virus
MAGSGYLMFLG

SEQ ID NO: 178910 - protein, 11 aa, Yellow fever virus
AGSGYLMFLGG

SEQ ID NO: 178911 - protein, 11 aa, Yellow fever virus
GSGYLMFLGGV

SEQ ID NO: 178912 - protein, 11 aa, Yellow fever virus
SGYLMFLGGVK

SEQ ID NO: 178913 - protein, 11 aa, Yellow fever virus
GYLMFLGGVEP

SEQ ID NO: 178914 - protein, 11 aa, Yellow fever virus
YLMFLGGAKPT

SEQ ID NO: 178915 - protein, 11 aa, Yellow fever virus
LMFLGGVEPTH

SEQ ID NO: 178916 - protein, 11 aa, Yellow fever virus
MFLGGAKPTHI

SEQ ID NO: 178917 - protein, 11 aa, Yellow fever virus
FLGGAKPTHIS

SEQ ID NO: 178918 - protein, 11 aa, Yellow fever virus
LGGVEPTHISY

SEQ ID NO: 178919 - protein, 11 aa, Yellow fever virus
GGVKPTHISYV

SEQ ID NO: 178920 - protein, 11 aa, Yellow fever virus
GVKPTHISYVM

SEQ ID NO: 178921 - protein, 11 aa, Yellow fever virus
VKPTHISYVML

SEQ ID NO: 178922 - protein, 11 aa, Yellow fever virus
KPTHISYVMLI

SEQ ID NO: 178923 - protein, 11 aa, Yellow fever virus
PTHISYVMLIF

SEQ ID NO: 178924 - protein, 11 aa, Yellow fever virus
THISYVMLIFF

SEQ ID NO: 178925 - protein, 11 aa, Yellow fever virus
HISYVMLIFFV

SEQ ID NO: 178926 - protein, 11 aa, Yellow fever virus
ISYVMLIFFVL

SEQ ID NO: 178927 - protein, 11 aa, Yellow fever virus
SYVMLIFFVLM

SEQ ID NO: 178928 - protein, 11 aa, Yellow fever virus
YVMLIFFVLMV

SEQ ID NO: 178929 - protein, 11 aa, Yellow fever virus
VMLIFFVLMVV

SEQ ID NO: 178930 - protein, 11 aa, Yellow fever virus
MLIFFVLMVVI

SEQ ID NO: 178931 - protein, 11 aa, Yellow fever virus
LIFFVLMVVII

SEQ ID NO: 178932 - protein, 11 aa, Yellow fever virus
IFFVLMVVIIP

SEQ ID NO: 178933 - protein, 11 aa, Yellow fever virus
FFVLMVVIIPE

SEQ ID NO: 178934 - protein, 11 aa, Yellow fever virus
FVLMVVIIPEP

SEQ ID NO: 178935 - protein, 11 aa, Yellow fever virus
VLMVVIIPEPG

SEQ ID NO: 178936 - protein, 11 aa, Yellow fever virus
LMVVIIPEPGQ

SEQ ID NO: 178937 - protein, 11 aa, Yellow fever virus
MVVIIPEPGQQ

SEQ ID NO: 178938 - protein, 11 aa, Yellow fever virus
VVIIPEPGQQR

SEQ ID NO: 178939 - protein, 11 aa, Yellow fever virus
VVIPEPGQQRT

SEQ ID NO: 178940 - protein, 11 aa, Yellow fever virus
IIPEPGQQRTI

SEQ ID NO: 178941 - protein, 11 aa, Yellow fever virus
IPEPGQQRTIQ

SEQ ID NO: 178942 - protein, 11 aa, Yellow fever virus
PEPGQQRTIQD

SEQ ID NO: 178943 - protein, 11 aa, Yellow fever virus
EPGQQRTIQDN

SEQ ID NO: 178944 - protein, 11 aa, Yellow fever virus
PGQQRTIQDNQ

SEQ ID NO: 178945 - protein, 11 aa, Yellow fever virus
GQQRTIQDNQV

SEQ ID NO: 178946 - protein, 11 aa, Yellow fever virus
QQRTIQDNQVA

SEQ ID NO: 178947 - protein, 11 aa, Yellow fever virus
QRSIQDNQVAF

SEQ ID NO: 178948 - protein, 11 aa, Yellow fever virus
RSIQDNQVAFL

SEQ ID NO: 178949 - protein, 11 aa, Yellow fever virus
SIQDNQVAFLI

SEQ ID NO: 178950 - protein, 11 aa, Yellow fever virus
IQDNQVAFLII

SEQ ID NO: 178951 - protein, 11 aa, Yellow fever virus
QDNQVAFLIIG

SEQ ID NO: 178952 - protein, 11 aa, Yellow fever virus
DNQVAFLIIGI

SEQ ID NO: 178953 - protein, 11 aa, Yellow fever virus
NQVAFLIIGIL

SEQ ID NO: 178954 - protein, 11 aa, Yellow fever virus
QVAFLIIGILT

SEQ ID NO: 178955 - protein, 11 aa, Yellow fever virus
VAFLIIGILTL

SEQ ID NO: 178956 - protein, 11 aa, Yellow fever virus
AYLIIGILTLL

SEQ ID NO: 178957 - protein, 11 aa, Yellow fever virus
YLIIGILTLLS

SEQ ID NO: 178958 - protein, 11 aa, Yellow fever virus
LIIGILTLVSV

SEQ ID NO: 178959 - protein, 11 aa, Yellow fever virus
IIGILTLVSVV

SEQ ID NO: 178960 - protein, 11 aa, Yellow fever virus
IGILTLVSVVA

SEQ ID NO: 178961 - protein, 11 aa, Yellow fever virus
GILTLVSVVAA

SEQ ID NO: 178962 - protein, 11 aa, Yellow fever virus
ILTLVSVVAAN

SEQ ID NO: 178963 - protein, 11 aa, Yellow fever virus
LTLVSVVAANE

SEQ ID NO: 178964 - protein, 11 aa, Yellow fever virus
TLVSVVAANEL

SEQ ID NO: 178965 - protein, 11 aa, Yellow fever virus
LVSVVAANELG

SEQ ID NO: 178966 - protein, 11 aa, Yellow fever virus
VSVVAANELGM

SEQ ID NO: 178967 - protein, 11 aa, Yellow fever virus
SVVAANELGML

SEQ ID NO: 178968 - protein, 11 aa, Yellow fever virus
VVAANELGMLE

SEQ ID NO: 178969 - protein, 11 aa, Yellow fever virus
VAANELGMLER

SEQ ID NO: 178970 - protein, 11 aa, Yellow fever virus
AANELGMLERT

SEQ ID NO: 178971 - protein, 11 aa, Yellow fever virus
ANELGMLERTK

SEQ ID NO: 178972 - protein, 11 aa, Yellow fever virus
NELGMLERTKE

SEQ ID NO: 178973 - protein, 11 aa, Yellow fever virus
ELGMLERTKED

SEQ ID NO: 178974 - protein, 11 aa, Yellow fever virus
LGMLEKTKEDF

SEQ ID NO: 178975 - protein, 11 aa, Yellow fever virus
GMLEKTKEDFF

SEQ ID NO: 178976 - protein, 11 aa, Yellow fever virus
MLEKTKEDFFG

SEQ ID NO: 178977 - protein, 11 aa, Yellow fever virus
LEKTKEDFFGK

SEQ ID NO: 178978 - protein, 11 aa, Yellow fever virus
EKTKEDFFGKR

SEQ ID NO: 178979 - protein, 11 aa, Yellow fever virus
TSGGTIPWSWP

SEQ ID NO: 178980 - protein, 11 aa, Yellow fever virus
SGGTIPWSWPD

SEQ ID NO: 178981 - protein, 11 aa, Yellow fever virus
GGTIPWSWPDL

SEQ ID NO: 178982 - protein, 11 aa, Yellow fever virus
GTIPWSWPDLD

SEQ ID NO: 178983 - protein, 11 aa, Yellow fever virus
TIPWSWPDLDL

SEQ ID NO: 178984 - protein, 11 aa, Yellow fever virus
IPWSWPDLDLK

SEQ ID NO: 178985 - protein, 11 aa, Yellow fever virus
AWTVYVGIVTI

SEQ ID NO: 178986 - protein, 11 aa, Yellow fever virus
WTVYVGIVTIL

SEQ ID NO: 178987 - protein, 11 aa, Yellow fever virus
TVYVGIVTILS

SEQ ID NO: 178988 - protein, 11 aa, Yellow fever virus
VYVGIVTILSP

SEQ ID NO: 178989 - protein, 11 aa, Yellow fever virus
YVGIVTILSPM

SEQ ID NO: 178990 - protein, 11 aa, Yellow fever virus
VGIVTILSPML

SEQ ID NO: 178991 - protein, 11 aa, Yellow fever virus
GIVTILSPMLH

SEQ ID NO: 178992 - protein, 11 aa, Yellow fever virus
IVTILSPMLHH

SEQ ID NO: 178993 - protein, 11 aa, Yellow fever virus
VTILSPMLHHW

SEQ ID NO: 178994 - protein, 11 aa, Yellow fever virus
TILSPMLHHWI

SEQ ID NO: 178995 - protein, 11 aa, Yellow fever virus
ILSPMLHHWIK

SEQ ID NO: 178996 - protein, 11 aa, Yellow fever virus
ASVLSFMDKGV

SEQ ID NO: 178997 - protein, 11 aa, Yellow fever virus
SVLSFMDKGVP

SEQ ID NO: 178998 - protein, 11 aa, Yellow fever virus
VLSFMDKGVPF

SEQ ID NO: 178999 - protein, 11 aa, Yellow fever virus
LSFMDKGVPFM

SEQ ID NO: 179000 - protein, 11 aa, Yellow fever virus
SFMDKGVPFMK

SEQ ID NO: 179001 - protein, 11 aa, Yellow fever virus
FMDKGVPFMKM

SEQ ID NO: 179002 - protein, 11 aa, Yellow fever virus
MDKGVPFMKMN

SEQ ID NO: 179003 - protein, 11 aa, Yellow fever virus
DKGVPFMKMNI

SEQ ID NO: 179004 - protein, 11 aa, Yellow fever virus
KGVPFMKMNIS

SEQ ID NO: 179005 - protein, 11 aa, Yellow fever virus
GVPFMKMNISV

SEQ ID NO: 179006 - protein, 11 aa, Yellow fever virus
IPFMKMNISVV

SEQ ID NO: 179007 - protein, 11 aa, Yellow fever virus
PFMKMNISVII

SEQ ID NO: 179008 - protein, 11 aa, Yellow fever virus
FMKMNISVIIL

SEQ ID NO: 179009 - protein, 11 aa, Yellow fever virus
MKMNISVIILL

SEQ ID NO: 179010 - protein, 11 aa, Yellow fever virus
KMNISVIILLV

SEQ ID NO: 179011 - protein, 11 aa, Yellow fever virus
MNISVIILLVS

SEQ ID NO: 179012 - protein, 11 aa, Yellow fever virus
NISVIILLVSG

SEQ ID NO: 179013 - protein, 11 aa, Yellow fever virus
ISVIILLVSGW

SEQ ID NO: 179014 - protein, 11 aa, Yellow fever virus
SVIILLVSGWN

SEQ ID NO: 179015 - protein, 11 aa, Yellow fever virus
VIILLVSGWNS

SEQ ID NO: 179016 - protein, 11 aa, Yellow fever virus
IILLVSGWNSI

SEQ ID NO: 179017 - protein, 11 aa, Yellow fever virus
ILLVSGWNSIT

SEQ ID NO: 179018 - protein, 11 aa, Yellow fever virus
LLISGWNSITV

SEQ ID NO: 179019 - protein, 11 aa, Yellow fever virus
LVSGWNSITVI

SEQ ID NO: 179020 - protein, 11 aa, Yellow fever virus
VSGWNSITVIP

SEQ ID NO: 179021 - protein, 11 aa, Yellow fever virus
SGWNSITVIPL

SEQ ID NO: 179022 - protein, 11 aa, Yellow fever virus
GWNSITVIPLL

SEQ ID NO: 179023 - protein, 11 aa, Yellow fever virus
WNSITVIPLLC

SEQ ID NO: 179024 - protein, 11 aa, Yellow fever virus
NSITVIPLLCG

SEQ ID NO: 179025 - protein, 11 aa, Yellow fever virus
SITVIPLLCGV

SEQ ID NO: 179026 - protein, 11 aa, Yellow fever virus
ITVIPLLCGVG

SEQ ID NO: 179027 - protein, 11 aa, Yellow fever virus
TVIPLLCGVGG

SEQ ID NO: 179028 - protein, 11 aa, Yellow fever virus
VIPLLCGVGGA

SEQ ID NO: 179029 - protein, 11 aa, Yellow fever virus
IPLLCGVGGAM

SEQ ID NO: 179030 - protein, 11 aa, Yellow fever virus
PLLCGVGGAML

SEQ ID NO: 179031 - protein, 11 aa, Yellow fever virus
LLCGVGGAMLH

SEQ ID NO: 179032 - protein, 11 aa, Yellow fever virus
LCGVGGAMLHW

SEQ ID NO: 179033 - protein, 11 aa, Yellow fever virus
CGVGGAMLHWT

SEQ ID NO: 179034 - protein, 11 aa, Yellow fever virus
GVGGAMLHWTL

SEQ ID NO: 179035 - protein, 11 aa, Yellow fever virus
VGGAMLHWTLI

SEQ ID NO: 179036 - protein, 11 aa, Yellow fever virus
GGAMLHWTLIL

SEQ ID NO: 179037 - protein, 11 aa, Yellow fever virus
GAMLHWTLILP

SEQ ID NO: 179038 - protein, 11 aa, Yellow fever virus
AMLHWTLILPG

SEQ ID NO: 179039 - protein, 11 aa, Yellow fever virus
MLHWTLILPGI

SEQ ID NO: 179040 - protein, 11 aa, Yellow fever virus
LHWTLILPGIK

SEQ ID NO: 179041 - protein, 11 aa, Yellow fever virus
HWTLILPGIKA

SEQ ID NO: 179042 - protein, 11 aa, Yellow fever virus
WTLILPGIKAQ

SEQ ID NO: 179043 - protein, 11 aa, Yellow fever virus
TLILPGIKAQQ

SEQ ID NO: 179044 - protein, 11 aa, Yellow fever virus
PGIKAQQSKLP

SEQ ID NO: 179045 - protein, 11 aa, Yellow fever virus
GIKAQQSKLPQ

SEQ ID NO: 179046 - protein, 11 aa, Yellow fever virus
IKAQQSKLAQK

SEQ ID NO: 179047 - protein, 11 aa, Yellow fever virus
KAQQSKLAQKR

SEQ ID NO: 179048 - protein, 11 aa, Yellow fever virus
AQQSKLAQKRV

SEQ ID NO: 179049 - protein, 11 aa, Yellow fever virus
QQSKLAQKRVF

SEQ ID NO: 179050 - protein, 11 aa, Yellow fever virus
QSKLAQKRVFH

SEQ ID NO: 179051 - protein, 11 aa, Yellow fever virus
SKLAQKRVFHG

SEQ ID NO: 179052 - protein, 11 aa, Yellow fever virus
KLAQKRVFHGV

SEQ ID NO: 179053 - protein, 11 aa, Yellow fever virus
LAQKRVFHGVA

SEQ ID NO: 179054 - protein, 11 aa, Yellow fever virus
AQKRVFHGVAK

SEQ ID NO: 179055 - protein, 11 aa, Yellow fever virus
QKRVFHGVAKN

SEQ ID NO: 179056 - protein, 11 aa, Yellow fever virus
KRVFHGVAKNP

SEQ ID NO: 179057 - protein, 11 aa, Yellow fever virus
RVFHGVAENPV

SEQ ID NO: 179058 - protein, 11 aa, Yellow fever virus
VFHGVAENPVV

SEQ ID NO: 179059 - protein, 11 aa, Yellow fever virus
FHGVAENPVVD

SEQ ID NO: 179060 - protein, 11 aa, Yellow fever virus
HGVAENPVVDG

SEQ ID NO: 179061 - protein, 11 aa, Yellow fever virus
GVAENPVVDGN

SEQ ID NO: 179062 - protein, 11 aa, Yellow fever virus
VAENPVVDGNP

SEQ ID NO: 179063 - protein, 11 aa, Yellow fever virus
AENPVVDGNPT

SEQ ID NO: 179064 - protein, 11 aa, Yellow fever virus
KNPVVDGNPTA

SEQ ID NO: 179065 - protein, 11 aa, Yellow fever virus
NPVVDGNPTAD

SEQ ID NO: 179066 - protein, 11 aa, Yellow fever virus
PVVDGNPTADI

SEQ ID NO: 179067 - protein, 11 aa, Yellow fever virus
VVDGNPTADIE

SEQ ID NO: 179068 - protein, 11 aa, Yellow fever virus
VDGNPTADIEE

SEQ ID NO: 179069 - protein, 11 aa, Yellow fever virus
DGNPTADIEEA

SEQ ID NO: 179070 - protein, 11 aa, Yellow fever virus
GNPTADIEEAP

SEQ ID NO: 179071 - protein, 11 aa, Yellow fever virus
NPTADIEEAPE

SEQ ID NO: 179072 - protein, 11 aa, Yellow fever virus
PTADIEEAPEM

SEQ ID NO: 179073 - protein, 11 aa, Yellow fever virus
TADIEEAPEMP

SEQ ID NO: 179074 - protein, 11 aa, Yellow fever virus
ADIEEAPEMPA

SEQ ID NO: 179075 - protein, 11 aa, Yellow fever virus
DIEEAPEMPVL

SEQ ID NO: 179076 - protein, 11 aa, Yellow fever virus
IEEAPEMPVLY

SEQ ID NO: 179077 - protein, 11 aa, Yellow fever virus
EEAPEMPVLYE

SEQ ID NO: 179078 - protein, 11 aa, Yellow fever virus
EAPEMPVLYEK

SEQ ID NO: 179079 - protein, 11 aa, Yellow fever virus
APEMPVLYEKK

SEQ ID NO: 179080 - protein, 11 aa, Yellow fever virus
PEMPVLYEKKL

SEQ ID NO: 179081 - protein, 11 aa, Yellow fever virus
EMPVLYEKKLA

SEQ ID NO: 179082 - protein, 11 aa, Yellow fever virus
MPVLYEKKLAL

SEQ ID NO: 179083 - protein, 11 aa, Yellow fever virus
PVLYEKKLALY

SEQ ID NO: 179084 - protein, 11 aa, Yellow fever virus
VLYEKKLALYL

SEQ ID NO: 179085 - protein, 11 aa, Yellow fever virus
ALYLLLALSLM

SEQ ID NO: 179086 - protein, 11 aa, Yellow fever virus
LYLLLALSLMS

SEQ ID NO: 179087 - protein, 11 aa, Yellow fever virus
YLLLALSLMSV

SEQ ID NO: 179088 - protein, 11 aa, Yellow fever virus
LLLALSLMSVA

SEQ ID NO: 179089 - protein, 11 aa, Yellow fever virus
LLALSLMSVAM

SEQ ID NO: 179090 - protein, 11 aa, Yellow fever virus
LALSLMSVAMC

SEQ ID NO: 179091 - protein, 11 aa, Yellow fever virus
ALSLMSVAMCR

SEQ ID NO: 179092 - protein, 11 aa, Yellow fever virus
LSLMSVAMCRT

SEQ ID NO: 179093 - protein, 11 aa, Yellow fever virus
SLMSVAMCRTP

SEQ ID NO: 179094 - protein, 11 aa, Yellow fever virus
LMSVAMCRTPF

SEQ ID NO: 179095 - protein, 11 aa, Yellow fever virus
MSVAMCRTPFS

SEQ ID NO: 179096 - protein, 11 aa, Yellow fever virus
VAMCRTPFSLD

SEQ ID NO: 179097 - protein, 11 aa, Yellow fever virus
AMCRTPFSLDE

SEQ ID NO: 179098 - protein, 11 aa, Yellow fever virus
MCRTPFSLDEG

SEQ ID NO: 179099 - protein, 11 aa, Yellow fever virus
CRTPFSLDEGI

SEQ ID NO: 179100 - protein, 11 aa, Yellow fever virus
RTPFSLDEGIV

SEQ ID NO: 179101 - protein, 11 aa, Yellow fever virus
TPFSLDEGIVL

SEQ ID NO: 179102 - protein, 11 aa, Yellow fever virus
PFSLAEGIVLS

SEQ ID NO: 179103 - protein, 11 aa, Yellow fever virus
FSLAEGIVLSS

SEQ ID NO: 179104 - protein, 11 aa, Yellow fever virus
SLAEGIVLSSA

SEQ ID NO: 179105 - protein, 11 aa, Yellow fever virus
LAEGIVLSSAA

SEQ ID NO: 179106 - protein, 11 aa, Yellow fever virus
AEGIVLASAAS

SEQ ID NO: 179107 - protein, 11 aa, Yellow fever virus
EGIVLASAASG

SEQ ID NO: 179108 - protein, 11 aa, Yellow fever virus
GIVLASAASGP

SEQ ID NO: 179109 - protein, 11 aa, Yellow fever virus
IVLASAASGPL

SEQ ID NO: 179110 - protein, 11 aa, Yellow fever virus
VLASAASGPLI

SEQ ID NO: 179111 - protein, 11 aa, Yellow fever virus
LASAASGPLIE

SEQ ID NO: 179112 - protein, 11 aa, Yellow fever virus
ASAASGPLIEG

SEQ ID NO: 179113 - protein, 11 aa, Yellow fever virus
SAASGPLIEGN

SEQ ID NO: 179114 - protein, 11 aa, Yellow fever virus
AASGPLIEGNT

SEQ ID NO: 179115 - protein, 11 aa, Yellow fever virus
ASGPLIEGNTS

SEQ ID NO: 179116 - protein, 11 aa, Yellow fever virus
SGPLIEGNTSL

SEQ ID NO: 179117 - protein, 11 aa, Yellow fever virus
VSMTGVMRGNY

SEQ ID NO: 179118 - protein, 11 aa, Yellow fever virus
SMTGVMRGNYY

SEQ ID NO: 179119 - protein, 11 aa, Yellow fever virus
MTGVMRGNYYA

SEQ ID NO: 179120 - protein, 11 aa, Yellow fever virus
TGVMRGNYYAF

SEQ ID NO: 179121 - protein, 11 aa, Yellow fever virus
GVMRGNYYAFV

SEQ ID NO: 179122 - protein, 11 aa, Yellow fever virus
VMRGNYYAFVG

SEQ ID NO: 179123 - protein, 11 aa, Yellow fever virus
MRGNYYAFVGV

SEQ ID NO: 179124 - protein, 11 aa, Yellow fever virus
RGNYYAFVGVM

SEQ ID NO: 179125 - protein, 11 aa, Yellow fever virus
GNYYAFVGVMY

SEQ ID NO: 179126 - protein, 11 aa, Yellow fever virus
NYYAFVGVMYN

SEQ ID NO: 179127 - protein, 11 aa, Yellow fever virus
YYAFVGVMYNL

SEQ ID NO: 179128 - protein, 11 aa, Yellow fever virus
YAFVGVAYNLW

SEQ ID NO: 179129 - protein, 11 aa, Yellow fever virus
AFVGVAYNLWK

SEQ ID NO: 179130 - protein, 11 aa, Yellow fever virus
FVGVAYNLWKM

SEQ ID NO: 179131 - protein, 11 aa, Yellow fever virus
VGVMYNLWKME

SEQ ID NO: 179132 - protein, 11 aa, Yellow fever virus
GVMYNLWKMET

SEQ ID NO: 179133 - protein, 11 aa, Yellow fever virus
VMYNLWKMETG

SEQ ID NO: 179134 - protein, 11 aa, Yellow fever virus
MYNLWKMETGR

SEQ ID NO: 179135 - protein, 11 aa, Yellow fever virus
YNLWKMETGRR

SEQ ID NO: 179136 - protein, 11 aa, Yellow fever virus
NLWKMETGRRG

SEQ ID NO: 179137 - protein, 11 aa, Yellow fever virus
RRGRANGKTLG

SEQ ID NO: 179138 - protein, 11 aa, Yellow fever virus
RGRANGKTLGE

SEQ ID NO: 179139 - protein, 11 aa, Yellow fever virus
GRANGKTLGEV

SEQ ID NO: 179140 - protein, 11 aa, Yellow fever virus
RANGKTLGEVW

SEQ ID NO: 179141 - protein, 11 aa, Yellow fever virus
ASGKTLGEVWK

SEQ ID NO: 179142 - protein, 11 aa, Yellow fever virus
SGKTLGEVWKR

SEQ ID NO: 179143 - protein, 11 aa, Yellow fever virus
VWKRELNLLDR

SEQ ID NO: 179144 - protein, 11 aa, Yellow fever virus
WKRELNLLDKR

SEQ ID NO: 179145 - protein, 11 aa, Yellow fever virus
KRELNLLDKRQ

SEQ ID NO: 179146 - protein, 11 aa, Yellow fever virus
RELNLLDKRQF

SEQ ID NO: 179147 - protein, 11 aa, Yellow fever virus
ELNLLDKRQFE

SEQ ID NO: 179148 - protein, 11 aa, Yellow fever virus
LNLLDKRQFEL

SEQ ID NO: 179149 - protein, 11 aa, Yellow fever virus
NLLDKQQFELY

SEQ ID NO: 179150 - protein, 11 aa, Yellow fever virus
LLDKQQFELYK

SEQ ID NO: 179151 - protein, 11 aa, Yellow fever virus
LDKQQFELYKR

SEQ ID NO: 179152 - protein, 11 aa, Yellow fever virus
DKRQFELYKRT

SEQ ID NO: 179153 - protein, 11 aa, Yellow fever virus
KRQFELYKRTD

SEQ ID NO: 179154 - protein, 11 aa, Yellow fever virus
RQFELYKRTDI

SEQ ID NO: 179155 - protein, 11 aa, Yellow fever virus
QFELYKRTDIT

SEQ ID NO: 179156 - protein, 11 aa, Yellow fever virus
FELYKRTDITE

SEQ ID NO: 179157 - protein, 11 aa, Yellow fever virus
ELYKRTDITEV

SEQ ID NO: 179158 - protein, 11 aa, Yellow fever virus
LYKRTDITEVD

SEQ ID NO: 179159 - protein, 11 aa, Yellow fever virus
YKRTDITEVDR

SEQ ID NO: 179160 - protein, 11 aa, Yellow fever virus
KRTDITEVDRD

SEQ ID NO: 179161 - protein, 11 aa, Yellow fever virus
RTDITEVDRDM

SEQ ID NO: 179162 - protein, 11 aa, Yellow fever virus
TDITEVDRDMA

SEQ ID NO: 179163 - protein, 11 aa, Yellow fever virus
DITEVDRDMAR

SEQ ID NO: 179164 - protein, 11 aa, Yellow fever virus
ITEVDRDMARR

SEQ ID NO: 179165 - protein, 11 aa, Yellow fever virus
TEVDRDMARRH

SEQ ID NO: 179166 - protein, 11 aa, Yellow fever virus
EVDRDMARRHL

SEQ ID NO: 179167 - protein, 11 aa, Yellow fever virus
VDRDMARRHLA

SEQ ID NO: 179168 - protein, 11 aa, Yellow fever virus
DRDMARRHLAE

SEQ ID NO: 179169 - protein, 11 aa, Yellow fever virus
RDMARRHLAEG

SEQ ID NO: 179170 - protein, 11 aa, Yellow fever virus
DMARRHLAEGK

SEQ ID NO: 179171 - protein, 11 aa, Yellow fever virus
MARRHLAEGKV

SEQ ID NO: 179172 - protein, 11 aa, Yellow fever virus
RGYVKLEGRVT

SEQ ID NO: 179173 - protein, 11 aa, Yellow fever virus
GYVKLEGRVTD

SEQ ID NO: 179174 - protein, 11 aa, Yellow fever virus
YVKLEGRVTDL

SEQ ID NO: 179175 - protein, 11 aa, Yellow fever virus
VKLEGRVTDLG

SEQ ID NO: 179176 - protein, 11 aa, Yellow fever virus
KLEGRVTDLGC

SEQ ID NO: 179177 - protein, 11 aa, Yellow fever virus
LEGRVTDLGCG

SEQ ID NO: 179178 - protein, 11 aa, Yellow fever virus
EGRVTDLGCGR

SEQ ID NO: 179179 - protein, 11 aa, Yellow fever virus
GRVTDLGCGRG

SEQ ID NO: 179180 - protein, 11 aa, Yellow fever virus
RVTDLGCGRGG

SEQ ID NO: 179181 - protein, 11 aa, Yellow fever virus
VTDLGCGRGGW

SEQ ID NO: 179182 - protein, 11 aa, Yellow fever virus
TDLGCGRGGWC

SEQ ID NO: 179183 - protein, 11 aa, Yellow fever virus
AQKEVSGVKGY

SEQ ID NO: 179184 - protein, 11 aa, Yellow fever virus
QKEVSGVKGYT

SEQ ID NO: 179185 - protein, 11 aa, Yellow fever virus
KEVSGVKGYTL

SEQ ID NO: 179186 - protein, 11 aa, Yellow fever virus
EVSGVKGYTLG

SEQ ID NO: 179187 - protein, 11 aa, Yellow fever virus
VSGVKGYTLGR

SEQ ID NO: 179188 - protein, 11 aa, Yellow fever virus
SGVKGYTLGRD

SEQ ID NO: 179189 - protein, 11 aa, Yellow fever virus
GVKGYTLGRDG

SEQ ID NO: 179190 - protein, 11 aa, Yellow fever virus
VKGYTLGRDGH

SEQ ID NO: 179191 - protein, 11 aa, Yellow fever virus
KGYTLGRDGHE

SEQ ID NO: 179192 - protein, 11 aa, Yellow fever virus
GYTLGRDGHEK

SEQ ID NO: 179193 - protein, 11 aa, Yellow fever virus
YTLGRDGHEKP

SEQ ID NO: 179194 - protein, 11 aa, Yellow fever virus
TLGREGHEKPM

SEQ ID NO: 179195 - protein, 11 aa, Yellow fever virus
LGREGHEKPMN

SEQ ID NO: 179196 - protein, 11 aa, Yellow fever virus
GREGHEKPMNV

SEQ ID NO: 179197 - protein, 11 aa, Yellow fever virus
REGHEKPMNVR

SEQ ID NO: 179198 - protein, 11 aa, Yellow fever virus
EGHEKPMNVRS

SEQ ID NO: 179199 - protein, 11 aa, Yellow fever virus
GHEKPMNVRSL

SEQ ID NO: 179200 - protein, 11 aa, Yellow fever virus
HEKPMNVRSLG

SEQ ID NO: 179201 - protein, 11 aa, Yellow fever virus
EKPMNVRSLGW

SEQ ID NO: 179202 - protein, 11 aa, Yellow fever virus
KPMNVRSLGWN

SEQ ID NO: 179203 - protein, 11 aa, Yellow fever virus
PMNVRSLGWNI

SEQ ID NO: 179204 - protein, 11 aa, Yellow fever virus
MNVQSLGWNIV

SEQ ID NO: 179205 - protein, 11 aa, Yellow fever virus
NVQSLGWNIVT

SEQ ID NO: 179206 - protein, 11 aa, Yellow fever virus
VQSLGWNIVTF

SEQ ID NO: 179207 - protein, 11 aa, Yellow fever virus
QSLGWNIVTFK

SEQ ID NO: 179208 - protein, 11 aa, Yellow fever virus
SLGWNIVTFKD

SEQ ID NO: 179209 - protein, 11 aa, Yellow fever virus
LGWNIVTFKDK

SEQ ID NO: 179210 - protein, 11 aa, Yellow fever virus
GWNIVTFKDKT

SEQ ID NO: 179211 - protein, 11 aa, Yellow fever virus
WNIVTFKDKTD

SEQ ID NO: 179212 - protein, 11 aa, Yellow fever virus
NIVTFKDKTDI

SEQ ID NO: 179213 - protein, 11 aa, Yellow fever virus
IVTFKDKTDIH

SEQ ID NO: 179214 - protein, 11 aa, Yellow fever virus
VTFKDKTDIHR

SEQ ID NO: 179215 - protein, 11 aa, Yellow fever virus
TFKDKTDVHRL

SEQ ID NO: 179216 - protein, 11 aa, Yellow fever virus
FKDKTDVHRLE

SEQ ID NO: 179217 - protein, 11 aa, Yellow fever virus
KDKTDIHHLEP

SEQ ID NO: 179218 - protein, 11 aa, Yellow fever virus
LEPAKCETLLC

SEQ ID NO: 179219 - protein, 11 aa, Yellow fever virus
EPAKCETLLCD

SEQ ID NO: 179220 - protein, 11 aa, Yellow fever virus
PAKCETLLCDI

SEQ ID NO: 179221 - protein, 11 aa, Yellow fever virus
AKCETLLCDIG

SEQ ID NO: 179222 - protein, 11 aa, Yellow fever virus
KCETLLCDIGE

SEQ ID NO: 179223 - protein, 11 aa, Yellow fever virus
CETLLCDIGES

SEQ ID NO: 179224 - protein, 11 aa, Yellow fever virus
ETLLCDIGESS

SEQ ID NO: 179225 - protein, 11 aa, Yellow fever virus
TLLCDIGESSP

SEQ ID NO: 179226 - protein, 11 aa, Yellow fever virus
LLCDIGESSPS

SEQ ID NO: 179227 - protein, 11 aa, Yellow fever virus
LCDIGESSPSS

SEQ ID NO: 179228 - protein, 11 aa, Yellow fever virus
CDIGESSPSSV

SEQ ID NO: 179229 - protein, 11 aa, Yellow fever virus
DIGESSPSSVT

SEQ ID NO: 179230 - protein, 11 aa, Yellow fever virus
IGESSPSSVTE

SEQ ID NO: 179231 - protein, 11 aa, Yellow fever virus
GESSPSSVTEG

SEQ ID NO: 179232 - protein, 11 aa, Yellow fever virus
ESSPSSVTEGE

SEQ ID NO: 179233 - protein, 11 aa, Yellow fever virus
SSPSSVTEGER

SEQ ID NO: 179234 - protein, 11 aa, Yellow fever virus
SPSSVTEGERT

SEQ ID NO: 179235 - protein, 11 aa, Yellow fever virus
SSSVTEGERTM

SEQ ID NO: 179236 - protein, 11 aa, Yellow fever virus
SSVTEGERTMR

SEQ ID NO: 179237 - protein, 11 aa, Yellow fever virus
SVTEGERTMRV

SEQ ID NO: 179238 - protein, 11 aa, Yellow fever virus
VTEGERTMRVL

SEQ ID NO: 179239 - protein, 11 aa, Yellow fever virus
TEGERTMRVLD

SEQ ID NO: 179240 - protein, 11 aa, Yellow fever virus
EGERTMRVLDT

SEQ ID NO: 179241 - protein, 11 aa, Yellow fever virus
GERTMRVLDTV

SEQ ID NO: 179242 - protein, 11 aa, Yellow fever virus
ERTMRVLDTVE

SEQ ID NO: 179243 - protein, 11 aa, Yellow fever virus
RTMRVLDTVEK

SEQ ID NO: 179244 - protein, 11 aa, Yellow fever virus
TMRVLDTVEKW

SEQ ID NO: 179245 - protein, 11 aa, Yellow fever virus
MRVLDTVEKWL

SEQ ID NO: 179246 - protein, 11 aa, Yellow fever virus
RVLETVEKWLA

SEQ ID NO: 179247 - protein, 11 aa, Yellow fever virus
VLETVEKWLAC

SEQ ID NO: 179248 - protein, 11 aa, Yellow fever virus
LETIEKWLACG

SEQ ID NO: 179249 - protein, 11 aa, Yellow fever virus
ETIEKWLACGV

SEQ ID NO: 179250 - protein, 11 aa, Yellow fever virus
TIEKWLACGVD

SEQ ID NO: 179251 - protein, 11 aa, Yellow fever virus
IEKWLACGVDN

SEQ ID NO: 179252 - protein, 11 aa, Yellow fever virus
WLACGVDNFCI

SEQ ID NO: 179253 - protein, 11 aa, Yellow fever virus
LACGVDNFCIK

SEQ ID NO: 179254 - protein, 11 aa, Yellow fever virus
ACGVDNFCIKV

SEQ ID NO: 179255 - protein, 11 aa, Yellow fever virus
CGVDNFCIKVL

SEQ ID NO: 179256 - protein, 11 aa, Yellow fever virus
GVDNFCIKVLA

SEQ ID NO: 179257 - protein, 11 aa, Yellow fever virus
VDNFCIKVLAP

SEQ ID NO: 179258 - protein, 11 aa, Yellow fever virus
DNFCIKVLAPY

SEQ ID NO: 179259 - protein, 11 aa, Yellow fever virus
NFCIKVLAPYM

SEQ ID NO: 179260 - protein, 11 aa, Yellow fever virus
FCIKVLAPYMP

SEQ ID NO: 179261 - protein, 11 aa, Yellow fever virus
CIKVLAPYMPD

SEQ ID NO: 179262 - protein, 11 aa, Yellow fever virus
IKVLAPYMPDV

SEQ ID NO: 179263 - protein, 11 aa, Yellow fever virus
KVLAPYMPDVI

SEQ ID NO: 179264 - protein, 11 aa, Yellow fever virus
VLAPYMPDVIE

SEQ ID NO: 179265 - protein, 11 aa, Yellow fever virus
LAPYMPDVIEK

SEQ ID NO: 179266 - protein, 11 aa, Yellow fever virus
APYMPDVIEKL

SEQ ID NO: 179267 - protein, 11 aa, Yellow fever virus
PYMPDVIEKLE

SEQ ID NO: 179268 - protein, 11 aa, Yellow fever virus
YMPDVIEKLEL

SEQ ID NO: 179269 - protein, 11 aa, Yellow fever virus
MPDVIEKLELL

SEQ ID NO: 179270 - protein, 11 aa, Yellow fever virus
PDVIEKLELLQ

SEQ ID NO: 179271 - protein, 11 aa, Yellow fever virus
DVIEKLELLQR

SEQ ID NO: 179272 - protein, 11 aa, Yellow fever virus
VIEKLELLQRR

SEQ ID NO: 179273 - protein, 11 aa, Yellow fever virus
IEKLELLQRRF

SEQ ID NO: 179274 - protein, 11 aa, Yellow fever virus
ELLQRRFGGTI

SEQ ID NO: 179275 - protein, 11 aa, Yellow fever virus
LLQRRFGGTII

SEQ ID NO: 179276 - protein, 11 aa, Yellow fever virus
LQRRFGGTIIR

SEQ ID NO: 179277 - protein, 11 aa, Yellow fever virus
QRRFGGTIIRN

SEQ ID NO: 179278 - protein, 11 aa, Yellow fever virus
RRFGGTIIRNP

SEQ ID NO: 179279 - protein, 11 aa, Yellow fever virus
RFGGTIIRNPL

SEQ ID NO: 179280 - protein, 11 aa, Yellow fever virus
FGGTIIRNPLS

SEQ ID NO: 179281 - protein, 11 aa, Yellow fever virus
GGTIIRNPLSR

SEQ ID NO: 179282 - protein, 11 aa, Yellow fever virus
GTIIRNPLSRN

SEQ ID NO: 179283 - protein, 11 aa, Yellow fever virus
TIIRNPLSRNS

SEQ ID NO: 179284 - protein, 11 aa, Yellow fever virus
IIRNPLSRNST

SEQ ID NO: 179285 - protein, 11 aa, Yellow fever virus
MYYVSGARSNI

SEQ ID NO: 179286 - protein, 11 aa, Yellow fever virus
YYVSGARSNIT

SEQ ID NO: 179287 - protein, 11 aa, Yellow fever virus
YVSGARSNITF

SEQ ID NO: 179288 - protein, 11 aa, Yellow fever virus
VSGARSNITFT

SEQ ID NO: 179289 - protein, 11 aa, Yellow fever virus
SGARSNITFTV

SEQ ID NO: 179290 - protein, 11 aa, Yellow fever virus
GARSNITFTVN

SEQ ID NO: 179291 - protein, 11 aa, Yellow fever virus
ARSNITFTVNQ

SEQ ID NO: 179292 - protein, 11 aa, Yellow fever virus
RSNITFTVNQT

SEQ ID NO: 179293 - protein, 11 aa, Yellow fever virus
SNITFTVNQTS

SEQ ID NO: 179294 - protein, 11 aa, Yellow fever virus
NITFTVNQTSR

SEQ ID NO: 179295 - protein, 11 aa, Yellow fever virus
ITFTVNQTSRL

SEQ ID NO: 179296 - protein, 11 aa, Yellow fever virus
RRPTGKVTLEP

SEQ ID NO: 179297 - protein, 11 aa, Yellow fever virus
RPTGKVTLEPD

SEQ ID NO: 179298 - protein, 11 aa, Yellow fever virus
PTGKVTLEPDV

SEQ ID NO: 179299 - protein, 11 aa, Yellow fever virus
TGKVTLEPDVI

SEQ ID NO: 179300 - protein, 11 aa, Yellow fever virus
GKVTLEPDVIL

SEQ ID NO: 179301 - protein, 11 aa, Yellow fever virus
KVTLEPDVILP

SEQ ID NO: 179302 - protein, 11 aa, Yellow fever virus
VTLEPDVILPI

SEQ ID NO: 179303 - protein, 11 aa, Yellow fever virus
TLEADVTLPIG

SEQ ID NO: 179304 - protein, 11 aa, Yellow fever virus
LEPDVILPIGT

SEQ ID NO: 179305 - protein, 11 aa, Yellow fever virus
EPDVILPIGTR

SEQ ID NO: 179306 - protein, 11 aa, Yellow fever virus
PDVILPIGTRS

SEQ ID NO: 179307 - protein, 11 aa, Yellow fever virus
DVTLPIGTRSV

SEQ ID NO: 179308 - protein, 11 aa, Yellow fever virus
VTLPIGTRSVE

SEQ ID NO: 179309 - protein, 11 aa, Yellow fever virus
TLPIGTRSVET

SEQ ID NO: 179310 - protein, 11 aa, Yellow fever virus
RSVETDKGPLN

SEQ ID NO: 179311 - protein, 11 aa, Yellow fever virus
SVETDKGPLDR

SEQ ID NO: 179312 - protein, 11 aa, Yellow fever virus
DAIEERVERIK

SEQ ID NO: 179313 - protein, 11 aa, Yellow fever virus
AIEERVERIKT

SEQ ID NO: 179314 - protein, 11 aa, Yellow fever virus
IEERVERIKTE

SEQ ID NO: 179315 - protein, 11 aa, Yellow fever virus
EERVERIKTEY

SEQ ID NO: 179316 - protein, 11 aa, Yellow fever virus
ERVERIKTEYA

SEQ ID NO: 179317 - protein, 11 aa, Yellow fever virus
RVERIKTEYAA

SEQ ID NO: 179318 - protein, 11 aa, Yellow fever virus
VERIKSEYMTT

SEQ ID NO: 179319 - protein, 11 aa, Yellow fever virus
ERIKSEYMTTW

SEQ ID NO: 179320 - protein, 11 aa, Yellow fever virus
RIKSEYMTTWF

SEQ ID NO: 179321 - protein, 11 aa, Yellow fever virus
IKSEYMTTWFY

SEQ ID NO: 179322 - protein, 11 aa, Yellow fever virus
KSEYMTTWFYD

SEQ ID NO: 179323 - protein, 11 aa, Yellow fever virus
SEYMTTWFYDN

SEQ ID NO: 179324 - protein, 11 aa, Yellow fever virus
EYMTTWFYDND

SEQ ID NO: 179325 - protein, 11 aa, Yellow fever virus
YMTTWFYDNDN

SEQ ID NO: 179326 - protein, 11 aa, Yellow fever virus
MTTWFYDNDNP

SEQ ID NO: 179327 - protein, 11 aa, Yellow fever virus
TTWFYDNDNPY

SEQ ID NO: 179328 - protein, 11 aa, Yellow fever virus
TWFYDNDNPYR

SEQ ID NO: 179329 - protein, 11 aa, Yellow fever virus
WFHDNDNPYRT

SEQ ID NO: 179330 - protein, 11 aa, Yellow fever virus
FHDNDNPYRTW

SEQ ID NO: 179331 - protein, 11 aa, Yellow fever virus
HDNDNPYRTWH

SEQ ID NO: 179332 - protein, 11 aa, Yellow fever virus
YRTWHYCGSYI

SEQ ID NO: 179333 - protein, 11 aa, Yellow fever virus
RTWHYCGSYIT

SEQ ID NO: 179334 - protein, 11 aa, Yellow fever virus
TWHYCGSYITK

SEQ ID NO: 179335 - protein, 11 aa, Yellow fever virus
WHYCGSYITKT

SEQ ID NO: 179336 - protein, 11 aa, Yellow fever virus
HYCGSYITKTS

SEQ ID NO: 179337 - protein, 11 aa, Yellow fever virus
YCGSYITKTSG

SEQ ID NO: 179338 - protein, 11 aa, Yellow fever virus
CGSYITKTSGS

SEQ ID NO: 179339 - protein, 11 aa, Yellow fever virus
GSYITKTSGSA

SEQ ID NO: 179340 - protein, 11 aa, Yellow fever virus
SYITKTSGSAA

SEQ ID NO: 179341 - protein, 11 aa, Yellow fever virus
YITKTSGSAAS

SEQ ID NO: 179342 - protein, 11 aa, Yellow fever virus
ITKTSGSAASM

SEQ ID NO: 179343 - protein, 11 aa, Yellow fever virus
TKTSGSAASMI

SEQ ID NO: 179344 - protein, 11 aa, Yellow fever virus
KTSGSAASMIN

SEQ ID NO: 179345 - protein, 11 aa, Yellow fever virus
TSGSAASMING

SEQ ID NO: 179346 - protein, 11 aa, Yellow fever virus
SGSAASMINGV

SEQ ID NO: 179347 - protein, 11 aa, Yellow fever virus
GSAASMINGVI

SEQ ID NO: 179348 - protein, 11 aa, Yellow fever virus
SAASMINGVIK

SEQ ID NO: 179349 - protein, 11 aa, Yellow fever virus
AASMINGVIKI

SEQ ID NO: 179350 - protein, 11 aa, Yellow fever virus
ASMINGVIKIL

SEQ ID NO: 179351 - protein, 11 aa, Yellow fever virus
SMINGVIKILT

SEQ ID NO: 179352 - protein, 11 aa, Yellow fever virus
MINGVIKILTF

SEQ ID NO: 179353 - protein, 11 aa, Yellow fever virus
INGVIKILTFP

SEQ ID NO: 179354 - protein, 11 aa, Yellow fever virus
NGVIKILTFPW

SEQ ID NO: 179355 - protein, 11 aa, Yellow fever virus
GVIKILTFPWD

SEQ ID NO: 179356 - protein, 11 aa, Yellow fever virus
VIKILTFPWDR

SEQ ID NO: 179357 - protein, 11 aa, Yellow fever virus
IKILTFPWDRI

SEQ ID NO: 179358 - protein, 11 aa, Yellow fever virus
KILTFPWDRIE

SEQ ID NO: 179359 - protein, 11 aa, Yellow fever virus
ILTFPWDRIEE

SEQ ID NO: 179360 - protein, 11 aa, Yellow fever virus
LTFPWDRIEEV

SEQ ID NO: 179361 - protein, 11 aa, Yellow fever virus
TFPWDRIEEVT

SEQ ID NO: 179362 - protein, 11 aa, Yellow fever virus
FPWDRIEEVTR

SEQ ID NO: 179363 - protein, 11 aa, Yellow fever virus
PWDKIEEVTRM

SEQ ID NO: 179364 - protein, 11 aa, Yellow fever virus
WDKIEEVTRMA

SEQ ID NO: 179365 - protein, 11 aa, Yellow fever virus
DKIEEVTRMAM

SEQ ID NO: 179366 - protein, 11 aa, Yellow fever virus
KIEEVTRMAMT

SEQ ID NO: 179367 - protein, 11 aa, Yellow fever virus
DPPAGTRKIMR

SEQ ID NO: 179368 - protein, 11 aa, Yellow fever virus
PPAGTRKIMRV

SEQ ID NO: 179369 - protein, 11 aa, Yellow fever virus
PAGTRKIMRVV

SEQ ID NO: 179370 - protein, 11 aa, Yellow fever virus
AGTRKIMRVVN

SEQ ID NO: 179371 - protein, 11 aa, Yellow fever virus
GTRKIMRVVNR

SEQ ID NO: 179372 - protein, 11 aa, Yellow fever virus
TRKIMRVVNRW

SEQ ID NO: 179373 - protein, 11 aa, Yellow fever virus
RKIMRVVNRWL

SEQ ID NO: 179374 - protein, 11 aa, Yellow fever virus
KIMRVVNRWLF

SEQ ID NO: 179375 - protein, 11 aa, Yellow fever virus
IMRVVNRWLFR

SEQ ID NO: 179376 - protein, 11 aa, Yellow fever virus
MRVVNRWLFRH

SEQ ID NO: 179377 - protein, 11 aa, Yellow fever virus
RVVNRWLFRHL

SEQ ID NO: 179378 - protein, 11 aa, Yellow fever virus
VVNRWLFRHLS

SEQ ID NO: 179379 - protein, 11 aa, Yellow fever virus
VNRWLFRHLSR

SEQ ID NO: 179380 - protein, 11 aa, Yellow fever virus
NRWLFRHLSRE

SEQ ID NO: 179381 - protein, 11 aa, Yellow fever virus
RWLFRHLSREK

SEQ ID NO: 179382 - protein, 11 aa, Yellow fever virus
WLFRHLAREKS

SEQ ID NO: 179383 - protein, 11 aa, Yellow fever virus
LFRHLAREKSP

SEQ ID NO: 179384 - protein, 11 aa, Yellow fever virus
FRHLAREKSPR

SEQ ID NO: 179385 - protein, 11 aa, Yellow fever virus
RHLAREKSPRL

SEQ ID NO: 179386 - protein, 11 aa, Yellow fever virus
HLAREKSPRLC

SEQ ID NO: 179387 - protein, 11 aa, Yellow fever virus
LAREKSPRLCT

SEQ ID NO: 179388 - protein, 11 aa, Yellow fever virus
AREKSPRLCTK

SEQ ID NO: 179389 - protein, 11 aa, Yellow fever virus
REKSPRLCTKE

SEQ ID NO: 179390 - protein, 11 aa, Yellow fever virus
EKSPRLCTKEE

SEQ ID NO: 179391 - protein, 11 aa, Yellow fever virus
KSPRLCTKEEF

SEQ ID NO: 179392 - protein, 11 aa, Yellow fever virus
SPRLCTKEEFI

SEQ ID NO: 179393 - protein, 11 aa, Yellow fever virus
FIAKVRSHAAV

SEQ ID NO: 179394 - protein, 11 aa, Yellow fever virus
IAKVRSHAAVG

SEQ ID NO: 179395 - protein, 11 aa, Yellow fever virus
AKVRSHAAVGA

SEQ ID NO: 179396 - protein, 11 aa, Yellow fever virus
KVRSHAAVGAF

SEQ ID NO: 179397 - protein, 11 aa, Yellow fever virus
VRSHAAVGAFL

SEQ ID NO: 179398 - protein, 11 aa, Yellow fever virus
RSHAAVGAFLE

SEQ ID NO: 179399 - protein, 11 aa, Yellow fever virus
SHAAVGAFLEE

SEQ ID NO: 179400 - protein, 11 aa, Yellow fever virus
HAAVGAFLEEQ

SEQ ID NO: 179401 - protein, 11 aa, Yellow fever virus
AAVGAFLEEQE

SEQ ID NO: 179402 - protein, 11 aa, Yellow fever virus
AVGAFLEEQEQ

SEQ ID NO: 179403 - protein, 11 aa, Yellow fever virus
VGAFLEEQEQW

SEQ ID NO: 179404 - protein, 11 aa, Yellow fever virus
GAFLEEQEQWK

SEQ ID NO: 179405 - protein, 11 aa, Yellow fever virus
AFLEEQEQWKT

SEQ ID NO: 179406 - protein, 11 aa, Yellow fever virus
FLEEQEQWKTA

SEQ ID NO: 179407 - protein, 11 aa, Yellow fever virus
LEEQDQWKTAN

SEQ ID NO: 179408 - protein, 11 aa, Yellow fever virus
EEQDQWKTANE

SEQ ID NO: 179409 - protein, 11 aa, Yellow fever virus
EQDQWKTANEA

SEQ ID NO: 179410 - protein, 11 aa, Yellow fever virus
QDQWKTANEAV

SEQ ID NO: 179411 - protein, 11 aa, Yellow fever virus
DQWKTANEAVQ

SEQ ID NO: 179412 - protein, 11 aa, Yellow fever virus
EAVQDPKFWEM

SEQ ID NO: 179413 - protein, 11 aa, Yellow fever virus
AVQDPKFWEMV

SEQ ID NO: 179414 - protein, 11 aa, Yellow fever virus
VQDPKFWEMVD

SEQ ID NO: 179415 - protein, 11 aa, Yellow fever virus
QDPKFWEMVDA

SEQ ID NO: 179416 - protein, 11 aa, Yellow fever virus
DPKFWEMVDAE

SEQ ID NO: 179417 - protein, 11 aa, Yellow fever virus
PKFWEMVDAER

SEQ ID NO: 179418 - protein, 11 aa, Yellow fever virus
KFWEMVDAERK

SEQ ID NO: 179419 - protein, 11 aa, Yellow fever virus
FWEMVDAERKL

SEQ ID NO: 179420 - protein, 11 aa, Yellow fever virus
WEMVDAERKLH

SEQ ID NO: 179421 - protein, 11 aa, Yellow fever virus
EMVDAERKLHQ

SEQ ID NO: 179422 - protein, 11 aa, Yellow fever virus
MVDAERKLHQQ

SEQ ID NO: 179423 - protein, 11 aa, Yellow fever virus
VDAERKLHQQG

SEQ ID NO: 179424 - protein, 11 aa, Yellow fever virus
DAERKLHQQGR

SEQ ID NO: 179425 - protein, 11 aa, Yellow fever virus
AERKLHQQGRC

SEQ ID NO: 179426 - protein, 11 aa, Yellow fever virus
ERKLHQQGRCQ

SEQ ID NO: 179427 - protein, 11 aa, Yellow fever virus
RKLHQQGRCQS

SEQ ID NO: 179428 - protein, 11 aa, Yellow fever virus
KLHQQGRCQSC

SEQ ID NO: 179429 - protein, 11 aa, Yellow fever virus
LHQQGRCQSCV

SEQ ID NO: 179430 - protein, 11 aa, Yellow fever virus
HQQGRCQSCVY

SEQ ID NO: 179431 - protein, 11 aa, Yellow fever virus
QQGRCQSCVYN

SEQ ID NO: 179432 - protein, 11 aa, Yellow fever virus
QGRCQSCVYNM

SEQ ID NO: 179433 - protein, 11 aa, Yellow fever virus
GRCQSCVYNMM

SEQ ID NO: 179434 - protein, 11 aa, Yellow fever virus
RCQSCVYNMMG

SEQ ID NO: 179435 - protein, 11 aa, Yellow fever virus
CQSCVYNMMGK

SEQ ID NO: 179436 - protein, 11 aa, Yellow fever virus
QSCVYNMMGKR

SEQ ID NO: 179437 - protein, 11 aa, Yellow fever virus
SCVYNMMGKRE

SEQ ID NO: 179438 - protein, 11 aa, Yellow fever virus
AIWYMWLGARF

SEQ ID NO: 179439 - protein, 11 aa, Yellow fever virus
IWYMWLGARFL

SEQ ID NO: 179440 - protein, 11 aa, Yellow fever virus
WYMWLGARFLE

SEQ ID NO: 179441 - protein, 11 aa, Yellow fever virus
YMWLGARFLEF

SEQ ID NO: 179442 - protein, 11 aa, Yellow fever virus
MWLGARFLEFE

SEQ ID NO: 179443 - protein, 11 aa, Yellow fever virus
WLGARFLEFEA

SEQ ID NO: 179444 - protein, 11 aa, Yellow fever virus
LGARFLEFEAL

SEQ ID NO: 179445 - protein, 11 aa, Yellow fever virus
GARFLEFEALG

SEQ ID NO: 179446 - protein, 11 aa, Yellow fever virus
ARFLEFEALGF

SEQ ID NO: 179447 - protein, 11 aa, Yellow fever virus
RFLEFEALGFL

SEQ ID NO: 179448 - protein, 11 aa, Yellow fever virus
FLEFEALGFLN

SEQ ID NO: 179449 - protein, 11 aa, Yellow fever virus
RENSGGGVEGT

SEQ ID NO: 179450 - protein, 11 aa, Yellow fever virus
ENSGGGVEGTG

SEQ ID NO: 179451 - protein, 11 aa, Yellow fever virus
NSGGGVEGTGL

SEQ ID NO: 179452 - protein, 11 aa, Yellow fever virus
SGGGVEGTGLQ

SEQ ID NO: 179453 - protein, 11 aa, Yellow fever virus
GGGVEGTGLQY

SEQ ID NO: 179454 - protein, 11 aa, Yellow fever virus
GGVEGTGLQYL

SEQ ID NO: 179455 - protein, 11 aa, Yellow fever virus
GVEGTGLQYLG

SEQ ID NO: 179456 - protein, 11 aa, Yellow fever virus
VEGTGLQYLGY

SEQ ID NO: 179457 - protein, 11 aa, Yellow fever virus
EGTGLQYLGYV

SEQ ID NO: 179458 - protein, 11 aa, Yellow fever virus
GTGLQYLGYVI

SEQ ID NO: 179459 - protein, 11 aa, Yellow fever virus
IGLQYLGYVIK

SEQ ID NO: 179460 - protein, 11 aa, Yellow fever virus
GLQYLGYVIKD

SEQ ID NO: 179461 - protein, 11 aa, Yellow fever virus
LQYLGYVIKDL

SEQ ID NO: 179462 - protein, 11 aa, Yellow fever virus
QYLGYVIKDLS

SEQ ID NO: 179463 - protein, 11 aa, Yellow fever virus
YLGYVIKDLST

SEQ ID NO: 179464 - protein, 11 aa, Yellow fever virus
LGYVIKDLSTK

SEQ ID NO: 179465 - protein, 11 aa, Yellow fever virus
GYVIKDLSTKE

SEQ ID NO: 179466 - protein, 11 aa, Yellow fever virus
YVIKDLSTKEG

SEQ ID NO: 179467 - protein, 11 aa, Yellow fever virus
VIKDLSTKEGG

SEQ ID NO: 179468 - protein, 11 aa, Yellow fever virus
IKDLSTKEGGG

SEQ ID NO: 179469 - protein, 11 aa, Yellow fever virus
KDLSTKEGGGF

SEQ ID NO: 179470 - protein, 11 aa, Yellow fever virus
DLSTKEGGGFY

SEQ ID NO: 179471 - protein, 11 aa, Yellow fever virus
LSTKEGGGFYA

SEQ ID NO: 179472 - protein, 11 aa, Yellow fever virus
STKEGGGFYAD

SEQ ID NO: 179473 - protein, 11 aa, Yellow fever virus
TKEGGGFYADD

SEQ ID NO: 179474 - protein, 11 aa, Yellow fever virus
KEGGGFYADDT

SEQ ID NO: 179475 - protein, 11 aa, Yellow fever virus
EGGGFYADDTA

SEQ ID NO: 179476 - protein, 11 aa, Yellow fever virus
GGGLYADDTAG

SEQ ID NO: 179477 - protein, 11 aa, Yellow fever virus
GGLYADDTAGW

SEQ ID NO: 179478 - protein, 11 aa, Yellow fever virus
GLYADDTAGWD

SEQ ID NO: 179479 - protein, 11 aa, Yellow fever virus
LYADDTAGWDT

SEQ ID NO: 179480 - protein, 11 aa, Yellow fever virus
EADLDDEQEIM

SEQ ID NO: 179481 - protein, 11 aa, Yellow fever virus
ADLDDEQEIMS

SEQ ID NO: 179482 - protein, 11 aa, Yellow fever virus
DLDDEQEIMSY

SEQ ID NO: 179483 - protein, 11 aa, Yellow fever virus
LDDEQEIMSYM

SEQ ID NO: 179484 - protein, 11 aa, Yellow fever virus
DDEQEIMSYMN

SEQ ID NO: 179485 - protein, 11 aa, Yellow fever virus
DEQEIMSYMNA

SEQ ID NO: 179486 - protein, 11 aa, Yellow fever virus
EQEIMSYMNAE

SEQ ID NO: 179487 - protein, 11 aa, Yellow fever virus
QEIMSYMNAEQ

SEQ ID NO: 179488 - protein, 11 aa, Yellow fever virus
EIMSYMNAEQR

SEQ ID NO: 179489 - protein, 11 aa, Yellow fever virus
IMSYMNAEQRK

SEQ ID NO: 179490 - protein, 11 aa, Yellow fever virus
MSYMNAEQRKL

SEQ ID NO: 179491 - protein, 11 aa, Yellow fever virus
SYMNAEQRKLA

SEQ ID NO: 179492 - protein, 11 aa, Yellow fever virus
YMNAEQRKLAW

SEQ ID NO: 179493 - protein, 11 aa, Yellow fever virus
MNAEQRKLAWA

SEQ ID NO: 179494 - protein, 11 aa, Yellow fever virus
NAEQRKLAWAV

SEQ ID NO: 179495 - protein, 11 aa, Yellow fever virus
AEQRKLAWAVM

SEQ ID NO: 179496 - protein, 11 aa, Yellow fever virus
EQRKLAWAVME

SEQ ID NO: 179497 - protein, 11 aa, Yellow fever virus
QRKLAWAVMEM

SEQ ID NO: 179498 - protein, 11 aa, Yellow fever virus
RKLAWAVMEMT

SEQ ID NO: 179499 - protein, 11 aa, Yellow fever virus
KLAWAVMEMTY

SEQ ID NO: 179500 - protein, 11 aa, Yellow fever virus
LAWAVMEMTYK

SEQ ID NO: 179501 - protein, 11 aa, Yellow fever virus
AWAVMEMTYKN

SEQ ID NO: 179502 - protein, 11 aa, Yellow fever virus
WAVMEMTYKNK

SEQ ID NO: 179503 - protein, 11 aa, Yellow fever virus
AIMEMTYKNKV

SEQ ID NO: 179504 - protein, 11 aa, Yellow fever virus
IMEMTYKNKVV

SEQ ID NO: 179505 - protein, 11 aa, Yellow fever virus
KNKVVKVLRPT

SEQ ID NO: 179506 - protein, 11 aa, Yellow fever virus
NKVVKVLRPTP

SEQ ID NO: 179507 - protein, 11 aa, Yellow fever virus
KVVKVLRPTPG

SEQ ID NO: 179508 - protein, 11 aa, Yellow fever virus
VVKVLRPTPGG

SEQ ID NO: 179509 - protein, 11 aa, Yellow fever virus
VKVLRPTPGGK

SEQ ID NO: 179510 - protein, 11 aa, Yellow fever virus
KVLRPTPGGKA

SEQ ID NO: 179511 - protein, 11 aa, Yellow fever virus
VLRPAPGGKAF

SEQ ID NO: 179512 - protein, 11 aa, Yellow fever virus
LRPAPGGKAFM

SEQ ID NO: 179513 - protein, 11 aa, Yellow fever virus
RPAPGGKAFMD

SEQ ID NO: 179514 - protein, 11 aa, Yellow fever virus
PAPGGKAFMDI

SEQ ID NO: 179515 - protein, 11 aa, Yellow fever virus
APGGKAFMDII

SEQ ID NO: 179516 - protein, 11 aa, Yellow fever virus
PGGKAFMDIIS

SEQ ID NO: 179517 - protein, 11 aa, Yellow fever virus
GGKAFMDIISR

SEQ ID NO: 179518 - protein, 11 aa, Yellow fever virus
GKAFMDIISRR

SEQ ID NO: 179519 - protein, 11 aa, Yellow fever virus
KAFMDIISRRD

SEQ ID NO: 179520 - protein, 11 aa, Yellow fever virus
AFMDIISRRDQ

SEQ ID NO: 179521 - protein, 11 aa, Yellow fever virus
FMDIISRRDQR

SEQ ID NO: 179522 - protein, 11 aa, Yellow fever virus
MDIISRRDQRG

SEQ ID NO: 179523 - protein, 11 aa, Yellow fever virus
DIISRRDQRGS

SEQ ID NO: 179524 - protein, 11 aa, Yellow fever virus
IISRRDQRGSG

SEQ ID NO: 179525 - protein, 11 aa, Yellow fever virus
ISRRDQRGSRQ

SEQ ID NO: 179526 - protein, 11 aa, Yellow fever virus
SRRDQRGSRQV

SEQ ID NO: 179527 - protein, 11 aa, Yellow fever virus
RRDQRGSRQVV

SEQ ID NO: 179528 - protein, 11 aa, Yellow fever virus
RDQRGSRQVVT

SEQ ID NO: 179529 - protein, 11 aa, Yellow fever virus
DQRGSRQVVTY

SEQ ID NO: 179530 - protein, 11 aa, Yellow fever virus
QRGSRQVVTYA

SEQ ID NO: 179531 - protein, 11 aa, Yellow fever virus
RGSRQVVTYAL

SEQ ID NO: 179532 - protein, 11 aa, Yellow fever virus
GSRQVVTYALN

SEQ ID NO: 179533 - protein, 11 aa, Yellow fever virus
SRQVVTYALNT

SEQ ID NO: 179534 - protein, 11 aa, Yellow fever virus
RQVVTYALNTI

SEQ ID NO: 179535 - protein, 11 aa, Yellow fever virus
VQLIRMAEAEN

SEQ ID NO: 179536 - protein, 11 aa, Yellow fever virus
QLIRMAEAENV

SEQ ID NO: 179537 - protein, 11 aa, Yellow fever virus
LIRMAEAENVI

SEQ ID NO: 179538 - protein, 11 aa, Yellow fever virus
IRMAEAEMVIN

SEQ ID NO: 179539 - protein, 11 aa, Yellow fever virus
RMAEAEMVINH

SEQ ID NO: 179540 - protein, 11 aa, Yellow fever virus
MAEAEMVINHQ

SEQ ID NO: 179541 - protein, 11 aa, Yellow fever virus
AEAEMVINHQH

SEQ ID NO: 179542 - protein, 11 aa, Yellow fever virus
EAEMVINHQHV

SEQ ID NO: 179543 - protein, 11 aa, Yellow fever virus
AEMVINHQHVN

SEQ ID NO: 179544 - protein, 11 aa, Yellow fever virus
EMVINHQHVNE

SEQ ID NO: 179545 - protein, 11 aa, Yellow fever virus
MVINHQHVNEC

SEQ ID NO: 179546 - protein, 11 aa, Yellow fever virus
VINHQHVNECD

SEQ ID NO: 179547 - protein, 11 aa, Yellow fever virus
INHQHVNECDE

SEQ ID NO: 179548 - protein, 11 aa, Yellow fever virus
NHQHVNECDES

SEQ ID NO: 179549 - protein, 11 aa, Yellow fever virus
LARLEAWLTEH

SEQ ID NO: 179550 - protein, 11 aa, Yellow fever virus
ARLEAWLTEHG

SEQ ID NO: 179551 - protein, 11 aa, Yellow fever virus
RLDAWLAENGC

SEQ ID NO: 179552 - protein, 11 aa, Yellow fever virus
LEAWLTEHGCD

SEQ ID NO: 179553 - protein, 11 aa, Yellow fever virus
EAWLTEHGCDR

SEQ ID NO: 179554 - protein, 11 aa, Yellow fever virus
AWLTEHGCDRL

SEQ ID NO: 179555 - protein, 11 aa, Yellow fever virus
RLRRMAVSGDD

SEQ ID NO: 179556 - protein, 11 aa, Yellow fever virus
LRRMAVSGDDC

SEQ ID NO: 179557 - protein, 11 aa, Yellow fever virus
RRMAVSGDDCV

SEQ ID NO: 179558 - protein, 11 aa, Yellow fever virus
RMAVNGDDCVV

SEQ ID NO: 179559 - protein, 11 aa, Yellow fever virus
MAVSGDDCVVK

SEQ ID NO: 179560 - protein, 11 aa, Yellow fever virus
AVNGDDCVVRP

SEQ ID NO: 179561 - protein, 11 aa, Yellow fever virus
VSGDDCVVRPV

SEQ ID NO: 179562 - protein, 11 aa, Yellow fever virus
SGDDCVVRPVD

SEQ ID NO: 179563 - protein, 11 aa, Yellow fever virus
GDDCVVRPVDD

SEQ ID NO: 179564 - protein, 11 aa, Yellow fever virus
DDCVVRPVDDR

SEQ ID NO: 179565 - protein, 11 aa, Yellow fever virus
DCVVRPVDDRF

SEQ ID NO: 179566 - protein, 11 aa, Yellow fever virus
CVVRPVDDRFG

SEQ ID NO: 179567 - protein, 11 aa, Yellow fever virus
VVRPVDDRFGL

SEQ ID NO: 179568 - protein, 11 aa, Yellow fever virus
VRPVDDRFGLA

SEQ ID NO: 179569 - protein, 11 aa, Yellow fever virus
RPVDDRFGLAL

SEQ ID NO: 179570 - protein, 11 aa, Yellow fever virus
PVDDRFGLALS

SEQ ID NO: 179571 - protein, 11 aa, Yellow fever virus
VDDRFGLALSH

SEQ ID NO: 179572 - protein, 11 aa, Yellow fever virus
DDRFGMALSHL

SEQ ID NO: 179573 - protein, 11 aa, Yellow fever virus
DRFGMALSHLN

SEQ ID NO: 179574 - protein, 11 aa, Yellow fever virus
RFGMALSHLNA

SEQ ID NO: 179575 - protein, 11 aa, Yellow fever virus
FGMALSHLNAM

SEQ ID NO: 179576 - protein, 11 aa, Yellow fever virus
GMALSHLNAMS

SEQ ID NO: 179577 - protein, 11 aa, Yellow fever virus
MALSHLNAMSK

SEQ ID NO: 179578 - protein, 11 aa, Yellow fever virus
KDISEWQPSKE

SEQ ID NO: 179579 - protein, 11 aa, Yellow fever virus
DISEWQPSKEW

SEQ ID NO: 179580 - protein, 11 aa, Yellow fever virus
ISEWQPSKGWT

SEQ ID NO: 179581 - protein, 11 aa, Yellow fever virus
SEWQPSKGWTD

SEQ ID NO: 179582 - protein, 11 aa, Yellow fever virus
EWQPSKGWTDW

SEQ ID NO: 179583 - protein, 11 aa, Yellow fever virus
WQPSKGWTDWE

SEQ ID NO: 179584 - protein, 11 aa, Yellow fever virus
QPSKEWTDWEN

SEQ ID NO: 179585 - protein, 11 aa, Yellow fever virus
PSKGWTDWENV

SEQ ID NO: 179586 - protein, 11 aa, Yellow fever virus
SKGWTDWESVP

SEQ ID NO: 179587 - protein, 11 aa, Yellow fever virus
KGWTDWENVPF

SEQ ID NO: 179588 - protein, 11 aa, Yellow fever virus
GWTDWESVPFC

SEQ ID NO: 179589 - protein, 11 aa, Yellow fever virus
WTDWENVPFCS

SEQ ID NO: 179590 - protein, 11 aa, Yellow fever virus
TDWENVPFCSH

SEQ ID NO: 179591 - protein, 11 aa, Yellow fever virus
DWENVPFCSHR

SEQ ID NO: 179592 - protein, 11 aa, Yellow fever virus
WENVPFCSHRF

SEQ ID NO: 179593 - protein, 11 aa, Yellow fever virus
ENVPFCSHRFH

SEQ ID NO: 179594 - protein, 11 aa, Yellow fever virus
SVPFCSHHFHE

SEQ ID NO: 179595 - protein, 11 aa, Yellow fever virus
VPFCSHRFHEL

SEQ ID NO: 179596 - protein, 11 aa, Yellow fever virus
PFCSHHFHELV

SEQ ID NO: 179597 - protein, 11 aa, Yellow fever virus
FCSHHFHELVL

SEQ ID NO: 179598 - protein, 11 aa, Yellow fever virus
CSHHFHELVLK

SEQ ID NO: 179599 - protein, 11 aa, Yellow fever virus
SHHFHELVLKD

SEQ ID NO: 179600 - protein, 11 aa, Yellow fever virus
HHFHELVLKDG

SEQ ID NO: 179601 - protein, 11 aa, Yellow fever virus
HFHELVLKDGR

SEQ ID NO: 179602 - protein, 11 aa, Yellow fever virus
FHELVLKDGRK

SEQ ID NO: 179603 - protein, 11 aa, Yellow fever virus
HELHLKDGRRI

SEQ ID NO: 179604 - protein, 11 aa, Yellow fever virus
ELHLKDGRRIV

SEQ ID NO: 179605 - protein, 11 aa, Yellow fever virus
LHLKDGRRIVV

SEQ ID NO: 179606 - protein, 11 aa, Yellow fever virus
HLKDGRRIVVP

SEQ ID NO: 179607 - protein, 11 aa, Yellow fever virus
LKDGRKVVVPC

SEQ ID NO: 179608 - protein, 11 aa, Yellow fever virus
KDGRKVVVPCR

SEQ ID NO: 179609 - protein, 11 aa, Yellow fever virus
DGRKVVVPCRD

SEQ ID NO: 179610 - protein, 11 aa, Yellow fever virus
GRKVVVPCRDQ

SEQ ID NO: 179611 - protein, 11 aa, Yellow fever virus
RKVVVPCRDQD

SEQ ID NO: 179612 - protein, 11 aa, Yellow fever virus
KVVVPCRDQDE

SEQ ID NO: 179613 - protein, 11 aa, Yellow fever virus
VVVPCRDQDEL

SEQ ID NO: 179614 - protein, 11 aa, Yellow fever virus
VVPCRDQDELI

SEQ ID NO: 179615 - protein, 11 aa, Yellow fever virus
VPCRDQDELIG

SEQ ID NO: 179616 - protein, 11 aa, Yellow fever virus
PCRDQDELIGR

SEQ ID NO: 179617 - protein, 11 aa, Yellow fever virus
CRDQDELIGRG

SEQ ID NO: 179618 - protein, 11 aa, Yellow fever virus
RDQDELIGRGR

SEQ ID NO: 179619 - protein, 11 aa, Yellow fever virus
DQDELIGRGRV

SEQ ID NO: 179620 - protein, 11 aa, Yellow fever virus
FHKRDMRLLSF

SEQ ID NO: 179621 - protein, 11 aa, Yellow fever virus
HKRDMRLLSFA

SEQ ID NO: 179622 - protein, 11 aa, Yellow fever virus
KRDMRLLSFAV

SEQ ID NO: 179623 - protein, 11 aa, Yellow fever virus
RDMRLLSFAVS

SEQ ID NO: 179624 - protein, 11 aa, Yellow fever virus
DMRLLSFAVSS

SEQ ID NO: 179625 - protein, 11 aa, Yellow fever virus
MRLLSFAVSSA

SEQ ID NO: 179626 - protein, 11 aa, Yellow fever virus
RLLSFAVSSAV

SEQ ID NO: 179627 - protein, 11 aa, Yellow fever virus
LLSFAVSSAVP

SEQ ID NO: 179628 - protein, 11 aa, Yellow fever virus
LSFAVSSAVPT

SEQ ID NO: 179629 - protein, 11 aa, Yellow fever virus
SFAVSSAVPTA

SEQ ID NO: 179630 - protein, 11 aa, Yellow fever virus
FAVSSAVPTAW

SEQ ID NO: 179631 - protein, 11 aa, Yellow fever virus
AVSSAVPTAWV

SEQ ID NO: 179632 - protein, 11 aa, Yellow fever virus
VSSAVPTAWVP

SEQ ID NO: 179633 - protein, 11 aa, Yellow fever virus
SSAVPTAWVPS

SEQ ID NO: 179634 - protein, 11 aa, Yellow fever virus
SAVPTAWVPSG

SEQ ID NO: 179635 - protein, 11 aa, Yellow fever virus
AVPTAWVPSGR

SEQ ID NO: 179636 - protein, 11 aa, Yellow fever virus
VPTAWVPSGRT

SEQ ID NO: 179637 - protein, 11 aa, Yellow fever virus
PTAWVPSGRTT

SEQ ID NO: 179638 - protein, 11 aa, Yellow fever virus
TAWVPSGRTTW

SEQ ID NO: 179639 - protein, 11 aa, Yellow fever virus
AWVPSGRTTWS

SEQ ID NO: 179640 - protein, 11 aa, Yellow fever virus
WVPSGRTTWSV

SEQ ID NO: 179641 - protein, 11 aa, Yellow fever virus
VPSGRTTWSVH

SEQ ID NO: 179642 - protein, 11 aa, Yellow fever virus
PSGRTTWSVHG

SEQ ID NO: 179643 - protein, 11 aa, Yellow fever virus
SGRTTWSVHGK

SEQ ID NO: 179644 - protein, 11 aa, Yellow fever virus
GRTTWSVHGKG

SEQ ID NO: 179645 - protein, 11 aa, Yellow fever virus
RTTWSVHGKGE

SEQ ID NO: 179646 - protein, 11 aa, Yellow fever virus
TTWSVHGKGEW

SEQ ID NO: 179647 - protein, 11 aa, Yellow fever virus
TWSVHGKGEWM

SEQ ID NO: 179648 - protein, 11 aa, Yellow fever virus
WSVHGKGEWMT

SEQ ID NO: 179649 - protein, 11 aa, Yellow fever virus
SVHGKGEWMTT

SEQ ID NO: 179650 - protein, 11 aa, Yellow fever virus
VHGKGEWMTTQ

SEQ ID NO: 179651 - protein, 11 aa, Yellow fever virus
HGRGEWMTTED

SEQ ID NO: 179652 - protein, 11 aa, Yellow fever virus
GKGEWMTTQDM

SEQ ID NO: 179653 - protein, 11 aa, Yellow fever virus
KGEWMTTQDML

SEQ ID NO: 179654 - protein, 11 aa, Yellow fever virus
GEWMTTEDMLG

SEQ ID NO: 179655 - protein, 11 aa, Yellow fever virus
EWMTTEDMLDV

SEQ ID NO: 179656 - protein, 11 aa, Yellow fever virus
WMTTEDMLGVW

SEQ ID NO: 179657 - protein, 11 aa, Yellow fever virus
MTTEDMLGVWN

SEQ ID NO: 179658 - protein, 11 aa, Yellow fever virus
TTEDMLGVWNR

SEQ ID NO: 179659 - protein, 11 aa, Yellow fever virus
TEDMLDVWNRV

SEQ ID NO: 179660 - protein, 11 aa, Yellow fever virus
EDMLGVWNRVW

SEQ ID NO: 179661 - protein, 11 aa, Yellow fever virus
DMLDVWNRVWV

SEQ ID NO: 179662 - protein, 11 aa, Yellow fever virus
MLDVWNRVWVL

SEQ ID NO: 179663 - protein, 11 aa, Yellow fever virus
LDVWNRVWVLN

SEQ ID NO: 179664 - protein, 11 aa, Yellow fever virus
DVWNRVWVLNN

SEQ ID NO: 179665 - protein, 11 aa, Yellow fever virus
VWNRVWVLNNP

SEQ ID NO: 179666 - protein, 11 aa, Yellow fever virus
WNRVWVLNNPH

SEQ ID NO: 179667 - protein, 11 aa, Yellow fever virus
NRVWVLNNPHM

SEQ ID NO: 179668 - protein, 11 aa, Yellow fever virus
RVWVLNNPHMK

SEQ ID NO: 179669 - protein, 11 aa, Yellow fever virus
VWVLNNPHMKD

SEQ ID NO: 179670 - protein, 11 aa, Yellow fever virus
WVLNNPHMKDK

SEQ ID NO: 179671 - protein, 11 aa, Yellow fever virus
VLNNPHMKDKT

SEQ ID NO: 179672 - protein, 11 aa, Yellow fever virus
TNNPHMQDKTV

SEQ ID NO: 179673 - protein, 11 aa, Yellow fever virus
NNPHMQDKTVV

SEQ ID NO: 179674 - protein, 11 aa, Yellow fever virus
NPHMQDKTVVK

SEQ ID NO: 179675 - protein, 11 aa, Yellow fever virus
PHMQDKTMVKE

SEQ ID NO: 179676 - protein, 11 aa, Yellow fever virus
HMQDKTMVKEW

SEQ ID NO: 179677 - protein, 11 aa, Yellow fever virus
MQDKTMVKEWR

SEQ ID NO: 179678 - protein, 11 aa, Yellow fever virus
QDKTMVKEWRD

SEQ ID NO: 179679 - protein, 11 aa, Yellow fever virus
DKTMVKEWRDV

SEQ ID NO: 179680 - protein, 11 aa, Yellow fever virus
KTMVKEWRDVP

SEQ ID NO: 179681 - protein, 11 aa, Yellow fever virus
TMVKEWRDVPY

SEQ ID NO: 179682 - protein, 11 aa, Yellow fever virus
MVKEWRDVPYL

SEQ ID NO: 179683 - protein, 11 aa, Yellow fever virus
VKEWRDVPYLT

SEQ ID NO: 179684 - protein, 11 aa, Yellow fever virus
KEWRDVPYLTK

SEQ ID NO: 179685 - protein, 11 aa, Yellow fever virus
EWRDVPYLTKR

SEQ ID NO: 179686 - protein, 11 aa, Yellow fever virus
GMTNRATWASN

SEQ ID NO: 179687 - protein, 11 aa, Yellow fever virus
MTNRATWASNI

SEQ ID NO: 179688 - protein, 11 aa, Yellow fever virus
TNRATWASNIH

SEQ ID NO: 179689 - protein, 11 aa, Yellow fever virus
NRATWASNIHL

SEQ ID NO: 179690 - protein, 11 aa, Yellow fever virus
RATWASNIHLV

SEQ ID NO: 179691 - protein, 11 aa, Yellow fever virus
ATWASNIHLVI

SEQ ID NO: 179692 - protein, 11 aa, Yellow fever virus
TWASNIHLVIH

SEQ ID NO: 179693 - protein, 11 aa, Yellow fever virus
WASNIHLVIHR

SEQ ID NO: 179694 - protein, 11 aa, Yellow fever virus
ASNIHLVIHRI

SEQ ID NO: 179695 - protein, 11 aa, Yellow fever virus
SNIHLVIHRIR

SEQ ID NO: 179696 - protein, 11 aa, Yellow fever virus
HIHLVIHRIRN

SEQ ID NO: 179697 - protein, 11 aa, Yellow fever virus
IHLVIHRIRNL

SEQ ID NO: 179698 - protein, 11 aa, Yellow fever virus
HLVIHRIRTLV

SEQ ID NO: 179699 - protein, 11 aa, Yellow fever virus
LVIHRIRTLVG

SEQ ID NO: 179700 - protein, 11 aa, Yellow fever virus
VIHRIRTLVGQ

SEQ ID NO: 179701 - protein, 11 aa, Yellow fever virus
IHRIRTLVGQE

SEQ ID NO: 179702 - protein, 11 aa, Yellow fever virus
HRIRTLVGQEK

SEQ ID NO: 179703 - protein, 11 aa, Yellow fever virus
RIRTLVGQEKY

SEQ ID NO: 179704 - protein, 11 aa, Yellow fever virus
IRTLVGQEKYT

SEQ ID NO: 179705 - protein, 11 aa, Yellow fever virus
RTLVGQEKYTD

SEQ ID NO: 179706 - protein, 11 aa, Yellow fever virus
TLVGQEKYTDY

SEQ ID NO: 179707 - protein, 11 aa, Yellow fever virus
LVGQEKYTDYL

SEQ ID NO: 179708 - protein, 11 aa, Yellow fever virus
VGQEKYTDYLT

SEQ ID NO: 179709 - protein, 11 aa, Yellow fever virus
GQEKFTDYLTV

SEQ ID NO: 179710 - protein, 11 aa, Yellow fever virus
QEKFTDYLTVM

SEQ ID NO: 179711 - protein, 11 aa, Yellow fever virus
EKFTDYLTVMD

SEQ ID NO: 179712 - protein, 11 aa, Yellow fever virus
KFTDYLTVMDR

SEQ ID NO: 179713 - protein, 11 aa, Yellow fever virus
FTDYLTVMDRY

SEQ ID NO: 179714 - protein, 11 aa, Yellow fever virus
DRYSVDADLQP

SEQ ID NO: 179715 - protein, 11 aa, Yellow fever virus
RYSVDADLQPG

SEQ ID NO: 179716 - protein, 11 aa, Yellow fever virus
YSVDADLQPGE

SEQ ID NO: 179717 - protein, 11 aa, Yellow fever virus
SVDADLQPGEL

SEQ ID NO: 179718 - protein, 11 aa, Yellow fever virus
VDADLQPGELI

SEQ ID NO: 179719 - protein, 11 aa, Yellow fever virus
GPSRGVQGFIS

SEQ ID NO: 179720 - protein, 11 aa, Yellow fever virus
PSRGVQGFISF

SEQ ID NO: 179721 - protein, 11 aa, Yellow fever virus
FSFNILTGKKI

SEQ ID NO: 179722 - protein, 11 aa, Yellow fever virus
SFNILTGKKIT

SEQ ID NO: 179723 - protein, 11 aa, Yellow fever virus
FNILTGKKLTA

SEQ ID NO: 179724 - protein, 11 aa, Yellow fever virus
NILTGKKITAQ

SEQ ID NO: 179725 - protein, 11 aa, Yellow fever virus
ILTGKKLTAHL

SEQ ID NO: 179726 - protein, 11 aa, Yellow fever virus
LTGKKITAQLK

SEQ ID NO: 179727 - protein, 11 aa, Yellow fever virus
TGKKLTAHLKK

SEQ ID NO: 179728 - protein, 11 aa, Yellow fever virus
GKKLTAHLKKL

SEQ ID NO: 179729 - protein, 11 aa, Yellow fever virus
KKLTAHLKKLW

SEQ ID NO: 179730 - protein, 11 aa, Yellow fever virus
KLTAHLKKLWR

SEQ ID NO: 179731 - protein, 11 aa, Yellow fever virus
LTAHLKKLWRM

SEQ ID NO: 179732 - protein, 11 aa, Yellow fever virus
TAHLKKLWRML

SEQ ID NO: 179733 - protein, 11 aa, Yellow fever virus
AHLKKLWRMLD

SEQ ID NO: 179734 - protein, 11 aa, Yellow fever virus
QLKRLWKMLDP

SEQ ID NO: 179735 - protein, 11 aa, Yellow fever virus
LKKLWRMLDPR

SEQ ID NO: 179736 - protein, 11 aa, Yellow fever virus
KKLWRMLDPRQ

SEQ ID NO: 179737 - protein, 11 aa, Yellow fever virus
KLWRMLDPRQG

SEQ ID NO: 179738 - protein, 11 aa, Yellow fever virus
WRMLDPRQGLT

SEQ ID NO: 179739 - protein, 11 aa, Yellow fever virus
KMLDPRQGLAA

SEQ ID NO: 179740 - protein, 11 aa, Yellow fever virus
MLDPRQGLTVL

SEQ ID NO: 179741 - protein, 11 aa, Yellow fever virus
LDPRQGLTVLR

SEQ ID NO: 179742 - protein, 11 aa, Yellow fever virus
DPRQGLTVLRK

SEQ ID NO: 179743 - protein, 11 aa, Yellow fever virus
PRQGLTVLRKV

SEQ ID NO: 179744 - protein, 11 aa, Yellow fever virus
RQGLTVLRKVK

SEQ ID NO: 179745 - protein, 11 aa, Yellow fever virus
QGLTVLRKVKR

SEQ ID NO: 179746 - protein, 11 aa, Yellow fever virus
GLTVLRKVKRV

SEQ ID NO: 179747 - protein, 11 aa, Yellow fever virus
LTVLRKVKRVV

SEQ ID NO: 179748 - protein, 11 aa, Yellow fever virus
TVLRKVKRVVA

SEQ ID NO: 179749 - protein, 11 aa, Yellow fever virus
VLRKVKRVVAG

SEQ ID NO: 179750 - protein, 11 aa, Yellow fever virus
KVKRVVASLMI

SEQ ID NO: 179751 - protein, 11 aa, Yellow fever virus
VKRVVASLMIG

SEQ ID NO: 179752 - protein, 11 aa, Yellow fever virus
KRVVASLMIGL

SEQ ID NO: 179753 - protein, 11 aa, Yellow fever virus
RVVASLMIGLS

SEQ ID NO: 179754 - protein, 11 aa, Yellow fever virus
VVASLMIGLSS

SEQ ID NO: 179755 - protein, 11 aa, Yellow fever virus
VASLMIGLSSR

SEQ ID NO: 179756 - protein, 11 aa, Yellow fever virus
ASLMIGLSSRK

SEQ ID NO: 179757 - protein, 11 aa, Yellow fever virus
SLMIGLSSRKR

SEQ ID NO: 179758 - protein, 11 aa, Yellow fever virus
RGLSSRKRRSS

SEQ ID NO: 179759 - protein, 11 aa, Yellow fever virus
GLSSRKRRSSE

SEQ ID NO: 179760 - protein, 11 aa, Yellow fever virus
LSSRKRRSHDA

SEQ ID NO: 179761 - protein, 11 aa, Yellow fever virus
SSRKRRSHDAL

SEQ ID NO: 179762 - protein, 11 aa, Yellow fever virus
AVQFLILGMLL

SEQ ID NO: 179763 - protein, 11 aa, Yellow fever virus
VQLLILGMILM

SEQ ID NO: 179764 - protein, 11 aa, Yellow fever virus
TGGVTLMRKNR

SEQ ID NO: 179765 - protein, 11 aa, Yellow fever virus
TSEDLGKTFSI

SEQ ID NO: 179766 - protein, 11 aa, Yellow fever virus
SEDLGKTFSIG

SEQ ID NO: 179767 - protein, 11 aa, Yellow fever virus
EDLGKTFSVGA

SEQ ID NO: 179768 - protein, 11 aa, Yellow fever virus
DLGKTFSMGTG

SEQ ID NO: 179769 - protein, 11 aa, Yellow fever virus
LGKTFSIGTGN

SEQ ID NO: 179770 - protein, 11 aa, Yellow fever virus
GKTFSLGTGNC

SEQ ID NO: 179771 - protein, 11 aa, Yellow fever virus
KTFSLGTGNCT

SEQ ID NO: 179772 - protein, 11 aa, Yellow fever virus
TFSLGTGNCTT

SEQ ID NO: 179773 - protein, 11 aa, Yellow fever virus
FSMGTGNCTTN

SEQ ID NO: 179774 - protein, 11 aa, Yellow fever virus
SMGTGNCTTNI

SEQ ID NO: 179775 - protein, 11 aa, Yellow fever virus
LGTGNCTTNIL

SEQ ID NO: 179776 - protein, 11 aa, Yellow fever virus
GVENVRVTYGK

SEQ ID NO: 179777 - protein, 11 aa, Yellow fever virus
VENVRVTYGKC

SEQ ID NO: 179778 - protein, 11 aa, Yellow fever virus
ENVRVTYGKCD

SEQ ID NO: 179779 - protein, 11 aa, Yellow fever virus
NVRVTYGKCDS

SEQ ID NO: 179780 - protein, 11 aa, Yellow fever virus
VRVTYGKCDSA

SEQ ID NO: 179781 - protein, 11 aa, Yellow fever virus
RVTYGKCDSAG

SEQ ID NO: 179782 - protein, 11 aa, Yellow fever virus
VTYGKCDSAGR

SEQ ID NO: 179783 - protein, 11 aa, Yellow fever virus
TYGKCDSAGRS

SEQ ID NO: 179784 - protein, 11 aa, Yellow fever virus
RWLVRNPFFAI

SEQ ID NO: 179785 - protein, 11 aa, Yellow fever virus
WLVRNPFFAIT

SEQ ID NO: 179786 - protein, 11 aa, Yellow fever virus
LVRNPFFAITA

SEQ ID NO: 179787 - protein, 11 aa, Yellow fever virus
RNPFFAITALA

SEQ ID NO: 179788 - protein, 11 aa, Yellow fever virus
NPFFAITALAI

SEQ ID NO: 179789 - protein, 11 aa, Yellow fever virus
PFFAITALAIA

SEQ ID NO: 179790 - protein, 11 aa, Yellow fever virus
FFAITALAIAY

SEQ ID NO: 179791 - protein, 11 aa, Yellow fever virus
FAITALAIAYL

SEQ ID NO: 179792 - protein, 11 aa, Yellow fever virus
AITALAIAYLV

SEQ ID NO: 179793 - protein, 11 aa, Yellow fever virus
ITALAIAYLVG

SEQ ID NO: 179794 - protein, 11 aa, Yellow fever virus
TALAIAYLVGS

SEQ ID NO: 179795 - protein, 11 aa, Yellow fever virus
ALAIAYLVGSN

SEQ ID NO: 179796 - protein, 11 aa, Yellow fever virus
LAIAYLVGNNT

SEQ ID NO: 179797 - protein, 11 aa, Yellow fever virus
AIAYLVGNNTT

SEQ ID NO: 179798 - protein, 11 aa, Yellow fever virus
IAYLVGNNMTQ

SEQ ID NO: 179799 - protein, 11 aa, Yellow fever virus
AYLVGNNTTQR

SEQ ID NO: 179800 - protein, 11 aa, Yellow fever virus
YLVGNNKTQRV

SEQ ID NO: 179801 - protein, 11 aa, Yellow fever virus
LVGNNTTQRVV

SEQ ID NO: 179802 - protein, 11 aa, Yellow fever virus
VGNNKTQRVVI

SEQ ID NO: 179803 - protein, 11 aa, Yellow fever virus
GNNMTQRVVIA

SEQ ID NO: 179804 - protein, 11 aa, Yellow fever virus
NNKTQRVVIAL

SEQ ID NO: 179805 - protein, 11 aa, Yellow fever virus
NTTQRVVIALL

SEQ ID NO: 179806 - protein, 11 aa, Yellow fever virus
TTQRVVIALLV

SEQ ID NO: 179807 - protein, 11 aa, Yellow fever virus
GTWVSASLEQD

SEQ ID NO: 179808 - protein, 11 aa, Yellow fever virus
TWVSASLEQDK

SEQ ID NO: 179809 - protein, 11 aa, Yellow fever virus
WVSASLEQDKC

SEQ ID NO: 179810 - protein, 11 aa, Yellow fever virus
VSASLEQDKCV

SEQ ID NO: 179811 - protein, 11 aa, Yellow fever virus
SATLEQGKCVT

SEQ ID NO: 179812 - protein, 11 aa, Yellow fever virus
ASLEQDKCVTV

SEQ ID NO: 179813 - protein, 11 aa, Yellow fever virus
TLEQGKCVTVM

SEQ ID NO: 179814 - protein, 11 aa, Yellow fever virus
DISLQTVAIDG

SEQ ID NO: 179815 - protein, 11 aa, Yellow fever virus
ISLQTVAIDGP

SEQ ID NO: 179816 - protein, 11 aa, Yellow fever virus
SLQTVAIDGPA

SEQ ID NO: 179817 - protein, 11 aa, Yellow fever virus
LQTVAIDGPAE

SEQ ID NO: 179818 - protein, 11 aa, Yellow fever virus
ETVAIDRPAEA

SEQ ID NO: 179819 - protein, 11 aa, Yellow fever virus
TVAIDRPAEAR

SEQ ID NO: 179820 - protein, 11 aa, Yellow fever virus
VAIDRPAEARK

SEQ ID NO: 179821 - protein, 11 aa, Yellow fever virus
AIDRPAEARKV

SEQ ID NO: 179822 - protein, 11 aa, Yellow fever virus
IDRPAEARKVC

SEQ ID NO: 179823 - protein, 11 aa, Yellow fever virus
DRPAEARKVCY

SEQ ID NO: 179824 - protein, 11 aa, Yellow fever virus
RPAEARKVCYN

SEQ ID NO: 179825 - protein, 11 aa, Yellow fever virus
PAEARKVCYSA

SEQ ID NO: 179826 - protein, 11 aa, Yellow fever virus
AEARKVCYSAV

SEQ ID NO: 179827 - protein, 11 aa, Yellow fever virus
EARKVCYSAVL

SEQ ID NO: 179828 - protein, 11 aa, Yellow fever virus
ARKVCYSAVLT

SEQ ID NO: 179829 - protein, 11 aa, Yellow fever virus
YNAVLTHVKID

SEQ ID NO: 179830 - protein, 11 aa, Yellow fever virus
NAVLTHVKIDD

SEQ ID NO: 179831 - protein, 11 aa, Yellow fever virus
QTKIQYVIRAR

SEQ ID NO: 179832 - protein, 11 aa, Yellow fever virus
TKIQYVIRARL

SEQ ID NO: 179833 - protein, 11 aa, Yellow fever virus
KIQYVIRARLH

SEQ ID NO: 179834 - protein, 11 aa, Yellow fever virus
IQYVIRARLHV

SEQ ID NO: 179835 - protein, 11 aa, Yellow fever virus
QYVIRARLHVG

SEQ ID NO: 179836 - protein, 11 aa, Yellow fever virus
YVIRARLHVGA

SEQ ID NO: 179837 - protein, 11 aa, Yellow fever virus
VIKAQLHVGAK

SEQ ID NO: 179838 - protein, 11 aa, Yellow fever virus
IKAQLHVGAKQ

SEQ ID NO: 179839 - protein, 11 aa, Yellow fever virus
KAQLHVGAKQE

SEQ ID NO: 179840 - protein, 11 aa, Yellow fever virus
AQLHVGAKQED

SEQ ID NO: 179841 - protein, 11 aa, Yellow fever virus
QLHVGAKQEDW

SEQ ID NO: 179842 - protein, 11 aa, Yellow fever virus
LHVGAKQEDWK

SEQ ID NO: 179843 - protein, 11 aa, Yellow fever virus
HVGAKQENWKT

SEQ ID NO: 179844 - protein, 11 aa, Yellow fever virus
VGAKQENWNTS

SEQ ID NO: 179845 - protein, 11 aa, Yellow fever virus
GAKQENWNTSI

SEQ ID NO: 179846 - protein, 11 aa, Yellow fever virus
AKQENWNTSIK

SEQ ID NO: 179847 - protein, 11 aa, Yellow fever virus
KQENWNTSIKT

SEQ ID NO: 179848 - protein, 11 aa, Yellow fever virus
QENWNTSIKTL

SEQ ID NO: 179849 - protein, 11 aa, Yellow fever virus
ENWNTSIKTLK

SEQ ID NO: 179850 - protein, 11 aa, Yellow fever virus
NWNTSIKTLKF

SEQ ID NO: 179851 - protein, 11 aa, Yellow fever virus
WNTSIKTLKFD

SEQ ID NO: 179852 - protein, 11 aa, Yellow fever virus
NTSIKTLKFDA

SEQ ID NO: 179853 - protein, 11 aa, Yellow fever virus
TDIKTLKFDVL

SEQ ID NO: 179854 - protein, 11 aa, Yellow fever virus
DIKTLKFDVLS

SEQ ID NO: 179855 - protein, 11 aa, Yellow fever virus
KFDVLSGSQEA

SEQ ID NO: 179856 - protein, 11 aa, Yellow fever virus
FDVLSGSQEAE

SEQ ID NO: 179857 - protein, 11 aa, Yellow fever virus
DVLSGSQEAEF

SEQ ID NO: 179858 - protein, 11 aa, Yellow fever virus
ALSGSQEVEFT

SEQ ID NO: 179859 - protein, 11 aa, Yellow fever virus
LSGSQEVEFTG

SEQ ID NO: 179860 - protein, 11 aa, Yellow fever virus
SGSQEVEFTGY

SEQ ID NO: 179861 - protein, 11 aa, Yellow fever virus
GSQEVEFTGYG

SEQ ID NO: 179862 - protein, 11 aa, Yellow fever virus
SQEVEFTGYGK

SEQ ID NO: 179863 - protein, 11 aa, Yellow fever virus
QEAEFTGYGKV

SEQ ID NO: 179864 - protein, 11 aa, Yellow fever virus
EVEFTGYGKAT

SEQ ID NO: 179865 - protein, 11 aa, Yellow fever virus
AEFTGYGKVTL

SEQ ID NO: 179866 - protein, 11 aa, Yellow fever virus
EFTGYGKVTLE

SEQ ID NO: 179867 - protein, 11 aa, Yellow fever virus
FTGYGKVTLEC

SEQ ID NO: 179868 - protein, 11 aa, Yellow fever virus
TGYGKATLECR

SEQ ID NO: 179869 - protein, 11 aa, Yellow fever virus
GYGKVTLECQV

SEQ ID NO: 179870 - protein, 11 aa, Yellow fever virus
YGKATLECRVQ

SEQ ID NO: 179871 - protein, 11 aa, Yellow fever virus
GKVTLECQVQT

SEQ ID NO: 179872 - protein, 11 aa, Yellow fever virus
KATLECRVQTA

SEQ ID NO: 179873 - protein, 11 aa, Yellow fever virus
ATLECRVQTAV

SEQ ID NO: 179874 - protein, 11 aa, Yellow fever virus
GNSYIAEMEKD

SEQ ID NO: 179875 - protein, 11 aa, Yellow fever virus
NSYIAEMEKDS

SEQ ID NO: 179876 - protein, 11 aa, Yellow fever virus
SYIAEMEKDSW

SEQ ID NO: 179877 - protein, 11 aa, Yellow fever virus
YIAEMEKDSWI

SEQ ID NO: 179878 - protein, 11 aa, Yellow fever virus
IAEMEKDSWIV

SEQ ID NO: 179879 - protein, 11 aa, Yellow fever virus
AEMEKDSWIVD

SEQ ID NO: 179880 - protein, 11 aa, Yellow fever virus
EMEKDSWIVDR

SEQ ID NO: 179881 - protein, 11 aa, Yellow fever virus
MEKDSWIVDRQ

SEQ ID NO: 179882 - protein, 11 aa, Yellow fever virus
EKDSWIVDRQW

SEQ ID NO: 179883 - protein, 11 aa, Yellow fever virus
KDSWIVDRQWA

SEQ ID NO: 179884 - protein, 11 aa, Yellow fever virus
WQSGSGGVWRG

SEQ ID NO: 179885 - protein, 11 aa, Yellow fever virus
QSGSGGVWRGM

SEQ ID NO: 179886 - protein, 11 aa, Yellow fever virus
SGSGGVWRGMH

SEQ ID NO: 179887 - protein, 11 aa, Yellow fever virus
GSGGVWRGMHH

SEQ ID NO: 179888 - protein, 11 aa, Yellow fever virus
SGGVWRGMHHL

SEQ ID NO: 179889 - protein, 11 aa, Yellow fever virus
GGVWRGMHHLV

SEQ ID NO: 179890 - protein, 11 aa, Yellow fever virus
GVWRGMHHLVE

SEQ ID NO: 179891 - protein, 11 aa, Yellow fever virus
VWRGMHHLVEF

SEQ ID NO: 179892 - protein, 11 aa, Yellow fever virus
AVTIRVLALGN

SEQ ID NO: 179893 - protein, 11 aa, Yellow fever virus
VTIRVLALGNQ

SEQ ID NO: 179894 - protein, 11 aa, Yellow fever virus
MSFVKNPTDTD

SEQ ID NO: 179895 - protein, 11 aa, Yellow fever virus
SFVKNPTDTDH

SEQ ID NO: 179896 - protein, 11 aa, Yellow fever virus
QVKVPKGAPCR

SEQ ID NO: 179897 - protein, 11 aa, Yellow fever virus
VKVPKGAPCRI

SEQ ID NO: 179898 - protein, 11 aa, Yellow fever virus
KVPKGAPCRIP

SEQ ID NO: 179899 - protein, 11 aa, Yellow fever virus
VPKGAPCRIPV

SEQ ID NO: 179900 - protein, 11 aa, Yellow fever virus
PKGAPCRIPVI

SEQ ID NO: 179901 - protein, 11 aa, Yellow fever virus
PFGDSYIIIGT

SEQ ID NO: 179902 - protein, 11 aa, Yellow fever virus
FGDSYIIIGTG

SEQ ID NO: 179903 - protein, 11 aa, Yellow fever virus
GDSYIIIGTGD

SEQ ID NO: 179904 - protein, 11 aa, Yellow fever virus
DSYIIIGTGDS

SEQ ID NO: 179905 - protein, 11 aa, Yellow fever virus
SYIIIGTGDSR

SEQ ID NO: 179906 - protein, 11 aa, Yellow fever virus
YIIIGTGDSRL

SEQ ID NO: 179907 - protein, 11 aa, Yellow fever virus
IIIGTGDSRLT

SEQ ID NO: 179908 - protein, 11 aa, Yellow fever virus
IIGTGDSRLTY

SEQ ID NO: 179909 - protein, 11 aa, Yellow fever virus
IGTGDSRLTYQ

SEQ ID NO: 179910 - protein, 11 aa, Yellow fever virus
GVERLAVMGDV

SEQ ID NO: 179911 - protein, 11 aa, Yellow fever virus
VERLAVMGDVA

SEQ ID NO: 179912 - protein, 11 aa, Yellow fever virus
ERLAVMGDVAW

SEQ ID NO: 179913 - protein, 11 aa, Yellow fever virus
RLAVMGDVAWD

SEQ ID NO: 179914 - protein, 11 aa, Yellow fever virus
LAVMGDVAWDF

SEQ ID NO: 179915 - protein, 11 aa, Yellow fever virus
AVMGDVAWDFS

SEQ ID NO: 179916 - protein, 11 aa, Yellow fever virus
VMGDVAWDFSS

SEQ ID NO: 179917 - protein, 11 aa, Yellow fever virus
MGDVAWDFSSA

SEQ ID NO: 179918 - protein, 11 aa, Yellow fever virus
GDVAWDFSSAG

SEQ ID NO: 179919 - protein, 11 aa, Yellow fever virus
DVAWDFSSAGG

SEQ ID NO: 179920 - protein, 11 aa, Yellow fever virus
VAWDFSSAGGF

SEQ ID NO: 179921 - protein, 11 aa, Yellow fever virus
AWDFSSAGGFL

SEQ ID NO: 179922 - protein, 11 aa, Yellow fever virus
WDFSSAGGLFT

SEQ ID NO: 179923 - protein, 11 aa, Yellow fever virus
DFSSAGGLFTS

SEQ ID NO: 179924 - protein, 11 aa, Yellow fever virus
FSSAGGLFTSI

SEQ ID NO: 179925 - protein, 11 aa, Yellow fever virus
SSAGGLFTSIG

SEQ ID NO: 179926 - protein, 11 aa, Yellow fever virus
SAGGFLTSVGK

SEQ ID NO: 179927 - protein, 11 aa, Yellow fever virus
AGGFLTSVGKG

SEQ ID NO: 179928 - protein, 11 aa, Yellow fever virus
GGFLTSVGKGI

SEQ ID NO: 179929 - protein, 11 aa, Yellow fever virus
GFLTSVGKGIH

SEQ ID NO: 179930 - protein, 11 aa, Yellow fever virus
FLTSVGKGIHT

SEQ ID NO: 179931 - protein, 11 aa, Yellow fever virus
LTSVGKGIHTV

SEQ ID NO: 179932 - protein, 11 aa, Yellow fever virus
GGLNWITKVII

SEQ ID NO: 179933 - protein, 11 aa, Yellow fever virus
GLNWITKVIIG

SEQ ID NO: 179934 - protein, 11 aa, Yellow fever virus
LNWITKVIMGV

SEQ ID NO: 179935 - protein, 11 aa, Yellow fever virus
NWITKVIIGAV

SEQ ID NO: 179936 - protein, 11 aa, Yellow fever virus
WITKVIIGAVL

SEQ ID NO: 179937 - protein, 11 aa, Yellow fever virus
ITKVIIGAVLI

SEQ ID NO: 179938 - protein, 11 aa, Yellow fever virus
TKVIMGVVLIW

SEQ ID NO: 179939 - protein, 11 aa, Yellow fever virus
KVIMGVVLIWV

SEQ ID NO: 179940 - protein, 11 aa, Yellow fever virus
VIMGVVLIWVG

SEQ ID NO: 179941 - protein, 11 aa, Yellow fever virus
IIGAVLIWVGI

SEQ ID NO: 179942 - protein, 11 aa, Yellow fever virus
MGVVLIWVGIN

SEQ ID NO: 179943 - protein, 11 aa, Yellow fever virus
GVVLIWVGINT

SEQ ID NO: 179944 - protein, 11 aa, Yellow fever virus
VVLIWVGINTR

SEQ ID NO: 179945 - protein, 11 aa, Yellow fever virus
GADQGCAINFA

SEQ ID NO: 179946 - protein, 11 aa, Yellow fever virus
ADQGCAINFAK

SEQ ID NO: 179947 - protein, 11 aa, Yellow fever virus
DQGCAINFAKR

SEQ ID NO: 179948 - protein, 11 aa, Yellow fever virus
QGCAINFAKRE

SEQ ID NO: 179949 - protein, 11 aa, Yellow fever virus
GCAINFAKREL

SEQ ID NO: 179950 - protein, 11 aa, Yellow fever virus
CAINFAKRELK

SEQ ID NO: 179951 - protein, 11 aa, Yellow fever virus
AINFAKRELKC

SEQ ID NO: 179952 - protein, 11 aa, Yellow fever virus
INFAKRELKCG

SEQ ID NO: 179953 - protein, 11 aa, Yellow fever virus
VKLASIIKASY

SEQ ID NO: 179954 - protein, 11 aa, Yellow fever virus
KLASIIKASYE

SEQ ID NO: 179955 - protein, 11 aa, Yellow fever virus
LASIIKASYEE

SEQ ID NO: 179956 - protein, 11 aa, Yellow fever virus
ASIIKASYEEG

SEQ ID NO: 179957 - protein, 11 aa, Yellow fever virus
SIIKASYEEGK

SEQ ID NO: 179958 - protein, 11 aa, Yellow fever virus
IIKASYEEGKC

SEQ ID NO: 179959 - protein, 11 aa, Yellow fever virus
IKASYEEGKCG

SEQ ID NO: 179960 - protein, 11 aa, Yellow fever virus
KASYEEGKCGL

SEQ ID NO: 179961 - protein, 11 aa, Yellow fever virus
ASYEEGKCGLN

SEQ ID NO: 179962 - protein, 11 aa, Yellow fever virus
SYEEGKCGLNS

SEQ ID NO: 179963 - protein, 11 aa, Yellow fever virus
YEEGKCGLNSV

SEQ ID NO: 179964 - protein, 11 aa, Yellow fever virus
IFEENEVDISI

SEQ ID NO: 179965 - protein, 11 aa, Yellow fever virus
FEENEVDISIV

SEQ ID NO: 179966 - protein, 11 aa, Yellow fever virus
ISIVVQDPKNI

SEQ ID NO: 179967 - protein, 11 aa, Yellow fever virus
SIVVQDPKNIY

SEQ ID NO: 179968 - protein, 11 aa, Yellow fever virus
IVVQDPKNIYQ

SEQ ID NO: 179969 - protein, 11 aa, Yellow fever virus
YGWKTWGKSLV

SEQ ID NO: 179970 - protein, 11 aa, Yellow fever virus
GWKTWGKSLVF

SEQ ID NO: 179971 - protein, 11 aa, Yellow fever virus
WKTWGKSLVFS

SEQ ID NO: 179972 - protein, 11 aa, Yellow fever virus
KTWGKSLVFSP

SEQ ID NO: 179973 - protein, 11 aa, Yellow fever virus
TWGKSLVFSPG

SEQ ID NO: 179974 - protein, 11 aa, Yellow fever virus
WGKSLVFSPGR

SEQ ID NO: 179975 - protein, 11 aa, Yellow fever virus
GKSLVFSPGRK

SEQ ID NO: 179976 - protein, 11 aa, Yellow fever virus
KSLVFSPGRKN

SEQ ID NO: 179977 - protein, 11 aa, Yellow fever virus
SLVFSPGRKNG

SEQ ID NO: 179978 - protein, 11 aa, Yellow fever virus
VFTTRVFMDAT

SEQ ID NO: 179979 - protein, 11 aa, Yellow fever virus
FTTRVFMDATF

SEQ ID NO: 179980 - protein, 11 aa, Yellow fever virus
TTRVFMDATFD

SEQ ID NO: 179981 - protein, 11 aa, Yellow fever virus
TRVFMDATFDY

SEQ ID NO: 179982 - protein, 11 aa, Yellow fever virus
RVFMDATFDYS

SEQ ID NO: 179983 - protein, 11 aa, Yellow fever virus
VFMDATFDYSV

SEQ ID NO: 179984 - protein, 11 aa, Yellow fever virus
FMDATFDYSVD

SEQ ID NO: 179985 - protein, 11 aa, Yellow fever virus
MDATFDYSVDC

SEQ ID NO: 179986 - protein, 11 aa, Yellow fever virus
DATFDYSVDCD

SEQ ID NO: 179987 - protein, 11 aa, Yellow fever virus
ATFDYSVDCDG

SEQ ID NO: 179988 - protein, 11 aa, Yellow fever virus
TFDYSVDCDGA

SEQ ID NO: 179989 - protein, 11 aa, Yellow fever virus
GSHEVNGTWMV

SEQ ID NO: 179990 - protein, 11 aa, Yellow fever virus
SHEVNGTWMVH

SEQ ID NO: 179991 - protein, 11 aa, Yellow fever virus
HEVNGTWMMHT

SEQ ID NO: 179992 - protein, 11 aa, Yellow fever virus
EVNGTWMVHTL

SEQ ID NO: 179993 - protein, 11 aa, Yellow fever virus
VNGTWMVHTLE

SEQ ID NO: 179994 - protein, 11 aa, Yellow fever virus
NGTWMMHTLET

SEQ ID NO: 179995 - protein, 11 aa, Yellow fever virus
GTWMMHTLETL

SEQ ID NO: 179996 - protein, 11 aa, Yellow fever virus
TWMVHTLETLD

SEQ ID NO: 179997 - protein, 11 aa, Yellow fever virus
WMVHTLETLDY

SEQ ID NO: 179998 - protein, 11 aa, Yellow fever virus
MVHTLETLDYK

SEQ ID NO: 179999 - protein, 11 aa, Yellow fever virus
MHTLETLDYKE

SEQ ID NO: 180000 - protein, 11 aa, Yellow fever virus
ALDYKECEWPP

SEQ ID NO: 180001 - protein, 11 aa, Yellow fever virus
MQVPLEVRREA

SEQ ID NO: 180002 - protein, 11 aa, Yellow fever virus
QVPLEVRREPC

SEQ ID NO: 180003 - protein, 11 aa, Yellow fever virus
VPLEVRREACP

SEQ ID NO: 180004 - protein, 11 aa, Yellow fever virus
PLEVRREACPG

SEQ ID NO: 180005 - protein, 11 aa, Yellow fever virus
LEVRREPCPGT

SEQ ID NO: 180006 - protein, 11 aa, Yellow fever virus
EVRREPCPGTS

SEQ ID NO: 180007 - protein, 11 aa, Yellow fever virus
VRREACPGTSV

SEQ ID NO: 180008 - protein, 11 aa, Yellow fever virus
RREPCPGTSVV

SEQ ID NO: 180009 - protein, 11 aa, Yellow fever virus
REVCPGTSVVV

SEQ ID NO: 180010 - protein, 11 aa, Yellow fever virus
EVCPGTSVVVD

SEQ ID NO: 180011 - protein, 11 aa, Yellow fever virus
VCPGTSVVVDS

SEQ ID NO: 180012 - protein, 11 aa, Yellow fever virus
CPGTSVVLDTG

SEQ ID NO: 180013 - protein, 11 aa, Yellow fever virus
PGTSVVVDTSC

SEQ ID NO: 180014 - protein, 11 aa, Yellow fever virus
GTSVVLDTGCD

SEQ ID NO: 180015 - protein, 11 aa, Yellow fever virus
TSVVVDTSCDG

SEQ ID NO: 180016 - protein, 11 aa, Yellow fever virus
SVVLDTGCDGR

SEQ ID NO: 180017 - protein, 11 aa, Yellow fever virus
VVVDSNCDGRG

SEQ ID NO: 180018 - protein, 11 aa, Yellow fever virus
VLDTGCDGRGK

SEQ ID NO: 180019 - protein, 11 aa, Yellow fever virus
LDTGCDGRGKS

SEQ ID NO: 180020 - protein, 11 aa, Yellow fever virus
DSNCDGRGKST

SEQ ID NO: 180021 - protein, 11 aa, Yellow fever virus
TSCDGRGKSTR

SEQ ID NO: 180022 - protein, 11 aa, Yellow fever virus
GCDGRGKSTRS

SEQ ID NO: 180023 - protein, 11 aa, Yellow fever virus
SARSTTDSGKI

SEQ ID NO: 180024 - protein, 11 aa, Yellow fever virus
ARSTTDSGKII

SEQ ID NO: 180025 - protein, 11 aa, Yellow fever virus
WYPMEIRPRKA

SEQ ID NO: 180026 - protein, 11 aa, Yellow fever virus
YPMEIRPMKTS

SEQ ID NO: 180027 - protein, 11 aa, Yellow fever virus
PMEIRPRKAHE

SEQ ID NO: 180028 - protein, 11 aa, Yellow fever virus
MEIRPMKTSDS

SEQ ID NO: 180029 - protein, 11 aa, Yellow fever virus
EIRPRKAHESH

SEQ ID NO: 180030 - protein, 11 aa, Yellow fever virus
IRPMKTSDSHL

SEQ ID NO: 180031 - protein, 11 aa, Yellow fever virus
RPRKAHESHLV

SEQ ID NO: 180032 - protein, 11 aa, Yellow fever virus
PRKAHESHLVR

SEQ ID NO: 180033 - protein, 11 aa, Yellow fever virus
RKAHESHLVRS

SEQ ID NO: 180034 - protein, 11 aa, Yellow fever virus
KTSDSHLVRSW

SEQ ID NO: 180035 - protein, 11 aa, Yellow fever virus
AHESHLVRSWV

SEQ ID NO: 180036 - protein, 11 aa, Yellow fever virus
MMIAMEVVLRR

SEQ ID NO: 180037 - protein, 11 aa, Yellow fever virus
MIAMEVVLRRR

SEQ ID NO: 180038 - protein, 11 aa, Yellow fever virus
IALEVVLRKRQ

SEQ ID NO: 180039 - protein, 11 aa, Yellow fever virus
AMEVVLRRRQG

SEQ ID NO: 180040 - protein, 11 aa, Yellow fever virus
MEVVLRRRQGP

SEQ ID NO: 180041 - protein, 11 aa, Yellow fever virus
VLRRRQGPKQM

SEQ ID NO: 180042 - protein, 11 aa, Yellow fever virus
LRRRQGPKQML

SEQ ID NO: 180043 - protein, 11 aa, Yellow fever virus
RKRQGPKQVLV

SEQ ID NO: 180044 - protein, 11 aa, Yellow fever virus
RRQGPKQMLVG

SEQ ID NO: 180045 - protein, 11 aa, Yellow fever virus
QGPKQMLVGGM

SEQ ID NO: 180046 - protein, 11 aa, Yellow fever virus
GPKQVLVGGVV

SEQ ID NO: 180047 - protein, 11 aa, Yellow fever virus
PKQVLVGGVVL

SEQ ID NO: 180048 - protein, 11 aa, Yellow fever virus
KQMLVGGMVLL

SEQ ID NO: 180049 - protein, 11 aa, Yellow fever virus
QMLVGGMVLLG

SEQ ID NO: 180050 - protein, 11 aa, Yellow fever virus
MLVGGMVLLGA

SEQ ID NO: 180051 - protein, 11 aa, Yellow fever virus
LVGGMVLLGAM

SEQ ID NO: 180052 - protein, 11 aa, Yellow fever virus
VGGMVLLGAML

SEQ ID NO: 180053 - protein, 11 aa, Yellow fever virus
GGMVLLGAMLV

SEQ ID NO: 180054 - protein, 11 aa, Yellow fever virus
GMVLLGAMLVG

SEQ ID NO: 180055 - protein, 11 aa, Yellow fever virus
MVLLGAMLVGQ

SEQ ID NO: 180056 - protein, 11 aa, Yellow fever virus
LGAMLVGQVTM

SEQ ID NO: 180057 - protein, 11 aa, Yellow fever virus
GAMLVGQVTML

SEQ ID NO: 180058 - protein, 11 aa, Yellow fever virus
AMLVGQVTMLD

SEQ ID NO: 180059 - protein, 11 aa, Yellow fever virus
MLVGQVTMLDL

SEQ ID NO: 180060 - protein, 11 aa, Yellow fever virus
LVGQVTMLDLV

SEQ ID NO: 180061 - protein, 11 aa, Yellow fever virus
VGQVTMLDLVK

SEQ ID NO: 180062 - protein, 11 aa, Yellow fever virus
LTMAVGLHFHE

SEQ ID NO: 180063 - protein, 11 aa, Yellow fever virus
VVAVGLHFHEI

SEQ ID NO: 180064 - protein, 11 aa, Yellow fever virus
MAVGLHFHEMN

SEQ ID NO: 180065 - protein, 11 aa, Yellow fever virus
MYMALIAAFSV

SEQ ID NO: 180066 - protein, 11 aa, Yellow fever virus
YMALIAAFSVR

SEQ ID NO: 180067 - protein, 11 aa, Yellow fever virus
MALIAAFSVRP

SEQ ID NO: 180068 - protein, 11 aa, Yellow fever virus
ALIAAFSVRPG

SEQ ID NO: 180069 - protein, 11 aa, Yellow fever virus
LIAAFSVRPGL

SEQ ID NO: 180070 - protein, 11 aa, Yellow fever virus
IAAFSVRPGLL

SEQ ID NO: 180071 - protein, 11 aa, Yellow fever virus
ASFSIRPGLLV

SEQ ID NO: 180072 - protein, 11 aa, Yellow fever virus
SFSIRPGLLIG

SEQ ID NO: 180073 - protein, 11 aa, Yellow fever virus
FSIRPGLLMGF

SEQ ID NO: 180074 - protein, 11 aa, Yellow fever virus
SIRPGLLVGFG

SEQ ID NO: 180075 - protein, 11 aa, Yellow fever virus
IRPGLLMGFGL

SEQ ID NO: 180076 - protein, 11 aa, Yellow fever virus
RPGLLVGFGLR

SEQ ID NO: 180077 - protein, 11 aa, Yellow fever virus
PGLLMGFGLRT

SEQ ID NO: 180078 - protein, 11 aa, Yellow fever virus
GLLVGFGLRTL

SEQ ID NO: 180079 - protein, 11 aa, Yellow fever virus
LLMGFGLRTLW

SEQ ID NO: 180080 - protein, 11 aa, Yellow fever virus
LVGFGLRTLWS

SEQ ID NO: 180081 - protein, 11 aa, Yellow fever virus
VGFGLRTLWSP

SEQ ID NO: 180082 - protein, 11 aa, Yellow fever virus
LWSPRERLVLA

SEQ ID NO: 180083 - protein, 11 aa, Yellow fever virus
WSPRERLVLAL

SEQ ID NO: 180084 - protein, 11 aa, Yellow fever virus
SPRERLVLALG

SEQ ID NO: 180085 - protein, 11 aa, Yellow fever virus
PRERLVLALGA

SEQ ID NO: 180086 - protein, 11 aa, Yellow fever virus
RERLVLALGAA

SEQ ID NO: 180087 - protein, 11 aa, Yellow fever virus
ERLVLALGAAM

SEQ ID NO: 180088 - protein, 11 aa, Yellow fever virus
RLVLALGAAMV

SEQ ID NO: 180089 - protein, 11 aa, Yellow fever virus
LVLALGAAMVE

SEQ ID NO: 180090 - protein, 11 aa, Yellow fever virus
VMAFGAAMVEV

SEQ ID NO: 180091 - protein, 11 aa, Yellow fever virus
MAFGAAMVEVA

SEQ ID NO: 180092 - protein, 11 aa, Yellow fever virus
AFGAAMVEVAL

SEQ ID NO: 180093 - protein, 11 aa, Yellow fever virus
FGAAMVEIALG

SEQ ID NO: 180094 - protein, 11 aa, Yellow fever virus
AAMVEVALGGM

SEQ ID NO: 180095 - protein, 11 aa, Yellow fever virus
AMVEVALGGMM

SEQ ID NO: 180096 - protein, 11 aa, Yellow fever virus
MVEVALGGMMG

SEQ ID NO: 180097 - protein, 11 aa, Yellow fever virus
VEVALGGMMGG

SEQ ID NO: 180098 - protein, 11 aa, Yellow fever virus
EVALGGMMGGL

SEQ ID NO: 180099 - protein, 11 aa, Yellow fever virus
VALGGMMGGLW

SEQ ID NO: 180100 - protein, 11 aa, Yellow fever virus
ALGGMMGGLWQ

SEQ ID NO: 180101 - protein, 11 aa, Yellow fever virus
LGGMMGGLWQY

SEQ ID NO: 180102 - protein, 11 aa, Yellow fever virus
GGMMGGLWQYL

SEQ ID NO: 180103 - protein, 11 aa, Yellow fever virus
GMMGGLWQYLN

SEQ ID NO: 180104 - protein, 11 aa, Yellow fever virus
MMGGLWQYLNA

SEQ ID NO: 180105 - protein, 11 aa, Yellow fever virus
NAISSRKASNT

SEQ ID NO: 180106 - protein, 11 aa, Yellow fever virus
AISSRKASNAV

SEQ ID NO: 180107 - protein, 11 aa, Yellow fever virus
ISSRKASNTIL

SEQ ID NO: 180108 - protein, 11 aa, Yellow fever virus
SSRKASNAVLP

SEQ ID NO: 180109 - protein, 11 aa, Yellow fever virus
SRKASNMILPL

SEQ ID NO: 180110 - protein, 11 aa, Yellow fever virus
RKASNMILPLM

SEQ ID NO: 180111 - protein, 11 aa, Yellow fever virus
KASNAVLPLMA

SEQ ID NO: 180112 - protein, 11 aa, Yellow fever virus
ASNMILPLMAL

SEQ ID NO: 180113 - protein, 11 aa, Yellow fever virus
SNAILPLMALL

SEQ ID NO: 180114 - protein, 11 aa, Yellow fever virus
NAVLPLMALLT

SEQ ID NO: 180115 - protein, 11 aa, Yellow fever virus
AVLPLMALLTP

SEQ ID NO: 180116 - protein, 11 aa, Yellow fever virus
ILPLMALMTPM

SEQ ID NO: 180117 - protein, 11 aa, Yellow fever virus
LMALMTPMTMH

SEQ ID NO: 180118 - protein, 11 aa, Yellow fever virus
MALLTPVTMHE

SEQ ID NO: 180119 - protein, 11 aa, Yellow fever virus
ALLTPVTMHEV

SEQ ID NO: 180120 - protein, 11 aa, Yellow fever virus
LLTPVTMHEVR

SEQ ID NO: 180121 - protein, 11 aa, Yellow fever virus
LTPVTMHEVRM

SEQ ID NO: 180122 - protein, 11 aa, Yellow fever virus
TPVTMYEVRMA

SEQ ID NO: 180123 - protein, 11 aa, Yellow fever virus
PVTMYEVRMAT

SEQ ID NO: 180124 - protein, 11 aa, Yellow fever virus
VTMHEVRMATM

SEQ ID NO: 180125 - protein, 11 aa, Yellow fever virus
TMAEVRLAAML

SEQ ID NO: 180126 - protein, 11 aa, Yellow fever virus
MLFCAVVIIGV

SEQ ID NO: 180127 - protein, 11 aa, Yellow fever virus
LFCAVVIIGVL

SEQ ID NO: 180128 - protein, 11 aa, Yellow fever virus
FCTVVIVGVLH

SEQ ID NO: 180129 - protein, 11 aa, Yellow fever virus
CTVVIVGVLHQ

SEQ ID NO: 180130 - protein, 11 aa, Yellow fever virus
TVVIVGVLHQN

SEQ ID NO: 180131 - protein, 11 aa, Yellow fever virus
VVIVGVLHQNA

SEQ ID NO: 180132 - protein, 11 aa, Yellow fever virus
VIVGVLHQNAK

SEQ ID NO: 180133 - protein, 11 aa, Yellow fever virus
IIGVLYQNSKD

SEQ ID NO: 180134 - protein, 11 aa, Yellow fever virus
IGVLYQNSKDT

SEQ ID NO: 180135 - protein, 11 aa, Yellow fever virus
GVLYQNSKDTS

SEQ ID NO: 180136 - protein, 11 aa, Yellow fever virus
VLHQNAKDTSM

SEQ ID NO: 180137 - protein, 11 aa, Yellow fever virus
LYQNSKDTSMQ

SEQ ID NO: 180138 - protein, 11 aa, Yellow fever virus
HQNAKDTSMQK

SEQ ID NO: 180139 - protein, 11 aa, Yellow fever virus
QNAKDTSMQKT

SEQ ID NO: 180140 - protein, 11 aa, Yellow fever virus
NAKDTSMQKTI

SEQ ID NO: 180141 - protein, 11 aa, Yellow fever virus
AKDTSMQKTIP

SEQ ID NO: 180142 - protein, 11 aa, Yellow fever virus
LGLCAFLATRL

SEQ ID NO: 180143 - protein, 11 aa, Yellow fever virus
GLCAFLATRLF

SEQ ID NO: 180144 - protein, 11 aa, Yellow fever virus
LCAFLATRLFG

SEQ ID NO: 180145 - protein, 11 aa, Yellow fever virus
CAFLATRLFGR

SEQ ID NO: 180146 - protein, 11 aa, Yellow fever virus
AFLATRLFGRR

SEQ ID NO: 180147 - protein, 11 aa, Yellow fever virus
FLATRLFGRRS

SEQ ID NO: 180148 - protein, 11 aa, Yellow fever virus
LATRLFGRRSI

SEQ ID NO: 180149 - protein, 11 aa, Yellow fever virus
ATRLFGRRSIP

SEQ ID NO: 180150 - protein, 11 aa, Yellow fever virus
TRLFGRRSIPV

SEQ ID NO: 180151 - protein, 11 aa, Yellow fever virus
RLFGRRSIPVN

SEQ ID NO: 180152 - protein, 11 aa, Yellow fever virus
LFGRRSIPVNE

SEQ ID NO: 180153 - protein, 11 aa, Yellow fever virus
ILMMLVSVAGK

SEQ ID NO: 180154 - protein, 11 aa, Yellow fever virus
VAGKVDGLELK

SEQ ID NO: 180155 - protein, 11 aa, Yellow fever virus
AGRVDGLELRK

SEQ ID NO: 180156 - protein, 11 aa, Yellow fever virus
GRVDGLELRKL

SEQ ID NO: 180157 - protein, 11 aa, Yellow fever virus
RVDGLELRKLG

SEQ ID NO: 180158 - protein, 11 aa, Yellow fever virus
DGLELKKLGEI

SEQ ID NO: 180159 - protein, 11 aa, Yellow fever virus
GLELKKLGEIS

SEQ ID NO: 180160 - protein, 11 aa, Yellow fever virus
LELKKLGEISW

SEQ ID NO: 180161 - protein, 11 aa, Yellow fever virus
ELKKLGEVAWE

SEQ ID NO: 180162 - protein, 11 aa, Yellow fever virus
LKKLGEISWEE

SEQ ID NO: 180163 - protein, 11 aa, Yellow fever virus
KKLGEISWEEE

SEQ ID NO: 180164 - protein, 11 aa, Yellow fever virus
KLGEVAWEEEA

SEQ ID NO: 180165 - protein, 11 aa, Yellow fever virus
LGEISWEEEAE

SEQ ID NO: 180166 - protein, 11 aa, Yellow fever virus
GEISWEEEAEI

SEQ ID NO: 180167 - protein, 11 aa, Yellow fever virus
EVAWEEEAEIS

SEQ ID NO: 180168 - protein, 11 aa, Yellow fever virus
ISWEEEAEISG

SEQ ID NO: 180169 - protein, 11 aa, Yellow fever virus
GSSARYDVALN

SEQ ID NO: 180170 - protein, 11 aa, Yellow fever virus
SSARYDVALNE

SEQ ID NO: 180171 - protein, 11 aa, Yellow fever virus
SARYDVALNEQ

SEQ ID NO: 180172 - protein, 11 aa, Yellow fever virus
ARYDVALNEQG

SEQ ID NO: 180173 - protein, 11 aa, Yellow fever virus
LALVGAAIHPS

SEQ ID NO: 180174 - protein, 11 aa, Yellow fever virus
ALVGAAIHPSA

SEQ ID NO: 180175 - protein, 11 aa, Yellow fever virus
LVGAAIHPSAL

SEQ ID NO: 180176 - protein, 11 aa, Yellow fever virus
VGAAIHPSALL

SEQ ID NO: 180177 - protein, 11 aa, Yellow fever virus
GAAIHPSALLL

SEQ ID NO: 180178 - protein, 11 aa, Yellow fever virus
AAIHPSALLLV

SEQ ID NO: 180179 - protein, 11 aa, Yellow fever virus
AIHPSALLLVL

SEQ ID NO: 180180 - protein, 11 aa, Yellow fever virus
IHPFALLLVLG

SEQ ID NO: 180181 - protein, 11 aa, Yellow fever virus
HPSALLLVLAG

SEQ ID NO: 180182 - protein, 11 aa, Yellow fever virus
PSALLLVLAGW

SEQ ID NO: 180183 - protein, 11 aa, Yellow fever virus
SALLLVLAGWL

SEQ ID NO: 180184 - protein, 11 aa, Yellow fever virus
ALLLVLGGWIL

SEQ ID NO: 180185 - protein, 11 aa, Yellow fever virus
LLLVLGGWILH

SEQ ID NO: 180186 - protein, 11 aa, Yellow fever virus
LLVLGGWILHI

SEQ ID NO: 180187 - protein, 11 aa, Yellow fever virus
LVLGGWVLHIK

SEQ ID NO: 180188 - protein, 11 aa, Yellow fever virus
VLAGWLFHVRR

SEQ ID NO: 180189 - protein, 11 aa, Yellow fever virus
LGGWVLHIKGA

SEQ ID NO: 180190 - protein, 11 aa, Yellow fever virus
GGWVLHIKGAR

SEQ ID NO: 180191 - protein, 11 aa, Yellow fever virus
GWVLHIKGARR

SEQ ID NO: 180192 - protein, 11 aa, Yellow fever virus
WLFHVRRARRS

SEQ ID NO: 180193 - protein, 11 aa, Yellow fever virus
LFHVRRARRSG

SEQ ID NO: 180194 - protein, 11 aa, Yellow fever virus
FHVKGARRSGD

SEQ ID NO: 180195 - protein, 11 aa, Yellow fever virus
HVKGARRSGDV

SEQ ID NO: 180196 - protein, 11 aa, Yellow fever virus
VKGARRSGDVL

SEQ ID NO: 180197 - protein, 11 aa, Yellow fever virus
RRARRSGDVLW

SEQ ID NO: 180198 - protein, 11 aa, Yellow fever virus
PTPKVIEECEY

SEQ ID NO: 180199 - protein, 11 aa, Yellow fever virus
TPKVIEECEYL

SEQ ID NO: 180200 - protein, 11 aa, Yellow fever virus
PKVIEECEYLE

SEQ ID NO: 180201 - protein, 11 aa, Yellow fever virus
KVIEECEYLED

SEQ ID NO: 180202 - protein, 11 aa, Yellow fever virus
VIEECEYLEDG

SEQ ID NO: 180203 - protein, 11 aa, Yellow fever virus
EECEYLEDGIY

SEQ ID NO: 180204 - protein, 11 aa, Yellow fever virus
ECEYLEDGIYG

SEQ ID NO: 180205 - protein, 11 aa, Yellow fever virus
CEHLEDGISGI

SEQ ID NO: 180206 - protein, 11 aa, Yellow fever virus
EYLEDGIYGIF

SEQ ID NO: 180207 - protein, 11 aa, Yellow fever virus
HLEDGISGIFQ

SEQ ID NO: 180208 - protein, 11 aa, Yellow fever virus
WHVTRGAFLVW

SEQ ID NO: 180209 - protein, 11 aa, Yellow fever virus
HVTRGAFLVWN

SEQ ID NO: 180210 - protein, 11 aa, Yellow fever virus
VTRGAFLVWNG

SEQ ID NO: 180211 - protein, 11 aa, Yellow fever virus
TRGAFLVWNGK

SEQ ID NO: 180212 - protein, 11 aa, Yellow fever virus
RGAFLVWNGKK

SEQ ID NO: 180213 - protein, 11 aa, Yellow fever virus
GAFLVWNGKKL

SEQ ID NO: 180214 - protein, 11 aa, Yellow fever virus
AFLVWNGKKLI

SEQ ID NO: 180215 - protein, 11 aa, Yellow fever virus
FLVWNGKKLIP

SEQ ID NO: 180216 - protein, 11 aa, Yellow fever virus
LVWNGKKLIPS

SEQ ID NO: 180217 - protein, 11 aa, Yellow fever virus
VWNGKKLIPSW

SEQ ID NO: 180218 - protein, 11 aa, Yellow fever virus
WNGKKLIPSWA

SEQ ID NO: 180219 - protein, 11 aa, Yellow fever virus
AYGGSWKLDGR

SEQ ID NO: 180220 - protein, 11 aa, Yellow fever virus
YGGSWKLDGRW

SEQ ID NO: 180221 - protein, 11 aa, Yellow fever virus
GGSWKLDGRWD

SEQ ID NO: 180222 - protein, 11 aa, Yellow fever virus
GSWKLDGRWDG

SEQ ID NO: 180223 - protein, 11 aa, Yellow fever virus
SWKLDGRWDGE

SEQ ID NO: 180224 - protein, 11 aa, Yellow fever virus
WKLDGRWDGEE

SEQ ID NO: 180225 - protein, 11 aa, Yellow fever virus
KLDGRWDGEEE

SEQ ID NO: 180226 - protein, 11 aa, Yellow fever virus
LDGRWDGEEEV

SEQ ID NO: 180227 - protein, 11 aa, Yellow fever virus
DGRWDGEEEVQ

SEQ ID NO: 180228 - protein, 11 aa, Yellow fever virus
VQLIAAAPGKN

SEQ ID NO: 180229 - protein, 11 aa, Yellow fever virus
QLIAAAPGKNV

SEQ ID NO: 180230 - protein, 11 aa, Yellow fever virus
LIAAAPGKNVV

SEQ ID NO: 180231 - protein, 11 aa, Yellow fever virus
IAAAPGKNVVN

SEQ ID NO: 180232 - protein, 11 aa, Yellow fever virus
AAAPGKNVVNV

SEQ ID NO: 180233 - protein, 11 aa, Yellow fever virus
AVPGKSVVNVQ

SEQ ID NO: 180234 - protein, 11 aa, Yellow fever virus
APGKNVVNVQT

SEQ ID NO: 180235 - protein, 11 aa, Yellow fever virus
PGKSVVNVQTK

SEQ ID NO: 180236 - protein, 11 aa, Yellow fever virus
GKSVVNVQTKP

SEQ ID NO: 180237 - protein, 11 aa, Yellow fever virus
KSVVNVQTKPS

SEQ ID NO: 180238 - protein, 11 aa, Yellow fever virus
AVVNVQTKPSL

SEQ ID NO: 180239 - protein, 11 aa, Yellow fever virus
VNVQTKPSVFK

SEQ ID NO: 180240 - protein, 11 aa, Yellow fever virus
NVQTKPSVFKV

SEQ ID NO: 180241 - protein, 11 aa, Yellow fever virus
VQTKPSLFRVK

SEQ ID NO: 180242 - protein, 11 aa, Yellow fever virus
QTKPSVFKVRN

SEQ ID NO: 180243 - protein, 11 aa, Yellow fever virus
TKPSVFKVRNG

SEQ ID NO: 180244 - protein, 11 aa, Yellow fever virus
KPSLFRVKNGG

SEQ ID NO: 180245 - protein, 11 aa, Yellow fever virus
PSLFRVKNGGE

SEQ ID NO: 180246 - protein, 11 aa, Yellow fever virus
SLFRVKNGGEI

SEQ ID NO: 180247 - protein, 11 aa, Yellow fever virus
VFKVRNGGEIG

SEQ ID NO: 180248 - protein, 11 aa, Yellow fever virus
SPIVNRNGEVV

SEQ ID NO: 180249 - protein, 11 aa, Yellow fever virus
PIVNRNGEVVG

SEQ ID NO: 180250 - protein, 11 aa, Yellow fever virus
IVNRNGEVVGL

SEQ ID NO: 180251 - protein, 11 aa, Yellow fever virus
VNRNGEVVGLY

SEQ ID NO: 180252 - protein, 11 aa, Yellow fever virus
NRNGEVVGLYG

SEQ ID NO: 180253 - protein, 11 aa, Yellow fever virus
RNGEVVGLYGN

SEQ ID NO: 180254 - protein, 11 aa, Yellow fever virus
NGEVVGLYGNG

SEQ ID NO: 180255 - protein, 11 aa, Yellow fever virus
AISQTELKEES

SEQ ID NO: 180256 - protein, 11 aa, Yellow fever virus
ISQTELKEESK

SEQ ID NO: 180257 - protein, 11 aa, Yellow fever virus
SQTELKEESKE

SEQ ID NO: 180258 - protein, 11 aa, Yellow fever virus
QTELKEESKEE

SEQ ID NO: 180259 - protein, 11 aa, Yellow fever virus
TELKEESKEEL

SEQ ID NO: 180260 - protein, 11 aa, Yellow fever virus
EVKEESKEELQ

SEQ ID NO: 180261 - protein, 11 aa, Yellow fever virus
VKEESKEELQE

SEQ ID NO: 180262 - protein, 11 aa, Yellow fever virus
KEESKEELQEI

SEQ ID NO: 180263 - protein, 11 aa, Yellow fever virus
EESKEELQEIP

SEQ ID NO: 180264 - protein, 11 aa, Yellow fever virus
EGKEELREIPT

SEQ ID NO: 180265 - protein, 11 aa, Yellow fever virus
GKEELREIPTM

SEQ ID NO: 180266 - protein, 11 aa, Yellow fever virus
KEELQEISTML

SEQ ID NO: 180267 - protein, 11 aa, Yellow fever virus
EELQEISTMLK

SEQ ID NO: 180268 - protein, 11 aa, Yellow fever virus
ELQEISTMLKK

SEQ ID NO: 180269 - protein, 11 aa, Yellow fever virus
LQEISTMLKKG

SEQ ID NO: 180270 - protein, 11 aa, Yellow fever virus
QEIPTMLKKGK

SEQ ID NO: 180271 - protein, 11 aa, Yellow fever virus
EISTMLKKGMT

SEQ ID NO: 180272 - protein, 11 aa, Yellow fever virus
ISTMLKKGMTT

SEQ ID NO: 180273 - protein, 11 aa, Yellow fever virus
PTMLKKGKTTI

SEQ ID NO: 180274 - protein, 11 aa, Yellow fever virus
TMLKKGKTTIL

SEQ ID NO: 180275 - protein, 11 aa, Yellow fever virus
MLKKGKTTILD

SEQ ID NO: 180276 - protein, 11 aa, Yellow fever virus
LKKGKTTILDF

SEQ ID NO: 180277 - protein, 11 aa, Yellow fever virus
KKGKTTILDFH

SEQ ID NO: 180278 - protein, 11 aa, Yellow fever virus
KGKTTILDFHP

SEQ ID NO: 180279 - protein, 11 aa, Yellow fever virus
GKTTILDFHPG

SEQ ID NO: 180280 - protein, 11 aa, Yellow fever virus
KTTILDFHPGA

SEQ ID NO: 180281 - protein, 11 aa, Yellow fever virus
TTILDYHPGAG

SEQ ID NO: 180282 - protein, 11 aa, Yellow fever virus
TILDYHPGAGK

SEQ ID NO: 180283 - protein, 11 aa, Yellow fever virus
ILDYHPGAGKT

SEQ ID NO: 180284 - protein, 11 aa, Yellow fever virus
AHGSGREVIDV

SEQ ID NO: 180285 - protein, 11 aa, Yellow fever virus
HGSGREVIDVM

SEQ ID NO: 180286 - protein, 11 aa, Yellow fever virus
GSGREVIDVMC

SEQ ID NO: 180287 - protein, 11 aa, Yellow fever virus
SGREVIDVMCH

SEQ ID NO: 180288 - protein, 11 aa, Yellow fever virus
GREVIDVMCHA

SEQ ID NO: 180289 - protein, 11 aa, Yellow fever virus
REVIDVMCHAT

SEQ ID NO: 180290 - protein, 11 aa, Yellow fever virus
LTYRMLEPTRA

SEQ ID NO: 180291 - protein, 11 aa, Yellow fever virus
TYRMLEPTRAV

SEQ ID NO: 180292 - protein, 11 aa, Yellow fever virus
YRMLEPTRAVN

SEQ ID NO: 180293 - protein, 11 aa, Yellow fever virus
RMLEPTRAVNW

SEQ ID NO: 180294 - protein, 11 aa, Yellow fever virus
MLEPTRAVNWE

SEQ ID NO: 180295 - protein, 11 aa, Yellow fever virus
LEPTRAVNWEV

SEQ ID NO: 180296 - protein, 11 aa, Yellow fever virus
EPTRAVNWEVI

SEQ ID NO: 180297 - protein, 11 aa, Yellow fever virus
PTRAVNWEVII

SEQ ID NO: 180298 - protein, 11 aa, Yellow fever virus
TRAVNWEVIIM

SEQ ID NO: 180299 - protein, 11 aa, Yellow fever virus
RAVNWEVIIMD

SEQ ID NO: 180300 - protein, 11 aa, Yellow fever virus
AVNWEVIIMDE

SEQ ID NO: 180301 - protein, 11 aa, Yellow fever virus
QTDIPSEPWTA

SEQ ID NO: 180302 - protein, 11 aa, Yellow fever virus
TDIPSEPWTAG

SEQ ID NO: 180303 - protein, 11 aa, Yellow fever virus
DIPSEPWTAGH

SEQ ID NO: 180304 - protein, 11 aa, Yellow fever virus
IPSEPWTAGHE

SEQ ID NO: 180305 - protein, 11 aa, Yellow fever virus
PSEPWTAGHEW

SEQ ID NO: 180306 - protein, 11 aa, Yellow fever virus
SEPWTAGHEWI

SEQ ID NO: 180307 - protein, 11 aa, Yellow fever virus
EPWTAGHEWIL

SEQ ID NO: 180308 - protein, 11 aa, Yellow fever virus
PWTAGHEWILA

SEQ ID NO: 180309 - protein, 11 aa, Yellow fever virus
WTAGHEWILAD

SEQ ID NO: 180310 - protein, 11 aa, Yellow fever virus
TAGHEWILADK

SEQ ID NO: 180311 - protein, 11 aa, Yellow fever virus
AGHEWILADKR

SEQ ID NO: 180312 - protein, 11 aa, Yellow fever virus
EKEYPTIKQKK

SEQ ID NO: 180313 - protein, 11 aa, Yellow fever virus
KEYPTIKQKKP

SEQ ID NO: 180314 - protein, 11 aa, Yellow fever virus
VDRVLDCRTAF

SEQ ID NO: 180315 - protein, 11 aa, Yellow fever virus
DRVLDCRTAFK

SEQ ID NO: 180316 - protein, 11 aa, Yellow fever virus
AYKPVLVDEGK

SEQ ID NO: 180317 - protein, 11 aa, Yellow fever virus
YKPVLVDEGKK

SEQ ID NO: 180318 - protein, 11 aa, Yellow fever virus
MVAPLYGVEGI

SEQ ID NO: 180319 - protein, 11 aa, Yellow fever virus
VAPLYGVEGIK

SEQ ID NO: 180320 - protein, 11 aa, Yellow fever virus
APLYGVEGIKT

SEQ ID NO: 180321 - protein, 11 aa, Yellow fever virus
PLYGVEGIKTP

SEQ ID NO: 180322 - protein, 11 aa, Yellow fever virus
LYGVEGIKTPV

SEQ ID NO: 180323 - protein, 11 aa, Yellow fever virus
YGVEGIKTPVS

SEQ ID NO: 180324 - protein, 11 aa, Yellow fever virus
GVEGIKTPVSP

SEQ ID NO: 180325 - protein, 11 aa, Yellow fever virus
VEGIKTPVSPG

SEQ ID NO: 180326 - protein, 11 aa, Yellow fever virus
MRLRDDQRRVS

SEQ ID NO: 180327 - protein, 11 aa, Yellow fever virus
RLRDDQRRVSR

SEQ ID NO: 180328 - protein, 11 aa, Yellow fever virus
LRDDQRRVSRE

SEQ ID NO: 180329 - protein, 11 aa, Yellow fever virus
RDDQRRVSREL

SEQ ID NO: 180330 - protein, 11 aa, Yellow fever virus
DDQRRVSRELV

SEQ ID NO: 180331 - protein, 11 aa, Yellow fever virus
DQRRVSRELVR

SEQ ID NO: 180332 - protein, 11 aa, Yellow fever virus
QRRVSRELVRN

SEQ ID NO: 180333 - protein, 11 aa, Yellow fever virus
RRVSRELVRNC

SEQ ID NO: 180334 - protein, 11 aa, Yellow fever virus
RVSRELVRNCD

SEQ ID NO: 180335 - protein, 11 aa, Yellow fever virus
VFRELVRNCDQ

SEQ ID NO: 180336 - protein, 11 aa, Yellow fever virus
SRELVRNCDLP

SEQ ID NO: 180337 - protein, 11 aa, Yellow fever virus
RELVRNCDQPV

SEQ ID NO: 180338 - protein, 11 aa, Yellow fever virus
ELVRNCDQPVW

SEQ ID NO: 180339 - protein, 11 aa, Yellow fever virus
LVRNCDQPVWL

SEQ ID NO: 180340 - protein, 11 aa, Yellow fever virus
VRGCDLPVWLA

SEQ ID NO: 180341 - protein, 11 aa, Yellow fever virus
RNCDQPVWLSW

SEQ ID NO: 180342 - protein, 11 aa, Yellow fever virus
NCDQPVWLSWQ

SEQ ID NO: 180343 - protein, 11 aa, Yellow fever virus
CDLPVWLAWQV

SEQ ID NO: 180344 - protein, 11 aa, Yellow fever virus
DQPVWLSWQVA

SEQ ID NO: 180345 - protein, 11 aa, Yellow fever virus
LPVWLAWQVAK

SEQ ID NO: 180346 - protein, 11 aa, Yellow fever virus
PVWLSWQVAKP

SEQ ID NO: 180347 - protein, 11 aa, Yellow fever virus
VWLSWQVAKPG

SEQ ID NO: 180348 - protein, 11 aa, Yellow fever virus
WLAWQVAKAGL

SEQ ID NO: 180349 - protein, 11 aa, Yellow fever virus
LSWQVAKPGLK

SEQ ID NO: 180350 - protein, 11 aa, Yellow fever virus
AWQVAKAGLKT

SEQ ID NO: 180351 - protein, 11 aa, Yellow fever virus
NDRKWCFEGPD

SEQ ID NO: 180352 - protein, 11 aa, Yellow fever virus
DRKWCFEGPDE

SEQ ID NO: 180353 - protein, 11 aa, Yellow fever virus
RKWCFEGPDEH

SEQ ID NO: 180354 - protein, 11 aa, Yellow fever virus
KWCFDGPKEHE

SEQ ID NO: 180355 - protein, 11 aa, Yellow fever virus
WCFEGPDEHEI

SEQ ID NO: 180356 - protein, 11 aa, Yellow fever virus
CFDGPKEHEIL

SEQ ID NO: 180357 - protein, 11 aa, Yellow fever virus
FEGPDEHEILN

SEQ ID NO: 180358 - protein, 11 aa, Yellow fever virus
EGPDEHEILND

SEQ ID NO: 180359 - protein, 11 aa, Yellow fever virus
GPKEHEILNDS

SEQ ID NO: 180360 - protein, 11 aa, Yellow fever virus
PDEHEILNDSG

SEQ ID NO: 180361 - protein, 11 aa, Yellow fever virus
KEHEILNDSGE

SEQ ID NO: 180362 - protein, 11 aa, Yellow fever virus
NDSGETVKCRT

SEQ ID NO: 180363 - protein, 11 aa, Yellow fever virus
DSGETVKCRTP

SEQ ID NO: 180364 - protein, 11 aa, Yellow fever virus
SGETVKCRTPG

SEQ ID NO: 180365 - protein, 11 aa, Yellow fever virus
GETVKCRTPGG

SEQ ID NO: 180366 - protein, 11 aa, Yellow fever virus
ETVKCRTPGGA

SEQ ID NO: 180367 - protein, 11 aa, Yellow fever virus
TVKCRTPGGAK

SEQ ID NO: 180368 - protein, 11 aa, Yellow fever virus
VKCRAPGGAKR

SEQ ID NO: 180369 - protein, 11 aa, Yellow fever virus
KCRSPGGAKRA

SEQ ID NO: 180370 - protein, 11 aa, Yellow fever virus
CRTPGGAKKPL

SEQ ID NO: 180371 - protein, 11 aa, Yellow fever virus
RTPGGAKKPLR

SEQ ID NO: 180372 - protein, 11 aa, Yellow fever virus
SPGGAKRALRP

SEQ ID NO: 180373 - protein, 11 aa, Yellow fever virus
PGGAKRALRPR

SEQ ID NO: 180374 - protein, 11 aa, Yellow fever virus
GGAKRALRPRW

SEQ ID NO: 180375 - protein, 11 aa, Yellow fever virus
GAKRPLRPRWC

SEQ ID NO: 180376 - protein, 11 aa, Yellow fever virus
AKRPLRPRWCD

SEQ ID NO: 180377 - protein, 11 aa, Yellow fever virus
KRPLRPRWCDE

SEQ ID NO: 180378 - protein, 11 aa, Yellow fever virus
RPLRPRWCDER

SEQ ID NO: 180379 - protein, 11 aa, Yellow fever virus
FAEGRRGAADV

SEQ ID NO: 180380 - protein, 11 aa, Yellow fever virus
AEGRRGAAEIL

SEQ ID NO: 180381 - protein, 11 aa, Yellow fever virus
EGRRGAADVLV

SEQ ID NO: 180382 - protein, 11 aa, Yellow fever virus
GRRGAAEMLVI

SEQ ID NO: 180383 - protein, 11 aa, Yellow fever virus
RRGAAEMLVIL

SEQ ID NO: 180384 - protein, 11 aa, Yellow fever virus
RGAAEILVVLS

SEQ ID NO: 180385 - protein, 11 aa, Yellow fever virus
GAADVLVVLSE

SEQ ID NO: 180386 - protein, 11 aa, Yellow fever virus
AADVLVVLSEL

SEQ ID NO: 180387 - protein, 11 aa, Yellow fever virus
AEILVVLSELP

SEQ ID NO: 180388 - protein, 11 aa, Yellow fever virus
EMLVILTELPD

SEQ ID NO: 180389 - protein, 11 aa, Yellow fever virus
MLVILTELPDF

SEQ ID NO: 180390 - protein, 11 aa, Yellow fever virus
LVILTELPDFL

SEQ ID NO: 180391 - protein, 11 aa, Yellow fever virus
VILTELPDFLA

SEQ ID NO: 180392 - protein, 11 aa, Yellow fever virus
ILTELPDFLAK

SEQ ID NO: 180393 - protein, 11 aa, Yellow fever virus
PEAMTIAMLFI

SEQ ID NO: 180394 - protein, 11 aa, Yellow fever virus
EAMTIAMLFIL

SEQ ID NO: 180395 - protein, 11 aa, Yellow fever virus
AMTIAMLFILA

SEQ ID NO: 180396 - protein, 11 aa, Yellow fever virus
MTIAMLFILAG

SEQ ID NO: 180397 - protein, 11 aa, Yellow fever virus
TIAMLFILAGL

SEQ ID NO: 180398 - protein, 11 aa, Yellow fever virus
IAMLFILAGLL

SEQ ID NO: 180399 - protein, 11 aa, Yellow fever virus
AMLFILAGLLT

SEQ ID NO: 180400 - protein, 11 aa, Yellow fever virus
FLLAGLLTSGA

SEQ ID NO: 180401 - protein, 11 aa, Yellow fever virus
LLAGLLTSGAV

SEQ ID NO: 180402 - protein, 11 aa, Yellow fever virus
AVIFFMSPKGM

SEQ ID NO: 180403 - protein, 11 aa, Yellow fever virus
PKGISRMSMAK

SEQ ID NO: 180404 - protein, 11 aa, Yellow fever virus
KGISRMSMAKG

SEQ ID NO: 180405 - protein, 11 aa, Yellow fever virus
GISRMSMAKGT

SEQ ID NO: 180406 - protein, 11 aa, Yellow fever virus
ISRMSMAKGTM

SEQ ID NO: 180407 - protein, 11 aa, Yellow fever virus
MSMAKGTMAGC

SEQ ID NO: 180408 - protein, 11 aa, Yellow fever virus
SMAKGTMAGCG

SEQ ID NO: 180409 - protein, 11 aa, Yellow fever virus
MAKGTMAGCGY

SEQ ID NO: 180410 - protein, 11 aa, Yellow fever virus
AKGTMAGCGYL

SEQ ID NO: 180411 - protein, 11 aa, Yellow fever virus
KGTMAGCGYLM

SEQ ID NO: 180412 - protein, 11 aa, Yellow fever virus
GCGYLMFLGGA

SEQ ID NO: 180413 - protein, 11 aa, Yellow fever virus
CGYLMFLGGAK

SEQ ID NO: 180414 - protein, 11 aa, Yellow fever virus
GYLMFLGGAKP

SEQ ID NO: 180415 - protein, 11 aa, Yellow fever virus
YLMFLGGVEPT

SEQ ID NO: 180416 - protein, 11 aa, Yellow fever virus
LMFLGGAKPTH

SEQ ID NO: 180417 - protein, 11 aa, Yellow fever virus
MFLGGVEPTHI

SEQ ID NO: 180418 - protein, 11 aa, Yellow fever virus
FLGGVEPTHIS

SEQ ID NO: 180419 - protein, 11 aa, Yellow fever virus
LGGAKPTHISY

SEQ ID NO: 180420 - protein, 11 aa, Yellow fever virus
GGAKPTHISYI

SEQ ID NO: 180421 - protein, 11 aa, Yellow fever virus
GVEPTHISYIM

SEQ ID NO: 180422 - protein, 11 aa, Yellow fever virus
VEPTHISYIML

SEQ ID NO: 180423 - protein, 11 aa, Yellow fever virus
EPTHISYIMLI

SEQ ID NO: 180424 - protein, 11 aa, Yellow fever virus
VIIPEPGQQRT

SEQ ID NO: 180425 - protein, 11 aa, Yellow fever virus
VIPEPGQQRTI

SEQ ID NO: 180426 - protein, 11 aa, Yellow fever virus
QRTIQDNQVAY

SEQ ID NO: 180427 - protein, 11 aa, Yellow fever virus
RTIQDNQVAYL

SEQ ID NO: 180428 - protein, 11 aa, Yellow fever virus
TIQDNQVAYLI

SEQ ID NO: 180429 - protein, 11 aa, Yellow fever virus
AFLIIGILTLV

SEQ ID NO: 180430 - protein, 11 aa, Yellow fever virus
FLIIGILTLVS

SEQ ID NO: 180431 - protein, 11 aa, Yellow fever virus
LIIGILTLLSV

SEQ ID NO: 180432 - protein, 11 aa, Yellow fever virus
IIGILTLLSVV

SEQ ID NO: 180433 - protein, 11 aa, Yellow fever virus
IGILTLLSVVA

SEQ ID NO: 180434 - protein, 11 aa, Yellow fever virus
GILTLLSVVAA

SEQ ID NO: 180435 - protein, 11 aa, Yellow fever virus
ILTLLSVVAAN

SEQ ID NO: 180436 - protein, 11 aa, Yellow fever virus
LTLLSVVAANE

SEQ ID NO: 180437 - protein, 11 aa, Yellow fever virus
TLLSVVAANEL

SEQ ID NO: 180438 - protein, 11 aa, Yellow fever virus
LLSVVAANELG

SEQ ID NO: 180439 - protein, 11 aa, Yellow fever virus
LSVVAANELGM

SEQ ID NO: 180440 - protein, 11 aa, Yellow fever virus
SIVAANELGML

SEQ ID NO: 180441 - protein, 11 aa, Yellow fever virus
IVAANELGMLE

SEQ ID NO: 180442 - protein, 11 aa, Yellow fever virus
LGMLERTKEDL

SEQ ID NO: 180443 - protein, 11 aa, Yellow fever virus
GMLERTKEDLF

SEQ ID NO: 180444 - protein, 11 aa, Yellow fever virus
MLERTKEDLFG

SEQ ID NO: 180445 - protein, 11 aa, Yellow fever virus
LEKTKEDFFGR

SEQ ID NO: 180446 - protein, 11 aa, Yellow fever virus
EKTKEDFFGRR

SEQ ID NO: 180447 - protein, 11 aa, Yellow fever virus
IPSGASPWSWP

SEQ ID NO: 180448 - protein, 11 aa, Yellow fever virus
PSGASPWSWPD

SEQ ID NO: 180449 - protein, 11 aa, Yellow fever virus
SGAIPWSWPDL

SEQ ID NO: 180450 - protein, 11 aa, Yellow fever virus
GASPWSWPDLD

SEQ ID NO: 180451 - protein, 11 aa, Yellow fever virus
AIPWSWPDLDL

SEQ ID NO: 180452 - protein, 11 aa, Yellow fever virus
VPFMKMNISVV

SEQ ID NO: 180453 - protein, 11 aa, Yellow fever virus
PFMKMNISVVI

SEQ ID NO: 180454 - protein, 11 aa, Yellow fever virus
FMKMNISVVIL

SEQ ID NO: 180455 - protein, 11 aa, Yellow fever virus
MKMNISVVILL

SEQ ID NO: 180456 - protein, 11 aa, Yellow fever virus
KMNISVVILLV

SEQ ID NO: 180457 - protein, 11 aa, Yellow fever virus
MNISVVILLVS

SEQ ID NO: 180458 - protein, 11 aa, Yellow fever virus
NISVVILLVSG

SEQ ID NO: 180459 - protein, 11 aa, Yellow fever virus
ISVVILLVSGW

SEQ ID NO: 180460 - protein, 11 aa, Yellow fever virus
SVVILLVSGWN

SEQ ID NO: 180461 - protein, 11 aa, Yellow fever virus
VVILLVSGWNS

SEQ ID NO: 180462 - protein, 11 aa, Yellow fever virus
VILLVSGWNSI

SEQ ID NO: 180463 - protein, 11 aa, Yellow fever virus
MLLISGWNSIT

SEQ ID NO: 180464 - protein, 11 aa, Yellow fever virus
LISGWNSITVM

SEQ ID NO: 180465 - protein, 11 aa, Yellow fever virus
ISGWNSITVMP

SEQ ID NO: 180466 - protein, 11 aa, Yellow fever virus
SITVIPLLCGI

SEQ ID NO: 180467 - protein, 11 aa, Yellow fever virus
ITVIPLLCGIG

SEQ ID NO: 180468 - protein, 11 aa, Yellow fever virus
TVIPLLCGIGG

SEQ ID NO: 180469 - protein, 11 aa, Yellow fever virus
VIPLLCGIGGA

SEQ ID NO: 180470 - protein, 11 aa, Yellow fever virus
MPLLCGIGCAT

SEQ ID NO: 180471 - protein, 11 aa, Yellow fever virus
PLLCGIGCATL

SEQ ID NO: 180472 - protein, 11 aa, Yellow fever virus
LLCGIGCATLH

SEQ ID NO: 180473 - protein, 11 aa, Yellow fever virus
LCGIGGAMLHW

SEQ ID NO: 180474 - protein, 11 aa, Yellow fever virus
CGIGGAMLHWT

SEQ ID NO: 180475 - protein, 11 aa, Yellow fever virus
GIGCAMLHWTL

SEQ ID NO: 180476 - protein, 11 aa, Yellow fever virus
IGCATLHWSLI

SEQ ID NO: 180477 - protein, 11 aa, Yellow fever virus
GCAMLHWTLIL

SEQ ID NO: 180478 - protein, 11 aa, Yellow fever virus
CATLHWSLILP

SEQ ID NO: 180479 - protein, 11 aa, Yellow fever virus
ATLHWSLILPG

SEQ ID NO: 180480 - protein, 11 aa, Yellow fever virus
TLHWSLILPGI

SEQ ID NO: 180481 - protein, 11 aa, Yellow fever virus
IKAQQSKLPQR

SEQ ID NO: 180482 - protein, 11 aa, Yellow fever virus
KAQQSKLPQRR

SEQ ID NO: 180483 - protein, 11 aa, Yellow fever virus
AQQSKLPQRRV

SEQ ID NO: 180484 - protein, 11 aa, Yellow fever virus
QQSKLPQRRVF

SEQ ID NO: 180485 - protein, 11 aa, Yellow fever virus
QSKLPQRRVFH

SEQ ID NO: 180486 - protein, 11 aa, Yellow fever virus
SKLPQRRVFHG

SEQ ID NO: 180487 - protein, 11 aa, Yellow fever virus
KLPQRRVFHGV

SEQ ID NO: 180488 - protein, 11 aa, Yellow fever virus
LPQRRVFHGVA

SEQ ID NO: 180489 - protein, 11 aa, Yellow fever virus
AQRRVFHGVAE

SEQ ID NO: 180490 - protein, 11 aa, Yellow fever virus
QRRVFHGVAEN

SEQ ID NO: 180491 - protein, 11 aa, Yellow fever virus
RRVFHGVAENP

SEQ ID NO: 180492 - protein, 11 aa, Yellow fever virus
ENPVVDGNPTV

SEQ ID NO: 180493 - protein, 11 aa, Yellow fever virus
VDIEEAPEMPV

SEQ ID NO: 180494 - protein, 11 aa, Yellow fever virus
ALYLLLALSLS

SEQ ID NO: 180495 - protein, 11 aa, Yellow fever virus
LYLLLALSLSS

SEQ ID NO: 180496 - protein, 11 aa, Yellow fever virus
YLLLALSLSSV

SEQ ID NO: 180497 - protein, 11 aa, Yellow fever virus
LLLALSLSSVA

SEQ ID NO: 180498 - protein, 11 aa, Yellow fever virus
LLALSLSSVAM

SEQ ID NO: 180499 - protein, 11 aa, Yellow fever virus
LALSLSSVAMC

SEQ ID NO: 180500 - protein, 11 aa, Yellow fever virus
ALSLSSVAMCR

SEQ ID NO: 180501 - protein, 11 aa, Yellow fever virus
LSLSSVAMCRT

SEQ ID NO: 180502 - protein, 11 aa, Yellow fever virus
SLSSVAMCRTP

SEQ ID NO: 180503 - protein, 11 aa, Yellow fever virus
LSSVAMCRTPF

SEQ ID NO: 180504 - protein, 11 aa, Yellow fever virus
SSVAMCRTPFS

SEQ ID NO: 180505 - protein, 11 aa, Yellow fever virus
PFSLDEGIVLA

SEQ ID NO: 180506 - protein, 11 aa, Yellow fever virus
FSLDEGIVLAS

SEQ ID NO: 180507 - protein, 11 aa, Yellow fever virus
SLDEGIVLASA

SEQ ID NO: 180508 - protein, 11 aa, Yellow fever virus
LDEGIVLASAA

SEQ ID NO: 180509 - protein, 11 aa, Yellow fever virus
AEGIVLSSAAL

SEQ ID NO: 180510 - protein, 11 aa, Yellow fever virus
EGIVLSSAALG

SEQ ID NO: 180511 - protein, 11 aa, Yellow fever virus
GIVLSSAALGP

SEQ ID NO: 180512 - protein, 11 aa, Yellow fever virus
IVLSSAALGPL

SEQ ID NO: 180513 - protein, 11 aa, Yellow fever virus
VLSSAALGPLI

SEQ ID NO: 180514 - protein, 11 aa, Yellow fever virus
LSSAALGPLIE

SEQ ID NO: 180515 - protein, 11 aa, Yellow fever virus
SSAALGPLIEG

SEQ ID NO: 180516 - protein, 11 aa, Yellow fever virus
RGNYYAFVGVA

SEQ ID NO: 180517 - protein, 11 aa, Yellow fever virus
GNYYAFVGVAY

SEQ ID NO: 180518 - protein, 11 aa, Yellow fever virus
NYYAFVGVAYN

SEQ ID NO: 180519 - protein, 11 aa, Yellow fever virus
YYAFVGVAYNL

SEQ ID NO: 180520 - protein, 11 aa, Yellow fever virus
VGVAYNLWKMK

SEQ ID NO: 180521 - protein, 11 aa, Yellow fever virus
GVAYNLWKMKT

SEQ ID NO: 180522 - protein, 11 aa, Yellow fever virus
VMYNLWKMKTE

SEQ ID NO: 180523 - protein, 11 aa, Yellow fever virus
MYNLWKMKTER

SEQ ID NO: 180524 - protein, 11 aa, Yellow fever virus
YNLWKMKTARR

SEQ ID NO: 180525 - protein, 11 aa, Yellow fever virus
NLWKMKTARRG

SEQ ID NO: 180526 - protein, 11 aa, Yellow fever virus
RRGSASGKTLG

SEQ ID NO: 180527 - protein, 11 aa, Yellow fever virus
RGSASGKTLGE

SEQ ID NO: 180528 - protein, 11 aa, Yellow fever virus
GSASGKTLGEV

SEQ ID NO: 180529 - protein, 11 aa, Yellow fever virus
SASGKTLGEVW

SEQ ID NO: 180530 - protein, 11 aa, Yellow fever virus
WKRELNLLDRQ

SEQ ID NO: 180531 - protein, 11 aa, Yellow fever virus
KRELNLLDRQQ

SEQ ID NO: 180532 - protein, 11 aa, Yellow fever virus
RELNLLDRQQF

SEQ ID NO: 180533 - protein, 11 aa, Yellow fever virus
ELNLLDRQQFE

SEQ ID NO: 180534 - protein, 11 aa, Yellow fever virus
LNLLDKQQFEM

SEQ ID NO: 180535 - protein, 11 aa, Yellow fever virus
NLLDRQQFELY

SEQ ID NO: 180536 - protein, 11 aa, Yellow fever virus
LLDRQQFELYK

SEQ ID NO: 180537 - protein, 11 aa, Yellow fever virus
LDKQQFEMYKR

SEQ ID NO: 180538 - protein, 11 aa, Yellow fever virus
DKQQFEMYKRT

SEQ ID NO: 180539 - protein, 11 aa, Yellow fever virus
RQQFELYKRTD

SEQ ID NO: 180540 - protein, 11 aa, Yellow fever virus
QQFEMYKRTDI

SEQ ID NO: 180541 - protein, 11 aa, Yellow fever virus
QFEMYKRTDII

SEQ ID NO: 180542 - protein, 11 aa, Yellow fever virus
FEMYKRTDIIE

SEQ ID NO: 180543 - protein, 11 aa, Yellow fever virus
EMYKRTDIIEV

SEQ ID NO: 180544 - protein, 11 aa, Yellow fever virus
MYKRTDIIEVD

SEQ ID NO: 180545 - protein, 11 aa, Yellow fever virus
YKRTDIIEVDR

SEQ ID NO: 180546 - protein, 11 aa, Yellow fever virus
KRTDIIEVDRD

SEQ ID NO: 180547 - protein, 11 aa, Yellow fever virus
RTDIIEVDRDM

SEQ ID NO: 180548 - protein, 11 aa, Yellow fever virus
TDIIEVDRDMA

SEQ ID NO: 180549 - protein, 11 aa, Yellow fever virus
DIIEVDRDMAR

SEQ ID NO: 180550 - protein, 11 aa, Yellow fever virus
IIEVDRDMARR

SEQ ID NO: 180551 - protein, 11 aa, Yellow fever virus
IEVDRDMARRH

SEQ ID NO: 180552 - protein, 11 aa, Yellow fever virus
RGYVKLEGRVM

SEQ ID NO: 180553 - protein, 11 aa, Yellow fever virus
GYVKLEGRVMD

SEQ ID NO: 180554 - protein, 11 aa, Yellow fever virus
YVKLEGRVMDL

SEQ ID NO: 180555 - protein, 11 aa, Yellow fever virus
VKLEGRVMDLG

SEQ ID NO: 180556 - protein, 11 aa, Yellow fever virus
KLEGRVMDLGC

SEQ ID NO: 180557 - protein, 11 aa, Yellow fever virus
LEGRVMDLGCG

SEQ ID NO: 180558 - protein, 11 aa, Yellow fever virus
EGRVMDLGCGR

SEQ ID NO: 180559 - protein, 11 aa, Yellow fever virus
GRVMDLGCGRG

SEQ ID NO: 180560 - protein, 11 aa, Yellow fever virus
RVMDLGCGRGG

SEQ ID NO: 180561 - protein, 11 aa, Yellow fever virus
VMDLGCGRGGW

SEQ ID NO: 180562 - protein, 11 aa, Yellow fever virus
MDLGCGRGGWC

SEQ ID NO: 180563 - protein, 11 aa, Yellow fever virus
SGVKGFTLGRE

SEQ ID NO: 180564 - protein, 11 aa, Yellow fever virus
GVKGFTLGREG

SEQ ID NO: 180565 - protein, 11 aa, Yellow fever virus
VKGFTLGREGH

SEQ ID NO: 180566 - protein, 11 aa, Yellow fever virus
KGFTLGREGHE

SEQ ID NO: 180567 - protein, 11 aa, Yellow fever virus
GFTLGREGHEK

SEQ ID NO: 180568 - protein, 11 aa, Yellow fever virus
FTLGREGHEKP

SEQ ID NO: 180569 - protein, 11 aa, Yellow fever virus
MNVRSLGWNII

SEQ ID NO: 180570 - protein, 11 aa, Yellow fever virus
NVRSLGWNIIT

SEQ ID NO: 180571 - protein, 11 aa, Yellow fever virus
VRSLGWNIITF

SEQ ID NO: 180572 - protein, 11 aa, Yellow fever virus
RSLGWNIITFK

SEQ ID NO: 180573 - protein, 11 aa, Yellow fever virus
NIVTFKDKTDV

SEQ ID NO: 180574 - protein, 11 aa, Yellow fever virus
IVTFKDKTDVH

SEQ ID NO: 180575 - protein, 11 aa, Yellow fever virus
ITFKDKTDVHP

SEQ ID NO: 180576 - protein, 11 aa, Yellow fever virus
TFKDKTDIHHL

SEQ ID NO: 180577 - protein, 11 aa, Yellow fever virus
FKDKTDVHPLE

SEQ ID NO: 180578 - protein, 11 aa, Yellow fever virus
KDKTDIHRLES

SEQ ID NO: 180579 - protein, 11 aa, Yellow fever virus
LEPMKCDTLLC

SEQ ID NO: 180580 - protein, 11 aa, Yellow fever virus
ESVKCDTLLCD

SEQ ID NO: 180581 - protein, 11 aa, Yellow fever virus
PMKCDTLLCDI

SEQ ID NO: 180582 - protein, 11 aa, Yellow fever virus
LKCETLLCDIG

SEQ ID NO: 180583 - protein, 11 aa, Yellow fever virus
CDIGESSPSSA

SEQ ID NO: 180584 - protein, 11 aa, Yellow fever virus
DIGESSPSSAT

SEQ ID NO: 180585 - protein, 11 aa, Yellow fever virus
IGESSSSSITE

SEQ ID NO: 180586 - protein, 11 aa, Yellow fever virus
GESSSSSITEG

SEQ ID NO: 180587 - protein, 11 aa, Yellow fever virus
ESSSSSITEGE

SEQ ID NO: 180588 - protein, 11 aa, Yellow fever virus
SSSSSITEGER

SEQ ID NO: 180589 - protein, 11 aa, Yellow fever virus
SSSSITEGERT

SEQ ID NO: 180590 - protein, 11 aa, Yellow fever virus
PSSVTEGERTL

SEQ ID NO: 180591 - protein, 11 aa, Yellow fever virus
SSVTEGERTLR

SEQ ID NO: 180592 - protein, 11 aa, Yellow fever virus
SVTEGERTLRV

SEQ ID NO: 180593 - protein, 11 aa, Yellow fever virus
VTEGERTLRVL

SEQ ID NO: 180594 - protein, 11 aa, Yellow fever virus
TEGERTLRVLE

SEQ ID NO: 180595 - protein, 11 aa, Yellow fever virus
EGERTLRVLET

SEQ ID NO: 180596 - protein, 11 aa, Yellow fever virus
GERTLRVLETV

SEQ ID NO: 180597 - protein, 11 aa, Yellow fever virus
ERTLRVLDTVE

SEQ ID NO: 180598 - protein, 11 aa, Yellow fever virus
RTLRVLDTVEK

SEQ ID NO: 180599 - protein, 11 aa, Yellow fever virus
TLRVLDTVEKW

SEQ ID NO: 180600 - protein, 11 aa, Yellow fever virus
LRVLETIEKWL

SEQ ID NO: 180601 - protein, 11 aa, Yellow fever virus
RVLETIEKWLA

SEQ ID NO: 180602 - protein, 11 aa, Yellow fever virus
VLETIEKWLAC

SEQ ID NO: 180603 - protein, 11 aa, Yellow fever virus
LETVEKWLACG

SEQ ID NO: 180604 - protein, 11 aa, Yellow fever virus
ETVEKWLACGV

SEQ ID NO: 180605 - protein, 11 aa, Yellow fever virus
FCVKVLAPYMR

SEQ ID NO: 180606 - protein, 11 aa, Yellow fever virus
CVKVLAPYMRD

SEQ ID NO: 180607 - protein, 11 aa, Yellow fever virus
VKVLAPYMRDV

SEQ ID NO: 180608 - protein, 11 aa, Yellow fever virus
KVLAPYMRDVL

SEQ ID NO: 180609 - protein, 11 aa, Yellow fever virus
VLAPYMRDVLE

SEQ ID NO: 180610 - protein, 11 aa, Yellow fever virus
LAPYMRDVLEK

SEQ ID NO: 180611 - protein, 11 aa, Yellow fever virus
APYMRDVLEKL

SEQ ID NO: 180612 - protein, 11 aa, Yellow fever virus
PYMRDVLEKLE

SEQ ID NO: 180613 - protein, 11 aa, Yellow fever virus
YMRDVLEKLEL

SEQ ID NO: 180614 - protein, 11 aa, Yellow fever virus
MRDVLEKLELL

SEQ ID NO: 180615 - protein, 11 aa, Yellow fever virus
RDVLEKLELLQ

SEQ ID NO: 180616 - protein, 11 aa, Yellow fever virus
TGKVTLEADVT

SEQ ID NO: 180617 - protein, 11 aa, Yellow fever virus
GKVTLEADVTL

SEQ ID NO: 180618 - protein, 11 aa, Yellow fever virus
KVTLEADVTLP

SEQ ID NO: 180619 - protein, 11 aa, Yellow fever virus
VTLEADVTLPI

SEQ ID NO: 180620 - protein, 11 aa, Yellow fever virus
TLEPDVILPIG

SEQ ID NO: 180621 - protein, 11 aa, Yellow fever virus
LEADVTLPIGT

SEQ ID NO: 180622 - protein, 11 aa, Yellow fever virus
EADVTLPIGTR

SEQ ID NO: 180623 - protein, 11 aa, Yellow fever virus
ADVTLPIGTRS

SEQ ID NO: 180624 - protein, 11 aa, Yellow fever virus
SVETDKGPLNR

SEQ ID NO: 180625 - protein, 11 aa, Yellow fever virus
EAIKERVERIK

SEQ ID NO: 180626 - protein, 11 aa, Yellow fever virus
AIKERVERIKS

SEQ ID NO: 180627 - protein, 11 aa, Yellow fever virus
IEERVERIKNE

SEQ ID NO: 180628 - protein, 11 aa, Yellow fever virus
KERVERIKSEY

SEQ ID NO: 180629 - protein, 11 aa, Yellow fever virus
ERVERIKNEYA

SEQ ID NO: 180630 - protein, 11 aa, Yellow fever virus
RVERIKNEYAT

SEQ ID NO: 180631 - protein, 11 aa, Yellow fever virus
VERIKTEYAAT

SEQ ID NO: 180632 - protein, 11 aa, Yellow fever virus
ERIKTEYAATW

SEQ ID NO: 180633 - protein, 11 aa, Yellow fever virus
RIKTEYAATWF

SEQ ID NO: 180634 - protein, 11 aa, Yellow fever virus
IKNEYATTWFY

SEQ ID NO: 180635 - protein, 11 aa, Yellow fever virus
KNEYATTWFYD

SEQ ID NO: 180636 - protein, 11 aa, Yellow fever virus
TEYAATWFHDN

SEQ ID NO: 180637 - protein, 11 aa, Yellow fever virus
EYAATWFYDND

SEQ ID NO: 180638 - protein, 11 aa, Yellow fever virus
YAATWFHDNDN

SEQ ID NO: 180639 - protein, 11 aa, Yellow fever virus
ATTWFYDNDNP

SEQ ID NO: 180640 - protein, 11 aa, Yellow fever virus
ATWFYDNDNPY

SEQ ID NO: 180641 - protein, 11 aa, Yellow fever virus
TWFHDNDNPYR

SEQ ID NO: 180642 - protein, 11 aa, Yellow fever virus
AASMVNGVIKL

SEQ ID NO: 180643 - protein, 11 aa, Yellow fever virus
ASMVNGVIKLL

SEQ ID NO: 180644 - protein, 11 aa, Yellow fever virus
SMVNGVIKLLT

SEQ ID NO: 180645 - protein, 11 aa, Yellow fever virus
MVNGVIKLLTY

SEQ ID NO: 180646 - protein, 11 aa, Yellow fever virus
VNGVIKLLTYP

SEQ ID NO: 180647 - protein, 11 aa, Yellow fever virus
NGVIKLLTYPW

SEQ ID NO: 180648 - protein, 11 aa, Yellow fever virus
GVIKLLTYPWD

SEQ ID NO: 180649 - protein, 11 aa, Yellow fever virus
VIKILTYPWDK

SEQ ID NO: 180650 - protein, 11 aa, Yellow fever virus
IKLLTYPWDKI

SEQ ID NO: 180651 - protein, 11 aa, Yellow fever virus
KILTYPWDKIE

SEQ ID NO: 180652 - protein, 11 aa, Yellow fever virus
LLTYPWDKIEE

SEQ ID NO: 180653 - protein, 11 aa, Yellow fever virus
LTYPWDKIEEV

SEQ ID NO: 180654 - protein, 11 aa, Yellow fever virus
TYPWDKIEEVT

SEQ ID NO: 180655 - protein, 11 aa, Yellow fever virus
YPWDKIEEVTR

SEQ ID NO: 180656 - protein, 11 aa, Yellow fever virus
WLFRHLSREKN

SEQ ID NO: 180657 - protein, 11 aa, Yellow fever virus
LFRHLSREKNP

SEQ ID NO: 180658 - protein, 11 aa, Yellow fever virus
FRHLSREKNPR

SEQ ID NO: 180659 - protein, 11 aa, Yellow fever virus
RHLSREKNPRL

SEQ ID NO: 180660 - protein, 11 aa, Yellow fever virus
HLSREKNPRLC

SEQ ID NO: 180661 - protein, 11 aa, Yellow fever virus
LAREKKPRLCT

SEQ ID NO: 180662 - protein, 11 aa, Yellow fever virus
SREKNPRLCTK

SEQ ID NO: 180663 - protein, 11 aa, Yellow fever virus
REKKPRLCTKE

SEQ ID NO: 180664 - protein, 11 aa, Yellow fever virus
EKKPRLCTKEE

SEQ ID NO: 180665 - protein, 11 aa, Yellow fever virus
KKPRLCTKEEF

SEQ ID NO: 180666 - protein, 11 aa, Yellow fever virus
KPRLCTKEEFI

SEQ ID NO: 180667 - protein, 11 aa, Yellow fever virus
KVRSHAAIGAF

SEQ ID NO: 180668 - protein, 11 aa, Yellow fever virus
VRSHAAIGAFL

SEQ ID NO: 180669 - protein, 11 aa, Yellow fever virus
RSHAAIGAFLE

SEQ ID NO: 180670 - protein, 11 aa, Yellow fever virus
SHAAIGAFLEE

SEQ ID NO: 180671 - protein, 11 aa, Yellow fever virus
HAAIGAFLEEQ

SEQ ID NO: 180672 - protein, 11 aa, Yellow fever virus
AAIGAFLEEQE

SEQ ID NO: 180673 - protein, 11 aa, Yellow fever virus
AIGAYLEEQDQ

SEQ ID NO: 180674 - protein, 11 aa, Yellow fever virus
IGAYLEEQDQW

SEQ ID NO: 180675 - protein, 11 aa, Yellow fever virus
GAYLEEQDQWK

SEQ ID NO: 180676 - protein, 11 aa, Yellow fever virus
AYLEEQDQWKT

SEQ ID NO: 180677 - protein, 11 aa, Yellow fever virus
YLEEQDQWKTA

SEQ ID NO: 180678 - protein, 11 aa, Yellow fever virus
KFWELVDEERR

SEQ ID NO: 180679 - protein, 11 aa, Yellow fever virus
FWELVDEERRL

SEQ ID NO: 180680 - protein, 11 aa, Yellow fever virus
WELVDEERRLH

SEQ ID NO: 180681 - protein, 11 aa, Yellow fever virus
ELVDEERRLHQ

SEQ ID NO: 180682 - protein, 11 aa, Yellow fever virus
LVDEERRLHQQ

SEQ ID NO: 180683 - protein, 11 aa, Yellow fever virus
VDEERRLHQQG

SEQ ID NO: 180684 - protein, 11 aa, Yellow fever virus
DEERRLHQQGR

SEQ ID NO: 180685 - protein, 11 aa, Yellow fever virus
EERRLHQQGRC

SEQ ID NO: 180686 - protein, 11 aa, Yellow fever virus
ERRLHQQGRCR

SEQ ID NO: 180687 - protein, 11 aa, Yellow fever virus
RRLHQQGRCRT

SEQ ID NO: 180688 - protein, 11 aa, Yellow fever virus
RLHQQGRCRTC

SEQ ID NO: 180689 - protein, 11 aa, Yellow fever virus
TGLQYLGYVIR

SEQ ID NO: 180690 - protein, 11 aa, Yellow fever virus
QYLGYVIRDLS

SEQ ID NO: 180691 - protein, 11 aa, Yellow fever virus
YLGYVIRDLSA

SEQ ID NO: 180692 - protein, 11 aa, Yellow fever virus
LGYVIRDLSAK

SEQ ID NO: 180693 - protein, 11 aa, Yellow fever virus
GYVIRDLSAKE

SEQ ID NO: 180694 - protein, 11 aa, Yellow fever virus
YVIRDLSAKEG

SEQ ID NO: 180695 - protein, 11 aa, Yellow fever virus
VIRDLSAKEGG

SEQ ID NO: 180696 - protein, 11 aa, Yellow fever virus
IRDLSAKEGGG

SEQ ID NO: 180697 - protein, 11 aa, Yellow fever virus
RDLAAMDGGGL

SEQ ID NO: 180698 - protein, 11 aa, Yellow fever virus
DLSAKEGGGFY

SEQ ID NO: 180699 - protein, 11 aa, Yellow fever virus
LAAMDGGGLYA

SEQ ID NO: 180700 - protein, 11 aa, Yellow fever virus
SAKEGGGFYAD

SEQ ID NO: 180701 - protein, 11 aa, Yellow fever virus
AKEGGGFYADD

SEQ ID NO: 180702 - protein, 11 aa, Yellow fever virus
MDGGGLYADDT

SEQ ID NO: 180703 - protein, 11 aa, Yellow fever virus
DGGGLYADDTA

SEQ ID NO: 180704 - protein, 11 aa, Yellow fever virus
DDEQEIMSYMS

SEQ ID NO: 180705 - protein, 11 aa, Yellow fever virus
DEQEILNYMSS

SEQ ID NO: 180706 - protein, 11 aa, Yellow fever virus
EQEIMSYMSPE

SEQ ID NO: 180707 - protein, 11 aa, Yellow fever virus
QEILNYMSSHH

SEQ ID NO: 180708 - protein, 11 aa, Yellow fever virus
EIMSYMSPEQR

SEQ ID NO: 180709 - protein, 11 aa, Yellow fever virus
IMSYMSPEQRK

SEQ ID NO: 180710 - protein, 11 aa, Yellow fever virus
MSYMSPEQRKL

SEQ ID NO: 180711 - protein, 11 aa, Yellow fever virus
SYMSPEQRKLA

SEQ ID NO: 180712 - protein, 11 aa, Yellow fever virus
YMSSHHKKLAQ

SEQ ID NO: 180713 - protein, 11 aa, Yellow fever virus
MSSHHKKLAQA

SEQ ID NO: 180714 - protein, 11 aa, Yellow fever virus
SSHHKKLAQAV

SEQ ID NO: 180715 - protein, 11 aa, Yellow fever virus
SHHKKLAQAVM

SEQ ID NO: 180716 - protein, 11 aa, Yellow fever virus
EQRKLAWAIME

SEQ ID NO: 180717 - protein, 11 aa, Yellow fever virus
QRKLAWAIMEM

SEQ ID NO: 180718 - protein, 11 aa, Yellow fever virus
RKLAWAIMEMT

SEQ ID NO: 180719 - protein, 11 aa, Yellow fever virus
KLAWAIMEMTY

SEQ ID NO: 180720 - protein, 11 aa, Yellow fever virus
LAWAIMEMTYK

SEQ ID NO: 180721 - protein, 11 aa, Yellow fever virus
AWAIMEMTYKN

SEQ ID NO: 180722 - protein, 11 aa, Yellow fever virus
WAIMEMTYKNK

SEQ ID NO: 180723 - protein, 11 aa, Yellow fever virus
VLRPTPGGKAY

SEQ ID NO: 180724 - protein, 11 aa, Yellow fever virus
LRPTPGGKAYM

SEQ ID NO: 180725 - protein, 11 aa, Yellow fever virus
RPTPGGKAYMD

SEQ ID NO: 180726 - protein, 11 aa, Yellow fever virus
PTPGGKAYMDV

SEQ ID NO: 180727 - protein, 11 aa, Yellow fever virus
TPGGKAYMDVI

SEQ ID NO: 180728 - protein, 11 aa, Yellow fever virus
VISRRDQRGSR

SEQ ID NO: 180729 - protein, 11 aa, Yellow fever virus
IRMAEAENVIH

SEQ ID NO: 180730 - protein, 11 aa, Yellow fever virus
RMAEAENVIHH

SEQ ID NO: 180731 - protein, 11 aa, Yellow fever virus
MAEAENVIHHQ

SEQ ID NO: 180732 - protein, 11 aa, Yellow fever virus
AEAEMVIHHHH

SEQ ID NO: 180733 - protein, 11 aa, Yellow fever virus
EAEMVIHHHHV

SEQ ID NO: 180734 - protein, 11 aa, Yellow fever virus
AEMVINHQHVQ

SEQ ID NO: 180735 - protein, 11 aa, Yellow fever virus
ENVIHHQHVQD

SEQ ID NO: 180736 - protein, 11 aa, Yellow fever virus
NVIHHQHVQDC

SEQ ID NO: 180737 - protein, 11 aa, Yellow fever virus
VINHQHVQECG

SEQ ID NO: 180738 - protein, 11 aa, Yellow fever virus
INHQHVQECGE

SEQ ID NO: 180739 - protein, 11 aa, Yellow fever virus
NHQHVNECDEG

SEQ ID NO: 180740 - protein, 11 aa, Yellow fever virus
LARLDAWLAEN

SEQ ID NO: 180741 - protein, 11 aa, Yellow fever virus
ARLDAWLAENG

SEQ ID NO: 180742 - protein, 11 aa, Yellow fever virus
RLEAWLIEHGC

SEQ ID NO: 180743 - protein, 11 aa, Yellow fever virus
LDAWLAENGCD

SEQ ID NO: 180744 - protein, 11 aa, Yellow fever virus
DAWLAENGCDR

SEQ ID NO: 180745 - protein, 11 aa, Yellow fever virus
AWLAENGCDRL

SEQ ID NO: 180746 - protein, 11 aa, Yellow fever virus
RLARMAVSGDD

SEQ ID NO: 180747 - protein, 11 aa, Yellow fever virus
LARMAVSGDDC

SEQ ID NO: 180748 - protein, 11 aa, Yellow fever virus
ARMAVSGDDCV

SEQ ID NO: 180749 - protein, 11 aa, Yellow fever virus
MAVNGDDCVVR

SEQ ID NO: 180750 - protein, 11 aa, Yellow fever virus
AVSGDDCVVKP

SEQ ID NO: 180751 - protein, 11 aa, Yellow fever virus
VNGDDCVVRPI

SEQ ID NO: 180752 - protein, 11 aa, Yellow fever virus
NGDDCVVRPID

SEQ ID NO: 180753 - protein, 11 aa, Yellow fever virus
GDDCVVKPVDD

SEQ ID NO: 180754 - protein, 11 aa, Yellow fever virus
DDCVVKPVDDR

SEQ ID NO: 180755 - protein, 11 aa, Yellow fever virus
DCVVKPVDDRF

SEQ ID NO: 180756 - protein, 11 aa, Yellow fever virus
CVVKPVDDRFG

SEQ ID NO: 180757 - protein, 11 aa, Yellow fever virus
VVKPVDDRFGL

SEQ ID NO: 180758 - protein, 11 aa, Yellow fever virus
VKPVDDRFGLA

SEQ ID NO: 180759 - protein, 11 aa, Yellow fever virus
RPIDDRFGMAL

SEQ ID NO: 180760 - protein, 11 aa, Yellow fever virus
PIDDRFGMALS

SEQ ID NO: 180761 - protein, 11 aa, Yellow fever virus
IDDRFGMALSH

SEQ ID NO: 180762 - protein, 11 aa, Yellow fever virus
ISEWQPSKEWT

SEQ ID NO: 180763 - protein, 11 aa, Yellow fever virus
SEWQPSKEWTD

SEQ ID NO: 180764 - protein, 11 aa, Yellow fever virus
EWQPSKEWTDW

SEQ ID NO: 180765 - protein, 11 aa, Yellow fever virus
WQPSKEWTDWE

SEQ ID NO: 180766 - protein, 11 aa, Yellow fever virus
QPSKGWTDWES

SEQ ID NO: 180767 - protein, 11 aa, Yellow fever virus
PSKEWTDWENV

SEQ ID NO: 180768 - protein, 11 aa, Yellow fever virus
SKGWTDWENVP

SEQ ID NO: 180769 - protein, 11 aa, Yellow fever virus
KEWTDWENVPF

SEQ ID NO: 180770 - protein, 11 aa, Yellow fever virus
GWTDWENVPFC

SEQ ID NO: 180771 - protein, 11 aa, Yellow fever virus
WTDWESVPFCS

SEQ ID NO: 180772 - protein, 11 aa, Yellow fever virus
TDWESVPFCSH

SEQ ID NO: 180773 - protein, 11 aa, Yellow fever virus
DWESVPFCSHH

SEQ ID NO: 180774 - protein, 11 aa, Yellow fever virus
WESVPFCSHHF

SEQ ID NO: 180775 - protein, 11 aa, Yellow fever virus
ESVPFCSHHFH

SEQ ID NO: 180776 - protein, 11 aa, Yellow fever virus
NVPFCSHRFHE

SEQ ID NO: 180777 - protein, 11 aa, Yellow fever virus
PFCSHHFHELH

SEQ ID NO: 180778 - protein, 11 aa, Yellow fever virus
FCSHHFHELHL

SEQ ID NO: 180779 - protein, 11 aa, Yellow fever virus
CSHHFHELHLK

SEQ ID NO: 180780 - protein, 11 aa, Yellow fever virus
SHHFHELHLKD

SEQ ID NO: 180781 - protein, 11 aa, Yellow fever virus
HHFHELHLKDG

SEQ ID NO: 180782 - protein, 11 aa, Yellow fever virus
HFHELHLKDGR

SEQ ID NO: 180783 - protein, 11 aa, Yellow fever virus
FHELHLKDGRR

SEQ ID NO: 180784 - protein, 11 aa, Yellow fever virus
HELVLKDGRKV

SEQ ID NO: 180785 - protein, 11 aa, Yellow fever virus
ELVLKDGRKVV

SEQ ID NO: 180786 - protein, 11 aa, Yellow fever virus
LVLKDGRKVVV

SEQ ID NO: 180787 - protein, 11 aa, Yellow fever virus
VLKDGRKVVVP

SEQ ID NO: 180788 - protein, 11 aa, Yellow fever virus
LKDGRKIVVPC

SEQ ID NO: 180789 - protein, 11 aa, Yellow fever virus
KDGRKIVVPCR

SEQ ID NO: 180790 - protein, 11 aa, Yellow fever virus
DGRKIVVPCRD

SEQ ID NO: 180791 - protein, 11 aa, Yellow fever virus
GRKIVVPCRDQ

SEQ ID NO: 180792 - protein, 11 aa, Yellow fever virus
RKIVVPCRDQD

SEQ ID NO: 180793 - protein, 11 aa, Yellow fever virus
KIVVPCRDQDE

SEQ ID NO: 180794 - protein, 11 aa, Yellow fever virus
IVVPCRDQDEL

SEQ ID NO: 180795 - protein, 11 aa, Yellow fever virus
LSFAVSSAVPM

SEQ ID NO: 180796 - protein, 11 aa, Yellow fever virus
SFAVSSAVPMA

SEQ ID NO: 180797 - protein, 11 aa, Yellow fever virus
FAVSSAVPMAW

SEQ ID NO: 180798 - protein, 11 aa, Yellow fever virus
AVSSAVPMAWV

SEQ ID NO: 180799 - protein, 11 aa, Yellow fever virus
VSSAVPMAWVP

SEQ ID NO: 180800 - protein, 11 aa, Yellow fever virus
SSAVPMAWVPS

SEQ ID NO: 180801 - protein, 11 aa, Yellow fever virus
SAVPMAWVPSG

SEQ ID NO: 180802 - protein, 11 aa, Yellow fever virus
AVPMAWVPSGR

SEQ ID NO: 180803 - protein, 11 aa, Yellow fever virus
VPMAWVPSGRT

SEQ ID NO: 180804 - protein, 11 aa, Yellow fever virus
PMAWVPSGRTT

SEQ ID NO: 180805 - protein, 11 aa, Yellow fever virus
MAWVPSGRTTW

SEQ ID NO: 180806 - protein, 11 aa, Yellow fever virus
SGRTTWSVHGR

SEQ ID NO: 180807 - protein, 11 aa, Yellow fever virus
GRTTWSVHGRG

SEQ ID NO: 180808 - protein, 11 aa, Yellow fever virus
RTTWSVHGRGE

SEQ ID NO: 180809 - protein, 11 aa, Yellow fever virus
TTWSVHGRGEW

SEQ ID NO: 180810 - protein, 11 aa, Yellow fever virus
TWSVHGRGEWM

SEQ ID NO: 180811 - protein, 11 aa, Yellow fever virus
WSVHGRGEWMT

SEQ ID NO: 180812 - protein, 11 aa, Yellow fever virus
SVHGRGEWMTT

SEQ ID NO: 180813 - protein, 11 aa, Yellow fever virus
VHGRGEWMTTE

SEQ ID NO: 180814 - protein, 11 aa, Yellow fever virus
HGKGEWMTTQD

SEQ ID NO: 180815 - protein, 11 aa, Yellow fever virus
GRGEWMTTEDM

SEQ ID NO: 180816 - protein, 11 aa, Yellow fever virus
RGEWMTTEDML

SEQ ID NO: 180817 - protein, 11 aa, Yellow fever virus
GEWMTTEDMLD

SEQ ID NO: 180818 - protein, 11 aa, Yellow fever virus
EWMTTEDMLGV

SEQ ID NO: 180819 - protein, 11 aa, Yellow fever virus
WMTTEDMLDVW

SEQ ID NO: 180820 - protein, 11 aa, Yellow fever virus
MTTEDMLDVWN

SEQ ID NO: 180821 - protein, 11 aa, Yellow fever virus
TTEDMLDVWNR

SEQ ID NO: 180822 - protein, 11 aa, Yellow fever virus
TEDMLGVWNRV

SEQ ID NO: 180823 - protein, 11 aa, Yellow fever virus
EDMLDVWNRVW

SEQ ID NO: 180824 - protein, 11 aa, Yellow fever virus
DMLGVWNRVWI

SEQ ID NO: 180825 - protein, 11 aa, Yellow fever virus
MLGVWNRVWIT

SEQ ID NO: 180826 - protein, 11 aa, Yellow fever virus
LGVWNRVWITN

SEQ ID NO: 180827 - protein, 11 aa, Yellow fever virus
GVWNRVWITNN

SEQ ID NO: 180828 - protein, 11 aa, Yellow fever virus
RVWVLNNPHMT

SEQ ID NO: 180829 - protein, 11 aa, Yellow fever virus
VWVLNNPHMTD

SEQ ID NO: 180830 - protein, 11 aa, Yellow fever virus
WVLNNPHMTDK

SEQ ID NO: 180831 - protein, 11 aa, Yellow fever virus
VLNNPHMTDKT

SEQ ID NO: 180832 - protein, 11 aa, Yellow fever virus
LNNPHMKDKTT

SEQ ID NO: 180833 - protein, 11 aa, Yellow fever virus
NNPHMKDKTTV

SEQ ID NO: 180834 - protein, 11 aa, Yellow fever virus
NPHMKDKTTVK

SEQ ID NO: 180835 - protein, 11 aa, Yellow fever virus
PHMQDKTVVKE

SEQ ID NO: 180836 - protein, 11 aa, Yellow fever virus
HMQDKTVVKEW

SEQ ID NO: 180837 - protein, 11 aa, Yellow fever virus
MQDKTVVKEWR

SEQ ID NO: 180838 - protein, 11 aa, Yellow fever virus
QDKTVVKEWRD

SEQ ID NO: 180839 - protein, 11 aa, Yellow fever virus
DKTVVKEWRDV

SEQ ID NO: 180840 - protein, 11 aa, Yellow fever virus
KTVVKEWRDVP

SEQ ID NO: 180841 - protein, 11 aa, Yellow fever virus
TVVKEWRDVPY

SEQ ID NO: 180842 - protein, 11 aa, Yellow fever virus
VVKEWRDVPYL

SEQ ID NO: 180843 - protein, 11 aa, Yellow fever virus
IKEWRDVPYLT

SEQ ID NO: 180844 - protein, 11 aa, Yellow fever virus
NIHLVIHRIRT

SEQ ID NO: 180845 - protein, 11 aa, Yellow fever virus
HLVIHRIRNLI

SEQ ID NO: 180846 - protein, 11 aa, Yellow fever virus
LVIHRIRNLIG

SEQ ID NO: 180847 - protein, 11 aa, Yellow fever virus
VIHRIRNLIGQ

SEQ ID NO: 180848 - protein, 11 aa, Yellow fever virus
IHRIRNLIGQE

SEQ ID NO: 180849 - protein, 11 aa, Yellow fever virus
HRIRNLIGQEK

SEQ ID NO: 180850 - protein, 11 aa, Yellow fever virus
RIRTLIGQEKF

SEQ ID NO: 180851 - protein, 11 aa, Yellow fever virus
IRNLIGQEKYT

SEQ ID NO: 180852 - protein, 11 aa, Yellow fever virus
RNLIGQEKYTD

SEQ ID NO: 180853 - protein, 11 aa, Yellow fever virus
TLIGQEKFTDY

SEQ ID NO: 180854 - protein, 11 aa, Yellow fever virus
LIGQEKFTDYL

SEQ ID NO: 180855 - protein, 11 aa, Yellow fever virus
IGQEKFTDYLT

SEQ ID NO: 180856 - protein, 11 aa, Yellow fever virus
NILTGKKLTAH

SEQ ID NO: 180857 - protein, 11 aa, Yellow fever virus
ILTGKKITAQL

SEQ ID NO: 180858 - protein, 11 aa, Yellow fever virus
LTGKKLTAHLK

SEQ ID NO: 180859 - protein, 11 aa, Yellow fever virus
TGKKITAQLKR

SEQ ID NO: 180860 - protein, 11 aa, Yellow fever virus
GKKITAQLKRL

SEQ ID NO: 180861 - protein, 11 aa, Yellow fever virus
KKITAQLKRLW

SEQ ID NO: 180862 - protein, 11 aa, Yellow fever virus
KITAQLKRLWK

SEQ ID NO: 180863 - protein, 11 aa, Yellow fever virus
ITAQLKRLWKM

SEQ ID NO: 180864 - protein, 11 aa, Yellow fever virus
TAQLKRLWKML

SEQ ID NO: 180865 - protein, 11 aa, Yellow fever virus
AQLKRLWKMLD

SEQ ID NO: 180866 - protein, 11 aa, Yellow fever virus
HLKKLWRMLDP

SEQ ID NO: 180867 - protein, 11 aa, Yellow fever virus
RMLDPRQGLTV

SEQ ID NO: 180868 - protein, 11 aa, Yellow fever virus
IGLSSRKRRSN

SEQ ID NO: 180869 - protein, 11 aa, Yellow fever virus
LSSRKRRSSEM

SEQ ID NO: 180870 - protein, 11 aa, Yellow fever virus
SSRKRRSSEMT

SEQ ID NO: 180871 - protein, 11 aa, Yellow fever virus
LFPLLLLGLLA

SEQ ID NO: 180872 - protein, 11 aa, Yellow fever virus
FPLLLLGLLAL

SEQ ID NO: 180873 - protein, 11 aa, Yellow fever virus
SGGVTLVRKNR

SEQ ID NO: 180874 - protein, 11 aa, Yellow fever virus
TAEDLGKTFSL

SEQ ID NO: 180875 - protein, 11 aa, Yellow fever virus
SEDLGKTFSMG

SEQ ID NO: 180876 - protein, 11 aa, Yellow fever virus
EDLGKTFSLGT

SEQ ID NO: 180877 - protein, 11 aa, Yellow fever virus
DLGKTFSLGTG

SEQ ID NO: 180878 - protein, 11 aa, Yellow fever virus
LGKTFSVGAGN

SEQ ID NO: 180879 - protein, 11 aa, Yellow fever virus
GKTFSVGAGNC

SEQ ID NO: 180880 - protein, 11 aa, Yellow fever virus
KTFSIGTGNCT

SEQ ID NO: 180881 - protein, 11 aa, Yellow fever virus
TFSIGTGNCTT

SEQ ID NO: 180882 - protein, 11 aa, Yellow fever virus
FSIGTGNCTTN

SEQ ID NO: 180883 - protein, 11 aa, Yellow fever virus
SVGAGNCTTNI

SEQ ID NO: 180884 - protein, 11 aa, Yellow fever virus
VGAGNCTTNIL

SEQ ID NO: 180885 - protein, 11 aa, Yellow fever virus
LAIAYLVGNNK

SEQ ID NO: 180886 - protein, 11 aa, Yellow fever virus
AIAYLVGNNMT

SEQ ID NO: 180887 - protein, 11 aa, Yellow fever virus
IAYLVGNNTTQ

SEQ ID NO: 180888 - protein, 11 aa, Yellow fever virus
AYLVGNNKTQR

SEQ ID NO: 180889 - protein, 11 aa, Yellow fever virus
YLVGNNMTQRV

SEQ ID NO: 180890 - protein, 11 aa, Yellow fever virus
LVGNNKTQRVV

SEQ ID NO: 180891 - protein, 11 aa, Yellow fever virus
VGNNMTQRVVI

SEQ ID NO: 180892 - protein, 11 aa, Yellow fever virus
GNNTTQRVVIA

SEQ ID NO: 180893 - protein, 11 aa, Yellow fever virus
NNTTQRVVIAL

SEQ ID NO: 180894 - protein, 11 aa, Yellow fever virus
SLETVAIDGPV

SEQ ID NO: 180895 - protein, 11 aa, Yellow fever virus
LETVAIDGPVE

SEQ ID NO: 180896 - protein, 11 aa, Yellow fever virus
QTVAIDGPAEA

SEQ ID NO: 180897 - protein, 11 aa, Yellow fever virus
TVAIDGPVEAR

SEQ ID NO: 180898 - protein, 11 aa, Yellow fever virus
VAIDGPVEARK

SEQ ID NO: 180899 - protein, 11 aa, Yellow fever virus
AIDGPVEARKV

SEQ ID NO: 180900 - protein, 11 aa, Yellow fever virus
IDGPVEARKVC

SEQ ID NO: 180901 - protein, 11 aa, Yellow fever virus
DGPVEARKVCY

SEQ ID NO: 180902 - protein, 11 aa, Yellow fever virus
GPAEARKVCYS

SEQ ID NO: 180903 - protein, 11 aa, Yellow fever virus
PVEARKVCYNA

SEQ ID NO: 180904 - protein, 11 aa, Yellow fever virus
VEARKVCYNAV

SEQ ID NO: 180905 - protein, 11 aa, Yellow fever virus
LHVGAKQENWK

SEQ ID NO: 180906 - protein, 11 aa, Yellow fever virus
HVGAKQEDWKT

SEQ ID NO: 180907 - protein, 11 aa, Yellow fever virus
VGAKQEDWKTD

SEQ ID NO: 180908 - protein, 11 aa, Yellow fever virus
GAKQENWKTDI

SEQ ID NO: 180909 - protein, 11 aa, Yellow fever virus
AKQENWKTDIK

SEQ ID NO: 180910 - protein, 11 aa, Yellow fever virus
KQEDWKTDIKT

SEQ ID NO: 180911 - protein, 11 aa, Yellow fever virus
QEDWKTDIKTL

SEQ ID NO: 180912 - protein, 11 aa, Yellow fever virus
EDWKTDIKTLK

SEQ ID NO: 180913 - protein, 11 aa, Yellow fever virus
NWKTDIKTLKF

SEQ ID NO: 180914 - protein, 11 aa, Yellow fever virus
WKTDIKTLKFD

SEQ ID NO: 180915 - protein, 11 aa, Yellow fever virus
KTDIKTLKFDV

SEQ ID NO: 180916 - protein, 11 aa, Yellow fever virus
VLSGSQEAEFT

SEQ ID NO: 180917 - protein, 11 aa, Yellow fever virus
QEVEFTGYGKA

SEQ ID NO: 180918 - protein, 11 aa, Yellow fever virus
EAEFTGYGKVT

SEQ ID NO: 180919 - protein, 11 aa, Yellow fever virus
VEFTGYGKATL

SEQ ID NO: 180920 - protein, 11 aa, Yellow fever virus
TGYGKVTLECQ

SEQ ID NO: 180921 - protein, 11 aa, Yellow fever virus
GVERLAVMGDA

SEQ ID NO: 180922 - protein, 11 aa, Yellow fever virus
VERLAVMGDAA

SEQ ID NO: 180923 - protein, 11 aa, Yellow fever virus
AAWDFSSAGGL

SEQ ID NO: 180924 - protein, 11 aa, Yellow fever virus
LNWITKVIIGA

SEQ ID NO: 180925 - protein, 11 aa, Yellow fever virus
NWITKVIMGVV

SEQ ID NO: 180926 - protein, 11 aa, Yellow fever virus
IMGAVLIWVGF

SEQ ID NO: 180927 - protein, 11 aa, Yellow fever virus
MGAVLIWVGFN

SEQ ID NO: 180928 - protein, 11 aa, Yellow fever virus
NGTWMVHTLET

SEQ ID NO: 180929 - protein, 11 aa, Yellow fever virus
GTWMVHTLETL

SEQ ID NO: 180930 - protein, 11 aa, Yellow fever virus
TWMMHTLETLD

SEQ ID NO: 180931 - protein, 11 aa, Yellow fever virus
WMMHTLETLDY

SEQ ID NO: 180932 - protein, 11 aa, Yellow fever virus
MMHTLETLDYK

SEQ ID NO: 180933 - protein, 11 aa, Yellow fever virus
VHTLETLDYKE

SEQ ID NO: 180934 - protein, 11 aa, Yellow fever virus
MQVPLEVKREV

SEQ ID NO: 180935 - protein, 11 aa, Yellow fever virus
QVPLEVKREVC

SEQ ID NO: 180936 - protein, 11 aa, Yellow fever virus
VPLEVKREVCP

SEQ ID NO: 180937 - protein, 11 aa, Yellow fever virus
PLEVKREVCPG

SEQ ID NO: 180938 - protein, 11 aa, Yellow fever virus
LEVKREVCPGT

SEQ ID NO: 180939 - protein, 11 aa, Yellow fever virus
EVKREVCPGTS

SEQ ID NO: 180940 - protein, 11 aa, Yellow fever virus
VKREVCPGTSV

SEQ ID NO: 180941 - protein, 11 aa, Yellow fever virus
KREVCPGTSVV

SEQ ID NO: 180942 - protein, 11 aa, Yellow fever virus
REPCPGTSVVL

SEQ ID NO: 180943 - protein, 11 aa, Yellow fever virus
EPCPGTSVVVD

SEQ ID NO: 180944 - protein, 11 aa, Yellow fever virus
PCPGTSVVLDT

SEQ ID NO: 180945 - protein, 11 aa, Yellow fever virus
CPGTSVVVDSN

SEQ ID NO: 180946 - protein, 11 aa, Yellow fever virus
PGTSVVLDTGC

SEQ ID NO: 180947 - protein, 11 aa, Yellow fever virus
GTSVVVDSNCD

SEQ ID NO: 180948 - protein, 11 aa, Yellow fever virus
TSVVVDSNCDG

SEQ ID NO: 180949 - protein, 11 aa, Yellow fever virus
SVVVDSNCDGR

SEQ ID NO: 180950 - protein, 11 aa, Yellow fever virus
VVVDTSCDGRG

SEQ ID NO: 180951 - protein, 11 aa, Yellow fever virus
VVDTSCDGRGK

SEQ ID NO: 180952 - protein, 11 aa, Yellow fever virus
VDSNCDGRGKS

SEQ ID NO: 180953 - protein, 11 aa, Yellow fever virus
DTGCDGRGKST

SEQ ID NO: 180954 - protein, 11 aa, Yellow fever virus
GNCDGRGKSAR

SEQ ID NO: 180955 - protein, 11 aa, Yellow fever virus
SCDGRGKSTRS

SEQ ID NO: 180956 - protein, 11 aa, Yellow fever virus
YPMEIRPRKAH

SEQ ID NO: 180957 - protein, 11 aa, Yellow fever virus
PMEIRPMKTSD

SEQ ID NO: 180958 - protein, 11 aa, Yellow fever virus
MEIRPRKAHES

SEQ ID NO: 180959 - protein, 11 aa, Yellow fever virus
EIRPMKTSDSH

SEQ ID NO: 180960 - protein, 11 aa, Yellow fever virus
IRPRKAHESHL

SEQ ID NO: 180961 - protein, 11 aa, Yellow fever virus
RPMKTSDSHLV

SEQ ID NO: 180962 - protein, 11 aa, Yellow fever virus
PMKTSDSHLVR

SEQ ID NO: 180963 - protein, 11 aa, Yellow fever virus
MKTSDSHLVRS

SEQ ID NO: 180964 - protein, 11 aa, Yellow fever virus
QGPKQVLVGGV

SEQ ID NO: 180965 - protein, 11 aa, Yellow fever virus
GPKQMLVGGMV

SEQ ID NO: 180966 - protein, 11 aa, Yellow fever virus
PKQMLVGGMVL

SEQ ID NO: 180967 - protein, 11 aa, Yellow fever virus
KQVLVGGVVLL

SEQ ID NO: 180968 - protein, 11 aa, Yellow fever virus
QVLVGGVVLLG

SEQ ID NO: 180969 - protein, 11 aa, Yellow fever virus
VLVGGVVLLGA

SEQ ID NO: 180970 - protein, 11 aa, Yellow fever virus
VGQVTLLDLLE

SEQ ID NO: 180971 - protein, 11 aa, Yellow fever virus
FVVAVGLHFHE

SEQ ID NO: 180972 - protein, 11 aa, Yellow fever virus
IVAVGLHFHEM

SEQ ID NO: 180973 - protein, 11 aa, Yellow fever virus
ASFSIRPGLLM

SEQ ID NO: 180974 - protein, 11 aa, Yellow fever virus
SFSIRPGLLVG

SEQ ID NO: 180975 - protein, 11 aa, Yellow fever virus
FSIRPGLLVGF

SEQ ID NO: 180976 - protein, 11 aa, Yellow fever virus
SIRPGLLMGFG

SEQ ID NO: 180977 - protein, 11 aa, Yellow fever virus
IRPGLLVGFGL

SEQ ID NO: 180978 - protein, 11 aa, Yellow fever virus
VMAFGAAMVEI

SEQ ID NO: 180979 - protein, 11 aa, Yellow fever virus
MAFGAAMVEIA

SEQ ID NO: 180980 - protein, 11 aa, Yellow fever virus
AFGAAMVEIAL

SEQ ID NO: 180981 - protein, 11 aa, Yellow fever virus
NAVASRKASNA

SEQ ID NO: 180982 - protein, 11 aa, Yellow fever virus
AISSRKASNMI

SEQ ID NO: 180983 - protein, 11 aa, Yellow fever virus
ISSRKASNAVL

SEQ ID NO: 180984 - protein, 11 aa, Yellow fever virus
SSRKASNMILP

SEQ ID NO: 180985 - protein, 11 aa, Yellow fever virus
SRKASNAILPL

SEQ ID NO: 180986 - protein, 11 aa, Yellow fever virus
RKASNAVLPLM

SEQ ID NO: 180987 - protein, 11 aa, Yellow fever virus
KASNMILPLMA

SEQ ID NO: 180988 - protein, 11 aa, Yellow fever virus
ASNAILPLMAL

SEQ ID NO: 180989 - protein, 11 aa, Yellow fever virus
SNMILPLMALM

SEQ ID NO: 180990 - protein, 11 aa, Yellow fever virus
NAILPLMALLT

SEQ ID NO: 180991 - protein, 11 aa, Yellow fever virus
MILPLMALMTP

SEQ ID NO: 180992 - protein, 11 aa, Yellow fever virus
LMALLTPVTMY

SEQ ID NO: 180993 - protein, 11 aa, Yellow fever virus
MALMTPMTMHE

SEQ ID NO: 180994 - protein, 11 aa, Yellow fever virus
ALLTPVTMYEV

SEQ ID NO: 180995 - protein, 11 aa, Yellow fever virus
LMTPMTMHEVR

SEQ ID NO: 180996 - protein, 11 aa, Yellow fever virus
MTPMTMHEVRM

SEQ ID NO: 180997 - protein, 11 aa, Yellow fever virus
TPVTMHEVRMA

SEQ ID NO: 180998 - protein, 11 aa, Yellow fever virus
PMTMHEVRMAT

SEQ ID NO: 180999 - protein, 11 aa, Yellow fever virus
MTMHEVRMATM

SEQ ID NO: 181000 - protein, 11 aa, Yellow fever virus
TMHEVRMATML

SEQ ID NO: 181001 - protein, 11 aa, Yellow fever virus
MLFCTVVIVGV

SEQ ID NO: 181002 - protein, 11 aa, Yellow fever virus
LFCTVVIVGVL

SEQ ID NO: 181003 - protein, 11 aa, Yellow fever virus
FCTVVIIGVLY

SEQ ID NO: 181004 - protein, 11 aa, Yellow fever virus
CTVVIIGVLYQ

SEQ ID NO: 181005 - protein, 11 aa, Yellow fever virus
TVVIIGVLYQN

SEQ ID NO: 181006 - protein, 11 aa, Yellow fever virus
VVIVGVLHQNS

SEQ ID NO: 181007 - protein, 11 aa, Yellow fever virus
VIIGVLYQNSK

SEQ ID NO: 181008 - protein, 11 aa, Yellow fever virus
IVGVLHQNSKD

SEQ ID NO: 181009 - protein, 11 aa, Yellow fever virus
VGVLHQNAKDT

SEQ ID NO: 181010 - protein, 11 aa, Yellow fever virus
GVLHQNAKDTS

SEQ ID NO: 181011 - protein, 11 aa, Yellow fever virus
VLYQNSKDTSM

SEQ ID NO: 181012 - protein, 11 aa, Yellow fever virus
LHQNAKDTSMQ

SEQ ID NO: 181013 - protein, 11 aa, Yellow fever virus
YQNSKDTSMQK

SEQ ID NO: 181014 - protein, 11 aa, Yellow fever virus
GLELKKLGEVA

SEQ ID NO: 181015 - protein, 11 aa, Yellow fever virus
LELKKLGEVAW

SEQ ID NO: 181016 - protein, 11 aa, Yellow fever virus
ELKKLGEISWE

SEQ ID NO: 181017 - protein, 11 aa, Yellow fever virus
LKKLGEVAWEE

SEQ ID NO: 181018 - protein, 11 aa, Yellow fever virus
KKLGEVAWEEE

SEQ ID NO: 181019 - protein, 11 aa, Yellow fever virus
IHPSALLLVLA

SEQ ID NO: 181020 - protein, 11 aa, Yellow fever virus
FALLLVLGGWI

SEQ ID NO: 181021 - protein, 11 aa, Yellow fever virus
LVLGGWILHIK

SEQ ID NO: 181022 - protein, 11 aa, Yellow fever virus
VLGGWVLHIKG

SEQ ID NO: 181023 - protein, 11 aa, Yellow fever virus
LAGWLFHVRRA

SEQ ID NO: 181024 - protein, 11 aa, Yellow fever virus
AGWLFHVRRAR

SEQ ID NO: 181025 - protein, 11 aa, Yellow fever virus
GWLFHVRRARR

SEQ ID NO: 181026 - protein, 11 aa, Yellow fever virus
WVLHIKGARRS

SEQ ID NO: 181027 - protein, 11 aa, Yellow fever virus
VLHIKGARRSG

SEQ ID NO: 181028 - protein, 11 aa, Yellow fever virus
FHVRRARRSGD

SEQ ID NO: 181029 - protein, 11 aa, Yellow fever virus
HVRRARRSGDV

SEQ ID NO: 181030 - protein, 11 aa, Yellow fever virus
VRRARRSGDVL

SEQ ID NO: 181031 - protein, 11 aa, Yellow fever virus
VQLIAAVPGKS

SEQ ID NO: 181032 - protein, 11 aa, Yellow fever virus
QLIAAVPGKSV

SEQ ID NO: 181033 - protein, 11 aa, Yellow fever virus
LIAAVPGKSVV

SEQ ID NO: 181034 - protein, 11 aa, Yellow fever virus
IAAVPGKSVVN

SEQ ID NO: 181035 - protein, 11 aa, Yellow fever virus
AAVPGKSVVNV

SEQ ID NO: 181036 - protein, 11 aa, Yellow fever virus
AAPGKNVVNVQ

SEQ ID NO: 181037 - protein, 11 aa, Yellow fever virus
VPGKSVVNVQT

SEQ ID NO: 181038 - protein, 11 aa, Yellow fever virus
AVVNVQTKPSV

SEQ ID NO: 181039 - protein, 11 aa, Yellow fever virus
ELKEESKEELQ

SEQ ID NO: 181040 - protein, 11 aa, Yellow fever virus
LKEESKEELQE

SEQ ID NO: 181041 - protein, 11 aa, Yellow fever virus
EEGKEELQEIS

SEQ ID NO: 181042 - protein, 11 aa, Yellow fever virus
EGKEELQEIST

SEQ ID NO: 181043 - protein, 11 aa, Yellow fever virus
GKEELQEISTM

SEQ ID NO: 181044 - protein, 11 aa, Yellow fever virus
QEISTMLKKGM

SEQ ID NO: 181045 - protein, 11 aa, Yellow fever virus
STMLKKGMTTI

SEQ ID NO: 181046 - protein, 11 aa, Yellow fever virus
LKKGMTTILDY

SEQ ID NO: 181047 - protein, 11 aa, Yellow fever virus
KKGMTTILDYH

SEQ ID NO: 181048 - protein, 11 aa, Yellow fever virus
KGMTTILDYHP

SEQ ID NO: 181049 - protein, 11 aa, Yellow fever virus
GMTTILDYHPG

SEQ ID NO: 181050 - protein, 11 aa, Yellow fever virus
MTTILDYHPGA

SEQ ID NO: 181051 - protein, 11 aa, Yellow fever virus
VSRELVRNCDL

SEQ ID NO: 181052 - protein, 11 aa, Yellow fever virus
FRELVRNCDQP

SEQ ID NO: 181053 - protein, 11 aa, Yellow fever virus
VRNCDQPVWLS

SEQ ID NO: 181054 - protein, 11 aa, Yellow fever virus
RGCDLPVWLAW

SEQ ID NO: 181055 - protein, 11 aa, Yellow fever virus
GCDLPVWLAWQ

SEQ ID NO: 181056 - protein, 11 aa, Yellow fever virus
GPDEHEILNDS

SEQ ID NO: 181057 - protein, 11 aa, Yellow fever virus
PKEHEILNDSG

SEQ ID NO: 181058 - protein, 11 aa, Yellow fever virus
DEHEILNDSGE

SEQ ID NO: 181059 - protein, 11 aa, Yellow fever virus
VKCRTPGGAKK

SEQ ID NO: 181060 - protein, 11 aa, Yellow fever virus
KCRTPGGAKKP

SEQ ID NO: 181061 - protein, 11 aa, Yellow fever virus
CRAPGGAKRPL

SEQ ID NO: 181062 - protein, 11 aa, Yellow fever virus
RSPGGAKRALR

SEQ ID NO: 181063 - protein, 11 aa, Yellow fever virus
TPGGAKKPLRP

SEQ ID NO: 181064 - protein, 11 aa, Yellow fever virus
PGGAKRPLRPR

SEQ ID NO: 181065 - protein, 11 aa, Yellow fever virus
GGAKRPLRPRW

SEQ ID NO: 181066 - protein, 11 aa, Yellow fever virus
GAKRALRPRWC

SEQ ID NO: 181067 - protein, 11 aa, Yellow fever virus
AKRALRPRWCD

SEQ ID NO: 181068 - protein, 11 aa, Yellow fever virus
KRALRPRWCDE

SEQ ID NO: 181069 - protein, 11 aa, Yellow fever virus
RALRPRWCDER

SEQ ID NO: 181070 - protein, 11 aa, Yellow fever virus
FAEGRRGAAEI

SEQ ID NO: 181071 - protein, 11 aa, Yellow fever virus
AEGRRGAADVL

SEQ ID NO: 181072 - protein, 11 aa, Yellow fever virus
EGRRGAAEILV

SEQ ID NO: 181073 - protein, 11 aa, Yellow fever virus
GRRGAADVLVV

SEQ ID NO: 181074 - protein, 11 aa, Yellow fever virus
RRGAADVLVVL

SEQ ID NO: 181075 - protein, 11 aa, Yellow fever virus
RGAADVLVVLS

SEQ ID NO: 181076 - protein, 11 aa, Yellow fever virus
GAAEILVVLSE

SEQ ID NO: 181077 - protein, 11 aa, Yellow fever virus
AAEMLVILTEL

SEQ ID NO: 181078 - protein, 11 aa, Yellow fever virus
AEMLVILTELP

SEQ ID NO: 181079 - protein, 11 aa, Yellow fever virus
EILVVLSELPD

SEQ ID NO: 181080 - protein, 11 aa, Yellow fever virus
ILVVLSELPDF

SEQ ID NO: 181081 - protein, 11 aa, Yellow fever virus
CGYLMFLGGVE

SEQ ID NO: 181082 - protein, 11 aa, Yellow fever virus
GGVEPTHISYI

SEQ ID NO: 181083 - protein, 11 aa, Yellow fever virus
GAKPTHISYIM

SEQ ID NO: 181084 - protein, 11 aa, Yellow fever virus
AKPTHISYIML

SEQ ID NO: 181085 - protein, 11 aa, Yellow fever virus
VIIPEPGQQRS

SEQ ID NO: 181086 - protein, 11 aa, Yellow fever virus
IIPEPGQQRSI

SEQ ID NO: 181087 - protein, 11 aa, Yellow fever virus
LIIGILTLLSI

SEQ ID NO: 181088 - protein, 11 aa, Yellow fever virus
IIGILTLLSIV

SEQ ID NO: 181089 - protein, 11 aa, Yellow fever virus
IGILTLLSIVA

SEQ ID NO: 181090 - protein, 11 aa, Yellow fever virus
GILTLLSIVAA

SEQ ID NO: 181091 - protein, 11 aa, Yellow fever virus
ILTLLSIVAAN

SEQ ID NO: 181092 - protein, 11 aa, Yellow fever virus
LTLLSIVAANE

SEQ ID NO: 181093 - protein, 11 aa, Yellow fever virus
TLLSIVAANEL

SEQ ID NO: 181094 - protein, 11 aa, Yellow fever virus
LLSIVAANELG

SEQ ID NO: 181095 - protein, 11 aa, Yellow fever virus
LSIVAANELGM

SEQ ID NO: 181096 - protein, 11 aa, Yellow fever virus
LERTKEDLFGK

SEQ ID NO: 181097 - protein, 11 aa, Yellow fever virus
ERTKEDLFGKK

SEQ ID NO: 181098 - protein, 11 aa, Yellow fever virus
ISSSASPWSWP

SEQ ID NO: 181099 - protein, 11 aa, Yellow fever virus
PSGAIPWSWPD

SEQ ID NO: 181100 - protein, 11 aa, Yellow fever virus
SGASPWSWPDL

SEQ ID NO: 181101 - protein, 11 aa, Yellow fever virus
GAIPWSWPDLD

SEQ ID NO: 181102 - protein, 11 aa, Yellow fever virus
KMNISVIMLLI

SEQ ID NO: 181103 - protein, 11 aa, Yellow fever virus
MNISVIMLLIS

SEQ ID NO: 181104 - protein, 11 aa, Yellow fever virus
NISVIMLLISG

SEQ ID NO: 181105 - protein, 11 aa, Yellow fever virus
ISVIMLLISGW

SEQ ID NO: 181106 - protein, 11 aa, Yellow fever virus
SVIMLLISGWN

SEQ ID NO: 181107 - protein, 11 aa, Yellow fever virus
VIMLLISGWNS

SEQ ID NO: 181108 - protein, 11 aa, Yellow fever virus
IMLLISGWNSI

SEQ ID NO: 181109 - protein, 11 aa, Yellow fever virus
IPLLCGIGGAM

SEQ ID NO: 181110 - protein, 11 aa, Yellow fever virus
PLLCGIGGAML

SEQ ID NO: 181111 - protein, 11 aa, Yellow fever virus
LLCGIGGAMLH

SEQ ID NO: 181112 - protein, 11 aa, Yellow fever virus
LCGIGCATLHW

SEQ ID NO: 181113 - protein, 11 aa, Yellow fever virus
CGIGCATLHWS

SEQ ID NO: 181114 - protein, 11 aa, Yellow fever virus
GIGCATLHWSL

SEQ ID NO: 181115 - protein, 11 aa, Yellow fever virus
IGGAMLHWTLI

SEQ ID NO: 181116 - protein, 11 aa, Yellow fever virus
GCATLHWSLIL

SEQ ID NO: 181117 - protein, 11 aa, Yellow fever virus
CAMLHWTLILP

SEQ ID NO: 181118 - protein, 11 aa, Yellow fever virus
PQRRVFHGVAK

SEQ ID NO: 181119 - protein, 11 aa, Yellow fever virus
DEGIVLASAAL

SEQ ID NO: 181120 - protein, 11 aa, Yellow fever virus
VAYNLWKMKTA

SEQ ID NO: 181121 - protein, 11 aa, Yellow fever virus
AYNLWKMKTAR

SEQ ID NO: 181122 - protein, 11 aa, Yellow fever virus
YNLWKMKTERR

SEQ ID NO: 181123 - protein, 11 aa, Yellow fever virus
NLWKMKTERRG

SEQ ID NO: 181124 - protein, 11 aa, Yellow fever virus
RRGTANGKTLG

SEQ ID NO: 181125 - protein, 11 aa, Yellow fever virus
RGTANGKTLGE

SEQ ID NO: 181126 - protein, 11 aa, Yellow fever virus
GTANGKTLGEV

SEQ ID NO: 181127 - protein, 11 aa, Yellow fever virus
TANGKTLGEVW

SEQ ID NO: 181128 - protein, 11 aa, Yellow fever virus
LNLLDRQQFEL

SEQ ID NO: 181129 - protein, 11 aa, Yellow fever virus
NLLDKQQFEMY

SEQ ID NO: 181130 - protein, 11 aa, Yellow fever virus
LLDKQQFEMYK

SEQ ID NO: 181131 - protein, 11 aa, Yellow fever virus
LDRQQFELYKR

SEQ ID NO: 181132 - protein, 11 aa, Yellow fever virus
DRQQFELYKRT

SEQ ID NO: 181133 - protein, 11 aa, Yellow fever virus
KQQFEMYKRTD

SEQ ID NO: 181134 - protein, 11 aa, Yellow fever virus
NIITFKDKTDV

SEQ ID NO: 181135 - protein, 11 aa, Yellow fever virus
IITFKDKTDVH

SEQ ID NO: 181136 - protein, 11 aa, Yellow fever virus
VTFKDKTDVHR

SEQ ID NO: 181137 - protein, 11 aa, Yellow fever virus
TFKDKTDVHPL

SEQ ID NO: 181138 - protein, 11 aa, Yellow fever virus
FKDKTDIHHLE

SEQ ID NO: 181139 - protein, 11 aa, Yellow fever virus
KDKTDVHRLEP

SEQ ID NO: 181140 - protein, 11 aa, Yellow fever virus
LEPLKCETLLC

SEQ ID NO: 181141 - protein, 11 aa, Yellow fever virus
EPLKCETLLCD

SEQ ID NO: 181142 - protein, 11 aa, Yellow fever virus
SVKCDTLLCDI

SEQ ID NO: 181143 - protein, 11 aa, Yellow fever virus
MKCDTLLCDIG

SEQ ID NO: 181144 - protein, 11 aa, Yellow fever virus
CDIGESSSSSI

SEQ ID NO: 181145 - protein, 11 aa, Yellow fever virus
DIGESSSSSIT

SEQ ID NO: 181146 - protein, 11 aa, Yellow fever virus
IGESSPSSATE

SEQ ID NO: 181147 - protein, 11 aa, Yellow fever virus
GESSPSSATEG

SEQ ID NO: 181148 - protein, 11 aa, Yellow fever virus
ESSPSSATEGE

SEQ ID NO: 181149 - protein, 11 aa, Yellow fever virus
SSPSSATEGER

SEQ ID NO: 181150 - protein, 11 aa, Yellow fever virus
SPSSATEGERT

SEQ ID NO: 181151 - protein, 11 aa, Yellow fever virus
SSSITEGERTV

SEQ ID NO: 181152 - protein, 11 aa, Yellow fever virus
SSITEGERTVR

SEQ ID NO: 181153 - protein, 11 aa, Yellow fever virus
SATEGERTLRV

SEQ ID NO: 181154 - protein, 11 aa, Yellow fever virus
ITEGERTVRVL

SEQ ID NO: 181155 - protein, 11 aa, Yellow fever virus
TEGERTLRVLD

SEQ ID NO: 181156 - protein, 11 aa, Yellow fever virus
EGERTLRVLDT

SEQ ID NO: 181157 - protein, 11 aa, Yellow fever virus
GERTLRVLDTV

SEQ ID NO: 181158 - protein, 11 aa, Yellow fever virus
ERTLRVLETIE

SEQ ID NO: 181159 - protein, 11 aa, Yellow fever virus
RTLRVLETVEK

SEQ ID NO: 181160 - protein, 11 aa, Yellow fever virus
TLRVLETIEKW

SEQ ID NO: 181161 - protein, 11 aa, Yellow fever virus
LRVLETVEKWL

SEQ ID NO: 181162 - protein, 11 aa, Yellow fever virus
GAIEERVERIK

SEQ ID NO: 181163 - protein, 11 aa, Yellow fever virus
AIEERVERIKN

SEQ ID NO: 181164 - protein, 11 aa, Yellow fever virus
IKERVERIKSE

SEQ ID NO: 181165 - protein, 11 aa, Yellow fever virus
EERVERIKNEY

SEQ ID NO: 181166 - protein, 11 aa, Yellow fever virus
VERIKNEYATT

SEQ ID NO: 181167 - protein, 11 aa, Yellow fever virus
ERIKNEYATTW

SEQ ID NO: 181168 - protein, 11 aa, Yellow fever virus
RIKNEYATTWF

SEQ ID NO: 181169 - protein, 11 aa, Yellow fever virus
IKTEYAATWFY

SEQ ID NO: 181170 - protein, 11 aa, Yellow fever virus
KTEYAATWFYD

SEQ ID NO: 181171 - protein, 11 aa, Yellow fever virus
TEYAATWFYDN

SEQ ID NO: 181172 - protein, 11 aa, Yellow fever virus
EYATTWFYDND

SEQ ID NO: 181173 - protein, 11 aa, Yellow fever virus
YAATWFYDNDN

SEQ ID NO: 181174 - protein, 11 aa, Yellow fever virus
AATWFHDNDNP

SEQ ID NO: 181175 - protein, 11 aa, Yellow fever virus
ATWFHDNDNPY

SEQ ID NO: 181176 - protein, 11 aa, Yellow fever virus
VIKLLTYPWDK

SEQ ID NO: 181177 - protein, 11 aa, Yellow fever virus
IKILTYPWDKI

SEQ ID NO: 181178 - protein, 11 aa, Yellow fever virus
KLLTYPWDKIE

SEQ ID NO: 181179 - protein, 11 aa, Yellow fever virus
ILTYPWDKIEE

SEQ ID NO: 181180 - protein, 11 aa, Yellow fever virus
WLFRHLAREKK

SEQ ID NO: 181181 - protein, 11 aa, Yellow fever virus
LFRHLAREKKP

SEQ ID NO: 181182 - protein, 11 aa, Yellow fever virus
FRHLAREKKPR

SEQ ID NO: 181183 - protein, 11 aa, Yellow fever virus
RHLAREKKPRL

SEQ ID NO: 181184 - protein, 11 aa, Yellow fever virus
HLAREKKPRLC

SEQ ID NO: 181185 - protein, 11 aa, Yellow fever virus
LSREKNPRLCT

SEQ ID NO: 181186 - protein, 11 aa, Yellow fever virus
AREKKPRLCTK

SEQ ID NO: 181187 - protein, 11 aa, Yellow fever virus
AAIGAYLEEQD

SEQ ID NO: 181188 - protein, 11 aa, Yellow fever virus
AIGAFLEEQEQ

SEQ ID NO: 181189 - protein, 11 aa, Yellow fever virus
IGAFLEEQEQW

SEQ ID NO: 181190 - protein, 11 aa, Yellow fever virus
RDLSAKEGGGF

SEQ ID NO: 181191 - protein, 11 aa, Yellow fever virus
DLAAMDGGGLY

SEQ ID NO: 181192 - protein, 11 aa, Yellow fever virus
LSAKEGGGFYA

SEQ ID NO: 181193 - protein, 11 aa, Yellow fever virus
AAMDGGGLYAD

SEQ ID NO: 181194 - protein, 11 aa, Yellow fever virus
AMDGGGLYADD

SEQ ID NO: 181195 - protein, 11 aa, Yellow fever virus
DEQEIMSYMSP

SEQ ID NO: 181196 - protein, 11 aa, Yellow fever virus
EQEILNYMSSH

SEQ ID NO: 181197 - protein, 11 aa, Yellow fever virus
QEIMSYMSPEQ

SEQ ID NO: 181198 - protein, 11 aa, Yellow fever virus
EILNYMSSHHK

SEQ ID NO: 181199 - protein, 11 aa, Yellow fever virus
ILNYMSSHHKK

SEQ ID NO: 181200 - protein, 11 aa, Yellow fever virus
LNYMSSHHKKL

SEQ ID NO: 181201 - protein, 11 aa, Yellow fever virus
NYMSSHHKKLA

SEQ ID NO: 181202 - protein, 11 aa, Yellow fever virus
YMSPEQRKLAW

SEQ ID NO: 181203 - protein, 11 aa, Yellow fever virus
MSPEQRKLAWA

SEQ ID NO: 181204 - protein, 11 aa, Yellow fever virus
SPEQRKLAWAI

SEQ ID NO: 181205 - protein, 11 aa, Yellow fever virus
PEQRKLAWAIM

SEQ ID NO: 181206 - protein, 11 aa, Yellow fever virus
MAEAEMVIHHH

SEQ ID NO: 181207 - protein, 11 aa, Yellow fever virus
AEAENVIHHQH

SEQ ID NO: 181208 - protein, 11 aa, Yellow fever virus
EAENVIHHQHV

SEQ ID NO: 181209 - protein, 11 aa, Yellow fever virus
AEMVIHHHHVQ

SEQ ID NO: 181210 - protein, 11 aa, Yellow fever virus
EMVINHQHVQE

SEQ ID NO: 181211 - protein, 11 aa, Yellow fever virus
MVIHHHHVQDC

SEQ ID NO: 181212 - protein, 11 aa, Yellow fever virus
VIHHHHVQDCD

SEQ ID NO: 181213 - protein, 11 aa, Yellow fever virus
IHHHHVQDCDD

SEQ ID NO: 181214 - protein, 11 aa, Yellow fever virus
HHHHVQDCDDS

SEQ ID NO: 181215 - protein, 11 aa, Yellow fever virus
LVRLEAWLIEH

SEQ ID NO: 181216 - protein, 11 aa, Yellow fever virus
VRLEAWLIEHG

SEQ ID NO: 181217 - protein, 11 aa, Yellow fever virus
RLETWLAENGC

SEQ ID NO: 181218 - protein, 11 aa, Yellow fever virus
LEAWLIEHGCD

SEQ ID NO: 181219 - protein, 11 aa, Yellow fever virus
EAWLIEHGCDR

SEQ ID NO: 181220 - protein, 11 aa, Yellow fever virus
AWLIEHGCDRL

SEQ ID NO: 181221 - protein, 11 aa, Yellow fever virus
RLNRMAVNGDD

SEQ ID NO: 181222 - protein, 11 aa, Yellow fever virus
LSRMAVSGDDC

SEQ ID NO: 181223 - protein, 11 aa, Yellow fever virus
NRMAVNGDDCV

SEQ ID NO: 181224 - protein, 11 aa, Yellow fever virus
VSGDDCVVKPV

SEQ ID NO: 181225 - protein, 11 aa, Yellow fever virus
SGDDCVVKPVD

SEQ ID NO: 181226 - protein, 11 aa, Yellow fever virus
VVRPIDDRFGM

SEQ ID NO: 181227 - protein, 11 aa, Yellow fever virus
VRPIDDRFGMA

SEQ ID NO: 181228 - protein, 11 aa, Yellow fever virus
KPVDDRFGLAL

SEQ ID NO: 181229 - protein, 11 aa, Yellow fever virus
QPSKGWTDWEN

SEQ ID NO: 181230 - protein, 11 aa, Yellow fever virus
PSKGWTDWESV

SEQ ID NO: 181231 - protein, 11 aa, Yellow fever virus
SKEWTDWENVP

SEQ ID NO: 181232 - protein, 11 aa, Yellow fever virus
KGWTDWESVPF

SEQ ID NO: 181233 - protein, 11 aa, Yellow fever virus
EWTDWENVPFC

SEQ ID NO: 181234 - protein, 11 aa, Yellow fever virus
PFCSHRFHELQ

SEQ ID NO: 181235 - protein, 11 aa, Yellow fever virus
FCSHRFHELQL

SEQ ID NO: 181236 - protein, 11 aa, Yellow fever virus
CSHRFHELQLK

SEQ ID NO: 181237 - protein, 11 aa, Yellow fever virus
SHRFHELQLKD

SEQ ID NO: 181238 - protein, 11 aa, Yellow fever virus
HRFHELQLKDG

SEQ ID NO: 181239 - protein, 11 aa, Yellow fever virus
RFHELQLKDGR

SEQ ID NO: 181240 - protein, 11 aa, Yellow fever virus
HELVLKDGRKI

SEQ ID NO: 181241 - protein, 11 aa, Yellow fever virus
ELVLKDGRKIV

SEQ ID NO: 181242 - protein, 11 aa, Yellow fever virus
LVLKDGRKIVV

SEQ ID NO: 181243 - protein, 11 aa, Yellow fever virus
VLKDGRKIVVP

SEQ ID NO: 181244 - protein, 11 aa, Yellow fever virus
VHGKGEWMTTE

SEQ ID NO: 181245 - protein, 11 aa, Yellow fever virus
GKGEWMTTEDR

SEQ ID NO: 181246 - protein, 11 aa, Yellow fever virus
KGEWMTTEDRL

SEQ ID NO: 181247 - protein, 11 aa, Yellow fever virus
GEWMTTEDRLE

SEQ ID NO: 181248 - protein, 11 aa, Yellow fever virus
EWMTTQDMLDV

SEQ ID NO: 181249 - protein, 11 aa, Yellow fever virus
WMTTQDMLDVW

SEQ ID NO: 181250 - protein, 11 aa, Yellow fever virus
MTTEDRLEVWN

SEQ ID NO: 181251 - protein, 11 aa, Yellow fever virus
TTEDRLEVWNR

SEQ ID NO: 181252 - protein, 11 aa, Yellow fever virus
TEDRLEVWNRV

SEQ ID NO: 181253 - protein, 11 aa, Yellow fever virus
QDMLDVWNRVW

SEQ ID NO: 181254 - protein, 11 aa, Yellow fever virus
DRLEVWNRVWI

SEQ ID NO: 181255 - protein, 11 aa, Yellow fever virus
RLEVWNRVWIT

SEQ ID NO: 181256 - protein, 11 aa, Yellow fever virus
LNNPHMTDKTT

SEQ ID NO: 181257 - protein, 11 aa, Yellow fever virus
NNPHMTDKTTI

SEQ ID NO: 181258 - protein, 11 aa, Yellow fever virus
NPHMTDKTTIK

SEQ ID NO: 181259 - protein, 11 aa, Yellow fever virus
PHMKDKTTVKE

SEQ ID NO: 181260 - protein, 11 aa, Yellow fever virus
HMKDKTTVKEW

SEQ ID NO: 181261 - protein, 11 aa, Yellow fever virus
MKDKTTVKEWR

SEQ ID NO: 181262 - protein, 11 aa, Yellow fever virus
KDKTTVKEWRD

SEQ ID NO: 181263 - protein, 11 aa, Yellow fever virus
DKTTVKEWRDV

SEQ ID NO: 181264 - protein, 11 aa, Yellow fever virus
KTTVKEWRDVP

SEQ ID NO: 181265 - protein, 11 aa, Yellow fever virus
TTVKEWRDVPY

SEQ ID NO: 181266 - protein, 11 aa, Yellow fever virus
TVKEWRDVPYL

SEQ ID NO: 181267 - protein, 11 aa, Yellow fever virus
RIRNLIGQEKY

SEQ ID NO: 181268 - protein, 11 aa, Yellow fever virus
IRTLIGQEKFT

SEQ ID NO: 181269 - protein, 11 aa, Yellow fever virus
RTLIGQEKFTD

SEQ ID NO: 181270 - protein, 11 aa, Yellow fever virus
NLIGQEKYTDY

SEQ ID NO: 181271 - protein, 11 aa, Yellow fever virus
TVQLLILGMIL

SEQ ID NO: 181272 - protein, 11 aa, Yellow fever virus
GGGVTLVRKNR

SEQ ID NO: 181273 - protein, 11 aa, Yellow fever virus
TSEDLGKTFSM

SEQ ID NO: 181274 - protein, 11 aa, Yellow fever virus
AEDLGKTFSLG

SEQ ID NO: 181275 - protein, 11 aa, Yellow fever virus
EDLGKTFSMGT

SEQ ID NO: 181276 - protein, 11 aa, Yellow fever virus
DLGKTFSVGAG

SEQ ID NO: 181277 - protein, 11 aa, Yellow fever virus
LGKTFSLGTGN

SEQ ID NO: 181278 - protein, 11 aa, Yellow fever virus
GKTFSIGTGNC

SEQ ID NO: 181279 - protein, 11 aa, Yellow fever virus
KTFSMGTGNCT

SEQ ID NO: 181280 - protein, 11 aa, Yellow fever virus
TFSVGAGNCTT

SEQ ID NO: 181281 - protein, 11 aa, Yellow fever virus
FSVGAGNCTTN

SEQ ID NO: 181282 - protein, 11 aa, Yellow fever virus
SLGTGNCTTNI

SEQ ID NO: 181283 - protein, 11 aa, Yellow fever virus
MGTGNCTTNIL

SEQ ID NO: 181284 - protein, 11 aa, Yellow fever virus
LAIAYLVGSNM

SEQ ID NO: 181285 - protein, 11 aa, Yellow fever virus
AIAYLVGNNKT

SEQ ID NO: 181286 - protein, 11 aa, Yellow fever virus
ETVAIDGPVEA

SEQ ID NO: 181287 - protein, 11 aa, Yellow fever virus
GPVEARKVCYN

SEQ ID NO: 181288 - protein, 11 aa, Yellow fever virus
VGAKQENWKTD

SEQ ID NO: 181289 - protein, 11 aa, Yellow fever virus
GAKQEDWKTDI

SEQ ID NO: 181290 - protein, 11 aa, Yellow fever virus
AKQEDWKTDIK

SEQ ID NO: 181291 - protein, 11 aa, Yellow fever virus
KQENWKTDIKT

SEQ ID NO: 181292 - protein, 11 aa, Yellow fever virus
QENWKTDIKTL

SEQ ID NO: 181293 - protein, 11 aa, Yellow fever virus
ENWKTDIKTLK

SEQ ID NO: 181294 - protein, 11 aa, Yellow fever virus
DWKTDIKTLKF

SEQ ID NO: 181295 - protein, 11 aa, Yellow fever virus
KTDIKTLKFDA

SEQ ID NO: 181296 - protein, 11 aa, Yellow fever virus
DTSCDGRGKST

SEQ ID NO: 181297 - protein, 11 aa, Yellow fever virus
TGCDGRGKSTR

SEQ ID NO: 181298 - protein, 11 aa, Yellow fever virus
FTVAVGLHFHE

SEQ ID NO: 181299 - protein, 11 aa, Yellow fever virus
TMAVGLHFHEM

SEQ ID NO: 181300 - protein, 11 aa, Yellow fever virus
ASFSIRPGLLI

SEQ ID NO: 181301 - protein, 11 aa, Yellow fever virus
SFSIRPGLLMG

SEQ ID NO: 181302 - protein, 11 aa, Yellow fever virus
NAISSRKASNM

SEQ ID NO: 181303 - protein, 11 aa, Yellow fever virus
AVASRKASNAI

SEQ ID NO: 181304 - protein, 11 aa, Yellow fever virus
ISSRKASNMIL

SEQ ID NO: 181305 - protein, 11 aa, Yellow fever virus
ASRKASNAILP

SEQ ID NO: 181306 - protein, 11 aa, Yellow fever virus
PVTMHEVRMAT

SEQ ID NO: 181307 - protein, 11 aa, Yellow fever virus
VTMYEVRMATM

SEQ ID NO: 181308 - protein, 11 aa, Yellow fever virus
TMYEVRMATML

SEQ ID NO: 181309 - protein, 11 aa, Yellow fever virus
MLLCAVVIIGV

SEQ ID NO: 181310 - protein, 11 aa, Yellow fever virus
LLCAVVIIGVL

SEQ ID NO: 181311 - protein, 11 aa, Yellow fever virus
LCAVVIIGVLH

SEQ ID NO: 181312 - protein, 11 aa, Yellow fever virus
VVIIGVLYQNS

SEQ ID NO: 181313 - protein, 11 aa, Yellow fever virus
VIVGVLHQNSK

SEQ ID NO: 181314 - protein, 11 aa, Yellow fever virus
IVGVLHQNAKD

SEQ ID NO: 181315 - protein, 11 aa, Yellow fever virus
VGVLHQNSKDT

SEQ ID NO: 181316 - protein, 11 aa, Yellow fever virus
VLGGWILHIKG

SEQ ID NO: 181317 - protein, 11 aa, Yellow fever virus
LGGWILHIKGA

SEQ ID NO: 181318 - protein, 11 aa, Yellow fever virus
GGWILHIKGAR

SEQ ID NO: 181319 - protein, 11 aa, Yellow fever virus
GWILHIKGARR

SEQ ID NO: 181320 - protein, 11 aa, Yellow fever virus
WILHIKGARRS

SEQ ID NO: 181321 - protein, 11 aa, Yellow fever virus
ILHIKGARRSG

SEQ ID NO: 181322 - protein, 11 aa, Yellow fever virus
VKCRSPGGAKR

SEQ ID NO: 181323 - protein, 11 aa, Yellow fever virus
KCRAPGGAKRP

SEQ ID NO: 181324 - protein, 11 aa, Yellow fever virus
CRSPGGAKRAL

SEQ ID NO: 181325 - protein, 11 aa, Yellow fever virus
RAPGGAKRPLR

SEQ ID NO: 181326 - protein, 11 aa, Yellow fever virus
APGGAKRPLRP

SEQ ID NO: 181327 - protein, 11 aa, Yellow fever virus
GRRGAAEILVV

SEQ ID NO: 181328 - protein, 11 aa, Yellow fever virus
RRGAAEILVVL

SEQ ID NO: 181329 - protein, 11 aa, Yellow fever virus
RGAAEMLVILT

SEQ ID NO: 181330 - protein, 11 aa, Yellow fever virus
GAAEMLVILTE

SEQ ID NO: 181331 - protein, 11 aa, Yellow fever virus
AAEILVVLSEL

SEQ ID NO: 181332 - protein, 11 aa, Yellow fever virus
ADVLVVLSELP

SEQ ID NO: 181333 - protein, 11 aa, Yellow fever virus
DVLVVLSELPD

SEQ ID NO: 181334 - protein, 11 aa, Yellow fever virus
TPSGAIPWSWP

SEQ ID NO: 181335 - protein, 11 aa, Yellow fever virus
SSSASPWSWPD

SEQ ID NO: 181336 - protein, 11 aa, Yellow fever virus
CGIGCAMLHWT

SEQ ID NO: 181337 - protein, 11 aa, Yellow fever virus
GIGGAMLHWTL

SEQ ID NO: 181338 - protein, 11 aa, Yellow fever virus
IGCAMLHWTLI

SEQ ID NO: 181339 - protein, 11 aa, Yellow fever virus
ITFKDKTDIHH

SEQ ID NO: 181340 - protein, 11 aa, Yellow fever virus
KDKTDVHPLEP

SEQ ID NO: 181341 - protein, 11 aa, Yellow fever virus
LESVKCDTLLC

SEQ ID NO: 181342 - protein, 11 aa, Yellow fever virus
EPMKCDTLLCD

SEQ ID NO: 181343 - protein, 11 aa, Yellow fever virus
PLKCETLLCDI

SEQ ID NO: 181344 - protein, 11 aa, Yellow fever virus
PSSATEGERTL

SEQ ID NO: 181345 - protein, 11 aa, Yellow fever virus
SSATEGERTLR

SEQ ID NO: 181346 - protein, 11 aa, Yellow fever virus
SITEGERTVRV

SEQ ID NO: 181347 - protein, 11 aa, Yellow fever virus
ATEGERTLRVL

SEQ ID NO: 181348 - protein, 11 aa, Yellow fever virus
GERTLRVLETI

SEQ ID NO: 181349 - protein, 11 aa, Yellow fever virus
ERTLRVLETVE

SEQ ID NO: 181350 - protein, 11 aa, Yellow fever virus
RTLRVLETIEK

SEQ ID NO: 181351 - protein, 11 aa, Yellow fever virus
TLRVLETVEKW

SEQ ID NO: 181352 - protein, 11 aa, Yellow fever virus
LRVLDTVEKWL

SEQ ID NO: 181353 - protein, 11 aa, Yellow fever virus
IKTEYAATWFH

SEQ ID NO: 181354 - protein, 11 aa, Yellow fever virus
KTEYAATWFHD

SEQ ID NO: 181355 - protein, 11 aa, Yellow fever virus
NEYATTWFYDN

SEQ ID NO: 181356 - protein, 11 aa, Yellow fever virus
EYAATWFHDND

SEQ ID NO: 181357 - protein, 11 aa, Yellow fever virus
YATTWFYDNDN

SEQ ID NO: 181358 - protein, 11 aa, Yellow fever virus
AATWFYDNDNP

SEQ ID NO: 181359 - protein, 11 aa, Yellow fever virus
AENVIHHQHVQ

SEQ ID NO: 181360 - protein, 11 aa, Yellow fever virus
EMVIHHHHVQD

SEQ ID NO: 181361 - protein, 11 aa, Yellow fever virus
MVINHQHVQEC

SEQ ID NO: 181362 - protein, 11 aa, Yellow fever virus
NHQHVQECGEN

SEQ ID NO: 181363 - protein, 11 aa, Yellow fever virus
LERLETWLAEN

SEQ ID NO: 181364 - protein, 11 aa, Yellow fever virus
ERLETWLAENG

SEQ ID NO: 181365 - protein, 11 aa, Yellow fever virus
LETWLAENGCD

SEQ ID NO: 181366 - protein, 11 aa, Yellow fever virus
ETWLAENGCDR

SEQ ID NO: 181367 - protein, 11 aa, Yellow fever virus
TWLAENGCDRL

SEQ ID NO: 181368 - protein, 11 aa, Yellow fever virus
RLSRMAVSGDD

SEQ ID NO: 181369 - protein, 11 aa, Yellow fever virus
LNRMAVNGDDC

SEQ ID NO: 181370 - protein, 11 aa, Yellow fever virus
SRMAVSGDDCV

SEQ ID NO: 181371 - protein, 11 aa, Yellow fever virus
GEWMTTQDMLD

SEQ ID NO: 181372 - protein, 11 aa, Yellow fever virus
EWMTTEDRLEV

SEQ ID NO: 181373 - protein, 11 aa, Yellow fever virus
WMTTEDRLEVW

SEQ ID NO: 181374 - protein, 11 aa, Yellow fever virus
MTTQDMLDVWN

SEQ ID NO: 181375 - protein, 11 aa, Yellow fever virus
TTQDMLDVWNR

SEQ ID NO: 181376 - protein, 11 aa, Yellow fever virus
TQDMLDVWNRV

SEQ ID NO: 181377 - protein, 11 aa, Yellow fever virus
EDRLEVWNRVW

SEQ ID NO: 181378 - protein, 11 aa, Yellow fever virus
PHMTDKTTIKE

SEQ ID NO: 181379 - protein, 11 aa, Yellow fever virus
HMTDKTTIKEW

SEQ ID NO: 181380 - protein, 11 aa, Yellow fever virus
MTDKTTIKEWR

SEQ ID NO: 181381 - protein, 11 aa, Yellow fever virus
TDKTTIKEWRD

SEQ ID NO: 181382 - protein, 11 aa, Yellow fever virus
DKTTIKEWRDV

SEQ ID NO: 181383 - protein, 11 aa, Yellow fever virus
KTTIKEWRDVP

SEQ ID NO: 181384 - protein, 11 aa, Yellow fever virus
TTIKEWRDVPY

SEQ ID NO: 181385 - protein, 11 aa, Yellow fever virus
TIKEWRDVPYL

SEQ ID NO: 181386 - protein, 9 aa, Tick-borne encephalitis virus
MAGKAILKG

SEQ ID NO: 181387 - protein, 9 aa, Tick-borne encephalitis virus
AGKAILKGK

SEQ ID NO: 181388 - protein, 9 aa, Tick-borne encephalitis virus
GKAILKGKG

SEQ ID NO: 181389 - protein, 9 aa, Tick-borne encephalitis virus
KAILKGKGG

SEQ ID NO: 181390 - protein, 9 aa, Tick-borne encephalitis virus
AILKGKGGG

SEQ ID NO: 181391 - protein, 9 aa, Tick-borne encephalitis virus
ILKGKGGGP

SEQ ID NO: 181392 - protein, 9 aa, Tick-borne encephalitis virus
LKGKGGGPP

SEQ ID NO: 181393 - protein, 9 aa, Tick-borne encephalitis virus
KGKGGGPPR

SEQ ID NO: 181394 - protein, 9 aa, Tick-borne encephalitis virus
GKGGGPPRR

SEQ ID NO: 181395 - protein, 9 aa, Tick-borne encephalitis virus
KGGGPPRRV

SEQ ID NO: 181396 - protein, 9 aa, Tick-borne encephalitis virus
GGGPPRRVS

SEQ ID NO: 181397 - protein, 9 aa, Tick-borne encephalitis virus
GGPPRRVSK

SEQ ID NO: 181398 - protein, 9 aa, Tick-borne encephalitis virus
GPPRRVSKE

SEQ ID NO: 181399 - protein, 9 aa, Tick-borne encephalitis virus
PPRRVSKET

SEQ ID NO: 181400 - protein, 9 aa, Tick-borne encephalitis virus
PRRVSKETA

SEQ ID NO: 181401 - protein, 9 aa, Tick-borne encephalitis virus
RRVSKETAK

SEQ ID NO: 181402 - protein, 9 aa, Tick-borne encephalitis virus
RVSKETAKK

SEQ ID NO: 181403 - protein, 9 aa, Tick-borne encephalitis virus
VSKETAKKT

SEQ ID NO: 181404 - protein, 9 aa, Tick-borne encephalitis virus
SKETAKKTR

SEQ ID NO: 181405 - protein, 9 aa, Tick-borne encephalitis virus
KETAKKTRQ

SEQ ID NO: 181406 - protein, 9 aa, Tick-borne encephalitis virus
ETAKKTRQS

SEQ ID NO: 181407 - protein, 9 aa, Tick-borne encephalitis virus
TAKKTRQSR

SEQ ID NO: 181408 - protein, 9 aa, Tick-borne encephalitis virus
AKKTRQSRV

SEQ ID NO: 181409 - protein, 9 aa, Tick-borne encephalitis virus
KKTRQSRVQ

SEQ ID NO: 181410 - protein, 9 aa, Tick-borne encephalitis virus
KTRQSRVQM

SEQ ID NO: 181411 - protein, 9 aa, Tick-borne encephalitis virus
TRQSRVQMP

SEQ ID NO: 181412 - protein, 9 aa, Tick-borne encephalitis virus
RQSRVQMPN

SEQ ID NO: 181413 - protein, 9 aa, Tick-borne encephalitis virus
QSRVQMPNG

SEQ ID NO: 181414 - protein, 9 aa, Tick-borne encephalitis virus
SRVQMPNGL

SEQ ID NO: 181415 - protein, 9 aa, Tick-borne encephalitis virus
RVQMPNGLV

SEQ ID NO: 181416 - protein, 9 aa, Tick-borne encephalitis virus
VQMPNGLVL

SEQ ID NO: 181417 - protein, 9 aa, Tick-borne encephalitis virus
QMPNGLVLM

SEQ ID NO: 181418 - protein, 9 aa, Tick-borne encephalitis virus
MPNGLVLMR

SEQ ID NO: 181419 - protein, 9 aa, Tick-borne encephalitis virus
PNGLVLMRM

SEQ ID NO: 181420 - protein, 9 aa, Tick-borne encephalitis virus
NGLVLMRMM

SEQ ID NO: 181421 - protein, 9 aa, Tick-borne encephalitis virus
GLVLMRMMG

SEQ ID NO: 181422 - protein, 9 aa, Tick-borne encephalitis virus
LVLMRMMGI

SEQ ID NO: 181423 - protein, 9 aa, Tick-borne encephalitis virus
VLMRMMGIL

SEQ ID NO: 181424 - protein, 9 aa, Tick-borne encephalitis virus
LMRMMGILW

SEQ ID NO: 181425 - protein, 9 aa, Tick-borne encephalitis virus
MRMMGILWH

SEQ ID NO: 181426 - protein, 9 aa, Tick-borne encephalitis virus
RMMGILWHA

SEQ ID NO: 181427 - protein, 9 aa, Tick-borne encephalitis virus
MMGILWHAV

SEQ ID NO: 181428 - protein, 9 aa, Tick-borne encephalitis virus
MGILWHAVA

SEQ ID NO: 181429 - protein, 9 aa, Tick-borne encephalitis virus
GILWHAVAG

SEQ ID NO: 181430 - protein, 9 aa, Tick-borne encephalitis virus
ILWHAVAGT

SEQ ID NO: 181431 - protein, 9 aa, Tick-borne encephalitis virus
LWHAVAGTA

SEQ ID NO: 181432 - protein, 9 aa, Tick-borne encephalitis virus
WHAVAGTAR

SEQ ID NO: 181433 - protein, 9 aa, Tick-borne encephalitis virus
HAVAGTARS

SEQ ID NO: 181434 - protein, 9 aa, Tick-borne encephalitis virus
AVAGTARSP

SEQ ID NO: 181435 - protein, 9 aa, Tick-borne encephalitis virus
VAGTARSPV

SEQ ID NO: 181436 - protein, 9 aa, Tick-borne encephalitis virus
AGTARSPVL

SEQ ID NO: 181437 - protein, 9 aa, Tick-borne encephalitis virus
GTARSPVLK

SEQ ID NO: 181438 - protein, 9 aa, Tick-borne encephalitis virus
TARSPVLKS

SEQ ID NO: 181439 - protein, 9 aa, Tick-borne encephalitis virus
ARSPVLKSF

SEQ ID NO: 181440 - protein, 9 aa, Tick-borne encephalitis virus
RSPVLKSFW

SEQ ID NO: 181441 - protein, 9 aa, Tick-borne encephalitis virus
SPVLKSFWN

SEQ ID NO: 181442 - protein, 9 aa, Tick-borne encephalitis virus
PVLKSFWNS

SEQ ID NO: 181443 - protein, 9 aa, Tick-borne encephalitis virus
VLKSFWNSV

SEQ ID NO: 181444 - protein, 9 aa, Tick-borne encephalitis virus
LKSFWNSVP

SEQ ID NO: 181445 - protein, 9 aa, Tick-borne encephalitis virus
KSFWNSVPL

SEQ ID NO: 181446 - protein, 9 aa, Tick-borne encephalitis virus
SFWNSVPLK

SEQ ID NO: 181447 - protein, 9 aa, Tick-borne encephalitis virus
FWNSVPLKQ

SEQ ID NO: 181448 - protein, 9 aa, Tick-borne encephalitis virus
WNSVPLKQA

SEQ ID NO: 181449 - protein, 9 aa, Tick-borne encephalitis virus
NSVPLKQAT

SEQ ID NO: 181450 - protein, 9 aa, Tick-borne encephalitis virus
SVPLKQATA

SEQ ID NO: 181451 - protein, 9 aa, Tick-borne encephalitis virus
VPLKQATAA

SEQ ID NO: 181452 - protein, 9 aa, Tick-borne encephalitis virus
PLKQATAAL

SEQ ID NO: 181453 - protein, 9 aa, Tick-borne encephalitis virus
LKQATAALR

SEQ ID NO: 181454 - protein, 9 aa, Tick-borne encephalitis virus
KQATAALRK

SEQ ID NO: 181455 - protein, 9 aa, Tick-borne encephalitis virus
QATAALRKI

SEQ ID NO: 181456 - protein, 9 aa, Tick-borne encephalitis virus
ATAALRKIK

SEQ ID NO: 181457 - protein, 9 aa, Tick-borne encephalitis virus
TAALRKIKK

SEQ ID NO: 181458 - protein, 9 aa, Tick-borne encephalitis virus
AALRKIKKA

SEQ ID NO: 181459 - protein, 9 aa, Tick-borne encephalitis virus
ALRKIKKAV

SEQ ID NO: 181460 - protein, 9 aa, Tick-borne encephalitis virus
LRKIKKAVS

SEQ ID NO: 181461 - protein, 9 aa, Tick-borne encephalitis virus
RKIKKAVST

SEQ ID NO: 181462 - protein, 9 aa, Tick-borne encephalitis virus
KIKKAVSTL

SEQ ID NO: 181463 - protein, 9 aa, Tick-borne encephalitis virus
IKKAVSTLM

SEQ ID NO: 181464 - protein, 9 aa, Tick-borne encephalitis virus
AVSTLMVGL

SEQ ID NO: 181465 - protein, 9 aa, Tick-borne encephalitis virus
VSTLMVGLQ

SEQ ID NO: 181466 - protein, 9 aa, Tick-borne encephalitis virus
LMVGLQRRG

SEQ ID NO: 181467 - protein, 9 aa, Tick-borne encephalitis virus
MVGLQRRGK

SEQ ID NO: 181468 - protein, 9 aa, Tick-borne encephalitis virus
VGLQRRGKR

SEQ ID NO: 181469 - protein, 9 aa, Tick-borne encephalitis virus
GLQRRGKRR

SEQ ID NO: 181470 - protein, 9 aa, Tick-borne encephalitis virus
LQRRGKRRS

SEQ ID NO: 181471 - protein, 9 aa, Tick-borne encephalitis virus
QRRGKRRSA

SEQ ID NO: 181472 - protein, 9 aa, Tick-borne encephalitis virus
TLAATVRKE

SEQ ID NO: 181473 - protein, 9 aa, Tick-borne encephalitis virus
LAATVRKER

SEQ ID NO: 181474 - protein, 9 aa, Tick-borne encephalitis virus
AATVRKERD

SEQ ID NO: 181475 - protein, 9 aa, Tick-borne encephalitis virus
ATVRKERDG

SEQ ID NO: 181476 - protein, 9 aa, Tick-borne encephalitis virus
TVRKERDGT

SEQ ID NO: 181477 - protein, 9 aa, Tick-borne encephalitis virus
VRKERDGTT

SEQ ID NO: 181478 - protein, 9 aa, Tick-borne encephalitis virus
RKERDGTTV

SEQ ID NO: 181479 - protein, 9 aa, Tick-borne encephalitis virus
KERDGTTVI

SEQ ID NO: 181480 - protein, 9 aa, Tick-borne encephalitis virus
ERDGTTVIR

SEQ ID NO: 181481 - protein, 9 aa, Tick-borne encephalitis virus
RDGTTVIRA

SEQ ID NO: 181482 - protein, 9 aa, Tick-borne encephalitis virus
DGTTVIRAE

SEQ ID NO: 181483 - protein, 9 aa, Tick-borne encephalitis virus
GTTVIRAEG

SEQ ID NO: 181484 - protein, 9 aa, Tick-borne encephalitis virus
TTVIRAEGK

SEQ ID NO: 181485 - protein, 9 aa, Tick-borne encephalitis virus
TVIRAEGKD

SEQ ID NO: 181486 - protein, 9 aa, Tick-borne encephalitis virus
VIRAEGKDA

SEQ ID NO: 181487 - protein, 9 aa, Tick-borne encephalitis virus
IRAEGKDAA

SEQ ID NO: 181488 - protein, 9 aa, Tick-borne encephalitis virus
RAEGKDAAT

SEQ ID NO: 181489 - protein, 9 aa, Tick-borne encephalitis virus
AEGKDAATQ

SEQ ID NO: 181490 - protein, 9 aa, Tick-borne encephalitis virus
EGKDAATQV

SEQ ID NO: 181491 - protein, 9 aa, Tick-borne encephalitis virus
GKDAATQVR

SEQ ID NO: 181492 - protein, 9 aa, Tick-borne encephalitis virus
KDAATQVRV

SEQ ID NO: 181493 - protein, 9 aa, Tick-borne encephalitis virus
DAATQVRVE

SEQ ID NO: 181494 - protein, 9 aa, Tick-borne encephalitis virus
AATQVRVEN

SEQ ID NO: 181495 - protein, 9 aa, Tick-borne encephalitis virus
ATQVRVENG

SEQ ID NO: 181496 - protein, 9 aa, Tick-borne encephalitis virus
TQVRVENGT

SEQ ID NO: 181497 - protein, 9 aa, Tick-borne encephalitis virus
QVRVENGTC

SEQ ID NO: 181498 - protein, 9 aa, Tick-borne encephalitis virus
VRVENGTCV

SEQ ID NO: 181499 - protein, 9 aa, Tick-borne encephalitis virus
RVENGTCVI

SEQ ID NO: 181500 - protein, 9 aa, Tick-borne encephalitis virus
VENGTCVIL

SEQ ID NO: 181501 - protein, 9 aa, Tick-borne encephalitis virus
ENGTCVILA

SEQ ID NO: 181502 - protein, 9 aa, Tick-borne encephalitis virus
NGTCVILAT

SEQ ID NO: 181503 - protein, 9 aa, Tick-borne encephalitis virus
GTCVILATD

SEQ ID NO: 181504 - protein, 9 aa, Tick-borne encephalitis virus
TCVILATDM

SEQ ID NO: 181505 - protein, 9 aa, Tick-borne encephalitis virus
CVILATDMG

SEQ ID NO: 181506 - protein, 9 aa, Tick-borne encephalitis virus
VILATDMGS

SEQ ID NO: 181507 - protein, 9 aa, Tick-borne encephalitis virus
ILATDMGSW

SEQ ID NO: 181508 - protein, 9 aa, Tick-borne encephalitis virus
LATDMGSWC

SEQ ID NO: 181509 - protein, 9 aa, Tick-borne encephalitis virus
ATDMGSWCD

SEQ ID NO: 181510 - protein, 9 aa, Tick-borne encephalitis virus
TDMGSWCDD

SEQ ID NO: 181511 - protein, 9 aa, Tick-borne encephalitis virus
DMGSWCDDS

SEQ ID NO: 181512 - protein, 9 aa, Tick-borne encephalitis virus
MGSWCDDSL

SEQ ID NO: 181513 - protein, 9 aa, Tick-borne encephalitis virus
GSWCDDSLT

SEQ ID NO: 181514 - protein, 9 aa, Tick-borne encephalitis virus
SWCDDSLTY

SEQ ID NO: 181515 - protein, 9 aa, Tick-borne encephalitis virus
WCDDSLTYE

SEQ ID NO: 181516 - protein, 9 aa, Tick-borne encephalitis virus
CDDSLTYEC

SEQ ID NO: 181517 - protein, 9 aa, Tick-borne encephalitis virus
DDSLTYECV

SEQ ID NO: 181518 - protein, 9 aa, Tick-borne encephalitis virus
DSLTYECVT

SEQ ID NO: 181519 - protein, 9 aa, Tick-borne encephalitis virus
SLTYECVTI

SEQ ID NO: 181520 - protein, 9 aa, Tick-borne encephalitis virus
LTYECVTID

SEQ ID NO: 181521 - protein, 9 aa, Tick-borne encephalitis virus
TYECVTIDQ

SEQ ID NO: 181522 - protein, 9 aa, Tick-borne encephalitis virus
YECVTIDQG

SEQ ID NO: 181523 - protein, 9 aa, Tick-borne encephalitis virus
ECVTIDQGE

SEQ ID NO: 181524 - protein, 9 aa, Tick-borne encephalitis virus
CVTIDQGEE

SEQ ID NO: 181525 - protein, 9 aa, Tick-borne encephalitis virus
VTIDQGEEP

SEQ ID NO: 181526 - protein, 9 aa, Tick-borne encephalitis virus
TIDQGEEPV

SEQ ID NO: 181527 - protein, 9 aa, Tick-borne encephalitis virus
IDQGEEPVD

SEQ ID NO: 181528 - protein, 9 aa, Tick-borne encephalitis virus
DQGEEPVDV

SEQ ID NO: 181529 - protein, 9 aa, Tick-borne encephalitis virus
QGEEPVDVD

SEQ ID NO: 181530 - protein, 9 aa, Tick-borne encephalitis virus
GEEPVDVDC

SEQ ID NO: 181531 - protein, 9 aa, Tick-borne encephalitis virus
EEPVDVDCF

SEQ ID NO: 181532 - protein, 9 aa, Tick-borne encephalitis virus
EPVDVDCFC

SEQ ID NO: 181533 - protein, 9 aa, Tick-borne encephalitis virus
PVDVDCFCR

SEQ ID NO: 181534 - protein, 9 aa, Tick-borne encephalitis virus
VDVDCFCRN

SEQ ID NO: 181535 - protein, 9 aa, Tick-borne encephalitis virus
DVDCFCRNV

SEQ ID NO: 181536 - protein, 9 aa, Tick-borne encephalitis virus
VDCFCRNVD

SEQ ID NO: 181537 - protein, 9 aa, Tick-borne encephalitis virus
DCFCRNVDG

SEQ ID NO: 181538 - protein, 9 aa, Tick-borne encephalitis virus
CFCRNVDGV

SEQ ID NO: 181539 - protein, 9 aa, Tick-borne encephalitis virus
FCRNVDGVY

SEQ ID NO: 181540 - protein, 9 aa, Tick-borne encephalitis virus
CRNVDGVYL

SEQ ID NO: 181541 - protein, 9 aa, Tick-borne encephalitis virus
RNVDGVYLE

SEQ ID NO: 181542 - protein, 9 aa, Tick-borne encephalitis virus
NVDGVYLEY

SEQ ID NO: 181543 - protein, 9 aa, Tick-borne encephalitis virus
VDGVYLEYG

SEQ ID NO: 181544 - protein, 9 aa, Tick-borne encephalitis virus
DGVYLEYGR

SEQ ID NO: 181545 - protein, 9 aa, Tick-borne encephalitis virus
GVYLEYGRC

SEQ ID NO: 181546 - protein, 9 aa, Tick-borne encephalitis virus
VYLEYGRCG

SEQ ID NO: 181547 - protein, 9 aa, Tick-borne encephalitis virus
YLEYGRCGK

SEQ ID NO: 181548 - protein, 9 aa, Tick-borne encephalitis virus
LEYGRCGKQ

SEQ ID NO: 181549 - protein, 9 aa, Tick-borne encephalitis virus
EYGRCGKQE

SEQ ID NO: 181550 - protein, 9 aa, Tick-borne encephalitis virus
YGRCGKQEG

SEQ ID NO: 181551 - protein, 9 aa, Tick-borne encephalitis virus
GRCGKQEGS

SEQ ID NO: 181552 - protein, 9 aa, Tick-borne encephalitis virus
RCGKQEGSR

SEQ ID NO: 181553 - protein, 9 aa, Tick-borne encephalitis virus
CGKQEGSRT

SEQ ID NO: 181554 - protein, 9 aa, Tick-borne encephalitis virus
GKQEGSRTR

SEQ ID NO: 181555 - protein, 9 aa, Tick-borne encephalitis virus
KQEGSRTRR

SEQ ID NO: 181556 - protein, 9 aa, Tick-borne encephalitis virus
QEGSRTRRS

SEQ ID NO: 181557 - protein, 9 aa, Tick-borne encephalitis virus
EGSRTRRSV

SEQ ID NO: 181558 - protein, 9 aa, Tick-borne encephalitis virus
GSRTRRSVL

SEQ ID NO: 181559 - protein, 9 aa, Tick-borne encephalitis virus
SRTRRSVLI

SEQ ID NO: 181560 - protein, 9 aa, Tick-borne encephalitis virus
RTRRSVLIP

SEQ ID NO: 181561 - protein, 9 aa, Tick-borne encephalitis virus
TRRSVLIPS

SEQ ID NO: 181562 - protein, 9 aa, Tick-borne encephalitis virus
RRSVLIPSH

SEQ ID NO: 181563 - protein, 9 aa, Tick-borne encephalitis virus
RSVLIPSHA

SEQ ID NO: 181564 - protein, 9 aa, Tick-borne encephalitis virus
SVLIPSHAQ

SEQ ID NO: 181565 - protein, 9 aa, Tick-borne encephalitis virus
VLIPSHAQG

SEQ ID NO: 181566 - protein, 9 aa, Tick-borne encephalitis virus
LIPSHAQGD

SEQ ID NO: 181567 - protein, 9 aa, Tick-borne encephalitis virus
IPSHAQGDL

SEQ ID NO: 181568 - protein, 9 aa, Tick-borne encephalitis virus
PSHAQGDLT

SEQ ID NO: 181569 - protein, 9 aa, Tick-borne encephalitis virus
SHAQGDLTG

SEQ ID NO: 181570 - protein, 9 aa, Tick-borne encephalitis virus
HAQGDLTGR

SEQ ID NO: 181571 - protein, 9 aa, Tick-borne encephalitis virus
AQGDLTGRG

SEQ ID NO: 181572 - protein, 9 aa, Tick-borne encephalitis virus
QGDLTGRGH

SEQ ID NO: 181573 - protein, 9 aa, Tick-borne encephalitis virus
GDLTGRGHK

SEQ ID NO: 181574 - protein, 9 aa, Tick-borne encephalitis virus
DLTGRGHKW

SEQ ID NO: 181575 - protein, 9 aa, Tick-borne encephalitis virus
LTGRGHKWL

SEQ ID NO: 181576 - protein, 9 aa, Tick-borne encephalitis virus
TGRGHKWLE

SEQ ID NO: 181577 - protein, 9 aa, Tick-borne encephalitis virus
GRGHKWLEG

SEQ ID NO: 181578 - protein, 9 aa, Tick-borne encephalitis virus
RGHKWLEGD

SEQ ID NO: 181579 - protein, 9 aa, Tick-borne encephalitis virus
GHKWLEGDS

SEQ ID NO: 181580 - protein, 9 aa, Tick-borne encephalitis virus
HKWLEGDSL

SEQ ID NO: 181581 - protein, 9 aa, Tick-borne encephalitis virus
KWLEGDSLR

SEQ ID NO: 181582 - protein, 9 aa, Tick-borne encephalitis virus
WLEGDSLRT

SEQ ID NO: 181583 - protein, 9 aa, Tick-borne encephalitis virus
LEGDSLRTH

SEQ ID NO: 181584 - protein, 9 aa, Tick-borne encephalitis virus
EGDSLRTHL

SEQ ID NO: 181585 - protein, 9 aa, Tick-borne encephalitis virus
GDSLRTHLT

SEQ ID NO: 181586 - protein, 9 aa, Tick-borne encephalitis virus
DSLRTHLTR

SEQ ID NO: 181587 - protein, 9 aa, Tick-borne encephalitis virus
SLRTHLTRV

SEQ ID NO: 181588 - protein, 9 aa, Tick-borne encephalitis virus
LRTHLTRVE

SEQ ID NO: 181589 - protein, 9 aa, Tick-borne encephalitis virus
RTHLTRVEG

SEQ ID NO: 181590 - protein, 9 aa, Tick-borne encephalitis virus
THLTRVEGW

SEQ ID NO: 181591 - protein, 9 aa, Tick-borne encephalitis virus
HLTRVEGWV

SEQ ID NO: 181592 - protein, 9 aa, Tick-borne encephalitis virus
LTRVEGWVW

SEQ ID NO: 181593 - protein, 9 aa, Tick-borne encephalitis virus
TRVEGWVWK

SEQ ID NO: 181594 - protein, 9 aa, Tick-borne encephalitis virus
RVEGWVWKN

SEQ ID NO: 181595 - protein, 9 aa, Tick-borne encephalitis virus
VEGWVWKNK

SEQ ID NO: 181596 - protein, 9 aa, Tick-borne encephalitis virus
VVWLTVESV

SEQ ID NO: 181597 - protein, 9 aa, Tick-borne encephalitis virus
VWLTVESVV

SEQ ID NO: 181598 - protein, 9 aa, Tick-borne encephalitis virus
WLTVESVVT

SEQ ID NO: 181599 - protein, 9 aa, Tick-borne encephalitis virus
LTVESVVTR

SEQ ID NO: 181600 - protein, 9 aa, Tick-borne encephalitis virus
TVESVVTRV

SEQ ID NO: 181601 - protein, 9 aa, Tick-borne encephalitis virus
VVVLLCLAP

SEQ ID NO: 181602 - protein, 9 aa, Tick-borne encephalitis virus
VVLLCLAPV

SEQ ID NO: 181603 - protein, 9 aa, Tick-borne encephalitis virus
VLLCLAPVY

SEQ ID NO: 181604 - protein, 9 aa, Tick-borne encephalitis virus
LLCLAPVYA

SEQ ID NO: 181605 - protein, 9 aa, Tick-borne encephalitis virus
LCLAPVYAS

SEQ ID NO: 181606 - protein, 9 aa, Tick-borne encephalitis virus
CLAPVYASR

SEQ ID NO: 181607 - protein, 9 aa, Tick-borne encephalitis virus
LAPVYASRC

SEQ ID NO: 181608 - protein, 9 aa, Tick-borne encephalitis virus
APVYASRCT

SEQ ID NO: 181609 - protein, 9 aa, Tick-borne encephalitis virus
PVYASRCTH

SEQ ID NO: 181610 - protein, 9 aa, Tick-borne encephalitis virus
VYASRCTHL

SEQ ID NO: 181611 - protein, 9 aa, Tick-borne encephalitis virus
YASRCTHLE

SEQ ID NO: 181612 - protein, 9 aa, Tick-borne encephalitis virus
ASRCTHLEN

SEQ ID NO: 181613 - protein, 9 aa, Tick-borne encephalitis virus
SRCTHLENR

SEQ ID NO: 181614 - protein, 9 aa, Tick-borne encephalitis virus
RCTHLENRD

SEQ ID NO: 181615 - protein, 9 aa, Tick-borne encephalitis virus
CTHLENRDF

SEQ ID NO: 181616 - protein, 9 aa, Tick-borne encephalitis virus
THLENRDFV

SEQ ID NO: 181617 - protein, 9 aa, Tick-borne encephalitis virus
HLENRDFVT

SEQ ID NO: 181618 - protein, 9 aa, Tick-borne encephalitis virus
LENRDFVTG

SEQ ID NO: 181619 - protein, 9 aa, Tick-borne encephalitis virus
ENRDFVTGT

SEQ ID NO: 181620 - protein, 9 aa, Tick-borne encephalitis virus
NRDFVTGTQ

SEQ ID NO: 181621 - protein, 9 aa, Tick-borne encephalitis virus
RDFVTGTQG

SEQ ID NO: 181622 - protein, 9 aa, Tick-borne encephalitis virus
DFVTGTQGT

SEQ ID NO: 181623 - protein, 9 aa, Tick-borne encephalitis virus
FVTGTQGTT

SEQ ID NO: 181624 - protein, 9 aa, Tick-borne encephalitis virus
VTGTQGTTR

SEQ ID NO: 181625 - protein, 9 aa, Tick-borne encephalitis virus
TGTQGTTRV

SEQ ID NO: 181626 - protein, 9 aa, Tick-borne encephalitis virus
GTQGTTRVT

SEQ ID NO: 181627 - protein, 9 aa, Tick-borne encephalitis virus
TQGTTRVTL

SEQ ID NO: 181628 - protein, 9 aa, Tick-borne encephalitis virus
QGTTRVTLV

SEQ ID NO: 181629 - protein, 9 aa, Tick-borne encephalitis virus
GTTRVTLVL

SEQ ID NO: 181630 - protein, 9 aa, Tick-borne encephalitis virus
TTRVTLVLE

SEQ ID NO: 181631 - protein, 9 aa, Tick-borne encephalitis virus
TRVTLVLEL

SEQ ID NO: 181632 - protein, 9 aa, Tick-borne encephalitis virus
RVTLVLELG

SEQ ID NO: 181633 - protein, 9 aa, Tick-borne encephalitis virus
VTLVLELGG

SEQ ID NO: 181634 - protein, 9 aa, Tick-borne encephalitis virus
TLVLELGGC

SEQ ID NO: 181635 - protein, 9 aa, Tick-borne encephalitis virus
LVLELGGCV

SEQ ID NO: 181636 - protein, 9 aa, Tick-borne encephalitis virus
VLELGGCVT

SEQ ID NO: 181637 - protein, 9 aa, Tick-borne encephalitis virus
LELGGCVTI

SEQ ID NO: 181638 - protein, 9 aa, Tick-borne encephalitis virus
ELGGCVTIT

SEQ ID NO: 181639 - protein, 9 aa, Tick-borne encephalitis virus
LGGCVTITA

SEQ ID NO: 181640 - protein, 9 aa, Tick-borne encephalitis virus
GGCVTITAE

SEQ ID NO: 181641 - protein, 9 aa, Tick-borne encephalitis virus
GCVTITAEG

SEQ ID NO: 181642 - protein, 9 aa, Tick-borne encephalitis virus
CVTITAEGK

SEQ ID NO: 181643 - protein, 9 aa, Tick-borne encephalitis virus
VTITAEGKP

SEQ ID NO: 181644 - protein, 9 aa, Tick-borne encephalitis virus
TITAEGKPS

SEQ ID NO: 181645 - protein, 9 aa, Tick-borne encephalitis virus
ITAEGKPSM

SEQ ID NO: 181646 - protein, 9 aa, Tick-borne encephalitis virus
TAEGKPSMD

SEQ ID NO: 181647 - protein, 9 aa, Tick-borne encephalitis virus
AEGKPSMDV

SEQ ID NO: 181648 - protein, 9 aa, Tick-borne encephalitis virus
EGKPSMDVW

SEQ ID NO: 181649 - protein, 9 aa, Tick-borne encephalitis virus
GKPSMDVWL

SEQ ID NO: 181650 - protein, 9 aa, Tick-borne encephalitis virus
KPSMDVWLD

SEQ ID NO: 181651 - protein, 9 aa, Tick-borne encephalitis virus
PSMDVWLDS

SEQ ID NO: 181652 - protein, 9 aa, Tick-borne encephalitis virus
SMDVWLDSI

SEQ ID NO: 181653 - protein, 9 aa, Tick-borne encephalitis virus
MDVWLDSIY

SEQ ID NO: 181654 - protein, 9 aa, Tick-borne encephalitis virus
DVWLDSIYQ

SEQ ID NO: 181655 - protein, 9 aa, Tick-borne encephalitis virus
VWLDSIYQE

SEQ ID NO: 181656 - protein, 9 aa, Tick-borne encephalitis virus
WLDSIYQEN

SEQ ID NO: 181657 - protein, 9 aa, Tick-borne encephalitis virus
LDSIYQENP

SEQ ID NO: 181658 - protein, 9 aa, Tick-borne encephalitis virus
DSIYQENPA

SEQ ID NO: 181659 - protein, 9 aa, Tick-borne encephalitis virus
SIYQENPAK

SEQ ID NO: 181660 - protein, 9 aa, Tick-borne encephalitis virus
IYQENPAKT

SEQ ID NO: 181661 - protein, 9 aa, Tick-borne encephalitis virus
YQENPAKTR

SEQ ID NO: 181662 - protein, 9 aa, Tick-borne encephalitis virus
QENPAKTRE

SEQ ID NO: 181663 - protein, 9 aa, Tick-borne encephalitis virus
ENPAKTREY

SEQ ID NO: 181664 - protein, 9 aa, Tick-borne encephalitis virus
NPAKTREYC

SEQ ID NO: 181665 - protein, 9 aa, Tick-borne encephalitis virus
PAKTREYCL

SEQ ID NO: 181666 - protein, 9 aa, Tick-borne encephalitis virus
AKTREYCLH

SEQ ID NO: 181667 - protein, 9 aa, Tick-borne encephalitis virus
KTREYCLHA

SEQ ID NO: 181668 - protein, 9 aa, Tick-borne encephalitis virus
TREYCLHAK

SEQ ID NO: 181669 - protein, 9 aa, Tick-borne encephalitis virus
REYCLHAKL

SEQ ID NO: 181670 - protein, 9 aa, Tick-borne encephalitis virus
EYCLHAKLS

SEQ ID NO: 181671 - protein, 9 aa, Tick-borne encephalitis virus
YCLHAKLSD

SEQ ID NO: 181672 - protein, 9 aa, Tick-borne encephalitis virus
CLHAKLSDT

SEQ ID NO: 181673 - protein, 9 aa, Tick-borne encephalitis virus
LHAKLSDTK

SEQ ID NO: 181674 - protein, 9 aa, Tick-borne encephalitis virus
HAKLSDTKV

SEQ ID NO: 181675 - protein, 9 aa, Tick-borne encephalitis virus
AKLSDTKVA

SEQ ID NO: 181676 - protein, 9 aa, Tick-borne encephalitis virus
KLSDTKVAA

SEQ ID NO: 181677 - protein, 9 aa, Tick-borne encephalitis virus
LSDTKVAAR

SEQ ID NO: 181678 - protein, 9 aa, Tick-borne encephalitis virus
SDTKVAARC

SEQ ID NO: 181679 - protein, 9 aa, Tick-borne encephalitis virus
DTKVAARCP

SEQ ID NO: 181680 - protein, 9 aa, Tick-borne encephalitis virus
TKVAARCPT

SEQ ID NO: 181681 - protein, 9 aa, Tick-borne encephalitis virus
KVAARCPTM

SEQ ID NO: 181682 - protein, 9 aa, Tick-borne encephalitis virus
VAARCPTMG

SEQ ID NO: 181683 - protein, 9 aa, Tick-borne encephalitis virus
AARCPTMGP

SEQ ID NO: 181684 - protein, 9 aa, Tick-borne encephalitis virus
ARCPTMGPA

SEQ ID NO: 181685 - protein, 9 aa, Tick-borne encephalitis virus
RCPTMGPAT

SEQ ID NO: 181686 - protein, 9 aa, Tick-borne encephalitis virus
CPTMGPATL

SEQ ID NO: 181687 - protein, 9 aa, Tick-borne encephalitis virus
PTMGPATLA

SEQ ID NO: 181688 - protein, 9 aa, Tick-borne encephalitis virus
TMGPATLAE

SEQ ID NO: 181689 - protein, 9 aa, Tick-borne encephalitis virus
MGPATLAEE

SEQ ID NO: 181690 - protein, 9 aa, Tick-borne encephalitis virus
GPATLAEEH

SEQ ID NO: 181691 - protein, 9 aa, Tick-borne encephalitis virus
PATLAEEHQ

SEQ ID NO: 181692 - protein, 9 aa, Tick-borne encephalitis virus
ATLAEEHQS

SEQ ID NO: 181693 - protein, 9 aa, Tick-borne encephalitis virus
TLAEEHQSG

SEQ ID NO: 181694 - protein, 9 aa, Tick-borne encephalitis virus
LAEEHQSGT

SEQ ID NO: 181695 - protein, 9 aa, Tick-borne encephalitis virus
AEEHQSGTV

SEQ ID NO: 181696 - protein, 9 aa, Tick-borne encephalitis virus
EEHQSGTVC

SEQ ID NO: 181697 - protein, 9 aa, Tick-borne encephalitis virus
EHQSGTVCK

SEQ ID NO: 181698 - protein, 9 aa, Tick-borne encephalitis virus
HQSGTVCKR

SEQ ID NO: 181699 - protein, 9 aa, Tick-borne encephalitis virus
QSGTVCKRD

SEQ ID NO: 181700 - protein, 9 aa, Tick-borne encephalitis virus
SGTVCKRDQ

SEQ ID NO: 181701 - protein, 9 aa, Tick-borne encephalitis virus
GTVCKRDQS

SEQ ID NO: 181702 - protein, 9 aa, Tick-borne encephalitis virus
TVCKRDQSD

SEQ ID NO: 181703 - protein, 9 aa, Tick-borne encephalitis virus
VCKRDQSDR

SEQ ID NO: 181704 - protein, 9 aa, Tick-borne encephalitis virus
CKRDQSDRG

SEQ ID NO: 181705 - protein, 9 aa, Tick-borne encephalitis virus
KRDQSDRGW

SEQ ID NO: 181706 - protein, 9 aa, Tick-borne encephalitis virus
RDQSDRGWG

SEQ ID NO: 181707 - protein, 9 aa, Tick-borne encephalitis virus
DQSDRGWGN

SEQ ID NO: 181708 - protein, 9 aa, Tick-borne encephalitis virus
QSDRGWGNH

SEQ ID NO: 181709 - protein, 9 aa, Tick-borne encephalitis virus
SDRGWGNHC

SEQ ID NO: 181710 - protein, 9 aa, Tick-borne encephalitis virus
DRGWGNHCG

SEQ ID NO: 181711 - protein, 9 aa, Tick-borne encephalitis virus
RGWGNHCGL

SEQ ID NO: 181712 - protein, 9 aa, Tick-borne encephalitis virus
GWGNHCGLF

SEQ ID NO: 181713 - protein, 9 aa, Tick-borne encephalitis virus
WGNHCGLFG

SEQ ID NO: 181714 - protein, 9 aa, Tick-borne encephalitis virus
GNHCGLFGK

SEQ ID NO: 181715 - protein, 9 aa, Tick-borne encephalitis virus
NHCGLFGKG

SEQ ID NO: 181716 - protein, 9 aa, Tick-borne encephalitis virus
HCGLFGKGS

SEQ ID NO: 181717 - protein, 9 aa, Tick-borne encephalitis virus
CGLFGKGSI

SEQ ID NO: 181718 - protein, 9 aa, Tick-borne encephalitis virus
GLFGKGSIV

SEQ ID NO: 181719 - protein, 9 aa, Tick-borne encephalitis virus
LFGKGSIVT

SEQ ID NO: 181720 - protein, 9 aa, Tick-borne encephalitis virus
FGKGSIVTC

SEQ ID NO: 181721 - protein, 9 aa, Tick-borne encephalitis virus
GKGSIVTCV

SEQ ID NO: 181722 - protein, 9 aa, Tick-borne encephalitis virus
KGSIVTCVK

SEQ ID NO: 181723 - protein, 9 aa, Tick-borne encephalitis virus
GSIVTCVKA

SEQ ID NO: 181724 - protein, 9 aa, Tick-borne encephalitis virus
SIVTCVKAS

SEQ ID NO: 181725 - protein, 9 aa, Tick-borne encephalitis virus
IVTCVKASC

SEQ ID NO: 181726 - protein, 9 aa, Tick-borne encephalitis virus
VTCVKASCE

SEQ ID NO: 181727 - protein, 9 aa, Tick-borne encephalitis virus
TCVKASCEA

SEQ ID NO: 181728 - protein, 9 aa, Tick-borne encephalitis virus
CVKASCEAK

SEQ ID NO: 181729 - protein, 9 aa, Tick-borne encephalitis virus
VKASCEAKK

SEQ ID NO: 181730 - protein, 9 aa, Tick-borne encephalitis virus
KASCEAKKK

SEQ ID NO: 181731 - protein, 9 aa, Tick-borne encephalitis virus
ASCEAKKKA

SEQ ID NO: 181732 - protein, 9 aa, Tick-borne encephalitis virus
SCEAKKKAT

SEQ ID NO: 181733 - protein, 9 aa, Tick-borne encephalitis virus
CEAKKKATG

SEQ ID NO: 181734 - protein, 9 aa, Tick-borne encephalitis virus
EAKKKATGH

SEQ ID NO: 181735 - protein, 9 aa, Tick-borne encephalitis virus
AKKKATGHV

SEQ ID NO: 181736 - protein, 9 aa, Tick-borne encephalitis virus
KKKATGHVY

SEQ ID NO: 181737 - protein, 9 aa, Tick-borne encephalitis virus
KKATGHVYD

SEQ ID NO: 181738 - protein, 9 aa, Tick-borne encephalitis virus
KATGHVYDA

SEQ ID NO: 181739 - protein, 9 aa, Tick-borne encephalitis virus
ATGHVYDAN

SEQ ID NO: 181740 - protein, 9 aa, Tick-borne encephalitis virus
TGHVYDANK

SEQ ID NO: 181741 - protein, 9 aa, Tick-borne encephalitis virus
GHVYDANKI

SEQ ID NO: 181742 - protein, 9 aa, Tick-borne encephalitis virus
HVYDANKIV

SEQ ID NO: 181743 - protein, 9 aa, Tick-borne encephalitis virus
VYDANKIVY

SEQ ID NO: 181744 - protein, 9 aa, Tick-borne encephalitis virus
YDANKIVYT

SEQ ID NO: 181745 - protein, 9 aa, Tick-borne encephalitis virus
DANKIVYTV

SEQ ID NO: 181746 - protein, 9 aa, Tick-borne encephalitis virus
ANKIVYTVK

SEQ ID NO: 181747 - protein, 9 aa, Tick-borne encephalitis virus
NKIVYTVKV

SEQ ID NO: 181748 - protein, 9 aa, Tick-borne encephalitis virus
KIVYTVKVE

SEQ ID NO: 181749 - protein, 9 aa, Tick-borne encephalitis virus
IVYTVKVEP

SEQ ID NO: 181750 - protein, 9 aa, Tick-borne encephalitis virus
VYTVKVEPH

SEQ ID NO: 181751 - protein, 9 aa, Tick-borne encephalitis virus
YTVKVEPHT

SEQ ID NO: 181752 - protein, 9 aa, Tick-borne encephalitis virus
TVKVEPHTG

SEQ ID NO: 181753 - protein, 9 aa, Tick-borne encephalitis virus
VKVEPHTGD

SEQ ID NO: 181754 - protein, 9 aa, Tick-borne encephalitis virus
KVEPHTGDY

SEQ ID NO: 181755 - protein, 9 aa, Tick-borne encephalitis virus
VEPHTGDYV

SEQ ID NO: 181756 - protein, 9 aa, Tick-borne encephalitis virus
EPHTGDYVA

SEQ ID NO: 181757 - protein, 9 aa, Tick-borne encephalitis virus
PHTGDYVAA

SEQ ID NO: 181758 - protein, 9 aa, Tick-borne encephalitis virus
HTGDYVAAN

SEQ ID NO: 181759 - protein, 9 aa, Tick-borne encephalitis virus
TGDYVAANE

SEQ ID NO: 181760 - protein, 9 aa, Tick-borne encephalitis virus
GDYVAANET

SEQ ID NO: 181761 - protein, 9 aa, Tick-borne encephalitis virus
DYVAANETH

SEQ ID NO: 181762 - protein, 9 aa, Tick-borne encephalitis virus
YVAANETHS

SEQ ID NO: 181763 - protein, 9 aa, Tick-borne encephalitis virus
VAANETHSG

SEQ ID NO: 181764 - protein, 9 aa, Tick-borne encephalitis virus
AANETHSGR

SEQ ID NO: 181765 - protein, 9 aa, Tick-borne encephalitis virus
ANETHSGRK

SEQ ID NO: 181766 - protein, 9 aa, Tick-borne encephalitis virus
NETHSGRKT

SEQ ID NO: 181767 - protein, 9 aa, Tick-borne encephalitis virus
ETHSGRKTA

SEQ ID NO: 181768 - protein, 9 aa, Tick-borne encephalitis virus
THSGRKTAS

SEQ ID NO: 181769 - protein, 9 aa, Tick-borne encephalitis virus
HSGRKTASF

SEQ ID NO: 181770 - protein, 9 aa, Tick-borne encephalitis virus
SGRKTASFT

SEQ ID NO: 181771 - protein, 9 aa, Tick-borne encephalitis virus
GRKTASFTV

SEQ ID NO: 181772 - protein, 9 aa, Tick-borne encephalitis virus
RKTASFTVS

SEQ ID NO: 181773 - protein, 9 aa, Tick-borne encephalitis virus
KTASFTVSS

SEQ ID NO: 181774 - protein, 9 aa, Tick-borne encephalitis virus
TASFTVSSE

SEQ ID NO: 181775 - protein, 9 aa, Tick-borne encephalitis virus
ASFTVSSEK

SEQ ID NO: 181776 - protein, 9 aa, Tick-borne encephalitis virus
SFTVSSEKT

SEQ ID NO: 181777 - protein, 9 aa, Tick-borne encephalitis virus
FTVSSEKTI

SEQ ID NO: 181778 - protein, 9 aa, Tick-borne encephalitis virus
TVSSEKTIL

SEQ ID NO: 181779 - protein, 9 aa, Tick-borne encephalitis virus
VSSEKTILT

SEQ ID NO: 181780 - protein, 9 aa, Tick-borne encephalitis virus
SSEKTILTM

SEQ ID NO: 181781 - protein, 9 aa, Tick-borne encephalitis virus
SEKTILTMG

SEQ ID NO: 181782 - protein, 9 aa, Tick-borne encephalitis virus
EKTILTMGD

SEQ ID NO: 181783 - protein, 9 aa, Tick-borne encephalitis virus
KTILTMGDY

SEQ ID NO: 181784 - protein, 9 aa, Tick-borne encephalitis virus
TILTMGDYG

SEQ ID NO: 181785 - protein, 9 aa, Tick-borne encephalitis virus
ILTMGDYGD

SEQ ID NO: 181786 - protein, 9 aa, Tick-borne encephalitis virus
LTMGDYGDV

SEQ ID NO: 181787 - protein, 9 aa, Tick-borne encephalitis virus
TMGDYGDVS

SEQ ID NO: 181788 - protein, 9 aa, Tick-borne encephalitis virus
MGDYGDVSL

SEQ ID NO: 181789 - protein, 9 aa, Tick-borne encephalitis virus
GDYGDVSLL

SEQ ID NO: 181790 - protein, 9 aa, Tick-borne encephalitis virus
DYGDVSLLC

SEQ ID NO: 181791 - protein, 9 aa, Tick-borne encephalitis virus
YGDVSLLCR

SEQ ID NO: 181792 - protein, 9 aa, Tick-borne encephalitis virus
GDVSLLCRV

SEQ ID NO: 181793 - protein, 9 aa, Tick-borne encephalitis virus
DVSLLCRVA

SEQ ID NO: 181794 - protein, 9 aa, Tick-borne encephalitis virus
VSLLCRVAS

SEQ ID NO: 181795 - protein, 9 aa, Tick-borne encephalitis virus
SLLCRVASG

SEQ ID NO: 181796 - protein, 9 aa, Tick-borne encephalitis virus
LLCRVASGV

SEQ ID NO: 181797 - protein, 9 aa, Tick-borne encephalitis virus
LCRVASGVD

SEQ ID NO: 181798 - protein, 9 aa, Tick-borne encephalitis virus
CRVASGVDL

SEQ ID NO: 181799 - protein, 9 aa, Tick-borne encephalitis virus
RVASGVDLA

SEQ ID NO: 181800 - protein, 9 aa, Tick-borne encephalitis virus
VASGVDLAQ

SEQ ID NO: 181801 - protein, 9 aa, Tick-borne encephalitis virus
ASGVDLAQT

SEQ ID NO: 181802 - protein, 9 aa, Tick-borne encephalitis virus
SGVDLAQTV

SEQ ID NO: 181803 - protein, 9 aa, Tick-borne encephalitis virus
GVDLAQTVI

SEQ ID NO: 181804 - protein, 9 aa, Tick-borne encephalitis virus
VDLAQTVIL

SEQ ID NO: 181805 - protein, 9 aa, Tick-borne encephalitis virus
DLAQTVILE

SEQ ID NO: 181806 - protein, 9 aa, Tick-borne encephalitis virus
LAQTVILEL

SEQ ID NO: 181807 - protein, 9 aa, Tick-borne encephalitis virus
AQTVILELD

SEQ ID NO: 181808 - protein, 9 aa, Tick-borne encephalitis virus
QTVILELDK

SEQ ID NO: 181809 - protein, 9 aa, Tick-borne encephalitis virus
TVILELDKT

SEQ ID NO: 181810 - protein, 9 aa, Tick-borne encephalitis virus
VILELDKTS

SEQ ID NO: 181811 - protein, 9 aa, Tick-borne encephalitis virus
ILELDKTSE

SEQ ID NO: 181812 - protein, 9 aa, Tick-borne encephalitis virus
LELDKTSEH

SEQ ID NO: 181813 - protein, 9 aa, Tick-borne encephalitis virus
ELDKTSEHL

SEQ ID NO: 181814 - protein, 9 aa, Tick-borne encephalitis virus
LDKTSEHLP

SEQ ID NO: 181815 - protein, 9 aa, Tick-borne encephalitis virus
DKTSEHLPT

SEQ ID NO: 181816 - protein, 9 aa, Tick-borne encephalitis virus
KTSEHLPTA

SEQ ID NO: 181817 - protein, 9 aa, Tick-borne encephalitis virus
TSEHLPTAW

SEQ ID NO: 181818 - protein, 9 aa, Tick-borne encephalitis virus
SEHLPTAWQ

SEQ ID NO: 181819 - protein, 9 aa, Tick-borne encephalitis virus
EHLPTAWQV

SEQ ID NO: 181820 - protein, 9 aa, Tick-borne encephalitis virus
HLPTAWQVH

SEQ ID NO: 181821 - protein, 9 aa, Tick-borne encephalitis virus
LPTAWQVHR

SEQ ID NO: 181822 - protein, 9 aa, Tick-borne encephalitis virus
PTAWQVHRD

SEQ ID NO: 181823 - protein, 9 aa, Tick-borne encephalitis virus
TAWQVHRDW

SEQ ID NO: 181824 - protein, 9 aa, Tick-borne encephalitis virus
AWQVHRDWF

SEQ ID NO: 181825 - protein, 9 aa, Tick-borne encephalitis virus
WQVHRDWFN

SEQ ID NO: 181826 - protein, 9 aa, Tick-borne encephalitis virus
QVHRDWFND

SEQ ID NO: 181827 - protein, 9 aa, Tick-borne encephalitis virus
VHRDWFNDL

SEQ ID NO: 181828 - protein, 9 aa, Tick-borne encephalitis virus
HRDWFNDLA

SEQ ID NO: 181829 - protein, 9 aa, Tick-borne encephalitis virus
RDWFNDLAL

SEQ ID NO: 181830 - protein, 9 aa, Tick-borne encephalitis virus
DWFNDLALP

SEQ ID NO: 181831 - protein, 9 aa, Tick-borne encephalitis virus
WFNDLALPW

SEQ ID NO: 181832 - protein, 9 aa, Tick-borne encephalitis virus
FNDLALPWK

SEQ ID NO: 181833 - protein, 9 aa, Tick-borne encephalitis virus
NDLALPWKH

SEQ ID NO: 181834 - protein, 9 aa, Tick-borne encephalitis virus
DLALPWKHE

SEQ ID NO: 181835 - protein, 9 aa, Tick-borne encephalitis virus
LALPWKHEG

SEQ ID NO: 181836 - protein, 9 aa, Tick-borne encephalitis virus
ALPWKHEGA

SEQ ID NO: 181837 - protein, 9 aa, Tick-borne encephalitis virus
LPWKHEGAQ

SEQ ID NO: 181838 - protein, 9 aa, Tick-borne encephalitis virus
HEGAQNWNN

SEQ ID NO: 181839 - protein, 9 aa, Tick-borne encephalitis virus
EGAQNWNNA

SEQ ID NO: 181840 - protein, 9 aa, Tick-borne encephalitis virus
GAQNWNNAE

SEQ ID NO: 181841 - protein, 9 aa, Tick-borne encephalitis virus
AQNWNNAER

SEQ ID NO: 181842 - protein, 9 aa, Tick-borne encephalitis virus
QNWNNAERL

SEQ ID NO: 181843 - protein, 9 aa, Tick-borne encephalitis virus
NWNNAERLV

SEQ ID NO: 181844 - protein, 9 aa, Tick-borne encephalitis virus
WNNAERLVE

SEQ ID NO: 181845 - protein, 9 aa, Tick-borne encephalitis virus
NNAERLVEF

SEQ ID NO: 181846 - protein, 9 aa, Tick-borne encephalitis virus
NAERLVEFG

SEQ ID NO: 181847 - protein, 9 aa, Tick-borne encephalitis virus
AERLVEFGA

SEQ ID NO: 181848 - protein, 9 aa, Tick-borne encephalitis virus
ERLVEFGAP

SEQ ID NO: 181849 - protein, 9 aa, Tick-borne encephalitis virus
RLVEFGAPH

SEQ ID NO: 181850 - protein, 9 aa, Tick-borne encephalitis virus
LVEFGAPHA

SEQ ID NO: 181851 - protein, 9 aa, Tick-borne encephalitis virus
VEFGAPHAV

SEQ ID NO: 181852 - protein, 9 aa, Tick-borne encephalitis virus
EFGAPHAVK

SEQ ID NO: 181853 - protein, 9 aa, Tick-borne encephalitis virus
FGAPHAVKM

SEQ ID NO: 181854 - protein, 9 aa, Tick-borne encephalitis virus
GAPHAVKMD

SEQ ID NO: 181855 - protein, 9 aa, Tick-borne encephalitis virus
APHAVKMDV

SEQ ID NO: 181856 - protein, 9 aa, Tick-borne encephalitis virus
PHAVKMDVY

SEQ ID NO: 181857 - protein, 9 aa, Tick-borne encephalitis virus
HAVKMDVYN

SEQ ID NO: 181858 - protein, 9 aa, Tick-borne encephalitis virus
AVKMDVYNL

SEQ ID NO: 181859 - protein, 9 aa, Tick-borne encephalitis virus
VKMDVYNLG

SEQ ID NO: 181860 - protein, 9 aa, Tick-borne encephalitis virus
KMDVYNLGD

SEQ ID NO: 181861 - protein, 9 aa, Tick-borne encephalitis virus
MDVYNLGDQ

SEQ ID NO: 181862 - protein, 9 aa, Tick-borne encephalitis virus
DVYNLGDQT

SEQ ID NO: 181863 - protein, 9 aa, Tick-borne encephalitis virus
VYNLGDQTG

SEQ ID NO: 181864 - protein, 9 aa, Tick-borne encephalitis virus
YNLGDQTGV

SEQ ID NO: 181865 - protein, 9 aa, Tick-borne encephalitis virus
NLGDQTGVL

SEQ ID NO: 181866 - protein, 9 aa, Tick-borne encephalitis virus
LGDQTGVLL

SEQ ID NO: 181867 - protein, 9 aa, Tick-borne encephalitis virus
GDQTGVLLK

SEQ ID NO: 181868 - protein, 9 aa, Tick-borne encephalitis virus
DQTGVLLKS

SEQ ID NO: 181869 - protein, 9 aa, Tick-borne encephalitis virus
QTGVLLKSL

SEQ ID NO: 181870 - protein, 9 aa, Tick-borne encephalitis virus
TGVLLKSLA

SEQ ID NO: 181871 - protein, 9 aa, Tick-borne encephalitis virus
GVLLKSLAG

SEQ ID NO: 181872 - protein, 9 aa, Tick-borne encephalitis virus
VLLKSLAGV

SEQ ID NO: 181873 - protein, 9 aa, Tick-borne encephalitis virus
LLKSLAGVP

SEQ ID NO: 181874 - protein, 9 aa, Tick-borne encephalitis virus
LKSLAGVPV

SEQ ID NO: 181875 - protein, 9 aa, Tick-borne encephalitis virus
KSLAGVPVA

SEQ ID NO: 181876 - protein, 9 aa, Tick-borne encephalitis virus
SLAGVPVAH

SEQ ID NO: 181877 - protein, 9 aa, Tick-borne encephalitis virus
LAGVPVAHI

SEQ ID NO: 181878 - protein, 9 aa, Tick-borne encephalitis virus
AGVPVAHID

SEQ ID NO: 181879 - protein, 9 aa, Tick-borne encephalitis virus
GVPVAHIDG

SEQ ID NO: 181880 - protein, 9 aa, Tick-borne encephalitis virus
VPVAHIDGT

SEQ ID NO: 181881 - protein, 9 aa, Tick-borne encephalitis virus
PVAHIDGTK

SEQ ID NO: 181882 - protein, 9 aa, Tick-borne encephalitis virus
VAHIDGTKY

SEQ ID NO: 181883 - protein, 9 aa, Tick-borne encephalitis virus
AHIDGTKYH

SEQ ID NO: 181884 - protein, 9 aa, Tick-borne encephalitis virus
HIDGTKYHL

SEQ ID NO: 181885 - protein, 9 aa, Tick-borne encephalitis virus
IDGTKYHLK

SEQ ID NO: 181886 - protein, 9 aa, Tick-borne encephalitis virus
DGTKYHLKS

SEQ ID NO: 181887 - protein, 9 aa, Tick-borne encephalitis virus
GTKYHLKSG

SEQ ID NO: 181888 - protein, 9 aa, Tick-borne encephalitis virus
TKYHLKSGH

SEQ ID NO: 181889 - protein, 9 aa, Tick-borne encephalitis virus
KYHLKSGHV

SEQ ID NO: 181890 - protein, 9 aa, Tick-borne encephalitis virus
YHLKSGHVT

SEQ ID NO: 181891 - protein, 9 aa, Tick-borne encephalitis virus
HLKSGHVTC

SEQ ID NO: 181892 - protein, 9 aa, Tick-borne encephalitis virus
LKSGHVTCE

SEQ ID NO: 181893 - protein, 9 aa, Tick-borne encephalitis virus
KSGHVTCEV

SEQ ID NO: 181894 - protein, 9 aa, Tick-borne encephalitis virus
SGHVTCEVG

SEQ ID NO: 181895 - protein, 9 aa, Tick-borne encephalitis virus
GHVTCEVGL

SEQ ID NO: 181896 - protein, 9 aa, Tick-borne encephalitis virus
HVTCEVGLE

SEQ ID NO: 181897 - protein, 9 aa, Tick-borne encephalitis virus
VTCEVGLEK

SEQ ID NO: 181898 - protein, 9 aa, Tick-borne encephalitis virus
TCEVGLEKL

SEQ ID NO: 181899 - protein, 9 aa, Tick-borne encephalitis virus
CEVGLEKLK

SEQ ID NO: 181900 - protein, 9 aa, Tick-borne encephalitis virus
EVGLEKLKM

SEQ ID NO: 181901 - protein, 9 aa, Tick-borne encephalitis virus
VGLEKLKMK

SEQ ID NO: 181902 - protein, 9 aa, Tick-borne encephalitis virus
GLEKLKMKG

SEQ ID NO: 181903 - protein, 9 aa, Tick-borne encephalitis virus
LEKLKMKGL

SEQ ID NO: 181904 - protein, 9 aa, Tick-borne encephalitis virus
EKLKMKGLT

SEQ ID NO: 181905 - protein, 9 aa, Tick-borne encephalitis virus
KLKMKGLTY

SEQ ID NO: 181906 - protein, 9 aa, Tick-borne encephalitis virus
LKMKGLTYT

SEQ ID NO: 181907 - protein, 9 aa, Tick-borne encephalitis virus
KMKGLTYTM

SEQ ID NO: 181908 - protein, 9 aa, Tick-borne encephalitis virus
MKGLTYTMC

SEQ ID NO: 181909 - protein, 9 aa, Tick-borne encephalitis virus
KGLTYTMCD

SEQ ID NO: 181910 - protein, 9 aa, Tick-borne encephalitis virus
GLTYTMCDK

SEQ ID NO: 181911 - protein, 9 aa, Tick-borne encephalitis virus
LTYTMCDKT

SEQ ID NO: 181912 - protein, 9 aa, Tick-borne encephalitis virus
TYTMCDKTK

SEQ ID NO: 181913 - protein, 9 aa, Tick-borne encephalitis virus
YTMCDKTKF

SEQ ID NO: 181914 - protein, 9 aa, Tick-borne encephalitis virus
TMCDKTKFT

SEQ ID NO: 181915 - protein, 9 aa, Tick-borne encephalitis virus
MCDKTKFTW

SEQ ID NO: 181916 - protein, 9 aa, Tick-borne encephalitis virus
CDKTKFTWK

SEQ ID NO: 181917 - protein, 9 aa, Tick-borne encephalitis virus
DKTKFTWKR

SEQ ID NO: 181918 - protein, 9 aa, Tick-borne encephalitis virus
KTKFTWKRI

SEQ ID NO: 181919 - protein, 9 aa, Tick-borne encephalitis virus
TKFTWKRIP

SEQ ID NO: 181920 - protein, 9 aa, Tick-borne encephalitis virus
KFTWKRIPT

SEQ ID NO: 181921 - protein, 9 aa, Tick-borne encephalitis virus
FTWKRIPTD

SEQ ID NO: 181922 - protein, 9 aa, Tick-borne encephalitis virus
TWKRIPTDS

SEQ ID NO: 181923 - protein, 9 aa, Tick-borne encephalitis virus
WKRIPTDSG

SEQ ID NO: 181924 - protein, 9 aa, Tick-borne encephalitis virus
KRIPTDSGH

SEQ ID NO: 181925 - protein, 9 aa, Tick-borne encephalitis virus
RIPTDSGHD

SEQ ID NO: 181926 - protein, 9 aa, Tick-borne encephalitis virus
IPTDSGHDT

SEQ ID NO: 181927 - protein, 9 aa, Tick-borne encephalitis virus
PTDSGHDTV

SEQ ID NO: 181928 - protein, 9 aa, Tick-borne encephalitis virus
TDSGHDTVV

SEQ ID NO: 181929 - protein, 9 aa, Tick-borne encephalitis virus
DSGHDTVVM

SEQ ID NO: 181930 - protein, 9 aa, Tick-borne encephalitis virus
SGHDTVVME

SEQ ID NO: 181931 - protein, 9 aa, Tick-borne encephalitis virus
GHDTVVMEV

SEQ ID NO: 181932 - protein, 9 aa, Tick-borne encephalitis virus
HDTVVMEVA

SEQ ID NO: 181933 - protein, 9 aa, Tick-borne encephalitis virus
DTVVMEVAF

SEQ ID NO: 181934 - protein, 9 aa, Tick-borne encephalitis virus
TVVMEVAFS

SEQ ID NO: 181935 - protein, 9 aa, Tick-borne encephalitis virus
VVMEVAFSG

SEQ ID NO: 181936 - protein, 9 aa, Tick-borne encephalitis virus
VMEVAFSGT

SEQ ID NO: 181937 - protein, 9 aa, Tick-borne encephalitis virus
MEVAFSGTK

SEQ ID NO: 181938 - protein, 9 aa, Tick-borne encephalitis virus
EVAFSGTKP

SEQ ID NO: 181939 - protein, 9 aa, Tick-borne encephalitis virus
VAFSGTKPC

SEQ ID NO: 181940 - protein, 9 aa, Tick-borne encephalitis virus
AFSGTKPCR

SEQ ID NO: 181941 - protein, 9 aa, Tick-borne encephalitis virus
FSGTKPCRI

SEQ ID NO: 181942 - protein, 9 aa, Tick-borne encephalitis virus
SGTKPCRIP

SEQ ID NO: 181943 - protein, 9 aa, Tick-borne encephalitis virus
GTKPCRIPV

SEQ ID NO: 181944 - protein, 9 aa, Tick-borne encephalitis virus
TKPCRIPVR

SEQ ID NO: 181945 - protein, 9 aa, Tick-borne encephalitis virus
KPCRIPVRA

SEQ ID NO: 181946 - protein, 9 aa, Tick-borne encephalitis virus
PCRIPVRAV

SEQ ID NO: 181947 - protein, 9 aa, Tick-borne encephalitis virus
CRIPVRAVA

SEQ ID NO: 181948 - protein, 9 aa, Tick-borne encephalitis virus
RIPVRAVAH

SEQ ID NO: 181949 - protein, 9 aa, Tick-borne encephalitis virus
IPVRAVAHG

SEQ ID NO: 181950 - protein, 9 aa, Tick-borne encephalitis virus
PVRAVAHGS

SEQ ID NO: 181951 - protein, 9 aa, Tick-borne encephalitis virus
VRAVAHGSP

SEQ ID NO: 181952 - protein, 9 aa, Tick-borne encephalitis virus
RAVAHGSPD

SEQ ID NO: 181953 - protein, 9 aa, Tick-borne encephalitis virus
AVAHGSPDV

SEQ ID NO: 181954 - protein, 9 aa, Tick-borne encephalitis virus
VAHGSPDVN

SEQ ID NO: 181955 - protein, 9 aa, Tick-borne encephalitis virus
AHGSPDVNV

SEQ ID NO: 181956 - protein, 9 aa, Tick-borne encephalitis virus
HGSPDVNVA

SEQ ID NO: 181957 - protein, 9 aa, Tick-borne encephalitis virus
GSPDVNVAM

SEQ ID NO: 181958 - protein, 9 aa, Tick-borne encephalitis virus
SPDVNVAML

SEQ ID NO: 181959 - protein, 9 aa, Tick-borne encephalitis virus
PDVNVAMLI

SEQ ID NO: 181960 - protein, 9 aa, Tick-borne encephalitis virus
DVNVAMLIT

SEQ ID NO: 181961 - protein, 9 aa, Tick-borne encephalitis virus
VNVAMLITP

SEQ ID NO: 181962 - protein, 9 aa, Tick-borne encephalitis virus
NVAMLITPN

SEQ ID NO: 181963 - protein, 9 aa, Tick-borne encephalitis virus
VAMLITPNP

SEQ ID NO: 181964 - protein, 9 aa, Tick-borne encephalitis virus
AMLITPNPT

SEQ ID NO: 181965 - protein, 9 aa, Tick-borne encephalitis virus
MLITPNPTI

SEQ ID NO: 181966 - protein, 9 aa, Tick-borne encephalitis virus
LITPNPTIE

SEQ ID NO: 181967 - protein, 9 aa, Tick-borne encephalitis virus
ITPNPTIEN

SEQ ID NO: 181968 - protein, 9 aa, Tick-borne encephalitis virus
TPNPTIENN

SEQ ID NO: 181969 - protein, 9 aa, Tick-borne encephalitis virus
PNPTIENNG

SEQ ID NO: 181970 - protein, 9 aa, Tick-borne encephalitis virus
NPTIENNGG

SEQ ID NO: 181971 - protein, 9 aa, Tick-borne encephalitis virus
PTIENNGGG

SEQ ID NO: 181972 - protein, 9 aa, Tick-borne encephalitis virus
TIENNGGGF

SEQ ID NO: 181973 - protein, 9 aa, Tick-borne encephalitis virus
IENNGGGFI

SEQ ID NO: 181974 - protein, 9 aa, Tick-borne encephalitis virus
ENNGGGFIE

SEQ ID NO: 181975 - protein, 9 aa, Tick-borne encephalitis virus
NNGGGFIEM

SEQ ID NO: 181976 - protein, 9 aa, Tick-borne encephalitis virus
NGGGFIEMQ

SEQ ID NO: 181977 - protein, 9 aa, Tick-borne encephalitis virus
GGGFIEMQL

SEQ ID NO: 181978 - protein, 9 aa, Tick-borne encephalitis virus
GGFIEMQLP

SEQ ID NO: 181979 - protein, 9 aa, Tick-borne encephalitis virus
GFIEMQLPP

SEQ ID NO: 181980 - protein, 9 aa, Tick-borne encephalitis virus
FIEMQLPPG

SEQ ID NO: 181981 - protein, 9 aa, Tick-borne encephalitis virus
IEMQLPPGD

SEQ ID NO: 181982 - protein, 9 aa, Tick-borne encephalitis virus
EMQLPPGDN

SEQ ID NO: 181983 - protein, 9 aa, Tick-borne encephalitis virus
MQLPPGDNI

SEQ ID NO: 181984 - protein, 9 aa, Tick-borne encephalitis virus
QLPPGDNII

SEQ ID NO: 181985 - protein, 9 aa, Tick-borne encephalitis virus
LPPGDNIIY

SEQ ID NO: 181986 - protein, 9 aa, Tick-borne encephalitis virus
PPGDNIIYV

SEQ ID NO: 181987 - protein, 9 aa, Tick-borne encephalitis virus
PGDNIIYVG

SEQ ID NO: 181988 - protein, 9 aa, Tick-borne encephalitis virus
GDNIIYVGE

SEQ ID NO: 181989 - protein, 9 aa, Tick-borne encephalitis virus
DNIIYVGEL

SEQ ID NO: 181990 - protein, 9 aa, Tick-borne encephalitis virus
NIIYVGELS

SEQ ID NO: 181991 - protein, 9 aa, Tick-borne encephalitis virus
IIYVGELSH

SEQ ID NO: 181992 - protein, 9 aa, Tick-borne encephalitis virus
IYVGELSHQ

SEQ ID NO: 181993 - protein, 9 aa, Tick-borne encephalitis virus
YVGELSHQW

SEQ ID NO: 181994 - protein, 9 aa, Tick-borne encephalitis virus
VGELSHQWF

SEQ ID NO: 181995 - protein, 9 aa, Tick-borne encephalitis virus
GELSHQWFQ

SEQ ID NO: 181996 - protein, 9 aa, Tick-borne encephalitis virus
ELSHQWFQK

SEQ ID NO: 181997 - protein, 9 aa, Tick-borne encephalitis virus
LSHQWFQKG

SEQ ID NO: 181998 - protein, 9 aa, Tick-borne encephalitis virus
SHQWFQKGS

SEQ ID NO: 181999 - protein, 9 aa, Tick-borne encephalitis virus
HQWFQKGSS

SEQ ID NO: 182000 - protein, 9 aa, Tick-borne encephalitis virus
QWFQKGSSI

SEQ ID NO: 182001 - protein, 9 aa, Tick-borne encephalitis virus
WFQKGSSIG

SEQ ID NO: 182002 - protein, 9 aa, Tick-borne encephalitis virus
FQKGSSIGR

SEQ ID NO: 182003 - protein, 9 aa, Tick-borne encephalitis virus
QKGSSIGRV

SEQ ID NO: 182004 - protein, 9 aa, Tick-borne encephalitis virus
KGSSIGRVF

SEQ ID NO: 182005 - protein, 9 aa, Tick-borne encephalitis virus
GSSIGRVFQ

SEQ ID NO: 182006 - protein, 9 aa, Tick-borne encephalitis virus
SSIGRVFQK

SEQ ID NO: 182007 - protein, 9 aa, Tick-borne encephalitis virus
SIGRVFQKT

SEQ ID NO: 182008 - protein, 9 aa, Tick-borne encephalitis virus
IGRVFQKTR

SEQ ID NO: 182009 - protein, 9 aa, Tick-borne encephalitis virus
GRVFQKTRK

SEQ ID NO: 182010 - protein, 9 aa, Tick-borne encephalitis virus
RVFQKTRKG

SEQ ID NO: 182011 - protein, 9 aa, Tick-borne encephalitis virus
VFQKTRKGI

SEQ ID NO: 182012 - protein, 9 aa, Tick-borne encephalitis virus
FQKTRKGIE

SEQ ID NO: 182013 - protein, 9 aa, Tick-borne encephalitis virus
QKTRKGIER

SEQ ID NO: 182014 - protein, 9 aa, Tick-borne encephalitis virus
KTRKGIERL

SEQ ID NO: 182015 - protein, 9 aa, Tick-borne encephalitis virus
TRKGIERLT

SEQ ID NO: 182016 - protein, 9 aa, Tick-borne encephalitis virus
RKGIERLTV

SEQ ID NO: 182017 - protein, 9 aa, Tick-borne encephalitis virus
KGIERLTVI

SEQ ID NO: 182018 - protein, 9 aa, Tick-borne encephalitis virus
GIERLTVIG

SEQ ID NO: 182019 - protein, 9 aa, Tick-borne encephalitis virus
IERLTVIGE

SEQ ID NO: 182020 - protein, 9 aa, Tick-borne encephalitis virus
ERLTVIGEH

SEQ ID NO: 182021 - protein, 9 aa, Tick-borne encephalitis virus
RLTVIGEHA

SEQ ID NO: 182022 - protein, 9 aa, Tick-borne encephalitis virus
LTVIGEHAW

SEQ ID NO: 182023 - protein, 9 aa, Tick-borne encephalitis virus
TVIGEHAWD

SEQ ID NO: 182024 - protein, 9 aa, Tick-borne encephalitis virus
VIGEHAWDF

SEQ ID NO: 182025 - protein, 9 aa, Tick-borne encephalitis virus
IGEHAWDFG

SEQ ID NO: 182026 - protein, 9 aa, Tick-borne encephalitis virus
GEHAWDFGS

SEQ ID NO: 182027 - protein, 9 aa, Tick-borne encephalitis virus
EHAWDFGST

SEQ ID NO: 182028 - protein, 9 aa, Tick-borne encephalitis virus
HAWDFGSTG

SEQ ID NO: 182029 - protein, 9 aa, Tick-borne encephalitis virus
AWDFGSTGG

SEQ ID NO: 182030 - protein, 9 aa, Tick-borne encephalitis virus
WDFGSTGGF

SEQ ID NO: 182031 - protein, 9 aa, Tick-borne encephalitis virus
DFGSTGGFL

SEQ ID NO: 182032 - protein, 9 aa, Tick-borne encephalitis virus
FGSTGGFLT

SEQ ID NO: 182033 - protein, 9 aa, Tick-borne encephalitis virus
GSTGGFLTS

SEQ ID NO: 182034 - protein, 9 aa, Tick-borne encephalitis virus
STGGFLTSV

SEQ ID NO: 182035 - protein, 9 aa, Tick-borne encephalitis virus
TGGFLTSVG

SEQ ID NO: 182036 - protein, 9 aa, Tick-borne encephalitis virus
GGFLTSVGK

SEQ ID NO: 182037 - protein, 9 aa, Tick-borne encephalitis virus
GFLTSVGKA

SEQ ID NO: 182038 - protein, 9 aa, Tick-borne encephalitis virus
FLTSVGKAL

SEQ ID NO: 182039 - protein, 9 aa, Tick-borne encephalitis virus
LTSVGKALH

SEQ ID NO: 182040 - protein, 9 aa, Tick-borne encephalitis virus
TSVGKALHT

SEQ ID NO: 182041 - protein, 9 aa, Tick-borne encephalitis virus
SVGKALHTV

SEQ ID NO: 182042 - protein, 9 aa, Tick-borne encephalitis virus
VGKALHTVL

SEQ ID NO: 182043 - protein, 9 aa, Tick-borne encephalitis virus
GKALHTVLG

SEQ ID NO: 182044 - protein, 9 aa, Tick-borne encephalitis virus
KALHTVLGG

SEQ ID NO: 182045 - protein, 9 aa, Tick-borne encephalitis virus
ALHTVLGGA

SEQ ID NO: 182046 - protein, 9 aa, Tick-borne encephalitis virus
LHTVLGGAF

SEQ ID NO: 182047 - protein, 9 aa, Tick-borne encephalitis virus
HTVLGGAFN

SEQ ID NO: 182048 - protein, 9 aa, Tick-borne encephalitis virus
TVLGGAFNS

SEQ ID NO: 182049 - protein, 9 aa, Tick-borne encephalitis virus
VLGGAFNSL

SEQ ID NO: 182050 - protein, 9 aa, Tick-borne encephalitis virus
LGGAFNSLF

SEQ ID NO: 182051 - protein, 9 aa, Tick-borne encephalitis virus
GGAFNSLFG

SEQ ID NO: 182052 - protein, 9 aa, Tick-borne encephalitis virus
GAFNSLFGG

SEQ ID NO: 182053 - protein, 9 aa, Tick-borne encephalitis virus
AFNSLFGGV

SEQ ID NO: 182054 - protein, 9 aa, Tick-borne encephalitis virus
FNSLFGGVG

SEQ ID NO: 182055 - protein, 9 aa, Tick-borne encephalitis virus
NSLFGGVGF

SEQ ID NO: 182056 - protein, 9 aa, Tick-borne encephalitis virus
SLFGGVGFL

SEQ ID NO: 182057 - protein, 9 aa, Tick-borne encephalitis virus
LFGGVGFLP

SEQ ID NO: 182058 - protein, 9 aa, Tick-borne encephalitis virus
FGGVGFLPK

SEQ ID NO: 182059 - protein, 9 aa, Tick-borne encephalitis virus
GGVGFLPKI

SEQ ID NO: 182060 - protein, 9 aa, Tick-borne encephalitis virus
GVGFLPKIL

SEQ ID NO: 182061 - protein, 9 aa, Tick-borne encephalitis virus
VGFLPKILV

SEQ ID NO: 182062 - protein, 9 aa, Tick-borne encephalitis virus
GFLPKILVG

SEQ ID NO: 182063 - protein, 9 aa, Tick-borne encephalitis virus
GVALAWLGL

SEQ ID NO: 182064 - protein, 9 aa, Tick-borne encephalitis virus
VALAWLGLN

SEQ ID NO: 182065 - protein, 9 aa, Tick-borne encephalitis virus
ALAWLGLNM

SEQ ID NO: 182066 - protein, 9 aa, Tick-borne encephalitis virus
LAWLGLNMR

SEQ ID NO: 182067 - protein, 9 aa, Tick-borne encephalitis virus
AWLGLNMRN

SEQ ID NO: 182068 - protein, 9 aa, Tick-borne encephalitis virus
WLGLNMRNP

SEQ ID NO: 182069 - protein, 9 aa, Tick-borne encephalitis virus
LGLNMRNPT

SEQ ID NO: 182070 - protein, 9 aa, Tick-borne encephalitis virus
GLNMRNPTM

SEQ ID NO: 182071 - protein, 9 aa, Tick-borne encephalitis virus
LNMRNPTMS

SEQ ID NO: 182072 - protein, 9 aa, Tick-borne encephalitis virus
NMRNPTMSM

SEQ ID NO: 182073 - protein, 9 aa, Tick-borne encephalitis virus
MRNPTMSMS

SEQ ID NO: 182074 - protein, 9 aa, Tick-borne encephalitis virus
RNPTMSMSF

SEQ ID NO: 182075 - protein, 9 aa, Tick-borne encephalitis virus
NPTMSMSFL

SEQ ID NO: 182076 - protein, 9 aa, Tick-borne encephalitis virus
PTMSMSFLL

SEQ ID NO: 182077 - protein, 9 aa, Tick-borne encephalitis virus
TMSMSFLLA

SEQ ID NO: 182078 - protein, 9 aa, Tick-borne encephalitis virus
MSMSFLLAG

SEQ ID NO: 182079 - protein, 9 aa, Tick-borne encephalitis virus
SMSFLLAGG

SEQ ID NO: 182080 - protein, 9 aa, Tick-borne encephalitis virus
MSFLLAGGL

SEQ ID NO: 182081 - protein, 9 aa, Tick-borne encephalitis virus
SFLLAGGLV

SEQ ID NO: 182082 - protein, 9 aa, Tick-borne encephalitis virus
FLLAGGLVL

SEQ ID NO: 182083 - protein, 9 aa, Tick-borne encephalitis virus
LLAGGLVLA

SEQ ID NO: 182084 - protein, 9 aa, Tick-borne encephalitis virus
LAGGLVLAM

SEQ ID NO: 182085 - protein, 9 aa, Tick-borne encephalitis virus
AGGLVLAMT

SEQ ID NO: 182086 - protein, 9 aa, Tick-borne encephalitis virus
GGLVLAMTL

SEQ ID NO: 182087 - protein, 9 aa, Tick-borne encephalitis virus
GLVLAMTLG

SEQ ID NO: 182088 - protein, 9 aa, Tick-borne encephalitis virus
LVLAMTLGV

SEQ ID NO: 182089 - protein, 9 aa, Tick-borne encephalitis virus
VLAMTLGVG

SEQ ID NO: 182090 - protein, 9 aa, Tick-borne encephalitis virus
LAMTLGVGA

SEQ ID NO: 182091 - protein, 9 aa, Tick-borne encephalitis virus
AMTLGVGAD

SEQ ID NO: 182092 - protein, 9 aa, Tick-borne encephalitis virus
MTLGVGADV

SEQ ID NO: 182093 - protein, 9 aa, Tick-borne encephalitis virus
TLGVGADVG

SEQ ID NO: 182094 - protein, 9 aa, Tick-borne encephalitis virus
LGVGADVGC

SEQ ID NO: 182095 - protein, 9 aa, Tick-borne encephalitis virus
GVGADVGCA

SEQ ID NO: 182096 - protein, 9 aa, Tick-borne encephalitis virus
VGADVGCAV

SEQ ID NO: 182097 - protein, 9 aa, Tick-borne encephalitis virus
GADVGCAVD

SEQ ID NO: 182098 - protein, 9 aa, Tick-borne encephalitis virus
ADVGCAVDT

SEQ ID NO: 182099 - protein, 9 aa, Tick-borne encephalitis virus
DVGCAVDTE

SEQ ID NO: 182100 - protein, 9 aa, Tick-borne encephalitis virus
VGCAVDTER

SEQ ID NO: 182101 - protein, 9 aa, Tick-borne encephalitis virus
GCAVDTERM

SEQ ID NO: 182102 - protein, 9 aa, Tick-borne encephalitis virus
CAVDTERME

SEQ ID NO: 182103 - protein, 9 aa, Tick-borne encephalitis virus
AVDTERMEL

SEQ ID NO: 182104 - protein, 9 aa, Tick-borne encephalitis virus
VDTERMELR

SEQ ID NO: 182105 - protein, 9 aa, Tick-borne encephalitis virus
DTERMELRC

SEQ ID NO: 182106 - protein, 9 aa, Tick-borne encephalitis virus
TERMELRCG

SEQ ID NO: 182107 - protein, 9 aa, Tick-borne encephalitis virus
ERMELRCGE

SEQ ID NO: 182108 - protein, 9 aa, Tick-borne encephalitis virus
RMELRCGEG

SEQ ID NO: 182109 - protein, 9 aa, Tick-borne encephalitis virus
MELRCGEGL

SEQ ID NO: 182110 - protein, 9 aa, Tick-borne encephalitis virus
ELRCGEGLV

SEQ ID NO: 182111 - protein, 9 aa, Tick-borne encephalitis virus
LRCGEGLVV

SEQ ID NO: 182112 - protein, 9 aa, Tick-borne encephalitis virus
RCGEGLVVW

SEQ ID NO: 182113 - protein, 9 aa, Tick-borne encephalitis virus
CGEGLVVWR

SEQ ID NO: 182114 - protein, 9 aa, Tick-borne encephalitis virus
GEGLVVWRE

SEQ ID NO: 182115 - protein, 9 aa, Tick-borne encephalitis virus
EGLVVWREV

SEQ ID NO: 182116 - protein, 9 aa, Tick-borne encephalitis virus
GLVVWREVS

SEQ ID NO: 182117 - protein, 9 aa, Tick-borne encephalitis virus
LVVWREVSE

SEQ ID NO: 182118 - protein, 9 aa, Tick-borne encephalitis virus
VVWREVSEW

SEQ ID NO: 182119 - protein, 9 aa, Tick-borne encephalitis virus
VWREVSEWY

SEQ ID NO: 182120 - protein, 9 aa, Tick-borne encephalitis virus
WREVSEWYD

SEQ ID NO: 182121 - protein, 9 aa, Tick-borne encephalitis virus
REVSEWYDN

SEQ ID NO: 182122 - protein, 9 aa, Tick-borne encephalitis virus
EVSEWYDNY

SEQ ID NO: 182123 - protein, 9 aa, Tick-borne encephalitis virus
VSEWYDNYA

SEQ ID NO: 182124 - protein, 9 aa, Tick-borne encephalitis virus
SEWYDNYAY

SEQ ID NO: 182125 - protein, 9 aa, Tick-borne encephalitis virus
EWYDNYAYY

SEQ ID NO: 182126 - protein, 9 aa, Tick-borne encephalitis virus
WYDNYAYYP

SEQ ID NO: 182127 - protein, 9 aa, Tick-borne encephalitis virus
YDNYAYYPE

SEQ ID NO: 182128 - protein, 9 aa, Tick-borne encephalitis virus
DNYAYYPET

SEQ ID NO: 182129 - protein, 9 aa, Tick-borne encephalitis virus
NYAYYPETP

SEQ ID NO: 182130 - protein, 9 aa, Tick-borne encephalitis virus
YAYYPETPG

SEQ ID NO: 182131 - protein, 9 aa, Tick-borne encephalitis virus
AYYPETPGA

SEQ ID NO: 182132 - protein, 9 aa, Tick-borne encephalitis virus
YYPETPGAL

SEQ ID NO: 182133 - protein, 9 aa, Tick-borne encephalitis virus
YPETPGALA

SEQ ID NO: 182134 - protein, 9 aa, Tick-borne encephalitis virus
PETPGALAS

SEQ ID NO: 182135 - protein, 9 aa, Tick-borne encephalitis virus
ETPGALASA

SEQ ID NO: 182136 - protein, 9 aa, Tick-borne encephalitis virus
TPGALASAI

SEQ ID NO: 182137 - protein, 9 aa, Tick-borne encephalitis virus
PGALASAIK

SEQ ID NO: 182138 - protein, 9 aa, Tick-borne encephalitis virus
GALASAIKE

SEQ ID NO: 182139 - protein, 9 aa, Tick-borne encephalitis virus
ALASAIKET

SEQ ID NO: 182140 - protein, 9 aa, Tick-borne encephalitis virus
LASAIKETF

SEQ ID NO: 182141 - protein, 9 aa, Tick-borne encephalitis virus
ASAIKETFE

SEQ ID NO: 182142 - protein, 9 aa, Tick-borne encephalitis virus
SAIKETFEE

SEQ ID NO: 182143 - protein, 9 aa, Tick-borne encephalitis virus
AIKETFEEG

SEQ ID NO: 182144 - protein, 9 aa, Tick-borne encephalitis virus
IKETFEEGT

SEQ ID NO: 182145 - protein, 9 aa, Tick-borne encephalitis virus
KETFEEGTC

SEQ ID NO: 182146 - protein, 9 aa, Tick-borne encephalitis virus
ETFEEGTCG

SEQ ID NO: 182147 - protein, 9 aa, Tick-borne encephalitis virus
TFEEGTCGI

SEQ ID NO: 182148 - protein, 9 aa, Tick-borne encephalitis virus
FEEGTCGIV

SEQ ID NO: 182149 - protein, 9 aa, Tick-borne encephalitis virus
EEGTCGIVP

SEQ ID NO: 182150 - protein, 9 aa, Tick-borne encephalitis virus
EGTCGIVPQ

SEQ ID NO: 182151 - protein, 9 aa, Tick-borne encephalitis virus
GTCGIVPQN

SEQ ID NO: 182152 - protein, 9 aa, Tick-borne encephalitis virus
TCGIVPQNR

SEQ ID NO: 182153 - protein, 9 aa, Tick-borne encephalitis virus
CGIVPQNRL

SEQ ID NO: 182154 - protein, 9 aa, Tick-borne encephalitis virus
GIVPQNRLE

SEQ ID NO: 182155 - protein, 9 aa, Tick-borne encephalitis virus
IVPQNRLEM

SEQ ID NO: 182156 - protein, 9 aa, Tick-borne encephalitis virus
VPQNRLEMA

SEQ ID NO: 182157 - protein, 9 aa, Tick-borne encephalitis virus
PQNRLEMAM

SEQ ID NO: 182158 - protein, 9 aa, Tick-borne encephalitis virus
QNRLEMAMW

SEQ ID NO: 182159 - protein, 9 aa, Tick-borne encephalitis virus
NRLEMAMWR

SEQ ID NO: 182160 - protein, 9 aa, Tick-borne encephalitis virus
RLEMAMWRS

SEQ ID NO: 182161 - protein, 9 aa, Tick-borne encephalitis virus
LEMAMWRSS

SEQ ID NO: 182162 - protein, 9 aa, Tick-borne encephalitis virus
EMAMWRSSA

SEQ ID NO: 182163 - protein, 9 aa, Tick-borne encephalitis virus
MAMWRSSAT

SEQ ID NO: 182164 - protein, 9 aa, Tick-borne encephalitis virus
AMWRSSATE

SEQ ID NO: 182165 - protein, 9 aa, Tick-borne encephalitis virus
MWRSSATEL

SEQ ID NO: 182166 - protein, 9 aa, Tick-borne encephalitis virus
WRSSATELN

SEQ ID NO: 182167 - protein, 9 aa, Tick-borne encephalitis virus
RSSATELNL

SEQ ID NO: 182168 - protein, 9 aa, Tick-borne encephalitis virus
SSATELNLA

SEQ ID NO: 182169 - protein, 9 aa, Tick-borne encephalitis virus
SATELNLAL

SEQ ID NO: 182170 - protein, 9 aa, Tick-borne encephalitis virus
ATELNLALA

SEQ ID NO: 182171 - protein, 9 aa, Tick-borne encephalitis virus
TELNLALAE

SEQ ID NO: 182172 - protein, 9 aa, Tick-borne encephalitis virus
ELNLALAEG

SEQ ID NO: 182173 - protein, 9 aa, Tick-borne encephalitis virus
LNLALAEGD

SEQ ID NO: 182174 - protein, 9 aa, Tick-borne encephalitis virus
NLALAEGDA

SEQ ID NO: 182175 - protein, 9 aa, Tick-borne encephalitis virus
LALAEGDAN

SEQ ID NO: 182176 - protein, 9 aa, Tick-borne encephalitis virus
ALAEGDANL

SEQ ID NO: 182177 - protein, 9 aa, Tick-borne encephalitis virus
LAEGDANLT

SEQ ID NO: 182178 - protein, 9 aa, Tick-borne encephalitis virus
AEGDANLTV

SEQ ID NO: 182179 - protein, 9 aa, Tick-borne encephalitis virus
EGDANLTVV

SEQ ID NO: 182180 - protein, 9 aa, Tick-borne encephalitis virus
GDANLTVVV

SEQ ID NO: 182181 - protein, 9 aa, Tick-borne encephalitis virus
DANLTVVVD

SEQ ID NO: 182182 - protein, 9 aa, Tick-borne encephalitis virus
ANLTVVVDK

SEQ ID NO: 182183 - protein, 9 aa, Tick-borne encephalitis virus
NLTVVVDKL

SEQ ID NO: 182184 - protein, 9 aa, Tick-borne encephalitis virus
LTVVVDKLD

SEQ ID NO: 182185 - protein, 9 aa, Tick-borne encephalitis virus
TVVVDKLDP

SEQ ID NO: 182186 - protein, 9 aa, Tick-borne encephalitis virus
VVVDKLDPT

SEQ ID NO: 182187 - protein, 9 aa, Tick-borne encephalitis virus
VVDKLDPTD

SEQ ID NO: 182188 - protein, 9 aa, Tick-borne encephalitis virus
VDKLDPTDY

SEQ ID NO: 182189 - protein, 9 aa, Tick-borne encephalitis virus
DKLDPTDYR

SEQ ID NO: 182190 - protein, 9 aa, Tick-borne encephalitis virus
KLDPTDYRG

SEQ ID NO: 182191 - protein, 9 aa, Tick-borne encephalitis virus
LDPTDYRGG

SEQ ID NO: 182192 - protein, 9 aa, Tick-borne encephalitis virus
DPTDYRGGI

SEQ ID NO: 182193 - protein, 9 aa, Tick-borne encephalitis virus
PTDYRGGIP

SEQ ID NO: 182194 - protein, 9 aa, Tick-borne encephalitis virus
TDYRGGIPG

SEQ ID NO: 182195 - protein, 9 aa, Tick-borne encephalitis virus
DYRGGIPGL

SEQ ID NO: 182196 - protein, 9 aa, Tick-borne encephalitis virus
YRGGIPGLL

SEQ ID NO: 182197 - protein, 9 aa, Tick-borne encephalitis virus
RGGIPGLLK

SEQ ID NO: 182198 - protein, 9 aa, Tick-borne encephalitis virus
GGIPGLLKK

SEQ ID NO: 182199 - protein, 9 aa, Tick-borne encephalitis virus
GIPGLLKKG

SEQ ID NO: 182200 - protein, 9 aa, Tick-borne encephalitis virus
IPGLLKKGK

SEQ ID NO: 182201 - protein, 9 aa, Tick-borne encephalitis virus
PGLLKKGKD

SEQ ID NO: 182202 - protein, 9 aa, Tick-borne encephalitis virus
GLLKKGKDI

SEQ ID NO: 182203 - protein, 9 aa, Tick-borne encephalitis virus
LLKKGKDIK

SEQ ID NO: 182204 - protein, 9 aa, Tick-borne encephalitis virus
LKKGKDIKV

SEQ ID NO: 182205 - protein, 9 aa, Tick-borne encephalitis virus
KKGKDIKVS

SEQ ID NO: 182206 - protein, 9 aa, Tick-borne encephalitis virus
KGKDIKVSW

SEQ ID NO: 182207 - protein, 9 aa, Tick-borne encephalitis virus
GKDIKVSWK

SEQ ID NO: 182208 - protein, 9 aa, Tick-borne encephalitis virus
KDIKVSWKS

SEQ ID NO: 182209 - protein, 9 aa, Tick-borne encephalitis virus
DIKVSWKSW

SEQ ID NO: 182210 - protein, 9 aa, Tick-borne encephalitis virus
IKVSWKSWG

SEQ ID NO: 182211 - protein, 9 aa, Tick-borne encephalitis virus
KVSWKSWGH

SEQ ID NO: 182212 - protein, 9 aa, Tick-borne encephalitis virus
VSWKSWGHS

SEQ ID NO: 182213 - protein, 9 aa, Tick-borne encephalitis virus
SWGHSMIWS

SEQ ID NO: 182214 - protein, 9 aa, Tick-borne encephalitis virus
SMIWSVPEA

SEQ ID NO: 182215 - protein, 9 aa, Tick-borne encephalitis virus
MIWSVPEAP

SEQ ID NO: 182216 - protein, 9 aa, Tick-borne encephalitis virus
IWSVPEAPR

SEQ ID NO: 182217 - protein, 9 aa, Tick-borne encephalitis virus
WSVPEAPRR

SEQ ID NO: 182218 - protein, 9 aa, Tick-borne encephalitis virus
SVPEAPRRF

SEQ ID NO: 182219 - protein, 9 aa, Tick-borne encephalitis virus
VPEAPRRFM

SEQ ID NO: 182220 - protein, 9 aa, Tick-borne encephalitis virus
PEAPRRFMV

SEQ ID NO: 182221 - protein, 9 aa, Tick-borne encephalitis virus
EAPRRFMVG

SEQ ID NO: 182222 - protein, 9 aa, Tick-borne encephalitis virus
APRRFMVGT

SEQ ID NO: 182223 - protein, 9 aa, Tick-borne encephalitis virus
PRRFMVGTE

SEQ ID NO: 182224 - protein, 9 aa, Tick-borne encephalitis virus
RRFMVGTEG

SEQ ID NO: 182225 - protein, 9 aa, Tick-borne encephalitis virus
RFMVGTEGG

SEQ ID NO: 182226 - protein, 9 aa, Tick-borne encephalitis virus
SECPLERRK

SEQ ID NO: 182227 - protein, 9 aa, Tick-borne encephalitis virus
ECPLERRKT

SEQ ID NO: 182228 - protein, 9 aa, Tick-borne encephalitis virus
CPLERRKTG

SEQ ID NO: 182229 - protein, 9 aa, Tick-borne encephalitis virus
PLERRKTGV

SEQ ID NO: 182230 - protein, 9 aa, Tick-borne encephalitis virus
LERRKTGVF

SEQ ID NO: 182231 - protein, 9 aa, Tick-borne encephalitis virus
ERRKTGVFT

SEQ ID NO: 182232 - protein, 9 aa, Tick-borne encephalitis virus
RRKTGVFTV

SEQ ID NO: 182233 - protein, 9 aa, Tick-borne encephalitis virus
RKTGVFTVA

SEQ ID NO: 182234 - protein, 9 aa, Tick-borne encephalitis virus
KTGVFTVAE

SEQ ID NO: 182235 - protein, 9 aa, Tick-borne encephalitis virus
TGVFTVAEF

SEQ ID NO: 182236 - protein, 9 aa, Tick-borne encephalitis virus
GVFTVAEFG

SEQ ID NO: 182237 - protein, 9 aa, Tick-borne encephalitis virus
VFTVAEFGV

SEQ ID NO: 182238 - protein, 9 aa, Tick-borne encephalitis virus
FTVAEFGVG

SEQ ID NO: 182239 - protein, 9 aa, Tick-borne encephalitis virus
TVAEFGVGL

SEQ ID NO: 182240 - protein, 9 aa, Tick-borne encephalitis virus
VAEFGVGLR

SEQ ID NO: 182241 - protein, 9 aa, Tick-borne encephalitis virus
AEFGVGLRT

SEQ ID NO: 182242 - protein, 9 aa, Tick-borne encephalitis virus
EFGVGLRTK

SEQ ID NO: 182243 - protein, 9 aa, Tick-borne encephalitis virus
FGVGLRTKV

SEQ ID NO: 182244 - protein, 9 aa, Tick-borne encephalitis virus
GVGLRTKVF

SEQ ID NO: 182245 - protein, 9 aa, Tick-borne encephalitis virus
VGLRTKVFL

SEQ ID NO: 182246 - protein, 9 aa, Tick-borne encephalitis virus
GLRTKVFLD

SEQ ID NO: 182247 - protein, 9 aa, Tick-borne encephalitis virus
LRTKVFLDF

SEQ ID NO: 182248 - protein, 9 aa, Tick-borne encephalitis virus
RTKVFLDFR

SEQ ID NO: 182249 - protein, 9 aa, Tick-borne encephalitis virus
TKVFLDFRQ

SEQ ID NO: 182250 - protein, 9 aa, Tick-borne encephalitis virus
KVFLDFRQE

SEQ ID NO: 182251 - protein, 9 aa, Tick-borne encephalitis virus
VFLDFRQES

SEQ ID NO: 182252 - protein, 9 aa, Tick-borne encephalitis virus
FLDFRQEST

SEQ ID NO: 182253 - protein, 9 aa, Tick-borne encephalitis virus
LDFRQESTH

SEQ ID NO: 182254 - protein, 9 aa, Tick-borne encephalitis virus
DFRQESTHE

SEQ ID NO: 182255 - protein, 9 aa, Tick-borne encephalitis virus
FRQESTHEC

SEQ ID NO: 182256 - protein, 9 aa, Tick-borne encephalitis virus
RQESTHECD

SEQ ID NO: 182257 - protein, 9 aa, Tick-borne encephalitis virus
QESTHECDT

SEQ ID NO: 182258 - protein, 9 aa, Tick-borne encephalitis virus
ESTHECDTG

SEQ ID NO: 182259 - protein, 9 aa, Tick-borne encephalitis virus
STHECDTGV

SEQ ID NO: 182260 - protein, 9 aa, Tick-borne encephalitis virus
THECDTGVM

SEQ ID NO: 182261 - protein, 9 aa, Tick-borne encephalitis virus
HECDTGVMG

SEQ ID NO: 182262 - protein, 9 aa, Tick-borne encephalitis virus
ECDTGVMGA

SEQ ID NO: 182263 - protein, 9 aa, Tick-borne encephalitis virus
CDTGVMGAA

SEQ ID NO: 182264 - protein, 9 aa, Tick-borne encephalitis virus
DTGVMGAAV

SEQ ID NO: 182265 - protein, 9 aa, Tick-borne encephalitis virus
TGVMGAAVK

SEQ ID NO: 182266 - protein, 9 aa, Tick-borne encephalitis virus
GVMGAAVKN

SEQ ID NO: 182267 - protein, 9 aa, Tick-borne encephalitis virus
VMGAAVKNG

SEQ ID NO: 182268 - protein, 9 aa, Tick-borne encephalitis virus
MGAAVKNGM

SEQ ID NO: 182269 - protein, 9 aa, Tick-borne encephalitis virus
GAAVKNGMA

SEQ ID NO: 182270 - protein, 9 aa, Tick-borne encephalitis virus
AAVKNGMAV

SEQ ID NO: 182271 - protein, 9 aa, Tick-borne encephalitis virus
AVKNGMAVH

SEQ ID NO: 182272 - protein, 9 aa, Tick-borne encephalitis virus
VKNGMAVHT

SEQ ID NO: 182273 - protein, 9 aa, Tick-borne encephalitis virus
KNGMAVHTD

SEQ ID NO: 182274 - protein, 9 aa, Tick-borne encephalitis virus
NGMAVHTDQ

SEQ ID NO: 182275 - protein, 9 aa, Tick-borne encephalitis virus
GMAVHTDQS

SEQ ID NO: 182276 - protein, 9 aa, Tick-borne encephalitis virus
MAVHTDQSL

SEQ ID NO: 182277 - protein, 9 aa, Tick-borne encephalitis virus
AVHTDQSLW

SEQ ID NO: 182278 - protein, 9 aa, Tick-borne encephalitis virus
VHTDQSLWM

SEQ ID NO: 182279 - protein, 9 aa, Tick-borne encephalitis virus
HTDQSLWMK

SEQ ID NO: 182280 - protein, 9 aa, Tick-borne encephalitis virus
TDQSLWMKS

SEQ ID NO: 182281 - protein, 9 aa, Tick-borne encephalitis virus
DQSLWMKSV

SEQ ID NO: 182282 - protein, 9 aa, Tick-borne encephalitis virus
QSLWMKSVR

SEQ ID NO: 182283 - protein, 9 aa, Tick-borne encephalitis virus
SLWMKSVRN

SEQ ID NO: 182284 - protein, 9 aa, Tick-borne encephalitis virus
LWMKSVRND

SEQ ID NO: 182285 - protein, 9 aa, Tick-borne encephalitis virus
WMKSVRNDT

SEQ ID NO: 182286 - protein, 9 aa, Tick-borne encephalitis virus
MKSVRNDTG

SEQ ID NO: 182287 - protein, 9 aa, Tick-borne encephalitis virus
KSVRNDTGT

SEQ ID NO: 182288 - protein, 9 aa, Tick-borne encephalitis virus
SVRNDTGTY

SEQ ID NO: 182289 - protein, 9 aa, Tick-borne encephalitis virus
VRNDTGTYI

SEQ ID NO: 182290 - protein, 9 aa, Tick-borne encephalitis virus
RNDTGTYIV

SEQ ID NO: 182291 - protein, 9 aa, Tick-borne encephalitis virus
NDTGTYIVE

SEQ ID NO: 182292 - protein, 9 aa, Tick-borne encephalitis virus
DTGTYIVEL

SEQ ID NO: 182293 - protein, 9 aa, Tick-borne encephalitis virus
TGTYIVELL

SEQ ID NO: 182294 - protein, 9 aa, Tick-borne encephalitis virus
GTYIVELLV

SEQ ID NO: 182295 - protein, 9 aa, Tick-borne encephalitis virus
TYIVELLVT

SEQ ID NO: 182296 - protein, 9 aa, Tick-borne encephalitis virus
YIVELLVTD

SEQ ID NO: 182297 - protein, 9 aa, Tick-borne encephalitis virus
IVELLVTDL

SEQ ID NO: 182298 - protein, 9 aa, Tick-borne encephalitis virus
VELLVTDLR

SEQ ID NO: 182299 - protein, 9 aa, Tick-borne encephalitis virus
ELLVTDLRN

SEQ ID NO: 182300 - protein, 9 aa, Tick-borne encephalitis virus
LLVTDLRNC

SEQ ID NO: 182301 - protein, 9 aa, Tick-borne encephalitis virus
LVTDLRNCS

SEQ ID NO: 182302 - protein, 9 aa, Tick-borne encephalitis virus
VTDLRNCSW

SEQ ID NO: 182303 - protein, 9 aa, Tick-borne encephalitis virus
TDLRNCSWP

SEQ ID NO: 182304 - protein, 9 aa, Tick-borne encephalitis virus
DLRNCSWPA

SEQ ID NO: 182305 - protein, 9 aa, Tick-borne encephalitis virus
LRNCSWPAS

SEQ ID NO: 182306 - protein, 9 aa, Tick-borne encephalitis virus
RNCSWPASH

SEQ ID NO: 182307 - protein, 9 aa, Tick-borne encephalitis virus
NCSWPASHT

SEQ ID NO: 182308 - protein, 9 aa, Tick-borne encephalitis virus
CSWPASHTI

SEQ ID NO: 182309 - protein, 9 aa, Tick-borne encephalitis virus
SWPASHTID

SEQ ID NO: 182310 - protein, 9 aa, Tick-borne encephalitis virus
WPASHTIDN

SEQ ID NO: 182311 - protein, 9 aa, Tick-borne encephalitis virus
PASHTIDNA

SEQ ID NO: 182312 - protein, 9 aa, Tick-borne encephalitis virus
ASHTIDNAE

SEQ ID NO: 182313 - protein, 9 aa, Tick-borne encephalitis virus
SHTIDNAEV

SEQ ID NO: 182314 - protein, 9 aa, Tick-borne encephalitis virus
HTIDNAEVV

SEQ ID NO: 182315 - protein, 9 aa, Tick-borne encephalitis virus
TIDNAEVVD

SEQ ID NO: 182316 - protein, 9 aa, Tick-borne encephalitis virus
IDNAEVVDS

SEQ ID NO: 182317 - protein, 9 aa, Tick-borne encephalitis virus
DNAEVVDSE

SEQ ID NO: 182318 - protein, 9 aa, Tick-borne encephalitis virus
NAEVVDSEL

SEQ ID NO: 182319 - protein, 9 aa, Tick-borne encephalitis virus
AEVVDSELF

SEQ ID NO: 182320 - protein, 9 aa, Tick-borne encephalitis virus
EVVDSELFL

SEQ ID NO: 182321 - protein, 9 aa, Tick-borne encephalitis virus
VVDSELFLP

SEQ ID NO: 182322 - protein, 9 aa, Tick-borne encephalitis virus
VDSELFLPA

SEQ ID NO: 182323 - protein, 9 aa, Tick-borne encephalitis virus
DSELFLPAS

SEQ ID NO: 182324 - protein, 9 aa, Tick-borne encephalitis virus
SELFLPASL

SEQ ID NO: 182325 - protein, 9 aa, Tick-borne encephalitis virus
ELFLPASLA

SEQ ID NO: 182326 - protein, 9 aa, Tick-borne encephalitis virus
LFLPASLAG

SEQ ID NO: 182327 - protein, 9 aa, Tick-borne encephalitis virus
FLPASLAGP

SEQ ID NO: 182328 - protein, 9 aa, Tick-borne encephalitis virus
LPASLAGPR

SEQ ID NO: 182329 - protein, 9 aa, Tick-borne encephalitis virus
PASLAGPRS

SEQ ID NO: 182330 - protein, 9 aa, Tick-borne encephalitis virus
ASLAGPRSW

SEQ ID NO: 182331 - protein, 9 aa, Tick-borne encephalitis virus
SLAGPRSWY

SEQ ID NO: 182332 - protein, 9 aa, Tick-borne encephalitis virus
LAGPRSWYN

SEQ ID NO: 182333 - protein, 9 aa, Tick-borne encephalitis virus
AGPRSWYNR

SEQ ID NO: 182334 - protein, 9 aa, Tick-borne encephalitis virus
GPRSWYNRI

SEQ ID NO: 182335 - protein, 9 aa, Tick-borne encephalitis virus
PRSWYNRIP

SEQ ID NO: 182336 - protein, 9 aa, Tick-borne encephalitis virus
RSWYNRIPG

SEQ ID NO: 182337 - protein, 9 aa, Tick-borne encephalitis virus
SWYNRIPGY

SEQ ID NO: 182338 - protein, 9 aa, Tick-borne encephalitis virus
WYNRIPGYS

SEQ ID NO: 182339 - protein, 9 aa, Tick-borne encephalitis virus
YNRIPGYSE

SEQ ID NO: 182340 - protein, 9 aa, Tick-borne encephalitis virus
NRIPGYSEQ

SEQ ID NO: 182341 - protein, 9 aa, Tick-borne encephalitis virus
RIPGYSEQV

SEQ ID NO: 182342 - protein, 9 aa, Tick-borne encephalitis virus
IPGYSEQVK

SEQ ID NO: 182343 - protein, 9 aa, Tick-borne encephalitis virus
PGYSEQVKG

SEQ ID NO: 182344 - protein, 9 aa, Tick-borne encephalitis virus
GYSEQVKGP

SEQ ID NO: 182345 - protein, 9 aa, Tick-borne encephalitis virus
YSEQVKGPW

SEQ ID NO: 182346 - protein, 9 aa, Tick-borne encephalitis virus
SEQVKGPWK

SEQ ID NO: 182347 - protein, 9 aa, Tick-borne encephalitis virus
EQVKGPWKY

SEQ ID NO: 182348 - protein, 9 aa, Tick-borne encephalitis virus
QVKGPWKYS

SEQ ID NO: 182349 - protein, 9 aa, Tick-borne encephalitis virus
VKGPWKYSP

SEQ ID NO: 182350 - protein, 9 aa, Tick-borne encephalitis virus
KGPWKYSPI

SEQ ID NO: 182351 - protein, 9 aa, Tick-borne encephalitis virus
GPWKYSPIR

SEQ ID NO: 182352 - protein, 9 aa, Tick-borne encephalitis virus
PWKYSPIRV

SEQ ID NO: 182353 - protein, 9 aa, Tick-borne encephalitis virus
PIRVTREEC

SEQ ID NO: 182354 - protein, 9 aa, Tick-borne encephalitis virus
IRVTREECP

SEQ ID NO: 182355 - protein, 9 aa, Tick-borne encephalitis virus
RVTREECPG

SEQ ID NO: 182356 - protein, 9 aa, Tick-borne encephalitis virus
VTREECPGT

SEQ ID NO: 182357 - protein, 9 aa, Tick-borne encephalitis virus
TREECPGTR

SEQ ID NO: 182358 - protein, 9 aa, Tick-borne encephalitis virus
REECPGTRV

SEQ ID NO: 182359 - protein, 9 aa, Tick-borne encephalitis virus
ECPGTRVTI

SEQ ID NO: 182360 - protein, 9 aa, Tick-borne encephalitis virus
INADCDKRG

SEQ ID NO: 182361 - protein, 9 aa, Tick-borne encephalitis virus
NADCDKRGA

SEQ ID NO: 182362 - protein, 9 aa, Tick-borne encephalitis virus
ADCDKRGAS

SEQ ID NO: 182363 - protein, 9 aa, Tick-borne encephalitis virus
DCDKRGASV

SEQ ID NO: 182364 - protein, 9 aa, Tick-borne encephalitis virus
CDKRGASVR

SEQ ID NO: 182365 - protein, 9 aa, Tick-borne encephalitis virus
DKRGASVRS

SEQ ID NO: 182366 - protein, 9 aa, Tick-borne encephalitis virus
KRGASVRST

SEQ ID NO: 182367 - protein, 9 aa, Tick-borne encephalitis virus
RGASVRSTT

SEQ ID NO: 182368 - protein, 9 aa, Tick-borne encephalitis virus
GASVRSTTE

SEQ ID NO: 182369 - protein, 9 aa, Tick-borne encephalitis virus
ASVRSTTES

SEQ ID NO: 182370 - protein, 9 aa, Tick-borne encephalitis virus
SVRSTTESG

SEQ ID NO: 182371 - protein, 9 aa, Tick-borne encephalitis virus
VRSTTESGK

SEQ ID NO: 182372 - protein, 9 aa, Tick-borne encephalitis virus
RSTTESGKV

SEQ ID NO: 182373 - protein, 9 aa, Tick-borne encephalitis virus
STTESGKVI

SEQ ID NO: 182374 - protein, 9 aa, Tick-borne encephalitis virus
TTESGKVIP

SEQ ID NO: 182375 - protein, 9 aa, Tick-borne encephalitis virus
TESGKVIPE

SEQ ID NO: 182376 - protein, 9 aa, Tick-borne encephalitis virus
ESGKVIPEW

SEQ ID NO: 182377 - protein, 9 aa, Tick-borne encephalitis virus
SGKVIPEWC

SEQ ID NO: 182378 - protein, 9 aa, Tick-borne encephalitis virus
GKVIPEWCC

SEQ ID NO: 182379 - protein, 9 aa, Tick-borne encephalitis virus
KVIPEWCCR

SEQ ID NO: 182380 - protein, 9 aa, Tick-borne encephalitis virus
VIPEWCCRT

SEQ ID NO: 182381 - protein, 9 aa, Tick-borne encephalitis virus
IPEWCCRTC

SEQ ID NO: 182382 - protein, 9 aa, Tick-borne encephalitis virus
PEWCCRTCT

SEQ ID NO: 182383 - protein, 9 aa, Tick-borne encephalitis virus
EWCCRTCTL

SEQ ID NO: 182384 - protein, 9 aa, Tick-borne encephalitis virus
WCCRTCTLP

SEQ ID NO: 182385 - protein, 9 aa, Tick-borne encephalitis virus
CCRTCTLPP

SEQ ID NO: 182386 - protein, 9 aa, Tick-borne encephalitis virus
CRTCTLPPV

SEQ ID NO: 182387 - protein, 9 aa, Tick-borne encephalitis virus
RTCTLPPVT

SEQ ID NO: 182388 - protein, 9 aa, Tick-borne encephalitis virus
TCTLPPVTF

SEQ ID NO: 182389 - protein, 9 aa, Tick-borne encephalitis virus
CTLPPVTFR

SEQ ID NO: 182390 - protein, 9 aa, Tick-borne encephalitis virus
TLPPVTFRT

SEQ ID NO: 182391 - protein, 9 aa, Tick-borne encephalitis virus
LPPVTFRTG

SEQ ID NO: 182392 - protein, 9 aa, Tick-borne encephalitis virus
PPVTFRTGT

SEQ ID NO: 182393 - protein, 9 aa, Tick-borne encephalitis virus
PVTFRTGTD

SEQ ID NO: 182394 - protein, 9 aa, Tick-borne encephalitis virus
VTFRTGTDC

SEQ ID NO: 182395 - protein, 9 aa, Tick-borne encephalitis virus
TFRTGTDCW

SEQ ID NO: 182396 - protein, 9 aa, Tick-borne encephalitis virus
FRTGTDCWY

SEQ ID NO: 182397 - protein, 9 aa, Tick-borne encephalitis virus
RTGTDCWYA

SEQ ID NO: 182398 - protein, 9 aa, Tick-borne encephalitis virus
TGTDCWYAM

SEQ ID NO: 182399 - protein, 9 aa, Tick-borne encephalitis virus
GTDCWYAME

SEQ ID NO: 182400 - protein, 9 aa, Tick-borne encephalitis virus
TDCWYAMEI

SEQ ID NO: 182401 - protein, 9 aa, Tick-borne encephalitis virus
DCWYAMEIR

SEQ ID NO: 182402 - protein, 9 aa, Tick-borne encephalitis virus
CWYAMEIRP

SEQ ID NO: 182403 - protein, 9 aa, Tick-borne encephalitis virus
WYAMEIRPV

SEQ ID NO: 182404 - protein, 9 aa, Tick-borne encephalitis virus
YAMEIRPVH

SEQ ID NO: 182405 - protein, 9 aa, Tick-borne encephalitis virus
AMEIRPVHD

SEQ ID NO: 182406 - protein, 9 aa, Tick-borne encephalitis virus
MEIRPVHDQ

SEQ ID NO: 182407 - protein, 9 aa, Tick-borne encephalitis virus
EIRPVHDQG

SEQ ID NO: 182408 - protein, 9 aa, Tick-borne encephalitis virus
IRPVHDQGG

SEQ ID NO: 182409 - protein, 9 aa, Tick-borne encephalitis virus
RPVHDQGGL

SEQ ID NO: 182410 - protein, 9 aa, Tick-borne encephalitis virus
PVHDQGGLV

SEQ ID NO: 182411 - protein, 9 aa, Tick-borne encephalitis virus
VHDQGGLVR

SEQ ID NO: 182412 - protein, 9 aa, Tick-borne encephalitis virus
HDQGGLVRS

SEQ ID NO: 182413 - protein, 9 aa, Tick-borne encephalitis virus
DQGGLVRSM

SEQ ID NO: 182414 - protein, 9 aa, Tick-borne encephalitis virus
QGGLVRSMV

SEQ ID NO: 182415 - protein, 9 aa, Tick-borne encephalitis virus
GGLVRSMVV

SEQ ID NO: 182416 - protein, 9 aa, Tick-borne encephalitis virus
GLVRSMVVA

SEQ ID NO: 182417 - protein, 9 aa, Tick-borne encephalitis virus
LVRSMVVAD

SEQ ID NO: 182418 - protein, 9 aa, Tick-borne encephalitis virus
VRSMVVADN

SEQ ID NO: 182419 - protein, 9 aa, Tick-borne encephalitis virus
RSMVVADNG

SEQ ID NO: 182420 - protein, 9 aa, Tick-borne encephalitis virus
SMVVADNGE

SEQ ID NO: 182421 - protein, 9 aa, Tick-borne encephalitis virus
MVVADNGEL

SEQ ID NO: 182422 - protein, 9 aa, Tick-borne encephalitis virus
VVADNGELL

SEQ ID NO: 182423 - protein, 9 aa, Tick-borne encephalitis virus
VADNGELLS

SEQ ID NO: 182424 - protein, 9 aa, Tick-borne encephalitis virus
ADNGELLSE

SEQ ID NO: 182425 - protein, 9 aa, Tick-borne encephalitis virus
DNGELLSEG

SEQ ID NO: 182426 - protein, 9 aa, Tick-borne encephalitis virus
NGELLSEGG

SEQ ID NO: 182427 - protein, 9 aa, Tick-borne encephalitis virus
GELLSEGGI

SEQ ID NO: 182428 - protein, 9 aa, Tick-borne encephalitis virus
ELLSEGGIP

SEQ ID NO: 182429 - protein, 9 aa, Tick-borne encephalitis virus
LLSEGGIPG

SEQ ID NO: 182430 - protein, 9 aa, Tick-borne encephalitis virus
LSEGGVPGI

SEQ ID NO: 182431 - protein, 9 aa, Tick-borne encephalitis virus
SEGGIPGIV

SEQ ID NO: 182432 - protein, 9 aa, Tick-borne encephalitis virus
EGGIPGIVA

SEQ ID NO: 182433 - protein, 9 aa, Tick-borne encephalitis virus
GGVPGIVAL

SEQ ID NO: 182434 - protein, 9 aa, Tick-borne encephalitis virus
GVPGIVALF

SEQ ID NO: 182435 - protein, 9 aa, Tick-borne encephalitis virus
IPGIVALFV

SEQ ID NO: 182436 - protein, 9 aa, Tick-borne encephalitis virus
PGIVALFVV

SEQ ID NO: 182437 - protein, 9 aa, Tick-borne encephalitis virus
GIVALFVVL

SEQ ID NO: 182438 - protein, 9 aa, Tick-borne encephalitis virus
IVALFVVLE

SEQ ID NO: 182439 - protein, 9 aa, Tick-borne encephalitis virus
VALFVVLEY

SEQ ID NO: 182440 - protein, 9 aa, Tick-borne encephalitis virus
ALFVVLEYV

SEQ ID NO: 182441 - protein, 9 aa, Tick-borne encephalitis virus
LFVVLEYVI

SEQ ID NO: 182442 - protein, 9 aa, Tick-borne encephalitis virus
FVVLEYVIR

SEQ ID NO: 182443 - protein, 9 aa, Tick-borne encephalitis virus
VVLEYVIRR

SEQ ID NO: 182444 - protein, 9 aa, Tick-borne encephalitis virus
VLEYVIRRR

SEQ ID NO: 182445 - protein, 9 aa, Tick-borne encephalitis virus
LEYVIRRRP

SEQ ID NO: 182446 - protein, 9 aa, Tick-borne encephalitis virus
EYVIRRRPA

SEQ ID NO: 182447 - protein, 9 aa, Tick-borne encephalitis virus
YVIRRRPAT

SEQ ID NO: 182448 - protein, 9 aa, Tick-borne encephalitis virus
VIRRRPATG

SEQ ID NO: 182449 - protein, 9 aa, Tick-borne encephalitis virus
IRRRPATGT

SEQ ID NO: 182450 - protein, 9 aa, Tick-borne encephalitis virus
RRRPATGTT

SEQ ID NO: 182451 - protein, 9 aa, Tick-borne encephalitis virus
RRPATGTTA

SEQ ID NO: 182452 - protein, 9 aa, Tick-borne encephalitis virus
RPATGTTAM

SEQ ID NO: 182453 - protein, 9 aa, Tick-borne encephalitis virus
PATGTTAMW

SEQ ID NO: 182454 - protein, 9 aa, Tick-borne encephalitis virus
ATGTTAMWG

SEQ ID NO: 182455 - protein, 9 aa, Tick-borne encephalitis virus
TGTTAMWGG

SEQ ID NO: 182456 - protein, 9 aa, Tick-borne encephalitis virus
WGGIVVLAL

SEQ ID NO: 182457 - protein, 9 aa, Tick-borne encephalitis virus
GGIVVLALL

SEQ ID NO: 182458 - protein, 9 aa, Tick-borne encephalitis virus
GIVVLALLV

SEQ ID NO: 182459 - protein, 9 aa, Tick-borne encephalitis virus
IVVLALLVT

SEQ ID NO: 182460 - protein, 9 aa, Tick-borne encephalitis virus
VVLALLVTG

SEQ ID NO: 182461 - protein, 9 aa, Tick-borne encephalitis virus
VLALLVTGL

SEQ ID NO: 182462 - protein, 9 aa, Tick-borne encephalitis virus
LALLVTGLV

SEQ ID NO: 182463 - protein, 9 aa, Tick-borne encephalitis virus
ALLVTGLVR

SEQ ID NO: 182464 - protein, 9 aa, Tick-borne encephalitis virus
VRIESLVRY

SEQ ID NO: 182465 - protein, 9 aa, Tick-borne encephalitis virus
RIESLVRYV

SEQ ID NO: 182466 - protein, 9 aa, Tick-borne encephalitis virus
IESLVRYVV

SEQ ID NO: 182467 - protein, 9 aa, Tick-borne encephalitis virus
ESLVRYVVA

SEQ ID NO: 182468 - protein, 9 aa, Tick-borne encephalitis virus
SLVRYVVAV

SEQ ID NO: 182469 - protein, 9 aa, Tick-borne encephalitis virus
LVRYVVAVG

SEQ ID NO: 182470 - protein, 9 aa, Tick-borne encephalitis virus
VRYVVAVGI

SEQ ID NO: 182471 - protein, 9 aa, Tick-borne encephalitis virus
RYVVAVGIT

SEQ ID NO: 182472 - protein, 9 aa, Tick-borne encephalitis virus
YVVAVGITF

SEQ ID NO: 182473 - protein, 9 aa, Tick-borne encephalitis virus
VVAVGITFH

SEQ ID NO: 182474 - protein, 9 aa, Tick-borne encephalitis virus
VAVGITFHL

SEQ ID NO: 182475 - protein, 9 aa, Tick-borne encephalitis virus
AVGITFHLE

SEQ ID NO: 182476 - protein, 9 aa, Tick-borne encephalitis virus
VGITFHLEL

SEQ ID NO: 182477 - protein, 9 aa, Tick-borne encephalitis virus
GITFHLELG

SEQ ID NO: 182478 - protein, 9 aa, Tick-borne encephalitis virus
ITFHLELGP

SEQ ID NO: 182479 - protein, 9 aa, Tick-borne encephalitis virus
TFHLELGPE

SEQ ID NO: 182480 - protein, 9 aa, Tick-borne encephalitis virus
FHLELGPEI

SEQ ID NO: 182481 - protein, 9 aa, Tick-borne encephalitis virus
HLELGPEIV

SEQ ID NO: 182482 - protein, 9 aa, Tick-borne encephalitis virus
LELGPEIVA

SEQ ID NO: 182483 - protein, 9 aa, Tick-borne encephalitis virus
ELGPEIVAL

SEQ ID NO: 182484 - protein, 9 aa, Tick-borne encephalitis virus
LGPEIVALT

SEQ ID NO: 182485 - protein, 9 aa, Tick-borne encephalitis virus
GPEIVALTL

SEQ ID NO: 182486 - protein, 9 aa, Tick-borne encephalitis virus
PEIVALTLL

SEQ ID NO: 182487 - protein, 9 aa, Tick-borne encephalitis virus
EIVALTLLQ

SEQ ID NO: 182488 - protein, 9 aa, Tick-borne encephalitis virus
IVALTLLQA

SEQ ID NO: 182489 - protein, 9 aa, Tick-borne encephalitis virus
VALTLLQAV

SEQ ID NO: 182490 - protein, 9 aa, Tick-borne encephalitis virus
ALTLLQAVF

SEQ ID NO: 182491 - protein, 9 aa, Tick-borne encephalitis virus
LTLLQAVFE

SEQ ID NO: 182492 - protein, 9 aa, Tick-borne encephalitis virus
TLLQAVFEL

SEQ ID NO: 182493 - protein, 9 aa, Tick-borne encephalitis virus
LLQAVFELR

SEQ ID NO: 182494 - protein, 9 aa, Tick-borne encephalitis virus
LQAVFELRV

SEQ ID NO: 182495 - protein, 9 aa, Tick-borne encephalitis virus
QAVFELRVG

SEQ ID NO: 182496 - protein, 9 aa, Tick-borne encephalitis virus
AVFELRVGL

SEQ ID NO: 182497 - protein, 9 aa, Tick-borne encephalitis virus
VFELRVGLL

SEQ ID NO: 182498 - protein, 9 aa, Tick-borne encephalitis virus
FELRVGLLS

SEQ ID NO: 182499 - protein, 9 aa, Tick-borne encephalitis virus
ELRVGLLSA

SEQ ID NO: 182500 - protein, 9 aa, Tick-borne encephalitis virus
LRVGLLSAF

SEQ ID NO: 182501 - protein, 9 aa, Tick-borne encephalitis virus
RVGLLSAFA

SEQ ID NO: 182502 - protein, 9 aa, Tick-borne encephalitis virus
VGLLSAFAL

SEQ ID NO: 182503 - protein, 9 aa, Tick-borne encephalitis virus
GLLSAFALR

SEQ ID NO: 182504 - protein, 9 aa, Tick-borne encephalitis virus
LLSAFALRS

SEQ ID NO: 182505 - protein, 9 aa, Tick-borne encephalitis virus
LSAFALRSN

SEQ ID NO: 182506 - protein, 9 aa, Tick-borne encephalitis virus
SAFALRSNL

SEQ ID NO: 182507 - protein, 9 aa, Tick-borne encephalitis virus
AFALRSNLT

SEQ ID NO: 182508 - protein, 9 aa, Tick-borne encephalitis virus
FALRSNLTV

SEQ ID NO: 182509 - protein, 9 aa, Tick-borne encephalitis virus
ALRSNLTVR

SEQ ID NO: 182510 - protein, 9 aa, Tick-borne encephalitis virus
LRSNLTVRE

SEQ ID NO: 182511 - protein, 9 aa, Tick-borne encephalitis virus
RSNLTVREM

SEQ ID NO: 182512 - protein, 9 aa, Tick-borne encephalitis virus
SNLTVREMV

SEQ ID NO: 182513 - protein, 9 aa, Tick-borne encephalitis virus
NLTVREMVT

SEQ ID NO: 182514 - protein, 9 aa, Tick-borne encephalitis virus
LTVREMVTI

SEQ ID NO: 182515 - protein, 9 aa, Tick-borne encephalitis virus
TVREMVTIY

SEQ ID NO: 182516 - protein, 9 aa, Tick-borne encephalitis virus
VREMVTIYF

SEQ ID NO: 182517 - protein, 9 aa, Tick-borne encephalitis virus
REMVTIYFL

SEQ ID NO: 182518 - protein, 9 aa, Tick-borne encephalitis virus
EMVTIYFLL

SEQ ID NO: 182519 - protein, 9 aa, Tick-borne encephalitis virus
MVTIYFLLL

SEQ ID NO: 182520 - protein, 9 aa, Tick-borne encephalitis virus
VTIYFLLLV

SEQ ID NO: 182521 - protein, 9 aa, Tick-borne encephalitis virus
TIYFLLLVL

SEQ ID NO: 182522 - protein, 9 aa, Tick-borne encephalitis virus
IYFLLLVLE

SEQ ID NO: 182523 - protein, 9 aa, Tick-borne encephalitis virus
YFLLLVLEL

SEQ ID NO: 182524 - protein, 9 aa, Tick-borne encephalitis virus
FLLLVLELG

SEQ ID NO: 182525 - protein, 9 aa, Tick-borne encephalitis virus
LLLVLELGL

SEQ ID NO: 182526 - protein, 9 aa, Tick-borne encephalitis virus
LLVLELGLP

SEQ ID NO: 182527 - protein, 9 aa, Tick-borne encephalitis virus
LVLELGLPS

SEQ ID NO: 182528 - protein, 9 aa, Tick-borne encephalitis virus
LWKWGDALA

SEQ ID NO: 182529 - protein, 9 aa, Tick-borne encephalitis virus
WKWGDALAM

SEQ ID NO: 182530 - protein, 9 aa, Tick-borne encephalitis virus
KWGDALAMG

SEQ ID NO: 182531 - protein, 9 aa, Tick-borne encephalitis virus
WGDALAMGA

SEQ ID NO: 182532 - protein, 9 aa, Tick-borne encephalitis virus
GDALAMGAL

SEQ ID NO: 182533 - protein, 9 aa, Tick-borne encephalitis virus
DALAMGALI

SEQ ID NO: 182534 - protein, 9 aa, Tick-borne encephalitis virus
ALAMGALIF

SEQ ID NO: 182535 - protein, 9 aa, Tick-borne encephalitis virus
LAMGALIFR

SEQ ID NO: 182536 - protein, 9 aa, Tick-borne encephalitis virus
AMGALIFRA

SEQ ID NO: 182537 - protein, 9 aa, Tick-borne encephalitis virus
MGALIFRAC

SEQ ID NO: 182538 - protein, 9 aa, Tick-borne encephalitis virus
GALIFRACT

SEQ ID NO: 182539 - protein, 9 aa, Tick-borne encephalitis virus
ALIFRACTA

SEQ ID NO: 182540 - protein, 9 aa, Tick-borne encephalitis virus
LIFRACTAE

SEQ ID NO: 182541 - protein, 9 aa, Tick-borne encephalitis virus
IFRACTAEG

SEQ ID NO: 182542 - protein, 9 aa, Tick-borne encephalitis virus
FRACTAEGK

SEQ ID NO: 182543 - protein, 9 aa, Tick-borne encephalitis virus
RACTAEEKT

SEQ ID NO: 182544 - protein, 9 aa, Tick-borne encephalitis virus
ACTAEEKTG

SEQ ID NO: 182545 - protein, 9 aa, Tick-borne encephalitis virus
CTAEEKTGV

SEQ ID NO: 182546 - protein, 9 aa, Tick-borne encephalitis virus
TAEEKTGVG

SEQ ID NO: 182547 - protein, 9 aa, Tick-borne encephalitis virus
AEEKTGVGL

SEQ ID NO: 182548 - protein, 9 aa, Tick-borne encephalitis virus
EEKTGVGLL

SEQ ID NO: 182549 - protein, 9 aa, Tick-borne encephalitis virus
EKTGVGLLL

SEQ ID NO: 182550 - protein, 9 aa, Tick-borne encephalitis virus
KTGVGLLLM

SEQ ID NO: 182551 - protein, 9 aa, Tick-borne encephalitis virus
TGVGLLLMA

SEQ ID NO: 182552 - protein, 9 aa, Tick-borne encephalitis virus
GVGLLLMAL

SEQ ID NO: 182553 - protein, 9 aa, Tick-borne encephalitis virus
VGLLLMALM

SEQ ID NO: 182554 - protein, 9 aa, Tick-borne encephalitis virus
GLLLMALMT

SEQ ID NO: 182555 - protein, 9 aa, Tick-borne encephalitis virus
LLLMALMTQ

SEQ ID NO: 182556 - protein, 9 aa, Tick-borne encephalitis virus
LLMALMTQQ

SEQ ID NO: 182557 - protein, 9 aa, Tick-borne encephalitis virus
LMALMTQQD

SEQ ID NO: 182558 - protein, 9 aa, Tick-borne encephalitis virus
AHYGLMLFL

SEQ ID NO: 182559 - protein, 9 aa, Tick-borne encephalitis virus
HYGLMLFLG

SEQ ID NO: 182560 - protein, 9 aa, Tick-borne encephalitis virus
WKLIRGHRE

SEQ ID NO: 182561 - protein, 9 aa, Tick-borne encephalitis virus
KLIRGHREQ

SEQ ID NO: 182562 - protein, 9 aa, Tick-borne encephalitis virus
LIRGHREQK

SEQ ID NO: 182563 - protein, 9 aa, Tick-borne encephalitis virus
IRGHREQKG

SEQ ID NO: 182564 - protein, 9 aa, Tick-borne encephalitis virus
RGHREQKGL

SEQ ID NO: 182565 - protein, 9 aa, Tick-borne encephalitis virus
GHREQKGLT

SEQ ID NO: 182566 - protein, 9 aa, Tick-borne encephalitis virus
HREQKGLTW

SEQ ID NO: 182567 - protein, 9 aa, Tick-borne encephalitis virus
REQKGLTWI

SEQ ID NO: 182568 - protein, 9 aa, Tick-borne encephalitis virus
EQKGLTWIV

SEQ ID NO: 182569 - protein, 9 aa, Tick-borne encephalitis virus
QKGLTWIVP

SEQ ID NO: 182570 - protein, 9 aa, Tick-borne encephalitis virus
KGLTWIVPL

SEQ ID NO: 182571 - protein, 9 aa, Tick-borne encephalitis virus
GLTWIVPLA

SEQ ID NO: 182572 - protein, 9 aa, Tick-borne encephalitis virus
VPLAGLLGG

SEQ ID NO: 182573 - protein, 9 aa, Tick-borne encephalitis virus
PLAGLLGGE

SEQ ID NO: 182574 - protein, 9 aa, Tick-borne encephalitis virus
LAGLLGGEG

SEQ ID NO: 182575 - protein, 9 aa, Tick-borne encephalitis virus
AGLLGGEGS

SEQ ID NO: 182576 - protein, 9 aa, Tick-borne encephalitis virus
GLLGGEGSG

SEQ ID NO: 182577 - protein, 9 aa, Tick-borne encephalitis virus
LLGGEGSGV

SEQ ID NO: 182578 - protein, 9 aa, Tick-borne encephalitis virus
LGGEGSGVR

SEQ ID NO: 182579 - protein, 9 aa, Tick-borne encephalitis virus
GGEGSGVRL

SEQ ID NO: 182580 - protein, 9 aa, Tick-borne encephalitis virus
GEGSGVRLL

SEQ ID NO: 182581 - protein, 9 aa, Tick-borne encephalitis virus
EGSGVRLLA

SEQ ID NO: 182582 - protein, 9 aa, Tick-borne encephalitis virus
GSGVRLLAF

SEQ ID NO: 182583 - protein, 9 aa, Tick-borne encephalitis virus
SGVRLLAFW

SEQ ID NO: 182584 - protein, 9 aa, Tick-borne encephalitis virus
GVRLLAFWE

SEQ ID NO: 182585 - protein, 9 aa, Tick-borne encephalitis virus
VRLLAFWEL

SEQ ID NO: 182586 - protein, 9 aa, Tick-borne encephalitis virus
RLLAFWELA

SEQ ID NO: 182587 - protein, 9 aa, Tick-borne encephalitis virus
HRGRRSFSE

SEQ ID NO: 182588 - protein, 9 aa, Tick-borne encephalitis virus
RGRRSFSEP

SEQ ID NO: 182589 - protein, 9 aa, Tick-borne encephalitis virus
GRRSFSEPL

SEQ ID NO: 182590 - protein, 9 aa, Tick-borne encephalitis virus
RRSFSEPLT

SEQ ID NO: 182591 - protein, 9 aa, Tick-borne encephalitis virus
RSFSEPLTV

SEQ ID NO: 182592 - protein, 9 aa, Tick-borne encephalitis virus
SFSEPLTVV

SEQ ID NO: 182593 - protein, 9 aa, Tick-borne encephalitis virus
FSEPLTVVG

SEQ ID NO: 182594 - protein, 9 aa, Tick-borne encephalitis virus
SEPLTVVGV

SEQ ID NO: 182595 - protein, 9 aa, Tick-borne encephalitis virus
EPLTVVGVM

SEQ ID NO: 182596 - protein, 9 aa, Tick-borne encephalitis virus
PLTVVGVML

SEQ ID NO: 182597 - protein, 9 aa, Tick-borne encephalitis virus
LTVVGVMLT

SEQ ID NO: 182598 - protein, 9 aa, Tick-borne encephalitis virus
TVVGVMLTL

SEQ ID NO: 182599 - protein, 9 aa, Tick-borne encephalitis virus
VVGVMLTLA

SEQ ID NO: 182600 - protein, 9 aa, Tick-borne encephalitis virus
VGVMLTLAS

SEQ ID NO: 182601 - protein, 9 aa, Tick-borne encephalitis virus
GVMLTLASG

SEQ ID NO: 182602 - protein, 9 aa, Tick-borne encephalitis virus
VMLTLASGM

SEQ ID NO: 182603 - protein, 9 aa, Tick-borne encephalitis virus
MLTLASGMM

SEQ ID NO: 182604 - protein, 9 aa, Tick-borne encephalitis virus
LTLASGMMR

SEQ ID NO: 182605 - protein, 9 aa, Tick-borne encephalitis virus
TLASGMMRH

SEQ ID NO: 182606 - protein, 9 aa, Tick-borne encephalitis virus
LASGMMRHT

SEQ ID NO: 182607 - protein, 9 aa, Tick-borne encephalitis virus
ASGMMRHTS

SEQ ID NO: 182608 - protein, 9 aa, Tick-borne encephalitis virus
SGMMRHTSQ

SEQ ID NO: 182609 - protein, 9 aa, Tick-borne encephalitis virus
GMMRHTSQE

SEQ ID NO: 182610 - protein, 9 aa, Tick-borne encephalitis virus
MMRHTSQEA

SEQ ID NO: 182611 - protein, 9 aa, Tick-borne encephalitis virus
MRHTSQEAL

SEQ ID NO: 182612 - protein, 9 aa, Tick-borne encephalitis virus
RHTSQEALC

SEQ ID NO: 182613 - protein, 9 aa, Tick-borne encephalitis virus
HTSQEALCA

SEQ ID NO: 182614 - protein, 9 aa, Tick-borne encephalitis virus
TSQEALCAL

SEQ ID NO: 182615 - protein, 9 aa, Tick-borne encephalitis virus
SQEALCALA

SEQ ID NO: 182616 - protein, 9 aa, Tick-borne encephalitis virus
QEALCALAV

SEQ ID NO: 182617 - protein, 9 aa, Tick-borne encephalitis virus
EALCALAVA

SEQ ID NO: 182618 - protein, 9 aa, Tick-borne encephalitis virus
ALCALAVAS

SEQ ID NO: 182619 - protein, 9 aa, Tick-borne encephalitis virus
LCALAVASF

SEQ ID NO: 182620 - protein, 9 aa, Tick-borne encephalitis virus
CALAVASFL

SEQ ID NO: 182621 - protein, 9 aa, Tick-borne encephalitis virus
ALAVASFLL

SEQ ID NO: 182622 - protein, 9 aa, Tick-borne encephalitis virus
LAVASFLLL

SEQ ID NO: 182623 - protein, 9 aa, Tick-borne encephalitis virus
AVASFLLLM

SEQ ID NO: 182624 - protein, 9 aa, Tick-borne encephalitis virus
VASFLLLML

SEQ ID NO: 182625 - protein, 9 aa, Tick-borne encephalitis virus
ASFLLLMLV

SEQ ID NO: 182626 - protein, 9 aa, Tick-borne encephalitis virus
SFLLLMLVL

SEQ ID NO: 182627 - protein, 9 aa, Tick-borne encephalitis virus
FLLLMLVLG

SEQ ID NO: 182628 - protein, 9 aa, Tick-borne encephalitis virus
LLLMLVLGT

SEQ ID NO: 182629 - protein, 9 aa, Tick-borne encephalitis virus
LLMLVLGTR

SEQ ID NO: 182630 - protein, 9 aa, Tick-borne encephalitis virus
LMLVLGTRK

SEQ ID NO: 182631 - protein, 9 aa, Tick-borne encephalitis virus
MLVLGTRKM

SEQ ID NO: 182632 - protein, 9 aa, Tick-borne encephalitis virus
LVLGTRKMQ

SEQ ID NO: 182633 - protein, 9 aa, Tick-borne encephalitis virus
VLGTRKMQL

SEQ ID NO: 182634 - protein, 9 aa, Tick-borne encephalitis virus
LGTRKMQLV

SEQ ID NO: 182635 - protein, 9 aa, Tick-borne encephalitis virus
GTRKMQLVA

SEQ ID NO: 182636 - protein, 9 aa, Tick-borne encephalitis virus
TRKMQLVAE

SEQ ID NO: 182637 - protein, 9 aa, Tick-borne encephalitis virus
RKMQLVAEW

SEQ ID NO: 182638 - protein, 9 aa, Tick-borne encephalitis virus
KMQLVAEWS

SEQ ID NO: 182639 - protein, 9 aa, Tick-borne encephalitis virus
MQLVAEWSG

SEQ ID NO: 182640 - protein, 9 aa, Tick-borne encephalitis virus
QLVAEWSGC

SEQ ID NO: 182641 - protein, 9 aa, Tick-borne encephalitis virus
LVAEWSGCV

SEQ ID NO: 182642 - protein, 9 aa, Tick-borne encephalitis virus
VAEWSGCVE

SEQ ID NO: 182643 - protein, 9 aa, Tick-borne encephalitis virus
AEWSGCVEW

SEQ ID NO: 182644 - protein, 9 aa, Tick-borne encephalitis virus
EWSGCVEWH

SEQ ID NO: 182645 - protein, 9 aa, Tick-borne encephalitis virus
WSGCVEWHP

SEQ ID NO: 182646 - protein, 9 aa, Tick-borne encephalitis virus
SGCVEWHPE

SEQ ID NO: 182647 - protein, 9 aa, Tick-borne encephalitis virus
GCVEWHPEL

SEQ ID NO: 182648 - protein, 9 aa, Tick-borne encephalitis virus
CVEWHPELM

SEQ ID NO: 182649 - protein, 9 aa, Tick-borne encephalitis virus
VEWHPELMN

SEQ ID NO: 182650 - protein, 9 aa, Tick-borne encephalitis virus
EWHPELMNE

SEQ ID NO: 182651 - protein, 9 aa, Tick-borne encephalitis virus
WHPELMNEG

SEQ ID NO: 182652 - protein, 9 aa, Tick-borne encephalitis virus
HPELMNEGG

SEQ ID NO: 182653 - protein, 9 aa, Tick-borne encephalitis virus
PELMNEGGE

SEQ ID NO: 182654 - protein, 9 aa, Tick-borne encephalitis virus
ELMNEGGEV

SEQ ID NO: 182655 - protein, 9 aa, Tick-borne encephalitis virus
LMNEGGEVS

SEQ ID NO: 182656 - protein, 9 aa, Tick-borne encephalitis virus
MNEGGEVSL

SEQ ID NO: 182657 - protein, 9 aa, Tick-borne encephalitis virus
NEGGEVSLR

SEQ ID NO: 182658 - protein, 9 aa, Tick-borne encephalitis virus
EGGEVSLRV

SEQ ID NO: 182659 - protein, 9 aa, Tick-borne encephalitis virus
GGEVSLRVR

SEQ ID NO: 182660 - protein, 9 aa, Tick-borne encephalitis virus
GEVSLRVRQ

SEQ ID NO: 182661 - protein, 9 aa, Tick-borne encephalitis virus
EVSLRVRQD

SEQ ID NO: 182662 - protein, 9 aa, Tick-borne encephalitis virus
VSLRVRQDS

SEQ ID NO: 182663 - protein, 9 aa, Tick-borne encephalitis virus
SLRVRQDSM

SEQ ID NO: 182664 - protein, 9 aa, Tick-borne encephalitis virus
LRVRQDSMG

SEQ ID NO: 182665 - protein, 9 aa, Tick-borne encephalitis virus
RVRQDSMGN

SEQ ID NO: 182666 - protein, 9 aa, Tick-borne encephalitis virus
VRQDSMGNF

SEQ ID NO: 182667 - protein, 9 aa, Tick-borne encephalitis virus
RQDSMGNFH

SEQ ID NO: 182668 - protein, 9 aa, Tick-borne encephalitis virus
QDSMGNFHL

SEQ ID NO: 182669 - protein, 9 aa, Tick-borne encephalitis virus
DSMGNFHLT

SEQ ID NO: 182670 - protein, 9 aa, Tick-borne encephalitis virus
SMGNFHLTE

SEQ ID NO: 182671 - protein, 9 aa, Tick-borne encephalitis virus
MGNFHLTEL

SEQ ID NO: 182672 - protein, 9 aa, Tick-borne encephalitis virus
GNFHLTELE

SEQ ID NO: 182673 - protein, 9 aa, Tick-borne encephalitis virus
NFHLTELEK

SEQ ID NO: 182674 - protein, 9 aa, Tick-borne encephalitis virus
FHLTELEKE

SEQ ID NO: 182675 - protein, 9 aa, Tick-borne encephalitis virus
HLTELEKEE

SEQ ID NO: 182676 - protein, 9 aa, Tick-borne encephalitis virus
LTELEKEER

SEQ ID NO: 182677 - protein, 9 aa, Tick-borne encephalitis virus
TELEKEERV

SEQ ID NO: 182678 - protein, 9 aa, Tick-borne encephalitis virus
ELEKEERVM

SEQ ID NO: 182679 - protein, 9 aa, Tick-borne encephalitis virus
LEKEERVMA

SEQ ID NO: 182680 - protein, 9 aa, Tick-borne encephalitis virus
EKEERVMAF

SEQ ID NO: 182681 - protein, 9 aa, Tick-borne encephalitis virus
KEERVMAFW

SEQ ID NO: 182682 - protein, 9 aa, Tick-borne encephalitis virus
EERVMAFWL

SEQ ID NO: 182683 - protein, 9 aa, Tick-borne encephalitis virus
ERVMAFWLL

SEQ ID NO: 182684 - protein, 9 aa, Tick-borne encephalitis virus
RVMAFWLLA

SEQ ID NO: 182685 - protein, 9 aa, Tick-borne encephalitis virus
VMAFWLLAG

SEQ ID NO: 182686 - protein, 9 aa, Tick-borne encephalitis virus
MAFWLLAGL

SEQ ID NO: 182687 - protein, 9 aa, Tick-borne encephalitis virus
AFWLLAGLA

SEQ ID NO: 182688 - protein, 9 aa, Tick-borne encephalitis virus
FWLLAGLAA

SEQ ID NO: 182689 - protein, 9 aa, Tick-borne encephalitis virus
WLLAGLAAS

SEQ ID NO: 182690 - protein, 9 aa, Tick-borne encephalitis virus
LLAGLAASA

SEQ ID NO: 182691 - protein, 9 aa, Tick-borne encephalitis virus
AGLAASAFH

SEQ ID NO: 182692 - protein, 9 aa, Tick-borne encephalitis virus
GLAASAFHW

SEQ ID NO: 182693 - protein, 9 aa, Tick-borne encephalitis virus
LAASAFHWS

SEQ ID NO: 182694 - protein, 9 aa, Tick-borne encephalitis virus
AASAFHWSG

SEQ ID NO: 182695 - protein, 9 aa, Tick-borne encephalitis virus
ASAFHWSGI

SEQ ID NO: 182696 - protein, 9 aa, Tick-borne encephalitis virus
SAFHWSGIL

SEQ ID NO: 182697 - protein, 9 aa, Tick-borne encephalitis virus
AFHWSGILG

SEQ ID NO: 182698 - protein, 9 aa, Tick-borne encephalitis virus
FHWSGILGV

SEQ ID NO: 182699 - protein, 9 aa, Tick-borne encephalitis virus
HWSGILGVM

SEQ ID NO: 182700 - protein, 9 aa, Tick-borne encephalitis virus
WSGILGVMG

SEQ ID NO: 182701 - protein, 9 aa, Tick-borne encephalitis virus
SGILGVMGL

SEQ ID NO: 182702 - protein, 9 aa, Tick-borne encephalitis virus
GILGVMGLW

SEQ ID NO: 182703 - protein, 9 aa, Tick-borne encephalitis virus
ILGVMGLWT

SEQ ID NO: 182704 - protein, 9 aa, Tick-borne encephalitis virus
LGVMGLWTL

SEQ ID NO: 182705 - protein, 9 aa, Tick-borne encephalitis virus
GVMGLWTLS

SEQ ID NO: 182706 - protein, 9 aa, Tick-borne encephalitis virus
VMGLWTLSE

SEQ ID NO: 182707 - protein, 9 aa, Tick-borne encephalitis virus
MGLWTLSEM

SEQ ID NO: 182708 - protein, 9 aa, Tick-borne encephalitis virus
GLWTLSEML

SEQ ID NO: 182709 - protein, 9 aa, Tick-borne encephalitis virus
LWTLSEMLR

SEQ ID NO: 182710 - protein, 9 aa, Tick-borne encephalitis virus
ARRSDLVFS

SEQ ID NO: 182711 - protein, 9 aa, Tick-borne encephalitis virus
RRSDLVFSG

SEQ ID NO: 182712 - protein, 9 aa, Tick-borne encephalitis virus
RSDLVFSGQ

SEQ ID NO: 182713 - protein, 9 aa, Tick-borne encephalitis virus
SDLVFSGQG

SEQ ID NO: 182714 - protein, 9 aa, Tick-borne encephalitis virus
DLVFSGQGG

SEQ ID NO: 182715 - protein, 9 aa, Tick-borne encephalitis virus
LVFSGQGGR

SEQ ID NO: 182716 - protein, 9 aa, Tick-borne encephalitis virus
VFSGQGGRE

SEQ ID NO: 182717 - protein, 9 aa, Tick-borne encephalitis virus
FSGQGGRER

SEQ ID NO: 182718 - protein, 9 aa, Tick-borne encephalitis virus
SGQGGRERG

SEQ ID NO: 182719 - protein, 9 aa, Tick-borne encephalitis virus
GQGGRERGD

SEQ ID NO: 182720 - protein, 9 aa, Tick-borne encephalitis virus
QGGRERGDR

SEQ ID NO: 182721 - protein, 9 aa, Tick-borne encephalitis virus
GGRERGDRP

SEQ ID NO: 182722 - protein, 9 aa, Tick-borne encephalitis virus
GRERGDRPF

SEQ ID NO: 182723 - protein, 9 aa, Tick-borne encephalitis virus
RERGDRPFE

SEQ ID NO: 182724 - protein, 9 aa, Tick-borne encephalitis virus
ERGDRPFEV

SEQ ID NO: 182725 - protein, 9 aa, Tick-borne encephalitis virus
RGDRPFEVK

SEQ ID NO: 182726 - protein, 9 aa, Tick-borne encephalitis virus
GDRPFEVKD

SEQ ID NO: 182727 - protein, 9 aa, Tick-borne encephalitis virus
DRPFEVKDG

SEQ ID NO: 182728 - protein, 9 aa, Tick-borne encephalitis virus
RPFEVKDGV

SEQ ID NO: 182729 - protein, 9 aa, Tick-borne encephalitis virus
PFEVKDGVY

SEQ ID NO: 182730 - protein, 9 aa, Tick-borne encephalitis virus
FEVKDGVYR

SEQ ID NO: 182731 - protein, 9 aa, Tick-borne encephalitis virus
EVKDGVYRI

SEQ ID NO: 182732 - protein, 9 aa, Tick-borne encephalitis virus
VKDGVYRIF

SEQ ID NO: 182733 - protein, 9 aa, Tick-borne encephalitis virus
KDGVYRIFS

SEQ ID NO: 182734 - protein, 9 aa, Tick-borne encephalitis virus
DGVYRIFSP

SEQ ID NO: 182735 - protein, 9 aa, Tick-borne encephalitis virus
GVYRIFSPG

SEQ ID NO: 182736 - protein, 9 aa, Tick-borne encephalitis virus
VYRIFSPGL

SEQ ID NO: 182737 - protein, 9 aa, Tick-borne encephalitis virus
YRIFSPGLL

SEQ ID NO: 182738 - protein, 9 aa, Tick-borne encephalitis virus
RIFSPGLLW

SEQ ID NO: 182739 - protein, 9 aa, Tick-borne encephalitis virus
IFSPGLLWG

SEQ ID NO: 182740 - protein, 9 aa, Tick-borne encephalitis virus
FSPGLLWGQ

SEQ ID NO: 182741 - protein, 9 aa, Tick-borne encephalitis virus
SPGLLWGQR

SEQ ID NO: 182742 - protein, 9 aa, Tick-borne encephalitis virus
PGLLWGQRQ

SEQ ID NO: 182743 - protein, 9 aa, Tick-borne encephalitis virus
GLLWGQRQV

SEQ ID NO: 182744 - protein, 9 aa, Tick-borne encephalitis virus
LLWGQRQVG

SEQ ID NO: 182745 - protein, 9 aa, Tick-borne encephalitis virus
LWGQRQVGV

SEQ ID NO: 182746 - protein, 9 aa, Tick-borne encephalitis virus
WGQRQVGVG

SEQ ID NO: 182747 - protein, 9 aa, Tick-borne encephalitis virus
GQRQVGVGY

SEQ ID NO: 182748 - protein, 9 aa, Tick-borne encephalitis virus
QRQVGVGYG

SEQ ID NO: 182749 - protein, 9 aa, Tick-borne encephalitis virus
RQVGVGYGF

SEQ ID NO: 182750 - protein, 9 aa, Tick-borne encephalitis virus
QVGVGYGSK

SEQ ID NO: 182751 - protein, 9 aa, Tick-borne encephalitis virus
VGVGYGSKG

SEQ ID NO: 182752 - protein, 9 aa, Tick-borne encephalitis virus
GVGYGSKGV

SEQ ID NO: 182753 - protein, 9 aa, Tick-borne encephalitis virus
VGYGSKGVL

SEQ ID NO: 182754 - protein, 9 aa, Tick-borne encephalitis virus
GYGSKGVLH

SEQ ID NO: 182755 - protein, 9 aa, Tick-borne encephalitis virus
YGSKGVLHT

SEQ ID NO: 182756 - protein, 9 aa, Tick-borne encephalitis virus
GSKGVLHTM

SEQ ID NO: 182757 - protein, 9 aa, Tick-borne encephalitis virus
SKGVLHTMW

SEQ ID NO: 182758 - protein, 9 aa, Tick-borne encephalitis virus
KGVLHTMWH

SEQ ID NO: 182759 - protein, 9 aa, Tick-borne encephalitis virus
GVLHTMWHV

SEQ ID NO: 182760 - protein, 9 aa, Tick-borne encephalitis virus
VLHTMWHVT

SEQ ID NO: 182761 - protein, 9 aa, Tick-borne encephalitis virus
LHTMWHVTR

SEQ ID NO: 182762 - protein, 9 aa, Tick-borne encephalitis virus
HTMWHVTRG

SEQ ID NO: 182763 - protein, 9 aa, Tick-borne encephalitis virus
TMWHVTRGA

SEQ ID NO: 182764 - protein, 9 aa, Tick-borne encephalitis virus
MWHVTRGAA

SEQ ID NO: 182765 - protein, 9 aa, Tick-borne encephalitis virus
WHVTRGAAL

SEQ ID NO: 182766 - protein, 9 aa, Tick-borne encephalitis virus
HVTRGAALS

SEQ ID NO: 182767 - protein, 9 aa, Tick-borne encephalitis virus
VTRGAALSI

SEQ ID NO: 182768 - protein, 9 aa, Tick-borne encephalitis virus
TRGAALSID

SEQ ID NO: 182769 - protein, 9 aa, Tick-borne encephalitis virus
RGAALSIDD

SEQ ID NO: 182770 - protein, 9 aa, Tick-borne encephalitis virus
GAALSIDDA

SEQ ID NO: 182771 - protein, 9 aa, Tick-borne encephalitis virus
AALSIDDAV

SEQ ID NO: 182772 - protein, 9 aa, Tick-borne encephalitis virus
ALSIDDAVA

SEQ ID NO: 182773 - protein, 9 aa, Tick-borne encephalitis virus
LSIDDAVAG

SEQ ID NO: 182774 - protein, 9 aa, Tick-borne encephalitis virus
SIDDAVAGP

SEQ ID NO: 182775 - protein, 9 aa, Tick-borne encephalitis virus
IDDAVAGPY

SEQ ID NO: 182776 - protein, 9 aa, Tick-borne encephalitis virus
DDAVAGPYW

SEQ ID NO: 182777 - protein, 9 aa, Tick-borne encephalitis virus
DAVAGPYWA

SEQ ID NO: 182778 - protein, 9 aa, Tick-borne encephalitis virus
AVAGPYWAD

SEQ ID NO: 182779 - protein, 9 aa, Tick-borne encephalitis virus
VAGPYWADV

SEQ ID NO: 182780 - protein, 9 aa, Tick-borne encephalitis virus
AGPYWADVK

SEQ ID NO: 182781 - protein, 9 aa, Tick-borne encephalitis virus
GPYWADVKE

SEQ ID NO: 182782 - protein, 9 aa, Tick-borne encephalitis virus
PYWADVKED

SEQ ID NO: 182783 - protein, 9 aa, Tick-borne encephalitis virus
YWADVKEDV

SEQ ID NO: 182784 - protein, 9 aa, Tick-borne encephalitis virus
WADVKEDVV

SEQ ID NO: 182785 - protein, 9 aa, Tick-borne encephalitis virus
ADVKEDVVC

SEQ ID NO: 182786 - protein, 9 aa, Tick-borne encephalitis virus
DVKEDVVCY

SEQ ID NO: 182787 - protein, 9 aa, Tick-borne encephalitis virus
VKEDVVCYG

SEQ ID NO: 182788 - protein, 9 aa, Tick-borne encephalitis virus
KEDVVCYGG

SEQ ID NO: 182789 - protein, 9 aa, Tick-borne encephalitis virus
EDVVCYGGA

SEQ ID NO: 182790 - protein, 9 aa, Tick-borne encephalitis virus
DVVCYGGAW

SEQ ID NO: 182791 - protein, 9 aa, Tick-borne encephalitis virus
VVCYGGAWS

SEQ ID NO: 182792 - protein, 9 aa, Tick-borne encephalitis virus
VCYGGAWSL

SEQ ID NO: 182793 - protein, 9 aa, Tick-borne encephalitis virus
CYGGAWSLE

SEQ ID NO: 182794 - protein, 9 aa, Tick-borne encephalitis virus
YGGAWSLEE

SEQ ID NO: 182795 - protein, 9 aa, Tick-borne encephalitis virus
GGAWSLEEK

SEQ ID NO: 182796 - protein, 9 aa, Tick-borne encephalitis virus
GAWSLEEKW

SEQ ID NO: 182797 - protein, 9 aa, Tick-borne encephalitis virus
AWSLEEKWK

SEQ ID NO: 182798 - protein, 9 aa, Tick-borne encephalitis virus
WSLEEKWKG

SEQ ID NO: 182799 - protein, 9 aa, Tick-borne encephalitis virus
SLEEKWKGE

SEQ ID NO: 182800 - protein, 9 aa, Tick-borne encephalitis virus
LEEKWKGET

SEQ ID NO: 182801 - protein, 9 aa, Tick-borne encephalitis virus
EEKWKGETV

SEQ ID NO: 182802 - protein, 9 aa, Tick-borne encephalitis virus
EKWKGETVQ

SEQ ID NO: 182803 - protein, 9 aa, Tick-borne encephalitis virus
KWKGETVQV

SEQ ID NO: 182804 - protein, 9 aa, Tick-borne encephalitis virus
WKGETVQVH

SEQ ID NO: 182805 - protein, 9 aa, Tick-borne encephalitis virus
KGETVQVHA

SEQ ID NO: 182806 - protein, 9 aa, Tick-borne encephalitis virus
GETVQVHAF

SEQ ID NO: 182807 - protein, 9 aa, Tick-borne encephalitis virus
ETVQVHAFP

SEQ ID NO: 182808 - protein, 9 aa, Tick-borne encephalitis virus
TVQVHAFPP

SEQ ID NO: 182809 - protein, 9 aa, Tick-borne encephalitis virus
VQVHAFPPG

SEQ ID NO: 182810 - protein, 9 aa, Tick-borne encephalitis virus
QVHAFPPGR

SEQ ID NO: 182811 - protein, 9 aa, Tick-borne encephalitis virus
VHAFPPGRA

SEQ ID NO: 182812 - protein, 9 aa, Tick-borne encephalitis virus
HAFPPGRAH

SEQ ID NO: 182813 - protein, 9 aa, Tick-borne encephalitis virus
AFPPGRAHE

SEQ ID NO: 182814 - protein, 9 aa, Tick-borne encephalitis virus
FPPGRAHEV

SEQ ID NO: 182815 - protein, 9 aa, Tick-borne encephalitis virus
PPGRAHEVH

SEQ ID NO: 182816 - protein, 9 aa, Tick-borne encephalitis virus
PGRAHEVHQ

SEQ ID NO: 182817 - protein, 9 aa, Tick-borne encephalitis virus
GRAHEVHQC

SEQ ID NO: 182818 - protein, 9 aa, Tick-borne encephalitis virus
RAHEVHQCQ

SEQ ID NO: 182819 - protein, 9 aa, Tick-borne encephalitis virus
AHEVHQCQP

SEQ ID NO: 182820 - protein, 9 aa, Tick-borne encephalitis virus
HEVHQCQPG

SEQ ID NO: 182821 - protein, 9 aa, Tick-borne encephalitis virus
EVHQCQPGE

SEQ ID NO: 182822 - protein, 9 aa, Tick-borne encephalitis virus
VHQCQPGEL

SEQ ID NO: 182823 - protein, 9 aa, Tick-borne encephalitis virus
HQCQPGELL

SEQ ID NO: 182824 - protein, 9 aa, Tick-borne encephalitis virus
QCQPGELLL

SEQ ID NO: 182825 - protein, 9 aa, Tick-borne encephalitis virus
CQPGELLLD

SEQ ID NO: 182826 - protein, 9 aa, Tick-borne encephalitis virus
QPGELLLDT

SEQ ID NO: 182827 - protein, 9 aa, Tick-borne encephalitis virus
PGELLLDTG

SEQ ID NO: 182828 - protein, 9 aa, Tick-borne encephalitis virus
GELLLDTGR

SEQ ID NO: 182829 - protein, 9 aa, Tick-borne encephalitis virus
ELLLDTGRR

SEQ ID NO: 182830 - protein, 9 aa, Tick-borne encephalitis virus
GAVPIDLAK

SEQ ID NO: 182831 - protein, 9 aa, Tick-borne encephalitis virus
AVPIDLAKG

SEQ ID NO: 182832 - protein, 9 aa, Tick-borne encephalitis virus
VPIDLAKGT

SEQ ID NO: 182833 - protein, 9 aa, Tick-borne encephalitis virus
PIDLAKGTS

SEQ ID NO: 182834 - protein, 9 aa, Tick-borne encephalitis virus
IDLAKGTSG

SEQ ID NO: 182835 - protein, 9 aa, Tick-borne encephalitis virus
DLAKGTSGS

SEQ ID NO: 182836 - protein, 9 aa, Tick-borne encephalitis virus
LAKGTSGSP

SEQ ID NO: 182837 - protein, 9 aa, Tick-borne encephalitis virus
AKGTSGSPI

SEQ ID NO: 182838 - protein, 9 aa, Tick-borne encephalitis virus
KGTSGSPIL

SEQ ID NO: 182839 - protein, 9 aa, Tick-borne encephalitis virus
GTSGSPILN

SEQ ID NO: 182840 - protein, 9 aa, Tick-borne encephalitis virus
TSGSPILNS

SEQ ID NO: 182841 - protein, 9 aa, Tick-borne encephalitis virus
SGSPILNSQ

SEQ ID NO: 182842 - protein, 9 aa, Tick-borne encephalitis virus
GSPILNSQG

SEQ ID NO: 182843 - protein, 9 aa, Tick-borne encephalitis virus
SPILNSQGV

SEQ ID NO: 182844 - protein, 9 aa, Tick-borne encephalitis virus
PILNSQGVV

SEQ ID NO: 182845 - protein, 9 aa, Tick-borne encephalitis virus
ILNSQGVVV

SEQ ID NO: 182846 - protein, 9 aa, Tick-borne encephalitis virus
LNSQGVVVG

SEQ ID NO: 182847 - protein, 9 aa, Tick-borne encephalitis virus
NSQGVVVGL

SEQ ID NO: 182848 - protein, 9 aa, Tick-borne encephalitis virus
SQGVVVGLY

SEQ ID NO: 182849 - protein, 9 aa, Tick-borne encephalitis virus
QGVVVGLYG

SEQ ID NO: 182850 - protein, 9 aa, Tick-borne encephalitis virus
GVVVGLYGN

SEQ ID NO: 182851 - protein, 9 aa, Tick-borne encephalitis virus
VVVGLYGNG

SEQ ID NO: 182852 - protein, 9 aa, Tick-borne encephalitis virus
VVGLYGNGL

SEQ ID NO: 182853 - protein, 9 aa, Tick-borne encephalitis virus
VGLYGNGLK

SEQ ID NO: 182854 - protein, 9 aa, Tick-borne encephalitis virus
GLYGNGLKT

SEQ ID NO: 182855 - protein, 9 aa, Tick-borne encephalitis virus
LYGNGLKTN

SEQ ID NO: 182856 - protein, 9 aa, Tick-borne encephalitis virus
YGNGLKTNE

SEQ ID NO: 182857 - protein, 9 aa, Tick-borne encephalitis virus
GNGLKTNET

SEQ ID NO: 182858 - protein, 9 aa, Tick-borne encephalitis virus
NGLKTNETY

SEQ ID NO: 182859 - protein, 9 aa, Tick-borne encephalitis virus
GLKTNETYV

SEQ ID NO: 182860 - protein, 9 aa, Tick-borne encephalitis virus
LKTNETYVS

SEQ ID NO: 182861 - protein, 9 aa, Tick-borne encephalitis virus
KTNETYVSS

SEQ ID NO: 182862 - protein, 9 aa, Tick-borne encephalitis virus
TNETYVSSI

SEQ ID NO: 182863 - protein, 9 aa, Tick-borne encephalitis virus
NETYVSSIA

SEQ ID NO: 182864 - protein, 9 aa, Tick-borne encephalitis virus
ETYVSSIAQ

SEQ ID NO: 182865 - protein, 9 aa, Tick-borne encephalitis virus
TYVSSIAQG

SEQ ID NO: 182866 - protein, 9 aa, Tick-borne encephalitis virus
YVSSIAQGE

SEQ ID NO: 182867 - protein, 9 aa, Tick-borne encephalitis virus
VSSIAQGEA

SEQ ID NO: 182868 - protein, 9 aa, Tick-borne encephalitis virus
SSIAQGEAE

SEQ ID NO: 182869 - protein, 9 aa, Tick-borne encephalitis virus
SIAQGEAEK

SEQ ID NO: 182870 - protein, 9 aa, Tick-borne encephalitis virus
IAQGEAEKS

SEQ ID NO: 182871 - protein, 9 aa, Tick-borne encephalitis virus
AQGEAEKSR

SEQ ID NO: 182872 - protein, 9 aa, Tick-borne encephalitis virus
QGEAEKSRP

SEQ ID NO: 182873 - protein, 9 aa, Tick-borne encephalitis virus
GEAEKSRPN

SEQ ID NO: 182874 - protein, 9 aa, Tick-borne encephalitis virus
EAEKSRPNL

SEQ ID NO: 182875 - protein, 9 aa, Tick-borne encephalitis virus
AEKSRPNLP

SEQ ID NO: 182876 - protein, 9 aa, Tick-borne encephalitis virus
EKSRPNLPP

SEQ ID NO: 182877 - protein, 9 aa, Tick-borne encephalitis virus
KSRPNLPPA

SEQ ID NO: 182878 - protein, 9 aa, Tick-borne encephalitis virus
SRPNLPPAV

SEQ ID NO: 182879 - protein, 9 aa, Tick-borne encephalitis virus
GTGWTAKGQ

SEQ ID NO: 182880 - protein, 9 aa, Tick-borne encephalitis virus
TGWTAKGQI

SEQ ID NO: 182881 - protein, 9 aa, Tick-borne encephalitis virus
GWTAKGQIT

SEQ ID NO: 182882 - protein, 9 aa, Tick-borne encephalitis virus
WTAKGQITV

SEQ ID NO: 182883 - protein, 9 aa, Tick-borne encephalitis virus
TAKGQITVL

SEQ ID NO: 182884 - protein, 9 aa, Tick-borne encephalitis virus
AKGQITVLD

SEQ ID NO: 182885 - protein, 9 aa, Tick-borne encephalitis virus
KGQITVLDM

SEQ ID NO: 182886 - protein, 9 aa, Tick-borne encephalitis virus
GQITVLDMH

SEQ ID NO: 182887 - protein, 9 aa, Tick-borne encephalitis virus
QITVLDMHP

SEQ ID NO: 182888 - protein, 9 aa, Tick-borne encephalitis virus
ITVLDMHPG

SEQ ID NO: 182889 - protein, 9 aa, Tick-borne encephalitis virus
TVLDMHPGS

SEQ ID NO: 182890 - protein, 9 aa, Tick-borne encephalitis virus
VLDMHPGSG

SEQ ID NO: 182891 - protein, 9 aa, Tick-borne encephalitis virus
LDMHPGSGK

SEQ ID NO: 182892 - protein, 9 aa, Tick-borne encephalitis virus
DMHPGSGKT

SEQ ID NO: 182893 - protein, 9 aa, Tick-borne encephalitis virus
MHPGSGKTH

SEQ ID NO: 182894 - protein, 9 aa, Tick-borne encephalitis virus
HPGSGKTHR

SEQ ID NO: 182895 - protein, 9 aa, Tick-borne encephalitis virus
PGSGKTHRV

SEQ ID NO: 182896 - protein, 9 aa, Tick-borne encephalitis virus
GSGKTHRVL

SEQ ID NO: 182897 - protein, 9 aa, Tick-borne encephalitis virus
SGKTHRVLP

SEQ ID NO: 182898 - protein, 9 aa, Tick-borne encephalitis virus
GKTHRVLPE

SEQ ID NO: 182899 - protein, 9 aa, Tick-borne encephalitis virus
KTHRVLPEL

SEQ ID NO: 182900 - protein, 9 aa, Tick-borne encephalitis virus
THRVLPELI

SEQ ID NO: 182901 - protein, 9 aa, Tick-borne encephalitis virus
HRVLPELIR

SEQ ID NO: 182902 - protein, 9 aa, Tick-borne encephalitis virus
RVLPELIRQ

SEQ ID NO: 182903 - protein, 9 aa, Tick-borne encephalitis virus
VLPELIRQC

SEQ ID NO: 182904 - protein, 9 aa, Tick-borne encephalitis virus
LPELIRQCI

SEQ ID NO: 182905 - protein, 9 aa, Tick-borne encephalitis virus
PELIRQCID

SEQ ID NO: 182906 - protein, 9 aa, Tick-borne encephalitis virus
ELIRQCIDR

SEQ ID NO: 182907 - protein, 9 aa, Tick-borne encephalitis virus
LIRQCIDRR

SEQ ID NO: 182908 - protein, 9 aa, Tick-borne encephalitis virus
IRQCIDRRL

SEQ ID NO: 182909 - protein, 9 aa, Tick-borne encephalitis virus
RQCIDRRLR

SEQ ID NO: 182910 - protein, 9 aa, Tick-borne encephalitis virus
QCIDRRLRT

SEQ ID NO: 182911 - protein, 9 aa, Tick-borne encephalitis virus
CIDRRLRTL

SEQ ID NO: 182912 - protein, 9 aa, Tick-borne encephalitis virus
IDRRLRTLV

SEQ ID NO: 182913 - protein, 9 aa, Tick-borne encephalitis virus
DRRLRTLVL

SEQ ID NO: 182914 - protein, 9 aa, Tick-borne encephalitis virus
RRLRTLVLA

SEQ ID NO: 182915 - protein, 9 aa, Tick-borne encephalitis virus
RLRTLVLAP

SEQ ID NO: 182916 - protein, 9 aa, Tick-borne encephalitis virus
LRTLVLAPT

SEQ ID NO: 182917 - protein, 9 aa, Tick-borne encephalitis virus
RTLVLAPTR

SEQ ID NO: 182918 - protein, 9 aa, Tick-borne encephalitis virus
TLVLAPTRV

SEQ ID NO: 182919 - protein, 9 aa, Tick-borne encephalitis virus
LVLAPTRVV

SEQ ID NO: 182920 - protein, 9 aa, Tick-borne encephalitis virus
VLAPTRVVL

SEQ ID NO: 182921 - protein, 9 aa, Tick-borne encephalitis virus
LAPTRVVLK

SEQ ID NO: 182922 - protein, 9 aa, Tick-borne encephalitis virus
APTRVVLKE

SEQ ID NO: 182923 - protein, 9 aa, Tick-borne encephalitis virus
PTRVVLKEM

SEQ ID NO: 182924 - protein, 9 aa, Tick-borne encephalitis virus
TRVVLKEME

SEQ ID NO: 182925 - protein, 9 aa, Tick-borne encephalitis virus
RVVLKEMER

SEQ ID NO: 182926 - protein, 9 aa, Tick-borne encephalitis virus
VVLKEMERA

SEQ ID NO: 182927 - protein, 9 aa, Tick-borne encephalitis virus
VLKEMERAL

SEQ ID NO: 182928 - protein, 9 aa, Tick-borne encephalitis virus
LKEMERALN

SEQ ID NO: 182929 - protein, 9 aa, Tick-borne encephalitis virus
KEMERALNG

SEQ ID NO: 182930 - protein, 9 aa, Tick-borne encephalitis virus
EMERALNGK

SEQ ID NO: 182931 - protein, 9 aa, Tick-borne encephalitis virus
MERALNGKR

SEQ ID NO: 182932 - protein, 9 aa, Tick-borne encephalitis virus
ERALNGKRV

SEQ ID NO: 182933 - protein, 9 aa, Tick-borne encephalitis virus
RALNGKRVR

SEQ ID NO: 182934 - protein, 9 aa, Tick-borne encephalitis virus
ALNGKRVRF

SEQ ID NO: 182935 - protein, 9 aa, Tick-borne encephalitis virus
LNGKRVRFH

SEQ ID NO: 182936 - protein, 9 aa, Tick-borne encephalitis virus
NGKRVRFHS

SEQ ID NO: 182937 - protein, 9 aa, Tick-borne encephalitis virus
GKRVRFHSP

SEQ ID NO: 182938 - protein, 9 aa, Tick-borne encephalitis virus
KRVRFHSPA

SEQ ID NO: 182939 - protein, 9 aa, Tick-borne encephalitis virus
RVRFHSPAV

SEQ ID NO: 182940 - protein, 9 aa, Tick-borne encephalitis virus
VRFHSPAVG

SEQ ID NO: 182941 - protein, 9 aa, Tick-borne encephalitis virus
RFHSPAVGD

SEQ ID NO: 182942 - protein, 9 aa, Tick-borne encephalitis virus
FHSPAVGDQ

SEQ ID NO: 182943 - protein, 9 aa, Tick-borne encephalitis virus
HSPAVGDQQ

SEQ ID NO: 182944 - protein, 9 aa, Tick-borne encephalitis virus
DQQVGGAIV

SEQ ID NO: 182945 - protein, 9 aa, Tick-borne encephalitis virus
QQVGGAIVD

SEQ ID NO: 182946 - protein, 9 aa, Tick-borne encephalitis virus
GGAIVDVMC

SEQ ID NO: 182947 - protein, 9 aa, Tick-borne encephalitis virus
GAIVDVMCH

SEQ ID NO: 182948 - protein, 9 aa, Tick-borne encephalitis virus
AIVDVMCHA

SEQ ID NO: 182949 - protein, 9 aa, Tick-borne encephalitis virus
IVDVMCHAT

SEQ ID NO: 182950 - protein, 9 aa, Tick-borne encephalitis virus
VDVMCHATY

SEQ ID NO: 182951 - protein, 9 aa, Tick-borne encephalitis virus
DVMCHATYV

SEQ ID NO: 182952 - protein, 9 aa, Tick-borne encephalitis virus
VMCHATYVN

SEQ ID NO: 182953 - protein, 9 aa, Tick-borne encephalitis virus
MCHATYVNR

SEQ ID NO: 182954 - protein, 9 aa, Tick-borne encephalitis virus
CHATYVNRR

SEQ ID NO: 182955 - protein, 9 aa, Tick-borne encephalitis virus
HATYVNRRL

SEQ ID NO: 182956 - protein, 9 aa, Tick-borne encephalitis virus
ATYVNRRLL

SEQ ID NO: 182957 - protein, 9 aa, Tick-borne encephalitis virus
TYVNRRLLP

SEQ ID NO: 182958 - protein, 9 aa, Tick-borne encephalitis virus
YVNRRLLPQ

SEQ ID NO: 182959 - protein, 9 aa, Tick-borne encephalitis virus
VNRRLLPQG

SEQ ID NO: 182960 - protein, 9 aa, Tick-borne encephalitis virus
NRRLLPQGR

SEQ ID NO: 182961 - protein, 9 aa, Tick-borne encephalitis virus
RRLLPQGRQ

SEQ ID NO: 182962 - protein, 9 aa, Tick-borne encephalitis virus
RLLPQGRQN

SEQ ID NO: 182963 - protein, 9 aa, Tick-borne encephalitis virus
LLPQGRQNW

SEQ ID NO: 182964 - protein, 9 aa, Tick-borne encephalitis virus
LPQGRQNWE

SEQ ID NO: 182965 - protein, 9 aa, Tick-borne encephalitis virus
PQGRQNWEV

SEQ ID NO: 182966 - protein, 9 aa, Tick-borne encephalitis virus
QGRQNWEVA

SEQ ID NO: 182967 - protein, 9 aa, Tick-borne encephalitis virus
GRQNWEVAI

SEQ ID NO: 182968 - protein, 9 aa, Tick-borne encephalitis virus
RQNWEVAIM

SEQ ID NO: 182969 - protein, 9 aa, Tick-borne encephalitis virus
QNWEVAIMD

SEQ ID NO: 182970 - protein, 9 aa, Tick-borne encephalitis virus
NWEVAIMDE

SEQ ID NO: 182971 - protein, 9 aa, Tick-borne encephalitis virus
WEVAIMDEA

SEQ ID NO: 182972 - protein, 9 aa, Tick-borne encephalitis virus
EVAIMDEAH

SEQ ID NO: 182973 - protein, 9 aa, Tick-borne encephalitis virus
VAIMDEAHW

SEQ ID NO: 182974 - protein, 9 aa, Tick-borne encephalitis virus
AIMDEAHWT

SEQ ID NO: 182975 - protein, 9 aa, Tick-borne encephalitis virus
IMDEAHWTD

SEQ ID NO: 182976 - protein, 9 aa, Tick-borne encephalitis virus
MDEAHWTDP

SEQ ID NO: 182977 - protein, 9 aa, Tick-borne encephalitis virus
DEAHWTDPH

SEQ ID NO: 182978 - protein, 9 aa, Tick-borne encephalitis virus
EAHWTDPHS

SEQ ID NO: 182979 - protein, 9 aa, Tick-borne encephalitis virus
AHWTDPHSI

SEQ ID NO: 182980 - protein, 9 aa, Tick-borne encephalitis virus
HWTDPHSIA

SEQ ID NO: 182981 - protein, 9 aa, Tick-borne encephalitis virus
WTDPHSIAA

SEQ ID NO: 182982 - protein, 9 aa, Tick-borne encephalitis virus
TDPHSIAAR

SEQ ID NO: 182983 - protein, 9 aa, Tick-borne encephalitis virus
DPHSIAARG

SEQ ID NO: 182984 - protein, 9 aa, Tick-borne encephalitis virus
PHSIAARGH

SEQ ID NO: 182985 - protein, 9 aa, Tick-borne encephalitis virus
HSIAARGHL

SEQ ID NO: 182986 - protein, 9 aa, Tick-borne encephalitis virus
SIAARGHLY

SEQ ID NO: 182987 - protein, 9 aa, Tick-borne encephalitis virus
IAARGHLYT

SEQ ID NO: 182988 - protein, 9 aa, Tick-borne encephalitis virus
AARGHLYTL

SEQ ID NO: 182989 - protein, 9 aa, Tick-borne encephalitis virus
ARGHLYTLA

SEQ ID NO: 182990 - protein, 9 aa, Tick-borne encephalitis virus
RGHLYTLAK

SEQ ID NO: 182991 - protein, 9 aa, Tick-borne encephalitis virus
GHLYTLAKE

SEQ ID NO: 182992 - protein, 9 aa, Tick-borne encephalitis virus
HLYTLAKEN

SEQ ID NO: 182993 - protein, 9 aa, Tick-borne encephalitis virus
LYTLAKENK

SEQ ID NO: 182994 - protein, 9 aa, Tick-borne encephalitis virus
YTLAKENKC

SEQ ID NO: 182995 - protein, 9 aa, Tick-borne encephalitis virus
TLAKENKCA

SEQ ID NO: 182996 - protein, 9 aa, Tick-borne encephalitis virus
LAKENKCAL

SEQ ID NO: 182997 - protein, 9 aa, Tick-borne encephalitis virus
AKENKCALV

SEQ ID NO: 182998 - protein, 9 aa, Tick-borne encephalitis virus
KENKCALVL

SEQ ID NO: 182999 - protein, 9 aa, Tick-borne encephalitis virus
ENKCALVLM

SEQ ID NO: 183000 - protein, 9 aa, Tick-borne encephalitis virus
NKCALVLMT

SEQ ID NO: 183001 - protein, 9 aa, Tick-borne encephalitis virus
KCALVLMTA

SEQ ID NO: 183002 - protein, 9 aa, Tick-borne encephalitis virus
CALVLMTAT

SEQ ID NO: 183003 - protein, 9 aa, Tick-borne encephalitis virus
ALVLMTATP

SEQ ID NO: 183004 - protein, 9 aa, Tick-borne encephalitis virus
LVLMTATPP

SEQ ID NO: 183005 - protein, 9 aa, Tick-borne encephalitis virus
VLMTATPPG

SEQ ID NO: 183006 - protein, 9 aa, Tick-borne encephalitis virus
LMTATPPGK

SEQ ID NO: 183007 - protein, 9 aa, Tick-borne encephalitis virus
MTATPPGKS

SEQ ID NO: 183008 - protein, 9 aa, Tick-borne encephalitis virus
TATPPGKSE

SEQ ID NO: 183009 - protein, 9 aa, Tick-borne encephalitis virus
ATPPGKSEP

SEQ ID NO: 183010 - protein, 9 aa, Tick-borne encephalitis virus
TPPGKSEPF

SEQ ID NO: 183011 - protein, 9 aa, Tick-borne encephalitis virus
PPGKSEPFP

SEQ ID NO: 183012 - protein, 9 aa, Tick-borne encephalitis virus
PGKSEPFPE

SEQ ID NO: 183013 - protein, 9 aa, Tick-borne encephalitis virus
GKSEPFPES

SEQ ID NO: 183014 - protein, 9 aa, Tick-borne encephalitis virus
KSEPFPESN

SEQ ID NO: 183015 - protein, 9 aa, Tick-borne encephalitis virus
SEPFPESNG

SEQ ID NO: 183016 - protein, 9 aa, Tick-borne encephalitis virus
EPFPESNGA

SEQ ID NO: 183017 - protein, 9 aa, Tick-borne encephalitis virus
PFPESNGAI

SEQ ID NO: 183018 - protein, 9 aa, Tick-borne encephalitis virus
FPESNGAIT

SEQ ID NO: 183019 - protein, 9 aa, Tick-borne encephalitis virus
PESNGAITS

SEQ ID NO: 183020 - protein, 9 aa, Tick-borne encephalitis virus
ESNGAITSE

SEQ ID NO: 183021 - protein, 9 aa, Tick-borne encephalitis virus
SNGAITSEE

SEQ ID NO: 183022 - protein, 9 aa, Tick-borne encephalitis virus
NGAISSEEK

SEQ ID NO: 183023 - protein, 9 aa, Tick-borne encephalitis virus
GAISSEEKQ

SEQ ID NO: 183024 - protein, 9 aa, Tick-borne encephalitis virus
AISSEEKQI

SEQ ID NO: 183025 - protein, 9 aa, Tick-borne encephalitis virus
ISSEEKQIP

SEQ ID NO: 183026 - protein, 9 aa, Tick-borne encephalitis virus
SEEKQIPDG

SEQ ID NO: 183027 - protein, 9 aa, Tick-borne encephalitis virus
EEKQIPDGE

SEQ ID NO: 183028 - protein, 9 aa, Tick-borne encephalitis virus
EKQIPDGEW

SEQ ID NO: 183029 - protein, 9 aa, Tick-borne encephalitis virus
KQIPDGEWR

SEQ ID NO: 183030 - protein, 9 aa, Tick-borne encephalitis virus
QIPDGEWRD

SEQ ID NO: 183031 - protein, 9 aa, Tick-borne encephalitis virus
IPDGEWRDG

SEQ ID NO: 183032 - protein, 9 aa, Tick-borne encephalitis virus
PDGEWRDGF

SEQ ID NO: 183033 - protein, 9 aa, Tick-borne encephalitis virus
DGEWRDGFD

SEQ ID NO: 183034 - protein, 9 aa, Tick-borne encephalitis virus
GEWRDGFDW

SEQ ID NO: 183035 - protein, 9 aa, Tick-borne encephalitis virus
EWRDGFDWI

SEQ ID NO: 183036 - protein, 9 aa, Tick-borne encephalitis virus
WRDGFDWIT

SEQ ID NO: 183037 - protein, 9 aa, Tick-borne encephalitis virus
RDGFDWITE

SEQ ID NO: 183038 - protein, 9 aa, Tick-borne encephalitis virus
DGFDWITEY

SEQ ID NO: 183039 - protein, 9 aa, Tick-borne encephalitis virus
GFDWITEYE

SEQ ID NO: 183040 - protein, 9 aa, Tick-borne encephalitis virus
FDWITEYEG

SEQ ID NO: 183041 - protein, 9 aa, Tick-borne encephalitis virus
DWITEYEGR

SEQ ID NO: 183042 - protein, 9 aa, Tick-borne encephalitis virus
WITEYEGRT

SEQ ID NO: 183043 - protein, 9 aa, Tick-borne encephalitis virus
ITEYEGRTA

SEQ ID NO: 183044 - protein, 9 aa, Tick-borne encephalitis virus
TEYEGRTAW

SEQ ID NO: 183045 - protein, 9 aa, Tick-borne encephalitis virus
EYEGRTAWF

SEQ ID NO: 183046 - protein, 9 aa, Tick-borne encephalitis virus
YEGRTAWFV

SEQ ID NO: 183047 - protein, 9 aa, Tick-borne encephalitis virus
EGRTAWFVP

SEQ ID NO: 183048 - protein, 9 aa, Tick-borne encephalitis virus
GRTAWFVPS

SEQ ID NO: 183049 - protein, 9 aa, Tick-borne encephalitis virus
RTAWFVPSI

SEQ ID NO: 183050 - protein, 9 aa, Tick-borne encephalitis virus
TAWFVPSIA

SEQ ID NO: 183051 - protein, 9 aa, Tick-borne encephalitis virus
AWFVPSIAK

SEQ ID NO: 183052 - protein, 9 aa, Tick-borne encephalitis virus
WFVPSIAKG

SEQ ID NO: 183053 - protein, 9 aa, Tick-borne encephalitis virus
FVPSIAKGG

SEQ ID NO: 183054 - protein, 9 aa, Tick-borne encephalitis virus
VPSIAKGGI

SEQ ID NO: 183055 - protein, 9 aa, Tick-borne encephalitis virus
PSIAKGGII

SEQ ID NO: 183056 - protein, 9 aa, Tick-borne encephalitis virus
SIAKGGIIA

SEQ ID NO: 183057 - protein, 9 aa, Tick-borne encephalitis virus
IAKGGIIAR

SEQ ID NO: 183058 - protein, 9 aa, Tick-borne encephalitis virus
AKGGIIART

SEQ ID NO: 183059 - protein, 9 aa, Tick-borne encephalitis virus
KGGIIARTL

SEQ ID NO: 183060 - protein, 9 aa, Tick-borne encephalitis virus
GGIIARTLR

SEQ ID NO: 183061 - protein, 9 aa, Tick-borne encephalitis virus
GIIARTLRQ

SEQ ID NO: 183062 - protein, 9 aa, Tick-borne encephalitis virus
IIARTLRQK

SEQ ID NO: 183063 - protein, 9 aa, Tick-borne encephalitis virus
IARTLRQKG

SEQ ID NO: 183064 - protein, 9 aa, Tick-borne encephalitis virus
ARTLRQKGK

SEQ ID NO: 183065 - protein, 9 aa, Tick-borne encephalitis virus
RTLRQKGKS

SEQ ID NO: 183066 - protein, 9 aa, Tick-borne encephalitis virus
TLRQKGKSV

SEQ ID NO: 183067 - protein, 9 aa, Tick-borne encephalitis virus
LRQKGKSVI

SEQ ID NO: 183068 - protein, 9 aa, Tick-borne encephalitis virus
RQKGKSVIC

SEQ ID NO: 183069 - protein, 9 aa, Tick-borne encephalitis virus
QKGKSVICL

SEQ ID NO: 183070 - protein, 9 aa, Tick-borne encephalitis virus
KGKSVICLN

SEQ ID NO: 183071 - protein, 9 aa, Tick-borne encephalitis virus
GKSVICLNS

SEQ ID NO: 183072 - protein, 9 aa, Tick-borne encephalitis virus
KSVICLNSK

SEQ ID NO: 183073 - protein, 9 aa, Tick-borne encephalitis virus
SVICLNSKT

SEQ ID NO: 183074 - protein, 9 aa, Tick-borne encephalitis virus
VICLNSKTF

SEQ ID NO: 183075 - protein, 9 aa, Tick-borne encephalitis virus
ICLNSKTFE

SEQ ID NO: 183076 - protein, 9 aa, Tick-borne encephalitis virus
CLNSKTFEK

SEQ ID NO: 183077 - protein, 9 aa, Tick-borne encephalitis virus
LNSKTFEKD

SEQ ID NO: 183078 - protein, 9 aa, Tick-borne encephalitis virus
NSKTFEKDY

SEQ ID NO: 183079 - protein, 9 aa, Tick-borne encephalitis virus
SKTFEKDYS

SEQ ID NO: 183080 - protein, 9 aa, Tick-borne encephalitis virus
KTFEKDYSR

SEQ ID NO: 183081 - protein, 9 aa, Tick-borne encephalitis virus
TFEKDYSRV

SEQ ID NO: 183082 - protein, 9 aa, Tick-borne encephalitis virus
FEKDYSRVR

SEQ ID NO: 183083 - protein, 9 aa, Tick-borne encephalitis virus
EKDYSRVRD

SEQ ID NO: 183084 - protein, 9 aa, Tick-borne encephalitis virus
KDYSRVRDE

SEQ ID NO: 183085 - protein, 9 aa, Tick-borne encephalitis virus
DYSRVRDEK

SEQ ID NO: 183086 - protein, 9 aa, Tick-borne encephalitis virus
YSRVRDEKP

SEQ ID NO: 183087 - protein, 9 aa, Tick-borne encephalitis virus
SRVRDEKPD

SEQ ID NO: 183088 - protein, 9 aa, Tick-borne encephalitis virus
RVRDEKPDF

SEQ ID NO: 183089 - protein, 9 aa, Tick-borne encephalitis virus
VRDEKPDFV

SEQ ID NO: 183090 - protein, 9 aa, Tick-borne encephalitis virus
RDEKPDFVV

SEQ ID NO: 183091 - protein, 9 aa, Tick-borne encephalitis virus
DEKPDFVVT

SEQ ID NO: 183092 - protein, 9 aa, Tick-borne encephalitis virus
EKPDFVVTT

SEQ ID NO: 183093 - protein, 9 aa, Tick-borne encephalitis virus
KPDFVVTTD

SEQ ID NO: 183094 - protein, 9 aa, Tick-borne encephalitis virus
PDFVVTTDI

SEQ ID NO: 183095 - protein, 9 aa, Tick-borne encephalitis virus
DFVVTTDIS

SEQ ID NO: 183096 - protein, 9 aa, Tick-borne encephalitis virus
FVVTTDISE

SEQ ID NO: 183097 - protein, 9 aa, Tick-borne encephalitis virus
VVTTDISEM

SEQ ID NO: 183098 - protein, 9 aa, Tick-borne encephalitis virus
VTTDISEMG

SEQ ID NO: 183099 - protein, 9 aa, Tick-borne encephalitis virus
TTDISEMGA

SEQ ID NO: 183100 - protein, 9 aa, Tick-borne encephalitis virus
TDISEMGAN

SEQ ID NO: 183101 - protein, 9 aa, Tick-borne encephalitis virus
DISEMGANL

SEQ ID NO: 183102 - protein, 9 aa, Tick-borne encephalitis virus
ISEMGANLD

SEQ ID NO: 183103 - protein, 9 aa, Tick-borne encephalitis virus
SEMGANLDV

SEQ ID NO: 183104 - protein, 9 aa, Tick-borne encephalitis virus
EMGANLDVS

SEQ ID NO: 183105 - protein, 9 aa, Tick-borne encephalitis virus
MGANLDVSR

SEQ ID NO: 183106 - protein, 9 aa, Tick-borne encephalitis virus
GANLDVSRV

SEQ ID NO: 183107 - protein, 9 aa, Tick-borne encephalitis virus
ANLDVSRVI

SEQ ID NO: 183108 - protein, 9 aa, Tick-borne encephalitis virus
NLDVSRVID

SEQ ID NO: 183109 - protein, 9 aa, Tick-borne encephalitis virus
LDVSRVIDG

SEQ ID NO: 183110 - protein, 9 aa, Tick-borne encephalitis virus
DVSRVIDGR

SEQ ID NO: 183111 - protein, 9 aa, Tick-borne encephalitis virus
VSRVIDGRT

SEQ ID NO: 183112 - protein, 9 aa, Tick-borne encephalitis virus
SRVIDGRTN

SEQ ID NO: 183113 - protein, 9 aa, Tick-borne encephalitis virus
RVIDGRTNI

SEQ ID NO: 183114 - protein, 9 aa, Tick-borne encephalitis virus
VIDGRTNIK

SEQ ID NO: 183115 - protein, 9 aa, Tick-borne encephalitis virus
IDGRTNIKP

SEQ ID NO: 183116 - protein, 9 aa, Tick-borne encephalitis virus
DGRTNIKPE

SEQ ID NO: 183117 - protein, 9 aa, Tick-borne encephalitis virus
GRTNIKPEE

SEQ ID NO: 183118 - protein, 9 aa, Tick-borne encephalitis virus
RTNIKPEEV

SEQ ID NO: 183119 - protein, 9 aa, Tick-borne encephalitis virus
TNIKPEEVD

SEQ ID NO: 183120 - protein, 9 aa, Tick-borne encephalitis virus
NIKPEEVDG

SEQ ID NO: 183121 - protein, 9 aa, Tick-borne encephalitis virus
IKPEEVDGR

SEQ ID NO: 183122 - protein, 9 aa, Tick-borne encephalitis virus
KPEEVDGRV

SEQ ID NO: 183123 - protein, 9 aa, Tick-borne encephalitis virus
PEEVDGRVE

SEQ ID NO: 183124 - protein, 9 aa, Tick-borne encephalitis virus
EEVDGRVEL

SEQ ID NO: 183125 - protein, 9 aa, Tick-borne encephalitis virus
EVDGRVELT

SEQ ID NO: 183126 - protein, 9 aa, Tick-borne encephalitis virus
VDGRVELTG

SEQ ID NO: 183127 - protein, 9 aa, Tick-borne encephalitis virus
DGRVELTGT

SEQ ID NO: 183128 - protein, 9 aa, Tick-borne encephalitis virus
GRVELTGTR

SEQ ID NO: 183129 - protein, 9 aa, Tick-borne encephalitis virus
RVELTGTRR

SEQ ID NO: 183130 - protein, 9 aa, Tick-borne encephalitis virus
VELTGTRRV

SEQ ID NO: 183131 - protein, 9 aa, Tick-borne encephalitis virus
ELTGTRRVT

SEQ ID NO: 183132 - protein, 9 aa, Tick-borne encephalitis virus
LTGTRRVTT

SEQ ID NO: 183133 - protein, 9 aa, Tick-borne encephalitis virus
TGTRRVTTA

SEQ ID NO: 183134 - protein, 9 aa, Tick-borne encephalitis virus
GTRRVTTAS

SEQ ID NO: 183135 - protein, 9 aa, Tick-borne encephalitis virus
TRRVTTASA

SEQ ID NO: 183136 - protein, 9 aa, Tick-borne encephalitis virus
RRVTTASAA

SEQ ID NO: 183137 - protein, 9 aa, Tick-borne encephalitis virus
RVTTASAAQ

SEQ ID NO: 183138 - protein, 9 aa, Tick-borne encephalitis virus
VTTASAAQR

SEQ ID NO: 183139 - protein, 9 aa, Tick-borne encephalitis virus
TTASAAQRR

SEQ ID NO: 183140 - protein, 9 aa, Tick-borne encephalitis virus
TASAAQRRG

SEQ ID NO: 183141 - protein, 9 aa, Tick-borne encephalitis virus
ASAAQRRGR

SEQ ID NO: 183142 - protein, 9 aa, Tick-borne encephalitis virus
SAAQRRGRV

SEQ ID NO: 183143 - protein, 9 aa, Tick-borne encephalitis virus
AAQRRGRVG

SEQ ID NO: 183144 - protein, 9 aa, Tick-borne encephalitis virus
AQRRGRVGR

SEQ ID NO: 183145 - protein, 9 aa, Tick-borne encephalitis virus
QRRGRVGRQ

SEQ ID NO: 183146 - protein, 9 aa, Tick-borne encephalitis virus
RRGRVGRQE

SEQ ID NO: 183147 - protein, 9 aa, Tick-borne encephalitis virus
RGRVGRQEG

SEQ ID NO: 183148 - protein, 9 aa, Tick-borne encephalitis virus
GRVGRQEGR

SEQ ID NO: 183149 - protein, 9 aa, Tick-borne encephalitis virus
RVGRQEGRT

SEQ ID NO: 183150 - protein, 9 aa, Tick-borne encephalitis virus
VGRQEGRTD

SEQ ID NO: 183151 - protein, 9 aa, Tick-borne encephalitis virus
GRQEGRTDE

SEQ ID NO: 183152 - protein, 9 aa, Tick-borne encephalitis virus
RQEGRTDEY

SEQ ID NO: 183153 - protein, 9 aa, Tick-borne encephalitis virus
QEGRTDEYI

SEQ ID NO: 183154 - protein, 9 aa, Tick-borne encephalitis virus
EGRTDEYIY

SEQ ID NO: 183155 - protein, 9 aa, Tick-borne encephalitis virus
GRTDEYIYS

SEQ ID NO: 183156 - protein, 9 aa, Tick-borne encephalitis virus
RTDEYIYSG

SEQ ID NO: 183157 - protein, 9 aa, Tick-borne encephalitis virus
TDEYIYSGQ

SEQ ID NO: 183158 - protein, 9 aa, Tick-borne encephalitis virus
DEYIYSGQC

SEQ ID NO: 183159 - protein, 9 aa, Tick-borne encephalitis virus
EYIYSGQCD

SEQ ID NO: 183160 - protein, 9 aa, Tick-borne encephalitis virus
YIYSGQCDD

SEQ ID NO: 183161 - protein, 9 aa, Tick-borne encephalitis virus
IYSGQCDDD

SEQ ID NO: 183162 - protein, 9 aa, Tick-borne encephalitis virus
YSGQCDDDD

SEQ ID NO: 183163 - protein, 9 aa, Tick-borne encephalitis virus
SGQCDDDDS

SEQ ID NO: 183164 - protein, 9 aa, Tick-borne encephalitis virus
GQCDDDDSG

SEQ ID NO: 183165 - protein, 9 aa, Tick-borne encephalitis virus
QCDDDDSGL

SEQ ID NO: 183166 - protein, 9 aa, Tick-borne encephalitis virus
CDDDDSGLV

SEQ ID NO: 183167 - protein, 9 aa, Tick-borne encephalitis virus
DDDDSGLVQ

SEQ ID NO: 183168 - protein, 9 aa, Tick-borne encephalitis virus
DDDSGLVQW

SEQ ID NO: 183169 - protein, 9 aa, Tick-borne encephalitis virus
DDSGLVQWK

SEQ ID NO: 183170 - protein, 9 aa, Tick-borne encephalitis virus
DSGLVQWKE

SEQ ID NO: 183171 - protein, 9 aa, Tick-borne encephalitis virus
SGLVQWKEA

SEQ ID NO: 183172 - protein, 9 aa, Tick-borne encephalitis virus
GLVQWKEAQ

SEQ ID NO: 183173 - protein, 9 aa, Tick-borne encephalitis virus
LVQWKEAQI

SEQ ID NO: 183174 - protein, 9 aa, Tick-borne encephalitis virus
VQWKEAQIL

SEQ ID NO: 183175 - protein, 9 aa, Tick-borne encephalitis virus
QWKEAQILL

SEQ ID NO: 183176 - protein, 9 aa, Tick-borne encephalitis virus
WKEAQILLD

SEQ ID NO: 183177 - protein, 9 aa, Tick-borne encephalitis virus
KEAQILLDN

SEQ ID NO: 183178 - protein, 9 aa, Tick-borne encephalitis virus
EAQILLDNI

SEQ ID NO: 183179 - protein, 9 aa, Tick-borne encephalitis virus
AQILLDNIT

SEQ ID NO: 183180 - protein, 9 aa, Tick-borne encephalitis virus
QILLDNITT

SEQ ID NO: 183181 - protein, 9 aa, Tick-borne encephalitis virus
ILLDNITTL

SEQ ID NO: 183182 - protein, 9 aa, Tick-borne encephalitis virus
LLDNITTLR

SEQ ID NO: 183183 - protein, 9 aa, Tick-borne encephalitis virus
LDNITTLRG

SEQ ID NO: 183184 - protein, 9 aa, Tick-borne encephalitis virus
DNITTLRGP

SEQ ID NO: 183185 - protein, 9 aa, Tick-borne encephalitis virus
NITTLRGPV

SEQ ID NO: 183186 - protein, 9 aa, Tick-borne encephalitis virus
ITTLRGPVA

SEQ ID NO: 183187 - protein, 9 aa, Tick-borne encephalitis virus
TTLRGPVAT

SEQ ID NO: 183188 - protein, 9 aa, Tick-borne encephalitis virus
TLRGPVATF

SEQ ID NO: 183189 - protein, 9 aa, Tick-borne encephalitis virus
LRGPVATFY

SEQ ID NO: 183190 - protein, 9 aa, Tick-borne encephalitis virus
RGPVATFYG

SEQ ID NO: 183191 - protein, 9 aa, Tick-borne encephalitis virus
GPVATFYGP

SEQ ID NO: 183192 - protein, 9 aa, Tick-borne encephalitis virus
PVATFYGPE

SEQ ID NO: 183193 - protein, 9 aa, Tick-borne encephalitis virus
VATFYGPEQ

SEQ ID NO: 183194 - protein, 9 aa, Tick-borne encephalitis virus
ATFYGPEQD

SEQ ID NO: 183195 - protein, 9 aa, Tick-borne encephalitis virus
TFYGPEQDK

SEQ ID NO: 183196 - protein, 9 aa, Tick-borne encephalitis virus
FYGPEQDKM

SEQ ID NO: 183197 - protein, 9 aa, Tick-borne encephalitis virus
YGPEQDKMP

SEQ ID NO: 183198 - protein, 9 aa, Tick-borne encephalitis virus
GPEQDKMPE

SEQ ID NO: 183199 - protein, 9 aa, Tick-borne encephalitis virus
PEQDKMPEV

SEQ ID NO: 183200 - protein, 9 aa, Tick-borne encephalitis virus
EQDKMPEVA

SEQ ID NO: 183201 - protein, 9 aa, Tick-borne encephalitis virus
QDKMPEVAG

SEQ ID NO: 183202 - protein, 9 aa, Tick-borne encephalitis virus
DKMPEVAGH

SEQ ID NO: 183203 - protein, 9 aa, Tick-borne encephalitis virus
KMPEVAGHF

SEQ ID NO: 183204 - protein, 9 aa, Tick-borne encephalitis virus
MPEVAGHFR

SEQ ID NO: 183205 - protein, 9 aa, Tick-borne encephalitis virus
PEVAGHFRL

SEQ ID NO: 183206 - protein, 9 aa, Tick-borne encephalitis virus
EVAGHFRLT

SEQ ID NO: 183207 - protein, 9 aa, Tick-borne encephalitis virus
VAGHFRLTE

SEQ ID NO: 183208 - protein, 9 aa, Tick-borne encephalitis virus
AGHFRLTEE

SEQ ID NO: 183209 - protein, 9 aa, Tick-borne encephalitis virus
GHFRLTEEK

SEQ ID NO: 183210 - protein, 9 aa, Tick-borne encephalitis virus
HFRLTEEKR

SEQ ID NO: 183211 - protein, 9 aa, Tick-borne encephalitis virus
FRLTEEKRK

SEQ ID NO: 183212 - protein, 9 aa, Tick-borne encephalitis virus
RLTEEKRKH

SEQ ID NO: 183213 - protein, 9 aa, Tick-borne encephalitis virus
LTEEKRKHF

SEQ ID NO: 183214 - protein, 9 aa, Tick-borne encephalitis virus
TEEKRKHFR

SEQ ID NO: 183215 - protein, 9 aa, Tick-borne encephalitis virus
EEKRKHFRH

SEQ ID NO: 183216 - protein, 9 aa, Tick-borne encephalitis virus
EKRKHFRHL

SEQ ID NO: 183217 - protein, 9 aa, Tick-borne encephalitis virus
KRKHFRHLL

SEQ ID NO: 183218 - protein, 9 aa, Tick-borne encephalitis virus
RKHFRHLLT

SEQ ID NO: 183219 - protein, 9 aa, Tick-borne encephalitis virus
KHFRHLLTH

SEQ ID NO: 183220 - protein, 9 aa, Tick-borne encephalitis virus
HFRHLLTHC

SEQ ID NO: 183221 - protein, 9 aa, Tick-borne encephalitis virus
FRHLLTHCD

SEQ ID NO: 183222 - protein, 9 aa, Tick-borne encephalitis virus
RHLLTHCDF

SEQ ID NO: 183223 - protein, 9 aa, Tick-borne encephalitis virus
HLLTHCDFT

SEQ ID NO: 183224 - protein, 9 aa, Tick-borne encephalitis virus
LLTHCDFTP

SEQ ID NO: 183225 - protein, 9 aa, Tick-borne encephalitis virus
LTHCDFTPW

SEQ ID NO: 183226 - protein, 9 aa, Tick-borne encephalitis virus
THCDFTPWL

SEQ ID NO: 183227 - protein, 9 aa, Tick-borne encephalitis virus
HCDFTPWLA

SEQ ID NO: 183228 - protein, 9 aa, Tick-borne encephalitis virus
CDFTPWLAW

SEQ ID NO: 183229 - protein, 9 aa, Tick-borne encephalitis virus
DFTPWLAWH

SEQ ID NO: 183230 - protein, 9 aa, Tick-borne encephalitis virus
FTPWLAWHV

SEQ ID NO: 183231 - protein, 9 aa, Tick-borne encephalitis virus
TPWLAWHVA

SEQ ID NO: 183232 - protein, 9 aa, Tick-borne encephalitis virus
PWLAWHVAA

SEQ ID NO: 183233 - protein, 9 aa, Tick-borne encephalitis virus
WLAWHVAAN

SEQ ID NO: 183234 - protein, 9 aa, Tick-borne encephalitis virus
LAWHVAANV

SEQ ID NO: 183235 - protein, 9 aa, Tick-borne encephalitis virus
AWHVAANVS

SEQ ID NO: 183236 - protein, 9 aa, Tick-borne encephalitis virus
WHVAANVSS

SEQ ID NO: 183237 - protein, 9 aa, Tick-borne encephalitis virus
HVAANVSSV

SEQ ID NO: 183238 - protein, 9 aa, Tick-borne encephalitis virus
VAANVSSVT

SEQ ID NO: 183239 - protein, 9 aa, Tick-borne encephalitis virus
AANVSSVTS

SEQ ID NO: 183240 - protein, 9 aa, Tick-borne encephalitis virus
ANVSSVTSR

SEQ ID NO: 183241 - protein, 9 aa, Tick-borne encephalitis virus
NVSSVTSRN

SEQ ID NO: 183242 - protein, 9 aa, Tick-borne encephalitis virus
VSSVTSRNW

SEQ ID NO: 183243 - protein, 9 aa, Tick-borne encephalitis virus
SSVTSRNWT

SEQ ID NO: 183244 - protein, 9 aa, Tick-borne encephalitis virus
SVTSRNWTW

SEQ ID NO: 183245 - protein, 9 aa, Tick-borne encephalitis virus
VTSRNWTWE

SEQ ID NO: 183246 - protein, 9 aa, Tick-borne encephalitis virus
TSRNWTWEG

SEQ ID NO: 183247 - protein, 9 aa, Tick-borne encephalitis virus
SRNWTWEGP

SEQ ID NO: 183248 - protein, 9 aa, Tick-borne encephalitis virus
RNWTWEGPE

SEQ ID NO: 183249 - protein, 9 aa, Tick-borne encephalitis virus
NWTWEGPEE

SEQ ID NO: 183250 - protein, 9 aa, Tick-borne encephalitis virus
WTWEGPEEN

SEQ ID NO: 183251 - protein, 9 aa, Tick-borne encephalitis virus
TWEGPEENT

SEQ ID NO: 183252 - protein, 9 aa, Tick-borne encephalitis virus
WEGPEENTV

SEQ ID NO: 183253 - protein, 9 aa, Tick-borne encephalitis virus
EGPEENTVD

SEQ ID NO: 183254 - protein, 9 aa, Tick-borne encephalitis virus
GPEENTVDE

SEQ ID NO: 183255 - protein, 9 aa, Tick-borne encephalitis virus
PEENTVDEA

SEQ ID NO: 183256 - protein, 9 aa, Tick-borne encephalitis virus
EENTVDEAN

SEQ ID NO: 183257 - protein, 9 aa, Tick-borne encephalitis virus
ENTVDEANG

SEQ ID NO: 183258 - protein, 9 aa, Tick-borne encephalitis virus
NTVDEANGD

SEQ ID NO: 183259 - protein, 9 aa, Tick-borne encephalitis virus
TVDEANGDL

SEQ ID NO: 183260 - protein, 9 aa, Tick-borne encephalitis virus
VDEANGDLV

SEQ ID NO: 183261 - protein, 9 aa, Tick-borne encephalitis virus
DEANGDLVT

SEQ ID NO: 183262 - protein, 9 aa, Tick-borne encephalitis virus
EANGDLVTF

SEQ ID NO: 183263 - protein, 9 aa, Tick-borne encephalitis virus
ANGDLVTFR

SEQ ID NO: 183264 - protein, 9 aa, Tick-borne encephalitis virus
NGDLVTFRS

SEQ ID NO: 183265 - protein, 9 aa, Tick-borne encephalitis virus
GDLVTFRSP

SEQ ID NO: 183266 - protein, 9 aa, Tick-borne encephalitis virus
DLVTFRSPN

SEQ ID NO: 183267 - protein, 9 aa, Tick-borne encephalitis virus
LVTFRSPNG

SEQ ID NO: 183268 - protein, 9 aa, Tick-borne encephalitis virus
VTFRSPNGA

SEQ ID NO: 183269 - protein, 9 aa, Tick-borne encephalitis virus
TFRSPNGAE

SEQ ID NO: 183270 - protein, 9 aa, Tick-borne encephalitis virus
FRSPNGAER

SEQ ID NO: 183271 - protein, 9 aa, Tick-borne encephalitis virus
RSPNGAERT

SEQ ID NO: 183272 - protein, 9 aa, Tick-borne encephalitis virus
SPNGAERTL

SEQ ID NO: 183273 - protein, 9 aa, Tick-borne encephalitis virus
PNGAERTLR

SEQ ID NO: 183274 - protein, 9 aa, Tick-borne encephalitis virus
NGAERTLRP

SEQ ID NO: 183275 - protein, 9 aa, Tick-borne encephalitis virus
GAERTLRPV

SEQ ID NO: 183276 - protein, 9 aa, Tick-borne encephalitis virus
AERTLRPVW

SEQ ID NO: 183277 - protein, 9 aa, Tick-borne encephalitis virus
ERTLRPVWR

SEQ ID NO: 183278 - protein, 9 aa, Tick-borne encephalitis virus
RTLRPVWRD

SEQ ID NO: 183279 - protein, 9 aa, Tick-borne encephalitis virus
TLRPVWRDA

SEQ ID NO: 183280 - protein, 9 aa, Tick-borne encephalitis virus
LRPVWRDAR

SEQ ID NO: 183281 - protein, 9 aa, Tick-borne encephalitis virus
RPVWRDARM

SEQ ID NO: 183282 - protein, 9 aa, Tick-borne encephalitis virus
PVWRDARMF

SEQ ID NO: 183283 - protein, 9 aa, Tick-borne encephalitis virus
VWRDARMFR

SEQ ID NO: 183284 - protein, 9 aa, Tick-borne encephalitis virus
WRDARMFRE

SEQ ID NO: 183285 - protein, 9 aa, Tick-borne encephalitis virus
RDARMFREG

SEQ ID NO: 183286 - protein, 9 aa, Tick-borne encephalitis virus
DARMFREGR

SEQ ID NO: 183287 - protein, 9 aa, Tick-borne encephalitis virus
ARMFREGRD

SEQ ID NO: 183288 - protein, 9 aa, Tick-borne encephalitis virus
RMFREGRDI

SEQ ID NO: 183289 - protein, 9 aa, Tick-borne encephalitis virus
MFREGRDIR

SEQ ID NO: 183290 - protein, 9 aa, Tick-borne encephalitis virus
FREGRDIRE

SEQ ID NO: 183291 - protein, 9 aa, Tick-borne encephalitis virus
REGRDIREF

SEQ ID NO: 183292 - protein, 9 aa, Tick-borne encephalitis virus
EGRDIREFV

SEQ ID NO: 183293 - protein, 9 aa, Tick-borne encephalitis virus
GRDIREFVA

SEQ ID NO: 183294 - protein, 9 aa, Tick-borne encephalitis virus
RDIREFVAY

SEQ ID NO: 183295 - protein, 9 aa, Tick-borne encephalitis virus
DIREFVAYA

SEQ ID NO: 183296 - protein, 9 aa, Tick-borne encephalitis virus
IREFVAYAS

SEQ ID NO: 183297 - protein, 9 aa, Tick-borne encephalitis virus
REFVAYASG

SEQ ID NO: 183298 - protein, 9 aa, Tick-borne encephalitis virus
EFVAYASGR

SEQ ID NO: 183299 - protein, 9 aa, Tick-borne encephalitis virus
FVAYASGRR

SEQ ID NO: 183300 - protein, 9 aa, Tick-borne encephalitis virus
VAYASGRRS

SEQ ID NO: 183301 - protein, 9 aa, Tick-borne encephalitis virus
AYASGRRSF

SEQ ID NO: 183302 - protein, 9 aa, Tick-borne encephalitis virus
YASGRRSFG

SEQ ID NO: 183303 - protein, 9 aa, Tick-borne encephalitis virus
ASGRRSFGD

SEQ ID NO: 183304 - protein, 9 aa, Tick-borne encephalitis virus
SGRRSFGDV

SEQ ID NO: 183305 - protein, 9 aa, Tick-borne encephalitis virus
GRRSFGDVL

SEQ ID NO: 183306 - protein, 9 aa, Tick-borne encephalitis virus
RRSFGDVLS

SEQ ID NO: 183307 - protein, 9 aa, Tick-borne encephalitis virus
RSFGDVLSG

SEQ ID NO: 183308 - protein, 9 aa, Tick-borne encephalitis virus
SFGDVLSGM

SEQ ID NO: 183309 - protein, 9 aa, Tick-borne encephalitis virus
FGDVLSGMS

SEQ ID NO: 183310 - protein, 9 aa, Tick-borne encephalitis virus
GDVLSGMSG

SEQ ID NO: 183311 - protein, 9 aa, Tick-borne encephalitis virus
DVLSGMSGV

SEQ ID NO: 183312 - protein, 9 aa, Tick-borne encephalitis virus
VLSGMSGVP

SEQ ID NO: 183313 - protein, 9 aa, Tick-borne encephalitis virus
LSGMSGVPE

SEQ ID NO: 183314 - protein, 9 aa, Tick-borne encephalitis virus
SGMSGVPEL

SEQ ID NO: 183315 - protein, 9 aa, Tick-borne encephalitis virus
GMSGVPELL

SEQ ID NO: 183316 - protein, 9 aa, Tick-borne encephalitis virus
MSGVPELLR

SEQ ID NO: 183317 - protein, 9 aa, Tick-borne encephalitis virus
SGVPELLRH

SEQ ID NO: 183318 - protein, 9 aa, Tick-borne encephalitis virus
GVPELLRHR

SEQ ID NO: 183319 - protein, 9 aa, Tick-borne encephalitis virus
VPELLRHRC

SEQ ID NO: 183320 - protein, 9 aa, Tick-borne encephalitis virus
PELLRHRCV

SEQ ID NO: 183321 - protein, 9 aa, Tick-borne encephalitis virus
ELLRHRCVS

SEQ ID NO: 183322 - protein, 9 aa, Tick-borne encephalitis virus
LLRHRCVSA

SEQ ID NO: 183323 - protein, 9 aa, Tick-borne encephalitis virus
LRHRCVSAM

SEQ ID NO: 183324 - protein, 9 aa, Tick-borne encephalitis virus
RHRCVSAMD

SEQ ID NO: 183325 - protein, 9 aa, Tick-borne encephalitis virus
HRCVSAMDV

SEQ ID NO: 183326 - protein, 9 aa, Tick-borne encephalitis virus
RCVSAMDVF

SEQ ID NO: 183327 - protein, 9 aa, Tick-borne encephalitis virus
CVSAMDVFY

SEQ ID NO: 183328 - protein, 9 aa, Tick-borne encephalitis virus
VSAMDVFYT

SEQ ID NO: 183329 - protein, 9 aa, Tick-borne encephalitis virus
SAMDVFYTL

SEQ ID NO: 183330 - protein, 9 aa, Tick-borne encephalitis virus
AMDVFYTLM

SEQ ID NO: 183331 - protein, 9 aa, Tick-borne encephalitis virus
MDVFYTLMH

SEQ ID NO: 183332 - protein, 9 aa, Tick-borne encephalitis virus
DVFYTLMHE

SEQ ID NO: 183333 - protein, 9 aa, Tick-borne encephalitis virus
VFYTLMHEE

SEQ ID NO: 183334 - protein, 9 aa, Tick-borne encephalitis virus
FYTLMHEEP

SEQ ID NO: 183335 - protein, 9 aa, Tick-borne encephalitis virus
YTLMHEEPG

SEQ ID NO: 183336 - protein, 9 aa, Tick-borne encephalitis virus
TLMHEEPGS

SEQ ID NO: 183337 - protein, 9 aa, Tick-borne encephalitis virus
LMHEEPGSR

SEQ ID NO: 183338 - protein, 9 aa, Tick-borne encephalitis virus
MHEEPGSRA

SEQ ID NO: 183339 - protein, 9 aa, Tick-borne encephalitis virus
HEEPGSRAM

SEQ ID NO: 183340 - protein, 9 aa, Tick-borne encephalitis virus
EEPGSRAMR

SEQ ID NO: 183341 - protein, 9 aa, Tick-borne encephalitis virus
EPGSRAMRM

SEQ ID NO: 183342 - protein, 9 aa, Tick-borne encephalitis virus
PGSRAMRMA

SEQ ID NO: 183343 - protein, 9 aa, Tick-borne encephalitis virus
GSRAMRMAE

SEQ ID NO: 183344 - protein, 9 aa, Tick-borne encephalitis virus
SRAMRMAER

SEQ ID NO: 183345 - protein, 9 aa, Tick-borne encephalitis virus
RAMRMAERD

SEQ ID NO: 183346 - protein, 9 aa, Tick-borne encephalitis virus
AMRMAERDA

SEQ ID NO: 183347 - protein, 9 aa, Tick-borne encephalitis virus
MRMAERDAP

SEQ ID NO: 183348 - protein, 9 aa, Tick-borne encephalitis virus
RMAERDAPE

SEQ ID NO: 183349 - protein, 9 aa, Tick-borne encephalitis virus
MAERDAPEA

SEQ ID NO: 183350 - protein, 9 aa, Tick-borne encephalitis virus
AERDAPEAF

SEQ ID NO: 183351 - protein, 9 aa, Tick-borne encephalitis virus
ERDAPEAFL

SEQ ID NO: 183352 - protein, 9 aa, Tick-borne encephalitis virus
RDAPEAFLT

SEQ ID NO: 183353 - protein, 9 aa, Tick-borne encephalitis virus
DAPEAFLTV

SEQ ID NO: 183354 - protein, 9 aa, Tick-borne encephalitis virus
APEAFLTVV

SEQ ID NO: 183355 - protein, 9 aa, Tick-borne encephalitis virus
PEAFLTVVE

SEQ ID NO: 183356 - protein, 9 aa, Tick-borne encephalitis virus
VEMMVLGLA

SEQ ID NO: 183357 - protein, 9 aa, Tick-borne encephalitis virus
EMMVLGLAT

SEQ ID NO: 183358 - protein, 9 aa, Tick-borne encephalitis virus
MMVLGLATL

SEQ ID NO: 183359 - protein, 9 aa, Tick-borne encephalitis virus
MVLGLATLG

SEQ ID NO: 183360 - protein, 9 aa, Tick-borne encephalitis virus
VLGLATLGV

SEQ ID NO: 183361 - protein, 9 aa, Tick-borne encephalitis virus
LGLATLGVV

SEQ ID NO: 183362 - protein, 9 aa, Tick-borne encephalitis virus
GLATLGVVW

SEQ ID NO: 183363 - protein, 9 aa, Tick-borne encephalitis virus
LATLGVVWC

SEQ ID NO: 183364 - protein, 9 aa, Tick-borne encephalitis virus
ATLGVVWCF

SEQ ID NO: 183365 - protein, 9 aa, Tick-borne encephalitis virus
TLGVVWCFV

SEQ ID NO: 183366 - protein, 9 aa, Tick-borne encephalitis virus
LGVVWCFVV

SEQ ID NO: 183367 - protein, 9 aa, Tick-borne encephalitis virus
GVVWCFVVR

SEQ ID NO: 183368 - protein, 9 aa, Tick-borne encephalitis virus
VVWCFVVRT

SEQ ID NO: 183369 - protein, 9 aa, Tick-borne encephalitis virus
VWCFVVRTS

SEQ ID NO: 183370 - protein, 9 aa, Tick-borne encephalitis virus
WCFVVRTSI

SEQ ID NO: 183371 - protein, 9 aa, Tick-borne encephalitis virus
CFVVRTSIS

SEQ ID NO: 183372 - protein, 9 aa, Tick-borne encephalitis virus
FVVRTSISR

SEQ ID NO: 183373 - protein, 9 aa, Tick-borne encephalitis virus
VVRTSISRM

SEQ ID NO: 183374 - protein, 9 aa, Tick-borne encephalitis virus
VRTSISRMM

SEQ ID NO: 183375 - protein, 9 aa, Tick-borne encephalitis virus
RTSISRMML

SEQ ID NO: 183376 - protein, 9 aa, Tick-borne encephalitis virus
TSISRMMLG

SEQ ID NO: 183377 - protein, 9 aa, Tick-borne encephalitis virus
SISRMMLGT

SEQ ID NO: 183378 - protein, 9 aa, Tick-borne encephalitis virus
ISRMMLGTL

SEQ ID NO: 183379 - protein, 9 aa, Tick-borne encephalitis virus
SRMMLGTLV

SEQ ID NO: 183380 - protein, 9 aa, Tick-borne encephalitis virus
RMMLGTLVL

SEQ ID NO: 183381 - protein, 9 aa, Tick-borne encephalitis virus
MMLGTLVLL

SEQ ID NO: 183382 - protein, 9 aa, Tick-borne encephalitis virus
MLGTLVLLA

SEQ ID NO: 183383 - protein, 9 aa, Tick-borne encephalitis virus
LGTLVLLAS

SEQ ID NO: 183384 - protein, 9 aa, Tick-borne encephalitis virus
GTLVLLASL

SEQ ID NO: 183385 - protein, 9 aa, Tick-borne encephalitis virus
TLVLLASLA

SEQ ID NO: 183386 - protein, 9 aa, Tick-borne encephalitis virus
LVLLASLAL

SEQ ID NO: 183387 - protein, 9 aa, Tick-borne encephalitis virus
VLLASLALL

SEQ ID NO: 183388 - protein, 9 aa, Tick-borne encephalitis virus
LLASLALLW

SEQ ID NO: 183389 - protein, 9 aa, Tick-borne encephalitis virus
LASLALLWA

SEQ ID NO: 183390 - protein, 9 aa, Tick-borne encephalitis virus
ASLALLWAG

SEQ ID NO: 183391 - protein, 9 aa, Tick-borne encephalitis virus
SLALLWAGG

SEQ ID NO: 183392 - protein, 9 aa, Tick-borne encephalitis virus
LALLWAGGV

SEQ ID NO: 183393 - protein, 9 aa, Tick-borne encephalitis virus
ALLWAGGVS

SEQ ID NO: 183394 - protein, 9 aa, Tick-borne encephalitis virus
LLWAGGVSY

SEQ ID NO: 183395 - protein, 9 aa, Tick-borne encephalitis virus
LWAGGVSYG

SEQ ID NO: 183396 - protein, 9 aa, Tick-borne encephalitis virus
WAGGVSYGN

SEQ ID NO: 183397 - protein, 9 aa, Tick-borne encephalitis virus
AGGVSYGNM

SEQ ID NO: 183398 - protein, 9 aa, Tick-borne encephalitis virus
GGVSYGNMA

SEQ ID NO: 183399 - protein, 9 aa, Tick-borne encephalitis virus
GVSYGNMAG

SEQ ID NO: 183400 - protein, 9 aa, Tick-borne encephalitis virus
VSYGNMAGV

SEQ ID NO: 183401 - protein, 9 aa, Tick-borne encephalitis virus
SYGNMAGVA

SEQ ID NO: 183402 - protein, 9 aa, Tick-borne encephalitis virus
YGNMAGVAL

SEQ ID NO: 183403 - protein, 9 aa, Tick-borne encephalitis virus
GNMAGVALI

SEQ ID NO: 183404 - protein, 9 aa, Tick-borne encephalitis virus
NMAGVALIF

SEQ ID NO: 183405 - protein, 9 aa, Tick-borne encephalitis virus
MAGVALIFY

SEQ ID NO: 183406 - protein, 9 aa, Tick-borne encephalitis virus
AGVALIFYT

SEQ ID NO: 183407 - protein, 9 aa, Tick-borne encephalitis virus
GVALIFYTL

SEQ ID NO: 183408 - protein, 9 aa, Tick-borne encephalitis virus
VALIFYTLL

SEQ ID NO: 183409 - protein, 9 aa, Tick-borne encephalitis virus
ALIFYTLLT

SEQ ID NO: 183410 - protein, 9 aa, Tick-borne encephalitis virus
LIFYTLLTV

SEQ ID NO: 183411 - protein, 9 aa, Tick-borne encephalitis virus
IFYTLLTVL

SEQ ID NO: 183412 - protein, 9 aa, Tick-borne encephalitis virus
FYTLLTVLQ

SEQ ID NO: 183413 - protein, 9 aa, Tick-borne encephalitis virus
YTLLTVLQP

SEQ ID NO: 183414 - protein, 9 aa, Tick-borne encephalitis virus
TLLTVLQPE

SEQ ID NO: 183415 - protein, 9 aa, Tick-borne encephalitis virus
LLTVLQPEA

SEQ ID NO: 183416 - protein, 9 aa, Tick-borne encephalitis virus
LTVLQPEAG

SEQ ID NO: 183417 - protein, 9 aa, Tick-borne encephalitis virus
TVLQPEAGK

SEQ ID NO: 183418 - protein, 9 aa, Tick-borne encephalitis virus
VLQPEAGKQ

SEQ ID NO: 183419 - protein, 9 aa, Tick-borne encephalitis virus
LQPEAGKQR

SEQ ID NO: 183420 - protein, 9 aa, Tick-borne encephalitis virus
QPEAGKQRS

SEQ ID NO: 183421 - protein, 9 aa, Tick-borne encephalitis virus
PEAGKQRSS

SEQ ID NO: 183422 - protein, 9 aa, Tick-borne encephalitis virus
EAGKQRSSD

SEQ ID NO: 183423 - protein, 9 aa, Tick-borne encephalitis virus
AGKQRSSDD

SEQ ID NO: 183424 - protein, 9 aa, Tick-borne encephalitis virus
GKQRSSDDN

SEQ ID NO: 183425 - protein, 9 aa, Tick-borne encephalitis virus
KQRSSDDNK

SEQ ID NO: 183426 - protein, 9 aa, Tick-borne encephalitis virus
QRSSDDNKL

SEQ ID NO: 183427 - protein, 9 aa, Tick-borne encephalitis virus
RSSDDNKLA

SEQ ID NO: 183428 - protein, 9 aa, Tick-borne encephalitis virus
SSDDNKLAY

SEQ ID NO: 183429 - protein, 9 aa, Tick-borne encephalitis virus
SDDNKLAYF

SEQ ID NO: 183430 - protein, 9 aa, Tick-borne encephalitis virus
DDNKLAYFL

SEQ ID NO: 183431 - protein, 9 aa, Tick-borne encephalitis virus
DNKLAYFLL

SEQ ID NO: 183432 - protein, 9 aa, Tick-borne encephalitis virus
NKLAYFLLT

SEQ ID NO: 183433 - protein, 9 aa, Tick-borne encephalitis virus
KLAYFLLTL

SEQ ID NO: 183434 - protein, 9 aa, Tick-borne encephalitis virus
LAYFLLTLC

SEQ ID NO: 183435 - protein, 9 aa, Tick-borne encephalitis virus
AYFLLTLCS

SEQ ID NO: 183436 - protein, 9 aa, Tick-borne encephalitis virus
YFLLTLCSL

SEQ ID NO: 183437 - protein, 9 aa, Tick-borne encephalitis virus
FLLTLCSLA

SEQ ID NO: 183438 - protein, 9 aa, Tick-borne encephalitis virus
LLTLCSLAG

SEQ ID NO: 183439 - protein, 9 aa, Tick-borne encephalitis virus
LTLCSLAGL

SEQ ID NO: 183440 - protein, 9 aa, Tick-borne encephalitis virus
TLCSLAGLV

SEQ ID NO: 183441 - protein, 9 aa, Tick-borne encephalitis virus
LCSLAGLVA

SEQ ID NO: 183442 - protein, 9 aa, Tick-borne encephalitis virus
CSLAGLVAA

SEQ ID NO: 183443 - protein, 9 aa, Tick-borne encephalitis virus
SLAGLVAAN

SEQ ID NO: 183444 - protein, 9 aa, Tick-borne encephalitis virus
LAGLVAANE

SEQ ID NO: 183445 - protein, 9 aa, Tick-borne encephalitis virus
AGLVAANEM

SEQ ID NO: 183446 - protein, 9 aa, Tick-borne encephalitis virus
GLVAANEMG

SEQ ID NO: 183447 - protein, 9 aa, Tick-borne encephalitis virus
LVAANEMGF

SEQ ID NO: 183448 - protein, 9 aa, Tick-borne encephalitis virus
VAANEMGFL

SEQ ID NO: 183449 - protein, 9 aa, Tick-borne encephalitis virus
AANEMGFLE

SEQ ID NO: 183450 - protein, 9 aa, Tick-borne encephalitis virus
ANEMGFLEK

SEQ ID NO: 183451 - protein, 9 aa, Tick-borne encephalitis virus
NEMGFLEKT

SEQ ID NO: 183452 - protein, 9 aa, Tick-borne encephalitis virus
EMGFLEKTK

SEQ ID NO: 183453 - protein, 9 aa, Tick-borne encephalitis virus
MGFLEKTKA

SEQ ID NO: 183454 - protein, 9 aa, Tick-borne encephalitis virus
GFLEKTKAD

SEQ ID NO: 183455 - protein, 9 aa, Tick-borne encephalitis virus
FLEKTKADL

SEQ ID NO: 183456 - protein, 9 aa, Tick-borne encephalitis virus
LEKTKADLS

SEQ ID NO: 183457 - protein, 9 aa, Tick-borne encephalitis virus
EKTKADLST

SEQ ID NO: 183458 - protein, 9 aa, Tick-borne encephalitis virus
KTKADLSTV

SEQ ID NO: 183459 - protein, 9 aa, Tick-borne encephalitis virus
TKADLSTVL

SEQ ID NO: 183460 - protein, 9 aa, Tick-borne encephalitis virus
KADLSTVLW

SEQ ID NO: 183461 - protein, 9 aa, Tick-borne encephalitis virus
ADLSTVLWS

SEQ ID NO: 183462 - protein, 9 aa, Tick-borne encephalitis virus
ELRSWEEWT

SEQ ID NO: 183463 - protein, 9 aa, Tick-borne encephalitis virus
LRSWEEWTN

SEQ ID NO: 183464 - protein, 9 aa, Tick-borne encephalitis virus
RSWEEWTNI

SEQ ID NO: 183465 - protein, 9 aa, Tick-borne encephalitis virus
SWEEWTNID

SEQ ID NO: 183466 - protein, 9 aa, Tick-borne encephalitis virus
WEEWTNIDI

SEQ ID NO: 183467 - protein, 9 aa, Tick-borne encephalitis virus
EEWTNIDIQ

SEQ ID NO: 183468 - protein, 9 aa, Tick-borne encephalitis virus
EWTNIDIQP

SEQ ID NO: 183469 - protein, 9 aa, Tick-borne encephalitis virus
WTNIDIQPA

SEQ ID NO: 183470 - protein, 9 aa, Tick-borne encephalitis virus
TNIDIQPAR

SEQ ID NO: 183471 - protein, 9 aa, Tick-borne encephalitis virus
NIDIQPARS

SEQ ID NO: 183472 - protein, 9 aa, Tick-borne encephalitis virus
IDIQPARSW

SEQ ID NO: 183473 - protein, 9 aa, Tick-borne encephalitis virus
DIQPARSWG

SEQ ID NO: 183474 - protein, 9 aa, Tick-borne encephalitis virus
IQPARSWGT

SEQ ID NO: 183475 - protein, 9 aa, Tick-borne encephalitis virus
QPARSWGTY

SEQ ID NO: 183476 - protein, 9 aa, Tick-borne encephalitis virus
PARSWGTYV

SEQ ID NO: 183477 - protein, 9 aa, Tick-borne encephalitis virus
ARSWGTYVL

SEQ ID NO: 183478 - protein, 9 aa, Tick-borne encephalitis virus
RSWGTYVLV

SEQ ID NO: 183479 - protein, 9 aa, Tick-borne encephalitis virus
SWGTYVLVV

SEQ ID NO: 183480 - protein, 9 aa, Tick-borne encephalitis virus
WGTYVLVVS

SEQ ID NO: 183481 - protein, 9 aa, Tick-borne encephalitis virus
GTYVLVVSL

SEQ ID NO: 183482 - protein, 9 aa, Tick-borne encephalitis virus
TYVLVVSLF

SEQ ID NO: 183483 - protein, 9 aa, Tick-borne encephalitis virus
YVLVVSLFT

SEQ ID NO: 183484 - protein, 9 aa, Tick-borne encephalitis virus
VLVVSLFTP

SEQ ID NO: 183485 - protein, 9 aa, Tick-borne encephalitis virus
LVVSLFTPY

SEQ ID NO: 183486 - protein, 9 aa, Tick-borne encephalitis virus
VVSLFTPYI

SEQ ID NO: 183487 - protein, 9 aa, Tick-borne encephalitis virus
VSLFTPYII

SEQ ID NO: 183488 - protein, 9 aa, Tick-borne encephalitis virus
SLFTPYIIH

SEQ ID NO: 183489 - protein, 9 aa, Tick-borne encephalitis virus
LFTPYIIHQ

SEQ ID NO: 183490 - protein, 9 aa, Tick-borne encephalitis virus
FTPYIIHQL

SEQ ID NO: 183491 - protein, 9 aa, Tick-borne encephalitis virus
TPYIIHQLQ

SEQ ID NO: 183492 - protein, 9 aa, Tick-borne encephalitis virus
PYIIHQLQT

SEQ ID NO: 183493 - protein, 9 aa, Tick-borne encephalitis virus
YIIHQLQTK

SEQ ID NO: 183494 - protein, 9 aa, Tick-borne encephalitis virus
IIHQLQTKI

SEQ ID NO: 183495 - protein, 9 aa, Tick-borne encephalitis virus
IHQLQTKIQ

SEQ ID NO: 183496 - protein, 9 aa, Tick-borne encephalitis virus
HQLQTKIQQ

SEQ ID NO: 183497 - protein, 9 aa, Tick-borne encephalitis virus
QLQTKIQQL

SEQ ID NO: 183498 - protein, 9 aa, Tick-borne encephalitis virus
LQTKIQQLV

SEQ ID NO: 183499 - protein, 9 aa, Tick-borne encephalitis virus
QTKIQQLVN

SEQ ID NO: 183500 - protein, 9 aa, Tick-borne encephalitis virus
TKIQQLVNS

SEQ ID NO: 183501 - protein, 9 aa, Tick-borne encephalitis virus
KIQQLVNSA

SEQ ID NO: 183502 - protein, 9 aa, Tick-borne encephalitis virus
IQQLVNSAV

SEQ ID NO: 183503 - protein, 9 aa, Tick-borne encephalitis virus
QQLVNSAVA

SEQ ID NO: 183504 - protein, 9 aa, Tick-borne encephalitis virus
QLVNSAVAT

SEQ ID NO: 183505 - protein, 9 aa, Tick-borne encephalitis virus
LVNSAVATG

SEQ ID NO: 183506 - protein, 9 aa, Tick-borne encephalitis virus
VNSAVATGA

SEQ ID NO: 183507 - protein, 9 aa, Tick-borne encephalitis virus
NSAVATGAQ

SEQ ID NO: 183508 - protein, 9 aa, Tick-borne encephalitis virus
SAVATGAQA

SEQ ID NO: 183509 - protein, 9 aa, Tick-borne encephalitis virus
AVATGAQAM

SEQ ID NO: 183510 - protein, 9 aa, Tick-borne encephalitis virus
VATGAQAMR

SEQ ID NO: 183511 - protein, 9 aa, Tick-borne encephalitis virus
ATGAQAMRD

SEQ ID NO: 183512 - protein, 9 aa, Tick-borne encephalitis virus
TGAQAMRDL

SEQ ID NO: 183513 - protein, 9 aa, Tick-borne encephalitis virus
GAQAMRDLG

SEQ ID NO: 183514 - protein, 9 aa, Tick-borne encephalitis virus
AQAMRDLGG

SEQ ID NO: 183515 - protein, 9 aa, Tick-borne encephalitis virus
QAMRDLGGG

SEQ ID NO: 183516 - protein, 9 aa, Tick-borne encephalitis virus
AMRDLGGGA

SEQ ID NO: 183517 - protein, 9 aa, Tick-borne encephalitis virus
MRDLGGGAP

SEQ ID NO: 183518 - protein, 9 aa, Tick-borne encephalitis virus
RDLGGGAPF

SEQ ID NO: 183519 - protein, 9 aa, Tick-borne encephalitis virus
DLGGGAPFF

SEQ ID NO: 183520 - protein, 9 aa, Tick-borne encephalitis virus
LGGGAPFFG

SEQ ID NO: 183521 - protein, 9 aa, Tick-borne encephalitis virus
GGGAPFFGV

SEQ ID NO: 183522 - protein, 9 aa, Tick-borne encephalitis virus
GGAPFFGVA

SEQ ID NO: 183523 - protein, 9 aa, Tick-borne encephalitis virus
GAPFFGVAG

SEQ ID NO: 183524 - protein, 9 aa, Tick-borne encephalitis virus
APFFGVAGH

SEQ ID NO: 183525 - protein, 9 aa, Tick-borne encephalitis virus
PFFGVAGHV

SEQ ID NO: 183526 - protein, 9 aa, Tick-borne encephalitis virus
FFGVAGHVM

SEQ ID NO: 183527 - protein, 9 aa, Tick-borne encephalitis virus
GVAGHVMAL

SEQ ID NO: 183528 - protein, 9 aa, Tick-borne encephalitis virus
VAGHVMALG

SEQ ID NO: 183529 - protein, 9 aa, Tick-borne encephalitis virus
AGHVMALGV

SEQ ID NO: 183530 - protein, 9 aa, Tick-borne encephalitis virus
GHVMALGVV

SEQ ID NO: 183531 - protein, 9 aa, Tick-borne encephalitis virus
HVMALGVVS

SEQ ID NO: 183532 - protein, 9 aa, Tick-borne encephalitis virus
VMALGVVSL

SEQ ID NO: 183533 - protein, 9 aa, Tick-borne encephalitis virus
MALGVVSLV

SEQ ID NO: 183534 - protein, 9 aa, Tick-borne encephalitis virus
ALGVVSLVG

SEQ ID NO: 183535 - protein, 9 aa, Tick-borne encephalitis virus
LGVVSLVGA

SEQ ID NO: 183536 - protein, 9 aa, Tick-borne encephalitis virus
GVVSLVGAT

SEQ ID NO: 183537 - protein, 9 aa, Tick-borne encephalitis virus
VVSLVGATP

SEQ ID NO: 183538 - protein, 9 aa, Tick-borne encephalitis virus
VSLVGATPT

SEQ ID NO: 183539 - protein, 9 aa, Tick-borne encephalitis virus
SLVGATPTS

SEQ ID NO: 183540 - protein, 9 aa, Tick-borne encephalitis virus
LVGATPTSL

SEQ ID NO: 183541 - protein, 9 aa, Tick-borne encephalitis virus
VGATPTSLV

SEQ ID NO: 183542 - protein, 9 aa, Tick-borne encephalitis virus
GATPTSLVV

SEQ ID NO: 183543 - protein, 9 aa, Tick-borne encephalitis virus
ATPTSLVVG

SEQ ID NO: 183544 - protein, 9 aa, Tick-borne encephalitis virus
TPTSLVVGV

SEQ ID NO: 183545 - protein, 9 aa, Tick-borne encephalitis virus
PTSLVVGVG

SEQ ID NO: 183546 - protein, 9 aa, Tick-borne encephalitis virus
TSLVVGVGL

SEQ ID NO: 183547 - protein, 9 aa, Tick-borne encephalitis virus
SLVVGVGLA

SEQ ID NO: 183548 - protein, 9 aa, Tick-borne encephalitis virus
LVVGVGLAA

SEQ ID NO: 183549 - protein, 9 aa, Tick-borne encephalitis virus
VVGVGLAAF

SEQ ID NO: 183550 - protein, 9 aa, Tick-borne encephalitis virus
VGVGLAAFH

SEQ ID NO: 183551 - protein, 9 aa, Tick-borne encephalitis virus
GVGLAAFHL

SEQ ID NO: 183552 - protein, 9 aa, Tick-borne encephalitis virus
VGLAAFHLA

SEQ ID NO: 183553 - protein, 9 aa, Tick-borne encephalitis virus
GLAAFHLAI

SEQ ID NO: 183554 - protein, 9 aa, Tick-borne encephalitis virus
LAAFHLAIV

SEQ ID NO: 183555 - protein, 9 aa, Tick-borne encephalitis virus
AAFHLAIVV

SEQ ID NO: 183556 - protein, 9 aa, Tick-borne encephalitis virus
AFHLAIVVS

SEQ ID NO: 183557 - protein, 9 aa, Tick-borne encephalitis virus
FHLAIVVSG

SEQ ID NO: 183558 - protein, 9 aa, Tick-borne encephalitis virus
HLAIVVSGL

SEQ ID NO: 183559 - protein, 9 aa, Tick-borne encephalitis virus
LAIVVSGLE

SEQ ID NO: 183560 - protein, 9 aa, Tick-borne encephalitis virus
AIVVSGLEA

SEQ ID NO: 183561 - protein, 9 aa, Tick-borne encephalitis virus
IVVSGLEAE

SEQ ID NO: 183562 - protein, 9 aa, Tick-borne encephalitis virus
VVSGLEAEL

SEQ ID NO: 183563 - protein, 9 aa, Tick-borne encephalitis virus
VSGLEAELT

SEQ ID NO: 183564 - protein, 9 aa, Tick-borne encephalitis virus
SGLEAELTQ

SEQ ID NO: 183565 - protein, 9 aa, Tick-borne encephalitis virus
GLEAELTQR

SEQ ID NO: 183566 - protein, 9 aa, Tick-borne encephalitis virus
LEAELTQRA

SEQ ID NO: 183567 - protein, 9 aa, Tick-borne encephalitis virus
EAELTQRAH

SEQ ID NO: 183568 - protein, 9 aa, Tick-borne encephalitis virus
AELTQRAHK

SEQ ID NO: 183569 - protein, 9 aa, Tick-borne encephalitis virus
ELTQRAHKV

SEQ ID NO: 183570 - protein, 9 aa, Tick-borne encephalitis virus
LTQRAHKVF

SEQ ID NO: 183571 - protein, 9 aa, Tick-borne encephalitis virus
TQRAHKVFF

SEQ ID NO: 183572 - protein, 9 aa, Tick-borne encephalitis virus
QRAHKVFFS

SEQ ID NO: 183573 - protein, 9 aa, Tick-borne encephalitis virus
RAHKVFFSA

SEQ ID NO: 183574 - protein, 9 aa, Tick-borne encephalitis virus
AHKVFFSAM

SEQ ID NO: 183575 - protein, 9 aa, Tick-borne encephalitis virus
HKVFFSAMV

SEQ ID NO: 183576 - protein, 9 aa, Tick-borne encephalitis virus
KVFFSAMVR

SEQ ID NO: 183577 - protein, 9 aa, Tick-borne encephalitis virus
VFFSAMVRN

SEQ ID NO: 183578 - protein, 9 aa, Tick-borne encephalitis virus
FFSAMVRNP

SEQ ID NO: 183579 - protein, 9 aa, Tick-borne encephalitis virus
FSAMVRNPM

SEQ ID NO: 183580 - protein, 9 aa, Tick-borne encephalitis virus
SAMVRNPMV

SEQ ID NO: 183581 - protein, 9 aa, Tick-borne encephalitis virus
AMVRNPMVD

SEQ ID NO: 183582 - protein, 9 aa, Tick-borne encephalitis virus
MVRNPMVDG

SEQ ID NO: 183583 - protein, 9 aa, Tick-borne encephalitis virus
VRNPMVDGD

SEQ ID NO: 183584 - protein, 9 aa, Tick-borne encephalitis virus
RNPMVDGDV

SEQ ID NO: 183585 - protein, 9 aa, Tick-borne encephalitis virus
NPMVDGDVI

SEQ ID NO: 183586 - protein, 9 aa, Tick-borne encephalitis virus
PMVDGDVIN

SEQ ID NO: 183587 - protein, 9 aa, Tick-borne encephalitis virus
MVDGDVINP

SEQ ID NO: 183588 - protein, 9 aa, Tick-borne encephalitis virus
VDGDVINPF

SEQ ID NO: 183589 - protein, 9 aa, Tick-borne encephalitis virus
DGDVINPFG

SEQ ID NO: 183590 - protein, 9 aa, Tick-borne encephalitis virus
GDVINPFGE

SEQ ID NO: 183591 - protein, 9 aa, Tick-borne encephalitis virus
DVINPFGEG

SEQ ID NO: 183592 - protein, 9 aa, Tick-borne encephalitis virus
VINPFGEGE

SEQ ID NO: 183593 - protein, 9 aa, Tick-borne encephalitis virus
INPFGEGEA

SEQ ID NO: 183594 - protein, 9 aa, Tick-borne encephalitis virus
NPFGEGEAK

SEQ ID NO: 183595 - protein, 9 aa, Tick-borne encephalitis virus
PFGEGEAKP

SEQ ID NO: 183596 - protein, 9 aa, Tick-borne encephalitis virus
FGEGEAKPA

SEQ ID NO: 183597 - protein, 9 aa, Tick-borne encephalitis virus
GEGEAKPAL

SEQ ID NO: 183598 - protein, 9 aa, Tick-borne encephalitis virus
EGEAKPALY

SEQ ID NO: 183599 - protein, 9 aa, Tick-borne encephalitis virus
GEAKPALYE

SEQ ID NO: 183600 - protein, 9 aa, Tick-borne encephalitis virus
EAKPALYER

SEQ ID NO: 183601 - protein, 9 aa, Tick-borne encephalitis virus
AKPALYERK

SEQ ID NO: 183602 - protein, 9 aa, Tick-borne encephalitis virus
KPALYERKM

SEQ ID NO: 183603 - protein, 9 aa, Tick-borne encephalitis virus
PALYERKMS

SEQ ID NO: 183604 - protein, 9 aa, Tick-borne encephalitis virus
ALYERKMSL

SEQ ID NO: 183605 - protein, 9 aa, Tick-borne encephalitis virus
LYERKMSLV

SEQ ID NO: 183606 - protein, 9 aa, Tick-borne encephalitis virus
YERKMSLVL

SEQ ID NO: 183607 - protein, 9 aa, Tick-borne encephalitis virus
ERKMSLVLA

SEQ ID NO: 183608 - protein, 9 aa, Tick-borne encephalitis virus
RKMSLVLAI

SEQ ID NO: 183609 - protein, 9 aa, Tick-borne encephalitis virus
MSLVLAIVL

SEQ ID NO: 183610 - protein, 9 aa, Tick-borne encephalitis virus
SLVLAIVLC

SEQ ID NO: 183611 - protein, 9 aa, Tick-borne encephalitis virus
LVLAIVLCL

SEQ ID NO: 183612 - protein, 9 aa, Tick-borne encephalitis virus
VLCLMSVVM

SEQ ID NO: 183613 - protein, 9 aa, Tick-borne encephalitis virus
LCLMSVVMN

SEQ ID NO: 183614 - protein, 9 aa, Tick-borne encephalitis virus
CLMSVVMNR

SEQ ID NO: 183615 - protein, 9 aa, Tick-borne encephalitis virus
LMSVVMNRT

SEQ ID NO: 183616 - protein, 9 aa, Tick-borne encephalitis virus
MSVVMNRTV

SEQ ID NO: 183617 - protein, 9 aa, Tick-borne encephalitis virus
SVVMNRTVP

SEQ ID NO: 183618 - protein, 9 aa, Tick-borne encephalitis virus
VVMNRTVPS

SEQ ID NO: 183619 - protein, 9 aa, Tick-borne encephalitis virus
VMNRTVPSI

SEQ ID NO: 183620 - protein, 9 aa, Tick-borne encephalitis virus
MNRTVPSIT

SEQ ID NO: 183621 - protein, 9 aa, Tick-borne encephalitis virus
NRTVPSITE

SEQ ID NO: 183622 - protein, 9 aa, Tick-borne encephalitis virus
RTVPSITEA

SEQ ID NO: 183623 - protein, 9 aa, Tick-borne encephalitis virus
TVPSITEAS

SEQ ID NO: 183624 - protein, 9 aa, Tick-borne encephalitis virus
VPSITEASA

SEQ ID NO: 183625 - protein, 9 aa, Tick-borne encephalitis virus
PSITEASAV

SEQ ID NO: 183626 - protein, 9 aa, Tick-borne encephalitis virus
SITEASAVG

SEQ ID NO: 183627 - protein, 9 aa, Tick-borne encephalitis virus
ITEASAVGL

SEQ ID NO: 183628 - protein, 9 aa, Tick-borne encephalitis virus
TEASAVGLA

SEQ ID NO: 183629 - protein, 9 aa, Tick-borne encephalitis virus
EASAVGLAA

SEQ ID NO: 183630 - protein, 9 aa, Tick-borne encephalitis virus
ASAVGLAAA

SEQ ID NO: 183631 - protein, 9 aa, Tick-borne encephalitis virus
SAVGLAAAG

SEQ ID NO: 183632 - protein, 9 aa, Tick-borne encephalitis virus
AVGLAAAGQ

SEQ ID NO: 183633 - protein, 9 aa, Tick-borne encephalitis virus
VGLAAAGQL

SEQ ID NO: 183634 - protein, 9 aa, Tick-borne encephalitis virus
GLAAAGQLL

SEQ ID NO: 183635 - protein, 9 aa, Tick-borne encephalitis virus
LAAAGQLLR

SEQ ID NO: 183636 - protein, 9 aa, Tick-borne encephalitis virus
AAAGQLLRP

SEQ ID NO: 183637 - protein, 9 aa, Tick-borne encephalitis virus
AAGQLLRPE

SEQ ID NO: 183638 - protein, 9 aa, Tick-borne encephalitis virus
GQLLRPEAD

SEQ ID NO: 183639 - protein, 9 aa, Tick-borne encephalitis virus
QLLRPEADT

SEQ ID NO: 183640 - protein, 9 aa, Tick-borne encephalitis virus
LLRPEADTL

SEQ ID NO: 183641 - protein, 9 aa, Tick-borne encephalitis virus
LRPEADTLW

SEQ ID NO: 183642 - protein, 9 aa, Tick-borne encephalitis virus
RPEADTLWT

SEQ ID NO: 183643 - protein, 9 aa, Tick-borne encephalitis virus
PEADTLWTM

SEQ ID NO: 183644 - protein, 9 aa, Tick-borne encephalitis virus
EADTLWTMP

SEQ ID NO: 183645 - protein, 9 aa, Tick-borne encephalitis virus
ADTLWTMPV

SEQ ID NO: 183646 - protein, 9 aa, Tick-borne encephalitis virus
DTLWTMPVA

SEQ ID NO: 183647 - protein, 9 aa, Tick-borne encephalitis virus
TLWTMPVAC

SEQ ID NO: 183648 - protein, 9 aa, Tick-borne encephalitis virus
LWTMPVACG

SEQ ID NO: 183649 - protein, 9 aa, Tick-borne encephalitis virus
WTMPVACGL

SEQ ID NO: 183650 - protein, 9 aa, Tick-borne encephalitis virus
TMPVACGLS

SEQ ID NO: 183651 - protein, 9 aa, Tick-borne encephalitis virus
MPVACGLSG

SEQ ID NO: 183652 - protein, 9 aa, Tick-borne encephalitis virus
PVACGLSGV

SEQ ID NO: 183653 - protein, 9 aa, Tick-borne encephalitis virus
VACGLSGVV

SEQ ID NO: 183654 - protein, 9 aa, Tick-borne encephalitis virus
ACGLSGVVR

SEQ ID NO: 183655 - protein, 9 aa, Tick-borne encephalitis virus
CGLSGVVRG

SEQ ID NO: 183656 - protein, 9 aa, Tick-borne encephalitis virus
GLSGVVRGS

SEQ ID NO: 183657 - protein, 9 aa, Tick-borne encephalitis virus
LSGVVRGSL

SEQ ID NO: 183658 - protein, 9 aa, Tick-borne encephalitis virus
SGVVRGSLW

SEQ ID NO: 183659 - protein, 9 aa, Tick-borne encephalitis virus
GVVRGSLWG

SEQ ID NO: 183660 - protein, 9 aa, Tick-borne encephalitis virus
VVRGSLWGF

SEQ ID NO: 183661 - protein, 9 aa, Tick-borne encephalitis virus
VRGSLWGFL

SEQ ID NO: 183662 - protein, 9 aa, Tick-borne encephalitis virus
RGSLWGFLP

SEQ ID NO: 183663 - protein, 9 aa, Tick-borne encephalitis virus
GSLWGFLPL

SEQ ID NO: 183664 - protein, 9 aa, Tick-borne encephalitis virus
SLWGFLPLG

SEQ ID NO: 183665 - protein, 9 aa, Tick-borne encephalitis virus
LWGFLPLGH

SEQ ID NO: 183666 - protein, 9 aa, Tick-borne encephalitis virus
WGFLPLGHR

SEQ ID NO: 183667 - protein, 9 aa, Tick-borne encephalitis virus
GFLPLGHRL

SEQ ID NO: 183668 - protein, 9 aa, Tick-borne encephalitis virus
FLPLGHRLW

SEQ ID NO: 183669 - protein, 9 aa, Tick-borne encephalitis virus
LPLGHRLWL

SEQ ID NO: 183670 - protein, 9 aa, Tick-borne encephalitis virus
PLGHRLWLR

SEQ ID NO: 183671 - protein, 9 aa, Tick-borne encephalitis virus
LGHRLWLRA

SEQ ID NO: 183672 - protein, 9 aa, Tick-borne encephalitis virus
GHRLWLRAS

SEQ ID NO: 183673 - protein, 9 aa, Tick-borne encephalitis virus
HRLWLRASG

SEQ ID NO: 183674 - protein, 9 aa, Tick-borne encephalitis virus
RLWLRASGS

SEQ ID NO: 183675 - protein, 9 aa, Tick-borne encephalitis virus
LWLRASGSR

SEQ ID NO: 183676 - protein, 9 aa, Tick-borne encephalitis virus
WLRASGSRR

SEQ ID NO: 183677 - protein, 9 aa, Tick-borne encephalitis virus
LRASGSRRG

SEQ ID NO: 183678 - protein, 9 aa, Tick-borne encephalitis virus
RASGSRRGG

SEQ ID NO: 183679 - protein, 9 aa, Tick-borne encephalitis virus
ASGSRRGGS

SEQ ID NO: 183680 - protein, 9 aa, Tick-borne encephalitis virus
SGSRRGGSE

SEQ ID NO: 183681 - protein, 9 aa, Tick-borne encephalitis virus
GSRRGGSEG

SEQ ID NO: 183682 - protein, 9 aa, Tick-borne encephalitis virus
SRRGGSEGD

SEQ ID NO: 183683 - protein, 9 aa, Tick-borne encephalitis virus
RRGGSEGDT

SEQ ID NO: 183684 - protein, 9 aa, Tick-borne encephalitis virus
RGGSEGDTL

SEQ ID NO: 183685 - protein, 9 aa, Tick-borne encephalitis virus
GGSEGDTLG

SEQ ID NO: 183686 - protein, 9 aa, Tick-borne encephalitis virus
GSEGDTLGD

SEQ ID NO: 183687 - protein, 9 aa, Tick-borne encephalitis virus
SEGDTLGDL

SEQ ID NO: 183688 - protein, 9 aa, Tick-borne encephalitis virus
EGDTLGDLW

SEQ ID NO: 183689 - protein, 9 aa, Tick-borne encephalitis virus
GDTLGDLWK

SEQ ID NO: 183690 - protein, 9 aa, Tick-borne encephalitis virus
DTLGDLWKR

SEQ ID NO: 183691 - protein, 9 aa, Tick-borne encephalitis virus
TLGDLWKRK

SEQ ID NO: 183692 - protein, 9 aa, Tick-borne encephalitis virus
LGDLWKRKL

SEQ ID NO: 183693 - protein, 9 aa, Tick-borne encephalitis virus
GDLWKRKLN

SEQ ID NO: 183694 - protein, 9 aa, Tick-borne encephalitis virus
LNGCTKEEF

SEQ ID NO: 183695 - protein, 9 aa, Tick-borne encephalitis virus
NGCTKEEFF

SEQ ID NO: 183696 - protein, 9 aa, Tick-borne encephalitis virus
GCTKEEFFA

SEQ ID NO: 183697 - protein, 9 aa, Tick-borne encephalitis virus
CTKEEFFAY

SEQ ID NO: 183698 - protein, 9 aa, Tick-borne encephalitis virus
TKEEFFAYR

SEQ ID NO: 183699 - protein, 9 aa, Tick-borne encephalitis virus
KEEFFAYRR

SEQ ID NO: 183700 - protein, 9 aa, Tick-borne encephalitis virus
EEFFAYRRT

SEQ ID NO: 183701 - protein, 9 aa, Tick-borne encephalitis virus
EFFAYRRTG

SEQ ID NO: 183702 - protein, 9 aa, Tick-borne encephalitis virus
FFAYRRTGI

SEQ ID NO: 183703 - protein, 9 aa, Tick-borne encephalitis virus
FAYRRTGIL

SEQ ID NO: 183704 - protein, 9 aa, Tick-borne encephalitis virus
AYRRTGILE

SEQ ID NO: 183705 - protein, 9 aa, Tick-borne encephalitis virus
YRRTGILET

SEQ ID NO: 183706 - protein, 9 aa, Tick-borne encephalitis virus
RRTGILETE

SEQ ID NO: 183707 - protein, 9 aa, Tick-borne encephalitis virus
RTGILETER

SEQ ID NO: 183708 - protein, 9 aa, Tick-borne encephalitis virus
TGILETERD

SEQ ID NO: 183709 - protein, 9 aa, Tick-borne encephalitis virus
GILETERDK

SEQ ID NO: 183710 - protein, 9 aa, Tick-borne encephalitis virus
ILETERDKA

SEQ ID NO: 183711 - protein, 9 aa, Tick-borne encephalitis virus
LETERDKAR

SEQ ID NO: 183712 - protein, 9 aa, Tick-borne encephalitis virus
ETERDKARE

SEQ ID NO: 183713 - protein, 9 aa, Tick-borne encephalitis virus
TERDKAREL

SEQ ID NO: 183714 - protein, 9 aa, Tick-borne encephalitis virus
ERDKARELL

SEQ ID NO: 183715 - protein, 9 aa, Tick-borne encephalitis virus
RDKARELLR

SEQ ID NO: 183716 - protein, 9 aa, Tick-borne encephalitis virus
DKARELLRR

SEQ ID NO: 183717 - protein, 9 aa, Tick-borne encephalitis virus
KARELLRRG

SEQ ID NO: 183718 - protein, 9 aa, Tick-borne encephalitis virus
ARELLRRGE

SEQ ID NO: 183719 - protein, 9 aa, Tick-borne encephalitis virus
RELLRRGET

SEQ ID NO: 183720 - protein, 9 aa, Tick-borne encephalitis virus
ELLRRGETN

SEQ ID NO: 183721 - protein, 9 aa, Tick-borne encephalitis virus
RGETNMGLA

SEQ ID NO: 183722 - protein, 9 aa, Tick-borne encephalitis virus
GETNMGLAV

SEQ ID NO: 183723 - protein, 9 aa, Tick-borne encephalitis virus
ETNMGLAVS

SEQ ID NO: 183724 - protein, 9 aa, Tick-borne encephalitis virus
TNMGLAVSR

SEQ ID NO: 183725 - protein, 9 aa, Tick-borne encephalitis virus
NMGLAVSRG

SEQ ID NO: 183726 - protein, 9 aa, Tick-borne encephalitis virus
MGLAVSRGT

SEQ ID NO: 183727 - protein, 9 aa, Tick-borne encephalitis virus
GLAVSRGTA

SEQ ID NO: 183728 - protein, 9 aa, Tick-borne encephalitis virus
LAVSRGTAK

SEQ ID NO: 183729 - protein, 9 aa, Tick-borne encephalitis virus
AVSRGTAKL

SEQ ID NO: 183730 - protein, 9 aa, Tick-borne encephalitis virus
VSRGTAKLA

SEQ ID NO: 183731 - protein, 9 aa, Tick-borne encephalitis virus
SRGTAKLAW

SEQ ID NO: 183732 - protein, 9 aa, Tick-borne encephalitis virus
RGTAKLAWL

SEQ ID NO: 183733 - protein, 9 aa, Tick-borne encephalitis virus
GTAKLAWLE

SEQ ID NO: 183734 - protein, 9 aa, Tick-borne encephalitis virus
TAKLAWLEE

SEQ ID NO: 183735 - protein, 9 aa, Tick-borne encephalitis virus
AKLAWLEER

SEQ ID NO: 183736 - protein, 9 aa, Tick-borne encephalitis virus
KLAWLEERG

SEQ ID NO: 183737 - protein, 9 aa, Tick-borne encephalitis virus
LAWLEERGY

SEQ ID NO: 183738 - protein, 9 aa, Tick-borne encephalitis virus
AWLEERGYA

SEQ ID NO: 183739 - protein, 9 aa, Tick-borne encephalitis virus
WLEERGYAT

SEQ ID NO: 183740 - protein, 9 aa, Tick-borne encephalitis virus
LEERGYATL

SEQ ID NO: 183741 - protein, 9 aa, Tick-borne encephalitis virus
EERGYATLK

SEQ ID NO: 183742 - protein, 9 aa, Tick-borne encephalitis virus
ERGYATLKG

SEQ ID NO: 183743 - protein, 9 aa, Tick-borne encephalitis virus
RGYATLKGE

SEQ ID NO: 183744 - protein, 9 aa, Tick-borne encephalitis virus
GYATLKGEV

SEQ ID NO: 183745 - protein, 9 aa, Tick-borne encephalitis virus
YATLKGEVV

SEQ ID NO: 183746 - protein, 9 aa, Tick-borne encephalitis virus
ATLKGEVVD

SEQ ID NO: 183747 - protein, 9 aa, Tick-borne encephalitis virus
TLKGEVVDL

SEQ ID NO: 183748 - protein, 9 aa, Tick-borne encephalitis virus
LKGEVVDLG

SEQ ID NO: 183749 - protein, 9 aa, Tick-borne encephalitis virus
KGEVVDLGC

SEQ ID NO: 183750 - protein, 9 aa, Tick-borne encephalitis virus
GEVVDLGCG

SEQ ID NO: 183751 - protein, 9 aa, Tick-borne encephalitis virus
EVVDLGCGR

SEQ ID NO: 183752 - protein, 9 aa, Tick-borne encephalitis virus
VVDLGCGRG

SEQ ID NO: 183753 - protein, 9 aa, Tick-borne encephalitis virus
VDLGCGRGG

SEQ ID NO: 183754 - protein, 9 aa, Tick-borne encephalitis virus
DLGCGRGGW

SEQ ID NO: 183755 - protein, 9 aa, Tick-borne encephalitis virus
LGCGRGGWS

SEQ ID NO: 183756 - protein, 9 aa, Tick-borne encephalitis virus
GCGRGGWSY

SEQ ID NO: 183757 - protein, 9 aa, Tick-borne encephalitis virus
CGRGGWSYY

SEQ ID NO: 183758 - protein, 9 aa, Tick-borne encephalitis virus
GRGGWSYYA

SEQ ID NO: 183759 - protein, 9 aa, Tick-borne encephalitis virus
RGGWSYYAA

SEQ ID NO: 183760 - protein, 9 aa, Tick-borne encephalitis virus
GGWSYYAAS

SEQ ID NO: 183761 - protein, 9 aa, Tick-borne encephalitis virus
GWSYYAASR

SEQ ID NO: 183762 - protein, 9 aa, Tick-borne encephalitis virus
WSYYAASRP

SEQ ID NO: 183763 - protein, 9 aa, Tick-borne encephalitis virus
SYYAASRPA

SEQ ID NO: 183764 - protein, 9 aa, Tick-borne encephalitis virus
YYAASRPAV

SEQ ID NO: 183765 - protein, 9 aa, Tick-borne encephalitis virus
YAASRPAVM

SEQ ID NO: 183766 - protein, 9 aa, Tick-borne encephalitis virus
AASRPAVMS

SEQ ID NO: 183767 - protein, 9 aa, Tick-borne encephalitis virus
ASRPAVMSV

SEQ ID NO: 183768 - protein, 9 aa, Tick-borne encephalitis virus
SRPAVMSVK

SEQ ID NO: 183769 - protein, 9 aa, Tick-borne encephalitis virus
RPAVMSVKA

SEQ ID NO: 183770 - protein, 9 aa, Tick-borne encephalitis virus
PAVMSVKAY

SEQ ID NO: 183771 - protein, 9 aa, Tick-borne encephalitis virus
AVMSVKAYT

SEQ ID NO: 183772 - protein, 9 aa, Tick-borne encephalitis virus
VMSVKAYTI

SEQ ID NO: 183773 - protein, 9 aa, Tick-borne encephalitis virus
MSVKAYTIG

SEQ ID NO: 183774 - protein, 9 aa, Tick-borne encephalitis virus
SVKAYTIGG

SEQ ID NO: 183775 - protein, 9 aa, Tick-borne encephalitis virus
VKAYTIGGK

SEQ ID NO: 183776 - protein, 9 aa, Tick-borne encephalitis virus
KAYTIGGKG

SEQ ID NO: 183777 - protein, 9 aa, Tick-borne encephalitis virus
AYTIGGKGH

SEQ ID NO: 183778 - protein, 9 aa, Tick-borne encephalitis virus
YTIGGKGHE

SEQ ID NO: 183779 - protein, 9 aa, Tick-borne encephalitis virus
TIGGKGHET

SEQ ID NO: 183780 - protein, 9 aa, Tick-borne encephalitis virus
IGGKGHETP

SEQ ID NO: 183781 - protein, 9 aa, Tick-borne encephalitis virus
GGKGHETPK

SEQ ID NO: 183782 - protein, 9 aa, Tick-borne encephalitis virus
GKGHETPKM

SEQ ID NO: 183783 - protein, 9 aa, Tick-borne encephalitis virus
KGHETPKMV

SEQ ID NO: 183784 - protein, 9 aa, Tick-borne encephalitis virus
GHETPKMVT

SEQ ID NO: 183785 - protein, 9 aa, Tick-borne encephalitis virus
HETPKMVTS

SEQ ID NO: 183786 - protein, 9 aa, Tick-borne encephalitis virus
ETPKMVTSL

SEQ ID NO: 183787 - protein, 9 aa, Tick-borne encephalitis virus
TPKMVTSLG

SEQ ID NO: 183788 - protein, 9 aa, Tick-borne encephalitis virus
PKMVTSLGW

SEQ ID NO: 183789 - protein, 9 aa, Tick-borne encephalitis virus
KMVTSLGWN

SEQ ID NO: 183790 - protein, 9 aa, Tick-borne encephalitis virus
MVTSLGWNL

SEQ ID NO: 183791 - protein, 9 aa, Tick-borne encephalitis virus
VTSLGWNLI

SEQ ID NO: 183792 - protein, 9 aa, Tick-borne encephalitis virus
TSLGWNLIK

SEQ ID NO: 183793 - protein, 9 aa, Tick-borne encephalitis virus
SLGWNLIKF

SEQ ID NO: 183794 - protein, 9 aa, Tick-borne encephalitis virus
LGWNLIKFR

SEQ ID NO: 183795 - protein, 9 aa, Tick-borne encephalitis virus
GWNLIKFRA

SEQ ID NO: 183796 - protein, 9 aa, Tick-borne encephalitis virus
WNLIKFRAG

SEQ ID NO: 183797 - protein, 9 aa, Tick-borne encephalitis virus
NLIKFRAGM

SEQ ID NO: 183798 - protein, 9 aa, Tick-borne encephalitis virus
LIKFRAGMD

SEQ ID NO: 183799 - protein, 9 aa, Tick-borne encephalitis virus
IKFRAGMDV

SEQ ID NO: 183800 - protein, 9 aa, Tick-borne encephalitis virus
KFRAGMDVF

SEQ ID NO: 183801 - protein, 9 aa, Tick-borne encephalitis virus
FRAGMDVFS

SEQ ID NO: 183802 - protein, 9 aa, Tick-borne encephalitis virus
RAGMDVFSM

SEQ ID NO: 183803 - protein, 9 aa, Tick-borne encephalitis virus
AGMDVFSMQ

SEQ ID NO: 183804 - protein, 9 aa, Tick-borne encephalitis virus
GMDVFSMQP

SEQ ID NO: 183805 - protein, 9 aa, Tick-borne encephalitis virus
MDVFSMQPH

SEQ ID NO: 183806 - protein, 9 aa, Tick-borne encephalitis virus
DVFSMQPHR

SEQ ID NO: 183807 - protein, 9 aa, Tick-borne encephalitis virus
VFSMQPHRA

SEQ ID NO: 183808 - protein, 9 aa, Tick-borne encephalitis virus
FSMQPHRAD

SEQ ID NO: 183809 - protein, 9 aa, Tick-borne encephalitis virus
SMQPHRADT

SEQ ID NO: 183810 - protein, 9 aa, Tick-borne encephalitis virus
MQPHRADTI

SEQ ID NO: 183811 - protein, 9 aa, Tick-borne encephalitis virus
QPHRADTIM

SEQ ID NO: 183812 - protein, 9 aa, Tick-borne encephalitis virus
PHRADTIMC

SEQ ID NO: 183813 - protein, 9 aa, Tick-borne encephalitis virus
HRADTIMCD

SEQ ID NO: 183814 - protein, 9 aa, Tick-borne encephalitis virus
RADTIMCDI

SEQ ID NO: 183815 - protein, 9 aa, Tick-borne encephalitis virus
ADTIMCDIG

SEQ ID NO: 183816 - protein, 9 aa, Tick-borne encephalitis virus
DTIMCDIGE

SEQ ID NO: 183817 - protein, 9 aa, Tick-borne encephalitis virus
TIMCDIGES

SEQ ID NO: 183818 - protein, 9 aa, Tick-borne encephalitis virus
IMCDIGESN

SEQ ID NO: 183819 - protein, 9 aa, Tick-borne encephalitis virus
MCDIGESNP

SEQ ID NO: 183820 - protein, 9 aa, Tick-borne encephalitis virus
CDIGESNPD

SEQ ID NO: 183821 - protein, 9 aa, Tick-borne encephalitis virus
DIGESNPDA

SEQ ID NO: 183822 - protein, 9 aa, Tick-borne encephalitis virus
IGESNPDAV

SEQ ID NO: 183823 - protein, 9 aa, Tick-borne encephalitis virus
GESNPDAVV

SEQ ID NO: 183824 - protein, 9 aa, Tick-borne encephalitis virus
ESNPDAVVE

SEQ ID NO: 183825 - protein, 9 aa, Tick-borne encephalitis virus
SNPDAVVEG

SEQ ID NO: 183826 - protein, 9 aa, Tick-borne encephalitis virus
NPDAVVEGE

SEQ ID NO: 183827 - protein, 9 aa, Tick-borne encephalitis virus
PDAVVEGER

SEQ ID NO: 183828 - protein, 9 aa, Tick-borne encephalitis virus
DAVVEGERT

SEQ ID NO: 183829 - protein, 9 aa, Tick-borne encephalitis virus
AVVEGERTR

SEQ ID NO: 183830 - protein, 9 aa, Tick-borne encephalitis virus
VVEGERTRK

SEQ ID NO: 183831 - protein, 9 aa, Tick-borne encephalitis virus
VEGERTRKV

SEQ ID NO: 183832 - protein, 9 aa, Tick-borne encephalitis virus
EGERTRKVI

SEQ ID NO: 183833 - protein, 9 aa, Tick-borne encephalitis virus
GERTRKVIL

SEQ ID NO: 183834 - protein, 9 aa, Tick-borne encephalitis virus
ERTRKVILL

SEQ ID NO: 183835 - protein, 9 aa, Tick-borne encephalitis virus
RTRKVILLM

SEQ ID NO: 183836 - protein, 9 aa, Tick-borne encephalitis virus
TRKVILLME

SEQ ID NO: 183837 - protein, 9 aa, Tick-borne encephalitis virus
RKVILLMEQ

SEQ ID NO: 183838 - protein, 9 aa, Tick-borne encephalitis virus
KVILLMEQW

SEQ ID NO: 183839 - protein, 9 aa, Tick-borne encephalitis virus
VILLMEQWK

SEQ ID NO: 183840 - protein, 9 aa, Tick-borne encephalitis virus
ILLMEQWKN

SEQ ID NO: 183841 - protein, 9 aa, Tick-borne encephalitis virus
LLMEQWKNR

SEQ ID NO: 183842 - protein, 9 aa, Tick-borne encephalitis virus
LMEQWKNRN

SEQ ID NO: 183843 - protein, 9 aa, Tick-borne encephalitis virus
MEQWKNRNP

SEQ ID NO: 183844 - protein, 9 aa, Tick-borne encephalitis virus
EQWKNRNPT

SEQ ID NO: 183845 - protein, 9 aa, Tick-borne encephalitis virus
QWKNRNPTA

SEQ ID NO: 183846 - protein, 9 aa, Tick-borne encephalitis virus
WKNRNPTAT

SEQ ID NO: 183847 - protein, 9 aa, Tick-borne encephalitis virus
KNRNPTATC

SEQ ID NO: 183848 - protein, 9 aa, Tick-borne encephalitis virus
NRNPTATCV

SEQ ID NO: 183849 - protein, 9 aa, Tick-borne encephalitis virus
RNPTATCVF

SEQ ID NO: 183850 - protein, 9 aa, Tick-borne encephalitis virus
NPTATCVFK

SEQ ID NO: 183851 - protein, 9 aa, Tick-borne encephalitis virus
PTATCVFKV

SEQ ID NO: 183852 - protein, 9 aa, Tick-borne encephalitis virus
TATCVFKVL

SEQ ID NO: 183853 - protein, 9 aa, Tick-borne encephalitis virus
ATCVFKVLA

SEQ ID NO: 183854 - protein, 9 aa, Tick-borne encephalitis virus
TCVFKVLAP

SEQ ID NO: 183855 - protein, 9 aa, Tick-borne encephalitis virus
CVFKVLAPY

SEQ ID NO: 183856 - protein, 9 aa, Tick-borne encephalitis virus
VFKVLAPYR

SEQ ID NO: 183857 - protein, 9 aa, Tick-borne encephalitis virus
FKVLAPYRP

SEQ ID NO: 183858 - protein, 9 aa, Tick-borne encephalitis virus
KVLAPYRPE

SEQ ID NO: 183859 - protein, 9 aa, Tick-borne encephalitis virus
VLAPYRPEV

SEQ ID NO: 183860 - protein, 9 aa, Tick-borne encephalitis virus
LAPYRPEVI

SEQ ID NO: 183861 - protein, 9 aa, Tick-borne encephalitis virus
APYRPEVIE

SEQ ID NO: 183862 - protein, 9 aa, Tick-borne encephalitis virus
PYRPEVIEA

SEQ ID NO: 183863 - protein, 9 aa, Tick-borne encephalitis virus
YRPEVIEAL

SEQ ID NO: 183864 - protein, 9 aa, Tick-borne encephalitis virus
RPEVIEALH

SEQ ID NO: 183865 - protein, 9 aa, Tick-borne encephalitis virus
PEVIEALHR

SEQ ID NO: 183866 - protein, 9 aa, Tick-borne encephalitis virus
EVIEALHRF

SEQ ID NO: 183867 - protein, 9 aa, Tick-borne encephalitis virus
VIEALHRFQ

SEQ ID NO: 183868 - protein, 9 aa, Tick-borne encephalitis virus
IEALHRFQL

SEQ ID NO: 183869 - protein, 9 aa, Tick-borne encephalitis virus
EALHRFQLQ

SEQ ID NO: 183870 - protein, 9 aa, Tick-borne encephalitis virus
ALHRFQLQW

SEQ ID NO: 183871 - protein, 9 aa, Tick-borne encephalitis virus
LHRFQLQWG

SEQ ID NO: 183872 - protein, 9 aa, Tick-borne encephalitis virus
HRFQLQWGG

SEQ ID NO: 183873 - protein, 9 aa, Tick-borne encephalitis virus
RFQLQWGGG

SEQ ID NO: 183874 - protein, 9 aa, Tick-borne encephalitis virus
FQLQWGGGL

SEQ ID NO: 183875 - protein, 9 aa, Tick-borne encephalitis virus
QLQWGGGLV

SEQ ID NO: 183876 - protein, 9 aa, Tick-borne encephalitis virus
LQWGGGLVR

SEQ ID NO: 183877 - protein, 9 aa, Tick-borne encephalitis virus
QWGGGLVRT

SEQ ID NO: 183878 - protein, 9 aa, Tick-borne encephalitis virus
WGGGLVRTP

SEQ ID NO: 183879 - protein, 9 aa, Tick-borne encephalitis virus
GGGLVRTPF

SEQ ID NO: 183880 - protein, 9 aa, Tick-borne encephalitis virus
GGLVRTPFS

SEQ ID NO: 183881 - protein, 9 aa, Tick-borne encephalitis virus
GLVRTPFSR

SEQ ID NO: 183882 - protein, 9 aa, Tick-borne encephalitis virus
LVRTPFSRN

SEQ ID NO: 183883 - protein, 9 aa, Tick-borne encephalitis virus
VRTPFSRNS

SEQ ID NO: 183884 - protein, 9 aa, Tick-borne encephalitis virus
RTPFSRNST

SEQ ID NO: 183885 - protein, 9 aa, Tick-borne encephalitis virus
TPFSRNSTH

SEQ ID NO: 183886 - protein, 9 aa, Tick-borne encephalitis virus
PFSRNSTHE

SEQ ID NO: 183887 - protein, 9 aa, Tick-borne encephalitis virus
FSRNSTHEM

SEQ ID NO: 183888 - protein, 9 aa, Tick-borne encephalitis virus
SRNSTHEMY

SEQ ID NO: 183889 - protein, 9 aa, Tick-borne encephalitis virus
RNSTHEMYY

SEQ ID NO: 183890 - protein, 9 aa, Tick-borne encephalitis virus
NSTHEMYYS

SEQ ID NO: 183891 - protein, 9 aa, Tick-borne encephalitis virus
STHEMYYST

SEQ ID NO: 183892 - protein, 9 aa, Tick-borne encephalitis virus
THEMYYSTA

SEQ ID NO: 183893 - protein, 9 aa, Tick-borne encephalitis virus
HEMYYSTAV

SEQ ID NO: 183894 - protein, 9 aa, Tick-borne encephalitis virus
EMYYSTAVT

SEQ ID NO: 183895 - protein, 9 aa, Tick-borne encephalitis virus
MYYSTAVTG

SEQ ID NO: 183896 - protein, 9 aa, Tick-borne encephalitis virus
YYSTAVTGN

SEQ ID NO: 183897 - protein, 9 aa, Tick-borne encephalitis virus
YSTAVTGNI

SEQ ID NO: 183898 - protein, 9 aa, Tick-borne encephalitis virus
STAVTGNIV

SEQ ID NO: 183899 - protein, 9 aa, Tick-borne encephalitis virus
TAVTGNIVN

SEQ ID NO: 183900 - protein, 9 aa, Tick-borne encephalitis virus
AVTGNIVNS

SEQ ID NO: 183901 - protein, 9 aa, Tick-borne encephalitis virus
VTGNIVNSV

SEQ ID NO: 183902 - protein, 9 aa, Tick-borne encephalitis virus
TGNIVNSVN

SEQ ID NO: 183903 - protein, 9 aa, Tick-borne encephalitis virus
GNIVNSVNI

SEQ ID NO: 183904 - protein, 9 aa, Tick-borne encephalitis virus
NIVNSVNIQ

SEQ ID NO: 183905 - protein, 9 aa, Tick-borne encephalitis virus
IVNSVNIQS

SEQ ID NO: 183906 - protein, 9 aa, Tick-borne encephalitis virus
VNSVNIQSR

SEQ ID NO: 183907 - protein, 9 aa, Tick-borne encephalitis virus
NSVNIQSRK

SEQ ID NO: 183908 - protein, 9 aa, Tick-borne encephalitis virus
SVNIQSRKL

SEQ ID NO: 183909 - protein, 9 aa, Tick-borne encephalitis virus
VNIQSRKLL

SEQ ID NO: 183910 - protein, 9 aa, Tick-borne encephalitis virus
NIQSRKLLA

SEQ ID NO: 183911 - protein, 9 aa, Tick-borne encephalitis virus
IQSRKLLAR

SEQ ID NO: 183912 - protein, 9 aa, Tick-borne encephalitis virus
QSRKLLARF

SEQ ID NO: 183913 - protein, 9 aa, Tick-borne encephalitis virus
SRKLLARFG

SEQ ID NO: 183914 - protein, 9 aa, Tick-borne encephalitis virus
RKLLARFGD

SEQ ID NO: 183915 - protein, 9 aa, Tick-borne encephalitis virus
KLLARFGDQ

SEQ ID NO: 183916 - protein, 9 aa, Tick-borne encephalitis virus
LLARFGDQR

SEQ ID NO: 183917 - protein, 9 aa, Tick-borne encephalitis virus
LARFGDQRG

SEQ ID NO: 183918 - protein, 9 aa, Tick-borne encephalitis virus
ARFGDQRGP

SEQ ID NO: 183919 - protein, 9 aa, Tick-borne encephalitis virus
RFGDQRGPT

SEQ ID NO: 183920 - protein, 9 aa, Tick-borne encephalitis virus
FGDQRGPTR

SEQ ID NO: 183921 - protein, 9 aa, Tick-borne encephalitis virus
GDQRGPTRV

SEQ ID NO: 183922 - protein, 9 aa, Tick-borne encephalitis virus
DQRGPTRVP

SEQ ID NO: 183923 - protein, 9 aa, Tick-borne encephalitis virus
QRGPTRVPE

SEQ ID NO: 183924 - protein, 9 aa, Tick-borne encephalitis virus
RGPTRVPEL

SEQ ID NO: 183925 - protein, 9 aa, Tick-borne encephalitis virus
GPTRVPELD

SEQ ID NO: 183926 - protein, 9 aa, Tick-borne encephalitis virus
PTRVPELDL

SEQ ID NO: 183927 - protein, 9 aa, Tick-borne encephalitis virus
TRVPELDLG

SEQ ID NO: 183928 - protein, 9 aa, Tick-borne encephalitis virus
RVPELDLGV

SEQ ID NO: 183929 - protein, 9 aa, Tick-borne encephalitis virus
VPELDLGVG

SEQ ID NO: 183930 - protein, 9 aa, Tick-borne encephalitis virus
PELDLGVGT

SEQ ID NO: 183931 - protein, 9 aa, Tick-borne encephalitis virus
ELDLGVGTR

SEQ ID NO: 183932 - protein, 9 aa, Tick-borne encephalitis virus
LDLGVGTRC

SEQ ID NO: 183933 - protein, 9 aa, Tick-borne encephalitis virus
DLGVGTRCV

SEQ ID NO: 183934 - protein, 9 aa, Tick-borne encephalitis virus
LGVGTRCVV

SEQ ID NO: 183935 - protein, 9 aa, Tick-borne encephalitis virus
GVGTRCVVL

SEQ ID NO: 183936 - protein, 9 aa, Tick-borne encephalitis virus
VGTRCVVLA

SEQ ID NO: 183937 - protein, 9 aa, Tick-borne encephalitis virus
GTRCVVLAE

SEQ ID NO: 183938 - protein, 9 aa, Tick-borne encephalitis virus
TRCVVLAED

SEQ ID NO: 183939 - protein, 9 aa, Tick-borne encephalitis virus
RCVVLAEDK

SEQ ID NO: 183940 - protein, 9 aa, Tick-borne encephalitis virus
CVVLAEDKV

SEQ ID NO: 183941 - protein, 9 aa, Tick-borne encephalitis virus
VVLAEDKVK

SEQ ID NO: 183942 - protein, 9 aa, Tick-borne encephalitis virus
VLAEDKVKE

SEQ ID NO: 183943 - protein, 9 aa, Tick-borne encephalitis virus
LAEDKVKEK

SEQ ID NO: 183944 - protein, 9 aa, Tick-borne encephalitis virus
AEDKVKEKD

SEQ ID NO: 183945 - protein, 9 aa, Tick-borne encephalitis virus
EDKVKEKDV

SEQ ID NO: 183946 - protein, 9 aa, Tick-borne encephalitis virus
DKVKEKDVQ

SEQ ID NO: 183947 - protein, 9 aa, Tick-borne encephalitis virus
KVKEKDVQE

SEQ ID NO: 183948 - protein, 9 aa, Tick-borne encephalitis virus
VKEKDVQER

SEQ ID NO: 183949 - protein, 9 aa, Tick-borne encephalitis virus
KEKDVQERI

SEQ ID NO: 183950 - protein, 9 aa, Tick-borne encephalitis virus
DVQERISAL

SEQ ID NO: 183951 - protein, 9 aa, Tick-borne encephalitis virus
ERISALREQ

SEQ ID NO: 183952 - protein, 9 aa, Tick-borne encephalitis virus
RISALREQY

SEQ ID NO: 183953 - protein, 9 aa, Tick-borne encephalitis virus
ALREQYGET

SEQ ID NO: 183954 - protein, 9 aa, Tick-borne encephalitis virus
LREQYGETW

SEQ ID NO: 183955 - protein, 9 aa, Tick-borne encephalitis virus
REQYGETWH

SEQ ID NO: 183956 - protein, 9 aa, Tick-borne encephalitis virus
DREHPYRTW

SEQ ID NO: 183957 - protein, 9 aa, Tick-borne encephalitis virus
REHPYRTWQ

SEQ ID NO: 183958 - protein, 9 aa, Tick-borne encephalitis virus
EHPYRTWQY

SEQ ID NO: 183959 - protein, 9 aa, Tick-borne encephalitis virus
HPYRTWQYW

SEQ ID NO: 183960 - protein, 9 aa, Tick-borne encephalitis virus
PYRTWQYWG

SEQ ID NO: 183961 - protein, 9 aa, Tick-borne encephalitis virus
YRTWQYWGS

SEQ ID NO: 183962 - protein, 9 aa, Tick-borne encephalitis virus
RTWQYWGSY

SEQ ID NO: 183963 - protein, 9 aa, Tick-borne encephalitis virus
TWQYWGSYR

SEQ ID NO: 183964 - protein, 9 aa, Tick-borne encephalitis virus
WQYWGSYRT

SEQ ID NO: 183965 - protein, 9 aa, Tick-borne encephalitis virus
QYWGSYRTA

SEQ ID NO: 183966 - protein, 9 aa, Tick-borne encephalitis virus
YWGSYRTAP

SEQ ID NO: 183967 - protein, 9 aa, Tick-borne encephalitis virus
WGSYRTAPT

SEQ ID NO: 183968 - protein, 9 aa, Tick-borne encephalitis virus
GSYRTAPTG

SEQ ID NO: 183969 - protein, 9 aa, Tick-borne encephalitis virus
SYRTAPTGS

SEQ ID NO: 183970 - protein, 9 aa, Tick-borne encephalitis virus
YRTAPTGSA

SEQ ID NO: 183971 - protein, 9 aa, Tick-borne encephalitis virus
RTAPTGSAA

SEQ ID NO: 183972 - protein, 9 aa, Tick-borne encephalitis virus
TAPTGSAAS

SEQ ID NO: 183973 - protein, 9 aa, Tick-borne encephalitis virus
APTGSAASL

SEQ ID NO: 183974 - protein, 9 aa, Tick-borne encephalitis virus
PTGSAASLI

SEQ ID NO: 183975 - protein, 9 aa, Tick-borne encephalitis virus
TGSAASLIN

SEQ ID NO: 183976 - protein, 9 aa, Tick-borne encephalitis virus
GSAASLING

SEQ ID NO: 183977 - protein, 9 aa, Tick-borne encephalitis virus
SAASLINGV

SEQ ID NO: 183978 - protein, 9 aa, Tick-borne encephalitis virus
AASLINGVV

SEQ ID NO: 183979 - protein, 9 aa, Tick-borne encephalitis virus
ASLINGVVK

SEQ ID NO: 183980 - protein, 9 aa, Tick-borne encephalitis virus
SLINGVVKL

SEQ ID NO: 183981 - protein, 9 aa, Tick-borne encephalitis virus
LINGVVKLL

SEQ ID NO: 183982 - protein, 9 aa, Tick-borne encephalitis virus
INGVVKLLS

SEQ ID NO: 183983 - protein, 9 aa, Tick-borne encephalitis virus
NGVVKLLSW

SEQ ID NO: 183984 - protein, 9 aa, Tick-borne encephalitis virus
GVVKLLSWP

SEQ ID NO: 183985 - protein, 9 aa, Tick-borne encephalitis virus
VVKLLSWPW

SEQ ID NO: 183986 - protein, 9 aa, Tick-borne encephalitis virus
VKLLSWPWN

SEQ ID NO: 183987 - protein, 9 aa, Tick-borne encephalitis virus
KLLSWPWNA

SEQ ID NO: 183988 - protein, 9 aa, Tick-borne encephalitis virus
LLSWPWNAR

SEQ ID NO: 183989 - protein, 9 aa, Tick-borne encephalitis virus
LSWPWNARE

SEQ ID NO: 183990 - protein, 9 aa, Tick-borne encephalitis virus
SWPWNARED

SEQ ID NO: 183991 - protein, 9 aa, Tick-borne encephalitis virus
WPWNAREDV

SEQ ID NO: 183992 - protein, 9 aa, Tick-borne encephalitis virus
PWNAREDVV

SEQ ID NO: 183993 - protein, 9 aa, Tick-borne encephalitis virus
WNAREDVVR

SEQ ID NO: 183994 - protein, 9 aa, Tick-borne encephalitis virus
NAREDVVRM

SEQ ID NO: 183995 - protein, 9 aa, Tick-borne encephalitis virus
AREDVVRMA

SEQ ID NO: 183996 - protein, 9 aa, Tick-borne encephalitis virus
REDVVRMAM

SEQ ID NO: 183997 - protein, 9 aa, Tick-borne encephalitis virus
EDVVRMAMT

SEQ ID NO: 183998 - protein, 9 aa, Tick-borne encephalitis virus
DVVRMAMTD

SEQ ID NO: 183999 - protein, 9 aa, Tick-borne encephalitis virus
VVRMAMTDT

SEQ ID NO: 184000 - protein, 9 aa, Tick-borne encephalitis virus
VRMAMTDTT

SEQ ID NO: 184001 - protein, 9 aa, Tick-borne encephalitis virus
RMAMTDTTA

SEQ ID NO: 184002 - protein, 9 aa, Tick-borne encephalitis virus
MAMTDTTAF

SEQ ID NO: 184003 - protein, 9 aa, Tick-borne encephalitis virus
AMTDTTAFG

SEQ ID NO: 184004 - protein, 9 aa, Tick-borne encephalitis virus
MTDTTAFGQ

SEQ ID NO: 184005 - protein, 9 aa, Tick-borne encephalitis virus
TDTTAFGQQ

SEQ ID NO: 184006 - protein, 9 aa, Tick-borne encephalitis virus
DTTAFGQQR

SEQ ID NO: 184007 - protein, 9 aa, Tick-borne encephalitis virus
TTAFGQQRV

SEQ ID NO: 184008 - protein, 9 aa, Tick-borne encephalitis virus
TAFGQQRVF

SEQ ID NO: 184009 - protein, 9 aa, Tick-borne encephalitis virus
AFGQQRVFK

SEQ ID NO: 184010 - protein, 9 aa, Tick-borne encephalitis virus
FGQQRVFKE

SEQ ID NO: 184011 - protein, 9 aa, Tick-borne encephalitis virus
GQQRVFKEK

SEQ ID NO: 184012 - protein, 9 aa, Tick-borne encephalitis virus
QQRVFKEKV

SEQ ID NO: 184013 - protein, 9 aa, Tick-borne encephalitis virus
QRVFKEKVD

SEQ ID NO: 184014 - protein, 9 aa, Tick-borne encephalitis virus
RVFKEKVDT

SEQ ID NO: 184015 - protein, 9 aa, Tick-borne encephalitis virus
VFKEKVDTK

SEQ ID NO: 184016 - protein, 9 aa, Tick-borne encephalitis virus
FKEKVDTKA

SEQ ID NO: 184017 - protein, 9 aa, Tick-borne encephalitis virus
KEKVDTKAQ

SEQ ID NO: 184018 - protein, 9 aa, Tick-borne encephalitis virus
EKVDTKAQE

SEQ ID NO: 184019 - protein, 9 aa, Tick-borne encephalitis virus
KVDTKAQEP

SEQ ID NO: 184020 - protein, 9 aa, Tick-borne encephalitis virus
VDTKAQEPQ

SEQ ID NO: 184021 - protein, 9 aa, Tick-borne encephalitis virus
DTKAQEPQP

SEQ ID NO: 184022 - protein, 9 aa, Tick-borne encephalitis virus
TKAQEPQPG

SEQ ID NO: 184023 - protein, 9 aa, Tick-borne encephalitis virus
KAQEPQPGT

SEQ ID NO: 184024 - protein, 9 aa, Tick-borne encephalitis virus
AQEPQPGTK

SEQ ID NO: 184025 - protein, 9 aa, Tick-borne encephalitis virus
QEPQPGTKV

SEQ ID NO: 184026 - protein, 9 aa, Tick-borne encephalitis virus
EPQPGTKVI

SEQ ID NO: 184027 - protein, 9 aa, Tick-borne encephalitis virus
PQPGTKVIM

SEQ ID NO: 184028 - protein, 9 aa, Tick-borne encephalitis virus
QPGTKVIMR

SEQ ID NO: 184029 - protein, 9 aa, Tick-borne encephalitis virus
PGTKVIMRA

SEQ ID NO: 184030 - protein, 9 aa, Tick-borne encephalitis virus
GTKVIMRAV

SEQ ID NO: 184031 - protein, 9 aa, Tick-borne encephalitis virus
TKVIMRAVN

SEQ ID NO: 184032 - protein, 9 aa, Tick-borne encephalitis virus
KVIMRAVND

SEQ ID NO: 184033 - protein, 9 aa, Tick-borne encephalitis virus
VIMRAVNDW

SEQ ID NO: 184034 - protein, 9 aa, Tick-borne encephalitis virus
IMRAVNDWI

SEQ ID NO: 184035 - protein, 9 aa, Tick-borne encephalitis virus
MRAVNDWIL

SEQ ID NO: 184036 - protein, 9 aa, Tick-borne encephalitis virus
RAVNDWILE

SEQ ID NO: 184037 - protein, 9 aa, Tick-borne encephalitis virus
AVNDWILER

SEQ ID NO: 184038 - protein, 9 aa, Tick-borne encephalitis virus
VNDWILERL

SEQ ID NO: 184039 - protein, 9 aa, Tick-borne encephalitis virus
NDWILERLA

SEQ ID NO: 184040 - protein, 9 aa, Tick-borne encephalitis virus
DWILERLAR

SEQ ID NO: 184041 - protein, 9 aa, Tick-borne encephalitis virus
WILERLARK

SEQ ID NO: 184042 - protein, 9 aa, Tick-borne encephalitis virus
ILERLARKS

SEQ ID NO: 184043 - protein, 9 aa, Tick-borne encephalitis virus
KPRMCSREE

SEQ ID NO: 184044 - protein, 9 aa, Tick-borne encephalitis virus
PRMCSREEF

SEQ ID NO: 184045 - protein, 9 aa, Tick-borne encephalitis virus
RMCSREEFI

SEQ ID NO: 184046 - protein, 9 aa, Tick-borne encephalitis virus
MCSREEFIA

SEQ ID NO: 184047 - protein, 9 aa, Tick-borne encephalitis virus
CSREEFIAK

SEQ ID NO: 184048 - protein, 9 aa, Tick-borne encephalitis virus
SREEFIAKV

SEQ ID NO: 184049 - protein, 9 aa, Tick-borne encephalitis virus
REEFIAKVK

SEQ ID NO: 184050 - protein, 9 aa, Tick-borne encephalitis virus
EEFIAKVKS

SEQ ID NO: 184051 - protein, 9 aa, Tick-borne encephalitis virus
EFIAKVKSN

SEQ ID NO: 184052 - protein, 9 aa, Tick-borne encephalitis virus
FIAKVKSNA

SEQ ID NO: 184053 - protein, 9 aa, Tick-borne encephalitis virus
IAKVKSNAA

SEQ ID NO: 184054 - protein, 9 aa, Tick-borne encephalitis virus
AKVKSNAAL

SEQ ID NO: 184055 - protein, 9 aa, Tick-borne encephalitis virus
KVKSNAALG

SEQ ID NO: 184056 - protein, 9 aa, Tick-borne encephalitis virus
VKSNAALGA

SEQ ID NO: 184057 - protein, 9 aa, Tick-borne encephalitis virus
KSNAALGAW

SEQ ID NO: 184058 - protein, 9 aa, Tick-borne encephalitis virus
SNAALGAWS

SEQ ID NO: 184059 - protein, 9 aa, Tick-borne encephalitis virus
NAALGAWSD

SEQ ID NO: 184060 - protein, 9 aa, Tick-borne encephalitis virus
AALGAWSDE

SEQ ID NO: 184061 - protein, 9 aa, Tick-borne encephalitis virus
ALGAWSDEQ

SEQ ID NO: 184062 - protein, 9 aa, Tick-borne encephalitis virus
LGAWSDEQN

SEQ ID NO: 184063 - protein, 9 aa, Tick-borne encephalitis virus
GAWSDEQNR

SEQ ID NO: 184064 - protein, 9 aa, Tick-borne encephalitis virus
AWSDEQNRW

SEQ ID NO: 184065 - protein, 9 aa, Tick-borne encephalitis virus
WSDEQNRWS

SEQ ID NO: 184066 - protein, 9 aa, Tick-borne encephalitis virus
SAKEAVEDP

SEQ ID NO: 184067 - protein, 9 aa, Tick-borne encephalitis virus
AKEAVEDPA

SEQ ID NO: 184068 - protein, 9 aa, Tick-borne encephalitis virus
KEAVEDPAF

SEQ ID NO: 184069 - protein, 9 aa, Tick-borne encephalitis virus
EAVEDPAFW

SEQ ID NO: 184070 - protein, 9 aa, Tick-borne encephalitis virus
AVEDPAFWQ

SEQ ID NO: 184071 - protein, 9 aa, Tick-borne encephalitis virus
VEDPAFWQL

SEQ ID NO: 184072 - protein, 9 aa, Tick-borne encephalitis virus
EDPAFWQLV

SEQ ID NO: 184073 - protein, 9 aa, Tick-borne encephalitis virus
DPAFWQLVD

SEQ ID NO: 184074 - protein, 9 aa, Tick-borne encephalitis virus
PAFWQLVDE

SEQ ID NO: 184075 - protein, 9 aa, Tick-borne encephalitis virus
AFWQLVDEE

SEQ ID NO: 184076 - protein, 9 aa, Tick-borne encephalitis virus
FWQLVDEER

SEQ ID NO: 184077 - protein, 9 aa, Tick-borne encephalitis virus
WQLVDEERE

SEQ ID NO: 184078 - protein, 9 aa, Tick-borne encephalitis virus
QLVDEERER

SEQ ID NO: 184079 - protein, 9 aa, Tick-borne encephalitis virus
LVDEERERH

SEQ ID NO: 184080 - protein, 9 aa, Tick-borne encephalitis virus
VDEERERHL

SEQ ID NO: 184081 - protein, 9 aa, Tick-borne encephalitis virus
DEERERHLA

SEQ ID NO: 184082 - protein, 9 aa, Tick-borne encephalitis virus
EERERHLAG

SEQ ID NO: 184083 - protein, 9 aa, Tick-borne encephalitis virus
ERERHLAGR

SEQ ID NO: 184084 - protein, 9 aa, Tick-borne encephalitis virus
RERHLAGRC

SEQ ID NO: 184085 - protein, 9 aa, Tick-borne encephalitis virus
ERHLAGRCA

SEQ ID NO: 184086 - protein, 9 aa, Tick-borne encephalitis virus
RHLAGRCAH

SEQ ID NO: 184087 - protein, 9 aa, Tick-borne encephalitis virus
HLAGRCAHC

SEQ ID NO: 184088 - protein, 9 aa, Tick-borne encephalitis virus
LAGRCAHCV

SEQ ID NO: 184089 - protein, 9 aa, Tick-borne encephalitis virus
GRCAHCVYN

SEQ ID NO: 184090 - protein, 9 aa, Tick-borne encephalitis virus
RCAHCVYNM

SEQ ID NO: 184091 - protein, 9 aa, Tick-borne encephalitis virus
CAHCVYNMM

SEQ ID NO: 184092 - protein, 9 aa, Tick-borne encephalitis virus
AHCVYNMMG

SEQ ID NO: 184093 - protein, 9 aa, Tick-borne encephalitis virus
HCVYNMMGK

SEQ ID NO: 184094 - protein, 9 aa, Tick-borne encephalitis virus
CVYNMMGKR

SEQ ID NO: 184095 - protein, 9 aa, Tick-borne encephalitis virus
VYNMMGKRE

SEQ ID NO: 184096 - protein, 9 aa, Tick-borne encephalitis virus
YNMMGKREK

SEQ ID NO: 184097 - protein, 9 aa, Tick-borne encephalitis virus
NMMGKREKK

SEQ ID NO: 184098 - protein, 9 aa, Tick-borne encephalitis virus
MMGKREKKL

SEQ ID NO: 184099 - protein, 9 aa, Tick-borne encephalitis virus
MGKREKKLG

SEQ ID NO: 184100 - protein, 9 aa, Tick-borne encephalitis virus
GKREKKLGE

SEQ ID NO: 184101 - protein, 9 aa, Tick-borne encephalitis virus
KREKKLGEF

SEQ ID NO: 184102 - protein, 9 aa, Tick-borne encephalitis virus
REKKLGEFG

SEQ ID NO: 184103 - protein, 9 aa, Tick-borne encephalitis virus
EKKLGEFGV

SEQ ID NO: 184104 - protein, 9 aa, Tick-borne encephalitis virus
KKLGEFGVA

SEQ ID NO: 184105 - protein, 9 aa, Tick-borne encephalitis virus
KLGEFGVAK

SEQ ID NO: 184106 - protein, 9 aa, Tick-borne encephalitis virus
LGEFGVAKG

SEQ ID NO: 184107 - protein, 9 aa, Tick-borne encephalitis virus
GEFGVAKGS

SEQ ID NO: 184108 - protein, 9 aa, Tick-borne encephalitis virus
EFGVAKGSR

SEQ ID NO: 184109 - protein, 9 aa, Tick-borne encephalitis virus
FGVAKGSRA

SEQ ID NO: 184110 - protein, 9 aa, Tick-borne encephalitis virus
GVAKGSRAI

SEQ ID NO: 184111 - protein, 9 aa, Tick-borne encephalitis virus
VAKGSRAIW

SEQ ID NO: 184112 - protein, 9 aa, Tick-borne encephalitis virus
AKGSRAIWY

SEQ ID NO: 184113 - protein, 9 aa, Tick-borne encephalitis virus
KGSRAIWYM

SEQ ID NO: 184114 - protein, 9 aa, Tick-borne encephalitis virus
GSRAIWYMW

SEQ ID NO: 184115 - protein, 9 aa, Tick-borne encephalitis virus
SRAIWYMWL

SEQ ID NO: 184116 - protein, 9 aa, Tick-borne encephalitis virus
RAIWYMWLG

SEQ ID NO: 184117 - protein, 9 aa, Tick-borne encephalitis virus
AIWYMWLGS

SEQ ID NO: 184118 - protein, 9 aa, Tick-borne encephalitis virus
IWYMWLGSR

SEQ ID NO: 184119 - protein, 9 aa, Tick-borne encephalitis virus
WYMWLGSRF

SEQ ID NO: 184120 - protein, 9 aa, Tick-borne encephalitis virus
YMWLGSRFL

SEQ ID NO: 184121 - protein, 9 aa, Tick-borne encephalitis virus
MWLGSRFLE

SEQ ID NO: 184122 - protein, 9 aa, Tick-borne encephalitis virus
WLGSRFLEF

SEQ ID NO: 184123 - protein, 9 aa, Tick-borne encephalitis virus
LGSRFLEFE

SEQ ID NO: 184124 - protein, 9 aa, Tick-borne encephalitis virus
GSRFLEFEA

SEQ ID NO: 184125 - protein, 9 aa, Tick-borne encephalitis virus
SRFLEFEAL

SEQ ID NO: 184126 - protein, 9 aa, Tick-borne encephalitis virus
RFLEFEALG

SEQ ID NO: 184127 - protein, 9 aa, Tick-borne encephalitis virus
FLEFEALGF

SEQ ID NO: 184128 - protein, 9 aa, Tick-borne encephalitis virus
LEFEALGFL

SEQ ID NO: 184129 - protein, 9 aa, Tick-borne encephalitis virus
EFEALGFLN

SEQ ID NO: 184130 - protein, 9 aa, Tick-borne encephalitis virus
FEALGFLNE

SEQ ID NO: 184131 - protein, 9 aa, Tick-borne encephalitis virus
EALGFLNED

SEQ ID NO: 184132 - protein, 9 aa, Tick-borne encephalitis virus
ALGFLNEDH

SEQ ID NO: 184133 - protein, 9 aa, Tick-borne encephalitis virus
LGFLNEDHW

SEQ ID NO: 184134 - protein, 9 aa, Tick-borne encephalitis virus
GFLNEDHWA

SEQ ID NO: 184135 - protein, 9 aa, Tick-borne encephalitis virus
FLNEDHWAS

SEQ ID NO: 184136 - protein, 9 aa, Tick-borne encephalitis virus
LNEDHWASR

SEQ ID NO: 184137 - protein, 9 aa, Tick-borne encephalitis virus
NEDHWASRG

SEQ ID NO: 184138 - protein, 9 aa, Tick-borne encephalitis virus
EDHWASRGS

SEQ ID NO: 184139 - protein, 9 aa, Tick-borne encephalitis virus
DHWASRGSS

SEQ ID NO: 184140 - protein, 9 aa, Tick-borne encephalitis virus
HWASRGSSG

SEQ ID NO: 184141 - protein, 9 aa, Tick-borne encephalitis virus
WASRGSSGS

SEQ ID NO: 184142 - protein, 9 aa, Tick-borne encephalitis virus
ASRGSSGSG

SEQ ID NO: 184143 - protein, 9 aa, Tick-borne encephalitis virus
SRGSSGSGV

SEQ ID NO: 184144 - protein, 9 aa, Tick-borne encephalitis virus
RGSSGSGVE

SEQ ID NO: 184145 - protein, 9 aa, Tick-borne encephalitis virus
GSSGSGVEG

SEQ ID NO: 184146 - protein, 9 aa, Tick-borne encephalitis virus
SSGSGVEGI

SEQ ID NO: 184147 - protein, 9 aa, Tick-borne encephalitis virus
SGSGVEGIS

SEQ ID NO: 184148 - protein, 9 aa, Tick-borne encephalitis virus
GSGVEGISL

SEQ ID NO: 184149 - protein, 9 aa, Tick-borne encephalitis virus
SGVEGISLN

SEQ ID NO: 184150 - protein, 9 aa, Tick-borne encephalitis virus
GVEGISLNY

SEQ ID NO: 184151 - protein, 9 aa, Tick-borne encephalitis virus
VEGISLNYL

SEQ ID NO: 184152 - protein, 9 aa, Tick-borne encephalitis virus
EGISLNYLG

SEQ ID NO: 184153 - protein, 9 aa, Tick-borne encephalitis virus
GISLNYLGW

SEQ ID NO: 184154 - protein, 9 aa, Tick-borne encephalitis virus
ISLNYLGWH

SEQ ID NO: 184155 - protein, 9 aa, Tick-borne encephalitis virus
SLNYLGWHL

SEQ ID NO: 184156 - protein, 9 aa, Tick-borne encephalitis virus
LNYLGWHLK

SEQ ID NO: 184157 - protein, 9 aa, Tick-borne encephalitis virus
NYLGWYLKG

SEQ ID NO: 184158 - protein, 9 aa, Tick-borne encephalitis virus
YLGWHLKKL

SEQ ID NO: 184159 - protein, 9 aa, Tick-borne encephalitis virus
LGWHLKKLS

SEQ ID NO: 184160 - protein, 9 aa, Tick-borne encephalitis virus
LSTLEGGLF

SEQ ID NO: 184161 - protein, 9 aa, Tick-borne encephalitis virus
STLEGGLFY

SEQ ID NO: 184162 - protein, 9 aa, Tick-borne encephalitis virus
TLEGGLFYA

SEQ ID NO: 184163 - protein, 9 aa, Tick-borne encephalitis virus
LEGGLFYAD

SEQ ID NO: 184164 - protein, 9 aa, Tick-borne encephalitis virus
EGGLFYADD

SEQ ID NO: 184165 - protein, 9 aa, Tick-borne encephalitis virus
GGLFYADDT

SEQ ID NO: 184166 - protein, 9 aa, Tick-borne encephalitis virus
GLFYADDTA

SEQ ID NO: 184167 - protein, 9 aa, Tick-borne encephalitis virus
LFYADDTAG

SEQ ID NO: 184168 - protein, 9 aa, Tick-borne encephalitis virus
FYADDTAGW

SEQ ID NO: 184169 - protein, 9 aa, Tick-borne encephalitis virus
YADDTAGWD

SEQ ID NO: 184170 - protein, 9 aa, Tick-borne encephalitis virus
ADDTAGWDT

SEQ ID NO: 184171 - protein, 9 aa, Tick-borne encephalitis virus
DDTAGWDTK

SEQ ID NO: 184172 - protein, 9 aa, Tick-borne encephalitis virus
DTAGWDTKV

SEQ ID NO: 184173 - protein, 9 aa, Tick-borne encephalitis virus
TAGWDTKVT

SEQ ID NO: 184174 - protein, 9 aa, Tick-borne encephalitis virus
AGWDTKVTN

SEQ ID NO: 184175 - protein, 9 aa, Tick-borne encephalitis virus
GWDTKVTNA

SEQ ID NO: 184176 - protein, 9 aa, Tick-borne encephalitis virus
WDTKVTNAD

SEQ ID NO: 184177 - protein, 9 aa, Tick-borne encephalitis virus
DTKVTNADL

SEQ ID NO: 184178 - protein, 9 aa, Tick-borne encephalitis virus
TKVTNADLE

SEQ ID NO: 184179 - protein, 9 aa, Tick-borne encephalitis virus
KVTNADLED

SEQ ID NO: 184180 - protein, 9 aa, Tick-borne encephalitis virus
VTNADLEDE

SEQ ID NO: 184181 - protein, 9 aa, Tick-borne encephalitis virus
TNADLEDEE

SEQ ID NO: 184182 - protein, 9 aa, Tick-borne encephalitis virus
NADLEDEEQ

SEQ ID NO: 184183 - protein, 9 aa, Tick-borne encephalitis virus
ADLEDEEQL

SEQ ID NO: 184184 - protein, 9 aa, Tick-borne encephalitis virus
DLEDEEQLL

SEQ ID NO: 184185 - protein, 9 aa, Tick-borne encephalitis virus
LEDEEQLLR

SEQ ID NO: 184186 - protein, 9 aa, Tick-borne encephalitis virus
EDEEQLLRY

SEQ ID NO: 184187 - protein, 9 aa, Tick-borne encephalitis virus
DEEQLLRYM

SEQ ID NO: 184188 - protein, 9 aa, Tick-borne encephalitis virus
EEQLLRYME

SEQ ID NO: 184189 - protein, 9 aa, Tick-borne encephalitis virus
EQLLRYMEG

SEQ ID NO: 184190 - protein, 9 aa, Tick-borne encephalitis virus
QLLRYMEGE

SEQ ID NO: 184191 - protein, 9 aa, Tick-borne encephalitis virus
LLRYMEGEH

SEQ ID NO: 184192 - protein, 9 aa, Tick-borne encephalitis virus
LRYMEGEHK

SEQ ID NO: 184193 - protein, 9 aa, Tick-borne encephalitis virus
RYMEGEHKQ

SEQ ID NO: 184194 - protein, 9 aa, Tick-borne encephalitis virus
YMEGEHKQL

SEQ ID NO: 184195 - protein, 9 aa, Tick-borne encephalitis virus
MEGEHKQLA

SEQ ID NO: 184196 - protein, 9 aa, Tick-borne encephalitis virus
EGEHKQLAA

SEQ ID NO: 184197 - protein, 9 aa, Tick-borne encephalitis virus
GEHKQLAAT

SEQ ID NO: 184198 - protein, 9 aa, Tick-borne encephalitis virus
EHKQLAATI

SEQ ID NO: 184199 - protein, 9 aa, Tick-borne encephalitis virus
HKQLAATIM

SEQ ID NO: 184200 - protein, 9 aa, Tick-borne encephalitis virus
KQLAATIMQ

SEQ ID NO: 184201 - protein, 9 aa, Tick-borne encephalitis virus
QLAATIMQK

SEQ ID NO: 184202 - protein, 9 aa, Tick-borne encephalitis virus
LAATIMQKA

SEQ ID NO: 184203 - protein, 9 aa, Tick-borne encephalitis virus
AATIMQKAY

SEQ ID NO: 184204 - protein, 9 aa, Tick-borne encephalitis virus
ATIMQKAYH

SEQ ID NO: 184205 - protein, 9 aa, Tick-borne encephalitis virus
TIMQKAYHA

SEQ ID NO: 184206 - protein, 9 aa, Tick-borne encephalitis virus
IMQKAYHAK

SEQ ID NO: 184207 - protein, 9 aa, Tick-borne encephalitis virus
MQKAYHAKV

SEQ ID NO: 184208 - protein, 9 aa, Tick-borne encephalitis virus
QKAYHAKVV

SEQ ID NO: 184209 - protein, 9 aa, Tick-borne encephalitis virus
KAYHAKVVK

SEQ ID NO: 184210 - protein, 9 aa, Tick-borne encephalitis virus
AYHAKVVKV

SEQ ID NO: 184211 - protein, 9 aa, Tick-borne encephalitis virus
YHAKVVKVA

SEQ ID NO: 184212 - protein, 9 aa, Tick-borne encephalitis virus
HAKVVKVAR

SEQ ID NO: 184213 - protein, 9 aa, Tick-borne encephalitis virus
AKVVKVARP

SEQ ID NO: 184214 - protein, 9 aa, Tick-borne encephalitis virus
KVVKVARPS

SEQ ID NO: 184215 - protein, 9 aa, Tick-borne encephalitis virus
VVKVARPSR

SEQ ID NO: 184216 - protein, 9 aa, Tick-borne encephalitis virus
VKVARPSRD

SEQ ID NO: 184217 - protein, 9 aa, Tick-borne encephalitis virus
KVARPSRDG

SEQ ID NO: 184218 - protein, 9 aa, Tick-borne encephalitis virus
VARPSRDGG

SEQ ID NO: 184219 - protein, 9 aa, Tick-borne encephalitis virus
ARPSRDGGC

SEQ ID NO: 184220 - protein, 9 aa, Tick-borne encephalitis virus
RPSRDGGCI

SEQ ID NO: 184221 - protein, 9 aa, Tick-borne encephalitis virus
PSRDGGCIM

SEQ ID NO: 184222 - protein, 9 aa, Tick-borne encephalitis virus
SRDGGCIMD

SEQ ID NO: 184223 - protein, 9 aa, Tick-borne encephalitis virus
RDGGCIMDV

SEQ ID NO: 184224 - protein, 9 aa, Tick-borne encephalitis virus
DGGCIMDVI

SEQ ID NO: 184225 - protein, 9 aa, Tick-borne encephalitis virus
GGCIMDVIT

SEQ ID NO: 184226 - protein, 9 aa, Tick-borne encephalitis virus
GCIMDVITR

SEQ ID NO: 184227 - protein, 9 aa, Tick-borne encephalitis virus
CIMDVITRR

SEQ ID NO: 184228 - protein, 9 aa, Tick-borne encephalitis virus
IMDVITRRD

SEQ ID NO: 184229 - protein, 9 aa, Tick-borne encephalitis virus
MDVITRRDQ

SEQ ID NO: 184230 - protein, 9 aa, Tick-borne encephalitis virus
DVITRRDQR

SEQ ID NO: 184231 - protein, 9 aa, Tick-borne encephalitis virus
VITRRDQRG

SEQ ID NO: 184232 - protein, 9 aa, Tick-borne encephalitis virus
ITRRDQRGS

SEQ ID NO: 184233 - protein, 9 aa, Tick-borne encephalitis virus
TRRDQRGSG

SEQ ID NO: 184234 - protein, 9 aa, Tick-borne encephalitis virus
RRDQRGSGQ

SEQ ID NO: 184235 - protein, 9 aa, Tick-borne encephalitis virus
RDQRGSGQV

SEQ ID NO: 184236 - protein, 9 aa, Tick-borne encephalitis virus
DQRGSGQVV

SEQ ID NO: 184237 - protein, 9 aa, Tick-borne encephalitis virus
QRGSGQVVT

SEQ ID NO: 184238 - protein, 9 aa, Tick-borne encephalitis virus
RGSGQVVTY

SEQ ID NO: 184239 - protein, 9 aa, Tick-borne encephalitis virus
GSGQVVTYA

SEQ ID NO: 184240 - protein, 9 aa, Tick-borne encephalitis virus
SGQVVTYAL

SEQ ID NO: 184241 - protein, 9 aa, Tick-borne encephalitis virus
GQVVTYALN

SEQ ID NO: 184242 - protein, 9 aa, Tick-borne encephalitis virus
QVVTYALNT

SEQ ID NO: 184243 - protein, 9 aa, Tick-borne encephalitis virus
VVTYALNTL

SEQ ID NO: 184244 - protein, 9 aa, Tick-borne encephalitis virus
VTYALNTLT

SEQ ID NO: 184245 - protein, 9 aa, Tick-borne encephalitis virus
TYALNTLTN

SEQ ID NO: 184246 - protein, 9 aa, Tick-borne encephalitis virus
YALNTLTNI

SEQ ID NO: 184247 - protein, 9 aa, Tick-borne encephalitis virus
ALNTLTNIK

SEQ ID NO: 184248 - protein, 9 aa, Tick-borne encephalitis virus
LNTLTNIKV

SEQ ID NO: 184249 - protein, 9 aa, Tick-borne encephalitis virus
NTLTNIKVQ

SEQ ID NO: 184250 - protein, 9 aa, Tick-borne encephalitis virus
TLTNIKVQL

SEQ ID NO: 184251 - protein, 9 aa, Tick-borne encephalitis virus
LTNIKVQLI

SEQ ID NO: 184252 - protein, 9 aa, Tick-borne encephalitis virus
TNIKVQLIR

SEQ ID NO: 184253 - protein, 9 aa, Tick-borne encephalitis virus
NIKVQLIRM

SEQ ID NO: 184254 - protein, 9 aa, Tick-borne encephalitis virus
IKVQLIRMM

SEQ ID NO: 184255 - protein, 9 aa, Tick-borne encephalitis virus
KVQLIRMME

SEQ ID NO: 184256 - protein, 9 aa, Tick-borne encephalitis virus
VQLIRMMEG

SEQ ID NO: 184257 - protein, 9 aa, Tick-borne encephalitis virus
QLIRMMEGE

SEQ ID NO: 184258 - protein, 9 aa, Tick-borne encephalitis virus
LIRMMEGEG

SEQ ID NO: 184259 - protein, 9 aa, Tick-borne encephalitis virus
IRMMEGEGV

SEQ ID NO: 184260 - protein, 9 aa, Tick-borne encephalitis virus
RMMEGEGVI

SEQ ID NO: 184261 - protein, 9 aa, Tick-borne encephalitis virus
MMEGEGVIE

SEQ ID NO: 184262 - protein, 9 aa, Tick-borne encephalitis virus
MEGEGVIEA

SEQ ID NO: 184263 - protein, 9 aa, Tick-borne encephalitis virus
EGEGVIEAS

SEQ ID NO: 184264 - protein, 9 aa, Tick-borne encephalitis virus
GEGVIEASD

SEQ ID NO: 184265 - protein, 9 aa, Tick-borne encephalitis virus
EGVIEASDA

SEQ ID NO: 184266 - protein, 9 aa, Tick-borne encephalitis virus
GVIEASDAH

SEQ ID NO: 184267 - protein, 9 aa, Tick-borne encephalitis virus
VIEASDAHN

SEQ ID NO: 184268 - protein, 9 aa, Tick-borne encephalitis virus
IEASDAHNP

SEQ ID NO: 184269 - protein, 9 aa, Tick-borne encephalitis virus
EASDAHNPR

SEQ ID NO: 184270 - protein, 9 aa, Tick-borne encephalitis virus
ASDAHNPRL

SEQ ID NO: 184271 - protein, 9 aa, Tick-borne encephalitis virus
SDAHNPRLL

SEQ ID NO: 184272 - protein, 9 aa, Tick-borne encephalitis virus
DAHNPRLLR

SEQ ID NO: 184273 - protein, 9 aa, Tick-borne encephalitis virus
AHNPRLLRV

SEQ ID NO: 184274 - protein, 9 aa, Tick-borne encephalitis virus
HNPRLLRVE

SEQ ID NO: 184275 - protein, 9 aa, Tick-borne encephalitis virus
NPRLLRVER

SEQ ID NO: 184276 - protein, 9 aa, Tick-borne encephalitis virus
PRLLRVERW

SEQ ID NO: 184277 - protein, 9 aa, Tick-borne encephalitis virus
RLLRVERWL

SEQ ID NO: 184278 - protein, 9 aa, Tick-borne encephalitis virus
LLRVERWLR

SEQ ID NO: 184279 - protein, 9 aa, Tick-borne encephalitis virus
LRVERWLRD

SEQ ID NO: 184280 - protein, 9 aa, Tick-borne encephalitis virus
RVERWLRDH

SEQ ID NO: 184281 - protein, 9 aa, Tick-borne encephalitis virus
VERWLRDHG

SEQ ID NO: 184282 - protein, 9 aa, Tick-borne encephalitis virus
DHGEERLGR

SEQ ID NO: 184283 - protein, 9 aa, Tick-borne encephalitis virus
HGEERLGRM

SEQ ID NO: 184284 - protein, 9 aa, Tick-borne encephalitis virus
GEERLGRML

SEQ ID NO: 184285 - protein, 9 aa, Tick-borne encephalitis virus
EERLGRMLV

SEQ ID NO: 184286 - protein, 9 aa, Tick-borne encephalitis virus
ERLGRMLVS

SEQ ID NO: 184287 - protein, 9 aa, Tick-borne encephalitis virus
RLGRMLVSG

SEQ ID NO: 184288 - protein, 9 aa, Tick-borne encephalitis virus
LGRMLVSGD

SEQ ID NO: 184289 - protein, 9 aa, Tick-borne encephalitis virus
GRMLVSGDD

SEQ ID NO: 184290 - protein, 9 aa, Tick-borne encephalitis virus
RMLVSGDDC

SEQ ID NO: 184291 - protein, 9 aa, Tick-borne encephalitis virus
MLVSGDDCV

SEQ ID NO: 184292 - protein, 9 aa, Tick-borne encephalitis virus
LVSGDDCVV

SEQ ID NO: 184293 - protein, 9 aa, Tick-borne encephalitis virus
VSGDDCVVR

SEQ ID NO: 184294 - protein, 9 aa, Tick-borne encephalitis virus
SGDDCVVRP

SEQ ID NO: 184295 - protein, 9 aa, Tick-borne encephalitis virus
GDDCVVRPV

SEQ ID NO: 184296 - protein, 9 aa, Tick-borne encephalitis virus
DDCVVRPVD

SEQ ID NO: 184297 - protein, 9 aa, Tick-borne encephalitis virus
DCVVRPVDD

SEQ ID NO: 184298 - protein, 9 aa, Tick-borne encephalitis virus
CVVRPVDDR

SEQ ID NO: 184299 - protein, 9 aa, Tick-borne encephalitis virus
VVRPVDDRF

SEQ ID NO: 184300 - protein, 9 aa, Tick-borne encephalitis virus
VRPVDDRFS

SEQ ID NO: 184301 - protein, 9 aa, Tick-borne encephalitis virus
DDRFGKALY

SEQ ID NO: 184302 - protein, 9 aa, Tick-borne encephalitis virus
DRFGKALYF

SEQ ID NO: 184303 - protein, 9 aa, Tick-borne encephalitis virus
RFGKALYFL

SEQ ID NO: 184304 - protein, 9 aa, Tick-borne encephalitis virus
FGKALYFLN

SEQ ID NO: 184305 - protein, 9 aa, Tick-borne encephalitis virus
GKALYFLND

SEQ ID NO: 184306 - protein, 9 aa, Tick-borne encephalitis virus
KALYFLNDM

SEQ ID NO: 184307 - protein, 9 aa, Tick-borne encephalitis virus
ALYFLNDMA

SEQ ID NO: 184308 - protein, 9 aa, Tick-borne encephalitis virus
LYFLNDMAK

SEQ ID NO: 184309 - protein, 9 aa, Tick-borne encephalitis virus
YFLNDMAKT

SEQ ID NO: 184310 - protein, 9 aa, Tick-borne encephalitis virus
FLNDMAKTR

SEQ ID NO: 184311 - protein, 9 aa, Tick-borne encephalitis virus
LNDMAKTRK

SEQ ID NO: 184312 - protein, 9 aa, Tick-borne encephalitis virus
NDMAKTRKD

SEQ ID NO: 184313 - protein, 9 aa, Tick-borne encephalitis virus
DMAKTRKDI

SEQ ID NO: 184314 - protein, 9 aa, Tick-borne encephalitis virus
MAKTRKDIG

SEQ ID NO: 184315 - protein, 9 aa, Tick-borne encephalitis virus
AKTRKDIGE

SEQ ID NO: 184316 - protein, 9 aa, Tick-borne encephalitis virus
KTRKDIGEW

SEQ ID NO: 184317 - protein, 9 aa, Tick-borne encephalitis virus
TRKDIGEWE

SEQ ID NO: 184318 - protein, 9 aa, Tick-borne encephalitis virus
RKDIGEWEH

SEQ ID NO: 184319 - protein, 9 aa, Tick-borne encephalitis virus
KDIGEWEHS

SEQ ID NO: 184320 - protein, 9 aa, Tick-borne encephalitis virus
DIGEWEHSV

SEQ ID NO: 184321 - protein, 9 aa, Tick-borne encephalitis virus
IGEWEHSVG

SEQ ID NO: 184322 - protein, 9 aa, Tick-borne encephalitis virus
GEWEHSVGF

SEQ ID NO: 184323 - protein, 9 aa, Tick-borne encephalitis virus
EWEHSVGFS

SEQ ID NO: 184324 - protein, 9 aa, Tick-borne encephalitis virus
NWEEVPFCS

SEQ ID NO: 184325 - protein, 9 aa, Tick-borne encephalitis virus
WEEVPFCSH

SEQ ID NO: 184326 - protein, 9 aa, Tick-borne encephalitis virus
EEVPFCSHH

SEQ ID NO: 184327 - protein, 9 aa, Tick-borne encephalitis virus
EVPFCSHHF

SEQ ID NO: 184328 - protein, 9 aa, Tick-borne encephalitis virus
VPFCSHHFH

SEQ ID NO: 184329 - protein, 9 aa, Tick-borne encephalitis virus
PFCSHHFHE

SEQ ID NO: 184330 - protein, 9 aa, Tick-borne encephalitis virus
FCSHHFHEL

SEQ ID NO: 184331 - protein, 9 aa, Tick-borne encephalitis virus
CSHHFHELV

SEQ ID NO: 184332 - protein, 9 aa, Tick-borne encephalitis virus
SHHFHELVM

SEQ ID NO: 184333 - protein, 9 aa, Tick-borne encephalitis virus
HHFHELVMK

SEQ ID NO: 184334 - protein, 9 aa, Tick-borne encephalitis virus
HFHELVMKD

SEQ ID NO: 184335 - protein, 9 aa, Tick-borne encephalitis virus
FHELVMKDG

SEQ ID NO: 184336 - protein, 9 aa, Tick-borne encephalitis virus
HELVMKDGR

SEQ ID NO: 184337 - protein, 9 aa, Tick-borne encephalitis virus
ELVMKDGRA

SEQ ID NO: 184338 - protein, 9 aa, Tick-borne encephalitis virus
LVMKDGRAL

SEQ ID NO: 184339 - protein, 9 aa, Tick-borne encephalitis virus
VMKDGRALI

SEQ ID NO: 184340 - protein, 9 aa, Tick-borne encephalitis virus
MKDGRALIV

SEQ ID NO: 184341 - protein, 9 aa, Tick-borne encephalitis virus
KDGRALIVP

SEQ ID NO: 184342 - protein, 9 aa, Tick-borne encephalitis virus
DGRALIVPC

SEQ ID NO: 184343 - protein, 9 aa, Tick-borne encephalitis virus
GRALIVPCR

SEQ ID NO: 184344 - protein, 9 aa, Tick-borne encephalitis virus
RALIVPCRD

SEQ ID NO: 184345 - protein, 9 aa, Tick-borne encephalitis virus
ALIVPCRDQ

SEQ ID NO: 184346 - protein, 9 aa, Tick-borne encephalitis virus
LIVPCRDQD

SEQ ID NO: 184347 - protein, 9 aa, Tick-borne encephalitis virus
IVPCRDQDE

SEQ ID NO: 184348 - protein, 9 aa, Tick-borne encephalitis virus
VPCRDQDEL

SEQ ID NO: 184349 - protein, 9 aa, Tick-borne encephalitis virus
PCRDQDELV

SEQ ID NO: 184350 - protein, 9 aa, Tick-borne encephalitis virus
CRDQDELVG

SEQ ID NO: 184351 - protein, 9 aa, Tick-borne encephalitis virus
RDQDELVGR

SEQ ID NO: 184352 - protein, 9 aa, Tick-borne encephalitis virus
DQDELVGRA

SEQ ID NO: 184353 - protein, 9 aa, Tick-borne encephalitis virus
QDELVGRAR

SEQ ID NO: 184354 - protein, 9 aa, Tick-borne encephalitis virus
DELVGRARV

SEQ ID NO: 184355 - protein, 9 aa, Tick-borne encephalitis virus
ELVGRARVS

SEQ ID NO: 184356 - protein, 9 aa, Tick-borne encephalitis virus
LVGRARVSP

SEQ ID NO: 184357 - protein, 9 aa, Tick-borne encephalitis virus
VGRARVSPG

SEQ ID NO: 184358 - protein, 9 aa, Tick-borne encephalitis virus
GRARVSPGC

SEQ ID NO: 184359 - protein, 9 aa, Tick-borne encephalitis virus
RARVSPGCG

SEQ ID NO: 184360 - protein, 9 aa, Tick-borne encephalitis virus
ARVSPGCGW

SEQ ID NO: 184361 - protein, 9 aa, Tick-borne encephalitis virus
RVSPGCGWS

SEQ ID NO: 184362 - protein, 9 aa, Tick-borne encephalitis virus
VSPGCGWSV

SEQ ID NO: 184363 - protein, 9 aa, Tick-borne encephalitis virus
SPGCGWSVR

SEQ ID NO: 184364 - protein, 9 aa, Tick-borne encephalitis virus
PGCGWSVRE

SEQ ID NO: 184365 - protein, 9 aa, Tick-borne encephalitis virus
GCGWSVRET

SEQ ID NO: 184366 - protein, 9 aa, Tick-borne encephalitis virus
CGWSVRETA

SEQ ID NO: 184367 - protein, 9 aa, Tick-borne encephalitis virus
GWSVRETAC

SEQ ID NO: 184368 - protein, 9 aa, Tick-borne encephalitis virus
WSVRETACL

SEQ ID NO: 184369 - protein, 9 aa, Tick-borne encephalitis virus
SVRETACLS

SEQ ID NO: 184370 - protein, 9 aa, Tick-borne encephalitis virus
VRETACLSK

SEQ ID NO: 184371 - protein, 9 aa, Tick-borne encephalitis virus
RETACLSKA

SEQ ID NO: 184372 - protein, 9 aa, Tick-borne encephalitis virus
ETACLSKAY

SEQ ID NO: 184373 - protein, 9 aa, Tick-borne encephalitis virus
TACLSKAYG

SEQ ID NO: 184374 - protein, 9 aa, Tick-borne encephalitis virus
ACLSKAYGQ

SEQ ID NO: 184375 - protein, 9 aa, Tick-borne encephalitis virus
CLSKAYGQM

SEQ ID NO: 184376 - protein, 9 aa, Tick-borne encephalitis virus
LSKAYGQMW

SEQ ID NO: 184377 - protein, 9 aa, Tick-borne encephalitis virus
SKAYGQMWL

SEQ ID NO: 184378 - protein, 9 aa, Tick-borne encephalitis virus
KAYGQMWLL

SEQ ID NO: 184379 - protein, 9 aa, Tick-borne encephalitis virus
AYGQMWLLS

SEQ ID NO: 184380 - protein, 9 aa, Tick-borne encephalitis virus
YGQMWLLSY

SEQ ID NO: 184381 - protein, 9 aa, Tick-borne encephalitis virus
GQMWLLSYF

SEQ ID NO: 184382 - protein, 9 aa, Tick-borne encephalitis virus
QMWLLSYFH

SEQ ID NO: 184383 - protein, 9 aa, Tick-borne encephalitis virus
MWLLSYFHR

SEQ ID NO: 184384 - protein, 9 aa, Tick-borne encephalitis virus
WLLSYFHRR

SEQ ID NO: 184385 - protein, 9 aa, Tick-borne encephalitis virus
LLSYFHRRD

SEQ ID NO: 184386 - protein, 9 aa, Tick-borne encephalitis virus
LSYFHRRDL

SEQ ID NO: 184387 - protein, 9 aa, Tick-borne encephalitis virus
SYFHRRDLR

SEQ ID NO: 184388 - protein, 9 aa, Tick-borne encephalitis virus
YFHRRDLRT

SEQ ID NO: 184389 - protein, 9 aa, Tick-borne encephalitis virus
FHRRDLRTL

SEQ ID NO: 184390 - protein, 9 aa, Tick-borne encephalitis virus
HRRDLRTLG

SEQ ID NO: 184391 - protein, 9 aa, Tick-borne encephalitis virus
RRDLRTLGL

SEQ ID NO: 184392 - protein, 9 aa, Tick-borne encephalitis virus
RDLRTLGLA

SEQ ID NO: 184393 - protein, 9 aa, Tick-borne encephalitis virus
DLRTLGLAI

SEQ ID NO: 184394 - protein, 9 aa, Tick-borne encephalitis virus
LRTLGLAIC

SEQ ID NO: 184395 - protein, 9 aa, Tick-borne encephalitis virus
RTLGLAICS

SEQ ID NO: 184396 - protein, 9 aa, Tick-borne encephalitis virus
TLGLAICSA

SEQ ID NO: 184397 - protein, 9 aa, Tick-borne encephalitis virus
LGLAICSAV

SEQ ID NO: 184398 - protein, 9 aa, Tick-borne encephalitis virus
GLAICSAVP

SEQ ID NO: 184399 - protein, 9 aa, Tick-borne encephalitis virus
SAVPVDWVP

SEQ ID NO: 184400 - protein, 9 aa, Tick-borne encephalitis virus
AVPVDWVPT

SEQ ID NO: 184401 - protein, 9 aa, Tick-borne encephalitis virus
VPVDWVPTG

SEQ ID NO: 184402 - protein, 9 aa, Tick-borne encephalitis virus
PVDWVPTGR

SEQ ID NO: 184403 - protein, 9 aa, Tick-borne encephalitis virus
VDWVPTGRT

SEQ ID NO: 184404 - protein, 9 aa, Tick-borne encephalitis virus
DWVPTGRTT

SEQ ID NO: 184405 - protein, 9 aa, Tick-borne encephalitis virus
WVPTGRTTW

SEQ ID NO: 184406 - protein, 9 aa, Tick-borne encephalitis virus
VPTGRTTWS

SEQ ID NO: 184407 - protein, 9 aa, Tick-borne encephalitis virus
PTGRTTWSI

SEQ ID NO: 184408 - protein, 9 aa, Tick-borne encephalitis virus
TGRTTWSIH

SEQ ID NO: 184409 - protein, 9 aa, Tick-borne encephalitis virus
GRTTWSIHA

SEQ ID NO: 184410 - protein, 9 aa, Tick-borne encephalitis virus
RTTWSIHAS

SEQ ID NO: 184411 - protein, 9 aa, Tick-borne encephalitis virus
TTWSIHASG

SEQ ID NO: 184412 - protein, 9 aa, Tick-borne encephalitis virus
TWSIHASGA

SEQ ID NO: 184413 - protein, 9 aa, Tick-borne encephalitis virus
WSIHASGAW

SEQ ID NO: 184414 - protein, 9 aa, Tick-borne encephalitis virus
SIHASGAWM

SEQ ID NO: 184415 - protein, 9 aa, Tick-borne encephalitis virus
IHASGAWMT

SEQ ID NO: 184416 - protein, 9 aa, Tick-borne encephalitis virus
HASGAWMTT

SEQ ID NO: 184417 - protein, 9 aa, Tick-borne encephalitis virus
ASGAWMTTE

SEQ ID NO: 184418 - protein, 9 aa, Tick-borne encephalitis virus
SGAWMTTED

SEQ ID NO: 184419 - protein, 9 aa, Tick-borne encephalitis virus
GAWMTTEDM

SEQ ID NO: 184420 - protein, 9 aa, Tick-borne encephalitis virus
AWMTTEDML

SEQ ID NO: 184421 - protein, 9 aa, Tick-borne encephalitis virus
WMTTEDMLD

SEQ ID NO: 184422 - protein, 9 aa, Tick-borne encephalitis virus
MTTEDMLDV

SEQ ID NO: 184423 - protein, 9 aa, Tick-borne encephalitis virus
TTEDMLDVW

SEQ ID NO: 184424 - protein, 9 aa, Tick-borne encephalitis virus
TEDMLDVWN

SEQ ID NO: 184425 - protein, 9 aa, Tick-borne encephalitis virus
EDMLDVWNR

SEQ ID NO: 184426 - protein, 9 aa, Tick-borne encephalitis virus
DMLDVWNRV

SEQ ID NO: 184427 - protein, 9 aa, Tick-borne encephalitis virus
MLDVWNRVW

SEQ ID NO: 184428 - protein, 9 aa, Tick-borne encephalitis virus
LDVWNRVWI

SEQ ID NO: 184429 - protein, 9 aa, Tick-borne encephalitis virus
DVWNRVWIL

SEQ ID NO: 184430 - protein, 9 aa, Tick-borne encephalitis virus
VWNRVWILD

SEQ ID NO: 184431 - protein, 9 aa, Tick-borne encephalitis virus
WNRVWILDN

SEQ ID NO: 184432 - protein, 9 aa, Tick-borne encephalitis virus
NRVWILDNP

SEQ ID NO: 184433 - protein, 9 aa, Tick-borne encephalitis virus
RVWILDNPF

SEQ ID NO: 184434 - protein, 9 aa, Tick-borne encephalitis virus
VWILDNPFM

SEQ ID NO: 184435 - protein, 9 aa, Tick-borne encephalitis virus
WILDNPFMH

SEQ ID NO: 184436 - protein, 9 aa, Tick-borne encephalitis virus
ILDNPFMHS

SEQ ID NO: 184437 - protein, 9 aa, Tick-borne encephalitis virus
LDNPFMHSK

SEQ ID NO: 184438 - protein, 9 aa, Tick-borne encephalitis virus
DNPFMHSKE

SEQ ID NO: 184439 - protein, 9 aa, Tick-borne encephalitis virus
NPFMHSKEK

SEQ ID NO: 184440 - protein, 9 aa, Tick-borne encephalitis virus
EWRDVPYLP

SEQ ID NO: 184441 - protein, 9 aa, Tick-borne encephalitis virus
WRDVPYLPK

SEQ ID NO: 184442 - protein, 9 aa, Tick-borne encephalitis virus
RDVPYLPKS

SEQ ID NO: 184443 - protein, 9 aa, Tick-borne encephalitis virus
VPYLPKSHD

SEQ ID NO: 184444 - protein, 9 aa, Tick-borne encephalitis virus
PYLPKSHDM

SEQ ID NO: 184445 - protein, 9 aa, Tick-borne encephalitis virus
YLPKSHDML

SEQ ID NO: 184446 - protein, 9 aa, Tick-borne encephalitis virus
LPKSHDMLC

SEQ ID NO: 184447 - protein, 9 aa, Tick-borne encephalitis virus
PKSHDMLCS

SEQ ID NO: 184448 - protein, 9 aa, Tick-borne encephalitis virus
KSHDMLCSS

SEQ ID NO: 184449 - protein, 9 aa, Tick-borne encephalitis virus
SHDMLCSSL

SEQ ID NO: 184450 - protein, 9 aa, Tick-borne encephalitis virus
HDMLCSSLV

SEQ ID NO: 184451 - protein, 9 aa, Tick-borne encephalitis virus
DMLCSSLVG

SEQ ID NO: 184452 - protein, 9 aa, Tick-borne encephalitis virus
MLCSSLVGR

SEQ ID NO: 184453 - protein, 9 aa, Tick-borne encephalitis virus
LCSSLVGRK

SEQ ID NO: 184454 - protein, 9 aa, Tick-borne encephalitis virus
CSSLVGRKE

SEQ ID NO: 184455 - protein, 9 aa, Tick-borne encephalitis virus
SSLVGRKER

SEQ ID NO: 184456 - protein, 9 aa, Tick-borne encephalitis virus
SLVGRKERA

SEQ ID NO: 184457 - protein, 9 aa, Tick-borne encephalitis virus
LVGRKERAE

SEQ ID NO: 184458 - protein, 9 aa, Tick-borne encephalitis virus
VGRKERAEW

SEQ ID NO: 184459 - protein, 9 aa, Tick-borne encephalitis virus
GRKERAEWA

SEQ ID NO: 184460 - protein, 9 aa, Tick-borne encephalitis virus
RKERAEWAK

SEQ ID NO: 184461 - protein, 9 aa, Tick-borne encephalitis virus
KERAEWAKN

SEQ ID NO: 184462 - protein, 9 aa, Tick-borne encephalitis virus
ERAEWAKNI

SEQ ID NO: 184463 - protein, 9 aa, Tick-borne encephalitis virus
RAEWAKNIW

SEQ ID NO: 184464 - protein, 9 aa, Tick-borne encephalitis virus
AEWAKNIWG

SEQ ID NO: 184465 - protein, 9 aa, Tick-borne encephalitis virus
EWAKNIWGA

SEQ ID NO: 184466 - protein, 9 aa, Tick-borne encephalitis virus
WAKNIWGAV

SEQ ID NO: 184467 - protein, 9 aa, Tick-borne encephalitis virus
AKNIWGAVE

SEQ ID NO: 184468 - protein, 9 aa, Tick-borne encephalitis virus
KNIWGAVEK

SEQ ID NO: 184469 - protein, 9 aa, Tick-borne encephalitis virus
NIWGAVEKV

SEQ ID NO: 184470 - protein, 9 aa, Tick-borne encephalitis virus
IWGAVEKVR

SEQ ID NO: 184471 - protein, 9 aa, Tick-borne encephalitis virus
WGAVEKVRK

SEQ ID NO: 184472 - protein, 9 aa, Tick-borne encephalitis virus
GAVEKVRKM

SEQ ID NO: 184473 - protein, 9 aa, Tick-borne encephalitis virus
AVEKVRKMI

SEQ ID NO: 184474 - protein, 9 aa, Tick-borne encephalitis virus
VEKVRKMIG

SEQ ID NO: 184475 - protein, 9 aa, Tick-borne encephalitis virus
KFKDYLSCM

SEQ ID NO: 184476 - protein, 9 aa, Tick-borne encephalitis virus
FKDYLSCMD

SEQ ID NO: 184477 - protein, 9 aa, Tick-borne encephalitis virus
KDYLSCMDR

SEQ ID NO: 184478 - protein, 9 aa, Tick-borne encephalitis virus
DYLSCMDRH

SEQ ID NO: 184479 - protein, 9 aa, Tick-borne encephalitis virus
YLSCMDRHD

SEQ ID NO: 184480 - protein, 9 aa, Tick-borne encephalitis virus
LSCMDRHDL

SEQ ID NO: 184481 - protein, 9 aa, Tick-borne encephalitis virus
SCMDRHDLH

SEQ ID NO: 184482 - protein, 9 aa, Tick-borne encephalitis virus
CMDRHDLHW

SEQ ID NO: 184483 - protein, 9 aa, Tick-borne encephalitis virus
MDRHDLHWE

SEQ ID NO: 184484 - protein, 9 aa, Tick-borne encephalitis virus
DRHDLHWEL

SEQ ID NO: 184485 - protein, 9 aa, Tick-borne encephalitis virus
RHDLHWELK

SEQ ID NO: 184486 - protein, 9 aa, Tick-borne encephalitis virus
HDLHWELKL

SEQ ID NO: 184487 - protein, 9 aa, Tick-borne encephalitis virus
DLHWELKLE

SEQ ID NO: 184488 - protein, 9 aa, Tick-borne encephalitis virus
LHWELKLES

SEQ ID NO: 184489 - protein, 9 aa, Tick-borne encephalitis virus
HWELKLESS

SEQ ID NO: 184490 - protein, 9 aa, Tick-borne encephalitis virus
WELKLESSI

SEQ ID NO: 184491 - protein, 9 aa, Tick-borne encephalitis virus
ELKLESSII

SEQ ID NO: 184492 - protein, 9 aa, Tick-borne encephalitis virus
MVKKAILKG

SEQ ID NO: 184493 - protein, 9 aa, Tick-borne encephalitis virus
VKKAILKGK

SEQ ID NO: 184494 - protein, 9 aa, Tick-borne encephalitis virus
KKAILKGKG

SEQ ID NO: 184495 - protein, 9 aa, Tick-borne encephalitis virus
KGGGPPRRA

SEQ ID NO: 184496 - protein, 9 aa, Tick-borne encephalitis virus
GGGPPRRAS

SEQ ID NO: 184497 - protein, 9 aa, Tick-borne encephalitis virus
GGPPRRASK

SEQ ID NO: 184498 - protein, 9 aa, Tick-borne encephalitis virus
GPPRRASKE

SEQ ID NO: 184499 - protein, 9 aa, Tick-borne encephalitis virus
PPRRVSKEA

SEQ ID NO: 184500 - protein, 9 aa, Tick-borne encephalitis virus
PRRASKETA

SEQ ID NO: 184501 - protein, 9 aa, Tick-borne encephalitis virus
RRVSKETAT

SEQ ID NO: 184502 - protein, 9 aa, Tick-borne encephalitis virus
RVSKETATK

SEQ ID NO: 184503 - protein, 9 aa, Tick-borne encephalitis virus
VSKETATKT

SEQ ID NO: 184504 - protein, 9 aa, Tick-borne encephalitis virus
SKETATKTR

SEQ ID NO: 184505 - protein, 9 aa, Tick-borne encephalitis virus
KETATKTRQ

SEQ ID NO: 184506 - protein, 9 aa, Tick-borne encephalitis virus
ETATKTRQP

SEQ ID NO: 184507 - protein, 9 aa, Tick-borne encephalitis virus
TATKTRQPR

SEQ ID NO: 184508 - protein, 9 aa, Tick-borne encephalitis virus
ATKTRQPRV

SEQ ID NO: 184509 - protein, 9 aa, Tick-borne encephalitis virus
KKTRQSRVR

SEQ ID NO: 184510 - protein, 9 aa, Tick-borne encephalitis virus
KTRQSRVRM

SEQ ID NO: 184511 - protein, 9 aa, Tick-borne encephalitis virus
TRQSRVRMP

SEQ ID NO: 184512 - protein, 9 aa, Tick-borne encephalitis virus
RQSRVRMPN

SEQ ID NO: 184513 - protein, 9 aa, Tick-borne encephalitis virus
QSRVRMPNG

SEQ ID NO: 184514 - protein, 9 aa, Tick-borne encephalitis virus
SRVRMPNGL

SEQ ID NO: 184515 - protein, 9 aa, Tick-borne encephalitis virus
RVRMPNGLV

SEQ ID NO: 184516 - protein, 9 aa, Tick-borne encephalitis virus
VRMPNGLVL

SEQ ID NO: 184517 - protein, 9 aa, Tick-borne encephalitis virus
RMPNGLVLM

SEQ ID NO: 184518 - protein, 9 aa, Tick-borne encephalitis virus
MPSGLVLMR

SEQ ID NO: 184519 - protein, 9 aa, Tick-borne encephalitis virus
PSGLVLMRM

SEQ ID NO: 184520 - protein, 9 aa, Tick-borne encephalitis virus
NGLVLMRML

SEQ ID NO: 184521 - protein, 9 aa, Tick-borne encephalitis virus
GLVLMRMLG

SEQ ID NO: 184522 - protein, 9 aa, Tick-borne encephalitis virus
LVLMRMLGI

SEQ ID NO: 184523 - protein, 9 aa, Tick-borne encephalitis virus
VLMRMLGIL

SEQ ID NO: 184524 - protein, 9 aa, Tick-borne encephalitis virus
LMRMLGILW

SEQ ID NO: 184525 - protein, 9 aa, Tick-borne encephalitis virus
MRMLGILWH

SEQ ID NO: 184526 - protein, 9 aa, Tick-borne encephalitis virus
RMLGILWHA

SEQ ID NO: 184527 - protein, 9 aa, Tick-borne encephalitis virus
MMGILWHAI

SEQ ID NO: 184528 - protein, 9 aa, Tick-borne encephalitis virus
MGILWHAIA

SEQ ID NO: 184529 - protein, 9 aa, Tick-borne encephalitis virus
GILWHAIAG

SEQ ID NO: 184530 - protein, 9 aa, Tick-borne encephalitis virus
ILWHAIAGT

SEQ ID NO: 184531 - protein, 9 aa, Tick-borne encephalitis virus
LWHAIAGTA

SEQ ID NO: 184532 - protein, 9 aa, Tick-borne encephalitis virus
WHAIAGTAR

SEQ ID NO: 184533 - protein, 9 aa, Tick-borne encephalitis virus
HAVAGTARN

SEQ ID NO: 184534 - protein, 9 aa, Tick-borne encephalitis virus
AVAGTARNP

SEQ ID NO: 184535 - protein, 9 aa, Tick-borne encephalitis virus
VAGTARNPV

SEQ ID NO: 184536 - protein, 9 aa, Tick-borne encephalitis virus
AGTARNPVL

SEQ ID NO: 184537 - protein, 9 aa, Tick-borne encephalitis virus
GTARNPVLK

SEQ ID NO: 184538 - protein, 9 aa, Tick-borne encephalitis virus
TARNPVLKA

SEQ ID NO: 184539 - protein, 9 aa, Tick-borne encephalitis virus
ARNPVLKAF

SEQ ID NO: 184540 - protein, 9 aa, Tick-borne encephalitis virus
RNPVLKAFW

SEQ ID NO: 184541 - protein, 9 aa, Tick-borne encephalitis virus
NPVLKAFWN

SEQ ID NO: 184542 - protein, 9 aa, Tick-borne encephalitis virus
PVLKAFWNS

SEQ ID NO: 184543 - protein, 9 aa, Tick-borne encephalitis virus
VLKAFWNSV

SEQ ID NO: 184544 - protein, 9 aa, Tick-borne encephalitis virus
LKAFWNSVP

SEQ ID NO: 184545 - protein, 9 aa, Tick-borne encephalitis virus
KAFWNSVPL

SEQ ID NO: 184546 - protein, 9 aa, Tick-borne encephalitis virus
SFWNSVPLR

SEQ ID NO: 184547 - protein, 9 aa, Tick-borne encephalitis virus
FWNSVPLRQ

SEQ ID NO: 184548 - protein, 9 aa, Tick-borne encephalitis virus
WNSVPLRQA

SEQ ID NO: 184549 - protein, 9 aa, Tick-borne encephalitis virus
NSVPLRQAT

SEQ ID NO: 184550 - protein, 9 aa, Tick-borne encephalitis virus
SVPLRQATA

SEQ ID NO: 184551 - protein, 9 aa, Tick-borne encephalitis virus
VPLRQATAA

SEQ ID NO: 184552 - protein, 9 aa, Tick-borne encephalitis virus
PLRQATAAL

SEQ ID NO: 184553 - protein, 9 aa, Tick-borne encephalitis virus
LRQATAALR

SEQ ID NO: 184554 - protein, 9 aa, Tick-borne encephalitis virus
RQATAALRK

SEQ ID NO: 184555 - protein, 9 aa, Tick-borne encephalitis virus
QAMAALRKI

SEQ ID NO: 184556 - protein, 9 aa, Tick-borne encephalitis virus
AMAALRKIK

SEQ ID NO: 184557 - protein, 9 aa, Tick-borne encephalitis virus
TAALRKIKR

SEQ ID NO: 184558 - protein, 9 aa, Tick-borne encephalitis virus
AALRKIKRT

SEQ ID NO: 184559 - protein, 9 aa, Tick-borne encephalitis virus
ALRKIKRTV

SEQ ID NO: 184560 - protein, 9 aa, Tick-borne encephalitis virus
LRKIKRTVS

SEQ ID NO: 184561 - protein, 9 aa, Tick-borne encephalitis virus
RKIKRTVSA

SEQ ID NO: 184562 - protein, 9 aa, Tick-borne encephalitis virus
KIKRTVSAL

SEQ ID NO: 184563 - protein, 9 aa, Tick-borne encephalitis virus
IKRTVSALM

SEQ ID NO: 184564 - protein, 9 aa, Tick-borne encephalitis virus
TVSALMVGL

SEQ ID NO: 184565 - protein, 9 aa, Tick-borne encephalitis virus
VSALMVGLQ

SEQ ID NO: 184566 - protein, 9 aa, Tick-borne encephalitis virus
LMVGLQKRG

SEQ ID NO: 184567 - protein, 9 aa, Tick-borne encephalitis virus
MVGLQKRGK

SEQ ID NO: 184568 - protein, 9 aa, Tick-borne encephalitis virus
VGLQKRGKR

SEQ ID NO: 184569 - protein, 9 aa, Tick-borne encephalitis virus
GLQKRGKRR

SEQ ID NO: 184570 - protein, 9 aa, Tick-borne encephalitis virus
LQKRGKRRS

SEQ ID NO: 184571 - protein, 9 aa, Tick-borne encephalitis virus
QKRGKRRSA

SEQ ID NO: 184572 - protein, 9 aa, Tick-borne encephalitis virus
AFAATVRRE

SEQ ID NO: 184573 - protein, 9 aa, Tick-borne encephalitis virus
LAATVRKEG

SEQ ID NO: 184574 - protein, 9 aa, Tick-borne encephalitis virus
AATVRKEGD

SEQ ID NO: 184575 - protein, 9 aa, Tick-borne encephalitis virus
ATVRKEGDG

SEQ ID NO: 184576 - protein, 9 aa, Tick-borne encephalitis virus
TVRKERDGS

SEQ ID NO: 184577 - protein, 9 aa, Tick-borne encephalitis virus
VRKERDGST

SEQ ID NO: 184578 - protein, 9 aa, Tick-borne encephalitis virus
RKERDGSTV

SEQ ID NO: 184579 - protein, 9 aa, Tick-borne encephalitis virus
KERDGSTVI

SEQ ID NO: 184580 - protein, 9 aa, Tick-borne encephalitis virus
ERDGSTVIR

SEQ ID NO: 184581 - protein, 9 aa, Tick-borne encephalitis virus
RDGSTVIRA

SEQ ID NO: 184582 - protein, 9 aa, Tick-borne encephalitis virus
DGSTVIRAE

SEQ ID NO: 184583 - protein, 9 aa, Tick-borne encephalitis virus
GSTVIRAEG

SEQ ID NO: 184584 - protein, 9 aa, Tick-borne encephalitis virus
STVIRAEGK

SEQ ID NO: 184585 - protein, 9 aa, Tick-borne encephalitis virus
TVIRAEGRD

SEQ ID NO: 184586 - protein, 9 aa, Tick-borne encephalitis virus
VIRAEGRDA

SEQ ID NO: 184587 - protein, 9 aa, Tick-borne encephalitis virus
IRAEGRDAA

SEQ ID NO: 184588 - protein, 9 aa, Tick-borne encephalitis virus
RAEGRDAAT

SEQ ID NO: 184589 - protein, 9 aa, Tick-borne encephalitis virus
AEGRDAATQ

SEQ ID NO: 184590 - protein, 9 aa, Tick-borne encephalitis virus
EGRDAATQV

SEQ ID NO: 184591 - protein, 9 aa, Tick-borne encephalitis virus
GRDAATQVR

SEQ ID NO: 184592 - protein, 9 aa, Tick-borne encephalitis virus
RDAATQVRV

SEQ ID NO: 184593 - protein, 9 aa, Tick-borne encephalitis virus
VENGTCVIM

SEQ ID NO: 184594 - protein, 9 aa, Tick-borne encephalitis virus
ENGTCVILV

SEQ ID NO: 184595 - protein, 9 aa, Tick-borne encephalitis virus
NGTCVILVT

SEQ ID NO: 184596 - protein, 9 aa, Tick-borne encephalitis virus
GTCVILVTD

SEQ ID NO: 184597 - protein, 9 aa, Tick-borne encephalitis virus
TCVILVTDM

SEQ ID NO: 184598 - protein, 9 aa, Tick-borne encephalitis virus
CVILVTDMG

SEQ ID NO: 184599 - protein, 9 aa, Tick-borne encephalitis virus
VILVTDMGS

SEQ ID NO: 184600 - protein, 9 aa, Tick-borne encephalitis virus
ILVTDMGSW

SEQ ID NO: 184601 - protein, 9 aa, Tick-borne encephalitis virus
LVTDMGSWC

SEQ ID NO: 184602 - protein, 9 aa, Tick-borne encephalitis virus
VTDMGSWCD

SEQ ID NO: 184603 - protein, 9 aa, Tick-borne encephalitis virus
TDMGAWCDD

SEQ ID NO: 184604 - protein, 9 aa, Tick-borne encephalitis virus
DMGAWCDDS

SEQ ID NO: 184605 - protein, 9 aa, Tick-borne encephalitis virus
MGAWCDDSL

SEQ ID NO: 184606 - protein, 9 aa, Tick-borne encephalitis virus
GSWCDDSLS

SEQ ID NO: 184607 - protein, 9 aa, Tick-borne encephalitis virus
SWCDDSLSY

SEQ ID NO: 184608 - protein, 9 aa, Tick-borne encephalitis virus
WCDDSLSYE

SEQ ID NO: 184609 - protein, 9 aa, Tick-borne encephalitis virus
CDDSLSYEC

SEQ ID NO: 184610 - protein, 9 aa, Tick-borne encephalitis virus
DDSLSYECV

SEQ ID NO: 184611 - protein, 9 aa, Tick-borne encephalitis virus
DSLSYECVT

SEQ ID NO: 184612 - protein, 9 aa, Tick-borne encephalitis virus
SLSYECVTI

SEQ ID NO: 184613 - protein, 9 aa, Tick-borne encephalitis virus
LSYECVTID

SEQ ID NO: 184614 - protein, 9 aa, Tick-borne encephalitis virus
SYECVTIDQ

SEQ ID NO: 184615 - protein, 9 aa, Tick-borne encephalitis virus
DCFCRNVDR

SEQ ID NO: 184616 - protein, 9 aa, Tick-borne encephalitis virus
CFCRNVDRV

SEQ ID NO: 184617 - protein, 9 aa, Tick-borne encephalitis virus
FCRNVDGVH

SEQ ID NO: 184618 - protein, 9 aa, Tick-borne encephalitis virus
CRNVDGVHL

SEQ ID NO: 184619 - protein, 9 aa, Tick-borne encephalitis virus
RNVDGVHLE

SEQ ID NO: 184620 - protein, 9 aa, Tick-borne encephalitis virus
NVDGVHLEY

SEQ ID NO: 184621 - protein, 9 aa, Tick-borne encephalitis virus
VDGVHLEYG

SEQ ID NO: 184622 - protein, 9 aa, Tick-borne encephalitis virus
DGVHLEYGR

SEQ ID NO: 184623 - protein, 9 aa, Tick-borne encephalitis virus
GVHLEYGRC

SEQ ID NO: 184624 - protein, 9 aa, Tick-borne encephalitis virus
VHLEYGRCG

SEQ ID NO: 184625 - protein, 9 aa, Tick-borne encephalitis virus
HLEYGRCGK

SEQ ID NO: 184626 - protein, 9 aa, Tick-borne encephalitis virus
RTRRSVLIR

SEQ ID NO: 184627 - protein, 9 aa, Tick-borne encephalitis virus
TRRSVLIRS

SEQ ID NO: 184628 - protein, 9 aa, Tick-borne encephalitis virus
RRSVLIRSH

SEQ ID NO: 184629 - protein, 9 aa, Tick-borne encephalitis virus
RSVLIRSHA

SEQ ID NO: 184630 - protein, 9 aa, Tick-borne encephalitis virus
SVLIRSHAQ

SEQ ID NO: 184631 - protein, 9 aa, Tick-borne encephalitis virus
VLIRSHAQG

SEQ ID NO: 184632 - protein, 9 aa, Tick-borne encephalitis virus
LIPSHAQGE

SEQ ID NO: 184633 - protein, 9 aa, Tick-borne encephalitis virus
IPSHAQGEL

SEQ ID NO: 184634 - protein, 9 aa, Tick-borne encephalitis virus
PSHAQGELT

SEQ ID NO: 184635 - protein, 9 aa, Tick-borne encephalitis virus
SHAQGELTG

SEQ ID NO: 184636 - protein, 9 aa, Tick-borne encephalitis virus
HAQGELTGR

SEQ ID NO: 184637 - protein, 9 aa, Tick-borne encephalitis virus
AQGELTGRG

SEQ ID NO: 184638 - protein, 9 aa, Tick-borne encephalitis virus
QGELTGRGH

SEQ ID NO: 184639 - protein, 9 aa, Tick-borne encephalitis virus
GELTGRGHK

SEQ ID NO: 184640 - protein, 9 aa, Tick-borne encephalitis virus
ELTGRGHKW

SEQ ID NO: 184641 - protein, 9 aa, Tick-borne encephalitis virus
LTGRGRKWL

SEQ ID NO: 184642 - protein, 9 aa, Tick-borne encephalitis virus
TGRGRKWLE

SEQ ID NO: 184643 - protein, 9 aa, Tick-borne encephalitis virus
GRGRKWLEG

SEQ ID NO: 184644 - protein, 9 aa, Tick-borne encephalitis virus
RGRKWLEGD

SEQ ID NO: 184645 - protein, 9 aa, Tick-borne encephalitis virus
GRKWLEGDS

SEQ ID NO: 184646 - protein, 9 aa, Tick-borne encephalitis virus
RKWLEGDSL

SEQ ID NO: 184647 - protein, 9 aa, Tick-borne encephalitis virus
VEGWVWKNR

SEQ ID NO: 184648 - protein, 9 aa, Tick-borne encephalitis virus
VVWLTLESV

SEQ ID NO: 184649 - protein, 9 aa, Tick-borne encephalitis virus
VWLTLESVV

SEQ ID NO: 184650 - protein, 9 aa, Tick-borne encephalitis virus
WLTLESVVT

SEQ ID NO: 184651 - protein, 9 aa, Tick-borne encephalitis virus
LTLESVVTR

SEQ ID NO: 184652 - protein, 9 aa, Tick-borne encephalitis virus
TLESVVTRV

SEQ ID NO: 184653 - protein, 9 aa, Tick-borne encephalitis virus
LVVLLCLAP

SEQ ID NO: 184654 - protein, 9 aa, Tick-borne encephalitis virus
VVLFCLAPV

SEQ ID NO: 184655 - protein, 9 aa, Tick-borne encephalitis virus
ALLCLAPVY

SEQ ID NO: 184656 - protein, 9 aa, Tick-borne encephalitis virus
LFCLAPVYA

SEQ ID NO: 184657 - protein, 9 aa, Tick-borne encephalitis virus
FCLAPVYAS

SEQ ID NO: 184658 - protein, 9 aa, Tick-borne encephalitis virus
PSMDVWLDA

SEQ ID NO: 184659 - protein, 9 aa, Tick-borne encephalitis virus
SMDVWLDAI

SEQ ID NO: 184660 - protein, 9 aa, Tick-borne encephalitis virus
MDVWLDAIY

SEQ ID NO: 184661 - protein, 9 aa, Tick-borne encephalitis virus
DVWLDAIYQ

SEQ ID NO: 184662 - protein, 9 aa, Tick-borne encephalitis virus
VWLDAIYQE

SEQ ID NO: 184663 - protein, 9 aa, Tick-borne encephalitis virus
WLDAIYQEN

SEQ ID NO: 184664 - protein, 9 aa, Tick-borne encephalitis virus
LDAIYQENP

SEQ ID NO: 184665 - protein, 9 aa, Tick-borne encephalitis virus
DAIYQENPA

SEQ ID NO: 184666 - protein, 9 aa, Tick-borne encephalitis virus
AIYQENPAK

SEQ ID NO: 184667 - protein, 9 aa, Tick-borne encephalitis virus
IYQESPAKT

SEQ ID NO: 184668 - protein, 9 aa, Tick-borne encephalitis virus
YQESPAKTR

SEQ ID NO: 184669 - protein, 9 aa, Tick-borne encephalitis virus
QESPAKTRE

SEQ ID NO: 184670 - protein, 9 aa, Tick-borne encephalitis virus
ESPAKTREY

SEQ ID NO: 184671 - protein, 9 aa, Tick-borne encephalitis virus
SPAKTREYC

SEQ ID NO: 184672 - protein, 9 aa, Tick-borne encephalitis virus
PAQTREYCL

SEQ ID NO: 184673 - protein, 9 aa, Tick-borne encephalitis virus
AQTREYCLH

SEQ ID NO: 184674 - protein, 9 aa, Tick-borne encephalitis virus
KTREYCLHV

SEQ ID NO: 184675 - protein, 9 aa, Tick-borne encephalitis virus
TREYCLHVK

SEQ ID NO: 184676 - protein, 9 aa, Tick-borne encephalitis virus
REYCLHVKL

SEQ ID NO: 184677 - protein, 9 aa, Tick-borne encephalitis virus
EYCLHVKLS

SEQ ID NO: 184678 - protein, 9 aa, Tick-borne encephalitis virus
YCLHVKLSD

SEQ ID NO: 184679 - protein, 9 aa, Tick-borne encephalitis virus
CLHVKLSDT

SEQ ID NO: 184680 - protein, 9 aa, Tick-borne encephalitis virus
LHVKLSDTK

SEQ ID NO: 184681 - protein, 9 aa, Tick-borne encephalitis virus
HVKLSDTKV

SEQ ID NO: 184682 - protein, 9 aa, Tick-borne encephalitis virus
VKLSDTKVA

SEQ ID NO: 184683 - protein, 9 aa, Tick-borne encephalitis virus
KVAARCPTT

SEQ ID NO: 184684 - protein, 9 aa, Tick-borne encephalitis virus
VAARCPTTG

SEQ ID NO: 184685 - protein, 9 aa, Tick-borne encephalitis virus
AARCPTTGP

SEQ ID NO: 184686 - protein, 9 aa, Tick-borne encephalitis virus
ARCPTTGPA

SEQ ID NO: 184687 - protein, 9 aa, Tick-borne encephalitis virus
RCPTTGPAT

SEQ ID NO: 184688 - protein, 9 aa, Tick-borne encephalitis virus
CPTTGPATL

SEQ ID NO: 184689 - protein, 9 aa, Tick-borne encephalitis virus
PTTGPATLA

SEQ ID NO: 184690 - protein, 9 aa, Tick-borne encephalitis virus
TMGPATLTE

SEQ ID NO: 184691 - protein, 9 aa, Tick-borne encephalitis virus
TGPATLAEQ

SEQ ID NO: 184692 - protein, 9 aa, Tick-borne encephalitis virus
GPATLAEQH

SEQ ID NO: 184693 - protein, 9 aa, Tick-borne encephalitis virus
PATLTEEHQ

SEQ ID NO: 184694 - protein, 9 aa, Tick-borne encephalitis virus
ATLAEEHQG

SEQ ID NO: 184695 - protein, 9 aa, Tick-borne encephalitis virus
TLAEEHQGG

SEQ ID NO: 184696 - protein, 9 aa, Tick-borne encephalitis virus
LAEEHQGGT

SEQ ID NO: 184697 - protein, 9 aa, Tick-borne encephalitis virus
AEEHQGGTV

SEQ ID NO: 184698 - protein, 9 aa, Tick-borne encephalitis virus
EEHQGGTVC

SEQ ID NO: 184699 - protein, 9 aa, Tick-borne encephalitis virus
EHQGGTVCK

SEQ ID NO: 184700 - protein, 9 aa, Tick-borne encephalitis virus
HQGGTVCKR

SEQ ID NO: 184701 - protein, 9 aa, Tick-borne encephalitis virus
QGGTVCKRD

SEQ ID NO: 184702 - protein, 9 aa, Tick-borne encephalitis virus
GGTVCKRDQ

SEQ ID NO: 184703 - protein, 9 aa, Tick-borne encephalitis virus
LFGKGSIVA

SEQ ID NO: 184704 - protein, 9 aa, Tick-borne encephalitis virus
FGKGSIVAC

SEQ ID NO: 184705 - protein, 9 aa, Tick-borne encephalitis virus
GKGSIVACV

SEQ ID NO: 184706 - protein, 9 aa, Tick-borne encephalitis virus
KGSIVACVK

SEQ ID NO: 184707 - protein, 9 aa, Tick-borne encephalitis virus
GSIVACVKA

SEQ ID NO: 184708 - protein, 9 aa, Tick-borne encephalitis virus
SIVACVKAA

SEQ ID NO: 184709 - protein, 9 aa, Tick-borne encephalitis virus
IVACVKAAC

SEQ ID NO: 184710 - protein, 9 aa, Tick-borne encephalitis virus
VACVKAACE

SEQ ID NO: 184711 - protein, 9 aa, Tick-borne encephalitis virus
ACVKAACEA

SEQ ID NO: 184712 - protein, 9 aa, Tick-borne encephalitis virus
CVKAACEAK

SEQ ID NO: 184713 - protein, 9 aa, Tick-borne encephalitis virus
VKAACEAKK

SEQ ID NO: 184714 - protein, 9 aa, Tick-borne encephalitis virus
KAACEAKKK

SEQ ID NO: 184715 - protein, 9 aa, Tick-borne encephalitis virus
AACEAKKKA

SEQ ID NO: 184716 - protein, 9 aa, Tick-borne encephalitis virus
ACEAKKKAT

SEQ ID NO: 184717 - protein, 9 aa, Tick-borne encephalitis virus
KATGHVYDP

SEQ ID NO: 184718 - protein, 9 aa, Tick-borne encephalitis virus
ATGHVYDPN

SEQ ID NO: 184719 - protein, 9 aa, Tick-borne encephalitis virus
TGHVYDANR

SEQ ID NO: 184720 - protein, 9 aa, Tick-borne encephalitis virus
GHVYDANRI

SEQ ID NO: 184721 - protein, 9 aa, Tick-borne encephalitis virus
HVYDPNKIV

SEQ ID NO: 184722 - protein, 9 aa, Tick-borne encephalitis virus
VYDPNKIVY

SEQ ID NO: 184723 - protein, 9 aa, Tick-borne encephalitis virus
YDANRIVYT

SEQ ID NO: 184724 - protein, 9 aa, Tick-borne encephalitis virus
DANKIVYTI

SEQ ID NO: 184725 - protein, 9 aa, Tick-borne encephalitis virus
ANRIVYTVK

SEQ ID NO: 184726 - protein, 9 aa, Tick-borne encephalitis virus
NKIVYPVKV

SEQ ID NO: 184727 - protein, 9 aa, Tick-borne encephalitis virus
KIVYTIKVE

SEQ ID NO: 184728 - protein, 9 aa, Tick-borne encephalitis virus
IVYTIKVEP

SEQ ID NO: 184729 - protein, 9 aa, Tick-borne encephalitis virus
VYPVKVEPH

SEQ ID NO: 184730 - protein, 9 aa, Tick-borne encephalitis virus
YTIKVEPHT

SEQ ID NO: 184731 - protein, 9 aa, Tick-borne encephalitis virus
PVKVEPHTG

SEQ ID NO: 184732 - protein, 9 aa, Tick-borne encephalitis virus
IKVEPHTGD

SEQ ID NO: 184733 - protein, 9 aa, Tick-borne encephalitis virus
PHTGDYVAV

SEQ ID NO: 184734 - protein, 9 aa, Tick-borne encephalitis virus
HTGDYVAPH

SEQ ID NO: 184735 - protein, 9 aa, Tick-borne encephalitis virus
TGDYVAVNE

SEQ ID NO: 184736 - protein, 9 aa, Tick-borne encephalitis virus
GDYVAPHET

SEQ ID NO: 184737 - protein, 9 aa, Tick-borne encephalitis virus
DYVAVNETH

SEQ ID NO: 184738 - protein, 9 aa, Tick-borne encephalitis virus
YVAPHETHS

SEQ ID NO: 184739 - protein, 9 aa, Tick-borne encephalitis virus
VAPHETHSG

SEQ ID NO: 184740 - protein, 9 aa, Tick-borne encephalitis virus
APHETHSGR

SEQ ID NO: 184741 - protein, 9 aa, Tick-borne encephalitis virus
PHETHSGRK

SEQ ID NO: 184742 - protein, 9 aa, Tick-borne encephalitis virus
HETHSGRKT

SEQ ID NO: 184743 - protein, 9 aa, Tick-borne encephalitis virus
ETHSGRKTP

SEQ ID NO: 184744 - protein, 9 aa, Tick-borne encephalitis virus
THSGRKTPS

SEQ ID NO: 184745 - protein, 9 aa, Tick-borne encephalitis virus
HSGRKTPSF

SEQ ID NO: 184746 - protein, 9 aa, Tick-borne encephalitis virus
SGRKTPSFT

SEQ ID NO: 184747 - protein, 9 aa, Tick-borne encephalitis virus
GRKTASFTI

SEQ ID NO: 184748 - protein, 9 aa, Tick-borne encephalitis virus
RKTASFTIS

SEQ ID NO: 184749 - protein, 9 aa, Tick-borne encephalitis virus
KTASFTISS

SEQ ID NO: 184750 - protein, 9 aa, Tick-borne encephalitis virus
TASFTISSE

SEQ ID NO: 184751 - protein, 9 aa, Tick-borne encephalitis virus
ASFTISSEK

SEQ ID NO: 184752 - protein, 9 aa, Tick-borne encephalitis virus
SFTISSEKT

SEQ ID NO: 184753 - protein, 9 aa, Tick-borne encephalitis virus
FTISSEKTI

SEQ ID NO: 184754 - protein, 9 aa, Tick-borne encephalitis virus
TISSEKTIL

SEQ ID NO: 184755 - protein, 9 aa, Tick-borne encephalitis virus
ISSEKTILT

SEQ ID NO: 184756 - protein, 9 aa, Tick-borne encephalitis virus
SSEKTILNM

SEQ ID NO: 184757 - protein, 9 aa, Tick-borne encephalitis virus
SEKTILNMG

SEQ ID NO: 184758 - protein, 9 aa, Tick-borne encephalitis virus
EKTILTMGE

SEQ ID NO: 184759 - protein, 9 aa, Tick-borne encephalitis virus
KTILTMGEY

SEQ ID NO: 184760 - protein, 9 aa, Tick-borne encephalitis virus
TILTMGEYG

SEQ ID NO: 184761 - protein, 9 aa, Tick-borne encephalitis virus
ILTMGEYGD

SEQ ID NO: 184762 - protein, 9 aa, Tick-borne encephalitis virus
LTMGEYGDV

SEQ ID NO: 184763 - protein, 9 aa, Tick-borne encephalitis virus
TMGEYGDVS

SEQ ID NO: 184764 - protein, 9 aa, Tick-borne encephalitis virus
MGEYGDVSL

SEQ ID NO: 184765 - protein, 9 aa, Tick-borne encephalitis virus
GEYGDVSLL

SEQ ID NO: 184766 - protein, 9 aa, Tick-borne encephalitis virus
EYGDVSLLC

SEQ ID NO: 184767 - protein, 9 aa, Tick-borne encephalitis virus
YGDVSLLCK

SEQ ID NO: 184768 - protein, 9 aa, Tick-borne encephalitis virus
GDVSLLCKV

SEQ ID NO: 184769 - protein, 9 aa, Tick-borne encephalitis virus
DVSLLCKVP

SEQ ID NO: 184770 - protein, 9 aa, Tick-borne encephalitis virus
VSLLCKVPS

SEQ ID NO: 184771 - protein, 9 aa, Tick-borne encephalitis virus
SLLCKVPSG

SEQ ID NO: 184772 - protein, 9 aa, Tick-borne encephalitis virus
LLCKVPSGV

SEQ ID NO: 184773 - protein, 9 aa, Tick-borne encephalitis virus
LCKVPSGVD

SEQ ID NO: 184774 - protein, 9 aa, Tick-borne encephalitis virus
CKVPSGVDL

SEQ ID NO: 184775 - protein, 9 aa, Tick-borne encephalitis virus
KVPSGVDLA

SEQ ID NO: 184776 - protein, 9 aa, Tick-borne encephalitis virus
VPSGVDLAQ

SEQ ID NO: 184777 - protein, 9 aa, Tick-borne encephalitis virus
PSGVDLAQT

SEQ ID NO: 184778 - protein, 9 aa, Tick-borne encephalitis virus
VILELDKTV

SEQ ID NO: 184779 - protein, 9 aa, Tick-borne encephalitis virus
ILELDKTVE

SEQ ID NO: 184780 - protein, 9 aa, Tick-borne encephalitis virus
LELDKTVEH

SEQ ID NO: 184781 - protein, 9 aa, Tick-borne encephalitis virus
ELDKTVEHL

SEQ ID NO: 184782 - protein, 9 aa, Tick-borne encephalitis virus
LDKTVEHLP

SEQ ID NO: 184783 - protein, 9 aa, Tick-borne encephalitis virus
DKTVEHLPT

SEQ ID NO: 184784 - protein, 9 aa, Tick-borne encephalitis virus
KTVEHLPTA

SEQ ID NO: 184785 - protein, 9 aa, Tick-borne encephalitis virus
TVEHLPTAW

SEQ ID NO: 184786 - protein, 9 aa, Tick-borne encephalitis virus
VEHLPTAWQ

SEQ ID NO: 184787 - protein, 9 aa, Tick-borne encephalitis virus
HLPTAWQVR

SEQ ID NO: 184788 - protein, 9 aa, Tick-borne encephalitis virus
LPTAWQVRR

SEQ ID NO: 184789 - protein, 9 aa, Tick-borne encephalitis virus
PTAWQVRRD

SEQ ID NO: 184790 - protein, 9 aa, Tick-borne encephalitis virus
TAWQVRRDW

SEQ ID NO: 184791 - protein, 9 aa, Tick-borne encephalitis virus
AWQVRRDWF

SEQ ID NO: 184792 - protein, 9 aa, Tick-borne encephalitis virus
WQVRRDWFN

SEQ ID NO: 184793 - protein, 9 aa, Tick-borne encephalitis virus
QVRRDWFND

SEQ ID NO: 184794 - protein, 9 aa, Tick-borne encephalitis virus
VRRDWFNDL

SEQ ID NO: 184795 - protein, 9 aa, Tick-borne encephalitis virus
RRDWFNDLA

SEQ ID NO: 184796 - protein, 9 aa, Tick-borne encephalitis virus
FNDLALPWR

SEQ ID NO: 184797 - protein, 9 aa, Tick-borne encephalitis virus
NDLALPWRH

SEQ ID NO: 184798 - protein, 9 aa, Tick-borne encephalitis virus
DLALPWRHE

SEQ ID NO: 184799 - protein, 9 aa, Tick-borne encephalitis virus
LALPWRHEG

SEQ ID NO: 184800 - protein, 9 aa, Tick-borne encephalitis virus
ALPWRHEGA

SEQ ID NO: 184801 - protein, 9 aa, Tick-borne encephalitis virus
LPWRHEGAQ

SEQ ID NO: 184802 - protein, 9 aa, Tick-borne encephalitis virus
HEGAQQWNN

SEQ ID NO: 184803 - protein, 9 aa, Tick-borne encephalitis virus
EGAQQWNNA

SEQ ID NO: 184804 - protein, 9 aa, Tick-borne encephalitis virus
GAQQWNNAE

SEQ ID NO: 184805 - protein, 9 aa, Tick-borne encephalitis virus
AQQWNNAER

SEQ ID NO: 184806 - protein, 9 aa, Tick-borne encephalitis virus
QQWNNAERL

SEQ ID NO: 184807 - protein, 9 aa, Tick-borne encephalitis virus
QWNNAERLV

SEQ ID NO: 184808 - protein, 9 aa, Tick-borne encephalitis virus
AERLVEFGV

SEQ ID NO: 184809 - protein, 9 aa, Tick-borne encephalitis virus
ERLVEFGVP

SEQ ID NO: 184810 - protein, 9 aa, Tick-borne encephalitis virus
RLVEFGVPH

SEQ ID NO: 184811 - protein, 9 aa, Tick-borne encephalitis virus
LVEFGVPHA

SEQ ID NO: 184812 - protein, 9 aa, Tick-borne encephalitis virus
VEFGVPHAV

SEQ ID NO: 184813 - protein, 9 aa, Tick-borne encephalitis virus
EFGVPHAVK

SEQ ID NO: 184814 - protein, 9 aa, Tick-borne encephalitis virus
FGVPHAVKM

SEQ ID NO: 184815 - protein, 9 aa, Tick-borne encephalitis virus
GVPHAVKMD

SEQ ID NO: 184816 - protein, 9 aa, Tick-borne encephalitis virus
VPHAVKMDV

SEQ ID NO: 184817 - protein, 9 aa, Tick-borne encephalitis virus
DQTGVLLKA

SEQ ID NO: 184818 - protein, 9 aa, Tick-borne encephalitis virus
QTGVLLKAL

SEQ ID NO: 184819 - protein, 9 aa, Tick-borne encephalitis virus
TGVLLKALA

SEQ ID NO: 184820 - protein, 9 aa, Tick-borne encephalitis virus
GVLLKALAG

SEQ ID NO: 184821 - protein, 9 aa, Tick-borne encephalitis virus
VLLKALAGV

SEQ ID NO: 184822 - protein, 9 aa, Tick-borne encephalitis virus
LLKALAGVP

SEQ ID NO: 184823 - protein, 9 aa, Tick-borne encephalitis virus
LKALAGVPV

SEQ ID NO: 184824 - protein, 9 aa, Tick-borne encephalitis virus
KALAGVPVA

SEQ ID NO: 184825 - protein, 9 aa, Tick-borne encephalitis virus
ALAGVPVAH

SEQ ID NO: 184826 - protein, 9 aa, Tick-borne encephalitis virus
AGVPVAHIE

SEQ ID NO: 184827 - protein, 9 aa, Tick-borne encephalitis virus
GVPVAHIEG

SEQ ID NO: 184828 - protein, 9 aa, Tick-borne encephalitis virus
VPVAHIEGT

SEQ ID NO: 184829 - protein, 9 aa, Tick-borne encephalitis virus
PVAHIEGTK

SEQ ID NO: 184830 - protein, 9 aa, Tick-borne encephalitis virus
VAHIEGTKY

SEQ ID NO: 184831 - protein, 9 aa, Tick-borne encephalitis virus
AHIEGTKYH

SEQ ID NO: 184832 - protein, 9 aa, Tick-borne encephalitis virus
HIEGTKYHL

SEQ ID NO: 184833 - protein, 9 aa, Tick-borne encephalitis virus
IEGTKYHLK

SEQ ID NO: 184834 - protein, 9 aa, Tick-borne encephalitis virus
EGTKYHLKS

SEQ ID NO: 184835 - protein, 9 aa, Tick-borne encephalitis virus
GAKYHLKSG

SEQ ID NO: 184836 - protein, 9 aa, Tick-borne encephalitis virus
AKYHLKSGH

SEQ ID NO: 184837 - protein, 9 aa, Tick-borne encephalitis virus
VGLEKLKMN

SEQ ID NO: 184838 - protein, 9 aa, Tick-borne encephalitis virus
GLEKLKMNG

SEQ ID NO: 184839 - protein, 9 aa, Tick-borne encephalitis virus
LEKLKMNGL

SEQ ID NO: 184840 - protein, 9 aa, Tick-borne encephalitis virus
EKLKMNGLT

SEQ ID NO: 184841 - protein, 9 aa, Tick-borne encephalitis virus
KLKMNGLTY

SEQ ID NO: 184842 - protein, 9 aa, Tick-borne encephalitis virus
LKMNGLTYT

SEQ ID NO: 184843 - protein, 9 aa, Tick-borne encephalitis virus
KMKGLTYTV

SEQ ID NO: 184844 - protein, 9 aa, Tick-borne encephalitis virus
MKGLTYTVC

SEQ ID NO: 184845 - protein, 9 aa, Tick-borne encephalitis virus
KGLTYTVCD

SEQ ID NO: 184846 - protein, 9 aa, Tick-borne encephalitis virus
GLTYTVCDK

SEQ ID NO: 184847 - protein, 9 aa, Tick-borne encephalitis virus
LTYTVCDKT

SEQ ID NO: 184848 - protein, 9 aa, Tick-borne encephalitis virus
TYTVCDKTK

SEQ ID NO: 184849 - protein, 9 aa, Tick-borne encephalitis virus
YTVCDKTKF

SEQ ID NO: 184850 - protein, 9 aa, Tick-borne encephalitis virus
TMCDKTKFA

SEQ ID NO: 184851 - protein, 9 aa, Tick-borne encephalitis virus
MCDKTKFAW

SEQ ID NO: 184852 - protein, 9 aa, Tick-borne encephalitis virus
CDKTKFAWK

SEQ ID NO: 184853 - protein, 9 aa, Tick-borne encephalitis virus
DKTKFAWKR

SEQ ID NO: 184854 - protein, 9 aa, Tick-borne encephalitis virus
KTKFTWKRA

SEQ ID NO: 184855 - protein, 9 aa, Tick-borne encephalitis virus
TKFTWKRAP

SEQ ID NO: 184856 - protein, 9 aa, Tick-borne encephalitis virus
KFTWKRAPT

SEQ ID NO: 184857 - protein, 9 aa, Tick-borne encephalitis virus
FTWKRAPTD

SEQ ID NO: 184858 - protein, 9 aa, Tick-borne encephalitis virus
TWKRAPTDS

SEQ ID NO: 184859 - protein, 9 aa, Tick-borne encephalitis virus
WKRAPTDSG

SEQ ID NO: 184860 - protein, 9 aa, Tick-borne encephalitis virus
KRAPTDSGH

SEQ ID NO: 184861 - protein, 9 aa, Tick-borne encephalitis virus
RAPTDSGHD

SEQ ID NO: 184862 - protein, 9 aa, Tick-borne encephalitis virus
TPTDSGHDT

SEQ ID NO: 184863 - protein, 9 aa, Tick-borne encephalitis virus
HDTVVMEVT

SEQ ID NO: 184864 - protein, 9 aa, Tick-borne encephalitis virus
DTVVMEVTF

SEQ ID NO: 184865 - protein, 9 aa, Tick-borne encephalitis virus
TVVMEVTFS

SEQ ID NO: 184866 - protein, 9 aa, Tick-borne encephalitis virus
VVMEVTFSG

SEQ ID NO: 184867 - protein, 9 aa, Tick-borne encephalitis virus
VMEVTFSGT

SEQ ID NO: 184868 - protein, 9 aa, Tick-borne encephalitis virus
MEVTFSGTK

SEQ ID NO: 184869 - protein, 9 aa, Tick-borne encephalitis virus
EVTFSGTKP

SEQ ID NO: 184870 - protein, 9 aa, Tick-borne encephalitis virus
VTFSGTKPC

SEQ ID NO: 184871 - protein, 9 aa, Tick-borne encephalitis virus
TFSGTKPCR

SEQ ID NO: 184872 - protein, 9 aa, Tick-borne encephalitis virus
PVRAVAHGF

SEQ ID NO: 184873 - protein, 9 aa, Tick-borne encephalitis virus
VRAVAHGFP

SEQ ID NO: 184874 - protein, 9 aa, Tick-borne encephalitis virus
RAVAHGFPD

SEQ ID NO: 184875 - protein, 9 aa, Tick-borne encephalitis virus
AVAHGFPDV

SEQ ID NO: 184876 - protein, 9 aa, Tick-borne encephalitis virus
VAHGFPDVN

SEQ ID NO: 184877 - protein, 9 aa, Tick-borne encephalitis virus
AHGFPDVNV

SEQ ID NO: 184878 - protein, 9 aa, Tick-borne encephalitis virus
HGFPDVNVA

SEQ ID NO: 184879 - protein, 9 aa, Tick-borne encephalitis virus
GFPDVNVAM

SEQ ID NO: 184880 - protein, 9 aa, Tick-borne encephalitis virus
FPDVNVAML

SEQ ID NO: 184881 - protein, 9 aa, Tick-borne encephalitis virus
ITPNPTIET

SEQ ID NO: 184882 - protein, 9 aa, Tick-borne encephalitis virus
TPNPTIETN

SEQ ID NO: 184883 - protein, 9 aa, Tick-borne encephalitis virus
PNPTIETNG

SEQ ID NO: 184884 - protein, 9 aa, Tick-borne encephalitis virus
NPTIETNGG

SEQ ID NO: 184885 - protein, 9 aa, Tick-borne encephalitis virus
PTIETNGGG

SEQ ID NO: 184886 - protein, 9 aa, Tick-borne encephalitis virus
TIETNGGGF

SEQ ID NO: 184887 - protein, 9 aa, Tick-borne encephalitis virus
IETNGGGFI

SEQ ID NO: 184888 - protein, 9 aa, Tick-borne encephalitis virus
ETNGGGFIE

SEQ ID NO: 184889 - protein, 9 aa, Tick-borne encephalitis virus
TNGGGFIEM

SEQ ID NO: 184890 - protein, 9 aa, Tick-borne encephalitis virus
IIYVGELSY

SEQ ID NO: 184891 - protein, 9 aa, Tick-borne encephalitis virus
IYVGELSYQ

SEQ ID NO: 184892 - protein, 9 aa, Tick-borne encephalitis virus
YVGELSYQW

SEQ ID NO: 184893 - protein, 9 aa, Tick-borne encephalitis virus
VGELSYQWF

SEQ ID NO: 184894 - protein, 9 aa, Tick-borne encephalitis virus
GELSYQWFQ

SEQ ID NO: 184895 - protein, 9 aa, Tick-borne encephalitis virus
ELSYQWFQK

SEQ ID NO: 184896 - protein, 9 aa, Tick-borne encephalitis virus
LSYQWFQKG

SEQ ID NO: 184897 - protein, 9 aa, Tick-borne encephalitis virus
SYQWFQKGS

SEQ ID NO: 184898 - protein, 9 aa, Tick-borne encephalitis virus
YQWFQKGSS

SEQ ID NO: 184899 - protein, 9 aa, Tick-borne encephalitis virus
IGRVFQKTK

SEQ ID NO: 184900 - protein, 9 aa, Tick-borne encephalitis virus
GRVFQKTKK

SEQ ID NO: 184901 - protein, 9 aa, Tick-borne encephalitis virus
RVFQKTKKG

SEQ ID NO: 184902 - protein, 9 aa, Tick-borne encephalitis virus
VFQKTKKGI

SEQ ID NO: 184903 - protein, 9 aa, Tick-borne encephalitis virus
FQKTKKGIE

SEQ ID NO: 184904 - protein, 9 aa, Tick-borne encephalitis virus
QKTKKGIER

SEQ ID NO: 184905 - protein, 9 aa, Tick-borne encephalitis virus
KTKKGIERL

SEQ ID NO: 184906 - protein, 9 aa, Tick-borne encephalitis virus
TKKGIERLT

SEQ ID NO: 184907 - protein, 9 aa, Tick-borne encephalitis virus
KKGIERLTV

SEQ ID NO: 184908 - protein, 9 aa, Tick-borne encephalitis virus
RGIERLTVI

SEQ ID NO: 184909 - protein, 9 aa, Tick-borne encephalitis virus
EHAWDFGSA

SEQ ID NO: 184910 - protein, 9 aa, Tick-borne encephalitis virus
HAWDFGSAG

SEQ ID NO: 184911 - protein, 9 aa, Tick-borne encephalitis virus
AWDFGSAGG

SEQ ID NO: 184912 - protein, 9 aa, Tick-borne encephalitis virus
WDFGSAGGF

SEQ ID NO: 184913 - protein, 9 aa, Tick-borne encephalitis virus
DFGSAGGFL

SEQ ID NO: 184914 - protein, 9 aa, Tick-borne encephalitis virus
FGSAGGFLS

SEQ ID NO: 184915 - protein, 9 aa, Tick-borne encephalitis virus
GSAGGFLSS

SEQ ID NO: 184916 - protein, 9 aa, Tick-borne encephalitis virus
SAGGFLSSI

SEQ ID NO: 184917 - protein, 9 aa, Tick-borne encephalitis virus
AGGFLSSIG

SEQ ID NO: 184918 - protein, 9 aa, Tick-borne encephalitis virus
GGFLSSIGK

SEQ ID NO: 184919 - protein, 9 aa, Tick-borne encephalitis virus
GFLSSIGKA

SEQ ID NO: 184920 - protein, 9 aa, Tick-borne encephalitis virus
FLSSIGKAV

SEQ ID NO: 184921 - protein, 9 aa, Tick-borne encephalitis virus
LSSIGKAVH

SEQ ID NO: 184922 - protein, 9 aa, Tick-borne encephalitis virus
SSIGKAVHT

SEQ ID NO: 184923 - protein, 9 aa, Tick-borne encephalitis virus
SIGKAVHTV

SEQ ID NO: 184924 - protein, 9 aa, Tick-borne encephalitis virus
IGKAVHTVL

SEQ ID NO: 184925 - protein, 9 aa, Tick-borne encephalitis virus
GKAVHTVLG

SEQ ID NO: 184926 - protein, 9 aa, Tick-borne encephalitis virus
KAVHTVLGG

SEQ ID NO: 184927 - protein, 9 aa, Tick-borne encephalitis virus
AVHTVLGGA

SEQ ID NO: 184928 - protein, 9 aa, Tick-borne encephalitis virus
VHTVLGGAF

SEQ ID NO: 184929 - protein, 9 aa, Tick-borne encephalitis virus
VLGGAFNSI

SEQ ID NO: 184930 - protein, 9 aa, Tick-borne encephalitis virus
LGGAFNSIF

SEQ ID NO: 184931 - protein, 9 aa, Tick-borne encephalitis virus
GGAFNSIFG

SEQ ID NO: 184932 - protein, 9 aa, Tick-borne encephalitis virus
GAFNSIFGG

SEQ ID NO: 184933 - protein, 9 aa, Tick-borne encephalitis virus
AFNSIFGGV

SEQ ID NO: 184934 - protein, 9 aa, Tick-borne encephalitis virus
FNSIFGGVG

SEQ ID NO: 184935 - protein, 9 aa, Tick-borne encephalitis virus
NSIFGGVGF

SEQ ID NO: 184936 - protein, 9 aa, Tick-borne encephalitis virus
SIFGGVGFL

SEQ ID NO: 184937 - protein, 9 aa, Tick-borne encephalitis virus
IFGGVGFLP

SEQ ID NO: 184938 - protein, 9 aa, Tick-borne encephalitis virus
FGGVGFIPK

SEQ ID NO: 184939 - protein, 9 aa, Tick-borne encephalitis virus
GGVGFLPKL

SEQ ID NO: 184940 - protein, 9 aa, Tick-borne encephalitis virus
GVGFLPKLL

SEQ ID NO: 184941 - protein, 9 aa, Tick-borne encephalitis virus
VGFLPKLLL

SEQ ID NO: 184942 - protein, 9 aa, Tick-borne encephalitis virus
GFLPKLLLG

SEQ ID NO: 184943 - protein, 9 aa, Tick-borne encephalitis virus
GVVLAWLGL

SEQ ID NO: 184944 - protein, 9 aa, Tick-borne encephalitis virus
VVLAWLGLN

SEQ ID NO: 184945 - protein, 9 aa, Tick-borne encephalitis virus
VLAWLGLNM

SEQ ID NO: 184946 - protein, 9 aa, Tick-borne encephalitis virus
MRNPTMSMG

SEQ ID NO: 184947 - protein, 9 aa, Tick-borne encephalitis virus
RNPTMSMGF

SEQ ID NO: 184948 - protein, 9 aa, Tick-borne encephalitis virus
NPTMSMGFL

SEQ ID NO: 184949 - protein, 9 aa, Tick-borne encephalitis virus
PTMSMGFLL

SEQ ID NO: 184950 - protein, 9 aa, Tick-borne encephalitis virus
TMSMGFLLA

SEQ ID NO: 184951 - protein, 9 aa, Tick-borne encephalitis virus
MSMGFLLAG

SEQ ID NO: 184952 - protein, 9 aa, Tick-borne encephalitis virus
SMGFLLAGG

SEQ ID NO: 184953 - protein, 9 aa, Tick-borne encephalitis virus
MGFLLAGGL

SEQ ID NO: 184954 - protein, 9 aa, Tick-borne encephalitis virus
GFLLAGGLV

SEQ ID NO: 184955 - protein, 9 aa, Tick-borne encephalitis virus
FLLAGVLVL

SEQ ID NO: 184956 - protein, 9 aa, Tick-borne encephalitis virus
LLAGVLVLA

SEQ ID NO: 184957 - protein, 9 aa, Tick-borne encephalitis virus
LAGVLVLAM

SEQ ID NO: 184958 - protein, 9 aa, Tick-borne encephalitis virus
AGVLVLAMT

SEQ ID NO: 184959 - protein, 9 aa, Tick-borne encephalitis virus
GVLVLAMTL

SEQ ID NO: 184960 - protein, 9 aa, Tick-borne encephalitis virus
VLVLAMTLG

SEQ ID NO: 184961 - protein, 9 aa, Tick-borne encephalitis virus
LGVGADVGG

SEQ ID NO: 184962 - protein, 9 aa, Tick-borne encephalitis virus
GVGADVGGA

SEQ ID NO: 184963 - protein, 9 aa, Tick-borne encephalitis virus
VGADVGGAV

SEQ ID NO: 184964 - protein, 9 aa, Tick-borne encephalitis virus
GADVGGAVD

SEQ ID NO: 184965 - protein, 9 aa, Tick-borne encephalitis virus
ADVGGAVDT

SEQ ID NO: 184966 - protein, 9 aa, Tick-borne encephalitis virus
DVGGAVDTE

SEQ ID NO: 184967 - protein, 9 aa, Tick-borne encephalitis virus
VGGAVDTER

SEQ ID NO: 184968 - protein, 9 aa, Tick-borne encephalitis virus
GGAVDTERM

SEQ ID NO: 184969 - protein, 9 aa, Tick-borne encephalitis virus
GAVDTERME

SEQ ID NO: 184970 - protein, 9 aa, Tick-borne encephalitis virus
SEWYDNYAF

SEQ ID NO: 184971 - protein, 9 aa, Tick-borne encephalitis virus
EWYDNYAFY

SEQ ID NO: 184972 - protein, 9 aa, Tick-borne encephalitis virus
WYDNYAFYP

SEQ ID NO: 184973 - protein, 9 aa, Tick-borne encephalitis virus
YDNYAFYPE

SEQ ID NO: 184974 - protein, 9 aa, Tick-borne encephalitis virus
DNYAFYPET

SEQ ID NO: 184975 - protein, 9 aa, Tick-borne encephalitis virus
NYAFYPETP

SEQ ID NO: 184976 - protein, 9 aa, Tick-borne encephalitis virus
YAFYPETPG

SEQ ID NO: 184977 - protein, 9 aa, Tick-borne encephalitis virus
AFYPETPGA

SEQ ID NO: 184978 - protein, 9 aa, Tick-borne encephalitis virus
FYPETPGAL

SEQ ID NO: 184979 - protein, 9 aa, Tick-borne encephalitis virus
PGALASAIR

SEQ ID NO: 184980 - protein, 9 aa, Tick-borne encephalitis virus
GALASAIRE

SEQ ID NO: 184981 - protein, 9 aa, Tick-borne encephalitis virus
ALASAIKEA

SEQ ID NO: 184982 - protein, 9 aa, Tick-borne encephalitis virus
LASAIKEAF

SEQ ID NO: 184983 - protein, 9 aa, Tick-borne encephalitis virus
ASAIRETFE

SEQ ID NO: 184984 - protein, 9 aa, Tick-borne encephalitis virus
SAIRETFEE

SEQ ID NO: 184985 - protein, 9 aa, Tick-borne encephalitis virus
AIKEAFEEG

SEQ ID NO: 184986 - protein, 9 aa, Tick-borne encephalitis virus
IKETFEEGS

SEQ ID NO: 184987 - protein, 9 aa, Tick-borne encephalitis virus
KETFEEGSC

SEQ ID NO: 184988 - protein, 9 aa, Tick-borne encephalitis virus
ETFEEGSCG

SEQ ID NO: 184989 - protein, 9 aa, Tick-borne encephalitis virus
TFEEGSCGV

SEQ ID NO: 184990 - protein, 9 aa, Tick-borne encephalitis virus
FEEGSCGVV

SEQ ID NO: 184991 - protein, 9 aa, Tick-borne encephalitis virus
EEGSCGVVP

SEQ ID NO: 184992 - protein, 9 aa, Tick-borne encephalitis virus
EGSCGVVPQ

SEQ ID NO: 184993 - protein, 9 aa, Tick-borne encephalitis virus
GSCGVVPQN

SEQ ID NO: 184994 - protein, 9 aa, Tick-borne encephalitis virus
SCGVVPQNR

SEQ ID NO: 184995 - protein, 9 aa, Tick-borne encephalitis virus
CGVVPQNRL

SEQ ID NO: 184996 - protein, 9 aa, Tick-borne encephalitis virus
GVVPQNRLE

SEQ ID NO: 184997 - protein, 9 aa, Tick-borne encephalitis virus
VVPQNRLEM

SEQ ID NO: 184998 - protein, 9 aa, Tick-borne encephalitis virus
LPQNRLEMA

SEQ ID NO: 184999 - protein, 9 aa, Tick-borne encephalitis virus
LEMAMWRSA

SEQ ID NO: 185000 - protein, 9 aa, Tick-borne encephalitis virus
EMAMWRSSV

SEQ ID NO: 185001 - protein, 9 aa, Tick-borne encephalitis virus
MAMWRSSVT

SEQ ID NO: 185002 - protein, 9 aa, Tick-borne encephalitis virus
AMWRSSVTE

SEQ ID NO: 185003 - protein, 9 aa, Tick-borne encephalitis virus
MWRSSVTEL

SEQ ID NO: 185004 - protein, 9 aa, Tick-borne encephalitis virus
WRSSVTELN

SEQ ID NO: 185005 - protein, 9 aa, Tick-borne encephalitis virus
RSSVTELNL

SEQ ID NO: 185006 - protein, 9 aa, Tick-borne encephalitis virus
SSVTELNLA

SEQ ID NO: 185007 - protein, 9 aa, Tick-borne encephalitis virus
SVTELNLAL

SEQ ID NO: 185008 - protein, 9 aa, Tick-borne encephalitis virus
VTELNLALA

SEQ ID NO: 185009 - protein, 9 aa, Tick-borne encephalitis virus
LNLALAEGE

SEQ ID NO: 185010 - protein, 9 aa, Tick-borne encephalitis virus
NLALAEGEA

SEQ ID NO: 185011 - protein, 9 aa, Tick-borne encephalitis virus
LALAEGEAN

SEQ ID NO: 185012 - protein, 9 aa, Tick-borne encephalitis virus
ALAEGEANL

SEQ ID NO: 185013 - protein, 9 aa, Tick-borne encephalitis virus
LAEGEANLT

SEQ ID NO: 185014 - protein, 9 aa, Tick-borne encephalitis virus
AEGEANLTV

SEQ ID NO: 185015 - protein, 9 aa, Tick-borne encephalitis virus
EGEANLTVV

SEQ ID NO: 185016 - protein, 9 aa, Tick-borne encephalitis virus
GEANLTVVV

SEQ ID NO: 185017 - protein, 9 aa, Tick-borne encephalitis virus
EANLTVVVD

SEQ ID NO: 185018 - protein, 9 aa, Tick-borne encephalitis virus
ANLTVMVDK

SEQ ID NO: 185019 - protein, 9 aa, Tick-borne encephalitis virus
NLTVVVDKF

SEQ ID NO: 185020 - protein, 9 aa, Tick-borne encephalitis virus
LTVVVDKFD

SEQ ID NO: 185021 - protein, 9 aa, Tick-borne encephalitis virus
TVVVDKFDP

SEQ ID NO: 185022 - protein, 9 aa, Tick-borne encephalitis virus
VVVDKFDPT

SEQ ID NO: 185023 - protein, 9 aa, Tick-borne encephalitis virus
VVDKFDPTD

SEQ ID NO: 185024 - protein, 9 aa, Tick-borne encephalitis virus
VDKFDPTDY

SEQ ID NO: 185025 - protein, 9 aa, Tick-borne encephalitis virus
DKFDPTDYR

SEQ ID NO: 185026 - protein, 9 aa, Tick-borne encephalitis virus
KFDPTDYRG

SEQ ID NO: 185027 - protein, 9 aa, Tick-borne encephalitis virus
FDPTDYRGG

SEQ ID NO: 185028 - protein, 9 aa, Tick-borne encephalitis virus
DPTDYRGGV

SEQ ID NO: 185029 - protein, 9 aa, Tick-borne encephalitis virus
PTDYRGGVP

SEQ ID NO: 185030 - protein, 9 aa, Tick-borne encephalitis virus
TDYRGGVPG

SEQ ID NO: 185031 - protein, 9 aa, Tick-borne encephalitis virus
DYRGGVPGL

SEQ ID NO: 185032 - protein, 9 aa, Tick-borne encephalitis virus
YRGGVPGLL

SEQ ID NO: 185033 - protein, 9 aa, Tick-borne encephalitis virus
RGGVPGLLK

SEQ ID NO: 185034 - protein, 9 aa, Tick-borne encephalitis virus
GGVPGLLKK

SEQ ID NO: 185035 - protein, 9 aa, Tick-borne encephalitis virus
GVPGLLKKG

SEQ ID NO: 185036 - protein, 9 aa, Tick-borne encephalitis virus
VPGLLKKGK

SEQ ID NO: 185037 - protein, 9 aa, Tick-borne encephalitis virus
SGLLRKGKD

SEQ ID NO: 185038 - protein, 9 aa, Tick-borne encephalitis virus
GLLRKGKDI

SEQ ID NO: 185039 - protein, 9 aa, Tick-borne encephalitis virus
LLRKGKDIK

SEQ ID NO: 185040 - protein, 9 aa, Tick-borne encephalitis virus
LRKGKDIKV

SEQ ID NO: 185041 - protein, 9 aa, Tick-borne encephalitis virus
RKGKDIKVS

SEQ ID NO: 185042 - protein, 9 aa, Tick-borne encephalitis virus
KGKDIRVSW

SEQ ID NO: 185043 - protein, 9 aa, Tick-borne encephalitis virus
GKDIRVSWK

SEQ ID NO: 185044 - protein, 9 aa, Tick-borne encephalitis virus
KDIRVSWKS

SEQ ID NO: 185045 - protein, 9 aa, Tick-borne encephalitis virus
DIKVSWRSW

SEQ ID NO: 185046 - protein, 9 aa, Tick-borne encephalitis virus
IRVSWKSWG

SEQ ID NO: 185047 - protein, 9 aa, Tick-borne encephalitis virus
KVSWKSWGQ

SEQ ID NO: 185048 - protein, 9 aa, Tick-borne encephalitis virus
VSWKSWGQS

SEQ ID NO: 185049 - protein, 9 aa, Tick-borne encephalitis virus
SWGQSMIWS

SEQ ID NO: 185050 - protein, 9 aa, Tick-borne encephalitis virus
SMIWSIPEA

SEQ ID NO: 185051 - protein, 9 aa, Tick-borne encephalitis virus
MIWSIPEAP

SEQ ID NO: 185052 - protein, 9 aa, Tick-borne encephalitis virus
IWSIPEAPR

SEQ ID NO: 185053 - protein, 9 aa, Tick-borne encephalitis virus
WSIPEAPRR

SEQ ID NO: 185054 - protein, 9 aa, Tick-borne encephalitis virus
SIPEAPRRF

SEQ ID NO: 185055 - protein, 9 aa, Tick-borne encephalitis virus
IPEAPRRFM

SEQ ID NO: 185056 - protein, 9 aa, Tick-borne encephalitis virus
PEASRRFMV

SEQ ID NO: 185057 - protein, 9 aa, Tick-borne encephalitis virus
EASRRFMVG

SEQ ID NO: 185058 - protein, 9 aa, Tick-borne encephalitis virus
APRRFMVGI

SEQ ID NO: 185059 - protein, 9 aa, Tick-borne encephalitis virus
PRRFMVGIE

SEQ ID NO: 185060 - protein, 9 aa, Tick-borne encephalitis virus
RRFMVGIEG

SEQ ID NO: 185061 - protein, 9 aa, Tick-borne encephalitis virus
RFMVGTEGS

SEQ ID NO: 185062 - protein, 9 aa, Tick-borne encephalitis virus
NECPLERRK

SEQ ID NO: 185063 - protein, 9 aa, Tick-borne encephalitis virus
ECPPERRKT

SEQ ID NO: 185064 - protein, 9 aa, Tick-borne encephalitis virus
CPPERRKTG

SEQ ID NO: 185065 - protein, 9 aa, Tick-borne encephalitis virus
PPERRKTGV

SEQ ID NO: 185066 - protein, 9 aa, Tick-borne encephalitis virus
LERRKTGIF

SEQ ID NO: 185067 - protein, 9 aa, Tick-borne encephalitis virus
ERRKTGIFT

SEQ ID NO: 185068 - protein, 9 aa, Tick-borne encephalitis virus
RRKTGIFTV

SEQ ID NO: 185069 - protein, 9 aa, Tick-borne encephalitis virus
RKTGIFTVA

SEQ ID NO: 185070 - protein, 9 aa, Tick-borne encephalitis virus
KTGIFTVAE

SEQ ID NO: 185071 - protein, 9 aa, Tick-borne encephalitis virus
TGIFTVAEF

SEQ ID NO: 185072 - protein, 9 aa, Tick-borne encephalitis virus
GIFTVAEFG

SEQ ID NO: 185073 - protein, 9 aa, Tick-borne encephalitis virus
IFTVAEFGV

SEQ ID NO: 185074 - protein, 9 aa, Tick-borne encephalitis virus
VGLRTKVFV

SEQ ID NO: 185075 - protein, 9 aa, Tick-borne encephalitis virus
GLRTKVFVD

SEQ ID NO: 185076 - protein, 9 aa, Tick-borne encephalitis virus
LRTKVFVDF

SEQ ID NO: 185077 - protein, 9 aa, Tick-borne encephalitis virus
RTKVFVDFR

SEQ ID NO: 185078 - protein, 9 aa, Tick-borne encephalitis virus
TKVFVDFRQ

SEQ ID NO: 185079 - protein, 9 aa, Tick-borne encephalitis virus
KVFVDFRQE

SEQ ID NO: 185080 - protein, 9 aa, Tick-borne encephalitis virus
VFLDFRQEP

SEQ ID NO: 185081 - protein, 9 aa, Tick-borne encephalitis virus
FLDFRQEPT

SEQ ID NO: 185082 - protein, 9 aa, Tick-borne encephalitis virus
LDFRQEPTH

SEQ ID NO: 185083 - protein, 9 aa, Tick-borne encephalitis virus
DFRQEPTHE

SEQ ID NO: 185084 - protein, 9 aa, Tick-borne encephalitis virus
FRQEPTHEC

SEQ ID NO: 185085 - protein, 9 aa, Tick-borne encephalitis virus
RQEPTHECD

SEQ ID NO: 185086 - protein, 9 aa, Tick-borne encephalitis virus
QEPTHECDT

SEQ ID NO: 185087 - protein, 9 aa, Tick-borne encephalitis virus
EPTHECDTG

SEQ ID NO: 185088 - protein, 9 aa, Tick-borne encephalitis virus
PTHECDTGV

SEQ ID NO: 185089 - protein, 9 aa, Tick-borne encephalitis virus
AAVKNGMAI

SEQ ID NO: 185090 - protein, 9 aa, Tick-borne encephalitis virus
AVKNGMAIH

SEQ ID NO: 185091 - protein, 9 aa, Tick-borne encephalitis virus
VKNGMAIHT

SEQ ID NO: 185092 - protein, 9 aa, Tick-borne encephalitis virus
KNGMAIHTD

SEQ ID NO: 185093 - protein, 9 aa, Tick-borne encephalitis virus
NGMAIHTDQ

SEQ ID NO: 185094 - protein, 9 aa, Tick-borne encephalitis virus
GMAIHTDQS

SEQ ID NO: 185095 - protein, 9 aa, Tick-borne encephalitis virus
MAIHTDQSL

SEQ ID NO: 185096 - protein, 9 aa, Tick-borne encephalitis virus
AIHTDQSLW

SEQ ID NO: 185097 - protein, 9 aa, Tick-borne encephalitis virus
IHTDQSLWM

SEQ ID NO: 185098 - protein, 9 aa, Tick-borne encephalitis virus
HTDQSLWMR

SEQ ID NO: 185099 - protein, 9 aa, Tick-borne encephalitis virus
TDQSLWMRS

SEQ ID NO: 185100 - protein, 9 aa, Tick-borne encephalitis virus
DQSLWMRSM

SEQ ID NO: 185101 - protein, 9 aa, Tick-borne encephalitis virus
QSLWMRSMK

SEQ ID NO: 185102 - protein, 9 aa, Tick-borne encephalitis virus
SLWMRSMKN

SEQ ID NO: 185103 - protein, 9 aa, Tick-borne encephalitis virus
LWMRSMKND

SEQ ID NO: 185104 - protein, 9 aa, Tick-borne encephalitis virus
WMRSMKNDT

SEQ ID NO: 185105 - protein, 9 aa, Tick-borne encephalitis virus
MRSMKNDTG

SEQ ID NO: 185106 - protein, 9 aa, Tick-borne encephalitis virus
RSMKNDTGT

SEQ ID NO: 185107 - protein, 9 aa, Tick-borne encephalitis virus
SMKNDTGTY

SEQ ID NO: 185108 - protein, 9 aa, Tick-borne encephalitis virus
MKNDTGTYI

SEQ ID NO: 185109 - protein, 9 aa, Tick-borne encephalitis virus
KNDTGTYIV

SEQ ID NO: 185110 - protein, 9 aa, Tick-borne encephalitis virus
NETGTYIVE

SEQ ID NO: 185111 - protein, 9 aa, Tick-borne encephalitis virus
ETGTYIVEL

SEQ ID NO: 185112 - protein, 9 aa, Tick-borne encephalitis virus
PASHTIDNP

SEQ ID NO: 185113 - protein, 9 aa, Tick-borne encephalitis virus
ASHTIDNAD

SEQ ID NO: 185114 - protein, 9 aa, Tick-borne encephalitis virus
SHTIDNADV

SEQ ID NO: 185115 - protein, 9 aa, Tick-borne encephalitis virus
HTIDNADVV

SEQ ID NO: 185116 - protein, 9 aa, Tick-borne encephalitis virus
TIDNADVVD

SEQ ID NO: 185117 - protein, 9 aa, Tick-borne encephalitis virus
IDNADVVDS

SEQ ID NO: 185118 - protein, 9 aa, Tick-borne encephalitis virus
DNADVVDSE

SEQ ID NO: 185119 - protein, 9 aa, Tick-borne encephalitis virus
NADVVDSEL

SEQ ID NO: 185120 - protein, 9 aa, Tick-borne encephalitis virus
ADVVDSELF

SEQ ID NO: 185121 - protein, 9 aa, Tick-borne encephalitis virus
DVVDSELFL

SEQ ID NO: 185122 - protein, 9 aa, Tick-borne encephalitis virus
VVDSESFLP

SEQ ID NO: 185123 - protein, 9 aa, Tick-borne encephalitis virus
VDSESFLPA

SEQ ID NO: 185124 - protein, 9 aa, Tick-borne encephalitis virus
DSESFLPAS

SEQ ID NO: 185125 - protein, 9 aa, Tick-borne encephalitis virus
SESFLPASL

SEQ ID NO: 185126 - protein, 9 aa, Tick-borne encephalitis virus
ESFLPASLA

SEQ ID NO: 185127 - protein, 9 aa, Tick-borne encephalitis virus
SFLPASLAG

SEQ ID NO: 185128 - protein, 9 aa, Tick-borne encephalitis virus
WYNRIPGYA

SEQ ID NO: 185129 - protein, 9 aa, Tick-borne encephalitis virus
YNRIPGYAE

SEQ ID NO: 185130 - protein, 9 aa, Tick-borne encephalitis virus
NRIPGYAEQ

SEQ ID NO: 185131 - protein, 9 aa, Tick-borne encephalitis virus
RIPGYAEQV

SEQ ID NO: 185132 - protein, 9 aa, Tick-borne encephalitis virus
IPGYAEQVK

SEQ ID NO: 185133 - protein, 9 aa, Tick-borne encephalitis virus
PGYAEQVKG

SEQ ID NO: 185134 - protein, 9 aa, Tick-borne encephalitis virus
GYAEQVKGP

SEQ ID NO: 185135 - protein, 9 aa, Tick-borne encephalitis virus
YAEQVKGPW

SEQ ID NO: 185136 - protein, 9 aa, Tick-borne encephalitis virus
AEQVKGPWK

SEQ ID NO: 185137 - protein, 9 aa, Tick-borne encephalitis virus
EQVKGPWKH

SEQ ID NO: 185138 - protein, 9 aa, Tick-borne encephalitis virus
QVKGPWKHT

SEQ ID NO: 185139 - protein, 9 aa, Tick-borne encephalitis virus
VKGPWKHTP

SEQ ID NO: 185140 - protein, 9 aa, Tick-borne encephalitis virus
KGPWKHTPI

SEQ ID NO: 185141 - protein, 9 aa, Tick-borne encephalitis virus
GPWKHTPIR

SEQ ID NO: 185142 - protein, 9 aa, Tick-borne encephalitis virus
PWKHTPIRV

SEQ ID NO: 185143 - protein, 9 aa, Tick-borne encephalitis virus
PIRVIREEC

SEQ ID NO: 185144 - protein, 9 aa, Tick-borne encephalitis virus
IRVIREECP

SEQ ID NO: 185145 - protein, 9 aa, Tick-borne encephalitis virus
RVIREECPG

SEQ ID NO: 185146 - protein, 9 aa, Tick-borne encephalitis virus
VIREECPGT

SEQ ID NO: 185147 - protein, 9 aa, Tick-borne encephalitis virus
IREECPGTT

SEQ ID NO: 185148 - protein, 9 aa, Tick-borne encephalitis virus
REECPGTTV

SEQ ID NO: 185149 - protein, 9 aa, Tick-borne encephalitis virus
ECPGTKVTI

SEQ ID NO: 185150 - protein, 9 aa, Tick-borne encephalitis virus
INAKCDKRG

SEQ ID NO: 185151 - protein, 9 aa, Tick-borne encephalitis virus
NAKCDKRGA

SEQ ID NO: 185152 - protein, 9 aa, Tick-borne encephalitis virus
AKCDKRGAS

SEQ ID NO: 185153 - protein, 9 aa, Tick-borne encephalitis virus
KCDKRGASV

SEQ ID NO: 185154 - protein, 9 aa, Tick-borne encephalitis virus
CDRRGASVR

SEQ ID NO: 185155 - protein, 9 aa, Tick-borne encephalitis virus
DRRGASVRS

SEQ ID NO: 185156 - protein, 9 aa, Tick-borne encephalitis virus
RRGASVRST

SEQ ID NO: 185157 - protein, 9 aa, Tick-borne encephalitis virus
VIPEWCCRA

SEQ ID NO: 185158 - protein, 9 aa, Tick-borne encephalitis virus
IPEWCCRAC

SEQ ID NO: 185159 - protein, 9 aa, Tick-borne encephalitis virus
PEWCCRACT

SEQ ID NO: 185160 - protein, 9 aa, Tick-borne encephalitis virus
EWCCRACTM

SEQ ID NO: 185161 - protein, 9 aa, Tick-borne encephalitis virus
WCCRACTMP

SEQ ID NO: 185162 - protein, 9 aa, Tick-borne encephalitis virus
CCRACTMPP

SEQ ID NO: 185163 - protein, 9 aa, Tick-borne encephalitis virus
CRACTMPPV

SEQ ID NO: 185164 - protein, 9 aa, Tick-borne encephalitis virus
RACTMPPVT

SEQ ID NO: 185165 - protein, 9 aa, Tick-borne encephalitis virus
ACTMPPVTF

SEQ ID NO: 185166 - protein, 9 aa, Tick-borne encephalitis virus
CTMPPVTFR

SEQ ID NO: 185167 - protein, 9 aa, Tick-borne encephalitis virus
TMPPVTFRT

SEQ ID NO: 185168 - protein, 9 aa, Tick-borne encephalitis virus
MPPVTFRTG

SEQ ID NO: 185169 - protein, 9 aa, Tick-borne encephalitis virus
PPVTIRTGT

SEQ ID NO: 185170 - protein, 9 aa, Tick-borne encephalitis virus
PVTIRTGTD

SEQ ID NO: 185171 - protein, 9 aa, Tick-borne encephalitis virus
VTIRTGTDC

SEQ ID NO: 185172 - protein, 9 aa, Tick-borne encephalitis virus
TIRTGTDCW

SEQ ID NO: 185173 - protein, 9 aa, Tick-borne encephalitis virus
IRTGTDCWY

SEQ ID NO: 185174 - protein, 9 aa, Tick-borne encephalitis virus
PVHDQGGLI

SEQ ID NO: 185175 - protein, 9 aa, Tick-borne encephalitis virus
VHDQGGLIR

SEQ ID NO: 185176 - protein, 9 aa, Tick-borne encephalitis virus
HDQGGLIRS

SEQ ID NO: 185177 - protein, 9 aa, Tick-borne encephalitis virus
DQGGLIRSM

SEQ ID NO: 185178 - protein, 9 aa, Tick-borne encephalitis virus
QGGLVRSTV

SEQ ID NO: 185179 - protein, 9 aa, Tick-borne encephalitis virus
GGLIRSMVV

SEQ ID NO: 185180 - protein, 9 aa, Tick-borne encephalitis virus
GLIRSMVVA

SEQ ID NO: 185181 - protein, 9 aa, Tick-borne encephalitis virus
LVRSTVVAD

SEQ ID NO: 185182 - protein, 9 aa, Tick-borne encephalitis virus
IRSMVVADN

SEQ ID NO: 185183 - protein, 9 aa, Tick-borne encephalitis virus
RSTVVADNG

SEQ ID NO: 185184 - protein, 9 aa, Tick-borne encephalitis virus
STVVADNGE

SEQ ID NO: 185185 - protein, 9 aa, Tick-borne encephalitis virus
TVVADNGEL

SEQ ID NO: 185186 - protein, 9 aa, Tick-borne encephalitis virus
GELLSEGGV

SEQ ID NO: 185187 - protein, 9 aa, Tick-borne encephalitis virus
ELLSEGGVP

SEQ ID NO: 185188 - protein, 9 aa, Tick-borne encephalitis virus
LLSEGGVPG

SEQ ID NO: 185189 - protein, 9 aa, Tick-borne encephalitis virus
LSEGGIPGI

SEQ ID NO: 185190 - protein, 9 aa, Tick-borne encephalitis virus
SEGGVPGIV

SEQ ID NO: 185191 - protein, 9 aa, Tick-borne encephalitis virus
EGGVPGIVA

SEQ ID NO: 185192 - protein, 9 aa, Tick-borne encephalitis virus
GGIPGIVAL

SEQ ID NO: 185193 - protein, 9 aa, Tick-borne encephalitis virus
GIPGIVALF

SEQ ID NO: 185194 - protein, 9 aa, Tick-borne encephalitis virus
VPGIVALFV

SEQ ID NO: 185195 - protein, 9 aa, Tick-borne encephalitis virus
ALFVVLEYI

SEQ ID NO: 185196 - protein, 9 aa, Tick-borne encephalitis virus
LFVVLEYII

SEQ ID NO: 185197 - protein, 9 aa, Tick-borne encephalitis virus
FVVLEYIIR

SEQ ID NO: 185198 - protein, 9 aa, Tick-borne encephalitis virus
VVLEYIIRR

SEQ ID NO: 185199 - protein, 9 aa, Tick-borne encephalitis virus
VLEYIIRRR

SEQ ID NO: 185200 - protein, 9 aa, Tick-borne encephalitis virus
LEYIIRRRP

SEQ ID NO: 185201 - protein, 9 aa, Tick-borne encephalitis virus
EYIIRRRPS

SEQ ID NO: 185202 - protein, 9 aa, Tick-borne encephalitis virus
YIIRRRPST

SEQ ID NO: 185203 - protein, 9 aa, Tick-borne encephalitis virus
IIRRRPSTG

SEQ ID NO: 185204 - protein, 9 aa, Tick-borne encephalitis virus
IRRRPSTGT

SEQ ID NO: 185205 - protein, 9 aa, Tick-borne encephalitis virus
RRRPSTGTT

SEQ ID NO: 185206 - protein, 9 aa, Tick-borne encephalitis virus
RRPSTGTTV

SEQ ID NO: 185207 - protein, 9 aa, Tick-borne encephalitis virus
RPSTGTTVV

SEQ ID NO: 185208 - protein, 9 aa, Tick-borne encephalitis virus
PSTGTTVVW

SEQ ID NO: 185209 - protein, 9 aa, Tick-borne encephalitis virus
STGTTVVWG

SEQ ID NO: 185210 - protein, 9 aa, Tick-borne encephalitis virus
TGTTVVWGG

SEQ ID NO: 185211 - protein, 9 aa, Tick-borne encephalitis virus
WGGVVVLAL

SEQ ID NO: 185212 - protein, 9 aa, Tick-borne encephalitis virus
GGVVVLALL

SEQ ID NO: 185213 - protein, 9 aa, Tick-borne encephalitis virus
GVVVLALLV

SEQ ID NO: 185214 - protein, 9 aa, Tick-borne encephalitis virus
VVVLALLVT

SEQ ID NO: 185215 - protein, 9 aa, Tick-borne encephalitis virus
VVFALLVTG

SEQ ID NO: 185216 - protein, 9 aa, Tick-borne encephalitis virus
VLALLVTGM

SEQ ID NO: 185217 - protein, 9 aa, Tick-borne encephalitis virus
LALLVTGMV

SEQ ID NO: 185218 - protein, 9 aa, Tick-borne encephalitis virus
ALLVTGMVR

SEQ ID NO: 185219 - protein, 9 aa, Tick-borne encephalitis virus
VKIESLVRY

SEQ ID NO: 185220 - protein, 9 aa, Tick-borne encephalitis virus
KIESLVRYV

SEQ ID NO: 185221 - protein, 9 aa, Tick-borne encephalitis virus
VESLVRYVV

SEQ ID NO: 185222 - protein, 9 aa, Tick-borne encephalitis virus
RYVVAVGIA

SEQ ID NO: 185223 - protein, 9 aa, Tick-borne encephalitis virus
YVVAVGIAF

SEQ ID NO: 185224 - protein, 9 aa, Tick-borne encephalitis virus
VVAVGIAFH

SEQ ID NO: 185225 - protein, 9 aa, Tick-borne encephalitis virus
VAVGITFHF

SEQ ID NO: 185226 - protein, 9 aa, Tick-borne encephalitis virus
AVGITFHFE

SEQ ID NO: 185227 - protein, 9 aa, Tick-borne encephalitis virus
VGITFHFEL

SEQ ID NO: 185228 - protein, 9 aa, Tick-borne encephalitis virus
GITFHFELG

SEQ ID NO: 185229 - protein, 9 aa, Tick-borne encephalitis virus
ITFHFELGP

SEQ ID NO: 185230 - protein, 9 aa, Tick-borne encephalitis virus
AFHLELGPE

SEQ ID NO: 185231 - protein, 9 aa, Tick-borne encephalitis virus
FHFELGPEI

SEQ ID NO: 185232 - protein, 9 aa, Tick-borne encephalitis virus
HFELGPEIV

SEQ ID NO: 185233 - protein, 9 aa, Tick-borne encephalitis virus
FELGPEIVA

SEQ ID NO: 185234 - protein, 9 aa, Tick-borne encephalitis virus
LGPEIVALM

SEQ ID NO: 185235 - protein, 9 aa, Tick-borne encephalitis virus
GPEIVALML

SEQ ID NO: 185236 - protein, 9 aa, Tick-borne encephalitis virus
PEIVALMLL

SEQ ID NO: 185237 - protein, 9 aa, Tick-borne encephalitis virus
EIVALMLLQ

SEQ ID NO: 185238 - protein, 9 aa, Tick-borne encephalitis virus
IVALMLLQA

SEQ ID NO: 185239 - protein, 9 aa, Tick-borne encephalitis virus
VALMLLQAV

SEQ ID NO: 185240 - protein, 9 aa, Tick-borne encephalitis virus
ALMLLQAVF

SEQ ID NO: 185241 - protein, 9 aa, Tick-borne encephalitis virus
LMLLQAVFE

SEQ ID NO: 185242 - protein, 9 aa, Tick-borne encephalitis virus
MLLQAVFEL

SEQ ID NO: 185243 - protein, 9 aa, Tick-borne encephalitis virus
LLSAFALRR

SEQ ID NO: 185244 - protein, 9 aa, Tick-borne encephalitis virus
LSAFALRRS

SEQ ID NO: 185245 - protein, 9 aa, Tick-borne encephalitis virus
SAFALRRSL

SEQ ID NO: 185246 - protein, 9 aa, Tick-borne encephalitis virus
AFALRRSLT

SEQ ID NO: 185247 - protein, 9 aa, Tick-borne encephalitis virus
FALRRSLTV

SEQ ID NO: 185248 - protein, 9 aa, Tick-borne encephalitis virus
ALRRSLTVR

SEQ ID NO: 185249 - protein, 9 aa, Tick-borne encephalitis virus
LRRSLTVRE

SEQ ID NO: 185250 - protein, 9 aa, Tick-borne encephalitis virus
RRSLTVREM

SEQ ID NO: 185251 - protein, 9 aa, Tick-borne encephalitis virus
RSLTVREMV

SEQ ID NO: 185252 - protein, 9 aa, Tick-borne encephalitis virus
SLTVREMVT

SEQ ID NO: 185253 - protein, 9 aa, Tick-borne encephalitis virus
LTVREMVTT

SEQ ID NO: 185254 - protein, 9 aa, Tick-borne encephalitis virus
TVREMVTTY

SEQ ID NO: 185255 - protein, 9 aa, Tick-borne encephalitis virus
VREMVTTYF

SEQ ID NO: 185256 - protein, 9 aa, Tick-borne encephalitis virus
REMVTTYFL

SEQ ID NO: 185257 - protein, 9 aa, Tick-borne encephalitis virus
EMVTTYFLL

SEQ ID NO: 185258 - protein, 9 aa, Tick-borne encephalitis virus
MVTTYFLLL

SEQ ID NO: 185259 - protein, 9 aa, Tick-borne encephalitis virus
VTTYFLLLV

SEQ ID NO: 185260 - protein, 9 aa, Tick-borne encephalitis virus
TTYFLLLVL

SEQ ID NO: 185261 - protein, 9 aa, Tick-borne encephalitis virus
TYFLLLVLE

SEQ ID NO: 185262 - protein, 9 aa, Tick-borne encephalitis virus
LVLELGLPG

SEQ ID NO: 185263 - protein, 9 aa, Tick-borne encephalitis virus
FWKWGDALA

SEQ ID NO: 185264 - protein, 9 aa, Tick-borne encephalitis virus
WRWGDALAM

SEQ ID NO: 185265 - protein, 9 aa, Tick-borne encephalitis virus
RWGDALAMG

SEQ ID NO: 185266 - protein, 9 aa, Tick-borne encephalitis virus
ALAMGALIL

SEQ ID NO: 185267 - protein, 9 aa, Tick-borne encephalitis virus
LAMGALILR

SEQ ID NO: 185268 - protein, 9 aa, Tick-borne encephalitis virus
AMGALILRA

SEQ ID NO: 185269 - protein, 9 aa, Tick-borne encephalitis virus
MGALILRAC

SEQ ID NO: 185270 - protein, 9 aa, Tick-borne encephalitis virus
GALILRACT

SEQ ID NO: 185271 - protein, 9 aa, Tick-borne encephalitis virus
ALILRACTA

SEQ ID NO: 185272 - protein, 9 aa, Tick-borne encephalitis virus
LILRACTAE

SEQ ID NO: 185273 - protein, 9 aa, Tick-borne encephalitis virus
IFRACTAEE

SEQ ID NO: 185274 - protein, 9 aa, Tick-borne encephalitis virus
FRACTAEEK

SEQ ID NO: 185275 - protein, 9 aa, Tick-borne encephalitis virus
RACTAEGKT

SEQ ID NO: 185276 - protein, 9 aa, Tick-borne encephalitis virus
ACTAEGKTG

SEQ ID NO: 185277 - protein, 9 aa, Tick-borne encephalitis virus
CTAEGKTGA

SEQ ID NO: 185278 - protein, 9 aa, Tick-borne encephalitis virus
TAEGKTGAG

SEQ ID NO: 185279 - protein, 9 aa, Tick-borne encephalitis virus
AEGKTGAGL

SEQ ID NO: 185280 - protein, 9 aa, Tick-borne encephalitis virus
EGKTGAGLL

SEQ ID NO: 185281 - protein, 9 aa, Tick-borne encephalitis virus
GKTGAGLLL

SEQ ID NO: 185282 - protein, 9 aa, Tick-borne encephalitis virus
KTGAGLLLM

SEQ ID NO: 185283 - protein, 9 aa, Tick-borne encephalitis virus
TGAGLLLMA

SEQ ID NO: 185284 - protein, 9 aa, Tick-borne encephalitis virus
GAGLLLMAL

SEQ ID NO: 185285 - protein, 9 aa, Tick-borne encephalitis virus
AGLLLMALM

SEQ ID NO: 185286 - protein, 9 aa, Tick-borne encephalitis virus
GLLLMALIT

SEQ ID NO: 185287 - protein, 9 aa, Tick-borne encephalitis virus
LLLMPLLTK

SEQ ID NO: 185288 - protein, 9 aa, Tick-borne encephalitis virus
LLMALMTQR

SEQ ID NO: 185289 - protein, 9 aa, Tick-borne encephalitis virus
LMALMTQRD

SEQ ID NO: 185290 - protein, 9 aa, Tick-borne encephalitis virus
VHHGLVCFL

SEQ ID NO: 185291 - protein, 9 aa, Tick-borne encephalitis virus
HHGLVCFLS

SEQ ID NO: 185292 - protein, 9 aa, Tick-borne encephalitis virus
WRLIRGHRE

SEQ ID NO: 185293 - protein, 9 aa, Tick-borne encephalitis virus
RLIRGHREQ

SEQ ID NO: 185294 - protein, 9 aa, Tick-borne encephalitis virus
LLKGHREQK

SEQ ID NO: 185295 - protein, 9 aa, Tick-borne encephalitis virus
LKGHREQKG

SEQ ID NO: 185296 - protein, 9 aa, Tick-borne encephalitis virus
KGHREQKGL

SEQ ID NO: 185297 - protein, 9 aa, Tick-borne encephalitis virus
GHREQKGLS

SEQ ID NO: 185298 - protein, 9 aa, Tick-borne encephalitis virus
HREQKGLSW

SEQ ID NO: 185299 - protein, 9 aa, Tick-borne encephalitis virus
REQKGLTWV

SEQ ID NO: 185300 - protein, 9 aa, Tick-borne encephalitis virus
EQKGLSWIV

SEQ ID NO: 185301 - protein, 9 aa, Tick-borne encephalitis virus
QKGLTWVVP

SEQ ID NO: 185302 - protein, 9 aa, Tick-borne encephalitis virus
KGLTWVVPL

SEQ ID NO: 185303 - protein, 9 aa, Tick-borne encephalitis virus
GLTWVVPLA

SEQ ID NO: 185304 - protein, 9 aa, Tick-borne encephalitis virus
VPLARLLGG

SEQ ID NO: 185305 - protein, 9 aa, Tick-borne encephalitis virus
PLARLLGGE

SEQ ID NO: 185306 - protein, 9 aa, Tick-borne encephalitis virus
LARLLGGEG

SEQ ID NO: 185307 - protein, 9 aa, Tick-borne encephalitis virus
ARLLGGEGS

SEQ ID NO: 185308 - protein, 9 aa, Tick-borne encephalitis virus
RLLGGEGSG

SEQ ID NO: 185309 - protein, 9 aa, Tick-borne encephalitis virus
LLGGEGSGI

SEQ ID NO: 185310 - protein, 9 aa, Tick-borne encephalitis virus
LGGEGSGIR

SEQ ID NO: 185311 - protein, 9 aa, Tick-borne encephalitis virus
GGEGSGIRL

SEQ ID NO: 185312 - protein, 9 aa, Tick-borne encephalitis virus
GEGSGIRLL

SEQ ID NO: 185313 - protein, 9 aa, Tick-borne encephalitis virus
EGSGIRLLA

SEQ ID NO: 185314 - protein, 9 aa, Tick-borne encephalitis virus
GSGIRLLAF

SEQ ID NO: 185315 - protein, 9 aa, Tick-borne encephalitis virus
SGIRLLAFW

SEQ ID NO: 185316 - protein, 9 aa, Tick-borne encephalitis virus
GIRLLAFWE

SEQ ID NO: 185317 - protein, 9 aa, Tick-borne encephalitis virus
IRLLAFWEL

SEQ ID NO: 185318 - protein, 9 aa, Tick-borne encephalitis virus
RLLAFWELS

SEQ ID NO: 185319 - protein, 9 aa, Tick-borne encephalitis virus
HGRRRSFSE

SEQ ID NO: 185320 - protein, 9 aa, Tick-borne encephalitis virus
GRRRSFSEP

SEQ ID NO: 185321 - protein, 9 aa, Tick-borne encephalitis virus
RRRSFSEPL

SEQ ID NO: 185322 - protein, 9 aa, Tick-borne encephalitis virus
VGVMLTLAG

SEQ ID NO: 185323 - protein, 9 aa, Tick-borne encephalitis virus
GVMLTLAGG

SEQ ID NO: 185324 - protein, 9 aa, Tick-borne encephalitis virus
VMLTLAGGM

SEQ ID NO: 185325 - protein, 9 aa, Tick-borne encephalitis virus
MLTLAGGMM

SEQ ID NO: 185326 - protein, 9 aa, Tick-borne encephalitis virus
LTLAGGMMR

SEQ ID NO: 185327 - protein, 9 aa, Tick-borne encephalitis virus
TLAGGMMRH

SEQ ID NO: 185328 - protein, 9 aa, Tick-borne encephalitis virus
LAGGMMRHT

SEQ ID NO: 185329 - protein, 9 aa, Tick-borne encephalitis virus
AGGMMRHTS

SEQ ID NO: 185330 - protein, 9 aa, Tick-borne encephalitis virus
GGMMRHTSQ

SEQ ID NO: 185331 - protein, 9 aa, Tick-borne encephalitis virus
GMMRHTPQE

SEQ ID NO: 185332 - protein, 9 aa, Tick-borne encephalitis virus
MMRHTPQEA

SEQ ID NO: 185333 - protein, 9 aa, Tick-borne encephalitis virus
MRHTPQEAL

SEQ ID NO: 185334 - protein, 9 aa, Tick-borne encephalitis virus
RHTPQEALC

SEQ ID NO: 185335 - protein, 9 aa, Tick-borne encephalitis virus
HTPQEALCA

SEQ ID NO: 185336 - protein, 9 aa, Tick-borne encephalitis virus
TPQEALCAL

SEQ ID NO: 185337 - protein, 9 aa, Tick-borne encephalitis virus
PQEALCALA

SEQ ID NO: 185338 - protein, 9 aa, Tick-borne encephalitis virus
EWSGCVEWY

SEQ ID NO: 185339 - protein, 9 aa, Tick-borne encephalitis virus
WSGCVEWYP

SEQ ID NO: 185340 - protein, 9 aa, Tick-borne encephalitis virus
SGCVEWYPE

SEQ ID NO: 185341 - protein, 9 aa, Tick-borne encephalitis virus
GCVEWYPEL

SEQ ID NO: 185342 - protein, 9 aa, Tick-borne encephalitis virus
CVEWHPELV

SEQ ID NO: 185343 - protein, 9 aa, Tick-borne encephalitis virus
VEWHPELVN

SEQ ID NO: 185344 - protein, 9 aa, Tick-borne encephalitis virus
EWHPELVNE

SEQ ID NO: 185345 - protein, 9 aa, Tick-borne encephalitis virus
WHPELVNEG

SEQ ID NO: 185346 - protein, 9 aa, Tick-borne encephalitis virus
HPELVNEGG

SEQ ID NO: 185347 - protein, 9 aa, Tick-borne encephalitis virus
PELVNEGGE

SEQ ID NO: 185348 - protein, 9 aa, Tick-borne encephalitis virus
ELVNEGGEV

SEQ ID NO: 185349 - protein, 9 aa, Tick-borne encephalitis virus
LVNEGGEVS

SEQ ID NO: 185350 - protein, 9 aa, Tick-borne encephalitis virus
VNEGGEVSL

SEQ ID NO: 185351 - protein, 9 aa, Tick-borne encephalitis virus
VSLRVRQDA

SEQ ID NO: 185352 - protein, 9 aa, Tick-borne encephalitis virus
SLRVRQDAM

SEQ ID NO: 185353 - protein, 9 aa, Tick-borne encephalitis virus
LRVRQDAMG

SEQ ID NO: 185354 - protein, 9 aa, Tick-borne encephalitis virus
RVRQDAMGN

SEQ ID NO: 185355 - protein, 9 aa, Tick-borne encephalitis virus
VRQDAMGNF

SEQ ID NO: 185356 - protein, 9 aa, Tick-borne encephalitis virus
RQDAMGNFH

SEQ ID NO: 185357 - protein, 9 aa, Tick-borne encephalitis virus
QDAMGNFHL

SEQ ID NO: 185358 - protein, 9 aa, Tick-borne encephalitis virus
DAMGNFHLT

SEQ ID NO: 185359 - protein, 9 aa, Tick-borne encephalitis virus
AMGNFHLTE

SEQ ID NO: 185360 - protein, 9 aa, Tick-borne encephalitis virus
TELEKEERM

SEQ ID NO: 185361 - protein, 9 aa, Tick-borne encephalitis virus
ELEKEERMM

SEQ ID NO: 185362 - protein, 9 aa, Tick-borne encephalitis virus
LEKEERMMA

SEQ ID NO: 185363 - protein, 9 aa, Tick-borne encephalitis virus
EKEERMMAF

SEQ ID NO: 185364 - protein, 9 aa, Tick-borne encephalitis virus
KEERMMAFW

SEQ ID NO: 185365 - protein, 9 aa, Tick-borne encephalitis virus
EERMMAFWL

SEQ ID NO: 185366 - protein, 9 aa, Tick-borne encephalitis virus
ERMMAFWLL

SEQ ID NO: 185367 - protein, 9 aa, Tick-borne encephalitis virus
RMMAFWLLA

SEQ ID NO: 185368 - protein, 9 aa, Tick-borne encephalitis virus
MMAFWLLAG

SEQ ID NO: 185369 - protein, 9 aa, Tick-borne encephalitis virus
MAFWLIAGL

SEQ ID NO: 185370 - protein, 9 aa, Tick-borne encephalitis virus
AFWLIAGLA

SEQ ID NO: 185371 - protein, 9 aa, Tick-borne encephalitis virus
FWLIAGLAA

SEQ ID NO: 185372 - protein, 9 aa, Tick-borne encephalitis virus
WLIAGLAAS

SEQ ID NO: 185373 - protein, 9 aa, Tick-borne encephalitis virus
LIAGLAASA

SEQ ID NO: 185374 - protein, 9 aa, Tick-borne encephalitis virus
AGLAASAIH

SEQ ID NO: 185375 - protein, 9 aa, Tick-borne encephalitis virus
GLAASAIHW

SEQ ID NO: 185376 - protein, 9 aa, Tick-borne encephalitis virus
LAASAIHWS

SEQ ID NO: 185377 - protein, 9 aa, Tick-borne encephalitis virus
AASAIHWSG

SEQ ID NO: 185378 - protein, 9 aa, Tick-borne encephalitis virus
ASAIHWSGI

SEQ ID NO: 185379 - protein, 9 aa, Tick-borne encephalitis virus
SAVHWSGIL

SEQ ID NO: 185380 - protein, 9 aa, Tick-borne encephalitis virus
AIHWSGILG

SEQ ID NO: 185381 - protein, 9 aa, Tick-borne encephalitis virus
VHWSGILGV

SEQ ID NO: 185382 - protein, 9 aa, Tick-borne encephalitis virus
HWSGIIGVM

SEQ ID NO: 185383 - protein, 9 aa, Tick-borne encephalitis virus
WSGIIGVMG

SEQ ID NO: 185384 - protein, 9 aa, Tick-borne encephalitis virus
SGIIGVMGL

SEQ ID NO: 185385 - protein, 9 aa, Tick-borne encephalitis virus
GIIGVMGLW

SEQ ID NO: 185386 - protein, 9 aa, Tick-borne encephalitis virus
IIGVMGLWT

SEQ ID NO: 185387 - protein, 9 aa, Tick-borne encephalitis virus
IGVMGLWTL

SEQ ID NO: 185388 - protein, 9 aa, Tick-borne encephalitis virus
GVMGLWTLT

SEQ ID NO: 185389 - protein, 9 aa, Tick-borne encephalitis virus
VMGLWTLTE

SEQ ID NO: 185390 - protein, 9 aa, Tick-borne encephalitis virus
MGLWTLTEM

SEQ ID NO: 185391 - protein, 9 aa, Tick-borne encephalitis virus
GLWTLTEML

SEQ ID NO: 185392 - protein, 9 aa, Tick-borne encephalitis virus
LWTLTEMLR

SEQ ID NO: 185393 - protein, 9 aa, Tick-borne encephalitis virus
SRRSDLVFS

SEQ ID NO: 185394 - protein, 9 aa, Tick-borne encephalitis virus
RRSGLVFSG

SEQ ID NO: 185395 - protein, 9 aa, Tick-borne encephalitis virus
RSDLAFSGQ

SEQ ID NO: 185396 - protein, 9 aa, Tick-borne encephalitis virus
SGLVFSGQG

SEQ ID NO: 185397 - protein, 9 aa, Tick-borne encephalitis virus
DLVFSGQGN

SEQ ID NO: 185398 - protein, 9 aa, Tick-borne encephalitis virus
LAFSGQGGR

SEQ ID NO: 185399 - protein, 9 aa, Tick-borne encephalitis virus
VFSGQGRGE

SEQ ID NO: 185400 - protein, 9 aa, Tick-borne encephalitis virus
FSGQGNRER

SEQ ID NO: 185401 - protein, 9 aa, Tick-borne encephalitis virus
SGQGNRERG

SEQ ID NO: 185402 - protein, 9 aa, Tick-borne encephalitis virus
GQGNRERGD

SEQ ID NO: 185403 - protein, 9 aa, Tick-borne encephalitis virus
QGGRERGDK

SEQ ID NO: 185404 - protein, 9 aa, Tick-borne encephalitis virus
GGRERGDKP

SEQ ID NO: 185405 - protein, 9 aa, Tick-borne encephalitis virus
GRERGDKPF

SEQ ID NO: 185406 - protein, 9 aa, Tick-borne encephalitis virus
RERGDKPFE

SEQ ID NO: 185407 - protein, 9 aa, Tick-borne encephalitis virus
ERGDKPFEV

SEQ ID NO: 185408 - protein, 9 aa, Tick-borne encephalitis virus
RGDKPFEVK

SEQ ID NO: 185409 - protein, 9 aa, Tick-borne encephalitis virus
GDKPFEVKD

SEQ ID NO: 185410 - protein, 9 aa, Tick-borne encephalitis virus
DKPFEVKDG

SEQ ID NO: 185411 - protein, 9 aa, Tick-borne encephalitis virus
KPFEVKDGV

SEQ ID NO: 185412 - protein, 9 aa, Tick-borne encephalitis virus
PFEVRDGVY

SEQ ID NO: 185413 - protein, 9 aa, Tick-borne encephalitis virus
FEVRDGVYR

SEQ ID NO: 185414 - protein, 9 aa, Tick-borne encephalitis virus
EVRDGVYRI

SEQ ID NO: 185415 - protein, 9 aa, Tick-borne encephalitis virus
VRDGVYRIF

SEQ ID NO: 185416 - protein, 9 aa, Tick-borne encephalitis virus
RDGVYRIFS

SEQ ID NO: 185417 - protein, 9 aa, Tick-borne encephalitis virus
YRIFSPGLF

SEQ ID NO: 185418 - protein, 9 aa, Tick-borne encephalitis virus
RIFSPGLFW

SEQ ID NO: 185419 - protein, 9 aa, Tick-borne encephalitis virus
IFSPGLFWG

SEQ ID NO: 185420 - protein, 9 aa, Tick-borne encephalitis virus
FSPGLFWGQ

SEQ ID NO: 185421 - protein, 9 aa, Tick-borne encephalitis virus
SPGLFWGQN

SEQ ID NO: 185422 - protein, 9 aa, Tick-borne encephalitis virus
PGLFWGQNQ

SEQ ID NO: 185423 - protein, 9 aa, Tick-borne encephalitis virus
GLFWGQNQV

SEQ ID NO: 185424 - protein, 9 aa, Tick-borne encephalitis virus
LFWGQNQVG

SEQ ID NO: 185425 - protein, 9 aa, Tick-borne encephalitis virus
FWGQNQVGV

SEQ ID NO: 185426 - protein, 9 aa, Tick-borne encephalitis virus
WGQNQVGVG

SEQ ID NO: 185427 - protein, 9 aa, Tick-borne encephalitis virus
GQNQVGVGY

SEQ ID NO: 185428 - protein, 9 aa, Tick-borne encephalitis virus
QNQVGVGYG

SEQ ID NO: 185429 - protein, 9 aa, Tick-borne encephalitis virus
RQVGVGYGS

SEQ ID NO: 185430 - protein, 9 aa, Tick-borne encephalitis virus
QVGVGYGFK

SEQ ID NO: 185431 - protein, 9 aa, Tick-borne encephalitis virus
VGVGYGFKG

SEQ ID NO: 185432 - protein, 9 aa, Tick-borne encephalitis virus
GVGYGFKGV

SEQ ID NO: 185433 - protein, 9 aa, Tick-borne encephalitis virus
VGYGFKGVL

SEQ ID NO: 185434 - protein, 9 aa, Tick-borne encephalitis virus
GYGFKGVLH

SEQ ID NO: 185435 - protein, 9 aa, Tick-borne encephalitis virus
YGFKGVLHT

SEQ ID NO: 185436 - protein, 9 aa, Tick-borne encephalitis virus
GFKGVLHTM

SEQ ID NO: 185437 - protein, 9 aa, Tick-borne encephalitis virus
FKGVLHTMW

SEQ ID NO: 185438 - protein, 9 aa, Tick-borne encephalitis virus
RGVLHTMWH

SEQ ID NO: 185439 - protein, 9 aa, Tick-borne encephalitis virus
HVTRGAALY

SEQ ID NO: 185440 - protein, 9 aa, Tick-borne encephalitis virus
VTRGAALYI

SEQ ID NO: 185441 - protein, 9 aa, Tick-borne encephalitis virus
TRGAALSIN

SEQ ID NO: 185442 - protein, 9 aa, Tick-borne encephalitis virus
RGAALSIND

SEQ ID NO: 185443 - protein, 9 aa, Tick-borne encephalitis virus
GAALSINDA

SEQ ID NO: 185444 - protein, 9 aa, Tick-borne encephalitis virus
AALSINDAV

SEQ ID NO: 185445 - protein, 9 aa, Tick-borne encephalitis virus
ALSINDAVA

SEQ ID NO: 185446 - protein, 9 aa, Tick-borne encephalitis virus
LSINDAVAG

SEQ ID NO: 185447 - protein, 9 aa, Tick-borne encephalitis virus
SINDAVAGP

SEQ ID NO: 185448 - protein, 9 aa, Tick-borne encephalitis virus
INDAVAGPY

SEQ ID NO: 185449 - protein, 9 aa, Tick-borne encephalitis virus
NDAVAGPYW

SEQ ID NO: 185450 - protein, 9 aa, Tick-borne encephalitis virus
DAVVGPYWA

SEQ ID NO: 185451 - protein, 9 aa, Tick-borne encephalitis virus
AVVGPYWAD

SEQ ID NO: 185452 - protein, 9 aa, Tick-borne encephalitis virus
VVGPYWADV

SEQ ID NO: 185453 - protein, 9 aa, Tick-borne encephalitis virus
AGPYWADVR

SEQ ID NO: 185454 - protein, 9 aa, Tick-borne encephalitis virus
GPYWADVRE

SEQ ID NO: 185455 - protein, 9 aa, Tick-borne encephalitis virus
PYWADVRED

SEQ ID NO: 185456 - protein, 9 aa, Tick-borne encephalitis virus
YWADVREDV

SEQ ID NO: 185457 - protein, 9 aa, Tick-borne encephalitis virus
WADVREDVV

SEQ ID NO: 185458 - protein, 9 aa, Tick-borne encephalitis virus
ADVREDVVC

SEQ ID NO: 185459 - protein, 9 aa, Tick-borne encephalitis virus
DVREDVVCY

SEQ ID NO: 185460 - protein, 9 aa, Tick-borne encephalitis virus
VREDVVCYG

SEQ ID NO: 185461 - protein, 9 aa, Tick-borne encephalitis virus
REDVVCYGG

SEQ ID NO: 185462 - protein, 9 aa, Tick-borne encephalitis virus
EDVVCYGGT

SEQ ID NO: 185463 - protein, 9 aa, Tick-borne encephalitis virus
DVVCYGGTW

SEQ ID NO: 185464 - protein, 9 aa, Tick-borne encephalitis virus
VVCYGGTWS

SEQ ID NO: 185465 - protein, 9 aa, Tick-borne encephalitis virus
VCYGGTWSL

SEQ ID NO: 185466 - protein, 9 aa, Tick-borne encephalitis virus
CYGGTWSLE

SEQ ID NO: 185467 - protein, 9 aa, Tick-borne encephalitis virus
YGGTWSLEE

SEQ ID NO: 185468 - protein, 9 aa, Tick-borne encephalitis virus
GGTWSLEEK

SEQ ID NO: 185469 - protein, 9 aa, Tick-borne encephalitis virus
GTWSLEEKW

SEQ ID NO: 185470 - protein, 9 aa, Tick-borne encephalitis virus
AWSLEEKWR

SEQ ID NO: 185471 - protein, 9 aa, Tick-borne encephalitis virus
WSLEEKWRG

SEQ ID NO: 185472 - protein, 9 aa, Tick-borne encephalitis virus
SLEEKWRGE

SEQ ID NO: 185473 - protein, 9 aa, Tick-borne encephalitis virus
LEEKWRGET

SEQ ID NO: 185474 - protein, 9 aa, Tick-borne encephalitis virus
EEKWRGETV

SEQ ID NO: 185475 - protein, 9 aa, Tick-borne encephalitis virus
EKWRGETVQ

SEQ ID NO: 185476 - protein, 9 aa, Tick-borne encephalitis virus
KWRGETVQV

SEQ ID NO: 185477 - protein, 9 aa, Tick-borne encephalitis virus
WRGETVQVH

SEQ ID NO: 185478 - protein, 9 aa, Tick-borne encephalitis virus
RGETVQVHA

SEQ ID NO: 185479 - protein, 9 aa, Tick-borne encephalitis virus
QVHAFPPGK

SEQ ID NO: 185480 - protein, 9 aa, Tick-borne encephalitis virus
VHAFPPGKA

SEQ ID NO: 185481 - protein, 9 aa, Tick-borne encephalitis virus
HAFPPGKAH

SEQ ID NO: 185482 - protein, 9 aa, Tick-borne encephalitis virus
AFPPGKAHE

SEQ ID NO: 185483 - protein, 9 aa, Tick-borne encephalitis virus
FPPGKAHEV

SEQ ID NO: 185484 - protein, 9 aa, Tick-borne encephalitis virus
PPGKAHEVH

SEQ ID NO: 185485 - protein, 9 aa, Tick-borne encephalitis virus
PGKAHEVHQ

SEQ ID NO: 185486 - protein, 9 aa, Tick-borne encephalitis virus
GKAHEVHQC

SEQ ID NO: 185487 - protein, 9 aa, Tick-borne encephalitis virus
KAHEVHQCQ

SEQ ID NO: 185488 - protein, 9 aa, Tick-borne encephalitis virus
HQCQPGELI

SEQ ID NO: 185489 - protein, 9 aa, Tick-borne encephalitis virus
QCQPGELIL

SEQ ID NO: 185490 - protein, 9 aa, Tick-borne encephalitis virus
CQPGELILD

SEQ ID NO: 185491 - protein, 9 aa, Tick-borne encephalitis virus
QPGELILDT

SEQ ID NO: 185492 - protein, 9 aa, Tick-borne encephalitis virus
PGELILDTG

SEQ ID NO: 185493 - protein, 9 aa, Tick-borne encephalitis virus
GELILDTGR

SEQ ID NO: 185494 - protein, 9 aa, Tick-borne encephalitis virus
ELILDTGRK

SEQ ID NO: 185495 - protein, 9 aa, Tick-borne encephalitis virus
GAIPIDLVK

SEQ ID NO: 185496 - protein, 9 aa, Tick-borne encephalitis virus
AIPIDLVKG

SEQ ID NO: 185497 - protein, 9 aa, Tick-borne encephalitis virus
IPIDLVKGT

SEQ ID NO: 185498 - protein, 9 aa, Tick-borne encephalitis virus
PIDLVKGTS

SEQ ID NO: 185499 - protein, 9 aa, Tick-borne encephalitis virus
IDLVKGTSG

SEQ ID NO: 185500 - protein, 9 aa, Tick-borne encephalitis virus
DLVKGTSGS

SEQ ID NO: 185501 - protein, 9 aa, Tick-borne encephalitis virus
LVKGTSGSP

SEQ ID NO: 185502 - protein, 9 aa, Tick-borne encephalitis virus
VKGTSGSPI

SEQ ID NO: 185503 - protein, 9 aa, Tick-borne encephalitis virus
KGTSGSPTL

SEQ ID NO: 185504 - protein, 9 aa, Tick-borne encephalitis virus
GTSGSPIIN

SEQ ID NO: 185505 - protein, 9 aa, Tick-borne encephalitis virus
TSGSPILNA

SEQ ID NO: 185506 - protein, 9 aa, Tick-borne encephalitis virus
SGSPILNAQ

SEQ ID NO: 185507 - protein, 9 aa, Tick-borne encephalitis virus
GSPILNAQG

SEQ ID NO: 185508 - protein, 9 aa, Tick-borne encephalitis virus
SPILNAQGV

SEQ ID NO: 185509 - protein, 9 aa, Tick-borne encephalitis virus
PILNAQGVV

SEQ ID NO: 185510 - protein, 9 aa, Tick-borne encephalitis virus
ILNAQGVVV

SEQ ID NO: 185511 - protein, 9 aa, Tick-borne encephalitis virus
LNAQGVVVG

SEQ ID NO: 185512 - protein, 9 aa, Tick-borne encephalitis virus
NAQGVVVGL

SEQ ID NO: 185513 - protein, 9 aa, Tick-borne encephalitis virus
AQGVVVGLY

SEQ ID NO: 185514 - protein, 9 aa, Tick-borne encephalitis virus
QGAVVGLYG

SEQ ID NO: 185515 - protein, 9 aa, Tick-borne encephalitis virus
GAVVGLYGN

SEQ ID NO: 185516 - protein, 9 aa, Tick-borne encephalitis virus
AVVGLYGNG

SEQ ID NO: 185517 - protein, 9 aa, Tick-borne encephalitis virus
YGNGLKTNG

SEQ ID NO: 185518 - protein, 9 aa, Tick-borne encephalitis virus
GNGLKTNGT

SEQ ID NO: 185519 - protein, 9 aa, Tick-borne encephalitis virus
NGLKTNGTY

SEQ ID NO: 185520 - protein, 9 aa, Tick-borne encephalitis virus
GLKTNGTYV

SEQ ID NO: 185521 - protein, 9 aa, Tick-borne encephalitis virus
LKTNGTYVS

SEQ ID NO: 185522 - protein, 9 aa, Tick-borne encephalitis virus
KTNGTYVSS

SEQ ID NO: 185523 - protein, 9 aa, Tick-borne encephalitis virus
TNGTYVSSI

SEQ ID NO: 185524 - protein, 9 aa, Tick-borne encephalitis virus
NGTYVSSIA

SEQ ID NO: 185525 - protein, 9 aa, Tick-borne encephalitis virus
GTYVSSIAQ

SEQ ID NO: 185526 - protein, 9 aa, Tick-borne encephalitis virus
VSSIAQGEV

SEQ ID NO: 185527 - protein, 9 aa, Tick-borne encephalitis virus
SSIAQGEVE

SEQ ID NO: 185528 - protein, 9 aa, Tick-borne encephalitis virus
SIAQGEVEK

SEQ ID NO: 185529 - protein, 9 aa, Tick-borne encephalitis virus
IAQGEVEKS

SEQ ID NO: 185530 - protein, 9 aa, Tick-borne encephalitis virus
AQGEVEKSR

SEQ ID NO: 185531 - protein, 9 aa, Tick-borne encephalitis virus
QGEVEKSRP

SEQ ID NO: 185532 - protein, 9 aa, Tick-borne encephalitis virus
GEVEKSRPN

SEQ ID NO: 185533 - protein, 9 aa, Tick-borne encephalitis virus
EVEKSRPNL

SEQ ID NO: 185534 - protein, 9 aa, Tick-borne encephalitis virus
VEKSRPNLP

SEQ ID NO: 185535 - protein, 9 aa, Tick-borne encephalitis virus
EKSRPNLPQ

SEQ ID NO: 185536 - protein, 9 aa, Tick-borne encephalitis virus
KSRPNLPQA

SEQ ID NO: 185537 - protein, 9 aa, Tick-borne encephalitis virus
SRPNLPQAV

SEQ ID NO: 185538 - protein, 9 aa, Tick-borne encephalitis virus
GTGWTSKGQ

SEQ ID NO: 185539 - protein, 9 aa, Tick-borne encephalitis virus
TGWTSKGQI

SEQ ID NO: 185540 - protein, 9 aa, Tick-borne encephalitis virus
GWTSKGQIT

SEQ ID NO: 185541 - protein, 9 aa, Tick-borne encephalitis virus
WTSKGQITV

SEQ ID NO: 185542 - protein, 9 aa, Tick-borne encephalitis virus
TSKGQITVL

SEQ ID NO: 185543 - protein, 9 aa, Tick-borne encephalitis virus
SKGQITVLD

SEQ ID NO: 185544 - protein, 9 aa, Tick-borne encephalitis virus
LPELIRQCT

SEQ ID NO: 185545 - protein, 9 aa, Tick-borne encephalitis virus
PELIRQCTD

SEQ ID NO: 185546 - protein, 9 aa, Tick-borne encephalitis virus
ELIRQCTDR

SEQ ID NO: 185547 - protein, 9 aa, Tick-borne encephalitis virus
LIRQCTDRR

SEQ ID NO: 185548 - protein, 9 aa, Tick-borne encephalitis virus
IRQCTDRRL

SEQ ID NO: 185549 - protein, 9 aa, Tick-borne encephalitis virus
RQCTDRRLR

SEQ ID NO: 185550 - protein, 9 aa, Tick-borne encephalitis virus
QCTDRRLRT

SEQ ID NO: 185551 - protein, 9 aa, Tick-borne encephalitis virus
CTDRRLRTL

SEQ ID NO: 185552 - protein, 9 aa, Tick-borne encephalitis virus
TDRRLRTLV

SEQ ID NO: 185553 - protein, 9 aa, Tick-borne encephalitis virus
LKEMERALS

SEQ ID NO: 185554 - protein, 9 aa, Tick-borne encephalitis virus
KEMERALSG

SEQ ID NO: 185555 - protein, 9 aa, Tick-borne encephalitis virus
EMERALSGK

SEQ ID NO: 185556 - protein, 9 aa, Tick-borne encephalitis virus
MERALSGKR

SEQ ID NO: 185557 - protein, 9 aa, Tick-borne encephalitis virus
ERALSGKRV

SEQ ID NO: 185558 - protein, 9 aa, Tick-borne encephalitis virus
RALSGKRVR

SEQ ID NO: 185559 - protein, 9 aa, Tick-borne encephalitis virus
ALSGKRVRF

SEQ ID NO: 185560 - protein, 9 aa, Tick-borne encephalitis virus
LSGKRVRFH

SEQ ID NO: 185561 - protein, 9 aa, Tick-borne encephalitis virus
SGKRVRFHS

SEQ ID NO: 185562 - protein, 9 aa, Tick-borne encephalitis virus
GKRVRFLSP

SEQ ID NO: 185563 - protein, 9 aa, Tick-borne encephalitis virus
KRVRFLSPA

SEQ ID NO: 185564 - protein, 9 aa, Tick-borne encephalitis virus
RVRFLSPAV

SEQ ID NO: 185565 - protein, 9 aa, Tick-borne encephalitis virus
VRFHSPAVS

SEQ ID NO: 185566 - protein, 9 aa, Tick-borne encephalitis virus
RFHSPAVSD

SEQ ID NO: 185567 - protein, 9 aa, Tick-borne encephalitis virus
FHSPAVSDQ

SEQ ID NO: 185568 - protein, 9 aa, Tick-borne encephalitis virus
HSPAVSDQQ

SEQ ID NO: 185569 - protein, 9 aa, Tick-borne encephalitis virus
DQQAGGAIV

SEQ ID NO: 185570 - protein, 9 aa, Tick-borne encephalitis virus
QQAGGAIVD

SEQ ID NO: 185571 - protein, 9 aa, Tick-borne encephalitis virus
GGSIVDVMC

SEQ ID NO: 185572 - protein, 9 aa, Tick-borne encephalitis virus
GSIVDVMCH

SEQ ID NO: 185573 - protein, 9 aa, Tick-borne encephalitis virus
SIVDVMCHA

SEQ ID NO: 185574 - protein, 9 aa, Tick-borne encephalitis virus
IVDLMCHTT

SEQ ID NO: 185575 - protein, 9 aa, Tick-borne encephalitis virus
VDLMCHTTY

SEQ ID NO: 185576 - protein, 9 aa, Tick-borne encephalitis virus
DLMCHTTYV

SEQ ID NO: 185577 - protein, 9 aa, Tick-borne encephalitis virus
LMCHTTYVN

SEQ ID NO: 185578 - protein, 9 aa, Tick-borne encephalitis virus
MCHTTYVNR

SEQ ID NO: 185579 - protein, 9 aa, Tick-borne encephalitis virus
CHTTYVNRR

SEQ ID NO: 185580 - protein, 9 aa, Tick-borne encephalitis virus
HATYVSRRL

SEQ ID NO: 185581 - protein, 9 aa, Tick-borne encephalitis virus
TTYVNRRLL

SEQ ID NO: 185582 - protein, 9 aa, Tick-borne encephalitis virus
TYVSRRLLP

SEQ ID NO: 185583 - protein, 9 aa, Tick-borne encephalitis virus
YVSRRLLPQ

SEQ ID NO: 185584 - protein, 9 aa, Tick-borne encephalitis virus
VSRRLLPQG

SEQ ID NO: 185585 - protein, 9 aa, Tick-borne encephalitis virus
SRRLLPQGR

SEQ ID NO: 185586 - protein, 9 aa, Tick-borne encephalitis virus
GRQNWEVAT

SEQ ID NO: 185587 - protein, 9 aa, Tick-borne encephalitis virus
RQNWEVATI

SEQ ID NO: 185588 - protein, 9 aa, Tick-borne encephalitis virus
QNWEVATID

SEQ ID NO: 185589 - protein, 9 aa, Tick-borne encephalitis virus
NWEVATIDE

SEQ ID NO: 185590 - protein, 9 aa, Tick-borne encephalitis virus
WEVATIDEA

SEQ ID NO: 185591 - protein, 9 aa, Tick-borne encephalitis virus
EVATIDEAH

SEQ ID NO: 185592 - protein, 9 aa, Tick-borne encephalitis virus
VATIDEAHW

SEQ ID NO: 185593 - protein, 9 aa, Tick-borne encephalitis virus
ATIDEAHWT

SEQ ID NO: 185594 - protein, 9 aa, Tick-borne encephalitis virus
TIDEAHWTD

SEQ ID NO: 185595 - protein, 9 aa, Tick-borne encephalitis virus
IDEAHWTDP

SEQ ID NO: 185596 - protein, 9 aa, Tick-borne encephalitis virus
RGHLYTLAQ

SEQ ID NO: 185597 - protein, 9 aa, Tick-borne encephalitis virus
GHLYTLAQE

SEQ ID NO: 185598 - protein, 9 aa, Tick-borne encephalitis virus
HLYTLAQEN

SEQ ID NO: 185599 - protein, 9 aa, Tick-borne encephalitis virus
LYTLAQENK

SEQ ID NO: 185600 - protein, 9 aa, Tick-borne encephalitis virus
YTLAQENKC

SEQ ID NO: 185601 - protein, 9 aa, Tick-borne encephalitis virus
TLAQENKCA

SEQ ID NO: 185602 - protein, 9 aa, Tick-borne encephalitis virus
LAQENKCAL

SEQ ID NO: 185603 - protein, 9 aa, Tick-borne encephalitis virus
AQENKCALV

SEQ ID NO: 185604 - protein, 9 aa, Tick-borne encephalitis virus
QENKCALVL

SEQ ID NO: 185605 - protein, 9 aa, Tick-borne encephalitis virus
ALVLMTATR

SEQ ID NO: 185606 - protein, 9 aa, Tick-borne encephalitis virus
LVLMTATRP

SEQ ID NO: 185607 - protein, 9 aa, Tick-borne encephalitis virus
VLMTATRPG

SEQ ID NO: 185608 - protein, 9 aa, Tick-borne encephalitis virus
LMTATRPGK

SEQ ID NO: 185609 - protein, 9 aa, Tick-borne encephalitis virus
MTATRPGKS

SEQ ID NO: 185610 - protein, 9 aa, Tick-borne encephalitis virus
TATRPGKSE

SEQ ID NO: 185611 - protein, 9 aa, Tick-borne encephalitis virus
ATRPGKSEP

SEQ ID NO: 185612 - protein, 9 aa, Tick-borne encephalitis virus
TRPGKSEPF

SEQ ID NO: 185613 - protein, 9 aa, Tick-borne encephalitis virus
RPGKSEPFP

SEQ ID NO: 185614 - protein, 9 aa, Tick-borne encephalitis virus
SEPFPESNR

SEQ ID NO: 185615 - protein, 9 aa, Tick-borne encephalitis virus
EPFPESNRG

SEQ ID NO: 185616 - protein, 9 aa, Tick-borne encephalitis virus
PFPESNRGI

SEQ ID NO: 185617 - protein, 9 aa, Tick-borne encephalitis virus
FPESNGAIS

SEQ ID NO: 185618 - protein, 9 aa, Tick-borne encephalitis virus
PESNGAISS

SEQ ID NO: 185619 - protein, 9 aa, Tick-borne encephalitis virus
ESNGAISSE

SEQ ID NO: 185620 - protein, 9 aa, Tick-borne encephalitis virus
SNGAISSEE

SEQ ID NO: 185621 - protein, 9 aa, Tick-borne encephalitis virus
NGAITSEEK

SEQ ID NO: 185622 - protein, 9 aa, Tick-borne encephalitis virus
GAITSEEKQ

SEQ ID NO: 185623 - protein, 9 aa, Tick-borne encephalitis virus
AITSEEKQI

SEQ ID NO: 185624 - protein, 9 aa, Tick-borne encephalitis virus
ITSEEKQIP

SEQ ID NO: 185625 - protein, 9 aa, Tick-borne encephalitis virus
SEERQIPDG

SEQ ID NO: 185626 - protein, 9 aa, Tick-borne encephalitis virus
EERQIPDGE

SEQ ID NO: 185627 - protein, 9 aa, Tick-borne encephalitis virus
ERQIPDGEW

SEQ ID NO: 185628 - protein, 9 aa, Tick-borne encephalitis virus
RQIPDGEWR

SEQ ID NO: 185629 - protein, 9 aa, Tick-borne encephalitis virus
QIPEGEWRD

SEQ ID NO: 185630 - protein, 9 aa, Tick-borne encephalitis virus
IPEGEWRDG

SEQ ID NO: 185631 - protein, 9 aa, Tick-borne encephalitis virus
PEGEWRDGF

SEQ ID NO: 185632 - protein, 9 aa, Tick-borne encephalitis virus
EGEWRDGFD

SEQ ID NO: 185633 - protein, 9 aa, Tick-borne encephalitis virus
WITEYEGRS

SEQ ID NO: 185634 - protein, 9 aa, Tick-borne encephalitis virus
ITEYEGRSA

SEQ ID NO: 185635 - protein, 9 aa, Tick-borne encephalitis virus
TEYEGRSAW

SEQ ID NO: 185636 - protein, 9 aa, Tick-borne encephalitis virus
EYEGRSAWF

SEQ ID NO: 185637 - protein, 9 aa, Tick-borne encephalitis virus
YEGRSAWFV

SEQ ID NO: 185638 - protein, 9 aa, Tick-borne encephalitis virus
EGRSAWFVP

SEQ ID NO: 185639 - protein, 9 aa, Tick-borne encephalitis virus
GRSAWFVPS

SEQ ID NO: 185640 - protein, 9 aa, Tick-borne encephalitis virus
RSAWFVPSI

SEQ ID NO: 185641 - protein, 9 aa, Tick-borne encephalitis virus
TAWFVPSIV

SEQ ID NO: 185642 - protein, 9 aa, Tick-borne encephalitis virus
AWFVPSIVK

SEQ ID NO: 185643 - protein, 9 aa, Tick-borne encephalitis virus
WFVPSIVKG

SEQ ID NO: 185644 - protein, 9 aa, Tick-borne encephalitis virus
FVPSIVKGG

SEQ ID NO: 185645 - protein, 9 aa, Tick-borne encephalitis virus
VPSIAKGGA

SEQ ID NO: 185646 - protein, 9 aa, Tick-borne encephalitis virus
PSIAKGGAI

SEQ ID NO: 185647 - protein, 9 aa, Tick-borne encephalitis virus
SIAKGGAIA

SEQ ID NO: 185648 - protein, 9 aa, Tick-borne encephalitis virus
IAKGGAIAR

SEQ ID NO: 185649 - protein, 9 aa, Tick-borne encephalitis virus
AKGGAIART

SEQ ID NO: 185650 - protein, 9 aa, Tick-borne encephalitis virus
KGGAIARTL

SEQ ID NO: 185651 - protein, 9 aa, Tick-borne encephalitis virus
GGAIARTLR

SEQ ID NO: 185652 - protein, 9 aa, Tick-borne encephalitis virus
GAIARTLRQ

SEQ ID NO: 185653 - protein, 9 aa, Tick-borne encephalitis virus
AIARTLRQK

SEQ ID NO: 185654 - protein, 9 aa, Tick-borne encephalitis virus
IARALRQKG

SEQ ID NO: 185655 - protein, 9 aa, Tick-borne encephalitis virus
ARALRQKGK

SEQ ID NO: 185656 - protein, 9 aa, Tick-borne encephalitis virus
RALRQKGKS

SEQ ID NO: 185657 - protein, 9 aa, Tick-borne encephalitis virus
ALRQKGKSV

SEQ ID NO: 185658 - protein, 9 aa, Tick-borne encephalitis virus
SKTFEKDYT

SEQ ID NO: 185659 - protein, 9 aa, Tick-borne encephalitis virus
KTFEKDYTR

SEQ ID NO: 185660 - protein, 9 aa, Tick-borne encephalitis virus
TFEKDYTRV

SEQ ID NO: 185661 - protein, 9 aa, Tick-borne encephalitis virus
FEKDYTRVR

SEQ ID NO: 185662 - protein, 9 aa, Tick-borne encephalitis virus
EKDYTRVRD

SEQ ID NO: 185663 - protein, 9 aa, Tick-borne encephalitis virus
KDYTRVRDE

SEQ ID NO: 185664 - protein, 9 aa, Tick-borne encephalitis virus
DYTRVRDEK

SEQ ID NO: 185665 - protein, 9 aa, Tick-borne encephalitis virus
YTRVRDEKP

SEQ ID NO: 185666 - protein, 9 aa, Tick-borne encephalitis virus
TRVRDEKPD

SEQ ID NO: 185667 - protein, 9 aa, Tick-borne encephalitis virus
IKPEEVDGK

SEQ ID NO: 185668 - protein, 9 aa, Tick-borne encephalitis virus
KPEEVDGKV

SEQ ID NO: 185669 - protein, 9 aa, Tick-borne encephalitis virus
PEEVDGKVE

SEQ ID NO: 185670 - protein, 9 aa, Tick-borne encephalitis virus
EEVDGKVEL

SEQ ID NO: 185671 - protein, 9 aa, Tick-borne encephalitis virus
EVDGKVELT

SEQ ID NO: 185672 - protein, 9 aa, Tick-borne encephalitis virus
VDGKVELTG

SEQ ID NO: 185673 - protein, 9 aa, Tick-borne encephalitis virus
DGKVELTGT

SEQ ID NO: 185674 - protein, 9 aa, Tick-borne encephalitis virus
GKVELTGTR

SEQ ID NO: 185675 - protein, 9 aa, Tick-borne encephalitis virus
KVELTGTRR

SEQ ID NO: 185676 - protein, 9 aa, Tick-borne encephalitis virus
VELIGTRRV

SEQ ID NO: 185677 - protein, 9 aa, Tick-borne encephalitis virus
ELIGTRRVT

SEQ ID NO: 185678 - protein, 9 aa, Tick-borne encephalitis virus
LIGTRRVTT

SEQ ID NO: 185679 - protein, 9 aa, Tick-borne encephalitis virus
IGTRRVTTA

SEQ ID NO: 185680 - protein, 9 aa, Tick-borne encephalitis virus
RVTTASAAP

SEQ ID NO: 185681 - protein, 9 aa, Tick-borne encephalitis virus
VTTASAAPR

SEQ ID NO: 185682 - protein, 9 aa, Tick-borne encephalitis virus
TTASAAPRR

SEQ ID NO: 185683 - protein, 9 aa, Tick-borne encephalitis virus
TASAAPRRG

SEQ ID NO: 185684 - protein, 9 aa, Tick-borne encephalitis virus
ASAAPRRGR

SEQ ID NO: 185685 - protein, 9 aa, Tick-borne encephalitis virus
SAAPRRGRV

SEQ ID NO: 185686 - protein, 9 aa, Tick-borne encephalitis virus
AAPRRGRVG

SEQ ID NO: 185687 - protein, 9 aa, Tick-borne encephalitis virus
APRRGRVGR

SEQ ID NO: 185688 - protein, 9 aa, Tick-borne encephalitis virus
QRRGRVGRH

SEQ ID NO: 185689 - protein, 9 aa, Tick-borne encephalitis virus
RRGRVGRQD

SEQ ID NO: 185690 - protein, 9 aa, Tick-borne encephalitis virus
RGRVGRQDG

SEQ ID NO: 185691 - protein, 9 aa, Tick-borne encephalitis virus
GRVGRQDGR

SEQ ID NO: 185692 - protein, 9 aa, Tick-borne encephalitis virus
RVGRQDGRT

SEQ ID NO: 185693 - protein, 9 aa, Tick-borne encephalitis virus
VGRQDGRTD

SEQ ID NO: 185694 - protein, 9 aa, Tick-borne encephalitis virus
GRQDGRTDE

SEQ ID NO: 185695 - protein, 9 aa, Tick-borne encephalitis virus
RQDGRTDEY

SEQ ID NO: 185696 - protein, 9 aa, Tick-borne encephalitis virus
QDGRTDEYI

SEQ ID NO: 185697 - protein, 9 aa, Tick-borne encephalitis virus
DGRTDEYIY

SEQ ID NO: 185698 - protein, 9 aa, Tick-borne encephalitis virus
GRIDEYIYS

SEQ ID NO: 185699 - protein, 9 aa, Tick-borne encephalitis virus
RIDEYIYSG

SEQ ID NO: 185700 - protein, 9 aa, Tick-borne encephalitis virus
IDEYIYSGQ

SEQ ID NO: 185701 - protein, 9 aa, Tick-borne encephalitis virus
YIYSGQCDE

SEQ ID NO: 185702 - protein, 9 aa, Tick-borne encephalitis virus
IYSGQCDEY

SEQ ID NO: 185703 - protein, 9 aa, Tick-borne encephalitis virus
YSGQCDEYD

SEQ ID NO: 185704 - protein, 9 aa, Tick-borne encephalitis virus
SGQCDEYDS

SEQ ID NO: 185705 - protein, 9 aa, Tick-borne encephalitis virus
GQCDDDDGG

SEQ ID NO: 185706 - protein, 9 aa, Tick-borne encephalitis virus
QCDDDDGGL

SEQ ID NO: 185707 - protein, 9 aa, Tick-borne encephalitis virus
CDDDDSVLV

SEQ ID NO: 185708 - protein, 9 aa, Tick-borne encephalitis virus
DDDDSVLVQ

SEQ ID NO: 185709 - protein, 9 aa, Tick-borne encephalitis virus
DDDSVLVQW

SEQ ID NO: 185710 - protein, 9 aa, Tick-borne encephalitis virus
DDGGLVQWK

SEQ ID NO: 185711 - protein, 9 aa, Tick-borne encephalitis virus
DGGLVQWKE

SEQ ID NO: 185712 - protein, 9 aa, Tick-borne encephalitis virus
GGLVQWKEA

SEQ ID NO: 185713 - protein, 9 aa, Tick-borne encephalitis virus
GLVQWKEGQ

SEQ ID NO: 185714 - protein, 9 aa, Tick-borne encephalitis virus
LVQWKEGQI

SEQ ID NO: 185715 - protein, 9 aa, Tick-borne encephalitis virus
VQWKEGQIL

SEQ ID NO: 185716 - protein, 9 aa, Tick-borne encephalitis virus
QWKEGQILL

SEQ ID NO: 185717 - protein, 9 aa, Tick-borne encephalitis virus
WKEGQILLD

SEQ ID NO: 185718 - protein, 9 aa, Tick-borne encephalitis virus
KEAQILLDD

SEQ ID NO: 185719 - protein, 9 aa, Tick-borne encephalitis virus
EAQILLDDI

SEQ ID NO: 185720 - protein, 9 aa, Tick-borne encephalitis virus
AQILLDDIT

SEQ ID NO: 185721 - protein, 9 aa, Tick-borne encephalitis virus
QILLDNIIT

SEQ ID NO: 185722 - protein, 9 aa, Tick-borne encephalitis virus
ILLDNIITL

SEQ ID NO: 185723 - protein, 9 aa, Tick-borne encephalitis virus
LLDDITTLR

SEQ ID NO: 185724 - protein, 9 aa, Tick-borne encephalitis virus
LDNIITLRG

SEQ ID NO: 185725 - protein, 9 aa, Tick-borne encephalitis virus
DDITTLRGP

SEQ ID NO: 185726 - protein, 9 aa, Tick-borne encephalitis virus
DITTLRGPV

SEQ ID NO: 185727 - protein, 9 aa, Tick-borne encephalitis virus
ITTLRGPVV

SEQ ID NO: 185728 - protein, 9 aa, Tick-borne encephalitis virus
ITLRGPVAT

SEQ ID NO: 185729 - protein, 9 aa, Tick-borne encephalitis virus
TLRGPVVTF

SEQ ID NO: 185730 - protein, 9 aa, Tick-borne encephalitis virus
LRGPVVTFY

SEQ ID NO: 185731 - protein, 9 aa, Tick-borne encephalitis virus
RGPVVTFYG

SEQ ID NO: 185732 - protein, 9 aa, Tick-borne encephalitis virus
GPVVTFYGP

SEQ ID NO: 185733 - protein, 9 aa, Tick-borne encephalitis virus
PVVTFYGPE

SEQ ID NO: 185734 - protein, 9 aa, Tick-borne encephalitis virus
VVTFYGPEQ

SEQ ID NO: 185735 - protein, 9 aa, Tick-borne encephalitis virus
VTFYGPEQD

SEQ ID NO: 185736 - protein, 9 aa, Tick-borne encephalitis virus
TFYGPEQDR

SEQ ID NO: 185737 - protein, 9 aa, Tick-borne encephalitis virus
FYGPEQDRM

SEQ ID NO: 185738 - protein, 9 aa, Tick-borne encephalitis virus
YGPEQDRMP

SEQ ID NO: 185739 - protein, 9 aa, Tick-borne encephalitis virus
GPEQDRMPE

SEQ ID NO: 185740 - protein, 9 aa, Tick-borne encephalitis virus
PEQDRMPEV

SEQ ID NO: 185741 - protein, 9 aa, Tick-borne encephalitis virus
EQDRMPEVA

SEQ ID NO: 185742 - protein, 9 aa, Tick-borne encephalitis virus
QDRMPEVAG

SEQ ID NO: 185743 - protein, 9 aa, Tick-borne encephalitis virus
DRMPEVAGH

SEQ ID NO: 185744 - protein, 9 aa, Tick-borne encephalitis virus
RMPEVAGHF

SEQ ID NO: 185745 - protein, 9 aa, Tick-borne encephalitis virus
MPEVAGHYR

SEQ ID NO: 185746 - protein, 9 aa, Tick-borne encephalitis virus
PEVAGHYRL

SEQ ID NO: 185747 - protein, 9 aa, Tick-borne encephalitis virus
EVAGHYRLT

SEQ ID NO: 185748 - protein, 9 aa, Tick-borne encephalitis virus
VAGHYRLTE

SEQ ID NO: 185749 - protein, 9 aa, Tick-borne encephalitis virus
AGHYRLTEE

SEQ ID NO: 185750 - protein, 9 aa, Tick-borne encephalitis virus
GHYRLTEEK

SEQ ID NO: 185751 - protein, 9 aa, Tick-borne encephalitis virus
HYRLTEEKR

SEQ ID NO: 185752 - protein, 9 aa, Tick-borne encephalitis virus
YRLTEEKRK

SEQ ID NO: 185753 - protein, 9 aa, Tick-borne encephalitis virus
WHVAANVSG

SEQ ID NO: 185754 - protein, 9 aa, Tick-borne encephalitis virus
HVAANVSGV

SEQ ID NO: 185755 - protein, 9 aa, Tick-borne encephalitis virus
VAANVSGVT

SEQ ID NO: 185756 - protein, 9 aa, Tick-borne encephalitis virus
AANVSSVTD

SEQ ID NO: 185757 - protein, 9 aa, Tick-borne encephalitis virus
ANVSSVTDR

SEQ ID NO: 185758 - protein, 9 aa, Tick-borne encephalitis virus
NVSSVTDRS

SEQ ID NO: 185759 - protein, 9 aa, Tick-borne encephalitis virus
VSSVTDRSW

SEQ ID NO: 185760 - protein, 9 aa, Tick-borne encephalitis virus
SSVTDRSWT

SEQ ID NO: 185761 - protein, 9 aa, Tick-borne encephalitis virus
SVTDRSWTW

SEQ ID NO: 185762 - protein, 9 aa, Tick-borne encephalitis virus
VTDRSWTWE

SEQ ID NO: 185763 - protein, 9 aa, Tick-borne encephalitis virus
TDRSWTWEG

SEQ ID NO: 185764 - protein, 9 aa, Tick-borne encephalitis virus
DRSWTWEGP

SEQ ID NO: 185765 - protein, 9 aa, Tick-borne encephalitis virus
RSWTWEGPE

SEQ ID NO: 185766 - protein, 9 aa, Tick-borne encephalitis virus
SWTWEGPEA

SEQ ID NO: 185767 - protein, 9 aa, Tick-borne encephalitis virus
WTWEGPEAN

SEQ ID NO: 185768 - protein, 9 aa, Tick-borne encephalitis virus
TWEGPEENA

SEQ ID NO: 185769 - protein, 9 aa, Tick-borne encephalitis virus
WEGPEANAV

SEQ ID NO: 185770 - protein, 9 aa, Tick-borne encephalitis virus
EGPEENAVD

SEQ ID NO: 185771 - protein, 9 aa, Tick-borne encephalitis virus
GPEENAVDE

SEQ ID NO: 185772 - protein, 9 aa, Tick-borne encephalitis virus
PEENAVDEA

SEQ ID NO: 185773 - protein, 9 aa, Tick-borne encephalitis virus
EANAVDEAS

SEQ ID NO: 185774 - protein, 9 aa, Tick-borne encephalitis virus
ANAVDEASG

SEQ ID NO: 185775 - protein, 9 aa, Tick-borne encephalitis virus
NAVDEANGD

SEQ ID NO: 185776 - protein, 9 aa, Tick-borne encephalitis virus
AVDEANGDL

SEQ ID NO: 185777 - protein, 9 aa, Tick-borne encephalitis virus
VDEASGDLV

SEQ ID NO: 185778 - protein, 9 aa, Tick-borne encephalitis virus
DEASGDLVT

SEQ ID NO: 185779 - protein, 9 aa, Tick-borne encephalitis virus
EASGDLVTF

SEQ ID NO: 185780 - protein, 9 aa, Tick-borne encephalitis virus
ASGDLVTFR

SEQ ID NO: 185781 - protein, 9 aa, Tick-borne encephalitis virus
SGDLVTFRS

SEQ ID NO: 185782 - protein, 9 aa, Tick-borne encephalitis virus
GDLVTFKSP

SEQ ID NO: 185783 - protein, 9 aa, Tick-borne encephalitis virus
DLVTFKSPN

SEQ ID NO: 185784 - protein, 9 aa, Tick-borne encephalitis virus
LVTFKSPNG

SEQ ID NO: 185785 - protein, 9 aa, Tick-borne encephalitis virus
VTFKSPNGA

SEQ ID NO: 185786 - protein, 9 aa, Tick-borne encephalitis virus
TFKSPNGAE

SEQ ID NO: 185787 - protein, 9 aa, Tick-borne encephalitis virus
FKSPNGAER

SEQ ID NO: 185788 - protein, 9 aa, Tick-borne encephalitis virus
KSPNGAERT

SEQ ID NO: 185789 - protein, 9 aa, Tick-borne encephalitis virus
PNGAERTLK

SEQ ID NO: 185790 - protein, 9 aa, Tick-borne encephalitis virus
NGAERTLKP

SEQ ID NO: 185791 - protein, 9 aa, Tick-borne encephalitis virus
GAERTLKPV

SEQ ID NO: 185792 - protein, 9 aa, Tick-borne encephalitis virus
AERTLKPVW

SEQ ID NO: 185793 - protein, 9 aa, Tick-borne encephalitis virus
ERTLRPVWK

SEQ ID NO: 185794 - protein, 9 aa, Tick-borne encephalitis virus
RTLRPVWKD

SEQ ID NO: 185795 - protein, 9 aa, Tick-borne encephalitis virus
TLRPVWKDA

SEQ ID NO: 185796 - protein, 9 aa, Tick-borne encephalitis virus
LRPVWKDAR

SEQ ID NO: 185797 - protein, 9 aa, Tick-borne encephalitis virus
RPVWKDARM

SEQ ID NO: 185798 - protein, 9 aa, Tick-borne encephalitis virus
PVWKDARMF

SEQ ID NO: 185799 - protein, 9 aa, Tick-borne encephalitis virus
VWKDARMFK

SEQ ID NO: 185800 - protein, 9 aa, Tick-borne encephalitis virus
WKDARMFKE

SEQ ID NO: 185801 - protein, 9 aa, Tick-borne encephalitis virus
KDARMFKEG

SEQ ID NO: 185802 - protein, 9 aa, Tick-borne encephalitis virus
DARMFKEGR

SEQ ID NO: 185803 - protein, 9 aa, Tick-borne encephalitis virus
ARMFKEGRD

SEQ ID NO: 185804 - protein, 9 aa, Tick-borne encephalitis virus
RMFKEGRDI

SEQ ID NO: 185805 - protein, 9 aa, Tick-borne encephalitis virus
MFKEGRDIK

SEQ ID NO: 185806 - protein, 9 aa, Tick-borne encephalitis virus
FKEGRDIKE

SEQ ID NO: 185807 - protein, 9 aa, Tick-borne encephalitis virus
KEGRDIKEF

SEQ ID NO: 185808 - protein, 9 aa, Tick-borne encephalitis virus
EGRDIKEFV

SEQ ID NO: 185809 - protein, 9 aa, Tick-borne encephalitis virus
GRDIKEFVA

SEQ ID NO: 185810 - protein, 9 aa, Tick-borne encephalitis virus
RDIKEFVAY

SEQ ID NO: 185811 - protein, 9 aa, Tick-borne encephalitis virus
DIKEFVAYA

SEQ ID NO: 185812 - protein, 9 aa, Tick-borne encephalitis virus
IKEFVAYAS

SEQ ID NO: 185813 - protein, 9 aa, Tick-borne encephalitis virus
KEFVAYASG

SEQ ID NO: 185814 - protein, 9 aa, Tick-borne encephalitis virus
EFIAYASGR

SEQ ID NO: 185815 - protein, 9 aa, Tick-borne encephalitis virus
FIAYASGRR

SEQ ID NO: 185816 - protein, 9 aa, Tick-borne encephalitis virus
IAYASGRRS

SEQ ID NO: 185817 - protein, 9 aa, Tick-borne encephalitis virus
AYASGRRSI

SEQ ID NO: 185818 - protein, 9 aa, Tick-borne encephalitis virus
YASGRRSIG

SEQ ID NO: 185819 - protein, 9 aa, Tick-borne encephalitis virus
ASGRRSIGD

SEQ ID NO: 185820 - protein, 9 aa, Tick-borne encephalitis virus
SGRRSIGDV

SEQ ID NO: 185821 - protein, 9 aa, Tick-borne encephalitis virus
GRRSIGDVL

SEQ ID NO: 185822 - protein, 9 aa, Tick-borne encephalitis virus
RRSFGDVLT

SEQ ID NO: 185823 - protein, 9 aa, Tick-borne encephalitis virus
RSFGDVLTG

SEQ ID NO: 185824 - protein, 9 aa, Tick-borne encephalitis virus
SFGDVLTGM

SEQ ID NO: 185825 - protein, 9 aa, Tick-borne encephalitis virus
FGDVLTGMS

SEQ ID NO: 185826 - protein, 9 aa, Tick-borne encephalitis virus
GDVLTGMSG

SEQ ID NO: 185827 - protein, 9 aa, Tick-borne encephalitis virus
DVLTGMSGV

SEQ ID NO: 185828 - protein, 9 aa, Tick-borne encephalitis virus
VLTGMSGVP

SEQ ID NO: 185829 - protein, 9 aa, Tick-borne encephalitis virus
LTGMSGVPE

SEQ ID NO: 185830 - protein, 9 aa, Tick-borne encephalitis virus
TGMSGVPEL

SEQ ID NO: 185831 - protein, 9 aa, Tick-borne encephalitis virus
LRHRCVSAL

SEQ ID NO: 185832 - protein, 9 aa, Tick-borne encephalitis virus
RHRCVSALD

SEQ ID NO: 185833 - protein, 9 aa, Tick-borne encephalitis virus
HRCVSALDV

SEQ ID NO: 185834 - protein, 9 aa, Tick-borne encephalitis virus
RCVSALDVF

SEQ ID NO: 185835 - protein, 9 aa, Tick-borne encephalitis virus
CVSALDVFY

SEQ ID NO: 185836 - protein, 9 aa, Tick-borne encephalitis virus
VSALDVFYT

SEQ ID NO: 185837 - protein, 9 aa, Tick-borne encephalitis virus
SALDVFYTL

SEQ ID NO: 185838 - protein, 9 aa, Tick-borne encephalitis virus
ALDVFYTLM

SEQ ID NO: 185839 - protein, 9 aa, Tick-borne encephalitis virus
LDVFYTLMH

SEQ ID NO: 185840 - protein, 9 aa, Tick-borne encephalitis virus
DVFYTLMHD

SEQ ID NO: 185841 - protein, 9 aa, Tick-borne encephalitis virus
VFYTLMHEK

SEQ ID NO: 185842 - protein, 9 aa, Tick-borne encephalitis virus
FYTLMHEKP

SEQ ID NO: 185843 - protein, 9 aa, Tick-borne encephalitis virus
YTLMHDEPG

SEQ ID NO: 185844 - protein, 9 aa, Tick-borne encephalitis virus
TLMHEKPDS

SEQ ID NO: 185845 - protein, 9 aa, Tick-borne encephalitis virus
LMHEEPGSS

SEQ ID NO: 185846 - protein, 9 aa, Tick-borne encephalitis virus
MHDEPGSRA

SEQ ID NO: 185847 - protein, 9 aa, Tick-borne encephalitis virus
HEEPGSSAM

SEQ ID NO: 185848 - protein, 9 aa, Tick-borne encephalitis virus
EEPGSRAMK

SEQ ID NO: 185849 - protein, 9 aa, Tick-borne encephalitis virus
EPGSRAMKM

SEQ ID NO: 185850 - protein, 9 aa, Tick-borne encephalitis virus
PGSRAMKMA

SEQ ID NO: 185851 - protein, 9 aa, Tick-borne encephalitis virus
GSRAMKMAE

SEQ ID NO: 185852 - protein, 9 aa, Tick-borne encephalitis virus
SRAMKMAER

SEQ ID NO: 185853 - protein, 9 aa, Tick-borne encephalitis virus
RAMKMAERD

SEQ ID NO: 185854 - protein, 9 aa, Tick-borne encephalitis virus
AMKMAERDA

SEQ ID NO: 185855 - protein, 9 aa, Tick-borne encephalitis virus
MKMAERDAP

SEQ ID NO: 185856 - protein, 9 aa, Tick-borne encephalitis virus
KMAERDAPE

SEQ ID NO: 185857 - protein, 9 aa, Tick-borne encephalitis virus
DAPEAFLTM

SEQ ID NO: 185858 - protein, 9 aa, Tick-borne encephalitis virus
APEAFLTMV

SEQ ID NO: 185859 - protein, 9 aa, Tick-borne encephalitis virus
PEAFLTMVE

SEQ ID NO: 185860 - protein, 9 aa, Tick-borne encephalitis virus
AEMMVLGLA

SEQ ID NO: 185861 - protein, 9 aa, Tick-borne encephalitis virus
EVMVLGLAT

SEQ ID NO: 185862 - protein, 9 aa, Tick-borne encephalitis virus
VMVLGLATL

SEQ ID NO: 185863 - protein, 9 aa, Tick-borne encephalitis virus
MVLGLGTLG

SEQ ID NO: 185864 - protein, 9 aa, Tick-borne encephalitis virus
VLGLGTLGV

SEQ ID NO: 185865 - protein, 9 aa, Tick-borne encephalitis virus
LGLATLGVI

SEQ ID NO: 185866 - protein, 9 aa, Tick-borne encephalitis virus
GLATLGVIW

SEQ ID NO: 185867 - protein, 9 aa, Tick-borne encephalitis virus
LATLGVIWC

SEQ ID NO: 185868 - protein, 9 aa, Tick-borne encephalitis virus
ATLGVIWCF

SEQ ID NO: 185869 - protein, 9 aa, Tick-borne encephalitis virus
TLGVIWCFV

SEQ ID NO: 185870 - protein, 9 aa, Tick-borne encephalitis virus
LGVIWCFVV

SEQ ID NO: 185871 - protein, 9 aa, Tick-borne encephalitis virus
GVIWCFVVR

SEQ ID NO: 185872 - protein, 9 aa, Tick-borne encephalitis virus
VIWCFVVRT

SEQ ID NO: 185873 - protein, 9 aa, Tick-borne encephalitis virus
IWCFVVRTS

SEQ ID NO: 185874 - protein, 9 aa, Tick-borne encephalitis virus
WCFVARTSI

SEQ ID NO: 185875 - protein, 9 aa, Tick-borne encephalitis virus
CFVARTSIS

SEQ ID NO: 185876 - protein, 9 aa, Tick-borne encephalitis virus
FVARTSISR

SEQ ID NO: 185877 - protein, 9 aa, Tick-borne encephalitis virus
VVRASISRM

SEQ ID NO: 185878 - protein, 9 aa, Tick-borne encephalitis virus
ARTSISRMM

SEQ ID NO: 185879 - protein, 9 aa, Tick-borne encephalitis virus
RASISRMML

SEQ ID NO: 185880 - protein, 9 aa, Tick-borne encephalitis virus
ASISRMMLG

SEQ ID NO: 185881 - protein, 9 aa, Tick-borne encephalitis virus
TLVLLASLL

SEQ ID NO: 185882 - protein, 9 aa, Tick-borne encephalitis virus
LVLLASLLL

SEQ ID NO: 185883 - protein, 9 aa, Tick-borne encephalitis virus
VLLASLLLL

SEQ ID NO: 185884 - protein, 9 aa, Tick-borne encephalitis virus
LLASLLLLW

SEQ ID NO: 185885 - protein, 9 aa, Tick-borne encephalitis virus
LASLLLLWA

SEQ ID NO: 185886 - protein, 9 aa, Tick-borne encephalitis virus
ASLLLLWAG

SEQ ID NO: 185887 - protein, 9 aa, Tick-borne encephalitis virus
SLLLLWAGG

SEQ ID NO: 185888 - protein, 9 aa, Tick-borne encephalitis virus
LLLLWAGGV

SEQ ID NO: 185889 - protein, 9 aa, Tick-borne encephalitis virus
LLLWAGGVG

SEQ ID NO: 185890 - protein, 9 aa, Tick-borne encephalitis virus
LLWAGGVGY

SEQ ID NO: 185891 - protein, 9 aa, Tick-borne encephalitis virus
LWAGGVGYG

SEQ ID NO: 185892 - protein, 9 aa, Tick-borne encephalitis virus
WAGGVGYGN

SEQ ID NO: 185893 - protein, 9 aa, Tick-borne encephalitis virus
AGGVGYGNM

SEQ ID NO: 185894 - protein, 9 aa, Tick-borne encephalitis virus
GGVGYGNMA

SEQ ID NO: 185895 - protein, 9 aa, Tick-borne encephalitis virus
GVGYGNMAG

SEQ ID NO: 185896 - protein, 9 aa, Tick-borne encephalitis virus
VGYGNMAGV

SEQ ID NO: 185897 - protein, 9 aa, Tick-borne encephalitis virus
GYGNMAGVA

SEQ ID NO: 185898 - protein, 9 aa, Tick-borne encephalitis virus
LLTVLQPEV

SEQ ID NO: 185899 - protein, 9 aa, Tick-borne encephalitis virus
LTVLQPEVG

SEQ ID NO: 185900 - protein, 9 aa, Tick-borne encephalitis virus
TVLQPEVGK

SEQ ID NO: 185901 - protein, 9 aa, Tick-borne encephalitis virus
VLQPEVGKQ

SEQ ID NO: 185902 - protein, 9 aa, Tick-borne encephalitis virus
LQPEVGKQR

SEQ ID NO: 185903 - protein, 9 aa, Tick-borne encephalitis virus
QPEVGKQRS

SEQ ID NO: 185904 - protein, 9 aa, Tick-borne encephalitis virus
PEVGKQRSS

SEQ ID NO: 185905 - protein, 9 aa, Tick-borne encephalitis virus
EVGKQRSSD

SEQ ID NO: 185906 - protein, 9 aa, Tick-borne encephalitis virus
VGKQRSSDD

SEQ ID NO: 185907 - protein, 9 aa, Tick-borne encephalitis virus
YFLLTLCSV

SEQ ID NO: 185908 - protein, 9 aa, Tick-borne encephalitis virus
FLLTLCSVA

SEQ ID NO: 185909 - protein, 9 aa, Tick-borne encephalitis virus
LLTLCSVAG

SEQ ID NO: 185910 - protein, 9 aa, Tick-borne encephalitis virus
LTLCSVAGL

SEQ ID NO: 185911 - protein, 9 aa, Tick-borne encephalitis virus
TLCSVAGLV

SEQ ID NO: 185912 - protein, 9 aa, Tick-borne encephalitis virus
LCSVAGLVA

SEQ ID NO: 185913 - protein, 9 aa, Tick-borne encephalitis virus
CSVAGLVAA

SEQ ID NO: 185914 - protein, 9 aa, Tick-borne encephalitis virus
SVAGLVAAN

SEQ ID NO: 185915 - protein, 9 aa, Tick-borne encephalitis virus
VAGLVAANE

SEQ ID NO: 185916 - protein, 9 aa, Tick-borne encephalitis virus
LVAANEMGL

SEQ ID NO: 185917 - protein, 9 aa, Tick-borne encephalitis virus
VAANEMGLL

SEQ ID NO: 185918 - protein, 9 aa, Tick-borne encephalitis virus
AANEMGLLE

SEQ ID NO: 185919 - protein, 9 aa, Tick-borne encephalitis virus
ANEMGFLER

SEQ ID NO: 185920 - protein, 9 aa, Tick-borne encephalitis virus
NEMGFLERT

SEQ ID NO: 185921 - protein, 9 aa, Tick-borne encephalitis virus
EMGFLERTK

SEQ ID NO: 185922 - protein, 9 aa, Tick-borne encephalitis virus
MGFLERTKA

SEQ ID NO: 185923 - protein, 9 aa, Tick-borne encephalitis virus
GFLERTKAD

SEQ ID NO: 185924 - protein, 9 aa, Tick-borne encephalitis virus
FLERTKADL

SEQ ID NO: 185925 - protein, 9 aa, Tick-borne encephalitis virus
LERTKADLS

SEQ ID NO: 185926 - protein, 9 aa, Tick-borne encephalitis virus
ERTKADLST

SEQ ID NO: 185927 - protein, 9 aa, Tick-borne encephalitis virus
RTKADLSTV

SEQ ID NO: 185928 - protein, 9 aa, Tick-borne encephalitis virus
TKADLSTAL

SEQ ID NO: 185929 - protein, 9 aa, Tick-borne encephalitis virus
KADLSTALW

SEQ ID NO: 185930 - protein, 9 aa, Tick-borne encephalitis virus
ADLSTALWS

SEQ ID NO: 185931 - protein, 9 aa, Tick-borne encephalitis virus
EPRPWSEWT

SEQ ID NO: 185932 - protein, 9 aa, Tick-borne encephalitis virus
PRPWSEWTN

SEQ ID NO: 185933 - protein, 9 aa, Tick-borne encephalitis virus
RPWSEWTNV

SEQ ID NO: 185934 - protein, 9 aa, Tick-borne encephalitis virus
PWSEWTNVD

SEQ ID NO: 185935 - protein, 9 aa, Tick-borne encephalitis virus
WSEWTNVDI

SEQ ID NO: 185936 - protein, 9 aa, Tick-borne encephalitis virus
SEWTNVDIQ

SEQ ID NO: 185937 - protein, 9 aa, Tick-borne encephalitis virus
EWTNVDIQP

SEQ ID NO: 185938 - protein, 9 aa, Tick-borne encephalitis virus
WTNVDIQPA

SEQ ID NO: 185939 - protein, 9 aa, Tick-borne encephalitis virus
TNVDIQPAR

SEQ ID NO: 185940 - protein, 9 aa, Tick-borne encephalitis virus
NVDIQPARS

SEQ ID NO: 185941 - protein, 9 aa, Tick-borne encephalitis virus
VDIQPARSW

SEQ ID NO: 185942 - protein, 9 aa, Tick-borne encephalitis virus
VVSLFTPYM

SEQ ID NO: 185943 - protein, 9 aa, Tick-borne encephalitis virus
VSLFTPYMI

SEQ ID NO: 185944 - protein, 9 aa, Tick-borne encephalitis virus
SLFTPYMIH

SEQ ID NO: 185945 - protein, 9 aa, Tick-borne encephalitis virus
LFTPYMIHQ

SEQ ID NO: 185946 - protein, 9 aa, Tick-borne encephalitis virus
FTPYMIHQL

SEQ ID NO: 185947 - protein, 9 aa, Tick-borne encephalitis virus
TPYMIHQLQ

SEQ ID NO: 185948 - protein, 9 aa, Tick-borne encephalitis virus
PYMIHQLQT

SEQ ID NO: 185949 - protein, 9 aa, Tick-borne encephalitis virus
YMIHQLQTK

SEQ ID NO: 185950 - protein, 9 aa, Tick-borne encephalitis virus
MIHQLQTKI

SEQ ID NO: 185951 - protein, 9 aa, Tick-borne encephalitis virus
QQLVNSAVV

SEQ ID NO: 185952 - protein, 9 aa, Tick-borne encephalitis virus
QLVNSAVAS

SEQ ID NO: 185953 - protein, 9 aa, Tick-borne encephalitis virus
LVNSAVASG

SEQ ID NO: 185954 - protein, 9 aa, Tick-borne encephalitis virus
VNSAVASGA

SEQ ID NO: 185955 - protein, 9 aa, Tick-borne encephalitis virus
NSAVASGAQ

SEQ ID NO: 185956 - protein, 9 aa, Tick-borne encephalitis virus
SAVASGAQA

SEQ ID NO: 185957 - protein, 9 aa, Tick-borne encephalitis virus
AVASGAQAM

SEQ ID NO: 185958 - protein, 9 aa, Tick-borne encephalitis virus
VASGAQAMR

SEQ ID NO: 185959 - protein, 9 aa, Tick-borne encephalitis virus
ASGAQAMRD

SEQ ID NO: 185960 - protein, 9 aa, Tick-borne encephalitis virus
SGAQAMRDL

SEQ ID NO: 185961 - protein, 9 aa, Tick-borne encephalitis virus
AMRDLGGGT

SEQ ID NO: 185962 - protein, 9 aa, Tick-borne encephalitis virus
MRDLGGGTP

SEQ ID NO: 185963 - protein, 9 aa, Tick-borne encephalitis virus
RDLGGGTPF

SEQ ID NO: 185964 - protein, 9 aa, Tick-borne encephalitis virus
DLGGGTPFF

SEQ ID NO: 185965 - protein, 9 aa, Tick-borne encephalitis virus
LGGGTPFFG

SEQ ID NO: 185966 - protein, 9 aa, Tick-borne encephalitis virus
GGGTPFFGV

SEQ ID NO: 185967 - protein, 9 aa, Tick-borne encephalitis virus
GGTPFFGVA

SEQ ID NO: 185968 - protein, 9 aa, Tick-borne encephalitis virus
GTPFFGVAG

SEQ ID NO: 185969 - protein, 9 aa, Tick-borne encephalitis virus
TPFFGVAGH

SEQ ID NO: 185970 - protein, 9 aa, Tick-borne encephalitis virus
PFIGVAGHV

SEQ ID NO: 185971 - protein, 9 aa, Tick-borne encephalitis virus
FFGVAGHVV

SEQ ID NO: 185972 - protein, 9 aa, Tick-borne encephalitis virus
GVAGHVMTL

SEQ ID NO: 185973 - protein, 9 aa, Tick-borne encephalitis virus
VAGHVMTLG

SEQ ID NO: 185974 - protein, 9 aa, Tick-borne encephalitis virus
AGHVMTLGV

SEQ ID NO: 185975 - protein, 9 aa, Tick-borne encephalitis virus
GHVMTLGVV

SEQ ID NO: 185976 - protein, 9 aa, Tick-borne encephalitis virus
HVMTLGVVS

SEQ ID NO: 185977 - protein, 9 aa, Tick-borne encephalitis virus
VMTLGVVSL

SEQ ID NO: 185978 - protein, 9 aa, Tick-borne encephalitis virus
MTLGVVSLI

SEQ ID NO: 185979 - protein, 9 aa, Tick-borne encephalitis virus
TLGVVSLIG

SEQ ID NO: 185980 - protein, 9 aa, Tick-borne encephalitis virus
LGVVSLIGA

SEQ ID NO: 185981 - protein, 9 aa, Tick-borne encephalitis virus
GVVSLIGAT

SEQ ID NO: 185982 - protein, 9 aa, Tick-borne encephalitis virus
VVSLIGATP

SEQ ID NO: 185983 - protein, 9 aa, Tick-borne encephalitis virus
VSLIGATPT

SEQ ID NO: 185984 - protein, 9 aa, Tick-borne encephalitis virus
SLIGATPTS

SEQ ID NO: 185985 - protein, 9 aa, Tick-borne encephalitis virus
LIGATPTSL

SEQ ID NO: 185986 - protein, 9 aa, Tick-borne encephalitis virus
IGATPTSLM

SEQ ID NO: 185987 - protein, 9 aa, Tick-borne encephalitis virus
GATPTSLMV

SEQ ID NO: 185988 - protein, 9 aa, Tick-borne encephalitis virus
ATPTSLMVG

SEQ ID NO: 185989 - protein, 9 aa, Tick-borne encephalitis virus
TPTSLMVGV

SEQ ID NO: 185990 - protein, 9 aa, Tick-borne encephalitis virus
PTSLMVGVG

SEQ ID NO: 185991 - protein, 9 aa, Tick-borne encephalitis virus
TSLMVGVGL

SEQ ID NO: 185992 - protein, 9 aa, Tick-borne encephalitis virus
SLMVGVGLA

SEQ ID NO: 185993 - protein, 9 aa, Tick-borne encephalitis virus
LMVGVGLAA

SEQ ID NO: 185994 - protein, 9 aa, Tick-borne encephalitis virus
MVGVGLAAL

SEQ ID NO: 185995 - protein, 9 aa, Tick-borne encephalitis virus
VGVGLAALH

SEQ ID NO: 185996 - protein, 9 aa, Tick-borne encephalitis virus
GVGLAALHL

SEQ ID NO: 185997 - protein, 9 aa, Tick-borne encephalitis virus
VGLAALHLA

SEQ ID NO: 185998 - protein, 9 aa, Tick-borne encephalitis virus
GLAALHLAI

SEQ ID NO: 185999 - protein, 9 aa, Tick-borne encephalitis virus
LAALHLAIV

SEQ ID NO: 186000 - protein, 9 aa, Tick-borne encephalitis virus
AALHLAIVV

SEQ ID NO: 186001 - protein, 9 aa, Tick-borne encephalitis virus
ALHLAIVVS

SEQ ID NO: 186002 - protein, 9 aa, Tick-borne encephalitis virus
LHLAIVVSG

SEQ ID NO: 186003 - protein, 9 aa, Tick-borne encephalitis virus
SAMVRNPML

SEQ ID NO: 186004 - protein, 9 aa, Tick-borne encephalitis virus
AMVRNPMLD

SEQ ID NO: 186005 - protein, 9 aa, Tick-borne encephalitis virus
MVRNPMLDG

SEQ ID NO: 186006 - protein, 9 aa, Tick-borne encephalitis virus
VRNPMLDGD

SEQ ID NO: 186007 - protein, 9 aa, Tick-borne encephalitis virus
RNPMLDGDV

SEQ ID NO: 186008 - protein, 9 aa, Tick-borne encephalitis virus
NPMLDGDVI

SEQ ID NO: 186009 - protein, 9 aa, Tick-borne encephalitis virus
PMLDGDVIY

SEQ ID NO: 186010 - protein, 9 aa, Tick-borne encephalitis virus
MLDGDVIYP

SEQ ID NO: 186011 - protein, 9 aa, Tick-borne encephalitis virus
LDGDVIYPF

SEQ ID NO: 186012 - protein, 9 aa, Tick-borne encephalitis virus
DGDVIYPFG

SEQ ID NO: 186013 - protein, 9 aa, Tick-borne encephalitis virus
GDVIYPFGE

SEQ ID NO: 186014 - protein, 9 aa, Tick-borne encephalitis virus
DVIYPFGEG

SEQ ID NO: 186015 - protein, 9 aa, Tick-borne encephalitis virus
VIYPFGEGE

SEQ ID NO: 186016 - protein, 9 aa, Tick-borne encephalitis virus
INPFGEGET

SEQ ID NO: 186017 - protein, 9 aa, Tick-borne encephalitis virus
NPFGEGETK

SEQ ID NO: 186018 - protein, 9 aa, Tick-borne encephalitis virus
PFGEGETKP

SEQ ID NO: 186019 - protein, 9 aa, Tick-borne encephalitis virus
FGEGETKPA

SEQ ID NO: 186020 - protein, 9 aa, Tick-borne encephalitis virus
GEGETKPAL

SEQ ID NO: 186021 - protein, 9 aa, Tick-borne encephalitis virus
EGETKPALY

SEQ ID NO: 186022 - protein, 9 aa, Tick-borne encephalitis virus
GETKPALYE

SEQ ID NO: 186023 - protein, 9 aa, Tick-borne encephalitis virus
ETKPALYER

SEQ ID NO: 186024 - protein, 9 aa, Tick-borne encephalitis virus
TKPALYERK

SEQ ID NO: 186025 - protein, 9 aa, Tick-borne encephalitis virus
KPALYERRM

SEQ ID NO: 186026 - protein, 9 aa, Tick-borne encephalitis virus
PALYERRMS

SEQ ID NO: 186027 - protein, 9 aa, Tick-borne encephalitis virus
ALYERRMSL

SEQ ID NO: 186028 - protein, 9 aa, Tick-borne encephalitis virus
LYERRMSLV

SEQ ID NO: 186029 - protein, 9 aa, Tick-borne encephalitis virus
YERRMSLVL

SEQ ID NO: 186030 - protein, 9 aa, Tick-borne encephalitis virus
ERRMSLVLA

SEQ ID NO: 186031 - protein, 9 aa, Tick-borne encephalitis virus
RKMSLVLAV

SEQ ID NO: 186032 - protein, 9 aa, Tick-borne encephalitis virus
MSLVLAIAL

SEQ ID NO: 186033 - protein, 9 aa, Tick-borne encephalitis virus
SLVLAIALC

SEQ ID NO: 186034 - protein, 9 aa, Tick-borne encephalitis virus
LVLAIALCL

SEQ ID NO: 186035 - protein, 9 aa, Tick-borne encephalitis virus
ALCLMSVVM

SEQ ID NO: 186036 - protein, 9 aa, Tick-borne encephalitis virus
LCLMAVVMN

SEQ ID NO: 186037 - protein, 9 aa, Tick-borne encephalitis virus
CLMAVVMNR

SEQ ID NO: 186038 - protein, 9 aa, Tick-borne encephalitis virus
LMAVVMNRT

SEQ ID NO: 186039 - protein, 9 aa, Tick-borne encephalitis virus
MAVVMNRTV

SEQ ID NO: 186040 - protein, 9 aa, Tick-borne encephalitis virus
SVVMNRTVA

SEQ ID NO: 186041 - protein, 9 aa, Tick-borne encephalitis virus
VVMNRTVAS

SEQ ID NO: 186042 - protein, 9 aa, Tick-borne encephalitis virus
VMNRTVASI

SEQ ID NO: 186043 - protein, 9 aa, Tick-borne encephalitis virus
MNRTVASIT

SEQ ID NO: 186044 - protein, 9 aa, Tick-borne encephalitis virus
NRTVASITE

SEQ ID NO: 186045 - protein, 9 aa, Tick-borne encephalitis virus
RTVASITEA

SEQ ID NO: 186046 - protein, 9 aa, Tick-borne encephalitis virus
TVASITEAS

SEQ ID NO: 186047 - protein, 9 aa, Tick-borne encephalitis virus
VASITEASA

SEQ ID NO: 186048 - protein, 9 aa, Tick-borne encephalitis virus
ASITEASAV

SEQ ID NO: 186049 - protein, 9 aa, Tick-borne encephalitis virus
SITEAAAVG

SEQ ID NO: 186050 - protein, 9 aa, Tick-borne encephalitis virus
ITEAAAVGL

SEQ ID NO: 186051 - protein, 9 aa, Tick-borne encephalitis virus
TEAAAVGLA

SEQ ID NO: 186052 - protein, 9 aa, Tick-borne encephalitis virus
EAAAVGLAA

SEQ ID NO: 186053 - protein, 9 aa, Tick-borne encephalitis virus
ASAVGLAAV

SEQ ID NO: 186054 - protein, 9 aa, Tick-borne encephalitis virus
SAVGLAAVG

SEQ ID NO: 186055 - protein, 9 aa, Tick-borne encephalitis virus
AVGLAAVGQ

SEQ ID NO: 186056 - protein, 9 aa, Tick-borne encephalitis virus
VGLAAVGQL

SEQ ID NO: 186057 - protein, 9 aa, Tick-borne encephalitis virus
GLAAVGQLL

SEQ ID NO: 186058 - protein, 9 aa, Tick-borne encephalitis virus
LAAVGQLLR

SEQ ID NO: 186059 - protein, 9 aa, Tick-borne encephalitis virus
AAVGQLLRP

SEQ ID NO: 186060 - protein, 9 aa, Tick-borne encephalitis virus
AVGQLLRPE

SEQ ID NO: 186061 - protein, 9 aa, Tick-borne encephalitis virus
GQLLRPEVD

SEQ ID NO: 186062 - protein, 9 aa, Tick-borne encephalitis virus
QLLRPEVDT

SEQ ID NO: 186063 - protein, 9 aa, Tick-borne encephalitis virus
LLRPEVDTL

SEQ ID NO: 186064 - protein, 9 aa, Tick-borne encephalitis virus
LRPEVDTLW

SEQ ID NO: 186065 - protein, 9 aa, Tick-borne encephalitis virus
RPEVDTLWT

SEQ ID NO: 186066 - protein, 9 aa, Tick-borne encephalitis virus
PEVDTLWTM

SEQ ID NO: 186067 - protein, 9 aa, Tick-borne encephalitis virus
EVDTLWTMP

SEQ ID NO: 186068 - protein, 9 aa, Tick-borne encephalitis virus
VDTLWTMPV

SEQ ID NO: 186069 - protein, 9 aa, Tick-borne encephalitis virus
WTMPVACGM

SEQ ID NO: 186070 - protein, 9 aa, Tick-borne encephalitis virus
TMPVACGMS

SEQ ID NO: 186071 - protein, 9 aa, Tick-borne encephalitis virus
MPVACGMSG

SEQ ID NO: 186072 - protein, 9 aa, Tick-borne encephalitis virus
PVACGMSGV

SEQ ID NO: 186073 - protein, 9 aa, Tick-borne encephalitis virus
VACGMSGVV

SEQ ID NO: 186074 - protein, 9 aa, Tick-borne encephalitis virus
ACGMSGVVR

SEQ ID NO: 186075 - protein, 9 aa, Tick-borne encephalitis virus
CGMSGVVRG

SEQ ID NO: 186076 - protein, 9 aa, Tick-borne encephalitis virus
GMSGVVRGS

SEQ ID NO: 186077 - protein, 9 aa, Tick-borne encephalitis virus
MSGVVRGSL

SEQ ID NO: 186078 - protein, 9 aa, Tick-borne encephalitis virus
SSVVRGSLW

SEQ ID NO: 186079 - protein, 9 aa, Tick-borne encephalitis virus
SVVRGSLWG

SEQ ID NO: 186080 - protein, 9 aa, Tick-borne encephalitis virus
VVTGSLWGF

SEQ ID NO: 186081 - protein, 9 aa, Tick-borne encephalitis virus
VTGSLWGFL

SEQ ID NO: 186082 - protein, 9 aa, Tick-borne encephalitis virus
TGSLWGFLP

SEQ ID NO: 186083 - protein, 9 aa, Tick-borne encephalitis virus
RLWLRASGG

SEQ ID NO: 186084 - protein, 9 aa, Tick-borne encephalitis virus
LWLRASGGR

SEQ ID NO: 186085 - protein, 9 aa, Tick-borne encephalitis virus
WLRASGGRR

SEQ ID NO: 186086 - protein, 9 aa, Tick-borne encephalitis virus
LRASGGRRG

SEQ ID NO: 186087 - protein, 9 aa, Tick-borne encephalitis virus
RASGGRRGG

SEQ ID NO: 186088 - protein, 9 aa, Tick-borne encephalitis virus
ASGGRRGGS

SEQ ID NO: 186089 - protein, 9 aa, Tick-borne encephalitis virus
SGGRRGGSE

SEQ ID NO: 186090 - protein, 9 aa, Tick-borne encephalitis virus
GGRRGGSEG

SEQ ID NO: 186091 - protein, 9 aa, Tick-borne encephalitis virus
GRRGGSEGD

SEQ ID NO: 186092 - protein, 9 aa, Tick-borne encephalitis virus
RRGGAEGDT

SEQ ID NO: 186093 - protein, 9 aa, Tick-borne encephalitis virus
RGGAEGDTL

SEQ ID NO: 186094 - protein, 9 aa, Tick-borne encephalitis virus
GGAEGDTLG

SEQ ID NO: 186095 - protein, 9 aa, Tick-borne encephalitis virus
GAEGDTLGD

SEQ ID NO: 186096 - protein, 9 aa, Tick-borne encephalitis virus
AEGDTLGDL

SEQ ID NO: 186097 - protein, 9 aa, Tick-borne encephalitis virus
DGDTLGDLW

SEQ ID NO: 186098 - protein, 9 aa, Tick-borne encephalitis virus
DTLGDLWKQ

SEQ ID NO: 186099 - protein, 9 aa, Tick-borne encephalitis virus
TLGDLWKRR

SEQ ID NO: 186100 - protein, 9 aa, Tick-borne encephalitis virus
LGDLWKRRL

SEQ ID NO: 186101 - protein, 9 aa, Tick-borne encephalitis virus
GDLWKRRLN

SEQ ID NO: 186102 - protein, 9 aa, Tick-borne encephalitis virus
LNNCTREEF

SEQ ID NO: 186103 - protein, 9 aa, Tick-borne encephalitis virus
NNCTREEFF

SEQ ID NO: 186104 - protein, 9 aa, Tick-borne encephalitis virus
NCTREEFFV

SEQ ID NO: 186105 - protein, 9 aa, Tick-borne encephalitis virus
CTREEFFVY

SEQ ID NO: 186106 - protein, 9 aa, Tick-borne encephalitis virus
TREEFFVYR

SEQ ID NO: 186107 - protein, 9 aa, Tick-borne encephalitis virus
REEFFVYRR

SEQ ID NO: 186108 - protein, 9 aa, Tick-borne encephalitis virus
EEFFVYRRT

SEQ ID NO: 186109 - protein, 9 aa, Tick-borne encephalitis virus
EFFVYRRTG

SEQ ID NO: 186110 - protein, 9 aa, Tick-borne encephalitis virus
FFVYRRTGI

SEQ ID NO: 186111 - protein, 9 aa, Tick-borne encephalitis virus
FVYRRTGIL

SEQ ID NO: 186112 - protein, 9 aa, Tick-borne encephalitis virus
VYRRTGILE

SEQ ID NO: 186113 - protein, 9 aa, Tick-borne encephalitis virus
YRRTGIMET

SEQ ID NO: 186114 - protein, 9 aa, Tick-borne encephalitis virus
RRAGILETE

SEQ ID NO: 186115 - protein, 9 aa, Tick-borne encephalitis virus
RTGIMETER

SEQ ID NO: 186116 - protein, 9 aa, Tick-borne encephalitis virus
TGIMETERD

SEQ ID NO: 186117 - protein, 9 aa, Tick-borne encephalitis virus
GILETERDR

SEQ ID NO: 186118 - protein, 9 aa, Tick-borne encephalitis virus
IMETERDKA

SEQ ID NO: 186119 - protein, 9 aa, Tick-borne encephalitis virus
LETERDRAR

SEQ ID NO: 186120 - protein, 9 aa, Tick-borne encephalitis virus
ETERDRARE

SEQ ID NO: 186121 - protein, 9 aa, Tick-borne encephalitis virus
TERDRAREL

SEQ ID NO: 186122 - protein, 9 aa, Tick-borne encephalitis virus
ERDRARELL

SEQ ID NO: 186123 - protein, 9 aa, Tick-borne encephalitis virus
RDKARELLK

SEQ ID NO: 186124 - protein, 9 aa, Tick-borne encephalitis virus
DKARELLRK

SEQ ID NO: 186125 - protein, 9 aa, Tick-borne encephalitis virus
KARELLRKG

SEQ ID NO: 186126 - protein, 9 aa, Tick-borne encephalitis virus
ARELLRKGE

SEQ ID NO: 186127 - protein, 9 aa, Tick-borne encephalitis virus
RELLRKGET

SEQ ID NO: 186128 - protein, 9 aa, Tick-borne encephalitis virus
ELLRKGETN

SEQ ID NO: 186129 - protein, 9 aa, Tick-borne encephalitis virus
KGETNTGLA

SEQ ID NO: 186130 - protein, 9 aa, Tick-borne encephalitis virus
GETNTGLAV

SEQ ID NO: 186131 - protein, 9 aa, Tick-borne encephalitis virus
ETNTGLAVS

SEQ ID NO: 186132 - protein, 9 aa, Tick-borne encephalitis virus
TNTGLAVSR

SEQ ID NO: 186133 - protein, 9 aa, Tick-borne encephalitis virus
NTGLAVSRG

SEQ ID NO: 186134 - protein, 9 aa, Tick-borne encephalitis virus
TGLAVSRGT

SEQ ID NO: 186135 - protein, 9 aa, Tick-borne encephalitis virus
SYYAASRPS

SEQ ID NO: 186136 - protein, 9 aa, Tick-borne encephalitis virus
YYAASRPSV

SEQ ID NO: 186137 - protein, 9 aa, Tick-borne encephalitis virus
YAASRPSVM

SEQ ID NO: 186138 - protein, 9 aa, Tick-borne encephalitis virus
AASRPSVMS

SEQ ID NO: 186139 - protein, 9 aa, Tick-borne encephalitis virus
ASRPAVMNV

SEQ ID NO: 186140 - protein, 9 aa, Tick-borne encephalitis virus
SRPAVMSVR

SEQ ID NO: 186141 - protein, 9 aa, Tick-borne encephalitis virus
RPAVMSVRA

SEQ ID NO: 186142 - protein, 9 aa, Tick-borne encephalitis virus
PAVMSVRAY

SEQ ID NO: 186143 - protein, 9 aa, Tick-borne encephalitis virus
AVMSVRAYT

SEQ ID NO: 186144 - protein, 9 aa, Tick-borne encephalitis virus
VMSVRAYTI

SEQ ID NO: 186145 - protein, 9 aa, Tick-borne encephalitis virus
MSVRAYTIG

SEQ ID NO: 186146 - protein, 9 aa, Tick-borne encephalitis virus
SVRAYTIGG

SEQ ID NO: 186147 - protein, 9 aa, Tick-borne encephalitis virus
VRAYTIGGR

SEQ ID NO: 186148 - protein, 9 aa, Tick-borne encephalitis virus
RAYTIGGRG

SEQ ID NO: 186149 - protein, 9 aa, Tick-borne encephalitis virus
AYTIGGRGH

SEQ ID NO: 186150 - protein, 9 aa, Tick-borne encephalitis virus
YTIGGRGHE

SEQ ID NO: 186151 - protein, 9 aa, Tick-borne encephalitis virus
TIGGRGHEA

SEQ ID NO: 186152 - protein, 9 aa, Tick-borne encephalitis virus
IGGRGHEAP

SEQ ID NO: 186153 - protein, 9 aa, Tick-borne encephalitis virus
GGRGHEAPK

SEQ ID NO: 186154 - protein, 9 aa, Tick-borne encephalitis virus
GRGHEAPKM

SEQ ID NO: 186155 - protein, 9 aa, Tick-borne encephalitis virus
RGHEAPKMV

SEQ ID NO: 186156 - protein, 9 aa, Tick-borne encephalitis virus
GHEAPKMVT

SEQ ID NO: 186157 - protein, 9 aa, Tick-borne encephalitis virus
HEAPKMVTS

SEQ ID NO: 186158 - protein, 9 aa, Tick-borne encephalitis virus
EAPKMVTSL

SEQ ID NO: 186159 - protein, 9 aa, Tick-borne encephalitis virus
APKMVTSLG

SEQ ID NO: 186160 - protein, 9 aa, Tick-borne encephalitis virus
PRMVTSLGW

SEQ ID NO: 186161 - protein, 9 aa, Tick-borne encephalitis virus
RMVTSLGWN

SEQ ID NO: 186162 - protein, 9 aa, Tick-borne encephalitis virus
GWNLIKFRS

SEQ ID NO: 186163 - protein, 9 aa, Tick-borne encephalitis virus
WNLIKFRSG

SEQ ID NO: 186164 - protein, 9 aa, Tick-borne encephalitis virus
NLIKFRSGM

SEQ ID NO: 186165 - protein, 9 aa, Tick-borne encephalitis virus
LIKFRSGMD

SEQ ID NO: 186166 - protein, 9 aa, Tick-borne encephalitis virus
IKFRSGMDV

SEQ ID NO: 186167 - protein, 9 aa, Tick-borne encephalitis virus
KFRSGMDVF

SEQ ID NO: 186168 - protein, 9 aa, Tick-borne encephalitis virus
FRSGMDVFS

SEQ ID NO: 186169 - protein, 9 aa, Tick-borne encephalitis virus
RSGMDVFSM

SEQ ID NO: 186170 - protein, 9 aa, Tick-borne encephalitis virus
SGMDVFSMQ

SEQ ID NO: 186171 - protein, 9 aa, Tick-borne encephalitis virus
GVDVFSMQP

SEQ ID NO: 186172 - protein, 9 aa, Tick-borne encephalitis virus
VDVFSMQPH

SEQ ID NO: 186173 - protein, 9 aa, Tick-borne encephalitis virus
MQPHRADTV

SEQ ID NO: 186174 - protein, 9 aa, Tick-borne encephalitis virus
QPHRADTVM

SEQ ID NO: 186175 - protein, 9 aa, Tick-borne encephalitis virus
PHRADTVMC

SEQ ID NO: 186176 - protein, 9 aa, Tick-borne encephalitis virus
HRADTVMCD

SEQ ID NO: 186177 - protein, 9 aa, Tick-borne encephalitis virus
RADTVMCDI

SEQ ID NO: 186178 - protein, 9 aa, Tick-borne encephalitis virus
ADTVMCDIG

SEQ ID NO: 186179 - protein, 9 aa, Tick-borne encephalitis virus
DTVMCDIGE

SEQ ID NO: 186180 - protein, 9 aa, Tick-borne encephalitis virus
TVMCDIGES

SEQ ID NO: 186181 - protein, 9 aa, Tick-borne encephalitis virus
VMCDIGESS

SEQ ID NO: 186182 - protein, 9 aa, Tick-borne encephalitis virus
MCDIGESSP

SEQ ID NO: 186183 - protein, 9 aa, Tick-borne encephalitis virus
CDIGESSPD

SEQ ID NO: 186184 - protein, 9 aa, Tick-borne encephalitis virus
DIGESSPDA

SEQ ID NO: 186185 - protein, 9 aa, Tick-borne encephalitis virus
IGESSPDAA

SEQ ID NO: 186186 - protein, 9 aa, Tick-borne encephalitis virus
GESSPDAAV

SEQ ID NO: 186187 - protein, 9 aa, Tick-borne encephalitis virus
ESSPDAAVE

SEQ ID NO: 186188 - protein, 9 aa, Tick-borne encephalitis virus
SSPDAAVEG

SEQ ID NO: 186189 - protein, 9 aa, Tick-borne encephalitis virus
SPDAAVEGE

SEQ ID NO: 186190 - protein, 9 aa, Tick-borne encephalitis virus
PDAAVEGER

SEQ ID NO: 186191 - protein, 9 aa, Tick-borne encephalitis virus
DAAVEGERT

SEQ ID NO: 186192 - protein, 9 aa, Tick-borne encephalitis virus
AAVEGERTR

SEQ ID NO: 186193 - protein, 9 aa, Tick-borne encephalitis virus
AVEGERTRK

SEQ ID NO: 186194 - protein, 9 aa, Tick-borne encephalitis virus
VEGERTRRV

SEQ ID NO: 186195 - protein, 9 aa, Tick-borne encephalitis virus
EGERTRRVI

SEQ ID NO: 186196 - protein, 9 aa, Tick-borne encephalitis virus
GERTRRVIL

SEQ ID NO: 186197 - protein, 9 aa, Tick-borne encephalitis virus
ERTRRVILL

SEQ ID NO: 186198 - protein, 9 aa, Tick-borne encephalitis virus
RTRRVILLM

SEQ ID NO: 186199 - protein, 9 aa, Tick-borne encephalitis virus
TRRVILLME

SEQ ID NO: 186200 - protein, 9 aa, Tick-borne encephalitis virus
RRVILLMEQ

SEQ ID NO: 186201 - protein, 9 aa, Tick-borne encephalitis virus
RVILLMEQW

SEQ ID NO: 186202 - protein, 9 aa, Tick-borne encephalitis virus
ILLMEQWKI

SEQ ID NO: 186203 - protein, 9 aa, Tick-borne encephalitis virus
LLMEQWKIR

SEQ ID NO: 186204 - protein, 9 aa, Tick-borne encephalitis virus
LMEQWKIRN

SEQ ID NO: 186205 - protein, 9 aa, Tick-borne encephalitis virus
MEQWKIRNP

SEQ ID NO: 186206 - protein, 9 aa, Tick-borne encephalitis virus
EQWKNRNPA

SEQ ID NO: 186207 - protein, 9 aa, Tick-borne encephalitis virus
QWKIRNPTA

SEQ ID NO: 186208 - protein, 9 aa, Tick-borne encephalitis virus
WKNRNPTAA

SEQ ID NO: 186209 - protein, 9 aa, Tick-borne encephalitis virus
KNRNPTAAC

SEQ ID NO: 186210 - protein, 9 aa, Tick-borne encephalitis virus
NRNPTAACV

SEQ ID NO: 186211 - protein, 9 aa, Tick-borne encephalitis virus
RNPTAACVF

SEQ ID NO: 186212 - protein, 9 aa, Tick-borne encephalitis virus
NPTAACVFK

SEQ ID NO: 186213 - protein, 9 aa, Tick-borne encephalitis virus
PTAACVFKV

SEQ ID NO: 186214 - protein, 9 aa, Tick-borne encephalitis virus
TAACVFKVL

SEQ ID NO: 186215 - protein, 9 aa, Tick-borne encephalitis virus
AACVFKVLA

SEQ ID NO: 186216 - protein, 9 aa, Tick-borne encephalitis virus
ACVFKVLAP

SEQ ID NO: 186217 - protein, 9 aa, Tick-borne encephalitis virus
KVLAPYRPK

SEQ ID NO: 186218 - protein, 9 aa, Tick-borne encephalitis virus
VLAPYRPKV

SEQ ID NO: 186219 - protein, 9 aa, Tick-borne encephalitis virus
LAPYRPKVI

SEQ ID NO: 186220 - protein, 9 aa, Tick-borne encephalitis virus
APYRPKVIE

SEQ ID NO: 186221 - protein, 9 aa, Tick-borne encephalitis virus
PYRPEVIET

SEQ ID NO: 186222 - protein, 9 aa, Tick-borne encephalitis virus
YRPKVIEAL

SEQ ID NO: 186223 - protein, 9 aa, Tick-borne encephalitis virus
RPKVIEALH

SEQ ID NO: 186224 - protein, 9 aa, Tick-borne encephalitis virus
PEVIETLHR

SEQ ID NO: 186225 - protein, 9 aa, Tick-borne encephalitis virus
EVIETLHRF

SEQ ID NO: 186226 - protein, 9 aa, Tick-borne encephalitis virus
VIETLHRFQ

SEQ ID NO: 186227 - protein, 9 aa, Tick-borne encephalitis virus
IETLHRFQL

SEQ ID NO: 186228 - protein, 9 aa, Tick-borne encephalitis virus
EALHRFQLR

SEQ ID NO: 186229 - protein, 9 aa, Tick-borne encephalitis virus
ALHRFQLRW

SEQ ID NO: 186230 - protein, 9 aa, Tick-borne encephalitis virus
LHRFQLRWG

SEQ ID NO: 186231 - protein, 9 aa, Tick-borne encephalitis virus
HRFQLRWGG

SEQ ID NO: 186232 - protein, 9 aa, Tick-borne encephalitis virus
RFQLRWGGG

SEQ ID NO: 186233 - protein, 9 aa, Tick-borne encephalitis virus
FQLRWGGGL

SEQ ID NO: 186234 - protein, 9 aa, Tick-borne encephalitis virus
QLRWGGGLV

SEQ ID NO: 186235 - protein, 9 aa, Tick-borne encephalitis virus
LRWGGGLVR

SEQ ID NO: 186236 - protein, 9 aa, Tick-borne encephalitis virus
RWGGGLVRT

SEQ ID NO: 186237 - protein, 9 aa, Tick-borne encephalitis virus
PFSRNSTHK

SEQ ID NO: 186238 - protein, 9 aa, Tick-borne encephalitis virus
FSRNSTHKV

SEQ ID NO: 186239 - protein, 9 aa, Tick-borne encephalitis virus
SRNSTHKVY

SEQ ID NO: 186240 - protein, 9 aa, Tick-borne encephalitis virus
RNSTHKVYY

SEQ ID NO: 186241 - protein, 9 aa, Tick-borne encephalitis virus
NSTHKVYYS

SEQ ID NO: 186242 - protein, 9 aa, Tick-borne encephalitis virus
STHKVYYST

SEQ ID NO: 186243 - protein, 9 aa, Tick-borne encephalitis virus
THKVYYSTA

SEQ ID NO: 186244 - protein, 9 aa, Tick-borne encephalitis virus
HEMYYSTAI

SEQ ID NO: 186245 - protein, 9 aa, Tick-borne encephalitis virus
EMYYSTAIT

SEQ ID NO: 186246 - protein, 9 aa, Tick-borne encephalitis virus
MYYSTAITG

SEQ ID NO: 186247 - protein, 9 aa, Tick-borne encephalitis virus
YYSTAITGN

SEQ ID NO: 186248 - protein, 9 aa, Tick-borne encephalitis virus
YSTAITGNI

SEQ ID NO: 186249 - protein, 9 aa, Tick-borne encephalitis virus
STAITGNIV

SEQ ID NO: 186250 - protein, 9 aa, Tick-borne encephalitis virus
TAITGNIVN

SEQ ID NO: 186251 - protein, 9 aa, Tick-borne encephalitis virus
AITGNIVNS

SEQ ID NO: 186252 - protein, 9 aa, Tick-borne encephalitis virus
ITGNIVNSV

SEQ ID NO: 186253 - protein, 9 aa, Tick-borne encephalitis virus
GNIVNSVNV

SEQ ID NO: 186254 - protein, 9 aa, Tick-borne encephalitis virus
NIVNSVNVQ

SEQ ID NO: 186255 - protein, 9 aa, Tick-borne encephalitis virus
IVNSVNVQS

SEQ ID NO: 186256 - protein, 9 aa, Tick-borne encephalitis virus
VNSVNVQSR

SEQ ID NO: 186257 - protein, 9 aa, Tick-borne encephalitis virus
NSVNVQSRK

SEQ ID NO: 186258 - protein, 9 aa, Tick-borne encephalitis virus
SVNVQSRKL

SEQ ID NO: 186259 - protein, 9 aa, Tick-borne encephalitis virus
VNVQSRKLL

SEQ ID NO: 186260 - protein, 9 aa, Tick-borne encephalitis virus
NVQSRKLLA

SEQ ID NO: 186261 - protein, 9 aa, Tick-borne encephalitis virus
VQSRKLLAR

SEQ ID NO: 186262 - protein, 9 aa, Tick-borne encephalitis virus
SRKLLARFA

SEQ ID NO: 186263 - protein, 9 aa, Tick-borne encephalitis virus
RKLLARFAG

SEQ ID NO: 186264 - protein, 9 aa, Tick-borne encephalitis virus
KLLARFAGQ

SEQ ID NO: 186265 - protein, 9 aa, Tick-borne encephalitis virus
LLARFAGQR

SEQ ID NO: 186266 - protein, 9 aa, Tick-borne encephalitis virus
LARFAGQRG

SEQ ID NO: 186267 - protein, 9 aa, Tick-borne encephalitis virus
ARFAGQRGP

SEQ ID NO: 186268 - protein, 9 aa, Tick-borne encephalitis virus
RFAGQRGPT

SEQ ID NO: 186269 - protein, 9 aa, Tick-borne encephalitis virus
FGDQRGPTK

SEQ ID NO: 186270 - protein, 9 aa, Tick-borne encephalitis virus
GDQRGPTKV

SEQ ID NO: 186271 - protein, 9 aa, Tick-borne encephalitis virus
DQRGPTKVP

SEQ ID NO: 186272 - protein, 9 aa, Tick-borne encephalitis virus
QRGPTKVPE

SEQ ID NO: 186273 - protein, 9 aa, Tick-borne encephalitis virus
RGPTKVPEL

SEQ ID NO: 186274 - protein, 9 aa, Tick-borne encephalitis virus
GPTKVPELD

SEQ ID NO: 186275 - protein, 9 aa, Tick-borne encephalitis virus
PTKVPELDL

SEQ ID NO: 186276 - protein, 9 aa, Tick-borne encephalitis virus
TKVPELDLG

SEQ ID NO: 186277 - protein, 9 aa, Tick-borne encephalitis virus
RVPELDLGI

SEQ ID NO: 186278 - protein, 9 aa, Tick-borne encephalitis virus
VPELDLGIG

SEQ ID NO: 186279 - protein, 9 aa, Tick-borne encephalitis virus
PELDLGIGT

SEQ ID NO: 186280 - protein, 9 aa, Tick-borne encephalitis virus
ELDLGIGTR

SEQ ID NO: 186281 - protein, 9 aa, Tick-borne encephalitis virus
LDLGIGTRC

SEQ ID NO: 186282 - protein, 9 aa, Tick-borne encephalitis virus
DLGIGTRCV

SEQ ID NO: 186283 - protein, 9 aa, Tick-borne encephalitis virus
LGIGTRCVV

SEQ ID NO: 186284 - protein, 9 aa, Tick-borne encephalitis virus
GIGTRCVVL

SEQ ID NO: 186285 - protein, 9 aa, Tick-borne encephalitis virus
IGTRCVVLA

SEQ ID NO: 186286 - protein, 9 aa, Tick-borne encephalitis virus
GTRCVVLAD

SEQ ID NO: 186287 - protein, 9 aa, Tick-borne encephalitis virus
TRCVFLAED

SEQ ID NO: 186288 - protein, 9 aa, Tick-borne encephalitis virus
RCVVLAEDR

SEQ ID NO: 186289 - protein, 9 aa, Tick-borne encephalitis virus
CVVLAEDRV

SEQ ID NO: 186290 - protein, 9 aa, Tick-borne encephalitis virus
VVLAEDRVR

SEQ ID NO: 186291 - protein, 9 aa, Tick-borne encephalitis virus
VLAEDRVRE

SEQ ID NO: 186292 - protein, 9 aa, Tick-borne encephalitis virus
LAEDKVKEQ

SEQ ID NO: 186293 - protein, 9 aa, Tick-borne encephalitis virus
AEDKVKEQD

SEQ ID NO: 186294 - protein, 9 aa, Tick-borne encephalitis virus
EDKVKEQDV

SEQ ID NO: 186295 - protein, 9 aa, Tick-borne encephalitis virus
DKVKEQDVQ

SEQ ID NO: 186296 - protein, 9 aa, Tick-borne encephalitis virus
KVKEQDVQE

SEQ ID NO: 186297 - protein, 9 aa, Tick-borne encephalitis virus
VKEQDVQER

SEQ ID NO: 186298 - protein, 9 aa, Tick-borne encephalitis virus
KEQDVQERI

SEQ ID NO: 186299 - protein, 9 aa, Tick-borne encephalitis virus
DVQERIRAL

SEQ ID NO: 186300 - protein, 9 aa, Tick-borne encephalitis virus
ERIRALREQ

SEQ ID NO: 186301 - protein, 9 aa, Tick-borne encephalitis virus
RIRALREQY

SEQ ID NO: 186302 - protein, 9 aa, Tick-borne encephalitis virus
ALREQYSET

SEQ ID NO: 186303 - protein, 9 aa, Tick-borne encephalitis virus
LREQYSETW

SEQ ID NO: 186304 - protein, 9 aa, Tick-borne encephalitis virus
REQYSETWH

SEQ ID NO: 186305 - protein, 9 aa, Tick-borne encephalitis virus
DEEHPYRTW

SEQ ID NO: 186306 - protein, 9 aa, Tick-borne encephalitis virus
EEHPYRTWQ

SEQ ID NO: 186307 - protein, 9 aa, Tick-borne encephalitis virus
PTGSAASLT

SEQ ID NO: 186308 - protein, 9 aa, Tick-borne encephalitis virus
TGSAASLTN

SEQ ID NO: 186309 - protein, 9 aa, Tick-borne encephalitis virus
GSAASLTNG

SEQ ID NO: 186310 - protein, 9 aa, Tick-borne encephalitis virus
SAASLTNGV

SEQ ID NO: 186311 - protein, 9 aa, Tick-borne encephalitis virus
AASLTNGVV

SEQ ID NO: 186312 - protein, 9 aa, Tick-borne encephalitis virus
ASLTNGVVK

SEQ ID NO: 186313 - protein, 9 aa, Tick-borne encephalitis virus
SLTNGVVKL

SEQ ID NO: 186314 - protein, 9 aa, Tick-borne encephalitis virus
LTNGVVKLL

SEQ ID NO: 186315 - protein, 9 aa, Tick-borne encephalitis virus
TNGVVKLLS

SEQ ID NO: 186316 - protein, 9 aa, Tick-borne encephalitis virus
VVRMAMTDP

SEQ ID NO: 186317 - protein, 9 aa, Tick-borne encephalitis virus
VRMAMTDPT

SEQ ID NO: 186318 - protein, 9 aa, Tick-borne encephalitis virus
RMAMTDPTP

SEQ ID NO: 186319 - protein, 9 aa, Tick-borne encephalitis virus
MAMTDPTPA

SEQ ID NO: 186320 - protein, 9 aa, Tick-borne encephalitis virus
AMTDPTPAW

SEQ ID NO: 186321 - protein, 9 aa, Tick-borne encephalitis virus
MTDPTPAWQ

SEQ ID NO: 186322 - protein, 9 aa, Tick-borne encephalitis virus
TDPTPAWQQ

SEQ ID NO: 186323 - protein, 9 aa, Tick-borne encephalitis virus
DPTPAWQQR

SEQ ID NO: 186324 - protein, 9 aa, Tick-borne encephalitis virus
PTPAWQQRV

SEQ ID NO: 186325 - protein, 9 aa, Tick-borne encephalitis virus
TPAWQQRVF

SEQ ID NO: 186326 - protein, 9 aa, Tick-borne encephalitis virus
PAWQQRVFK

SEQ ID NO: 186327 - protein, 9 aa, Tick-borne encephalitis virus
FGQQRVFKD

SEQ ID NO: 186328 - protein, 9 aa, Tick-borne encephalitis virus
GQQRVFKDK

SEQ ID NO: 186329 - protein, 9 aa, Tick-borne encephalitis virus
QQRVFKDKV

SEQ ID NO: 186330 - protein, 9 aa, Tick-borne encephalitis virus
QRVFKDKVD

SEQ ID NO: 186331 - protein, 9 aa, Tick-borne encephalitis virus
RVFKDKVDT

SEQ ID NO: 186332 - protein, 9 aa, Tick-borne encephalitis virus
VFKDKVDTK

SEQ ID NO: 186333 - protein, 9 aa, Tick-borne encephalitis virus
FKDKVDTKA

SEQ ID NO: 186334 - protein, 9 aa, Tick-borne encephalitis virus
KDKVDTKAQ

SEQ ID NO: 186335 - protein, 9 aa, Tick-borne encephalitis virus
DKVDTKAQE

SEQ ID NO: 186336 - protein, 9 aa, Tick-borne encephalitis virus
NADTKAQEP

SEQ ID NO: 186337 - protein, 9 aa, Tick-borne encephalitis virus
ADTKAQEPQ

SEQ ID NO: 186338 - protein, 9 aa, Tick-borne encephalitis virus
AQEPQPGTR

SEQ ID NO: 186339 - protein, 9 aa, Tick-borne encephalitis virus
QEPQPGTRV

SEQ ID NO: 186340 - protein, 9 aa, Tick-borne encephalitis virus
EPQPGTRVI

SEQ ID NO: 186341 - protein, 9 aa, Tick-borne encephalitis virus
PQPGTRVIM

SEQ ID NO: 186342 - protein, 9 aa, Tick-borne encephalitis virus
QPGTRVIMR

SEQ ID NO: 186343 - protein, 9 aa, Tick-borne encephalitis virus
PGTRVIMRA

SEQ ID NO: 186344 - protein, 9 aa, Tick-borne encephalitis virus
GTRVIMRAV

SEQ ID NO: 186345 - protein, 9 aa, Tick-borne encephalitis virus
TRVIMRAVN

SEQ ID NO: 186346 - protein, 9 aa, Tick-borne encephalitis virus
RVIMRAVND

SEQ ID NO: 186347 - protein, 9 aa, Tick-borne encephalitis virus
IMRAVNDWM

SEQ ID NO: 186348 - protein, 9 aa, Tick-borne encephalitis virus
MRAVNDWML

SEQ ID NO: 186349 - protein, 9 aa, Tick-borne encephalitis virus
RAVNDWMLD

SEQ ID NO: 186350 - protein, 9 aa, Tick-borne encephalitis virus
AVNDWMLDR

SEQ ID NO: 186351 - protein, 9 aa, Tick-borne encephalitis virus
VNDWMLDRL

SEQ ID NO: 186352 - protein, 9 aa, Tick-borne encephalitis virus
NDWMLDRLA

SEQ ID NO: 186353 - protein, 9 aa, Tick-borne encephalitis virus
DWILERLAQ

SEQ ID NO: 186354 - protein, 9 aa, Tick-borne encephalitis virus
WILERLAQK

SEQ ID NO: 186355 - protein, 9 aa, Tick-borne encephalitis virus
ILERLAQKS

SEQ ID NO: 186356 - protein, 9 aa, Tick-borne encephalitis virus
KPRMCSKEE

SEQ ID NO: 186357 - protein, 9 aa, Tick-borne encephalitis virus
PRMCSKEEF

SEQ ID NO: 186358 - protein, 9 aa, Tick-borne encephalitis virus
RMCSKEEFI

SEQ ID NO: 186359 - protein, 9 aa, Tick-borne encephalitis virus
MCSKEEFIA

SEQ ID NO: 186360 - protein, 9 aa, Tick-borne encephalitis virus
CSKEEFIAK

SEQ ID NO: 186361 - protein, 9 aa, Tick-borne encephalitis virus
SKEEFIAKV

SEQ ID NO: 186362 - protein, 9 aa, Tick-borne encephalitis virus
KEEFIAKVK

SEQ ID NO: 186363 - protein, 9 aa, Tick-borne encephalitis virus
EEFIAKVRS

SEQ ID NO: 186364 - protein, 9 aa, Tick-borne encephalitis virus
EFIAKVRSN

SEQ ID NO: 186365 - protein, 9 aa, Tick-borne encephalitis virus
FIAKVRSNA

SEQ ID NO: 186366 - protein, 9 aa, Tick-borne encephalitis virus
IAKVRSNAA

SEQ ID NO: 186367 - protein, 9 aa, Tick-borne encephalitis virus
AKVKSSAAL

SEQ ID NO: 186368 - protein, 9 aa, Tick-borne encephalitis virus
KVRSNAALG

SEQ ID NO: 186369 - protein, 9 aa, Tick-borne encephalitis virus
VRSNAALGA

SEQ ID NO: 186370 - protein, 9 aa, Tick-borne encephalitis virus
RSNAALGAW

SEQ ID NO: 186371 - protein, 9 aa, Tick-borne encephalitis virus
SSAALGAWS

SEQ ID NO: 186372 - protein, 9 aa, Tick-borne encephalitis virus
SAALGAWSD

SEQ ID NO: 186373 - protein, 9 aa, Tick-borne encephalitis virus
AALGAWSNE

SEQ ID NO: 186374 - protein, 9 aa, Tick-borne encephalitis virus
ALGAWSNEQ

SEQ ID NO: 186375 - protein, 9 aa, Tick-borne encephalitis virus
LGAWSEEQN

SEQ ID NO: 186376 - protein, 9 aa, Tick-borne encephalitis virus
GAWSNEQNR

SEQ ID NO: 186377 - protein, 9 aa, Tick-borne encephalitis virus
AWSEEQNRW

SEQ ID NO: 186378 - protein, 9 aa, Tick-borne encephalitis virus
WSDEQNRWA

SEQ ID NO: 186379 - protein, 9 aa, Tick-borne encephalitis virus
SAREAVEDP

SEQ ID NO: 186380 - protein, 9 aa, Tick-borne encephalitis virus
AREAVEDPA

SEQ ID NO: 186381 - protein, 9 aa, Tick-borne encephalitis virus
REAVEDPAF

SEQ ID NO: 186382 - protein, 9 aa, Tick-borne encephalitis virus
EAVEDPVFW

SEQ ID NO: 186383 - protein, 9 aa, Tick-borne encephalitis virus
AVEDPAFWH

SEQ ID NO: 186384 - protein, 9 aa, Tick-borne encephalitis virus
VEDPAFWHL

SEQ ID NO: 186385 - protein, 9 aa, Tick-borne encephalitis virus
EDPAFWHLV

SEQ ID NO: 186386 - protein, 9 aa, Tick-borne encephalitis virus
DPAFWHLVD

SEQ ID NO: 186387 - protein, 9 aa, Tick-borne encephalitis virus
PAFWHLVDE

SEQ ID NO: 186388 - protein, 9 aa, Tick-borne encephalitis virus
AFWHLVDEE

SEQ ID NO: 186389 - protein, 9 aa, Tick-borne encephalitis virus
FWHLVDEER

SEQ ID NO: 186390 - protein, 9 aa, Tick-borne encephalitis virus
WHLVDEERE

SEQ ID NO: 186391 - protein, 9 aa, Tick-borne encephalitis virus
HLVDEERER

SEQ ID NO: 186392 - protein, 9 aa, Tick-borne encephalitis virus
LVDEERERD

SEQ ID NO: 186393 - protein, 9 aa, Tick-borne encephalitis virus
VDEERERDL

SEQ ID NO: 186394 - protein, 9 aa, Tick-borne encephalitis virus
DEERERHLM

SEQ ID NO: 186395 - protein, 9 aa, Tick-borne encephalitis virus
EERERHLMG

SEQ ID NO: 186396 - protein, 9 aa, Tick-borne encephalitis virus
ERERHLMGR

SEQ ID NO: 186397 - protein, 9 aa, Tick-borne encephalitis virus
RERHLMGRC

SEQ ID NO: 186398 - protein, 9 aa, Tick-borne encephalitis virus
ERHLMGRCA

SEQ ID NO: 186399 - protein, 9 aa, Tick-borne encephalitis virus
RHLMGRCAH

SEQ ID NO: 186400 - protein, 9 aa, Tick-borne encephalitis virus
HLMGRCAHC

SEQ ID NO: 186401 - protein, 9 aa, Tick-borne encephalitis virus
LMGRCAHCV

SEQ ID NO: 186402 - protein, 9 aa, Tick-borne encephalitis virus
GRCAHCVHN

SEQ ID NO: 186403 - protein, 9 aa, Tick-borne encephalitis virus
RCAHCVHNM

SEQ ID NO: 186404 - protein, 9 aa, Tick-borne encephalitis virus
CAHCVHNMM

SEQ ID NO: 186405 - protein, 9 aa, Tick-borne encephalitis virus
AHCVHNMMG

SEQ ID NO: 186406 - protein, 9 aa, Tick-borne encephalitis virus
HCVHNMMGK

SEQ ID NO: 186407 - protein, 9 aa, Tick-borne encephalitis virus
CVHNMMGKR

SEQ ID NO: 186408 - protein, 9 aa, Tick-borne encephalitis virus
VHNMMGKRE

SEQ ID NO: 186409 - protein, 9 aa, Tick-borne encephalitis virus
HNMMGKREK

SEQ ID NO: 186410 - protein, 9 aa, Tick-borne encephalitis virus
NIMGKREKK

SEQ ID NO: 186411 - protein, 9 aa, Tick-borne encephalitis virus
IMGKREKKL

SEQ ID NO: 186412 - protein, 9 aa, Tick-borne encephalitis virus
KKLGEFGVS

SEQ ID NO: 186413 - protein, 9 aa, Tick-borne encephalitis virus
KLGEFGVSK

SEQ ID NO: 186414 - protein, 9 aa, Tick-borne encephalitis virus
LGEFGVSKG

SEQ ID NO: 186415 - protein, 9 aa, Tick-borne encephalitis virus
GEFGVSKGS

SEQ ID NO: 186416 - protein, 9 aa, Tick-borne encephalitis virus
EFGVSKGSR

SEQ ID NO: 186417 - protein, 9 aa, Tick-borne encephalitis virus
FGVSKGSRA

SEQ ID NO: 186418 - protein, 9 aa, Tick-borne encephalitis virus
GVSKGSRAM

SEQ ID NO: 186419 - protein, 9 aa, Tick-borne encephalitis virus
VSKGSRAMW

SEQ ID NO: 186420 - protein, 9 aa, Tick-borne encephalitis virus
SKGSRAMWY

SEQ ID NO: 186421 - protein, 9 aa, Tick-borne encephalitis virus
KGSRAMWYM

SEQ ID NO: 186422 - protein, 9 aa, Tick-borne encephalitis virus
GSRAMWYMW

SEQ ID NO: 186423 - protein, 9 aa, Tick-borne encephalitis virus
SRAMWYMWL

SEQ ID NO: 186424 - protein, 9 aa, Tick-borne encephalitis virus
RAMWYMWLG

SEQ ID NO: 186425 - protein, 9 aa, Tick-borne encephalitis virus
AMWYMWLGS

SEQ ID NO: 186426 - protein, 9 aa, Tick-borne encephalitis virus
MWYMWLGSR

SEQ ID NO: 186427 - protein, 9 aa, Tick-borne encephalitis virus
YMWLGSRFQ

SEQ ID NO: 186428 - protein, 9 aa, Tick-borne encephalitis virus
MWLGSRFQE

SEQ ID NO: 186429 - protein, 9 aa, Tick-borne encephalitis virus
WLGSRFQEF

SEQ ID NO: 186430 - protein, 9 aa, Tick-borne encephalitis virus
LGSRFQEFE

SEQ ID NO: 186431 - protein, 9 aa, Tick-borne encephalitis virus
GSRFQEFEA

SEQ ID NO: 186432 - protein, 9 aa, Tick-borne encephalitis virus
SRFQEFEAL

SEQ ID NO: 186433 - protein, 9 aa, Tick-borne encephalitis virus
RFQEFEALG

SEQ ID NO: 186434 - protein, 9 aa, Tick-borne encephalitis virus
FQEFEALGF

SEQ ID NO: 186435 - protein, 9 aa, Tick-borne encephalitis virus
QEFEALGFL

SEQ ID NO: 186436 - protein, 9 aa, Tick-borne encephalitis virus
NEDHWASRE

SEQ ID NO: 186437 - protein, 9 aa, Tick-borne encephalitis virus
EDHWASRES

SEQ ID NO: 186438 - protein, 9 aa, Tick-borne encephalitis virus
DHWASRESS

SEQ ID NO: 186439 - protein, 9 aa, Tick-borne encephalitis virus
HWASRESSG

SEQ ID NO: 186440 - protein, 9 aa, Tick-borne encephalitis virus
WASRESSGA

SEQ ID NO: 186441 - protein, 9 aa, Tick-borne encephalitis virus
ASRESSGAG

SEQ ID NO: 186442 - protein, 9 aa, Tick-borne encephalitis virus
SRESSGAGV

SEQ ID NO: 186443 - protein, 9 aa, Tick-borne encephalitis virus
RESSGAGVE

SEQ ID NO: 186444 - protein, 9 aa, Tick-borne encephalitis virus
ESSGAGVEG

SEQ ID NO: 186445 - protein, 9 aa, Tick-borne encephalitis virus
SSGAGVEGI

SEQ ID NO: 186446 - protein, 9 aa, Tick-borne encephalitis virus
SGAGVEGIS

SEQ ID NO: 186447 - protein, 9 aa, Tick-borne encephalitis virus
GAGVEGISL

SEQ ID NO: 186448 - protein, 9 aa, Tick-borne encephalitis virus
AGVEGISLN

SEQ ID NO: 186449 - protein, 9 aa, Tick-borne encephalitis virus
ISLNYLGWY

SEQ ID NO: 186450 - protein, 9 aa, Tick-borne encephalitis virus
SLNYLGWYL

SEQ ID NO: 186451 - protein, 9 aa, Tick-borne encephalitis virus
LNYLGWYLK

SEQ ID NO: 186452 - protein, 9 aa, Tick-borne encephalitis virus
NYLGWHLKK

SEQ ID NO: 186453 - protein, 9 aa, Tick-borne encephalitis virus
YLGWYLKGL

SEQ ID NO: 186454 - protein, 9 aa, Tick-borne encephalitis virus
LGWYLKGLS

SEQ ID NO: 186455 - protein, 9 aa, Tick-borne encephalitis virus
LSTLNGGLF

SEQ ID NO: 186456 - protein, 9 aa, Tick-borne encephalitis virus
STLNGGLFY

SEQ ID NO: 186457 - protein, 9 aa, Tick-borne encephalitis virus
TLNGGLFYA

SEQ ID NO: 186458 - protein, 9 aa, Tick-borne encephalitis virus
LNGGLFYAD

SEQ ID NO: 186459 - protein, 9 aa, Tick-borne encephalitis virus
NGGLFYADD

SEQ ID NO: 186460 - protein, 9 aa, Tick-borne encephalitis virus
ADLEDEEQI

SEQ ID NO: 186461 - protein, 9 aa, Tick-borne encephalitis virus
DLEDEEQIL

SEQ ID NO: 186462 - protein, 9 aa, Tick-borne encephalitis virus
LEDEEQILR

SEQ ID NO: 186463 - protein, 9 aa, Tick-borne encephalitis virus
EDEEQILRY

SEQ ID NO: 186464 - protein, 9 aa, Tick-borne encephalitis virus
DEEQILRYM

SEQ ID NO: 186465 - protein, 9 aa, Tick-borne encephalitis virus
EEQILRYME

SEQ ID NO: 186466 - protein, 9 aa, Tick-borne encephalitis virus
EQILRYMEG

SEQ ID NO: 186467 - protein, 9 aa, Tick-borne encephalitis virus
QILRYMEGE

SEQ ID NO: 186468 - protein, 9 aa, Tick-borne encephalitis virus
ILRYMEGEH

SEQ ID NO: 186469 - protein, 9 aa, Tick-borne encephalitis virus
LRYMEGEHR

SEQ ID NO: 186470 - protein, 9 aa, Tick-borne encephalitis virus
RYMEGEHRQ

SEQ ID NO: 186471 - protein, 9 aa, Tick-borne encephalitis virus
YMEGEHRQL

SEQ ID NO: 186472 - protein, 9 aa, Tick-borne encephalitis virus
MEGEHRQLA

SEQ ID NO: 186473 - protein, 9 aa, Tick-borne encephalitis virus
EGEHKQLAT

SEQ ID NO: 186474 - protein, 9 aa, Tick-borne encephalitis virus
GEHKQLATT

SEQ ID NO: 186475 - protein, 9 aa, Tick-borne encephalitis virus
EHKQLATTI

SEQ ID NO: 186476 - protein, 9 aa, Tick-borne encephalitis virus
HKQLATTIM

SEQ ID NO: 186477 - protein, 9 aa, Tick-borne encephalitis virus
KQLATTIMQ

SEQ ID NO: 186478 - protein, 9 aa, Tick-borne encephalitis virus
QLATTIMQK

SEQ ID NO: 186479 - protein, 9 aa, Tick-borne encephalitis virus
LATTIMQKA

SEQ ID NO: 186480 - protein, 9 aa, Tick-borne encephalitis virus
ATTIMQKAY

SEQ ID NO: 186481 - protein, 9 aa, Tick-borne encephalitis virus
TTIMQKAYH

SEQ ID NO: 186482 - protein, 9 aa, Tick-borne encephalitis virus
TVMQKAYHA

SEQ ID NO: 186483 - protein, 9 aa, Tick-borne encephalitis virus
VMQKAYHAK

SEQ ID NO: 186484 - protein, 9 aa, Tick-borne encephalitis virus
VKVARPSRE

SEQ ID NO: 186485 - protein, 9 aa, Tick-borne encephalitis virus
KVARPSREG

SEQ ID NO: 186486 - protein, 9 aa, Tick-borne encephalitis virus
VARPSREGG

SEQ ID NO: 186487 - protein, 9 aa, Tick-borne encephalitis virus
ARPSREGGC

SEQ ID NO: 186488 - protein, 9 aa, Tick-borne encephalitis virus
RPSRDGGCV

SEQ ID NO: 186489 - protein, 9 aa, Tick-borne encephalitis virus
PSRDGGCVM

SEQ ID NO: 186490 - protein, 9 aa, Tick-borne encephalitis virus
SRDGGCVMD

SEQ ID NO: 186491 - protein, 9 aa, Tick-borne encephalitis virus
RDGGCVMDV

SEQ ID NO: 186492 - protein, 9 aa, Tick-borne encephalitis virus
DGGCVMDVI

SEQ ID NO: 186493 - protein, 9 aa, Tick-borne encephalitis virus
GGCVMDVIT

SEQ ID NO: 186494 - protein, 9 aa, Tick-borne encephalitis virus
GCVMDVITR

SEQ ID NO: 186495 - protein, 9 aa, Tick-borne encephalitis virus
CVMDVITRR

SEQ ID NO: 186496 - protein, 9 aa, Tick-borne encephalitis virus
VMDVITRRD

SEQ ID NO: 186497 - protein, 9 aa, Tick-borne encephalitis virus
TRRDQRGSV

SEQ ID NO: 186498 - protein, 9 aa, Tick-borne encephalitis virus
RRDQRGSVQ

SEQ ID NO: 186499 - protein, 9 aa, Tick-borne encephalitis virus
RDQRGSVQV

SEQ ID NO: 186500 - protein, 9 aa, Tick-borne encephalitis virus
DQRGSVQVV

SEQ ID NO: 186501 - protein, 9 aa, Tick-borne encephalitis virus
QRGSVQVVT

SEQ ID NO: 186502 - protein, 9 aa, Tick-borne encephalitis virus
RGSVQVVTY

SEQ ID NO: 186503 - protein, 9 aa, Tick-borne encephalitis virus
GSVQVVTYA

SEQ ID NO: 186504 - protein, 9 aa, Tick-borne encephalitis virus
SVQVVTYAL

SEQ ID NO: 186505 - protein, 9 aa, Tick-borne encephalitis virus
VQVVTYALN

SEQ ID NO: 186506 - protein, 9 aa, Tick-borne encephalitis virus
VVTYALNTH

SEQ ID NO: 186507 - protein, 9 aa, Tick-borne encephalitis virus
VTYALNTHT

SEQ ID NO: 186508 - protein, 9 aa, Tick-borne encephalitis virus
TYALNTHTN

SEQ ID NO: 186509 - protein, 9 aa, Tick-borne encephalitis virus
YALNTHTNI

SEQ ID NO: 186510 - protein, 9 aa, Tick-borne encephalitis virus
ALNTHTNIK

SEQ ID NO: 186511 - protein, 9 aa, Tick-borne encephalitis virus
LNTHTNIKV

SEQ ID NO: 186512 - protein, 9 aa, Tick-borne encephalitis virus
NTHTNIKVQ

SEQ ID NO: 186513 - protein, 9 aa, Tick-borne encephalitis virus
THTNIKVQL

SEQ ID NO: 186514 - protein, 9 aa, Tick-borne encephalitis virus
HTNIKVQLI

SEQ ID NO: 186515 - protein, 9 aa, Tick-borne encephalitis virus
RMMEGEGVV

SEQ ID NO: 186516 - protein, 9 aa, Tick-borne encephalitis virus
MMEGEGVVE

SEQ ID NO: 186517 - protein, 9 aa, Tick-borne encephalitis virus
MEGEGVVEA

SEQ ID NO: 186518 - protein, 9 aa, Tick-borne encephalitis virus
EGEGVIEAA

SEQ ID NO: 186519 - protein, 9 aa, Tick-borne encephalitis virus
GEGVIEAAD

SEQ ID NO: 186520 - protein, 9 aa, Tick-borne encephalitis virus
EGVIEAADA

SEQ ID NO: 186521 - protein, 9 aa, Tick-borne encephalitis virus
GVIEAADAH

SEQ ID NO: 186522 - protein, 9 aa, Tick-borne encephalitis virus
VIEAADAHN

SEQ ID NO: 186523 - protein, 9 aa, Tick-borne encephalitis virus
IEAADAHNP

SEQ ID NO: 186524 - protein, 9 aa, Tick-borne encephalitis virus
EAADAHNPR

SEQ ID NO: 186525 - protein, 9 aa, Tick-borne encephalitis virus
AADAHNPRL

SEQ ID NO: 186526 - protein, 9 aa, Tick-borne encephalitis virus
ADAHNPRLL

SEQ ID NO: 186527 - protein, 9 aa, Tick-borne encephalitis virus
DAHNPRLFR

SEQ ID NO: 186528 - protein, 9 aa, Tick-borne encephalitis virus
AHNPRLFRV

SEQ ID NO: 186529 - protein, 9 aa, Tick-borne encephalitis virus
HNPRLFRVE

SEQ ID NO: 186530 - protein, 9 aa, Tick-borne encephalitis virus
NPRLFRVER

SEQ ID NO: 186531 - protein, 9 aa, Tick-borne encephalitis virus
PRLFRVERW

SEQ ID NO: 186532 - protein, 9 aa, Tick-borne encephalitis virus
RLFRVERWL

SEQ ID NO: 186533 - protein, 9 aa, Tick-borne encephalitis virus
LLRVERWLK

SEQ ID NO: 186534 - protein, 9 aa, Tick-borne encephalitis virus
LRVERWLKE

SEQ ID NO: 186535 - protein, 9 aa, Tick-borne encephalitis virus
RVERWLKEH

SEQ ID NO: 186536 - protein, 9 aa, Tick-borne encephalitis virus
VERWLKEHG

SEQ ID NO: 186537 - protein, 9 aa, Tick-borne encephalitis virus
EHGEERLGR

SEQ ID NO: 186538 - protein, 9 aa, Tick-borne encephalitis virus
YGEERLGRM

SEQ ID NO: 186539 - protein, 9 aa, Tick-borne encephalitis virus
GGERLGRML

SEQ ID NO: 186540 - protein, 9 aa, Tick-borne encephalitis virus
GERLGRMLV

SEQ ID NO: 186541 - protein, 9 aa, Tick-borne encephalitis virus
SGDDCVVRG

SEQ ID NO: 186542 - protein, 9 aa, Tick-borne encephalitis virus
GDDCVVRPL

SEQ ID NO: 186543 - protein, 9 aa, Tick-borne encephalitis virus
DDCVVRPLD

SEQ ID NO: 186544 - protein, 9 aa, Tick-borne encephalitis virus
DCVVRPLDD

SEQ ID NO: 186545 - protein, 9 aa, Tick-borne encephalitis virus
CVVRPLDDR

SEQ ID NO: 186546 - protein, 9 aa, Tick-borne encephalitis virus
VVRPLDDRF

SEQ ID NO: 186547 - protein, 9 aa, Tick-borne encephalitis virus
VRPLDDRFG

SEQ ID NO: 186548 - protein, 9 aa, Tick-borne encephalitis virus
DDRFSKALY

SEQ ID NO: 186549 - protein, 9 aa, Tick-borne encephalitis virus
DRFSKALYF

SEQ ID NO: 186550 - protein, 9 aa, Tick-borne encephalitis virus
RFSKALYFL

SEQ ID NO: 186551 - protein, 9 aa, Tick-borne encephalitis virus
FSKALYFLN

SEQ ID NO: 186552 - protein, 9 aa, Tick-borne encephalitis virus
SKALYFLND

SEQ ID NO: 186553 - protein, 9 aa, Tick-borne encephalitis virus
RALYFLNDM

SEQ ID NO: 186554 - protein, 9 aa, Tick-borne encephalitis virus
DMAKTRKDV

SEQ ID NO: 186555 - protein, 9 aa, Tick-borne encephalitis virus
MAKTRKDVG

SEQ ID NO: 186556 - protein, 9 aa, Tick-borne encephalitis virus
AKTRKDVGE

SEQ ID NO: 186557 - protein, 9 aa, Tick-borne encephalitis virus
KTRKDVGEW

SEQ ID NO: 186558 - protein, 9 aa, Tick-borne encephalitis virus
TRKDVGEWE

SEQ ID NO: 186559 - protein, 9 aa, Tick-borne encephalitis virus
RKDVGEWEH

SEQ ID NO: 186560 - protein, 9 aa, Tick-borne encephalitis virus
KDVGEWEHS

SEQ ID NO: 186561 - protein, 9 aa, Tick-borne encephalitis virus
DVGEWEHSV

SEQ ID NO: 186562 - protein, 9 aa, Tick-borne encephalitis virus
VGEWEHSVG

SEQ ID NO: 186563 - protein, 9 aa, Tick-borne encephalitis virus
GEWEHSAGF

SEQ ID NO: 186564 - protein, 9 aa, Tick-borne encephalitis virus
EWEHSAGFS

SEQ ID NO: 186565 - protein, 9 aa, Tick-borne encephalitis virus
SWEEVPFCS

SEQ ID NO: 186566 - protein, 9 aa, Tick-borne encephalitis virus
VEEVPFCSH

SEQ ID NO: 186567 - protein, 9 aa, Tick-borne encephalitis virus
EAVPFCSHH

SEQ ID NO: 186568 - protein, 9 aa, Tick-borne encephalitis virus
AVPFCSHHF

SEQ ID NO: 186569 - protein, 9 aa, Tick-borne encephalitis virus
ELVMKDGRT

SEQ ID NO: 186570 - protein, 9 aa, Tick-borne encephalitis virus
LVMKDGRSL

SEQ ID NO: 186571 - protein, 9 aa, Tick-borne encephalitis virus
VMKDGRTLV

SEQ ID NO: 186572 - protein, 9 aa, Tick-borne encephalitis virus
MKDGRSLIV

SEQ ID NO: 186573 - protein, 9 aa, Tick-borne encephalitis virus
KDGRSLIVP

SEQ ID NO: 186574 - protein, 9 aa, Tick-borne encephalitis virus
DGRTLVVPC

SEQ ID NO: 186575 - protein, 9 aa, Tick-borne encephalitis virus
GRSLIVPCR

SEQ ID NO: 186576 - protein, 9 aa, Tick-borne encephalitis virus
RSLIVPCRD

SEQ ID NO: 186577 - protein, 9 aa, Tick-borne encephalitis virus
SLIVPCRDQ

SEQ ID NO: 186578 - protein, 9 aa, Tick-borne encephalitis virus
LVVPCRDQD

SEQ ID NO: 186579 - protein, 9 aa, Tick-borne encephalitis virus
VVPCRDQDE

SEQ ID NO: 186580 - protein, 9 aa, Tick-borne encephalitis virus
QDELVGRAP

SEQ ID NO: 186581 - protein, 9 aa, Tick-borne encephalitis virus
DELVGRARI

SEQ ID NO: 186582 - protein, 9 aa, Tick-borne encephalitis virus
ELVGRARIS

SEQ ID NO: 186583 - protein, 9 aa, Tick-borne encephalitis virus
LVGRARISP

SEQ ID NO: 186584 - protein, 9 aa, Tick-borne encephalitis virus
VGRARISPG

SEQ ID NO: 186585 - protein, 9 aa, Tick-borne encephalitis virus
GRARISPGC

SEQ ID NO: 186586 - protein, 9 aa, Tick-borne encephalitis virus
RARISPGCG

SEQ ID NO: 186587 - protein, 9 aa, Tick-borne encephalitis virus
ARISPGCGW

SEQ ID NO: 186588 - protein, 9 aa, Tick-borne encephalitis virus
RISPGCGWS

SEQ ID NO: 186589 - protein, 9 aa, Tick-borne encephalitis virus
ISPGCGWSV

SEQ ID NO: 186590 - protein, 9 aa, Tick-borne encephalitis virus
SPGCGWSIR

SEQ ID NO: 186591 - protein, 9 aa, Tick-borne encephalitis virus
PGCGWSIRE

SEQ ID NO: 186592 - protein, 9 aa, Tick-borne encephalitis virus
GCGWSIRET

SEQ ID NO: 186593 - protein, 9 aa, Tick-borne encephalitis virus
CGWSIRETA

SEQ ID NO: 186594 - protein, 9 aa, Tick-borne encephalitis virus
GWSIRETAC

SEQ ID NO: 186595 - protein, 9 aa, Tick-borne encephalitis virus
WSIRETACL

SEQ ID NO: 186596 - protein, 9 aa, Tick-borne encephalitis virus
SIRETACLS

SEQ ID NO: 186597 - protein, 9 aa, Tick-borne encephalitis virus
IRETACLSK

SEQ ID NO: 186598 - protein, 9 aa, Tick-borne encephalitis virus
RRDLRTLGF

SEQ ID NO: 186599 - protein, 9 aa, Tick-borne encephalitis virus
RDLRTLGLT

SEQ ID NO: 186600 - protein, 9 aa, Tick-borne encephalitis virus
DLRTLGLTI

SEQ ID NO: 186601 - protein, 9 aa, Tick-borne encephalitis virus
LRTLGLAIN

SEQ ID NO: 186602 - protein, 9 aa, Tick-borne encephalitis virus
RTLGLAINS

SEQ ID NO: 186603 - protein, 9 aa, Tick-borne encephalitis virus
TLGLAINSA

SEQ ID NO: 186604 - protein, 9 aa, Tick-borne encephalitis virus
LGLAINSAV

SEQ ID NO: 186605 - protein, 9 aa, Tick-borne encephalitis virus
GLAINSAVP

SEQ ID NO: 186606 - protein, 9 aa, Tick-borne encephalitis virus
SAVPIDWVP

SEQ ID NO: 186607 - protein, 9 aa, Tick-borne encephalitis virus
AVPIDWVPT

SEQ ID NO: 186608 - protein, 9 aa, Tick-borne encephalitis virus
VPADWVPTG

SEQ ID NO: 186609 - protein, 9 aa, Tick-borne encephalitis virus
PIDWVPTGR

SEQ ID NO: 186610 - protein, 9 aa, Tick-borne encephalitis virus
ADWVPTGRT

SEQ ID NO: 186611 - protein, 9 aa, Tick-borne encephalitis virus
TWSIHASGS

SEQ ID NO: 186612 - protein, 9 aa, Tick-borne encephalitis virus
WSIHASGSW

SEQ ID NO: 186613 - protein, 9 aa, Tick-borne encephalitis virus
SIHASGAWI

SEQ ID NO: 186614 - protein, 9 aa, Tick-borne encephalitis virus
IHASGAWIT

SEQ ID NO: 186615 - protein, 9 aa, Tick-borne encephalitis virus
HASGAWITT

SEQ ID NO: 186616 - protein, 9 aa, Tick-borne encephalitis virus
ASGAWITTE

SEQ ID NO: 186617 - protein, 9 aa, Tick-borne encephalitis virus
SGAWMTTEN

SEQ ID NO: 186618 - protein, 9 aa, Tick-borne encephalitis virus
GAWMTTENM

SEQ ID NO: 186619 - protein, 9 aa, Tick-borne encephalitis virus
AWMTTENML

SEQ ID NO: 186620 - protein, 9 aa, Tick-borne encephalitis virus
WMTTENMLD

SEQ ID NO: 186621 - protein, 9 aa, Tick-borne encephalitis virus
MTTENMLDV

SEQ ID NO: 186622 - protein, 9 aa, Tick-borne encephalitis virus
TTENMLDVW

SEQ ID NO: 186623 - protein, 9 aa, Tick-borne encephalitis virus
TENMLDVWN

SEQ ID NO: 186624 - protein, 9 aa, Tick-borne encephalitis virus
ENMLDVWNR

SEQ ID NO: 186625 - protein, 9 aa, Tick-borne encephalitis virus
NMLDVWNRV

SEQ ID NO: 186626 - protein, 9 aa, Tick-borne encephalitis virus
WILDNPFMQ

SEQ ID NO: 186627 - protein, 9 aa, Tick-borne encephalitis virus
ILDNPFMQN

SEQ ID NO: 186628 - protein, 9 aa, Tick-borne encephalitis virus
LDNPFMQNK

SEQ ID NO: 186629 - protein, 9 aa, Tick-borne encephalitis virus
DNPFMQNKE

SEQ ID NO: 186630 - protein, 9 aa, Tick-borne encephalitis virus
NPFMQNKEK

SEQ ID NO: 186631 - protein, 9 aa, Tick-borne encephalitis virus
EWRDIPYLP

SEQ ID NO: 186632 - protein, 9 aa, Tick-borne encephalitis virus
WRDIPYLPK

SEQ ID NO: 186633 - protein, 9 aa, Tick-borne encephalitis virus
RDVPYLPKA

SEQ ID NO: 186634 - protein, 9 aa, Tick-borne encephalitis virus
VPYLPKAQD

SEQ ID NO: 186635 - protein, 9 aa, Tick-borne encephalitis virus
PYLPKAQDM

SEQ ID NO: 186636 - protein, 9 aa, Tick-borne encephalitis virus
YLPKAQDML

SEQ ID NO: 186637 - protein, 9 aa, Tick-borne encephalitis virus
LPKAQDMLC

SEQ ID NO: 186638 - protein, 9 aa, Tick-borne encephalitis virus
PKAQDMLCS

SEQ ID NO: 186639 - protein, 9 aa, Tick-borne encephalitis virus
KAQDMLCSS

SEQ ID NO: 186640 - protein, 9 aa, Tick-borne encephalitis virus
AQDMLCSSL

SEQ ID NO: 186641 - protein, 9 aa, Tick-borne encephalitis virus
QDMLCSSLV

SEQ ID NO: 186642 - protein, 9 aa, Tick-borne encephalitis virus
LCSSLVGRR

SEQ ID NO: 186643 - protein, 9 aa, Tick-borne encephalitis virus
CSSLVGRRE

SEQ ID NO: 186644 - protein, 9 aa, Tick-borne encephalitis virus
SSLVGRRER

SEQ ID NO: 186645 - protein, 9 aa, Tick-borne encephalitis virus
SLVGRRERA

SEQ ID NO: 186646 - protein, 9 aa, Tick-borne encephalitis virus
LVGRRERAE

SEQ ID NO: 186647 - protein, 9 aa, Tick-borne encephalitis virus
VGRRERAEW

SEQ ID NO: 186648 - protein, 9 aa, Tick-borne encephalitis virus
GRRERAEWA

SEQ ID NO: 186649 - protein, 9 aa, Tick-borne encephalitis virus
RRERAEWAK

SEQ ID NO: 186650 - protein, 9 aa, Tick-borne encephalitis virus
RERAEWAKN

SEQ ID NO: 186651 - protein, 9 aa, Tick-borne encephalitis virus
ERAEWARNI

SEQ ID NO: 186652 - protein, 9 aa, Tick-borne encephalitis virus
RAEWARNIW

SEQ ID NO: 186653 - protein, 9 aa, Tick-borne encephalitis virus
AEWARNIWG

SEQ ID NO: 186654 - protein, 9 aa, Tick-borne encephalitis virus
EWARNIWGA

SEQ ID NO: 186655 - protein, 9 aa, Tick-borne encephalitis virus
WARNIWGAV

SEQ ID NO: 186656 - protein, 9 aa, Tick-borne encephalitis virus
ARNIWGAVE

SEQ ID NO: 186657 - protein, 9 aa, Tick-borne encephalitis virus
RNIWGAVEK

SEQ ID NO: 186658 - protein, 9 aa, Tick-borne encephalitis virus
WGAVEKVRR

SEQ ID NO: 186659 - protein, 9 aa, Tick-borne encephalitis virus
GAVEKVRRM

SEQ ID NO: 186660 - protein, 9 aa, Tick-borne encephalitis virus
AVEKVRRMI

SEQ ID NO: 186661 - protein, 9 aa, Tick-borne encephalitis virus
VEKVRRMIG

SEQ ID NO: 186662 - protein, 9 aa, Tick-borne encephalitis virus
KFRDYLSCM

SEQ ID NO: 186663 - protein, 9 aa, Tick-borne encephalitis virus
FRDYLSCMD

SEQ ID NO: 186664 - protein, 9 aa, Tick-borne encephalitis virus
RDYLSCMDR

SEQ ID NO: 186665 - protein, 9 aa, Tick-borne encephalitis virus
DYPSCMDRH

SEQ ID NO: 186666 - protein, 9 aa, Tick-borne encephalitis virus
YLSCMDRHY

SEQ ID NO: 186667 - protein, 9 aa, Tick-borne encephalitis virus
PSCMDRHDL

SEQ ID NO: 186668 - protein, 9 aa, Tick-borne encephalitis virus
SCMDRHYLH

SEQ ID NO: 186669 - protein, 9 aa, Tick-borne encephalitis virus
CMDRHYLHW

SEQ ID NO: 186670 - protein, 9 aa, Tick-borne encephalitis virus
MDRHYLHWN

SEQ ID NO: 186671 - protein, 9 aa, Tick-borne encephalitis virus
DRHYLHWNL

SEQ ID NO: 186672 - protein, 9 aa, Tick-borne encephalitis virus
RHDLHWELR

SEQ ID NO: 186673 - protein, 9 aa, Tick-borne encephalitis virus
HDLHWELRL

SEQ ID NO: 186674 - protein, 9 aa, Tick-borne encephalitis virus
DLHWELRLE

SEQ ID NO: 186675 - protein, 9 aa, Tick-borne encephalitis virus
LHWELRLES

SEQ ID NO: 186676 - protein, 9 aa, Tick-borne encephalitis virus
HWELRLESS

SEQ ID NO: 186677 - protein, 9 aa, Tick-borne encephalitis virus
WELRLESSI

SEQ ID NO: 186678 - protein, 9 aa, Tick-borne encephalitis virus
ELRLESSII

SEQ ID NO: 186679 - protein, 9 aa, Tick-borne encephalitis virus
MARKAILKG

SEQ ID NO: 186680 - protein, 9 aa, Tick-borne encephalitis virus
ARKAILKGK

SEQ ID NO: 186681 - protein, 9 aa, Tick-borne encephalitis virus
RKAILKGKG

SEQ ID NO: 186682 - protein, 9 aa, Tick-borne encephalitis virus
PPRRASKET

SEQ ID NO: 186683 - protein, 9 aa, Tick-borne encephalitis virus
PRRVSKEAA

SEQ ID NO: 186684 - protein, 9 aa, Tick-borne encephalitis virus
RRVSKETAR

SEQ ID NO: 186685 - protein, 9 aa, Tick-borne encephalitis virus
RVSKETARK

SEQ ID NO: 186686 - protein, 9 aa, Tick-borne encephalitis virus
VSKETARKT

SEQ ID NO: 186687 - protein, 9 aa, Tick-borne encephalitis virus
SKETARKTR

SEQ ID NO: 186688 - protein, 9 aa, Tick-borne encephalitis virus
KETARKTRQ

SEQ ID NO: 186689 - protein, 9 aa, Tick-borne encephalitis virus
ETARKTRQS

SEQ ID NO: 186690 - protein, 9 aa, Tick-borne encephalitis virus
TARKTRQSR

SEQ ID NO: 186691 - protein, 9 aa, Tick-borne encephalitis virus
ARKTRQSRV

SEQ ID NO: 186692 - protein, 9 aa, Tick-borne encephalitis virus
TKTRQPRVQ

SEQ ID NO: 186693 - protein, 9 aa, Tick-borne encephalitis virus
KTRQPRVQM

SEQ ID NO: 186694 - protein, 9 aa, Tick-borne encephalitis virus
TRQPRVQMP

SEQ ID NO: 186695 - protein, 9 aa, Tick-borne encephalitis virus
RQPRVQMPN

SEQ ID NO: 186696 - protein, 9 aa, Tick-borne encephalitis virus
QPRVQMPNG

SEQ ID NO: 186697 - protein, 9 aa, Tick-borne encephalitis virus
PRVQMPNGL

SEQ ID NO: 186698 - protein, 9 aa, Tick-borne encephalitis virus
RVQMPSGLV

SEQ ID NO: 186699 - protein, 9 aa, Tick-borne encephalitis virus
VQMPSGLVL

SEQ ID NO: 186700 - protein, 9 aa, Tick-borne encephalitis virus
QMPSGLVLM

SEQ ID NO: 186701 - protein, 9 aa, Tick-borne encephalitis virus
SGLVLMRMM

SEQ ID NO: 186702 - protein, 9 aa, Tick-borne encephalitis virus
LVLMRMMGF

SEQ ID NO: 186703 - protein, 9 aa, Tick-borne encephalitis virus
VLMRMMGFL

SEQ ID NO: 186704 - protein, 9 aa, Tick-borne encephalitis virus
LMRMMGFLW

SEQ ID NO: 186705 - protein, 9 aa, Tick-borne encephalitis virus
MRMMGFLWH

SEQ ID NO: 186706 - protein, 9 aa, Tick-borne encephalitis virus
RMMGFLWHA

SEQ ID NO: 186707 - protein, 9 aa, Tick-borne encephalitis virus
MLGILWHAV

SEQ ID NO: 186708 - protein, 9 aa, Tick-borne encephalitis virus
LGILWHAVA

SEQ ID NO: 186709 - protein, 9 aa, Tick-borne encephalitis virus
GFLWHAIAG

SEQ ID NO: 186710 - protein, 9 aa, Tick-borne encephalitis virus
FLWHAIAGT

SEQ ID NO: 186711 - protein, 9 aa, Tick-borne encephalitis virus
LWHAVAGTV

SEQ ID NO: 186712 - protein, 9 aa, Tick-borne encephalitis virus
WHAVAGTVR

SEQ ID NO: 186713 - protein, 9 aa, Tick-borne encephalitis virus
HAIAGTARS

SEQ ID NO: 186714 - protein, 9 aa, Tick-borne encephalitis virus
AIAGTARSP

SEQ ID NO: 186715 - protein, 9 aa, Tick-borne encephalitis virus
IAGTARSPV

SEQ ID NO: 186716 - protein, 9 aa, Tick-borne encephalitis virus
AGTVRSPVL

SEQ ID NO: 186717 - protein, 9 aa, Tick-borne encephalitis virus
GTVRSPVLK

SEQ ID NO: 186718 - protein, 9 aa, Tick-borne encephalitis virus
TVRSPVLKS

SEQ ID NO: 186719 - protein, 9 aa, Tick-borne encephalitis virus
VRSPVLKSF

SEQ ID NO: 186720 - protein, 9 aa, Tick-borne encephalitis virus
SPVLKSFWK

SEQ ID NO: 186721 - protein, 9 aa, Tick-borne encephalitis virus
PVLKSFWKS

SEQ ID NO: 186722 - protein, 9 aa, Tick-borne encephalitis virus
VLKSFWKSV

SEQ ID NO: 186723 - protein, 9 aa, Tick-borne encephalitis virus
LKSFWKSVP

SEQ ID NO: 186724 - protein, 9 aa, Tick-borne encephalitis virus
KSFWKSVPL

SEQ ID NO: 186725 - protein, 9 aa, Tick-borne encephalitis virus
AFWNSVPLK

SEQ ID NO: 186726 - protein, 9 aa, Tick-borne encephalitis virus
FWKSVPLKQ

SEQ ID NO: 186727 - protein, 9 aa, Tick-borne encephalitis virus
WKSVPLKQA

SEQ ID NO: 186728 - protein, 9 aa, Tick-borne encephalitis virus
KSVPLKQAT

SEQ ID NO: 186729 - protein, 9 aa, Tick-borne encephalitis virus
SVPLKQAMA

SEQ ID NO: 186730 - protein, 9 aa, Tick-borne encephalitis virus
VPLKQAMAA

SEQ ID NO: 186731 - protein, 9 aa, Tick-borne encephalitis virus
PLKQAMAAL

SEQ ID NO: 186732 - protein, 9 aa, Tick-borne encephalitis virus
LKQAMAALR

SEQ ID NO: 186733 - protein, 9 aa, Tick-borne encephalitis virus
KQAMAALRK

SEQ ID NO: 186734 - protein, 9 aa, Tick-borne encephalitis virus
QATTALRKI

SEQ ID NO: 186735 - protein, 9 aa, Tick-borne encephalitis virus
ATTALRKIK

SEQ ID NO: 186736 - protein, 9 aa, Tick-borne encephalitis virus
MAALRKIKK

SEQ ID NO: 186737 - protein, 9 aa, Tick-borne encephalitis virus
TALRKIKMA

SEQ ID NO: 186738 - protein, 9 aa, Tick-borne encephalitis virus
ALRKIKMAV

SEQ ID NO: 186739 - protein, 9 aa, Tick-borne encephalitis virus
LRKIKMAVS

SEQ ID NO: 186740 - protein, 9 aa, Tick-borne encephalitis virus
RKIKKAVSA

SEQ ID NO: 186741 - protein, 9 aa, Tick-borne encephalitis virus
KIKKAVSAL

SEQ ID NO: 186742 - protein, 9 aa, Tick-borne encephalitis virus
IKMAVSALM

SEQ ID NO: 186743 - protein, 9 aa, Tick-borne encephalitis virus
AVSALMVGL

SEQ ID NO: 186744 - protein, 9 aa, Tick-borne encephalitis virus
VSALMIGLQ

SEQ ID NO: 186745 - protein, 9 aa, Tick-borne encephalitis virus
LMIGLQRRG

SEQ ID NO: 186746 - protein, 9 aa, Tick-borne encephalitis virus
MIGLQRRGK

SEQ ID NO: 186747 - protein, 9 aa, Tick-borne encephalitis virus
VGLQRRGKK

SEQ ID NO: 186748 - protein, 9 aa, Tick-borne encephalitis virus
GLQRRGKKR

SEQ ID NO: 186749 - protein, 9 aa, Tick-borne encephalitis virus
LQRRGKKRS

SEQ ID NO: 186750 - protein, 9 aa, Tick-borne encephalitis virus
QRRGKKRST

SEQ ID NO: 186751 - protein, 9 aa, Tick-borne encephalitis virus
TIAATVRKE

SEQ ID NO: 186752 - protein, 9 aa, Tick-borne encephalitis virus
FAATVRKER

SEQ ID NO: 186753 - protein, 9 aa, Tick-borne encephalitis virus
AATVRREGD

SEQ ID NO: 186754 - protein, 9 aa, Tick-borne encephalitis virus
ATVRREGDG

SEQ ID NO: 186755 - protein, 9 aa, Tick-borne encephalitis virus
TVRKEGDGT

SEQ ID NO: 186756 - protein, 9 aa, Tick-borne encephalitis virus
VRKEGDGTT

SEQ ID NO: 186757 - protein, 9 aa, Tick-borne encephalitis virus
RKEGDGTTV

SEQ ID NO: 186758 - protein, 9 aa, Tick-borne encephalitis virus
KEGDGTTVI

SEQ ID NO: 186759 - protein, 9 aa, Tick-borne encephalitis virus
EGDGTTVIR

SEQ ID NO: 186760 - protein, 9 aa, Tick-borne encephalitis virus
GDGTTVIRA

SEQ ID NO: 186761 - protein, 9 aa, Tick-borne encephalitis virus
DDTTVIRAE

SEQ ID NO: 186762 - protein, 9 aa, Tick-borne encephalitis virus
DTTVIRAEG

SEQ ID NO: 186763 - protein, 9 aa, Tick-borne encephalitis virus
TTVIRAEGR

SEQ ID NO: 186764 - protein, 9 aa, Tick-borne encephalitis virus
ENGTCVIMA

SEQ ID NO: 186765 - protein, 9 aa, Tick-borne encephalitis virus
NGTCVIMAT

SEQ ID NO: 186766 - protein, 9 aa, Tick-borne encephalitis virus
GTCVIMATD

SEQ ID NO: 186767 - protein, 9 aa, Tick-borne encephalitis virus
TCVIMATDM

SEQ ID NO: 186768 - protein, 9 aa, Tick-borne encephalitis virus
CVIMATDMG

SEQ ID NO: 186769 - protein, 9 aa, Tick-borne encephalitis virus
VIMATDMGS

SEQ ID NO: 186770 - protein, 9 aa, Tick-borne encephalitis virus
IMATDMGSW

SEQ ID NO: 186771 - protein, 9 aa, Tick-borne encephalitis virus
LATDMGAWC

SEQ ID NO: 186772 - protein, 9 aa, Tick-borne encephalitis virus
ATDMGAWCD

SEQ ID NO: 186773 - protein, 9 aa, Tick-borne encephalitis virus
GAWCDDSLS

SEQ ID NO: 186774 - protein, 9 aa, Tick-borne encephalitis virus
AWCDDSLSY

SEQ ID NO: 186775 - protein, 9 aa, Tick-borne encephalitis virus
FCRNVDRVY

SEQ ID NO: 186776 - protein, 9 aa, Tick-borne encephalitis virus
CRNVDRVYL

SEQ ID NO: 186777 - protein, 9 aa, Tick-borne encephalitis virus
RNVDRVYLE

SEQ ID NO: 186778 - protein, 9 aa, Tick-borne encephalitis virus
NVDRVYLEY

SEQ ID NO: 186779 - protein, 9 aa, Tick-borne encephalitis virus
VDRVYLEYG

SEQ ID NO: 186780 - protein, 9 aa, Tick-borne encephalitis virus
DRVYLEYGR

SEQ ID NO: 186781 - protein, 9 aa, Tick-borne encephalitis virus
RVYLEYGRC

SEQ ID NO: 186782 - protein, 9 aa, Tick-borne encephalitis virus
LIRSHAQGD

SEQ ID NO: 186783 - protein, 9 aa, Tick-borne encephalitis virus
IRSHAQGDL

SEQ ID NO: 186784 - protein, 9 aa, Tick-borne encephalitis virus
RSHAQGDLT

SEQ ID NO: 186785 - protein, 9 aa, Tick-borne encephalitis virus
QGELTGRGR

SEQ ID NO: 186786 - protein, 9 aa, Tick-borne encephalitis virus
GELTGRGRK

SEQ ID NO: 186787 - protein, 9 aa, Tick-borne encephalitis virus
ELTGRGRKW

SEQ ID NO: 186788 - protein, 9 aa, Tick-borne encephalitis virus
IVWLTVESV

SEQ ID NO: 186789 - protein, 9 aa, Tick-borne encephalitis virus
VWMTVESVV

SEQ ID NO: 186790 - protein, 9 aa, Tick-borne encephalitis virus
WMTVESVVT

SEQ ID NO: 186791 - protein, 9 aa, Tick-borne encephalitis virus
LTLESVVAR

SEQ ID NO: 186792 - protein, 9 aa, Tick-borne encephalitis virus
TVESVVTRI

SEQ ID NO: 186793 - protein, 9 aa, Tick-borne encephalitis virus
VVVLFCLAP

SEQ ID NO: 186794 - protein, 9 aa, Tick-borne encephalitis virus
AVLLCLAPV

SEQ ID NO: 186795 - protein, 9 aa, Tick-borne encephalitis virus
VLFCLAPVY

SEQ ID NO: 186796 - protein, 9 aa, Tick-borne encephalitis virus
WLDAIYQES

SEQ ID NO: 186797 - protein, 9 aa, Tick-borne encephalitis virus
LDAIYQESP

SEQ ID NO: 186798 - protein, 9 aa, Tick-borne encephalitis virus
DAIYQESPA

SEQ ID NO: 186799 - protein, 9 aa, Tick-borne encephalitis virus
AIYQESPAK

SEQ ID NO: 186800 - protein, 9 aa, Tick-borne encephalitis virus
IYQEKPAKT

SEQ ID NO: 186801 - protein, 9 aa, Tick-borne encephalitis virus
YQENPAQTR

SEQ ID NO: 186802 - protein, 9 aa, Tick-borne encephalitis virus
QEKPAKTRE

SEQ ID NO: 186803 - protein, 9 aa, Tick-borne encephalitis virus
EKPAKTREY

SEQ ID NO: 186804 - protein, 9 aa, Tick-borne encephalitis virus
NPAQTREYC

SEQ ID NO: 186805 - protein, 9 aa, Tick-borne encephalitis virus
QTREYCLHA

SEQ ID NO: 186806 - protein, 9 aa, Tick-borne encephalitis virus
PTMGPATLT

SEQ ID NO: 186807 - protein, 9 aa, Tick-borne encephalitis virus
TTGPATLAE

SEQ ID NO: 186808 - protein, 9 aa, Tick-borne encephalitis virus
MGPATLTEE

SEQ ID NO: 186809 - protein, 9 aa, Tick-borne encephalitis virus
GPATLTEEH

SEQ ID NO: 186810 - protein, 9 aa, Tick-borne encephalitis virus
PATLAEQHQ

SEQ ID NO: 186811 - protein, 9 aa, Tick-borne encephalitis virus
ATLAEQHQS

SEQ ID NO: 186812 - protein, 9 aa, Tick-borne encephalitis virus
TLTEEHQGG

SEQ ID NO: 186813 - protein, 9 aa, Tick-borne encephalitis virus
LAEQHQSGT

SEQ ID NO: 186814 - protein, 9 aa, Tick-borne encephalitis virus
AEQHQSGTV

SEQ ID NO: 186815 - protein, 9 aa, Tick-borne encephalitis virus
EQHQSGTVC

SEQ ID NO: 186816 - protein, 9 aa, Tick-borne encephalitis virus
QHQSGTVCK

SEQ ID NO: 186817 - protein, 9 aa, Tick-borne encephalitis virus
GSIVTCVKV

SEQ ID NO: 186818 - protein, 9 aa, Tick-borne encephalitis virus
SIVTCVKVA

SEQ ID NO: 186819 - protein, 9 aa, Tick-borne encephalitis virus
IVTCVKVAC

SEQ ID NO: 186820 - protein, 9 aa, Tick-borne encephalitis virus
VTCVKVACE

SEQ ID NO: 186821 - protein, 9 aa, Tick-borne encephalitis virus
TCVKVACEA

SEQ ID NO: 186822 - protein, 9 aa, Tick-borne encephalitis virus
CVKVACEAK

SEQ ID NO: 186823 - protein, 9 aa, Tick-borne encephalitis virus
VKVACEAKK

SEQ ID NO: 186824 - protein, 9 aa, Tick-borne encephalitis virus
KVACEAKKK

SEQ ID NO: 186825 - protein, 9 aa, Tick-borne encephalitis virus
VACEAKKKA

SEQ ID NO: 186826 - protein, 9 aa, Tick-borne encephalitis virus
TGHVYDPNK

SEQ ID NO: 186827 - protein, 9 aa, Tick-borne encephalitis virus
GHVYDPNKI

SEQ ID NO: 186828 - protein, 9 aa, Tick-borne encephalitis virus
HVYDANRIV

SEQ ID NO: 186829 - protein, 9 aa, Tick-borne encephalitis virus
VYDANRIVY

SEQ ID NO: 186830 - protein, 9 aa, Tick-borne encephalitis virus
YDPNKIVYP

SEQ ID NO: 186831 - protein, 9 aa, Tick-borne encephalitis virus
DPNKIVYPV

SEQ ID NO: 186832 - protein, 9 aa, Tick-borne encephalitis virus
ANKIVYTIK

SEQ ID NO: 186833 - protein, 9 aa, Tick-borne encephalitis virus
NRIVYTVKV

SEQ ID NO: 186834 - protein, 9 aa, Tick-borne encephalitis virus
RIVYTVKVE

SEQ ID NO: 186835 - protein, 9 aa, Tick-borne encephalitis virus
IVYPVKVEP

SEQ ID NO: 186836 - protein, 9 aa, Tick-borne encephalitis virus
VYTIKVEPH

SEQ ID NO: 186837 - protein, 9 aa, Tick-borne encephalitis virus
YPVKVEPHT

SEQ ID NO: 186838 - protein, 9 aa, Tick-borne encephalitis virus
TIKVEPHTG

SEQ ID NO: 186839 - protein, 9 aa, Tick-borne encephalitis virus
PHTGDYVAP

SEQ ID NO: 186840 - protein, 9 aa, Tick-borne encephalitis virus
HTGDYVAVN

SEQ ID NO: 186841 - protein, 9 aa, Tick-borne encephalitis virus
TGDYVAPHE

SEQ ID NO: 186842 - protein, 9 aa, Tick-borne encephalitis virus
GDYVAVNET

SEQ ID NO: 186843 - protein, 9 aa, Tick-borne encephalitis virus
DYVAPHETH

SEQ ID NO: 186844 - protein, 9 aa, Tick-borne encephalitis virus
YVAVNETHS

SEQ ID NO: 186845 - protein, 9 aa, Tick-borne encephalitis virus
VAVNETHSG

SEQ ID NO: 186846 - protein, 9 aa, Tick-borne encephalitis virus
AVNETHSGR

SEQ ID NO: 186847 - protein, 9 aa, Tick-borne encephalitis virus
VNETHSGRK

SEQ ID NO: 186848 - protein, 9 aa, Tick-borne encephalitis virus
GRKTPSFTV

SEQ ID NO: 186849 - protein, 9 aa, Tick-borne encephalitis virus
RKTPSFTVS

SEQ ID NO: 186850 - protein, 9 aa, Tick-borne encephalitis virus
KTPSFTVSS

SEQ ID NO: 186851 - protein, 9 aa, Tick-borne encephalitis virus
TPSFTVSSE

SEQ ID NO: 186852 - protein, 9 aa, Tick-borne encephalitis virus
PSFTVSSEK

SEQ ID NO: 186853 - protein, 9 aa, Tick-borne encephalitis virus
VSSEKTILN

SEQ ID NO: 186854 - protein, 9 aa, Tick-borne encephalitis virus
EKTILNMGD

SEQ ID NO: 186855 - protein, 9 aa, Tick-borne encephalitis virus
KTILNMGDY

SEQ ID NO: 186856 - protein, 9 aa, Tick-borne encephalitis virus
TILNMGDYG

SEQ ID NO: 186857 - protein, 9 aa, Tick-borne encephalitis virus
ILNMGDYGD

SEQ ID NO: 186858 - protein, 9 aa, Tick-borne encephalitis virus
LNMGDYGDV

SEQ ID NO: 186859 - protein, 9 aa, Tick-borne encephalitis virus
NMGDYGDVS

SEQ ID NO: 186860 - protein, 9 aa, Tick-borne encephalitis virus
VILELDKTL

SEQ ID NO: 186861 - protein, 9 aa, Tick-borne encephalitis virus
ILELDKTLE

SEQ ID NO: 186862 - protein, 9 aa, Tick-borne encephalitis virus
LELDKTLEH

SEQ ID NO: 186863 - protein, 9 aa, Tick-borne encephalitis virus
ELDKTLEHL

SEQ ID NO: 186864 - protein, 9 aa, Tick-borne encephalitis virus
LDKTLEHLP

SEQ ID NO: 186865 - protein, 9 aa, Tick-borne encephalitis virus
DKTLEHLPT

SEQ ID NO: 186866 - protein, 9 aa, Tick-borne encephalitis virus
KTLEHLPTA

SEQ ID NO: 186867 - protein, 9 aa, Tick-borne encephalitis virus
TLEHLPTAW

SEQ ID NO: 186868 - protein, 9 aa, Tick-borne encephalitis virus
LEHLPTAWQ

SEQ ID NO: 186869 - protein, 9 aa, Tick-borne encephalitis virus
ALPWRHEGV

SEQ ID NO: 186870 - protein, 9 aa, Tick-borne encephalitis virus
LPWKHEGAR

SEQ ID NO: 186871 - protein, 9 aa, Tick-borne encephalitis virus
HEGAQHWNN

SEQ ID NO: 186872 - protein, 9 aa, Tick-borne encephalitis virus
EGAQHWNNA

SEQ ID NO: 186873 - protein, 9 aa, Tick-borne encephalitis virus
GAQHWNNAE

SEQ ID NO: 186874 - protein, 9 aa, Tick-borne encephalitis virus
AQHWNNAER

SEQ ID NO: 186875 - protein, 9 aa, Tick-borne encephalitis virus
QHWNNAERL

SEQ ID NO: 186876 - protein, 9 aa, Tick-borne encephalitis virus
HWNNAERLV

SEQ ID NO: 186877 - protein, 9 aa, Tick-borne encephalitis virus
VPVAHIDGA

SEQ ID NO: 186878 - protein, 9 aa, Tick-borne encephalitis virus
PVAHIDGAK

SEQ ID NO: 186879 - protein, 9 aa, Tick-borne encephalitis virus
VAHIDGAKY

SEQ ID NO: 186880 - protein, 9 aa, Tick-borne encephalitis virus
AHIDGAKYH

SEQ ID NO: 186881 - protein, 9 aa, Tick-borne encephalitis virus
HIDGAKYHL

SEQ ID NO: 186882 - protein, 9 aa, Tick-borne encephalitis virus
IDGAKYHLK

SEQ ID NO: 186883 - protein, 9 aa, Tick-borne encephalitis virus
DGAKYHLKS

SEQ ID NO: 186884 - protein, 9 aa, Tick-borne encephalitis virus
KMNGLTYTM

SEQ ID NO: 186885 - protein, 9 aa, Tick-borne encephalitis virus
MNGLTYTMC

SEQ ID NO: 186886 - protein, 9 aa, Tick-borne encephalitis virus
NGLTYTMCD

SEQ ID NO: 186887 - protein, 9 aa, Tick-borne encephalitis virus
TVCDKTKFT

SEQ ID NO: 186888 - protein, 9 aa, Tick-borne encephalitis virus
VCDKTKFTW

SEQ ID NO: 186889 - protein, 9 aa, Tick-borne encephalitis virus
CDKTKFTWR

SEQ ID NO: 186890 - protein, 9 aa, Tick-borne encephalitis virus
DKTKFTWRR

SEQ ID NO: 186891 - protein, 9 aa, Tick-borne encephalitis virus
KTKFAWKRT

SEQ ID NO: 186892 - protein, 9 aa, Tick-borne encephalitis virus
TKFAWKRTP

SEQ ID NO: 186893 - protein, 9 aa, Tick-borne encephalitis virus
KFAWKRTPT

SEQ ID NO: 186894 - protein, 9 aa, Tick-borne encephalitis virus
FAWKRTPTD

SEQ ID NO: 186895 - protein, 9 aa, Tick-borne encephalitis virus
AWKRTPTDS

SEQ ID NO: 186896 - protein, 9 aa, Tick-borne encephalitis virus
WKRTPTDSG

SEQ ID NO: 186897 - protein, 9 aa, Tick-borne encephalitis virus
KRTPTDSGH

SEQ ID NO: 186898 - protein, 9 aa, Tick-borne encephalitis virus
RTPTDSGHD

SEQ ID NO: 186899 - protein, 9 aa, Tick-borne encephalitis virus
APTDSGHDT

SEQ ID NO: 186900 - protein, 9 aa, Tick-borne encephalitis virus
HDTVVMEVS

SEQ ID NO: 186901 - protein, 9 aa, Tick-borne encephalitis virus
DTVVMEVSF

SEQ ID NO: 186902 - protein, 9 aa, Tick-borne encephalitis virus
TVVMEVSFS

SEQ ID NO: 186903 - protein, 9 aa, Tick-borne encephalitis virus
VVMEVSFSG

SEQ ID NO: 186904 - protein, 9 aa, Tick-borne encephalitis virus
VMEVSFSGT

SEQ ID NO: 186905 - protein, 9 aa, Tick-borne encephalitis virus
MEVSFSGTK

SEQ ID NO: 186906 - protein, 9 aa, Tick-borne encephalitis virus
EVSFSGTKP

SEQ ID NO: 186907 - protein, 9 aa, Tick-borne encephalitis virus
VSFSGTKPC

SEQ ID NO: 186908 - protein, 9 aa, Tick-borne encephalitis virus
SFSGTKPCR

SEQ ID NO: 186909 - protein, 9 aa, Tick-borne encephalitis virus
GRVFQKTRR

SEQ ID NO: 186910 - protein, 9 aa, Tick-borne encephalitis virus
RVFQKTRRG

SEQ ID NO: 186911 - protein, 9 aa, Tick-borne encephalitis virus
VFQKTRRGI

SEQ ID NO: 186912 - protein, 9 aa, Tick-borne encephalitis virus
FQKTRRGIE

SEQ ID NO: 186913 - protein, 9 aa, Tick-borne encephalitis virus
QKTRRGIER

SEQ ID NO: 186914 - protein, 9 aa, Tick-borne encephalitis virus
KTRRGIERL

SEQ ID NO: 186915 - protein, 9 aa, Tick-borne encephalitis virus
TRRGIERLT

SEQ ID NO: 186916 - protein, 9 aa, Tick-borne encephalitis virus
RRGIERLTV

SEQ ID NO: 186917 - protein, 9 aa, Tick-borne encephalitis virus
WDFGSTGGL

SEQ ID NO: 186918 - protein, 9 aa, Tick-borne encephalitis virus
DFGSTGGLL

SEQ ID NO: 186919 - protein, 9 aa, Tick-borne encephalitis virus
FGSTGGFLA

SEQ ID NO: 186920 - protein, 9 aa, Tick-borne encephalitis virus
GSTGGFLAS

SEQ ID NO: 186921 - protein, 9 aa, Tick-borne encephalitis virus
STGGFLASV

SEQ ID NO: 186922 - protein, 9 aa, Tick-borne encephalitis virus
TGGFLASVG

SEQ ID NO: 186923 - protein, 9 aa, Tick-borne encephalitis virus
GGFLASVGK

SEQ ID NO: 186924 - protein, 9 aa, Tick-borne encephalitis virus
GFLASVGKA

SEQ ID NO: 186925 - protein, 9 aa, Tick-borne encephalitis virus
FLASVGKAL

SEQ ID NO: 186926 - protein, 9 aa, Tick-borne encephalitis virus
LASVGKALH

SEQ ID NO: 186927 - protein, 9 aa, Tick-borne encephalitis virus
ASVGKALHT

SEQ ID NO: 186928 - protein, 9 aa, Tick-borne encephalitis virus
SIGKALHTV

SEQ ID NO: 186929 - protein, 9 aa, Tick-borne encephalitis virus
IGKALHTVL

SEQ ID NO: 186930 - protein, 9 aa, Tick-borne encephalitis virus
SLFGGVGFI

SEQ ID NO: 186931 - protein, 9 aa, Tick-borne encephalitis virus
LFGGVGFIP

SEQ ID NO: 186932 - protein, 9 aa, Tick-borne encephalitis virus
GGVGFIPKL

SEQ ID NO: 186933 - protein, 9 aa, Tick-borne encephalitis virus
GVGFIPKLL

SEQ ID NO: 186934 - protein, 9 aa, Tick-borne encephalitis virus
VGFLPKILM

SEQ ID NO: 186935 - protein, 9 aa, Tick-borne encephalitis virus
GFLPKILMG

SEQ ID NO: 186936 - protein, 9 aa, Tick-borne encephalitis virus
GMALAWLGL

SEQ ID NO: 186937 - protein, 9 aa, Tick-borne encephalitis virus
AALAWLGLN

SEQ ID NO: 186938 - protein, 9 aa, Tick-borne encephalitis virus
SMSFLLAGV

SEQ ID NO: 186939 - protein, 9 aa, Tick-borne encephalitis virus
MSFLLAGVL

SEQ ID NO: 186940 - protein, 9 aa, Tick-borne encephalitis virus
SFLLAGVLV

SEQ ID NO: 186941 - protein, 9 aa, Tick-borne encephalitis virus
ALASAIRET

SEQ ID NO: 186942 - protein, 9 aa, Tick-borne encephalitis virus
LASAIRETF

SEQ ID NO: 186943 - protein, 9 aa, Tick-borne encephalitis virus
ASAIKEAFE

SEQ ID NO: 186944 - protein, 9 aa, Tick-borne encephalitis virus
SAIKEAFEE

SEQ ID NO: 186945 - protein, 9 aa, Tick-borne encephalitis virus
AIRETFEEG

SEQ ID NO: 186946 - protein, 9 aa, Tick-borne encephalitis virus
IKETFEEGN

SEQ ID NO: 186947 - protein, 9 aa, Tick-borne encephalitis virus
KETFEEGNC

SEQ ID NO: 186948 - protein, 9 aa, Tick-borne encephalitis virus
ETFEEGNCG

SEQ ID NO: 186949 - protein, 9 aa, Tick-borne encephalitis virus
TFEEGNCGI

SEQ ID NO: 186950 - protein, 9 aa, Tick-borne encephalitis virus
FEEGNCGIV

SEQ ID NO: 186951 - protein, 9 aa, Tick-borne encephalitis virus
EEGNCGIVP

SEQ ID NO: 186952 - protein, 9 aa, Tick-borne encephalitis virus
EGNCGIVPQ

SEQ ID NO: 186953 - protein, 9 aa, Tick-borne encephalitis virus
GNCGIVPQN

SEQ ID NO: 186954 - protein, 9 aa, Tick-borne encephalitis virus
NCGIVPQNR

SEQ ID NO: 186955 - protein, 9 aa, Tick-borne encephalitis virus
CGILPQNRL

SEQ ID NO: 186956 - protein, 9 aa, Tick-borne encephalitis virus
GILPQNRLE

SEQ ID NO: 186957 - protein, 9 aa, Tick-borne encephalitis virus
ILPQNRLEM

SEQ ID NO: 186958 - protein, 9 aa, Tick-borne encephalitis virus
EMAMWRSAV

SEQ ID NO: 186959 - protein, 9 aa, Tick-borne encephalitis virus
MAMWRSAVT

SEQ ID NO: 186960 - protein, 9 aa, Tick-borne encephalitis virus
AMWRSAVTE

SEQ ID NO: 186961 - protein, 9 aa, Tick-borne encephalitis virus
MWRSAVTEL

SEQ ID NO: 186962 - protein, 9 aa, Tick-borne encephalitis virus
WRSAVTELN

SEQ ID NO: 186963 - protein, 9 aa, Tick-borne encephalitis virus
RSAVTELNL

SEQ ID NO: 186964 - protein, 9 aa, Tick-borne encephalitis virus
SAVTELNLA

SEQ ID NO: 186965 - protein, 9 aa, Tick-borne encephalitis virus
AVTELNLAL

SEQ ID NO: 186966 - protein, 9 aa, Tick-borne encephalitis virus
STELNLALA

SEQ ID NO: 186967 - protein, 9 aa, Tick-borne encephalitis virus
EGEANLTVM

SEQ ID NO: 186968 - protein, 9 aa, Tick-borne encephalitis virus
GEANLTVMV

SEQ ID NO: 186969 - protein, 9 aa, Tick-borne encephalitis virus
EANLTVMVD

SEQ ID NO: 186970 - protein, 9 aa, Tick-borne encephalitis virus
NLTVMVDKF

SEQ ID NO: 186971 - protein, 9 aa, Tick-borne encephalitis virus
LTVMVDKFD

SEQ ID NO: 186972 - protein, 9 aa, Tick-borne encephalitis virus
TVMVDKFDP

SEQ ID NO: 186973 - protein, 9 aa, Tick-borne encephalitis virus
VMVDKFDPT

SEQ ID NO: 186974 - protein, 9 aa, Tick-borne encephalitis virus
MVDKFDPTD

SEQ ID NO: 186975 - protein, 9 aa, Tick-borne encephalitis virus
PTDYRGGVS

SEQ ID NO: 186976 - protein, 9 aa, Tick-borne encephalitis virus
TDYRGGVSG

SEQ ID NO: 186977 - protein, 9 aa, Tick-borne encephalitis virus
DYRGGVSGL

SEQ ID NO: 186978 - protein, 9 aa, Tick-borne encephalitis virus
YRGGVSGLL

SEQ ID NO: 186979 - protein, 9 aa, Tick-borne encephalitis virus
RGGVSGLLR

SEQ ID NO: 186980 - protein, 9 aa, Tick-borne encephalitis virus
GGIPGLLRK

SEQ ID NO: 186981 - protein, 9 aa, Tick-borne encephalitis virus
GIPGLLRKG

SEQ ID NO: 186982 - protein, 9 aa, Tick-borne encephalitis virus
VSGLLRKGK

SEQ ID NO: 186983 - protein, 9 aa, Tick-borne encephalitis virus
PGLLRKGKD

SEQ ID NO: 186984 - protein, 9 aa, Tick-borne encephalitis virus
LLKKGKDIR

SEQ ID NO: 186985 - protein, 9 aa, Tick-borne encephalitis virus
LKKGKDIRV

SEQ ID NO: 186986 - protein, 9 aa, Tick-borne encephalitis virus
KKGKDIRVS

SEQ ID NO: 186987 - protein, 9 aa, Tick-borne encephalitis virus
GKDIKVSWR

SEQ ID NO: 186988 - protein, 9 aa, Tick-borne encephalitis virus
KDIKVSWRS

SEQ ID NO: 186989 - protein, 9 aa, Tick-borne encephalitis virus
DIRVSWKSW

SEQ ID NO: 186990 - protein, 9 aa, Tick-borne encephalitis virus
IKVSWRSWG

SEQ ID NO: 186991 - protein, 9 aa, Tick-borne encephalitis virus
KVSWRSWGH

SEQ ID NO: 186992 - protein, 9 aa, Tick-borne encephalitis virus
VSWKSWGQA

SEQ ID NO: 186993 - protein, 9 aa, Tick-borne encephalitis virus
SWGQSVIWS

SEQ ID NO: 186994 - protein, 9 aa, Tick-borne encephalitis virus
AMIWSIPEA

SEQ ID NO: 186995 - protein, 9 aa, Tick-borne encephalitis virus
MIWSIPEAS

SEQ ID NO: 186996 - protein, 9 aa, Tick-borne encephalitis virus
IWSIPEASR

SEQ ID NO: 186997 - protein, 9 aa, Tick-borne encephalitis virus
WSIPEASRR

SEQ ID NO: 186998 - protein, 9 aa, Tick-borne encephalitis virus
SIPEASRRF

SEQ ID NO: 186999 - protein, 9 aa, Tick-borne encephalitis virus
IPEASRRFM

SEQ ID NO: 187000 - protein, 9 aa, Tick-borne encephalitis virus
ASRRFMVGT

SEQ ID NO: 187001 - protein, 9 aa, Tick-borne encephalitis virus
SRRFMVGTE

SEQ ID NO: 187002 - protein, 9 aa, Tick-borne encephalitis virus
RFMVGTEGQ

SEQ ID NO: 187003 - protein, 9 aa, Tick-borne encephalitis virus
SECPPERRK

SEQ ID NO: 187004 - protein, 9 aa, Tick-borne encephalitis virus
PLERRKTGI

SEQ ID NO: 187005 - protein, 9 aa, Tick-borne encephalitis virus
PERRKTGVF

SEQ ID NO: 187006 - protein, 9 aa, Tick-borne encephalitis virus
VFVDFRQES

SEQ ID NO: 187007 - protein, 9 aa, Tick-borne encephalitis virus
FVDFRQEST

SEQ ID NO: 187008 - protein, 9 aa, Tick-borne encephalitis virus
VDFRQESTH

SEQ ID NO: 187009 - protein, 9 aa, Tick-borne encephalitis virus
DFRQEATHE

SEQ ID NO: 187010 - protein, 9 aa, Tick-borne encephalitis virus
FRQEATHEC

SEQ ID NO: 187011 - protein, 9 aa, Tick-borne encephalitis virus
RQEATHECD

SEQ ID NO: 187012 - protein, 9 aa, Tick-borne encephalitis virus
QEATHECDT

SEQ ID NO: 187013 - protein, 9 aa, Tick-borne encephalitis virus
EATHECDTG

SEQ ID NO: 187014 - protein, 9 aa, Tick-borne encephalitis virus
ATHECDTGV

SEQ ID NO: 187015 - protein, 9 aa, Tick-borne encephalitis virus
DQSLWMKSM

SEQ ID NO: 187016 - protein, 9 aa, Tick-borne encephalitis virus
QSLWMKSVK

SEQ ID NO: 187017 - protein, 9 aa, Tick-borne encephalitis virus
SLWMKSVKN

SEQ ID NO: 187018 - protein, 9 aa, Tick-borne encephalitis virus
LWMKSVKND

SEQ ID NO: 187019 - protein, 9 aa, Tick-borne encephalitis virus
WMKSVKNDT

SEQ ID NO: 187020 - protein, 9 aa, Tick-borne encephalitis virus
MKSVKNDTG

SEQ ID NO: 187021 - protein, 9 aa, Tick-borne encephalitis virus
KSVKNDTGT

SEQ ID NO: 187022 - protein, 9 aa, Tick-borne encephalitis virus
SVKNDTGTY

SEQ ID NO: 187023 - protein, 9 aa, Tick-borne encephalitis virus
VKNDTGTYI

SEQ ID NO: 187024 - protein, 9 aa, Tick-borne encephalitis virus
RNETGTYIV

SEQ ID NO: 187025 - protein, 9 aa, Tick-borne encephalitis virus
ASHTIDNPE

SEQ ID NO: 187026 - protein, 9 aa, Tick-borne encephalitis virus
SHTIDNPEV

SEQ ID NO: 187027 - protein, 9 aa, Tick-borne encephalitis virus
HTIDNPEVV

SEQ ID NO: 187028 - protein, 9 aa, Tick-borne encephalitis virus
TIDNPEVVD

SEQ ID NO: 187029 - protein, 9 aa, Tick-borne encephalitis virus
IDNPEVVDS

SEQ ID NO: 187030 - protein, 9 aa, Tick-borne encephalitis virus
DNPEVVDSE

SEQ ID NO: 187031 - protein, 9 aa, Tick-borne encephalitis virus
NADVVDSES

SEQ ID NO: 187032 - protein, 9 aa, Tick-borne encephalitis virus
ADVVDSESF

SEQ ID NO: 187033 - protein, 9 aa, Tick-borne encephalitis virus
DVVDSESFL

SEQ ID NO: 187034 - protein, 9 aa, Tick-borne encephalitis virus
QVKGPWKYT

SEQ ID NO: 187035 - protein, 9 aa, Tick-borne encephalitis virus
VKGPWKYTP

SEQ ID NO: 187036 - protein, 9 aa, Tick-borne encephalitis virus
KGPWKYTPI

SEQ ID NO: 187037 - protein, 9 aa, Tick-borne encephalitis virus
GPWKYTPIR

SEQ ID NO: 187038 - protein, 9 aa, Tick-borne encephalitis virus
PWKYTPIRV

SEQ ID NO: 187039 - protein, 9 aa, Tick-borne encephalitis virus
PIRVVRGEC

SEQ ID NO: 187040 - protein, 9 aa, Tick-borne encephalitis virus
IRVVRGECP

SEQ ID NO: 187041 - protein, 9 aa, Tick-borne encephalitis virus
RVVRGECPG

SEQ ID NO: 187042 - protein, 9 aa, Tick-borne encephalitis virus
VVRGECPGT

SEQ ID NO: 187043 - protein, 9 aa, Tick-borne encephalitis virus
TREECPGTK

SEQ ID NO: 187044 - protein, 9 aa, Tick-borne encephalitis virus
REECPGTKV

SEQ ID NO: 187045 - protein, 9 aa, Tick-borne encephalitis virus
ECPGTTVTI

SEQ ID NO: 187046 - protein, 9 aa, Tick-borne encephalitis virus
ISADCDKRG

SEQ ID NO: 187047 - protein, 9 aa, Tick-borne encephalitis virus
SADCDKRGA

SEQ ID NO: 187048 - protein, 9 aa, Tick-borne encephalitis virus
ADCDRRGAS

SEQ ID NO: 187049 - protein, 9 aa, Tick-borne encephalitis virus
DCDRRGASV

SEQ ID NO: 187050 - protein, 9 aa, Tick-borne encephalitis virus
TCTLPPVTI

SEQ ID NO: 187051 - protein, 9 aa, Tick-borne encephalitis virus
CTLPPVTIR

SEQ ID NO: 187052 - protein, 9 aa, Tick-borne encephalitis virus
TLPPVTIRT

SEQ ID NO: 187053 - protein, 9 aa, Tick-borne encephalitis virus
LPPVTIRTG

SEQ ID NO: 187054 - protein, 9 aa, Tick-borne encephalitis virus
DQGGLVRST

SEQ ID NO: 187055 - protein, 9 aa, Tick-borne encephalitis virus
QGGLIRSMV

SEQ ID NO: 187056 - protein, 9 aa, Tick-borne encephalitis virus
GGLVRSTVV

SEQ ID NO: 187057 - protein, 9 aa, Tick-borne encephalitis virus
GLVRSTVVA

SEQ ID NO: 187058 - protein, 9 aa, Tick-borne encephalitis virus
LIRSMVVAD

SEQ ID NO: 187059 - protein, 9 aa, Tick-borne encephalitis virus
VRSTVVADN

SEQ ID NO: 187060 - protein, 9 aa, Tick-borne encephalitis virus
IRRRPSTGS

SEQ ID NO: 187061 - protein, 9 aa, Tick-borne encephalitis virus
RRRPATGTA

SEQ ID NO: 187062 - protein, 9 aa, Tick-borne encephalitis virus
RRPATGTAV

SEQ ID NO: 187063 - protein, 9 aa, Tick-borne encephalitis virus
RPATGTAVV

SEQ ID NO: 187064 - protein, 9 aa, Tick-borne encephalitis virus
PATGTAVVW

SEQ ID NO: 187065 - protein, 9 aa, Tick-borne encephalitis virus
ATGTAVVWG

SEQ ID NO: 187066 - protein, 9 aa, Tick-borne encephalitis virus
TGTAVVWGG

SEQ ID NO: 187067 - protein, 9 aa, Tick-borne encephalitis virus
WGGFVVLAL

SEQ ID NO: 187068 - protein, 9 aa, Tick-borne encephalitis virus
GGFVVLALL

SEQ ID NO: 187069 - protein, 9 aa, Tick-borne encephalitis virus
GFVVLALLV

SEQ ID NO: 187070 - protein, 9 aa, Tick-borne encephalitis virus
FVVLALLVT

SEQ ID NO: 187071 - protein, 9 aa, Tick-borne encephalitis virus
IVLALLVTG

SEQ ID NO: 187072 - protein, 9 aa, Tick-borne encephalitis virus
VFALLVTGL

SEQ ID NO: 187073 - protein, 9 aa, Tick-borne encephalitis virus
FALLVTGLV

SEQ ID NO: 187074 - protein, 9 aa, Tick-borne encephalitis virus
ALLVTGLVK

SEQ ID NO: 187075 - protein, 9 aa, Tick-borne encephalitis virus
VRMESLVRY

SEQ ID NO: 187076 - protein, 9 aa, Tick-borne encephalitis virus
RMESLVRYV

SEQ ID NO: 187077 - protein, 9 aa, Tick-borne encephalitis virus
MESLVRYVV

SEQ ID NO: 187078 - protein, 9 aa, Tick-borne encephalitis virus
VAVGIAFHL

SEQ ID NO: 187079 - protein, 9 aa, Tick-borne encephalitis virus
AVGIAFHLE

SEQ ID NO: 187080 - protein, 9 aa, Tick-borne encephalitis virus
VGIAFHLEL

SEQ ID NO: 187081 - protein, 9 aa, Tick-borne encephalitis virus
GIAFHLELG

SEQ ID NO: 187082 - protein, 9 aa, Tick-borne encephalitis virus
IAFHLELGP

SEQ ID NO: 187083 - protein, 9 aa, Tick-borne encephalitis virus
TFHFELGPE

SEQ ID NO: 187084 - protein, 9 aa, Tick-borne encephalitis virus
LSAFALRRG

SEQ ID NO: 187085 - protein, 9 aa, Tick-borne encephalitis virus
SAFALRRGL

SEQ ID NO: 187086 - protein, 9 aa, Tick-borne encephalitis virus
AFALRRGLT

SEQ ID NO: 187087 - protein, 9 aa, Tick-borne encephalitis virus
FALRRGLTV

SEQ ID NO: 187088 - protein, 9 aa, Tick-borne encephalitis virus
ALRRGLTVR

SEQ ID NO: 187089 - protein, 9 aa, Tick-borne encephalitis virus
LRRGLTVRE

SEQ ID NO: 187090 - protein, 9 aa, Tick-borne encephalitis virus
RRGLTVREM

SEQ ID NO: 187091 - protein, 9 aa, Tick-borne encephalitis virus
RGLTVREMV

SEQ ID NO: 187092 - protein, 9 aa, Tick-borne encephalitis virus
GLTVREMVT

SEQ ID NO: 187093 - protein, 9 aa, Tick-borne encephalitis virus
LTVREMVIT

SEQ ID NO: 187094 - protein, 9 aa, Tick-borne encephalitis virus
TVREMVITY

SEQ ID NO: 187095 - protein, 9 aa, Tick-borne encephalitis virus
VREMVITYF

SEQ ID NO: 187096 - protein, 9 aa, Tick-borne encephalitis virus
REMVITYFL

SEQ ID NO: 187097 - protein, 9 aa, Tick-borne encephalitis virus
EMVITYFLL

SEQ ID NO: 187098 - protein, 9 aa, Tick-borne encephalitis virus
MVITYFLLL

SEQ ID NO: 187099 - protein, 9 aa, Tick-borne encephalitis virus
VITYFLLLV

SEQ ID NO: 187100 - protein, 9 aa, Tick-borne encephalitis virus
ITYFLLLVL

SEQ ID NO: 187101 - protein, 9 aa, Tick-borne encephalitis virus
LVLELGLPY

SEQ ID NO: 187102 - protein, 9 aa, Tick-borne encephalitis virus
LWRWGDALA

SEQ ID NO: 187103 - protein, 9 aa, Tick-borne encephalitis virus
ILRACTAEG

SEQ ID NO: 187104 - protein, 9 aa, Tick-borne encephalitis virus
LRACTAEGK

SEQ ID NO: 187105 - protein, 9 aa, Tick-borne encephalitis virus
RACTAEGKA

SEQ ID NO: 187106 - protein, 9 aa, Tick-borne encephalitis virus
ACTAEGKAG

SEQ ID NO: 187107 - protein, 9 aa, Tick-borne encephalitis virus
CTAEGKTGV

SEQ ID NO: 187108 - protein, 9 aa, Tick-borne encephalitis virus
TAEGKAGVG

SEQ ID NO: 187109 - protein, 9 aa, Tick-borne encephalitis virus
AEGKAGVGL

SEQ ID NO: 187110 - protein, 9 aa, Tick-borne encephalitis virus
EGKAGVGLL

SEQ ID NO: 187111 - protein, 9 aa, Tick-borne encephalitis virus
GKAGVGLLL

SEQ ID NO: 187112 - protein, 9 aa, Tick-borne encephalitis virus
KAGVGLLLM

SEQ ID NO: 187113 - protein, 9 aa, Tick-borne encephalitis virus
AGVGLLLMA

SEQ ID NO: 187114 - protein, 9 aa, Tick-borne encephalitis virus
GVGLLLMPL

SEQ ID NO: 187115 - protein, 9 aa, Tick-borne encephalitis virus
VGLLLMALI

SEQ ID NO: 187116 - protein, 9 aa, Tick-borne encephalitis virus
GLLLMPLLT

SEQ ID NO: 187117 - protein, 9 aa, Tick-borne encephalitis virus
LLLMALITQ

SEQ ID NO: 187118 - protein, 9 aa, Tick-borne encephalitis virus
LLMALITQQ

SEQ ID NO: 187119 - protein, 9 aa, Tick-borne encephalitis virus
LMALITQQD

SEQ ID NO: 187120 - protein, 9 aa, Tick-borne encephalitis virus
VHYGLIIFL

SEQ ID NO: 187121 - protein, 9 aa, Tick-borne encephalitis virus
HYGLIIFLG

SEQ ID NO: 187122 - protein, 9 aa, Tick-borne encephalitis virus
WRLLKGHRE

SEQ ID NO: 187123 - protein, 9 aa, Tick-borne encephalitis virus
RLLKGHREQ

SEQ ID NO: 187124 - protein, 9 aa, Tick-borne encephalitis virus
LLRGHREQK

SEQ ID NO: 187125 - protein, 9 aa, Tick-borne encephalitis virus
LRGHREQKG

SEQ ID NO: 187126 - protein, 9 aa, Tick-borne encephalitis virus
EGHREQKGL

SEQ ID NO: 187127 - protein, 9 aa, Tick-borne encephalitis virus
REQKGLSWI

SEQ ID NO: 187128 - protein, 9 aa, Tick-borne encephalitis virus
EQKGLTWVV

SEQ ID NO: 187129 - protein, 9 aa, Tick-borne encephalitis virus
QKGLSWIVP

SEQ ID NO: 187130 - protein, 9 aa, Tick-borne encephalitis virus
KGLSWIVPL

SEQ ID NO: 187131 - protein, 9 aa, Tick-borne encephalitis virus
GLSWIVPLA

SEQ ID NO: 187132 - protein, 9 aa, Tick-borne encephalitis virus
VPLAGLMGG

SEQ ID NO: 187133 - protein, 9 aa, Tick-borne encephalitis virus
PLAGLMGGE

SEQ ID NO: 187134 - protein, 9 aa, Tick-borne encephalitis virus
LAGLMGGEG

SEQ ID NO: 187135 - protein, 9 aa, Tick-borne encephalitis virus
AGLMGGEGS

SEQ ID NO: 187136 - protein, 9 aa, Tick-borne encephalitis virus
GLMGGEGSG

SEQ ID NO: 187137 - protein, 9 aa, Tick-borne encephalitis virus
LMGGEGSGI

SEQ ID NO: 187138 - protein, 9 aa, Tick-borne encephalitis virus
MGGEGSGIR

SEQ ID NO: 187139 - protein, 9 aa, Tick-borne encephalitis virus
EGSGIRLLS

SEQ ID NO: 187140 - protein, 9 aa, Tick-borne encephalitis virus
GSGIRLLSF

SEQ ID NO: 187141 - protein, 9 aa, Tick-borne encephalitis virus
SGIRLLSFW

SEQ ID NO: 187142 - protein, 9 aa, Tick-borne encephalitis virus
GIRLLSFWE

SEQ ID NO: 187143 - protein, 9 aa, Tick-borne encephalitis virus
IRLLSFWEL

SEQ ID NO: 187144 - protein, 9 aa, Tick-borne encephalitis virus
RLLSFWELS

SEQ ID NO: 187145 - protein, 9 aa, Tick-borne encephalitis virus
HGKRRSFSE

SEQ ID NO: 187146 - protein, 9 aa, Tick-borne encephalitis virus
GKRRSFSEP

SEQ ID NO: 187147 - protein, 9 aa, Tick-borne encephalitis virus
KRRSFSEPL

SEQ ID NO: 187148 - protein, 9 aa, Tick-borne encephalitis virus
ASGMMRHTP

SEQ ID NO: 187149 - protein, 9 aa, Tick-borne encephalitis virus
SGMMRHTPQ

SEQ ID NO: 187150 - protein, 9 aa, Tick-borne encephalitis virus
CVEWYPELV

SEQ ID NO: 187151 - protein, 9 aa, Tick-borne encephalitis virus
VEWYPELVN

SEQ ID NO: 187152 - protein, 9 aa, Tick-borne encephalitis virus
EWYPELVNE

SEQ ID NO: 187153 - protein, 9 aa, Tick-borne encephalitis virus
WYPELVNEG

SEQ ID NO: 187154 - protein, 9 aa, Tick-borne encephalitis virus
YPELVNEGG

SEQ ID NO: 187155 - protein, 9 aa, Tick-borne encephalitis virus
ERMMAFWLI

SEQ ID NO: 187156 - protein, 9 aa, Tick-borne encephalitis virus
RMMAFWLIA

SEQ ID NO: 187157 - protein, 9 aa, Tick-borne encephalitis virus
MMAFWLIAG

SEQ ID NO: 187158 - protein, 9 aa, Tick-borne encephalitis virus
AFWLLAGLS

SEQ ID NO: 187159 - protein, 9 aa, Tick-borne encephalitis virus
FWLLAGLSA

SEQ ID NO: 187160 - protein, 9 aa, Tick-borne encephalitis virus
WLLAGLSAS

SEQ ID NO: 187161 - protein, 9 aa, Tick-borne encephalitis virus
LLAGLSASA

SEQ ID NO: 187162 - protein, 9 aa, Tick-borne encephalitis virus
AGLAASAVH

SEQ ID NO: 187163 - protein, 9 aa, Tick-borne encephalitis virus
GLAASAVHW

SEQ ID NO: 187164 - protein, 9 aa, Tick-borne encephalitis virus
LAASAVHWS

SEQ ID NO: 187165 - protein, 9 aa, Tick-borne encephalitis virus
AASAVHWSG

SEQ ID NO: 187166 - protein, 9 aa, Tick-borne encephalitis virus
ASAVHWSGI

SEQ ID NO: 187167 - protein, 9 aa, Tick-borne encephalitis virus
SAIHWSGIL

SEQ ID NO: 187168 - protein, 9 aa, Tick-borne encephalitis virus
AVHWSGILG

SEQ ID NO: 187169 - protein, 9 aa, Tick-borne encephalitis virus
IHWSGILGV

SEQ ID NO: 187170 - protein, 9 aa, Tick-borne encephalitis virus
VMGLWTLTK

SEQ ID NO: 187171 - protein, 9 aa, Tick-borne encephalitis virus
MGLWTLTKM

SEQ ID NO: 187172 - protein, 9 aa, Tick-borne encephalitis virus
GLWTLSEMM

SEQ ID NO: 187173 - protein, 9 aa, Tick-borne encephalitis virus
LWTLSEMMR

SEQ ID NO: 187174 - protein, 9 aa, Tick-borne encephalitis virus
ARRSGLVFS

SEQ ID NO: 187175 - protein, 9 aa, Tick-borne encephalitis virus
RRSDLAFSG

SEQ ID NO: 187176 - protein, 9 aa, Tick-borne encephalitis virus
RSGLVFSGQ

SEQ ID NO: 187177 - protein, 9 aa, Tick-borne encephalitis virus
SDLAFSGQG

SEQ ID NO: 187178 - protein, 9 aa, Tick-borne encephalitis virus
GLVFSGQGG

SEQ ID NO: 187179 - protein, 9 aa, Tick-borne encephalitis virus
LVFSGQGRG

SEQ ID NO: 187180 - protein, 9 aa, Tick-borne encephalitis virus
VFSGQGNRE

SEQ ID NO: 187181 - protein, 9 aa, Tick-borne encephalitis virus
FSGQGRGER

SEQ ID NO: 187182 - protein, 9 aa, Tick-borne encephalitis virus
SGQGRGERG

SEQ ID NO: 187183 - protein, 9 aa, Tick-borne encephalitis virus
GQGRGERGD

SEQ ID NO: 187184 - protein, 9 aa, Tick-borne encephalitis virus
QGNRERGDR

SEQ ID NO: 187185 - protein, 9 aa, Tick-borne encephalitis virus
GRGERGDKP

SEQ ID NO: 187186 - protein, 9 aa, Tick-borne encephalitis virus
RGERGDKPF

SEQ ID NO: 187187 - protein, 9 aa, Tick-borne encephalitis virus
GERGDKPFE

SEQ ID NO: 187188 - protein, 9 aa, Tick-borne encephalitis virus
RGDRPFEVR

SEQ ID NO: 187189 - protein, 9 aa, Tick-borne encephalitis virus
GDRPFEVRD

SEQ ID NO: 187190 - protein, 9 aa, Tick-borne encephalitis virus
DRPFEVRDG

SEQ ID NO: 187191 - protein, 9 aa, Tick-borne encephalitis virus
RPFEVRDGV

SEQ ID NO: 187192 - protein, 9 aa, Tick-borne encephalitis virus
SPGLFWGQR

SEQ ID NO: 187193 - protein, 9 aa, Tick-borne encephalitis virus
PGLFWGQRQ

SEQ ID NO: 187194 - protein, 9 aa, Tick-borne encephalitis virus
GLFWGQSQV

SEQ ID NO: 187195 - protein, 9 aa, Tick-borne encephalitis virus
LFWGQSQVG

SEQ ID NO: 187196 - protein, 9 aa, Tick-borne encephalitis virus
FWGQRQVGV

SEQ ID NO: 187197 - protein, 9 aa, Tick-borne encephalitis virus
WGQSQVGVG

SEQ ID NO: 187198 - protein, 9 aa, Tick-borne encephalitis virus
GQSQVGVGY

SEQ ID NO: 187199 - protein, 9 aa, Tick-borne encephalitis virus
QSQVGVGYG

SEQ ID NO: 187200 - protein, 9 aa, Tick-borne encephalitis virus
NQVGVGYGS

SEQ ID NO: 187201 - protein, 9 aa, Tick-borne encephalitis virus
QVGVGYGFR

SEQ ID NO: 187202 - protein, 9 aa, Tick-borne encephalitis virus
VGVGYGFRG

SEQ ID NO: 187203 - protein, 9 aa, Tick-borne encephalitis virus
GVGYGFRGV

SEQ ID NO: 187204 - protein, 9 aa, Tick-borne encephalitis virus
VGYGFRGVL

SEQ ID NO: 187205 - protein, 9 aa, Tick-borne encephalitis virus
GYGFRGVLH

SEQ ID NO: 187206 - protein, 9 aa, Tick-borne encephalitis virus
YGFRGVLHT

SEQ ID NO: 187207 - protein, 9 aa, Tick-borne encephalitis virus
GFRGVLHTM

SEQ ID NO: 187208 - protein, 9 aa, Tick-borne encephalitis virus
FRGVLHTMW

SEQ ID NO: 187209 - protein, 9 aa, Tick-borne encephalitis virus
VTRGAALSV

SEQ ID NO: 187210 - protein, 9 aa, Tick-borne encephalitis virus
TRGAALSVD

SEQ ID NO: 187211 - protein, 9 aa, Tick-borne encephalitis virus
RGAALSVDD

SEQ ID NO: 187212 - protein, 9 aa, Tick-borne encephalitis virus
GAALYIDDA

SEQ ID NO: 187213 - protein, 9 aa, Tick-borne encephalitis virus
AALSVDDAV

SEQ ID NO: 187214 - protein, 9 aa, Tick-borne encephalitis virus
ALSIDDAVV

SEQ ID NO: 187215 - protein, 9 aa, Tick-borne encephalitis virus
LSVDDAVVG

SEQ ID NO: 187216 - protein, 9 aa, Tick-borne encephalitis virus
YIDDAVAGP

SEQ ID NO: 187217 - protein, 9 aa, Tick-borne encephalitis virus
VDDAVVGPY

SEQ ID NO: 187218 - protein, 9 aa, Tick-borne encephalitis virus
DDAVVGPYW

SEQ ID NO: 187219 - protein, 9 aa, Tick-borne encephalitis virus
DAVAGPYWS

SEQ ID NO: 187220 - protein, 9 aa, Tick-borne encephalitis virus
AVAGPYWSD

SEQ ID NO: 187221 - protein, 9 aa, Tick-borne encephalitis virus
VAGPYWAEV

SEQ ID NO: 187222 - protein, 9 aa, Tick-borne encephalitis virus
VGPYWADVK

SEQ ID NO: 187223 - protein, 9 aa, Tick-borne encephalitis virus
GPYWAEVKE

SEQ ID NO: 187224 - protein, 9 aa, Tick-borne encephalitis virus
PYWSDVRED

SEQ ID NO: 187225 - protein, 9 aa, Tick-borne encephalitis virus
YWSDVREDV

SEQ ID NO: 187226 - protein, 9 aa, Tick-borne encephalitis virus
WSDVREDVV

SEQ ID NO: 187227 - protein, 9 aa, Tick-borne encephalitis virus
SDVREDVVC

SEQ ID NO: 187228 - protein, 9 aa, Tick-borne encephalitis virus
EVKEDVVCY

SEQ ID NO: 187229 - protein, 9 aa, Tick-borne encephalitis virus
TWSLEEKWK

SEQ ID NO: 187230 - protein, 9 aa, Tick-borne encephalitis virus
GELLLDTGG

SEQ ID NO: 187231 - protein, 9 aa, Tick-borne encephalitis virus
ELLLDTGGR

SEQ ID NO: 187232 - protein, 9 aa, Tick-borne encephalitis virus
GAIPIDLAK

SEQ ID NO: 187233 - protein, 9 aa, Tick-borne encephalitis virus
AIPIDLAKG

SEQ ID NO: 187234 - protein, 9 aa, Tick-borne encephalitis virus
IPIDLAKGT

SEQ ID NO: 187235 - protein, 9 aa, Tick-borne encephalitis virus
LIDLSKGTS

SEQ ID NO: 187236 - protein, 9 aa, Tick-borne encephalitis virus
IDLSKGTSR

SEQ ID NO: 187237 - protein, 9 aa, Tick-borne encephalitis virus
DLSKGTSRS

SEQ ID NO: 187238 - protein, 9 aa, Tick-borne encephalitis virus
LSKGTSRSP

SEQ ID NO: 187239 - protein, 9 aa, Tick-borne encephalitis virus
SKGTSRSPI

SEQ ID NO: 187240 - protein, 9 aa, Tick-borne encephalitis virus
KGTSGSPII

SEQ ID NO: 187241 - protein, 9 aa, Tick-borne encephalitis virus
GTSRSPILN

SEQ ID NO: 187242 - protein, 9 aa, Tick-borne encephalitis virus
TSGSPIINS

SEQ ID NO: 187243 - protein, 9 aa, Tick-borne encephalitis virus
SGSPTLNSQ

SEQ ID NO: 187244 - protein, 9 aa, Tick-borne encephalitis virus
GSPTLNSQG

SEQ ID NO: 187245 - protein, 9 aa, Tick-borne encephalitis virus
SPILNAQGA

SEQ ID NO: 187246 - protein, 9 aa, Tick-borne encephalitis virus
PILNAQGAV

SEQ ID NO: 187247 - protein, 9 aa, Tick-borne encephalitis virus
ILNAQGAVV

SEQ ID NO: 187248 - protein, 9 aa, Tick-borne encephalitis virus
LNAQGAVVG

SEQ ID NO: 187249 - protein, 9 aa, Tick-borne encephalitis virus
NAQGAVVGL

SEQ ID NO: 187250 - protein, 9 aa, Tick-borne encephalitis virus
AQGAVVGLY

SEQ ID NO: 187251 - protein, 9 aa, Tick-borne encephalitis virus
SIAQGEAER

SEQ ID NO: 187252 - protein, 9 aa, Tick-borne encephalitis virus
IAQGEAERS

SEQ ID NO: 187253 - protein, 9 aa, Tick-borne encephalitis virus
AQGEAERSR

SEQ ID NO: 187254 - protein, 9 aa, Tick-borne encephalitis virus
QGEAERSRP

SEQ ID NO: 187255 - protein, 9 aa, Tick-borne encephalitis virus
GEAEKSRPS

SEQ ID NO: 187256 - protein, 9 aa, Tick-borne encephalitis virus
EAERSRPNL

SEQ ID NO: 187257 - protein, 9 aa, Tick-borne encephalitis virus
AERSRPNLP

SEQ ID NO: 187258 - protein, 9 aa, Tick-borne encephalitis virus
EKSRPSLPP

SEQ ID NO: 187259 - protein, 9 aa, Tick-borne encephalitis virus
RSRPNLPQA

SEQ ID NO: 187260 - protein, 9 aa, Tick-borne encephalitis virus
SRPSLPPAV

SEQ ID NO: 187261 - protein, 9 aa, Tick-borne encephalitis virus
GMGWTAKGQ

SEQ ID NO: 187262 - protein, 9 aa, Tick-borne encephalitis virus
MGWTAKGQI

SEQ ID NO: 187263 - protein, 9 aa, Tick-borne encephalitis virus
LKEMERALT

SEQ ID NO: 187264 - protein, 9 aa, Tick-borne encephalitis virus
KEMERALTG

SEQ ID NO: 187265 - protein, 9 aa, Tick-borne encephalitis virus
EMERALTGK

SEQ ID NO: 187266 - protein, 9 aa, Tick-borne encephalitis virus
MERALTGKR

SEQ ID NO: 187267 - protein, 9 aa, Tick-borne encephalitis virus
ERALTGKRV

SEQ ID NO: 187268 - protein, 9 aa, Tick-borne encephalitis virus
RALTGKRVR

SEQ ID NO: 187269 - protein, 9 aa, Tick-borne encephalitis virus
ALTGKRVRF

SEQ ID NO: 187270 - protein, 9 aa, Tick-borne encephalitis virus
LTGKRVRFL

SEQ ID NO: 187271 - protein, 9 aa, Tick-borne encephalitis virus
TGKRVRFLS

SEQ ID NO: 187272 - protein, 9 aa, Tick-borne encephalitis virus
KRVRFHSPV

SEQ ID NO: 187273 - protein, 9 aa, Tick-borne encephalitis virus
RVRFHSPVV

SEQ ID NO: 187274 - protein, 9 aa, Tick-borne encephalitis virus
VRFLSPAVS

SEQ ID NO: 187275 - protein, 9 aa, Tick-borne encephalitis virus
RFLSPAVSD

SEQ ID NO: 187276 - protein, 9 aa, Tick-borne encephalitis virus
FHSPVVGDQ

SEQ ID NO: 187277 - protein, 9 aa, Tick-borne encephalitis virus
HSPAVGDHQ

SEQ ID NO: 187278 - protein, 9 aa, Tick-borne encephalitis virus
DQQVGGSIV

SEQ ID NO: 187279 - protein, 9 aa, Tick-borne encephalitis virus
QQVGGSIVD

SEQ ID NO: 187280 - protein, 9 aa, Tick-borne encephalitis virus
GGAIVDLMC

SEQ ID NO: 187281 - protein, 9 aa, Tick-borne encephalitis virus
GAIVDLMCH

SEQ ID NO: 187282 - protein, 9 aa, Tick-borne encephalitis virus
AIVDLMCHT

SEQ ID NO: 187283 - protein, 9 aa, Tick-borne encephalitis virus
VMCHATYVS

SEQ ID NO: 187284 - protein, 9 aa, Tick-borne encephalitis virus
MCHATYVSR

SEQ ID NO: 187285 - protein, 9 aa, Tick-borne encephalitis virus
CHATYVSRR

SEQ ID NO: 187286 - protein, 9 aa, Tick-borne encephalitis virus
HTTYVNRRL

SEQ ID NO: 187287 - protein, 9 aa, Tick-borne encephalitis virus
ATYVSRRLL

SEQ ID NO: 187288 - protein, 9 aa, Tick-borne encephalitis virus
FPESNRGIT

SEQ ID NO: 187289 - protein, 9 aa, Tick-borne encephalitis virus
PESNRGITS

SEQ ID NO: 187290 - protein, 9 aa, Tick-borne encephalitis virus
ESNRGITSE

SEQ ID NO: 187291 - protein, 9 aa, Tick-borne encephalitis virus
SNRGITSEV

SEQ ID NO: 187292 - protein, 9 aa, Tick-borne encephalitis virus
NGAITSEER

SEQ ID NO: 187293 - protein, 9 aa, Tick-borne encephalitis virus
GAITSEERQ

SEQ ID NO: 187294 - protein, 9 aa, Tick-borne encephalitis virus
AITSEERQI

SEQ ID NO: 187295 - protein, 9 aa, Tick-borne encephalitis virus
ITSEERQIP

SEQ ID NO: 187296 - protein, 9 aa, Tick-borne encephalitis virus
SEEKQIPEG

SEQ ID NO: 187297 - protein, 9 aa, Tick-borne encephalitis virus
EEKQIPEGE

SEQ ID NO: 187298 - protein, 9 aa, Tick-borne encephalitis virus
EKQIPEGEW

SEQ ID NO: 187299 - protein, 9 aa, Tick-borne encephalitis virus
KQIPEGEWR

SEQ ID NO: 187300 - protein, 9 aa, Tick-borne encephalitis virus
QIPNGEWRD

SEQ ID NO: 187301 - protein, 9 aa, Tick-borne encephalitis virus
IPNGEWRDG

SEQ ID NO: 187302 - protein, 9 aa, Tick-borne encephalitis virus
PNGEWRDGF

SEQ ID NO: 187303 - protein, 9 aa, Tick-borne encephalitis virus
NGEWRDGFD

SEQ ID NO: 187304 - protein, 9 aa, Tick-borne encephalitis virus
SAWFVPSIA

SEQ ID NO: 187305 - protein, 9 aa, Tick-borne encephalitis virus
VPSIAKGGV

SEQ ID NO: 187306 - protein, 9 aa, Tick-borne encephalitis virus
PSIAKGGVI

SEQ ID NO: 187307 - protein, 9 aa, Tick-borne encephalitis virus
SIAKGGVIA

SEQ ID NO: 187308 - protein, 9 aa, Tick-borne encephalitis virus
IAKGGVIAR

SEQ ID NO: 187309 - protein, 9 aa, Tick-borne encephalitis virus
AKGGVIART

SEQ ID NO: 187310 - protein, 9 aa, Tick-borne encephalitis virus
KGGVIARTL

SEQ ID NO: 187311 - protein, 9 aa, Tick-borne encephalitis virus
GGVIARTLR

SEQ ID NO: 187312 - protein, 9 aa, Tick-borne encephalitis virus
GVIARTLRQ

SEQ ID NO: 187313 - protein, 9 aa, Tick-borne encephalitis virus
VIARTLRQK

SEQ ID NO: 187314 - protein, 9 aa, Tick-borne encephalitis virus
EVDGRVELI

SEQ ID NO: 187315 - protein, 9 aa, Tick-borne encephalitis virus
VDGRVELIG

SEQ ID NO: 187316 - protein, 9 aa, Tick-borne encephalitis virus
DGRVELIGT

SEQ ID NO: 187317 - protein, 9 aa, Tick-borne encephalitis virus
GRVELIGTR

SEQ ID NO: 187318 - protein, 9 aa, Tick-borne encephalitis virus
RVELIGTRR

SEQ ID NO: 187319 - protein, 9 aa, Tick-borne encephalitis virus
PRRGRVGRQ

SEQ ID NO: 187320 - protein, 9 aa, Tick-borne encephalitis virus
RRGRVGRHE

SEQ ID NO: 187321 - protein, 9 aa, Tick-borne encephalitis virus
RGRVGRHEG

SEQ ID NO: 187322 - protein, 9 aa, Tick-borne encephalitis virus
GRVGRHEGR

SEQ ID NO: 187323 - protein, 9 aa, Tick-borne encephalitis virus
RVGRHEGRT

SEQ ID NO: 187324 - protein, 9 aa, Tick-borne encephalitis virus
VGRHEGRTD

SEQ ID NO: 187325 - protein, 9 aa, Tick-borne encephalitis virus
GRHEGRTDE

SEQ ID NO: 187326 - protein, 9 aa, Tick-borne encephalitis virus
RHEGRTDEY

SEQ ID NO: 187327 - protein, 9 aa, Tick-borne encephalitis virus
HEGRTDEYI

SEQ ID NO: 187328 - protein, 9 aa, Tick-borne encephalitis virus
EGRIDEYIY

SEQ ID NO: 187329 - protein, 9 aa, Tick-borne encephalitis virus
SGQCDDDDG

SEQ ID NO: 187330 - protein, 9 aa, Tick-borne encephalitis virus
GQCDEYDSG

SEQ ID NO: 187331 - protein, 9 aa, Tick-borne encephalitis virus
QCDDDDSVL

SEQ ID NO: 187332 - protein, 9 aa, Tick-borne encephalitis virus
CDDDDGGLV

SEQ ID NO: 187333 - protein, 9 aa, Tick-borne encephalitis virus
DDDDGGLVQ

SEQ ID NO: 187334 - protein, 9 aa, Tick-borne encephalitis virus
EYDSGLVQW

SEQ ID NO: 187335 - protein, 9 aa, Tick-borne encephalitis virus
DDSVLVQWK

SEQ ID NO: 187336 - protein, 9 aa, Tick-borne encephalitis virus
DSVLVQWKE

SEQ ID NO: 187337 - protein, 9 aa, Tick-borne encephalitis virus
SVLVQWKEA

SEQ ID NO: 187338 - protein, 9 aa, Tick-borne encephalitis virus
VLVQWKEAQ

SEQ ID NO: 187339 - protein, 9 aa, Tick-borne encephalitis virus
KEGQILLDN

SEQ ID NO: 187340 - protein, 9 aa, Tick-borne encephalitis virus
EGQILLDNI

SEQ ID NO: 187341 - protein, 9 aa, Tick-borne encephalitis virus
AQILLDNII

SEQ ID NO: 187342 - protein, 9 aa, Tick-borne encephalitis virus
QILLDDITT

SEQ ID NO: 187343 - protein, 9 aa, Tick-borne encephalitis virus
ILLDDITTL

SEQ ID NO: 187344 - protein, 9 aa, Tick-borne encephalitis virus
LLDNIITLR

SEQ ID NO: 187345 - protein, 9 aa, Tick-borne encephalitis virus
LDDITTLRG

SEQ ID NO: 187346 - protein, 9 aa, Tick-borne encephalitis virus
DNIITLRGP

SEQ ID NO: 187347 - protein, 9 aa, Tick-borne encephalitis virus
NIITLRGPV

SEQ ID NO: 187348 - protein, 9 aa, Tick-borne encephalitis virus
IITLRGPVA

SEQ ID NO: 187349 - protein, 9 aa, Tick-borne encephalitis virus
TTLRGPVVT

SEQ ID NO: 187350 - protein, 9 aa, Tick-borne encephalitis virus
KMPEVAGHY

SEQ ID NO: 187351 - protein, 9 aa, Tick-borne encephalitis virus
AANVSGVTS

SEQ ID NO: 187352 - protein, 9 aa, Tick-borne encephalitis virus
ANVSGVTSR

SEQ ID NO: 187353 - protein, 9 aa, Tick-borne encephalitis virus
NVSSVTSRS

SEQ ID NO: 187354 - protein, 9 aa, Tick-borne encephalitis virus
VSSVTSRSW

SEQ ID NO: 187355 - protein, 9 aa, Tick-borne encephalitis virus
SGVTSRNWT

SEQ ID NO: 187356 - protein, 9 aa, Tick-borne encephalitis virus
GVTSRNWTW

SEQ ID NO: 187357 - protein, 9 aa, Tick-borne encephalitis virus
VTSRSWTWE

SEQ ID NO: 187358 - protein, 9 aa, Tick-borne encephalitis virus
TSRSWTWEG

SEQ ID NO: 187359 - protein, 9 aa, Tick-borne encephalitis virus
SRSWTWEGP

SEQ ID NO: 187360 - protein, 9 aa, Tick-borne encephalitis virus
SWTWEGPEE

SEQ ID NO: 187361 - protein, 9 aa, Tick-borne encephalitis virus
TWEGPEANA

SEQ ID NO: 187362 - protein, 9 aa, Tick-borne encephalitis virus
WEGPEENAV

SEQ ID NO: 187363 - protein, 9 aa, Tick-borne encephalitis virus
EGPEANAVD

SEQ ID NO: 187364 - protein, 9 aa, Tick-borne encephalitis virus
GPEANAVDE

SEQ ID NO: 187365 - protein, 9 aa, Tick-borne encephalitis virus
PEANAVDEA

SEQ ID NO: 187366 - protein, 9 aa, Tick-borne encephalitis virus
EENAVDEAN

SEQ ID NO: 187367 - protein, 9 aa, Tick-borne encephalitis virus
ENAVDEANG

SEQ ID NO: 187368 - protein, 9 aa, Tick-borne encephalitis virus
NAVDEASGD

SEQ ID NO: 187369 - protein, 9 aa, Tick-borne encephalitis virus
AVDEASGDL

SEQ ID NO: 187370 - protein, 9 aa, Tick-borne encephalitis virus
VDEASGGLV

SEQ ID NO: 187371 - protein, 9 aa, Tick-borne encephalitis virus
DEASGGLVT

SEQ ID NO: 187372 - protein, 9 aa, Tick-borne encephalitis virus
EASGGLVTF

SEQ ID NO: 187373 - protein, 9 aa, Tick-borne encephalitis virus
ANGDLVTFK

SEQ ID NO: 187374 - protein, 9 aa, Tick-borne encephalitis virus
NGDLVTFKS

SEQ ID NO: 187375 - protein, 9 aa, Tick-borne encephalitis virus
GGLVTFRSP

SEQ ID NO: 187376 - protein, 9 aa, Tick-borne encephalitis virus
GLVTFRSPN

SEQ ID NO: 187377 - protein, 9 aa, Tick-borne encephalitis virus
ERTLKPVWR

SEQ ID NO: 187378 - protein, 9 aa, Tick-borne encephalitis virus
RTLKPVWRD

SEQ ID NO: 187379 - protein, 9 aa, Tick-borne encephalitis virus
TLKPVWRDA

SEQ ID NO: 187380 - protein, 9 aa, Tick-borne encephalitis virus
LKPVWRDAR

SEQ ID NO: 187381 - protein, 9 aa, Tick-borne encephalitis virus
KPVWRDARM

SEQ ID NO: 187382 - protein, 9 aa, Tick-borne encephalitis virus
EGRDIREFI

SEQ ID NO: 187383 - protein, 9 aa, Tick-borne encephalitis virus
GRDIREFIA

SEQ ID NO: 187384 - protein, 9 aa, Tick-borne encephalitis virus
RDIREFIAY

SEQ ID NO: 187385 - protein, 9 aa, Tick-borne encephalitis virus
DIREFIAYA

SEQ ID NO: 187386 - protein, 9 aa, Tick-borne encephalitis virus
IREFIAYAS

SEQ ID NO: 187387 - protein, 9 aa, Tick-borne encephalitis virus
REFIAYASG

SEQ ID NO: 187388 - protein, 9 aa, Tick-borne encephalitis virus
RRSIGDVLT

SEQ ID NO: 187389 - protein, 9 aa, Tick-borne encephalitis virus
RSIGDVLTG

SEQ ID NO: 187390 - protein, 9 aa, Tick-borne encephalitis virus
SIGDVLTGM

SEQ ID NO: 187391 - protein, 9 aa, Tick-borne encephalitis virus
IGDVLTGMS

SEQ ID NO: 187392 - protein, 9 aa, Tick-borne encephalitis virus
VFYTLMHDE

SEQ ID NO: 187393 - protein, 9 aa, Tick-borne encephalitis virus
FYTLMHDEP

SEQ ID NO: 187394 - protein, 9 aa, Tick-borne encephalitis virus
YTLMHEKPD

SEQ ID NO: 187395 - protein, 9 aa, Tick-borne encephalitis virus
TLMHDEPGS

SEQ ID NO: 187396 - protein, 9 aa, Tick-borne encephalitis virus
LMHDEPGSR

SEQ ID NO: 187397 - protein, 9 aa, Tick-borne encephalitis virus
MHEEPGSSA

SEQ ID NO: 187398 - protein, 9 aa, Tick-borne encephalitis virus
HDEPGSRAM

SEQ ID NO: 187399 - protein, 9 aa, Tick-borne encephalitis virus
DEPGSRAMK

SEQ ID NO: 187400 - protein, 9 aa, Tick-borne encephalitis virus
KPDSRAMRM

SEQ ID NO: 187401 - protein, 9 aa, Tick-borne encephalitis virus
PGSSAMRMA

SEQ ID NO: 187402 - protein, 9 aa, Tick-borne encephalitis virus
DSRAMRMAE

SEQ ID NO: 187403 - protein, 9 aa, Tick-borne encephalitis virus
SSAMRMAER

SEQ ID NO: 187404 - protein, 9 aa, Tick-borne encephalitis virus
SAMRMAERD

SEQ ID NO: 187405 - protein, 9 aa, Tick-borne encephalitis virus
DAPEAFLTL

SEQ ID NO: 187406 - protein, 9 aa, Tick-borne encephalitis virus
APEAFLTLV

SEQ ID NO: 187407 - protein, 9 aa, Tick-borne encephalitis virus
PEAFLTMAE

SEQ ID NO: 187408 - protein, 9 aa, Tick-borne encephalitis virus
VEVMVLGLA

SEQ ID NO: 187409 - protein, 9 aa, Tick-borne encephalitis virus
EMLVLGLAT

SEQ ID NO: 187410 - protein, 9 aa, Tick-borne encephalitis virus
MLVLGLATL

SEQ ID NO: 187411 - protein, 9 aa, Tick-borne encephalitis virus
LVLGLATLG

SEQ ID NO: 187412 - protein, 9 aa, Tick-borne encephalitis virus
LGLGTLGVV

SEQ ID NO: 187413 - protein, 9 aa, Tick-borne encephalitis virus
GLGTLGVVW

SEQ ID NO: 187414 - protein, 9 aa, Tick-borne encephalitis virus
LGTLGVVWC

SEQ ID NO: 187415 - protein, 9 aa, Tick-borne encephalitis virus
GTLGVVWCF

SEQ ID NO: 187416 - protein, 9 aa, Tick-borne encephalitis virus
LGVVWCFVA

SEQ ID NO: 187417 - protein, 9 aa, Tick-borne encephalitis virus
GVVWCFVAR

SEQ ID NO: 187418 - protein, 9 aa, Tick-borne encephalitis virus
VVWCFVART

SEQ ID NO: 187419 - protein, 9 aa, Tick-borne encephalitis virus
VWCFVVRAS

SEQ ID NO: 187420 - protein, 9 aa, Tick-borne encephalitis virus
WCFVVRASI

SEQ ID NO: 187421 - protein, 9 aa, Tick-borne encephalitis virus
CFVVRASIS

SEQ ID NO: 187422 - protein, 9 aa, Tick-borne encephalitis virus
FVVRASISR

SEQ ID NO: 187423 - protein, 9 aa, Tick-borne encephalitis virus
VARTSISRM

SEQ ID NO: 187424 - protein, 9 aa, Tick-borne encephalitis virus
VRASISRMM

SEQ ID NO: 187425 - protein, 9 aa, Tick-borne encephalitis virus
TLVLLASLV

SEQ ID NO: 187426 - protein, 9 aa, Tick-borne encephalitis virus
LVLLASLVL

SEQ ID NO: 187427 - protein, 9 aa, Tick-borne encephalitis virus
VLLASLVLL

SEQ ID NO: 187428 - protein, 9 aa, Tick-borne encephalitis virus
LLASLVLLW

SEQ ID NO: 187429 - protein, 9 aa, Tick-borne encephalitis virus
LASLVLLWA

SEQ ID NO: 187430 - protein, 9 aa, Tick-borne encephalitis virus
ASLVLLWAG

SEQ ID NO: 187431 - protein, 9 aa, Tick-borne encephalitis virus
SLVLLWAGG

SEQ ID NO: 187432 - protein, 9 aa, Tick-borne encephalitis virus
LVLLWAGGV

SEQ ID NO: 187433 - protein, 9 aa, Tick-borne encephalitis virus
ALLWAGGVG

SEQ ID NO: 187434 - protein, 9 aa, Tick-borne encephalitis virus
ANEMGLLER

SEQ ID NO: 187435 - protein, 9 aa, Tick-borne encephalitis virus
NEMGLLERT

SEQ ID NO: 187436 - protein, 9 aa, Tick-borne encephalitis virus
EMGLLERTK

SEQ ID NO: 187437 - protein, 9 aa, Tick-borne encephalitis virus
MGLLERTKA

SEQ ID NO: 187438 - protein, 9 aa, Tick-borne encephalitis virus
GLLERTKAD

SEQ ID NO: 187439 - protein, 9 aa, Tick-borne encephalitis virus
LLERTKADL

SEQ ID NO: 187440 - protein, 9 aa, Tick-borne encephalitis virus
EKTKADLSA

SEQ ID NO: 187441 - protein, 9 aa, Tick-borne encephalitis virus
KTKADLSTA

SEQ ID NO: 187442 - protein, 9 aa, Tick-borne encephalitis virus
TKADLSAVL

SEQ ID NO: 187443 - protein, 9 aa, Tick-borne encephalitis virus
KADLSAVLW

SEQ ID NO: 187444 - protein, 9 aa, Tick-borne encephalitis virus
ADLSTVLWA

SEQ ID NO: 187445 - protein, 9 aa, Tick-borne encephalitis virus
EPRSWGEWT

SEQ ID NO: 187446 - protein, 9 aa, Tick-borne encephalitis virus
PRSWGEWTN

SEQ ID NO: 187447 - protein, 9 aa, Tick-borne encephalitis virus
RSWGEWTNI

SEQ ID NO: 187448 - protein, 9 aa, Tick-borne encephalitis virus
SWGEWTNID

SEQ ID NO: 187449 - protein, 9 aa, Tick-borne encephalitis virus
WGEWTNIDI

SEQ ID NO: 187450 - protein, 9 aa, Tick-borne encephalitis virus
GEWTNIDIQ

SEQ ID NO: 187451 - protein, 9 aa, Tick-borne encephalitis virus
QLVNSAVVT

SEQ ID NO: 187452 - protein, 9 aa, Tick-borne encephalitis virus
LVNSAVVTG

SEQ ID NO: 187453 - protein, 9 aa, Tick-borne encephalitis virus
VNSAVVTGA

SEQ ID NO: 187454 - protein, 9 aa, Tick-borne encephalitis virus
NSAVVTGAQ

SEQ ID NO: 187455 - protein, 9 aa, Tick-borne encephalitis virus
SAVVTGAQA

SEQ ID NO: 187456 - protein, 9 aa, Tick-borne encephalitis virus
AVVTGAQAM

SEQ ID NO: 187457 - protein, 9 aa, Tick-borne encephalitis virus
VVTGAQAMR

SEQ ID NO: 187458 - protein, 9 aa, Tick-borne encephalitis virus
VTGAQAMRD

SEQ ID NO: 187459 - protein, 9 aa, Tick-borne encephalitis virus
DLGGGAPFL

SEQ ID NO: 187460 - protein, 9 aa, Tick-borne encephalitis virus
LGGGAPFLG

SEQ ID NO: 187461 - protein, 9 aa, Tick-borne encephalitis virus
GGGAPFIGV

SEQ ID NO: 187462 - protein, 9 aa, Tick-borne encephalitis virus
GGAPFIGVA

SEQ ID NO: 187463 - protein, 9 aa, Tick-borne encephalitis virus
GAPFFGIAG

SEQ ID NO: 187464 - protein, 9 aa, Tick-borne encephalitis virus
APFIGVAGH

SEQ ID NO: 187465 - protein, 9 aa, Tick-borne encephalitis virus
PFFGIAGHV

SEQ ID NO: 187466 - protein, 9 aa, Tick-borne encephalitis virus
FFGIAGHVM

SEQ ID NO: 187467 - protein, 9 aa, Tick-borne encephalitis virus
GVAGHVVAL

SEQ ID NO: 187468 - protein, 9 aa, Tick-borne encephalitis virus
VAGHVVALG

SEQ ID NO: 187469 - protein, 9 aa, Tick-borne encephalitis virus
AGHVVALGV

SEQ ID NO: 187470 - protein, 9 aa, Tick-borne encephalitis virus
GHVVALGVV

SEQ ID NO: 187471 - protein, 9 aa, Tick-borne encephalitis virus
HVVALGVVS

SEQ ID NO: 187472 - protein, 9 aa, Tick-borne encephalitis virus
VVALGVVSL

SEQ ID NO: 187473 - protein, 9 aa, Tick-borne encephalitis virus
VALGVVSLV

SEQ ID NO: 187474 - protein, 9 aa, Tick-borne encephalitis virus
SLGVVSLVG

SEQ ID NO: 187475 - protein, 9 aa, Tick-borne encephalitis virus
MVGVGLAAF

SEQ ID NO: 187476 - protein, 9 aa, Tick-borne encephalitis virus
IYPFGEGET

SEQ ID NO: 187477 - protein, 9 aa, Tick-borne encephalitis virus
YPFGEGETK

SEQ ID NO: 187478 - protein, 9 aa, Tick-borne encephalitis virus
AKPALYERR

SEQ ID NO: 187479 - protein, 9 aa, Tick-borne encephalitis virus
RKMSLVLAT

SEQ ID NO: 187480 - protein, 9 aa, Tick-borne encephalitis virus
MSLVLAVVL

SEQ ID NO: 187481 - protein, 9 aa, Tick-borne encephalitis virus
SLVLAVVLC

SEQ ID NO: 187482 - protein, 9 aa, Tick-borne encephalitis virus
LVLAVVLCL

SEQ ID NO: 187483 - protein, 9 aa, Tick-borne encephalitis virus
VLCLMAVVM

SEQ ID NO: 187484 - protein, 9 aa, Tick-borne encephalitis virus
LCLISVVMN

SEQ ID NO: 187485 - protein, 9 aa, Tick-borne encephalitis virus
CLISVVMNR

SEQ ID NO: 187486 - protein, 9 aa, Tick-borne encephalitis virus
LISVVMNRT

SEQ ID NO: 187487 - protein, 9 aa, Tick-borne encephalitis virus
ISVVMNRTV

SEQ ID NO: 187488 - protein, 9 aa, Tick-borne encephalitis virus
AVVMNRTVA

SEQ ID NO: 187489 - protein, 9 aa, Tick-borne encephalitis virus
VVMNRTVLS

SEQ ID NO: 187490 - protein, 9 aa, Tick-borne encephalitis virus
VMNRTVLSI

SEQ ID NO: 187491 - protein, 9 aa, Tick-borne encephalitis virus
MNRTVLSIT

SEQ ID NO: 187492 - protein, 9 aa, Tick-borne encephalitis virus
NRTMASITE

SEQ ID NO: 187493 - protein, 9 aa, Tick-borne encephalitis virus
RTMASITEA

SEQ ID NO: 187494 - protein, 9 aa, Tick-borne encephalitis virus
TVLSITEAS

SEQ ID NO: 187495 - protein, 9 aa, Tick-borne encephalitis virus
VPSITEAAA

SEQ ID NO: 187496 - protein, 9 aa, Tick-borne encephalitis virus
PSITEAAAV

SEQ ID NO: 187497 - protein, 9 aa, Tick-borne encephalitis virus
AAAVGLAAA

SEQ ID NO: 187498 - protein, 9 aa, Tick-borne encephalitis virus
AAVGLAAAG

SEQ ID NO: 187499 - protein, 9 aa, Tick-borne encephalitis virus
AVGLAALGQ

SEQ ID NO: 187500 - protein, 9 aa, Tick-borne encephalitis virus
VGLAALGQL

SEQ ID NO: 187501 - protein, 9 aa, Tick-borne encephalitis virus
GLAALGQLL

SEQ ID NO: 187502 - protein, 9 aa, Tick-borne encephalitis virus
LAAAGQLLS

SEQ ID NO: 187503 - protein, 9 aa, Tick-borne encephalitis virus
AAAGQLLSP

SEQ ID NO: 187504 - protein, 9 aa, Tick-borne encephalitis virus
AAGQLLSPE

SEQ ID NO: 187505 - protein, 9 aa, Tick-borne encephalitis virus
GQLLSPEAD

SEQ ID NO: 187506 - protein, 9 aa, Tick-borne encephalitis virus
QLLSPEADT

SEQ ID NO: 187507 - protein, 9 aa, Tick-borne encephalitis virus
LLSPEADTL

SEQ ID NO: 187508 - protein, 9 aa, Tick-borne encephalitis virus
LSPEADTLW

SEQ ID NO: 187509 - protein, 9 aa, Tick-borne encephalitis virus
SPEADTLWT

SEQ ID NO: 187510 - protein, 9 aa, Tick-borne encephalitis virus
PEEDTLWTM

SEQ ID NO: 187511 - protein, 9 aa, Tick-borne encephalitis virus
EEDTLWTMP

SEQ ID NO: 187512 - protein, 9 aa, Tick-borne encephalitis virus
EDTLWTMPV

SEQ ID NO: 187513 - protein, 9 aa, Tick-borne encephalitis virus
MPVACGLSS

SEQ ID NO: 187514 - protein, 9 aa, Tick-borne encephalitis virus
PVACGLSSV

SEQ ID NO: 187515 - protein, 9 aa, Tick-borne encephalitis virus
VACGLSSVV

SEQ ID NO: 187516 - protein, 9 aa, Tick-borne encephalitis virus
ACGLSSVVR

SEQ ID NO: 187517 - protein, 9 aa, Tick-borne encephalitis virus
CGLSSVVRG

SEQ ID NO: 187518 - protein, 9 aa, Tick-borne encephalitis virus
GLSSVVRGS

SEQ ID NO: 187519 - protein, 9 aa, Tick-borne encephalitis virus
LSSVVRGSL

SEQ ID NO: 187520 - protein, 9 aa, Tick-borne encephalitis virus
SGVVTGSLW

SEQ ID NO: 187521 - protein, 9 aa, Tick-borne encephalitis virus
GVVTGSLWG

SEQ ID NO: 187522 - protein, 9 aa, Tick-borne encephalitis virus
ASGSRRGGA

SEQ ID NO: 187523 - protein, 9 aa, Tick-borne encephalitis virus
SGSRRGGAE

SEQ ID NO: 187524 - protein, 9 aa, Tick-borne encephalitis virus
GSRRGGAEG

SEQ ID NO: 187525 - protein, 9 aa, Tick-borne encephalitis virus
SRRGGAEGD

SEQ ID NO: 187526 - protein, 9 aa, Tick-borne encephalitis virus
RRGGSDGDT

SEQ ID NO: 187527 - protein, 9 aa, Tick-borne encephalitis virus
RGGSDGDTL

SEQ ID NO: 187528 - protein, 9 aa, Tick-borne encephalitis virus
GGSDGDTLG

SEQ ID NO: 187529 - protein, 9 aa, Tick-borne encephalitis virus
GSDGDTLGD

SEQ ID NO: 187530 - protein, 9 aa, Tick-borne encephalitis virus
SDGDTLGDL

SEQ ID NO: 187531 - protein, 9 aa, Tick-borne encephalitis virus
TLGDLWKQR

SEQ ID NO: 187532 - protein, 9 aa, Tick-borne encephalitis virus
LGDLWKQRL

SEQ ID NO: 187533 - protein, 9 aa, Tick-borne encephalitis virus
GDLWKQRLN

SEQ ID NO: 187534 - protein, 9 aa, Tick-borne encephalitis virus
LNSCTKEEF

SEQ ID NO: 187535 - protein, 9 aa, Tick-borne encephalitis virus
NSCTKEEFF

SEQ ID NO: 187536 - protein, 9 aa, Tick-borne encephalitis virus
SCTKEEFFV

SEQ ID NO: 187537 - protein, 9 aa, Tick-borne encephalitis virus
CTKEEFFVY

SEQ ID NO: 187538 - protein, 9 aa, Tick-borne encephalitis virus
TKEEFFVYR

SEQ ID NO: 187539 - protein, 9 aa, Tick-borne encephalitis virus
KEEFFVYRR

SEQ ID NO: 187540 - protein, 9 aa, Tick-borne encephalitis virus
EEFFIYRRT

SEQ ID NO: 187541 - protein, 9 aa, Tick-borne encephalitis virus
EFFIYRRTG

SEQ ID NO: 187542 - protein, 9 aa, Tick-borne encephalitis virus
FFVYRRAGI

SEQ ID NO: 187543 - protein, 9 aa, Tick-borne encephalitis virus
FVYRRAGIL

SEQ ID NO: 187544 - protein, 9 aa, Tick-borne encephalitis virus
IYRRTGILE

SEQ ID NO: 187545 - protein, 9 aa, Tick-borne encephalitis virus
YRRAGILET

SEQ ID NO: 187546 - protein, 9 aa, Tick-borne encephalitis virus
RRTGIMETE

SEQ ID NO: 187547 - protein, 9 aa, Tick-borne encephalitis virus
RAGILETER

SEQ ID NO: 187548 - protein, 9 aa, Tick-borne encephalitis virus
AGILETERD

SEQ ID NO: 187549 - protein, 9 aa, Tick-borne encephalitis virus
GIMETERDK

SEQ ID NO: 187550 - protein, 9 aa, Tick-borne encephalitis virus
ILETERDRA

SEQ ID NO: 187551 - protein, 9 aa, Tick-borne encephalitis virus
METERDKAR

SEQ ID NO: 187552 - protein, 9 aa, Tick-borne encephalitis virus
RDRARELLR

SEQ ID NO: 187553 - protein, 9 aa, Tick-borne encephalitis virus
DKARELLKR

SEQ ID NO: 187554 - protein, 9 aa, Tick-borne encephalitis virus
KARELLKKG

SEQ ID NO: 187555 - protein, 9 aa, Tick-borne encephalitis virus
ARELLKKGE

SEQ ID NO: 187556 - protein, 9 aa, Tick-borne encephalitis virus
RELLKRGET

SEQ ID NO: 187557 - protein, 9 aa, Tick-borne encephalitis virus
ELLKRGETN

SEQ ID NO: 187558 - protein, 9 aa, Tick-borne encephalitis virus
KGETNMGLA

SEQ ID NO: 187559 - protein, 9 aa, Tick-borne encephalitis virus
GETNVGLAV

SEQ ID NO: 187560 - protein, 9 aa, Tick-borne encephalitis virus
ETNVGLAVS

SEQ ID NO: 187561 - protein, 9 aa, Tick-borne encephalitis virus
TNVGLAVSR

SEQ ID NO: 187562 - protein, 9 aa, Tick-borne encephalitis virus
NVGLAVSRG

SEQ ID NO: 187563 - protein, 9 aa, Tick-borne encephalitis virus
VGLAVSRGT

SEQ ID NO: 187564 - protein, 9 aa, Tick-borne encephalitis virus
AASRPAVMN

SEQ ID NO: 187565 - protein, 9 aa, Tick-borne encephalitis virus
ASRPSVMSV

SEQ ID NO: 187566 - protein, 9 aa, Tick-borne encephalitis virus
SRPSVMSVK

SEQ ID NO: 187567 - protein, 9 aa, Tick-borne encephalitis virus
RPSVMSVKA

SEQ ID NO: 187568 - protein, 9 aa, Tick-borne encephalitis virus
PSVMSVKAY

SEQ ID NO: 187569 - protein, 9 aa, Tick-borne encephalitis virus
SVMSVKAYT

SEQ ID NO: 187570 - protein, 9 aa, Tick-borne encephalitis virus
VMNVRAYTI

SEQ ID NO: 187571 - protein, 9 aa, Tick-borne encephalitis virus
MNVRAYTIG

SEQ ID NO: 187572 - protein, 9 aa, Tick-borne encephalitis virus
NVRAYTIGG

SEQ ID NO: 187573 - protein, 9 aa, Tick-borne encephalitis virus
VRAYTIGGK

SEQ ID NO: 187574 - protein, 9 aa, Tick-borne encephalitis virus
RAYTIGGKG

SEQ ID NO: 187575 - protein, 9 aa, Tick-borne encephalitis virus
TIGGKGHEA

SEQ ID NO: 187576 - protein, 9 aa, Tick-borne encephalitis virus
IGGKGHEAP

SEQ ID NO: 187577 - protein, 9 aa, Tick-borne encephalitis virus
GGKGHEAPK

SEQ ID NO: 187578 - protein, 9 aa, Tick-borne encephalitis virus
GKGHEAPKM

SEQ ID NO: 187579 - protein, 9 aa, Tick-borne encephalitis virus
KGHEAPKMV

SEQ ID NO: 187580 - protein, 9 aa, Tick-borne encephalitis virus
GHETPRMVT

SEQ ID NO: 187581 - protein, 9 aa, Tick-borne encephalitis virus
HETPRMVTS

SEQ ID NO: 187582 - protein, 9 aa, Tick-borne encephalitis virus
ETPRMVTSL

SEQ ID NO: 187583 - protein, 9 aa, Tick-borne encephalitis virus
TPRMVTSLG

SEQ ID NO: 187584 - protein, 9 aa, Tick-borne encephalitis virus
NLIKFRAGV

SEQ ID NO: 187585 - protein, 9 aa, Tick-borne encephalitis virus
LIKFRAGVD

SEQ ID NO: 187586 - protein, 9 aa, Tick-borne encephalitis virus
IKFRAGVDV

SEQ ID NO: 187587 - protein, 9 aa, Tick-borne encephalitis virus
KFRAGVDVF

SEQ ID NO: 187588 - protein, 9 aa, Tick-borne encephalitis virus
FRAGVDVFS

SEQ ID NO: 187589 - protein, 9 aa, Tick-borne encephalitis virus
RAGVDVFSM

SEQ ID NO: 187590 - protein, 9 aa, Tick-borne encephalitis virus
AGVDVFSMQ

SEQ ID NO: 187591 - protein, 9 aa, Tick-borne encephalitis virus
IMCDIGESS

SEQ ID NO: 187592 - protein, 9 aa, Tick-borne encephalitis virus
IGESNPDAA

SEQ ID NO: 187593 - protein, 9 aa, Tick-borne encephalitis virus
GESNPDAAV

SEQ ID NO: 187594 - protein, 9 aa, Tick-borne encephalitis virus
ESNPDAAVE

SEQ ID NO: 187595 - protein, 9 aa, Tick-borne encephalitis virus
SNPDAAVEG

SEQ ID NO: 187596 - protein, 9 aa, Tick-borne encephalitis virus
NPDAAVEGE

SEQ ID NO: 187597 - protein, 9 aa, Tick-borne encephalitis virus
PDAVVEGEK

SEQ ID NO: 187598 - protein, 9 aa, Tick-borne encephalitis virus
DAVVEGEKT

SEQ ID NO: 187599 - protein, 9 aa, Tick-borne encephalitis virus
AVVEGEKTR

SEQ ID NO: 187600 - protein, 9 aa, Tick-borne encephalitis virus
AVEGERTRR

SEQ ID NO: 187601 - protein, 9 aa, Tick-borne encephalitis virus
VEGEKTRKV

SEQ ID NO: 187602 - protein, 9 aa, Tick-borne encephalitis virus
EGEKTRKVI

SEQ ID NO: 187603 - protein, 9 aa, Tick-borne encephalitis virus
GEKTRKVIL

SEQ ID NO: 187604 - protein, 9 aa, Tick-borne encephalitis virus
EKTRKVILL

SEQ ID NO: 187605 - protein, 9 aa, Tick-borne encephalitis virus
KTRKVILLM

SEQ ID NO: 187606 - protein, 9 aa, Tick-borne encephalitis virus
EQWKIRNPT

SEQ ID NO: 187607 - protein, 9 aa, Tick-borne encephalitis virus
QWKNRNPAA

SEQ ID NO: 187608 - protein, 9 aa, Tick-borne encephalitis virus
WKNRNPAAA

SEQ ID NO: 187609 - protein, 9 aa, Tick-borne encephalitis virus
KIRNPTATC

SEQ ID NO: 187610 - protein, 9 aa, Tick-borne encephalitis virus
NRNPAAACV

SEQ ID NO: 187611 - protein, 9 aa, Tick-borne encephalitis virus
RNPAAACVF

SEQ ID NO: 187612 - protein, 9 aa, Tick-borne encephalitis virus
NPAAACVFK

SEQ ID NO: 187613 - protein, 9 aa, Tick-borne encephalitis virus
PAAACVFKV

SEQ ID NO: 187614 - protein, 9 aa, Tick-borne encephalitis virus
AAACVFKVL

SEQ ID NO: 187615 - protein, 9 aa, Tick-borne encephalitis virus
PYRPKVIEA

SEQ ID NO: 187616 - protein, 9 aa, Tick-borne encephalitis virus
YRPEVIETL

SEQ ID NO: 187617 - protein, 9 aa, Tick-borne encephalitis virus
RPEVIETLH

SEQ ID NO: 187618 - protein, 9 aa, Tick-borne encephalitis virus
PKVIEALHR

SEQ ID NO: 187619 - protein, 9 aa, Tick-borne encephalitis virus
KVIEALHRF

SEQ ID NO: 187620 - protein, 9 aa, Tick-borne encephalitis virus
EALHRFQLK

SEQ ID NO: 187621 - protein, 9 aa, Tick-borne encephalitis virus
ALHRFQLKW

SEQ ID NO: 187622 - protein, 9 aa, Tick-borne encephalitis virus
LHRFQLKWG

SEQ ID NO: 187623 - protein, 9 aa, Tick-borne encephalitis virus
HRFQLKWGG

SEQ ID NO: 187624 - protein, 9 aa, Tick-borne encephalitis virus
RFQLKWGGG

SEQ ID NO: 187625 - protein, 9 aa, Tick-borne encephalitis virus
FQLKWGGGL

SEQ ID NO: 187626 - protein, 9 aa, Tick-borne encephalitis virus
QLKWGGGLV

SEQ ID NO: 187627 - protein, 9 aa, Tick-borne encephalitis virus
LKWGGGLVR

SEQ ID NO: 187628 - protein, 9 aa, Tick-borne encephalitis virus
KWGGGLVRT

SEQ ID NO: 187629 - protein, 9 aa, Tick-borne encephalitis virus
HKVYYSTAV

SEQ ID NO: 187630 - protein, 9 aa, Tick-borne encephalitis virus
KVYYSTAVT

SEQ ID NO: 187631 - protein, 9 aa, Tick-borne encephalitis virus
VYYSTAVTG

SEQ ID NO: 187632 - protein, 9 aa, Tick-borne encephalitis virus
FAGQRGPTR

SEQ ID NO: 187633 - protein, 9 aa, Tick-borne encephalitis virus
AGQRGPTRV

SEQ ID NO: 187634 - protein, 9 aa, Tick-borne encephalitis virus
GQRGPTRVP

SEQ ID NO: 187635 - protein, 9 aa, Tick-borne encephalitis virus
KVPELDLGV

SEQ ID NO: 187636 - protein, 9 aa, Tick-borne encephalitis virus
LGVGTRCVF

SEQ ID NO: 187637 - protein, 9 aa, Tick-borne encephalitis virus
GVGTRCVFL

SEQ ID NO: 187638 - protein, 9 aa, Tick-borne encephalitis virus
VGTRCVFLA

SEQ ID NO: 187639 - protein, 9 aa, Tick-borne encephalitis virus
GTRCVFLAE

SEQ ID NO: 187640 - protein, 9 aa, Tick-borne encephalitis virus
TRCVVLADD

SEQ ID NO: 187641 - protein, 9 aa, Tick-borne encephalitis virus
RCVVLADDK

SEQ ID NO: 187642 - protein, 9 aa, Tick-borne encephalitis virus
CVVLADDKV

SEQ ID NO: 187643 - protein, 9 aa, Tick-borne encephalitis virus
VVLAEDKVR

SEQ ID NO: 187644 - protein, 9 aa, Tick-borne encephalitis virus
VLAEDKVRE

SEQ ID NO: 187645 - protein, 9 aa, Tick-borne encephalitis virus
LAEDRVREK

SEQ ID NO: 187646 - protein, 9 aa, Tick-borne encephalitis virus
AEDRVREKD

SEQ ID NO: 187647 - protein, 9 aa, Tick-borne encephalitis virus
EDRVREKDV

SEQ ID NO: 187648 - protein, 9 aa, Tick-borne encephalitis virus
DRVREKDVQ

SEQ ID NO: 187649 - protein, 9 aa, Tick-borne encephalitis virus
RVREKDVQE

SEQ ID NO: 187650 - protein, 9 aa, Tick-borne encephalitis virus
VREKDVQER

SEQ ID NO: 187651 - protein, 9 aa, Tick-borne encephalitis virus
REKDVQERI

SEQ ID NO: 187652 - protein, 9 aa, Tick-borne encephalitis virus
DVQERINAL

SEQ ID NO: 187653 - protein, 9 aa, Tick-borne encephalitis virus
ERINALREQ

SEQ ID NO: 187654 - protein, 9 aa, Tick-borne encephalitis virus
RIKALREQY

SEQ ID NO: 187655 - protein, 9 aa, Tick-borne encephalitis virus
ALKEQYGET

SEQ ID NO: 187656 - protein, 9 aa, Tick-borne encephalitis virus
LKEQYGETW

SEQ ID NO: 187657 - protein, 9 aa, Tick-borne encephalitis virus
KEQYGETWH

SEQ ID NO: 187658 - protein, 9 aa, Tick-borne encephalitis virus
DGEHPYRTW

SEQ ID NO: 187659 - protein, 9 aa, Tick-borne encephalitis virus
GEHPYRTWQ

SEQ ID NO: 187660 - protein, 9 aa, Tick-borne encephalitis virus
AWQQRVFKK

SEQ ID NO: 187661 - protein, 9 aa, Tick-borne encephalitis virus
WQQRVFKKN

SEQ ID NO: 187662 - protein, 9 aa, Tick-borne encephalitis virus
QQRVFKKNA

SEQ ID NO: 187663 - protein, 9 aa, Tick-borne encephalitis virus
QRVFKKNAD

SEQ ID NO: 187664 - protein, 9 aa, Tick-borne encephalitis virus
RVFKKNADT

SEQ ID NO: 187665 - protein, 9 aa, Tick-borne encephalitis virus
VFKKNADTK

SEQ ID NO: 187666 - protein, 9 aa, Tick-borne encephalitis virus
FKKNADTKA

SEQ ID NO: 187667 - protein, 9 aa, Tick-borne encephalitis virus
KKNADTKAQ

SEQ ID NO: 187668 - protein, 9 aa, Tick-borne encephalitis virus
KNADTKAQE

SEQ ID NO: 187669 - protein, 9 aa, Tick-borne encephalitis virus
DWMLDRLAQ

SEQ ID NO: 187670 - protein, 9 aa, Tick-borne encephalitis virus
WMLDRLAQK

SEQ ID NO: 187671 - protein, 9 aa, Tick-borne encephalitis virus
ILERLAQRS

SEQ ID NO: 187672 - protein, 9 aa, Tick-borne encephalitis virus
NSRIHSKEE

SEQ ID NO: 187673 - protein, 9 aa, Tick-borne encephalitis virus
SRIHSKEEF

SEQ ID NO: 187674 - protein, 9 aa, Tick-borne encephalitis virus
RIHSKEEFI

SEQ ID NO: 187675 - protein, 9 aa, Tick-borne encephalitis virus
IHSKEEFIA

SEQ ID NO: 187676 - protein, 9 aa, Tick-borne encephalitis virus
HSKEEFIAK

SEQ ID NO: 187677 - protein, 9 aa, Tick-borne encephalitis virus
KEEFIAKVR

SEQ ID NO: 187678 - protein, 9 aa, Tick-borne encephalitis virus
EFIAKVKSS

SEQ ID NO: 187679 - protein, 9 aa, Tick-borne encephalitis virus
FIAKVKSSA

SEQ ID NO: 187680 - protein, 9 aa, Tick-borne encephalitis virus
IAKVKSSAA

SEQ ID NO: 187681 - protein, 9 aa, Tick-borne encephalitis virus
AKVRSNAAL

SEQ ID NO: 187682 - protein, 9 aa, Tick-borne encephalitis virus
KVKSSAALG

SEQ ID NO: 187683 - protein, 9 aa, Tick-borne encephalitis virus
VKSSAALGA

SEQ ID NO: 187684 - protein, 9 aa, Tick-borne encephalitis virus
KSSAALGAW

SEQ ID NO: 187685 - protein, 9 aa, Tick-borne encephalitis virus
NAALGAWSE

SEQ ID NO: 187686 - protein, 9 aa, Tick-borne encephalitis virus
AALGAWSEE

SEQ ID NO: 187687 - protein, 9 aa, Tick-borne encephalitis virus
ALGAWSEEQ

SEQ ID NO: 187688 - protein, 9 aa, Tick-borne encephalitis virus
LGAWSNEQN

SEQ ID NO: 187689 - protein, 9 aa, Tick-borne encephalitis virus
GAWSEEQNR

SEQ ID NO: 187690 - protein, 9 aa, Tick-borne encephalitis virus
AWSNEQNRW

SEQ ID NO: 187691 - protein, 9 aa, Tick-borne encephalitis virus
WSNEQNRWS

SEQ ID NO: 187692 - protein, 9 aa, Tick-borne encephalitis virus
NAKEAVEDP

SEQ ID NO: 187693 - protein, 9 aa, Tick-borne encephalitis virus
AKEAVEDPV

SEQ ID NO: 187694 - protein, 9 aa, Tick-borne encephalitis virus
KEAVEDPVF

SEQ ID NO: 187695 - protein, 9 aa, Tick-borne encephalitis virus
AVEDPVFWQ

SEQ ID NO: 187696 - protein, 9 aa, Tick-borne encephalitis virus
VEDPVFWQL

SEQ ID NO: 187697 - protein, 9 aa, Tick-borne encephalitis virus
EDPVFWQLV

SEQ ID NO: 187698 - protein, 9 aa, Tick-borne encephalitis virus
DPVFWQLVD

SEQ ID NO: 187699 - protein, 9 aa, Tick-borne encephalitis virus
PVFWQLVDE

SEQ ID NO: 187700 - protein, 9 aa, Tick-borne encephalitis virus
VFWQLVDEE

SEQ ID NO: 187701 - protein, 9 aa, Tick-borne encephalitis virus
FWRLVDEER

SEQ ID NO: 187702 - protein, 9 aa, Tick-borne encephalitis virus
WRLVDEERE

SEQ ID NO: 187703 - protein, 9 aa, Tick-borne encephalitis virus
RLVDEERER

SEQ ID NO: 187704 - protein, 9 aa, Tick-borne encephalitis virus
DEERERHLT

SEQ ID NO: 187705 - protein, 9 aa, Tick-borne encephalitis virus
EERERDLAG

SEQ ID NO: 187706 - protein, 9 aa, Tick-borne encephalitis virus
ERERHLTGR

SEQ ID NO: 187707 - protein, 9 aa, Tick-borne encephalitis virus
RERHLTGRC

SEQ ID NO: 187708 - protein, 9 aa, Tick-borne encephalitis virus
ERDLAGRSA

SEQ ID NO: 187709 - protein, 9 aa, Tick-borne encephalitis virus
RDLAGRSAH

SEQ ID NO: 187710 - protein, 9 aa, Tick-borne encephalitis virus
DLAGRSAHG

SEQ ID NO: 187711 - protein, 9 aa, Tick-borne encephalitis virus
LAGRCAHCA

SEQ ID NO: 187712 - protein, 9 aa, Tick-borne encephalitis virus
GRCAHCAYN

SEQ ID NO: 187713 - protein, 9 aa, Tick-borne encephalitis virus
RSAHGVFNI

SEQ ID NO: 187714 - protein, 9 aa, Tick-borne encephalitis virus
SAHGVFNIM

SEQ ID NO: 187715 - protein, 9 aa, Tick-borne encephalitis virus
AHGVFNIMG

SEQ ID NO: 187716 - protein, 9 aa, Tick-borne encephalitis virus
HGVFNIMGK

SEQ ID NO: 187717 - protein, 9 aa, Tick-borne encephalitis virus
GVFNIMGKR

SEQ ID NO: 187718 - protein, 9 aa, Tick-borne encephalitis virus
VFNIMGKRE

SEQ ID NO: 187719 - protein, 9 aa, Tick-borne encephalitis virus
FNIMGKREK

SEQ ID NO: 187720 - protein, 9 aa, Tick-borne encephalitis virus
EDHWASRGF

SEQ ID NO: 187721 - protein, 9 aa, Tick-borne encephalitis virus
DHWASRGFS

SEQ ID NO: 187722 - protein, 9 aa, Tick-borne encephalitis virus
HWASRGFSG

SEQ ID NO: 187723 - protein, 9 aa, Tick-borne encephalitis virus
WASRGFSGS

SEQ ID NO: 187724 - protein, 9 aa, Tick-borne encephalitis virus
ASRESSGSG

SEQ ID NO: 187725 - protein, 9 aa, Tick-borne encephalitis virus
SRESSGSGV

SEQ ID NO: 187726 - protein, 9 aa, Tick-borne encephalitis virus
RGFSGSGVE

SEQ ID NO: 187727 - protein, 9 aa, Tick-borne encephalitis virus
ESSGSGVEG

SEQ ID NO: 187728 - protein, 9 aa, Tick-borne encephalitis virus
FSGSGVEGI

SEQ ID NO: 187729 - protein, 9 aa, Tick-borne encephalitis virus
NYLGWHLKG

SEQ ID NO: 187730 - protein, 9 aa, Tick-borne encephalitis virus
YLGWHLKGL

SEQ ID NO: 187731 - protein, 9 aa, Tick-borne encephalitis virus
LGWHLKGLS

SEQ ID NO: 187732 - protein, 9 aa, Tick-borne encephalitis virus
LSILEGGLF

SEQ ID NO: 187733 - protein, 9 aa, Tick-borne encephalitis virus
SILEGGLFY

SEQ ID NO: 187734 - protein, 9 aa, Tick-borne encephalitis virus
ILEGGLFYA

SEQ ID NO: 187735 - protein, 9 aa, Tick-borne encephalitis virus
PEGGLFYAD

SEQ ID NO: 187736 - protein, 9 aa, Tick-borne encephalitis virus
EGEHRQLAA

SEQ ID NO: 187737 - protein, 9 aa, Tick-borne encephalitis virus
GEHRQLAAT

SEQ ID NO: 187738 - protein, 9 aa, Tick-borne encephalitis virus
EHRQLAATI

SEQ ID NO: 187739 - protein, 9 aa, Tick-borne encephalitis virus
HRQLAATIM

SEQ ID NO: 187740 - protein, 9 aa, Tick-borne encephalitis virus
RQLAATIMQ

SEQ ID NO: 187741 - protein, 9 aa, Tick-borne encephalitis virus
QLAATVMQK

SEQ ID NO: 187742 - protein, 9 aa, Tick-borne encephalitis virus
LAATVMQKA

SEQ ID NO: 187743 - protein, 9 aa, Tick-borne encephalitis virus
AATVMQKAY

SEQ ID NO: 187744 - protein, 9 aa, Tick-borne encephalitis virus
ATVMQKAYH

SEQ ID NO: 187745 - protein, 9 aa, Tick-borne encephalitis virus
RPSREGGCV

SEQ ID NO: 187746 - protein, 9 aa, Tick-borne encephalitis virus
PSREGGCVM

SEQ ID NO: 187747 - protein, 9 aa, Tick-borne encephalitis virus
SREGGCVMD

SEQ ID NO: 187748 - protein, 9 aa, Tick-borne encephalitis virus
REGGCVMDV

SEQ ID NO: 187749 - protein, 9 aa, Tick-borne encephalitis virus
EGGCVMDVI

SEQ ID NO: 187750 - protein, 9 aa, Tick-borne encephalitis virus
EGEGVIEAT

SEQ ID NO: 187751 - protein, 9 aa, Tick-borne encephalitis virus
GEGVIEATD

SEQ ID NO: 187752 - protein, 9 aa, Tick-borne encephalitis virus
EGVIEATDA

SEQ ID NO: 187753 - protein, 9 aa, Tick-borne encephalitis virus
GVIEATDAH

SEQ ID NO: 187754 - protein, 9 aa, Tick-borne encephalitis virus
VIEATDAHN

SEQ ID NO: 187755 - protein, 9 aa, Tick-borne encephalitis virus
IEATDAHNP

SEQ ID NO: 187756 - protein, 9 aa, Tick-borne encephalitis virus
EATDAHNPR

SEQ ID NO: 187757 - protein, 9 aa, Tick-borne encephalitis virus
ATDAHNPRL

SEQ ID NO: 187758 - protein, 9 aa, Tick-borne encephalitis virus
TDAHNPRLL

SEQ ID NO: 187759 - protein, 9 aa, Tick-borne encephalitis virus
LFRVERWLR

SEQ ID NO: 187760 - protein, 9 aa, Tick-borne encephalitis virus
LRVERWLRE

SEQ ID NO: 187761 - protein, 9 aa, Tick-borne encephalitis virus
RVERWLRNH

SEQ ID NO: 187762 - protein, 9 aa, Tick-borne encephalitis virus
VERWLRDYG

SEQ ID NO: 187763 - protein, 9 aa, Tick-borne encephalitis virus
EHGGERLGR

SEQ ID NO: 187764 - protein, 9 aa, Tick-borne encephalitis virus
HGGERLGRM

SEQ ID NO: 187765 - protein, 9 aa, Tick-borne encephalitis virus
GDDCVVRPI

SEQ ID NO: 187766 - protein, 9 aa, Tick-borne encephalitis virus
DDCVVRPID

SEQ ID NO: 187767 - protein, 9 aa, Tick-borne encephalitis virus
DCVVRPIDD

SEQ ID NO: 187768 - protein, 9 aa, Tick-borne encephalitis virus
CVVRPIDDR

SEQ ID NO: 187769 - protein, 9 aa, Tick-borne encephalitis virus
VVRPIDDRF

SEQ ID NO: 187770 - protein, 9 aa, Tick-borne encephalitis virus
VRPIDDRFG

SEQ ID NO: 187771 - protein, 9 aa, Tick-borne encephalitis virus
DDRFSRALY

SEQ ID NO: 187772 - protein, 9 aa, Tick-borne encephalitis virus
DRFSRALYF

SEQ ID NO: 187773 - protein, 9 aa, Tick-borne encephalitis virus
RFSRALYFL

SEQ ID NO: 187774 - protein, 9 aa, Tick-borne encephalitis virus
FSRALYFLN

SEQ ID NO: 187775 - protein, 9 aa, Tick-borne encephalitis virus
SRALYFLND

SEQ ID NO: 187776 - protein, 9 aa, Tick-borne encephalitis virus
GALYFLNDM

SEQ ID NO: 187777 - protein, 9 aa, Tick-borne encephalitis virus
DIGEWEHSA

SEQ ID NO: 187778 - protein, 9 aa, Tick-borne encephalitis virus
IGEWEHSAG

SEQ ID NO: 187779 - protein, 9 aa, Tick-borne encephalitis virus
GEWEHSAGL

SEQ ID NO: 187780 - protein, 9 aa, Tick-borne encephalitis virus
EWEHSAGLS

SEQ ID NO: 187781 - protein, 9 aa, Tick-borne encephalitis virus
GWEEVPFCS

SEQ ID NO: 187782 - protein, 9 aa, Tick-borne encephalitis virus
WEAVPFCSH

SEQ ID NO: 187783 - protein, 9 aa, Tick-borne encephalitis virus
ELVMKDGRS

SEQ ID NO: 187784 - protein, 9 aa, Tick-borne encephalitis virus
LVMKDGRTL

SEQ ID NO: 187785 - protein, 9 aa, Tick-borne encephalitis virus
VMKDGRSLI

SEQ ID NO: 187786 - protein, 9 aa, Tick-borne encephalitis virus
MKDGRTLVV

SEQ ID NO: 187787 - protein, 9 aa, Tick-borne encephalitis virus
KDGRTLVVP

SEQ ID NO: 187788 - protein, 9 aa, Tick-borne encephalitis virus
DGRSLIVPC

SEQ ID NO: 187789 - protein, 9 aa, Tick-borne encephalitis virus
GRTLVVPCR

SEQ ID NO: 187790 - protein, 9 aa, Tick-borne encephalitis virus
RTLVVPCRD

SEQ ID NO: 187791 - protein, 9 aa, Tick-borne encephalitis virus
TLVVPCRDQ

SEQ ID NO: 187792 - protein, 9 aa, Tick-borne encephalitis virus
DELVGRAPV

SEQ ID NO: 187793 - protein, 9 aa, Tick-borne encephalitis virus
ELVGRAPVS

SEQ ID NO: 187794 - protein, 9 aa, Tick-borne encephalitis virus
LVGRAPVSP

SEQ ID NO: 187795 - protein, 9 aa, Tick-borne encephalitis virus
VGRAPVSPG

SEQ ID NO: 187796 - protein, 9 aa, Tick-borne encephalitis virus
GRAPVSPGC

SEQ ID NO: 187797 - protein, 9 aa, Tick-borne encephalitis virus
RAPVSPGCG

SEQ ID NO: 187798 - protein, 9 aa, Tick-borne encephalitis virus
APVSPGCGW

SEQ ID NO: 187799 - protein, 9 aa, Tick-borne encephalitis virus
PVSPGCGWS

SEQ ID NO: 187800 - protein, 9 aa, Tick-borne encephalitis virus
VSPGCGWSI

SEQ ID NO: 187801 - protein, 9 aa, Tick-borne encephalitis virus
RDLRTLGFA

SEQ ID NO: 187802 - protein, 9 aa, Tick-borne encephalitis virus
DLRTLGFAI

SEQ ID NO: 187803 - protein, 9 aa, Tick-borne encephalitis virus
LRTLGLTIC

SEQ ID NO: 187804 - protein, 9 aa, Tick-borne encephalitis virus
RTLGLAISS

SEQ ID NO: 187805 - protein, 9 aa, Tick-borne encephalitis virus
TLGLTICSA

SEQ ID NO: 187806 - protein, 9 aa, Tick-borne encephalitis virus
LGLTICSAV

SEQ ID NO: 187807 - protein, 9 aa, Tick-borne encephalitis virus
GFAICSAVP

SEQ ID NO: 187808 - protein, 9 aa, Tick-borne encephalitis virus
SAVPADWVP

SEQ ID NO: 187809 - protein, 9 aa, Tick-borne encephalitis virus
AVPADWVPT

SEQ ID NO: 187810 - protein, 9 aa, Tick-borne encephalitis virus
VPIDWVPTG

SEQ ID NO: 187811 - protein, 9 aa, Tick-borne encephalitis virus
PADWVPTGR

SEQ ID NO: 187812 - protein, 9 aa, Tick-borne encephalitis virus
IDWVPTGRT

SEQ ID NO: 187813 - protein, 9 aa, Tick-borne encephalitis virus
SIHASGSWM

SEQ ID NO: 187814 - protein, 9 aa, Tick-borne encephalitis virus
IHASGSWMT

SEQ ID NO: 187815 - protein, 9 aa, Tick-borne encephalitis virus
HASGSWMTT

SEQ ID NO: 187816 - protein, 9 aa, Tick-borne encephalitis virus
ASGSWMTTE

SEQ ID NO: 187817 - protein, 9 aa, Tick-borne encephalitis virus
SGSWMTTED

SEQ ID NO: 187818 - protein, 9 aa, Tick-borne encephalitis virus
GAWITTEDM

SEQ ID NO: 187819 - protein, 9 aa, Tick-borne encephalitis virus
AWITTEDML

SEQ ID NO: 187820 - protein, 9 aa, Tick-borne encephalitis virus
WITTEDMLD

SEQ ID NO: 187821 - protein, 9 aa, Tick-borne encephalitis virus
ITTEDMLDV

SEQ ID NO: 187822 - protein, 9 aa, Tick-borne encephalitis virus
ILDNPFMHG

SEQ ID NO: 187823 - protein, 9 aa, Tick-borne encephalitis virus
LDNPFMHGK

SEQ ID NO: 187824 - protein, 9 aa, Tick-borne encephalitis virus
DNPFMQNKG

SEQ ID NO: 187825 - protein, 9 aa, Tick-borne encephalitis virus
NPFMQNKER

SEQ ID NO: 187826 - protein, 9 aa, Tick-borne encephalitis virus
EWRNVPYLP

SEQ ID NO: 187827 - protein, 9 aa, Tick-borne encephalitis virus
WRNVPYLPK

SEQ ID NO: 187828 - protein, 9 aa, Tick-borne encephalitis virus
RDIPYLPKA

SEQ ID NO: 187829 - protein, 9 aa, Tick-borne encephalitis virus
IPYLPKAHD

SEQ ID NO: 187830 - protein, 9 aa, Tick-borne encephalitis virus
PYLPKAHDM

SEQ ID NO: 187831 - protein, 9 aa, Tick-borne encephalitis virus
YLPKAHDML

SEQ ID NO: 187832 - protein, 9 aa, Tick-borne encephalitis virus
LPKAHDMLC

SEQ ID NO: 187833 - protein, 9 aa, Tick-borne encephalitis virus
PKAHDMLCS

SEQ ID NO: 187834 - protein, 9 aa, Tick-borne encephalitis virus
KAHDMLCSS

SEQ ID NO: 187835 - protein, 9 aa, Tick-borne encephalitis virus
AHDMLCSSL

SEQ ID NO: 187836 - protein, 9 aa, Tick-borne encephalitis virus
LCSSLVGRT

SEQ ID NO: 187837 - protein, 9 aa, Tick-borne encephalitis virus
CSSLVGRTE

SEQ ID NO: 187838 - protein, 9 aa, Tick-borne encephalitis virus
SSLVGRTER

SEQ ID NO: 187839 - protein, 9 aa, Tick-borne encephalitis virus
SLVGRTERA

SEQ ID NO: 187840 - protein, 9 aa, Tick-borne encephalitis virus
LVGRTERAE

SEQ ID NO: 187841 - protein, 9 aa, Tick-borne encephalitis virus
VGRTERAEW

SEQ ID NO: 187842 - protein, 9 aa, Tick-borne encephalitis virus
GRTERAEWA

SEQ ID NO: 187843 - protein, 9 aa, Tick-borne encephalitis virus
RKERAEWAR

SEQ ID NO: 187844 - protein, 9 aa, Tick-borne encephalitis virus
KERAEWARN

SEQ ID NO: 187845 - protein, 9 aa, Tick-borne encephalitis virus
GAVEKVRKI

SEQ ID NO: 187846 - protein, 9 aa, Tick-borne encephalitis virus
AVEKVRKMM

SEQ ID NO: 187847 - protein, 9 aa, Tick-borne encephalitis virus
VEKVRKIVG

SEQ ID NO: 187848 - protein, 9 aa, Tick-borne encephalitis virus
RFKDYLSCM

SEQ ID NO: 187849 - protein, 9 aa, Tick-borne encephalitis virus
CKDYPSCMD

SEQ ID NO: 187850 - protein, 9 aa, Tick-borne encephalitis virus
KDYPSCMDR

SEQ ID NO: 187851 - protein, 9 aa, Tick-borne encephalitis virus
YPSCMDRHD

SEQ ID NO: 187852 - protein, 9 aa, Tick-borne encephalitis virus
LSCMDRHYL

SEQ ID NO: 187853 - protein, 9 aa, Tick-borne encephalitis virus
RHYLHWNLK

SEQ ID NO: 187854 - protein, 9 aa, Tick-borne encephalitis virus
HYLHWNLKL

SEQ ID NO: 187855 - protein, 9 aa, Tick-borne encephalitis virus
YLHWNLKLE

SEQ ID NO: 187856 - protein, 9 aa, Tick-borne encephalitis virus
LHWNLKLES

SEQ ID NO: 187857 - protein, 9 aa, Tick-borne encephalitis virus
HWELKLEGS

SEQ ID NO: 187858 - protein, 9 aa, Tick-borne encephalitis virus
WELKLEGSI

SEQ ID NO: 187859 - protein, 9 aa, Tick-borne encephalitis virus
ELKLEGSII

SEQ ID NO: 187860 - protein, 9 aa, Tick-borne encephalitis virus
RRVSKEAAK

SEQ ID NO: 187861 - protein, 9 aa, Tick-borne encephalitis virus
RASKETAKK

SEQ ID NO: 187862 - protein, 9 aa, Tick-borne encephalitis virus
ASKETAKKT

SEQ ID NO: 187863 - protein, 9 aa, Tick-borne encephalitis virus
SKEAAKKTR

SEQ ID NO: 187864 - protein, 9 aa, Tick-borne encephalitis virus
KEAAKKTRQ

SEQ ID NO: 187865 - protein, 9 aa, Tick-borne encephalitis virus
EAAKKTRQS

SEQ ID NO: 187866 - protein, 9 aa, Tick-borne encephalitis virus
AAKKTRQSR

SEQ ID NO: 187867 - protein, 9 aa, Tick-borne encephalitis virus
RKTRQSRVQ

SEQ ID NO: 187868 - protein, 9 aa, Tick-borne encephalitis virus
RQSRVQMPS

SEQ ID NO: 187869 - protein, 9 aa, Tick-borne encephalitis virus
QSRVQMPSG

SEQ ID NO: 187870 - protein, 9 aa, Tick-borne encephalitis virus
SRVQMPSGL

SEQ ID NO: 187871 - protein, 9 aa, Tick-borne encephalitis virus
MMGFLWHAI

SEQ ID NO: 187872 - protein, 9 aa, Tick-borne encephalitis virus
MGFLWHAIA

SEQ ID NO: 187873 - protein, 9 aa, Tick-borne encephalitis virus
HAVAGTVRS

SEQ ID NO: 187874 - protein, 9 aa, Tick-borne encephalitis virus
AVAGTVRSP

SEQ ID NO: 187875 - protein, 9 aa, Tick-borne encephalitis virus
VAGTVRSPV

SEQ ID NO: 187876 - protein, 9 aa, Tick-borne encephalitis virus
PVLKSFWKP

SEQ ID NO: 187877 - protein, 9 aa, Tick-borne encephalitis virus
VLKSFWKPV

SEQ ID NO: 187878 - protein, 9 aa, Tick-borne encephalitis virus
LKSFWKPVP

SEQ ID NO: 187879 - protein, 9 aa, Tick-borne encephalitis virus
KSFWKPVPL

SEQ ID NO: 187880 - protein, 9 aa, Tick-borne encephalitis virus
SFWKSVPLK

SEQ ID NO: 187881 - protein, 9 aa, Tick-borne encephalitis virus
FWKPVPLKQ

SEQ ID NO: 187882 - protein, 9 aa, Tick-borne encephalitis virus
WKPVPLKQA

SEQ ID NO: 187883 - protein, 9 aa, Tick-borne encephalitis virus
NSVPLKQAM

SEQ ID NO: 187884 - protein, 9 aa, Tick-borne encephalitis virus
SVPLKQATT

SEQ ID NO: 187885 - protein, 9 aa, Tick-borne encephalitis virus
VPLKQATTA

SEQ ID NO: 187886 - protein, 9 aa, Tick-borne encephalitis virus
PLKQATTAL

SEQ ID NO: 187887 - protein, 9 aa, Tick-borne encephalitis virus
LKQATTALR

SEQ ID NO: 187888 - protein, 9 aa, Tick-borne encephalitis virus
KQATTALRK

SEQ ID NO: 187889 - protein, 9 aa, Tick-borne encephalitis virus
TTALRKIKM

SEQ ID NO: 187890 - protein, 9 aa, Tick-borne encephalitis virus
AALRKIKRA

SEQ ID NO: 187891 - protein, 9 aa, Tick-borne encephalitis virus
ALRKIKRAV

SEQ ID NO: 187892 - protein, 9 aa, Tick-borne encephalitis virus
LRKIKRAVS

SEQ ID NO: 187893 - protein, 9 aa, Tick-borne encephalitis virus
RKIKRAVST

SEQ ID NO: 187894 - protein, 9 aa, Tick-borne encephalitis virus
KIKMAVSAL

SEQ ID NO: 187895 - protein, 9 aa, Tick-borne encephalitis virus
IKRAVSTLM

SEQ ID NO: 187896 - protein, 9 aa, Tick-borne encephalitis virus
AVSALMIGL

SEQ ID NO: 187897 - protein, 9 aa, Tick-borne encephalitis virus
VSTLMIGLQ

SEQ ID NO: 187898 - protein, 9 aa, Tick-borne encephalitis virus
LMVGLQRRE

SEQ ID NO: 187899 - protein, 9 aa, Tick-borne encephalitis virus
MVGLQRREK

SEQ ID NO: 187900 - protein, 9 aa, Tick-borne encephalitis virus
IGLQRRGKK

SEQ ID NO: 187901 - protein, 9 aa, Tick-borne encephalitis virus
GLQRREKKR

SEQ ID NO: 187902 - protein, 9 aa, Tick-borne encephalitis virus
LQRREKKRS

SEQ ID NO: 187903 - protein, 9 aa, Tick-borne encephalitis virus
QKRGKRRSV

SEQ ID NO: 187904 - protein, 9 aa, Tick-borne encephalitis virus
TFAATVRKE

SEQ ID NO: 187905 - protein, 9 aa, Tick-borne encephalitis virus
IAATVRKER

SEQ ID NO: 187906 - protein, 9 aa, Tick-borne encephalitis virus
ATVRKERDD

SEQ ID NO: 187907 - protein, 9 aa, Tick-borne encephalitis virus
TVRKERDDT

SEQ ID NO: 187908 - protein, 9 aa, Tick-borne encephalitis virus
VRREGDGTT

SEQ ID NO: 187909 - protein, 9 aa, Tick-borne encephalitis virus
RREGDGTTV

SEQ ID NO: 187910 - protein, 9 aa, Tick-borne encephalitis virus
REGDGTTVI

SEQ ID NO: 187911 - protein, 9 aa, Tick-borne encephalitis virus
ERDDTTVIR

SEQ ID NO: 187912 - protein, 9 aa, Tick-borne encephalitis virus
RDDTTVIRA

SEQ ID NO: 187913 - protein, 9 aa, Tick-borne encephalitis virus
VILATDMGA

SEQ ID NO: 187914 - protein, 9 aa, Tick-borne encephalitis virus
ILATDMGAW

SEQ ID NO: 187915 - protein, 9 aa, Tick-borne encephalitis virus
MATDMGSWC

SEQ ID NO: 187916 - protein, 9 aa, Tick-borne encephalitis virus
IVWMTVESV

SEQ ID NO: 187917 - protein, 9 aa, Tick-borne encephalitis virus
WLTLESVVA

SEQ ID NO: 187918 - protein, 9 aa, Tick-borne encephalitis virus
MTVESVVTR

SEQ ID NO: 187919 - protein, 9 aa, Tick-borne encephalitis virus
TLESVVARV

SEQ ID NO: 187920 - protein, 9 aa, Tick-borne encephalitis virus
VAVLLCLAP

SEQ ID NO: 187921 - protein, 9 aa, Tick-borne encephalitis virus
VALLCLAPV

SEQ ID NO: 187922 - protein, 9 aa, Tick-borne encephalitis virus
WLDAIYQEK

SEQ ID NO: 187923 - protein, 9 aa, Tick-borne encephalitis virus
LDAIYQEKP

SEQ ID NO: 187924 - protein, 9 aa, Tick-borne encephalitis virus
DAIYQEKPA

SEQ ID NO: 187925 - protein, 9 aa, Tick-borne encephalitis virus
AIYQEKPAK

SEQ ID NO: 187926 - protein, 9 aa, Tick-borne encephalitis virus
IYQENPAQT

SEQ ID NO: 187927 - protein, 9 aa, Tick-borne encephalitis virus
YQEKPAKTR

SEQ ID NO: 187928 - protein, 9 aa, Tick-borne encephalitis virus
QENPAQTRE

SEQ ID NO: 187929 - protein, 9 aa, Tick-borne encephalitis virus
ENPAQTREY

SEQ ID NO: 187930 - protein, 9 aa, Tick-borne encephalitis virus
KPAKTREYC

SEQ ID NO: 187931 - protein, 9 aa, Tick-borne encephalitis virus
ATLTEEHQG

SEQ ID NO: 187932 - protein, 9 aa, Tick-borne encephalitis virus
TLAEQHQSG

SEQ ID NO: 187933 - protein, 9 aa, Tick-borne encephalitis virus
LTEEHQGGT

SEQ ID NO: 187934 - protein, 9 aa, Tick-borne encephalitis virus
TEEHQGGTV

SEQ ID NO: 187935 - protein, 9 aa, Tick-borne encephalitis virus
SIVTCVKAA

SEQ ID NO: 187936 - protein, 9 aa, Tick-borne encephalitis virus
IVTCVKAAC

SEQ ID NO: 187937 - protein, 9 aa, Tick-borne encephalitis virus
VTCVKAACE

SEQ ID NO: 187938 - protein, 9 aa, Tick-borne encephalitis virus
TCVKAACEA

SEQ ID NO: 187939 - protein, 9 aa, Tick-borne encephalitis virus
CVKVSCEAK

SEQ ID NO: 187940 - protein, 9 aa, Tick-borne encephalitis virus
VKVSCEAKK

SEQ ID NO: 187941 - protein, 9 aa, Tick-borne encephalitis virus
KVSCEAKKK

SEQ ID NO: 187942 - protein, 9 aa, Tick-borne encephalitis virus
VSCEAKKKA

SEQ ID NO: 187943 - protein, 9 aa, Tick-borne encephalitis virus
DANRIVYTV

SEQ ID NO: 187944 - protein, 9 aa, Tick-borne encephalitis virus
PNKIVYPVK

SEQ ID NO: 187945 - protein, 9 aa, Tick-borne encephalitis virus
NKIVYTIKV

SEQ ID NO: 187946 - protein, 9 aa, Tick-borne encephalitis virus
KIVYPVKVE

SEQ ID NO: 187947 - protein, 9 aa, Tick-borne encephalitis virus
LPWRHEGVQ

SEQ ID NO: 187948 - protein, 9 aa, Tick-borne encephalitis virus
HEGVQNWNN

SEQ ID NO: 187949 - protein, 9 aa, Tick-borne encephalitis virus
EGARNWNNA

SEQ ID NO: 187950 - protein, 9 aa, Tick-borne encephalitis virus
GVQNWNNAE

SEQ ID NO: 187951 - protein, 9 aa, Tick-borne encephalitis virus
ARNWNNAER

SEQ ID NO: 187952 - protein, 9 aa, Tick-borne encephalitis virus
RNWNNAERL

SEQ ID NO: 187953 - protein, 9 aa, Tick-borne encephalitis virus
KTKFTWKRT

SEQ ID NO: 187954 - protein, 9 aa, Tick-borne encephalitis virus
TKFTWKRTP

SEQ ID NO: 187955 - protein, 9 aa, Tick-borne encephalitis virus
KFTWKRTPT

SEQ ID NO: 187956 - protein, 9 aa, Tick-borne encephalitis virus
FTWKRTPTD

SEQ ID NO: 187957 - protein, 9 aa, Tick-borne encephalitis virus
TWKRTPTDS

SEQ ID NO: 187958 - protein, 9 aa, Tick-borne encephalitis virus
WRRTPTDSG

SEQ ID NO: 187959 - protein, 9 aa, Tick-borne encephalitis virus
RRTPTDSGH

SEQ ID NO: 187960 - protein, 9 aa, Tick-borne encephalitis virus
FGSTGGLLT

SEQ ID NO: 187961 - protein, 9 aa, Tick-borne encephalitis virus
GSTGGLLTS

SEQ ID NO: 187962 - protein, 9 aa, Tick-borne encephalitis virus
STGGLLTSV

SEQ ID NO: 187963 - protein, 9 aa, Tick-borne encephalitis virus
TGGLLTSVG

SEQ ID NO: 187964 - protein, 9 aa, Tick-borne encephalitis virus
GGLLTSVGK

SEQ ID NO: 187965 - protein, 9 aa, Tick-borne encephalitis virus
GLLTSVGKA

SEQ ID NO: 187966 - protein, 9 aa, Tick-borne encephalitis virus
LLTSVGKAL

SEQ ID NO: 187967 - protein, 9 aa, Tick-borne encephalitis virus
LSSIGKALH

SEQ ID NO: 187968 - protein, 9 aa, Tick-borne encephalitis virus
SSIGKALHT

SEQ ID NO: 187969 - protein, 9 aa, Tick-borne encephalitis virus
VGFLPKILI

SEQ ID NO: 187970 - protein, 9 aa, Tick-borne encephalitis virus
GFIPKLLLG

SEQ ID NO: 187971 - protein, 9 aa, Tick-borne encephalitis virus
GAALAWLGL

SEQ ID NO: 187972 - protein, 9 aa, Tick-borne encephalitis virus
MALAWLGLN

SEQ ID NO: 187973 - protein, 9 aa, Tick-borne encephalitis virus
IRETFEEGT

SEQ ID NO: 187974 - protein, 9 aa, Tick-borne encephalitis virus
KEAFEEGTC

SEQ ID NO: 187975 - protein, 9 aa, Tick-borne encephalitis virus
EAFEEGTCG

SEQ ID NO: 187976 - protein, 9 aa, Tick-borne encephalitis virus
AFEEGTCGI

SEQ ID NO: 187977 - protein, 9 aa, Tick-borne encephalitis virus
FEEGTCGIL

SEQ ID NO: 187978 - protein, 9 aa, Tick-borne encephalitis virus
EEGTCGILP

SEQ ID NO: 187979 - protein, 9 aa, Tick-borne encephalitis virus
EGTCGILPQ

SEQ ID NO: 187980 - protein, 9 aa, Tick-borne encephalitis virus
GTCGILPQN

SEQ ID NO: 187981 - protein, 9 aa, Tick-borne encephalitis virus
TCGILPQNR

SEQ ID NO: 187982 - protein, 9 aa, Tick-borne encephalitis virus
EMAMWRSSS

SEQ ID NO: 187983 - protein, 9 aa, Tick-borne encephalitis virus
MAMWRSSST

SEQ ID NO: 187984 - protein, 9 aa, Tick-borne encephalitis virus
AMWRSAATE

SEQ ID NO: 187985 - protein, 9 aa, Tick-borne encephalitis virus
MWRSSSTEL

SEQ ID NO: 187986 - protein, 9 aa, Tick-borne encephalitis virus
WRSAATELN

SEQ ID NO: 187987 - protein, 9 aa, Tick-borne encephalitis virus
RSSSTELNL

SEQ ID NO: 187988 - protein, 9 aa, Tick-borne encephalitis virus
SAATELNLA

SEQ ID NO: 187989 - protein, 9 aa, Tick-borne encephalitis virus
SSTELNLAL

SEQ ID NO: 187990 - protein, 9 aa, Tick-borne encephalitis virus
RGGIPGLLR

SEQ ID NO: 187991 - protein, 9 aa, Tick-borne encephalitis virus
GGVSGLLRK

SEQ ID NO: 187992 - protein, 9 aa, Tick-borne encephalitis virus
GVSGLLRKG

SEQ ID NO: 187993 - protein, 9 aa, Tick-borne encephalitis virus
IPGLLRKGK

SEQ ID NO: 187994 - protein, 9 aa, Tick-borne encephalitis virus
RVSWKSWGH

SEQ ID NO: 187995 - protein, 9 aa, Tick-borne encephalitis virus
VSWRSWGHS

SEQ ID NO: 187996 - protein, 9 aa, Tick-borne encephalitis virus
SWGQAMIWS

SEQ ID NO: 187997 - protein, 9 aa, Tick-borne encephalitis virus
SIIWSIPEA

SEQ ID NO: 187998 - protein, 9 aa, Tick-borne encephalitis virus
IIWSIPEAP

SEQ ID NO: 187999 - protein, 9 aa, Tick-borne encephalitis virus
RFMVGIEGS

SEQ ID NO: 188000 - protein, 9 aa, Tick-borne encephalitis virus
VFLDFRQEA

SEQ ID NO: 188001 - protein, 9 aa, Tick-borne encephalitis virus
FLDFRQEAT

SEQ ID NO: 188002 - protein, 9 aa, Tick-borne encephalitis virus
LDFRQEATH

SEQ ID NO: 188003 - protein, 9 aa, Tick-borne encephalitis virus
QSLWMKSMK

SEQ ID NO: 188004 - protein, 9 aa, Tick-borne encephalitis virus
SLWMKSMKN

SEQ ID NO: 188005 - protein, 9 aa, Tick-borne encephalitis virus
LWMKSMKND

SEQ ID NO: 188006 - protein, 9 aa, Tick-borne encephalitis virus
WMKSMKNDT

SEQ ID NO: 188007 - protein, 9 aa, Tick-borne encephalitis virus
MKSMKNDTG

SEQ ID NO: 188008 - protein, 9 aa, Tick-borne encephalitis virus
KSMKNDTGT

SEQ ID NO: 188009 - protein, 9 aa, Tick-borne encephalitis virus
SVRNETGTY

SEQ ID NO: 188010 - protein, 9 aa, Tick-borne encephalitis virus
VRNETGTYI

SEQ ID NO: 188011 - protein, 9 aa, Tick-borne encephalitis virus
NPEVVDSEL

SEQ ID NO: 188012 - protein, 9 aa, Tick-borne encephalitis virus
PEVVDSELF

SEQ ID NO: 188013 - protein, 9 aa, Tick-borne encephalitis virus
QVKGPWKYL

SEQ ID NO: 188014 - protein, 9 aa, Tick-borne encephalitis virus
VKGPWKYLP

SEQ ID NO: 188015 - protein, 9 aa, Tick-borne encephalitis virus
KGPWKYLPI

SEQ ID NO: 188016 - protein, 9 aa, Tick-borne encephalitis virus
GPWKYLPIR

SEQ ID NO: 188017 - protein, 9 aa, Tick-borne encephalitis virus
PWKYLPIRV

SEQ ID NO: 188018 - protein, 9 aa, Tick-borne encephalitis virus
IREECPGTR

SEQ ID NO: 188019 - protein, 9 aa, Tick-borne encephalitis virus
RGECPGTKV

SEQ ID NO: 188020 - protein, 9 aa, Tick-borne encephalitis virus
ECPGTRVII

SEQ ID NO: 188021 - protein, 9 aa, Tick-borne encephalitis virus
ISADCDRRG

SEQ ID NO: 188022 - protein, 9 aa, Tick-borne encephalitis virus
TADCDKRGA

SEQ ID NO: 188023 - protein, 9 aa, Tick-borne encephalitis virus
RRRPSTGST

SEQ ID NO: 188024 - protein, 9 aa, Tick-borne encephalitis virus
RRPSTGSTV

SEQ ID NO: 188025 - protein, 9 aa, Tick-borne encephalitis virus
RPSTGSTVV

SEQ ID NO: 188026 - protein, 9 aa, Tick-borne encephalitis virus
PSTGSTVVW

SEQ ID NO: 188027 - protein, 9 aa, Tick-borne encephalitis virus
STGSTVVWG

SEQ ID NO: 188028 - protein, 9 aa, Tick-borne encephalitis virus
TGTTAVWGG

SEQ ID NO: 188029 - protein, 9 aa, Tick-borne encephalitis virus
WGGIVVFAL

SEQ ID NO: 188030 - protein, 9 aa, Tick-borne encephalitis virus
GGLIVLALL

SEQ ID NO: 188031 - protein, 9 aa, Tick-borne encephalitis virus
GLIVLALLV

SEQ ID NO: 188032 - protein, 9 aa, Tick-borne encephalitis virus
LIVLALLVT

SEQ ID NO: 188033 - protein, 9 aa, Tick-borne encephalitis virus
ALLVTGMVK

SEQ ID NO: 188034 - protein, 9 aa, Tick-borne encephalitis virus
VKVESLVRY

SEQ ID NO: 188035 - protein, 9 aa, Tick-borne encephalitis virus
KVESLVRYV

SEQ ID NO: 188036 - protein, 9 aa, Tick-borne encephalitis virus
LSAFALRRN

SEQ ID NO: 188037 - protein, 9 aa, Tick-borne encephalitis virus
SAFALRRNL

SEQ ID NO: 188038 - protein, 9 aa, Tick-borne encephalitis virus
AFALRRNLT

SEQ ID NO: 188039 - protein, 9 aa, Tick-borne encephalitis virus
FALRRNLTV

SEQ ID NO: 188040 - protein, 9 aa, Tick-borne encephalitis virus
ALRRNLTVR

SEQ ID NO: 188041 - protein, 9 aa, Tick-borne encephalitis virus
LRRNLTVRE

SEQ ID NO: 188042 - protein, 9 aa, Tick-borne encephalitis virus
RRNLTVREM

SEQ ID NO: 188043 - protein, 9 aa, Tick-borne encephalitis virus
RNLTVREMV

SEQ ID NO: 188044 - protein, 9 aa, Tick-borne encephalitis virus
SLTVREMVI

SEQ ID NO: 188045 - protein, 9 aa, Tick-borne encephalitis virus
CTAEGKAGV

SEQ ID NO: 188046 - protein, 9 aa, Tick-borne encephalitis virus
TAEGKTGVG

SEQ ID NO: 188047 - protein, 9 aa, Tick-borne encephalitis virus
AEGKTGVGL

SEQ ID NO: 188048 - protein, 9 aa, Tick-borne encephalitis virus
EGKTGVGLL

SEQ ID NO: 188049 - protein, 9 aa, Tick-borne encephalitis virus
GKTGVGLLL

SEQ ID NO: 188050 - protein, 9 aa, Tick-borne encephalitis virus
AGVGLLLMP

SEQ ID NO: 188051 - protein, 9 aa, Tick-borne encephalitis virus
VGLLLMPLL

SEQ ID NO: 188052 - protein, 9 aa, Tick-borne encephalitis virus
LLMPLLTKR

SEQ ID NO: 188053 - protein, 9 aa, Tick-borne encephalitis virus
LMPLLTKRG

SEQ ID NO: 188054 - protein, 9 aa, Tick-borne encephalitis virus
VHYGLIFFL

SEQ ID NO: 188055 - protein, 9 aa, Tick-borne encephalitis virus
HYGLIFFLS

SEQ ID NO: 188056 - protein, 9 aa, Tick-borne encephalitis virus
WRLLRGHRE

SEQ ID NO: 188057 - protein, 9 aa, Tick-borne encephalitis virus
RLLRGHREQ

SEQ ID NO: 188058 - protein, 9 aa, Tick-borne encephalitis virus
LLEGHREQK

SEQ ID NO: 188059 - protein, 9 aa, Tick-borne encephalitis virus
LEGHREQKG

SEQ ID NO: 188060 - protein, 9 aa, Tick-borne encephalitis virus
REQKGLSWT

SEQ ID NO: 188061 - protein, 9 aa, Tick-borne encephalitis virus
EQKGLSWTV

SEQ ID NO: 188062 - protein, 9 aa, Tick-borne encephalitis virus
QKGLSWTVP

SEQ ID NO: 188063 - protein, 9 aa, Tick-borne encephalitis virus
KGLSWTVPL

SEQ ID NO: 188064 - protein, 9 aa, Tick-borne encephalitis virus
GLSWTVPLA

SEQ ID NO: 188065 - protein, 9 aa, Tick-borne encephalitis virus
VPMARLLGG

SEQ ID NO: 188066 - protein, 9 aa, Tick-borne encephalitis virus
PLAGLVGGE

SEQ ID NO: 188067 - protein, 9 aa, Tick-borne encephalitis virus
MARLLGGEG

SEQ ID NO: 188068 - protein, 9 aa, Tick-borne encephalitis virus
AGLVGGEGS

SEQ ID NO: 188069 - protein, 9 aa, Tick-borne encephalitis virus
GLVGGEGSG

SEQ ID NO: 188070 - protein, 9 aa, Tick-borne encephalitis virus
LVGGEGSGI

SEQ ID NO: 188071 - protein, 9 aa, Tick-borne encephalitis virus
VGGEGSGIR

SEQ ID NO: 188072 - protein, 9 aa, Tick-borne encephalitis virus
SGRRRSFSE

SEQ ID NO: 188073 - protein, 9 aa, Tick-borne encephalitis virus
AGLSASAFH

SEQ ID NO: 188074 - protein, 9 aa, Tick-borne encephalitis virus
GLSASAFHW

SEQ ID NO: 188075 - protein, 9 aa, Tick-borne encephalitis virus
LAASALHWS

SEQ ID NO: 188076 - protein, 9 aa, Tick-borne encephalitis virus
SASAFHWSG

SEQ ID NO: 188077 - protein, 9 aa, Tick-borne encephalitis virus
ASALHWSGI

SEQ ID NO: 188078 - protein, 9 aa, Tick-borne encephalitis virus
SALHWSGIL

SEQ ID NO: 188079 - protein, 9 aa, Tick-borne encephalitis virus
AIHWSGIIG

SEQ ID NO: 188080 - protein, 9 aa, Tick-borne encephalitis virus
IHWSGIIGV

SEQ ID NO: 188081 - protein, 9 aa, Tick-borne encephalitis virus
GLWTLTKML

SEQ ID NO: 188082 - protein, 9 aa, Tick-borne encephalitis virus
LWTLTKMLR

SEQ ID NO: 188083 - protein, 9 aa, Tick-borne encephalitis virus
ARRSDLAFS

SEQ ID NO: 188084 - protein, 9 aa, Tick-borne encephalitis virus
DLVFSGQGR

SEQ ID NO: 188085 - protein, 9 aa, Tick-borne encephalitis virus
LVFSGQGNR

SEQ ID NO: 188086 - protein, 9 aa, Tick-borne encephalitis virus
AFSGQGGRE

SEQ ID NO: 188087 - protein, 9 aa, Tick-borne encephalitis virus
QGRGERGDK

SEQ ID NO: 188088 - protein, 9 aa, Tick-borne encephalitis virus
GNRERGDRP

SEQ ID NO: 188089 - protein, 9 aa, Tick-borne encephalitis virus
NRERGDRPF

SEQ ID NO: 188090 - protein, 9 aa, Tick-borne encephalitis virus
RGDKPFEVR

SEQ ID NO: 188091 - protein, 9 aa, Tick-borne encephalitis virus
GDKPFEVRD

SEQ ID NO: 188092 - protein, 9 aa, Tick-borne encephalitis virus
DKPFEVRDG

SEQ ID NO: 188093 - protein, 9 aa, Tick-borne encephalitis virus
KPFEVRDGV

SEQ ID NO: 188094 - protein, 9 aa, Tick-borne encephalitis virus
SPGLFWGQS

SEQ ID NO: 188095 - protein, 9 aa, Tick-borne encephalitis virus
PGLFWGQSQ

SEQ ID NO: 188096 - protein, 9 aa, Tick-borne encephalitis virus
GLFWGQRQV

SEQ ID NO: 188097 - protein, 9 aa, Tick-borne encephalitis virus
LFWGQRQVG

SEQ ID NO: 188098 - protein, 9 aa, Tick-borne encephalitis virus
FWGQSQVGV

SEQ ID NO: 188099 - protein, 9 aa, Tick-borne encephalitis virus
SQVGVGYGS

SEQ ID NO: 188100 - protein, 9 aa, Tick-borne encephalitis virus
TRGAALYID

SEQ ID NO: 188101 - protein, 9 aa, Tick-borne encephalitis virus
RGAALYIDD

SEQ ID NO: 188102 - protein, 9 aa, Tick-borne encephalitis virus
GAALSVDDA

SEQ ID NO: 188103 - protein, 9 aa, Tick-borne encephalitis virus
AALYIDDAV

SEQ ID NO: 188104 - protein, 9 aa, Tick-borne encephalitis virus
ALSVDDAVV

SEQ ID NO: 188105 - protein, 9 aa, Tick-borne encephalitis virus
LYIDDAVAG

SEQ ID NO: 188106 - protein, 9 aa, Tick-borne encephalitis virus
SIDDAVVGP

SEQ ID NO: 188107 - protein, 9 aa, Tick-borne encephalitis virus
IDDAVVGPY

SEQ ID NO: 188108 - protein, 9 aa, Tick-borne encephalitis virus
AVAGPYWAE

SEQ ID NO: 188109 - protein, 9 aa, Tick-borne encephalitis virus
VAGPYWSDV

SEQ ID NO: 188110 - protein, 9 aa, Tick-borne encephalitis virus
AGPYWSDVR

SEQ ID NO: 188111 - protein, 9 aa, Tick-borne encephalitis virus
GPYWSDVRE

SEQ ID NO: 188112 - protein, 9 aa, Tick-borne encephalitis virus
PYWAEVKED

SEQ ID NO: 188113 - protein, 9 aa, Tick-borne encephalitis virus
YWAEVKEDV

SEQ ID NO: 188114 - protein, 9 aa, Tick-borne encephalitis virus
WAEVKEDVV

SEQ ID NO: 188115 - protein, 9 aa, Tick-borne encephalitis virus
AEVKEDVVC

SEQ ID NO: 188116 - protein, 9 aa, Tick-borne encephalitis virus
GAVLIDLSK

SEQ ID NO: 188117 - protein, 9 aa, Tick-borne encephalitis virus
AVLIDLSKG

SEQ ID NO: 188118 - protein, 9 aa, Tick-borne encephalitis virus
VLIDLSKGT

SEQ ID NO: 188119 - protein, 9 aa, Tick-borne encephalitis virus
AKGTSGSPT

SEQ ID NO: 188120 - protein, 9 aa, Tick-borne encephalitis virus
KGTSRSPIL

SEQ ID NO: 188121 - protein, 9 aa, Tick-borne encephalitis virus
GTSGSPTLN

SEQ ID NO: 188122 - protein, 9 aa, Tick-borne encephalitis virus
TSGSPTLNS

SEQ ID NO: 188123 - protein, 9 aa, Tick-borne encephalitis virus
SRSPILNAQ

SEQ ID NO: 188124 - protein, 9 aa, Tick-borne encephalitis virus
RSPILNAQG

SEQ ID NO: 188125 - protein, 9 aa, Tick-borne encephalitis virus
SPIINSQGV

SEQ ID NO: 188126 - protein, 9 aa, Tick-borne encephalitis virus
PIINSQGVV

SEQ ID NO: 188127 - protein, 9 aa, Tick-borne encephalitis virus
IINSQGVVV

SEQ ID NO: 188128 - protein, 9 aa, Tick-borne encephalitis virus
INSQGVVVG

SEQ ID NO: 188129 - protein, 9 aa, Tick-borne encephalitis virus
GEAERSRPN

SEQ ID NO: 188130 - protein, 9 aa, Tick-borne encephalitis virus
EAEKSRPSL

SEQ ID NO: 188131 - protein, 9 aa, Tick-borne encephalitis virus
AEKSRPSLP

SEQ ID NO: 188132 - protein, 9 aa, Tick-borne encephalitis virus
ERSRPNLPQ

SEQ ID NO: 188133 - protein, 9 aa, Tick-borne encephalitis virus
KSRPSLPPA

SEQ ID NO: 188134 - protein, 9 aa, Tick-borne encephalitis virus
GIGWTAKGQ

SEQ ID NO: 188135 - protein, 9 aa, Tick-borne encephalitis virus
IGWTAKGQI

SEQ ID NO: 188136 - protein, 9 aa, Tick-borne encephalitis virus
VRFHSPVVG

SEQ ID NO: 188137 - protein, 9 aa, Tick-borne encephalitis virus
RFHSPVVGD

SEQ ID NO: 188138 - protein, 9 aa, Tick-borne encephalitis virus
FLSPAVSDQ

SEQ ID NO: 188139 - protein, 9 aa, Tick-borne encephalitis virus
HSPVVGDQQ

SEQ ID NO: 188140 - protein, 9 aa, Tick-borne encephalitis virus
DQQMGGAIV

SEQ ID NO: 188141 - protein, 9 aa, Tick-borne encephalitis virus
QQMGGAIVD

SEQ ID NO: 188142 - protein, 9 aa, Tick-borne encephalitis virus
NRGITSEVK

SEQ ID NO: 188143 - protein, 9 aa, Tick-borne encephalitis virus
RGITSEVKQ

SEQ ID NO: 188144 - protein, 9 aa, Tick-borne encephalitis virus
GITSEVKQI

SEQ ID NO: 188145 - protein, 9 aa, Tick-borne encephalitis virus
ITSEVKQIP

SEQ ID NO: 188146 - protein, 9 aa, Tick-borne encephalitis virus
SEVKQIPEG

SEQ ID NO: 188147 - protein, 9 aa, Tick-borne encephalitis virus
EERQIPNGE

SEQ ID NO: 188148 - protein, 9 aa, Tick-borne encephalitis virus
VKQIPEGEW

SEQ ID NO: 188149 - protein, 9 aa, Tick-borne encephalitis virus
RQIPNGEWR

SEQ ID NO: 188150 - protein, 9 aa, Tick-borne encephalitis virus
VPSIVKGGI

SEQ ID NO: 188151 - protein, 9 aa, Tick-borne encephalitis virus
PSIVKGGII

SEQ ID NO: 188152 - protein, 9 aa, Tick-borne encephalitis virus
SIVKGGIIA

SEQ ID NO: 188153 - protein, 9 aa, Tick-borne encephalitis virus
IVKGGIIAR

SEQ ID NO: 188154 - protein, 9 aa, Tick-borne encephalitis virus
VKGGIIART

SEQ ID NO: 188155 - protein, 9 aa, Tick-borne encephalitis virus
KGGIIARAL

SEQ ID NO: 188156 - protein, 9 aa, Tick-borne encephalitis virus
GGIIARALR

SEQ ID NO: 188157 - protein, 9 aa, Tick-borne encephalitis virus
GIIARALRQ

SEQ ID NO: 188158 - protein, 9 aa, Tick-borne encephalitis virus
IIARALRQK

SEQ ID NO: 188159 - protein, 9 aa, Tick-borne encephalitis virus
RVGRQEGRI

SEQ ID NO: 188160 - protein, 9 aa, Tick-borne encephalitis virus
VGRQEGRID

SEQ ID NO: 188161 - protein, 9 aa, Tick-borne encephalitis virus
GRQEGRIDE

SEQ ID NO: 188162 - protein, 9 aa, Tick-borne encephalitis virus
RQEGRIDEY

SEQ ID NO: 188163 - protein, 9 aa, Tick-borne encephalitis virus
QEGRIDEYI

SEQ ID NO: 188164 - protein, 9 aa, Tick-borne encephalitis virus
GQCDDDDSV

SEQ ID NO: 188165 - protein, 9 aa, Tick-borne encephalitis virus
QCDEYDSGL

SEQ ID NO: 188166 - protein, 9 aa, Tick-borne encephalitis virus
CDEYDSGLV

SEQ ID NO: 188167 - protein, 9 aa, Tick-borne encephalitis virus
DEYDSGLVQ

SEQ ID NO: 188168 - protein, 9 aa, Tick-borne encephalitis virus
DDDGGLVQW

SEQ ID NO: 188169 - protein, 9 aa, Tick-borne encephalitis virus
YDSGLVQWK

SEQ ID NO: 188170 - protein, 9 aa, Tick-borne encephalitis virus
SGLVQWKEG

SEQ ID NO: 188171 - protein, 9 aa, Tick-borne encephalitis virus
GQILLDNIT

SEQ ID NO: 188172 - protein, 9 aa, Tick-borne encephalitis virus
NVSGVTSRN

SEQ ID NO: 188173 - protein, 9 aa, Tick-borne encephalitis virus
VSGVTSRNW

SEQ ID NO: 188174 - protein, 9 aa, Tick-borne encephalitis virus
SSVTSRSWT

SEQ ID NO: 188175 - protein, 9 aa, Tick-borne encephalitis virus
SVTSRSWTW

SEQ ID NO: 188176 - protein, 9 aa, Tick-borne encephalitis virus
NAVDEASGG

SEQ ID NO: 188177 - protein, 9 aa, Tick-borne encephalitis virus
AVDEASGGL

SEQ ID NO: 188178 - protein, 9 aa, Tick-borne encephalitis virus
ASGGLVTFR

SEQ ID NO: 188179 - protein, 9 aa, Tick-borne encephalitis virus
SGGLVTFRS

SEQ ID NO: 188180 - protein, 9 aa, Tick-borne encephalitis virus
LMHEKPDSR

SEQ ID NO: 188181 - protein, 9 aa, Tick-borne encephalitis virus
MHEKPDSRA

SEQ ID NO: 188182 - protein, 9 aa, Tick-borne encephalitis virus
HEKPDSRAM

SEQ ID NO: 188183 - protein, 9 aa, Tick-borne encephalitis virus
EKPDSRAMR

SEQ ID NO: 188184 - protein, 9 aa, Tick-borne encephalitis virus
EPGSSAMRM

SEQ ID NO: 188185 - protein, 9 aa, Tick-borne encephalitis virus
PDSRAMRMA

SEQ ID NO: 188186 - protein, 9 aa, Tick-borne encephalitis virus
GSSAMRMAE

SEQ ID NO: 188187 - protein, 9 aa, Tick-borne encephalitis virus
APEAFLTVA

SEQ ID NO: 188188 - protein, 9 aa, Tick-borne encephalitis virus
PEAFLTLVE

SEQ ID NO: 188189 - protein, 9 aa, Tick-borne encephalitis virus
VEMMVLGLG

SEQ ID NO: 188190 - protein, 9 aa, Tick-borne encephalitis virus
EMMVLGLGT

SEQ ID NO: 188191 - protein, 9 aa, Tick-borne encephalitis virus
MMVLGLGTL

SEQ ID NO: 188192 - protein, 9 aa, Tick-borne encephalitis virus
VVWCFVVRA

SEQ ID NO: 188193 - protein, 9 aa, Tick-borne encephalitis virus
VWCFVARTS

SEQ ID NO: 188194 - protein, 9 aa, Tick-borne encephalitis virus
VLLWAGGVS

SEQ ID NO: 188195 - protein, 9 aa, Tick-borne encephalitis virus
KTKADLSAV

SEQ ID NO: 188196 - protein, 9 aa, Tick-borne encephalitis virus
ADLSAVLWS

SEQ ID NO: 188197 - protein, 9 aa, Tick-borne encephalitis virus
EVRSWEEWT

SEQ ID NO: 188198 - protein, 9 aa, Tick-borne encephalitis virus
MRSWEEWTN

SEQ ID NO: 188199 - protein, 9 aa, Tick-borne encephalitis virus
DLGGGAPFI

SEQ ID NO: 188200 - protein, 9 aa, Tick-borne encephalitis virus
LGGGAPFIG

SEQ ID NO: 188201 - protein, 9 aa, Tick-borne encephalitis virus
GGGAPFLGV

SEQ ID NO: 188202 - protein, 9 aa, Tick-borne encephalitis virus
GGAPFFGIA

SEQ ID NO: 188203 - protein, 9 aa, Tick-borne encephalitis virus
GAPFIGVAG

SEQ ID NO: 188204 - protein, 9 aa, Tick-borne encephalitis virus
APFLGVAGH

SEQ ID NO: 188205 - protein, 9 aa, Tick-borne encephalitis virus
PFLGVAGHV

SEQ ID NO: 188206 - protein, 9 aa, Tick-borne encephalitis virus
FLGVAGHVM

SEQ ID NO: 188207 - protein, 9 aa, Tick-borne encephalitis virus
GVAGHVMSL

SEQ ID NO: 188208 - protein, 9 aa, Tick-borne encephalitis virus
VAGHVMSLG

SEQ ID NO: 188209 - protein, 9 aa, Tick-borne encephalitis virus
AGHVMSLGV

SEQ ID NO: 188210 - protein, 9 aa, Tick-borne encephalitis virus
GHVMSLGVV

SEQ ID NO: 188211 - protein, 9 aa, Tick-borne encephalitis virus
HVMSLGVVS

SEQ ID NO: 188212 - protein, 9 aa, Tick-borne encephalitis virus
VMSLGVVSL

SEQ ID NO: 188213 - protein, 9 aa, Tick-borne encephalitis virus
MSLGVVSLV

SEQ ID NO: 188214 - protein, 9 aa, Tick-borne encephalitis virus
RRMSLVLAI

SEQ ID NO: 188215 - protein, 9 aa, Tick-borne encephalitis virus
MSLVLATVL

SEQ ID NO: 188216 - protein, 9 aa, Tick-borne encephalitis virus
SLVLATVLC

SEQ ID NO: 188217 - protein, 9 aa, Tick-borne encephalitis virus
LVLATVLCL

SEQ ID NO: 188218 - protein, 9 aa, Tick-borne encephalitis virus
VLCLISVVM

SEQ ID NO: 188219 - protein, 9 aa, Tick-borne encephalitis virus
MSVVMNRTM

SEQ ID NO: 188220 - protein, 9 aa, Tick-borne encephalitis virus
SVVMNRTMA

SEQ ID NO: 188221 - protein, 9 aa, Tick-borne encephalitis virus
VVMNRTMAS

SEQ ID NO: 188222 - protein, 9 aa, Tick-borne encephalitis virus
VMNRTMASI

SEQ ID NO: 188223 - protein, 9 aa, Tick-borne encephalitis virus
MNRTMASIT

SEQ ID NO: 188224 - protein, 9 aa, Tick-borne encephalitis virus
NRTVLSITE

SEQ ID NO: 188225 - protein, 9 aa, Tick-borne encephalitis virus
RTVLSITEA

SEQ ID NO: 188226 - protein, 9 aa, Tick-borne encephalitis virus
TMASITEAS

SEQ ID NO: 188227 - protein, 9 aa, Tick-borne encephalitis virus
MASITEASA

SEQ ID NO: 188228 - protein, 9 aa, Tick-borne encephalitis virus
LSITEASAV

SEQ ID NO: 188229 - protein, 9 aa, Tick-borne encephalitis virus
ASAVGLAAL

SEQ ID NO: 188230 - protein, 9 aa, Tick-borne encephalitis virus
SAVGLAALG

SEQ ID NO: 188231 - protein, 9 aa, Tick-borne encephalitis virus
LAALGQLLR

SEQ ID NO: 188232 - protein, 9 aa, Tick-borne encephalitis virus
AALGQLLRP

SEQ ID NO: 188233 - protein, 9 aa, Tick-borne encephalitis virus
AAGQLLKPE

SEQ ID NO: 188234 - protein, 9 aa, Tick-borne encephalitis virus
GQLLRPEED

SEQ ID NO: 188235 - protein, 9 aa, Tick-borne encephalitis virus
QLLRPEEDT

SEQ ID NO: 188236 - protein, 9 aa, Tick-borne encephalitis virus
LLKPEADTL

SEQ ID NO: 188237 - protein, 9 aa, Tick-borne encephalitis virus
LRPEEDTLW

SEQ ID NO: 188238 - protein, 9 aa, Tick-borne encephalitis virus
RPEEDTLWT

SEQ ID NO: 188239 - protein, 9 aa, Tick-borne encephalitis virus
ACGLSGVVT

SEQ ID NO: 188240 - protein, 9 aa, Tick-borne encephalitis virus
CGLSGVVTG

SEQ ID NO: 188241 - protein, 9 aa, Tick-borne encephalitis virus
GLSGVVTGS

SEQ ID NO: 188242 - protein, 9 aa, Tick-borne encephalitis virus
LSGVVTGSL

SEQ ID NO: 188243 - protein, 9 aa, Tick-borne encephalitis virus
SGSRRGGSD

SEQ ID NO: 188244 - protein, 9 aa, Tick-borne encephalitis virus
GSRRGGSDG

SEQ ID NO: 188245 - protein, 9 aa, Tick-borne encephalitis virus
SRRGGSDGD

SEQ ID NO: 188246 - protein, 9 aa, Tick-borne encephalitis virus
LNSCTREEF

SEQ ID NO: 188247 - protein, 9 aa, Tick-borne encephalitis virus
NSCTREEFF

SEQ ID NO: 188248 - protein, 9 aa, Tick-borne encephalitis virus
SCTREEFFI

SEQ ID NO: 188249 - protein, 9 aa, Tick-borne encephalitis virus
CTREEFFIY

SEQ ID NO: 188250 - protein, 9 aa, Tick-borne encephalitis virus
TREEFFIYR

SEQ ID NO: 188251 - protein, 9 aa, Tick-borne encephalitis virus
REEFFIYRR

SEQ ID NO: 188252 - protein, 9 aa, Tick-borne encephalitis virus
EEFFVYRRA

SEQ ID NO: 188253 - protein, 9 aa, Tick-borne encephalitis virus
EFFVYRRAG

SEQ ID NO: 188254 - protein, 9 aa, Tick-borne encephalitis virus
FFIYRRTGI

SEQ ID NO: 188255 - protein, 9 aa, Tick-borne encephalitis virus
FVYRRTGIM

SEQ ID NO: 188256 - protein, 9 aa, Tick-borne encephalitis virus
VYRRTGIME

SEQ ID NO: 188257 - protein, 9 aa, Tick-borne encephalitis virus
DKARELLKK

SEQ ID NO: 188258 - protein, 9 aa, Tick-borne encephalitis virus
KARELLKRG

SEQ ID NO: 188259 - protein, 9 aa, Tick-borne encephalitis virus
ARELLKRGE

SEQ ID NO: 188260 - protein, 9 aa, Tick-borne encephalitis virus
RELLKKGET

SEQ ID NO: 188261 - protein, 9 aa, Tick-borne encephalitis virus
ELLKKGETN

SEQ ID NO: 188262 - protein, 9 aa, Tick-borne encephalitis virus
RGETNVGLA

SEQ ID NO: 188263 - protein, 9 aa, Tick-borne encephalitis virus
SRPAVMNVR

SEQ ID NO: 188264 - protein, 9 aa, Tick-borne encephalitis virus
RPAVMNVRA

SEQ ID NO: 188265 - protein, 9 aa, Tick-borne encephalitis virus
PAVMNVRAY

SEQ ID NO: 188266 - protein, 9 aa, Tick-borne encephalitis virus
AVMNVRAYT

SEQ ID NO: 188267 - protein, 9 aa, Tick-borne encephalitis virus
VKAYTIGGR

SEQ ID NO: 188268 - protein, 9 aa, Tick-borne encephalitis virus
KAYTIGGRG

SEQ ID NO: 188269 - protein, 9 aa, Tick-borne encephalitis virus
TIGGRGHET

SEQ ID NO: 188270 - protein, 9 aa, Tick-borne encephalitis virus
IGGRGHETP

SEQ ID NO: 188271 - protein, 9 aa, Tick-borne encephalitis virus
GGRGHETPK

SEQ ID NO: 188272 - protein, 9 aa, Tick-borne encephalitis virus
GKGHETPRM

SEQ ID NO: 188273 - protein, 9 aa, Tick-borne encephalitis virus
RGHETPKMV

SEQ ID NO: 188274 - protein, 9 aa, Tick-borne encephalitis virus
VMCDIGESN

SEQ ID NO: 188275 - protein, 9 aa, Tick-borne encephalitis virus
VVEGEKTRK

SEQ ID NO: 188276 - protein, 9 aa, Tick-borne encephalitis virus
WKIRNPTAT

SEQ ID NO: 188277 - protein, 9 aa, Tick-borne encephalitis virus
KNRNPAAAC

SEQ ID NO: 188278 - protein, 9 aa, Tick-borne encephalitis virus
IRNPTATCV

SEQ ID NO: 188279 - protein, 9 aa, Tick-borne encephalitis virus
ETLHRFQLQ

SEQ ID NO: 188280 - protein, 9 aa, Tick-borne encephalitis virus
TLHRFQLQW

SEQ ID NO: 188281 - protein, 9 aa, Tick-borne encephalitis virus
RCVFLAEDK

SEQ ID NO: 188282 - protein, 9 aa, Tick-borne encephalitis virus
CVFLAEDKV

SEQ ID NO: 188283 - protein, 9 aa, Tick-borne encephalitis virus
VFLAEDKVK

SEQ ID NO: 188284 - protein, 9 aa, Tick-borne encephalitis virus
FLAEDKVKE

SEQ ID NO: 188285 - protein, 9 aa, Tick-borne encephalitis virus
LAEDKVREK

SEQ ID NO: 188286 - protein, 9 aa, Tick-borne encephalitis virus
AEDKVREKD

SEQ ID NO: 188287 - protein, 9 aa, Tick-borne encephalitis virus
EDKVREKDV

SEQ ID NO: 188288 - protein, 9 aa, Tick-borne encephalitis virus
DKVREKDVQ

SEQ ID NO: 188289 - protein, 9 aa, Tick-borne encephalitis virus
KVREKDVQE

SEQ ID NO: 188290 - protein, 9 aa, Tick-borne encephalitis virus
VKEQDVRER

SEQ ID NO: 188291 - protein, 9 aa, Tick-borne encephalitis virus
KEQDVRERI

SEQ ID NO: 188292 - protein, 9 aa, Tick-borne encephalitis virus
DVRERIRAL

SEQ ID NO: 188293 - protein, 9 aa, Tick-borne encephalitis virus
ERIKALREQ

SEQ ID NO: 188294 - protein, 9 aa, Tick-borne encephalitis virus
RINALREQY

SEQ ID NO: 188295 - protein, 9 aa, Tick-borne encephalitis virus
NGEHPYRTW

SEQ ID NO: 188296 - protein, 9 aa, Tick-borne encephalitis virus
AEHPYRTWQ

SEQ ID NO: 188297 - protein, 9 aa, Tick-borne encephalitis virus
WILERLAQR

SEQ ID NO: 188298 - protein, 9 aa, Tick-borne encephalitis virus
ILERLARKN

SEQ ID NO: 188299 - protein, 9 aa, Tick-borne encephalitis virus
RPRMCSREE

SEQ ID NO: 188300 - protein, 9 aa, Tick-borne encephalitis virus
NAALGAWSN

SEQ ID NO: 188301 - protein, 9 aa, Tick-borne encephalitis virus
WSEEQNRWS

SEQ ID NO: 188302 - protein, 9 aa, Tick-borne encephalitis virus
GAREAVEDP

SEQ ID NO: 188303 - protein, 9 aa, Tick-borne encephalitis virus
AVEDPAFWR

SEQ ID NO: 188304 - protein, 9 aa, Tick-borne encephalitis virus
VEDPAFWRL

SEQ ID NO: 188305 - protein, 9 aa, Tick-borne encephalitis virus
EDPAFWRLV

SEQ ID NO: 188306 - protein, 9 aa, Tick-borne encephalitis virus
DPAFWRLVD

SEQ ID NO: 188307 - protein, 9 aa, Tick-borne encephalitis virus
PAFWRLVDE

SEQ ID NO: 188308 - protein, 9 aa, Tick-borne encephalitis virus
AFWRLVDEE

SEQ ID NO: 188309 - protein, 9 aa, Tick-borne encephalitis virus
FWKLVDEER

SEQ ID NO: 188310 - protein, 9 aa, Tick-borne encephalitis virus
WKLVDEERE

SEQ ID NO: 188311 - protein, 9 aa, Tick-borne encephalitis virus
KLVDEERER

SEQ ID NO: 188312 - protein, 9 aa, Tick-borne encephalitis virus
DEERERDLA

SEQ ID NO: 188313 - protein, 9 aa, Tick-borne encephalitis virus
EERERHLTG

SEQ ID NO: 188314 - protein, 9 aa, Tick-borne encephalitis virus
ERERDLAGR

SEQ ID NO: 188315 - protein, 9 aa, Tick-borne encephalitis virus
RERDLAGRS

SEQ ID NO: 188316 - protein, 9 aa, Tick-borne encephalitis virus
ERHLTGRCA

SEQ ID NO: 188317 - protein, 9 aa, Tick-borne encephalitis virus
RHLTGRCAH

SEQ ID NO: 188318 - protein, 9 aa, Tick-borne encephalitis virus
HLTGRCAHC

SEQ ID NO: 188319 - protein, 9 aa, Tick-borne encephalitis virus
LAGRSAHGV

SEQ ID NO: 188320 - protein, 9 aa, Tick-borne encephalitis virus
GRSAHGVFN

SEQ ID NO: 188321 - protein, 9 aa, Tick-borne encephalitis virus
RCAHCAYNM

SEQ ID NO: 188322 - protein, 9 aa, Tick-borne encephalitis virus
CAHCAYNMM

SEQ ID NO: 188323 - protein, 9 aa, Tick-borne encephalitis virus
AHCAYNMMG

SEQ ID NO: 188324 - protein, 9 aa, Tick-borne encephalitis virus
HCAYNMMGK

SEQ ID NO: 188325 - protein, 9 aa, Tick-borne encephalitis virus
CAYNMMGKR

SEQ ID NO: 188326 - protein, 9 aa, Tick-borne encephalitis virus
AYNMMGKRE

SEQ ID NO: 188327 - protein, 9 aa, Tick-borne encephalitis virus
WASRESSGS

SEQ ID NO: 188328 - protein, 9 aa, Tick-borne encephalitis virus
ASRGFSGSG

SEQ ID NO: 188329 - protein, 9 aa, Tick-borne encephalitis virus
SRGFSGSGV

SEQ ID NO: 188330 - protein, 9 aa, Tick-borne encephalitis virus
RESSGSGVE

SEQ ID NO: 188331 - protein, 9 aa, Tick-borne encephalitis virus
GFSGSGVEG

SEQ ID NO: 188332 - protein, 9 aa, Tick-borne encephalitis virus
NYLGWYLKE

SEQ ID NO: 188333 - protein, 9 aa, Tick-borne encephalitis virus
YLGWHLKRL

SEQ ID NO: 188334 - protein, 9 aa, Tick-borne encephalitis virus
LGWYLKELS

SEQ ID NO: 188335 - protein, 9 aa, Tick-borne encephalitis virus
LSTPEGGLF

SEQ ID NO: 188336 - protein, 9 aa, Tick-borne encephalitis virus
STPEGGLFY

SEQ ID NO: 188337 - protein, 9 aa, Tick-borne encephalitis virus
TPEGGLFYA

SEQ ID NO: 188338 - protein, 9 aa, Tick-borne encephalitis virus
EHKQLAATV

SEQ ID NO: 188339 - protein, 9 aa, Tick-borne encephalitis virus
HKQLAATVM

SEQ ID NO: 188340 - protein, 9 aa, Tick-borne encephalitis virus
KQLAATVMQ

SEQ ID NO: 188341 - protein, 9 aa, Tick-borne encephalitis virus
EGEGVVEAS

SEQ ID NO: 188342 - protein, 9 aa, Tick-borne encephalitis virus
GEGVVEASD

SEQ ID NO: 188343 - protein, 9 aa, Tick-borne encephalitis virus
EGVVEASDA

SEQ ID NO: 188344 - protein, 9 aa, Tick-borne encephalitis virus
GVVEASDAH

SEQ ID NO: 188345 - protein, 9 aa, Tick-borne encephalitis virus
VVEASDAHN

SEQ ID NO: 188346 - protein, 9 aa, Tick-borne encephalitis virus
VEASDAHNP

SEQ ID NO: 188347 - protein, 9 aa, Tick-borne encephalitis virus
TDAHNPRLF

SEQ ID NO: 188348 - protein, 9 aa, Tick-borne encephalitis virus
LRVERWLRN

SEQ ID NO: 188349 - protein, 9 aa, Tick-borne encephalitis virus
RVERWLRDY

SEQ ID NO: 188350 - protein, 9 aa, Tick-borne encephalitis virus
VERWLRNHG

SEQ ID NO: 188351 - protein, 9 aa, Tick-borne encephalitis virus
NHGEERLGR

SEQ ID NO: 188352 - protein, 9 aa, Tick-borne encephalitis virus
GDDCVVRGI

SEQ ID NO: 188353 - protein, 9 aa, Tick-borne encephalitis virus
DDCVVRGID

SEQ ID NO: 188354 - protein, 9 aa, Tick-borne encephalitis virus
DCVVRGIDD

SEQ ID NO: 188355 - protein, 9 aa, Tick-borne encephalitis virus
CVVRGIDDR

SEQ ID NO: 188356 - protein, 9 aa, Tick-borne encephalitis virus
VVRGIDDRF

SEQ ID NO: 188357 - protein, 9 aa, Tick-borne encephalitis virus
VRPVDDRFG

SEQ ID NO: 188358 - protein, 9 aa, Tick-borne encephalitis virus
DDRFGRALY

SEQ ID NO: 188359 - protein, 9 aa, Tick-borne encephalitis virus
DRFGRALYF

SEQ ID NO: 188360 - protein, 9 aa, Tick-borne encephalitis virus
RFGRALYFL

SEQ ID NO: 188361 - protein, 9 aa, Tick-borne encephalitis virus
FGRALYFLN

SEQ ID NO: 188362 - protein, 9 aa, Tick-borne encephalitis virus
GRALYFLND

SEQ ID NO: 188363 - protein, 9 aa, Tick-borne encephalitis virus
EWEHSAGFA

SEQ ID NO: 188364 - protein, 9 aa, Tick-borne encephalitis virus
SWEAVPFCS

SEQ ID NO: 188365 - protein, 9 aa, Tick-borne encephalitis virus
VMKDGRALV

SEQ ID NO: 188366 - protein, 9 aa, Tick-borne encephalitis virus
MKDGRALVV

SEQ ID NO: 188367 - protein, 9 aa, Tick-borne encephalitis virus
KDGRALVVP

SEQ ID NO: 188368 - protein, 9 aa, Tick-borne encephalitis virus
DGRALVVPC

SEQ ID NO: 188369 - protein, 9 aa, Tick-borne encephalitis virus
GRALVVPCR

SEQ ID NO: 188370 - protein, 9 aa, Tick-borne encephalitis virus
RALVVPCRD

SEQ ID NO: 188371 - protein, 9 aa, Tick-borne encephalitis virus
ALVVPCRDQ

SEQ ID NO: 188372 - protein, 9 aa, Tick-borne encephalitis virus
LRTLGLAIS

SEQ ID NO: 188373 - protein, 9 aa, Tick-borne encephalitis virus
RTLGLTICS

SEQ ID NO: 188374 - protein, 9 aa, Tick-borne encephalitis virus
TLGLAISSA

SEQ ID NO: 188375 - protein, 9 aa, Tick-borne encephalitis virus
LGLAISSAV

SEQ ID NO: 188376 - protein, 9 aa, Tick-borne encephalitis virus
GLTICSAVP

SEQ ID NO: 188377 - protein, 9 aa, Tick-borne encephalitis virus
SAVPTDWVP

SEQ ID NO: 188378 - protein, 9 aa, Tick-borne encephalitis virus
AVPTDWVPT

SEQ ID NO: 188379 - protein, 9 aa, Tick-borne encephalitis virus
VPTDWVPTG

SEQ ID NO: 188380 - protein, 9 aa, Tick-borne encephalitis virus
PTDWVPTGR

SEQ ID NO: 188381 - protein, 9 aa, Tick-borne encephalitis virus
TDWVPTGRT

SEQ ID NO: 188382 - protein, 9 aa, Tick-borne encephalitis virus
SGAWITTED

SEQ ID NO: 188383 - protein, 9 aa, Tick-borne encephalitis virus
GSWMTTEDM

SEQ ID NO: 188384 - protein, 9 aa, Tick-borne encephalitis virus
SWMTTEDML

SEQ ID NO: 188385 - protein, 9 aa, Tick-borne encephalitis virus
DNPFMHGKE

SEQ ID NO: 188386 - protein, 9 aa, Tick-borne encephalitis virus
NPFMHGKEK

SEQ ID NO: 188387 - protein, 9 aa, Tick-borne encephalitis virus
RNVPYLPKA

SEQ ID NO: 188388 - protein, 9 aa, Tick-borne encephalitis virus
VPYLPKAHD

SEQ ID NO: 188389 - protein, 9 aa, Tick-borne encephalitis virus
RTERAEWAK

SEQ ID NO: 188390 - protein, 9 aa, Tick-borne encephalitis virus
TERAEWAKN

SEQ ID NO: 188391 - protein, 9 aa, Tick-borne encephalitis virus
AVEKVRKMV

SEQ ID NO: 188392 - protein, 9 aa, Tick-borne encephalitis virus
VEKVRKMMG

SEQ ID NO: 188393 - protein, 9 aa, Tick-borne encephalitis virus
KCKDYPSCM

SEQ ID NO: 188394 - protein, 9 aa, Tick-borne encephalitis virus
LHWELKLEG

SEQ ID NO: 188395 - protein, 9 aa, Tick-borne encephalitis virus
HWNLKLESS

SEQ ID NO: 188396 - protein, 9 aa, Tick-borne encephalitis virus
WNLKLESSI

SEQ ID NO: 188397 - protein, 9 aa, Tick-borne encephalitis virus
NLKLESSIF

SEQ ID NO: 188398 - protein, 9 aa, Tick-borne encephalitis virus
RRASKETAK

SEQ ID NO: 188399 - protein, 9 aa, Tick-borne encephalitis virus
RVSKEAAKK

SEQ ID NO: 188400 - protein, 9 aa, Tick-borne encephalitis virus
VSKEAAKKT

SEQ ID NO: 188401 - protein, 9 aa, Tick-borne encephalitis virus
SFWKPVPLK

SEQ ID NO: 188402 - protein, 9 aa, Tick-borne encephalitis virus
KPVPLKQAT

SEQ ID NO: 188403 - protein, 9 aa, Tick-borne encephalitis virus
PVPLKQATA

SEQ ID NO: 188404 - protein, 9 aa, Tick-borne encephalitis virus
RKIKMAVSA

SEQ ID NO: 188405 - protein, 9 aa, Tick-borne encephalitis virus
KIKRAVSTL

SEQ ID NO: 188406 - protein, 9 aa, Tick-borne encephalitis virus
IKKAVSALM

SEQ ID NO: 188407 - protein, 9 aa, Tick-borne encephalitis virus
AVSTLMIGL

SEQ ID NO: 188408 - protein, 9 aa, Tick-borne encephalitis virus
VGLQRREKK

SEQ ID NO: 188409 - protein, 9 aa, Tick-borne encephalitis virus
QRREKKRST

SEQ ID NO: 188410 - protein, 9 aa, Tick-borne encephalitis virus
FAATVRREG

SEQ ID NO: 188411 - protein, 9 aa, Tick-borne encephalitis virus
TVRREGDGT

SEQ ID NO: 188412 - protein, 9 aa, Tick-borne encephalitis virus
VRKERDDTT

SEQ ID NO: 188413 - protein, 9 aa, Tick-borne encephalitis virus
RKERDDTTV

SEQ ID NO: 188414 - protein, 9 aa, Tick-borne encephalitis virus
KERDDTTVI

SEQ ID NO: 188415 - protein, 9 aa, Tick-borne encephalitis virus
VVWMTVESV

SEQ ID NO: 188416 - protein, 9 aa, Tick-borne encephalitis virus
TVESVVTRT

SEQ ID NO: 188417 - protein, 9 aa, Tick-borne encephalitis virus
VVALLCLAP

SEQ ID NO: 188418 - protein, 9 aa, Tick-borne encephalitis virus
AIYQENPAQ

SEQ ID NO: 188419 - protein, 9 aa, Tick-borne encephalitis virus
SIVTCVKVS

SEQ ID NO: 188420 - protein, 9 aa, Tick-borne encephalitis virus
IVTCVKVSC

SEQ ID NO: 188421 - protein, 9 aa, Tick-borne encephalitis virus
VTCVKVSCE

SEQ ID NO: 188422 - protein, 9 aa, Tick-borne encephalitis virus
TCVKVSCEA

SEQ ID NO: 188423 - protein, 9 aa, Tick-borne encephalitis virus
HEGARNWNN

SEQ ID NO: 188424 - protein, 9 aa, Tick-borne encephalitis virus
EGVQNWNNA

SEQ ID NO: 188425 - protein, 9 aa, Tick-borne encephalitis virus
GARNWNNAE

SEQ ID NO: 188426 - protein, 9 aa, Tick-borne encephalitis virus
VQNWNNAER

SEQ ID NO: 188427 - protein, 9 aa, Tick-borne encephalitis virus
KTKFTWRRT

SEQ ID NO: 188428 - protein, 9 aa, Tick-borne encephalitis virus
TKFTWRRTP

SEQ ID NO: 188429 - protein, 9 aa, Tick-borne encephalitis virus
KFTWRRTPT

SEQ ID NO: 188430 - protein, 9 aa, Tick-borne encephalitis virus
FTWRRTPTD

SEQ ID NO: 188431 - protein, 9 aa, Tick-borne encephalitis virus
TWRRTPTDS

SEQ ID NO: 188432 - protein, 9 aa, Tick-borne encephalitis virus
FLSSIGKAL

SEQ ID NO: 188433 - protein, 9 aa, Tick-borne encephalitis virus
VGFIPKLLL

SEQ ID NO: 188434 - protein, 9 aa, Tick-borne encephalitis virus
GFLPKILIG

SEQ ID NO: 188435 - protein, 9 aa, Tick-borne encephalitis virus
IKEAFEEGT

SEQ ID NO: 188436 - protein, 9 aa, Tick-borne encephalitis virus
RETFEEGTC

SEQ ID NO: 188437 - protein, 9 aa, Tick-borne encephalitis virus
EMAMWRSAA

SEQ ID NO: 188438 - protein, 9 aa, Tick-borne encephalitis virus
MAMWRSAAT

SEQ ID NO: 188439 - protein, 9 aa, Tick-borne encephalitis virus
AMWRSSSTE

SEQ ID NO: 188440 - protein, 9 aa, Tick-borne encephalitis virus
MWRSAATEL

SEQ ID NO: 188441 - protein, 9 aa, Tick-borne encephalitis virus
WRSSSTELN

SEQ ID NO: 188442 - protein, 9 aa, Tick-borne encephalitis virus
RSAATELNL

SEQ ID NO: 188443 - protein, 9 aa, Tick-borne encephalitis virus
SSSTELNLA

SEQ ID NO: 188444 - protein, 9 aa, Tick-borne encephalitis virus
AATELNLAL

SEQ ID NO: 188445 - protein, 9 aa, Tick-borne encephalitis virus
SWGHSIIWS

SEQ ID NO: 188446 - protein, 9 aa, Tick-borne encephalitis virus
SVIWSIPEA

SEQ ID NO: 188447 - protein, 9 aa, Tick-borne encephalitis virus
VIWSIPEAP

SEQ ID NO: 188448 - protein, 9 aa, Tick-borne encephalitis virus
LWMKSVRNE

SEQ ID NO: 188449 - protein, 9 aa, Tick-borne encephalitis virus
WMKSVRNET

SEQ ID NO: 188450 - protein, 9 aa, Tick-borne encephalitis virus
MKSVRNETG

SEQ ID NO: 188451 - protein, 9 aa, Tick-borne encephalitis virus
KSVRNETGT

SEQ ID NO: 188452 - protein, 9 aa, Tick-borne encephalitis virus
VRGECPGTK

SEQ ID NO: 188453 - protein, 9 aa, Tick-borne encephalitis virus
ECPGTTVVI

SEQ ID NO: 188454 - protein, 9 aa, Tick-borne encephalitis virus
ITADCDKRG

SEQ ID NO: 188455 - protein, 9 aa, Tick-borne encephalitis virus
SADCDRRGA

SEQ ID NO: 188456 - protein, 9 aa, Tick-borne encephalitis virus
RPATGTTAV

SEQ ID NO: 188457 - protein, 9 aa, Tick-borne encephalitis virus
PATGTTAVW

SEQ ID NO: 188458 - protein, 9 aa, Tick-borne encephalitis virus
ATGTTAVWG

SEQ ID NO: 188459 - protein, 9 aa, Tick-borne encephalitis virus
TGSTVVWGG

SEQ ID NO: 188460 - protein, 9 aa, Tick-borne encephalitis virus
WGGLIVLAL

SEQ ID NO: 188461 - protein, 9 aa, Tick-borne encephalitis virus
GGIVVFALL

SEQ ID NO: 188462 - protein, 9 aa, Tick-borne encephalitis virus
GIVVFALLV

SEQ ID NO: 188463 - protein, 9 aa, Tick-borne encephalitis virus
IVVFALLVT

SEQ ID NO: 188464 - protein, 9 aa, Tick-borne encephalitis virus
LMALMTQQN

SEQ ID NO: 188465 - protein, 9 aa, Tick-borne encephalitis virus
VHYGLMLFL

SEQ ID NO: 188466 - protein, 9 aa, Tick-borne encephalitis virus
HYGLIFFLG

SEQ ID NO: 188467 - protein, 9 aa, Tick-borne encephalitis virus
WRLLEGHRE

SEQ ID NO: 188468 - protein, 9 aa, Tick-borne encephalitis virus
RLLEGHREQ

SEQ ID NO: 188469 - protein, 9 aa, Tick-borne encephalitis virus
KGLSWIVPM

SEQ ID NO: 188470 - protein, 9 aa, Tick-borne encephalitis virus
GLSWIVPMA

SEQ ID NO: 188471 - protein, 9 aa, Tick-borne encephalitis virus
VPLAGLVGG

SEQ ID NO: 188472 - protein, 9 aa, Tick-borne encephalitis virus
PMARLLGGE

SEQ ID NO: 188473 - protein, 9 aa, Tick-borne encephalitis virus
LAGLVGGEG

SEQ ID NO: 188474 - protein, 9 aa, Tick-borne encephalitis virus
AGLAASALH

SEQ ID NO: 188475 - protein, 9 aa, Tick-borne encephalitis virus
GLAASALHW

SEQ ID NO: 188476 - protein, 9 aa, Tick-borne encephalitis virus
LSASAFHWS

SEQ ID NO: 188477 - protein, 9 aa, Tick-borne encephalitis virus
AASALHWSG

SEQ ID NO: 188478 - protein, 9 aa, Tick-borne encephalitis virus
SAIHWSGII

SEQ ID NO: 188479 - protein, 9 aa, Tick-borne encephalitis virus
ALHWSGILG

SEQ ID NO: 188480 - protein, 9 aa, Tick-borne encephalitis virus
LHWSGILGV

SEQ ID NO: 188481 - protein, 9 aa, Tick-borne encephalitis virus
LWTLSEMLK

SEQ ID NO: 188482 - protein, 9 aa, Tick-borne encephalitis virus
DLAFSGQGG

SEQ ID NO: 188483 - protein, 9 aa, Tick-borne encephalitis virus
ALYIDDAVA

SEQ ID NO: 188484 - protein, 9 aa, Tick-borne encephalitis virus
LSIDDAVVG

SEQ ID NO: 188485 - protein, 9 aa, Tick-borne encephalitis virus
SVDDAVVGP

SEQ ID NO: 188486 - protein, 9 aa, Tick-borne encephalitis virus
AGPYWAEVK

SEQ ID NO: 188487 - protein, 9 aa, Tick-borne encephalitis virus
TSRSPILNA

SEQ ID NO: 188488 - protein, 9 aa, Tick-borne encephalitis virus
SGSPIINSQ

SEQ ID NO: 188489 - protein, 9 aa, Tick-borne encephalitis virus
GSPIINSQG

SEQ ID NO: 188490 - protein, 9 aa, Tick-borne encephalitis virus
SPTLNSQGV

SEQ ID NO: 188491 - protein, 9 aa, Tick-borne encephalitis virus
PTLNSQGVV

SEQ ID NO: 188492 - protein, 9 aa, Tick-borne encephalitis virus
TLNSQGVVV

SEQ ID NO: 188493 - protein, 9 aa, Tick-borne encephalitis virus
GSGWTAKGQ

SEQ ID NO: 188494 - protein, 9 aa, Tick-borne encephalitis virus
SGWTAKGQI

SEQ ID NO: 188495 - protein, 9 aa, Tick-borne encephalitis virus
FHSPAVGDH

SEQ ID NO: 188496 - protein, 9 aa, Tick-borne encephalitis virus
LSPAVSDQQ

SEQ ID NO: 188497 - protein, 9 aa, Tick-borne encephalitis virus
DHQGGGAIV

SEQ ID NO: 188498 - protein, 9 aa, Tick-borne encephalitis virus
HQGGGAIVD

SEQ ID NO: 188499 - protein, 9 aa, Tick-borne encephalitis virus
SEERQIPNG

SEQ ID NO: 188500 - protein, 9 aa, Tick-borne encephalitis virus
EVKQIPEGE

SEQ ID NO: 188501 - protein, 9 aa, Tick-borne encephalitis virus
ERQIPNGEW

SEQ ID NO: 188502 - protein, 9 aa, Tick-borne encephalitis virus
AKGGIIARA

SEQ ID NO: 188503 - protein, 9 aa, Tick-borne encephalitis virus
EEPGSSAMR

SEQ ID NO: 188504 - protein, 9 aa, Tick-borne encephalitis virus
APEAFLTMA

SEQ ID NO: 188505 - protein, 9 aa, Tick-borne encephalitis virus
PEAFLTVAE

SEQ ID NO: 188506 - protein, 9 aa, Tick-borne encephalitis virus
AEMLVLGLA

SEQ ID NO: 188507 - protein, 9 aa, Tick-borne encephalitis virus
EMRSWEEWT

SEQ ID NO: 188508 - protein, 9 aa, Tick-borne encephalitis virus
VRSWEEWTN

SEQ ID NO: 188509 - protein, 9 aa, Tick-borne encephalitis virus
GGGAPFFGI

SEQ ID NO: 188510 - protein, 9 aa, Tick-borne encephalitis virus
GGAPFLGVA

SEQ ID NO: 188511 - protein, 9 aa, Tick-borne encephalitis virus
GAPFLGVAG

SEQ ID NO: 188512 - protein, 9 aa, Tick-borne encephalitis virus
APFFGIAGH

SEQ ID NO: 188513 - protein, 9 aa, Tick-borne encephalitis virus
FIGVAGHVM

SEQ ID NO: 188514 - protein, 9 aa, Tick-borne encephalitis virus
GIAGHVMAL

SEQ ID NO: 188515 - protein, 9 aa, Tick-borne encephalitis virus
IAGHVMALG

SEQ ID NO: 188516 - protein, 9 aa, Tick-borne encephalitis virus
MSLVLAVAL

SEQ ID NO: 188517 - protein, 9 aa, Tick-borne encephalitis virus
SLVLAVALC

SEQ ID NO: 188518 - protein, 9 aa, Tick-borne encephalitis virus
LVLAVALCL

SEQ ID NO: 188519 - protein, 9 aa, Tick-borne encephalitis virus
SVVMNRTVL

SEQ ID NO: 188520 - protein, 9 aa, Tick-borne encephalitis virus
TVPSITEAA

SEQ ID NO: 188521 - protein, 9 aa, Tick-borne encephalitis virus
VLSITEASA

SEQ ID NO: 188522 - protein, 9 aa, Tick-borne encephalitis virus
LAAAGQLLK

SEQ ID NO: 188523 - protein, 9 aa, Tick-borne encephalitis virus
AAAGQLLKP

SEQ ID NO: 188524 - protein, 9 aa, Tick-borne encephalitis virus
ALGQLLRPE

SEQ ID NO: 188525 - protein, 9 aa, Tick-borne encephalitis virus
GQLLKPEAD

SEQ ID NO: 188526 - protein, 9 aa, Tick-borne encephalitis virus
QLLKPEADT

SEQ ID NO: 188527 - protein, 9 aa, Tick-borne encephalitis virus
LLRPEEDTL

SEQ ID NO: 188528 - protein, 9 aa, Tick-borne encephalitis virus
LKPEADTLW

SEQ ID NO: 188529 - protein, 9 aa, Tick-borne encephalitis virus
KPEADTLWT

SEQ ID NO: 188530 - protein, 9 aa, Tick-borne encephalitis virus
SCTREEFFA

SEQ ID NO: 188531 - protein, 9 aa, Tick-borne encephalitis virus
CTREEFFAY

SEQ ID NO: 188532 - protein, 9 aa, Tick-borne encephalitis virus
TREEFFAYR

SEQ ID NO: 188533 - protein, 9 aa, Tick-borne encephalitis virus
REEFFAYRR

SEQ ID NO: 188534 - protein, 9 aa, Tick-borne encephalitis virus
FIYRRTGIL

SEQ ID NO: 188535 - protein, 9 aa, Tick-borne encephalitis virus
VYRRAGILE

SEQ ID NO: 188536 - protein, 9 aa, Tick-borne encephalitis virus
DRARELLRR

SEQ ID NO: 188537 - protein, 9 aa, Tick-borne encephalitis virus
RARELLRRG

SEQ ID NO: 188538 - protein, 9 aa, Tick-borne encephalitis virus
GGKGHETPR

SEQ ID NO: 188539 - protein, 9 aa, Tick-borne encephalitis virus
GRGHETPKM

SEQ ID NO: 188540 - protein, 9 aa, Tick-borne encephalitis virus
KGHETPRMV

SEQ ID NO: 188541 - protein, 9 aa, Tick-borne encephalitis virus
VVLADDKVK

SEQ ID NO: 188542 - protein, 9 aa, Tick-borne encephalitis virus
VLADDKVKE

SEQ ID NO: 188543 - protein, 9 aa, Tick-borne encephalitis virus
LADDKVKEK

SEQ ID NO: 188544 - protein, 9 aa, Tick-borne encephalitis virus
ADDKVKEKD

SEQ ID NO: 188545 - protein, 9 aa, Tick-borne encephalitis virus
DDKVKEKDV

SEQ ID NO: 188546 - protein, 9 aa, Tick-borne encephalitis virus
DKVKEQDVR

SEQ ID NO: 188547 - protein, 9 aa, Tick-borne encephalitis virus
KVKEQDVRE

SEQ ID NO: 188548 - protein, 9 aa, Tick-borne encephalitis virus
DVQERIKAL

SEQ ID NO: 188549 - protein, 9 aa, Tick-borne encephalitis virus
ERIRALKEQ

SEQ ID NO: 188550 - protein, 9 aa, Tick-borne encephalitis virus
RIRALKEQY

SEQ ID NO: 188551 - protein, 9 aa, Tick-borne encephalitis virus
DAEHPYRTW

SEQ ID NO: 188552 - protein, 9 aa, Tick-borne encephalitis virus
MLDRLAQKS

SEQ ID NO: 188553 - protein, 9 aa, Tick-borne encephalitis virus
RPRMCSKEE

SEQ ID NO: 188554 - protein, 9 aa, Tick-borne encephalitis virus
AVEDPAFWK

SEQ ID NO: 188555 - protein, 9 aa, Tick-borne encephalitis virus
VEDPAFWKL

SEQ ID NO: 188556 - protein, 9 aa, Tick-borne encephalitis virus
EDPAFWKLV

SEQ ID NO: 188557 - protein, 9 aa, Tick-borne encephalitis virus
DPAFWKLVD

SEQ ID NO: 188558 - protein, 9 aa, Tick-borne encephalitis virus
PAFWKLVDE

SEQ ID NO: 188559 - protein, 9 aa, Tick-borne encephalitis virus
AFWKLVDEE

SEQ ID NO: 188560 - protein, 9 aa, Tick-borne encephalitis virus
LTGRCAHCV

SEQ ID NO: 188561 - protein, 9 aa, Tick-borne encephalitis virus
WASRGSSGA

SEQ ID NO: 188562 - protein, 9 aa, Tick-borne encephalitis virus
ASRGSSGAG

SEQ ID NO: 188563 - protein, 9 aa, Tick-borne encephalitis virus
SRGSSGAGV

SEQ ID NO: 188564 - protein, 9 aa, Tick-borne encephalitis virus
RGSSGAGVE

SEQ ID NO: 188565 - protein, 9 aa, Tick-borne encephalitis virus
GSSGAGVEG

SEQ ID NO: 188566 - protein, 9 aa, Tick-borne encephalitis virus
NYLGWHLKR

SEQ ID NO: 188567 - protein, 9 aa, Tick-borne encephalitis virus
YLGWYLKEL

SEQ ID NO: 188568 - protein, 9 aa, Tick-borne encephalitis virus
LGWHLKRLS

SEQ ID NO: 188569 - protein, 9 aa, Tick-borne encephalitis virus
FRVERWLRD

SEQ ID NO: 188570 - protein, 9 aa, Tick-borne encephalitis virus
RVERWLREH

SEQ ID NO: 188571 - protein, 9 aa, Tick-borne encephalitis virus
VERWLREHG

SEQ ID NO: 188572 - protein, 9 aa, Tick-borne encephalitis virus
DYGEERLGR

SEQ ID NO: 188573 - protein, 9 aa, Tick-borne encephalitis virus
VRGIDDRFG

SEQ ID NO: 188574 - protein, 9 aa, Tick-borne encephalitis virus
DDRFSGALY

SEQ ID NO: 188575 - protein, 9 aa, Tick-borne encephalitis virus
DRFSGALYF

SEQ ID NO: 188576 - protein, 9 aa, Tick-borne encephalitis virus
RFSGALYFL

SEQ ID NO: 188577 - protein, 9 aa, Tick-borne encephalitis virus
FSGALYFLN

SEQ ID NO: 188578 - protein, 9 aa, Tick-borne encephalitis virus
SGALYFLND

SEQ ID NO: 188579 - protein, 9 aa, Tick-borne encephalitis virus
SVEEVPFCS

SEQ ID NO: 188580 - protein, 9 aa, Tick-borne encephalitis virus
LRTLGFAIC

SEQ ID NO: 188581 - protein, 9 aa, Tick-borne encephalitis virus
RTLGFAICS

SEQ ID NO: 188582 - protein, 9 aa, Tick-borne encephalitis virus
TLGFAICSA

SEQ ID NO: 188583 - protein, 9 aa, Tick-borne encephalitis virus
LGFAICSAV

SEQ ID NO: 188584 - protein, 9 aa, Tick-borne encephalitis virus
GLAISSAVP

SEQ ID NO: 188585 - protein, 9 aa, Tick-borne encephalitis virus
NPFMQNKGK

SEQ ID NO: 188586 - protein, 9 aa, Tick-borne encephalitis virus
IPYLPKAQD

SEQ ID NO: 188587 - protein, 9 aa, Tick-borne encephalitis virus
AVEKVRKIV

SEQ ID NO: 188588 - protein, 9 aa, Tick-borne encephalitis virus
VEKVRKMVG

SEQ ID NO: 188589 - protein, 9 aa, Tick-borne encephalitis virus
MAGKAILKG

SEQ ID NO: 188590 - protein, 9 aa, Tick-borne encephalitis virus
AGKAILKGK

SEQ ID NO: 188591 - protein, 9 aa, Tick-borne encephalitis virus
GKAILKGKG

SEQ ID NO: 188592 - protein, 9 aa, Tick-borne encephalitis virus
KAILKGKGG

SEQ ID NO: 188593 - protein, 9 aa, Tick-borne encephalitis virus
AILKGKGGG

SEQ ID NO: 188594 - protein, 9 aa, Tick-borne encephalitis virus
ILKGKGGGP

SEQ ID NO: 188595 - protein, 9 aa, Tick-borne encephalitis virus
LKGKGGGPP

SEQ ID NO: 188596 - protein, 9 aa, Tick-borne encephalitis virus
KGKGGGPPR

SEQ ID NO: 188597 - protein, 9 aa, Tick-borne encephalitis virus
GKGGGPPRR

SEQ ID NO: 188598 - protein, 9 aa, Tick-borne encephalitis virus
KGGGPPRRV

SEQ ID NO: 188599 - protein, 9 aa, Tick-borne encephalitis virus
GGGPPRRVS

SEQ ID NO: 188600 - protein, 9 aa, Tick-borne encephalitis virus
GGPPRRVSK

SEQ ID NO: 188601 - protein, 9 aa, Tick-borne encephalitis virus
GPPRRVSKE

SEQ ID NO: 188602 - protein, 9 aa, Tick-borne encephalitis virus
PPRRVSKET

SEQ ID NO: 188603 - protein, 9 aa, Tick-borne encephalitis virus
PRRVSKETA

SEQ ID NO: 188604 - protein, 9 aa, Tick-borne encephalitis virus
RRVSKETAK

SEQ ID NO: 188605 - protein, 9 aa, Tick-borne encephalitis virus
RVSKETAKK

SEQ ID NO: 188606 - protein, 9 aa, Tick-borne encephalitis virus
VSKETAKKT

SEQ ID NO: 188607 - protein, 9 aa, Tick-borne encephalitis virus
SKETAKKTR

SEQ ID NO: 188608 - protein, 9 aa, Tick-borne encephalitis virus
KETAKKTRQ

SEQ ID NO: 188609 - protein, 9 aa, Tick-borne encephalitis virus
ETAKKTRQS

SEQ ID NO: 188610 - protein, 9 aa, Tick-borne encephalitis virus
TAKKTRQSR

SEQ ID NO: 188611 - protein, 9 aa, Tick-borne encephalitis virus
AKKTRQSRV

SEQ ID NO: 188612 - protein, 9 aa, Tick-borne encephalitis virus
KKTRQSRVQ

SEQ ID NO: 188613 - protein, 9 aa, Tick-borne encephalitis virus
KTRQSRVQM

SEQ ID NO: 188614 - protein, 9 aa, Tick-borne encephalitis virus
TRQSRVQMP

SEQ ID NO: 188615 - protein, 9 aa, Tick-borne encephalitis virus
RQSRVQMPN

SEQ ID NO: 188616 - protein, 9 aa, Tick-borne encephalitis virus
QSRVQMPNG

SEQ ID NO: 188617 - protein, 9 aa, Tick-borne encephalitis virus
SRVQMPNGL

SEQ ID NO: 188618 - protein, 9 aa, Tick-borne encephalitis virus
RVQMPNGLV

SEQ ID NO: 188619 - protein, 9 aa, Tick-borne encephalitis virus
VQMPNGLVL

SEQ ID NO: 188620 - protein, 9 aa, Tick-borne encephalitis virus
QMPNGLVLM

SEQ ID NO: 188621 - protein, 9 aa, Tick-borne encephalitis virus
MPNGLVLMR

SEQ ID NO: 188622 - protein, 9 aa, Tick-borne encephalitis virus
PNGLVLMRM

SEQ ID NO: 188623 - protein, 9 aa, Tick-borne encephalitis virus
NGLVLMRMM

SEQ ID NO: 188624 - protein, 9 aa, Tick-borne encephalitis virus
GLVLMRMMG

SEQ ID NO: 188625 - protein, 9 aa, Tick-borne encephalitis virus
LVLMRMMGI

SEQ ID NO: 188626 - protein, 9 aa, Tick-borne encephalitis virus
VLMRMMGIL

SEQ ID NO: 188627 - protein, 9 aa, Tick-borne encephalitis virus
LMRMMGILW

SEQ ID NO: 188628 - protein, 9 aa, Tick-borne encephalitis virus
MRMMGILWH

SEQ ID NO: 188629 - protein, 9 aa, Tick-borne encephalitis virus
RMMGILWHA

SEQ ID NO: 188630 - protein, 9 aa, Tick-borne encephalitis virus
MMGILWHAV

SEQ ID NO: 188631 - protein, 9 aa, Tick-borne encephalitis virus
MGILWHAVA

SEQ ID NO: 188632 - protein, 9 aa, Tick-borne encephalitis virus
GILWHAVAG

SEQ ID NO: 188633 - protein, 9 aa, Tick-borne encephalitis virus
ILWHAVAGT

SEQ ID NO: 188634 - protein, 9 aa, Tick-borne encephalitis virus
LWHAVAGTA

SEQ ID NO: 188635 - protein, 9 aa, Tick-borne encephalitis virus
WHAVAGTAR

SEQ ID NO: 188636 - protein, 9 aa, Tick-borne encephalitis virus
HAVAGTARS

SEQ ID NO: 188637 - protein, 9 aa, Tick-borne encephalitis virus
AVAGTARSP

SEQ ID NO: 188638 - protein, 9 aa, Tick-borne encephalitis virus
VAGTARSPV

SEQ ID NO: 188639 - protein, 9 aa, Tick-borne encephalitis virus
AGTARSPVL

SEQ ID NO: 188640 - protein, 9 aa, Tick-borne encephalitis virus
GTARSPVLK

SEQ ID NO: 188641 - protein, 9 aa, Tick-borne encephalitis virus
TARSPVLKS

SEQ ID NO: 188642 - protein, 9 aa, Tick-borne encephalitis virus
ARSPVLKSF

SEQ ID NO: 188643 - protein, 9 aa, Tick-borne encephalitis virus
RSPVLKSFW

SEQ ID NO: 188644 - protein, 9 aa, Tick-borne encephalitis virus
SPVLKSFWN

SEQ ID NO: 188645 - protein, 9 aa, Tick-borne encephalitis virus
PVLKSFWNS

SEQ ID NO: 188646 - protein, 9 aa, Tick-borne encephalitis virus
VLKSFWNSV

SEQ ID NO: 188647 - protein, 9 aa, Tick-borne encephalitis virus
LKSFWNSVP

SEQ ID NO: 188648 - protein, 9 aa, Tick-borne encephalitis virus
KSFWNSVPL

SEQ ID NO: 188649 - protein, 9 aa, Tick-borne encephalitis virus
SFWNSVPLK

SEQ ID NO: 188650 - protein, 9 aa, Tick-borne encephalitis virus
FWNSVPLKQ

SEQ ID NO: 188651 - protein, 9 aa, Tick-borne encephalitis virus
WNSVPLKQA

SEQ ID NO: 188652 - protein, 9 aa, Tick-borne encephalitis virus
NSVPLKQAT

SEQ ID NO: 188653 - protein, 9 aa, Tick-borne encephalitis virus
SVPLKQATA

SEQ ID NO: 188654 - protein, 9 aa, Tick-borne encephalitis virus
VPLKQATAA

SEQ ID NO: 188655 - protein, 9 aa, Tick-borne encephalitis virus
PLKQATAAL

SEQ ID NO: 188656 - protein, 9 aa, Tick-borne encephalitis virus
LKQATAALR

SEQ ID NO: 188657 - protein, 9 aa, Tick-borne encephalitis virus
KQATAALRK

SEQ ID NO: 188658 - protein, 9 aa, Tick-borne encephalitis virus
QATAALRKI

SEQ ID NO: 188659 - protein, 9 aa, Tick-borne encephalitis virus
ATAALRKIK

SEQ ID NO: 188660 - protein, 9 aa, Tick-borne encephalitis virus
TAALRKIKK

SEQ ID NO: 188661 - protein, 9 aa, Tick-borne encephalitis virus
AALRKIKKA

SEQ ID NO: 188662 - protein, 9 aa, Tick-borne encephalitis virus
ALRKIKKAV

SEQ ID NO: 188663 - protein, 9 aa, Tick-borne encephalitis virus
LRKIKKAVS

SEQ ID NO: 188664 - protein, 9 aa, Tick-borne encephalitis virus
RKIKKAVST

SEQ ID NO: 188665 - protein, 9 aa, Tick-borne encephalitis virus
KIKKAVSTL

SEQ ID NO: 188666 - protein, 9 aa, Tick-borne encephalitis virus
IKKAVSTLM

SEQ ID NO: 188667 - protein, 9 aa, Tick-borne encephalitis virus
AVSTLMVGL

SEQ ID NO: 188668 - protein, 9 aa, Tick-borne encephalitis virus
VSTLMVGLQ

SEQ ID NO: 188669 - protein, 9 aa, Tick-borne encephalitis virus
LMVGLQRRG

SEQ ID NO: 188670 - protein, 9 aa, Tick-borne encephalitis virus
MVGLQRRGK

SEQ ID NO: 188671 - protein, 9 aa, Tick-borne encephalitis virus
VGLQRRGKR

SEQ ID NO: 188672 - protein, 9 aa, Tick-borne encephalitis virus
GLQRRGKRR

SEQ ID NO: 188673 - protein, 9 aa, Tick-borne encephalitis virus
LQRRGKRRS

SEQ ID NO: 188674 - protein, 9 aa, Tick-borne encephalitis virus
QRRGKRRSA

SEQ ID NO: 188675 - protein, 9 aa, Tick-borne encephalitis virus
TLAATVRKE

SEQ ID NO: 188676 - protein, 9 aa, Tick-borne encephalitis virus
LAATVRKER

SEQ ID NO: 188677 - protein, 9 aa, Tick-borne encephalitis virus
AATVRKERD

SEQ ID NO: 188678 - protein, 9 aa, Tick-borne encephalitis virus
ATVRKERDG

SEQ ID NO: 188679 - protein, 9 aa, Tick-borne encephalitis virus
TVRKERDGT

SEQ ID NO: 188680 - protein, 9 aa, Tick-borne encephalitis virus
VRKERDGTT

SEQ ID NO: 188681 - protein, 9 aa, Tick-borne encephalitis virus
RKERDGTTV

SEQ ID NO: 188682 - protein, 9 aa, Tick-borne encephalitis virus
KERDGTTVI

SEQ ID NO: 188683 - protein, 9 aa, Tick-borne encephalitis virus
ERDGTTVIR

SEQ ID NO: 188684 - protein, 9 aa, Tick-borne encephalitis virus
RDGTTVIRA

SEQ ID NO: 188685 - protein, 9 aa, Tick-borne encephalitis virus
DGTTVIRAE

SEQ ID NO: 188686 - protein, 9 aa, Tick-borne encephalitis virus
GTTVIRAEG

SEQ ID NO: 188687 - protein, 9 aa, Tick-borne encephalitis virus
TTVIRAEGK

SEQ ID NO: 188688 - protein, 9 aa, Tick-borne encephalitis virus
TVIRAEGKD

SEQ ID NO: 188689 - protein, 9 aa, Tick-borne encephalitis virus
VIRAEGKDA

SEQ ID NO: 188690 - protein, 9 aa, Tick-borne encephalitis virus
IRAEGKDAA

SEQ ID NO: 188691 - protein, 9 aa, Tick-borne encephalitis virus
RAEGKDAAT

SEQ ID NO: 188692 - protein, 9 aa, Tick-borne encephalitis virus
AEGKDAATQ

SEQ ID NO: 188693 - protein, 9 aa, Tick-borne encephalitis virus
EGKDAATQV

SEQ ID NO: 188694 - protein, 9 aa, Tick-borne encephalitis virus
GKDAATQVR

SEQ ID NO: 188695 - protein, 9 aa, Tick-borne encephalitis virus
KDAATQVRV

SEQ ID NO: 188696 - protein, 9 aa, Tick-borne encephalitis virus
DAATQVRVE

SEQ ID NO: 188697 - protein, 9 aa, Tick-borne encephalitis virus
AATQVRVEN

SEQ ID NO: 188698 - protein, 9 aa, Tick-borne encephalitis virus
ATQVRVENG

SEQ ID NO: 188699 - protein, 9 aa, Tick-borne encephalitis virus
TQVRVENGT

SEQ ID NO: 188700 - protein, 9 aa, Tick-borne encephalitis virus
QVRVENGTC

SEQ ID NO: 188701 - protein, 9 aa, Tick-borne encephalitis virus
VRVENGTCV

SEQ ID NO: 188702 - protein, 9 aa, Tick-borne encephalitis virus
RVENGTCVI

SEQ ID NO: 188703 - protein, 9 aa, Tick-borne encephalitis virus
VENGTCVIL

SEQ ID NO: 188704 - protein, 9 aa, Tick-borne encephalitis virus
ENGTCVILA

SEQ ID NO: 188705 - protein, 9 aa, Tick-borne encephalitis virus
NGTCVILAT

SEQ ID NO: 188706 - protein, 9 aa, Tick-borne encephalitis virus
GTCVILATD

SEQ ID NO: 188707 - protein, 9 aa, Tick-borne encephalitis virus
TCVILATDM

SEQ ID NO: 188708 - protein, 9 aa, Tick-borne encephalitis virus
CVILATDMG

SEQ ID NO: 188709 - protein, 9 aa, Tick-borne encephalitis virus
VILATDMGS

SEQ ID NO: 188710 - protein, 9 aa, Tick-borne encephalitis virus
ILATDMGSW

SEQ ID NO: 188711 - protein, 9 aa, Tick-borne encephalitis virus
LATDMGSWC

SEQ ID NO: 188712 - protein, 9 aa, Tick-borne encephalitis virus
ATDMGSWCD

SEQ ID NO: 188713 - protein, 9 aa, Tick-borne encephalitis virus
TDMGSWCDD

SEQ ID NO: 188714 - protein, 9 aa, Tick-borne encephalitis virus
DMGSWCDDS

SEQ ID NO: 188715 - protein, 9 aa, Tick-borne encephalitis virus
MGSWCDDSL

SEQ ID NO: 188716 - protein, 9 aa, Tick-borne encephalitis virus
GSWCDDSLT

SEQ ID NO: 188717 - protein, 9 aa, Tick-borne encephalitis virus
SWCDDSLTY

SEQ ID NO: 188718 - protein, 9 aa, Tick-borne encephalitis virus
WCDDSLTYE

SEQ ID NO: 188719 - protein, 9 aa, Tick-borne encephalitis virus
CDDSLTYEC

SEQ ID NO: 188720 - protein, 9 aa, Tick-borne encephalitis virus
DDSLTYECV

SEQ ID NO: 188721 - protein, 9 aa, Tick-borne encephalitis virus
DSLTYECVT

SEQ ID NO: 188722 - protein, 9 aa, Tick-borne encephalitis virus
SLTYECVTI

SEQ ID NO: 188723 - protein, 9 aa, Tick-borne encephalitis virus
LTYECVTID

SEQ ID NO: 188724 - protein, 9 aa, Tick-borne encephalitis virus
TYECVTIDQ

SEQ ID NO: 188725 - protein, 9 aa, Tick-borne encephalitis virus
YECVTIDQG

SEQ ID NO: 188726 - protein, 9 aa, Tick-borne encephalitis virus
ECVTIDQGE

SEQ ID NO: 188727 - protein, 9 aa, Tick-borne encephalitis virus
CVTIDQGEE

SEQ ID NO: 188728 - protein, 9 aa, Tick-borne encephalitis virus
VTIDQGEEP

SEQ ID NO: 188729 - protein, 9 aa, Tick-borne encephalitis virus
TIDQGEEPV

SEQ ID NO: 188730 - protein, 9 aa, Tick-borne encephalitis virus
IDQGEEPVD

SEQ ID NO: 188731 - protein, 9 aa, Tick-borne encephalitis virus
DQGEEPVDV

SEQ ID NO: 188732 - protein, 9 aa, Tick-borne encephalitis virus
QGEEPVDVD

SEQ ID NO: 188733 - protein, 9 aa, Tick-borne encephalitis virus
GEEPVDVDC

SEQ ID NO: 188734 - protein, 9 aa, Tick-borne encephalitis virus
EEPVDVDCF

SEQ ID NO: 188735 - protein, 9 aa, Tick-borne encephalitis virus
EPVDVDCFC

SEQ ID NO: 188736 - protein, 9 aa, Tick-borne encephalitis virus
PVDVDCFCR

SEQ ID NO: 188737 - protein, 9 aa, Tick-borne encephalitis virus
VDVDCFCRN

SEQ ID NO: 188738 - protein, 9 aa, Tick-borne encephalitis virus
DVDCFCRNV

SEQ ID NO: 188739 - protein, 9 aa, Tick-borne encephalitis virus
VDCFCRNVD

SEQ ID NO: 188740 - protein, 9 aa, Tick-borne encephalitis virus
DCFCRNVDG

SEQ ID NO: 188741 - protein, 9 aa, Tick-borne encephalitis virus
CFCRNVDGV

SEQ ID NO: 188742 - protein, 9 aa, Tick-borne encephalitis virus
FCRNVDGVY

SEQ ID NO: 188743 - protein, 9 aa, Tick-borne encephalitis virus
CRNVDGVYL

SEQ ID NO: 188744 - protein, 9 aa, Tick-borne encephalitis virus
RNVDGVYLE

SEQ ID NO: 188745 - protein, 9 aa, Tick-borne encephalitis virus
NVDGVYLEY

SEQ ID NO: 188746 - protein, 9 aa, Tick-borne encephalitis virus
VDGVYLEYG

SEQ ID NO: 188747 - protein, 9 aa, Tick-borne encephalitis virus
DGVYLEYGR

SEQ ID NO: 188748 - protein, 9 aa, Tick-borne encephalitis virus
GVYLEYGRC

SEQ ID NO: 188749 - protein, 9 aa, Tick-borne encephalitis virus
VYLEYGRCG

SEQ ID NO: 188750 - protein, 9 aa, Tick-borne encephalitis virus
YLEYGRCGK

SEQ ID NO: 188751 - protein, 9 aa, Tick-borne encephalitis virus
LEYGRCGKQ

SEQ ID NO: 188752 - protein, 9 aa, Tick-borne encephalitis virus
EYGRCGKQE

SEQ ID NO: 188753 - protein, 9 aa, Tick-borne encephalitis virus
YGRCGKQEG

SEQ ID NO: 188754 - protein, 9 aa, Tick-borne encephalitis virus
GRCGKQEGS

SEQ ID NO: 188755 - protein, 9 aa, Tick-borne encephalitis virus
RCGKQEGSR

SEQ ID NO: 188756 - protein, 9 aa, Tick-borne encephalitis virus
CGKQEGSRT

SEQ ID NO: 188757 - protein, 9 aa, Tick-borne encephalitis virus
GKQEGSRTR

SEQ ID NO: 188758 - protein, 9 aa, Tick-borne encephalitis virus
KQEGSRTRR

SEQ ID NO: 188759 - protein, 9 aa, Tick-borne encephalitis virus
QEGSRTRRS

SEQ ID NO: 188760 - protein, 9 aa, Tick-borne encephalitis virus
EGSRTRRSV

SEQ ID NO: 188761 - protein, 9 aa, Tick-borne encephalitis virus
GSRTRRSVL

SEQ ID NO: 188762 - protein, 9 aa, Tick-borne encephalitis virus
SRTRRSVLI

SEQ ID NO: 188763 - protein, 9 aa, Tick-borne encephalitis virus
RTRRSVLIP

SEQ ID NO: 188764 - protein, 9 aa, Tick-borne encephalitis virus
TRRSVLIPS

SEQ ID NO: 188765 - protein, 9 aa, Tick-borne encephalitis virus
RRSVLIPSH

SEQ ID NO: 188766 - protein, 9 aa, Tick-borne encephalitis virus
RSVLIPSHA

SEQ ID NO: 188767 - protein, 9 aa, Tick-borne encephalitis virus
SVLIPSHAQ

SEQ ID NO: 188768 - protein, 9 aa, Tick-borne encephalitis virus
VLIPSHAQG

SEQ ID NO: 188769 - protein, 9 aa, Tick-borne encephalitis virus
LIPSHAQGD

SEQ ID NO: 188770 - protein, 9 aa, Tick-borne encephalitis virus
IPSHAQGDL

SEQ ID NO: 188771 - protein, 9 aa, Tick-borne encephalitis virus
PSHAQGDLT

SEQ ID NO: 188772 - protein, 9 aa, Tick-borne encephalitis virus
SHAQGDLTG

SEQ ID NO: 188773 - protein, 9 aa, Tick-borne encephalitis virus
HAQGDLTGR

SEQ ID NO: 188774 - protein, 9 aa, Tick-borne encephalitis virus
AQGDLTGRG

SEQ ID NO: 188775 - protein, 9 aa, Tick-borne encephalitis virus
QGDLTGRGH

SEQ ID NO: 188776 - protein, 9 aa, Tick-borne encephalitis virus
GDLTGRGHK

SEQ ID NO: 188777 - protein, 9 aa, Tick-borne encephalitis virus
DLTGRGHKW

SEQ ID NO: 188778 - protein, 9 aa, Tick-borne encephalitis virus
LTGRGHKWL

SEQ ID NO: 188779 - protein, 9 aa, Tick-borne encephalitis virus
TGRGHKWLE

SEQ ID NO: 188780 - protein, 9 aa, Tick-borne encephalitis virus
GRGHKWLEG

SEQ ID NO: 188781 - protein, 9 aa, Tick-borne encephalitis virus
RGHKWLEGD

SEQ ID NO: 188782 - protein, 9 aa, Tick-borne encephalitis virus
GHKWLEGDS

SEQ ID NO: 188783 - protein, 9 aa, Tick-borne encephalitis virus
HKWLEGDSL

SEQ ID NO: 188784 - protein, 9 aa, Tick-borne encephalitis virus
KWLEGDSLR

SEQ ID NO: 188785 - protein, 9 aa, Tick-borne encephalitis virus
WLEGDSLRT

SEQ ID NO: 188786 - protein, 9 aa, Tick-borne encephalitis virus
LEGDSLRTH

SEQ ID NO: 188787 - protein, 9 aa, Tick-borne encephalitis virus
EGDSLRTHL

SEQ ID NO: 188788 - protein, 9 aa, Tick-borne encephalitis virus
GDSLRTHLT

SEQ ID NO: 188789 - protein, 9 aa, Tick-borne encephalitis virus
DSLRTHLTR

SEQ ID NO: 188790 - protein, 9 aa, Tick-borne encephalitis virus
SLRTHLTRV

SEQ ID NO: 188791 - protein, 9 aa, Tick-borne encephalitis virus
LRTHLTRVE

SEQ ID NO: 188792 - protein, 9 aa, Tick-borne encephalitis virus
RTHLTRVEG

SEQ ID NO: 188793 - protein, 9 aa, Tick-borne encephalitis virus
THLTRVEGW

SEQ ID NO: 188794 - protein, 9 aa, Tick-borne encephalitis virus
HLTRVEGWV

SEQ ID NO: 188795 - protein, 9 aa, Tick-borne encephalitis virus
LTRVEGWVW

SEQ ID NO: 188796 - protein, 9 aa, Tick-borne encephalitis virus
TRVEGWVWK

SEQ ID NO: 188797 - protein, 9 aa, Tick-borne encephalitis virus
RVEGWVWKN

SEQ ID NO: 188798 - protein, 9 aa, Tick-borne encephalitis virus
VEGWVWKNK

SEQ ID NO: 188799 - protein, 9 aa, Tick-borne encephalitis virus
VVWLTVESV

SEQ ID NO: 188800 - protein, 9 aa, Tick-borne encephalitis virus
VWLTVESVV

SEQ ID NO: 188801 - protein, 9 aa, Tick-borne encephalitis virus
WLTVESVVT

SEQ ID NO: 188802 - protein, 9 aa, Tick-borne encephalitis virus
LTVESVVTR

SEQ ID NO: 188803 - protein, 9 aa, Tick-borne encephalitis virus
TVESVVTRV

SEQ ID NO: 188804 - protein, 9 aa, Tick-borne encephalitis virus
VVVLLCLAP

SEQ ID NO: 188805 - protein, 9 aa, Tick-borne encephalitis virus
VVLLCLAPV

SEQ ID NO: 188806 - protein, 9 aa, Tick-borne encephalitis virus
VLLCLAPVY

SEQ ID NO: 188807 - protein, 9 aa, Tick-borne encephalitis virus
LLCLAPVYA

SEQ ID NO: 188808 - protein, 9 aa, Tick-borne encephalitis virus
LCLAPVYAS

SEQ ID NO: 188809 - protein, 9 aa, Tick-borne encephalitis virus
CLAPVYASR

SEQ ID NO: 188810 - protein, 9 aa, Tick-borne encephalitis virus
LAPVYASRC

SEQ ID NO: 188811 - protein, 9 aa, Tick-borne encephalitis virus
APVYASRCT

SEQ ID NO: 188812 - protein, 9 aa, Tick-borne encephalitis virus
PVYASRCTH

SEQ ID NO: 188813 - protein, 9 aa, Tick-borne encephalitis virus
VYASRCTHL

SEQ ID NO: 188814 - protein, 9 aa, Tick-borne encephalitis virus
YASRCTHLE

SEQ ID NO: 188815 - protein, 9 aa, Tick-borne encephalitis virus
ASRCTHLEN

SEQ ID NO: 188816 - protein, 9 aa, Tick-borne encephalitis virus
SRCTHLENR

SEQ ID NO: 188817 - protein, 9 aa, Tick-borne encephalitis virus
RCTHLENRD

SEQ ID NO: 188818 - protein, 9 aa, Tick-borne encephalitis virus
CTHLENRDF

SEQ ID NO: 188819 - protein, 9 aa, Tick-borne encephalitis virus
THLENRDFV

SEQ ID NO: 188820 - protein, 9 aa, Tick-borne encephalitis virus
HLENRDFVT

SEQ ID NO: 188821 - protein, 9 aa, Tick-borne encephalitis virus
LENRDFVTG

SEQ ID NO: 188822 - protein, 9 aa, Tick-borne encephalitis virus
ENRDFVTGT

SEQ ID NO: 188823 - protein, 9 aa, Tick-borne encephalitis virus
NRDFVTGTQ

SEQ ID NO: 188824 - protein, 9 aa, Tick-borne encephalitis virus
RDFVTGTQG

SEQ ID NO: 188825 - protein, 9 aa, Tick-borne encephalitis virus
DFVTGTQGT

SEQ ID NO: 188826 - protein, 9 aa, Tick-borne encephalitis virus
FVTGTQGTT

SEQ ID NO: 188827 - protein, 9 aa, Tick-borne encephalitis virus
VTGTQGTTR

SEQ ID NO: 188828 - protein, 9 aa, Tick-borne encephalitis virus
TGTQGTTRV

SEQ ID NO: 188829 - protein, 9 aa, Tick-borne encephalitis virus
GTQGTTRVT

SEQ ID NO: 188830 - protein, 9 aa, Tick-borne encephalitis virus
TQGTTRVTL

SEQ ID NO: 188831 - protein, 9 aa, Tick-borne encephalitis virus
QGTTRVTLV

SEQ ID NO: 188832 - protein, 9 aa, Tick-borne encephalitis virus
GTTRVTLVL

SEQ ID NO: 188833 - protein, 9 aa, Tick-borne encephalitis virus
TTRVTLVLE

SEQ ID NO: 188834 - protein, 9 aa, Tick-borne encephalitis virus
TRVTLVLEL

SEQ ID NO: 188835 - protein, 9 aa, Tick-borne encephalitis virus
RVTLVLELG

SEQ ID NO: 188836 - protein, 9 aa, Tick-borne encephalitis virus
VTLVLELGG

SEQ ID NO: 188837 - protein, 9 aa, Tick-borne encephalitis virus
TLVLELGGC

SEQ ID NO: 188838 - protein, 9 aa, Tick-borne encephalitis virus
LVLELGGCV

SEQ ID NO: 188839 - protein, 9 aa, Tick-borne encephalitis virus
VLELGGCVT

SEQ ID NO: 188840 - protein, 9 aa, Tick-borne encephalitis virus
LELGGCVTI

SEQ ID NO: 188841 - protein, 9 aa, Tick-borne encephalitis virus
ELGGCVTIT

SEQ ID NO: 188842 - protein, 9 aa, Tick-borne encephalitis virus
LGGCVTITA

SEQ ID NO: 188843 - protein, 9 aa, Tick-borne encephalitis virus
GGCVTITAE

SEQ ID NO: 188844 - protein, 9 aa, Tick-borne encephalitis virus
GCVTITAEG

SEQ ID NO: 188845 - protein, 9 aa, Tick-borne encephalitis virus
CVTITAEGK

SEQ ID NO: 188846 - protein, 9 aa, Tick-borne encephalitis virus
VTITAEGKP

SEQ ID NO: 188847 - protein, 9 aa, Tick-borne encephalitis virus
TITAEGKPS

SEQ ID NO: 188848 - protein, 9 aa, Tick-borne encephalitis virus
ITAEGKPSM

SEQ ID NO: 188849 - protein, 9 aa, Tick-borne encephalitis virus
TAEGKPSMD

SEQ ID NO: 188850 - protein, 9 aa, Tick-borne encephalitis virus
AEGKPSMDV

SEQ ID NO: 188851 - protein, 9 aa, Tick-borne encephalitis virus
EGKPSMDVW

SEQ ID NO: 188852 - protein, 9 aa, Tick-borne encephalitis virus
GKPSMDVWL

SEQ ID NO: 188853 - protein, 9 aa, Tick-borne encephalitis virus
KPSMDVWLD

SEQ ID NO: 188854 - protein, 9 aa, Tick-borne encephalitis virus
PSMDVWLDS

SEQ ID NO: 188855 - protein, 9 aa, Tick-borne encephalitis virus
SMDVWLDSI

SEQ ID NO: 188856 - protein, 9 aa, Tick-borne encephalitis virus
MDVWLDSIY

SEQ ID NO: 188857 - protein, 9 aa, Tick-borne encephalitis virus
DVWLDSIYQ

SEQ ID NO: 188858 - protein, 9 aa, Tick-borne encephalitis virus
VWLDSIYQE

SEQ ID NO: 188859 - protein, 9 aa, Tick-borne encephalitis virus
WLDSIYQEN

SEQ ID NO: 188860 - protein, 9 aa, Tick-borne encephalitis virus
LDSIYQENP

SEQ ID NO: 188861 - protein, 9 aa, Tick-borne encephalitis virus
DSIYQENPA

SEQ ID NO: 188862 - protein, 9 aa, Tick-borne encephalitis virus
SIYQENPAK

SEQ ID NO: 188863 - protein, 9 aa, Tick-borne encephalitis virus
IYQENPAKT

SEQ ID NO: 188864 - protein, 9 aa, Tick-borne encephalitis virus
YQENPAKTR

SEQ ID NO: 188865 - protein, 9 aa, Tick-borne encephalitis virus
QENPAKTRE

SEQ ID NO: 188866 - protein, 9 aa, Tick-borne encephalitis virus
ENPAKTREY

SEQ ID NO: 188867 - protein, 9 aa, Tick-borne encephalitis virus
NPAKTREYC

SEQ ID NO: 188868 - protein, 9 aa, Tick-borne encephalitis virus
PAKTREYCL

SEQ ID NO: 188869 - protein, 9 aa, Tick-borne encephalitis virus
AKTREYCLH

SEQ ID NO: 188870 - protein, 9 aa, Tick-borne encephalitis virus
KTREYCLHA

SEQ ID NO: 188871 - protein, 9 aa, Tick-borne encephalitis virus
TREYCLHAK

SEQ ID NO: 188872 - protein, 9 aa, Tick-borne encephalitis virus
REYCLHAKL

SEQ ID NO: 188873 - protein, 9 aa, Tick-borne encephalitis virus
EYCLHAKLS

SEQ ID NO: 188874 - protein, 9 aa, Tick-borne encephalitis virus
YCLHAKLSD

SEQ ID NO: 188875 - protein, 9 aa, Tick-borne encephalitis virus
CLHAKLSDT

SEQ ID NO: 188876 - protein, 9 aa, Tick-borne encephalitis virus
LHAKLSDTK

SEQ ID NO: 188877 - protein, 9 aa, Tick-borne encephalitis virus
HAKLSDTKV

SEQ ID NO: 188878 - protein, 9 aa, Tick-borne encephalitis virus
AKLSDTKVA

SEQ ID NO: 188879 - protein, 9 aa, Tick-borne encephalitis virus
KLSDTKVAA

SEQ ID NO: 188880 - protein, 9 aa, Tick-borne encephalitis virus
LSDTKVAAR

SEQ ID NO: 188881 - protein, 9 aa, Tick-borne encephalitis virus
SDTKVAARC

SEQ ID NO: 188882 - protein, 9 aa, Tick-borne encephalitis virus
DTKVAARCP

SEQ ID NO: 188883 - protein, 9 aa, Tick-borne encephalitis virus
TKVAARCPT

SEQ ID NO: 188884 - protein, 9 aa, Tick-borne encephalitis virus
KVAARCPTM

SEQ ID NO: 188885 - protein, 9 aa, Tick-borne encephalitis virus
VAARCPTMG

SEQ ID NO: 188886 - protein, 9 aa, Tick-borne encephalitis virus
AARCPTMGP

SEQ ID NO: 188887 - protein, 9 aa, Tick-borne encephalitis virus
ARCPTMGPA

SEQ ID NO: 188888 - protein, 9 aa, Tick-borne encephalitis virus
RCPTMGPAT

SEQ ID NO: 188889 - protein, 9 aa, Tick-borne encephalitis virus
CPTMGPATL

SEQ ID NO: 188890 - protein, 9 aa, Tick-borne encephalitis virus
PTMGPATLA

SEQ ID NO: 188891 - protein, 9 aa, Tick-borne encephalitis virus
TMGPATLAE

SEQ ID NO: 188892 - protein, 9 aa, Tick-borne encephalitis virus
MGPATLAEE

SEQ ID NO: 188893 - protein, 9 aa, Tick-borne encephalitis virus
GPATLAEEH

SEQ ID NO: 188894 - protein, 9 aa, Tick-borne encephalitis virus
PATLAEEHQ

SEQ ID NO: 188895 - protein, 9 aa, Tick-borne encephalitis virus
ATLAEEHQS

SEQ ID NO: 188896 - protein, 9 aa, Tick-borne encephalitis virus
TLAEEHQSG

SEQ ID NO: 188897 - protein, 9 aa, Tick-borne encephalitis virus
LAEEHQSGT

SEQ ID NO: 188898 - protein, 9 aa, Tick-borne encephalitis virus
AEEHQSGTV

SEQ ID NO: 188899 - protein, 9 aa, Tick-borne encephalitis virus
EEHQSGTVC

SEQ ID NO: 188900 - protein, 9 aa, Tick-borne encephalitis virus
EHQSGTVCK

SEQ ID NO: 188901 - protein, 9 aa, Tick-borne encephalitis virus
HQSGTVCKR

SEQ ID NO: 188902 - protein, 9 aa, Tick-borne encephalitis virus
QSGTVCKRD

SEQ ID NO: 188903 - protein, 9 aa, Tick-borne encephalitis virus
SGTVCKRDQ

SEQ ID NO: 188904 - protein, 9 aa, Tick-borne encephalitis virus
GTVCKRDQS

SEQ ID NO: 188905 - protein, 9 aa, Tick-borne encephalitis virus
TVCKRDQSD

SEQ ID NO: 188906 - protein, 9 aa, Tick-borne encephalitis virus
VCKRDQSDR

SEQ ID NO: 188907 - protein, 9 aa, Tick-borne encephalitis virus
CKRDQSDRG

SEQ ID NO: 188908 - protein, 9 aa, Tick-borne encephalitis virus
KRDQSDRGW

SEQ ID NO: 188909 - protein, 9 aa, Tick-borne encephalitis virus
RDQSDRGWG

SEQ ID NO: 188910 - protein, 9 aa, Tick-borne encephalitis virus
DQSDRGWGN

SEQ ID NO: 188911 - protein, 9 aa, Tick-borne encephalitis virus
QSDRGWGNH

SEQ ID NO: 188912 - protein, 9 aa, Tick-borne encephalitis virus
SDRGWGNHC

SEQ ID NO: 188913 - protein, 9 aa, Tick-borne encephalitis virus
DRGWGNHCG

SEQ ID NO: 188914 - protein, 9 aa, Tick-borne encephalitis virus
RGWGNHCGL

SEQ ID NO: 188915 - protein, 9 aa, Tick-borne encephalitis virus
GWGNHCGLF

SEQ ID NO: 188916 - protein, 9 aa, Tick-borne encephalitis virus
WGNHCGLFG

SEQ ID NO: 188917 - protein, 9 aa, Tick-borne encephalitis virus
GNHCGLFGK

SEQ ID NO: 188918 - protein, 9 aa, Tick-borne encephalitis virus
NHCGLFGKG

SEQ ID NO: 188919 - protein, 9 aa, Tick-borne encephalitis virus
HCGLFGKGS

SEQ ID NO: 188920 - protein, 9 aa, Tick-borne encephalitis virus
CGLFGKGSI

SEQ ID NO: 188921 - protein, 9 aa, Tick-borne encephalitis virus
GLFGKGSIV

SEQ ID NO: 188922 - protein, 9 aa, Tick-borne encephalitis virus
LFGKGSIVT

SEQ ID NO: 188923 - protein, 9 aa, Tick-borne encephalitis virus
FGKGSIVTC

SEQ ID NO: 188924 - protein, 9 aa, Tick-borne encephalitis virus
GKGSIVTCV

SEQ ID NO: 188925 - protein, 9 aa, Tick-borne encephalitis virus
KGSIVTCVK

SEQ ID NO: 188926 - protein, 9 aa, Tick-borne encephalitis virus
GSIVTCVKA

SEQ ID NO: 188927 - protein, 9 aa, Tick-borne encephalitis virus
SIVTCVKAS

SEQ ID NO: 188928 - protein, 9 aa, Tick-borne encephalitis virus
IVTCVKASC

SEQ ID NO: 188929 - protein, 9 aa, Tick-borne encephalitis virus
VTCVKASCE

SEQ ID NO: 188930 - protein, 9 aa, Tick-borne encephalitis virus
TCVKASCEA

SEQ ID NO: 188931 - protein, 9 aa, Tick-borne encephalitis virus
CVKASCEAK

SEQ ID NO: 188932 - protein, 9 aa, Tick-borne encephalitis virus
VKASCEAKK

SEQ ID NO: 188933 - protein, 9 aa, Tick-borne encephalitis virus
KASCEAKKK

SEQ ID NO: 188934 - protein, 9 aa, Tick-borne encephalitis virus
ASCEAKKKA

SEQ ID NO: 188935 - protein, 9 aa, Tick-borne encephalitis virus
SCEAKKKAT

SEQ ID NO: 188936 - protein, 9 aa, Tick-borne encephalitis virus
CEAKKKATG

SEQ ID NO: 188937 - protein, 9 aa, Tick-borne encephalitis virus
EAKKKATGH

SEQ ID NO: 188938 - protein, 9 aa, Tick-borne encephalitis virus
AKKKATGHV

SEQ ID NO: 188939 - protein, 9 aa, Tick-borne encephalitis virus
KKKATGHVY

SEQ ID NO: 188940 - protein, 9 aa, Tick-borne encephalitis virus
KKATGHVYD

SEQ ID NO: 188941 - protein, 9 aa, Tick-borne encephalitis virus
KATGHVYDA

SEQ ID NO: 188942 - protein, 9 aa, Tick-borne encephalitis virus
ATGHVYDAN

SEQ ID NO: 188943 - protein, 9 aa, Tick-borne encephalitis virus
TGHVYDANK

SEQ ID NO: 188944 - protein, 9 aa, Tick-borne encephalitis virus
GHVYDANKI

SEQ ID NO: 188945 - protein, 9 aa, Tick-borne encephalitis virus
HVYDANKIV

SEQ ID NO: 188946 - protein, 9 aa, Tick-borne encephalitis virus
VYDANKIVY

SEQ ID NO: 188947 - protein, 9 aa, Tick-borne encephalitis virus
YDANKIVYT

SEQ ID NO: 188948 - protein, 9 aa, Tick-borne encephalitis virus
DANKIVYTV

SEQ ID NO: 188949 - protein, 9 aa, Tick-borne encephalitis virus
ANKIVYTVK

SEQ ID NO: 188950 - protein, 9 aa, Tick-borne encephalitis virus
NKIVYTVKV

SEQ ID NO: 188951 - protein, 9 aa, Tick-borne encephalitis virus
KIVYTVKVE

SEQ ID NO: 188952 - protein, 9 aa, Tick-borne encephalitis virus
IVYTVKVEP

SEQ ID NO: 188953 - protein, 9 aa, Tick-borne encephalitis virus
VYTVKVEPH

SEQ ID NO: 188954 - protein, 9 aa, Tick-borne encephalitis virus
YTVKVEPHT

SEQ ID NO: 188955 - protein, 9 aa, Tick-borne encephalitis virus
TVKVEPHTG

SEQ ID NO: 188956 - protein, 9 aa, Tick-borne encephalitis virus
VKVEPHTGD

SEQ ID NO: 188957 - protein, 9 aa, Tick-borne encephalitis virus
KVEPHTGDY

SEQ ID NO: 188958 - protein, 9 aa, Tick-borne encephalitis virus
VEPHTGDYV

SEQ ID NO: 188959 - protein, 9 aa, Tick-borne encephalitis virus
EPHTGDYVA

SEQ ID NO: 188960 - protein, 9 aa, Tick-borne encephalitis virus
PHTGDYVAA

SEQ ID NO: 188961 - protein, 9 aa, Tick-borne encephalitis virus
HTGDYVAAN

SEQ ID NO: 188962 - protein, 9 aa, Tick-borne encephalitis virus
TGDYVAANE

SEQ ID NO: 188963 - protein, 9 aa, Tick-borne encephalitis virus
GDYVAANET

SEQ ID NO: 188964 - protein, 9 aa, Tick-borne encephalitis virus
DYVAANETH

SEQ ID NO: 188965 - protein, 9 aa, Tick-borne encephalitis virus
YVAANETHS

SEQ ID NO: 188966 - protein, 9 aa, Tick-borne encephalitis virus
VAANETHSG

SEQ ID NO: 188967 - protein, 9 aa, Tick-borne encephalitis virus
AANETHSGR

SEQ ID NO: 188968 - protein, 9 aa, Tick-borne encephalitis virus
ANETHSGRK

SEQ ID NO: 188969 - protein, 9 aa, Tick-borne encephalitis virus
NETHSGRKT

SEQ ID NO: 188970 - protein, 9 aa, Tick-borne encephalitis virus
ETHSGRKTA

SEQ ID NO: 188971 - protein, 9 aa, Tick-borne encephalitis virus
THSGRKTAS

SEQ ID NO: 188972 - protein, 9 aa, Tick-borne encephalitis virus
HSGRKTASF

SEQ ID NO: 188973 - protein, 9 aa, Tick-borne encephalitis virus
SGRKTASFT

SEQ ID NO: 188974 - protein, 9 aa, Tick-borne encephalitis virus
GRKTASFTV

SEQ ID NO: 188975 - protein, 9 aa, Tick-borne encephalitis virus
RKTASFTVS

SEQ ID NO: 188976 - protein, 9 aa, Tick-borne encephalitis virus
KTASFTVSS

SEQ ID NO: 188977 - protein, 9 aa, Tick-borne encephalitis virus
TASFTVSSE

SEQ ID NO: 188978 - protein, 9 aa, Tick-borne encephalitis virus
ASFTVSSEK

SEQ ID NO: 188979 - protein, 9 aa, Tick-borne encephalitis virus
SFTVSSEKT

SEQ ID NO: 188980 - protein, 9 aa, Tick-borne encephalitis virus
FTVSSEKTI

SEQ ID NO: 188981 - protein, 9 aa, Tick-borne encephalitis virus
TVSSEKTIL

SEQ ID NO: 188982 - protein, 9 aa, Tick-borne encephalitis virus
VSSEKTILT

SEQ ID NO: 188983 - protein, 9 aa, Tick-borne encephalitis virus
SSEKTILTM

SEQ ID NO: 188984 - protein, 9 aa, Tick-borne encephalitis virus
SEKTILTMG

SEQ ID NO: 188985 - protein, 9 aa, Tick-borne encephalitis virus
EKTILTMGD

SEQ ID NO: 188986 - protein, 9 aa, Tick-borne encephalitis virus
KTILTMGDY

SEQ ID NO: 188987 - protein, 9 aa, Tick-borne encephalitis virus
TILTMGDYG

SEQ ID NO: 188988 - protein, 9 aa, Tick-borne encephalitis virus
ILTMGDYGD

SEQ ID NO: 188989 - protein, 9 aa, Tick-borne encephalitis virus
LTMGDYGDV

SEQ ID NO: 188990 - protein, 9 aa, Tick-borne encephalitis virus
TMGDYGDVS

SEQ ID NO: 188991 - protein, 9 aa, Tick-borne encephalitis virus
MGDYGDVSL

SEQ ID NO: 188992 - protein, 9 aa, Tick-borne encephalitis virus
GDYGDVSLL

SEQ ID NO: 188993 - protein, 9 aa, Tick-borne encephalitis virus
DYGDVSLLC

SEQ ID NO: 188994 - protein, 9 aa, Tick-borne encephalitis virus
YGDVSLLCR

SEQ ID NO: 188995 - protein, 9 aa, Tick-borne encephalitis virus
GDVSLLCRV

SEQ ID NO: 188996 - protein, 9 aa, Tick-borne encephalitis virus
DVSLLCRVA

SEQ ID NO: 188997 - protein, 9 aa, Tick-borne encephalitis virus
VSLLCRVAS

SEQ ID NO: 188998 - protein, 9 aa, Tick-borne encephalitis virus
SLLCRVASG

SEQ ID NO: 188999 - protein, 9 aa, Tick-borne encephalitis virus
LLCRVASGV

SEQ ID NO: 189000 - protein, 9 aa, Tick-borne encephalitis virus
LCRVASGVD

SEQ ID NO: 189001 - protein, 9 aa, Tick-borne encephalitis virus
CRVASGVDL

SEQ ID NO: 189002 - protein, 9 aa, Tick-borne encephalitis virus
RVASGVDLA

SEQ ID NO: 189003 - protein, 9 aa, Tick-borne encephalitis virus
VASGVDLAQ

SEQ ID NO: 189004 - protein, 9 aa, Tick-borne encephalitis virus
ASGVDLAQT

SEQ ID NO: 189005 - protein, 9 aa, Tick-borne encephalitis virus
SGVDLAQTV

SEQ ID NO: 189006 - protein, 9 aa, Tick-borne encephalitis virus
GVDLAQTVI

SEQ ID NO: 189007 - protein, 9 aa, Tick-borne encephalitis virus
VDLAQTVIL

SEQ ID NO: 189008 - protein, 9 aa, Tick-borne encephalitis virus
DLAQTVILE

SEQ ID NO: 189009 - protein, 9 aa, Tick-borne encephalitis virus
LAQTVILEL

SEQ ID NO: 189010 - protein, 9 aa, Tick-borne encephalitis virus
AQTVILELD

SEQ ID NO: 189011 - protein, 9 aa, Tick-borne encephalitis virus
QTVILELDK

SEQ ID NO: 189012 - protein, 9 aa, Tick-borne encephalitis virus
TVILELDKT

SEQ ID NO: 189013 - protein, 9 aa, Tick-borne encephalitis virus
VILELDKTS

SEQ ID NO: 189014 - protein, 9 aa, Tick-borne encephalitis virus
ILELDKTSE

SEQ ID NO: 189015 - protein, 9 aa, Tick-borne encephalitis virus
LELDKTSEH

SEQ ID NO: 189016 - protein, 9 aa, Tick-borne encephalitis virus
ELDKTSEHL

SEQ ID NO: 189017 - protein, 9 aa, Tick-borne encephalitis virus
LDKTSEHLP

SEQ ID NO: 189018 - protein, 9 aa, Tick-borne encephalitis virus
DKTSEHLPT

SEQ ID NO: 189019 - protein, 9 aa, Tick-borne encephalitis virus
KTSEHLPTA

SEQ ID NO: 189020 - protein, 9 aa, Tick-borne encephalitis virus
TSEHLPTAW

SEQ ID NO: 189021 - protein, 9 aa, Tick-borne encephalitis virus
SEHLPTAWQ

SEQ ID NO: 189022 - protein, 9 aa, Tick-borne encephalitis virus
EHLPTAWQV

SEQ ID NO: 189023 - protein, 9 aa, Tick-borne encephalitis virus
HLPTAWQVH

SEQ ID NO: 189024 - protein, 9 aa, Tick-borne encephalitis virus
LPTAWQVHR

SEQ ID NO: 189025 - protein, 9 aa, Tick-borne encephalitis virus
PTAWQVHRD

SEQ ID NO: 189026 - protein, 9 aa, Tick-borne encephalitis virus
TAWQVHRDW

SEQ ID NO: 189027 - protein, 9 aa, Tick-borne encephalitis virus
AWQVHRDWF

SEQ ID NO: 189028 - protein, 9 aa, Tick-borne encephalitis virus
WQVHRDWFN

SEQ ID NO: 189029 - protein, 9 aa, Tick-borne encephalitis virus
QVHRDWFND

SEQ ID NO: 189030 - protein, 9 aa, Tick-borne encephalitis virus
VHRDWFNDL

SEQ ID NO: 189031 - protein, 9 aa, Tick-borne encephalitis virus
HRDWFNDLA

SEQ ID NO: 189032 - protein, 9 aa, Tick-borne encephalitis virus
RDWFNDLAL

SEQ ID NO: 189033 - protein, 9 aa, Tick-borne encephalitis virus
DWFNDLALP

SEQ ID NO: 189034 - protein, 9 aa, Tick-borne encephalitis virus
WFNDLALPW

SEQ ID NO: 189035 - protein, 9 aa, Tick-borne encephalitis virus
FNDLALPWK

SEQ ID NO: 189036 - protein, 9 aa, Tick-borne encephalitis virus
NDLALPWKH

SEQ ID NO: 189037 - protein, 9 aa, Tick-borne encephalitis virus
DLALPWKHE

SEQ ID NO: 189038 - protein, 9 aa, Tick-borne encephalitis virus
LALPWKHEG

SEQ ID NO: 189039 - protein, 9 aa, Tick-borne encephalitis virus
ALPWKHEGA

SEQ ID NO: 189040 - protein, 9 aa, Tick-borne encephalitis virus
LPWKHEGAQ

SEQ ID NO: 189041 - protein, 9 aa, Tick-borne encephalitis virus
HEGAQNWNN

SEQ ID NO: 189042 - protein, 9 aa, Tick-borne encephalitis virus
EGAQNWNNA

SEQ ID NO: 189043 - protein, 9 aa, Tick-borne encephalitis virus
GAQNWNNAE

SEQ ID NO: 189044 - protein, 9 aa, Tick-borne encephalitis virus
AQNWNNAER

SEQ ID NO: 189045 - protein, 9 aa, Tick-borne encephalitis virus
QNWNNAERL

SEQ ID NO: 189046 - protein, 9 aa, Tick-borne encephalitis virus
NWNNAERLV

SEQ ID NO: 189047 - protein, 9 aa, Tick-borne encephalitis virus
WNNAERLVE

SEQ ID NO: 189048 - protein, 9 aa, Tick-borne encephalitis virus
NNAERLVEF

SEQ ID NO: 189049 - protein, 9 aa, Tick-borne encephalitis virus
NAERLVEFG

SEQ ID NO: 189050 - protein, 9 aa, Tick-borne encephalitis virus
AERLVEFGA

SEQ ID NO: 189051 - protein, 9 aa, Tick-borne encephalitis virus
ERLVEFGAP

SEQ ID NO: 189052 - protein, 9 aa, Tick-borne encephalitis virus
RLVEFGAPH

SEQ ID NO: 189053 - protein, 9 aa, Tick-borne encephalitis virus
LVEFGAPHA

SEQ ID NO: 189054 - protein, 9 aa, Tick-borne encephalitis virus
VEFGAPHAV

SEQ ID NO: 189055 - protein, 9 aa, Tick-borne encephalitis virus
EFGAPHAVK

SEQ ID NO: 189056 - protein, 9 aa, Tick-borne encephalitis virus
FGAPHAVKM

SEQ ID NO: 189057 - protein, 9 aa, Tick-borne encephalitis virus
GAPHAVKMD

SEQ ID NO: 189058 - protein, 9 aa, Tick-borne encephalitis virus
APHAVKMDV

SEQ ID NO: 189059 - protein, 9 aa, Tick-borne encephalitis virus
PHAVKMDVY

SEQ ID NO: 189060 - protein, 9 aa, Tick-borne encephalitis virus
HAVKMDVYN

SEQ ID NO: 189061 - protein, 9 aa, Tick-borne encephalitis virus
AVKMDVYNL

SEQ ID NO: 189062 - protein, 9 aa, Tick-borne encephalitis virus
VKMDVYNLG

SEQ ID NO: 189063 - protein, 9 aa, Tick-borne encephalitis virus
KMDVYNLGD

SEQ ID NO: 189064 - protein, 9 aa, Tick-borne encephalitis virus
MDVYNLGDQ

SEQ ID NO: 189065 - protein, 9 aa, Tick-borne encephalitis virus
DVYNLGDQT

SEQ ID NO: 189066 - protein, 9 aa, Tick-borne encephalitis virus
VYNLGDQTG

SEQ ID NO: 189067 - protein, 9 aa, Tick-borne encephalitis virus
YNLGDQTGV

SEQ ID NO: 189068 - protein, 9 aa, Tick-borne encephalitis virus
NLGDQTGVL

SEQ ID NO: 189069 - protein, 9 aa, Tick-borne encephalitis virus
LGDQTGVLL

SEQ ID NO: 189070 - protein, 9 aa, Tick-borne encephalitis virus
GDQTGVLLK

SEQ ID NO: 189071 - protein, 9 aa, Tick-borne encephalitis virus
DQTGVLLKS

SEQ ID NO: 189072 - protein, 9 aa, Tick-borne encephalitis virus
QTGVLLKSL

SEQ ID NO: 189073 - protein, 9 aa, Tick-borne encephalitis virus
TGVLLKSLA

SEQ ID NO: 189074 - protein, 9 aa, Tick-borne encephalitis virus
GVLLKSLAG

SEQ ID NO: 189075 - protein, 9 aa, Tick-borne encephalitis virus
VLLKSLAGV

SEQ ID NO: 189076 - protein, 9 aa, Tick-borne encephalitis virus
LLKSLAGVP

SEQ ID NO: 189077 - protein, 9 aa, Tick-borne encephalitis virus
LKSLAGVPV

SEQ ID NO: 189078 - protein, 9 aa, Tick-borne encephalitis virus
KSLAGVPVA

SEQ ID NO: 189079 - protein, 9 aa, Tick-borne encephalitis virus
SLAGVPVAH

SEQ ID NO: 189080 - protein, 9 aa, Tick-borne encephalitis virus
LAGVPVAHI

SEQ ID NO: 189081 - protein, 9 aa, Tick-borne encephalitis virus
AGVPVAHID

SEQ ID NO: 189082 - protein, 9 aa, Tick-borne encephalitis virus
GVPVAHIDG

SEQ ID NO: 189083 - protein, 9 aa, Tick-borne encephalitis virus
VPVAHIDGT

SEQ ID NO: 189084 - protein, 9 aa, Tick-borne encephalitis virus
PVAHIDGTK

SEQ ID NO: 189085 - protein, 9 aa, Tick-borne encephalitis virus
VAHIDGTKY

SEQ ID NO: 189086 - protein, 9 aa, Tick-borne encephalitis virus
AHIDGTKYH

SEQ ID NO: 189087 - protein, 9 aa, Tick-borne encephalitis virus
HIDGTKYHL

SEQ ID NO: 189088 - protein, 9 aa, Tick-borne encephalitis virus
IDGTKYHLK

SEQ ID NO: 189089 - protein, 9 aa, Tick-borne encephalitis virus
DGTKYHLKS

SEQ ID NO: 189090 - protein, 9 aa, Tick-borne encephalitis virus
GTKYHLKSG

SEQ ID NO: 189091 - protein, 9 aa, Tick-borne encephalitis virus
TKYHLKSGH

SEQ ID NO: 189092 - protein, 9 aa, Tick-borne encephalitis virus
KYHLKSGHV

SEQ ID NO: 189093 - protein, 9 aa, Tick-borne encephalitis virus
YHLKSGHVT

SEQ ID NO: 189094 - protein, 9 aa, Tick-borne encephalitis virus
HLKSGHVTC

SEQ ID NO: 189095 - protein, 9 aa, Tick-borne encephalitis virus
LKSGHVTCE

SEQ ID NO: 189096 - protein, 9 aa, Tick-borne encephalitis virus
KSGHVTCEV

SEQ ID NO: 189097 - protein, 9 aa, Tick-borne encephalitis virus
SGHVTCEVG

SEQ ID NO: 189098 - protein, 9 aa, Tick-borne encephalitis virus
GHVTCEVGL

SEQ ID NO: 189099 - protein, 9 aa, Tick-borne encephalitis virus
HVTCEVGLE

SEQ ID NO: 189100 - protein, 9 aa, Tick-borne encephalitis virus
VTCEVGLEK

SEQ ID NO: 189101 - protein, 9 aa, Tick-borne encephalitis virus
TCEVGLEKL

SEQ ID NO: 189102 - protein, 9 aa, Tick-borne encephalitis virus
CEVGLEKLK

SEQ ID NO: 189103 - protein, 9 aa, Tick-borne encephalitis virus
EVGLEKLKM

SEQ ID NO: 189104 - protein, 9 aa, Tick-borne encephalitis virus
VGLEKLKMK

SEQ ID NO: 189105 - protein, 9 aa, Tick-borne encephalitis virus
GLEKLKMKG

SEQ ID NO: 189106 - protein, 9 aa, Tick-borne encephalitis virus
LEKLKMKGL

SEQ ID NO: 189107 - protein, 9 aa, Tick-borne encephalitis virus
EKLKMKGLT

SEQ ID NO: 189108 - protein, 9 aa, Tick-borne encephalitis virus
KLKMKGLTY

SEQ ID NO: 189109 - protein, 9 aa, Tick-borne encephalitis virus
LKMKGLTYT

SEQ ID NO: 189110 - protein, 9 aa, Tick-borne encephalitis virus
KMKGLTYTM

SEQ ID NO: 189111 - protein, 9 aa, Tick-borne encephalitis virus
MKGLTYTMC

SEQ ID NO: 189112 - protein, 9 aa, Tick-borne encephalitis virus
KGLTYTMCD

SEQ ID NO: 189113 - protein, 9 aa, Tick-borne encephalitis virus
GLTYTMCDK

SEQ ID NO: 189114 - protein, 9 aa, Tick-borne encephalitis virus
LTYTMCDKT

SEQ ID NO: 189115 - protein, 9 aa, Tick-borne encephalitis virus
TYTMCDKTK

SEQ ID NO: 189116 - protein, 9 aa, Tick-borne encephalitis virus
YTMCDKTKF

SEQ ID NO: 189117 - protein, 9 aa, Tick-borne encephalitis virus
TMCDKTKFT

SEQ ID NO: 189118 - protein, 9 aa, Tick-borne encephalitis virus
MCDKTKFTW

SEQ ID NO: 189119 - protein, 9 aa, Tick-borne encephalitis virus
CDKTKFTWK

SEQ ID NO: 189120 - protein, 9 aa, Tick-borne encephalitis virus
DKTKFTWKR

SEQ ID NO: 189121 - protein, 9 aa, Tick-borne encephalitis virus
KTKFTWKRI

SEQ ID NO: 189122 - protein, 9 aa, Tick-borne encephalitis virus
TKFTWKRIP

SEQ ID NO: 189123 - protein, 9 aa, Tick-borne encephalitis virus
KFTWKRIPT

SEQ ID NO: 189124 - protein, 9 aa, Tick-borne encephalitis virus
FTWKRIPTD

SEQ ID NO: 189125 - protein, 9 aa, Tick-borne encephalitis virus
TWKRIPTDS

SEQ ID NO: 189126 - protein, 9 aa, Tick-borne encephalitis virus
WKRIPTDSG

SEQ ID NO: 189127 - protein, 9 aa, Tick-borne encephalitis virus
KRIPTDSGH

SEQ ID NO: 189128 - protein, 9 aa, Tick-borne encephalitis virus
RIPTDSGHD

SEQ ID NO: 189129 - protein, 9 aa, Tick-borne encephalitis virus
IPTDSGHDT

SEQ ID NO: 189130 - protein, 9 aa, Tick-borne encephalitis virus
PTDSGHDTV

SEQ ID NO: 189131 - protein, 9 aa, Tick-borne encephalitis virus
TDSGHDTVV

SEQ ID NO: 189132 - protein, 9 aa, Tick-borne encephalitis virus
DSGHDTVVM

SEQ ID NO: 189133 - protein, 9 aa, Tick-borne encephalitis virus
SGHDTVVME

SEQ ID NO: 189134 - protein, 9 aa, Tick-borne encephalitis virus
GHDTVVMEV

SEQ ID NO: 189135 - protein, 9 aa, Tick-borne encephalitis virus
HDTVVMEVA

SEQ ID NO: 189136 - protein, 9 aa, Tick-borne encephalitis virus
DTVVMEVAF

SEQ ID NO: 189137 - protein, 9 aa, Tick-borne encephalitis virus
TVVMEVAFS

SEQ ID NO: 189138 - protein, 9 aa, Tick-borne encephalitis virus
VVMEVAFSG

SEQ ID NO: 189139 - protein, 9 aa, Tick-borne encephalitis virus
VMEVAFSGT

SEQ ID NO: 189140 - protein, 9 aa, Tick-borne encephalitis virus
MEVAFSGTK

SEQ ID NO: 189141 - protein, 9 aa, Tick-borne encephalitis virus
EVAFSGTKP

SEQ ID NO: 189142 - protein, 9 aa, Tick-borne encephalitis virus
VAFSGTKPC

SEQ ID NO: 189143 - protein, 9 aa, Tick-borne encephalitis virus
AFSGTKPCR

SEQ ID NO: 189144 - protein, 9 aa, Tick-borne encephalitis virus
FSGTKPCRI

SEQ ID NO: 189145 - protein, 9 aa, Tick-borne encephalitis virus
SGTKPCRIP

SEQ ID NO: 189146 - protein, 9 aa, Tick-borne encephalitis virus
GTKPCRIPV

SEQ ID NO: 189147 - protein, 9 aa, Tick-borne encephalitis virus
TKPCRIPVR

SEQ ID NO: 189148 - protein, 9 aa, Tick-borne encephalitis virus
KPCRIPVRA

SEQ ID NO: 189149 - protein, 9 aa, Tick-borne encephalitis virus
PCRIPVRAV

SEQ ID NO: 189150 - protein, 9 aa, Tick-borne encephalitis virus
CRIPVRAVA

SEQ ID NO: 189151 - protein, 9 aa, Tick-borne encephalitis virus
RIPVRAVAH

SEQ ID NO: 189152 - protein, 9 aa, Tick-borne encephalitis virus
IPVRAVAHG

SEQ ID NO: 189153 - protein, 9 aa, Tick-borne encephalitis virus
PVRAVAHGS

SEQ ID NO: 189154 - protein, 9 aa, Tick-borne encephalitis virus
VRAVAHGSP

SEQ ID NO: 189155 - protein, 9 aa, Tick-borne encephalitis virus
RAVAHGSPD

SEQ ID NO: 189156 - protein, 9 aa, Tick-borne encephalitis virus
AVAHGSPDV

SEQ ID NO: 189157 - protein, 9 aa, Tick-borne encephalitis virus
VAHGSPDVN

SEQ ID NO: 189158 - protein, 9 aa, Tick-borne encephalitis virus
AHGSPDVNV

SEQ ID NO: 189159 - protein, 9 aa, Tick-borne encephalitis virus
HGSPDVNVA

SEQ ID NO: 189160 - protein, 9 aa, Tick-borne encephalitis virus
GSPDVNVAM

SEQ ID NO: 189161 - protein, 9 aa, Tick-borne encephalitis virus
SPDVNVAML

SEQ ID NO: 189162 - protein, 9 aa, Tick-borne encephalitis virus
PDVNVAMLI

SEQ ID NO: 189163 - protein, 9 aa, Tick-borne encephalitis virus
DVNVAMLIT

SEQ ID NO: 189164 - protein, 9 aa, Tick-borne encephalitis virus
VNVAMLITP

SEQ ID NO: 189165 - protein, 9 aa, Tick-borne encephalitis virus
NVAMLITPN

SEQ ID NO: 189166 - protein, 9 aa, Tick-borne encephalitis virus
VAMLITPNP

SEQ ID NO: 189167 - protein, 9 aa, Tick-borne encephalitis virus
AMLITPNPT

SEQ ID NO: 189168 - protein, 9 aa, Tick-borne encephalitis virus
MLITPNPTI

SEQ ID NO: 189169 - protein, 9 aa, Tick-borne encephalitis virus
LITPNPTIE

SEQ ID NO: 189170 - protein, 9 aa, Tick-borne encephalitis virus
ITPNPTIEN

SEQ ID NO: 189171 - protein, 9 aa, Tick-borne encephalitis virus
TPNPTIENN

SEQ ID NO: 189172 - protein, 9 aa, Tick-borne encephalitis virus
PNPTIENNG

SEQ ID NO: 189173 - protein, 9 aa, Tick-borne encephalitis virus
NPTIENNGG

SEQ ID NO: 189174 - protein, 9 aa, Tick-borne encephalitis virus
PTIENNGGG

SEQ ID NO: 189175 - protein, 9 aa, Tick-borne encephalitis virus
TIENNGGGF

SEQ ID NO: 189176 - protein, 9 aa, Tick-borne encephalitis virus
IENNGGGFI

SEQ ID NO: 189177 - protein, 9 aa, Tick-borne encephalitis virus
ENNGGGFIE

SEQ ID NO: 189178 - protein, 9 aa, Tick-borne encephalitis virus
NNGGGFIEM

SEQ ID NO: 189179 - protein, 9 aa, Tick-borne encephalitis virus
NGGGFIEMQ

SEQ ID NO: 189180 - protein, 9 aa, Tick-borne encephalitis virus
GGGFIEMQL

SEQ ID NO: 189181 - protein, 9 aa, Tick-borne encephalitis virus
GGFIEMQLP

SEQ ID NO: 189182 - protein, 9 aa, Tick-borne encephalitis virus
GFIEMQLPP

SEQ ID NO: 189183 - protein, 9 aa, Tick-borne encephalitis virus
FIEMQLPPG

SEQ ID NO: 189184 - protein, 9 aa, Tick-borne encephalitis virus
IEMQLPPGD

SEQ ID NO: 189185 - protein, 9 aa, Tick-borne encephalitis virus
EMQLPPGDN

SEQ ID NO: 189186 - protein, 9 aa, Tick-borne encephalitis virus
MQLPPGDNI

SEQ ID NO: 189187 - protein, 9 aa, Tick-borne encephalitis virus
QLPPGDNII

SEQ ID NO: 189188 - protein, 9 aa, Tick-borne encephalitis virus
LPPGDNIIY

SEQ ID NO: 189189 - protein, 9 aa, Tick-borne encephalitis virus
PPGDNIIYV

SEQ ID NO: 189190 - protein, 9 aa, Tick-borne encephalitis virus
PGDNIIYVG

SEQ ID NO: 189191 - protein, 9 aa, Tick-borne encephalitis virus
GDNIIYVGE

SEQ ID NO: 189192 - protein, 9 aa, Tick-borne encephalitis virus
DNIIYVGEL

SEQ ID NO: 189193 - protein, 9 aa, Tick-borne encephalitis virus
NIIYVGELS

SEQ ID NO: 189194 - protein, 9 aa, Tick-borne encephalitis virus
IIYVGELSH

SEQ ID NO: 189195 - protein, 9 aa, Tick-borne encephalitis virus
IYVGELSHQ

SEQ ID NO: 189196 - protein, 9 aa, Tick-borne encephalitis virus
YVGELSHQW

SEQ ID NO: 189197 - protein, 9 aa, Tick-borne encephalitis virus
VGELSHQWF

SEQ ID NO: 189198 - protein, 9 aa, Tick-borne encephalitis virus
GELSHQWFQ

SEQ ID NO: 189199 - protein, 9 aa, Tick-borne encephalitis virus
ELSHQWFQK

SEQ ID NO: 189200 - protein, 9 aa, Tick-borne encephalitis virus
LSHQWFQKG

SEQ ID NO: 189201 - protein, 9 aa, Tick-borne encephalitis virus
SHQWFQKGS

SEQ ID NO: 189202 - protein, 9 aa, Tick-borne encephalitis virus
HQWFQKGSS

SEQ ID NO: 189203 - protein, 9 aa, Tick-borne encephalitis virus
QWFQKGSSI

SEQ ID NO: 189204 - protein, 9 aa, Tick-borne encephalitis virus
WFQKGSSIG

SEQ ID NO: 189205 - protein, 9 aa, Tick-borne encephalitis virus
FQKGSSIGR

SEQ ID NO: 189206 - protein, 9 aa, Tick-borne encephalitis virus
QKGSSIGRV

SEQ ID NO: 189207 - protein, 9 aa, Tick-borne encephalitis virus
KGSSIGRVF

SEQ ID NO: 189208 - protein, 9 aa, Tick-borne encephalitis virus
GSSIGRVFQ

SEQ ID NO: 189209 - protein, 9 aa, Tick-borne encephalitis virus
SSIGRVFQK

SEQ ID NO: 189210 - protein, 9 aa, Tick-borne encephalitis virus
SIGRVFQKT

SEQ ID NO: 189211 - protein, 9 aa, Tick-borne encephalitis virus
IGRVFQKTR

SEQ ID NO: 189212 - protein, 9 aa, Tick-borne encephalitis virus
GRVFQKTRK

SEQ ID NO: 189213 - protein, 9 aa, Tick-borne encephalitis virus
RVFQKTRKG

SEQ ID NO: 189214 - protein, 9 aa, Tick-borne encephalitis virus
VFQKTRKGI

SEQ ID NO: 189215 - protein, 9 aa, Tick-borne encephalitis virus
FQKTRKGIE

SEQ ID NO: 189216 - protein, 9 aa, Tick-borne encephalitis virus
QKTRKGIER

SEQ ID NO: 189217 - protein, 9 aa, Tick-borne encephalitis virus
KTRKGIERL

SEQ ID NO: 189218 - protein, 9 aa, Tick-borne encephalitis virus
TRKGIERLT

SEQ ID NO: 189219 - protein, 9 aa, Tick-borne encephalitis virus
RKGIERLTV

SEQ ID NO: 189220 - protein, 9 aa, Tick-borne encephalitis virus
KGIERLTVI

SEQ ID NO: 189221 - protein, 9 aa, Tick-borne encephalitis virus
GIERLTVIG

SEQ ID NO: 189222 - protein, 9 aa, Tick-borne encephalitis virus
IERLTVIGE

SEQ ID NO: 189223 - protein, 9 aa, Tick-borne encephalitis virus
ERLTVIGEH

SEQ ID NO: 189224 - protein, 9 aa, Tick-borne encephalitis virus
RLTVIGEHA

SEQ ID NO: 189225 - protein, 9 aa, Tick-borne encephalitis virus
LTVIGEHAW

SEQ ID NO: 189226 - protein, 9 aa, Tick-borne encephalitis virus
TVIGEHAWD

SEQ ID NO: 189227 - protein, 9 aa, Tick-borne encephalitis virus
VIGEHAWDF

SEQ ID NO: 189228 - protein, 9 aa, Tick-borne encephalitis virus
IGEHAWDFG

SEQ ID NO: 189229 - protein, 9 aa, Tick-borne encephalitis virus
GEHAWDFGS

SEQ ID NO: 189230 - protein, 9 aa, Tick-borne encephalitis virus
EHAWDFGST

SEQ ID NO: 189231 - protein, 9 aa, Tick-borne encephalitis virus
HAWDFGSTG

SEQ ID NO: 189232 - protein, 9 aa, Tick-borne encephalitis virus
AWDFGSTGG

SEQ ID NO: 189233 - protein, 9 aa, Tick-borne encephalitis virus
WDFGSTGGF

SEQ ID NO: 189234 - protein, 9 aa, Tick-borne encephalitis virus
DFGSTGGFL

SEQ ID NO: 189235 - protein, 9 aa, Tick-borne encephalitis virus
FGSTGGFLT

SEQ ID NO: 189236 - protein, 9 aa, Tick-borne encephalitis virus
GSTGGFLTS

SEQ ID NO: 189237 - protein, 9 aa, Tick-borne encephalitis virus
STGGFLTSV

SEQ ID NO: 189238 - protein, 9 aa, Tick-borne encephalitis virus
TGGFLTSVG

SEQ ID NO: 189239 - protein, 9 aa, Tick-borne encephalitis virus
GGFLTSVGK

SEQ ID NO: 189240 - protein, 9 aa, Tick-borne encephalitis virus
GFLTSVGKA

SEQ ID NO: 189241 - protein, 9 aa, Tick-borne encephalitis virus
FLTSVGKAL

SEQ ID NO: 189242 - protein, 9 aa, Tick-borne encephalitis virus
LTSVGKALH

SEQ ID NO: 189243 - protein, 9 aa, Tick-borne encephalitis virus
TSVGKALHT

SEQ ID NO: 189244 - protein, 9 aa, Tick-borne encephalitis virus
SVGKALHTV

SEQ ID NO: 189245 - protein, 9 aa, Tick-borne encephalitis virus
VGKALHTVL

SEQ ID NO: 189246 - protein, 9 aa, Tick-borne encephalitis virus
GKALHTVLG

SEQ ID NO: 189247 - protein, 9 aa, Tick-borne encephalitis virus
KALHTVLGG

SEQ ID NO: 189248 - protein, 9 aa, Tick-borne encephalitis virus
ALHTVLGGA

SEQ ID NO: 189249 - protein, 9 aa, Tick-borne encephalitis virus
LHTVLGGAF

SEQ ID NO: 189250 - protein, 9 aa, Tick-borne encephalitis virus
HTVLGGAFN

SEQ ID NO: 189251 - protein, 9 aa, Tick-borne encephalitis virus
TVLGGAFNS

SEQ ID NO: 189252 - protein, 9 aa, Tick-borne encephalitis virus
VLGGAFNSL

SEQ ID NO: 189253 - protein, 9 aa, Tick-borne encephalitis virus
LGGAFNSLF

SEQ ID NO: 189254 - protein, 9 aa, Tick-borne encephalitis virus
GGAFNSLFG

SEQ ID NO: 189255 - protein, 9 aa, Tick-borne encephalitis virus
GAFNSLFGG

SEQ ID NO: 189256 - protein, 9 aa, Tick-borne encephalitis virus
AFNSLFGGV

SEQ ID NO: 189257 - protein, 9 aa, Tick-borne encephalitis virus
FNSLFGGVG

SEQ ID NO: 189258 - protein, 9 aa, Tick-borne encephalitis virus
NSLFGGVGF

SEQ ID NO: 189259 - protein, 9 aa, Tick-borne encephalitis virus
SLFGGVGFL

SEQ ID NO: 189260 - protein, 9 aa, Tick-borne encephalitis virus
LFGGVGFLP

SEQ ID NO: 189261 - protein, 9 aa, Tick-borne encephalitis virus
FGGVGFLPK

SEQ ID NO: 189262 - protein, 9 aa, Tick-borne encephalitis virus
GGVGFLPKI

SEQ ID NO: 189263 - protein, 9 aa, Tick-borne encephalitis virus
GVGFLPKIL

SEQ ID NO: 189264 - protein, 9 aa, Tick-borne encephalitis virus
VGFLPKILV

SEQ ID NO: 189265 - protein, 9 aa, Tick-borne encephalitis virus
GFLPKILVG

SEQ ID NO: 189266 - protein, 9 aa, Tick-borne encephalitis virus
GVALAWLGL

SEQ ID NO: 189267 - protein, 9 aa, Tick-borne encephalitis virus
VALAWLGLN

SEQ ID NO: 189268 - protein, 9 aa, Tick-borne encephalitis virus
ALAWLGLNM

SEQ ID NO: 189269 - protein, 9 aa, Tick-borne encephalitis virus
LAWLGLNMR

SEQ ID NO: 189270 - protein, 9 aa, Tick-borne encephalitis virus
AWLGLNMRN

SEQ ID NO: 189271 - protein, 9 aa, Tick-borne encephalitis virus
WLGLNMRNP

SEQ ID NO: 189272 - protein, 9 aa, Tick-borne encephalitis virus
LGLNMRNPT

SEQ ID NO: 189273 - protein, 9 aa, Tick-borne encephalitis virus
GLNMRNPTM

SEQ ID NO: 189274 - protein, 9 aa, Tick-borne encephalitis virus
LNMRNPTMS

SEQ ID NO: 189275 - protein, 9 aa, Tick-borne encephalitis virus
NMRNPTMSM

SEQ ID NO: 189276 - protein, 9 aa, Tick-borne encephalitis virus
MRNPTMSMS

SEQ ID NO: 189277 - protein, 9 aa, Tick-borne encephalitis virus
RNPTMSMSF

SEQ ID NO: 189278 - protein, 9 aa, Tick-borne encephalitis virus
NPTMSMSFL

SEQ ID NO: 189279 - protein, 9 aa, Tick-borne encephalitis virus
PTMSMSFLL

SEQ ID NO: 189280 - protein, 9 aa, Tick-borne encephalitis virus
TMSMSFLLA

SEQ ID NO: 189281 - protein, 9 aa, Tick-borne encephalitis virus
MSMSFLLAG

SEQ ID NO: 189282 - protein, 9 aa, Tick-borne encephalitis virus
SMSFLLAGG

SEQ ID NO: 189283 - protein, 9 aa, Tick-borne encephalitis virus
MSFLLAGGL

SEQ ID NO: 189284 - protein, 9 aa, Tick-borne encephalitis virus
SFLLAGGLV

SEQ ID NO: 189285 - protein, 9 aa, Tick-borne encephalitis virus
FLLAGGLVL

SEQ ID NO: 189286 - protein, 9 aa, Tick-borne encephalitis virus
LLAGGLVLA

SEQ ID NO: 189287 - protein, 9 aa, Tick-borne encephalitis virus
LAGGLVLAM

SEQ ID NO: 189288 - protein, 9 aa, Tick-borne encephalitis virus
AGGLVLAMT

SEQ ID NO: 189289 - protein, 9 aa, Tick-borne encephalitis virus
GGLVLAMTL

SEQ ID NO: 189290 - protein, 9 aa, Tick-borne encephalitis virus
GLVLAMTLG

SEQ ID NO: 189291 - protein, 9 aa, Tick-borne encephalitis virus
LVLAMTLGV

SEQ ID NO: 189292 - protein, 9 aa, Tick-borne encephalitis virus
VLAMTLGVG

SEQ ID NO: 189293 - protein, 9 aa, Tick-borne encephalitis virus
LAMTLGVGA

SEQ ID NO: 189294 - protein, 9 aa, Tick-borne encephalitis virus
AMTLGVGAD

SEQ ID NO: 189295 - protein, 9 aa, Tick-borne encephalitis virus
MTLGVGADV

SEQ ID NO: 189296 - protein, 9 aa, Tick-borne encephalitis virus
TLGVGADVG

SEQ ID NO: 189297 - protein, 9 aa, Tick-borne encephalitis virus
LGVGADVGC

SEQ ID NO: 189298 - protein, 9 aa, Tick-borne encephalitis virus
GVGADVGCA

SEQ ID NO: 189299 - protein, 9 aa, Tick-borne encephalitis virus
VGADVGCAV

SEQ ID NO: 189300 - protein, 9 aa, Tick-borne encephalitis virus
GADVGCAVD

SEQ ID NO: 189301 - protein, 9 aa, Tick-borne encephalitis virus
ADVGCAVDT

SEQ ID NO: 189302 - protein, 9 aa, Tick-borne encephalitis virus
DVGCAVDTE

SEQ ID NO: 189303 - protein, 9 aa, Tick-borne encephalitis virus
VGCAVDTER

SEQ ID NO: 189304 - protein, 9 aa, Tick-borne encephalitis virus
GCAVDTERM

SEQ ID NO: 189305 - protein, 9 aa, Tick-borne encephalitis virus
CAVDTERME

SEQ ID NO: 189306 - protein, 9 aa, Tick-borne encephalitis virus
AVDTERMEL

SEQ ID NO: 189307 - protein, 9 aa, Tick-borne encephalitis virus
VDTERMELR

SEQ ID NO: 189308 - protein, 9 aa, Tick-borne encephalitis virus
DTERMELRC

SEQ ID NO: 189309 - protein, 9 aa, Tick-borne encephalitis virus
TERMELRCG

SEQ ID NO: 189310 - protein, 9 aa, Tick-borne encephalitis virus
ERMELRCGE

SEQ ID NO: 189311 - protein, 9 aa, Tick-borne encephalitis virus
RMELRCGEG

SEQ ID NO: 189312 - protein, 9 aa, Tick-borne encephalitis virus
MELRCGEGL

SEQ ID NO: 189313 - protein, 9 aa, Tick-borne encephalitis virus
ELRCGEGLV

SEQ ID NO: 189314 - protein, 9 aa, Tick-borne encephalitis virus
LRCGEGLVV

SEQ ID NO: 189315 - protein, 9 aa, Tick-borne encephalitis virus
RCGEGLVVW

SEQ ID NO: 189316 - protein, 9 aa, Tick-borne encephalitis virus
CGEGLVVWR

SEQ ID NO: 189317 - protein, 9 aa, Tick-borne encephalitis virus
GEGLVVWRE

SEQ ID NO: 189318 - protein, 9 aa, Tick-borne encephalitis virus
EGLVVWREV

SEQ ID NO: 189319 - protein, 9 aa, Tick-borne encephalitis virus
GLVVWREVS

SEQ ID NO: 189320 - protein, 9 aa, Tick-borne encephalitis virus
LVVWREVSE

SEQ ID NO: 189321 - protein, 9 aa, Tick-borne encephalitis virus
VVWREVSEW

SEQ ID NO: 189322 - protein, 9 aa, Tick-borne encephalitis virus
VWREVSEWY

SEQ ID NO: 189323 - protein, 9 aa, Tick-borne encephalitis virus
WREVSEWYD

SEQ ID NO: 189324 - protein, 9 aa, Tick-borne encephalitis virus
REVSEWYDN

SEQ ID NO: 189325 - protein, 9 aa, Tick-borne encephalitis virus
EVSEWYDNY

SEQ ID NO: 189326 - protein, 9 aa, Tick-borne encephalitis virus
VSEWYDNYA

SEQ ID NO: 189327 - protein, 9 aa, Tick-borne encephalitis virus
SEWYDNYAY

SEQ ID NO: 189328 - protein, 9 aa, Tick-borne encephalitis virus
EWYDNYAYY

SEQ ID NO: 189329 - protein, 9 aa, Tick-borne encephalitis virus
WYDNYAYYP

SEQ ID NO: 189330 - protein, 9 aa, Tick-borne encephalitis virus
YDNYAYYPE

SEQ ID NO: 189331 - protein, 9 aa, Tick-borne encephalitis virus
DNYAYYPET

SEQ ID NO: 189332 - protein, 9 aa, Tick-borne encephalitis virus
NYAYYPETP

SEQ ID NO: 189333 - protein, 9 aa, Tick-borne encephalitis virus
YAYYPETPG

SEQ ID NO: 189334 - protein, 9 aa, Tick-borne encephalitis virus
AYYPETPGA

SEQ ID NO: 189335 - protein, 9 aa, Tick-borne encephalitis virus
YYPETPGAL

SEQ ID NO: 189336 - protein, 9 aa, Tick-borne encephalitis virus
YPETPGALA

SEQ ID NO: 189337 - protein, 9 aa, Tick-borne encephalitis virus
PETPGALAS

SEQ ID NO: 189338 - protein, 9 aa, Tick-borne encephalitis virus
ETPGALASA

SEQ ID NO: 189339 - protein, 9 aa, Tick-borne encephalitis virus
TPGALASAI

SEQ ID NO: 189340 - protein, 9 aa, Tick-borne encephalitis virus
PGALASAIK

SEQ ID NO: 189341 - protein, 9 aa, Tick-borne encephalitis virus
GALASAIKE

SEQ ID NO: 189342 - protein, 9 aa, Tick-borne encephalitis virus
ALASAIKET

SEQ ID NO: 189343 - protein, 9 aa, Tick-borne encephalitis virus
LASAIKETF

SEQ ID NO: 189344 - protein, 9 aa, Tick-borne encephalitis virus
ASAIKETFE

SEQ ID NO: 189345 - protein, 9 aa, Tick-borne encephalitis virus
SAIKETFEE

SEQ ID NO: 189346 - protein, 9 aa, Tick-borne encephalitis virus
AIKETFEEG

SEQ ID NO: 189347 - protein, 9 aa, Tick-borne encephalitis virus
IKETFEEGT

SEQ ID NO: 189348 - protein, 9 aa, Tick-borne encephalitis virus
KETFEEGTC

SEQ ID NO: 189349 - protein, 9 aa, Tick-borne encephalitis virus
ETFEEGTCG

SEQ ID NO: 189350 - protein, 9 aa, Tick-borne encephalitis virus
TFEEGTCGI

SEQ ID NO: 189351 - protein, 9 aa, Tick-borne encephalitis virus
FEEGTCGIV

SEQ ID NO: 189352 - protein, 9 aa, Tick-borne encephalitis virus
EEGTCGIVP

SEQ ID NO: 189353 - protein, 9 aa, Tick-borne encephalitis virus
EGTCGIVPQ

SEQ ID NO: 189354 - protein, 9 aa, Tick-borne encephalitis virus
GTCGIVPQN

SEQ ID NO: 189355 - protein, 9 aa, Tick-borne encephalitis virus
TCGIVPQNR

SEQ ID NO: 189356 - protein, 9 aa, Tick-borne encephalitis virus
CGIVPQNRL

SEQ ID NO: 189357 - protein, 9 aa, Tick-borne encephalitis virus
GIVPQNRLE

SEQ ID NO: 189358 - protein, 9 aa, Tick-borne encephalitis virus
IVPQNRLEM

SEQ ID NO: 189359 - protein, 9 aa, Tick-borne encephalitis virus
VPQNRLEMA

SEQ ID NO: 189360 - protein, 9 aa, Tick-borne encephalitis virus
PQNRLEMAM

SEQ ID NO: 189361 - protein, 9 aa, Tick-borne encephalitis virus
QNRLEMAMW

SEQ ID NO: 189362 - protein, 9 aa, Tick-borne encephalitis virus
NRLEMAMWR

SEQ ID NO: 189363 - protein, 9 aa, Tick-borne encephalitis virus
RLEMAMWRS

SEQ ID NO: 189364 - protein, 9 aa, Tick-borne encephalitis virus
LEMAMWRSS

SEQ ID NO: 189365 - protein, 9 aa, Tick-borne encephalitis virus
EMAMWRSSA

SEQ ID NO: 189366 - protein, 9 aa, Tick-borne encephalitis virus
MAMWRSSAT

SEQ ID NO: 189367 - protein, 9 aa, Tick-borne encephalitis virus
AMWRSSATE

SEQ ID NO: 189368 - protein, 9 aa, Tick-borne encephalitis virus
MWRSSATEL

SEQ ID NO: 189369 - protein, 9 aa, Tick-borne encephalitis virus
WRSSATELN

SEQ ID NO: 189370 - protein, 9 aa, Tick-borne encephalitis virus
RSSATELNL

SEQ ID NO: 189371 - protein, 9 aa, Tick-borne encephalitis virus
SSATELNLA

SEQ ID NO: 189372 - protein, 9 aa, Tick-borne encephalitis virus
SATELNLAL

SEQ ID NO: 189373 - protein, 9 aa, Tick-borne encephalitis virus
ATELNLALA

SEQ ID NO: 189374 - protein, 9 aa, Tick-borne encephalitis virus
TELNLALAE

SEQ ID NO: 189375 - protein, 9 aa, Tick-borne encephalitis virus
ELNLALAEG

SEQ ID NO: 189376 - protein, 9 aa, Tick-borne encephalitis virus
LNLALAEGD

SEQ ID NO: 189377 - protein, 9 aa, Tick-borne encephalitis virus
NLALAEGDA

SEQ ID NO: 189378 - protein, 9 aa, Tick-borne encephalitis virus
LALAEGDAN

SEQ ID NO: 189379 - protein, 9 aa, Tick-borne encephalitis virus
ALAEGDANL

SEQ ID NO: 189380 - protein, 9 aa, Tick-borne encephalitis virus
LAEGDANLT

SEQ ID NO: 189381 - protein, 9 aa, Tick-borne encephalitis virus
AEGDANLTV

SEQ ID NO: 189382 - protein, 9 aa, Tick-borne encephalitis virus
EGDANLTVV

SEQ ID NO: 189383 - protein, 9 aa, Tick-borne encephalitis virus
GDANLTVVV

SEQ ID NO: 189384 - protein, 9 aa, Tick-borne encephalitis virus
DANLTVVVD

SEQ ID NO: 189385 - protein, 9 aa, Tick-borne encephalitis virus
ANLTVVVDK

SEQ ID NO: 189386 - protein, 9 aa, Tick-borne encephalitis virus
NLTVVVDKL

SEQ ID NO: 189387 - protein, 9 aa, Tick-borne encephalitis virus
LTVVVDKLD

SEQ ID NO: 189388 - protein, 9 aa, Tick-borne encephalitis virus
TVVVDKLDP

SEQ ID NO: 189389 - protein, 9 aa, Tick-borne encephalitis virus
VVVDKLDPT

SEQ ID NO: 189390 - protein, 9 aa, Tick-borne encephalitis virus
VVDKLDPTD

SEQ ID NO: 189391 - protein, 9 aa, Tick-borne encephalitis virus
VDKLDPTDY

SEQ ID NO: 189392 - protein, 9 aa, Tick-borne encephalitis virus
DKLDPTDYR

SEQ ID NO: 189393 - protein, 9 aa, Tick-borne encephalitis virus
KLDPTDYRG

SEQ ID NO: 189394 - protein, 9 aa, Tick-borne encephalitis virus
LDPTDYRGG

SEQ ID NO: 189395 - protein, 9 aa, Tick-borne encephalitis virus
DPTDYRGGI

SEQ ID NO: 189396 - protein, 9 aa, Tick-borne encephalitis virus
PTDYRGGIP

SEQ ID NO: 189397 - protein, 9 aa, Tick-borne encephalitis virus
TDYRGGIPG

SEQ ID NO: 189398 - protein, 9 aa, Tick-borne encephalitis virus
DYRGGIPGL

SEQ ID NO: 189399 - protein, 9 aa, Tick-borne encephalitis virus
YRGGIPGLL

SEQ ID NO: 189400 - protein, 9 aa, Tick-borne encephalitis virus
RGGIPGLLK

SEQ ID NO: 189401 - protein, 9 aa, Tick-borne encephalitis virus
GGIPGLLKK

SEQ ID NO: 189402 - protein, 9 aa, Tick-borne encephalitis virus
GIPGLLKKG

SEQ ID NO: 189403 - protein, 9 aa, Tick-borne encephalitis virus
IPGLLKKGK

SEQ ID NO: 189404 - protein, 9 aa, Tick-borne encephalitis virus
PGLLKKGKD

SEQ ID NO: 189405 - protein, 9 aa, Tick-borne encephalitis virus
GLLKKGKDI

SEQ ID NO: 189406 - protein, 9 aa, Tick-borne encephalitis virus
LLKKGKDIK

SEQ ID NO: 189407 - protein, 9 aa, Tick-borne encephalitis virus
LKKGKDIKV

SEQ ID NO: 189408 - protein, 9 aa, Tick-borne encephalitis virus
KKGKDIKVS

SEQ ID NO: 189409 - protein, 9 aa, Tick-borne encephalitis virus
KGKDIKVSW

SEQ ID NO: 189410 - protein, 9 aa, Tick-borne encephalitis virus
GKDIKVSWK

SEQ ID NO: 189411 - protein, 9 aa, Tick-borne encephalitis virus
KDIKVSWKS

SEQ ID NO: 189412 - protein, 9 aa, Tick-borne encephalitis virus
DIKVSWKSW

SEQ ID NO: 189413 - protein, 9 aa, Tick-borne encephalitis virus
IKVSWKSWG

SEQ ID NO: 189414 - protein, 9 aa, Tick-borne encephalitis virus
KVSWKSWGH

SEQ ID NO: 189415 - protein, 9 aa, Tick-borne encephalitis virus
VSWKSWGHS

SEQ ID NO: 189416 - protein, 9 aa, Tick-borne encephalitis virus
SWGHSMIWS

SEQ ID NO: 189417 - protein, 9 aa, Tick-borne encephalitis virus
SMIWSVPEA

SEQ ID NO: 189418 - protein, 9 aa, Tick-borne encephalitis virus
MIWSVPEAP

SEQ ID NO: 189419 - protein, 9 aa, Tick-borne encephalitis virus
IWSVPEAPR

SEQ ID NO: 189420 - protein, 9 aa, Tick-borne encephalitis virus
WSVPEAPRR

SEQ ID NO: 189421 - protein, 9 aa, Tick-borne encephalitis virus
SVPEAPRRF

SEQ ID NO: 189422 - protein, 9 aa, Tick-borne encephalitis virus
VPEAPRRFM

SEQ ID NO: 189423 - protein, 9 aa, Tick-borne encephalitis virus
PEAPRRFMV

SEQ ID NO: 189424 - protein, 9 aa, Tick-borne encephalitis virus
EAPRRFMVG

SEQ ID NO: 189425 - protein, 9 aa, Tick-borne encephalitis virus
APRRFMVGT

SEQ ID NO: 189426 - protein, 9 aa, Tick-borne encephalitis virus
PRRFMVGTE

SEQ ID NO: 189427 - protein, 9 aa, Tick-borne encephalitis virus
RRFMVGTEG

SEQ ID NO: 189428 - protein, 9 aa, Tick-borne encephalitis virus
RFMVGTEGG

SEQ ID NO: 189429 - protein, 9 aa, Tick-borne encephalitis virus
SECPLERRK

SEQ ID NO: 189430 - protein, 9 aa, Tick-borne encephalitis virus
ECPLERRKT

SEQ ID NO: 189431 - protein, 9 aa, Tick-borne encephalitis virus
CPLERRKTG

SEQ ID NO: 189432 - protein, 9 aa, Tick-borne encephalitis virus
PLERRKTGV

SEQ ID NO: 189433 - protein, 9 aa, Tick-borne encephalitis virus
LERRKTGVF

SEQ ID NO: 189434 - protein, 9 aa, Tick-borne encephalitis virus
ERRKTGVFT

SEQ ID NO: 189435 - protein, 9 aa, Tick-borne encephalitis virus
RRKTGVFTV

SEQ ID NO: 189436 - protein, 9 aa, Tick-borne encephalitis virus
RKTGVFTVA

SEQ ID NO: 189437 - protein, 9 aa, Tick-borne encephalitis virus
KTGVFTVAE

SEQ ID NO: 189438 - protein, 9 aa, Tick-borne encephalitis virus
TGVFTVAEF

SEQ ID NO: 189439 - protein, 9 aa, Tick-borne encephalitis virus
GVFTVAEFG

SEQ ID NO: 189440 - protein, 9 aa, Tick-borne encephalitis virus
VFTVAEFGV

SEQ ID NO: 189441 - protein, 9 aa, Tick-borne encephalitis virus
FTVAEFGVG

SEQ ID NO: 189442 - protein, 9 aa, Tick-borne encephalitis virus
TVAEFGVGL

SEQ ID NO: 189443 - protein, 9 aa, Tick-borne encephalitis virus
VAEFGVGLR

SEQ ID NO: 189444 - protein, 9 aa, Tick-borne encephalitis virus
AEFGVGLRT

SEQ ID NO: 189445 - protein, 9 aa, Tick-borne encephalitis virus
EFGVGLRTK

SEQ ID NO: 189446 - protein, 9 aa, Tick-borne encephalitis virus
FGVGLRTKV

SEQ ID NO: 189447 - protein, 9 aa, Tick-borne encephalitis virus
GVGLRTKVF

SEQ ID NO: 189448 - protein, 9 aa, Tick-borne encephalitis virus
VGLRTKVFL

SEQ ID NO: 189449 - protein, 9 aa, Tick-borne encephalitis virus
GLRTKVFLD

SEQ ID NO: 189450 - protein, 9 aa, Tick-borne encephalitis virus
LRTKVFLDF

SEQ ID NO: 189451 - protein, 9 aa, Tick-borne encephalitis virus
RTKVFLDFR

SEQ ID NO: 189452 - protein, 9 aa, Tick-borne encephalitis virus
TKVFLDFRQ

SEQ ID NO: 189453 - protein, 9 aa, Tick-borne encephalitis virus
KVFLDFRQE

SEQ ID NO: 189454 - protein, 9 aa, Tick-borne encephalitis virus
VFLDFRQES

SEQ ID NO: 189455 - protein, 9 aa, Tick-borne encephalitis virus
FLDFRQEST

SEQ ID NO: 189456 - protein, 9 aa, Tick-borne encephalitis virus
LDFRQESTH

SEQ ID NO: 189457 - protein, 9 aa, Tick-borne encephalitis virus
DFRQESTHE

SEQ ID NO: 189458 - protein, 9 aa, Tick-borne encephalitis virus
FRQESTHEC

SEQ ID NO: 189459 - protein, 9 aa, Tick-borne encephalitis virus
RQESTHECD

SEQ ID NO: 189460 - protein, 9 aa, Tick-borne encephalitis virus
QESTHECDT

SEQ ID NO: 189461 - protein, 9 aa, Tick-borne encephalitis virus
ESTHECDTG

SEQ ID NO: 189462 - protein, 9 aa, Tick-borne encephalitis virus
STHECDTGV

SEQ ID NO: 189463 - protein, 9 aa, Tick-borne encephalitis virus
THECDTGVM

SEQ ID NO: 189464 - protein, 9 aa, Tick-borne encephalitis virus
HECDTGVMG

SEQ ID NO: 189465 - protein, 9 aa, Tick-borne encephalitis virus
ECDTGVMGA

SEQ ID NO: 189466 - protein, 9 aa, Tick-borne encephalitis virus
CDTGVMGAA

SEQ ID NO: 189467 - protein, 9 aa, Tick-borne encephalitis virus
DTGVMGAAV

SEQ ID NO: 189468 - protein, 9 aa, Tick-borne encephalitis virus
TGVMGAAVK

SEQ ID NO: 189469 - protein, 9 aa, Tick-borne encephalitis virus
GVMGAAVKN

SEQ ID NO: 189470 - protein, 9 aa, Tick-borne encephalitis virus
VMGAAVKNG

SEQ ID NO: 189471 - protein, 9 aa, Tick-borne encephalitis virus
MGAAVKNGM

SEQ ID NO: 189472 - protein, 9 aa, Tick-borne encephalitis virus
GAAVKNGMA

SEQ ID NO: 189473 - protein, 9 aa, Tick-borne encephalitis virus
AAVKNGMAV

SEQ ID NO: 189474 - protein, 9 aa, Tick-borne encephalitis virus
AVKNGMAVH

SEQ ID NO: 189475 - protein, 9 aa, Tick-borne encephalitis virus
VKNGMAVHT

SEQ ID NO: 189476 - protein, 9 aa, Tick-borne encephalitis virus
KNGMAVHTD

SEQ ID NO: 189477 - protein, 9 aa, Tick-borne encephalitis virus
NGMAVHTDQ

SEQ ID NO: 189478 - protein, 9 aa, Tick-borne encephalitis virus
GMAVHTDQS

SEQ ID NO: 189479 - protein, 9 aa, Tick-borne encephalitis virus
MAVHTDQSL

SEQ ID NO: 189480 - protein, 9 aa, Tick-borne encephalitis virus
AVHTDQSLW

SEQ ID NO: 189481 - protein, 9 aa, Tick-borne encephalitis virus
VHTDQSLWM

SEQ ID NO: 189482 - protein, 9 aa, Tick-borne encephalitis virus
HTDQSLWMK

SEQ ID NO: 189483 - protein, 9 aa, Tick-borne encephalitis virus
TDQSLWMKS

SEQ ID NO: 189484 - protein, 9 aa, Tick-borne encephalitis virus
DQSLWMKSV

SEQ ID NO: 189485 - protein, 9 aa, Tick-borne encephalitis virus
QSLWMKSVR

SEQ ID NO: 189486 - protein, 9 aa, Tick-borne encephalitis virus
SLWMKSVRN

SEQ ID NO: 189487 - protein, 9 aa, Tick-borne encephalitis virus
LWMKSVRND

SEQ ID NO: 189488 - protein, 9 aa, Tick-borne encephalitis virus
WMKSVRNDT

SEQ ID NO: 189489 - protein, 9 aa, Tick-borne encephalitis virus
MKSVRNDTG

SEQ ID NO: 189490 - protein, 9 aa, Tick-borne encephalitis virus
KSVRNDTGT

SEQ ID NO: 189491 - protein, 9 aa, Tick-borne encephalitis virus
SVRNDTGTY

SEQ ID NO: 189492 - protein, 9 aa, Tick-borne encephalitis virus
VRNDTGTYI

SEQ ID NO: 189493 - protein, 9 aa, Tick-borne encephalitis virus
RNDTGTYIV

SEQ ID NO: 189494 - protein, 9 aa, Tick-borne encephalitis virus
NDTGTYIVE

SEQ ID NO: 189495 - protein, 9 aa, Tick-borne encephalitis virus
DTGTYIVEL

SEQ ID NO: 189496 - protein, 9 aa, Tick-borne encephalitis virus
TGTYIVELL

SEQ ID NO: 189497 - protein, 9 aa, Tick-borne encephalitis virus
GTYIVELLV

SEQ ID NO: 189498 - protein, 9 aa, Tick-borne encephalitis virus
TYIVELLVT

SEQ ID NO: 189499 - protein, 9 aa, Tick-borne encephalitis virus
YIVELLVTD

SEQ ID NO: 189500 - protein, 9 aa, Tick-borne encephalitis virus
IVELLVTDL

SEQ ID NO: 189501 - protein, 9 aa, Tick-borne encephalitis virus
VELLVTDLR

SEQ ID NO: 189502 - protein, 9 aa, Tick-borne encephalitis virus
ELLVTDLRN

SEQ ID NO: 189503 - protein, 9 aa, Tick-borne encephalitis virus
LLVTDLRNC

SEQ ID NO: 189504 - protein, 9 aa, Tick-borne encephalitis virus
LVTDLRNCS

SEQ ID NO: 189505 - protein, 9 aa, Tick-borne encephalitis virus
VTDLRNCSW

SEQ ID NO: 189506 - protein, 9 aa, Tick-borne encephalitis virus
TDLRNCSWP

SEQ ID NO: 189507 - protein, 9 aa, Tick-borne encephalitis virus
DLRNCSWPA

SEQ ID NO: 189508 - protein, 9 aa, Tick-borne encephalitis virus
LRNCSWPAS

SEQ ID NO: 189509 - protein, 9 aa, Tick-borne encephalitis virus
RNCSWPASH

SEQ ID NO: 189510 - protein, 9 aa, Tick-borne encephalitis virus
NCSWPASHT

SEQ ID NO: 189511 - protein, 9 aa, Tick-borne encephalitis virus
CSWPASHTI

SEQ ID NO: 189512 - protein, 9 aa, Tick-borne encephalitis virus
SWPASHTID

SEQ ID NO: 189513 - protein, 9 aa, Tick-borne encephalitis virus
WPASHTIDN

SEQ ID NO: 189514 - protein, 9 aa, Tick-borne encephalitis virus
PASHTIDNA

SEQ ID NO: 189515 - protein, 9 aa, Tick-borne encephalitis virus
ASHTIDNAE

SEQ ID NO: 189516 - protein, 9 aa, Tick-borne encephalitis virus
SHTIDNAEV

SEQ ID NO: 189517 - protein, 9 aa, Tick-borne encephalitis virus
HTIDNAEVV

SEQ ID NO: 189518 - protein, 9 aa, Tick-borne encephalitis virus
TIDNAEVVD

SEQ ID NO: 189519 - protein, 9 aa, Tick-borne encephalitis virus
IDNAEVVDS

SEQ ID NO: 189520 - protein, 9 aa, Tick-borne encephalitis virus
DNAEVVDSE

SEQ ID NO: 189521 - protein, 9 aa, Tick-borne encephalitis virus
NAEVVDSEL

SEQ ID NO: 189522 - protein, 9 aa, Tick-borne encephalitis virus
AEVVDSELF

SEQ ID NO: 189523 - protein, 9 aa, Tick-borne encephalitis virus
EVVDSELFL

SEQ ID NO: 189524 - protein, 9 aa, Tick-borne encephalitis virus
VVDSELFLP

SEQ ID NO: 189525 - protein, 9 aa, Tick-borne encephalitis virus
VDSELFLPA

SEQ ID NO: 189526 - protein, 9 aa, Tick-borne encephalitis virus
DSELFLPAS

SEQ ID NO: 189527 - protein, 9 aa, Tick-borne encephalitis virus
SELFLPASL

SEQ ID NO: 189528 - protein, 9 aa, Tick-borne encephalitis virus
ELFLPASLA

SEQ ID NO: 189529 - protein, 9 aa, Tick-borne encephalitis virus
LFLPASLAG

SEQ ID NO: 189530 - protein, 9 aa, Tick-borne encephalitis virus
FLPASLAGP

SEQ ID NO: 189531 - protein, 9 aa, Tick-borne encephalitis virus
LPASLAGPR

SEQ ID NO: 189532 - protein, 9 aa, Tick-borne encephalitis virus
PASLAGPRS

SEQ ID NO: 189533 - protein, 9 aa, Tick-borne encephalitis virus
ASLAGPRSW

SEQ ID NO: 189534 - protein, 9 aa, Tick-borne encephalitis virus
SLAGPRSWY

SEQ ID NO: 189535 - protein, 9 aa, Tick-borne encephalitis virus
LAGPRSWYN

SEQ ID NO: 189536 - protein, 9 aa, Tick-borne encephalitis virus
AGPRSWYNR

SEQ ID NO: 189537 - protein, 9 aa, Tick-borne encephalitis virus
GPRSWYNRI

SEQ ID NO: 189538 - protein, 9 aa, Tick-borne encephalitis virus
PRSWYNRIP

SEQ ID NO: 189539 - protein, 9 aa, Tick-borne encephalitis virus
RSWYNRIPG

SEQ ID NO: 189540 - protein, 9 aa, Tick-borne encephalitis virus
SWYNRIPGY

SEQ ID NO: 189541 - protein, 9 aa, Tick-borne encephalitis virus
WYNRIPGYS

SEQ ID NO: 189542 - protein, 9 aa, Tick-borne encephalitis virus
YNRIPGYSE

SEQ ID NO: 189543 - protein, 9 aa, Tick-borne encephalitis virus
NRIPGYSEQ

SEQ ID NO: 189544 - protein, 9 aa, Tick-borne encephalitis virus
RIPGYSEQV

SEQ ID NO: 189545 - protein, 9 aa, Tick-borne encephalitis virus
IPGYSEQVK

SEQ ID NO: 189546 - protein, 9 aa, Tick-borne encephalitis virus
PGYSEQVKG

SEQ ID NO: 189547 - protein, 9 aa, Tick-borne encephalitis virus
GYSEQVKGP

SEQ ID NO: 189548 - protein, 9 aa, Tick-borne encephalitis virus
YSEQVKGPW

SEQ ID NO: 189549 - protein, 9 aa, Tick-borne encephalitis virus
SEQVKGPWK

SEQ ID NO: 189550 - protein, 9 aa, Tick-borne encephalitis virus
EQVKGPWKY

SEQ ID NO: 189551 - protein, 9 aa, Tick-borne encephalitis virus
QVKGPWKYS

SEQ ID NO: 189552 - protein, 9 aa, Tick-borne encephalitis virus
VKGPWKYSP

SEQ ID NO: 189553 - protein, 9 aa, Tick-borne encephalitis virus
KGPWKYSPI

SEQ ID NO: 189554 - protein, 9 aa, Tick-borne encephalitis virus
GPWKYSPIR

SEQ ID NO: 189555 - protein, 9 aa, Tick-borne encephalitis virus
PWKYSPIRV

SEQ ID NO: 189556 - protein, 9 aa, Tick-borne encephalitis virus
PIRVTREEC

SEQ ID NO: 189557 - protein, 9 aa, Tick-borne encephalitis virus
IRVTREECP

SEQ ID NO: 189558 - protein, 9 aa, Tick-borne encephalitis virus
RVTREECPG

SEQ ID NO: 189559 - protein, 9 aa, Tick-borne encephalitis virus
VTREECPGT

SEQ ID NO: 189560 - protein, 9 aa, Tick-borne encephalitis virus
TREECPGTR

SEQ ID NO: 189561 - protein, 9 aa, Tick-borne encephalitis virus
REECPGTRV

SEQ ID NO: 189562 - protein, 9 aa, Tick-borne encephalitis virus
ECPGTRVTI

SEQ ID NO: 189563 - protein, 9 aa, Tick-borne encephalitis virus
INADCDKRG

SEQ ID NO: 189564 - protein, 9 aa, Tick-borne encephalitis virus
NADCDKRGA

SEQ ID NO: 189565 - protein, 9 aa, Tick-borne encephalitis virus
ADCDKRGAS

SEQ ID NO: 189566 - protein, 9 aa, Tick-borne encephalitis virus
DCDKRGASV

SEQ ID NO: 189567 - protein, 9 aa, Tick-borne encephalitis virus
CDKRGASVR

SEQ ID NO: 189568 - protein, 9 aa, Tick-borne encephalitis virus
DKRGASVRS

SEQ ID NO: 189569 - protein, 9 aa, Tick-borne encephalitis virus
KRGASVRST

SEQ ID NO: 189570 - protein, 9 aa, Tick-borne encephalitis virus
RGASVRSTT

SEQ ID NO: 189571 - protein, 9 aa, Tick-borne encephalitis virus
GASVRSTTE

SEQ ID NO: 189572 - protein, 9 aa, Tick-borne encephalitis virus
ASVRSTTES

SEQ ID NO: 189573 - protein, 9 aa, Tick-borne encephalitis virus
SVRSTTESG

SEQ ID NO: 189574 - protein, 9 aa, Tick-borne encephalitis virus
VRSTTESGK

SEQ ID NO: 189575 - protein, 9 aa, Tick-borne encephalitis virus
RSTTESGKV

SEQ ID NO: 189576 - protein, 9 aa, Tick-borne encephalitis virus
STTESGKVI

SEQ ID NO: 189577 - protein, 9 aa, Tick-borne encephalitis virus
TTESGKVIP

SEQ ID NO: 189578 - protein, 9 aa, Tick-borne encephalitis virus
TESGKVIPE

SEQ ID NO: 189579 - protein, 9 aa, Tick-borne encephalitis virus
ESGKVIPEW

SEQ ID NO: 189580 - protein, 9 aa, Tick-borne encephalitis virus
SGKVIPEWC

SEQ ID NO: 189581 - protein, 9 aa, Tick-borne encephalitis virus
GKVIPEWCC

SEQ ID NO: 189582 - protein, 9 aa, Tick-borne encephalitis virus
KVIPEWCCR

SEQ ID NO: 189583 - protein, 9 aa, Tick-borne encephalitis virus
VIPEWCCRT

SEQ ID NO: 189584 - protein, 9 aa, Tick-borne encephalitis virus
IPEWCCRTC

SEQ ID NO: 189585 - protein, 9 aa, Tick-borne encephalitis virus
PEWCCRTCT

SEQ ID NO: 189586 - protein, 9 aa, Tick-borne encephalitis virus
EWCCRTCTL

SEQ ID NO: 189587 - protein, 9 aa, Tick-borne encephalitis virus
WCCRTCTLP

SEQ ID NO: 189588 - protein, 9 aa, Tick-borne encephalitis virus
CCRTCTLPP

SEQ ID NO: 189589 - protein, 9 aa, Tick-borne encephalitis virus
CRTCTLPPV

SEQ ID NO: 189590 - protein, 9 aa, Tick-borne encephalitis virus
RTCTLPPVT

SEQ ID NO: 189591 - protein, 9 aa, Tick-borne encephalitis virus
TCTLPPVTF

SEQ ID NO: 189592 - protein, 9 aa, Tick-borne encephalitis virus
CTLPPVTFR

SEQ ID NO: 189593 - protein, 9 aa, Tick-borne encephalitis virus
TLPPVTFRT

SEQ ID NO: 189594 - protein, 9 aa, Tick-borne encephalitis virus
LPPVTFRTG

SEQ ID NO: 189595 - protein, 9 aa, Tick-borne encephalitis virus
PPVTFRTGT

SEQ ID NO: 189596 - protein, 9 aa, Tick-borne encephalitis virus
PVTFRTGTD

SEQ ID NO: 189597 - protein, 9 aa, Tick-borne encephalitis virus
VTFRTGTDC

SEQ ID NO: 189598 - protein, 9 aa, Tick-borne encephalitis virus
TFRTGTDCW

SEQ ID NO: 189599 - protein, 9 aa, Tick-borne encephalitis virus
FRTGTDCWY

SEQ ID NO: 189600 - protein, 9 aa, Tick-borne encephalitis virus
RTGTDCWYA

SEQ ID NO: 189601 - protein, 9 aa, Tick-borne encephalitis virus
TGTDCWYAM

SEQ ID NO: 189602 - protein, 9 aa, Tick-borne encephalitis virus
GTDCWYAME

SEQ ID NO: 189603 - protein, 9 aa, Tick-borne encephalitis virus
TDCWYAMEI

SEQ ID NO: 189604 - protein, 9 aa, Tick-borne encephalitis virus
DCWYAMEIR

SEQ ID NO: 189605 - protein, 9 aa, Tick-borne encephalitis virus
CWYAMEIRP

SEQ ID NO: 189606 - protein, 9 aa, Tick-borne encephalitis virus
WYAMEIRPV

SEQ ID NO: 189607 - protein, 9 aa, Tick-borne encephalitis virus
YAMEIRPVH

SEQ ID NO: 189608 - protein, 9 aa, Tick-borne encephalitis virus
AMEIRPVHD

SEQ ID NO: 189609 - protein, 9 aa, Tick-borne encephalitis virus
MEIRPVHDQ

SEQ ID NO: 189610 - protein, 9 aa, Tick-borne encephalitis virus
EIRPVHDQG

SEQ ID NO: 189611 - protein, 9 aa, Tick-borne encephalitis virus
IRPVHDQGG

SEQ ID NO: 189612 - protein, 9 aa, Tick-borne encephalitis virus
RPVHDQGGL

SEQ ID NO: 189613 - protein, 9 aa, Tick-borne encephalitis virus
PVHDQGGLV

SEQ ID NO: 189614 - protein, 9 aa, Tick-borne encephalitis virus
VHDQGGLVR

SEQ ID NO: 189615 - protein, 9 aa, Tick-borne encephalitis virus
HDQGGLVRS

SEQ ID NO: 189616 - protein, 9 aa, Tick-borne encephalitis virus
DQGGLVRSM

SEQ ID NO: 189617 - protein, 9 aa, Tick-borne encephalitis virus
QGGLVRSMV

SEQ ID NO: 189618 - protein, 9 aa, Tick-borne encephalitis virus
GGLVRSMVV

SEQ ID NO: 189619 - protein, 9 aa, Tick-borne encephalitis virus
GLVRSMVVA

SEQ ID NO: 189620 - protein, 9 aa, Tick-borne encephalitis virus
LVRSMVVAD

SEQ ID NO: 189621 - protein, 9 aa, Tick-borne encephalitis virus
VRSMVVADN

SEQ ID NO: 189622 - protein, 9 aa, Tick-borne encephalitis virus
RSMVVADNG

SEQ ID NO: 189623 - protein, 9 aa, Tick-borne encephalitis virus
SMVVADNGE

SEQ ID NO: 189624 - protein, 9 aa, Tick-borne encephalitis virus
MVVADNGEL

SEQ ID NO: 189625 - protein, 9 aa, Tick-borne encephalitis virus
VVADNGELL

SEQ ID NO: 189626 - protein, 9 aa, Tick-borne encephalitis virus
VADNGELLS

SEQ ID NO: 189627 - protein, 9 aa, Tick-borne encephalitis virus
ADNGELLSE

SEQ ID NO: 189628 - protein, 9 aa, Tick-borne encephalitis virus
DNGELLSEG

SEQ ID NO: 189629 - protein, 9 aa, Tick-borne encephalitis virus
NGELLSEGG

SEQ ID NO: 189630 - protein, 9 aa, Tick-borne encephalitis virus
GELLSEGGI

SEQ ID NO: 189631 - protein, 9 aa, Tick-borne encephalitis virus
ELLSEGGIP

SEQ ID NO: 189632 - protein, 9 aa, Tick-borne encephalitis virus
LLSEGGIPG

SEQ ID NO: 189633 - protein, 9 aa, Tick-borne encephalitis virus
LSEGGVPGI

SEQ ID NO: 189634 - protein, 9 aa, Tick-borne encephalitis virus
SEGGIPGIV

SEQ ID NO: 189635 - protein, 9 aa, Tick-borne encephalitis virus
EGGIPGIVA

SEQ ID NO: 189636 - protein, 9 aa, Tick-borne encephalitis virus
GGVPGIVAL

SEQ ID NO: 189637 - protein, 9 aa, Tick-borne encephalitis virus
GVPGIVALF

SEQ ID NO: 189638 - protein, 9 aa, Tick-borne encephalitis virus
IPGIVALFV

SEQ ID NO: 189639 - protein, 9 aa, Tick-borne encephalitis virus
PGIVALFVV

SEQ ID NO: 189640 - protein, 9 aa, Tick-borne encephalitis virus
GIVALFVVL

SEQ ID NO: 189641 - protein, 9 aa, Tick-borne encephalitis virus
IVALFVVLE

SEQ ID NO: 189642 - protein, 9 aa, Tick-borne encephalitis virus
VALFVVLEY

SEQ ID NO: 189643 - protein, 9 aa, Tick-borne encephalitis virus
ALFVVLEYV

SEQ ID NO: 189644 - protein, 9 aa, Tick-borne encephalitis virus
LFVVLEYVI

SEQ ID NO: 189645 - protein, 9 aa, Tick-borne encephalitis virus
FVVLEYVIR

SEQ ID NO: 189646 - protein, 9 aa, Tick-borne encephalitis virus
VVLEYVIRR

SEQ ID NO: 189647 - protein, 9 aa, Tick-borne encephalitis virus
VLEYVIRRR

SEQ ID NO: 189648 - protein, 9 aa, Tick-borne encephalitis virus
LEYVIRRRP

SEQ ID NO: 189649 - protein, 9 aa, Tick-borne encephalitis virus
EYVIRRRPA

SEQ ID NO: 189650 - protein, 9 aa, Tick-borne encephalitis virus
YVIRRRPAT

SEQ ID NO: 189651 - protein, 9 aa, Tick-borne encephalitis virus
VIRRRPATG

SEQ ID NO: 189652 - protein, 9 aa, Tick-borne encephalitis virus
IRRRPATGT

SEQ ID NO: 189653 - protein, 9 aa, Tick-borne encephalitis virus
RRRPATGTT

SEQ ID NO: 189654 - protein, 9 aa, Tick-borne encephalitis virus
RRPATGTTA

SEQ ID NO: 189655 - protein, 9 aa, Tick-borne encephalitis virus
RPATGTTAM

SEQ ID NO: 189656 - protein, 9 aa, Tick-borne encephalitis virus
PATGTTAMW

SEQ ID NO: 189657 - protein, 9 aa, Tick-borne encephalitis virus
ATGTTAMWG

SEQ ID NO: 189658 - protein, 9 aa, Tick-borne encephalitis virus
TGTTAMWGG

SEQ ID NO: 189659 - protein, 9 aa, Tick-borne encephalitis virus
WGGIVVLAL

SEQ ID NO: 189660 - protein, 9 aa, Tick-borne encephalitis virus
GGIVVLALL

SEQ ID NO: 189661 - protein, 9 aa, Tick-borne encephalitis virus
GIVVLALLV

SEQ ID NO: 189662 - protein, 9 aa, Tick-borne encephalitis virus
IVVLALLVT

SEQ ID NO: 189663 - protein, 9 aa, Tick-borne encephalitis virus
VVLALLVTG

SEQ ID NO: 189664 - protein, 9 aa, Tick-borne encephalitis virus
VLALLVTGL

SEQ ID NO: 189665 - protein, 9 aa, Tick-borne encephalitis virus
LALLVTGLV

SEQ ID NO: 189666 - protein, 9 aa, Tick-borne encephalitis virus
ALLVTGLVR

SEQ ID NO: 189667 - protein, 9 aa, Tick-borne encephalitis virus
VRIESLVRY

SEQ ID NO: 189668 - protein, 9 aa, Tick-borne encephalitis virus
RIESLVRYV

SEQ ID NO: 189669 - protein, 9 aa, Tick-borne encephalitis virus
IESLVRYVV

SEQ ID NO: 189670 - protein, 9 aa, Tick-borne encephalitis virus
ESLVRYVVA

SEQ ID NO: 189671 - protein, 9 aa, Tick-borne encephalitis virus
SLVRYVVAV

SEQ ID NO: 189672 - protein, 9 aa, Tick-borne encephalitis virus
LVRYVVAVG

SEQ ID NO: 189673 - protein, 9 aa, Tick-borne encephalitis virus
VRYVVAVGI

SEQ ID NO: 189674 - protein, 9 aa, Tick-borne encephalitis virus
RYVVAVGIT

SEQ ID NO: 189675 - protein, 9 aa, Tick-borne encephalitis virus
YVVAVGITF

SEQ ID NO: 189676 - protein, 9 aa, Tick-borne encephalitis virus
VVAVGITFH

SEQ ID NO: 189677 - protein, 9 aa, Tick-borne encephalitis virus
VAVGITFHL

SEQ ID NO: 189678 - protein, 9 aa, Tick-borne encephalitis virus
AVGITFHLE

SEQ ID NO: 189679 - protein, 9 aa, Tick-borne encephalitis virus
VGITFHLEL

SEQ ID NO: 189680 - protein, 9 aa, Tick-borne encephalitis virus
GITFHLELG

SEQ ID NO: 189681 - protein, 9 aa, Tick-borne encephalitis virus
ITFHLELGP

SEQ ID NO: 189682 - protein, 9 aa, Tick-borne encephalitis virus
TFHLELGPE

SEQ ID NO: 189683 - protein, 9 aa, Tick-borne encephalitis virus
FHLELGPEI

SEQ ID NO: 189684 - protein, 9 aa, Tick-borne encephalitis virus
HLELGPEIV

SEQ ID NO: 189685 - protein, 9 aa, Tick-borne encephalitis virus
LELGPEIVA

SEQ ID NO: 189686 - protein, 9 aa, Tick-borne encephalitis virus
ELGPEIVAL

SEQ ID NO: 189687 - protein, 9 aa, Tick-borne encephalitis virus
LGPEIVALT

SEQ ID NO: 189688 - protein, 9 aa, Tick-borne encephalitis virus
GPEIVALTL

SEQ ID NO: 189689 - protein, 9 aa, Tick-borne encephalitis virus
PEIVALTLL

SEQ ID NO: 189690 - protein, 9 aa, Tick-borne encephalitis virus
EIVALTLLQ

SEQ ID NO: 189691 - protein, 9 aa, Tick-borne encephalitis virus
IVALTLLQA

SEQ ID NO: 189692 - protein, 9 aa, Tick-borne encephalitis virus
VALTLLQAV

SEQ ID NO: 189693 - protein, 9 aa, Tick-borne encephalitis virus
ALTLLQAVF

SEQ ID NO: 189694 - protein, 9 aa, Tick-borne encephalitis virus
LTLLQAVFE

SEQ ID NO: 189695 - protein, 9 aa, Tick-borne encephalitis virus
TLLQAVFEL

SEQ ID NO: 189696 - protein, 9 aa, Tick-borne encephalitis virus
LLQAVFELR

SEQ ID NO: 189697 - protein, 9 aa, Tick-borne encephalitis virus
LQAVFELRV

SEQ ID NO: 189698 - protein, 9 aa, Tick-borne encephalitis virus
QAVFELRVG

SEQ ID NO: 189699 - protein, 9 aa, Tick-borne encephalitis virus
AVFELRVGL

SEQ ID NO: 189700 - protein, 9 aa, Tick-borne encephalitis virus
VFELRVGLL

SEQ ID NO: 189701 - protein, 9 aa, Tick-borne encephalitis virus
FELRVGLLS

SEQ ID NO: 189702 - protein, 9 aa, Tick-borne encephalitis virus
ELRVGLLSA

SEQ ID NO: 189703 - protein, 9 aa, Tick-borne encephalitis virus
LRVGLLSAF

SEQ ID NO: 189704 - protein, 9 aa, Tick-borne encephalitis virus
RVGLLSAFA

SEQ ID NO: 189705 - protein, 9 aa, Tick-borne encephalitis virus
VGLLSAFAL

SEQ ID NO: 189706 - protein, 9 aa, Tick-borne encephalitis virus
GLLSAFALR

SEQ ID NO: 189707 - protein, 9 aa, Tick-borne encephalitis virus
LLSAFALRS

SEQ ID NO: 189708 - protein, 9 aa, Tick-borne encephalitis virus
LSAFALRSN

SEQ ID NO: 189709 - protein, 9 aa, Tick-borne encephalitis virus
SAFALRSNL

SEQ ID NO: 189710 - protein, 9 aa, Tick-borne encephalitis virus
AFALRSNLT

SEQ ID NO: 189711 - protein, 9 aa, Tick-borne encephalitis virus
FALRSNLTV

SEQ ID NO: 189712 - protein, 9 aa, Tick-borne encephalitis virus
ALRSNLTVR

SEQ ID NO: 189713 - protein, 9 aa, Tick-borne encephalitis virus
LRSNLTVRE

SEQ ID NO: 189714 - protein, 9 aa, Tick-borne encephalitis virus
RSNLTVREM

SEQ ID NO: 189715 - protein, 9 aa, Tick-borne encephalitis virus
SNLTVREMV

SEQ ID NO: 189716 - protein, 9 aa, Tick-borne encephalitis virus
NLTVREMVT

SEQ ID NO: 189717 - protein, 9 aa, Tick-borne encephalitis virus
LTVREMVTI

SEQ ID NO: 189718 - protein, 9 aa, Tick-borne encephalitis virus
TVREMVTIY

SEQ ID NO: 189719 - protein, 9 aa, Tick-borne encephalitis virus
VREMVTIYF

SEQ ID NO: 189720 - protein, 9 aa, Tick-borne encephalitis virus
REMVTIYFL

SEQ ID NO: 189721 - protein, 9 aa, Tick-borne encephalitis virus
EMVTIYFLL

SEQ ID NO: 189722 - protein, 9 aa, Tick-borne encephalitis virus
MVTIYFLLL

SEQ ID NO: 189723 - protein, 9 aa, Tick-borne encephalitis virus
VTIYFLLLV

SEQ ID NO: 189724 - protein, 9 aa, Tick-borne encephalitis virus
TIYFLLLVL

SEQ ID NO: 189725 - protein, 9 aa, Tick-borne encephalitis virus
IYFLLLVLE

SEQ ID NO: 189726 - protein, 9 aa, Tick-borne encephalitis virus
YFLLLVLEL

SEQ ID NO: 189727 - protein, 9 aa, Tick-borne encephalitis virus
FLLLVLELG

SEQ ID NO: 189728 - protein, 9 aa, Tick-borne encephalitis virus
LLLVLELGL

SEQ ID NO: 189729 - protein, 9 aa, Tick-borne encephalitis virus
LLVLELGLP

SEQ ID NO: 189730 - protein, 9 aa, Tick-borne encephalitis virus
LVLELGLPS

SEQ ID NO: 189731 - protein, 9 aa, Tick-borne encephalitis virus
LWKWGDALA

SEQ ID NO: 189732 - protein, 9 aa, Tick-borne encephalitis virus
WKWGDALAM

SEQ ID NO: 189733 - protein, 9 aa, Tick-borne encephalitis virus
KWGDALAMG

SEQ ID NO: 189734 - protein, 9 aa, Tick-borne encephalitis virus
WGDALAMGA

SEQ ID NO: 189735 - protein, 9 aa, Tick-borne encephalitis virus
GDALAMGAL

SEQ ID NO: 189736 - protein, 9 aa, Tick-borne encephalitis virus
DALAMGALI

SEQ ID NO: 189737 - protein, 9 aa, Tick-borne encephalitis virus
ALAMGALIF

SEQ ID NO: 189738 - protein, 9 aa, Tick-borne encephalitis virus
LAMGALIFR

SEQ ID NO: 189739 - protein, 9 aa, Tick-borne encephalitis virus
AMGALIFRA

SEQ ID NO: 189740 - protein, 9 aa, Tick-borne encephalitis virus
MGALIFRAC

SEQ ID NO: 189741 - protein, 9 aa, Tick-borne encephalitis virus
GALIFRACT

SEQ ID NO: 189742 - protein, 9 aa, Tick-borne encephalitis virus
ALIFRACTA

SEQ ID NO: 189743 - protein, 9 aa, Tick-borne encephalitis virus
LIFRACTAE

SEQ ID NO: 189744 - protein, 9 aa, Tick-borne encephalitis virus
IFRACTAEG

SEQ ID NO: 189745 - protein, 9 aa, Tick-borne encephalitis virus
FRACTAEGK

SEQ ID NO: 189746 - protein, 9 aa, Tick-borne encephalitis virus
RACTAEEKT

SEQ ID NO: 189747 - protein, 9 aa, Tick-borne encephalitis virus
ACTAEEKTG

SEQ ID NO: 189748 - protein, 9 aa, Tick-borne encephalitis virus
CTAEEKTGV

SEQ ID NO: 189749 - protein, 9 aa, Tick-borne encephalitis virus
TAEEKTGVG

SEQ ID NO: 189750 - protein, 9 aa, Tick-borne encephalitis virus
AEEKTGVGL

SEQ ID NO: 189751 - protein, 9 aa, Tick-borne encephalitis virus
EEKTGVGLL

SEQ ID NO: 189752 - protein, 9 aa, Tick-borne encephalitis virus
EKTGVGLLL

SEQ ID NO: 189753 - protein, 9 aa, Tick-borne encephalitis virus
KTGVGLLLM

SEQ ID NO: 189754 - protein, 9 aa, Tick-borne encephalitis virus
TGVGLLLMA

SEQ ID NO: 189755 - protein, 9 aa, Tick-borne encephalitis virus
GVGLLLMAL

SEQ ID NO: 189756 - protein, 9 aa, Tick-borne encephalitis virus
VGLLLMALM

SEQ ID NO: 189757 - protein, 9 aa, Tick-borne encephalitis virus
GLLLMALMT

SEQ ID NO: 189758 - protein, 9 aa, Tick-borne encephalitis virus
LLLMALMTQ

SEQ ID NO: 189759 - protein, 9 aa, Tick-borne encephalitis virus
LLMALMTQQ

SEQ ID NO: 189760 - protein, 9 aa, Tick-borne encephalitis virus
LMALMTQQD

SEQ ID NO: 189761 - protein, 9 aa, Tick-borne encephalitis virus
AHYGLMLFL

SEQ ID NO: 189762 - protein, 9 aa, Tick-borne encephalitis virus
HYGLMLFLG

SEQ ID NO: 189763 - protein, 9 aa, Tick-borne encephalitis virus
WKLIRGHRE

SEQ ID NO: 189764 - protein, 9 aa, Tick-borne encephalitis virus
KLIRGHREQ

SEQ ID NO: 189765 - protein, 9 aa, Tick-borne encephalitis virus
LIRGHREQK

SEQ ID NO: 189766 - protein, 9 aa, Tick-borne encephalitis virus
IRGHREQKG

SEQ ID NO: 189767 - protein, 9 aa, Tick-borne encephalitis virus
RGHREQKGL

SEQ ID NO: 189768 - protein, 9 aa, Tick-borne encephalitis virus
GHREQKGLT

SEQ ID NO: 189769 - protein, 9 aa, Tick-borne encephalitis virus
HREQKGLTW

SEQ ID NO: 189770 - protein, 9 aa, Tick-borne encephalitis virus
REQKGLTWI

SEQ ID NO: 189771 - protein, 9 aa, Tick-borne encephalitis virus
EQKGLTWIV

SEQ ID NO: 189772 - protein, 9 aa, Tick-borne encephalitis virus
QKGLTWIVP

SEQ ID NO: 189773 - protein, 9 aa, Tick-borne encephalitis virus
KGLTWIVPL

SEQ ID NO: 189774 - protein, 9 aa, Tick-borne encephalitis virus
GLTWIVPLA

SEQ ID NO: 189775 - protein, 9 aa, Tick-borne encephalitis virus
VPLAGLLGG

SEQ ID NO: 189776 - protein, 9 aa, Tick-borne encephalitis virus
PLAGLLGGE

SEQ ID NO: 189777 - protein, 9 aa, Tick-borne encephalitis virus
LAGLLGGEG

SEQ ID NO: 189778 - protein, 9 aa, Tick-borne encephalitis virus
AGLLGGEGS

SEQ ID NO: 189779 - protein, 9 aa, Tick-borne encephalitis virus
GLLGGEGSG

SEQ ID NO: 189780 - protein, 9 aa, Tick-borne encephalitis virus
LLGGEGSGV

SEQ ID NO: 189781 - protein, 9 aa, Tick-borne encephalitis virus
LGGEGSGVR

SEQ ID NO: 189782 - protein, 9 aa, Tick-borne encephalitis virus
GGEGSGVRL

SEQ ID NO: 189783 - protein, 9 aa, Tick-borne encephalitis virus
GEGSGVRLL

SEQ ID NO: 189784 - protein, 9 aa, Tick-borne encephalitis virus
EGSGVRLLA

SEQ ID NO: 189785 - protein, 9 aa, Tick-borne encephalitis virus
GSGVRLLAF

SEQ ID NO: 189786 - protein, 9 aa, Tick-borne encephalitis virus
SGVRLLAFW

SEQ ID NO: 189787 - protein, 9 aa, Tick-borne encephalitis virus
GVRLLAFWE

SEQ ID NO: 189788 - protein, 9 aa, Tick-borne encephalitis virus
VRLLAFWEL

SEQ ID NO: 189789 - protein, 9 aa, Tick-borne encephalitis virus
RLLAFWELA

SEQ ID NO: 189790 - protein, 9 aa, Tick-borne encephalitis virus
HRGRRSFSE

SEQ ID NO: 189791 - protein, 9 aa, Tick-borne encephalitis virus
RGRRSFSEP

SEQ ID NO: 189792 - protein, 9 aa, Tick-borne encephalitis virus
GRRSFSEPL

SEQ ID NO: 189793 - protein, 9 aa, Tick-borne encephalitis virus
RRSFSEPLT

SEQ ID NO: 189794 - protein, 9 aa, Tick-borne encephalitis virus
RSFSEPLTV

SEQ ID NO: 189795 - protein, 9 aa, Tick-borne encephalitis virus
SFSEPLTVV

SEQ ID NO: 189796 - protein, 9 aa, Tick-borne encephalitis virus
FSEPLTVVG

SEQ ID NO: 189797 - protein, 9 aa, Tick-borne encephalitis virus
SEPLTVVGV

SEQ ID NO: 189798 - protein, 9 aa, Tick-borne encephalitis virus
EPLTVVGVM

SEQ ID NO: 189799 - protein, 9 aa, Tick-borne encephalitis virus
PLTVVGVML

SEQ ID NO: 189800 - protein, 9 aa, Tick-borne encephalitis virus
LTVVGVMLT

SEQ ID NO: 189801 - protein, 9 aa, Tick-borne encephalitis virus
TVVGVMLTL

SEQ ID NO: 189802 - protein, 9 aa, Tick-borne encephalitis virus
VVGVMLTLA

SEQ ID NO: 189803 - protein, 9 aa, Tick-borne encephalitis virus
VGVMLTLAS

SEQ ID NO: 189804 - protein, 9 aa, Tick-borne encephalitis virus
GVMLTLASG

SEQ ID NO: 189805 - protein, 9 aa, Tick-borne encephalitis virus
VMLTLASGM

SEQ ID NO: 189806 - protein, 9 aa, Tick-borne encephalitis virus
MLTLASGMM

SEQ ID NO: 189807 - protein, 9 aa, Tick-borne encephalitis virus
LTLASGMMR

SEQ ID NO: 189808 - protein, 9 aa, Tick-borne encephalitis virus
TLASGMMRH

SEQ ID NO: 189809 - protein, 9 aa, Tick-borne encephalitis virus
LASGMMRHT

SEQ ID NO: 189810 - protein, 9 aa, Tick-borne encephalitis virus
ASGMMRHTS

SEQ ID NO: 189811 - protein, 9 aa, Tick-borne encephalitis virus
SGMMRHTSQ

SEQ ID NO: 189812 - protein, 9 aa, Tick-borne encephalitis virus
GMMRHTSQE

SEQ ID NO: 189813 - protein, 9 aa, Tick-borne encephalitis virus
MMRHTSQEA

SEQ ID NO: 189814 - protein, 9 aa, Tick-borne encephalitis virus
MRHTSQEAL

SEQ ID NO: 189815 - protein, 9 aa, Tick-borne encephalitis virus
RHTSQEALC

SEQ ID NO: 189816 - protein, 9 aa, Tick-borne encephalitis virus
HTSQEALCA

SEQ ID NO: 189817 - protein, 9 aa, Tick-borne encephalitis virus
TSQEALCAL

SEQ ID NO: 189818 - protein, 9 aa, Tick-borne encephalitis virus
SQEALCALA

SEQ ID NO: 189819 - protein, 9 aa, Tick-borne encephalitis virus
QEALCALAV

SEQ ID NO: 189820 - protein, 9 aa, Tick-borne encephalitis virus
EALCALAVA

SEQ ID NO: 189821 - protein, 9 aa, Tick-borne encephalitis virus
ALCALAVAS

SEQ ID NO: 189822 - protein, 9 aa, Tick-borne encephalitis virus
LCALAVASF

SEQ ID NO: 189823 - protein, 9 aa, Tick-borne encephalitis virus
CALAVASFL

SEQ ID NO: 189824 - protein, 9 aa, Tick-borne encephalitis virus
ALAVASFLL

SEQ ID NO: 189825 - protein, 9 aa, Tick-borne encephalitis virus
LAVASFLLL

SEQ ID NO: 189826 - protein, 9 aa, Tick-borne encephalitis virus
AVASFLLLM

SEQ ID NO: 189827 - protein, 9 aa, Tick-borne encephalitis virus
VASFLLLML

SEQ ID NO: 189828 - protein, 9 aa, Tick-borne encephalitis virus
ASFLLLMLV

SEQ ID NO: 189829 - protein, 9 aa, Tick-borne encephalitis virus
SFLLLMLVL

SEQ ID NO: 189830 - protein, 9 aa, Tick-borne encephalitis virus
FLLLMLVLG

SEQ ID NO: 189831 - protein, 9 aa, Tick-borne encephalitis virus
LLLMLVLGT

SEQ ID NO: 189832 - protein, 9 aa, Tick-borne encephalitis virus
LLMLVLGTR

SEQ ID NO: 189833 - protein, 9 aa, Tick-borne encephalitis virus
LMLVLGTRK

SEQ ID NO: 189834 - protein, 9 aa, Tick-borne encephalitis virus
MLVLGTRKM

SEQ ID NO: 189835 - protein, 9 aa, Tick-borne encephalitis virus
LVLGTRKMQ

SEQ ID NO: 189836 - protein, 9 aa, Tick-borne encephalitis virus
VLGTRKMQL

SEQ ID NO: 189837 - protein, 9 aa, Tick-borne encephalitis virus
LGTRKMQLV

SEQ ID NO: 189838 - protein, 9 aa, Tick-borne encephalitis virus
GTRKMQLVA

SEQ ID NO: 189839 - protein, 9 aa, Tick-borne encephalitis virus
TRKMQLVAE

SEQ ID NO: 189840 - protein, 9 aa, Tick-borne encephalitis virus
RKMQLVAEW

SEQ ID NO: 189841 - protein, 9 aa, Tick-borne encephalitis virus
KMQLVAEWS

SEQ ID NO: 189842 - protein, 9 aa, Tick-borne encephalitis virus
MQLVAEWSG

SEQ ID NO: 189843 - protein, 9 aa, Tick-borne encephalitis virus
QLVAEWSGC

SEQ ID NO: 189844 - protein, 9 aa, Tick-borne encephalitis virus
LVAEWSGCV

SEQ ID NO: 189845 - protein, 9 aa, Tick-borne encephalitis virus
VAEWSGCVE

SEQ ID NO: 189846 - protein, 9 aa, Tick-borne encephalitis virus
AEWSGCVEW

SEQ ID NO: 189847 - protein, 9 aa, Tick-borne encephalitis virus
EWSGCVEWH

SEQ ID NO: 189848 - protein, 9 aa, Tick-borne encephalitis virus
WSGCVEWHP

SEQ ID NO: 189849 - protein, 9 aa, Tick-borne encephalitis virus
SGCVEWHPE

SEQ ID NO: 189850 - protein, 9 aa, Tick-borne encephalitis virus
GCVEWHPEL

SEQ ID NO: 189851 - protein, 9 aa, Tick-borne encephalitis virus
CVEWHPELM

SEQ ID NO: 189852 - protein, 9 aa, Tick-borne encephalitis virus
VEWHPELMN

SEQ ID NO: 189853 - protein, 9 aa, Tick-borne encephalitis virus
EWHPELMNE

SEQ ID NO: 189854 - protein, 9 aa, Tick-borne encephalitis virus
WHPELMNEG

SEQ ID NO: 189855 - protein, 9 aa, Tick-borne encephalitis virus
HPELMNEGG

SEQ ID NO: 189856 - protein, 9 aa, Tick-borne encephalitis virus
PELMNEGGE

SEQ ID NO: 189857 - protein, 9 aa, Tick-borne encephalitis virus
ELMNEGGEV

SEQ ID NO: 189858 - protein, 9 aa, Tick-borne encephalitis virus
LMNEGGEVS

SEQ ID NO: 189859 - protein, 9 aa, Tick-borne encephalitis virus
MNEGGEVSL

SEQ ID NO: 189860 - protein, 9 aa, Tick-borne encephalitis virus
NEGGEVSLR

SEQ ID NO: 189861 - protein, 9 aa, Tick-borne encephalitis virus
EGGEVSLRV

SEQ ID NO: 189862 - protein, 9 aa, Tick-borne encephalitis virus
GGEVSLRVR

SEQ ID NO: 189863 - protein, 9 aa, Tick-borne encephalitis virus
GEVSLRVRQ

SEQ ID NO: 189864 - protein, 9 aa, Tick-borne encephalitis virus
EVSLRVRQD

SEQ ID NO: 189865 - protein, 9 aa, Tick-borne encephalitis virus
VSLRVRQDS

SEQ ID NO: 189866 - protein, 9 aa, Tick-borne encephalitis virus
SLRVRQDSM

SEQ ID NO: 189867 - protein, 9 aa, Tick-borne encephalitis virus
LRVRQDSMG

SEQ ID NO: 189868 - protein, 9 aa, Tick-borne encephalitis virus
RVRQDSMGN

SEQ ID NO: 189869 - protein, 9 aa, Tick-borne encephalitis virus
VRQDSMGNF

SEQ ID NO: 189870 - protein, 9 aa, Tick-borne encephalitis virus
RQDSMGNFH

SEQ ID NO: 189871 - protein, 9 aa, Tick-borne encephalitis virus
QDSMGNFHL

SEQ ID NO: 189872 - protein, 9 aa, Tick-borne encephalitis virus
DSMGNFHLT

SEQ ID NO: 189873 - protein, 9 aa, Tick-borne encephalitis virus
SMGNFHLTE

SEQ ID NO: 189874 - protein, 9 aa, Tick-borne encephalitis virus
MGNFHLTEL

SEQ ID NO: 189875 - protein, 9 aa, Tick-borne encephalitis virus
GNFHLTELE

SEQ ID NO: 189876 - protein, 9 aa, Tick-borne encephalitis virus
NFHLTELEK

SEQ ID NO: 189877 - protein, 9 aa, Tick-borne encephalitis virus
FHLTELEKE

SEQ ID NO: 189878 - protein, 9 aa, Tick-borne encephalitis virus
HLTELEKEE

SEQ ID NO: 189879 - protein, 9 aa, Tick-borne encephalitis virus
LTELEKEER

SEQ ID NO: 189880 - protein, 9 aa, Tick-borne encephalitis virus
TELEKEERV

SEQ ID NO: 189881 - protein, 9 aa, Tick-borne encephalitis virus
ELEKEERVM

SEQ ID NO: 189882 - protein, 9 aa, Tick-borne encephalitis virus
LEKEERVMA

SEQ ID NO: 189883 - protein, 9 aa, Tick-borne encephalitis virus
EKEERVMAF

SEQ ID NO: 189884 - protein, 9 aa, Tick-borne encephalitis virus
KEERVMAFW

SEQ ID NO: 189885 - protein, 9 aa, Tick-borne encephalitis virus
EERVMAFWL

SEQ ID NO: 189886 - protein, 9 aa, Tick-borne encephalitis virus
ERVMAFWLL

SEQ ID NO: 189887 - protein, 9 aa, Tick-borne encephalitis virus
RVMAFWLLA

SEQ ID NO: 189888 - protein, 9 aa, Tick-borne encephalitis virus
VMAFWLLAG

SEQ ID NO: 189889 - protein, 9 aa, Tick-borne encephalitis virus
MAFWLLAGL

SEQ ID NO: 189890 - protein, 9 aa, Tick-borne encephalitis virus
AFWLLAGLA

SEQ ID NO: 189891 - protein, 9 aa, Tick-borne encephalitis virus
FWLLAGLAA

SEQ ID NO: 189892 - protein, 9 aa, Tick-borne encephalitis virus
WLLAGLAAS

SEQ ID NO: 189893 - protein, 9 aa, Tick-borne encephalitis virus
LLAGLAASA

SEQ ID NO: 189894 - protein, 9 aa, Tick-borne encephalitis virus
AGLAASAFH

SEQ ID NO: 189895 - protein, 9 aa, Tick-borne encephalitis virus
GLAASAFHW

SEQ ID NO: 189896 - protein, 9 aa, Tick-borne encephalitis virus
LAASAFHWS

SEQ ID NO: 189897 - protein, 9 aa, Tick-borne encephalitis virus
AASAFHWSG

SEQ ID NO: 189898 - protein, 9 aa, Tick-borne encephalitis virus
ASAFHWSGI

SEQ ID NO: 189899 - protein, 9 aa, Tick-borne encephalitis virus
SAFHWSGIL

SEQ ID NO: 189900 - protein, 9 aa, Tick-borne encephalitis virus
AFHWSGILG

SEQ ID NO: 189901 - protein, 9 aa, Tick-borne encephalitis virus
FHWSGILGV

SEQ ID NO: 189902 - protein, 9 aa, Tick-borne encephalitis virus
HWSGILGVM

SEQ ID NO: 189903 - protein, 9 aa, Tick-borne encephalitis virus
WSGILGVMG

SEQ ID NO: 189904 - protein, 9 aa, Tick-borne encephalitis virus
SGILGVMGL

SEQ ID NO: 189905 - protein, 9 aa, Tick-borne encephalitis virus
GILGVMGLW

SEQ ID NO: 189906 - protein, 9 aa, Tick-borne encephalitis virus
ILGVMGLWT

SEQ ID NO: 189907 - protein, 9 aa, Tick-borne encephalitis virus
LGVMGLWTL

SEQ ID NO: 189908 - protein, 9 aa, Tick-borne encephalitis virus
GVMGLWTLS

SEQ ID NO: 189909 - protein, 9 aa, Tick-borne encephalitis virus
VMGLWTLSE

SEQ ID NO: 189910 - protein, 9 aa, Tick-borne encephalitis virus
MGLWTLSEM

SEQ ID NO: 189911 - protein, 9 aa, Tick-borne encephalitis virus
GLWTLSEML

SEQ ID NO: 189912 - protein, 9 aa, Tick-borne encephalitis virus
LWTLSEMLR

SEQ ID NO: 189913 - protein, 9 aa, Tick-borne encephalitis virus
ARRSDLVFS

SEQ ID NO: 189914 - protein, 9 aa, Tick-borne encephalitis virus
RRSDLVFSG

SEQ ID NO: 189915 - protein, 9 aa, Tick-borne encephalitis virus
RSDLVFSGQ

SEQ ID NO: 189916 - protein, 9 aa, Tick-borne encephalitis virus
SDLVFSGQG

SEQ ID NO: 189917 - protein, 9 aa, Tick-borne encephalitis virus
DLVFSGQGG

SEQ ID NO: 189918 - protein, 9 aa, Tick-borne encephalitis virus
LVFSGQGGR

SEQ ID NO: 189919 - protein, 9 aa, Tick-borne encephalitis virus
VFSGQGGRE

SEQ ID NO: 189920 - protein, 9 aa, Tick-borne encephalitis virus
FSGQGGRER

SEQ ID NO: 189921 - protein, 9 aa, Tick-borne encephalitis virus
SGQGGRERG

SEQ ID NO: 189922 - protein, 9 aa, Tick-borne encephalitis virus
GQGGRERGD

SEQ ID NO: 189923 - protein, 9 aa, Tick-borne encephalitis virus
QGGRERGDR

SEQ ID NO: 189924 - protein, 9 aa, Tick-borne encephalitis virus
GGRERGDRP

SEQ ID NO: 189925 - protein, 9 aa, Tick-borne encephalitis virus
GRERGDRPF

SEQ ID NO: 189926 - protein, 9 aa, Tick-borne encephalitis virus
RERGDRPFE

SEQ ID NO: 189927 - protein, 9 aa, Tick-borne encephalitis virus
ERGDRPFEV

SEQ ID NO: 189928 - protein, 9 aa, Tick-borne encephalitis virus
RGDRPFEVK

SEQ ID NO: 189929 - protein, 9 aa, Tick-borne encephalitis virus
GDRPFEVKD

SEQ ID NO: 189930 - protein, 9 aa, Tick-borne encephalitis virus
DRPFEVKDG

SEQ ID NO: 189931 - protein, 9 aa, Tick-borne encephalitis virus
RPFEVKDGV

SEQ ID NO: 189932 - protein, 9 aa, Tick-borne encephalitis virus
PFEVKDGVY

SEQ ID NO: 189933 - protein, 9 aa, Tick-borne encephalitis virus
FEVKDGVYR

SEQ ID NO: 189934 - protein, 9 aa, Tick-borne encephalitis virus
EVKDGVYRI

SEQ ID NO: 189935 - protein, 9 aa, Tick-borne encephalitis virus
VKDGVYRIF

SEQ ID NO: 189936 - protein, 9 aa, Tick-borne encephalitis virus
KDGVYRIFS

SEQ ID NO: 189937 - protein, 9 aa, Tick-borne encephalitis virus
DGVYRIFSP

SEQ ID NO: 189938 - protein, 9 aa, Tick-borne encephalitis virus
GVYRIFSPG

SEQ ID NO: 189939 - protein, 9 aa, Tick-borne encephalitis virus
VYRIFSPGL

SEQ ID NO: 189940 - protein, 9 aa, Tick-borne encephalitis virus
YRIFSPGLL

SEQ ID NO: 189941 - protein, 9 aa, Tick-borne encephalitis virus
RIFSPGLLW

SEQ ID NO: 189942 - protein, 9 aa, Tick-borne encephalitis virus
IFSPGLLWG

SEQ ID NO: 189943 - protein, 9 aa, Tick-borne encephalitis virus
FSPGLLWGQ

SEQ ID NO: 189944 - protein, 9 aa, Tick-borne encephalitis virus
SPGLLWGQR

SEQ ID NO: 189945 - protein, 9 aa, Tick-borne encephalitis virus
PGLLWGQRQ

SEQ ID NO: 189946 - protein, 9 aa, Tick-borne encephalitis virus
GLLWGQRQV

SEQ ID NO: 189947 - protein, 9 aa, Tick-borne encephalitis virus
LLWGQRQVG

SEQ ID NO: 189948 - protein, 9 aa, Tick-borne encephalitis virus
LWGQRQVGV

SEQ ID NO: 189949 - protein, 9 aa, Tick-borne encephalitis virus
WGQRQVGVG

SEQ ID NO: 189950 - protein, 9 aa, Tick-borne encephalitis virus
GQRQVGVGY

SEQ ID NO: 189951 - protein, 9 aa, Tick-borne encephalitis virus
QRQVGVGYG

SEQ ID NO: 189952 - protein, 9 aa, Tick-borne encephalitis virus
RQVGVGYGF

SEQ ID NO: 189953 - protein, 9 aa, Tick-borne encephalitis virus
QVGVGYGSK

SEQ ID NO: 189954 - protein, 9 aa, Tick-borne encephalitis virus
VGVGYGSKG

SEQ ID NO: 189955 - protein, 9 aa, Tick-borne encephalitis virus
GVGYGSKGV

SEQ ID NO: 189956 - protein, 9 aa, Tick-borne encephalitis virus
VGYGSKGVL

SEQ ID NO: 189957 - protein, 9 aa, Tick-borne encephalitis virus
GYGSKGVLH

SEQ ID NO: 189958 - protein, 9 aa, Tick-borne encephalitis virus
YGSKGVLHT

SEQ ID NO: 189959 - protein, 9 aa, Tick-borne encephalitis virus
GSKGVLHTM

SEQ ID NO: 189960 - protein, 9 aa, Tick-borne encephalitis virus
SKGVLHTMW

SEQ ID NO: 189961 - protein, 9 aa, Tick-borne encephalitis virus
KGVLHTMWH

SEQ ID NO: 189962 - protein, 9 aa, Tick-borne encephalitis virus
GVLHTMWHV

SEQ ID NO: 189963 - protein, 9 aa, Tick-borne encephalitis virus
VLHTMWHVT

SEQ ID NO: 189964 - protein, 9 aa, Tick-borne encephalitis virus
LHTMWHVTR

SEQ ID NO: 189965 - protein, 9 aa, Tick-borne encephalitis virus
HTMWHVTRG

SEQ ID NO: 189966 - protein, 9 aa, Tick-borne encephalitis virus
TMWHVTRGA

SEQ ID NO: 189967 - protein, 9 aa, Tick-borne encephalitis virus
MWHVTRGAA

SEQ ID NO: 189968 - protein, 9 aa, Tick-borne encephalitis virus
WHVTRGAAL

SEQ ID NO: 189969 - protein, 9 aa, Tick-borne encephalitis virus
HVTRGAALS

SEQ ID NO: 189970 - protein, 9 aa, Tick-borne encephalitis virus
VTRGAALSI

SEQ ID NO: 189971 - protein, 9 aa, Tick-borne encephalitis virus
TRGAALSID

SEQ ID NO: 189972 - protein, 9 aa, Tick-borne encephalitis virus
RGAALSIDD

SEQ ID NO: 189973 - protein, 9 aa, Tick-borne encephalitis virus
GAALSIDDA

SEQ ID NO: 189974 - protein, 9 aa, Tick-borne encephalitis virus
AALSIDDAV

SEQ ID NO: 189975 - protein, 9 aa, Tick-borne encephalitis virus
ALSIDDAVA

SEQ ID NO: 189976 - protein, 9 aa, Tick-borne encephalitis virus
LSIDDAVAG

SEQ ID NO: 189977 - protein, 9 aa, Tick-borne encephalitis virus
SIDDAVAGP

SEQ ID NO: 189978 - protein, 9 aa, Tick-borne encephalitis virus
IDDAVAGPY

SEQ ID NO: 189979 - protein, 9 aa, Tick-borne encephalitis virus
DDAVAGPYW

SEQ ID NO: 189980 - protein, 9 aa, Tick-borne encephalitis virus
DAVAGPYWA

SEQ ID NO: 189981 - protein, 9 aa, Tick-borne encephalitis virus
AVAGPYWAD

SEQ ID NO: 189982 - protein, 9 aa, Tick-borne encephalitis virus
VAGPYWADV

SEQ ID NO: 189983 - protein, 9 aa, Tick-borne encephalitis virus
AGPYWADVK

SEQ ID NO: 189984 - protein, 9 aa, Tick-borne encephalitis virus
GPYWADVKE

SEQ ID NO: 189985 - protein, 9 aa, Tick-borne encephalitis virus
PYWADVKED

SEQ ID NO: 189986 - protein, 9 aa, Tick-borne encephalitis virus
YWADVKEDV

SEQ ID NO: 189987 - protein, 9 aa, Tick-borne encephalitis virus
WADVKEDVV

SEQ ID NO: 189988 - protein, 9 aa, Tick-borne encephalitis virus
ADVKEDVVC

SEQ ID NO: 189989 - protein, 9 aa, Tick-borne encephalitis virus
DVKEDVVCY

SEQ ID NO: 189990 - protein, 9 aa, Tick-borne encephalitis virus
VKEDVVCYG

SEQ ID NO: 189991 - protein, 9 aa, Tick-borne encephalitis virus
KEDVVCYGG

SEQ ID NO: 189992 - protein, 9 aa, Tick-borne encephalitis virus
EDVVCYGGA

SEQ ID NO: 189993 - protein, 9 aa, Tick-borne encephalitis virus
DVVCYGGAW

SEQ ID NO: 189994 - protein, 9 aa, Tick-borne encephalitis virus
VVCYGGAWS

SEQ ID NO: 189995 - protein, 9 aa, Tick-borne encephalitis virus
VCYGGAWSL

SEQ ID NO: 189996 - protein, 9 aa, Tick-borne encephalitis virus
CYGGAWSLE

SEQ ID NO: 189997 - protein, 9 aa, Tick-borne encephalitis virus
YGGAWSLEE

SEQ ID NO: 189998 - protein, 9 aa, Tick-borne encephalitis virus
GGAWSLEEK

SEQ ID NO: 189999 - protein, 9 aa, Tick-borne encephalitis virus
GAWSLEEKW

SEQ ID NO: 190000 - protein, 9 aa, Tick-borne encephalitis virus
AWSLEEKWK

SEQ ID NO: 190001 - protein, 9 aa, Tick-borne encephalitis virus
WSLEEKWKG

SEQ ID NO: 190002 - protein, 9 aa, Tick-borne encephalitis virus
SLEEKWKGE

SEQ ID NO: 190003 - protein, 9 aa, Tick-borne encephalitis virus
LEEKWKGET

SEQ ID NO: 190004 - protein, 9 aa, Tick-borne encephalitis virus
EEKWKGETV

SEQ ID NO: 190005 - protein, 9 aa, Tick-borne encephalitis virus
EKWKGETVQ

SEQ ID NO: 190006 - protein, 9 aa, Tick-borne encephalitis virus
KWKGETVQV

SEQ ID NO: 190007 - protein, 9 aa, Tick-borne encephalitis virus
WKGETVQVH

SEQ ID NO: 190008 - protein, 9 aa, Tick-borne encephalitis virus
KGETVQVHA

SEQ ID NO: 190009 - protein, 9 aa, Tick-borne encephalitis virus
GETVQVHAF

SEQ ID NO: 190010 - protein, 9 aa, Tick-borne encephalitis virus
ETVQVHAFP

SEQ ID NO: 190011 - protein, 9 aa, Tick-borne encephalitis virus
TVQVHAFPP

SEQ ID NO: 190012 - protein, 9 aa, Tick-borne encephalitis virus
VQVHAFPPG

SEQ ID NO: 190013 - protein, 9 aa, Tick-borne encephalitis virus
QVHAFPPGR

SEQ ID NO: 190014 - protein, 9 aa, Tick-borne encephalitis virus
VHAFPPGRA

SEQ ID NO: 190015 - protein, 9 aa, Tick-borne encephalitis virus
HAFPPGRAH

SEQ ID NO: 190016 - protein, 9 aa, Tick-borne encephalitis virus
AFPPGRAHE

SEQ ID NO: 190017 - protein, 9 aa, Tick-borne encephalitis virus
FPPGRAHEV

SEQ ID NO: 190018 - protein, 9 aa, Tick-borne encephalitis virus
PPGRAHEVH

SEQ ID NO: 190019 - protein, 9 aa, Tick-borne encephalitis virus
PGRAHEVHQ

SEQ ID NO: 190020 - protein, 9 aa, Tick-borne encephalitis virus
GRAHEVHQC

SEQ ID NO: 190021 - protein, 9 aa, Tick-borne encephalitis virus
RAHEVHQCQ

SEQ ID NO: 190022 - protein, 9 aa, Tick-borne encephalitis virus
AHEVHQCQP

SEQ ID NO: 190023 - protein, 9 aa, Tick-borne encephalitis virus
HEVHQCQPG

SEQ ID NO: 190024 - protein, 9 aa, Tick-borne encephalitis virus
EVHQCQPGE

SEQ ID NO: 190025 - protein, 9 aa, Tick-borne encephalitis virus
VHQCQPGEL

SEQ ID NO: 190026 - protein, 9 aa, Tick-borne encephalitis virus
HQCQPGELL

SEQ ID NO: 190027 - protein, 9 aa, Tick-borne encephalitis virus
QCQPGELLL

SEQ ID NO: 190028 - protein, 9 aa, Tick-borne encephalitis virus
CQPGELLLD

SEQ ID NO: 190029 - protein, 9 aa, Tick-borne encephalitis virus
QPGELLLDT

SEQ ID NO: 190030 - protein, 9 aa, Tick-borne encephalitis virus
PGELLLDTG

SEQ ID NO: 190031 - protein, 9 aa, Tick-borne encephalitis virus
GELLLDTGR

SEQ ID NO: 190032 - protein, 9 aa, Tick-borne encephalitis virus
ELLLDTGRR

SEQ ID NO: 190033 - protein, 9 aa, Tick-borne encephalitis virus
GAVPIDLAK

SEQ ID NO: 190034 - protein, 9 aa, Tick-borne encephalitis virus
AVPIDLAKG

SEQ ID NO: 190035 - protein, 9 aa, Tick-borne encephalitis virus
VPIDLAKGT

SEQ ID NO: 190036 - protein, 9 aa, Tick-borne encephalitis virus
PIDLAKGTS

SEQ ID NO: 190037 - protein, 9 aa, Tick-borne encephalitis virus
IDLAKGTSG

SEQ ID NO: 190038 - protein, 9 aa, Tick-borne encephalitis virus
DLAKGTSGS

SEQ ID NO: 190039 - protein, 9 aa, Tick-borne encephalitis virus
LAKGTSGSP

SEQ ID NO: 190040 - protein, 9 aa, Tick-borne encephalitis virus
AKGTSGSPI

SEQ ID NO: 190041 - protein, 9 aa, Tick-borne encephalitis virus
KGTSGSPIL

SEQ ID NO: 190042 - protein, 9 aa, Tick-borne encephalitis virus
GTSGSPILN

SEQ ID NO: 190043 - protein, 9 aa, Tick-borne encephalitis virus
TSGSPILNS

SEQ ID NO: 190044 - protein, 9 aa, Tick-borne encephalitis virus
SGSPILNSQ

SEQ ID NO: 190045 - protein, 9 aa, Tick-borne encephalitis virus
GSPILNSQG

SEQ ID NO: 190046 - protein, 9 aa, Tick-borne encephalitis virus
SPILNSQGV

SEQ ID NO: 190047 - protein, 9 aa, Tick-borne encephalitis virus
PILNSQGVV

SEQ ID NO: 190048 - protein, 9 aa, Tick-borne encephalitis virus
ILNSQGVVV

SEQ ID NO: 190049 - protein, 9 aa, Tick-borne encephalitis virus
LNSQGVVVG

SEQ ID NO: 190050 - protein, 9 aa, Tick-borne encephalitis virus
NSQGVVVGL

SEQ ID NO: 190051 - protein, 9 aa, Tick-borne encephalitis virus
SQGVVVGLY

SEQ ID NO: 190052 - protein, 9 aa, Tick-borne encephalitis virus
QGVVVGLYG

SEQ ID NO: 190053 - protein, 9 aa, Tick-borne encephalitis virus
GVVVGLYGN

SEQ ID NO: 190054 - protein, 9 aa, Tick-borne encephalitis virus
VVVGLYGNG

SEQ ID NO: 190055 - protein, 9 aa, Tick-borne encephalitis virus
VVGLYGNGL

SEQ ID NO: 190056 - protein, 9 aa, Tick-borne encephalitis virus
VGLYGNGLK

SEQ ID NO: 190057 - protein, 9 aa, Tick-borne encephalitis virus
GLYGNGLKT

SEQ ID NO: 190058 - protein, 9 aa, Tick-borne encephalitis virus
LYGNGLKTN

SEQ ID NO: 190059 - protein, 9 aa, Tick-borne encephalitis virus
YGNGLKTNE

SEQ ID NO: 190060 - protein, 9 aa, Tick-borne encephalitis virus
GNGLKTNET

SEQ ID NO: 190061 - protein, 9 aa, Tick-borne encephalitis virus
NGLKTNETY

SEQ ID NO: 190062 - protein, 9 aa, Tick-borne encephalitis virus
GLKTNETYV

SEQ ID NO: 190063 - protein, 9 aa, Tick-borne encephalitis virus
LKTNETYVS

SEQ ID NO: 190064 - protein, 9 aa, Tick-borne encephalitis virus
KTNETYVSS

SEQ ID NO: 190065 - protein, 9 aa, Tick-borne encephalitis virus
TNETYVSSI

SEQ ID NO: 190066 - protein, 9 aa, Tick-borne encephalitis virus
NETYVSSIA

SEQ ID NO: 190067 - protein, 9 aa, Tick-borne encephalitis virus
ETYVSSIAQ

SEQ ID NO: 190068 - protein, 9 aa, Tick-borne encephalitis virus
TYVSSIAQG

SEQ ID NO: 190069 - protein, 9 aa, Tick-borne encephalitis virus
YVSSIAQGE

SEQ ID NO: 190070 - protein, 9 aa, Tick-borne encephalitis virus
VSSIAQGEA

SEQ ID NO: 190071 - protein, 9 aa, Tick-borne encephalitis virus
SSIAQGEAE

SEQ ID NO: 190072 - protein, 9 aa, Tick-borne encephalitis virus
SIAQGEAEK

SEQ ID NO: 190073 - protein, 9 aa, Tick-borne encephalitis virus
IAQGEAEKS

SEQ ID NO: 190074 - protein, 9 aa, Tick-borne encephalitis virus
AQGEAEKSR

SEQ ID NO: 190075 - protein, 9 aa, Tick-borne encephalitis virus
QGEAEKSRP

SEQ ID NO: 190076 - protein, 9 aa, Tick-borne encephalitis virus
GEAEKSRPN

SEQ ID NO: 190077 - protein, 9 aa, Tick-borne encephalitis virus
EAEKSRPNL

SEQ ID NO: 190078 - protein, 9 aa, Tick-borne encephalitis virus
AEKSRPNLP

SEQ ID NO: 190079 - protein, 9 aa, Tick-borne encephalitis virus
EKSRPNLPP

SEQ ID NO: 190080 - protein, 9 aa, Tick-borne encephalitis virus
KSRPNLPPA

SEQ ID NO: 190081 - protein, 9 aa, Tick-borne encephalitis virus
SRPNLPPAV

SEQ ID NO: 190082 - protein, 9 aa, Tick-borne encephalitis virus
GTGWTAKGQ

SEQ ID NO: 190083 - protein, 9 aa, Tick-borne encephalitis virus
TGWTAKGQI

SEQ ID NO: 190084 - protein, 9 aa, Tick-borne encephalitis virus
GWTAKGQIT

SEQ ID NO: 190085 - protein, 9 aa, Tick-borne encephalitis virus
WTAKGQITV

SEQ ID NO: 190086 - protein, 9 aa, Tick-borne encephalitis virus
TAKGQITVL

SEQ ID NO: 190087 - protein, 9 aa, Tick-borne encephalitis virus
AKGQITVLD

SEQ ID NO: 190088 - protein, 9 aa, Tick-borne encephalitis virus
KGQITVLDM

SEQ ID NO: 190089 - protein, 9 aa, Tick-borne encephalitis virus
GQITVLDMH

SEQ ID NO: 190090 - protein, 9 aa, Tick-borne encephalitis virus
QITVLDMHP

SEQ ID NO: 190091 - protein, 9 aa, Tick-borne encephalitis virus
ITVLDMHPG

SEQ ID NO: 190092 - protein, 9 aa, Tick-borne encephalitis virus
TVLDMHPGS

SEQ ID NO: 190093 - protein, 9 aa, Tick-borne encephalitis virus
VLDMHPGSG

SEQ ID NO: 190094 - protein, 9 aa, Tick-borne encephalitis virus
LDMHPGSGK

SEQ ID NO: 190095 - protein, 9 aa, Tick-borne encephalitis virus
DMHPGSGKT

SEQ ID NO: 190096 - protein, 9 aa, Tick-borne encephalitis virus
MHPGSGKTH

SEQ ID NO: 190097 - protein, 9 aa, Tick-borne encephalitis virus
HPGSGKTHR

SEQ ID NO: 190098 - protein, 9 aa, Tick-borne encephalitis virus
PGSGKTHRV

SEQ ID NO: 190099 - protein, 9 aa, Tick-borne encephalitis virus
GSGKTHRVL

SEQ ID NO: 190100 - protein, 9 aa, Tick-borne encephalitis virus
SGKTHRVLP

SEQ ID NO: 190101 - protein, 9 aa, Tick-borne encephalitis virus
GKTHRVLPE

SEQ ID NO: 190102 - protein, 9 aa, Tick-borne encephalitis virus
KTHRVLPEL

SEQ ID NO: 190103 - protein, 9 aa, Tick-borne encephalitis virus
THRVLPELI

SEQ ID NO: 190104 - protein, 9 aa, Tick-borne encephalitis virus
HRVLPELIR

SEQ ID NO: 190105 - protein, 9 aa, Tick-borne encephalitis virus
RVLPELIRQ

SEQ ID NO: 190106 - protein, 9 aa, Tick-borne encephalitis virus
VLPELIRQC

SEQ ID NO: 190107 - protein, 9 aa, Tick-borne encephalitis virus
LPELIRQCI

SEQ ID NO: 190108 - protein, 9 aa, Tick-borne encephalitis virus
PELIRQCID

SEQ ID NO: 190109 - protein, 9 aa, Tick-borne encephalitis virus
ELIRQCIDR

SEQ ID NO: 190110 - protein, 9 aa, Tick-borne encephalitis virus
LIRQCIDRR

SEQ ID NO: 190111 - protein, 9 aa, Tick-borne encephalitis virus
IRQCIDRRL

SEQ ID NO: 190112 - protein, 9 aa, Tick-borne encephalitis virus
RQCIDRRLR

SEQ ID NO: 190113 - protein, 9 aa, Tick-borne encephalitis virus
QCIDRRLRT

SEQ ID NO: 190114 - protein, 9 aa, Tick-borne encephalitis virus
CIDRRLRTL

SEQ ID NO: 190115 - protein, 9 aa, Tick-borne encephalitis virus
IDRRLRTLV

SEQ ID NO: 190116 - protein, 9 aa, Tick-borne encephalitis virus
DRRLRTLVL

SEQ ID NO: 190117 - protein, 9 aa, Tick-borne encephalitis virus
RRLRTLVLA

SEQ ID NO: 190118 - protein, 9 aa, Tick-borne encephalitis virus
RLRTLVLAP

SEQ ID NO: 190119 - protein, 9 aa, Tick-borne encephalitis virus
LRTLVLAPT

SEQ ID NO: 190120 - protein, 9 aa, Tick-borne encephalitis virus
RTLVLAPTR

SEQ ID NO: 190121 - protein, 9 aa, Tick-borne encephalitis virus
TLVLAPTRV

SEQ ID NO: 190122 - protein, 9 aa, Tick-borne encephalitis virus
LVLAPTRVV

SEQ ID NO: 190123 - protein, 9 aa, Tick-borne encephalitis virus
VLAPTRVVL

SEQ ID NO: 190124 - protein, 9 aa, Tick-borne encephalitis virus
LAPTRVVLK

SEQ ID NO: 190125 - protein, 9 aa, Tick-borne encephalitis virus
APTRVVLKE

SEQ ID NO: 190126 - protein, 9 aa, Tick-borne encephalitis virus
PTRVVLKEM

SEQ ID NO: 190127 - protein, 9 aa, Tick-borne encephalitis virus
TRVVLKEME

SEQ ID NO: 190128 - protein, 9 aa, Tick-borne encephalitis virus
RVVLKEMER

SEQ ID NO: 190129 - protein, 9 aa, Tick-borne encephalitis virus
VVLKEMERA

SEQ ID NO: 190130 - protein, 9 aa, Tick-borne encephalitis virus
VLKEMERAL

SEQ ID NO: 190131 - protein, 9 aa, Tick-borne encephalitis virus
LKEMERALN

SEQ ID NO: 190132 - protein, 9 aa, Tick-borne encephalitis virus
KEMERALNG

SEQ ID NO: 190133 - protein, 9 aa, Tick-borne encephalitis virus
EMERALNGK

SEQ ID NO: 190134 - protein, 9 aa, Tick-borne encephalitis virus
MERALNGKR

SEQ ID NO: 190135 - protein, 9 aa, Tick-borne encephalitis virus
ERALNGKRV

SEQ ID NO: 190136 - protein, 9 aa, Tick-borne encephalitis virus
RALNGKRVR

SEQ ID NO: 190137 - protein, 9 aa, Tick-borne encephalitis virus
ALNGKRVRF

SEQ ID NO: 190138 - protein, 9 aa, Tick-borne encephalitis virus
LNGKRVRFH

SEQ ID NO: 190139 - protein, 9 aa, Tick-borne encephalitis virus
NGKRVRFHS

SEQ ID NO: 190140 - protein, 9 aa, Tick-borne encephalitis virus
GKRVRFHSP

SEQ ID NO: 190141 - protein, 9 aa, Tick-borne encephalitis virus
KRVRFHSPA

SEQ ID NO: 190142 - protein, 9 aa, Tick-borne encephalitis virus
RVRFHSPAV

SEQ ID NO: 190143 - protein, 9 aa, Tick-borne encephalitis virus
VRFHSPAVG

SEQ ID NO: 190144 - protein, 9 aa, Tick-borne encephalitis virus
RFHSPAVGD

SEQ ID NO: 190145 - protein, 9 aa, Tick-borne encephalitis virus
FHSPAVGDQ

SEQ ID NO: 190146 - protein, 9 aa, Tick-borne encephalitis virus
HSPAVGDQQ

SEQ ID NO: 190147 - protein, 9 aa, Tick-borne encephalitis virus
DQQVGGAIV

SEQ ID NO: 190148 - protein, 9 aa, Tick-borne encephalitis virus
QQVGGAIVD

SEQ ID NO: 190149 - protein, 9 aa, Tick-borne encephalitis virus
GGAIVDVMC

SEQ ID NO: 190150 - protein, 9 aa, Tick-borne encephalitis virus
GAIVDVMCH

SEQ ID NO: 190151 - protein, 9 aa, Tick-borne encephalitis virus
AIVDVMCHA

SEQ ID NO: 190152 - protein, 9 aa, Tick-borne encephalitis virus
IVDVMCHAT

SEQ ID NO: 190153 - protein, 9 aa, Tick-borne encephalitis virus
VDVMCHATY

SEQ ID NO: 190154 - protein, 9 aa, Tick-borne encephalitis virus
DVMCHATYV

SEQ ID NO: 190155 - protein, 9 aa, Tick-borne encephalitis virus
VMCHATYVN

SEQ ID NO: 190156 - protein, 9 aa, Tick-borne encephalitis virus
MCHATYVNR

SEQ ID NO: 190157 - protein, 9 aa, Tick-borne encephalitis virus
CHATYVNRR

SEQ ID NO: 190158 - protein, 9 aa, Tick-borne encephalitis virus
HATYVNRRL

SEQ ID NO: 190159 - protein, 9 aa, Tick-borne encephalitis virus
ATYVNRRLL

SEQ ID NO: 190160 - protein, 9 aa, Tick-borne encephalitis virus
TYVNRRLLP

SEQ ID NO: 190161 - protein, 9 aa, Tick-borne encephalitis virus
YVNRRLLPQ

SEQ ID NO: 190162 - protein, 9 aa, Tick-borne encephalitis virus
VNRRLLPQG

SEQ ID NO: 190163 - protein, 9 aa, Tick-borne encephalitis virus
NRRLLPQGR

SEQ ID NO: 190164 - protein, 9 aa, Tick-borne encephalitis virus
RRLLPQGRQ

SEQ ID NO: 190165 - protein, 9 aa, Tick-borne encephalitis virus
RLLPQGRQN

SEQ ID NO: 190166 - protein, 9 aa, Tick-borne encephalitis virus
LLPQGRQNW

SEQ ID NO: 190167 - protein, 9 aa, Tick-borne encephalitis virus
LPQGRQNWE

SEQ ID NO: 190168 - protein, 9 aa, Tick-borne encephalitis virus
PQGRQNWEV

SEQ ID NO: 190169 - protein, 9 aa, Tick-borne encephalitis virus
QGRQNWEVA

SEQ ID NO: 190170 - protein, 9 aa, Tick-borne encephalitis virus
GRQNWEVAI

SEQ ID NO: 190171 - protein, 9 aa, Tick-borne encephalitis virus
RQNWEVAIM

SEQ ID NO: 190172 - protein, 9 aa, Tick-borne encephalitis virus
QNWEVAIMD

SEQ ID NO: 190173 - protein, 9 aa, Tick-borne encephalitis virus
NWEVAIMDE

SEQ ID NO: 190174 - protein, 9 aa, Tick-borne encephalitis virus
WEVAIMDEA

SEQ ID NO: 190175 - protein, 9 aa, Tick-borne encephalitis virus
EVAIMDEAH

SEQ ID NO: 190176 - protein, 9 aa, Tick-borne encephalitis virus
VAIMDEAHW

SEQ ID NO: 190177 - protein, 9 aa, Tick-borne encephalitis virus
AIMDEAHWT

SEQ ID NO: 190178 - protein, 9 aa, Tick-borne encephalitis virus
IMDEAHWTD

SEQ ID NO: 190179 - protein, 9 aa, Tick-borne encephalitis virus
MDEAHWTDP

SEQ ID NO: 190180 - protein, 9 aa, Tick-borne encephalitis virus
DEAHWTDPH

SEQ ID NO: 190181 - protein, 9 aa, Tick-borne encephalitis virus
EAHWTDPHS

SEQ ID NO: 190182 - protein, 9 aa, Tick-borne encephalitis virus
AHWTDPHSI

SEQ ID NO: 190183 - protein, 9 aa, Tick-borne encephalitis virus
HWTDPHSIA

SEQ ID NO: 190184 - protein, 9 aa, Tick-borne encephalitis virus
WTDPHSIAA

SEQ ID NO: 190185 - protein, 9 aa, Tick-borne encephalitis virus
TDPHSIAAR

SEQ ID NO: 190186 - protein, 9 aa, Tick-borne encephalitis virus
DPHSIAARG

SEQ ID NO: 190187 - protein, 9 aa, Tick-borne encephalitis virus
PHSIAARGH

SEQ ID NO: 190188 - protein, 9 aa, Tick-borne encephalitis virus
HSIAARGHL

SEQ ID NO: 190189 - protein, 9 aa, Tick-borne encephalitis virus
SIAARGHLY

SEQ ID NO: 190190 - protein, 9 aa, Tick-borne encephalitis virus
IAARGHLYT

SEQ ID NO: 190191 - protein, 9 aa, Tick-borne encephalitis virus
AARGHLYTL

SEQ ID NO: 190192 - protein, 9 aa, Tick-borne encephalitis virus
ARGHLYTLA

SEQ ID NO: 190193 - protein, 9 aa, Tick-borne encephalitis virus
RGHLYTLAK

SEQ ID NO: 190194 - protein, 9 aa, Tick-borne encephalitis virus
GHLYTLAKE

SEQ ID NO: 190195 - protein, 9 aa, Tick-borne encephalitis virus
HLYTLAKEN

SEQ ID NO: 190196 - protein, 9 aa, Tick-borne encephalitis virus
LYTLAKENK

SEQ ID NO: 190197 - protein, 9 aa, Tick-borne encephalitis virus
YTLAKENKC

SEQ ID NO: 190198 - protein, 9 aa, Tick-borne encephalitis virus
TLAKENKCA

SEQ ID NO: 190199 - protein, 9 aa, Tick-borne encephalitis virus
LAKENKCAL

SEQ ID NO: 190200 - protein, 9 aa, Tick-borne encephalitis virus
AKENKCALV

SEQ ID NO: 190201 - protein, 9 aa, Tick-borne encephalitis virus
KENKCALVL

SEQ ID NO: 190202 - protein, 9 aa, Tick-borne encephalitis virus
ENKCALVLM

SEQ ID NO: 190203 - protein, 9 aa, Tick-borne encephalitis virus
NKCALVLMT

SEQ ID NO: 190204 - protein, 9 aa, Tick-borne encephalitis virus
KCALVLMTA

SEQ ID NO: 190205 - protein, 9 aa, Tick-borne encephalitis virus
CALVLMTAT

SEQ ID NO: 190206 - protein, 9 aa, Tick-borne encephalitis virus
ALVLMTATP

SEQ ID NO: 190207 - protein, 9 aa, Tick-borne encephalitis virus
LVLMTATPP

SEQ ID NO: 190208 - protein, 9 aa, Tick-borne encephalitis virus
VLMTATPPG

SEQ ID NO: 190209 - protein, 9 aa, Tick-borne encephalitis virus
LMTATPPGK

SEQ ID NO: 190210 - protein, 9 aa, Tick-borne encephalitis virus
MTATPPGKS

SEQ ID NO: 190211 - protein, 9 aa, Tick-borne encephalitis virus
TATPPGKSE

SEQ ID NO: 190212 - protein, 9 aa, Tick-borne encephalitis virus
ATPPGKSEP

SEQ ID NO: 190213 - protein, 9 aa, Tick-borne encephalitis virus
TPPGKSEPF

SEQ ID NO: 190214 - protein, 9 aa, Tick-borne encephalitis virus
PPGKSEPFP

SEQ ID NO: 190215 - protein, 9 aa, Tick-borne encephalitis virus
PGKSEPFPE

SEQ ID NO: 190216 - protein, 9 aa, Tick-borne encephalitis virus
GKSEPFPES

SEQ ID NO: 190217 - protein, 9 aa, Tick-borne encephalitis virus
KSEPFPESN

SEQ ID NO: 190218 - protein, 9 aa, Tick-borne encephalitis virus
SEPFPESNG

SEQ ID NO: 190219 - protein, 9 aa, Tick-borne encephalitis virus
EPFPESNGA

SEQ ID NO: 190220 - protein, 9 aa, Tick-borne encephalitis virus
PFPESNGAI

SEQ ID NO: 190221 - protein, 9 aa, Tick-borne encephalitis virus
FPESNGAIT

SEQ ID NO: 190222 - protein, 9 aa, Tick-borne encephalitis virus
PESNGAITS

SEQ ID NO: 190223 - protein, 9 aa, Tick-borne encephalitis virus
ESNGAITSE

SEQ ID NO: 190224 - protein, 9 aa, Tick-borne encephalitis virus
SNGAITSEE

SEQ ID NO: 190225 - protein, 9 aa, Tick-borne encephalitis virus
NGAISSEEK

SEQ ID NO: 190226 - protein, 9 aa, Tick-borne encephalitis virus
GAISSEEKQ

SEQ ID NO: 190227 - protein, 9 aa, Tick-borne encephalitis virus
AISSEEKQI

SEQ ID NO: 190228 - protein, 9 aa, Tick-borne encephalitis virus
ISSEEKQIP

SEQ ID NO: 190229 - protein, 9 aa, Tick-borne encephalitis virus
SEEKQIPDG

SEQ ID NO: 190230 - protein, 9 aa, Tick-borne encephalitis virus
EEKQIPDGE

SEQ ID NO: 190231 - protein, 9 aa, Tick-borne encephalitis virus
EKQIPDGEW

SEQ ID NO: 190232 - protein, 9 aa, Tick-borne encephalitis virus
KQIPDGEWR

SEQ ID NO: 190233 - protein, 9 aa, Tick-borne encephalitis virus
QIPDGEWRD

SEQ ID NO: 190234 - protein, 9 aa, Tick-borne encephalitis virus
IPDGEWRDG

SEQ ID NO: 190235 - protein, 9 aa, Tick-borne encephalitis virus
PDGEWRDGF

SEQ ID NO: 190236 - protein, 9 aa, Tick-borne encephalitis virus
DGEWRDGFD

SEQ ID NO: 190237 - protein, 9 aa, Tick-borne encephalitis virus
GEWRDGFDW

SEQ ID NO: 190238 - protein, 9 aa, Tick-borne encephalitis virus
EWRDGFDWI

SEQ ID NO: 190239 - protein, 9 aa, Tick-borne encephalitis virus
WRDGFDWIT

SEQ ID NO: 190240 - protein, 9 aa, Tick-borne encephalitis virus
RDGFDWITE

SEQ ID NO: 190241 - protein, 9 aa, Tick-borne encephalitis virus
DGFDWITEY

SEQ ID NO: 190242 - protein, 9 aa, Tick-borne encephalitis virus
GFDWITEYE

SEQ ID NO: 190243 - protein, 9 aa, Tick-borne encephalitis virus
FDWITEYEG

SEQ ID NO: 190244 - protein, 9 aa, Tick-borne encephalitis virus
DWITEYEGR

SEQ ID NO: 190245 - protein, 9 aa, Tick-borne encephalitis virus
WITEYEGRT

SEQ ID NO: 190246 - protein, 9 aa, Tick-borne encephalitis virus
ITEYEGRTA

SEQ ID NO: 190247 - protein, 9 aa, Tick-borne encephalitis virus
TEYEGRTAW

SEQ ID NO: 190248 - protein, 9 aa, Tick-borne encephalitis virus
EYEGRTAWF

SEQ ID NO: 190249 - protein, 9 aa, Tick-borne encephalitis virus
YEGRTAWFV

SEQ ID NO: 190250 - protein, 9 aa, Tick-borne encephalitis virus
EGRTAWFVP

SEQ ID NO: 190251 - protein, 9 aa, Tick-borne encephalitis virus
GRTAWFVPS

SEQ ID NO: 190252 - protein, 9 aa, Tick-borne encephalitis virus
RTAWFVPSI

SEQ ID NO: 190253 - protein, 9 aa, Tick-borne encephalitis virus
TAWFVPSIA

SEQ ID NO: 190254 - protein, 9 aa, Tick-borne encephalitis virus
AWFVPSIAK

SEQ ID NO: 190255 - protein, 9 aa, Tick-borne encephalitis virus
WFVPSIAKG

SEQ ID NO: 190256 - protein, 9 aa, Tick-borne encephalitis virus
FVPSIAKGG

SEQ ID NO: 190257 - protein, 9 aa, Tick-borne encephalitis virus
VPSIAKGGI

SEQ ID NO: 190258 - protein, 9 aa, Tick-borne encephalitis virus
PSIAKGGII

SEQ ID NO: 190259 - protein, 9 aa, Tick-borne encephalitis virus
SIAKGGIIA

SEQ ID NO: 190260 - protein, 9 aa, Tick-borne encephalitis virus
IAKGGIIAR

SEQ ID NO: 190261 - protein, 9 aa, Tick-borne encephalitis virus
AKGGIIART

SEQ ID NO: 190262 - protein, 9 aa, Tick-borne encephalitis virus
KGGIIARTL

SEQ ID NO: 190263 - protein, 9 aa, Tick-borne encephalitis virus
GGIIARTLR

SEQ ID NO: 190264 - protein, 9 aa, Tick-borne encephalitis virus
GIIARTLRQ

SEQ ID NO: 190265 - protein, 9 aa, Tick-borne encephalitis virus
IIARTLRQK

SEQ ID NO: 190266 - protein, 9 aa, Tick-borne encephalitis virus
IARTLRQKG

SEQ ID NO: 190267 - protein, 9 aa, Tick-borne encephalitis virus
ARTLRQKGK

SEQ ID NO: 190268 - protein, 9 aa, Tick-borne encephalitis virus
RTLRQKGKS

SEQ ID NO: 190269 - protein, 9 aa, Tick-borne encephalitis virus
TLRQKGKSV

SEQ ID NO: 190270 - protein, 9 aa, Tick-borne encephalitis virus
LRQKGKSVI

SEQ ID NO: 190271 - protein, 9 aa, Tick-borne encephalitis virus
RQKGKSVIC

SEQ ID NO: 190272 - protein, 9 aa, Tick-borne encephalitis virus
QKGKSVICL

SEQ ID NO: 190273 - protein, 9 aa, Tick-borne encephalitis virus
KGKSVICLN

SEQ ID NO: 190274 - protein, 9 aa, Tick-borne encephalitis virus
GKSVICLNS

SEQ ID NO: 190275 - protein, 9 aa, Tick-borne encephalitis virus
KSVICLNSK

SEQ ID NO: 190276 - protein, 9 aa, Tick-borne encephalitis virus
SVICLNSKT

SEQ ID NO: 190277 - protein, 9 aa, Tick-borne encephalitis virus
VICLNSKTF

SEQ ID NO: 190278 - protein, 9 aa, Tick-borne encephalitis virus
ICLNSKTFE

SEQ ID NO: 190279 - protein, 9 aa, Tick-borne encephalitis virus
CLNSKTFEK

SEQ ID NO: 190280 - protein, 9 aa, Tick-borne encephalitis virus
LNSKTFEKD

SEQ ID NO: 190281 - protein, 9 aa, Tick-borne encephalitis virus
NSKTFEKDY

SEQ ID NO: 190282 - protein, 9 aa, Tick-borne encephalitis virus
SKTFEKDYS

SEQ ID NO: 190283 - protein, 9 aa, Tick-borne encephalitis virus
KTFEKDYSR

SEQ ID NO: 190284 - protein, 9 aa, Tick-borne encephalitis virus
TFEKDYSRV

SEQ ID NO: 190285 - protein, 9 aa, Tick-borne encephalitis virus
FEKDYSRVR

SEQ ID NO: 190286 - protein, 9 aa, Tick-borne encephalitis virus
EKDYSRVRD

SEQ ID NO: 190287 - protein, 9 aa, Tick-borne encephalitis virus
KDYSRVRDE

SEQ ID NO: 190288 - protein, 9 aa, Tick-borne encephalitis virus
DYSRVRDEK

SEQ ID NO: 190289 - protein, 9 aa, Tick-borne encephalitis virus
YSRVRDEKP

SEQ ID NO: 190290 - protein, 9 aa, Tick-borne encephalitis virus
SRVRDEKPD

SEQ ID NO: 190291 - protein, 9 aa, Tick-borne encephalitis virus
RVRDEKPDF

SEQ ID NO: 190292 - protein, 9 aa, Tick-borne encephalitis virus
VRDEKPDFV

SEQ ID NO: 190293 - protein, 9 aa, Tick-borne encephalitis virus
RDEKPDFVV

SEQ ID NO: 190294 - protein, 9 aa, Tick-borne encephalitis virus
DEKPDFVVT

SEQ ID NO: 190295 - protein, 9 aa, Tick-borne encephalitis virus
EKPDFVVTT

SEQ ID NO: 190296 - protein, 9 aa, Tick-borne encephalitis virus
KPDFVVTTD

SEQ ID NO: 190297 - protein, 9 aa, Tick-borne encephalitis virus
PDFVVTTDI

SEQ ID NO: 190298 - protein, 9 aa, Tick-borne encephalitis virus
DFVVTTDIS

SEQ ID NO: 190299 - protein, 9 aa, Tick-borne encephalitis virus
FVVTTDISE

SEQ ID NO: 190300 - protein, 9 aa, Tick-borne encephalitis virus
VVTTDISEM

SEQ ID NO: 190301 - protein, 9 aa, Tick-borne encephalitis virus
VTTDISEMG

SEQ ID NO: 190302 - protein, 9 aa, Tick-borne encephalitis virus
TTDISEMGA

SEQ ID NO: 190303 - protein, 9 aa, Tick-borne encephalitis virus
TDISEMGAN

SEQ ID NO: 190304 - protein, 9 aa, Tick-borne encephalitis virus
DISEMGANL

SEQ ID NO: 190305 - protein, 9 aa, Tick-borne encephalitis virus
ISEMGANLD

SEQ ID NO: 190306 - protein, 9 aa, Tick-borne encephalitis virus
SEMGANLDV

SEQ ID NO: 190307 - protein, 9 aa, Tick-borne encephalitis virus
EMGANLDVS

SEQ ID NO: 190308 - protein, 9 aa, Tick-borne encephalitis virus
MGANLDVSR

SEQ ID NO: 190309 - protein, 9 aa, Tick-borne encephalitis virus
GANLDVSRV

SEQ ID NO: 190310 - protein, 9 aa, Tick-borne encephalitis virus
ANLDVSRVI

SEQ ID NO: 190311 - protein, 9 aa, Tick-borne encephalitis virus
NLDVSRVID

SEQ ID NO: 190312 - protein, 9 aa, Tick-borne encephalitis virus
LDVSRVIDG

SEQ ID NO: 190313 - protein, 9 aa, Tick-borne encephalitis virus
DVSRVIDGR

SEQ ID NO: 190314 - protein, 9 aa, Tick-borne encephalitis virus
VSRVIDGRT

SEQ ID NO: 190315 - protein, 9 aa, Tick-borne encephalitis virus
SRVIDGRTN

SEQ ID NO: 190316 - protein, 9 aa, Tick-borne encephalitis virus
RVIDGRTNI

SEQ ID NO: 190317 - protein, 9 aa, Tick-borne encephalitis virus
VIDGRTNIK

SEQ ID NO: 190318 - protein, 9 aa, Tick-borne encephalitis virus
IDGRTNIKP

SEQ ID NO: 190319 - protein, 9 aa, Tick-borne encephalitis virus
DGRTNIKPE

SEQ ID NO: 190320 - protein, 9 aa, Tick-borne encephalitis virus
GRTNIKPEE

SEQ ID NO: 190321 - protein, 9 aa, Tick-borne encephalitis virus
RTNIKPEEV

SEQ ID NO: 190322 - protein, 9 aa, Tick-borne encephalitis virus
TNIKPEEVD

SEQ ID NO: 190323 - protein, 9 aa, Tick-borne encephalitis virus
NIKPEEVDG

SEQ ID NO: 190324 - protein, 9 aa, Tick-borne encephalitis virus
IKPEEVDGR

SEQ ID NO: 190325 - protein, 9 aa, Tick-borne encephalitis virus
KPEEVDGRV

SEQ ID NO: 190326 - protein, 9 aa, Tick-borne encephalitis virus
PEEVDGRVE

SEQ ID NO: 190327 - protein, 9 aa, Tick-borne encephalitis virus
EEVDGRVEL

SEQ ID NO: 190328 - protein, 9 aa, Tick-borne encephalitis virus
EVDGRVELT

SEQ ID NO: 190329 - protein, 9 aa, Tick-borne encephalitis virus
VDGRVELTG

SEQ ID NO: 190330 - protein, 9 aa, Tick-borne encephalitis virus
DGRVELTGT

SEQ ID NO: 190331 - protein, 9 aa, Tick-borne encephalitis virus
GRVELTGTR

SEQ ID NO: 190332 - protein, 9 aa, Tick-borne encephalitis virus
RVELTGTRR

SEQ ID NO: 190333 - protein, 9 aa, Tick-borne encephalitis virus
VELTGTRRV

SEQ ID NO: 190334 - protein, 9 aa, Tick-borne encephalitis virus
ELTGTRRVT

SEQ ID NO: 190335 - protein, 9 aa, Tick-borne encephalitis virus
LTGTRRVTT

SEQ ID NO: 190336 - protein, 9 aa, Tick-borne encephalitis virus
TGTRRVTTA

SEQ ID NO: 190337 - protein, 9 aa, Tick-borne encephalitis virus
GTRRVTTAS

SEQ ID NO: 190338 - protein, 9 aa, Tick-borne encephalitis virus
TRRVTTASA

SEQ ID NO: 190339 - protein, 9 aa, Tick-borne encephalitis virus
RRVTTASAA

SEQ ID NO: 190340 - protein, 9 aa, Tick-borne encephalitis virus
RVTTASAAQ

SEQ ID NO: 190341 - protein, 9 aa, Tick-borne encephalitis virus
VTTASAAQR

SEQ ID NO: 190342 - protein, 9 aa, Tick-borne encephalitis virus
TTASAAQRR

SEQ ID NO: 190343 - protein, 9 aa, Tick-borne encephalitis virus
TASAAQRRG

SEQ ID NO: 190344 - protein, 9 aa, Tick-borne encephalitis virus
ASAAQRRGR

SEQ ID NO: 190345 - protein, 9 aa, Tick-borne encephalitis virus
SAAQRRGRV

SEQ ID NO: 190346 - protein, 9 aa, Tick-borne encephalitis virus
AAQRRGRVG

SEQ ID NO: 190347 - protein, 9 aa, Tick-borne encephalitis virus
AQRRGRVGR

SEQ ID NO: 190348 - protein, 9 aa, Tick-borne encephalitis virus
QRRGRVGRQ

SEQ ID NO: 190349 - protein, 9 aa, Tick-borne encephalitis virus
RRGRVGRQE

SEQ ID NO: 190350 - protein, 9 aa, Tick-borne encephalitis virus
RGRVGRQEG

SEQ ID NO: 190351 - protein, 9 aa, Tick-borne encephalitis virus
GRVGRQEGR

SEQ ID NO: 190352 - protein, 9 aa, Tick-borne encephalitis virus
RVGRQEGRT

SEQ ID NO: 190353 - protein, 9 aa, Tick-borne encephalitis virus
VGRQEGRTD

SEQ ID NO: 190354 - protein, 9 aa, Tick-borne encephalitis virus
GRQEGRTDE

SEQ ID NO: 190355 - protein, 9 aa, Tick-borne encephalitis virus
RQEGRTDEY

SEQ ID NO: 190356 - protein, 9 aa, Tick-borne encephalitis virus
QEGRTDEYI

SEQ ID NO: 190357 - protein, 9 aa, Tick-borne encephalitis virus
EGRTDEYIY

SEQ ID NO: 190358 - protein, 9 aa, Tick-borne encephalitis virus
GRTDEYIYS

SEQ ID NO: 190359 - protein, 9 aa, Tick-borne encephalitis virus
RTDEYIYSG

SEQ ID NO: 190360 - protein, 9 aa, Tick-borne encephalitis virus
TDEYIYSGQ

SEQ ID NO: 190361 - protein, 9 aa, Tick-borne encephalitis virus
DEYIYSGQC

SEQ ID NO: 190362 - protein, 9 aa, Tick-borne encephalitis virus
EYIYSGQCD

SEQ ID NO: 190363 - protein, 9 aa, Tick-borne encephalitis virus
YIYSGQCDD

SEQ ID NO: 190364 - protein, 9 aa, Tick-borne encephalitis virus
IYSGQCDDD

SEQ ID NO: 190365 - protein, 9 aa, Tick-borne encephalitis virus
YSGQCDDDD

SEQ ID NO: 190366 - protein, 9 aa, Tick-borne encephalitis virus
SGQCDDDDS

SEQ ID NO: 190367 - protein, 9 aa, Tick-borne encephalitis virus
GQCDDDDSG

SEQ ID NO: 190368 - protein, 9 aa, Tick-borne encephalitis virus
QCDDDDSGL

SEQ ID NO: 190369 - protein, 9 aa, Tick-borne encephalitis virus
CDDDDSGLV

SEQ ID NO: 190370 - protein, 9 aa, Tick-borne encephalitis virus
DDDDSGLVQ

SEQ ID NO: 190371 - protein, 9 aa, Tick-borne encephalitis virus
DDDSGLVQW

SEQ ID NO: 190372 - protein, 9 aa, Tick-borne encephalitis virus
DDSGLVQWK

SEQ ID NO: 190373 - protein, 9 aa, Tick-borne encephalitis virus
DSGLVQWKE

SEQ ID NO: 190374 - protein, 9 aa, Tick-borne encephalitis virus
SGLVQWKEA

SEQ ID NO: 190375 - protein, 9 aa, Tick-borne encephalitis virus
GLVQWKEAQ

SEQ ID NO: 190376 - protein, 9 aa, Tick-borne encephalitis virus
LVQWKEAQI

SEQ ID NO: 190377 - protein, 9 aa, Tick-borne encephalitis virus
VQWKEAQIL

SEQ ID NO: 190378 - protein, 9 aa, Tick-borne encephalitis virus
QWKEAQILL

SEQ ID NO: 190379 - protein, 9 aa, Tick-borne encephalitis virus
WKEAQILLD

SEQ ID NO: 190380 - protein, 9 aa, Tick-borne encephalitis virus
KEAQILLDN

SEQ ID NO: 190381 - protein, 9 aa, Tick-borne encephalitis virus
EAQILLDNI

SEQ ID NO: 190382 - protein, 9 aa, Tick-borne encephalitis virus
AQILLDNIT

SEQ ID NO: 190383 - protein, 9 aa, Tick-borne encephalitis virus
QILLDNITT

SEQ ID NO: 190384 - protein, 9 aa, Tick-borne encephalitis virus
ILLDNITTL

SEQ ID NO: 190385 - protein, 9 aa, Tick-borne encephalitis virus
LLDNITTLR

SEQ ID NO: 190386 - protein, 9 aa, Tick-borne encephalitis virus
LDNITTLRG

SEQ ID NO: 190387 - protein, 9 aa, Tick-borne encephalitis virus
DNITTLRGP

SEQ ID NO: 190388 - protein, 9 aa, Tick-borne encephalitis virus
NITTLRGPV

SEQ ID NO: 190389 - protein, 9 aa, Tick-borne encephalitis virus
ITTLRGPVA

SEQ ID NO: 190390 - protein, 9 aa, Tick-borne encephalitis virus
TTLRGPVAT

SEQ ID NO: 190391 - protein, 9 aa, Tick-borne encephalitis virus
TLRGPVATF

SEQ ID NO: 190392 - protein, 9 aa, Tick-borne encephalitis virus
LRGPVATFY

SEQ ID NO: 190393 - protein, 9 aa, Tick-borne encephalitis virus
RGPVATFYG

SEQ ID NO: 190394 - protein, 9 aa, Tick-borne encephalitis virus
GPVATFYGP

SEQ ID NO: 190395 - protein, 9 aa, Tick-borne encephalitis virus
PVATFYGPE

SEQ ID NO: 190396 - protein, 9 aa, Tick-borne encephalitis virus
VATFYGPEQ

SEQ ID NO: 190397 - protein, 9 aa, Tick-borne encephalitis virus
ATFYGPEQD

SEQ ID NO: 190398 - protein, 9 aa, Tick-borne encephalitis virus
TFYGPEQDK

SEQ ID NO: 190399 - protein, 9 aa, Tick-borne encephalitis virus
FYGPEQDKM

SEQ ID NO: 190400 - protein, 9 aa, Tick-borne encephalitis virus
YGPEQDKMP

SEQ ID NO: 190401 - protein, 9 aa, Tick-borne encephalitis virus
GPEQDKMPE

SEQ ID NO: 190402 - protein, 9 aa, Tick-borne encephalitis virus
PEQDKMPEV

SEQ ID NO: 190403 - protein, 9 aa, Tick-borne encephalitis virus
EQDKMPEVA

SEQ ID NO: 190404 - protein, 9 aa, Tick-borne encephalitis virus
QDKMPEVAG

SEQ ID NO: 190405 - protein, 9 aa, Tick-borne encephalitis virus
DKMPEVAGH

SEQ ID NO: 190406 - protein, 9 aa, Tick-borne encephalitis virus
KMPEVAGHF

SEQ ID NO: 190407 - protein, 9 aa, Tick-borne encephalitis virus
MPEVAGHFR

SEQ ID NO: 190408 - protein, 9 aa, Tick-borne encephalitis virus
PEVAGHFRL

SEQ ID NO: 190409 - protein, 9 aa, Tick-borne encephalitis virus
EVAGHFRLT

SEQ ID NO: 190410 - protein, 9 aa, Tick-borne encephalitis virus
VAGHFRLTE

SEQ ID NO: 190411 - protein, 9 aa, Tick-borne encephalitis virus
AGHFRLTEE

SEQ ID NO: 190412 - protein, 9 aa, Tick-borne encephalitis virus
GHFRLTEEK

SEQ ID NO: 190413 - protein, 9 aa, Tick-borne encephalitis virus
HFRLTEEKR

SEQ ID NO: 190414 - protein, 9 aa, Tick-borne encephalitis virus
FRLTEEKRK

SEQ ID NO: 190415 - protein, 9 aa, Tick-borne encephalitis virus
RLTEEKRKH

SEQ ID NO: 190416 - protein, 9 aa, Tick-borne encephalitis virus
LTEEKRKHF

SEQ ID NO: 190417 - protein, 9 aa, Tick-borne encephalitis virus
TEEKRKHFR

SEQ ID NO: 190418 - protein, 9 aa, Tick-borne encephalitis virus
EEKRKHFRH

SEQ ID NO: 190419 - protein, 9 aa, Tick-borne encephalitis virus
EKRKHFRHL

SEQ ID NO: 190420 - protein, 9 aa, Tick-borne encephalitis virus
KRKHFRHLL

SEQ ID NO: 190421 - protein, 9 aa, Tick-borne encephalitis virus
RKHFRHLLT

SEQ ID NO: 190422 - protein, 9 aa, Tick-borne encephalitis virus
KHFRHLLTH

SEQ ID NO: 190423 - protein, 9 aa, Tick-borne encephalitis virus
HFRHLLTHC

SEQ ID NO: 190424 - protein, 9 aa, Tick-borne encephalitis virus
FRHLLTHCD

SEQ ID NO: 190425 - protein, 9 aa, Tick-borne encephalitis virus
RHLLTHCDF

SEQ ID NO: 190426 - protein, 9 aa, Tick-borne encephalitis virus
HLLTHCDFT

SEQ ID NO: 190427 - protein, 9 aa, Tick-borne encephalitis virus
LLTHCDFTP

SEQ ID NO: 190428 - protein, 9 aa, Tick-borne encephalitis virus
LTHCDFTPW

SEQ ID NO: 190429 - protein, 9 aa, Tick-borne encephalitis virus
THCDFTPWL

SEQ ID NO: 190430 - protein, 9 aa, Tick-borne encephalitis virus
HCDFTPWLA

SEQ ID NO: 190431 - protein, 9 aa, Tick-borne encephalitis virus
CDFTPWLAW

SEQ ID NO: 190432 - protein, 9 aa, Tick-borne encephalitis virus
DFTPWLAWH

SEQ ID NO: 190433 - protein, 9 aa, Tick-borne encephalitis virus
FTPWLAWHV

SEQ ID NO: 190434 - protein, 9 aa, Tick-borne encephalitis virus
TPWLAWHVA

SEQ ID NO: 190435 - protein, 9 aa, Tick-borne encephalitis virus
PWLAWHVAA

SEQ ID NO: 190436 - protein, 9 aa, Tick-borne encephalitis virus
WLAWHVAAN

SEQ ID NO: 190437 - protein, 9 aa, Tick-borne encephalitis virus
LAWHVAANV

SEQ ID NO: 190438 - protein, 9 aa, Tick-borne encephalitis virus
AWHVAANVS

SEQ ID NO: 190439 - protein, 9 aa, Tick-borne encephalitis virus
WHVAANVSS

SEQ ID NO: 190440 - protein, 9 aa, Tick-borne encephalitis virus
HVAANVSSV

SEQ ID NO: 190441 - protein, 9 aa, Tick-borne encephalitis virus
VAANVSSVT

SEQ ID NO: 190442 - protein, 9 aa, Tick-borne encephalitis virus
AANVSSVTS

SEQ ID NO: 190443 - protein, 9 aa, Tick-borne encephalitis virus
ANVSSVTSR

SEQ ID NO: 190444 - protein, 9 aa, Tick-borne encephalitis virus
NVSSVTSRN

SEQ ID NO: 190445 - protein, 9 aa, Tick-borne encephalitis virus
VSSVTSRNW

SEQ ID NO: 190446 - protein, 9 aa, Tick-borne encephalitis virus
SSVTSRNWT

SEQ ID NO: 190447 - protein, 9 aa, Tick-borne encephalitis virus
SVTSRNWTW

SEQ ID NO: 190448 - protein, 9 aa, Tick-borne encephalitis virus
VTSRNWTWE

SEQ ID NO: 190449 - protein, 9 aa, Tick-borne encephalitis virus
TSRNWTWEG

SEQ ID NO: 190450 - protein, 9 aa, Tick-borne encephalitis virus
SRNWTWEGP

SEQ ID NO: 190451 - protein, 9 aa, Tick-borne encephalitis virus
RNWTWEGPE

SEQ ID NO: 190452 - protein, 9 aa, Tick-borne encephalitis virus
NWTWEGPEE

SEQ ID NO: 190453 - protein, 9 aa, Tick-borne encephalitis virus
WTWEGPEEN

SEQ ID NO: 190454 - protein, 9 aa, Tick-borne encephalitis virus
TWEGPEENT

SEQ ID NO: 190455 - protein, 9 aa, Tick-borne encephalitis virus
WEGPEENTV

SEQ ID NO: 190456 - protein, 9 aa, Tick-borne encephalitis virus
EGPEENTVD

SEQ ID NO: 190457 - protein, 9 aa, Tick-borne encephalitis virus
GPEENTVDE

SEQ ID NO: 190458 - protein, 9 aa, Tick-borne encephalitis virus
PEENTVDEA

SEQ ID NO: 190459 - protein, 9 aa, Tick-borne encephalitis virus
EENTVDEAN

SEQ ID NO: 190460 - protein, 9 aa, Tick-borne encephalitis virus
ENTVDEANG

SEQ ID NO: 190461 - protein, 9 aa, Tick-borne encephalitis virus
NTVDEANGD

SEQ ID NO: 190462 - protein, 9 aa, Tick-borne encephalitis virus
TVDEANGDL

SEQ ID NO: 190463 - protein, 9 aa, Tick-borne encephalitis virus
VDEANGDLV

SEQ ID NO: 190464 - protein, 9 aa, Tick-borne encephalitis virus
DEANGDLVT

SEQ ID NO: 190465 - protein, 9 aa, Tick-borne encephalitis virus
EANGDLVTF

SEQ ID NO: 190466 - protein, 9 aa, Tick-borne encephalitis virus
ANGDLVTFR

SEQ ID NO: 190467 - protein, 9 aa, Tick-borne encephalitis virus
NGDLVTFRS

SEQ ID NO: 190468 - protein, 9 aa, Tick-borne encephalitis virus
GDLVTFRSP

SEQ ID NO: 190469 - protein, 9 aa, Tick-borne encephalitis virus
DLVTFRSPN

SEQ ID NO: 190470 - protein, 9 aa, Tick-borne encephalitis virus
LVTFRSPNG

SEQ ID NO: 190471 - protein, 9 aa, Tick-borne encephalitis virus
VTFRSPNGA

SEQ ID NO: 190472 - protein, 9 aa, Tick-borne encephalitis virus
TFRSPNGAE

SEQ ID NO: 190473 - protein, 9 aa, Tick-borne encephalitis virus
FRSPNGAER

SEQ ID NO: 190474 - protein, 9 aa, Tick-borne encephalitis virus
RSPNGAERT

SEQ ID NO: 190475 - protein, 9 aa, Tick-borne encephalitis virus
SPNGAERTL

SEQ ID NO: 190476 - protein, 9 aa, Tick-borne encephalitis virus
PNGAERTLR

SEQ ID NO: 190477 - protein, 9 aa, Tick-borne encephalitis virus
NGAERTLRP

SEQ ID NO: 190478 - protein, 9 aa, Tick-borne encephalitis virus
GAERTLRPV

SEQ ID NO: 190479 - protein, 9 aa, Tick-borne encephalitis virus
AERTLRPVW

SEQ ID NO: 190480 - protein, 9 aa, Tick-borne encephalitis virus
ERTLRPVWR

SEQ ID NO: 190481 - protein, 9 aa, Tick-borne encephalitis virus
RTLRPVWRD

SEQ ID NO: 190482 - protein, 9 aa, Tick-borne encephalitis virus
TLRPVWRDA

SEQ ID NO: 190483 - protein, 9 aa, Tick-borne encephalitis virus
LRPVWRDAR

SEQ ID NO: 190484 - protein, 9 aa, Tick-borne encephalitis virus
RPVWRDARM

SEQ ID NO: 190485 - protein, 9 aa, Tick-borne encephalitis virus
PVWRDARMF

SEQ ID NO: 190486 - protein, 9 aa, Tick-borne encephalitis virus
VWRDARMFR

SEQ ID NO: 190487 - protein, 9 aa, Tick-borne encephalitis virus
WRDARMFRE

SEQ ID NO: 190488 - protein, 9 aa, Tick-borne encephalitis virus
RDARMFREG

SEQ ID NO: 190489 - protein, 9 aa, Tick-borne encephalitis virus
DARMFREGR

SEQ ID NO: 190490 - protein, 9 aa, Tick-borne encephalitis virus
ARMFREGRD

SEQ ID NO: 190491 - protein, 9 aa, Tick-borne encephalitis virus
RMFREGRDI

SEQ ID NO: 190492 - protein, 9 aa, Tick-borne encephalitis virus
MFREGRDIR

SEQ ID NO: 190493 - protein, 9 aa, Tick-borne encephalitis virus
FREGRDIRE

SEQ ID NO: 190494 - protein, 9 aa, Tick-borne encephalitis virus
REGRDIREF

SEQ ID NO: 190495 - protein, 9 aa, Tick-borne encephalitis virus
EGRDIREFV

SEQ ID NO: 190496 - protein, 9 aa, Tick-borne encephalitis virus
GRDIREFVA

SEQ ID NO: 190497 - protein, 9 aa, Tick-borne encephalitis virus
RDIREFVAY

SEQ ID NO: 190498 - protein, 9 aa, Tick-borne encephalitis virus
DIREFVAYA

SEQ ID NO: 190499 - protein, 9 aa, Tick-borne encephalitis virus
IREFVAYAS

SEQ ID NO: 190500 - protein, 9 aa, Tick-borne encephalitis virus
REFVAYASG

SEQ ID NO: 190501 - protein, 9 aa, Tick-borne encephalitis virus
EFVAYASGR

SEQ ID NO: 190502 - protein, 9 aa, Tick-borne encephalitis virus
FVAYASGRR

SEQ ID NO: 190503 - protein, 9 aa, Tick-borne encephalitis virus
VAYASGRRS

SEQ ID NO: 190504 - protein, 9 aa, Tick-borne encephalitis virus
AYASGRRSF

SEQ ID NO: 190505 - protein, 9 aa, Tick-borne encephalitis virus
YASGRRSFG

SEQ ID NO: 190506 - protein, 9 aa, Tick-borne encephalitis virus
ASGRRSFGD

SEQ ID NO: 190507 - protein, 9 aa, Tick-borne encephalitis virus
SGRRSFGDV

SEQ ID NO: 190508 - protein, 9 aa, Tick-borne encephalitis virus
GRRSFGDVL

SEQ ID NO: 190509 - protein, 9 aa, Tick-borne encephalitis virus
RRSFGDVLS

SEQ ID NO: 190510 - protein, 9 aa, Tick-borne encephalitis virus
RSFGDVLSG

SEQ ID NO: 190511 - protein, 9 aa, Tick-borne encephalitis virus
SFGDVLSGM

SEQ ID NO: 190512 - protein, 9 aa, Tick-borne encephalitis virus
FGDVLSGMS

SEQ ID NO: 190513 - protein, 9 aa, Tick-borne encephalitis virus
GDVLSGMSG

SEQ ID NO: 190514 - protein, 9 aa, Tick-borne encephalitis virus
DVLSGMSGV

SEQ ID NO: 190515 - protein, 9 aa, Tick-borne encephalitis virus
VLSGMSGVP

SEQ ID NO: 190516 - protein, 9 aa, Tick-borne encephalitis virus
LSGMSGVPE

SEQ ID NO: 190517 - protein, 9 aa, Tick-borne encephalitis virus
SGMSGVPEL

SEQ ID NO: 190518 - protein, 9 aa, Tick-borne encephalitis virus
GMSGVPELL

SEQ ID NO: 190519 - protein, 9 aa, Tick-borne encephalitis virus
MSGVPELLR

SEQ ID NO: 190520 - protein, 9 aa, Tick-borne encephalitis virus
SGVPELLRH

SEQ ID NO: 190521 - protein, 9 aa, Tick-borne encephalitis virus
GVPELLRHR

SEQ ID NO: 190522 - protein, 9 aa, Tick-borne encephalitis virus
VPELLRHRC

SEQ ID NO: 190523 - protein, 9 aa, Tick-borne encephalitis virus
PELLRHRCV

SEQ ID NO: 190524 - protein, 9 aa, Tick-borne encephalitis virus
ELLRHRCVS

SEQ ID NO: 190525 - protein, 9 aa, Tick-borne encephalitis virus
LLRHRCVSA

SEQ ID NO: 190526 - protein, 9 aa, Tick-borne encephalitis virus
LRHRCVSAM

SEQ ID NO: 190527 - protein, 9 aa, Tick-borne encephalitis virus
RHRCVSAMD

SEQ ID NO: 190528 - protein, 9 aa, Tick-borne encephalitis virus
HRCVSAMDV

SEQ ID NO: 190529 - protein, 9 aa, Tick-borne encephalitis virus
RCVSAMDVF

SEQ ID NO: 190530 - protein, 9 aa, Tick-borne encephalitis virus
CVSAMDVFY

SEQ ID NO: 190531 - protein, 9 aa, Tick-borne encephalitis virus
VSAMDVFYT

SEQ ID NO: 190532 - protein, 9 aa, Tick-borne encephalitis virus
SAMDVFYTL

SEQ ID NO: 190533 - protein, 9 aa, Tick-borne encephalitis virus
AMDVFYTLM

SEQ ID NO: 190534 - protein, 9 aa, Tick-borne encephalitis virus
MDVFYTLMH

SEQ ID NO: 190535 - protein, 9 aa, Tick-borne encephalitis virus
DVFYTLMHE

SEQ ID NO: 190536 - protein, 9 aa, Tick-borne encephalitis virus
VFYTLMHEE

SEQ ID NO: 190537 - protein, 9 aa, Tick-borne encephalitis virus
FYTLMHEEP

SEQ ID NO: 190538 - protein, 9 aa, Tick-borne encephalitis virus
YTLMHEEPG

SEQ ID NO: 190539 - protein, 9 aa, Tick-borne encephalitis virus
TLMHEEPGS

SEQ ID NO: 190540 - protein, 9 aa, Tick-borne encephalitis virus
LMHEEPGSR

SEQ ID NO: 190541 - protein, 9 aa, Tick-borne encephalitis virus
MHEEPGSRA

SEQ ID NO: 190542 - protein, 9 aa, Tick-borne encephalitis virus
HEEPGSRAM

SEQ ID NO: 190543 - protein, 9 aa, Tick-borne encephalitis virus
EEPGSRAMR

SEQ ID NO: 190544 - protein, 9 aa, Tick-borne encephalitis virus
EPGSRAMRM

SEQ ID NO: 190545 - protein, 9 aa, Tick-borne encephalitis virus
PGSRAMRMA

SEQ ID NO: 190546 - protein, 9 aa, Tick-borne encephalitis virus
GSRAMRMAE

SEQ ID NO: 190547 - protein, 9 aa, Tick-borne encephalitis virus
SRAMRMAER

SEQ ID NO: 190548 - protein, 9 aa, Tick-borne encephalitis virus
RAMRMAERD

SEQ ID NO: 190549 - protein, 9 aa, Tick-borne encephalitis virus
AMRMAERDA

SEQ ID NO: 190550 - protein, 9 aa, Tick-borne encephalitis virus
MRMAERDAP

SEQ ID NO: 190551 - protein, 9 aa, Tick-borne encephalitis virus
RMAERDAPE

SEQ ID NO: 190552 - protein, 9 aa, Tick-borne encephalitis virus
MAERDAPEA

SEQ ID NO: 190553 - protein, 9 aa, Tick-borne encephalitis virus
AERDAPEAF

SEQ ID NO: 190554 - protein, 9 aa, Tick-borne encephalitis virus
ERDAPEAFL

SEQ ID NO: 190555 - protein, 9 aa, Tick-borne encephalitis virus
RDAPEAFLT

SEQ ID NO: 190556 - protein, 9 aa, Tick-borne encephalitis virus
DAPEAFLTV

SEQ ID NO: 190557 - protein, 9 aa, Tick-borne encephalitis virus
APEAFLTVV

SEQ ID NO: 190558 - protein, 9 aa, Tick-borne encephalitis virus
PEAFLTVVE

SEQ ID NO: 190559 - protein, 9 aa, Tick-borne encephalitis virus
VEMMVLGLA

SEQ ID NO: 190560 - protein, 9 aa, Tick-borne encephalitis virus
EMMVLGLAT

SEQ ID NO: 190561 - protein, 9 aa, Tick-borne encephalitis virus
MMVLGLATL

SEQ ID NO: 190562 - protein, 9 aa, Tick-borne encephalitis virus
MVLGLATLG

SEQ ID NO: 190563 - protein, 9 aa, Tick-borne encephalitis virus
VLGLATLGV

SEQ ID NO: 190564 - protein, 9 aa, Tick-borne encephalitis virus
LGLATLGVV

SEQ ID NO: 190565 - protein, 9 aa, Tick-borne encephalitis virus
GLATLGVVW

SEQ ID NO: 190566 - protein, 9 aa, Tick-borne encephalitis virus
LATLGVVWC

SEQ ID NO: 190567 - protein, 9 aa, Tick-borne encephalitis virus
ATLGVVWCF

SEQ ID NO: 190568 - protein, 9 aa, Tick-borne encephalitis virus
TLGVVWCFV

SEQ ID NO: 190569 - protein, 9 aa, Tick-borne encephalitis virus
LGVVWCFVV

SEQ ID NO: 190570 - protein, 9 aa, Tick-borne encephalitis virus
GVVWCFVVR

SEQ ID NO: 190571 - protein, 9 aa, Tick-borne encephalitis virus
VVWCFVVRT

SEQ ID NO: 190572 - protein, 9 aa, Tick-borne encephalitis virus
VWCFVVRTS

SEQ ID NO: 190573 - protein, 9 aa, Tick-borne encephalitis virus
WCFVVRTSI

SEQ ID NO: 190574 - protein, 9 aa, Tick-borne encephalitis virus
CFVVRTSIS

SEQ ID NO: 190575 - protein, 9 aa, Tick-borne encephalitis virus
FVVRTSISR

SEQ ID NO: 190576 - protein, 9 aa, Tick-borne encephalitis virus
VVRTSISRM

SEQ ID NO: 190577 - protein, 9 aa, Tick-borne encephalitis virus
VRTSISRMM

SEQ ID NO: 190578 - protein, 9 aa, Tick-borne encephalitis virus
RTSISRMML

SEQ ID NO: 190579 - protein, 9 aa, Tick-borne encephalitis virus
TSISRMMLG

SEQ ID NO: 190580 - protein, 9 aa, Tick-borne encephalitis virus
SISRMMLGT

SEQ ID NO: 190581 - protein, 9 aa, Tick-borne encephalitis virus
ISRMMLGTL

SEQ ID NO: 190582 - protein, 9 aa, Tick-borne encephalitis virus
SRMMLGTLV

SEQ ID NO: 190583 - protein, 9 aa, Tick-borne encephalitis virus
RMMLGTLVL

SEQ ID NO: 190584 - protein, 9 aa, Tick-borne encephalitis virus
MMLGTLVLL

SEQ ID NO: 190585 - protein, 9 aa, Tick-borne encephalitis virus
MLGTLVLLA

SEQ ID NO: 190586 - protein, 9 aa, Tick-borne encephalitis virus
LGTLVLLAS

SEQ ID NO: 190587 - protein, 9 aa, Tick-borne encephalitis virus
GTLVLLASL

SEQ ID NO: 190588 - protein, 9 aa, Tick-borne encephalitis virus
TLVLLASLA

SEQ ID NO: 190589 - protein, 9 aa, Tick-borne encephalitis virus
LVLLASLAL

SEQ ID NO: 190590 - protein, 9 aa, Tick-borne encephalitis virus
VLLASLALL

SEQ ID NO: 190591 - protein, 9 aa, Tick-borne encephalitis virus
LLASLALLW

SEQ ID NO: 190592 - protein, 9 aa, Tick-borne encephalitis virus
LASLALLWA

SEQ ID NO: 190593 - protein, 9 aa, Tick-borne encephalitis virus
ASLALLWAG

SEQ ID NO: 190594 - protein, 9 aa, Tick-borne encephalitis virus
SLALLWAGG

SEQ ID NO: 190595 - protein, 9 aa, Tick-borne encephalitis virus
LALLWAGGV

SEQ ID NO: 190596 - protein, 9 aa, Tick-borne encephalitis virus
ALLWAGGVS

SEQ ID NO: 190597 - protein, 9 aa, Tick-borne encephalitis virus
LLWAGGVSY

SEQ ID NO: 190598 - protein, 9 aa, Tick-borne encephalitis virus
LWAGGVSYG

SEQ ID NO: 190599 - protein, 9 aa, Tick-borne encephalitis virus
WAGGVSYGN

SEQ ID NO: 190600 - protein, 9 aa, Tick-borne encephalitis virus
AGGVSYGNM

SEQ ID NO: 190601 - protein, 9 aa, Tick-borne encephalitis virus
GGVSYGNMA

SEQ ID NO: 190602 - protein, 9 aa, Tick-borne encephalitis virus
GVSYGNMAG

SEQ ID NO: 190603 - protein, 9 aa, Tick-borne encephalitis virus
VSYGNMAGV

SEQ ID NO: 190604 - protein, 9 aa, Tick-borne encephalitis virus
SYGNMAGVA

SEQ ID NO: 190605 - protein, 9 aa, Tick-borne encephalitis virus
YGNMAGVAL

SEQ ID NO: 190606 - protein, 9 aa, Tick-borne encephalitis virus
GNMAGVALI

SEQ ID NO: 190607 - protein, 9 aa, Tick-borne encephalitis virus
NMAGVALIF

SEQ ID NO: 190608 - protein, 9 aa, Tick-borne encephalitis virus
MAGVALIFY

SEQ ID NO: 190609 - protein, 9 aa, Tick-borne encephalitis virus
AGVALIFYT

SEQ ID NO: 190610 - protein, 9 aa, Tick-borne encephalitis virus
GVALIFYTL

SEQ ID NO: 190611 - protein, 9 aa, Tick-borne encephalitis virus
VALIFYTLL

SEQ ID NO: 190612 - protein, 9 aa, Tick-borne encephalitis virus
ALIFYTLLT

SEQ ID NO: 190613 - protein, 9 aa, Tick-borne encephalitis virus
LIFYTLLTV

SEQ ID NO: 190614 - protein, 9 aa, Tick-borne encephalitis virus
IFYTLLTVL

SEQ ID NO: 190615 - protein, 9 aa, Tick-borne encephalitis virus
FYTLLTVLQ

SEQ ID NO: 190616 - protein, 9 aa, Tick-borne encephalitis virus
YTLLTVLQP

SEQ ID NO: 190617 - protein, 9 aa, Tick-borne encephalitis virus
TLLTVLQPE

SEQ ID NO: 190618 - protein, 9 aa, Tick-borne encephalitis virus
LLTVLQPEA

SEQ ID NO: 190619 - protein, 9 aa, Tick-borne encephalitis virus
LTVLQPEAG

SEQ ID NO: 190620 - protein, 9 aa, Tick-borne encephalitis virus
TVLQPEAGK

SEQ ID NO: 190621 - protein, 9 aa, Tick-borne encephalitis virus
VLQPEAGKQ

SEQ ID NO: 190622 - protein, 9 aa, Tick-borne encephalitis virus
LQPEAGKQR

SEQ ID NO: 190623 - protein, 9 aa, Tick-borne encephalitis virus
QPEAGKQRS

SEQ ID NO: 190624 - protein, 9 aa, Tick-borne encephalitis virus
PEAGKQRSS

SEQ ID NO: 190625 - protein, 9 aa, Tick-borne encephalitis virus
EAGKQRSSD

SEQ ID NO: 190626 - protein, 9 aa, Tick-borne encephalitis virus
AGKQRSSDD

SEQ ID NO: 190627 - protein, 9 aa, Tick-borne encephalitis virus
GKQRSSDDN

SEQ ID NO: 190628 - protein, 9 aa, Tick-borne encephalitis virus
KQRSSDDNK

SEQ ID NO: 190629 - protein, 9 aa, Tick-borne encephalitis virus
QRSSDDNKL

SEQ ID NO: 190630 - protein, 9 aa, Tick-borne encephalitis virus
RSSDDNKLA

SEQ ID NO: 190631 - protein, 9 aa, Tick-borne encephalitis virus
SSDDNKLAY

SEQ ID NO: 190632 - protein, 9 aa, Tick-borne encephalitis virus
SDDNKLAYF

SEQ ID NO: 190633 - protein, 9 aa, Tick-borne encephalitis virus
DDNKLAYFL

SEQ ID NO: 190634 - protein, 9 aa, Tick-borne encephalitis virus
DNKLAYFLL

SEQ ID NO: 190635 - protein, 9 aa, Tick-borne encephalitis virus
NKLAYFLLT

SEQ ID NO: 190636 - protein, 9 aa, Tick-borne encephalitis virus
KLAYFLLTL

SEQ ID NO: 190637 - protein, 9 aa, Tick-borne encephalitis virus
LAYFLLTLC

SEQ ID NO: 190638 - protein, 9 aa, Tick-borne encephalitis virus
AYFLLTLCS

SEQ ID NO: 190639 - protein, 9 aa, Tick-borne encephalitis virus
YFLLTLCSL

SEQ ID NO: 190640 - protein, 9 aa, Tick-borne encephalitis virus
FLLTLCSLA

SEQ ID NO: 190641 - protein, 9 aa, Tick-borne encephalitis virus
LLTLCSLAG

SEQ ID NO: 190642 - protein, 9 aa, Tick-borne encephalitis virus
LTLCSLAGL

SEQ ID NO: 190643 - protein, 9 aa, Tick-borne encephalitis virus
TLCSLAGLV

SEQ ID NO: 190644 - protein, 9 aa, Tick-borne encephalitis virus
LCSLAGLVA

SEQ ID NO: 190645 - protein, 9 aa, Tick-borne encephalitis virus
CSLAGLVAA

SEQ ID NO: 190646 - protein, 9 aa, Tick-borne encephalitis virus
SLAGLVAAN

SEQ ID NO: 190647 - protein, 9 aa, Tick-borne encephalitis virus
LAGLVAANE

SEQ ID NO: 190648 - protein, 9 aa, Tick-borne encephalitis virus
AGLVAANEM

SEQ ID NO: 190649 - protein, 9 aa, Tick-borne encephalitis virus
GLVAANEMG

SEQ ID NO: 190650 - protein, 9 aa, Tick-borne encephalitis virus
LVAANEMGF

SEQ ID NO: 190651 - protein, 9 aa, Tick-borne encephalitis virus
VAANEMGFL

SEQ ID NO: 190652 - protein, 9 aa, Tick-borne encephalitis virus
AANEMGFLE

SEQ ID NO: 190653 - protein, 9 aa, Tick-borne encephalitis virus
ANEMGFLEK

SEQ ID NO: 190654 - protein, 9 aa, Tick-borne encephalitis virus
NEMGFLEKT

SEQ ID NO: 190655 - protein, 9 aa, Tick-borne encephalitis virus
EMGFLEKTK

SEQ ID NO: 190656 - protein, 9 aa, Tick-borne encephalitis virus
MGFLEKTKA

SEQ ID NO: 190657 - protein, 9 aa, Tick-borne encephalitis virus
GFLEKTKAD

SEQ ID NO: 190658 - protein, 9 aa, Tick-borne encephalitis virus
FLEKTKADL

SEQ ID NO: 190659 - protein, 9 aa, Tick-borne encephalitis virus
LEKTKADLS

SEQ ID NO: 190660 - protein, 9 aa, Tick-borne encephalitis virus
EKTKADLST

SEQ ID NO: 190661 - protein, 9 aa, Tick-borne encephalitis virus
KTKADLSTV

SEQ ID NO: 190662 - protein, 9 aa, Tick-borne encephalitis virus
TKADLSTVL

SEQ ID NO: 190663 - protein, 9 aa, Tick-borne encephalitis virus
KADLSTVLW

SEQ ID NO: 190664 - protein, 9 aa, Tick-borne encephalitis virus
ADLSTVLWS

SEQ ID NO: 190665 - protein, 9 aa, Tick-borne encephalitis virus
ELRSWEEWT

SEQ ID NO: 190666 - protein, 9 aa, Tick-borne encephalitis virus
LRSWEEWTN

SEQ ID NO: 190667 - protein, 9 aa, Tick-borne encephalitis virus
RSWEEWTNI

SEQ ID NO: 190668 - protein, 9 aa, Tick-borne encephalitis virus
SWEEWTNID

SEQ ID NO: 190669 - protein, 9 aa, Tick-borne encephalitis virus
WEEWTNIDI

SEQ ID NO: 190670 - protein, 9 aa, Tick-borne encephalitis virus
EEWTNIDIQ

SEQ ID NO: 190671 - protein, 9 aa, Tick-borne encephalitis virus
EWTNIDIQP

SEQ ID NO: 190672 - protein, 9 aa, Tick-borne encephalitis virus
WTNIDIQPA

SEQ ID NO: 190673 - protein, 9 aa, Tick-borne encephalitis virus
TNIDIQPAR

SEQ ID NO: 190674 - protein, 9 aa, Tick-borne encephalitis virus
NIDIQPARS

SEQ ID NO: 190675 - protein, 9 aa, Tick-borne encephalitis virus
IDIQPARSW

SEQ ID NO: 190676 - protein, 9 aa, Tick-borne encephalitis virus
DIQPARSWG

SEQ ID NO: 190677 - protein, 9 aa, Tick-borne encephalitis virus
IQPARSWGT

SEQ ID NO: 190678 - protein, 9 aa, Tick-borne encephalitis virus
QPARSWGTY

SEQ ID NO: 190679 - protein, 9 aa, Tick-borne encephalitis virus
PARSWGTYV

SEQ ID NO: 190680 - protein, 9 aa, Tick-borne encephalitis virus
ARSWGTYVL

SEQ ID NO: 190681 - protein, 9 aa, Tick-borne encephalitis virus
RSWGTYVLV

SEQ ID NO: 190682 - protein, 9 aa, Tick-borne encephalitis virus
SWGTYVLVV

SEQ ID NO: 190683 - protein, 9 aa, Tick-borne encephalitis virus
WGTYVLVVS

SEQ ID NO: 190684 - protein, 9 aa, Tick-borne encephalitis virus
GTYVLVVSL

SEQ ID NO: 190685 - protein, 9 aa, Tick-borne encephalitis virus
TYVLVVSLF

SEQ ID NO: 190686 - protein, 9 aa, Tick-borne encephalitis virus
YVLVVSLFT

SEQ ID NO: 190687 - protein, 9 aa, Tick-borne encephalitis virus
VLVVSLFTP

SEQ ID NO: 190688 - protein, 9 aa, Tick-borne encephalitis virus
LVVSLFTPY

SEQ ID NO: 190689 - protein, 9 aa, Tick-borne encephalitis virus
VVSLFTPYI

SEQ ID NO: 190690 - protein, 9 aa, Tick-borne encephalitis virus
VSLFTPYII

SEQ ID NO: 190691 - protein, 9 aa, Tick-borne encephalitis virus
SLFTPYIIH

SEQ ID NO: 190692 - protein, 9 aa, Tick-borne encephalitis virus
LFTPYIIHQ

SEQ ID NO: 190693 - protein, 9 aa, Tick-borne encephalitis virus
FTPYIIHQL

SEQ ID NO: 190694 - protein, 9 aa, Tick-borne encephalitis virus
TPYIIHQLQ

SEQ ID NO: 190695 - protein, 9 aa, Tick-borne encephalitis virus
PYIIHQLQT

SEQ ID NO: 190696 - protein, 9 aa, Tick-borne encephalitis virus
YIIHQLQTK

SEQ ID NO: 190697 - protein, 9 aa, Tick-borne encephalitis virus
IIHQLQTKI

SEQ ID NO: 190698 - protein, 9 aa, Tick-borne encephalitis virus
IHQLQTKIQ

SEQ ID NO: 190699 - protein, 9 aa, Tick-borne encephalitis virus
HQLQTKIQQ

SEQ ID NO: 190700 - protein, 9 aa, Tick-borne encephalitis virus
QLQTKIQQL

SEQ ID NO: 190701 - protein, 9 aa, Tick-borne encephalitis virus
LQTKIQQLV

SEQ ID NO: 190702 - protein, 9 aa, Tick-borne encephalitis virus
QTKIQQLVN

SEQ ID NO: 190703 - protein, 9 aa, Tick-borne encephalitis virus
TKIQQLVNS

SEQ ID NO: 190704 - protein, 9 aa, Tick-borne encephalitis virus
KIQQLVNSA

SEQ ID NO: 190705 - protein, 9 aa, Tick-borne encephalitis virus
IQQLVNSAV

SEQ ID NO: 190706 - protein, 9 aa, Tick-borne encephalitis virus
QQLVNSAVA

SEQ ID NO: 190707 - protein, 9 aa, Tick-borne encephalitis virus
QLVNSAVAT

SEQ ID NO: 190708 - protein, 9 aa, Tick-borne encephalitis virus
LVNSAVATG

SEQ ID NO: 190709 - protein, 9 aa, Tick-borne encephalitis virus
VNSAVATGA

SEQ ID NO: 190710 - protein, 9 aa, Tick-borne encephalitis virus
NSAVATGAQ

SEQ ID NO: 190711 - protein, 9 aa, Tick-borne encephalitis virus
SAVATGAQA

SEQ ID NO: 190712 - protein, 9 aa, Tick-borne encephalitis virus
AVATGAQAM

SEQ ID NO: 190713 - protein, 9 aa, Tick-borne encephalitis virus
VATGAQAMR

SEQ ID NO: 190714 - protein, 9 aa, Tick-borne encephalitis virus
ATGAQAMRD

SEQ ID NO: 190715 - protein, 9 aa, Tick-borne encephalitis virus
TGAQAMRDL

SEQ ID NO: 190716 - protein, 9 aa, Tick-borne encephalitis virus
GAQAMRDLG

SEQ ID NO: 190717 - protein, 9 aa, Tick-borne encephalitis virus
AQAMRDLGG

SEQ ID NO: 190718 - protein, 9 aa, Tick-borne encephalitis virus
QAMRDLGGG

SEQ ID NO: 190719 - protein, 9 aa, Tick-borne encephalitis virus
AMRDLGGGA

SEQ ID NO: 190720 - protein, 9 aa, Tick-borne encephalitis virus
MRDLGGGAP

SEQ ID NO: 190721 - protein, 9 aa, Tick-borne encephalitis virus
RDLGGGAPF

SEQ ID NO: 190722 - protein, 9 aa, Tick-borne encephalitis virus
DLGGGAPFF

SEQ ID NO: 190723 - protein, 9 aa, Tick-borne encephalitis virus
LGGGAPFFG

SEQ ID NO: 190724 - protein, 9 aa, Tick-borne encephalitis virus
GGGAPFFGV

SEQ ID NO: 190725 - protein, 9 aa, Tick-borne encephalitis virus
GGAPFFGVA

SEQ ID NO: 190726 - protein, 9 aa, Tick-borne encephalitis virus
GAPFFGVAG

SEQ ID NO: 190727 - protein, 9 aa, Tick-borne encephalitis virus
APFFGVAGH

SEQ ID NO: 190728 - protein, 9 aa, Tick-borne encephalitis virus
PFFGVAGHV

SEQ ID NO: 190729 - protein, 9 aa, Tick-borne encephalitis virus
FFGVAGHVM

SEQ ID NO: 190730 - protein, 9 aa, Tick-borne encephalitis virus
GVAGHVMAL

SEQ ID NO: 190731 - protein, 9 aa, Tick-borne encephalitis virus
VAGHVMALG

SEQ ID NO: 190732 - protein, 9 aa, Tick-borne encephalitis virus
AGHVMALGV

SEQ ID NO: 190733 - protein, 9 aa, Tick-borne encephalitis virus
GHVMALGVV

SEQ ID NO: 190734 - protein, 9 aa, Tick-borne encephalitis virus
HVMALGVVS

SEQ ID NO: 190735 - protein, 9 aa, Tick-borne encephalitis virus
VMALGVVSL

SEQ ID NO: 190736 - protein, 9 aa, Tick-borne encephalitis virus
MALGVVSLV

SEQ ID NO: 190737 - protein, 9 aa, Tick-borne encephalitis virus
ALGVVSLVG

SEQ ID NO: 190738 - protein, 9 aa, Tick-borne encephalitis virus
LGVVSLVGA

SEQ ID NO: 190739 - protein, 9 aa, Tick-borne encephalitis virus
GVVSLVGAT

SEQ ID NO: 190740 - protein, 9 aa, Tick-borne encephalitis virus
VVSLVGATP

SEQ ID NO: 190741 - protein, 9 aa, Tick-borne encephalitis virus
VSLVGATPT

SEQ ID NO: 190742 - protein, 9 aa, Tick-borne encephalitis virus
SLVGATPTS

SEQ ID NO: 190743 - protein, 9 aa, Tick-borne encephalitis virus
LVGATPTSL

SEQ ID NO: 190744 - protein, 9 aa, Tick-borne encephalitis virus
VGATPTSLV

SEQ ID NO: 190745 - protein, 9 aa, Tick-borne encephalitis virus
GATPTSLVV

SEQ ID NO: 190746 - protein, 9 aa, Tick-borne encephalitis virus
ATPTSLVVG

SEQ ID NO: 190747 - protein, 9 aa, Tick-borne encephalitis virus
TPTSLVVGV

SEQ ID NO: 190748 - protein, 9 aa, Tick-borne encephalitis virus
PTSLVVGVG

SEQ ID NO: 190749 - protein, 9 aa, Tick-borne encephalitis virus
TSLVVGVGL

SEQ ID NO: 190750 - protein, 9 aa, Tick-borne encephalitis virus
SLVVGVGLA

SEQ ID NO: 190751 - protein, 9 aa, Tick-borne encephalitis virus
LVVGVGLAA

SEQ ID NO: 190752 - protein, 9 aa, Tick-borne encephalitis virus
VVGVGLAAF

SEQ ID NO: 190753 - protein, 9 aa, Tick-borne encephalitis virus
VGVGLAAFH

SEQ ID NO: 190754 - protein, 9 aa, Tick-borne encephalitis virus
GVGLAAFHL

SEQ ID NO: 190755 - protein, 9 aa, Tick-borne encephalitis virus
VGLAAFHLA

SEQ ID NO: 190756 - protein, 9 aa, Tick-borne encephalitis virus
GLAAFHLAI

SEQ ID NO: 190757 - protein, 9 aa, Tick-borne encephalitis virus
LAAFHLAIV

SEQ ID NO: 190758 - protein, 9 aa, Tick-borne encephalitis virus
AAFHLAIVV

SEQ ID NO: 190759 - protein, 9 aa, Tick-borne encephalitis virus
AFHLAIVVS

SEQ ID NO: 190760 - protein, 9 aa, Tick-borne encephalitis virus
FHLAIVVSG

SEQ ID NO: 190761 - protein, 9 aa, Tick-borne encephalitis virus
HLAIVVSGL

SEQ ID NO: 190762 - protein, 9 aa, Tick-borne encephalitis virus
LAIVVSGLE

SEQ ID NO: 190763 - protein, 9 aa, Tick-borne encephalitis virus
AIVVSGLEA

SEQ ID NO: 190764 - protein, 9 aa, Tick-borne encephalitis virus
IVVSGLEAE

SEQ ID NO: 190765 - protein, 9 aa, Tick-borne encephalitis virus
VVSGLEAEL

SEQ ID NO: 190766 - protein, 9 aa, Tick-borne encephalitis virus
VSGLEAELT

SEQ ID NO: 190767 - protein, 9 aa, Tick-borne encephalitis virus
SGLEAELTQ

SEQ ID NO: 190768 - protein, 9 aa, Tick-borne encephalitis virus
GLEAELTQR

SEQ ID NO: 190769 - protein, 9 aa, Tick-borne encephalitis virus
LEAELTQRA

SEQ ID NO: 190770 - protein, 9 aa, Tick-borne encephalitis virus
EAELTQRAH

SEQ ID NO: 190771 - protein, 9 aa, Tick-borne encephalitis virus
AELTQRAHK

SEQ ID NO: 190772 - protein, 9 aa, Tick-borne encephalitis virus
ELTQRAHKV

SEQ ID NO: 190773 - protein, 9 aa, Tick-borne encephalitis virus
LTQRAHKVF

SEQ ID NO: 190774 - protein, 9 aa, Tick-borne encephalitis virus
TQRAHKVFF

SEQ ID NO: 190775 - protein, 9 aa, Tick-borne encephalitis virus
QRAHKVFFS

SEQ ID NO: 190776 - protein, 9 aa, Tick-borne encephalitis virus
RAHKVFFSA

SEQ ID NO: 190777 - protein, 9 aa, Tick-borne encephalitis virus
AHKVFFSAM

SEQ ID NO: 190778 - protein, 9 aa, Tick-borne encephalitis virus
HKVFFSAMV

SEQ ID NO: 190779 - protein, 9 aa, Tick-borne encephalitis virus
KVFFSAMVR

SEQ ID NO: 190780 - protein, 9 aa, Tick-borne encephalitis virus
VFFSAMVRN

SEQ ID NO: 190781 - protein, 9 aa, Tick-borne encephalitis virus
FFSAMVRNP

SEQ ID NO: 190782 - protein, 9 aa, Tick-borne encephalitis virus
FSAMVRNPM

SEQ ID NO: 190783 - protein, 9 aa, Tick-borne encephalitis virus
SAMVRNPMV

SEQ ID NO: 190784 - protein, 9 aa, Tick-borne encephalitis virus
AMVRNPMVD

SEQ ID NO: 190785 - protein, 9 aa, Tick-borne encephalitis virus
MVRNPMVDG

SEQ ID NO: 190786 - protein, 9 aa, Tick-borne encephalitis virus
VRNPMVDGD

SEQ ID NO: 190787 - protein, 9 aa, Tick-borne encephalitis virus
RNPMVDGDV

SEQ ID NO: 190788 - protein, 9 aa, Tick-borne encephalitis virus
NPMVDGDVI

SEQ ID NO: 190789 - protein, 9 aa, Tick-borne encephalitis virus
PMVDGDVIN

SEQ ID NO: 190790 - protein, 9 aa, Tick-borne encephalitis virus
MVDGDVINP

SEQ ID NO: 190791 - protein, 9 aa, Tick-borne encephalitis virus
VDGDVINPF

SEQ ID NO: 190792 - protein, 9 aa, Tick-borne encephalitis virus
DGDVINPFG

SEQ ID NO: 190793 - protein, 9 aa, Tick-borne encephalitis virus
GDVINPFGE

SEQ ID NO: 190794 - protein, 9 aa, Tick-borne encephalitis virus
DVINPFGEG

SEQ ID NO: 190795 - protein, 9 aa, Tick-borne encephalitis virus
VINPFGEGE

SEQ ID NO: 190796 - protein, 9 aa, Tick-borne encephalitis virus
INPFGEGEA

SEQ ID NO: 190797 - protein, 9 aa, Tick-borne encephalitis virus
NPFGEGEAK

SEQ ID NO: 190798 - protein, 9 aa, Tick-borne encephalitis virus
PFGEGEAKP

SEQ ID NO: 190799 - protein, 9 aa, Tick-borne encephalitis virus
FGEGEAKPA

SEQ ID NO: 190800 - protein, 9 aa, Tick-borne encephalitis virus
GEGEAKPAL

SEQ ID NO: 190801 - protein, 9 aa, Tick-borne encephalitis virus
EGEAKPALY

SEQ ID NO: 190802 - protein, 9 aa, Tick-borne encephalitis virus
GEAKPALYE

SEQ ID NO: 190803 - protein, 9 aa, Tick-borne encephalitis virus
EAKPALYER

SEQ ID NO: 190804 - protein, 9 aa, Tick-borne encephalitis virus
AKPALYERK

SEQ ID NO: 190805 - protein, 9 aa, Tick-borne encephalitis virus
KPALYERKM

SEQ ID NO: 190806 - protein, 9 aa, Tick-borne encephalitis virus
PALYERKMS

SEQ ID NO: 190807 - protein, 9 aa, Tick-borne encephalitis virus
ALYERKMSL

SEQ ID NO: 190808 - protein, 9 aa, Tick-borne encephalitis virus
LYERKMSLV

SEQ ID NO: 190809 - protein, 9 aa, Tick-borne encephalitis virus
YERKMSLVL

SEQ ID NO: 190810 - protein, 9 aa, Tick-borne encephalitis virus
ERKMSLVLA

SEQ ID NO: 190811 - protein, 9 aa, Tick-borne encephalitis virus
RKMSLVLAI

SEQ ID NO: 190812 - protein, 9 aa, Tick-borne encephalitis virus
MSLVLAIVL

SEQ ID NO: 190813 - protein, 9 aa, Tick-borne encephalitis virus
SLVLAIVLC

SEQ ID NO: 190814 - protein, 9 aa, Tick-borne encephalitis virus
LVLAIVLCL

SEQ ID NO: 190815 - protein, 9 aa, Tick-borne encephalitis virus
VLCLMSVVM

SEQ ID NO: 190816 - protein, 9 aa, Tick-borne encephalitis virus
LCLMSVVMN

SEQ ID NO: 190817 - protein, 9 aa, Tick-borne encephalitis virus
CLMSVVMNR

SEQ ID NO: 190818 - protein, 9 aa, Tick-borne encephalitis virus
LMSVVMNRT

SEQ ID NO: 190819 - protein, 9 aa, Tick-borne encephalitis virus
MSVVMNRTV

SEQ ID NO: 190820 - protein, 9 aa, Tick-borne encephalitis virus
SVVMNRTVP

SEQ ID NO: 190821 - protein, 9 aa, Tick-borne encephalitis virus
VVMNRTVPS

SEQ ID NO: 190822 - protein, 9 aa, Tick-borne encephalitis virus
VMNRTVPSI

SEQ ID NO: 190823 - protein, 9 aa, Tick-borne encephalitis virus
MNRTVPSIT

SEQ ID NO: 190824 - protein, 9 aa, Tick-borne encephalitis virus
NRTVPSITE

SEQ ID NO: 190825 - protein, 9 aa, Tick-borne encephalitis virus
RTVPSITEA

SEQ ID NO: 190826 - protein, 9 aa, Tick-borne encephalitis virus
TVPSITEAS

SEQ ID NO: 190827 - protein, 9 aa, Tick-borne encephalitis virus
VPSITEASA

SEQ ID NO: 190828 - protein, 9 aa, Tick-borne encephalitis virus
PSITEASAV

SEQ ID NO: 190829 - protein, 9 aa, Tick-borne encephalitis virus
SITEASAVG

SEQ ID NO: 190830 - protein, 9 aa, Tick-borne encephalitis virus
ITEASAVGL

SEQ ID NO: 190831 - protein, 9 aa, Tick-borne encephalitis virus
TEASAVGLA

SEQ ID NO: 190832 - protein, 9 aa, Tick-borne encephalitis virus
EASAVGLAA

SEQ ID NO: 190833 - protein, 9 aa, Tick-borne encephalitis virus
ASAVGLAAA

SEQ ID NO: 190834 - protein, 9 aa, Tick-borne encephalitis virus
SAVGLAAAG

SEQ ID NO: 190835 - protein, 9 aa, Tick-borne encephalitis virus
AVGLAAAGQ

SEQ ID NO: 190836 - protein, 9 aa, Tick-borne encephalitis virus
VGLAAAGQL

SEQ ID NO: 190837 - protein, 9 aa, Tick-borne encephalitis virus
GLAAAGQLL

SEQ ID NO: 190838 - protein, 9 aa, Tick-borne encephalitis virus
LAAAGQLLR

SEQ ID NO: 190839 - protein, 9 aa, Tick-borne encephalitis virus
AAAGQLLRP

SEQ ID NO: 190840 - protein, 9 aa, Tick-borne encephalitis virus
AAGQLLRPE

SEQ ID NO: 190841 - protein, 9 aa, Tick-borne encephalitis virus
GQLLRPEAD

SEQ ID NO: 190842 - protein, 9 aa, Tick-borne encephalitis virus
QLLRPEADT

SEQ ID NO: 190843 - protein, 9 aa, Tick-borne encephalitis virus
LLRPEADTL

SEQ ID NO: 190844 - protein, 9 aa, Tick-borne encephalitis virus
LRPEADTLW

SEQ ID NO: 190845 - protein, 9 aa, Tick-borne encephalitis virus
RPEADTLWT

SEQ ID NO: 190846 - protein, 9 aa, Tick-borne encephalitis virus
PEADTLWTM

SEQ ID NO: 190847 - protein, 9 aa, Tick-borne encephalitis virus
EADTLWTMP

SEQ ID NO: 190848 - protein, 9 aa, Tick-borne encephalitis virus
ADTLWTMPV

SEQ ID NO: 190849 - protein, 9 aa, Tick-borne encephalitis virus
DTLWTMPVA

SEQ ID NO: 190850 - protein, 9 aa, Tick-borne encephalitis virus
TLWTMPVAC

SEQ ID NO: 190851 - protein, 9 aa, Tick-borne encephalitis virus
LWTMPVACG

SEQ ID NO: 190852 - protein, 9 aa, Tick-borne encephalitis virus
WTMPVACGL

SEQ ID NO: 190853 - protein, 9 aa, Tick-borne encephalitis virus
TMPVACGLS

SEQ ID NO: 190854 - protein, 9 aa, Tick-borne encephalitis virus
MPVACGLSG

SEQ ID NO: 190855 - protein, 9 aa, Tick-borne encephalitis virus
PVACGLSGV

SEQ ID NO: 190856 - protein, 9 aa, Tick-borne encephalitis virus
VACGLSGVV

SEQ ID NO: 190857 - protein, 9 aa, Tick-borne encephalitis virus
ACGLSGVVR

SEQ ID NO: 190858 - protein, 9 aa, Tick-borne encephalitis virus
CGLSGVVRG

SEQ ID NO: 190859 - protein, 9 aa, Tick-borne encephalitis virus
GLSGVVRGS

SEQ ID NO: 190860 - protein, 9 aa, Tick-borne encephalitis virus
LSGVVRGSL

SEQ ID NO: 190861 - protein, 9 aa, Tick-borne encephalitis virus
SGVVRGSLW

SEQ ID NO: 190862 - protein, 9 aa, Tick-borne encephalitis virus
GVVRGSLWG

SEQ ID NO: 190863 - protein, 9 aa, Tick-borne encephalitis virus
VVRGSLWGF

SEQ ID NO: 190864 - protein, 9 aa, Tick-borne encephalitis virus
VRGSLWGFL

SEQ ID NO: 190865 - protein, 9 aa, Tick-borne encephalitis virus
RGSLWGFLP

SEQ ID NO: 190866 - protein, 9 aa, Tick-borne encephalitis virus
GSLWGFLPL

SEQ ID NO: 190867 - protein, 9 aa, Tick-borne encephalitis virus
SLWGFLPLG

SEQ ID NO: 190868 - protein, 9 aa, Tick-borne encephalitis virus
LWGFLPLGH

SEQ ID NO: 190869 - protein, 9 aa, Tick-borne encephalitis virus
WGFLPLGHR

SEQ ID NO: 190870 - protein, 9 aa, Tick-borne encephalitis virus
GFLPLGHRL

SEQ ID NO: 190871 - protein, 9 aa, Tick-borne encephalitis virus
FLPLGHRLW

SEQ ID NO: 190872 - protein, 9 aa, Tick-borne encephalitis virus
LPLGHRLWL

SEQ ID NO: 190873 - protein, 9 aa, Tick-borne encephalitis virus
PLGHRLWLR

SEQ ID NO: 190874 - protein, 9 aa, Tick-borne encephalitis virus
LGHRLWLRA

SEQ ID NO: 190875 - protein, 9 aa, Tick-borne encephalitis virus
GHRLWLRAS

SEQ ID NO: 190876 - protein, 9 aa, Tick-borne encephalitis virus
HRLWLRASG

SEQ ID NO: 190877 - protein, 9 aa, Tick-borne encephalitis virus
RLWLRASGS

SEQ ID NO: 190878 - protein, 9 aa, Tick-borne encephalitis virus
LWLRASGSR

SEQ ID NO: 190879 - protein, 9 aa, Tick-borne encephalitis virus
WLRASGSRR

SEQ ID NO: 190880 - protein, 9 aa, Tick-borne encephalitis virus
LRASGSRRG

SEQ ID NO: 190881 - protein, 9 aa, Tick-borne encephalitis virus
RASGSRRGG

SEQ ID NO: 190882 - protein, 9 aa, Tick-borne encephalitis virus
ASGSRRGGS

SEQ ID NO: 190883 - protein, 9 aa, Tick-borne encephalitis virus
SGSRRGGSE

SEQ ID NO: 190884 - protein, 9 aa, Tick-borne encephalitis virus
GSRRGGSEG

SEQ ID NO: 190885 - protein, 9 aa, Tick-borne encephalitis virus
SRRGGSEGD

SEQ ID NO: 190886 - protein, 9 aa, Tick-borne encephalitis virus
RRGGSEGDT

SEQ ID NO: 190887 - protein, 9 aa, Tick-borne encephalitis virus
RGGSEGDTL

SEQ ID NO: 190888 - protein, 9 aa, Tick-borne encephalitis virus
GGSEGDTLG

SEQ ID NO: 190889 - protein, 9 aa, Tick-borne encephalitis virus
GSEGDTLGD

SEQ ID NO: 190890 - protein, 9 aa, Tick-borne encephalitis virus
SEGDTLGDL

SEQ ID NO: 190891 - protein, 9 aa, Tick-borne encephalitis virus
EGDTLGDLW

SEQ ID NO: 190892 - protein, 9 aa, Tick-borne encephalitis virus
GDTLGDLWK

SEQ ID NO: 190893 - protein, 9 aa, Tick-borne encephalitis virus
DTLGDLWKR

SEQ ID NO: 190894 - protein, 9 aa, Tick-borne encephalitis virus
TLGDLWKRK

SEQ ID NO: 190895 - protein, 9 aa, Tick-borne encephalitis virus
LGDLWKRKL

SEQ ID NO: 190896 - protein, 9 aa, Tick-borne encephalitis virus
GDLWKRKLN

SEQ ID NO: 190897 - protein, 9 aa, Tick-borne encephalitis virus
LNGCTKEEF

SEQ ID NO: 190898 - protein, 9 aa, Tick-borne encephalitis virus
NGCTKEEFF

SEQ ID NO: 190899 - protein, 9 aa, Tick-borne encephalitis virus
GCTKEEFFA

SEQ ID NO: 190900 - protein, 9 aa, Tick-borne encephalitis virus
CTKEEFFAY

SEQ ID NO: 190901 - protein, 9 aa, Tick-borne encephalitis virus
TKEEFFAYR

SEQ ID NO: 190902 - protein, 9 aa, Tick-borne encephalitis virus
KEEFFAYRR

SEQ ID NO: 190903 - protein, 9 aa, Tick-borne encephalitis virus
EEFFAYRRT

SEQ ID NO: 190904 - protein, 9 aa, Tick-borne encephalitis virus
EFFAYRRTG

SEQ ID NO: 190905 - protein, 9 aa, Tick-borne encephalitis virus
FFAYRRTGI

SEQ ID NO: 190906 - protein, 9 aa, Tick-borne encephalitis virus
FAYRRTGIL

SEQ ID NO: 190907 - protein, 9 aa, Tick-borne encephalitis virus
AYRRTGILE

SEQ ID NO: 190908 - protein, 9 aa, Tick-borne encephalitis virus
YRRTGILET

SEQ ID NO: 190909 - protein, 9 aa, Tick-borne encephalitis virus
RRTGILETE

SEQ ID NO: 190910 - protein, 9 aa, Tick-borne encephalitis virus
RTGILETER

SEQ ID NO: 190911 - protein, 9 aa, Tick-borne encephalitis virus
TGILETERD

SEQ ID NO: 190912 - protein, 9 aa, Tick-borne encephalitis virus
GILETERDK

SEQ ID NO: 190913 - protein, 9 aa, Tick-borne encephalitis virus
ILETERDKA

SEQ ID NO: 190914 - protein, 9 aa, Tick-borne encephalitis virus
LETERDKAR

SEQ ID NO: 190915 - protein, 9 aa, Tick-borne encephalitis virus
ETERDKARE

SEQ ID NO: 190916 - protein, 9 aa, Tick-borne encephalitis virus
TERDKAREL

SEQ ID NO: 190917 - protein, 9 aa, Tick-borne encephalitis virus
ERDKARELL

SEQ ID NO: 190918 - protein, 9 aa, Tick-borne encephalitis virus
RDKARELLR

SEQ ID NO: 190919 - protein, 9 aa, Tick-borne encephalitis virus
DKARELLRR

SEQ ID NO: 190920 - protein, 9 aa, Tick-borne encephalitis virus
KARELLRRG

SEQ ID NO: 190921 - protein, 9 aa, Tick-borne encephalitis virus
ARELLRRGE

SEQ ID NO: 190922 - protein, 9 aa, Tick-borne encephalitis virus
RELLRRGET

SEQ ID NO: 190923 - protein, 9 aa, Tick-borne encephalitis virus
ELLRRGETN

SEQ ID NO: 190924 - protein, 9 aa, Tick-borne encephalitis virus
RGETNMGLA

SEQ ID NO: 190925 - protein, 9 aa, Tick-borne encephalitis virus
GETNMGLAV

SEQ ID NO: 190926 - protein, 9 aa, Tick-borne encephalitis virus
ETNMGLAVS

SEQ ID NO: 190927 - protein, 9 aa, Tick-borne encephalitis virus
TNMGLAVSR

SEQ ID NO: 190928 - protein, 9 aa, Tick-borne encephalitis virus
NMGLAVSRG

SEQ ID NO: 190929 - protein, 9 aa, Tick-borne encephalitis virus
MGLAVSRGT

SEQ ID NO: 190930 - protein, 9 aa, Tick-borne encephalitis virus
GLAVSRGTA

SEQ ID NO: 190931 - protein, 9 aa, Tick-borne encephalitis virus
LAVSRGTAK

SEQ ID NO: 190932 - protein, 9 aa, Tick-borne encephalitis virus
AVSRGTAKL

SEQ ID NO: 190933 - protein, 9 aa, Tick-borne encephalitis virus
VSRGTAKLA

SEQ ID NO: 190934 - protein, 9 aa, Tick-borne encephalitis virus
SRGTAKLAW

SEQ ID NO: 190935 - protein, 9 aa, Tick-borne encephalitis virus
RGTAKLAWL

SEQ ID NO: 190936 - protein, 9 aa, Tick-borne encephalitis virus
GTAKLAWLE

SEQ ID NO: 190937 - protein, 9 aa, Tick-borne encephalitis virus
TAKLAWLEE

SEQ ID NO: 190938 - protein, 9 aa, Tick-borne encephalitis virus
AKLAWLEER

SEQ ID NO: 190939 - protein, 9 aa, Tick-borne encephalitis virus
KLAWLEERG

SEQ ID NO: 190940 - protein, 9 aa, Tick-borne encephalitis virus
LAWLEERGY

SEQ ID NO: 190941 - protein, 9 aa, Tick-borne encephalitis virus
AWLEERGYA

SEQ ID NO: 190942 - protein, 9 aa, Tick-borne encephalitis virus
WLEERGYAT

SEQ ID NO: 190943 - protein, 9 aa, Tick-borne encephalitis virus
LEERGYATL

SEQ ID NO: 190944 - protein, 9 aa, Tick-borne encephalitis virus
EERGYATLK

SEQ ID NO: 190945 - protein, 9 aa, Tick-borne encephalitis virus
ERGYATLKG

SEQ ID NO: 190946 - protein, 9 aa, Tick-borne encephalitis virus
RGYATLKGE

SEQ ID NO: 190947 - protein, 9 aa, Tick-borne encephalitis virus
GYATLKGEV

SEQ ID NO: 190948 - protein, 9 aa, Tick-borne encephalitis virus
YATLKGEVV

SEQ ID NO: 190949 - protein, 9 aa, Tick-borne encephalitis virus
ATLKGEVVD

SEQ ID NO: 190950 - protein, 9 aa, Tick-borne encephalitis virus
TLKGEVVDL

SEQ ID NO: 190951 - protein, 9 aa, Tick-borne encephalitis virus
LKGEVVDLG

SEQ ID NO: 190952 - protein, 9 aa, Tick-borne encephalitis virus
KGEVVDLGC

SEQ ID NO: 190953 - protein, 9 aa, Tick-borne encephalitis virus
GEVVDLGCG

SEQ ID NO: 190954 - protein, 9 aa, Tick-borne encephalitis virus
EVVDLGCGR

SEQ ID NO: 190955 - protein, 9 aa, Tick-borne encephalitis virus
VVDLGCGRG

SEQ ID NO: 190956 - protein, 9 aa, Tick-borne encephalitis virus
VDLGCGRGG

SEQ ID NO: 190957 - protein, 9 aa, Tick-borne encephalitis virus
DLGCGRGGW

SEQ ID NO: 190958 - protein, 9 aa, Tick-borne encephalitis virus
LGCGRGGWS

SEQ ID NO: 190959 - protein, 9 aa, Tick-borne encephalitis virus
GCGRGGWSY

SEQ ID NO: 190960 - protein, 9 aa, Tick-borne encephalitis virus
CGRGGWSYY

SEQ ID NO: 190961 - protein, 9 aa, Tick-borne encephalitis virus
GRGGWSYYA

SEQ ID NO: 190962 - protein, 9 aa, Tick-borne encephalitis virus
RGGWSYYAA

SEQ ID NO: 190963 - protein, 9 aa, Tick-borne encephalitis virus
GGWSYYAAS

SEQ ID NO: 190964 - protein, 9 aa, Tick-borne encephalitis virus
GWSYYAASR

SEQ ID NO: 190965 - protein, 9 aa, Tick-borne encephalitis virus
WSYYAASRP

SEQ ID NO: 190966 - protein, 9 aa, Tick-borne encephalitis virus
SYYAASRPA

SEQ ID NO: 190967 - protein, 9 aa, Tick-borne encephalitis virus
YYAASRPAV

SEQ ID NO: 190968 - protein, 9 aa, Tick-borne encephalitis virus
YAASRPAVM

SEQ ID NO: 190969 - protein, 9 aa, Tick-borne encephalitis virus
AASRPAVMS

SEQ ID NO: 190970 - protein, 9 aa, Tick-borne encephalitis virus
ASRPAVMSV

SEQ ID NO: 190971 - protein, 9 aa, Tick-borne encephalitis virus
SRPAVMSVK

SEQ ID NO: 190972 - protein, 9 aa, Tick-borne encephalitis virus
RPAVMSVKA

SEQ ID NO: 190973 - protein, 9 aa, Tick-borne encephalitis virus
PAVMSVKAY

SEQ ID NO: 190974 - protein, 9 aa, Tick-borne encephalitis virus
AVMSVKAYT

SEQ ID NO: 190975 - protein, 9 aa, Tick-borne encephalitis virus
VMSVKAYTI

SEQ ID NO: 190976 - protein, 9 aa, Tick-borne encephalitis virus
MSVKAYTIG

SEQ ID NO: 190977 - protein, 9 aa, Tick-borne encephalitis virus
SVKAYTIGG

SEQ ID NO: 190978 - protein, 9 aa, Tick-borne encephalitis virus
VKAYTIGGK

SEQ ID NO: 190979 - protein, 9 aa, Tick-borne encephalitis virus
KAYTIGGKG

SEQ ID NO: 190980 - protein, 9 aa, Tick-borne encephalitis virus
AYTIGGKGH

SEQ ID NO: 190981 - protein, 9 aa, Tick-borne encephalitis virus
YTIGGKGHE

SEQ ID NO: 190982 - protein, 9 aa, Tick-borne encephalitis virus
TIGGKGHET

SEQ ID NO: 190983 - protein, 9 aa, Tick-borne encephalitis virus
IGGKGHETP

SEQ ID NO: 190984 - protein, 9 aa, Tick-borne encephalitis virus
GGKGHETPK

SEQ ID NO: 190985 - protein, 9 aa, Tick-borne encephalitis virus
GKGHETPKM

SEQ ID NO: 190986 - protein, 9 aa, Tick-borne encephalitis virus
KGHETPKMV

SEQ ID NO: 190987 - protein, 9 aa, Tick-borne encephalitis virus
GHETPKMVT

SEQ ID NO: 190988 - protein, 9 aa, Tick-borne encephalitis virus
HETPKMVTS

SEQ ID NO: 190989 - protein, 9 aa, Tick-borne encephalitis virus
ETPKMVTSL

SEQ ID NO: 190990 - protein, 9 aa, Tick-borne encephalitis virus
TPKMVTSLG

SEQ ID NO: 190991 - protein, 9 aa, Tick-borne encephalitis virus
PKMVTSLGW

SEQ ID NO: 190992 - protein, 9 aa, Tick-borne encephalitis virus
KMVTSLGWN

SEQ ID NO: 190993 - protein, 9 aa, Tick-borne encephalitis virus
MVTSLGWNL

SEQ ID NO: 190994 - protein, 9 aa, Tick-borne encephalitis virus
VTSLGWNLI

SEQ ID NO: 190995 - protein, 9 aa, Tick-borne encephalitis virus
TSLGWNLIK

SEQ ID NO: 190996 - protein, 9 aa, Tick-borne encephalitis virus
SLGWNLIKF

SEQ ID NO: 190997 - protein, 9 aa, Tick-borne encephalitis virus
LGWNLIKFR

SEQ ID NO: 190998 - protein, 9 aa, Tick-borne encephalitis virus
GWNLIKFRA

SEQ ID NO: 190999 - protein, 9 aa, Tick-borne encephalitis virus
WNLIKFRAG

SEQ ID NO: 191000 - protein, 9 aa, Tick-borne encephalitis virus
NLIKFRAGM

SEQ ID NO: 191001 - protein, 9 aa, Tick-borne encephalitis virus
LIKFRAGMD

SEQ ID NO: 191002 - protein, 9 aa, Tick-borne encephalitis virus
IKFRAGMDV

SEQ ID NO: 191003 - protein, 9 aa, Tick-borne encephalitis virus
KFRAGMDVF

SEQ ID NO: 191004 - protein, 9 aa, Tick-borne encephalitis virus
FRAGMDVFS

SEQ ID NO: 191005 - protein, 9 aa, Tick-borne encephalitis virus
RAGMDVFSM

SEQ ID NO: 191006 - protein, 9 aa, Tick-borne encephalitis virus
AGMDVFSMQ

SEQ ID NO: 191007 - protein, 9 aa, Tick-borne encephalitis virus
GMDVFSMQP

SEQ ID NO: 191008 - protein, 9 aa, Tick-borne encephalitis virus
MDVFSMQPH

SEQ ID NO: 191009 - protein, 9 aa, Tick-borne encephalitis virus
DVFSMQPHR

SEQ ID NO: 191010 - protein, 9 aa, Tick-borne encephalitis virus
VFSMQPHRA

SEQ ID NO: 191011 - protein, 9 aa, Tick-borne encephalitis virus
FSMQPHRAD

SEQ ID NO: 191012 - protein, 9 aa, Tick-borne encephalitis virus
SMQPHRADT

SEQ ID NO: 191013 - protein, 9 aa, Tick-borne encephalitis virus
MQPHRADTI

SEQ ID NO: 191014 - protein, 9 aa, Tick-borne encephalitis virus
QPHRADTIM

SEQ ID NO: 191015 - protein, 9 aa, Tick-borne encephalitis virus
PHRADTIMC

SEQ ID NO: 191016 - protein, 9 aa, Tick-borne encephalitis virus
HRADTIMCD

SEQ ID NO: 191017 - protein, 9 aa, Tick-borne encephalitis virus
RADTIMCDI

SEQ ID NO: 191018 - protein, 9 aa, Tick-borne encephalitis virus
ADTIMCDIG

SEQ ID NO: 191019 - protein, 9 aa, Tick-borne encephalitis virus
DTIMCDIGE

SEQ ID NO: 191020 - protein, 9 aa, Tick-borne encephalitis virus
TIMCDIGES

SEQ ID NO: 191021 - protein, 9 aa, Tick-borne encephalitis virus
IMCDIGESN

SEQ ID NO: 191022 - protein, 9 aa, Tick-borne encephalitis virus
MCDIGESNP

SEQ ID NO: 191023 - protein, 9 aa, Tick-borne encephalitis virus
CDIGESNPD

SEQ ID NO: 191024 - protein, 9 aa, Tick-borne encephalitis virus
DIGESNPDA

SEQ ID NO: 191025 - protein, 9 aa, Tick-borne encephalitis virus
IGESNPDAV

SEQ ID NO: 191026 - protein, 9 aa, Tick-borne encephalitis virus
GESNPDAVV

SEQ ID NO: 191027 - protein, 9 aa, Tick-borne encephalitis virus
ESNPDAVVE

SEQ ID NO: 191028 - protein, 9 aa, Tick-borne encephalitis virus
SNPDAVVEG

SEQ ID NO: 191029 - protein, 9 aa, Tick-borne encephalitis virus
NPDAVVEGE

SEQ ID NO: 191030 - protein, 9 aa, Tick-borne encephalitis virus
PDAVVEGER

SEQ ID NO: 191031 - protein, 9 aa, Tick-borne encephalitis virus
DAVVEGERT

SEQ ID NO: 191032 - protein, 9 aa, Tick-borne encephalitis virus
AVVEGERTR

SEQ ID NO: 191033 - protein, 9 aa, Tick-borne encephalitis virus
VVEGERTRK

SEQ ID NO: 191034 - protein, 9 aa, Tick-borne encephalitis virus
VEGERTRKV

SEQ ID NO: 191035 - protein, 9 aa, Tick-borne encephalitis virus
EGERTRKVI

SEQ ID NO: 191036 - protein, 9 aa, Tick-borne encephalitis virus
GERTRKVIL

SEQ ID NO: 191037 - protein, 9 aa, Tick-borne encephalitis virus
ERTRKVILL

SEQ ID NO: 191038 - protein, 9 aa, Tick-borne encephalitis virus
RTRKVILLM

SEQ ID NO: 191039 - protein, 9 aa, Tick-borne encephalitis virus
TRKVILLME

SEQ ID NO: 191040 - protein, 9 aa, Tick-borne encephalitis virus
RKVILLMEQ

SEQ ID NO: 191041 - protein, 9 aa, Tick-borne encephalitis virus
KVILLMEQW

SEQ ID NO: 191042 - protein, 9 aa, Tick-borne encephalitis virus
VILLMEQWK

SEQ ID NO: 191043 - protein, 9 aa, Tick-borne encephalitis virus
ILLMEQWKN

SEQ ID NO: 191044 - protein, 9 aa, Tick-borne encephalitis virus
LLMEQWKNR

SEQ ID NO: 191045 - protein, 9 aa, Tick-borne encephalitis virus
LMEQWKNRN

SEQ ID NO: 191046 - protein, 9 aa, Tick-borne encephalitis virus
MEQWKNRNP

SEQ ID NO: 191047 - protein, 9 aa, Tick-borne encephalitis virus
EQWKNRNPT

SEQ ID NO: 191048 - protein, 9 aa, Tick-borne encephalitis virus
QWKNRNPTA

SEQ ID NO: 191049 - protein, 9 aa, Tick-borne encephalitis virus
WKNRNPTAT

SEQ ID NO: 191050 - protein, 9 aa, Tick-borne encephalitis virus
KNRNPTATC

SEQ ID NO: 191051 - protein, 9 aa, Tick-borne encephalitis virus
NRNPTATCV

SEQ ID NO: 191052 - protein, 9 aa, Tick-borne encephalitis virus
RNPTATCVF

SEQ ID NO: 191053 - protein, 9 aa, Tick-borne encephalitis virus
NPTATCVFK

SEQ ID NO: 191054 - protein, 9 aa, Tick-borne encephalitis virus
PTATCVFKV

SEQ ID NO: 191055 - protein, 9 aa, Tick-borne encephalitis virus
TATCVFKVL

SEQ ID NO: 191056 - protein, 9 aa, Tick-borne encephalitis virus
ATCVFKVLA

SEQ ID NO: 191057 - protein, 9 aa, Tick-borne encephalitis virus
TCVFKVLAP

SEQ ID NO: 191058 - protein, 9 aa, Tick-borne encephalitis virus
CVFKVLAPY

SEQ ID NO: 191059 - protein, 9 aa, Tick-borne encephalitis virus
VFKVLAPYR

SEQ ID NO: 191060 - protein, 9 aa, Tick-borne encephalitis virus
FKVLAPYRP

SEQ ID NO: 191061 - protein, 9 aa, Tick-borne encephalitis virus
KVLAPYRPE

SEQ ID NO: 191062 - protein, 9 aa, Tick-borne encephalitis virus
VLAPYRPEV

SEQ ID NO: 191063 - protein, 9 aa, Tick-borne encephalitis virus
LAPYRPEVI

SEQ ID NO: 191064 - protein, 9 aa, Tick-borne encephalitis virus
APYRPEVIE

SEQ ID NO: 191065 - protein, 9 aa, Tick-borne encephalitis virus
PYRPEVIEA

SEQ ID NO: 191066 - protein, 9 aa, Tick-borne encephalitis virus
YRPEVIEAL

SEQ ID NO: 191067 - protein, 9 aa, Tick-borne encephalitis virus
RPEVIEALH

SEQ ID NO: 191068 - protein, 9 aa, Tick-borne encephalitis virus
PEVIEALHR

SEQ ID NO: 191069 - protein, 9 aa, Tick-borne encephalitis virus
EVIEALHRF

SEQ ID NO: 191070 - protein, 9 aa, Tick-borne encephalitis virus
VIEALHRFQ

SEQ ID NO: 191071 - protein, 9 aa, Tick-borne encephalitis virus
IEALHRFQL

SEQ ID NO: 191072 - protein, 9 aa, Tick-borne encephalitis virus
EALHRFQLQ

SEQ ID NO: 191073 - protein, 9 aa, Tick-borne encephalitis virus
ALHRFQLQW

SEQ ID NO: 191074 - protein, 9 aa, Tick-borne encephalitis virus
LHRFQLQWG

SEQ ID NO: 191075 - protein, 9 aa, Tick-borne encephalitis virus
HRFQLQWGG

SEQ ID NO: 191076 - protein, 9 aa, Tick-borne encephalitis virus
RFQLQWGGG

SEQ ID NO: 191077 - protein, 9 aa, Tick-borne encephalitis virus
FQLQWGGGL

SEQ ID NO: 191078 - protein, 9 aa, Tick-borne encephalitis virus
QLQWGGGLV

SEQ ID NO: 191079 - protein, 9 aa, Tick-borne encephalitis virus
LQWGGGLVR

SEQ ID NO: 191080 - protein, 9 aa, Tick-borne encephalitis virus
QWGGGLVRT

SEQ ID NO: 191081 - protein, 9 aa, Tick-borne encephalitis virus
WGGGLVRTP

SEQ ID NO: 191082 - protein, 9 aa, Tick-borne encephalitis virus
GGGLVRTPF

SEQ ID NO: 191083 - protein, 9 aa, Tick-borne encephalitis virus
GGLVRTPFS

SEQ ID NO: 191084 - protein, 9 aa, Tick-borne encephalitis virus
GLVRTPFSR

SEQ ID NO: 191085 - protein, 9 aa, Tick-borne encephalitis virus
LVRTPFSRN

SEQ ID NO: 191086 - protein, 9 aa, Tick-borne encephalitis virus
VRTPFSRNS

SEQ ID NO: 191087 - protein, 9 aa, Tick-borne encephalitis virus
RTPFSRNST

SEQ ID NO: 191088 - protein, 9 aa, Tick-borne encephalitis virus
TPFSRNSTH

SEQ ID NO: 191089 - protein, 9 aa, Tick-borne encephalitis virus
PFSRNSTHE

SEQ ID NO: 191090 - protein, 9 aa, Tick-borne encephalitis virus
FSRNSTHEM

SEQ ID NO: 191091 - protein, 9 aa, Tick-borne encephalitis virus
SRNSTHEMY

SEQ ID NO: 191092 - protein, 9 aa, Tick-borne encephalitis virus
RNSTHEMYY

SEQ ID NO: 191093 - protein, 9 aa, Tick-borne encephalitis virus
NSTHEMYYS

SEQ ID NO: 191094 - protein, 9 aa, Tick-borne encephalitis virus
STHEMYYST

SEQ ID NO: 191095 - protein, 9 aa, Tick-borne encephalitis virus
THEMYYSTA

SEQ ID NO: 191096 - protein, 9 aa, Tick-borne encephalitis virus
HEMYYSTAV

SEQ ID NO: 191097 - protein, 9 aa, Tick-borne encephalitis virus
EMYYSTAVT

SEQ ID NO: 191098 - protein, 9 aa, Tick-borne encephalitis virus
MYYSTAVTG

SEQ ID NO: 191099 - protein, 9 aa, Tick-borne encephalitis virus
YYSTAVTGN

SEQ ID NO: 191100 - protein, 9 aa, Tick-borne encephalitis virus
YSTAVTGNI

SEQ ID NO: 191101 - protein, 9 aa, Tick-borne encephalitis virus
STAVTGNIV

SEQ ID NO: 191102 - protein, 9 aa, Tick-borne encephalitis virus
TAVTGNIVN

SEQ ID NO: 191103 - protein, 9 aa, Tick-borne encephalitis virus
AVTGNIVNS

SEQ ID NO: 191104 - protein, 9 aa, Tick-borne encephalitis virus
VTGNIVNSV

SEQ ID NO: 191105 - protein, 9 aa, Tick-borne encephalitis virus
TGNIVNSVN

SEQ ID NO: 191106 - protein, 9 aa, Tick-borne encephalitis virus
GNIVNSVNI

SEQ ID NO: 191107 - protein, 9 aa, Tick-borne encephalitis virus
NIVNSVNIQ

SEQ ID NO: 191108 - protein, 9 aa, Tick-borne encephalitis virus
IVNSVNIQS

SEQ ID NO: 191109 - protein, 9 aa, Tick-borne encephalitis virus
VNSVNIQSR

SEQ ID NO: 191110 - protein, 9 aa, Tick-borne encephalitis virus
NSVNIQSRK

SEQ ID NO: 191111 - protein, 9 aa, Tick-borne encephalitis virus
SVNIQSRKL

SEQ ID NO: 191112 - protein, 9 aa, Tick-borne encephalitis virus
VNIQSRKLL

SEQ ID NO: 191113 - protein, 9 aa, Tick-borne encephalitis virus
NIQSRKLLA

SEQ ID NO: 191114 - protein, 9 aa, Tick-borne encephalitis virus
IQSRKLLAR

SEQ ID NO: 191115 - protein, 9 aa, Tick-borne encephalitis virus
QSRKLLARF

SEQ ID NO: 191116 - protein, 9 aa, Tick-borne encephalitis virus
SRKLLARFG

SEQ ID NO: 191117 - protein, 9 aa, Tick-borne encephalitis virus
RKLLARFGD

SEQ ID NO: 191118 - protein, 9 aa, Tick-borne encephalitis virus
KLLARFGDQ

SEQ ID NO: 191119 - protein, 9 aa, Tick-borne encephalitis virus
LLARFGDQR

SEQ ID NO: 191120 - protein, 9 aa, Tick-borne encephalitis virus
LARFGDQRG

SEQ ID NO: 191121 - protein, 9 aa, Tick-borne encephalitis virus
ARFGDQRGP

SEQ ID NO: 191122 - protein, 9 aa, Tick-borne encephalitis virus
RFGDQRGPT

SEQ ID NO: 191123 - protein, 9 aa, Tick-borne encephalitis virus
FGDQRGPTR

SEQ ID NO: 191124 - protein, 9 aa, Tick-borne encephalitis virus
GDQRGPTRV

SEQ ID NO: 191125 - protein, 9 aa, Tick-borne encephalitis virus
DQRGPTRVP

SEQ ID NO: 191126 - protein, 9 aa, Tick-borne encephalitis virus
QRGPTRVPE

SEQ ID NO: 191127 - protein, 9 aa, Tick-borne encephalitis virus
RGPTRVPEL

SEQ ID NO: 191128 - protein, 9 aa, Tick-borne encephalitis virus
GPTRVPELD

SEQ ID NO: 191129 - protein, 9 aa, Tick-borne encephalitis virus
PTRVPELDL

SEQ ID NO: 191130 - protein, 9 aa, Tick-borne encephalitis virus
TRVPELDLG

SEQ ID NO: 191131 - protein, 9 aa, Tick-borne encephalitis virus
RVPELDLGV

SEQ ID NO: 191132 - protein, 9 aa, Tick-borne encephalitis virus
VPELDLGVG

SEQ ID NO: 191133 - protein, 9 aa, Tick-borne encephalitis virus
PELDLGVGT

SEQ ID NO: 191134 - protein, 9 aa, Tick-borne encephalitis virus
ELDLGVGTR

SEQ ID NO: 191135 - protein, 9 aa, Tick-borne encephalitis virus
LDLGVGTRC

SEQ ID NO: 191136 - protein, 9 aa, Tick-borne encephalitis virus
DLGVGTRCV

SEQ ID NO: 191137 - protein, 9 aa, Tick-borne encephalitis virus
LGVGTRCVV

SEQ ID NO: 191138 - protein, 9 aa, Tick-borne encephalitis virus
GVGTRCVVL

SEQ ID NO: 191139 - protein, 9 aa, Tick-borne encephalitis virus
VGTRCVVLA

SEQ ID NO: 191140 - protein, 9 aa, Tick-borne encephalitis virus
GTRCVVLAE

SEQ ID NO: 191141 - protein, 9 aa, Tick-borne encephalitis virus
TRCVVLAED

SEQ ID NO: 191142 - protein, 9 aa, Tick-borne encephalitis virus
RCVVLAEDK

SEQ ID NO: 191143 - protein, 9 aa, Tick-borne encephalitis virus
CVVLAEDKV

SEQ ID NO: 191144 - protein, 9 aa, Tick-borne encephalitis virus
VVLAEDKVK

SEQ ID NO: 191145 - protein, 9 aa, Tick-borne encephalitis virus
VLAEDKVKE

SEQ ID NO: 191146 - protein, 9 aa, Tick-borne encephalitis virus
LAEDKVKEK

SEQ ID NO: 191147 - protein, 9 aa, Tick-borne encephalitis virus
AEDKVKEKD

SEQ ID NO: 191148 - protein, 9 aa, Tick-borne encephalitis virus
EDKVKEKDV

SEQ ID NO: 191149 - protein, 9 aa, Tick-borne encephalitis virus
DKVKEKDVQ

SEQ ID NO: 191150 - protein, 9 aa, Tick-borne encephalitis virus
KVKEKDVQE

SEQ ID NO: 191151 - protein, 9 aa, Tick-borne encephalitis virus
VKEKDVQER

SEQ ID NO: 191152 - protein, 9 aa, Tick-borne encephalitis virus
KEKDVQERI

SEQ ID NO: 191153 - protein, 9 aa, Tick-borne encephalitis virus
DVQERISAL

SEQ ID NO: 191154 - protein, 9 aa, Tick-borne encephalitis virus
ERISALREQ

SEQ ID NO: 191155 - protein, 9 aa, Tick-borne encephalitis virus
RISALREQY

SEQ ID NO: 191156 - protein, 9 aa, Tick-borne encephalitis virus
ALREQYGET

SEQ ID NO: 191157 - protein, 9 aa, Tick-borne encephalitis virus
LREQYGETW

SEQ ID NO: 191158 - protein, 9 aa, Tick-borne encephalitis virus
REQYGETWH

SEQ ID NO: 191159 - protein, 9 aa, Tick-borne encephalitis virus
DREHPYRTW

SEQ ID NO: 191160 - protein, 9 aa, Tick-borne encephalitis virus
REHPYRTWQ

SEQ ID NO: 191161 - protein, 9 aa, Tick-borne encephalitis virus
EHPYRTWQY

SEQ ID NO: 191162 - protein, 9 aa, Tick-borne encephalitis virus
HPYRTWQYW

SEQ ID NO: 191163 - protein, 9 aa, Tick-borne encephalitis virus
PYRTWQYWG

SEQ ID NO: 191164 - protein, 9 aa, Tick-borne encephalitis virus
YRTWQYWGS

SEQ ID NO: 191165 - protein, 9 aa, Tick-borne encephalitis virus
RTWQYWGSY

SEQ ID NO: 191166 - protein, 9 aa, Tick-borne encephalitis virus
TWQYWGSYR

SEQ ID NO: 191167 - protein, 9 aa, Tick-borne encephalitis virus
WQYWGSYRT

SEQ ID NO: 191168 - protein, 9 aa, Tick-borne encephalitis virus
QYWGSYRTA

SEQ ID NO: 191169 - protein, 9 aa, Tick-borne encephalitis virus
YWGSYRTAP

SEQ ID NO: 191170 - protein, 9 aa, Tick-borne encephalitis virus
WGSYRTAPT

SEQ ID NO: 191171 - protein, 9 aa, Tick-borne encephalitis virus
GSYRTAPTG

SEQ ID NO: 191172 - protein, 9 aa, Tick-borne encephalitis virus
SYRTAPTGS

SEQ ID NO: 191173 - protein, 9 aa, Tick-borne encephalitis virus
YRTAPTGSA

SEQ ID NO: 191174 - protein, 9 aa, Tick-borne encephalitis virus
RTAPTGSAA

SEQ ID NO: 191175 - protein, 9 aa, Tick-borne encephalitis virus
TAPTGSAAS

SEQ ID NO: 191176 - protein, 9 aa, Tick-borne encephalitis virus
APTGSAASL

SEQ ID NO: 191177 - protein, 9 aa, Tick-borne encephalitis virus
PTGSAASLI

SEQ ID NO: 191178 - protein, 9 aa, Tick-borne encephalitis virus
TGSAASLIN

SEQ ID NO: 191179 - protein, 9 aa, Tick-borne encephalitis virus
GSAASLING

SEQ ID NO: 191180 - protein, 9 aa, Tick-borne encephalitis virus
SAASLINGV

SEQ ID NO: 191181 - protein, 9 aa, Tick-borne encephalitis virus
AASLINGVV

SEQ ID NO: 191182 - protein, 9 aa, Tick-borne encephalitis virus
ASLINGVVK

SEQ ID NO: 191183 - protein, 9 aa, Tick-borne encephalitis virus
SLINGVVKL

SEQ ID NO: 191184 - protein, 9 aa, Tick-borne encephalitis virus
LINGVVKLL

SEQ ID NO: 191185 - protein, 9 aa, Tick-borne encephalitis virus
INGVVKLLS

SEQ ID NO: 191186 - protein, 9 aa, Tick-borne encephalitis virus
NGVVKLLSW

SEQ ID NO: 191187 - protein, 9 aa, Tick-borne encephalitis virus
GVVKLLSWP

SEQ ID NO: 191188 - protein, 9 aa, Tick-borne encephalitis virus
VVKLLSWPW

SEQ ID NO: 191189 - protein, 9 aa, Tick-borne encephalitis virus
VKLLSWPWN

SEQ ID NO: 191190 - protein, 9 aa, Tick-borne encephalitis virus
KLLSWPWNA

SEQ ID NO: 191191 - protein, 9 aa, Tick-borne encephalitis virus
LLSWPWNAR

SEQ ID NO: 191192 - protein, 9 aa, Tick-borne encephalitis virus
LSWPWNARE

SEQ ID NO: 191193 - protein, 9 aa, Tick-borne encephalitis virus
SWPWNARED

SEQ ID NO: 191194 - protein, 9 aa, Tick-borne encephalitis virus
WPWNAREDV

SEQ ID NO: 191195 - protein, 9 aa, Tick-borne encephalitis virus
PWNAREDVV

SEQ ID NO: 191196 - protein, 9 aa, Tick-borne encephalitis virus
WNAREDVVR

SEQ ID NO: 191197 - protein, 9 aa, Tick-borne encephalitis virus
NAREDVVRM

SEQ ID NO: 191198 - protein, 9 aa, Tick-borne encephalitis virus
AREDVVRMA

SEQ ID NO: 191199 - protein, 9 aa, Tick-borne encephalitis virus
REDVVRMAM

SEQ ID NO: 191200 - protein, 9 aa, Tick-borne encephalitis virus
EDVVRMAMT

SEQ ID NO: 191201 - protein, 9 aa, Tick-borne encephalitis virus
DVVRMAMTD

SEQ ID NO: 191202 - protein, 9 aa, Tick-borne encephalitis virus
VVRMAMTDT

SEQ ID NO: 191203 - protein, 9 aa, Tick-borne encephalitis virus
VRMAMTDTT

SEQ ID NO: 191204 - protein, 9 aa, Tick-borne encephalitis virus
RMAMTDTTA

SEQ ID NO: 191205 - protein, 9 aa, Tick-borne encephalitis virus
MAMTDTTAF

SEQ ID NO: 191206 - protein, 9 aa, Tick-borne encephalitis virus
AMTDTTAFG

SEQ ID NO: 191207 - protein, 9 aa, Tick-borne encephalitis virus
MTDTTAFGQ

SEQ ID NO: 191208 - protein, 9 aa, Tick-borne encephalitis virus
TDTTAFGQQ

SEQ ID NO: 191209 - protein, 9 aa, Tick-borne encephalitis virus
DTTAFGQQR

SEQ ID NO: 191210 - protein, 9 aa, Tick-borne encephalitis virus
TTAFGQQRV

SEQ ID NO: 191211 - protein, 9 aa, Tick-borne encephalitis virus
TAFGQQRVF

SEQ ID NO: 191212 - protein, 9 aa, Tick-borne encephalitis virus
AFGQQRVFK

SEQ ID NO: 191213 - protein, 9 aa, Tick-borne encephalitis virus
FGQQRVFKE

SEQ ID NO: 191214 - protein, 9 aa, Tick-borne encephalitis virus
GQQRVFKEK

SEQ ID NO: 191215 - protein, 9 aa, Tick-borne encephalitis virus
QQRVFKEKV

SEQ ID NO: 191216 - protein, 9 aa, Tick-borne encephalitis virus
QRVFKEKVD

SEQ ID NO: 191217 - protein, 9 aa, Tick-borne encephalitis virus
RVFKEKVDT

SEQ ID NO: 191218 - protein, 9 aa, Tick-borne encephalitis virus
VFKEKVDTK

SEQ ID NO: 191219 - protein, 9 aa, Tick-borne encephalitis virus
FKEKVDTKA

SEQ ID NO: 191220 - protein, 9 aa, Tick-borne encephalitis virus
KEKVDTKAQ

SEQ ID NO: 191221 - protein, 9 aa, Tick-borne encephalitis virus
EKVDTKAQE

SEQ ID NO: 191222 - protein, 9 aa, Tick-borne encephalitis virus
KVDTKAQEP

SEQ ID NO: 191223 - protein, 9 aa, Tick-borne encephalitis virus
VDTKAQEPQ

SEQ ID NO: 191224 - protein, 9 aa, Tick-borne encephalitis virus
DTKAQEPQP

SEQ ID NO: 191225 - protein, 9 aa, Tick-borne encephalitis virus
TKAQEPQPG

SEQ ID NO: 191226 - protein, 9 aa, Tick-borne encephalitis virus
KAQEPQPGT

SEQ ID NO: 191227 - protein, 9 aa, Tick-borne encephalitis virus
AQEPQPGTK

SEQ ID NO: 191228 - protein, 9 aa, Tick-borne encephalitis virus
QEPQPGTKV

SEQ ID NO: 191229 - protein, 9 aa, Tick-borne encephalitis virus
EPQPGTKVI

SEQ ID NO: 191230 - protein, 9 aa, Tick-borne encephalitis virus
PQPGTKVIM

SEQ ID NO: 191231 - protein, 9 aa, Tick-borne encephalitis virus
QPGTKVIMR

SEQ ID NO: 191232 - protein, 9 aa, Tick-borne encephalitis virus
PGTKVIMRA

SEQ ID NO: 191233 - protein, 9 aa, Tick-borne encephalitis virus
GTKVIMRAV

SEQ ID NO: 191234 - protein, 9 aa, Tick-borne encephalitis virus
TKVIMRAVN

SEQ ID NO: 191235 - protein, 9 aa, Tick-borne encephalitis virus
KVIMRAVND

SEQ ID NO: 191236 - protein, 9 aa, Tick-borne encephalitis virus
VIMRAVNDW

SEQ ID NO: 191237 - protein, 9 aa, Tick-borne encephalitis virus
IMRAVNDWI

SEQ ID NO: 191238 - protein, 9 aa, Tick-borne encephalitis virus
MRAVNDWIL

SEQ ID NO: 191239 - protein, 9 aa, Tick-borne encephalitis virus
RAVNDWILE

SEQ ID NO: 191240 - protein, 9 aa, Tick-borne encephalitis virus
AVNDWILER

SEQ ID NO: 191241 - protein, 9 aa, Tick-borne encephalitis virus
VNDWILERL

SEQ ID NO: 191242 - protein, 9 aa, Tick-borne encephalitis virus
NDWILERLA

SEQ ID NO: 191243 - protein, 9 aa, Tick-borne encephalitis virus
DWILERLAR

SEQ ID NO: 191244 - protein, 9 aa, Tick-borne encephalitis virus
WILERLARK

SEQ ID NO: 191245 - protein, 9 aa, Tick-borne encephalitis virus
ILERLARKS

SEQ ID NO: 191246 - protein, 9 aa, Tick-borne encephalitis virus
KPRMCSREE

SEQ ID NO: 191247 - protein, 9 aa, Tick-borne encephalitis virus
PRMCSREEF

SEQ ID NO: 191248 - protein, 9 aa, Tick-borne encephalitis virus
RMCSREEFI

SEQ ID NO: 191249 - protein, 9 aa, Tick-borne encephalitis virus
MCSREEFIA

SEQ ID NO: 191250 - protein, 9 aa, Tick-borne encephalitis virus
CSREEFIAK

SEQ ID NO: 191251 - protein, 9 aa, Tick-borne encephalitis virus
SREEFIAKV

SEQ ID NO: 191252 - protein, 9 aa, Tick-borne encephalitis virus
REEFIAKVK

SEQ ID NO: 191253 - protein, 9 aa, Tick-borne encephalitis virus
EEFIAKVKS

SEQ ID NO: 191254 - protein, 9 aa, Tick-borne encephalitis virus
EFIAKVKSN

SEQ ID NO: 191255 - protein, 9 aa, Tick-borne encephalitis virus
FIAKVKSNA

SEQ ID NO: 191256 - protein, 9 aa, Tick-borne encephalitis virus
IAKVKSNAA

SEQ ID NO: 191257 - protein, 9 aa, Tick-borne encephalitis virus
AKVKSNAAL

SEQ ID NO: 191258 - protein, 9 aa, Tick-borne encephalitis virus
KVKSNAALG

SEQ ID NO: 191259 - protein, 9 aa, Tick-borne encephalitis virus
VKSNAALGA

SEQ ID NO: 191260 - protein, 9 aa, Tick-borne encephalitis virus
KSNAALGAW

SEQ ID NO: 191261 - protein, 9 aa, Tick-borne encephalitis virus
SNAALGAWS

SEQ ID NO: 191262 - protein, 9 aa, Tick-borne encephalitis virus
NAALGAWSD

SEQ ID NO: 191263 - protein, 9 aa, Tick-borne encephalitis virus
AALGAWSDE

SEQ ID NO: 191264 - protein, 9 aa, Tick-borne encephalitis virus
ALGAWSDEQ

SEQ ID NO: 191265 - protein, 9 aa, Tick-borne encephalitis virus
LGAWSDEQN

SEQ ID NO: 191266 - protein, 9 aa, Tick-borne encephalitis virus
GAWSDEQNR

SEQ ID NO: 191267 - protein, 9 aa, Tick-borne encephalitis virus
AWSDEQNRW

SEQ ID NO: 191268 - protein, 9 aa, Tick-borne encephalitis virus
WSDEQNRWS

SEQ ID NO: 191269 - protein, 9 aa, Tick-borne encephalitis virus
SAKEAVEDP

SEQ ID NO: 191270 - protein, 9 aa, Tick-borne encephalitis virus
AKEAVEDPA

SEQ ID NO: 191271 - protein, 9 aa, Tick-borne encephalitis virus
KEAVEDPAF

SEQ ID NO: 191272 - protein, 9 aa, Tick-borne encephalitis virus
EAVEDPAFW

SEQ ID NO: 191273 - protein, 9 aa, Tick-borne encephalitis virus
AVEDPAFWQ

SEQ ID NO: 191274 - protein, 9 aa, Tick-borne encephalitis virus
VEDPAFWQL

SEQ ID NO: 191275 - protein, 9 aa, Tick-borne encephalitis virus
EDPAFWQLV

SEQ ID NO: 191276 - protein, 9 aa, Tick-borne encephalitis virus
DPAFWQLVD

SEQ ID NO: 191277 - protein, 9 aa, Tick-borne encephalitis virus
PAFWQLVDE

SEQ ID NO: 191278 - protein, 9 aa, Tick-borne encephalitis virus
AFWQLVDEE

SEQ ID NO: 191279 - protein, 9 aa, Tick-borne encephalitis virus
FWQLVDEER

SEQ ID NO: 191280 - protein, 9 aa, Tick-borne encephalitis virus
WQLVDEERE

SEQ ID NO: 191281 - protein, 9 aa, Tick-borne encephalitis virus
QLVDEERER

SEQ ID NO: 191282 - protein, 9 aa, Tick-borne encephalitis virus
LVDEERERH

SEQ ID NO: 191283 - protein, 9 aa, Tick-borne encephalitis virus
VDEERERHL

SEQ ID NO: 191284 - protein, 9 aa, Tick-borne encephalitis virus
DEERERHLA

SEQ ID NO: 191285 - protein, 9 aa, Tick-borne encephalitis virus
EERERHLAG

SEQ ID NO: 191286 - protein, 9 aa, Tick-borne encephalitis virus
ERERHLAGR

SEQ ID NO: 191287 - protein, 9 aa, Tick-borne encephalitis virus
RERHLAGRC

SEQ ID NO: 191288 - protein, 9 aa, Tick-borne encephalitis virus
ERHLAGRCA

SEQ ID NO: 191289 - protein, 9 aa, Tick-borne encephalitis virus
RHLAGRCAH

SEQ ID NO: 191290 - protein, 9 aa, Tick-borne encephalitis virus
HLAGRCAHC

SEQ ID NO: 191291 - protein, 9 aa, Tick-borne encephalitis virus
LAGRCAHCV

SEQ ID NO: 191292 - protein, 9 aa, Tick-borne encephalitis virus
GRCAHCVYN

SEQ ID NO: 191293 - protein, 9 aa, Tick-borne encephalitis virus
RCAHCVYNM

SEQ ID NO: 191294 - protein, 9 aa, Tick-borne encephalitis virus
CAHCVYNMM

SEQ ID NO: 191295 - protein, 9 aa, Tick-borne encephalitis virus
AHCVYNMMG

SEQ ID NO: 191296 - protein, 9 aa, Tick-borne encephalitis virus
HCVYNMMGK

SEQ ID NO: 191297 - protein, 9 aa, Tick-borne encephalitis virus
CVYNMMGKR

SEQ ID NO: 191298 - protein, 9 aa, Tick-borne encephalitis virus
VYNMMGKRE

SEQ ID NO: 191299 - protein, 9 aa, Tick-borne encephalitis virus
YNMMGKREK

SEQ ID NO: 191300 - protein, 9 aa, Tick-borne encephalitis virus
NMMGKREKK

SEQ ID NO: 191301 - protein, 9 aa, Tick-borne encephalitis virus
MMGKREKKL

SEQ ID NO: 191302 - protein, 9 aa, Tick-borne encephalitis virus
MGKREKKLG

SEQ ID NO: 191303 - protein, 9 aa, Tick-borne encephalitis virus
GKREKKLGE

SEQ ID NO: 191304 - protein, 9 aa, Tick-borne encephalitis virus
KREKKLGEF

SEQ ID NO: 191305 - protein, 9 aa, Tick-borne encephalitis virus
REKKLGEFG

SEQ ID NO: 191306 - protein, 9 aa, Tick-borne encephalitis virus
EKKLGEFGV

SEQ ID NO: 191307 - protein, 9 aa, Tick-borne encephalitis virus
KKLGEFGVA

SEQ ID NO: 191308 - protein, 9 aa, Tick-borne encephalitis virus
KLGEFGVAK

SEQ ID NO: 191309 - protein, 9 aa, Tick-borne encephalitis virus
LGEFGVAKG

SEQ ID NO: 191310 - protein, 9 aa, Tick-borne encephalitis virus
GEFGVAKGS

SEQ ID NO: 191311 - protein, 9 aa, Tick-borne encephalitis virus
EFGVAKGSR

SEQ ID NO: 191312 - protein, 9 aa, Tick-borne encephalitis virus
FGVAKGSRA

SEQ ID NO: 191313 - protein, 9 aa, Tick-borne encephalitis virus
GVAKGSRAI

SEQ ID NO: 191314 - protein, 9 aa, Tick-borne encephalitis virus
VAKGSRAIW

SEQ ID NO: 191315 - protein, 9 aa, Tick-borne encephalitis virus
AKGSRAIWY

SEQ ID NO: 191316 - protein, 9 aa, Tick-borne encephalitis virus
KGSRAIWYM

SEQ ID NO: 191317 - protein, 9 aa, Tick-borne encephalitis virus
GSRAIWYMW

SEQ ID NO: 191318 - protein, 9 aa, Tick-borne encephalitis virus
SRAIWYMWL

SEQ ID NO: 191319 - protein, 9 aa, Tick-borne encephalitis virus
RAIWYMWLG

SEQ ID NO: 191320 - protein, 9 aa, Tick-borne encephalitis virus
AIWYMWLGS

SEQ ID NO: 191321 - protein, 9 aa, Tick-borne encephalitis virus
IWYMWLGSR

SEQ ID NO: 191322 - protein, 9 aa, Tick-borne encephalitis virus
WYMWLGSRF

SEQ ID NO: 191323 - protein, 9 aa, Tick-borne encephalitis virus
YMWLGSRFL

SEQ ID NO: 191324 - protein, 9 aa, Tick-borne encephalitis virus
MWLGSRFLE

SEQ ID NO: 191325 - protein, 9 aa, Tick-borne encephalitis virus
WLGSRFLEF

SEQ ID NO: 191326 - protein, 9 aa, Tick-borne encephalitis virus
LGSRFLEFE

SEQ ID NO: 191327 - protein, 9 aa, Tick-borne encephalitis virus
GSRFLEFEA

SEQ ID NO: 191328 - protein, 9 aa, Tick-borne encephalitis virus
SRFLEFEAL

SEQ ID NO: 191329 - protein, 9 aa, Tick-borne encephalitis virus
RFLEFEALG

SEQ ID NO: 191330 - protein, 9 aa, Tick-borne encephalitis virus
FLEFEALGF

SEQ ID NO: 191331 - protein, 9 aa, Tick-borne encephalitis virus
LEFEALGFL

SEQ ID NO: 191332 - protein, 9 aa, Tick-borne encephalitis virus
EFEALGFLN

SEQ ID NO: 191333 - protein, 9 aa, Tick-borne encephalitis virus
FEALGFLNE

SEQ ID NO: 191334 - protein, 9 aa, Tick-borne encephalitis virus
EALGFLNED

SEQ ID NO: 191335 - protein, 9 aa, Tick-borne encephalitis virus
ALGFLNEDH

SEQ ID NO: 191336 - protein, 9 aa, Tick-borne encephalitis virus
LGFLNEDHW

SEQ ID NO: 191337 - protein, 9 aa, Tick-borne encephalitis virus
GFLNEDHWA

SEQ ID NO: 191338 - protein, 9 aa, Tick-borne encephalitis virus
FLNEDHWAS

SEQ ID NO: 191339 - protein, 9 aa, Tick-borne encephalitis virus
LNEDHWASR

SEQ ID NO: 191340 - protein, 9 aa, Tick-borne encephalitis virus
NEDHWASRG

SEQ ID NO: 191341 - protein, 9 aa, Tick-borne encephalitis virus
EDHWASRGS

SEQ ID NO: 191342 - protein, 9 aa, Tick-borne encephalitis virus
DHWASRGSS

SEQ ID NO: 191343 - protein, 9 aa, Tick-borne encephalitis virus
HWASRGSSG

SEQ ID NO: 191344 - protein, 9 aa, Tick-borne encephalitis virus
WASRGSSGS

SEQ ID NO: 191345 - protein, 9 aa, Tick-borne encephalitis virus
ASRGSSGSG

SEQ ID NO: 191346 - protein, 9 aa, Tick-borne encephalitis virus
SRGSSGSGV

SEQ ID NO: 191347 - protein, 9 aa, Tick-borne encephalitis virus
RGSSGSGVE

SEQ ID NO: 191348 - protein, 9 aa, Tick-borne encephalitis virus
GSSGSGVEG

SEQ ID NO: 191349 - protein, 9 aa, Tick-borne encephalitis virus
SSGSGVEGI

SEQ ID NO: 191350 - protein, 9 aa, Tick-borne encephalitis virus
SGSGVEGIS

SEQ ID NO: 191351 - protein, 9 aa, Tick-borne encephalitis virus
GSGVEGISL

SEQ ID NO: 191352 - protein, 9 aa, Tick-borne encephalitis virus
SGVEGISLN

SEQ ID NO: 191353 - protein, 9 aa, Tick-borne encephalitis virus
GVEGISLNY

SEQ ID NO: 191354 - protein, 9 aa, Tick-borne encephalitis virus
VEGISLNYL

SEQ ID NO: 191355 - protein, 9 aa, Tick-borne encephalitis virus
EGISLNYLG

SEQ ID NO: 191356 - protein, 9 aa, Tick-borne encephalitis virus
GISLNYLGW

SEQ ID NO: 191357 - protein, 9 aa, Tick-borne encephalitis virus
ISLNYLGWH

SEQ ID NO: 191358 - protein, 9 aa, Tick-borne encephalitis virus
SLNYLGWHL

SEQ ID NO: 191359 - protein, 9 aa, Tick-borne encephalitis virus
LNYLGWHLK

SEQ ID NO: 191360 - protein, 9 aa, Tick-borne encephalitis virus
NYLGWYLKG

SEQ ID NO: 191361 - protein, 9 aa, Tick-borne encephalitis virus
YLGWHLKKL

SEQ ID NO: 191362 - protein, 9 aa, Tick-borne encephalitis virus
LGWHLKKLS

SEQ ID NO: 191363 - protein, 9 aa, Tick-borne encephalitis virus
LSTLEGGLF

SEQ ID NO: 191364 - protein, 9 aa, Tick-borne encephalitis virus
STLEGGLFY

SEQ ID NO: 191365 - protein, 9 aa, Tick-borne encephalitis virus
TLEGGLFYA

SEQ ID NO: 191366 - protein, 9 aa, Tick-borne encephalitis virus
LEGGLFYAD

SEQ ID NO: 191367 - protein, 9 aa, Tick-borne encephalitis virus
EGGLFYADD

SEQ ID NO: 191368 - protein, 9 aa, Tick-borne encephalitis virus
GGLFYADDT

SEQ ID NO: 191369 - protein, 9 aa, Tick-borne encephalitis virus
GLFYADDTA

SEQ ID NO: 191370 - protein, 9 aa, Tick-borne encephalitis virus
LFYADDTAG

SEQ ID NO: 191371 - protein, 9 aa, Tick-borne encephalitis virus
FYADDTAGW

SEQ ID NO: 191372 - protein, 9 aa, Tick-borne encephalitis virus
YADDTAGWD

SEQ ID NO: 191373 - protein, 9 aa, Tick-borne encephalitis virus
ADDTAGWDT

SEQ ID NO: 191374 - protein, 9 aa, Tick-borne encephalitis virus
DDTAGWDTK

SEQ ID NO: 191375 - protein, 9 aa, Tick-borne encephalitis virus
DTAGWDTKV

SEQ ID NO: 191376 - protein, 9 aa, Tick-borne encephalitis virus
TAGWDTKVT

SEQ ID NO: 191377 - protein, 9 aa, Tick-borne encephalitis virus
AGWDTKVTN

SEQ ID NO: 191378 - protein, 9 aa, Tick-borne encephalitis virus
GWDTKVTNA

SEQ ID NO: 191379 - protein, 9 aa, Tick-borne encephalitis virus
WDTKVTNAD

SEQ ID NO: 191380 - protein, 9 aa, Tick-borne encephalitis virus
DTKVTNADL

SEQ ID NO: 191381 - protein, 9 aa, Tick-borne encephalitis virus
TKVTNADLE

SEQ ID NO: 191382 - protein, 9 aa, Tick-borne encephalitis virus
KVTNADLED

SEQ ID NO: 191383 - protein, 9 aa, Tick-borne encephalitis virus
VTNADLEDE

SEQ ID NO: 191384 - protein, 9 aa, Tick-borne encephalitis virus
TNADLEDEE

SEQ ID NO: 191385 - protein, 9 aa, Tick-borne encephalitis virus
NADLEDEEQ

SEQ ID NO: 191386 - protein, 9 aa, Tick-borne encephalitis virus
ADLEDEEQL

SEQ ID NO: 191387 - protein, 9 aa, Tick-borne encephalitis virus
DLEDEEQLL

SEQ ID NO: 191388 - protein, 9 aa, Tick-borne encephalitis virus
LEDEEQLLR

SEQ ID NO: 191389 - protein, 9 aa, Tick-borne encephalitis virus
EDEEQLLRY

SEQ ID NO: 191390 - protein, 9 aa, Tick-borne encephalitis virus
DEEQLLRYM

SEQ ID NO: 191391 - protein, 9 aa, Tick-borne encephalitis virus
EEQLLRYME

SEQ ID NO: 191392 - protein, 9 aa, Tick-borne encephalitis virus
EQLLRYMEG

SEQ ID NO: 191393 - protein, 9 aa, Tick-borne encephalitis virus
QLLRYMEGE

SEQ ID NO: 191394 - protein, 9 aa, Tick-borne encephalitis virus
LLRYMEGEH

SEQ ID NO: 191395 - protein, 9 aa, Tick-borne encephalitis virus
LRYMEGEHK

SEQ ID NO: 191396 - protein, 9 aa, Tick-borne encephalitis virus
RYMEGEHKQ

SEQ ID NO: 191397 - protein, 9 aa, Tick-borne encephalitis virus
YMEGEHKQL

SEQ ID NO: 191398 - protein, 9 aa, Tick-borne encephalitis virus
MEGEHKQLA

SEQ ID NO: 191399 - protein, 9 aa, Tick-borne encephalitis virus
EGEHKQLAA

SEQ ID NO: 191400 - protein, 9 aa, Tick-borne encephalitis virus
GEHKQLAAT

SEQ ID NO: 191401 - protein, 9 aa, Tick-borne encephalitis virus
EHKQLAATI

SEQ ID NO: 191402 - protein, 9 aa, Tick-borne encephalitis virus
HKQLAATIM

SEQ ID NO: 191403 - protein, 9 aa, Tick-borne encephalitis virus
KQLAATIMQ

SEQ ID NO: 191404 - protein, 9 aa, Tick-borne encephalitis virus
QLAATIMQK

SEQ ID NO: 191405 - protein, 9 aa, Tick-borne encephalitis virus
LAATIMQKA

SEQ ID NO: 191406 - protein, 9 aa, Tick-borne encephalitis virus
AATIMQKAY

SEQ ID NO: 191407 - protein, 9 aa, Tick-borne encephalitis virus
ATIMQKAYH

SEQ ID NO: 191408 - protein, 9 aa, Tick-borne encephalitis virus
TIMQKAYHA

SEQ ID NO: 191409 - protein, 9 aa, Tick-borne encephalitis virus
IMQKAYHAK

SEQ ID NO: 191410 - protein, 9 aa, Tick-borne encephalitis virus
MQKAYHAKV

SEQ ID NO: 191411 - protein, 9 aa, Tick-borne encephalitis virus
QKAYHAKVV

SEQ ID NO: 191412 - protein, 9 aa, Tick-borne encephalitis virus
KAYHAKVVK

SEQ ID NO: 191413 - protein, 9 aa, Tick-borne encephalitis virus
AYHAKVVKV

SEQ ID NO: 191414 - protein, 9 aa, Tick-borne encephalitis virus
YHAKVVKVA

SEQ ID NO: 191415 - protein, 9 aa, Tick-borne encephalitis virus
HAKVVKVAR

SEQ ID NO: 191416 - protein, 9 aa, Tick-borne encephalitis virus
AKVVKVARP

SEQ ID NO: 191417 - protein, 9 aa, Tick-borne encephalitis virus
KVVKVARPS

SEQ ID NO: 191418 - protein, 9 aa, Tick-borne encephalitis virus
VVKVARPSR

SEQ ID NO: 191419 - protein, 9 aa, Tick-borne encephalitis virus
VKVARPSRD

SEQ ID NO: 191420 - protein, 9 aa, Tick-borne encephalitis virus
KVARPSRDG

SEQ ID NO: 191421 - protein, 9 aa, Tick-borne encephalitis virus
VARPSRDGG

SEQ ID NO: 191422 - protein, 9 aa, Tick-borne encephalitis virus
ARPSRDGGC

SEQ ID NO: 191423 - protein, 9 aa, Tick-borne encephalitis virus
RPSRDGGCI

SEQ ID NO: 191424 - protein, 9 aa, Tick-borne encephalitis virus
PSRDGGCIM

SEQ ID NO: 191425 - protein, 9 aa, Tick-borne encephalitis virus
SRDGGCIMD

SEQ ID NO: 191426 - protein, 9 aa, Tick-borne encephalitis virus
RDGGCIMDV

SEQ ID NO: 191427 - protein, 9 aa, Tick-borne encephalitis virus
DGGCIMDVI

SEQ ID NO: 191428 - protein, 9 aa, Tick-borne encephalitis virus
GGCIMDVIT

SEQ ID NO: 191429 - protein, 9 aa, Tick-borne encephalitis virus
GCIMDVITR

SEQ ID NO: 191430 - protein, 9 aa, Tick-borne encephalitis virus
CIMDVITRR

SEQ ID NO: 191431 - protein, 9 aa, Tick-borne encephalitis virus
IMDVITRRD

SEQ ID NO: 191432 - protein, 9 aa, Tick-borne encephalitis virus
MDVITRRDQ

SEQ ID NO: 191433 - protein, 9 aa, Tick-borne encephalitis virus
DVITRRDQR

SEQ ID NO: 191434 - protein, 9 aa, Tick-borne encephalitis virus
VITRRDQRG

SEQ ID NO: 191435 - protein, 9 aa, Tick-borne encephalitis virus
ITRRDQRGS

SEQ ID NO: 191436 - protein, 9 aa, Tick-borne encephalitis virus
TRRDQRGSG

SEQ ID NO: 191437 - protein, 9 aa, Tick-borne encephalitis virus
RRDQRGSGQ

SEQ ID NO: 191438 - protein, 9 aa, Tick-borne encephalitis virus
RDQRGSGQV

SEQ ID NO: 191439 - protein, 9 aa, Tick-borne encephalitis virus
DQRGSGQVV

SEQ ID NO: 191440 - protein, 9 aa, Tick-borne encephalitis virus
QRGSGQVVT

SEQ ID NO: 191441 - protein, 9 aa, Tick-borne encephalitis virus
RGSGQVVTY

SEQ ID NO: 191442 - protein, 9 aa, Tick-borne encephalitis virus
GSGQVVTYA

SEQ ID NO: 191443 - protein, 9 aa, Tick-borne encephalitis virus
SGQVVTYAL

SEQ ID NO: 191444 - protein, 9 aa, Tick-borne encephalitis virus
GQVVTYALN

SEQ ID NO: 191445 - protein, 9 aa, Tick-borne encephalitis virus
QVVTYALNT

SEQ ID NO: 191446 - protein, 9 aa, Tick-borne encephalitis virus
VVTYALNTL

SEQ ID NO: 191447 - protein, 9 aa, Tick-borne encephalitis virus
VTYALNTLT

SEQ ID NO: 191448 - protein, 9 aa, Tick-borne encephalitis virus
TYALNTLTN

SEQ ID NO: 191449 - protein, 9 aa, Tick-borne encephalitis virus
YALNTLTNI

SEQ ID NO: 191450 - protein, 9 aa, Tick-borne encephalitis virus
ALNTLTNIK

SEQ ID NO: 191451 - protein, 9 aa, Tick-borne encephalitis virus
LNTLTNIKV

SEQ ID NO: 191452 - protein, 9 aa, Tick-borne encephalitis virus
NTLTNIKVQ

SEQ ID NO: 191453 - protein, 9 aa, Tick-borne encephalitis virus
TLTNIKVQL

SEQ ID NO: 191454 - protein, 9 aa, Tick-borne encephalitis virus
LTNIKVQLI

SEQ ID NO: 191455 - protein, 9 aa, Tick-borne encephalitis virus
TNIKVQLIR

SEQ ID NO: 191456 - protein, 9 aa, Tick-borne encephalitis virus
NIKVQLIRM

SEQ ID NO: 191457 - protein, 9 aa, Tick-borne encephalitis virus
IKVQLIRMM

SEQ ID NO: 191458 - protein, 9 aa, Tick-borne encephalitis virus
KVQLIRMME

SEQ ID NO: 191459 - protein, 9 aa, Tick-borne encephalitis virus
VQLIRMMEG

SEQ ID NO: 191460 - protein, 9 aa, Tick-borne encephalitis virus
QLIRMMEGE

SEQ ID NO: 191461 - protein, 9 aa, Tick-borne encephalitis virus
LIRMMEGEG

SEQ ID NO: 191462 - protein, 9 aa, Tick-borne encephalitis virus
IRMMEGEGV

SEQ ID NO: 191463 - protein, 9 aa, Tick-borne encephalitis virus
RMMEGEGVI

SEQ ID NO: 191464 - protein, 9 aa, Tick-borne encephalitis virus
MMEGEGVIE

SEQ ID NO: 191465 - protein, 9 aa, Tick-borne encephalitis virus
MEGEGVIEA

SEQ ID NO: 191466 - protein, 9 aa, Tick-borne encephalitis virus
EGEGVIEAS

SEQ ID NO: 191467 - protein, 9 aa, Tick-borne encephalitis virus
GEGVIEASD

SEQ ID NO: 191468 - protein, 9 aa, Tick-borne encephalitis virus
EGVIEASDA

SEQ ID NO: 191469 - protein, 9 aa, Tick-borne encephalitis virus
GVIEASDAH

SEQ ID NO: 191470 - protein, 9 aa, Tick-borne encephalitis virus
VIEASDAHN

SEQ ID NO: 191471 - protein, 9 aa, Tick-borne encephalitis virus
IEASDAHNP

SEQ ID NO: 191472 - protein, 9 aa, Tick-borne encephalitis virus
EASDAHNPR

SEQ ID NO: 191473 - protein, 9 aa, Tick-borne encephalitis virus
ASDAHNPRL

SEQ ID NO: 191474 - protein, 9 aa, Tick-borne encephalitis virus
SDAHNPRLL

SEQ ID NO: 191475 - protein, 9 aa, Tick-borne encephalitis virus
DAHNPRLLR

SEQ ID NO: 191476 - protein, 9 aa, Tick-borne encephalitis virus
AHNPRLLRV

SEQ ID NO: 191477 - protein, 9 aa, Tick-borne encephalitis virus
HNPRLLRVE

SEQ ID NO: 191478 - protein, 9 aa, Tick-borne encephalitis virus
NPRLLRVER

SEQ ID NO: 191479 - protein, 9 aa, Tick-borne encephalitis virus
PRLLRVERW

SEQ ID NO: 191480 - protein, 9 aa, Tick-borne encephalitis virus
RLLRVERWL

SEQ ID NO: 191481 - protein, 9 aa, Tick-borne encephalitis virus
LLRVERWLR

SEQ ID NO: 191482 - protein, 9 aa, Tick-borne encephalitis virus
LRVERWLRD

SEQ ID NO: 191483 - protein, 9 aa, Tick-borne encephalitis virus
RVERWLRDH

SEQ ID NO: 191484 - protein, 9 aa, Tick-borne encephalitis virus
VERWLRDHG

SEQ ID NO: 191485 - protein, 9 aa, Tick-borne encephalitis virus
DHGEERLGR

SEQ ID NO: 191486 - protein, 9 aa, Tick-borne encephalitis virus
HGEERLGRM

SEQ ID NO: 191487 - protein, 9 aa, Tick-borne encephalitis virus
GEERLGRML

SEQ ID NO: 191488 - protein, 9 aa, Tick-borne encephalitis virus
EERLGRMLV

SEQ ID NO: 191489 - protein, 9 aa, Tick-borne encephalitis virus
ERLGRMLVS

SEQ ID NO: 191490 - protein, 9 aa, Tick-borne encephalitis virus
RLGRMLVSG

SEQ ID NO: 191491 - protein, 9 aa, Tick-borne encephalitis virus
LGRMLVSGD

SEQ ID NO: 191492 - protein, 9 aa, Tick-borne encephalitis virus
GRMLVSGDD

SEQ ID NO: 191493 - protein, 9 aa, Tick-borne encephalitis virus
RMLVSGDDC

SEQ ID NO: 191494 - protein, 9 aa, Tick-borne encephalitis virus
MLVSGDDCV

SEQ ID NO: 191495 - protein, 9 aa, Tick-borne encephalitis virus
LVSGDDCVV

SEQ ID NO: 191496 - protein, 9 aa, Tick-borne encephalitis virus
VSGDDCVVR

SEQ ID NO: 191497 - protein, 9 aa, Tick-borne encephalitis virus
SGDDCVVRP

SEQ ID NO: 191498 - protein, 9 aa, Tick-borne encephalitis virus
GDDCVVRPV

SEQ ID NO: 191499 - protein, 9 aa, Tick-borne encephalitis virus
DDCVVRPVD

SEQ ID NO: 191500 - protein, 9 aa, Tick-borne encephalitis virus
DCVVRPVDD

SEQ ID NO: 191501 - protein, 9 aa, Tick-borne encephalitis virus
CVVRPVDDR

SEQ ID NO: 191502 - protein, 9 aa, Tick-borne encephalitis virus
VVRPVDDRF

SEQ ID NO: 191503 - protein, 9 aa, Tick-borne encephalitis virus
VRPVDDRFS

SEQ ID NO: 191504 - protein, 9 aa, Tick-borne encephalitis virus
DDRFGKALY

SEQ ID NO: 191505 - protein, 9 aa, Tick-borne encephalitis virus
DRFGKALYF

SEQ ID NO: 191506 - protein, 9 aa, Tick-borne encephalitis virus
RFGKALYFL

SEQ ID NO: 191507 - protein, 9 aa, Tick-borne encephalitis virus
FGKALYFLN

SEQ ID NO: 191508 - protein, 9 aa, Tick-borne encephalitis virus
GKALYFLND

SEQ ID NO: 191509 - protein, 9 aa, Tick-borne encephalitis virus
KALYFLNDM

SEQ ID NO: 191510 - protein, 9 aa, Tick-borne encephalitis virus
ALYFLNDMA

SEQ ID NO: 191511 - protein, 9 aa, Tick-borne encephalitis virus
LYFLNDMAK

SEQ ID NO: 191512 - protein, 9 aa, Tick-borne encephalitis virus
YFLNDMAKT

SEQ ID NO: 191513 - protein, 9 aa, Tick-borne encephalitis virus
FLNDMAKTR

SEQ ID NO: 191514 - protein, 9 aa, Tick-borne encephalitis virus
LNDMAKTRK

SEQ ID NO: 191515 - protein, 9 aa, Tick-borne encephalitis virus
NDMAKTRKD

SEQ ID NO: 191516 - protein, 9 aa, Tick-borne encephalitis virus
DMAKTRKDI

SEQ ID NO: 191517 - protein, 9 aa, Tick-borne encephalitis virus
MAKTRKDIG

SEQ ID NO: 191518 - protein, 9 aa, Tick-borne encephalitis virus
AKTRKDIGE

SEQ ID NO: 191519 - protein, 9 aa, Tick-borne encephalitis virus
KTRKDIGEW

SEQ ID NO: 191520 - protein, 9 aa, Tick-borne encephalitis virus
TRKDIGEWE

SEQ ID NO: 191521 - protein, 9 aa, Tick-borne encephalitis virus
RKDIGEWEH

SEQ ID NO: 191522 - protein, 9 aa, Tick-borne encephalitis virus
KDIGEWEHS

SEQ ID NO: 191523 - protein, 9 aa, Tick-borne encephalitis virus
DIGEWEHSV

SEQ ID NO: 191524 - protein, 9 aa, Tick-borne encephalitis virus
IGEWEHSVG

SEQ ID NO: 191525 - protein, 9 aa, Tick-borne encephalitis virus
GEWEHSVGF

SEQ ID NO: 191526 - protein, 9 aa, Tick-borne encephalitis virus
EWEHSVGFS

SEQ ID NO: 191527 - protein, 9 aa, Tick-borne encephalitis virus
NWEEVPFCS

SEQ ID NO: 191528 - protein, 9 aa, Tick-borne encephalitis virus
WEEVPFCSH

SEQ ID NO: 191529 - protein, 9 aa, Tick-borne encephalitis virus
EEVPFCSHH

SEQ ID NO: 191530 - protein, 9 aa, Tick-borne encephalitis virus
EVPFCSHHF

SEQ ID NO: 191531 - protein, 9 aa, Tick-borne encephalitis virus
VPFCSHHFH

SEQ ID NO: 191532 - protein, 9 aa, Tick-borne encephalitis virus
PFCSHHFHE

SEQ ID NO: 191533 - protein, 9 aa, Tick-borne encephalitis virus
FCSHHFHEL

SEQ ID NO: 191534 - protein, 9 aa, Tick-borne encephalitis virus
CSHHFHELV

SEQ ID NO: 191535 - protein, 9 aa, Tick-borne encephalitis virus
SHHFHELVM

SEQ ID NO: 191536 - protein, 9 aa, Tick-borne encephalitis virus
HHFHELVMK

SEQ ID NO: 191537 - protein, 9 aa, Tick-borne encephalitis virus
HFHELVMKD

SEQ ID NO: 191538 - protein, 9 aa, Tick-borne encephalitis virus
FHELVMKDG

SEQ ID NO: 191539 - protein, 9 aa, Tick-borne encephalitis virus
HELVMKDGR

SEQ ID NO: 191540 - protein, 9 aa, Tick-borne encephalitis virus
ELVMKDGRA

SEQ ID NO: 191541 - protein, 9 aa, Tick-borne encephalitis virus
LVMKDGRAL

SEQ ID NO: 191542 - protein, 9 aa, Tick-borne encephalitis virus
VMKDGRALI

SEQ ID NO: 191543 - protein, 9 aa, Tick-borne encephalitis virus
MKDGRALIV

SEQ ID NO: 191544 - protein, 9 aa, Tick-borne encephalitis virus
KDGRALIVP

SEQ ID NO: 191545 - protein, 9 aa, Tick-borne encephalitis virus
DGRALIVPC

SEQ ID NO: 191546 - protein, 9 aa, Tick-borne encephalitis virus
GRALIVPCR

SEQ ID NO: 191547 - protein, 9 aa, Tick-borne encephalitis virus
RALIVPCRD

SEQ ID NO: 191548 - protein, 9 aa, Tick-borne encephalitis virus
ALIVPCRDQ

SEQ ID NO: 191549 - protein, 9 aa, Tick-borne encephalitis virus
LIVPCRDQD

SEQ ID NO: 191550 - protein, 9 aa, Tick-borne encephalitis virus
IVPCRDQDE

SEQ ID NO: 191551 - protein, 9 aa, Tick-borne encephalitis virus
VPCRDQDEL

SEQ ID NO: 191552 - protein, 9 aa, Tick-borne encephalitis virus
PCRDQDELV

SEQ ID NO: 191553 - protein, 9 aa, Tick-borne encephalitis virus
CRDQDELVG

SEQ ID NO: 191554 - protein, 9 aa, Tick-borne encephalitis virus
RDQDELVGR

SEQ ID NO: 191555 - protein, 9 aa, Tick-borne encephalitis virus
DQDELVGRA

SEQ ID NO: 191556 - protein, 9 aa, Tick-borne encephalitis virus
QDELVGRAR

SEQ ID NO: 191557 - protein, 9 aa, Tick-borne encephalitis virus
DELVGRARV

SEQ ID NO: 191558 - protein, 9 aa, Tick-borne encephalitis virus
ELVGRARVS

SEQ ID NO: 191559 - protein, 9 aa, Tick-borne encephalitis virus
LVGRARVSP

SEQ ID NO: 191560 - protein, 9 aa, Tick-borne encephalitis virus
VGRARVSPG

SEQ ID NO: 191561 - protein, 9 aa, Tick-borne encephalitis virus
GRARVSPGC

SEQ ID NO: 191562 - protein, 9 aa, Tick-borne encephalitis virus
RARVSPGCG

SEQ ID NO: 191563 - protein, 9 aa, Tick-borne encephalitis virus
ARVSPGCGW

SEQ ID NO: 191564 - protein, 9 aa, Tick-borne encephalitis virus
RVSPGCGWS

SEQ ID NO: 191565 - protein, 9 aa, Tick-borne encephalitis virus
VSPGCGWSV

SEQ ID NO: 191566 - protein, 9 aa, Tick-borne encephalitis virus
SPGCGWSVR

SEQ ID NO: 191567 - protein, 9 aa, Tick-borne encephalitis virus
PGCGWSVRE

SEQ ID NO: 191568 - protein, 9 aa, Tick-borne encephalitis virus
GCGWSVRET

SEQ ID NO: 191569 - protein, 9 aa, Tick-borne encephalitis virus
CGWSVRETA

SEQ ID NO: 191570 - protein, 9 aa, Tick-borne encephalitis virus
GWSVRETAC

SEQ ID NO: 191571 - protein, 9 aa, Tick-borne encephalitis virus
WSVRETACL

SEQ ID NO: 191572 - protein, 9 aa, Tick-borne encephalitis virus
SVRETACLS

SEQ ID NO: 191573 - protein, 9 aa, Tick-borne encephalitis virus
VRETACLSK

SEQ ID NO: 191574 - protein, 9 aa, Tick-borne encephalitis virus
RETACLSKA

SEQ ID NO: 191575 - protein, 9 aa, Tick-borne encephalitis virus
ETACLSKAY

SEQ ID NO: 191576 - protein, 9 aa, Tick-borne encephalitis virus
TACLSKAYG

SEQ ID NO: 191577 - protein, 9 aa, Tick-borne encephalitis virus
ACLSKAYGQ

SEQ ID NO: 191578 - protein, 9 aa, Tick-borne encephalitis virus
CLSKAYGQM

SEQ ID NO: 191579 - protein, 9 aa, Tick-borne encephalitis virus
LSKAYGQMW

SEQ ID NO: 191580 - protein, 9 aa, Tick-borne encephalitis virus
SKAYGQMWL

SEQ ID NO: 191581 - protein, 9 aa, Tick-borne encephalitis virus
KAYGQMWLL

SEQ ID NO: 191582 - protein, 9 aa, Tick-borne encephalitis virus
AYGQMWLLS

SEQ ID NO: 191583 - protein, 9 aa, Tick-borne encephalitis virus
YGQMWLLSY

SEQ ID NO: 191584 - protein, 9 aa, Tick-borne encephalitis virus
GQMWLLSYF

SEQ ID NO: 191585 - protein, 9 aa, Tick-borne encephalitis virus
QMWLLSYFH

SEQ ID NO: 191586 - protein, 9 aa, Tick-borne encephalitis virus
MWLLSYFHR

SEQ ID NO: 191587 - protein, 9 aa, Tick-borne encephalitis virus
WLLSYFHRR

SEQ ID NO: 191588 - protein, 9 aa, Tick-borne encephalitis virus
LLSYFHRRD

SEQ ID NO: 191589 - protein, 9 aa, Tick-borne encephalitis virus
LSYFHRRDL

SEQ ID NO: 191590 - protein, 9 aa, Tick-borne encephalitis virus
SYFHRRDLR

SEQ ID NO: 191591 - protein, 9 aa, Tick-borne encephalitis virus
YFHRRDLRT

SEQ ID NO: 191592 - protein, 9 aa, Tick-borne encephalitis virus
FHRRDLRTL

SEQ ID NO: 191593 - protein, 9 aa, Tick-borne encephalitis virus
HRRDLRTLG

SEQ ID NO: 191594 - protein, 9 aa, Tick-borne encephalitis virus
RRDLRTLGL

SEQ ID NO: 191595 - protein, 9 aa, Tick-borne encephalitis virus
RDLRTLGLA

SEQ ID NO: 191596 - protein, 9 aa, Tick-borne encephalitis virus
DLRTLGLAI

SEQ ID NO: 191597 - protein, 9 aa, Tick-borne encephalitis virus
LRTLGLAIC

SEQ ID NO: 191598 - protein, 9 aa, Tick-borne encephalitis virus
RTLGLAICS

SEQ ID NO: 191599 - protein, 9 aa, Tick-borne encephalitis virus
TLGLAICSA

SEQ ID NO: 191600 - protein, 9 aa, Tick-borne encephalitis virus
LGLAICSAV

SEQ ID NO: 191601 - protein, 9 aa, Tick-borne encephalitis virus
GLAICSAVP

SEQ ID NO: 191602 - protein, 9 aa, Tick-borne encephalitis virus
SAVPVDWVP

SEQ ID NO: 191603 - protein, 9 aa, Tick-borne encephalitis virus
AVPVDWVPT

SEQ ID NO: 191604 - protein, 9 aa, Tick-borne encephalitis virus
VPVDWVPTG

SEQ ID NO: 191605 - protein, 9 aa, Tick-borne encephalitis virus
PVDWVPTGR

SEQ ID NO: 191606 - protein, 9 aa, Tick-borne encephalitis virus
VDWVPTGRT

SEQ ID NO: 191607 - protein, 9 aa, Tick-borne encephalitis virus
DWVPTGRTT

SEQ ID NO: 191608 - protein, 9 aa, Tick-borne encephalitis virus
WVPTGRTTW

SEQ ID NO: 191609 - protein, 9 aa, Tick-borne encephalitis virus
VPTGRTTWS

SEQ ID NO: 191610 - protein, 9 aa, Tick-borne encephalitis virus
PTGRTTWSI

SEQ ID NO: 191611 - protein, 9 aa, Tick-borne encephalitis virus
TGRTTWSIH

SEQ ID NO: 191612 - protein, 9 aa, Tick-borne encephalitis virus
GRTTWSIHA

SEQ ID NO: 191613 - protein, 9 aa, Tick-borne encephalitis virus
RTTWSIHAS

SEQ ID NO: 191614 - protein, 9 aa, Tick-borne encephalitis virus
TTWSIHASG

SEQ ID NO: 191615 - protein, 9 aa, Tick-borne encephalitis virus
TWSIHASGA

SEQ ID NO: 191616 - protein, 9 aa, Tick-borne encephalitis virus
WSIHASGAW

SEQ ID NO: 191617 - protein, 9 aa, Tick-borne encephalitis virus
SIHASGAWM

SEQ ID NO: 191618 - protein, 9 aa, Tick-borne encephalitis virus
IHASGAWMT

SEQ ID NO: 191619 - protein, 9 aa, Tick-borne encephalitis virus
HASGAWMTT

SEQ ID NO: 191620 - protein, 9 aa, Tick-borne encephalitis virus
ASGAWMTTE

SEQ ID NO: 191621 - protein, 9 aa, Tick-borne encephalitis virus
SGAWMTTED

SEQ ID NO: 191622 - protein, 9 aa, Tick-borne encephalitis virus
GAWMTTEDM

SEQ ID NO: 191623 - protein, 9 aa, Tick-borne encephalitis virus
AWMTTEDML

SEQ ID NO: 191624 - protein, 9 aa, Tick-borne encephalitis virus
WMTTEDMLD

SEQ ID NO: 191625 - protein, 9 aa, Tick-borne encephalitis virus
MTTEDMLDV

SEQ ID NO: 191626 - protein, 9 aa, Tick-borne encephalitis virus
TTEDMLDVW

SEQ ID NO: 191627 - protein, 9 aa, Tick-borne encephalitis virus
TEDMLDVWN

SEQ ID NO: 191628 - protein, 9 aa, Tick-borne encephalitis virus
EDMLDVWNR

SEQ ID NO: 191629 - protein, 9 aa, Tick-borne encephalitis virus
DMLDVWNRV

SEQ ID NO: 191630 - protein, 9 aa, Tick-borne encephalitis virus
MLDVWNRVW

SEQ ID NO: 191631 - protein, 9 aa, Tick-borne encephalitis virus
LDVWNRVWI

SEQ ID NO: 191632 - protein, 9 aa, Tick-borne encephalitis virus
DVWNRVWIL

SEQ ID NO: 191633 - protein, 9 aa, Tick-borne encephalitis virus
VWNRVWILD

SEQ ID NO: 191634 - protein, 9 aa, Tick-borne encephalitis virus
WNRVWILDN

SEQ ID NO: 191635 - protein, 9 aa, Tick-borne encephalitis virus
NRVWILDNP

SEQ ID NO: 191636 - protein, 9 aa, Tick-borne encephalitis virus
RVWILDNPF

SEQ ID NO: 191637 - protein, 9 aa, Tick-borne encephalitis virus
VWILDNPFM

SEQ ID NO: 191638 - protein, 9 aa, Tick-borne encephalitis virus
WILDNPFMH

SEQ ID NO: 191639 - protein, 9 aa, Tick-borne encephalitis virus
ILDNPFMHS

SEQ ID NO: 191640 - protein, 9 aa, Tick-borne encephalitis virus
LDNPFMHSK

SEQ ID NO: 191641 - protein, 9 aa, Tick-borne encephalitis virus
DNPFMHSKE

SEQ ID NO: 191642 - protein, 9 aa, Tick-borne encephalitis virus
NPFMHSKEK

SEQ ID NO: 191643 - protein, 9 aa, Tick-borne encephalitis virus
EWRDVPYLP

SEQ ID NO: 191644 - protein, 9 aa, Tick-borne encephalitis virus
WRDVPYLPK

SEQ ID NO: 191645 - protein, 9 aa, Tick-borne encephalitis virus
RDVPYLPKS

SEQ ID NO: 191646 - protein, 9 aa, Tick-borne encephalitis virus
VPYLPKSHD

SEQ ID NO: 191647 - protein, 9 aa, Tick-borne encephalitis virus
PYLPKSHDM

SEQ ID NO: 191648 - protein, 9 aa, Tick-borne encephalitis virus
YLPKSHDML

SEQ ID NO: 191649 - protein, 9 aa, Tick-borne encephalitis virus
LPKSHDMLC

SEQ ID NO: 191650 - protein, 9 aa, Tick-borne encephalitis virus
PKSHDMLCS

SEQ ID NO: 191651 - protein, 9 aa, Tick-borne encephalitis virus
KSHDMLCSS

SEQ ID NO: 191652 - protein, 9 aa, Tick-borne encephalitis virus
SHDMLCSSL

SEQ ID NO: 191653 - protein, 9 aa, Tick-borne encephalitis virus
HDMLCSSLV

SEQ ID NO: 191654 - protein, 9 aa, Tick-borne encephalitis virus
DMLCSSLVG

SEQ ID NO: 191655 - protein, 9 aa, Tick-borne encephalitis virus
MLCSSLVGR

SEQ ID NO: 191656 - protein, 9 aa, Tick-borne encephalitis virus
LCSSLVGRK

SEQ ID NO: 191657 - protein, 9 aa, Tick-borne encephalitis virus
CSSLVGRKE

SEQ ID NO: 191658 - protein, 9 aa, Tick-borne encephalitis virus
SSLVGRKER

SEQ ID NO: 191659 - protein, 9 aa, Tick-borne encephalitis virus
SLVGRKERA

SEQ ID NO: 191660 - protein, 9 aa, Tick-borne encephalitis virus
LVGRKERAE

SEQ ID NO: 191661 - protein, 9 aa, Tick-borne encephalitis virus
VGRKERAEW

SEQ ID NO: 191662 - protein, 9 aa, Tick-borne encephalitis virus
GRKERAEWA

SEQ ID NO: 191663 - protein, 9 aa, Tick-borne encephalitis virus
RKERAEWAK

SEQ ID NO: 191664 - protein, 9 aa, Tick-borne encephalitis virus
KERAEWAKN

SEQ ID NO: 191665 - protein, 9 aa, Tick-borne encephalitis virus
ERAEWAKNI

SEQ ID NO: 191666 - protein, 9 aa, Tick-borne encephalitis virus
RAEWAKNIW

SEQ ID NO: 191667 - protein, 9 aa, Tick-borne encephalitis virus
AEWAKNIWG

SEQ ID NO: 191668 - protein, 9 aa, Tick-borne encephalitis virus
EWAKNIWGA

SEQ ID NO: 191669 - protein, 9 aa, Tick-borne encephalitis virus
WAKNIWGAV

SEQ ID NO: 191670 - protein, 9 aa, Tick-borne encephalitis virus
AKNIWGAVE

SEQ ID NO: 191671 - protein, 9 aa, Tick-borne encephalitis virus
KNIWGAVEK

SEQ ID NO: 191672 - protein, 9 aa, Tick-borne encephalitis virus
NIWGAVEKV

SEQ ID NO: 191673 - protein, 9 aa, Tick-borne encephalitis virus
IWGAVEKVR

SEQ ID NO: 191674 - protein, 9 aa, Tick-borne encephalitis virus
WGAVEKVRK

SEQ ID NO: 191675 - protein, 9 aa, Tick-borne encephalitis virus
GAVEKVRKM

SEQ ID NO: 191676 - protein, 9 aa, Tick-borne encephalitis virus
AVEKVRKMI

SEQ ID NO: 191677 - protein, 9 aa, Tick-borne encephalitis virus
VEKVRKMIG

SEQ ID NO: 191678 - protein, 9 aa, Tick-borne encephalitis virus
KFKDYLSCM

SEQ ID NO: 191679 - protein, 9 aa, Tick-borne encephalitis virus
FKDYLSCMD

SEQ ID NO: 191680 - protein, 9 aa, Tick-borne encephalitis virus
KDYLSCMDR

SEQ ID NO: 191681 - protein, 9 aa, Tick-borne encephalitis virus
DYLSCMDRH

SEQ ID NO: 191682 - protein, 9 aa, Tick-borne encephalitis virus
YLSCMDRHD

SEQ ID NO: 191683 - protein, 9 aa, Tick-borne encephalitis virus
LSCMDRHDL

SEQ ID NO: 191684 - protein, 9 aa, Tick-borne encephalitis virus
SCMDRHDLH

SEQ ID NO: 191685 - protein, 9 aa, Tick-borne encephalitis virus
CMDRHDLHW

SEQ ID NO: 191686 - protein, 9 aa, Tick-borne encephalitis virus
MDRHDLHWE

SEQ ID NO: 191687 - protein, 9 aa, Tick-borne encephalitis virus
DRHDLHWEL

SEQ ID NO: 191688 - protein, 9 aa, Tick-borne encephalitis virus
RHDLHWELK

SEQ ID NO: 191689 - protein, 9 aa, Tick-borne encephalitis virus
HDLHWELKL

SEQ ID NO: 191690 - protein, 9 aa, Tick-borne encephalitis virus
DLHWELKLE

SEQ ID NO: 191691 - protein, 9 aa, Tick-borne encephalitis virus
LHWELKLES

SEQ ID NO: 191692 - protein, 9 aa, Tick-borne encephalitis virus
HWELKLESS

SEQ ID NO: 191693 - protein, 9 aa, Tick-borne encephalitis virus
WELKLESSI

SEQ ID NO: 191694 - protein, 9 aa, Tick-borne encephalitis virus
ELKLESSII

SEQ ID NO: 191695 - protein, 9 aa, Tick-borne encephalitis virus
MVKKAILKG

SEQ ID NO: 191696 - protein, 9 aa, Tick-borne encephalitis virus
VKKAILKGK

SEQ ID NO: 191697 - protein, 9 aa, Tick-borne encephalitis virus
KKAILKGKG

SEQ ID NO: 191698 - protein, 9 aa, Tick-borne encephalitis virus
KGGGPPRRA

SEQ ID NO: 191699 - protein, 9 aa, Tick-borne encephalitis virus
GGGPPRRAS

SEQ ID NO: 191700 - protein, 9 aa, Tick-borne encephalitis virus
GGPPRRASK

SEQ ID NO: 191701 - protein, 9 aa, Tick-borne encephalitis virus
GPPRRASKE

SEQ ID NO: 191702 - protein, 9 aa, Tick-borne encephalitis virus
PPRRVSKEA

SEQ ID NO: 191703 - protein, 9 aa, Tick-borne encephalitis virus
PRRASKETA

SEQ ID NO: 191704 - protein, 9 aa, Tick-borne encephalitis virus
RRVSKETAT

SEQ ID NO: 191705 - protein, 9 aa, Tick-borne encephalitis virus
RVSKETATK

SEQ ID NO: 191706 - protein, 9 aa, Tick-borne encephalitis virus
VSKETATKT

SEQ ID NO: 191707 - protein, 9 aa, Tick-borne encephalitis virus
SKETATKTR

SEQ ID NO: 191708 - protein, 9 aa, Tick-borne encephalitis virus
KETATKTRQ

SEQ ID NO: 191709 - protein, 9 aa, Tick-borne encephalitis virus
ETATKTRQP

SEQ ID NO: 191710 - protein, 9 aa, Tick-borne encephalitis virus
TATKTRQPR

SEQ ID NO: 191711 - protein, 9 aa, Tick-borne encephalitis virus
ATKTRQPRV

SEQ ID NO: 191712 - protein, 9 aa, Tick-borne encephalitis virus
KKTRQSRVR

SEQ ID NO: 191713 - protein, 9 aa, Tick-borne encephalitis virus
KTRQSRVRM

SEQ ID NO: 191714 - protein, 9 aa, Tick-borne encephalitis virus
TRQSRVRMP

SEQ ID NO: 191715 - protein, 9 aa, Tick-borne encephalitis virus
RQSRVRMPN

SEQ ID NO: 191716 - protein, 9 aa, Tick-borne encephalitis virus
QSRVRMPNG

SEQ ID NO: 191717 - protein, 9 aa, Tick-borne encephalitis virus
SRVRMPNGL

SEQ ID NO: 191718 - protein, 9 aa, Tick-borne encephalitis virus
RVRMPNGLV

SEQ ID NO: 191719 - protein, 9 aa, Tick-borne encephalitis virus
VRMPNGLVL

SEQ ID NO: 191720 - protein, 9 aa, Tick-borne encephalitis virus
RMPNGLVLM

SEQ ID NO: 191721 - protein, 9 aa, Tick-borne encephalitis virus
MPSGLVLMR

SEQ ID NO: 191722 - protein, 9 aa, Tick-borne encephalitis virus
PSGLVLMRM

SEQ ID NO: 191723 - protein, 9 aa, Tick-borne encephalitis virus
NGLVLMRML

SEQ ID NO: 191724 - protein, 9 aa, Tick-borne encephalitis virus
GLVLMRMLG

SEQ ID NO: 191725 - protein, 9 aa, Tick-borne encephalitis virus
LVLMRMLGI

SEQ ID NO: 191726 - protein, 9 aa, Tick-borne encephalitis virus
VLMRMLGIL

SEQ ID NO: 191727 - protein, 9 aa, Tick-borne encephalitis virus
LMRMLGILW

SEQ ID NO: 191728 - protein, 9 aa, Tick-borne encephalitis virus
MRMLGILWH

SEQ ID NO: 191729 - protein, 9 aa, Tick-borne encephalitis virus
RMLGILWHA

SEQ ID NO: 191730 - protein, 9 aa, Tick-borne encephalitis virus
MMGILWHAI

SEQ ID NO: 191731 - protein, 9 aa, Tick-borne encephalitis virus
MGILWHAIA

SEQ ID NO: 191732 - protein, 9 aa, Tick-borne encephalitis virus
GILWHAIAG

SEQ ID NO: 191733 - protein, 9 aa, Tick-borne encephalitis virus
ILWHAIAGT

SEQ ID NO: 191734 - protein, 9 aa, Tick-borne encephalitis virus
LWHAIAGTA

SEQ ID NO: 191735 - protein, 9 aa, Tick-borne encephalitis virus
WHAIAGTAR

SEQ ID NO: 191736 - protein, 9 aa, Tick-borne encephalitis virus
HAVAGTARN

SEQ ID NO: 191737 - protein, 9 aa, Tick-borne encephalitis virus
AVAGTARNP

SEQ ID NO: 191738 - protein, 9 aa, Tick-borne encephalitis virus
VAGTARNPV

SEQ ID NO: 191739 - protein, 9 aa, Tick-borne encephalitis virus
AGTARNPVL

SEQ ID NO: 191740 - protein, 9 aa, Tick-borne encephalitis virus
GTARNPVLK

SEQ ID NO: 191741 - protein, 9 aa, Tick-borne encephalitis virus
TARNPVLKA

SEQ ID NO: 191742 - protein, 9 aa, Tick-borne encephalitis virus
ARNPVLKAF

SEQ ID NO: 191743 - protein, 9 aa, Tick-borne encephalitis virus
RNPVLKAFW

SEQ ID NO: 191744 - protein, 9 aa, Tick-borne encephalitis virus
NPVLKAFWN

SEQ ID NO: 191745 - protein, 9 aa, Tick-borne encephalitis virus
PVLKAFWNS

SEQ ID NO: 191746 - protein, 9 aa, Tick-borne encephalitis virus
VLKAFWNSV

SEQ ID NO: 191747 - protein, 9 aa, Tick-borne encephalitis virus
LKAFWNSVP

SEQ ID NO: 191748 - protein, 9 aa, Tick-borne encephalitis virus
KAFWNSVPL

SEQ ID NO: 191749 - protein, 9 aa, Tick-borne encephalitis virus
SFWNSVPLR

SEQ ID NO: 191750 - protein, 9 aa, Tick-borne encephalitis virus
FWNSVPLRQ

SEQ ID NO: 191751 - protein, 9 aa, Tick-borne encephalitis virus
WNSVPLRQA

SEQ ID NO: 191752 - protein, 9 aa, Tick-borne encephalitis virus
NSVPLRQAT

SEQ ID NO: 191753 - protein, 9 aa, Tick-borne encephalitis virus
SVPLRQATA

SEQ ID NO: 191754 - protein, 9 aa, Tick-borne encephalitis virus
VPLRQATAA

SEQ ID NO: 191755 - protein, 9 aa, Tick-borne encephalitis virus
PLRQATAAL

SEQ ID NO: 191756 - protein, 9 aa, Tick-borne encephalitis virus
LRQATAALR

SEQ ID NO: 191757 - protein, 9 aa, Tick-borne encephalitis virus
RQATAALRK

SEQ ID NO: 191758 - protein, 9 aa, Tick-borne encephalitis virus
QAMAALRKI

SEQ ID NO: 191759 - protein, 9 aa, Tick-borne encephalitis virus
AMAALRKIK

SEQ ID NO: 191760 - protein, 9 aa, Tick-borne encephalitis virus
TAALRKIKR

SEQ ID NO: 191761 - protein, 9 aa, Tick-borne encephalitis virus
AALRKIKRT

SEQ ID NO: 191762 - protein, 9 aa, Tick-borne encephalitis virus
ALRKIKRTV

SEQ ID NO: 191763 - protein, 9 aa, Tick-borne encephalitis virus
LRKIKRTVS

SEQ ID NO: 191764 - protein, 9 aa, Tick-borne encephalitis virus
RKIKRTVSA

SEQ ID NO: 191765 - protein, 9 aa, Tick-borne encephalitis virus
KIKRTVSAL

SEQ ID NO: 191766 - protein, 9 aa, Tick-borne encephalitis virus
IKRTVSALM

SEQ ID NO: 191767 - protein, 9 aa, Tick-borne encephalitis virus
TVSALMVGL

SEQ ID NO: 191768 - protein, 9 aa, Tick-borne encephalitis virus
VSALMVGLQ

SEQ ID NO: 191769 - protein, 9 aa, Tick-borne encephalitis virus
LMVGLQKRG

SEQ ID NO: 191770 - protein, 9 aa, Tick-borne encephalitis virus
MVGLQKRGK

SEQ ID NO: 191771 - protein, 9 aa, Tick-borne encephalitis virus
VGLQKRGKR

SEQ ID NO: 191772 - protein, 9 aa, Tick-borne encephalitis virus
GLQKRGKRR

SEQ ID NO: 191773 - protein, 9 aa, Tick-borne encephalitis virus
LQKRGKRRS

SEQ ID NO: 191774 - protein, 9 aa, Tick-borne encephalitis virus
QKRGKRRSA

SEQ ID NO: 191775 - protein, 9 aa, Tick-borne encephalitis virus
AFAATVRRE

SEQ ID NO: 191776 - protein, 9 aa, Tick-borne encephalitis virus
LAATVRKEG

SEQ ID NO: 191777 - protein, 9 aa, Tick-borne encephalitis virus
AATVRKEGD

SEQ ID NO: 191778 - protein, 9 aa, Tick-borne encephalitis virus
ATVRKEGDG

SEQ ID NO: 191779 - protein, 9 aa, Tick-borne encephalitis virus
TVRKERDGS

SEQ ID NO: 191780 - protein, 9 aa, Tick-borne encephalitis virus
VRKERDGST

SEQ ID NO: 191781 - protein, 9 aa, Tick-borne encephalitis virus
RKERDGSTV

SEQ ID NO: 191782 - protein, 9 aa, Tick-borne encephalitis virus
KERDGSTVI

SEQ ID NO: 191783 - protein, 9 aa, Tick-borne encephalitis virus
ERDGSTVIR

SEQ ID NO: 191784 - protein, 9 aa, Tick-borne encephalitis virus
RDGSTVIRA

SEQ ID NO: 191785 - protein, 9 aa, Tick-borne encephalitis virus
DGSTVIRAE

SEQ ID NO: 191786 - protein, 9 aa, Tick-borne encephalitis virus
GSTVIRAEG

SEQ ID NO: 191787 - protein, 9 aa, Tick-borne encephalitis virus
STVIRAEGK

SEQ ID NO: 191788 - protein, 9 aa, Tick-borne encephalitis virus
TVIRAEGRD

SEQ ID NO: 191789 - protein, 9 aa, Tick-borne encephalitis virus
VIRAEGRDA

SEQ ID NO: 191790 - protein, 9 aa, Tick-borne encephalitis virus
IRAEGRDAA

SEQ ID NO: 191791 - protein, 9 aa, Tick-borne encephalitis virus
RAEGRDAAT

SEQ ID NO: 191792 - protein, 9 aa, Tick-borne encephalitis virus
AEGRDAATQ

SEQ ID NO: 191793 - protein, 9 aa, Tick-borne encephalitis virus
EGRDAATQV

SEQ ID NO: 191794 - protein, 9 aa, Tick-borne encephalitis virus
GRDAATQVR

SEQ ID NO: 191795 - protein, 9 aa, Tick-borne encephalitis virus
RDAATQVRV

SEQ ID NO: 191796 - protein, 9 aa, Tick-borne encephalitis virus
VENGTCVIM

SEQ ID NO: 191797 - protein, 9 aa, Tick-borne encephalitis virus
ENGTCVILV

SEQ ID NO: 191798 - protein, 9 aa, Tick-borne encephalitis virus
NGTCVILVT

SEQ ID NO: 191799 - protein, 9 aa, Tick-borne encephalitis virus
GTCVILVTD

SEQ ID NO: 191800 - protein, 9 aa, Tick-borne encephalitis virus
TCVILVTDM

SEQ ID NO: 191801 - protein, 9 aa, Tick-borne encephalitis virus
CVILVTDMG

SEQ ID NO: 191802 - protein, 9 aa, Tick-borne encephalitis virus
VILVTDMGS

SEQ ID NO: 191803 - protein, 9 aa, Tick-borne encephalitis virus
ILVTDMGSW

SEQ ID NO: 191804 - protein, 9 aa, Tick-borne encephalitis virus
LVTDMGSWC

SEQ ID NO: 191805 - protein, 9 aa, Tick-borne encephalitis virus
VTDMGSWCD

SEQ ID NO: 191806 - protein, 9 aa, Tick-borne encephalitis virus
TDMGAWCDD

SEQ ID NO: 191807 - protein, 9 aa, Tick-borne encephalitis virus
DMGAWCDDS

SEQ ID NO: 191808 - protein, 9 aa, Tick-borne encephalitis virus
MGAWCDDSL

SEQ ID NO: 191809 - protein, 9 aa, Tick-borne encephalitis virus
GSWCDDSLS

SEQ ID NO: 191810 - protein, 9 aa, Tick-borne encephalitis virus
SWCDDSLSY

SEQ ID NO: 191811 - protein, 9 aa, Tick-borne encephalitis virus
WCDDSLSYE

SEQ ID NO: 191812 - protein, 9 aa, Tick-borne encephalitis virus
CDDSLSYEC

SEQ ID NO: 191813 - protein, 9 aa, Tick-borne encephalitis virus
DDSLSYECV

SEQ ID NO: 191814 - protein, 9 aa, Tick-borne encephalitis virus
DSLSYECVT

SEQ ID NO: 191815 - protein, 9 aa, Tick-borne encephalitis virus
SLSYECVTI

SEQ ID NO: 191816 - protein, 9 aa, Tick-borne encephalitis virus
LSYECVTID

SEQ ID NO: 191817 - protein, 9 aa, Tick-borne encephalitis virus
SYECVTIDQ

SEQ ID NO: 191818 - protein, 9 aa, Tick-borne encephalitis virus
DCFCRNVDR

SEQ ID NO: 191819 - protein, 9 aa, Tick-borne encephalitis virus
CFCRNVDRV

SEQ ID NO: 191820 - protein, 9 aa, Tick-borne encephalitis virus
FCRNVDGVH

SEQ ID NO: 191821 - protein, 9 aa, Tick-borne encephalitis virus
CRNVDGVHL

SEQ ID NO: 191822 - protein, 9 aa, Tick-borne encephalitis virus
RNVDGVHLE

SEQ ID NO: 191823 - protein, 9 aa, Tick-borne encephalitis virus
NVDGVHLEY

SEQ ID NO: 191824 - protein, 9 aa, Tick-borne encephalitis virus
VDGVHLEYG

SEQ ID NO: 191825 - protein, 9 aa, Tick-borne encephalitis virus
DGVHLEYGR

SEQ ID NO: 191826 - protein, 9 aa, Tick-borne encephalitis virus
GVHLEYGRC

SEQ ID NO: 191827 - protein, 9 aa, Tick-borne encephalitis virus
VHLEYGRCG

SEQ ID NO: 191828 - protein, 9 aa, Tick-borne encephalitis virus
HLEYGRCGK

SEQ ID NO: 191829 - protein, 9 aa, Tick-borne encephalitis virus
RTRRSVLIR

SEQ ID NO: 191830 - protein, 9 aa, Tick-borne encephalitis virus
TRRSVLIRS

SEQ ID NO: 191831 - protein, 9 aa, Tick-borne encephalitis virus
RRSVLIRSH

SEQ ID NO: 191832 - protein, 9 aa, Tick-borne encephalitis virus
RSVLIRSHA

SEQ ID NO: 191833 - protein, 9 aa, Tick-borne encephalitis virus
SVLIRSHAQ

SEQ ID NO: 191834 - protein, 9 aa, Tick-borne encephalitis virus
VLIRSHAQG

SEQ ID NO: 191835 - protein, 9 aa, Tick-borne encephalitis virus
LIPSHAQGE

SEQ ID NO: 191836 - protein, 9 aa, Tick-borne encephalitis virus
IPSHAQGEL

SEQ ID NO: 191837 - protein, 9 aa, Tick-borne encephalitis virus
PSHAQGELT

SEQ ID NO: 191838 - protein, 9 aa, Tick-borne encephalitis virus
SHAQGELTG

SEQ ID NO: 191839 - protein, 9 aa, Tick-borne encephalitis virus
HAQGELTGR

SEQ ID NO: 191840 - protein, 9 aa, Tick-borne encephalitis virus
AQGELTGRG

SEQ ID NO: 191841 - protein, 9 aa, Tick-borne encephalitis virus
QGELTGRGH

SEQ ID NO: 191842 - protein, 9 aa, Tick-borne encephalitis virus
GELTGRGHK

SEQ ID NO: 191843 - protein, 9 aa, Tick-borne encephalitis virus
ELTGRGHKW

SEQ ID NO: 191844 - protein, 9 aa, Tick-borne encephalitis virus
LTGRGRKWL

SEQ ID NO: 191845 - protein, 9 aa, Tick-borne encephalitis virus
TGRGRKWLE

SEQ ID NO: 191846 - protein, 9 aa, Tick-borne encephalitis virus
GRGRKWLEG

SEQ ID NO: 191847 - protein, 9 aa, Tick-borne encephalitis virus
RGRKWLEGD

SEQ ID NO: 191848 - protein, 9 aa, Tick-borne encephalitis virus
GRKWLEGDS

SEQ ID NO: 191849 - protein, 9 aa, Tick-borne encephalitis virus
RKWLEGDSL

SEQ ID NO: 191850 - protein, 9 aa, Tick-borne encephalitis virus
VEGWVWKNR

SEQ ID NO: 191851 - protein, 9 aa, Tick-borne encephalitis virus
VVWLTLESV

SEQ ID NO: 191852 - protein, 9 aa, Tick-borne encephalitis virus
VWLTLESVV

SEQ ID NO: 191853 - protein, 9 aa, Tick-borne encephalitis virus
WLTLESVVT

SEQ ID NO: 191854 - protein, 9 aa, Tick-borne encephalitis virus
LTLESVVTR

SEQ ID NO: 191855 - protein, 9 aa, Tick-borne encephalitis virus
TLESVVTRV

SEQ ID NO: 191856 - protein, 9 aa, Tick-borne encephalitis virus
LVVLLCLAP

SEQ ID NO: 191857 - protein, 9 aa, Tick-borne encephalitis virus
VVLFCLAPV

SEQ ID NO: 191858 - protein, 9 aa, Tick-borne encephalitis virus
ALLCLAPVY

SEQ ID NO: 191859 - protein, 9 aa, Tick-borne encephalitis virus
LFCLAPVYA

SEQ ID NO: 191860 - protein, 9 aa, Tick-borne encephalitis virus
FCLAPVYAS

SEQ ID NO: 191861 - protein, 9 aa, Tick-borne encephalitis virus
PSMDVWLDA

SEQ ID NO: 191862 - protein, 9 aa, Tick-borne encephalitis virus
SMDVWLDAI

SEQ ID NO: 191863 - protein, 9 aa, Tick-borne encephalitis virus
MDVWLDAIY

SEQ ID NO: 191864 - protein, 9 aa, Tick-borne encephalitis virus
DVWLDAIYQ

SEQ ID NO: 191865 - protein, 9 aa, Tick-borne encephalitis virus
VWLDAIYQE

SEQ ID NO: 191866 - protein, 9 aa, Tick-borne encephalitis virus
WLDAIYQEN

SEQ ID NO: 191867 - protein, 9 aa, Tick-borne encephalitis virus
LDAIYQENP

SEQ ID NO: 191868 - protein, 9 aa, Tick-borne encephalitis virus
DAIYQENPA

SEQ ID NO: 191869 - protein, 9 aa, Tick-borne encephalitis virus
AIYQENPAK

SEQ ID NO: 191870 - protein, 9 aa, Tick-borne encephalitis virus
IYQESPAKT

SEQ ID NO: 191871 - protein, 9 aa, Tick-borne encephalitis virus
YQESPAKTR

SEQ ID NO: 191872 - protein, 9 aa, Tick-borne encephalitis virus
QESPAKTRE

SEQ ID NO: 191873 - protein, 9 aa, Tick-borne encephalitis virus
ESPAKTREY

SEQ ID NO: 191874 - protein, 9 aa, Tick-borne encephalitis virus
SPAKTREYC

SEQ ID NO: 191875 - protein, 9 aa, Tick-borne encephalitis virus
PAQTREYCL

SEQ ID NO: 191876 - protein, 9 aa, Tick-borne encephalitis virus
AQTREYCLH

SEQ ID NO: 191877 - protein, 9 aa, Tick-borne encephalitis virus
KTREYCLHV

SEQ ID NO: 191878 - protein, 9 aa, Tick-borne encephalitis virus
TREYCLHVK

SEQ ID NO: 191879 - protein, 9 aa, Tick-borne encephalitis virus
REYCLHVKL

SEQ ID NO: 191880 - protein, 9 aa, Tick-borne encephalitis virus
EYCLHVKLS

SEQ ID NO: 191881 - protein, 9 aa, Tick-borne encephalitis virus
YCLHVKLSD

SEQ ID NO: 191882 - protein, 9 aa, Tick-borne encephalitis virus
CLHVKLSDT

SEQ ID NO: 191883 - protein, 9 aa, Tick-borne encephalitis virus
LHVKLSDTK

SEQ ID NO: 191884 - protein, 9 aa, Tick-borne encephalitis virus
HVKLSDTKV

SEQ ID NO: 191885 - protein, 9 aa, Tick-borne encephalitis virus
VKLSDTKVA

SEQ ID NO: 191886 - protein, 9 aa, Tick-borne encephalitis virus
KVAARCPTT

SEQ ID NO: 191887 - protein, 9 aa, Tick-borne encephalitis virus
VAARCPTTG

SEQ ID NO: 191888 - protein, 9 aa, Tick-borne encephalitis virus
AARCPTTGP

SEQ ID NO: 191889 - protein, 9 aa, Tick-borne encephalitis virus
ARCPTTGPA

SEQ ID NO: 191890 - protein, 9 aa, Tick-borne encephalitis virus
RCPTTGPAT

SEQ ID NO: 191891 - protein, 9 aa, Tick-borne encephalitis virus
CPTTGPATL

SEQ ID NO: 191892 - protein, 9 aa, Tick-borne encephalitis virus
PTTGPATLA

SEQ ID NO: 191893 - protein, 9 aa, Tick-borne encephalitis virus
TMGPATLTE

SEQ ID NO: 191894 - protein, 9 aa, Tick-borne encephalitis virus
TGPATLAEQ

SEQ ID NO: 191895 - protein, 9 aa, Tick-borne encephalitis virus
GPATLAEQH

SEQ ID NO: 191896 - protein, 9 aa, Tick-borne encephalitis virus
PATLTEEHQ

SEQ ID NO: 191897 - protein, 9 aa, Tick-borne encephalitis virus
ATLAEEHQG

SEQ ID NO: 191898 - protein, 9 aa, Tick-borne encephalitis virus
TLAEEHQGG

SEQ ID NO: 191899 - protein, 9 aa, Tick-borne encephalitis virus
LAEEHQGGT

SEQ ID NO: 191900 - protein, 9 aa, Tick-borne encephalitis virus
AEEHQGGTV

SEQ ID NO: 191901 - protein, 9 aa, Tick-borne encephalitis virus
EEHQGGTVC

SEQ ID NO: 191902 - protein, 9 aa, Tick-borne encephalitis virus
EHQGGTVCK

SEQ ID NO: 191903 - protein, 9 aa, Tick-borne encephalitis virus
HQGGTVCKR

SEQ ID NO: 191904 - protein, 9 aa, Tick-borne encephalitis virus
QGGTVCKRD

SEQ ID NO: 191905 - protein, 9 aa, Tick-borne encephalitis virus
GGTVCKRDQ

SEQ ID NO: 191906 - protein, 9 aa, Tick-borne encephalitis virus
LFGKGSIVA

SEQ ID NO: 191907 - protein, 9 aa, Tick-borne encephalitis virus
FGKGSIVAC

SEQ ID NO: 191908 - protein, 9 aa, Tick-borne encephalitis virus
GKGSIVACV

SEQ ID NO: 191909 - protein, 9 aa, Tick-borne encephalitis virus
KGSIVACVK

SEQ ID NO: 191910 - protein, 9 aa, Tick-borne encephalitis virus
GSIVACVKA

SEQ ID NO: 191911 - protein, 9 aa, Tick-borne encephalitis virus
SIVACVKAA

SEQ ID NO: 191912 - protein, 9 aa, Tick-borne encephalitis virus
IVACVKAAC

SEQ ID NO: 191913 - protein, 9 aa, Tick-borne encephalitis virus
VACVKAACE

SEQ ID NO: 191914 - protein, 9 aa, Tick-borne encephalitis virus
ACVKAACEA

SEQ ID NO: 191915 - protein, 9 aa, Tick-borne encephalitis virus
CVKAACEAK

SEQ ID NO: 191916 - protein, 9 aa, Tick-borne encephalitis virus
VKAACEAKK

SEQ ID NO: 191917 - protein, 9 aa, Tick-borne encephalitis virus
KAACEAKKK

SEQ ID NO: 191918 - protein, 9 aa, Tick-borne encephalitis virus
AACEAKKKA

SEQ ID NO: 191919 - protein, 9 aa, Tick-borne encephalitis virus
ACEAKKKAT

SEQ ID NO: 191920 - protein, 9 aa, Tick-borne encephalitis virus
KATGHVYDP

SEQ ID NO: 191921 - protein, 9 aa, Tick-borne encephalitis virus
ATGHVYDPN

SEQ ID NO: 191922 - protein, 9 aa, Tick-borne encephalitis virus
TGHVYDANR

SEQ ID NO: 191923 - protein, 9 aa, Tick-borne encephalitis virus
GHVYDANRI

SEQ ID NO: 191924 - protein, 9 aa, Tick-borne encephalitis virus
HVYDPNKIV

SEQ ID NO: 191925 - protein, 9 aa, Tick-borne encephalitis virus
VYDPNKIVY

SEQ ID NO: 191926 - protein, 9 aa, Tick-borne encephalitis virus
YDANRIVYT

SEQ ID NO: 191927 - protein, 9 aa, Tick-borne encephalitis virus
DANKIVYTI

SEQ ID NO: 191928 - protein, 9 aa, Tick-borne encephalitis virus
ANRIVYTVK

SEQ ID NO: 191929 - protein, 9 aa, Tick-borne encephalitis virus
NKIVYPVKV

SEQ ID NO: 191930 - protein, 9 aa, Tick-borne encephalitis virus
KIVYTIKVE

SEQ ID NO: 191931 - protein, 9 aa, Tick-borne encephalitis virus
IVYTIKVEP

SEQ ID NO: 191932 - protein, 9 aa, Tick-borne encephalitis virus
VYPVKVEPH

SEQ ID NO: 191933 - protein, 9 aa, Tick-borne encephalitis virus
YTIKVEPHT

SEQ ID NO: 191934 - protein, 9 aa, Tick-borne encephalitis virus
PVKVEPHTG

SEQ ID NO: 191935 - protein, 9 aa, Tick-borne encephalitis virus
IKVEPHTGD

SEQ ID NO: 191936 - protein, 9 aa, Tick-borne encephalitis virus
PHTGDYVAV

SEQ ID NO: 191937 - protein, 9 aa, Tick-borne encephalitis virus
HTGDYVAPH

SEQ ID NO: 191938 - protein, 9 aa, Tick-borne encephalitis virus
TGDYVAVNE

SEQ ID NO: 191939 - protein, 9 aa, Tick-borne encephalitis virus
GDYVAPHET

SEQ ID NO: 191940 - protein, 9 aa, Tick-borne encephalitis virus
DYVAVNETH

SEQ ID NO: 191941 - protein, 9 aa, Tick-borne encephalitis virus
YVAPHETHS

SEQ ID NO: 191942 - protein, 9 aa, Tick-borne encephalitis virus
VAPHETHSG

SEQ ID NO: 191943 - protein, 9 aa, Tick-borne encephalitis virus
APHETHSGR

SEQ ID NO: 191944 - protein, 9 aa, Tick-borne encephalitis virus
PHETHSGRK

SEQ ID NO: 191945 - protein, 9 aa, Tick-borne encephalitis virus
HETHSGRKT

SEQ ID NO: 191946 - protein, 9 aa, Tick-borne encephalitis virus
ETHSGRKTP

SEQ ID NO: 191947 - protein, 9 aa, Tick-borne encephalitis virus
THSGRKTPS

SEQ ID NO: 191948 - protein, 9 aa, Tick-borne encephalitis virus
HSGRKTPSF

SEQ ID NO: 191949 - protein, 9 aa, Tick-borne encephalitis virus
SGRKTPSFT

SEQ ID NO: 191950 - protein, 9 aa, Tick-borne encephalitis virus
GRKTASFTI

SEQ ID NO: 191951 - protein, 9 aa, Tick-borne encephalitis virus
RKTASFTIS

SEQ ID NO: 191952 - protein, 9 aa, Tick-borne encephalitis virus
KTASFTISS

SEQ ID NO: 191953 - protein, 9 aa, Tick-borne encephalitis virus
TASFTISSE

SEQ ID NO: 191954 - protein, 9 aa, Tick-borne encephalitis virus
ASFTISSEK

SEQ ID NO: 191955 - protein, 9 aa, Tick-borne encephalitis virus
SFTISSEKT

SEQ ID NO: 191956 - protein, 9 aa, Tick-borne encephalitis virus
FTISSEKTI

SEQ ID NO: 191957 - protein, 9 aa, Tick-borne encephalitis virus
TISSEKTIL

SEQ ID NO: 191958 - protein, 9 aa, Tick-borne encephalitis virus
ISSEKTILT

SEQ ID NO: 191959 - protein, 9 aa, Tick-borne encephalitis virus
SSEKTILNM

SEQ ID NO: 191960 - protein, 9 aa, Tick-borne encephalitis virus
SEKTILNMG

SEQ ID NO: 191961 - protein, 9 aa, Tick-borne encephalitis virus
EKTILTMGE

SEQ ID NO: 191962 - protein, 9 aa, Tick-borne encephalitis virus
KTILTMGEY

SEQ ID NO: 191963 - protein, 9 aa, Tick-borne encephalitis virus
TILTMGEYG

SEQ ID NO: 191964 - protein, 9 aa, Tick-borne encephalitis virus
ILTMGEYGD

SEQ ID NO: 191965 - protein, 9 aa, Tick-borne encephalitis virus
LTMGEYGDV

SEQ ID NO: 191966 - protein, 9 aa, Tick-borne encephalitis virus
TMGEYGDVS

SEQ ID NO: 191967 - protein, 9 aa, Tick-borne encephalitis virus
MGEYGDVSL

SEQ ID NO: 191968 - protein, 9 aa, Tick-borne encephalitis virus
GEYGDVSLL

SEQ ID NO: 191969 - protein, 9 aa, Tick-borne encephalitis virus
EYGDVSLLC

SEQ ID NO: 191970 - protein, 9 aa, Tick-borne encephalitis virus
YGDVSLLCK

SEQ ID NO: 191971 - protein, 9 aa, Tick-borne encephalitis virus
GDVSLLCKV

SEQ ID NO: 191972 - protein, 9 aa, Tick-borne encephalitis virus
DVSLLCKVP

SEQ ID NO: 191973 - protein, 9 aa, Tick-borne encephalitis virus
VSLLCKVPS

SEQ ID NO: 191974 - protein, 9 aa, Tick-borne encephalitis virus
SLLCKVPSG

SEQ ID NO: 191975 - protein, 9 aa, Tick-borne encephalitis virus
LLCKVPSGV

SEQ ID NO: 191976 - protein, 9 aa, Tick-borne encephalitis virus
LCKVPSGVD

SEQ ID NO: 191977 - protein, 9 aa, Tick-borne encephalitis virus
CKVPSGVDL

SEQ ID NO: 191978 - protein, 9 aa, Tick-borne encephalitis virus
KVPSGVDLA

SEQ ID NO: 191979 - protein, 9 aa, Tick-borne encephalitis virus
VPSGVDLAQ

SEQ ID NO: 191980 - protein, 9 aa, Tick-borne encephalitis virus
PSGVDLAQT

SEQ ID NO: 191981 - protein, 9 aa, Tick-borne encephalitis virus
VILELDKTV

SEQ ID NO: 191982 - protein, 9 aa, Tick-borne encephalitis virus
ILELDKTVE

SEQ ID NO: 191983 - protein, 9 aa, Tick-borne encephalitis virus
LELDKTVEH

SEQ ID NO: 191984 - protein, 9 aa, Tick-borne encephalitis virus
ELDKTVEHL

SEQ ID NO: 191985 - protein, 9 aa, Tick-borne encephalitis virus
LDKTVEHLP

SEQ ID NO: 191986 - protein, 9 aa, Tick-borne encephalitis virus
DKTVEHLPT

SEQ ID NO: 191987 - protein, 9 aa, Tick-borne encephalitis virus
KTVEHLPTA

SEQ ID NO: 191988 - protein, 9 aa, Tick-borne encephalitis virus
TVEHLPTAW

SEQ ID NO: 191989 - protein, 9 aa, Tick-borne encephalitis virus
VEHLPTAWQ

SEQ ID NO: 191990 - protein, 9 aa, Tick-borne encephalitis virus
HLPTAWQVR

SEQ ID NO: 191991 - protein, 9 aa, Tick-borne encephalitis virus
LPTAWQVRR

SEQ ID NO: 191992 - protein, 9 aa, Tick-borne encephalitis virus
PTAWQVRRD

SEQ ID NO: 191993 - protein, 9 aa, Tick-borne encephalitis virus
TAWQVRRDW

SEQ ID NO: 191994 - protein, 9 aa, Tick-borne encephalitis virus
AWQVRRDWF

SEQ ID NO: 191995 - protein, 9 aa, Tick-borne encephalitis virus
WQVRRDWFN

SEQ ID NO: 191996 - protein, 9 aa, Tick-borne encephalitis virus
QVRRDWFND

SEQ ID NO: 191997 - protein, 9 aa, Tick-borne encephalitis virus
VRRDWFNDL

SEQ ID NO: 191998 - protein, 9 aa, Tick-borne encephalitis virus
RRDWFNDLA

SEQ ID NO: 191999 - protein, 9 aa, Tick-borne encephalitis virus
FNDLALPWR

SEQ ID NO: 192000 - protein, 9 aa, Tick-borne encephalitis virus
NDLALPWRH

SEQ ID NO: 192001 - protein, 9 aa, Tick-borne encephalitis virus
DLALPWRHE

SEQ ID NO: 192002 - protein, 9 aa, Tick-borne encephalitis virus
LALPWRHEG

SEQ ID NO: 192003 - protein, 9 aa, Tick-borne encephalitis virus
ALPWRHEGA

SEQ ID NO: 192004 - protein, 9 aa, Tick-borne encephalitis virus
LPWRHEGAQ

SEQ ID NO: 192005 - protein, 9 aa, Tick-borne encephalitis virus
HEGAQQWNN

SEQ ID NO: 192006 - protein, 9 aa, Tick-borne encephalitis virus
EGAQQWNNA

SEQ ID NO: 192007 - protein, 9 aa, Tick-borne encephalitis virus
GAQQWNNAE

SEQ ID NO: 192008 - protein, 9 aa, Tick-borne encephalitis virus
AQQWNNAER

SEQ ID NO: 192009 - protein, 9 aa, Tick-borne encephalitis virus
QQWNNAERL

SEQ ID NO: 192010 - protein, 9 aa, Tick-borne encephalitis virus
QWNNAERLV

SEQ ID NO: 192011 - protein, 9 aa, Tick-borne encephalitis virus
AERLVEFGV

SEQ ID NO: 192012 - protein, 9 aa, Tick-borne encephalitis virus
ERLVEFGVP

SEQ ID NO: 192013 - protein, 9 aa, Tick-borne encephalitis virus
RLVEFGVPH

SEQ ID NO: 192014 - protein, 9 aa, Tick-borne encephalitis virus
LVEFGVPHA

SEQ ID NO: 192015 - protein, 9 aa, Tick-borne encephalitis virus
VEFGVPHAV

SEQ ID NO: 192016 - protein, 9 aa, Tick-borne encephalitis virus
EFGVPHAVK

SEQ ID NO: 192017 - protein, 9 aa, Tick-borne encephalitis virus
FGVPHAVKM

SEQ ID NO: 192018 - protein, 9 aa, Tick-borne encephalitis virus
GVPHAVKMD

SEQ ID NO: 192019 - protein, 9 aa, Tick-borne encephalitis virus
VPHAVKMDV

SEQ ID NO: 192020 - protein, 9 aa, Tick-borne encephalitis virus
DQTGVLLKA

SEQ ID NO: 192021 - protein, 9 aa, Tick-borne encephalitis virus
QTGVLLKAL

SEQ ID NO: 192022 - protein, 9 aa, Tick-borne encephalitis virus
TGVLLKALA

SEQ ID NO: 192023 - protein, 9 aa, Tick-borne encephalitis virus
GVLLKALAG

SEQ ID NO: 192024 - protein, 9 aa, Tick-borne encephalitis virus
VLLKALAGV

SEQ ID NO: 192025 - protein, 9 aa, Tick-borne encephalitis virus
LLKALAGVP

SEQ ID NO: 192026 - protein, 9 aa, Tick-borne encephalitis virus
LKALAGVPV

SEQ ID NO: 192027 - protein, 9 aa, Tick-borne encephalitis virus
KALAGVPVA

SEQ ID NO: 192028 - protein, 9 aa, Tick-borne encephalitis virus
ALAGVPVAH

SEQ ID NO: 192029 - protein, 9 aa, Tick-borne encephalitis virus
AGVPVAHIE

SEQ ID NO: 192030 - protein, 9 aa, Tick-borne encephalitis virus
GVPVAHIEG

SEQ ID NO: 192031 - protein, 9 aa, Tick-borne encephalitis virus
VPVAHIEGT

SEQ ID NO: 192032 - protein, 9 aa, Tick-borne encephalitis virus
PVAHIEGTK

SEQ ID NO: 192033 - protein, 9 aa, Tick-borne encephalitis virus
VAHIEGTKY

SEQ ID NO: 192034 - protein, 9 aa, Tick-borne encephalitis virus
AHIEGTKYH

SEQ ID NO: 192035 - protein, 9 aa, Tick-borne encephalitis virus
HIEGTKYHL

SEQ ID NO: 192036 - protein, 9 aa, Tick-borne encephalitis virus
IEGTKYHLK

SEQ ID NO: 192037 - protein, 9 aa, Tick-borne encephalitis virus
EGTKYHLKS

SEQ ID NO: 192038 - protein, 9 aa, Tick-borne encephalitis virus
GAKYHLKSG

SEQ ID NO: 192039 - protein, 9 aa, Tick-borne encephalitis virus
AKYHLKSGH

SEQ ID NO: 192040 - protein, 9 aa, Tick-borne encephalitis virus
VGLEKLKMN

SEQ ID NO: 192041 - protein, 9 aa, Tick-borne encephalitis virus
GLEKLKMNG

SEQ ID NO: 192042 - protein, 9 aa, Tick-borne encephalitis virus
LEKLKMNGL

SEQ ID NO: 192043 - protein, 9 aa, Tick-borne encephalitis virus
EKLKMNGLT

SEQ ID NO: 192044 - protein, 9 aa, Tick-borne encephalitis virus
KLKMNGLTY

SEQ ID NO: 192045 - protein, 9 aa, Tick-borne encephalitis virus
LKMNGLTYT

SEQ ID NO: 192046 - protein, 9 aa, Tick-borne encephalitis virus
KMKGLTYTV

SEQ ID NO: 192047 - protein, 9 aa, Tick-borne encephalitis virus
MKGLTYTVC

SEQ ID NO: 192048 - protein, 9 aa, Tick-borne encephalitis virus
KGLTYTVCD

SEQ ID NO: 192049 - protein, 9 aa, Tick-borne encephalitis virus
GLTYTVCDK

SEQ ID NO: 192050 - protein, 9 aa, Tick-borne encephalitis virus
LTYTVCDKT

SEQ ID NO: 192051 - protein, 9 aa, Tick-borne encephalitis virus
TYTVCDKTK

SEQ ID NO: 192052 - protein, 9 aa, Tick-borne encephalitis virus
YTVCDKTKF

SEQ ID NO: 192053 - protein, 9 aa, Tick-borne encephalitis virus
TMCDKTKFA

SEQ ID NO: 192054 - protein, 9 aa, Tick-borne encephalitis virus
MCDKTKFAW

SEQ ID NO: 192055 - protein, 9 aa, Tick-borne encephalitis virus
CDKTKFAWK

SEQ ID NO: 192056 - protein, 9 aa, Tick-borne encephalitis virus
DKTKFAWKR

SEQ ID NO: 192057 - protein, 9 aa, Tick-borne encephalitis virus
KTKFTWKRA

SEQ ID NO: 192058 - protein, 9 aa, Tick-borne encephalitis virus
TKFTWKRAP

SEQ ID NO: 192059 - protein, 9 aa, Tick-borne encephalitis virus
KFTWKRAPT

SEQ ID NO: 192060 - protein, 9 aa, Tick-borne encephalitis virus
FTWKRAPTD

SEQ ID NO: 192061 - protein, 9 aa, Tick-borne encephalitis virus
TWKRAPTDS

SEQ ID NO: 192062 - protein, 9 aa, Tick-borne encephalitis virus
WKRAPTDSG

SEQ ID NO: 192063 - protein, 9 aa, Tick-borne encephalitis virus
KRAPTDSGH

SEQ ID NO: 192064 - protein, 9 aa, Tick-borne encephalitis virus
RAPTDSGHD

SEQ ID NO: 192065 - protein, 9 aa, Tick-borne encephalitis virus
TPTDSGHDT

SEQ ID NO: 192066 - protein, 9 aa, Tick-borne encephalitis virus
HDTVVMEVT

SEQ ID NO: 192067 - protein, 9 aa, Tick-borne encephalitis virus
DTVVMEVTF

SEQ ID NO: 192068 - protein, 9 aa, Tick-borne encephalitis virus
TVVMEVTFS

SEQ ID NO: 192069 - protein, 9 aa, Tick-borne encephalitis virus
VVMEVTFSG

SEQ ID NO: 192070 - protein, 9 aa, Tick-borne encephalitis virus
VMEVTFSGT

SEQ ID NO: 192071 - protein, 9 aa, Tick-borne encephalitis virus
MEVTFSGTK

SEQ ID NO: 192072 - protein, 9 aa, Tick-borne encephalitis virus
EVTFSGTKP

SEQ ID NO: 192073 - protein, 9 aa, Tick-borne encephalitis virus
VTFSGTKPC

SEQ ID NO: 192074 - protein, 9 aa, Tick-borne encephalitis virus
TFSGTKPCR

SEQ ID NO: 192075 - protein, 9 aa, Tick-borne encephalitis virus
PVRAVAHGF

SEQ ID NO: 192076 - protein, 9 aa, Tick-borne encephalitis virus
VRAVAHGFP

SEQ ID NO: 192077 - protein, 9 aa, Tick-borne encephalitis virus
RAVAHGFPD

SEQ ID NO: 192078 - protein, 9 aa, Tick-borne encephalitis virus
AVAHGFPDV

SEQ ID NO: 192079 - protein, 9 aa, Tick-borne encephalitis virus
VAHGFPDVN

SEQ ID NO: 192080 - protein, 9 aa, Tick-borne encephalitis virus
AHGFPDVNV

SEQ ID NO: 192081 - protein, 9 aa, Tick-borne encephalitis virus
HGFPDVNVA

SEQ ID NO: 192082 - protein, 9 aa, Tick-borne encephalitis virus
GFPDVNVAM

SEQ ID NO: 192083 - protein, 9 aa, Tick-borne encephalitis virus
FPDVNVAML

SEQ ID NO: 192084 - protein, 9 aa, Tick-borne encephalitis virus
ITPNPTIET

SEQ ID NO: 192085 - protein, 9 aa, Tick-borne encephalitis virus
TPNPTIETN

SEQ ID NO: 192086 - protein, 9 aa, Tick-borne encephalitis virus
PNPTIETNG

SEQ ID NO: 192087 - protein, 9 aa, Tick-borne encephalitis virus
NPTIETNGG

SEQ ID NO: 192088 - protein, 9 aa, Tick-borne encephalitis virus
PTIETNGGG

SEQ ID NO: 192089 - protein, 9 aa, Tick-borne encephalitis virus
TIETNGGGF

SEQ ID NO: 192090 - protein, 9 aa, Tick-borne encephalitis virus
IETNGGGFI

SEQ ID NO: 192091 - protein, 9 aa, Tick-borne encephalitis virus
ETNGGGFIE

SEQ ID NO: 192092 - protein, 9 aa, Tick-borne encephalitis virus
TNGGGFIEM

SEQ ID NO: 192093 - protein, 9 aa, Tick-borne encephalitis virus
IIYVGELSY

SEQ ID NO: 192094 - protein, 9 aa, Tick-borne encephalitis virus
IYVGELSYQ

SEQ ID NO: 192095 - protein, 9 aa, Tick-borne encephalitis virus
YVGELSYQW

SEQ ID NO: 192096 - protein, 9 aa, Tick-borne encephalitis virus
VGELSYQWF

SEQ ID NO: 192097 - protein, 9 aa, Tick-borne encephalitis virus
GELSYQWFQ

SEQ ID NO: 192098 - protein, 9 aa, Tick-borne encephalitis virus
ELSYQWFQK

SEQ ID NO: 192099 - protein, 9 aa, Tick-borne encephalitis virus
LSYQWFQKG

SEQ ID NO: 192100 - protein, 9 aa, Tick-borne encephalitis virus
SYQWFQKGS

SEQ ID NO: 192101 - protein, 9 aa, Tick-borne encephalitis virus
YQWFQKGSS

SEQ ID NO: 192102 - protein, 9 aa, Tick-borne encephalitis virus
IGRVFQKTK

SEQ ID NO: 192103 - protein, 9 aa, Tick-borne encephalitis virus
GRVFQKTKK

SEQ ID NO: 192104 - protein, 9 aa, Tick-borne encephalitis virus
RVFQKTKKG

SEQ ID NO: 192105 - protein, 9 aa, Tick-borne encephalitis virus
VFQKTKKGI

SEQ ID NO: 192106 - protein, 9 aa, Tick-borne encephalitis virus
FQKTKKGIE

SEQ ID NO: 192107 - protein, 9 aa, Tick-borne encephalitis virus
QKTKKGIER

SEQ ID NO: 192108 - protein, 9 aa, Tick-borne encephalitis virus
KTKKGIERL

SEQ ID NO: 192109 - protein, 9 aa, Tick-borne encephalitis virus
TKKGIERLT

SEQ ID NO: 192110 - protein, 9 aa, Tick-borne encephalitis virus
KKGIERLTV

SEQ ID NO: 192111 - protein, 9 aa, Tick-borne encephalitis virus
RGIERLTVI

SEQ ID NO: 192112 - protein, 9 aa, Tick-borne encephalitis virus
EHAWDFGSA

SEQ ID NO: 192113 - protein, 9 aa, Tick-borne encephalitis virus
HAWDFGSAG

SEQ ID NO: 192114 - protein, 9 aa, Tick-borne encephalitis virus
AWDFGSAGG

SEQ ID NO: 192115 - protein, 9 aa, Tick-borne encephalitis virus
WDFGSAGGF

SEQ ID NO: 192116 - protein, 9 aa, Tick-borne encephalitis virus
DFGSAGGFL

SEQ ID NO: 192117 - protein, 9 aa, Tick-borne encephalitis virus
FGSAGGFLS

SEQ ID NO: 192118 - protein, 9 aa, Tick-borne encephalitis virus
GSAGGFLSS

SEQ ID NO: 192119 - protein, 9 aa, Tick-borne encephalitis virus
SAGGFLSSI

SEQ ID NO: 192120 - protein, 9 aa, Tick-borne encephalitis virus
AGGFLSSIG

SEQ ID NO: 192121 - protein, 9 aa, Tick-borne encephalitis virus
GGFLSSIGK

SEQ ID NO: 192122 - protein, 9 aa, Tick-borne encephalitis virus
GFLSSIGKA

SEQ ID NO: 192123 - protein, 9 aa, Tick-borne encephalitis virus
FLSSIGKAV

SEQ ID NO: 192124 - protein, 9 aa, Tick-borne encephalitis virus
LSSIGKAVH

SEQ ID NO: 192125 - protein, 9 aa, Tick-borne encephalitis virus
SSIGKAVHT

SEQ ID NO: 192126 - protein, 9 aa, Tick-borne encephalitis virus
SIGKAVHTV

SEQ ID NO: 192127 - protein, 9 aa, Tick-borne encephalitis virus
IGKAVHTVL

SEQ ID NO: 192128 - protein, 9 aa, Tick-borne encephalitis virus
GKAVHTVLG

SEQ ID NO: 192129 - protein, 9 aa, Tick-borne encephalitis virus
KAVHTVLGG

SEQ ID NO: 192130 - protein, 9 aa, Tick-borne encephalitis virus
AVHTVLGGA

SEQ ID NO: 192131 - protein, 9 aa, Tick-borne encephalitis virus
VHTVLGGAF

SEQ ID NO: 192132 - protein, 9 aa, Tick-borne encephalitis virus
VLGGAFNSI

SEQ ID NO: 192133 - protein, 9 aa, Tick-borne encephalitis virus
LGGAFNSIF

SEQ ID NO: 192134 - protein, 9 aa, Tick-borne encephalitis virus
GGAFNSIFG

SEQ ID NO: 192135 - protein, 9 aa, Tick-borne encephalitis virus
GAFNSIFGG

SEQ ID NO: 192136 - protein, 9 aa, Tick-borne encephalitis virus
AFNSIFGGV

SEQ ID NO: 192137 - protein, 9 aa, Tick-borne encephalitis virus
FNSIFGGVG

SEQ ID NO: 192138 - protein, 9 aa, Tick-borne encephalitis virus
NSIFGGVGF

SEQ ID NO: 192139 - protein, 9 aa, Tick-borne encephalitis virus
SIFGGVGFL

SEQ ID NO: 192140 - protein, 9 aa, Tick-borne encephalitis virus
IFGGVGFLP

SEQ ID NO: 192141 - protein, 9 aa, Tick-borne encephalitis virus
FGGVGFIPK

SEQ ID NO: 192142 - protein, 9 aa, Tick-borne encephalitis virus
GGVGFLPKL

SEQ ID NO: 192143 - protein, 9 aa, Tick-borne encephalitis virus
GVGFLPKLL

SEQ ID NO: 192144 - protein, 9 aa, Tick-borne encephalitis virus
VGFLPKLLL

SEQ ID NO: 192145 - protein, 9 aa, Tick-borne encephalitis virus
GFLPKLLLG

SEQ ID NO: 192146 - protein, 9 aa, Tick-borne encephalitis virus
GVVLAWLGL

SEQ ID NO: 192147 - protein, 9 aa, Tick-borne encephalitis virus
VVLAWLGLN

SEQ ID NO: 192148 - protein, 9 aa, Tick-borne encephalitis virus
VLAWLGLNM

SEQ ID NO: 192149 - protein, 9 aa, Tick-borne encephalitis virus
MRNPTMSMG

SEQ ID NO: 192150 - protein, 9 aa, Tick-borne encephalitis virus
RNPTMSMGF

SEQ ID NO: 192151 - protein, 9 aa, Tick-borne encephalitis virus
NPTMSMGFL

SEQ ID NO: 192152 - protein, 9 aa, Tick-borne encephalitis virus
PTMSMGFLL

SEQ ID NO: 192153 - protein, 9 aa, Tick-borne encephalitis virus
TMSMGFLLA

SEQ ID NO: 192154 - protein, 9 aa, Tick-borne encephalitis virus
MSMGFLLAG

SEQ ID NO: 192155 - protein, 9 aa, Tick-borne encephalitis virus
SMGFLLAGG

SEQ ID NO: 192156 - protein, 9 aa, Tick-borne encephalitis virus
MGFLLAGGL

SEQ ID NO: 192157 - protein, 9 aa, Tick-borne encephalitis virus
GFLLAGGLV

SEQ ID NO: 192158 - protein, 9 aa, Tick-borne encephalitis virus
FLLAGVLVL

SEQ ID NO: 192159 - protein, 9 aa, Tick-borne encephalitis virus
LLAGVLVLA

SEQ ID NO: 192160 - protein, 9 aa, Tick-borne encephalitis virus
LAGVLVLAM

SEQ ID NO: 192161 - protein, 9 aa, Tick-borne encephalitis virus
AGVLVLAMT

SEQ ID NO: 192162 - protein, 9 aa, Tick-borne encephalitis virus
GVLVLAMTL

SEQ ID NO: 192163 - protein, 9 aa, Tick-borne encephalitis virus
VLVLAMTLG

SEQ ID NO: 192164 - protein, 9 aa, Tick-borne encephalitis virus
LGVGADVGG

SEQ ID NO: 192165 - protein, 9 aa, Tick-borne encephalitis virus
GVGADVGGA

SEQ ID NO: 192166 - protein, 9 aa, Tick-borne encephalitis virus
VGADVGGAV

SEQ ID NO: 192167 - protein, 9 aa, Tick-borne encephalitis virus
GADVGGAVD

SEQ ID NO: 192168 - protein, 9 aa, Tick-borne encephalitis virus
ADVGGAVDT

SEQ ID NO: 192169 - protein, 9 aa, Tick-borne encephalitis virus
DVGGAVDTE

SEQ ID NO: 192170 - protein, 9 aa, Tick-borne encephalitis virus
VGGAVDTER

SEQ ID NO: 192171 - protein, 9 aa, Tick-borne encephalitis virus
GGAVDTERM

SEQ ID NO: 192172 - protein, 9 aa, Tick-borne encephalitis virus
GAVDTERME

SEQ ID NO: 192173 - protein, 9 aa, Tick-borne encephalitis virus
SEWYDNYAF

SEQ ID NO: 192174 - protein, 9 aa, Tick-borne encephalitis virus
EWYDNYAFY

SEQ ID NO: 192175 - protein, 9 aa, Tick-borne encephalitis virus
WYDNYAFYP

SEQ ID NO: 192176 - protein, 9 aa, Tick-borne encephalitis virus
YDNYAFYPE

SEQ ID NO: 192177 - protein, 9 aa, Tick-borne encephalitis virus
DNYAFYPET

SEQ ID NO: 192178 - protein, 9 aa, Tick-borne encephalitis virus
NYAFYPETP

SEQ ID NO: 192179 - protein, 9 aa, Tick-borne encephalitis virus
YAFYPETPG

SEQ ID NO: 192180 - protein, 9 aa, Tick-borne encephalitis virus
AFYPETPGA

SEQ ID NO: 192181 - protein, 9 aa, Tick-borne encephalitis virus
FYPETPGAL

SEQ ID NO: 192182 - protein, 9 aa, Tick-borne encephalitis virus
PGALASAIR

SEQ ID NO: 192183 - protein, 9 aa, Tick-borne encephalitis virus
GALASAIRE

SEQ ID NO: 192184 - protein, 9 aa, Tick-borne encephalitis virus
ALASAIKEA

SEQ ID NO: 192185 - protein, 9 aa, Tick-borne encephalitis virus
LASAIKEAF

SEQ ID NO: 192186 - protein, 9 aa, Tick-borne encephalitis virus
ASAIRETFE

SEQ ID NO: 192187 - protein, 9 aa, Tick-borne encephalitis virus
SAIRETFEE

SEQ ID NO: 192188 - protein, 9 aa, Tick-borne encephalitis virus
AIKEAFEEG

SEQ ID NO: 192189 - protein, 9 aa, Tick-borne encephalitis virus
IKETFEEGS

SEQ ID NO: 192190 - protein, 9 aa, Tick-borne encephalitis virus
KETFEEGSC

SEQ ID NO: 192191 - protein, 9 aa, Tick-borne encephalitis virus
ETFEEGSCG

SEQ ID NO: 192192 - protein, 9 aa, Tick-borne encephalitis virus
TFEEGSCGV

SEQ ID NO: 192193 - protein, 9 aa, Tick-borne encephalitis virus
FEEGSCGVV

SEQ ID NO: 192194 - protein, 9 aa, Tick-borne encephalitis virus
EEGSCGVVP

SEQ ID NO: 192195 - protein, 9 aa, Tick-borne encephalitis virus
EGSCGVVPQ

SEQ ID NO: 192196 - protein, 9 aa, Tick-borne encephalitis virus
GSCGVVPQN

SEQ ID NO: 192197 - protein, 9 aa, Tick-borne encephalitis virus
SCGVVPQNR

SEQ ID NO: 192198 - protein, 9 aa, Tick-borne encephalitis virus
CGVVPQNRL

SEQ ID NO: 192199 - protein, 9 aa, Tick-borne encephalitis virus
GVVPQNRLE

SEQ ID NO: 192200 - protein, 9 aa, Tick-borne encephalitis virus
VVPQNRLEM

SEQ ID NO: 192201 - protein, 9 aa, Tick-borne encephalitis virus
LPQNRLEMA

SEQ ID NO: 192202 - protein, 9 aa, Tick-borne encephalitis virus
LEMAMWRSA

SEQ ID NO: 192203 - protein, 9 aa, Tick-borne encephalitis virus
EMAMWRSSV

SEQ ID NO: 192204 - protein, 9 aa, Tick-borne encephalitis virus
MAMWRSSVT

SEQ ID NO: 192205 - protein, 9 aa, Tick-borne encephalitis virus
AMWRSSVTE

SEQ ID NO: 192206 - protein, 9 aa, Tick-borne encephalitis virus
MWRSSVTEL

SEQ ID NO: 192207 - protein, 9 aa, Tick-borne encephalitis virus
WRSSVTELN

SEQ ID NO: 192208 - protein, 9 aa, Tick-borne encephalitis virus
RSSVTELNL

SEQ ID NO: 192209 - protein, 9 aa, Tick-borne encephalitis virus
SSVTELNLA

SEQ ID NO: 192210 - protein, 9 aa, Tick-borne encephalitis virus
SVTELNLAL

SEQ ID NO: 192211 - protein, 9 aa, Tick-borne encephalitis virus
VTELNLALA

SEQ ID NO: 192212 - protein, 9 aa, Tick-borne encephalitis virus
LNLALAEGE

SEQ ID NO: 192213 - protein, 9 aa, Tick-borne encephalitis virus
NLALAEGEA

SEQ ID NO: 192214 - protein, 9 aa, Tick-borne encephalitis virus
LALAEGEAN

SEQ ID NO: 192215 - protein, 9 aa, Tick-borne encephalitis virus
ALAEGEANL

SEQ ID NO: 192216 - protein, 9 aa, Tick-borne encephalitis virus
LAEGEANLT

SEQ ID NO: 192217 - protein, 9 aa, Tick-borne encephalitis virus
AEGEANLTV

SEQ ID NO: 192218 - protein, 9 aa, Tick-borne encephalitis virus
EGEANLTVV

SEQ ID NO: 192219 - protein, 9 aa, Tick-borne encephalitis virus
GEANLTVVV

SEQ ID NO: 192220 - protein, 9 aa, Tick-borne encephalitis virus
EANLTVVVD

SEQ ID NO: 192221 - protein, 9 aa, Tick-borne encephalitis virus
ANLTVMVDK

SEQ ID NO: 192222 - protein, 9 aa, Tick-borne encephalitis virus
NLTVVVDKF

SEQ ID NO: 192223 - protein, 9 aa, Tick-borne encephalitis virus
LTVVVDKFD

SEQ ID NO: 192224 - protein, 9 aa, Tick-borne encephalitis virus
TVVVDKFDP

SEQ ID NO: 192225 - protein, 9 aa, Tick-borne encephalitis virus
VVVDKFDPT

SEQ ID NO: 192226 - protein, 9 aa, Tick-borne encephalitis virus
VVDKFDPTD

SEQ ID NO: 192227 - protein, 9 aa, Tick-borne encephalitis virus
VDKFDPTDY

SEQ ID NO: 192228 - protein, 9 aa, Tick-borne encephalitis virus
DKFDPTDYR

SEQ ID NO: 192229 - protein, 9 aa, Tick-borne encephalitis virus
KFDPTDYRG

SEQ ID NO: 192230 - protein, 9 aa, Tick-borne encephalitis virus
FDPTDYRGG

SEQ ID NO: 192231 - protein, 9 aa, Tick-borne encephalitis virus
DPTDYRGGV

SEQ ID NO: 192232 - protein, 9 aa, Tick-borne encephalitis virus
PTDYRGGVP

SEQ ID NO: 192233 - protein, 9 aa, Tick-borne encephalitis virus
TDYRGGVPG

SEQ ID NO: 192234 - protein, 9 aa, Tick-borne encephalitis virus
DYRGGVPGL

SEQ ID NO: 192235 - protein, 9 aa, Tick-borne encephalitis virus
YRGGVPGLL

SEQ ID NO: 192236 - protein, 9 aa, Tick-borne encephalitis virus
RGGVPGLLK

SEQ ID NO: 192237 - protein, 9 aa, Tick-borne encephalitis virus
GGVPGLLKK

SEQ ID NO: 192238 - protein, 9 aa, Tick-borne encephalitis virus
GVPGLLKKG

SEQ ID NO: 192239 - protein, 9 aa, Tick-borne encephalitis virus
VPGLLKKGK

SEQ ID NO: 192240 - protein, 9 aa, Tick-borne encephalitis virus
SGLLRKGKD

SEQ ID NO: 192241 - protein, 9 aa, Tick-borne encephalitis virus
GLLRKGKDI

SEQ ID NO: 192242 - protein, 9 aa, Tick-borne encephalitis virus
LLRKGKDIK

SEQ ID NO: 192243 - protein, 9 aa, Tick-borne encephalitis virus
LRKGKDIKV

SEQ ID NO: 192244 - protein, 9 aa, Tick-borne encephalitis virus
RKGKDIKVS

SEQ ID NO: 192245 - protein, 9 aa, Tick-borne encephalitis virus
KGKDIRVSW

SEQ ID NO: 192246 - protein, 9 aa, Tick-borne encephalitis virus
GKDIRVSWK

SEQ ID NO: 192247 - protein, 9 aa, Tick-borne encephalitis virus
KDIRVSWKS

SEQ ID NO: 192248 - protein, 9 aa, Tick-borne encephalitis virus
DIKVSWRSW

SEQ ID NO: 192249 - protein, 9 aa, Tick-borne encephalitis virus
IRVSWKSWG

SEQ ID NO: 192250 - protein, 9 aa, Tick-borne encephalitis virus
KVSWKSWGQ

SEQ ID NO: 192251 - protein, 9 aa, Tick-borne encephalitis virus
VSWKSWGQS

SEQ ID NO: 192252 - protein, 9 aa, Tick-borne encephalitis virus
SWGQSMIWS

SEQ ID NO: 192253 - protein, 9 aa, Tick-borne encephalitis virus
SMIWSIPEA

SEQ ID NO: 192254 - protein, 9 aa, Tick-borne encephalitis virus
MIWSIPEAP

SEQ ID NO: 192255 - protein, 9 aa, Tick-borne encephalitis virus
IWSIPEAPR

SEQ ID NO: 192256 - protein, 9 aa, Tick-borne encephalitis virus
WSIPEAPRR

SEQ ID NO: 192257 - protein, 9 aa, Tick-borne encephalitis virus
SIPEAPRRF

SEQ ID NO: 192258 - protein, 9 aa, Tick-borne encephalitis virus
IPEAPRRFM

SEQ ID NO: 192259 - protein, 9 aa, Tick-borne encephalitis virus
PEASRRFMV

SEQ ID NO: 192260 - protein, 9 aa, Tick-borne encephalitis virus
EASRRFMVG

SEQ ID NO: 192261 - protein, 9 aa, Tick-borne encephalitis virus
APRRFMVGI

SEQ ID NO: 192262 - protein, 9 aa, Tick-borne encephalitis virus
PRRFMVGIE

SEQ ID NO: 192263 - protein, 9 aa, Tick-borne encephalitis virus
RRFMVGIEG

SEQ ID NO: 192264 - protein, 9 aa, Tick-borne encephalitis virus
RFMVGTEGS

SEQ ID NO: 192265 - protein, 9 aa, Tick-borne encephalitis virus
NECPLERRK

SEQ ID NO: 192266 - protein, 9 aa, Tick-borne encephalitis virus
ECPPERRKT

SEQ ID NO: 192267 - protein, 9 aa, Tick-borne encephalitis virus
CPPERRKTG

SEQ ID NO: 192268 - protein, 9 aa, Tick-borne encephalitis virus
PPERRKTGV

SEQ ID NO: 192269 - protein, 9 aa, Tick-borne encephalitis virus
LERRKTGIF

SEQ ID NO: 192270 - protein, 9 aa, Tick-borne encephalitis virus
ERRKTGIFT

SEQ ID NO: 192271 - protein, 9 aa, Tick-borne encephalitis virus
RRKTGIFTV

SEQ ID NO: 192272 - protein, 9 aa, Tick-borne encephalitis virus
RKTGIFTVA

SEQ ID NO: 192273 - protein, 9 aa, Tick-borne encephalitis virus
KTGIFTVAE

SEQ ID NO: 192274 - protein, 9 aa, Tick-borne encephalitis virus
TGIFTVAEF

SEQ ID NO: 192275 - protein, 9 aa, Tick-borne encephalitis virus
GIFTVAEFG

SEQ ID NO: 192276 - protein, 9 aa, Tick-borne encephalitis virus
IFTVAEFGV

SEQ ID NO: 192277 - protein, 9 aa, Tick-borne encephalitis virus
VGLRTKVFV

SEQ ID NO: 192278 - protein, 9 aa, Tick-borne encephalitis virus
GLRTKVFVD

SEQ ID NO: 192279 - protein, 9 aa, Tick-borne encephalitis virus
LRTKVFVDF

SEQ ID NO: 192280 - protein, 9 aa, Tick-borne encephalitis virus
RTKVFVDFR

SEQ ID NO: 192281 - protein, 9 aa, Tick-borne encephalitis virus
TKVFVDFRQ

SEQ ID NO: 192282 - protein, 9 aa, Tick-borne encephalitis virus
KVFVDFRQE

SEQ ID NO: 192283 - protein, 9 aa, Tick-borne encephalitis virus
VFLDFRQEP

SEQ ID NO: 192284 - protein, 9 aa, Tick-borne encephalitis virus
FLDFRQEPT

SEQ ID NO: 192285 - protein, 9 aa, Tick-borne encephalitis virus
LDFRQEPTH

SEQ ID NO: 192286 - protein, 9 aa, Tick-borne encephalitis virus
DFRQEPTHE

SEQ ID NO: 192287 - protein, 9 aa, Tick-borne encephalitis virus
FRQEPTHEC

SEQ ID NO: 192288 - protein, 9 aa, Tick-borne encephalitis virus
RQEPTHECD

SEQ ID NO: 192289 - protein, 9 aa, Tick-borne encephalitis virus
QEPTHECDT

SEQ ID NO: 192290 - protein, 9 aa, Tick-borne encephalitis virus
EPTHECDTG

SEQ ID NO: 192291 - protein, 9 aa, Tick-borne encephalitis virus
PTHECDTGV

SEQ ID NO: 192292 - protein, 9 aa, Tick-borne encephalitis virus
AAVKNGMAI

SEQ ID NO: 192293 - protein, 9 aa, Tick-borne encephalitis virus
AVKNGMAIH

SEQ ID NO: 192294 - protein, 9 aa, Tick-borne encephalitis virus
VKNGMAIHT

SEQ ID NO: 192295 - protein, 9 aa, Tick-borne encephalitis virus
KNGMAIHTD

SEQ ID NO: 192296 - protein, 9 aa, Tick-borne encephalitis virus
NGMAIHTDQ

SEQ ID NO: 192297 - protein, 9 aa, Tick-borne encephalitis virus
GMAIHTDQS

SEQ ID NO: 192298 - protein, 9 aa, Tick-borne encephalitis virus
MAIHTDQSL

SEQ ID NO: 192299 - protein, 9 aa, Tick-borne encephalitis virus
AIHTDQSLW

SEQ ID NO: 192300 - protein, 9 aa, Tick-borne encephalitis virus
IHTDQSLWM

SEQ ID NO: 192301 - protein, 9 aa, Tick-borne encephalitis virus
HTDQSLWMR

SEQ ID NO: 192302 - protein, 9 aa, Tick-borne encephalitis virus
TDQSLWMRS

SEQ ID NO: 192303 - protein, 9 aa, Tick-borne encephalitis virus
DQSLWMRSM

SEQ ID NO: 192304 - protein, 9 aa, Tick-borne encephalitis virus
QSLWMRSMK

SEQ ID NO: 192305 - protein, 9 aa, Tick-borne encephalitis virus
SLWMRSMKN

SEQ ID NO: 192306 - protein, 9 aa, Tick-borne encephalitis virus
LWMRSMKND

SEQ ID NO: 192307 - protein, 9 aa, Tick-borne encephalitis virus
WMRSMKNDT

SEQ ID NO: 192308 - protein, 9 aa, Tick-borne encephalitis virus
MRSMKNDTG

SEQ ID NO: 192309 - protein, 9 aa, Tick-borne encephalitis virus
RSMKNDTGT

SEQ ID NO: 192310 - protein, 9 aa, Tick-borne encephalitis virus
SMKNDTGTY

SEQ ID NO: 192311 - protein, 9 aa, Tick-borne encephalitis virus
MKNDTGTYI

SEQ ID NO: 192312 - protein, 9 aa, Tick-borne encephalitis virus
KNDTGTYIV

SEQ ID NO: 192313 - protein, 9 aa, Tick-borne encephalitis virus
NETGTYIVE

SEQ ID NO: 192314 - protein, 9 aa, Tick-borne encephalitis virus
ETGTYIVEL

SEQ ID NO: 192315 - protein, 9 aa, Tick-borne encephalitis virus
PASHTIDNP

SEQ ID NO: 192316 - protein, 9 aa, Tick-borne encephalitis virus
ASHTIDNAD

SEQ ID NO: 192317 - protein, 9 aa, Tick-borne encephalitis virus
SHTIDNADV

SEQ ID NO: 192318 - protein, 9 aa, Tick-borne encephalitis virus
HTIDNADVV

SEQ ID NO: 192319 - protein, 9 aa, Tick-borne encephalitis virus
TIDNADVVD

SEQ ID NO: 192320 - protein, 9 aa, Tick-borne encephalitis virus
IDNADVVDS

SEQ ID NO: 192321 - protein, 9 aa, Tick-borne encephalitis virus
DNADVVDSE

SEQ ID NO: 192322 - protein, 9 aa, Tick-borne encephalitis virus
NADVVDSEL

SEQ ID NO: 192323 - protein, 9 aa, Tick-borne encephalitis virus
ADVVDSELF

SEQ ID NO: 192324 - protein, 9 aa, Tick-borne encephalitis virus
DVVDSELFL

SEQ ID NO: 192325 - protein, 9 aa, Tick-borne encephalitis virus
VVDSESFLP

SEQ ID NO: 192326 - protein, 9 aa, Tick-borne encephalitis virus
VDSESFLPA

SEQ ID NO: 192327 - protein, 9 aa, Tick-borne encephalitis virus
DSESFLPAS

SEQ ID NO: 192328 - protein, 9 aa, Tick-borne encephalitis virus
SESFLPASL

SEQ ID NO: 192329 - protein, 9 aa, Tick-borne encephalitis virus
ESFLPASLA

SEQ ID NO: 192330 - protein, 9 aa, Tick-borne encephalitis virus
SFLPASLAG

SEQ ID NO: 192331 - protein, 9 aa, Tick-borne encephalitis virus
WYNRIPGYA

SEQ ID NO: 192332 - protein, 9 aa, Tick-borne encephalitis virus
YNRIPGYAE

SEQ ID NO: 192333 - protein, 9 aa, Tick-borne encephalitis virus
NRIPGYAEQ

SEQ ID NO: 192334 - protein, 9 aa, Tick-borne encephalitis virus
RIPGYAEQV

SEQ ID NO: 192335 - protein, 9 aa, Tick-borne encephalitis virus
IPGYAEQVK

SEQ ID NO: 192336 - protein, 9 aa, Tick-borne encephalitis virus
PGYAEQVKG

SEQ ID NO: 192337 - protein, 9 aa, Tick-borne encephalitis virus
GYAEQVKGP

SEQ ID NO: 192338 - protein, 9 aa, Tick-borne encephalitis virus
YAEQVKGPW

SEQ ID NO: 192339 - protein, 9 aa, Tick-borne encephalitis virus
AEQVKGPWK

SEQ ID NO: 192340 - protein, 9 aa, Tick-borne encephalitis virus
EQVKGPWKH

SEQ ID NO: 192341 - protein, 9 aa, Tick-borne encephalitis virus
QVKGPWKHT

SEQ ID NO: 192342 - protein, 9 aa, Tick-borne encephalitis virus
VKGPWKHTP

SEQ ID NO: 192343 - protein, 9 aa, Tick-borne encephalitis virus
KGPWKHTPI

SEQ ID NO: 192344 - protein, 9 aa, Tick-borne encephalitis virus
GPWKHTPIR

SEQ ID NO: 192345 - protein, 9 aa, Tick-borne encephalitis virus
PWKHTPIRV

SEQ ID NO: 192346 - protein, 9 aa, Tick-borne encephalitis virus
PIRVIREEC

SEQ ID NO: 192347 - protein, 9 aa, Tick-borne encephalitis virus
IRVIREECP

SEQ ID NO: 192348 - protein, 9 aa, Tick-borne encephalitis virus
RVIREECPG

SEQ ID NO: 192349 - protein, 9 aa, Tick-borne encephalitis virus
VIREECPGT

SEQ ID NO: 192350 - protein, 9 aa, Tick-borne encephalitis virus
IREECPGTT

SEQ ID NO: 192351 - protein, 9 aa, Tick-borne encephalitis virus
REECPGTTV

SEQ ID NO: 192352 - protein, 9 aa, Tick-borne encephalitis virus
ECPGTKVTI

SEQ ID NO: 192353 - protein, 9 aa, Tick-borne encephalitis virus
INAKCDKRG

SEQ ID NO: 192354 - protein, 9 aa, Tick-borne encephalitis virus
NAKCDKRGA

SEQ ID NO: 192355 - protein, 9 aa, Tick-borne encephalitis virus
AKCDKRGAS

SEQ ID NO: 192356 - protein, 9 aa, Tick-borne encephalitis virus
KCDKRGASV

SEQ ID NO: 192357 - protein, 9 aa, Tick-borne encephalitis virus
CDRRGASVR

SEQ ID NO: 192358 - protein, 9 aa, Tick-borne encephalitis virus
DRRGASVRS

SEQ ID NO: 192359 - protein, 9 aa, Tick-borne encephalitis virus
RRGASVRST

SEQ ID NO: 192360 - protein, 9 aa, Tick-borne encephalitis virus
VIPEWCCRA

SEQ ID NO: 192361 - protein, 9 aa, Tick-borne encephalitis virus
IPEWCCRAC

SEQ ID NO: 192362 - protein, 9 aa, Tick-borne encephalitis virus
PEWCCRACT

SEQ ID NO: 192363 - protein, 9 aa, Tick-borne encephalitis virus
EWCCRACTM

SEQ ID NO: 192364 - protein, 9 aa, Tick-borne encephalitis virus
WCCRACTMP

SEQ ID NO: 192365 - protein, 9 aa, Tick-borne encephalitis virus
CCRACTMPP

SEQ ID NO: 192366 - protein, 9 aa, Tick-borne encephalitis virus
CRACTMPPV

SEQ ID NO: 192367 - protein, 9 aa, Tick-borne encephalitis virus
RACTMPPVT

SEQ ID NO: 192368 - protein, 9 aa, Tick-borne encephalitis virus
ACTMPPVTF

SEQ ID NO: 192369 - protein, 9 aa, Tick-borne encephalitis virus
CTMPPVTFR

SEQ ID NO: 192370 - protein, 9 aa, Tick-borne encephalitis virus
TMPPVTFRT

SEQ ID NO: 192371 - protein, 9 aa, Tick-borne encephalitis virus
MPPVTFRTG

SEQ ID NO: 192372 - protein, 9 aa, Tick-borne encephalitis virus
PPVTIRTGT

SEQ ID NO: 192373 - protein, 9 aa, Tick-borne encephalitis virus
PVTIRTGTD

SEQ ID NO: 192374 - protein, 9 aa, Tick-borne encephalitis virus
VTIRTGTDC

SEQ ID NO: 192375 - protein, 9 aa, Tick-borne encephalitis virus
TIRTGTDCW

SEQ ID NO: 192376 - protein, 9 aa, Tick-borne encephalitis virus
IRTGTDCWY

SEQ ID NO: 192377 - protein, 9 aa, Tick-borne encephalitis virus
PVHDQGGLI

SEQ ID NO: 192378 - protein, 9 aa, Tick-borne encephalitis virus
VHDQGGLIR

SEQ ID NO: 192379 - protein, 9 aa, Tick-borne encephalitis virus
HDQGGLIRS

SEQ ID NO: 192380 - protein, 9 aa, Tick-borne encephalitis virus
DQGGLIRSM

SEQ ID NO: 192381 - protein, 9 aa, Tick-borne encephalitis virus
QGGLVRSTV

SEQ ID NO: 192382 - protein, 9 aa, Tick-borne encephalitis virus
GGLIRSMVV

SEQ ID NO: 192383 - protein, 9 aa, Tick-borne encephalitis virus
GLIRSMVVA

SEQ ID NO: 192384 - protein, 9 aa, Tick-borne encephalitis virus
LVRSTVVAD

SEQ ID NO: 192385 - protein, 9 aa, Tick-borne encephalitis virus
IRSMVVADN

SEQ ID NO: 192386 - protein, 9 aa, Tick-borne encephalitis virus
RSTVVADNG

SEQ ID NO: 192387 - protein, 9 aa, Tick-borne encephalitis virus
STVVADNGE

SEQ ID NO: 192388 - protein, 9 aa, Tick-borne encephalitis virus
TVVADNGEL

SEQ ID NO: 192389 - protein, 9 aa, Tick-borne encephalitis virus
GELLSEGGV

SEQ ID NO: 192390 - protein, 9 aa, Tick-borne encephalitis virus
ELLSEGGVP

SEQ ID NO: 192391 - protein, 9 aa, Tick-borne encephalitis virus
LLSEGGVPG

SEQ ID NO: 192392 - protein, 9 aa, Tick-borne encephalitis virus
LSEGGIPGI

SEQ ID NO: 192393 - protein, 9 aa, Tick-borne encephalitis virus
SEGGVPGIV

SEQ ID NO: 192394 - protein, 9 aa, Tick-borne encephalitis virus
EGGVPGIVA

SEQ ID NO: 192395 - protein, 9 aa, Tick-borne encephalitis virus
GGIPGIVAL

SEQ ID NO: 192396 - protein, 9 aa, Tick-borne encephalitis virus
GIPGIVALF

SEQ ID NO: 192397 - protein, 9 aa, Tick-borne encephalitis virus
VPGIVALFV

SEQ ID NO: 192398 - protein, 9 aa, Tick-borne encephalitis virus
ALFVVLEYI

SEQ ID NO: 192399 - protein, 9 aa, Tick-borne encephalitis virus
LFVVLEYII

SEQ ID NO: 192400 - protein, 9 aa, Tick-borne encephalitis virus
FVVLEYIIR

SEQ ID NO: 192401 - protein, 9 aa, Tick-borne encephalitis virus
VVLEYIIRR

SEQ ID NO: 192402 - protein, 9 aa, Tick-borne encephalitis virus
VLEYIIRRR

SEQ ID NO: 192403 - protein, 9 aa, Tick-borne encephalitis virus
LEYIIRRRP

SEQ ID NO: 192404 - protein, 9 aa, Tick-borne encephalitis virus
EYIIRRRPS

SEQ ID NO: 192405 - protein, 9 aa, Tick-borne encephalitis virus
YIIRRRPST

SEQ ID NO: 192406 - protein, 9 aa, Tick-borne encephalitis virus
IIRRRPSTG

SEQ ID NO: 192407 - protein, 9 aa, Tick-borne encephalitis virus
IRRRPSTGT

SEQ ID NO: 192408 - protein, 9 aa, Tick-borne encephalitis virus
RRRPSTGTT

SEQ ID NO: 192409 - protein, 9 aa, Tick-borne encephalitis virus
RRPSTGTTV

SEQ ID NO: 192410 - protein, 9 aa, Tick-borne encephalitis virus
RPSTGTTVV

SEQ ID NO: 192411 - protein, 9 aa, Tick-borne encephalitis virus
PSTGTTVVW

SEQ ID NO: 192412 - protein, 9 aa, Tick-borne encephalitis virus
STGTTVVWG

SEQ ID NO: 192413 - protein, 9 aa, Tick-borne encephalitis virus
TGTTVVWGG

SEQ ID NO: 192414 - protein, 9 aa, Tick-borne encephalitis virus
WGGVVVLAL

SEQ ID NO: 192415 - protein, 9 aa, Tick-borne encephalitis virus
GGVVVLALL

SEQ ID NO: 192416 - protein, 9 aa, Tick-borne encephalitis virus
GVVVLALLV

SEQ ID NO: 192417 - protein, 9 aa, Tick-borne encephalitis virus
VVVLALLVT

SEQ ID NO: 192418 - protein, 9 aa, Tick-borne encephalitis virus
VVFALLVTG

SEQ ID NO: 192419 - protein, 9 aa, Tick-borne encephalitis virus
VLALLVTGM

SEQ ID NO: 192420 - protein, 9 aa, Tick-borne encephalitis virus
LALLVTGMV

SEQ ID NO: 192421 - protein, 9 aa, Tick-borne encephalitis virus
ALLVTGMVR

SEQ ID NO: 192422 - protein, 9 aa, Tick-borne encephalitis virus
VKIESLVRY

SEQ ID NO: 192423 - protein, 9 aa, Tick-borne encephalitis virus
KIESLVRYV

SEQ ID NO: 192424 - protein, 9 aa, Tick-borne encephalitis virus
VESLVRYVV

SEQ ID NO: 192425 - protein, 9 aa, Tick-borne encephalitis virus
RYVVAVGIA

SEQ ID NO: 192426 - protein, 9 aa, Tick-borne encephalitis virus
YVVAVGIAF

SEQ ID NO: 192427 - protein, 9 aa, Tick-borne encephalitis virus
VVAVGIAFH

SEQ ID NO: 192428 - protein, 9 aa, Tick-borne encephalitis virus
VAVGITFHF

SEQ ID NO: 192429 - protein, 9 aa, Tick-borne encephalitis virus
AVGITFHFE

SEQ ID NO: 192430 - protein, 9 aa, Tick-borne encephalitis virus
VGITFHFEL

SEQ ID NO: 192431 - protein, 9 aa, Tick-borne encephalitis virus
GITFHFELG

SEQ ID NO: 192432 - protein, 9 aa, Tick-borne encephalitis virus
ITFHFELGP

SEQ ID NO: 192433 - protein, 9 aa, Tick-borne encephalitis virus
AFHLELGPE

SEQ ID NO: 192434 - protein, 9 aa, Tick-borne encephalitis virus
FHFELGPEI

SEQ ID NO: 192435 - protein, 9 aa, Tick-borne encephalitis virus
HFELGPEIV

SEQ ID NO: 192436 - protein, 9 aa, Tick-borne encephalitis virus
FELGPEIVA

SEQ ID NO: 192437 - protein, 9 aa, Tick-borne encephalitis virus
LGPEIVALM

SEQ ID NO: 192438 - protein, 9 aa, Tick-borne encephalitis virus
GPEIVALML

SEQ ID NO: 192439 - protein, 9 aa, Tick-borne encephalitis virus
PEIVALMLL

SEQ ID NO: 192440 - protein, 9 aa, Tick-borne encephalitis virus
EIVALMLLQ

SEQ ID NO: 192441 - protein, 9 aa, Tick-borne encephalitis virus
IVALMLLQA

SEQ ID NO: 192442 - protein, 9 aa, Tick-borne encephalitis virus
VALMLLQAV

SEQ ID NO: 192443 - protein, 9 aa, Tick-borne encephalitis virus
ALMLLQAVF

SEQ ID NO: 192444 - protein, 9 aa, Tick-borne encephalitis virus
LMLLQAVFE

SEQ ID NO: 192445 - protein, 9 aa, Tick-borne encephalitis virus
MLLQAVFEL

SEQ ID NO: 192446 - protein, 9 aa, Tick-borne encephalitis virus
LLSAFALRR

SEQ ID NO: 192447 - protein, 9 aa, Tick-borne encephalitis virus
LSAFALRRS

SEQ ID NO: 192448 - protein, 9 aa, Tick-borne encephalitis virus
SAFALRRSL

SEQ ID NO: 192449 - protein, 9 aa, Tick-borne encephalitis virus
AFALRRSLT

SEQ ID NO: 192450 - protein, 9 aa, Tick-borne encephalitis virus
FALRRSLTV

SEQ ID NO: 192451 - protein, 9 aa, Tick-borne encephalitis virus
ALRRSLTVR

SEQ ID NO: 192452 - protein, 9 aa, Tick-borne encephalitis virus
LRRSLTVRE

SEQ ID NO: 192453 - protein, 9 aa, Tick-borne encephalitis virus
RRSLTVREM

SEQ ID NO: 192454 - protein, 9 aa, Tick-borne encephalitis virus
RSLTVREMV

SEQ ID NO: 192455 - protein, 9 aa, Tick-borne encephalitis virus
SLTVREMVT

SEQ ID NO: 192456 - protein, 9 aa, Tick-borne encephalitis virus
LTVREMVTT

SEQ ID NO: 192457 - protein, 9 aa, Tick-borne encephalitis virus
TVREMVTTY

SEQ ID NO: 192458 - protein, 9 aa, Tick-borne encephalitis virus
VREMVTTYF

SEQ ID NO: 192459 - protein, 9 aa, Tick-borne encephalitis virus
REMVTTYFL

SEQ ID NO: 192460 - protein, 9 aa, Tick-borne encephalitis virus
EMVTTYFLL

SEQ ID NO: 192461 - protein, 9 aa, Tick-borne encephalitis virus
MVTTYFLLL

SEQ ID NO: 192462 - protein, 9 aa, Tick-borne encephalitis virus
VTTYFLLLV

SEQ ID NO: 192463 - protein, 9 aa, Tick-borne encephalitis virus
TTYFLLLVL

SEQ ID NO: 192464 - protein, 9 aa, Tick-borne encephalitis virus
TYFLLLVLE

SEQ ID NO: 192465 - protein, 9 aa, Tick-borne encephalitis virus
LVLELGLPG

SEQ ID NO: 192466 - protein, 9 aa, Tick-borne encephalitis virus
FWKWGDALA

SEQ ID NO: 192467 - protein, 9 aa, Tick-borne encephalitis virus
WRWGDALAM

SEQ ID NO: 192468 - protein, 9 aa, Tick-borne encephalitis virus
RWGDALAMG

SEQ ID NO: 192469 - protein, 9 aa, Tick-borne encephalitis virus
ALAMGALIL

SEQ ID NO: 192470 - protein, 9 aa, Tick-borne encephalitis virus
LAMGALILR

SEQ ID NO: 192471 - protein, 9 aa, Tick-borne encephalitis virus
AMGALILRA

SEQ ID NO: 192472 - protein, 9 aa, Tick-borne encephalitis virus
MGALILRAC

SEQ ID NO: 192473 - protein, 9 aa, Tick-borne encephalitis virus
GALILRACT

SEQ ID NO: 192474 - protein, 9 aa, Tick-borne encephalitis virus
ALILRACTA

SEQ ID NO: 192475 - protein, 9 aa, Tick-borne encephalitis virus
LILRACTAE

SEQ ID NO: 192476 - protein, 9 aa, Tick-borne encephalitis virus
IFRACTAEE

SEQ ID NO: 192477 - protein, 9 aa, Tick-borne encephalitis virus
FRACTAEEK

SEQ ID NO: 192478 - protein, 9 aa, Tick-borne encephalitis virus
RACTAEGKT

SEQ ID NO: 192479 - protein, 9 aa, Tick-borne encephalitis virus
ACTAEGKTG

SEQ ID NO: 192480 - protein, 9 aa, Tick-borne encephalitis virus
CTAEGKTGA

SEQ ID NO: 192481 - protein, 9 aa, Tick-borne encephalitis virus
TAEGKTGAG

SEQ ID NO: 192482 - protein, 9 aa, Tick-borne encephalitis virus
AEGKTGAGL

SEQ ID NO: 192483 - protein, 9 aa, Tick-borne encephalitis virus
EGKTGAGLL

SEQ ID NO: 192484 - protein, 9 aa, Tick-borne encephalitis virus
GKTGAGLLL

SEQ ID NO: 192485 - protein, 9 aa, Tick-borne encephalitis virus
KTGAGLLLM

SEQ ID NO: 192486 - protein, 9 aa, Tick-borne encephalitis virus
TGAGLLLMA

SEQ ID NO: 192487 - protein, 9 aa, Tick-borne encephalitis virus
GAGLLLMAL

SEQ ID NO: 192488 - protein, 9 aa, Tick-borne encephalitis virus
AGLLLMALM

SEQ ID NO: 192489 - protein, 9 aa, Tick-borne encephalitis virus
GLLLMALIT

SEQ ID NO: 192490 - protein, 9 aa, Tick-borne encephalitis virus
LLLMPLLTK

SEQ ID NO: 192491 - protein, 9 aa, Tick-borne encephalitis virus
LLMALMTQR

SEQ ID NO: 192492 - protein, 9 aa, Tick-borne encephalitis virus
LMALMTQRD

SEQ ID NO: 192493 - protein, 9 aa, Tick-borne encephalitis virus
VHHGLVCFL

SEQ ID NO: 192494 - protein, 9 aa, Tick-borne encephalitis virus
HHGLVCFLS

SEQ ID NO: 192495 - protein, 9 aa, Tick-borne encephalitis virus
WRLIRGHRE

SEQ ID NO: 192496 - protein, 9 aa, Tick-borne encephalitis virus
RLIRGHREQ

SEQ ID NO: 192497 - protein, 9 aa, Tick-borne encephalitis virus
LLKGHREQK

SEQ ID NO: 192498 - protein, 9 aa, Tick-borne encephalitis virus
LKGHREQKG

SEQ ID NO: 192499 - protein, 9 aa, Tick-borne encephalitis virus
KGHREQKGL

SEQ ID NO: 192500 - protein, 9 aa, Tick-borne encephalitis virus
GHREQKGLS

SEQ ID NO: 192501 - protein, 9 aa, Tick-borne encephalitis virus
HREQKGLSW

SEQ ID NO: 192502 - protein, 9 aa, Tick-borne encephalitis virus
REQKGLTWV

SEQ ID NO: 192503 - protein, 9 aa, Tick-borne encephalitis virus
EQKGLSWIV

SEQ ID NO: 192504 - protein, 9 aa, Tick-borne encephalitis virus
QKGLTWVVP

SEQ ID NO: 192505 - protein, 9 aa, Tick-borne encephalitis virus
KGLTWVVPL

SEQ ID NO: 192506 - protein, 9 aa, Tick-borne encephalitis virus
GLTWVVPLA

SEQ ID NO: 192507 - protein, 9 aa, Tick-borne encephalitis virus
VPLARLLGG

SEQ ID NO: 192508 - protein, 9 aa, Tick-borne encephalitis virus
PLARLLGGE

SEQ ID NO: 192509 - protein, 9 aa, Tick-borne encephalitis virus
LARLLGGEG

SEQ ID NO: 192510 - protein, 9 aa, Tick-borne encephalitis virus
ARLLGGEGS

SEQ ID NO: 192511 - protein, 9 aa, Tick-borne encephalitis virus
RLLGGEGSG

SEQ ID NO: 192512 - protein, 9 aa, Tick-borne encephalitis virus
LLGGEGSGI

SEQ ID NO: 192513 - protein, 9 aa, Tick-borne encephalitis virus
LGGEGSGIR

SEQ ID NO: 192514 - protein, 9 aa, Tick-borne encephalitis virus
GGEGSGIRL

SEQ ID NO: 192515 - protein, 9 aa, Tick-borne encephalitis virus
GEGSGIRLL

SEQ ID NO: 192516 - protein, 9 aa, Tick-borne encephalitis virus
EGSGIRLLA

SEQ ID NO: 192517 - protein, 9 aa, Tick-borne encephalitis virus
GSGIRLLAF

SEQ ID NO: 192518 - protein, 9 aa, Tick-borne encephalitis virus
SGIRLLAFW

SEQ ID NO: 192519 - protein, 9 aa, Tick-borne encephalitis virus
GIRLLAFWE

SEQ ID NO: 192520 - protein, 9 aa, Tick-borne encephalitis virus
IRLLAFWEL

SEQ ID NO: 192521 - protein, 9 aa, Tick-borne encephalitis virus
RLLAFWELS

SEQ ID NO: 192522 - protein, 9 aa, Tick-borne encephalitis virus
HGRRRSFSE

SEQ ID NO: 192523 - protein, 9 aa, Tick-borne encephalitis virus
GRRRSFSEP

SEQ ID NO: 192524 - protein, 9 aa, Tick-borne encephalitis virus
RRRSFSEPL

SEQ ID NO: 192525 - protein, 9 aa, Tick-borne encephalitis virus
VGVMLTLAG

SEQ ID NO: 192526 - protein, 9 aa, Tick-borne encephalitis virus
GVMLTLAGG

SEQ ID NO: 192527 - protein, 9 aa, Tick-borne encephalitis virus
VMLTLAGGM

SEQ ID NO: 192528 - protein, 9 aa, Tick-borne encephalitis virus
MLTLAGGMM

SEQ ID NO: 192529 - protein, 9 aa, Tick-borne encephalitis virus
LTLAGGMMR

SEQ ID NO: 192530 - protein, 9 aa, Tick-borne encephalitis virus
TLAGGMMRH

SEQ ID NO: 192531 - protein, 9 aa, Tick-borne encephalitis virus
LAGGMMRHT

SEQ ID NO: 192532 - protein, 9 aa, Tick-borne encephalitis virus
AGGMMRHTS

SEQ ID NO: 192533 - protein, 9 aa, Tick-borne encephalitis virus
GGMMRHTSQ

SEQ ID NO: 192534 - protein, 9 aa, Tick-borne encephalitis virus
GMMRHTPQE

SEQ ID NO: 192535 - protein, 9 aa, Tick-borne encephalitis virus
MMRHTPQEA

SEQ ID NO: 192536 - protein, 9 aa, Tick-borne encephalitis virus
MRHTPQEAL

SEQ ID NO: 192537 - protein, 9 aa, Tick-borne encephalitis virus
RHTPQEALC

SEQ ID NO: 192538 - protein, 9 aa, Tick-borne encephalitis virus
HTPQEALCA

SEQ ID NO: 192539 - protein, 9 aa, Tick-borne encephalitis virus
TPQEALCAL

SEQ ID NO: 192540 - protein, 9 aa, Tick-borne encephalitis virus
PQEALCALA

SEQ ID NO: 192541 - protein, 9 aa, Tick-borne encephalitis virus
EWSGCVEWY

SEQ ID NO: 192542 - protein, 9 aa, Tick-borne encephalitis virus
WSGCVEWYP

SEQ ID NO: 192543 - protein, 9 aa, Tick-borne encephalitis virus
SGCVEWYPE

SEQ ID NO: 192544 - protein, 9 aa, Tick-borne encephalitis virus
GCVEWYPEL

SEQ ID NO: 192545 - protein, 9 aa, Tick-borne encephalitis virus
CVEWHPELV

SEQ ID NO: 192546 - protein, 9 aa, Tick-borne encephalitis virus
VEWHPELVN

SEQ ID NO: 192547 - protein, 9 aa, Tick-borne encephalitis virus
EWHPELVNE

SEQ ID NO: 192548 - protein, 9 aa, Tick-borne encephalitis virus
WHPELVNEG

SEQ ID NO: 192549 - protein, 9 aa, Tick-borne encephalitis virus
HPELVNEGG

SEQ ID NO: 192550 - protein, 9 aa, Tick-borne encephalitis virus
PELVNEGGE

SEQ ID NO: 192551 - protein, 9 aa, Tick-borne encephalitis virus
ELVNEGGEV

SEQ ID NO: 192552 - protein, 9 aa, Tick-borne encephalitis virus
LVNEGGEVS

SEQ ID NO: 192553 - protein, 9 aa, Tick-borne encephalitis virus
VNEGGEVSL

SEQ ID NO: 192554 - protein, 9 aa, Tick-borne encephalitis virus
VSLRVRQDA

SEQ ID NO: 192555 - protein, 9 aa, Tick-borne encephalitis virus
SLRVRQDAM

SEQ ID NO: 192556 - protein, 9 aa, Tick-borne encephalitis virus
LRVRQDAMG

SEQ ID NO: 192557 - protein, 9 aa, Tick-borne encephalitis virus
RVRQDAMGN

SEQ ID NO: 192558 - protein, 9 aa, Tick-borne encephalitis virus
VRQDAMGNF

SEQ ID NO: 192559 - protein, 9 aa, Tick-borne encephalitis virus
RQDAMGNFH

SEQ ID NO: 192560 - protein, 9 aa, Tick-borne encephalitis virus
QDAMGNFHL

SEQ ID NO: 192561 - protein, 9 aa, Tick-borne encephalitis virus
DAMGNFHLT

SEQ ID NO: 192562 - protein, 9 aa, Tick-borne encephalitis virus
AMGNFHLTE

SEQ ID NO: 192563 - protein, 9 aa, Tick-borne encephalitis virus
TELEKEERM

SEQ ID NO: 192564 - protein, 9 aa, Tick-borne encephalitis virus
ELEKEERMM

SEQ ID NO: 192565 - protein, 9 aa, Tick-borne encephalitis virus
LEKEERMMA

SEQ ID NO: 192566 - protein, 9 aa, Tick-borne encephalitis virus
EKEERMMAF

SEQ ID NO: 192567 - protein, 9 aa, Tick-borne encephalitis virus
KEERMMAFW

SEQ ID NO: 192568 - protein, 9 aa, Tick-borne encephalitis virus
EERMMAFWL

SEQ ID NO: 192569 - protein, 9 aa, Tick-borne encephalitis virus
ERMMAFWLL

SEQ ID NO: 192570 - protein, 9 aa, Tick-borne encephalitis virus
RMMAFWLLA

SEQ ID NO: 192571 - protein, 9 aa, Tick-borne encephalitis virus
MMAFWLLAG

SEQ ID NO: 192572 - protein, 9 aa, Tick-borne encephalitis virus
MAFWLIAGL

SEQ ID NO: 192573 - protein, 9 aa, Tick-borne encephalitis virus
AFWLIAGLA

SEQ ID NO: 192574 - protein, 9 aa, Tick-borne encephalitis virus
FWLIAGLAA

SEQ ID NO: 192575 - protein, 9 aa, Tick-borne encephalitis virus
WLIAGLAAS

SEQ ID NO: 192576 - protein, 9 aa, Tick-borne encephalitis virus
LIAGLAASA

SEQ ID NO: 192577 - protein, 9 aa, Tick-borne encephalitis virus
AGLAASAIH

SEQ ID NO: 192578 - protein, 9 aa, Tick-borne encephalitis virus
GLAASAIHW

SEQ ID NO: 192579 - protein, 9 aa, Tick-borne encephalitis virus
LAASAIHWS

SEQ ID NO: 192580 - protein, 9 aa, Tick-borne encephalitis virus
AASAIHWSG

SEQ ID NO: 192581 - protein, 9 aa, Tick-borne encephalitis virus
ASAIHWSGI

SEQ ID NO: 192582 - protein, 9 aa, Tick-borne encephalitis virus
SAVHWSGIL

SEQ ID NO: 192583 - protein, 9 aa, Tick-borne encephalitis virus
AIHWSGILG

SEQ ID NO: 192584 - protein, 9 aa, Tick-borne encephalitis virus
VHWSGILGV

SEQ ID NO: 192585 - protein, 9 aa, Tick-borne encephalitis virus
HWSGIIGVM

SEQ ID NO: 192586 - protein, 9 aa, Tick-borne encephalitis virus
WSGIIGVMG

SEQ ID NO: 192587 - protein, 9 aa, Tick-borne encephalitis virus
SGIIGVMGL

SEQ ID NO: 192588 - protein, 9 aa, Tick-borne encephalitis virus
GIIGVMGLW

SEQ ID NO: 192589 - protein, 9 aa, Tick-borne encephalitis virus
IIGVMGLWT

SEQ ID NO: 192590 - protein, 9 aa, Tick-borne encephalitis virus
IGVMGLWTL

SEQ ID NO: 192591 - protein, 9 aa, Tick-borne encephalitis virus
GVMGLWTLT

SEQ ID NO: 192592 - protein, 9 aa, Tick-borne encephalitis virus
VMGLWTLTE

SEQ ID NO: 192593 - protein, 9 aa, Tick-borne encephalitis virus
MGLWTLTEM

SEQ ID NO: 192594 - protein, 9 aa, Tick-borne encephalitis virus
GLWTLTEML

SEQ ID NO: 192595 - protein, 9 aa, Tick-borne encephalitis virus
LWTLTEMLR

SEQ ID NO: 192596 - protein, 9 aa, Tick-borne encephalitis virus
SRRSDLVFS

SEQ ID NO: 192597 - protein, 9 aa, Tick-borne encephalitis virus
RRSGLVFSG

SEQ ID NO: 192598 - protein, 9 aa, Tick-borne encephalitis virus
RSDLAFSGQ

SEQ ID NO: 192599 - protein, 9 aa, Tick-borne encephalitis virus
SGLVFSGQG

SEQ ID NO: 192600 - protein, 9 aa, Tick-borne encephalitis virus
DLVFSGQGN

SEQ ID NO: 192601 - protein, 9 aa, Tick-borne encephalitis virus
LAFSGQGGR

SEQ ID NO: 192602 - protein, 9 aa, Tick-borne encephalitis virus
VFSGQGRGE

SEQ ID NO: 192603 - protein, 9 aa, Tick-borne encephalitis virus
FSGQGNRER

SEQ ID NO: 192604 - protein, 9 aa, Tick-borne encephalitis virus
SGQGNRERG

SEQ ID NO: 192605 - protein, 9 aa, Tick-borne encephalitis virus
GQGNRERGD

SEQ ID NO: 192606 - protein, 9 aa, Tick-borne encephalitis virus
QGGRERGDK

SEQ ID NO: 192607 - protein, 9 aa, Tick-borne encephalitis virus
GGRERGDKP

SEQ ID NO: 192608 - protein, 9 aa, Tick-borne encephalitis virus
GRERGDKPF

SEQ ID NO: 192609 - protein, 9 aa, Tick-borne encephalitis virus
RERGDKPFE

SEQ ID NO: 192610 - protein, 9 aa, Tick-borne encephalitis virus
ERGDKPFEV

SEQ ID NO: 192611 - protein, 9 aa, Tick-borne encephalitis virus
RGDKPFEVK

SEQ ID NO: 192612 - protein, 9 aa, Tick-borne encephalitis virus
GDKPFEVKD

SEQ ID NO: 192613 - protein, 9 aa, Tick-borne encephalitis virus
DKPFEVKDG

SEQ ID NO: 192614 - protein, 9 aa, Tick-borne encephalitis virus
KPFEVKDGV

SEQ ID NO: 192615 - protein, 9 aa, Tick-borne encephalitis virus
PFEVRDGVY

SEQ ID NO: 192616 - protein, 9 aa, Tick-borne encephalitis virus
FEVRDGVYR

SEQ ID NO: 192617 - protein, 9 aa, Tick-borne encephalitis virus
EVRDGVYRI

SEQ ID NO: 192618 - protein, 9 aa, Tick-borne encephalitis virus
VRDGVYRIF

SEQ ID NO: 192619 - protein, 9 aa, Tick-borne encephalitis virus
RDGVYRIFS

SEQ ID NO: 192620 - protein, 9 aa, Tick-borne encephalitis virus
YRIFSPGLF

SEQ ID NO: 192621 - protein, 9 aa, Tick-borne encephalitis virus
RIFSPGLFW

SEQ ID NO: 192622 - protein, 9 aa, Tick-borne encephalitis virus
IFSPGLFWG

SEQ ID NO: 192623 - protein, 9 aa, Tick-borne encephalitis virus
FSPGLFWGQ

SEQ ID NO: 192624 - protein, 9 aa, Tick-borne encephalitis virus
SPGLFWGQN

SEQ ID NO: 192625 - protein, 9 aa, Tick-borne encephalitis virus
PGLFWGQNQ

SEQ ID NO: 192626 - protein, 9 aa, Tick-borne encephalitis virus
GLFWGQNQV

SEQ ID NO: 192627 - protein, 9 aa, Tick-borne encephalitis virus
LFWGQNQVG

SEQ ID NO: 192628 - protein, 9 aa, Tick-borne encephalitis virus
FWGQNQVGV

SEQ ID NO: 192629 - protein, 9 aa, Tick-borne encephalitis virus
WGQNQVGVG

SEQ ID NO: 192630 - protein, 9 aa, Tick-borne encephalitis virus
GQNQVGVGY

SEQ ID NO: 192631 - protein, 9 aa, Tick-borne encephalitis virus
QNQVGVGYG

SEQ ID NO: 192632 - protein, 9 aa, Tick-borne encephalitis virus
RQVGVGYGS

SEQ ID NO: 192633 - protein, 9 aa, Tick-borne encephalitis virus
QVGVGYGFK

SEQ ID NO: 192634 - protein, 9 aa, Tick-borne encephalitis virus
VGVGYGFKG

SEQ ID NO: 192635 - protein, 9 aa, Tick-borne encephalitis virus
GVGYGFKGV

SEQ ID NO: 192636 - protein, 9 aa, Tick-borne encephalitis virus
VGYGFKGVL

SEQ ID NO: 192637 - protein, 9 aa, Tick-borne encephalitis virus
GYGFKGVLH

SEQ ID NO: 192638 - protein, 9 aa, Tick-borne encephalitis virus
YGFKGVLHT

SEQ ID NO: 192639 - protein, 9 aa, Tick-borne encephalitis virus
GFKGVLHTM

SEQ ID NO: 192640 - protein, 9 aa, Tick-borne encephalitis virus
FKGVLHTMW

SEQ ID NO: 192641 - protein, 9 aa, Tick-borne encephalitis virus
RGVLHTMWH

SEQ ID NO: 192642 - protein, 9 aa, Tick-borne encephalitis virus
HVTRGAALY

SEQ ID NO: 192643 - protein, 9 aa, Tick-borne encephalitis virus
VTRGAALYI

SEQ ID NO: 192644 - protein, 9 aa, Tick-borne encephalitis virus
TRGAALSIN

SEQ ID NO: 192645 - protein, 9 aa, Tick-borne encephalitis virus
RGAALSIND

SEQ ID NO: 192646 - protein, 9 aa, Tick-borne encephalitis virus
GAALSINDA

SEQ ID NO: 192647 - protein, 9 aa, Tick-borne encephalitis virus
AALSINDAV

SEQ ID NO: 192648 - protein, 9 aa, Tick-borne encephalitis virus
ALSINDAVA

SEQ ID NO: 192649 - protein, 9 aa, Tick-borne encephalitis virus
LSINDAVAG

SEQ ID NO: 192650 - protein, 9 aa, Tick-borne encephalitis virus
SINDAVAGP

SEQ ID NO: 192651 - protein, 9 aa, Tick-borne encephalitis virus
INDAVAGPY

SEQ ID NO: 192652 - protein, 9 aa, Tick-borne encephalitis virus
NDAVAGPYW

SEQ ID NO: 192653 - protein, 9 aa, Tick-borne encephalitis virus
DAVVGPYWA

SEQ ID NO: 192654 - protein, 9 aa, Tick-borne encephalitis virus
AVVGPYWAD

SEQ ID NO: 192655 - protein, 9 aa, Tick-borne encephalitis virus
VVGPYWADV

SEQ ID NO: 192656 - protein, 9 aa, Tick-borne encephalitis virus
AGPYWADVR

SEQ ID NO: 192657 - protein, 9 aa, Tick-borne encephalitis virus
GPYWADVRE

SEQ ID NO: 192658 - protein, 9 aa, Tick-borne encephalitis virus
PYWADVRED

SEQ ID NO: 192659 - protein, 9 aa, Tick-borne encephalitis virus
YWADVREDV

SEQ ID NO: 192660 - protein, 9 aa, Tick-borne encephalitis virus
WADVREDVV

SEQ ID NO: 192661 - protein, 9 aa, Tick-borne encephalitis virus
ADVREDVVC

SEQ ID NO: 192662 - protein, 9 aa, Tick-borne encephalitis virus
DVREDVVCY

SEQ ID NO: 192663 - protein, 9 aa, Tick-borne encephalitis virus
VREDVVCYG

SEQ ID NO: 192664 - protein, 9 aa, Tick-borne encephalitis virus
REDVVCYGG

SEQ ID NO: 192665 - protein, 9 aa, Tick-borne encephalitis virus
EDVVCYGGT

SEQ ID NO: 192666 - protein, 9 aa, Tick-borne encephalitis virus
DVVCYGGTW

SEQ ID NO: 192667 - protein, 9 aa, Tick-borne encephalitis virus
VVCYGGTWS

SEQ ID NO: 192668 - protein, 9 aa, Tick-borne encephalitis virus
VCYGGTWSL

SEQ ID NO: 192669 - protein, 9 aa, Tick-borne encephalitis virus
CYGGTWSLE

SEQ ID NO: 192670 - protein, 9 aa, Tick-borne encephalitis virus
YGGTWSLEE

SEQ ID NO: 192671 - protein, 9 aa, Tick-borne encephalitis virus
GGTWSLEEK

SEQ ID NO: 192672 - protein, 9 aa, Tick-borne encephalitis virus
GTWSLEEKW

SEQ ID NO: 192673 - protein, 9 aa, Tick-borne encephalitis virus
AWSLEEKWR

SEQ ID NO: 192674 - protein, 9 aa, Tick-borne encephalitis virus
WSLEEKWRG

SEQ ID NO: 192675 - protein, 9 aa, Tick-borne encephalitis virus
SLEEKWRGE

SEQ ID NO: 192676 - protein, 9 aa, Tick-borne encephalitis virus
LEEKWRGET

SEQ ID NO: 192677 - protein, 9 aa, Tick-borne encephalitis virus
EEKWRGETV

SEQ ID NO: 192678 - protein, 9 aa, Tick-borne encephalitis virus
EKWRGETVQ

SEQ ID NO: 192679 - protein, 9 aa, Tick-borne encephalitis virus
KWRGETVQV

SEQ ID NO: 192680 - protein, 9 aa, Tick-borne encephalitis virus
WRGETVQVH

SEQ ID NO: 192681 - protein, 9 aa, Tick-borne encephalitis virus
RGETVQVHA

SEQ ID NO: 192682 - protein, 9 aa, Tick-borne encephalitis virus
QVHAFPPGK

SEQ ID NO: 192683 - protein, 9 aa, Tick-borne encephalitis virus
VHAFPPGKA

SEQ ID NO: 192684 - protein, 9 aa, Tick-borne encephalitis virus
HAFPPGKAH

SEQ ID NO: 192685 - protein, 9 aa, Tick-borne encephalitis virus
AFPPGKAHE

SEQ ID NO: 192686 - protein, 9 aa, Tick-borne encephalitis virus
FPPGKAHEV

SEQ ID NO: 192687 - protein, 9 aa, Tick-borne encephalitis virus
PPGKAHEVH

SEQ ID NO: 192688 - protein, 9 aa, Tick-borne encephalitis virus
PGKAHEVHQ

SEQ ID NO: 192689 - protein, 9 aa, Tick-borne encephalitis virus
GKAHEVHQC

SEQ ID NO: 192690 - protein, 9 aa, Tick-borne encephalitis virus
KAHEVHQCQ

SEQ ID NO: 192691 - protein, 9 aa, Tick-borne encephalitis virus
HQCQPGELI

SEQ ID NO: 192692 - protein, 9 aa, Tick-borne encephalitis virus
QCQPGELIL

SEQ ID NO: 192693 - protein, 9 aa, Tick-borne encephalitis virus
CQPGELILD

SEQ ID NO: 192694 - protein, 9 aa, Tick-borne encephalitis virus
QPGELILDT

SEQ ID NO: 192695 - protein, 9 aa, Tick-borne encephalitis virus
PGELILDTG

SEQ ID NO: 192696 - protein, 9 aa, Tick-borne encephalitis virus
GELILDTGR

SEQ ID NO: 192697 - protein, 9 aa, Tick-borne encephalitis virus
ELILDTGRK

SEQ ID NO: 192698 - protein, 9 aa, Tick-borne encephalitis virus
GAIPIDLVK

SEQ ID NO: 192699 - protein, 9 aa, Tick-borne encephalitis virus
AIPIDLVKG

SEQ ID NO: 192700 - protein, 9 aa, Tick-borne encephalitis virus
IPIDLVKGT

SEQ ID NO: 192701 - protein, 9 aa, Tick-borne encephalitis virus
PIDLVKGTS

SEQ ID NO: 192702 - protein, 9 aa, Tick-borne encephalitis virus
IDLVKGTSG

SEQ ID NO: 192703 - protein, 9 aa, Tick-borne encephalitis virus
DLVKGTSGS

SEQ ID NO: 192704 - protein, 9 aa, Tick-borne encephalitis virus
LVKGTSGSP

SEQ ID NO: 192705 - protein, 9 aa, Tick-borne encephalitis virus
VKGTSGSPI

SEQ ID NO: 192706 - protein, 9 aa, Tick-borne encephalitis virus
KGTSGSPTL

SEQ ID NO: 192707 - protein, 9 aa, Tick-borne encephalitis virus
GTSGSPIIN

SEQ ID NO: 192708 - protein, 9 aa, Tick-borne encephalitis virus
TSGSPILNA

SEQ ID NO: 192709 - protein, 9 aa, Tick-borne encephalitis virus
SGSPILNAQ

SEQ ID NO: 192710 - protein, 9 aa, Tick-borne encephalitis virus
GSPILNAQG

SEQ ID NO: 192711 - protein, 9 aa, Tick-borne encephalitis virus
SPILNAQGV

SEQ ID NO: 192712 - protein, 9 aa, Tick-borne encephalitis virus
PILNAQGVV

SEQ ID NO: 192713 - protein, 9 aa, Tick-borne encephalitis virus
ILNAQGVVV

SEQ ID NO: 192714 - protein, 9 aa, Tick-borne encephalitis virus
LNAQGVVVG

SEQ ID NO: 192715 - protein, 9 aa, Tick-borne encephalitis virus
NAQGVVVGL

SEQ ID NO: 192716 - protein, 9 aa, Tick-borne encephalitis virus
AQGVVVGLY

SEQ ID NO: 192717 - protein, 9 aa, Tick-borne encephalitis virus
QGAVVGLYG

SEQ ID NO: 192718 - protein, 9 aa, Tick-borne encephalitis virus
GAVVGLYGN

SEQ ID NO: 192719 - protein, 9 aa, Tick-borne encephalitis virus
AVVGLYGNG

SEQ ID NO: 192720 - protein, 9 aa, Tick-borne encephalitis virus
YGNGLKTNG

SEQ ID NO: 192721 - protein, 9 aa, Tick-borne encephalitis virus
GNGLKTNGT

SEQ ID NO: 192722 - protein, 9 aa, Tick-borne encephalitis virus
NGLKTNGTY

SEQ ID NO: 192723 - protein, 9 aa, Tick-borne encephalitis virus
GLKTNGTYV

SEQ ID NO: 192724 - protein, 9 aa, Tick-borne encephalitis virus
LKTNGTYVS

SEQ ID NO: 192725 - protein, 9 aa, Tick-borne encephalitis virus
KTNGTYVSS

SEQ ID NO: 192726 - protein, 9 aa, Tick-borne encephalitis virus
TNGTYVSSI

SEQ ID NO: 192727 - protein, 9 aa, Tick-borne encephalitis virus
NGTYVSSIA

SEQ ID NO: 192728 - protein, 9 aa, Tick-borne encephalitis virus
GTYVSSIAQ

SEQ ID NO: 192729 - protein, 9 aa, Tick-borne encephalitis virus
VSSIAQGEV

SEQ ID NO: 192730 - protein, 9 aa, Tick-borne encephalitis virus
SSIAQGEVE

SEQ ID NO: 192731 - protein, 9 aa, Tick-borne encephalitis virus
SIAQGEVEK

SEQ ID NO: 192732 - protein, 9 aa, Tick-borne encephalitis virus
IAQGEVEKS

SEQ ID NO: 192733 - protein, 9 aa, Tick-borne encephalitis virus
AQGEVEKSR

SEQ ID NO: 192734 - protein, 9 aa, Tick-borne encephalitis virus
QGEVEKSRP

SEQ ID NO: 192735 - protein, 9 aa, Tick-borne encephalitis virus
GEVEKSRPN

SEQ ID NO: 192736 - protein, 9 aa, Tick-borne encephalitis virus
EVEKSRPNL

SEQ ID NO: 192737 - protein, 9 aa, Tick-borne encephalitis virus
VEKSRPNLP

SEQ ID NO: 192738 - protein, 9 aa, Tick-borne encephalitis virus
EKSRPNLPQ

SEQ ID NO: 192739 - protein, 9 aa, Tick-borne encephalitis virus
KSRPNLPQA

SEQ ID NO: 192740 - protein, 9 aa, Tick-borne encephalitis virus
SRPNLPQAV

SEQ ID NO: 192741 - protein, 9 aa, Tick-borne encephalitis virus
GTGWTSKGQ

SEQ ID NO: 192742 - protein, 9 aa, Tick-borne encephalitis virus
TGWTSKGQI

SEQ ID NO: 192743 - protein, 9 aa, Tick-borne encephalitis virus
GWTSKGQIT

SEQ ID NO: 192744 - protein, 9 aa, Tick-borne encephalitis virus
WTSKGQITV

SEQ ID NO: 192745 - protein, 9 aa, Tick-borne encephalitis virus
TSKGQITVL

SEQ ID NO: 192746 - protein, 9 aa, Tick-borne encephalitis virus
SKGQITVLD

SEQ ID NO: 192747 - protein, 9 aa, Tick-borne encephalitis virus
LPELIRQCT

SEQ ID NO: 192748 - protein, 9 aa, Tick-borne encephalitis virus
PELIRQCTD

SEQ ID NO: 192749 - protein, 9 aa, Tick-borne encephalitis virus
ELIRQCTDR

SEQ ID NO: 192750 - protein, 9 aa, Tick-borne encephalitis virus
LIRQCTDRR

SEQ ID NO: 192751 - protein, 9 aa, Tick-borne encephalitis virus
IRQCTDRRL

SEQ ID NO: 192752 - protein, 9 aa, Tick-borne encephalitis virus
RQCTDRRLR

SEQ ID NO: 192753 - protein, 9 aa, Tick-borne encephalitis virus
QCTDRRLRT

SEQ ID NO: 192754 - protein, 9 aa, Tick-borne encephalitis virus
CTDRRLRTL

SEQ ID NO: 192755 - protein, 9 aa, Tick-borne encephalitis virus
TDRRLRTLV

SEQ ID NO: 192756 - protein, 9 aa, Tick-borne encephalitis virus
LKEMERALS

SEQ ID NO: 192757 - protein, 9 aa, Tick-borne encephalitis virus
KEMERALSG

SEQ ID NO: 192758 - protein, 9 aa, Tick-borne encephalitis virus
EMERALSGK

SEQ ID NO: 192759 - protein, 9 aa, Tick-borne encephalitis virus
MERALSGKR

SEQ ID NO: 192760 - protein, 9 aa, Tick-borne encephalitis virus
ERALSGKRV

SEQ ID NO: 192761 - protein, 9 aa, Tick-borne encephalitis virus
RALSGKRVR

SEQ ID NO: 192762 - protein, 9 aa, Tick-borne encephalitis virus
ALSGKRVRF

SEQ ID NO: 192763 - protein, 9 aa, Tick-borne encephalitis virus
LSGKRVRFH

SEQ ID NO: 192764 - protein, 9 aa, Tick-borne encephalitis virus
SGKRVRFHS

SEQ ID NO: 192765 - protein, 9 aa, Tick-borne encephalitis virus
GKRVRFLSP

SEQ ID NO: 192766 - protein, 9 aa, Tick-borne encephalitis virus
KRVRFLSPA

SEQ ID NO: 192767 - protein, 9 aa, Tick-borne encephalitis virus
RVRFLSPAV

SEQ ID NO: 192768 - protein, 9 aa, Tick-borne encephalitis virus
VRFHSPAVS

SEQ ID NO: 192769 - protein, 9 aa, Tick-borne encephalitis virus
RFHSPAVSD

SEQ ID NO: 192770 - protein, 9 aa, Tick-borne encephalitis virus
FHSPAVSDQ

SEQ ID NO: 192771 - protein, 9 aa, Tick-borne encephalitis virus
HSPAVSDQQ

SEQ ID NO: 192772 - protein, 9 aa, Tick-borne encephalitis virus
DQQAGGAIV

SEQ ID NO: 192773 - protein, 9 aa, Tick-borne encephalitis virus
QQAGGAIVD

SEQ ID NO: 192774 - protein, 9 aa, Tick-borne encephalitis virus
GGSIVDVMC

SEQ ID NO: 192775 - protein, 9 aa, Tick-borne encephalitis virus
GSIVDVMCH

SEQ ID NO: 192776 - protein, 9 aa, Tick-borne encephalitis virus
SIVDVMCHA

SEQ ID NO: 192777 - protein, 9 aa, Tick-borne encephalitis virus
IVDLMCHTT

SEQ ID NO: 192778 - protein, 9 aa, Tick-borne encephalitis virus
VDLMCHTTY

SEQ ID NO: 192779 - protein, 9 aa, Tick-borne encephalitis virus
DLMCHTTYV

SEQ ID NO: 192780 - protein, 9 aa, Tick-borne encephalitis virus
LMCHTTYVN

SEQ ID NO: 192781 - protein, 9 aa, Tick-borne encephalitis virus
MCHTTYVNR

SEQ ID NO: 192782 - protein, 9 aa, Tick-borne encephalitis virus
CHTTYVNRR

SEQ ID NO: 192783 - protein, 9 aa, Tick-borne encephalitis virus
HATYVSRRL

SEQ ID NO: 192784 - protein, 9 aa, Tick-borne encephalitis virus
TTYVNRRLL

SEQ ID NO: 192785 - protein, 9 aa, Tick-borne encephalitis virus
TYVSRRLLP

SEQ ID NO: 192786 - protein, 9 aa, Tick-borne encephalitis virus
YVSRRLLPQ

SEQ ID NO: 192787 - protein, 9 aa, Tick-borne encephalitis virus
VSRRLLPQG

SEQ ID NO: 192788 - protein, 9 aa, Tick-borne encephalitis virus
SRRLLPQGR

SEQ ID NO: 192789 - protein, 9 aa, Tick-borne encephalitis virus
GRQNWEVAT

SEQ ID NO: 192790 - protein, 9 aa, Tick-borne encephalitis virus
RQNWEVATI

SEQ ID NO: 192791 - protein, 9 aa, Tick-borne encephalitis virus
QNWEVATID

SEQ ID NO: 192792 - protein, 9 aa, Tick-borne encephalitis virus
NWEVATIDE

SEQ ID NO: 192793 - protein, 9 aa, Tick-borne encephalitis virus
WEVATIDEA

SEQ ID NO: 192794 - protein, 9 aa, Tick-borne encephalitis virus
EVATIDEAH

SEQ ID NO: 192795 - protein, 9 aa, Tick-borne encephalitis virus
VATIDEAHW

SEQ ID NO: 192796 - protein, 9 aa, Tick-borne encephalitis virus
ATIDEAHWT

SEQ ID NO: 192797 - protein, 9 aa, Tick-borne encephalitis virus
TIDEAHWTD

SEQ ID NO: 192798 - protein, 9 aa, Tick-borne encephalitis virus
IDEAHWTDP

SEQ ID NO: 192799 - protein, 9 aa, Tick-borne encephalitis virus
RGHLYTLAQ

SEQ ID NO: 192800 - protein, 9 aa, Tick-borne encephalitis virus
GHLYTLAQE

SEQ ID NO: 192801 - protein, 9 aa, Tick-borne encephalitis virus
HLYTLAQEN

SEQ ID NO: 192802 - protein, 9 aa, Tick-borne encephalitis virus
LYTLAQENK

SEQ ID NO: 192803 - protein, 9 aa, Tick-borne encephalitis virus
YTLAQENKC

SEQ ID NO: 192804 - protein, 9 aa, Tick-borne encephalitis virus
TLAQENKCA

SEQ ID NO: 192805 - protein, 9 aa, Tick-borne encephalitis virus
LAQENKCAL

SEQ ID NO: 192806 - protein, 9 aa, Tick-borne encephalitis virus
AQENKCALV

SEQ ID NO: 192807 - protein, 9 aa, Tick-borne encephalitis virus
QENKCALVL

SEQ ID NO: 192808 - protein, 9 aa, Tick-borne encephalitis virus
ALVLMTATR

SEQ ID NO: 192809 - protein, 9 aa, Tick-borne encephalitis virus
LVLMTATRP

SEQ ID NO: 192810 - protein, 9 aa, Tick-borne encephalitis virus
VLMTATRPG

SEQ ID NO: 192811 - protein, 9 aa, Tick-borne encephalitis virus
LMTATRPGK

SEQ ID NO: 192812 - protein, 9 aa, Tick-borne encephalitis virus
MTATRPGKS

SEQ ID NO: 192813 - protein, 9 aa, Tick-borne encephalitis virus
TATRPGKSE

SEQ ID NO: 192814 - protein, 9 aa, Tick-borne encephalitis virus
ATRPGKSEP

SEQ ID NO: 192815 - protein, 9 aa, Tick-borne encephalitis virus
TRPGKSEPF

SEQ ID NO: 192816 - protein, 9 aa, Tick-borne encephalitis virus
RPGKSEPFP

SEQ ID NO: 192817 - protein, 9 aa, Tick-borne encephalitis virus
SEPFPESNR

SEQ ID NO: 192818 - protein, 9 aa, Tick-borne encephalitis virus
EPFPESNRG

SEQ ID NO: 192819 - protein, 9 aa, Tick-borne encephalitis virus
PFPESNRGI

SEQ ID NO: 192820 - protein, 9 aa, Tick-borne encephalitis virus
FPESNGAIS

SEQ ID NO: 192821 - protein, 9 aa, Tick-borne encephalitis virus
PESNGAISS

SEQ ID NO: 192822 - protein, 9 aa, Tick-borne encephalitis virus
ESNGAISSE

SEQ ID NO: 192823 - protein, 9 aa, Tick-borne encephalitis virus
SNGAISSEE

SEQ ID NO: 192824 - protein, 9 aa, Tick-borne encephalitis virus
NGAITSEEK

SEQ ID NO: 192825 - protein, 9 aa, Tick-borne encephalitis virus
GAITSEEKQ

SEQ ID NO: 192826 - protein, 9 aa, Tick-borne encephalitis virus
AITSEEKQI

SEQ ID NO: 192827 - protein, 9 aa, Tick-borne encephalitis virus
ITSEEKQIP

SEQ ID NO: 192828 - protein, 9 aa, Tick-borne encephalitis virus
SEERQIPDG

SEQ ID NO: 192829 - protein, 9 aa, Tick-borne encephalitis virus
EERQIPDGE

SEQ ID NO: 192830 - protein, 9 aa, Tick-borne encephalitis virus
ERQIPDGEW

SEQ ID NO: 192831 - protein, 9 aa, Tick-borne encephalitis virus
RQIPDGEWR

SEQ ID NO: 192832 - protein, 9 aa, Tick-borne encephalitis virus
QIPEGEWRD

SEQ ID NO: 192833 - protein, 9 aa, Tick-borne encephalitis virus
IPEGEWRDG

SEQ ID NO: 192834 - protein, 9 aa, Tick-borne encephalitis virus
PEGEWRDGF

SEQ ID NO: 192835 - protein, 9 aa, Tick-borne encephalitis virus
EGEWRDGFD

SEQ ID NO: 192836 - protein, 9 aa, Tick-borne encephalitis virus
WITEYEGRS

SEQ ID NO: 192837 - protein, 9 aa, Tick-borne encephalitis virus
ITEYEGRSA

SEQ ID NO: 192838 - protein, 9 aa, Tick-borne encephalitis virus
TEYEGRSAW

SEQ ID NO: 192839 - protein, 9 aa, Tick-borne encephalitis virus
EYEGRSAWF

SEQ ID NO: 192840 - protein, 9 aa, Tick-borne encephalitis virus
YEGRSAWFV

SEQ ID NO: 192841 - protein, 9 aa, Tick-borne encephalitis virus
EGRSAWFVP

SEQ ID NO: 192842 - protein, 9 aa, Tick-borne encephalitis virus
GRSAWFVPS

SEQ ID NO: 192843 - protein, 9 aa, Tick-borne encephalitis virus
RSAWFVPSI

SEQ ID NO: 192844 - protein, 9 aa, Tick-borne encephalitis virus
TAWFVPSIV

SEQ ID NO: 192845 - protein, 9 aa, Tick-borne encephalitis virus
AWFVPSIVK

SEQ ID NO: 192846 - protein, 9 aa, Tick-borne encephalitis virus
WFVPSIVKG

SEQ ID NO: 192847 - protein, 9 aa, Tick-borne encephalitis virus
FVPSIVKGG

SEQ ID NO: 192848 - protein, 9 aa, Tick-borne encephalitis virus
VPSIAKGGA

SEQ ID NO: 192849 - protein, 9 aa, Tick-borne encephalitis virus
PSIAKGGAI

SEQ ID NO: 192850 - protein, 9 aa, Tick-borne encephalitis virus
SIAKGGAIA

SEQ ID NO: 192851 - protein, 9 aa, Tick-borne encephalitis virus
IAKGGAIAR

SEQ ID NO: 192852 - protein, 9 aa, Tick-borne encephalitis virus
AKGGAIART

SEQ ID NO: 192853 - protein, 9 aa, Tick-borne encephalitis virus
KGGAIARTL

SEQ ID NO: 192854 - protein, 9 aa, Tick-borne encephalitis virus
GGAIARTLR

SEQ ID NO: 192855 - protein, 9 aa, Tick-borne encephalitis virus
GAIARTLRQ

SEQ ID NO: 192856 - protein, 9 aa, Tick-borne encephalitis virus
AIARTLRQK

SEQ ID NO: 192857 - protein, 9 aa, Tick-borne encephalitis virus
IARALRQKG

SEQ ID NO: 192858 - protein, 9 aa, Tick-borne encephalitis virus
ARALRQKGK

SEQ ID NO: 192859 - protein, 9 aa, Tick-borne encephalitis virus
RALRQKGKS

SEQ ID NO: 192860 - protein, 9 aa, Tick-borne encephalitis virus
ALRQKGKSV

SEQ ID NO: 192861 - protein, 9 aa, Tick-borne encephalitis virus
SKTFEKDYT

SEQ ID NO: 192862 - protein, 9 aa, Tick-borne encephalitis virus
KTFEKDYTR

SEQ ID NO: 192863 - protein, 9 aa, Tick-borne encephalitis virus
TFEKDYTRV

SEQ ID NO: 192864 - protein, 9 aa, Tick-borne encephalitis virus
FEKDYTRVR

SEQ ID NO: 192865 - protein, 9 aa, Tick-borne encephalitis virus
EKDYTRVRD

SEQ ID NO: 192866 - protein, 9 aa, Tick-borne encephalitis virus
KDYTRVRDE

SEQ ID NO: 192867 - protein, 9 aa, Tick-borne encephalitis virus
DYTRVRDEK

SEQ ID NO: 192868 - protein, 9 aa, Tick-borne encephalitis virus
YTRVRDEKP

SEQ ID NO: 192869 - protein, 9 aa, Tick-borne encephalitis virus
TRVRDEKPD

SEQ ID NO: 192870 - protein, 9 aa, Tick-borne encephalitis virus
IKPEEVDGK

SEQ ID NO: 192871 - protein, 9 aa, Tick-borne encephalitis virus
KPEEVDGKV

SEQ ID NO: 192872 - protein, 9 aa, Tick-borne encephalitis virus
PEEVDGKVE

SEQ ID NO: 192873 - protein, 9 aa, Tick-borne encephalitis virus
EEVDGKVEL

SEQ ID NO: 192874 - protein, 9 aa, Tick-borne encephalitis virus
EVDGKVELT

SEQ ID NO: 192875 - protein, 9 aa, Tick-borne encephalitis virus
VDGKVELTG

SEQ ID NO: 192876 - protein, 9 aa, Tick-borne encephalitis virus
DGKVELTGT

SEQ ID NO: 192877 - protein, 9 aa, Tick-borne encephalitis virus
GKVELTGTR

SEQ ID NO: 192878 - protein, 9 aa, Tick-borne encephalitis virus
KVELTGTRR

SEQ ID NO: 192879 - protein, 9 aa, Tick-borne encephalitis virus
VELIGTRRV

SEQ ID NO: 192880 - protein, 9 aa, Tick-borne encephalitis virus
ELIGTRRVT

SEQ ID NO: 192881 - protein, 9 aa, Tick-borne encephalitis virus
LIGTRRVTT

SEQ ID NO: 192882 - protein, 9 aa, Tick-borne encephalitis virus
IGTRRVTTA

SEQ ID NO: 192883 - protein, 9 aa, Tick-borne encephalitis virus
RVTTASAAP

SEQ ID NO: 192884 - protein, 9 aa, Tick-borne encephalitis virus
VTTASAAPR

SEQ ID NO: 192885 - protein, 9 aa, Tick-borne encephalitis virus
TTASAAPRR

SEQ ID NO: 192886 - protein, 9 aa, Tick-borne encephalitis virus
TASAAPRRG

SEQ ID NO: 192887 - protein, 9 aa, Tick-borne encephalitis virus
ASAAPRRGR

SEQ ID NO: 192888 - protein, 9 aa, Tick-borne encephalitis virus
SAAPRRGRV

SEQ ID NO: 192889 - protein, 9 aa, Tick-borne encephalitis virus
AAPRRGRVG

SEQ ID NO: 192890 - protein, 9 aa, Tick-borne encephalitis virus
APRRGRVGR

SEQ ID NO: 192891 - protein, 9 aa, Tick-borne encephalitis virus
QRRGRVGRH

SEQ ID NO: 192892 - protein, 9 aa, Tick-borne encephalitis virus
RRGRVGRQD

SEQ ID NO: 192893 - protein, 9 aa, Tick-borne encephalitis virus
RGRVGRQDG

SEQ ID NO: 192894 - protein, 9 aa, Tick-borne encephalitis virus
GRVGRQDGR

SEQ ID NO: 192895 - protein, 9 aa, Tick-borne encephalitis virus
RVGRQDGRT

SEQ ID NO: 192896 - protein, 9 aa, Tick-borne encephalitis virus
VGRQDGRTD

SEQ ID NO: 192897 - protein, 9 aa, Tick-borne encephalitis virus
GRQDGRTDE

SEQ ID NO: 192898 - protein, 9 aa, Tick-borne encephalitis virus
RQDGRTDEY

SEQ ID NO: 192899 - protein, 9 aa, Tick-borne encephalitis virus
QDGRTDEYI

SEQ ID NO: 192900 - protein, 9 aa, Tick-borne encephalitis virus
DGRTDEYIY

SEQ ID NO: 192901 - protein, 9 aa, Tick-borne encephalitis virus
GRIDEYIYS

SEQ ID NO: 192902 - protein, 9 aa, Tick-borne encephalitis virus
RIDEYIYSG

SEQ ID NO: 192903 - protein, 9 aa, Tick-borne encephalitis virus
IDEYIYSGQ

SEQ ID NO: 192904 - protein, 9 aa, Tick-borne encephalitis virus
YIYSGQCDE

SEQ ID NO: 192905 - protein, 9 aa, Tick-borne encephalitis virus
IYSGQCDEY

SEQ ID NO: 192906 - protein, 9 aa, Tick-borne encephalitis virus
YSGQCDEYD

SEQ ID NO: 192907 - protein, 9 aa, Tick-borne encephalitis virus
SGQCDEYDS

SEQ ID NO: 192908 - protein, 9 aa, Tick-borne encephalitis virus
GQCDDDDGG

SEQ ID NO: 192909 - protein, 9 aa, Tick-borne encephalitis virus
QCDDDDGGL

SEQ ID NO: 192910 - protein, 9 aa, Tick-borne encephalitis virus
CDDDDSVLV

SEQ ID NO: 192911 - protein, 9 aa, Tick-borne encephalitis virus
DDDDSVLVQ

SEQ ID NO: 192912 - protein, 9 aa, Tick-borne encephalitis virus
DDDSVLVQW

SEQ ID NO: 192913 - protein, 9 aa, Tick-borne encephalitis virus
DDGGLVQWK

SEQ ID NO: 192914 - protein, 9 aa, Tick-borne encephalitis virus
DGGLVQWKE

SEQ ID NO: 192915 - protein, 9 aa, Tick-borne encephalitis virus
GGLVQWKEA

SEQ ID NO: 192916 - protein, 9 aa, Tick-borne encephalitis virus
GLVQWKEGQ

SEQ ID NO: 192917 - protein, 9 aa, Tick-borne encephalitis virus
LVQWKEGQI

SEQ ID NO: 192918 - protein, 9 aa, Tick-borne encephalitis virus
VQWKEGQIL

SEQ ID NO: 192919 - protein, 9 aa, Tick-borne encephalitis virus
QWKEGQILL

SEQ ID NO: 192920 - protein, 9 aa, Tick-borne encephalitis virus
WKEGQILLD

SEQ ID NO: 192921 - protein, 9 aa, Tick-borne encephalitis virus
KEAQILLDD

SEQ ID NO: 192922 - protein, 9 aa, Tick-borne encephalitis virus
EAQILLDDI

SEQ ID NO: 192923 - protein, 9 aa, Tick-borne encephalitis virus
AQILLDDIT

SEQ ID NO: 192924 - protein, 9 aa, Tick-borne encephalitis virus
QILLDNIIT

SEQ ID NO: 192925 - protein, 9 aa, Tick-borne encephalitis virus
ILLDNIITL

SEQ ID NO: 192926 - protein, 9 aa, Tick-borne encephalitis virus
LLDDITTLR

SEQ ID NO: 192927 - protein, 9 aa, Tick-borne encephalitis virus
LDNIITLRG

SEQ ID NO: 192928 - protein, 9 aa, Tick-borne encephalitis virus
DDITTLRGP

SEQ ID NO: 192929 - protein, 9 aa, Tick-borne encephalitis virus
DITTLRGPV

SEQ ID NO: 192930 - protein, 9 aa, Tick-borne encephalitis virus
ITTLRGPVV

SEQ ID NO: 192931 - protein, 9 aa, Tick-borne encephalitis virus
ITLRGPVAT

SEQ ID NO: 192932 - protein, 9 aa, Tick-borne encephalitis virus
TLRGPVVTF

SEQ ID NO: 192933 - protein, 9 aa, Tick-borne encephalitis virus
LRGPVVTFY

SEQ ID NO: 192934 - protein, 9 aa, Tick-borne encephalitis virus
RGPVVTFYG

SEQ ID NO: 192935 - protein, 9 aa, Tick-borne encephalitis virus
GPVVTFYGP

SEQ ID NO: 192936 - protein, 9 aa, Tick-borne encephalitis virus
PVVTFYGPE

SEQ ID NO: 192937 - protein, 9 aa, Tick-borne encephalitis virus
VVTFYGPEQ

SEQ ID NO: 192938 - protein, 9 aa, Tick-borne encephalitis virus
VTFYGPEQD

SEQ ID NO: 192939 - protein, 9 aa, Tick-borne encephalitis virus
TFYGPEQDR

SEQ ID NO: 192940 - protein, 9 aa, Tick-borne encephalitis virus
FYGPEQDRM

SEQ ID NO: 192941 - protein, 9 aa, Tick-borne encephalitis virus
YGPEQDRMP

SEQ ID NO: 192942 - protein, 9 aa, Tick-borne encephalitis virus
GPEQDRMPE

SEQ ID NO: 192943 - protein, 9 aa, Tick-borne encephalitis virus
PEQDRMPEV

SEQ ID NO: 192944 - protein, 9 aa, Tick-borne encephalitis virus
EQDRMPEVA

SEQ ID NO: 192945 - protein, 9 aa, Tick-borne encephalitis virus
QDRMPEVAG

SEQ ID NO: 192946 - protein, 9 aa, Tick-borne encephalitis virus
DRMPEVAGH

SEQ ID NO: 192947 - protein, 9 aa, Tick-borne encephalitis virus
RMPEVAGHF

SEQ ID NO: 192948 - protein, 9 aa, Tick-borne encephalitis virus
MPEVAGHYR

SEQ ID NO: 192949 - protein, 9 aa, Tick-borne encephalitis virus
PEVAGHYRL

SEQ ID NO: 192950 - protein, 9 aa, Tick-borne encephalitis virus
EVAGHYRLT

SEQ ID NO: 192951 - protein, 9 aa, Tick-borne encephalitis virus
VAGHYRLTE

SEQ ID NO: 192952 - protein, 9 aa, Tick-borne encephalitis virus
AGHYRLTEE

SEQ ID NO: 192953 - protein, 9 aa, Tick-borne encephalitis virus
GHYRLTEEK

SEQ ID NO: 192954 - protein, 9 aa, Tick-borne encephalitis virus
HYRLTEEKR

SEQ ID NO: 192955 - protein, 9 aa, Tick-borne encephalitis virus
YRLTEEKRK

SEQ ID NO: 192956 - protein, 9 aa, Tick-borne encephalitis virus
WHVAANVSG

SEQ ID NO: 192957 - protein, 9 aa, Tick-borne encephalitis virus
HVAANVSGV

SEQ ID NO: 192958 - protein, 9 aa, Tick-borne encephalitis virus
VAANVSGVT

SEQ ID NO: 192959 - protein, 9 aa, Tick-borne encephalitis virus
AANVSSVTD

SEQ ID NO: 192960 - protein, 9 aa, Tick-borne encephalitis virus
ANVSSVTDR

SEQ ID NO: 192961 - protein, 9 aa, Tick-borne encephalitis virus
NVSSVTDRS

SEQ ID NO: 192962 - protein, 9 aa, Tick-borne encephalitis virus
VSSVTDRSW

SEQ ID NO: 192963 - protein, 9 aa, Tick-borne encephalitis virus
SSVTDRSWT

SEQ ID NO: 192964 - protein, 9 aa, Tick-borne encephalitis virus
SVTDRSWTW

SEQ ID NO: 192965 - protein, 9 aa, Tick-borne encephalitis virus
VTDRSWTWE

SEQ ID NO: 192966 - protein, 9 aa, Tick-borne encephalitis virus
TDRSWTWEG

SEQ ID NO: 192967 - protein, 9 aa, Tick-borne encephalitis virus
DRSWTWEGP

SEQ ID NO: 192968 - protein, 9 aa, Tick-borne encephalitis virus
RSWTWEGPE

SEQ ID NO: 192969 - protein, 9 aa, Tick-borne encephalitis virus
SWTWEGPEA

SEQ ID NO: 192970 - protein, 9 aa, Tick-borne encephalitis virus
WTWEGPEAN

SEQ ID NO: 192971 - protein, 9 aa, Tick-borne encephalitis virus
TWEGPEENA

SEQ ID NO: 192972 - protein, 9 aa, Tick-borne encephalitis virus
WEGPEANAV

SEQ ID NO: 192973 - protein, 9 aa, Tick-borne encephalitis virus
EGPEENAVD

SEQ ID NO: 192974 - protein, 9 aa, Tick-borne encephalitis virus
GPEENAVDE

SEQ ID NO: 192975 - protein, 9 aa, Tick-borne encephalitis virus
PEENAVDEA

SEQ ID NO: 192976 - protein, 9 aa, Tick-borne encephalitis virus
EANAVDEAS

SEQ ID NO: 192977 - protein, 9 aa, Tick-borne encephalitis virus
ANAVDEASG

SEQ ID NO: 192978 - protein, 9 aa, Tick-borne encephalitis virus
NAVDEANGD

SEQ ID NO: 192979 - protein, 9 aa, Tick-borne encephalitis virus
AVDEANGDL

SEQ ID NO: 192980 - protein, 9 aa, Tick-borne encephalitis virus
VDEASGDLV

SEQ ID NO: 192981 - protein, 9 aa, Tick-borne encephalitis virus
DEASGDLVT

SEQ ID NO: 192982 - protein, 9 aa, Tick-borne encephalitis virus
EASGDLVTF

SEQ ID NO: 192983 - protein, 9 aa, Tick-borne encephalitis virus
ASGDLVTFR

SEQ ID NO: 192984 - protein, 9 aa, Tick-borne encephalitis virus
SGDLVTFRS

SEQ ID NO: 192985 - protein, 9 aa, Tick-borne encephalitis virus
GDLVTFKSP

SEQ ID NO: 192986 - protein, 9 aa, Tick-borne encephalitis virus
DLVTFKSPN

SEQ ID NO: 192987 - protein, 9 aa, Tick-borne encephalitis virus
LVTFKSPNG

SEQ ID NO: 192988 - protein, 9 aa, Tick-borne encephalitis virus
VTFKSPNGA

SEQ ID NO: 192989 - protein, 9 aa, Tick-borne encephalitis virus
TFKSPNGAE

SEQ ID NO: 192990 - protein, 9 aa, Tick-borne encephalitis virus
FKSPNGAER

SEQ ID NO: 192991 - protein, 9 aa, Tick-borne encephalitis virus
KSPNGAERT

SEQ ID NO: 192992 - protein, 9 aa, Tick-borne encephalitis virus
PNGAERTLK

SEQ ID NO: 192993 - protein, 9 aa, Tick-borne encephalitis virus
NGAERTLKP

SEQ ID NO: 192994 - protein, 9 aa, Tick-borne encephalitis virus
GAERTLKPV

SEQ ID NO: 192995 - protein, 9 aa, Tick-borne encephalitis virus
AERTLKPVW

SEQ ID NO: 192996 - protein, 9 aa, Tick-borne encephalitis virus
ERTLRPVWK

SEQ ID NO: 192997 - protein, 9 aa, Tick-borne encephalitis virus
RTLRPVWKD

SEQ ID NO: 192998 - protein, 9 aa, Tick-borne encephalitis virus
TLRPVWKDA

SEQ ID NO: 192999 - protein, 9 aa, Tick-borne encephalitis virus
LRPVWKDAR

SEQ ID NO: 193000 - protein, 9 aa, Tick-borne encephalitis virus
RPVWKDARM

SEQ ID NO: 193001 - protein, 9 aa, Tick-borne encephalitis virus
PVWKDARMF

SEQ ID NO: 193002 - protein, 9 aa, Tick-borne encephalitis virus
VWKDARMFK

SEQ ID NO: 193003 - protein, 9 aa, Tick-borne encephalitis virus
WKDARMFKE

SEQ ID NO: 193004 - protein, 9 aa, Tick-borne encephalitis virus
KDARMFKEG

SEQ ID NO: 193005 - protein, 9 aa, Tick-borne encephalitis virus
DARMFKEGR

SEQ ID NO: 193006 - protein, 9 aa, Tick-borne encephalitis virus
ARMFKEGRD

SEQ ID NO: 193007 - protein, 9 aa, Tick-borne encephalitis virus
RMFKEGRDI

SEQ ID NO: 193008 - protein, 9 aa, Tick-borne encephalitis virus
MFKEGRDIK

SEQ ID NO: 193009 - protein, 9 aa, Tick-borne encephalitis virus
FKEGRDIKE

SEQ ID NO: 193010 - protein, 9 aa, Tick-borne encephalitis virus
KEGRDIKEF

SEQ ID NO: 193011 - protein, 9 aa, Tick-borne encephalitis virus
EGRDIKEFV

SEQ ID NO: 193012 - protein, 9 aa, Tick-borne encephalitis virus
GRDIKEFVA

SEQ ID NO: 193013 - protein, 9 aa, Tick-borne encephalitis virus
RDIKEFVAY

SEQ ID NO: 193014 - protein, 9 aa, Tick-borne encephalitis virus
DIKEFVAYA

SEQ ID NO: 193015 - protein, 9 aa, Tick-borne encephalitis virus
IKEFVAYAS

SEQ ID NO: 193016 - protein, 9 aa, Tick-borne encephalitis virus
KEFVAYASG

SEQ ID NO: 193017 - protein, 9 aa, Tick-borne encephalitis virus
EFIAYASGR

SEQ ID NO: 193018 - protein, 9 aa, Tick-borne encephalitis virus
FIAYASGRR

SEQ ID NO: 193019 - protein, 9 aa, Tick-borne encephalitis virus
IAYASGRRS

SEQ ID NO: 193020 - protein, 9 aa, Tick-borne encephalitis virus
AYASGRRSI

SEQ ID NO: 193021 - protein, 9 aa, Tick-borne encephalitis virus
YASGRRSIG

SEQ ID NO: 193022 - protein, 9 aa, Tick-borne encephalitis virus
ASGRRSIGD

SEQ ID NO: 193023 - protein, 9 aa, Tick-borne encephalitis virus
SGRRSIGDV

SEQ ID NO: 193024 - protein, 9 aa, Tick-borne encephalitis virus
GRRSIGDVL

SEQ ID NO: 193025 - protein, 9 aa, Tick-borne encephalitis virus
RRSFGDVLT

SEQ ID NO: 193026 - protein, 9 aa, Tick-borne encephalitis virus
RSFGDVLTG

SEQ ID NO: 193027 - protein, 9 aa, Tick-borne encephalitis virus
SFGDVLTGM

SEQ ID NO: 193028 - protein, 9 aa, Tick-borne encephalitis virus
FGDVLTGMS

SEQ ID NO: 193029 - protein, 9 aa, Tick-borne encephalitis virus
GDVLTGMSG

SEQ ID NO: 193030 - protein, 9 aa, Tick-borne encephalitis virus
DVLTGMSGV

SEQ ID NO: 193031 - protein, 9 aa, Tick-borne encephalitis virus
VLTGMSGVP

SEQ ID NO: 193032 - protein, 9 aa, Tick-borne encephalitis virus
LTGMSGVPE

SEQ ID NO: 193033 - protein, 9 aa, Tick-borne encephalitis virus
TGMSGVPEL

SEQ ID NO: 193034 - protein, 9 aa, Tick-borne encephalitis virus
LRHRCVSAL

SEQ ID NO: 193035 - protein, 9 aa, Tick-borne encephalitis virus
RHRCVSALD

SEQ ID NO: 193036 - protein, 9 aa, Tick-borne encephalitis virus
HRCVSALDV

SEQ ID NO: 193037 - protein, 9 aa, Tick-borne encephalitis virus
RCVSALDVF

SEQ ID NO: 193038 - protein, 9 aa, Tick-borne encephalitis virus
CVSALDVFY

SEQ ID NO: 193039 - protein, 9 aa, Tick-borne encephalitis virus
VSALDVFYT

SEQ ID NO: 193040 - protein, 9 aa, Tick-borne encephalitis virus
SALDVFYTL

SEQ ID NO: 193041 - protein, 9 aa, Tick-borne encephalitis virus
ALDVFYTLM

SEQ ID NO: 193042 - protein, 9 aa, Tick-borne encephalitis virus
LDVFYTLMH

SEQ ID NO: 193043 - protein, 9 aa, Tick-borne encephalitis virus
DVFYTLMHD

SEQ ID NO: 193044 - protein, 9 aa, Tick-borne encephalitis virus
VFYTLMHEK

SEQ ID NO: 193045 - protein, 9 aa, Tick-borne encephalitis virus
FYTLMHEKP

SEQ ID NO: 193046 - protein, 9 aa, Tick-borne encephalitis virus
YTLMHDEPG

SEQ ID NO: 193047 - protein, 9 aa, Tick-borne encephalitis virus
TLMHEKPDS

SEQ ID NO: 193048 - protein, 9 aa, Tick-borne encephalitis virus
LMHEEPGSS

SEQ ID NO: 193049 - protein, 9 aa, Tick-borne encephalitis virus
MHDEPGSRA

SEQ ID NO: 193050 - protein, 9 aa, Tick-borne encephalitis virus
HEEPGSSAM

SEQ ID NO: 193051 - protein, 9 aa, Tick-borne encephalitis virus
EEPGSRAMK

SEQ ID NO: 193052 - protein, 9 aa, Tick-borne encephalitis virus
EPGSRAMKM

SEQ ID NO: 193053 - protein, 9 aa, Tick-borne encephalitis virus
PGSRAMKMA

SEQ ID NO: 193054 - protein, 9 aa, Tick-borne encephalitis virus
GSRAMKMAE

SEQ ID NO: 193055 - protein, 9 aa, Tick-borne encephalitis virus
SRAMKMAER

SEQ ID NO: 193056 - protein, 9 aa, Tick-borne encephalitis virus
RAMKMAERD

SEQ ID NO: 193057 - protein, 9 aa, Tick-borne encephalitis virus
AMKMAERDA

SEQ ID NO: 193058 - protein, 9 aa, Tick-borne encephalitis virus
MKMAERDAP

SEQ ID NO: 193059 - protein, 9 aa, Tick-borne encephalitis virus
KMAERDAPE

SEQ ID NO: 193060 - protein, 9 aa, Tick-borne encephalitis virus
DAPEAFLTM

SEQ ID NO: 193061 - protein, 9 aa, Tick-borne encephalitis virus
APEAFLTMV

SEQ ID NO: 193062 - protein, 9 aa, Tick-borne encephalitis virus
PEAFLTMVE

SEQ ID NO: 193063 - protein, 9 aa, Tick-borne encephalitis virus
AEMMVLGLA

SEQ ID NO: 193064 - protein, 9 aa, Tick-borne encephalitis virus
EVMVLGLAT

SEQ ID NO: 193065 - protein, 9 aa, Tick-borne encephalitis virus
VMVLGLATL

SEQ ID NO: 193066 - protein, 9 aa, Tick-borne encephalitis virus
MVLGLGTLG

SEQ ID NO: 193067 - protein, 9 aa, Tick-borne encephalitis virus
VLGLGTLGV

SEQ ID NO: 193068 - protein, 9 aa, Tick-borne encephalitis virus
LGLATLGVI

SEQ ID NO: 193069 - protein, 9 aa, Tick-borne encephalitis virus
GLATLGVIW

SEQ ID NO: 193070 - protein, 9 aa, Tick-borne encephalitis virus
LATLGVIWC

SEQ ID NO: 193071 - protein, 9 aa, Tick-borne encephalitis virus
ATLGVIWCF

SEQ ID NO: 193072 - protein, 9 aa, Tick-borne encephalitis virus
TLGVIWCFV

SEQ ID NO: 193073 - protein, 9 aa, Tick-borne encephalitis virus
LGVIWCFVV

SEQ ID NO: 193074 - protein, 9 aa, Tick-borne encephalitis virus
GVIWCFVVR

SEQ ID NO: 193075 - protein, 9 aa, Tick-borne encephalitis virus
VIWCFVVRT

SEQ ID NO: 193076 - protein, 9 aa, Tick-borne encephalitis virus
IWCFVVRTS

SEQ ID NO: 193077 - protein, 9 aa, Tick-borne encephalitis virus
WCFVARTSI

SEQ ID NO: 193078 - protein, 9 aa, Tick-borne encephalitis virus
CFVARTSIS

SEQ ID NO: 193079 - protein, 9 aa, Tick-borne encephalitis virus
FVARTSISR

SEQ ID NO: 193080 - protein, 9 aa, Tick-borne encephalitis virus
VVRASISRM

SEQ ID NO: 193081 - protein, 9 aa, Tick-borne encephalitis virus
ARTSISRMM

SEQ ID NO: 193082 - protein, 9 aa, Tick-borne encephalitis virus
RASISRMML

SEQ ID NO: 193083 - protein, 9 aa, Tick-borne encephalitis virus
ASISRMMLG

SEQ ID NO: 193084 - protein, 9 aa, Tick-borne encephalitis virus
TLVLLASLL

SEQ ID NO: 193085 - protein, 9 aa, Tick-borne encephalitis virus
LVLLASLLL

SEQ ID NO: 193086 - protein, 9 aa, Tick-borne encephalitis virus
VLLASLLLL

SEQ ID NO: 193087 - protein, 9 aa, Tick-borne encephalitis virus
LLASLLLLW

SEQ ID NO: 193088 - protein, 9 aa, Tick-borne encephalitis virus
LASLLLLWA

SEQ ID NO: 193089 - protein, 9 aa, Tick-borne encephalitis virus
ASLLLLWAG

SEQ ID NO: 193090 - protein, 9 aa, Tick-borne encephalitis virus
SLLLLWAGG

SEQ ID NO: 193091 - protein, 9 aa, Tick-borne encephalitis virus
LLLLWAGGV

SEQ ID NO: 193092 - protein, 9 aa, Tick-borne encephalitis virus
LLLWAGGVG

SEQ ID NO: 193093 - protein, 9 aa, Tick-borne encephalitis virus
LLWAGGVGY

SEQ ID NO: 193094 - protein, 9 aa, Tick-borne encephalitis virus
LWAGGVGYG

SEQ ID NO: 193095 - protein, 9 aa, Tick-borne encephalitis virus
WAGGVGYGN

SEQ ID NO: 193096 - protein, 9 aa, Tick-borne encephalitis virus
AGGVGYGNM

SEQ ID NO: 193097 - protein, 9 aa, Tick-borne encephalitis virus
GGVGYGNMA

SEQ ID NO: 193098 - protein, 9 aa, Tick-borne encephalitis virus
GVGYGNMAG

SEQ ID NO: 193099 - protein, 9 aa, Tick-borne encephalitis virus
VGYGNMAGV

SEQ ID NO: 193100 - protein, 9 aa, Tick-borne encephalitis virus
GYGNMAGVA

SEQ ID NO: 193101 - protein, 9 aa, Tick-borne encephalitis virus
LLTVLQPEV

SEQ ID NO: 193102 - protein, 9 aa, Tick-borne encephalitis virus
LTVLQPEVG

SEQ ID NO: 193103 - protein, 9 aa, Tick-borne encephalitis virus
TVLQPEVGK

SEQ ID NO: 193104 - protein, 9 aa, Tick-borne encephalitis virus
VLQPEVGKQ

SEQ ID NO: 193105 - protein, 9 aa, Tick-borne encephalitis virus
LQPEVGKQR

SEQ ID NO: 193106 - protein, 9 aa, Tick-borne encephalitis virus
QPEVGKQRS

SEQ ID NO: 193107 - protein, 9 aa, Tick-borne encephalitis virus
PEVGKQRSS

SEQ ID NO: 193108 - protein, 9 aa, Tick-borne encephalitis virus
EVGKQRSSD

SEQ ID NO: 193109 - protein, 9 aa, Tick-borne encephalitis virus
VGKQRSSDD

SEQ ID NO: 193110 - protein, 9 aa, Tick-borne encephalitis virus
YFLLTLCSV

SEQ ID NO: 193111 - protein, 9 aa, Tick-borne encephalitis virus
FLLTLCSVA

SEQ ID NO: 193112 - protein, 9 aa, Tick-borne encephalitis virus
LLTLCSVAG

SEQ ID NO: 193113 - protein, 9 aa, Tick-borne encephalitis virus
LTLCSVAGL

SEQ ID NO: 193114 - protein, 9 aa, Tick-borne encephalitis virus
TLCSVAGLV

SEQ ID NO: 193115 - protein, 9 aa, Tick-borne encephalitis virus
LCSVAGLVA

SEQ ID NO: 193116 - protein, 9 aa, Tick-borne encephalitis virus
CSVAGLVAA

SEQ ID NO: 193117 - protein, 9 aa, Tick-borne encephalitis virus
SVAGLVAAN

SEQ ID NO: 193118 - protein, 9 aa, Tick-borne encephalitis virus
VAGLVAANE

SEQ ID NO: 193119 - protein, 9 aa, Tick-borne encephalitis virus
LVAANEMGL

SEQ ID NO: 193120 - protein, 9 aa, Tick-borne encephalitis virus
VAANEMGLL

SEQ ID NO: 193121 - protein, 9 aa, Tick-borne encephalitis virus
AANEMGLLE

SEQ ID NO: 193122 - protein, 9 aa, Tick-borne encephalitis virus
ANEMGFLER

SEQ ID NO: 193123 - protein, 9 aa, Tick-borne encephalitis virus
NEMGFLERT

SEQ ID NO: 193124 - protein, 9 aa, Tick-borne encephalitis virus
EMGFLERTK

SEQ ID NO: 193125 - protein, 9 aa, Tick-borne encephalitis virus
MGFLERTKA

SEQ ID NO: 193126 - protein, 9 aa, Tick-borne encephalitis virus
GFLERTKAD

SEQ ID NO: 193127 - protein, 9 aa, Tick-borne encephalitis virus
FLERTKADL

SEQ ID NO: 193128 - protein, 9 aa, Tick-borne encephalitis virus
LERTKADLS

SEQ ID NO: 193129 - protein, 9 aa, Tick-borne encephalitis virus
ERTKADLST

SEQ ID NO: 193130 - protein, 9 aa, Tick-borne encephalitis virus
RTKADLSTV

SEQ ID NO: 193131 - protein, 9 aa, Tick-borne encephalitis virus
TKADLSTAL

SEQ ID NO: 193132 - protein, 9 aa, Tick-borne encephalitis virus
KADLSTALW

SEQ ID NO: 193133 - protein, 9 aa, Tick-borne encephalitis virus
ADLSTALWS

SEQ ID NO: 193134 - protein, 9 aa, Tick-borne encephalitis virus
EPRPWSEWT

SEQ ID NO: 193135 - protein, 9 aa, Tick-borne encephalitis virus
PRPWSEWTN

SEQ ID NO: 193136 - protein, 9 aa, Tick-borne encephalitis virus
RPWSEWTNV

SEQ ID NO: 193137 - protein, 9 aa, Tick-borne encephalitis virus
PWSEWTNVD

SEQ ID NO: 193138 - protein, 9 aa, Tick-borne encephalitis virus
WSEWTNVDI

SEQ ID NO: 193139 - protein, 9 aa, Tick-borne encephalitis virus
SEWTNVDIQ

SEQ ID NO: 193140 - protein, 9 aa, Tick-borne encephalitis virus
EWTNVDIQP

SEQ ID NO: 193141 - protein, 9 aa, Tick-borne encephalitis virus
WTNVDIQPA

SEQ ID NO: 193142 - protein, 9 aa, Tick-borne encephalitis virus
TNVDIQPAR

SEQ ID NO: 193143 - protein, 9 aa, Tick-borne encephalitis virus
NVDIQPARS

SEQ ID NO: 193144 - protein, 9 aa, Tick-borne encephalitis virus
VDIQPARSW

SEQ ID NO: 193145 - protein, 9 aa, Tick-borne encephalitis virus
VVSLFTPYM

SEQ ID NO: 193146 - protein, 9 aa, Tick-borne encephalitis virus
VSLFTPYMI

SEQ ID NO: 193147 - protein, 9 aa, Tick-borne encephalitis virus
SLFTPYMIH

SEQ ID NO: 193148 - protein, 9 aa, Tick-borne encephalitis virus
LFTPYMIHQ

SEQ ID NO: 193149 - protein, 9 aa, Tick-borne encephalitis virus
FTPYMIHQL

SEQ ID NO: 193150 - protein, 9 aa, Tick-borne encephalitis virus
TPYMIHQLQ

SEQ ID NO: 193151 - protein, 9 aa, Tick-borne encephalitis virus
PYMIHQLQT

SEQ ID NO: 193152 - protein, 9 aa, Tick-borne encephalitis virus
YMIHQLQTK

SEQ ID NO: 193153 - protein, 9 aa, Tick-borne encephalitis virus
MIHQLQTKI

SEQ ID NO: 193154 - protein, 9 aa, Tick-borne encephalitis virus
QQLVNSAVV

SEQ ID NO: 193155 - protein, 9 aa, Tick-borne encephalitis virus
QLVNSAVAS

SEQ ID NO: 193156 - protein, 9 aa, Tick-borne encephalitis virus
LVNSAVASG

SEQ ID NO: 193157 - protein, 9 aa, Tick-borne encephalitis virus
VNSAVASGA

SEQ ID NO: 193158 - protein, 9 aa, Tick-borne encephalitis virus
NSAVASGAQ

SEQ ID NO: 193159 - protein, 9 aa, Tick-borne encephalitis virus
SAVASGAQA

SEQ ID NO: 193160 - protein, 9 aa, Tick-borne encephalitis virus
AVASGAQAM

SEQ ID NO: 193161 - protein, 9 aa, Tick-borne encephalitis virus
VASGAQAMR

SEQ ID NO: 193162 - protein, 9 aa, Tick-borne encephalitis virus
ASGAQAMRD

SEQ ID NO: 193163 - protein, 9 aa, Tick-borne encephalitis virus
SGAQAMRDL

SEQ ID NO: 193164 - protein, 9 aa, Tick-borne encephalitis virus
AMRDLGGGT

SEQ ID NO: 193165 - protein, 9 aa, Tick-borne encephalitis virus
MRDLGGGTP

SEQ ID NO: 193166 - protein, 9 aa, Tick-borne encephalitis virus
RDLGGGTPF

SEQ ID NO: 193167 - protein, 9 aa, Tick-borne encephalitis virus
DLGGGTPFF

SEQ ID NO: 193168 - protein, 9 aa, Tick-borne encephalitis virus
LGGGTPFFG

SEQ ID NO: 193169 - protein, 9 aa, Tick-borne encephalitis virus
GGGTPFFGV

SEQ ID NO: 193170 - protein, 9 aa, Tick-borne encephalitis virus
GGTPFFGVA

SEQ ID NO: 193171 - protein, 9 aa, Tick-borne encephalitis virus
GTPFFGVAG

SEQ ID NO: 193172 - protein, 9 aa, Tick-borne encephalitis virus
TPFFGVAGH

SEQ ID NO: 193173 - protein, 9 aa, Tick-borne encephalitis virus
PFIGVAGHV

SEQ ID NO: 193174 - protein, 9 aa, Tick-borne encephalitis virus
FFGVAGHVV

SEQ ID NO: 193175 - protein, 9 aa, Tick-borne encephalitis virus
GVAGHVMTL

SEQ ID NO: 193176 - protein, 9 aa, Tick-borne encephalitis virus
VAGHVMTLG

SEQ ID NO: 193177 - protein, 9 aa, Tick-borne encephalitis virus
AGHVMTLGV

SEQ ID NO: 193178 - protein, 9 aa, Tick-borne encephalitis virus
GHVMTLGVV

SEQ ID NO: 193179 - protein, 9 aa, Tick-borne encephalitis virus
HVMTLGVVS

SEQ ID NO: 193180 - protein, 9 aa, Tick-borne encephalitis virus
VMTLGVVSL

SEQ ID NO: 193181 - protein, 9 aa, Tick-borne encephalitis virus
MTLGVVSLI

SEQ ID NO: 193182 - protein, 9 aa, Tick-borne encephalitis virus
TLGVVSLIG

SEQ ID NO: 193183 - protein, 9 aa, Tick-borne encephalitis virus
LGVVSLIGA

SEQ ID NO: 193184 - protein, 9 aa, Tick-borne encephalitis virus
GVVSLIGAT

SEQ ID NO: 193185 - protein, 9 aa, Tick-borne encephalitis virus
VVSLIGATP

SEQ ID NO: 193186 - protein, 9 aa, Tick-borne encephalitis virus
VSLIGATPT

SEQ ID NO: 193187 - protein, 9 aa, Tick-borne encephalitis virus
SLIGATPTS

SEQ ID NO: 193188 - protein, 9 aa, Tick-borne encephalitis virus
LIGATPTSL

SEQ ID NO: 193189 - protein, 9 aa, Tick-borne encephalitis virus
IGATPTSLM

SEQ ID NO: 193190 - protein, 9 aa, Tick-borne encephalitis virus
GATPTSLMV

SEQ ID NO: 193191 - protein, 9 aa, Tick-borne encephalitis virus
ATPTSLMVG

SEQ ID NO: 193192 - protein, 9 aa, Tick-borne encephalitis virus
TPTSLMVGV

SEQ ID NO: 193193 - protein, 9 aa, Tick-borne encephalitis virus
PTSLMVGVG

SEQ ID NO: 193194 - protein, 9 aa, Tick-borne encephalitis virus
TSLMVGVGL

SEQ ID NO: 193195 - protein, 9 aa, Tick-borne encephalitis virus
SLMVGVGLA

SEQ ID NO: 193196 - protein, 9 aa, Tick-borne encephalitis virus
LMVGVGLAA

SEQ ID NO: 193197 - protein, 9 aa, Tick-borne encephalitis virus
MVGVGLAAL

SEQ ID NO: 193198 - protein, 9 aa, Tick-borne encephalitis virus
VGVGLAALH

SEQ ID NO: 193199 - protein, 9 aa, Tick-borne encephalitis virus
GVGLAALHL

SEQ ID NO: 193200 - protein, 9 aa, Tick-borne encephalitis virus
VGLAALHLA

SEQ ID NO: 193201 - protein, 9 aa, Tick-borne encephalitis virus
GLAALHLAI

SEQ ID NO: 193202 - protein, 9 aa, Tick-borne encephalitis virus
LAALHLAIV

SEQ ID NO: 193203 - protein, 9 aa, Tick-borne encephalitis virus
AALHLAIVV

SEQ ID NO: 193204 - protein, 9 aa, Tick-borne encephalitis virus
ALHLAIVVS

SEQ ID NO: 193205 - protein, 9 aa, Tick-borne encephalitis virus
LHLAIVVSG

SEQ ID NO: 193206 - protein, 9 aa, Tick-borne encephalitis virus
SAMVRNPML

SEQ ID NO: 193207 - protein, 9 aa, Tick-borne encephalitis virus
AMVRNPMLD

SEQ ID NO: 193208 - protein, 9 aa, Tick-borne encephalitis virus
MVRNPMLDG

SEQ ID NO: 193209 - protein, 9 aa, Tick-borne encephalitis virus
VRNPMLDGD

SEQ ID NO: 193210 - protein, 9 aa, Tick-borne encephalitis virus
RNPMLDGDV

SEQ ID NO: 193211 - protein, 9 aa, Tick-borne encephalitis virus
NPMLDGDVI

SEQ ID NO: 193212 - protein, 9 aa, Tick-borne encephalitis virus
PMLDGDVIY

SEQ ID NO: 193213 - protein, 9 aa, Tick-borne encephalitis virus
MLDGDVIYP

SEQ ID NO: 193214 - protein, 9 aa, Tick-borne encephalitis virus
LDGDVIYPF

SEQ ID NO: 193215 - protein, 9 aa, Tick-borne encephalitis virus
DGDVIYPFG

SEQ ID NO: 193216 - protein, 9 aa, Tick-borne encephalitis virus
GDVIYPFGE

SEQ ID NO: 193217 - protein, 9 aa, Tick-borne encephalitis virus
DVIYPFGEG

SEQ ID NO: 193218 - protein, 9 aa, Tick-borne encephalitis virus
VIYPFGEGE

SEQ ID NO: 193219 - protein, 9 aa, Tick-borne encephalitis virus
INPFGEGET

SEQ ID NO: 193220 - protein, 9 aa, Tick-borne encephalitis virus
NPFGEGETK

SEQ ID NO: 193221 - protein, 9 aa, Tick-borne encephalitis virus
PFGEGETKP

SEQ ID NO: 193222 - protein, 9 aa, Tick-borne encephalitis virus
FGEGETKPA

SEQ ID NO: 193223 - protein, 9 aa, Tick-borne encephalitis virus
GEGETKPAL

SEQ ID NO: 193224 - protein, 9 aa, Tick-borne encephalitis virus
EGETKPALY

SEQ ID NO: 193225 - protein, 9 aa, Tick-borne encephalitis virus
GETKPALYE

SEQ ID NO: 193226 - protein, 9 aa, Tick-borne encephalitis virus
ETKPALYER

SEQ ID NO: 193227 - protein, 9 aa, Tick-borne encephalitis virus
TKPALYERK

SEQ ID NO: 193228 - protein, 9 aa, Tick-borne encephalitis virus
KPALYERRM

SEQ ID NO: 193229 - protein, 9 aa, Tick-borne encephalitis virus
PALYERRMS

SEQ ID NO: 193230 - protein, 9 aa, Tick-borne encephalitis virus
ALYERRMSL

SEQ ID NO: 193231 - protein, 9 aa, Tick-borne encephalitis virus
LYERRMSLV

SEQ ID NO: 193232 - protein, 9 aa, Tick-borne encephalitis virus
YERRMSLVL

SEQ ID NO: 193233 - protein, 9 aa, Tick-borne encephalitis virus
ERRMSLVLA

SEQ ID NO: 193234 - protein, 9 aa, Tick-borne encephalitis virus
RKMSLVLAV

SEQ ID NO: 193235 - protein, 9 aa, Tick-borne encephalitis virus
MSLVLAIAL

SEQ ID NO: 193236 - protein, 9 aa, Tick-borne encephalitis virus
SLVLAIALC

SEQ ID NO: 193237 - protein, 9 aa, Tick-borne encephalitis virus
LVLAIALCL

SEQ ID NO: 193238 - protein, 9 aa, Tick-borne encephalitis virus
ALCLMSVVM

SEQ ID NO: 193239 - protein, 9 aa, Tick-borne encephalitis virus
LCLMAVVMN

SEQ ID NO: 193240 - protein, 9 aa, Tick-borne encephalitis virus
CLMAVVMNR

SEQ ID NO: 193241 - protein, 9 aa, Tick-borne encephalitis virus
LMAVVMNRT

SEQ ID NO: 193242 - protein, 9 aa, Tick-borne encephalitis virus
MAVVMNRTV

SEQ ID NO: 193243 - protein, 9 aa, Tick-borne encephalitis virus
SVVMNRTVA

SEQ ID NO: 193244 - protein, 9 aa, Tick-borne encephalitis virus
VVMNRTVAS

SEQ ID NO: 193245 - protein, 9 aa, Tick-borne encephalitis virus
VMNRTVASI

SEQ ID NO: 193246 - protein, 9 aa, Tick-borne encephalitis virus
MNRTVASIT

SEQ ID NO: 193247 - protein, 9 aa, Tick-borne encephalitis virus
NRTVASITE

SEQ ID NO: 193248 - protein, 9 aa, Tick-borne encephalitis virus
RTVASITEA

SEQ ID NO: 193249 - protein, 9 aa, Tick-borne encephalitis virus
TVASITEAS

SEQ ID NO: 193250 - protein, 9 aa, Tick-borne encephalitis virus
VASITEASA

SEQ ID NO: 193251 - protein, 9 aa, Tick-borne encephalitis virus
ASITEASAV

SEQ ID NO: 193252 - protein, 9 aa, Tick-borne encephalitis virus
SITEAAAVG

SEQ ID NO: 193253 - protein, 9 aa, Tick-borne encephalitis virus
ITEAAAVGL

SEQ ID NO: 193254 - protein, 9 aa, Tick-borne encephalitis virus
TEAAAVGLA

SEQ ID NO: 193255 - protein, 9 aa, Tick-borne encephalitis virus
EAAAVGLAA

SEQ ID NO: 193256 - protein, 9 aa, Tick-borne encephalitis virus
ASAVGLAAV

SEQ ID NO: 193257 - protein, 9 aa, Tick-borne encephalitis virus
SAVGLAAVG

SEQ ID NO: 193258 - protein, 9 aa, Tick-borne encephalitis virus
AVGLAAVGQ

SEQ ID NO: 193259 - protein, 9 aa, Tick-borne encephalitis virus
VGLAAVGQL

SEQ ID NO: 193260 - protein, 9 aa, Tick-borne encephalitis virus
GLAAVGQLL

SEQ ID NO: 193261 - protein, 9 aa, Tick-borne encephalitis virus
LAAVGQLLR

SEQ ID NO: 193262 - protein, 9 aa, Tick-borne encephalitis virus
AAVGQLLRP

SEQ ID NO: 193263 - protein, 9 aa, Tick-borne encephalitis virus
AVGQLLRPE

SEQ ID NO: 193264 - protein, 9 aa, Tick-borne encephalitis virus
GQLLRPEVD

SEQ ID NO: 193265 - protein, 9 aa, Tick-borne encephalitis virus
QLLRPEVDT

SEQ ID NO: 193266 - protein, 9 aa, Tick-borne encephalitis virus
LLRPEVDTL

SEQ ID NO: 193267 - protein, 9 aa, Tick-borne encephalitis virus
LRPEVDTLW

SEQ ID NO: 193268 - protein, 9 aa, Tick-borne encephalitis virus
RPEVDTLWT

SEQ ID NO: 193269 - protein, 9 aa, Tick-borne encephalitis virus
PEVDTLWTM

SEQ ID NO: 193270 - protein, 9 aa, Tick-borne encephalitis virus
EVDTLWTMP

SEQ ID NO: 193271 - protein, 9 aa, Tick-borne encephalitis virus
VDTLWTMPV

SEQ ID NO: 193272 - protein, 9 aa, Tick-borne encephalitis virus
WTMPVACGM

SEQ ID NO: 193273 - protein, 9 aa, Tick-borne encephalitis virus
TMPVACGMS

SEQ ID NO: 193274 - protein, 9 aa, Tick-borne encephalitis virus
MPVACGMSG

SEQ ID NO: 193275 - protein, 9 aa, Tick-borne encephalitis virus
PVACGMSGV

SEQ ID NO: 193276 - protein, 9 aa, Tick-borne encephalitis virus
VACGMSGVV

SEQ ID NO: 193277 - protein, 9 aa, Tick-borne encephalitis virus
ACGMSGVVR

SEQ ID NO: 193278 - protein, 9 aa, Tick-borne encephalitis virus
CGMSGVVRG

SEQ ID NO: 193279 - protein, 9 aa, Tick-borne encephalitis virus
GMSGVVRGS

SEQ ID NO: 193280 - protein, 9 aa, Tick-borne encephalitis virus
MSGVVRGSL

SEQ ID NO: 193281 - protein, 9 aa, Tick-borne encephalitis virus
SSVVRGSLW

SEQ ID NO: 193282 - protein, 9 aa, Tick-borne encephalitis virus
SVVRGSLWG

SEQ ID NO: 193283 - protein, 9 aa, Tick-borne encephalitis virus
VVTGSLWGF

SEQ ID NO: 193284 - protein, 9 aa, Tick-borne encephalitis virus
VTGSLWGFL

SEQ ID NO: 193285 - protein, 9 aa, Tick-borne encephalitis virus
TGSLWGFLP

SEQ ID NO: 193286 - protein, 9 aa, Tick-borne encephalitis virus
RLWLRASGG

SEQ ID NO: 193287 - protein, 9 aa, Tick-borne encephalitis virus
LWLRASGGR

SEQ ID NO: 193288 - protein, 9 aa, Tick-borne encephalitis virus
WLRASGGRR

SEQ ID NO: 193289 - protein, 9 aa, Tick-borne encephalitis virus
LRASGGRRG

SEQ ID NO: 193290 - protein, 9 aa, Tick-borne encephalitis virus
RASGGRRGG

SEQ ID NO: 193291 - protein, 9 aa, Tick-borne encephalitis virus
ASGGRRGGS

SEQ ID NO: 193292 - protein, 9 aa, Tick-borne encephalitis virus
SGGRRGGSE

SEQ ID NO: 193293 - protein, 9 aa, Tick-borne encephalitis virus
GGRRGGSEG

SEQ ID NO: 193294 - protein, 9 aa, Tick-borne encephalitis virus
GRRGGSEGD

SEQ ID NO: 193295 - protein, 9 aa, Tick-borne encephalitis virus
RRGGAEGDT

SEQ ID NO: 193296 - protein, 9 aa, Tick-borne encephalitis virus
RGGAEGDTL

SEQ ID NO: 193297 - protein, 9 aa, Tick-borne encephalitis virus
GGAEGDTLG

SEQ ID NO: 193298 - protein, 9 aa, Tick-borne encephalitis virus
GAEGDTLGD

SEQ ID NO: 193299 - protein, 9 aa, Tick-borne encephalitis virus
AEGDTLGDL

SEQ ID NO: 193300 - protein, 9 aa, Tick-borne encephalitis virus
DGDTLGDLW

SEQ ID NO: 193301 - protein, 9 aa, Tick-borne encephalitis virus
DTLGDLWKQ

SEQ ID NO: 193302 - protein, 9 aa, Tick-borne encephalitis virus
TLGDLWKRR

SEQ ID NO: 193303 - protein, 9 aa, Tick-borne encephalitis virus
LGDLWKRRL

SEQ ID NO: 193304 - protein, 9 aa, Tick-borne encephalitis virus
GDLWKRRLN

SEQ ID NO: 193305 - protein, 9 aa, Tick-borne encephalitis virus
LNNCTREEF

SEQ ID NO: 193306 - protein, 9 aa, Tick-borne encephalitis virus
NNCTREEFF

SEQ ID NO: 193307 - protein, 9 aa, Tick-borne encephalitis virus
NCTREEFFV

SEQ ID NO: 193308 - protein, 9 aa, Tick-borne encephalitis virus
CTREEFFVY

SEQ ID NO: 193309 - protein, 9 aa, Tick-borne encephalitis virus
TREEFFVYR

SEQ ID NO: 193310 - protein, 9 aa, Tick-borne encephalitis virus
REEFFVYRR

SEQ ID NO: 193311 - protein, 9 aa, Tick-borne encephalitis virus
EEFFVYRRT

SEQ ID NO: 193312 - protein, 9 aa, Tick-borne encephalitis virus
EFFVYRRTG

SEQ ID NO: 193313 - protein, 9 aa, Tick-borne encephalitis virus
FFVYRRTGI

SEQ ID NO: 193314 - protein, 9 aa, Tick-borne encephalitis virus
FVYRRTGIL

SEQ ID NO: 193315 - protein, 9 aa, Tick-borne encephalitis virus
VYRRTGILE

SEQ ID NO: 193316 - protein, 9 aa, Tick-borne encephalitis virus
YRRTGIMET

SEQ ID NO: 193317 - protein, 9 aa, Tick-borne encephalitis virus
RRAGILETE

SEQ ID NO: 193318 - protein, 9 aa, Tick-borne encephalitis virus
RTGIMETER

SEQ ID NO: 193319 - protein, 9 aa, Tick-borne encephalitis virus
TGIMETERD

SEQ ID NO: 193320 - protein, 9 aa, Tick-borne encephalitis virus
GILETERDR

SEQ ID NO: 193321 - protein, 9 aa, Tick-borne encephalitis virus
IMETERDKA

SEQ ID NO: 193322 - protein, 9 aa, Tick-borne encephalitis virus
LETERDRAR

SEQ ID NO: 193323 - protein, 9 aa, Tick-borne encephalitis virus
ETERDRARE

SEQ ID NO: 193324 - protein, 9 aa, Tick-borne encephalitis virus
TERDRAREL

SEQ ID NO: 193325 - protein, 9 aa, Tick-borne encephalitis virus
ERDRARELL

SEQ ID NO: 193326 - protein, 9 aa, Tick-borne encephalitis virus
RDKARELLK

SEQ ID NO: 193327 - protein, 9 aa, Tick-borne encephalitis virus
DKARELLRK

SEQ ID NO: 193328 - protein, 9 aa, Tick-borne encephalitis virus
KARELLRKG

SEQ ID NO: 193329 - protein, 9 aa, Tick-borne encephalitis virus
ARELLRKGE

SEQ ID NO: 193330 - protein, 9 aa, Tick-borne encephalitis virus
RELLRKGET

SEQ ID NO: 193331 - protein, 9 aa, Tick-borne encephalitis virus
ELLRKGETN

SEQ ID NO: 193332 - protein, 9 aa, Tick-borne encephalitis virus
KGETNTGLA

SEQ ID NO: 193333 - protein, 9 aa, Tick-borne encephalitis virus
GETNTGLAV

SEQ ID NO: 193334 - protein, 9 aa, Tick-borne encephalitis virus
ETNTGLAVS

SEQ ID NO: 193335 - protein, 9 aa, Tick-borne encephalitis virus
TNTGLAVSR

SEQ ID NO: 193336 - protein, 9 aa, Tick-borne encephalitis virus
NTGLAVSRG

SEQ ID NO: 193337 - protein, 9 aa, Tick-borne encephalitis virus
TGLAVSRGT

SEQ ID NO: 193338 - protein, 9 aa, Tick-borne encephalitis virus
SYYAASRPS

SEQ ID NO: 193339 - protein, 9 aa, Tick-borne encephalitis virus
YYAASRPSV

SEQ ID NO: 193340 - protein, 9 aa, Tick-borne encephalitis virus
YAASRPSVM

SEQ ID NO: 193341 - protein, 9 aa, Tick-borne encephalitis virus
AASRPSVMS

SEQ ID NO: 193342 - protein, 9 aa, Tick-borne encephalitis virus
ASRPAVMNV

SEQ ID NO: 193343 - protein, 9 aa, Tick-borne encephalitis virus
SRPAVMSVR

SEQ ID NO: 193344 - protein, 9 aa, Tick-borne encephalitis virus
RPAVMSVRA

SEQ ID NO: 193345 - protein, 9 aa, Tick-borne encephalitis virus
PAVMSVRAY

SEQ ID NO: 193346 - protein, 9 aa, Tick-borne encephalitis virus
AVMSVRAYT

SEQ ID NO: 193347 - protein, 9 aa, Tick-borne encephalitis virus
VMSVRAYTI

SEQ ID NO: 193348 - protein, 9 aa, Tick-borne encephalitis virus
MSVRAYTIG

SEQ ID NO: 193349 - protein, 9 aa, Tick-borne encephalitis virus
SVRAYTIGG

SEQ ID NO: 193350 - protein, 9 aa, Tick-borne encephalitis virus
VRAYTIGGR

SEQ ID NO: 193351 - protein, 9 aa, Tick-borne encephalitis virus
RAYTIGGRG

SEQ ID NO: 193352 - protein, 9 aa, Tick-borne encephalitis virus
AYTIGGRGH

SEQ ID NO: 193353 - protein, 9 aa, Tick-borne encephalitis virus
YTIGGRGHE

SEQ ID NO: 193354 - protein, 9 aa, Tick-borne encephalitis virus
TIGGRGHEA

SEQ ID NO: 193355 - protein, 9 aa, Tick-borne encephalitis virus
IGGRGHEAP

SEQ ID NO: 193356 - protein, 9 aa, Tick-borne encephalitis virus
GGRGHEAPK

SEQ ID NO: 193357 - protein, 9 aa, Tick-borne encephalitis virus
GRGHEAPKM

SEQ ID NO: 193358 - protein, 9 aa, Tick-borne encephalitis virus
RGHEAPKMV

SEQ ID NO: 193359 - protein, 9 aa, Tick-borne encephalitis virus
GHEAPKMVT

SEQ ID NO: 193360 - protein, 9 aa, Tick-borne encephalitis virus
HEAPKMVTS

SEQ ID NO: 193361 - protein, 9 aa, Tick-borne encephalitis virus
EAPKMVTSL

SEQ ID NO: 193362 - protein, 9 aa, Tick-borne encephalitis virus
APKMVTSLG

SEQ ID NO: 193363 - protein, 9 aa, Tick-borne encephalitis virus
PRMVTSLGW

SEQ ID NO: 193364 - protein, 9 aa, Tick-borne encephalitis virus
RMVTSLGWN

SEQ ID NO: 193365 - protein, 9 aa, Tick-borne encephalitis virus
GWNLIKFRS

SEQ ID NO: 193366 - protein, 9 aa, Tick-borne encephalitis virus
WNLIKFRSG

SEQ ID NO: 193367 - protein, 9 aa, Tick-borne encephalitis virus
NLIKFRSGM

SEQ ID NO: 193368 - protein, 9 aa, Tick-borne encephalitis virus
LIKFRSGMD

SEQ ID NO: 193369 - protein, 9 aa, Tick-borne encephalitis virus
IKFRSGMDV

SEQ ID NO: 193370 - protein, 9 aa, Tick-borne encephalitis virus
KFRSGMDVF

SEQ ID NO: 193371 - protein, 9 aa, Tick-borne encephalitis virus
FRSGMDVFS

SEQ ID NO: 193372 - protein, 9 aa, Tick-borne encephalitis virus
RSGMDVFSM

SEQ ID NO: 193373 - protein, 9 aa, Tick-borne encephalitis virus
SGMDVFSMQ

SEQ ID NO: 193374 - protein, 9 aa, Tick-borne encephalitis virus
GVDVFSMQP

SEQ ID NO: 193375 - protein, 9 aa, Tick-borne encephalitis virus
VDVFSMQPH

SEQ ID NO: 193376 - protein, 9 aa, Tick-borne encephalitis virus
MQPHRADTV

SEQ ID NO: 193377 - protein, 9 aa, Tick-borne encephalitis virus
QPHRADTVM

SEQ ID NO: 193378 - protein, 9 aa, Tick-borne encephalitis virus
PHRADTVMC

SEQ ID NO: 193379 - protein, 9 aa, Tick-borne encephalitis virus
HRADTVMCD

SEQ ID NO: 193380 - protein, 9 aa, Tick-borne encephalitis virus
RADTVMCDI

SEQ ID NO: 193381 - protein, 9 aa, Tick-borne encephalitis virus
ADTVMCDIG

SEQ ID NO: 193382 - protein, 9 aa, Tick-borne encephalitis virus
DTVMCDIGE

SEQ ID NO: 193383 - protein, 9 aa, Tick-borne encephalitis virus
TVMCDIGES

SEQ ID NO: 193384 - protein, 9 aa, Tick-borne encephalitis virus
VMCDIGESS

SEQ ID NO: 193385 - protein, 9 aa, Tick-borne encephalitis virus
MCDIGESSP

SEQ ID NO: 193386 - protein, 9 aa, Tick-borne encephalitis virus
CDIGESSPD

SEQ ID NO: 193387 - protein, 9 aa, Tick-borne encephalitis virus
DIGESSPDA

SEQ ID NO: 193388 - protein, 9 aa, Tick-borne encephalitis virus
IGESSPDAA

SEQ ID NO: 193389 - protein, 9 aa, Tick-borne encephalitis virus
GESSPDAAV

SEQ ID NO: 193390 - protein, 9 aa, Tick-borne encephalitis virus
ESSPDAAVE

SEQ ID NO: 193391 - protein, 9 aa, Tick-borne encephalitis virus
SSPDAAVEG

SEQ ID NO: 193392 - protein, 9 aa, Tick-borne encephalitis virus
SPDAAVEGE

SEQ ID NO: 193393 - protein, 9 aa, Tick-borne encephalitis virus
PDAAVEGER

SEQ ID NO: 193394 - protein, 9 aa, Tick-borne encephalitis virus
DAAVEGERT

SEQ ID NO: 193395 - protein, 9 aa, Tick-borne encephalitis virus
AAVEGERTR

SEQ ID NO: 193396 - protein, 9 aa, Tick-borne encephalitis virus
AVEGERTRK

SEQ ID NO: 193397 - protein, 9 aa, Tick-borne encephalitis virus
VEGERTRRV

SEQ ID NO: 193398 - protein, 9 aa, Tick-borne encephalitis virus
EGERTRRVI

SEQ ID NO: 193399 - protein, 9 aa, Tick-borne encephalitis virus
GERTRRVIL

SEQ ID NO: 193400 - protein, 9 aa, Tick-borne encephalitis virus
ERTRRVILL

SEQ ID NO: 193401 - protein, 9 aa, Tick-borne encephalitis virus
RTRRVILLM

SEQ ID NO: 193402 - protein, 9 aa, Tick-borne encephalitis virus
TRRVILLME

SEQ ID NO: 193403 - protein, 9 aa, Tick-borne encephalitis virus
RRVILLMEQ

SEQ ID NO: 193404 - protein, 9 aa, Tick-borne encephalitis virus
RVILLMEQW

SEQ ID NO: 193405 - protein, 9 aa, Tick-borne encephalitis virus
ILLMEQWKI

SEQ ID NO: 193406 - protein, 9 aa, Tick-borne encephalitis virus
LLMEQWKIR

SEQ ID NO: 193407 - protein, 9 aa, Tick-borne encephalitis virus
LMEQWKIRN

SEQ ID NO: 193408 - protein, 9 aa, Tick-borne encephalitis virus
MEQWKIRNP

SEQ ID NO: 193409 - protein, 9 aa, Tick-borne encephalitis virus
EQWKNRNPA

SEQ ID NO: 193410 - protein, 9 aa, Tick-borne encephalitis virus
QWKIRNPTA

SEQ ID NO: 193411 - protein, 9 aa, Tick-borne encephalitis virus
WKNRNPTAA

SEQ ID NO: 193412 - protein, 9 aa, Tick-borne encephalitis virus
KNRNPTAAC

SEQ ID NO: 193413 - protein, 9 aa, Tick-borne encephalitis virus
NRNPTAACV

SEQ ID NO: 193414 - protein, 9 aa, Tick-borne encephalitis virus
RNPTAACVF

SEQ ID NO: 193415 - protein, 9 aa, Tick-borne encephalitis virus
NPTAACVFK

SEQ ID NO: 193416 - protein, 9 aa, Tick-borne encephalitis virus
PTAACVFKV

SEQ ID NO: 193417 - protein, 9 aa, Tick-borne encephalitis virus
TAACVFKVL

SEQ ID NO: 193418 - protein, 9 aa, Tick-borne encephalitis virus
AACVFKVLA

SEQ ID NO: 193419 - protein, 9 aa, Tick-borne encephalitis virus
ACVFKVLAP

SEQ ID NO: 193420 - protein, 9 aa, Tick-borne encephalitis virus
KVLAPYRPK

SEQ ID NO: 193421 - protein, 9 aa, Tick-borne encephalitis virus
VLAPYRPKV

SEQ ID NO: 193422 - protein, 9 aa, Tick-borne encephalitis virus
LAPYRPKVI

SEQ ID NO: 193423 - protein, 9 aa, Tick-borne encephalitis virus
APYRPKVIE

SEQ ID NO: 193424 - protein, 9 aa, Tick-borne encephalitis virus
PYRPEVIET

SEQ ID NO: 193425 - protein, 9 aa, Tick-borne encephalitis virus
YRPKVIEAL

SEQ ID NO: 193426 - protein, 9 aa, Tick-borne encephalitis virus
RPKVIEALH

SEQ ID NO: 193427 - protein, 9 aa, Tick-borne encephalitis virus
PEVIETLHR

SEQ ID NO: 193428 - protein, 9 aa, Tick-borne encephalitis virus
EVIETLHRF

SEQ ID NO: 193429 - protein, 9 aa, Tick-borne encephalitis virus
VIETLHRFQ

SEQ ID NO: 193430 - protein, 9 aa, Tick-borne encephalitis virus
IETLHRFQL

SEQ ID NO: 193431 - protein, 9 aa, Tick-borne encephalitis virus
EALHRFQLR

SEQ ID NO: 193432 - protein, 9 aa, Tick-borne encephalitis virus
ALHRFQLRW

SEQ ID NO: 193433 - protein, 9 aa, Tick-borne encephalitis virus
LHRFQLRWG

SEQ ID NO: 193434 - protein, 9 aa, Tick-borne encephalitis virus
HRFQLRWGG

SEQ ID NO: 193435 - protein, 9 aa, Tick-borne encephalitis virus
RFQLRWGGG

SEQ ID NO: 193436 - protein, 9 aa, Tick-borne encephalitis virus
FQLRWGGGL

SEQ ID NO: 193437 - protein, 9 aa, Tick-borne encephalitis virus
QLRWGGGLV

SEQ ID NO: 193438 - protein, 9 aa, Tick-borne encephalitis virus
LRWGGGLVR

SEQ ID NO: 193439 - protein, 9 aa, Tick-borne encephalitis virus
RWGGGLVRT

SEQ ID NO: 193440 - protein, 9 aa, Tick-borne encephalitis virus
PFSRNSTHK

SEQ ID NO: 193441 - protein, 9 aa, Tick-borne encephalitis virus
FSRNSTHKV

SEQ ID NO: 193442 - protein, 9 aa, Tick-borne encephalitis virus
SRNSTHKVY

SEQ ID NO: 193443 - protein, 9 aa, Tick-borne encephalitis virus
RNSTHKVYY

SEQ ID NO: 193444 - protein, 9 aa, Tick-borne encephalitis virus
NSTHKVYYS

SEQ ID NO: 193445 - protein, 9 aa, Tick-borne encephalitis virus
STHKVYYST

SEQ ID NO: 193446 - protein, 9 aa, Tick-borne encephalitis virus
THKVYYSTA

SEQ ID NO: 193447 - protein, 9 aa, Tick-borne encephalitis virus
HEMYYSTAI

SEQ ID NO: 193448 - protein, 9 aa, Tick-borne encephalitis virus
EMYYSTAIT

SEQ ID NO: 193449 - protein, 9 aa, Tick-borne encephalitis virus
MYYSTAITG

SEQ ID NO: 193450 - protein, 9 aa, Tick-borne encephalitis virus
YYSTAITGN

SEQ ID NO: 193451 - protein, 9 aa, Tick-borne encephalitis virus
YSTAITGNI

SEQ ID NO: 193452 - protein, 9 aa, Tick-borne encephalitis virus
STAITGNIV

SEQ ID NO: 193453 - protein, 9 aa, Tick-borne encephalitis virus
TAITGNIVN

SEQ ID NO: 193454 - protein, 9 aa, Tick-borne encephalitis virus
AITGNIVNS

SEQ ID NO: 193455 - protein, 9 aa, Tick-borne encephalitis virus
ITGNIVNSV

SEQ ID NO: 193456 - protein, 9 aa, Tick-borne encephalitis virus
GNIVNSVNV

SEQ ID NO: 193457 - protein, 9 aa, Tick-borne encephalitis virus
NIVNSVNVQ

SEQ ID NO: 193458 - protein, 9 aa, Tick-borne encephalitis virus
IVNSVNVQS

SEQ ID NO: 193459 - protein, 9 aa, Tick-borne encephalitis virus
VNSVNVQSR

SEQ ID NO: 193460 - protein, 9 aa, Tick-borne encephalitis virus
NSVNVQSRK

SEQ ID NO: 193461 - protein, 9 aa, Tick-borne encephalitis virus
SVNVQSRKL

SEQ ID NO: 193462 - protein, 9 aa, Tick-borne encephalitis virus
VNVQSRKLL

SEQ ID NO: 193463 - protein, 9 aa, Tick-borne encephalitis virus
NVQSRKLLA

SEQ ID NO: 193464 - protein, 9 aa, Tick-borne encephalitis virus
VQSRKLLAR

SEQ ID NO: 193465 - protein, 9 aa, Tick-borne encephalitis virus
SRKLLARFA

SEQ ID NO: 193466 - protein, 9 aa, Tick-borne encephalitis virus
RKLLARFAG

SEQ ID NO: 193467 - protein, 9 aa, Tick-borne encephalitis virus
KLLARFAGQ

SEQ ID NO: 193468 - protein, 9 aa, Tick-borne encephalitis virus
LLARFAGQR

SEQ ID NO: 193469 - protein, 9 aa, Tick-borne encephalitis virus
LARFAGQRG

SEQ ID NO: 193470 - protein, 9 aa, Tick-borne encephalitis virus
ARFAGQRGP

SEQ ID NO: 193471 - protein, 9 aa, Tick-borne encephalitis virus
RFAGQRGPT

SEQ ID NO: 193472 - protein, 9 aa, Tick-borne encephalitis virus
FGDQRGPTK

SEQ ID NO: 193473 - protein, 9 aa, Tick-borne encephalitis virus
GDQRGPTKV

SEQ ID NO: 193474 - protein, 9 aa, Tick-borne encephalitis virus
DQRGPTKVP

SEQ ID NO: 193475 - protein, 9 aa, Tick-borne encephalitis virus
QRGPTKVPE

SEQ ID NO: 193476 - protein, 9 aa, Tick-borne encephalitis virus
RGPTKVPEL

SEQ ID NO: 193477 - protein, 9 aa, Tick-borne encephalitis virus
GPTKVPELD

SEQ ID NO: 193478 - protein, 9 aa, Tick-borne encephalitis virus
PTKVPELDL

SEQ ID NO: 193479 - protein, 9 aa, Tick-borne encephalitis virus
TKVPELDLG

SEQ ID NO: 193480 - protein, 9 aa, Tick-borne encephalitis virus
RVPELDLGI

SEQ ID NO: 193481 - protein, 9 aa, Tick-borne encephalitis virus
VPELDLGIG

SEQ ID NO: 193482 - protein, 9 aa, Tick-borne encephalitis virus
PELDLGIGT

SEQ ID NO: 193483 - protein, 9 aa, Tick-borne encephalitis virus
ELDLGIGTR

SEQ ID NO: 193484 - protein, 9 aa, Tick-borne encephalitis virus
LDLGIGTRC

SEQ ID NO: 193485 - protein, 9 aa, Tick-borne encephalitis virus
DLGIGTRCV

SEQ ID NO: 193486 - protein, 9 aa, Tick-borne encephalitis virus
LGIGTRCVV

SEQ ID NO: 193487 - protein, 9 aa, Tick-borne encephalitis virus
GIGTRCVVL

SEQ ID NO: 193488 - protein, 9 aa, Tick-borne encephalitis virus
IGTRCVVLA

SEQ ID NO: 193489 - protein, 9 aa, Tick-borne encephalitis virus
GTRCVVLAD

SEQ ID NO: 193490 - protein, 9 aa, Tick-borne encephalitis virus
TRCVFLAED

SEQ ID NO: 193491 - protein, 9 aa, Tick-borne encephalitis virus
RCVVLAEDR

SEQ ID NO: 193492 - protein, 9 aa, Tick-borne encephalitis virus
CVVLAEDRV

SEQ ID NO: 193493 - protein, 9 aa, Tick-borne encephalitis virus
VVLAEDRVR

SEQ ID NO: 193494 - protein, 9 aa, Tick-borne encephalitis virus
VLAEDRVRE

SEQ ID NO: 193495 - protein, 9 aa, Tick-borne encephalitis virus
LAEDKVKEQ

SEQ ID NO: 193496 - protein, 9 aa, Tick-borne encephalitis virus
AEDKVKEQD

SEQ ID NO: 193497 - protein, 9 aa, Tick-borne encephalitis virus
EDKVKEQDV

SEQ ID NO: 193498 - protein, 9 aa, Tick-borne encephalitis virus
DKVKEQDVQ

SEQ ID NO: 193499 - protein, 9 aa, Tick-borne encephalitis virus
KVKEQDVQE

SEQ ID NO: 193500 - protein, 9 aa, Tick-borne encephalitis virus
VKEQDVQER

SEQ ID NO: 193501 - protein, 9 aa, Tick-borne encephalitis virus
KEQDVQERI

SEQ ID NO: 193502 - protein, 9 aa, Tick-borne encephalitis virus
DVQERIRAL

SEQ ID NO: 193503 - protein, 9 aa, Tick-borne encephalitis virus
ERIRALREQ

SEQ ID NO: 193504 - protein, 9 aa, Tick-borne encephalitis virus
RIRALREQY

SEQ ID NO: 193505 - protein, 9 aa, Tick-borne encephalitis virus
ALREQYSET

SEQ ID NO: 193506 - protein, 9 aa, Tick-borne encephalitis virus
LREQYSETW

SEQ ID NO: 193507 - protein, 9 aa, Tick-borne encephalitis virus
REQYSETWH

SEQ ID NO: 193508 - protein, 9 aa, Tick-borne encephalitis virus
DEEHPYRTW

SEQ ID NO: 193509 - protein, 9 aa, Tick-borne encephalitis virus
EEHPYRTWQ

SEQ ID NO: 193510 - protein, 9 aa, Tick-borne encephalitis virus
PTGSAASLT

SEQ ID NO: 193511 - protein, 9 aa, Tick-borne encephalitis virus
TGSAASLTN

SEQ ID NO: 193512 - protein, 9 aa, Tick-borne encephalitis virus
GSAASLTNG

SEQ ID NO: 193513 - protein, 9 aa, Tick-borne encephalitis virus
SAASLTNGV

SEQ ID NO: 193514 - protein, 9 aa, Tick-borne encephalitis virus
AASLTNGVV

SEQ ID NO: 193515 - protein, 9 aa, Tick-borne encephalitis virus
ASLTNGVVK

SEQ ID NO: 193516 - protein, 9 aa, Tick-borne encephalitis virus
SLTNGVVKL

SEQ ID NO: 193517 - protein, 9 aa, Tick-borne encephalitis virus
LTNGVVKLL

SEQ ID NO: 193518 - protein, 9 aa, Tick-borne encephalitis virus
TNGVVKLLS

SEQ ID NO: 193519 - protein, 9 aa, Tick-borne encephalitis virus
VVRMAMTDP

SEQ ID NO: 193520 - protein, 9 aa, Tick-borne encephalitis virus
VRMAMTDPT

SEQ ID NO: 193521 - protein, 9 aa, Tick-borne encephalitis virus
RMAMTDPTP

SEQ ID NO: 193522 - protein, 9 aa, Tick-borne encephalitis virus
MAMTDPTPA

SEQ ID NO: 193523 - protein, 9 aa, Tick-borne encephalitis virus
AMTDPTPAW

SEQ ID NO: 193524 - protein, 9 aa, Tick-borne encephalitis virus
MTDPTPAWQ

SEQ ID NO: 193525 - protein, 9 aa, Tick-borne encephalitis virus
TDPTPAWQQ

SEQ ID NO: 193526 - protein, 9 aa, Tick-borne encephalitis virus
DPTPAWQQR

SEQ ID NO: 193527 - protein, 9 aa, Tick-borne encephalitis virus
PTPAWQQRV

SEQ ID NO: 193528 - protein, 9 aa, Tick-borne encephalitis virus
TPAWQQRVF

SEQ ID NO: 193529 - protein, 9 aa, Tick-borne encephalitis virus
PAWQQRVFK

SEQ ID NO: 193530 - protein, 9 aa, Tick-borne encephalitis virus
FGQQRVFKD

SEQ ID NO: 193531 - protein, 9 aa, Tick-borne encephalitis virus
GQQRVFKDK

SEQ ID NO: 193532 - protein, 9 aa, Tick-borne encephalitis virus
QQRVFKDKV

SEQ ID NO: 193533 - protein, 9 aa, Tick-borne encephalitis virus
QRVFKDKVD

SEQ ID NO: 193534 - protein, 9 aa, Tick-borne encephalitis virus
RVFKDKVDT

SEQ ID NO: 193535 - protein, 9 aa, Tick-borne encephalitis virus
VFKDKVDTK

SEQ ID NO: 193536 - protein, 9 aa, Tick-borne encephalitis virus
FKDKVDTKA

SEQ ID NO: 193537 - protein, 9 aa, Tick-borne encephalitis virus
KDKVDTKAQ

SEQ ID NO: 193538 - protein, 9 aa, Tick-borne encephalitis virus
DKVDTKAQE

SEQ ID NO: 193539 - protein, 9 aa, Tick-borne encephalitis virus
NADTKAQEP

SEQ ID NO: 193540 - protein, 9 aa, Tick-borne encephalitis virus
ADTKAQEPQ

SEQ ID NO: 193541 - protein, 9 aa, Tick-borne encephalitis virus
AQEPQPGTR

SEQ ID NO: 193542 - protein, 9 aa, Tick-borne encephalitis virus
QEPQPGTRV

SEQ ID NO: 193543 - protein, 9 aa, Tick-borne encephalitis virus
EPQPGTRVI

SEQ ID NO: 193544 - protein, 9 aa, Tick-borne encephalitis virus
PQPGTRVIM

SEQ ID NO: 193545 - protein, 9 aa, Tick-borne encephalitis virus
QPGTRVIMR

SEQ ID NO: 193546 - protein, 9 aa, Tick-borne encephalitis virus
PGTRVIMRA

SEQ ID NO: 193547 - protein, 9 aa, Tick-borne encephalitis virus
GTRVIMRAV

SEQ ID NO: 193548 - protein, 9 aa, Tick-borne encephalitis virus
TRVIMRAVN

SEQ ID NO: 193549 - protein, 9 aa, Tick-borne encephalitis virus
RVIMRAVND

SEQ ID NO: 193550 - protein, 9 aa, Tick-borne encephalitis virus
IMRAVNDWM

SEQ ID NO: 193551 - protein, 9 aa, Tick-borne encephalitis virus
MRAVNDWML

SEQ ID NO: 193552 - protein, 9 aa, Tick-borne encephalitis virus
RAVNDWMLD

SEQ ID NO: 193553 - protein, 9 aa, Tick-borne encephalitis virus
AVNDWMLDR

SEQ ID NO: 193554 - protein, 9 aa, Tick-borne encephalitis virus
VNDWMLDRL

SEQ ID NO: 193555 - protein, 9 aa, Tick-borne encephalitis virus
NDWMLDRLA

SEQ ID NO: 193556 - protein, 9 aa, Tick-borne encephalitis virus
DWILERLAQ

SEQ ID NO: 193557 - protein, 9 aa, Tick-borne encephalitis virus
WILERLAQK

SEQ ID NO: 193558 - protein, 9 aa, Tick-borne encephalitis virus
ILERLAQKS

SEQ ID NO: 193559 - protein, 9 aa, Tick-borne encephalitis virus
KPRMCSKEE

SEQ ID NO: 193560 - protein, 9 aa, Tick-borne encephalitis virus
PRMCSKEEF

SEQ ID NO: 193561 - protein, 9 aa, Tick-borne encephalitis virus
RMCSKEEFI

SEQ ID NO: 193562 - protein, 9 aa, Tick-borne encephalitis virus
MCSKEEFIA

SEQ ID NO: 193563 - protein, 9 aa, Tick-borne encephalitis virus
CSKEEFIAK

SEQ ID NO: 193564 - protein, 9 aa, Tick-borne encephalitis virus
SKEEFIAKV

SEQ ID NO: 193565 - protein, 9 aa, Tick-borne encephalitis virus
KEEFIAKVK

SEQ ID NO: 193566 - protein, 9 aa, Tick-borne encephalitis virus
EEFIAKVRS

SEQ ID NO: 193567 - protein, 9 aa, Tick-borne encephalitis virus
EFIAKVRSN

SEQ ID NO: 193568 - protein, 9 aa, Tick-borne encephalitis virus
FIAKVRSNA

SEQ ID NO: 193569 - protein, 9 aa, Tick-borne encephalitis virus
IAKVRSNAA

SEQ ID NO: 193570 - protein, 9 aa, Tick-borne encephalitis virus
AKVKSSAAL

SEQ ID NO: 193571 - protein, 9 aa, Tick-borne encephalitis virus
KVRSNAALG

SEQ ID NO: 193572 - protein, 9 aa, Tick-borne encephalitis virus
VRSNAALGA

SEQ ID NO: 193573 - protein, 9 aa, Tick-borne encephalitis virus
RSNAALGAW

SEQ ID NO: 193574 - protein, 9 aa, Tick-borne encephalitis virus
SSAALGAWS

SEQ ID NO: 193575 - protein, 9 aa, Tick-borne encephalitis virus
SAALGAWSD

SEQ ID NO: 193576 - protein, 9 aa, Tick-borne encephalitis virus
AALGAWSNE

SEQ ID NO: 193577 - protein, 9 aa, Tick-borne encephalitis virus
ALGAWSNEQ

SEQ ID NO: 193578 - protein, 9 aa, Tick-borne encephalitis virus
LGAWSEEQN

SEQ ID NO: 193579 - protein, 9 aa, Tick-borne encephalitis virus
GAWSNEQNR

SEQ ID NO: 193580 - protein, 9 aa, Tick-borne encephalitis virus
AWSEEQNRW

SEQ ID NO: 193581 - protein, 9 aa, Tick-borne encephalitis virus
WSDEQNRWA

SEQ ID NO: 193582 - protein, 9 aa, Tick-borne encephalitis virus
SAREAVEDP

SEQ ID NO: 193583 - protein, 9 aa, Tick-borne encephalitis virus
AREAVEDPA

SEQ ID NO: 193584 - protein, 9 aa, Tick-borne encephalitis virus
REAVEDPAF

SEQ ID NO: 193585 - protein, 9 aa, Tick-borne encephalitis virus
EAVEDPVFW

SEQ ID NO: 193586 - protein, 9 aa, Tick-borne encephalitis virus
AVEDPAFWH

SEQ ID NO: 193587 - protein, 9 aa, Tick-borne encephalitis virus
VEDPAFWHL

SEQ ID NO: 193588 - protein, 9 aa, Tick-borne encephalitis virus
EDPAFWHLV

SEQ ID NO: 193589 - protein, 9 aa, Tick-borne encephalitis virus
DPAFWHLVD

SEQ ID NO: 193590 - protein, 9 aa, Tick-borne encephalitis virus
PAFWHLVDE

SEQ ID NO: 193591 - protein, 9 aa, Tick-borne encephalitis virus
AFWHLVDEE

SEQ ID NO: 193592 - protein, 9 aa, Tick-borne encephalitis virus
FWHLVDEER

SEQ ID NO: 193593 - protein, 9 aa, Tick-borne encephalitis virus
WHLVDEERE

SEQ ID NO: 193594 - protein, 9 aa, Tick-borne encephalitis virus
HLVDEERER

SEQ ID NO: 193595 - protein, 9 aa, Tick-borne encephalitis virus
LVDEERERD

SEQ ID NO: 193596 - protein, 9 aa, Tick-borne encephalitis virus
VDEERERDL

SEQ ID NO: 193597 - protein, 9 aa, Tick-borne encephalitis virus
DEERERHLM

SEQ ID NO: 193598 - protein, 9 aa, Tick-borne encephalitis virus
EERERHLMG

SEQ ID NO: 193599 - protein, 9 aa, Tick-borne encephalitis virus
ERERHLMGR

SEQ ID NO: 193600 - protein, 9 aa, Tick-borne encephalitis virus
RERHLMGRC

SEQ ID NO: 193601 - protein, 9 aa, Tick-borne encephalitis virus
ERHLMGRCA

SEQ ID NO: 193602 - protein, 9 aa, Tick-borne encephalitis virus
RHLMGRCAH

SEQ ID NO: 193603 - protein, 9 aa, Tick-borne encephalitis virus
HLMGRCAHC

SEQ ID NO: 193604 - protein, 9 aa, Tick-borne encephalitis virus
LMGRCAHCV

SEQ ID NO: 193605 - protein, 9 aa, Tick-borne encephalitis virus
GRCAHCVHN

SEQ ID NO: 193606 - protein, 9 aa, Tick-borne encephalitis virus
RCAHCVHNM

SEQ ID NO: 193607 - protein, 9 aa, Tick-borne encephalitis virus
CAHCVHNMM

SEQ ID NO: 193608 - protein, 9 aa, Tick-borne encephalitis virus
AHCVHNMMG

SEQ ID NO: 193609 - protein, 9 aa, Tick-borne encephalitis virus
HCVHNMMGK

SEQ ID NO: 193610 - protein, 9 aa, Tick-borne encephalitis virus
CVHNMMGKR

SEQ ID NO: 193611 - protein, 9 aa, Tick-borne encephalitis virus
VHNMMGKRE

SEQ ID NO: 193612 - protein, 9 aa, Tick-borne encephalitis virus
HNMMGKREK

SEQ ID NO: 193613 - protein, 9 aa, Tick-borne encephalitis virus
NIMGKREKK

SEQ ID NO: 193614 - protein, 9 aa, Tick-borne encephalitis virus
IMGKREKKL

SEQ ID NO: 193615 - protein, 9 aa, Tick-borne encephalitis virus
KKLGEFGVS

SEQ ID NO: 193616 - protein, 9 aa, Tick-borne encephalitis virus
KLGEFGVSK

SEQ ID NO: 193617 - protein, 9 aa, Tick-borne encephalitis virus
LGEFGVSKG

SEQ ID NO: 193618 - protein, 9 aa, Tick-borne encephalitis virus
GEFGVSKGS

SEQ ID NO: 193619 - protein, 9 aa, Tick-borne encephalitis virus
EFGVSKGSR

SEQ ID NO: 193620 - protein, 9 aa, Tick-borne encephalitis virus
FGVSKGSRA

SEQ ID NO: 193621 - protein, 9 aa, Tick-borne encephalitis virus
GVSKGSRAM

SEQ ID NO: 193622 - protein, 9 aa, Tick-borne encephalitis virus
VSKGSRAMW

SEQ ID NO: 193623 - protein, 9 aa, Tick-borne encephalitis virus
SKGSRAMWY

SEQ ID NO: 193624 - protein, 9 aa, Tick-borne encephalitis virus
KGSRAMWYM

SEQ ID NO: 193625 - protein, 9 aa, Tick-borne encephalitis virus
GSRAMWYMW

SEQ ID NO: 193626 - protein, 9 aa, Tick-borne encephalitis virus
SRAMWYMWL

SEQ ID NO: 193627 - protein, 9 aa, Tick-borne encephalitis virus
RAMWYMWLG

SEQ ID NO: 193628 - protein, 9 aa, Tick-borne encephalitis virus
AMWYMWLGS

SEQ ID NO: 193629 - protein, 9 aa, Tick-borne encephalitis virus
MWYMWLGSR

SEQ ID NO: 193630 - protein, 9 aa, Tick-borne encephalitis virus
YMWLGSRFQ

SEQ ID NO: 193631 - protein, 9 aa, Tick-borne encephalitis virus
MWLGSRFQE

SEQ ID NO: 193632 - protein, 9 aa, Tick-borne encephalitis virus
WLGSRFQEF

SEQ ID NO: 193633 - protein, 9 aa, Tick-borne encephalitis virus
LGSRFQEFE

SEQ ID NO: 193634 - protein, 9 aa, Tick-borne encephalitis virus
GSRFQEFEA

SEQ ID NO: 193635 - protein, 9 aa, Tick-borne encephalitis virus
SRFQEFEAL

SEQ ID NO: 193636 - protein, 9 aa, Tick-borne encephalitis virus
RFQEFEALG

SEQ ID NO: 193637 - protein, 9 aa, Tick-borne encephalitis virus
FQEFEALGF

SEQ ID NO: 193638 - protein, 9 aa, Tick-borne encephalitis virus
QEFEALGFL

SEQ ID NO: 193639 - protein, 9 aa, Tick-borne encephalitis virus
NEDHWASRE

SEQ ID NO: 193640 - protein, 9 aa, Tick-borne encephalitis virus
EDHWASRES

SEQ ID NO: 193641 - protein, 9 aa, Tick-borne encephalitis virus
DHWASRESS

SEQ ID NO: 193642 - protein, 9 aa, Tick-borne encephalitis virus
HWASRESSG

SEQ ID NO: 193643 - protein, 9 aa, Tick-borne encephalitis virus
WASRESSGA

SEQ ID NO: 193644 - protein, 9 aa, Tick-borne encephalitis virus
ASRESSGAG

SEQ ID NO: 193645 - protein, 9 aa, Tick-borne encephalitis virus
SRESSGAGV

SEQ ID NO: 193646 - protein, 9 aa, Tick-borne encephalitis virus
RESSGAGVE

SEQ ID NO: 193647 - protein, 9 aa, Tick-borne encephalitis virus
ESSGAGVEG

SEQ ID NO: 193648 - protein, 9 aa, Tick-borne encephalitis virus
SSGAGVEGI

SEQ ID NO: 193649 - protein, 9 aa, Tick-borne encephalitis virus
SGAGVEGIS

SEQ ID NO: 193650 - protein, 9 aa, Tick-borne encephalitis virus
GAGVEGISL

SEQ ID NO: 193651 - protein, 9 aa, Tick-borne encephalitis virus
AGVEGISLN

SEQ ID NO: 193652 - protein, 9 aa, Tick-borne encephalitis virus
ISLNYLGWY

SEQ ID NO: 193653 - protein, 9 aa, Tick-borne encephalitis virus
SLNYLGWYL

SEQ ID NO: 193654 - protein, 9 aa, Tick-borne encephalitis virus
LNYLGWYLK

SEQ ID NO: 193655 - protein, 9 aa, Tick-borne encephalitis virus
NYLGWHLKK

SEQ ID NO: 193656 - protein, 9 aa, Tick-borne encephalitis virus
YLGWYLKGL

SEQ ID NO: 193657 - protein, 9 aa, Tick-borne encephalitis virus
LGWYLKGLS

SEQ ID NO: 193658 - protein, 9 aa, Tick-borne encephalitis virus
LSTLNGGLF

SEQ ID NO: 193659 - protein, 9 aa, Tick-borne encephalitis virus
STLNGGLFY

SEQ ID NO: 193660 - protein, 9 aa, Tick-borne encephalitis virus
TLNGGLFYA

SEQ ID NO: 193661 - protein, 9 aa, Tick-borne encephalitis virus
LNGGLFYAD

SEQ ID NO: 193662 - protein, 9 aa, Tick-borne encephalitis virus
NGGLFYADD

SEQ ID NO: 193663 - protein, 9 aa, Tick-borne encephalitis virus
ADLEDEEQI

SEQ ID NO: 193664 - protein, 9 aa, Tick-borne encephalitis virus
DLEDEEQIL

SEQ ID NO: 193665 - protein, 9 aa, Tick-borne encephalitis virus
LEDEEQILR

SEQ ID NO: 193666 - protein, 9 aa, Tick-borne encephalitis virus
EDEEQILRY

SEQ ID NO: 193667 - protein, 9 aa, Tick-borne encephalitis virus
DEEQILRYM

SEQ ID NO: 193668 - protein, 9 aa, Tick-borne encephalitis virus
EEQILRYME

SEQ ID NO: 193669 - protein, 9 aa, Tick-borne encephalitis virus
EQILRYMEG

SEQ ID NO: 193670 - protein, 9 aa, Tick-borne encephalitis virus
QILRYMEGE

SEQ ID NO: 193671 - protein, 9 aa, Tick-borne encephalitis virus
ILRYMEGEH

SEQ ID NO: 193672 - protein, 9 aa, Tick-borne encephalitis virus
LRYMEGEHR

SEQ ID NO: 193673 - protein, 9 aa, Tick-borne encephalitis virus
RYMEGEHRQ

SEQ ID NO: 193674 - protein, 9 aa, Tick-borne encephalitis virus
YMEGEHRQL

SEQ ID NO: 193675 - protein, 9 aa, Tick-borne encephalitis virus
MEGEHRQLA

SEQ ID NO: 193676 - protein, 9 aa, Tick-borne encephalitis virus
EGEHKQLAT

SEQ ID NO: 193677 - protein, 9 aa, Tick-borne encephalitis virus
GEHKQLATT

SEQ ID NO: 193678 - protein, 9 aa, Tick-borne encephalitis virus
EHKQLATTI

SEQ ID NO: 193679 - protein, 9 aa, Tick-borne encephalitis virus
HKQLATTIM

SEQ ID NO: 193680 - protein, 9 aa, Tick-borne encephalitis virus
KQLATTIMQ

SEQ ID NO: 193681 - protein, 9 aa, Tick-borne encephalitis virus
QLATTIMQK

SEQ ID NO: 193682 - protein, 9 aa, Tick-borne encephalitis virus
LATTIMQKA

SEQ ID NO: 193683 - protein, 9 aa, Tick-borne encephalitis virus
ATTIMQKAY

SEQ ID NO: 193684 - protein, 9 aa, Tick-borne encephalitis virus
TTIMQKAYH

SEQ ID NO: 193685 - protein, 9 aa, Tick-borne encephalitis virus
TVMQKAYHA

SEQ ID NO: 193686 - protein, 9 aa, Tick-borne encephalitis virus
VMQKAYHAK

SEQ ID NO: 193687 - protein, 9 aa, Tick-borne encephalitis virus
VKVARPSRE

SEQ ID NO: 193688 - protein, 9 aa, Tick-borne encephalitis virus
KVARPSREG

SEQ ID NO: 193689 - protein, 9 aa, Tick-borne encephalitis virus
VARPSREGG

SEQ ID NO: 193690 - protein, 9 aa, Tick-borne encephalitis virus
ARPSREGGC

SEQ ID NO: 193691 - protein, 9 aa, Tick-borne encephalitis virus
RPSRDGGCV

SEQ ID NO: 193692 - protein, 9 aa, Tick-borne encephalitis virus
PSRDGGCVM

SEQ ID NO: 193693 - protein, 9 aa, Tick-borne encephalitis virus
SRDGGCVMD

SEQ ID NO: 193694 - protein, 9 aa, Tick-borne encephalitis virus
RDGGCVMDV

SEQ ID NO: 193695 - protein, 9 aa, Tick-borne encephalitis virus
DGGCVMDVI

SEQ ID NO: 193696 - protein, 9 aa, Tick-borne encephalitis virus
GGCVMDVIT

SEQ ID NO: 193697 - protein, 9 aa, Tick-borne encephalitis virus
GCVMDVITR

SEQ ID NO: 193698 - protein, 9 aa, Tick-borne encephalitis virus
CVMDVITRR

SEQ ID NO: 193699 - protein, 9 aa, Tick-borne encephalitis virus
VMDVITRRD

SEQ ID NO: 193700 - protein, 9 aa, Tick-borne encephalitis virus
TRRDQRGSV

SEQ ID NO: 193701 - protein, 9 aa, Tick-borne encephalitis virus
RRDQRGSVQ

SEQ ID NO: 193702 - protein, 9 aa, Tick-borne encephalitis virus
RDQRGSVQV

SEQ ID NO: 193703 - protein, 9 aa, Tick-borne encephalitis virus
DQRGSVQVV

SEQ ID NO: 193704 - protein, 9 aa, Tick-borne encephalitis virus
QRGSVQVVT

SEQ ID NO: 193705 - protein, 9 aa, Tick-borne encephalitis virus
RGSVQVVTY

SEQ ID NO: 193706 - protein, 9 aa, Tick-borne encephalitis virus
GSVQVVTYA

SEQ ID NO: 193707 - protein, 9 aa, Tick-borne encephalitis virus
SVQVVTYAL

SEQ ID NO: 193708 - protein, 9 aa, Tick-borne encephalitis virus
VQVVTYALN

SEQ ID NO: 193709 - protein, 9 aa, Tick-borne encephalitis virus
VVTYALNTH

SEQ ID NO: 193710 - protein, 9 aa, Tick-borne encephalitis virus
VTYALNTHT

SEQ ID NO: 193711 - protein, 9 aa, Tick-borne encephalitis virus
TYALNTHTN

SEQ ID NO: 193712 - protein, 9 aa, Tick-borne encephalitis virus
YALNTHTNI

SEQ ID NO: 193713 - protein, 9 aa, Tick-borne encephalitis virus
ALNTHTNIK

SEQ ID NO: 193714 - protein, 9 aa, Tick-borne encephalitis virus
LNTHTNIKV

SEQ ID NO: 193715 - protein, 9 aa, Tick-borne encephalitis virus
NTHTNIKVQ

SEQ ID NO: 193716 - protein, 9 aa, Tick-borne encephalitis virus
THTNIKVQL

SEQ ID NO: 193717 - protein, 9 aa, Tick-borne encephalitis virus
HTNIKVQLI

SEQ ID NO: 193718 - protein, 9 aa, Tick-borne encephalitis virus
RMMEGEGVV

SEQ ID NO: 193719 - protein, 9 aa, Tick-borne encephalitis virus
MMEGEGVVE

SEQ ID NO: 193720 - protein, 9 aa, Tick-borne encephalitis virus
MEGEGVVEA

SEQ ID NO: 193721 - protein, 9 aa, Tick-borne encephalitis virus
EGEGVIEAA

SEQ ID NO: 193722 - protein, 9 aa, Tick-borne encephalitis virus
GEGVIEAAD

SEQ ID NO: 193723 - protein, 9 aa, Tick-borne encephalitis virus
EGVIEAADA

SEQ ID NO: 193724 - protein, 9 aa, Tick-borne encephalitis virus
GVIEAADAH

SEQ ID NO: 193725 - protein, 9 aa, Tick-borne encephalitis virus
VIEAADAHN

SEQ ID NO: 193726 - protein, 9 aa, Tick-borne encephalitis virus
IEAADAHNP

SEQ ID NO: 193727 - protein, 9 aa, Tick-borne encephalitis virus
EAADAHNPR

SEQ ID NO: 193728 - protein, 9 aa, Tick-borne encephalitis virus
AADAHNPRL

SEQ ID NO: 193729 - protein, 9 aa, Tick-borne encephalitis virus
ADAHNPRLL

SEQ ID NO: 193730 - protein, 9 aa, Tick-borne encephalitis virus
DAHNPRLFR

SEQ ID NO: 193731 - protein, 9 aa, Tick-borne encephalitis virus
AHNPRLFRV

SEQ ID NO: 193732 - protein, 9 aa, Tick-borne encephalitis virus
HNPRLFRVE

SEQ ID NO: 193733 - protein, 9 aa, Tick-borne encephalitis virus
NPRLFRVER

SEQ ID NO: 193734 - protein, 9 aa, Tick-borne encephalitis virus
PRLFRVERW

SEQ ID NO: 193735 - protein, 9 aa, Tick-borne encephalitis virus
RLFRVERWL

SEQ ID NO: 193736 - protein, 9 aa, Tick-borne encephalitis virus
LLRVERWLK

SEQ ID NO: 193737 - protein, 9 aa, Tick-borne encephalitis virus
LRVERWLKE

SEQ ID NO: 193738 - protein, 9 aa, Tick-borne encephalitis virus
RVERWLKEH

SEQ ID NO: 193739 - protein, 9 aa, Tick-borne encephalitis virus
VERWLKEHG

SEQ ID NO: 193740 - protein, 9 aa, Tick-borne encephalitis virus
EHGEERLGR

SEQ ID NO: 193741 - protein, 9 aa, Tick-borne encephalitis virus
YGEERLGRM

SEQ ID NO: 193742 - protein, 9 aa, Tick-borne encephalitis virus
GGERLGRML

SEQ ID NO: 193743 - protein, 9 aa, Tick-borne encephalitis virus
GERLGRMLV

SEQ ID NO: 193744 - protein, 9 aa, Tick-borne encephalitis virus
SGDDCVVRG

SEQ ID NO: 193745 - protein, 9 aa, Tick-borne encephalitis virus
GDDCVVRPL

SEQ ID NO: 193746 - protein, 9 aa, Tick-borne encephalitis virus
DDCVVRPLD

SEQ ID NO: 193747 - protein, 9 aa, Tick-borne encephalitis virus
DCVVRPLDD

SEQ ID NO: 193748 - protein, 9 aa, Tick-borne encephalitis virus
CVVRPLDDR

SEQ ID NO: 193749 - protein, 9 aa, Tick-borne encephalitis virus
VVRPLDDRF

SEQ ID NO: 193750 - protein, 9 aa, Tick-borne encephalitis virus
VRPLDDRFG

SEQ ID NO: 193751 - protein, 9 aa, Tick-borne encephalitis virus
DDRFSKALY

SEQ ID NO: 193752 - protein, 9 aa, Tick-borne encephalitis virus
DRFSKALYF

SEQ ID NO: 193753 - protein, 9 aa, Tick-borne encephalitis virus
RFSKALYFL

SEQ ID NO: 193754 - protein, 9 aa, Tick-borne encephalitis virus
FSKALYFLN

SEQ ID NO: 193755 - protein, 9 aa, Tick-borne encephalitis virus
SKALYFLND

SEQ ID NO: 193756 - protein, 9 aa, Tick-borne encephalitis virus
RALYFLNDM

SEQ ID NO: 193757 - protein, 9 aa, Tick-borne encephalitis virus
DMAKTRKDV

SEQ ID NO: 193758 - protein, 9 aa, Tick-borne encephalitis virus
MAKTRKDVG

SEQ ID NO: 193759 - protein, 9 aa, Tick-borne encephalitis virus
AKTRKDVGE

SEQ ID NO: 193760 - protein, 9 aa, Tick-borne encephalitis virus
KTRKDVGEW

SEQ ID NO: 193761 - protein, 9 aa, Tick-borne encephalitis virus
TRKDVGEWE

SEQ ID NO: 193762 - protein, 9 aa, Tick-borne encephalitis virus
RKDVGEWEH

SEQ ID NO: 193763 - protein, 9 aa, Tick-borne encephalitis virus
KDVGEWEHS

SEQ ID NO: 193764 - protein, 9 aa, Tick-borne encephalitis virus
DVGEWEHSV

SEQ ID NO: 193765 - protein, 9 aa, Tick-borne encephalitis virus
VGEWEHSVG

SEQ ID NO: 193766 - protein, 9 aa, Tick-borne encephalitis virus
GEWEHSAGF

SEQ ID NO: 193767 - protein, 9 aa, Tick-borne encephalitis virus
EWEHSAGFS

SEQ ID NO: 193768 - protein, 9 aa, Tick-borne encephalitis virus
SWEEVPFCS

SEQ ID NO: 193769 - protein, 9 aa, Tick-borne encephalitis virus
VEEVPFCSH

SEQ ID NO: 193770 - protein, 9 aa, Tick-borne encephalitis virus
EAVPFCSHH

SEQ ID NO: 193771 - protein, 9 aa, Tick-borne encephalitis virus
AVPFCSHHF

SEQ ID NO: 193772 - protein, 9 aa, Tick-borne encephalitis virus
ELVMKDGRT

SEQ ID NO: 193773 - protein, 9 aa, Tick-borne encephalitis virus
LVMKDGRSL

SEQ ID NO: 193774 - protein, 9 aa, Tick-borne encephalitis virus
VMKDGRTLV

SEQ ID NO: 193775 - protein, 9 aa, Tick-borne encephalitis virus
MKDGRSLIV

SEQ ID NO: 193776 - protein, 9 aa, Tick-borne encephalitis virus
KDGRSLIVP

SEQ ID NO: 193777 - protein, 9 aa, Tick-borne encephalitis virus
DGRTLVVPC

SEQ ID NO: 193778 - protein, 9 aa, Tick-borne encephalitis virus
GRSLIVPCR

SEQ ID NO: 193779 - protein, 9 aa, Tick-borne encephalitis virus
RSLIVPCRD

SEQ ID NO: 193780 - protein, 9 aa, Tick-borne encephalitis virus
SLIVPCRDQ

SEQ ID NO: 193781 - protein, 9 aa, Tick-borne encephalitis virus
LVVPCRDQD

SEQ ID NO: 193782 - protein, 9 aa, Tick-borne encephalitis virus
VVPCRDQDE

SEQ ID NO: 193783 - protein, 9 aa, Tick-borne encephalitis virus
QDELVGRAP

SEQ ID NO: 193784 - protein, 9 aa, Tick-borne encephalitis virus
DELVGRARI

SEQ ID NO: 193785 - protein, 9 aa, Tick-borne encephalitis virus
ELVGRARIS

SEQ ID NO: 193786 - protein, 9 aa, Tick-borne encephalitis virus
LVGRARISP

SEQ ID NO: 193787 - protein, 9 aa, Tick-borne encephalitis virus
VGRARISPG

SEQ ID NO: 193788 - protein, 9 aa, Tick-borne encephalitis virus
GRARISPGC

SEQ ID NO: 193789 - protein, 9 aa, Tick-borne encephalitis virus
RARISPGCG

SEQ ID NO: 193790 - protein, 9 aa, Tick-borne encephalitis virus
ARISPGCGW

SEQ ID NO: 193791 - protein, 9 aa, Tick-borne encephalitis virus
RISPGCGWS

SEQ ID NO: 193792 - protein, 9 aa, Tick-borne encephalitis virus
ISPGCGWSV

SEQ ID NO: 193793 - protein, 9 aa, Tick-borne encephalitis virus
SPGCGWSIR

SEQ ID NO: 193794 - protein, 9 aa, Tick-borne encephalitis virus
PGCGWSIRE

SEQ ID NO: 193795 - protein, 9 aa, Tick-borne encephalitis virus
GCGWSIRET

SEQ ID NO: 193796 - protein, 9 aa, Tick-borne encephalitis virus
CGWSIRETA

SEQ ID NO: 193797 - protein, 9 aa, Tick-borne encephalitis virus
GWSIRETAC

SEQ ID NO: 193798 - protein, 9 aa, Tick-borne encephalitis virus
WSIRETACL

SEQ ID NO: 193799 - protein, 9 aa, Tick-borne encephalitis virus
SIRETACLS

SEQ ID NO: 193800 - protein, 9 aa, Tick-borne encephalitis virus
IRETACLSK

SEQ ID NO: 193801 - protein, 9 aa, Tick-borne encephalitis virus
RRDLRTLGF

SEQ ID NO: 193802 - protein, 9 aa, Tick-borne encephalitis virus
RDLRTLGLT

SEQ ID NO: 193803 - protein, 9 aa, Tick-borne encephalitis virus
DLRTLGLTI

SEQ ID NO: 193804 - protein, 9 aa, Tick-borne encephalitis virus
LRTLGLAIN

SEQ ID NO: 193805 - protein, 9 aa, Tick-borne encephalitis virus
RTLGLAINS

SEQ ID NO: 193806 - protein, 9 aa, Tick-borne encephalitis virus
TLGLAINSA

SEQ ID NO: 193807 - protein, 9 aa, Tick-borne encephalitis virus
LGLAINSAV

SEQ ID NO: 193808 - protein, 9 aa, Tick-borne encephalitis virus
GLAINSAVP

SEQ ID NO: 193809 - protein, 9 aa, Tick-borne encephalitis virus
SAVPIDWVP

SEQ ID NO: 193810 - protein, 9 aa, Tick-borne encephalitis virus
AVPIDWVPT

SEQ ID NO: 193811 - protein, 9 aa, Tick-borne encephalitis virus
VPADWVPTG

SEQ ID NO: 193812 - protein, 9 aa, Tick-borne encephalitis virus
PIDWVPTGR

SEQ ID NO: 193813 - protein, 9 aa, Tick-borne encephalitis virus
ADWVPTGRT

SEQ ID NO: 193814 - protein, 9 aa, Tick-borne encephalitis virus
TWSIHASGS

SEQ ID NO: 193815 - protein, 9 aa, Tick-borne encephalitis virus
WSIHASGSW

SEQ ID NO: 193816 - protein, 9 aa, Tick-borne encephalitis virus
SIHASGAWI

SEQ ID NO: 193817 - protein, 9 aa, Tick-borne encephalitis virus
IHASGAWIT

SEQ ID NO: 193818 - protein, 9 aa, Tick-borne encephalitis virus
HASGAWITT

SEQ ID NO: 193819 - protein, 9 aa, Tick-borne encephalitis virus
ASGAWITTE

SEQ ID NO: 193820 - protein, 9 aa, Tick-borne encephalitis virus
SGAWMTTEN

SEQ ID NO: 193821 - protein, 9 aa, Tick-borne encephalitis virus
GAWMTTENM

SEQ ID NO: 193822 - protein, 9 aa, Tick-borne encephalitis virus
AWMTTENML

SEQ ID NO: 193823 - protein, 9 aa, Tick-borne encephalitis virus
WMTTENMLD

SEQ ID NO: 193824 - protein, 9 aa, Tick-borne encephalitis virus
MTTENMLDV

SEQ ID NO: 193825 - protein, 9 aa, Tick-borne encephalitis virus
TTENMLDVW

SEQ ID NO: 193826 - protein, 9 aa, Tick-borne encephalitis virus
TENMLDVWN

SEQ ID NO: 193827 - protein, 9 aa, Tick-borne encephalitis virus
ENMLDVWNR

SEQ ID NO: 193828 - protein, 9 aa, Tick-borne encephalitis virus
NMLDVWNRV

SEQ ID NO: 193829 - protein, 9 aa, Tick-borne encephalitis virus
WILDNPFMQ

SEQ ID NO: 193830 - protein, 9 aa, Tick-borne encephalitis virus
ILDNPFMQN

SEQ ID NO: 193831 - protein, 9 aa, Tick-borne encephalitis virus
LDNPFMQNK

SEQ ID NO: 193832 - protein, 9 aa, Tick-borne encephalitis virus
DNPFMQNKE

SEQ ID NO: 193833 - protein, 9 aa, Tick-borne encephalitis virus
NPFMQNKEK

SEQ ID NO: 193834 - protein, 9 aa, Tick-borne encephalitis virus
EWRDIPYLP

SEQ ID NO: 193835 - protein, 9 aa, Tick-borne encephalitis virus
WRDIPYLPK

SEQ ID NO: 193836 - protein, 9 aa, Tick-borne encephalitis virus
RDVPYLPKA

SEQ ID NO: 193837 - protein, 9 aa, Tick-borne encephalitis virus
VPYLPKAQD

SEQ ID NO: 193838 - protein, 9 aa, Tick-borne encephalitis virus
PYLPKAQDM

SEQ ID NO: 193839 - protein, 9 aa, Tick-borne encephalitis virus
YLPKAQDML

SEQ ID NO: 193840 - protein, 9 aa, Tick-borne encephalitis virus
LPKAQDMLC

SEQ ID NO: 193841 - protein, 9 aa, Tick-borne encephalitis virus
PKAQDMLCS

SEQ ID NO: 193842 - protein, 9 aa, Tick-borne encephalitis virus
KAQDMLCSS

SEQ ID NO: 193843 - protein, 9 aa, Tick-borne encephalitis virus
AQDMLCSSL

SEQ ID NO: 193844 - protein, 9 aa, Tick-borne encephalitis virus
QDMLCSSLV

SEQ ID NO: 193845 - protein, 9 aa, Tick-borne encephalitis virus
LCSSLVGRR

SEQ ID NO: 193846 - protein, 9 aa, Tick-borne encephalitis virus
CSSLVGRRE

SEQ ID NO: 193847 - protein, 9 aa, Tick-borne encephalitis virus
SSLVGRRER

SEQ ID NO: 193848 - protein, 9 aa, Tick-borne encephalitis virus
SLVGRRERA

SEQ ID NO: 193849 - protein, 9 aa, Tick-borne encephalitis virus
LVGRRERAE

SEQ ID NO: 193850 - protein, 9 aa, Tick-borne encephalitis virus
VGRRERAEW

SEQ ID NO: 193851 - protein, 9 aa, Tick-borne encephalitis virus
GRRERAEWA

SEQ ID NO: 193852 - protein, 9 aa, Tick-borne encephalitis virus
RRERAEWAK

SEQ ID NO: 193853 - protein, 9 aa, Tick-borne encephalitis virus
RERAEWAKN

SEQ ID NO: 193854 - protein, 9 aa, Tick-borne encephalitis virus
ERAEWARNI

SEQ ID NO: 193855 - protein, 9 aa, Tick-borne encephalitis virus
RAEWARNIW

SEQ ID NO: 193856 - protein, 9 aa, Tick-borne encephalitis virus
AEWARNIWG

SEQ ID NO: 193857 - protein, 9 aa, Tick-borne encephalitis virus
EWARNIWGA

SEQ ID NO: 193858 - protein, 9 aa, Tick-borne encephalitis virus
WARNIWGAV

SEQ ID NO: 193859 - protein, 9 aa, Tick-borne encephalitis virus
ARNIWGAVE

SEQ ID NO: 193860 - protein, 9 aa, Tick-borne encephalitis virus
RNIWGAVEK

SEQ ID NO: 193861 - protein, 9 aa, Tick-borne encephalitis virus
WGAVEKVRR

SEQ ID NO: 193862 - protein, 9 aa, Tick-borne encephalitis virus
GAVEKVRRM

SEQ ID NO: 193863 - protein, 9 aa, Tick-borne encephalitis virus
AVEKVRRMI

SEQ ID NO: 193864 - protein, 9 aa, Tick-borne encephalitis virus
VEKVRRMIG

SEQ ID NO: 193865 - protein, 9 aa, Tick-borne encephalitis virus
KFRDYLSCM

SEQ ID NO: 193866 - protein, 9 aa, Tick-borne encephalitis virus
FRDYLSCMD

SEQ ID NO: 193867 - protein, 9 aa, Tick-borne encephalitis virus
RDYLSCMDR

SEQ ID NO: 193868 - protein, 9 aa, Tick-borne encephalitis virus
DYPSCMDRH

SEQ ID NO: 193869 - protein, 9 aa, Tick-borne encephalitis virus
YLSCMDRHY

SEQ ID NO: 193870 - protein, 9 aa, Tick-borne encephalitis virus
PSCMDRHDL

SEQ ID NO: 193871 - protein, 9 aa, Tick-borne encephalitis virus
SCMDRHYLH

SEQ ID NO: 193872 - protein, 9 aa, Tick-borne encephalitis virus
CMDRHYLHW

SEQ ID NO: 193873 - protein, 9 aa, Tick-borne encephalitis virus
MDRHYLHWN

SEQ ID NO: 193874 - protein, 9 aa, Tick-borne encephalitis virus
DRHYLHWNL

SEQ ID NO: 193875 - protein, 9 aa, Tick-borne encephalitis virus
RHDLHWELR

SEQ ID NO: 193876 - protein, 9 aa, Tick-borne encephalitis virus
HDLHWELRL

SEQ ID NO: 193877 - protein, 9 aa, Tick-borne encephalitis virus
DLHWELRLE

SEQ ID NO: 193878 - protein, 9 aa, Tick-borne encephalitis virus
LHWELRLES

SEQ ID NO: 193879 - protein, 9 aa, Tick-borne encephalitis virus
HWELRLESS

SEQ ID NO: 193880 - protein, 9 aa, Tick-borne encephalitis virus
WELRLESSI

SEQ ID NO: 193881 - protein, 9 aa, Tick-borne encephalitis virus
ELRLESSII

SEQ ID NO: 193882 - protein, 9 aa, Tick-borne encephalitis virus
MARKAILKG

SEQ ID NO: 193883 - protein, 9 aa, Tick-borne encephalitis virus
ARKAILKGK

SEQ ID NO: 193884 - protein, 9 aa, Tick-borne encephalitis virus
RKAILKGKG

SEQ ID NO: 193885 - protein, 9 aa, Tick-borne encephalitis virus
PPRRASKET

SEQ ID NO: 193886 - protein, 9 aa, Tick-borne encephalitis virus
PRRVSKEAA

SEQ ID NO: 193887 - protein, 9 aa, Tick-borne encephalitis virus
RRVSKETAR

SEQ ID NO: 193888 - protein, 9 aa, Tick-borne encephalitis virus
RVSKETARK

SEQ ID NO: 193889 - protein, 9 aa, Tick-borne encephalitis virus
VSKETARKT

SEQ ID NO: 193890 - protein, 9 aa, Tick-borne encephalitis virus
SKETARKTR

SEQ ID NO: 193891 - protein, 9 aa, Tick-borne encephalitis virus
KETARKTRQ

SEQ ID NO: 193892 - protein, 9 aa, Tick-borne encephalitis virus
ETARKTRQS

SEQ ID NO: 193893 - protein, 9 aa, Tick-borne encephalitis virus
TARKTRQSR

SEQ ID NO: 193894 - protein, 9 aa, Tick-borne encephalitis virus
ARKTRQSRV

SEQ ID NO: 193895 - protein, 9 aa, Tick-borne encephalitis virus
TKTRQPRVQ

SEQ ID NO: 193896 - protein, 9 aa, Tick-borne encephalitis virus
KTRQPRVQM

SEQ ID NO: 193897 - protein, 9 aa, Tick-borne encephalitis virus
TRQPRVQMP

SEQ ID NO: 193898 - protein, 9 aa, Tick-borne encephalitis virus
RQPRVQMPN

SEQ ID NO: 193899 - protein, 9 aa, Tick-borne encephalitis virus
QPRVQMPNG

SEQ ID NO: 193900 - protein, 9 aa, Tick-borne encephalitis virus
PRVQMPNGL

SEQ ID NO: 193901 - protein, 9 aa, Tick-borne encephalitis virus
RVQMPSGLV

SEQ ID NO: 193902 - protein, 9 aa, Tick-borne encephalitis virus
VQMPSGLVL

SEQ ID NO: 193903 - protein, 9 aa, Tick-borne encephalitis virus
QMPSGLVLM

SEQ ID NO: 193904 - protein, 9 aa, Tick-borne encephalitis virus
SGLVLMRMM

SEQ ID NO: 193905 - protein, 9 aa, Tick-borne encephalitis virus
LVLMRMMGF

SEQ ID NO: 193906 - protein, 9 aa, Tick-borne encephalitis virus
VLMRMMGFL

SEQ ID NO: 193907 - protein, 9 aa, Tick-borne encephalitis virus
LMRMMGFLW

SEQ ID NO: 193908 - protein, 9 aa, Tick-borne encephalitis virus
MRMMGFLWH

SEQ ID NO: 193909 - protein, 9 aa, Tick-borne encephalitis virus
RMMGFLWHA

SEQ ID NO: 193910 - protein, 9 aa, Tick-borne encephalitis virus
MLGILWHAV

SEQ ID NO: 193911 - protein, 9 aa, Tick-borne encephalitis virus
LGILWHAVA

SEQ ID NO: 193912 - protein, 9 aa, Tick-borne encephalitis virus
GFLWHAIAG

SEQ ID NO: 193913 - protein, 9 aa, Tick-borne encephalitis virus
FLWHAIAGT

SEQ ID NO: 193914 - protein, 9 aa, Tick-borne encephalitis virus
LWHAVAGTV

SEQ ID NO: 193915 - protein, 9 aa, Tick-borne encephalitis virus
WHAVAGTVR

SEQ ID NO: 193916 - protein, 9 aa, Tick-borne encephalitis virus
HAIAGTARS

SEQ ID NO: 193917 - protein, 9 aa, Tick-borne encephalitis virus
AIAGTARSP

SEQ ID NO: 193918 - protein, 9 aa, Tick-borne encephalitis virus
IAGTARSPV

SEQ ID NO: 193919 - protein, 9 aa, Tick-borne encephalitis virus
AGTVRSPVL

SEQ ID NO: 193920 - protein, 9 aa, Tick-borne encephalitis virus
GTVRSPVLK

SEQ ID NO: 193921 - protein, 9 aa, Tick-borne encephalitis virus
TVRSPVLKS

SEQ ID NO: 193922 - protein, 9 aa, Tick-borne encephalitis virus
VRSPVLKSF

SEQ ID NO: 193923 - protein, 9 aa, Tick-borne encephalitis virus
SPVLKSFWK

SEQ ID NO: 193924 - protein, 9 aa, Tick-borne encephalitis virus
PVLKSFWKS

SEQ ID NO: 193925 - protein, 9 aa, Tick-borne encephalitis virus
VLKSFWKSV

SEQ ID NO: 193926 - protein, 9 aa, Tick-borne encephalitis virus
LKSFWKSVP

SEQ ID NO: 193927 - protein, 9 aa, Tick-borne encephalitis virus
KSFWKSVPL

SEQ ID NO: 193928 - protein, 9 aa, Tick-borne encephalitis virus
AFWNSVPLK

SEQ ID NO: 193929 - protein, 9 aa, Tick-borne encephalitis virus
FWKSVPLKQ

SEQ ID NO: 193930 - protein, 9 aa, Tick-borne encephalitis virus
WKSVPLKQA

SEQ ID NO: 193931 - protein, 9 aa, Tick-borne encephalitis virus
KSVPLKQAT

SEQ ID NO: 193932 - protein, 9 aa, Tick-borne encephalitis virus
SVPLKQAMA

SEQ ID NO: 193933 - protein, 9 aa, Tick-borne encephalitis virus
VPLKQAMAA

SEQ ID NO: 193934 - protein, 9 aa, Tick-borne encephalitis virus
PLKQAMAAL

SEQ ID NO: 193935 - protein, 9 aa, Tick-borne encephalitis virus
LKQAMAALR

SEQ ID NO: 193936 - protein, 9 aa, Tick-borne encephalitis virus
KQAMAALRK

SEQ ID NO: 193937 - protein, 9 aa, Tick-borne encephalitis virus
QATTALRKI

SEQ ID NO: 193938 - protein, 9 aa, Tick-borne encephalitis virus
ATTALRKIK

SEQ ID NO: 193939 - protein, 9 aa, Tick-borne encephalitis virus
MAALRKIKK

SEQ ID NO: 193940 - protein, 9 aa, Tick-borne encephalitis virus
TALRKIKMA

SEQ ID NO: 193941 - protein, 9 aa, Tick-borne encephalitis virus
ALRKIKMAV

SEQ ID NO: 193942 - protein, 9 aa, Tick-borne encephalitis virus
LRKIKMAVS

SEQ ID NO: 193943 - protein, 9 aa, Tick-borne encephalitis virus
RKIKKAVSA

SEQ ID NO: 193944 - protein, 9 aa, Tick-borne encephalitis virus
KIKKAVSAL

SEQ ID NO: 193945 - protein, 9 aa, Tick-borne encephalitis virus
IKMAVSALM

SEQ ID NO: 193946 - protein, 9 aa, Tick-borne encephalitis virus
AVSALMVGL

SEQ ID NO: 193947 - protein, 9 aa, Tick-borne encephalitis virus
VSALMIGLQ

SEQ ID NO: 193948 - protein, 9 aa, Tick-borne encephalitis virus
LMIGLQRRG

SEQ ID NO: 193949 - protein, 9 aa, Tick-borne encephalitis virus
MIGLQRRGK

SEQ ID NO: 193950 - protein, 9 aa, Tick-borne encephalitis virus
VGLQRRGKK

SEQ ID NO: 193951 - protein, 9 aa, Tick-borne encephalitis virus
GLQRRGKKR

SEQ ID NO: 193952 - protein, 9 aa, Tick-borne encephalitis virus
LQRRGKKRS

SEQ ID NO: 193953 - protein, 9 aa, Tick-borne encephalitis virus
QRRGKKRST

SEQ ID NO: 193954 - protein, 9 aa, Tick-borne encephalitis virus
TIAATVRKE

SEQ ID NO: 193955 - protein, 9 aa, Tick-borne encephalitis virus
FAATVRKER

SEQ ID NO: 193956 - protein, 9 aa, Tick-borne encephalitis virus
AATVRREGD

SEQ ID NO: 193957 - protein, 9 aa, Tick-borne encephalitis virus
ATVRREGDG

SEQ ID NO: 193958 - protein, 9 aa, Tick-borne encephalitis virus
TVRKEGDGT

SEQ ID NO: 193959 - protein, 9 aa, Tick-borne encephalitis virus
VRKEGDGTT

SEQ ID NO: 193960 - protein, 9 aa, Tick-borne encephalitis virus
RKEGDGTTV

SEQ ID NO: 193961 - protein, 9 aa, Tick-borne encephalitis virus
KEGDGTTVI

SEQ ID NO: 193962 - protein, 9 aa, Tick-borne encephalitis virus
EGDGTTVIR

SEQ ID NO: 193963 - protein, 9 aa, Tick-borne encephalitis virus
GDGTTVIRA

SEQ ID NO: 193964 - protein, 9 aa, Tick-borne encephalitis virus
DDTTVIRAE

SEQ ID NO: 193965 - protein, 9 aa, Tick-borne encephalitis virus
DTTVIRAEG

SEQ ID NO: 193966 - protein, 9 aa, Tick-borne encephalitis virus
TTVIRAEGR

SEQ ID NO: 193967 - protein, 9 aa, Tick-borne encephalitis virus
ENGTCVIMA

SEQ ID NO: 193968 - protein, 9 aa, Tick-borne encephalitis virus
NGTCVIMAT

SEQ ID NO: 193969 - protein, 9 aa, Tick-borne encephalitis virus
GTCVIMATD

SEQ ID NO: 193970 - protein, 9 aa, Tick-borne encephalitis virus
TCVIMATDM

SEQ ID NO: 193971 - protein, 9 aa, Tick-borne encephalitis virus
CVIMATDMG

SEQ ID NO: 193972 - protein, 9 aa, Tick-borne encephalitis virus
VIMATDMGS

SEQ ID NO: 193973 - protein, 9 aa, Tick-borne encephalitis virus
IMATDMGSW

SEQ ID NO: 193974 - protein, 9 aa, Tick-borne encephalitis virus
LATDMGAWC

SEQ ID NO: 193975 - protein, 9 aa, Tick-borne encephalitis virus
ATDMGAWCD

SEQ ID NO: 193976 - protein, 9 aa, Tick-borne encephalitis virus
GAWCDDSLS

SEQ ID NO: 193977 - protein, 9 aa, Tick-borne encephalitis virus
AWCDDSLSY

SEQ ID NO: 193978 - protein, 9 aa, Tick-borne encephalitis virus
FCRNVDRVY

SEQ ID NO: 193979 - protein, 9 aa, Tick-borne encephalitis virus
CRNVDRVYL

SEQ ID NO: 193980 - protein, 9 aa, Tick-borne encephalitis virus
RNVDRVYLE

SEQ ID NO: 193981 - protein, 9 aa, Tick-borne encephalitis virus
NVDRVYLEY

SEQ ID NO: 193982 - protein, 9 aa, Tick-borne encephalitis virus
VDRVYLEYG

SEQ ID NO: 193983 - protein, 9 aa, Tick-borne encephalitis virus
DRVYLEYGR

SEQ ID NO: 193984 - protein, 9 aa, Tick-borne encephalitis virus
RVYLEYGRC

SEQ ID NO: 193985 - protein, 9 aa, Tick-borne encephalitis virus
LIRSHAQGD

SEQ ID NO: 193986 - protein, 9 aa, Tick-borne encephalitis virus
IRSHAQGDL

SEQ ID NO: 193987 - protein, 9 aa, Tick-borne encephalitis virus
RSHAQGDLT

SEQ ID NO: 193988 - protein, 9 aa, Tick-borne encephalitis virus
QGELTGRGR

SEQ ID NO: 193989 - protein, 9 aa, Tick-borne encephalitis virus
GELTGRGRK

SEQ ID NO: 193990 - protein, 9 aa, Tick-borne encephalitis virus
ELTGRGRKW

SEQ ID NO: 193991 - protein, 9 aa, Tick-borne encephalitis virus
IVWLTVESV

SEQ ID NO: 193992 - protein, 9 aa, Tick-borne encephalitis virus
VWMTVESVV

SEQ ID NO: 193993 - protein, 9 aa, Tick-borne encephalitis virus
WMTVESVVT

SEQ ID NO: 193994 - protein, 9 aa, Tick-borne encephalitis virus
LTLESVVAR

SEQ ID NO: 193995 - protein, 9 aa, Tick-borne encephalitis virus
TVESVVTRI

SEQ ID NO: 193996 - protein, 9 aa, Tick-borne encephalitis virus
VVVLFCLAP

SEQ ID NO: 193997 - protein, 9 aa, Tick-borne encephalitis virus
AVLLCLAPV

SEQ ID NO: 193998 - protein, 9 aa, Tick-borne encephalitis virus
VLFCLAPVY

SEQ ID NO: 193999 - protein, 9 aa, Tick-borne encephalitis virus
WLDAIYQES

SEQ ID NO: 194000 - protein, 9 aa, Tick-borne encephalitis virus
LDAIYQESP

SEQ ID NO: 194001 - protein, 9 aa, Tick-borne encephalitis virus
DAIYQESPA

SEQ ID NO: 194002 - protein, 9 aa, Tick-borne encephalitis virus
AIYQESPAK

SEQ ID NO: 194003 - protein, 9 aa, Tick-borne encephalitis virus
IYQEKPAKT

SEQ ID NO: 194004 - protein, 9 aa, Tick-borne encephalitis virus
YQENPAQTR

SEQ ID NO: 194005 - protein, 9 aa, Tick-borne encephalitis virus
QEKPAKTRE

SEQ ID NO: 194006 - protein, 9 aa, Tick-borne encephalitis virus
EKPAKTREY

SEQ ID NO: 194007 - protein, 9 aa, Tick-borne encephalitis virus
NPAQTREYC

SEQ ID NO: 194008 - protein, 9 aa, Tick-borne encephalitis virus
QTREYCLHA

SEQ ID NO: 194009 - protein, 9 aa, Tick-borne encephalitis virus
PTMGPATLT

SEQ ID NO: 194010 - protein, 9 aa, Tick-borne encephalitis virus
TTGPATLAE

SEQ ID NO: 194011 - protein, 9 aa, Tick-borne encephalitis virus
MGPATLTEE

SEQ ID NO: 194012 - protein, 9 aa, Tick-borne encephalitis virus
GPATLTEEH

SEQ ID NO: 194013 - protein, 9 aa, Tick-borne encephalitis virus
PATLAEQHQ

SEQ ID NO: 194014 - protein, 9 aa, Tick-borne encephalitis virus
ATLAEQHQS

SEQ ID NO: 194015 - protein, 9 aa, Tick-borne encephalitis virus
TLTEEHQGG

SEQ ID NO: 194016 - protein, 9 aa, Tick-borne encephalitis virus
LAEQHQSGT

SEQ ID NO: 194017 - protein, 9 aa, Tick-borne encephalitis virus
AEQHQSGTV

SEQ ID NO: 194018 - protein, 9 aa, Tick-borne encephalitis virus
EQHQSGTVC

SEQ ID NO: 194019 - protein, 9 aa, Tick-borne encephalitis virus
QHQSGTVCK

SEQ ID NO: 194020 - protein, 9 aa, Tick-borne encephalitis virus
GSIVTCVKV

SEQ ID NO: 194021 - protein, 9 aa, Tick-borne encephalitis virus
SIVTCVKVA

SEQ ID NO: 194022 - protein, 9 aa, Tick-borne encephalitis virus
IVTCVKVAC

SEQ ID NO: 194023 - protein, 9 aa, Tick-borne encephalitis virus
VTCVKVACE

SEQ ID NO: 194024 - protein, 9 aa, Tick-borne encephalitis virus
TCVKVACEA

SEQ ID NO: 194025 - protein, 9 aa, Tick-borne encephalitis virus
CVKVACEAK

SEQ ID NO: 194026 - protein, 9 aa, Tick-borne encephalitis virus
VKVACEAKK

SEQ ID NO: 194027 - protein, 9 aa, Tick-borne encephalitis virus
KVACEAKKK

SEQ ID NO: 194028 - protein, 9 aa, Tick-borne encephalitis virus
VACEAKKKA

SEQ ID NO: 194029 - protein, 9 aa, Tick-borne encephalitis virus
TGHVYDPNK

SEQ ID NO: 194030 - protein, 9 aa, Tick-borne encephalitis virus
GHVYDPNKI

SEQ ID NO: 194031 - protein, 9 aa, Tick-borne encephalitis virus
HVYDANRIV

SEQ ID NO: 194032 - protein, 9 aa, Tick-borne encephalitis virus
VYDANRIVY

SEQ ID NO: 194033 - protein, 9 aa, Tick-borne encephalitis virus
YDPNKIVYP

SEQ ID NO: 194034 - protein, 9 aa, Tick-borne encephalitis virus
DPNKIVYPV

SEQ ID NO: 194035 - protein, 9 aa, Tick-borne encephalitis virus
ANKIVYTIK

SEQ ID NO: 194036 - protein, 9 aa, Tick-borne encephalitis virus
NRIVYTVKV

SEQ ID NO: 194037 - protein, 9 aa, Tick-borne encephalitis virus
RIVYTVKVE

SEQ ID NO: 194038 - protein, 9 aa, Tick-borne encephalitis virus
IVYPVKVEP

SEQ ID NO: 194039 - protein, 9 aa, Tick-borne encephalitis virus
VYTIKVEPH

SEQ ID NO: 194040 - protein, 9 aa, Tick-borne encephalitis virus
YPVKVEPHT

SEQ ID NO: 194041 - protein, 9 aa, Tick-borne encephalitis virus
TIKVEPHTG

SEQ ID NO: 194042 - protein, 9 aa, Tick-borne encephalitis virus
PHTGDYVAP

SEQ ID NO: 194043 - protein, 9 aa, Tick-borne encephalitis virus
HTGDYVAVN

SEQ ID NO: 194044 - protein, 9 aa, Tick-borne encephalitis virus
TGDYVAPHE

SEQ ID NO: 194045 - protein, 9 aa, Tick-borne encephalitis virus
GDYVAVNET

SEQ ID NO: 194046 - protein, 9 aa, Tick-borne encephalitis virus
DYVAPHETH

SEQ ID NO: 194047 - protein, 9 aa, Tick-borne encephalitis virus
YVAVNETHS

SEQ ID NO: 194048 - protein, 9 aa, Tick-borne encephalitis virus
VAVNETHSG

SEQ ID NO: 194049 - protein, 9 aa, Tick-borne encephalitis virus
AVNETHSGR

SEQ ID NO: 194050 - protein, 9 aa, Tick-borne encephalitis virus
VNETHSGRK

SEQ ID NO: 194051 - protein, 9 aa, Tick-borne encephalitis virus
GRKTPSFTV

SEQ ID NO: 194052 - protein, 9 aa, Tick-borne encephalitis virus
RKTPSFTVS

SEQ ID NO: 194053 - protein, 9 aa, Tick-borne encephalitis virus
KTPSFTVSS

SEQ ID NO: 194054 - protein, 9 aa, Tick-borne encephalitis virus
TPSFTVSSE

SEQ ID NO: 194055 - protein, 9 aa, Tick-borne encephalitis virus
PSFTVSSEK

SEQ ID NO: 194056 - protein, 9 aa, Tick-borne encephalitis virus
VSSEKTILN

SEQ ID NO: 194057 - protein, 9 aa, Tick-borne encephalitis virus
EKTILNMGD

SEQ ID NO: 194058 - protein, 9 aa, Tick-borne encephalitis virus
KTILNMGDY

SEQ ID NO: 194059 - protein, 9 aa, Tick-borne encephalitis virus
TILNMGDYG

SEQ ID NO: 194060 - protein, 9 aa, Tick-borne encephalitis virus
ILNMGDYGD

SEQ ID NO: 194061 - protein, 9 aa, Tick-borne encephalitis virus
LNMGDYGDV

SEQ ID NO: 194062 - protein, 9 aa, Tick-borne encephalitis virus
NMGDYGDVS

SEQ ID NO: 194063 - protein, 9 aa, Tick-borne encephalitis virus
VILELDKTL

SEQ ID NO: 194064 - protein, 9 aa, Tick-borne encephalitis virus
ILELDKTLE

SEQ ID NO: 194065 - protein, 9 aa, Tick-borne encephalitis virus
LELDKTLEH

SEQ ID NO: 194066 - protein, 9 aa, Tick-borne encephalitis virus
ELDKTLEHL

SEQ ID NO: 194067 - protein, 9 aa, Tick-borne encephalitis virus
LDKTLEHLP

SEQ ID NO: 194068 - protein, 9 aa, Tick-borne encephalitis virus
DKTLEHLPT

SEQ ID NO: 194069 - protein, 9 aa, Tick-borne encephalitis virus
KTLEHLPTA

SEQ ID NO: 194070 - protein, 9 aa, Tick-borne encephalitis virus
TLEHLPTAW

SEQ ID NO: 194071 - protein, 9 aa, Tick-borne encephalitis virus
LEHLPTAWQ

SEQ ID NO: 194072 - protein, 9 aa, Tick-borne encephalitis virus
ALPWRHEGV

SEQ ID NO: 194073 - protein, 9 aa, Tick-borne encephalitis virus
LPWKHEGAR

SEQ ID NO: 194074 - protein, 9 aa, Tick-borne encephalitis virus
HEGAQHWNN

SEQ ID NO: 194075 - protein, 9 aa, Tick-borne encephalitis virus
EGAQHWNNA

SEQ ID NO: 194076 - protein, 9 aa, Tick-borne encephalitis virus
GAQHWNNAE

SEQ ID NO: 194077 - protein, 9 aa, Tick-borne encephalitis virus
AQHWNNAER

SEQ ID NO: 194078 - protein, 9 aa, Tick-borne encephalitis virus
QHWNNAERL

SEQ ID NO: 194079 - protein, 9 aa, Tick-borne encephalitis virus
HWNNAERLV

SEQ ID NO: 194080 - protein, 9 aa, Tick-borne encephalitis virus
VPVAHIDGA

SEQ ID NO: 194081 - protein, 9 aa, Tick-borne encephalitis virus
PVAHIDGAK

SEQ ID NO: 194082 - protein, 9 aa, Tick-borne encephalitis virus
VAHIDGAKY

SEQ ID NO: 194083 - protein, 9 aa, Tick-borne encephalitis virus
AHIDGAKYH

SEQ ID NO: 194084 - protein, 9 aa, Tick-borne encephalitis virus
HIDGAKYHL

SEQ ID NO: 194085 - protein, 9 aa, Tick-borne encephalitis virus
IDGAKYHLK

SEQ ID NO: 194086 - protein, 9 aa, Tick-borne encephalitis virus
DGAKYHLKS

SEQ ID NO: 194087 - protein, 9 aa, Tick-borne encephalitis virus
KMNGLTYTM

SEQ ID NO: 194088 - protein, 9 aa, Tick-borne encephalitis virus
MNGLTYTMC

SEQ ID NO: 194089 - protein, 9 aa, Tick-borne encephalitis virus
NGLTYTMCD

SEQ ID NO: 194090 - protein, 9 aa, Tick-borne encephalitis virus
TVCDKTKFT

SEQ ID NO: 194091 - protein, 9 aa, Tick-borne encephalitis virus
VCDKTKFTW

SEQ ID NO: 194092 - protein, 9 aa, Tick-borne encephalitis virus
CDKTKFTWR

SEQ ID NO: 194093 - protein, 9 aa, Tick-borne encephalitis virus
DKTKFTWRR

SEQ ID NO: 194094 - protein, 9 aa, Tick-borne encephalitis virus
KTKFAWKRT

SEQ ID NO: 194095 - protein, 9 aa, Tick-borne encephalitis virus
TKFAWKRTP

SEQ ID NO: 194096 - protein, 9 aa, Tick-borne encephalitis virus
KFAWKRTPT

SEQ ID NO: 194097 - protein, 9 aa, Tick-borne encephalitis virus
FAWKRTPTD

SEQ ID NO: 194098 - protein, 9 aa, Tick-borne encephalitis virus
AWKRTPTDS

SEQ ID NO: 194099 - protein, 9 aa, Tick-borne encephalitis virus
WKRTPTDSG

SEQ ID NO: 194100 - protein, 9 aa, Tick-borne encephalitis virus
KRTPTDSGH

SEQ ID NO: 194101 - protein, 9 aa, Tick-borne encephalitis virus
RTPTDSGHD

SEQ ID NO: 194102 - protein, 9 aa, Tick-borne encephalitis virus
APTDSGHDT

SEQ ID NO: 194103 - protein, 9 aa, Tick-borne encephalitis virus
HDTVVMEVS

SEQ ID NO: 194104 - protein, 9 aa, Tick-borne encephalitis virus
DTVVMEVSF

SEQ ID NO: 194105 - protein, 9 aa, Tick-borne encephalitis virus
TVVMEVSFS

SEQ ID NO: 194106 - protein, 9 aa, Tick-borne encephalitis virus
VVMEVSFSG

SEQ ID NO: 194107 - protein, 9 aa, Tick-borne encephalitis virus
VMEVSFSGT

SEQ ID NO: 194108 - protein, 9 aa, Tick-borne encephalitis virus
MEVSFSGTK

SEQ ID NO: 194109 - protein, 9 aa, Tick-borne encephalitis virus
EVSFSGTKP

SEQ ID NO: 194110 - protein, 9 aa, Tick-borne encephalitis virus
VSFSGTKPC

SEQ ID NO: 194111 - protein, 9 aa, Tick-borne encephalitis virus
SFSGTKPCR

SEQ ID NO: 194112 - protein, 9 aa, Tick-borne encephalitis virus
GRVFQKTRR

SEQ ID NO: 194113 - protein, 9 aa, Tick-borne encephalitis virus
RVFQKTRRG

SEQ ID NO: 194114 - protein, 9 aa, Tick-borne encephalitis virus
VFQKTRRGI

SEQ ID NO: 194115 - protein, 9 aa, Tick-borne encephalitis virus
FQKTRRGIE

SEQ ID NO: 194116 - protein, 9 aa, Tick-borne encephalitis virus
QKTRRGIER

SEQ ID NO: 194117 - protein, 9 aa, Tick-borne encephalitis virus
KTRRGIERL

SEQ ID NO: 194118 - protein, 9 aa, Tick-borne encephalitis virus
TRRGIERLT

SEQ ID NO: 194119 - protein, 9 aa, Tick-borne encephalitis virus
RRGIERLTV

SEQ ID NO: 194120 - protein, 9 aa, Tick-borne encephalitis virus
WDFGSTGGL

SEQ ID NO: 194121 - protein, 9 aa, Tick-borne encephalitis virus
DFGSTGGLL

SEQ ID NO: 194122 - protein, 9 aa, Tick-borne encephalitis virus
FGSTGGFLA

SEQ ID NO: 194123 - protein, 9 aa, Tick-borne encephalitis virus
GSTGGFLAS

SEQ ID NO: 194124 - protein, 9 aa, Tick-borne encephalitis virus
STGGFLASV

SEQ ID NO: 194125 - protein, 9 aa, Tick-borne encephalitis virus
TGGFLASVG

SEQ ID NO: 194126 - protein, 9 aa, Tick-borne encephalitis virus
GGFLASVGK

SEQ ID NO: 194127 - protein, 9 aa, Tick-borne encephalitis virus
GFLASVGKA

SEQ ID NO: 194128 - protein, 9 aa, Tick-borne encephalitis virus
FLASVGKAL

SEQ ID NO: 194129 - protein, 9 aa, Tick-borne encephalitis virus
LASVGKALH

SEQ ID NO: 194130 - protein, 9 aa, Tick-borne encephalitis virus
ASVGKALHT

SEQ ID NO: 194131 - protein, 9 aa, Tick-borne encephalitis virus
SIGKALHTV

SEQ ID NO: 194132 - protein, 9 aa, Tick-borne encephalitis virus
IGKALHTVL

SEQ ID NO: 194133 - protein, 9 aa, Tick-borne encephalitis virus
SLFGGVGFI

SEQ ID NO: 194134 - protein, 9 aa, Tick-borne encephalitis virus
LFGGVGFIP

SEQ ID NO: 194135 - protein, 9 aa, Tick-borne encephalitis virus
GGVGFIPKL

SEQ ID NO: 194136 - protein, 9 aa, Tick-borne encephalitis virus
GVGFIPKLL

SEQ ID NO: 194137 - protein, 9 aa, Tick-borne encephalitis virus
VGFLPKILM

SEQ ID NO: 194138 - protein, 9 aa, Tick-borne encephalitis virus
GFLPKILMG

SEQ ID NO: 194139 - protein, 9 aa, Tick-borne encephalitis virus
GMALAWLGL

SEQ ID NO: 194140 - protein, 9 aa, Tick-borne encephalitis virus
AALAWLGLN

SEQ ID NO: 194141 - protein, 9 aa, Tick-borne encephalitis virus
SMSFLLAGV

SEQ ID NO: 194142 - protein, 9 aa, Tick-borne encephalitis virus
MSFLLAGVL

SEQ ID NO: 194143 - protein, 9 aa, Tick-borne encephalitis virus
SFLLAGVLV

SEQ ID NO: 194144 - protein, 9 aa, Tick-borne encephalitis virus
ALASAIRET

SEQ ID NO: 194145 - protein, 9 aa, Tick-borne encephalitis virus
LASAIRETF

SEQ ID NO: 194146 - protein, 9 aa, Tick-borne encephalitis virus
ASAIKEAFE

SEQ ID NO: 194147 - protein, 9 aa, Tick-borne encephalitis virus
SAIKEAFEE

SEQ ID NO: 194148 - protein, 9 aa, Tick-borne encephalitis virus
AIRETFEEG

SEQ ID NO: 194149 - protein, 9 aa, Tick-borne encephalitis virus
IKETFEEGN

SEQ ID NO: 194150 - protein, 9 aa, Tick-borne encephalitis virus
KETFEEGNC

SEQ ID NO: 194151 - protein, 9 aa, Tick-borne encephalitis virus
ETFEEGNCG

SEQ ID NO: 194152 - protein, 9 aa, Tick-borne encephalitis virus
TFEEGNCGI

SEQ ID NO: 194153 - protein, 9 aa, Tick-borne encephalitis virus
FEEGNCGIV

SEQ ID NO: 194154 - protein, 9 aa, Tick-borne encephalitis virus
EEGNCGIVP

SEQ ID NO: 194155 - protein, 9 aa, Tick-borne encephalitis virus
EGNCGIVPQ

SEQ ID NO: 194156 - protein, 9 aa, Tick-borne encephalitis virus
GNCGIVPQN

SEQ ID NO: 194157 - protein, 9 aa, Tick-borne encephalitis virus
NCGIVPQNR

SEQ ID NO: 194158 - protein, 9 aa, Tick-borne encephalitis virus
CGILPQNRL

SEQ ID NO: 194159 - protein, 9 aa, Tick-borne encephalitis virus
GILPQNRLE

SEQ ID NO: 194160 - protein, 9 aa, Tick-borne encephalitis virus
ILPQNRLEM

SEQ ID NO: 194161 - protein, 9 aa, Tick-borne encephalitis virus
EMAMWRSAV

SEQ ID NO: 194162 - protein, 9 aa, Tick-borne encephalitis virus
MAMWRSAVT

SEQ ID NO: 194163 - protein, 9 aa, Tick-borne encephalitis virus
AMWRSAVTE

SEQ ID NO: 194164 - protein, 9 aa, Tick-borne encephalitis virus
MWRSAVTEL

SEQ ID NO: 194165 - protein, 9 aa, Tick-borne encephalitis virus
WRSAVTELN

SEQ ID NO: 194166 - protein, 9 aa, Tick-borne encephalitis virus
RSAVTELNL

SEQ ID NO: 194167 - protein, 9 aa, Tick-borne encephalitis virus
SAVTELNLA

SEQ ID NO: 194168 - protein, 9 aa, Tick-borne encephalitis virus
AVTELNLAL

SEQ ID NO: 194169 - protein, 9 aa, Tick-borne encephalitis virus
STELNLALA

SEQ ID NO: 194170 - protein, 9 aa, Tick-borne encephalitis virus
EGEANLTVM

SEQ ID NO: 194171 - protein, 9 aa, Tick-borne encephalitis virus
GEANLTVMV

SEQ ID NO: 194172 - protein, 9 aa, Tick-borne encephalitis virus
EANLTVMVD

SEQ ID NO: 194173 - protein, 9 aa, Tick-borne encephalitis virus
NLTVMVDKF

SEQ ID NO: 194174 - protein, 9 aa, Tick-borne encephalitis virus
LTVMVDKFD

SEQ ID NO: 194175 - protein, 9 aa, Tick-borne encephalitis virus
TVMVDKFDP

SEQ ID NO: 194176 - protein, 9 aa, Tick-borne encephalitis virus
VMVDKFDPT

SEQ ID NO: 194177 - protein, 9 aa, Tick-borne encephalitis virus
MVDKFDPTD

SEQ ID NO: 194178 - protein, 9 aa, Tick-borne encephalitis virus
PTDYRGGVS

SEQ ID NO: 194179 - protein, 9 aa, Tick-borne encephalitis virus
TDYRGGVSG

SEQ ID NO: 194180 - protein, 9 aa, Tick-borne encephalitis virus
DYRGGVSGL

SEQ ID NO: 194181 - protein, 9 aa, Tick-borne encephalitis virus
YRGGVSGLL

SEQ ID NO: 194182 - protein, 9 aa, Tick-borne encephalitis virus
RGGVSGLLR

SEQ ID NO: 194183 - protein, 9 aa, Tick-borne encephalitis virus
GGIPGLLRK

SEQ ID NO: 194184 - protein, 9 aa, Tick-borne encephalitis virus
GIPGLLRKG

SEQ ID NO: 194185 - protein, 9 aa, Tick-borne encephalitis virus
VSGLLRKGK

SEQ ID NO: 194186 - protein, 9 aa, Tick-borne encephalitis virus
PGLLRKGKD

SEQ ID NO: 194187 - protein, 9 aa, Tick-borne encephalitis virus
LLKKGKDIR

SEQ ID NO: 194188 - protein, 9 aa, Tick-borne encephalitis virus
LKKGKDIRV

SEQ ID NO: 194189 - protein, 9 aa, Tick-borne encephalitis virus
KKGKDIRVS

SEQ ID NO: 194190 - protein, 9 aa, Tick-borne encephalitis virus
GKDIKVSWR

SEQ ID NO: 194191 - protein, 9 aa, Tick-borne encephalitis virus
KDIKVSWRS

SEQ ID NO: 194192 - protein, 9 aa, Tick-borne encephalitis virus
DIRVSWKSW

SEQ ID NO: 194193 - protein, 9 aa, Tick-borne encephalitis virus
IKVSWRSWG

SEQ ID NO: 194194 - protein, 9 aa, Tick-borne encephalitis virus
KVSWRSWGH

SEQ ID NO: 194195 - protein, 9 aa, Tick-borne encephalitis virus
VSWKSWGQA

SEQ ID NO: 194196 - protein, 9 aa, Tick-borne encephalitis virus
SWGQSVIWS

SEQ ID NO: 194197 - protein, 9 aa, Tick-borne encephalitis virus
AMIWSIPEA

SEQ ID NO: 194198 - protein, 9 aa, Tick-borne encephalitis virus
MIWSIPEAS

SEQ ID NO: 194199 - protein, 9 aa, Tick-borne encephalitis virus
IWSIPEASR

SEQ ID NO: 194200 - protein, 9 aa, Tick-borne encephalitis virus
WSIPEASRR

SEQ ID NO: 194201 - protein, 9 aa, Tick-borne encephalitis virus
SIPEASRRF

SEQ ID NO: 194202 - protein, 9 aa, Tick-borne encephalitis virus
IPEASRRFM

SEQ ID NO: 194203 - protein, 9 aa, Tick-borne encephalitis virus
ASRRFMVGT

SEQ ID NO: 194204 - protein, 9 aa, Tick-borne encephalitis virus
SRRFMVGTE

SEQ ID NO: 194205 - protein, 9 aa, Tick-borne encephalitis virus
RFMVGTEGQ

SEQ ID NO: 194206 - protein, 9 aa, Tick-borne encephalitis virus
SECPPERRK

SEQ ID NO: 194207 - protein, 9 aa, Tick-borne encephalitis virus
PLERRKTGI

SEQ ID NO: 194208 - protein, 9 aa, Tick-borne encephalitis virus
PERRKTGVF

SEQ ID NO: 194209 - protein, 9 aa, Tick-borne encephalitis virus
VFVDFRQES

SEQ ID NO: 194210 - protein, 9 aa, Tick-borne encephalitis virus
FVDFRQEST

SEQ ID NO: 194211 - protein, 9 aa, Tick-borne encephalitis virus
VDFRQESTH

SEQ ID NO: 194212 - protein, 9 aa, Tick-borne encephalitis virus
DFRQEATHE

SEQ ID NO: 194213 - protein, 9 aa, Tick-borne encephalitis virus
FRQEATHEC

SEQ ID NO: 194214 - protein, 9 aa, Tick-borne encephalitis virus
RQEATHECD

SEQ ID NO: 194215 - protein, 9 aa, Tick-borne encephalitis virus
QEATHECDT

SEQ ID NO: 194216 - protein, 9 aa, Tick-borne encephalitis virus
EATHECDTG

SEQ ID NO: 194217 - protein, 9 aa, Tick-borne encephalitis virus
ATHECDTGV

SEQ ID NO: 194218 - protein, 9 aa, Tick-borne encephalitis virus
DQSLWMKSM

SEQ ID NO: 194219 - protein, 9 aa, Tick-borne encephalitis virus
QSLWMKSVK

SEQ ID NO: 194220 - protein, 9 aa, Tick-borne encephalitis virus
SLWMKSVKN

SEQ ID NO: 194221 - protein, 9 aa, Tick-borne encephalitis virus
LWMKSVKND

SEQ ID NO: 194222 - protein, 9 aa, Tick-borne encephalitis virus
WMKSVKNDT

SEQ ID NO: 194223 - protein, 9 aa, Tick-borne encephalitis virus
MKSVKNDTG

SEQ ID NO: 194224 - protein, 9 aa, Tick-borne encephalitis virus
KSVKNDTGT

SEQ ID NO: 194225 - protein, 9 aa, Tick-borne encephalitis virus
SVKNDTGTY

SEQ ID NO: 194226 - protein, 9 aa, Tick-borne encephalitis virus
VKNDTGTYI

SEQ ID NO: 194227 - protein, 9 aa, Tick-borne encephalitis virus
RNETGTYIV

SEQ ID NO: 194228 - protein, 9 aa, Tick-borne encephalitis virus
ASHTIDNPE

SEQ ID NO: 194229 - protein, 9 aa, Tick-borne encephalitis virus
SHTIDNPEV

SEQ ID NO: 194230 - protein, 9 aa, Tick-borne encephalitis virus
HTIDNPEVV

SEQ ID NO: 194231 - protein, 9 aa, Tick-borne encephalitis virus
TIDNPEVVD

SEQ ID NO: 194232 - protein, 9 aa, Tick-borne encephalitis virus
IDNPEVVDS

SEQ ID NO: 194233 - protein, 9 aa, Tick-borne encephalitis virus
DNPEVVDSE

SEQ ID NO: 194234 - protein, 9 aa, Tick-borne encephalitis virus
NADVVDSES

SEQ ID NO: 194235 - protein, 9 aa, Tick-borne encephalitis virus
ADVVDSESF

SEQ ID NO: 194236 - protein, 9 aa, Tick-borne encephalitis virus
DVVDSESFL

SEQ ID NO: 194237 - protein, 9 aa, Tick-borne encephalitis virus
QVKGPWKYT

SEQ ID NO: 194238 - protein, 9 aa, Tick-borne encephalitis virus
VKGPWKYTP

SEQ ID NO: 194239 - protein, 9 aa, Tick-borne encephalitis virus
KGPWKYTPI

SEQ ID NO: 194240 - protein, 9 aa, Tick-borne encephalitis virus
GPWKYTPIR

SEQ ID NO: 194241 - protein, 9 aa, Tick-borne encephalitis virus
PWKYTPIRV

SEQ ID NO: 194242 - protein, 9 aa, Tick-borne encephalitis virus
PIRVVRGEC

SEQ ID NO: 194243 - protein, 9 aa, Tick-borne encephalitis virus
IRVVRGECP

SEQ ID NO: 194244 - protein, 9 aa, Tick-borne encephalitis virus
RVVRGECPG

SEQ ID NO: 194245 - protein, 9 aa, Tick-borne encephalitis virus
VVRGECPGT

SEQ ID NO: 194246 - protein, 9 aa, Tick-borne encephalitis virus
TREECPGTK

SEQ ID NO: 194247 - protein, 9 aa, Tick-borne encephalitis virus
REECPGTKV

SEQ ID NO: 194248 - protein, 9 aa, Tick-borne encephalitis virus
ECPGTTVTI

SEQ ID NO: 194249 - protein, 9 aa, Tick-borne encephalitis virus
ISADCDKRG

SEQ ID NO: 194250 - protein, 9 aa, Tick-borne encephalitis virus
SADCDKRGA

SEQ ID NO: 194251 - protein, 9 aa, Tick-borne encephalitis virus
ADCDRRGAS

SEQ ID NO: 194252 - protein, 9 aa, Tick-borne encephalitis virus
DCDRRGASV

SEQ ID NO: 194253 - protein, 9 aa, Tick-borne encephalitis virus
TCTLPPVTI

SEQ ID NO: 194254 - protein, 9 aa, Tick-borne encephalitis virus
CTLPPVTIR

SEQ ID NO: 194255 - protein, 9 aa, Tick-borne encephalitis virus
TLPPVTIRT

SEQ ID NO: 194256 - protein, 9 aa, Tick-borne encephalitis virus
LPPVTIRTG

SEQ ID NO: 194257 - protein, 9 aa, Tick-borne encephalitis virus
DQGGLVRST

SEQ ID NO: 194258 - protein, 9 aa, Tick-borne encephalitis virus
QGGLIRSMV

SEQ ID NO: 194259 - protein, 9 aa, Tick-borne encephalitis virus
GGLVRSTVV

SEQ ID NO: 194260 - protein, 9 aa, Tick-borne encephalitis virus
GLVRSTVVA

SEQ ID NO: 194261 - protein, 9 aa, Tick-borne encephalitis virus
LIRSMVVAD

SEQ ID NO: 194262 - protein, 9 aa, Tick-borne encephalitis virus
VRSTVVADN

SEQ ID NO: 194263 - protein, 9 aa, Tick-borne encephalitis virus
IRRRPSTGS

SEQ ID NO: 194264 - protein, 9 aa, Tick-borne encephalitis virus
RRRPATGTA

SEQ ID NO: 194265 - protein, 9 aa, Tick-borne encephalitis virus
RRPATGTAV

SEQ ID NO: 194266 - protein, 9 aa, Tick-borne encephalitis virus
RPATGTAVV

SEQ ID NO: 194267 - protein, 9 aa, Tick-borne encephalitis virus
PATGTAVVW

SEQ ID NO: 194268 - protein, 9 aa, Tick-borne encephalitis virus
ATGTAVVWG

SEQ ID NO: 194269 - protein, 9 aa, Tick-borne encephalitis virus
TGTAVVWGG

SEQ ID NO: 194270 - protein, 9 aa, Tick-borne encephalitis virus
WGGFVVLAL

SEQ ID NO: 194271 - protein, 9 aa, Tick-borne encephalitis virus
GGFVVLALL

SEQ ID NO: 194272 - protein, 9 aa, Tick-borne encephalitis virus
GFVVLALLV

SEQ ID NO: 194273 - protein, 9 aa, Tick-borne encephalitis virus
FVVLALLVT

SEQ ID NO: 194274 - protein, 9 aa, Tick-borne encephalitis virus
IVLALLVTG

SEQ ID NO: 194275 - protein, 9 aa, Tick-borne encephalitis virus
VFALLVTGL

SEQ ID NO: 194276 - protein, 9 aa, Tick-borne encephalitis virus
FALLVTGLV

SEQ ID NO: 194277 - protein, 9 aa, Tick-borne encephalitis virus
ALLVTGLVK

SEQ ID NO: 194278 - protein, 9 aa, Tick-borne encephalitis virus
VRMESLVRY

SEQ ID NO: 194279 - protein, 9 aa, Tick-borne encephalitis virus
RMESLVRYV

SEQ ID NO: 194280 - protein, 9 aa, Tick-borne encephalitis virus
MESLVRYVV

SEQ ID NO: 194281 - protein, 9 aa, Tick-borne encephalitis virus
VAVGIAFHL

SEQ ID NO: 194282 - protein, 9 aa, Tick-borne encephalitis virus
AVGIAFHLE

SEQ ID NO: 194283 - protein, 9 aa, Tick-borne encephalitis virus
VGIAFHLEL

SEQ ID NO: 194284 - protein, 9 aa, Tick-borne encephalitis virus
GIAFHLELG

SEQ ID NO: 194285 - protein, 9 aa, Tick-borne encephalitis virus
IAFHLELGP

SEQ ID NO: 194286 - protein, 9 aa, Tick-borne encephalitis virus
TFHFELGPE

SEQ ID NO: 194287 - protein, 9 aa, Tick-borne encephalitis virus
LSAFALRRG

SEQ ID NO: 194288 - protein, 9 aa, Tick-borne encephalitis virus
SAFALRRGL

SEQ ID NO: 194289 - protein, 9 aa, Tick-borne encephalitis virus
AFALRRGLT

SEQ ID NO: 194290 - protein, 9 aa, Tick-borne encephalitis virus
FALRRGLTV

SEQ ID NO: 194291 - protein, 9 aa, Tick-borne encephalitis virus
ALRRGLTVR

SEQ ID NO: 194292 - protein, 9 aa, Tick-borne encephalitis virus
LRRGLTVRE

SEQ ID NO: 194293 - protein, 9 aa, Tick-borne encephalitis virus
RRGLTVREM

SEQ ID NO: 194294 - protein, 9 aa, Tick-borne encephalitis virus
RGLTVREMV

SEQ ID NO: 194295 - protein, 9 aa, Tick-borne encephalitis virus
GLTVREMVT

SEQ ID NO: 194296 - protein, 9 aa, Tick-borne encephalitis virus
LTVREMVIT

SEQ ID NO: 194297 - protein, 9 aa, Tick-borne encephalitis virus
TVREMVITY

SEQ ID NO: 194298 - protein, 9 aa, Tick-borne encephalitis virus
VREMVITYF

SEQ ID NO: 194299 - protein, 9 aa, Tick-borne encephalitis virus
REMVITYFL

SEQ ID NO: 194300 - protein, 9 aa, Tick-borne encephalitis virus
EMVITYFLL

SEQ ID NO: 194301 - protein, 9 aa, Tick-borne encephalitis virus
MVITYFLLL

SEQ ID NO: 194302 - protein, 9 aa, Tick-borne encephalitis virus
VITYFLLLV

SEQ ID NO: 194303 - protein, 9 aa, Tick-borne encephalitis virus
ITYFLLLVL

SEQ ID NO: 194304 - protein, 9 aa, Tick-borne encephalitis virus
LVLELGLPY

SEQ ID NO: 194305 - protein, 9 aa, Tick-borne encephalitis virus
LWRWGDALA

SEQ ID NO: 194306 - protein, 9 aa, Tick-borne encephalitis virus
ILRACTAEG

SEQ ID NO: 194307 - protein, 9 aa, Tick-borne encephalitis virus
LRACTAEGK

SEQ ID NO: 194308 - protein, 9 aa, Tick-borne encephalitis virus
RACTAEGKA

SEQ ID NO: 194309 - protein, 9 aa, Tick-borne encephalitis virus
ACTAEGKAG

SEQ ID NO: 194310 - protein, 9 aa, Tick-borne encephalitis virus
CTAEGKTGV

SEQ ID NO: 194311 - protein, 9 aa, Tick-borne encephalitis virus
TAEGKAGVG

SEQ ID NO: 194312 - protein, 9 aa, Tick-borne encephalitis virus
AEGKAGVGL

SEQ ID NO: 194313 - protein, 9 aa, Tick-borne encephalitis virus
EGKAGVGLL

SEQ ID NO: 194314 - protein, 9 aa, Tick-borne encephalitis virus
GKAGVGLLL

SEQ ID NO: 194315 - protein, 9 aa, Tick-borne encephalitis virus
KAGVGLLLM

SEQ ID NO: 194316 - protein, 9 aa, Tick-borne encephalitis virus
AGVGLLLMA

SEQ ID NO: 194317 - protein, 9 aa, Tick-borne encephalitis virus
GVGLLLMPL

SEQ ID NO: 194318 - protein, 9 aa, Tick-borne encephalitis virus
VGLLLMALI

SEQ ID NO: 194319 - protein, 9 aa, Tick-borne encephalitis virus
GLLLMPLLT

SEQ ID NO: 194320 - protein, 9 aa, Tick-borne encephalitis virus
LLLMALITQ

SEQ ID NO: 194321 - protein, 9 aa, Tick-borne encephalitis virus
LLMALITQQ

SEQ ID NO: 194322 - protein, 9 aa, Tick-borne encephalitis virus
LMALITQQD

SEQ ID NO: 194323 - protein, 9 aa, Tick-borne encephalitis virus
VHYGLIIFL

SEQ ID NO: 194324 - protein, 9 aa, Tick-borne encephalitis virus
HYGLIIFLG

SEQ ID NO: 194325 - protein, 9 aa, Tick-borne encephalitis virus
WRLLKGHRE

SEQ ID NO: 194326 - protein, 9 aa, Tick-borne encephalitis virus
RLLKGHREQ

SEQ ID NO: 194327 - protein, 9 aa, Tick-borne encephalitis virus
LLRGHREQK

SEQ ID NO: 194328 - protein, 9 aa, Tick-borne encephalitis virus
LRGHREQKG

SEQ ID NO: 194329 - protein, 9 aa, Tick-borne encephalitis virus
EGHREQKGL

SEQ ID NO: 194330 - protein, 9 aa, Tick-borne encephalitis virus
REQKGLSWI

SEQ ID NO: 194331 - protein, 9 aa, Tick-borne encephalitis virus
EQKGLTWVV

SEQ ID NO: 194332 - protein, 9 aa, Tick-borne encephalitis virus
QKGLSWIVP

SEQ ID NO: 194333 - protein, 9 aa, Tick-borne encephalitis virus
KGLSWIVPL

SEQ ID NO: 194334 - protein, 9 aa, Tick-borne encephalitis virus
GLSWIVPLA

SEQ ID NO: 194335 - protein, 9 aa, Tick-borne encephalitis virus
VPLAGLMGG

SEQ ID NO: 194336 - protein, 9 aa, Tick-borne encephalitis virus
PLAGLMGGE

SEQ ID NO: 194337 - protein, 9 aa, Tick-borne encephalitis virus
LAGLMGGEG

SEQ ID NO: 194338 - protein, 9 aa, Tick-borne encephalitis virus
AGLMGGEGS

SEQ ID NO: 194339 - protein, 9 aa, Tick-borne encephalitis virus
GLMGGEGSG

SEQ ID NO: 194340 - protein, 9 aa, Tick-borne encephalitis virus
LMGGEGSGI

SEQ ID NO: 194341 - protein, 9 aa, Tick-borne encephalitis virus
MGGEGSGIR

SEQ ID NO: 194342 - protein, 9 aa, Tick-borne encephalitis virus
EGSGIRLLS

SEQ ID NO: 194343 - protein, 9 aa, Tick-borne encephalitis virus
GSGIRLLSF

SEQ ID NO: 194344 - protein, 9 aa, Tick-borne encephalitis virus
SGIRLLSFW

SEQ ID NO: 194345 - protein, 9 aa, Tick-borne encephalitis virus
GIRLLSFWE

SEQ ID NO: 194346 - protein, 9 aa, Tick-borne encephalitis virus
IRLLSFWEL

SEQ ID NO: 194347 - protein, 9 aa, Tick-borne encephalitis virus
RLLSFWELS

SEQ ID NO: 194348 - protein, 9 aa, Tick-borne encephalitis virus
HGKRRSFSE

SEQ ID NO: 194349 - protein, 9 aa, Tick-borne encephalitis virus
GKRRSFSEP

SEQ ID NO: 194350 - protein, 9 aa, Tick-borne encephalitis virus
KRRSFSEPL

SEQ ID NO: 194351 - protein, 9 aa, Tick-borne encephalitis virus
ASGMMRHTP

SEQ ID NO: 194352 - protein, 9 aa, Tick-borne encephalitis virus
SGMMRHTPQ

SEQ ID NO: 194353 - protein, 9 aa, Tick-borne encephalitis virus
CVEWYPELV

SEQ ID NO: 194354 - protein, 9 aa, Tick-borne encephalitis virus
VEWYPELVN

SEQ ID NO: 194355 - protein, 9 aa, Tick-borne encephalitis virus
EWYPELVNE

SEQ ID NO: 194356 - protein, 9 aa, Tick-borne encephalitis virus
WYPELVNEG

SEQ ID NO: 194357 - protein, 9 aa, Tick-borne encephalitis virus
YPELVNEGG

SEQ ID NO: 194358 - protein, 9 aa, Tick-borne encephalitis virus
ERMMAFWLI

SEQ ID NO: 194359 - protein, 9 aa, Tick-borne encephalitis virus
RMMAFWLIA

SEQ ID NO: 194360 - protein, 9 aa, Tick-borne encephalitis virus
MMAFWLIAG

SEQ ID NO: 194361 - protein, 9 aa, Tick-borne encephalitis virus
AFWLLAGLS

SEQ ID NO: 194362 - protein, 9 aa, Tick-borne encephalitis virus
FWLLAGLSA

SEQ ID NO: 194363 - protein, 9 aa, Tick-borne encephalitis virus
WLLAGLSAS

SEQ ID NO: 194364 - protein, 9 aa, Tick-borne encephalitis virus
LLAGLSASA

SEQ ID NO: 194365 - protein, 9 aa, Tick-borne encephalitis virus
AGLAASAVH

SEQ ID NO: 194366 - protein, 9 aa, Tick-borne encephalitis virus
GLAASAVHW

SEQ ID NO: 194367 - protein, 9 aa, Tick-borne encephalitis virus
LAASAVHWS

SEQ ID NO: 194368 - protein, 9 aa, Tick-borne encephalitis virus
AASAVHWSG

SEQ ID NO: 194369 - protein, 9 aa, Tick-borne encephalitis virus
ASAVHWSGI

SEQ ID NO: 194370 - protein, 9 aa, Tick-borne encephalitis virus
SAIHWSGIL

SEQ ID NO: 194371 - protein, 9 aa, Tick-borne encephalitis virus
AVHWSGILG

SEQ ID NO: 194372 - protein, 9 aa, Tick-borne encephalitis virus
IHWSGILGV

SEQ ID NO: 194373 - protein, 9 aa, Tick-borne encephalitis virus
VMGLWTLTK

SEQ ID NO: 194374 - protein, 9 aa, Tick-borne encephalitis virus
MGLWTLTKM

SEQ ID NO: 194375 - protein, 9 aa, Tick-borne encephalitis virus
GLWTLSEMM

SEQ ID NO: 194376 - protein, 9 aa, Tick-borne encephalitis virus
LWTLSEMMR

SEQ ID NO: 194377 - protein, 9 aa, Tick-borne encephalitis virus
ARRSGLVFS

SEQ ID NO: 194378 - protein, 9 aa, Tick-borne encephalitis virus
RRSDLAFSG

SEQ ID NO: 194379 - protein, 9 aa, Tick-borne encephalitis virus
RSGLVFSGQ

SEQ ID NO: 194380 - protein, 9 aa, Tick-borne encephalitis virus
SDLAFSGQG

SEQ ID NO: 194381 - protein, 9 aa, Tick-borne encephalitis virus
GLVFSGQGG

SEQ ID NO: 194382 - protein, 9 aa, Tick-borne encephalitis virus
LVFSGQGRG

SEQ ID NO: 194383 - protein, 9 aa, Tick-borne encephalitis virus
VFSGQGNRE

SEQ ID NO: 194384 - protein, 9 aa, Tick-borne encephalitis virus
FSGQGRGER

SEQ ID NO: 194385 - protein, 9 aa, Tick-borne encephalitis virus
SGQGRGERG

SEQ ID NO: 194386 - protein, 9 aa, Tick-borne encephalitis virus
GQGRGERGD

SEQ ID NO: 194387 - protein, 9 aa, Tick-borne encephalitis virus
QGNRERGDR

SEQ ID NO: 194388 - protein, 9 aa, Tick-borne encephalitis virus
GRGERGDKP

SEQ ID NO: 194389 - protein, 9 aa, Tick-borne encephalitis virus
RGERGDKPF

SEQ ID NO: 194390 - protein, 9 aa, Tick-borne encephalitis virus
GERGDKPFE

SEQ ID NO: 194391 - protein, 9 aa, Tick-borne encephalitis virus
RGDRPFEVR

SEQ ID NO: 194392 - protein, 9 aa, Tick-borne encephalitis virus
GDRPFEVRD

SEQ ID NO: 194393 - protein, 9 aa, Tick-borne encephalitis virus
DRPFEVRDG

SEQ ID NO: 194394 - protein, 9 aa, Tick-borne encephalitis virus
RPFEVRDGV

SEQ ID NO: 194395 - protein, 9 aa, Tick-borne encephalitis virus
SPGLFWGQR

SEQ ID NO: 194396 - protein, 9 aa, Tick-borne encephalitis virus
PGLFWGQRQ

SEQ ID NO: 194397 - protein, 9 aa, Tick-borne encephalitis virus
GLFWGQSQV

SEQ ID NO: 194398 - protein, 9 aa, Tick-borne encephalitis virus
LFWGQSQVG

SEQ ID NO: 194399 - protein, 9 aa, Tick-borne encephalitis virus
FWGQRQVGV

SEQ ID NO: 194400 - protein, 9 aa, Tick-borne encephalitis virus
WGQSQVGVG

SEQ ID NO: 194401 - protein, 9 aa, Tick-borne encephalitis virus
GQSQVGVGY

SEQ ID NO: 194402 - protein, 9 aa, Tick-borne encephalitis virus
QSQVGVGYG

SEQ ID NO: 194403 - protein, 9 aa, Tick-borne encephalitis virus
NQVGVGYGS

SEQ ID NO: 194404 - protein, 9 aa, Tick-borne encephalitis virus
QVGVGYGFR

SEQ ID NO: 194405 - protein, 9 aa, Tick-borne encephalitis virus
VGVGYGFRG

SEQ ID NO: 194406 - protein, 9 aa, Tick-borne encephalitis virus
GVGYGFRGV

SEQ ID NO: 194407 - protein, 9 aa, Tick-borne encephalitis virus
VGYGFRGVL

SEQ ID NO: 194408 - protein, 9 aa, Tick-borne encephalitis virus
GYGFRGVLH

SEQ ID NO: 194409 - protein, 9 aa, Tick-borne encephalitis virus
YGFRGVLHT

SEQ ID NO: 194410 - protein, 9 aa, Tick-borne encephalitis virus
GFRGVLHTM

SEQ ID NO: 194411 - protein, 9 aa, Tick-borne encephalitis virus
FRGVLHTMW

SEQ ID NO: 194412 - protein, 9 aa, Tick-borne encephalitis virus
VTRGAALSV

SEQ ID NO: 194413 - protein, 9 aa, Tick-borne encephalitis virus
TRGAALSVD

SEQ ID NO: 194414 - protein, 9 aa, Tick-borne encephalitis virus
RGAALSVDD

SEQ ID NO: 194415 - protein, 9 aa, Tick-borne encephalitis virus
GAALYIDDA

SEQ ID NO: 194416 - protein, 9 aa, Tick-borne encephalitis virus
AALSVDDAV

SEQ ID NO: 194417 - protein, 9 aa, Tick-borne encephalitis virus
ALSIDDAVV

SEQ ID NO: 194418 - protein, 9 aa, Tick-borne encephalitis virus
LSVDDAVVG

SEQ ID NO: 194419 - protein, 9 aa, Tick-borne encephalitis virus
YIDDAVAGP

SEQ ID NO: 194420 - protein, 9 aa, Tick-borne encephalitis virus
VDDAVVGPY

SEQ ID NO: 194421 - protein, 9 aa, Tick-borne encephalitis virus
DDAVVGPYW

SEQ ID NO: 194422 - protein, 9 aa, Tick-borne encephalitis virus
DAVAGPYWS

SEQ ID NO: 194423 - protein, 9 aa, Tick-borne encephalitis virus
AVAGPYWSD

SEQ ID NO: 194424 - protein, 9 aa, Tick-borne encephalitis virus
VAGPYWAEV

SEQ ID NO: 194425 - protein, 9 aa, Tick-borne encephalitis virus
VGPYWADVK

SEQ ID NO: 194426 - protein, 9 aa, Tick-borne encephalitis virus
GPYWAEVKE

SEQ ID NO: 194427 - protein, 9 aa, Tick-borne encephalitis virus
PYWSDVRED

SEQ ID NO: 194428 - protein, 9 aa, Tick-borne encephalitis virus
YWSDVREDV

SEQ ID NO: 194429 - protein, 9 aa, Tick-borne encephalitis virus
WSDVREDVV

SEQ ID NO: 194430 - protein, 9 aa, Tick-borne encephalitis virus
SDVREDVVC

SEQ ID NO: 194431 - protein, 9 aa, Tick-borne encephalitis virus
EVKEDVVCY

SEQ ID NO: 194432 - protein, 9 aa, Tick-borne encephalitis virus
TWSLEEKWK

SEQ ID NO: 194433 - protein, 9 aa, Tick-borne encephalitis virus
GELLLDTGG

SEQ ID NO: 194434 - protein, 9 aa, Tick-borne encephalitis virus
ELLLDTGGR

SEQ ID NO: 194435 - protein, 9 aa, Tick-borne encephalitis virus
GAIPIDLAK

SEQ ID NO: 194436 - protein, 9 aa, Tick-borne encephalitis virus
AIPIDLAKG

SEQ ID NO: 194437 - protein, 9 aa, Tick-borne encephalitis virus
IPIDLAKGT

SEQ ID NO: 194438 - protein, 9 aa, Tick-borne encephalitis virus
LIDLSKGTS

SEQ ID NO: 194439 - protein, 9 aa, Tick-borne encephalitis virus
IDLSKGTSR

SEQ ID NO: 194440 - protein, 9 aa, Tick-borne encephalitis virus
DLSKGTSRS

SEQ ID NO: 194441 - protein, 9 aa, Tick-borne encephalitis virus
LSKGTSRSP

SEQ ID NO: 194442 - protein, 9 aa, Tick-borne encephalitis virus
SKGTSRSPI

SEQ ID NO: 194443 - protein, 9 aa, Tick-borne encephalitis virus
KGTSGSPII

SEQ ID NO: 194444 - protein, 9 aa, Tick-borne encephalitis virus
GTSRSPILN

SEQ ID NO: 194445 - protein, 9 aa, Tick-borne encephalitis virus
TSGSPIINS

SEQ ID NO: 194446 - protein, 9 aa, Tick-borne encephalitis virus
SGSPTLNSQ

SEQ ID NO: 194447 - protein, 9 aa, Tick-borne encephalitis virus
GSPTLNSQG

SEQ ID NO: 194448 - protein, 9 aa, Tick-borne encephalitis virus
SPILNAQGA

SEQ ID NO: 194449 - protein, 9 aa, Tick-borne encephalitis virus
PILNAQGAV

SEQ ID NO: 194450 - protein, 9 aa, Tick-borne encephalitis virus
ILNAQGAVV

SEQ ID NO: 194451 - protein, 9 aa, Tick-borne encephalitis virus
LNAQGAVVG

SEQ ID NO: 194452 - protein, 9 aa, Tick-borne encephalitis virus
NAQGAVVGL

SEQ ID NO: 194453 - protein, 9 aa, Tick-borne encephalitis virus
AQGAVVGLY

SEQ ID NO: 194454 - protein, 9 aa, Tick-borne encephalitis virus
SIAQGEAER

SEQ ID NO: 194455 - protein, 9 aa, Tick-borne encephalitis virus
IAQGEAERS

SEQ ID NO: 194456 - protein, 9 aa, Tick-borne encephalitis virus
AQGEAERSR

SEQ ID NO: 194457 - protein, 9 aa, Tick-borne encephalitis virus
QGEAERSRP

SEQ ID NO: 194458 - protein, 9 aa, Tick-borne encephalitis virus
GEAEKSRPS

SEQ ID NO: 194459 - protein, 9 aa, Tick-borne encephalitis virus
EAERSRPNL

SEQ ID NO: 194460 - protein, 9 aa, Tick-borne encephalitis virus
AERSRPNLP

SEQ ID NO: 194461 - protein, 9 aa, Tick-borne encephalitis virus
EKSRPSLPP

SEQ ID NO: 194462 - protein, 9 aa, Tick-borne encephalitis virus
RSRPNLPQA

SEQ ID NO: 194463 - protein, 9 aa, Tick-borne encephalitis virus
SRPSLPPAV

SEQ ID NO: 194464 - protein, 9 aa, Tick-borne encephalitis virus
GMGWTAKGQ

SEQ ID NO: 194465 - protein, 9 aa, Tick-borne encephalitis virus
MGWTAKGQI

SEQ ID NO: 194466 - protein, 9 aa, Tick-borne encephalitis virus
LKEMERALT

SEQ ID NO: 194467 - protein, 9 aa, Tick-borne encephalitis virus
KEMERALTG

SEQ ID NO: 194468 - protein, 9 aa, Tick-borne encephalitis virus
EMERALTGK

SEQ ID NO: 194469 - protein, 9 aa, Tick-borne encephalitis virus
MERALTGKR

SEQ ID NO: 194470 - protein, 9 aa, Tick-borne encephalitis virus
ERALTGKRV

SEQ ID NO: 194471 - protein, 9 aa, Tick-borne encephalitis virus
RALTGKRVR

SEQ ID NO: 194472 - protein, 9 aa, Tick-borne encephalitis virus
ALTGKRVRF

SEQ ID NO: 194473 - protein, 9 aa, Tick-borne encephalitis virus
LTGKRVRFL

SEQ ID NO: 194474 - protein, 9 aa, Tick-borne encephalitis virus
TGKRVRFLS

SEQ ID NO: 194475 - protein, 9 aa, Tick-borne encephalitis virus
KRVRFHSPV

SEQ ID NO: 194476 - protein, 9 aa, Tick-borne encephalitis virus
RVRFHSPVV

SEQ ID NO: 194477 - protein, 9 aa, Tick-borne encephalitis virus
VRFLSPAVS

SEQ ID NO: 194478 - protein, 9 aa, Tick-borne encephalitis virus
RFLSPAVSD

SEQ ID NO: 194479 - protein, 9 aa, Tick-borne encephalitis virus
FHSPVVGDQ

SEQ ID NO: 194480 - protein, 9 aa, Tick-borne encephalitis virus
HSPAVGDHQ

SEQ ID NO: 194481 - protein, 9 aa, Tick-borne encephalitis virus
DQQVGGSIV

SEQ ID NO: 194482 - protein, 9 aa, Tick-borne encephalitis virus
QQVGGSIVD

SEQ ID NO: 194483 - protein, 9 aa, Tick-borne encephalitis virus
GGAIVDLMC

SEQ ID NO: 194484 - protein, 9 aa, Tick-borne encephalitis virus
GAIVDLMCH

SEQ ID NO: 194485 - protein, 9 aa, Tick-borne encephalitis virus
AIVDLMCHT

SEQ ID NO: 194486 - protein, 9 aa, Tick-borne encephalitis virus
VMCHATYVS

SEQ ID NO: 194487 - protein, 9 aa, Tick-borne encephalitis virus
MCHATYVSR

SEQ ID NO: 194488 - protein, 9 aa, Tick-borne encephalitis virus
CHATYVSRR

SEQ ID NO: 194489 - protein, 9 aa, Tick-borne encephalitis virus
HTTYVNRRL

SEQ ID NO: 194490 - protein, 9 aa, Tick-borne encephalitis virus
ATYVSRRLL

SEQ ID NO: 194491 - protein, 9 aa, Tick-borne encephalitis virus
FPESNRGIT

SEQ ID NO: 194492 - protein, 9 aa, Tick-borne encephalitis virus
PESNRGITS

SEQ ID NO: 194493 - protein, 9 aa, Tick-borne encephalitis virus
ESNRGITSE

SEQ ID NO: 194494 - protein, 9 aa, Tick-borne encephalitis virus
SNRGITSEV

SEQ ID NO: 194495 - protein, 9 aa, Tick-borne encephalitis virus
NGAITSEER

SEQ ID NO: 194496 - protein, 9 aa, Tick-borne encephalitis virus
GAITSEERQ

SEQ ID NO: 194497 - protein, 9 aa, Tick-borne encephalitis virus
AITSEERQI

SEQ ID NO: 194498 - protein, 9 aa, Tick-borne encephalitis virus
ITSEERQIP

SEQ ID NO: 194499 - protein, 9 aa, Tick-borne encephalitis virus
SEEKQIPEG

SEQ ID NO: 194500 - protein, 9 aa, Tick-borne encephalitis virus
EEKQIPEGE

SEQ ID NO: 194501 - protein, 9 aa, Tick-borne encephalitis virus
EKQIPEGEW

SEQ ID NO: 194502 - protein, 9 aa, Tick-borne encephalitis virus
KQIPEGEWR

SEQ ID NO: 194503 - protein, 9 aa, Tick-borne encephalitis virus
QIPNGEWRD

SEQ ID NO: 194504 - protein, 9 aa, Tick-borne encephalitis virus
IPNGEWRDG

SEQ ID NO: 194505 - protein, 9 aa, Tick-borne encephalitis virus
PNGEWRDGF

SEQ ID NO: 194506 - protein, 9 aa, Tick-borne encephalitis virus
NGEWRDGFD

SEQ ID NO: 194507 - protein, 9 aa, Tick-borne encephalitis virus
SAWFVPSIA

SEQ ID NO: 194508 - protein, 9 aa, Tick-borne encephalitis virus
VPSIAKGGV

SEQ ID NO: 194509 - protein, 9 aa, Tick-borne encephalitis virus
PSIAKGGVI

SEQ ID NO: 194510 - protein, 9 aa, Tick-borne encephalitis virus
SIAKGGVIA

SEQ ID NO: 194511 - protein, 9 aa, Tick-borne encephalitis virus
IAKGGVIAR

SEQ ID NO: 194512 - protein, 9 aa, Tick-borne encephalitis virus
AKGGVIART

SEQ ID NO: 194513 - protein, 9 aa, Tick-borne encephalitis virus
KGGVIARTL

SEQ ID NO: 194514 - protein, 9 aa, Tick-borne encephalitis virus
GGVIARTLR

SEQ ID NO: 194515 - protein, 9 aa, Tick-borne encephalitis virus
GVIARTLRQ

SEQ ID NO: 194516 - protein, 9 aa, Tick-borne encephalitis virus
VIARTLRQK

SEQ ID NO: 194517 - protein, 9 aa, Tick-borne encephalitis virus
EVDGRVELI

SEQ ID NO: 194518 - protein, 9 aa, Tick-borne encephalitis virus
VDGRVELIG

SEQ ID NO: 194519 - protein, 9 aa, Tick-borne encephalitis virus
DGRVELIGT

SEQ ID NO: 194520 - protein, 9 aa, Tick-borne encephalitis virus
GRVELIGTR

SEQ ID NO: 194521 - protein, 9 aa, Tick-borne encephalitis virus
RVELIGTRR

SEQ ID NO: 194522 - protein, 9 aa, Tick-borne encephalitis virus
PRRGRVGRQ

SEQ ID NO: 194523 - protein, 9 aa, Tick-borne encephalitis virus
RRGRVGRHE

SEQ ID NO: 194524 - protein, 9 aa, Tick-borne encephalitis virus
RGRVGRHEG

SEQ ID NO: 194525 - protein, 9 aa, Tick-borne encephalitis virus
GRVGRHEGR

SEQ ID NO: 194526 - protein, 9 aa, Tick-borne encephalitis virus
RVGRHEGRT

SEQ ID NO: 194527 - protein, 9 aa, Tick-borne encephalitis virus
VGRHEGRTD

SEQ ID NO: 194528 - protein, 9 aa, Tick-borne encephalitis virus
GRHEGRTDE

SEQ ID NO: 194529 - protein, 9 aa, Tick-borne encephalitis virus
RHEGRTDEY

SEQ ID NO: 194530 - protein, 9 aa, Tick-borne encephalitis virus
HEGRTDEYI

SEQ ID NO: 194531 - protein, 9 aa, Tick-borne encephalitis virus
EGRIDEYIY

SEQ ID NO: 194532 - protein, 9 aa, Tick-borne encephalitis virus
SGQCDDDDG

SEQ ID NO: 194533 - protein, 9 aa, Tick-borne encephalitis virus
GQCDEYDSG

SEQ ID NO: 194534 - protein, 9 aa, Tick-borne encephalitis virus
QCDDDDSVL

SEQ ID NO: 194535 - protein, 9 aa, Tick-borne encephalitis virus
CDDDDGGLV

SEQ ID NO: 194536 - protein, 9 aa, Tick-borne encephalitis virus
DDDDGGLVQ

SEQ ID NO: 194537 - protein, 9 aa, Tick-borne encephalitis virus
EYDSGLVQW

SEQ ID NO: 194538 - protein, 9 aa, Tick-borne encephalitis virus
DDSVLVQWK

SEQ ID NO: 194539 - protein, 9 aa, Tick-borne encephalitis virus
DSVLVQWKE

SEQ ID NO: 194540 - protein, 9 aa, Tick-borne encephalitis virus
SVLVQWKEA

SEQ ID NO: 194541 - protein, 9 aa, Tick-borne encephalitis virus
VLVQWKEAQ

SEQ ID NO: 194542 - protein, 9 aa, Tick-borne encephalitis virus
KEGQILLDN

SEQ ID NO: 194543 - protein, 9 aa, Tick-borne encephalitis virus
EGQILLDNI

SEQ ID NO: 194544 - protein, 9 aa, Tick-borne encephalitis virus
AQILLDNII

SEQ ID NO: 194545 - protein, 9 aa, Tick-borne encephalitis virus
QILLDDITT

SEQ ID NO: 194546 - protein, 9 aa, Tick-borne encephalitis virus
ILLDDITTL

SEQ ID NO: 194547 - protein, 9 aa, Tick-borne encephalitis virus
LLDNIITLR

SEQ ID NO: 194548 - protein, 9 aa, Tick-borne encephalitis virus
LDDITTLRG

SEQ ID NO: 194549 - protein, 9 aa, Tick-borne encephalitis virus
DNIITLRGP

SEQ ID NO: 194550 - protein, 9 aa, Tick-borne encephalitis virus
NIITLRGPV

SEQ ID NO: 194551 - protein, 9 aa, Tick-borne encephalitis virus
IITLRGPVA

SEQ ID NO: 194552 - protein, 9 aa, Tick-borne encephalitis virus
TTLRGPVVT

SEQ ID NO: 194553 - protein, 9 aa, Tick-borne encephalitis virus
KMPEVAGHY

SEQ ID NO: 194554 - protein, 9 aa, Tick-borne encephalitis virus
AANVSGVTS

SEQ ID NO: 194555 - protein, 9 aa, Tick-borne encephalitis virus
ANVSGVTSR

SEQ ID NO: 194556 - protein, 9 aa, Tick-borne encephalitis virus
NVSSVTSRS

SEQ ID NO: 194557 - protein, 9 aa, Tick-borne encephalitis virus
VSSVTSRSW

SEQ ID NO: 194558 - protein, 9 aa, Tick-borne encephalitis virus
SGVTSRNWT

SEQ ID NO: 194559 - protein, 9 aa, Tick-borne encephalitis virus
GVTSRNWTW

SEQ ID NO: 194560 - protein, 9 aa, Tick-borne encephalitis virus
VTSRSWTWE

SEQ ID NO: 194561 - protein, 9 aa, Tick-borne encephalitis virus
TSRSWTWEG

SEQ ID NO: 194562 - protein, 9 aa, Tick-borne encephalitis virus
SRSWTWEGP

SEQ ID NO: 194563 - protein, 9 aa, Tick-borne encephalitis virus
SWTWEGPEE

SEQ ID NO: 194564 - protein, 9 aa, Tick-borne encephalitis virus
TWEGPEANA

SEQ ID NO: 194565 - protein, 9 aa, Tick-borne encephalitis virus
WEGPEENAV

SEQ ID NO: 194566 - protein, 9 aa, Tick-borne encephalitis virus
EGPEANAVD

SEQ ID NO: 194567 - protein, 9 aa, Tick-borne encephalitis virus
GPEANAVDE

SEQ ID NO: 194568 - protein, 9 aa, Tick-borne encephalitis virus
PEANAVDEA

SEQ ID NO: 194569 - protein, 9 aa, Tick-borne encephalitis virus
EENAVDEAN

SEQ ID NO: 194570 - protein, 9 aa, Tick-borne encephalitis virus
ENAVDEANG

SEQ ID NO: 194571 - protein, 9 aa, Tick-borne encephalitis virus
NAVDEASGD

SEQ ID NO: 194572 - protein, 9 aa, Tick-borne encephalitis virus
AVDEASGDL

SEQ ID NO: 194573 - protein, 9 aa, Tick-borne encephalitis virus
VDEASGGLV

SEQ ID NO: 194574 - protein, 9 aa, Tick-borne encephalitis virus
DEASGGLVT

SEQ ID NO: 194575 - protein, 9 aa, Tick-borne encephalitis virus
EASGGLVTF

SEQ ID NO: 194576 - protein, 9 aa, Tick-borne encephalitis virus
ANGDLVTFK

SEQ ID NO: 194577 - protein, 9 aa, Tick-borne encephalitis virus
NGDLVTFKS

SEQ ID NO: 194578 - protein, 9 aa, Tick-borne encephalitis virus
GGLVTFRSP

SEQ ID NO: 194579 - protein, 9 aa, Tick-borne encephalitis virus
GLVTFRSPN

SEQ ID NO: 194580 - protein, 9 aa, Tick-borne encephalitis virus
ERTLKPVWR

SEQ ID NO: 194581 - protein, 9 aa, Tick-borne encephalitis virus
RTLKPVWRD

SEQ ID NO: 194582 - protein, 9 aa, Tick-borne encephalitis virus
TLKPVWRDA

SEQ ID NO: 194583 - protein, 9 aa, Tick-borne encephalitis virus
LKPVWRDAR

SEQ ID NO: 194584 - protein, 9 aa, Tick-borne encephalitis virus
KPVWRDARM

SEQ ID NO: 194585 - protein, 9 aa, Tick-borne encephalitis virus
EGRDIREFI

SEQ ID NO: 194586 - protein, 9 aa, Tick-borne encephalitis virus
GRDIREFIA

SEQ ID NO: 194587 - protein, 9 aa, Tick-borne encephalitis virus
RDIREFIAY

SEQ ID NO: 194588 - protein, 9 aa, Tick-borne encephalitis virus
DIREFIAYA

SEQ ID NO: 194589 - protein, 9 aa, Tick-borne encephalitis virus
IREFIAYAS

SEQ ID NO: 194590 - protein, 9 aa, Tick-borne encephalitis virus
REFIAYASG

SEQ ID NO: 194591 - protein, 9 aa, Tick-borne encephalitis virus
RRSIGDVLT

SEQ ID NO: 194592 - protein, 9 aa, Tick-borne encephalitis virus
RSIGDVLTG

SEQ ID NO: 194593 - protein, 9 aa, Tick-borne encephalitis virus
SIGDVLTGM

SEQ ID NO: 194594 - protein, 9 aa, Tick-borne encephalitis virus
IGDVLTGMS

SEQ ID NO: 194595 - protein, 9 aa, Tick-borne encephalitis virus
VFYTLMHDE

SEQ ID NO: 194596 - protein, 9 aa, Tick-borne encephalitis virus
FYTLMHDEP

SEQ ID NO: 194597 - protein, 9 aa, Tick-borne encephalitis virus
YTLMHEKPD

SEQ ID NO: 194598 - protein, 9 aa, Tick-borne encephalitis virus
TLMHDEPGS

SEQ ID NO: 194599 - protein, 9 aa, Tick-borne encephalitis virus
LMHDEPGSR

SEQ ID NO: 194600 - protein, 9 aa, Tick-borne encephalitis virus
MHEEPGSSA

SEQ ID NO: 194601 - protein, 9 aa, Tick-borne encephalitis virus
HDEPGSRAM

SEQ ID NO: 194602 - protein, 9 aa, Tick-borne encephalitis virus
DEPGSRAMK

SEQ ID NO: 194603 - protein, 9 aa, Tick-borne encephalitis virus
KPDSRAMRM

SEQ ID NO: 194604 - protein, 9 aa, Tick-borne encephalitis virus
PGSSAMRMA

SEQ ID NO: 194605 - protein, 9 aa, Tick-borne encephalitis virus
DSRAMRMAE

SEQ ID NO: 194606 - protein, 9 aa, Tick-borne encephalitis virus
SSAMRMAER

SEQ ID NO: 194607 - protein, 9 aa, Tick-borne encephalitis virus
SAMRMAERD

SEQ ID NO: 194608 - protein, 9 aa, Tick-borne encephalitis virus
DAPEAFLTL

SEQ ID NO: 194609 - protein, 9 aa, Tick-borne encephalitis virus
APEAFLTLV

SEQ ID NO: 194610 - protein, 9 aa, Tick-borne encephalitis virus
PEAFLTMAE

SEQ ID NO: 194611 - protein, 9 aa, Tick-borne encephalitis virus
VEVMVLGLA

SEQ ID NO: 194612 - protein, 9 aa, Tick-borne encephalitis virus
EMLVLGLAT

SEQ ID NO: 194613 - protein, 9 aa, Tick-borne encephalitis virus
MLVLGLATL

SEQ ID NO: 194614 - protein, 9 aa, Tick-borne encephalitis virus
LVLGLATLG

SEQ ID NO: 194615 - protein, 9 aa, Tick-borne encephalitis virus
LGLGTLGVV

SEQ ID NO: 194616 - protein, 9 aa, Tick-borne encephalitis virus
GLGTLGVVW

SEQ ID NO: 194617 - protein, 9 aa, Tick-borne encephalitis virus
LGTLGVVWC

SEQ ID NO: 194618 - protein, 9 aa, Tick-borne encephalitis virus
GTLGVVWCF

SEQ ID NO: 194619 - protein, 9 aa, Tick-borne encephalitis virus
LGVVWCFVA

SEQ ID NO: 194620 - protein, 9 aa, Tick-borne encephalitis virus
GVVWCFVAR

SEQ ID NO: 194621 - protein, 9 aa, Tick-borne encephalitis virus
VVWCFVART

SEQ ID NO: 194622 - protein, 9 aa, Tick-borne encephalitis virus
VWCFVVRAS

SEQ ID NO: 194623 - protein, 9 aa, Tick-borne encephalitis virus
WCFVVRASI

SEQ ID NO: 194624 - protein, 9 aa, Tick-borne encephalitis virus
CFVVRASIS

SEQ ID NO: 194625 - protein, 9 aa, Tick-borne encephalitis virus
FVVRASISR

SEQ ID NO: 194626 - protein, 9 aa, Tick-borne encephalitis virus
VARTSISRM

SEQ ID NO: 194627 - protein, 9 aa, Tick-borne encephalitis virus
VRASISRMM

SEQ ID NO: 194628 - protein, 9 aa, Tick-borne encephalitis virus
TLVLLASLV

SEQ ID NO: 194629 - protein, 9 aa, Tick-borne encephalitis virus
LVLLASLVL

SEQ ID NO: 194630 - protein, 9 aa, Tick-borne encephalitis virus
VLLASLVLL

SEQ ID NO: 194631 - protein, 9 aa, Tick-borne encephalitis virus
LLASLVLLW

SEQ ID NO: 194632 - protein, 9 aa, Tick-borne encephalitis virus
LASLVLLWA

SEQ ID NO: 194633 - protein, 9 aa, Tick-borne encephalitis virus
ASLVLLWAG

SEQ ID NO: 194634 - protein, 9 aa, Tick-borne encephalitis virus
SLVLLWAGG

SEQ ID NO: 194635 - protein, 9 aa, Tick-borne encephalitis virus
LVLLWAGGV

SEQ ID NO: 194636 - protein, 9 aa, Tick-borne encephalitis virus
ALLWAGGVG

SEQ ID NO: 194637 - protein, 9 aa, Tick-borne encephalitis virus
ANEMGLLER

SEQ ID NO: 194638 - protein, 9 aa, Tick-borne encephalitis virus
NEMGLLERT

SEQ ID NO: 194639 - protein, 9 aa, Tick-borne encephalitis virus
EMGLLERTK

SEQ ID NO: 194640 - protein, 9 aa, Tick-borne encephalitis virus
MGLLERTKA

SEQ ID NO: 194641 - protein, 9 aa, Tick-borne encephalitis virus
GLLERTKAD

SEQ ID NO: 194642 - protein, 9 aa, Tick-borne encephalitis virus
LLERTKADL

SEQ ID NO: 194643 - protein, 9 aa, Tick-borne encephalitis virus
EKTKADLSA

SEQ ID NO: 194644 - protein, 9 aa, Tick-borne encephalitis virus
KTKADLSTA

SEQ ID NO: 194645 - protein, 9 aa, Tick-borne encephalitis virus
TKADLSAVL

SEQ ID NO: 194646 - protein, 9 aa, Tick-borne encephalitis virus
KADLSAVLW

SEQ ID NO: 194647 - protein, 9 aa, Tick-borne encephalitis virus
ADLSTVLWA

SEQ ID NO: 194648 - protein, 9 aa, Tick-borne encephalitis virus
EPRSWGEWT

SEQ ID NO: 194649 - protein, 9 aa, Tick-borne encephalitis virus
PRSWGEWTN

SEQ ID NO: 194650 - protein, 9 aa, Tick-borne encephalitis virus
RSWGEWTNI

SEQ ID NO: 194651 - protein, 9 aa, Tick-borne encephalitis virus
SWGEWTNID

SEQ ID NO: 194652 - protein, 9 aa, Tick-borne encephalitis virus
WGEWTNIDI

SEQ ID NO: 194653 - protein, 9 aa, Tick-borne encephalitis virus
GEWTNIDIQ

SEQ ID NO: 194654 - protein, 9 aa, Tick-borne encephalitis virus
QLVNSAVVT

SEQ ID NO: 194655 - protein, 9 aa, Tick-borne encephalitis virus
LVNSAVVTG

SEQ ID NO: 194656 - protein, 9 aa, Tick-borne encephalitis virus
VNSAVVTGA

SEQ ID NO: 194657 - protein, 9 aa, Tick-borne encephalitis virus
NSAVVTGAQ

SEQ ID NO: 194658 - protein, 9 aa, Tick-borne encephalitis virus
SAVVTGAQA

SEQ ID NO: 194659 - protein, 9 aa, Tick-borne encephalitis virus
AVVTGAQAM

SEQ ID NO: 194660 - protein, 9 aa, Tick-borne encephalitis virus
VVTGAQAMR

SEQ ID NO: 194661 - protein, 9 aa, Tick-borne encephalitis virus
VTGAQAMRD

SEQ ID NO: 194662 - protein, 9 aa, Tick-borne encephalitis virus
DLGGGAPFL

SEQ ID NO: 194663 - protein, 9 aa, Tick-borne encephalitis virus
LGGGAPFLG

SEQ ID NO: 194664 - protein, 9 aa, Tick-borne encephalitis virus
GGGAPFIGV

SEQ ID NO: 194665 - protein, 9 aa, Tick-borne encephalitis virus
GGAPFIGVA

SEQ ID NO: 194666 - protein, 9 aa, Tick-borne encephalitis virus
GAPFFGIAG

SEQ ID NO: 194667 - protein, 9 aa, Tick-borne encephalitis virus
APFIGVAGH

SEQ ID NO: 194668 - protein, 9 aa, Tick-borne encephalitis virus
PFFGIAGHV

SEQ ID NO: 194669 - protein, 9 aa, Tick-borne encephalitis virus
FFGIAGHVM

SEQ ID NO: 194670 - protein, 9 aa, Tick-borne encephalitis virus
GVAGHVVAL

SEQ ID NO: 194671 - protein, 9 aa, Tick-borne encephalitis virus
VAGHVVALG

SEQ ID NO: 194672 - protein, 9 aa, Tick-borne encephalitis virus
AGHVVALGV

SEQ ID NO: 194673 - protein, 9 aa, Tick-borne encephalitis virus
GHVVALGVV

SEQ ID NO: 194674 - protein, 9 aa, Tick-borne encephalitis virus
HVVALGVVS

SEQ ID NO: 194675 - protein, 9 aa, Tick-borne encephalitis virus
VVALGVVSL

SEQ ID NO: 194676 - protein, 9 aa, Tick-borne encephalitis virus
VALGVVSLV

SEQ ID NO: 194677 - protein, 9 aa, Tick-borne encephalitis virus
SLGVVSLVG

SEQ ID NO: 194678 - protein, 9 aa, Tick-borne encephalitis virus
MVGVGLAAF

SEQ ID NO: 194679 - protein, 9 aa, Tick-borne encephalitis virus
IYPFGEGET

SEQ ID NO: 194680 - protein, 9 aa, Tick-borne encephalitis virus
YPFGEGETK

SEQ ID NO: 194681 - protein, 9 aa, Tick-borne encephalitis virus
AKPALYERR

SEQ ID NO: 194682 - protein, 9 aa, Tick-borne encephalitis virus
RKMSLVLAT

SEQ ID NO: 194683 - protein, 9 aa, Tick-borne encephalitis virus
MSLVLAVVL

SEQ ID NO: 194684 - protein, 9 aa, Tick-borne encephalitis virus
SLVLAVVLC

SEQ ID NO: 194685 - protein, 9 aa, Tick-borne encephalitis virus
LVLAVVLCL

SEQ ID NO: 194686 - protein, 9 aa, Tick-borne encephalitis virus
VLCLMAVVM

SEQ ID NO: 194687 - protein, 9 aa, Tick-borne encephalitis virus
LCLISVVMN

SEQ ID NO: 194688 - protein, 9 aa, Tick-borne encephalitis virus
CLISVVMNR

SEQ ID NO: 194689 - protein, 9 aa, Tick-borne encephalitis virus
LISVVMNRT

SEQ ID NO: 194690 - protein, 9 aa, Tick-borne encephalitis virus
ISVVMNRTV

SEQ ID NO: 194691 - protein, 9 aa, Tick-borne encephalitis virus
AVVMNRTVA

SEQ ID NO: 194692 - protein, 9 aa, Tick-borne encephalitis virus
VVMNRTVLS

SEQ ID NO: 194693 - protein, 9 aa, Tick-borne encephalitis virus
VMNRTVLSI

SEQ ID NO: 194694 - protein, 9 aa, Tick-borne encephalitis virus
MNRTVLSIT

SEQ ID NO: 194695 - protein, 9 aa, Tick-borne encephalitis virus
NRTMASITE

SEQ ID NO: 194696 - protein, 9 aa, Tick-borne encephalitis virus
RTMASITEA

SEQ ID NO: 194697 - protein, 9 aa, Tick-borne encephalitis virus
TVLSITEAS

SEQ ID NO: 194698 - protein, 9 aa, Tick-borne encephalitis virus
VPSITEAAA

SEQ ID NO: 194699 - protein, 9 aa, Tick-borne encephalitis virus
PSITEAAAV

SEQ ID NO: 194700 - protein, 9 aa, Tick-borne encephalitis virus
AAAVGLAAA

SEQ ID NO: 194701 - protein, 9 aa, Tick-borne encephalitis virus
AAVGLAAAG

SEQ ID NO: 194702 - protein, 9 aa, Tick-borne encephalitis virus
AVGLAALGQ

SEQ ID NO: 194703 - protein, 9 aa, Tick-borne encephalitis virus
VGLAALGQL

SEQ ID NO: 194704 - protein, 9 aa, Tick-borne encephalitis virus
GLAALGQLL

SEQ ID NO: 194705 - protein, 9 aa, Tick-borne encephalitis virus
LAAAGQLLS

SEQ ID NO: 194706 - protein, 9 aa, Tick-borne encephalitis virus
AAAGQLLSP

SEQ ID NO: 194707 - protein, 9 aa, Tick-borne encephalitis virus
AAGQLLSPE

SEQ ID NO: 194708 - protein, 9 aa, Tick-borne encephalitis virus
GQLLSPEAD

SEQ ID NO: 194709 - protein, 9 aa, Tick-borne encephalitis virus
QLLSPEADT

SEQ ID NO: 194710 - protein, 9 aa, Tick-borne encephalitis virus
LLSPEADTL

SEQ ID NO: 194711 - protein, 9 aa, Tick-borne encephalitis virus
LSPEADTLW

SEQ ID NO: 194712 - protein, 9 aa, Tick-borne encephalitis virus
SPEADTLWT

SEQ ID NO: 194713 - protein, 9 aa, Tick-borne encephalitis virus
PEEDTLWTM

SEQ ID NO: 194714 - protein, 9 aa, Tick-borne encephalitis virus
EEDTLWTMP

SEQ ID NO: 194715 - protein, 9 aa, Tick-borne encephalitis virus
EDTLWTMPV

SEQ ID NO: 194716 - protein, 9 aa, Tick-borne encephalitis virus
MPVACGLSS

SEQ ID NO: 194717 - protein, 9 aa, Tick-borne encephalitis virus
PVACGLSSV

SEQ ID NO: 194718 - protein, 9 aa, Tick-borne encephalitis virus
VACGLSSVV

SEQ ID NO: 194719 - protein, 9 aa, Tick-borne encephalitis virus
ACGLSSVVR

SEQ ID NO: 194720 - protein, 9 aa, Tick-borne encephalitis virus
CGLSSVVRG

SEQ ID NO: 194721 - protein, 9 aa, Tick-borne encephalitis virus
GLSSVVRGS

SEQ ID NO: 194722 - protein, 9 aa, Tick-borne encephalitis virus
LSSVVRGSL

SEQ ID NO: 194723 - protein, 9 aa, Tick-borne encephalitis virus
SGVVTGSLW

SEQ ID NO: 194724 - protein, 9 aa, Tick-borne encephalitis virus
GVVTGSLWG

SEQ ID NO: 194725 - protein, 9 aa, Tick-borne encephalitis virus
ASGSRRGGA

SEQ ID NO: 194726 - protein, 9 aa, Tick-borne encephalitis virus
SGSRRGGAE

SEQ ID NO: 194727 - protein, 9 aa, Tick-borne encephalitis virus
GSRRGGAEG

SEQ ID NO: 194728 - protein, 9 aa, Tick-borne encephalitis virus
SRRGGAEGD

SEQ ID NO: 194729 - protein, 9 aa, Tick-borne encephalitis virus
RRGGSDGDT

SEQ ID NO: 194730 - protein, 9 aa, Tick-borne encephalitis virus
RGGSDGDTL

SEQ ID NO: 194731 - protein, 9 aa, Tick-borne encephalitis virus
GGSDGDTLG

SEQ ID NO: 194732 - protein, 9 aa, Tick-borne encephalitis virus
GSDGDTLGD

SEQ ID NO: 194733 - protein, 9 aa, Tick-borne encephalitis virus
SDGDTLGDL

SEQ ID NO: 194734 - protein, 9 aa, Tick-borne encephalitis virus
TLGDLWKQR

SEQ ID NO: 194735 - protein, 9 aa, Tick-borne encephalitis virus
LGDLWKQRL

SEQ ID NO: 194736 - protein, 9 aa, Tick-borne encephalitis virus
GDLWKQRLN

SEQ ID NO: 194737 - protein, 9 aa, Tick-borne encephalitis virus
LNSCTKEEF

SEQ ID NO: 194738 - protein, 9 aa, Tick-borne encephalitis virus
NSCTKEEFF

SEQ ID NO: 194739 - protein, 9 aa, Tick-borne encephalitis virus
SCTKEEFFV

SEQ ID NO: 194740 - protein, 9 aa, Tick-borne encephalitis virus
CTKEEFFVY

SEQ ID NO: 194741 - protein, 9 aa, Tick-borne encephalitis virus
TKEEFFVYR

SEQ ID NO: 194742 - protein, 9 aa, Tick-borne encephalitis virus
KEEFFVYRR

SEQ ID NO: 194743 - protein, 9 aa, Tick-borne encephalitis virus
EEFFIYRRT

SEQ ID NO: 194744 - protein, 9 aa, Tick-borne encephalitis virus
EFFIYRRTG

SEQ ID NO: 194745 - protein, 9 aa, Tick-borne encephalitis virus
FFVYRRAGI

SEQ ID NO: 194746 - protein, 9 aa, Tick-borne encephalitis virus
FVYRRAGIL

SEQ ID NO: 194747 - protein, 9 aa, Tick-borne encephalitis virus
IYRRTGILE

SEQ ID NO: 194748 - protein, 9 aa, Tick-borne encephalitis virus
YRRAGILET

SEQ ID NO: 194749 - protein, 9 aa, Tick-borne encephalitis virus
RRTGIMETE

SEQ ID NO: 194750 - protein, 9 aa, Tick-borne encephalitis virus
RAGILETER

SEQ ID NO: 194751 - protein, 9 aa, Tick-borne encephalitis virus
AGILETERD

SEQ ID NO: 194752 - protein, 9 aa, Tick-borne encephalitis virus
GIMETERDK

SEQ ID NO: 194753 - protein, 9 aa, Tick-borne encephalitis virus
ILETERDRA

SEQ ID NO: 194754 - protein, 9 aa, Tick-borne encephalitis virus
METERDKAR

SEQ ID NO: 194755 - protein, 9 aa, Tick-borne encephalitis virus
RDRARELLR

SEQ ID NO: 194756 - protein, 9 aa, Tick-borne encephalitis virus
DKARELLKR

SEQ ID NO: 194757 - protein, 9 aa, Tick-borne encephalitis virus
KARELLKKG

SEQ ID NO: 194758 - protein, 9 aa, Tick-borne encephalitis virus
ARELLKKGE

SEQ ID NO: 194759 - protein, 9 aa, Tick-borne encephalitis virus
RELLKRGET

SEQ ID NO: 194760 - protein, 9 aa, Tick-borne encephalitis virus
ELLKRGETN

SEQ ID NO: 194761 - protein, 9 aa, Tick-borne encephalitis virus
KGETNMGLA

SEQ ID NO: 194762 - protein, 9 aa, Tick-borne encephalitis virus
GETNVGLAV

SEQ ID NO: 194763 - protein, 9 aa, Tick-borne encephalitis virus
ETNVGLAVS

SEQ ID NO: 194764 - protein, 9 aa, Tick-borne encephalitis virus
TNVGLAVSR

SEQ ID NO: 194765 - protein, 9 aa, Tick-borne encephalitis virus
NVGLAVSRG

SEQ ID NO: 194766 - protein, 9 aa, Tick-borne encephalitis virus
VGLAVSRGT

SEQ ID NO: 194767 - protein, 9 aa, Tick-borne encephalitis virus
AASRPAVMN

SEQ ID NO: 194768 - protein, 9 aa, Tick-borne encephalitis virus
ASRPSVMSV

SEQ ID NO: 194769 - protein, 9 aa, Tick-borne encephalitis virus
SRPSVMSVK

SEQ ID NO: 194770 - protein, 9 aa, Tick-borne encephalitis virus
RPSVMSVKA

SEQ ID NO: 194771 - protein, 9 aa, Tick-borne encephalitis virus
PSVMSVKAY

SEQ ID NO: 194772 - protein, 9 aa, Tick-borne encephalitis virus
SVMSVKAYT

SEQ ID NO: 194773 - protein, 9 aa, Tick-borne encephalitis virus
VMNVRAYTI

SEQ ID NO: 194774 - protein, 9 aa, Tick-borne encephalitis virus
MNVRAYTIG

SEQ ID NO: 194775 - protein, 9 aa, Tick-borne encephalitis virus
NVRAYTIGG

SEQ ID NO: 194776 - protein, 9 aa, Tick-borne encephalitis virus
VRAYTIGGK

SEQ ID NO: 194777 - protein, 9 aa, Tick-borne encephalitis virus
RAYTIGGKG

SEQ ID NO: 194778 - protein, 9 aa, Tick-borne encephalitis virus
TIGGKGHEA

SEQ ID NO: 194779 - protein, 9 aa, Tick-borne encephalitis virus
IGGKGHEAP

SEQ ID NO: 194780 - protein, 9 aa, Tick-borne encephalitis virus
GGKGHEAPK

SEQ ID NO: 194781 - protein, 9 aa, Tick-borne encephalitis virus
GKGHEAPKM

SEQ ID NO: 194782 - protein, 9 aa, Tick-borne encephalitis virus
KGHEAPKMV

SEQ ID NO: 194783 - protein, 9 aa, Tick-borne encephalitis virus
GHETPRMVT

SEQ ID NO: 194784 - protein, 9 aa, Tick-borne encephalitis virus
HETPRMVTS

SEQ ID NO: 194785 - protein, 9 aa, Tick-borne encephalitis virus
ETPRMVTSL

SEQ ID NO: 194786 - protein, 9 aa, Tick-borne encephalitis virus
TPRMVTSLG

SEQ ID NO: 194787 - protein, 9 aa, Tick-borne encephalitis virus
NLIKFRAGV

SEQ ID NO: 194788 - protein, 9 aa, Tick-borne encephalitis virus
LIKFRAGVD

SEQ ID NO: 194789 - protein, 9 aa, Tick-borne encephalitis virus
IKFRAGVDV

SEQ ID NO: 194790 - protein, 9 aa, Tick-borne encephalitis virus
KFRAGVDVF

SEQ ID NO: 194791 - protein, 9 aa, Tick-borne encephalitis virus
FRAGVDVFS

SEQ ID NO: 194792 - protein, 9 aa, Tick-borne encephalitis virus
RAGVDVFSM

SEQ ID NO: 194793 - protein, 9 aa, Tick-borne encephalitis virus
AGVDVFSMQ

SEQ ID NO: 194794 - protein, 9 aa, Tick-borne encephalitis virus
IMCDIGESS

SEQ ID NO: 194795 - protein, 9 aa, Tick-borne encephalitis virus
IGESNPDAA

SEQ ID NO: 194796 - protein, 9 aa, Tick-borne encephalitis virus
GESNPDAAV

SEQ ID NO: 194797 - protein, 9 aa, Tick-borne encephalitis virus
ESNPDAAVE

SEQ ID NO: 194798 - protein, 9 aa, Tick-borne encephalitis virus
SNPDAAVEG

SEQ ID NO: 194799 - protein, 9 aa, Tick-borne encephalitis virus
NPDAAVEGE

SEQ ID NO: 194800 - protein, 9 aa, Tick-borne encephalitis virus
PDAVVEGEK

SEQ ID NO: 194801 - protein, 9 aa, Tick-borne encephalitis virus
DAVVEGEKT

SEQ ID NO: 194802 - protein, 9 aa, Tick-borne encephalitis virus
AVVEGEKTR

SEQ ID NO: 194803 - protein, 9 aa, Tick-borne encephalitis virus
AVEGERTRR

SEQ ID NO: 194804 - protein, 9 aa, Tick-borne encephalitis virus
VEGEKTRKV

SEQ ID NO: 194805 - protein, 9 aa, Tick-borne encephalitis virus
EGEKTRKVI

SEQ ID NO: 194806 - protein, 9 aa, Tick-borne encephalitis virus
GEKTRKVIL

SEQ ID NO: 194807 - protein, 9 aa, Tick-borne encephalitis virus
EKTRKVILL

SEQ ID NO: 194808 - protein, 9 aa, Tick-borne encephalitis virus
KTRKVILLM

SEQ ID NO: 194809 - protein, 9 aa, Tick-borne encephalitis virus
EQWKIRNPT

SEQ ID NO: 194810 - protein, 9 aa, Tick-borne encephalitis virus
QWKNRNPAA

SEQ ID NO: 194811 - protein, 9 aa, Tick-borne encephalitis virus
WKNRNPAAA

SEQ ID NO: 194812 - protein, 9 aa, Tick-borne encephalitis virus
KIRNPTATC

SEQ ID NO: 194813 - protein, 9 aa, Tick-borne encephalitis virus
NRNPAAACV

SEQ ID NO: 194814 - protein, 9 aa, Tick-borne encephalitis virus
RNPAAACVF

SEQ ID NO: 194815 - protein, 9 aa, Tick-borne encephalitis virus
NPAAACVFK

SEQ ID NO: 194816 - protein, 9 aa, Tick-borne encephalitis virus
PAAACVFKV

SEQ ID NO: 194817 - protein, 9 aa, Tick-borne encephalitis virus
AAACVFKVL

SEQ ID NO: 194818 - protein, 9 aa, Tick-borne encephalitis virus
PYRPKVIEA

SEQ ID NO: 194819 - protein, 9 aa, Tick-borne encephalitis virus
YRPEVIETL

SEQ ID NO: 194820 - protein, 9 aa, Tick-borne encephalitis virus
RPEVIETLH

SEQ ID NO: 194821 - protein, 9 aa, Tick-borne encephalitis virus
PKVIEALHR

SEQ ID NO: 194822 - protein, 9 aa, Tick-borne encephalitis virus
KVIEALHRF

SEQ ID NO: 194823 - protein, 9 aa, Tick-borne encephalitis virus
EALHRFQLK

SEQ ID NO: 194824 - protein, 9 aa, Tick-borne encephalitis virus
ALHRFQLKW

SEQ ID NO: 194825 - protein, 9 aa, Tick-borne encephalitis virus
LHRFQLKWG

SEQ ID NO: 194826 - protein, 9 aa, Tick-borne encephalitis virus
HRFQLKWGG

SEQ ID NO: 194827 - protein, 9 aa, Tick-borne encephalitis virus
RFQLKWGGG

SEQ ID NO: 194828 - protein, 9 aa, Tick-borne encephalitis virus
FQLKWGGGL

SEQ ID NO: 194829 - protein, 9 aa, Tick-borne encephalitis virus
QLKWGGGLV

SEQ ID NO: 194830 - protein, 9 aa, Tick-borne encephalitis virus
LKWGGGLVR

SEQ ID NO: 194831 - protein, 9 aa, Tick-borne encephalitis virus
KWGGGLVRT

SEQ ID NO: 194832 - protein, 9 aa, Tick-borne encephalitis virus
HKVYYSTAV

SEQ ID NO: 194833 - protein, 9 aa, Tick-borne encephalitis virus
KVYYSTAVT

SEQ ID NO: 194834 - protein, 9 aa, Tick-borne encephalitis virus
VYYSTAVTG

SEQ ID NO: 194835 - protein, 9 aa, Tick-borne encephalitis virus
FAGQRGPTR

SEQ ID NO: 194836 - protein, 9 aa, Tick-borne encephalitis virus
AGQRGPTRV

SEQ ID NO: 194837 - protein, 9 aa, Tick-borne encephalitis virus
GQRGPTRVP

SEQ ID NO: 194838 - protein, 9 aa, Tick-borne encephalitis virus
KVPELDLGV

SEQ ID NO: 194839 - protein, 9 aa, Tick-borne encephalitis virus
LGVGTRCVF

SEQ ID NO: 194840 - protein, 9 aa, Tick-borne encephalitis virus
GVGTRCVFL

SEQ ID NO: 194841 - protein, 9 aa, Tick-borne encephalitis virus
VGTRCVFLA

SEQ ID NO: 194842 - protein, 9 aa, Tick-borne encephalitis virus
GTRCVFLAE

SEQ ID NO: 194843 - protein, 9 aa, Tick-borne encephalitis virus
TRCVVLADD

SEQ ID NO: 194844 - protein, 9 aa, Tick-borne encephalitis virus
RCVVLADDK

SEQ ID NO: 194845 - protein, 9 aa, Tick-borne encephalitis virus
CVVLADDKV

SEQ ID NO: 194846 - protein, 9 aa, Tick-borne encephalitis virus
VVLAEDKVR

SEQ ID NO: 194847 - protein, 9 aa, Tick-borne encephalitis virus
VLAEDKVRE

SEQ ID NO: 194848 - protein, 9 aa, Tick-borne encephalitis virus
LAEDRVREK

SEQ ID NO: 194849 - protein, 9 aa, Tick-borne encephalitis virus
AEDRVREKD

SEQ ID NO: 194850 - protein, 9 aa, Tick-borne encephalitis virus
EDRVREKDV

SEQ ID NO: 194851 - protein, 9 aa, Tick-borne encephalitis virus
DRVREKDVQ

SEQ ID NO: 194852 - protein, 9 aa, Tick-borne encephalitis virus
RVREKDVQE

SEQ ID NO: 194853 - protein, 9 aa, Tick-borne encephalitis virus
VREKDVQER

SEQ ID NO: 194854 - protein, 9 aa, Tick-borne encephalitis virus
REKDVQERI

SEQ ID NO: 194855 - protein, 9 aa, Tick-borne encephalitis virus
DVQERINAL

SEQ ID NO: 194856 - protein, 9 aa, Tick-borne encephalitis virus
ERINALREQ

SEQ ID NO: 194857 - protein, 9 aa, Tick-borne encephalitis virus
RIKALREQY

SEQ ID NO: 194858 - protein, 9 aa, Tick-borne encephalitis virus
ALKEQYGET

SEQ ID NO: 194859 - protein, 9 aa, Tick-borne encephalitis virus
LKEQYGETW

SEQ ID NO: 194860 - protein, 9 aa, Tick-borne encephalitis virus
KEQYGETWH

SEQ ID NO: 194861 - protein, 9 aa, Tick-borne encephalitis virus
DGEHPYRTW

SEQ ID NO: 194862 - protein, 9 aa, Tick-borne encephalitis virus
GEHPYRTWQ

SEQ ID NO: 194863 - protein, 9 aa, Tick-borne encephalitis virus
AWQQRVFKK

SEQ ID NO: 194864 - protein, 9 aa, Tick-borne encephalitis virus
WQQRVFKKN

SEQ ID NO: 194865 - protein, 9 aa, Tick-borne encephalitis virus
QQRVFKKNA

SEQ ID NO: 194866 - protein, 9 aa, Tick-borne encephalitis virus
QRVFKKNAD

SEQ ID NO: 194867 - protein, 9 aa, Tick-borne encephalitis virus
RVFKKNADT

SEQ ID NO: 194868 - protein, 9 aa, Tick-borne encephalitis virus
VFKKNADTK

SEQ ID NO: 194869 - protein, 9 aa, Tick-borne encephalitis virus
FKKNADTKA

SEQ ID NO: 194870 - protein, 9 aa, Tick-borne encephalitis virus
KKNADTKAQ

SEQ ID NO: 194871 - protein, 9 aa, Tick-borne encephalitis virus
KNADTKAQE

SEQ ID NO: 194872 - protein, 9 aa, Tick-borne encephalitis virus
DWMLDRLAQ

SEQ ID NO: 194873 - protein, 9 aa, Tick-borne encephalitis virus
WMLDRLAQK

SEQ ID NO: 194874 - protein, 9 aa, Tick-borne encephalitis virus
ILERLAQRS

SEQ ID NO: 194875 - protein, 9 aa, Tick-borne encephalitis virus
NSRIHSKEE

SEQ ID NO: 194876 - protein, 9 aa, Tick-borne encephalitis virus
SRIHSKEEF

SEQ ID NO: 194877 - protein, 9 aa, Tick-borne encephalitis virus
RIHSKEEFI

SEQ ID NO: 194878 - protein, 9 aa, Tick-borne encephalitis virus
IHSKEEFIA

SEQ ID NO: 194879 - protein, 9 aa, Tick-borne encephalitis virus
HSKEEFIAK

SEQ ID NO: 194880 - protein, 9 aa, Tick-borne encephalitis virus
KEEFIAKVR

SEQ ID NO: 194881 - protein, 9 aa, Tick-borne encephalitis virus
EFIAKVKSS

SEQ ID NO: 194882 - protein, 9 aa, Tick-borne encephalitis virus
FIAKVKSSA

SEQ ID NO: 194883 - protein, 9 aa, Tick-borne encephalitis virus
IAKVKSSAA

SEQ ID NO: 194884 - protein, 9 aa, Tick-borne encephalitis virus
AKVRSNAAL

SEQ ID NO: 194885 - protein, 9 aa, Tick-borne encephalitis virus
KVKSSAALG

SEQ ID NO: 194886 - protein, 9 aa, Tick-borne encephalitis virus
VKSSAALGA

SEQ ID NO: 194887 - protein, 9 aa, Tick-borne encephalitis virus
KSSAALGAW

SEQ ID NO: 194888 - protein, 9 aa, Tick-borne encephalitis virus
NAALGAWSE

SEQ ID NO: 194889 - protein, 9 aa, Tick-borne encephalitis virus
AALGAWSEE

SEQ ID NO: 194890 - protein, 9 aa, Tick-borne encephalitis virus
ALGAWSEEQ

SEQ ID NO: 194891 - protein, 9 aa, Tick-borne encephalitis virus
LGAWSNEQN

SEQ ID NO: 194892 - protein, 9 aa, Tick-borne encephalitis virus
GAWSEEQNR

SEQ ID NO: 194893 - protein, 9 aa, Tick-borne encephalitis virus
AWSNEQNRW

SEQ ID NO: 194894 - protein, 9 aa, Tick-borne encephalitis virus
WSNEQNRWS

SEQ ID NO: 194895 - protein, 9 aa, Tick-borne encephalitis virus
NAKEAVEDP

SEQ ID NO: 194896 - protein, 9 aa, Tick-borne encephalitis virus
AKEAVEDPV

SEQ ID NO: 194897 - protein, 9 aa, Tick-borne encephalitis virus
KEAVEDPVF

SEQ ID NO: 194898 - protein, 9 aa, Tick-borne encephalitis virus
AVEDPVFWQ

SEQ ID NO: 194899 - protein, 9 aa, Tick-borne encephalitis virus
VEDPVFWQL

SEQ ID NO: 194900 - protein, 9 aa, Tick-borne encephalitis virus
EDPVFWQLV

SEQ ID NO: 194901 - protein, 9 aa, Tick-borne encephalitis virus
DPVFWQLVD

SEQ ID NO: 194902 - protein, 9 aa, Tick-borne encephalitis virus
PVFWQLVDE

SEQ ID NO: 194903 - protein, 9 aa, Tick-borne encephalitis virus
VFWQLVDEE

SEQ ID NO: 194904 - protein, 9 aa, Tick-borne encephalitis virus
FWRLVDEER

SEQ ID NO: 194905 - protein, 9 aa, Tick-borne encephalitis virus
WRLVDEERE

SEQ ID NO: 194906 - protein, 9 aa, Tick-borne encephalitis virus
RLVDEERER

SEQ ID NO: 194907 - protein, 9 aa, Tick-borne encephalitis virus
DEERERHLT

SEQ ID NO: 194908 - protein, 9 aa, Tick-borne encephalitis virus
EERERDLAG

SEQ ID NO: 194909 - protein, 9 aa, Tick-borne encephalitis virus
ERERHLTGR

SEQ ID NO: 194910 - protein, 9 aa, Tick-borne encephalitis virus
RERHLTGRC

SEQ ID NO: 194911 - protein, 9 aa, Tick-borne encephalitis virus
ERDLAGRSA

SEQ ID NO: 194912 - protein, 9 aa, Tick-borne encephalitis virus
RDLAGRSAH

SEQ ID NO: 194913 - protein, 9 aa, Tick-borne encephalitis virus
DLAGRSAHG

SEQ ID NO: 194914 - protein, 9 aa, Tick-borne encephalitis virus
LAGRCAHCA

SEQ ID NO: 194915 - protein, 9 aa, Tick-borne encephalitis virus
GRCAHCAYN

SEQ ID NO: 194916 - protein, 9 aa, Tick-borne encephalitis virus
RSAHGVFNI

SEQ ID NO: 194917 - protein, 9 aa, Tick-borne encephalitis virus
SAHGVFNIM

SEQ ID NO: 194918 - protein, 9 aa, Tick-borne encephalitis virus
AHGVFNIMG

SEQ ID NO: 194919 - protein, 9 aa, Tick-borne encephalitis virus
HGVFNIMGK

SEQ ID NO: 194920 - protein, 9 aa, Tick-borne encephalitis virus
GVFNIMGKR

SEQ ID NO: 194921 - protein, 9 aa, Tick-borne encephalitis virus
VFNIMGKRE

SEQ ID NO: 194922 - protein, 9 aa, Tick-borne encephalitis virus
FNIMGKREK

SEQ ID NO: 194923 - protein, 9 aa, Tick-borne encephalitis virus
EDHWASRGF

SEQ ID NO: 194924 - protein, 9 aa, Tick-borne encephalitis virus
DHWASRGFS

SEQ ID NO: 194925 - protein, 9 aa, Tick-borne encephalitis virus
HWASRGFSG

SEQ ID NO: 194926 - protein, 9 aa, Tick-borne encephalitis virus
WASRGFSGS

SEQ ID NO: 194927 - protein, 9 aa, Tick-borne encephalitis virus
ASRESSGSG

SEQ ID NO: 194928 - protein, 9 aa, Tick-borne encephalitis virus
SRESSGSGV

SEQ ID NO: 194929 - protein, 9 aa, Tick-borne encephalitis virus
RGFSGSGVE

SEQ ID NO: 194930 - protein, 9 aa, Tick-borne encephalitis virus
ESSGSGVEG

SEQ ID NO: 194931 - protein, 9 aa, Tick-borne encephalitis virus
FSGSGVEGI

SEQ ID NO: 194932 - protein, 9 aa, Tick-borne encephalitis virus
NYLGWHLKG

SEQ ID NO: 194933 - protein, 9 aa, Tick-borne encephalitis virus
YLGWHLKGL

SEQ ID NO: 194934 - protein, 9 aa, Tick-borne encephalitis virus
LGWHLKGLS

SEQ ID NO: 194935 - protein, 9 aa, Tick-borne encephalitis virus
LSILEGGLF

SEQ ID NO: 194936 - protein, 9 aa, Tick-borne encephalitis virus
SILEGGLFY

SEQ ID NO: 194937 - protein, 9 aa, Tick-borne encephalitis virus
ILEGGLFYA

SEQ ID NO: 194938 - protein, 9 aa, Tick-borne encephalitis virus
PEGGLFYAD

SEQ ID NO: 194939 - protein, 9 aa, Tick-borne encephalitis virus
EGEHRQLAA

SEQ ID NO: 194940 - protein, 9 aa, Tick-borne encephalitis virus
GEHRQLAAT

SEQ ID NO: 194941 - protein, 9 aa, Tick-borne encephalitis virus
EHRQLAATI

SEQ ID NO: 194942 - protein, 9 aa, Tick-borne encephalitis virus
HRQLAATIM

SEQ ID NO: 194943 - protein, 9 aa, Tick-borne encephalitis virus
RQLAATIMQ

SEQ ID NO: 194944 - protein, 9 aa, Tick-borne encephalitis virus
QLAATVMQK

SEQ ID NO: 194945 - protein, 9 aa, Tick-borne encephalitis virus
LAATVMQKA

SEQ ID NO: 194946 - protein, 9 aa, Tick-borne encephalitis virus
AATVMQKAY

SEQ ID NO: 194947 - protein, 9 aa, Tick-borne encephalitis virus
ATVMQKAYH

SEQ ID NO: 194948 - protein, 9 aa, Tick-borne encephalitis virus
RPSREGGCV

SEQ ID NO: 194949 - protein, 9 aa, Tick-borne encephalitis virus
PSREGGCVM

SEQ ID NO: 194950 - protein, 9 aa, Tick-borne encephalitis virus
SREGGCVMD

SEQ ID NO: 194951 - protein, 9 aa, Tick-borne encephalitis virus
REGGCVMDV

SEQ ID NO: 194952 - protein, 9 aa, Tick-borne encephalitis virus
EGGCVMDVI

SEQ ID NO: 194953 - protein, 9 aa, Tick-borne encephalitis virus
EGEGVIEAT

SEQ ID NO: 194954 - protein, 9 aa, Tick-borne encephalitis virus
GEGVIEATD

SEQ ID NO: 194955 - protein, 9 aa, Tick-borne encephalitis virus
EGVIEATDA

SEQ ID NO: 194956 - protein, 9 aa, Tick-borne encephalitis virus
GVIEATDAH

SEQ ID NO: 194957 - protein, 9 aa, Tick-borne encephalitis virus
VIEATDAHN

SEQ ID NO: 194958 - protein, 9 aa, Tick-borne encephalitis virus
IEATDAHNP

SEQ ID NO: 194959 - protein, 9 aa, Tick-borne encephalitis virus
EATDAHNPR

SEQ ID NO: 194960 - protein, 9 aa, Tick-borne encephalitis virus
ATDAHNPRL

SEQ ID NO: 194961 - protein, 9 aa, Tick-borne encephalitis virus
TDAHNPRLL

SEQ ID NO: 194962 - protein, 9 aa, Tick-borne encephalitis virus
LFRVERWLR

SEQ ID NO: 194963 - protein, 9 aa, Tick-borne encephalitis virus
LRVERWLRE

SEQ ID NO: 194964 - protein, 9 aa, Tick-borne encephalitis virus
RVERWLRNH

SEQ ID NO: 194965 - protein, 9 aa, Tick-borne encephalitis virus
VERWLRDYG

SEQ ID NO: 194966 - protein, 9 aa, Tick-borne encephalitis virus
EHGGERLGR

SEQ ID NO: 194967 - protein, 9 aa, Tick-borne encephalitis virus
HGGERLGRM

SEQ ID NO: 194968 - protein, 9 aa, Tick-borne encephalitis virus
GDDCVVRPI

SEQ ID NO: 194969 - protein, 9 aa, Tick-borne encephalitis virus
DDCVVRPID

SEQ ID NO: 194970 - protein, 9 aa, Tick-borne encephalitis virus
DCVVRPIDD

SEQ ID NO: 194971 - protein, 9 aa, Tick-borne encephalitis virus
CVVRPIDDR

SEQ ID NO: 194972 - protein, 9 aa, Tick-borne encephalitis virus
VVRPIDDRF

SEQ ID NO: 194973 - protein, 9 aa, Tick-borne encephalitis virus
VRPIDDRFG

SEQ ID NO: 194974 - protein, 9 aa, Tick-borne encephalitis virus
DDRFSRALY

SEQ ID NO: 194975 - protein, 9 aa, Tick-borne encephalitis virus
DRFSRALYF

SEQ ID NO: 194976 - protein, 9 aa, Tick-borne encephalitis virus
RFSRALYFL

SEQ ID NO: 194977 - protein, 9 aa, Tick-borne encephalitis virus
FSRALYFLN

SEQ ID NO: 194978 - protein, 9 aa, Tick-borne encephalitis virus
SRALYFLND

SEQ ID NO: 194979 - protein, 9 aa, Tick-borne encephalitis virus
GALYFLNDM

SEQ ID NO: 194980 - protein, 9 aa, Tick-borne encephalitis virus
DIGEWEHSA

SEQ ID NO: 194981 - protein, 9 aa, Tick-borne encephalitis virus
IGEWEHSAG

SEQ ID NO: 194982 - protein, 9 aa, Tick-borne encephalitis virus
GEWEHSAGL

SEQ ID NO: 194983 - protein, 9 aa, Tick-borne encephalitis virus
EWEHSAGLS

SEQ ID NO: 194984 - protein, 9 aa, Tick-borne encephalitis virus
GWEEVPFCS

SEQ ID NO: 194985 - protein, 9 aa, Tick-borne encephalitis virus
WEAVPFCSH

SEQ ID NO: 194986 - protein, 9 aa, Tick-borne encephalitis virus
ELVMKDGRS

SEQ ID NO: 194987 - protein, 9 aa, Tick-borne encephalitis virus
LVMKDGRTL

SEQ ID NO: 194988 - protein, 9 aa, Tick-borne encephalitis virus
VMKDGRSLI

SEQ ID NO: 194989 - protein, 9 aa, Tick-borne encephalitis virus
MKDGRTLVV

SEQ ID NO: 194990 - protein, 9 aa, Tick-borne encephalitis virus
KDGRTLVVP

SEQ ID NO: 194991 - protein, 9 aa, Tick-borne encephalitis virus
DGRSLIVPC

SEQ ID NO: 194992 - protein, 9 aa, Tick-borne encephalitis virus
GRTLVVPCR

SEQ ID NO: 194993 - protein, 9 aa, Tick-borne encephalitis virus
RTLVVPCRD

SEQ ID NO: 194994 - protein, 9 aa, Tick-borne encephalitis virus
TLVVPCRDQ

SEQ ID NO: 194995 - protein, 9 aa, Tick-borne encephalitis virus
DELVGRAPV

SEQ ID NO: 194996 - protein, 9 aa, Tick-borne encephalitis virus
ELVGRAPVS

SEQ ID NO: 194997 - protein, 9 aa, Tick-borne encephalitis virus
LVGRAPVSP

SEQ ID NO: 194998 - protein, 9 aa, Tick-borne encephalitis virus
VGRAPVSPG

SEQ ID NO: 194999 - protein, 9 aa, Tick-borne encephalitis virus
GRAPVSPGC

SEQ ID NO: 195000 - protein, 9 aa, Tick-borne encephalitis virus
RAPVSPGCG

SEQ ID NO: 195001 - protein, 9 aa, Tick-borne encephalitis virus
APVSPGCGW

SEQ ID NO: 195002 - protein, 9 aa, Tick-borne encephalitis virus
PVSPGCGWS

SEQ ID NO: 195003 - protein, 9 aa, Tick-borne encephalitis virus
VSPGCGWSI

SEQ ID NO: 195004 - protein, 9 aa, Tick-borne encephalitis virus
RDLRTLGFA

SEQ ID NO: 195005 - protein, 9 aa, Tick-borne encephalitis virus
DLRTLGFAI

SEQ ID NO: 195006 - protein, 9 aa, Tick-borne encephalitis virus
LRTLGLTIC

SEQ ID NO: 195007 - protein, 9 aa, Tick-borne encephalitis virus
RTLGLAISS

SEQ ID NO: 195008 - protein, 9 aa, Tick-borne encephalitis virus
TLGLTICSA

SEQ ID NO: 195009 - protein, 9 aa, Tick-borne encephalitis virus
LGLTICSAV

SEQ ID NO: 195010 - protein, 9 aa, Tick-borne encephalitis virus
GFAICSAVP

SEQ ID NO: 195011 - protein, 9 aa, Tick-borne encephalitis virus
SAVPADWVP

SEQ ID NO: 195012 - protein, 9 aa, Tick-borne encephalitis virus
AVPADWVPT

SEQ ID NO: 195013 - protein, 9 aa, Tick-borne encephalitis virus
VPIDWVPTG

SEQ ID NO: 195014 - protein, 9 aa, Tick-borne encephalitis virus
PADWVPTGR

SEQ ID NO: 195015 - protein, 9 aa, Tick-borne encephalitis virus
IDWVPTGRT

SEQ ID NO: 195016 - protein, 9 aa, Tick-borne encephalitis virus
SIHASGSWM

SEQ ID NO: 195017 - protein, 9 aa, Tick-borne encephalitis virus
IHASGSWMT

SEQ ID NO: 195018 - protein, 9 aa, Tick-borne encephalitis virus
HASGSWMTT

SEQ ID NO: 195019 - protein, 9 aa, Tick-borne encephalitis virus
ASGSWMTTE

SEQ ID NO: 195020 - protein, 9 aa, Tick-borne encephalitis virus
SGSWMTTED

SEQ ID NO: 195021 - protein, 9 aa, Tick-borne encephalitis virus
GAWITTEDM

SEQ ID NO: 195022 - protein, 9 aa, Tick-borne encephalitis virus
AWITTEDML

SEQ ID NO: 195023 - protein, 9 aa, Tick-borne encephalitis virus
WITTEDMLD

SEQ ID NO: 195024 - protein, 9 aa, Tick-borne encephalitis virus
ITTEDMLDV

SEQ ID NO: 195025 - protein, 9 aa, Tick-borne encephalitis virus
ILDNPFMHG

SEQ ID NO: 195026 - protein, 9 aa, Tick-borne encephalitis virus
LDNPFMHGK

SEQ ID NO: 195027 - protein, 9 aa, Tick-borne encephalitis virus
DNPFMQNKG

SEQ ID NO: 195028 - protein, 9 aa, Tick-borne encephalitis virus
NPFMQNKER

SEQ ID NO: 195029 - protein, 9 aa, Tick-borne encephalitis virus
EWRNVPYLP

SEQ ID NO: 195030 - protein, 9 aa, Tick-borne encephalitis virus
WRNVPYLPK

SEQ ID NO: 195031 - protein, 9 aa, Tick-borne encephalitis virus
RDIPYLPKA

SEQ ID NO: 195032 - protein, 9 aa, Tick-borne encephalitis virus
IPYLPKAHD

SEQ ID NO: 195033 - protein, 9 aa, Tick-borne encephalitis virus
PYLPKAHDM

SEQ ID NO: 195034 - protein, 9 aa, Tick-borne encephalitis virus
YLPKAHDML

SEQ ID NO: 195035 - protein, 9 aa, Tick-borne encephalitis virus
LPKAHDMLC

SEQ ID NO: 195036 - protein, 9 aa, Tick-borne encephalitis virus
PKAHDMLCS

SEQ ID NO: 195037 - protein, 9 aa, Tick-borne encephalitis virus
KAHDMLCSS

SEQ ID NO: 195038 - protein, 9 aa, Tick-borne encephalitis virus
AHDMLCSSL

SEQ ID NO: 195039 - protein, 9 aa, Tick-borne encephalitis virus
LCSSLVGRT

SEQ ID NO: 195040 - protein, 9 aa, Tick-borne encephalitis virus
CSSLVGRTE

SEQ ID NO: 195041 - protein, 9 aa, Tick-borne encephalitis virus
SSLVGRTER

SEQ ID NO: 195042 - protein, 9 aa, Tick-borne encephalitis virus
SLVGRTERA

SEQ ID NO: 195043 - protein, 9 aa, Tick-borne encephalitis virus
LVGRTERAE

SEQ ID NO: 195044 - protein, 9 aa, Tick-borne encephalitis virus
VGRTERAEW

SEQ ID NO: 195045 - protein, 9 aa, Tick-borne encephalitis virus
GRTERAEWA

SEQ ID NO: 195046 - protein, 9 aa, Tick-borne encephalitis virus
RKERAEWAR

SEQ ID NO: 195047 - protein, 9 aa, Tick-borne encephalitis virus
KERAEWARN

SEQ ID NO: 195048 - protein, 9 aa, Tick-borne encephalitis virus
GAVEKVRKI

SEQ ID NO: 195049 - protein, 9 aa, Tick-borne encephalitis virus
AVEKVRKMM

SEQ ID NO: 195050 - protein, 9 aa, Tick-borne encephalitis virus
VEKVRKIVG

SEQ ID NO: 195051 - protein, 9 aa, Tick-borne encephalitis virus
RFKDYLSCM

SEQ ID NO: 195052 - protein, 9 aa, Tick-borne encephalitis virus
CKDYPSCMD

SEQ ID NO: 195053 - protein, 9 aa, Tick-borne encephalitis virus
KDYPSCMDR

SEQ ID NO: 195054 - protein, 9 aa, Tick-borne encephalitis virus
YPSCMDRHD

SEQ ID NO: 195055 - protein, 9 aa, Tick-borne encephalitis virus
LSCMDRHYL

SEQ ID NO: 195056 - protein, 9 aa, Tick-borne encephalitis virus
RHYLHWNLK

SEQ ID NO: 195057 - protein, 9 aa, Tick-borne encephalitis virus
HYLHWNLKL

SEQ ID NO: 195058 - protein, 9 aa, Tick-borne encephalitis virus
YLHWNLKLE

SEQ ID NO: 195059 - protein, 9 aa, Tick-borne encephalitis virus
LHWNLKLES

SEQ ID NO: 195060 - protein, 9 aa, Tick-borne encephalitis virus
HWELKLEGS

SEQ ID NO: 195061 - protein, 9 aa, Tick-borne encephalitis virus
WELKLEGSI

SEQ ID NO: 195062 - protein, 9 aa, Tick-borne encephalitis virus
ELKLEGSII

SEQ ID NO: 195063 - protein, 9 aa, Tick-borne encephalitis virus
RRVSKEAAK

SEQ ID NO: 195064 - protein, 9 aa, Tick-borne encephalitis virus
RASKETAKK

SEQ ID NO: 195065 - protein, 9 aa, Tick-borne encephalitis virus
ASKETAKKT

SEQ ID NO: 195066 - protein, 9 aa, Tick-borne encephalitis virus
SKEAAKKTR

SEQ ID NO: 195067 - protein, 9 aa, Tick-borne encephalitis virus
KEAAKKTRQ

SEQ ID NO: 195068 - protein, 9 aa, Tick-borne encephalitis virus
EAAKKTRQS

SEQ ID NO: 195069 - protein, 9 aa, Tick-borne encephalitis virus
AAKKTRQSR

SEQ ID NO: 195070 - protein, 9 aa, Tick-borne encephalitis virus
RKTRQSRVQ

SEQ ID NO: 195071 - protein, 9 aa, Tick-borne encephalitis virus
RQSRVQMPS

SEQ ID NO: 195072 - protein, 9 aa, Tick-borne encephalitis virus
QSRVQMPSG

SEQ ID NO: 195073 - protein, 9 aa, Tick-borne encephalitis virus
SRVQMPSGL

SEQ ID NO: 195074 - protein, 9 aa, Tick-borne encephalitis virus
MMGFLWHAI

SEQ ID NO: 195075 - protein, 9 aa, Tick-borne encephalitis virus
MGFLWHAIA

SEQ ID NO: 195076 - protein, 9 aa, Tick-borne encephalitis virus
HAVAGTVRS

SEQ ID NO: 195077 - protein, 9 aa, Tick-borne encephalitis virus
AVAGTVRSP

SEQ ID NO: 195078 - protein, 9 aa, Tick-borne encephalitis virus
VAGTVRSPV

SEQ ID NO: 195079 - protein, 9 aa, Tick-borne encephalitis virus
PVLKSFWKP

SEQ ID NO: 195080 - protein, 9 aa, Tick-borne encephalitis virus
VLKSFWKPV

SEQ ID NO: 195081 - protein, 9 aa, Tick-borne encephalitis virus
LKSFWKPVP

SEQ ID NO: 195082 - protein, 9 aa, Tick-borne encephalitis virus
KSFWKPVPL

SEQ ID NO: 195083 - protein, 9 aa, Tick-borne encephalitis virus
SFWKSVPLK

SEQ ID NO: 195084 - protein, 9 aa, Tick-borne encephalitis virus
FWKPVPLKQ

SEQ ID NO: 195085 - protein, 9 aa, Tick-borne encephalitis virus
WKPVPLKQA

SEQ ID NO: 195086 - protein, 9 aa, Tick-borne encephalitis virus
NSVPLKQAM

SEQ ID NO: 195087 - protein, 9 aa, Tick-borne encephalitis virus
SVPLKQATT

SEQ ID NO: 195088 - protein, 9 aa, Tick-borne encephalitis virus
VPLKQATTA

SEQ ID NO: 195089 - protein, 9 aa, Tick-borne encephalitis virus
PLKQATTAL

SEQ ID NO: 195090 - protein, 9 aa, Tick-borne encephalitis virus
LKQATTALR

SEQ ID NO: 195091 - protein, 9 aa, Tick-borne encephalitis virus
KQATTALRK

SEQ ID NO: 195092 - protein, 9 aa, Tick-borne encephalitis virus
TTALRKIKM

SEQ ID NO: 195093 - protein, 9 aa, Tick-borne encephalitis virus
AALRKIKRA

SEQ ID NO: 195094 - protein, 9 aa, Tick-borne encephalitis virus
ALRKIKRAV

SEQ ID NO: 195095 - protein, 9 aa, Tick-borne encephalitis virus
LRKIKRAVS

SEQ ID NO: 195096 - protein, 9 aa, Tick-borne encephalitis virus
RKIKRAVST

SEQ ID NO: 195097 - protein, 9 aa, Tick-borne encephalitis virus
KIKMAVSAL

SEQ ID NO: 195098 - protein, 9 aa, Tick-borne encephalitis virus
IKRAVSTLM

SEQ ID NO: 195099 - protein, 9 aa, Tick-borne encephalitis virus
AVSALMIGL

SEQ ID NO: 195100 - protein, 9 aa, Tick-borne encephalitis virus
VSTLMIGLQ

SEQ ID NO: 195101 - protein, 9 aa, Tick-borne encephalitis virus
LMVGLQRRE

SEQ ID NO: 195102 - protein, 9 aa, Tick-borne encephalitis virus
MVGLQRREK

SEQ ID NO: 195103 - protein, 9 aa, Tick-borne encephalitis virus
IGLQRRGKK

SEQ ID NO: 195104 - protein, 9 aa, Tick-borne encephalitis virus
GLQRREKKR

SEQ ID NO: 195105 - protein, 9 aa, Tick-borne encephalitis virus
LQRREKKRS

SEQ ID NO: 195106 - protein, 9 aa, Tick-borne encephalitis virus
QKRGKRRSV

SEQ ID NO: 195107 - protein, 9 aa, Tick-borne encephalitis virus
TFAATVRKE

SEQ ID NO: 195108 - protein, 9 aa, Tick-borne encephalitis virus
IAATVRKER

SEQ ID NO: 195109 - protein, 9 aa, Tick-borne encephalitis virus
ATVRKERDD

SEQ ID NO: 195110 - protein, 9 aa, Tick-borne encephalitis virus
TVRKERDDT

SEQ ID NO: 195111 - protein, 9 aa, Tick-borne encephalitis virus
VRREGDGTT

SEQ ID NO: 195112 - protein, 9 aa, Tick-borne encephalitis virus
RREGDGTTV

SEQ ID NO: 195113 - protein, 9 aa, Tick-borne encephalitis virus
REGDGTTVI

SEQ ID NO: 195114 - protein, 9 aa, Tick-borne encephalitis virus
ERDDTTVIR

SEQ ID NO: 195115 - protein, 9 aa, Tick-borne encephalitis virus
RDDTTVIRA

SEQ ID NO: 195116 - protein, 9 aa, Tick-borne encephalitis virus
VILATDMGA

SEQ ID NO: 195117 - protein, 9 aa, Tick-borne encephalitis virus
ILATDMGAW

SEQ ID NO: 195118 - protein, 9 aa, Tick-borne encephalitis virus
MATDMGSWC

SEQ ID NO: 195119 - protein, 9 aa, Tick-borne encephalitis virus
IVWMTVESV

SEQ ID NO: 195120 - protein, 9 aa, Tick-borne encephalitis virus
WLTLESVVA

SEQ ID NO: 195121 - protein, 9 aa, Tick-borne encephalitis virus
MTVESVVTR

SEQ ID NO: 195122 - protein, 9 aa, Tick-borne encephalitis virus
TLESVVARV

SEQ ID NO: 195123 - protein, 9 aa, Tick-borne encephalitis virus
VAVLLCLAP

SEQ ID NO: 195124 - protein, 9 aa, Tick-borne encephalitis virus
VALLCLAPV

SEQ ID NO: 195125 - protein, 9 aa, Tick-borne encephalitis virus
WLDAIYQEK

SEQ ID NO: 195126 - protein, 9 aa, Tick-borne encephalitis virus
LDAIYQEKP

SEQ ID NO: 195127 - protein, 9 aa, Tick-borne encephalitis virus
DAIYQEKPA

SEQ ID NO: 195128 - protein, 9 aa, Tick-borne encephalitis virus
AIYQEKPAK

SEQ ID NO: 195129 - protein, 9 aa, Tick-borne encephalitis virus
IYQENPAQT

SEQ ID NO: 195130 - protein, 9 aa, Tick-borne encephalitis virus
YQEKPAKTR

SEQ ID NO: 195131 - protein, 9 aa, Tick-borne encephalitis virus
QENPAQTRE

SEQ ID NO: 195132 - protein, 9 aa, Tick-borne encephalitis virus
ENPAQTREY

SEQ ID NO: 195133 - protein, 9 aa, Tick-borne encephalitis virus
KPAKTREYC

SEQ ID NO: 195134 - protein, 9 aa, Tick-borne encephalitis virus
ATLTEEHQG

SEQ ID NO: 195135 - protein, 9 aa, Tick-borne encephalitis virus
TLAEQHQSG

SEQ ID NO: 195136 - protein, 9 aa, Tick-borne encephalitis virus
LTEEHQGGT

SEQ ID NO: 195137 - protein, 9 aa, Tick-borne encephalitis virus
TEEHQGGTV

SEQ ID NO: 195138 - protein, 9 aa, Tick-borne encephalitis virus
SIVTCVKAA

SEQ ID NO: 195139 - protein, 9 aa, Tick-borne encephalitis virus
IVTCVKAAC

SEQ ID NO: 195140 - protein, 9 aa, Tick-borne encephalitis virus
VTCVKAACE

SEQ ID NO: 195141 - protein, 9 aa, Tick-borne encephalitis virus
TCVKAACEA

SEQ ID NO: 195142 - protein, 9 aa, Tick-borne encephalitis virus
CVKVSCEAK

SEQ ID NO: 195143 - protein, 9 aa, Tick-borne encephalitis virus
VKVSCEAKK

SEQ ID NO: 195144 - protein, 9 aa, Tick-borne encephalitis virus
KVSCEAKKK

SEQ ID NO: 195145 - protein, 9 aa, Tick-borne encephalitis virus
VSCEAKKKA

SEQ ID NO: 195146 - protein, 9 aa, Tick-borne encephalitis virus
DANRIVYTV

SEQ ID NO: 195147 - protein, 9 aa, Tick-borne encephalitis virus
PNKIVYPVK

SEQ ID NO: 195148 - protein, 9 aa, Tick-borne encephalitis virus
NKIVYTIKV

SEQ ID NO: 195149 - protein, 9 aa, Tick-borne encephalitis virus
KIVYPVKVE

SEQ ID NO: 195150 - protein, 9 aa, Tick-borne encephalitis virus
LPWRHEGVQ

SEQ ID NO: 195151 - protein, 9 aa, Tick-borne encephalitis virus
HEGVQNWNN

SEQ ID NO: 195152 - protein, 9 aa, Tick-borne encephalitis virus
EGARNWNNA

SEQ ID NO: 195153 - protein, 9 aa, Tick-borne encephalitis virus
GVQNWNNAE

SEQ ID NO: 195154 - protein, 9 aa, Tick-borne encephalitis virus
ARNWNNAER

SEQ ID NO: 195155 - protein, 9 aa, Tick-borne encephalitis virus
RNWNNAERL

SEQ ID NO: 195156 - protein, 9 aa, Tick-borne encephalitis virus
KTKFTWKRT

SEQ ID NO: 195157 - protein, 9 aa, Tick-borne encephalitis virus
TKFTWKRTP

SEQ ID NO: 195158 - protein, 9 aa, Tick-borne encephalitis virus
KFTWKRTPT

SEQ ID NO: 195159 - protein, 9 aa, Tick-borne encephalitis virus
FTWKRTPTD

SEQ ID NO: 195160 - protein, 9 aa, Tick-borne encephalitis virus
TWKRTPTDS

SEQ ID NO: 195161 - protein, 9 aa, Tick-borne encephalitis virus
WRRTPTDSG

SEQ ID NO: 195162 - protein, 9 aa, Tick-borne encephalitis virus
RRTPTDSGH

SEQ ID NO: 195163 - protein, 9 aa, Tick-borne encephalitis virus
FGSTGGLLT

SEQ ID NO: 195164 - protein, 9 aa, Tick-borne encephalitis virus
GSTGGLLTS

SEQ ID NO: 195165 - protein, 9 aa, Tick-borne encephalitis virus
STGGLLTSV

SEQ ID NO: 195166 - protein, 9 aa, Tick-borne encephalitis virus
TGGLLTSVG

SEQ ID NO: 195167 - protein, 9 aa, Tick-borne encephalitis virus
GGLLTSVGK

SEQ ID NO: 195168 - protein, 9 aa, Tick-borne encephalitis virus
GLLTSVGKA

SEQ ID NO: 195169 - protein, 9 aa, Tick-borne encephalitis virus
LLTSVGKAL

SEQ ID NO: 195170 - protein, 9 aa, Tick-borne encephalitis virus
LSSIGKALH

SEQ ID NO: 195171 - protein, 9 aa, Tick-borne encephalitis virus
SSIGKALHT

SEQ ID NO: 195172 - protein, 9 aa, Tick-borne encephalitis virus
VGFLPKILI

SEQ ID NO: 195173 - protein, 9 aa, Tick-borne encephalitis virus
GFIPKLLLG

SEQ ID NO: 195174 - protein, 9 aa, Tick-borne encephalitis virus
GAALAWLGL

SEQ ID NO: 195175 - protein, 9 aa, Tick-borne encephalitis virus
MALAWLGLN

SEQ ID NO: 195176 - protein, 9 aa, Tick-borne encephalitis virus
IRETFEEGT

SEQ ID NO: 195177 - protein, 9 aa, Tick-borne encephalitis virus
KEAFEEGTC

SEQ ID NO: 195178 - protein, 9 aa, Tick-borne encephalitis virus
EAFEEGTCG

SEQ ID NO: 195179 - protein, 9 aa, Tick-borne encephalitis virus
AFEEGTCGI

SEQ ID NO: 195180 - protein, 9 aa, Tick-borne encephalitis virus
FEEGTCGIL

SEQ ID NO: 195181 - protein, 9 aa, Tick-borne encephalitis virus
EEGTCGILP

SEQ ID NO: 195182 - protein, 9 aa, Tick-borne encephalitis virus
EGTCGILPQ

SEQ ID NO: 195183 - protein, 9 aa, Tick-borne encephalitis virus
GTCGILPQN

SEQ ID NO: 195184 - protein, 9 aa, Tick-borne encephalitis virus
TCGILPQNR

SEQ ID NO: 195185 - protein, 9 aa, Tick-borne encephalitis virus
EMAMWRSSS

SEQ ID NO: 195186 - protein, 9 aa, Tick-borne encephalitis virus
MAMWRSSST

SEQ ID NO: 195187 - protein, 9 aa, Tick-borne encephalitis virus
AMWRSAATE

SEQ ID NO: 195188 - protein, 9 aa, Tick-borne encephalitis virus
MWRSSSTEL

SEQ ID NO: 195189 - protein, 9 aa, Tick-borne encephalitis virus
WRSAATELN

SEQ ID NO: 195190 - protein, 9 aa, Tick-borne encephalitis virus
RSSSTELNL

SEQ ID NO: 195191 - protein, 9 aa, Tick-borne encephalitis virus
SAATELNLA

SEQ ID NO: 195192 - protein, 9 aa, Tick-borne encephalitis virus
SSTELNLAL

SEQ ID NO: 195193 - protein, 9 aa, Tick-borne encephalitis virus
RGGIPGLLR

SEQ ID NO: 195194 - protein, 9 aa, Tick-borne encephalitis virus
GGVSGLLRK

SEQ ID NO: 195195 - protein, 9 aa, Tick-borne encephalitis virus
GVSGLLRKG

SEQ ID NO: 195196 - protein, 9 aa, Tick-borne encephalitis virus
IPGLLRKGK

SEQ ID NO: 195197 - protein, 9 aa, Tick-borne encephalitis virus
RVSWKSWGH

SEQ ID NO: 195198 - protein, 9 aa, Tick-borne encephalitis virus
VSWRSWGHS

SEQ ID NO: 195199 - protein, 9 aa, Tick-borne encephalitis virus
SWGQAMIWS

SEQ ID NO: 195200 - protein, 9 aa, Tick-borne encephalitis virus
SIIWSIPEA

SEQ ID NO: 195201 - protein, 9 aa, Tick-borne encephalitis virus
IIWSIPEAP

SEQ ID NO: 195202 - protein, 9 aa, Tick-borne encephalitis virus
RFMVGIEGS

SEQ ID NO: 195203 - protein, 9 aa, Tick-borne encephalitis virus
VFLDFRQEA

SEQ ID NO: 195204 - protein, 9 aa, Tick-borne encephalitis virus
FLDFRQEAT

SEQ ID NO: 195205 - protein, 9 aa, Tick-borne encephalitis virus
LDFRQEATH

SEQ ID NO: 195206 - protein, 9 aa, Tick-borne encephalitis virus
QSLWMKSMK

SEQ ID NO: 195207 - protein, 9 aa, Tick-borne encephalitis virus
SLWMKSMKN

SEQ ID NO: 195208 - protein, 9 aa, Tick-borne encephalitis virus
LWMKSMKND

SEQ ID NO: 195209 - protein, 9 aa, Tick-borne encephalitis virus
WMKSMKNDT

SEQ ID NO: 195210 - protein, 9 aa, Tick-borne encephalitis virus
MKSMKNDTG

SEQ ID NO: 195211 - protein, 9 aa, Tick-borne encephalitis virus
KSMKNDTGT

SEQ ID NO: 195212 - protein, 9 aa, Tick-borne encephalitis virus
SVRNETGTY

SEQ ID NO: 195213 - protein, 9 aa, Tick-borne encephalitis virus
VRNETGTYI

SEQ ID NO: 195214 - protein, 9 aa, Tick-borne encephalitis virus
NPEVVDSEL

SEQ ID NO: 195215 - protein, 9 aa, Tick-borne encephalitis virus
PEVVDSELF

SEQ ID NO: 195216 - protein, 9 aa, Tick-borne encephalitis virus
QVKGPWKYL

SEQ ID NO: 195217 - protein, 9 aa, Tick-borne encephalitis virus
VKGPWKYLP

SEQ ID NO: 195218 - protein, 9 aa, Tick-borne encephalitis virus
KGPWKYLPI

SEQ ID NO: 195219 - protein, 9 aa, Tick-borne encephalitis virus
GPWKYLPIR

SEQ ID NO: 195220 - protein, 9 aa, Tick-borne encephalitis virus
PWKYLPIRV

SEQ ID NO: 195221 - protein, 9 aa, Tick-borne encephalitis virus
IREECPGTR

SEQ ID NO: 195222 - protein, 9 aa, Tick-borne encephalitis virus
RGECPGTKV

SEQ ID NO: 195223 - protein, 9 aa, Tick-borne encephalitis virus
ECPGTRVII

SEQ ID NO: 195224 - protein, 9 aa, Tick-borne encephalitis virus
ISADCDRRG

SEQ ID NO: 195225 - protein, 9 aa, Tick-borne encephalitis virus
TADCDKRGA

SEQ ID NO: 195226 - protein, 9 aa, Tick-borne encephalitis virus
RRRPSTGST

SEQ ID NO: 195227 - protein, 9 aa, Tick-borne encephalitis virus
RRPSTGSTV

SEQ ID NO: 195228 - protein, 9 aa, Tick-borne encephalitis virus
RPSTGSTVV

SEQ ID NO: 195229 - protein, 9 aa, Tick-borne encephalitis virus
PSTGSTVVW

SEQ ID NO: 195230 - protein, 9 aa, Tick-borne encephalitis virus
STGSTVVWG

SEQ ID NO: 195231 - protein, 9 aa, Tick-borne encephalitis virus
TGTTAVWGG

SEQ ID NO: 195232 - protein, 9 aa, Tick-borne encephalitis virus
WGGIVVFAL

SEQ ID NO: 195233 - protein, 9 aa, Tick-borne encephalitis virus
GGLIVLALL

SEQ ID NO: 195234 - protein, 9 aa, Tick-borne encephalitis virus
GLIVLALLV

SEQ ID NO: 195235 - protein, 9 aa, Tick-borne encephalitis virus
LIVLALLVT

SEQ ID NO: 195236 - protein, 9 aa, Tick-borne encephalitis virus
ALLVTGMVK

SEQ ID NO: 195237 - protein, 9 aa, Tick-borne encephalitis virus
VKVESLVRY

SEQ ID NO: 195238 - protein, 9 aa, Tick-borne encephalitis virus
KVESLVRYV

SEQ ID NO: 195239 - protein, 9 aa, Tick-borne encephalitis virus
LSAFALRRN

SEQ ID NO: 195240 - protein, 9 aa, Tick-borne encephalitis virus
SAFALRRNL

SEQ ID NO: 195241 - protein, 9 aa, Tick-borne encephalitis virus
AFALRRNLT

SEQ ID NO: 195242 - protein, 9 aa, Tick-borne encephalitis virus
FALRRNLTV

SEQ ID NO: 195243 - protein, 9 aa, Tick-borne encephalitis virus
ALRRNLTVR

SEQ ID NO: 195244 - protein, 9 aa, Tick-borne encephalitis virus
LRRNLTVRE

SEQ ID NO: 195245 - protein, 9 aa, Tick-borne encephalitis virus
RRNLTVREM

SEQ ID NO: 195246 - protein, 9 aa, Tick-borne encephalitis virus
RNLTVREMV

SEQ ID NO: 195247 - protein, 9 aa, Tick-borne encephalitis virus
SLTVREMVI

SEQ ID NO: 195248 - protein, 9 aa, Tick-borne encephalitis virus
CTAEGKAGV

SEQ ID NO: 195249 - protein, 9 aa, Tick-borne encephalitis virus
TAEGKTGVG

SEQ ID NO: 195250 - protein, 9 aa, Tick-borne encephalitis virus
AEGKTGVGL

SEQ ID NO: 195251 - protein, 9 aa, Tick-borne encephalitis virus
EGKTGVGLL

SEQ ID NO: 195252 - protein, 9 aa, Tick-borne encephalitis virus
GKTGVGLLL

SEQ ID NO: 195253 - protein, 9 aa, Tick-borne encephalitis virus
AGVGLLLMP

SEQ ID NO: 195254 - protein, 9 aa, Tick-borne encephalitis virus
VGLLLMPLL

SEQ ID NO: 195255 - protein, 9 aa, Tick-borne encephalitis virus
LLMPLLTKR

SEQ ID NO: 195256 - protein, 9 aa, Tick-borne encephalitis virus
LMPLLTKRG

SEQ ID NO: 195257 - protein, 9 aa, Tick-borne encephalitis virus
VHYGLIFFL

SEQ ID NO: 195258 - protein, 9 aa, Tick-borne encephalitis virus
HYGLIFFLS

SEQ ID NO: 195259 - protein, 9 aa, Tick-borne encephalitis virus
WRLLRGHRE

SEQ ID NO: 195260 - protein, 9 aa, Tick-borne encephalitis virus
RLLRGHREQ

SEQ ID NO: 195261 - protein, 9 aa, Tick-borne encephalitis virus
LLEGHREQK

SEQ ID NO: 195262 - protein, 9 aa, Tick-borne encephalitis virus
LEGHREQKG

SEQ ID NO: 195263 - protein, 9 aa, Tick-borne encephalitis virus
REQKGLSWT

SEQ ID NO: 195264 - protein, 9 aa, Tick-borne encephalitis virus
EQKGLSWTV

SEQ ID NO: 195265 - protein, 9 aa, Tick-borne encephalitis virus
QKGLSWTVP

SEQ ID NO: 195266 - protein, 9 aa, Tick-borne encephalitis virus
KGLSWTVPL

SEQ ID NO: 195267 - protein, 9 aa, Tick-borne encephalitis virus
GLSWTVPLA

SEQ ID NO: 195268 - protein, 9 aa, Tick-borne encephalitis virus
VPMARLLGG

SEQ ID NO: 195269 - protein, 9 aa, Tick-borne encephalitis virus
PLAGLVGGE

SEQ ID NO: 195270 - protein, 9 aa, Tick-borne encephalitis virus
MARLLGGEG

SEQ ID NO: 195271 - protein, 9 aa, Tick-borne encephalitis virus
AGLVGGEGS

SEQ ID NO: 195272 - protein, 9 aa, Tick-borne encephalitis virus
GLVGGEGSG

SEQ ID NO: 195273 - protein, 9 aa, Tick-borne encephalitis virus
LVGGEGSGI

SEQ ID NO: 195274 - protein, 9 aa, Tick-borne encephalitis virus
VGGEGSGIR

SEQ ID NO: 195275 - protein, 9 aa, Tick-borne encephalitis virus
SGRRRSFSE

SEQ ID NO: 195276 - protein, 9 aa, Tick-borne encephalitis virus
AGLSASAFH

SEQ ID NO: 195277 - protein, 9 aa, Tick-borne encephalitis virus
GLSASAFHW

SEQ ID NO: 195278 - protein, 9 aa, Tick-borne encephalitis virus
LAASALHWS

SEQ ID NO: 195279 - protein, 9 aa, Tick-borne encephalitis virus
SASAFHWSG

SEQ ID NO: 195280 - protein, 9 aa, Tick-borne encephalitis virus
ASALHWSGI

SEQ ID NO: 195281 - protein, 9 aa, Tick-borne encephalitis virus
SALHWSGIL

SEQ ID NO: 195282 - protein, 9 aa, Tick-borne encephalitis virus
AIHWSGIIG

SEQ ID NO: 195283 - protein, 9 aa, Tick-borne encephalitis virus
IHWSGIIGV

SEQ ID NO: 195284 - protein, 9 aa, Tick-borne encephalitis virus
GLWTLTKML

SEQ ID NO: 195285 - protein, 9 aa, Tick-borne encephalitis virus
LWTLTKMLR

SEQ ID NO: 195286 - protein, 9 aa, Tick-borne encephalitis virus
ARRSDLAFS

SEQ ID NO: 195287 - protein, 9 aa, Tick-borne encephalitis virus
DLVFSGQGR

SEQ ID NO: 195288 - protein, 9 aa, Tick-borne encephalitis virus
LVFSGQGNR

SEQ ID NO: 195289 - protein, 9 aa, Tick-borne encephalitis virus
AFSGQGGRE

SEQ ID NO: 195290 - protein, 9 aa, Tick-borne encephalitis virus
QGRGERGDK

SEQ ID NO: 195291 - protein, 9 aa, Tick-borne encephalitis virus
GNRERGDRP

SEQ ID NO: 195292 - protein, 9 aa, Tick-borne encephalitis virus
NRERGDRPF

SEQ ID NO: 195293 - protein, 9 aa, Tick-borne encephalitis virus
RGDKPFEVR

SEQ ID NO: 195294 - protein, 9 aa, Tick-borne encephalitis virus
GDKPFEVRD

SEQ ID NO: 195295 - protein, 9 aa, Tick-borne encephalitis virus
DKPFEVRDG

SEQ ID NO: 195296 - protein, 9 aa, Tick-borne encephalitis virus
KPFEVRDGV

SEQ ID NO: 195297 - protein, 9 aa, Tick-borne encephalitis virus
SPGLFWGQS

SEQ ID NO: 195298 - protein, 9 aa, Tick-borne encephalitis virus
PGLFWGQSQ

SEQ ID NO: 195299 - protein, 9 aa, Tick-borne encephalitis virus
GLFWGQRQV

SEQ ID NO: 195300 - protein, 9 aa, Tick-borne encephalitis virus
LFWGQRQVG

SEQ ID NO: 195301 - protein, 9 aa, Tick-borne encephalitis virus
FWGQSQVGV

SEQ ID NO: 195302 - protein, 9 aa, Tick-borne encephalitis virus
SQVGVGYGS

SEQ ID NO: 195303 - protein, 9 aa, Tick-borne encephalitis virus
TRGAALYID

SEQ ID NO: 195304 - protein, 9 aa, Tick-borne encephalitis virus
RGAALYIDD

SEQ ID NO: 195305 - protein, 9 aa, Tick-borne encephalitis virus
GAALSVDDA

SEQ ID NO: 195306 - protein, 9 aa, Tick-borne encephalitis virus
AALYIDDAV

SEQ ID NO: 195307 - protein, 9 aa, Tick-borne encephalitis virus
ALSVDDAVV

SEQ ID NO: 195308 - protein, 9 aa, Tick-borne encephalitis virus
LYIDDAVAG

SEQ ID NO: 195309 - protein, 9 aa, Tick-borne encephalitis virus
SIDDAVVGP

SEQ ID NO: 195310 - protein, 9 aa, Tick-borne encephalitis virus
IDDAVVGPY

SEQ ID NO: 195311 - protein, 9 aa, Tick-borne encephalitis virus
AVAGPYWAE

SEQ ID NO: 195312 - protein, 9 aa, Tick-borne encephalitis virus
VAGPYWSDV

SEQ ID NO: 195313 - protein, 9 aa, Tick-borne encephalitis virus
AGPYWSDVR

SEQ ID NO: 195314 - protein, 9 aa, Tick-borne encephalitis virus
GPYWSDVRE

SEQ ID NO: 195315 - protein, 9 aa, Tick-borne encephalitis virus
PYWAEVKED

SEQ ID NO: 195316 - protein, 9 aa, Tick-borne encephalitis virus
YWAEVKEDV

SEQ ID NO: 195317 - protein, 9 aa, Tick-borne encephalitis virus
WAEVKEDVV

SEQ ID NO: 195318 - protein, 9 aa, Tick-borne encephalitis virus
AEVKEDVVC

SEQ ID NO: 195319 - protein, 9 aa, Tick-borne encephalitis virus
GAVLIDLSK

SEQ ID NO: 195320 - protein, 9 aa, Tick-borne encephalitis virus
AVLIDLSKG

SEQ ID NO: 195321 - protein, 9 aa, Tick-borne encephalitis virus
VLIDLSKGT

SEQ ID NO: 195322 - protein, 9 aa, Tick-borne encephalitis virus
AKGTSGSPT

SEQ ID NO: 195323 - protein, 9 aa, Tick-borne encephalitis virus
KGTSRSPIL

SEQ ID NO: 195324 - protein, 9 aa, Tick-borne encephalitis virus
GTSGSPTLN

SEQ ID NO: 195325 - protein, 9 aa, Tick-borne encephalitis virus
TSGSPTLNS

SEQ ID NO: 195326 - protein, 9 aa, Tick-borne encephalitis virus
SRSPILNAQ

SEQ ID NO: 195327 - protein, 9 aa, Tick-borne encephalitis virus
RSPILNAQG

SEQ ID NO: 195328 - protein, 9 aa, Tick-borne encephalitis virus
SPIINSQGV

SEQ ID NO: 195329 - protein, 9 aa, Tick-borne encephalitis virus
PIINSQGVV

SEQ ID NO: 195330 - protein, 9 aa, Tick-borne encephalitis virus
IINSQGVVV

SEQ ID NO: 195331 - protein, 9 aa, Tick-borne encephalitis virus
INSQGVVVG

SEQ ID NO: 195332 - protein, 9 aa, Tick-borne encephalitis virus
GEAERSRPN

SEQ ID NO: 195333 - protein, 9 aa, Tick-borne encephalitis virus
EAEKSRPSL

SEQ ID NO: 195334 - protein, 9 aa, Tick-borne encephalitis virus
AEKSRPSLP

SEQ ID NO: 195335 - protein, 9 aa, Tick-borne encephalitis virus
ERSRPNLPQ

SEQ ID NO: 195336 - protein, 9 aa, Tick-borne encephalitis virus
KSRPSLPPA

SEQ ID NO: 195337 - protein, 9 aa, Tick-borne encephalitis virus
GIGWTAKGQ

SEQ ID NO: 195338 - protein, 9 aa, Tick-borne encephalitis virus
IGWTAKGQI

SEQ ID NO: 195339 - protein, 9 aa, Tick-borne encephalitis virus
VRFHSPVVG

SEQ ID NO: 195340 - protein, 9 aa, Tick-borne encephalitis virus
RFHSPVVGD

SEQ ID NO: 195341 - protein, 9 aa, Tick-borne encephalitis virus
FLSPAVSDQ

SEQ ID NO: 195342 - protein, 9 aa, Tick-borne encephalitis virus
HSPVVGDQQ

SEQ ID NO: 195343 - protein, 9 aa, Tick-borne encephalitis virus
DQQMGGAIV

SEQ ID NO: 195344 - protein, 9 aa, Tick-borne encephalitis virus
QQMGGAIVD

SEQ ID NO: 195345 - protein, 9 aa, Tick-borne encephalitis virus
NRGITSEVK

SEQ ID NO: 195346 - protein, 9 aa, Tick-borne encephalitis virus
RGITSEVKQ

SEQ ID NO: 195347 - protein, 9 aa, Tick-borne encephalitis virus
GITSEVKQI

SEQ ID NO: 195348 - protein, 9 aa, Tick-borne encephalitis virus
ITSEVKQIP

SEQ ID NO: 195349 - protein, 9 aa, Tick-borne encephalitis virus
SEVKQIPEG

SEQ ID NO: 195350 - protein, 9 aa, Tick-borne encephalitis virus
EERQIPNGE

SEQ ID NO: 195351 - protein, 9 aa, Tick-borne encephalitis virus
VKQIPEGEW

SEQ ID NO: 195352 - protein, 9 aa, Tick-borne encephalitis virus
RQIPNGEWR

SEQ ID NO: 195353 - protein, 9 aa, Tick-borne encephalitis virus
VPSIVKGGI

SEQ ID NO: 195354 - protein, 9 aa, Tick-borne encephalitis virus
PSIVKGGII

SEQ ID NO: 195355 - protein, 9 aa, Tick-borne encephalitis virus
SIVKGGIIA

SEQ ID NO: 195356 - protein, 9 aa, Tick-borne encephalitis virus
IVKGGIIAR

SEQ ID NO: 195357 - protein, 9 aa, Tick-borne encephalitis virus
VKGGIIART

SEQ ID NO: 195358 - protein, 9 aa, Tick-borne encephalitis virus
KGGIIARAL

SEQ ID NO: 195359 - protein, 9 aa, Tick-borne encephalitis virus
GGIIARALR

SEQ ID NO: 195360 - protein, 9 aa, Tick-borne encephalitis virus
GIIARALRQ

SEQ ID NO: 195361 - protein, 9 aa, Tick-borne encephalitis virus
IIARALRQK

SEQ ID NO: 195362 - protein, 9 aa, Tick-borne encephalitis virus
RVGRQEGRI

SEQ ID NO: 195363 - protein, 9 aa, Tick-borne encephalitis virus
VGRQEGRID

SEQ ID NO: 195364 - protein, 9 aa, Tick-borne encephalitis virus
GRQEGRIDE

SEQ ID NO: 195365 - protein, 9 aa, Tick-borne encephalitis virus
RQEGRIDEY

SEQ ID NO: 195366 - protein, 9 aa, Tick-borne encephalitis virus
QEGRIDEYI

SEQ ID NO: 195367 - protein, 9 aa, Tick-borne encephalitis virus
GQCDDDDSV

SEQ ID NO: 195368 - protein, 9 aa, Tick-borne encephalitis virus
QCDEYDSGL

SEQ ID NO: 195369 - protein, 9 aa, Tick-borne encephalitis virus
CDEYDSGLV

SEQ ID NO: 195370 - protein, 9 aa, Tick-borne encephalitis virus
DEYDSGLVQ

SEQ ID NO: 195371 - protein, 9 aa, Tick-borne encephalitis virus
DDDGGLVQW

SEQ ID NO: 195372 - protein, 9 aa, Tick-borne encephalitis virus
YDSGLVQWK

SEQ ID NO: 195373 - protein, 9 aa, Tick-borne encephalitis virus
SGLVQWKEG

SEQ ID NO: 195374 - protein, 9 aa, Tick-borne encephalitis virus
GQILLDNIT

SEQ ID NO: 195375 - protein, 9 aa, Tick-borne encephalitis virus
NVSGVTSRN

SEQ ID NO: 195376 - protein, 9 aa, Tick-borne encephalitis virus
VSGVTSRNW

SEQ ID NO: 195377 - protein, 9 aa, Tick-borne encephalitis virus
SSVTSRSWT

SEQ ID NO: 195378 - protein, 9 aa, Tick-borne encephalitis virus
SVTSRSWTW

SEQ ID NO: 195379 - protein, 9 aa, Tick-borne encephalitis virus
NAVDEASGG

SEQ ID NO: 195380 - protein, 9 aa, Tick-borne encephalitis virus
AVDEASGGL

SEQ ID NO: 195381 - protein, 9 aa, Tick-borne encephalitis virus
ASGGLVTFR

SEQ ID NO: 195382 - protein, 9 aa, Tick-borne encephalitis virus
SGGLVTFRS

SEQ ID NO: 195383 - protein, 9 aa, Tick-borne encephalitis virus
LMHEKPDSR

SEQ ID NO: 195384 - protein, 9 aa, Tick-borne encephalitis virus
MHEKPDSRA

SEQ ID NO: 195385 - protein, 9 aa, Tick-borne encephalitis virus
HEKPDSRAM

SEQ ID NO: 195386 - protein, 9 aa, Tick-borne encephalitis virus
EKPDSRAMR

SEQ ID NO: 195387 - protein, 9 aa, Tick-borne encephalitis virus
EPGSSAMRM

SEQ ID NO: 195388 - protein, 9 aa, Tick-borne encephalitis virus
PDSRAMRMA

SEQ ID NO: 195389 - protein, 9 aa, Tick-borne encephalitis virus
GSSAMRMAE

SEQ ID NO: 195390 - protein, 9 aa, Tick-borne encephalitis virus
APEAFLTVA

SEQ ID NO: 195391 - protein, 9 aa, Tick-borne encephalitis virus
PEAFLTLVE

SEQ ID NO: 195392 - protein, 9 aa, Tick-borne encephalitis virus
VEMMVLGLG

SEQ ID NO: 195393 - protein, 9 aa, Tick-borne encephalitis virus
EMMVLGLGT

SEQ ID NO: 195394 - protein, 9 aa, Tick-borne encephalitis virus
MMVLGLGTL

SEQ ID NO: 195395 - protein, 9 aa, Tick-borne encephalitis virus
VVWCFVVRA

SEQ ID NO: 195396 - protein, 9 aa, Tick-borne encephalitis virus
VWCFVARTS

SEQ ID NO: 195397 - protein, 9 aa, Tick-borne encephalitis virus
VLLWAGGVS

SEQ ID NO: 195398 - protein, 9 aa, Tick-borne encephalitis virus
KTKADLSAV

SEQ ID NO: 195399 - protein, 9 aa, Tick-borne encephalitis virus
ADLSAVLWS

SEQ ID NO: 195400 - protein, 9 aa, Tick-borne encephalitis virus
EVRSWEEWT

SEQ ID NO: 195401 - protein, 9 aa, Tick-borne encephalitis virus
MRSWEEWTN

SEQ ID NO: 195402 - protein, 9 aa, Tick-borne encephalitis virus
DLGGGAPFI

SEQ ID NO: 195403 - protein, 9 aa, Tick-borne encephalitis virus
LGGGAPFIG

SEQ ID NO: 195404 - protein, 9 aa, Tick-borne encephalitis virus
GGGAPFLGV

SEQ ID NO: 195405 - protein, 9 aa, Tick-borne encephalitis virus
GGAPFFGIA

SEQ ID NO: 195406 - protein, 9 aa, Tick-borne encephalitis virus
GAPFIGVAG

SEQ ID NO: 195407 - protein, 9 aa, Tick-borne encephalitis virus
APFLGVAGH

SEQ ID NO: 195408 - protein, 9 aa, Tick-borne encephalitis virus
PFLGVAGHV

SEQ ID NO: 195409 - protein, 9 aa, Tick-borne encephalitis virus
FLGVAGHVM

SEQ ID NO: 195410 - protein, 9 aa, Tick-borne encephalitis virus
GVAGHVMSL

SEQ ID NO: 195411 - protein, 9 aa, Tick-borne encephalitis virus
VAGHVMSLG

SEQ ID NO: 195412 - protein, 9 aa, Tick-borne encephalitis virus
AGHVMSLGV

SEQ ID NO: 195413 - protein, 9 aa, Tick-borne encephalitis virus
GHVMSLGVV

SEQ ID NO: 195414 - protein, 9 aa, Tick-borne encephalitis virus
HVMSLGVVS

SEQ ID NO: 195415 - protein, 9 aa, Tick-borne encephalitis virus
VMSLGVVSL

SEQ ID NO: 195416 - protein, 9 aa, Tick-borne encephalitis virus
MSLGVVSLV
